United States Patent 7,250,496 (BIOINFORMATICALLY DETECTABLE GROUP OF NOVEL REGULATORY GENES AND USES THEREOF) - sequence listing, part 30

SEQ ID NO: 1284594 - RNA, 21 nt, Human
aaacuccacaagaaauaguaa

SEQ ID NO: 1284595 - RNA, 20 nt, Human
aacuuagaagggaaaaaggu

SEQ ID NO: 1284596 - RNA, 19 nt, Human
aagagaaauacaaagggau

SEQ ID NO: 1284597 - RNA, 19 nt, Human
aagcagaaaagagauucua

SEQ ID NO: 1284598 - RNA, 23 nt, Human
aagggacaaaaagcacuaaggga

SEQ ID NO: 1284599 - RNA, 22 nt, Human
aaguccagaacuuaaagugaca

SEQ ID NO: 1284600 - RNA, 21 nt, Human
aauaagagaaauacaaaggga

SEQ ID NO: 1284601 - RNA, 21 nt, Human
aauacaaagaaccccaagucc

SEQ ID NO: 1284602 - RNA, 25 nt, Human
aauacaaagggaucaaaaagcuaaa

SEQ ID NO: 1284603 - RNA, 23 nt, Human
acaaaaagcacuaagggagcuga

SEQ ID NO: 1284604 - RNA, 21 nt, Human
acaaagaaccccaaguccaga

SEQ ID NO: 1284605 - RNA, 18 nt, Human
accuaggcugaugugaga

SEQ ID NO: 1284606 - RNA, 24 nt, Human
agaaccccaaguccagaacuuaaa

SEQ ID NO: 1284607 - RNA, 19 nt, Human
agacaaacaaacacaaaug

SEQ ID NO: 1284608 - RNA, 28 nt, Human
agacaaacaaacacaaaugccggacccc

SEQ ID NO: 1284609 - RNA, 21 nt, Human
agagccuuggaggaggggugg

SEQ ID NO: 1284610 - RNA, 18 nt, Human
agauguaaaaaucugacc

SEQ ID NO: 1284611 - RNA, 20 nt, Human
agcaccuuuuugggacuucc

SEQ ID NO: 1284612 - RNA, 19 nt, Human
agcagaacuuagaagggaa

SEQ ID NO: 1284613 - RNA, 18 nt, Human
aggaaaaaaauauauaaa

SEQ ID NO: 1284614 - RNA, 20 nt, Human
aggaaaaaaauauauaaaca

SEQ ID NO: 1284615 - RNA, 22 nt, Human
aggacagagaagagguuagaaa

SEQ ID NO: 1284616 - RNA, 23 nt, Human
aggagagcaaaggcaaguuugag

SEQ ID NO: 1284617 - RNA, 20 nt, Human
agguuagaaagagaauaaga

SEQ ID NO: 1284618 - RNA, 22 nt, Human
auggagcuugaauggcuuaaag

SEQ ID NO: 1284619 - RNA, 26 nt, Human
caaacaaacacaaaugcuuugcuguu

SEQ ID NO: 1284620 - RNA, 20 nt, Human
caaagaaccccaaguccaga

SEQ ID NO: 1284621 - RNA, 26 nt, Human
caacaaaaagcuuaacacaaaauuaa

SEQ ID NO: 1284622 - RNA, 19 nt, Human
caagacaguucucaaaggc

SEQ ID NO: 1284623 - RNA, 18 nt, Human
caaguuggaaagguauca

SEQ ID NO: 1284624 - RNA, 19 nt, Human
cacaacaugaugagcuagg

SEQ ID NO: 1284625 - RNA, 19 nt, Human
cacgaugcaacaaaaagcu

SEQ ID NO: 1284626 - RNA, 24 nt, Human
cacgaugcaacaaaaagcuuaaca

SEQ ID NO: 1284627 - RNA, 25 nt, Human
cacuucagcugugguuaaauagcuu

SEQ ID NO: 1284628 - RNA, 22 nt, Human
cagcuuccacauucucaguccu

SEQ ID NO: 1284629 - RNA, 22 nt, Human
cauuacaucacugaaaaacucc

SEQ ID NO: 1284630 - RNA, 21 nt, Human
cccuccacucaacacaacuga

SEQ ID NO: 1284631 - RNA, 19 nt, Human
cgggaagggacaaaaagca

SEQ ID NO: 1284632 - RNA, 21 nt, Human
cuuaucuguucuccaagacag

SEQ ID NO: 1284633 - RNA, 20 nt, Human
cuucucagauauacugcaua

SEQ ID NO: 1284634 - RNA, 22 nt, Human
gaacuuagaagggaaaaaggug

SEQ ID NO: 1284635 - RNA, 18 nt, Human
gaagcucaauguaagaau

SEQ ID NO: 1284636 - RNA, 19 nt, Human
gaauaagagaaauacaaag

SEQ ID NO: 1284637 - RNA, 23 nt, Human
gagcuauuuuucugggccuuuuc

SEQ ID NO: 1284638 - RNA, 19 nt, Human
gagcuugaauggcuuaaag

SEQ ID NO: 1284639 - RNA, 22 nt, Human
gcaacaaaaagcuuaacacaaa

SEQ ID NO: 1284640 - RNA, 20 nt, Human
gccuuaccccccacuucagc

SEQ ID NO: 1284641 - RNA, 18 nt, Human
ggaagggacaaaaagcac

SEQ ID NO: 1284642 - RNA, 19 nt, Human
ggaucaaaaagcuaaagug

SEQ ID NO: 1284643 - RNA, 20 nt, Human
gguuguuuccuuucccuucu

SEQ ID NO: 1284644 - RNA, 24 nt, Human
guaaaaaucugaccuaguugaaca

SEQ ID NO: 1284645 - RNA, 20 nt, Human
guuugaggacagagaagagg

SEQ ID NO: 1284646 - RNA, 24 nt, Human
uaaaaaauagacaauuuauaagga

SEQ ID NO: 1284647 - RNA, 22 nt, Human
uaaaauauccaauccuauaaag

SEQ ID NO: 1284648 - RNA, 23 nt, Human
uaaaauauccaauccuauaaagu

SEQ ID NO: 1284649 - RNA, 23 nt, Human
uaaacucccuccacucaacacaa

SEQ ID NO: 1284650 - RNA, 21 nt, Human
uaaaugaugccgcucagagcc

SEQ ID NO: 1284651 - RNA, 21 nt, Human
uacaaagggaucaaaaagcua

SEQ ID NO: 1284652 - RNA, 21 nt, Human
uacaaauagacaaacaaacac

SEQ ID NO: 1284653 - RNA, 26 nt, Human
uacaaauagacaaacaaacacaaaug

SEQ ID NO: 1284654 - RNA, 18 nt, Human
uacuuuacacagugcuaa

SEQ ID NO: 1284655 - RNA, 23 nt, Human
uagaaagagauguaaaaaucuga

SEQ ID NO: 1284656 - RNA, 20 nt, Human
uagcagaacuuagaagggaa

SEQ ID NO: 1284657 - RNA, 24 nt, Human
uagcuuuuuuaaaaaauagacaau

SEQ ID NO: 1284658 - RNA, 26 nt, Human
uauaaggaaaaaaauauauaaacacu

SEQ ID NO: 1284659 - RNA, 20 nt, Human
uauuauauuggaauugcagu

SEQ ID NO: 1284660 - RNA, 22 nt, Human
ucaagcuuaucuguucuccaag

SEQ ID NO: 1284661 - RNA, 23 nt, Human
ucccaaacccuauguccucucua

SEQ ID NO: 1284662 - RNA, 21 nt, Human
ucucaaaggcaacauuccuuu

SEQ ID NO: 1284663 - RNA, 19 nt, Human
ugacaaguuggaaagguau

SEQ ID NO: 1284664 - RNA, 20 nt, Human
ugacagcaccuuuuugggac

SEQ ID NO: 1284665 - RNA, 19 nt, Human
ugcacaaaaucuugucucu

SEQ ID NO: 1284666 - RNA, 26 nt, Human
ugcagcaaguauuuacauguauguac

SEQ ID NO: 1284667 - RNA, 27 nt, Human
ugcagcaaguauuuacauguauguacc

SEQ ID NO: 1284668 - RNA, 21 nt, Human
uggcauugguauucuaaagga

SEQ ID NO: 1284669 - RNA, 18 nt, Human
uggcugcugguugggaag

SEQ ID NO: 1284670 - RNA, 18 nt, Human
uggcugcugguugggaag

SEQ ID NO: 1284671 - RNA, 23 nt, Human
uggcugcugguugggaagggucc

SEQ ID NO: 1284672 - RNA, 22 nt, Human
uggcuuaaagcuacugcauauu

SEQ ID NO: 1284673 - RNA, 21 nt, Human
uucuaggaaauuggggugggg

SEQ ID NO: 1284674 - RNA, 20 nt, Human
uuggcuacaagcauuacauc

SEQ ID NO: 1284675 - RNA, 21 nt, Human
aaacagaugacuccaggucua

SEQ ID NO: 1284676 - RNA, 23 nt, Human
aaagugucagaacuaagaccaaa

SEQ ID NO: 1284677 - RNA, 19 nt, Human
aagugggaagugcagcugg

SEQ ID NO: 1284678 - RNA, 19 nt, Human
aauccuugccucacagagg

SEQ ID NO: 1284679 - RNA, 22 nt, Human
acagaggagaacuuuugcucca

SEQ ID NO: 1284680 - RNA, 20 nt, Human
acuggcuuuucuucuuccca

SEQ ID NO: 1284681 - RNA, 20 nt, Human
agcccauuaaagugucagaa

SEQ ID NO: 1284682 - RNA, 21 nt, Human
aggcacagagucagaaguggg

SEQ ID NO: 1284683 - RNA, 19 nt, Human
agggaacagcaggcacaga

SEQ ID NO: 1284684 - RNA, 18 nt, Human
augccagccgcuuggcau

SEQ ID NO: 1284685 - RNA, 21 nt, Human
caaaggcaaagaucuucccca

SEQ ID NO: 1284686 - RNA, 19 nt, Human
cacagcuucacaggcugcc

SEQ ID NO: 1284687 - RNA, 23 nt, Human
cacagcuucacaggcugccucag

SEQ ID NO: 1284688 - RNA, 22 nt, Human
cagcagcguggccauggaugcc

SEQ ID NO: 1284689 - RNA, 21 nt, Human
cagcaggcacagagucagaag

SEQ ID NO: 1284690 - RNA, 19 nt, Human
cagcagggaacagcaggca

SEQ ID NO: 1284691 - RNA, 27 nt, Human
caggaaggauccagcaggacauagugg

SEQ ID NO: 1284692 - RNA, 24 nt, Human
caggaaguccuccucagccagcuc

SEQ ID NO: 1284693 - RNA, 23 nt, Human
ccaagcccauuaaagugucagaa

SEQ ID NO: 1284694 - RNA, 20 nt, Human
ccacuacagccucaagccag

SEQ ID NO: 1284695 - RNA, 19 nt, Human
ccgagucccucagccacgc

SEQ ID NO: 1284696 - RNA, 18 nt, Human
ccucccacuacagccuca

SEQ ID NO: 1284697 - RNA, 21 nt, Human
cgaagaagccaccgcuaagcg

SEQ ID NO: 1284698 - RNA, 21 nt, Human
cgccuucucaccaucucaccc

SEQ ID NO: 1284699 - RNA, 22 nt, Human
cuacagccucaagccagcaucu

SEQ ID NO: 1284700 - RNA, 23 nt, Human
cucaccaucucacccgagccacu

SEQ ID NO: 1284701 - RNA, 19 nt, Human
cuccagggucccaagccca

SEQ ID NO: 1284702 - RNA, 20 nt, Human
cuccagggucccaagcccau

SEQ ID NO: 1284703 - RNA, 19 nt, Human
cucgcuccugaaauccuug

SEQ ID NO: 1284704 - RNA, 22 nt, Human
gaaauccuugccucacagagga

SEQ ID NO: 1284705 - RNA, 19 nt, Human
gaagaagccaccgcuaagg

SEQ ID NO: 1284706 - RNA, 21 nt, Human
gacgccaacccaggccagcag

SEQ ID NO: 1284707 - RNA, 22 nt, Human
gcaacgaagaagccaccgcuaa

SEQ ID NO: 1284708 - RNA, 19 nt, Human
gcuaagcguggucuugggg

SEQ ID NO: 1284709 - RNA, 19 nt, Human
ggaagugcagcuggacgcc

SEQ ID NO: 1284710 - RNA, 21 nt, Human
ggaccuccgagucccucagcc

SEQ ID NO: 1284711 - RNA, 19 nt, Human
ggagacgccaacccaggcc

SEQ ID NO: 1284712 - RNA, 18 nt, Human
ggcgcccggguucugcug

SEQ ID NO: 1284713 - RNA, 20 nt, Human
gggcaggcagggcgggagcu

SEQ ID NO: 1284714 - RNA, 19 nt, Human
uaagaccaaaacagaugac

SEQ ID NO: 1284715 - RNA, 26 nt, Human
uaagaccaaaacagaugacuccaggu

SEQ ID NO: 1284716 - RNA, 22 nt, Human
ucacagaggagaacuuuugcuu

SEQ ID NO: 1284717 - RNA, 19 nt, Human
ucacuggcuuuucuucuuc

SEQ ID NO: 1284718 - RNA, 21 nt, Human
uccgcugggccucccacuaca

SEQ ID NO: 1284719 - RNA, 19 nt, Human
ucuaagcugcuguggaccu

SEQ ID NO: 1284720 - RNA, 19 nt, Human
ugccucacagaggagaacu

SEQ ID NO: 1284721 - RNA, 20 nt, Human
uggaccuccgagucccucag

SEQ ID NO: 1284722 - RNA, 19 nt, Human
uggcagagggagcacaugg

SEQ ID NO: 1284723 - RNA, 18 nt, Human
ugggccucccacuacagc

SEQ ID NO: 1284724 - RNA, 19 nt, Human
aaagugcuggaauuacagg

SEQ ID NO: 1284725 - RNA, 22 nt, Human
aaagugcuggaauuacaggcau

SEQ ID NO: 1284726 - RNA, 24 nt, Human
aaagugcuggaauuacaggcauga

SEQ ID NO: 1284727 - RNA, 20 nt, Human
aaccuccaccugccagguuc

SEQ ID NO: 1284728 - RNA, 24 nt, Human
aagauggcagaggaugggaggaag

SEQ ID NO: 1284729 - RNA, 24 nt, Human
aagcgauccaccugccuuggccuc

SEQ ID NO: 1284730 - RNA, 26 nt, Human
aagugcuggaauuacaggcaugagcc

SEQ ID NO: 1284731 - RNA, 20 nt, Human
aauuacaggcaugagccacc

SEQ ID NO: 1284732 - RNA, 18 nt, Human
accaaguaccaagauggc

SEQ ID NO: 1284733 - RNA, 24 nt, Human
accauguuggccaggcuggucucg

SEQ ID NO: 1284734 - RNA, 20 nt, Human
accccgccuggccugagcca

SEQ ID NO: 1284735 - RNA, 21 nt, Human
accucucauguccuucuccac

SEQ ID NO: 1284736 - RNA, 18 nt, Human
acgggguuucaccauguu

SEQ ID NO: 1284737 - RNA, 23 nt, Human
acgggguuucaccauguuggcca

SEQ ID NO: 1284738 - RNA, 24 nt, Human
acgggguuucaccauguuggccag

SEQ ID NO: 1284739 - RNA, 20 nt, Human
acucaugguccuuucacagg

SEQ ID NO: 1284740 - RNA, 27 nt, Human
acucuauugcccaggcuggagugcaau

SEQ ID NO: 1284741 - RNA, 19 nt, Human
agccuccugaguagcuaag

SEQ ID NO: 1284742 - RNA, 18 nt, Human
agcuaagggauuacaggc

SEQ ID NO: 1284743 - RNA, 20 nt, Human
agcuaagggauuacaggcgu

SEQ ID NO: 1284744 - RNA, 22 nt, Human
agcuaagggauuacaggcguga

SEQ ID NO: 1284745 - RNA, 18 nt, Human
aggagcaaaaagggucua

SEQ ID NO: 1284746 - RNA, 19 nt, Human
aggcagucaccugacggug

SEQ ID NO: 1284747 - RNA, 18 nt, Human
agggauuacaggcgugag

SEQ ID NO: 1284748 - RNA, 22 nt, Human
agggauuacaggcgugagccac

SEQ ID NO: 1284749 - RNA, 23 nt, Human
agggauuacaggcgugagccacc

SEQ ID NO: 1284750 - RNA, 24 nt, Human
agggauuacaggcgugagccacca

SEQ ID NO: 1284751 - RNA, 21 nt, Human
agguucaagugauucuccugc

SEQ ID NO: 1284752 - RNA, 22 nt, Human
agguucaagugauucuccugcc

SEQ ID NO: 1284753 - RNA, 23 nt, Human
agguucaagugauucuccugccu

SEQ ID NO: 1284754 - RNA, 19 nt, Human
aguaccaagauggcagagg

SEQ ID NO: 1284755 - RNA, 18 nt, Human
agucuuugcugggucagc

SEQ ID NO: 1284756 - RNA, 24 nt, Human
agugauucuccugccucagccucc

SEQ ID NO: 1284757 - RNA, 24 nt, Human
agugcaauggcacgaucuuggcuc

SEQ ID NO: 1284758 - RNA, 23 nt, Human
augguccuuucacagggucagag

SEQ ID NO: 1284759 - RNA, 18 nt, Human
auucuccugccucagccu

SEQ ID NO: 1284760 - RNA, 20 nt, Human
caaagaaaggagccaacagu

SEQ ID NO: 1284761 - RNA, 22 nt, Human
caagcccccaaguccaaucccc

SEQ ID NO: 1284762 - RNA, 22 nt, Human
caagcccccaaguccaaucccc

SEQ ID NO: 1284763 - RNA, 23 nt, Human
caagcccccaaguccaaucccuu

SEQ ID NO: 1284764 - RNA, 20 nt, Human
caagcgauccaccugccuug

SEQ ID NO: 1284765 - RNA, 20 nt, Human
caagugauucuccugccuca

SEQ ID NO: 1284766 - RNA, 22 nt, Human
caagugauucuccugccucagc

SEQ ID NO: 1284767 - RNA, 21 nt, Human
caccauguuggccaggcuggu

SEQ ID NO: 1284768 - RNA, 24 nt, Human
caccauguuggccaggcuggucuc

SEQ ID NO: 1284769 - RNA, 23 nt, Human
cacccaucccucuggaaguccuc

SEQ ID NO: 1284770 - RNA, 19 nt, Human
caccccgccuggccugagc

SEQ ID NO: 1284771 - RNA, 24 nt, Human
caccugccuuggccuccuaaagug

SEQ ID NO: 1284772 - RNA, 24 nt, Human
cacucuauugcccaggcuggagug

SEQ ID NO: 1284773 - RNA, 18 nt, Human
cagagcagugcaggaagg

SEQ ID NO: 1284774 - RNA, 22 nt, Human
cagccuccugaguagcuaaggg

SEQ ID NO: 1284775 - RNA, 22 nt, Human
caggaaggacugggggacccua

SEQ ID NO: 1284776 - RNA, 18 nt, Human
caggagccccuccucucc

SEQ ID NO: 1284777 - RNA, 19 nt, Human
caggagccccuccucuccu

SEQ ID NO: 1284778 - RNA, 21 nt, Human
caucaagguccaagcccccaa

SEQ ID NO: 1284779 - RNA, 22 nt, Human
caucaagguccaagcccccaag

SEQ ID NO: 1284780 - RNA, 24 nt, Human
caucaagguccaagcccccaaguc

SEQ ID NO: 1284781 - RNA, 18 nt, Human
cauggcccaagaugauag

SEQ ID NO: 1284782 - RNA, 24 nt, Human
cauguuggccaggcuggucucgaa

SEQ ID NO: 1284783 - RNA, 21 nt, Human
ccaaguccaauccccugugcu

SEQ ID NO: 1284784 - RNA, 18 nt, Human
ccagguucaagugauucu

SEQ ID NO: 1284785 - RNA, 19 nt, Human
ccagguucaagugauucuc

SEQ ID NO: 1284786 - RNA, 20 nt, Human
cccaggagccccuccucucc

SEQ ID NO: 1284787 - RNA, 18 nt, Human
ccccacuuccuucucauc

SEQ ID NO: 1284788 - RNA, 26 nt, Human
ccccacuuccuucucaucuccuccaa

SEQ ID NO: 1284789 - RNA, 18 nt, Human
cccuccugacuucccacu

SEQ ID NO: 1284790 - RNA, 21 nt, Human
cccucuggaaguccucaggaa

SEQ ID NO: 1284791 - RNA, 23 nt, Human
cccugugcugauccagauccuuc

SEQ ID NO: 1284792 - RNA, 21 nt, Human
ccucaagcgauccaccugccu

SEQ ID NO: 1284793 - RNA, 18 nt, Human
ccuccugacuucccacua

SEQ ID NO: 1284794 - RNA, 22 nt, Human
ccucucaucaugcucagugguc

SEQ ID NO: 1284795 - RNA, 21 nt, Human
ccucugagcccuguucccagg

SEQ ID NO: 1284796 - RNA, 25 nt, Human
ccugaguagcuaagggauuacaggc

SEQ ID NO: 1284797 - RNA, 24 nt, Human
ccugccagguucaagugauucucc

SEQ ID NO: 1284798 - RNA, 23 nt, Human
ccugccucagccuccugaguagc

SEQ ID NO: 1284799 - RNA, 21 nt, Human
ccuggccucaagcgauccacc

SEQ ID NO: 1284800 - RNA, 23 nt, Human
ccuggccucaagcgauccaccug

SEQ ID NO: 1284801 - RNA, 23 nt, Human
ccuggccucaagcgauccaccug

SEQ ID NO: 1284802 - RNA, 20 nt, Human
cggagucuuugcugggucag

SEQ ID NO: 1284803 - RNA, 21 nt, Human
cgugauggguccuucccacag

SEQ ID NO: 1284804 - RNA, 19 nt, Human
cuaaagugcuggaauuaca

SEQ ID NO: 1284805 - RNA, 24 nt, Human
cuaaagugcuggaauuacaggcau

SEQ ID NO: 1284806 - RNA, 24 nt, Human
cucaagcgauccaccugccuuggc

SEQ ID NO: 1284807 - RNA, 20 nt, Human
cucacucuauugcccaggcc

SEQ ID NO: 1284808 - RNA, 19 nt, Human
cucacuguaaccuccaccu

SEQ ID NO: 1284809 - RNA, 24 nt, Human
cucacuguaaccuccaccugccag

SEQ ID NO: 1284810 - RNA, 18 nt, Human
cuccaagucacgggccug

SEQ ID NO: 1284811 - RNA, 26 nt, Human
cuccugaguagcuaagggauuacagg

SEQ ID NO: 1284812 - RNA, 18 nt, Human
cugccagguucaagugau

SEQ ID NO: 1284813 - RNA, 25 nt, Human
cugccagguucaagugauucuccug

SEQ ID NO: 1284814 - RNA, 23 nt, Human
cugccucagccuccugaguagcu

SEQ ID NO: 1284815 - RNA, 21 nt, Human
cugccucugagcccuguuccc

SEQ ID NO: 1284816 - RNA, 18 nt, Human
cugggucagccuauauug

SEQ ID NO: 1284817 - RNA, 24 nt, Human
cuguaaccuccaccugccagguuc

SEQ ID NO: 1284818 - RNA, 18 nt, Human
gaacacccuggaaucggc

SEQ ID NO: 1284819 - RNA, 19 nt, Human
gaauuacaggcaugagcca

SEQ ID NO: 1284820 - RNA, 24 nt, Human
gagacgggguuucaccauguuggc

SEQ ID NO: 1284821 - RNA, 21 nt, Human
gagccaacaguaggcgaggaa

SEQ ID NO: 1284822 - RNA, 20 nt, Human
gagccucaguuuccccauug

SEQ ID NO: 1284823 - RNA, 18 nt, Human
gaggaugggaggaaggca

SEQ ID NO: 1284824 - RNA, 23 nt, Human
gaggugcugggcacaugucugcu

SEQ ID NO: 1284825 - RNA, 21 nt, Human
gauggcagaggaugggaggaa

SEQ ID NO: 1284826 - RNA, 18 nt, Human
gauuacaggcgugagcca

SEQ ID NO: 1284827 - RNA, 21 nt, Human
gauuacaggcgugagccacca

SEQ ID NO: 1284828 - RNA, 24 nt, Human
gauuacaggcgugagccaccaugu

SEQ ID NO: 1284829 - RNA, 19 nt, Human
gcagucaccugacgguggg

SEQ ID NO: 1284830 - RNA, 21 nt, Human
gccaggccgugcuagccaggg

SEQ ID NO: 1284831 - RNA, 19 nt, Human
gcccaggcuggagugcaau

SEQ ID NO: 1284832 - RNA, 22 nt, Human
gccuuggccuccuaaagugcug

SEQ ID NO: 1284833 - RNA, 23 nt, Human
gcgauccaccugccuuggccucc

SEQ ID NO: 1284834 - RNA, 20 nt, Human
gcucaguggucuucguccgu

SEQ ID NO: 1284835 - RNA, 19 nt, Human
gcuggagugcaauggcacg

SEQ ID NO: 1284836 - RNA, 22 nt, Human
ggaaggcaccucucauguccuu

SEQ ID NO: 1284837 - RNA, 22 nt, Human
ggacucugccaggccgugcuag

SEQ ID NO: 1284838 - RNA, 24 nt, Human
ggauuacaggcgugagccaccaug

SEQ ID NO: 1284839 - RNA, 23 nt, Human
gggauuacaggcgugagccacca

SEQ ID NO: 1284840 - RNA, 24 nt, Human
gggauuacaggcgugagccaccau

SEQ ID NO: 1284841 - RNA, 18 nt, Human
gggccuggcacaaaggag

SEQ ID NO: 1284842 - RNA, 23 nt, Human
gggguuucaccauguuggccagg

SEQ ID NO: 1284843 - RNA, 22 nt, Human
ggguuucaccauguuggccagg

SEQ ID NO: 1284844 - RNA, 23 nt, Human
guagagacgggguuucaccaugu

SEQ ID NO: 1284845 - RNA, 21 nt, Human
guagcuaagggauuacaggcg

SEQ ID NO: 1284846 - RNA, 24 nt, Human
guagcuaagggauuacaggcguga

SEQ ID NO: 1284847 - RNA, 19 nt, Human
guccuucuccacccauccc

SEQ ID NO: 1284848 - RNA, 24 nt, Human
gugauucuccugccucagccuccu

SEQ ID NO: 1284849 - RNA, 19 nt, Human
gugcuggaauuacaggcau

SEQ ID NO: 1284850 - RNA, 21 nt, Human
guucccaggagccccuccucu

SEQ ID NO: 1284851 - RNA, 24 nt, Human
uaaagugcuggaauuacaggcaug

SEQ ID NO: 1284852 - RNA, 26 nt, Human
uaauuuuuuuguauuuuuaguagaga

SEQ ID NO: 1284853 - RNA, 18 nt, Human
uacaggcgugagccacca

SEQ ID NO: 1284854 - RNA, 22 nt, Human
uaccaucaagguccaagccccc

SEQ ID NO: 1284855 - RNA, 22 nt, Human
uagagacgggguuucaccaugu

SEQ ID NO: 1284856 - RNA, 24 nt, Human
uaguagagacgggguuucaccaug

SEQ ID NO: 1284857 - RNA, 26 nt, Human
uaguagagacgggguuucaccauguu

SEQ ID NO: 1284858 - RNA, 19 nt, Human
uauugcccaggcuggagug

SEQ ID NO: 1284859 - RNA, 20 nt, Human
uauugcccaggcuggagugc

SEQ ID NO: 1284860 - RNA, 25 nt, Human
ucaaagaaaggagccaacaguaggc

SEQ ID NO: 1284861 - RNA, 19 nt, Human
ucaagugauucuccugccu

SEQ ID NO: 1284862 - RNA, 24 nt, Human
ucacucuauugcccaggcuggagu

SEQ ID NO: 1284863 - RNA, 18 nt, Human
ucacuguaaccuccaccu

SEQ ID NO: 1284864 - RNA, 19 nt, Human
ucacuguaaccuccaccug

SEQ ID NO: 1284865 - RNA, 20 nt, Human
ucacuguaaccuccaccugc

SEQ ID NO: 1284866 - RNA, 24 nt, Human
ucacuguaaccuccaccugccagg

SEQ ID NO: 1284867 - RNA, 20 nt, Human
ucaguggucuucguccgucc

SEQ ID NO: 1284868 - RNA, 23 nt, Human
ucaguggucuucguccguccucc

SEQ ID NO: 1284869 - RNA, 25 nt, Human
ucccacagauacugcagaacccucc

SEQ ID NO: 1284870 - RNA, 20 nt, Human
ucccaggagccccuccucuc

SEQ ID NO: 1284871 - RNA, 24 nt, Human
uccuaaagugcuggaauuacaggc

SEQ ID NO: 1284872 - RNA, 26 nt, Human
uccugaguagcuaagggauuacaggc

SEQ ID NO: 1284873 - RNA, 24 nt, Human
uccugggaggcccaggucugccug

SEQ ID NO: 1284874 - RNA, 18 nt, Human
uccuucucaucuccucca

SEQ ID NO: 1284875 - RNA, 24 nt, Human
ucuauugcccaggcuggagugcaa

SEQ ID NO: 1284876 - RNA, 23 nt, Human
ucucacucuauugcccaggcugg

SEQ ID NO: 1284877 - RNA, 24 nt, Human
ucucacucuauugcccaggcugga

SEQ ID NO: 1284878 - RNA, 26 nt, Human
ucucacucuauugcccaggcuggagu

SEQ ID NO: 1284879 - RNA, 24 nt, Human
ucuccugccucagccuccugagua

SEQ ID NO: 1284880 - RNA, 21 nt, Human
ucuccuggcauggacauccag

SEQ ID NO: 1284881 - RNA, 21 nt, Human
ucugagcccuguucccaggag

SEQ ID NO: 1284882 - RNA, 23 nt, Human
ucugagcccuguucccaggagga

SEQ ID NO: 1284883 - RNA, 26 nt, Human
ugacucaaagaaaggagccaacaggg

SEQ ID NO: 1284884 - RNA, 18 nt, Human
ugagacagagucucacuc

SEQ ID NO: 1284885 - RNA, 22 nt, Human
ugagacagagucucacucuauu

SEQ ID NO: 1284886 - RNA, 18 nt, Human
ugagccaccccgccuggc

SEQ ID NO: 1284887 - RNA, 23 nt, Human
ugccaggccgugcuagccagggg

SEQ ID NO: 1284888 - RNA, 24 nt, Human
ugccagguucaagugauucuccug

SEQ ID NO: 1284889 - RNA, 18 nt, Human
ugcccaggcuggagugca

SEQ ID NO: 1284890 - RNA, 21 nt, Human
ugcccaggcuggagugcaaug

SEQ ID NO: 1284891 - RNA, 24 nt, Human
ugcccaggcuggagugcaauggca

SEQ ID NO: 1284892 - RNA, 24 nt, Human
ugccguggugagcaggagcuuccc

SEQ ID NO: 1284893 - RNA, 23 nt, Human
ugccucagccuccugaguagcua

SEQ ID NO: 1284894 - RNA, 24 nt, Human
ugccucagccuccugaguagcuaa

SEQ ID NO: 1284895 - RNA, 22 nt, Human
ugccugccucucuccuggcaug

SEQ ID NO: 1284896 - RNA, 19 nt, Human
ugcuagccagggggcugcc

SEQ ID NO: 1284897 - RNA, 22 nt, Human
ugcuagccagggggcugccgug

SEQ ID NO: 1284898 - RNA, 22 nt, Human
ugcugauccagauccuuccugc

SEQ ID NO: 1284899 - RNA, 20 nt, Human
uggaacacccuggaaucggc

SEQ ID NO: 1284900 - RNA, 18 nt, Human
uggaauuacaggcaugag

SEQ ID NO: 1284901 - RNA, 21 nt, Human
uggaauuacaggcaugagcca

SEQ ID NO: 1284902 - RNA, 22 nt, Human
uggaauuacaggcaugagccac

SEQ ID NO: 1284903 - RNA, 23 nt, Human
uggaauuacaggcaugagccacc

SEQ ID NO: 1284904 - RNA, 24 nt, Human
uggaauuacaggcaugagccaccc

SEQ ID NO: 1284905 - RNA, 18 nt, Human
uggacucugccaggccgu

SEQ ID NO: 1284906 - RNA, 23 nt, Human
uggagugcaauggcacgaucuug

SEQ ID NO: 1284907 - RNA, 24 nt, Human
uggagugcaauggcacgaucuugg

SEQ ID NO: 1284908 - RNA, 24 nt, Human
uggcacgaucuuggcucacuguaa

SEQ ID NO: 1284909 - RNA, 24 nt, Human
uggccaggcuggucucgaauuccu

SEQ ID NO: 1284910 - RNA, 24 nt, Human
uggcucacuguaaccuccaccugc

SEQ ID NO: 1284911 - RNA, 24 nt, Human
ugggaguguuaggagcaaaaaggg

SEQ ID NO: 1284912 - RNA, 21 nt, Human
uggggccuggcacaaaggagg

SEQ ID NO: 1284913 - RNA, 19 nt, Human
ugggggacccuaugcggug

SEQ ID NO: 1284914 - RNA, 18 nt, Human
uuaguagagacgggguuu

SEQ ID NO: 1284915 - RNA, 22 nt, Human
uuaguagagacgggguuucacc

SEQ ID NO: 1284916 - RNA, 24 nt, Human
uuaguagagacgggguuucaccau

SEQ ID NO: 1284917 - RNA, 21 nt, Human
uucaagugauucuccugccuc

SEQ ID NO: 1284918 - RNA, 23 nt, Human
uucaagugauucuccugccucag

SEQ ID NO: 1284919 - RNA, 24 nt, Human
uucaagugauucuccugccucagc

SEQ ID NO: 1284920 - RNA, 23 nt, Human
uuccccauugguaaaaugaggau

SEQ ID NO: 1284921 - RNA, 23 nt, Human
uuccuggccucaagcgauccacc

SEQ ID NO: 1284922 - RNA, 18 nt, Human
uugcccaggcuggagugc

SEQ ID NO: 1284923 - RNA, 18 nt, Human
uuggccuccuaaagugcu

SEQ ID NO: 1284924 - RNA, 18 nt, Human
uugggguugggagacuuu

SEQ ID NO: 1284925 - RNA, 23 nt, Human
uuguauuuuuaguagagacgggg

SEQ ID NO: 1284926 - RNA, 24 nt, Human
uuucaccauguuggccaggcuggu

SEQ ID NO: 1284927 - RNA, 26 nt, Human
uuugaagaccaaguucuuccccacuu

SEQ ID NO: 1284928 - RNA, 24 nt, Human
uuuuuaguagagacgggguuucac

SEQ ID NO: 1284929 - RNA, 21 nt, Human
uuuuuguauuuuuaguagaga

SEQ ID NO: 1284930 - RNA, 21 nt, Human
uuuuuuguauuuuuaguagag

SEQ ID NO: 1284931 - RNA, 24 nt, Human
uuuuuuguauuuuuaguagagacg

SEQ ID NO: 1284932 - RNA, 21 nt, Human
acacgcugcccuccucuuggg

SEQ ID NO: 1284933 - RNA, 19 nt, Human
agaaagagggaggggggac

SEQ ID NO: 1284934 - RNA, 21 nt, Human
agagaaagcggggaacccgga

SEQ ID NO: 1284935 - RNA, 24 nt, Human
agagaggaguggagggagcugugu

SEQ ID NO: 1284936 - RNA, 22 nt, Human
agaggacugggggccaccgcuu

SEQ ID NO: 1284937 - RNA, 21 nt, Human
agagggaggggggacauagag

SEQ ID NO: 1284938 - RNA, 21 nt, Human
agcagcagaagaggacugggg

SEQ ID NO: 1284939 - RNA, 22 nt, Human
agccaggguccuccugcagcca

SEQ ID NO: 1284940 - RNA, 28 nt, Human
agcccggggcaucugccugguugggcca

SEQ ID NO: 1284941 - RNA, 19 nt, Human
agcucccguggcuguggcc

SEQ ID NO: 1284942 - RNA, 21 nt, Human
agcuggaggaggaagaggggc

SEQ ID NO: 1284943 - RNA, 24 nt, Human
aggacgcuugcggcgcuggugaug

SEQ ID NO: 1284944 - RNA, 18 nt, Human
aggaggaagaggggcugg

SEQ ID NO: 1284945 - RNA, 20 nt, Human
aggaggaagaggggcugggc

SEQ ID NO: 1284946 - RNA, 27 nt, Human
agggaggggggacauagagaaagcggg

SEQ ID NO: 1284947 - RNA, 24 nt, Human
aggugucccuggcugcacugagcu

SEQ ID NO: 1284948 - RNA, 24 nt, Human
agugauaagagaggaguggaggga

SEQ ID NO: 1284949 - RNA, 18 nt, Human
agugccuugcgcggcccu

SEQ ID NO: 1284950 - RNA, 21 nt, Human
aucuaccccuuuccucuccca

SEQ ID NO: 1284951 - RNA, 23 nt, Human
cacgucccagaccacaggcacac

SEQ ID NO: 1284952 - RNA, 20 nt, Human
cagaccccuccccccacugg

SEQ ID NO: 1284953 - RNA, 19 nt, Human
cagcccacgucccagacca

SEQ ID NO: 1284954 - RNA, 18 nt, Human
cagcucaaaaggaugcag

SEQ ID NO: 1284955 - RNA, 24 nt, Human
cagcugcucccuccccagggaccc

SEQ ID NO: 1284956 - RNA, 24 nt, Human
cauccagcccacgucccagaccuu

SEQ ID NO: 1284957 - RNA, 21 nt, Human
caugugcuguaccaccuccuc

SEQ ID NO: 1284958 - RNA, 18 nt, Human
ccaaacccaugugcugua

SEQ ID NO: 1284959 - RNA, 19 nt, Human
ccaccagcccucagccagg

SEQ ID NO: 1284960 - RNA, 18 nt, Human
ccagaccccagaccccuc

SEQ ID NO: 1284961 - RNA, 22 nt, Human
cccacgucccagaccacaggca

SEQ ID NO: 1284962 - RNA, 19 nt, Human
cccagaccacaggcacacg

SEQ ID NO: 1284963 - RNA, 22 nt, Human
cccaggcugggauuuugggggc

SEQ ID NO: 1284964 - RNA, 18 nt, Human
ccccaagguacucccuug

SEQ ID NO: 1284965 - RNA, 19 nt, Human
ccccagaccccucccccca

SEQ ID NO: 1284966 - RNA, 19 nt, Human
ccccagaccccucccccca

SEQ ID NO: 1284967 - RNA, 18 nt, Human
ccccagggacccgucucc

SEQ ID NO: 1284968 - RNA, 23 nt, Human
ccccagggacccgucuccacuuu

SEQ ID NO: 1284969 - RNA, 21 nt, Human
ccccuccccccacuggagccc

SEQ ID NO: 1284970 - RNA, 22 nt, Human
cccggaccagaccccagacccc

SEQ ID NO: 1284971 - RNA, 24 nt, Human
cccggggcaucugccugguugggg

SEQ ID NO: 1284972 - RNA, 18 nt, Human
cccucagucucuuuccuc

SEQ ID NO: 1284973 - RNA, 18 nt, Human
ccgcgcgcgcgggggccg

SEQ ID NO: 1284974 - RNA, 18 nt, Human
ccggggcuggggcugcgg

SEQ ID NO: 1284975 - RNA, 23 nt, Human
ccuacagauuccaccucccaucu

SEQ ID NO: 1284976 - RNA, 25 nt, Human
ccuccugcagccagcucaaaaggau

SEQ ID NO: 1284977 - RNA, 18 nt, Human
cggaagaggggcucccag

SEQ ID NO: 1284978 - RNA, 24 nt, Human
cggaagaggggcucccagggcugg

SEQ ID NO: 1284979 - RNA, 19 nt, Human
cggaccagaccccagaccc

SEQ ID NO: 1284980 - RNA, 22 nt, Human
cggcagcagucccaagccuggu

SEQ ID NO: 1284981 - RNA, 22 nt, Human
cgggagcggcgccgggcgcggg

SEQ ID NO: 1284982 - RNA, 21 nt, Human
cgucugggcacuccugggucg

SEQ ID NO: 1284983 - RNA, 22 nt, Human
cucccaccucuugaccugaacc

SEQ ID NO: 1284984 - RNA, 22 nt, Human
cucccuucugagggcuguagcc

SEQ ID NO: 1284985 - RNA, 21 nt, Human
cuccugcagccagcucaaaag

SEQ ID NO: 1284986 - RNA, 23 nt, Human
cucugguaccauccaccggcagc

SEQ ID NO: 1284987 - RNA, 18 nt, Human
cucuuuccuccccucccu

SEQ ID NO: 1284988 - RNA, 21 nt, Human
cuggugaugcgccgcggcucc

SEQ ID NO: 1284989 - RNA, 22 nt, Human
cuugaccugaaccccuuuuaac

SEQ ID NO: 1284990 - RNA, 21 nt, Human
gaacccggaccagaccccaga

SEQ ID NO: 1284991 - RNA, 23 nt, Human
gaagaggggcugggccgguagua

SEQ ID NO: 1284992 - RNA, 21 nt, Human
gacccgucuccacucccuggg

SEQ ID NO: 1284993 - RNA, 20 nt, Human
gagcagcagaagaggacugg

SEQ ID NO: 1284994 - RNA, 20 nt, Human
gagcggcuggagcuccagga

SEQ ID NO: 1284995 - RNA, 23 nt, Human
gagcuguguagugcggaagaggg

SEQ ID NO: 1284996 - RNA, 18 nt, Human
gagcuugggggaggcugu

SEQ ID NO: 1284997 - RNA, 21 nt, Human
gaggacugggggccaccgcuu

SEQ ID NO: 1284998 - RNA, 21 nt, Human
gaggagcuugggggaggcugu

SEQ ID NO: 1284999 - RNA, 22 nt, Human
gagggccccaggaggagggggc

SEQ ID NO: 1285000 - RNA, 20 nt, Human
gccccaggccagggcccuca

SEQ ID NO: 1285001 - RNA, 21 nt, Human
gccggggcuggggcugcggcu

SEQ ID NO: 1285002 - RNA, 21 nt, Human
gcgagauuuggagggcgagcg

SEQ ID NO: 1285003 - RNA, 21 nt, Human
gcgagcggcuggggcuguggg

SEQ ID NO: 1285004 - RNA, 24 nt, Human
gcugaggggcuucuugggcgacgg

SEQ ID NO: 1285005 - RNA, 24 nt, Human
gcuguggggccagccaccagcccu

SEQ ID NO: 1285006 - RNA, 21 nt, Human
ggaagaggggcugggccggua

SEQ ID NO: 1285007 - RNA, 18 nt, Human
ggacccgucuccacuccc

SEQ ID NO: 1285008 - RNA, 18 nt, Human
ggagcccggggcaucugc

SEQ ID NO: 1285009 - RNA, 21 nt, Human
ggaggaggaagaggggcuggg

SEQ ID NO: 1285010 - RNA, 21 nt, Human
ggaggagggggcugggagcag

SEQ ID NO: 1285011 - RNA, 22 nt, Human
ggccaaggaagacuucaugaga

SEQ ID NO: 1285012 - RNA, 25 nt, Human
ggcccuggaggagggagacggcgcg

SEQ ID NO: 1285013 - RNA, 22 nt, Human
ggccggggcugcgcgacgagcu

SEQ ID NO: 1285014 - RNA, 18 nt, Human
ggccggggcuggggcugc

SEQ ID NO: 1285015 - RNA, 20 nt, Human
ggccggggcuggggcugcgg

SEQ ID NO: 1285016 - RNA, 20 nt, Human
ggcugcggcuguggcuccgg

SEQ ID NO: 1285017 - RNA, 21 nt, Human
ggcuggggcuguggggccgcu

SEQ ID NO: 1285018 - RNA, 21 nt, Human
ggcugggggcacugcugaccu

SEQ ID NO: 1285019 - RNA, 22 nt, Human
gggcugcggcuguggcuccggg

SEQ ID NO: 1285020 - RNA, 18 nt, Human
gggcuguggggccgcuuc

SEQ ID NO: 1285021 - RNA, 21 nt, Human
ggggcugggagcagcagaaga

SEQ ID NO: 1285022 - RNA, 24 nt, Human
gggggcugggagcagcagaagagg

SEQ ID NO: 1285023 - RNA, 19 nt, Human
ggugaggagagccuggccu

SEQ ID NO: 1285024 - RNA, 19 nt, Human
ggugcaccaaggguuaggc

SEQ ID NO: 1285025 - RNA, 20 nt, Human
ggugcaccaaggguuaggcu

SEQ ID NO: 1285026 - RNA, 19 nt, Human
guagugcggaagaggggcu

SEQ ID NO: 1285027 - RNA, 23 nt, Human
uagcucccguggcuguggccucc

SEQ ID NO: 1285028 - RNA, 23 nt, Human
ucagccaggguccuccugcagcc

SEQ ID NO: 1285029 - RNA, 18 nt, Human
ucagguccaaagcacaug

SEQ ID NO: 1285030 - RNA, 19 nt, Human
uccaccggcagcaguccca

SEQ ID NO: 1285031 - RNA, 20 nt, Human
uccaccggcagcagucccaa

SEQ ID NO: 1285032 - RNA, 25 nt, Human
ucccaucuaccccuuuccucuccca

SEQ ID NO: 1285033 - RNA, 19 nt, Human
uccccagcuuggauggggg

SEQ ID NO: 1285034 - RNA, 20 nt, Human
uccccagggacccgucucca

SEQ ID NO: 1285035 - RNA, 23 nt, Human
ucccggcugaggggcuucuuggg

SEQ ID NO: 1285036 - RNA, 21 nt, Human
ucccguggcuguggccggggc

SEQ ID NO: 1285037 - RNA, 18 nt, Human
ucccugggggcuacucag

SEQ ID NO: 1285038 - RNA, 19 nt, Human
uccuugucccggcugaggg

SEQ ID NO: 1285039 - RNA, 20 nt, Human
ucuccacucccugggggcua

SEQ ID NO: 1285040 - RNA, 18 nt, Human
ucucccaccucuugaccu

SEQ ID NO: 1285041 - RNA, 22 nt, Human
ucucccaccucuugaccugaac

SEQ ID NO: 1285042 - RNA, 23 nt, Human
ucugucuagcuccaaacccaugu

SEQ ID NO: 1285043 - RNA, 23 nt, Human
ucuuggguggggcugggggcacu

SEQ ID NO: 1285044 - RNA, 20 nt, Human
ugaagugacagagcagauca

SEQ ID NO: 1285045 - RNA, 24 nt, Human
ugaccugucagcugcucccucccc

SEQ ID NO: 1285046 - RNA, 23 nt, Human
ugagggccccaggaggagggggc

SEQ ID NO: 1285047 - RNA, 22 nt, Human
ugcaaggugucccuggcugcac

SEQ ID NO: 1285048 - RNA, 23 nt, Human
ugcccagugauaagagaggagug

SEQ ID NO: 1285049 - RNA, 19 nt, Human
ugccuagcuccccaggcug

SEQ ID NO: 1285050 - RNA, 24 nt, Human
ugccugugacccugggcugccauc

SEQ ID NO: 1285051 - RNA, 21 nt, Human
ugcggaagaggggcucccagg

SEQ ID NO: 1285052 - RNA, 20 nt, Human
ugcggaugggcgaguagcug

SEQ ID NO: 1285053 - RNA, 22 nt, Human
ugcucccuccccagggacccgu

SEQ ID NO: 1285054 - RNA, 19 nt, Human
uggaggaggaagaggggcu

SEQ ID NO: 1285055 - RNA, 21 nt, Human
uggaggaggaagaggggcugg

SEQ ID NO: 1285056 - RNA, 18 nt, Human
uggaggagggagacggcg

SEQ ID NO: 1285057 - RNA, 19 nt, Human
uggaggagggagacggcgc

SEQ ID NO: 1285058 - RNA, 19 nt, Human
uggagggagcuguguagug

SEQ ID NO: 1285059 - RNA, 19 nt, Human
uggcccagggcauggggug

SEQ ID NO: 1285060 - RNA, 22 nt, Human
uggccucggccucagagugccu

SEQ ID NO: 1285061 - RNA, 19 nt, Human
uggcgggccgcgcgcgcgg

SEQ ID NO: 1285062 - RNA, 21 nt, Human
uggcgggccgcgcgcgcgggg

SEQ ID NO: 1285063 - RNA, 20 nt, Human
uggcuguggccggggcuggg

SEQ ID NO: 1285064 - RNA, 19 nt, Human
uggggccagccaccagccc

SEQ ID NO: 1285065 - RNA, 19 nt, Human
uggggccagccaccagccc

SEQ ID NO: 1285066 - RNA, 23 nt, Human
uggggccgcuucuccgcagagcg

SEQ ID NO: 1285067 - RNA, 20 nt, Human
uggggugaggagagccuggc

SEQ ID NO: 1285068 - RNA, 18 nt, Human
uggguggggcugggggca

SEQ ID NO: 1285069 - RNA, 20 nt, Human
uggguggggcugggggcacu

SEQ ID NO: 1285070 - RNA, 22 nt, Human
ugguaccauccaccggcagcag

SEQ ID NO: 1285071 - RNA, 21 nt, Human
ugguaggaccuuggcccaggg

SEQ ID NO: 1285072 - RNA, 18 nt, Human
ugucagguccaaagcaca

SEQ ID NO: 1285073 - RNA, 20 nt, Human
ugucccggcugaggggcuuc

SEQ ID NO: 1285074 - RNA, 24 nt, Human
uguucuuccuucugucuagcucca

SEQ ID NO: 1285075 - RNA, 19 nt, Human
uuaggcuguucuuccuucu

SEQ ID NO: 1285076 - RNA, 18 nt, Human
uugcaaggugucccuggc

SEQ ID NO: 1285077 - RNA, 24 nt, Human
uuggcccuggaggagggagacggc

SEQ ID NO: 1285078 - RNA, 22 nt, Human
uugucccggcugaggggcuucu

SEQ ID NO: 1285079 - RNA, 18 nt, Human
aagacccacccaaagucc

SEQ ID NO: 1285080 - RNA, 21 nt, Human
aauggcagacaucaggaagga

SEQ ID NO: 1285081 - RNA, 23 nt, Human
acucccugggaagacccacccaa

SEQ ID NO: 1285082 - RNA, 18 nt, Human
agacuguuuucuacuauc

SEQ ID NO: 1285083 - RNA, 27 nt, Human
augaagcagaucacuggggcugaccuu

SEQ ID NO: 1285084 - RNA, 21 nt, Human
caccggauccgccucggggac

SEQ ID NO: 1285085 - RNA, 23 nt, Human
caggguauagaaugaaaggcagg

SEQ ID NO: 1285086 - RNA, 23 nt, Human
caucaggaaggaggagaggaacc

SEQ ID NO: 1285087 - RNA, 23 nt, Human
ccuacucccugggaagacccacc

SEQ ID NO: 1285088 - RNA, 24 nt, Human
cugggaagacccacccaaaguccu

SEQ ID NO: 1285089 - RNA, 18 nt, Human
cuguacuccagcucucag

SEQ ID NO: 1285090 - RNA, 18 nt, Human
cuguacuccagcucucag

SEQ ID NO: 1285091 - RNA, 19 nt, Human
cuguacuccagcucucagc

SEQ ID NO: 1285092 - RNA, 24 nt, Human
cuucucaauugcucugaacucuag

SEQ ID NO: 1285093 - RNA, 23 nt, Human
gaagcagaucacuggggcugacc

SEQ ID NO: 1285094 - RNA, 23 nt, Human
gcaccagcauccagacuguuuuc

SEQ ID NO: 1285095 - RNA, 23 nt, Human
gcaggagauaaaauugcacuucu

SEQ ID NO: 1285096 - RNA, 18 nt, Human
ggagaggaaccauuugug

SEQ ID NO: 1285097 - RNA, 22 nt, Human
gucagggucaccaaagugugag

SEQ ID NO: 1285098 - RNA, 21 nt, Human
uagaaugaaaggcaggagaua

SEQ ID NO: 1285099 - RNA, 25 nt, Human
uaguggcaccagcauccagacuguu

SEQ ID NO: 1285100 - RNA, 24 nt, Human
ucacaguugaacacgaugguucag

SEQ ID NO: 1285101 - RNA, 23 nt, Human
ucacuggggcugaccuugggugu

SEQ ID NO: 1285102 - RNA, 25 nt, Human
ucacuggggcugaccuuggguguau

SEQ ID NO: 1285103 - RNA, 22 nt, Human
ucaguaccaccugcccagagca

SEQ ID NO: 1285104 - RNA, 19 nt, Human
ucucucacuuccagaacac

SEQ ID NO: 1285105 - RNA, 22 nt, Human
ucucucacuuccagaacaccgg

SEQ ID NO: 1285106 - RNA, 19 nt, Human
ucucugagggugcccuacu

SEQ ID NO: 1285107 - RNA, 20 nt, Human
ucuucaccgcagugcuuaga

SEQ ID NO: 1285108 - RNA, 18 nt, Human
ugcccagagcaaaucuga

SEQ ID NO: 1285109 - RNA, 22 nt, Human
ugcccagagcaaaucugaugga

SEQ ID NO: 1285110 - RNA, 19 nt, Human
uucacaguugaacacgaug

SEQ ID NO: 1285111 - RNA, 21 nt, Human
uucuguacuccagcucucagc

SEQ ID NO: 1285112 - RNA, 19 nt, Human
aacugaacucccaggugcc

SEQ ID NO: 1285113 - RNA, 20 nt, Human
aucaggaaggucggaaucuc

SEQ ID NO: 1285114 - RNA, 18 nt, Human
guccaacugaacucccag

SEQ ID NO: 1285115 - RNA, 21 nt, Human
ucccaggugccgacagagucc

SEQ ID NO: 1285116 - RNA, 18 nt, Human
uccuuggucuucuucugg

SEQ ID NO: 1285117 - RNA, 19 nt, Human
ugggagaagucaggagugg

SEQ ID NO: 1285118 - RNA, 21 nt, Human
aaccuuuugagguuauucuga

SEQ ID NO: 1285119 - RNA, 21 nt, Human
accuucuuggcggacagagaa

SEQ ID NO: 1285120 - RNA, 18 nt, Human
agacgguggcgguggggg

SEQ ID NO: 1285121 - RNA, 18 nt, Human
aggagacaggugggagag

SEQ ID NO: 1285122 - RNA, 19 nt, Human
agggucccgggaggagagu

SEQ ID NO: 1285123 - RNA, 21 nt, Human
cagcugccugcuguucccgcc

SEQ ID NO: 1285124 - RNA, 23 nt, Human
cccacaaacucuucugcaaaccu

SEQ ID NO: 1285125 - RNA, 25 nt, Human
cccgggaggagaguugcagcuugcc

SEQ ID NO: 1285126 - RNA, 21 nt, Human
ccgccgcugcccccuucuccg

SEQ ID NO: 1285127 - RNA, 24 nt, Human
ccgccgcugcccccuucuccguuc

SEQ ID NO: 1285128 - RNA, 19 nt, Human
ccgcggcagcgacacagug

SEQ ID NO: 1285129 - RNA, 20 nt, Human
ccuccauuaggcuggugcuc

SEQ ID NO: 1285130 - RNA, 23 nt, Human
ccuuuaaugagacaaauggaaac

SEQ ID NO: 1285131 - RNA, 18 nt, Human
cgcggugccuucuucucc

SEQ ID NO: 1285132 - RNA, 20 nt, Human
cguucacucuccgcggugcc

SEQ ID NO: 1285133 - RNA, 18 nt, Human
cuuuuucuucuuuaccuu

SEQ ID NO: 1285134 - RNA, 22 nt, Human
gaccuucuuggcggacagagaa

SEQ ID NO: 1285135 - RNA, 20 nt, Human
gagggucccgggaggagagu

SEQ ID NO: 1285136 - RNA, 25 nt, Human
gaucuucaacaucaguuagcaaucc

SEQ ID NO: 1285137 - RNA, 18 nt, Human
gcagcugccugcuguucc

SEQ ID NO: 1285138 - RNA, 23 nt, Human
gccugcuguucccgccgcugccc

SEQ ID NO: 1285139 - RNA, 20 nt, Human
ggagacaggugggagaguuc

SEQ ID NO: 1285140 - RNA, 22 nt, Human
ggccgcggcagcgacacagugc

SEQ ID NO: 1285141 - RNA, 21 nt, Human
gggccgcggcagcgacacagu

SEQ ID NO: 1285142 - RNA, 24 nt, Human
guggcggugggggccgcggcagcg

SEQ ID NO: 1285143 - RNA, 20 nt, Human
guucacucuccgcggugccu

SEQ ID NO: 1285144 - RNA, 23 nt, Human
guuucuuuuucuuuuucuucuuu

SEQ ID NO: 1285145 - RNA, 19 nt, Human
uauccaaauucuucccaac

SEQ ID NO: 1285146 - RNA, 23 nt, Human
ucauuuaggaugccuuuggcugc

SEQ ID NO: 1285147 - RNA, 24 nt, Human
ucucucuuuaauuuugucuuugau

SEQ ID NO: 1285148 - RNA, 27 nt, Human
ucuucugcaaaccucuccaucuccaua

SEQ ID NO: 1285149 - RNA, 20 nt, Human
ucuuucuuuuucuuugucuc

SEQ ID NO: 1285150 - RNA, 19 nt, Human
ucuuuguguuucuuuuucu

SEQ ID NO: 1285151 - RNA, 23 nt, Human
ucuuuuauguuaucauuuaggau

SEQ ID NO: 1285152 - RNA, 20 nt, Human
ugagacaaauggaaacucac

SEQ ID NO: 1285153 - RNA, 28 nt, Human
ugagacaaauggaaacucacuguucucu

SEQ ID NO: 1285154 - RNA, 23 nt, Human
ugcuguucccgccgcugcccccu

SEQ ID NO: 1285155 - RNA, 18 nt, Human
uguucccgccgcugcccc

SEQ ID NO: 1285156 - RNA, 25 nt, Human
uguuuuugguuucuccuucccacuu

SEQ ID NO: 1285157 - RNA, 24 nt, Human
uucagcaaaaucuuuacuucucca

SEQ ID NO: 1285158 - RNA, 18 nt, Human
uucucuggaauuuuggaa

SEQ ID NO: 1285159 - RNA, 23 nt, Human
uuggcugcuugaucuucaacauc

SEQ ID NO: 1285160 - RNA, 25 nt, Human
uugucucucucuuuaauuuugucuu

SEQ ID NO: 1285161 - RNA, 21 nt, Human
uuuguaagucuucuauauuug

SEQ ID NO: 1285162 - RNA, 22 nt, Human
uuuguaagucuucuauauuugu

SEQ ID NO: 1285163 - RNA, 27 nt, Human
uuuguaagucuucuauauuuguuuuug

SEQ ID NO: 1285164 - RNA, 26 nt, Human
aauacaaaaacaggaucauuauuaga

SEQ ID NO: 1285165 - RNA, 20 nt, Human
accauaaauauggagauaca

SEQ ID NO: 1285166 - RNA, 19 nt, Human
agugugagguccaagaaca

SEQ ID NO: 1285167 - RNA, 22 nt, Human
agugugagguccaagaacagau

SEQ ID NO: 1285168 - RNA, 22 nt, Human
caaagaauugagggggguggga

SEQ ID NO: 1285169 - RNA, 23 nt, Human
cagcaccaaugugaagaaaauac

SEQ ID NO: 1285170 - RNA, 26 nt, Human
cagcaccaaugugaagaaaauacaaa

SEQ ID NO: 1285171 - RNA, 26 nt, Human
cauuauuagagccaaagaauugaggg

SEQ ID NO: 1285172 - RNA, 19 nt, Human
gggggugggagcagaagcu

SEQ ID NO: 1285173 - RNA, 19 nt, Human
uaucagcaccaaugugaag

SEQ ID NO: 1285174 - RNA, 20 nt, Human
ugauguggaaucugaugaug

SEQ ID NO: 1285175 - RNA, 19 nt, Human
acagugcccacaaauaugc

SEQ ID NO: 1285176 - RNA, 21 nt, Human
caugugcaucuucauacgagu

SEQ ID NO: 1285177 - RNA, 21 nt, Human
acccaaaucauuugcuuuccu

SEQ ID NO: 1285178 - RNA, 23 nt, Human
agaaaaaacauaaauuggaucau

SEQ ID NO: 1285179 - RNA, 24 nt, Human
aguggugguguccaucuccuggca

SEQ ID NO: 1285180 - RNA, 18 nt, Human
auaaggcaaucaaauguu

SEQ ID NO: 1285181 - RNA, 18 nt, Human
cacaugugccuuccaaau

SEQ ID NO: 1285182 - RNA, 23 nt, Human
caccgugcagucaucacgauuag

SEQ ID NO: 1285183 - RNA, 25 nt, Human
cagaaugagagccccauucuccauu

SEQ ID NO: 1285184 - RNA, 19 nt, Human
cagcggcauggcccuccuc

SEQ ID NO: 1285185 - RNA, 20 nt, Human
cagcggcauggcccuccucu

SEQ ID NO: 1285186 - RNA, 20 nt, Human
cagcggcauggcccuccucu

SEQ ID NO: 1285187 - RNA, 21 nt, Human
cagcggcauggcccuccucug

SEQ ID NO: 1285188 - RNA, 24 nt, Human
cauaaugcauaugcucacaugugg

SEQ ID NO: 1285189 - RNA, 19 nt, Human
ccuguaaaacuagagcagg

SEQ ID NO: 1285190 - RNA, 20 nt, Human
cuguuuuaaggucaggaaaa

SEQ ID NO: 1285191 - RNA, 18 nt, Human
cuuccugaguugagcuuc

SEQ ID NO: 1285192 - RNA, 18 nt, Human
gaaaagaacucaaagaag

SEQ ID NO: 1285193 - RNA, 22 nt, Human
gguaugaggacagacccuaaaa

SEQ ID NO: 1285194 - RNA, 19 nt, Human
gucagaaugagagccccau

SEQ ID NO: 1285195 - RNA, 24 nt, Human
gugcacagcauagaucaaagacac

SEQ ID NO: 1285196 - RNA, 23 nt, Human
guggugguguccaucuccuggca

SEQ ID NO: 1285197 - RNA, 18 nt, Human
uaaauaaugggaaaaaua

SEQ ID NO: 1285198 - RNA, 22 nt, Human
uaaauaaugggaaaaauauacc

SEQ ID NO: 1285199 - RNA, 22 nt, Human
uaaggugcacagcauagaucaa

SEQ ID NO: 1285200 - RNA, 19 nt, Human
uagacaucauaaagaauaa

SEQ ID NO: 1285201 - RNA, 21 nt, Human
ucagcagugcauuggugggcu

SEQ ID NO: 1285202 - RNA, 23 nt, Human
uccccaaaauauaaacaaagaaa

SEQ ID NO: 1285203 - RNA, 24 nt, Human
uccccaaaauauaaacaaagaaaa

SEQ ID NO: 1285204 - RNA, 19 nt, Human
ugaaaagaacucaaagaag

SEQ ID NO: 1285205 - RNA, 22 nt, Human
ugaaaagaacucaaagaagaug

SEQ ID NO: 1285206 - RNA, 23 nt, Human
ugcacagcauagaucaaagacac

SEQ ID NO: 1285207 - RNA, 21 nt, Human
ugcucacaugugccuuccaaa

SEQ ID NO: 1285208 - RNA, 18 nt, Human
uggcaagguacuugacca

SEQ ID NO: 1285209 - RNA, 21 nt, Human
ugugagaucaccaaugugaca

SEQ ID NO: 1285210 - RNA, 22 nt, Human
uguuucaaucuccuucccuuuu

SEQ ID NO: 1285211 - RNA, 23 nt, Human
uucaaucuccuucccuuuucagc

SEQ ID NO: 1285212 - RNA, 19 nt, Human
uuccccaaaauauaaacaa

SEQ ID NO: 1285213 - RNA, 18 nt, Human
uugaccaugugauaaggc

SEQ ID NO: 1285214 - RNA, 25 nt, Human
uugucaguggugguguccaucuccu

SEQ ID NO: 1285215 - RNA, 18 nt, Human
uuuggcaagguacuugac

SEQ ID NO: 1285216 - RNA, 20 nt, Human
aaaaccaccauaauccagca

SEQ ID NO: 1285217 - RNA, 18 nt, Human
aaaggcacaccaaauucu

SEQ ID NO: 1285218 - RNA, 20 nt, Human
aacauggugaaacccugucu

SEQ ID NO: 1285219 - RNA, 21 nt, Human
aacauggugaaacccugucuc

SEQ ID NO: 1285220 - RNA, 20 nt, Human
aagaaaaagaauugaauucc

SEQ ID NO: 1285221 - RNA, 25 nt, Human
aagucaauuucaguuaaaagacuua

SEQ ID NO: 1285222 - RNA, 23 nt, Human
aaguuucuugaaggauuaguucu

SEQ ID NO: 1285223 - RNA, 20 nt, Human
aauugcuugagcccaggagg

SEQ ID NO: 1285224 - RNA, 23 nt, Human
acaaauugaaaggcacaccaaau

SEQ ID NO: 1285225 - RNA, 19 nt, Human
acacaacugacugucccuu

SEQ ID NO: 1285226 - RNA, 24 nt, Human
acccugucucuacaaaaaauacga

SEQ ID NO: 1285227 - RNA, 19 nt, Human
agauaucagaacauaaaac

SEQ ID NO: 1285228 - RNA, 22 nt, Human
agccuggccaacauggugaaac

SEQ ID NO: 1285229 - RNA, 24 nt, Human
agccuggccaacauggugaaaccc

SEQ ID NO: 1285230 - RNA, 25 nt, Human
agcuggaagaaaaauauacucacaa

SEQ ID NO: 1285231 - RNA, 19 nt, Human
agcuuuuugggaggcugag

SEQ ID NO: 1285232 - RNA, 22 nt, Human
aggaaagaugaaaauuuaagau

SEQ ID NO: 1285233 - RNA, 24 nt, Human
aggcaugguggcucaugcuaguaa

SEQ ID NO: 1285234 - RNA, 22 nt, Human
aggccaggcaugguggcucaug

SEQ ID NO: 1285235 - RNA, 24 nt, Human
aggcugagguugcagugagccuag

SEQ ID NO: 1285236 - RNA, 25 nt, Human
aggcugagguugcagugagccuagg

SEQ ID NO: 1285237 - RNA, 22 nt, Human
auaaaaaucaaggugugaacaa

SEQ ID NO: 1285238 - RNA, 22 nt, Human
auaggccaggcaugguggcuca

SEQ ID NO: 1285239 - RNA, 23 nt, Human
aucuguuccaaucugcugugauc

SEQ ID NO: 1285240 - RNA, 19 nt, Human
augcuuaugccugggaguu

SEQ ID NO: 1285241 - RNA, 23 nt, Human
augcuuaugccugggaguucaag

SEQ ID NO: 1285242 - RNA, 21 nt, Human
auguaaacauaaaauacugga

SEQ ID NO: 1285243 - RNA, 23 nt, Human
caaauaguccauccacaacagga

SEQ ID NO: 1285244 - RNA, 24 nt, Human
caacauggugaaacccugucucua

SEQ ID NO: 1285245 - RNA, 25 nt, Human
caagaaaaauacauguaucuagaag

SEQ ID NO: 1285246 - RNA, 24 nt, Human
caagaccagccuggccaacauggu

SEQ ID NO: 1285247 - RNA, 21 nt, Human
cacaacaggaaagaugaaaau

SEQ ID NO: 1285248 - RNA, 19 nt, Human
cacaccuauaaucccagcc

SEQ ID NO: 1285249 - RNA, 26 nt, Human
caccauaauccagcauguggaacugg

SEQ ID NO: 1285250 - RNA, 21 nt, Human
cagcacuuccaagauaggcau

SEQ ID NO: 1285251 - RNA, 20 nt, Human
cagcuuuuugggaggcugag

SEQ ID NO: 1285252 - RNA, 23 nt, Human
cagcuuuuugggaggcugagaca

SEQ ID NO: 1285253 - RNA, 18 nt, Human
caggcagaaugcuuaugc

SEQ ID NO: 1285254 - RNA, 21 nt, Human
cauaaaaccaccauaauccag

SEQ ID NO: 1285255 - RNA, 21 nt, Human
caucccucuugggcaguuuua

SEQ ID NO: 1285256 - RNA, 24 nt, Human
caugcuaguaaucccagcuuuuug

SEQ ID NO: 1285257 - RNA, 22 nt, Human
cauuauuauuucaauuuaggga

SEQ ID NO: 1285258 - RNA, 21 nt, Human
cccaaagagaauauucagcac

SEQ ID NO: 1285259 - RNA, 23 nt, Human
ccuauaaucccagccacucagga

SEQ ID NO: 1285260 - RNA, 22 nt, Human
ccuggccaacauggugaaaccc

SEQ ID NO: 1285261 - RNA, 24 nt, Human
ccuggccaacauggugaaacccug

SEQ ID NO: 1285262 - RNA, 22 nt, Human
cucaugcuaguaaucccagcuu

SEQ ID NO: 1285263 - RNA, 24 nt, Human
cuggccaacauggugaaacccugu

SEQ ID NO: 1285264 - RNA, 24 nt, Human
cugucuaaaaaaaaaagcuaauua

SEQ ID NO: 1285265 - RNA, 19 nt, Human
cuuaugccugggaguucaa

SEQ ID NO: 1285266 - RNA, 23 nt, Human
cuuaugccugggaguucaagacc

SEQ ID NO: 1285267 - RNA, 19 nt, Human
gaaaggcacaccaaauucu

SEQ ID NO: 1285268 - RNA, 22 nt, Human
gaacaaaacuauaacauuuuca

SEQ ID NO: 1285269 - RNA, 22 nt, Human
gagaaaguagagauuuguugac

SEQ ID NO: 1285270 - RNA, 23 nt, Human
gagaauugcuugagcccaggagg

SEQ ID NO: 1285271 - RNA, 24 nt, Human
gagacaugagaauugcuugagccc

SEQ ID NO: 1285272 - RNA, 19 nt, Human
gagguugcagugagccuag

SEQ ID NO: 1285273 - RNA, 19 nt, Human
gagguugcagugagccuag

SEQ ID NO: 1285274 - RNA, 22 nt, Human
gcaguuuuacuccaaguuucuu

SEQ ID NO: 1285275 - RNA, 20 nt, Human
gcaugguggcacacaccuau

SEQ ID NO: 1285276 - RNA, 24 nt, Human
gccaacauggugaaacccugucuc

SEQ ID NO: 1285277 - RNA, 21 nt, Human
gccaggcaugguggcucaugc

SEQ ID NO: 1285278 - RNA, 24 nt, Human
gcccaggaggcugagguugcagug

SEQ ID NO: 1285279 - RNA, 24 nt, Human
gcuugagcccaggaggcugagguu

SEQ ID NO: 1285280 - RNA, 22 nt, Human
ggaggcugagguugcagugagc

SEQ ID NO: 1285281 - RNA, 19 nt, Human
ggauuucucagauaucaga

SEQ ID NO: 1285282 - RNA, 20 nt, Human
ggcaggguuuguuauaguuu

SEQ ID NO: 1285283 - RNA, 24 nt, Human
gguggcacacaccuauaaucccag

SEQ ID NO: 1285284 - RNA, 24 nt, Human
gguggcucaugcuaguaaucccag

SEQ ID NO: 1285285 - RNA, 22 nt, Human
guagacaaauaguccauccaca

SEQ ID NO: 1285286 - RNA, 21 nt, Human
guuauuauaugguaaauguuu

SEQ ID NO: 1285287 - RNA, 20 nt, Human
uaaaaaaaaaagcuaauuau

SEQ ID NO: 1285288 - RNA, 23 nt, Human
uaaaauacuggaacucuucagua

SEQ ID NO: 1285289 - RNA, 24 nt, Human
uaaugaggaggauuucucagauau

SEQ ID NO: 1285290 - RNA, 20 nt, Human
uaauugguguugacacaacu

SEQ ID NO: 1285291 - RNA, 23 nt, Human
uagaagcagaauaaugaggagga

SEQ ID NO: 1285292 - RNA, 21 nt, Human
uauaagaaaaagaauugaauu

SEQ ID NO: 1285293 - RNA, 24 nt, Human
uaugaaaaagcuaauuauaggcca

SEQ ID NO: 1285294 - RNA, 19 nt, Human
uauuucaauuuagggaaaa

SEQ ID NO: 1285295 - RNA, 18 nt, Human
ucaauauaaaaaucaagg

SEQ ID NO: 1285296 - RNA, 25 nt, Human
ucaauauaaaaaucaaggugugaac

SEQ ID NO: 1285297 - RNA, 22 nt, Human
uccacaacaggaaagaugaaaa

SEQ ID NO: 1285298 - RNA, 23 nt, Human
uccauccacaacaggaaagauga

SEQ ID NO: 1285299 - RNA, 22 nt, Human
ugaacaaaacuauaacauuuuc

SEQ ID NO: 1285300 - RNA, 18 nt, Human
ugacacaacugacugucc

SEQ ID NO: 1285301 - RNA, 24 nt, Human
ugagacaggcagaaugcuuaugcc

SEQ ID NO: 1285302 - RNA, 22 nt, Human
ugagcccaggaggcugagguug

SEQ ID NO: 1285303 - RNA, 19 nt, Human
ugagguugcagugagccua

SEQ ID NO: 1285304 - RNA, 24 nt, Human
ugcuaguaaucccagcuuuuuggg

SEQ ID NO: 1285305 - RNA, 20 nt, Human
uggaagaaaaauauacucac

SEQ ID NO: 1285306 - RNA, 21 nt, Human
uggagcaauugcuuaucgugc

SEQ ID NO: 1285307 - RNA, 22 nt, Human
uggcacacaccuauaaucccag

SEQ ID NO: 1285308 - RNA, 24 nt, Human
uggccaacauggugaaacccuguc

SEQ ID NO: 1285309 - RNA, 21 nt, Human
uggcucaugcuaguaauccca

SEQ ID NO: 1285310 - RNA, 22 nt, Human
uggcucaugcuaguaaucccag

SEQ ID NO: 1285311 - RNA, 19 nt, Human
ugggaggcugagacaggca

SEQ ID NO: 1285312 - RNA, 23 nt, Human
ugguggcacacaccuauaauccc

SEQ ID NO: 1285313 - RNA, 24 nt, Human
ugguggcucaugcuaguaauccca

SEQ ID NO: 1285314 - RNA, 18 nt, Human
uguaaacauaaaauacug

SEQ ID NO: 1285315 - RNA, 21 nt, Human
ugucccuuuauaagaaaaaga

SEQ ID NO: 1285316 - RNA, 27 nt, Human
ugucuaaaaaaaaaagcuaauuaucuc

SEQ ID NO: 1285317 - RNA, 18 nt, Human
uguggaacuggcauagga

SEQ ID NO: 1285318 - RNA, 22 nt, Human
uguguugauguuagcaucugau

SEQ ID NO: 1285319 - RNA, 21 nt, Human
uuaaaagacuuaaauauaaua

SEQ ID NO: 1285320 - RNA, 21 nt, Human
uuacuguuguugaagaauaaa

SEQ ID NO: 1285321 - RNA, 18 nt, Human
uuagcugugcaugguggc

SEQ ID NO: 1285322 - RNA, 20 nt, Human
uugacacaacugacuguccc

SEQ ID NO: 1285323 - RNA, 24 nt, Human
uugcuugagcccaggaggcugagg

SEQ ID NO: 1285324 - RNA, 21 nt, Human
uugggaggcugagacaggcag

SEQ ID NO: 1285325 - RNA, 23 nt, Human
agagaggucccuuuggagccccc

SEQ ID NO: 1285326 - RNA, 18 nt, Human
aggaaggcuggggagaag

SEQ ID NO: 1285327 - RNA, 22 nt, Human
aggaaggcuggggagaagcucu

SEQ ID NO: 1285328 - RNA, 23 nt, Human
caagagagaggucccuuuggagc

SEQ ID NO: 1285329 - RNA, 23 nt, Human
cagccuccagaggaaggcugggg

SEQ ID NO: 1285330 - RNA, 22 nt, Human
cagggccgagaugccgcaaagc

SEQ ID NO: 1285331 - RNA, 23 nt, Human
ccugcacuuuggucccaaagcag

SEQ ID NO: 1285332 - RNA, 21 nt, Human
ccuuuggagcccccaagaguc

SEQ ID NO: 1285333 - RNA, 22 nt, Human
cgcccugcacuuuggucccaaa

SEQ ID NO: 1285334 - RNA, 23 nt, Human
cggagcccgacucuaacgucggu

SEQ ID NO: 1285335 - RNA, 19 nt, Human
cuccagaggaaggcugggg

SEQ ID NO: 1285336 - RNA, 24 nt, Human
gagccagggccgagaugccgcaaa

SEQ ID NO: 1285337 - RNA, 18 nt, Human
gccaagagagaggucccu

SEQ ID NO: 1285338 - RNA, 19 nt, Human
gucccaaagcaggcucuau

SEQ ID NO: 1285339 - RNA, 22 nt, Human
uccagaggaaggcuggggagaa

SEQ ID NO: 1285340 - RNA, 25 nt, Human
ucucauccuccucuuccuaagaucc

SEQ ID NO: 1285341 - RNA, 18 nt, Human
ugccaagagagagguccc

SEQ ID NO: 1285342 - RNA, 19 nt, Human
ugccaagagagaggucccu

SEQ ID NO: 1285343 - RNA, 22 nt, Human
uggagcccccaagagucaaagg

SEQ ID NO: 1285344 - RNA, 19 nt, Human
aaacaaaccaauaaaaugc

SEQ ID NO: 1285345 - RNA, 24 nt, Human
aaacaagguaaaaaauuacaucug

SEQ ID NO: 1285346 - RNA, 21 nt, Human
aaacacacagcucauguccuc

SEQ ID NO: 1285347 - RNA, 23 nt, Human
aaaguaauauacaaacaugccaa

SEQ ID NO: 1285348 - RNA, 26 nt, Human
aaaguaauauacaaacaugccaaaac

SEQ ID NO: 1285349 - RNA, 26 nt, Human
aaauccaugcucccuucagcagcacg

SEQ ID NO: 1285350 - RNA, 18 nt, Human
aaguaauauacaaacaug

SEQ ID NO: 1285351 - RNA, 22 nt, Human
aauauacaaacaugccaaaaca

SEQ ID NO: 1285352 - RNA, 22 nt, Human
accccaccccccuccccccacc

SEQ ID NO: 1285353 - RNA, 25 nt, Human
accccaccccccuccccccaccccu

SEQ ID NO: 1285354 - RNA, 24 nt, Human
aggaccccaccccccuccccccac

SEQ ID NO: 1285355 - RNA, 19 nt, Human
aggaugaaaagaauccucu

SEQ ID NO: 1285356 - RNA, 18 nt, Human
auaacaacuauaacucuc

SEQ ID NO: 1285357 - RNA, 21 nt, Human
aucacuguauucagcuccauc

SEQ ID NO: 1285358 - RNA, 23 nt, Human
auccacaucuccccuggguccag

SEQ ID NO: 1285359 - RNA, 18 nt, Human
augaaaagaauccucucu

SEQ ID NO: 1285360 - RNA, 23 nt, Human
augcagagugugcaugaagcuau

SEQ ID NO: 1285361 - RNA, 19 nt, Human
augcucccuucagcagcac

SEQ ID NO: 1285362 - RNA, 23 nt, Human
augguccagguucuucuagauga

SEQ ID NO: 1285363 - RNA, 20 nt, Human
caaaccuaaacagcaaauaa

SEQ ID NO: 1285364 - RNA, 26 nt, Human
cacaaaccuaaacagcaaauaaaaau

SEQ ID NO: 1285365 - RNA, 21 nt, Human
caccagaauuauguauuuuuc

SEQ ID NO: 1285366 - RNA, 19 nt, Human
caccccccuccccccaccc

SEQ ID NO: 1285367 - RNA, 20 nt, Human
caccccccuccccccacccc

SEQ ID NO: 1285368 - RNA, 23 nt, Human
caccccccuccccccaccccugc

SEQ ID NO: 1285369 - RNA, 24 nt, Human
caccccccuccccccaccccugcu

SEQ ID NO: 1285370 - RNA, 18 nt, Human
caccccugcuccuaggag

SEQ ID NO: 1285371 - RNA, 19 nt, Human
cacucccucuuccuuuucc

SEQ ID NO: 1285372 - RNA, 19 nt, Human
cagcuccaucaagaauggu

SEQ ID NO: 1285373 - RNA, 23 nt, Human
caucacacagcuuuguagaaaca

SEQ ID NO: 1285374 - RNA, 23 nt, Human
cauugugccuucaaauccuccug

SEQ ID NO: 1285375 - RNA, 23 nt, Human
ccaaaacaagguaaaaaauuaca

SEQ ID NO: 1285376 - RNA, 18 nt, Human
ccaccccccuccccccac

SEQ ID NO: 1285377 - RNA, 21 nt, Human
ccaccccccuccccccacccc

SEQ ID NO: 1285378 - RNA, 19 nt, Human
ccacucccucuuccuuuuc

SEQ ID NO: 1285379 - RNA, 18 nt, Human
ccccaccccccucccccc

SEQ ID NO: 1285380 - RNA, 19 nt, Human
ccccaccccccucccccca

SEQ ID NO: 1285381 - RNA, 18 nt, Human
cccccuccccccaccccu

SEQ ID NO: 1285382 - RNA, 23 nt, Human
cccccuccccccaccccugcucc

SEQ ID NO: 1285383 - RNA, 19 nt, Human
ccccuggguccaguguucu

SEQ ID NO: 1285384 - RNA, 23 nt, Human
ccccuggguccaguguucuucuc

SEQ ID NO: 1285385 - RNA, 23 nt, Human
cccuucagcagcacguguaauaa

SEQ ID NO: 1285386 - RNA, 19 nt, Human
ccucaggcucaggggcgag

SEQ ID NO: 1285387 - RNA, 22 nt, Human
ccuucagcagcacguguaauaa

SEQ ID NO: 1285388 - RNA, 19 nt, Human
cguaagaaacaggaccucc

SEQ ID NO: 1285389 - RNA, 28 nt, Human
cuaaguaucauagauaaaauccaugcuu

SEQ ID NO: 1285390 - RNA, 21 nt, Human
cuccccccaccccugcuccua

SEQ ID NO: 1285391 - RNA, 21 nt, Human
cuccuagaaggaccccacccc

SEQ ID NO: 1285392 - RNA, 18 nt, Human
cuccucagauucaucuga

SEQ ID NO: 1285393 - RNA, 18 nt, Human
cuccucaggcucaggggc

SEQ ID NO: 1285394 - RNA, 22 nt, Human
cuccuucuccggcuccuccuca

SEQ ID NO: 1285395 - RNA, 24 nt, Human
gaaaacacacagcucauguccucc

SEQ ID NO: 1285396 - RNA, 28 nt, Human
gaaggaccccaccccccuccccccaccc

SEQ ID NO: 1285397 - RNA, 21 nt, Human
gaccccaccccccucccccca

SEQ ID NO: 1285398 - RNA, 22 nt, Human
gaccccaccccccuccccccac

SEQ ID NO: 1285399 - RNA, 24 nt, Human
gacuccuagaaggaccccaccccc

SEQ ID NO: 1285400 - RNA, 21 nt, Human
gagugcucgcuucaggagcac

SEQ ID NO: 1285401 - RNA, 20 nt, Human
ggaaaggguggaacuggaaa

SEQ ID NO: 1285402 - RNA, 23 nt, Human
ggaaaggguggaacuggaaacgc

SEQ ID NO: 1285403 - RNA, 20 nt, Human
ggaccuccagguuccgcccc

SEQ ID NO: 1285404 - RNA, 25 nt, Human
uaaaauagauaguauauauuagacg

SEQ ID NO: 1285405 - RNA, 26 nt, Human
uaccaguauuuccaaaauauuuaaaa

SEQ ID NO: 1285406 - RNA, 18 nt, Human
uagaaggaccccaccccc

SEQ ID NO: 1285407 - RNA, 28 nt, Human
uagaaggaccccaccccccuccccccaa

SEQ ID NO: 1285408 - RNA, 23 nt, Human
uagauaaaauccaugcucccuuc

SEQ ID NO: 1285409 - RNA, 22 nt, Human
uaggauaaaagaauugucucuu

SEQ ID NO: 1285410 - RNA, 24 nt, Human
uauaaaaagggugguggugccgca

SEQ ID NO: 1285411 - RNA, 22 nt, Human
uauauaacaacuauaacucuca

SEQ ID NO: 1285412 - RNA, 18 nt, Human
uauauguauguguauaua

SEQ ID NO: 1285413 - RNA, 19 nt, Human
uauauguauguguauauaa

SEQ ID NO: 1285414 - RNA, 22 nt, Human
ucaaaaguacaacaauuuccaa

SEQ ID NO: 1285415 - RNA, 24 nt, Human
ucaggagcacauauaauaauacag

SEQ ID NO: 1285416 - RNA, 20 nt, Human
uccaugcucccuucagcagc

SEQ ID NO: 1285417 - RNA, 20 nt, Human
uccccaagagacccacucua

SEQ ID NO: 1285418 - RNA, 18 nt, Human
uccccccaccccugcucc

SEQ ID NO: 1285419 - RNA, 25 nt, Human
ucucaggccgaugaccucaggccuc

SEQ ID NO: 1285420 - RNA, 24 nt, Human
ucuccggcuccuccucagauucau

SEQ ID NO: 1285421 - RNA, 25 nt, Human
ucuccggcuccuccucagauucauc

SEQ ID NO: 1285422 - RNA, 21 nt, Human
ugaaaagaauccucucuuaaa

SEQ ID NO: 1285423 - RNA, 18 nt, Human
ugaccucaggccuccccg

SEQ ID NO: 1285424 - RNA, 18 nt, Human
ugagccccugcauugugc

SEQ ID NO: 1285425 - RNA, 22 nt, Human
ugaucugcacaaaugguuccuc

SEQ ID NO: 1285426 - RNA, 18 nt, Human
ugccaaaacaagguaaaa

SEQ ID NO: 1285427 - RNA, 23 nt, Human
uggaauaaaguuccugcugaaaa

SEQ ID NO: 1285428 - RNA, 21 nt, Human
uggacugcaaguccguaagaa

SEQ ID NO: 1285429 - RNA, 19 nt, Human
uuacaagaauuuaggggaa

SEQ ID NO: 1285430 - RNA, 19 nt, Human
uucaauggccgacauuuuc

SEQ ID NO: 1285431 - RNA, 23 nt, Human
uucauuuuuauuauguuucccca

SEQ ID NO: 1285432 - RNA, 20 nt, Human
uuuaaaauaauauuuaaugu

SEQ ID NO: 1285433 - RNA, 26 nt, Human
aaaaagaauugucucuuaaaaaugaa

SEQ ID NO: 1285434 - RNA, 24 nt, Human
aaacaagguaaaaaauuacaucug

SEQ ID NO: 1285435 - RNA, 21 nt, Human
aaacacacagcucauguccuc

SEQ ID NO: 1285436 - RNA, 23 nt, Human
aaaguaacauacaaacaugccaa

SEQ ID NO: 1285437 - RNA, 26 nt, Human
aaaguaacauacaaacaugccaaaac

SEQ ID NO: 1285438 - RNA, 21 nt, Human
aaccaugcucccuucagcagc

SEQ ID NO: 1285439 - RNA, 21 nt, Human
aaucaggaaggucggaaucuc

SEQ ID NO: 1285440 - RNA, 19 nt, Human
aauggccgacauuuuccau

SEQ ID NO: 1285441 - RNA, 20 nt, Human
accccaccccccucccccca

SEQ ID NO: 1285442 - RNA, 22 nt, Human
accccaccccccuccccccacc

SEQ ID NO: 1285443 - RNA, 25 nt, Human
accccaccccccuccccccaccccu

SEQ ID NO: 1285444 - RNA, 21 nt, Human
aggaaaggguggaacuggaaa

SEQ ID NO: 1285445 - RNA, 24 nt, Human
aggaccccaccccccuccccccac

SEQ ID NO: 1285446 - RNA, 19 nt, Human
aggaugaaaagaauccucu

SEQ ID NO: 1285447 - RNA, 18 nt, Human
auaacaacuauaacucuc

SEQ ID NO: 1285448 - RNA, 19 nt, Human
auacaaaccaauaaaaugc

SEQ ID NO: 1285449 - RNA, 21 nt, Human
aucacuguauucagcuccauc

SEQ ID NO: 1285450 - RNA, 24 nt, Human
aucuggggucugucucugcugagg

SEQ ID NO: 1285451 - RNA, 18 nt, Human
augaaaagaauccucucu

SEQ ID NO: 1285452 - RNA, 23 nt, Human
augcagagugugcaugaagcuau

SEQ ID NO: 1285453 - RNA, 19 nt, Human
augcucccuucagcagcac

SEQ ID NO: 1285454 - RNA, 23 nt, Human
augguccagguucuucuagauga

SEQ ID NO: 1285455 - RNA, 20 nt, Human
caaaccuaaacagcaaauaa

SEQ ID NO: 1285456 - RNA, 21 nt, Human
caaagccugaagcauguuggg

SEQ ID NO: 1285457 - RNA, 26 nt, Human
cacaaaccuaaacagcaaauaaaaau

SEQ ID NO: 1285458 - RNA, 19 nt, Human
caccccccuccccccaccc

SEQ ID NO: 1285459 - RNA, 20 nt, Human
caccccccuccccccacccc

SEQ ID NO: 1285460 - RNA, 23 nt, Human
caccccccuccccccaccccugc

SEQ ID NO: 1285461 - RNA, 24 nt, Human
caccccccuccccccaccccugcu

SEQ ID NO: 1285462 - RNA, 18 nt, Human
caccccugcuccuaggag

SEQ ID NO: 1285463 - RNA, 18 nt, Human
cagcuccaucaagaaugg

SEQ ID NO: 1285464 - RNA, 23 nt, Human
caucacacagcuuuauagaaaca

SEQ ID NO: 1285465 - RNA, 23 nt, Human
cauugugccuucaaauccuccug

SEQ ID NO: 1285466 - RNA, 23 nt, Human
ccaaaacaagguaaaaaauuaca

SEQ ID NO: 1285467 - RNA, 18 nt, Human
ccaacugaucuccaggca

SEQ ID NO: 1285468 - RNA, 18 nt, Human
ccaccccccuccccccac

SEQ ID NO: 1285469 - RNA, 21 nt, Human
ccaccccccuccccccacccc

SEQ ID NO: 1285470 - RNA, 22 nt, Human
ccaccccccuccccccaccccu

SEQ ID NO: 1285471 - RNA, 23 nt, Human
ccagcagaggcuguguccucucc

SEQ ID NO: 1285472 - RNA, 20 nt, Human
cccaaccucagaccauuguc

SEQ ID NO: 1285473 - RNA, 18 nt, Human
ccccaccccccucccccc

SEQ ID NO: 1285474 - RNA, 19 nt, Human
ccccaccccccucccccca

SEQ ID NO: 1285475 - RNA, 18 nt, Human
ccccccuccccccacccc

SEQ ID NO: 1285476 - RNA, 23 nt, Human
cccccuccccccaccccugcucc

SEQ ID NO: 1285477 - RNA, 19 nt, Human
ccccuggguccgguguucu

SEQ ID NO: 1285478 - RNA, 23 nt, Human
cccuucagcagcacguguaauaa

SEQ ID NO: 1285479 - RNA, 22 nt, Human
ccuggagauccugggugaaugg

SEQ ID NO: 1285480 - RNA, 22 nt, Human
ccuucagcagcacguguaauaa

SEQ ID NO: 1285481 - RNA, 19 nt, Human
cguaagaaacaggaccucc

SEQ ID NO: 1285482 - RNA, 21 nt, Human
cuccccccaccccugcuccua

SEQ ID NO: 1285483 - RNA, 21 nt, Human
cuccuagaaggaccccacccc

SEQ ID NO: 1285484 - RNA, 24 nt, Human
cuccugccacugucccaaccucag

SEQ ID NO: 1285485 - RNA, 20 nt, Human
cugccaggcugaucucuugu

SEQ ID NO: 1285486 - RNA, 19 nt, Human
cugggugaaugguaucucc

SEQ ID NO: 1285487 - RNA, 23 nt, Human
cuucagggacuccacaucccucu

SEQ ID NO: 1285488 - RNA, 24 nt, Human
gaaaacacacagcucauguccucc

SEQ ID NO: 1285489 - RNA, 21 nt, Human
gaagcauguuggggucucuuc

SEQ ID NO: 1285490 - RNA, 28 nt, Human
gaaggaccccaccccccuccccccaccc

SEQ ID NO: 1285491 - RNA, 22 nt, Human
gaccccaccccccuccccccac

SEQ ID NO: 1285492 - RNA, 21 nt, Human
gagugcucgcuucaggagcac

SEQ ID NO: 1285493 - RNA, 24 nt, Human
gccugaagcauguuggggucucuu

SEQ ID NO: 1285494 - RNA, 23 nt, Human
ggaaaggguggaacuggaaacgc

SEQ ID NO: 1285495 - RNA, 20 nt, Human
ggaccuccagguuccgcccc

SEQ ID NO: 1285496 - RNA, 25 nt, Human
ggacuccuagaaggaccccaccccc

SEQ ID NO: 1285497 - RNA, 25 nt, Human
uaaaauagauaguauauauuagacg

SEQ ID NO: 1285498 - RNA, 23 nt, Human
uaacauacaaacaugccaaaaca

SEQ ID NO: 1285499 - RNA, 23 nt, Human
uaacugccaggcugaucucuugu

SEQ ID NO: 1285500 - RNA, 26 nt, Human
uaccaguauuuccaaaauauuuaaaa

SEQ ID NO: 1285501 - RNA, 18 nt, Human
uagaaggaccccaccccc

SEQ ID NO: 1285502 - RNA, 28 nt, Human
uagaaggaccccaccccccuccccccaa

SEQ ID NO: 1285503 - RNA, 21 nt, Human
uagagaacagcucugagaaga

SEQ ID NO: 1285504 - RNA, 23 nt, Human
uagauaaaaaccaugcucccuuc

SEQ ID NO: 1285505 - RNA, 22 nt, Human
uagaugaucugcacaaaugguu

SEQ ID NO: 1285506 - RNA, 24 nt, Human
uaggagaagucaggaguagagaac

SEQ ID NO: 1285507 - RNA, 24 nt, Human
uauaaaaagggugguggugccgca

SEQ ID NO: 1285508 - RNA, 18 nt, Human
uauauguauguguauaua

SEQ ID NO: 1285509 - RNA, 19 nt, Human
uauauguauguguauauaa

SEQ ID NO: 1285510 - RNA, 22 nt, Human
ucaaaaguacaacaauuuccaa

SEQ ID NO: 1285511 - RNA, 18 nt, Human
ucaauggccgacauuuuc

SEQ ID NO: 1285512 - RNA, 18 nt, Human
uccccccaccccugcucc

SEQ ID NO: 1285513 - RNA, 26 nt, Human
uccccuggguccgguguucuucucuc

SEQ ID NO: 1285514 - RNA, 18 nt, Human
ucccucuauucccugucc

SEQ ID NO: 1285515 - RNA, 21 nt, Human
uccugggugaaugguaucucc

SEQ ID NO: 1285516 - RNA, 25 nt, Human
ucucaggccgaugaccucaggccuc

SEQ ID NO: 1285517 - RNA, 26 nt, Human
ucuccaggcaccacggaguccggucc

SEQ ID NO: 1285518 - RNA, 21 nt, Human
ugaaaagaauccucucuuaaa

SEQ ID NO: 1285519 - RNA, 18 nt, Human
ugaccucaggccuccccg

SEQ ID NO: 1285520 - RNA, 18 nt, Human
ugagccccugcauugugc

SEQ ID NO: 1285521 - RNA, 22 nt, Human
ugaucugcacaaaugguuccuc

SEQ ID NO: 1285522 - RNA, 18 nt, Human
ugccaaaacaagguaaaa

SEQ ID NO: 1285523 - RNA, 23 nt, Human
uggaauaaaguuccugcugaaaa

SEQ ID NO: 1285524 - RNA, 21 nt, Human
uggacugcaaguccguaagaa

SEQ ID NO: 1285525 - RNA, 21 nt, Human
uguccaaaagcaucuucaggg

SEQ ID NO: 1285526 - RNA, 22 nt, Human
ugucccagcagaggcugugucc

SEQ ID NO: 1285527 - RNA, 19 nt, Human
uguccuggagauccugggu

SEQ ID NO: 1285528 - RNA, 19 nt, Human
ugucucugcugaggguggg

SEQ ID NO: 1285529 - RNA, 19 nt, Human
uguuggggucucuucgucu

SEQ ID NO: 1285530 - RNA, 19 nt, Human
uuacaagaauuuaggggaa

SEQ ID NO: 1285531 - RNA, 18 nt, Human
uucaaauauauaugaaau

SEQ ID NO: 1285532 - RNA, 23 nt, Human
uucauuuuuauuauguuucccca

SEQ ID NO: 1285533 - RNA, 19 nt, Human
aaacaucagccgcgcaauc

SEQ ID NO: 1285534 - RNA, 19 nt, Human
aaacuuacagugccuuuug

SEQ ID NO: 1285535 - RNA, 23 nt, Human
aaagccucccaaaacaguucacu

SEQ ID NO: 1285536 - RNA, 18 nt, Human
aaaguauauauucuucca

SEQ ID NO: 1285537 - RNA, 21 nt, Human
aaaucaguuuuaguccugcag

SEQ ID NO: 1285538 - RNA, 24 nt, Human
aacaucaucuuuacgaacuucagc

SEQ ID NO: 1285539 - RNA, 23 nt, Human
aagcacaaauuuugaaaaagccu

SEQ ID NO: 1285540 - RNA, 25 nt, Human
acagccagcaagaaaauggagaccu

SEQ ID NO: 1285541 - RNA, 22 nt, Human
agacgaaucuacugugauguua

SEQ ID NO: 1285542 - RNA, 24 nt, Human
agcagaagacagaaaugagggacc

SEQ ID NO: 1285543 - RNA, 21 nt, Human
agggacugaaaccaacuuugc

SEQ ID NO: 1285544 - RNA, 20 nt, Human
agugaaaacugaaugugaug

SEQ ID NO: 1285545 - RNA, 23 nt, Human
auagaaccuuuaugggauuucaa

SEQ ID NO: 1285546 - RNA, 22 nt, Human
augggauuucaauuccacuuuc

SEQ ID NO: 1285547 - RNA, 20 nt, Human
caagauacuagucccaugcu

SEQ ID NO: 1285548 - RNA, 18 nt, Human
cacugugccgccucaagu

SEQ ID NO: 1285549 - RNA, 20 nt, Human
cacuucagccacagggaggg

SEQ ID NO: 1285550 - RNA, 21 nt, Human
cacuuugccuccuuuuguuuc

SEQ ID NO: 1285551 - RNA, 22 nt, Human
cagcaagaaaauggagacccca

SEQ ID NO: 1285552 - RNA, 19 nt, Human
cagcagcagaagacagaaa

SEQ ID NO: 1285553 - RNA, 22 nt, Human
caucagccgcgcaauccccagg

SEQ ID NO: 1285554 - RNA, 18 nt, Human
ccacggccaaucgacuug

SEQ ID NO: 1285555 - RNA, 19 nt, Human
ccagacccugaugacuuga

SEQ ID NO: 1285556 - RNA, 22 nt, Human
ccaguuggcugacauaaacauc

SEQ ID NO: 1285557 - RNA, 18 nt, Human
ccauaaacuguucccaga

SEQ ID NO: 1285558 - RNA, 18 nt, Human
ccccaggggcaaguuggg

SEQ ID NO: 1285559 - RNA, 19 nt, Human
ccgccucaagucaaauagg

SEQ ID NO: 1285560 - RNA, 27 nt, Human
ccugcaguuuaucuauggucgguacuc

SEQ ID NO: 1285561 - RNA, 19 nt, Human
cuccagaugagaacucagc

SEQ ID NO: 1285562 - RNA, 21 nt, Human
cuccagaugagaacucagccu

SEQ ID NO: 1285563 - RNA, 19 nt, Human
cugugccgccucaagucaa

SEQ ID NO: 1285564 - RNA, 18 nt, Human
cuucugaguucacaucaa

SEQ ID NO: 1285565 - RNA, 18 nt, Human
cuugacaauaauagaacc

SEQ ID NO: 1285566 - RNA, 19 nt, Human
cuuuuacacagccagaccc

SEQ ID NO: 1285567 - RNA, 21 nt, Human
gacauaaacaucuauggcacc

SEQ ID NO: 1285568 - RNA, 21 nt, Human
gaccuugacaauaauagaacc

SEQ ID NO: 1285569 - RNA, 21 nt, Human
uaaaugagcuugaagugaaga

SEQ ID NO: 1285570 - RNA, 20 nt, Human
uaaguagaaaaccugucaug

SEQ ID NO: 1285571 - RNA, 21 nt, Human
uaaguagaaaaccugucaugu

SEQ ID NO: 1285572 - RNA, 23 nt, Human
uaauuuguuacagagcaguagaa

SEQ ID NO: 1285573 - RNA, 18 nt, Human
uacuagucccaugcucug

SEQ ID NO: 1285574 - RNA, 22 nt, Human
uagaaaaccugucaugugagag

SEQ ID NO: 1285575 - RNA, 21 nt, Human
uagaaaaugaauacaauagca

SEQ ID NO: 1285576 - RNA, 23 nt, Human
uagcaaagcacaaauuuugaaaa

SEQ ID NO: 1285577 - RNA, 24 nt, Human
uauuuguuuuuuauuuacagcuua

SEQ ID NO: 1285578 - RNA, 19 nt, Human
ucagaacacuucagccaca

SEQ ID NO: 1285579 - RNA, 21 nt, Human
ucccagagacuccagaugaga

SEQ ID NO: 1285580 - RNA, 27 nt, Human
ucccagagacuccagaugagaacucag

SEQ ID NO: 1285581 - RNA, 24 nt, Human
uccccagcagcagaagacagaaau

SEQ ID NO: 1285582 - RNA, 18 nt, Human
uccccaggggcaaguugg

SEQ ID NO: 1285583 - RNA, 21 nt, Human
ucccugauaacuguaaaugag

SEQ ID NO: 1285584 - RNA, 19 nt, Human
uccugggugggccugaccu

SEQ ID NO: 1285585 - RNA, 23 nt, Human
ucuauggucacagcacuuuuauc

SEQ ID NO: 1285586 - RNA, 22 nt, Human
ucuccuuuccuugagugggagu

SEQ ID NO: 1285587 - RNA, 19 nt, Human
ugaaaaagccucccaaaac

SEQ ID NO: 1285588 - RNA, 23 nt, Human
ugaaaccaacuuugccuucuaaa

SEQ ID NO: 1285589 - RNA, 23 nt, Human
ugaauacaauagcaaagcacaaa

SEQ ID NO: 1285590 - RNA, 23 nt, Human
ugacauaaacaucuauggcaccc

SEQ ID NO: 1285591 - RNA, 21 nt, Human
ugagaacucagccuggccaaa

SEQ ID NO: 1285592 - RNA, 18 nt, Human
ugagaagaacucagcgca

SEQ ID NO: 1285593 - RNA, 18 nt, Human
ugagaagaacucagcgca

SEQ ID NO: 1285594 - RNA, 20 nt, Human
ugagaaggcauguggguggc

SEQ ID NO: 1285595 - RNA, 21 nt, Human
ugagaaggcauguggguggcc

SEQ ID NO: 1285596 - RNA, 20 nt, Human
ugcaguuucagggacugaaa

SEQ ID NO: 1285597 - RNA, 24 nt, Human
ugccauaaaagguacuaaguagaa

SEQ ID NO: 1285598 - RNA, 21 nt, Human
ugcucuguuucaauuuugcaa

SEQ ID NO: 1285599 - RNA, 19 nt, Human
ugcuugauucaugagucca

SEQ ID NO: 1285600 - RNA, 20 nt, Human
uggaaguagauuucuuccca

SEQ ID NO: 1285601 - RNA, 26 nt, Human
uggaaguagauuucuucccagagaag

SEQ ID NO: 1285602 - RNA, 18 nt, Human
uggacuucugaguucaca

SEQ ID NO: 1285603 - RNA, 25 nt, Human
uggcugacauaaacaucuauggcac

SEQ ID NO: 1285604 - RNA, 22 nt, Human
uggcugcagaagaagucagaua

SEQ ID NO: 1285605 - RNA, 23 nt, Human
uggcugcagaagaagucagauau

SEQ ID NO: 1285606 - RNA, 20 nt, Human
ugggagugaaaacugaaugu

SEQ ID NO: 1285607 - RNA, 23 nt, Human
ugggagugaaaacugaaugugau

SEQ ID NO: 1285608 - RNA, 19 nt, Human
uguuacagagcaguagaaa

SEQ ID NO: 1285609 - RNA, 19 nt, Human
uuacagagcaguagaaaaa

SEQ ID NO: 1285610 - RNA, 20 nt, Human
uuccugaacauggacuucug

SEQ ID NO: 1285611 - RNA, 22 nt, Human
uuguuugaacaugcaauuuuug

SEQ ID NO: 1285612 - RNA, 23 nt, Human
aaaaagaaaaaugaaucuucaau

SEQ ID NO: 1285613 - RNA, 22 nt, Human
aacuccuggguucaagugaccc

SEQ ID NO: 1285614 - RNA, 19 nt, Human
accauguugcccagguuga

SEQ ID NO: 1285615 - RNA, 22 nt, Human
agaguccuuuuacaccagugcu

SEQ ID NO: 1285616 - RNA, 19 nt, Human
agugacccacccaccuugg

SEQ ID NO: 1285617 - RNA, 23 nt, Human
caagugacccacccaccuuggcc

SEQ ID NO: 1285618 - RNA, 18 nt, Human
caccauguugcccagguu

SEQ ID NO: 1285619 - RNA, 24 nt, Human
caccauguugcccagguugauguc

SEQ ID NO: 1285620 - RNA, 22 nt, Human
cacccaccuuggccucccaaag

SEQ ID NO: 1285621 - RNA, 23 nt, Human
cacccaccuuggccucccaaagu

SEQ ID NO: 1285622 - RNA, 23 nt, Human
cauguugcccagguugaugucaa

SEQ ID NO: 1285623 - RNA, 24 nt, Human
cauguugcccagguugaugucaaa

SEQ ID NO: 1285624 - RNA, 18 nt, Human
ccuggguucaagugaccc

SEQ ID NO: 1285625 - RNA, 24 nt, Human
ccuggguucaagugacccacccac

SEQ ID NO: 1285626 - RNA, 18 nt, Human
guccugaagaauggaaaa

SEQ ID NO: 1285627 - RNA, 24 nt, Human
gugacccacccaccuuggccuccc

SEQ ID NO: 1285628 - RNA, 24 nt, Human
ugacccacccaccuuggccuccca

SEQ ID NO: 1285629 - RNA, 24 nt, Human
uucaagugacccacccaccuuggc

SEQ ID NO: 1285630 - RNA, 20 nt, Human
aaaggucaucugaagcuccc

SEQ ID NO: 1285631 - RNA, 24 nt, Human
aaaguguggguauuauaggcauga

SEQ ID NO: 1285632 - RNA, 20 nt, Human
aaaucccagacagcuacucu

SEQ ID NO: 1285633 - RNA, 21 nt, Human
aacaaaaauucuauacccaaa

SEQ ID NO: 1285634 - RNA, 21 nt, Human
aaccugguaauuugcagggaa

SEQ ID NO: 1285635 - RNA, 19 nt, Human
aagaaggccaaguagaauc

SEQ ID NO: 1285636 - RNA, 24 nt, Human
aagcaauccaccugccucagccuc

SEQ ID NO: 1285637 - RNA, 18 nt, Human
aaggaaaggagacacagu

SEQ ID NO: 1285638 - RNA, 22 nt, Human
aauuccaaaccaccccaggcuc

SEQ ID NO: 1285639 - RNA, 26 nt, Human
acagagcacagcaggcgggagaaaac

SEQ ID NO: 1285640 - RNA, 27 nt, Human
acagucauaguacuuacuucauucacc

SEQ ID NO: 1285641 - RNA, 19 nt, Human
accauagaagacacaaggg

SEQ ID NO: 1285642 - RNA, 24 nt, Human
accuucaugaccuuguucaugcca

SEQ ID NO: 1285643 - RNA, 23 nt, Human
acuucauucaccaaugaaaaaua

SEQ ID NO: 1285644 - RNA, 18 nt, Human
agaaagucaagcagauga

SEQ ID NO: 1285645 - RNA, 21 nt, Human
agaaagucaagcagaugaaag

SEQ ID NO: 1285646 - RNA, 19 nt, Human
agaagaaggccaaguagaa

SEQ ID NO: 1285647 - RNA, 24 nt, Human
agaauaaaaacauauagggaagga

SEQ ID NO: 1285648 - RNA, 21 nt, Human
agcaauccaccugccucagcc

SEQ ID NO: 1285649 - RNA, 22 nt, Human
agcacagcaggcgggagaaaac

SEQ ID NO: 1285650 - RNA, 21 nt, Human
aggcagcuucagagaugcagg

SEQ ID NO: 1285651 - RNA, 19 nt, Human
aggcaugagcuacugcacc

SEQ ID NO: 1285652 - RNA, 19 nt, Human
aggccauaggaggcaggga

SEQ ID NO: 1285653 - RNA, 20 nt, Human
aggguuaaaagccaagcacu

SEQ ID NO: 1285654 - RNA, 19 nt, Human
aucaucuuaaguaaaacua

SEQ ID NO: 1285655 - RNA, 23 nt, Human
auccacuuuaucuccucagaccu

SEQ ID NO: 1285656 - RNA, 20 nt, Human
auguugccccggcuggucuc

SEQ ID NO: 1285657 - RNA, 18 nt, Human
auuauaggcaugagcuac

SEQ ID NO: 1285658 - RNA, 22 nt, Human
auuauaggcaugagcuacugca

SEQ ID NO: 1285659 - RNA, 25 nt, Human
caaaauagaacuacuauaacuaaua

SEQ ID NO: 1285660 - RNA, 20 nt, Human
cacagcaggcgggagaaaac

SEQ ID NO: 1285661 - RNA, 22 nt, Human
cacagcuuugguagccuuaucc

SEQ ID NO: 1285662 - RNA, 23 nt, Human
caccugccucagccucccaaagu

SEQ ID NO: 1285663 - RNA, 19 nt, Human
cacuagaaauaaaguuaug

SEQ ID NO: 1285664 - RNA, 21 nt, Human
cacuccaggccaugccuucac

SEQ ID NO: 1285665 - RNA, 22 nt, Human
cagaauagaagaaggccaagua

SEQ ID NO: 1285666 - RNA, 23 nt, Human
cagagaugcaggcuccgcaacuc

SEQ ID NO: 1285667 - RNA, 26 nt, Human
cagcaggcgggagaaaaccgccuccc

SEQ ID NO: 1285668 - RNA, 22 nt, Human
cagcuacucucccaaagagaaa

SEQ ID NO: 1285669 - RNA, 21 nt, Human
cagcugaaauauucaccuccu

SEQ ID NO: 1285670 - RNA, 22 nt, Human
cagggaagauaggaucucaaau

SEQ ID NO: 1285671 - RNA, 19 nt, Human
caucuccagcucuuccugu

SEQ ID NO: 1285672 - RNA, 24 nt, Human
ccaaaguguggguauuauaggcau

SEQ ID NO: 1285673 - RNA, 21 nt, Human
ccaagcacuccaggccaugcc

SEQ ID NO: 1285674 - RNA, 19 nt, Human
ccaccugccucagccuccc

SEQ ID NO: 1285675 - RNA, 21 nt, Human
ccacugcugaacgaccaccug

SEQ ID NO: 1285676 - RNA, 19 nt, Human
ccagagcagguaauacacu

SEQ ID NO: 1285677 - RNA, 25 nt, Human
cccaccacacacagagcacaaugaa

SEQ ID NO: 1285678 - RNA, 23 nt, Human
cccagacagcuacucucccaaag

SEQ ID NO: 1285679 - RNA, 23 nt, Human
ccccaggcucagcaguguggauu

SEQ ID NO: 1285680 - RNA, 25 nt, Human
ccgcccagagaccguggaggaggca

SEQ ID NO: 1285681 - RNA, 24 nt, Human
ccucccgcgagguccaacagaaac

SEQ ID NO: 1285682 - RNA, 20 nt, Human
ccuguaccucuaaagcacuc

SEQ ID NO: 1285683 - RNA, 22 nt, Human
cuaaagucaacuuuucaagguc

SEQ ID NO: 1285684 - RNA, 18 nt, Human
cuacugcaccuagccaug

SEQ ID NO: 1285685 - RNA, 21 nt, Human
cuccaggccaugccuucaccg

SEQ ID NO: 1285686 - RNA, 21 nt, Human
cuccgagaugagggagggcuc

SEQ ID NO: 1285687 - RNA, 20 nt, Human
cuccucagcucaagcaaucc

SEQ ID NO: 1285688 - RNA, 23 nt, Human
cucugugaagccaucuccagcuc

SEQ ID NO: 1285689 - RNA, 22 nt, Human
cugaaaauaugcuccaccaaaa

SEQ ID NO: 1285690 - RNA, 24 nt, Human
cugaagcucccuuucacagcuuug

SEQ ID NO: 1285691 - RNA, 22 nt, Human
cuggugccaaagagaggauucu

SEQ ID NO: 1285692 - RNA, 18 nt, Human
cuuuccauguacccuuuc

SEQ ID NO: 1285693 - RNA, 21 nt, Human
gaaaucaacuuaacccaaaac

SEQ ID NO: 1285694 - RNA, 23 nt, Human
gaacuccucagcucaagcaaucc

SEQ ID NO: 1285695 - RNA, 19 nt, Human
gaagaaauguauuccuauc

SEQ ID NO: 1285696 - RNA, 21 nt, Human
gaagacacaagggagcccagg

SEQ ID NO: 1285697 - RNA, 22 nt, Human
gaaucaucuuaaguaaaacuag

SEQ ID NO: 1285698 - RNA, 20 nt, Human
gacauuucagacaagcaaga

SEQ ID NO: 1285699 - RNA, 25 nt, Human
gagaaaacaaagggccuguucaaag

SEQ ID NO: 1285700 - RNA, 25 nt, Human
gagagaaaacuguuucuaaacaaaa

SEQ ID NO: 1285701 - RNA, 18 nt, Human
gcaauccaccugccucag

SEQ ID NO: 1285702 - RNA, 24 nt, Human
gcaauccaccugccucagccuccc

SEQ ID NO: 1285703 - RNA, 21 nt, Human
gcagaaaacaagggugaccau

SEQ ID NO: 1285704 - RNA, 18 nt, Human
gcagcagagaggucacag

SEQ ID NO: 1285705 - RNA, 24 nt, Human
gccaugccuucacccucaugaucc

SEQ ID NO: 1285706 - RNA, 21 nt, Human
gccuucacccucaugauccau

SEQ ID NO: 1285707 - RNA, 20 nt, Human
gcuauguugccccggcuggu

SEQ ID NO: 1285708 - RNA, 24 nt, Human
gcuauguugccccggcuggucucg

SEQ ID NO: 1285709 - RNA, 24 nt, Human
gcucaagcaauccaccugccucag

SEQ ID NO: 1285710 - RNA, 22 nt, Human
ggaaggcaucagcucagacuac

SEQ ID NO: 1285711 - RNA, 19 nt, Human
ggaggaggcagcagagagg

SEQ ID NO: 1285712 - RNA, 24 nt, Human
ggguauuauaggcaugagcuacug

SEQ ID NO: 1285713 - RNA, 23 nt, Human
gguagagauggcauuuugcuaug

SEQ ID NO: 1285714 - RNA, 20 nt, Human
uaaaccaugaaaucaacuua

SEQ ID NO: 1285715 - RNA, 21 nt, Human
uaaauuacagagaauugaucc

SEQ ID NO: 1285716 - RNA, 24 nt, Human
uacacacguaccaggcuacuaccu

SEQ ID NO: 1285717 - RNA, 19 nt, Human
uacacagaaagucaagcag

SEQ ID NO: 1285718 - RNA, 23 nt, Human
uaccuggaaaaucacugucaaaa

SEQ ID NO: 1285719 - RNA, 22 nt, Human
uagaagacacaagggagcccag

SEQ ID NO: 1285720 - RNA, 22 nt, Human
uagagauggcauuuugcuaugu

SEQ ID NO: 1285721 - RNA, 18 nt, Human
uaggaaccuaaagucaac

SEQ ID NO: 1285722 - RNA, 22 nt, Human
uauaacuaauagucauuuuaga

SEQ ID NO: 1285723 - RNA, 21 nt, Human
uauguugccccggcuggucuc

SEQ ID NO: 1285724 - RNA, 24 nt, Human
uauguugccccggcuggucucgaa

SEQ ID NO: 1285725 - RNA, 18 nt, Human
uauucuacacacguacca

SEQ ID NO: 1285726 - RNA, 22 nt, Human
ucagacuacagcccacugcuga

SEQ ID NO: 1285727 - RNA, 22 nt, Human
uccaaaauagaacuacuauaac

SEQ ID NO: 1285728 - RNA, 24 nt, Human
ucccaaaguguggguauuauaggc

SEQ ID NO: 1285729 - RNA, 19 nt, Human
ucccagacagcuacucucc

SEQ ID NO: 1285730 - RNA, 21 nt, Human
uccuagaacugaaggaaaugg

SEQ ID NO: 1285731 - RNA, 20 nt, Human
uccucagcucaagcaaucca

SEQ ID NO: 1285732 - RNA, 23 nt, Human
ucguggcaauuuucagaacacug

SEQ ID NO: 1285733 - RNA, 24 nt, Human
ucuaaagcacucuguuccuaccuc

SEQ ID NO: 1285734 - RNA, 21 nt, Human
ucucaaaucccagacagcuac

SEQ ID NO: 1285735 - RNA, 23 nt, Human
ucucgaacuccucagcucaagca

SEQ ID NO: 1285736 - RNA, 21 nt, Human
ugaaaauaugcuccaccaaaa

SEQ ID NO: 1285737 - RNA, 18 nt, Human
ugaaauauucaccuccuc

SEQ ID NO: 1285738 - RNA, 24 nt, Human
ugaaaucaacuuaacccaaaacug

SEQ ID NO: 1285739 - RNA, 19 nt, Human
ugaagccaucuccagcucu

SEQ ID NO: 1285740 - RNA, 23 nt, Human
ugaagccaucuccagcucuuccu

SEQ ID NO: 1285741 - RNA, 20 nt, Human
ugacacagaaagaggaacaa

SEQ ID NO: 1285742 - RNA, 24 nt, Human
ugccccggcuggucucgaacuccu

SEQ ID NO: 1285743 - RNA, 23 nt, Human
ugccucagccucccaaagugugg

SEQ ID NO: 1285744 - RNA, 19 nt, Human
ugccuucacccucaugauc

SEQ ID NO: 1285745 - RNA, 25 nt, Human
ugcuccaccaaaaugagaaaaugac

SEQ ID NO: 1285746 - RNA, 20 nt, Human
ugcugaacgaccaccugaga

SEQ ID NO: 1285747 - RNA, 21 nt, Human
uggaggaggcagcagagaggu

SEQ ID NO: 1285748 - RNA, 23 nt, Human
uggauuuucagacugaaagggcc

SEQ ID NO: 1285749 - RNA, 18 nt, Human
uggcauuuugcuauguug

SEQ ID NO: 1285750 - RNA, 26 nt, Human
uuacaccuauccacuuuaucuccuca

SEQ ID NO: 1285751 - RNA, 18 nt, Human
uucacagcuuugguagcc

SEQ ID NO: 1285752 - RNA, 19 nt, Human
uuccuagaacugaaggaaa

SEQ ID NO: 1285753 - RNA, 21 nt, Human
uuucaaggucuggaaagguca

SEQ ID NO: 1285754 - RNA, 21 nt, Human
uuucaaggucuggaaagguca

SEQ ID NO: 1285755 - RNA, 20 nt, Human
uuuccuagaacugaaggaaa

SEQ ID NO: 1285756 - RNA, 19 nt, Human
uuuugcuauguugccccgg

SEQ ID NO: 1285757 - RNA, 23 nt, Human
uuuugcuauguugccccggcugg

SEQ ID NO: 1285758 - RNA, 22 nt, Human
auucacuguacauuucuaaacu

SEQ ID NO: 1285759 - RNA, 23 nt, Human
ugacugacagaacucuaauacag

SEQ ID NO: 1285760 - RNA, 20 nt, Human
acucgccuggcagccucaac

SEQ ID NO: 1285761 - RNA, 24 nt, Human
cagaaaggccugacucgccuggca

SEQ ID NO: 1285762 - RNA, 21 nt, Human
caggcgagguccagaaaggcc

SEQ ID NO: 1285763 - RNA, 20 nt, Human
ccagaaaggccugacucgcc

SEQ ID NO: 1285764 - RNA, 24 nt, Human
ccugacucgccuggcagccucaac

SEQ ID NO: 1285765 - RNA, 23 nt, Human
cugggucaauuucaggcacagcc

SEQ ID NO: 1285766 - RNA, 20 nt, Human
gcaucuauuuuguaaaugcu

SEQ ID NO: 1285767 - RNA, 19 nt, Human
ugacucgccuggcagccuc

SEQ ID NO: 1285768 - RNA, 22 nt, Human
uggcagccucaacggacuuguc

SEQ ID NO: 1285769 - RNA, 23 nt, Human
aaagaucagaugguuguagacaa

SEQ ID NO: 1285770 - RNA, 23 nt, Human
aaagguaccugauuggaccaaaa

SEQ ID NO: 1285771 - RNA, 24 nt, Human
accaaaacaaugacauggugacuc

SEQ ID NO: 1285772 - RNA, 24 nt, Human
auaggauggguauucauccucuuu

SEQ ID NO: 1285773 - RNA, 24 nt, Human
augacauggugacucuuccuugga

SEQ ID NO: 1285774 - RNA, 21 nt, Human
auggcugcauaguauuccaug

SEQ ID NO: 1285775 - RNA, 21 nt, Human
augguauuucuaguucuagau

SEQ ID NO: 1285776 - RNA, 21 nt, Human
augguuguagacaaguggcau

SEQ ID NO: 1285777 - RNA, 22 nt, Human
cacaacaguccccggaguguga

SEQ ID NO: 1285778 - RNA, 19 nt, Human
cacugugugaccacauuca

SEQ ID NO: 1285779 - RNA, 21 nt, Human
cagcuuuguucuuuuggcuua

SEQ ID NO: 1285780 - RNA, 19 nt, Human
caugucccuacaaaggaca

SEQ ID NO: 1285781 - RNA, 18 nt, Human
ccacauuuucuuaaucca

SEQ ID NO: 1285782 - RNA, 21 nt, Human
cccaguaaugggauggcuggg

SEQ ID NO: 1285783 - RNA, 18 nt, Human
cccccaucccccuacccc

SEQ ID NO: 1285784 - RNA, 19 nt, Human
ccccuaccccacaacaguc

SEQ ID NO: 1285785 - RNA, 18 nt, Human
ccuuuuaaaagggauugc

SEQ ID NO: 1285786 - RNA, 24 nt, Human
cuaugagugagaacaugugguguu

SEQ ID NO: 1285787 - RNA, 19 nt, Human
cucccccaucccccuaccc

SEQ ID NO: 1285788 - RNA, 23 nt, Human
cuccuaaugcuaucccuccccca

SEQ ID NO: 1285789 - RNA, 24 nt, Human
cugcacccauuaacuugucauuua

SEQ ID NO: 1285790 - RNA, 21 nt, Human
gacauggugacucuuccuugg

SEQ ID NO: 1285791 - RNA, 20 nt, Human
gcauaauaugauacugaaau

SEQ ID NO: 1285792 - RNA, 19 nt, Human
gcgugugucuucauagcag

SEQ ID NO: 1285793 - RNA, 21 nt, Human
ggaauccucuccccauugcuu

SEQ ID NO: 1285794 - RNA, 21 nt, Human
ggacaugaacucaucauuuuu

SEQ ID NO: 1285795 - RNA, 18 nt, Human
gguuacuguagccuugua

SEQ ID NO: 1285796 - RNA, 20 nt, Human
guaguauaguuugaagucag

SEQ ID NO: 1285797 - RNA, 21 nt, Human
uaccccacaacaguccccgga

SEQ ID NO: 1285798 - RNA, 19 nt, Human
uacuuacauauguauacau

SEQ ID NO: 1285799 - RNA, 19 nt, Human
uagaaagaauaaaaaauua

SEQ ID NO: 1285800 - RNA, 19 nt, Human
uagcagcaugauuuauaau

SEQ ID NO: 1285801 - RNA, 24 nt, Human
uagggaauccucuccccauugcuu

SEQ ID NO: 1285802 - RNA, 20 nt, Human
uauaugugccacauuuucuu

SEQ ID NO: 1285803 - RNA, 21 nt, Human
uaucaugguuggacauuuggg

SEQ ID NO: 1285804 - RNA, 24 nt, Human
uauugugaauagugccacgauaaa

SEQ ID NO: 1285805 - RNA, 21 nt, Human
ucccccaucccccuaccccac

SEQ ID NO: 1285806 - RNA, 23 nt, Human
ucccccaucccccuaccccacaa

SEQ ID NO: 1285807 - RNA, 20 nt, Human
ucccuacaaaggacaugaac

SEQ ID NO: 1285808 - RNA, 25 nt, Human
uccuaaugcuaucccucccccaucc

SEQ ID NO: 1285809 - RNA, 22 nt, Human
uccuuggaaaaggacuagaaag

SEQ ID NO: 1285810 - RNA, 23 nt, Human
ucuccuaaugcuaucccuccccc

SEQ ID NO: 1285811 - RNA, 23 nt, Human
ucuuugcuauugugaauagugcc

SEQ ID NO: 1285812 - RNA, 22 nt, Human
ugaagucaggcagcgugaugcc

SEQ ID NO: 1285813 - RNA, 20 nt, Human
ugacauggugacucuuccuu

SEQ ID NO: 1285814 - RNA, 23 nt, Human
ugacauggugacucuuccuugga

SEQ ID NO: 1285815 - RNA, 20 nt, Human
ugagaacaugugguguuugg

SEQ ID NO: 1285816 - RNA, 19 nt, Human
ugagugagaacauguggug

SEQ ID NO: 1285817 - RNA, 24 nt, Human
ugagugagaacaugugguguuugg

SEQ ID NO: 1285818 - RNA, 19 nt, Human
ugccauguuggugugcugc

SEQ ID NO: 1285819 - RNA, 26 nt, Human
ugccuccagcuuuguucuuuuggcuu

SEQ ID NO: 1285820 - RNA, 21 nt, Human
ugccugggacaguccuggucg

SEQ ID NO: 1285821 - RNA, 19 nt, Human
uggcuagccaguuuuccca

SEQ ID NO: 1285822 - RNA, 25 nt, Human
ugguaccaguaccaugcuguuuugg

SEQ ID NO: 1285823 - RNA, 19 nt, Human
uguaaggaagggauccagu

SEQ ID NO: 1285824 - RNA, 22 nt, Human
uguaaggaagggauccaguuuc

SEQ ID NO: 1285825 - RNA, 21 nt, Human
ugucaaagaucagaugguugu

SEQ ID NO: 1285826 - RNA, 25 nt, Human
ugugcaaauuacuuacauauguaua

SEQ ID NO: 1285827 - RNA, 20 nt, Human
uguucuguuccauuaaucua

SEQ ID NO: 1285828 - RNA, 23 nt, Human
uuaaauagggaauccucucccca

SEQ ID NO: 1285829 - RNA, 20 nt, Human
uuccaugguguauaugugcc

SEQ ID NO: 1285830 - RNA, 26 nt, Human
uuccaugguguauaugugccacauuu

SEQ ID NO: 1285831 - RNA, 22 nt, Human
uuggaaaaggacuagaaagaau

SEQ ID NO: 1285832 - RNA, 20 nt, Human
uuggaccaaaacaaugacau

SEQ ID NO: 1285833 - RNA, 19 nt, Human
uuuccaguuucauccaugu

SEQ ID NO: 1285834 - RNA, 22 nt, Human
uuuccaguuucauccauguccc

SEQ ID NO: 1285835 - RNA, 18 nt, Human
uuucuaguucuagauccc

SEQ ID NO: 1285836 - RNA, 19 nt, Human
uuucuaguucuagaucccu

SEQ ID NO: 1285837 - RNA, 20 nt, Human
uuugguaccaguaccaugcu

SEQ ID NO: 1285838 - RNA, 22 nt, Human
uuuuauggcugcauaguauucc

SEQ ID NO: 1285839 - RNA, 22 nt, Human
aaaacucaaaaguuagggcccc

SEQ ID NO: 1285840 - RNA, 21 nt, Human
auugaguguucuggaggacuu

SEQ ID NO: 1285841 - RNA, 24 nt, Human
caaaacucaaaaguuagggccccc

SEQ ID NO: 1285842 - RNA, 23 nt, Human
cagaggccaucgcuaggcugggc

SEQ ID NO: 1285843 - RNA, 25 nt, Human
cagcucuccccuccccuggucaccc

SEQ ID NO: 1285844 - RNA, 26 nt, Human
cagugggccacacacugggcugugcu

SEQ ID NO: 1285845 - RNA, 19 nt, Human
ccagugggccacacacugg

SEQ ID NO: 1285846 - RNA, 22 nt, Human
ccagugggccacacacugggcu

SEQ ID NO: 1285847 - RNA, 18 nt, Human
ccccagugggccacacac

SEQ ID NO: 1285848 - RNA, 20 nt, Human
ccccggacccccggguuccc

SEQ ID NO: 1285849 - RNA, 19 nt, Human
ccggacccccggguucccc

SEQ ID NO: 1285850 - RNA, 19 nt, Human
ccugcagaggccaucgcua

SEQ ID NO: 1285851 - RNA, 22 nt, Human
ccuuggggcagcaccccagugg

SEQ ID NO: 1285852 - RNA, 19 nt, Human
cgaccgagacaaguugcag

SEQ ID NO: 1285853 - RNA, 22 nt, Human
cgacuccuuaagcagcucuccc

SEQ ID NO: 1285854 - RNA, 25 nt, Human
cucaaaaguuagggcccccggaccc

SEQ ID NO: 1285855 - RNA, 19 nt, Human
gacccucuuucagggggag

SEQ ID NO: 1285856 - RNA, 21 nt, Human
gcaaaacucaaaaguuagggc

SEQ ID NO: 1285857 - RNA, 19 nt, Human
gcagaggccaucgcuaggc

SEQ ID NO: 1285858 - RNA, 20 nt, Human
gccacacacugggcugugcu

SEQ ID NO: 1285859 - RNA, 19 nt, Human
gcuaggcugggcagauggc

SEQ ID NO: 1285860 - RNA, 21 nt, Human
ggagacucucuccugacccuc

SEQ ID NO: 1285861 - RNA, 25 nt, Human
ggggagaaaaugucuggcugcagga

SEQ ID NO: 1285862 - RNA, 20 nt, Human
ggggcgugcaaaacucaaaa

SEQ ID NO: 1285863 - RNA, 20 nt, Human
ucuggaggacuuuggaccau

SEQ ID NO: 1285864 - RNA, 18 nt, Human
uguaagucucggggagac

SEQ ID NO: 1285865 - RNA, 21 nt, Human
uucuggaggacuuuggaccau

SEQ ID NO: 1285866 - RNA, 23 nt, Human
aaacaaaagaaggugccuacuga

SEQ ID NO: 1285867 - RNA, 19 nt, Human
aaacacaacaauuccacac

SEQ ID NO: 1285868 - RNA, 21 nt, Human
aaacaucccauguuugacccu

SEQ ID NO: 1285869 - RNA, 19 nt, Human
aaagugcuggcauuacagg

SEQ ID NO: 1285870 - RNA, 24 nt, Human
aaagugcuggcauuacaggcauga

SEQ ID NO: 1285871 - RNA, 19 nt, Human
aaccuccaccucucagguu

SEQ ID NO: 1285872 - RNA, 19 nt, Human
aacuaugugaucaaacccc

SEQ ID NO: 1285873 - RNA, 22 nt, Human
aagaaaaaacaaaagaaggugc

SEQ ID NO: 1285874 - RNA, 24 nt, Human
aagaaggugccuacugaguuuucu

SEQ ID NO: 1285875 - RNA, 23 nt, Human
aagcacagguaguucugaaaucu

SEQ ID NO: 1285876 - RNA, 22 nt, Human
aaguagcugggauuacaugugc

SEQ ID NO: 1285877 - RNA, 21 nt, Human
acaacaauuccacaccccaaa

SEQ ID NO: 1285878 - RNA, 22 nt, Human
acaagaaaaaacaaaagaaggu

SEQ ID NO: 1285879 - RNA, 21 nt, Human
acaccaagcuaauuuuuguau

SEQ ID NO: 1285880 - RNA, 23 nt, Human
acaccaugcccacaccaucccca

SEQ ID NO: 1285881 - RNA, 27 nt, Human
acaccaugcccacaccauccccauaga

SEQ ID NO: 1285882 - RNA, 19 nt, Human
acaggguuuugccaucuag

SEQ ID NO: 1285883 - RNA, 24 nt, Human
acaggguuuugccaucuaggccag

SEQ ID NO: 1285884 - RNA, 19 nt, Human
acagucuugcuuaucagaa

SEQ ID NO: 1285885 - RNA, 18 nt, Human
accacaagaaaaaacaaa

SEQ ID NO: 1285886 - RNA, 18 nt, Human
accuuggcaaagugcugg

SEQ ID NO: 1285887 - RNA, 20 nt, Human
acucagcucaucuucuuccc

SEQ ID NO: 1285888 - RNA, 24 nt, Human
agaccagcauccucagcccacgcu

SEQ ID NO: 1285889 - RNA, 25 nt, Human
aggaaaauaagguggaaaccagagg

SEQ ID NO: 1285890 - RNA, 22 nt, Human
aggcagcaucucagugauugac

SEQ ID NO: 1285891 - RNA, 22 nt, Human
aguagagacaggguuuugccau

SEQ ID NO: 1285892 - RNA, 19 nt, Human
agugcaguggcacaaucuc

SEQ ID NO: 1285893 - RNA, 21 nt, Human
augaaaccagacauaaccaug

SEQ ID NO: 1285894 - RNA, 24 nt, Human
auggcauauuuauaacugaagaaa

SEQ ID NO: 1285895 - RNA, 21 nt, Human
augucugaauccccucagccc

SEQ ID NO: 1285896 - RNA, 25 nt, Human
auuuuuguauuuuuuaguagagaca

SEQ ID NO: 1285897 - RNA, 24 nt, Human
caaagugcuggcauuacaggcaug

SEQ ID NO: 1285898 - RNA, 19 nt, Human
caacuaugugaucaaaccc

SEQ ID NO: 1285899 - RNA, 18 nt, Human
cacaagaaaaaacaaaag

SEQ ID NO: 1285900 - RNA, 24 nt, Human
cacaagaaaaaacaaaagaaggug

SEQ ID NO: 1285901 - RNA, 24 nt, Human
cacaagaaaaaacaaaagaaggug

SEQ ID NO: 1285902 - RNA, 24 nt, Human
caccacaccaagcuaauuuuugua

SEQ ID NO: 1285903 - RNA, 20 nt, Human
cacgaugguuccuggacuca

SEQ ID NO: 1285904 - RNA, 21 nt, Human
cagaagcacagguaguucuga

SEQ ID NO: 1285905 - RNA, 24 nt, Human
caggguuuugccaucuaggccagg

SEQ ID NO: 1285906 - RNA, 21 nt, Human
caguucucccuaccucagccu

SEQ ID NO: 1285907 - RNA, 24 nt, Human
cauuacaggcaugagccaucaugc

SEQ ID NO: 1285908 - RNA, 18 nt, Human
ccacaccaagcuaauuuu

SEQ ID NO: 1285909 - RNA, 24 nt, Human
ccacauuuuccccccuacaccaug

SEQ ID NO: 1285910 - RNA, 21 nt, Human
ccacucagcucaucuucuucc

SEQ ID NO: 1285911 - RNA, 21 nt, Human
ccagaccagcauccucagccc

SEQ ID NO: 1285912 - RNA, 24 nt, Human
ccagaccagcauccucagcccacg

SEQ ID NO: 1285913 - RNA, 20 nt, Human
ccauagaauuuagggugagg

SEQ ID NO: 1285914 - RNA, 21 nt, Human
cccaaguagcugggauuacau

SEQ ID NO: 1285915 - RNA, 24 nt, Human
cccagaccagcauccucagcccac

SEQ ID NO: 1285916 - RNA, 23 nt, Human
cccauagaauuuagggugaggca

SEQ ID NO: 1285917 - RNA, 21 nt, Human
ccccaaaguuaacagucuugc

SEQ ID NO: 1285918 - RNA, 25 nt, Human
ccccagcagugacucugcguggggc

SEQ ID NO: 1285919 - RNA, 18 nt, Human
ccccccuacaccaugccc

SEQ ID NO: 1285920 - RNA, 21 nt, Human
ccccuacaccaugcccacacc

SEQ ID NO: 1285921 - RNA, 24 nt, Human
cccuaccucagccucccaaguagc

SEQ ID NO: 1285922 - RNA, 20 nt, Human
cccuccuuagaccccguuua

SEQ ID NO: 1285923 - RNA, 19 nt, Human
ccuacaccaugcccacacc

SEQ ID NO: 1285924 - RNA, 20 nt, Human
ccuacugaguuuucuucuuu

SEQ ID NO: 1285925 - RNA, 24 nt, Human
ccugaccuuaggugaucugcccac

SEQ ID NO: 1285926 - RNA, 22 nt, Human
cggacaccacaagaaaaaacaa

SEQ ID NO: 1285927 - RNA, 30 nt, Human
cggacaccacaagaaaaaacaaaagaaggg

SEQ ID NO: 1285928 - RNA, 22 nt, Human
cguggaugaaucucacaugcag

SEQ ID NO: 1285929 - RNA, 19 nt, Human
cucacuguaaccuccaccu

SEQ ID NO: 1285930 - RNA, 24 nt, Human
cucacuguaaccuccaccucucag

SEQ ID NO: 1285931 - RNA, 23 nt, Human
cucagccucccaaguagcuggga

SEQ ID NO: 1285932 - RNA, 19 nt, Human
cucagugaccccaucccuu

SEQ ID NO: 1285933 - RNA, 26 nt, Human
cucccuaccucagccucccaaguagc

SEQ ID NO: 1285934 - RNA, 21 nt, Human
cugcccaccuuggcaaagugc

SEQ ID NO: 1285935 - RNA, 24 nt, Human
cuuaggugaucugcccaccuuggc

SEQ ID NO: 1285936 - RNA, 19 nt, Human
cuucucagugaccccaucc

SEQ ID NO: 1285937 - RNA, 24 nt, Human
gaaacacaacaauuccacacccca

SEQ ID NO: 1285938 - RNA, 22 nt, Human
gaagaaacacaacaauuccaca

SEQ ID NO: 1285939 - RNA, 19 nt, Human
gacaccacaagaaaaaaca

SEQ ID NO: 1285940 - RNA, 23 nt, Human
gaccuuaggugaucugcccaccu

SEQ ID NO: 1285941 - RNA, 18 nt, Human
gagucuugcuuugucacc

SEQ ID NO: 1285942 - RNA, 24 nt, Human
gcaaagugcuggcauuacaggcau

SEQ ID NO: 1285943 - RNA, 23 nt, Human
gcauccucagcccacgcuuugcc

SEQ ID NO: 1285944 - RNA, 24 nt, Human
gcauuacaggcaugagccaucaug

SEQ ID NO: 1285945 - RNA, 19 nt, Human
gcuagagugcaguggcaca

SEQ ID NO: 1285946 - RNA, 21 nt, Human
ggaacccagaccagcauccuc

SEQ ID NO: 1285947 - RNA, 22 nt, Human
ggaauuccuacaaacuuucuau

SEQ ID NO: 1285948 - RNA, 24 nt, Human
ggacaccacaagaaaaaacaaaag

SEQ ID NO: 1285949 - RNA, 19 nt, Human
ggacucaguuccuccagga

SEQ ID NO: 1285950 - RNA, 23 nt, Human
ggcauuacaggcaugagccauca

SEQ ID NO: 1285951 - RNA, 23 nt, Human
ggccaggcugaucuugaacuccu

SEQ ID NO: 1285952 - RNA, 23 nt, Human
ggcugaucuugaacuccugaccu

SEQ ID NO: 1285953 - RNA, 19 nt, Human
ggguuuugccaucuaggcc

SEQ ID NO: 1285954 - RNA, 25 nt, Human
uaauuuuuguauuuuuuaguagaga

SEQ ID NO: 1285955 - RNA, 25 nt, Human
uacaaacuuucuauggugaacagaa

SEQ ID NO: 1285956 - RNA, 20 nt, Human
uacaggcaugagccaucaug

SEQ ID NO: 1285957 - RNA, 23 nt, Human
uacaggcaugagccaucaugccc

SEQ ID NO: 1285958 - RNA, 24 nt, Human
uaccucagccucccaaguagcugg

SEQ ID NO: 1285959 - RNA, 19 nt, Human
uagaccccguuuacuuucc

SEQ ID NO: 1285960 - RNA, 20 nt, Human
uagagacaggguuuugccau

SEQ ID NO: 1285961 - RNA, 19 nt, Human
uagagugcaguggcacaau

SEQ ID NO: 1285962 - RNA, 23 nt, Human
uagagugcaguggcacaaucuca

SEQ ID NO: 1285963 - RNA, 19 nt, Human
uaguagagacaggguuuug

SEQ ID NO: 1285964 - RNA, 19 nt, Human
uaugucaggaauuccuaca

SEQ ID NO: 1285965 - RNA, 24 nt, Human
ucacaugcaggaugcugauccgga

SEQ ID NO: 1285966 - RNA, 24 nt, Human
ucacuguaaccuccaccucucagg

SEQ ID NO: 1285967 - RNA, 25 nt, Human
ucacuguaaccuccaccucucaggu

SEQ ID NO: 1285968 - RNA, 19 nt, Human
ucacuguucugcuucuuuu

SEQ ID NO: 1285969 - RNA, 22 nt, Human
ucagaacacgcaacuaugugau

SEQ ID NO: 1285970 - RNA, 19 nt, Human
ucagcccacgcuuugccac

SEQ ID NO: 1285971 - RNA, 18 nt, Human
ucagccucccaaguagcu

SEQ ID NO: 1285972 - RNA, 20 nt, Human
ucagccucccaaguagcugg

SEQ ID NO: 1285973 - RNA, 20 nt, Human
ucagcucaucuucuucccuc

SEQ ID NO: 1285974 - RNA, 20 nt, Human
ucagugaccccaucccuucc

SEQ ID NO: 1285975 - RNA, 23 nt, Human
uccagaugaccaacucuuaacuu

SEQ ID NO: 1285976 - RNA, 19 nt, Human
uccucagcccacgcuuugc

SEQ ID NO: 1285977 - RNA, 22 nt, Human
ucuauggugaacagaauagagc

SEQ ID NO: 1285978 - RNA, 19 nt, Human
ucuggaacccagaccagca

SEQ ID NO: 1285979 - RNA, 23 nt, Human
ucuugaacuccugaccuuaggug

SEQ ID NO: 1285980 - RNA, 19 nt, Human
ucuugcuuugucacccagg

SEQ ID NO: 1285981 - RNA, 23 nt, Human
ucuugcuuugucacccaggcuag

SEQ ID NO: 1285982 - RNA, 24 nt, Human
ucuugcuuugucacccaggcuaga

SEQ ID NO: 1285983 - RNA, 19 nt, Human
ucuuuggguugcccagcuu

SEQ ID NO: 1285984 - RNA, 19 nt, Human
ugaagcagcugccacccaa

SEQ ID NO: 1285985 - RNA, 20 nt, Human
ugaccuuaggugaucugccc

SEQ ID NO: 1285986 - RNA, 24 nt, Human
ugaccuuaggugaucugcccaccu

SEQ ID NO: 1285987 - RNA, 21 nt, Human
ugaguuuucuucuuuccagau

SEQ ID NO: 1285988 - RNA, 18 nt, Human
ugauugacaggccccucc

SEQ ID NO: 1285989 - RNA, 25 nt, Human
ugauugacaggccccuccuuagacc

SEQ ID NO: 1285990 - RNA, 22 nt, Human
ugcaaagaagaaacacaacaau

SEQ ID NO: 1285991 - RNA, 24 nt, Human
ugcaaagaagaaacacaacaauuc

SEQ ID NO: 1285992 - RNA, 18 nt, Human
ugccacccaaguguagaa

SEQ ID NO: 1285993 - RNA, 23 nt, Human
ugccacccucauuucuggaaccc

SEQ ID NO: 1285994 - RNA, 24 nt, Human
ugcuuugucacccaggcuagagug

SEQ ID NO: 1285995 - RNA, 19 nt, Human
uggagucuugcuuugucac

SEQ ID NO: 1285996 - RNA, 20 nt, Human
uggcacaaucucaacucacu

SEQ ID NO: 1285997 - RNA, 18 nt, Human
uggcauuacaggcaugag

SEQ ID NO: 1285998 - RNA, 22 nt, Human
uggcauuacaggcaugagccau

SEQ ID NO: 1285999 - RNA, 24 nt, Human
uggcauuacaggcaugagccauca

SEQ ID NO: 1286000 - RNA, 19 nt, Human
uggcuggacucuuuccauu

SEQ ID NO: 1286001 - RNA, 22 nt, Human
uggcuggacucuuuccauuuug

SEQ ID NO: 1286002 - RNA, 21 nt, Human
ugggaaaaccuucaucaucag

SEQ ID NO: 1286003 - RNA, 19 nt, Human
ugggauuacaugugcccac

SEQ ID NO: 1286004 - RNA, 21 nt, Human
ugggauuacaugugcccacca

SEQ ID NO: 1286005 - RNA, 24 nt, Human
ugggauuacaugugcccaccacca

SEQ ID NO: 1286006 - RNA, 21 nt, Human
ugguuccuggacucaguuccu

SEQ ID NO: 1286007 - RNA, 22 nt, Human
ugucacccaggcuagagugcag

SEQ ID NO: 1286008 - RNA, 24 nt, Human
uuacucaucuguuuuuuucacugu

SEQ ID NO: 1286009 - RNA, 22 nt, Human
uuagggugaggcagcaucucag

SEQ ID NO: 1286010 - RNA, 24 nt, Human
uuaguagagacaggguuuugccau

SEQ ID NO: 1286011 - RNA, 20 nt, Human
uuccccccuacaccaugccc

SEQ ID NO: 1286012 - RNA, 20 nt, Human
uugccacucagcucaucuuc

SEQ ID NO: 1286013 - RNA, 24 nt, Human
uugcuuugucacccaggcuagagu

SEQ ID NO: 1286014 - RNA, 18 nt, Human
uuggccacgaugguuccu

SEQ ID NO: 1286015 - RNA, 23 nt, Human
uuuagggugaggcagcaucucag

SEQ ID NO: 1286016 - RNA, 20 nt, Human
uuuccugggugugguuuggg

SEQ ID NO: 1286017 - RNA, 24 nt, Human
uuugucacccaggcuagagugcag

SEQ ID NO: 1286018 - RNA, 21 nt, Human
uuuuuaguagagacaggguuu

SEQ ID NO: 1286019 - RNA, 21 nt, Human
uuuuuguauuuuuuaguagag

SEQ ID NO: 1286020 - RNA, 22 nt, Human
uuuuuuaguagagacaggguuu

SEQ ID NO: 1286021 - RNA, 23 nt, Human
uuuuuuuuucugagauggagucu

SEQ ID NO: 1286022 - RNA, 24 nt, Human
uuuuuuuuuucugagauggagucu

SEQ ID NO: 1286023 - RNA, 18 nt, Human
accauccagccaagccag

SEQ ID NO: 1286024 - RNA, 22 nt, Human
accuucguugcucuuccugcca

SEQ ID NO: 1286025 - RNA, 27 nt, Human
agccaggcaugguuuugcaaauacucc

SEQ ID NO: 1286026 - RNA, 19 nt, Human
caccuucaccuucguugcu

SEQ ID NO: 1286027 - RNA, 18 nt, Human
cauccagccaagccaggc

SEQ ID NO: 1286028 - RNA, 26 nt, Human
ccaagccaggcaugguuuugcaaaua

SEQ ID NO: 1286029 - RNA, 22 nt, Human
ccucaaaaggauguaagguagg

SEQ ID NO: 1286030 - RNA, 24 nt, Human
ccuucaccuucguugcucuuccug

SEQ ID NO: 1286031 - RNA, 21 nt, Human
ucuguaaguccaacuugguuu

SEQ ID NO: 1286032 - RNA, 18 nt, Human
uuucuuggaauaaucugu

SEQ ID NO: 1286033 - RNA, 22 nt, Human
aggcagcgucugcucagaguug

SEQ ID NO: 1286034 - RNA, 23 nt, Human
guggguggaggcugucuuggaag

SEQ ID NO: 1286035 - RNA, 20 nt, Human
uuggcgauggcgggaaagcc

SEQ ID NO: 1286036 - RNA, 18 nt, Human
uggucuaccagaacacag

SEQ ID NO: 1286037 - RNA, 24 nt, Human
aaaaugcuuugguccugauaccag

SEQ ID NO: 1286038 - RNA, 23 nt, Human
acccagagugcuaaggauggugu

SEQ ID NO: 1286039 - RNA, 27 nt, Human
auaagaacaucuucucucucuucuucc

SEQ ID NO: 1286040 - RNA, 23 nt, Human
ccagacacccagagugcuaagga

SEQ ID NO: 1286041 - RNA, 23 nt, Human
cuguucauacaucuccugugucc

SEQ ID NO: 1286042 - RNA, 24 nt, Human
cuucuuccuuuuugccauaaagua

SEQ ID NO: 1286043 - RNA, 20 nt, Human
ggugugcugugaaggcuguu

SEQ ID NO: 1286044 - RNA, 18 nt, Human
uagaagcugcaaauucac

SEQ ID NO: 1286045 - RNA, 19 nt, Human
uccagguccaauuccauuu

SEQ ID NO: 1286046 - RNA, 18 nt, Human
ucucucucuucuuccuuu

SEQ ID NO: 1286047 - RNA, 20 nt, Human
ugacuuccagguccaauucc

SEQ ID NO: 1286048 - RNA, 18 nt, Human
ugugcugugaaggcuguu

SEQ ID NO: 1286049 - RNA, 18 nt, Human
uuccuuuuugccauaaag

SEQ ID NO: 1286050 - RNA, 19 nt, Human
aggaagugcugaccacuac

SEQ ID NO: 1286051 - RNA, 22 nt, Human
caacggauccuuccuuggagcc

SEQ ID NO: 1286052 - RNA, 19 nt, Human
ugaguugacguacaggaag

SEQ ID NO: 1286053 - RNA, 20 nt, Human
ugggaaggauuuggaaguag

SEQ ID NO: 1286054 - RNA, 22 nt, Human
ugggaaggauuuggaaguagua

SEQ ID NO: 1286055 - RNA, 21 nt, Human
cuccaugauguagaucuugcu

SEQ ID NO: 1286056 - RNA, 22 nt, Human
gcuuaucaaacacugcaaccag

SEQ ID NO: 1286057 - RNA, 23 nt, Human
uggcacugaugucaucaccucca

SEQ ID NO: 1286058 - RNA, 18 nt, Human
aagguuugcucauuguuu

SEQ ID NO: 1286059 - RNA, 24 nt, Human
caagguuugcucauuguuuucagu

SEQ ID NO: 1286060 - RNA, 23 nt, Human
uugcucauuguuuucaguguagg

SEQ ID NO: 1286061 - RNA, 18 nt, Human
uauuauuguaacugucac

SEQ ID NO: 1286062 - RNA, 22 nt, Human
acaaaaacagcugcaggaagag

SEQ ID NO: 1286063 - RNA, 21 nt, Human
aggaagagguggaggggggcc

SEQ ID NO: 1286064 - RNA, 23 nt, Human
aggcacuugggcauggagucuuc

SEQ ID NO: 1286065 - RNA, 19 nt, Human
agguggaggggggccuguc

SEQ ID NO: 1286066 - RNA, 22 nt, Human
caaauaaaggagcagucauccc

SEQ ID NO: 1286067 - RNA, 20 nt, Human
cagcugcaggaagaggugga

SEQ ID NO: 1286068 - RNA, 19 nt, Human
cauuauguuucccccccac

SEQ ID NO: 1286069 - RNA, 27 nt, Human
ccccccaacgaaaggaaaaccgguuuc

SEQ ID NO: 1286070 - RNA, 20 nt, Human
ccuugaggggggggauuaca

SEQ ID NO: 1286071 - RNA, 23 nt, Human
ccuugaggggggggauuacaggc

SEQ ID NO: 1286072 - RNA, 18 nt, Human
gcuuagccuucacuccuu

SEQ ID NO: 1286073 - RNA, 21 nt, Human
ggagcagucaucccuagggca

SEQ ID NO: 1286074 - RNA, 22 nt, Human
gguacaaaaacagcugcaggaa

SEQ ID NO: 1286075 - RNA, 21 nt, Human
guggaggggggccugucauua

SEQ ID NO: 1286076 - RNA, 23 nt, Human
uaacaguaccucuaaguuucagu

SEQ ID NO: 1286077 - RNA, 18 nt, Human
uaagacucccaacauaaa

SEQ ID NO: 1286078 - RNA, 19 nt, Human
uaccucuaaguuucagucc

SEQ ID NO: 1286079 - RNA, 24 nt, Human
uauguuucccccccaccccccaac

SEQ ID NO: 1286080 - RNA, 24 nt, Human
uccuccuaucuaguuguacuuuaa

SEQ ID NO: 1286081 - RNA, 18 nt, Human
ugaggggggggauuacag

SEQ ID NO: 1286082 - RNA, 19 nt, Human
ugcaggaagagguggaggg

SEQ ID NO: 1286083 - RNA, 21 nt, Human
ugucauuauguuuccccccca

SEQ ID NO: 1286084 - RNA, 20 nt, Human
uuagccuucacuccuuccuc

SEQ ID NO: 1286085 - RNA, 20 nt, Human
aaaaaucccuagggauucag

SEQ ID NO: 1286086 - RNA, 18 nt, Human
aaagcagauguggcugcc

SEQ ID NO: 1286087 - RNA, 23 nt, Human
aagcagauguggcugccuuggau

SEQ ID NO: 1286088 - RNA, 18 nt, Human
agcacaaccaguccuccc

SEQ ID NO: 1286089 - RNA, 23 nt, Human
caaagcggcagcaugcuaucgcc

SEQ ID NO: 1286090 - RNA, 24 nt, Human
cacucccggccugcccgcuggagg

SEQ ID NO: 1286091 - RNA, 26 nt, Human
ccagcugguccucugaggaccagcca

SEQ ID NO: 1286092 - RNA, 21 nt, Human
ccgaccauccugggcuucucu

SEQ ID NO: 1286093 - RNA, 19 nt, Human
ccucucaaaggacaaaagc

SEQ ID NO: 1286094 - RNA, 24 nt, Human
cgcuggaggcgcggcucccaccau

SEQ ID NO: 1286095 - RNA, 27 nt, Human
cggcagcaugcuaucgccuucuccagc

SEQ ID NO: 1286096 - RNA, 18 nt, Human
cuagggacugucaaagcg

SEQ ID NO: 1286097 - RNA, 21 nt, Human
cuggcuuuaaaaaaaucccua

SEQ ID NO: 1286098 - RNA, 20 nt, Human
cuuggaucagcugcacgcag

SEQ ID NO: 1286099 - RNA, 20 nt, Human
ggaaggagaggcggccccag

SEQ ID NO: 1286100 - RNA, 21 nt, Human
ggcagcaugcuaucgccuucu

SEQ ID NO: 1286101 - RNA, 21 nt, Human
ggcuuuaaaaaaaucccuagg

SEQ ID NO: 1286102 - RNA, 24 nt, Human
uaucgccuucuccagcccuucucc

SEQ ID NO: 1286103 - RNA, 21 nt, Human
uccugggcuucucuuugggca

SEQ ID NO: 1286104 - RNA, 21 nt, Human
ucgccuucuccagcccuucuc

SEQ ID NO: 1286105 - RNA, 18 nt, Human
ucuccagcccuucuccag

SEQ ID NO: 1286106 - RNA, 21 nt, Human
ucucuuugggcagaccugggc

SEQ ID NO: 1286107 - RNA, 22 nt, Human
ucuggaccgcgacugcuaggga

SEQ ID NO: 1286108 - RNA, 24 nt, Human
ucuuugggcagaccugggccaggg

SEQ ID NO: 1286109 - RNA, 21 nt, Human
ugccccugcggaaggagaggc

SEQ ID NO: 1286110 - RNA, 20 nt, Human
aacaaucuggaccucaagug

SEQ ID NO: 1286111 - RNA, 21 nt, Human
aagaggaggaggucuguucca

SEQ ID NO: 1286112 - RNA, 22 nt, Human
aauaauuugucuaggaguuuau

SEQ ID NO: 1286113 - RNA, 25 nt, Human
aaugguuuucucuuguccagugcug

SEQ ID NO: 1286114 - RNA, 18 nt, Human
aauguguuuuucuuggca

SEQ ID NO: 1286115 - RNA, 20 nt, Human
acacugaagaaaauggacau

SEQ ID NO: 1286116 - RNA, 18 nt, Human
accacucuuacuuccccu

SEQ ID NO: 1286117 - RNA, 18 nt, Human
agauaagguaccugcagg

SEQ ID NO: 1286118 - RNA, 23 nt, Human
aggaggucuguuccacagacacc

SEQ ID NO: 1286119 - RNA, 19 nt, Human
aggcagccaugggguggca

SEQ ID NO: 1286120 - RNA, 21 nt, Human
aggcagccaugggguggcaca

SEQ ID NO: 1286121 - RNA, 22 nt, Human
aggcaggguugucaaggccagg

SEQ ID NO: 1286122 - RNA, 22 nt, Human
aggggguuuagagaagaggagg

SEQ ID NO: 1286123 - RNA, 22 nt, Human
aguagagugggcccauuuucau

SEQ ID NO: 1286124 - RNA, 22 nt, Human
aucaaugccguugauauuuagc

SEQ ID NO: 1286125 - RNA, 22 nt, Human
aucaccucucuuuauucugcca

SEQ ID NO: 1286126 - RNA, 21 nt, Human
augaagugugcugggaagccc

SEQ ID NO: 1286127 - RNA, 19 nt, Human
caacgauacuaaagcccca

SEQ ID NO: 1286128 - RNA, 21 nt, Human
caacuucccaaguaacuucuu

SEQ ID NO: 1286129 - RNA, 21 nt, Human
cacacugaagaaaauggacau

SEQ ID NO: 1286130 - RNA, 18 nt, Human
cacagggugugucuagug

SEQ ID NO: 1286131 - RNA, 18 nt, Human
caccaacgauacuaaagc

SEQ ID NO: 1286132 - RNA, 18 nt, Human
cacccacaaugcugauuc

SEQ ID NO: 1286133 - RNA, 20 nt, Human
cagcacucggucauugcugc

SEQ ID NO: 1286134 - RNA, 20 nt, Human
caggcacugcgccugucccc

SEQ ID NO: 1286135 - RNA, 18 nt, Human
caggggguuuagagaaga

SEQ ID NO: 1286136 - RNA, 18 nt, Human
cauauccaccaacgauac

SEQ ID NO: 1286137 - RNA, 19 nt, Human
ccaacgauacuaaagcccc

SEQ ID NO: 1286138 - RNA, 24 nt, Human
ccacaggcacugcgccugucccca

SEQ ID NO: 1286139 - RNA, 21 nt, Human
ccacagggugugucuaguggc

SEQ ID NO: 1286140 - RNA, 22 nt, Human
ccaccaacgauacuaaagcccc

SEQ ID NO: 1286141 - RNA, 19 nt, Human
ccccagcaacggucaugcc

SEQ ID NO: 1286142 - RNA, 21 nt, Human
ccucaaaggcaggguugucaa

SEQ ID NO: 1286143 - RNA, 23 nt, Human
ccucacuccauguggaaagagac

SEQ ID NO: 1286144 - RNA, 18 nt, Human
cuaaagccccaacuuccc

SEQ ID NO: 1286145 - RNA, 23 nt, Human
cuccgcguucugagucgccuccu

SEQ ID NO: 1286146 - RNA, 21 nt, Human
cucuccgaugagaagcuccag

SEQ ID NO: 1286147 - RNA, 25 nt, Human
cugcagcagagguugaaggcaaaua

SEQ ID NO: 1286148 - RNA, 26 nt, Human
gaaggcaaauauggcagacuagguca

SEQ ID NO: 1286149 - RNA, 19 nt, Human
gagaagaggaggaggucug

SEQ ID NO: 1286150 - RNA, 20 nt, Human
gcaacucuccgaugagaagc

SEQ ID NO: 1286151 - RNA, 19 nt, Human
gcugcagcagagguugaag

SEQ ID NO: 1286152 - RNA, 21 nt, Human
ggcaacagcaggggacgcggc

SEQ ID NO: 1286153 - RNA, 22 nt, Human
ggcaacagcaggggacgcggca

SEQ ID NO: 1286154 - RNA, 23 nt, Human
gggaagcccaagccacaugaccc

SEQ ID NO: 1286155 - RNA, 23 nt, Human
gggcaacagcaggggacgcggca

SEQ ID NO: 1286156 - RNA, 22 nt, Human
gguaaacuaaguggcuguugug

SEQ ID NO: 1286157 - RNA, 18 nt, Human
guggugcuggcugcugcu

SEQ ID NO: 1286158 - RNA, 21 nt, Human
guggugcuggcugcugcugcu

SEQ ID NO: 1286159 - RNA, 18 nt, Human
gugguguguggugcuggc

SEQ ID NO: 1286160 - RNA, 19 nt, Human
guguggugucagcuccagc

SEQ ID NO: 1286161 - RNA, 20 nt, Human
uaaagccccaacuucccaag

SEQ ID NO: 1286162 - RNA, 20 nt, Human
uacaucuuugcacacugaag

SEQ ID NO: 1286163 - RNA, 23 nt, Human
uacuaaagccccaacuucccaag

SEQ ID NO: 1286164 - RNA, 24 nt, Human
uagcaauuguuaaauucacucucu

SEQ ID NO: 1286165 - RNA, 21 nt, Human
ucagcuccagcgcucuccuca

SEQ ID NO: 1286166 - RNA, 18 nt, Human
uccacagacaccaucuca

SEQ ID NO: 1286167 - RNA, 21 nt, Human
uccaccaacgauacuaaagcc

SEQ ID NO: 1286168 - RNA, 22 nt, Human
uccaccaacgauacuaaagccc

SEQ ID NO: 1286169 - RNA, 23 nt, Human
uccaggacaucuguuuuugagau

SEQ ID NO: 1286170 - RNA, 21 nt, Human
uccccaaacagucugcuucug

SEQ ID NO: 1286171 - RNA, 18 nt, Human
uccuaacugaauguaagg

SEQ ID NO: 1286172 - RNA, 21 nt, Human
ucgcugaaaguacucggcugc

SEQ ID NO: 1286173 - RNA, 19 nt, Human
ucguugccacccacaaugc

SEQ ID NO: 1286174 - RNA, 23 nt, Human
ucuacuaguuuuccuucucucca

SEQ ID NO: 1286175 - RNA, 24 nt, Human
ucucuuguaaaaaguuucugaggc

SEQ ID NO: 1286176 - RNA, 19 nt, Human
ucuguuccacagacaccau

SEQ ID NO: 1286177 - RNA, 24 nt, Human
ugaagaaaauggacauaaaacuaa

SEQ ID NO: 1286178 - RNA, 21 nt, Human
ugaaggcaaauauggcagacu

SEQ ID NO: 1286179 - RNA, 20 nt, Human
ugcaaggcagccauggggug

SEQ ID NO: 1286180 - RNA, 24 nt, Human
ugcugcugcuaugauuuccugcuu

SEQ ID NO: 1286181 - RNA, 20 nt, Human
ugcugggaagcccaagccac

SEQ ID NO: 1286182 - RNA, 19 nt, Human
uggaaagagacgcugaugu

SEQ ID NO: 1286183 - RNA, 21 nt, Human
uggccagcacucggucauugc

SEQ ID NO: 1286184 - RNA, 19 nt, Human
uggccugaauaaucugggc

SEQ ID NO: 1286185 - RNA, 21 nt, Human
uggugguguguggugcuggcu

SEQ ID NO: 1286186 - RNA, 22 nt, Human
uuaccaggcugggguuucccug

SEQ ID NO: 1286187 - RNA, 22 nt, Human
uuagagaagaggaggaggucug

SEQ ID NO: 1286188 - RNA, 22 nt, Human
uucaugugguuccuucuuuaca

SEQ ID NO: 1286189 - RNA, 20 nt, Human
uucguugccacccacaaugc

SEQ ID NO: 1286190 - RNA, 19 nt, Human
uugcauuacaucuuugcac

SEQ ID NO: 1286191 - RNA, 20 nt, Human
accgcaaccggcggauuugc

SEQ ID NO: 1286192 - RNA, 21 nt, Human
agaaaaugcuaauugugaaag

SEQ ID NO: 1286193 - RNA, 21 nt, Human
agccuauggugcggcggccgg

SEQ ID NO: 1286194 - RNA, 19 nt, Human
aggcagcagaaaaugcuaa

SEQ ID NO: 1286195 - RNA, 19 nt, Human
auccccuccuccuccccca

SEQ ID NO: 1286196 - RNA, 22 nt, Human
auccccuccuccucccccacag

SEQ ID NO: 1286197 - RNA, 20 nt, Human
caagaacaagguaaccugug

SEQ ID NO: 1286198 - RNA, 19 nt, Human
caaucacggcccccggcug

SEQ ID NO: 1286199 - RNA, 20 nt, Human
caggcagcagaaaaugcuaa

SEQ ID NO: 1286200 - RNA, 20 nt, Human
ccaggccaaucacggccccc

SEQ ID NO: 1286201 - RNA, 23 nt, Human
ccccacagccgcggguacccggg

SEQ ID NO: 1286202 - RNA, 21 nt, Human
cccccacagccgcggguaccc

SEQ ID NO: 1286203 - RNA, 21 nt, Human
ccggcgauccccuccuccucc

SEQ ID NO: 1286204 - RNA, 20 nt, Human
ccuccuccucccccacagcc

SEQ ID NO: 1286205 - RNA, 23 nt, Human
cggccggcccgccgguccgcgcu

SEQ ID NO: 1286206 - RNA, 21 nt, Human
cuccuccucccccacagccgc

SEQ ID NO: 1286207 - RNA, 24 nt, Human
cugggucccuucuauaggucgcag

SEQ ID NO: 1286208 - RNA, 25 nt, Human
cugggucccuucuauaggucgcagg

SEQ ID NO: 1286209 - RNA, 23 nt, Human
gagccucuuuucuuucugggccu

SEQ ID NO: 1286210 - RNA, 22 nt, Human
gccggcccgccgguccgcgcug

SEQ ID NO: 1286211 - RNA, 21 nt, Human
gccucuuuucuuucugggccu

SEQ ID NO: 1286212 - RNA, 19 nt, Human
gcggcggccggcccgccgg

SEQ ID NO: 1286213 - RNA, 23 nt, Human
ggccggcccgccgguccgcgcug

SEQ ID NO: 1286214 - RNA, 20 nt, Human
uaaaagcaaugcaagaacaa

SEQ ID NO: 1286215 - RNA, 26 nt, Human
uccauggaauacccccggcgaucccc

SEQ ID NO: 1286216 - RNA, 22 nt, Human
ucccccacagccgcggguaccc

SEQ ID NO: 1286217 - RNA, 23 nt, Human
ucgcaggcagcagaaaaugcuaa

SEQ ID NO: 1286218 - RNA, 20 nt, Human
ugagagccucuuuucuuucu

SEQ ID NO: 1286219 - RNA, 22 nt, Human
uggaauacccccggcgaucccc

SEQ ID NO: 1286220 - RNA, 23 nt, Human
uuucugcugagagccucuuuucu

SEQ ID NO: 1286221 - RNA, 19 nt, Human
aacuggccucaucauuuuc

SEQ ID NO: 1286222 - RNA, 19 nt, Human
accacccaacgccauccca

SEQ ID NO: 1286223 - RNA, 20 nt, Human
acccaacgccaucccagcug

SEQ ID NO: 1286224 - RNA, 18 nt, Human
agacaaacugggcacagc

SEQ ID NO: 1286225 - RNA, 24 nt, Human
agcguacugaagucaaagcaguuc

SEQ ID NO: 1286226 - RNA, 22 nt, Human
agcugggguccccagcagugcc

SEQ ID NO: 1286227 - RNA, 19 nt, Human
aggaagucggagacaaacu

SEQ ID NO: 1286228 - RNA, 18 nt, Human
agggggugcaggaagagg

SEQ ID NO: 1286229 - RNA, 19 nt, Human
auuuucuccauccucgccc

SEQ ID NO: 1286230 - RNA, 21 nt, Human
cacaccacccaacgccauccc

SEQ ID NO: 1286231 - RNA, 19 nt, Human
cacccaacgccaucccagc

SEQ ID NO: 1286232 - RNA, 21 nt, Human
caccucaacuggccucaucau

SEQ ID NO: 1286233 - RNA, 20 nt, Human
cacuaucugcagccucccag

SEQ ID NO: 1286234 - RNA, 20 nt, Human
caggcaggggcaccauggug

SEQ ID NO: 1286235 - RNA, 19 nt, Human
caggggcaccauggugagg

SEQ ID NO: 1286236 - RNA, 23 nt, Human
caguaagcaucauagccagagcc

SEQ ID NO: 1286237 - RNA, 21 nt, Human
cagugagugggcacaccuccc

SEQ ID NO: 1286238 - RNA, 18 nt, Human
cagugugggccggagggu

SEQ ID NO: 1286239 - RNA, 24 nt, Human
caucccagcugaugcacuaucugc

SEQ ID NO: 1286240 - RNA, 21 nt, Human
ccacaccacccaacgccaucc

SEQ ID NO: 1286241 - RNA, 20 nt, Human
ccacucggccgccuccuccc

SEQ ID NO: 1286242 - RNA, 20 nt, Human
ccauucagcccacucggccg

SEQ ID NO: 1286243 - RNA, 19 nt, Human
cccagcuggggucuuucca

SEQ ID NO: 1286244 - RNA, 18 nt, Human
ccgcucggccuccuccuc

SEQ ID NO: 1286245 - RNA, 21 nt, Human
ccuccuccuccuccaccuucu

SEQ ID NO: 1286246 - RNA, 19 nt, Human
ccugcagcagguguuccuc

SEQ ID NO: 1286247 - RNA, 22 nt, Human
ccuugguaaaggccgggagcuc

SEQ ID NO: 1286248 - RNA, 19 nt, Human
cgagagaugggggagcugg

SEQ ID NO: 1286249 - RNA, 18 nt, Human
cgccuccucccgcucggc

SEQ ID NO: 1286250 - RNA, 18 nt, Human
cggccgccuccucccgcu

SEQ ID NO: 1286251 - RNA, 26 nt, Human
cgggcacagauggcuguacuggcggg

SEQ ID NO: 1286252 - RNA, 19 nt, Human
cuaucugcagccucccagc

SEQ ID NO: 1286253 - RNA, 20 nt, Human
cugaagucaaagcaguuccc

SEQ ID NO: 1286254 - RNA, 19 nt, Human
cugcagcagguguuccucc

SEQ ID NO: 1286255 - RNA, 26 nt, Human
cugcagccucccagcuggggucuuuc

SEQ ID NO: 1286256 - RNA, 18 nt, Human
gaagucggagacaaacug

SEQ ID NO: 1286257 - RNA, 21 nt, Human
gaguacaggugcgagggcggc

SEQ ID NO: 1286258 - RNA, 19 nt, Human
gcccacucggccgccuccu

SEQ ID NO: 1286259 - RNA, 19 nt, Human
gccuccuccuccuccucca

SEQ ID NO: 1286260 - RNA, 24 nt, Human
gccuggagugccaccucuagccuu

SEQ ID NO: 1286261 - RNA, 24 nt, Human
gcucggccuccuccuccuccucca

SEQ ID NO: 1286262 - RNA, 19 nt, Human
gcuucuaugggggucccug

SEQ ID NO: 1286263 - RNA, 19 nt, Human
ggggagcugggguccccag

SEQ ID NO: 1286264 - RNA, 23 nt, Human
uaagcaucauagccagagccgau

SEQ ID NO: 1286265 - RNA, 22 nt, Human
ucaacuggccucaucauuuucu

SEQ ID NO: 1286266 - RNA, 20 nt, Human
ucaggcaggggcaccauggu

SEQ ID NO: 1286267 - RNA, 21 nt, Human
uccccagcagugccacagagg

SEQ ID NO: 1286268 - RNA, 24 nt, Human
uccccagcagugccacagaggcug

SEQ ID NO: 1286269 - RNA, 22 nt, Human
uccucccgcucggccuccuccu

SEQ ID NO: 1286270 - RNA, 26 nt, Human
uccuccuccuccuccaccuucucccc

SEQ ID NO: 1286271 - RNA, 21 nt, Human
uccuuggguguguugguuuug

SEQ ID NO: 1286272 - RNA, 22 nt, Human
ugauuuccuccuuccgcaccuc

SEQ ID NO: 1286273 - RNA, 22 nt, Human
ugcacuaucugcagccucccag

SEQ ID NO: 1286274 - RNA, 23 nt, Human
ugcagccucccagcuggggucuu

SEQ ID NO: 1286275 - RNA, 23 nt, Human
uggagugccaccucuagccuuuc

SEQ ID NO: 1286276 - RNA, 22 nt, Human
uggcgggagaaguugucugcca

SEQ ID NO: 1286277 - RNA, 23 nt, Human
uggcuguacuggcgggagaaguu

SEQ ID NO: 1286278 - RNA, 21 nt, Human
ugugcucacgaacuugggcac

SEQ ID NO: 1286279 - RNA, 24 nt, Human
uuccacaccacccaacgccauccc

SEQ ID NO: 1286280 - RNA, 19 nt, Human
uucuccaggucucugagcg

SEQ ID NO: 1286281 - RNA, 21 nt, Human
uugagagggucaggcaggggc

SEQ ID NO: 1286282 - RNA, 22 nt, Human
uuuguaggaaaugggcagcuug

SEQ ID NO: 1286283 - RNA, 21 nt, Human
acagaggcccagccagccucc

SEQ ID NO: 1286284 - RNA, 19 nt, Human
agccuaucucuucgcccug

SEQ ID NO: 1286285 - RNA, 22 nt, Human
aggggacaaggaaaugcuaggg

SEQ ID NO: 1286286 - RNA, 18 nt, Human
agggugggagguggggag

SEQ ID NO: 1286287 - RNA, 18 nt, Human
agguggucaaaacgggaa

SEQ ID NO: 1286288 - RNA, 20 nt, Human
aguggggaguagggugggag

SEQ ID NO: 1286289 - RNA, 18 nt, Human
caaaacgggaauauagug

SEQ ID NO: 1286290 - RNA, 18 nt, Human
cagcacagugggucuggc

SEQ ID NO: 1286291 - RNA, 25 nt, Human
ccacagacugacagaaaacagcaca

SEQ ID NO: 1286292 - RNA, 19 nt, Human
ccacuguccccaauuaugu

SEQ ID NO: 1286293 - RNA, 21 nt, Human
ccccgggggcagagaagauca

SEQ ID NO: 1286294 - RNA, 20 nt, Human
cccugaguggcgggcggcuc

SEQ ID NO: 1286295 - RNA, 18 nt, Human
ccuagcccugucagggac

SEQ ID NO: 1286296 - RNA, 20 nt, Human
ccugaccuucacuugagugu

SEQ ID NO: 1286297 - RNA, 18 nt, Human
cgggaauauaguggggag

SEQ ID NO: 1286298 - RNA, 23 nt, Human
cugcagcccugcugaccaggcug

SEQ ID NO: 1286299 - RNA, 21 nt, Human
cuuggugcugugccacagacu

SEQ ID NO: 1286300 - RNA, 24 nt, Human
gaguggcgggcggcucggcagggg

SEQ ID NO: 1286301 - RNA, 22 nt, Human
gaguguggaucccuugaccccc

SEQ ID NO: 1286302 - RNA, 23 nt, Human
gcugugccacagacugacagaaa

SEQ ID NO: 1286303 - RNA, 22 nt, Human
ggaagaggggacaaggaaaugc

SEQ ID NO: 1286304 - RNA, 23 nt, Human
gggcagcugaggggcugaggugg

SEQ ID NO: 1286305 - RNA, 21 nt, Human
ggggaagaggggacaaggaaa

SEQ ID NO: 1286306 - RNA, 20 nt, Human
ggugggagguggggagauag

SEQ ID NO: 1286307 - RNA, 21 nt, Human
uagaucggacugcccugagug

SEQ ID NO: 1286308 - RNA, 20 nt, Human
uagcccugucagggacuggu

SEQ ID NO: 1286309 - RNA, 19 nt, Human
uagggugggagguggggag

SEQ ID NO: 1286310 - RNA, 19 nt, Human
uaguggggaguaggguggg

SEQ ID NO: 1286311 - RNA, 23 nt, Human
uaguggggaguagggugggaggu

SEQ ID NO: 1286312 - RNA, 21 nt, Human
uaugugcgugggagagacuga

SEQ ID NO: 1286313 - RNA, 18 nt, Human
uccagguggaggaggaag

SEQ ID NO: 1286314 - RNA, 26 nt, Human
ucugaaguauuucuuccuugcagggu

SEQ ID NO: 1286315 - RNA, 22 nt, Human
ucuggccccgggggcagagaag

SEQ ID NO: 1286316 - RNA, 21 nt, Human
ugagaaaaggcaguuuaucca

SEQ ID NO: 1286317 - RNA, 20 nt, Human
ugagagggggcagcugaggg

SEQ ID NO: 1286318 - RNA, 22 nt, Human
ugagagggggcagcugaggggc

SEQ ID NO: 1286319 - RNA, 20 nt, Human
ugaguguggaucccuugacc

SEQ ID NO: 1286320 - RNA, 18 nt, Human
ugcuaggggcuccaggug

SEQ ID NO: 1286321 - RNA, 19 nt, Human
ugcuaggggcuccaggugg

SEQ ID NO: 1286322 - RNA, 18 nt, Human
uggcagagcuuggugcug

SEQ ID NO: 1286323 - RNA, 25 nt, Human
uggccaaagugagagggggcagcug

SEQ ID NO: 1286324 - RNA, 27 nt, Human
ugggauuggccaaagugagagggggca

SEQ ID NO: 1286325 - RNA, 18 nt, Human
uggggaguagggugggag

SEQ ID NO: 1286326 - RNA, 24 nt, Human
ugggggacugcagcccugcugacc

SEQ ID NO: 1286327 - RNA, 24 nt, Human
ugguaagagagcccccacuguccc

SEQ ID NO: 1286328 - RNA, 23 nt, Human
uggucaaaacgggaauauagugg

SEQ ID NO: 1286329 - RNA, 24 nt, Human
uguggcuggccacugaggccaggc

SEQ ID NO: 1286330 - RNA, 24 nt, Human
uuggugccugggauuggccaaagu

SEQ ID NO: 1286331 - RNA, 18 nt, Human
acagaaaagcaguacagg

SEQ ID NO: 1286332 - RNA, 21 nt, Human
cacacagaaaagcaguacagg

SEQ ID NO: 1286333 - RNA, 25 nt, Human
cacacagaaaagcaguacaggcucc

SEQ ID NO: 1286334 - RNA, 21 nt, Human
cacccuuguaagggccagaag

SEQ ID NO: 1286335 - RNA, 22 nt, Human
cacccuuguaagggccagaagc

SEQ ID NO: 1286336 - RNA, 23 nt, Human
cagauaucucgccaccuuguuuc

SEQ ID NO: 1286337 - RNA, 20 nt, Human
cgaagcacacagaaaagcag

SEQ ID NO: 1286338 - RNA, 23 nt, Human
ggauguucaggauguccaaggaa

SEQ ID NO: 1286339 - RNA, 26 nt, Human
gggccagaagcgaagcacacagaaaa

SEQ ID NO: 1286340 - RNA, 18 nt, Human
ucccucuccuccacuucu

SEQ ID NO: 1286341 - RNA, 21 nt, Human
ugauaggcacccuuguaaggg

SEQ ID NO: 1286342 - RNA, 21 nt, Human
aagcguuucccagaccugucc

SEQ ID NO: 1286343 - RNA, 24 nt, Human
aagcguuucccagaccuguccccc

SEQ ID NO: 1286344 - RNA, 18 nt, Human
agcaggugaccgcacgcg

SEQ ID NO: 1286345 - RNA, 21 nt, Human
ccacagacggcggcgacccgc

SEQ ID NO: 1286346 - RNA, 20 nt, Human
ccugcagacacccacagacc

SEQ ID NO: 1286347 - RNA, 22 nt, Human
ccugcagacacccacagaccuc

SEQ ID NO: 1286348 - RNA, 21 nt, Human
ccuucugccuuccuucucaaa

SEQ ID NO: 1286349 - RNA, 22 nt, Human
cuccaaaacgauuugaaguaga

SEQ ID NO: 1286350 - RNA, 24 nt, Human
cugucccccaguagaugcccuuca

SEQ ID NO: 1286351 - RNA, 19 nt, Human
gaaguagaaagcguuuccc

SEQ ID NO: 1286352 - RNA, 20 nt, Human
gacccagggcuggcuugagc

SEQ ID NO: 1286353 - RNA, 20 nt, Human
gccccgccggcuugggggcc

SEQ ID NO: 1286354 - RNA, 21 nt, Human
gcggcgaccacagacggcggc

SEQ ID NO: 1286355 - RNA, 23 nt, Human
gcuggcuugagcgcacuggccuc

SEQ ID NO: 1286356 - RNA, 24 nt, Human
ggccccgcgggggacccagggcug

SEQ ID NO: 1286357 - RNA, 21 nt, Human
ggcggcgacccgccgcgggaa

SEQ ID NO: 1286358 - RNA, 26 nt, Human
gggggacccagggcuggcuugagcgc

SEQ ID NO: 1286359 - RNA, 21 nt, Human
uagaaagcguuucccagaccu

SEQ ID NO: 1286360 - RNA, 19 nt, Human
ugaaguagaaagcguuucc

SEQ ID NO: 1286361 - RNA, 23 nt, Human
ugcaaggaggacuccaaaacgau

SEQ ID NO: 1286362 - RNA, 19 nt, Human
uguggcaucuccuaaggcu

SEQ ID NO: 1286363 - RNA, 21 nt, Human
uucuggaauguggcaucuccu

SEQ ID NO: 1286364 - RNA, 22 nt, Human
aacuaagccuaagaggcccaac

SEQ ID NO: 1286365 - RNA, 19 nt, Human
aagcaacucauacucuccc

SEQ ID NO: 1286366 - RNA, 18 nt, Human
aagcagaugugcacauau

SEQ ID NO: 1286367 - RNA, 21 nt, Human
aagccagcacgauauugaucc

SEQ ID NO: 1286368 - RNA, 19 nt, Human
acucucccaagugacaaaa

SEQ ID NO: 1286369 - RNA, 20 nt, Human
augagcacccaccugauaga

SEQ ID NO: 1286370 - RNA, 21 nt, Human
caacacaggcugcuggaaauc

SEQ ID NO: 1286371 - RNA, 20 nt, Human
cagcacgauauugaucccuc

SEQ ID NO: 1286372 - RNA, 21 nt, Human
caguaggagcugccagugaug

SEQ ID NO: 1286373 - RNA, 27 nt, Human
ccauccccaugagccagagcacagcua

SEQ ID NO: 1286374 - RNA, 19 nt, Human
cccaugagccagagcacag

SEQ ID NO: 1286375 - RNA, 18 nt, Human
gaagcagaugugcacaua

SEQ ID NO: 1286376 - RNA, 20 nt, Human
gcugcuggaaaucaucucca

SEQ ID NO: 1286377 - RNA, 19 nt, Human
uaaagacaucauggaacug

SEQ ID NO: 1286378 - RNA, 19 nt, Human
uaaagcaacucauacucuc

SEQ ID NO: 1286379 - RNA, 25 nt, Human
uacauucagcucugguuggagguuc

SEQ ID NO: 1286380 - RNA, 19 nt, Human
uaucaaacuuaucaucuag

SEQ ID NO: 1286381 - RNA, 22 nt, Human
ugagcacccaccugauagauaa

SEQ ID NO: 1286382 - RNA, 21 nt, Human
uggauagggccgaagcagaug

SEQ ID NO: 1286383 - RNA, 21 nt, Human
uggcaaaggugguccugucug

SEQ ID NO: 1286384 - RNA, 21 nt, Human
ugugcacauauauagcugccu

SEQ ID NO: 1286385 - RNA, 22 nt, Human
uucagcucugguuggagguucu

SEQ ID NO: 1286386 - RNA, 20 nt, Human
uuccaauaaagacaucaugg

SEQ ID NO: 1286387 - RNA, 24 nt, Human
uuuaagccagcacgauauugaucc

SEQ ID NO: 1286388 - RNA, 19 nt, Human
agugugaggauugggagga

SEQ ID NO: 1286389 - RNA, 24 nt, Human
gaccuacuccgcuaacccaguggg

SEQ ID NO: 1286390 - RNA, 20 nt, Human
uagugugaggauugggagga

SEQ ID NO: 1286391 - RNA, 22 nt, Human
uagugugaggauugggaggaac

SEQ ID NO: 1286392 - RNA, 22 nt, Human
ugugaggauugggaggaacucg

SEQ ID NO: 1286393 - RNA, 23 nt, Human
cucuuaccccuuugugcugacua

SEQ ID NO: 1286394 - RNA, 22 nt, Human
cuuugugcugacuauuuucucc

SEQ ID NO: 1286395 - RNA, 27 nt, Human
uauuccauuccuguagcaauguguguu

SEQ ID NO: 1286396 - RNA, 23 nt, Human
uguuuuuuccuccuauagcucuu

SEQ ID NO: 1286397 - RNA, 21 nt, Human
ccaauucuucugcagauucua

SEQ ID NO: 1286398 - RNA, 18 nt, Human
uguccaauucuucugcag

SEQ ID NO: 1286399 - RNA, 24 nt, Human
uguccaauucuucugcagauucua

SEQ ID NO: 1286400 - RNA, 21 nt, Human
aaacggccagggacagagcaa

SEQ ID NO: 1286401 - RNA, 22 nt, Human
agccuauccaauuucucucuca

SEQ ID NO: 1286402 - RNA, 23 nt, Human
agucugugggguugaccacacag

SEQ ID NO: 1286403 - RNA, 21 nt, Human
caaaaucccgagccaagugca

SEQ ID NO: 1286404 - RNA, 21 nt, Human
caaaaugccucccaagaguga

SEQ ID NO: 1286405 - RNA, 21 nt, Human
cacaaguguagccaaaauccc

SEQ ID NO: 1286406 - RNA, 25 nt, Human
caggugccaccucuucuuaucacuc

SEQ ID NO: 1286407 - RNA, 22 nt, Human
cauuuuuguuuuuuuauggagg

SEQ ID NO: 1286408 - RNA, 18 nt, Human
cggccagggacagagcaa

SEQ ID NO: 1286409 - RNA, 27 nt, Human
cucaaaaugccucccaagagugaagca

SEQ ID NO: 1286410 - RNA, 20 nt, Human
cucuucucaaaaugccuccc

SEQ ID NO: 1286411 - RNA, 19 nt, Human
cuucaaccaaggaaguaag

SEQ ID NO: 1286412 - RNA, 28 nt, Human
gccuauccaauuucucucucaggcagcc

SEQ ID NO: 1286413 - RNA, 21 nt, Human
gucaccuuguauuuggaaguc

SEQ ID NO: 1286414 - RNA, 19 nt, Human
guccuuuuuuguuucauuu

SEQ ID NO: 1286415 - RNA, 21 nt, Human
guuuuguccuuuuuuguuuca

SEQ ID NO: 1286416 - RNA, 18 nt, Human
uauccaauuucucucuca

SEQ ID NO: 1286417 - RNA, 21 nt, Human
ucaaccaaggaaguaaggagg

SEQ ID NO: 1286418 - RNA, 21 nt, Human
ucauuuuucauuuccauuuuu

SEQ ID NO: 1286419 - RNA, 19 nt, Human
ucccgagccaagugcaaag

SEQ ID NO: 1286420 - RNA, 21 nt, Human
ucuccuacugcuuuggcugga

SEQ ID NO: 1286421 - RNA, 23 nt, Human
ucugugggguugaccacacaggu

SEQ ID NO: 1286422 - RNA, 20 nt, Human
ucuuugauuuugcucuucuc

SEQ ID NO: 1286423 - RNA, 22 nt, Human
ugaggcacucagguggggagag

SEQ ID NO: 1286424 - RNA, 20 nt, Human
ugcuuuggcuggaaacucug

SEQ ID NO: 1286425 - RNA, 21 nt, Human
uggaaguagaacuaagaaggg

SEQ ID NO: 1286426 - RNA, 20 nt, Human
uggcaagauguucuccuacu

SEQ ID NO: 1286427 - RNA, 28 nt, Human
uggcaagauguucuccuacugcuuuggc

SEQ ID NO: 1286428 - RNA, 19 nt, Human
uguuuuuuuauggaggguu

SEQ ID NO: 1286429 - RNA, 21 nt, Human
uucuuaucacuccaccuuggc

SEQ ID NO: 1286430 - RNA, 22 nt, Human
uuggaaguagaacuaagaaggg

SEQ ID NO: 1286431 - RNA, 20 nt, Human
uugucuggcaagauguucuc

SEQ ID NO: 1286432 - RNA, 25 nt, Human
uuuguuuuuuuauggaggguugggg

SEQ ID NO: 1286433 - RNA, 19 nt, Human
acacugauacuuggcuagg

SEQ ID NO: 1286434 - RNA, 18 nt, Human
acccaggucagugucuga

SEQ ID NO: 1286435 - RNA, 18 nt, Human
aggaagaggacccagguc

SEQ ID NO: 1286436 - RNA, 18 nt, Human
aggauucuuuguggccuc

SEQ ID NO: 1286437 - RNA, 24 nt, Human
auccuauccaccaaagacugguua

SEQ ID NO: 1286438 - RNA, 24 nt, Human
cagguccaauccuauccaccaaag

SEQ ID NO: 1286439 - RNA, 24 nt, Human
ccaggauucuuuguggccucuucc

SEQ ID NO: 1286440 - RNA, 21 nt, Human
gaaaguaaaggagcuagaggc

SEQ ID NO: 1286441 - RNA, 22 nt, Human
gaacugaaguuauucacagcaa

SEQ ID NO: 1286442 - RNA, 23 nt, Human
gagaaaguaaaggagcuagaggc

SEQ ID NO: 1286443 - RNA, 18 nt, Human
gcccuacccugagagucu

SEQ ID NO: 1286444 - RNA, 23 nt, Human
gggaacaggaagaggacccaggu

SEQ ID NO: 1286445 - RNA, 23 nt, Human
uccaauccuauccaccaaagacu

SEQ ID NO: 1286446 - RNA, 22 nt, Human
uccacaggagaaaguaaaggag

SEQ ID NO: 1286447 - RNA, 27 nt, Human
ugaagggaacaggaagaggacccaggu

SEQ ID NO: 1286448 - RNA, 18 nt, Human
ugacuugcugaagggaac

SEQ ID NO: 1286449 - RNA, 20 nt, Human
uggcuaggguguaugacuug

SEQ ID NO: 1286450 - RNA, 24 nt, Human
agcuguguucuggaaggagauggg

SEQ ID NO: 1286451 - RNA, 24 nt, Human
aggcgggaccaucucuccaggaga

SEQ ID NO: 1286452 - RNA, 20 nt, Human
caggcuggcaugcagggaga

SEQ ID NO: 1286453 - RNA, 18 nt, Human
ccaucucuccaggagacc

SEQ ID NO: 1286454 - RNA, 24 nt, Human
cccacagcuggagcugacugcgac

SEQ ID NO: 1286455 - RNA, 20 nt, Human
cuccgcaggggccuugugcc

SEQ ID NO: 1286456 - RNA, 22 nt, Human
cuccugaugcuuccagcugugu

SEQ ID NO: 1286457 - RNA, 23 nt, Human
cugacugcgaccaggucuucucc

SEQ ID NO: 1286458 - RNA, 20 nt, Human
cuugugccccacagcuggag

SEQ ID NO: 1286459 - RNA, 19 nt, Human
uaagcaggcuggcaugcag

SEQ ID NO: 1286460 - RNA, 21 nt, Human
ucuccugaugcuuccagcugu

SEQ ID NO: 1286461 - RNA, 19 nt, Human
ugagcuccgcaggggccuu

SEQ ID NO: 1286462 - RNA, 18 nt, Human
uggaaggagaugggucug

SEQ ID NO: 1286463 - RNA, 19 nt, Human
uguucuggaaggagauggg

SEQ ID NO: 1286464 - RNA, 23 nt, Human
cucuggguucucugaagaugucu

SEQ ID NO: 1286465 - RNA, 21 nt, Human
ucugaagaugucuccccuguc

SEQ ID NO: 1286466 - RNA, 18 nt, Human
aaacaacuggaaaccaga

SEQ ID NO: 1286467 - RNA, 23 nt, Human
aaacaacuggaaaccagagaccc

SEQ ID NO: 1286468 - RNA, 22 nt, Human
aacaacuggaaaccagagaccc

SEQ ID NO: 1286469 - RNA, 21 nt, Human
aaacuuggaagaacaaguucu

SEQ ID NO: 1286470 - RNA, 19 nt, Human
aacaaggaaacuuggaaga

SEQ ID NO: 1286471 - RNA, 19 nt, Human
aagaaaacaaaauaugaga

SEQ ID NO: 1286472 - RNA, 27 nt, Human
aauaagaaaacaaaauaugagaaggga

SEQ ID NO: 1286473 - RNA, 23 nt, Human
acaaaauaugagaagggagaagc

SEQ ID NO: 1286474 - RNA, 19 nt, Human
acaggaggaugugcauagg

SEQ ID NO: 1286475 - RNA, 20 nt, Human
acccauuuagcccucucgcu

SEQ ID NO: 1286476 - RNA, 22 nt, Human
acccuaaaaaugacccagcaca

SEQ ID NO: 1286477 - RNA, 18 nt, Human
accugggagggaaggccc

SEQ ID NO: 1286478 - RNA, 20 nt, Human
agagauggacccauuuagcc

SEQ ID NO: 1286479 - RNA, 23 nt, Human
agagauggacccauuuagcccuc

SEQ ID NO: 1286480 - RNA, 21 nt, Human
agauccuaucacccacucuuc

SEQ ID NO: 1286481 - RNA, 19 nt, Human
aggacaaggacaaccuuga

SEQ ID NO: 1286482 - RNA, 24 nt, Human
agugugggcaccauaaggaaaugu

SEQ ID NO: 1286483 - RNA, 18 nt, Human
auaggacaaggacaaccu

SEQ ID NO: 1286484 - RNA, 29 nt, Human
auauguguguguguauguaugugugugug

SEQ ID NO: 1286485 - RNA, 19 nt, Human
augccaaauccaaaguuuu

SEQ ID NO: 1286486 - RNA, 20 nt, Human
augugcauagguuauaugca

SEQ ID NO: 1286487 - RNA, 20 nt, Human
auguguguguguauguaugu

SEQ ID NO: 1286488 - RNA, 22 nt, Human
augugugugugugugugugugu

SEQ ID NO: 1286489 - RNA, 23 nt, Human
auguguguguguguguguguguu

SEQ ID NO: 1286490 - RNA, 20 nt, Human
caaaagacccccuacaccuc

SEQ ID NO: 1286491 - RNA, 22 nt, Human
caaaagacccccuacaccucac

SEQ ID NO: 1286492 - RNA, 18 nt, Human
caccgcggccagcgcccc

SEQ ID NO: 1286493 - RNA, 25 nt, Human
caccgcucagccucugaauaucuuu

SEQ ID NO: 1286494 - RNA, 19 nt, Human
cagcaacugagcacucccu

SEQ ID NO: 1286495 - RNA, 21 nt, Human
cagcacauguccagccaccuc

SEQ ID NO: 1286496 - RNA, 20 nt, Human
cagcaccgcggccagcgccc

SEQ ID NO: 1286497 - RNA, 21 nt, Human
caggcccugggcugggguccc

SEQ ID NO: 1286498 - RNA, 19 nt, Human
caggcuucaggccuauagu

SEQ ID NO: 1286499 - RNA, 21 nt, Human
cagggcaccaggugagguccc

SEQ ID NO: 1286500 - RNA, 21 nt, Human
cagggccugcuggcgccgccc

SEQ ID NO: 1286501 - RNA, 22 nt, Human
cagggccugcuggcgccgcccu

SEQ ID NO: 1286502 - RNA, 25 nt, Human
cauguccagccaccucuucagugcc

SEQ ID NO: 1286503 - RNA, 23 nt, Human
ccaagcccaccagggccugcugg

SEQ ID NO: 1286504 - RNA, 24 nt, Human
ccagccaccucuucagugcccucu

SEQ ID NO: 1286505 - RNA, 18 nt, Human
cccccuacaccucacccu

SEQ ID NO: 1286506 - RNA, 21 nt, Human
cccccuacaccucacccuaaa

SEQ ID NO: 1286507 - RNA, 21 nt, Human
ccccgcccccuccuccguccg

SEQ ID NO: 1286508 - RNA, 22 nt, Human
ccccuccauuccuuaccccccu

SEQ ID NO: 1286509 - RNA, 19 nt, Human
cccgcccccuccuccgucc

SEQ ID NO: 1286510 - RNA, 19 nt, Human
cccuaaaaaugacccagca

SEQ ID NO: 1286511 - RNA, 23 nt, Human
cccuagagauggacccauuuagc

SEQ ID NO: 1286512 - RNA, 20 nt, Human
ccguuucagcaccgcggcca

SEQ ID NO: 1286513 - RNA, 23 nt, Human
ccucugaauaucuuugaaguggg

SEQ ID NO: 1286514 - RNA, 19 nt, Human
cgagagccccgcccccucc

SEQ ID NO: 1286515 - RNA, 18 nt, Human
cgcccccuccuccguccg

SEQ ID NO: 1286516 - RNA, 21 nt, Human
cgucucccucuucccggcuca

SEQ ID NO: 1286517 - RNA, 21 nt, Human
cuagagauggacccauuuagc

SEQ ID NO: 1286518 - RNA, 18 nt, Human
cuccagucuccugccucc

SEQ ID NO: 1286519 - RNA, 19 nt, Human
cucccaagcccaccagggc

SEQ ID NO: 1286520 - RNA, 19 nt, Human
cuccugccuccucccaagc

SEQ ID NO: 1286521 - RNA, 24 nt, Human
cugaagaauuugauucccuaguuu

SEQ ID NO: 1286522 - RNA, 18 nt, Human
cugaagcugguagccagu

SEQ ID NO: 1286523 - RNA, 23 nt, Human
cugaagcugguagccaguucugg

SEQ ID NO: 1286524 - RNA, 22 nt, Human
cugauggccccuccauuccuua

SEQ ID NO: 1286525 - RNA, 21 nt, Human
cugcaccgcucagccucugaa

SEQ ID NO: 1286526 - RNA, 21 nt, Human
gaaccaaucccccuauagaug

SEQ ID NO: 1286527 - RNA, 27 nt, Human
gagagagugugugugugugugugugug

SEQ ID NO: 1286528 - RNA, 18 nt, Human
gaggccuagaagcagguc

SEQ ID NO: 1286529 - RNA, 20 nt, Human
gcaccaggugaggucccuuc

SEQ ID NO: 1286530 - RNA, 18 nt, Human
gcccugcccgucucccuc

SEQ ID NO: 1286531 - RNA, 25 nt, Human
gcccugcccgucucccucuucccgg

SEQ ID NO: 1286532 - RNA, 22 nt, Human
ggaggaaaaaagucugcagaga

SEQ ID NO: 1286533 - RNA, 20 nt, Human
ggaggaggcugaggucaggg

SEQ ID NO: 1286534 - RNA, 22 nt, Human
ggggauccuggaaccaaucccc

SEQ ID NO: 1286535 - RNA, 24 nt, Human
guguguguauauauaugugugugu

SEQ ID NO: 1286536 - RNA, 24 nt, Human
guguguguauauauaugugugugu

SEQ ID NO: 1286537 - RNA, 20 nt, Human
gugugugugugugugugugu

SEQ ID NO: 1286538 - RNA, 21 nt, Human
gugugugugugugugugugug

SEQ ID NO: 1286539 - RNA, 21 nt, Human
gugugugugugugugugugug

SEQ ID NO: 1286540 - RNA, 21 nt, Human
gugugugugugugugugugug

SEQ ID NO: 1286541 - RNA, 20 nt, Human
guuuggggaggaggcugagg

SEQ ID NO: 1286542 - RNA, 24 nt, Human
uacaccucacccuaaaaaugaccc

SEQ ID NO: 1286543 - RNA, 24 nt, Human
uacauagcauuuacauuguauuag

SEQ ID NO: 1286544 - RNA, 25 nt, Human
uagagauggacccauuuagcccucu

SEQ ID NO: 1286545 - RNA, 20 nt, Human
uauaacaaauuacuugaaca

SEQ ID NO: 1286546 - RNA, 20 nt, Human
uauaacaaauuacuugaaca

SEQ ID NO: 1286547 - RNA, 24 nt, Human
uauagaugacuauaugccaaaucc

SEQ ID NO: 1286548 - RNA, 21 nt, Human
uauauauauguguguguguau

SEQ ID NO: 1286549 - RNA, 21 nt, Human
uauauauauguguguguguau

SEQ ID NO: 1286550 - RNA, 20 nt, Human
uauauguguguguguaugua

SEQ ID NO: 1286551 - RNA, 21 nt, Human
uauauguguguguguauguau

SEQ ID NO: 1286552 - RNA, 24 nt, Human
uauguaugugugugugugugugag

SEQ ID NO: 1286553 - RNA, 23 nt, Human
uauguaugugugugugugugugu

SEQ ID NO: 1286554 - RNA, 23 nt, Human
uauguaugugugugugugugugu

SEQ ID NO: 1286555 - RNA, 21 nt, Human
uauguguguguguauguaugu

SEQ ID NO: 1286556 - RNA, 18 nt, Human
uaugugugugugugugug

SEQ ID NO: 1286557 - RNA, 23 nt, Human
uaugugugugugugugugugugu

SEQ ID NO: 1286558 - RNA, 24 nt, Human
uaugugugugugugugugugugug

SEQ ID NO: 1286559 - RNA, 24 nt, Human
uauuauaaguaaucuagagaugau

SEQ ID NO: 1286560 - RNA, 18 nt, Human
ucacugcaguucugcuuc

SEQ ID NO: 1286561 - RNA, 19 nt, Human
ucaggccuauaguagccag

SEQ ID NO: 1286562 - RNA, 22 nt, Human
ucccaagcccaccagggccugc

SEQ ID NO: 1286563 - RNA, 19 nt, Human
uccccagcaacugagcacu

SEQ ID NO: 1286564 - RNA, 25 nt, Human
ucccucuucccggcucacggcuccc

SEQ ID NO: 1286565 - RNA, 18 nt, Human
ucccugcaccgcucagcc

SEQ ID NO: 1286566 - RNA, 18 nt, Human
uccguagcuuuguggaug

SEQ ID NO: 1286567 - RNA, 19 nt, Human
uccuccguccgcggagggc

SEQ ID NO: 1286568 - RNA, 24 nt, Human
ucuccagucuccugccuccuccca

SEQ ID NO: 1286569 - RNA, 19 nt, Human
ucuccugccuccucccaag

SEQ ID NO: 1286570 - RNA, 22 nt, Human
ucucugaagaauuugauucccu

SEQ ID NO: 1286571 - RNA, 18 nt, Human
ugaagcugguagccaguu

SEQ ID NO: 1286572 - RNA, 22 nt, Human
ugaagcugguagccaguucugg

SEQ ID NO: 1286573 - RNA, 24 nt, Human
ugacuauaugccaaauccaaaguu

SEQ ID NO: 1286574 - RNA, 20 nt, Human
ugagagagagagagagugug

SEQ ID NO: 1286575 - RNA, 22 nt, Human
ugagcacucccugcaccgcuca

SEQ ID NO: 1286576 - RNA, 20 nt, Human
ugaggacuugggcauccaug

SEQ ID NO: 1286577 - RNA, 21 nt, Human
ugagggcagcaggcccugggc

SEQ ID NO: 1286578 - RNA, 19 nt, Human
ugauggccccuccauuccu

SEQ ID NO: 1286579 - RNA, 23 nt, Human
ugccaggugccuguguccgcucu

SEQ ID NO: 1286580 - RNA, 18 nt, Human
uggcgccgcccugcccgu

SEQ ID NO: 1286581 - RNA, 20 nt, Human
uggggaggaggcugagguca

SEQ ID NO: 1286582 - RNA, 22 nt, Human
uguauauauaugugugugugua

SEQ ID NO: 1286583 - RNA, 22 nt, Human
uguauauauaugugugugugua

SEQ ID NO: 1286584 - RNA, 19 nt, Human
uguauguaugugugugugu

SEQ ID NO: 1286585 - RNA, 21 nt, Human
uguauguaugugugugugugu

SEQ ID NO: 1286586 - RNA, 25 nt, Human
uguauguaugugugugugugugugg

SEQ ID NO: 1286587 - RNA, 25 nt, Human
uguaugugugugugugugugugugg

SEQ ID NO: 1286588 - RNA, 19 nt, Human
ugugauauuuggcucccgg

SEQ ID NO: 1286589 - RNA, 23 nt, Human
ugugauauuuggcucccgggagg

SEQ ID NO: 1286590 - RNA, 19 nt, Human
uguguauauauaugugugu

SEQ ID NO: 1286591 - RNA, 19 nt, Human
uguguauauauaugugugu

SEQ ID NO: 1286592 - RNA, 19 nt, Human
uguguauauauaugugugu

SEQ ID NO: 1286593 - RNA, 19 nt, Human
uguguauauauaugugugu

SEQ ID NO: 1286594 - RNA, 21 nt, Human
uguguauauauaugugugugu

SEQ ID NO: 1286595 - RNA, 21 nt, Human
uguguauauauaugugugugu

SEQ ID NO: 1286596 - RNA, 22 nt, Human
uguguauauauaugugugugug

SEQ ID NO: 1286597 - RNA, 22 nt, Human
uguguauauauaugugugugug

SEQ ID NO: 1286598 - RNA, 24 nt, Human
uguguauauauaugugugugugua

SEQ ID NO: 1286599 - RNA, 24 nt, Human
uguguauauauaugugugugugua

SEQ ID NO: 1286600 - RNA, 19 nt, Human
uguguauguaugugugugu

SEQ ID NO: 1286601 - RNA, 19 nt, Human
uguguauguaugugugugu

SEQ ID NO: 1286602 - RNA, 21 nt, Human
uguguauguaugugugugugu

SEQ ID NO: 1286603 - RNA, 22 nt, Human
uguguauguaugugugugugug

SEQ ID NO: 1286604 - RNA, 19 nt, Human
uguguguauauauaugugu

SEQ ID NO: 1286605 - RNA, 19 nt, Human
uguguguauauauaugugu

SEQ ID NO: 1286606 - RNA, 21 nt, Human
uguguguauauauaugugugu

SEQ ID NO: 1286607 - RNA, 21 nt, Human
uguguguauauauaugugugu

SEQ ID NO: 1286608 - RNA, 23 nt, Human
uguguguauauauauguguguug

SEQ ID NO: 1286609 - RNA, 23 nt, Human
uguguguauauauauguguguug

SEQ ID NO: 1286610 - RNA, 19 nt, Human
uguguguauguaugugugu

SEQ ID NO: 1286611 - RNA, 23 nt, Human
uguguguauguaugugugugugu

SEQ ID NO: 1286612 - RNA, 24 nt, Human
uguguguauguaugugugugugug

SEQ ID NO: 1286613 - RNA, 31 nt, Human
uguguguauguaugugugugugugugugugg

SEQ ID NO: 1286614 - RNA, 21 nt, Human
uguguguguauauauaugugu

SEQ ID NO: 1286615 - RNA, 21 nt, Human
uguguguguauauauaugugu

SEQ ID NO: 1286616 - RNA, 23 nt, Human
uguguguguauauauaugugugu

SEQ ID NO: 1286617 - RNA, 23 nt, Human
uguguguguauauauaugugugu

SEQ ID NO: 1286618 - RNA, 21 nt, Human
uguguguguguauauauaugu

SEQ ID NO: 1286619 - RNA, 21 nt, Human
uguguguguguauauauaugu

SEQ ID NO: 1286620 - RNA, 25 nt, Human
uguguguguguauauauauguguca

SEQ ID NO: 1286621 - RNA, 25 nt, Human
uguguguguguauauauauguguca

SEQ ID NO: 1286622 - RNA, 24 nt, Human
uguguguguguauauauaugugug

SEQ ID NO: 1286623 - RNA, 24 nt, Human
uguguguguguauauauaugugug

SEQ ID NO: 1286624 - RNA, 20 nt, Human
uguguguguguauguaugug

SEQ ID NO: 1286625 - RNA, 23 nt, Human
uguguguguguauguaugugugu

SEQ ID NO: 1286626 - RNA, 18 nt, Human
uguguguguguguguaua

SEQ ID NO: 1286627 - RNA, 18 nt, Human
uguguguguguguguaua

SEQ ID NO: 1286628 - RNA, 20 nt, Human
uguguguguguguguauaua

SEQ ID NO: 1286629 - RNA, 20 nt, Human
uguguguguguguguauaua

SEQ ID NO: 1286630 - RNA, 18 nt, Human
ugugugugugugugugug

SEQ ID NO: 1286631 - RNA, 18 nt, Human
ugugugugugugugugug

SEQ ID NO: 1286632 - RNA, 18 nt, Human
ugugugugugugugugug

SEQ ID NO: 1286633 - RNA, 18 nt, Human
ugugugugugugugugug

SEQ ID NO: 1286634 - RNA, 18 nt, Human
ugugugugugugugugug

SEQ ID NO: 1286635 - RNA, 18 nt, Human
ugugugugugugugugug

SEQ ID NO: 1286636 - RNA, 18 nt, Human
ugugugugugugugugug

SEQ ID NO: 1286637 - RNA, 18 nt, Human
ugugugugugugugugug

SEQ ID NO: 1286638 - RNA, 18 nt, Human
ugugugugugugugugug

SEQ ID NO: 1286639 - RNA, 18 nt, Human
ugugugugugugugugug

SEQ ID NO: 1286640 - RNA, 18 nt, Human
ugugugugugugugugug

SEQ ID NO: 1286641 - RNA, 18 nt, Human
ugugugugugugugugug

SEQ ID NO: 1286642 - RNA, 18 nt, Human
ugugugugugugugugug

SEQ ID NO: 1286643 - RNA, 18 nt, Human
ugugugugugugugugug

SEQ ID NO: 1286644 - RNA, 18 nt, Human
ugugugugugugugugug

SEQ ID NO: 1286645 - RNA, 18 nt, Human
ugugugugugugugugug

SEQ ID NO: 1286646 - RNA, 24 nt, Human
uguguguguguguguguguauaua

SEQ ID NO: 1286647 - RNA, 24 nt, Human
uguguguguguguguguguauaua

SEQ ID NO: 1286648 - RNA, 21 nt, Human
ugugugugugugugugugugu

SEQ ID NO: 1286649 - RNA, 21 nt, Human
ugugugugugugugugugugu

SEQ ID NO: 1286650 - RNA, 21 nt, Human
ugugugugugugugugugugu

SEQ ID NO: 1286651 - RNA, 21 nt, Human
ugugugugugugugugugugu

SEQ ID NO: 1286652 - RNA, 21 nt, Human
ugugugugugugugugugugu

SEQ ID NO: 1286653 - RNA, 21 nt, Human
ugugugugugugugugugugu

SEQ ID NO: 1286654 - RNA, 21 nt, Human
ugugugugugugugugugugu

SEQ ID NO: 1286655 - RNA, 21 nt, Human
ugugugugugugugugugugu

SEQ ID NO: 1286656 - RNA, 21 nt, Human
ugugugugugugugugugugu

SEQ ID NO: 1286657 - RNA, 21 nt, Human
ugugugugugugugugugugu

SEQ ID NO: 1286658 - RNA, 21 nt, Human
ugugugugugugugugugugu

SEQ ID NO: 1286659 - RNA, 21 nt, Human
ugugugugugugugugugugu

SEQ ID NO: 1286660 - RNA, 21 nt, Human
ugugugugugugugugugugu

SEQ ID NO: 1286661 - RNA, 21 nt, Human
ugugugugugugugugugugu

SEQ ID NO: 1286662 - RNA, 21 nt, Human
ugugugugugugugugugugu

SEQ ID NO: 1286663 - RNA, 21 nt, Human
ugugugugugugugugugugu

SEQ ID NO: 1286664 - RNA, 21 nt, Human
ugugugugugugugugugugu

SEQ ID NO: 1286665 - RNA, 21 nt, Human
ugugugugugugugugugugu

SEQ ID NO: 1286666 - RNA, 21 nt, Human
ugugugugugugugugugugu

SEQ ID NO: 1286667 - RNA, 21 nt, Human
ugugugugugugugugugugu

SEQ ID NO: 1286668 - RNA, 21 nt, Human
ugugugugugugugugugugu

SEQ ID NO: 1286669 - RNA, 21 nt, Human
ugugugugugugugugugugu

SEQ ID NO: 1286670 - RNA, 21 nt, Human
ugugugugugugugugugugu

SEQ ID NO: 1286671 - RNA, 22 nt, Human
ugugugugugugugugugugua

SEQ ID NO: 1286672 - RNA, 22 nt, Human
ugugugugugugugugugugua

SEQ ID NO: 1286673 - RNA, 22 nt, Human
ugugugugugugugugugugug

SEQ ID NO: 1286674 - RNA, 22 nt, Human
ugugugugugugugugugugug

SEQ ID NO: 1286675 - RNA, 22 nt, Human
ugugugugugugugugugugug

SEQ ID NO: 1286676 - RNA, 22 nt, Human
ugugugugugugugugugugug

SEQ ID NO: 1286677 - RNA, 22 nt, Human
ugugugugugugugugugugug

SEQ ID NO: 1286678 - RNA, 22 nt, Human
ugugugugugugugugugugug

SEQ ID NO: 1286679 - RNA, 22 nt, Human
ugugugugugugugugugugug

SEQ ID NO: 1286680 - RNA, 22 nt, Human
ugugugugugugugugugugug

SEQ ID NO: 1286681 - RNA, 18 nt, Human
uucaaggcaaggggaaga

SEQ ID NO: 1286682 - RNA, 20 nt, Human
uugccaggugccuguguccg

SEQ ID NO: 1286683 - RNA, 23 nt, Human
uuggcaucugcaggggauccugg

SEQ ID NO: 1286684 - RNA, 27 nt, Human
uuguggauggaggccuagaagcagguc

SEQ ID NO: 1286685 - RNA, 24 nt, Human
uuuaguguuauaauaaaaggcuuc

SEQ ID NO: 1286686 - RNA, 25 nt, Human
uuugaagugggucacugcaguucug

SEQ ID NO: 1286687 - RNA, 19 nt, Human
uuugcugcuguguggaacu

SEQ ID NO: 1286688 - RNA, 19 nt, Human
aagcaccgggugaaaagag

SEQ ID NO: 1286689 - RNA, 18 nt, Human
agaagcaccgggugaaaa

SEQ ID NO: 1286690 - RNA, 22 nt, Human
agcugcuuugggacgccugggu

SEQ ID NO: 1286691 - RNA, 25 nt, Human
auggcggcccccagcugcuuuggga

SEQ ID NO: 1286692 - RNA, 18 nt, Human
caaaauggcggcccccag

SEQ ID NO: 1286693 - RNA, 19 nt, Human
caccgggugaaaagagcuc

SEQ ID NO: 1286694 - RNA, 20 nt, Human
cagaagugggcugcccugcg

SEQ ID NO: 1286695 - RNA, 20 nt, Human
cggcaaaauggcggccccca

SEQ ID NO: 1286696 - RNA, 24 nt, Human
cgguugggccccaggcaggaaguu

SEQ ID NO: 1286697 - RNA, 21 nt, Human
gacgaugagggaaggcgaaga

SEQ ID NO: 1286698 - RNA, 21 nt, Human
gccccaggcaggaaguuucug

SEQ ID NO: 1286699 - RNA, 21 nt, Human
gcugagggagcuuuuuggugg

SEQ ID NO: 1286700 - RNA, 23 nt, Human
ucuugccuuuuugcuccacaugg

SEQ ID NO: 1286701 - RNA, 21 nt, Human
ugccguacggcaaaauggcgg

SEQ ID NO: 1286702 - RNA, 19 nt, Human
ugcuuugggacgccugggu

SEQ ID NO: 1286703 - RNA, 22 nt, Human
ugcuuugggacgccuggguucg

SEQ ID NO: 1286704 - RNA, 24 nt, Human
uggcggagucguagaagcaccggg

SEQ ID NO: 1286705 - RNA, 24 nt, Human
uuccagcgccaaacaccaggguac

SEQ ID NO: 1286706 - RNA, 20 nt, Human
uuuuugcuccacaugguggu

SEQ ID NO: 1286707 - RNA, 24 nt, Human
ucuugcuuccagcaucagccugga

SEQ ID NO: 1286708 - RNA, 18 nt, Human
aagaaccuuuagccaacg

SEQ ID NO: 1286709 - RNA, 20 nt, Human
aaguaauacugcuguugcuu

SEQ ID NO: 1286710 - RNA, 21 nt, Human
aauacaaucuccaaagaaccu

SEQ ID NO: 1286711 - RNA, 22 nt, Human
caaagaaccuuuagccaacgug

SEQ ID NO: 1286712 - RNA, 22 nt, Human
caaucuccaaagaaccuuuagc

SEQ ID NO: 1286713 - RNA, 20 nt, Human
caccauugcucuuuuggguu

SEQ ID NO: 1286714 - RNA, 18 nt, Human
cacugugcuucccccugc

SEQ ID NO: 1286715 - RNA, 19 nt, Human
caguggcuuuuuugauguu

SEQ ID NO: 1286716 - RNA, 20 nt, Human
cccugcuuguccuuuuccuc

SEQ ID NO: 1286717 - RNA, 23 nt, Human
cucuuuggucucacauuuuucau

SEQ ID NO: 1286718 - RNA, 18 nt, Human
cuguuuccugccuuuuuu

SEQ ID NO: 1286719 - RNA, 21 nt, Human
cuuuggucucacauuuuucau

SEQ ID NO: 1286720 - RNA, 23 nt, Human
cuuuucaccauugcucuuuuggg

SEQ ID NO: 1286721 - RNA, 21 nt, Human
gagagucguucaguuucucca

SEQ ID NO: 1286722 - RNA, 19 nt, Human
uccaaguauugaauggaag

SEQ ID NO: 1286723 - RNA, 19 nt, Human
uccaaguauugaauggaag

SEQ ID NO: 1286724 - RNA, 19 nt, Human
uccaauacaaucuccaaag

SEQ ID NO: 1286725 - RNA, 21 nt, Human
uccuuugcugugauugcuccu

SEQ ID NO: 1286726 - RNA, 23 nt, Human
ucuuuggucucacauuuuucauu

SEQ ID NO: 1286727 - RNA, 20 nt, Human
ugauguuugcagguccaagu

SEQ ID NO: 1286728 - RNA, 22 nt, Human
ugcuccuuucucuuuggucuca

SEQ ID NO: 1286729 - RNA, 19 nt, Human
ugcugugauugcuccuuuc

SEQ ID NO: 1286730 - RNA, 24 nt, Human
uuccuguuuccugccuuuuuuguu

SEQ ID NO: 1286731 - RNA, 22 nt, Human
uucuuuucaccauugcucuuuu

SEQ ID NO: 1286732 - RNA, 19 nt, Human
uuggguuuugucuuuggaa

SEQ ID NO: 1286733 - RNA, 20 nt, Human
uuuuuuguuguagccacugu

SEQ ID NO: 1286734 - RNA, 21 nt, Human
aaaugggguccuuuguccauu

SEQ ID NO: 1286735 - RNA, 19 nt, Human
acaagaguagcgcuggcug

SEQ ID NO: 1286736 - RNA, 22 nt, Human
acaccccagacucaucucccuc

SEQ ID NO: 1286737 - RNA, 18 nt, Human
acagagccacagccacac

SEQ ID NO: 1286738 - RNA, 19 nt, Human
agaguccuucuggggcuuc

SEQ ID NO: 1286739 - RNA, 20 nt, Human
aggcucugcugggaauggug

SEQ ID NO: 1286740 - RNA, 19 nt, Human
aggcucugcuggggauagu

SEQ ID NO: 1286741 - RNA, 19 nt, Human
aggcucugcuggggauagu

SEQ ID NO: 1286742 - RNA, 19 nt, Human
aggcucugcuggggauagu

SEQ ID NO: 1286743 - RNA, 19 nt, Human
aggcucugcuggggauggu

SEQ ID NO: 1286744 - RNA, 19 nt, Human
aggcucugcuggggauggu

SEQ ID NO: 1286745 - RNA, 19 nt, Human
aggcucugcuggggauggu

SEQ ID NO: 1286746 - RNA, 19 nt, Human
aggcucugcuggggauggu

SEQ ID NO: 1286747 - RNA, 19 nt, Human
aggcuuugcuggggauggu

SEQ ID NO: 1286748 - RNA, 18 nt, Human
agucuuuucuccauguuc

SEQ ID NO: 1286749 - RNA, 21 nt, Human
augauuaucuguagagcuuuu

SEQ ID NO: 1286750 - RNA, 22 nt, Human
caaaugggguccuuuguccauu

SEQ ID NO: 1286751 - RNA, 22 nt, Human
caaaugggguccuuuguccauu

SEQ ID NO: 1286752 - RNA, 22 nt, Human
caaaugggguccuuuuuccauu

SEQ ID NO: 1286753 - RNA, 22 nt, Human
cagcggauucuuuauguguggu

SEQ ID NO: 1286754 - RNA, 25 nt, Human
caguggaguccuuucugcguguucu

SEQ ID NO: 1286755 - RNA, 25 nt, Human
caguggaguccuuucuucguguucu

SEQ ID NO: 1286756 - RNA, 25 nt, Human
cagugggguccuuucuccauguucu

SEQ ID NO: 1286757 - RNA, 25 nt, Human
cagugggguccuuucuccguguucu

SEQ ID NO: 1286758 - RNA, 25 nt, Human
cagugggguccuuucuccguguucu

SEQ ID NO: 1286759 - RNA, 25 nt, Human
ccaaaggucuuccaguuuuaucuga

SEQ ID NO: 1286760 - RNA, 18 nt, Human
ccaaggccugcaggccca

SEQ ID NO: 1286761 - RNA, 22 nt, Human
ccacaccccagacucaucuccc

SEQ ID NO: 1286762 - RNA, 23 nt, Human
ccacagccacaccccagacucau

SEQ ID NO: 1286763 - RNA, 24 nt, Human
ccacagccacaccccagacucauc

SEQ ID NO: 1286764 - RNA, 22 nt, Human
cccuugguugcuggaguuuucu

SEQ ID NO: 1286765 - RNA, 23 nt, Human
ccugcaggcccaggagcagcacc

SEQ ID NO: 1286766 - RNA, 18 nt, Human
ccugccccccaagaagcu

SEQ ID NO: 1286767 - RNA, 19 nt, Human
ccuggagugaggggaaaua

SEQ ID NO: 1286768 - RNA, 20 nt, Human
ccuggagugaggggaaauau

SEQ ID NO: 1286769 - RNA, 20 nt, Human
ccuuucucuauuuucuguag

SEQ ID NO: 1286770 - RNA, 20 nt, Human
ccuuucucuauuuucuguag

SEQ ID NO: 1286771 - RNA, 20 nt, Human
ccuuucucuauuuucuguag

SEQ ID NO: 1286772 - RNA, 20 nt, Human
ccuuucucuauuuucuguag

SEQ ID NO: 1286773 - RNA, 20 nt, Human
ccuuucucuauuuucuguag

SEQ ID NO: 1286774 - RNA, 20 nt, Human
ccuuucucuauuuucuguag

SEQ ID NO: 1286775 - RNA, 20 nt, Human
ccuuucucuauuuucuguag

SEQ ID NO: 1286776 - RNA, 20 nt, Human
ccuuucucuauuuucuguag

SEQ ID NO: 1286777 - RNA, 24 nt, Human
cuauguucuguagacucugcugca

SEQ ID NO: 1286778 - RNA, 20 nt, Human
cucauuggccaguggagucc

SEQ ID NO: 1286779 - RNA, 20 nt, Human
cucauuggccaguggagucc

SEQ ID NO: 1286780 - RNA, 20 nt, Human
cucugcugggaauggugugg

SEQ ID NO: 1286781 - RNA, 20 nt, Human
cucugcugggaauggugugg

SEQ ID NO: 1286782 - RNA, 20 nt, Human
cugcaggcccaggagcagca

SEQ ID NO: 1286783 - RNA, 25 nt, Human
cugcuggggauagugugguguucuc

SEQ ID NO: 1286784 - RNA, 25 nt, Human
cugcuggggauagugugguguucuc

SEQ ID NO: 1286785 - RNA, 25 nt, Human
cugcuggggauagugugguguucuc

SEQ ID NO: 1286786 - RNA, 25 nt, Human
cugcuggggaugaugugguguucuc

SEQ ID NO: 1286787 - RNA, 25 nt, Human
cugcuggggauggugugguguucuc

SEQ ID NO: 1286788 - RNA, 25 nt, Human
cugcuggggauggugugguguucuc

SEQ ID NO: 1286789 - RNA, 20 nt, Human
cuggaaaagaugugcuuuuu

SEQ ID NO: 1286790 - RNA, 21 nt, Human
cuggcaggccuucuugauacc

SEQ ID NO: 1286791 - RNA, 19 nt, Human
cuucucauuggccaaugga

SEQ ID NO: 1286792 - RNA, 23 nt, Human
cuucucauuggccaauggagucc

SEQ ID NO: 1286793 - RNA, 20 nt, Human
cuuuaugugugguaguggag

SEQ ID NO: 1286794 - RNA, 21 nt, Human
gacucaucucccuccggaacu

SEQ ID NO: 1286795 - RNA, 21 nt, Human
gacugucguuucuccauguuc

SEQ ID NO: 1286796 - RNA, 18 nt, Human
gagccacagccacacccc

SEQ ID NO: 1286797 - RNA, 21 nt, Human
gccuguaggcuugucaguugg

SEQ ID NO: 1286798 - RNA, 21 nt, Human
gcucugcugggaauagugugg

SEQ ID NO: 1286799 - RNA, 20 nt, Human
gggaauggugcgguguucuc

SEQ ID NO: 1286800 - RNA, 23 nt, Human
gggaauggugcgguguucucauu

SEQ ID NO: 1286801 - RNA, 23 nt, Human
gguguucucauuggccaguggag

SEQ ID NO: 1286802 - RNA, 23 nt, Human
gguguucucauuggccaguggag

SEQ ID NO: 1286803 - RNA, 20 nt, Human
guccuuuuuccauuuucugu

SEQ ID NO: 1286804 - RNA, 25 nt, Human
gugcuggggauggugugguguucuc

SEQ ID NO: 1286805 - RNA, 24 nt, Human
guggagucagcaggaucaacagag

SEQ ID NO: 1286806 - RNA, 22 nt, Human
uaaaugggguccuuucuccauu

SEQ ID NO: 1286807 - RNA, 22 nt, Human
uccauguucuguagacucuguu

SEQ ID NO: 1286808 - RNA, 24 nt, Human
uccauuuucuguaggcucugcuag

SEQ ID NO: 1286809 - RNA, 24 nt, Human
uccauuuucuguaggcucugcuag

SEQ ID NO: 1286810 - RNA, 24 nt, Human
uccauuuucuguaggcucugcuga

SEQ ID NO: 1286811 - RNA, 24 nt, Human
uccauuuucuguaggcucugcugg

SEQ ID NO: 1286812 - RNA, 24 nt, Human
uccauuuucuguaggcucugcugg

SEQ ID NO: 1286813 - RNA, 24 nt, Human
uccauuuucuguaggcucugcugg

SEQ ID NO: 1286814 - RNA, 24 nt, Human
uccauuuucuguaggcucugcugg

SEQ ID NO: 1286815 - RNA, 24 nt, Human
uccauuuucuguaggcugugcugg

SEQ ID NO: 1286816 - RNA, 21 nt, Human
uccccaguuuucugauauucu

SEQ ID NO: 1286817 - RNA, 18 nt, Human
uccggaacuggcaggccu

SEQ ID NO: 1286818 - RNA, 24 nt, Human
ucuauuuucuguaggcccugcugg

SEQ ID NO: 1286819 - RNA, 24 nt, Human
ucuauuuucuguaggcccugcugg

SEQ ID NO: 1286820 - RNA, 22 nt, Human
ucuauuuucuguaggcucugcc

SEQ ID NO: 1286821 - RNA, 24 nt, Human
ucuauuuucuguaggcucugcugg

SEQ ID NO: 1286822 - RNA, 24 nt, Human
ucuauuuucuguaggcucugcugg

SEQ ID NO: 1286823 - RNA, 24 nt, Human
ucuauuuucuguaggcucugcugg

SEQ ID NO: 1286824 - RNA, 24 nt, Human
ucuauuuucuguaggcucugcugg

SEQ ID NO: 1286825 - RNA, 24 nt, Human
ucuauuuucuguaggcucugcugg

SEQ ID NO: 1286826 - RNA, 24 nt, Human
ucuauuuucuguaggcucugcugg

SEQ ID NO: 1286827 - RNA, 24 nt, Human
ucuauuuucuguaggcucugcugg

SEQ ID NO: 1286828 - RNA, 24 nt, Human
ucuauuuucuguaggcucugcugg

SEQ ID NO: 1286829 - RNA, 24 nt, Human
ucuauuuucuguaggcucugcugg

SEQ ID NO: 1286830 - RNA, 24 nt, Human
ucucauuggccaauguagucuuuu

SEQ ID NO: 1286831 - RNA, 22 nt, Human
ucucauuggcugaugguguccu

SEQ ID NO: 1286832 - RNA, 19 nt, Human
ucuguaggcccugcugggg

SEQ ID NO: 1286833 - RNA, 22 nt, Human
ucuucagaagugggaggagccu

SEQ ID NO: 1286834 - RNA, 20 nt, Human
ucuucucauuggccaauggg

SEQ ID NO: 1286835 - RNA, 24 nt, Human
ugagacagaguccuucuggggcuu

SEQ ID NO: 1286836 - RNA, 19 nt, Human
ugaucucauuggccagugg

SEQ ID NO: 1286837 - RNA, 19 nt, Human
ugauguggucuucucauug

SEQ ID NO: 1286838 - RNA, 19 nt, Human
ugauguggucuucucauug

SEQ ID NO: 1286839 - RNA, 19 nt, Human
ugauguggucuucucauug

SEQ ID NO: 1286840 - RNA, 19 nt, Human
ugaugugguuuucucauug

SEQ ID NO: 1286841 - RNA, 19 nt, Human
ugaugugguuuucucauug

SEQ ID NO: 1286842 - RNA, 25 nt, Human
ugcagaacaaugugaucaaaaggga

SEQ ID NO: 1286843 - RNA, 27 nt, Human
ugcugaggaugauguggucgagccccu

SEQ ID NO: 1286844 - RNA, 27 nt, Human
ugcugaggaugauguggucgagccccu

SEQ ID NO: 1286845 - RNA, 27 nt, Human
ugcugaggaugauguggucgagccccu

SEQ ID NO: 1286846 - RNA, 27 nt, Human
ugcuggggaugauguggucgagccccu

SEQ ID NO: 1286847 - RNA, 27 nt, Human
ugcuggggaugauguggucgagccccu

SEQ ID NO: 1286848 - RNA, 27 nt, Human
ugcuggggaugauguggucgagccccu

SEQ ID NO: 1286849 - RNA, 26 nt, Human
ugcuggggaugauguggucgagcccu

SEQ ID NO: 1286850 - RNA, 24 nt, Human
ugcuggggaugauguggucuucuc

SEQ ID NO: 1286851 - RNA, 24 nt, Human
ugcuggggaugaugugguuuucuc

SEQ ID NO: 1286852 - RNA, 20 nt, Human
ugcuggggaugguguggccu

SEQ ID NO: 1286853 - RNA, 24 nt, Human
ugcuggggaugguguggucuucuc

SEQ ID NO: 1286854 - RNA, 24 nt, Human
ugcuggggaugguguggucuucuc

SEQ ID NO: 1286855 - RNA, 24 nt, Human
ugcuggggaugguguggucuucuc

SEQ ID NO: 1286856 - RNA, 23 nt, Human
ugcuuggucugugaauugccuga

SEQ ID NO: 1286857 - RNA, 19 nt, Human
uggaaggaaguuguagucu

SEQ ID NO: 1286858 - RNA, 19 nt, Human
uggaauguaguagcaccug

SEQ ID NO: 1286859 - RNA, 25 nt, Human
uggccaaaggaguccugucuccauu

SEQ ID NO: 1286860 - RNA, 22 nt, Human
uggccaauggggucauuucuuc

SEQ ID NO: 1286861 - RNA, 22 nt, Human
uggccgauggggucauuucuuc

SEQ ID NO: 1286862 - RNA, 22 nt, Human
uggcguuauauguuuuuuucca

SEQ ID NO: 1286863 - RNA, 19 nt, Human
ugguguggccuucucauug

SEQ ID NO: 1286864 - RNA, 19 nt, Human
ugguguggucuucucauug

SEQ ID NO: 1286865 - RNA, 19 nt, Human
ugguguggucuucucauug

SEQ ID NO: 1286866 - RNA, 19 nt, Human
ugguguggucuucucauug

SEQ ID NO: 1286867 - RNA, 19 nt, Human
ugguguggucuucucauug

SEQ ID NO: 1286868 - RNA, 19 nt, Human
ugguguggucuucucauug

SEQ ID NO: 1286869 - RNA, 19 nt, Human
ugguguggucuucucauug

SEQ ID NO: 1286870 - RNA, 19 nt, Human
ugguguggucuucucauug

SEQ ID NO: 1286871 - RNA, 23 nt, Human
uguaguuuuugucaggagcuugu

SEQ ID NO: 1286872 - RNA, 24 nt, Human
uguuggggauguugugguguucuc

SEQ ID NO: 1286873 - RNA, 25 nt, Human
uuacuggggauggugugguguucuc

SEQ ID NO: 1286874 - RNA, 23 nt, Human
uuccccaguuuucugauauucuu

SEQ ID NO: 1286875 - RNA, 24 nt, Human
uucuccauguucuguaggcuuuac

SEQ ID NO: 1286876 - RNA, 24 nt, Human
uucugcguguucuguaggcucugc

SEQ ID NO: 1286877 - RNA, 22 nt, Human
uugcuggagaugguauggucuu

SEQ ID NO: 1286878 - RNA, 22 nt, Human
uuucuuguuaccguugauuugc

SEQ ID NO: 1286879 - RNA, 19 nt, Human
uuuugcucuugggugcugg

SEQ ID NO: 1286880 - RNA, 20 nt, Human
aaacuccaaaagggagcugg

SEQ ID NO: 1286881 - RNA, 23 nt, Human
aaagggagcuggauuuagaccuc

SEQ ID NO: 1286882 - RNA, 25 nt, Human
acaaacuccaaaagggagggaacgc

SEQ ID NO: 1286883 - RNA, 23 nt, Human
agaauggcacaaacuccaaaagg

SEQ ID NO: 1286884 - RNA, 19 nt, Human
agggagcuggauuuagacc

SEQ ID NO: 1286885 - RNA, 19 nt, Human
ccagaagcuccuggaauga

SEQ ID NO: 1286886 - RNA, 22 nt, Human
cuccucugaauuuugcaaccug

SEQ ID NO: 1286887 - RNA, 18 nt, Human
gcugcugcucaaaucgga

SEQ ID NO: 1286888 - RNA, 23 nt, Human
uccaaaagggagcuggauuuaga

SEQ ID NO: 1286889 - RNA, 21 nt, Human
uccccauguagauaacgggau

SEQ ID NO: 1286890 - RNA, 22 nt, Human
uccuggaaugagcaggucuggc

SEQ ID NO: 1286891 - RNA, 19 nt, Human
uggaaugagcaggucuggc

SEQ ID NO: 1286892 - RNA, 21 nt, Human
uggcacaaacuccaaaaggga

SEQ ID NO: 1286893 - RNA, 19 nt, Human
uguuccuucucccagaagc

SEQ ID NO: 1286894 - RNA, 18 nt, Human
agcauggaaaaacuggug

SEQ ID NO: 1286895 - RNA, 19 nt, Human
augaagccuacacuccuga

SEQ ID NO: 1286896 - RNA, 19 nt, Human
auuugcaugaagccuacac

SEQ ID NO: 1286897 - RNA, 24 nt, Human
cagagaugguaaaacaggccugug

SEQ ID NO: 1286898 - RNA, 21 nt, Human
cagcauggaaaaacuggugcu

SEQ ID NO: 1286899 - RNA, 20 nt, Human
cagugugaauuucugaugug

SEQ ID NO: 1286900 - RNA, 19 nt, Human
caugaagccuacacuccug

SEQ ID NO: 1286901 - RNA, 21 nt, Human
ccucaccagugugaauuucug

SEQ ID NO: 1286902 - RNA, 21 nt, Human
cuccagugugaauuaucuuau

SEQ ID NO: 1286903 - RNA, 25 nt, Human
cucucuccaguguguuuuuuuaaaa

SEQ ID NO: 1286904 - RNA, 20 nt, Human
cuuaaagucuuuuuacauuc

SEQ ID NO: 1286905 - RNA, 21 nt, Human
cuuaacacugcaagcucugau

SEQ ID NO: 1286906 - RNA, 22 nt, Human
uaacacugcaagcucugaucca

SEQ ID NO: 1286907 - RNA, 25 nt, Human
ucaccagugugaauuucugaugugu

SEQ ID NO: 1286908 - RNA, 19 nt, Human
uccaguuuguacucagaga

SEQ ID NO: 1286909 - RNA, 26 nt, Human
ucuccagcauggaaaaacuggugcug

SEQ ID NO: 1286910 - RNA, 19 nt, Human
ugaaaaggguuuuccucca

SEQ ID NO: 1286911 - RNA, 18 nt, Human
ugaagaguguauguucug

SEQ ID NO: 1286912 - RNA, 20 nt, Human
ugcaagcucugauccaguac

SEQ ID NO: 1286913 - RNA, 24 nt, Human
ugcuccucuccagcauggaaaaac

SEQ ID NO: 1286914 - RNA, 22 nt, Human
uguacucagagaugguaaaaca

SEQ ID NO: 1286915 - RNA, 22 nt, Human
uguagggccucucuccagugug

SEQ ID NO: 1286916 - RNA, 24 nt, Human
ugugaauuucugauguguuugccu

SEQ ID NO: 1286917 - RNA, 22 nt, Human
uugcaauaacagugcuccucuc

SEQ ID NO: 1286918 - RNA, 19 nt, Human
uuuguagggccucucucca

SEQ ID NO: 1286919 - RNA, 21 nt, Human
cucauuaacagaauccuugga

SEQ ID NO: 1286920 - RNA, 23 nt, Human
uaacagaauccuuggaaccagcg

SEQ ID NO: 1286921 - RNA, 24 nt, Human
ucacaccucuggccuugauucaga

SEQ ID NO: 1286922 - RNA, 18 nt, Human
uccucuaaagaugcaguc

SEQ ID NO: 1286923 - RNA, 19 nt, Human
ucuaaagaugcagucaugc

SEQ ID NO: 1286924 - RNA, 22 nt, Human
uggaaccagcgaaaccaucucc

SEQ ID NO: 1286925 - RNA, 23 nt, Human
uuggaaccagcgaaaccaucucc

SEQ ID NO: 1286926 - RNA, 25 nt, Human
uuggaaccagcgaaaccaucuccuc

SEQ ID NO: 1286927 - RNA, 24 nt, Human
aacuugcuuugcuguucugagacc

SEQ ID NO: 1286928 - RNA, 22 nt, Human
cagaaucggacagagucgaaga

SEQ ID NO: 1286929 - RNA, 23 nt, Human
caggcucaggcggcucagggccc

SEQ ID NO: 1286930 - RNA, 19 nt, Human
cagggccccggcgcagauc

SEQ ID NO: 1286931 - RNA, 18 nt, Human
ccccggagucugaguggg

SEQ ID NO: 1286932 - RNA, 18 nt, Human
ccccggagucugaguggg

SEQ ID NO: 1286933 - RNA, 21 nt, Human
cccggagucugaguggggagc

SEQ ID NO: 1286934 - RNA, 18 nt, Human
cgcgggaacgggggacac

SEQ ID NO: 1286935 - RNA, 21 nt, Human
cgcuaggaaagcgcgagucuc

SEQ ID NO: 1286936 - RNA, 19 nt, Human
cgggcagugaguucaagca

SEQ ID NO: 1286937 - RNA, 20 nt, Human
cuauccgcaccccguagagu

SEQ ID NO: 1286938 - RNA, 18 nt, Human
cucuccaggcccggcacc

SEQ ID NO: 1286939 - RNA, 21 nt, Human
cugucuccgcagcgaguugca

SEQ ID NO: 1286940 - RNA, 23 nt, Human
gaccgguggcugugccgcccgga

SEQ ID NO: 1286941 - RNA, 18 nt, Human
gcacucuccaggcccggc

SEQ ID NO: 1286942 - RNA, 22 nt, Human
ggacuggagaucuggaccggug

SEQ ID NO: 1286943 - RNA, 18 nt, Human
ggcgcagaucugucggcc

SEQ ID NO: 1286944 - RNA, 18 nt, Human
ggcucagggccccggcgc

SEQ ID NO: 1286945 - RNA, 21 nt, Human
gggaacgggggacacgcggga

SEQ ID NO: 1286946 - RNA, 18 nt, Human
uaggaaagcgcgagucuc

SEQ ID NO: 1286947 - RNA, 19 nt, Human
ucugcagaaucggacagag

SEQ ID NO: 1286948 - RNA, 21 nt, Human
aggaaugcggggcuaaggagu

SEQ ID NO: 1286949 - RNA, 28 nt, Human
cagagcccaagguagaaaccgauggagg

SEQ ID NO: 1286950 - RNA, 24 nt, Human
ccaagguagaaaccgauggaggcu

SEQ ID NO: 1286951 - RNA, 20 nt, Human
gagcccaagguagaaaccga

SEQ ID NO: 1286952 - RNA, 20 nt, Human
gcagagcccaagguagaaac

SEQ ID NO: 1286953 - RNA, 19 nt, Human
guagaaaccgauggaggcg

SEQ ID NO: 1286954 - RNA, 23 nt, Human
guggguccuuucccgcgacuacc

SEQ ID NO: 1286955 - RNA, 22 nt, Human
uaccugcuugccucucucagaa

SEQ ID NO: 1286956 - RNA, 24 nt, Human
ucagaaccugcaagugaagugcgg

SEQ ID NO: 1286957 - RNA, 19 nt, Human
ucggcggcgcagagcccaa

SEQ ID NO: 1286958 - RNA, 18 nt, Human
aaacaggauugggggacc

SEQ ID NO: 1286959 - RNA, 20 nt, Human
aaacaggauugggggaccca

SEQ ID NO: 1286960 - RNA, 21 nt, Human
auuuauccaaaaccuucuuuu

SEQ ID NO: 1286961 - RNA, 22 nt, Human
cuugcuuguugauuuuucuuuu

SEQ ID NO: 1286962 - RNA, 24 nt, Human
gacccauuauuuauccaaaaccuu

SEQ ID NO: 1286963 - RNA, 25 nt, Human
ucucagugcucuuugcagaucuuuu

SEQ ID NO: 1286964 - RNA, 25 nt, Human
ucuuuugcaaacaggauugggggac

SEQ ID NO: 1286965 - RNA, 22 nt, Human
ugucaaaucguagguccuuucc

SEQ ID NO: 1286966 - RNA, 25 nt, Human
uugcaaacaggauugggggacccau

SEQ ID NO: 1286967 - RNA, 18 nt, Human
uuuccaguguagacugga

SEQ ID NO: 1286968 - RNA, 21 nt, Human
uuuccaguguagacuggaugu

SEQ ID NO: 1286969 - RNA, 19 nt, Human
aacacucacuuccucauuu

SEQ ID NO: 1286970 - RNA, 18 nt, Human
aagccagcauuaauugag

SEQ ID NO: 1286971 - RNA, 20 nt, Human
aagccagcauuaauugagug

SEQ ID NO: 1286972 - RNA, 20 nt, Human
aaggauggaaagaccacuuu

SEQ ID NO: 1286973 - RNA, 22 nt, Human
acagaacgacagaaugacaccg

SEQ ID NO: 1286974 - RNA, 24 nt, Human
acgauuuccacagugauccuccuu

SEQ ID NO: 1286975 - RNA, 22 nt, Human
aguggugauuuuaaauccaaag

SEQ ID NO: 1286976 - RNA, 21 nt, Human
cacagugauccuccuuccucc

SEQ ID NO: 1286977 - RNA, 19 nt, Human
cacauucaccuuccacacc

SEQ ID NO: 1286978 - RNA, 19 nt, Human
cagugauccuccuuccucc

SEQ ID NO: 1286979 - RNA, 18 nt, Human
ccuccuuccuccuccacg

SEQ ID NO: 1286980 - RNA, 22 nt, Human
cugugcuaaggauggaaagacc

SEQ ID NO: 1286981 - RNA, 19 nt, Human
gaguggugauuuuaaaucc

SEQ ID NO: 1286982 - RNA, 25 nt, Human
gaguggugauuuuaaauccaaagga

SEQ ID NO: 1286983 - RNA, 22 nt, Human
uaacagaacgacagaaugacac

SEQ ID NO: 1286984 - RNA, 24 nt, Human
uccaagaacacucacuuccucauu

SEQ ID NO: 1286985 - RNA, 27 nt, Human
uccacagugauccuccuuccuccucca

SEQ ID NO: 1286986 - RNA, 21 nt, Human
uggaguggugauuuuaaaucc

SEQ ID NO: 1286987 - RNA, 25 nt, Human
uucacuggcagcacauucaccuucc

SEQ ID NO: 1286988 - RNA, 26 nt, Human
uucacuggcagcacauucaccuucca

SEQ ID NO: 1286989 - RNA, 19 nt, Human
uuccacagugauccuccuu

SEQ ID NO: 1286990 - RNA, 20 nt, Human
uuuccacagugauccuccuu

SEQ ID NO: 1286991 - RNA, 23 nt, Human
aaaauccucugagcuccccuacu

SEQ ID NO: 1286992 - RNA, 19 nt, Human
agaacuaccagaauaugau

SEQ ID NO: 1286993 - RNA, 23 nt, Human
cagaugaaguaaauagaaaaucc

SEQ ID NO: 1286994 - RNA, 25 nt, Human
ccaaccccacauggaugaggguauc

SEQ ID NO: 1286995 - RNA, 18 nt, Human
ccccacauggaugagggu

SEQ ID NO: 1286996 - RNA, 20 nt, Human
gaucguuaaggauuggggga

SEQ ID NO: 1286997 - RNA, 18 nt, Human
gccgggauaacaggccag

SEQ ID NO: 1286998 - RNA, 19 nt, Human
ugccgggauaacaggccag

SEQ ID NO: 1286999 - RNA, 23 nt, Human
ugcucauccuccaaccccacaug

SEQ ID NO: 1287000 - RNA, 22 nt, Human
uggcugcucauccuccaacccc

SEQ ID NO: 1287001 - RNA, 20 nt, Human
aaccagcuuuuccaaacuag

SEQ ID NO: 1287002 - RNA, 24 nt, Human
aaccgcaguauguauuucacaacc

SEQ ID NO: 1287003 - RNA, 20 nt, Human
auauguaauuaucauaugau

SEQ ID NO: 1287004 - RNA, 25 nt, Human
caaccagcuuuuccaaacuaggucc

SEQ ID NO: 1287005 - RNA, 22 nt, Human
caauuugaugagggcucacacc

SEQ ID NO: 1287006 - RNA, 23 nt, Human
cacaccgugcuguucuccucugg

SEQ ID NO: 1287007 - RNA, 21 nt, Human
cagcuuuuccaaacuaggucc

SEQ ID NO: 1287008 - RNA, 23 nt, Human
cgggaggaggcugaaccgcagua

SEQ ID NO: 1287009 - RNA, 21 nt, Human
cuaggucccaggaagcacugg

SEQ ID NO: 1287010 - RNA, 22 nt, Human
ggacaauuugaugagggcucac

SEQ ID NO: 1287011 - RNA, 26 nt, Human
uaggcgggaggaggcugaaccgcagu

SEQ ID NO: 1287012 - RNA, 23 nt, Human
uagguuucuggcuuggacaauuu

SEQ ID NO: 1287013 - RNA, 22 nt, Human
uccaaacuaggucccaggaagc

SEQ ID NO: 1287014 - RNA, 22 nt, Human
uccaggaaaaggccuagguuuc

SEQ ID NO: 1287015 - RNA, 22 nt, Human
ucccaggaagcacugguuucgg

SEQ ID NO: 1287016 - RNA, 24 nt, Human
ucuggcuuggacaauuugaugagg

SEQ ID NO: 1287017 - RNA, 19 nt, Human
agcagcagcucgggugcgg

SEQ ID NO: 1287018 - RNA, 21 nt, Human
cagccaggcaaaauccuucaa

SEQ ID NO: 1287019 - RNA, 18 nt, Human
ccaaagaucagaaugaag

SEQ ID NO: 1287020 - RNA, 18 nt, Human
ccagccaggcaaaauccu

SEQ ID NO: 1287021 - RNA, 20 nt, Human
ccaggcaaaauccuucaaag

SEQ ID NO: 1287022 - RNA, 19 nt, Human
ccccgggcggcagggagcc

SEQ ID NO: 1287023 - RNA, 18 nt, Human
cccgcgcgucccccgagg

SEQ ID NO: 1287024 - RNA, 19 nt, Human
ccgaggccgccgcgucccc

SEQ ID NO: 1287025 - RNA, 18 nt, Human
ccgcgccgccgccggggc

SEQ ID NO: 1287026 - RNA, 19 nt, Human
cgacccagucagcaaugca

SEQ ID NO: 1287027 - RNA, 24 nt, Human
cgacccagucagcaaugcauccag

SEQ ID NO: 1287028 - RNA, 18 nt, Human
cgccggggcccgcgcguc

SEQ ID NO: 1287029 - RNA, 23 nt, Human
cgccggggcccgcgcgucccccg

SEQ ID NO: 1287030 - RNA, 25 nt, Human
cggcagggagccguucuccucggcc

SEQ ID NO: 1287031 - RNA, 22 nt, Human
cggccgacccagucagcaaugc

SEQ ID NO: 1287032 - RNA, 22 nt, Human
cgggccgccuccaggaugcagu

SEQ ID NO: 1287033 - RNA, 21 nt, Human
cggggccgcagccgcggagca

SEQ ID NO: 1287034 - RNA, 21 nt, Human
gagcagcagcucgggugcggg

SEQ ID NO: 1287035 - RNA, 23 nt, Human
ucaaagaaccugagugugcugaa

SEQ ID NO: 1287036 - RNA, 20 nt, Human
uccgcgccgccgccggggcc

SEQ ID NO: 1287037 - RNA, 24 nt, Human
uccgcgccgccgccggggcccgcg

SEQ ID NO: 1287038 - RNA, 20 nt, Human
ugagaaugauuccagccagg

SEQ ID NO: 1287039 - RNA, 19 nt, Human
aaagcacaaagggagggcc

SEQ ID NO: 1287040 - RNA, 23 nt, Human
aaagguagggggucaagggggug

SEQ ID NO: 1287041 - RNA, 24 nt, Human
aaagugcugggauuacaggcguga

SEQ ID NO: 1287042 - RNA, 19 nt, Human
aacagccccacgcaaauga

SEQ ID NO: 1287043 - RNA, 21 nt, Human
aacagccccacgcaaaugaac

SEQ ID NO: 1287044 - RNA, 21 nt, Human
aagcacaaagggagggcccgg

SEQ ID NO: 1287045 - RNA, 20 nt, Human
aagcacucugcaaucacuca

SEQ ID NO: 1287046 - RNA, 25 nt, Human
aagcaucaaaguccugcacgaagcc

SEQ ID NO: 1287047 - RNA, 22 nt, Human
aagggggugguaaccgaguggg

SEQ ID NO: 1287048 - RNA, 19 nt, Human
aagugcugggauuacaggc

SEQ ID NO: 1287049 - RNA, 19 nt, Human
aagugcugggauuacaggc

SEQ ID NO: 1287050 - RNA, 26 nt, Human
aagugcugggauuacaggcgugagcc

SEQ ID NO: 1287051 - RNA, 18 nt, Human
acacagggaacccaaguc

SEQ ID NO: 1287052 - RNA, 23 nt, Human
acaggcacccaccaccacgcccg

SEQ ID NO: 1287053 - RNA, 22 nt, Human
accacccugcuggaaacuccaa

SEQ ID NO: 1287054 - RNA, 24 nt, Human
accagauacagagcugaucaucug

SEQ ID NO: 1287055 - RNA, 25 nt, Human
acccgccucggccucccaaagugcu

SEQ ID NO: 1287056 - RNA, 23 nt, Human
acggaacaccccaagcaucaaag

SEQ ID NO: 1287057 - RNA, 18 nt, Human
acgggguuucaccguguu

SEQ ID NO: 1287058 - RNA, 19 nt, Human
acgggguuucaccguguua

SEQ ID NO: 1287059 - RNA, 20 nt, Human
acgggguuucaccguguuag

SEQ ID NO: 1287060 - RNA, 24 nt, Human
acgggguuucaccguguuagccag

SEQ ID NO: 1287061 - RNA, 18 nt, Human
acugcaagcuccgccucc

SEQ ID NO: 1287062 - RNA, 20 nt, Human
agaugggugaauggcugggg

SEQ ID NO: 1287063 - RNA, 22 nt, Human
agcccaggucgcugggccagaa

SEQ ID NO: 1287064 - RNA, 24 nt, Human
agcgacagagcccagaccccacag

SEQ ID NO: 1287065 - RNA, 19 nt, Human
aggcaagaaugccccccuc

SEQ ID NO: 1287066 - RNA, 25 nt, Human
aggcuggagugcaguggcgccaucu

SEQ ID NO: 1287067 - RNA, 21 nt, Human
agggcccgggcccagaaccug

SEQ ID NO: 1287068 - RNA, 18 nt, Human
aggugcgggcgccgugcu

SEQ ID NO: 1287069 - RNA, 21 nt, Human
aguagagacgggguuucaccg

SEQ ID NO: 1287070 - RNA, 18 nt, Human
aguagcugggacuacagg

SEQ ID NO: 1287071 - RNA, 19 nt, Human
agugcaguggcgccaucug

SEQ ID NO: 1287072 - RNA, 18 nt, Human
agugcugggauuacaggc

SEQ ID NO: 1287073 - RNA, 27 nt, Human
auauuucuguguguguguguguguggu

SEQ ID NO: 1287074 - RNA, 19 nt, Human
augaaccccuccuggucag

SEQ ID NO: 1287075 - RNA, 20 nt, Human
augugacgcauguguuuaua

SEQ ID NO: 1287076 - RNA, 21 nt, Human
auucuccugccucagccuccc

SEQ ID NO: 1287077 - RNA, 24 nt, Human
caaagugcugggauuacaggcgug

SEQ ID NO: 1287078 - RNA, 20 nt, Human
caacacggaacaccccaagc

SEQ ID NO: 1287079 - RNA, 20 nt, Human
caaccgacuuaaccagauac

SEQ ID NO: 1287080 - RNA, 23 nt, Human
caaccucuucuuuuuuuuuuuuu

SEQ ID NO: 1287081 - RNA, 21 nt, Human
cacaguccuccccugcccuuc

SEQ ID NO: 1287082 - RNA, 27 nt, Human
caccacccugcuggaaacuccaagucc

SEQ ID NO: 1287083 - RNA, 18 nt, Human
cacccaccaccacgcccg

SEQ ID NO: 1287084 - RNA, 23 nt, Human
cacccgccucggccucccaaagu

SEQ ID NO: 1287085 - RNA, 18 nt, Human
caccguguuagccagggu

SEQ ID NO: 1287086 - RNA, 24 nt, Human
caccguguuagccaggguggucuc

SEQ ID NO: 1287087 - RNA, 21 nt, Human
caccucgggagcagcuggcag

SEQ ID NO: 1287088 - RNA, 21 nt, Human
caccugggagucaacacggaa

SEQ ID NO: 1287089 - RNA, 24 nt, Human
cacucaggcuggagugcaguggcg

SEQ ID NO: 1287090 - RNA, 21 nt, Human
cagagcccagaccccacaguc

SEQ ID NO: 1287091 - RNA, 26 nt, Human
cagcuggagcucgagaacugcggcgg

SEQ ID NO: 1287092 - RNA, 21 nt, Human
caggcacccaccaccacgccc

SEQ ID NO: 1287093 - RNA, 21 nt, Human
cagggcugcuuggaggucaaa

SEQ ID NO: 1287094 - RNA, 19 nt, Human
cauccugcuucuuccuucu

SEQ ID NO: 1287095 - RNA, 20 nt, Human
ccaaagugcugggauuacag

SEQ ID NO: 1287096 - RNA, 22 nt, Human
ccaaagugcugggauuacaggc

SEQ ID NO: 1287097 - RNA, 22 nt, Human
ccaaagugcugggauuacaggc

SEQ ID NO: 1287098 - RNA, 24 nt, Human
ccaaagugcugggauuacaggcgu

SEQ ID NO: 1287099 - RNA, 22 nt, Human
ccacaguccuccccugcccuuc

SEQ ID NO: 1287100 - RNA, 21 nt, Human
ccagcaaccgacuuaaccaga

SEQ ID NO: 1287101 - RNA, 18 nt, Human
ccaggccaacagccccac

SEQ ID NO: 1287102 - RNA, 18 nt, Human
ccauucuccugccucagc

SEQ ID NO: 1287103 - RNA, 19 nt, Human
cccacaguccuccccugcc

SEQ ID NO: 1287104 - RNA, 24 nt, Human
cccacaguccuccccugcccuucc

SEQ ID NO: 1287105 - RNA, 21 nt, Human
ccccacgcaaaugaaccccuc

SEQ ID NO: 1287106 - RNA, 24 nt, Human
ccccacgcaaaugaaccccuccug

SEQ ID NO: 1287107 - RNA, 24 nt, Human
ccccccauccagcccccugccagc

SEQ ID NO: 1287108 - RNA, 20 nt, Human
cccccugccagccagcaggg

SEQ ID NO: 1287109 - RNA, 25 nt, Human
ccccucacacacagggaacccaagu

SEQ ID NO: 1287110 - RNA, 23 nt, Human
cccgaguagcugggacuacaggc

SEQ ID NO: 1287111 - RNA, 24 nt, Human
cccgaguagcugggacuacaggca

SEQ ID NO: 1287112 - RNA, 23 nt, Human
cccggccuugacucaaccucuuc

SEQ ID NO: 1287113 - RNA, 18 nt, Human
ccuccgggcgcgcagcgc

SEQ ID NO: 1287114 - RNA, 19 nt, Human
ccugacaggcucuggcuac

SEQ ID NO: 1287115 - RNA, 20 nt, Human
ccugaucucgugauccaccc

SEQ ID NO: 1287116 - RNA, 23 nt, Human
ccugccucagccucccgaguagc

SEQ ID NO: 1287117 - RNA, 24 nt, Human
ccugccucagccucccgaguagcu

SEQ ID NO: 1287118 - RNA, 20 nt, Human
cgacagagcccagaccccac

SEQ ID NO: 1287119 - RNA, 18 nt, Human
cgcaaaugaaccccuccu

SEQ ID NO: 1287120 - RNA, 24 nt, Human
cgcaaaugaaccccuccuggucag

SEQ ID NO: 1287121 - RNA, 19 nt, Human
cgccucccggguucgcacc

SEQ ID NO: 1287122 - RNA, 18 nt, Human
cgggagaagcguggggcg

SEQ ID NO: 1287123 - RNA, 19 nt, Human
cgggagaagcguggggcgg

SEQ ID NO: 1287124 - RNA, 21 nt, Human
cgggagcagcuggcaggcaag

SEQ ID NO: 1287125 - RNA, 20 nt, Human
cgggcgcgcagcgcgggcgg

SEQ ID NO: 1287126 - RNA, 24 nt, Human
cgggguuucaccguguuagccagg

SEQ ID NO: 1287127 - RNA, 24 nt, Human
cucagccucccgaguagcugggac

SEQ ID NO: 1287128 - RNA, 21 nt, Human
cucccggguucgcaccauucu

SEQ ID NO: 1287129 - RNA, 24 nt, Human
cuccugaucucgugauccacccgc

SEQ ID NO: 1287130 - RNA, 24 nt, Human
cucgcucugucacucaggcuggag

SEQ ID NO: 1287131 - RNA, 19 nt, Human
cucgugauccacccgccuc

SEQ ID NO: 1287132 - RNA, 20 nt, Human
cucugucacucaggcuggag

SEQ ID NO: 1287133 - RNA, 18 nt, Human
cugcccuuccugacaggc

SEQ ID NO: 1287134 - RNA, 18 nt, Human
cugcccuuccugacaggc

SEQ ID NO: 1287135 - RNA, 20 nt, Human
cugcccuuccugacaggcuc

SEQ ID NO: 1287136 - RNA, 18 nt, Human
cuuccugacaggcucugg

SEQ ID NO: 1287137 - RNA, 26 nt, Human
gacucaaccucuucuuuuuuuuuuuu

SEQ ID NO: 1287138 - RNA, 24 nt, Human
gagacgggguuucaccguguuagc

SEQ ID NO: 1287139 - RNA, 20 nt, Human
gaguagcugggacuacaggc

SEQ ID NO: 1287140 - RNA, 25 nt, Human
gaguagcugggacuacaggcaccca

SEQ ID NO: 1287141 - RNA, 22 nt, Human
gaucucgugauccacccgccuc

SEQ ID NO: 1287142 - RNA, 24 nt, Human
gaucucgugauccacccgccucgg

SEQ ID NO: 1287143 - RNA, 18 nt, Human
gauuacaggcgugagcca

SEQ ID NO: 1287144 - RNA, 20 nt, Human
gauuacaggcgugagccacc

SEQ ID NO: 1287145 - RNA, 22 nt, Human
gauuacaggcgugagccaccgc

SEQ ID NO: 1287146 - RNA, 18 nt, Human
gcaaggccuuuuccucag

SEQ ID NO: 1287147 - RNA, 24 nt, Human
gccgugcucgcucguccucgccgg

SEQ ID NO: 1287148 - RNA, 25 nt, Human
gccucccggguucgcaccauucucc

SEQ ID NO: 1287149 - RNA, 23 nt, Human
gccucggccucccaaagugcugg

SEQ ID NO: 1287150 - RNA, 20 nt, Human
gcgcagcgcgggcggugcgg

SEQ ID NO: 1287151 - RNA, 24 nt, Human
gcggcggucgcuccuccgggcgcg

SEQ ID NO: 1287152 - RNA, 19 nt, Human
gcguggggcggacgcggag

SEQ ID NO: 1287153 - RNA, 24 nt, Human
gcuggagugcaguggcgccaucug

SEQ ID NO: 1287154 - RNA, 22 nt, Human
ggagacagagucucgcucuguc

SEQ ID NO: 1287155 - RNA, 24 nt, Human
ggagggcccgggcccagaaccugu

SEQ ID NO: 1287156 - RNA, 19 nt, Human
ggcccagaaccugucaggg

SEQ ID NO: 1287157 - RNA, 21 nt, Human
ggcgcaagaacugcagagaca

SEQ ID NO: 1287158 - RNA, 20 nt, Human
gggcgccgugcucgcucguc

SEQ ID NO: 1287159 - RNA, 24 nt, Human
ggggucaggggugacagagaggga

SEQ ID NO: 1287160 - RNA, 23 nt, Human
gggguuucaccguguuagccagg

SEQ ID NO: 1287161 - RNA, 20 nt, Human
gguagggggucaagggggug

SEQ ID NO: 1287162 - RNA, 20 nt, Human
ggugacagagagggaggggc

SEQ ID NO: 1287163 - RNA, 21 nt, Human
ggugacagagagggaggggcu

SEQ ID NO: 1287164 - RNA, 23 nt, Human
guagagacgggguuucaccgugu

SEQ ID NO: 1287165 - RNA, 18 nt, Human
gucaagggggugguaacc

SEQ ID NO: 1287166 - RNA, 24 nt, Human
gugauccacccgccucggccuccc

SEQ ID NO: 1287167 - RNA, 19 nt, Human
gugcaggcugguuccgcug

SEQ ID NO: 1287168 - RNA, 21 nt, Human
gugcccaucuauguguacaac

SEQ ID NO: 1287169 - RNA, 22 nt, Human
guguguguguguguggugugug

SEQ ID NO: 1287170 - RNA, 21 nt, Human
gugugugugugugugugugug

SEQ ID NO: 1287171 - RNA, 21 nt, Human
uaaccgaguggggcuuauguc

SEQ ID NO: 1287172 - RNA, 26 nt, Human
uaacuuuuuguauuuuuuuaguagag

SEQ ID NO: 1287173 - RNA, 27 nt, Human
uaacuuuuuguauuuuuuuaguagaga

SEQ ID NO: 1287174 - RNA, 26 nt, Human
uacagauggauggaugauccaggcca

SEQ ID NO: 1287175 - RNA, 26 nt, Human
uacagaugggugaauggcugggguca

SEQ ID NO: 1287176 - RNA, 23 nt, Human
uacaggcgugagccaccgcgccc

SEQ ID NO: 1287177 - RNA, 21 nt, Human
uaguagagacgggguuucacc

SEQ ID NO: 1287178 - RNA, 24 nt, Human
uaguagagacgggguuucaccgug

SEQ ID NO: 1287179 - RNA, 26 nt, Human
uaguagagacgggguuucaccguguu

SEQ ID NO: 1287180 - RNA, 19 nt, Human
uauauuucugugugugugu

SEQ ID NO: 1287181 - RNA, 19 nt, Human
uauauuucugugugugugu

SEQ ID NO: 1287182 - RNA, 19 nt, Human
uauauuucugugugugugu

SEQ ID NO: 1287183 - RNA, 22 nt, Human
ucaacacggaacaccccaagca

SEQ ID NO: 1287184 - RNA, 24 nt, Human
ucaccguguuagccaggguggucu

SEQ ID NO: 1287185 - RNA, 24 nt, Human
ucacucaggcuggagugcaguggc

SEQ ID NO: 1287186 - RNA, 18 nt, Human
ucacugcaagcuccgccu

SEQ ID NO: 1287187 - RNA, 19 nt, Human
ucacugcaagcuccgccuc

SEQ ID NO: 1287188 - RNA, 24 nt, Human
ucacugcaagcuccgccucccggg

SEQ ID NO: 1287189 - RNA, 23 nt, Human
ucagccucccgaguagcugggac

SEQ ID NO: 1287190 - RNA, 24 nt, Human
ucccaaagugcugggauuacaggc

SEQ ID NO: 1287191 - RNA, 24 nt, Human
ucccgaguagcugggacuacaggc

SEQ ID NO: 1287192 - RNA, 21 nt, Human
ucccggguucgcaccauucuc

SEQ ID NO: 1287193 - RNA, 24 nt, Human
ucccggguucgcaccauucuccug

SEQ ID NO: 1287194 - RNA, 22 nt, Human
uccugcacgaagccucuucaaa

SEQ ID NO: 1287195 - RNA, 21 nt, Human
ucgcaccauucuccugccuca

SEQ ID NO: 1287196 - RNA, 22 nt, Human
ucgcucguccucgccgggggac

SEQ ID NO: 1287197 - RNA, 24 nt, Human
ucgcucugucacucaggcuggagu

SEQ ID NO: 1287198 - RNA, 24 nt, Human
ucuccugccucagccucccgagua

SEQ ID NO: 1287199 - RNA, 19 nt, Human
ucucgcucugucacucagg

SEQ ID NO: 1287200 - RNA, 22 nt, Human
ucucgcucugucacucaggcug

SEQ ID NO: 1287201 - RNA, 23 nt, Human
ucucgcucugucacucaggcugg

SEQ ID NO: 1287202 - RNA, 24 nt, Human
ucucgcucugucacucaggcugga

SEQ ID NO: 1287203 - RNA, 18 nt, Human
ucucgugauccacccgcc

SEQ ID NO: 1287204 - RNA, 20 nt, Human
ucucuggcacagguagggcu

SEQ ID NO: 1287205 - RNA, 22 nt, Human
ucugaaaugcccaugugacgca

SEQ ID NO: 1287206 - RNA, 22 nt, Human
ucuggcacagguagggcugucu

SEQ ID NO: 1287207 - RNA, 24 nt, Human
ucuggcacagguagggcugucugg

SEQ ID NO: 1287208 - RNA, 24 nt, Human
ucugucacucaggcuggagugcag

SEQ ID NO: 1287209 - RNA, 24 nt, Human
ucugugugugugugugugugugug

SEQ ID NO: 1287210 - RNA, 20 nt, Human
ugacagagagggaggggcuu

SEQ ID NO: 1287211 - RNA, 18 nt, Human
ugagaggaaugggcagug

SEQ ID NO: 1287212 - RNA, 23 nt, Human
ugagaggaaugggcagugggcag

SEQ ID NO: 1287213 - RNA, 21 nt, Human
ugcaaggccuuuuccucagug

SEQ ID NO: 1287214 - RNA, 24 nt, Human
ugcacaccacccugcuggaaacuc

SEQ ID NO: 1287215 - RNA, 23 nt, Human
ugcacacuucucucugugagugu

SEQ ID NO: 1287216 - RNA, 23 nt, Human
ugcagagacaaagcacaaaggga

SEQ ID NO: 1287217 - RNA, 24 nt, Human
ugccucagccucccgaguagcugg

SEQ ID NO: 1287218 - RNA, 21 nt, Human
ugcgggcgccgugcucgcucg

SEQ ID NO: 1287219 - RNA, 24 nt, Human
ugcggggcccggagcgggagaagc

SEQ ID NO: 1287220 - RNA, 23 nt, Human
ugcucgcucguccucgccggggg

SEQ ID NO: 1287221 - RNA, 24 nt, Human
ugcugggauuacaggcgugagcca

SEQ ID NO: 1287222 - RNA, 22 nt, Human
uggagacagagucucgcucugu

SEQ ID NO: 1287223 - RNA, 28 nt, Human
uggagugcaguggcgccauccuagcacg

SEQ ID NO: 1287224 - RNA, 23 nt, Human
uggagugcaguggcgccaucugg

SEQ ID NO: 1287225 - RNA, 18 nt, Human
uggcaggcaagaaugccc

SEQ ID NO: 1287226 - RNA, 21 nt, Human
uggcaggcaagaaugcccccc

SEQ ID NO: 1287227 - RNA, 19 nt, Human
uggcuggggucagggguga

SEQ ID NO: 1287228 - RNA, 19 nt, Human
ugggacuacaggcacccac

SEQ ID NO: 1287229 - RNA, 21 nt, Human
ugggacuacaggcacccacca

SEQ ID NO: 1287230 - RNA, 24 nt, Human
ugggacuacaggcacccaccacca

SEQ ID NO: 1287231 - RNA, 18 nt, Human
ugggauuacaggcgugag

SEQ ID NO: 1287232 - RNA, 19 nt, Human
ugggauuacaggcgugagc

SEQ ID NO: 1287233 - RNA, 21 nt, Human
ugggauuacaggcgugagcca

SEQ ID NO: 1287234 - RNA, 22 nt, Human
ugggauuacaggcgugagccac

SEQ ID NO: 1287235 - RNA, 23 nt, Human
ugggauuacaggcgugagccacc

SEQ ID NO: 1287236 - RNA, 24 nt, Human
ugggauuacaggcgugagccaccg

SEQ ID NO: 1287237 - RNA, 20 nt, Human
ugggguggggagggggagug

SEQ ID NO: 1287238 - RNA, 19 nt, Human
uggugcacaccacccugcu

SEQ ID NO: 1287239 - RNA, 27 nt, Human
uguacagaugggugaauggcugggguc

SEQ ID NO: 1287240 - RNA, 22 nt, Human
ugucugggggaggaaacugaga

SEQ ID NO: 1287241 - RNA, 19 nt, Human
uguggcaguggcugaacug

SEQ ID NO: 1287242 - RNA, 24 nt, Human
ugugguguguguacaugcacacuu

SEQ ID NO: 1287243 - RNA, 26 nt, Human
uguguacaugcacacuucucucugug

SEQ ID NO: 1287244 - RNA, 20 nt, Human
ugugugguguguguacaugc

SEQ ID NO: 1287245 - RNA, 19 nt, Human
uguguguacaugcacacuu

SEQ ID NO: 1287246 - RNA, 20 nt, Human
ugugugugguguguguacau

SEQ ID NO: 1287247 - RNA, 19 nt, Human
uguguguguguggugugug

SEQ ID NO: 1287248 - RNA, 20 nt, Human
uguguguguguggugugugu

SEQ ID NO: 1287249 - RNA, 23 nt, Human
uguguguguguguggugugugua

SEQ ID NO: 1287250 - RNA, 22 nt, Human
uguguguguguguguggugugu

SEQ ID NO: 1287251 - RNA, 18 nt, Human
ugugugugugugugugug

SEQ ID NO: 1287252 - RNA, 18 nt, Human
ugugugugugugugugug

SEQ ID NO: 1287253 - RNA, 18 nt, Human
ugugugugugugugugug

SEQ ID NO: 1287254 - RNA, 18 nt, Human
ugugugugugugugugug

SEQ ID NO: 1287255 - RNA, 18 nt, Human
ugugugugugugugugug

SEQ ID NO: 1287256 - RNA, 18 nt, Human
ugugugugugugugugug

SEQ ID NO: 1287257 - RNA, 18 nt, Human
ugugugugugugugugug

SEQ ID NO: 1287258 - RNA, 24 nt, Human
uguguguguguguguguggugugu

SEQ ID NO: 1287259 - RNA, 19 nt, Human
ugugugugugugugugugu

SEQ ID NO: 1287260 - RNA, 20 nt, Human
ugugugugugugugugugug

SEQ ID NO: 1287261 - RNA, 20 nt, Human
ugugugugugugugugugug

SEQ ID NO: 1287262 - RNA, 21 nt, Human
ugugugugugugugugugugu

SEQ ID NO: 1287263 - RNA, 21 nt, Human
ugugugugugugugugugugu

SEQ ID NO: 1287264 - RNA, 21 nt, Human
ugugugugugugugugugugu

SEQ ID NO: 1287265 - RNA, 21 nt, Human
ugugugugugugugugugugu

SEQ ID NO: 1287266 - RNA, 21 nt, Human
ugugugugugugugugugugu

SEQ ID NO: 1287267 - RNA, 21 nt, Human
ugugugugugugugugugugu

SEQ ID NO: 1287268 - RNA, 21 nt, Human
ugugugugugugugugugugu

SEQ ID NO: 1287269 - RNA, 21 nt, Human
ugugugugugugugugugugu

SEQ ID NO: 1287270 - RNA, 21 nt, Human
ugugugugugugugugugugu

SEQ ID NO: 1287271 - RNA, 21 nt, Human
ugugugugugugugugugugu

SEQ ID NO: 1287272 - RNA, 21 nt, Human
ugugugugugugugugugugu

SEQ ID NO: 1287273 - RNA, 22 nt, Human
ugugugugugugugugugugug

SEQ ID NO: 1287274 - RNA, 22 nt, Human
ugugugugugugugugugugug

SEQ ID NO: 1287275 - RNA, 22 nt, Human
ugugugugugugugugugugug

SEQ ID NO: 1287276 - RNA, 22 nt, Human
ugugugugugugugugugugug

SEQ ID NO: 1287277 - RNA, 23 nt, Human
ugugugugugugugugugugugu

SEQ ID NO: 1287278 - RNA, 21 nt, Human
uguguuuauauuucugugugu

SEQ ID NO: 1287279 - RNA, 21 nt, Human
uuaacacugagaugggguggg

SEQ ID NO: 1287280 - RNA, 18 nt, Human
uuaguagagacgggguuu

SEQ ID NO: 1287281 - RNA, 22 nt, Human
uuaguagagacgggguuucacc

SEQ ID NO: 1287282 - RNA, 24 nt, Human
uuaguagagacgggguuucaccgu

SEQ ID NO: 1287283 - RNA, 18 nt, Human
uucaccguguuagccagg

SEQ ID NO: 1287284 - RNA, 19 nt, Human
uuccucagugaaaguuuca

SEQ ID NO: 1287285 - RNA, 25 nt, Human
uuuaugaccuucuuucuagcucucu

SEQ ID NO: 1287286 - RNA, 19 nt, Human
uuucaccguguuagccagg

SEQ ID NO: 1287287 - RNA, 24 nt, Human
uuuuuaguagagacgggguuucac

SEQ ID NO: 1287288 - RNA, 23 nt, Human
uuuuuguauuuuuuuaguagaga

SEQ ID NO: 1287289 - RNA, 25 nt, Human
uuuuuguauuuuuuuaguagagacg

SEQ ID NO: 1287290 - RNA, 23 nt, Human
uuuuuuaguagagacgggguuuc

SEQ ID NO: 1287291 - RNA, 26 nt, Human
uuuuuuuuuuuuggagacagagucuc

SEQ ID NO: 1287292 - RNA, 19 nt, Human
aaguggccaugaaccagaa

SEQ ID NO: 1287293 - RNA, 20 nt, Human
agaaacccuacuagccuaac

SEQ ID NO: 1287294 - RNA, 24 nt, Human
agccuaacugaagaucgaaauuuu

SEQ ID NO: 1287295 - RNA, 19 nt, Human
caaguggccaugaaccaga

SEQ ID NO: 1287296 - RNA, 24 nt, Human
cagaaacccuacuagccuaacuga

SEQ ID NO: 1287297 - RNA, 20 nt, Human
cagcaaguggccaugaacca

SEQ ID NO: 1287298 - RNA, 25 nt, Human
ccagaaacccuacuagccuaacuga

SEQ ID NO: 1287299 - RNA, 19 nt, Human
gaaccagaaacccuacuag

SEQ ID NO: 1287300 - RNA, 18 nt, Human
ugaaccagaaacccuacu

SEQ ID NO: 1287301 - RNA, 20 nt, Human
ugugagucuuacuucugcag

SEQ ID NO: 1287302 - RNA, 18 nt, Human
agaacagcaaggcugaga

SEQ ID NO: 1287303 - RNA, 19 nt, Human
agcaaggcugagaguccac

SEQ ID NO: 1287304 - RNA, 23 nt, Human
agcaggauguuuuaagggaauga

SEQ ID NO: 1287305 - RNA, 20 nt, Human
ccaguguacaaccaggaaaa

SEQ ID NO: 1287306 - RNA, 22 nt, Human
gcaaggcugagaguccacagug

SEQ ID NO: 1287307 - RNA, 21 nt, Human
gcagaacagcaaggcugagag

SEQ ID NO: 1287308 - RNA, 21 nt, Human
ggcagaacagcaaggcugaga

SEQ ID NO: 1287309 - RNA, 22 nt, Human
uccacaguggagauggagaaag

SEQ ID NO: 1287310 - RNA, 22 nt, Human
uccacaguggagauggagaagc

SEQ ID NO: 1287311 - RNA, 23 nt, Human
uugaugcaaugguaaucuuccag

SEQ ID NO: 1287312 - RNA, 22 nt, Human
cacaggcaaaucucugcaacuc

SEQ ID NO: 1287313 - RNA, 27 nt, Human
cagcacaggcaaaucucugcaacucuc

SEQ ID NO: 1287314 - RNA, 23 nt, Human
ggcaaaucucugcaacucuccuc

SEQ ID NO: 1287315 - RNA, 23 nt, Human
ugcaaaugacagcacaggcaaau

SEQ ID NO: 1287316 - RNA, 20 nt, Human
ugcaacucuccuccugaaag

SEQ ID NO: 1287317 - RNA, 21 nt, Human
aagcucuggagacuuucagcu

SEQ ID NO: 1287318 - RNA, 20 nt, Human
cacugggauuucuacacucu

SEQ ID NO: 1287319 - RNA, 19 nt, Human
cccuuccuuucuuuucagu

SEQ ID NO: 1287320 - RNA, 22 nt, Human
cccuuccuuucuuuucagugcu

SEQ ID NO: 1287321 - RNA, 29 nt, Human
cccuuccuuucuuuucagugcucugagaa

SEQ ID NO: 1287322 - RNA, 19 nt, Human
cucucuguaagcucuggag

SEQ ID NO: 1287323 - RNA, 22 nt, Human
cucugagaaguauauagaaaag

SEQ ID NO: 1287324 - RNA, 19 nt, Human
cucuguugguacaugcuac

SEQ ID NO: 1287325 - RNA, 18 nt, Human
gauuucuacacucuccuc

SEQ ID NO: 1287326 - RNA, 21 nt, Human
gguacaacucugucuccaacu

SEQ ID NO: 1287327 - RNA, 23 nt, Human
guacaacucugucuccaacugaa

SEQ ID NO: 1287328 - RNA, 23 nt, Human
uacaugcuaccacugggauuucu

SEQ ID NO: 1287329 - RNA, 19 nt, Human
uccucugcaaacccuuccu

SEQ ID NO: 1287330 - RNA, 28 nt, Human
ucuccucugcaaacccuuccuuucuuuu

SEQ ID NO: 1287331 - RNA, 18 nt, Human
ucucuguaagcucuggag

SEQ ID NO: 1287332 - RNA, 18 nt, Human
ucuguaagcucuggagac

SEQ ID NO: 1287333 - RNA, 18 nt, Human
ugaaggaaaagaguccuu

SEQ ID NO: 1287334 - RNA, 23 nt, Human
ugucuccaacugaaggaaaagag

SEQ ID NO: 1287335 - RNA, 18 nt, Human
uuuucagugcucugagaa

SEQ ID NO: 1287336 - RNA, 18 nt, Human
aaccaaggagccuuccuc

SEQ ID NO: 1287337 - RNA, 21 nt, Human
aagugcagacccaguuugacc

SEQ ID NO: 1287338 - RNA, 23 nt, Human
agccuccguuuucccuccugucg

SEQ ID NO: 1287339 - RNA, 22 nt, Human
agcuguguagaccuggagccuc

SEQ ID NO: 1287340 - RNA, 23 nt, Human
aggagccuuccucccugcugucc

SEQ ID NO: 1287341 - RNA, 25 nt, Human
aguuugaccagaaaacucaggucuc

SEQ ID NO: 1287342 - RNA, 23 nt, Human
caaaauuuaccaggauuuggcac

SEQ ID NO: 1287343 - RNA, 18 nt, Human
caagaugaucccaaccaa

SEQ ID NO: 1287344 - RNA, 23 nt, Human
caagcaaucucugcccaauaugg

SEQ ID NO: 1287345 - RNA, 23 nt, Human
cacccucaagugcagacccaguu

SEQ ID NO: 1287346 - RNA, 22 nt, Human
cagagagacagcaauuucccuu

SEQ ID NO: 1287347 - RNA, 24 nt, Human
cagcaauuucccuuuccagugcuu

SEQ ID NO: 1287348 - RNA, 26 nt, Human
caggagcuuuuggcaagaugauccca

SEQ ID NO: 1287349 - RNA, 21 nt, Human
ccucaagugcagacccaguuu

SEQ ID NO: 1287350 - RNA, 18 nt, Human
ccuuccucccugcugucc

SEQ ID NO: 1287351 - RNA, 22 nt, Human
cuccacccucaagugcagaccc

SEQ ID NO: 1287352 - RNA, 23 nt, Human
gaccuggagccuccguuuucccu

SEQ ID NO: 1287353 - RNA, 24 nt, Human
gccuuccucccugcuguccuccac

SEQ ID NO: 1287354 - RNA, 22 nt, Human
gcuuuuggcaagaugaucccaa

SEQ ID NO: 1287355 - RNA, 19 nt, Human
uacacagcauuuuguucag

SEQ ID NO: 1287356 - RNA, 23 nt, Human
ucagagagacagcaauuucccuu

SEQ ID NO: 1287357 - RNA, 18 nt, Human
ucaggagcuuuuggcaag

SEQ ID NO: 1287358 - RNA, 21 nt, Human
ucccaaccaaggagccuuccu

SEQ ID NO: 1287359 - RNA, 24 nt, Human
ucuacugccacugccccacucacc

SEQ ID NO: 1287360 - RNA, 20 nt, Human
ugaccagaaaacucaggucu

SEQ ID NO: 1287361 - RNA, 24 nt, Human
ugaccagaaaacucaggucucugc

SEQ ID NO: 1287362 - RNA, 18 nt, Human
ugccccacucaccuuccc

SEQ ID NO: 1287363 - RNA, 22 nt, Human
ugccccacucaccuucccuuug

SEQ ID NO: 1287364 - RNA, 21 nt, Human
uggcaagaugaucccaaccaa

SEQ ID NO: 1287365 - RNA, 22 nt, Human
uggcaagaugaucccaaccaag

SEQ ID NO: 1287366 - RNA, 23 nt, Human
uuggcacucaggagcuuuuggca

SEQ ID NO: 1287367 - RNA, 20 nt, Human
aaucaaugcuuuugaaagac

SEQ ID NO: 1287368 - RNA, 18 nt, Human
aggggcguggguggguca

SEQ ID NO: 1287369 - RNA, 22 nt, Human
augcuuuugaaagacugccccc

SEQ ID NO: 1287370 - RNA, 20 nt, Human
cugcccccuugcccgccagg

SEQ ID NO: 1287371 - RNA, 18 nt, Human
gcccccuugcccgccagg

SEQ ID NO: 1287372 - RNA, 21 nt, Human
ggagaugguugaggggcgugg

SEQ ID NO: 1287373 - RNA, 20 nt, Human
ugggagaugguugaggggcg

SEQ ID NO: 1287374 - RNA, 21 nt, Human
uugaggggcguggguggguca

SEQ ID NO: 1287375 - RNA, 25 nt, Human
aaacaccgucucuggaaggacaccc

SEQ ID NO: 1287376 - RNA, 23 nt, Human
acgcagguaugagaccaaacgca

SEQ ID NO: 1287377 - RNA, 18 nt, Human
acugacccccagccccuc

SEQ ID NO: 1287378 - RNA, 20 nt, Human
agaaacguguuccgguccuc

SEQ ID NO: 1287379 - RNA, 22 nt, Human
agcccccagacuuaccuccccu

SEQ ID NO: 1287380 - RNA, 18 nt, Human
agccucucggcccggccc

SEQ ID NO: 1287381 - RNA, 19 nt, Human
aggggucccugguggaggc

SEQ ID NO: 1287382 - RNA, 21 nt, Human
caagguggggggcugccccuc

SEQ ID NO: 1287383 - RNA, 18 nt, Human
cacugcugugguuuccca

SEQ ID NO: 1287384 - RNA, 18 nt, Human
caggcacugaggugggga

SEQ ID NO: 1287385 - RNA, 20 nt, Human
caggcacugagguggggaca

SEQ ID NO: 1287386 - RNA, 25 nt, Human
cagggcuccagaguucaugaggagg

SEQ ID NO: 1287387 - RNA, 23 nt, Human
ccacacgggccugguguucuggg

SEQ ID NO: 1287388 - RNA, 19 nt, Human
ccacgccgccccgcucccc

SEQ ID NO: 1287389 - RNA, 23 nt, Human
ccagccucgggccgggcgcgccc

SEQ ID NO: 1287390 - RNA, 21 nt, Human
cccagccccucccuacguucc

SEQ ID NO: 1287391 - RNA, 21 nt, Human
cccccagacuuaccuccccuc

SEQ ID NO: 1287392 - RNA, 21 nt, Human
cccccagccucgggccgggcg

SEQ ID NO: 1287393 - RNA, 19 nt, Human
ccccgaguccgcccggccc

SEQ ID NO: 1287394 - RNA, 22 nt, Human
ccccgggucgcagaaacguguu

SEQ ID NO: 1287395 - RNA, 21 nt, Human
ccccuggaaacaccgucucug

SEQ ID NO: 1287396 - RNA, 25 nt, Human
ccccuggaaacaccgucucuggaag

SEQ ID NO: 1287397 - RNA, 25 nt, Human
cccggcccggccugggguccucggc

SEQ ID NO: 1287398 - RNA, 22 nt, Human
cccucaggccucggggccccug

SEQ ID NO: 1287399 - RNA, 19 nt, Human
ccgccccgcucccccagcc

SEQ ID NO: 1287400 - RNA, 20 nt, Human
ccgccccgcucccccagccu

SEQ ID NO: 1287401 - RNA, 22 nt, Human
ccuccccucuucuaucccgggc

SEQ ID NO: 1287402 - RNA, 21 nt, Human
ccucucggcccggcccggccu

SEQ ID NO: 1287403 - RNA, 23 nt, Human
ccugaccucagggugccacccac

SEQ ID NO: 1287404 - RNA, 26 nt, Human
ccugguguucugggaggcccgggcug

SEQ ID NO: 1287405 - RNA, 18 nt, Human
cgccacgccgccccgcuc

SEQ ID NO: 1287406 - RNA, 20 nt, Human
cggcccggcccggccugggg

SEQ ID NO: 1287407 - RNA, 22 nt, Human
cggcgcgcccgccacgccgccc

SEQ ID NO: 1287408 - RNA, 18 nt, Human
cgggcuggacugaccccc

SEQ ID NO: 1287409 - RNA, 18 nt, Human
cggggccccuggucaggc

SEQ ID NO: 1287410 - RNA, 21 nt, Human
cgggugucugcuguccugggu

SEQ ID NO: 1287411 - RNA, 24 nt, Human
cgguccccgaguccgcccggcccc

SEQ ID NO: 1287412 - RNA, 23 nt, Human
cucuucuaucccgggccaggaag

SEQ ID NO: 1287413 - RNA, 19 nt, Human
cuggcacagggggaggcuc

SEQ ID NO: 1287414 - RNA, 28 nt, Human
cuggcgggugucugcuguccuggguggg

SEQ ID NO: 1287415 - RNA, 18 nt, Human
cuggcugggcuggagccg

SEQ ID NO: 1287416 - RNA, 19 nt, Human
cugguguucugggaggccc

SEQ ID NO: 1287417 - RNA, 19 nt, Human
cuuaggauccccugaccuc

SEQ ID NO: 1287418 - RNA, 20 nt, Human
gaaacagggcagucacagcc

SEQ ID NO: 1287419 - RNA, 20 nt, Human
gaacuucaguccaggguggg

SEQ ID NO: 1287420 - RNA, 21 nt, Human
gagccccgggucgcagaaacg

SEQ ID NO: 1287421 - RNA, 22 nt, Human
gagcgcggcgacgagcacagcc

SEQ ID NO: 1287422 - RNA, 20 nt, Human
gagguggggacaggggaggg

SEQ ID NO: 1287423 - RNA, 22 nt, Human
gagugcuggcugggcuggagcc

SEQ ID NO: 1287424 - RNA, 18 nt, Human
gccucgggccgggcgcgc

SEQ ID NO: 1287425 - RNA, 19 nt, Human
gcgggggcgguccuccccc

SEQ ID NO: 1287426 - RNA, 21 nt, Human
gcgggugucugcuguccuggg

SEQ ID NO: 1287427 - RNA, 21 nt, Human
gcuggacugacccccagcccc

SEQ ID NO: 1287428 - RNA, 22 nt, Human
gcuggcacagggggaggcucag

SEQ ID NO: 1287429 - RNA, 22 nt, Human
gcuggcugggcuggagccgggg

SEQ ID NO: 1287430 - RNA, 21 nt, Human
ggccaggaaggcaaugggagg

SEQ ID NO: 1287431 - RNA, 23 nt, Human
ggcucagggccccgcaggcacug

SEQ ID NO: 1287432 - RNA, 18 nt, Human
ggcuggacccugagggag

SEQ ID NO: 1287433 - RNA, 18 nt, Human
ggcuggacccugagggag

SEQ ID NO: 1287434 - RNA, 21 nt, Human
ggcugggcuggagccggggcc

SEQ ID NO: 1287435 - RNA, 23 nt, Human
ggcugggcuggagccggggccgc

SEQ ID NO: 1287436 - RNA, 19 nt, Human
gggaggcccgggcuggacu

SEQ ID NO: 1287437 - RNA, 18 nt, Human
gggcagucacagccgggg

SEQ ID NO: 1287438 - RNA, 20 nt, Human
gggccccuggucaggacccu

SEQ ID NO: 1287439 - RNA, 19 nt, Human
ggggaucuggaagcggggg

SEQ ID NO: 1287440 - RNA, 22 nt, Human
ggggcauggcuggacccugagg

SEQ ID NO: 1287441 - RNA, 18 nt, Human
ggucugucgagucccuug

SEQ ID NO: 1287442 - RNA, 22 nt, Human
ggugggugaugagggccggggu

SEQ ID NO: 1287443 - RNA, 23 nt, Human
guagcccccagacuuaccucccc

SEQ ID NO: 1287444 - RNA, 20 nt, Human
guccaggguggggcauggcu

SEQ ID NO: 1287445 - RNA, 21 nt, Human
gugaugagggccggggugcag

SEQ ID NO: 1287446 - RNA, 22 nt, Human
guggggcauggcuggacccuga

SEQ ID NO: 1287447 - RNA, 21 nt, Human
uagcccccagacuuaccuccc

SEQ ID NO: 1287448 - RNA, 23 nt, Human
ucaguccaggguggggcauggcu

SEQ ID NO: 1287449 - RNA, 23 nt, Human
ucagugccggugggugaugaggg

SEQ ID NO: 1287450 - RNA, 23 nt, Human
ucaugaggaggggucccuggugg

SEQ ID NO: 1287451 - RNA, 19 nt, Human
ucccagaggcugaugcaga

SEQ ID NO: 1287452 - RNA, 21 nt, Human
ucccagaggcugaugcagacc

SEQ ID NO: 1287453 - RNA, 22 nt, Human
ucccugguggaggcugggccag

SEQ ID NO: 1287454 - RNA, 18 nt, Human
ucccuugcuggaugaggg

SEQ ID NO: 1287455 - RNA, 23 nt, Human
ucggcgcgcccgccacgccgccc

SEQ ID NO: 1287456 - RNA, 19 nt, Human
ucggggccccuggucaggc

SEQ ID NO: 1287457 - RNA, 21 nt, Human
ucguguggguguguggggagg

SEQ ID NO: 1287458 - RNA, 19 nt, Human
ucucagggcuccagaguuc

SEQ ID NO: 1287459 - RNA, 20 nt, Human
ucucuaagaaugaggacaga

SEQ ID NO: 1287460 - RNA, 18 nt, Human
ugacccccagccccuccc

SEQ ID NO: 1287461 - RNA, 20 nt, Human
ugagaccaaacgcagaacac

SEQ ID NO: 1287462 - RNA, 22 nt, Human
ugagaccaaacgcagaacacag

SEQ ID NO: 1287463 - RNA, 23 nt, Human
ugaggaggggucccugguggagg

SEQ ID NO: 1287464 - RNA, 19 nt, Human
ugagggaguggggcugcug

SEQ ID NO: 1287465 - RNA, 20 nt, Human
ugagggaguggggcugcugg

SEQ ID NO: 1287466 - RNA, 24 nt, Human
ugccccucuccucucagggcucca

SEQ ID NO: 1287467 - RNA, 21 nt, Human
ugcuggcugggcuggagccgg

SEQ ID NO: 1287468 - RNA, 22 nt, Human
uggcaucguguggguguguggg

SEQ ID NO: 1287469 - RNA, 19 nt, Human
ugggugaugagggccgggg

SEQ ID NO: 1287470 - RNA, 23 nt, Human
uggguggggacacggugcgugug

SEQ ID NO: 1287471 - RNA, 20 nt, Human
uguccuggguggggacacgg

SEQ ID NO: 1287472 - RNA, 18 nt, Human
uucguagcccccagacuu

SEQ ID NO: 1287473 - RNA, 25 nt, Human
uucguagcccccagacuuaccuccc

SEQ ID NO: 1287474 - RNA, 21 nt, Human
accaucaguccucccugccac

SEQ ID NO: 1287475 - RNA, 18 nt, Human
ccgcucgagcccaacucc

SEQ ID NO: 1287476 - RNA, 23 nt, Human
ccucccugccacucgguaagggc

SEQ ID NO: 1287477 - RNA, 18 nt, Human
ccugccacccuuguacug

SEQ ID NO: 1287478 - RNA, 21 nt, Human
cuccggugccaccugccaccc

SEQ ID NO: 1287479 - RNA, 21 nt, Human
gcguuauaaccaucaguccuc

SEQ ID NO: 1287480 - RNA, 21 nt, Human
ucgguaagggcugucuccuuc

SEQ ID NO: 1287481 - RNA, 19 nt, Human
ugccaccugccacccuugu

SEQ ID NO: 1287482 - RNA, 20 nt, Human
aaaggggccgcgcgccagcg

SEQ ID NO: 1287483 - RNA, 22 nt, Human
caagcaggugucccgcccuugc

SEQ ID NO: 1287484 - RNA, 18 nt, Human
cgcgcgccagcgccaagc

SEQ ID NO: 1287485 - RNA, 20 nt, Human
gggcucucggcgucccagac

SEQ ID NO: 1287486 - RNA, 18 nt, Human
uccaggcaaccgcggacg

SEQ ID NO: 1287487 - RNA, 24 nt, Human
uguuuggaaaagucucgcuccagg

SEQ ID NO: 1287488 - RNA, 20 nt, Human
caccuggccaccagagggcc

SEQ ID NO: 1287489 - RNA, 23 nt, Human
caccuggccaccagagggcccag

SEQ ID NO: 1287490 - RNA, 18 nt, Human
ccuggccaccagagggcc

SEQ ID NO: 1287491 - RNA, 21 nt, Human
cgcagugacagcuggaguuuc

SEQ ID NO: 1287492 - RNA, 19 nt, Human
cucagggccuuggcaucag

SEQ ID NO: 1287493 - RNA, 21 nt, Human
cucugcugcucagggccuugg

SEQ ID NO: 1287494 - RNA, 24 nt, Human
cuggaguuucuacggcaaagugau

SEQ ID NO: 1287495 - RNA, 18 nt, Human
gaugacugcaaugaccac

SEQ ID NO: 1287496 - RNA, 25 nt, Human
gccaccagagggcccagugagagaa

SEQ ID NO: 1287497 - RNA, 19 nt, Human
ugacagcuggaguuucuac

SEQ ID NO: 1287498 - RNA, 19 nt, Human
ugacugcaaugaccacgga

SEQ ID NO: 1287499 - RNA, 21 nt, Human
uguggccggcccucugcugcu

SEQ ID NO: 1287500 - RNA, 19 nt, Human
aagagcacugagcuacacc

SEQ ID NO: 1287501 - RNA, 18 nt, Human
agagcacugagcuacacc

SEQ ID NO: 1287502 - RNA, 23 nt, Human
caagagcacugagcuacaccagu

SEQ ID NO: 1287503 - RNA, 21 nt, Human
caguaaccaagagcacugagc

SEQ ID NO: 1287504 - RNA, 23 nt, Human
cucuuuguuuugucaucagagau

SEQ ID NO: 1287505 - RNA, 24 nt, Human
guuuugucaucagagaucacuugu

SEQ ID NO: 1287506 - RNA, 20 nt, Human
ucagagaucacuuguugcuu

SEQ ID NO: 1287507 - RNA, 21 nt, Human
ucuuuguuuugucaucagaga

SEQ ID NO: 1287508 - RNA, 21 nt, Human
ugacagugcuuuggaaugucu

SEQ ID NO: 1287509 - RNA, 22 nt, Human
uuguugcuucaguaaccaagag

SEQ ID NO: 1287510 - RNA, 18 nt, Human
ccauugcugacgagguga

SEQ ID NO: 1287511 - RNA, 18 nt, Human
gagagacagagauuugga

SEQ ID NO: 1287512 - RNA, 19 nt, Human
gcagggugcugacugccgg

SEQ ID NO: 1287513 - RNA, 19 nt, Human
ggagagacagagauuugga

SEQ ID NO: 1287514 - RNA, 18 nt, Human
ggugcugacugccggaga

SEQ ID NO: 1287515 - RNA, 23 nt, Human
uaauccauugcugacgaggugac

SEQ ID NO: 1287516 - RNA, 20 nt, Human
ugcagggugcugacugccgg

SEQ ID NO: 1287517 - RNA, 21 nt, Human
aauggcuuucccaugcucuuu

SEQ ID NO: 1287518 - RNA, 26 nt, Human
agaaggcugccuggaaaugggcacca

SEQ ID NO: 1287519 - RNA, 22 nt, Human
agccgacacuggaacuggaaca

SEQ ID NO: 1287520 - RNA, 18 nt, Human
augggcaccaugcaacug

SEQ ID NO: 1287521 - RNA, 20 nt, Human
cagccgacacuggaacugga

SEQ ID NO: 1287522 - RNA, 21 nt, Human
ccaugcaacuguccaucgugu

SEQ ID NO: 1287523 - RNA, 25 nt, Human
gagaaggcugccuggaaaugggcac

SEQ ID NO: 1287524 - RNA, 22 nt, Human
gggucagaacgagggaagaagg

SEQ ID NO: 1287525 - RNA, 20 nt, Human
ucagccgacacuggaacugg

SEQ ID NO: 1287526 - RNA, 18 nt, Human
ugaaauggcuuucccaug

SEQ ID NO: 1287527 - RNA, 23 nt, Human
ugaaauggcuuucccaugcucuu

SEQ ID NO: 1287528 - RNA, 23 nt, Human
uggaacauucaccagcuuugaaa

SEQ ID NO: 1287529 - RNA, 26 nt, Human
uggcuuucccaugcucuuuuccuuga

SEQ ID NO: 1287530 - RNA, 19 nt, Human
agggugcuucugcaacugg

SEQ ID NO: 1287531 - RNA, 20 nt, Human
ccucugggcagcaacuucca

SEQ ID NO: 1287532 - RNA, 19 nt, Human
cugggcagcaacuuccaug

SEQ ID NO: 1287533 - RNA, 23 nt, Human
gggcuuugggauggcaaaagaag

SEQ ID NO: 1287534 - RNA, 22 nt, Human
uagcuucgacugcccugcauga

SEQ ID NO: 1287535 - RNA, 18 nt, Human
uccaugagcacccugggc

SEQ ID NO: 1287536 - RNA, 24 nt, Human
uccaugagcacccugggcuuuggg

SEQ ID NO: 1287537 - RNA, 18 nt, Human
ugaccucugggcagcaac

SEQ ID NO: 1287538 - RNA, 20 nt, Human
ugagaaugcugaccucuggg

SEQ ID NO: 1287539 - RNA, 20 nt, Human
ugagcacccugggcuuuggg

SEQ ID NO: 1287540 - RNA, 18 nt, Human
ugggauggcaaaagaagg

SEQ ID NO: 1287541 - RNA, 20 nt, Human
uugagaaugcugaccucugg

SEQ ID NO: 1287542 - RNA, 22 nt, Human
uugggauggcaaaagaaggagc

SEQ ID NO: 1287543 - RNA, 24 nt, Human
aagaagcaugagcugggccuggug

SEQ ID NO: 1287544 - RNA, 18 nt, Human
acaggaggcagaggcugg

SEQ ID NO: 1287545 - RNA, 23 nt, Human
agacaggcaggaaucuggccagg

SEQ ID NO: 1287546 - RNA, 22 nt, Human
aggaggcagaggcugggccugg

SEQ ID NO: 1287547 - RNA, 23 nt, Human
aggcugggccuggagaggcugcc

SEQ ID NO: 1287548 - RNA, 21 nt, Human
caccaggaggcagcaguuggg

SEQ ID NO: 1287549 - RNA, 22 nt, Human
cacuggguggcaggagcugggu

SEQ ID NO: 1287550 - RNA, 25 nt, Human
cacuggguggcaggagcugggugug

SEQ ID NO: 1287551 - RNA, 22 nt, Human
cagcaguugggacuagagaggc

SEQ ID NO: 1287552 - RNA, 19 nt, Human
caggcaggaaucuggccag

SEQ ID NO: 1287553 - RNA, 19 nt, Human
cccuugugaggcaugagcu

SEQ ID NO: 1287554 - RNA, 20 nt, Human
ccugggacaggagcugggcc

SEQ ID NO: 1287555 - RNA, 23 nt, Human
cguccugggacaggagcugggcc

SEQ ID NO: 1287556 - RNA, 22 nt, Human
cuaaagaggccacuggguggca

SEQ ID NO: 1287557 - RNA, 19 nt, Human
cugggccuggagaggccac

SEQ ID NO: 1287558 - RNA, 19 nt, Human
cugggccuggagaggcugc

SEQ ID NO: 1287559 - RNA, 26 nt, Human
gagcugggccuggagaggccaccgug

SEQ ID NO: 1287560 - RNA, 24 nt, Human
gccaagaugcaggagcugggccug

SEQ ID NO: 1287561 - RNA, 18 nt, Human
gccuggugaggucgacuu

SEQ ID NO: 1287562 - RNA, 19 nt, Human
ggaaguuuugggccuggag

SEQ ID NO: 1287563 - RNA, 18 nt, Human
ggacuguagaggcugaca

SEQ ID NO: 1287564 - RNA, 18 nt, Human
ggaggcagaggcugggcc

SEQ ID NO: 1287565 - RNA, 18 nt, Human
ggccuggagaggccaccg

SEQ ID NO: 1287566 - RNA, 19 nt, Human
gggccuggagaugacgucc

SEQ ID NO: 1287567 - RNA, 20 nt, Human
gggccuggagaugacguccu

SEQ ID NO: 1287568 - RNA, 18 nt, Human
gugaggcagaugcugggc

SEQ ID NO: 1287569 - RNA, 21 nt, Human
gugaggucgacuugaggaagu

SEQ ID NO: 1287570 - RNA, 18 nt, Human
guggcaggagcugggugu

SEQ ID NO: 1287571 - RNA, 24 nt, Human
uccacagugaggcagaugcugggc

SEQ ID NO: 1287572 - RNA, 20 nt, Human
ugaaagguugggagcuuggc

SEQ ID NO: 1287573 - RNA, 22 nt, Human
ugaaagguugggagcuuggcuu

SEQ ID NO: 1287574 - RNA, 20 nt, Human
ugacaggaggcagaggcugg

SEQ ID NO: 1287575 - RNA, 22 nt, Human
ugacaggaggcagaggcugggc

SEQ ID NO: 1287576 - RNA, 19 nt, Human
ugagcugggccuggugagg

SEQ ID NO: 1287577 - RNA, 20 nt, Human
ugaggcaagagcugggccug

SEQ ID NO: 1287578 - RNA, 22 nt, Human
ugaggcaagagcugggccuguc

SEQ ID NO: 1287579 - RNA, 18 nt, Human
ugaggcagaugcugggcc

SEQ ID NO: 1287580 - RNA, 19 nt, Human
ugcugggagacaggcagga

SEQ ID NO: 1287581 - RNA, 19 nt, Human
ugcugggccugaagaaucu

SEQ ID NO: 1287582 - RNA, 18 nt, Human
uggagaggccaccgugag

SEQ ID NO: 1287583 - RNA, 21 nt, Human
uggcaggagcuggguguguag

SEQ ID NO: 1287584 - RNA, 22 nt, Human
ugggagacaggcaggaaucugg

SEQ ID NO: 1287585 - RNA, 24 nt, Human
ugggccuggaaaggcccuugugac

SEQ ID NO: 1287586 - RNA, 18 nt, Human
ugggccuggagaggcugc

SEQ ID NO: 1287587 - RNA, 18 nt, Human
uggguggcaggagcuggg

SEQ ID NO: 1287588 - RNA, 25 nt, Human
agaagagacagaagagaagacagaa

SEQ ID NO: 1287589 - RNA, 26 nt, Human
agacagaagagaagacagaagggacc

SEQ ID NO: 1287590 - RNA, 21 nt, Human
caaguuagaaguggcagacca

SEQ ID NO: 1287591 - RNA, 22 nt, Human
cucagaugaaagagaagagaca

SEQ ID NO: 1287592 - RNA, 18 nt, Human
cugcuacaucaacagagg

SEQ ID NO: 1287593 - RNA, 20 nt, Human
cuguguucaucuugugacuc

SEQ ID NO: 1287594 - RNA, 19 nt, Human
gacucugcuacaucaacag

SEQ ID NO: 1287595 - RNA, 25 nt, Human
gaugaaagagaagagacagaagaga

SEQ ID NO: 1287596 - RNA, 19 nt, Human
uagaaguggcagaccauug

SEQ ID NO: 1287597 - RNA, 22 nt, Human
ucuaaccuaacuucaagaaagu

SEQ ID NO: 1287598 - RNA, 19 nt, Human
ucuaugaucucagaugaaa

SEQ ID NO: 1287599 - RNA, 21 nt, Human
ucugcuacaucaacagaggcu

SEQ ID NO: 1287600 - RNA, 22 nt, Human
ugagaacaugaucuaaccuaac

SEQ ID NO: 1287601 - RNA, 24 nt, Human
uguucaucuugugacucugcuaca

SEQ ID NO: 1287602 - RNA, 18 nt, Human
uucaucuugugacucugc

SEQ ID NO: 1287603 - RNA, 22 nt, Human
ccuucuuguggcucugagaguc

SEQ ID NO: 1287604 - RNA, 22 nt, Human
cuucuuguggcucugagagucc

SEQ ID NO: 1287605 - RNA, 19 nt, Human
gcaaaggagagaugaccuu

SEQ ID NO: 1287606 - RNA, 19 nt, Human
cagggggcgcugcugcugc

SEQ ID NO: 1287607 - RNA, 21 nt, Human
ccaggcagggcgagcgccaag

SEQ ID NO: 1287608 - RNA, 20 nt, Human
ugcugcugcugcugggaagc

SEQ ID NO: 1287609 - RNA, 19 nt, Human
uuguccaggcagggcgagc

SEQ ID NO: 1287610 - RNA, 18 nt, Human
aaaugccacugaugggau

SEQ ID NO: 1287611 - RNA, 20 nt, Human
accgcuggacucuuccuuag

SEQ ID NO: 1287612 - RNA, 21 nt, Human
agaaauaaugauagagcuugg

SEQ ID NO: 1287613 - RNA, 22 nt, Human
agaaauaaugauagagcuuggg

SEQ ID NO: 1287614 - RNA, 20 nt, Human
aggcaagugcugaauggacc

SEQ ID NO: 1287615 - RNA, 21 nt, Human
auagagcuugggacucagauu

SEQ ID NO: 1287616 - RNA, 18 nt, Human
cacacuguuuuucccucu

SEQ ID NO: 1287617 - RNA, 19 nt, Human
cacacuguuuuucccucug

SEQ ID NO: 1287618 - RNA, 19 nt, Human
caccagcaacaccuguggu

SEQ ID NO: 1287619 - RNA, 23 nt, Human
cagcaacaccuguggucucacca

SEQ ID NO: 1287620 - RNA, 18 nt, Human
ccacugaugggaugucug

SEQ ID NO: 1287621 - RNA, 20 nt, Human
cugaauggaccgcuggacuc

SEQ ID NO: 1287622 - RNA, 24 nt, Human
cugaggcuguuugcuuaucuguuc

SEQ ID NO: 1287623 - RNA, 22 nt, Human
gccagccaagcauccucaucac

SEQ ID NO: 1287624 - RNA, 23 nt, Human
gcuagaaugcauggggccagcca

SEQ ID NO: 1287625 - RNA, 20 nt, Human
uaaugauagagcuugggacu

SEQ ID NO: 1287626 - RNA, 23 nt, Human
ucaccagcaacaccuguggucuc

SEQ ID NO: 1287627 - RNA, 23 nt, Human
ucuccugugagcaagucaccagc

SEQ ID NO: 1287628 - RNA, 24 nt, Human
ucucugcugugaccacaguggugc

SEQ ID NO: 1287629 - RNA, 20 nt, Human
ugagcaagucaccagcaaca

SEQ ID NO: 1287630 - RNA, 23 nt, Human
ugcugcuucucuuucacagcagu

SEQ ID NO: 1287631 - RNA, 19 nt, Human
uggccuugaguuacuaccu

SEQ ID NO: 1287632 - RNA, 19 nt, Human
ugguugcuuucccaagauu

SEQ ID NO: 1287633 - RNA, 25 nt, Human
uucaaccuucucucccuuuugggua

SEQ ID NO: 1287634 - RNA, 24 nt, Human
agccuuugaagauggagcugguug

SEQ ID NO: 1287635 - RNA, 21 nt, Human
caaacagcagagccuuugaag

SEQ ID NO: 1287636 - RNA, 26 nt, Human
cacacaaacagcagagccuuugaaga

SEQ ID NO: 1287637 - RNA, 20 nt, Human
cagagcucacaccuuucugu

SEQ ID NO: 1287638 - RNA, 26 nt, Human
ccagagcucacaccuuucugugucuu

SEQ ID NO: 1287639 - RNA, 22 nt, Human
cugcauggagaauggaugaacu

SEQ ID NO: 1287640 - RNA, 23 nt, Human
uacaggauuucuuucaucucuug

SEQ ID NO: 1287641 - RNA, 21 nt, Human
uauacacacaaacagcagagc

SEQ ID NO: 1287642 - RNA, 22 nt, Human
ucuauagaagguggcuccuuuc

SEQ ID NO: 1287643 - RNA, 18 nt, Human
ucucuuguggggaguaaa

SEQ ID NO: 1287644 - RNA, 23 nt, Human
ucugugucuugcuguaguuuugu

SEQ ID NO: 1287645 - RNA, 19 nt, Human
uucaucucuuguggggagu

SEQ ID NO: 1287646 - RNA, 23 nt, Human
aaaaaauccaaaauuaguaaaga

SEQ ID NO: 1287647 - RNA, 23 nt, Human
aaaauuaguaaagaaaaauauaa

SEQ ID NO: 1287648 - RNA, 18 nt, Human
aagcugugggacugcggc

SEQ ID NO: 1287649 - RNA, 31 nt, Human
agaaaaaaaauccaaaauuaguaaagaaaaa

SEQ ID NO: 1287650 - RNA, 23 nt, Human
aguaucuucccugcccaauaauu

SEQ ID NO: 1287651 - RNA, 18 nt, Human
caaagcaccccagcucuc

SEQ ID NO: 1287652 - RNA, 27 nt, Human
gccucacacgaauaacuuuuauuucac

SEQ ID NO: 1287653 - RNA, 18 nt, Human
gcggcccgguuccaggcc

SEQ ID NO: 1287654 - RNA, 30 nt, Human; identical to SEQ ID NO: 553021

SEQ ID NO: 1287655 - RNA, 19 nt, Human
guaaagaaaaauauaagaa

SEQ ID NO: 1287656 - RNA, 20 nt, Human
gugguugucgaagcuguggg

SEQ ID NO: 1287657 - RNA, 24 nt, Human
uaacuuuuauuucacucaaauuag

SEQ ID NO: 1287658 - RNA, 25 nt, Human
ugaaugaauacccuaaaggcaaacc

SEQ ID NO: 1287659 - RNA, 21 nt, Human
ugaucuagguugcuuuuccuu

SEQ ID NO: 1287660 - RNA, 18 nt, Human
uucaaagaaaaaaaaucc

SEQ ID NO: 1287661 - RNA, 20 nt, Human
uugcuuuuccuucagcaagg

SEQ ID NO: 1287662 - RNA, 18 nt, Human
uuuaaaaaguauuuagag

SEQ ID NO: 1287663 - RNA, 24 nt, Human
aaaaauucguuauuauucagauaa

SEQ ID NO: 1287664 - RNA, 20 nt, Human
aacggcgugacugcggcggg

SEQ ID NO: 1287665 - RNA, 22 nt, Human
aagcugaggucccggaucucac

SEQ ID NO: 1287666 - RNA, 19 nt, Human
aggcugcgcaggcggcgcc

SEQ ID NO: 1287667 - RNA, 24 nt, Human
aggugagcgccgccagccuggagc

SEQ ID NO: 1287668 - RNA, 19 nt, Human
caacaugauuuuguaguac

SEQ ID NO: 1287669 - RNA, 22 nt, Human
cagcuacuagugauuaagaacg

SEQ ID NO: 1287670 - RNA, 20 nt, Human
cccacgacaacuuccugaga

SEQ ID NO: 1287671 - RNA, 20 nt, Human
ccgccgccggagacccgcuc

SEQ ID NO: 1287672 - RNA, 18 nt, Human
ccggccccgcccccugcc

SEQ ID NO: 1287673 - RNA, 18 nt, Human
ccuccgggcggccggccc

SEQ ID NO: 1287674 - RNA, 21 nt, Human
ccugggucacccggcuaggag

SEQ ID NO: 1287675 - RNA, 20 nt, Human
cgcugcagcgccggcacgcc

SEQ ID NO: 1287676 - RNA, 18 nt, Human
cggcgccaggcccgggcc

SEQ ID NO: 1287677 - RNA, 20 nt, Human
cugaggucccggaucucacc

SEQ ID NO: 1287678 - RNA, 19 nt, Human
gagccugcuugcaaagcug

SEQ ID NO: 1287679 - RNA, 24 nt, Human
gcccccgucgccgccgccggagac

SEQ ID NO: 1287680 - RNA, 25 nt, Human
gugaagaaacugcaguccugugcgg

SEQ ID NO: 1287681 - RNA, 22 nt, Human
uaaaaagccucugccccacgac

SEQ ID NO: 1287682 - RNA, 20 nt, Human
ucacgcgcggcccggccccu

SEQ ID NO: 1287683 - RNA, 19 nt, Human
ucgccgccuugcagcgccg

SEQ ID NO: 1287684 - RNA, 24 nt, Human
ugaagaaacugcaguccugugcgg

SEQ ID NO: 1287685 - RNA, 20 nt, Human
ugagaaccugacccggcagg

SEQ ID NO: 1287686 - RNA, 22 nt, Human
ugagcgccgccagccuggagca

SEQ ID NO: 1287687 - RNA, 20 nt, Human
ugcagcgccgcgagcccagc

SEQ ID NO: 1287688 - RNA, 25 nt, Human
ugccccacgacaacuuccugagauu

SEQ ID NO: 1287689 - RNA, 21 nt, Human
ugcggcgggucacgcgcggcc

SEQ ID NO: 1287690 - RNA, 19 nt, Human
uuaaaaagccucugcccca

SEQ ID NO: 1287691 - RNA, 20 nt, Human
uuccugagaucugugaagaa

SEQ ID NO: 1287692 - RNA, 25 nt, Human
uugcagcgccgcgagcccagcgccc

SEQ ID NO: 1287693 - RNA, 21 nt, Human
uuuguaguacucuaucucagg

SEQ ID NO: 1287694 - RNA, 21 nt, Human
aaaaaugccaccauggccucc

SEQ ID NO: 1287695 - RNA, 19 nt, Human
aacaccugccccgcagcuc

SEQ ID NO: 1287696 - RNA, 23 nt, Human
aaccuucuucccuguuugcccac

SEQ ID NO: 1287697 - RNA, 18 nt, Human
aacuccuagcccaguccc

SEQ ID NO: 1287698 - RNA, 24 nt, Human
aagcggcggcaaccgaggcgagca

SEQ ID NO: 1287699 - RNA, 18 nt, Human
aaggagcacuggcugcag

SEQ ID NO: 1287700 - RNA, 24 nt, Human
aaguccccucccagaucugugacc

SEQ ID NO: 1287701 - RNA, 25 nt, Human
acagguaccagagacugccccccac

SEQ ID NO: 1287702 - RNA, 20 nt, Human
acagucccagaagggcccag

SEQ ID NO: 1287703 - RNA, 19 nt, Human
accaugcccaugcccccgc

SEQ ID NO: 1287704 - RNA, 18 nt, Human
acccgcuccuucaggucc

SEQ ID NO: 1287705 - RNA, 21 nt, Human
acccgcuccuucagguccacc

SEQ ID NO: 1287706 - RNA, 19 nt, Human
acccugauguccccacuuc

SEQ ID NO: 1287707 - RNA, 21 nt, Human
acugcccccuggcugauguac

SEQ ID NO: 1287708 - RNA, 19 nt, Human
agaaagacaauaggcugcc

SEQ ID NO: 1287709 - RNA, 22 nt, Human
agacugccccccacggccccaa

SEQ ID NO: 1287710 - RNA, 22 nt, Human
agcaaggcagccagggcggcac

SEQ ID NO: 1287711 - RNA, 19 nt, Human
aggagcagaggcgagucug

SEQ ID NO: 1287712 - RNA, 18 nt, Human
aggaugcccaggcccugc

SEQ ID NO: 1287713 - RNA, 21 nt, Human
agggcccagcuccugggcggc

SEQ ID NO: 1287714 - RNA, 25 nt, Human
agguaccagagacugccccccacgg

SEQ ID NO: 1287715 - RNA, 19 nt, Human
aguccagcgccaggaugcc

SEQ ID NO: 1287716 - RNA, 25 nt, Human
agugacggggggagcuugacaagga

SEQ ID NO: 1287717 - RNA, 26 nt, Human
aucucuccccucccugugccucccag

SEQ ID NO: 1287718 - RNA, 25 nt, Human
augcccagaggagugcccugggggc

SEQ ID NO: 1287719 - RNA, 21 nt, Human
augugggaaccagaacacacu

SEQ ID NO: 1287720 - RNA, 22 nt, Human
augugggaaccagaacacacug

SEQ ID NO: 1287721 - RNA, 20 nt, Human
auuugccaugccccuccuug

SEQ ID NO: 1287722 - RNA, 20 nt, Human
caaaauuugccaugccccuc

SEQ ID NO: 1287723 - RNA, 25 nt, Human
caaccgaggcgagcaaugggcacgg

SEQ ID NO: 1287724 - RNA, 19 nt, Human
caacuccuagcccaguccc

SEQ ID NO: 1287725 - RNA, 21 nt, Human
caagcugcaacaccugccccg

SEQ ID NO: 1287726 - RNA, 23 nt, Human
caaguccagcgccaggaugccca

SEQ ID NO: 1287727 - RNA, 21 nt, Human
cacacagguaccagagacugc

SEQ ID NO: 1287728 - RNA, 19 nt, Human
cacacccaagcuccugggc

SEQ ID NO: 1287729 - RNA, 22 nt, Human
cacacugauggaggaguuggca

SEQ ID NO: 1287730 - RNA, 22 nt, Human
cacagacucacccccacucucu

SEQ ID NO: 1287731 - RNA, 19 nt, Human
caccaugcccaugcccccg

SEQ ID NO: 1287732 - RNA, 21 nt, Human
caccccgcgcaccggcuacaa

SEQ ID NO: 1287733 - RNA, 22 nt, Human
caccuggagugacggggggagc

SEQ ID NO: 1287734 - RNA, 22 nt, Human
caccuucaucuccuccuggucc

SEQ ID NO: 1287735 - RNA, 20 nt, Human
cacucucuggggcuggggcc

SEQ ID NO: 1287736 - RNA, 19 nt, Human
cacugcgcuggggcggggc

SEQ ID NO: 1287737 - RNA, 19 nt, Human
cacuggcugcagggggggg

SEQ ID NO: 1287738 - RNA, 20 nt, Human
cagauguccuccuccaucuc

SEQ ID NO: 1287739 - RNA, 20 nt, Human
cagcaauccaguggugauca

SEQ ID NO: 1287740 - RNA, 22 nt, Human
cagcacacccaagcuccugggc

SEQ ID NO: 1287741 - RNA, 22 nt, Human
cagcagcggcugcggcuaaagc

SEQ ID NO: 1287742 - RNA, 19 nt, Human
cagccagggcggcacaggc

SEQ ID NO: 1287743 - RNA, 20 nt, Human
cagcuccugggcuuccuccu

SEQ ID NO: 1287744 - RNA, 24 nt, Human
cagggcggcacaggcaccaggucc

SEQ ID NO: 1287745 - RNA, 18 nt, Human
cagggggggggggggggg

SEQ ID NO: 1287746 - RNA, 22 nt, Human
caggugcagagcaucccugacg

SEQ ID NO: 1287747 - RNA, 22 nt, Human
caucuccuccugguccugggcc

SEQ ID NO: 1287748 - RNA, 24 nt, Human
caucucuccccucccugugccucc

SEQ ID NO: 1287749 - RNA, 24 nt, Human
caugcaccacgcgcugaaggaggc

SEQ ID NO: 1287750 - RNA, 25 nt, Human
caugucccuagcccggccugggugg

SEQ ID NO: 1287751 - RNA, 24 nt, Human
ccaaaaucccccacccgggaugcc

SEQ ID NO: 1287752 - RNA, 23 nt, Human
ccaaacacagacucacccccacu

SEQ ID NO: 1287753 - RNA, 20 nt, Human
ccaacuccuagcccaguccc

SEQ ID NO: 1287754 - RNA, 24 nt, Human
ccacggccccaaaaucccccaccc

SEQ ID NO: 1287755 - RNA, 24 nt, Human
ccacuggaccacaggagcagaggc

SEQ ID NO: 1287756 - RNA, 19 nt, Human
ccacuuccaaguccugacu

SEQ ID NO: 1287757 - RNA, 22 nt, Human
ccacuuccaaguccugacuccu

SEQ ID NO: 1287758 - RNA, 20 nt, Human
ccagagacugccccccacgg

SEQ ID NO: 1287759 - RNA, 20 nt, Human
ccagcucccagccugggagu

SEQ ID NO: 1287760 - RNA, 20 nt, Human
ccaguggugaucacccugcu

SEQ ID NO: 1287761 - RNA, 19 nt, Human
ccaugcccccgcccgugga

SEQ ID NO: 1287762 - RNA, 19 nt, Human
ccauggccucccggcucuc

SEQ ID NO: 1287763 - RNA, 24 nt, Human
cccaaaaucccccacccgggaugc

SEQ ID NO: 1287764 - RNA, 22 nt, Human
cccacccgggaugcccagagga

SEQ ID NO: 1287765 - RNA, 24 nt, Human
cccacggccccaaaaucccccacc

SEQ ID NO: 1287766 - RNA, 21 nt, Human
ccccaaacacagacucacccc

SEQ ID NO: 1287767 - RNA, 23 nt, Human
cccccacccgggaugcccagagg

SEQ ID NO: 1287768 - RNA, 21 nt, Human
ccccccacggccccaaaaucc

SEQ ID NO: 1287769 - RNA, 18 nt, Human
ccccucccugugccuccc

SEQ ID NO: 1287770 - RNA, 22 nt, Human
cccgcgcaccggcuacaagccg

SEQ ID NO: 1287771 - RNA, 21 nt, Human
cccggcucuccagguccccug

SEQ ID NO: 1287772 - RNA, 19 nt, Human
cccuagcccggccugggug

SEQ ID NO: 1287773 - RNA, 21 nt, Human
cccuagcccggccuggguggc

SEQ ID NO: 1287774 - RNA, 19 nt, Human
ccuagcccggccugggugg

SEQ ID NO: 1287775 - RNA, 19 nt, Human
ccucuggcuuuuucuggga

SEQ ID NO: 1287776 - RNA, 18 nt, Human
ccugacgauguccuccuc

SEQ ID NO: 1287777 - RNA, 23 nt, Human
ccugcucacuguccagauguccu

SEQ ID NO: 1287778 - RNA, 20 nt, Human
ccugggcggcaggacccagc

SEQ ID NO: 1287779 - RNA, 22 nt, Human
ccuggguggcagggcccagcuc

SEQ ID NO: 1287780 - RNA, 23 nt, Human
ccuuccauaaagucgcugcagcu

SEQ ID NO: 1287781 - RNA, 22 nt, Human
cgagaugcugcacaugcaccac

SEQ ID NO: 1287782 - RNA, 19 nt, Human
cgaggcgagcaaugggcac

SEQ ID NO: 1287783 - RNA, 22 nt, Human
cgcggagaaagacaauaggcug

SEQ ID NO: 1287784 - RNA, 20 nt, Human
cgcucagcaucaucggugac

SEQ ID NO: 1287785 - RNA, 21 nt, Human
cgcugcagcuucuccauggcc

SEQ ID NO: 1287786 - RNA, 22 nt, Human
cgcugcagcuucuccauggccc

SEQ ID NO: 1287787 - RNA, 20 nt, Human
cggccacuggaccacaggag

SEQ ID NO: 1287788 - RNA, 21 nt, Human
cggccccaaaaucccccaccc

SEQ ID NO: 1287789 - RNA, 24 nt, Human
cggcucuccagguccccugggaug

SEQ ID NO: 1287790 - RNA, 22 nt, Human
cgucucugacacugcccccugg

SEQ ID NO: 1287791 - RNA, 27 nt, Human
cucacuguccagauguccuccuccauc

SEQ ID NO: 1287792 - RNA, 22 nt, Human
cuccuagcccagucccgggggc

SEQ ID NO: 1287793 - RNA, 20 nt, Human
cuccuccaucuccgugcggc

SEQ ID NO: 1287794 - RNA, 23 nt, Human
cuccugggcuacuggggcuccua

SEQ ID NO: 1287795 - RNA, 23 nt, Human
cugcacguagccccagccacccc

SEQ ID NO: 1287796 - RNA, 22 nt, Human
cugcagcuucuccauggccccc

SEQ ID NO: 1287797 - RNA, 23 nt, Human
cuggaccucgguguccccaucug

SEQ ID NO: 1287798 - RNA, 20 nt, Human
cugggcuuccuccugcuggg

SEQ ID NO: 1287799 - RNA, 24 nt, Human
cuggggcuggggccgcuaccucug

SEQ ID NO: 1287800 - RNA, 21 nt, Human
cuuaaguccccucccagaucu

SEQ ID NO: 1287801 - RNA, 18 nt, Human
gaagugugccccauaccc

SEQ ID NO: 1287802 - RNA, 21 nt, Human
gacaauaggcugccucucccc

SEQ ID NO: 1287803 - RNA, 19 nt, Human
gacccagcuccugggcuuc

SEQ ID NO: 1287804 - RNA, 20 nt, Human
gacgaggccacugggugagc

SEQ ID NO: 1287805 - RNA, 18 nt, Human
gagcuucggugcaugggu

SEQ ID NO: 1287806 - RNA, 18 nt, Human
gagugcccugggggcaag

SEQ ID NO: 1287807 - RNA, 19 nt, Human
gcagcacacccuuuguucc

SEQ ID NO: 1287808 - RNA, 21 nt, Human
gcccccuggcugauguacuuu

SEQ ID NO: 1287809 - RNA, 23 nt, Human
gcgacagcucugcacguagcccc

SEQ ID NO: 1287810 - RNA, 19 nt, Human
gcggcagcagcggcugcgg

SEQ ID NO: 1287811 - RNA, 21 nt, Human
gcggcaggacccagcuccugg

SEQ ID NO: 1287812 - RNA, 22 nt, Human
gcggcucccggggcucccccgc

SEQ ID NO: 1287813 - RNA, 20 nt, Human
gcuaccucuggcuuuuucuu

SEQ ID NO: 1287814 - RNA, 20 nt, Human
gcuccgcgacagcucugcac

SEQ ID NO: 1287815 - RNA, 23 nt, Human
gcugcagcuucuccauggccccc

SEQ ID NO: 1287816 - RNA, 19 nt, Human
gcugcaggggggggggggg

SEQ ID NO: 1287817 - RNA, 18 nt, Human
ggcaaguggcacaccccc

SEQ ID NO: 1287818 - RNA, 18 nt, Human
ggcacuggcuccagcgga

SEQ ID NO: 1287819 - RNA, 19 nt, Human
ggcagggcccagcuccugg

SEQ ID NO: 1287820 - RNA, 22 nt, Human
ggccacugggugagccaggggc

SEQ ID NO: 1287821 - RNA, 20 nt, Human
ggcccggugggucuccccaa

SEQ ID NO: 1287822 - RNA, 22 nt, Human
ggccuggguggcagggcccagc

SEQ ID NO: 1287823 - RNA, 18 nt, Human
ggcggcggcagcagcggc

SEQ ID NO: 1287824 - RNA, 18 nt, Human
ggcucccggggcuccccc

SEQ ID NO: 1287825 - RNA, 25 nt, Human
ggcugcagggggggggggggggggu

SEQ ID NO: 1287826 - RNA, 19 nt, Human
gggcaaguggcacaccccc

SEQ ID NO: 1287827 - RNA, 22 nt, Human
gggcaaguggcacacccccuuc

SEQ ID NO: 1287828 - RNA, 19 nt, Human
gggcacuggcuccagcgga

SEQ ID NO: 1287829 - RNA, 23 nt, Human
gggcuacuggggcuccuagaguc

SEQ ID NO: 1287830 - RNA, 22 nt, Human
ggggagguggaucuuccagucg

SEQ ID NO: 1287831 - RNA, 19 nt, Human
ggggccgcuaccucuggcu

SEQ ID NO: 1287832 - RNA, 21 nt, Human
ggggcuccuagagugggcuca

SEQ ID NO: 1287833 - RNA, 20 nt, Human
ggggcuggggccgcuaccuc

SEQ ID NO: 1287834 - RNA, 18 nt, Human
gggggggggggggggggu

SEQ ID NO: 1287835 - RNA, 25 nt, Human
ggucccaaccuucuucccuguuugc

SEQ ID NO: 1287836 - RNA, 21 nt, Human
guagccccagccaccccgcgc

SEQ ID NO: 1287837 - RNA, 19 nt, Human
guccgcccuuggggaagug

SEQ ID NO: 1287838 - RNA, 23 nt, Human
gucuuuuccucuggaccucggug

SEQ ID NO: 1287839 - RNA, 20 nt, Human
guggcagggaggagcuucgg

SEQ ID NO: 1287840 - RNA, 19 nt, Human
uaagcuccggcaaccgccu

SEQ ID NO: 1287841 - RNA, 25 nt, Human
uaggcugccucucccccggcggcgg

SEQ ID NO: 1287842 - RNA, 22 nt, Human
uaggucuuaaguccccucccag

SEQ ID NO: 1287843 - RNA, 19 nt, Human
ucaaaauuugccaugcccc

SEQ ID NO: 1287844 - RNA, 22 nt, Human
ucagcaggguucugggcaaugg

SEQ ID NO: 1287845 - RNA, 22 nt, Human
ucagguccaccuucuccuucca

SEQ ID NO: 1287846 - RNA, 27 nt, Human
uccagcgcacagucccagaagggcccc

SEQ ID NO: 1287847 - RNA, 22 nt, Human
ucccaggucgcccaaguccagc

SEQ ID NO: 1287848 - RNA, 24 nt, Human
ucccaggucgcccaaguccagcgc

SEQ ID NO: 1287849 - RNA, 22 nt, Human
uccccaaacacagacucacccc

SEQ ID NO: 1287850 - RNA, 23 nt, Human
ucccccgcgggccgagccgagac

SEQ ID NO: 1287851 - RNA, 20 nt, Human
ucccggggcucccccgcggg

SEQ ID NO: 1287852 - RNA, 21 nt, Human
ucccuagcccggccugggugg

SEQ ID NO: 1287853 - RNA, 19 nt, Human
uccggccacuggaccacag

SEQ ID NO: 1287854 - RNA, 21 nt, Human
uccggccacuggaccacagga

SEQ ID NO: 1287855 - RNA, 19 nt, Human
uccgugcggcucccggggc

SEQ ID NO: 1287856 - RNA, 22 nt, Human
uccuagagugggcucaucagca

SEQ ID NO: 1287857 - RNA, 21 nt, Human
uccuccugcuggguccgcccc

SEQ ID NO: 1287858 - RNA, 18 nt, Human
uccugggcggcaggaccc

SEQ ID NO: 1287859 - RNA, 23 nt, Human
uccugggcggcaggacccagcuc

SEQ ID NO: 1287860 - RNA, 21 nt, Human
uccuuguggucgcccacaagc

SEQ ID NO: 1287861 - RNA, 21 nt, Human
ucgcugcagcuucuccauggc

SEQ ID NO: 1287862 - RNA, 23 nt, Human
ucuccccaaacacagacucaccc

SEQ ID NO: 1287863 - RNA, 21 nt, Human
ucucgcugcugggggcggggc

SEQ ID NO: 1287864 - RNA, 21 nt, Human
ugacacugcccccuggcugau

SEQ ID NO: 1287865 - RNA, 23 nt, Human
ugacacugcccccuggcugaugu

SEQ ID NO: 1287866 - RNA, 18 nt, Human
ugacggggggagcuugac

SEQ ID NO: 1287867 - RNA, 20 nt, Human
ugacuccuuugagccauccc

SEQ ID NO: 1287868 - RNA, 18 nt, Human
ugagaaaaggcagugggg

SEQ ID NO: 1287869 - RNA, 20 nt, Human
ugagaaaaggcaguggggag

SEQ ID NO: 1287870 - RNA, 21 nt, Human
ugagaaaaggcaguggggagg

SEQ ID NO: 1287871 - RNA, 23 nt, Human
ugagaaaaggcaguggggaggug

SEQ ID NO: 1287872 - RNA, 23 nt, Human
ugauagucagggucccaccuccu

SEQ ID NO: 1287873 - RNA, 21 nt, Human
ugcaggggggggggggggggg

SEQ ID NO: 1287874 - RNA, 22 nt, Human
ugccagggcagguauccagcuc

SEQ ID NO: 1287875 - RNA, 22 nt, Human
ugcccagaggagugcccugggg

SEQ ID NO: 1287876 - RNA, 25 nt, Human
ugccccgcagcuccugcagguucac

SEQ ID NO: 1287877 - RNA, 21 nt, Human
ugcccugggggcaaguggcac

SEQ ID NO: 1287878 - RNA, 23 nt, Human
ugcccugggggcaaguggcacac

SEQ ID NO: 1287879 - RNA, 20 nt, Human
ugcgucucugacacugcccu

SEQ ID NO: 1287880 - RNA, 21 nt, Human
ugcugggggcggggcuuaagc

SEQ ID NO: 1287881 - RNA, 26 nt, Human
uggauuuccuucagcuacccugaugu

SEQ ID NO: 1287882 - RNA, 24 nt, Human
uggcagggaggagcuucggugcau

SEQ ID NO: 1287883 - RNA, 20 nt, Human
uggcagggcccagcuccugg

SEQ ID NO: 1287884 - RNA, 24 nt, Human
uggccucccggcucuccagguccc

SEQ ID NO: 1287885 - RNA, 23 nt, Human
ugggauguucucgcugcuggggg

SEQ ID NO: 1287886 - RNA, 24 nt, Human
ugggcggcaggacccagcuccugg

SEQ ID NO: 1287887 - RNA, 21 nt, Human
uggggccgcuaccucuggcuu

SEQ ID NO: 1287888 - RNA, 24 nt, Human
uggggcuggggccgcuaccucugg

SEQ ID NO: 1287889 - RNA, 21 nt, Human
ugggugagccaggggcuggca

SEQ ID NO: 1287890 - RNA, 24 nt, Human
uggguggcagggcccagcuccugg

SEQ ID NO: 1287891 - RNA, 24 nt, Human
uucggugcauggguguggccggca

SEQ ID NO: 1287892 - RNA, 24 nt, Human
uucucgcugcugggggcggggcuu

SEQ ID NO: 1287893 - RNA, 18 nt, Human
uucucuacccgcuccuuc

SEQ ID NO: 1287894 - RNA, 24 nt, Human
uugccaugccccuccuuguggucg

SEQ ID NO: 1287895 - RNA, 21 nt, Human
uuugcccacucucagaccccg

SEQ ID NO: 1287896 - RNA, 22 nt, Human
aaagcuuucacaacccccacac

SEQ ID NO: 1287897 - RNA, 21 nt, Human
auccaucacacguaaccccag

SEQ ID NO: 1287898 - RNA, 23 nt, Human
cacaaaaaucaaagucaucacag

SEQ ID NO: 1287899 - RNA, 18 nt, Human
cacacguaaccccaggau

SEQ ID NO: 1287900 - RNA, 24 nt, Human
cacugaaagcuuucacaaccccca

SEQ ID NO: 1287901 - RNA, 26 nt, Human
ccaggaugaauacugggcaccaacuc

SEQ ID NO: 1287902 - RNA, 18 nt, Human
gaagaacuucuuggugga

SEQ ID NO: 1287903 - RNA, 25 nt, Human
gcacugaaagcuuucacaaccggag

SEQ ID NO: 1287904 - RNA, 22 nt, Human
ggcacugaaagcuuucacaacc

SEQ ID NO: 1287905 - RNA, 19 nt, Human
guaaccccaggaugaauac

SEQ ID NO: 1287906 - RNA, 20 nt, Human
guuuuuuggucuugaaacac

SEQ ID NO: 1287907 - RNA, 21 nt, Human
uaggaaacaucugacauccau

SEQ ID NO: 1287908 - RNA, 19 nt, Human
uauuguguuuuuuggucuu

SEQ ID NO: 1287909 - RNA, 19 nt, Human
ucacacguaaccccaggau

SEQ ID NO: 1287910 - RNA, 22 nt, Human
ucugacauccaucacacguaac

SEQ ID NO: 1287911 - RNA, 23 nt, Human
ugaaacacguuucacaaaaauca

SEQ ID NO: 1287912 - RNA, 23 nt, Human
ugacagaggcuuugacccgcacu

SEQ ID NO: 1287913 - RNA, 19 nt, Human
ugagaagaacuucuuggug

SEQ ID NO: 1287914 - RNA, 22 nt, Human
ugagaagaacuucuugguggag

SEQ ID NO: 1287915 - RNA, 23 nt, Human
ugagaagaacuucuugguggagg

SEQ ID NO: 1287916 - RNA, 19 nt, Human
ugagacugcuggggaaagu

SEQ ID NO: 1287917 - RNA, 25 nt, Human
uucacaacccccacacucugaugag

SEQ ID NO: 1287918 - RNA, 20 nt, Human
uucauuuauucugccaaaug

SEQ ID NO: 1287919 - RNA, 21 nt, Human
uuggcacugaaagcuuucaca

SEQ ID NO: 1287920 - RNA, 22 nt, Human
uugguguagugacagaggcuuu

SEQ ID NO: 1287921 - RNA, 23 nt, Human
uuuugguguagugacagaggcuu

SEQ ID NO: 1287922 - RNA, 21 nt, Human
uuuuuggucuugaaacacguu

SEQ ID NO: 1287923 - RNA, 23 nt, Human
accccgggacccgcgccccaggg

SEQ ID NO: 1287924 - RNA, 19 nt, Human
caaccucuccccacccccc

SEQ ID NO: 1287925 - RNA, 22 nt, Human
caaccucuccccaccccccacc

SEQ ID NO: 1287926 - RNA, 21 nt, Human
caccccccaccaccucccgcu

SEQ ID NO: 1287927 - RNA, 22 nt, Human
caccucccgcuccuauuucacc

SEQ ID NO: 1287928 - RNA, 21 nt, Human
caccuggacuccuggccaauc

SEQ ID NO: 1287929 - RNA, 21 nt, Human
caggacccagcccugcccugu

SEQ ID NO: 1287930 - RNA, 20 nt, Human
ccaccccccaccaccucccg

SEQ ID NO: 1287931 - RNA, 21 nt, Human
ccaccccgggacccgcgcccc

SEQ ID NO: 1287932 - RNA, 23 nt, Human
ccauccgcccccaccccgggacc

SEQ ID NO: 1287933 - RNA, 26 nt, Human
ccaugcaucgccccucccccguuccc

SEQ ID NO: 1287934 - RNA, 21 nt, Human
cccaccccccaccacccgagg

SEQ ID NO: 1287935 - RNA, 25 nt, Human
cccaccccccaccaccucccgcucc

SEQ ID NO: 1287936 - RNA, 21 nt, Human
cccagcccugcccuguccccc

SEQ ID NO: 1287937 - RNA, 21 nt, Human
cccaugucugcccaggaccca

SEQ ID NO: 1287938 - RNA, 19 nt, Human
ccccaccaccucccgcucc

SEQ ID NO: 1287939 - RNA, 19 nt, Human
ccccaccaccucccgcucc

SEQ ID NO: 1287940 - RNA, 21 nt, Human
ccccaccccccaccaccuccc

SEQ ID NO: 1287941 - RNA, 22 nt, Human
ccccauugucccugggggcggg

SEQ ID NO: 1287942 - RNA, 23 nt, Human
cccccauugucccugggggcggg

SEQ ID NO: 1287943 - RNA, 19 nt, Human
ccccgggccucucugcggg

SEQ ID NO: 1287944 - RNA, 19 nt, Human
cccgggacccgcgccccag

SEQ ID NO: 1287945 - RNA, 19 nt, Human
cccugcgcgcugcccccuc

SEQ ID NO: 1287946 - RNA, 22 nt, Human
cccugcgcgcugcccccuccuc

SEQ ID NO: 1287947 - RNA, 18 nt, Human
cccugggggcggguccca

SEQ ID NO: 1287948 - RNA, 23 nt, Human
ccucccgcuccuauuucaccguc

SEQ ID NO: 1287949 - RNA, 22 nt, Human
ccuccuguccccaccccauguc

SEQ ID NO: 1287950 - RNA, 25 nt, Human
ccuccuguccccaccccaugucugc

SEQ ID NO: 1287951 - RNA, 22 nt, Human
ccuguccccaccccaugucugc

SEQ ID NO: 1287952 - RNA, 22 nt, Human
ccugucccccauugucccuggg

SEQ ID NO: 1287953 - RNA, 21 nt, Human
cggccccugcgcgcugccccc

SEQ ID NO: 1287954 - RNA, 23 nt, Human
cgggcaccuggacuccuggccaa

SEQ ID NO: 1287955 - RNA, 22 nt, Human
cucaaccucuccccacccccca

SEQ ID NO: 1287956 - RNA, 22 nt, Human
cuccuggccaaucaaggcuugc

SEQ ID NO: 1287957 - RNA, 22 nt, Human
cucuccccaccccccaccaccu

SEQ ID NO: 1287958 - RNA, 18 nt, Human
cugcgcgcugcccccucc

SEQ ID NO: 1287959 - RNA, 21 nt, Human
cuuccggagcugaacucggcc

SEQ ID NO: 1287960 - RNA, 22 nt, Human
gaacucggccccugcgcgcugc

SEQ ID NO: 1287961 - RNA, 23 nt, Human
gaucccauccgcccccaccccgg

SEQ ID NO: 1287962 - RNA, 20 nt, Human
gcagccccgggccucucugc

SEQ ID NO: 1287963 - RNA, 21 nt, Human
gcccaggacccagcccugccc

SEQ ID NO: 1287964 - RNA, 23 nt, Human
gccccgggccucucugcgggccu

SEQ ID NO: 1287965 - RNA, 21 nt, Human
gcgggccuaggcuucugccca

SEQ ID NO: 1287966 - RNA, 19 nt, Human
ggagcugaacucggccccu

SEQ ID NO: 1287967 - RNA, 20 nt, Human
gucccccauugucccugggg

SEQ ID NO: 1287968 - RNA, 21 nt, Human
uccccaccccccaccaccucc

SEQ ID NO: 1287969 - RNA, 19 nt, Human
ucccugggggcggguccca

SEQ ID NO: 1287970 - RNA, 23 nt, Human
ucccugggggcgggucccagccu

SEQ ID NO: 1287971 - RNA, 21 nt, Human
uccggagcugaacucggcccc

SEQ ID NO: 1287972 - RNA, 21 nt, Human
uccucaaccucuccccacccc

SEQ ID NO: 1287973 - RNA, 22 nt, Human
ucgccccucccccguucccucc

SEQ ID NO: 1287974 - RNA, 19 nt, Human
ucuccucaaccucucccca

SEQ ID NO: 1287975 - RNA, 19 nt, Human
ugaacucggccccugcgcg

SEQ ID NO: 1287976 - RNA, 23 nt, Human
ugcucagggcgaggggcugaggu

SEQ ID NO: 1287977 - RNA, 20 nt, Human
uucaccgucccgaucccauc

SEQ ID NO: 1287978 - RNA, 18 nt, Human
aagaugccucugugagag

SEQ ID NO: 1287979 - RNA, 24 nt, Human
acccugaaauuccuccuuggucac

SEQ ID NO: 1287980 - RNA, 21 nt, Human
agcgcagaggagaaucugugu

SEQ ID NO: 1287981 - RNA, 27 nt, Human
auccagaacaacgccauauggaccccu

SEQ ID NO: 1287982 - RNA, 26 nt, Human
cagagggcaccuguauaccuucaaac

SEQ ID NO: 1287983 - RNA, 22 nt, Human
cagcagcagccugcucuucuuu

SEQ ID NO: 1287984 - RNA, 23 nt, Human
cagcagcagccugcucuucuuuu

SEQ ID NO: 1287985 - RNA, 24 nt, Human
cauucagugguugcuccuacccau

SEQ ID NO: 1287986 - RNA, 24 nt, Human
ccacaucaaacccacucagugagc

SEQ ID NO: 1287987 - RNA, 24 nt, Human
ccagcauccaccacaucaaaccca

SEQ ID NO: 1287988 - RNA, 18 nt, Human
ccuccuuggucacugccu

SEQ ID NO: 1287989 - RNA, 24 nt, Human
gaaauuccuccuuggucacugccu

SEQ ID NO: 1287990 - RNA, 20 nt, Human
gaacucaggagcuggagcag

SEQ ID NO: 1287991 - RNA, 18 nt, Human
gaagcagagaucaggcau

SEQ ID NO: 1287992 - RNA, 19 nt, Human
uaagagcccaugcaagaac

SEQ ID NO: 1287993 - RNA, 22 nt, Human
uaagaugccucugugagaggcu

SEQ ID NO: 1287994 - RNA, 23 nt, Human
uagcgcagaggagaaucuguguu

SEQ ID NO: 1287995 - RNA, 25 nt, Human
uauaccuucaaaccagucugcaacc

SEQ ID NO: 1287996 - RNA, 23 nt, Human
uccauuguucaguaggaacugcu

SEQ ID NO: 1287997 - RNA, 20 nt, Human
ucccgagccagcauccacca

SEQ ID NO: 1287998 - RNA, 26 nt, Human
ucccuuguuguugcacgggauggcaa

SEQ ID NO: 1287999 - RNA, 24 nt, Human
ucccuuugaguuaacgacgggaau

SEQ ID NO: 1288000 - RNA, 19 nt, Human
ucucuguagaagcagagau

SEQ ID NO: 1288001 - RNA, 24 nt, Human
ucucuucaggaucucuguagaagc

SEQ ID NO: 1288002 - RNA, 25 nt, Human
ucugcaaccucaggcugaguagcag

SEQ ID NO: 1288003 - RNA, 24 nt, Human
ugaauaggcacagagggcaccugu

SEQ ID NO: 1288004 - RNA, 25 nt, Human
ugaauaggcacagagggcaccugua

SEQ ID NO: 1288005 - RNA, 20 nt, Human
ugagcagugggagcugcaga

SEQ ID NO: 1288006 - RNA, 24 nt, Human
ugagcagugggagcugcagaccag

SEQ ID NO: 1288007 - RNA, 22 nt, Human
ugcacaguacuucccgagccag

SEQ ID NO: 1288008 - RNA, 20 nt, Human
ugcuuaagagcccaugcaag

SEQ ID NO: 1288009 - RNA, 23 nt, Human
uggagcagaccauucacccugaa

SEQ ID NO: 1288010 - RNA, 23 nt, Human
uggcaggcugagugcuccauugu

SEQ ID NO: 1288011 - RNA, 21 nt, Human
uguccacauagcgcagaggag

SEQ ID NO: 1288012 - RNA, 24 nt, Human
uuccuccuuggucacugccuuuuc

SEQ ID NO: 1288013 - RNA, 21 nt, Human
aaagaggcacucagggguggg

SEQ ID NO: 1288014 - RNA, 19 nt, Human
aacaugaugaaaccccauc

SEQ ID NO: 1288015 - RNA, 20 nt, Human
aacaugaugaaaccccaucu

SEQ ID NO: 1288016 - RNA, 21 nt, Human
aacaugaugaaaccccaucuc

SEQ ID NO: 1288017 - RNA, 21 nt, Human
aacaugaugaaaccccaucuc

SEQ ID NO: 1288018 - RNA, 22 nt, Human
aaccacaagcauggaucagccc

SEQ ID NO: 1288019 - RNA, 25 nt, Human
aacucagcucucccuaccucuccua

SEQ ID NO: 1288020 - RNA, 20 nt, Human
aagcagggcccgggacugcg

SEQ ID NO: 1288021 - RNA, 18 nt, Human
aagcaggguauucacgca

SEQ ID NO: 1288022 - RNA, 24 nt, Human
aagggccaggugcgguggcucaug

SEQ ID NO: 1288023 - RNA, 18 nt, Human
aaggggcuuagagacaaa

SEQ ID NO: 1288024 - RNA, 24 nt, Human
aaggucucagcuccaggucaucgg

SEQ ID NO: 1288025 - RNA, 18 nt, Human
aaguauuuagcacuaaac

SEQ ID NO: 1288026 - RNA, 23 nt, Human
aaucauaucacagggguauugag

SEQ ID NO: 1288027 - RNA, 21 nt, Human
acaaaaaacagacuuuauuga

SEQ ID NO: 1288028 - RNA, 24 nt, Human
acagagcgagacuccaucucaaaa

SEQ ID NO: 1288029 - RNA, 21 nt, Human
accagcucucugcugccggcu

SEQ ID NO: 1288030 - RNA, 18 nt, Human
acccagagaccugggaaa

SEQ ID NO: 1288031 - RNA, 18 nt, Human
accccaucucuacuaaaa

SEQ ID NO: 1288032 - RNA, 18 nt, Human
acugcauuccagccuggg

SEQ ID NO: 1288033 - RNA, 18 nt, Human
acugcauuccagccuggg

SEQ ID NO: 1288034 - RNA, 19 nt, Human
acugcauuccagccugggc

SEQ ID NO: 1288035 - RNA, 19 nt, Human
acugcauuccagccugggc

SEQ ID NO: 1288036 - RNA, 21 nt, Human
acugcauuccagccugggcga

SEQ ID NO: 1288037 - RNA, 22 nt, Human
acugcauuccagccugggcgac

SEQ ID NO: 1288038 - RNA, 23 nt, Human
acugcauuccagccugggcgaca

SEQ ID NO: 1288039 - RNA, 24 nt, Human
acugcauuccagccugggcgacag

SEQ ID NO: 1288040 - RNA, 26 nt, Human
acugcauuccagccugggcgacagag

SEQ ID NO: 1288041 - RNA, 24 nt, Human
acuugaggucaggaguucgagacc

SEQ ID NO: 1288042 - RNA, 21 nt, Human
agaacucccaagguggcccac

SEQ ID NO: 1288043 - RNA, 23 nt, Human
agacaggcaaggccuuaagucca

SEQ ID NO: 1288044 - RNA, 22 nt, Human
agacggggguugcagugagccg

SEQ ID NO: 1288045 - RNA, 20 nt, Human
agagaccugggaaauggggg

SEQ ID NO: 1288046 - RNA, 24 nt, Human
agaguaggcccaaaaguugggggu

SEQ ID NO: 1288047 - RNA, 18 nt, Human
agcaggcaugguggugcu

SEQ ID NO: 1288048 - RNA, 19 nt, Human
agcaguagcuugggguggu

SEQ ID NO: 1288049 - RNA, 25 nt, Human
agcccaggcugggguacccagagac

SEQ ID NO: 1288050 - RNA, 24 nt, Human
agccuggccaacaugaugaaaccc

SEQ ID NO: 1288051 - RNA, 24 nt, Human
agccugggcgacagagcgagacuc

SEQ ID NO: 1288052 - RNA, 21 nt, Human
agcucccacucgccaggcggc

SEQ ID NO: 1288053 - RNA, 23 nt, Human
aggcacucagggguggggggguc

SEQ ID NO: 1288054 - RNA, 18 nt, Human
aggcaggagauucgcuug

SEQ ID NO: 1288055 - RNA, 24 nt, Human
aggcaggagauucgcuugaacccg

SEQ ID NO: 1288056 - RNA, 18 nt, Human
aggcagguggaucacuug

SEQ ID NO: 1288057 - RNA, 22 nt, Human
aggcagguggaucacuugaggu

SEQ ID NO: 1288058 - RNA, 26 nt, Human
aggcagguggaucacuugaggucagg

SEQ ID NO: 1288059 - RNA, 24 nt, Human
aggcaugguggugcuugccuguaa

SEQ ID NO: 1288060 - RNA, 27 nt, Human
aggcccaaaaguuggggguugcuucga

SEQ ID NO: 1288061 - RNA, 25 nt, Human
aggcggcagcaguagcuuggggugg

SEQ ID NO: 1288062 - RNA, 24 nt, Human
aggcugaggcaggagauucgcuug

SEQ ID NO: 1288063 - RNA, 18 nt, Human
aggggagugcccuccucc

SEQ ID NO: 1288064 - RNA, 28 nt, Human
aggggcaggcuccugaccccccaagggg

SEQ ID NO: 1288065 - RNA, 22 nt, Human
aggggucugggagcccacaggg

SEQ ID NO: 1288066 - RNA, 24 nt, Human
aggugcgguggcucaugccuguaa

SEQ ID NO: 1288067 - RNA, 22 nt, Human
agguggaucacuugaggucagg

SEQ ID NO: 1288068 - RNA, 19 nt, Human
agucagaacucagcucucc

SEQ ID NO: 1288069 - RNA, 21 nt, Human
agucaugugcaugaguaugua

SEQ ID NO: 1288070 - RNA, 24 nt, Human
aucuugcuacugcauuccagccug

SEQ ID NO: 1288071 - RNA, 19 nt, Human
augccuguaaucccagcac

SEQ ID NO: 1288072 - RNA, 22 nt, Human
augggggcagagaguucugcac

SEQ ID NO: 1288073 - RNA, 24 nt, Human
caaaccggaaaagcacagcaucca

SEQ ID NO: 1288074 - RNA, 24 nt, Human
caaaccggaaaagcacagcaucca

SEQ ID NO: 1288075 - RNA, 24 nt, Human
caaggcagguggaucacuugaggu

SEQ ID NO: 1288076 - RNA, 26 nt, Human
caaggcagguggaucacuugagguca

SEQ ID NO: 1288077 - RNA, 22 nt, Human
caaggggcaggcuccugacccg

SEQ ID NO: 1288078 - RNA, 21 nt, Human
cacacacugugggcaccugug

SEQ ID NO: 1288079 - RNA, 19 nt, Human
cacagcauccaagcagggu

SEQ ID NO: 1288080 - RNA, 19 nt, Human
cacagggcauagacagggu

SEQ ID NO: 1288081 - RNA, 19 nt, Human
caccacguaccgccccgcc

SEQ ID NO: 1288082 - RNA, 21 nt, Human
caccacguaccgccccgccgg

SEQ ID NO: 1288083 - RNA, 19 nt, Human
cacgaugcggcugcgagag

SEQ ID NO: 1288084 - RNA, 23 nt, Human
cacuugaggucaggaguucgaga

SEQ ID NO: 1288085 - RNA, 19 nt, Human
cagaguaggcccaaaaguu

SEQ ID NO: 1288086 - RNA, 18 nt, Human
cagcacacacacuguggg

SEQ ID NO: 1288087 - RNA, 24 nt, Human
cagcacuuugaaaggccaaggcag

SEQ ID NO: 1288088 - RNA, 24 nt, Human
cagccaccaccacguaccgccccg

SEQ ID NO: 1288089 - RNA, 20 nt, Human
cagcccccagccggaccccc

SEQ ID NO: 1288090 - RNA, 24 nt, Human
cagcuacucggaaggcugaggcag

SEQ ID NO: 1288091 - RNA, 19 nt, Human
caggggucugggagcccac

SEQ ID NO: 1288092 - RNA, 24 nt, Human
cagguggaucacuugaggucagga

SEQ ID NO: 1288093 - RNA, 24 nt, Human
caucccuucagccuccugcauccu

SEQ ID NO: 1288094 - RNA, 20 nt, Human
caucucaaaaacaaacaaac

SEQ ID NO: 1288095 - RNA, 23 nt, Human
cauuccagccugggcgacagagc

SEQ ID NO: 1288096 - RNA, 19 nt, Human
ccaggcggcagcaguagcu

SEQ ID NO: 1288097 - RNA, 23 nt, Human
ccaguccagguaacaugggggca

SEQ ID NO: 1288098 - RNA, 22 nt, Human
cccaggcugggguacccagaga

SEQ ID NO: 1288099 - RNA, 23 nt, Human
ccccagggaauuucuuagaaccc

SEQ ID NO: 1288100 - RNA, 23 nt, Human
cccccagccggacccccugaggc

SEQ ID NO: 1288101 - RNA, 23 nt, Human
cccccagguuccuuugaugggcc

SEQ ID NO: 1288102 - RNA, 21 nt, Human
cccgggagacggggguugcag

SEQ ID NO: 1288103 - RNA, 18 nt, Human
ccgcagcacacacacugu

SEQ ID NO: 1288104 - RNA, 22 nt, Human
ccggaggcgugcacgcucgugc

SEQ ID NO: 1288105 - RNA, 23 nt, Human
ccuaccucuccuagccucaauuc

SEQ ID NO: 1288106 - RNA, 25 nt, Human
ccuccucguaagcagggcccgggac

SEQ ID NO: 1288107 - RNA, 19 nt, Human
ccuccugcauccuccccca

SEQ ID NO: 1288108 - RNA, 23 nt, Human
ccugacccggaaagcuccuuggc

SEQ ID NO: 1288109 - RNA, 18 nt, Human
ccugcauccucccccagg

SEQ ID NO: 1288110 - RNA, 18 nt, Human
ccugcgauggggaugggg

SEQ ID NO: 1288111 - RNA, 21 nt, Human
ccugcgauggggauggggaag

SEQ ID NO: 1288112 - RNA, 24 nt, Human
ccuggccaacaugaugaaacccca

SEQ ID NO: 1288113 - RNA, 22 nt, Human
ccugggcgacagagcgagacuc

SEQ ID NO: 1288114 - RNA, 20 nt, Human
ccuguaaucccagcacuuug

SEQ ID NO: 1288115 - RNA, 19 nt, Human
ccuguaaucccagcuacuc

SEQ ID NO: 1288116 - RNA, 21 nt, Human
ccuguaaucccagcuacucgg

SEQ ID NO: 1288117 - RNA, 22 nt, Human
ccugugcccggggucccagggc

SEQ ID NO: 1288118 - RNA, 21 nt, Human
ccuucugcuauauucacaguc

SEQ ID NO: 1288119 - RNA, 18 nt, Human
cgaagcccucucucccaa

SEQ ID NO: 1288120 - RNA, 18 nt, Human
cgaccagcucucugcugc

SEQ ID NO: 1288121 - RNA, 21 nt, Human
cgagaccagccuggccaacau

SEQ ID NO: 1288122 - RNA, 23 nt, Human
cgagagggcaccagacgcuggua

SEQ ID NO: 1288123 - RNA, 23 nt, Human
cgcaggggagugcccuccuccuc

SEQ ID NO: 1288124 - RNA, 22 nt, Human
cgccccgccgggaaauagccag

SEQ ID NO: 1288125 - RNA, 24 nt, Human
cgcccgaagcccucucucccaagg

SEQ ID NO: 1288126 - RNA, 20 nt, Human
cggaaggcugaggcaggaga

SEQ ID NO: 1288127 - RNA, 19 nt, Human
cggccugccgggcuguccu

SEQ ID NO: 1288128 - RNA, 24 nt, Human
cgggagacggggguugcagugagc

SEQ ID NO: 1288129 - RNA, 20 nt, Human
cuacugcauuccagccuggg

SEQ ID NO: 1288130 - RNA, 21 nt, Human
cuacugcauuccagccugggc

SEQ ID NO: 1288131 - RNA, 24 nt, Human
cuacugcauuccagccugggcgac

SEQ ID NO: 1288132 - RNA, 21 nt, Human
cucagccaccaccacguaccg

SEQ ID NO: 1288133 - RNA, 24 nt, Human
cucaugccuguaaucccagcacuu

SEQ ID NO: 1288134 - RNA, 19 nt, Human
cuccagcaauagugggaca

SEQ ID NO: 1288135 - RNA, 18 nt, Human
cuccaggucaucggccug

SEQ ID NO: 1288136 - RNA, 26 nt, Human
cucccccagcccaggcugggguaccc

SEQ ID NO: 1288137 - RNA, 23 nt, Human
cugcuguccacuaaccacaagca

SEQ ID NO: 1288138 - RNA, 18 nt, Human
cugugcccggggucccag

SEQ ID NO: 1288139 - RNA, 21 nt, Human
cuuaaguccaguaggccaaac

SEQ ID NO: 1288140 - RNA, 20 nt, Human
cuuagagacaaaccggaaaa

SEQ ID NO: 1288141 - RNA, 19 nt, Human
gaaagaggcacucaggggu

SEQ ID NO: 1288142 - RNA, 26 nt, Human
gaaccagagcacagaguguuggagaa

SEQ ID NO: 1288143 - RNA, 20 nt, Human
gaagcugaaagaggcacuca

SEQ ID NO: 1288144 - RNA, 21 nt, Human
gacccggaaagcuccuuggcg

SEQ ID NO: 1288145 - RNA, 28 nt, Human
gagcacagugagagaaaugccgguaccc

SEQ ID NO: 1288146 - RNA, 24 nt, Human
gaucacuugaggucaggaguucga

SEQ ID NO: 1288147 - RNA, 24 nt, Human
gcauuccagccugggcgacagagc

SEQ ID NO: 1288148 - RNA, 24 nt, Human
gccaacaugaugaaaccccaucuc

SEQ ID NO: 1288149 - RNA, 19 nt, Human
gcccgaagcccucucuccc

SEQ ID NO: 1288150 - RNA, 20 nt, Human
gcggcagcaguagcuugggg

SEQ ID NO: 1288151 - RNA, 20 nt, Human
gcggcagcaguagcuugggg

SEQ ID NO: 1288152 - RNA, 22 nt, Human
gcuacugcauuccagccugggc

SEQ ID NO: 1288153 - RNA, 24 nt, Human
gcuacugcauuccagccugggcga

SEQ ID NO: 1288154 - RNA, 18 nt, Human
gcucucagccaccaccac

SEQ ID NO: 1288155 - RNA, 22 nt, Human
ggaaaagcacagcauccaagca

SEQ ID NO: 1288156 - RNA, 22 nt, Human
ggaucacuugaggucaggaguu

SEQ ID NO: 1288157 - RNA, 18 nt, Human
ggccaggugcgguggcuc

SEQ ID NO: 1288158 - RNA, 19 nt, Human
ggccugccgggcuguccuu

SEQ ID NO: 1288159 - RNA, 25 nt, Human
gggccaggggcaguuccccagggaa

SEQ ID NO: 1288160 - RNA, 18 nt, Human
gggcccgggacugcgcgg

SEQ ID NO: 1288161 - RNA, 19 nt, Human
gggguggugggcgaccagc

SEQ ID NO: 1288162 - RNA, 22 nt, Human
gggguugcagugagccgaaauc

SEQ ID NO: 1288163 - RNA, 21 nt, Human
ggguggugggcgaccagcucu

SEQ ID NO: 1288164 - RNA, 23 nt, Human
gguggcucaugccuguaauccca

SEQ ID NO: 1288165 - RNA, 24 nt, Human
gguggcucaugccuguaaucccag

SEQ ID NO: 1288166 - RNA, 24 nt, Human
gguggugcuugccuguaaucccag

SEQ ID NO: 1288167 - RNA, 19 nt, Human
gugcaucccuucagccucc

SEQ ID NO: 1288168 - RNA, 24 nt, Human
guugcagugagccgaaaucuugcu

SEQ ID NO: 1288169 - RNA, 21 nt, Human
uaaaaaaaaaauaauaaaagg

SEQ ID NO: 1288170 - RNA, 18 nt, Human
uaagagcacagugagaga

SEQ ID NO: 1288171 - RNA, 23 nt, Human
uaagagcacagugagagaaaugc

SEQ ID NO: 1288172 - RNA, 19 nt, Human
uaccauguccagccuccag

SEQ ID NO: 1288173 - RNA, 22 nt, Human
uacugcauuccagccugggcga

SEQ ID NO: 1288174 - RNA, 23 nt, Human
uacugcauuccagccugggcgac

SEQ ID NO: 1288175 - RNA, 24 nt, Human
uacugcauuccagccugggcgaca

SEQ ID NO: 1288176 - RNA, 22 nt, Human
uagcaagacaauacaccaccgg

SEQ ID NO: 1288177 - RNA, 24 nt, Human
uagcaagacaauacaccaccggga

SEQ ID NO: 1288178 - RNA, 19 nt, Human
uagccaggcggcagcagua

SEQ ID NO: 1288179 - RNA, 21 nt, Human
uagcgcaggggagugcccucc

SEQ ID NO: 1288180 - RNA, 20 nt, Human
uagcugaggacacagccacu

SEQ ID NO: 1288181 - RNA, 18 nt, Human
uaggcccaaaaguugggg

SEQ ID NO: 1288182 - RNA, 23 nt, Human
uagggggucaggaaaauagcagg

SEQ ID NO: 1288183 - RNA, 20 nt, Human
ucacuugaggucaggaguuc

SEQ ID NO: 1288184 - RNA, 21 nt, Human
ucagaacucagcucucccuac

SEQ ID NO: 1288185 - RNA, 19 nt, Human
ucagccuccugcauccucc

SEQ ID NO: 1288186 - RNA, 18 nt, Human
ucagcucucccuaccucu

SEQ ID NO: 1288187 - RNA, 22 nt, Human
ucagcucucccuaccucuccua

SEQ ID NO: 1288188 - RNA, 22 nt, Human
ucaugccuguaaucccagcacu

SEQ ID NO: 1288189 - RNA, 23 nt, Human
uccacauauauaaauccuuaggu

SEQ ID NO: 1288190 - RNA, 22 nt, Human
uccagccuccagcaauaguggg

SEQ ID NO: 1288191 - RNA, 21 nt, Human
uccagccugggcgacagagcg

SEQ ID NO: 1288192 - RNA, 23 nt, Human
uccagccugggcgacagagcgag

SEQ ID NO: 1288193 - RNA, 24 nt, Human
uccagccugggcgacagagcgaga

SEQ ID NO: 1288194 - RNA, 20 nt, Human
ucccaaggggcaggcuccug

SEQ ID NO: 1288195 - RNA, 18 nt, Human
ucccagggcucgcccgaa

SEQ ID NO: 1288196 - RNA, 21 nt, Human
ucccuucagccuccugcaucc

SEQ ID NO: 1288197 - RNA, 20 nt, Human
uccuuaggucagggcuucug

SEQ ID NO: 1288198 - RNA, 23 nt, Human
ucgcuugaacccgggagacgggg

SEQ ID NO: 1288199 - RNA, 20 nt, Human
ucucccccagcccaggcugg

SEQ ID NO: 1288200 - RNA, 23 nt, Human
ucucccccagcccaggcuggggu

SEQ ID NO: 1288201 - RNA, 19 nt, Human
ucuccuagccucaauucag

SEQ ID NO: 1288202 - RNA, 20 nt, Human
ucucuacuaaaaauaaaaaa

SEQ ID NO: 1288203 - RNA, 24 nt, Human
ucucugcugccggcugggacccag

SEQ ID NO: 1288204 - RNA, 24 nt, Human
ucugcugccggcugggaccggggc

SEQ ID NO: 1288205 - RNA, 20 nt, Human
ucuguagcugaggacacagc

SEQ ID NO: 1288206 - RNA, 19 nt, Human
ugaaaccccaucucuacua

SEQ ID NO: 1288207 - RNA, 24 nt, Human
ugaaaggccaaggcagguggauca

SEQ ID NO: 1288208 - RNA, 23 nt, Human
ugacccggaaagcuccuuggcgg

SEQ ID NO: 1288209 - RNA, 21 nt, Human
ugacucaaagcucaggggucu

SEQ ID NO: 1288210 - RNA, 18 nt, Human
ugagaggccagggaaacc

SEQ ID NO: 1288211 - RNA, 18 nt, Human
ugagaugcccagagguag

SEQ ID NO: 1288212 - RNA, 24 nt, Human
ugaggcaggagauucgcuugaacc

SEQ ID NO: 1288213 - RNA, 25 nt, Human
ugaggcaggagauucgcuugaaccc

SEQ ID NO: 1288214 - RNA, 18 nt, Human
ugaggcuacaaaccguga

SEQ ID NO: 1288215 - RNA, 19 nt, Human
ugaugccacugacucaaag

SEQ ID NO: 1288216 - RNA, 20 nt, Human
ugaugccacugacucaaagc

SEQ ID NO: 1288217 - RNA, 18 nt, Human
ugcacaggugaagucaga

SEQ ID NO: 1288218 - RNA, 21 nt, Human
ugcacgcucgugccaccacuu

SEQ ID NO: 1288219 - RNA, 23 nt, Human
ugcaucccuucagccuccugcau

SEQ ID NO: 1288220 - RNA, 23 nt, Human
ugcccuggagaaaggggcuuaga

SEQ ID NO: 1288221 - RNA, 18 nt, Human
ugccgggcuguccuucag

SEQ ID NO: 1288222 - RNA, 23 nt, Human
ugccuguaaucccagcacuuuga

SEQ ID NO: 1288223 - RNA, 23 nt, Human
ugccuguaaucccagcuacucgg

SEQ ID NO: 1288224 - RNA, 20 nt, Human
ugcucagccgucuccuggcu

SEQ ID NO: 1288225 - RNA, 24 nt, Human
uggaucacuugaggucaggaguuc

SEQ ID NO: 1288226 - RNA, 27 nt, Human
uggaucacuugaggucaggaguucgag

SEQ ID NO: 1288227 - RNA, 21 nt, Human
uggcucaguacaaggcacucu

SEQ ID NO: 1288228 - RNA, 22 nt, Human
uggcucaugccuguaaucccag

SEQ ID NO: 1288229 - RNA, 24 nt, Human
uggcucaugccuguaaucccagca

SEQ ID NO: 1288230 - RNA, 19 nt, Human
ugggaaaugggggagaguc

SEQ ID NO: 1288231 - RNA, 22 nt, Human
ugggaaaugggggagagucaug

SEQ ID NO: 1288232 - RNA, 20 nt, Human
uggggaagcugaaagaggca

SEQ ID NO: 1288233 - RNA, 22 nt, Human
uggugggcgaccagcucucugc

SEQ ID NO: 1288234 - RNA, 24 nt, Human
ugguggugcuugccuguaauccca

SEQ ID NO: 1288235 - RNA, 28 nt, Human
ugguuuuugggacuaugaucaguacacu

SEQ ID NO: 1288236 - RNA, 24 nt, Human
ugucuuauauaaggagauagaggc

SEQ ID NO: 1288237 - RNA, 25 nt, Human
ugugccucuucuaggucagacacca

SEQ ID NO: 1288238 - RNA, 21 nt, Human
uguuggagaacucccaaggug

SEQ ID NO: 1288239 - RNA, 21 nt, Human
uuagaagggccaggugcggug

SEQ ID NO: 1288240 - RNA, 18 nt, Human
uugcagugagccgaaauc

SEQ ID NO: 1288241 - RNA, 19 nt, Human
uugcagugagccgaaaucu

SEQ ID NO: 1288242 - RNA, 18 nt, Human
uugcugagcccccggccu

SEQ ID NO: 1288243 - RNA, 21 nt, Human
uugggguggugggcgaccagc

SEQ ID NO: 1288244 - RNA, 18 nt, Human
aaaaggccccagcuguga

SEQ ID NO: 1288245 - RNA, 26 nt, Human
aaaaggccccagcugugaugaagucc

SEQ ID NO: 1288246 - RNA, 21 nt, Human
aagugacacaaaaggccccag

SEQ ID NO: 1288247 - RNA, 21 nt, Human
aauggcagacaucaggaagga

SEQ ID NO: 1288248 - RNA, 23 nt, Human
acucccugggaagacccacccaa

SEQ ID NO: 1288249 - RNA, 18 nt, Human
agacuguuuccuacuauc

SEQ ID NO: 1288250 - RNA, 20 nt, Human
aucugaagugacacaaaagg

SEQ ID NO: 1288251 - RNA, 27 nt, Human
augaagcagaucacuggggcugaccuu

SEQ ID NO: 1288252 - RNA, 18 nt, Human
auggauuaggcuucugga

SEQ ID NO: 1288253 - RNA, 23 nt, Human
cacaaaaggccccagcugugaug

SEQ ID NO: 1288254 - RNA, 20 nt, Human
cacguuagaaacagaucuaa

SEQ ID NO: 1288255 - RNA, 23 nt, Human
caggguauagaaugaaaggcagg

SEQ ID NO: 1288256 - RNA, 20 nt, Human
caguaccaccggcccagagc

SEQ ID NO: 1288257 - RNA, 23 nt, Human
caucaggaaggaggagaggaacc

SEQ ID NO: 1288258 - RNA, 20 nt, Human
ccacccaaaguccuggcuau

SEQ ID NO: 1288259 - RNA, 23 nt, Human
ccuacucccugggaagacccacc

SEQ ID NO: 1288260 - RNA, 24 nt, Human
cugggaagacccacccaaaguccu

SEQ ID NO: 1288261 - RNA, 23 nt, Human
gaagcagaucacuggggcugacc

SEQ ID NO: 1288262 - RNA, 23 nt, Human
gcaggagauaaaauugcacuucu

SEQ ID NO: 1288263 - RNA, 18 nt, Human
ggagaggaaccauuggug

SEQ ID NO: 1288264 - RNA, 18 nt, Human
guaccaccggcccagagc

SEQ ID NO: 1288265 - RNA, 22 nt, Human
gucagggucaccaaagugugag

SEQ ID NO: 1288266 - RNA, 21 nt, Human
uagaaugaaaggcaggagaua

SEQ ID NO: 1288267 - RNA, 25 nt, Human
uaguggcaccagcauccagacuguu

SEQ ID NO: 1288268 - RNA, 24 nt, Human
ucacaguugaacacgaugguucag

SEQ ID NO: 1288269 - RNA, 23 nt, Human
ucacuggggcugaccuugggugu

SEQ ID NO: 1288270 - RNA, 25 nt, Human
ucacuggggcugaccuuggguguau

SEQ ID NO: 1288271 - RNA, 22 nt, Human
ucaguaccaccggcccagagca

SEQ ID NO: 1288272 - RNA, 19 nt, Human
ucucucacuuccagaacac

SEQ ID NO: 1288273 - RNA, 22 nt, Human
ucucucacuuccagaacaccgg

SEQ ID NO: 1288274 - RNA, 19 nt, Human
ucucugagggugcccuacu

SEQ ID NO: 1288275 - RNA, 20 nt, Human
ucuucaccgcagugcuuaga

SEQ ID NO: 1288276 - RNA, 18 nt, Human
ugaugaaguccaaagcca

SEQ ID NO: 1288277 - RNA, 20 nt, Human
ugccugaaacuucaaugaga

SEQ ID NO: 1288278 - RNA, 19 nt, Human
uucaaugagauccauucca

SEQ ID NO: 1288279 - RNA, 19 nt, Human
uucacaguugaacacgaug

SEQ ID NO: 1288280 - RNA, 23 nt, Human
uucucaauugcucugaacucuag

SEQ ID NO: 1288281 - RNA, 21 nt, Human
aggucuguugcugggccuggg

SEQ ID NO: 1288282 - RNA, 19 nt, Human
aguggaggaucggggucug

SEQ ID NO: 1288283 - RNA, 22 nt, Human
gucuguugcugggccugggcaa

SEQ ID NO: 1288284 - RNA, 18 nt, Human
guggaggaucggggucug

SEQ ID NO: 1288285 - RNA, 21 nt, Human
ucuguugcugggccugggcaa

SEQ ID NO: 1288286 - RNA, 22 nt, Human
ugaguggaggaucggggucugg

SEQ ID NO: 1288287 - RNA, 18 nt, Human
ugcacuggaagcugcaga

SEQ ID NO: 1288288 - RNA, 24 nt, Human
uguggagcucugcacuggaagcug

SEQ ID NO: 1288289 - RNA, 21 nt, Human
uguugcugggccugggcaaug

SEQ ID NO: 1288290 - RNA, 18 nt, Human
uugcugggccugggcaau

SEQ ID NO: 1288291 - RNA, 21 nt, Human
aaaagucauuaaacauaacuc

SEQ ID NO: 1288292 - RNA, 21 nt, Human
aaaucacaaccagugagacug

SEQ ID NO: 1288293 - RNA, 20 nt, Human
aacucagucuuuggauuugc

SEQ ID NO: 1288294 - RNA, 18 nt, Human
aaggggaaacccuggguc

SEQ ID NO: 1288295 - RNA, 30 nt, Human
aauaugauauauaugcauacauauauauag

SEQ ID NO: 1288296 - RNA, 23 nt, Human
accuugggugauguauuucuggc

SEQ ID NO: 1288297 - RNA, 21 nt, Human
acucagcaaucucaccacaga

SEQ ID NO: 1288298 - RNA, 18 nt, Human
acugccaccuugggugau

SEQ ID NO: 1288299 - RNA, 19 nt, Human
agaggcacagaugcugagc

SEQ ID NO: 1288300 - RNA, 21 nt, Human
aggggugcugcaugggcggcg

SEQ ID NO: 1288301 - RNA, 18 nt, Human
aucacaucaccugacuca

SEQ ID NO: 1288302 - RNA, 20 nt, Human
caacacuaaagugaccaaau

SEQ ID NO: 1288303 - RNA, 19 nt, Human
cacagaugcugagccucca

SEQ ID NO: 1288304 - RNA, 22 nt, Human
caccaaaaaguuucauuuucuu

SEQ ID NO: 1288305 - RNA, 18 nt, Human
cagauaagccacuugcca

SEQ ID NO: 1288306 - RNA, 19 nt, Human
cagaugcugagccuccaag

SEQ ID NO: 1288307 - RNA, 18 nt, Human
cagcaggacuuauuuuua

SEQ ID NO: 1288308 - RNA, 22 nt, Human
cagggacagaauucgugggaga

SEQ ID NO: 1288309 - RNA, 23 nt, Human
cauacauauauauauauaauaua

SEQ ID NO: 1288310 - RNA, 20 nt, Human
ccaacacuaaagugaccaaa

SEQ ID NO: 1288311 - RNA, 19 nt, Human
ccgcggcucggaauccagc

SEQ ID NO: 1288312 - RNA, 24 nt, Human
ccucaucaccuucagcuuugccca

SEQ ID NO: 1288313 - RNA, 20 nt, Human
ccuuuccccugucccaacac

SEQ ID NO: 1288314 - RNA, 23 nt, Human
cggcgcuuggacccgcgcucugg

SEQ ID NO: 1288315 - RNA, 19 nt, Human
cgugggagagaaggcagag

SEQ ID NO: 1288316 - RNA, 19 nt, Human
gagacugagaaaaaaauuc

SEQ ID NO: 1288317 - RNA, 18 nt, Human
gagaggcacagaugcuga

SEQ ID NO: 1288318 - RNA, 21 nt, Human
gcaaagccagcgcgcuccgcg

SEQ ID NO: 1288319 - RNA, 19 nt, Human
gcaaucucaccacagauau

SEQ ID NO: 1288320 - RNA, 19 nt, Human
gcagagaaggguuucuucu

SEQ ID NO: 1288321 - RNA, 18 nt, Human
gcuauaaucacacuaccu

SEQ ID NO: 1288322 - RNA, 21 nt, Human
ggcaggaagggaucuggaggc

SEQ ID NO: 1288323 - RNA, 18 nt, Human
gucuuuggauuugcucuu

SEQ ID NO: 1288324 - RNA, 21 nt, Human
gugagacugagaaaaaaauuc

SEQ ID NO: 1288325 - RNA, 22 nt, Human
uaaaaaauauucacaccaaaaa

SEQ ID NO: 1288326 - RNA, 24 nt, Human
uaaaaucugacaguaguagugcua

SEQ ID NO: 1288327 - RNA, 22 nt, Human
uaaagugaccaaaucacaacca

SEQ ID NO: 1288328 - RNA, 24 nt, Human
uaagccacuugccacucacauuca

SEQ ID NO: 1288329 - RNA, 22 nt, Human
uaaucacacuaccuaacaaaau

SEQ ID NO: 1288330 - RNA, 19 nt, Human
uacagggacagaauucgug

SEQ ID NO: 1288331 - RNA, 21 nt, Human
uacucccgaccgcgcuccagg

SEQ ID NO: 1288332 - RNA, 18 nt, Human
uauauaugcauacauaua

SEQ ID NO: 1288333 - RNA, 22 nt, Human
uauauaugcauacauauauaua

SEQ ID NO: 1288334 - RNA, 19 nt, Human
uauaugcauacauauauau

SEQ ID NO: 1288335 - RNA, 20 nt, Human
uauaugcauacauauauaua

SEQ ID NO: 1288336 - RNA, 24 nt, Human
uauaugcauacauauauauauaua

SEQ ID NO: 1288337 - RNA, 22 nt, Human
uauuucuggaguuuucaacagu

SEQ ID NO: 1288338 - RNA, 26 nt, Human
ucagcaaucucaccacagauauuucc

SEQ ID NO: 1288339 - RNA, 20 nt, Human
uccaaaggaaaaaaguguau

SEQ ID NO: 1288340 - RNA, 23 nt, Human
uccuugcuuuuuacauccagagg

SEQ ID NO: 1288341 - RNA, 19 nt, Human
ucgcuacccucccacuccu

SEQ ID NO: 1288342 - RNA, 21 nt, Human
ucugaagucucugccuucccc

SEQ ID NO: 1288343 - RNA, 24 nt, Human
ucuucuuccucaucaccuucagcu

SEQ ID NO: 1288344 - RNA, 22 nt, Human
ucuuucaucauaaaauguuccu

SEQ ID NO: 1288345 - RNA, 22 nt, Human
ucuuuggauuugcucuuucagc

SEQ ID NO: 1288346 - RNA, 27 nt, Human
ugagaaaaaaauucgagguaauggaga

SEQ ID NO: 1288347 - RNA, 23 nt, Human
ugcgauuuuacucccgaccgcgc

SEQ ID NO: 1288348 - RNA, 19 nt, Human
uggcucgcuacccucccac

SEQ ID NO: 1288349 - RNA, 21 nt, Human
uuccuaguucuucuccaugga

SEQ ID NO: 1288350 - RNA, 21 nt, Human
aaggucccaaaauuccgccag

SEQ ID NO: 1288351 - RNA, 24 nt, Human
aaggucccaaaauuccgccagggg

SEQ ID NO: 1288352 - RNA, 23 nt, Human
agagcucaagacuacaaaaaagu

SEQ ID NO: 1288353 - RNA, 21 nt, Human
aguccgcuuagcgccgcugcc

SEQ ID NO: 1288354 - RNA, 25 nt, Human
ccaaagagcucaagacuacaaaaaa

SEQ ID NO: 1288355 - RNA, 22 nt, Human
ccaccgagaagggaaggcagcc

SEQ ID NO: 1288356 - RNA, 23 nt, Human
cccccaguugacccagaccucug

SEQ ID NO: 1288357 - RNA, 23 nt, Human
cccgcagccgcugggcccaaaga

SEQ ID NO: 1288358 - RNA, 18 nt, Human
ccgcagccgcugggcccc

SEQ ID NO: 1288359 - RNA, 18 nt, Human
ccgcugccgccccccagu

SEQ ID NO: 1288360 - RNA, 23 nt, Human
ccgguggcggcgggguggagagu

SEQ ID NO: 1288361 - RNA, 23 nt, Human
ccuguccuacagugcgcccgcag

SEQ ID NO: 1288362 - RNA, 21 nt, Human
cgccauacaguccgcuuagcg

SEQ ID NO: 1288363 - RNA, 20 nt, Human
cugccgccccccaguugacc

SEQ ID NO: 1288364 - RNA, 23 nt, Human
cugccgccccccaguugacccag

SEQ ID NO: 1288365 - RNA, 22 nt, Human
cuuagcgccgcugccgcccccc

SEQ ID NO: 1288366 - RNA, 25 nt, Human
gaaaggucccaaaauuccgccaggg

SEQ ID NO: 1288367 - RNA, 21 nt, Human
gcgaaaggucccaaaauuccg

SEQ ID NO: 1288368 - RNA, 21 nt, Human
guggcggcgggguggagagug

SEQ ID NO: 1288369 - RNA, 24 nt, Human
guggggggaucuuccuguccuaca

SEQ ID NO: 1288370 - RNA, 19 nt, Human
guuuucuuuuuaauguguu

SEQ ID NO: 1288371 - RNA, 24 nt, Human
uccuacagugcgcccgcagccgcu

SEQ ID NO: 1288372 - RNA, 25 nt, Human
ucgcgaaaggucccaaaauuccgcc

SEQ ID NO: 1288373 - RNA, 21 nt, Human
uggcggcgggguggagagugg

SEQ ID NO: 1288374 - RNA, 22 nt, Human
aagcuuucaguacugucagcac

SEQ ID NO: 1288375 - RNA, 18 nt, Human
aaggagcuaagugacuuc

SEQ ID NO: 1288376 - RNA, 19 nt, Human
acccccacccuccacccca

SEQ ID NO: 1288377 - RNA, 18 nt, Human
acccugaaagcuguggag

SEQ ID NO: 1288378 - RNA, 22 nt, Human
acccugaaagcuguggagcagg

SEQ ID NO: 1288379 - RNA, 28 nt, Human
acccugaaagcuguggagcagggagagu

SEQ ID NO: 1288380 - RNA, 20 nt, Human
auagaguucaucucuaggag

SEQ ID NO: 1288381 - RNA, 19 nt, Human
caccccagaagccauguca

SEQ ID NO: 1288382 - RNA, 22 nt, Human
cacccccacccuccaccccaga

SEQ ID NO: 1288383 - RNA, 19 nt, Human
caccuaaauuaucagcaac

SEQ ID NO: 1288384 - RNA, 24 nt, Human
caugaucccuuccccuccuggggg

SEQ ID NO: 1288385 - RNA, 22 nt, Human
ccaaagcccacagcuccagugc

SEQ ID NO: 1288386 - RNA, 26 nt, Human
ccacagcuccagugccacugcugacc

SEQ ID NO: 1288387 - RNA, 18 nt, Human
cccacagcuccagugcca

SEQ ID NO: 1288388 - RNA, 19 nt, Human
ccccacccuccaccccaga

SEQ ID NO: 1288389 - RNA, 21 nt, Human
ccccagaagccaugucaugcu

SEQ ID NO: 1288390 - RNA, 21 nt, Human
cccugaaagcuguggagcagg

SEQ ID NO: 1288391 - RNA, 23 nt, Human
ccuccacccccacccuccacccc

SEQ ID NO: 1288392 - RNA, 19 nt, Human
cuaaauuaucagcaacucc

SEQ ID NO: 1288393 - RNA, 24 nt, Human
cuaagugacuuccccaaagcccac

SEQ ID NO: 1288394 - RNA, 20 nt, Human
cugacuuuugggugggggug

SEQ ID NO: 1288395 - RNA, 21 nt, Human
gaccuccacccccacccucca

SEQ ID NO: 1288396 - RNA, 22 nt, Human
gaccuccacccccacccuccac

SEQ ID NO: 1288397 - RNA, 20 nt, Human
gacuuccccaaagcccacag

SEQ ID NO: 1288398 - RNA, 19 nt, Human
gccaugacccaguguccca

SEQ ID NO: 1288399 - RNA, 21 nt, Human
gcccacagcuccagugccacu

SEQ ID NO: 1288400 - RNA, 19 nt, Human
ggccaugacccaguguccc

SEQ ID NO: 1288401 - RNA, 30 nt, Human
uaaggagcuaagugacuuccccaaagcccu

SEQ ID NO: 1288402 - RNA, 19 nt, Human
uaaggggcuggauagaguu

SEQ ID NO: 1288403 - RNA, 22 nt, Human
uaagugacuuccccaaagccca

SEQ ID NO: 1288404 - RNA, 22 nt, Human
uagaccaaguaucuaucccacc

SEQ ID NO: 1288405 - RNA, 20 nt, Human
uagagggcucuccaugaucc

SEQ ID NO: 1288406 - RNA, 25 nt, Human
ucacucauaaacacacccugaaagc

SEQ ID NO: 1288407 - RNA, 22 nt, Human
uccacccccacccuccacccca

SEQ ID NO: 1288408 - RNA, 23 nt, Human
uccaugaucccuuccccuccugg

SEQ ID NO: 1288409 - RNA, 22 nt, Human
uccccaaagcccacagcuccag

SEQ ID NO: 1288410 - RNA, 24 nt, Human
uccguucuggccucuuccuuggaa

SEQ ID NO: 1288411 - RNA, 25 nt, Human
uccguucuggccucuuccuuggaag

SEQ ID NO: 1288412 - RNA, 21 nt, Human
ucucuaggagcaggaccucca

SEQ ID NO: 1288413 - RNA, 18 nt, Human
ugaucccuuccccuccug

SEQ ID NO: 1288414 - RNA, 21 nt, Human
ugccuucaacuucgggaaggu

SEQ ID NO: 1288415 - RNA, 24 nt, Human
ugcugacuuuuggguggggguggg

SEQ ID NO: 1288416 - RNA, 18 nt, Human
uggagcagggagagugca

SEQ ID NO: 1288417 - RNA, 23 nt, Human
ugggggugggaucaguuaaagag

SEQ ID NO: 1288418 - RNA, 18 nt, Human
uguggagcagggagagug

SEQ ID NO: 1288419 - RNA, 24 nt, Human
uuccuuggaagggucuaaaaacag

SEQ ID NO: 1288420 - RNA, 19 nt, Human
uugggugggggugggauca

SEQ ID NO: 1288421 - RNA, 28 nt, Human
aagaaucacaaggaagaagccgguaccc

SEQ ID NO: 1288422 - RNA, 24 nt, Human
agaaauucuucuuuuccaacuauc

SEQ ID NO: 1288423 - RNA, 19 nt, Human
aggaagaagcugugaaucu

SEQ ID NO: 1288424 - RNA, 23 nt, Human
aggaagaagcugugaaucuaaua

SEQ ID NO: 1288425 - RNA, 24 nt, Human
cagcuguauaaaugaagaucuuga

SEQ ID NO: 1288426 - RNA, 21 nt, Human
caucucuuucacacuugagcc

SEQ ID NO: 1288427 - RNA, 23 nt, Human
ccuggcuucaaacgaccaucuuu

SEQ ID NO: 1288428 - RNA, 22 nt, Human
cuccuggcuucaaacgaccauc

SEQ ID NO: 1288429 - RNA, 19 nt, Human
cuucaaacgaccaucuuuu

SEQ ID NO: 1288430 - RNA, 20 nt, Human
cuuuccauuucaucugcuuc

SEQ ID NO: 1288431 - RNA, 18 nt, Human
gaagaaaacauaaggaaa

SEQ ID NO: 1288432 - RNA, 20 nt, Human
gcaucaucucuuucacacuu

SEQ ID NO: 1288433 - RNA, 19 nt, Human
uaaggaaacuaaauuagag

SEQ ID NO: 1288434 - RNA, 20 nt, Human
uaaggaaacuaaauuagagg

SEQ ID NO: 1288435 - RNA, 19 nt, Human
uaaguguauuuacuucuuu

SEQ ID NO: 1288436 - RNA, 23 nt, Human
ugaagaaaacauaaggaaacuaa

SEQ ID NO: 1288437 - RNA, 20 nt, Human
ugagacaaguugaucuccug

SEQ ID NO: 1288438 - RNA, 21 nt, Human
uggauuuaacagcuguauaaa

SEQ ID NO: 1288439 - RNA, 18 nt, Human
ugugaaucuaauauauug

SEQ ID NO: 1288440 - RNA, 21 nt, Human
uuggaaauuucaugugcacca

SEQ ID NO: 1288441 - RNA, 19 nt, Human
uuucaaggcaucaucucuu

SEQ ID NO: 1288442 - RNA, 23 nt, Human
aaaaggagaggauccaaaaucaa

SEQ ID NO: 1288443 - RNA, 20 nt, Human
aggcagcagccaagucuggc

SEQ ID NO: 1288444 - RNA, 23 nt, Human
aggcagcagccaagucuggccgg

SEQ ID NO: 1288445 - RNA, 20 nt, Human
caguccccgagcugaccccc

SEQ ID NO: 1288446 - RNA, 18 nt, Human
ccccgagcugacccccuc

SEQ ID NO: 1288447 - RNA, 19 nt, Human
ccccgagcugacccccucu

SEQ ID NO: 1288448 - RNA, 22 nt, Human
cugacccccucugcaguccagg

SEQ ID NO: 1288449 - RNA, 22 nt, Human
gccaagucuggcucugcccagc

SEQ ID NO: 1288450 - RNA, 18 nt, Human
uccccgagcugacccccu

SEQ ID NO: 1288451 - RNA, 20 nt, Human
uccccgagcugacccccucu

SEQ ID NO: 1288452 - RNA, 22 nt, Human
uccccgagcugacccccucugc

SEQ ID NO: 1288453 - RNA, 18 nt, Human
aaacagaagguguccucc

SEQ ID NO: 1288454 - RNA, 22 nt, Human
aacagcacgagcccaccaucca

SEQ ID NO: 1288455 - RNA, 21 nt, Human
aagguuggggggcuugggccu

SEQ ID NO: 1288456 - RNA, 18 nt, Human
aaugguguacaccagguc

SEQ ID NO: 1288457 - RNA, 21 nt, Human
accauccaugcuccucagagc

SEQ ID NO: 1288458 - RNA, 23 nt, Human
accgcccaccgcacuacccaccc

SEQ ID NO: 1288459 - RNA, 23 nt, Human
accggcuccccaggcuggucucg

SEQ ID NO: 1288460 - RNA, 19 nt, Human
accucagugcccggcaccg

SEQ ID NO: 1288461 - RNA, 19 nt, Human
acucagcauccuccacccc

SEQ ID NO: 1288462 - RNA, 26 nt, Human
agaggccaaaguggauggugggcacc

SEQ ID NO: 1288463 - RNA, 21 nt, Human
agcaccagcuggucagaggug

SEQ ID NO: 1288464 - RNA, 20 nt, Human
agcaccugcaggccaaggcc

SEQ ID NO: 1288465 - RNA, 18 nt, Human
agcagaaggugcugaggg

SEQ ID NO: 1288466 - RNA, 20 nt, Human
agcccugggccagaugcagc

SEQ ID NO: 1288467 - RNA, 21 nt, Human
agcccugggccagaugcagcc

SEQ ID NO: 1288468 - RNA, 18 nt, Human
agcucaccugcaccugca

SEQ ID NO: 1288469 - RNA, 20 nt, Human
agcugcgcaccucagugccc

SEQ ID NO: 1288470 - RNA, 22 nt, Human
agcugggccucagcaaagcccg

SEQ ID NO: 1288471 - RNA, 21 nt, Human
aggaaggacagauugcucagg

SEQ ID NO: 1288472 - RNA, 21 nt, Human
aggacaggcaugucuggguca

SEQ ID NO: 1288473 - RNA, 23 nt, Human
aggagguccuggugggucagcac

SEQ ID NO: 1288474 - RNA, 19 nt, Human
aggcaggauggugacagug

SEQ ID NO: 1288475 - RNA, 23 nt, Human
aggcauggcuccgggccucaggg

SEQ ID NO: 1288476 - RNA, 25 nt, Human
aggccgaggccacauccagcgagaa

SEQ ID NO: 1288477 - RNA, 21 nt, Human
aggugggcuguggugagggcc

SEQ ID NO: 1288478 - RNA, 19 nt, Human
aguccaggucauaggccug

SEQ ID NO: 1288479 - RNA, 21 nt, Human
agugcugugggucagugcuca

SEQ ID NO: 1288480 - RNA, 18 nt, Human
auaggccuggagaaccuc

SEQ ID NO: 1288481 - RNA, 20 nt, Human
auggcucuggcgguccaucu

SEQ ID NO: 1288482 - RNA, 20 nt, Human
augguagagcaggagcuggg

SEQ ID NO: 1288483 - RNA, 19 nt, Human
caaagcccgaaucagcauu

SEQ ID NO: 1288484 - RNA, 22 nt, Human
caagaugggcauggcagagccc

SEQ ID NO: 1288485 - RNA, 19 nt, Human
caaggcccgggagaguggg

SEQ ID NO: 1288486 - RNA, 24 nt, Human
cacacucaccacccucgggcacca

SEQ ID NO: 1288487 - RNA, 20 nt, Human
caccacccucgggcaccaug

SEQ ID NO: 1288488 - RNA, 18 nt, Human
caccacucagcauccucc

SEQ ID NO: 1288489 - RNA, 27 nt, Human
caccagguagccggcacucggugggcu

SEQ ID NO: 1288490 - RNA, 25 nt, Human
cacccaggccgaggccacauccagc

SEQ ID NO: 1288491 - RNA, 26 nt, Human
caccccaccagcccccugcuucugca

SEQ ID NO: 1288492 - RNA, 20 nt, Human
caccccagcagcacccuuca

SEQ ID NO: 1288493 - RNA, 22 nt, Human
caccgcacuacccacccauugc

SEQ ID NO: 1288494 - RNA, 19 nt, Human
caccgcaguggacauagac

SEQ ID NO: 1288495 - RNA, 23 nt, Human
caccggcuccccaggcuggucuc

SEQ ID NO: 1288496 - RNA, 19 nt, Human
caccugcaccugcagaucc

SEQ ID NO: 1288497 - RNA, 21 nt, Human
caccuucagcauggccggggg

SEQ ID NO: 1288498 - RNA, 24 nt, Human
cacgcagcaccaucaccagguagc

SEQ ID NO: 1288499 - RNA, 21 nt, Human
cagagccucugcaggccugag

SEQ ID NO: 1288500 - RNA, 18 nt, Human
cagcagaaggugcugagg

SEQ ID NO: 1288501 - RNA, 22 nt, Human
cagcagaaggugcugagggucc

SEQ ID NO: 1288502 - RNA, 21 nt, Human
cagcagccgccaccuggcacu

SEQ ID NO: 1288503 - RNA, 18 nt, Human
cagcaggagaacucaguc

SEQ ID NO: 1288504 - RNA, 20 nt, Human
cagcaggagaacucagucac

SEQ ID NO: 1288505 - RNA, 20 nt, Human
cagcccccugcuucugcagc

SEQ ID NO: 1288506 - RNA, 21 nt, Human
cagcugggccucagcaaagcc

SEQ ID NO: 1288507 - RNA, 21 nt, Human
cagcugggucugcaugaagcu

SEQ ID NO: 1288508 - RNA, 20 nt, Human
cagcuggucccuucugaucu

SEQ ID NO: 1288509 - RNA, 22 nt, Human
caggaucaccauaaggcugcca

SEQ ID NO: 1288510 - RNA, 19 nt, Human
caggccccagaggcuugug

SEQ ID NO: 1288511 - RNA, 21 nt, Human
cagggccaucguggaugaagc

SEQ ID NO: 1288512 - RNA, 21 nt, Human
cagguucuccacgguguccuc

SEQ ID NO: 1288513 - RNA, 27 nt, Human
cauccuccaccccaccagcccccugcu

SEQ ID NO: 1288514 - RNA, 19 nt, Human
cauccugggugaagcccug

SEQ ID NO: 1288515 - RNA, 22 nt, Human
caugaagcugcgcaccucaguc

SEQ ID NO: 1288516 - RNA, 23 nt, Human
ccaccccagcagcacccuucaug

SEQ ID NO: 1288517 - RNA, 18 nt, Human
ccaccgcacuacccaccc

SEQ ID NO: 1288518 - RNA, 20 nt, Human
ccagaguaaccauccaugcu

SEQ ID NO: 1288519 - RNA, 19 nt, Human
ccagaugcagcccugugcu

SEQ ID NO: 1288520 - RNA, 20 nt, Human
ccagcgagaaggcauggcuc

SEQ ID NO: 1288521 - RNA, 22 nt, Human
ccaucucagaggcauuagccau

SEQ ID NO: 1288522 - RNA, 21 nt, Human
ccaugaggacaggcaugucug

SEQ ID NO: 1288523 - RNA, 24 nt, Human
cccaccacucagcauccuccaccc

SEQ ID NO: 1288524 - RNA, 20 nt, Human
cccaccgcacuacccaccca

SEQ ID NO: 1288525 - RNA, 20 nt, Human
ccccaugccgggguggcucc

SEQ ID NO: 1288526 - RNA, 20 nt, Human
cccccugcuucugcagcucc

SEQ ID NO: 1288527 - RNA, 26 nt, Human
cccccugcuucugcagcucccugaac

SEQ ID NO: 1288528 - RNA, 21 nt, Human
ccccuccgcaggcaugagggc

SEQ ID NO: 1288529 - RNA, 25 nt, Human
cccgcaccacaugguagagcaggag

SEQ ID NO: 1288530 - RNA, 21 nt, Human
cccuccgcaggcaugagggca

SEQ ID NO: 1288531 - RNA, 18 nt, Human
ccgaggccacauccagcg

SEQ ID NO: 1288532 - RNA, 18 nt, Human
ccggccuccaacucccag

SEQ ID NO: 1288533 - RNA, 23 nt, Human
ccggcuccccaggcuggucucgg

SEQ ID NO: 1288534 - RNA, 18 nt, Human
ccucagagccucugcagg

SEQ ID NO: 1288535 - RNA, 19 nt, Human
ccucuguccagggccccuc

SEQ ID NO: 1288536 - RNA, 23 nt, Human
ccugaaccaccucacaguggaag

SEQ ID NO: 1288537 - RNA, 18 nt, Human
ccuguaguugaagguugc

SEQ ID NO: 1288538 - RNA, 25 nt, Human
ccugugcugcgguggauuuguaugg

SEQ ID NO: 1288539 - RNA, 24 nt, Human
cggacucugggcagucagugucug

SEQ ID NO: 1288540 - RNA, 20 nt, Human
cggggggcuggccugcaguc

SEQ ID NO: 1288541 - RNA, 23 nt, Human
cuacugggcccucuagggcaaug

SEQ ID NO: 1288542 - RNA, 18 nt, Human
cucagcauccuccacccc

SEQ ID NO: 1288543 - RNA, 26 nt, Human
cucagggcgggagugcagguagagga

SEQ ID NO: 1288544 - RNA, 18 nt, Human
cuccaccccaccagcccc

SEQ ID NO: 1288545 - RNA, 22 nt, Human
cucccugaacggcaggccuccg

SEQ ID NO: 1288546 - RNA, 19 nt, Human
cuccgcaggcaugagggca

SEQ ID NO: 1288547 - RNA, 19 nt, Human
cuccugggcuaccuccagc

SEQ ID NO: 1288548 - RNA, 22 nt, Human
cugagugugcaguggcuccagc

SEQ ID NO: 1288549 - RNA, 22 nt, Human
cugcaccugcagauccagguuc

SEQ ID NO: 1288550 - RNA, 24 nt, Human
cugcgguggauuuguauggccagc

SEQ ID NO: 1288551 - RNA, 24 nt, Human
cugcuggcggcacugccuccuggg

SEQ ID NO: 1288552 - RNA, 24 nt, Human
cugcuggcucugaggcucuggcug

SEQ ID NO: 1288553 - RNA, 19 nt, Human
cuggaggccccgcaccaca

SEQ ID NO: 1288554 - RNA, 22 nt, Human
cuggaggccccgcaccacaugg

SEQ ID NO: 1288555 - RNA, 21 nt, Human
cugggugaagcccugaccguc

SEQ ID NO: 1288556 - RNA, 19 nt, Human
gaacagcacgagcccacca

SEQ ID NO: 1288557 - RNA, 23 nt, Human
gaacucagucaccggcuccccag

SEQ ID NO: 1288558 - RNA, 21 nt, Human
gaagagccggccuagcuggag

SEQ ID NO: 1288559 - RNA, 24 nt, Human
gaaggugcugaggguccuggcuug

SEQ ID NO: 1288560 - RNA, 20 nt, Human
gagacucuugaugaagagcu

SEQ ID NO: 1288561 - RNA, 22 nt, Human
gagggccuccugcuggguguuc

SEQ ID NO: 1288562 - RNA, 19 nt, Human
gaggguccuggcuugaggc

SEQ ID NO: 1288563 - RNA, 27 nt, Human
gauggcucuggcgguccaucucagaaa

SEQ ID NO: 1288564 - RNA, 24 nt, Human
gcaccgcccaccgcacuacccacc

SEQ ID NO: 1288565 - RNA, 18 nt, Human
gcacugccuccugggcua

SEQ ID NO: 1288566 - RNA, 23 nt, Human
gccagaugcagcccugugcugcg

SEQ ID NO: 1288567 - RNA, 18 nt, Human
gcccugcuccacauccug

SEQ ID NO: 1288568 - RNA, 18 nt, Human
gccucucuccagcagaag

SEQ ID NO: 1288569 - RNA, 26 nt, Human
gcuccagcaccugcaggccaaggccc

SEQ ID NO: 1288570 - RNA, 22 nt, Human
gcugggccagcuucaguggggc

SEQ ID NO: 1288571 - RNA, 24 nt, Human
ggaagagccggccuagcuggaggc

SEQ ID NO: 1288572 - RNA, 18 nt, Human
ggagaguggggaaguagg

SEQ ID NO: 1288573 - RNA, 23 nt, Human
ggaugccucuguccagggccccu

SEQ ID NO: 1288574 - RNA, 21 nt, Human
ggcauggcuccgggccucagg

SEQ ID NO: 1288575 - RNA, 25 nt, Human
ggccugaguuuguaugaggucgggg

SEQ ID NO: 1288576 - RNA, 23 nt, Human
gggcuugggccugccuccuccag

SEQ ID NO: 1288577 - RNA, 20 nt, Human
ggggagaaauaugguggagc

SEQ ID NO: 1288578 - RNA, 19 nt, Human
ggggugccaaggagcugga

SEQ ID NO: 1288579 - RNA, 24 nt, Human
ggguugaccuggaugggcaggagg

SEQ ID NO: 1288580 - RNA, 18 nt, Human
gguagagcaggagcuggg

SEQ ID NO: 1288581 - RNA, 21 nt, Human
ggucagagguguccucagggc

SEQ ID NO: 1288582 - RNA, 20 nt, Human
gucugcaugaagcugcgcac

SEQ ID NO: 1288583 - RNA, 20 nt, Human
gugaagcacuugcuucuggg

SEQ ID NO: 1288584 - RNA, 18 nt, Human
gugcugggccagcuucag

SEQ ID NO: 1288585 - RNA, 20 nt, Human
guggaacgccugugugaccc

SEQ ID NO: 1288586 - RNA, 24 nt, Human
guggaacgccugugugacccacca

SEQ ID NO: 1288587 - RNA, 18 nt, Human
guugaagguugccuuucc

SEQ ID NO: 1288588 - RNA, 22 nt, Human
ucaccugcaccugcagauccag

SEQ ID NO: 1288589 - RNA, 23 nt, Human
ucacgucagagaggccaaagugg

SEQ ID NO: 1288590 - RNA, 21 nt, Human
ucagcaaagcccgaaucagca

SEQ ID NO: 1288591 - RNA, 19 nt, Human
ucagcaccagcugggccuc

SEQ ID NO: 1288592 - RNA, 20 nt, Human
ucagcauccuccaccccacc

SEQ ID NO: 1288593 - RNA, 24 nt, Human
ucagcauccuccaccccaccagcc

SEQ ID NO: 1288594 - RNA, 26 nt, Human
ucagcauccuccaccccaccagcccc

SEQ ID NO: 1288595 - RNA, 24 nt, Human
ucaguggggcuacugggcccucua

SEQ ID NO: 1288596 - RNA, 19 nt, Human
ucagugucuggcugcccuc

SEQ ID NO: 1288597 - RNA, 23 nt, Human
ucccuucugaucucagcugccuc

SEQ ID NO: 1288598 - RNA, 18 nt, Human
uccucagggccaucgugg

SEQ ID NO: 1288599 - RNA, 19 nt, Human
uccucgguguagugcugug

SEQ ID NO: 1288600 - RNA, 19 nt, Human
uccuugggcccagaguaac

SEQ ID NO: 1288601 - RNA, 21 nt, Human
ucugcacgggguccaggcugg

SEQ ID NO: 1288602 - RNA, 18 nt, Human
ugacaggguugaccugga

SEQ ID NO: 1288603 - RNA, 24 nt, Human
ugaccuggaugggcaggaggucug

SEQ ID NO: 1288604 - RNA, 21 nt, Human
ugagaaaacgaugucugcugg

SEQ ID NO: 1288605 - RNA, 23 nt, Human
ugagaacagcacgagcccaccau

SEQ ID NO: 1288606 - RNA, 21 nt, Human
ugagugaaguucaccaggucc

SEQ ID NO: 1288607 - RNA, 22 nt, Human
ugauguggggugggucauugaa

SEQ ID NO: 1288608 - RNA, 25 nt, Human
ugauguggggugggucauugacagg

SEQ ID NO: 1288609 - RNA, 26 nt, Human
ugcaccugcagauccagguucuccac

SEQ ID NO: 1288610 - RNA, 22 nt, Human
ugcacgggguccaggcugggug

SEQ ID NO: 1288611 - RNA, 24 nt, Human
ugcagguacuggaucagaugcucu

SEQ ID NO: 1288612 - RNA, 18 nt, Human
ugccaaggagcuggaagg

SEQ ID NO: 1288613 - RNA, 23 nt, Human
ugccucuguccagggccccucug

SEQ ID NO: 1288614 - RNA, 20 nt, Human
ugcucuuccaccccagcagc

SEQ ID NO: 1288615 - RNA, 21 nt, Human
ugcucuuccaccccagcagca

SEQ ID NO: 1288616 - RNA, 18 nt, Human
uggaacagcacggucaca

SEQ ID NO: 1288617 - RNA, 21 nt, Human
uggaucagaugcucuuccacc

SEQ ID NO: 1288618 - RNA, 20 nt, Human
uggaugaagcgggccuugca

SEQ ID NO: 1288619 - RNA, 19 nt, Human
uggaugccucuguccaggg

SEQ ID NO: 1288620 - RNA, 18 nt, Human
uggauggagaagguacag

SEQ ID NO: 1288621 - RNA, 19 nt, Human
ugggucagcaccagcuggg

SEQ ID NO: 1288622 - RNA, 18 nt, Human
ugguagagcaggagcugg

SEQ ID NO: 1288623 - RNA, 18 nt, Human
uggucagagguguccuca

SEQ ID NO: 1288624 - RNA, 25 nt, Human
ugugagaacagcacgagcccaccau

SEQ ID NO: 1288625 - RNA, 20 nt, Human
ugugggaagaugaugugggg

SEQ ID NO: 1288626 - RNA, 18 nt, Human
uguggggugggucauuga

SEQ ID NO: 1288627 - RNA, 18 nt, Human
uguucugccucucuccac

SEQ ID NO: 1288628 - RNA, 22 nt, Human
uuagccaucaggacaaaaccgu

SEQ ID NO: 1288629 - RNA, 22 nt, Human
uucaguggggcuacugggcccu

SEQ ID NO: 1288630 - RNA, 22 nt, Human
uugcugggcugcuuaauggugu

SEQ ID NO: 1288631 - RNA, 24 nt, Human
aaauaauccagugacucccaaaac

SEQ ID NO: 1288632 - RNA, 19 nt, Human
aaguuguagccucaacacc

SEQ ID NO: 1288633 - RNA, 25 nt, Human
acaggcacccgccaccacgcccgac

SEQ ID NO: 1288634 - RNA, 20 nt, Human
accucaggacaucuugacau

SEQ ID NO: 1288635 - RNA, 25 nt, Human
accucccggguucacgccauucucc

SEQ ID NO: 1288636 - RNA, 27 nt, Human
acuacaggcacccgccaccacgcccga

SEQ ID NO: 1288637 - RNA, 24 nt, Human
aguagaguggugugaucucggcuc

SEQ ID NO: 1288638 - RNA, 18 nt, Human
aguagcugggacuacagg

SEQ ID NO: 1288639 - RNA, 19 nt, Human
caaaacagaaauacccaaa

SEQ ID NO: 1288640 - RNA, 24 nt, Human
caccucaggacaucuugacaucac

SEQ ID NO: 1288641 - RNA, 19 nt, Human
caccucccggguucacgcc

SEQ ID NO: 1288642 - RNA, 22 nt, Human
cacgccauucuccugccucagc

SEQ ID NO: 1288643 - RNA, 24 nt, Human
cagaaauacccaaacaaaauucaa

SEQ ID NO: 1288644 - RNA, 20 nt, Human
cagccuccugaguagcuggg

SEQ ID NO: 1288645 - RNA, 21 nt, Human
caggcacccgccaccacgccc

SEQ ID NO: 1288646 - RNA, 22 nt, Human
cagggaauguguagaaaacaag

SEQ ID NO: 1288647 - RNA, 24 nt, Human
ccacgcccgacuaauuucuuuuuu

SEQ ID NO: 1288648 - RNA, 18 nt, Human
cccagacuggaguagagu

SEQ ID NO: 1288649 - RNA, 23 nt, Human
ccugaguagcugggacuacaggc

SEQ ID NO: 1288650 - RNA, 24 nt, Human
ccugaguagcugggacuacaggca

SEQ ID NO: 1288651 - RNA, 19 nt, Human
cgcucugucgcccagacug

SEQ ID NO: 1288652 - RNA, 21 nt, Human
cgcucugucgcccagacugga

SEQ ID NO: 1288653 - RNA, 22 nt, Human
cuaauuucuuuuuuuuuuuuuu

SEQ ID NO: 1288654 - RNA, 24 nt, Human
cucacugcaagcuccaccucccgg

SEQ ID NO: 1288655 - RNA, 24 nt, Human
cucagccuccugaguagcugggac

SEQ ID NO: 1288656 - RNA, 22 nt, Human
cucccaaaacagaaauacccaa

SEQ ID NO: 1288657 - RNA, 21 nt, Human
cucccggguucacgccauucu

SEQ ID NO: 1288658 - RNA, 23 nt, Human
cucugucgcccagacuggaguag

SEQ ID NO: 1288659 - RNA, 23 nt, Human
cugccucagccuccugaguagcu

SEQ ID NO: 1288660 - RNA, 24 nt, Human
cuggcacauaauaugugcucccuu

SEQ ID NO: 1288661 - RNA, 24 nt, Human
cuguacaaguugcuguuccgucgc

SEQ ID NO: 1288662 - RNA, 20 nt, Human
gaguagcugggacuacaggc

SEQ ID NO: 1288663 - RNA, 25 nt, Human
gaguagcugggacuacaggcacccg

SEQ ID NO: 1288664 - RNA, 22 nt, Human
gcaagcuccaccucccggguuc

SEQ ID NO: 1288665 - RNA, 20 nt, Human
gcccagacuggaguagagug

SEQ ID NO: 1288666 - RNA, 20 nt, Human
gccucagccuccugaguagc

SEQ ID NO: 1288667 - RNA, 18 nt, Human
ggacaucuugacaucacu

SEQ ID NO: 1288668 - RNA, 21 nt, Human
gugaucucggcucacugcaag

SEQ ID NO: 1288669 - RNA, 20 nt, Human
gugcucccuuaaaaagcagg

SEQ ID NO: 1288670 - RNA, 21 nt, Human
guuacagucacacugacagcu

SEQ ID NO: 1288671 - RNA, 19 nt, Human
uaaaaaaaucaaaacuaua

SEQ ID NO: 1288672 - RNA, 21 nt, Human
uaaaagauccacccugccucu

SEQ ID NO: 1288673 - RNA, 19 nt, Human
uaauaugugcucccuuaaa

SEQ ID NO: 1288674 - RNA, 23 nt, Human
uacaggcacccgccaccacgccc

SEQ ID NO: 1288675 - RNA, 22 nt, Human
uacccaaacaaaauucaaacaa

SEQ ID NO: 1288676 - RNA, 21 nt, Human
uaguuuauucugucuuuccca

SEQ ID NO: 1288677 - RNA, 24 nt, Human
ucacugcaagcuccaccucccggg

SEQ ID NO: 1288678 - RNA, 23 nt, Human
ucagccuccugaguagcugggac

SEQ ID NO: 1288679 - RNA, 21 nt, Human
ucccggguucacgccauucuc

SEQ ID NO: 1288680 - RNA, 24 nt, Human
ucccggguucacgccauucuccug

SEQ ID NO: 1288681 - RNA, 24 nt, Human
uccugaguagcugggacuacaggc

SEQ ID NO: 1288682 - RNA, 24 nt, Human
ucuccugccucagccuccugagua

SEQ ID NO: 1288683 - RNA, 18 nt, Human
ucuuuuuuuuuuuuuuuu

SEQ ID NO: 1288684 - RNA, 21 nt, Human
ugcagcauuuaaaaauaaucc

SEQ ID NO: 1288685 - RNA, 24 nt, Human
ugccucagccuccugaguagcugg

SEQ ID NO: 1288686 - RNA, 24 nt, Human
uggaguagaguggugugaucucgg

SEQ ID NO: 1288687 - RNA, 21 nt, Human
ugggacuacaggcacccgcca

SEQ ID NO: 1288688 - RNA, 22 nt, Human
ugggacuacaggcacccgccac

SEQ ID NO: 1288689 - RNA, 24 nt, Human
ugggacuacaggcacccgccacca

SEQ ID NO: 1288690 - RNA, 18 nt, Human
uguagaaaacaaguggcc

SEQ ID NO: 1288691 - RNA, 20 nt, Human
uguagaaaacaaguggccua

SEQ ID NO: 1288692 - RNA, 19 nt, Human
uuaaguuguagccucaaca

SEQ ID NO: 1288693 - RNA, 22 nt, Human
uuuaaaaauaauccagugacuc

SEQ ID NO: 1288694 - RNA, 18 nt, Human
uuucccagcagugccugg

SEQ ID NO: 1288695 - RNA, 21 nt, Human
uuugguauuaaaagauccacc

SEQ ID NO: 1288696 - RNA, 18 nt, Human
uuuuuuuuuuuuuuuuug

SEQ ID NO: 1288697 - RNA, 24 nt, Human
uuuuuuuuuuuuuuuuugguuugg

SEQ ID NO: 1288698 - RNA, 23 nt, Human
uuuuuuuuuuuuuuuuuugguuu

SEQ ID NO: 1288699 - RNA, 22 nt, Human
aaaagaagcggaucucugggaa

SEQ ID NO: 1288700 - RNA, 19 nt, Human
aaagaagaaagcagagaag

SEQ ID NO: 1288701 - RNA, 24 nt, Human
aagaaagcagagaagaaaagaagc

SEQ ID NO: 1288702 - RNA, 21 nt, Human
aagaagaaagcagagaagaaa

SEQ ID NO: 1288703 - RNA, 24 nt, Human
aagaagaaagcagagaagaaaaga

SEQ ID NO: 1288704 - RNA, 19 nt, Human
aagaagaacaggagaacag

SEQ ID NO: 1288705 - RNA, 21 nt, Human
aagaagaacaggagaacaggc

SEQ ID NO: 1288706 - RNA, 26 nt, Human
aagaagcggaucucugggaagcagag

SEQ ID NO: 1288707 - RNA, 22 nt, Human
aagaguauuucaacuuguuuga

SEQ ID NO: 1288708 - RNA, 22 nt, Human
aagcaaucugcaaaagaagaac

SEQ ID NO: 1288709 - RNA, 19 nt, Human
aagcagagcaaguaaagca

SEQ ID NO: 1288710 - RNA, 21 nt, Human
aagcagccugccauccgguga

SEQ ID NO: 1288711 - RNA, 19 nt, Human
aagcggaucucugggaagc

SEQ ID NO: 1288712 - RNA, 18 nt, Human
agaaagaagaaagcagag

SEQ ID NO: 1288713 - RNA, 25 nt, Human
agaaagaagaaagcagagaagaaaa

SEQ ID NO: 1288714 - RNA, 23 nt, Human
agaaagcagagaagaaaagaagc

SEQ ID NO: 1288715 - RNA, 21 nt, Human
agaagaaaagaagcggaucuc

SEQ ID NO: 1288716 - RNA, 24 nt, Human
agaagaaaagaagcggaucucugg

SEQ ID NO: 1288717 - RNA, 18 nt, Human
agaagaacaggagaacag

SEQ ID NO: 1288718 - RNA, 18 nt, Human
agcagagaagaaaagaag

SEQ ID NO: 1288719 - RNA, 22 nt, Human
cagaaauaaggaaacugaaacc

SEQ ID NO: 1288720 - RNA, 19 nt, Human
caggagaacaggcauucac

SEQ ID NO: 1288721 - RNA, 20 nt, Human
ccauggagaagacauagcca

SEQ ID NO: 1288722 - RNA, 21 nt, Human
cucagaaauaaggaaacugaa

SEQ ID NO: 1288723 - RNA, 24 nt, Human
cucagaaauaaggaaacugaaacc

SEQ ID NO: 1288724 - RNA, 22 nt, Human
cugcaaaagaagaacaggagaa

SEQ ID NO: 1288725 - RNA, 18 nt, Human
gagaagaaaagaagcgga

SEQ ID NO: 1288726 - RNA, 20 nt, Human
gcccugugcacuggcaccug

SEQ ID NO: 1288727 - RNA, 30 nt, Human
uaaaaaccccauggagaagacauagccaag

SEQ ID NO: 1288728 - RNA, 24 nt, Human
uaaagcaaucugcaaaagaagaac

SEQ ID NO: 1288729 - RNA, 22 nt, Human
uaaggaaacugaaaccuagagg

SEQ ID NO: 1288730 - RNA, 27 nt, Human
uaaggaaacugaaaccuagaggggcug

SEQ ID NO: 1288731 - RNA, 26 nt, Human
uauuucaacuuguuugauacucauug

SEQ ID NO: 1288732 - RNA, 19 nt, Human
ucacugcagccgcuggaaa

SEQ ID NO: 1288733 - RNA, 18 nt, Human
ugaaaccuagaggggcug

SEQ ID NO: 1288734 - RNA, 18 nt, Human
ugaaaccuagaggggcug

SEQ ID NO: 1288735 - RNA, 20 nt, Human
ugaaaccuagaggggcuggg

SEQ ID NO: 1288736 - RNA, 23 nt, Human
aaacaccagaaacaucuggaaaa

SEQ ID NO: 1288737 - RNA, 25 nt, Human
aaacagaauaauuuauuugaaucca

SEQ ID NO: 1288738 - RNA, 24 nt, Human
acaccagaaacaucuggaaaagca

SEQ ID NO: 1288739 - RNA, 22 nt, Human
agagcaucuucauggccugaaa

SEQ ID NO: 1288740 - RNA, 20 nt, Human
agguguuggucuugguuucu

SEQ ID NO: 1288741 - RNA, 29 nt, Human
cacuuucguucuccccgucagcaugagaa

SEQ ID NO: 1288742 - RNA, 18 nt, Human
cauccagagcaucuucau

SEQ ID NO: 1288743 - RNA, 19 nt, Human
ccccaacauguuuuucugu

SEQ ID NO: 1288744 - RNA, 18 nt, Human
ccuugaaaaaaauaaaaa

SEQ ID NO: 1288745 - RNA, 23 nt, Human
cgauacacaaucagaggcuggaa

SEQ ID NO: 1288746 - RNA, 18 nt, Human
cuccccgucagcaugaga

SEQ ID NO: 1288747 - RNA, 27 nt, Human
gaaacaccagaaacaucuggaaaagca

SEQ ID NO: 1288748 - RNA, 23 nt, Human
gaccugcuugggauccuggaaac

SEQ ID NO: 1288749 - RNA, 18 nt, Human
gcugggcagggaugugcu

SEQ ID NO: 1288750 - RNA, 21 nt, Human
uagcccaugaaaguucacucu

SEQ ID NO: 1288751 - RNA, 22 nt, Human
ucauccagagcaucuucauggc

SEQ ID NO: 1288752 - RNA, 21 nt, Human
ugaaaaaccugcaguucaauu

SEQ ID NO: 1288753 - RNA, 19 nt, Human
ugagaacgacucuccacug

SEQ ID NO: 1288754 - RNA, 21 nt, Human
ugaguaagagguguuggucuu

SEQ ID NO: 1288755 - RNA, 23 nt, Human
uguugcacaagacauuguguaua

SEQ ID NO: 1288756 - RNA, 19 nt, Human
uugaauccaucuuuccuug

SEQ ID NO: 1288757 - RNA, 23 nt, Human
aaacacagaucacaucuucccca

SEQ ID NO: 1288758 - RNA, 18 nt, Human
aaaggcucuggggggaug

SEQ ID NO: 1288759 - RNA, 20 nt, Human
aaaggcucuggggggauguu

SEQ ID NO: 1288760 - RNA, 22 nt, Human
aaggcugacacggggaggccag

SEQ ID NO: 1288761 - RNA, 20 nt, Human
aaguccccuucuagguggcc

SEQ ID NO: 1288762 - RNA, 21 nt, Human
acacagaucacaucuucccca

SEQ ID NO: 1288763 - RNA, 24 nt, Human
acccugaguugggucagagaaagg

SEQ ID NO: 1288764 - RNA, 18 nt, Human
agagagaaacacagauca

SEQ ID NO: 1288765 - RNA, 22 nt, Human
agagagaaacacagaucacauc

SEQ ID NO: 1288766 - RNA, 24 nt, Human
aggccagacagcuucacggcacca

SEQ ID NO: 1288767 - RNA, 19 nt, Human
aggcgaggggcggccuggc

SEQ ID NO: 1288768 - RNA, 22 nt, Human
aggcugacacggggaggccaga

SEQ ID NO: 1288769 - RNA, 19 nt, Human
agggagcgaggucccgcuc

SEQ ID NO: 1288770 - RNA, 19 nt, Human
cacaucuuccccacgccua

SEQ ID NO: 1288771 - RNA, 19 nt, Human
caccacccccagccgagcc

SEQ ID NO: 1288772 - RNA, 18 nt, Human
cacugucagcggcagaac

SEQ ID NO: 1288773 - RNA, 23 nt, Human
cacugucagcggcagaaccgucc

SEQ ID NO: 1288774 - RNA, 24 nt, Human
cacuucugcucacggcuuuggaga

SEQ ID NO: 1288775 - RNA, 21 nt, Human
cagcggcagaaccguccccag

SEQ ID NO: 1288776 - RNA, 20 nt, Human
cccccagccgagcccugugu

SEQ ID NO: 1288777 - RNA, 22 nt, Human
ccggagcaagcccggccgggac

SEQ ID NO: 1288778 - RNA, 20 nt, Human
cgggaaggcgaggggcggcc

SEQ ID NO: 1288779 - RNA, 26 nt, Human
cuguccaaacuucaagaaaaacaaag

SEQ ID NO: 1288780 - RNA, 25 nt, Human
gagcaagcccggccgggacccuucg

SEQ ID NO: 1288781 - RNA, 23 nt, Human
gcaggagugcggcgggaaggccg

SEQ ID NO: 1288782 - RNA, 21 nt, Human
ggagaugggaggggggagaag

SEQ ID NO: 1288783 - RNA, 18 nt, Human
gggcuuuggggagacagc

SEQ ID NO: 1288784 - RNA, 21 nt, Human
uagguggccggcaccgcuuga

SEQ ID NO: 1288785 - RNA, 22 nt, Human
uccccgagugcuagggagcgag

SEQ ID NO: 1288786 - RNA, 18 nt, Human
uggaauaaguccccuucu

SEQ ID NO: 1288787 - RNA, 23 nt, Human
ugggaggggggagaagagagaaa

SEQ ID NO: 1288788 - RNA, 18 nt, Human
ugggcuuuggggagacag

SEQ ID NO: 1288789 - RNA, 21 nt, Human
ugggcuuuggggagacagcuc

SEQ ID NO: 1288790 - RNA, 20 nt, Human
uguccaaacuucaagaaaaa

SEQ ID NO: 1288791 - RNA, 21 nt, Human
uucacggcaccaguucucucc

SEQ ID NO: 1288792 - RNA, 22 nt, Human
uugcacuucacacacuucugcc

SEQ ID NO: 1288793 - RNA, 18 nt, Human
uuuggggagacagcuccu

SEQ ID NO: 1288794 - RNA, 19 nt, Human
aaaugucuguucagaucgc

SEQ ID NO: 1288795 - RNA, 23 nt, Human
ccucuucacauuccccuuuacua

SEQ ID NO: 1288796 - RNA, 22 nt, Human
ccuuugggaaaugucuguucag

SEQ ID NO: 1288797 - RNA, 24 nt, Human
gagcauuuuaaaaauauacuuauu

SEQ ID NO: 1288798 - RNA, 18 nt, Human
guaacacugcagaguaca

SEQ ID NO: 1288799 - RNA, 19 nt, Human
gucauuuucauaccauguc

SEQ ID NO: 1288800 - RNA, 22 nt, Human
guugcuguuuucuauaggagau

SEQ ID NO: 1288801 - RNA, 25 nt, Human
uaaugauugaaauaguacuacaugc

SEQ ID NO: 1288802 - RNA, 20 nt, Human
uauauaaauuauuuuuacau

SEQ ID NO: 1288803 - RNA, 19 nt, Human
uaucaaagaagauacauuu

SEQ ID NO: 1288804 - RNA, 23 nt, Human
ucccaugcaaauacauucagagc

SEQ ID NO: 1288805 - RNA, 26 nt, Human
uccccuuuacuaucaaagaagauacc

SEQ ID NO: 1288806 - RNA, 21 nt, Human
ugaauuuauauguugcuguuu

SEQ ID NO: 1288807 - RNA, 24 nt, Human
ugagaugauaucucauugugguuu

SEQ ID NO: 1288808 - RNA, 21 nt, Human
ugcagaguacauaaggauaau

SEQ ID NO: 1288809 - RNA, 22 nt, Human
uuaacauuugcccaccucuuca

SEQ ID NO: 1288810 - RNA, 19 nt, Human
uucagagcuguucuuaguu

SEQ ID NO: 1288811 - RNA, 23 nt, Human
uuuuuuugcugugguauuuuguc

SEQ ID NO: 1288812 - RNA, 19 nt, Human
aaccucaccgagagcccaa

SEQ ID NO: 1288813 - RNA, 21 nt, Human
agaagaggagagagagaggcc

SEQ ID NO: 1288814 - RNA, 25 nt, Human
agccaggugcucugcauggcaaggu

SEQ ID NO: 1288815 - RNA, 21 nt, Human
agcccaaacucucaccuacag

SEQ ID NO: 1288816 - RNA, 22 nt, Human
aucugucuuuaucgccuccccc

SEQ ID NO: 1288817 - RNA, 19 nt, Human
cacccccuggcccauaagc

SEQ ID NO: 1288818 - RNA, 20 nt, Human
cagggaccacaagccagcac

SEQ ID NO: 1288819 - RNA, 18 nt, Human
ccagcacagaggcgaccu

SEQ ID NO: 1288820 - RNA, 23 nt, Human
ccagcacagaggcgaccuccucc

SEQ ID NO: 1288821 - RNA, 20 nt, Human
cccaacccuuccacucugcu

SEQ ID NO: 1288822 - RNA, 20 nt, Human
ccccaacccuuccacucugc

SEQ ID NO: 1288823 - RNA, 18 nt, Human
cccccaacccuuccacuc

SEQ ID NO: 1288824 - RNA, 21 nt, Human
cccccaacccuuccacucugc

SEQ ID NO: 1288825 - RNA, 19 nt, Human
cccucccacccccuggccc

SEQ ID NO: 1288826 - RNA, 23 nt, Human
ccugcagccgggucagagugagc

SEQ ID NO: 1288827 - RNA, 23 nt, Human
ccuggcccauaagccuuuuccuu

SEQ ID NO: 1288828 - RNA, 23 nt, Human
cucccaaccucaccgagagccca

SEQ ID NO: 1288829 - RNA, 21 nt, Human
cucccucccacccccuggccc

SEQ ID NO: 1288830 - RNA, 20 nt, Human
cuggcccauaagccuuuucc

SEQ ID NO: 1288831 - RNA, 21 nt, Human
cuguuccugcuucucuuuuca

SEQ ID NO: 1288832 - RNA, 23 nt, Human
gaaagaaaaaugguaauacggaa

SEQ ID NO: 1288833 - RNA, 19 nt, Human
gagagagagaggccagagc

SEQ ID NO: 1288834 - RNA, 22 nt, Human
gagaggccagagccuggggaug

SEQ ID NO: 1288835 - RNA, 22 nt, Human
gccuuuuccuucucccaaccuc

SEQ ID NO: 1288836 - RNA, 25 nt, Human
gcugugcccauucucccucccaccc

SEQ ID NO: 1288837 - RNA, 21 nt, Human
ggcuugggggaagggcagcuc

SEQ ID NO: 1288838 - RNA, 20 nt, Human
gggcuugggggaagggcagc

SEQ ID NO: 1288839 - RNA, 23 nt, Human
gguugcccucaggguccuccuug

SEQ ID NO: 1288840 - RNA, 20 nt, Human
guggaguauuuuacuguucc

SEQ ID NO: 1288841 - RNA, 19 nt, Human
gugguugcccucagggucc

SEQ ID NO: 1288842 - RNA, 20 nt, Human
guuccugcuucucuuuucac

SEQ ID NO: 1288843 - RNA, 21 nt, Human
guucugguccccuugagucuu

SEQ ID NO: 1288844 - RNA, 21 nt, Human
ucccaaccucaccgagagccc

SEQ ID NO: 1288845 - RNA, 21 nt, Human
ucccaaccucaccgagagccc

SEQ ID NO: 1288846 - RNA, 22 nt, Human
ucccaaccucaccgagagccca

SEQ ID NO: 1288847 - RNA, 18 nt, Human
uccgggguuggcuccuuc

SEQ ID NO: 1288848 - RNA, 23 nt, Human
ucucccaaccucaccgagagccc

SEQ ID NO: 1288849 - RNA, 21 nt, Human
ucugucuuuaucgccuccccc

SEQ ID NO: 1288850 - RNA, 27 nt, Human
ugaaagaaaaaugguaauacggaaaca

SEQ ID NO: 1288851 - RNA, 19 nt, Human
uggcagaugagaagccagg

SEQ ID NO: 1288852 - RNA, 19 nt, Human
uggcccauaagccuuuucc

SEQ ID NO: 1288853 - RNA, 24 nt, Human
uggcugugcccauucucccuccca

SEQ ID NO: 1288854 - RNA, 18 nt, Human
ugggcuugggggaagggc

SEQ ID NO: 1288855 - RNA, 18 nt, Human
ugggggaagggcagcucc

SEQ ID NO: 1288856 - RNA, 24 nt, Human
ugguugcccucaggguccuccuug

SEQ ID NO: 1288857 - RNA, 20 nt, Human
ugucagggaccacaagccag

SEQ ID NO: 1288858 - RNA, 19 nt, Human
ugucuuuaucgccuccccc

SEQ ID NO: 1288859 - RNA, 22 nt, Human
uuccugcagccgggucagagug

SEQ ID NO: 1288860 - RNA, 19 nt, Human
uugcccucaggguccuccu

SEQ ID NO: 1288861 - RNA, 19 nt, Human
uuuacuguuccugcuucuc

SEQ ID NO: 1288862 - RNA, 28 nt, Human
aaaaaagaauuccucuaaucaugucacc

SEQ ID NO: 1288863 - RNA, 24 nt, Human
aaaaaagccaaaacugacaaacac

SEQ ID NO: 1288864 - RNA, 25 nt, Human
aaaaagacauacaauuuaacacaga

SEQ ID NO: 1288865 - RNA, 24 nt, Human
aaaaauuaaccaaauuuugucccu

SEQ ID NO: 1288866 - RNA, 21 nt, Human
aaacaagccacugcuuccuca

SEQ ID NO: 1288867 - RNA, 21 nt, Human
aaacaauggcaucaaauggac

SEQ ID NO: 1288868 - RNA, 23 nt, Human
aaacccaauucagaaaugaagaa

SEQ ID NO: 1288869 - RNA, 24 nt, Human
aaauauuggcagcuugaauaagcu

SEQ ID NO: 1288870 - RNA, 22 nt, Human
aacaaaggagaaaaaagccaaa

SEQ ID NO: 1288871 - RNA, 21 nt, Human
aacacgaaacauugacuaaua

SEQ ID NO: 1288872 - RNA, 23 nt, Human
aacagagcagcagaagcaucaag

SEQ ID NO: 1288873 - RNA, 24 nt, Human
aacagagcagcagaagcaucaaga

SEQ ID NO: 1288874 - RNA, 21 nt, Human
aagaauuccucuaaucauguc

SEQ ID NO: 1288875 - RNA, 21 nt, Human
aagagaaaacccaauucagaa

SEQ ID NO: 1288876 - RNA, 24 nt, Human
aauaaagaauauauacaaaaggga

SEQ ID NO: 1288877 - RNA, 26 nt, Human
aauucagagguauacuucugauuugg

SEQ ID NO: 1288878 - RNA, 18 nt, Human
acaaaacaaaaaaaagag

SEQ ID NO: 1288879 - RNA, 20 nt, Human
acaacaaaggagaaaaaagc

SEQ ID NO: 1288880 - RNA, 23 nt, Human
acaacaaaggagaaaaaagccaa

SEQ ID NO: 1288881 - RNA, 25 nt, Human
acaucaagaagagaaaacccaauuc

SEQ ID NO: 1288882 - RNA, 22 nt, Human
acccaauucagaaaugaagaaa

SEQ ID NO: 1288883 - RNA, 21 nt, Human
acccccagagcaucucaauau

SEQ ID NO: 1288884 - RNA, 23 nt, Human
acccuuucacuugaucucccccu

SEQ ID NO: 1288885 - RNA, 19 nt, Human
acugcuuccucaaagcaag

SEQ ID NO: 1288886 - RNA, 24 nt, Human
agaaaauccguggugaaaccugaa

SEQ ID NO: 1288887 - RNA, 20 nt, Human
agaaaugaagaaaacuggca

SEQ ID NO: 1288888 - RNA, 25 nt, Human
agaauacaacaaaggagaaaaaagc

SEQ ID NO: 1288889 - RNA, 20 nt, Human
agacuggagacagcaagggu

SEQ ID NO: 1288890 - RNA, 24 nt, Human
agauggauugguagaggugugucg

SEQ ID NO: 1288891 - RNA, 18 nt, Human
agcaaggaggcaaguacu

SEQ ID NO: 1288892 - RNA, 27 nt, Human
agcaaggaggcaaguacugaagaagaa

SEQ ID NO: 1288893 - RNA, 25 nt, Human
agcagaagcaucaagaucaggucca

SEQ ID NO: 1288894 - RNA, 19 nt, Human
agcucauuuuuucccucag

SEQ ID NO: 1288895 - RNA, 19 nt, Human
aguacugaagaagaaaagg

SEQ ID NO: 1288896 - RNA, 19 nt, Human
auaaugcggaacacgaaac

SEQ ID NO: 1288897 - RNA, 28 nt, Human
auacacccccagagcaucucccguaccg

SEQ ID NO: 1288898 - RNA, 20 nt, Human
auccagggaaucccagaaau

SEQ ID NO: 1288899 - RNA, 22 nt, Human
caaagcaaggaccaggcuccaa

SEQ ID NO: 1288900 - RNA, 21 nt, Human
caaaggagaaaaaagccaaaa

SEQ ID NO: 1288901 - RNA, 23 nt, Human
caaauaaugcggaacacgaaaca

SEQ ID NO: 1288902 - RNA, 20 nt, Human
caaaugacaacuugaucaca

SEQ ID NO: 1288903 - RNA, 21 nt, Human
caagaucagguccaaagaguu

SEQ ID NO: 1288904 - RNA, 23 nt, Human
caccacauaaauacugggcaaca

SEQ ID NO: 1288905 - RNA, 19 nt, Human
cacccuuucacuugaucuc

SEQ ID NO: 1288906 - RNA, 22 nt, Human
caccuucagcuaucaaucauuu

SEQ ID NO: 1288907 - RNA, 23 nt, Human
cagagcaucucaauaucccuggc

SEQ ID NO: 1288908 - RNA, 21 nt, Human
cagcaguuccuuaggagccaa

SEQ ID NO: 1288909 - RNA, 22 nt, Human
cagcaguuccuuaggagccaac

SEQ ID NO: 1288910 - RNA, 25 nt, Human
cagucucuuuuuuguggagagaagg

SEQ ID NO: 1288911 - RNA, 20 nt, Human
cauacaauuuaacacagacu

SEQ ID NO: 1288912 - RNA, 23 nt, Human
cauugccaagaaaaccucucagc

SEQ ID NO: 1288913 - RNA, 20 nt, Human
ccaacagagcagcagaagca

SEQ ID NO: 1288914 - RNA, 21 nt, Human
ccaauucagaaaugaagaaaa

SEQ ID NO: 1288915 - RNA, 22 nt, Human
ccagagcaucucaauaucccug

SEQ ID NO: 1288916 - RNA, 20 nt, Human
cccucaggugguuaaaggcc

SEQ ID NO: 1288917 - RNA, 21 nt, Human
cccucagucucuuuuuugugg

SEQ ID NO: 1288918 - RNA, 22 nt, Human
ccucaaaaacaaaacaaaaaaa

SEQ ID NO: 1288919 - RNA, 21 nt, Human
ccucacauugccaagaaaacc

SEQ ID NO: 1288920 - RNA, 23 nt, Human
ccucagucucuuuuuuguggaga

SEQ ID NO: 1288921 - RNA, 19 nt, Human
ccugaguugcucagcccuc

SEQ ID NO: 1288922 - RNA, 19 nt, Human
ccugccuuccucuuccucc

SEQ ID NO: 1288923 - RNA, 21 nt, Human
ccuguaggucgaaccaacacu

SEQ ID NO: 1288924 - RNA, 23 nt, Human
ccuuucacuugaucucccccuca

SEQ ID NO: 1288925 - RNA, 21 nt, Human
cgaaccaacacucaauccaug

SEQ ID NO: 1288926 - RNA, 19 nt, Human
cucaaaagaugauaaacaa

SEQ ID NO: 1288927 - RNA, 20 nt, Human
cucaaaagaugauaaacaau

SEQ ID NO: 1288928 - RNA, 21 nt, Human
cucaaaagaugauaaacaaug

SEQ ID NO: 1288929 - RNA, 22 nt, Human
cucacuaccaccuucagcuauc

SEQ ID NO: 1288930 - RNA, 19 nt, Human
cucauauaaugaauccagg

SEQ ID NO: 1288931 - RNA, 22 nt, Human
cuggccaccuacagcaaaauau

SEQ ID NO: 1288932 - RNA, 21 nt, Human
cuguaagcugauuccaaaagc

SEQ ID NO: 1288933 - RNA, 23 nt, Human
cuuccucaaagcaaggaccaggc

SEQ ID NO: 1288934 - RNA, 20 nt, Human
cuucuugaaacaagccacug

SEQ ID NO: 1288935 - RNA, 19 nt, Human
gaacauucuaccccugcuu

SEQ ID NO: 1288936 - RNA, 18 nt, Human
gaagaagaaaaggaacaa

SEQ ID NO: 1288937 - RNA, 21 nt, Human
gaaggaaaccaacaucaagaa

SEQ ID NO: 1288938 - RNA, 22 nt, Human
ggagaagggcuaucauacaaca

SEQ ID NO: 1288939 - RNA, 22 nt, Human
ggcagguauacaauacaccccc

SEQ ID NO: 1288940 - RNA, 24 nt, Human
ggggcaaauucuagacuaaagaaa

SEQ ID NO: 1288941 - RNA, 24 nt, Human
gucaccaucucauauaaugaaucc

SEQ ID NO: 1288942 - RNA, 24 nt, Human
gucucuuuuuuguggagagaaggg

SEQ ID NO: 1288943 - RNA, 25 nt, Human
uaaaaaagcaaaagaauaaagaaua

SEQ ID NO: 1288944 - RNA, 22 nt, Human
uaaaaaucugaccccaaggaau

SEQ ID NO: 1288945 - RNA, 23 nt, Human
uaaagcuuaguugaaucucuaaa

SEQ ID NO: 1288946 - RNA, 20 nt, Human
uaaaguaacuuuaaaaaucu

SEQ ID NO: 1288947 - RNA, 22 nt, Human
uaaaguguccucacuaccaccu

SEQ ID NO: 1288948 - RNA, 18 nt, Human
uaagggcaaaugguucaa

SEQ ID NO: 1288949 - RNA, 23 nt, Human
uaccccugcuuuggagaagggcu

SEQ ID NO: 1288950 - RNA, 20 nt, Human
uacugggagauuaaguccau

SEQ ID NO: 1288951 - RNA, 19 nt, Human
uagaaaauuaguuucaggg

SEQ ID NO: 1288952 - RNA, 18 nt, Human
uauacaauacacccccag

SEQ ID NO: 1288953 - RNA, 18 nt, Human
uaugaaggaaaccaacau

SEQ ID NO: 1288954 - RNA, 23 nt, Human
uaugagaaacaaaacuggccacc

SEQ ID NO: 1288955 - RNA, 19 nt, Human
ucagaaaugaagaaaacug

SEQ ID NO: 1288956 - RNA, 22 nt, Human
ucagaaguggcuucuugaaaca

SEQ ID NO: 1288957 - RNA, 21 nt, Human
ucagagguauacuucugauuu

SEQ ID NO: 1288958 - RNA, 24 nt, Human
ucauacaacauucagucagcugaa

SEQ ID NO: 1288959 - RNA, 23 nt, Human
ucccaacuacugggagauuaagu

SEQ ID NO: 1288960 - RNA, 18 nt, Human
uccguggugaaaccugaa

SEQ ID NO: 1288961 - RNA, 25 nt, Human
uccuuaggagccaacaugacaggug

SEQ ID NO: 1288962 - RNA, 18 nt, Human
ucgaaccaacacucaauc

SEQ ID NO: 1288963 - RNA, 20 nt, Human
ucuagacuaaagaaaugauc

SEQ ID NO: 1288964 - RNA, 24 nt, Human
ucuuccaaaugacaacuugaucac

SEQ ID NO: 1288965 - RNA, 25 nt, Human
ugaaacaagccacugcuuccucaaa

SEQ ID NO: 1288966 - RNA, 22 nt, Human
ugaaaccugaacauucuacccc

SEQ ID NO: 1288967 - RNA, 18 nt, Human
ugaagaagaaaaggaaca

SEQ ID NO: 1288968 - RNA, 21 nt, Human
ugacaggugggucagauuucc

SEQ ID NO: 1288969 - RNA, 23 nt, Human
ugaccccaaggaauccaggacac

SEQ ID NO: 1288970 - RNA, 23 nt, Human
ugagccgcuuacaacagcaguuc

SEQ ID NO: 1288971 - RNA, 23 nt, Human
ugaguaaguccugccuuccucuu

SEQ ID NO: 1288972 - RNA, 19 nt, Human
ugaucucccccucagucuc

SEQ ID NO: 1288973 - RNA, 22 nt, Human
uggguagauucuuagaucagaa

SEQ ID NO: 1288974 - RNA, 21 nt, Human
ugguagcauaaaauuuggccc

SEQ ID NO: 1288975 - RNA, 21 nt, Human
uguccucacuaccaccuucag

SEQ ID NO: 1288976 - RNA, 19 nt, Human
uuaacacagacugaguggg

SEQ ID NO: 1288977 - RNA, 23 nt, Human
uuauaaaguaacuuuaaaaaucu

SEQ ID NO: 1288978 - RNA, 22 nt, Human
uuaucuccucaaaaacaaaaca

SEQ ID NO: 1288979 - RNA, 24 nt, Human
uucagaggccaacagagcagcaga

SEQ ID NO: 1288980 - RNA, 19 nt, Human
uuccaaucuauuaugccug

SEQ ID NO: 1288981 - RNA, 20 nt, Human
uuuaaaacaucucccaacua

SEQ ID NO: 1288982 - RNA, 21 nt, Human
uuuaaaguguccucacuacca

SEQ ID NO: 1288983 - RNA, 24 nt, Human
uuuuaaaacaucucccaacuacug

SEQ ID NO: 1288984 - RNA, 25 nt, Human
aagcaagagugagccaccggcugga

SEQ ID NO: 1288985 - RNA, 21 nt, Human
accucagcaaagcaagaguga

SEQ ID NO: 1288986 - RNA, 20 nt, Human
cacgaugaccucagcaaagc

SEQ ID NO: 1288987 - RNA, 21 nt, Human
ccuucuguaacgcaugaguca

SEQ ID NO: 1288988 - RNA, 23 nt, Human
gcaaagcaagagugagccaccgg

SEQ ID NO: 1288989 - RNA, 20 nt, Human
guucuuuuuuucuggcacga

SEQ ID NO: 1288990 - RNA, 20 nt, Human
acaaagaaggaguccacaac

SEQ ID NO: 1288991 - RNA, 24 nt, Human
cugcuaaaaaugauagcuuuucuu

SEQ ID NO: 1288992 - RNA, 21 nt, Human
uagcuuuucuuucucuucaaa

SEQ ID NO: 1288993 - RNA, 24 nt, Human
uccaagagauguugaccagagaag

SEQ ID NO: 1288994 - RNA, 20 nt, Human
uccacaacuuuuccuuccaa

SEQ ID NO: 1288995 - RNA, 19 nt, Human
agagcuggggagcagaggg

SEQ ID NO: 1288996 - RNA, 23 nt, Human
agagugcaggugugcccgggccc

SEQ ID NO: 1288997 - RNA, 21 nt, Human
aggccaccaucagugccacga

SEQ ID NO: 1288998 - RNA, 22 nt, Human
agguggugcagagcuggggagc

SEQ ID NO: 1288999 - RNA, 21 nt, Human
aggugugcccgggcccagagc

SEQ ID NO: 1289000 - RNA, 23 nt, Human
cagagcuggggagcagagggagg

SEQ ID NO: 1289001 - RNA, 22 nt, Human
caggaugacucccgcauccaga

SEQ ID NO: 1289002 - RNA, 23 nt, Human
caggaugacucccgcauccagau

SEQ ID NO: 1289003 - RNA, 21 nt, Human
caggcaagauaggucacaggu

SEQ ID NO: 1289004 - RNA, 19 nt, Human
caggcccaguuugaggaug

SEQ ID NO: 1289005 - RNA, 23 nt, Human
caggcccaguuugaggaugccau

SEQ ID NO: 1289006 - RNA, 24 nt, Human
caggggcucaagguggggucuucu

SEQ ID NO: 1289007 - RNA, 18 nt, Human
caggugugcccgggccca

SEQ ID NO: 1289008 - RNA, 22 nt, Human
ccacgacugaggagcugaaggc

SEQ ID NO: 1289009 - RNA, 23 nt, Human
ccagcaggcaagauaggucacag

SEQ ID NO: 1289010 - RNA, 21 nt, Human
ccaggagguggugcagagcug

SEQ ID NO: 1289011 - RNA, 22 nt, Human
cccgcauccagauggcgacccu

SEQ ID NO: 1289012 - RNA, 23 nt, Human
cccucacagcagguggcagaggu

SEQ ID NO: 1289013 - RNA, 20 nt, Human
ccugcagccuccgcagcacc

SEQ ID NO: 1289014 - RNA, 22 nt, Human
cgaggcagagugcaggugugcc

SEQ ID NO: 1289015 - RNA, 28 nt, Human
cgcgagagccuccaggaccuagcggcag

SEQ ID NO: 1289016 - RNA, 18 nt, Human
cuagaaaggccccugugg

SEQ ID NO: 1289017 - RNA, 23 nt, Human
cuagcggcaguggucagcguccu

SEQ ID NO: 1289018 - RNA, 18 nt, Human
cuaggcucaguccuucug

SEQ ID NO: 1289019 - RNA, 20 nt, Human
cugaaggcccuccaggccca

SEQ ID NO: 1289020 - RNA, 18 nt, Human
gauaggucacagguggcc

SEQ ID NO: 1289021 - RNA, 18 nt, Human
gcacagcccucacagcag

SEQ ID NO: 1289022 - RNA, 21 nt, Human
gcccugcagccuccgcagcac

SEQ ID NO: 1289023 - RNA, 21 nt, Human
gcucuagaaaggccccugugg

SEQ ID NO: 1289024 - RNA, 21 nt, Human
ggauugguggcuccauggggu

SEQ ID NO: 1289025 - RNA, 19 nt, Human
ggcccaggggcucaaggug

SEQ ID NO: 1289026 - RNA, 18 nt, Human
gggagcagagggaggcca

SEQ ID NO: 1289027 - RNA, 21 nt, Human
gggcagggcaccugugccugc

SEQ ID NO: 1289028 - RNA, 22 nt, Human
ggggcagcugcagaaagcccug

SEQ ID NO: 1289029 - RNA, 21 nt, Human
ggggccgggcccaggggcuca

SEQ ID NO: 1289030 - RNA, 21 nt, Human
ggugugcccgggcccagagcc

SEQ ID NO: 1289031 - RNA, 23 nt, Human
gugcagagcuggggagcagaggg

SEQ ID NO: 1289032 - RNA, 19 nt, Human
ucagcccguggaagccgcc

SEQ ID NO: 1289033 - RNA, 19 nt, Human
ucagugccacgacugagga

SEQ ID NO: 1289034 - RNA, 21 nt, Human
uccaggcccaguuugaggaug

SEQ ID NO: 1289035 - RNA, 25 nt, Human
ucugcccaggaugacucccgcaucc

SEQ ID NO: 1289036 - RNA, 21 nt, Human
ugaaggcccuccaggcccagu

SEQ ID NO: 1289037 - RNA, 21 nt, Human
ugagcgaggcagagugcaggu

SEQ ID NO: 1289038 - RNA, 22 nt, Human
ugaggaugccaucacagcccau

SEQ ID NO: 1289039 - RNA, 24 nt, Human
ugaggaugccaucacagccgggac

SEQ ID NO: 1289040 - RNA, 18 nt, Human
uggcacagcccucacagc

SEQ ID NO: 1289041 - RNA, 22 nt, Human
uggcuccauggggugagcaaag

SEQ ID NO: 1289042 - RNA, 19 nt, Human
ugggcagggcaccugugcc

SEQ ID NO: 1289043 - RNA, 18 nt, Human
uggggagcagagggaggc

SEQ ID NO: 1289044 - RNA, 22 nt, Human
uggggcagcugggcaggauggc

SEQ ID NO: 1289045 - RNA, 19 nt, Human
uggggguccagagaggccg

SEQ ID NO: 1289046 - RNA, 20 nt, Human
uugggcagggcaccugugcc

SEQ ID NO: 1289047 - RNA, 21 nt, Human
uugggcagggcaccugugccu

SEQ ID NO: 1289048 - RNA, 21 nt, Human
aagauucucuuuagccugaaa

SEQ ID NO: 1289049 - RNA, 22 nt, Human
aggggaaaauauuaaaugaccc

SEQ ID NO: 1289050 - RNA, 19 nt, Human
cagaauucccaacaggccc

SEQ ID NO: 1289051 - RNA, 19 nt, Human
gcagaauucccaacaggcc

SEQ ID NO: 1289052 - RNA, 24 nt, Human
uagccugaaauuaugguccguacc

SEQ ID NO: 1289053 - RNA, 23 nt, Human
ucacccugagcagaauucccaac

SEQ ID NO: 1289054 - RNA, 24 nt, Human
ugaccccuuaagauucucuuuagc

SEQ ID NO: 1289055 - RNA, 19 nt, Human
uggcucagguccuuauggu

SEQ ID NO: 1289056 - RNA, 20 nt, Human
uggcucagguccuuaugguu

SEQ ID NO: 1289057 - RNA, 19 nt, Human
ugggauggagcacuggcuc

SEQ ID NO: 1289058 - RNA, 24 nt, Human
uuaaaugaccccuuaagauucucu

SEQ ID NO: 1289059 - RNA, 22 nt, Human
aaaacagcagcgauuuuuaaag

SEQ ID NO: 1289060 - RNA, 23 nt, Human
aaaacagcagcgauuuuuaaagu

SEQ ID NO: 1289061 - RNA, 23 nt, Human
aacugggucuccaccuucacgau

SEQ ID NO: 1289062 - RNA, 18 nt, Human
aagaaaacaggaaggcgu

SEQ ID NO: 1289063 - RNA, 22 nt, Human
acaguaucaacauuagaaugaa

SEQ ID NO: 1289064 - RNA, 21 nt, Human
accgcucacugaagccucgac

SEQ ID NO: 1289065 - RNA, 19 nt, Human
acuacaggugcgugccacc

SEQ ID NO: 1289066 - RNA, 21 nt, Human
agaggggaaagcagggucuug

SEQ ID NO: 1289067 - RNA, 22 nt, Human
agccucgaccuccuagacuuag

SEQ ID NO: 1289068 - RNA, 18 nt, Human
aggacaagaggggaaagc

SEQ ID NO: 1289069 - RNA, 19 nt, Human
aggcuggagugcaguggca

SEQ ID NO: 1289070 - RNA, 18 nt, Human
aguagcugggacuacagg

SEQ ID NO: 1289071 - RNA, 23 nt, Human
aguccuuugcuuuauuuugaagg

SEQ ID NO: 1289072 - RNA, 24 nt, Human
aucauucacacauccucccacagu

SEQ ID NO: 1289073 - RNA, 23 nt, Human
auuacaggggaauacacagcagc

SEQ ID NO: 1289074 - RNA, 18 nt, Human
auuuggguuguccucccc

SEQ ID NO: 1289075 - RNA, 20 nt, Human
cacaguaucaacauuagaau

SEQ ID NO: 1289076 - RNA, 24 nt, Human
cacaguaucaacauuagaaugaag

SEQ ID NO: 1289077 - RNA, 27 nt, Human
cacccucgccgcuccgcuggccgggaa

SEQ ID NO: 1289078 - RNA, 21 nt, Human
caccgcacuaauuuuuuuccu

SEQ ID NO: 1289079 - RNA, 22 nt, Human
cacuaauuuuuuuccuuuuuuu

SEQ ID NO: 1289080 - RNA, 23 nt, Human
cacugccacaaaaaaaugaggga

SEQ ID NO: 1289081 - RNA, 22 nt, Human
cagcaaaguggucaaacauaug

SEQ ID NO: 1289082 - RNA, 19 nt, Human
caggauuuaaggguccuuc

SEQ ID NO: 1289083 - RNA, 24 nt, Human
cagggucuugcucugucgcccagg

SEQ ID NO: 1289084 - RNA, 21 nt, Human
caucauucacacauccuccca

SEQ ID NO: 1289085 - RNA, 18 nt, Human
cauucaauuuccucugca

SEQ ID NO: 1289086 - RNA, 23 nt, Human
ccaaagcaucggcaauauuguac

SEQ ID NO: 1289087 - RNA, 19 nt, Human
ccacaaaaaaaugagggaa

SEQ ID NO: 1289088 - RNA, 21 nt, Human
cccacaguuuccagcaagcuu

SEQ ID NO: 1289089 - RNA, 24 nt, Human
ccccaaaaguaggaaggcaugcac

SEQ ID NO: 1289090 - RNA, 23 nt, Human
cccgaguagcugggacuacaggu

SEQ ID NO: 1289091 - RNA, 24 nt, Human
cccgaguagcugggacuacaggug

SEQ ID NO: 1289092 - RNA, 23 nt, Human
ccgcuucagccucccgaguagcu

SEQ ID NO: 1289093 - RNA, 24 nt, Human
ccucccgcuucagccucccgagua

SEQ ID NO: 1289094 - RNA, 23 nt, Human
ccugacccaagggcugaagaaag

SEQ ID NO: 1289095 - RNA, 21 nt, Human
ccugguugcagagggccuucc

SEQ ID NO: 1289096 - RNA, 20 nt, Human
ccuucucuuucuucaagucc

SEQ ID NO: 1289097 - RNA, 22 nt, Human
cgccuagagccugguuuuggag

SEQ ID NO: 1289098 - RNA, 24 nt, Human
cgcuucagccucccgaguagcugg

SEQ ID NO: 1289099 - RNA, 19 nt, Human
cuccaguugcuuggaauac

SEQ ID NO: 1289100 - RNA, 20 nt, Human
cugaagccucgaccuccuag

SEQ ID NO: 1289101 - RNA, 21 nt, Human
cugaggcacugccacaaaaaa

SEQ ID NO: 1289102 - RNA, 23 nt, Human
cugcagucguccccgccuagagc

SEQ ID NO: 1289103 - RNA, 22 nt, Human
cugguuuuggagccucgaggac

SEQ ID NO: 1289104 - RNA, 25 nt, Human
cuucagccucccgaguagcugggac

SEQ ID NO: 1289105 - RNA, 24 nt, Human
cuuccuucucuuucuucaaguccu

SEQ ID NO: 1289106 - RNA, 21 nt, Human
cuugcucugucgcccaggcug

SEQ ID NO: 1289107 - RNA, 18 nt, Human
cuuuuugguagagacggg

SEQ ID NO: 1289108 - RNA, 21 nt, Human
cuuuuuuuuuuuuuuucuuuu

SEQ ID NO: 1289109 - RNA, 22 nt, Human
gaaagcagggucuugcucuguc

SEQ ID NO: 1289110 - RNA, 22 nt, Human
gacccucccgcuucagccuccc

SEQ ID NO: 1289111 - RNA, 21 nt, Human
gaugggcgaccaacucuccac

SEQ ID NO: 1289112 - RNA, 19 nt, Human
gcccaggcuggagugcagu

SEQ ID NO: 1289113 - RNA, 23 nt, Human
gcccaggcuggagugcaguggca

SEQ ID NO: 1289114 - RNA, 25 nt, Human
gcucugucgcccaggcuggagugca

SEQ ID NO: 1289115 - RNA, 19 nt, Human
gcuggagugcaguggcaca

SEQ ID NO: 1289116 - RNA, 28 nt, Human
ggaaauaugcaucauucacacauccucc

SEQ ID NO: 1289117 - RNA, 21 nt, Human
ggacaagaggggaaagcaggg

SEQ ID NO: 1289118 - RNA, 19 nt, Human
ggagaaacacaguaucaac

SEQ ID NO: 1289119 - RNA, 23 nt, Human
gggaauuuggcaaggcuuugccc

SEQ ID NO: 1289120 - RNA, 26 nt, Human
guaaacacguaagccuacuggccucc

SEQ ID NO: 1289121 - RNA, 19 nt, Human
uaaaguucucaaaccaucc

SEQ ID NO: 1289122 - RNA, 19 nt, Human
uacacagcagcuuagagca

SEQ ID NO: 1289123 - RNA, 20 nt, Human
uacaggggaauacacagcag

SEQ ID NO: 1289124 - RNA, 24 nt, Human
uaucacccaucaccucuuuuauca

SEQ ID NO: 1289125 - RNA, 25 nt, Human
uauguucaaaugcuucaguuauacc

SEQ ID NO: 1289126 - RNA, 27 nt, Human
ucaccuaaaugacauccucuucuucau

SEQ ID NO: 1289127 - RNA, 23 nt, Human
ucagccucccgaguagcugggac

SEQ ID NO: 1289128 - RNA, 23 nt, Human
ucccgaguagcugggacuacagg

SEQ ID NO: 1289129 - RNA, 23 nt, Human
uccuccccagauguuucccauug

SEQ ID NO: 1289130 - RNA, 19 nt, Human
uccucuaagcuuuccagau

SEQ ID NO: 1289131 - RNA, 22 nt, Human
ucgcccaggcuggagugcagug

SEQ ID NO: 1289132 - RNA, 21 nt, Human
ucuguccacaguuagcaacau

SEQ ID NO: 1289133 - RNA, 24 nt, Human
ucugucgcccaggcuggagugcag

SEQ ID NO: 1289134 - RNA, 20 nt, Human
ucuuccuucucuuucuuccc

SEQ ID NO: 1289135 - RNA, 22 nt, Human
ucuugcucugucgcccaggcug

SEQ ID NO: 1289136 - RNA, 23 nt, Human
ucuugcucugucgcccaggcugg

SEQ ID NO: 1289137 - RNA, 24 nt, Human
ucuugcucugucgcccaggcugga

SEQ ID NO: 1289138 - RNA, 18 nt, Human
ucuuuuuuugucucucug

SEQ ID NO: 1289139 - RNA, 18 nt, Human
ugagggaaauccuguccu

SEQ ID NO: 1289140 - RNA, 22 nt, Human
ugagggaaauccuguccuuagc

SEQ ID NO: 1289141 - RNA, 19 nt, Human
ugaguccccacccucgccg

SEQ ID NO: 1289142 - RNA, 22 nt, Human
ugauucugggugugauuacaag

SEQ ID NO: 1289143 - RNA, 18 nt, Human
ugcaaagacuucuuccug

SEQ ID NO: 1289144 - RNA, 20 nt, Human
ugcaaagacuucuuccuguu

SEQ ID NO: 1289145 - RNA, 23 nt, Human
ugcaucauucacacauccuccca

SEQ ID NO: 1289146 - RNA, 22 nt, Human
ugcgugccaccacaccgcacua

SEQ ID NO: 1289147 - RNA, 23 nt, Human
ugcgugccaccacaccgcacuaa

SEQ ID NO: 1289148 - RNA, 24 nt, Human
ugcucugucgcccaggcuggagug

SEQ ID NO: 1289149 - RNA, 22 nt, Human
uggagccucgaggacgccgacg

SEQ ID NO: 1289150 - RNA, 18 nt, Human
uggagugcaguggcacaa

SEQ ID NO: 1289151 - RNA, 19 nt, Human
uggagugcaguggcacaau

SEQ ID NO: 1289152 - RNA, 21 nt, Human
uggagugcaguggcacaauca

SEQ ID NO: 1289153 - RNA, 21 nt, Human
uggcaaggcuuugcccuacgc

SEQ ID NO: 1289154 - RNA, 21 nt, Human
ugggacuacaggugcgugcca

SEQ ID NO: 1289155 - RNA, 22 nt, Human
ugggacuacaggugcgugccac

SEQ ID NO: 1289156 - RNA, 24 nt, Human
ugggacuacaggugcgugccacca

SEQ ID NO: 1289157 - RNA, 18 nt, Human
ugguagagacggguuucu

SEQ ID NO: 1289158 - RNA, 23 nt, Human
uguccuuagcuuccucuaagcuu

SEQ ID NO: 1289159 - RNA, 23 nt, Human
uguuagagucuuuguaaagcagc

SEQ ID NO: 1289160 - RNA, 22 nt, Human
uuaucauuuugucaccugaggc

SEQ ID NO: 1289161 - RNA, 21 nt, Human
uuccugagggagaaacacagu

SEQ ID NO: 1289162 - RNA, 18 nt, Human
uuccugaggguaguggag

SEQ ID NO: 1289163 - RNA, 24 nt, Human
uugcaaaacagcagcgauuuuuaa

SEQ ID NO: 1289164 - RNA, 24 nt, Human
uugccccaaaaguaggaaggcaug

SEQ ID NO: 1289165 - RNA, 24 nt, Human
uugcucugucgcccaggcuggagu

SEQ ID NO: 1289166 - RNA, 24 nt, Human
uugguucccuguagauguauuugg

SEQ ID NO: 1289167 - RNA, 22 nt, Human
uuuaaaguucucaaaccauccc

SEQ ID NO: 1289168 - RNA, 20 nt, Human
uuuggccugguugcagaggg

SEQ ID NO: 1289169 - RNA, 24 nt, Human
uuuuuuuucuuuuugguagagacg

SEQ ID NO: 1289170 - RNA, 18 nt, Human
uuuuuuuuuuucuuuuug

SEQ ID NO: 1289171 - RNA, 18 nt, Human
uuuuuuuuuuucuuuuug

SEQ ID NO: 1289172 - RNA, 23 nt, Human
uuuuuuuuuuuucuuuuugguag

SEQ ID NO: 1289173 - RNA, 19 nt, Human
acagugcugggacagccac

SEQ ID NO: 1289174 - RNA, 21 nt, Human
acucagucuccucaucuguaa

SEQ ID NO: 1289175 - RNA, 20 nt, Human
agagagggaggaaagaagga

SEQ ID NO: 1289176 - RNA, 18 nt, Human
aggaaagaaggaggcaag

SEQ ID NO: 1289177 - RNA, 19 nt, Human
aggacaaagcccagagaga

SEQ ID NO: 1289178 - RNA, 25 nt, Human
auaccaaaguccuccccacuuacca

SEQ ID NO: 1289179 - RNA, 18 nt, Human
cacagguucaccgcaugu

SEQ ID NO: 1289180 - RNA, 21 nt, Human
caccugauaccaaaguccucc

SEQ ID NO: 1289181 - RNA, 20 nt, Human
ccagagagagggaggaaaga

SEQ ID NO: 1289182 - RNA, 21 nt, Human
ccagcuggccucagccuauca

SEQ ID NO: 1289183 - RNA, 22 nt, Human
ccccacuuaccacccucucccu

SEQ ID NO: 1289184 - RNA, 20 nt, Human
ccccagcuauccacaccugg

SEQ ID NO: 1289185 - RNA, 20 nt, Human
cccuuuccuuuccggauguc

SEQ ID NO: 1289186 - RNA, 20 nt, Human
ccucaucuguaaaauggggu

SEQ ID NO: 1289187 - RNA, 21 nt, Human
ccugauaccaaaguccucccc

SEQ ID NO: 1289188 - RNA, 20 nt, Human
cgcagguuuguccagcugcu

SEQ ID NO: 1289189 - RNA, 23 nt, Human
cuauccacaccugauaccaaagu

SEQ ID NO: 1289190 - RNA, 22 nt, Human
cuccccacuuaccacccucucc

SEQ ID NO: 1289191 - RNA, 21 nt, Human
cugacugcccuuuccuuuccg

SEQ ID NO: 1289192 - RNA, 25 nt, Human
cugcccuuuccuuuccggaugucuc

SEQ ID NO: 1289193 - RNA, 21 nt, Human
gagccucaguuuuccccucug

SEQ ID NO: 1289194 - RNA, 23 nt, Human
ggaugucucaggacaaagcccag

SEQ ID NO: 1289195 - RNA, 25 nt, Human
gugacuugccuucuuugagccucag

SEQ ID NO: 1289196 - RNA, 20 nt, Human
ucucccuguggcugcugucu

SEQ ID NO: 1289197 - RNA, 22 nt, Human
ucuugggacucagucuccucau

SEQ ID NO: 1289198 - RNA, 21 nt, Human
ugacauccucugucgcagguu

SEQ ID NO: 1289199 - RNA, 20 nt, Human
ugagccucaguuuuccccuc

SEQ ID NO: 1289200 - RNA, 25 nt, Human
ugcccuuuccuuuccggaugucuca

SEQ ID NO: 1289201 - RNA, 21 nt, Human
uggcugcugucugacugcccu

SEQ ID NO: 1289202 - RNA, 20 nt, Human
uguaaaaugggguuaaugaa

SEQ ID NO: 1289203 - RNA, 21 nt, Human
cugggcccucuuccccucaga

SEQ ID NO: 1289204 - RNA, 23 nt, Human
agcccaguucccagggugugccu

SEQ ID NO: 1289205 - RNA, 21 nt, Human
cacggaagucaccugcugcac

SEQ ID NO: 1289206 - RNA, 24 nt, Human
cuccagcaacagcccaguucccag

SEQ ID NO: 1289207 - RNA, 23 nt, Human
cugcugcacugguuugccaacug

SEQ ID NO: 1289208 - RNA, 23 nt, Human
gcacagcagugucggcuccagca

SEQ ID NO: 1289209 - RNA, 22 nt, Human
gcuucacggaagucaccugcug

SEQ ID NO: 1289210 - RNA, 23 nt, Human
ucccagggugugccucuggcuuc

SEQ ID NO: 1289211 - RNA, 24 nt, Human
uggcuucacggaagucaccugcug

SEQ ID NO: 1289212 - RNA, 23 nt, Human
uucccagggugugccucuggcuu

SEQ ID NO: 1289213 - RNA, 22 nt, Human
aaagagccacugccucugcccc

SEQ ID NO: 1289214 - RNA, 20 nt, Human
acauagcaccuuuuccuucu

SEQ ID NO: 1289215 - RNA, 21 nt, Human
acucagugguguccagggcuc

SEQ ID NO: 1289216 - RNA, 18 nt, Human
agagccacugccucugcc

SEQ ID NO: 1289217 - RNA, 18 nt, Human
aucacagcuccuguggca

SEQ ID NO: 1289218 - RNA, 19 nt, Human
cacagccacaccugaguga

SEQ ID NO: 1289219 - RNA, 23 nt, Human
caccugagugaagccuucagaac

SEQ ID NO: 1289220 - RNA, 21 nt, Human
cagaacacaaagaucacagcc

SEQ ID NO: 1289221 - RNA, 21 nt, Human
ccagggcucccugcacuuccu

SEQ ID NO: 1289222 - RNA, 19 nt, Human
cccuggggaggucuggccu

SEQ ID NO: 1289223 - RNA, 24 nt, Human
ccucugcccccucagucacagcca

SEQ ID NO: 1289224 - RNA, 21 nt, Human
ccuucagaacacaaagaucac

SEQ ID NO: 1289225 - RNA, 29 nt, Human
cugaggcagaggccuagaagggauuucau

SEQ ID NO: 1289226 - RNA, 20 nt, Human
cugcccccucagucacagcc

SEQ ID NO: 1289227 - RNA, 18 nt, Human
gccacaccugagugaagc

SEQ ID NO: 1289228 - RNA, 25 nt, Human
guccagggcucccugcacuuccuuc

SEQ ID NO: 1289229 - RNA, 25 nt, Human
uaaagagccacugccucugcccccu

SEQ ID NO: 1289230 - RNA, 19 nt, Human
ucagaacacaaagaucaca

SEQ ID NO: 1289231 - RNA, 22 nt, Human
ucagugguguccagggcucccu

SEQ ID NO: 1289232 - RNA, 21 nt, Human
ucccuggggaggucuggccuu

SEQ ID NO: 1289233 - RNA, 20 nt, Human
ugaggcagaggccuagaagg

SEQ ID NO: 1289234 - RNA, 23 nt, Human
ugaggcagaggccuagaagggau

SEQ ID NO: 1289235 - RNA, 20 nt, Human
uguccagggcucccugcacu

SEQ ID NO: 1289236 - RNA, 21 nt, Human
aaaggauaccgagaagccagu

SEQ ID NO: 1289237 - RNA, 26 nt, Human
aacacacacacacacaugcacaccca

SEQ ID NO: 1289238 - RNA, 18 nt, Human
aagcgcgcuccaaagaca

SEQ ID NO: 1289239 - RNA, 25 nt, Human
acacacacacaugcacacccacacc

SEQ ID NO: 1289240 - RNA, 26 nt, Human
acccaccucucccauaaacacacaca

SEQ ID NO: 1289241 - RNA, 21 nt, Human
accccacgauaaacaaaaucg

SEQ ID NO: 1289242 - RNA, 24 nt, Human
accuaaagucucccagccucucca

SEQ ID NO: 1289243 - RNA, 21 nt, Human
acugcagguuuccagggucag

SEQ ID NO: 1289244 - RNA, 21 nt, Human
aggcacggauacgcuucugag

SEQ ID NO: 1289245 - RNA, 20 nt, Human
aguaaauaccaacccaugcu

SEQ ID NO: 1289246 - RNA, 19 nt, Human
agucgucgggcagcgucac

SEQ ID NO: 1289247 - RNA, 18 nt, Human
aguucauuggccguaccc

SEQ ID NO: 1289248 - RNA, 22 nt, Human
caaaaucgauuaguaaauacca

SEQ ID NO: 1289249 - RNA, 22 nt, Human
caaagacaccgugcccggcgca

SEQ ID NO: 1289250 - RNA, 23 nt, Human
caagcacugcgcgcgggggccgg

SEQ ID NO: 1289251 - RNA, 23 nt, Human
cacacacacacacaugcacaccc

SEQ ID NO: 1289252 - RNA, 23 nt, Human
cacacacaugcacacccacaccc

SEQ ID NO: 1289253 - RNA, 25 nt, Human
cacacacaugcacacccacacccac

SEQ ID NO: 1289254 - RNA, 31 nt, Human
cacacacaugcacacccacacccacgcgcgg

SEQ ID NO: 1289255 - RNA, 21 nt, Human
cacacacgcacgcacacaccc

SEQ ID NO: 1289256 - RNA, 18 nt, Human
cacacgcacgcacacacc

SEQ ID NO: 1289257 - RNA, 18 nt, Human
cacacuccugcccacgcc

SEQ ID NO: 1289258 - RNA, 19 nt, Human
cacagccuugcaagcaaaa

SEQ ID NO: 1289259 - RNA, 23 nt, Human
cacagccuugcaagcaaaaguuu

SEQ ID NO: 1289260 - RNA, 22 nt, Human
cacccacacccacgcgcgcccg

SEQ ID NO: 1289261 - RNA, 23 nt, Human
caccucucccauaaacacacaca

SEQ ID NO: 1289262 - RNA, 19 nt, Human
cacgcacacacccaccucu

SEQ ID NO: 1289263 - RNA, 22 nt, Human
cacgcacgcacacacccaccuc

SEQ ID NO: 1289264 - RNA, 19 nt, Human
cacgcccacgcagcgcucc

SEQ ID NO: 1289265 - RNA, 19 nt, Human
cagccucuccaccaccccg

SEQ ID NO: 1289266 - RNA, 22 nt, Human
ccacacccacgcgcgcccgcac

SEQ ID NO: 1289267 - RNA, 21 nt, Human
ccacgcccacgcagcgcuccg

SEQ ID NO: 1289268 - RNA, 22 nt, Human
ccacgcgcacacacuccugccc

SEQ ID NO: 1289269 - RNA, 23 nt, Human
cccacgcgcacacacuccugccc

SEQ ID NO: 1289270 - RNA, 25 nt, Human
cccacgcgcacacacuccugcccac

SEQ ID NO: 1289271 - RNA, 21 nt, Human
cccacgcgcgcccgcaccgcc

SEQ ID NO: 1289272 - RNA, 22 nt, Human
ccccacgcgcacacacuccugc

SEQ ID NO: 1289273 - RNA, 22 nt, Human
ccccagcuccuucgcugggcac

SEQ ID NO: 1289274 - RNA, 19 nt, Human
ccccggagaggauacucgg

SEQ ID NO: 1289275 - RNA, 21 nt, Human
cccggcgcugcugccucggcc

SEQ ID NO: 1289276 - RNA, 21 nt, Human
ccgccgaaggagaggggugga

SEQ ID NO: 1289277 - RNA, 22 nt, Human
ccucccgcacagccuugcaagc

SEQ ID NO: 1289278 - RNA, 21 nt, Human
ccucccguaggcuccgcugua

SEQ ID NO: 1289279 - RNA, 24 nt, Human
ccucucccauaaacacacacacaa

SEQ ID NO: 1289280 - RNA, 24 nt, Human
ccucuugagccuuggaacaggagu

SEQ ID NO: 1289281 - RNA, 18 nt, Human
ccugggugggauguaagg

SEQ ID NO: 1289282 - RNA, 23 nt, Human
cgaaggagagggguggaguucau

SEQ ID NO: 1289283 - RNA, 22 nt, Human
cgagaagccacccgcggagagc

SEQ ID NO: 1289284 - RNA, 22 nt, Human
cgagagcaccacgagggggagc

SEQ ID NO: 1289285 - RNA, 18 nt, Human
cgcaccgccccacgcgca

SEQ ID NO: 1289286 - RNA, 19 nt, Human
cgcagcgcuccgggaaguc

SEQ ID NO: 1289287 - RNA, 26 nt, Human
cgcccgcaccgccccacgcgcacaca

SEQ ID NO: 1289288 - RNA, 22 nt, Human
cgcgcacacacuccugcccacg

SEQ ID NO: 1289289 - RNA, 29 nt, Human
cgcgcgcccgcaccgccccacgcgcacag

SEQ ID NO: 1289290 - RNA, 21 nt, Human
cggcgcccugggacgcggcgc

SEQ ID NO: 1289291 - RNA, 20 nt, Human
cggcgcucucccggcgcugc

SEQ ID NO: 1289292 - RNA, 23 nt, Human
cguucucccucgcccucucucuc

SEQ ID NO: 1289293 - RNA, 21 nt, Human
cuagcgccuuccgagcccucc

SEQ ID NO: 1289294 - RNA, 24 nt, Human
cucacacacgcacgcacacaccca

SEQ ID NO: 1289295 - RNA, 19 nt, Human
cuccaaagacaccgugccc

SEQ ID NO: 1289296 - RNA, 22 nt, Human
cucccagccucuccaccacccc

SEQ ID NO: 1289297 - RNA, 33 nt, Human
cucccauaaacacacacacacacaugcacagug

SEQ ID NO: 1289298 - RNA, 19 nt, Human
cucuaaacaggguaggcag

SEQ ID NO: 1289299 - RNA, 20 nt, Human
cucuugagccuuggaacagg

SEQ ID NO: 1289300 - RNA, 22 nt, Human
gagaagcucugccgugguaucc

SEQ ID NO: 1289301 - RNA, 19 nt, Human
gagagagcugauggugggg

SEQ ID NO: 1289302 - RNA, 18 nt, Human
gaucccgcucccucccgc

SEQ ID NO: 1289303 - RNA, 19 nt, Human
gcacggauacgcuucugag

SEQ ID NO: 1289304 - RNA, 23 nt, Human
gccuuggaacaggagugggcugg

SEQ ID NO: 1289305 - RNA, 20 nt, Human
gcgccaccuccuuuucucca

SEQ ID NO: 1289306 - RNA, 24 nt, Human
ggaaagcgcgcuccaaagacaccg

SEQ ID NO: 1289307 - RNA, 22 nt, Human
ggacaggagguguuaggggugg

SEQ ID NO: 1289308 - RNA, 20 nt, Human
ggagaagcucugccguggua

SEQ ID NO: 1289309 - RNA, 21 nt, Human
ggcacgaggccuccccagcuc

SEQ ID NO: 1289310 - RNA, 18 nt, Human
ggucucggccugcgggcc

SEQ ID NO: 1289311 - RNA, 21 nt, Human
gguguuagggguggggagaga

SEQ ID NO: 1289312 - RNA, 20 nt, Human
gugguccgggcgccugcggg

SEQ ID NO: 1289313 - RNA, 25 nt, Human
guucucccucgcccucucucucuca

SEQ ID NO: 1289314 - RNA, 23 nt, Human
uaaagcggauccaguccugggug

SEQ ID NO: 1289315 - RNA, 21 nt, Human
uaagggcacgaggccucccca

SEQ ID NO: 1289316 - RNA, 19 nt, Human
uagcgccuuccgagcccuc

SEQ ID NO: 1289317 - RNA, 20 nt, Human
uagggguggggagagagcug

SEQ ID NO: 1289318 - RNA, 21 nt, Human
ucccagccucuccaccacccc

SEQ ID NO: 1289319 - RNA, 19 nt, Human
uccccagcuccuucgcugg

SEQ ID NO: 1289320 - RNA, 21 nt, Human
ucccucgcccucucucucuca

SEQ ID NO: 1289321 - RNA, 18 nt, Human
uccgagagcaccacgagg

SEQ ID NO: 1289322 - RNA, 20 nt, Human
uccuagcgccuuccgagccc

SEQ ID NO: 1289323 - RNA, 20 nt, Human
uccugcccacgcccacgcag

SEQ ID NO: 1289324 - RNA, 22 nt, Human
uccuugauuggacaggaggugu

SEQ ID NO: 1289325 - RNA, 23 nt, Human
ucucacacacgcacgcacacacc

SEQ ID NO: 1289326 - RNA, 18 nt, Human
ucucccagccucuccacc

SEQ ID NO: 1289327 - RNA, 18 nt, Human
ucucccagccucuccacc

SEQ ID NO: 1289328 - RNA, 19 nt, Human
ucucccagccucuccacca

SEQ ID NO: 1289329 - RNA, 20 nt, Human
ucucccagccucuccaccaa

SEQ ID NO: 1289330 - RNA, 20 nt, Human
ucucccaggcucguucuccc

SEQ ID NO: 1289331 - RNA, 23 nt, Human
ucucccggcgcugcugccucggc

SEQ ID NO: 1289332 - RNA, 19 nt, Human
ucucggccugcgggccguc

SEQ ID NO: 1289333 - RNA, 23 nt, Human
ucuggaggagaggcacgggugcg

SEQ ID NO: 1289334 - RNA, 24 nt, Human
ugauggugggggaucccgcucccu

SEQ ID NO: 1289335 - RNA, 21 nt, Human
uggaacaggagugggcugggg

SEQ ID NO: 1289336 - RNA, 23 nt, Human
ugggaaagcgcgcuccaaagaca

SEQ ID NO: 1289337 - RNA, 19 nt, Human
uggucgguccuaccuaaag

SEQ ID NO: 1289338 - RNA, 23 nt, Human
uucauuggccguacccuugggga

SEQ ID NO: 1289339 - RNA, 22 nt, Human
uugcucuaaacaggguaggcag

SEQ ID NO: 1289340 - RNA, 19 nt, Human
aaaaaagccauaaauacua

SEQ ID NO: 1289341 - RNA, 24 nt, Human
aaagccauaaauacuacuuaaaau

SEQ ID NO: 1289342 - RNA, 21 nt, Human
accccacugaccacugaauug

SEQ ID NO: 1289343 - RNA, 28 nt, Human
auauucuucaggaaauuacuuuccauug

SEQ ID NO: 1289344 - RNA, 20 nt, Human
cagggguaggcaugggcauc

SEQ ID NO: 1289345 - RNA, 18 nt, Human
cauuuuuaucaccuugua

SEQ ID NO: 1289346 - RNA, 22 nt, Human
ccuugcuuuugaccccuccucu

SEQ ID NO: 1289347 - RNA, 21 nt, Human
cuuuacucuccuuuucacagu

SEQ ID NO: 1289348 - RNA, 21 nt, Human
gaccccuccucuuuacucucc

SEQ ID NO: 1289349 - RNA, 19 nt, Human
gcuuuugaccccuccucuu

SEQ ID NO: 1289350 - RNA, 22 nt, Human
ucccaccccacugaccacugaa

SEQ ID NO: 1289351 - RNA, 21 nt, Human
ucgaucccagggguaggcaug

SEQ ID NO: 1289352 - RNA, 18 nt, Human
ugggcaucuuucccuccu

SEQ ID NO: 1289353 - RNA, 24 nt, Human
uguguuuccauuuuuaucaccuug

SEQ ID NO: 1289354 - RNA, 18 nt, Human
uugccggggucuuguguu

SEQ ID NO: 1289355 - RNA, 24 nt, Human
uuguucccaccccacugaccacug

SEQ ID NO: 1289356 - RNA, 23 nt, Human
cuaaguguguauaaaauaccagc

SEQ ID NO: 1289357 - RNA, 23 nt, Human
agcugcagagaggugcagagaca

SEQ ID NO: 1289358 - RNA, 18 nt, Human
aggcagaggcgcagcugg

SEQ ID NO: 1289359 - RNA, 22 nt, Human
caguggagaugaggcccugaug

SEQ ID NO: 1289360 - RNA, 22 nt, Human
ggaugaugaaauagaugaugag

SEQ ID NO: 1289361 - RNA, 21 nt, Human
ggggagguggagauggagaca

SEQ ID NO: 1289362 - RNA, 19 nt, Human
ggugcagagacaguggaga

SEQ ID NO: 1289363 - RNA, 20 nt, Human
guggagaugaggcccugaug

SEQ ID NO: 1289364 - RNA, 21 nt, Human
ucagggccgcauccaaagagg

SEQ ID NO: 1289365 - RNA, 18 nt, Human
agaaggcaccuccuaggc

SEQ ID NO: 1289366 - RNA, 19 nt, Human
agaaggugcacccaguccc

SEQ ID NO: 1289367 - RNA, 19 nt, Human
cagcagagaaggcaccucc

SEQ ID NO: 1289368 - RNA, 21 nt, Human
ccuguccugcaggacugggaa

SEQ ID NO: 1289369 - RNA, 22 nt, Human
gagcagagaaugcagcagagaa

SEQ ID NO: 1289370 - RNA, 19 nt, Human
ggcucaggcgcggugggga

SEQ ID NO: 1289371 - RNA, 22 nt, Human
ucagccccgggaucuuccagga

SEQ ID NO: 1289372 - RNA, 18 nt, Human
ucccugguggaggguggc

SEQ ID NO: 1289373 - RNA, 21 nt, Human
uccgguuccuguccugcagga

SEQ ID NO: 1289374 - RNA, 26 nt, Human
ugagcagagaaugcagcagagaaggc

SEQ ID NO: 1289375 - RNA, 21 nt, Human
uggccagaagcccccgggggc

SEQ ID NO: 1289376 - RNA, 19 nt, Human
uguccugcaggacugggaa

SEQ ID NO: 1289377 - RNA, 23 nt, Human
cccacccgcaguggccuugcggg

SEQ ID NO: 1289378 - RNA, 23 nt, Human
ccugcccacccgcaguggccuug

SEQ ID NO: 1289379 - RNA, 20 nt, Human
gcaguggccuugcggggugu

SEQ ID NO: 1289380 - RNA, 19 nt, Human
ggcagaaacgucaggucca

SEQ ID NO: 1289381 - RNA, 21 nt, Human
ucagguccaggaacugaggag

SEQ ID NO: 1289382 - RNA, 27 nt, Human
uccugcccacccgcaguggccuugcgg

SEQ ID NO: 1289383 - RNA, 22 nt, Human
aacacaagcucaaucagaccua

SEQ ID NO: 1289384 - RNA, 25 nt, Human
acaacacaagcucaaucagaccuac

SEQ ID NO: 1289385 - RNA, 22 nt, Human
accccacacccagcuccuccag

SEQ ID NO: 1289386 - RNA, 23 nt, Human
auaaaaaucugacccaggccccc

SEQ ID NO: 1289387 - RNA, 21 nt, Human
caccacaccaucccggaacaa

SEQ ID NO: 1289388 - RNA, 19 nt, Human
caccccacacccagcuccu

SEQ ID NO: 1289389 - RNA, 21 nt, Human
cagcccaacgcaccccacacc

SEQ ID NO: 1289390 - RNA, 24 nt, Human
cagcccaacgcaccccacacccag

SEQ ID NO: 1289391 - RNA, 20 nt, Human
caggccccccauuucuuucc

SEQ ID NO: 1289392 - RNA, 23 nt, Human
cagggacucucuccccuagaccc

SEQ ID NO: 1289393 - RNA, 21 nt, Human
cauccccucuuccaccacacc

SEQ ID NO: 1289394 - RNA, 23 nt, Human
ccaccacaccaucccggaacaag

SEQ ID NO: 1289395 - RNA, 21 nt, Human
ccaggccccccauuucuuucc

SEQ ID NO: 1289396 - RNA, 21 nt, Human
cccaaacuaggccuccccacc

SEQ ID NO: 1289397 - RNA, 22 nt, Human
cccaacgcaccccacacccagc

SEQ ID NO: 1289398 - RNA, 22 nt, Human
cccaccccacaauaaaaaucug

SEQ ID NO: 1289399 - RNA, 22 nt, Human
ccccacacccagcuccuccagc

SEQ ID NO: 1289400 - RNA, 19 nt, Human
cccccauuucuuucccuca

SEQ ID NO: 1289401 - RNA, 22 nt, Human
ccccucuuccaccacaccaucc

SEQ ID NO: 1289402 - RNA, 23 nt, Human
cucaucccaccccacaauaaaaa

SEQ ID NO: 1289403 - RNA, 23 nt, Human
cucccgggcuggaucagagagcc

SEQ ID NO: 1289404 - RNA, 19 nt, Human
cuccuccagcucgguccuc

SEQ ID NO: 1289405 - RNA, 22 nt, Human
gaacaagugcuccaggauuccc

SEQ ID NO: 1289406 - RNA, 19 nt, Human
ggaaguggccgucccuggg

SEQ ID NO: 1289407 - RNA, 28 nt, Human
ggaggggguugagggagucccaggaggg

SEQ ID NO: 1289408 - RNA, 19 nt, Human
gggcuggaucagagagccg

SEQ ID NO: 1289409 - RNA, 18 nt, Human
ggggcugggaccggggaa

SEQ ID NO: 1289410 - RNA, 23 nt, Human
ucaaucagaccuacuugcaccca

SEQ ID NO: 1289411 - RNA, 24 nt, Human
ucaaucagaccuacuugcacccaa

SEQ ID NO: 1289412 - RNA, 23 nt, Human
uccagcucgguccucucccgggc

SEQ ID NO: 1289413 - RNA, 26 nt, Human
uccccaccagcccaacgcaccccacc

SEQ ID NO: 1289414 - RNA, 24 nt, Human
uccccucuuccaccacaccauccc

SEQ ID NO: 1289415 - RNA, 22 nt, Human
ucccgggcuggaucagagagcc

SEQ ID NO: 1289416 - RNA, 21 nt, Human
ucuccccuagacccagggcug

SEQ ID NO: 1289417 - RNA, 24 nt, Human
ucuccccuagacccagggcugucc

SEQ ID NO: 1289418 - RNA, 18 nt, Human
ugcuccaggauucccugc

SEQ ID NO: 1289419 - RNA, 22 nt, Human
ugcuccaggauucccugcccac

SEQ ID NO: 1289420 - RNA, 21 nt, Human
ugcuccaggauucccugcccc

SEQ ID NO: 1289421 - RNA, 24 nt, Human
uggagaaaauggaggggguugagg

SEQ ID NO: 1289422 - RNA, 20 nt, Human
ugggggaacugggaggggcu

SEQ ID NO: 1289423 - RNA, 23 nt, Human
uguccauuggguagcaaugugga

SEQ ID NO: 1289424 - RNA, 23 nt, Human
uguccuacucaucccaccccaca

SEQ ID NO: 1289425 - RNA, 20 nt, Human
uucccugcccacuggccauu

SEQ ID NO: 1289426 - RNA, 23 nt, Human
gcaguggccucagcuaugguauu

SEQ ID NO: 1289427 - RNA, 20 nt, Human
gcugcaguggccucagcuau

SEQ ID NO: 1289428 - RNA, 21 nt, Human
ucacaacuuuaauugcugcug

SEQ ID NO: 1289429 - RNA, 22 nt, Human
uuucacaacuuuaauugcugcu

SEQ ID NO: 1289430 - RNA, 23 nt, Human
aaacacgaccagcggcuucauga

SEQ ID NO: 1289431 - RNA, 23 nt, Human
acaaacacgaccagcggcuucau

SEQ ID NO: 1289432 - RNA, 18 nt, Human
cgccguggacaaacacga

SEQ ID NO: 1289433 - RNA, 19 nt, Human
cggcaggucugcagcggga

SEQ ID NO: 1289434 - RNA, 18 nt, Human
gaccagcggcuucaugag

SEQ ID NO: 1289435 - RNA, 20 nt, Human
uuaauguaauuuucagugag

SEQ ID NO: 1289436 - RNA, 23 nt, Human
accucaaaaaauucauggaggaa

SEQ ID NO: 1289437 - RNA, 21 nt, Human
auagcaucaacaaguaugaag

SEQ ID NO: 1289438 - RNA, 24 nt, Human
auuuuugauuugcaaacaaggauu

SEQ ID NO: 1289439 - RNA, 26 nt, Human
caacaaguaugaaauuacuuugaaaa

SEQ ID NO: 1289440 - RNA, 19 nt, Human
cagggccaacugcgggagg

SEQ ID NO: 1289441 - RNA, 19 nt, Human
cccucaggccguacguaac

SEQ ID NO: 1289442 - RNA, 26 nt, Human
cggaacaccacagggccaacugcggg

SEQ ID NO: 1289443 - RNA, 18 nt, Human
cucuccacaaaaccaaca

SEQ ID NO: 1289444 - RNA, 19 nt, Human
uagcaucaacaaguaugaa

SEQ ID NO: 1289445 - RNA, 21 nt, Human
uaugaaauuacuuugaaaaca

SEQ ID NO: 1289446 - RNA, 21 nt, Human
ucucuccacaaaaccaacaug

SEQ ID NO: 1289447 - RNA, 20 nt, Human
uguaaaauuuuauugugaaa

SEQ ID NO: 1289448 - RNA, 19 nt, Human
aagcuuauuuauggaaaag

SEQ ID NO: 1289449 - RNA, 19 nt, Human
accaacuuucaacauggcu

SEQ ID NO: 1289450 - RNA, 23 nt, Human
accuacuggccucccccaacccu

SEQ ID NO: 1289451 - RNA, 20 nt, Human
acuuucaacauggcuucugg

SEQ ID NO: 1289452 - RNA, 28 nt, Human
agauaauuuuuuagugggccagagagcu

SEQ ID NO: 1289453 - RNA, 22 nt, Human
agcaaggcuggcaggggcccca

SEQ ID NO: 1289454 - RNA, 22 nt, Human
agcuagacgcgccugagggcug

SEQ ID NO: 1289455 - RNA, 18 nt, Human
aggcagggccgugagccg

SEQ ID NO: 1289456 - RNA, 22 nt, Human
aggcagggccgugagccgggcg

SEQ ID NO: 1289457 - RNA, 23 nt, Human
aggcugaugguggcagcaguggg

SEQ ID NO: 1289458 - RNA, 24 nt, Human
agggugauguggauuuuagaguag

SEQ ID NO: 1289459 - RNA, 21 nt, Human
auagacacaagccucaaacau

SEQ ID NO: 1289460 - RNA, 19 nt, Human
aucaucuguaucuaaucug

SEQ ID NO: 1289461 - RNA, 19 nt, Human
auuuauuugccaaccucau

SEQ ID NO: 1289462 - RNA, 30 nt, Human
caaauggccuuccuaaugacugcucuucuu

SEQ ID NO: 1289463 - RNA, 23 nt, Human
cauaauauccaacacauggcucu

SEQ ID NO: 1289464 - RNA, 20 nt, Human
ccaagaaaggaaggaguaau

SEQ ID NO: 1289465 - RNA, 25 nt, Human
ccauaccuacuggccucccccaacc

SEQ ID NO: 1289466 - RNA, 22 nt, Human
cccaagaaaggaaggaguaaua

SEQ ID NO: 1289467 - RNA, 19 nt, Human
cccccaacccucuugucug

SEQ ID NO: 1289468 - RNA, 22 nt, Human
ccucaucucuuuuuccuuagca

SEQ ID NO: 1289469 - RNA, 24 nt, Human
ccuuccuaaugacugcucuucucg

SEQ ID NO: 1289470 - RNA, 22 nt, Human
cgagggagaguccugggcugcc

SEQ ID NO: 1289471 - RNA, 25 nt, Human
cgccgagcuagacgcgccugagggc

SEQ ID NO: 1289472 - RNA, 24 nt, Human
cgccuggggcgcgucuucaggguc

SEQ ID NO: 1289473 - RNA, 23 nt, Human
cuacuggccucccccaacccucu

SEQ ID NO: 1289474 - RNA, 24 nt, Human
cuccaaaucccaggaagcuugcga

SEQ ID NO: 1289475 - RNA, 20 nt, Human
cucccaaaaguagauuagaa

SEQ ID NO: 1289476 - RNA, 24 nt, Human
cuggcaagcugacucuaucuauau

SEQ ID NO: 1289477 - RNA, 19 nt, Human
cugucuagcaaggcuggca

SEQ ID NO: 1289478 - RNA, 22 nt, Human
gaaauacauauuuauuugccaa

SEQ ID NO: 1289479 - RNA, 18 nt, Human
gaggcgccccccaggcag

SEQ ID NO: 1289480 - RNA, 21 nt, Human
gagggagaguccugggcugcc

SEQ ID NO: 1289481 - RNA, 18 nt, Human
gccugagggcugagcccc

SEQ ID NO: 1289482 - RNA, 27 nt, Human
gccuugggaggaggcucugaguagggg

SEQ ID NO: 1289483 - RNA, 23 nt, Human
gcgcgucuucaggguccucccgg

SEQ ID NO: 1289484 - RNA, 23 nt, Human
ggugaugagauccccuagaagga

SEQ ID NO: 1289485 - RNA, 21 nt, Human
guccugggcugccccugagcc

SEQ ID NO: 1289486 - RNA, 23 nt, Human
guccugggcugccccugagcccc

SEQ ID NO: 1289487 - RNA, 18 nt, Human
uaacccaagaaaggaagg

SEQ ID NO: 1289488 - RNA, 24 nt, Human
uaacccaagaaaggaaggaguaau

SEQ ID NO: 1289489 - RNA, 20 nt, Human
uaauauaaacaaauccauac

SEQ ID NO: 1289490 - RNA, 21 nt, Human
uaauuuaucuaacuucucuca

SEQ ID NO: 1289491 - RNA, 24 nt, Human
ucaaacauuuucuugcucugugcc

SEQ ID NO: 1289492 - RNA, 19 nt, Human
ucaggguccucccggcacu

SEQ ID NO: 1289493 - RNA, 21 nt, Human
ucaggguccucccggcacugg

SEQ ID NO: 1289494 - RNA, 21 nt, Human
uccaaauauucaggaaacagg

SEQ ID NO: 1289495 - RNA, 25 nt, Human
uccaaauggccuuccuaaugacugc

SEQ ID NO: 1289496 - RNA, 21 nt, Human
uccccuagaaggacuguucac

SEQ ID NO: 1289497 - RNA, 19 nt, Human
uccugggccuugggaggag

SEQ ID NO: 1289498 - RNA, 20 nt, Human
uccugggccuugggaggagg

SEQ ID NO: 1289499 - RNA, 22 nt, Human
uccugggccuugggaggaggcu

SEQ ID NO: 1289500 - RNA, 23 nt, Human
uccugggccuugggaggaggcuc

SEQ ID NO: 1289501 - RNA, 21 nt, Human
ucucacgugaacagagaggau

SEQ ID NO: 1289502 - RNA, 23 nt, Human
ucuucaggguccucccggcacug

SEQ ID NO: 1289503 - RNA, 19 nt, Human
ucuugcucugugccugucu

SEQ ID NO: 1289504 - RNA, 21 nt, Human
ucuugcucugugccugucuua

SEQ ID NO: 1289505 - RNA, 21 nt, Human
ucuugcucugugccugucuua

SEQ ID NO: 1289506 - RNA, 23 nt, Human
ucuuucaagcuauuucacaaggc

SEQ ID NO: 1289507 - RNA, 22 nt, Human
ugacacuccaaaucccaggaag

SEQ ID NO: 1289508 - RNA, 21 nt, Human
ugagccccagggcucgugauc

SEQ ID NO: 1289509 - RNA, 18 nt, Human
ugagccgggcgagggaga

SEQ ID NO: 1289510 - RNA, 21 nt, Human
ugaguagggccgccuggggcg

SEQ ID NO: 1289511 - RNA, 18 nt, Human
ugaucugcucccggaggc

SEQ ID NO: 1289512 - RNA, 21 nt, Human
ugcucccuaauggcucacaua

SEQ ID NO: 1289513 - RNA, 19 nt, Human
uggcagcaguggggcgucc

SEQ ID NO: 1289514 - RNA, 21 nt, Human
uggcagcaguggggcguccag

SEQ ID NO: 1289515 - RNA, 23 nt, Human
uggcagcaguggggcguccagag

SEQ ID NO: 1289516 - RNA, 20 nt, Human
ugggaggaggcucugaguag

SEQ ID NO: 1289517 - RNA, 21 nt, Human
uggggauuccagccaagucuu

SEQ ID NO: 1289518 - RNA, 22 nt, Human
uggggauuccagccaagucuug

SEQ ID NO: 1289519 - RNA, 19 nt, Human
ugucuugcagaagagugaa

SEQ ID NO: 1289520 - RNA, 20 nt, Human
uguuuauagacacaagccuc

SEQ ID NO: 1289521 - RNA, 22 nt, Human
uuaauauaaacaaauccauacc

SEQ ID NO: 1289522 - RNA, 25 nt, Human
uucaagcuauuucacaaggcugaug

SEQ ID NO: 1289523 - RNA, 23 nt, Human
uuccuuagcaucagucuucaucc

SEQ ID NO: 1289524 - RNA, 23 nt, Human
uugccuggugaugagauccccua

SEQ ID NO: 1289525 - RNA, 19 nt, Human
uuguugugcacuucugucc

SEQ ID NO: 1289526 - RNA, 18 nt, Human
uuuaaaaagucguggguc

SEQ ID NO: 1289527 - RNA, 19 nt, Human
ccccggggcggagggcacg

SEQ ID NO: 1289528 - RNA, 20 nt, Human
ggggaugggaaggcugggaa

SEQ ID NO: 1289529 - RNA, 21 nt, Human
ggggggaugggaaggcuggga

SEQ ID NO: 1289530 - RNA, 18 nt, Human
ugaaugauuugcuuucgg

SEQ ID NO: 1289531 - RNA, 19 nt, Human
ugggcaccccggggcggag

SEQ ID NO: 1289532 - RNA, 21 nt, Human
uggggggaugggaaggcuggg

SEQ ID NO: 1289533 - RNA, 25 nt, Human
uuuuuaaaaauuaucuuggaggggu

SEQ ID NO: 1289534 - RNA, 19 nt, Human
cugcagcaaugucauuccc

SEQ ID NO: 1289535 - RNA, 21 nt, Human
ugcagcaaugucauuccacau

SEQ ID NO: 1289536 - RNA, 22 nt, Human
ugcagcaaugucauuccacauc

SEQ ID NO: 1289537 - RNA, 22 nt, Human
aaacugaaugccgugaccacaa

SEQ ID NO: 1289538 - RNA, 22 nt, Human
aagagaccguuucccugccggc

SEQ ID NO: 1289539 - RNA, 21 nt, Human
agaacaaagcaaggcacccac

SEQ ID NO: 1289540 - RNA, 27 nt, Human
agagggaacaauuauuaauuucagagg

SEQ ID NO: 1289541 - RNA, 18 nt, Human
agcuaugacacagagaca

SEQ ID NO: 1289542 - RNA, 19 nt, Human
agugguuaaccacaaaggc

SEQ ID NO: 1289543 - RNA, 20 nt, Human
caagaaaacugaaugccgug

SEQ ID NO: 1289544 - RNA, 22 nt, Human
cagcucagggcacaaucuacag

SEQ ID NO: 1289545 - RNA, 26 nt, Human
caguucaaaccagaagagggaacaau

SEQ ID NO: 1289546 - RNA, 22 nt, Human
ccugaccuaaugcagccucaac

SEQ ID NO: 1289547 - RNA, 19 nt, Human
ccugcucagcauuugggag

SEQ ID NO: 1289548 - RNA, 24 nt, Human
ccuguccugcucagcauuugggag

SEQ ID NO: 1289549 - RNA, 20 nt, Human
ccuuugagguuaggauucuu

SEQ ID NO: 1289550 - RNA, 27 nt, Human
cgugaccacaaacccaugaguacccac

SEQ ID NO: 1289551 - RNA, 22 nt, Human
cugaaugccgugaccacaaacc

SEQ ID NO: 1289552 - RNA, 19 nt, Human
cugcucagcauuugggaga

SEQ ID NO: 1289553 - RNA, 20 nt, Human
cugcugccucucgccacagc

SEQ ID NO: 1289554 - RNA, 21 nt, Human
cugugugcuaagcacauccuc

SEQ ID NO: 1289555 - RNA, 18 nt, Human
cuugggaagaacaaagca

SEQ ID NO: 1289556 - RNA, 18 nt, Human
gaccguuucccugccggc

SEQ ID NO: 1289557 - RNA, 19 nt, Human
ggaagaacaaagcaagggg

SEQ ID NO: 1289558 - RNA, 22 nt, Human
gugaccacaaacccaugaguac

SEQ ID NO: 1289559 - RNA, 26 nt, Human
gugaccacaaacccaugaguacccac

SEQ ID NO: 1289560 - RNA, 21 nt, Human
uaaccacaaaggcuguggggu

SEQ ID NO: 1289561 - RNA, 21 nt, Human
uauucuggggcauccuagcaa

SEQ ID NO: 1289562 - RNA, 24 nt, Human
uauucuggggcauccuagcaagug

SEQ ID NO: 1289563 - RNA, 20 nt, Human
ucugcaggcaagaaaacuga

SEQ ID NO: 1289564 - RNA, 22 nt, Human
ugaccacaaacccaugaguacc

SEQ ID NO: 1289565 - RNA, 18 nt, Human
ugcaccccccuugccagg

SEQ ID NO: 1289566 - RNA, 19 nt, Human
ugccgugaccacaaaccca

SEQ ID NO: 1289567 - RNA, 22 nt, Human
uggcaauuaugaacaaauuuag

SEQ ID NO: 1289568 - RNA, 20 nt, Human
ugggagacugggguugacgc

SEQ ID NO: 1289569 - RNA, 24 nt, Human
ugggguugacgcuacugucugcug

SEQ ID NO: 1289570 - RNA, 26 nt, Human
ugugucguuccuuuggcaauuaugaa

SEQ ID NO: 1289571 - RNA, 19 nt, Human
uucaaaaggccaguucaaa

SEQ ID NO: 1289572 - RNA, 19 nt, Human
uucaaauauucuggggcau

SEQ ID NO: 1289573 - RNA, 18 nt, Human
uucccaguuuccauaaga

SEQ ID NO: 1289574 - RNA, 19 nt, Human
uugugucguuccuuuggca

SEQ ID NO: 1289575 - RNA, 20 nt, Human
aacucagaggcugaaagcag

SEQ ID NO: 1289576 - RNA, 19 nt, Human
aagaaagaaaagguccacu

SEQ ID NO: 1289577 - RNA, 20 nt, Human
aagaaagaaaagguccacuu

SEQ ID NO: 1289578 - RNA, 22 nt, Human
aagaagaaagaaaagguccacu

SEQ ID NO: 1289579 - RNA, 24 nt, Human
aagaagaaagaaaagguccacuug

SEQ ID NO: 1289580 - RNA, 21 nt, Human
aagcaagacuuugguaccaag

SEQ ID NO: 1289581 - RNA, 21 nt, Human
aagcaggagcuugcugacagc

SEQ ID NO: 1289582 - RNA, 22 nt, Human
aaggacagagcagucugcucug

SEQ ID NO: 1289583 - RNA, 24 nt, Human
aagugcuagaagugugugaaggcc

SEQ ID NO: 1289584 - RNA, 24 nt, Human
acgaaccuggaacucagaggcuga

SEQ ID NO: 1289585 - RNA, 23 nt, Human
acgggcacuggagggccucuccu

SEQ ID NO: 1289586 - RNA, 19 nt, Human
agaggcugaaagcaggagc

SEQ ID NO: 1289587 - RNA, 24 nt, Human
agcaagacuuugguaccaaggcag

SEQ ID NO: 1289588 - RNA, 21 nt, Human
aggagcuggaggcuggggagg

SEQ ID NO: 1289589 - RNA, 25 nt, Human
aggagcuggaggcuggggaggagcc

SEQ ID NO: 1289590 - RNA, 19 nt, Human
caaagugcuagaagugugu

SEQ ID NO: 1289591 - RNA, 20 nt, Human
cagaaccaaacagcagggac

SEQ ID NO: 1289592 - RNA, 21 nt, Human
caggagcuugcugacagcuga

SEQ ID NO: 1289593 - RNA, 25 nt, Human
caugcugcuuucacaccauccagcu

SEQ ID NO: 1289594 - RNA, 23 nt, Human
ccaagcaagacuuugguaccaag

SEQ ID NO: 1289595 - RNA, 18 nt, Human
ccaauccacgaaccugga

SEQ ID NO: 1289596 - RNA, 21 nt, Human
cucaggaaaaguccuugagga

SEQ ID NO: 1289597 - RNA, 25 nt, Human
cucaggaaaaguccuugaggacuuc

SEQ ID NO: 1289598 - RNA, 21 nt, Human
gaggcuggggaggagccugag

SEQ ID NO: 1289599 - RNA, 21 nt, Human
gcugaaagcaggagcuugcug

SEQ ID NO: 1289600 - RNA, 25 nt, Human
ggcuggggaggagccugaguguggg

SEQ ID NO: 1289601 - RNA, 19 nt, Human
gggaauggaggcuccagcc

SEQ ID NO: 1289602 - RNA, 24 nt, Human
ggggggcugcucugugggcagggg

SEQ ID NO: 1289603 - RNA, 22 nt, Human
gggucugacuauggacgccagu

SEQ ID NO: 1289604 - RNA, 23 nt, Human
uccuugaggacucagucgugcaa

SEQ ID NO: 1289605 - RNA, 19 nt, Human
ugaaagcaggagcuugcug

SEQ ID NO: 1289606 - RNA, 20 nt, Human
ugacuauggacgccaguguc

SEQ ID NO: 1289607 - RNA, 27 nt, Human
ugacuauggacgccagugucuucccuu

SEQ ID NO: 1289608 - RNA, 22 nt, Human
ugccggagcacagugcucagga

SEQ ID NO: 1289609 - RNA, 25 nt, Human
ugcuaccaagcaagacuuugguacc

SEQ ID NO: 1289610 - RNA, 18 nt, Human
ugcuagaagugugugaag

SEQ ID NO: 1289611 - RNA, 24 nt, Human
uggagaggagcuggaggcugggga

SEQ ID NO: 1289612 - RNA, 26 nt, Human
uggagaggagcuggaggcuggggagg

SEQ ID NO: 1289613 - RNA, 19 nt, Human
uggaggcuggggaggagcc

SEQ ID NO: 1289614 - RNA, 19 nt, Human
ugggaagauuucagaacca

SEQ ID NO: 1289615 - RNA, 24 nt, Human
uuggagaggagcuggaggcugguc

SEQ ID NO: 1289616 - RNA, 21 nt, Human
uugguaccaaggcagggaaug

SEQ ID NO: 1289617 - RNA, 18 nt, Human
acuccaccagccugugga

SEQ ID NO: 1289618 - RNA, 22 nt, Human
agaaugaaccaggugccggaug

SEQ ID NO: 1289619 - RNA, 21 nt, Human
agagugggacuuggcaaagag

SEQ ID NO: 1289620 - RNA, 19 nt, Human
agcagccggccuggauggc

SEQ ID NO: 1289621 - RNA, 18 nt, Human
agcgaggaggggcaggca

SEQ ID NO: 1289622 - RNA, 22 nt, Human
aggcaaggcagcggccuuccga

SEQ ID NO: 1289623 - RNA, 21 nt, Human
aggugugggggccuccagagc

SEQ ID NO: 1289624 - RNA, 19 nt, Human
augcggggcggggccuggc

SEQ ID NO: 1289625 - RNA, 23 nt, Human
augcggggcggggccuggcuucc

SEQ ID NO: 1289626 - RNA, 25 nt, Human
caaggcagcggccuuccgacccgcc

SEQ ID NO: 1289627 - RNA, 18 nt, Human
cacagaaugaaccaggug

SEQ ID NO: 1289628 - RNA, 22 nt, Human
caccagccuguggacuuggccu

SEQ ID NO: 1289629 - RNA, 19 nt, Human
cacugcggggcucuggggc

SEQ ID NO: 1289630 - RNA, 24 nt, Human
cagagcccgggccgggguagcugu

SEQ ID NO: 1289631 - RNA, 18 nt, Human
caggcuccccagggggcc

SEQ ID NO: 1289632 - RNA, 22 nt, Human
caggcuccccagggggccuccc

SEQ ID NO: 1289633 - RNA, 18 nt, Human
caucaugguaugccaggc

SEQ ID NO: 1289634 - RNA, 19 nt, Human
caugcggaaacagccgggc

SEQ ID NO: 1289635 - RNA, 18 nt, Human
ccaggugccggaugcggc

SEQ ID NO: 1289636 - RNA, 22 nt, Human
cccggcgggauggggggcgggg

SEQ ID NO: 1289637 - RNA, 19 nt, Human
ccgggccgggguagcuguc

SEQ ID NO: 1289638 - RNA, 19 nt, Human
ccgggguagcugucuccuc

SEQ ID NO: 1289639 - RNA, 19 nt, Human
ccuccaggcagaagggacc

SEQ ID NO: 1289640 - RNA, 21 nt, Human
ccucccacccgccaggaagcc

SEQ ID NO: 1289641 - RNA, 24 nt, Human
ccucccugagacagcggcaggggu

SEQ ID NO: 1289642 - RNA, 19 nt, Human
ccuugcucuugcuccucuu

SEQ ID NO: 1289643 - RNA, 20 nt, Human
ccuugcucuugcuccucuug

SEQ ID NO: 1289644 - RNA, 23 nt, Human
cgcccgagcgccccuugaagcuc

SEQ ID NO: 1289645 - RNA, 21 nt, Human
cgggccgggguagcugucucc

SEQ ID NO: 1289646 - RNA, 23 nt, Human
cucacugcggggcucuggggcag

SEQ ID NO: 1289647 - RNA, 20 nt, Human
cuccagagccaccucuuccc

SEQ ID NO: 1289648 - RNA, 20 nt, Human
cucccugagacagcggcagg

SEQ ID NO: 1289649 - RNA, 18 nt, Human
cuugccgugccgggacug

SEQ ID NO: 1289650 - RNA, 19 nt, Human
cuuucugaaguugaaggag

SEQ ID NO: 1289651 - RNA, 24 nt, Human
gccgugaagcucucgugcgcggag

SEQ ID NO: 1289652 - RNA, 19 nt, Human
gcuccccaaacaccgaccc

SEQ ID NO: 1289653 - RNA, 24 nt, Human
ggacugguggugguggugauggug

SEQ ID NO: 1289654 - RNA, 20 nt, Human
ggcagggguagcgaggaggg

SEQ ID NO: 1289655 - RNA, 23 nt, Human
ggccuggauggcccggagguagc

SEQ ID NO: 1289656 - RNA, 18 nt, Human
gggccuccagagcccggg

SEQ ID NO: 1289657 - RNA, 21 nt, Human
gggcggggccuuucugaaguu

SEQ ID NO: 1289658 - RNA, 22 nt, Human
gguagcgaggaggggcaggcag

SEQ ID NO: 1289659 - RNA, 20 nt, Human
ggugaugggagguguggggg

SEQ ID NO: 1289660 - RNA, 24 nt, Human
gguggugaugggaggugugggggc

SEQ ID NO: 1289661 - RNA, 22 nt, Human
gugauggugguggugaugguuu

SEQ ID NO: 1289662 - RNA, 20 nt, Human
guggugauggugguggugau

SEQ ID NO: 1289663 - RNA, 20 nt, Human
gugguggugaugguggugau

SEQ ID NO: 1289664 - RNA, 20 nt, Human
gugguggugauggugguggu

SEQ ID NO: 1289665 - RNA, 20 nt, Human
guggugguggugaugguggu

SEQ ID NO: 1289666 - RNA, 19 nt, Human
ucccccuugcgguccuugc

SEQ ID NO: 1289667 - RNA, 19 nt, Human
uccccggcgccuccagaga

SEQ ID NO: 1289668 - RNA, 18 nt, Human
ucccgcuuccccggcgcc

SEQ ID NO: 1289669 - RNA, 26 nt, Human
ucccggcgggauggggggcggggccu

SEQ ID NO: 1289670 - RNA, 18 nt, Human
ucccugagacagcggcag

SEQ ID NO: 1289671 - RNA, 22 nt, Human
uccgcaugcggaaacagccggg

SEQ ID NO: 1289672 - RNA, 22 nt, Human
ucucacugcggggcucuggggc

SEQ ID NO: 1289673 - RNA, 24 nt, Human
ucucacugcggggcucuggggcag

SEQ ID NO: 1289674 - RNA, 19 nt, Human
ucugaaguugaaggaggag

SEQ ID NO: 1289675 - RNA, 23 nt, Human
ucuucccucagccuugggcccau

SEQ ID NO: 1289676 - RNA, 22 nt, Human
ucuugccgugccgggacuggug

SEQ ID NO: 1289677 - RNA, 21 nt, Human
ugaaguugaaggaggagccgg

SEQ ID NO: 1289678 - RNA, 25 nt, Human
ugaccgacuguccauccagugacau

SEQ ID NO: 1289679 - RNA, 21 nt, Human
ugagacagcggcagggguagc

SEQ ID NO: 1289680 - RNA, 20 nt, Human
ugcacagaaugaaccaggug

SEQ ID NO: 1289681 - RNA, 19 nt, Human
ugccgggacuggugguggu

SEQ ID NO: 1289682 - RNA, 20 nt, Human
uggagaugcggggcggggcc

SEQ ID NO: 1289683 - RNA, 21 nt, Human
uggcaaagagcuucugcacag

SEQ ID NO: 1289684 - RNA, 23 nt, Human
uggcaaagagcuucugcacagaa

SEQ ID NO: 1289685 - RNA, 23 nt, Human
uggugaugggaggugugggggcc

SEQ ID NO: 1289686 - RNA, 20 nt, Human
ugguggugguggugaugguc

SEQ ID NO: 1289687 - RNA, 25 nt, Human
aaaacaacaacaacgcauuacccaa

SEQ ID NO: 1289688 - RNA, 20 nt, Human
aaacaacaacaacgcauuac

SEQ ID NO: 1289689 - RNA, 19 nt, Human
aagaagaacuaacuuagug

SEQ ID NO: 1289690 - RNA, 22 nt, Human
aagaccagcaggaaccccagga

SEQ ID NO: 1289691 - RNA, 22 nt, Human
aagagcuaucaaagagcaaucc

SEQ ID NO: 1289692 - RNA, 20 nt, Human
aagagcuuucuccacccugg

SEQ ID NO: 1289693 - RNA, 20 nt, Human
aagaguaggagaccggcauu

SEQ ID NO: 1289694 - RNA, 23 nt, Human
aagugagggugaagaagaacuaa

SEQ ID NO: 1289695 - RNA, 20 nt, Human
accggcauuuucccgggccu

SEQ ID NO: 1289696 - RNA, 18 nt, Human
accuagggcgccagcagc

SEQ ID NO: 1289697 - RNA, 25 nt, Human
agaaaacaacaacaacgcauuaccc

SEQ ID NO: 1289698 - RNA, 23 nt, Human
agaaagaaaacaacaacaacgca

SEQ ID NO: 1289699 - RNA, 19 nt, Human
agacaggaggggaggccag

SEQ ID NO: 1289700 - RNA, 21 nt, Human
agacaggaggggaggccagga

SEQ ID NO: 1289701 - RNA, 18 nt, Human
agaccagcaggaacccca

SEQ ID NO: 1289702 - RNA, 24 nt, Human
agagagaaagaaaacaacaacaac

SEQ ID NO: 1289703 - RNA, 22 nt, Human
agagaucauuccuggccaaguc

SEQ ID NO: 1289704 - RNA, 21 nt, Human
agcaggaaccccaggaccaug

SEQ ID NO: 1289705 - RNA, 19 nt, Human
aggaacagagaucauuccu

SEQ ID NO: 1289706 - RNA, 21 nt, Human
aggaagugagggugaagaaga

SEQ ID NO: 1289707 - RNA, 24 nt, Human
aggaugucgagcguggaggcggcg

SEQ ID NO: 1289708 - RNA, 22 nt, Human
augugugugugugugugugugu

SEQ ID NO: 1289709 - RNA, 22 nt, Human
augugugugugugugugugugu

SEQ ID NO: 1289710 - RNA, 19 nt, Human
caaagagcaauccgaucug

SEQ ID NO: 1289711 - RNA, 21 nt, Human
cagcucagugcccagcagcag

SEQ ID NO: 1289712 - RNA, 19 nt, Human
cagggagacgcaggggugg

SEQ ID NO: 1289713 - RNA, 25 nt, Human
cagugcccagcagcaguccuggugg

SEQ ID NO: 1289714 - RNA, 24 nt, Human
cauccuguuuccuccccccucacu

SEQ ID NO: 1289715 - RNA, 21 nt, Human
cauggucuuggccgcgcgccg

SEQ ID NO: 1289716 - RNA, 23 nt, Human
ccaagucagguacaaaggccaug

SEQ ID NO: 1289717 - RNA, 19 nt, Human
cccaugcgcccugggcgcc

SEQ ID NO: 1289718 - RNA, 21 nt, Human
ccuguuuccuccccccucacu

SEQ ID NO: 1289719 - RNA, 26 nt, Human
cgcccccuucaccaggcggcagcuca

SEQ ID NO: 1289720 - RNA, 21 nt, Human
cgguugcagggcccgggcccg

SEQ ID NO: 1289721 - RNA, 21 nt, Human
cguguguguaugugugugugu

SEQ ID NO: 1289722 - RNA, 19 nt, Human
cuccguugucuuccccccc

SEQ ID NO: 1289723 - RNA, 19 nt, Human
cugcagggagacgcagggg

SEQ ID NO: 1289724 - RNA, 21 nt, Human
cuucaccaggcggcagcucag

SEQ ID NO: 1289725 - RNA, 25 nt, Human
cuuuuugaccacaaagagguccugg

SEQ ID NO: 1289726 - RNA, 20 nt, Human
gaaaggcuucccuauaagga

SEQ ID NO: 1289727 - RNA, 21 nt, Human
gaacauucggguuacaaagaa

SEQ ID NO: 1289728 - RNA, 20 nt, Human
gaagaccagcaggaacccca

SEQ ID NO: 1289729 - RNA, 23 nt, Human
gagaaagaaaacaacaacaacgc

SEQ ID NO: 1289730 - RNA, 20 nt, Human
gccagacugagggcgaagac

SEQ ID NO: 1289731 - RNA, 20 nt, Human
gcccugggcgcccccuucac

SEQ ID NO: 1289732 - RNA, 25 nt, Human
gggagacgcaggggugguggguuag

SEQ ID NO: 1289733 - RNA, 22 nt, Human
uacaauuaugaaaagagcuauc

SEQ ID NO: 1289734 - RNA, 18 nt, Human
uacagggguaguaugugg

SEQ ID NO: 1289735 - RNA, 19 nt, Human
uagggagagaaaggggagc

SEQ ID NO: 1289736 - RNA, 21 nt, Human
uagggcgccagcagcaggugg

SEQ ID NO: 1289737 - RNA, 24 nt, Human
uaucaaagagcaauccgaucugau

SEQ ID NO: 1289738 - RNA, 18 nt, Human
uaugaaaagagcuaucaa

SEQ ID NO: 1289739 - RNA, 18 nt, Human
uaugugugugugugugug

SEQ ID NO: 1289740 - RNA, 23 nt, Human
uaugugugugugugugugugugu

SEQ ID NO: 1289741 - RNA, 24 nt, Human
uaugugugugugugugugugugug

SEQ ID NO: 1289742 - RNA, 27 nt, Human
ucccagagaggugccccagcgcuugcc

SEQ ID NO: 1289743 - RNA, 22 nt, Human
uccugggucagacucaaaccuc

SEQ ID NO: 1289744 - RNA, 22 nt, Human
ugaaaagagcuaucaaagagca

SEQ ID NO: 1289745 - RNA, 19 nt, Human
ugagggcgaagaccagcag

SEQ ID NO: 1289746 - RNA, 20 nt, Human
ugagggugugcaggaugucg

SEQ ID NO: 1289747 - RNA, 21 nt, Human
ugcaggaugucgagcguggag

SEQ ID NO: 1289748 - RNA, 22 nt, Human
ugcagggagacgcagggguggu

SEQ ID NO: 1289749 - RNA, 19 nt, Human
ugccagccaagaaaggcuu

SEQ ID NO: 1289750 - RNA, 25 nt, Human
ugccugcagggagacgcaggggugg

SEQ ID NO: 1289751 - RNA, 25 nt, Human
uggagcacccuuggcugggcugaaa

SEQ ID NO: 1289752 - RNA, 19 nt, Human
uggcaagagagaaagaaaa

SEQ ID NO: 1289753 - RNA, 20 nt, Human
ugguacagaugagcccggag

SEQ ID NO: 1289754 - RNA, 24 nt, Human
ugguacagaugagcccggagguuc

SEQ ID NO: 1289755 - RNA, 25 nt, Human
uguaugugugugugugugugugugg

SEQ ID NO: 1289756 - RNA, 20 nt, Human
uguguaugugugugugugug

SEQ ID NO: 1289757 - RNA, 19 nt, Human
uguguguaugugugugugu

SEQ ID NO: 1289758 - RNA, 18 nt, Human
ugugugugugugugugug

SEQ ID NO: 1289759 - RNA, 18 nt, Human
ugugugugugugugugug

SEQ ID NO: 1289760 - RNA, 18 nt, Human
ugugugugugugugugug

SEQ ID NO: 1289761 - RNA, 18 nt, Human
ugugugugugugugugug

SEQ ID NO: 1289762 - RNA, 18 nt, Human
ugugugugugugugugug

SEQ ID NO: 1289763 - RNA, 21 nt, Human
ugugugugugugugugugugu

SEQ ID NO: 1289764 - RNA, 21 nt, Human
ugugugugugugugugugugu

SEQ ID NO: 1289765 - RNA, 21 nt, Human
ugugugugugugugugugugu

SEQ ID NO: 1289766 - RNA, 21 nt, Human
ugugugugugugugugugugu

SEQ ID NO: 1289767 - RNA, 21 nt, Human
ugugugugugugugugugugu

SEQ ID NO: 1289768 - RNA, 22 nt, Human
ugugugugugugugugugugug

SEQ ID NO: 1289769 - RNA, 22 nt, Human
ugugugugugugugugugugug

SEQ ID NO: 1289770 - RNA, 23 nt, Human
uuacaauuaugaaaagagcuauc

SEQ ID NO: 1289771 - RNA, 20 nt, Human
uucagucguguguguaugug

SEQ ID NO: 1289772 - RNA, 22 nt, Human
uuccaaagagcuuucuccaccc

SEQ ID NO: 1289773 - RNA, 26 nt, Human
uuccaauauucaacuuuuggggacuu

SEQ ID NO: 1289774 - RNA, 23 nt, Human
aggcggcggcggggcccacugcc

SEQ ID NO: 1289775 - RNA, 20 nt, Human
cggcggcggggcccacugcc

SEQ ID NO: 1289776 - RNA, 20 nt, Human
gcgccgcagcgcgccaggcc

SEQ ID NO: 1289777 - RNA, 21 nt, Human
gcggcggcggggcccacugcc

SEQ ID NO: 1289778 - RNA, 21 nt, Human
ggcggggcccacugcccuucc

SEQ ID NO: 1289779 - RNA, 25 nt, Human
ggggcccacugcccuuccucgggag

SEQ ID NO: 1289780 - RNA, 20 nt, Human
ugggaggcggcggcggggcc

SEQ ID NO: 1289781 - RNA, 19 nt, Human
aaaugucuuuaaauagaua

SEQ ID NO: 1289782 - RNA, 23 nt, Human
agcuucuaauggugcaacaaucu

SEQ ID NO: 1289783 - RNA, 25 nt, Human
agguccucagagaccgcucaggguu

SEQ ID NO: 1289784 - RNA, 20 nt, Human
cgagaaaaacauuaaguugg

SEQ ID NO: 1289785 - RNA, 21 nt, Human
cuaauggugcaacaaucugcu

SEQ ID NO: 1289786 - RNA, 18 nt, Human
uauuugaauauuauaauu

SEQ ID NO: 1289787 - RNA, 18 nt, Human
ucugcucaccagguccuc

SEQ ID NO: 1289788 - RNA, 20 nt, Human
ucuguggaucaaccuagcuu

SEQ ID NO: 1289789 - RNA, 21 nt, Human
ugagcagugagaggcgccgcc

SEQ ID NO: 1289790 - RNA, 22 nt, Human
ugcaacaaucugcucaccaggu

SEQ ID NO: 1289791 - RNA, 22 nt, Human
ugcucaccagguccucagagac

SEQ ID NO: 1289792 - RNA, 22 nt, Human
uguggaucaaccuagcuucuaa

SEQ ID NO: 1289793 - RNA, 22 nt, Human
uucacauucuucgagaaaaaca

SEQ ID NO: 1289794 - RNA, 18 nt, Human
uucccaaacuuccagaac

SEQ ID NO: 1289795 - RNA, 22 nt, Human
uucuaauggugcaacaaucugc

SEQ ID NO: 1289796 - RNA, 18 nt, Human
aacacguccccacaucuc

SEQ ID NO: 1289797 - RNA, 20 nt, Human
auugugcugguugcuuuguu

SEQ ID NO: 1289798 - RNA, 21 nt, Human
ccgcgcgucacgcccggcccu

SEQ ID NO: 1289799 - RNA, 21 nt, Human
uccccacaucuccuguugccc

SEQ ID NO: 1289800 - RNA, 19 nt, Human
ugaggguggaggccaggcc

SEQ ID NO: 1289801 - RNA, 23 nt, Human
ugugcugguugcuuuguuugggg

SEQ ID NO: 1289802 - RNA, 22 nt, Human
aacauagggugaucaaagccaa

SEQ ID NO: 1289803 - RNA, 23 nt, Human
aagaugaaaacauuaugggagaa

SEQ ID NO: 1289804 - RNA, 23 nt, Human
aagccaaacaaaguuuaaaucag

SEQ ID NO: 1289805 - RNA, 19 nt, Human
acuccacgccuaagccagc

SEQ ID NO: 1289806 - RNA, 18 nt, Human
agggugaucaaagccaaa

SEQ ID NO: 1289807 - RNA, 21 nt, Human
caaaauaagcacaauggguca

SEQ ID NO: 1289808 - RNA, 21 nt, Human
ccaaaauaagcacaauggguc

SEQ ID NO: 1289809 - RNA, 26 nt, Human
cgccuaagccagcuugguuugaaggc

SEQ ID NO: 1289810 - RNA, 19 nt, Human
cuugguuugaaggcuucug

SEQ ID NO: 1289811 - RNA, 20 nt, Human
cuugguuugaaggcuucugg

SEQ ID NO: 1289812 - RNA, 24 nt, Human
gccaaacaaaguuuaaaucagcca

SEQ ID NO: 1289813 - RNA, 31 nt, Human
gucaaugguaacagacccugaauuuuucuuu

SEQ ID NO: 1289814 - RNA, 23 nt, Human
uacacaggaaagaugaaaacauu

SEQ ID NO: 1289815 - RNA, 21 nt, Human
ucaaugguaacagacccugaa

SEQ ID NO: 1289816 - RNA, 24 nt, Human
ugguaacagacccugaauuuuucu

SEQ ID NO: 1289817 - RNA, 22 nt, Human
uuaaggcaaaaucuaaguuuag

SEQ ID NO: 1289818 - RNA, 21 nt, Human
aacuauacaacuaaaaaaaac

SEQ ID NO: 1289819 - RNA, 21 nt, Human
agugaaggagugggaguggaa

SEQ ID NO: 1289820 - RNA, 23 nt, Human
ccuuuuagugaaggagugggagu

SEQ ID NO: 1289821 - RNA, 23 nt, Human
ucuuucacccccaggaagagguc

SEQ ID NO: 1289822 - RNA, 19 nt, Human
ugaagaaaggcagaugaua

SEQ ID NO: 1289823 - RNA, 18 nt, Human
ugcaaagugaagaaaggc

SEQ ID NO: 1289824 - RNA, 19 nt, Human
uuagugaaggagugggagu

SEQ ID NO: 1289825 - RNA, 23 nt, Human
accuccucccagccgggccgccg

SEQ ID NO: 1289826 - RNA, 20 nt, Human
caccuccucccagccgggcc

SEQ ID NO: 1289827 - RNA, 19 nt, Human
cagccgggccgccgccggg

SEQ ID NO: 1289828 - RNA, 19 nt, Human
cccccccggcccguccgcu

SEQ ID NO: 1289829 - RNA, 18 nt, Human
ccccgcccaccccgcgca

SEQ ID NO: 1289830 - RNA, 25 nt, Human
cccgaaagcaccuccucccagccgg

SEQ ID NO: 1289831 - RNA, 21 nt, Human
ccgccgcccaggcccccacag

SEQ ID NO: 1289832 - RNA, 19 nt, Human
ccgccucccgaaagcaccu

SEQ ID NO: 1289833 - RNA, 19 nt, Human
ccgcggccccgccucccga

SEQ ID NO: 1289834 - RNA, 19 nt, Human
ccguuuaggauugcgugag

SEQ ID NO: 1289835 - RNA, 21 nt, Human
cgaaagcaccuccucccagcc

SEQ ID NO: 1289836 - RNA, 21 nt, Human
cgcccaggcccccacaggucc

SEQ ID NO: 1289837 - RNA, 21 nt, Human
cgccucccgaaagcaccuccu

SEQ ID NO: 1289838 - RNA, 25 nt, Human
cgggaccagggccgcagccgagggc

SEQ ID NO: 1289839 - RNA, 23 nt, Human
gaacgcagcgcgcgcagcccuca

SEQ ID NO: 1289840 - RNA, 19 nt, Human
gccgcccaggcccccacag

SEQ ID NO: 1289841 - RNA, 23 nt, Human
gcgaacgcagcgcgcgcagcccu

SEQ ID NO: 1289842 - RNA, 21 nt, Human
ggccgccgccgggcagggggc

SEQ ID NO: 1289843 - RNA, 20 nt, Human
ucccgaaagcaccuccuccc

SEQ ID NO: 1289844 - RNA, 23 nt, Human
ucgggggcgccgccgcccaggcc

SEQ ID NO: 1289845 - RNA, 19 nt, Human
uggcgcgcgcgggccccgg

SEQ ID NO: 1289846 - RNA, 18 nt, Human
uuucccccgcccaccccg

SEQ ID NO: 1289847 - RNA, 19 nt, Human
acccuccccuccacuccca

SEQ ID NO: 1289848 - RNA, 23 nt, Human
acgcagucgaccccucugagcgc

SEQ ID NO: 1289849 - RNA, 19 nt, Human
agacaacauucccaguucu

SEQ ID NO: 1289850 - RNA, 19 nt, Human
agaggcuccuccacggccc

SEQ ID NO: 1289851 - RNA, 18 nt, Human
agccccgggacccggagc

SEQ ID NO: 1289852 - RNA, 24 nt, Human
agcgccucgggagccccgaauagc

SEQ ID NO: 1289853 - RNA, 18 nt, Human
agcugggugggcaggggc

SEQ ID NO: 1289854 - RNA, 28 nt, Human
aucacccuggagcugggugggcaggggc

SEQ ID NO: 1289855 - RNA, 18 nt, Human
cacagcgcuggcguuccu

SEQ ID NO: 1289856 - RNA, 21 nt, Human
cacccuggagcugggugggca

SEQ ID NO: 1289857 - RNA, 21 nt, Human
cacuuccgcuuccggcaagga

SEQ ID NO: 1289858 - RNA, 19 nt, Human
cagaggcuccuccacggcc

SEQ ID NO: 1289859 - RNA, 18 nt, Human
cagcagcccugagaaagg

SEQ ID NO: 1289860 - RNA, 20 nt, Human
cagcccugagaaagggacug

SEQ ID NO: 1289861 - RNA, 18 nt, Human
caggccagucccuccugc

SEQ ID NO: 1289862 - RNA, 22 nt, Human
cagucgaccccucugagcgccu

SEQ ID NO: 1289863 - RNA, 18 nt, Human
cccacggccuggcccgag

SEQ ID NO: 1289864 - RNA, 20 nt, Human
cccacggccuggcccgaggc

SEQ ID NO: 1289865 - RNA, 19 nt, Human
ccuccccuccacucccaga

SEQ ID NO: 1289866 - RNA, 23 nt, Human
ccuccugccccuauuucccuauc

SEQ ID NO: 1289867 - RNA, 22 nt, Human
ccuccuuuuacccuccccucca

SEQ ID NO: 1289868 - RNA, 25 nt, Human
ccuccuuuuacccuccccuccacuc

SEQ ID NO: 1289869 - RNA, 21 nt, Human
ccucugagggguucucagccc

SEQ ID NO: 1289870 - RNA, 20 nt, Human
ccucuggggcuccaucaccc

SEQ ID NO: 1289871 - RNA, 20 nt, Human
cgcugagacaacauucccag

SEQ ID NO: 1289872 - RNA, 22 nt, Human
cgugcuugccggccgucgccgu

SEQ ID NO: 1289873 - RNA, 21 nt, Human
cguggcaggaacgcgugcgcg

SEQ ID NO: 1289874 - RNA, 21 nt, Human
cuccgauaucccaaaccacag

SEQ ID NO: 1289875 - RNA, 21 nt, Human
cuccuuuuacccuccccucca

SEQ ID NO: 1289876 - RNA, 21 nt, Human
cucggaccccagccugcuggc

SEQ ID NO: 1289877 - RNA, 18 nt, Human
cucugagggguucucagc

SEQ ID NO: 1289878 - RNA, 19 nt, Human
cuggcccuggggcgcgggg

SEQ ID NO: 1289879 - RNA, 20 nt, Human
cuuuuacccuccccuccacu

SEQ ID NO: 1289880 - RNA, 20 nt, Human
gacaacauucccaguucucc

SEQ ID NO: 1289881 - RNA, 21 nt, Human
gagguucucggaccccagccu

SEQ ID NO: 1289882 - RNA, 22 nt, Human
gccaccagcacuguccccagaa

SEQ ID NO: 1289883 - RNA, 19 nt, Human
gcccgcugccggccgggcu

SEQ ID NO: 1289884 - RNA, 20 nt, Human
gcuccuccacggcccucccc

SEQ ID NO: 1289885 - RNA, 23 nt, Human
ggacccccagccagaugucccaa

SEQ ID NO: 1289886 - RNA, 19 nt, Human
ggagcugggugggcagggg

SEQ ID NO: 1289887 - RNA, 22 nt, Human
ggcagcucccuccugaucucgg

SEQ ID NO: 1289888 - RNA, 20 nt, Human
gggcaaggaggggccucggc

SEQ ID NO: 1289889 - RNA, 22 nt, Human
gggcagccagagccugguggga

SEQ ID NO: 1289890 - RNA, 22 nt, Human
gggcugcagcugcaggccaguc

SEQ ID NO: 1289891 - RNA, 19 nt, Human
ggggcuccaucacccugga

SEQ ID NO: 1289892 - RNA, 28 nt, Human
gucacgccaccacagcgagucugcgcgg

SEQ ID NO: 1289893 - RNA, 20 nt, Human
uagcagcugggagaaggggc

SEQ ID NO: 1289894 - RNA, 18 nt, Human
uagccuggccccuggguu

SEQ ID NO: 1289895 - RNA, 20 nt, Human
ucccagacugggcagcuccc

SEQ ID NO: 1289896 - RNA, 22 nt, Human
uccccuggcgagccaccuccuu

SEQ ID NO: 1289897 - RNA, 24 nt, Human
uccucuggggcuccaucacccugg

SEQ ID NO: 1289898 - RNA, 24 nt, Human
ucucggaccccagccugcuggccc

SEQ ID NO: 1289899 - RNA, 26 nt, Human
ugccccacggacgcagucgaccccuc

SEQ ID NO: 1289900 - RNA, 18 nt, Human
uggagggcagccagagcc

SEQ ID NO: 1289901 - RNA, 20 nt, Human
uggccccuggguugugcccc

SEQ ID NO: 1289902 - RNA, 21 nt, Human
uggccuccgauaucccaaacc

SEQ ID NO: 1289903 - RNA, 23 nt, Human
ugggacccccagccagauguccc

SEQ ID NO: 1289904 - RNA, 19 nt, Human
ugggagaaggggcgaggac

SEQ ID NO: 1289905 - RNA, 21 nt, Human
ugggagaaggggcgaggacug

SEQ ID NO: 1289906 - RNA, 20 nt, Human
uggguugugccccacggacg

SEQ ID NO: 1289907 - RNA, 20 nt, Human
uuacccuccccuccacuccc

SEQ ID NO: 1289908 - RNA, 19 nt, Human
aagccagcuccaagggcaa

SEQ ID NO: 1289909 - RNA, 23 nt, Human
agagaagccagcuccaagggcag

SEQ ID NO: 1289910 - RNA, 25 nt, Human
gccagcuccaagggcaggggaacgc

SEQ ID NO: 1289911 - RNA, 23 nt, Human
ugacagugugagcaggagucuug

SEQ ID NO: 1289912 - RNA, 23 nt, Human
aaaaagccaagcaggggaccgug

SEQ ID NO: 1289913 - RNA, 18 nt, Human
aaacucacaaaugccuuc

SEQ ID NO: 1289914 - RNA, 21 nt, Human
aaauaaccuuguugauuugaa

SEQ ID NO: 1289915 - RNA, 20 nt, Human
aaccuacucauucagcucug

SEQ ID NO: 1289916 - RNA, 20 nt, Human
aacuguauagcccccacagc

SEQ ID NO: 1289917 - RNA, 19 nt, Human
aagaaacuugauuguggcc

SEQ ID NO: 1289918 - RNA, 20 nt, Human
aagcauuguuaaaaagugag

SEQ ID NO: 1289919 - RNA, 22 nt, Human
agaggauauguggguccagagc

SEQ ID NO: 1289920 - RNA, 22 nt, Human
agagggagggagagagucaggc

SEQ ID NO: 1289921 - RNA, 18 nt, Human
agcugagcuuuggaaagu

SEQ ID NO: 1289922 - RNA, 20 nt, Human
agggaaggggaaaaagccaa

SEQ ID NO: 1289923 - RNA, 19 nt, Human
aggggaaaaagccaagcag

SEQ ID NO: 1289924 - RNA, 23 nt, Human
agguacacagaaaaggcagccuc

SEQ ID NO: 1289925 - RNA, 23 nt, Human
aguaguucccuuccucuucccag

SEQ ID NO: 1289926 - RNA, 20 nt, Human
agugauugguucagaaagaa

SEQ ID NO: 1289927 - RNA, 22 nt, Human
auaagaaucagcaaaugcacaa

SEQ ID NO: 1289928 - RNA, 24 nt, Human
augaugcaagcaaacagacaccac

SEQ ID NO: 1289929 - RNA, 20 nt, Human
augcaagcaaacagacacca

SEQ ID NO: 1289930 - RNA, 23 nt, Human
caagaugccuccugguaaacauc

SEQ ID NO: 1289931 - RNA, 24 nt, Human
caagaugccuccugguaaacauca

SEQ ID NO: 1289932 - RNA, 24 nt, Human
caccaggcucucacugaaugcucu

SEQ ID NO: 1289933 - RNA, 21 nt, Human
cagccuaucacagaguagcac

SEQ ID NO: 1289934 - RNA, 18 nt, Human
cagcuaguuuuaaaaauc

SEQ ID NO: 1289935 - RNA, 21 nt, Human
cagggaaggggaaaaagccaa

SEQ ID NO: 1289936 - RNA, 21 nt, Human
cauagaucacguaaaguccag

SEQ ID NO: 1289937 - RNA, 20 nt, Human
cccacgcccugaaacucaca

SEQ ID NO: 1289938 - RNA, 19 nt, Human
cccugcucucuuggcuguu

SEQ ID NO: 1289939 - RNA, 25 nt, Human
ccucugagagagucacaagggugaa

SEQ ID NO: 1289940 - RNA, 21 nt, Human
ccugauccugcaggaaaacuc

SEQ ID NO: 1289941 - RNA, 18 nt, Human
ccugguaaacaucacugg

SEQ ID NO: 1289942 - RNA, 19 nt, Human
cuggaaucuucugugccug

SEQ ID NO: 1289943 - RNA, 21 nt, Human
cugguggguucaucccuugga

SEQ ID NO: 1289944 - RNA, 19 nt, Human
cuugcagacaauggggcag

SEQ ID NO: 1289945 - RNA, 23 nt, Human
cuuucuggcaagaugccuccugg

SEQ ID NO: 1289946 - RNA, 25 nt, Human
gacaauggggcaguccucugagaga

SEQ ID NO: 1289947 - RNA, 22 nt, Human
gagcaaaucuucauuaaucuua

SEQ ID NO: 1289948 - RNA, 22 nt, Human
gagguaaaauaaugaugaugag

SEQ ID NO: 1289949 - RNA, 20 nt, Human
gaugaugaauaaauggaugg

SEQ ID NO: 1289950 - RNA, 20 nt, Human
gaugaugggcagggaagggg

SEQ ID NO: 1289951 - RNA, 19 nt, Human
gcagggaaggggaaaaagc

SEQ ID NO: 1289952 - RNA, 21 nt, Human
gggaaugaaaggaagaaagga

SEQ ID NO: 1289953 - RNA, 20 nt, Human
gguacugagcagaacaccag

SEQ ID NO: 1289954 - RNA, 21 nt, Human
uaacuaugaauugaugaaccc

SEQ ID NO: 1289955 - RNA, 18 nt, Human
uaagaaacuugauugugg

SEQ ID NO: 1289956 - RNA, 21 nt, Human
uaagaaucagcaaaugcacaa

SEQ ID NO: 1289957 - RNA, 21 nt, Human
uagaaggggacaaaggaggua

SEQ ID NO: 1289958 - RNA, 23 nt, Human
uagaucacguaaaguccagacug

SEQ ID NO: 1289959 - RNA, 22 nt, Human
uagcccccacagcugauuuccu

SEQ ID NO: 1289960 - RNA, 23 nt, Human
uauagcccccacagcugauuucc

SEQ ID NO: 1289961 - RNA, 24 nt, Human
ucaauaagucaaaauucaugagau

SEQ ID NO: 1289962 - RNA, 19 nt, Human
ucacuggguaagcaagagg

SEQ ID NO: 1289963 - RNA, 21 nt, Human
ucaucccuuggacauccuucu

SEQ ID NO: 1289964 - RNA, 21 nt, Human
ucaugucagugauugguucag

SEQ ID NO: 1289965 - RNA, 21 nt, Human
uccaggacugagauuggauuu

SEQ ID NO: 1289966 - RNA, 19 nt, Human
ucccagaaaugcuguuggu

SEQ ID NO: 1289967 - RNA, 22 nt, Human
ucccagaaugauggaugagacu

SEQ ID NO: 1289968 - RNA, 20 nt, Human
uccuuuacuuuuuguucagg

SEQ ID NO: 1289969 - RNA, 19 nt, Human
ucugaaaugaaggagagaa

SEQ ID NO: 1289970 - RNA, 19 nt, Human
ugaaaaaaucaaacagagg

SEQ ID NO: 1289971 - RNA, 24 nt, Human
ugagacuaaugcuaaacacaaugg

SEQ ID NO: 1289972 - RNA, 18 nt, Human
ugagauguaaacuuaccu

SEQ ID NO: 1289973 - RNA, 27 nt, Human
ugauauaccuuuuagugugacauuucu

SEQ ID NO: 1289974 - RNA, 18 nt, Human
ugaugaacccucuucagc

SEQ ID NO: 1289975 - RNA, 20 nt, Human
ugccuccugguaaacaucac

SEQ ID NO: 1289976 - RNA, 19 nt, Human
ugccuggaaaauaauaaga

SEQ ID NO: 1289977 - RNA, 24 nt, Human
uggaaagucuguacaucauaagaa

SEQ ID NO: 1289978 - RNA, 18 nt, Human
uggcaagaugccuccugg

SEQ ID NO: 1289979 - RNA, 25 nt, Human
uggcuccuggaacuguauagccccc

SEQ ID NO: 1289980 - RNA, 19 nt, Human
uggcuguuguuuacagaac

SEQ ID NO: 1289981 - RNA, 21 nt, Human
ugggggguucuaagaagcugu

SEQ ID NO: 1289982 - RNA, 21 nt, Human
uggucauuggucaucauuguc

SEQ ID NO: 1289983 - RNA, 24 nt, Human
uguauccauucacucucuccuuca

SEQ ID NO: 1289984 - RNA, 22 nt, Human
uucagcucuguauccauucacu

SEQ ID NO: 1289985 - RNA, 22 nt, Human
uucauuaauuuaacuaugaauu

SEQ ID NO: 1289986 - RNA, 20 nt, Human
uuccaaugcugcuuccauga

SEQ ID NO: 1289987 - RNA, 22 nt, Human
uucuuaaaggacuagaagggga

SEQ ID NO: 1289988 - RNA, 25 nt, Human
uuuaaaaaucugggcuccaccaacu

SEQ ID NO: 1289989 - RNA, 22 nt, Human
aaucauaaccagucuaaaccaa

SEQ ID NO: 1289990 - RNA, 21 nt, Human
acuugguccacucaucaguga

SEQ ID NO: 1289991 - RNA, 18 nt, Human
agcagccaucuuguggac

SEQ ID NO: 1289992 - RNA, 19 nt, Human
agccacagcagccaucuug

SEQ ID NO: 1289993 - RNA, 21 nt, Human
agggcgcaaggggaaaggccc

SEQ ID NO: 1289994 - RNA, 22 nt, Human
aggggagguuuauacagacagc

SEQ ID NO: 1289995 - RNA, 20 nt, Human
auggggucggggcggacccc

SEQ ID NO: 1289996 - RNA, 20 nt, Human
caccuccaagccuauuccca

SEQ ID NO: 1289997 - RNA, 24 nt, Human
caccuccaagccuauucccaguuc

SEQ ID NO: 1289998 - RNA, 24 nt, Human
cacgcccggcuucggagggcggcu

SEQ ID NO: 1289999 - RNA, 23 nt, Human
ccgccggcccgcuggccucccuc

SEQ ID NO: 1290000 - RNA, 20 nt, Human
ccuauucccaguuccugccu

SEQ ID NO: 1290001 - RNA, 23 nt, Human
ccuggcugauggaaucucaauuu

SEQ ID NO: 1290002 - RNA, 20 nt, Human
cgcaaggggaaaggcccgag

SEQ ID NO: 1290003 - RNA, 24 nt, Human
cggggcggaccccgccggcccgcu

SEQ ID NO: 1290004 - RNA, 20 nt, Human
gagcggggccggggauagga

SEQ ID NO: 1290005 - RNA, 23 nt, Human
gaggggagguuuauacagacagc

SEQ ID NO: 1290006 - RNA, 18 nt, Human
ggacaacaugcacgcucc

SEQ ID NO: 1290007 - RNA, 21 nt, Human
gggucguggauggggucgggg

SEQ ID NO: 1290008 - RNA, 18 nt, Human
ucccaguuccugccucug

SEQ ID NO: 1290009 - RNA, 19 nt, Human
ugcauguggacgugaugcc

SEQ ID NO: 1290010 - RNA, 18 nt, Human
ugccuggagccacagcag

SEQ ID NO: 1290011 - RNA, 22 nt, Human
uggagccacagcagccaucuug

SEQ ID NO: 1290012 - RNA, 23 nt, Human
uggggggugauuuuccuucccaa

SEQ ID NO: 1290013 - RNA, 24 nt, Human
uggggggugauuuuccuucccaag

SEQ ID NO: 1290014 - RNA, 23 nt, Human
uggggucggggcggaccccgcca

SEQ ID NO: 1290015 - RNA, 21 nt, Human
uguccuggccaccuccaagcc

SEQ ID NO: 1290016 - RNA, 19 nt, Human
uuccuucccaaguggaggg

SEQ ID NO: 1290017 - RNA, 24 nt, Human
uugcauguggacgugaugccugga

SEQ ID NO: 1290018 - RNA, 22 nt, Human
gagggcagaacagaauggcugu

SEQ ID NO: 1290019 - RNA, 18 nt, Human
gggcaucugaguuugagg

SEQ ID NO: 1290020 - RNA, 18 nt, Human
ucugaguuugagggcaga

SEQ ID NO: 1290021 - RNA, 19 nt, Human
ggaguaaacauugcuuucu

SEQ ID NO: 1290022 - RNA, 24 nt, Human
ucgcagacauucuguguggccucu

SEQ ID NO: 1290023 - RNA, 19 nt, Human
ucuguguggccuccaagcc

SEQ ID NO: 1290024 - RNA, 19 nt, Human
uggccuccaagcccacugu

SEQ ID NO: 1290025 - RNA, 18 nt, Human
uguagugcagguguagug

SEQ ID NO: 1290026 - RNA, 19 nt, Human
uucuggacuccgacaaucu

SEQ ID NO: 1290027 - RNA, 20 nt, Human
acaaccaacggguccguggg

SEQ ID NO: 1290028 - RNA, 23 nt, Human
acaauggaagggccacaguggcc

SEQ ID NO: 1290029 - RNA, 20 nt, Human
acacagccgggagcucacaa

SEQ ID NO: 1290030 - RNA, 31 nt, Human
acacugccacagucugcaggucccauaagcc

SEQ ID NO: 1290031 - RNA, 21 nt, Human
acagccgggagcucacaaggc

SEQ ID NO: 1290032 - RNA, 18 nt, Human
acaguggccagagguccc

SEQ ID NO: 1290033 - RNA, 19 nt, Human
acaugcugcaugucccaca

SEQ ID NO: 1290034 - RNA, 22 nt, Human
acucaggcugacccuugggucc

SEQ ID NO: 1290035 - RNA, 22 nt, Human
acuugaccagugugugaccacu

SEQ ID NO: 1290036 - RNA, 23 nt, Human
agagaagccacccuaacaguggg

SEQ ID NO: 1290037 - RNA, 24 nt, Human
agcacagcugccacucaccugccc

SEQ ID NO: 1290038 - RNA, 22 nt, Human
agcaguacacacucugccucug

SEQ ID NO: 1290039 - RNA, 18 nt, Human
agccuggcaggagaggcc

SEQ ID NO: 1290040 - RNA, 18 nt, Human
aggaagacauguaccagc

SEQ ID NO: 1290041 - RNA, 21 nt, Human
aggcaguggcugggucucagg

SEQ ID NO: 1290042 - RNA, 22 nt, Human
aggcaguggcugggucucaggg

SEQ ID NO: 1290043 - RNA, 21 nt, Human
aggccccaggccacccuccag

SEQ ID NO: 1290044 - RNA, 23 nt, Human
aggccuuggagcacucccuccag

SEQ ID NO: 1290045 - RNA, 18 nt, Human
aggcgcagugucucacag

SEQ ID NO: 1290046 - RNA, 21 nt, Human
aggcucaggcgugugcccgag

SEQ ID NO: 1290047 - RNA, 24 nt, Human
agggccacagguggcagcggcggg

SEQ ID NO: 1290048 - RNA, 18 nt, Human
agggcugagggacucagg

SEQ ID NO: 1290049 - RNA, 21 nt, Human
aggggcaccucagggcugagg

SEQ ID NO: 1290050 - RNA, 25 nt, Human
agggggaggagcuccccagccugcc

SEQ ID NO: 1290051 - RNA, 19 nt, Human
aguacacacucugccucug

SEQ ID NO: 1290052 - RNA, 23 nt, Human
agugccaggagaacucgggcggc

SEQ ID NO: 1290053 - RNA, 26 nt, Human
auggccucgggagggggagccguggc

SEQ ID NO: 1290054 - RNA, 19 nt, Human
cacacuugaccagugugug

SEQ ID NO: 1290055 - RNA, 19 nt, Human
cacagaacccgaaggacag

SEQ ID NO: 1290056 - RNA, 23 nt, Human
cacagccgggagcucacaaggcc

SEQ ID NO: 1290057 - RNA, 22 nt, Human
cacaggccccaggccacccucc

SEQ ID NO: 1290058 - RNA, 23 nt, Human
cacaguucacuauccacaggccc

SEQ ID NO: 1290059 - RNA, 23 nt, Human
caccacaggggccugagcacugg

SEQ ID NO: 1290060 - RNA, 21 nt, Human
caccaccuggcagggcagggc

SEQ ID NO: 1290061 - RNA, 24 nt, Human
cacccaggccacaggugguggagc

SEQ ID NO: 1290062 - RNA, 23 nt, Human
caccccaggguugcucuccugga

SEQ ID NO: 1290063 - RNA, 21 nt, Human
caccucugccacaggugacug

SEQ ID NO: 1290064 - RNA, 25 nt, Human
caccuggcagggcagggcugcuggc

SEQ ID NO: 1290065 - RNA, 21 nt, Human
cacucugccucugcacaccuc

SEQ ID NO: 1290066 - RNA, 19 nt, Human
cacugggugcggacggugg

SEQ ID NO: 1290067 - RNA, 19 nt, Human
cagagcugacucccaggcu

SEQ ID NO: 1290068 - RNA, 19 nt, Human
cagcccguggugggcacug

SEQ ID NO: 1290069 - RNA, 18 nt, Human
cagccggcguuccugaca

SEQ ID NO: 1290070 - RNA, 20 nt, Human
cagccgggagcucacaaggc

SEQ ID NO: 1290071 - RNA, 21 nt, Human
cagcggcgggcaggcuggggc

SEQ ID NO: 1290072 - RNA, 22 nt, Human
cagcggcgggcaggcuggggcc

SEQ ID NO: 1290073 - RNA, 19 nt, Human
caggagaacucgggcggca

SEQ ID NO: 1290074 - RNA, 18 nt, Human
cagggcagggcugcuggc

SEQ ID NO: 1290075 - RNA, 22 nt, Human
cagucaggguuguggggaggaa

SEQ ID NO: 1290076 - RNA, 19 nt, Human
cagugugugaccacuggau

SEQ ID NO: 1290077 - RNA, 20 nt, Human
ccacaggccccaggccaccc

SEQ ID NO: 1290078 - RNA, 19 nt, Human
ccaccaccacaggggccug

SEQ ID NO: 1290079 - RNA, 23 nt, Human
ccaccaccacaggggccugagca

SEQ ID NO: 1290080 - RNA, 21 nt, Human
ccagccccacgcugcggaugc

SEQ ID NO: 1290081 - RNA, 23 nt, Human
ccaggcugggaggcaguggcugg

SEQ ID NO: 1290082 - RNA, 21 nt, Human
cccacagugccaggagaacuc

SEQ ID NO: 1290083 - RNA, 18 nt, Human
cccaggccacccuccaga

SEQ ID NO: 1290084 - RNA, 22 nt, Human
cccaggguugcucuccuggaac

SEQ ID NO: 1290085 - RNA, 28 nt, Human
cccauguguccacaugcugcauguccca

SEQ ID NO: 1290086 - RNA, 19 nt, Human
ccccagggccccaccaccc

SEQ ID NO: 1290087 - RNA, 18 nt, Human
cccgcucacagcggggag

SEQ ID NO: 1290088 - RNA, 22 nt, Human
cccggcugcaggggacuguccu

SEQ ID NO: 1290089 - RNA, 18 nt, Human
cccuccagagcugacucc

SEQ ID NO: 1290090 - RNA, 21 nt, Human
ccgagcaguacacacucugcc

SEQ ID NO: 1290091 - RNA, 21 nt, Human
ccgcaggagcuggagcacagc

SEQ ID NO: 1290092 - RNA, 20 nt, Human
ccuacguggccggacagggc

SEQ ID NO: 1290093 - RNA, 19 nt, Human
ccuccagagcugacuccca

SEQ ID NO: 1290094 - RNA, 19 nt, Human
ccugagcacuggccccagg

SEQ ID NO: 1290095 - RNA, 19 nt, Human
ccuggcacugucaguggcg

SEQ ID NO: 1290096 - RNA, 18 nt, Human
ccugggguugggaaggag

SEQ ID NO: 1290097 - RNA, 20 nt, Human
cgagggggaggagcucccca

SEQ ID NO: 1290098 - RNA, 19 nt, Human
cgcuccaguuucccacuug

SEQ ID NO: 1290099 - RNA, 18 nt, Human
cggacagggcacauggug

SEQ ID NO: 1290100 - RNA, 19 nt, Human
cggagagcacgagcggcag

SEQ ID NO: 1290101 - RNA, 22 nt, Human
cggcugcaggggacuguccuug

SEQ ID NO: 1290102 - RNA, 20 nt, Human
cgggagggggagccguggcu

SEQ ID NO: 1290103 - RNA, 24 nt, Human
cucacagaacccgaaggacaggcg

SEQ ID NO: 1290104 - RNA, 22 nt, Human
cucgggggcagguggggugcuc

SEQ ID NO: 1290105 - RNA, 18 nt, Human
cucugccacagcuguggg

SEQ ID NO: 1290106 - RNA, 22 nt, Human
cugacucccaggcuacuguccc

SEQ ID NO: 1290107 - RNA, 25 nt, Human
cuggccccagggccccaccacccac

SEQ ID NO: 1290108 - RNA, 23 nt, Human
cuggggccggccagcggggucgc

SEQ ID NO: 1290109 - RNA, 18 nt, Human
gaacccgaaggacaggcg

SEQ ID NO: 1290110 - RNA, 18 nt, Human
gacagcagccuagagcuc

SEQ ID NO: 1290111 - RNA, 24 nt, Human
gagaagccacccuaacagugggcc

SEQ ID NO: 1290112 - RNA, 22 nt, Human
gagagaagccacccuaacagug

SEQ ID NO: 1290113 - RNA, 18 nt, Human
gagcacagccuggcagga

SEQ ID NO: 1290114 - RNA, 23 nt, Human
gagggacucaggcugacccuugg

SEQ ID NO: 1290115 - RNA, 20 nt, Human
gcagggccgggugguguugg

SEQ ID NO: 1290116 - RNA, 24 nt, Human
gcagguggggugcuccgcagcccu

SEQ ID NO: 1290117 - RNA, 19 nt, Human
gccacucaccugcccacca

SEQ ID NO: 1290118 - RNA, 19 nt, Human
gccuagagcucaggggcac

SEQ ID NO: 1290119 - RNA, 24 nt, Human
gccucgggagggggagccguggcu

SEQ ID NO: 1290120 - RNA, 18 nt, Human
gcuacagcacaccggccu

SEQ ID NO: 1290121 - RNA, 19 nt, Human
gcucugcucauccagcccc

SEQ ID NO: 1290122 - RNA, 18 nt, Human
gcugggucucgggggcag

SEQ ID NO: 1290123 - RNA, 20 nt, Human
ggaagggccacaguggccag

SEQ ID NO: 1290124 - RNA, 22 nt, Human
ggacagcagccuagagcucagg

SEQ ID NO: 1290125 - RNA, 21 nt, Human
ggagcucacaaggccaggccu

SEQ ID NO: 1290126 - RNA, 19 nt, Human
ggagcuccgccacagcccu

SEQ ID NO: 1290127 - RNA, 23 nt, Human
ggcagcguggggcugggucucgg

SEQ ID NO: 1290128 - RNA, 23 nt, Human
ggcagggcugcuggcugcacuuc

SEQ ID NO: 1290129 - RNA, 19 nt, Human
ggcuaugggaggaggaggg

SEQ ID NO: 1290130 - RNA, 18 nt, Human
ggcugcaggggacugucc

SEQ ID NO: 1290131 - RNA, 20 nt, Human
ggcugggaggcaguggcugg

SEQ ID NO: 1290132 - RNA, 18 nt, Human
ggcugggccccgcagggc

SEQ ID NO: 1290133 - RNA, 25 nt, Human
gggaggcucgacgggcucacaaucc

SEQ ID NO: 1290134 - RNA, 24 nt, Human
gggcagcguggggcugggucucgg

SEQ ID NO: 1290135 - RNA, 18 nt, Human
gggccccaccacccacug

SEQ ID NO: 1290136 - RNA, 18 nt, Human
gggcguagggggcgggag

SEQ ID NO: 1290137 - RNA, 19 nt, Human
ggguugggaaggagggagu

SEQ ID NO: 1290138 - RNA, 27 nt, Human
gucccacacugaggaaccucugccaca

SEQ ID NO: 1290139 - RNA, 23 nt, Human
gucugcaggucccauaagccugg

SEQ ID NO: 1290140 - RNA, 24 nt, Human
gugcagggguggguguugcagggc

SEQ ID NO: 1290141 - RNA, 21 nt, Human
gugccuccucgcagaggucug

SEQ ID NO: 1290142 - RNA, 24 nt, Human
gugguugcaagggguuucaguagg

SEQ ID NO: 1290143 - RNA, 22 nt, Human
uaccuuuuucgagggggaggag

SEQ ID NO: 1290144 - RNA, 18 nt, Human
ucacagugcuccucgucc

SEQ ID NO: 1290145 - RNA, 18 nt, Human
ucaccaccgccacaggcc

SEQ ID NO: 1290146 - RNA, 20 nt, Human
uccccagccugccgcugggu

SEQ ID NO: 1290147 - RNA, 21 nt, Human
uccuggguucagggcaggcuc

SEQ ID NO: 1290148 - RNA, 19 nt, Human
ucgggggcagguggggugc

SEQ ID NO: 1290149 - RNA, 19 nt, Human
ucguagugcaccccagggu

SEQ ID NO: 1290150 - RNA, 20 nt, Human
ucucaggggcucuguggcuc

SEQ ID NO: 1290151 - RNA, 24 nt, Human
ucucgggggcagguggggugcucc

SEQ ID NO: 1290152 - RNA, 22 nt, Human
ugaccagugugugaccacugga

SEQ ID NO: 1290153 - RNA, 21 nt, Human
ugagugccagguggcacaggg

SEQ ID NO: 1290154 - RNA, 19 nt, Human
ugccacacagccgggagcu

SEQ ID NO: 1290155 - RNA, 18 nt, Human
uggaugccaccaccacag

SEQ ID NO: 1290156 - RNA, 18 nt, Human
uggcagcggcccaguagg

SEQ ID NO: 1290157 - RNA, 20 nt, Human
uggcagggcagggcugcugg

SEQ ID NO: 1290158 - RNA, 25 nt, Human
uggcauggacagcagccuagagcuc

SEQ ID NO: 1290159 - RNA, 22 nt, Human
uggccccagggccccaccaccc

SEQ ID NO: 1290160 - RNA, 18 nt, Human
ugggagcacuuacuccag

SEQ ID NO: 1290161 - RNA, 18 nt, Human
ugggcagcguggggcugg

SEQ ID NO: 1290162 - RNA, 18 nt, Human
ugggcagcuggcagcggc

SEQ ID NO: 1290163 - RNA, 26 nt, Human
ugggccccgcagggccaggacccguc

SEQ ID NO: 1290164 - RNA, 21 nt, Human
ugguccagggcccacagugcc

SEQ ID NO: 1290165 - RNA, 19 nt, Human
ugucagccggcguuccuga

SEQ ID NO: 1290166 - RNA, 24 nt, Human
ugugcagggguggguguugcaggg

SEQ ID NO: 1290167 - RNA, 19 nt, Human
uguugcagggccggguggu

SEQ ID NO: 1290168 - RNA, 19 nt, Human
uuacuccaguugccugagu

SEQ ID NO: 1290169 - RNA, 24 nt, Human
aagcuggcuucacagagaaggugc

SEQ ID NO: 1290170 - RNA, 19 nt, Human
acccugggggaccgagggg

SEQ ID NO: 1290171 - RNA, 19 nt, Human
agaggaggggaguguuuga

SEQ ID NO: 1290172 - RNA, 18 nt, Human
cacugucacccggcagcc

SEQ ID NO: 1290173 - RNA, 18 nt, Human
cacugucacccggcagcc

SEQ ID NO: 1290174 - RNA, 25 nt, Human
cagagucagcuggucacugucaccc

SEQ ID NO: 1290175 - RNA, 25 nt, Human
cagagucagcuggucacugucaccc

SEQ ID NO: 1290176 - RNA, 22 nt, Human
ccagggacagagcccucucggg

SEQ ID NO: 1290177 - RNA, 21 nt, Human
ccaucugcaguggccgcaaag

SEQ ID NO: 1290178 - RNA, 20 nt, Human
ccccagggacagagcccucu

SEQ ID NO: 1290179 - RNA, 22 nt, Human
ccccagggacagagcccucucg

SEQ ID NO: 1290180 - RNA, 18 nt, Human
ccgcacggccuccgaugc

SEQ ID NO: 1290181 - RNA, 24 nt, Human
ccggcagcccggauuccgcgccca

SEQ ID NO: 1290182 - RNA, 24 nt, Human
ccggcagcccggauuccgcgccca

SEQ ID NO: 1290183 - RNA, 26 nt, Human
ccugccagaggcuccccagggacaga

SEQ ID NO: 1290184 - RNA, 19 nt, Human
cgcaaagacuaaagaggag

SEQ ID NO: 1290185 - RNA, 21 nt, Human
cgcgccuccgguaggcuccag

SEQ ID NO: 1290186 - RNA, 21 nt, Human
cgcgccuccgguaggcuccag

SEQ ID NO: 1290187 - RNA, 21 nt, Human
cgcucggacuccucgccgccc

SEQ ID NO: 1290188 - RNA, 21 nt, Human
cgcucggacuccucgccgccc

SEQ ID NO: 1290189 - RNA, 19 nt, Human
cgggggcuguggcggcuuu

SEQ ID NO: 1290190 - RNA, 19 nt, Human
gcagcaacugagcgcaccc

SEQ ID NO: 1290191 - RNA, 18 nt, Human
gggggcggucccggggag

SEQ ID NO: 1290192 - RNA, 19 nt, Human
ucacugucacccggcagcc

SEQ ID NO: 1290193 - RNA, 19 nt, Human
ucacugucacccggcagcc

SEQ ID NO: 1290194 - RNA, 19 nt, Human
ucccggggaggggcgcggc

SEQ ID NO: 1290195 - RNA, 19 nt, Human
ucccugacauuugcuaccu

SEQ ID NO: 1290196 - RNA, 18 nt, Human
ucgccgcccgcccggggc

SEQ ID NO: 1290197 - RNA, 18 nt, Human
ucgccgcccgcccggggc

SEQ ID NO: 1290198 - RNA, 19 nt, Human
ucggacuccucgccgcccg

SEQ ID NO: 1290199 - RNA, 19 nt, Human
ucggacuccucgccgcccg

SEQ ID NO: 1290200 - RNA, 24 nt, Human
ucgggggcuguggcggcuuuuccc

SEQ ID NO: 1290201 - RNA, 19 nt, Human
ucuccagcggcuguucggc

SEQ ID NO: 1290202 - RNA, 19 nt, Human
ucuccagcggcuguucggc

SEQ ID NO: 1290203 - RNA, 21 nt, Human
ucucccugacauuugcuaccu

SEQ ID NO: 1290204 - RNA, 22 nt, Human
ugagcgcacccugggggaccga

SEQ ID NO: 1290205 - RNA, 21 nt, Human
ugccagaggcuccccagggac

SEQ ID NO: 1290206 - RNA, 20 nt, Human
uggcggggcgcacgggcagc

SEQ ID NO: 1290207 - RNA, 21 nt, Human
aaacacggccuuggaaagaaa

SEQ ID NO: 1290208 - RNA, 19 nt, Human
acagagcuucaccccugac

SEQ ID NO: 1290209 - RNA, 19 nt, Human
acagagcuucaccccugac

SEQ ID NO: 1290210 - RNA, 21 nt, Human
agaaaggcuuccagcugcaga

SEQ ID NO: 1290211 - RNA, 19 nt, Human
aggagcugcucagcggcca

SEQ ID NO: 1290212 - RNA, 24 nt, Human
caaaccacauaguccgaggaaucg

SEQ ID NO: 1290213 - RNA, 19 nt, Human
cacacauggucagcaggau

SEQ ID NO: 1290214 - RNA, 23 nt, Human
cacucugucccuguagcaguuca

SEQ ID NO: 1290215 - RNA, 24 nt, Human
cagcaggauggagugcaggggcuc

SEQ ID NO: 1290216 - RNA, 23 nt, Human
ccagcugcagaaagcagggcuga

SEQ ID NO: 1290217 - RNA, 20 nt, Human
cccuguagcaguucaggggc

SEQ ID NO: 1290218 - RNA, 25 nt, Human
ccgacaagcuuccagaaccgacugc

SEQ ID NO: 1290219 - RNA, 21 nt, Human
ccuccucagacagagcuucac

SEQ ID NO: 1290220 - RNA, 23 nt, Human
cuccucagacagagcuucacccc

SEQ ID NO: 1290221 - RNA, 20 nt, Human
cuuccagaaccgacugcaac

SEQ ID NO: 1290222 - RNA, 22 nt, Human
gaaagcagggcugaccaggggc

SEQ ID NO: 1290223 - RNA, 23 nt, Human
gaacaggagggaccagauuuccu

SEQ ID NO: 1290224 - RNA, 18 nt, Human
gaccagauuuccuccuca

SEQ ID NO: 1290225 - RNA, 23 nt, Human
gaggucuuccaggagcugcucag

SEQ ID NO: 1290226 - RNA, 26 nt, Human
gauggagugcaggggcucgcagagcu

SEQ ID NO: 1290227 - RNA, 20 nt, Human
gccuuggaaagaaaggcuuc

SEQ ID NO: 1290228 - RNA, 18 nt, Human
ggaaagaaaggcuuccag

SEQ ID NO: 1290229 - RNA, 19 nt, Human
ggucuuccaggagcugcuc

SEQ ID NO: 1290230 - RNA, 23 nt, Human
ucccuguagcaguucaggggccu

SEQ ID NO: 1290231 - RNA, 23 nt, Human
ucugucccuguagcaguucaggg

SEQ ID NO: 1290232 - RNA, 19 nt, Human
ugaaaggagcagccucuau

SEQ ID NO: 1290233 - RNA, 21 nt, Human
uucacacauggucagcaggau

SEQ ID NO: 1290234 - RNA, 23 nt, Human
aaaaaguuuuaacuacagagacu

SEQ ID NO: 1290235 - RNA, 21 nt, Human
aaucuuuaauacuuaacaaag

SEQ ID NO: 1290236 - RNA, 25 nt, Human
cuugaaagcaaccacagaaaauaaa

SEQ ID NO: 1290237 - RNA, 20 nt, Human
gaaaaaguuuuaacuacaga

SEQ ID NO: 1290238 - RNA, 22 nt, Human
gagcaaugaaaaaaaaaaucuu

SEQ ID NO: 1290239 - RNA, 26 nt, Human
uaaccaagaacuaaguauauaccuca

SEQ ID NO: 1290240 - RNA, 18 nt, Human
uagcuugaaagcaaccac

SEQ ID NO: 1290241 - RNA, 22 nt, Human
ucuacaauuguagcuugaaagc

SEQ ID NO: 1290242 - RNA, 25 nt, Human
ugacauuccauuguucuacgucccu

SEQ ID NO: 1290243 - RNA, 21 nt, Human
ugggagcaaugaaaaaaaaaa

SEQ ID NO: 1290244 - RNA, 20 nt, Human
uguaaauucugguguaacuu

SEQ ID NO: 1290245 - RNA, 22 nt, Human
uuaguauuauuaauacaaugac

SEQ ID NO: 1290246 - RNA, 24 nt, Human
uuaguauuauuaauacaaugacuu

SEQ ID NO: 1290247 - RNA, 21 nt, Human
aaaguggccugcccagacuau

SEQ ID NO: 1290248 - RNA, 19 nt, Human
agacuauuuugguagcaag

SEQ ID NO: 1290249 - RNA, 23 nt, Human
agcaagcguggaaaucagaucug

SEQ ID NO: 1290250 - RNA, 21 nt, Human
aggaagucugcauuaucacga

SEQ ID NO: 1290251 - RNA, 18 nt, Human
cacaccaaagcaucagcc

SEQ ID NO: 1290252 - RNA, 21 nt, Human
cagagugcuggccacaccaaa

SEQ ID NO: 1290253 - RNA, 22 nt, Human
caguaaggaauuacaaauccug

SEQ ID NO: 1290254 - RNA, 20 nt, Human
ccacagagagaagaaaaggg

SEQ ID NO: 1290255 - RNA, 18 nt, Human
ccuguguuuguacuccag

SEQ ID NO: 1290256 - RNA, 26 nt, Human
cgaaaucgaaagcggccgccugcuca

SEQ ID NO: 1290257 - RNA, 20 nt, Human
cgccuacuuccaaaaguggc

SEQ ID NO: 1290258 - RNA, 24 nt, Human
cucaaggcaaauuucaaguaacuc

SEQ ID NO: 1290259 - RNA, 22 nt, Human
cuuccaaaaguggccugcccag

SEQ ID NO: 1290260 - RNA, 22 nt, Human
gcagcugccuacucugcagcug

SEQ ID NO: 1290261 - RNA, 23 nt, Human
ggaagucugcauuaucacgagga

SEQ ID NO: 1290262 - RNA, 24 nt, Human
ggggaaagcgaaaucgaaagcggc

SEQ ID NO: 1290263 - RNA, 20 nt, Human
uaacgccuacuuccaaaagu

SEQ ID NO: 1290264 - RNA, 19 nt, Human
uagcaagcguggaaaucag

SEQ ID NO: 1290265 - RNA, 24 nt, Human
uagcugaucaucuuuccguacauu

SEQ ID NO: 1290266 - RNA, 18 nt, Human
ucugcagcugugguucuc

SEQ ID NO: 1290267 - RNA, 21 nt, Human
ugagaaucucgggagcagccc

SEQ ID NO: 1290268 - RNA, 22 nt, Human
uggaaaggagguaacacacuca

SEQ ID NO: 1290269 - RNA, 22 nt, Human
uuacaguaaggaauuacaaauc

SEQ ID NO: 1290270 - RNA, 23 nt, Human
uuaggggaaagcgaaaucgaaag

SEQ ID NO: 1290271 - RNA, 18 nt, Human
uucagagugcuggccaca

SEQ ID NO: 1290272 - RNA, 21 nt, Human
ccaagagauaaugaugccuag

SEQ ID NO: 1290273 - RNA, 20 nt, Human
ugaaaucacugugcccaggg

SEQ ID NO: 1290274 - RNA, 19 nt, Human
uugcauguggcuucuuacc

SEQ ID NO: 1290275 - RNA, 23 nt, Human
aaaaugauccugccccaagacua

SEQ ID NO: 1290276 - RNA, 21 nt, Human
aaacaaacaacaaguacuuua

SEQ ID NO: 1290277 - RNA, 21 nt, Human
aaacaggaauaauaaaaacaa

SEQ ID NO: 1290278 - RNA, 31 nt, Human; identical to SEQ ID NO: 261317

SEQ ID NO: 1290279 - RNA, 21 nt, Human
aacacuguagaaagaagaaga

SEQ ID NO: 1290280 - RNA, 18 nt, Human
aacccuggggagaagaca

SEQ ID NO: 1290281 - RNA, 24 nt, Human
acuccaaggaaagccuaucuuggg

SEQ ID NO: 1290282 - RNA, 22 nt, Human
agaugacaucacuaauaugaaa

SEQ ID NO: 1290283 - RNA, 20 nt, Human
agcaaggaagacagaaauca

SEQ ID NO: 1290284 - RNA, 22 nt, Human
agcacaguaugaguuaggugag

SEQ ID NO: 1290285 - RNA, 23 nt, Human
agccagggagcauagaagacaaa

SEQ ID NO: 1290286 - RNA, 18 nt, Human
agucacauguucucagca

SEQ ID NO: 1290287 - RNA, 25 nt, Human
auagccucacucucuuucuucuguc

SEQ ID NO: 1290288 - RNA, 24 nt, Human
auccugcucauccugcucauucuc

SEQ ID NO: 1290289 - RNA, 19 nt, Human
aucugggccuucugcugcc

SEQ ID NO: 1290290 - RNA, 18 nt, Human
augagacagagaaggagu

SEQ ID NO: 1290291 - RNA, 18 nt, Human
augcuuuccagguguggg

SEQ ID NO: 1290292 - RNA, 25 nt, Human
caaaaugauccugccccaagacuaa

SEQ ID NO: 1290293 - RNA, 19 nt, Human
caaugggcuugaugacaaa

SEQ ID NO: 1290294 - RNA, 23 nt, Human
caaugggcuugaugacaaaguuc

SEQ ID NO: 1290295 - RNA, 20 nt, Human
cacacgcucauucuucucug

SEQ ID NO: 1290296 - RNA, 18 nt, Human
cauagaagacaaaguccg

SEQ ID NO: 1290297 - RNA, 26 nt, Human
cauccugcucauccugcucauucuca

SEQ ID NO: 1290298 - RNA, 19 nt, Human
cccuagaggcugggugccu

SEQ ID NO: 1290299 - RNA, 18 nt, Human
ccuucugcugccacucca

SEQ ID NO: 1290300 - RNA, 23 nt, Human
ccuucugcugccacuccauagcc

SEQ ID NO: 1290301 - RNA, 22 nt, Human
ccuugagggcugaacccugggg

SEQ ID NO: 1290302 - RNA, 21 nt, Human
cgcucauucuucucugccuca

SEQ ID NO: 1290303 - RNA, 23 nt, Human
cugcacacgcucauucuucucug

SEQ ID NO: 1290304 - RNA, 18 nt, Human
cugcugccacuccauagc

SEQ ID NO: 1290305 - RNA, 19 nt, Human
cugucgggccaguuccagc

SEQ ID NO: 1290306 - RNA, 20 nt, Human
gcucauucuucucugccuca

SEQ ID NO: 1290307 - RNA, 18 nt, Human
gucaaugugcugcuuguu

SEQ ID NO: 1290308 - RNA, 18 nt, Human
gugggacaaggaaaaagg

SEQ ID NO: 1290309 - RNA, 19 nt, Human
gugggacaaggaaaaaggg

SEQ ID NO: 1290310 - RNA, 22 nt, Human
uagccucacucucuuucuucug

SEQ ID NO: 1290311 - RNA, 23 nt, Human
uaggucagcacuagccucugccc

SEQ ID NO: 1290312 - RNA, 25 nt, Human
uaugaccuauagugacagaugacau

SEQ ID NO: 1290313 - RNA, 25 nt, Human
uauggugggacaggggggaaaauuc

SEQ ID NO: 1290314 - RNA, 24 nt, Human
ucacugcgguccuuggccauagcc

SEQ ID NO: 1290315 - RNA, 22 nt, Human
uccaagucuuccuguaccaucu

SEQ ID NO: 1290316 - RNA, 19 nt, Human
uccuguaccaucugggccu

SEQ ID NO: 1290317 - RNA, 24 nt, Human
ucugcagccagggagcauagaaga

SEQ ID NO: 1290318 - RNA, 18 nt, Human
ugacagaugacaucacua

SEQ ID NO: 1290319 - RNA, 23 nt, Human
ugaccuauagugacagaugacau

SEQ ID NO: 1290320 - RNA, 21 nt, Human
ugagggagguucuaagcuaga

SEQ ID NO: 1290321 - RNA, 24 nt, Human
ugagggagguucuaagcuagaggc

SEQ ID NO: 1290322 - RNA, 25 nt, Human
ugcauuagcaaggaagacagaaauc

SEQ ID NO: 1290323 - RNA, 18 nt, Human
ugcuuuccagguguggga

SEQ ID NO: 1290324 - RNA, 19 nt, Human
uggccagcuccgaaguggg

SEQ ID NO: 1290325 - RNA, 20 nt, Human
ugggggccuucaggugcuuc

SEQ ID NO: 1290326 - RNA, 22 nt, Human
ugguaaaggaaugaggccaaaa

SEQ ID NO: 1290327 - RNA, 27 nt, Human
uuuauggugggacaggggggaaaauuc

SEQ ID NO: 1290328 - RNA, 19 nt, Human
aagcgcucccugagggugg

SEQ ID NO: 1290329 - RNA, 22 nt, Human
aaucuaguugaaaugugaucuc

SEQ ID NO: 1290330 - RNA, 24 nt, Human
acgugagcagaagguacuccaguu

SEQ ID NO: 1290331 - RNA, 19 nt, Human
cccugagggugggccaccu

SEQ ID NO: 1290332 - RNA, 19 nt, Human
gggaaaugagaagcccucc

SEQ ID NO: 1290333 - RNA, 19 nt, Human
uaaugugguauuggggaaa

SEQ ID NO: 1290334 - RNA, 25 nt, Human
uagaagacagcucuguggauccucc

SEQ ID NO: 1290335 - RNA, 24 nt, Human
uccgagcacaagcgcucccugagg

SEQ ID NO: 1290336 - RNA, 27 nt, Human
ucuccagauuaccauagaagacagcuc

SEQ ID NO: 1290337 - RNA, 19 nt, Human
ugagaagacauacaaaugu

SEQ ID NO: 1290338 - RNA, 20 nt, Human
ugagacgauuuaauguggua

SEQ ID NO: 1290339 - RNA, 23 nt, Human
ugcuuuccuccuugucucucuca

SEQ ID NO: 1290340 - RNA, 21 nt, Human
uugaaaugugaucucugucuu

SEQ ID NO: 1290341 - RNA, 20 nt, Human
agacacuucucgagggcgcu

SEQ ID NO: 1290342 - RNA, 18 nt, Human
agucagugaauccaaaac

SEQ ID NO: 1290343 - RNA, 19 nt, Human
cagucccacggcugccgug

SEQ ID NO: 1290344 - RNA, 19 nt, Human
cauaaugcugccgaggagc

SEQ ID NO: 1290345 - RNA, 22 nt, Human
cccauaaugcugccgaggagcc

SEQ ID NO: 1290346 - RNA, 25 nt, Human
cucucagaaguggccgcucuaccag

SEQ ID NO: 1290347 - RNA, 21 nt, Human
cuuccgagcugggaaggcagg

SEQ ID NO: 1290348 - RNA, 18 nt, Human
ggagccugugccaguccc

SEQ ID NO: 1290349 - RNA, 19 nt, Human
ugccgaggagccugugcca

SEQ ID NO: 1290350 - RNA, 19 nt, Human
gugagcuccaaaaacaauu

SEQ ID NO: 1290351 - RNA, 23 nt, Human
uagggugagcuccaaaaacaauu

SEQ ID NO: 1290352 - RNA, 21 nt, Human
aaaaagcagaaggaacccaga

SEQ ID NO: 1290353 - RNA, 23 nt, Human
aaacacagccgacgccucacuca

SEQ ID NO: 1290354 - RNA, 21 nt, Human
aaagugaaaaaguucugcaga

SEQ ID NO: 1290355 - RNA, 19 nt, Human
aaguacaaaagcauacagu

SEQ ID NO: 1290356 - RNA, 24 nt, Human
acagccaaaaagcagaaggaaccc

SEQ ID NO: 1290357 - RNA, 24 nt, Human
agaaaguagaauggugguugccag

SEQ ID NO: 1290358 - RNA, 21 nt, Human
agauggcggcgacacugaagc

SEQ ID NO: 1290359 - RNA, 25 nt, Human
agccaaaaagcagaaggaacccaga

SEQ ID NO: 1290360 - RNA, 22 nt, Human
agcgggguccaaccagccaaga

SEQ ID NO: 1290361 - RNA, 19 nt, Human
auauaauaacacuacugaa

SEQ ID NO: 1290362 - RNA, 21 nt, Human
aucccacuuauccaagccuca

SEQ ID NO: 1290363 - RNA, 22 nt, Human
caagaagggccuuggagucuug

SEQ ID NO: 1290364 - RNA, 21 nt, Human
cagaaggaacccagaugucca

SEQ ID NO: 1290365 - RNA, 23 nt, Human
cagaaggaacccagauguccauu

SEQ ID NO: 1290366 - RNA, 21 nt, Human
cagauugguuguccaacagug

SEQ ID NO: 1290367 - RNA, 23 nt, Human
cagcggccguuuccccaaacccc

SEQ ID NO: 1290368 - RNA, 24 nt, Human
cauaaaaaugguuaagaugguaaa

SEQ ID NO: 1290369 - RNA, 19 nt, Human
ccccaaaccccugcggagc

SEQ ID NO: 1290370 - RNA, 18 nt, Human
ccgacgccucacucagcg

SEQ ID NO: 1290371 - RNA, 22 nt, Human
ccgcggugagaaacacagccga

SEQ ID NO: 1290372 - RNA, 21 nt, Human
cgcccuaacaaggcugcugga

SEQ ID NO: 1290373 - RNA, 22 nt, Human
cucuuaguuuugacaauauacu

SEQ ID NO: 1290374 - RNA, 22 nt, Human
cuugcaaacccaaguucacagu

SEQ ID NO: 1290375 - RNA, 22 nt, Human
gaccgcggugagaaacacagcc

SEQ ID NO: 1290376 - RNA, 18 nt, Human
gacuuguuauuuccuuuu

SEQ ID NO: 1290377 - RNA, 19 nt, Human
gccagggacugagggcaag

SEQ ID NO: 1290378 - RNA, 23 nt, Human
gccugugagggaaaaaaaauaac

SEQ ID NO: 1290379 - RNA, 19 nt, Human
ggccuuggagucuugaaga

SEQ ID NO: 1290380 - RNA, 22 nt, Human
gggguaauaucaagaagggccu

SEQ ID NO: 1290381 - RNA, 24 nt, Human
uaaaugaaauaagccagucaugaa

SEQ ID NO: 1290382 - RNA, 22 nt, Human
uaaaugaggacauuaggcuaaa

SEQ ID NO: 1290383 - RNA, 20 nt, Human
uaacaacagccaaaaagcag

SEQ ID NO: 1290384 - RNA, 22 nt, Human
uaacaacagccaaaaagcagaa

SEQ ID NO: 1290385 - RNA, 21 nt, Human
uagcauuauuaacaacagcca

SEQ ID NO: 1290386 - RNA, 20 nt, Human
uauauacauacaaugcaaua

SEQ ID NO: 1290387 - RNA, 18 nt, Human
uaucaagaagggccuugg

SEQ ID NO: 1290388 - RNA, 19 nt, Human
uaucaagaagggccuugga

SEQ ID NO: 1290389 - RNA, 19 nt, Human
uaucaugaaaacagaacuu

SEQ ID NO: 1290390 - RNA, 23 nt, Human
uaugugcaugauucuaaugugca

SEQ ID NO: 1290391 - RNA, 19 nt, Human
ucaaacucagcaacagaaa

SEQ ID NO: 1290392 - RNA, 21 nt, Human
ucaaacucagcaacagaaagu

SEQ ID NO: 1290393 - RNA, 25 nt, Human
ucaaacucagcaacagaaaguagaa

SEQ ID NO: 1290394 - RNA, 20 nt, Human
ucagcaacagaaaguagaau

SEQ ID NO: 1290395 - RNA, 25 nt, Human
ucagcggccguuuccccaaaccccu

SEQ ID NO: 1290396 - RNA, 20 nt, Human
uccccaaaccccugcggagc

SEQ ID NO: 1290397 - RNA, 23 nt, Human
ugaaaacagaacuucacauaucc

SEQ ID NO: 1290398 - RNA, 26 nt, Human
ugaaaacagaacuucacauauccaaa

SEQ ID NO: 1290399 - RNA, 21 nt, Human
ugaaauaagccagucaugaaa

SEQ ID NO: 1290400 - RNA, 20 nt, Human
ugaauaaacaaaauguggua

SEQ ID NO: 1290401 - RNA, 22 nt, Human
ugacaauauacuucuacauucu

SEQ ID NO: 1290402 - RNA, 18 nt, Human
ugagggcaaguggaaaua

SEQ ID NO: 1290403 - RNA, 20 nt, Human
ugaguugucuauaaaaauuu

SEQ ID NO: 1290404 - RNA, 20 nt, Human
ugaucuucguuuuacauccc

SEQ ID NO: 1290405 - RNA, 19 nt, Human
uggaugaauaaacaaaaug

SEQ ID NO: 1290406 - RNA, 21 nt, Human
ugggaggaaaagaccgcggug

SEQ ID NO: 1290407 - RNA, 18 nt, Human
uuauccaagccucaggcc

SEQ ID NO: 1290408 - RNA, 25 nt, Human
uucaaaagugaaaaauuuugaguug

SEQ ID NO: 1290409 - RNA, 23 nt, Human
uucagauuugcaaagugaaaaag

SEQ ID NO: 1290410 - RNA, 19 nt, Human
uugcaaagugaaaaaguuc

SEQ ID NO: 1290411 - RNA, 21 nt, Human
uuuccccaaaccccugcggag

SEQ ID NO: 1290412 - RNA, 19 nt, Human
acacugccaugauuucacc

SEQ ID NO: 1290413 - RNA, 18 nt, Human
acugccaugauuucaccc

SEQ ID NO: 1290414 - RNA, 26 nt, Human
caaggcaaguugguguuugaaaauca

SEQ ID NO: 1290415 - RNA, 21 nt, Human
cacacugccaugauuucaccc

SEQ ID NO: 1290416 - RNA, 21 nt, Human
cagaacaucuuauuuccuggc

SEQ ID NO: 1290417 - RNA, 18 nt, Human
cagaguguaucucugaug

SEQ ID NO: 1290418 - RNA, 23 nt, Human
caucuuauuuccuggcuguauca

SEQ ID NO: 1290419 - RNA, 22 nt, Human
cauucccuuccaaggcaaguug

SEQ ID NO: 1290420 - RNA, 20 nt, Human
cauuucaaaccccaaaguuc

SEQ ID NO: 1290421 - RNA, 21 nt, Human
cugaugcuggcaccacccagc

SEQ ID NO: 1290422 - RNA, 23 nt, Human
cugaugcuggcaccacccagcag

SEQ ID NO: 1290423 - RNA, 24 nt, Human
gcaaucugggccucaguuucccca

SEQ ID NO: 1290424 - RNA, 20 nt, Human
ggagaccuaggugccgggag

SEQ ID NO: 1290425 - RNA, 23 nt, Human
uaugggccugaaaggacaacagg

SEQ ID NO: 1290426 - RNA, 21 nt, Human
uaugugcaaucugggccucag

SEQ ID NO: 1290427 - RNA, 26 nt, Human
ucagcaccacaucuuuagcacauagu

SEQ ID NO: 1290428 - RNA, 24 nt, Human
ucagucggagcugcaguuuuccuu

SEQ ID NO: 1290429 - RNA, 19 nt, Human
ucugaagaaguucuucuca

SEQ ID NO: 1290430 - RNA, 20 nt, Human
ugaaaggacaacagggucac

SEQ ID NO: 1290431 - RNA, 20 nt, Human
ugccgggagucugaaguucu

SEQ ID NO: 1290432 - RNA, 18 nt, Human
uggaauaugggccugaaa

SEQ ID NO: 1290433 - RNA, 21 nt, Human
uucucauaucagaacacaugg

SEQ ID NO: 1290434 - RNA, 19 nt, Human
uuuaaugagaaaaacaugu

SEQ ID NO: 1290435 - RNA, 23 nt, Human
caccgugcuggucacugccugcu

SEQ ID NO: 1290436 - RNA, 21 nt, Human
cccacugugucuccaacugcu

SEQ ID NO: 1290437 - RNA, 19 nt, Human
ccccccucggacacccacu

SEQ ID NO: 1290438 - RNA, 25 nt, Human
cccgaggccaggagcccucuagggc

SEQ ID NO: 1290439 - RNA, 23 nt, Human
cgauagacuucccgaggccagga

SEQ ID NO: 1290440 - RNA, 23 nt, Human
cucuagggcugccgggugccacc

SEQ ID NO: 1290441 - RNA, 20 nt, Human
gaggccaggagcccucuagg

SEQ ID NO: 1290442 - RNA, 23 nt, Human
gcagagcccccccucggacaccc

SEQ ID NO: 1290443 - RNA, 23 nt, Human
gcagggcugggccugugcugugg

SEQ ID NO: 1290444 - RNA, 25 nt, Human
gccugugcugugguccuccggacgc

SEQ ID NO: 1290445 - RNA, 20 nt, Human
ggacgcagagcccccccucg

SEQ ID NO: 1290446 - RNA, 18 nt, Human
ggcacuuggcaccgguga

SEQ ID NO: 1290447 - RNA, 24 nt, Human
uagacuucccgaggccaggagccc

SEQ ID NO: 1290448 - RNA, 20 nt, Human
uccuccggacgcagagcccc

SEQ ID NO: 1290449 - RNA, 24 nt, Human
ucucuggaccugccucuuggucau

SEQ ID NO: 1290450 - RNA, 18 nt, Human
ugcagggcugggccugug

SEQ ID NO: 1290451 - RNA, 22 nt, Human
uuccacaccgugcuggucacug

SEQ ID NO: 1290452 - RNA, 24 nt, Human
aaacacagacacccacgaugagac

SEQ ID NO: 1290453 - RNA, 24 nt, Human
aacacagacacccacgaugagacg

SEQ ID NO: 1290454 - RNA, 19 nt, Human
acaaccuccccagccaugc

SEQ ID NO: 1290455 - RNA, 21 nt, Human
acccuccuuacccugcccccu

SEQ ID NO: 1290456 - RNA, 18 nt, Human
acgcggggcugggcugga

SEQ ID NO: 1290457 - RNA, 22 nt, Human
agaaaaugcugacauaugcugc

SEQ ID NO: 1290458 - RNA, 23 nt, Human
agaggagcgcggcgcugguagca

SEQ ID NO: 1290459 - RNA, 18 nt, Human
agagggaagggcccccug

SEQ ID NO: 1290460 - RNA, 21 nt, Human
cacaccccucucuugcccugc

SEQ ID NO: 1290461 - RNA, 22 nt, Human
cacacgggacggcacagcagcg

SEQ ID NO: 1290462 - RNA, 27 nt, Human
cacuuuaucacuuagaagauucacccu

SEQ ID NO: 1290463 - RNA, 20 nt, Human
cagccccuggccccagcgcc

SEQ ID NO: 1290464 - RNA, 28 nt, Human
cagccccuggccccagcgccgcuggccc

SEQ ID NO: 1290465 - RNA, 19 nt, Human
cauaauaaacacagacacc

SEQ ID NO: 1290466 - RNA, 22 nt, Human
cauaauaaacacagacacccac

SEQ ID NO: 1290467 - RNA, 22 nt, Human
ccaaauccacacgggacggcac

SEQ ID NO: 1290468 - RNA, 21 nt, Human
ccagccaugccagcccgcgcu

SEQ ID NO: 1290469 - RNA, 20 nt, Human
ccagccccuggccccagcgc

SEQ ID NO: 1290470 - RNA, 20 nt, Human
ccagcgccgcuggcccucgg

SEQ ID NO: 1290471 - RNA, 18 nt, Human
ccaggacucuucucccca

SEQ ID NO: 1290472 - RNA, 23 nt, Human
ccccagccaugccagcccgcgcu

SEQ ID NO: 1290473 - RNA, 20 nt, Human
cccccggggcccagcugcuc

SEQ ID NO: 1290474 - RNA, 19 nt, Human
cccccgucuuccccgucuc

SEQ ID NO: 1290475 - RNA, 19 nt, Human
ccccgucuuccccgucucu

SEQ ID NO: 1290476 - RNA, 24 nt, Human
cccuccuuacccugcccccuuguc

SEQ ID NO: 1290477 - RNA, 26 nt, Human
cccuccuuacccugcccccuugucuu

SEQ ID NO: 1290478 - RNA, 20 nt, Human
ccuacagaaaaccacacccc

SEQ ID NO: 1290479 - RNA, 21 nt, Human
ccuggccccagcgccgcuggc

SEQ ID NO: 1290480 - RNA, 26 nt, Human
ccuuauccacuuucaugcuccucccg

SEQ ID NO: 1290481 - RNA, 22 nt, Human
cgaccuggagccaaauccacac

SEQ ID NO: 1290482 - RNA, 21 nt, Human
cggaggccuaacccccucccu

SEQ ID NO: 1290483 - RNA, 21 nt, Human
cggcacagcagcguccugccg

SEQ ID NO: 1290484 - RNA, 24 nt, Human
cgguagaagaaauagugaaagucu

SEQ ID NO: 1290485 - RNA, 22 nt, Human
cuacagaaaaccacaccccucu

SEQ ID NO: 1290486 - RNA, 19 nt, Human
cucccguacuccuggcucc

SEQ ID NO: 1290487 - RNA, 21 nt, Human
cucccguacuccuggcuccuc

SEQ ID NO: 1290488 - RNA, 24 nt, Human
cucuuuguggcauuacuaauacaa

SEQ ID NO: 1290489 - RNA, 21 nt, Human
cuggauauucuccaggccugg

SEQ ID NO: 1290490 - RNA, 31 nt, Human
cugguagcaggcgacgccaggacucuucucu

SEQ ID NO: 1290491 - RNA, 26 nt, Human
cuuggucaagcgguaacgccagugcc

SEQ ID NO: 1290492 - RNA, 20 nt, Human
gaccuagaaggcaagaggug

SEQ ID NO: 1290493 - RNA, 18 nt, Human
gauucacccuccuuaccc

SEQ ID NO: 1290494 - RNA, 23 nt, Human
gcaagaggugagcccucugucac

SEQ ID NO: 1290495 - RNA, 18 nt, Human
gcacacggggaggacacc

SEQ ID NO: 1290496 - RNA, 23 nt, Human
gccucccccgucuuccccgucuc

SEQ ID NO: 1290497 - RNA, 24 nt, Human
gcgugcucucugcucacucuccaa

SEQ ID NO: 1290498 - RNA, 18 nt, Human
gcugcgggacgggcggac

SEQ ID NO: 1290499 - RNA, 23 nt, Human
ggacucuucuccccaggugcucc

SEQ ID NO: 1290500 - RNA, 23 nt, Human
ggccccagcgccgcuggcccucg

SEQ ID NO: 1290501 - RNA, 21 nt, Human
ggcgcugguagcaggcgacgc

SEQ ID NO: 1290502 - RNA, 21 nt, Human
gggaggcuggauauucuccag

SEQ ID NO: 1290503 - RNA, 20 nt, Human
gggcuggacccuacagaaaa

SEQ ID NO: 1290504 - RNA, 21 nt, Human
gugcagagaagaaaaugcuga

SEQ ID NO: 1290505 - RNA, 23 nt, Human
uaaacacagacacccacgaugag

SEQ ID NO: 1290506 - RNA, 24 nt, Human
uaagugcagagaagaaaaugcuga

SEQ ID NO: 1290507 - RNA, 21 nt, Human
uaccuccaccuuuaccuuccc

SEQ ID NO: 1290508 - RNA, 25 nt, Human
uagcaggcgacgccaggacucuucu

SEQ ID NO: 1290509 - RNA, 18 nt, Human
uaguggucccccggggcc

SEQ ID NO: 1290510 - RNA, 19 nt, Human
ucacggagggcuccggcag

SEQ ID NO: 1290511 - RNA, 21 nt, Human
uccccaggugcucccgccgcg

SEQ ID NO: 1290512 - RNA, 19 nt, Human
ucccccggggcccagcugc

SEQ ID NO: 1290513 - RNA, 22 nt, Human
uccuaugaucacgugacuugcu

SEQ ID NO: 1290514 - RNA, 21 nt, Human
uccuuaguuaccuccaccuuu

SEQ ID NO: 1290515 - RNA, 22 nt, Human
ucuccaggccuggcccgcaguc

SEQ ID NO: 1290516 - RNA, 20 nt, Human
ucucuggucucugcacacgg

SEQ ID NO: 1290517 - RNA, 23 nt, Human
ucugcucacucuccaaacuccag

SEQ ID NO: 1290518 - RNA, 18 nt, Human
ucuuaaagucuuugaucg

SEQ ID NO: 1290519 - RNA, 23 nt, Human
ugagaagugaccuagaaggcaag

SEQ ID NO: 1290520 - RNA, 19 nt, Human
ugagggcuccuuggucaag

SEQ ID NO: 1290521 - RNA, 20 nt, Human
ugcagcaaauugaccugaaa

SEQ ID NO: 1290522 - RNA, 22 nt, Human
ugccagcccgcgcucaggccuc

SEQ ID NO: 1290523 - RNA, 23 nt, Human
ugcccugcuccuuaguuaccucc

SEQ ID NO: 1290524 - RNA, 20 nt, Human
ugccuaagagggaagggccc

SEQ ID NO: 1290525 - RNA, 22 nt, Human
ugcucacucuccaaacuccagc

SEQ ID NO: 1290526 - RNA, 19 nt, Human
uggcauuacuaauacaacc

SEQ ID NO: 1290527 - RNA, 23 nt, Human
ugugggaggcuggauauucucca

SEQ ID NO: 1290528 - RNA, 24 nt, Human
ugugggaggcuggauauucuccag

SEQ ID NO: 1290529 - RNA, 23 nt, Human
uucacagccccugcgugcucucu

SEQ ID NO: 1290530 - RNA, 22 nt, Human
uuuaucacuuagaagauucacc

SEQ ID NO: 1290531 - RNA, 24 nt, Human
aaccuuacuugaaucaguaaaaaa

SEQ ID NO: 1290532 - RNA, 20 nt, Human
aagcauuuuuaaaaauaguc

SEQ ID NO: 1290533 - RNA, 22 nt, Human
aagcugacuccaaauacuauau

SEQ ID NO: 1290534 - RNA, 18 nt, Human
aagugcuuccaacuucag

SEQ ID NO: 1290535 - RNA, 19 nt, Human
aguccaaacugaaugaucu

SEQ ID NO: 1290536 - RNA, 18 nt, Human
augcaauacaugcacacg

SEQ ID NO: 1290537 - RNA, 22 nt, Human
augcacacgaagaaacuauaau

SEQ ID NO: 1290538 - RNA, 22 nt, Human
caaugcaauacaugcacacgaa

SEQ ID NO: 1290539 - RNA, 22 nt, Human
cacacaauguacuaaaggccuu

SEQ ID NO: 1290540 - RNA, 26 nt, Human
ccaauuuuaaaauuacaguuuucuua

SEQ ID NO: 1290541 - RNA, 21 nt, Human
cgaagaaacuauaauacagug

SEQ ID NO: 1290542 - RNA, 20 nt, Human
cuuuuauaucacacaugauu

SEQ ID NO: 1290543 - RNA, 18 nt, Human
uaaaauaucaacagugcc

SEQ ID NO: 1290544 - RNA, 18 nt, Human
uaaauaauauacuugaaa

SEQ ID NO: 1290545 - RNA, 19 nt, Human
uaagcugacuccaaauacu

SEQ ID NO: 1290546 - RNA, 23 nt, Human
uagauauaauuaguugcuaacaa

SEQ ID NO: 1290547 - RNA, 25 nt, Human
uagcaggagcuauucacacacaaug

SEQ ID NO: 1290548 - RNA, 23 nt, Human
ucaaaaaaugauuuggaaaaaca

SEQ ID NO: 1290549 - RNA, 19 nt, Human
ucaaaggacaacaaugcaa

SEQ ID NO: 1290550 - RNA, 19 nt, Human
ucuuuuauucaucucucca

SEQ ID NO: 1290551 - RNA, 22 nt, Human
ugcuuccaacuucagauaauuu

SEQ ID NO: 1290552 - RNA, 24 nt, Human
uguggugcugcaucuauaaaauuu

SEQ ID NO: 1290553 - RNA, 18 nt, Human
uguuuucaauucagucca

SEQ ID NO: 1290554 - RNA, 20 nt, Human
uugaugaaauauucuuaaga

SEQ ID NO: 1290555 - RNA, 20 nt, Human
uuuaagagguauuuacaaaa

SEQ ID NO: 1290556 - RNA, 19 nt, Human
aacaagagugagcuuguac

SEQ ID NO: 1290557 - RNA, 19 nt, Human
aagcaacgaaagccagcua

SEQ ID NO: 1290558 - RNA, 24 nt, Human
aagccagcuauuuguguggggaca

SEQ ID NO: 1290559 - RNA, 22 nt, Human
acacaaaccuccccucagcccu

SEQ ID NO: 1290560 - RNA, 18 nt, Human
acacuaggucauucaggc

SEQ ID NO: 1290561 - RNA, 21 nt, Human
acaggcauggggaucagucuu

SEQ ID NO: 1290562 - RNA, 21 nt, Human
acccagcccaguuuuuguuuu

SEQ ID NO: 1290563 - RNA, 22 nt, Human
accccuuccaacugacaaucua

SEQ ID NO: 1290564 - RNA, 22 nt, Human
accggccagcuccaaggggaua

SEQ ID NO: 1290565 - RNA, 18 nt, Human
accuccccucagcccuuc

SEQ ID NO: 1290566 - RNA, 20 nt, Human
aggugcuuuucaauccccag

SEQ ID NO: 1290567 - RNA, 20 nt, Human
auaccacacuaacccaaaga

SEQ ID NO: 1290568 - RNA, 19 nt, Human
auccaccuuuucccuacag

SEQ ID NO: 1290569 - RNA, 22 nt, Human
augaggcacuaauaucuuaccg

SEQ ID NO: 1290570 - RNA, 20 nt, Human
auuccuuccuauucucuucu

SEQ ID NO: 1290571 - RNA, 19 nt, Human
caacaagcaacgaaagcca

SEQ ID NO: 1290572 - RNA, 19 nt, Human
caaggcaaagccgggcugu

SEQ ID NO: 1290573 - RNA, 21 nt, Human
cacccuaaagugggagauaaa

SEQ ID NO: 1290574 - RNA, 18 nt, Human
cagucaaggcaaagccgg

SEQ ID NO: 1290575 - RNA, 22 nt, Human
cagucaaggcaaagccgggcug

SEQ ID NO: 1290576 - RNA, 21 nt, Human
ccaaugcauaaaaccuuuggc

SEQ ID NO: 1290577 - RNA, 19 nt, Human
cccugggggcaggcacagg

SEQ ID NO: 1290578 - RNA, 25 nt, Human
ccuucaaucaaagcaaaguacugac

SEQ ID NO: 1290579 - RNA, 24 nt, Human
ccuuguacauaguuuaaacucucc

SEQ ID NO: 1290580 - RNA, 22 nt, Human
cuggagucaccagaaaaaaaga

SEQ ID NO: 1290581 - RNA, 25 nt, Human
cuuaaaauuccccuaauaagaacuc

SEQ ID NO: 1290582 - RNA, 25 nt, Human
cuuuccuuuuuuucuuuccucccuu

SEQ ID NO: 1290583 - RNA, 22 nt, Human
cuuucugaauuccagaggugag

SEQ ID NO: 1290584 - RNA, 23 nt, Human
gauaacaauagcugcucuugauu

SEQ ID NO: 1290585 - RNA, 22 nt, Human
gccuacuggcugccacccuaaa

SEQ ID NO: 1290586 - RNA, 24 nt, Human
gcuuguacauaccacacuaaccca

SEQ ID NO: 1290587 - RNA, 21 nt, Human
gggcacaggcauggggaucag

SEQ ID NO: 1290588 - RNA, 22 nt, Human
gguuccuuuccuuuuuuucuuu

SEQ ID NO: 1290589 - RNA, 20 nt, Human
gucagucaaggcaaagccgg

SEQ ID NO: 1290590 - RNA, 22 nt, Human
guggguuuuucucagugccuug

SEQ ID NO: 1290591 - RNA, 23 nt, Human
uaaaaugaggcacuaauaucuua

SEQ ID NO: 1290592 - RNA, 24 nt, Human
uaaaauuccccuaauaagaacucc

SEQ ID NO: 1290593 - RNA, 24 nt, Human
uaacccaaagaggggaggcagaaa

SEQ ID NO: 1290594 - RNA, 22 nt, Human
uacacaaaccuccccucagccc

SEQ ID NO: 1290595 - RNA, 18 nt, Human
uacauaccacacuaaccc

SEQ ID NO: 1290596 - RNA, 19 nt, Human
uagagccaacucacucauu

SEQ ID NO: 1290597 - RNA, 19 nt, Human
uaggguagggguggaggug

SEQ ID NO: 1290598 - RNA, 24 nt, Human
uaguaauuagaaagucucgaaaau

SEQ ID NO: 1290599 - RNA, 23 nt, Human
ucaaagcaaaguacugacaauau

SEQ ID NO: 1290600 - RNA, 25 nt, Human
ucaagaguucagacagcugcgauga

SEQ ID NO: 1290601 - RNA, 26 nt, Human
ucacuuuuaaauacauggguguacac

SEQ ID NO: 1290602 - RNA, 18 nt, Human
ucagucaaggcaaagccg

SEQ ID NO: 1290603 - RNA, 21 nt, Human
ucaguuuacggcucacauuua

SEQ ID NO: 1290604 - RNA, 24 nt, Human
ucauucauucaacaagcaacgaaa

SEQ ID NO: 1290605 - RNA, 21 nt, Human
ucgguaugugcucauuucagu

SEQ ID NO: 1290606 - RNA, 19 nt, Human
ucuugauucuuauuucugg

SEQ ID NO: 1290607 - RNA, 20 nt, Human
ugcuacaaacuguguugcag

SEQ ID NO: 1290608 - RNA, 22 nt, Human
uggcaccaauccaccuuuuccc

SEQ ID NO: 1290609 - RNA, 21 nt, Human
uggcagaaacuggucacuguu

SEQ ID NO: 1290610 - RNA, 22 nt, Human
uggcuguucacgagccggcccu

SEQ ID NO: 1290611 - RNA, 20 nt, Human
uguaaaacauuuaaugugau

SEQ ID NO: 1290612 - RNA, 18 nt, Human
uguaaaaugaggcacuaa

SEQ ID NO: 1290613 - RNA, 22 nt, Human
ugucaugggcacaggcaugggg

SEQ ID NO: 1290614 - RNA, 23 nt, Human
ugucaugguguccucuuucaggg

SEQ ID NO: 1290615 - RNA, 19 nt, Human
uuccccuaauaagaacucc

SEQ ID NO: 1290616 - RNA, 21 nt, Human
uuccuaaggcagcccuugugg

SEQ ID NO: 1290617 - RNA, 21 nt, Human
uucugggguagcaguggguca

SEQ ID NO: 1290618 - RNA, 18 nt, Human
uuucucagugccuugcua

SEQ ID NO: 1290619 - RNA, 24 nt, Human
uuuuguuuucaacuauuuucuaau

SEQ ID NO: 1290620 - RNA, 25 nt, Human
aaaaaagaaaugaacacuaucagag

SEQ ID NO: 1290621 - RNA, 22 nt, Human
aaaaacaccaugcucuccucuc

SEQ ID NO: 1290622 - RNA, 24 nt, Human
aacaagcucuuccgggcuucacca

SEQ ID NO: 1290623 - RNA, 19 nt, Human
aagagcugggauuauaacu

SEQ ID NO: 1290624 - RNA, 24 nt, Human
aaggcaggccuccccuccugccuu

SEQ ID NO: 1290625 - RNA, 18 nt, Human
aauucauugacccaaaug

SEQ ID NO: 1290626 - RNA, 21 nt, Human
aauuggcacuucaaugcuugg

SEQ ID NO: 1290627 - RNA, 20 nt, Human
acaacuaagaucuuaauaac

SEQ ID NO: 1290628 - RNA, 19 nt, Human
acaagauuuccucuugaac

SEQ ID NO: 1290629 - RNA, 21 nt, Human
acaucagacccugugcuaagc

SEQ ID NO: 1290630 - RNA, 23 nt, Human
accugagugguguauuugaggag

SEQ ID NO: 1290631 - RNA, 23 nt, Human
agaauuggcacuucaaugcuugg

SEQ ID NO: 1290632 - RNA, 24 nt, Human
agagaugacagaagaaacuaaguc

SEQ ID NO: 1290633 - RNA, 22 nt, Human
agcaaaaacaccaugcucuccu

SEQ ID NO: 1290634 - RNA, 19 nt, Human
agccuaauuugaagauucu

SEQ ID NO: 1290635 - RNA, 23 nt, Human
agccuaauuugaagauucuccau

SEQ ID NO: 1290636 - RNA, 21 nt, Human
aggaagggggggugucugagc

SEQ ID NO: 1290637 - RNA, 23 nt, Human
aggggucagaggaguaaaacauu

SEQ ID NO: 1290638 - RNA, 19 nt, Human
aggucuccccacacccaag

SEQ ID NO: 1290639 - RNA, 19 nt, Human
aguaacaggggucagagga

SEQ ID NO: 1290640 - RNA, 22 nt, Human
agugggccaccacccuccaaga

SEQ ID NO: 1290641 - RNA, 20 nt, Human
augaagcaaaaacaccaugc

SEQ ID NO: 1290642 - RNA, 19 nt, Human
cacaagauuuccucuugaa

SEQ ID NO: 1290643 - RNA, 21 nt, Human
caccacccuccaagaccugca

SEQ ID NO: 1290644 - RNA, 20 nt, Human
caccacuccauggccugcug

SEQ ID NO: 1290645 - RNA, 27 nt, Human
cacccuccaagaccugcauggauccaa

SEQ ID NO: 1290646 - RNA, 24 nt, Human
cacuaucagagaagaauccugaug

SEQ ID NO: 1290647 - RNA, 24 nt, Human
cacuucaaugcuuggcaguacuuu

SEQ ID NO: 1290648 - RNA, 18 nt, Human
caggauuaaccucugcug

SEQ ID NO: 1290649 - RNA, 21 nt, Human
ccaagaccugcauggauccaa

SEQ ID NO: 1290650 - RNA, 23 nt, Human
cccagaaagagugggccaccacc

SEQ ID NO: 1290651 - RNA, 18 nt, Human
ccccuccugccuuuccca

SEQ ID NO: 1290652 - RNA, 25 nt, Human
cccuccaagaccugcauggauccaa

SEQ ID NO: 1290653 - RNA, 19 nt, Human
ccuccaagaccugcaugga

SEQ ID NO: 1290654 - RNA, 21 nt, Human
ccuccccuccugccuuuccca

SEQ ID NO: 1290655 - RNA, 21 nt, Human
ccucccugccugcaaagccca

SEQ ID NO: 1290656 - RNA, 20 nt, Human
ccuccugccuuucccaccaa

SEQ ID NO: 1290657 - RNA, 23 nt, Human
cuucauaaagaaguaacacaaga

SEQ ID NO: 1290658 - RNA, 21 nt, Human
gaaaguaccuuuaugauucua

SEQ ID NO: 1290659 - RNA, 24 nt, Human
gaacucgcucaccacuccauggcc

SEQ ID NO: 1290660 - RNA, 20 nt, Human
gaaugugguuggcacuguac

SEQ ID NO: 1290661 - RNA, 19 nt, Human
gagaagccuggaggaaggg

SEQ ID NO: 1290662 - RNA, 19 nt, Human
gaggaagggggggugucug

SEQ ID NO: 1290663 - RNA, 26 nt, Human
gagugggccaccacccuccaagaccu

SEQ ID NO: 1290664 - RNA, 18 nt, Human
gcuguagggcucgggagg

SEQ ID NO: 1290665 - RNA, 18 nt, Human
ggccaccacccuccaaga

SEQ ID NO: 1290666 - RNA, 19 nt, Human
ggcccagaaagagugggcc

SEQ ID NO: 1290667 - RNA, 23 nt, Human
ggugucugagccacccucuacuu

SEQ ID NO: 1290668 - RNA, 28 nt, Human
uaacuggaccucccugccugcaaagccc

SEQ ID NO: 1290669 - RNA, 21 nt, Human
ucaucuccaccaggcuggagu

SEQ ID NO: 1290670 - RNA, 19 nt, Human
uccaagaccugcauggauc

SEQ ID NO: 1290671 - RNA, 31 nt, Human
uccaccaggcuggaguccuucauaaagaagg

SEQ ID NO: 1290672 - RNA, 21 nt, Human
uccccacacccaagggccugu

SEQ ID NO: 1290673 - RNA, 30 nt, Human
ucugagccacccucuacuuggcccagaaag

SEQ ID NO: 1290674 - RNA, 23 nt, Human
ucuuccgggcuucaccaguuaca

SEQ ID NO: 1290675 - RNA, 18 nt, Human
ugagagaugacagaagaa

SEQ ID NO: 1290676 - RNA, 20 nt, Human
ugagccacccucuacuuggc

SEQ ID NO: 1290677 - RNA, 22 nt, Human
ugaggaguacagguuuccuugu

SEQ ID NO: 1290678 - RNA, 20 nt, Human
uggauuugauuucucugugc

SEQ ID NO: 1290679 - RNA, 23 nt, Human
uggcaguacuuuugaucuucuaa

SEQ ID NO: 1290680 - RNA, 24 nt, Human
uggcuucaggcccugcugucuccu

SEQ ID NO: 1290681 - RNA, 23 nt, Human
ugguguauuugaggaguacaggu

SEQ ID NO: 1290682 - RNA, 26 nt, Human
uuaauaacaguaaauucauugaccca

SEQ ID NO: 1290683 - RNA, 23 nt, Human
uuacaucagacccugugcuaagc

SEQ ID NO: 1290684 - RNA, 18 nt, Human
uuaguaagagcugggauu

SEQ ID NO: 1290685 - RNA, 21 nt, Human
uucaggacucauucaucucca

SEQ ID NO: 1290686 - RNA, 18 nt, Human
uuuaaggcauccauugag

SEQ ID NO: 1290687 - RNA, 22 nt, Human
uuuuuuguguguauuaucccag

SEQ ID NO: 1290688 - RNA, 21 nt, Human
aacaccccauuaagagggaaa

SEQ ID NO: 1290689 - RNA, 20 nt, Human
aggcaggcaggucuaaggcu

SEQ ID NO: 1290690 - RNA, 24 nt, Human
aggcaggcaggucuaaggcuaaca

SEQ ID NO: 1290691 - RNA, 21 nt, Human
augcucacagauguuuuccac

SEQ ID NO: 1290692 - RNA, 22 nt, Human
caugcucacagauguuuuccac

SEQ ID NO: 1290693 - RNA, 27 nt, Human
uccacaacaaacuuaucugacauccaa

SEQ ID NO: 1290694 - RNA, 18 nt, Human
uuuuccacaacaaacuua

SEQ ID NO: 1290695 - RNA, 23 nt, Human
uuuuccacaacaaacuuaucuga

SEQ ID NO: 1290696 - RNA, 24 nt, Human
cacucgagauucucgcccguggga

SEQ ID NO: 1290697 - RNA, 18 nt, Human
ccgccgcgggccgggcuc

SEQ ID NO: 1290698 - RNA, 19 nt, Human
ucgcacucgagauucucgc

SEQ ID NO: 1290699 - RNA, 24 nt, Human
aaauggcugaacaaagaaaacuaa

SEQ ID NO: 1290700 - RNA, 19 nt, Human
aacagcaaagugguagcaa

SEQ ID NO: 1290701 - RNA, 21 nt, Human
aaguaaccuuugcaaauggac

SEQ ID NO: 1290702 - RNA, 20 nt, Human
ccccugagcuuucgcugcuu

SEQ ID NO: 1290703 - RNA, 21 nt, Human
ccugcagaagccuccuuuguu

SEQ ID NO: 1290704 - RNA, 20 nt, Human
cucauaaugugccuagaauc

SEQ ID NO: 1290705 - RNA, 22 nt, Human
cuuuuuuucucuuuccucuaga

SEQ ID NO: 1290706 - RNA, 21 nt, Human
gcgcuccuccucguccuccuc

SEQ ID NO: 1290707 - RNA, 23 nt, Human
uaacugucgguccaaccuuauaa

SEQ ID NO: 1290708 - RNA, 18 nt, Human
uacagucucuaguaacag

SEQ ID NO: 1290709 - RNA, 24 nt, Human
ucuugaacagcaaagugguagcaa

SEQ ID NO: 1290710 - RNA, 18 nt, Human
ugggaagcaaaaucaaug

SEQ ID NO: 1290711 - RNA, 19 nt, Human
uguacugcuauauugcauu

SEQ ID NO: 1290712 - RNA, 19 nt, Human
ugucugauguacugcuaua

SEQ ID NO: 1290713 - RNA, 21 nt, Human
uuucccuccucauaaugugcc

SEQ ID NO: 1290714 - RNA, 20 nt, Human
ccuuacauaauaggcacccc

SEQ ID NO: 1290715 - RNA, 24 nt, Human
ccuugaagcuguacguagcuuggu

SEQ ID NO: 1290716 - RNA, 20 nt, Human
cucacuuucuggcccuggcc

SEQ ID NO: 1290717 - RNA, 21 nt, Human
cuuacauaauaggcaccccuc

SEQ ID NO: 1290718 - RNA, 21 nt, Human
uaauaggcaccccucucacuu

SEQ ID NO: 1290719 - RNA, 18 nt, Human
uagcuugguguccaucag

SEQ ID NO: 1290720 - RNA, 19 nt, Human
uccagugaugcuuccauag

SEQ ID NO: 1290721 - RNA, 21 nt, Human
ucucacuuucuggcccuggcc

SEQ ID NO: 1290722 - RNA, 23 nt, Human
ugaugcuuccauagcaggcuggg

SEQ ID NO: 1290723 - RNA, 20 nt, Human
agccaaguaaccaccaguga

SEQ ID NO: 1290724 - RNA, 23 nt, Human
caaguaaccaccagugaccagca

SEQ ID NO: 1290725 - RNA, 20 nt, Human
caccagugaccagcaggucu

SEQ ID NO: 1290726 - RNA, 23 nt, Human
cagcaggucuuugccccaaaccc

SEQ ID NO: 1290727 - RNA, 25 nt, Human
cagcuggcugccuccaaccccuugg

SEQ ID NO: 1290728 - RNA, 19 nt, Human
ccaaguaaccaccagugac

SEQ ID NO: 1290729 - RNA, 20 nt, Human
ccagguguacugucuguacu

SEQ ID NO: 1290730 - RNA, 19 nt, Human
cuguacuuugggaucagcu

SEQ ID NO: 1290731 - RNA, 18 nt, Human
cuguguuuuuagccuuug

SEQ ID NO: 1290732 - RNA, 18 nt, Human
cuuugccccaaacccucc

SEQ ID NO: 1290733 - RNA, 21 nt, Human
gccccaaacccuccaaggccu

SEQ ID NO: 1290734 - RNA, 18 nt, Human
gcugccaaauccucucgc

SEQ ID NO: 1290735 - RNA, 22 nt, Human
gucuguacuuugggaucagcug

SEQ ID NO: 1290736 - RNA, 18 nt, Human
uaaccaccagugaccagc

SEQ ID NO: 1290737 - RNA, 22 nt, Human
uaaccaccagugaccagcaggu

SEQ ID NO: 1290738 - RNA, 24 nt, Human
ucagugguccugccccagguuucu

SEQ ID NO: 1290739 - RNA, 20 nt, Human
ugccccaaacccuccaaggc

SEQ ID NO: 1290740 - RNA, 18 nt, Human
uggcugccuccaggugua

SEQ ID NO: 1290741 - RNA, 24 nt, Human
uuuuuagccuuugacaccaggauu

SEQ ID NO: 1290742 - RNA, 22 nt, Human
aagcugcagaaacccacuggau

SEQ ID NO: 1290743 - RNA, 25 nt, Human
accuaagcugcagaaaccggggguc

SEQ ID NO: 1290744 - RNA, 26 nt, Human
agaaacccacuggaugguuuccuagg

SEQ ID NO: 1290745 - RNA, 22 nt, Human
agcugcagaaacccacuggaug

SEQ ID NO: 1290746 - RNA, 19 nt, Human
cuaagcugcagaaacccac

SEQ ID NO: 1290747 - RNA, 23 nt, Human
cuggaugguuuccuagguucuga

SEQ ID NO: 1290748 - RNA, 18 nt, Human
gagauacagcagcuguaa

SEQ ID NO: 1290749 - RNA, 20 nt, Human
uaagcugcagaaacccacug

SEQ ID NO: 1290750 - RNA, 18 nt, Human
ucuucugaaggcugguua

SEQ ID NO: 1290751 - RNA, 19 nt, Human
ugaaacaccuaagcugcag

SEQ ID NO: 1290752 - RNA, 20 nt, Human
ugaaacaccuaagcugcaga

SEQ ID NO: 1290753 - RNA, 25 nt, Human
ugaaacaccuaagcugcagaaaccc

SEQ ID NO: 1290754 - RNA, 28 nt, Human
ugaguuggcauuaucuuuccuccccgga

SEQ ID NO: 1290755 - RNA, 21 nt, Human
ugggacgcguuaccuucacac

SEQ ID NO: 1290756 - RNA, 21 nt, Human
uucuucugaaggcugguuaug

SEQ ID NO: 1290757 - RNA, 23 nt, Human
uugaugcacaaacuucuugaaag

SEQ ID NO: 1290758 - RNA, 22 nt, Human
aaagagcuuugccuguccaggc

SEQ ID NO: 1290759 - RNA, 18 nt, Human
aagccgcuucucuucaag

SEQ ID NO: 1290760 - RNA, 19 nt, Human
aaggacccugggcucuccc

SEQ ID NO: 1290761 - RNA, 18 nt, Human
agaaagggggacagcgag

SEQ ID NO: 1290762 - RNA, 25 nt, Human
aggaggccuugggagaaagggggac

SEQ ID NO: 1290763 - RNA, 23 nt, Human
cagcgagcagggccccuccccag

SEQ ID NO: 1290764 - RNA, 19 nt, Human
caggcugcucuuccccuuc

SEQ ID NO: 1290765 - RNA, 24 nt, Human
ccagaagccgcuucucuucaagga

SEQ ID NO: 1290766 - RNA, 23 nt, Human
ccaggcugcucuuccccuucccc

SEQ ID NO: 1290767 - RNA, 19 nt, Human
cccaucuuuggcaggugaa

SEQ ID NO: 1290768 - RNA, 19 nt, Human
ccccuguuccugcuuggcc

SEQ ID NO: 1290769 - RNA, 22 nt, Human
ccccuuccccucuugggauucc

SEQ ID NO: 1290770 - RNA, 23 nt, Human
ccuccccagggcugcaugggggu

SEQ ID NO: 1290771 - RNA, 23 nt, Human
ccugcgcugccacgugcuccuug

SEQ ID NO: 1290772 - RNA, 23 nt, Human
ccuugccccgugaccccuguucc

SEQ ID NO: 1290773 - RNA, 20 nt, Human
cuccccagggcugcaugggg

SEQ ID NO: 1290774 - RNA, 19 nt, Human
cucucccuuugcaggaacc

SEQ ID NO: 1290775 - RNA, 21 nt, Human
cugccacgugcuccuugcccc

SEQ ID NO: 1290776 - RNA, 19 nt, Human
cugcuuccuuccuguuucc

SEQ ID NO: 1290777 - RNA, 18 nt, Human
cuguuuccugcgcugcca

SEQ ID NO: 1290778 - RNA, 21 nt, Human
gacagcgagcagggccccucc

SEQ ID NO: 1290779 - RNA, 21 nt, Human
gggagaaagggggacagcgag

SEQ ID NO: 1290780 - RNA, 20 nt, Human
gguggcugcuuccuuccugu

SEQ ID NO: 1290781 - RNA, 19 nt, Human
ucagacuaggcaggauaca

SEQ ID NO: 1290782 - RNA, 18 nt, Human
uccugcgcugccacgugc

SEQ ID NO: 1290783 - RNA, 18 nt, Human
uccugcgcugccacgugc

SEQ ID NO: 1290784 - RNA, 18 nt, Human
ugcacaugccaggcugcu

SEQ ID NO: 1290785 - RNA, 19 nt, Human
ugccacgugcuccuugccc

SEQ ID NO: 1290786 - RNA, 24 nt, Human
uuccccuuccccucuugggauucc

SEQ ID NO: 1290787 - RNA, 19 nt, Human
aaauaggagccaggaagag

SEQ ID NO: 1290788 - RNA, 21 nt, Human
aagaacagaaaggaugguggc

SEQ ID NO: 1290789 - RNA, 21 nt, Human
aaggagggaccuaccaugaug

SEQ ID NO: 1290790 - RNA, 22 nt, Human
aauucacacucuugagaacagu

SEQ ID NO: 1290791 - RNA, 23 nt, Human
acaggagcugcugucccuggggc

SEQ ID NO: 1290792 - RNA, 28 nt, Human
accaaaaucacaggagcugcugucccug

SEQ ID NO: 1290793 - RNA, 19 nt, Human
agccaggaagagaguguuc

SEQ ID NO: 1290794 - RNA, 23 nt, Human
auaaaauaguagcugccaccuaa

SEQ ID NO: 1290795 - RNA, 19 nt, Human
caaaguggauagcgaggua

SEQ ID NO: 1290796 - RNA, 21 nt, Human
cagggacucagagccaggccu

SEQ ID NO: 1290797 - RNA, 21 nt, Human
ccaagaagagagagagaagga

SEQ ID NO: 1290798 - RNA, 19 nt, Human
ccaggaagagaguguucca

SEQ ID NO: 1290799 - RNA, 19 nt, Human
cucugccuuuauuggcgga

SEQ ID NO: 1290800 - RNA, 18 nt, Human
gagaagcagguuaaagaa

SEQ ID NO: 1290801 - RNA, 21 nt, Human
gccuuauccaaucccaacucu

SEQ ID NO: 1290802 - RNA, 20 nt, Human
ggaaauaggagccaggaaga

SEQ ID NO: 1290803 - RNA, 24 nt, Human
gucuuuggaggcagcgaggaaaua

SEQ ID NO: 1290804 - RNA, 21 nt, Human
ucaggggaugugcucccucug

SEQ ID NO: 1290805 - RNA, 22 nt, Human
ucccaacucucccagucagcca

SEQ ID NO: 1290806 - RNA, 26 nt, Human
ugccuuauccaaucccaacucuccca

SEQ ID NO: 1290807 - RNA, 22 nt, Human
aacagcccugaccuauuacaga

SEQ ID NO: 1290808 - RNA, 29 nt, Human
aagccagcucugucuccaacaacaggggu

SEQ ID NO: 1290809 - RNA, 20 nt, Human
cccauuucccaagcacugau

SEQ ID NO: 1290810 - RNA, 22 nt, Human
cuuuaaauuguuauccugccca

SEQ ID NO: 1290811 - RNA, 18 nt, Human
uaagaaagauuaagcaca

SEQ ID NO: 1290812 - RNA, 21 nt, Human
uaucucuuuaaauuguuaucc

SEQ ID NO: 1290813 - RNA, 19 nt, Human
ucuccaacagcccugaccu

SEQ ID NO: 1290814 - RNA, 21 nt, Human
uucaggacccuggacaucagg

SEQ ID NO: 1290815 - RNA, 20 nt, Human
uuucaggacccuggacauca

SEQ ID NO: 1290816 - RNA, 18 nt, Human
aaagaagcucuuaucucu

SEQ ID NO: 1290817 - RNA, 24 nt, Human
aagaagcucuuaucucuucgcuga

SEQ ID NO: 1290818 - RNA, 21 nt, Human
agguguuaaaaaugugcaucu

SEQ ID NO: 1290819 - RNA, 22 nt, Human
ccgcggaaagggucuuccucuu

SEQ ID NO: 1290820 - RNA, 20 nt, Human
cugauaccauaaauccaggc

SEQ ID NO: 1290821 - RNA, 23 nt, Human
uaaaaaugugcaucugauaccau

SEQ ID NO: 1290822 - RNA, 21 nt, Human
ucuuccagacaccaggcucac

SEQ ID NO: 1290823 - RNA, 23 nt, Human
ucuucuggcaugaaaaauuccag

SEQ ID NO: 1290824 - RNA, 25 nt, Human
ugaagagauauuuuaaagagaaaac

SEQ ID NO: 1290825 - RNA, 21 nt, Human
aaguggagacaaguuuauuga

SEQ ID NO: 1290826 - RNA, 22 nt, Human
acuccgaggggauccguaagag

SEQ ID NO: 1290827 - RNA, 21 nt, Human
agugagacugaggaucuggua

SEQ ID NO: 1290828 - RNA, 22 nt, Human
caaguuuauugaggagcuugac

SEQ ID NO: 1290829 - RNA, 26 nt, Human
caccccucuucugcccuagcuugaga

SEQ ID NO: 1290830 - RNA, 20 nt, Human
caggccccugggugucuccc

SEQ ID NO: 1290831 - RNA, 19 nt, Human
ccuugucgccgcggccucg

SEQ ID NO: 1290832 - RNA, 21 nt, Human
cgcccgggaugcggaggucug

SEQ ID NO: 1290833 - RNA, 18 nt, Human
cgccgcggccucgccgcc

SEQ ID NO: 1290834 - RNA, 18 nt, Human
cgggaccagcgcacccug

SEQ ID NO: 1290835 - RNA, 19 nt, Human
cggucgaggcaugcugcgg

SEQ ID NO: 1290836 - RNA, 22 nt, Human
cucuucugcccuagcuugagag

SEQ ID NO: 1290837 - RNA, 19 nt, Human
cugcagccagugagggccc

SEQ ID NO: 1290838 - RNA, 22 nt, Human
cuugacaccccucuucugcccu

SEQ ID NO: 1290839 - RNA, 21 nt, Human
gcccuagcuugagagaacaac

SEQ ID NO: 1290840 - RNA, 23 nt, Human
gccuuuccuguggccccaggcac

SEQ ID NO: 1290841 - RNA, 20 nt, Human
gcgggccaggccccugggug

SEQ ID NO: 1290842 - RNA, 27 nt, Human
ggcgggccaggccccugggggacucuc

SEQ ID NO: 1290843 - RNA, 24 nt, Human
uaaggaaacagaucagcugcagcc

SEQ ID NO: 1290844 - RNA, 25 nt, Human
uaaggaaacagaucagcugcagcca

SEQ ID NO: 1290845 - RNA, 19 nt, Human
ucgccgcggccucgccgcc

SEQ ID NO: 1290846 - RNA, 25 nt, Human
ucucccauaucgcugucuuuaguga

SEQ ID NO: 1290847 - RNA, 19 nt, Human
ugagcgcgcgaccgggacc

SEQ ID NO: 1290848 - RNA, 24 nt, Human
ugagggccccugcguugggccugg

SEQ ID NO: 1290849 - RNA, 25 nt, Human
ugggugucucccauaucgcugucuu

SEQ ID NO: 1290850 - RNA, 21 nt, Human
aaguggagacaaguuuauuga

SEQ ID NO: 1290851 - RNA, 20 nt, Human
acucucagcucugaagccag

SEQ ID NO: 1290852 - RNA, 21 nt, Human
agugagacugaggaucuggua

SEQ ID NO: 1290853 - RNA, 22 nt, Human
caaguuuauugaggagcuugac

SEQ ID NO: 1290854 - RNA, 26 nt, Human
caccccucuucugcccuagcuugaga

SEQ ID NO: 1290855 - RNA, 19 nt, Human
cacuguguuggggcgaggc

SEQ ID NO: 1290856 - RNA, 23 nt, Human
cagcagggucuggcagccucugg

SEQ ID NO: 1290857 - RNA, 26 nt, Human
ccaggaauuucccauagcagcaccgg

SEQ ID NO: 1290858 - RNA, 22 nt, Human
ccagguuugugguguucugggg

SEQ ID NO: 1290859 - RNA, 23 nt, Human
ccccaggcacucucagcucugaa

SEQ ID NO: 1290860 - RNA, 22 nt, Human
ccugcugugggcagggcucugc

SEQ ID NO: 1290861 - RNA, 19 nt, Human
cgacaccgcaggaugccca

SEQ ID NO: 1290862 - RNA, 19 nt, Human
cugcagccagugagggccc

SEQ ID NO: 1290863 - RNA, 23 nt, Human
cugcccuagcuugagagaacaac

SEQ ID NO: 1290864 - RNA, 18 nt, Human
cuggggguccuggugaag

SEQ ID NO: 1290865 - RNA, 20 nt, Human
cuucugcccuagcuugagag

SEQ ID NO: 1290866 - RNA, 21 nt, Human
cuugacaccccucuucugccc

SEQ ID NO: 1290867 - RNA, 22 nt, Human
gcagcagggucuggcagccucu

SEQ ID NO: 1290868 - RNA, 23 nt, Human
gccuuuccuguggccccaggcac

SEQ ID NO: 1290869 - RNA, 20 nt, Human
gcgggccaggccccugggug

SEQ ID NO: 1290870 - RNA, 18 nt, Human
ggccccugggugucuccc

SEQ ID NO: 1290871 - RNA, 27 nt, Human
ggcgggccaggccccugggggacucuc

SEQ ID NO: 1290872 - RNA, 18 nt, Human
gucuggcagccucugggc

SEQ ID NO: 1290873 - RNA, 21 nt, Human
guggccccaggcacucucagc

SEQ ID NO: 1290874 - RNA, 24 nt, Human
uaaggaaacagaucagcugcagcc

SEQ ID NO: 1290875 - RNA, 25 nt, Human
uaaggaaacagaucagcugcagcca

SEQ ID NO: 1290876 - RNA, 22 nt, Human
uccagguuugugguguucuggg

SEQ ID NO: 1290877 - RNA, 19 nt, Human
ucccauagcagcaccgguc

SEQ ID NO: 1290878 - RNA, 19 nt, Human
ucccuggagauguccuucc

SEQ ID NO: 1290879 - RNA, 19 nt, Human
uccuggugaagaccacacu

SEQ ID NO: 1290880 - RNA, 24 nt, Human
ucgacaccgcaggaugcccaggaa

SEQ ID NO: 1290881 - RNA, 20 nt, Human
ucuccagguuugugguguuc

SEQ ID NO: 1290882 - RNA, 25 nt, Human
ucucccauaucgcugucuuuaguga

SEQ ID NO: 1290883 - RNA, 21 nt, Human
ucugaagccaggcuauugcuc

SEQ ID NO: 1290884 - RNA, 22 nt, Human
ucuggcagccucugggcucucc

SEQ ID NO: 1290885 - RNA, 24 nt, Human
ugagggccccugcguugggccugg

SEQ ID NO: 1290886 - RNA, 19 nt, Human
ugcugugggcagggcucug

SEQ ID NO: 1290887 - RNA, 19 nt, Human
ugggcucuccagguuugug

SEQ ID NO: 1290888 - RNA, 25 nt, Human
ugggugucucccauaucgcugucuu

SEQ ID NO: 1290889 - RNA, 19 nt, Human
uucacagucucaaaauauu

SEQ ID NO: 1290890 - RNA, 21 nt, Human
aaccaauccacaugcaagguc

SEQ ID NO: 1290891 - RNA, 26 nt, Human
acaaggagccagccaccacauccaga

SEQ ID NO: 1290892 - RNA, 23 nt, Human
agcaaaaccaauccacaugcaag

SEQ ID NO: 1290893 - RNA, 19 nt, Human
caaaaccaauccacaugca

SEQ ID NO: 1290894 - RNA, 21 nt, Human
cacgcagacccucgauaggcc

SEQ ID NO: 1290895 - RNA, 24 nt, Human
cagcagcaaaaccaauccacaugc

SEQ ID NO: 1290896 - RNA, 26 nt, Human
cauccagaguauucauucucggucau

SEQ ID NO: 1290897 - RNA, 21 nt, Human
ccacaggaugcugagcugcug

SEQ ID NO: 1290898 - RNA, 18 nt, Human
ccucucacucugcgugug

SEQ ID NO: 1290899 - RNA, 19 nt, Human
gacucacggcuucuucccu

SEQ ID NO: 1290900 - RNA, 24 nt, Human
gacucacggcuucuucccuacuuc

SEQ ID NO: 1290901 - RNA, 22 nt, Human
uccacaugcaaggucuggaggu

SEQ ID NO: 1290902 - RNA, 22 nt, Human
ucccuacuucccacccagguuc

SEQ ID NO: 1290903 - RNA, 18 nt, Human
uccuggccacgcagaccc

SEQ ID NO: 1290904 - RNA, 25 nt, Human
ugcugagcugcuguccuugagcccu

SEQ ID NO: 1290905 - RNA, 19 nt, Human
ugucggacacauacuagga

SEQ ID NO: 1290906 - RNA, 19 nt, Human
ugugcagccacaggaugcu

SEQ ID NO: 1290907 - RNA, 21 nt, Human
uuuccuuacagcagcaaaacc

SEQ ID NO: 1290908 - RNA, 19 nt, Human
cauuccuguucacuugagg

SEQ ID NO: 1290909 - RNA, 24 nt, Human
gaacuaggcugucugauccccagu

SEQ ID NO: 1290910 - RNA, 19 nt, Human
uacucuguccgggcuccug

SEQ ID NO: 1290911 - RNA, 23 nt, Human
ucccgccccaucccccaaaguaa

SEQ ID NO: 1290912 - RNA, 24 nt, Human
ugauccccagucccgccccauccc

SEQ ID NO: 1290913 - RNA, 22 nt, Human
uggaggagagagagcaggagca

SEQ ID NO: 1290914 - RNA, 23 nt, Human
uggaggagagagagcaggagcag

SEQ ID NO: 1290915 - RNA, 21 nt, Human
cggcgggaggauccccgggcc

SEQ ID NO: 1290916 - RNA, 23 nt, Human
uccccgggccgcuuucgccuccg

SEQ ID NO: 1290917 - RNA, 21 nt, Human
aagguguuuggauuguugaga

SEQ ID NO: 1290918 - RNA, 19 nt, Human
acuacagacagagacugug

SEQ ID NO: 1290919 - RNA, 20 nt, Human
agagacugugauuugagaug

SEQ ID NO: 1290920 - RNA, 19 nt, Human
agggaugaagaaaguuacu

SEQ ID NO: 1290921 - RNA, 23 nt, Human
caagaucgaggcacugaccaguc

SEQ ID NO: 1290922 - RNA, 20 nt, Human
caagggaugaagaaaguuac

SEQ ID NO: 1290923 - RNA, 26 nt, Human
ggcagauccacacuaugccaucucuu

SEQ ID NO: 1290924 - RNA, 23 nt, Human
uacuacagacagagacugugauu

SEQ ID NO: 1290925 - RNA, 21 nt, Human
ucaagggaugaagaaaguuac

SEQ ID NO: 1290926 - RNA, 24 nt, Human
ucuacuacagacagagacugugau

SEQ ID NO: 1290927 - RNA, 21 nt, Human
ugccaggggucagauuaagca

SEQ ID NO: 1290928 - RNA, 19 nt, Human
uucaagggaugaagaaagu

SEQ ID NO: 1290929 - RNA, 19 nt, Human
uucaagggaugaagaaagu

SEQ ID NO: 1290930 - RNA, 22 nt, Human
uucaagggaugaagaaaguuac

SEQ ID NO: 1290931 - RNA, 22 nt, Human
uucaagggaugaagaaaguuac

SEQ ID NO: 1290932 - RNA, 23 nt, Human
uucaagggaugaagaaaguuacu

SEQ ID NO: 1290933 - RNA, 26 nt, Human
aaaacagaagauacuaaaaaauggga

SEQ ID NO: 1290934 - RNA, 24 nt, Human
agaagauacuaaaaaaugggacua

SEQ ID NO: 1290935 - RNA, 19 nt, Human
aggaaaagagaucacaacg

SEQ ID NO: 1290936 - RNA, 23 nt, Human
aggccucagagaccacaaacacc

SEQ ID NO: 1290937 - RNA, 23 nt, Human
auacaauaugguuccaaaauggg

SEQ ID NO: 1290938 - RNA, 18 nt, Human
augggaaacuaaaauaga

SEQ ID NO: 1290939 - RNA, 18 nt, Human
caccgacugcucccucaa

SEQ ID NO: 1290940 - RNA, 19 nt, Human
cgugagaaaacagaagaua

SEQ ID NO: 1290941 - RNA, 20 nt, Human
cugcucccucaaagaauucc

SEQ ID NO: 1290942 - RNA, 21 nt, Human
gaugauggaagaagcauggaa

SEQ ID NO: 1290943 - RNA, 23 nt, Human
gccgcgccaacuccggcgucggg

SEQ ID NO: 1290944 - RNA, 19 nt, Human
gugagaaaacagaagauac

SEQ ID NO: 1290945 - RNA, 24 nt, Human
gugagaaaacagaagauacuaaaa

SEQ ID NO: 1290946 - RNA, 28 nt, Human
uaaaaaaugggacuaucuagugccugaa

SEQ ID NO: 1290947 - RNA, 25 nt, Human
uacaaagaaacauauaccaggcugg

SEQ ID NO: 1290948 - RNA, 24 nt, Human
uaccaggcugaacaaaccagaggc

SEQ ID NO: 1290949 - RNA, 18 nt, Human
ugagaaaacagaagauac

SEQ ID NO: 1290950 - RNA, 24 nt, Human
ugagaaaacagaagauacuaaaaa

SEQ ID NO: 1290951 - RNA, 19 nt, Human
ugagagggaacugagucuu

SEQ ID NO: 1290952 - RNA, 23 nt, Human
uggaagaagcauggaaauacaau

SEQ ID NO: 1290953 - RNA, 24 nt, Human
uggaagaagcauggaaauacaaua

SEQ ID NO: 1290954 - RNA, 22 nt, Human
acacgauccgcggugacugcac

SEQ ID NO: 1290955 - RNA, 27 nt, Human
agagcaaaugcagggcacuuggggccc

SEQ ID NO: 1290956 - RNA, 25 nt, Human
agcaaaugcagggcacuuggggccc

SEQ ID NO: 1290957 - RNA, 21 nt, Human
caaugaguguggugaaccauc

SEQ ID NO: 1290958 - RNA, 24 nt, Human
cacacgauccgcggugacugcacc

SEQ ID NO: 1290959 - RNA, 27 nt, Human
ccacagggcugccggacucgcguggcc

SEQ ID NO: 1290960 - RNA, 19 nt, Human
cccaagcuuccuccagaug

SEQ ID NO: 1290961 - RNA, 24 nt, Human
ccccagccggcccuuugcuuucac

SEQ ID NO: 1290962 - RNA, 19 nt, Human
cucgcccaagcuuccucca

SEQ ID NO: 1290963 - RNA, 23 nt, Human
cugccggacucgcguggccgcgu

SEQ ID NO: 1290964 - RNA, 21 nt, Human
cuuggggcccgggagccuugg

SEQ ID NO: 1290965 - RNA, 22 nt, Human
cuuuguuagaagagcaaaugca

SEQ ID NO: 1290966 - RNA, 24 nt, Human
gcccaagcuuccuccagaugccga

SEQ ID NO: 1290967 - RNA, 19 nt, Human
gccuugauccgucucucca

SEQ ID NO: 1290968 - RNA, 20 nt, Human
uagaagagcaaaugcagggc

SEQ ID NO: 1290969 - RNA, 21 nt, Human
ucucuccauuugcuucccauc

SEQ ID NO: 1290970 - RNA, 19 nt, Human
ugcaaugaguguggugaac

SEQ ID NO: 1290971 - RNA, 18 nt, Human
uggggcccgggagccuug

SEQ ID NO: 1290972 - RNA, 18 nt, Human
aagccacagcugaacacc

SEQ ID NO: 1290973 - RNA, 18 nt, Human
acaccaguuccccaugaa

SEQ ID NO: 1290974 - RNA, 20 nt, Human
aggccccaggggaacaccag

SEQ ID NO: 1290975 - RNA, 21 nt, Human
caguugccaggaggacaccag

SEQ ID NO: 1290976 - RNA, 18 nt, Human
ccaguuccccaugaacac

SEQ ID NO: 1290977 - RNA, 21 nt, Human
ccucaggugggcaccuagucc

SEQ ID NO: 1290978 - RNA, 20 nt, Human
ccuuacaccaagugaucucc

SEQ ID NO: 1290979 - RNA, 22 nt, Human
cucuucaggccccaggggaaca

SEQ ID NO: 1290980 - RNA, 26 nt, Human
cugaacaccaguuccccaugaacacc

SEQ ID NO: 1290981 - RNA, 23 nt, Human
uagcccaccuccuuacaccaagu

SEQ ID NO: 1290982 - RNA, 18 nt, Human
ucaagccacagcugaaca

SEQ ID NO: 1290983 - RNA, 18 nt, Human
uccucaggugggcaccua

SEQ ID NO: 1290984 - RNA, 20 nt, Human
ugccaggaggacaccaggac

SEQ ID NO: 1290985 - RNA, 23 nt, Human
ugcccagcuucauuaagcuuaaa

SEQ ID NO: 1290986 - RNA, 23 nt, Human
ugugugcaucaggugccaggcug

SEQ ID NO: 1290987 - RNA, 18 nt, Human
agcaccuuccccgucccg

SEQ ID NO: 1290988 - RNA, 23 nt, Human
cagccgccgcccuccacgcccgg

SEQ ID NO: 1290989 - RNA, 20 nt, Human
ccaagcaccuuccccguccc

SEQ ID NO: 1290990 - RNA, 22 nt, Human
ccacgcccggcgcgggcaggca

SEQ ID NO: 1290991 - RNA, 21 nt, Human
cccacagggaccacagcuucc

SEQ ID NO: 1290992 - RNA, 20 nt, Human
ccccgucccgcccugucugc

SEQ ID NO: 1290993 - RNA, 24 nt, Human
ccccucgcagccgccgcccuccac

SEQ ID NO: 1290994 - RNA, 19 nt, Human
cccgcagucccgcgugcau

SEQ ID NO: 1290995 - RNA, 20 nt, Human
ccgcagucccgcgugcauuc

SEQ ID NO: 1290996 - RNA, 18 nt, Human
ccgccgcccuccacgccc

SEQ ID NO: 1290997 - RNA, 18 nt, Human
ccuccaagcaccuucccc

SEQ ID NO: 1290998 - RNA, 24 nt, Human
cgcgucuggaggccucccccgcag

SEQ ID NO: 1290999 - RNA, 21 nt, Human
cuccagcacccccucgcagcc

SEQ ID NO: 1291000 - RNA, 21 nt, Human
cuccagcacccccucgcagcc

SEQ ID NO: 1291001 - RNA, 18 nt, Human
cuggaggccucccccgca

SEQ ID NO: 1291002 - RNA, 25 nt, Human
cuggcgacccuccuccagcaccccc

SEQ ID NO: 1291003 - RNA, 20 nt, Human
gacccuccuccagcaccccc

SEQ ID NO: 1291004 - RNA, 22 nt, Human
gcgggcaggcaggugcgcgucc

SEQ ID NO: 1291005 - RNA, 24 nt, Human
gcgguugcacuggcgacccuccuc

SEQ ID NO: 1291006 - RNA, 18 nt, Human
ucacugcacccuccaagc

SEQ ID NO: 1291007 - RNA, 23 nt, Human
uccaagcaccuuccccgucccgc

SEQ ID NO: 1291008 - RNA, 21 nt, Human
uccacgcccggcgcgggcagg

SEQ ID NO: 1291009 - RNA, 20 nt, Human
ucccgcgugcauucgccccu

SEQ ID NO: 1291010 - RNA, 23 nt, Human
ucgccccacagggaccacagcuu

SEQ ID NO: 1291011 - RNA, 20 nt, Human
ugcacuggcgacccuccucc

SEQ ID NO: 1291012 - RNA, 21 nt, Human
uugcacuggcgacccuccucc

SEQ ID NO: 1291013 - RNA, 23 nt, Human
agcgaaacugguccucugggggc

SEQ ID NO: 1291014 - RNA, 20 nt, Human
aucuggcuccggcccagagc

SEQ ID NO: 1291015 - RNA, 19 nt, Human
caugaggcgcgaugcgugg

SEQ ID NO: 1291016 - RNA, 21 nt, Human
ccccucgaaacuccccuggca

SEQ ID NO: 1291017 - RNA, 28 nt, Human
ccggcggcgcagcgaaacugguccucuu

SEQ ID NO: 1291018 - RNA, 21 nt, Human
ccucgaaacuccccuggcaga

SEQ ID NO: 1291019 - RNA, 23 nt, Human
cgagggccccugcugggagagug

SEQ ID NO: 1291020 - RNA, 21 nt, Human
cggcccagagcaugaggcgcg

SEQ ID NO: 1291021 - RNA, 22 nt, Human
cggcgcagcgaaacugguccuc

SEQ ID NO: 1291022 - RNA, 20 nt, Human
cgggagggaugaagggagca

SEQ ID NO: 1291023 - RNA, 22 nt, Human
cucuccgcauugcccccucgaa

SEQ ID NO: 1291024 - RNA, 24 nt, Human
cuguguccagcuggccgaguccca

SEQ ID NO: 1291025 - RNA, 26 nt, Human
gaugaagggagcaggggugggaggga

SEQ ID NO: 1291026 - RNA, 25 nt, Human
gcaccggaauuucuagacgcuucca

SEQ ID NO: 1291027 - RNA, 18 nt, Human
ggagcaggggugggaggg

SEQ ID NO: 1291028 - RNA, 20 nt, Human
gggccuccgagggccccugc

SEQ ID NO: 1291029 - RNA, 20 nt, Human
ggucugguggucgggaggga

SEQ ID NO: 1291030 - RNA, 24 nt, Human
guggggucugguggucgggaggga

SEQ ID NO: 1291031 - RNA, 23 nt, Human
ucaucuggcuccggcccagagca

SEQ ID NO: 1291032 - RNA, 19 nt, Human
uccccuggcagagucuguc

SEQ ID NO: 1291033 - RNA, 18 nt, Human
ugcccgugguuuugggga

SEQ ID NO: 1291034 - RNA, 21 nt, Human
ugcgaaguuuggcaaaaccgg

SEQ ID NO: 1291035 - RNA, 18 nt, Human
ugcugggcuggacccgug

SEQ ID NO: 1291036 - RNA, 19 nt, Human
uggccgagucccauuugcu

SEQ ID NO: 1291037 - RNA, 18 nt, Human
ugggagaguggggucugg

SEQ ID NO: 1291038 - RNA, 20 nt, Human
ugggagaguggggucuggug

SEQ ID NO: 1291039 - RNA, 22 nt, Human
uguccagcuggccgagucccau

SEQ ID NO: 1291040 - RNA, 23 nt, Human
ugucggcccgcgguucgcugcgc

SEQ ID NO: 1291041 - RNA, 22 nt, Human
uugcugggcuggacccguggcc

SEQ ID NO: 1291042 - RNA, 20 nt, Human
cccucuugcccuuccaccuu

SEQ ID NO: 1291043 - RNA, 23 nt, Human
ccuugcugucuugugcccucuug

SEQ ID NO: 1291044 - RNA, 20 nt, Human
cuugugcccucuugcccuuc

SEQ ID NO: 1291045 - RNA, 25 nt, Human
ugucuugugcccucuugcccuucca

SEQ ID NO: 1291046 - RNA, 18 nt, Human
aaacugccucagcugugg

SEQ ID NO: 1291047 - RNA, 25 nt, Human
aauacacauacacacacuaaaugug

SEQ ID NO: 1291048 - RNA, 19 nt, Human
acagagaggccacaugauc

SEQ ID NO: 1291049 - RNA, 23 nt, Human
acuuuaagaaguuaugagaaaga

SEQ ID NO: 1291050 - RNA, 22 nt, Human
agaccccugcaacucugcccaa

SEQ ID NO: 1291051 - RNA, 19 nt, Human
agauguuuccaggagagau

SEQ ID NO: 1291052 - RNA, 21 nt, Human
aggaacccaaauaauccggcc

SEQ ID NO: 1291053 - RNA, 22 nt, Human
aguuaugagaaagaaugaauac

SEQ ID NO: 1291054 - RNA, 22 nt, Human
auguggcagauguuuccaggag

SEQ ID NO: 1291055 - RNA, 19 nt, Human
ccagaccaaauauagacac

SEQ ID NO: 1291056 - RNA, 18 nt, Human
cccaaauaauccggccaa

SEQ ID NO: 1291057 - RNA, 18 nt, Human
ccccugcaacucugccca

SEQ ID NO: 1291058 - RNA, 21 nt, Human
ccccugcaacucugcccaacu

SEQ ID NO: 1291059 - RNA, 22 nt, Human
ccccugcaacucugcccaacuc

SEQ ID NO: 1291060 - RNA, 21 nt, Human
gcaacagagaggccacaugau

SEQ ID NO: 1291061 - RNA, 24 nt, Human
gcaacagagaggccacaugaucaa

SEQ ID NO: 1291062 - RNA, 23 nt, Human
gcagagcugucugcuaaugugag

SEQ ID NO: 1291063 - RNA, 20 nt, Human
gccacaugaucaaauaaaau

SEQ ID NO: 1291064 - RNA, 22 nt, Human
ggagaccccugcaacucugccc

SEQ ID NO: 1291065 - RNA, 20 nt, Human
ggccaaacugccucagcugu

SEQ ID NO: 1291066 - RNA, 21 nt, Human
uaaugugagcggggaaggcca

SEQ ID NO: 1291067 - RNA, 29 nt, Human
ucagccagaccaaauauagacacacugga

SEQ ID NO: 1291068 - RNA, 22 nt, Human
uccagccgaucagccagaccaa

SEQ ID NO: 1291069 - RNA, 18 nt, Human
ugaauacacauacacaca

SEQ ID NO: 1291070 - RNA, 20 nt, Human
ugagcggggaaggccagagu

SEQ ID NO: 1291071 - RNA, 19 nt, Human
ugcccaacucuuccucucg

SEQ ID NO: 1291072 - RNA, 19 nt, Human
uguggcagauguuuccagg

SEQ ID NO: 1291073 - RNA, 18 nt, Human
auaagacaaucuuuucau

SEQ ID NO: 1291074 - RNA, 18 nt, Human
auuucaccugggugcagg

SEQ ID NO: 1291075 - RNA, 21 nt, Human
cacccaauacuuuuguuucca

SEQ ID NO: 1291076 - RNA, 23 nt, Human
cauuucauguuucaaaguaagga

SEQ ID NO: 1291077 - RNA, 21 nt, Human
cccaauacuuuuguuuccagc

SEQ ID NO: 1291078 - RNA, 22 nt, Human
ccugaguaaauccaaucccccu

SEQ ID NO: 1291079 - RNA, 19 nt, Human
ccugggugcaggugggcug

SEQ ID NO: 1291080 - RNA, 19 nt, Human
cucacuuguaauuuuuccu

SEQ ID NO: 1291081 - RNA, 18 nt, Human
cuuugugugagcaacaug

SEQ ID NO: 1291082 - RNA, 20 nt, Human
ggagccaauuauaacccuuc

SEQ ID NO: 1291083 - RNA, 18 nt, Human
ggugggccaaauauggca

SEQ ID NO: 1291084 - RNA, 18 nt, Human
ucuccagauuuuggaaga

SEQ ID NO: 1291085 - RNA, 23 nt, Human
ucuuugugccuggugggccaaau

SEQ ID NO: 1291086 - RNA, 23 nt, Human
uguaaugcccacaauaagacaau

SEQ ID NO: 1291087 - RNA, 21 nt, Human
uuaaaggagccaauuauaacc

SEQ ID NO: 1291088 - RNA, 24 nt, Human
uucaccugggugcaggugggcucc

SEQ ID NO: 1291089 - RNA, 22 nt, Human
uugaaacuauaauuugauccuc

SEQ ID NO: 1291090 - RNA, 21 nt, Human
uuugauccucauuucauguuu

SEQ ID NO: 1291091 - RNA, 19 nt, Human
ccuccugcuguaguugaag

SEQ ID NO: 1291092 - RNA, 20 nt, Human
cuccugcuguaguugaagac

SEQ ID NO: 1291093 - RNA, 25 nt, Human
acccccgcccuucccccuccuccac

SEQ ID NO: 1291094 - RNA, 19 nt, Human
agaaaagcccauccugaag

SEQ ID NO: 1291095 - RNA, 20 nt, Human
agaaggucuaaggcagagaa

SEQ ID NO: 1291096 - RNA, 22 nt, Human
agccugcgaccgcgcggcauca

SEQ ID NO: 1291097 - RNA, 23 nt, Human
aggaagguauccccaucaggccu

SEQ ID NO: 1291098 - RNA, 22 nt, Human
aggcaaggccaggguuuaggug

SEQ ID NO: 1291099 - RNA, 21 nt, Human
caggaaagaauguucauggca

SEQ ID NO: 1291100 - RNA, 20 nt, Human
ccccaggaaaugugguuggg

SEQ ID NO: 1291101 - RNA, 23 nt, Human
ccccaggaaaugugguuggguga

SEQ ID NO: 1291102 - RNA, 18 nt, Human
ccccaucaggccuccucu

SEQ ID NO: 1291103 - RNA, 26 nt, Human
cccccgcccuucccccuccuccaccc

SEQ ID NO: 1291104 - RNA, 18 nt, Human
ccccgcccuucccccucc

SEQ ID NO: 1291105 - RNA, 22 nt, Human
ccccgcccuucccccuccucca

SEQ ID NO: 1291106 - RNA, 18 nt, Human
ccccgugccuggccccuc

SEQ ID NO: 1291107 - RNA, 21 nt, Human
cccgcccuucccccuccucca

SEQ ID NO: 1291108 - RNA, 18 nt, Human
ccgcccuucccccuccuc

SEQ ID NO: 1291109 - RNA, 21 nt, Human
cgugccuggccccucagagcc

SEQ ID NO: 1291110 - RNA, 20 nt, Human
cucucuggcacaagaucuug

SEQ ID NO: 1291111 - RNA, 20 nt, Human
gacagcaggaagguaucccc

SEQ ID NO: 1291112 - RNA, 20 nt, Human
gacugcagggcagggcacug

SEQ ID NO: 1291113 - RNA, 19 nt, Human
gaguugcgaguuagcgucg

SEQ ID NO: 1291114 - RNA, 23 nt, Human
gcacccacggcgccccugcuugc

SEQ ID NO: 1291115 - RNA, 23 nt, Human
gggcagggcacugcuggguucuc

SEQ ID NO: 1291116 - RNA, 19 nt, Human
gugguugggugagucaugg

SEQ ID NO: 1291117 - RNA, 20 nt, Human
uagcucagacugcagggcag

SEQ ID NO: 1291118 - RNA, 21 nt, Human
ucuaaggcagagaacacagau

SEQ ID NO: 1291119 - RNA, 18 nt, Human
ucuggcacaagaucuuga

SEQ ID NO: 1291120 - RNA, 20 nt, Human
ugaggccccaggaaaugugg

SEQ ID NO: 1291121 - RNA, 18 nt, Human
ugccucuguccgggucuc

SEQ ID NO: 1291122 - RNA, 19 nt, Human
ugcucaggaaggacagcag

SEQ ID NO: 1291123 - RNA, 20 nt, Human
uggguuuucucagcaagagg

SEQ ID NO: 1291124 - RNA, 22 nt, Human
uucacaaggaaucugguagcuc

SEQ ID NO: 1291125 - RNA, 20 nt, Human
agauggcuggugagaauuag

SEQ ID NO: 1291126 - RNA, 19 nt, Human
agcccugcugaauguggug

SEQ ID NO: 1291127 - RNA, 22 nt, Human
auguggugcaaguucagggcug

SEQ ID NO: 1291128 - RNA, 22 nt, Human
gagauggcuggugagaauucag

SEQ ID NO: 1291129 - RNA, 20 nt, Human
gcccugagauggcuggugag

SEQ ID NO: 1291130 - RNA, 23 nt, Human
ggcuggugccuggccacagggcc

SEQ ID NO: 1291131 - RNA, 21 nt, Human
ucagcccugcugaauguggug

SEQ ID NO: 1291132 - RNA, 18 nt, Human
ugacuggugaaguccugc

SEQ ID NO: 1291133 - RNA, 18 nt, Human
ugcauggaguuccaauga

SEQ ID NO: 1291134 - RNA, 21 nt, Human
uggugccuggccacagggccu

SEQ ID NO: 1291135 - RNA, 22 nt, Human
uucaaaugaggaaucaguagga

SEQ ID NO: 1291136 - RNA, 22 nt, Human
ugcggccacagacuccugccac

SEQ ID NO: 1291137 - RNA, 18 nt, Human
ugggcuucugccacccaa

SEQ ID NO: 1291138 - RNA, 22 nt, Human
agcgcgcaggcgcagcagcccc

SEQ ID NO: 1291139 - RNA, 23 nt, Human
cacacccguucccuugacagcug

SEQ ID NO: 1291140 - RNA, 21 nt, Human
ccgcggcaagccgcgagcgcg

SEQ ID NO: 1291141 - RNA, 21 nt, Human
ccuuccacacccguucccuug

SEQ ID NO: 1291142 - RNA, 23 nt, Human
cgcggaccuuugccccgccuccu

SEQ ID NO: 1291143 - RNA, 25 nt, Human
ugggcugcgcuccgggccgcggcaa

SEQ ID NO: 1291144 - RNA, 21 nt, Human
uugccccgccuccuuccacac

SEQ ID NO: 1291145 - RNA, 24 nt, Human
augggccucggcuuuccugucuuc

SEQ ID NO: 1291146 - RNA, 20 nt, Human
ggccucggcuuuccugucuu

SEQ ID NO: 1291147 - RNA, 21 nt, Human
ugggccucggcuuuccugucu

SEQ ID NO: 1291148 - RNA, 26 nt, Human
aagaggccagggauuuggcgguggga

SEQ ID NO: 1291149 - RNA, 20 nt, Human
acagcggaagaggccaggga

SEQ ID NO: 1291150 - RNA, 20 nt, Human
agcagaagcgguaacggcag

SEQ ID NO: 1291151 - RNA, 18 nt, Human
aggggggcguccaggcag

SEQ ID NO: 1291152 - RNA, 19 nt, Human
caccaggggggcguccagg

SEQ ID NO: 1291153 - RNA, 21 nt, Human
caccaggggggcguccaggca

SEQ ID NO: 1291154 - RNA, 20 nt, Human
cacuuuguccuucccguaca

SEQ ID NO: 1291155 - RNA, 18 nt, Human
cagccguugaggaagcgg

SEQ ID NO: 1291156 - RNA, 23 nt, Human
ccacuuuguccuucccguacaug

SEQ ID NO: 1291157 - RNA, 19 nt, Human
cccaugacgccgccggggc

SEQ ID NO: 1291158 - RNA, 22 nt, Human
cccaugacgccgccggggcgcg

SEQ ID NO: 1291159 - RNA, 24 nt, Human
cccgcggcuggugcccucugaagc

SEQ ID NO: 1291160 - RNA, 20 nt, Human
cccguacaugugcccggcca

SEQ ID NO: 1291161 - RNA, 19 nt, Human
ccgcagccgccggccccgg

SEQ ID NO: 1291162 - RNA, 20 nt, Human
ccgcagccgccggccccggc

SEQ ID NO: 1291163 - RNA, 22 nt, Human
ccguacaugugcccggccaccu

SEQ ID NO: 1291164 - RNA, 20 nt, Human
cgaggaggcccggggguucc

SEQ ID NO: 1291165 - RNA, 26 nt, Human
cgccggagaacccgagggucgcucag

SEQ ID NO: 1291166 - RNA, 23 nt, Human
cggaagaggccagggauuuggcg

SEQ ID NO: 1291167 - RNA, 21 nt, Human
cggcucccggcuccuguuccu

SEQ ID NO: 1291168 - RNA, 18 nt, Human
cugaagcgcggggagggg

SEQ ID NO: 1291169 - RNA, 20 nt, Human
cugcggggugcccucagggg

SEQ ID NO: 1291170 - RNA, 18 nt, Human
gaaaaaaaauagggcgag

SEQ ID NO: 1291171 - RNA, 21 nt, Human
gagcagaagcgguaacggcag

SEQ ID NO: 1291172 - RNA, 20 nt, Human
gagggagggggcgccggaga

SEQ ID NO: 1291173 - RNA, 21 nt, Human
gcguccaggcaggcccgagag

SEQ ID NO: 1291174 - RNA, 23 nt, Human
ggaagcggagucugccgcccgcc

SEQ ID NO: 1291175 - RNA, 20 nt, Human
ggcgcgggcgcuccucugcc

SEQ ID NO: 1291176 - RNA, 18 nt, Human
gggagggggcccaugacg

SEQ ID NO: 1291177 - RNA, 18 nt, Human
gggcgagggagggggcgc

SEQ ID NO: 1291178 - RNA, 22 nt, Human
gggcgcgaggaggcccgggggu

SEQ ID NO: 1291179 - RNA, 18 nt, Human
gggcgcuccucugcccaa

SEQ ID NO: 1291180 - RNA, 19 nt, Human
ggggacagcggaagaggcc

SEQ ID NO: 1291181 - RNA, 23 nt, Human
gugcacaccaggggggcguccag

SEQ ID NO: 1291182 - RNA, 21 nt, Human
guugccauaacggagagcaga

SEQ ID NO: 1291183 - RNA, 21 nt, Human
uaacggcagcgagaguaggaa

SEQ ID NO: 1291184 - RNA, 24 nt, Human
ucaaaacugugccaucuggauguu

SEQ ID NO: 1291185 - RNA, 18 nt, Human
ucaggcucgggcgcgagg

SEQ ID NO: 1291186 - RNA, 19 nt, Human
uccucugccgccgcagccg

SEQ ID NO: 1291187 - RNA, 20 nt, Human
uccucugccgccgcagccgc

SEQ ID NO: 1291188 - RNA, 21 nt, Human
ucgggcgcgaggaggcccggg

SEQ ID NO: 1291189 - RNA, 22 nt, Human
ugcccaacucucggcggaacgc

SEQ ID NO: 1291190 - RNA, 19 nt, Human
ugcccucugaagcgcgggg

SEQ ID NO: 1291191 - RNA, 20 nt, Human
ugcgagaggggcacgcagcc

SEQ ID NO: 1291192 - RNA, 23 nt, Human
auaaugauaaggaguugcuuuac

SEQ ID NO: 1291193 - RNA, 18 nt, Human
cacaaggagaggaauguu

SEQ ID NO: 1291194 - RNA, 19 nt, Human
cagaucacugaaguggucu

SEQ ID NO: 1291195 - RNA, 19 nt, Human
ccugggcaacaaauaaaac

SEQ ID NO: 1291196 - RNA, 24 nt, Human
cgcucuuuccagauacucucuucu

SEQ ID NO: 1291197 - RNA, 21 nt, Human
cucuguuuuucaauccucuga

SEQ ID NO: 1291198 - RNA, 24 nt, Human
cucuucuuccaggcuguaggucuu

SEQ ID NO: 1291199 - RNA, 22 nt, Human
gcucuuuccagauacucucuuc

SEQ ID NO: 1291200 - RNA, 24 nt, Human
uaaaauccugauucauuagcauua

SEQ ID NO: 1291201 - RNA, 19 nt, Human
uaaaugccuccaggggcgc

SEQ ID NO: 1291202 - RNA, 19 nt, Human
ugugucacuagcccucugu

SEQ ID NO: 1291203 - RNA, 19 nt, Human
uuacgcaugcgcucuuucc

SEQ ID NO: 1291204 - RNA, 23 nt, Human
uucauuagcauuaagucaccagg

SEQ ID NO: 1291205 - RNA, 20 nt, Human
uugcuuuacgcaugcgcucu

SEQ ID NO: 1291206 - RNA, 20 nt, Human
ggacucucccaccuucgagg

SEQ ID NO: 1291207 - RNA, 23 nt, Human
ucuuuucuucucuggacucuccc

SEQ ID NO: 1291208 - RNA, 21 nt, Human
aaaaagauuugacaaaaacua

SEQ ID NO: 1291209 - RNA, 19 nt, Human
aaacugcagcucguuccuc

SEQ ID NO: 1291210 - RNA, 21 nt, Human
aaagcauaaaaaaugcucuuc

SEQ ID NO: 1291211 - RNA, 20 nt, Human
aagcuggaccacugaaacca

SEQ ID NO: 1291212 - RNA, 22 nt, Human
aaugacuuccugaggaaacaga

SEQ ID NO: 1291213 - RNA, 25 nt, Human
acacaaccccaauaacaggggaacc

SEQ ID NO: 1291214 - RNA, 26 nt, Human
acaccaacacaaagcauaaaaaaugu

SEQ ID NO: 1291215 - RNA, 21 nt, Human
acgcacaucucaggggaacgc

SEQ ID NO: 1291216 - RNA, 23 nt, Human
acgcugcugguaaaggcugggug

SEQ ID NO: 1291217 - RNA, 26 nt, Human
acugcagcucguuccucagacgcacu

SEQ ID NO: 1291218 - RNA, 23 nt, Human
agaguacaaaaauuacacaccaa

SEQ ID NO: 1291219 - RNA, 23 nt, Human
auaaaaaaugcucuucauccaca

SEQ ID NO: 1291220 - RNA, 22 nt, Human
augacuuccugaggaaacagag

SEQ ID NO: 1291221 - RNA, 22 nt, Human
auuccaucuauguucccuuuca

SEQ ID NO: 1291222 - RNA, 28 nt, Human
caaaaaagauuugacaaaaacuagccac

SEQ ID NO: 1291223 - RNA, 24 nt, Human
caaggcagagaaauacauugauca

SEQ ID NO: 1291224 - RNA, 23 nt, Human
caauaauaacaaugaaaaacgaa

SEQ ID NO: 1291225 - RNA, 25 nt, Human
cacacaaccccaauaacagcauuuu

SEQ ID NO: 1291226 - RNA, 21 nt, Human
cacaccaacacaaagcauaaa

SEQ ID NO: 1291227 - RNA, 22 nt, Human
caccuccacaccucgacugccu

SEQ ID NO: 1291228 - RNA, 22 nt, Human
cacggaggcuacgcacaucuca

SEQ ID NO: 1291229 - RNA, 22 nt, Human
cacguggccauugcccgcaccc

SEQ ID NO: 1291230 - RNA, 18 nt, Human
cagagaaauacauugauc

SEQ ID NO: 1291231 - RNA, 24 nt, Human
ccaauaacagcauucucacaauaa

SEQ ID NO: 1291232 - RNA, 23 nt, Human
ccauugcccgcacccugucccgu

SEQ ID NO: 1291233 - RNA, 25 nt, Human
cccaauaacagcauucucacaauaa

SEQ ID NO: 1291234 - RNA, 20 nt, Human
cggggccuuggccacguggc

SEQ ID NO: 1291235 - RNA, 24 nt, Human
cucaaaguaaaaagaagcuugcaa

SEQ ID NO: 1291236 - RNA, 23 nt, Human
cucacacacaaccccaauaacag

SEQ ID NO: 1291237 - RNA, 21 nt, Human
cugaaaccaaacaauuggaug

SEQ ID NO: 1291238 - RNA, 23 nt, Human
cugcacugucuuccccaacccaa

SEQ ID NO: 1291239 - RNA, 22 nt, Human
gaccacugaaaccaaacaauug

SEQ ID NO: 1291240 - RNA, 18 nt, Human
gcacuguugggugcgaag

SEQ ID NO: 1291241 - RNA, 21 nt, Human
gcugcacugucuuccccaacc

SEQ ID NO: 1291242 - RNA, 20 nt, Human
gcugcugguaaaggcugggu

SEQ ID NO: 1291243 - RNA, 18 nt, Human
ggaugggaaaauaugaua

SEQ ID NO: 1291244 - RNA, 19 nt, Human
ggggaacgcucaaacugca

SEQ ID NO: 1291245 - RNA, 22 nt, Human
guaaaaagaagcuugcaaaaca

SEQ ID NO: 1291246 - RNA, 24 nt, Human
uaaaaaaugcucuucauccacaua

SEQ ID NO: 1291247 - RNA, 26 nt, Human
uaaaaagaagcuugcaaaacaucuca

SEQ ID NO: 1291248 - RNA, 25 nt, Human
uaaacagaugucuaauaaaugcaua

SEQ ID NO: 1291249 - RNA, 23 nt, Human
uaaagcuggaccacugaaaccaa

SEQ ID NO: 1291250 - RNA, 21 nt, Human
uaauaacaaugaaaaacgaaa

SEQ ID NO: 1291251 - RNA, 21 nt, Human
uaucauaaaaucaaaacauuu

SEQ ID NO: 1291252 - RNA, 24 nt, Human
ucaaaacauuuaagcaauauucca

SEQ ID NO: 1291253 - RNA, 27 nt, Human
ucacaauaauaacaaugaaaaacgaaa

SEQ ID NO: 1291254 - RNA, 24 nt, Human
ucaccuccacaccucgacugccuu

SEQ ID NO: 1291255 - RNA, 18 nt, Human
uccccaacccaacauugc

SEQ ID NO: 1291256 - RNA, 22 nt, Human
ugaaaaacgaaaaaccaaacag

SEQ ID NO: 1291257 - RNA, 19 nt, Human
ugauaggcaauuaagccau

SEQ ID NO: 1291258 - RNA, 18 nt, Human
ugaucaccuccacaccuc

SEQ ID NO: 1291259 - RNA, 24 nt, Human
ugcacaaaagcauaaaaaaugcuc

SEQ ID NO: 1291260 - RNA, 18 nt, Human
ugcacuaaacuuauuuuc

SEQ ID NO: 1291261 - RNA, 19 nt, Human
ugcacugucuuccccaacc

SEQ ID NO: 1291262 - RNA, 23 nt, Human
uggaccacugaaaccaaacaauu

SEQ ID NO: 1291263 - RNA, 21 nt, Human
ugggugcgaaggacaccugga

SEQ ID NO: 1291264 - RNA, 18 nt, Human
ugugaugugguggcgcag

SEQ ID NO: 1291265 - RNA, 23 nt, Human
aaaauaaaaugaccauuugucuu

SEQ ID NO: 1291266 - RNA, 26 nt, Human
cccugcucgccacucgcccuccuuuu

SEQ ID NO: 1291267 - RNA, 18 nt, Human
ccgaagccccugcucgcc

SEQ ID NO: 1291268 - RNA, 18 nt, Human
ccgcgccgggccggccgc

SEQ ID NO: 1291269 - RNA, 19 nt, Human
cggaguccgaggccugggc

SEQ ID NO: 1291270 - RNA, 23 nt, Human
cggccgaagccccugcucgccac

SEQ ID NO: 1291271 - RNA, 20 nt, Human
ggagcagccgauggccgagg

SEQ ID NO: 1291272 - RNA, 21 nt, Human
ggccaccggggagcagccgau

SEQ ID NO: 1291273 - RNA, 23 nt, Human
ggcggcggccgagagccccgcgc

SEQ ID NO: 1291274 - RNA, 19 nt, Human
ugaauccaagaagaugugu

SEQ ID NO: 1291275 - RNA, 21 nt, Human
ugcucgccacucgcccuccuu

SEQ ID NO: 1291276 - RNA, 21 nt, Human
aagcugcaugugggcacugag

SEQ ID NO: 1291277 - RNA, 24 nt, Human
aagcugcaugugggcacugagcag

SEQ ID NO: 1291278 - RNA, 24 nt, Human
aaugucuuuggcuuccggcauguu

SEQ ID NO: 1291279 - RNA, 19 nt, Human
acacuaaaggcuccugggu

SEQ ID NO: 1291280 - RNA, 18 nt, Human
aggcuuuggaacagcagc

SEQ ID NO: 1291281 - RNA, 23 nt, Human
agugcugcugucaaaggcuuugg

SEQ ID NO: 1291282 - RNA, 22 nt, Human
auacggauagacacuaggcuuc

SEQ ID NO: 1291283 - RNA, 21 nt, Human
caaaggcuuuggaacagcagc

SEQ ID NO: 1291284 - RNA, 21 nt, Human
caauuguacaccagaggugga

SEQ ID NO: 1291285 - RNA, 20 nt, Human
cagcagcuacaauuguacac

SEQ ID NO: 1291286 - RNA, 18 nt, Human
ccucuccaggcaaaggcu

SEQ ID NO: 1291287 - RNA, 21 nt, Human
ccucuccaggcaaaggcuagc

SEQ ID NO: 1291288 - RNA, 23 nt, Human
ccuucgccgccggcgcguuuccc

SEQ ID NO: 1291289 - RNA, 22 nt, Human
ccuugaggucccuggaaaggga

SEQ ID NO: 1291290 - RNA, 22 nt, Human
cucaugcagaucuguucaugcc

SEQ ID NO: 1291291 - RNA, 22 nt, Human
cugcauagccuuguuccucugg

SEQ ID NO: 1291292 - RNA, 23 nt, Human
cugccuuaagacggacaugccug

SEQ ID NO: 1291293 - RNA, 18 nt, Human
cuggcaaaguacuuccgg

SEQ ID NO: 1291294 - RNA, 22 nt, Human
gaaagggacaugacugucaucu

SEQ ID NO: 1291295 - RNA, 21 nt, Human
gaccugugaaugaaccuccau

SEQ ID NO: 1291296 - RNA, 23 nt, Human
gacguccguccucuccaggcaaa

SEQ ID NO: 1291297 - RNA, 18 nt, Human
gccuggacacagaggggc

SEQ ID NO: 1291298 - RNA, 20 nt, Human
gcguuuccccggggguccau

SEQ ID NO: 1291299 - RNA, 23 nt, Human
ggaaaaauggacaucuccuucau

SEQ ID NO: 1291300 - RNA, 21 nt, Human
ggagaccuuuuugaaacuugc

SEQ ID NO: 1291301 - RNA, 20 nt, Human
ggcacugagcagagugcugc

SEQ ID NO: 1291302 - RNA, 22 nt, Human
gguauguccugacaugcagaug

SEQ ID NO: 1291303 - RNA, 21 nt, Human
gugcauuuucauaggaagaau

SEQ ID NO: 1291304 - RNA, 18 nt, Human
uaaccaugugguccgugu

SEQ ID NO: 1291305 - RNA, 21 nt, Human
uaagacggacaugccuggaca

SEQ ID NO: 1291306 - RNA, 20 nt, Human
uaaguuggauacuggagggg

SEQ ID NO: 1291307 - RNA, 19 nt, Human
uacauuggcagaagugggu

SEQ ID NO: 1291308 - RNA, 21 nt, Human
uaccaggugcagacucauuca

SEQ ID NO: 1291309 - RNA, 25 nt, Human
uagccuuguuccucuggaauuucua

SEQ ID NO: 1291310 - RNA, 21 nt, Human
ucaucuuuguacucccugcac

SEQ ID NO: 1291311 - RNA, 24 nt, Human
ucauucauuugacuguuuucucgu

SEQ ID NO: 1291312 - RNA, 21 nt, Human
uccgguacuggaaaauucacc

SEQ ID NO: 1291313 - RNA, 20 nt, Human
uccucugauguucuuccuga

SEQ ID NO: 1291314 - RNA, 23 nt, Human
uccuggguuggcuugugaagcug

SEQ ID NO: 1291315 - RNA, 19 nt, Human
uccuucgccgccggcgcgu

SEQ ID NO: 1291316 - RNA, 26 nt, Human
uccuugaguacagggacaaucugauu

SEQ ID NO: 1291317 - RNA, 25 nt, Human
ucuaugaucgauggcauggaaagac

SEQ ID NO: 1291318 - RNA, 21 nt, Human
ucugcggcuggcggcccggga

SEQ ID NO: 1291319 - RNA, 22 nt, Human
ucuggaccugugaaugaaccuc

SEQ ID NO: 1291320 - RNA, 22 nt, Human
ugaaagucguccuugagguccc

SEQ ID NO: 1291321 - RNA, 18 nt, Human
ugacaugcagauguuucc

SEQ ID NO: 1291322 - RNA, 19 nt, Human
ugacugucaucuggcaauc

SEQ ID NO: 1291323 - RNA, 20 nt, Human
ugacuguuuucucgugcauu

SEQ ID NO: 1291324 - RNA, 24 nt, Human
ugcaguaauggcaaggauauguuc

SEQ ID NO: 1291325 - RNA, 22 nt, Human
ugcccauuaacaaauuuaacca

SEQ ID NO: 1291326 - RNA, 19 nt, Human
uggaaagggacaugacugu

SEQ ID NO: 1291327 - RNA, 25 nt, Human
uggaacagcagcuacaauuguacaa

SEQ ID NO: 1291328 - RNA, 21 nt, Human
uggcugaauccgaauccugug

SEQ ID NO: 1291329 - RNA, 19 nt, Human
uggcuugaccucaugcaga

SEQ ID NO: 1291330 - RNA, 23 nt, Human
uuacaguaucuuggaaauucagc

SEQ ID NO: 1291331 - RNA, 24 nt, Human
uuaccaggugaacugccaucaugu

SEQ ID NO: 1291332 - RNA, 22 nt, Human
uucaagccuccauuugcuguuu

SEQ ID NO: 1291333 - RNA, 22 nt, Human
uucacauuuauaucuucccuau

SEQ ID NO: 1291334 - RNA, 22 nt, Human
uucagauaauaaagguucugga

SEQ ID NO: 1291335 - RNA, 19 nt, Human
uucagcuacggaagaaaca

SEQ ID NO: 1291336 - RNA, 23 nt, Human
uucucccguaugccaaauuucau

SEQ ID NO: 1291337 - RNA, 23 nt, Human
uugcuguuuuuuuacugauggaa

SEQ ID NO: 1291338 - RNA, 19 nt, Human
uuucgcugcaagggcuuca

SEQ ID NO: 1291339 - RNA, 27 nt, Human
uuucuaguuuuugguuucccaucuuac

SEQ ID NO: 1291340 - RNA, 24 nt, Human
uccccacgguaugguuuacuacuu

SEQ ID NO: 1291341 - RNA, 23 nt, Human
ugguuuacuacuuggaucagaau

SEQ ID NO: 1291342 - RNA, 18 nt, Human
uuaagauaaauguugaga

SEQ ID NO: 1291343 - RNA, 22 nt, Human
agcuaucuaggguuccggccuc

SEQ ID NO: 1291344 - RNA, 19 nt, Human
accucagggacacccaggg

SEQ ID NO: 1291345 - RNA, 18 nt, Human
gguguccuggccugggca

SEQ ID NO: 1291346 - RNA, 21 nt, Human
ugcgaggugaggugcguccgg

SEQ ID NO: 1291347 - RNA, 25 nt, Human
cgcccacgaugacuggaugaauugc

SEQ ID NO: 1291348 - RNA, 22 nt, Human
cuggagccacgcccacgaugac

SEQ ID NO: 1291349 - RNA, 19 nt, Human
uggagccacgcccacgaug

SEQ ID NO: 1291350 - RNA, 19 nt, Human
uggagccacgcccacgaug

SEQ ID NO: 1291351 - RNA, 21 nt, Human
aaccuuauuugucguucccac

SEQ ID NO: 1291352 - RNA, 21 nt, Human
aaguggaggcugcagugauca

SEQ ID NO: 1291353 - RNA, 22 nt, Human
aucuugggugcuuugguccuag

SEQ ID NO: 1291354 - RNA, 19 nt, Human
cagccaguggcugggaagg

SEQ ID NO: 1291355 - RNA, 20 nt, Human
cuugggugcuuugguccuag

SEQ ID NO: 1291356 - RNA, 18 nt, Human
gaaguggaggcugcagug

SEQ ID NO: 1291357 - RNA, 23 nt, Human
gaggcugcagugaucagugauug

SEQ ID NO: 1291358 - RNA, 21 nt, Human
gcuuuuccuuagccuccuuca

SEQ ID NO: 1291359 - RNA, 22 nt, Human
ggaggcugcagugaucagugau

SEQ ID NO: 1291360 - RNA, 24 nt, Human
ggaggcugcagugaucagugauug

SEQ ID NO: 1291361 - RNA, 19 nt, Human
uaacaagacgcugaaucuu

SEQ ID NO: 1291362 - RNA, 21 nt, Human
uaacaagacgcugaaucuugg

SEQ ID NO: 1291363 - RNA, 22 nt, Human
ucagcagcaacuuuuguggccg

SEQ ID NO: 1291364 - RNA, 18 nt, Human
ucccaccacugauucgga

SEQ ID NO: 1291365 - RNA, 20 nt, Human
uccuggcgcuuuuccuuagc

SEQ ID NO: 1291366 - RNA, 23 nt, Human
ugcaccaguacgguccacacuua

SEQ ID NO: 1291367 - RNA, 22 nt, Human
uggcugggaaggagauguucag

SEQ ID NO: 1291368 - RNA, 20 nt, Human
ugggaaguggaggcugcagu

SEQ ID NO: 1291369 - RNA, 22 nt, Human
ugggaaguggaggcugcaguga

SEQ ID NO: 1291370 - RNA, 20 nt, Human
ugguccuagguuucuuaccu

SEQ ID NO: 1291371 - RNA, 27 nt, Human
agacggccggcuagagcccggcgggga

SEQ ID NO: 1291372 - RNA, 21 nt, Human
agcccgccgccaccucgggcc

SEQ ID NO: 1291373 - RNA, 18 nt, Human
agcggccgccucgccccc

SEQ ID NO: 1291374 - RNA, 21 nt, Human
caccagacggccggcuagagc

SEQ ID NO: 1291375 - RNA, 18 nt, Human
cagcccgccgccaccucg

SEQ ID NO: 1291376 - RNA, 19 nt, Human
cagcggccgccucgccccc

SEQ ID NO: 1291377 - RNA, 19 nt, Human
cagcugaagccgcgcacca

SEQ ID NO: 1291378 - RNA, 22 nt, Human
caggcgccgcucaucgcgcccc

SEQ ID NO: 1291379 - RNA, 24 nt, Human
ccaccagacggccggcuagagccc

SEQ ID NO: 1291380 - RNA, 26 nt, Human
ccccgcgcccagcccgccgccaccuc

SEQ ID NO: 1291381 - RNA, 22 nt, Human
cccgccgccaccucgggccacc

SEQ ID NO: 1291382 - RNA, 23 nt, Human
cccgccgccaccucgggccacca

SEQ ID NO: 1291383 - RNA, 19 nt, Human
ccgccucgccccccggccg

SEQ ID NO: 1291384 - RNA, 18 nt, Human
cgccccccggccgcgggc

SEQ ID NO: 1291385 - RNA, 18 nt, Human
cgccucgccccccggccg

SEQ ID NO: 1291386 - RNA, 23 nt, Human
cgccucgccccccggccgcgggc

SEQ ID NO: 1291387 - RNA, 19 nt, Human
cgcgccccgcgcccagccc

SEQ ID NO: 1291388 - RNA, 24 nt, Human
cgcgggcagcugaagccgcgcacc

SEQ ID NO: 1291389 - RNA, 23 nt, Human
cgggcagcugaagccgcgcacca

SEQ ID NO: 1291390 - RNA, 23 nt, Human
cucaucgcgccccgcgcccagcc

SEQ ID NO: 1291391 - RNA, 18 nt, Human
cuccugcucugcgcucac

SEQ ID NO: 1291392 - RNA, 23 nt, Human
cugaagccgcgcaccaccuccug

SEQ ID NO: 1291393 - RNA, 21 nt, Human
gacagcggccgccucgccccc

SEQ ID NO: 1291394 - RNA, 18 nt, Human
gccccgcgcccagcccgc

SEQ ID NO: 1291395 - RNA, 25 nt, Human
gccccgcgcccagcccgccgccacc

SEQ ID NO: 1291396 - RNA, 21 nt, Human
ugcgcucacguagcucgugca

SEQ ID NO: 1291397 - RNA, 25 nt, Human
aacacauaaacacagaagaguucca

SEQ ID NO: 1291398 - RNA, 20 nt, Human
caacucgaggugagggacgg

SEQ ID NO: 1291399 - RNA, 18 nt, Human
cacauaaacacagaagag

SEQ ID NO: 1291400 - RNA, 22 nt, Human
uaaacacagaagaguuccaaga

SEQ ID NO: 1291401 - RNA, 21 nt, Human
uaagucacuuacggaugaugc

SEQ ID NO: 1291402 - RNA, 22 nt, Human
aaaccccaaagcggaaaaccuc

SEQ ID NO: 1291403 - RNA, 19 nt, Human
aagcagagcccccaguccc

SEQ ID NO: 1291404 - RNA, 20 nt, Human
aagccagcaggaucccagga

SEQ ID NO: 1291405 - RNA, 23 nt, Human
acaggguaggugggugugggggc

SEQ ID NO: 1291406 - RNA, 24 nt, Human
accccauggacccaggugcagagg

SEQ ID NO: 1291407 - RNA, 19 nt, Human
accucgguucugcccaccu

SEQ ID NO: 1291408 - RNA, 22 nt, Human
acugccuugcuggcccuccccc

SEQ ID NO: 1291409 - RNA, 21 nt, Human
agaccccgcagaccccaugga

SEQ ID NO: 1291410 - RNA, 21 nt, Human
agaccccgcagaccccgcaga

SEQ ID NO: 1291411 - RNA, 22 nt, Human
agcacaggguaggugggugugg

SEQ ID NO: 1291412 - RNA, 23 nt, Human
agcagagcccccagucccugccc

SEQ ID NO: 1291413 - RNA, 21 nt, Human
agcagggacaggagcugacug

SEQ ID NO: 1291414 - RNA, 20 nt, Human
aggcagaccccgcagacccc

SEQ ID NO: 1291415 - RNA, 21 nt, Human
aggcagggccaggcauggggg

SEQ ID NO: 1291416 - RNA, 19 nt, Human
aggcaguucugguaggccu

SEQ ID NO: 1291417 - RNA, 21 nt, Human
aggccaggcagaccccgcaga

SEQ ID NO: 1291418 - RNA, 19 nt, Human
caaaccccaaagcggaaaa

SEQ ID NO: 1291419 - RNA, 22 nt, Human
caaagcggaaaaccucuuguca

SEQ ID NO: 1291420 - RNA, 20 nt, Human
cacaggguaggugggugugg

SEQ ID NO: 1291421 - RNA, 23 nt, Human
cacaggguaggugggugugggaa

SEQ ID NO: 1291422 - RNA, 23 nt, Human
caccacgcccuggaugccuucac

SEQ ID NO: 1291423 - RNA, 21 nt, Human
caccacgccguccgucaggau

SEQ ID NO: 1291424 - RNA, 25 nt, Human
caccgugaggaccuuggagaacacc

SEQ ID NO: 1291425 - RNA, 23 nt, Human
caccuccucgaaguaguagucca

SEQ ID NO: 1291426 - RNA, 19 nt, Human
caccuggcucaggcagggc

SEQ ID NO: 1291427 - RNA, 23 nt, Human
cacgcacaauggccucccgugug

SEQ ID NO: 1291428 - RNA, 19 nt, Human
cacugcccccacccuacgc

SEQ ID NO: 1291429 - RNA, 20 nt, Human
cacugcccccacccuacgcc

SEQ ID NO: 1291430 - RNA, 21 nt, Human
cacuuuaugacuccugaagcc

SEQ ID NO: 1291431 - RNA, 22 nt, Human
cagaacccacaggccaggcaga

SEQ ID NO: 1291432 - RNA, 24 nt, Human
cagagcccccagucccugccccuu

SEQ ID NO: 1291433 - RNA, 23 nt, Human
cagcaggaucccaggaggacugg

SEQ ID NO: 1291434 - RNA, 19 nt, Human
caggcagggccaggcaugg

SEQ ID NO: 1291435 - RNA, 19 nt, Human
cagggacaggagcugacug

SEQ ID NO: 1291436 - RNA, 23 nt, Human
ccaggcuuucucgggcguggggg

SEQ ID NO: 1291437 - RNA, 24 nt, Human
cccaagccagcaggaucccaggag

SEQ ID NO: 1291438 - RNA, 24 nt, Human
cccacaaagguuagacgcaaagca

SEQ ID NO: 1291439 - RNA, 23 nt, Human
cccacaggccaggcagaccccgc

SEQ ID NO: 1291440 - RNA, 18 nt, Human
cccagcucccuccaaguc

SEQ ID NO: 1291441 - RNA, 23 nt, Human
cccauuccucacugcccccaccc

SEQ ID NO: 1291442 - RNA, 20 nt, Human
ccccaaagcggaaaaccucu

SEQ ID NO: 1291443 - RNA, 23 nt, Human
ccccagagccgggcccaagccag

SEQ ID NO: 1291444 - RNA, 19 nt, Human
ccccccaggaaaucguccu

SEQ ID NO: 1291445 - RNA, 22 nt, Human
ccccccaggaaaucguccuccu

SEQ ID NO: 1291446 - RNA, 19 nt, Human
ccccgcagaccccgcagac

SEQ ID NO: 1291447 - RNA, 18 nt, Human
cccgcagaccccauggac

SEQ ID NO: 1291448 - RNA, 20 nt, Human
cccgcagaccccauggaccc

SEQ ID NO: 1291449 - RNA, 20 nt, Human
cccgcagaccccgcagaccc

SEQ ID NO: 1291450 - RNA, 24 nt, Human
ccgcugggcccaugcgugucguac

SEQ ID NO: 1291451 - RNA, 20 nt, Human
ccggagcgcgggcucacccc

SEQ ID NO: 1291452 - RNA, 24 nt, Human
ccggcagaacccacaggccaggca

SEQ ID NO: 1291453 - RNA, 25 nt, Human
ccucaugaucucccucccuccaccc

SEQ ID NO: 1291454 - RNA, 21 nt, Human
ccucggccagcacgcacuugg

SEQ ID NO: 1291455 - RNA, 22 nt, Human
ccucuguggcuguaguacucca

SEQ ID NO: 1291456 - RNA, 28 nt, Human
ccucuguggcuguaguacuccaccaccu

SEQ ID NO: 1291457 - RNA, 18 nt, Human
ccuggcucaggcagggcc

SEQ ID NO: 1291458 - RNA, 18 nt, Human
ccuucggccuugggggcc

SEQ ID NO: 1291459 - RNA, 20 nt, Human
cgcccuggaugccuucacac

SEQ ID NO: 1291460 - RNA, 24 nt, Human
cggaagggcacgaacuguacgaug

SEQ ID NO: 1291461 - RNA, 22 nt, Human
cucccagcucccuccaaguccc

SEQ ID NO: 1291462 - RNA, 21 nt, Human
cucccuccaagucccucauga

SEQ ID NO: 1291463 - RNA, 19 nt, Human
cucccucccuccacccacc

SEQ ID NO: 1291464 - RNA, 20 nt, Human
cuccggcagggacgcccagg

SEQ ID NO: 1291465 - RNA, 26 nt, Human
cucuguggcuguaguacuccaccacc

SEQ ID NO: 1291466 - RNA, 18 nt, Human
gaacucccagcucccucc

SEQ ID NO: 1291467 - RNA, 18 nt, Human
gaacucccagcucccucc

SEQ ID NO: 1291468 - RNA, 22 nt, Human
gacccauuccucacugccccca

SEQ ID NO: 1291469 - RNA, 24 nt, Human
gaccccgcagaccccgcagacccc

SEQ ID NO: 1291470 - RNA, 23 nt, Human
gagccgggcccaagccagcagga

SEQ ID NO: 1291471 - RNA, 21 nt, Human
gagcgcaggacgccgucuccc

SEQ ID NO: 1291472 - RNA, 21 nt, Human
gaucucccucccuccacccac

SEQ ID NO: 1291473 - RNA, 21 nt, Human
gauggcaaagucaugggacac

SEQ ID NO: 1291474 - RNA, 22 nt, Human
gcaugggggccuguauuuuguc

SEQ ID NO: 1291475 - RNA, 22 nt, Human
gcccccacccuacgcccuccac

SEQ ID NO: 1291476 - RNA, 19 nt, Human
gcccuggaugccuucacac

SEQ ID NO: 1291477 - RNA, 19 nt, Human
gcuggcccucccccacaaa

SEQ ID NO: 1291478 - RNA, 23 nt, Human
ggacaggugucugggucccccag

SEQ ID NO: 1291479 - RNA, 20 nt, Human
ggacugggaguggggccugg

SEQ ID NO: 1291480 - RNA, 21 nt, Human
ggccuugggggccccagagcc

SEQ ID NO: 1291481 - RNA, 22 nt, Human
gggacuggaggcuucugggagg

SEQ ID NO: 1291482 - RNA, 26 nt, Human
gggaggucggagggagcuuaagggac

SEQ ID NO: 1291483 - RNA, 19 nt, Human
gggaguggggccugguggg

SEQ ID NO: 1291484 - RNA, 19 nt, Human
gggggcaccagcagggaca

SEQ ID NO: 1291485 - RNA, 21 nt, Human
ggggggacugccuugcuggcc

SEQ ID NO: 1291486 - RNA, 22 nt, Human
gucccucaugaucucccucccu

SEQ ID NO: 1291487 - RNA, 19 nt, Human
gugucugggucccccaggc

SEQ ID NO: 1291488 - RNA, 23 nt, Human
uaguaguccaccgugaggaccuu

SEQ ID NO: 1291489 - RNA, 24 nt, Human
ucacugcccccacccuacgcccuc

SEQ ID NO: 1291490 - RNA, 21 nt, Human
uccaaaccccaaagcggaaaa

SEQ ID NO: 1291491 - RNA, 23 nt, Human
ucccguggaugaacucccagcuc

SEQ ID NO: 1291492 - RNA, 20 nt, Human
ucccuccacccaccuggcuc

SEQ ID NO: 1291493 - RNA, 21 nt, Human
uccggcagggacgcccaggcu

SEQ ID NO: 1291494 - RNA, 21 nt, Human
ucucccguggaugaacuccca

SEQ ID NO: 1291495 - RNA, 18 nt, Human
ucucccucccuccaccca

SEQ ID NO: 1291496 - RNA, 23 nt, Human
ucuccggcagggacgcccaggcu

SEQ ID NO: 1291497 - RNA, 20 nt, Human
ucugggucccccaggcuuuc

SEQ ID NO: 1291498 - RNA, 19 nt, Human
ugaagccccaccggcagaa

SEQ ID NO: 1291499 - RNA, 22 nt, Human
ugacuccugaagccccaccggc

SEQ ID NO: 1291500 - RNA, 22 nt, Human
ugacuguggggacaggugucug

SEQ ID NO: 1291501 - RNA, 20 nt, Human
ugaucucccucccuccaccc

SEQ ID NO: 1291502 - RNA, 19 nt, Human
ugauggacaugggcuggcg

SEQ ID NO: 1291503 - RNA, 20 nt, Human
ugcccccacccuacgcccuc

SEQ ID NO: 1291504 - RNA, 20 nt, Human
ugccuugcuggcccuccccc

SEQ ID NO: 1291505 - RNA, 21 nt, Human
uggacccugggcaggcaguuc

SEQ ID NO: 1291506 - RNA, 23 nt, Human
uggacccugggcaggcaguucug

SEQ ID NO: 1291507 - RNA, 25 nt, Human
uggaugccuucacacucaucguccu

SEQ ID NO: 1291508 - RNA, 24 nt, Human
uggggacaggaugucugggucccc

SEQ ID NO: 1291509 - RNA, 24 nt, Human
uggggacaggugucuggguccccc

SEQ ID NO: 1291510 - RNA, 22 nt, Human
uggggggacugccuugcuggcc

SEQ ID NO: 1291511 - RNA, 26 nt, Human
ugggucccccaggcuuuccccuaggg

SEQ ID NO: 1291512 - RNA, 21 nt, Human
ugguaggccuccaccacgccc

SEQ ID NO: 1291513 - RNA, 23 nt, Human
ugguggggacuggaggcuucugg

SEQ ID NO: 1291514 - RNA, 19 nt, Human
ugucccggagcgcgggcuc

SEQ ID NO: 1291515 - RNA, 20 nt, Human
uucucgggggcaggccucug

SEQ ID NO: 1291516 - RNA, 18 nt, Human
uucuugagcucccggaag

SEQ ID NO: 1291517 - RNA, 21 nt, Human
uuggagaacacgggaugcagg

SEQ ID NO: 1291518 - RNA, 22 nt, Human
uuggccagcgccgcaggggaug

SEQ ID NO: 1291519 - RNA, 22 nt, Human
gaggccuuucuugcagcagaag

SEQ ID NO: 1291520 - RNA, 21 nt, Human
agacagaauuccacauaucac

SEQ ID NO: 1291521 - RNA, 23 nt, Human
cacauaucacauuuaucgguaga

SEQ ID NO: 1291522 - RNA, 19 nt, Human
cagguggaugaauacgaua

SEQ ID NO: 1291523 - RNA, 21 nt, Human
cauucagaguaccacuauuuc

SEQ ID NO: 1291524 - RNA, 19 nt, Human
uagugguagagauaucauu

SEQ ID NO: 1291525 - RNA, 21 nt, Human
uccgugccaugugggcuccug

SEQ ID NO: 1291526 - RNA, 22 nt, Human
ucuucugggcguucaaugaaua

SEQ ID NO: 1291527 - RNA, 21 nt, Human
ugaggaaaaaauuagauuuaa

SEQ ID NO: 1291528 - RNA, 20 nt, Human
ugguagagauaucauucaga

SEQ ID NO: 1291529 - RNA, 19 nt, Human
ugugggcuccugaacaggu

SEQ ID NO: 1291530 - RNA, 18 nt, Human
uucagaguaccacuauuu

SEQ ID NO: 1291531 - RNA, 27 nt, Human
uuucccaagaugucagguggaugaaua

SEQ ID NO: 1291532 - RNA, 19 nt, Human
caccgcccccuccgacgca

SEQ ID NO: 1291533 - RNA, 19 nt, Human
cacuggagaagggggcugc

SEQ ID NO: 1291534 - RNA, 22 nt, Human
ccccgaaagcacuggagaaggg

SEQ ID NO: 1291535 - RNA, 22 nt, Human
ccccgagagcacuggagaaggg

SEQ ID NO: 1291536 - RNA, 24 nt, Human
cgaaagcacuggagaagggggcug

SEQ ID NO: 1291537 - RNA, 20 nt, Human
cgcagggaguagcgagugcc

SEQ ID NO: 1291538 - RNA, 22 nt, Human
cgcccccuccgacgcaagcccg

SEQ ID NO: 1291539 - RNA, 21 nt, Human
cucacaggguggggugggccu

SEQ ID NO: 1291540 - RNA, 19 nt, Human
gagcccaccgcccccuccg

SEQ ID NO: 1291541 - RNA, 22 nt, Human
ggugcacccuccccgaaagcac

SEQ ID NO: 1291542 - RNA, 20 nt, Human
uccccacaccuccgcggccg

SEQ ID NO: 1291543 - RNA, 24 nt, Human
uccccgaaagcacuggagaagggg

SEQ ID NO: 1291544 - RNA, 24 nt, Human
uccccgagagcacuggagaagggg

SEQ ID NO: 1291545 - RNA, 19 nt, Human
uggugcacccuccccgaaa

SEQ ID NO: 1291546 - RNA, 18 nt, Human
aaaccugcagcuucucug

SEQ ID NO: 1291547 - RNA, 23 nt, Human
aaagcaaacacuuucacuccucc

SEQ ID NO: 1291548 - RNA, 19 nt, Human
aagcaaacacuuucacucc

SEQ ID NO: 1291549 - RNA, 18 nt, Human
acuucguguacucaaugc

SEQ ID NO: 1291550 - RNA, 22 nt, Human
aggcacuaugacuuuccaggau

SEQ ID NO: 1291551 - RNA, 18 nt, Human
ccaggggagggccgcugc

SEQ ID NO: 1291552 - RNA, 20 nt, Human
cuccgaauggccuucggccu

SEQ ID NO: 1291553 - RNA, 22 nt, Human
cuccuccgcuggcugcaaaccu

SEQ ID NO: 1291554 - RNA, 24 nt, Human
gcgaacucucgcuugagcuccagc

SEQ ID NO: 1291555 - RNA, 22 nt, Human
ggagggccgcugccacaagaag

SEQ ID NO: 1291556 - RNA, 18 nt, Human
ggcuuuugcuaguugcuu

SEQ ID NO: 1291557 - RNA, 22 nt, Human
uccgcuggcugcaaaccugcag

SEQ ID NO: 1291558 - RNA, 23 nt, Human
ucggcccgccaggcacuguucug

SEQ ID NO: 1291559 - RNA, 19 nt, Human
ugcccucggcccgccaggc

SEQ ID NO: 1291560 - RNA, 18 nt, Human
uguugcuggcuuuugcua

SEQ ID NO: 1291561 - RNA, 19 nt, Human
uuccaugguucucccaggg

SEQ ID NO: 1291562 - RNA, 25 nt, Human
uuccaugguucucccaggggagggc

SEQ ID NO: 1291563 - RNA, 21 nt, Human
uugcuggcuuuugcuaguugc

SEQ ID NO: 1291564 - RNA, 18 nt, Human
aacuguguaaccuaaggc

SEQ ID NO: 1291565 - RNA, 19 nt, Human
aacuguguaaccuaaggcu

SEQ ID NO: 1291566 - RNA, 23 nt, Human
aagcacaacugaggccagagagc

SEQ ID NO: 1291567 - RNA, 20 nt, Human
aagcaggacagcacagcagc

SEQ ID NO: 1291568 - RNA, 18 nt, Human
aagcuuuuagcauggugc

SEQ ID NO: 1291569 - RNA, 21 nt, Human
aauccugagcccgggaggagg

SEQ ID NO: 1291570 - RNA, 30 nt, Human
acagcagcaggaaaagcacaacugaggccu

SEQ ID NO: 1291571 - RNA, 20 nt, Human
acccuccccaggcccagguc

SEQ ID NO: 1291572 - RNA, 19 nt, Human
acuccgucucaccgccccc

SEQ ID NO: 1291573 - RNA, 19 nt, Human
agagccugggcucuuuguc

SEQ ID NO: 1291574 - RNA, 18 nt, Human
agcaggaaaagcacaacu

SEQ ID NO: 1291575 - RNA, 21 nt, Human
agcccagggcagagcuagaug

SEQ ID NO: 1291576 - RNA, 21 nt, Human
agcugcauguuggaggaagag

SEQ ID NO: 1291577 - RNA, 24 nt, Human
aggcaagcccaugggacccgaagc

SEQ ID NO: 1291578 - RNA, 24 nt, Human
aggcagaggcucaggggagggugc

SEQ ID NO: 1291579 - RNA, 23 nt, Human
aggcccagguccaaaccccggcc

SEQ ID NO: 1291580 - RNA, 23 nt, Human
aggggacaaagagagguuccaga

SEQ ID NO: 1291581 - RNA, 20 nt, Human
aguacagugcccugugccag

SEQ ID NO: 1291582 - RNA, 20 nt, Human
auccugagcccgggaggagg

SEQ ID NO: 1291583 - RNA, 18 nt, Human
caaacagcgacccucccc

SEQ ID NO: 1291584 - RNA, 22 nt, Human
caacuccucccuguggagugau

SEQ ID NO: 1291585 - RNA, 21 nt, Human
caccgcccccugucuccagga

SEQ ID NO: 1291586 - RNA, 20 nt, Human
cacuaagugcucuauucaug

SEQ ID NO: 1291587 - RNA, 23 nt, Human
cagaaagcacacugggcuagaag

SEQ ID NO: 1291588 - RNA, 25 nt, Human
cagaugaccugcagcggcccuuccu

SEQ ID NO: 1291589 - RNA, 19 nt, Human
cagcgacccuccccaggcc

SEQ ID NO: 1291590 - RNA, 21 nt, Human
cagcgacccuccccaggccca

SEQ ID NO: 1291591 - RNA, 23 nt, Human
cagcggcccuuccugcucagucu

SEQ ID NO: 1291592 - RNA, 21 nt, Human
caggaaaagcacaacugaggc

SEQ ID NO: 1291593 - RNA, 27 nt, Human
caggaaaagcacaacugaggccagaga

SEQ ID NO: 1291594 - RNA, 25 nt, Human
caggaggggccugaggucaguggua

SEQ ID NO: 1291595 - RNA, 24 nt, Human
cagggucuguggugaagccagagg

SEQ ID NO: 1291596 - RNA, 18 nt, Human
caguggcuccucagggaa

SEQ ID NO: 1291597 - RNA, 22 nt, Human
caguggcuccucagggaaccca

SEQ ID NO: 1291598 - RNA, 20 nt, Human
ccaggcaccaugcuaacagc

SEQ ID NO: 1291599 - RNA, 22 nt, Human
cccaggaggggccugaggucag

SEQ ID NO: 1291600 - RNA, 24 nt, Human
cccagggcagagcuagauguggcc

SEQ ID NO: 1291601 - RNA, 20 nt, Human
cccagugggaauagcagguu

SEQ ID NO: 1291602 - RNA, 20 nt, Human
cccaugggacccgaagcagg

SEQ ID NO: 1291603 - RNA, 22 nt, Human
ccccaggcccagguccaaaccc

SEQ ID NO: 1291604 - RNA, 23 nt, Human
ccccaggcccagguccaaaccuu

SEQ ID NO: 1291605 - RNA, 20 nt, Human
ccccggccacugguguggcc

SEQ ID NO: 1291606 - RNA, 21 nt, Human
cccugugccaggcaccaugcc

SEQ ID NO: 1291607 - RNA, 21 nt, Human
cccugugccaggcaccaugcu

SEQ ID NO: 1291608 - RNA, 22 nt, Human
cccugugccaggcaccaugcua

SEQ ID NO: 1291609 - RNA, 21 nt, Human
ccuaguacagugcccugugcc

SEQ ID NO: 1291610 - RNA, 24 nt, Human
ccugcagcggcccuuccugcucag

SEQ ID NO: 1291611 - RNA, 22 nt, Human
ccuuacuccagaccugcucuuc

SEQ ID NO: 1291612 - RNA, 24 nt, Human
cgcuugagucccccagccuuacuc

SEQ ID NO: 1291613 - RNA, 21 nt, Human
cucacuccaacauuucaaaga

SEQ ID NO: 1291614 - RNA, 19 nt, Human
cuccuguuuucuggcaaug

SEQ ID NO: 1291615 - RNA, 24 nt, Human
cugaggcagaggcucaggggaggg

SEQ ID NO: 1291616 - RNA, 24 nt, Human
cugcagcggcccuuccugcucagu

SEQ ID NO: 1291617 - RNA, 19 nt, Human
cugcucagucuucugggau

SEQ ID NO: 1291618 - RNA, 18 nt, Human
cugguguggccugggcag

SEQ ID NO: 1291619 - RNA, 20 nt, Human
gaagaggggucuggacagug

SEQ ID NO: 1291620 - RNA, 27 nt, Human
gaagcaggacagcacagcagcaggaaa

SEQ ID NO: 1291621 - RNA, 21 nt, Human
gaccugcucuuccuccuguuu

SEQ ID NO: 1291622 - RNA, 21 nt, Human
gagacugggcugauuuucagc

SEQ ID NO: 1291623 - RNA, 22 nt, Human
gagcugcauguuggaggaagag

SEQ ID NO: 1291624 - RNA, 24 nt, Human
gcaaagcagaaagcacacugggcu

SEQ ID NO: 1291625 - RNA, 22 nt, Human
gcagcaggaaaagcacaacuga

SEQ ID NO: 1291626 - RNA, 27 nt, Human
gcagcggcccuuccugcucagucuucu

SEQ ID NO: 1291627 - RNA, 20 nt, Human
gcagggucuguggugaagcc

SEQ ID NO: 1291628 - RNA, 20 nt, Human
gcccugugccaggcaccaug

SEQ ID NO: 1291629 - RNA, 18 nt, Human
gcucuuccuccuguuuuc

SEQ ID NO: 1291630 - RNA, 24 nt, Human
ggaaaagcgcaucuggagcuuaga

SEQ ID NO: 1291631 - RNA, 19 nt, Human
ggaggaggcugaggcagag

SEQ ID NO: 1291632 - RNA, 20 nt, Human
ggaggaggcugaggcagagg

SEQ ID NO: 1291633 - RNA, 23 nt, Human
ggccacugguguggccugggcag

SEQ ID NO: 1291634 - RNA, 18 nt, Human
gggaauccugagcccggg

SEQ ID NO: 1291635 - RNA, 24 nt, Human
gugccugcacuaagugcucuauuc

SEQ ID NO: 1291636 - RNA, 26 nt, Human
guggcccaggaggggccugaggucag

SEQ ID NO: 1291637 - RNA, 19 nt, Human
guggccugggcagacuccg

SEQ ID NO: 1291638 - RNA, 21 nt, Human
gugguacagcugaggcaagcc

SEQ ID NO: 1291639 - RNA, 23 nt, Human
guguagagaaaaagcaaagaugg

SEQ ID NO: 1291640 - RNA, 25 nt, Human
guuaucuggaaggggacaaagagag

SEQ ID NO: 1291641 - RNA, 19 nt, Human
uaacagcauauaggguccc

SEQ ID NO: 1291642 - RNA, 19 nt, Human
uacagcugaggcaagccca

SEQ ID NO: 1291643 - RNA, 19 nt, Human
uagcccagggcagagcuag

SEQ ID NO: 1291644 - RNA, 22 nt, Human
uagcccagggcagagcuagaug

SEQ ID NO: 1291645 - RNA, 19 nt, Human
uaggucuuucucauuucug

SEQ ID NO: 1291646 - RNA, 20 nt, Human
uaguaggugguuuguguaga

SEQ ID NO: 1291647 - RNA, 18 nt, Human
ucaccccauugcaaguga

SEQ ID NO: 1291648 - RNA, 20 nt, Human
ucagugguacagcugaggca

SEQ ID NO: 1291649 - RNA, 18 nt, Human
uccccaggcccaggucca

SEQ ID NO: 1291650 - RNA, 22 nt, Human
uccccaggcccagguccaaacc

SEQ ID NO: 1291651 - RNA, 18 nt, Human
uccugagcccgggaggag

SEQ ID NO: 1291652 - RNA, 19 nt, Human
uccugagcccgggaggagg

SEQ ID NO: 1291653 - RNA, 21 nt, Human
ucucaaacagcgacccuccca

SEQ ID NO: 1291654 - RNA, 21 nt, Human
ucugggauucaacgaucauuc

SEQ ID NO: 1291655 - RNA, 18 nt, Human
ucuguggugaagccagag

SEQ ID NO: 1291656 - RNA, 18 nt, Human
ugaccugcagcggcccuu

SEQ ID NO: 1291657 - RNA, 19 nt, Human
ugaccugcagcggcccuuc

SEQ ID NO: 1291658 - RNA, 22 nt, Human
ugagcaggcucuucaauagccc

SEQ ID NO: 1291659 - RNA, 21 nt, Human
ugaggcaagcccaugggaccc

SEQ ID NO: 1291660 - RNA, 23 nt, Human
ugaggcagaggcucaggggaggg

SEQ ID NO: 1291661 - RNA, 23 nt, Human
ugaggccagagagccugggcucu

SEQ ID NO: 1291662 - RNA, 19 nt, Human
ugaguguguggcuguggaa

SEQ ID NO: 1291663 - RNA, 21 nt, Human
ugcagacuaagggagaggagg

SEQ ID NO: 1291664 - RNA, 20 nt, Human
ugccaggcaccaugcuaaca

SEQ ID NO: 1291665 - RNA, 18 nt, Human
ugccugcacuaagugcuc

SEQ ID NO: 1291666 - RNA, 18 nt, Human
ugcuaacagcauauaggg

SEQ ID NO: 1291667 - RNA, 20 nt, Human
uggaaaagcgcaucuggagc

SEQ ID NO: 1291668 - RNA, 20 nt, Human
uggccugggcagacuccguc

SEQ ID NO: 1291669 - RNA, 28 nt, Human
uguaguaggugguuuguguuguaaugac

SEQ ID NO: 1291670 - RNA, 21 nt, Human
ugugaggagagggaaauucag

SEQ ID NO: 1291671 - RNA, 19 nt, Human
uguuggaggaagagggguc

SEQ ID NO: 1291672 - RNA, 25 nt, Human
uguuuugcucccugcuguaucccca

SEQ ID NO: 1291673 - RNA, 27 nt, Human
uuaacacagaugaccugcagcggcccu

SEQ ID NO: 1291674 - RNA, 19 nt, Human
uuacuauucagaugugcca

SEQ ID NO: 1291675 - RNA, 19 nt, Human
uucucauuucugggccuca

SEQ ID NO: 1291676 - RNA, 20 nt, Human
uucuuaucugcaaacaagug

SEQ ID NO: 1291677 - RNA, 18 nt, Human
uugcucccugcuguaucc

SEQ ID NO: 1291678 - RNA, 22 nt, Human
uuuauaaagcugcguccuccuc

SEQ ID NO: 1291679 - RNA, 24 nt, Human
uuucuuaucugcaaacaaguggaa

SEQ ID NO: 1291680 - RNA, 18 nt, Human
aaagugcugggauuacaa

SEQ ID NO: 1291681 - RNA, 24 nt, Human
aaagugcugggauuacaaguguga

SEQ ID NO: 1291682 - RNA, 19 nt, Human
aacugaacucccaggugcc

SEQ ID NO: 1291683 - RNA, 20 nt, Human
aagcguguuggggucuccuc

SEQ ID NO: 1291684 - RNA, 19 nt, Human
aaguagcugggauuauagg

SEQ ID NO: 1291685 - RNA, 24 nt, Human
aaguagcugggauuauaggcacac

SEQ ID NO: 1291686 - RNA, 24 nt, Human
aagugauccgccugccuuggcuuc

SEQ ID NO: 1291687 - RNA, 18 nt, Human
aagugcugggauuacaag

SEQ ID NO: 1291688 - RNA, 19 nt, Human
aagugcugggauuacaagu

SEQ ID NO: 1291689 - RNA, 26 nt, Human
aagugcugggauuacaagugugagcc

SEQ ID NO: 1291690 - RNA, 21 nt, Human
aaucaggaaggucggaaucuc

SEQ ID NO: 1291691 - RNA, 18 nt, Human
acaggguuucaccauguu

SEQ ID NO: 1291692 - RNA, 21 nt, Human
acaggguuucaccauguuggc

SEQ ID NO: 1291693 - RNA, 24 nt, Human
acaggguuucaccauguuggccag

SEQ ID NO: 1291694 - RNA, 18 nt, Human
accauguuggccaggcug

SEQ ID NO: 1291695 - RNA, 23 nt, Human
acccaggcuggaguguaguggug

SEQ ID NO: 1291696 - RNA, 20 nt, Human
acccuucuuuuuuuucuucu

SEQ ID NO: 1291697 - RNA, 21 nt, Human
accgccuggcuaauuuuugua

SEQ ID NO: 1291698 - RNA, 25 nt, Human
acgcugucacccagacuggagugca

SEQ ID NO: 1291699 - RNA, 24 nt, Human
aggcacacaccacuaccgccuggc

SEQ ID NO: 1291700 - RNA, 19 nt, Human
aggcucaagugauucuccu

SEQ ID NO: 1291701 - RNA, 24 nt, Human
agugcaguagcacgaucucggcuc

SEQ ID NO: 1291702 - RNA, 21 nt, Human
aguguaguggugcaaucucag

SEQ ID NO: 1291703 - RNA, 20 nt, Human
aguuauucuccugccucagc

SEQ ID NO: 1291704 - RNA, 24 nt, Human
auuuuuguacuuuuaguagagaug

SEQ ID NO: 1291705 - RNA, 24 nt, Human
caaagugcugggauuacaagugug

SEQ ID NO: 1291706 - RNA, 23 nt, Human
caaccucuuccucccaggcucaa

SEQ ID NO: 1291707 - RNA, 22 nt, Human
caagugauccgccugccuuggc

SEQ ID NO: 1291708 - RNA, 22 nt, Human
caagugauucuccugucuuagc

SEQ ID NO: 1291709 - RNA, 21 nt, Human
caccauguuggccaggcuggu

SEQ ID NO: 1291710 - RNA, 24 nt, Human
caccauguuggccaggcuggucuc

SEQ ID NO: 1291711 - RNA, 27 nt, Human
caccauguuggccaggcuggucucaaa

SEQ ID NO: 1291712 - RNA, 21 nt, Human
cacccaggcuggaguguagug

SEQ ID NO: 1291713 - RNA, 23 nt, Human
cacgcugucacccagacuggagu

SEQ ID NO: 1291714 - RNA, 23 nt, Human
cacugcacccagccugaauuucu

SEQ ID NO: 1291715 - RNA, 24 nt, Human
caggguuucaccauguuggccagg

SEQ ID NO: 1291716 - RNA, 20 nt, Human
cagguagcugggauuacagg

SEQ ID NO: 1291717 - RNA, 28 nt, Human
caucucccggauuccaguuauucuccuu

SEQ ID NO: 1291718 - RNA, 24 nt, Human
cauguuggccaggcuggucucaaa

SEQ ID NO: 1291719 - RNA, 24 nt, Human
cauuuuguacuuuuaauagagaca

SEQ ID NO: 1291720 - RNA, 20 nt, Human
ccaaagugcugggauuacaa

SEQ ID NO: 1291721 - RNA, 21 nt, Human
ccaaagugcugggauuacaag

SEQ ID NO: 1291722 - RNA, 24 nt, Human
ccaaagugcugggauuacaagugu

SEQ ID NO: 1291723 - RNA, 19 nt, Human
ccacugcacccagccugaa

SEQ ID NO: 1291724 - RNA, 20 nt, Human
ccacugcacccagccugaau

SEQ ID NO: 1291725 - RNA, 23 nt, Human
ccagcagaggcuguguccucucc

SEQ ID NO: 1291726 - RNA, 24 nt, Human
ccaguuauucuccugccucagccu

SEQ ID NO: 1291727 - RNA, 20 nt, Human
cccaaccucagaccacuguc

SEQ ID NO: 1291728 - RNA, 23 nt, Human
cccaaguagcugggauuauaggc

SEQ ID NO: 1291729 - RNA, 24 nt, Human
cccaaguagcugggauuauaggca

SEQ ID NO: 1291730 - RNA, 21 nt, Human
cccaggcucaagugauucucc

SEQ ID NO: 1291731 - RNA, 23 nt, Human
cccaggcucaagugauucuccuc

SEQ ID NO: 1291732 - RNA, 20 nt, Human
ccgccuggcuaauuuuugua

SEQ ID NO: 1291733 - RNA, 24 nt, Human
ccucccaggcucaagugauucucc

SEQ ID NO: 1291734 - RNA, 24 nt, Human
ccucucagguagcugggauuacag

SEQ ID NO: 1291735 - RNA, 22 nt, Human
ccugccuuggcuucccaaagug

SEQ ID NO: 1291736 - RNA, 22 nt, Human
ccuggagauccugggugaaugg

SEQ ID NO: 1291737 - RNA, 18 nt, Human
ccuggccucaagugaucc

SEQ ID NO: 1291738 - RNA, 18 nt, Human
ccuggccucaagugaucc

SEQ ID NO: 1291739 - RNA, 21 nt, Human
ccuggccucaagugauccgcc

SEQ ID NO: 1291740 - RNA, 23 nt, Human
ccuggccucaagugauccgccug

SEQ ID NO: 1291741 - RNA, 21 nt, Human
cuaccgccuggcuaauuuuug

SEQ ID NO: 1291742 - RNA, 20 nt, Human
cucaagugauccgccugccu

SEQ ID NO: 1291743 - RNA, 23 nt, Human
cucaagugauucuccugucuuag

SEQ ID NO: 1291744 - RNA, 19 nt, Human
cucacgcugucacccagac

SEQ ID NO: 1291745 - RNA, 24 nt, Human
cucacugcaacaugcaucucccgg

SEQ ID NO: 1291746 - RNA, 19 nt, Human
cucacugcaaccucuuccu

SEQ ID NO: 1291747 - RNA, 24 nt, Human
cucacugcaaccucuuccucccag

SEQ ID NO: 1291748 - RNA, 24 nt, Human
cucagccucucagguagcugggau

SEQ ID NO: 1291749 - RNA, 23 nt, Human
cucagguagcugggauuacaggu

SEQ ID NO: 1291750 - RNA, 24 nt, Human
cucagguagcugggauuacaggug

SEQ ID NO: 1291751 - RNA, 20 nt, Human
cucaugccaaccuggcaacc

SEQ ID NO: 1291752 - RNA, 19 nt, Human
cucccaggcucaagugauu

SEQ ID NO: 1291753 - RNA, 20 nt, Human
cucccaggugccgacagagu

SEQ ID NO: 1291754 - RNA, 24 nt, Human
cuccugccacugucccaaccucag

SEQ ID NO: 1291755 - RNA, 23 nt, Human
cugcaaccucuuccucccaggcu

SEQ ID NO: 1291756 - RNA, 24 nt, Human
cugcaaccucuuccucccaggcuc

SEQ ID NO: 1291757 - RNA, 20 nt, Human
cugccaggcugaucucuugu

SEQ ID NO: 1291758 - RNA, 23 nt, Human
cugccucagccucucagguagcu

SEQ ID NO: 1291759 - RNA, 19 nt, Human
cugggugaaugguaucucc

SEQ ID NO: 1291760 - RNA, 23 nt, Human
cugucuuagccucccaaguagcu

SEQ ID NO: 1291761 - RNA, 23 nt, Human
cuuagccucccaaguagcuggga

SEQ ID NO: 1291762 - RNA, 18 nt, Human
cuuccucccaggcucaag

SEQ ID NO: 1291763 - RNA, 24 nt, Human
cuugcuuugucacccaggcuggag

SEQ ID NO: 1291764 - RNA, 19 nt, Human
cuuuuaguagagauggggu

SEQ ID NO: 1291765 - RNA, 22 nt, Human
gacagaaucuugcuuugucacc

SEQ ID NO: 1291766 - RNA, 18 nt, Human
gauuacaagugugagcca

SEQ ID NO: 1291767 - RNA, 19 nt, Human
gauuacaagugugagccac

SEQ ID NO: 1291768 - RNA, 23 nt, Human
gauuacaagugugagccacugca

SEQ ID NO: 1291769 - RNA, 18 nt, Human
gauuacaggugccugcca

SEQ ID NO: 1291770 - RNA, 21 nt, Human
gccauaaugcccagcuccauu

SEQ ID NO: 1291771 - RNA, 22 nt, Human
gccuuggcuucccaaagugcug

SEQ ID NO: 1291772 - RNA, 24 nt, Human
gccuuggcuucccaaagugcuggg

SEQ ID NO: 1291773 - RNA, 21 nt, Human
gcucacugcaaccucuuccuc

SEQ ID NO: 1291774 - RNA, 21 nt, Human
gcugggauuacaagugugagc

SEQ ID NO: 1291775 - RNA, 23 nt, Human
gcuggucucaaacuccuggccuc

SEQ ID NO: 1291776 - RNA, 24 nt, Human
gcuugaagcguguuggggucuccu

SEQ ID NO: 1291777 - RNA, 24 nt, Human
ggccucaagugauccgccugccuu

SEQ ID NO: 1291778 - RNA, 24 nt, Human
ggcuggucucaaacuccuggccuc

SEQ ID NO: 1291779 - RNA, 22 nt, Human
ggguuucaccauguuggccagg

SEQ ID NO: 1291780 - RNA, 18 nt, Human
guagcugggauuacaggu

SEQ ID NO: 1291781 - RNA, 20 nt, Human
guagcugggauuacaggugc

SEQ ID NO: 1291782 - RNA, 18 nt, Human
guagcugggauuauaggc

SEQ ID NO: 1291783 - RNA, 18 nt, Human
guccaacugaacucccag

SEQ ID NO: 1291784 - RNA, 24 nt, Human
gugauucuccugucuuagccuccc

SEQ ID NO: 1291785 - RNA, 23 nt, Human
uaacugccaggcugaucucuugu

SEQ ID NO: 1291786 - RNA, 24 nt, Human
uaauagagacaggguuucaccaug

SEQ ID NO: 1291787 - RNA, 26 nt, Human
uaauagagacaggguuucaccauguu

SEQ ID NO: 1291788 - RNA, 24 nt, Human
uaauuuuuguacuuuuaguagaga

SEQ ID NO: 1291789 - RNA, 24 nt, Human
uacaagugugagccacugcaccca

SEQ ID NO: 1291790 - RNA, 21 nt, Human
uagagacaggguuucaccaug

SEQ ID NO: 1291791 - RNA, 22 nt, Human
uagagacaggguuucaccaugu

SEQ ID NO: 1291792 - RNA, 19 nt, Human
uauucuccugccucagccu

SEQ ID NO: 1291793 - RNA, 22 nt, Human
ucacccaggcuggaguguagug

SEQ ID NO: 1291794 - RNA, 24 nt, Human
ucacgcugucacccagacuggagu

SEQ ID NO: 1291795 - RNA, 24 nt, Human
ucacugcaacaugcaucucccgga

SEQ ID NO: 1291796 - RNA, 22 nt, Human
ucacugcaaccucuuccuccca

SEQ ID NO: 1291797 - RNA, 24 nt, Human
ucacugcaaccucuuccucccagg

SEQ ID NO: 1291798 - RNA, 25 nt, Human
ucaggaugggaaagaaaaguagggu

SEQ ID NO: 1291799 - RNA, 21 nt, Human
ucagguagcugggauuacagg

SEQ ID NO: 1291800 - RNA, 18 nt, Human
ucccaaagugcugggauu

SEQ ID NO: 1291801 - RNA, 23 nt, Human
ucccaaagugcugggauuacaag

SEQ ID NO: 1291802 - RNA, 24 nt, Human
ucccaaguagcugggauuauaggc

SEQ ID NO: 1291803 - RNA, 21 nt, Human
ucccaggcucaagugauucuc

SEQ ID NO: 1291804 - RNA, 24 nt, Human
ucccaggcucaagugauucuccug

SEQ ID NO: 1291805 - RNA, 21 nt, Human
ucccaggugccgacagagucc

SEQ ID NO: 1291806 - RNA, 18 nt, Human
uccccagguucuccuucc

SEQ ID NO: 1291807 - RNA, 21 nt, Human
uccccagguucuccuuccuga

SEQ ID NO: 1291808 - RNA, 21 nt, Human
ucccggauuccaguuauucuc

SEQ ID NO: 1291809 - RNA, 24 nt, Human
ucccggauuccaguuauucuccug

SEQ ID NO: 1291810 - RNA, 18 nt, Human
ucccucuguucccugucc

SEQ ID NO: 1291811 - RNA, 21 nt, Human
uccugggugaaugguaucucc

SEQ ID NO: 1291812 - RNA, 18 nt, Human
uccuuggucuucuucugg

SEQ ID NO: 1291813 - RNA, 24 nt, Human
ucucacgcugucacccagacugga

SEQ ID NO: 1291814 - RNA, 23 nt, Human
ucucagguagcugggauuacagg

SEQ ID NO: 1291815 - RNA, 24 nt, Human
ucucagguagcugggauuacaggu

SEQ ID NO: 1291816 - RNA, 24 nt, Human
ucucccggauuccaguuauucucc

SEQ ID NO: 1291817 - RNA, 24 nt, Human
ucuccugccucagccucucaggua

SEQ ID NO: 1291818 - RNA, 26 nt, Human
ucuccugucuuagccucccaaguagc

SEQ ID NO: 1291819 - RNA, 19 nt, Human
ucuuccucccaggcucaag

SEQ ID NO: 1291820 - RNA, 23 nt, Human
ucuugcuuugucacccaggcugg

SEQ ID NO: 1291821 - RNA, 24 nt, Human
ucuugcuuugucacccaggcugga

SEQ ID NO: 1291822 - RNA, 18 nt, Human
ucuuuuuuuuuuuuuuuu

SEQ ID NO: 1291823 - RNA, 21 nt, Human
ugaauuucuccauucuuccca

SEQ ID NO: 1291824 - RNA, 23 nt, Human
ugacccuucuuuuuuuucuucuu

SEQ ID NO: 1291825 - RNA, 24 nt, Human
ugccucagccucucagguagcugg

SEQ ID NO: 1291826 - RNA, 19 nt, Human
ugccuuggcuucccaaagu

SEQ ID NO: 1291827 - RNA, 27 nt, Human
ugcugggauuacaagugugagccacug

SEQ ID NO: 1291828 - RNA, 24 nt, Human
ugcuuugucacccaggcuggagug

SEQ ID NO: 1291829 - RNA, 23 nt, Human
uggagugcaguagcacgaucucg

SEQ ID NO: 1291830 - RNA, 24 nt, Human
uggagugcaguagcacgaucucgg

SEQ ID NO: 1291831 - RNA, 23 nt, Human
uggaguguaguggugcaaucuca

SEQ ID NO: 1291832 - RNA, 24 nt, Human
uggaguguaguggugcaaucucag

SEQ ID NO: 1291833 - RNA, 24 nt, Human
uggccaggcuggucucaaacuccu

SEQ ID NO: 1291834 - RNA, 18 nt, Human
uggccucaagugauccgc

SEQ ID NO: 1291835 - RNA, 24 nt, Human
uggccucaagugauccgccugccu

SEQ ID NO: 1291836 - RNA, 19 nt, Human
ugggagaagucaggagugg

SEQ ID NO: 1291837 - RNA, 24 nt, Human
ugggagaagucaggaguggagaac

SEQ ID NO: 1291838 - RNA, 19 nt, Human
ugggauuacaagugugagc

SEQ ID NO: 1291839 - RNA, 21 nt, Human
ugggauuacaagugugagcca

SEQ ID NO: 1291840 - RNA, 22 nt, Human
ugggauuacaagugugagccac

SEQ ID NO: 1291841 - RNA, 22 nt, Human
ugggauuacaagugugagccac

SEQ ID NO: 1291842 - RNA, 24 nt, Human
ugggauuacaagugugagccacug

SEQ ID NO: 1291843 - RNA, 19 nt, Human
ugggauuacaggugccugc

SEQ ID NO: 1291844 - RNA, 21 nt, Human
ugggauuacaggugccugcca

SEQ ID NO: 1291845 - RNA, 21 nt, Human
ugggauuacaggugccugcca

SEQ ID NO: 1291846 - RNA, 22 nt, Human
ugggauuacaggugccugccau

SEQ ID NO: 1291847 - RNA, 21 nt, Human
ugggauuauaggcacacacca

SEQ ID NO: 1291848 - RNA, 22 nt, Human
ugggauuauaggcacacaccac

SEQ ID NO: 1291849 - RNA, 24 nt, Human
uggugcaaucucagcucacugcaa

SEQ ID NO: 1291850 - RNA, 20 nt, Human
uguacaugcccguuucagag

SEQ ID NO: 1291851 - RNA, 22 nt, Human
uguaguggugcaaucucagcuc

SEQ ID NO: 1291852 - RNA, 21 nt, Human
uguccaaaagcaucuucaggg

SEQ ID NO: 1291853 - RNA, 22 nt, Human
ugucccagcagaggcugugucc

SEQ ID NO: 1291854 - RNA, 18 nt, Human
uguccuggagauccuggg

SEQ ID NO: 1291855 - RNA, 24 nt, Human
uuaauagagacaggguuucaccau

SEQ ID NO: 1291856 - RNA, 18 nt, Human
uuaguagagaugggguuu

SEQ ID NO: 1291857 - RNA, 21 nt, Human
uuccaguuauucuccugccuc

SEQ ID NO: 1291858 - RNA, 23 nt, Human
uucuucccacacacccuccccag

SEQ ID NO: 1291859 - RNA, 19 nt, Human
uugaagcguguuggggucu

SEQ ID NO: 1291860 - RNA, 24 nt, Human
uugaagcguguuggggucuccucu

SEQ ID NO: 1291861 - RNA, 24 nt, Human
uugcuuugucacccaggcuggagu

SEQ ID NO: 1291862 - RNA, 24 nt, Human
uuucaccauguuggccaggcuggu

SEQ ID NO: 1291863 - RNA, 20 nt, Human
uuucagaguccagucuggug

SEQ ID NO: 1291864 - RNA, 24 nt, Human
uuugucacccaggcuggaguguag

SEQ ID NO: 1291865 - RNA, 20 nt, Human
uuuuuguacuuuuaguagag

SEQ ID NO: 1291866 - RNA, 26 nt, Human
uuuuuuuuuuuugagauagcaucuca

SEQ ID NO: 1291867 - RNA, 18 nt, Human
uuuuuuuuuuuuuuuuug

SEQ ID NO: 1291868 - RNA, 23 nt, Human
uauccacuggcugucccugcccc

SEQ ID NO: 1291869 - RNA, 19 nt, Human
aaaaaucugauuguguucu

SEQ ID NO: 1291870 - RNA, 23 nt, Human
aaaagacaccucauucaccuuca

SEQ ID NO: 1291871 - RNA, 26 nt, Human
aaauggcccuacaguguugagaagau

SEQ ID NO: 1291872 - RNA, 23 nt, Human
aacagaaaggaagcuuaaccugg

SEQ ID NO: 1291873 - RNA, 18 nt, Human
aaccuagcucagcgucag

SEQ ID NO: 1291874 - RNA, 19 nt, Human
aagcucaggucauggacuu

SEQ ID NO: 1291875 - RNA, 25 nt, Human
aaugaugaaaguauaacagaaagga

SEQ ID NO: 1291876 - RNA, 23 nt, Human
acagaaaggaagcuuaaccugga

SEQ ID NO: 1291877 - RNA, 23 nt, Human
acaggcaagacaugaugcuugug

SEQ ID NO: 1291878 - RNA, 24 nt, Human
acagucagguccucaccacguacc

SEQ ID NO: 1291879 - RNA, 24 nt, Human
accaccgggaucuccucauccucc

SEQ ID NO: 1291880 - RNA, 23 nt, Human
accucauucaccuucaggaccag

SEQ ID NO: 1291881 - RNA, 23 nt, Human
acugaacuguuggcugcugguga

SEQ ID NO: 1291882 - RNA, 18 nt, Human
agaaaggaagcuuaaccu

SEQ ID NO: 1291883 - RNA, 25 nt, Human
agguccucaccacguaccucaaucc

SEQ ID NO: 1291884 - RNA, 20 nt, Human
agguggugcuauugcuggug

SEQ ID NO: 1291885 - RNA, 24 nt, Human
aguuguauuauagaggggaaagau

SEQ ID NO: 1291886 - RNA, 24 nt, Human
auggaaucuuugguggcucugugg

SEQ ID NO: 1291887 - RNA, 21 nt, Human
caaccuagcucagcgucagaa

SEQ ID NO: 1291888 - RNA, 24 nt, Human
caaccuagcucagcgucagaaauu

SEQ ID NO: 1291889 - RNA, 22 nt, Human
caagagggcucccuugaacacc

SEQ ID NO: 1291890 - RNA, 20 nt, Human
cacacacagggcaagcccca

SEQ ID NO: 1291891 - RNA, 22 nt, Human
cacacccacacaagugaaguga

SEQ ID NO: 1291892 - RNA, 20 nt, Human
cacagcaucacaaugaugaa

SEQ ID NO: 1291893 - RNA, 25 nt, Human
cacagucagguccucaccacguacc

SEQ ID NO: 1291894 - RNA, 22 nt, Human
cagaagcaagcucccccacuga

SEQ ID NO: 1291895 - RNA, 21 nt, Human
caggaccagaacugagaccgg

SEQ ID NO: 1291896 - RNA, 25 nt, Human
caggcaagacaugaugcuugugcca

SEQ ID NO: 1291897 - RNA, 18 nt, Human
cagucuucaaaguugagg

SEQ ID NO: 1291898 - RNA, 23 nt, Human
caugcaggaacugccagaguccc

SEQ ID NO: 1291899 - RNA, 23 nt, Human
caugccaccaaccuagcucagcg

SEQ ID NO: 1291900 - RNA, 18 nt, Human
cauucaccuucaggacca

SEQ ID NO: 1291901 - RNA, 22 nt, Human
ccaaccuagcucagcgucagaa

SEQ ID NO: 1291902 - RNA, 22 nt, Human
ccucaaagcgaaggcccacagc

SEQ ID NO: 1291903 - RNA, 19 nt, Human
ccuggaaaaaucugauugu

SEQ ID NO: 1291904 - RNA, 19 nt, Human
ccuggccauaauuauucac

SEQ ID NO: 1291905 - RNA, 22 nt, Human
ccuuauucuugugccucuccug

SEQ ID NO: 1291906 - RNA, 21 nt, Human
cuccaggccccaccucaaagc

SEQ ID NO: 1291907 - RNA, 21 nt, Human
cuccuuggcacagauggcuga

SEQ ID NO: 1291908 - RNA, 20 nt, Human
cucugcuugcagggccacag

SEQ ID NO: 1291909 - RNA, 22 nt, Human
cucugcuugcagggccacaguc

SEQ ID NO: 1291910 - RNA, 23 nt, Human
cuguuccacuccacuaccauggc

SEQ ID NO: 1291911 - RNA, 22 nt, Human
gaacaccagcauuaucugagac

SEQ ID NO: 1291912 - RNA, 22 nt, Human
gaacagcuaguggaaagcacac

SEQ ID NO: 1291913 - RNA, 21 nt, Human
gaacugagaccgggugaaaga

SEQ ID NO: 1291914 - RNA, 18 nt, Human
gaacugccagagucccac

SEQ ID NO: 1291915 - RNA, 19 nt, Human
gaagcaagcucccccacug

SEQ ID NO: 1291916 - RNA, 19 nt, Human
gagcagcucgaggucacag

SEQ ID NO: 1291917 - RNA, 21 nt, Human
gagcagcucgaggucacagcc

SEQ ID NO: 1291918 - RNA, 22 nt, Human
gcaagcucccccacugaccccu

SEQ ID NO: 1291919 - RNA, 23 nt, Human
gugaagugagugcuccccagucc

SEQ ID NO: 1291920 - RNA, 18 nt, Human
guggaaagcacacccaca

SEQ ID NO: 1291921 - RNA, 21 nt, Human
uaaauguaggaagccauuuug

SEQ ID NO: 1291922 - RNA, 21 nt, Human
uaacagaaaggaagcuuaacc

SEQ ID NO: 1291923 - RNA, 23 nt, Human
uaacagaaaggaagcuuaaccug

SEQ ID NO: 1291924 - RNA, 19 nt, Human
uacacagaggaccaaaagg

SEQ ID NO: 1291925 - RNA, 21 nt, Human
uaccauggccaaagcucaggu

SEQ ID NO: 1291926 - RNA, 19 nt, Human
uagcucagcgucagaaauu

SEQ ID NO: 1291927 - RNA, 18 nt, Human
uauacaggcaagacauga

SEQ ID NO: 1291928 - RNA, 23 nt, Human
uccaaguaagaacagcuagugga

SEQ ID NO: 1291929 - RNA, 23 nt, Human
uccacuccacuaccauggccaaa

SEQ ID NO: 1291930 - RNA, 25 nt, Human
uccacuccacuaccauggccaaagc

SEQ ID NO: 1291931 - RNA, 18 nt, Human
uccacugggugaaacuga

SEQ ID NO: 1291932 - RNA, 20 nt, Human
uccaggccccaccucaaagc

SEQ ID NO: 1291933 - RNA, 23 nt, Human
ucccaaaagacaccucauucacc

SEQ ID NO: 1291934 - RNA, 19 nt, Human
ucccacggugcccagcugc

SEQ ID NO: 1291935 - RNA, 23 nt, Human
uccccagucccucuggcauccgu

SEQ ID NO: 1291936 - RNA, 23 nt, Human
ucccugccaugaaaccaugagga

SEQ ID NO: 1291937 - RNA, 18 nt, Human
uccuuggcacagauggcu

SEQ ID NO: 1291938 - RNA, 22 nt, Human
ucuccacugggugaaacugaac

SEQ ID NO: 1291939 - RNA, 20 nt, Human
ucuccugcccccuuccccca

SEQ ID NO: 1291940 - RNA, 22 nt, Human
ugaagugagcagcucgagguca

SEQ ID NO: 1291941 - RNA, 28 nt, Human
ugaagugagcagcucgaggucggaaccc

SEQ ID NO: 1291942 - RNA, 22 nt, Human
ugagcagcucgaggucacagcc

SEQ ID NO: 1291943 - RNA, 26 nt, Human
ugccagagucccacggugcccagcug

SEQ ID NO: 1291944 - RNA, 21 nt, Human
ugcccccuucccccacacucc

SEQ ID NO: 1291945 - RNA, 20 nt, Human
ugcuggugaccccuggccau

SEQ ID NO: 1291946 - RNA, 18 nt, Human
uggaaaaaucugauugug

SEQ ID NO: 1291947 - RNA, 19 nt, Human
uggcacagauggcugagcc

SEQ ID NO: 1291948 - RNA, 23 nt, Human
ugugccucuccugcccccuuccc

SEQ ID NO: 1291949 - RNA, 23 nt, Human
uuccucugcuugcagggccacag

SEQ ID NO: 1291950 - RNA, 21 nt, Human
aagguacuccaaaaagcucac

SEQ ID NO: 1291951 - RNA, 21 nt, Human
aaggauaaacuggacuuagag

SEQ ID NO: 1291952 - RNA, 18 nt, Human
agcugaagguuuucgaca

SEQ ID NO: 1291953 - RNA, 22 nt, Human
ccaguccaaagagaacaugguc

SEQ ID NO: 1291954 - RNA, 23 nt, Human
cgacaucagccccaccgaagcaa

SEQ ID NO: 1291955 - RNA, 19 nt, Human
cugaagguuuucgacauca

SEQ ID NO: 1291956 - RNA, 23 nt, Human
gaaaagccaguccaaagagaaca

SEQ ID NO: 1291957 - RNA, 21 nt, Human
gaauggaaggggaaaagccag

SEQ ID NO: 1291958 - RNA, 18 nt, Human
gcacugugacacugagca

SEQ ID NO: 1291959 - RNA, 21 nt, Human
ggaaaagccaguccaaagaga

SEQ ID NO: 1291960 - RNA, 19 nt, Human
uaagaugaauuacuuacug

SEQ ID NO: 1291961 - RNA, 19 nt, Human
uccaaagagaacaugguca

SEQ ID NO: 1291962 - RNA, 19 nt, Human
ugacacugagcaggagaaa

SEQ ID NO: 1291963 - RNA, 18 nt, Human
ugucuugggaagcugaag

SEQ ID NO: 1291964 - RNA, 19 nt, Human
ugucuugggaagcugaagg

SEQ ID NO: 1291965 - RNA, 26 nt, Human
uguuuuauucauucaauaaacguauu

SEQ ID NO: 1291966 - RNA, 19 nt, Human
uugucuugggaagcugaag

SEQ ID NO: 1291967 - RNA, 20 nt, Human
uuuaaacuaugucuuaguuu

SEQ ID NO: 1291968 - RNA, 20 nt, Human
uuuaagaugaauuacuuacc

SEQ ID NO: 1291969 - RNA, 19 nt, Human
uuuucgacaucagccccac

SEQ ID NO: 1291970 - RNA, 20 nt, Human
uguggugcugaccauucugg

SEQ ID NO: 1291971 - RNA, 18 nt, Human
acaagcagggcacgccgc

SEQ ID NO: 1291972 - RNA, 22 nt, Human
acgccgaguggggugcgugggc

SEQ ID NO: 1291973 - RNA, 19 nt, Human
cguaggggucacaaccucc

SEQ ID NO: 1291974 - RNA, 18 nt, Human
cuccgugcggaacccgcc

SEQ ID NO: 1291975 - RNA, 22 nt, Human
gcaagcuggggcuccguagggg

SEQ ID NO: 1291976 - RNA, 24 nt, Human
ggcaagcuggggcuccguaggggu

SEQ ID NO: 1291977 - RNA, 18 nt, Human
uccguaggggucacaacc

SEQ ID NO: 1291978 - RNA, 18 nt, Human
ugacaagcagggcacgcc

SEQ ID NO: 1291979 - RNA, 19 nt, Human
ugcgugggcaagcuggggc

SEQ ID NO: 1291980 - RNA, 22 nt, Human
ugguucgugaauaucacaaaag

SEQ ID NO: 1291981 - RNA, 20 nt, Human
agguggcgcuggcuggagac

SEQ ID NO: 1291982 - RNA, 18 nt, Human
ccauguauuaaacaaggu

SEQ ID NO: 1291983 - RNA, 18 nt, Human
cuggcuggagacaugcug

SEQ ID NO: 1291984 - RNA, 18 nt, Human
cuuccugacccgcucuuc

SEQ ID NO: 1291985 - RNA, 20 nt, Human
gaggauaguguauuuucagg

SEQ ID NO: 1291986 - RNA, 23 nt, Human
gaguucccauguauuaaacaagg

SEQ ID NO: 1291987 - RNA, 18 nt, Human
gccggugcgugcagggaa

SEQ ID NO: 1291988 - RNA, 24 nt, Human
uacagaaugaauuucagugaguuc

SEQ ID NO: 1291989 - RNA, 20 nt, Human
ucagguuugcaagucuggag

SEQ ID NO: 1291990 - RNA, 20 nt, Human
ucccauguauuaaacaaggu

SEQ ID NO: 1291991 - RNA, 23 nt, Human
uccccaucacagugugcgugcuu

SEQ ID NO: 1291992 - RNA, 21 nt, Human
uccuccccaucacagugugcg

SEQ ID NO: 1291993 - RNA, 22 nt, Human
ucugauagcuggaggauagugu

SEQ ID NO: 1291994 - RNA, 19 nt, Human
ugaguagaucucaauauaa

SEQ ID NO: 1291995 - RNA, 23 nt, Human
ugcgugcagggaacuugggccuc

SEQ ID NO: 1291996 - RNA, 20 nt, Human
ugcugugcucaucuuccuga

SEQ ID NO: 1291997 - RNA, 18 nt, Human
uggcgcuggcuggagaca

SEQ ID NO: 1291998 - RNA, 22 nt, Human
ugguacguaaacguccuccccu

SEQ ID NO: 1291999 - RNA, 23 nt, Human
ccacagcuguuaaauguguuugc

SEQ ID NO: 1292000 - RNA, 19 nt, Human
uuugcugaaaagggauaga

SEQ ID NO: 1292001 - RNA, 20 nt, Human
aaauuuaaucaucacucaag

SEQ ID NO: 1292002 - RNA, 19 nt, Human
cgaggguguacauuucuau

SEQ ID NO: 1292003 - RNA, 19 nt, Human
uauaaguauuuuucugugg

SEQ ID NO: 1292004 - RNA, 24 nt, Human
uggauuauauccuuuaggcaaauc

SEQ ID NO: 1292005 - RNA, 21 nt, Human
aagaaugaggaauuuaccugu

SEQ ID NO: 1292006 - RNA, 19 nt, Human
aagcucugaaguuuuuggc

SEQ ID NO: 1292007 - RNA, 19 nt, Human
acagucuguugaagaaugg

SEQ ID NO: 1292008 - RNA, 22 nt, Human
acuguuccagccucucgaagcu

SEQ ID NO: 1292009 - RNA, 19 nt, Human
agcaaaguggccuuuaccg

SEQ ID NO: 1292010 - RNA, 23 nt, Human
agcacgccuggugaugaugagca

SEQ ID NO: 1292011 - RNA, 20 nt, Human
agcuuccauucauucucuuc

SEQ ID NO: 1292012 - RNA, 18 nt, Human
aggaggaagggcuauccg

SEQ ID NO: 1292013 - RNA, 20 nt, Human
aggccuccagaugacagucu

SEQ ID NO: 1292014 - RNA, 19 nt, Human
aggccuccugagcccccag

SEQ ID NO: 1292015 - RNA, 20 nt, Human
aggcuucucugcuuguaaga

SEQ ID NO: 1292016 - RNA, 22 nt, Human
cagccccuucuguugcuuggag

SEQ ID NO: 1292017 - RNA, 24 nt, Human
ccaccuuccacugccauccgacuu

SEQ ID NO: 1292018 - RNA, 19 nt, Human
ccccagaggaggaagggcu

SEQ ID NO: 1292019 - RNA, 20 nt, Human
ccgacuccugauccaauccu

SEQ ID NO: 1292020 - RNA, 21 nt, Human
ccucucgaagcuucuuccucc

SEQ ID NO: 1292021 - RNA, 19 nt, Human
ccugagcccccagcaggau

SEQ ID NO: 1292022 - RNA, 22 nt, Human
ccugauccaauccaggccucca

SEQ ID NO: 1292023 - RNA, 18 nt, Human
ccuuccacugccauccga

SEQ ID NO: 1292024 - RNA, 21 nt, Human
ccuucuguugcuuggccaguc

SEQ ID NO: 1292025 - RNA, 19 nt, Human
cgaagcuucuuccuccuuc

SEQ ID NO: 1292026 - RNA, 18 nt, Human
cgacuccugauccaaucc

SEQ ID NO: 1292027 - RNA, 23 nt, Human
cgacuugcugaugcccaggcccc

SEQ ID NO: 1292028 - RNA, 20 nt, Human
cggcagcacgccuggugauu

SEQ ID NO: 1292029 - RNA, 19 nt, Human
cggcagcaucagggggcag

SEQ ID NO: 1292030 - RNA, 23 nt, Human
cucaacuguuccagccucucgaa

SEQ ID NO: 1292031 - RNA, 19 nt, Human
cucacagcaguaagaauga

SEQ ID NO: 1292032 - RNA, 23 nt, Human
cuccugauccaauccaggccucc

SEQ ID NO: 1292033 - RNA, 21 nt, Human
cuccugugugcucuugugcug

SEQ ID NO: 1292034 - RNA, 21 nt, Human
cucucuuaaaacuuuacccuc

SEQ ID NO: 1292035 - RNA, 23 nt, Human
cucuuaaaacuuuacccuccuug

SEQ ID NO: 1292036 - RNA, 19 nt, Human
cuuccuccuucccuguccc

SEQ ID NO: 1292037 - RNA, 23 nt, Human
cuuuuccauagcaaccgugacaa

SEQ ID NO: 1292038 - RNA, 23 nt, Human
gauccuugacauucugagaacug

SEQ ID NO: 1292039 - RNA, 23 nt, Human
gauuccauuucuccaccuuccac

SEQ ID NO: 1292040 - RNA, 21 nt, Human
ggagguagugcuucuuuugua

SEQ ID NO: 1292041 - RNA, 20 nt, Human
gggcaggccuccugagcccc

SEQ ID NO: 1292042 - RNA, 21 nt, Human
gugagaaaccagugacucaga

SEQ ID NO: 1292043 - RNA, 21 nt, Human
uaagucagguguuuguaaacc

SEQ ID NO: 1292044 - RNA, 19 nt, Human
uaauuuccaucccugguuc

SEQ ID NO: 1292045 - RNA, 18 nt, Human
uacaguucuuugaaagcu

SEQ ID NO: 1292046 - RNA, 21 nt, Human
uacuauucccuggaagucugu

SEQ ID NO: 1292047 - RNA, 18 nt, Human
uagcaaccgugacaaaag

SEQ ID NO: 1292048 - RNA, 24 nt, Human
uagugcaggcucagcuugcaccuc

SEQ ID NO: 1292049 - RNA, 23 nt, Human
uauuuuacuaugugauaaaggag

SEQ ID NO: 1292050 - RNA, 18 nt, Human
ucaaaugugucuccacau

SEQ ID NO: 1292051 - RNA, 26 nt, Human
ucacaccgagcugguuuuggccucuc

SEQ ID NO: 1292052 - RNA, 21 nt, Human
uccacauaguaggaguaaggu

SEQ ID NO: 1292053 - RNA, 23 nt, Human
uccacgguggccacaguaagaag

SEQ ID NO: 1292054 - RNA, 21 nt, Human
uccccagaguuucaucauuua

SEQ ID NO: 1292055 - RNA, 23 nt, Human
ucccuggaagucugugguacuuu

SEQ ID NO: 1292056 - RNA, 21 nt, Human
ucccugguucaagaugugccu

SEQ ID NO: 1292057 - RNA, 21 nt, Human
uccugauccaauccaggccuc

SEQ ID NO: 1292058 - RNA, 22 nt, Human
ucuaaaccuaagcaacagguau

SEQ ID NO: 1292059 - RNA, 23 nt, Human
ucugcagugcacggcagcaucag

SEQ ID NO: 1292060 - RNA, 23 nt, Human
ugaagaaugggcagcacagauug

SEQ ID NO: 1292061 - RNA, 21 nt, Human
ugaagcaaaggugaagcuucu

SEQ ID NO: 1292062 - RNA, 19 nt, Human
ugacaaaagguagugcagg

SEQ ID NO: 1292063 - RNA, 21 nt, Human
ugacaauaacagcaguaugcc

SEQ ID NO: 1292064 - RNA, 19 nt, Human
ugacagucuguugaagaau

SEQ ID NO: 1292065 - RNA, 24 nt, Human
ugacagucuguugaagaaugggca

SEQ ID NO: 1292066 - RNA, 23 nt, Human
ugacucagagaggggaauccgca

SEQ ID NO: 1292067 - RNA, 22 nt, Human
ugccauccgacuugcugaugcc

SEQ ID NO: 1292068 - RNA, 21 nt, Human
ugccauugagaaagacagcuu

SEQ ID NO: 1292069 - RNA, 19 nt, Human
ugccuugugaagcaaaggu

SEQ ID NO: 1292070 - RNA, 25 nt, Human
ugcucauuuacuugauacuuacaug

SEQ ID NO: 1292071 - RNA, 24 nt, Human
ugcucuugugcuggcuuugaagcu

SEQ ID NO: 1292072 - RNA, 20 nt, Human
uggcuccuaacaauuguucu

SEQ ID NO: 1292073 - RNA, 19 nt, Human
ugggaagauguccacggug

SEQ ID NO: 1292074 - RNA, 23 nt, Human
uggguuggaaucucagguuucuc

SEQ ID NO: 1292075 - RNA, 26 nt, Human
uggguuggaaucucagguuucucugg

SEQ ID NO: 1292076 - RNA, 23 nt, Human
uguaaccagccauguccuggagc

SEQ ID NO: 1292077 - RNA, 19 nt, Human
uguccuggagcagacacgg

SEQ ID NO: 1292078 - RNA, 20 nt, Human
uguccuggagcagacacggu

SEQ ID NO: 1292079 - RNA, 18 nt, Human
uuacuugauacuuacaug

SEQ ID NO: 1292080 - RNA, 18 nt, Human
uucccuguccccgcuuuc

SEQ ID NO: 1292081 - RNA, 21 nt, Human
uucccuguccccgcuuucuuu

SEQ ID NO: 1292082 - RNA, 19 nt, Human
uucugaaauaguacaugac

SEQ ID NO: 1292083 - RNA, 21 nt, Human
uucuuccuccuucccuguccc

SEQ ID NO: 1292084 - RNA, 21 nt, Human
uuucuccaccuuccacugcca

SEQ ID NO: 1292085 - RNA, 18 nt, Human
aagaacccaguugacacu

SEQ ID NO: 1292086 - RNA, 21 nt, Human
aagcagcggacccccuaaagc

SEQ ID NO: 1292087 - RNA, 24 nt, Human
aaggaacagcagaaauaaccagag

SEQ ID NO: 1292088 - RNA, 22 nt, Human
aauacacacaaaaucuugugua

SEQ ID NO: 1292089 - RNA, 19 nt, Human
acagcagaaauaaccagag

SEQ ID NO: 1292090 - RNA, 19 nt, Human
agcggacccccuaaagccc

SEQ ID NO: 1292091 - RNA, 18 nt, Human
aggcaacgaagaacccag

SEQ ID NO: 1292092 - RNA, 24 nt, Human
cagaaaaauacacacaaaaucuug

SEQ ID NO: 1292093 - RNA, 20 nt, Human
caggaagcagcggacccccu

SEQ ID NO: 1292094 - RNA, 20 nt, Human
ccccuaaagcccauuuuggg

SEQ ID NO: 1292095 - RNA, 23 nt, Human
cuuuuaggcaacgaagaacccag

SEQ ID NO: 1292096 - RNA, 20 nt, Human
gaacagcagaaauaaccaga

SEQ ID NO: 1292097 - RNA, 24 nt, Human
gaucgaagucaaggacuuugccuc

SEQ ID NO: 1292098 - RNA, 22 nt, Human
ggaacagcagaaauaaccagag

SEQ ID NO: 1292099 - RNA, 19 nt, Human
ucaggaagcagcggacccc

SEQ ID NO: 1292100 - RNA, 19 nt, Human
uccccguggguugugagag

SEQ ID NO: 1292101 - RNA, 21 nt, Human
ucuugucaagcucucuguugg

SEQ ID NO: 1292102 - RNA, 21 nt, Human
ugaaaaggaacagcagaaaua

SEQ ID NO: 1292103 - RNA, 22 nt, Human
uggccuuuuaggcaacgaagaa

SEQ ID NO: 1292104 - RNA, 20 nt, Human
uugggacaguagcuaucccc

SEQ ID NO: 1292105 - RNA, 18 nt, Human
uuucuugucaagcucucu

SEQ ID NO: 1292106 - RNA, 22 nt, Human
ggaggugaugaaagccccacuc

SEQ ID NO: 1292107 - RNA, 21 nt, Human
ggugaugaaagccccacuccu

SEQ ID NO: 1292108 - RNA, 18 nt, Human
ugaugaaagccccacucc

SEQ ID NO: 1292109 - RNA, 21 nt, Human
uaaauuucuagcauacugaac

SEQ ID NO: 1292110 - RNA, 23 nt, Human
aaaaugcuuucauguacuuacac

SEQ ID NO: 1292111 - RNA, 21 nt, Human
aaguccuugcauccaccccug

SEQ ID NO: 1292112 - RNA, 20 nt, Human
agaauguucuuuaaucaccu

SEQ ID NO: 1292113 - RNA, 20 nt, Human
agagggaaaugcaggacccc

SEQ ID NO: 1292114 - RNA, 21 nt, Human
ccaccccugaaagggugauuu

SEQ ID NO: 1292115 - RNA, 21 nt, Human
cgacagggccugcugcgacaa

SEQ ID NO: 1292116 - RNA, 24 nt, Human
cucagaaguccuugcauccacccc

SEQ ID NO: 1292117 - RNA, 18 nt, Human
gaaguccuugcauccacc

SEQ ID NO: 1292118 - RNA, 22 nt, Human
gaaguccuugcauccaccccug

SEQ ID NO: 1292119 - RNA, 18 nt, Human
gaguuguggccaaccucu

SEQ ID NO: 1292120 - RNA, 20 nt, Human
gcagagacgccagagggaaa

SEQ ID NO: 1292121 - RNA, 23 nt, Human
gccauucugcccauuacaguuaa

SEQ ID NO: 1292122 - RNA, 24 nt, Human
guuaacacuauagugguucuucuu

SEQ ID NO: 1292123 - RNA, 20 nt, Human
uacacccccaaauuaccagg

SEQ ID NO: 1292124 - RNA, 23 nt, Human
uaccagguaauuuagaauguucu

SEQ ID NO: 1292125 - RNA, 23 nt, Human
uaggccacaggaagggugacuaa

SEQ ID NO: 1292126 - RNA, 24 nt, Human
uagugguucuucuuccuagcgugu

SEQ ID NO: 1292127 - RNA, 26 nt, Human
uccaucgacagggccugcugcgacaa

SEQ ID NO: 1292128 - RNA, 20 nt, Human
uguggccaaccucuucucgg

SEQ ID NO: 1292129 - RNA, 21 nt, Human
uuaccagguaauuuagaaugu

SEQ ID NO: 1292130 - RNA, 22 nt, Human
uuagaauguucuuuaaucaccu

SEQ ID NO: 1292131 - RNA, 24 nt, Human
aagauagaaagcauugaaauucau

SEQ ID NO: 1292132 - RNA, 21 nt, Human
aagcuucaguuuucccagagg

SEQ ID NO: 1292133 - RNA, 19 nt, Human
caacccuaaaucaaaacaa

SEQ ID NO: 1292134 - RNA, 21 nt, Human
cacaacccuaaaucaaaacaa

SEQ ID NO: 1292135 - RNA, 28 nt, Human
cucauaccuaccucuaccaaucgguugg

SEQ ID NO: 1292136 - RNA, 18 nt, Human
gcaucuauaaauacaaga

SEQ ID NO: 1292137 - RNA, 23 nt, Human
uaccacaacccuaaaucaaaaca

SEQ ID NO: 1292138 - RNA, 28 nt, Human
uaccucuaccacaacccuaaaucaaaac

SEQ ID NO: 1292139 - RNA, 22 nt, Human
uauuacagaauuucacaaagaa

SEQ ID NO: 1292140 - RNA, 19 nt, Human
ugaagcuucaguuuuccca

SEQ ID NO: 1292141 - RNA, 19 nt, Human
ugaagcuucaguuuuccca

SEQ ID NO: 1292142 - RNA, 20 nt, Human
ugaaguagaauuuuauuaca

SEQ ID NO: 1292143 - RNA, 22 nt, Human
ugaaguagaauuuuauuacaga

SEQ ID NO: 1292144 - RNA, 23 nt, Human
ugaaguagaauuuuauuacagaa

SEQ ID NO: 1292145 - RNA, 21 nt, Human
uuauuacagaauuucacaaag

SEQ ID NO: 1292146 - RNA, 22 nt, Human
aaagacacugugugagugacac

SEQ ID NO: 1292147 - RNA, 24 nt, Human
aacacaggaccuggcacaaagaca

SEQ ID NO: 1292148 - RNA, 23 nt, Human
aggaccuggcacaaagacacugu

SEQ ID NO: 1292149 - RNA, 18 nt, Human
cacaggaccuggcacaaa

SEQ ID NO: 1292150 - RNA, 24 nt, Human
ccccaggucccgauaauauugccc

SEQ ID NO: 1292151 - RNA, 25 nt, Human
uaccucuccacgguuagagacacca

SEQ ID NO: 1292152 - RNA, 22 nt, Human
uagccaguaccucuccacgguu

SEQ ID NO: 1292153 - RNA, 28 nt, Human
uccacgguuagagacaccaacacaggac

SEQ ID NO: 1292154 - RNA, 21 nt, Human
ccucguuccauuguggcagag

SEQ ID NO: 1292155 - RNA, 21 nt, Human
cugauugucuguccagccgcu

SEQ ID NO: 1292156 - RNA, 21 nt, Human
uagcuugcacguuggaguggc

SEQ ID NO: 1292157 - RNA, 21 nt, Human
uaucugauuccuucugauugu

SEQ ID NO: 1292158 - RNA, 22 nt, Human
aagcccaccaagcuguacaaga

SEQ ID NO: 1292159 - RNA, 19 nt, Human
acucaucccaggucuccug

SEQ ID NO: 1292160 - RNA, 23 nt, Human
agcaggagagcagugacaggaaa

SEQ ID NO: 1292161 - RNA, 18 nt, Human
aggcuggcacagcggaug

SEQ ID NO: 1292162 - RNA, 24 nt, Human
caagaacauaaucuucuguucuuc

SEQ ID NO: 1292163 - RNA, 22 nt, Human
cagauuggcuacuggccccaca

SEQ ID NO: 1292164 - RNA, 18 nt, Human
cagcaggagagcagugac

SEQ ID NO: 1292165 - RNA, 22 nt, Human
cagcaucuuggguacuaguagg

SEQ ID NO: 1292166 - RNA, 20 nt, Human
cagcccauggcccccaagcc

SEQ ID NO: 1292167 - RNA, 21 nt, Human
cagcccccaggucaggagccu

SEQ ID NO: 1292168 - RNA, 27 nt, Human
cagcuacaggagacuggcagcccccag

SEQ ID NO: 1292169 - RNA, 18 nt, Human
caggaaccagcuacagga

SEQ ID NO: 1292170 - RNA, 18 nt, Human
caggucuccugaaggacc

SEQ ID NO: 1292171 - RNA, 21 nt, Human
cccaagcccaccaagcuguac

SEQ ID NO: 1292172 - RNA, 21 nt, Human
cccagcccauggcccccaagc

SEQ ID NO: 1292173 - RNA, 23 nt, Human
ccccagcccauggcccccaagcc

SEQ ID NO: 1292174 - RNA, 18 nt, Human
cccccaagcccaccaagc

SEQ ID NO: 1292175 - RNA, 23 nt, Human
cccccagcccauggcccccaagc

SEQ ID NO: 1292176 - RNA, 20 nt, Human
cuucuuugcccucuugugcc

SEQ ID NO: 1292177 - RNA, 21 nt, Human
gaaccagcuacaggagacugg

SEQ ID NO: 1292178 - RNA, 21 nt, Human
gagaccuauggccaggagccc

SEQ ID NO: 1292179 - RNA, 19 nt, Human
gagccugccuuccuugccc

SEQ ID NO: 1292180 - RNA, 18 nt, Human
gcccauggcccccaagcc

SEQ ID NO: 1292181 - RNA, 23 nt, Human
gcccccagcaggagagcagugac

SEQ ID NO: 1292182 - RNA, 22 nt, Human
gcccccaggucaggagccucug

SEQ ID NO: 1292183 - RNA, 18 nt, Human
gcugaaagagaccuaugg

SEQ ID NO: 1292184 - RNA, 22 nt, Human
gcuguuuucuucuuugcccucu

SEQ ID NO: 1292185 - RNA, 18 nt, Human
ggaaccagcuacaggaga

SEQ ID NO: 1292186 - RNA, 18 nt, Human
ggagaugcgccaagcugc

SEQ ID NO: 1292187 - RNA, 21 nt, Human
ggagccccccagcgccugccc

SEQ ID NO: 1292188 - RNA, 21 nt, Human
uaaccgggaaggacggugcgg

SEQ ID NO: 1292189 - RNA, 25 nt, Human
uacaagaacauaaucuucuguucuu

SEQ ID NO: 1292190 - RNA, 22 nt, Human
uacaggagacuggcagccccca

SEQ ID NO: 1292191 - RNA, 19 nt, Human
uauggccaggagcccccca

SEQ ID NO: 1292192 - RNA, 24 nt, Human
uauggccaggagccccccagcgcc

SEQ ID NO: 1292193 - RNA, 20 nt, Human
ucccccagcccauggccccc

SEQ ID NO: 1292194 - RNA, 24 nt, Human
ucuucuuugcccucuugugccauu

SEQ ID NO: 1292195 - RNA, 21 nt, Human
uggcccccaagcccaccaagc

SEQ ID NO: 1292196 - RNA, 18 nt, Human
ugguaugaggcuguuuuc

SEQ ID NO: 1292197 - RNA, 19 nt, Human
ugugaggggagguccccca

SEQ ID NO: 1292198 - RNA, 24 nt, Human
uguuuuggggaagcaccacucauc

SEQ ID NO: 1292199 - RNA, 19 nt, Human
uucuucuuugcccucuugu

SEQ ID NO: 1292200 - RNA, 20 nt, Human
uucuuugcccucuugugcca

SEQ ID NO: 1292201 - RNA, 19 nt, Human
cccuuugcucacacacuuc

SEQ ID NO: 1292202 - RNA, 23 nt, Human
ugagcucagguugccucuggcau

SEQ ID NO: 1292203 - RNA, 20 nt, Human
uugguucugaauguggagau

SEQ ID NO: 1292204 - RNA, 27 nt, Human
ggagacuggggggccaugggcagaggc

SEQ ID NO: 1292205 - RNA, 22 nt, Human
gggcagaggcagagaggcuggc

SEQ ID NO: 1292206 - RNA, 21 nt, Human
aaaaaacaaacagauaaaccc

SEQ ID NO: 1292207 - RNA, 22 nt, Human
aaaaacaaacagauaaacccua

SEQ ID NO: 1292208 - RNA, 18 nt, Human
aaaacaaacagauaaacc

SEQ ID NO: 1292209 - RNA, 24 nt, Human
aaacaaacagauaaacccuagaaa

SEQ ID NO: 1292210 - RNA, 18 nt, Human
aaacagauaaacccuaga

SEQ ID NO: 1292211 - RNA, 22 nt, Human
aaacagauaaacccuagaaacc

SEQ ID NO: 1292212 - RNA, 22 nt, Human
aacccucaacucaaaaaacaaa

SEQ ID NO: 1292213 - RNA, 22 nt, Human
acagccuuggagggggcacugg

SEQ ID NO: 1292214 - RNA, 21 nt, Human
acccucaacucaaaaaacaaa

SEQ ID NO: 1292215 - RNA, 21 nt, Human
acucaaaaaacaaacagauaa

SEQ ID NO: 1292216 - RNA, 23 nt, Human
agaaagauaaacuguuuccccau

SEQ ID NO: 1292217 - RNA, 19 nt, Human
agagggaggaggaaggggu

SEQ ID NO: 1292218 - RNA, 19 nt, Human
agggaggcccgggcuccug

SEQ ID NO: 1292219 - RNA, 21 nt, Human
agggaggcccgggcuccuggc

SEQ ID NO: 1292220 - RNA, 21 nt, Human
agggggcacuggagauggggg

SEQ ID NO: 1292221 - RNA, 20 nt, Human
auaaacccuagaaaccggug

SEQ ID NO: 1292222 - RNA, 19 nt, Human
caacucaaaaaacaaacag

SEQ ID NO: 1292223 - RNA, 26 nt, Human
caacucaaaaaacaaacagauaaacc

SEQ ID NO: 1292224 - RNA, 24 nt, Human
cacugcacagccuuggagggggca

SEQ ID NO: 1292225 - RNA, 21 nt, Human
caucacuagcaaugccaaggc

SEQ ID NO: 1292226 - RNA, 22 nt, Human
ccccaagacacugcacagccuu

SEQ ID NO: 1292227 - RNA, 23 nt, Human
ccgucucagaccagcaaaaggag

SEQ ID NO: 1292228 - RNA, 19 nt, Human
ccucaacucaaaaaacaaa

SEQ ID NO: 1292229 - RNA, 18 nt, Human
ccuuggagggggcacugg

SEQ ID NO: 1292230 - RNA, 25 nt, Human
cgggaaaaugccaucacugauagua

SEQ ID NO: 1292231 - RNA, 23 nt, Human
cugagagccccaagacacugcac

SEQ ID NO: 1292232 - RNA, 23 nt, Human
cugcacagccuuggagggggcac

SEQ ID NO: 1292233 - RNA, 22 nt, Human
gagaaggacuggagggcuggug

SEQ ID NO: 1292234 - RNA, 22 nt, Human
gaggcagcugcuuuaggagccc

SEQ ID NO: 1292235 - RNA, 19 nt, Human
gaggcccgggcuccuggcc

SEQ ID NO: 1292236 - RNA, 23 nt, Human
gccaaauacucccacuucauccc

SEQ ID NO: 1292237 - RNA, 19 nt, Human
ggacuggagggcugguggg

SEQ ID NO: 1292238 - RNA, 19 nt, Human
ggaggaggaagggguugag

SEQ ID NO: 1292239 - RNA, 21 nt, Human
ggaggaggaagggguugaggg

SEQ ID NO: 1292240 - RNA, 23 nt, Human
ggaggaggaagggguugaggggg

SEQ ID NO: 1292241 - RNA, 30 nt, Human
uaaaacuaaguccagaaagauaaacuguuu

SEQ ID NO: 1292242 - RNA, 21 nt, Human
uaaaaugaaaaguucagaucc

SEQ ID NO: 1292243 - RNA, 21 nt, Human
uaggagcccgggaaaaugcca

SEQ ID NO: 1292244 - RNA, 21 nt, Human
ucccauuuucccuuuguguuu

SEQ ID NO: 1292245 - RNA, 19 nt, Human
uccccauggacuuggggag

SEQ ID NO: 1292246 - RNA, 23 nt, Human
ugaggaacccucaacucaaaaaa

SEQ ID NO: 1292247 - RNA, 21 nt, Human
ugauaaaacuaaguccagaaa

SEQ ID NO: 1292248 - RNA, 21 nt, Human
ugcacagccuuggagggggca

SEQ ID NO: 1292249 - RNA, 23 nt, Human
uggagggcuggugggcuggagcc

SEQ ID NO: 1292250 - RNA, 22 nt, Human
uggcccugagagccccaagaca

SEQ ID NO: 1292251 - RNA, 24 nt, Human
uggggguaaacauuaaauauagag

SEQ ID NO: 1292252 - RNA, 22 nt, Human
uuggcccugagagccccaagac

SEQ ID NO: 1292253 - RNA, 26 nt, Human
aaaaaaaaaaaaaaauacaguaggag

SEQ ID NO: 1292254 - RNA, 24 nt, Human
aaaaaaaaaaauacaguaggagaa

SEQ ID NO: 1292255 - RNA, 26 nt, Human
aaaccaaagcaaggcagaagguagga

SEQ ID NO: 1292256 - RNA, 20 nt, Human
aacauggcaaaacucugucu

SEQ ID NO: 1292257 - RNA, 21 nt, Human
aacauggcaaaacucugucuc

SEQ ID NO: 1292258 - RNA, 21 nt, Human
aacccgggaggcggagguugc

SEQ ID NO: 1292259 - RNA, 18 nt, Human
aagaaggggugcaacagc

SEQ ID NO: 1292260 - RNA, 24 nt, Human
acagagcgagacuccaucucaaaa

SEQ ID NO: 1292261 - RNA, 20 nt, Human
accauguuggucaggcuggu

SEQ ID NO: 1292262 - RNA, 18 nt, Human
accgcacuccagccuggg

SEQ ID NO: 1292263 - RNA, 24 nt, Human
accgcacuccagccugggagacag

SEQ ID NO: 1292264 - RNA, 18 nt, Human
acgggguuucaccauguu

SEQ ID NO: 1292265 - RNA, 23 nt, Human
acgggguuucaccauguugguca

SEQ ID NO: 1292266 - RNA, 24 nt, Human
acgggguuucaccauguuggucag

SEQ ID NO: 1292267 - RNA, 24 nt, Human
acuccagccugggagacagagcga

SEQ ID NO: 1292268 - RNA, 27 nt, Human
acucuguugccuaggcuggaaugcaau

SEQ ID NO: 1292269 - RNA, 25 nt, Human
agaaaccaaagcaaggcagaaggua

SEQ ID NO: 1292270 - RNA, 19 nt, Human
agcagugaguucuaggaca

SEQ ID NO: 1292271 - RNA, 21 nt, Human
agccgagauugugccaccgca

SEQ ID NO: 1292272 - RNA, 18 nt, Human
agccuccugaguagcuag

SEQ ID NO: 1292273 - RNA, 24 nt, Human
agccugggagacagagcgagacuc

SEQ ID NO: 1292274 - RNA, 21 nt, Human
aggcggagguugcagugagcc

SEQ ID NO: 1292275 - RNA, 24 nt, Human
aggcggagguugcagugagccgag

SEQ ID NO: 1292276 - RNA, 22 nt, Human
aggcugguuuugaacuccuggc

SEQ ID NO: 1292277 - RNA, 23 nt, Human
agggcagaaccaaacggccccua

SEQ ID NO: 1292278 - RNA, 24 nt, Human
agguaagagaaucgcuuuaacccg

SEQ ID NO: 1292279 - RNA, 18 nt, Human
aguagcuaggauuacagg

SEQ ID NO: 1292280 - RNA, 20 nt, Human
agugauucucuugccucagc

SEQ ID NO: 1292281 - RNA, 20 nt, Human
aucgcuuuaacccgggaggc

SEQ ID NO: 1292282 - RNA, 24 nt, Human
auugugccaccgcacuccagccug

SEQ ID NO: 1292283 - RNA, 24 nt, Human
auuuuuauaucuuuaguagagacg

SEQ ID NO: 1292284 - RNA, 18 nt, Human
caaagcaaggcagaaggu

SEQ ID NO: 1292285 - RNA, 19 nt, Human
caaagcaaggcagaaggua

SEQ ID NO: 1292286 - RNA, 24 nt, Human
caacauggcaaaacucugucucua

SEQ ID NO: 1292287 - RNA, 21 nt, Human
caccauguuggucaggcuggu

SEQ ID NO: 1292288 - RNA, 24 nt, Human
caccauguuggucaggcugguuuu

SEQ ID NO: 1292289 - RNA, 24 nt, Human
caccgcacuccagccugggagaca

SEQ ID NO: 1292290 - RNA, 23 nt, Human
cacuccagccugggagacagagc

SEQ ID NO: 1292291 - RNA, 24 nt, Human
cacuccagccugggagacagagcg

SEQ ID NO: 1292292 - RNA, 24 nt, Human
cacucuguugccuaggcuggaaug

SEQ ID NO: 1292293 - RNA, 23 nt, Human
cacugcaaccuccaccuuccggg

SEQ ID NO: 1292294 - RNA, 19 nt, Human
cagccuccugaguagcuag

SEQ ID NO: 1292295 - RNA, 22 nt, Human
cagccuggauugugccaucuaa

SEQ ID NO: 1292296 - RNA, 23 nt, Human
cagccuggauugugccaucuaag

SEQ ID NO: 1292297 - RNA, 22 nt, Human
caguaggccaagguuaggcuuc

SEQ ID NO: 1292298 - RNA, 20 nt, Human
cauagaucaaaacaacgagc

SEQ ID NO: 1292299 - RNA, 24 nt, Human
cauguuggucaggcugguuuugaa

SEQ ID NO: 1292300 - RNA, 24 nt, Human
ccaaacggccccuacauagaucaa

SEQ ID NO: 1292301 - RNA, 20 nt, Human
ccaccgcacuccagccuggg

SEQ ID NO: 1292302 - RNA, 24 nt, Human
ccaccgcacuccagccugggagac

SEQ ID NO: 1292303 - RNA, 27 nt, Human
ccagugauucucuugccucagccuccu

SEQ ID NO: 1292304 - RNA, 25 nt, Human
ccaucucaaaaaaaaaaaaaaaaaa

SEQ ID NO: 1292305 - RNA, 19 nt, Human
ccccuacauagaucaaaac

SEQ ID NO: 1292306 - RNA, 20 nt, Human
ccggguuccagugauucucu

SEQ ID NO: 1292307 - RNA, 20 nt, Human
ccuaggcuggaaugcaaugg

SEQ ID NO: 1292308 - RNA, 23 nt, Human
ccugaguagcuaggauuacaggc

SEQ ID NO: 1292309 - RNA, 24 nt, Human
ccugaguagcuaggauuacaggca

SEQ ID NO: 1292310 - RNA, 19 nt, Human
ccugcaaagaccacaucaa

SEQ ID NO: 1292311 - RNA, 20 nt, Human
ccuggccaacauggcaaaac

SEQ ID NO: 1292312 - RNA, 24 nt, Human
ccuggccaacauggcaaaacucug

SEQ ID NO: 1292313 - RNA, 22 nt, Human
ccugggagacagagcgagacuc

SEQ ID NO: 1292314 - RNA, 21 nt, Human
ccuguaaucccagcuacucag

SEQ ID NO: 1292315 - RNA, 22 nt, Human
ccuguaaucccagcuacucagg

SEQ ID NO: 1292316 - RNA, 24 nt, Human
ccuuccggguuccagugauucucu

SEQ ID NO: 1292317 - RNA, 23 nt, Human
cgagacuccaucucaaaaaaaaa

SEQ ID NO: 1292318 - RNA, 24 nt, Human
cgagauugugccaccgcacuccag

SEQ ID NO: 1292319 - RNA, 24 nt, Human
cgggaggcggagguugcagugagc

SEQ ID NO: 1292320 - RNA, 24 nt, Human
cgggguuucaccauguuggucagg

SEQ ID NO: 1292321 - RNA, 24 nt, Human
cuacauagaucaaaacaacgagcu

SEQ ID NO: 1292322 - RNA, 18 nt, Human
cucaaaaaaaaaaaaaaa

SEQ ID NO: 1292323 - RNA, 23 nt, Human
cucaaaaaaaaaaaaaaaaaaaa

SEQ ID NO: 1292324 - RNA, 18 nt, Human
cucaaagcagagaauaag

SEQ ID NO: 1292325 - RNA, 24 nt, Human
cucaaagcagagaauaaguagcuc

SEQ ID NO: 1292326 - RNA, 24 nt, Human
cucacugcaaccuccaccuuccgg

SEQ ID NO: 1292327 - RNA, 18 nt, Human
cucaggaagcugagguaa

SEQ ID NO: 1292328 - RNA, 19 nt, Human
cuccaucucaaaaaaaaaa

SEQ ID NO: 1292329 - RNA, 24 nt, Human
cuccugaguagcuaggauuacagg

SEQ ID NO: 1292330 - RNA, 24 nt, Human
cugcaaccuccaccuuccggguuc

SEQ ID NO: 1292331 - RNA, 23 nt, Human
cuugccucagccuccugaguagc

SEQ ID NO: 1292332 - RNA, 24 nt, Human
cuugccucagccuccugaguagcu

SEQ ID NO: 1292333 - RNA, 18 nt, Human
cuuucuucuucuucuucu

SEQ ID NO: 1292334 - RNA, 23 nt, Human
cuuucuucuucuucuucuuuuuu

SEQ ID NO: 1292335 - RNA, 18 nt, Human
cuuuuuuuuuuuuuuuug

SEQ ID NO: 1292336 - RNA, 23 nt, Human
gagacgggguuucaccauguugg

SEQ ID NO: 1292337 - RNA, 24 nt, Human
gagacgggguuucaccauguuggu

SEQ ID NO: 1292338 - RNA, 23 nt, Human
gagguugcagugagccgagauug

SEQ ID NO: 1292339 - RNA, 24 nt, Human
gaguagcuaggauuacaggcacgc

SEQ ID NO: 1292340 - RNA, 18 nt, Human
gauuacaggcacgcgcca

SEQ ID NO: 1292341 - RNA, 21 nt, Human
gauucucuugccucagccucc

SEQ ID NO: 1292342 - RNA, 20 nt, Human
gcaagcauugugcuaagaac

SEQ ID NO: 1292343 - RNA, 24 nt, Human
gcacuccagccugggagacagagc

SEQ ID NO: 1292344 - RNA, 22 nt, Human
gcagaaccaaacggccccuaca

SEQ ID NO: 1292345 - RNA, 24 nt, Human
gccaacauggcaaaacucugucuc

SEQ ID NO: 1292346 - RNA, 30 nt, Human
gcuggaaugcaaugguguaaucucggcucc

SEQ ID NO: 1292347 - RNA, 20 nt, Human
gcuguagaugcuguuuccgg

SEQ ID NO: 1292348 - RNA, 25 nt, Human
ggacaaaugcaaauuugaagucccu

SEQ ID NO: 1292349 - RNA, 18 nt, Human
ggaccuguuaagcuaaua

SEQ ID NO: 1292350 - RNA, 22 nt, Human
ggagguugcagugagccgagau

SEQ ID NO: 1292351 - RNA, 24 nt, Human
ggagguugcagugagccgagauug

SEQ ID NO: 1292352 - RNA, 18 nt, Human
ggaugggggaacagggca

SEQ ID NO: 1292353 - RNA, 22 nt, Human
ggauuacaggcacgcgccacca

SEQ ID NO: 1292354 - RNA, 18 nt, Human
ggcugguuuugaacuccu

SEQ ID NO: 1292355 - RNA, 18 nt, Human
ggcuuguaggauggaugg

SEQ ID NO: 1292356 - RNA, 23 nt, Human
gggguuucaccauguuggucagg

SEQ ID NO: 1292357 - RNA, 20 nt, Human
guaaaacagacuauggccuu

SEQ ID NO: 1292358 - RNA, 23 nt, Human
guagagacgggguuucaccaugu

SEQ ID NO: 1292359 - RNA, 23 nt, Human
guaggagaaaccaaagcaaggca

SEQ ID NO: 1292360 - RNA, 19 nt, Human
gucucuacuaaaaacacaa

SEQ ID NO: 1292361 - RNA, 23 nt, Human
gugauucucuugccucagccucc

SEQ ID NO: 1292362 - RNA, 22 nt, Human
guggcaugcuccuguaauccca

SEQ ID NO: 1292363 - RNA, 20 nt, Human
guuaggcuuguaggauggau

SEQ ID NO: 1292364 - RNA, 24 nt, Human
guugcagugagccgagauugugcc

SEQ ID NO: 1292365 - RNA, 21 nt, Human
uaagcuaauagggguaaaaca

SEQ ID NO: 1292366 - RNA, 24 nt, Human
uaauuuuuauaucuuuaguagaga

SEQ ID NO: 1292367 - RNA, 20 nt, Human
uacaguaggagaaaccaaaa

SEQ ID NO: 1292368 - RNA, 24 nt, Human
uacaguaggagaaaccaaagcaag

SEQ ID NO: 1292369 - RNA, 22 nt, Human
uagagacgggguuucaccaugu

SEQ ID NO: 1292370 - RNA, 18 nt, Human
uagcagugaguucuagga

SEQ ID NO: 1292371 - RNA, 21 nt, Human
uaggauuacaggcacgcgcca

SEQ ID NO: 1292372 - RNA, 22 nt, Human
uaggauuacaggcacgcgccac

SEQ ID NO: 1292373 - RNA, 24 nt, Human
uaggauuacaggcacgcgccacca

SEQ ID NO: 1292374 - RNA, 24 nt, Human
uaguagagacgggguuucaccaug

SEQ ID NO: 1292375 - RNA, 26 nt, Human
uaguagagacgggguuucaccauguu

SEQ ID NO: 1292376 - RNA, 23 nt, Human
ucacugcaaccuccaccuuccgg

SEQ ID NO: 1292377 - RNA, 24 nt, Human
ucacugcaaccuccaccuuccggg

SEQ ID NO: 1292378 - RNA, 25 nt, Human
ucacugcaaccuccaccuuccgggu

SEQ ID NO: 1292379 - RNA, 18 nt, Human
ucaggaagcugagguaag

SEQ ID NO: 1292380 - RNA, 23 nt, Human
uccagccugggagacagagcgag

SEQ ID NO: 1292381 - RNA, 24 nt, Human
uccagccugggagacagagcgaga

SEQ ID NO: 1292382 - RNA, 23 nt, Human
uccaucucaaaaaaaaaaaaaaa

SEQ ID NO: 1292383 - RNA, 19 nt, Human
uccugaguagcuaggauua

SEQ ID NO: 1292384 - RNA, 24 nt, Human
uccugaguagcuaggauuacaggc

SEQ ID NO: 1292385 - RNA, 24 nt, Human
ucgcuuuaacccgggaggcggagg

SEQ ID NO: 1292386 - RNA, 23 nt, Human
ucucacucuguugccuaggcugg

SEQ ID NO: 1292387 - RNA, 24 nt, Human
ucucacucuguugccuaggcugga

SEQ ID NO: 1292388 - RNA, 21 nt, Human
ucucuacuaaaaacacaaaaa

SEQ ID NO: 1292389 - RNA, 24 nt, Human
ucuguugccuaggcuggaaugcaa

SEQ ID NO: 1292390 - RNA, 18 nt, Human
ucuucuucuuuuuuuuuu

SEQ ID NO: 1292391 - RNA, 24 nt, Human
ucuuuaguagagacgggguuucac

SEQ ID NO: 1292392 - RNA, 19 nt, Human
ucuuucuucuucuucuucu

SEQ ID NO: 1292393 - RNA, 18 nt, Human
ucuuuuuuuuuuuuuuuu

SEQ ID NO: 1292394 - RNA, 19 nt, Human
ucuuuuuuuuuuuuuuuug

SEQ ID NO: 1292395 - RNA, 22 nt, Human
ugagauggagucucacucuguu

SEQ ID NO: 1292396 - RNA, 22 nt, Human
ugagccgagauugugccaccgc

SEQ ID NO: 1292397 - RNA, 22 nt, Human
ugcaucauuucuuucuucuucu

SEQ ID NO: 1292398 - RNA, 24 nt, Human
ugccuaggcuggaaugcaauggug

SEQ ID NO: 1292399 - RNA, 23 nt, Human
ugccucagccuccugaguagcua

SEQ ID NO: 1292400 - RNA, 24 nt, Human
ugccucagccuccugaguagcuag

SEQ ID NO: 1292401 - RNA, 24 nt, Human
uggaaugcaaugguguaaucucgg

SEQ ID NO: 1292402 - RNA, 22 nt, Human
uggcaugcuccuguaaucccag

SEQ ID NO: 1292403 - RNA, 24 nt, Human
uggccaacauggcaaaacucuguc

SEQ ID NO: 1292404 - RNA, 25 nt, Human
ugggggaacagggcagaaccaaacu

SEQ ID NO: 1292405 - RNA, 24 nt, Human
uggucaggcugguuuugaacuccu

SEQ ID NO: 1292406 - RNA, 24 nt, Human
uguggcaugcuccuguaaucccag

SEQ ID NO: 1292407 - RNA, 22 nt, Human
uuagcugggucuuguggcaugc

SEQ ID NO: 1292408 - RNA, 18 nt, Human
uuaguagagacgggguuu

SEQ ID NO: 1292409 - RNA, 22 nt, Human
uuaguagagacgggguuucacc

SEQ ID NO: 1292410 - RNA, 24 nt, Human
uuaguagagacgggguuucaccau

SEQ ID NO: 1292411 - RNA, 23 nt, Human
uuccagugauucucuugccucag

SEQ ID NO: 1292412 - RNA, 18 nt, Human
uugcagugagccgagauu

SEQ ID NO: 1292413 - RNA, 19 nt, Human
uugcagugagccgagauug

SEQ ID NO: 1292414 - RNA, 22 nt, Human
uugcagugagccgagauugugc

SEQ ID NO: 1292415 - RNA, 18 nt, Human
uugccuaggcuggaaugc

SEQ ID NO: 1292416 - RNA, 23 nt, Human
uuguggcaugcuccuguaauccc

SEQ ID NO: 1292417 - RNA, 24 nt, Human
uuucaccauguuggucaggcuggu

SEQ ID NO: 1292418 - RNA, 21 nt, Human
uuuugaacuccuggccaacau

SEQ ID NO: 1292419 - RNA, 20 nt, Human
uuuuuauaucuuuaguagag

SEQ ID NO: 1292420 - RNA, 26 nt, Human
uuuuuuuuuuuugagauggagucuca

SEQ ID NO: 1292421 - RNA, 22 nt, Human
uuuuuuuuuuuuuugagaugga

SEQ ID NO: 1292422 - RNA, 26 nt, Human
aaaaaaaaaaaauaauaaccgcagaa

SEQ ID NO: 1292423 - RNA, 19 nt, Human
aaaaagaccaggacaugaa

SEQ ID NO: 1292424 - RNA, 22 nt, Human
aaaaagugcuauuuaaaaaugc

SEQ ID NO: 1292425 - RNA, 24 nt, Human
aaaagaccaggacaugaaagggaa

SEQ ID NO: 1292426 - RNA, 21 nt, Human
aaagacucucgaaucuaagca

SEQ ID NO: 1292427 - RNA, 20 nt, Human
aaaugucccucuggggcucc

SEQ ID NO: 1292428 - RNA, 21 nt, Human
aaauuacaacugacauuuuga

SEQ ID NO: 1292429 - RNA, 18 nt, Human
aagaccuuuuuuuuucuu

SEQ ID NO: 1292430 - RNA, 18 nt, Human
aagccugcagcuaucagg

SEQ ID NO: 1292431 - RNA, 21 nt, Human
aaggcaacuggaaagucaagg

SEQ ID NO: 1292432 - RNA, 24 nt, Human
aaggggaaugacaaucucuguuug

SEQ ID NO: 1292433 - RNA, 21 nt, Human
acaacugaacaaagccaacac

SEQ ID NO: 1292434 - RNA, 21 nt, Human
accgcagaaauuccacaccac

SEQ ID NO: 1292435 - RNA, 19 nt, Human
acuggaaggaccugucagu

SEQ ID NO: 1292436 - RNA, 19 nt, Human
agaccaggacaugaaaggg

SEQ ID NO: 1292437 - RNA, 20 nt, Human
aggaagacuggagccugguu

SEQ ID NO: 1292438 - RNA, 18 nt, Human
agguaagaaaggggcagg

SEQ ID NO: 1292439 - RNA, 21 nt, Human
agugugaaaguaagcaaggga

SEQ ID NO: 1292440 - RNA, 26 nt, Human
aguuuuguguuuuguuucuguuuuua

SEQ ID NO: 1292441 - RNA, 22 nt, Human
auucuacugcauguuggaauga

SEQ ID NO: 1292442 - RNA, 20 nt, Human
cacggugcgggaagcagggc

SEQ ID NO: 1292443 - RNA, 18 nt, Human
caggaaagacccacggug

SEQ ID NO: 1292444 - RNA, 23 nt, Human
caguauacaaacugucacagaau

SEQ ID NO: 1292445 - RNA, 21 nt, Human
ccacaccacuaacaaaaagug

SEQ ID NO: 1292446 - RNA, 23 nt, Human
ccacauugauuuccugcugagga

SEQ ID NO: 1292447 - RNA, 22 nt, Human
ccucauucuacugcauguugga

SEQ ID NO: 1292448 - RNA, 24 nt, Human
ccucuauugcuuacgcccucuuua

SEQ ID NO: 1292449 - RNA, 21 nt, Human
ccuguggccagcaugcucucu

SEQ ID NO: 1292450 - RNA, 21 nt, Human
cucuggggcuccacauugauu

SEQ ID NO: 1292451 - RNA, 24 nt, Human
cugcagugugaaaguaagcaaggg

SEQ ID NO: 1292452 - RNA, 23 nt, Human
gaccaagugcacugugaaaacaa

SEQ ID NO: 1292453 - RNA, 18 nt, Human
gcaaaaaaaaaaaaaaau

SEQ ID NO: 1292454 - RNA, 19 nt, Human
gcgggaagcagggcugcac

SEQ ID NO: 1292455 - RNA, 20 nt, Human
ggaagcagggcugcacuggg

SEQ ID NO: 1292456 - RNA, 19 nt, Human
gggcaggguuacugugaga

SEQ ID NO: 1292457 - RNA, 18 nt, Human
gugcgggaagcagggcug

SEQ ID NO: 1292458 - RNA, 19 nt, Human
guguguguagucuggaagg

SEQ ID NO: 1292459 - RNA, 21 nt, Human
guucacaagcagcuccucuca

SEQ ID NO: 1292460 - RNA, 19 nt, Human
uaaccgcagaaauuccaca

SEQ ID NO: 1292461 - RNA, 21 nt, Human
uaaccgcagaaauuccacacc

SEQ ID NO: 1292462 - RNA, 22 nt, Human
uaaccgcagaaauuccacacca

SEQ ID NO: 1292463 - RNA, 23 nt, Human
uagaaacaacugaacaaagccaa

SEQ ID NO: 1292464 - RNA, 23 nt, Human
uagaaacaacugaacaaagccaa

SEQ ID NO: 1292465 - RNA, 27 nt, Human
ucaucuguugcaaaaaaaaaaaaaaaa

SEQ ID NO: 1292466 - RNA, 24 nt, Human
uccacaccacuaacaaaaagugcu

SEQ ID NO: 1292467 - RNA, 26 nt, Human
ucccucuugccccugucaggggggcc

SEQ ID NO: 1292468 - RNA, 21 nt, Human
ucuacgugaaagcuuuucuua

SEQ ID NO: 1292469 - RNA, 18 nt, Human
ucucuaggcagacugauu

SEQ ID NO: 1292470 - RNA, 19 nt, Human
ucugucuuguccuccuucc

SEQ ID NO: 1292471 - RNA, 19 nt, Human
ugaaaauguacaguuacua

SEQ ID NO: 1292472 - RNA, 21 nt, Human
ugaaagggaaugauuuuuuug

SEQ ID NO: 1292473 - RNA, 20 nt, Human
ugaaaguaagcaagggacaa

SEQ ID NO: 1292474 - RNA, 18 nt, Human
ugacauggccaagacagu

SEQ ID NO: 1292475 - RNA, 19 nt, Human
ugacauggccaagacaguc

SEQ ID NO: 1292476 - RNA, 21 nt, Human
ugagauaaaaugucccucugg

SEQ ID NO: 1292477 - RNA, 23 nt, Human
ugagauaaaaugucccucugggg

SEQ ID NO: 1292478 - RNA, 30 nt, Human
ugcaaaaaaaaaaaaaaauaauaaccgcaa

SEQ ID NO: 1292479 - RNA, 21 nt, Human
ugcacugugaaaacaaaaccc

SEQ ID NO: 1292480 - RNA, 19 nt, Human
ugggacuguggagggagac

SEQ ID NO: 1292481 - RNA, 22 nt, Human
ugguuucuaaaguugagcuucu

SEQ ID NO: 1292482 - RNA, 26 nt, Human
uguccuauccugaggcugcaaucuca

SEQ ID NO: 1292483 - RNA, 24 nt, Human
ugucuuguccuccuucccccuuuc

SEQ ID NO: 1292484 - RNA, 23 nt, Human
ugugaaaguaagcaagggacaaa

SEQ ID NO: 1292485 - RNA, 19 nt, Human
uguguuuuguuucuguuuu

SEQ ID NO: 1292486 - RNA, 21 nt, Human
uguugcaaaaaaaaaaaaaaa

SEQ ID NO: 1292487 - RNA, 18 nt, Human
uguuggaaugaacucugg

SEQ ID NO: 1292488 - RNA, 18 nt, Human
uguuuuguuucuguuuuu

SEQ ID NO: 1292489 - RNA, 19 nt, Human
uuuagagucccucuugccc

SEQ ID NO: 1292490 - RNA, 19 nt, Human
uuugaaguuuccacuugua

SEQ ID NO: 1292491 - RNA, 21 nt, Human
uuugcagacuuugacgucuac

SEQ ID NO: 1292492 - RNA, 21 nt, Human
uuuuaugaucgcuuauguaau

SEQ ID NO: 1292493 - RNA, 21 nt, Human
aaacagacacuuccagacaca

SEQ ID NO: 1292494 - RNA, 20 nt, Human
cacccaugaggacuguuuca

SEQ ID NO: 1292495 - RNA, 18 nt, Human
cacucuucuuccuucugg

SEQ ID NO: 1292496 - RNA, 19 nt, Human
cagaaaguuccuaaagcug

SEQ ID NO: 1292497 - RNA, 20 nt, Human
cagaaaguuccuaaagcuga

SEQ ID NO: 1292498 - RNA, 20 nt, Human
cucuucuuccuucuggcuuu

SEQ ID NO: 1292499 - RNA, 24 nt, Human
gcugcuggcccauuggagcaaggg

SEQ ID NO: 1292500 - RNA, 23 nt, Human
guguucccucuucccuccccgcu

SEQ ID NO: 1292501 - RNA, 18 nt, Human
uauuucuucucugcuacu

SEQ ID NO: 1292502 - RNA, 21 nt, Human
ucaguccccuuuuccaguguc

SEQ ID NO: 1292503 - RNA, 18 nt, Human
uccagugauguggagcug

SEQ ID NO: 1292504 - RNA, 21 nt, Human
uccagugucuccuuccacccc

SEQ ID NO: 1292505 - RNA, 22 nt, Human
uccccugugaguggaauuccag

SEQ ID NO: 1292506 - RNA, 21 nt, Human
uggaauuccagaaacagacac

SEQ ID NO: 1292507 - RNA, 25 nt, Human
uuccuucuggcuuucgguuuggauu

SEQ ID NO: 1292508 - RNA, 20 nt, Human
uuggauuggcgcauggaggc

SEQ ID NO: 1292509 - RNA, 24 nt, Human
aggagcguccgcagagcccagagc

SEQ ID NO: 1292510 - RNA, 24 nt, Human
ccagaggucuccugacaugcugua

SEQ ID NO: 1292511 - RNA, 24 nt, Human
gaaggagcguccgcagagcccaga

SEQ ID NO: 1292512 - RNA, 20 nt, Human
ggaaggagcguccgcagagc

SEQ ID NO: 1292513 - RNA, 18 nt, Human
uccgcagagcccagagcc

SEQ ID NO: 1292514 - RNA, 23 nt, Human
uuccagaggucuccugacaugcu

SEQ ID NO: 1292515 - RNA, 18 nt, Human
ucaagacacccugcuuua

SEQ ID NO: 1292516 - RNA, 18 nt, Human
ugacuucaagacacccug

SEQ ID NO: 1292517 - RNA, 20 nt, Human
aaaagguccagagacgaaaa

SEQ ID NO: 1292518 - RNA, 18 nt, Human
ccucccaggcgccaggau

SEQ ID NO: 1292519 - RNA, 23 nt, Human
ccucuugccccgaccucccaggc

SEQ ID NO: 1292520 - RNA, 20 nt, Human
cggaauuucuggguucacac

SEQ ID NO: 1292521 - RNA, 19 nt, Human
cuggguucacacuuuuugc

SEQ ID NO: 1292522 - RNA, 18 nt, Human
cuucacgucuuccugccu

SEQ ID NO: 1292523 - RNA, 19 nt, Human
cuugccccgaccucccagg

SEQ ID NO: 1292524 - RNA, 20 nt, Human
cuuggaagcccccuuccugc

SEQ ID NO: 1292525 - RNA, 19 nt, Human
gaagcuccuucuguuucuu

SEQ ID NO: 1292526 - RNA, 18 nt, Human
uaaguugagcaggcugau

SEQ ID NO: 1292527 - RNA, 23 nt, Human
uauaaaacuaagcuaugcccaga

SEQ ID NO: 1292528 - RNA, 21 nt, Human
ucacgcgcgcguccucaaccu

SEQ ID NO: 1292529 - RNA, 18 nt, Human
uccagagacgaaaacuaa

SEQ ID NO: 1292530 - RNA, 24 nt, Human
uccauaaaauguauaaaacuaagc

SEQ ID NO: 1292531 - RNA, 23 nt, Human
ucccaggcgccaggauuacaggc

SEQ ID NO: 1292532 - RNA, 26 nt, Human
uccugaggcugucacgcgcgcguccu

SEQ ID NO: 1292533 - RNA, 18 nt, Human
ugaggcugucacgcgcgc

SEQ ID NO: 1292534 - RNA, 22 nt, Human
ugccccgaccucccaggcgcca

SEQ ID NO: 1292535 - RNA, 23 nt, Human
ugccccgaccucccaggcgccag

SEQ ID NO: 1292536 - RNA, 24 nt, Human
ugccccgccuuuccaaacagaacu

SEQ ID NO: 1292537 - RNA, 22 nt, Human
ugggcacaugucgugaggacuu

SEQ ID NO: 1292538 - RNA, 19 nt, Human
ugucgugaggacuuccuga

SEQ ID NO: 1292539 - RNA, 22 nt, Human
uuuuugcucucaacauugggaa

SEQ ID NO: 1292540 - RNA, 23 nt, Human
aaaaagcaugaaaauaaagagaa

SEQ ID NO: 1292541 - RNA, 24 nt, Human
aaagagaaaaaaggagaggcacag

SEQ ID NO: 1292542 - RNA, 19 nt, Human
aaagugcugggauuacagg

SEQ ID NO: 1292543 - RNA, 24 nt, Human
aaagugcugggauuacaggcacga

SEQ ID NO: 1292544 - RNA, 21 nt, Human
aagaauaaguagggugggugg

SEQ ID NO: 1292545 - RNA, 18 nt, Human
aagugcugggauuacagg

SEQ ID NO: 1292546 - RNA, 19 nt, Human
aagugcugggauuacaggc

SEQ ID NO: 1292547 - RNA, 26 nt, Human
aagugcugggauuacaggcacgagcc

SEQ ID NO: 1292548 - RNA, 24 nt, Human
accauauugggcgggcuggucucg

SEQ ID NO: 1292549 - RNA, 25 nt, Human
acccgccucagccucccaaagugcu

SEQ ID NO: 1292550 - RNA, 18 nt, Human
acgggguuucaccauauu

SEQ ID NO: 1292551 - RNA, 20 nt, Human
acgggguuucaccauauugg

SEQ ID NO: 1292552 - RNA, 25 nt, Human
acucugucgcccaggcuggagugca

SEQ ID NO: 1292553 - RNA, 25 nt, Human
aggcuggagugcaguggugcgaucu

SEQ ID NO: 1292554 - RNA, 19 nt, Human
aguagcugggauuacaggc

SEQ ID NO: 1292555 - RNA, 21 nt, Human
aguagcugggauuacaggcau

SEQ ID NO: 1292556 - RNA, 24 nt, Human
agugauucuccugccucagccucu

SEQ ID NO: 1292557 - RNA, 21 nt, Human
agugcaguggugcgaucucag

SEQ ID NO: 1292558 - RNA, 23 nt, Human
agugcaguggugcgaucucagcu

SEQ ID NO: 1292559 - RNA, 24 nt, Human
agugcaguggugcgaucucagcuc

SEQ ID NO: 1292560 - RNA, 18 nt, Human
agugcugggauuacaggc

SEQ ID NO: 1292561 - RNA, 24 nt, Human
aguggugcgaucucagcucacugc

SEQ ID NO: 1292562 - RNA, 18 nt, Human
agugucuaaccaggaagg

SEQ ID NO: 1292563 - RNA, 24 nt, Human
augauccacccgccucagccuccc

SEQ ID NO: 1292564 - RNA, 21 nt, Human
caaaggcacagaguacaacug

SEQ ID NO: 1292565 - RNA, 23 nt, Human
caaagugcugggauuacaggcac

SEQ ID NO: 1292566 - RNA, 24 nt, Human
caaagugcugggauuacaggcacg

SEQ ID NO: 1292567 - RNA, 25 nt, Human
caaauggugccuugcaccugacuca

SEQ ID NO: 1292568 - RNA, 20 nt, Human
caagugauucuccugccuca

SEQ ID NO: 1292569 - RNA, 22 nt, Human
caagugauucuccugccucagc

SEQ ID NO: 1292570 - RNA, 24 nt, Human
caccauauugggcgggcuggucuc

SEQ ID NO: 1292571 - RNA, 23 nt, Human
caccaugccuggcuaauuuuugu

SEQ ID NO: 1292572 - RNA, 23 nt, Human
cacccgccucagccucccaaagu

SEQ ID NO: 1292573 - RNA, 22 nt, Human
cacucugucgcccaggcuggag

SEQ ID NO: 1292574 - RNA, 22 nt, Human
cacugcaaccucugccucaggg

SEQ ID NO: 1292575 - RNA, 24 nt, Human
caggagagacgggguuucaccaua

SEQ ID NO: 1292576 - RNA, 19 nt, Human
cagggcccguuuuugaauu

SEQ ID NO: 1292577 - RNA, 24 nt, Human
caugauccacccgccucagccucc

SEQ ID NO: 1292578 - RNA, 20 nt, Human
caugccccuccucucuagga

SEQ ID NO: 1292579 - RNA, 22 nt, Human
cauggacagggcccguuuuuga

SEQ ID NO: 1292580 - RNA, 19 nt, Human
cauguuggggaaacagguu

SEQ ID NO: 1292581 - RNA, 19 nt, Human
ccaaagugcugggauuaca

SEQ ID NO: 1292582 - RNA, 23 nt, Human
ccaaagugcugggauuacaggca

SEQ ID NO: 1292583 - RNA, 26 nt, Human
ccacccgccucagccucccaaagugc

SEQ ID NO: 1292584 - RNA, 19 nt, Human
ccaccgcgccuggccccgc

SEQ ID NO: 1292585 - RNA, 19 nt, Human
ccaccgcgccuggccccgc

SEQ ID NO: 1292586 - RNA, 20 nt, Human
ccaccgcgccuggccccgcu

SEQ ID NO: 1292587 - RNA, 23 nt, Human
ccagcauguccuuuaaaucugga

SEQ ID NO: 1292588 - RNA, 21 nt, Human
ccaggaaggacagcgaggaca

SEQ ID NO: 1292589 - RNA, 24 nt, Human
cccaaagugcugggauuacaggca

SEQ ID NO: 1292590 - RNA, 24 nt, Human
ccgccucagccucccaaagugcug

SEQ ID NO: 1292591 - RNA, 20 nt, Human
ccugaccucaugauccaccc

SEQ ID NO: 1292592 - RNA, 19 nt, Human
cgaggacacugauaaaaag

SEQ ID NO: 1292593 - RNA, 24 nt, Human
cgcccaggcuggagugcaguggug

SEQ ID NO: 1292594 - RNA, 24 nt, Human
cgccucagccucccaaagugcugg

SEQ ID NO: 1292595 - RNA, 20 nt, Human
cgcgccuggccccgcuuuca

SEQ ID NO: 1292596 - RNA, 20 nt, Human
cgggguuucaccauauuggg

SEQ ID NO: 1292597 - RNA, 18 nt, Human
cggucuggaacauggcug

SEQ ID NO: 1292598 - RNA, 22 nt, Human
cuaguagcugggauuacaggca

SEQ ID NO: 1292599 - RNA, 24 nt, Human
cucacucugucgcccaggcuggag

SEQ ID NO: 1292600 - RNA, 23 nt, Human
cucacugcaaccucugccucagg

SEQ ID NO: 1292601 - RNA, 24 nt, Human
cucagccucucuaguagcugggau

SEQ ID NO: 1292602 - RNA, 24 nt, Human
cuccugaccucaugauccacccgc

SEQ ID NO: 1292603 - RNA, 23 nt, Human
cucuaguagcugggauuacaggc

SEQ ID NO: 1292604 - RNA, 24 nt, Human
cucuaguagcugggauuacaggca

SEQ ID NO: 1292605 - RNA, 23 nt, Human
cugcaaccucugccucagggauu

SEQ ID NO: 1292606 - RNA, 23 nt, Human
cugccucagccucucuaguagcu

SEQ ID NO: 1292607 - RNA, 19 nt, Human
cugccucagggauucaagu

SEQ ID NO: 1292608 - RNA, 23 nt, Human
cugcugggcacccagcauguccu

SEQ ID NO: 1292609 - RNA, 22 nt, Human
gaccucaugauccacccgccuc

SEQ ID NO: 1292610 - RNA, 25 nt, Human
gagacgggguuucaccauauugggc

SEQ ID NO: 1292611 - RNA, 18 nt, Human
gauuacaggcacgagcca

SEQ ID NO: 1292612 - RNA, 18 nt, Human
gauuacaggcaugcgcca

SEQ ID NO: 1292613 - RNA, 24 nt, Human
gauuacaggcaugcgccaccaugc

SEQ ID NO: 1292614 - RNA, 19 nt, Human
gcccaggcuggagugcagu

SEQ ID NO: 1292615 - RNA, 20 nt, Human
gcccaggcuggagugcagug

SEQ ID NO: 1292616 - RNA, 23 nt, Human
gcccaggcuggagugcaguggug

SEQ ID NO: 1292617 - RNA, 23 nt, Human
gcuggucucgaacuccugaccuc

SEQ ID NO: 1292618 - RNA, 22 nt, Human
ggaagugcguuuuccaugcccc

SEQ ID NO: 1292619 - RNA, 22 nt, Human
ggauuacaggcacgagccaccg

SEQ ID NO: 1292620 - RNA, 24 nt, Human
ggauuacaggcaugcgccaccaug

SEQ ID NO: 1292621 - RNA, 23 nt, Human
ggauucaagugauucuccugccu

SEQ ID NO: 1292622 - RNA, 24 nt, Human
ggcuggucucgaacuccugaccuc

SEQ ID NO: 1292623 - RNA, 23 nt, Human
gggauucaagugauucuccugcc

SEQ ID NO: 1292624 - RNA, 23 nt, Human
gggcgggcuggucucgaacuccu

SEQ ID NO: 1292625 - RNA, 18 nt, Human
gggguuucaccauauugg

SEQ ID NO: 1292626 - RNA, 19 nt, Human
ggucucgaacuccugaccu

SEQ ID NO: 1292627 - RNA, 20 nt, Human
guagcugggauuacaggcau

SEQ ID NO: 1292628 - RNA, 21 nt, Human
gugaagacaaacugaagaaua

SEQ ID NO: 1292629 - RNA, 24 nt, Human
gugauucuccugccucagccucuc

SEQ ID NO: 1292630 - RNA, 21 nt, Human
uaauucacagcaauuuuccuu

SEQ ID NO: 1292631 - RNA, 22 nt, Human
uacaggcacgagccaccgcgcc

SEQ ID NO: 1292632 - RNA, 22 nt, Human
uacaggcaugcgccaccaugcc

SEQ ID NO: 1292633 - RNA, 27 nt, Human
uaguagcugggauuacaggcaugcgcc

SEQ ID NO: 1292634 - RNA, 22 nt, Human
uauacuuuggaguauagaauug

SEQ ID NO: 1292635 - RNA, 19 nt, Human
ucaagugauucuccugccu

SEQ ID NO: 1292636 - RNA, 24 nt, Human
ucacucugucgcccaggcuggagu

SEQ ID NO: 1292637 - RNA, 22 nt, Human
ucacugcaaccucugccucagg

SEQ ID NO: 1292638 - RNA, 23 nt, Human
ucacugcaaccucugccucaggg

SEQ ID NO: 1292639 - RNA, 24 nt, Human
ucaggagagacgggguuucaccau

SEQ ID NO: 1292640 - RNA, 18 nt, Human
uccaagaugcauuuggcu

SEQ ID NO: 1292641 - RNA, 21 nt, Human
uccacccgccucagccuccca

SEQ ID NO: 1292642 - RNA, 25 nt, Human
uccaugaucauaaaaaauaacuaga

SEQ ID NO: 1292643 - RNA, 24 nt, Human
ucccaaagugcugggauuacaggc

SEQ ID NO: 1292644 - RNA, 22 nt, Human
ucgcccaggcuggagugcagug

SEQ ID NO: 1292645 - RNA, 24 nt, Human
ucuaguagcugggauuacaggcau

SEQ ID NO: 1292646 - RNA, 23 nt, Human
ucucacucugucgcccaggcugg

SEQ ID NO: 1292647 - RNA, 24 nt, Human
ucucacucugucgcccaggcugga

SEQ ID NO: 1292648 - RNA, 26 nt, Human
ucucacucugucgcccaggcuggagu

SEQ ID NO: 1292649 - RNA, 27 nt, Human
ucucacucugucgcccaggcuggagug

SEQ ID NO: 1292650 - RNA, 25 nt, Human
ucuccugccucagccucucuaguag

SEQ ID NO: 1292651 - RNA, 19 nt, Human
ucucgaacuccugaccuca

SEQ ID NO: 1292652 - RNA, 24 nt, Human
ucucuaguagcugggauuacaggc

SEQ ID NO: 1292653 - RNA, 24 nt, Human
ucugucgcccaggcuggagugcag

SEQ ID NO: 1292654 - RNA, 23 nt, Human
ugaccucaugauccacccgccuc

SEQ ID NO: 1292655 - RNA, 18 nt, Human
ugagacaaagucucacuc

SEQ ID NO: 1292656 - RNA, 22 nt, Human
ugagacaaagucucacucuguc

SEQ ID NO: 1292657 - RNA, 21 nt, Human
ugagauaggucucuggaaguu

SEQ ID NO: 1292658 - RNA, 20 nt, Human
ugauucuccugccucagccu

SEQ ID NO: 1292659 - RNA, 24 nt, Human
ugccucagccucucuaguagcugg

SEQ ID NO: 1292660 - RNA, 22 nt, Human
ugccucagggauucaagugauu

SEQ ID NO: 1292661 - RNA, 20 nt, Human
ugccuugcaccugacucaaa

SEQ ID NO: 1292662 - RNA, 24 nt, Human
ugcguuuuccaugccccuccucuc

SEQ ID NO: 1292663 - RNA, 22 nt, Human
ugcugccugcuuugaggucacu

SEQ ID NO: 1292664 - RNA, 19 nt, Human
ugcugggauuacaggcacg

SEQ ID NO: 1292665 - RNA, 24 nt, Human
ugcugggauuacaggcacgagcca

SEQ ID NO: 1292666 - RNA, 19 nt, Human
uggaacauggcuggcgucc

SEQ ID NO: 1292667 - RNA, 23 nt, Human
uggagugcaguggugcgaucuca

SEQ ID NO: 1292668 - RNA, 24 nt, Human
uggagugcaguggugcgaucucag

SEQ ID NO: 1292669 - RNA, 21 nt, Human
ugggauuacaggcacgagcca

SEQ ID NO: 1292670 - RNA, 22 nt, Human
ugggauuacaggcacgagccac

SEQ ID NO: 1292671 - RNA, 23 nt, Human
ugggauuacaggcacgagccacc

SEQ ID NO: 1292672 - RNA, 24 nt, Human
ugggauuacaggcacgagccaccg

SEQ ID NO: 1292673 - RNA, 24 nt, Human
ugggauuacaggcacgagccaccg

SEQ ID NO: 1292674 - RNA, 18 nt, Human
ugggauuacaggcaugcg

SEQ ID NO: 1292675 - RNA, 21 nt, Human
ugggauuacaggcaugcgcca

SEQ ID NO: 1292676 - RNA, 22 nt, Human
ugggauuacaggcaugcgccac

SEQ ID NO: 1292677 - RNA, 24 nt, Human
ugggauuacaggcaugcgccacca

SEQ ID NO: 1292678 - RNA, 24 nt, Human
ugggcgggcuggucucgaacuccu

SEQ ID NO: 1292679 - RNA, 24 nt, Human
uggugcgaucucagcucacugcaa

SEQ ID NO: 1292680 - RNA, 18 nt, Human
uguuuuuuuuuuucagga

SEQ ID NO: 1292681 - RNA, 22 nt, Human
uuacauuuccuuuuauguuucu

SEQ ID NO: 1292682 - RNA, 22 nt, Human
uuaggagacuucugacguacgg

SEQ ID NO: 1292683 - RNA, 21 nt, Human
uucaagugauucuccugccuc

SEQ ID NO: 1292684 - RNA, 23 nt, Human
uucaagugauucuccugccucag

SEQ ID NO: 1292685 - RNA, 24 nt, Human
uucaagugauucuccugccucagc

SEQ ID NO: 1292686 - RNA, 20 nt, Human
uucucaguucuggccucauc

SEQ ID NO: 1292687 - RNA, 22 nt, Human
uuucuuuggacacaugauccuu

SEQ ID NO: 1292688 - RNA, 22 nt, Human
uuugaggucacuugaaacagca

SEQ ID NO: 1292689 - RNA, 18 nt, Human
uuuguuuguuuuuugguc

SEQ ID NO: 1292690 - RNA, 31 nt, Human
uuuuuuuuuuucaggagagacgggguuucaa

SEQ ID NO: 1292691 - RNA, 24 nt, Human
agauggccagcaaguguguuccgc

SEQ ID NO: 1292692 - RNA, 23 nt, Human
agguucuggagauuguuggaacc

SEQ ID NO: 1292693 - RNA, 20 nt, Human
cacuugucgccugcccuuag

SEQ ID NO: 1292694 - RNA, 27 nt, Human
cagaucccugagguagagccuggccaa

SEQ ID NO: 1292695 - RNA, 19 nt, Human
cagcaaguguguuccgccc

SEQ ID NO: 1292696 - RNA, 24 nt, Human
cccucagcucugacugugaacacu

SEQ ID NO: 1292697 - RNA, 26 nt, Human
ccgcccuguucuagagcagaggcugg

SEQ ID NO: 1292698 - RNA, 23 nt, Human
cugacggccaaagcugugccagc

SEQ ID NO: 1292699 - RNA, 23 nt, Human
cugcugaaugugucccugucucu

SEQ ID NO: 1292700 - RNA, 19 nt, Human
ggacaugguucuguuagag

SEQ ID NO: 1292701 - RNA, 19 nt, Human
guagauuaugcugcucuca

SEQ ID NO: 1292702 - RNA, 21 nt, Human
gucgccugcccuuagugauag

SEQ ID NO: 1292703 - RNA, 20 nt, Human
ucccugagguagagccuggc

SEQ ID NO: 1292704 - RNA, 21 nt, Human
ucucuguagauuaugcugcuc

SEQ ID NO: 1292705 - RNA, 18 nt, Human
ugaaguccuggacauggu

SEQ ID NO: 1292706 - RNA, 19 nt, Human
ugacugugaacacugagcc

SEQ ID NO: 1292707 - RNA, 21 nt, Human
ugacugugaacacugagccuc

SEQ ID NO: 1292708 - RNA, 18 nt, Human
ugauagugcugauaggag

SEQ ID NO: 1292709 - RNA, 21 nt, Human
ugcccagaaggcucuccugac

SEQ ID NO: 1292710 - RNA, 22 nt, Human
ugcucucagaucccugagguag

SEQ ID NO: 1292711 - RNA, 18 nt, Human
uggaacagcccauuucuc

SEQ ID NO: 1292712 - RNA, 23 nt, Human
ugucucucuguagauuaugcugc

SEQ ID NO: 1292713 - RNA, 24 nt, Human
uuagugauagugcugauaggaggu

SEQ ID NO: 1292714 - RNA, 18 nt, Human
uucaagaaugucuguuga

SEQ ID NO: 1292715 - RNA, 19 nt, Human
acagacagaagagugcucu

SEQ ID NO: 1292716 - RNA, 23 nt, Human
accaagagacaaccccuaacccc

SEQ ID NO: 1292717 - RNA, 21 nt, Human
agacaggccacaggggucccc

SEQ ID NO: 1292718 - RNA, 20 nt, Human
agagacaaccccuaaccccc

SEQ ID NO: 1292719 - RNA, 21 nt, Human
agagacaaccccuaaccccca

SEQ ID NO: 1292720 - RNA, 21 nt, Human
agagcagcugagacaucuaca

SEQ ID NO: 1292721 - RNA, 19 nt, Human
agcuagggauggugcaagc

SEQ ID NO: 1292722 - RNA, 21 nt, Human
aggcuuccagucuugggcucu

SEQ ID NO: 1292723 - RNA, 19 nt, Human
agugcucugcgucaggaac

SEQ ID NO: 1292724 - RNA, 23 nt, Human
agugggccacccacgcucugaga

SEQ ID NO: 1292725 - RNA, 24 nt, Human
agugggugagugcucugcgucagg

SEQ ID NO: 1292726 - RNA, 18 nt, Human
cagugcccacugccgcuc

SEQ ID NO: 1292727 - RNA, 18 nt, Human
caugcccagccccacacc

SEQ ID NO: 1292728 - RNA, 26 nt, Human
ccacaacacugggugccuguaccccu

SEQ ID NO: 1292729 - RNA, 20 nt, Human
ccccacaccugaaaugggac

SEQ ID NO: 1292730 - RNA, 19 nt, Human
ccccagggaggguuggggg

SEQ ID NO: 1292731 - RNA, 18 nt, Human
cgcugggagggagggcuc

SEQ ID NO: 1292732 - RNA, 19 nt, Human
cuaaaaccaggccuccccu

SEQ ID NO: 1292733 - RNA, 19 nt, Human
cugaaggcuuccagucuug

SEQ ID NO: 1292734 - RNA, 18 nt, Human
gacaguauagcuugcugc

SEQ ID NO: 1292735 - RNA, 19 nt, Human
gagacaaccccuaaccccc

SEQ ID NO: 1292736 - RNA, 21 nt, Human
gagacaaccccuaacccccaa

SEQ ID NO: 1292737 - RNA, 24 nt, Human
gccaggccacaacacugggugccu

SEQ ID NO: 1292738 - RNA, 25 nt, Human
gggcucugugguuccucaaagaggu

SEQ ID NO: 1292739 - RNA, 18 nt, Human
gggcucugugguuccucc

SEQ ID NO: 1292740 - RNA, 22 nt, Human
gggguccccagggaggguuggg

SEQ ID NO: 1292741 - RNA, 19 nt, Human
gguugggggccagaagauu

SEQ ID NO: 1292742 - RNA, 21 nt, Human
uaaaaccaggccuccccuccc

SEQ ID NO: 1292743 - RNA, 28 nt, Human
uccagcaggagugaccaugcccagcccu

SEQ ID NO: 1292744 - RNA, 22 nt, Human
ucccuuguagagcagcugagac

SEQ ID NO: 1292745 - RNA, 22 nt, Human
ucuacagacagaagagugcucu

SEQ ID NO: 1292746 - RNA, 24 nt, Human
ucuagcaacgugaugcuuacaggg

SEQ ID NO: 1292747 - RNA, 23 nt, Human
ucuggcaugagauuuucuucuag

SEQ ID NO: 1292748 - RNA, 24 nt, Human
ucuggugagacaggccacaggggu

SEQ ID NO: 1292749 - RNA, 24 nt, Human
ugaaaugggacucccuuguagagc

SEQ ID NO: 1292750 - RNA, 22 nt, Human
ugagacaggccacagggguccc

SEQ ID NO: 1292751 - RNA, 21 nt, Human
ugagaggccgguggugccagg

SEQ ID NO: 1292752 - RNA, 20 nt, Human
ugagauuuucuucuagcaac

SEQ ID NO: 1292753 - RNA, 22 nt, Human
ugcaagcucuggcaugagauuu

SEQ ID NO: 1292754 - RNA, 28 nt, Human
ugcccagccccacaccugaaaugggacu

SEQ ID NO: 1292755 - RNA, 21 nt, Human
ugggagggagggcucuggaca

SEQ ID NO: 1292756 - RNA, 24 nt, Human
ugggugccuguaccccuggcucug

SEQ ID NO: 1292757 - RNA, 18 nt, Human
uuuauuacuagcaaaacc

SEQ ID NO: 1292758 - RNA, 22 nt, Human
aaacacaggucaugaagcauac

SEQ ID NO: 1292759 - RNA, 19 nt, Human
acagacagaagagugcucu

SEQ ID NO: 1292760 - RNA, 23 nt, Human
accaagagacaaccccuaacccc

SEQ ID NO: 1292761 - RNA, 21 nt, Human
agacaggccacaggggucccc

SEQ ID NO: 1292762 - RNA, 20 nt, Human
agagacaaccccuaaccccc

SEQ ID NO: 1292763 - RNA, 21 nt, Human
agagcagcugagacaucuaca

SEQ ID NO: 1292764 - RNA, 20 nt, Human
agauacaggugcccucugag

SEQ ID NO: 1292765 - RNA, 19 nt, Human
agcuagggauggugcaagc

SEQ ID NO: 1292766 - RNA, 24 nt, Human
aggaagucugugcacaggcagauc

SEQ ID NO: 1292767 - RNA, 23 nt, Human
aggcuggggagaggaaguagcug

SEQ ID NO: 1292768 - RNA, 24 nt, Human
aggcuggggagaggaaguagcugc

SEQ ID NO: 1292769 - RNA, 21 nt, Human
aggcuuccagucuugggcucu

SEQ ID NO: 1292770 - RNA, 19 nt, Human
agugcucugcgucaggaac

SEQ ID NO: 1292771 - RNA, 23 nt, Human
agugggccacccacgcucugaga

SEQ ID NO: 1292772 - RNA, 24 nt, Human
agugggugagugcucugcgucagg

SEQ ID NO: 1292773 - RNA, 23 nt, Human
auggagcuccaagaugguggcaa

SEQ ID NO: 1292774 - RNA, 22 nt, Human
cacaggcagaucugcuggugcc

SEQ ID NO: 1292775 - RNA, 19 nt, Human
cacaggucaugaagcauac

SEQ ID NO: 1292776 - RNA, 21 nt, Human
cacaggucaugaagcauaccc

SEQ ID NO: 1292777 - RNA, 26 nt, Human
caccaagagacaaccccuaaccccca

SEQ ID NO: 1292778 - RNA, 18 nt, Human
cagaagagugcucuggug

SEQ ID NO: 1292779 - RNA, 20 nt, Human
caugaagcauacccagcccc

SEQ ID NO: 1292780 - RNA, 18 nt, Human
caugcccagccccacacc

SEQ ID NO: 1292781 - RNA, 22 nt, Human
cauuacacuaugagggcaugga

SEQ ID NO: 1292782 - RNA, 26 nt, Human
ccacaacacugggugccuguaccccu

SEQ ID NO: 1292783 - RNA, 18 nt, Human
ccagaccagcuggcuggg

SEQ ID NO: 1292784 - RNA, 18 nt, Human
cccacaccugaaauggga

SEQ ID NO: 1292785 - RNA, 19 nt, Human
ccccagggaggguuggggg

SEQ ID NO: 1292786 - RNA, 24 nt, Human
ccccugaaggcacguccagggccc

SEQ ID NO: 1292787 - RNA, 21 nt, Human
cccgcagaagcaucuccccuc

SEQ ID NO: 1292788 - RNA, 24 nt, Human
cgcaggcccgcagaagcaucuccc

SEQ ID NO: 1292789 - RNA, 19 nt, Human
cuaaaaccaggccuccccu

SEQ ID NO: 1292790 - RNA, 22 nt, Human
cucugagcugccuccuggcccc

SEQ ID NO: 1292791 - RNA, 19 nt, Human
cugaaggcuuccagucuug

SEQ ID NO: 1292792 - RNA, 23 nt, Human
cugcauaacacauaugauacccu

SEQ ID NO: 1292793 - RNA, 24 nt, Human
cuggccccacaugggcagccuggc

SEQ ID NO: 1292794 - RNA, 24 nt, Human
gaagcauacccagccccugaaggc

SEQ ID NO: 1292795 - RNA, 19 nt, Human
gagacaaccccuaaccccc

SEQ ID NO: 1292796 - RNA, 21 nt, Human
gagacaaccccuaacccccaa

SEQ ID NO: 1292797 - RNA, 20 nt, Human
gagcuccaagaugguggcaa

SEQ ID NO: 1292798 - RNA, 24 nt, Human
gccaggccacaacacugggugccu

SEQ ID NO: 1292799 - RNA, 20 nt, Human
gcccaaggguuggagcccag

SEQ ID NO: 1292800 - RNA, 25 nt, Human
gggcucugugguuccucaaagaggu

SEQ ID NO: 1292801 - RNA, 22 nt, Human
gggguccccagggaggguuggg

SEQ ID NO: 1292802 - RNA, 22 nt, Human
ggguaaggcuggggagaggaag

SEQ ID NO: 1292803 - RNA, 19 nt, Human
gguugggggccagaagauu

SEQ ID NO: 1292804 - RNA, 18 nt, Human
guggccuuggccuugagg

SEQ ID NO: 1292805 - RNA, 21 nt, Human
uaaaaccaggccuccccuccc

SEQ ID NO: 1292806 - RNA, 19 nt, Human
uacccagccccugaaggca

SEQ ID NO: 1292807 - RNA, 28 nt, Human
uccagcaggagugaccaugcccagcccu

SEQ ID NO: 1292808 - RNA, 21 nt, Human
ucccagccagagucucaggac

SEQ ID NO: 1292809 - RNA, 22 nt, Human
ucccuuguagagcagcugagac

SEQ ID NO: 1292810 - RNA, 22 nt, Human
ucuacagacagaagagugcucu

SEQ ID NO: 1292811 - RNA, 24 nt, Human
ucuagcaacgugaugcuuacaggg

SEQ ID NO: 1292812 - RNA, 18 nt, Human
ucugagcacacuucucuc

SEQ ID NO: 1292813 - RNA, 23 nt, Human
ucuggcaugagauuuucuucuag

SEQ ID NO: 1292814 - RNA, 24 nt, Human
ucuggugagacaggccacaggggu

SEQ ID NO: 1292815 - RNA, 24 nt, Human
ugaaaugggacucccuuguagagc

SEQ ID NO: 1292816 - RNA, 22 nt, Human
ugagacaggccacagggguccc

SEQ ID NO: 1292817 - RNA, 21 nt, Human
ugagaggccgguggugccagg

SEQ ID NO: 1292818 - RNA, 20 nt, Human
ugagauuuucuucuagcaac

SEQ ID NO: 1292819 - RNA, 22 nt, Human
ugagcugccuccuggccccaca

SEQ ID NO: 1292820 - RNA, 18 nt, Human
ugauacccuggaagcacu

SEQ ID NO: 1292821 - RNA, 22 nt, Human
ugcaagcucuggcaugagauuu

SEQ ID NO: 1292822 - RNA, 28 nt, Human
ugcccagccccacaccugaaaugggacu

SEQ ID NO: 1292823 - RNA, 24 nt, Human
ugggugccuguaccccuggcucug

SEQ ID NO: 1292824 - RNA, 23 nt, Human
uuacauccagauacaggugcccu

SEQ ID NO: 1292825 - RNA, 22 nt, Human
acugaacaugagaaagaauccc

SEQ ID NO: 1292826 - RNA, 19 nt, Human
aggaaugggaaguccagga

SEQ ID NO: 1292827 - RNA, 22 nt, Human
cacggugccugcccaaaucccc

SEQ ID NO: 1292828 - RNA, 23 nt, Human
cacuguacugaacaugagaaaga

SEQ ID NO: 1292829 - RNA, 22 nt, Human
ccaaaaauccacuggcacagca

SEQ ID NO: 1292830 - RNA, 18 nt, Human
ccacggugccugcccaaa

SEQ ID NO: 1292831 - RNA, 22 nt, Human
ccugcccaaauccccuggccgc

SEQ ID NO: 1292832 - RNA, 23 nt, Human
cucguccccuucucggggaucca

SEQ ID NO: 1292833 - RNA, 21 nt, Human
guccccuucucggggauccac

SEQ ID NO: 1292834 - RNA, 27 nt, Human
uaccauggaaucuguagaaguacagga

SEQ ID NO: 1292835 - RNA, 21 nt, Human
uccccuggccgccgcccgacc

SEQ ID NO: 1292836 - RNA, 24 nt, Human
uccccuggccgccgcccgaccccc

SEQ ID NO: 1292837 - RNA, 22 nt, Human
ugagaaagaaucccaaaaaucc

SEQ ID NO: 1292838 - RNA, 27 nt, Human
ugagaaagaaucccaaaaauccacuuu

SEQ ID NO: 1292839 - RNA, 20 nt, Human
ugcccuggggccagaagguu

SEQ ID NO: 1292840 - RNA, 24 nt, Human
uguacugaacaugagaaagaaucc

SEQ ID NO: 1292841 - RNA, 25 nt, Human
uuuuuuagcuucacuguacugaaca

SEQ ID NO: 1292842 - RNA, 23 nt, Human
aaaacaaaaaacaguaaagagaa

SEQ ID NO: 1292843 - RNA, 28 nt, Human
aaaacaaaacaaaaaacaguaaagagaa

SEQ ID NO: 1292844 - RNA, 21 nt, Human
aaaacaaaacaacaaaacaaa

SEQ ID NO: 1292845 - RNA, 21 nt, Human
aaaauccacauaaaaagcaaa

SEQ ID NO: 1292846 - RNA, 26 nt, Human
aaacaaaacaacaaaacaaaacaaaa

SEQ ID NO: 1292847 - RNA, 22 nt, Human
aaacaacaaaacaaaacaaaaa

SEQ ID NO: 1292848 - RNA, 24 nt, Human
aaacaguaaagagaauacuauuga

SEQ ID NO: 1292849 - RNA, 20 nt, Human
aaagcgcucucaaggugcgg

SEQ ID NO: 1292850 - RNA, 19 nt, Human
aaagggagcauucaaggga

SEQ ID NO: 1292851 - RNA, 25 nt, Human
aacaaaacaacaaaacaaaacaaaa

SEQ ID NO: 1292852 - RNA, 18 nt, Human
aacacuaaaagggagcau

SEQ ID NO: 1292853 - RNA, 19 nt, Human
aacauggggaaaccccauc

SEQ ID NO: 1292854 - RNA, 20 nt, Human
aacauggggaaaccccaucu

SEQ ID NO: 1292855 - RNA, 21 nt, Human
aacauggggaaaccccaucuc

SEQ ID NO: 1292856 - RNA, 22 nt, Human
aacccuccugcacagccugccg

SEQ ID NO: 1292857 - RNA, 24 nt, Human
aagcgauccacccgccucggccuc

SEQ ID NO: 1292858 - RNA, 21 nt, Human
aagggacagcaggauguggaa

SEQ ID NO: 1292859 - RNA, 23 nt, Human
aaucacuugacguuagaguuuga

SEQ ID NO: 1292860 - RNA, 24 nt, Human
aaucgcuugaacccgggaggcaga

SEQ ID NO: 1292861 - RNA, 21 nt, Human
acaaaacaaaacaaaaaacag

SEQ ID NO: 1292862 - RNA, 25 nt, Human
acaaaacaaaacaaaaaacaguaaa

SEQ ID NO: 1292863 - RNA, 23 nt, Human
acaaaacaacaaaacaaaacaaa

SEQ ID NO: 1292864 - RNA, 25 nt, Human
acaaaacaacaaaacaaaacaaaaa

SEQ ID NO: 1292865 - RNA, 24 nt, Human
acagagcgagacuccguaucaaaa

SEQ ID NO: 1292866 - RNA, 20 nt, Human
accaccuggagguggcgggg

SEQ ID NO: 1292867 - RNA, 22 nt, Human
accacugcacuccagccugggc

SEQ ID NO: 1292868 - RNA, 24 nt, Human
accccaucucuacugaaaauacaa

SEQ ID NO: 1292869 - RNA, 21 nt, Human
acccgccucggccucccaaaa

SEQ ID NO: 1292870 - RNA, 24 nt, Human
acuauguugcccaggcuggucucg

SEQ ID NO: 1292871 - RNA, 25 nt, Human
acuauguugcccaggcuggucucga

SEQ ID NO: 1292872 - RNA, 24 nt, Human
acugcacuccagccugggcaacag

SEQ ID NO: 1292873 - RNA, 24 nt, Human
acugcacuccagccugggcaacag

SEQ ID NO: 1292874 - RNA, 19 nt, Human
acugcagccuugacuuccu

SEQ ID NO: 1292875 - RNA, 22 nt, Human
agaaaaaugaauggcacacagu

SEQ ID NO: 1292876 - RNA, 23 nt, Human
agaaucacuugacguuagaguuu

SEQ ID NO: 1292877 - RNA, 18 nt, Human
agacacggccuagaugug

SEQ ID NO: 1292878 - RNA, 21 nt, Human
agacccucugaauaaaaacuc

SEQ ID NO: 1292879 - RNA, 20 nt, Human
agagguugcaaugagcccag

SEQ ID NO: 1292880 - RNA, 19 nt, Human
agauaucaccgaagggaaa

SEQ ID NO: 1292881 - RNA, 23 nt, Human
agccgggcgugguggugcaugcc

SEQ ID NO: 1292882 - RNA, 24 nt, Human
agccuggccaacauggggaaaccc

SEQ ID NO: 1292883 - RNA, 24 nt, Human
agccugggcaacagagcgagacuc

SEQ ID NO: 1292884 - RNA, 18 nt, Human
aggaucggggacccgcug

SEQ ID NO: 1292885 - RNA, 19 nt, Human
aggcagagguugcaaugag

SEQ ID NO: 1292886 - RNA, 24 nt, Human
aggcaggagaaucgcuugaacccg

SEQ ID NO: 1292887 - RNA, 20 nt, Human
aggcugaggcaggagaaucg

SEQ ID NO: 1292888 - RNA, 24 nt, Human
aggcugaggcaggagaaucgcuug

SEQ ID NO: 1292889 - RNA, 24 nt, Human
aucucaccacugcacuccagccug

SEQ ID NO: 1292890 - RNA, 28 nt, Human
caaaaaacaaaacaacaaaacaaaacaa

SEQ ID NO: 1292891 - RNA, 22 nt, Human
caaaauucugggauuacaggca

SEQ ID NO: 1292892 - RNA, 21 nt, Human
caaagcugggcucuuggcugc

SEQ ID NO: 1292893 - RNA, 18 nt, Human
caaauuccugagguucac

SEQ ID NO: 1292894 - RNA, 22 nt, Human
caagggacucucuuagccaaua

SEQ ID NO: 1292895 - RNA, 23 nt, Human
cacccgccucggccucccaaaau

SEQ ID NO: 1292896 - RNA, 19 nt, Human
cacuauguugcccaggcug

SEQ ID NO: 1292897 - RNA, 24 nt, Human
cacuauguugcccaggcuggucuc

SEQ ID NO: 1292898 - RNA, 23 nt, Human
cacuccagccugggcaacagagc

SEQ ID NO: 1292899 - RNA, 24 nt, Human
cacuccagccugggcaacagagcg

SEQ ID NO: 1292900 - RNA, 19 nt, Human
cacugcacuccagccuggg

SEQ ID NO: 1292901 - RNA, 21 nt, Human
cacugcacuccagccugggca

SEQ ID NO: 1292902 - RNA, 22 nt, Human
cacugcacuccagccugggcaa

SEQ ID NO: 1292903 - RNA, 23 nt, Human
cacugcacuccagccugggcaac

SEQ ID NO: 1292904 - RNA, 24 nt, Human
cacugcacuccagccugggcaaca

SEQ ID NO: 1292905 - RNA, 24 nt, Human
cagacccucugaauaaaaacucug

SEQ ID NO: 1292906 - RNA, 24 nt, Human
cagagucucacuauguugcccagg

SEQ ID NO: 1292907 - RNA, 23 nt, Human
cagccugccgguaacuggaacca

SEQ ID NO: 1292908 - RNA, 24 nt, Human
cagccuggccaacauggggaaacc

SEQ ID NO: 1292909 - RNA, 21 nt, Human
cagccuugacuuccugggcuc

SEQ ID NO: 1292910 - RNA, 24 nt, Human
cagcucacugcagccuugacuucc

SEQ ID NO: 1292911 - RNA, 20 nt, Human
ccacugcacuccagccuggg

SEQ ID NO: 1292912 - RNA, 21 nt, Human
ccacugcacuccagccugggc

SEQ ID NO: 1292913 - RNA, 22 nt, Human
ccacugcacuccagccugggca

SEQ ID NO: 1292914 - RNA, 23 nt, Human
ccacugcacuccagccugggcaa

SEQ ID NO: 1292915 - RNA, 24 nt, Human
ccacugcacuccagccugggcaac

SEQ ID NO: 1292916 - RNA, 18 nt, Human
ccagacagugugcuaagc

SEQ ID NO: 1292917 - RNA, 24 nt, Human
cccaaaauucugggauuacaggca

SEQ ID NO: 1292918 - RNA, 22 nt, Human
ccccauuccccauggugcguuc

SEQ ID NO: 1292919 - RNA, 21 nt, Human
ccuccugcacagccugccggu

SEQ ID NO: 1292920 - RNA, 19 nt, Human
ccugcgguuaaggagugag

SEQ ID NO: 1292921 - RNA, 24 nt, Human
ccuggccaacauggggaaacccca

SEQ ID NO: 1292922 - RNA, 25 nt, Human
ccuggcuaaucuuuuuguuuuuugu

SEQ ID NO: 1292923 - RNA, 22 nt, Human
ccugggcaacagagcgagacuc

SEQ ID NO: 1292924 - RNA, 20 nt, Human
ccugggcucaaguaacccuc

SEQ ID NO: 1292925 - RNA, 23 nt, Human
ccugggcucaaguaacccuccug

SEQ ID NO: 1292926 - RNA, 22 nt, Human
ccuguaaucucagcuacuagag

SEQ ID NO: 1292927 - RNA, 22 nt, Human
ccugugcucaagcgauccaccc

SEQ ID NO: 1292928 - RNA, 20 nt, Human
ccuugacuuccugggcucaa

SEQ ID NO: 1292929 - RNA, 22 nt, Human
ccuugacuuccugggcucaagu

SEQ ID NO: 1292930 - RNA, 18 nt, Human
cgaagguccaaggucucu

SEQ ID NO: 1292931 - RNA, 24 nt, Human
cgccucggccucccaaaauucugg

SEQ ID NO: 1292932 - RNA, 25 nt, Human
cgguaacuggaaccacagaugugua

SEQ ID NO: 1292933 - RNA, 27 nt, Human
cguaucaaaaaacaaaacaacaaaaca

SEQ ID NO: 1292934 - RNA, 18 nt, Human
cguuagaguuugagacca

SEQ ID NO: 1292935 - RNA, 21 nt, Human
cguucuuacugaggccagggg

SEQ ID NO: 1292936 - RNA, 26 nt, Human
cuacuagugucucucacuagcuaugu

SEQ ID NO: 1292937 - RNA, 27 nt, Human
cucaaguaacccuccugcacagccugc

SEQ ID NO: 1292938 - RNA, 24 nt, Human
cucacugcagccuugacuuccugg

SEQ ID NO: 1292939 - RNA, 23 nt, Human
cuccguaucaaaaaacaaaacaa

SEQ ID NO: 1292940 - RNA, 22 nt, Human
cucucugccaucuagcugcccu

SEQ ID NO: 1292941 - RNA, 24 nt, Human
cuuccugggcucaaguaacccucc

SEQ ID NO: 1292942 - RNA, 21 nt, Human
gaccucaguugggaccaucuc

SEQ ID NO: 1292943 - RNA, 23 nt, Human
gagaaucgcuugaacccgggagg

SEQ ID NO: 1292944 - RNA, 20 nt, Human
gaggagaaaaaagaggcgca

SEQ ID NO: 1292945 - RNA, 24 nt, Human
gcacuccagccugggcaacagagc

SEQ ID NO: 1292946 - RNA, 24 nt, Human
gccaacauggggaaaccccaucuc

SEQ ID NO: 1292947 - RNA, 24 nt, Human
gcgauccacccgccucggccuccc

SEQ ID NO: 1292948 - RNA, 21 nt, Human
gcucaaguaacccuccugcac

SEQ ID NO: 1292949 - RNA, 28 nt, Human
ggaagaacaagacacggccuagauguga

SEQ ID NO: 1292950 - RNA, 23 nt, Human
ggcgugguggugcaugccuguaa

SEQ ID NO: 1292951 - RNA, 21 nt, Human
gggaaaccccaucucuacuga

SEQ ID NO: 1292952 - RNA, 18 nt, Human
gggaagaaccaccuggag

SEQ ID NO: 1292953 - RNA, 26 nt, Human
gggguugauuucuaucaccccuaggg

SEQ ID NO: 1292954 - RNA, 20 nt, Human
ggguucugugguguuguuuc

SEQ ID NO: 1292955 - RNA, 20 nt, Human
gguagaggagaaaaaagagg

SEQ ID NO: 1292956 - RNA, 22 nt, Human
guaucaaaaaacaaaacaacaa

SEQ ID NO: 1292957 - RNA, 24 nt, Human
guaucaaaaaacaaaacaacaaaa

SEQ ID NO: 1292958 - RNA, 23 nt, Human
guggugcaugccuguaaucucag

SEQ ID NO: 1292959 - RNA, 23 nt, Human
uaaaaagcaaauuccugagguuc

SEQ ID NO: 1292960 - RNA, 24 nt, Human
uaaaaagcaaauuccugagguuca

SEQ ID NO: 1292961 - RNA, 22 nt, Human
uaaauacuucuuguauacccca

SEQ ID NO: 1292962 - RNA, 18 nt, Human
uaacccuccugcacagcc

SEQ ID NO: 1292963 - RNA, 21 nt, Human
uaagccaggguccagacuacc

SEQ ID NO: 1292964 - RNA, 19 nt, Human
uacuagagaggcugaggca

SEQ ID NO: 1292965 - RNA, 24 nt, Human
uagugcaguggcacgaucacagcu

SEQ ID NO: 1292966 - RNA, 23 nt, Human
uaucaaaaaacaaaacaacaaaa

SEQ ID NO: 1292967 - RNA, 25 nt, Human
uaucaaaaaacaaaacaacaaaaca

SEQ ID NO: 1292968 - RNA, 20 nt, Human
uaugcuaauaagaccccgcc

SEQ ID NO: 1292969 - RNA, 23 nt, Human
uauguugcccaggcuggucucga

SEQ ID NO: 1292970 - RNA, 24 nt, Human
uauguugcccaggcuggucucgaa

SEQ ID NO: 1292971 - RNA, 25 nt, Human
ucaaaaaacaaaacaacaaaacaaa

SEQ ID NO: 1292972 - RNA, 24 nt, Human
ucacugcagccuugacuuccuggg

SEQ ID NO: 1292973 - RNA, 20 nt, Human
ucaggcaauaguuuaggauu

SEQ ID NO: 1292974 - RNA, 18 nt, Human
uccacauaaaaagcaaau

SEQ ID NO: 1292975 - RNA, 25 nt, Human
uccagacuaccccauagacugggag

SEQ ID NO: 1292976 - RNA, 23 nt, Human
uccagccugggcaacagagcgag

SEQ ID NO: 1292977 - RNA, 24 nt, Human
uccagccugggcaacagagcgaga

SEQ ID NO: 1292978 - RNA, 24 nt, Human
ucccaaaauucugggauuacaggc

SEQ ID NO: 1292979 - RNA, 21 nt, Human
uccugggcucaaguaacccuc

SEQ ID NO: 1292980 - RNA, 22 nt, Human
uccugggcucaaguaacccucc

SEQ ID NO: 1292981 - RNA, 24 nt, Human
uccugggcucaaguaacccuccug

SEQ ID NO: 1292982 - RNA, 21 nt, Human
uccugucucccucuuuuucuc

SEQ ID NO: 1292983 - RNA, 21 nt, Human
uccuuaggcaacugauuucca

SEQ ID NO: 1292984 - RNA, 18 nt, Human
ucgcuugaacccgggagg

SEQ ID NO: 1292985 - RNA, 21 nt, Human
ucuaaagccaugagaguaacu

SEQ ID NO: 1292986 - RNA, 18 nt, Human
ucuaggcacggcaugggg

SEQ ID NO: 1292987 - RNA, 18 nt, Human
ucucacuauguugcccag

SEQ ID NO: 1292988 - RNA, 19 nt, Human
ucucacuauguugcccagg

SEQ ID NO: 1292989 - RNA, 23 nt, Human
ucucacuauguugcccaggcugg

SEQ ID NO: 1292990 - RNA, 24 nt, Human
ucucacuauguugcccaggcuggu

SEQ ID NO: 1292991 - RNA, 26 nt, Human
ucucacuauguugcccaggcuggucu

SEQ ID NO: 1292992 - RNA, 27 nt, Human
ucucacuauguugcccaggcuggucuc

SEQ ID NO: 1292993 - RNA, 20 nt, Human
ucucccucuuuuucucaggc

SEQ ID NO: 1292994 - RNA, 23 nt, Human
ucucuacugaaaauacaaaaauu

SEQ ID NO: 1292995 - RNA, 18 nt, Human
ucugaaguuucuucuugu

SEQ ID NO: 1292996 - RNA, 19 nt, Human
ucugcagacugaauaagcg

SEQ ID NO: 1292997 - RNA, 23 nt, Human
ucugcggcgggaagaaccggggc

SEQ ID NO: 1292998 - RNA, 19 nt, Human
ucuuccagcuccccucacc

SEQ ID NO: 1292999 - RNA, 22 nt, Human
ugacacucacuuccuuuccaga

SEQ ID NO: 1293000 - RNA, 25 nt, Human
ugacuuccugggcucaaguaacccu

SEQ ID NO: 1293001 - RNA, 21 nt, Human
ugagaccagccuggccaacau

SEQ ID NO: 1293002 - RNA, 23 nt, Human
ugagaccagccuggccaacaugg

SEQ ID NO: 1293003 - RNA, 24 nt, Human
ugaggcaggagaaucgcuugaacc

SEQ ID NO: 1293004 - RNA, 25 nt, Human
ugaggcaggagaaucgcuugaaccc

SEQ ID NO: 1293005 - RNA, 24 nt, Human
ugcccaggcuggucucgaacgccu

SEQ ID NO: 1293006 - RNA, 21 nt, Human
ugccuggcuaaucuuuuuguu

SEQ ID NO: 1293007 - RNA, 22 nt, Human
ugccuguaaucucagcuacuag

SEQ ID NO: 1293008 - RNA, 23 nt, Human
ugccuguaaucucagcuacuaga

SEQ ID NO: 1293009 - RNA, 24 nt, Human
uggaaccacagauguguacugcca

SEQ ID NO: 1293010 - RNA, 23 nt, Human
uggcacgaucacagcucacugca

SEQ ID NO: 1293011 - RNA, 18 nt, Human
ugggauuacaggcagaau

SEQ ID NO: 1293012 - RNA, 20 nt, Human
ugggauuacaggcagaauca

SEQ ID NO: 1293013 - RNA, 21 nt, Human
ugggauuacaggcagaaucac

SEQ ID NO: 1293014 - RNA, 23 nt, Human
ugggauuacaggcagaaucacuu

SEQ ID NO: 1293015 - RNA, 24 nt, Human
uggguaaccaguguugaauaaugu

SEQ ID NO: 1293016 - RNA, 18 nt, Human
uggguaguuggagcuggg

SEQ ID NO: 1293017 - RNA, 21 nt, Human
uggugcaugccuguaaucuca

SEQ ID NO: 1293018 - RNA, 22 nt, Human
uggugcaugccuguaaucucag

SEQ ID NO: 1293019 - RNA, 23 nt, Human
uggugcguucucuuuuggguucu

SEQ ID NO: 1293020 - RNA, 24 nt, Human
ugguggugcaugccuguaaucuca

SEQ ID NO: 1293021 - RNA, 19 nt, Human
uguagugcaguggcacgau

SEQ ID NO: 1293022 - RNA, 21 nt, Human
uguccugucucccucuuuuuc

SEQ ID NO: 1293023 - RNA, 24 nt, Human
ugugaaguuguuuacaaagcaguu

SEQ ID NO: 1293024 - RNA, 19 nt, Human
ugugaaucuccuuuuggcu

SEQ ID NO: 1293025 - RNA, 22 nt, Human
ugugcucaagcgauccacccgc

SEQ ID NO: 1293026 - RNA, 20 nt, Human
uguuguuguuuuguuuuuuu

SEQ ID NO: 1293027 - RNA, 21 nt, Human
uguuuagaaaaaugaauggca

SEQ ID NO: 1293028 - RNA, 23 nt, Human
uguuucgucuuugcuuaguccca

SEQ ID NO: 1293029 - RNA, 23 nt, Human
uuacagaguuuaaccaaucauau

SEQ ID NO: 1293030 - RNA, 19 nt, Human
uuagccgggcgugguggug

SEQ ID NO: 1293031 - RNA, 24 nt, Human
uuagccgggcgugguggugcaugc

SEQ ID NO: 1293032 - RNA, 22 nt, Human
uucaucagcaaggauguaauga

SEQ ID NO: 1293033 - RNA, 21 nt, Human
uuccaugucuguguugccaga

SEQ ID NO: 1293034 - RNA, 27 nt, Human
uucucaaugucugaaaugacacucacu

SEQ ID NO: 1293035 - RNA, 20 nt, Human
uucuuacugaggccaggggu

SEQ ID NO: 1293036 - RNA, 21 nt, Human
uuguuguuguuuuguuuuuuu

SEQ ID NO: 1293037 - RNA, 22 nt, Human
uuguuuagaaaaaugaauggca

SEQ ID NO: 1293038 - RNA, 24 nt, Human
uuuguacagagucucacuauguug

SEQ ID NO: 1293039 - RNA, 23 nt, Human
uuuuaugcugcucccacucugcg

SEQ ID NO: 1293040 - RNA, 22 nt, Human
uuuuguuuuuuguacagagucu

SEQ ID NO: 1293041 - RNA, 21 nt, Human
uuuuuguuuuuuguacagagu

SEQ ID NO: 1293042 - RNA, 21 nt, Human
aaacauaaaaaacaaaugaug

SEQ ID NO: 1293043 - RNA, 19 nt, Human
aacauggugaaaccccguc

SEQ ID NO: 1293044 - RNA, 20 nt, Human
aacauggugaaaccccgucu

SEQ ID NO: 1293045 - RNA, 21 nt, Human
aacauggugaaaccccgucuc

SEQ ID NO: 1293046 - RNA, 23 nt, Human
aacauggugaaaccccgucucua

SEQ ID NO: 1293047 - RNA, 25 nt, Human
aaugauggcaggauggcaggaagaa

SEQ ID NO: 1293048 - RNA, 18 nt, Human
acaaaacauaaaaaacaa

SEQ ID NO: 1293049 - RNA, 19 nt, Human
acaaaacauaaaaaacaaa

SEQ ID NO: 1293050 - RNA, 24 nt, Human
accucauacccaagcagagugcca

SEQ ID NO: 1293051 - RNA, 21 nt, Human
accuguaaucccagcuacucg

SEQ ID NO: 1293052 - RNA, 24 nt, Human
acgagaucauaccuguaaucccag

SEQ ID NO: 1293053 - RNA, 20 nt, Human
acuugaaccugggaggcgga

SEQ ID NO: 1293054 - RNA, 22 nt, Human
acuugaaccugggaggcggagg

SEQ ID NO: 1293055 - RNA, 21 nt, Human
agccauucauauccuaagcaa

SEQ ID NO: 1293056 - RNA, 19 nt, Human
aggcagaucacgaggucaa

SEQ ID NO: 1293057 - RNA, 22 nt, Human
aggcaggagaagcacuugaacc

SEQ ID NO: 1293058 - RNA, 24 nt, Human
aggcaggagaagcacuugaaccug

SEQ ID NO: 1293059 - RNA, 25 nt, Human
aggcaggagaagcacuugaaccugg

SEQ ID NO: 1293060 - RNA, 20 nt, Human
aggcggagguugcagugagc

SEQ ID NO: 1293061 - RNA, 24 nt, Human
aggcggagguugcagugagcugag

SEQ ID NO: 1293062 - RNA, 24 nt, Human
aggcugaggcaggagaagcacuug

SEQ ID NO: 1293063 - RNA, 18 nt, Human
caagagauggagacuauc

SEQ ID NO: 1293064 - RNA, 25 nt, Human
cacgagaucauaccuguaaucccag

SEQ ID NO: 1293065 - RNA, 21 nt, Human
cacuugaaccugggaggcgga

SEQ ID NO: 1293066 - RNA, 21 nt, Human
caggcagaucacgaggucaag

SEQ ID NO: 1293067 - RNA, 22 nt, Human
caggcagaucacgaggucaaga

SEQ ID NO: 1293068 - RNA, 19 nt, Human
cauaccuguaaucccagcu

SEQ ID NO: 1293069 - RNA, 19 nt, Human
cauucauauccuaagcaac

SEQ ID NO: 1293070 - RNA, 22 nt, Human
ccuggcgaacauggugaaaccc

SEQ ID NO: 1293071 - RNA, 23 nt, Human
ccuggcgaacauggugaaacccc

SEQ ID NO: 1293072 - RNA, 24 nt, Human
ccuggcgaacauggugaaaccccg

SEQ ID NO: 1293073 - RNA, 19 nt, Human
ccugggaggcggagguugc

SEQ ID NO: 1293074 - RNA, 20 nt, Human
ccuguaaucccagcuacucg

SEQ ID NO: 1293075 - RNA, 20 nt, Human
ccuuccuuccugagcuccca

SEQ ID NO: 1293076 - RNA, 21 nt, Human
cgacaaaacauaaaaaacaaa

SEQ ID NO: 1293077 - RNA, 18 nt, Human
cugcuucugggugcuccu

SEQ ID NO: 1293078 - RNA, 24 nt, Human
cuuccugagcucccaggguuccuc

SEQ ID NO: 1293079 - RNA, 20 nt, Human
cuuccuuccugagcucccag

SEQ ID NO: 1293080 - RNA, 24 nt, Human
gaacauggugaaaccccgucucua

SEQ ID NO: 1293081 - RNA, 23 nt, Human
gagguugcagugagcugagaucg

SEQ ID NO: 1293082 - RNA, 22 nt, Human
gauggcaggaagaaccucauac

SEQ ID NO: 1293083 - RNA, 24 nt, Human
gcacuugaaccugggaggcggagg

SEQ ID NO: 1293084 - RNA, 24 nt, Human
gcgaacauggugaaaccccgucuc

SEQ ID NO: 1293085 - RNA, 21 nt, Human
ggagaagcacuugaaccuggg

SEQ ID NO: 1293086 - RNA, 24 nt, Human
ggagacuauccuggcgaacauggu

SEQ ID NO: 1293087 - RNA, 22 nt, Human
ggagguugcagugagcugagau

SEQ ID NO: 1293088 - RNA, 23 nt, Human
ggagguugcagugagcugagauc

SEQ ID NO: 1293089 - RNA, 24 nt, Human
ggagguugcagugagcugagaucg

SEQ ID NO: 1293090 - RNA, 21 nt, Human
gugaaaccccgucucuacuga

SEQ ID NO: 1293091 - RNA, 26 nt, Human
gugccagguuuuacagccuccgcuca

SEQ ID NO: 1293092 - RNA, 21 nt, Human
gugcuccuuccuuccugagcu

SEQ ID NO: 1293093 - RNA, 19 nt, Human
guugcagugagcugagauc

SEQ ID NO: 1293094 - RNA, 22 nt, Human
uaaaaaacaaaugauggcagga

SEQ ID NO: 1293095 - RNA, 22 nt, Human
uaaaaaacaaaugauggcagga

SEQ ID NO: 1293096 - RNA, 25 nt, Human
uaccuguaaucccagcuacucguga

SEQ ID NO: 1293097 - RNA, 24 nt, Human
ucacgaggucaagagauggagacu

SEQ ID NO: 1293098 - RNA, 19 nt, Human
ucccaggguuccucaaggu

SEQ ID NO: 1293099 - RNA, 22 nt, Human
uccugagcucccaggguuccuc

SEQ ID NO: 1293100 - RNA, 18 nt, Human
uccuuccugagcucccag

SEQ ID NO: 1293101 - RNA, 19 nt, Human
ucgcaccauugcacuucag

SEQ ID NO: 1293102 - RNA, 21 nt, Human
ucuacugauuucugguccucc

SEQ ID NO: 1293103 - RNA, 23 nt, Human
ucuucugugugaaacaggaacug

SEQ ID NO: 1293104 - RNA, 24 nt, Human
ugaaccugggaggcggagguugca

SEQ ID NO: 1293105 - RNA, 22 nt, Human
ugagcugagaucgcaccauugc

SEQ ID NO: 1293106 - RNA, 20 nt, Human
ugaggcaggagaagcacuug

SEQ ID NO: 1293107 - RNA, 24 nt, Human
ugaggcaggagaagcacuugaacc

SEQ ID NO: 1293108 - RNA, 25 nt, Human
ugaggcaggagaagcacuugaaccu

SEQ ID NO: 1293109 - RNA, 18 nt, Human
ugauuucugguccucccc

SEQ ID NO: 1293110 - RNA, 21 nt, Human
ugcuccuuccuuccugagcuc

SEQ ID NO: 1293111 - RNA, 23 nt, Human
ugcuccuuccuuccugagcuccc

SEQ ID NO: 1293112 - RNA, 24 nt, Human
uggcaggauggcaggaagaaccuc

SEQ ID NO: 1293113 - RNA, 21 nt, Human
uggcgacaaaacauaaaaaac

SEQ ID NO: 1293114 - RNA, 29 nt, Human
ugggaggcggagguugcagugacaacggu

SEQ ID NO: 1293115 - RNA, 24 nt, Human
ugggaggcggagguugcagugagc

SEQ ID NO: 1293116 - RNA, 24 nt, Human
uugaaccugggaggcggagguugc

SEQ ID NO: 1293117 - RNA, 18 nt, Human
uugcagugagcugagauc

SEQ ID NO: 1293118 - RNA, 20 nt, Human
uugcagugagcugagaucgc

SEQ ID NO: 1293119 - RNA, 22 nt, Human
uugcagugagcugagaucgcac

SEQ ID NO: 1293120 - RNA, 24 nt, Human
accugguuucuucaaagauagccc

SEQ ID NO: 1293121 - RNA, 21 nt, Human
cugaaccuugauuucuaaaca

SEQ ID NO: 1293122 - RNA, 23 nt, Human
cugaaccuugauuucuaaacaug

SEQ ID NO: 1293123 - RNA, 22 nt, Human
gcaaaaauccuuuucuccucuu

SEQ ID NO: 1293124 - RNA, 22 nt, Human
ucacugucaagauucuccugaa

SEQ ID NO: 1293125 - RNA, 19 nt, Human
uccuuuucuccucuucaaa

SEQ ID NO: 1293126 - RNA, 21 nt, Human
ucuccugaaccuugauuucua

SEQ ID NO: 1293127 - RNA, 24 nt, Human
ugcaaaaauccuuuucuccucuuc

SEQ ID NO: 1293128 - RNA, 23 nt, Human
ugucaagauucuccugaaccuuu

SEQ ID NO: 1293129 - RNA, 22 nt, Human
uucaaacuccuucuuagaaauc

SEQ ID NO: 1293130 - RNA, 25 nt, Human
aaccauuuaaaucauugcuuucuga

SEQ ID NO: 1293131 - RNA, 23 nt, Human
aacccauaauggaaucaaccaag

SEQ ID NO: 1293132 - RNA, 23 nt, Human
aagaauguucaccacaguucccc

SEQ ID NO: 1293133 - RNA, 22 nt, Human
aagcagaaaaauucaaaucaaa

SEQ ID NO: 1293134 - RNA, 23 nt, Human
aagcagaaaaauucaaaucaaac

SEQ ID NO: 1293135 - RNA, 21 nt, Human
aagcucccagccugggccauc

SEQ ID NO: 1293136 - RNA, 19 nt, Human
acaagccugcacaugugca

SEQ ID NO: 1293137 - RNA, 23 nt, Human
acauagcauuuccuccacgcucc

SEQ ID NO: 1293138 - RNA, 19 nt, Human
agaaaggaaaccugagccu

SEQ ID NO: 1293139 - RNA, 18 nt, Human
agaggauagguauuccag

SEQ ID NO: 1293140 - RNA, 18 nt, Human
aggaaaccugagccugag

SEQ ID NO: 1293141 - RNA, 24 nt, Human
aggagaaaggaaaccugagccuga

SEQ ID NO: 1293142 - RNA, 22 nt, Human
aggauagguauuccaggagaaa

SEQ ID NO: 1293143 - RNA, 24 nt, Human
aggcaagaaccaaagugacaucca

SEQ ID NO: 1293144 - RNA, 20 nt, Human
augaacacagggacccugcc

SEQ ID NO: 1293145 - RNA, 20 nt, Human
caagccaauccuuguugagu

SEQ ID NO: 1293146 - RNA, 19 nt, Human
caagcucccagccugggcc

SEQ ID NO: 1293147 - RNA, 21 nt, Human
caagcucccagccugggccau

SEQ ID NO: 1293148 - RNA, 20 nt, Human
caauaaacaugacugcagaa

SEQ ID NO: 1293149 - RNA, 22 nt, Human
cauccugaaucacaaggucagg

SEQ ID NO: 1293150 - RNA, 22 nt, Human
ccacgcuccacauaaaaagaag

SEQ ID NO: 1293151 - RNA, 21 nt, Human
ccagaagaauguucaccacag

SEQ ID NO: 1293152 - RNA, 24 nt, Human
cccuuuugcuucuucggucaagag

SEQ ID NO: 1293153 - RNA, 21 nt, Human
ccucaucaugaacacagggac

SEQ ID NO: 1293154 - RNA, 22 nt, Human
ccuuuauaauuucuguaggcau

SEQ ID NO: 1293155 - RNA, 18 nt, Human
cucaagggacggcaggcc

SEQ ID NO: 1293156 - RNA, 25 nt, Human
cuccaccaauaaacaugagguaccc

SEQ ID NO: 1293157 - RNA, 20 nt, Human
cucugggucccgaucaaccc

SEQ ID NO: 1293158 - RNA, 19 nt, Human
gaacacagggacccugcca

SEQ ID NO: 1293159 - RNA, 20 nt, Human
gaaggcagcagggcucugag

SEQ ID NO: 1293160 - RNA, 21 nt, Human
gaagggcagguuuuccaauga

SEQ ID NO: 1293161 - RNA, 24 nt, Human
gaauguucaccacaguuccccaga

SEQ ID NO: 1293162 - RNA, 23 nt, Human
gagaacagaaaggaauugcaagc

SEQ ID NO: 1293163 - RNA, 19 nt, Human
gagcaguuucagagccagc

SEQ ID NO: 1293164 - RNA, 23 nt, Human
gagcauggccagaagauuaaaua

SEQ ID NO: 1293165 - RNA, 22 nt, Human
gcuccacauaaaaagaaguaau

SEQ ID NO: 1293166 - RNA, 20 nt, Human
ggcagacaagccugcacaug

SEQ ID NO: 1293167 - RNA, 20 nt, Human
gggagugugauggcaccagc

SEQ ID NO: 1293168 - RNA, 20 nt, Human
gggcagguuuuccaaugagc

SEQ ID NO: 1293169 - RNA, 25 nt, Human
ggugaugaaggcagcagggcucuga

SEQ ID NO: 1293170 - RNA, 18 nt, Human
guccuagguaacaaugcu

SEQ ID NO: 1293171 - RNA, 24 nt, Human
guucagcuggaggugaugaaggcc

SEQ ID NO: 1293172 - RNA, 26 nt, Human
guucauaaaaauggcagugauauaaa

SEQ ID NO: 1293173 - RNA, 18 nt, Human
uaaaagagccugaagggc

SEQ ID NO: 1293174 - RNA, 19 nt, Human
uaaaagagccugaagggca

SEQ ID NO: 1293175 - RNA, 21 nt, Human
uaacaaugcuuuaccaucuga

SEQ ID NO: 1293176 - RNA, 23 nt, Human
uaauggaaucaaccaagccaauc

SEQ ID NO: 1293177 - RNA, 24 nt, Human
uacaucacuaaguuguucuagaga

SEQ ID NO: 1293178 - RNA, 20 nt, Human
uacccaaaggcaagaaccaa

SEQ ID NO: 1293179 - RNA, 22 nt, Human
uauacagggcaggacacguggc

SEQ ID NO: 1293180 - RNA, 20 nt, Human
uaucuagaggcuuugugaga

SEQ ID NO: 1293181 - RNA, 22 nt, Human
ucaacccauaauggaaucaacc

SEQ ID NO: 1293182 - RNA, 24 nt, Human
ucaccucugggucccgaucaaccc

SEQ ID NO: 1293183 - RNA, 21 nt, Human
ucacuaaguuguucuagagau

SEQ ID NO: 1293184 - RNA, 19 nt, Human
ucaggagcauggccagaag

SEQ ID NO: 1293185 - RNA, 21 nt, Human
ucauccugaaucacaagguca

SEQ ID NO: 1293186 - RNA, 21 nt, Human
uccaggagaaaggaaaccuga

SEQ ID NO: 1293187 - RNA, 23 nt, Human
uccugaaucacaaggucaggcuc

SEQ ID NO: 1293188 - RNA, 24 nt, Human
ucgaaaagccuuugcagugucucu

SEQ ID NO: 1293189 - RNA, 19 nt, Human
ucggucaagagaacagaaa

SEQ ID NO: 1293190 - RNA, 25 nt, Human
ugacaaguacuucacacagauaucu

SEQ ID NO: 1293191 - RNA, 24 nt, Human
ugacuacccaaaggcaagaaccaa

SEQ ID NO: 1293192 - RNA, 19 nt, Human
ugaguuccuggacacaugu

SEQ ID NO: 1293193 - RNA, 19 nt, Human
ugcucuuuguaacaccuuu

SEQ ID NO: 1293194 - RNA, 20 nt, Human
uggagcaguuucagagccag

SEQ ID NO: 1293195 - RNA, 21 nt, Human
uggagcaguuucagagccagc

SEQ ID NO: 1293196 - RNA, 18 nt, Human
uggaggugaugaaggcag

SEQ ID NO: 1293197 - RNA, 25 nt, Human
uguucuagagauuucugauuuuccu

SEQ ID NO: 1293198 - RNA, 18 nt, Human
uucaaggguggucagugc

SEQ ID NO: 1293199 - RNA, 23 nt, Human
uucacaagcucauccugaaucac

SEQ ID NO: 1293200 - RNA, 24 nt, Human
uucagagccagcugcguuugaaaa

SEQ ID NO: 1293201 - RNA, 19 nt, Human
uuccccagagcccaccgga

SEQ ID NO: 1293202 - RNA, 19 nt, Human
uugugagaggagaguguga

SEQ ID NO: 1293203 - RNA, 21 nt, Human
aaaggccaggacccacagaua

SEQ ID NO: 1293204 - RNA, 23 nt, Human
aaccccaaacaggccuggacaug

SEQ ID NO: 1293205 - RNA, 23 nt, Human
aaccccaacaggccccuccuggc

SEQ ID NO: 1293206 - RNA, 21 nt, Human
aacuacuaauugucaaccacc

SEQ ID NO: 1293207 - RNA, 18 nt, Human
aaggagagacuggaggug

SEQ ID NO: 1293208 - RNA, 19 nt, Human
aaggaggggggcgaagagg

SEQ ID NO: 1293209 - RNA, 20 nt, Human
aaggaggggggcgaagaggg

SEQ ID NO: 1293210 - RNA, 23 nt, Human
acacacacacacacacacacaca

SEQ ID NO: 1293211 - RNA, 31 nt, Human; identical to SEQ ID NO: 1101801

SEQ ID NO: 1293212 - RNA, 20 nt, Human
acaccgaaagaaaagaaaag

SEQ ID NO: 1293213 - RNA, 23 nt, Human
acccagcuucaggaguagaagcc

SEQ ID NO: 1293214 - RNA, 22 nt, Human
accccauucucucuccucccca

SEQ ID NO: 1293215 - RNA, 28 nt, Human
accccauucucucuccuccccacaguca

SEQ ID NO: 1293216 - RNA, 19 nt, Human
acccugugauuaaacuacu

SEQ ID NO: 1293217 - RNA, 24 nt, Human
acucaaaccccaacaggccccucc

SEQ ID NO: 1293218 - RNA, 18 nt, Human
agaaaagaaaaggcagaa

SEQ ID NO: 1293219 - RNA, 21 nt, Human
agaaaggccaggacccacaga

SEQ ID NO: 1293220 - RNA, 18 nt, Human
agaaauaaugugugcccc

SEQ ID NO: 1293221 - RNA, 18 nt, Human
agaaccuucccuaccccu

SEQ ID NO: 1293222 - RNA, 24 nt, Human
agagaagagaugaaaagagcagag

SEQ ID NO: 1293223 - RNA, 24 nt, Human
agagaggggaagggagcuugaggu

SEQ ID NO: 1293224 - RNA, 21 nt, Human
agagaugaaaagagcagaggg

SEQ ID NO: 1293225 - RNA, 21 nt, Human
agaggggaagggagcuugagg

SEQ ID NO: 1293226 - RNA, 19 nt, Human
agauaugaaccaggaugcc

SEQ ID NO: 1293227 - RNA, 18 nt, Human
agcaacacagauaugaac

SEQ ID NO: 1293228 - RNA, 19 nt, Human
agccgcugagguccucucc

SEQ ID NO: 1293229 - RNA, 21 nt, Human
aggccaggccacccagcuuca

SEQ ID NO: 1293230 - RNA, 18 nt, Human
aggcccagcuaagcccag

SEQ ID NO: 1293231 - RNA, 18 nt, Human
aggcccagcuaagcccag

SEQ ID NO: 1293232 - RNA, 24 nt, Human
aggccucagaggcccagcuaagcc

SEQ ID NO: 1293233 - RNA, 22 nt, Human
aggccuggccuggcugccggcc

SEQ ID NO: 1293234 - RNA, 23 nt, Human
aguacaggagacaccgaaagaaa

SEQ ID NO: 1293235 - RNA, 19 nt, Human
auaaugugugccccacccc

SEQ ID NO: 1293236 - RNA, 19 nt, Human
auaccacagacacacccug

SEQ ID NO: 1293237 - RNA, 21 nt, Human
aucccaucccuucccaucucc

SEQ ID NO: 1293238 - RNA, 23 nt, Human
aucccuucccaucuccuccccca

SEQ ID NO: 1293239 - RNA, 23 nt, Human
augaagaaaggccaggacccaca

SEQ ID NO: 1293240 - RNA, 31 nt, Human; identical to SEQ ID NO: 1101832

SEQ ID NO: 1293241 - RNA, 18 nt, Human
caacacagauaugaacca

SEQ ID NO: 1293242 - RNA, 22 nt, Human
caaccccaaacaggccuggaca

SEQ ID NO: 1293243 - RNA, 20 nt, Human
cacacacacacacacacaca

SEQ ID NO: 1293244 - RNA, 20 nt, Human
cacacacacacacacacaca

SEQ ID NO: 1293245 - RNA, 20 nt, Human
cacacacacacacacacaca

SEQ ID NO: 1293246 - RNA, 20 nt, Human
cacacacacacacacacaca

SEQ ID NO: 1293247 - RNA, 22 nt, Human
cacacacacacacacacacaca

SEQ ID NO: 1293248 - RNA, 22 nt, Human
cacacacacacacacacacaca

SEQ ID NO: 1293249 - RNA, 26 nt, Human
cacacacacacacacacacacacaca

SEQ ID NO: 1293250 - RNA, 30 nt, Human; identical to SEQ ID NO: 326474

SEQ ID NO: 1293251 - RNA, 29 nt, Human
cacacacacacacacacacacacacccug

SEQ ID NO: 1293252 - RNA, 22 nt, Human
cacacacacacccugugauuaa

SEQ ID NO: 1293253 - RNA, 22 nt, Human
cacagacacacccugugccaga

SEQ ID NO: 1293254 - RNA, 29 nt, Human
cacgggcugauaugcacgcacacagugug

SEQ ID NO: 1293255 - RNA, 20 nt, Human
cagacacuguagucagcaac

SEQ ID NO: 1293256 - RNA, 30 nt, Human; identical to SEQ ID NO: 1101847

SEQ ID NO: 1293257 - RNA, 18 nt, Human
cagccagggcucuggggc

SEQ ID NO: 1293258 - RNA, 22 nt, Human
cagcgacaccccucuguggucu

SEQ ID NO: 1293259 - RNA, 28 nt, Human
cagcgacaccccucuguggucuucagac

SEQ ID NO: 1293260 - RNA, 24 nt, Human
caggaagaucccagugacucaaac

SEQ ID NO: 1293261 - RNA, 24 nt, Human
caggacccacagauacuacccucu

SEQ ID NO: 1293262 - RNA, 23 nt, Human
caggaguagaagccaugguccaa

SEQ ID NO: 1293263 - RNA, 19 nt, Human
caggaguuucgggacccgg

SEQ ID NO: 1293264 - RNA, 20 nt, Human
caggccaggccaggccaccc

SEQ ID NO: 1293265 - RNA, 18 nt, Human
caguggguuuccggaauc

SEQ ID NO: 1293266 - RNA, 31 nt, Human; identical to SEQ ID NO: 1101857

SEQ ID NO: 1293267 - RNA, 27 nt, Human
cauauacaugcgugcacauaaacacac

SEQ ID NO: 1293268 - RNA, 21 nt, Human
caucacagacacuguagucag

SEQ ID NO: 1293269 - RNA, 27 nt, Human
caugaccagugagaaauaaugugugcc

SEQ ID NO: 1293270 - RNA, 23 nt, Human
caugcggacaucacagacacugu

SEQ ID NO: 1293271 - RNA, 20 nt, Human
ccaaaggaggggggcgaaga

SEQ ID NO: 1293272 - RNA, 22 nt, Human
ccaaagugguggaauauagugu

SEQ ID NO: 1293273 - RNA, 21 nt, Human
ccacccagcuucaggaguaga

SEQ ID NO: 1293274 - RNA, 24 nt, Human
ccacccagcuucaggaguagaagc

SEQ ID NO: 1293275 - RNA, 24 nt, Human
ccaggaagaucccagugacucaaa

SEQ ID NO: 1293276 - RNA, 20 nt, Human
ccauugccauggggacuguc

SEQ ID NO: 1293277 - RNA, 26 nt, Human
cccaaaagguugagagaagagaugaa

SEQ ID NO: 1293278 - RNA, 24 nt, Human
cccacugucccaaacucuucgucu

SEQ ID NO: 1293279 - RNA, 26 nt, Human
cccagaaaucccaucccuucccaucu

SEQ ID NO: 1293280 - RNA, 18 nt, Human
cccagcuucaggaguaga

SEQ ID NO: 1293281 - RNA, 21 nt, Human
cccagugacucaaaccccaac

SEQ ID NO: 1293282 - RNA, 25 nt, Human
cccaucuccucccccacugucccaa

SEQ ID NO: 1293283 - RNA, 22 nt, Human
ccccaaaagguugagagaagag

SEQ ID NO: 1293284 - RNA, 19 nt, Human
ccccaccccccaccaguga

SEQ ID NO: 1293285 - RNA, 18 nt, Human
cccgcucugggacccaga

SEQ ID NO: 1293286 - RNA, 22 nt, Human
cccggccgcgccgccuucccug

SEQ ID NO: 1293287 - RNA, 27 nt, Human
cccuggccagcccugccaucaguaugg

SEQ ID NO: 1293288 - RNA, 20 nt, Human
cccugggcggccuugggccu

SEQ ID NO: 1293289 - RNA, 21 nt, Human
cccugggcggccuugggccuu

SEQ ID NO: 1293290 - RNA, 22 nt, Human
cccuuaaacacugagcuccaaa

SEQ ID NO: 1293291 - RNA, 19 nt, Human
ccucccccacugucccaaa

SEQ ID NO: 1293292 - RNA, 19 nt, Human
ccuccgagaccccgggcag

SEQ ID NO: 1293293 - RNA, 18 nt, Human
ccucucucugcccugggc

SEQ ID NO: 1293294 - RNA, 18 nt, Human
ccugccaucaguauggga

SEQ ID NO: 1293295 - RNA, 23 nt, Human
ccuuggugggcucagguuuggga

SEQ ID NO: 1293296 - RNA, 19 nt, Human
cgcacacaugaagaaaggc

SEQ ID NO: 1293297 - RNA, 20 nt, Human
cgcugagguccucuccgccc

SEQ ID NO: 1293298 - RNA, 20 nt, Human
cguggugaugcauauacaug

SEQ ID NO: 1293299 - RNA, 20 nt, Human
cucagcccgggcugggagug

SEQ ID NO: 1293300 - RNA, 21 nt, Human
cuccugaagcagagcuggaaa

SEQ ID NO: 1293301 - RNA, 19 nt, Human
cuucagacaguggguuucc

SEQ ID NO: 1293302 - RNA, 21 nt, Human
cuucaggggugcuaguacccc

SEQ ID NO: 1293303 - RNA, 27 nt, Human
gaaaagagcagagggcagccgguaccc

SEQ ID NO: 1293304 - RNA, 21 nt, Human
gaaagaaaagaaaaggcagaa

SEQ ID NO: 1293305 - RNA, 21 nt, Human
gaaguacaggagacaccgaaa

SEQ ID NO: 1293306 - RNA, 24 nt, Human
gacacacccugugccagaagaguc

SEQ ID NO: 1293307 - RNA, 19 nt, Human
gaggagaaauuuugggaag

SEQ ID NO: 1293308 - RNA, 20 nt, Human
gaggagaaauuuugggaagu

SEQ ID NO: 1293309 - RNA, 19 nt, Human
gauucuuccagaugaggga

SEQ ID NO: 1293310 - RNA, 25 nt, Human
gcaaccccaaacaggccuggacaug

SEQ ID NO: 1293311 - RNA, 33 nt, Human; identical to SEQ ID NO: 1101896

SEQ ID NO: 1293312 - RNA, 23 nt, Human
gccaggccacccagcuucaggag

SEQ ID NO: 1293313 - RNA, 20 nt, Human
gcccccaaaggaggggggcc

SEQ ID NO: 1293314 - RNA, 22 nt, Human
gcccccaaaggaggggggcgaa

SEQ ID NO: 1293315 - RNA, 20 nt, Human
gcccugggcggccuugggcc

SEQ ID NO: 1293316 - RNA, 19 nt, Human
gcccuuaaacacugagcuc

SEQ ID NO: 1293317 - RNA, 20 nt, Human
gccgcgccgccuucccuggg

SEQ ID NO: 1293318 - RNA, 31 nt, Human
gcgugcacauaaacacacacacacacacaca

SEQ ID NO: 1293319 - RNA, 24 nt, Human
gcgugcucagcccgggcugggagu

SEQ ID NO: 1293320 - RNA, 19 nt, Human
gcuggguuggaggcacagg

SEQ ID NO: 1293321 - RNA, 21 nt, Human
ggagguggugucaggacacag

SEQ ID NO: 1293322 - RNA, 19 nt, Human
gguggauggggagguggug

SEQ ID NO: 1293323 - RNA, 21 nt, Human
gguuggaggcacagguggagc

SEQ ID NO: 1293324 - RNA, 21 nt, Human
guagauggcuuggaacauagc

SEQ ID NO: 1293325 - RNA, 21 nt, Human
gucacggggcccccaaaggag

SEQ ID NO: 1293326 - RNA, 21 nt, Human
guccagccagggcucuggggc

SEQ ID NO: 1293327 - RNA, 27 nt, Human
gugaugcauauacaugcgugcacauag

SEQ ID NO: 1293328 - RNA, 29 nt, Human
gugcacauaaacacacacacacacacaca

SEQ ID NO: 1293329 - RNA, 19 nt, Human
guggaauauagugugcccc

SEQ ID NO: 1293330 - RNA, 21 nt, Human
gugguggauggggagguggug

SEQ ID NO: 1293331 - RNA, 25 nt, Human
uacaggagacaccgaaagaaaagaa

SEQ ID NO: 1293332 - RNA, 33 nt, Human
uacaugcgugcacauaaacacacacacacagug

SEQ ID NO: 1293333 - RNA, 21 nt, Human
uaccccauucucucuccuccc

SEQ ID NO: 1293334 - RNA, 21 nt, Human
uagauggcuuggaacauagca

SEQ ID NO: 1293335 - RNA, 27 nt, Human
uaggcaaccccaaacaggccuggacau

SEQ ID NO: 1293336 - RNA, 23 nt, Human
uagucagcaacacagauaugaac

SEQ ID NO: 1293337 - RNA, 22 nt, Human
uagugugccccccacauucagg

SEQ ID NO: 1293338 - RNA, 20 nt, Human
ucaaccaccucacagguaua

SEQ ID NO: 1293339 - RNA, 21 nt, Human
ucacagacacuguagucagca

SEQ ID NO: 1293340 - RNA, 23 nt, Human
ucacagguauaccacagacacac

SEQ ID NO: 1293341 - RNA, 20 nt, Human
ucagcaacacagauaugaac

SEQ ID NO: 1293342 - RNA, 21 nt, Human
ucaggggugcuaguaccccau

SEQ ID NO: 1293343 - RNA, 21 nt, Human
uccaaagugguggaauauagu

SEQ ID NO: 1293344 - RNA, 23 nt, Human
uccagaguguucuggccucucau

SEQ ID NO: 1293345 - RNA, 22 nt, Human
uccagccagggcucuggggcca

SEQ ID NO: 1293346 - RNA, 22 nt, Human
uccagccccauugccaugggga

SEQ ID NO: 1293347 - RNA, 26 nt, Human
ucccaucuccucccccacugucccaa

SEQ ID NO: 1293348 - RNA, 24 nt, Human
uccccagaccucaauauccuucca

SEQ ID NO: 1293349 - RNA, 22 nt, Human
ucccugggugucgccgcagccg

SEQ ID NO: 1293350 - RNA, 19 nt, Human
ucccuucccaucuccuccc

SEQ ID NO: 1293351 - RNA, 23 nt, Human
uccugcccacaucugagcuccag

SEQ ID NO: 1293352 - RNA, 18 nt, Human
ucucauagcuccugaagc

SEQ ID NO: 1293353 - RNA, 23 nt, Human
ucucucuccuccccacagucaaa

SEQ ID NO: 1293354 - RNA, 24 nt, Human
ucugggaagcgggucagggucucc

SEQ ID NO: 1293355 - RNA, 19 nt, Human
ucuggggccacucagaggc

SEQ ID NO: 1293356 - RNA, 24 nt, Human
ucuguggucuucagacaguggguu

SEQ ID NO: 1293357 - RNA, 19 nt, Human
ugaaaagagcagagggcag

SEQ ID NO: 1293358 - RNA, 22 nt, Human
ugaaaagagcagagggcagcca

SEQ ID NO: 1293359 - RNA, 21 nt, Human
ugaagaagcugugcgugagua

SEQ ID NO: 1293360 - RNA, 21 nt, Human
ugacgguggcgagcacagggc

SEQ ID NO: 1293361 - RNA, 18 nt, Human
ugacucaaaccccaacag

SEQ ID NO: 1293362 - RNA, 21 nt, Human
ugacuucucuuaccucucacc

SEQ ID NO: 1293363 - RNA, 19 nt, Human
ugagagaaccuucccuacc

SEQ ID NO: 1293364 - RNA, 20 nt, Human
ugauaugcacgcacacauga

SEQ ID NO: 1293365 - RNA, 23 nt, Human
ugcaaaguccucccuuuucccca

SEQ ID NO: 1293366 - RNA, 19 nt, Human
ugcacauaaacacacacac

SEQ ID NO: 1293367 - RNA, 21 nt, Human
ugcacauaaacacacacacac

SEQ ID NO: 1293368 - RNA, 19 nt, Human
uggaauauagugugccccc

SEQ ID NO: 1293369 - RNA, 21 nt, Human
uggaauauagugugcccccca

SEQ ID NO: 1293370 - RNA, 18 nt, Human
ugggacccagaaauccca

SEQ ID NO: 1293371 - RNA, 20 nt, Human
ugggaguguccgagggcucu

SEQ ID NO: 1293372 - RNA, 24 nt, Human
uggggccacucagaggccuggccu

SEQ ID NO: 1293373 - RNA, 18 nt, Human
ugguggauggggaggugg

SEQ ID NO: 1293374 - RNA, 23 nt, Human
ugugugccccaccccccaccagu

SEQ ID NO: 1293375 - RNA, 25 nt, Human
uguuccccccuuuuccaagcccuua

SEQ ID NO: 1293376 - RNA, 19 nt, Human
uuccagaugagggaugcuc

SEQ ID NO: 1293377 - RNA, 21 nt, Human
uucucucuccuccccacaguc

SEQ ID NO: 1293378 - RNA, 19 nt, Human
uuggugggcucagguuugg

SEQ ID NO: 1293379 - RNA, 21 nt, Human
uuuccaagcccuuaaacacug

SEQ ID NO: 1293380 - RNA, 18 nt, Human
aaaacaaguucugcauau

SEQ ID NO: 1293381 - RNA, 18 nt, Human
ccucugugcgcccagcuc

SEQ ID NO: 1293382 - RNA, 21 nt, Human
cgcugggugggguggcagcgc

SEQ ID NO: 1293383 - RNA, 19 nt, Human
cugugcgcccagcucaagc

SEQ ID NO: 1293384 - RNA, 19 nt, Human
ggccuggcuguuccggcug

SEQ ID NO: 1293385 - RNA, 20 nt, Human
gugggguggcagcgcuggcu

SEQ ID NO: 1293386 - RNA, 24 nt, Human
ucauggccuggcuguuccggcugu

SEQ ID NO: 1293387 - RNA, 18 nt, Human
uccccugggucauggccu

SEQ ID NO: 1293388 - RNA, 22 nt, Human
ucgagggaauguuacagggcca

SEQ ID NO: 1293389 - RNA, 23 nt, Human
uggcaggggaacggaaaacaagu

SEQ ID NO: 1293390 - RNA, 21 nt, Human
uggccuggcuguuccggcugu

SEQ ID NO: 1293391 - RNA, 21 nt, Human
uggcuguuccggcuguggccu

SEQ ID NO: 1293392 - RNA, 25 nt, Human
uguuacagggccacagauccuggcg

SEQ ID NO: 1293393 - RNA, 21 nt, Human
aaaguagacauccaaaaaugu

SEQ ID NO: 1293394 - RNA, 18 nt, Human
aauaaaguagacauccaa

SEQ ID NO: 1293395 - RNA, 19 nt, Human
aaucuucuuuucuucaggc

SEQ ID NO: 1293396 - RNA, 18 nt, Human
caucagaguuugcugggg

SEQ ID NO: 1293397 - RNA, 18 nt, Human
cgguuggcaaucucuucc

SEQ ID NO: 1293398 - RNA, 19 nt, Human
uaaaaacaaagcuuuaauc

SEQ ID NO: 1293399 - RNA, 28 nt, Human
uaaaguagacauccaaaaauguggaugu

SEQ ID NO: 1293400 - RNA, 19 nt, Human
ucugcuuuccaaaaguaaa

SEQ ID NO: 1293401 - RNA, 20 nt, Human
ucuucaggcaaagccuccgg

SEQ ID NO: 1293402 - RNA, 26 nt, Human
uggaugucauuuaaaaacaaagcuuu

SEQ ID NO: 1293403 - RNA, 20 nt, Human
agaagccaccuaacauggua

SEQ ID NO: 1293404 - RNA, 23 nt, Human
cagccagccuuccaugcuggccu

SEQ ID NO: 1293405 - RNA, 21 nt, Human
cuaacaugguaaugagcuccu

SEQ ID NO: 1293406 - RNA, 18 nt, Human
cugcccgacuggggcugu

SEQ ID NO: 1293407 - RNA, 18 nt, Human
cuugaaaggaggagagaa

SEQ ID NO: 1293408 - RNA, 18 nt, Human
cuugaaaggaggagagaa

SEQ ID NO: 1293409 - RNA, 19 nt, Human
gaggcugaacaacuugaaa

SEQ ID NO: 1293410 - RNA, 21 nt, Human
gugcagagagcucagcacggg

SEQ ID NO: 1293411 - RNA, 22 nt, Human
ugaaaggaggagagaaaauucc

SEQ ID NO: 1293412 - RNA, 19 nt, Human
uggggcugugugcagagag

SEQ ID NO: 1293413 - RNA, 21 nt, Human
uucaagcagaggcugaacaac

SEQ ID NO: 1293414 - RNA, 20 nt, Human
aagagaagacagugcuuaga

SEQ ID NO: 1293415 - RNA, 25 nt, Human
acagagcacuccucugaccacccua

SEQ ID NO: 1293416 - RNA, 21 nt, Human
accacccuaacaauccgagag

SEQ ID NO: 1293417 - RNA, 21 nt, Human
acccuaacaauccgagaggaa

SEQ ID NO: 1293418 - RNA, 18 nt, Human
agagagucggugaaaguc

SEQ ID NO: 1293419 - RNA, 24 nt, Human
aggaaguggcuggcaacccaaucu

SEQ ID NO: 1293420 - RNA, 18 nt, Human
aggcagaucaucuaaugg

SEQ ID NO: 1293421 - RNA, 23 nt, Human
aucucacccuuccucuccugcag

SEQ ID NO: 1293422 - RNA, 20 nt, Human
augacauuuucagcuccucu

SEQ ID NO: 1293423 - RNA, 18 nt, Human
caaaaugggcaacaaguc

SEQ ID NO: 1293424 - RNA, 24 nt, Human
caaauucuuagcugugaucuaaua

SEQ ID NO: 1293425 - RNA, 23 nt, Human
cuccucgguuccaccgggugcca

SEQ ID NO: 1293426 - RNA, 24 nt, Human
cuccucugaccacccuaacaaucc

SEQ ID NO: 1293427 - RNA, 21 nt, Human
cucgucaugccucaaacagcu

SEQ ID NO: 1293428 - RNA, 24 nt, Human
cucuuacauuuacuagaaaugaca

SEQ ID NO: 1293429 - RNA, 19 nt, Human
gaaacacuucacugugcaa

SEQ ID NO: 1293430 - RNA, 20 nt, Human
gagaagacagugcuuagaga

SEQ ID NO: 1293431 - RNA, 25 nt, Human
gcugaaaacagaggcagaucaucua

SEQ ID NO: 1293432 - RNA, 23 nt, Human
uaagaggauguucccaaaucuug

SEQ ID NO: 1293433 - RNA, 22 nt, Human
uacuagaaaugacauuuucagc

SEQ ID NO: 1293434 - RNA, 21 nt, Human
ucaaaggggcugcacagagca

SEQ ID NO: 1293435 - RNA, 22 nt, Human
ucaaaggggcugcacagagcac

SEQ ID NO: 1293436 - RNA, 20 nt, Human
ucacccuuccucuccugcag

SEQ ID NO: 1293437 - RNA, 27 nt, Human
ucacccuuccucuccugcagaauaaga

SEQ ID NO: 1293438 - RNA, 23 nt, Human
ucacugugcaaauucuuagcugu

SEQ ID NO: 1293439 - RNA, 21 nt, Human
ucaguguaccccucucccuuc

SEQ ID NO: 1293440 - RNA, 24 nt, Human
ucccuccagagagucggugaaagu

SEQ ID NO: 1293441 - RNA, 25 nt, Human
ucucccuucgcuguuggcaauuaau

SEQ ID NO: 1293442 - RNA, 21 nt, Human
ucuccugcagaauaagaggau

SEQ ID NO: 1293443 - RNA, 23 nt, Human
ucuugaggcugaaaacagaggca

SEQ ID NO: 1293444 - RNA, 18 nt, Human
ugagggaagagaagacag

SEQ ID NO: 1293445 - RNA, 20 nt, Human
ugagggaagagaagacagug

SEQ ID NO: 1293446 - RNA, 25 nt, Human
ugcacagagcacuccucugaccacc

SEQ ID NO: 1293447 - RNA, 24 nt, Human
ugcagaauaagaggauguucccaa

SEQ ID NO: 1293448 - RNA, 20 nt, Human
ugugagggaagagaagacag

SEQ ID NO: 1293449 - RNA, 18 nt, Human
caaaggauagagggagcc

SEQ ID NO: 1293450 - RNA, 18 nt, Human
cucugcagggggugaagg

SEQ ID NO: 1293451 - RNA, 20 nt, Human
ugcaaaggauagagggagcc

SEQ ID NO: 1293452 - RNA, 18 nt, Human
acauagccucccaaccuc

SEQ ID NO: 1293453 - RNA, 21 nt, Human
auggcuuccagguccugcucc

SEQ ID NO: 1293454 - RNA, 22 nt, Human
cacccuggaggccaccagggcc

SEQ ID NO: 1293455 - RNA, 26 nt, Human
cacugaguccggguagaucaccuggu

SEQ ID NO: 1293456 - RNA, 22 nt, Human
cauccuuccagucacacauagc

SEQ ID NO: 1293457 - RNA, 28 nt, Human
ccacccggcaggacauccuuccagucac

SEQ ID NO: 1293458 - RNA, 20 nt, Human
ccggguagaucaccugguca

SEQ ID NO: 1293459 - RNA, 21 nt, Human
ccugugguagaacaugcaggc

SEQ ID NO: 1293460 - RNA, 19 nt, Human
cucccgcugcagggugugg

SEQ ID NO: 1293461 - RNA, 23 nt, Human
gccgauucucugcuucuugccac

SEQ ID NO: 1293462 - RNA, 20 nt, Human
gguguggugcgggugcacga

SEQ ID NO: 1293463 - RNA, 20 nt, Human
uacuugggccugugguagaa

SEQ ID NO: 1293464 - RNA, 21 nt, Human
uagccucccaaccucccuccc

SEQ ID NO: 1293465 - RNA, 23 nt, Human
ucacacauagccucccaaccucc

SEQ ID NO: 1293466 - RNA, 19 nt, Human
uggcuuccagguccugcuc

SEQ ID NO: 1293467 - RNA, 24 nt, Human
aacauaacuauuauuguaaaaaua

SEQ ID NO: 1293468 - RNA, 18 nt, Human
aggcagggaggcaggaag

SEQ ID NO: 1293469 - RNA, 20 nt, Human
cagcaguaaacaaucuauga

SEQ ID NO: 1293470 - RNA, 23 nt, Human
cuuaauacucacacacagaaaac

SEQ ID NO: 1293471 - RNA, 18 nt, Human
gaugaaguaucugcuuaa

SEQ ID NO: 1293472 - RNA, 18 nt, Human
gcagggaggcaggaaguc

SEQ ID NO: 1293473 - RNA, 24 nt, Human
gcaguaaacaaucuaugauccgga

SEQ ID NO: 1293474 - RNA, 24 nt, Human
uaaaaggaaaaaaaauccuagaaa

SEQ ID NO: 1293475 - RNA, 18 nt, Human
uaaaauuucaucaaggua

SEQ ID NO: 1293476 - RNA, 22 nt, Human
uauaaaaggaaaaaaaauccua

SEQ ID NO: 1293477 - RNA, 22 nt, Human
uauggaugaaguaucugcuuaa

SEQ ID NO: 1293478 - RNA, 23 nt, Human
ugaaaaaguaucauuuuaaaaca

SEQ ID NO: 1293479 - RNA, 24 nt, Human
uguaaaaauaaaaaauaaacauga

SEQ ID NO: 1293480 - RNA, 18 nt, Human
uuaaaaguaggaauuaga

SEQ ID NO: 1293481 - RNA, 25 nt, Human
aaagagugacaaggcaccaggacaa

SEQ ID NO: 1293482 - RNA, 20 nt, Human
aagaaccugucaggcagcac

SEQ ID NO: 1293483 - RNA, 22 nt, Human
aagagauggaucaaugaccaga

SEQ ID NO: 1293484 - RNA, 23 nt, Human
aaugaccagagacagggagagaa

SEQ ID NO: 1293485 - RNA, 22 nt, Human
agagaagaaccugucaggcagc

SEQ ID NO: 1293486 - RNA, 25 nt, Human
agagacagggagagaagaaccuguc

SEQ ID NO: 1293487 - RNA, 18 nt, Human
agaggagaauggagagga

SEQ ID NO: 1293488 - RNA, 19 nt, Human
agaugauaaagaaagaaug

SEQ ID NO: 1293489 - RNA, 19 nt, Human
aggagaagugaagacaucu

SEQ ID NO: 1293490 - RNA, 27 nt, Human
aggcuuuggagggagaugauccgacgg

SEQ ID NO: 1293491 - RNA, 18 nt, Human
agggcugaauacuauagu

SEQ ID NO: 1293492 - RNA, 22 nt, Human
caaagagauggaucaaugacca

SEQ ID NO: 1293493 - RNA, 23 nt, Human
caagaccuguuaggagucaggaa

SEQ ID NO: 1293494 - RNA, 21 nt, Human
caagauuacagaaagucaaag

SEQ ID NO: 1293495 - RNA, 28 nt, Human
cacaggaucacaagacugggaagguagg

SEQ ID NO: 1293496 - RNA, 21 nt, Human
caccaggacaagcagcucuga

SEQ ID NO: 1293497 - RNA, 23 nt, Human
cagaaagucaaagcagugucuca

SEQ ID NO: 1293498 - RNA, 23 nt, Human
cagagaaaggaaggggcuaaacc

SEQ ID NO: 1293499 - RNA, 19 nt, Human
cagagacagggagagaaga

SEQ ID NO: 1293500 - RNA, 18 nt, Human
caggaaccagccaaggag

SEQ ID NO: 1293501 - RNA, 18 nt, Human
ccacuccauuugcuggca

SEQ ID NO: 1293502 - RNA, 19 nt, Human
ccagccaaggagaagagga

SEQ ID NO: 1293503 - RNA, 20 nt, Human
ccagccaaggagaagaggag

SEQ ID NO: 1293504 - RNA, 23 nt, Human
cccagaccugggccagguuucca

SEQ ID NO: 1293505 - RNA, 21 nt, Human
ccucaucucaaaaaaugaggg

SEQ ID NO: 1293506 - RNA, 20 nt, Human
cuacagcaugaggggugcuc

SEQ ID NO: 1293507 - RNA, 22 nt, Human
cucugagaguggugagguccag

SEQ ID NO: 1293508 - RNA, 22 nt, Human
cuggucuuggcucugccucugg

SEQ ID NO: 1293509 - RNA, 19 nt, Human
gagaggaugguuggauacu

SEQ ID NO: 1293510 - RNA, 24 nt, Human
gagcccagagaaaggaaggggcua

SEQ ID NO: 1293511 - RNA, 20 nt, Human
gaggcaggaggacaagaggc

SEQ ID NO: 1293512 - RNA, 21 nt, Human
gcccagagaaaggaaggggcu

SEQ ID NO: 1293513 - RNA, 23 nt, Human
gcccagagaaaggaaggggcuaa

SEQ ID NO: 1293514 - RNA, 18 nt, Human
ggacaagaggcuuuggag

SEQ ID NO: 1293515 - RNA, 21 nt, Human
ggacaagaggcuuuggaggga

SEQ ID NO: 1293516 - RNA, 21 nt, Human
gggaagcagacugagcccaga

SEQ ID NO: 1293517 - RNA, 19 nt, Human
ggggugcucuagggaccac

SEQ ID NO: 1293518 - RNA, 24 nt, Human
uaaagagugacaaggcaccaggac

SEQ ID NO: 1293519 - RNA, 22 nt, Human
ucccucuucuugggaaugguuu

SEQ ID NO: 1293520 - RNA, 23 nt, Human
ugacaaggcaccaggacaagcag

SEQ ID NO: 1293521 - RNA, 26 nt, Human
ugagcccagagaaaggaaggggcuaa

SEQ ID NO: 1293522 - RNA, 18 nt, Human
ugaggucccucuucuugg

SEQ ID NO: 1293523 - RNA, 20 nt, Human
ugaguggugggaagcagacu

SEQ ID NO: 1293524 - RNA, 22 nt, Human
ugccucugguuugcgaugugac

SEQ ID NO: 1293525 - RNA, 20 nt, Human
ugggaagcagacugagccca

SEQ ID NO: 1293526 - RNA, 24 nt, Human
ugggaggacugagggcugaauagu

SEQ ID NO: 1293527 - RNA, 21 nt, Human
ugggccugauuccucaucuca

SEQ ID NO: 1293528 - RNA, 21 nt, Human
uugccagcugaggucccucuu

SEQ ID NO: 1293529 - RNA, 18 nt, Human
aaggagagagaagcagca

SEQ ID NO: 1293530 - RNA, 24 nt, Human
caaaaaugacugcuucagccaaag

SEQ ID NO: 1293531 - RNA, 22 nt, Human
caccuccugggaaaaugugcuc

SEQ ID NO: 1293532 - RNA, 18 nt, Human
cacgugcaggucacaggg

SEQ ID NO: 1293533 - RNA, 26 nt, Human
caggguagacucauuuucaauccauu

SEQ ID NO: 1293534 - RNA, 19 nt, Human
caucagaaaaggcaggaac

SEQ ID NO: 1293535 - RNA, 21 nt, Human
caucagaaaaggcaggaaccg

SEQ ID NO: 1293536 - RNA, 26 nt, Human
cucucaaaaaugacugcuucagccaa

SEQ ID NO: 1293537 - RNA, 19 nt, Human
cuucagccaaaggagagag

SEQ ID NO: 1293538 - RNA, 21 nt, Human
gaacaggccauuuucacuuca

SEQ ID NO: 1293539 - RNA, 23 nt, Human
gccaaaggagagagaagcagcaa

SEQ ID NO: 1293540 - RNA, 22 nt, Human
uauguucacacauacacucaug

SEQ ID NO: 1293541 - RNA, 20 nt, Human
ucaacugcaucaaaagagca

SEQ ID NO: 1293542 - RNA, 22 nt, Human
ugggaaaaugugcucucaaaaa

SEQ ID NO: 1293543 - RNA, 21 nt, Human
cacccagcaucgggucagugu

SEQ ID NO: 1293544 - RNA, 22 nt, Human
ucacccagcaucgggucagugu

SEQ ID NO: 1293545 - RNA, 21 nt, Human
ucaguguuguuugagggucug

SEQ ID NO: 1293546 - RNA, 22 nt, Human
uccuugguccucacccagcauc

SEQ ID NO: 1293547 - RNA, 25 nt, Human
accaagugcucccauaaugagaagc

SEQ ID NO: 1293548 - RNA, 19 nt, Human
agaagccauuccuagaacc

SEQ ID NO: 1293549 - RNA, 27 nt, Human
cccauaaugagaagccauuccuagaac

SEQ ID NO: 1293550 - RNA, 18 nt, Human
cuccggauccacucaauu

SEQ ID NO: 1293551 - RNA, 26 nt, Human
uaccuugaggccaauaucuccggcuc

SEQ ID NO: 1293552 - RNA, 21 nt, Human
uaguuuaauuuaaccaagugc

SEQ ID NO: 1293553 - RNA, 26 nt, Human
uaucuccggcuccggauccacucaau

SEQ ID NO: 1293554 - RNA, 18 nt, Human
ucuccggcuccggaucca

SEQ ID NO: 1293555 - RNA, 19 nt, Human
ucuccggcuccggauccac

SEQ ID NO: 1293556 - RNA, 19 nt, Human
aaacaaaccaaccacugug

SEQ ID NO: 1293557 - RNA, 19 nt, Human
aagcaugauuaaaccagug

SEQ ID NO: 1293558 - RNA, 20 nt, Human
aaucucucaucuucuuucuc

SEQ ID NO: 1293559 - RNA, 19 nt, Human
acccugaagcauauuaugg

SEQ ID NO: 1293560 - RNA, 25 nt, Human
agaauucagugaaaaccugcuccca

SEQ ID NO: 1293561 - RNA, 19 nt, Human
auguggauacccugugugc

SEQ ID NO: 1293562 - RNA, 22 nt, Human
cacaggccgaggaccgcagagc

SEQ ID NO: 1293563 - RNA, 23 nt, Human
cagugggggggccacaguuugcc

SEQ ID NO: 1293564 - RNA, 24 nt, Human
ccagcaaggcuaacuaaaucaaac

SEQ ID NO: 1293565 - RNA, 21 nt, Human
ccagugcagaaaaauacuaag

SEQ ID NO: 1293566 - RNA, 22 nt, Human
ccccagccaagcugcccggggc

SEQ ID NO: 1293567 - RNA, 22 nt, Human
ccccggaagccuagccccagcc

SEQ ID NO: 1293568 - RNA, 19 nt, Human
cccuaaguuaggguuccca

SEQ ID NO: 1293569 - RNA, 23 nt, Human
cccucagaauucagugaaaaccu

SEQ ID NO: 1293570 - RNA, 23 nt, Human
cuaacucaacaauguagcugcag

SEQ ID NO: 1293571 - RNA, 19 nt, Human
cuuucucuuuccccugccc

SEQ ID NO: 1293572 - RNA, 19 nt, Human
gcccaugaaagccacaaag

SEQ ID NO: 1293573 - RNA, 23 nt, Human
uaaaaacaaaacaaaccaaccac

SEQ ID NO: 1293574 - RNA, 20 nt, Human
uaacaaagacuucuggucag

SEQ ID NO: 1293575 - RNA, 25 nt, Human
uaacuaaaucaaacugugguuuaaa

SEQ ID NO: 1293576 - RNA, 19 nt, Human
uacaauaucaucacuaacu

SEQ ID NO: 1293577 - RNA, 22 nt, Human
ucccugcccaugaaagccacaa

SEQ ID NO: 1293578 - RNA, 19 nt, Human
ucucucaucuucuuucucu

SEQ ID NO: 1293579 - RNA, 23 nt, Human
ugaaagccacaaagagauuucuu

SEQ ID NO: 1293580 - RNA, 21 nt, Human
ugacagugggggggccacagu

SEQ ID NO: 1293581 - RNA, 24 nt, Human
ugcaggguaacauguggauacccu

SEQ ID NO: 1293582 - RNA, 20 nt, Human
ugccuuggaggacaugcaga

SEQ ID NO: 1293583 - RNA, 21 nt, Human
ugccuuggaggacaugcagag

SEQ ID NO: 1293584 - RNA, 27 nt, Human
uguagcugcaggguaacauguggauac

SEQ ID NO: 1293585 - RNA, 19 nt, Human
uuaaaccagugcagaaaaa

SEQ ID NO: 1293586 - RNA, 19 nt, Human
uuugccaaacuuugccuug

SEQ ID NO: 1293587 - RNA, 21 nt, Human
uuuguaauccaguuaagacca

SEQ ID NO: 1293588 - RNA, 18 nt, Human
uuuuacacacccugaagc

SEQ ID NO: 1293589 - RNA, 20 nt, Human
cacugcugcgaauccgggcc

SEQ ID NO: 1293590 - RNA, 25 nt, Human
ccugugaucaaaggcagccaccgac

SEQ ID NO: 1293591 - RNA, 18 nt, Human
cugcugcgaauccgggcc

SEQ ID NO: 1293592 - RNA, 21 nt, Human
cugugaucaaaggcagccacc

SEQ ID NO: 1293593 - RNA, 19 nt, Human
gccaccgacaggugcggga

SEQ ID NO: 1293594 - RNA, 22 nt, Human
ucaaaggcagccaccgacaggu

SEQ ID NO: 1293595 - RNA, 19 nt, Human
acaggaaugaggaaagaau

SEQ ID NO: 1293596 - RNA, 22 nt, Human
acaggaaugaggaaagaaugac

SEQ ID NO: 1293597 - RNA, 21 nt, Human
aggagggagacacaguucuga

SEQ ID NO: 1293598 - RNA, 18 nt, Human
cagcagaaccuuaacuga

SEQ ID NO: 1293599 - RNA, 22 nt, Human
cuucuugccgugucaucucucu

SEQ ID NO: 1293600 - RNA, 22 nt, Human
cuugccgugucaucucucuucu

SEQ ID NO: 1293601 - RNA, 23 nt, Human
gcagaaccuuaacugagugugac

SEQ ID NO: 1293602 - RNA, 21 nt, Human
gcaggagggagacacaguucu

SEQ ID NO: 1293603 - RNA, 21 nt, Human
ggucacaggaaugaggaaaga

SEQ ID NO: 1293604 - RNA, 24 nt, Human
ucacaggaaugaggaaagaaugac

SEQ ID NO: 1293605 - RNA, 18 nt, Human
ucaucucucuucucaggg

SEQ ID NO: 1293606 - RNA, 18 nt, Human
ugaggaaagaaugacucu

SEQ ID NO: 1293607 - RNA, 19 nt, Human
ugcaagcuucucuguucuc

SEQ ID NO: 1293608 - RNA, 22 nt, Human
ugcaagcuucucuguucucucc

SEQ ID NO: 1293609 - RNA, 22 nt, Human
uggcuccuagcagcagaaccuu

SEQ ID NO: 1293610 - RNA, 24 nt, Human
uuucucgcagauggucacaggaau

SEQ ID NO: 1293611 - RNA, 21 nt, Human
aaaagggaauccagagugagg

SEQ ID NO: 1293612 - RNA, 18 nt, Human
aggaaaagggaauccaga

SEQ ID NO: 1293613 - RNA, 20 nt, Human
aggaaaagggaauccagagu

SEQ ID NO: 1293614 - RNA, 22 nt, Human
augaagccaaggaccacugacc

SEQ ID NO: 1293615 - RNA, 26 nt, Human
augaagccaaggaccacugaccugac

SEQ ID NO: 1293616 - RNA, 22 nt, Human
caaggaccacugaccugaccga

SEQ ID NO: 1293617 - RNA, 23 nt, Human
caucccugagaugaagccaagga

SEQ ID NO: 1293618 - RNA, 20 nt, Human
ccugcaguguugcccaccac

SEQ ID NO: 1293619 - RNA, 20 nt, Human
cugagaugaagccaaggacc

SEQ ID NO: 1293620 - RNA, 18 nt, Human
gacuccacgucugcacag

SEQ ID NO: 1293621 - RNA, 20 nt, Human
uccagagugagguugccgac

SEQ ID NO: 1293622 - RNA, 18 nt, Human
ugaccugaccgauaaugg

SEQ ID NO: 1293623 - RNA, 24 nt, Human
ugaccugaccgauaauggaauucc

SEQ ID NO: 1293624 - RNA, 22 nt, Human
ugagaugaagccaaggaccacu

SEQ ID NO: 1293625 - RNA, 22 nt, Human
ugcacuguggcucgacaucugg

SEQ ID NO: 1293626 - RNA, 20 nt, Human
uugguucuauaaacguggag

SEQ ID NO: 1293627 - RNA, 23 nt, Human
aagaagacagcaugggcccacgc

SEQ ID NO: 1293628 - RNA, 23 nt, Human
accagugcccucccgugguccag

SEQ ID NO: 1293629 - RNA, 28 nt, Human
acccugagggacagugggugaagaggaa

SEQ ID NO: 1293630 - RNA, 19 nt, Human
agcaccagugcccucccgu

SEQ ID NO: 1293631 - RNA, 24 nt, Human
agggaugugaggaacuggacgcca

SEQ ID NO: 1293632 - RNA, 20 nt, Human
caccagugcccucccguggu

SEQ ID NO: 1293633 - RNA, 18 nt, Human
cagcggcuggacccugag

SEQ ID NO: 1293634 - RNA, 24 nt, Human
cagugggugaagaggaaggacccu

SEQ ID NO: 1293635 - RNA, 18 nt, Human
cccucccgugguccaggc

SEQ ID NO: 1293636 - RNA, 20 nt, Human
cuuuagcaccagugcccucc

SEQ ID NO: 1293637 - RNA, 20 nt, Human
gucacgugcuugaccagcug

SEQ ID NO: 1293638 - RNA, 25 nt, Human
ugacacauguacuaagaagacagca

SEQ ID NO: 1293639 - RNA, 22 nt, Human
ugugaggaacuggacgccagcg

SEQ ID NO: 1293640 - RNA, 22 nt, Human
uuaucagcuucgccucuccacu

SEQ ID NO: 1293641 - RNA, 24 nt, Human
acccuccacccccaggugagcauc

SEQ ID NO: 1293642 - RNA, 24 nt, Human
agcacccuccacccccaggugagc

SEQ ID NO: 1293643 - RNA, 19 nt, Human
cagaugcucaucugguggu

SEQ ID NO: 1293644 - RNA, 20 nt, Human
cagcacccuccacccccagg

SEQ ID NO: 1293645 - RNA, 25 nt, Human
cccccaggugagcaucugacagccu

SEQ ID NO: 1293646 - RNA, 18 nt, Human
ccuggcuggcaaaugauc

SEQ ID NO: 1293647 - RNA, 19 nt, Human
gcagguucugguugucaga

SEQ ID NO: 1293648 - RNA, 21 nt, Human
ggaggucagcacccuccaccc

SEQ ID NO: 1293649 - RNA, 18 nt, Human
ugccaucggaugcccacc

SEQ ID NO: 1293650 - RNA, 21 nt, Human
uguguggugcagguucugguu

SEQ ID NO: 1293651 - RNA, 23 nt, Human
uugucagaugcucaucugguggu

SEQ ID NO: 1293652 - RNA, 22 nt, Human
agccagccggugaggaaucagc

SEQ ID NO: 1293653 - RNA, 18 nt, Human
cagcugccgccagcucca

SEQ ID NO: 1293654 - RNA, 18 nt, Human
cagggaugccucuuccug

SEQ ID NO: 1293655 - RNA, 18 nt, Human
ccccagggaugccucuuc

SEQ ID NO: 1293656 - RNA, 19 nt, Human
ccuuggagagccccaggga

SEQ ID NO: 1293657 - RNA, 19 nt, Human
cuuggagagccccagggau

SEQ ID NO: 1293658 - RNA, 21 nt, Human
gcuggggaccagggcugggag

SEQ ID NO: 1293659 - RNA, 18 nt, Human
ggaggaugcacagagcca

SEQ ID NO: 1293660 - RNA, 20 nt, Human
ggaggaugcacagagccagc

SEQ ID NO: 1293661 - RNA, 23 nt, Human
ggcugggaggaugcacagagcca

SEQ ID NO: 1293662 - RNA, 22 nt, Human
ggcuggggaccagggcugggag

SEQ ID NO: 1293663 - RNA, 20 nt, Human
gggagggcuggggaccaggg

SEQ ID NO: 1293664 - RNA, 22 nt, Human
gggagggcuggggaccagggcu

SEQ ID NO: 1293665 - RNA, 19 nt, Human
uaccaauggcuguuucuag

SEQ ID NO: 1293666 - RNA, 23 nt, Human
uaggucaacaugagcuccuguaa

SEQ ID NO: 1293667 - RNA, 21 nt, Human
ucaguaccaauggcuguuucu

SEQ ID NO: 1293668 - RNA, 24 nt, Human
uccuguaaagggucucagggagug

SEQ ID NO: 1293669 - RNA, 20 nt, Human
ucgcugcagcugccgccagc

SEQ ID NO: 1293670 - RNA, 21 nt, Human
ucgcugcagcugccgccagcu

SEQ ID NO: 1293671 - RNA, 19 nt, Human
ucuguguuaaaauagccag

SEQ ID NO: 1293672 - RNA, 18 nt, Human
ugaguuugucccucugug

SEQ ID NO: 1293673 - RNA, 21 nt, Human
aaucagaaggcaaaaaucaaa

SEQ ID NO: 1293674 - RNA, 22 nt, Human
aggcaaaaaucaaaauuauuuc

SEQ ID NO: 1293675 - RNA, 23 nt, Human
aggcaaaaaucaaaauuauuuca

SEQ ID NO: 1293676 - RNA, 21 nt, Human
cagcagauauucucugggaac

SEQ ID NO: 1293677 - RNA, 23 nt, Human
gaaaauguuaaaagggcugagug

SEQ ID NO: 1293678 - RNA, 19 nt, Human
gaagaagacggugccuucg

SEQ ID NO: 1293679 - RNA, 24 nt, Human
guucuaccugaguuggaagaaggc

SEQ ID NO: 1293680 - RNA, 20 nt, Human
uaucagcagauauucucugg

SEQ ID NO: 1293681 - RNA, 18 nt, Human
ugaaaacagcaagacaaa

SEQ ID NO: 1293682 - RNA, 20 nt, Human
ugaaaacagcaagacaaaga

SEQ ID NO: 1293683 - RNA, 22 nt, Human
ugaaaacagcaagacaaagaca

SEQ ID NO: 1293684 - RNA, 21 nt, Human
uggcuuccggauaaacuucuu

SEQ ID NO: 1293685 - RNA, 24 nt, Human
uguauuagguuacaauuuugcaaa

SEQ ID NO: 1293686 - RNA, 21 nt, Human
uuaaaagggcugagugaaaac

SEQ ID NO: 1293687 - RNA, 21 nt, Human
uuacuuugaguuagagugagg

SEQ ID NO: 1293688 - RNA, 23 nt, Human
aaaccaaaagccggaguugggaa

SEQ ID NO: 1293689 - RNA, 19 nt, Human
aaagcccucuccggagccc

SEQ ID NO: 1293690 - RNA, 18 nt, Human
aagcccucuccggagccc

SEQ ID NO: 1293691 - RNA, 19 nt, Human
aagguggacacacaaaacc

SEQ ID NO: 1293692 - RNA, 18 nt, Human
acaaagcccucuccggag

SEQ ID NO: 1293693 - RNA, 20 nt, Human
acacaaaaccaaaagccgga

SEQ ID NO: 1293694 - RNA, 18 nt, Human
agcagccggggaggggcc

SEQ ID NO: 1293695 - RNA, 19 nt, Human
aggcucucuaagcccugcu

SEQ ID NO: 1293696 - RNA, 24 nt, Human
auaccuuuggaggugagacggccu

SEQ ID NO: 1293697 - RNA, 19 nt, Human
caaaagccggaguugggaa

SEQ ID NO: 1293698 - RNA, 22 nt, Human
caaaagccggaguugggaaaag

SEQ ID NO: 1293699 - RNA, 24 nt, Human
caagguggacacacaaaaccaaaa

SEQ ID NO: 1293700 - RNA, 19 nt, Human
cacacaaaaccaaaagccg

SEQ ID NO: 1293701 - RNA, 24 nt, Human
cagcaccagcagcucggcuuaagc

SEQ ID NO: 1293702 - RNA, 20 nt, Human
caggcucucuaagcccugcu

SEQ ID NO: 1293703 - RNA, 22 nt, Human
cagugugggacugcggcuggga

SEQ ID NO: 1293704 - RNA, 25 nt, Human
cccaccaccuucucaauuauucaca

SEQ ID NO: 1293705 - RNA, 22 nt, Human
cccccaacgccccccucauccc

SEQ ID NO: 1293706 - RNA, 19 nt, Human
ccccucaucccacggcucc

SEQ ID NO: 1293707 - RNA, 21 nt, Human
ccccucaucccacggcuccac

SEQ ID NO: 1293708 - RNA, 21 nt, Human
cccugucccccaacgcccccc

SEQ ID NO: 1293709 - RNA, 21 nt, Human
ccgccuuucaugccgcggccg

SEQ ID NO: 1293710 - RNA, 21 nt, Human
ccucaucccacggcuccacgg

SEQ ID NO: 1293711 - RNA, 18 nt, Human
ccucgccgccuuucaugc

SEQ ID NO: 1293712 - RNA, 23 nt, Human
ccugucccccaacgccccccuca

SEQ ID NO: 1293713 - RNA, 23 nt, Human
cggacucggcgcucagggucagc

SEQ ID NO: 1293714 - RNA, 21 nt, Human
cugcggcugggagcccgggcc

SEQ ID NO: 1293715 - RNA, 24 nt, Human
cugcucagaagucaagagcagcag

SEQ ID NO: 1293716 - RNA, 24 nt, Human
gaaaauucuuucucugaccaugcc

SEQ ID NO: 1293717 - RNA, 26 nt, Human
gagcagcagugcugccucuccucgcc

SEQ ID NO: 1293718 - RNA, 22 nt, Human
gcaagguggacacacaaaacca

SEQ ID NO: 1293719 - RNA, 24 nt, Human
gcagccggggaggggccgcgaggg

SEQ ID NO: 1293720 - RNA, 23 nt, Human
gccccccucaucccacggcucca

SEQ ID NO: 1293721 - RNA, 22 nt, Human
gcccgggcccuccgggagugaa

SEQ ID NO: 1293722 - RNA, 20 nt, Human
gcgaacaaagcccucuccgg

SEQ ID NO: 1293723 - RNA, 19 nt, Human
gggacuguugcaaacagcu

SEQ ID NO: 1293724 - RNA, 22 nt, Human
gggagcccgggcccuccgggag

SEQ ID NO: 1293725 - RNA, 20 nt, Human
gugaagauaccuuuggaggu

SEQ ID NO: 1293726 - RNA, 24 nt, Human
uaagcccugcucagaagucaagag

SEQ ID NO: 1293727 - RNA, 21 nt, Human
ucaggcucgcagcuccgcgcu

SEQ ID NO: 1293728 - RNA, 19 nt, Human
ucugaccaugccagacgcc

SEQ ID NO: 1293729 - RNA, 23 nt, Human
ucugccagcagccggggaggggc

SEQ ID NO: 1293730 - RNA, 18 nt, Human
ugagaauccauguggggu

SEQ ID NO: 1293731 - RNA, 23 nt, Human
ugcccugucccccaacgcccccc

SEQ ID NO: 1293732 - RNA, 26 nt, Human
ugcccugucccccaacgccccccuca

SEQ ID NO: 1293733 - RNA, 18 nt, Human
uggcgagagcgcgaacaa

SEQ ID NO: 1293734 - RNA, 19 nt, Human
uggcugaggaggcggcggg

SEQ ID NO: 1293735 - RNA, 24 nt, Human
uggggucggcuggcuccggaguug

SEQ ID NO: 1293736 - RNA, 25 nt, Human
uuugcccugucccccaacgcccccc

SEQ ID NO: 1293737 - RNA, 21 nt, Human
uuuggaggugagacggccucu

SEQ ID NO: 1293738 - RNA, 18 nt, Human
agacuuuggauggugggg

SEQ ID NO: 1293739 - RNA, 23 nt, Human
cugguacagacucauccaaaaag

SEQ ID NO: 1293740 - RNA, 21 nt, Human
ggugggggcaaaccccucuuu

SEQ ID NO: 1293741 - RNA, 23 nt, Human
guacagacucauccaaaaagcca

SEQ ID NO: 1293742 - RNA, 20 nt, Human
uagaauugccucugcuucuc

SEQ ID NO: 1293743 - RNA, 18 nt, Human
ugcagguacuuuucaucc

SEQ ID NO: 1293744 - RNA, 19 nt, Human
ugccucugcuucucagguc

SEQ ID NO: 1293745 - RNA, 20 nt, Human
uguagcguggccagcagggc

SEQ ID NO: 1293746 - RNA, 26 nt, Human
uuggauggugggggcaaaccccucuu

SEQ ID NO: 1293747 - RNA, 21 nt, Human
uugugguaaaauccagcugca

SEQ ID NO: 1293748 - RNA, 18 nt, Human
agacccggggggcaacaa

SEQ ID NO: 1293749 - RNA, 22 nt, Human
agagaggggggcagugugucca

SEQ ID NO: 1293750 - RNA, 21 nt, Human
agcagcgaguggucucagggc

SEQ ID NO: 1293751 - RNA, 20 nt, Human
agcugcagaguccgcagagg

SEQ ID NO: 1293752 - RNA, 21 nt, Human
aggcaagagaggggggcagug

SEQ ID NO: 1293753 - RNA, 18 nt, Human
caacaaucccaaaagaag

SEQ ID NO: 1293754 - RNA, 19 nt, Human
cccggggcaggggacuggc

SEQ ID NO: 1293755 - RNA, 22 nt, Human
cccgugcccucccucucccugc

SEQ ID NO: 1293756 - RNA, 19 nt, Human
ccgagcggguggggcgucu

SEQ ID NO: 1293757 - RNA, 21 nt, Human
ccugcgccggggccgcggagc

SEQ ID NO: 1293758 - RNA, 22 nt, Human
cgaguggucucagggcgcccaa

SEQ ID NO: 1293759 - RNA, 22 nt, Human
cgccuggacaccccccccguuc

SEQ ID NO: 1293760 - RNA, 21 nt, Human
cggcuggggugggaggauccg

SEQ ID NO: 1293761 - RNA, 20 nt, Human
cggggcaggggacuggcagc

SEQ ID NO: 1293762 - RNA, 24 nt, Human
gggcaggggacuggcagcagagga

SEQ ID NO: 1293763 - RNA, 20 nt, Human
ucccaacucgguaaagaccc

SEQ ID NO: 1293764 - RNA, 23 nt, Human
ucucagggcgcccaggacugguc

SEQ ID NO: 1293765 - RNA, 20 nt, Human
ucugcagagggugagagcag

SEQ ID NO: 1293766 - RNA, 23 nt, Human
uggaggcaagagaggggggcagu

SEQ ID NO: 1293767 - RNA, 21 nt, Human
ugggcuuugcccggggcaggg

SEQ ID NO: 1293768 - RNA, 24 nt, Human
uggggugggaggauccgccacucc

SEQ ID NO: 1293769 - RNA, 19 nt, Human
aagcaacucuggacagcca

SEQ ID NO: 1293770 - RNA, 22 nt, Human
agccagagaccaggugaggaca

SEQ ID NO: 1293771 - RNA, 23 nt, Human
agccagagaccaggugaggacaa

SEQ ID NO: 1293772 - RNA, 20 nt, Human
cacgauccggccagcaggau

SEQ ID NO: 1293773 - RNA, 19 nt, Human
cagaaucaaagacucuuac

SEQ ID NO: 1293774 - RNA, 21 nt, Human
ccgauccacacacaucgggug

SEQ ID NO: 1293775 - RNA, 19 nt, Human
cugggugggugcauguggc

SEQ ID NO: 1293776 - RNA, 24 nt, Human
gagagaucacagggugcaagucuc

SEQ ID NO: 1293777 - RNA, 18 nt, Human
gagggugcugggcgggug

SEQ ID NO: 1293778 - RNA, 23 nt, Human
gagggugcugggcgggugcaggu

SEQ ID NO: 1293779 - RNA, 20 nt, Human
gaucuccaacacggcaaucu

SEQ ID NO: 1293780 - RNA, 20 nt, Human
gcaggagaccaggugaguac

SEQ ID NO: 1293781 - RNA, 18 nt, Human
ggacaagguugcugggug

SEQ ID NO: 1293782 - RNA, 24 nt, Human
ggacagccagagaccaggugagga

SEQ ID NO: 1293783 - RNA, 24 nt, Human
uagaaaaauguuuacagugggcag

SEQ ID NO: 1293784 - RNA, 18 nt, Human
ucagaagaaagacaucca

SEQ ID NO: 1293785 - RNA, 21 nt, Human
uccacaugcagaauuugggau

SEQ ID NO: 1293786 - RNA, 18 nt, Human
uccgcagugcgguuccuc

SEQ ID NO: 1293787 - RNA, 18 nt, Human
ucugaggagagcugucgu

SEQ ID NO: 1293788 - RNA, 22 nt, Human
ucuggacagccagagaccaggu

SEQ ID NO: 1293789 - RNA, 21 nt, Human
ugauccgcagugcgguuccuc

SEQ ID NO: 1293790 - RNA, 18 nt, Human
ugcagguggcaucuguga

SEQ ID NO: 1293791 - RNA, 19 nt, Human
ugcugggugggugcaugug

SEQ ID NO: 1293792 - RNA, 18 nt, Human
ugggaugagugagagauc

SEQ ID NO: 1293793 - RNA, 24 nt, Human
ugggugcauguggcaucugcaaug

SEQ ID NO: 1293794 - RNA, 19 nt, Human
ugggugggugcauguggca

SEQ ID NO: 1293795 - RNA, 21 nt, Human
uguuuacagugggcagaauca

SEQ ID NO: 1293796 - RNA, 19 nt, Human
aaaaggacaguacacagag

SEQ ID NO: 1293797 - RNA, 22 nt, Human
aaaaggucaaagcaucauaaaa

SEQ ID NO: 1293798 - RNA, 18 nt, Human
aaggccccaaaaggucaa

SEQ ID NO: 1293799 - RNA, 23 nt, Human
acaaaaaaaggacaguacacaga

SEQ ID NO: 1293800 - RNA, 24 nt, Human
acuaagacaggaggauagugacuc

SEQ ID NO: 1293801 - RNA, 21 nt, Human
agacaaggcaguucaagggaa

SEQ ID NO: 1293802 - RNA, 18 nt, Human
agaggaaagggccuggcu

SEQ ID NO: 1293803 - RNA, 20 nt, Human
agccaggggaaagcacaggu

SEQ ID NO: 1293804 - RNA, 20 nt, Human
agcuagcccugggaagggaa

SEQ ID NO: 1293805 - RNA, 23 nt, Human
aggaggcagaagcagccagggga

SEQ ID NO: 1293806 - RNA, 21 nt, Human
agggggugaaggcaggcccag

SEQ ID NO: 1293807 - RNA, 20 nt, Human
agguagggcauggugggggg

SEQ ID NO: 1293808 - RNA, 19 nt, Human
aucagucaguguccagccu

SEQ ID NO: 1293809 - RNA, 24 nt, Human
auuuggcuugaaucagcauagucu

SEQ ID NO: 1293810 - RNA, 21 nt, Human
caaaaaaaggacaguacacag

SEQ ID NO: 1293811 - RNA, 21 nt, Human
caaagcaucauaaaauauagg

SEQ ID NO: 1293812 - RNA, 19 nt, Human
caagaaaagaggggacgau

SEQ ID NO: 1293813 - RNA, 21 nt, Human
caaggccccaaaaggucaaag

SEQ ID NO: 1293814 - RNA, 22 nt, Human
caaggccccaaaaggucaaagg

SEQ ID NO: 1293815 - RNA, 26 nt, Human
caauucccaagaaaagaggggacgau

SEQ ID NO: 1293816 - RNA, 18 nt, Human
cacuggggaaaugagggg

SEQ ID NO: 1293817 - RNA, 20 nt, Human
caguguccagccugagaagu

SEQ ID NO: 1293818 - RNA, 21 nt, Human
caucccccuagugcagucuca

SEQ ID NO: 1293819 - RNA, 21 nt, Human
ccaagaaaagaggggacgaug

SEQ ID NO: 1293820 - RNA, 21 nt, Human
ccagaacaaaaaaaggacaac

SEQ ID NO: 1293821 - RNA, 24 nt, Human
cccaaaaggucaaagcaucauaaa

SEQ ID NO: 1293822 - RNA, 19 nt, Human
cccagaacaaaaaaaggac

SEQ ID NO: 1293823 - RNA, 25 nt, Human
ccccugguugccuagugccuggucc

SEQ ID NO: 1293824 - RNA, 18 nt, Human
cuagcccugggaagggaa

SEQ ID NO: 1293825 - RNA, 18 nt, Human
gaaagcacagguacagga

SEQ ID NO: 1293826 - RNA, 22 nt, Human
gcccagaacaaaaaaaggacag

SEQ ID NO: 1293827 - RNA, 18 nt, Human
ggcaugguggggggugac

SEQ ID NO: 1293828 - RNA, 20 nt, Human
guuugucugugucccuacca

SEQ ID NO: 1293829 - RNA, 24 nt, Human
uacacagaggaaagggccuggcuu

SEQ ID NO: 1293830 - RNA, 24 nt, Human
uacaggacuauguuguggcuuccc

SEQ ID NO: 1293831 - RNA, 22 nt, Human
uacauagugauaugguuugucu

SEQ ID NO: 1293832 - RNA, 20 nt, Human
uacuuuauaaauuauccagu

SEQ ID NO: 1293833 - RNA, 23 nt, Human
uagaaccagugaaagauagauac

SEQ ID NO: 1293834 - RNA, 22 nt, Human
uagacagacagaugaauggaug

SEQ ID NO: 1293835 - RNA, 19 nt, Human
uagagugcaagaauggacu

SEQ ID NO: 1293836 - RNA, 23 nt, Human
uagagugcaagaauggacuaaua

SEQ ID NO: 1293837 - RNA, 22 nt, Human
uagauagacagacagaugaaug

SEQ ID NO: 1293838 - RNA, 23 nt, Human
uaggaauuagcuagcccugggaa

SEQ ID NO: 1293839 - RNA, 23 nt, Human
uaugacaggugugcucagauggc

SEQ ID NO: 1293840 - RNA, 24 nt, Human
ucagaauaacuccuauaucaguca

SEQ ID NO: 1293841 - RNA, 24 nt, Human
ucagagcuguagguacuaccccug

SEQ ID NO: 1293842 - RNA, 18 nt, Human
ucaguaggcucagagcug

SEQ ID NO: 1293843 - RNA, 20 nt, Human
uccagccugagaaguagaac

SEQ ID NO: 1293844 - RNA, 22 nt, Human
ucccaagaaaagaggggacgau

SEQ ID NO: 1293845 - RNA, 19 nt, Human
ucccuaccaaaaucucaug

SEQ ID NO: 1293846 - RNA, 21 nt, Human
uccucauccaucaaggcccca

SEQ ID NO: 1293847 - RNA, 19 nt, Human
uccugaggcuuccccagcc

SEQ ID NO: 1293848 - RNA, 22 nt, Human
ucuccuguuggccuugugaaga

SEQ ID NO: 1293849 - RNA, 21 nt, Human
ucucuaggaauuagcuagccc

SEQ ID NO: 1293850 - RNA, 20 nt, Human
ugaaagauagauacauagug

SEQ ID NO: 1293851 - RNA, 20 nt, Human
ugaagacaugucuugcuucu

SEQ ID NO: 1293852 - RNA, 19 nt, Human
ugaaggcaggcccagaaca

SEQ ID NO: 1293853 - RNA, 20 nt, Human
ugacugaaucauggggcugg

SEQ ID NO: 1293854 - RNA, 21 nt, Human
ugagaaguagaaccagugaaa

SEQ ID NO: 1293855 - RNA, 20 nt, Human
uggggaaaugagggggugaa

SEQ ID NO: 1293856 - RNA, 18 nt, Human
uggucacuggggaaauga

SEQ ID NO: 1293857 - RNA, 24 nt, Human
uggugguggugcuggaggggggau

SEQ ID NO: 1293858 - RNA, 24 nt, Human
ugucuugcuucuucuucaccuuca

SEQ ID NO: 1293859 - RNA, 24 nt, Human
uuccugaggcuuccccagccaugc

SEQ ID NO: 1293860 - RNA, 25 nt, Human
uuccugaggcuuccccagccaugcc

SEQ ID NO: 1293861 - RNA, 18 nt, Human
uucuccuuucacucacug

SEQ ID NO: 1293862 - RNA, 23 nt, Human
uuggccuugugaagacaugucuu

SEQ ID NO: 1293863 - RNA, 25 nt, Human
uuuaauacaccuacuggcuaugguc

SEQ ID NO: 1293864 - RNA, 19 nt, Human
aaaauuauaaauguaggcu

SEQ ID NO: 1293865 - RNA, 18 nt, Human
aaguagcugggauuacag

SEQ ID NO: 1293866 - RNA, 26 nt, Human
aaguagcugggauuacagccacaugc

SEQ ID NO: 1293867 - RNA, 21 nt, Human
aaugcaguggugcgaucucag

SEQ ID NO: 1293868 - RNA, 24 nt, Human
aaugcaguggugcgaucucagcuc

SEQ ID NO: 1293869 - RNA, 24 nt, Human
aauuuaguagagaugggguuucac

SEQ ID NO: 1293870 - RNA, 24 nt, Human
aauuuuuguaauuuaguagagaug

SEQ ID NO: 1293871 - RNA, 18 nt, Human
accauguuggccaggcug

SEQ ID NO: 1293872 - RNA, 24 nt, Human
acucugucgcccaggcuggaaugc

SEQ ID NO: 1293873 - RNA, 20 nt, Human
agcacucugggaggcugagg

SEQ ID NO: 1293874 - RNA, 21 nt, Human
aggcaccacgucuggccccaa

SEQ ID NO: 1293875 - RNA, 22 nt, Human
aggcugggcgcgguggcucacg

SEQ ID NO: 1293876 - RNA, 22 nt, Human
agguacaauuuucccaaaauuu

SEQ ID NO: 1293877 - RNA, 22 nt, Human
aguagagaugggguuucaccau

SEQ ID NO: 1293878 - RNA, 24 nt, Human
aguggugcgaucucagcucacugc

SEQ ID NO: 1293879 - RNA, 20 nt, Human
aguucaagugacucuccugc

SEQ ID NO: 1293880 - RNA, 22 nt, Human
augggguuucaccauguuggcc

SEQ ID NO: 1293881 - RNA, 23 nt, Human
augggguuucaccauguuggcca

SEQ ID NO: 1293882 - RNA, 24 nt, Human
augggguuucaccauguuggccag

SEQ ID NO: 1293883 - RNA, 22 nt, Human
caagugacucuccugccucagc

SEQ ID NO: 1293884 - RNA, 27 nt, Human
caagugacucuccugccucagccuccc

SEQ ID NO: 1293885 - RNA, 19 nt, Human
caagugauccacccccacc

SEQ ID NO: 1293886 - RNA, 24 nt, Human
caccaugcccagcuaauuuuugua

SEQ ID NO: 1293887 - RNA, 21 nt, Human
caccauguuggccaggcuggu

SEQ ID NO: 1293888 - RNA, 24 nt, Human
caccauguuggccaggcuggucuc

SEQ ID NO: 1293889 - RNA, 27 nt, Human
caccauguuggccaggcuggucucaaa

SEQ ID NO: 1293890 - RNA, 24 nt, Human
cacgccuguaaucccagcacucug

SEQ ID NO: 1293891 - RNA, 22 nt, Human
cacgucuggccccaauuugcuu

SEQ ID NO: 1293892 - RNA, 22 nt, Human
cacucugucgcccaggcuggaa

SEQ ID NO: 1293893 - RNA, 19 nt, Human
cacugcagucucuggcucc

SEQ ID NO: 1293894 - RNA, 24 nt, Human
cagcacucugggaggcugaggcgg

SEQ ID NO: 1293895 - RNA, 24 nt, Human
cauguuggccaggcuggucucaaa

SEQ ID NO: 1293896 - RNA, 19 nt, Human
cccaaguagcugggauuac

SEQ ID NO: 1293897 - RNA, 21 nt, Human
cccccaccuaggucucccaaa

SEQ ID NO: 1293898 - RNA, 24 nt, Human
ccugaccucaagugauccaccccc

SEQ ID NO: 1293899 - RNA, 24 nt, Human
ccugaccucaagugauccaccccc

SEQ ID NO: 1293900 - RNA, 23 nt, Human
ccugaguucaagugacucuccug

SEQ ID NO: 1293901 - RNA, 23 nt, Human
ccugccucagccucccaaguagc

SEQ ID NO: 1293902 - RNA, 18 nt, Human
ccuguaaucccagcacuc

SEQ ID NO: 1293903 - RNA, 24 nt, Human
cgccuguaaucccagcacucuggg

SEQ ID NO: 1293904 - RNA, 18 nt, Human
cucaagugauccaccccc

SEQ ID NO: 1293905 - RNA, 19 nt, Human
cucaagugauccacccccc

SEQ ID NO: 1293906 - RNA, 23 nt, Human
cucacgccuguaaucccagcacu

SEQ ID NO: 1293907 - RNA, 24 nt, Human
cucacgccuguaaucccagcacuc

SEQ ID NO: 1293908 - RNA, 21 nt, Human
cucacugcagucucuggcucc

SEQ ID NO: 1293909 - RNA, 23 nt, Human
cucagccucccaaguagcuggga

SEQ ID NO: 1293910 - RNA, 19 nt, Human
cuccugaguucaagugacu

SEQ ID NO: 1293911 - RNA, 27 nt, Human
cucuccugccucagccucccaaguagc

SEQ ID NO: 1293912 - RNA, 23 nt, Human
cugccucagccucccaaguagcu

SEQ ID NO: 1293913 - RNA, 23 nt, Human
cuguuuuguuuuuaaacaucaua

SEQ ID NO: 1293914 - RNA, 18 nt, Human
gaccucaagugauccacc

SEQ ID NO: 1293915 - RNA, 20 nt, Human
gagaugggguuucaccaugu

SEQ ID NO: 1293916 - RNA, 24 nt, Human
gagaugggguuucaccauguuggc

SEQ ID NO: 1293917 - RNA, 24 nt, Human
gauuacagccacaugccaccaugc

SEQ ID NO: 1293918 - RNA, 20 nt, Human
gcccaggcuggaaugcagug

SEQ ID NO: 1293919 - RNA, 23 nt, Human
gcuggucucaaacuccugaccuc

SEQ ID NO: 1293920 - RNA, 23 nt, Human
ggcgcgguggcucacgccuguaa

SEQ ID NO: 1293921 - RNA, 21 nt, Human
ggcucacgccuguaaucccag

SEQ ID NO: 1293922 - RNA, 24 nt, Human
ggcuggucucaaacuccugaccuc

SEQ ID NO: 1293923 - RNA, 22 nt, Human
gggguuucaccauguuggccag

SEQ ID NO: 1293924 - RNA, 22 nt, Human
ggguuucaccauguuggccagg

SEQ ID NO: 1293925 - RNA, 18 nt, Human
gguaaaagagaaugaaaa

SEQ ID NO: 1293926 - RNA, 23 nt, Human
gguggcucacgccuguaauccca

SEQ ID NO: 1293927 - RNA, 24 nt, Human
gguggcucacgccuguaaucccag

SEQ ID NO: 1293928 - RNA, 23 nt, Human
guagagaugggguuucaccaugu

SEQ ID NO: 1293929 - RNA, 24 nt, Human
gugacucuccugccucagccuccc

SEQ ID NO: 1293930 - RNA, 26 nt, Human
gugauccacccccaccuaggucuccc

SEQ ID NO: 1293931 - RNA, 23 nt, Human
guggcucacgccuguaaucccag

SEQ ID NO: 1293932 - RNA, 23 nt, Human
uaauuuuuguaauuuaguagaga

SEQ ID NO: 1293933 - RNA, 22 nt, Human
uacagccacaugccaccaugcc

SEQ ID NO: 1293934 - RNA, 22 nt, Human
uaccaagguuagugcucauauu

SEQ ID NO: 1293935 - RNA, 22 nt, Human
uagagaugggguuucaccaugu

SEQ ID NO: 1293936 - RNA, 24 nt, Human
uaguagagaugggguuucaccaug

SEQ ID NO: 1293937 - RNA, 26 nt, Human
uaguagagaugggguuucaccauguu

SEQ ID NO: 1293938 - RNA, 24 nt, Human
uauguaaugaaacuaauacacuga

SEQ ID NO: 1293939 - RNA, 19 nt, Human
ucacugcagucucuggcuc

SEQ ID NO: 1293940 - RNA, 20 nt, Human
ucacugcagucucuggcucc

SEQ ID NO: 1293941 - RNA, 22 nt, Human
ucacugcagucucuggcuccug

SEQ ID NO: 1293942 - RNA, 18 nt, Human
ucagccucccaaguagcu

SEQ ID NO: 1293943 - RNA, 20 nt, Human
ucagccucccaaguagcugg

SEQ ID NO: 1293944 - RNA, 23 nt, Human
uccacccccaccuaggucuccca

SEQ ID NO: 1293945 - RNA, 23 nt, Human
ucccaaguagcugggauuacagc

SEQ ID NO: 1293946 - RNA, 21 nt, Human
uccugaguucaagugacucuc

SEQ ID NO: 1293947 - RNA, 24 nt, Human
uccugaguucaagugacucuccug

SEQ ID NO: 1293948 - RNA, 22 nt, Human
ucgcccaggcuggaaugcagug

SEQ ID NO: 1293949 - RNA, 22 nt, Human
ucucacucugucgcccaggcug

SEQ ID NO: 1293950 - RNA, 23 nt, Human
ucucacucugucgcccaggcugg

SEQ ID NO: 1293951 - RNA, 24 nt, Human
ucucacucugucgcccaggcugga

SEQ ID NO: 1293952 - RNA, 26 nt, Human
ucucacucugucgcccaggcuggaau

SEQ ID NO: 1293953 - RNA, 27 nt, Human
ucucacucugucgcccaggcuggaaug

SEQ ID NO: 1293954 - RNA, 23 nt, Human
ucucuggcuccugaguucaagug

SEQ ID NO: 1293955 - RNA, 24 nt, Human
ucugucgcccaggcuggaaugcag

SEQ ID NO: 1293956 - RNA, 22 nt, Human
ugaccucaagugauccaccccc

SEQ ID NO: 1293957 - RNA, 18 nt, Human
ugagacagagucucacuc

SEQ ID NO: 1293958 - RNA, 22 nt, Human
ugagacagagucucacucuguc

SEQ ID NO: 1293959 - RNA, 18 nt, Human
ugagauugcaggcgugag

SEQ ID NO: 1293960 - RNA, 23 nt, Human
ugagauugcaggcgugaggcacc

SEQ ID NO: 1293961 - RNA, 24 nt, Human
ugagauugcaggcgugaggcacca

SEQ ID NO: 1293962 - RNA, 24 nt, Human
ugccucagccucccaaguagcugg

SEQ ID NO: 1293963 - RNA, 24 nt, Human
uggaaugcaguggugcgaucucag

SEQ ID NO: 1293964 - RNA, 24 nt, Human
uggccaggcuggucucaaacuccu

SEQ ID NO: 1293965 - RNA, 24 nt, Human
uggcucacgccuguaaucccagca

SEQ ID NO: 1293966 - RNA, 28 nt, Human
uggcuccugaguucaagugacucuccuu

SEQ ID NO: 1293967 - RNA, 19 nt, Human
ugggaggcugaggcgggug

SEQ ID NO: 1293968 - RNA, 20 nt, Human
ugggaggcugaggcgggugg

SEQ ID NO: 1293969 - RNA, 24 nt, Human
ugggauuacagccacaugccacca

SEQ ID NO: 1293970 - RNA, 25 nt, Human
ugggauuacagccacaugccaccau

SEQ ID NO: 1293971 - RNA, 24 nt, Human
ugggguuucaccauguuggccagg

SEQ ID NO: 1293972 - RNA, 24 nt, Human
uggugcgaucucagcucacugcag

SEQ ID NO: 1293973 - RNA, 18 nt, Human
uuaguagagaugggguuu

SEQ ID NO: 1293974 - RNA, 22 nt, Human
uuaguagagaugggguuucacc

SEQ ID NO: 1293975 - RNA, 24 nt, Human
uuaguagagaugggguuucaccau

SEQ ID NO: 1293976 - RNA, 23 nt, Human
uucaagugacucuccugccucag

SEQ ID NO: 1293977 - RNA, 24 nt, Human
uucaagugacucuccugccucagc

SEQ ID NO: 1293978 - RNA, 20 nt, Human
uucuccuauguaaugaaacu

SEQ ID NO: 1293979 - RNA, 21 nt, Human
uucugcagguacaauuuuccc

SEQ ID NO: 1293980 - RNA, 24 nt, Human
uuucaccauguuggccaggcuggu

SEQ ID NO: 1293981 - RNA, 19 nt, Human
uuuuuguaauuuaguagag

SEQ ID NO: 1293982 - RNA, 23 nt, Human
aaacauacaacuucucaagaugc

SEQ ID NO: 1293983 - RNA, 26 nt, Human
aaagaagaaaaagaaaauguagaaaa

SEQ ID NO: 1293984 - RNA, 24 nt, Human
aaccugggugacagagcaagacuc

SEQ ID NO: 1293985 - RNA, 22 nt, Human
aagaaaaagaaaauguagaaaa

SEQ ID NO: 1293986 - RNA, 18 nt, Human
aagaagaaaaagaaaaug

SEQ ID NO: 1293987 - RNA, 19 nt, Human
aagaagaaaaagaaaaugu

SEQ ID NO: 1293988 - RNA, 22 nt, Human
aagaagaaaaagaaaauguaga

SEQ ID NO: 1293989 - RNA, 24 nt, Human
acagagcaagacuccaucucaaaa

SEQ ID NO: 1293990 - RNA, 20 nt, Human
accgagaucacaccacugca

SEQ ID NO: 1293991 - RNA, 23 nt, Human
accugggugacagagcaagacuc

SEQ ID NO: 1293992 - RNA, 18 nt, Human
acugcacuccaaccuggg

SEQ ID NO: 1293993 - RNA, 24 nt, Human
acugcacuccaaccugggugacag

SEQ ID NO: 1293994 - RNA, 21 nt, Human
aggcggagguugcagugaacc

SEQ ID NO: 1293995 - RNA, 24 nt, Human
aggcggagguugcagugaaccgag

SEQ ID NO: 1293996 - RNA, 24 nt, Human
aucacaccacugcacuccaaccug

SEQ ID NO: 1293997 - RNA, 19 nt, Human
caacucucaguuccaauuu

SEQ ID NO: 1293998 - RNA, 23 nt, Human
caagacuccaucucaaaagaaga

SEQ ID NO: 1293999 - RNA, 26 nt, Human
caccacugcacuccaaccugggugac

SEQ ID NO: 1294000 - RNA, 23 nt, Human
cacuccaaccugggugacagagc

SEQ ID NO: 1294001 - RNA, 23 nt, Human
cacugcacuccaaccugggugac

SEQ ID NO: 1294002 - RNA, 24 nt, Human
cacugcacuccaaccugggugaca

SEQ ID NO: 1294003 - RNA, 20 nt, Human
ccacugcacuccaaccuggg

SEQ ID NO: 1294004 - RNA, 24 nt, Human
ccacugcacuccaaccugggugac

SEQ ID NO: 1294005 - RNA, 25 nt, Human
ccacugcacuccaaccugggugaca

SEQ ID NO: 1294006 - RNA, 18 nt, Human
cguaagcuucuucuuuac

SEQ ID NO: 1294007 - RNA, 22 nt, Human
gagguugcagugaaccgagauc

SEQ ID NO: 1294008 - RNA, 18 nt, Human
ggagguugcagugaaccg

SEQ ID NO: 1294009 - RNA, 24 nt, Human
ggagguugcagugaaccgagauca

SEQ ID NO: 1294010 - RNA, 23 nt, Human
ucacaccacugcacuccaaccug

SEQ ID NO: 1294011 - RNA, 24 nt, Human
uccaucucaaaagaagaaaaagaa

SEQ ID NO: 1294012 - RNA, 18 nt, Human
ucucaaaagaagaaaaag

SEQ ID NO: 1294013 - RNA, 23 nt, Human
ugcaaaauuuccaacugauuuug

SEQ ID NO: 1294014 - RNA, 18 nt, Human
ugcagcaaaauuuacaaa

SEQ ID NO: 1294015 - RNA, 20 nt, Human
uugcagugaaccgagaucac

SEQ ID NO: 1294016 - RNA, 22 nt, Human
aaaauacacuucaaagcuaugg

SEQ ID NO: 1294017 - RNA, 23 nt, Human
aaaauacugagaguugcuucccu

SEQ ID NO: 1294018 - RNA, 20 nt, Human
aaacaaacaaacaaauacag

SEQ ID NO: 1294019 - RNA, 22 nt, Human
aaacucaaccauccacaaauua

SEQ ID NO: 1294020 - RNA, 25 nt, Human
aaagaacugugcccuaaaauguaaa

SEQ ID NO: 1294021 - RNA, 18 nt, Human
aaauaacaaggcucuaaa

SEQ ID NO: 1294022 - RNA, 24 nt, Human
aacacaggacaaauucccauucuu

SEQ ID NO: 1294023 - RNA, 23 nt, Human
aaccauuuugaucaaaggugauc

SEQ ID NO: 1294024 - RNA, 18 nt, Human
aauauggguagggaugag

SEQ ID NO: 1294025 - RNA, 22 nt, Human
acagacaggacacauggcagug

SEQ ID NO: 1294026 - RNA, 19 nt, Human
acagagaaaaacaaacaaa

SEQ ID NO: 1294027 - RNA, 21 nt, Human
accauucaaaaaaguucucca

SEQ ID NO: 1294028 - RNA, 22 nt, Human
accuggugaguggguuuuauga

SEQ ID NO: 1294029 - RNA, 23 nt, Human
agaaaaacaaacaaacaaacaaa

SEQ ID NO: 1294030 - RNA, 24 nt, Human
agaccccaaguguucccaguucuc

SEQ ID NO: 1294031 - RNA, 24 nt, Human
agagaaaaacaaacaaacaaacaa

SEQ ID NO: 1294032 - RNA, 23 nt, Human
aggauacgcacucucugguguuu

SEQ ID NO: 1294033 - RNA, 21 nt, Human
agggggagaagcagauggagc

SEQ ID NO: 1294034 - RNA, 22 nt, Human
auacacuucaaagcuauggccc

SEQ ID NO: 1294035 - RNA, 19 nt, Human
aucaaguacuagauagggc

SEQ ID NO: 1294036 - RNA, 19 nt, Human
aucacuuuuuggagaaaca

SEQ ID NO: 1294037 - RNA, 23 nt, Human
aucacuuuuuggagaaacauaca

SEQ ID NO: 1294038 - RNA, 20 nt, Human
auggagcaucuccuucacug

SEQ ID NO: 1294039 - RNA, 21 nt, Human
caaaauaaaaacaucaacauc

SEQ ID NO: 1294040 - RNA, 27 nt, Human
caaaauacugagaguugcuucccuaug

SEQ ID NO: 1294041 - RNA, 23 nt, Human
caaacuccaccaaauacucugaa

SEQ ID NO: 1294042 - RNA, 22 nt, Human
caaauaguucacuuugcuuggg

SEQ ID NO: 1294043 - RNA, 23 nt, Human
caagaaagggacaaaaacaacua

SEQ ID NO: 1294044 - RNA, 25 nt, Human
cacagagaaaaacaaacaaacaaac

SEQ ID NO: 1294045 - RNA, 25 nt, Human
cacauggcagugcacuauucaaaau

SEQ ID NO: 1294046 - RNA, 20 nt, Human
cacuguaacuaaaagaaagc

SEQ ID NO: 1294047 - RNA, 26 nt, Human
cagcaaugccucguauuccacaacca

SEQ ID NO: 1294048 - RNA, 20 nt, Human
caguucuccuucuaaguaac

SEQ ID NO: 1294049 - RNA, 18 nt, Human
cauacauauauauacaua

SEQ ID NO: 1294050 - RNA, 19 nt, Human
caucacagagaaaaacaaa

SEQ ID NO: 1294051 - RNA, 23 nt, Human
ccagaacacaggacaaauuccca

SEQ ID NO: 1294052 - RNA, 20 nt, Human
cccaaauauaguuaacuucu

SEQ ID NO: 1294053 - RNA, 21 nt, Human
ccccagacacuaaagcaagcu

SEQ ID NO: 1294054 - RNA, 21 nt, Human
ccuaugcucaacauccauagg

SEQ ID NO: 1294055 - RNA, 19 nt, Human
ccugaggccaaauucuacu

SEQ ID NO: 1294056 - RNA, 22 nt, Human
cgaaaaacagcauucugacuaa

SEQ ID NO: 1294057 - RNA, 20 nt, Human
cuacaagguuaacccucaac

SEQ ID NO: 1294058 - RNA, 18 nt, Human
cucaucacagagaaaaac

SEQ ID NO: 1294059 - RNA, 20 nt, Human
cuggcuucuuuaccuugacu

SEQ ID NO: 1294060 - RNA, 21 nt, Human
cugugcuuagccauauuuagc

SEQ ID NO: 1294061 - RNA, 21 nt, Human
gaaaaacagcauucugacuaa

SEQ ID NO: 1294062 - RNA, 20 nt, Human
gaaaagauucuaccaccuuc

SEQ ID NO: 1294063 - RNA, 24 nt, Human
gagaaaaacaaacaaacaaacaaa

SEQ ID NO: 1294064 - RNA, 18 nt, Human
gagaaugguaauucuucu

SEQ ID NO: 1294065 - RNA, 24 nt, Human
gagcacugaccucaucacagagaa

SEQ ID NO: 1294066 - RNA, 23 nt, Human
gcaaucaucugcauuuuuaccac

SEQ ID NO: 1294067 - RNA, 25 nt, Human
gcagugcacuauucaaaaugcuuug

SEQ ID NO: 1294068 - RNA, 22 nt, Human
gcgaacucagguaaauggaaau

SEQ ID NO: 1294069 - RNA, 21 nt, Human
gcucuaaaagcagaauuauuu

SEQ ID NO: 1294070 - RNA, 20 nt, Human
ggaauccuuucuacauaccc

SEQ ID NO: 1294071 - RNA, 21 nt, Human
guaaaauagucuuucucccau

SEQ ID NO: 1294072 - RNA, 20 nt, Human
guaagaauuuuuugguuggg

SEQ ID NO: 1294073 - RNA, 20 nt, Human
guacucugggaagguuugaa

SEQ ID NO: 1294074 - RNA, 23 nt, Human
gugaaaauuaaacaccuaguucg

SEQ ID NO: 1294075 - RNA, 21 nt, Human
gugcucuuaugaccugugcuu

SEQ ID NO: 1294076 - RNA, 22 nt, Human
guugugaguggcugauaggggu

SEQ ID NO: 1294077 - RNA, 21 nt, Human
uaaaaagccugcaaaccccau

SEQ ID NO: 1294078 - RNA, 23 nt, Human
uaaaauaacaaggcucuaaaagc

SEQ ID NO: 1294079 - RNA, 19 nt, Human
uaaaaucuuuggcugacau

SEQ ID NO: 1294080 - RNA, 21 nt, Human
uaaaauggaagauucaggccc

SEQ ID NO: 1294081 - RNA, 21 nt, Human
uaacauagacgacugugugaa

SEQ ID NO: 1294082 - RNA, 20 nt, Human
uaacuaaaagaaagcaaacc

SEQ ID NO: 1294083 - RNA, 20 nt, Human
uaagaggcugaaaagauucu

SEQ ID NO: 1294084 - RNA, 21 nt, Human
uaaggagaaaagcaaagggua

SEQ ID NO: 1294085 - RNA, 23 nt, Human
uaaggagaaaagcaaaggguaaa

SEQ ID NO: 1294086 - RNA, 22 nt, Human
uaaguagggcaagauauaauau

SEQ ID NO: 1294087 - RNA, 22 nt, Human
uacaaacucaaccauccacaaa

SEQ ID NO: 1294088 - RNA, 24 nt, Human
uacagcaagagaaagggggagaag

SEQ ID NO: 1294089 - RNA, 25 nt, Human
uacagcaagagaaagggggagaagc

SEQ ID NO: 1294090 - RNA, 23 nt, Human
uagauagggcuuuuucuugaaag

SEQ ID NO: 1294091 - RNA, 21 nt, Human
uaggaccaaauuuggaaaggu

SEQ ID NO: 1294092 - RNA, 19 nt, Human
uaggaugcuaauaaacccu

SEQ ID NO: 1294093 - RNA, 21 nt, Human
ucaaauucaaacuccaccaaa

SEQ ID NO: 1294094 - RNA, 18 nt, Human
ucagagcacugaccucau

SEQ ID NO: 1294095 - RNA, 20 nt, Human
ucauaugaucuaaaccugaa

SEQ ID NO: 1294096 - RNA, 24 nt, Human
ucccuuuuuccucuuacuaaaagu

SEQ ID NO: 1294097 - RNA, 21 nt, Human
ucuaaaccugaacacauggau

SEQ ID NO: 1294098 - RNA, 23 nt, Human
ucuccaauaaccaucuucuuuaa

SEQ ID NO: 1294099 - RNA, 22 nt, Human
ucucugguguuucugcacgcuu

SEQ ID NO: 1294100 - RNA, 22 nt, Human
ucugcaaccuacaagguuaacc

SEQ ID NO: 1294101 - RNA, 19 nt, Human
ucuggggggaaaaaugauu

SEQ ID NO: 1294102 - RNA, 24 nt, Human
ucuuaugaccugugcuuagccaua

SEQ ID NO: 1294103 - RNA, 18 nt, Human
ucuucaccauaaaaagcc

SEQ ID NO: 1294104 - RNA, 19 nt, Human
ucuucaguaauuuuccuca

SEQ ID NO: 1294105 - RNA, 28 nt, Human
ugaaaaaaauuccuggaaaccaaagaag

SEQ ID NO: 1294106 - RNA, 20 nt, Human
ugaaauauuuuuuugucccc

SEQ ID NO: 1294107 - RNA, 20 nt, Human
ugaaaucugacuuuuuacuu

SEQ ID NO: 1294108 - RNA, 24 nt, Human
ugaacaggaggcugacaaacaagg

SEQ ID NO: 1294109 - RNA, 23 nt, Human
ugaccugaggccaaauucuacuc

SEQ ID NO: 1294110 - RNA, 19 nt, Human
ugaguaaaaggagugagga

SEQ ID NO: 1294111 - RNA, 25 nt, Human
ugccauuguccaauagaauuuuuca

SEQ ID NO: 1294112 - RNA, 22 nt, Human
ugccuguggcauuauauaauga

SEQ ID NO: 1294113 - RNA, 23 nt, Human
ugcucaacauccauaggaccaaa

SEQ ID NO: 1294114 - RNA, 19 nt, Human
ugcucagcaaaauaaaaac

SEQ ID NO: 1294115 - RNA, 21 nt, Human
ugcucugcacugcacagguaa

SEQ ID NO: 1294116 - RNA, 18 nt, Human
uggaaaguuuggcaacag

SEQ ID NO: 1294117 - RNA, 24 nt, Human
uggcagugcacuauucaaaaugcu

SEQ ID NO: 1294118 - RNA, 18 nt, Human
uggccugguacaggggga

SEQ ID NO: 1294119 - RNA, 18 nt, Human
uggcugaaaucaguugcu

SEQ ID NO: 1294120 - RNA, 23 nt, Human
ugguuuuaucacuuuuuggagaa

SEQ ID NO: 1294121 - RNA, 18 nt, Human
uguaauaguagugaaggu

SEQ ID NO: 1294122 - RNA, 20 nt, Human
uguaauaugcuauuaccuua

SEQ ID NO: 1294123 - RNA, 21 nt, Human
uguacucugggaagguuugaa

SEQ ID NO: 1294124 - RNA, 18 nt, Human
ugugcacaagaaaugaaa

SEQ ID NO: 1294125 - RNA, 19 nt, Human
ugugcacaagaaaugaaau

SEQ ID NO: 1294126 - RNA, 25 nt, Human
ugugcacaagaaaugaaaucuauuu

SEQ ID NO: 1294127 - RNA, 26 nt, Human
ugugcacaagaaaugaaaucuauuuc

SEQ ID NO: 1294128 - RNA, 25 nt, Human
uguucuuacaaacucaaccauccac

SEQ ID NO: 1294129 - RNA, 27 nt, Human
uuagccccaaagaacugugcccuaaaa

SEQ ID NO: 1294130 - RNA, 21 nt, Human
uuauucccagaacacaggaca

SEQ ID NO: 1294131 - RNA, 21 nt, Human
uucaaaaucagagcacugacc

SEQ ID NO: 1294132 - RNA, 21 nt, Human
uucacagacaggacacauggc

SEQ ID NO: 1294133 - RNA, 21 nt, Human
uucccagaacacaggacaaaa

SEQ ID NO: 1294134 - RNA, 19 nt, Human
uugaauuaaaugugaaugg

SEQ ID NO: 1294135 - RNA, 18 nt, Human
uugauuuaugaaggguuu

SEQ ID NO: 1294136 - RNA, 22 nt, Human
uuuaucacuuuuuggagaaaca

SEQ ID NO: 1294137 - RNA, 23 nt, Human
uuucuaagccucuucaauuauua

SEQ ID NO: 1294138 - RNA, 19 nt, Human
uuugaaaaaaauuccugga

SEQ ID NO: 1294139 - RNA, 20 nt, Human
uuugcuaaugacagacccca

SEQ ID NO: 1294140 - RNA, 18 nt, Human
aaacaaaaaacucuggac

SEQ ID NO: 1294141 - RNA, 19 nt, Human
aacaaaaaacucuggacac

SEQ ID NO: 1294142 - RNA, 24 nt, Human
acagagccagacccugucucaaga

SEQ ID NO: 1294143 - RNA, 23 nt, Human
accacuguacucuagucugccaa

SEQ ID NO: 1294144 - RNA, 21 nt, Human
acucuagucugccaacagagc

SEQ ID NO: 1294145 - RNA, 18 nt, Human
agaagucaaggcugcaau

SEQ ID NO: 1294146 - RNA, 28 nt, Human
agauauuuuauuaguuaaucagagagcu

SEQ ID NO: 1294147 - RNA, 24 nt, Human
agcuacucaggaggcugagguggg

SEQ ID NO: 1294148 - RNA, 24 nt, Human
aggcugaggugggaggaugacuug

SEQ ID NO: 1294149 - RNA, 24 nt, Human
aucucaccacuguacucuagucug

SEQ ID NO: 1294150 - RNA, 19 nt, Human
augcaugugaggguuaaag

SEQ ID NO: 1294151 - RNA, 21 nt, Human
cagacccugucucaagacaaa

SEQ ID NO: 1294152 - RNA, 20 nt, Human
cagggcucauuagcuuccuc

SEQ ID NO: 1294153 - RNA, 21 nt, Human
cagggcucauuagcuuccuca

SEQ ID NO: 1294154 - RNA, 18 nt, Human
ccacuguacucuagucug

SEQ ID NO: 1294155 - RNA, 21 nt, Human
cucaagacaaacaaaaaacuc

SEQ ID NO: 1294156 - RNA, 25 nt, Human
cucaagacaaacaaaaaacucugga

SEQ ID NO: 1294157 - RNA, 18 nt, Human
cucaccucauccccagac

SEQ ID NO: 1294158 - RNA, 18 nt, Human
cucaggaggcugaggugg

SEQ ID NO: 1294159 - RNA, 20 nt, Human
cucuagucugccaacagagc

SEQ ID NO: 1294160 - RNA, 19 nt, Human
cugccaacagagccagacc

SEQ ID NO: 1294161 - RNA, 19 nt, Human
cugucucaagacaaacaaa

SEQ ID NO: 1294162 - RNA, 24 nt, Human
gccaacagagccagacccugucuc

SEQ ID NO: 1294163 - RNA, 20 nt, Human
ggaggcugaggugggaggau

SEQ ID NO: 1294164 - RNA, 23 nt, Human
guacucuagucugccaacagagc

SEQ ID NO: 1294165 - RNA, 28 nt, Human
ucaagacaaacaaaaaacucuggacaca

SEQ ID NO: 1294166 - RNA, 22 nt, Human
ucucuggggauugguacacagu

SEQ ID NO: 1294167 - RNA, 23 nt, Human
ugagaggaccaaaugaaauggug

SEQ ID NO: 1294168 - RNA, 20 nt, Human
ugaggugggaggaugacuug

SEQ ID NO: 1294169 - RNA, 22 nt, Human
ugaggugggaggaugacuuggc

SEQ ID NO: 1294170 - RNA, 22 nt, Human
ugcaaugaacugugaucucacc

SEQ ID NO: 1294171 - RNA, 19 nt, Human
ugucucaagacaaacaaaa

SEQ ID NO: 1294172 - RNA, 23 nt, Human
ugugucaagugaauaaaugagag

SEQ ID NO: 1294173 - RNA, 23 nt, Human
aaacagcacaacgaggacuugaa

SEQ ID NO: 1294174 - RNA, 24 nt, Human
aaagugcugggacuacaggcguga

SEQ ID NO: 1294175 - RNA, 22 nt, Human
aaaugauccgguauggugaagc

SEQ ID NO: 1294176 - RNA, 19 nt, Human
aaggaacacuacugauacc

SEQ ID NO: 1294177 - RNA, 19 nt, Human
aagugcugggacuacaggc

SEQ ID NO: 1294178 - RNA, 26 nt, Human
aagugcugggacuacaggcgugagcc

SEQ ID NO: 1294179 - RNA, 25 nt, Human
aauauucaccuauaaguagggugac

SEQ ID NO: 1294180 - RNA, 24 nt, Human
aaucauguugaccaggcuggucuc

SEQ ID NO: 1294181 - RNA, 20 nt, Human
acucagucucccaaagugcu

SEQ ID NO: 1294182 - RNA, 18 nt, Human
agaaaacaaauagugccu

SEQ ID NO: 1294183 - RNA, 21 nt, Human
agcugucaaaagcaaggaacc

SEQ ID NO: 1294184 - RNA, 21 nt, Human
aggaggaucuaccuuguaaug

SEQ ID NO: 1294185 - RNA, 18 nt, Human
aguagcugggauuacagg

SEQ ID NO: 1294186 - RNA, 20 nt, Human
agugcaguggugccauccug

SEQ ID NO: 1294187 - RNA, 24 nt, Human
agugcaguggugccauccuggcuc

SEQ ID NO: 1294188 - RNA, 21 nt, Human
aucacagaaaugccccugauu

SEQ ID NO: 1294189 - RNA, 18 nt, Human
auggugaagcccagaucu

SEQ ID NO: 1294190 - RNA, 19 nt, Human
caaagcgccaucacagaaa

SEQ ID NO: 1294191 - RNA, 24 nt, Human
caaagugcugggacuacaggcgug

SEQ ID NO: 1294192 - RNA, 20 nt, Human
caaauagugccugugaccaa

SEQ ID NO: 1294193 - RNA, 23 nt, Human
caaccucagccuccuggguucaa

SEQ ID NO: 1294194 - RNA, 20 nt, Human
caagcgauucuccugccuca

SEQ ID NO: 1294195 - RNA, 22 nt, Human
caagcgauucuccugccucagc

SEQ ID NO: 1294196 - RNA, 18 nt, Human
cacauuauuuacacuacc

SEQ ID NO: 1294197 - RNA, 20 nt, Human
caccaugccuggccacucag

SEQ ID NO: 1294198 - RNA, 21 nt, Human
cacccccucuaacaaaaacag

SEQ ID NO: 1294199 - RNA, 28 nt, Human
cacucugccacuuaaggcccugcacccc

SEQ ID NO: 1294200 - RNA, 19 nt, Human
cacugcaaccucagccucc

SEQ ID NO: 1294201 - RNA, 21 nt, Human
cacugcaaccucagccuccug

SEQ ID NO: 1294202 - RNA, 23 nt, Human
cacugcaaccucagccuccuggg

SEQ ID NO: 1294203 - RNA, 24 nt, Human
cagagucuugcucuauugcccagg

SEQ ID NO: 1294204 - RNA, 22 nt, Human
cagccuccuggguucaagcgau

SEQ ID NO: 1294205 - RNA, 25 nt, Human
cagggcuugugguuagcccaaacau

SEQ ID NO: 1294206 - RNA, 24 nt, Human
cauguugaccaggcuggucucaaa

SEQ ID NO: 1294207 - RNA, 22 nt, Human
ccaaagugcugggacuacaggc

SEQ ID NO: 1294208 - RNA, 24 nt, Human
ccaaagugcugggacuacaggcgu

SEQ ID NO: 1294209 - RNA, 23 nt, Human
ccaacucagucucccaaagugcu

SEQ ID NO: 1294210 - RNA, 18 nt, Human
ccaauaucugcaagauaa

SEQ ID NO: 1294211 - RNA, 22 nt, Human
ccacccaacucagucucccaaa

SEQ ID NO: 1294212 - RNA, 18 nt, Human
ccacugaaguccucugca

SEQ ID NO: 1294213 - RNA, 24 nt, Human
cccaaagugcugggacuacaggcg

SEQ ID NO: 1294214 - RNA, 20 nt, Human
ccccacaagcacaguaaggu

SEQ ID NO: 1294215 - RNA, 21 nt, Human
ccccaguuaggaaaguuuuau

SEQ ID NO: 1294216 - RNA, 23 nt, Human
cccgaguagcugggauuacaggc

SEQ ID NO: 1294217 - RNA, 24 nt, Human
cccgaguagcugggauuacaggcg

SEQ ID NO: 1294218 - RNA, 22 nt, Human
ccgaguagcugggauuacaggc

SEQ ID NO: 1294219 - RNA, 23 nt, Human
ccgguauggugaagcccagaucu

SEQ ID NO: 1294220 - RNA, 23 nt, Human
ccuacaccaaaaaucaccacuau

SEQ ID NO: 1294221 - RNA, 19 nt, Human
ccuagcacccccucuaaca

SEQ ID NO: 1294222 - RNA, 18 nt, Human
ccucagccuccuggguuc

SEQ ID NO: 1294223 - RNA, 24 nt, Human
ccuccuggguucaagcgauucucc

SEQ ID NO: 1294224 - RNA, 22 nt, Human
ccuggcucacugcaaccucagc

SEQ ID NO: 1294225 - RNA, 23 nt, Human
ccuggguucaagcgauucuccug

SEQ ID NO: 1294226 - RNA, 24 nt, Human
ccugucccaaaucugauuuuuagu

SEQ ID NO: 1294227 - RNA, 25 nt, Human
cgguauggugaagcccagaucuuug

SEQ ID NO: 1294228 - RNA, 21 nt, Human
cuaaauccuuucagccccaca

SEQ ID NO: 1294229 - RNA, 18 nt, Human
cuaccacaccuggcuaau

SEQ ID NO: 1294230 - RNA, 23 nt, Human
cuagcacccccucuaacaaaaac

SEQ ID NO: 1294231 - RNA, 24 nt, Human
cucacugcaaccucagccuccugg

SEQ ID NO: 1294232 - RNA, 24 nt, Human
cucagccucccgaguagcugggau

SEQ ID NO: 1294233 - RNA, 26 nt, Human
cuccgaaucaggacaccuaugagagu

SEQ ID NO: 1294234 - RNA, 21 nt, Human
cuccuggguucaagcgauucu

SEQ ID NO: 1294235 - RNA, 20 nt, Human
cucuauugcccaggcuggag

SEQ ID NO: 1294236 - RNA, 23 nt, Human
cugccucagccucccgaguagcu

SEQ ID NO: 1294237 - RNA, 18 nt, Human
cugugugccagaugcccc

SEQ ID NO: 1294238 - RNA, 19 nt, Human
gacaaagcgccaucacaga

SEQ ID NO: 1294239 - RNA, 24 nt, Human
gaccucacgugauccacccaacuc

SEQ ID NO: 1294240 - RNA, 18 nt, Human
gacuacaggcgugagcca

SEQ ID NO: 1294241 - RNA, 21 nt, Human
gacuacaggcgugagccacca

SEQ ID NO: 1294242 - RNA, 24 nt, Human
gacuacaggcgugagccaccaugc

SEQ ID NO: 1294243 - RNA, 25 nt, Human
gagaaugguagagagcaggggccgg

SEQ ID NO: 1294244 - RNA, 25 nt, Human
gaguagcugggauuacaggcgccca

SEQ ID NO: 1294245 - RNA, 18 nt, Human
gaucacagggcuuguggu

SEQ ID NO: 1294246 - RNA, 21 nt, Human
gauucuccugccucagccucc

SEQ ID NO: 1294247 - RNA, 22 nt, Human
gcaaccucagccuccuggguuc

SEQ ID NO: 1294248 - RNA, 22 nt, Human
gcaggucaaagcauccuccuuu

SEQ ID NO: 1294249 - RNA, 19 nt, Human
gcccaggcuggagugcagu

SEQ ID NO: 1294250 - RNA, 20 nt, Human
gcccaggcuggagugcagug

SEQ ID NO: 1294251 - RNA, 20 nt, Human
gccucagccucccgaguagc

SEQ ID NO: 1294252 - RNA, 24 nt, Human
gcgauucuccugccucagccuccc

SEQ ID NO: 1294253 - RNA, 19 nt, Human
gcucauuugcaaaaguuaa

SEQ ID NO: 1294254 - RNA, 20 nt, Human
gcucauuugcaaaaguuaag

SEQ ID NO: 1294255 - RNA, 25 nt, Human
gcucuauugcccaggcuggagugca

SEQ ID NO: 1294256 - RNA, 21 nt, Human
gcuggagugcaguggugccag

SEQ ID NO: 1294257 - RNA, 23 nt, Human
gcuggucucaaacuccugaccuc

SEQ ID NO: 1294258 - RNA, 19 nt, Human
ggacacauguacagacugc

SEQ ID NO: 1294259 - RNA, 22 nt, Human
ggacacauguacagacugcauu

SEQ ID NO: 1294260 - RNA, 24 nt, Human
ggacuacaggcgugagccaccaug

SEQ ID NO: 1294261 - RNA, 22 nt, Human
ggagacagagucuugcucuauu

SEQ ID NO: 1294262 - RNA, 24 nt, Human
ggcuggucucaaacuccugaccuc

SEQ ID NO: 1294263 - RNA, 24 nt, Human
gggcagggagcugucaaaagcaag

SEQ ID NO: 1294264 - RNA, 23 nt, Human
gguagagagcaggggcagggagc

SEQ ID NO: 1294265 - RNA, 24 nt, Human
gguucaauagggaagacaaacacc

SEQ ID NO: 1294266 - RNA, 18 nt, Human
guagcugggauuacaggc

SEQ ID NO: 1294267 - RNA, 24 nt, Human
gugauccacccaacucagucuccc

SEQ ID NO: 1294268 - RNA, 21 nt, Human
uaaaucauguugaccaggcug

SEQ ID NO: 1294269 - RNA, 23 nt, Human
uaaguagggugaccauauaacgu

SEQ ID NO: 1294270 - RNA, 21 nt, Human
uaauggaucuaaaacuauugc

SEQ ID NO: 1294271 - RNA, 22 nt, Human
uacaggcgugagccaccaugcc

SEQ ID NO: 1294272 - RNA, 23 nt, Human
uacaggcgugagccaccaugccu

SEQ ID NO: 1294273 - RNA, 24 nt, Human
uaguagagacgagguuaaaucaug

SEQ ID NO: 1294274 - RNA, 22 nt, Human
uauccuccgaaucaggacaccu

SEQ ID NO: 1294275 - RNA, 21 nt, Human
uaugagaguaaaaaggaacac

SEQ ID NO: 1294276 - RNA, 19 nt, Human
uauugcccaggcuggagug

SEQ ID NO: 1294277 - RNA, 23 nt, Human
ucaaacuccugaccucacgugau

SEQ ID NO: 1294278 - RNA, 19 nt, Human
ucaagcgauucuccugccu

SEQ ID NO: 1294279 - RNA, 18 nt, Human
ucacugcaaccucagccu

SEQ ID NO: 1294280 - RNA, 23 nt, Human
ucacugcaaccucagccuccugg

SEQ ID NO: 1294281 - RNA, 24 nt, Human
ucacugcaaccucagccuccuggg

SEQ ID NO: 1294282 - RNA, 27 nt, Human
ucacugcaaccucagccuccuggguuc

SEQ ID NO: 1294283 - RNA, 18 nt, Human
ucagcagacauuucuuga

SEQ ID NO: 1294284 - RNA, 20 nt, Human
ucagccucccgaguagcugg

SEQ ID NO: 1294285 - RNA, 23 nt, Human
uccaaagccuugaauauagucac

SEQ ID NO: 1294286 - RNA, 24 nt, Human
ucccaaagugcugggacuacaggc

SEQ ID NO: 1294287 - RNA, 24 nt, Human
ucccgaguagcugggauuacaggc

SEQ ID NO: 1294288 - RNA, 21 nt, Human
uccuggguucaagcgauucuc

SEQ ID NO: 1294289 - RNA, 24 nt, Human
uccuggguucaagcgauucuccug

SEQ ID NO: 1294290 - RNA, 27 nt, Human
ucuaaaacuauugccuaaaaacuucua

SEQ ID NO: 1294291 - RNA, 24 nt, Human
ucuauugcccaggcuggagugcag

SEQ ID NO: 1294292 - RNA, 18 nt, Human
ucucacucugccacuuaa

SEQ ID NO: 1294293 - RNA, 24 nt, Human
ucuccugccucagccucccgagua

SEQ ID NO: 1294294 - RNA, 19 nt, Human
ucuugcucuauugcccagg

SEQ ID NO: 1294295 - RNA, 23 nt, Human
ucuugcucuauugcccaggcugg

SEQ ID NO: 1294296 - RNA, 24 nt, Human
ucuugcucuauugcccaggcugga

SEQ ID NO: 1294297 - RNA, 24 nt, Human
ugaccaggcuggucucaaacuccu

SEQ ID NO: 1294298 - RNA, 20 nt, Human
ugaccauauaacguauccuc

SEQ ID NO: 1294299 - RNA, 24 nt, Human
ugagauacauugugaugggcaggu

SEQ ID NO: 1294300 - RNA, 19 nt, Human
ugcauuaccacugacaaag

SEQ ID NO: 1294301 - RNA, 24 nt, Human
ugccagaugccccgcugggcaccc

SEQ ID NO: 1294302 - RNA, 18 nt, Human
ugcccaggcuggagugca

SEQ ID NO: 1294303 - RNA, 21 nt, Human
ugcccaggcuggagugcagug

SEQ ID NO: 1294304 - RNA, 24 nt, Human
ugcccaggcuggagugcaguggug

SEQ ID NO: 1294305 - RNA, 24 nt, Human
ugccucagccucccgaguagcugg

SEQ ID NO: 1294306 - RNA, 24 nt, Human
ugcugggacuacaggcgugagcca

SEQ ID NO: 1294307 - RNA, 20 nt, Human
uggagagggggguuugauuc

SEQ ID NO: 1294308 - RNA, 28 nt, Human
uggagugcaguggugccauccuagcacg

SEQ ID NO: 1294309 - RNA, 24 nt, Human
uggagugcaguggugccauccugg

SEQ ID NO: 1294310 - RNA, 21 nt, Human
uggcuaauuuuuuuuuuuuuu

SEQ ID NO: 1294311 - RNA, 20 nt, Human
uggcucacugcaaccucagc

SEQ ID NO: 1294312 - RNA, 18 nt, Human
ugggaacaaaguaauaca

SEQ ID NO: 1294313 - RNA, 18 nt, Human
ugggacuacaggcgugag

SEQ ID NO: 1294314 - RNA, 22 nt, Human
ugggacuacaggcgugagccac

SEQ ID NO: 1294315 - RNA, 24 nt, Human
ugggacuacaggcgugagccacca

SEQ ID NO: 1294316 - RNA, 25 nt, Human
ugggacuacaggcgugagccaccau

SEQ ID NO: 1294317 - RNA, 19 nt, Human
ugggauuacaggcgcccac

SEQ ID NO: 1294318 - RNA, 20 nt, Human
ugggauuacaggcgcccacu

SEQ ID NO: 1294319 - RNA, 24 nt, Human
ugggauuacaggcgcccacuacca

SEQ ID NO: 1294320 - RNA, 23 nt, Human
uggguucaagcgauucuccugcc

SEQ ID NO: 1294321 - RNA, 24 nt, Human
uggguucaagcgauucuccugccu

SEQ ID NO: 1294322 - RNA, 25 nt, Human
ugugccagaugccccgcugggcacc

SEQ ID NO: 1294323 - RNA, 20 nt, Human
uguguaaagggcuugcaggg

SEQ ID NO: 1294324 - RNA, 24 nt, Human
uuaguagagacgagguuaaaucau

SEQ ID NO: 1294325 - RNA, 21 nt, Human
uucaagcgauucuccugccuc

SEQ ID NO: 1294326 - RNA, 23 nt, Human
uucaagcgauucuccugccucag

SEQ ID NO: 1294327 - RNA, 24 nt, Human
uucaagcgauucuccugccucagc

SEQ ID NO: 1294328 - RNA, 22 nt, Human
uugcaaaaguuaaggaacaaga

SEQ ID NO: 1294329 - RNA, 24 nt, Human
uugcucuauugcccaggcuggagu

SEQ ID NO: 1294330 - RNA, 24 nt, Human
uuuuuuguauauuuaguagagacg

SEQ ID NO: 1294331 - RNA, 23 nt, Human
aagcuucucccugaaaccacucc

SEQ ID NO: 1294332 - RNA, 20 nt, Human
acacuggugaccuccgcgug

SEQ ID NO: 1294333 - RNA, 22 nt, Human
acagcuuaaagcacuuccacac

SEQ ID NO: 1294334 - RNA, 18 nt, Human
accacuucugcugucucu

SEQ ID NO: 1294335 - RNA, 21 nt, Human
accccgugauguacccugagg

SEQ ID NO: 1294336 - RNA, 25 nt, Human
cagaggacuucucccccgcguggac

SEQ ID NO: 1294337 - RNA, 24 nt, Human
cagcacaaggcuuucccacacuuc

SEQ ID NO: 1294338 - RNA, 18 nt, Human
cccccgugugggagcgaa

SEQ ID NO: 1294339 - RNA, 22 nt, Human
ccugaaaccacucccccguuca

SEQ ID NO: 1294340 - RNA, 20 nt, Human
cucccugaaaccacuccccc

SEQ ID NO: 1294341 - RNA, 19 nt, Human
cuccgcguggauucgcucc

SEQ ID NO: 1294342 - RNA, 19 nt, Human
cugagcugcaggaacuccc

SEQ ID NO: 1294343 - RNA, 18 nt, Human
gaacugugcccgggacac

SEQ ID NO: 1294344 - RNA, 22 nt, Human
gcagcacaaggcuuucccacac

SEQ ID NO: 1294345 - RNA, 19 nt, Human
gcauguucuucauaaagug

SEQ ID NO: 1294346 - RNA, 19 nt, Human
ggcucuuugugggucggcc

SEQ ID NO: 1294347 - RNA, 18 nt, Human
gggucggcccuggugggc

SEQ ID NO: 1294348 - RNA, 20 nt, Human
gguuucuccuuugugugagu

SEQ ID NO: 1294349 - RNA, 22 nt, Human
uaacugaggucaaauuuuuuca

SEQ ID NO: 1294350 - RNA, 23 nt, Human
uacccugagguccgaucugcagc

SEQ ID NO: 1294351 - RNA, 27 nt, Human
uagcggguuucuccuuugugugaguuc

SEQ ID NO: 1294352 - RNA, 23 nt, Human
ucaccaaccucauuaucuaacau

SEQ ID NO: 1294353 - RNA, 24 nt, Human
ucagggcaaagcuucucccugaaa

SEQ ID NO: 1294354 - RNA, 22 nt, Human
ucccccgugugggagcgaaggu

SEQ ID NO: 1294355 - RNA, 18 nt, Human
ucccugaaaccacucccc

SEQ ID NO: 1294356 - RNA, 18 nt, Human
ucugcagcacaaggcuuc

SEQ ID NO: 1294357 - RNA, 21 nt, Human
ugaggcgcgacuugugggagg

SEQ ID NO: 1294358 - RNA, 22 nt, Human
ugcagcacaaggcuuucccaca

SEQ ID NO: 1294359 - RNA, 18 nt, Human
ugcccgggacacacaggc

SEQ ID NO: 1294360 - RNA, 24 nt, Human
uggaguggaguucaggagcauguu

SEQ ID NO: 1294361 - RNA, 27 nt, Human
uggcucccugagcugcaggaacucccu

SEQ ID NO: 1294362 - RNA, 19 nt, Human
uguggaguggaguucagga

SEQ ID NO: 1294363 - RNA, 18 nt, Human
ugugggucggcccuggug

SEQ ID NO: 1294364 - RNA, 21 nt, Human
uucaaaagcugguuguggagu

SEQ ID NO: 1294365 - RNA, 18 nt, Human
uucucacacucccaacac

SEQ ID NO: 1294366 - RNA, 21 nt, Human
uuugugggucggcccuggugg

SEQ ID NO: 1294367 - RNA, 23 nt, Human
aaaaucucuuuguagacgaaugu

SEQ ID NO: 1294368 - RNA, 20 nt, Human
cuuaccuucaaguucugaua

SEQ ID NO: 1294369 - RNA, 22 nt, Human
ucaauuggugagaauuucucuu

SEQ ID NO: 1294370 - RNA, 19 nt, Human
ucuggagaacuuaauuucc

SEQ ID NO: 1294371 - RNA, 18 nt, Human
ugcuaaaaguuuucaaag

SEQ ID NO: 1294372 - RNA, 21 nt, Human
uggcuaauccuguaguaaugc

SEQ ID NO: 1294373 - RNA, 22 nt, Human
ugugauaccauaaaacacuggu

SEQ ID NO: 1294374 - RNA, 20 nt, Human
uucaaguucugauaugucuu

SEQ ID NO: 1294375 - RNA, 20 nt, Human
uucccuucuucaaccugcuu

SEQ ID NO: 1294376 - RNA, 18 nt, Human
uugauuugagcuaaacgu

SEQ ID NO: 1294377 - RNA, 22 nt, Human
aaaaacaaaacaaaacaaaaac

SEQ ID NO: 1294378 - RNA, 24 nt, Human
aaaaacaaacaacaaacaacaacc

SEQ ID NO: 1294379 - RNA, 21 nt, Human
aaaaauauugcaggacccaag

SEQ ID NO: 1294380 - RNA, 20 nt, Human
aaaacaaaacaaaacaaaaa

SEQ ID NO: 1294381 - RNA, 26 nt, Human
aaacaaaaacaaacaacaaacaacaa

SEQ ID NO: 1294382 - RNA, 26 nt, Human
aaacaaaacaaaaacaaacaacaaac

SEQ ID NO: 1294383 - RNA, 23 nt, Human
aaacaaaacaaaacaaaaacaaa

SEQ ID NO: 1294384 - RNA, 21 nt, Human
aaacaaacaacaaacaacaac

SEQ ID NO: 1294385 - RNA, 25 nt, Human
aaacaaacaacaaacaacaacuucg

SEQ ID NO: 1294386 - RNA, 22 nt, Human
aaacaacaaacaacaacuucgc

SEQ ID NO: 1294387 - RNA, 20 nt, Human
aacaaacaacaaacaacaac

SEQ ID NO: 1294388 - RNA, 26 nt, Human
aacaacaaacaacaacuucgcaggga

SEQ ID NO: 1294389 - RNA, 19 nt, Human
aacacaacuucaccggccu

SEQ ID NO: 1294390 - RNA, 20 nt, Human
aacagagugagucuccaucu

SEQ ID NO: 1294391 - RNA, 19 nt, Human
aacauugugaaacccuauc

SEQ ID NO: 1294392 - RNA, 20 nt, Human
aacauugugaaacccuaucu

SEQ ID NO: 1294393 - RNA, 21 nt, Human
aacauugugaaacccuaucuc

SEQ ID NO: 1294394 - RNA, 22 nt, Human
aacugguuguagaguugguuuc

SEQ ID NO: 1294395 - RNA, 20 nt, Human
aagaagcuucaagacacuaa

SEQ ID NO: 1294396 - RNA, 23 nt, Human
aagaggcaacaagaagcuucaag

SEQ ID NO: 1294397 - RNA, 21 nt, Human
aagcgugcgcagcagcaggag

SEQ ID NO: 1294398 - RNA, 22 nt, Human
aagggccagugaaagaggcaac

SEQ ID NO: 1294399 - RNA, 18 nt, Human
aaucaucugaggucagga

SEQ ID NO: 1294400 - RNA, 24 nt, Human
aaucaucugaggucaggaguucga

SEQ ID NO: 1294401 - RNA, 25 nt, Human
acaaaaacaaacaacaaacaacaac

SEQ ID NO: 1294402 - RNA, 23 nt, Human
acaaaacaaaaacaaacaacaaa

SEQ ID NO: 1294403 - RNA, 21 nt, Human
acaaaacaaaacaaaaacaaa

SEQ ID NO: 1294404 - RNA, 22 nt, Human
acacuaacuucauccaccuggc

SEQ ID NO: 1294405 - RNA, 24 nt, Human
acagagugagucuccaucucaaaa

SEQ ID NO: 1294406 - RNA, 20 nt, Human
acaucacugcacuccagccu

SEQ ID NO: 1294407 - RNA, 24 nt, Human
acaucacugcacuccagccugggc

SEQ ID NO: 1294408 - RNA, 20 nt, Human
accaguuuucauggcuuauu

SEQ ID NO: 1294409 - RNA, 24 nt, Human
accucagccuucccuucccuccag

SEQ ID NO: 1294410 - RNA, 19 nt, Human
accuggccacuuugcccag

SEQ ID NO: 1294411 - RNA, 27 nt, Human
acgggcaauaucguguaaccgaggucc

SEQ ID NO: 1294412 - RNA, 20 nt, Human
acucacugcagaucuccgag

SEQ ID NO: 1294413 - RNA, 24 nt, Human
acuccagccugggcaacagaguga

SEQ ID NO: 1294414 - RNA, 24 nt, Human
acugcacuccagccugggcaacag

SEQ ID NO: 1294415 - RNA, 24 nt, Human
acugcacuccagccugggcaacag

SEQ ID NO: 1294416 - RNA, 18 nt, Human
agagaagaaaauagcaau

SEQ ID NO: 1294417 - RNA, 20 nt, Human
agagccagguguguccacug

SEQ ID NO: 1294418 - RNA, 20 nt, Human
agcacaugccaggcuuccag

SEQ ID NO: 1294419 - RNA, 18 nt, Human
agcacugccuugagguug

SEQ ID NO: 1294420 - RNA, 22 nt, Human
agccgggagaggagggagcuuc

SEQ ID NO: 1294421 - RNA, 20 nt, Human
agccugggcaacagagugag

SEQ ID NO: 1294422 - RNA, 23 nt, Human
aggaguucgagaccagcauggcc

SEQ ID NO: 1294423 - RNA, 19 nt, Human
aggcagaggcgggcagggu

SEQ ID NO: 1294424 - RNA, 21 nt, Human
aggcagaggcgggcagggugc

SEQ ID NO: 1294425 - RNA, 18 nt, Human
aggcaggagaaugguuug

SEQ ID NO: 1294426 - RNA, 24 nt, Human
aggcaggagaaugguuugaaccca

SEQ ID NO: 1294427 - RNA, 27 nt, Human
aggcaggagaaugguuugaacccagga

SEQ ID NO: 1294428 - RNA, 26 nt, Human
aggcgggugaaucaucugaggucagg

SEQ ID NO: 1294429 - RNA, 24 nt, Human
aggcugaggcaggagaaugguuug

SEQ ID NO: 1294430 - RNA, 20 nt, Human
aggcugaggcgggugaauca

SEQ ID NO: 1294431 - RNA, 23 nt, Human
agggaaagagucagaacucaggg

SEQ ID NO: 1294432 - RNA, 23 nt, Human
aggggaguggccauuggcaggag

SEQ ID NO: 1294433 - RNA, 23 nt, Human
agguguggacaggcaggauggag

SEQ ID NO: 1294434 - RNA, 22 nt, Human
agucagaacucagggauuccuu

SEQ ID NO: 1294435 - RNA, 20 nt, Human
agugaaagaggcaacaagaa

SEQ ID NO: 1294436 - RNA, 19 nt, Human
agugcagcucuaaaguucc

SEQ ID NO: 1294437 - RNA, 20 nt, Human
auaaagccuucuuagguuua

SEQ ID NO: 1294438 - RNA, 24 nt, Human
aucacaucacugcacuccagccug

SEQ ID NO: 1294439 - RNA, 21 nt, Human
aucaucugaggucaggaguuc

SEQ ID NO: 1294440 - RNA, 24 nt, Human
aucaucugaggucaggaguucgag

SEQ ID NO: 1294441 - RNA, 24 nt, Human
aucugaggucaggaguucgagacc

SEQ ID NO: 1294442 - RNA, 18 nt, Human
auguugcgggcaccaagg

SEQ ID NO: 1294443 - RNA, 20 nt, Human
auguugcgggcaccaagguu

SEQ ID NO: 1294444 - RNA, 23 nt, Human
auucagaaguuccucauuucaac

SEQ ID NO: 1294445 - RNA, 26 nt, Human
caaaaaacaaaacaaaacaaaaacaa

SEQ ID NO: 1294446 - RNA, 25 nt, Human
caaaacaaaaacaaacaacaaacaa

SEQ ID NO: 1294447 - RNA, 23 nt, Human
caaaacaaaacaaaaacaaacaa

SEQ ID NO: 1294448 - RNA, 22 nt, Human
caaagauaaccauccuucagac

SEQ ID NO: 1294449 - RNA, 24 nt, Human
caacaccuugggaggcugaggcgg

SEQ ID NO: 1294450 - RNA, 20 nt, Human
caagccagggucccacuccc

SEQ ID NO: 1294451 - RNA, 26 nt, Human
cacacgggcaauaucguguaacaacg

SEQ ID NO: 1294452 - RNA, 21 nt, Human
cacaucacugcacuccagccu

SEQ ID NO: 1294453 - RNA, 24 nt, Human
cacaucuguaaucccaacaccuug

SEQ ID NO: 1294454 - RNA, 23 nt, Human
caccaggacauagaaugacuuag

SEQ ID NO: 1294455 - RNA, 25 nt, Human
caccaggcaccuugucagggacacc

SEQ ID NO: 1294456 - RNA, 26 nt, Human
cacccaggccauggucccuccuuggc

SEQ ID NO: 1294457 - RNA, 19 nt, Human
caccgugcuuuccuccggg

SEQ ID NO: 1294458 - RNA, 21 nt, Human
cacucaccccacccuggcccc

SEQ ID NO: 1294459 - RNA, 22 nt, Human
cacucaccccacccuggccccu

SEQ ID NO: 1294460 - RNA, 22 nt, Human
cacuccagccugggcaacagag

SEQ ID NO: 1294461 - RNA, 22 nt, Human
cacuccagccugggcaacagag

SEQ ID NO: 1294462 - RNA, 24 nt, Human
cacuccagccugggcaacagagug

SEQ ID NO: 1294463 - RNA, 18 nt, Human
cacugcacuccagccugg

SEQ ID NO: 1294464 - RNA, 19 nt, Human
cacugcacuccagccuggg

SEQ ID NO: 1294465 - RNA, 20 nt, Human
cacugcacuccagccugggc

SEQ ID NO: 1294466 - RNA, 21 nt, Human
cacugcacuccagccugggca

SEQ ID NO: 1294467 - RNA, 22 nt, Human
cacugcacuccagccugggcaa

SEQ ID NO: 1294468 - RNA, 23 nt, Human
cacugcacuccagccugggcaac

SEQ ID NO: 1294469 - RNA, 24 nt, Human
cacugcacuccagccugggcaaca

SEQ ID NO: 1294470 - RNA, 19 nt, Human
cagaacacgagguggcagc

SEQ ID NO: 1294471 - RNA, 19 nt, Human
cagaacacgagguggcagc

SEQ ID NO: 1294472 - RNA, 22 nt, Human
cagcagcaggagccucgggugc

SEQ ID NO: 1294473 - RNA, 19 nt, Human
cagccuucccuucccucca

SEQ ID NO: 1294474 - RNA, 21 nt, Human
caggaguucgagaccagcaug

SEQ ID NO: 1294475 - RNA, 18 nt, Human
caggcccacagaggaugg

SEQ ID NO: 1294476 - RNA, 21 nt, Human
cagggacaccguuucuuccac

SEQ ID NO: 1294477 - RNA, 24 nt, Human
caguuacuugagaggcugaggcag

SEQ ID NO: 1294478 - RNA, 24 nt, Human
caucacugcacuccagccugggca

SEQ ID NO: 1294479 - RNA, 23 nt, Human
caucucaaaaaacaaaacaaaac

SEQ ID NO: 1294480 - RNA, 26 nt, Human
caucucaaaaaacaaaacaaaacaaa

SEQ ID NO: 1294481 - RNA, 23 nt, Human
caucugaggucaggaguucgaga

SEQ ID NO: 1294482 - RNA, 23 nt, Human
caucuguaaucccaacaccuugg

SEQ ID NO: 1294483 - RNA, 24 nt, Human
caucuguaaucccaacaccuuggg

SEQ ID NO: 1294484 - RNA, 24 nt, Human
caugccuguaaucccaguuacuug

SEQ ID NO: 1294485 - RNA, 19 nt, Human
cauggccaacauugugaaa

SEQ ID NO: 1294486 - RNA, 20 nt, Human
ccccaaagauaaccauccuu

SEQ ID NO: 1294487 - RNA, 20 nt, Human
ccccacccuggccccugacc

SEQ ID NO: 1294488 - RNA, 24 nt, Human
ccccagaggagucccacagagcga

SEQ ID NO: 1294489 - RNA, 21 nt, Human
ccccgcgccgggccguguggc

SEQ ID NO: 1294490 - RNA, 24 nt, Human
cccuccuuguuuuauuuuucuccu

SEQ ID NO: 1294491 - RNA, 22 nt, Human
ccgcgccgggccguguggcugc

SEQ ID NO: 1294492 - RNA, 23 nt, Human
ccgcgugugcccgcuagagccag

SEQ ID NO: 1294493 - RNA, 21 nt, Human
ccgggagggaggagagucaca

SEQ ID NO: 1294494 - RNA, 22 nt, Human
ccuaugguuuguuccccuugaa

SEQ ID NO: 1294495 - RNA, 24 nt, Human
ccuauucaaauccaagccacaccc

SEQ ID NO: 1294496 - RNA, 23 nt, Human
ccuccuuggcaggcagaggcggg

SEQ ID NO: 1294497 - RNA, 20 nt, Human
ccuguaaucccaguuacuug

SEQ ID NO: 1294498 - RNA, 22 nt, Human
ccuguaaucccaguuacuugag

SEQ ID NO: 1294499 - RNA, 22 nt, Human
ccuugaacuaacaaggaaccuc

SEQ ID NO: 1294500 - RNA, 23 nt, Human
ccuuguuuuauuuuucuccucuu

SEQ ID NO: 1294501 - RNA, 24 nt, Human
cgagaucacaucacugcacuccag

SEQ ID NO: 1294502 - RNA, 21 nt, Human
cgggcaauaucguguaacaac

SEQ ID NO: 1294503 - RNA, 24 nt, Human
cgggugaaucaucugaggucagga

SEQ ID NO: 1294504 - RNA, 22 nt, Human
cguuuccaggaaaugaauaaag

SEQ ID NO: 1294505 - RNA, 23 nt, Human
cuagagccagguguguccacugu

SEQ ID NO: 1294506 - RNA, 21 nt, Human
cuagugcagcucuaaaguucc

SEQ ID NO: 1294507 - RNA, 24 nt, Human
cucacaucuguaaucccaacaccu

SEQ ID NO: 1294508 - RNA, 24 nt, Human
cuccuuggcaggcagaggcgggca

SEQ ID NO: 1294509 - RNA, 23 nt, Human
cucguccagguccggcucucucg

SEQ ID NO: 1294510 - RNA, 20 nt, Human
cucugcaccgugcuuuccuc

SEQ ID NO: 1294511 - RNA, 24 nt, Human
cugaaccguuuccucugcaccgug

SEQ ID NO: 1294512 - RNA, 23 nt, Human
cugcaaacuuaagcacguuaugc

SEQ ID NO: 1294513 - RNA, 24 nt, Human
cugcaccgugcuuuccuccgggug

SEQ ID NO: 1294514 - RNA, 21 nt, Human
cuggauuuggaagacccuauu

SEQ ID NO: 1294515 - RNA, 22 nt, Human
cuuucauauugaagagugauug

SEQ ID NO: 1294516 - RNA, 21 nt, Human
cuuugcccagguggacuuugg

SEQ ID NO: 1294517 - RNA, 20 nt, Human
gagccgggagaggagggagc

SEQ ID NO: 1294518 - RNA, 21 nt, Human
gagccucaguuucuucaucug

SEQ ID NO: 1294519 - RNA, 19 nt, Human
gaggagagggcgcagugag

SEQ ID NO: 1294520 - RNA, 18 nt, Human
gcaccaguuuucauggcu

SEQ ID NO: 1294521 - RNA, 24 nt, Human
gcacuccagccugggcaacagagu

SEQ ID NO: 1294522 - RNA, 20 nt, Human
gcagcagcaggagccucggg

SEQ ID NO: 1294523 - RNA, 22 nt, Human
gcaggagaaugguuugaaccca

SEQ ID NO: 1294524 - RNA, 24 nt, Human
gccaacauugugaaacccuaucuc

SEQ ID NO: 1294525 - RNA, 19 nt, Human
gccgggccguguggcugcg

SEQ ID NO: 1294526 - RNA, 21 nt, Human
gccgggccguguggcugcgga

SEQ ID NO: 1294527 - RNA, 20 nt, Human
gccuguaaucccaguuacuu

SEQ ID NO: 1294528 - RNA, 20 nt, Human
gcgcagcagcaggagccucg

SEQ ID NO: 1294529 - RNA, 25 nt, Human
gcgcagcagcaggagccucggguga

SEQ ID NO: 1294530 - RNA, 18 nt, Human
ggaaaugaauaaagccuu

SEQ ID NO: 1294531 - RNA, 19 nt, Human
ggcagggugcugcuggccu

SEQ ID NO: 1294532 - RNA, 23 nt, Human
ggcagggugcugcuggccugagg

SEQ ID NO: 1294533 - RNA, 20 nt, Human
ggccccugacaggucgccuc

SEQ ID NO: 1294534 - RNA, 21 nt, Human
ggccuggugugguggcucaca

SEQ ID NO: 1294535 - RNA, 24 nt, Human
ggccuggugugguggcucacaucu

SEQ ID NO: 1294536 - RNA, 21 nt, Human
gggaaagagucagaacucagg

SEQ ID NO: 1294537 - RNA, 20 nt, Human
ggggagguuggaggagaggg

SEQ ID NO: 1294538 - RNA, 23 nt, Human
gguaugguggcgcaugccuguaa

SEQ ID NO: 1294539 - RNA, 22 nt, Human
gguccuggggcuucaagcacca

SEQ ID NO: 1294540 - RNA, 24 nt, Human
gguggcgcaugccuguaaucccag

SEQ ID NO: 1294541 - RNA, 23 nt, Human
ggugugguggcucacaucuguaa

SEQ ID NO: 1294542 - RNA, 21 nt, Human
guaagcuccgugucagggacc

SEQ ID NO: 1294543 - RNA, 18 nt, Human
gugagucuccaucucaaa

SEQ ID NO: 1294544 - RNA, 23 nt, Human
guggcgcaugccuguaaucccag

SEQ ID NO: 1294545 - RNA, 19 nt, Human
uaaggagaucagauguugc

SEQ ID NO: 1294546 - RNA, 24 nt, Human
uagugugauggguggagccgggag

SEQ ID NO: 1294547 - RNA, 22 nt, Human
uaucccagggcaaggcugacag

SEQ ID NO: 1294548 - RNA, 26 nt, Human
ucaaaaaacaaaacaaaacaaaaaca

SEQ ID NO: 1294549 - RNA, 19 nt, Human
ucaagcaccagacugaacc

SEQ ID NO: 1294550 - RNA, 23 nt, Human
ucacaucacugcacuccagccug

SEQ ID NO: 1294551 - RNA, 21 nt, Human
ucacugcacuccagccugggc

SEQ ID NO: 1294552 - RNA, 24 nt, Human
ucacugcacuccagccugggcaac

SEQ ID NO: 1294553 - RNA, 22 nt, Human
ucagaacugggaauuggauuuc

SEQ ID NO: 1294554 - RNA, 23 nt, Human
ucagaacugggaauuggauuucg

SEQ ID NO: 1294555 - RNA, 21 nt, Human
ucaguagugugauggguggag

SEQ ID NO: 1294556 - RNA, 23 nt, Human
uccagccugggcaacagagugag

SEQ ID NO: 1294557 - RNA, 22 nt, Human
uccauaacugcgcccccaaaga

SEQ ID NO: 1294558 - RNA, 20 nt, Human
ucccuagauaccauggggcu

SEQ ID NO: 1294559 - RNA, 25 nt, Human
ucucaaaaaacaaaacaaaacaaaa

SEQ ID NO: 1294560 - RNA, 18 nt, Human
ucucaaggauucagccag

SEQ ID NO: 1294561 - RNA, 24 nt, Human
ucuccaucucaaaaaacaaaacaa

SEQ ID NO: 1294562 - RNA, 22 nt, Human
ucugaggucaggaguucgagac

SEQ ID NO: 1294563 - RNA, 23 nt, Human
ucugaggucaggaguucgagacc

SEQ ID NO: 1294564 - RNA, 20 nt, Human
ucugcaauuggggaaguggc

SEQ ID NO: 1294565 - RNA, 18 nt, Human
ucuggauuuggaagaccc

SEQ ID NO: 1294566 - RNA, 18 nt, Human
ucugguggguaugguggc

SEQ ID NO: 1294567 - RNA, 22 nt, Human
ugaaacccuaucuccacuaaaa

SEQ ID NO: 1294568 - RNA, 19 nt, Human
ugaaagggagguuggacag

SEQ ID NO: 1294569 - RNA, 20 nt, Human
ugaaaggggagguuggagga

SEQ ID NO: 1294570 - RNA, 24 nt, Human
ugaaucaucugaggucaggaguuc

SEQ ID NO: 1294571 - RNA, 24 nt, Human
ugagaggcugaggcaggagaaugg

SEQ ID NO: 1294572 - RNA, 26 nt, Human
ugagaggcugaggcaggagaaugguu

SEQ ID NO: 1294573 - RNA, 24 nt, Human
ugaggcaggagaaugguuugaacc

SEQ ID NO: 1294574 - RNA, 25 nt, Human
ugaggcaggagaaugguuugaaccc

SEQ ID NO: 1294575 - RNA, 24 nt, Human
ugaggcgggugaaucaucugaggu

SEQ ID NO: 1294576 - RNA, 26 nt, Human
ugaggcgggugaaucaucugagguca

SEQ ID NO: 1294577 - RNA, 20 nt, Human
ugauccauaacugcgccccc

SEQ ID NO: 1294578 - RNA, 28 nt, Human
ugcccugaguccucucaaggauucagcc

SEQ ID NO: 1294579 - RNA, 20 nt, Human
ugccuguaaucccaguuacu

SEQ ID NO: 1294580 - RNA, 23 nt, Human
ugccuguaaucccaguuacuuga

SEQ ID NO: 1294581 - RNA, 20 nt, Human
ugcucugcaaacuuaagcac

SEQ ID NO: 1294582 - RNA, 23 nt, Human
ugcugcuggccugaggguccugg

SEQ ID NO: 1294583 - RNA, 20 nt, Human
ugcugguccauuacucugag

SEQ ID NO: 1294584 - RNA, 18 nt, Human
uggaacagugugcugaga

SEQ ID NO: 1294585 - RNA, 21 nt, Human
uggaagugcucugcaaacuua

SEQ ID NO: 1294586 - RNA, 20 nt, Human
uggcaggcagaggcgggcag

SEQ ID NO: 1294587 - RNA, 21 nt, Human
uggcaggcagaggcgggcagg

SEQ ID NO: 1294588 - RNA, 24 nt, Human
uggcaggcagaggcgggcagggug

SEQ ID NO: 1294589 - RNA, 19 nt, Human
uggcagugggaggagccug

SEQ ID NO: 1294590 - RNA, 22 nt, Human
uggcagugggaggagccuggag

SEQ ID NO: 1294591 - RNA, 20 nt, Human
uggcauuucucaugucagga

SEQ ID NO: 1294592 - RNA, 20 nt, Human
uggccaacauugugaaaccc

SEQ ID NO: 1294593 - RNA, 21 nt, Human
uggcgcaugccuguaauccca

SEQ ID NO: 1294594 - RNA, 22 nt, Human
uggcgcaugccuguaaucccag

SEQ ID NO: 1294595 - RNA, 21 nt, Human
uggcucacaucuguaauccca

SEQ ID NO: 1294596 - RNA, 19 nt, Human
ugggaggcugaggcgggug

SEQ ID NO: 1294597 - RNA, 24 nt, Human
ugggaggcugaggcgggugaauca

SEQ ID NO: 1294598 - RNA, 19 nt, Human
uggggcugccuugcuaaaa

SEQ ID NO: 1294599 - RNA, 19 nt, Human
uggguggagccgggagagg

SEQ ID NO: 1294600 - RNA, 18 nt, Human
ugguaaaauaagaaagcc

SEQ ID NO: 1294601 - RNA, 24 nt, Human
ugguggcgcaugccuguaauccca

SEQ ID NO: 1294602 - RNA, 24 nt, Human
ugguggcucacaucuguaauccca

SEQ ID NO: 1294603 - RNA, 22 nt, Human
ugugauggguggagccgggaga

SEQ ID NO: 1294604 - RNA, 24 nt, Human
uguguggcugaguauggaagugcu

SEQ ID NO: 1294605 - RNA, 26 nt, Human
uguucugcuugcccugaguccucuca

SEQ ID NO: 1294606 - RNA, 22 nt, Human
uguuuuauuuuucuccucuucu

SEQ ID NO: 1294607 - RNA, 25 nt, Human
uuagguuuacugccggcccgccccg

SEQ ID NO: 1294608 - RNA, 19 nt, Human
uucagccaggguugagcau

SEQ ID NO: 1294609 - RNA, 23 nt, Human
uucuucaucuggaaaauggcacu

SEQ ID NO: 1294610 - RNA, 21 nt, Human
uuggaacagugugcugagaag

SEQ ID NO: 1294611 - RNA, 23 nt, Human
uuggaacagugugcugagaagag

SEQ ID NO: 1294612 - RNA, 20 nt, Human
uuggcagugggaggagccug

SEQ ID NO: 1294613 - RNA, 25 nt, Human
uugggaggcugaggcgggugaauca

SEQ ID NO: 1294614 - RNA, 21 nt, Human
uuuacugccggcccgccccgc

SEQ ID NO: 1294615 - RNA, 22 nt, Human
uuucucaugucaggaggggaug

SEQ ID NO: 1294616 - RNA, 24 nt, Human
uuuguuccccuugaaggaggaguu

SEQ ID NO: 1294617 - RNA, 25 nt, Human
agacacuggggaucccgggggagcc

SEQ ID NO: 1294618 - RNA, 21 nt, Human
agcagaccuccguuaaggcuu

SEQ ID NO: 1294619 - RNA, 19 nt, Human
caagcccaggaggguucug

SEQ ID NO: 1294620 - RNA, 24 nt, Human
cagacgguggcugcugucuuccuu

SEQ ID NO: 1294621 - RNA, 21 nt, Human
cagccccuucaucugccccug

SEQ ID NO: 1294622 - RNA, 25 nt, Human
ccaccagggaagcucugagguucug

SEQ ID NO: 1294623 - RNA, 23 nt, Human
ccacccgucagagcagaccuccg

SEQ ID NO: 1294624 - RNA, 18 nt, Human
cccccaggacugcccccg

SEQ ID NO: 1294625 - RNA, 19 nt, Human
cccccaggacugcccccgu

SEQ ID NO: 1294626 - RNA, 22 nt, Human
ccgcagcacccccaggacugcc

SEQ ID NO: 1294627 - RNA, 23 nt, Human
ccucuaggaccuacaggacggcc

SEQ ID NO: 1294628 - RNA, 18 nt, Human
ccugggaggucuaggcug

SEQ ID NO: 1294629 - RNA, 22 nt, Human
cgcagcacccccaggacugccc

SEQ ID NO: 1294630 - RNA, 20 nt, Human
cgguggcugcugucuuccuu

SEQ ID NO: 1294631 - RNA, 22 nt, Human
cugccccugggcuguggcuccu

SEQ ID NO: 1294632 - RNA, 20 nt, Human
cugcugucuuccuuucuggg

SEQ ID NO: 1294633 - RNA, 26 nt, Human
cuuucugggcucacccgggcucuggc

SEQ ID NO: 1294634 - RNA, 25 nt, Human
gacgauggagucguugauaaaggaa

SEQ ID NO: 1294635 - RNA, 26 nt, Human
gccuuauuggaguugccguucucaau

SEQ ID NO: 1294636 - RNA, 19 nt, Human
ggaaaagauccucagcuug

SEQ ID NO: 1294637 - RNA, 22 nt, Human
ggcgaccuuccugucagccugc

SEQ ID NO: 1294638 - RNA, 19 nt, Human
uaaaggaaaagauccucag

SEQ ID NO: 1294639 - RNA, 24 nt, Human
uccgcagccccuucaucugccccu

SEQ ID NO: 1294640 - RNA, 18 nt, Human
ucugagggcuggugugga

SEQ ID NO: 1294641 - RNA, 25 nt, Human
ucugagguucuggaggcagcuugac

SEQ ID NO: 1294642 - RNA, 21 nt, Human
ucuggcagagcccacccguca

SEQ ID NO: 1294643 - RNA, 21 nt, Human
ugcccccgucuuccgcagccc

SEQ ID NO: 1294644 - RNA, 19 nt, Human
uggggaucccgggggagcc

SEQ ID NO: 1294645 - RNA, 20 nt, Human
uggguggaggugcagagaga

SEQ ID NO: 1294646 - RNA, 22 nt, Human
ugguguggagggucacaggccu

SEQ ID NO: 1294647 - RNA, 24 nt, Human
uguagccgcagcacccccaggacu

SEQ ID NO: 1294648 - RNA, 20 nt, Human
uuucugggcucacccgggcu

SEQ ID NO: 1294649 - RNA, 25 nt, Human
aacacacacauccaggauccccuca

SEQ ID NO: 1294650 - RNA, 26 nt, Human
aagcauuuauuuuauuaccaaaaaca

SEQ ID NO: 1294651 - RNA, 23 nt, Human
auaacagccucuuuaacaagaac

SEQ ID NO: 1294652 - RNA, 22 nt, Human
cacauccaggauccccucaaag

SEQ ID NO: 1294653 - RNA, 18 nt, Human
cagaguccucaggcuccc

SEQ ID NO: 1294654 - RNA, 19 nt, Human
ccaggccagaguggaccac

SEQ ID NO: 1294655 - RNA, 21 nt, Human
cccacaaaauguagucuggca

SEQ ID NO: 1294656 - RNA, 21 nt, Human
ccucaaagaauccagaguccu

SEQ ID NO: 1294657 - RNA, 24 nt, Human
ccucaaagaauccagaguccucag

SEQ ID NO: 1294658 - RNA, 18 nt, Human
cucaaugccuccaauccu

SEQ ID NO: 1294659 - RNA, 18 nt, Human
gaaauggucuggcucugc

SEQ ID NO: 1294660 - RNA, 25 nt, Human
gaacacacacauccaggauccccuc

SEQ ID NO: 1294661 - RNA, 24 nt, Human
gcaaacccaggccagaguggacca

SEQ ID NO: 1294662 - RNA, 20 nt, Human
uaaucaugaaaguccuuggg

SEQ ID NO: 1294663 - RNA, 24 nt, Human
ucaaacuucaggaccuggggaaga

SEQ ID NO: 1294664 - RNA, 19 nt, Human
uccagaguccucaggcucc

SEQ ID NO: 1294665 - RNA, 18 nt, Human
uggcagaaaagggaaguc

SEQ ID NO: 1294666 - RNA, 24 nt, Human
uggcagaaaagggaagucuuuaga

SEQ ID NO: 1294667 - RNA, 22 nt, Human
uggggaagaaauggucuggcuc

SEQ ID NO: 1294668 - RNA, 25 nt, Human
uuaauaaacacgcucaaugccucca

SEQ ID NO: 1294669 - RNA, 23 nt, Human
aagcugguguccaugguuacagg

SEQ ID NO: 1294670 - RNA, 20 nt, Human
acugcacguucaucgacauc

SEQ ID NO: 1294671 - RNA, 23 nt, Human
agcuucuggccagcuugacauuu

SEQ ID NO: 1294672 - RNA, 25 nt, Human
aggaacaacggggagcaccaauuuc

SEQ ID NO: 1294673 - RNA, 24 nt, Human
ccuccauucaccacugcacguuca

SEQ ID NO: 1294674 - RNA, 21 nt, Human
gccaucuuccuccagcuucug

SEQ ID NO: 1294675 - RNA, 18 nt, Human
gcugcuggcagccuccau

SEQ ID NO: 1294676 - RNA, 20 nt, Human
gguuacaggaacaacgggga

SEQ ID NO: 1294677 - RNA, 19 nt, Human
guucuuuucacagcuauug

SEQ ID NO: 1294678 - RNA, 18 nt, Human
ucacauccuuugccaucu

SEQ ID NO: 1294679 - RNA, 22 nt, Human
ucacauccuuugccaucuuccu

SEQ ID NO: 1294680 - RNA, 22 nt, Human
uccauucaccacugcacguucc

SEQ ID NO: 1294681 - RNA, 18 nt, Human
uccuuugccaucuuccuc

SEQ ID NO: 1294682 - RNA, 24 nt, Human
uccuuugccaucuuccuccagcuu

SEQ ID NO: 1294683 - RNA, 25 nt, Human
ugacagccaccauugucaaugguac

SEQ ID NO: 1294684 - RNA, 20 nt, Human
ugcuggcagccuccauucac

SEQ ID NO: 1294685 - RNA, 18 nt, Human
uggcagccuccauucacc

SEQ ID NO: 1294686 - RNA, 23 nt, Human
uuccuccagcuucuggccagcuu

SEQ ID NO: 1294687 - RNA, 26 nt, Human
uuucacagcuauugacaauuuccaau

SEQ ID NO: 1294688 - RNA, 23 nt, Human
uuugccaucuuccuccagcuucu

SEQ ID NO: 1294689 - RNA, 27 nt, Human
uuuuaugcaggugcguucaucagcaac

SEQ ID NO: 1294690 - RNA, 19 nt, Human
gcucuguggcgggagcgag

SEQ ID NO: 1294691 - RNA, 20 nt, Human
gcugcgggcucuguggcggg

SEQ ID NO: 1294692 - RNA, 23 nt, Human
ggagcgaggccgacgggcggggc

SEQ ID NO: 1294693 - RNA, 22 nt, Human
gguccuucuuccucaaaagccu

SEQ ID NO: 1294694 - RNA, 21 nt, Human
ucuuccucaaaagccuuccag

SEQ ID NO: 1294695 - RNA, 18 nt, Human
uuccagauuuguuugugu

SEQ ID NO: 1294696 - RNA, 24 nt, Human
aaaaacugcaaaagaagccaugug

SEQ ID NO: 1294697 - RNA, 26 nt, Human
aaaagaagaaaaaauaucaauagcac

SEQ ID NO: 1294698 - RNA, 21 nt, Human
aaagaaaagaaugccaaaggg

SEQ ID NO: 1294699 - RNA, 19 nt, Human
aaagaagccaugugcucaa

SEQ ID NO: 1294700 - RNA, 21 nt, Human
aaauaucaauagcacaaaacu

SEQ ID NO: 1294701 - RNA, 19 nt, Human
aacaguucuugaucuaguc

SEQ ID NO: 1294702 - RNA, 22 nt, Human
aagaagaaaaaauaucaauaga

SEQ ID NO: 1294703 - RNA, 23 nt, Human
aagaagaaaaaauaucaauagca

SEQ ID NO: 1294704 - RNA, 19 nt, Human
aagaagccaugugcucaaa

SEQ ID NO: 1294705 - RNA, 23 nt, Human
aagcaaaagaagaaaaaagggac

SEQ ID NO: 1294706 - RNA, 25 nt, Human
acaaagcugucuccauuugcuaaag

SEQ ID NO: 1294707 - RNA, 26 nt, Human
acaaagcugucuccauuugcuaaagc

SEQ ID NO: 1294708 - RNA, 23 nt, Human
auuuuuuuaauaagcugugcauu

SEQ ID NO: 1294709 - RNA, 21 nt, Human
caaaagaagaaaaaauaucaa

SEQ ID NO: 1294710 - RNA, 21 nt, Human
caaagaaaagaaugccaaagg

SEQ ID NO: 1294711 - RNA, 24 nt, Human
caaagcugucuccauuugcuaaag

SEQ ID NO: 1294712 - RNA, 21 nt, Human
ccucugcuucugaaucaaagg

SEQ ID NO: 1294713 - RNA, 19 nt, Human
cuacacugcagaggagauc

SEQ ID NO: 1294714 - RNA, 18 nt, Human
cucaaagaaaagaaugcc

SEQ ID NO: 1294715 - RNA, 21 nt, Human
cucuacacugcagaggagauc

SEQ ID NO: 1294716 - RNA, 21 nt, Human
cugcaaaagaagccaugugcu

SEQ ID NO: 1294717 - RNA, 22 nt, Human
cuugcaggucuccaugcccugc

SEQ ID NO: 1294718 - RNA, 22 nt, Human
gaaaaacugcaaaagaagccau

SEQ ID NO: 1294719 - RNA, 21 nt, Human
gauaacaauuuugauuuuuuu

SEQ ID NO: 1294720 - RNA, 20 nt, Human
gcuaaagcuauaaacaguuc

SEQ ID NO: 1294721 - RNA, 21 nt, Human
uagcacaaaacugcccuuaua

SEQ ID NO: 1294722 - RNA, 22 nt, Human
ucaaggccaugugucuugcagg

SEQ ID NO: 1294723 - RNA, 21 nt, Human
ucuccaugcccugcacugccc

SEQ ID NO: 1294724 - RNA, 22 nt, Human
ugaagaccaugaacccucugcu

SEQ ID NO: 1294725 - RNA, 23 nt, Human
ugcaaaagaagccaugugcucaa

SEQ ID NO: 1294726 - RNA, 21 nt, Human
ugcaaaauacauggauggcca

SEQ ID NO: 1294727 - RNA, 19 nt, Human
ugcaaaggccucaaggcca

SEQ ID NO: 1294728 - RNA, 18 nt, Human
ugcccagcucuggucucu

SEQ ID NO: 1294729 - RNA, 24 nt, Human
ugugaagaaguuucacaaagcugg

SEQ ID NO: 1294730 - RNA, 19 nt, Human
ugugcaaaggccucaagga

SEQ ID NO: 1294731 - RNA, 21 nt, Human
ugugcaaaggccucaaggcca

SEQ ID NO: 1294732 - RNA, 21 nt, Human
uugaagaccaugaacccucug

SEQ ID NO: 1294733 - RNA, 25 nt, Human
uuugcuaaagcuauaaacaguucuu

SEQ ID NO: 1294734 - RNA, 21 nt, Human
aaacacaaccaaacuaaacug

SEQ ID NO: 1294735 - RNA, 24 nt, Human
aacaaaagguaagcaaaagggacc

SEQ ID NO: 1294736 - RNA, 19 nt, Human
aaccaagucuccuaauuug

SEQ ID NO: 1294737 - RNA, 21 nt, Human
aagacaaagcaaagcaucaac

SEQ ID NO: 1294738 - RNA, 19 nt, Human
aaggaccaaagauaguacu

SEQ ID NO: 1294739 - RNA, 19 nt, Human
aauacuuuccauugauagc

SEQ ID NO: 1294740 - RNA, 24 nt, Human
acaccacuuguaggccuuugcuag

SEQ ID NO: 1294741 - RNA, 18 nt, Human
accaugaaagugcauaau

SEQ ID NO: 1294742 - RNA, 24 nt, Human
acucgucgcccaggcuggagugca

SEQ ID NO: 1294743 - RNA, 22 nt, Human
acugagaaagacuauaccauga

SEQ ID NO: 1294744 - RNA, 24 nt, Human
acugcagcugcucuuugguuuggc

SEQ ID NO: 1294745 - RNA, 21 nt, Human
acugccaaacuggaguuaugu

SEQ ID NO: 1294746 - RNA, 25 nt, Human
acuucaguuauuucauuccacuucu

SEQ ID NO: 1294747 - RNA, 21 nt, Human
agaugaaaauaaacuuuguaa

SEQ ID NO: 1294748 - RNA, 23 nt, Human
auagucaaaaucugcuaauagaa

SEQ ID NO: 1294749 - RNA, 19 nt, Human
augguacuuguuagguaaa

SEQ ID NO: 1294750 - RNA, 23 nt, Human
auguagaaaugcaaaaaguacca

SEQ ID NO: 1294751 - RNA, 20 nt, Human
caaaagacaaagcaaagcau

SEQ ID NO: 1294752 - RNA, 22 nt, Human
caaaagacaaagcaaagcauca

SEQ ID NO: 1294753 - RNA, 20 nt, Human
caaagaggcagccuuucccu

SEQ ID NO: 1294754 - RNA, 24 nt, Human
caaagcaucaacauuaagucacag

SEQ ID NO: 1294755 - RNA, 21 nt, Human
caaccaaacuaaacuguacuu

SEQ ID NO: 1294756 - RNA, 24 nt, Human
cagccaaaagacaaagcaaagcau

SEQ ID NO: 1294757 - RNA, 19 nt, Human
caggagaacauuucugaaa

SEQ ID NO: 1294758 - RNA, 24 nt, Human
caugucaauguagguuaggccagc

SEQ ID NO: 1294759 - RNA, 22 nt, Human
cauuuuuaauuuaaauuggaaa

SEQ ID NO: 1294760 - RNA, 19 nt, Human
cccaaauaguugauagcaa

SEQ ID NO: 1294761 - RNA, 21 nt, Human
cccaggcuggagugcaaaggc

SEQ ID NO: 1294762 - RNA, 23 nt, Human
cgcccaggcuggagugcaaaggc

SEQ ID NO: 1294763 - RNA, 19 nt, Human
cgcgggagccccggcgacg

SEQ ID NO: 1294764 - RNA, 21 nt, Human
cgucgcccaggcuggagugca

SEQ ID NO: 1294765 - RNA, 24 nt, Human
cucgucgcccaggcuggagugcaa

SEQ ID NO: 1294766 - RNA, 22 nt, Human
cugaaagaucucacaugccuga

SEQ ID NO: 1294767 - RNA, 22 nt, Human
cugccuauucaaugcccagaau

SEQ ID NO: 1294768 - RNA, 25 nt, Human
cuuuguaaacuuguucauuuaaaau

SEQ ID NO: 1294769 - RNA, 24 nt, Human
gaaagugcauaauagugaagaaaa

SEQ ID NO: 1294770 - RNA, 19 nt, Human
gauagcagugcuagucccu

SEQ ID NO: 1294771 - RNA, 19 nt, Human
gcaagaccugaacuucaac

SEQ ID NO: 1294772 - RNA, 19 nt, Human
gcccaggcuggagugcaaa

SEQ ID NO: 1294773 - RNA, 19 nt, Human
gcugaaaugcaaaaauaug

SEQ ID NO: 1294774 - RNA, 22 nt, Human
gcuggagugcaaaggcuuuccg

SEQ ID NO: 1294775 - RNA, 21 nt, Human
ggaguuucacucgucgcccag

SEQ ID NO: 1294776 - RNA, 21 nt, Human
ggcugccgagccccgcguccc

SEQ ID NO: 1294777 - RNA, 26 nt, Human
guacugcagcugcucuuugguuuggc

SEQ ID NO: 1294778 - RNA, 24 nt, Human
guuucacucgucgcccaggcugga

SEQ ID NO: 1294779 - RNA, 24 nt, Human
uaaaguaauucauuaugacuuuug

SEQ ID NO: 1294780 - RNA, 21 nt, Human
uaacaaaauaauauagaauga

SEQ ID NO: 1294781 - RNA, 25 nt, Human
uaauagaaauacaauucaaguaaac

SEQ ID NO: 1294782 - RNA, 23 nt, Human
uaauggcaauggcaagaccugaa

SEQ ID NO: 1294783 - RNA, 18 nt, Human
uacaugucaauguagguu

SEQ ID NO: 1294784 - RNA, 18 nt, Human
uaccaugaaagugcauaa

SEQ ID NO: 1294785 - RNA, 19 nt, Human
uaccaugaaagugcauaau

SEQ ID NO: 1294786 - RNA, 19 nt, Human
uaggccagccaaaagacaa

SEQ ID NO: 1294787 - RNA, 20 nt, Human
uauagaaugaagucauuaga

SEQ ID NO: 1294788 - RNA, 28 nt, Human
ucacaugccugauaauccuuaauuuaaa

SEQ ID NO: 1294789 - RNA, 20 nt, Human
ucacucgucgcccaggcugg

SEQ ID NO: 1294790 - RNA, 21 nt, Human
ucacucgucgcccaggcugga

SEQ ID NO: 1294791 - RNA, 24 nt, Human
ucacucgucgcccaggcuggagug

SEQ ID NO: 1294792 - RNA, 22 nt, Human
ucacuuuaaaauaguguccauc

SEQ ID NO: 1294793 - RNA, 22 nt, Human
ucccacaccacuuguaggccuu

SEQ ID NO: 1294794 - RNA, 19 nt, Human
ucccuagaacaaaagguaa

SEQ ID NO: 1294795 - RNA, 26 nt, Human
ucccugauucccacaccacuuguagg

SEQ ID NO: 1294796 - RNA, 18 nt, Human
ucgcccaggcuggagugc

SEQ ID NO: 1294797 - RNA, 23 nt, Human
ugaaacauauggauuucagacau

SEQ ID NO: 1294798 - RNA, 24 nt, Human
ugaacuucaacuuuauuuuucuua

SEQ ID NO: 1294799 - RNA, 19 nt, Human
ugagauaccaaagaggcag

SEQ ID NO: 1294800 - RNA, 22 nt, Human
ugcaaaaaguaccaggagaaca

SEQ ID NO: 1294801 - RNA, 18 nt, Human
ugcauaauagugaagaaa

SEQ ID NO: 1294802 - RNA, 19 nt, Human
ugccaaacuggaguuaugu

SEQ ID NO: 1294803 - RNA, 23 nt, Human
uggaguuucacucgucgcccagg

SEQ ID NO: 1294804 - RNA, 20 nt, Human
uggcaagaccugaacuucac

SEQ ID NO: 1294805 - RNA, 21 nt, Human
uguacugcagcugcucuuugg

SEQ ID NO: 1294806 - RNA, 18 nt, Human
ugugcuauuaaagauguu

SEQ ID NO: 1294807 - RNA, 18 nt, Human
uguguacaugucaaugua

SEQ ID NO: 1294808 - RNA, 21 nt, Human
uuacugccuauucaaugccca

SEQ ID NO: 1294809 - RNA, 22 nt, Human
uucacucgucgcccaggcugga

SEQ ID NO: 1294810 - RNA, 24 nt, Human
uucacucgucgcccaggcuggagu

SEQ ID NO: 1294811 - RNA, 21 nt, Human
uuucacucgucgcccaggcug

SEQ ID NO: 1294812 - RNA, 23 nt, Human
uuucacucgucgcccaggcugga

SEQ ID NO: 1294813 - RNA, 23 nt, Human
uuucugaaucuauauuacauuuu

SEQ ID NO: 1294814 - RNA, 19 nt, Human
gcgcucagccgguccaggg

SEQ ID NO: 1294815 - RNA, 20 nt, Human
ggcgcucagccgguccaggg

SEQ ID NO: 1294816 - RNA, 26 nt, Human
aaggugggauucaggaagaucccacc

SEQ ID NO: 1294817 - RNA, 27 nt, Human
caaggcgggauucaggaagaucucacc

SEQ ID NO: 1294818 - RNA, 27 nt, Human
caagguggggcucaggaagaucccacc

SEQ ID NO: 1294819 - RNA, 24 nt, Human
ccuccaacccugaugggcaaggcg

SEQ ID NO: 1294820 - RNA, 18 nt, Human
gcacugggugaagcgcug

SEQ ID NO: 1294821 - RNA, 24 nt, Human
gcgagaugggguccaggcaaggcc

SEQ ID NO: 1294822 - RNA, 22 nt, Human
ggcacugggugaagcgcugucc

SEQ ID NO: 1294823 - RNA, 19 nt, Human
ugggguccaggcaaggccc

SEQ ID NO: 1294824 - RNA, 19 nt, Human
ugucugcgauuuucuccuu

SEQ ID NO: 1294825 - RNA, 23 nt, Human
ucuuugauuucugucaugggugc

SEQ ID NO: 1294826 - RNA, 18 nt, Human
ugaaacuggaagccauga

SEQ ID NO: 1294827 - RNA, 19 nt, Human
ugacuccuuugcuuuccuc

SEQ ID NO: 1294828 - RNA, 23 nt, Human
uuagaagucaauccgcccgccgc

SEQ ID NO: 1294829 - RNA, 19 nt, Human
uuuccacugaaacuggaag

SEQ ID NO: 1294830 - RNA, 22 nt, Human
uuuccucuuccucuucuggguu

SEQ ID NO: 1294831 - RNA, 25 nt, Human
aaacaaaaaccagcuggauccagag

SEQ ID NO: 1294832 - RNA, 23 nt, Human
aaaguucugggauuacaggcaca

SEQ ID NO: 1294833 - RNA, 23 nt, Human
aacaacuuucaggucacagacca

SEQ ID NO: 1294834 - RNA, 23 nt, Human
aacauccuuuagccucuuccaca

SEQ ID NO: 1294835 - RNA, 20 nt, Human
aaguuccaggaagaagcuga

SEQ ID NO: 1294836 - RNA, 20 nt, Human
acgggguuucuccauguugg

SEQ ID NO: 1294837 - RNA, 24 nt, Human
acgggguuucuccauguuggccag

SEQ ID NO: 1294838 - RNA, 25 nt, Human
acgggguuucuccauguuggccagu

SEQ ID NO: 1294839 - RNA, 21 nt, Human
agcaaaacaaaaaccagcugg

SEQ ID NO: 1294840 - RNA, 31 nt, Human
aggaagaagcugagccucagcaaaacaaaaa

SEQ ID NO: 1294841 - RNA, 24 nt, Human
aggugauccacccaccucggccuu

SEQ ID NO: 1294842 - RNA, 26 nt, Human
agucuggucucgaacuccugaccucc

SEQ ID NO: 1294843 - RNA, 23 nt, Human
aucaugucagccauuugagaccc

SEQ ID NO: 1294844 - RNA, 24 nt, Human
auuuuuguauuuuuaguagagacg

SEQ ID NO: 1294845 - RNA, 24 nt, Human
caaaguucugggauuacaggcaca

SEQ ID NO: 1294846 - RNA, 24 nt, Human
caccacaccuggcuaauuuuugua

SEQ ID NO: 1294847 - RNA, 22 nt, Human
cacccaccucggccuuccaaag

SEQ ID NO: 1294848 - RNA, 23 nt, Human
cacccaccucggccuuccaaagu

SEQ ID NO: 1294849 - RNA, 24 nt, Human
cagagucuugcucuguugcccagg

SEQ ID NO: 1294850 - RNA, 20 nt, Human
caugucagccauuugagacc

SEQ ID NO: 1294851 - RNA, 22 nt, Human
ccaaaguucugggauuacaggc

SEQ ID NO: 1294852 - RNA, 23 nt, Human
ccaaaguucugggauuacaggca

SEQ ID NO: 1294853 - RNA, 20 nt, Human
ccaggaagaagcugagccuc

SEQ ID NO: 1294854 - RNA, 21 nt, Human
ccaggaagaagcugagccuca

SEQ ID NO: 1294855 - RNA, 22 nt, Human
ccauguuggccagucuggucuc

SEQ ID NO: 1294856 - RNA, 24 nt, Human
ccugaccucaggugauccacccac

SEQ ID NO: 1294857 - RNA, 19 nt, Human
cgggguuucuccauguugg

SEQ ID NO: 1294858 - RNA, 23 nt, Human
cuaauuuuuguauuuuuaguaga

SEQ ID NO: 1294859 - RNA, 24 nt, Human
cuccauguuggccagucuggucuc

SEQ ID NO: 1294860 - RNA, 25 nt, Human
cucggccuuccaaaguucugggauu

SEQ ID NO: 1294861 - RNA, 24 nt, Human
gaccucaggugauccacccaccuc

SEQ ID NO: 1294862 - RNA, 24 nt, Human
gagacgggguuucuccauguuggc

SEQ ID NO: 1294863 - RNA, 25 nt, Human
gagaugccugccugacacagugagg

SEQ ID NO: 1294864 - RNA, 24 nt, Human
gagccucagcaaaacaaaaaccag

SEQ ID NO: 1294865 - RNA, 21 nt, Human
gauuacaggcacaagccacug

SEQ ID NO: 1294866 - RNA, 24 nt, Human
gauuacaggcacaagccacugugc

SEQ ID NO: 1294867 - RNA, 25 nt, Human
gcagaacacuccaacuauucaacaa

SEQ ID NO: 1294868 - RNA, 20 nt, Human
gcucuguugcccaggcugga

SEQ ID NO: 1294869 - RNA, 22 nt, Human
ggagacagagucuugcucuguu

SEQ ID NO: 1294870 - RNA, 24 nt, Human
ggauuacaggcacaagccacugug

SEQ ID NO: 1294871 - RNA, 19 nt, Human
ggucucgaacuccugaccu

SEQ ID NO: 1294872 - RNA, 23 nt, Human
guagagacgggguuucuccaugu

SEQ ID NO: 1294873 - RNA, 24 nt, Human
gugauccacccaccucggccuucc

SEQ ID NO: 1294874 - RNA, 24 nt, Human
uaauuuuuguauuuuuaguagaga

SEQ ID NO: 1294875 - RNA, 23 nt, Human
uacaggcacaagccacugugccc

SEQ ID NO: 1294876 - RNA, 21 nt, Human
uagaaaggaaggcauguauuu

SEQ ID NO: 1294877 - RNA, 24 nt, Human
uaguagagacgggguuucuccaug

SEQ ID NO: 1294878 - RNA, 20 nt, Human
ucaggugauccacccaccuc

SEQ ID NO: 1294879 - RNA, 24 nt, Human
uccaaaguucugggauuacaggca

SEQ ID NO: 1294880 - RNA, 24 nt, Human
uccauguuggccagucuggucucg

SEQ ID NO: 1294881 - RNA, 23 nt, Human
ucucgaacuccugaccucaggug

SEQ ID NO: 1294882 - RNA, 18 nt, Human
ucuguugcccaggcugga

SEQ ID NO: 1294883 - RNA, 23 nt, Human
ucuugcucuguugcccaggcugg

SEQ ID NO: 1294884 - RNA, 24 nt, Human
ucuugcucuguugcccaggcugga

SEQ ID NO: 1294885 - RNA, 21 nt, Human
ugaccucaggugauccaccca

SEQ ID NO: 1294886 - RNA, 24 nt, Human
ugaccucaggugauccacccaccu

SEQ ID NO: 1294887 - RNA, 24 nt, Human
ugauccacccaccucggccuucca

SEQ ID NO: 1294888 - RNA, 21 nt, Human
ugcagcaguagaaaggaaggc

SEQ ID NO: 1294889 - RNA, 23 nt, Human
ugcagcaguagaaaggaaggcau

SEQ ID NO: 1294890 - RNA, 19 nt, Human
ugcucuguugcccaggcug

SEQ ID NO: 1294891 - RNA, 22 nt, Human
uggagacagagucuugcucugu

SEQ ID NO: 1294892 - RNA, 21 nt, Human
ugggauuacaggcacaagcca

SEQ ID NO: 1294893 - RNA, 22 nt, Human
ugggauuacaggcacaagccac

SEQ ID NO: 1294894 - RNA, 22 nt, Human
ugggauuacaggcacaagccac

SEQ ID NO: 1294895 - RNA, 23 nt, Human
ugggauuacaggcacaagccacu

SEQ ID NO: 1294896 - RNA, 24 nt, Human
ugggauuacaggcacaagccacug

SEQ ID NO: 1294897 - RNA, 26 nt, Human
ugggauuacaggcacaagccacugug

SEQ ID NO: 1294898 - RNA, 21 nt, Human
uggucucgaacuccugaccuc

SEQ ID NO: 1294899 - RNA, 21 nt, Human
uguauuuuuaguagagacggg

SEQ ID NO: 1294900 - RNA, 27 nt, Human
uguuggccagucuggucucgaacuccu

SEQ ID NO: 1294901 - RNA, 18 nt, Human
uuaguagagacgggguuu

SEQ ID NO: 1294902 - RNA, 22 nt, Human
uuaguagagacgggguuucucc

SEQ ID NO: 1294903 - RNA, 24 nt, Human
uuaguagagacgggguuucuccau

SEQ ID NO: 1294904 - RNA, 23 nt, Human
uuguauuuuuaguagagacgggg

SEQ ID NO: 1294905 - RNA, 18 nt, Human
uuucuccauguuggccag

SEQ ID NO: 1294906 - RNA, 22 nt, Human
uuuuuaguagagacgggguuuc

SEQ ID NO: 1294907 - RNA, 20 nt, Human
uuuuuguauuuuuaguagag

SEQ ID NO: 1294908 - RNA, 23 nt, Human
agccgccaugugaauuggggaca

SEQ ID NO: 1294909 - RNA, 18 nt, Human
aggagcagcuggggcugg

SEQ ID NO: 1294910 - RNA, 21 nt, Human
caacaggagccggacacaguc

SEQ ID NO: 1294911 - RNA, 24 nt, Human
caagcucccggaccaccucauccu

SEQ ID NO: 1294912 - RNA, 23 nt, Human
caagugguucucuugugcugcca

SEQ ID NO: 1294913 - RNA, 19 nt, Human
cacagaauagggcaugccg

SEQ ID NO: 1294914 - RNA, 20 nt, Human
cagcaggaucucugagauuc

SEQ ID NO: 1294915 - RNA, 21 nt, Human
caggaucucugagauucgcac

SEQ ID NO: 1294916 - RNA, 20 nt, Human
ccauucaacccauucugguu

SEQ ID NO: 1294917 - RNA, 22 nt, Human
ccauuuucacauggccuuccuu

SEQ ID NO: 1294918 - RNA, 23 nt, Human
ccccgauccagcagcagccgcac

SEQ ID NO: 1294919 - RNA, 19 nt, Human
ccccgugguccagcaggau

SEQ ID NO: 1294920 - RNA, 19 nt, Human
ccggacacagucgaggugg

SEQ ID NO: 1294921 - RNA, 22 nt, Human
ccuuagaagccagaugcaagcc

SEQ ID NO: 1294922 - RNA, 26 nt, Human
ccuuagccacccugugguguccacag

SEQ ID NO: 1294923 - RNA, 19 nt, Human
cgccgaagggccuuggggg

SEQ ID NO: 1294924 - RNA, 21 nt, Human
cuccccgauccagcagcagcc

SEQ ID NO: 1294925 - RNA, 20 nt, Human
cugguagcagcaucggcuuc

SEQ ID NO: 1294926 - RNA, 18 nt, Human
gaggaggagcagcugggg

SEQ ID NO: 1294927 - RNA, 20 nt, Human
gaggaggagcagcuggggcu

SEQ ID NO: 1294928 - RNA, 19 nt, Human
gaguuggguuuggccccuu

SEQ ID NO: 1294929 - RNA, 24 nt, Human
gccagaugcaagccauucaaccca

SEQ ID NO: 1294930 - RNA, 18 nt, Human
gcccggcuagagcagcga

SEQ ID NO: 1294931 - RNA, 18 nt, Human
ggagaggugucaauucgu

SEQ ID NO: 1294932 - RNA, 21 nt, Human
gggcuugaggaggagcagcug

SEQ ID NO: 1294933 - RNA, 24 nt, Human
gugaugucgucuaucucugcgucg

SEQ ID NO: 1294934 - RNA, 22 nt, Human
uagcagcaucggcuucgcggaa

SEQ ID NO: 1294935 - RNA, 23 nt, Human
uccaagugguucucuugugcugc

SEQ ID NO: 1294936 - RNA, 21 nt, Human
uccauaguugacaagcucccg

SEQ ID NO: 1294937 - RNA, 19 nt, Human
ucuugguuuuggcuuggau

SEQ ID NO: 1294938 - RNA, 21 nt, Human
ugaggaggagcagcuggggcu

SEQ ID NO: 1294939 - RNA, 22 nt, Human
ugccauguacagggguguaaaa

SEQ ID NO: 1294940 - RNA, 20 nt, Human
uggaguggggucaggugguc

SEQ ID NO: 1294941 - RNA, 22 nt, Human
uggauuggugccccguggucca

SEQ ID NO: 1294942 - RNA, 20 nt, Human
ugggcagccacguggagugg

SEQ ID NO: 1294943 - RNA, 24 nt, Human
uggggucaggugguccagggugau

SEQ ID NO: 1294944 - RNA, 20 nt, Human
ugguuucuaucugggcuccc

SEQ ID NO: 1294945 - RNA, 23 nt, Human
uguccaaguuaccugaucuugcu

SEQ ID NO: 1294946 - RNA, 20 nt, Human
ugugcagaaguucaaccacc

SEQ ID NO: 1294947 - RNA, 20 nt, Human
uuccaguaaaaacuuaacca

SEQ ID NO: 1294948 - RNA, 19 nt, Human
uuccaguaaaaacuuaagg

SEQ ID NO: 1294949 - RNA, 24 nt, Human
uucgcggaagcccacagaauaggg

SEQ ID NO: 1294950 - RNA, 20 nt, Human
uugacaagcucccggaccac

SEQ ID NO: 1294951 - RNA, 21 nt, Human
uugugcagaaguucaaccacc

SEQ ID NO: 1294952 - RNA, 18 nt, Human
aaacaauguuucuacuaa

SEQ ID NO: 1294953 - RNA, 23 nt, Human
aaacaguucagguauggcuccca

SEQ ID NO: 1294954 - RNA, 18 nt, Human
aacguggugaaacaaugu

SEQ ID NO: 1294955 - RNA, 20 nt, Human
aagaaaacaucaaaaaggag

SEQ ID NO: 1294956 - RNA, 19 nt, Human
aagaugccaaacuuuuguc

SEQ ID NO: 1294957 - RNA, 18 nt, Human
aagccaaggagaaaggga

SEQ ID NO: 1294958 - RNA, 18 nt, Human
acaccaggggcccagaga

SEQ ID NO: 1294959 - RNA, 20 nt, Human
agaaaacaucaaaaaggaga

SEQ ID NO: 1294960 - RNA, 20 nt, Human
agaaagaaaacaauggucau

SEQ ID NO: 1294961 - RNA, 24 nt, Human
agacggcagggcuagaucuggggg

SEQ ID NO: 1294962 - RNA, 18 nt, Human
agagaggagggccuggaa

SEQ ID NO: 1294963 - RNA, 24 nt, Human
agcacuuugggaggccgaggcagg

SEQ ID NO: 1294964 - RNA, 21 nt, Human
aggagagggagggaaaggcuu

SEQ ID NO: 1294965 - RNA, 24 nt, Human
aggagggccuggaaccacagcuca

SEQ ID NO: 1294966 - RNA, 21 nt, Human
aggcagaggggagugcaaggg

SEQ ID NO: 1294967 - RNA, 20 nt, Human
aggcaggcggaucacgaggu

SEQ ID NO: 1294968 - RNA, 24 nt, Human
aggcaggcggaucacgaggucagg

SEQ ID NO: 1294969 - RNA, 26 nt, Human
aggcaggcggaucacgaggucaggag

SEQ ID NO: 1294970 - RNA, 21 nt, Human
aggccgaggcaggcggaucac

SEQ ID NO: 1294971 - RNA, 23 nt, Human
aggccgaggcaggcggaucacga

SEQ ID NO: 1294972 - RNA, 24 nt, Human
aggcggaucacgaggucaggagau

SEQ ID NO: 1294973 - RNA, 22 nt, Human
aggcuaaccaguuuccaacacu

SEQ ID NO: 1294974 - RNA, 19 nt, Human
aggcugaggcaggagaaug

SEQ ID NO: 1294975 - RNA, 21 nt, Human
agggaccaggcuucuaugagc

SEQ ID NO: 1294976 - RNA, 24 nt, Human
aguggcucacgccuguaaucccag

SEQ ID NO: 1294977 - RNA, 25 nt, Human
caaaaaaaguuagccggguguggug

SEQ ID NO: 1294978 - RNA, 22 nt, Human
caaagcuuaauaaaagggcugg

SEQ ID NO: 1294979 - RNA, 19 nt, Human
cacagcucagcuuucuguc

SEQ ID NO: 1294980 - RNA, 22 nt, Human
cacccauaacacaacuuuuguu

SEQ ID NO: 1294981 - RNA, 24 nt, Human
cacgccuguaaucccagcacuuug

SEQ ID NO: 1294982 - RNA, 24 nt, Human
cagcacuuugggaggccgaggcag

SEQ ID NO: 1294983 - RNA, 26 nt, Human
cagcacuuugggaggccgaggcaggc

SEQ ID NO: 1294984 - RNA, 24 nt, Human
cagcuacucaggaggcugaggcag

SEQ ID NO: 1294985 - RNA, 23 nt, Human
cagguauggcucccaagcccaga

SEQ ID NO: 1294986 - RNA, 24 nt, Human
cagucccauucccccaggaaauca

SEQ ID NO: 1294987 - RNA, 25 nt, Human
cauccugacacacagauaaaacauc

SEQ ID NO: 1294988 - RNA, 22 nt, Human
ccaagaugccaaacuuuugucu

SEQ ID NO: 1294989 - RNA, 18 nt, Human
ccaaggagaaagggagga

SEQ ID NO: 1294990 - RNA, 23 nt, Human
ccaggcuucuaugagcggggaga

SEQ ID NO: 1294991 - RNA, 25 nt, Human
cccaggaaaucaagaacaaacaaac

SEQ ID NO: 1294992 - RNA, 19 nt, Human
ccccagaaacccuugucuc

SEQ ID NO: 1294993 - RNA, 22 nt, Human
ccccagaaacccuugucuccag

SEQ ID NO: 1294994 - RNA, 21 nt, Human
ccccaggaaaucaagaacaaa

SEQ ID NO: 1294995 - RNA, 20 nt, Human
ccuggcuaacguggugaaac

SEQ ID NO: 1294996 - RNA, 21 nt, Human
ccuggcuaacguggugaaaca

SEQ ID NO: 1294997 - RNA, 21 nt, Human
ccuguagucccagcuacucag

SEQ ID NO: 1294998 - RNA, 19 nt, Human
ccuuugagccuacaguuga

SEQ ID NO: 1294999 - RNA, 20 nt, Human
cgaccaaccuuggacauggc

SEQ ID NO: 1295000 - RNA, 24 nt, Human
cgaggcaggcggaucacgagguca

SEQ ID NO: 1295001 - RNA, 23 nt, Human
cgccuguaaucccagcacuuugg

SEQ ID NO: 1295002 - RNA, 24 nt, Human
cgccuguaaucccagcacuuuggg

SEQ ID NO: 1295003 - RNA, 24 nt, Human
cgccuguagucccagcuacucagg

SEQ ID NO: 1295004 - RNA, 22 nt, Human
cucacgccuguaaucccagcac

SEQ ID NO: 1295005 - RNA, 24 nt, Human
cucacgccuguaaucccagcacuu

SEQ ID NO: 1295006 - RNA, 24 nt, Human
cucggcugggugcaguggcucacg

SEQ ID NO: 1295007 - RNA, 21 nt, Human
cucugaccuuacucaccgccu

SEQ ID NO: 1295008 - RNA, 19 nt, Human
cuggccaaagcagaagccc

SEQ ID NO: 1295009 - RNA, 21 nt, Human
cuggccaaagcagaagcccca

SEQ ID NO: 1295010 - RNA, 23 nt, Human
gaaaaaagauacacaccaggggc

SEQ ID NO: 1295011 - RNA, 18 nt, Human
gacauagaugcuucaagc

SEQ ID NO: 1295012 - RNA, 22 nt, Human
gagggaccaggcuucuaugagc

SEQ ID NO: 1295013 - RNA, 19 nt, Human
gccaggguucccuuaauuc

SEQ ID NO: 1295014 - RNA, 20 nt, Human
gccccagaaacccuugucuc

SEQ ID NO: 1295015 - RNA, 18 nt, Human
gccuuggaggaaacaguu

SEQ ID NO: 1295016 - RNA, 24 nt, Human
gcuaacguggugaaacaauguuuc

SEQ ID NO: 1295017 - RNA, 22 nt, Human
gcuggucugaaagacuggauuc

SEQ ID NO: 1295018 - RNA, 24 nt, Human
ggagaccauccuggcuaacguggu

SEQ ID NO: 1295019 - RNA, 19 nt, Human
ggagagggagggaaaggcu

SEQ ID NO: 1295020 - RNA, 19 nt, Human
ggcugggugcaguggcuca

SEQ ID NO: 1295021 - RNA, 20 nt, Human
gggacaagaaaacaucaaaa

SEQ ID NO: 1295022 - RNA, 24 nt, Human
gggacaagaaaacaucaaaaagga

SEQ ID NO: 1295023 - RNA, 22 nt, Human
gggacuagccuccacccauaac

SEQ ID NO: 1295024 - RNA, 24 nt, Human
gggugcaguggcucacgccuguaa

SEQ ID NO: 1295025 - RNA, 24 nt, Human
gggugugguggcgggcgccuguag

SEQ ID NO: 1295026 - RNA, 19 nt, Human
gguaacagagcaaugcacc

SEQ ID NO: 1295027 - RNA, 24 nt, Human
gguggcgggcgccuguagucccag

SEQ ID NO: 1295028 - RNA, 18 nt, Human
ggugugguggcgggcgcc

SEQ ID NO: 1295029 - RNA, 24 nt, Human
guaggacagcuagaagccuucaag

SEQ ID NO: 1295030 - RNA, 24 nt, Human
guucuugggcuuggagcaggcucu

SEQ ID NO: 1295031 - RNA, 21 nt, Human
guugcaaaggcagaggggagu

SEQ ID NO: 1295032 - RNA, 19 nt, Human
uaacguggugaaacaaugu

SEQ ID NO: 1295033 - RNA, 24 nt, Human
uaacguggugaaacaauguuucua

SEQ ID NO: 1295034 - RNA, 18 nt, Human
uaauucgaccaaccuugg

SEQ ID NO: 1295035 - RNA, 23 nt, Human
uagcggauuuuuuuguuaaauuu

SEQ ID NO: 1295036 - RNA, 23 nt, Human
uauuacaagacauuuuagagaaa

SEQ ID NO: 1295037 - RNA, 25 nt, Human
ucaaaaaggagagggagggaaaggc

SEQ ID NO: 1295038 - RNA, 24 nt, Human
ucacgaggucaggagauggagacc

SEQ ID NO: 1295039 - RNA, 19 nt, Human
ucagagucguauuuuuaug

SEQ ID NO: 1295040 - RNA, 24 nt, Human
ucaggcccagaagacggaugcuag

SEQ ID NO: 1295041 - RNA, 22 nt, Human
ucccaagcccagaaaaaauguu

SEQ ID NO: 1295042 - RNA, 24 nt, Human
ucccugagcuguggccccagaaac

SEQ ID NO: 1295043 - RNA, 22 nt, Human
ucucaugggcugggguaggggg

SEQ ID NO: 1295044 - RNA, 19 nt, Human
ugagcggggagaggcaggg

SEQ ID NO: 1295045 - RNA, 22 nt, Human
ugagcggggagaggcagggcca

SEQ ID NO: 1295046 - RNA, 18 nt, Human
ugccaaacuuuugucuug

SEQ ID NO: 1295047 - RNA, 23 nt, Human
ugcugcccacaguggguuugucu

SEQ ID NO: 1295048 - RNA, 19 nt, Human
uggacauggcuuagaugcu

SEQ ID NO: 1295049 - RNA, 19 nt, Human
uggcauaaaaauucucacu

SEQ ID NO: 1295050 - RNA, 19 nt, Human
uggccaaagcagaagcccc

SEQ ID NO: 1295051 - RNA, 22 nt, Human
uggccaaagcagaagccccagg

SEQ ID NO: 1295052 - RNA, 24 nt, Human
uggcucacgccuguaaucccagca

SEQ ID NO: 1295053 - RNA, 19 nt, Human
ugggaacugggcuagacag

SEQ ID NO: 1295054 - RNA, 20 nt, Human
ugggaggccgaggcaggcgg

SEQ ID NO: 1295055 - RNA, 24 nt, Human
ugggaggccgaggcaggcggauca

SEQ ID NO: 1295056 - RNA, 21 nt, Human
ugggcugggguagggggaggc

SEQ ID NO: 1295057 - RNA, 24 nt, Human
ugguggcgggcgccuguaguccca

SEQ ID NO: 1295058 - RNA, 22 nt, Human
uguagcuuucagagucguauuu

SEQ ID NO: 1295059 - RNA, 18 nt, Human
uguaggaaauggguaaca

SEQ ID NO: 1295060 - RNA, 23 nt, Human
ugugguggcgggcgccuguaguc

SEQ ID NO: 1295061 - RNA, 18 nt, Human
uuagagaaagaaaacaau

SEQ ID NO: 1295062 - RNA, 18 nt, Human
uuagccgggugugguggc

SEQ ID NO: 1295063 - RNA, 24 nt, Human
uuagccgggugugguggcgggcgc

SEQ ID NO: 1295064 - RNA, 23 nt, Human
uucuacuaaaaauacaaaaaaag

SEQ ID NO: 1295065 - RNA, 19 nt, Human
uucuugggcuuggagcagg

SEQ ID NO: 1295066 - RNA, 25 nt, Human
uugggaggccgaggcaggcggauca

SEQ ID NO: 1295067 - RNA, 27 nt, Human
uuggguuuuuuuuuuuuuuacuuuaaa

SEQ ID NO: 1295068 - RNA, 22 nt, Human
uuucuacuaaaaauacaaaaaa

SEQ ID NO: 1295069 - RNA, 21 nt, Human
uuucucauccugacacacaga

SEQ ID NO: 1295070 - RNA, 20 nt, Human
uuugucuugggacaagaaaa

SEQ ID NO: 1295071 - RNA, 27 nt, Human
uuuuguuuguuuuuuggguuuuuuuuu

SEQ ID NO: 1295072 - RNA, 19 nt, Human
uuuuuuuuuuuuuuacuuu

SEQ ID NO: 1295073 - RNA, 19 nt, Human
cacccaggggcagugggcc

SEQ ID NO: 1295074 - RNA, 26 nt, Human
cacccugggccagagcacccaggggc

SEQ ID NO: 1295075 - RNA, 19 nt, Human
cacugaagggaugcugagg

SEQ ID NO: 1295076 - RNA, 18 nt, Human
cacugcagcugggggagg

SEQ ID NO: 1295077 - RNA, 27 nt, Human
cagagucccgggccugcacuccccgag

SEQ ID NO: 1295078 - RNA, 19 nt, Human
cagcagguugacagucuuc

SEQ ID NO: 1295079 - RNA, 19 nt, Human
cccacauuguugguggcug

SEQ ID NO: 1295080 - RNA, 22 nt, Human
ccugggccagagcacccagggg

SEQ ID NO: 1295081 - RNA, 23 nt, Human
ccugggccagagcacccaggggc

SEQ ID NO: 1295082 - RNA, 20 nt, Human
gaccacugcagcugggggag

SEQ ID NO: 1295083 - RNA, 22 nt, Human
ggagcaaagaacacagaccucc

SEQ ID NO: 1295084 - RNA, 20 nt, Human
ggcaggguugcccacauugu

SEQ ID NO: 1295085 - RNA, 24 nt, Human
ggccagagcacccaggggcagugg

SEQ ID NO: 1295086 - RNA, 20 nt, Human
ggccugcacugaagggaugc

SEQ ID NO: 1295087 - RNA, 24 nt, Human
ggucccugaaaaugaagaugggag

SEQ ID NO: 1295088 - RNA, 18 nt, Human
ucccugaaaaugaagaug

SEQ ID NO: 1295089 - RNA, 20 nt, Human
ucccugaaaaugaagauggg

SEQ ID NO: 1295090 - RNA, 23 nt, Human
ugaaauggagcaaagaacacaga

SEQ ID NO: 1295091 - RNA, 19 nt, Human
ugcagcugggggaggggau

SEQ ID NO: 1295092 - RNA, 22 nt, Human
ugcugagggugccacccugggc

SEQ ID NO: 1295093 - RNA, 19 nt, Human
uugguggcugugcaguugu

SEQ ID NO: 1295094 - RNA, 24 nt, Human
aacaacaaucgcccaccaccacuu

SEQ ID NO: 1295095 - RNA, 28 nt, Human
cucaaugaggaauaagaagaauuaagaa

SEQ ID NO: 1295096 - RNA, 24 nt, Human
ucuuuuauaaagaugaagaacaag

SEQ ID NO: 1295097 - RNA, 22 nt, Human
aagguagagaagguagagguca

SEQ ID NO: 1295098 - RNA, 19 nt, Human
aaugcaggggugggggccg

SEQ ID NO: 1295099 - RNA, 21 nt, Human
acaagguagagaagguagagg

SEQ ID NO: 1295100 - RNA, 28 nt, Human
acaccaggcacccccucuccacaccccu

SEQ ID NO: 1295101 - RNA, 25 nt, Human
acaccccugcccuucccccagcccu

SEQ ID NO: 1295102 - RNA, 21 nt, Human
acagcggcagcggcggcgggc

SEQ ID NO: 1295103 - RNA, 26 nt, Human
accccugcaccccagcggggucagca

SEQ ID NO: 1295104 - RNA, 18 nt, Human
accccugcccuuccccca

SEQ ID NO: 1295105 - RNA, 22 nt, Human
accccugcccuucccccagccc

SEQ ID NO: 1295106 - RNA, 20 nt, Human
agcggcagcggcggcgggcg

SEQ ID NO: 1295107 - RNA, 26 nt, Human
agcggcagcggcggcgggcgcagggu

SEQ ID NO: 1295108 - RNA, 18 nt, Human
agcggcggcagcaccagc

SEQ ID NO: 1295109 - RNA, 20 nt, Human
agcugcacaccuugagcccc

SEQ ID NO: 1295110 - RNA, 21 nt, Human
aggcacccccucuccacaccc

SEQ ID NO: 1295111 - RNA, 26 nt, Human
aggggaggggaggggaggggagggcc

SEQ ID NO: 1295112 - RNA, 20 nt, Human
caccaggcacccccucucca

SEQ ID NO: 1295113 - RNA, 26 nt, Human
caccaggcacccccucuccacacccc

SEQ ID NO: 1295114 - RNA, 19 nt, Human
cacccccucuccacacccc

SEQ ID NO: 1295115 - RNA, 23 nt, Human
cacccccucuccacaccccugcc

SEQ ID NO: 1295116 - RNA, 18 nt, Human
caccccugcccuuccccc

SEQ ID NO: 1295117 - RNA, 19 nt, Human
cacuuggugggggcagaga

SEQ ID NO: 1295118 - RNA, 20 nt, Human
cagcggcagcggcggcgggc

SEQ ID NO: 1295119 - RNA, 24 nt, Human
cagcggcagcggcggcgggcgcag

SEQ ID NO: 1295120 - RNA, 18 nt, Human
cagcggcggcgggcgcag

SEQ ID NO: 1295121 - RNA, 18 nt, Human
ccagagcgggcguggggg

SEQ ID NO: 1295122 - RNA, 22 nt, Human
ccaggcacccccucuccacacc

SEQ ID NO: 1295123 - RNA, 18 nt, Human
ccccagcccuccugcagc

SEQ ID NO: 1295124 - RNA, 24 nt, Human
ccccguauccaugaggaagggcuc

SEQ ID NO: 1295125 - RNA, 21 nt, Human
ccccucuccacaccccugccc

SEQ ID NO: 1295126 - RNA, 19 nt, Human
cccuucccccagcccuccu

SEQ ID NO: 1295127 - RNA, 22 nt, Human
ccucagccgcggagcccagggc

SEQ ID NO: 1295128 - RNA, 21 nt, Human
ccucccgggaccccguaucca

SEQ ID NO: 1295129 - RNA, 22 nt, Human
ccugggcaggucccuggugaag

SEQ ID NO: 1295130 - RNA, 22 nt, Human
cgggcgugggggccccccucgg

SEQ ID NO: 1295131 - RNA, 20 nt, Human
cuccacaccccugcccuucc

SEQ ID NO: 1295132 - RNA, 19 nt, Human
cuccuccgaagggaacccc

SEQ ID NO: 1295133 - RNA, 22 nt, Human
cuggugaaggcugccucccggg

SEQ ID NO: 1295134 - RNA, 19 nt, Human
cuugagagagagagagaga

SEQ ID NO: 1295135 - RNA, 19 nt, Human
gaagguagaggucagggug

SEQ ID NO: 1295136 - RNA, 21 nt, Human
gagaaagaagacaccaggcac

SEQ ID NO: 1295137 - RNA, 20 nt, Human
gagccaaucgcgaaugcagg

SEQ ID NO: 1295138 - RNA, 22 nt, Human
gcacagcuacagcuggaucugc

SEQ ID NO: 1295139 - RNA, 20 nt, Human
gcacccccucuccacacccc

SEQ ID NO: 1295140 - RNA, 23 nt, Human
gcagagagagaaagaagacacca

SEQ ID NO: 1295141 - RNA, 18 nt, Human
gccagagcgggcgugggg

SEQ ID NO: 1295142 - RNA, 18 nt, Human
gcggcagcggcggcgggc

SEQ ID NO: 1295143 - RNA, 21 nt, Human
ggaggggaggggaggggaggg

SEQ ID NO: 1295144 - RNA, 21 nt, Human
ggaggggaggggaggggaggg

SEQ ID NO: 1295145 - RNA, 26 nt, Human
ggcacccccucuccacaccccugccc

SEQ ID NO: 1295146 - RNA, 22 nt, Human
ggcgggggaggggaggggaggg

SEQ ID NO: 1295147 - RNA, 18 nt, Human
gggcgggggaggggaggg

SEQ ID NO: 1295148 - RNA, 23 nt, Human
ggggaggggaggggaggggaggg

SEQ ID NO: 1295149 - RNA, 23 nt, Human
ggggaggggaggggaggggaggg

SEQ ID NO: 1295150 - RNA, 20 nt, Human
gguggcauaggugccaggug

SEQ ID NO: 1295151 - RNA, 18 nt, Human
uagagaagguagagguca

SEQ ID NO: 1295152 - RNA, 18 nt, Human
ucagccgcggagcccagg

SEQ ID NO: 1295153 - RNA, 22 nt, Human
ucaggguggaacaaaagggaag

SEQ ID NO: 1295154 - RNA, 19 nt, Human
ucccuaggagaugcugcag

SEQ ID NO: 1295155 - RNA, 22 nt, Human
ucccuggugaaggcugccuccc

SEQ ID NO: 1295156 - RNA, 20 nt, Human
uccugcagcagcgcagacuu

SEQ ID NO: 1295157 - RNA, 22 nt, Human
ucgcgaaugcaggggugggggc

SEQ ID NO: 1295158 - RNA, 19 nt, Human
ucuccugagaggccgucca

SEQ ID NO: 1295159 - RNA, 18 nt, Human
ugcacagcuacagcugga

SEQ ID NO: 1295160 - RNA, 22 nt, Human
ugcaccccagcggggucagcac

SEQ ID NO: 1295161 - RNA, 23 nt, Human
uggcauaggugccagguggaguc

SEQ ID NO: 1295162 - RNA, 22 nt, Human
ugguggcauaggugccaggugg

SEQ ID NO: 1295163 - RNA, 19 nt, Human
uucaggggccauugguggc

SEQ ID NO: 1295164 - RNA, 19 nt, Human
aacacaccaggccccaccu

SEQ ID NO: 1295165 - RNA, 18 nt, Human
aagaaacccaagaaaccc

SEQ ID NO: 1295166 - RNA, 24 nt, Human
aagagaggugaggaggcagcccug

SEQ ID NO: 1295167 - RNA, 23 nt, Human
aaguggccugcucagccucaguc

SEQ ID NO: 1295168 - RNA, 21 nt, Human
aauaagcccucaaccucgccc

SEQ ID NO: 1295169 - RNA, 23 nt, Human
acaaagcugaacacauaugaacg

SEQ ID NO: 1295170 - RNA, 21 nt, Human
acaccaggccccaccuccggc

SEQ ID NO: 1295171 - RNA, 23 nt, Human
acccccagaacccaaacacacca

SEQ ID NO: 1295172 - RNA, 18 nt, Human
acucgacucacugagugg

SEQ ID NO: 1295173 - RNA, 25 nt, Human
acuggcccugccgugcaccuccccc

SEQ ID NO: 1295174 - RNA, 21 nt, Human
acuggcuucaagaaacccaag

SEQ ID NO: 1295175 - RNA, 24 nt, Human
agaaacccaagaaacccuccccac

SEQ ID NO: 1295176 - RNA, 23 nt, Human
agaacccaaacacaccaggcccc

SEQ ID NO: 1295177 - RNA, 24 nt, Human
agcccagcuguccagcuguucagg

SEQ ID NO: 1295178 - RNA, 19 nt, Human
agcccucaaccucgcccca

SEQ ID NO: 1295179 - RNA, 24 nt, Human
agccggggccuggucacagcugcu

SEQ ID NO: 1295180 - RNA, 18 nt, Human
agcugcccccacccaguc

SEQ ID NO: 1295181 - RNA, 19 nt, Human
aggaggagcaggcuuguua

SEQ ID NO: 1295182 - RNA, 22 nt, Human
aggcuuguuacauugccagagc

SEQ ID NO: 1295183 - RNA, 21 nt, Human
agggacagcucgggugugggg

SEQ ID NO: 1295184 - RNA, 23 nt, Human
agguguccccgccccuguggccu

SEQ ID NO: 1295185 - RNA, 23 nt, Human
aguccuggggcuggggcagguuc

SEQ ID NO: 1295186 - RNA, 26 nt, Human
auccacccccagaacccaaacacacc

SEQ ID NO: 1295187 - RNA, 18 nt, Human
augggaaauacuggcuuc

SEQ ID NO: 1295188 - RNA, 20 nt, Human
caaaaugcucuccucuuagg

SEQ ID NO: 1295189 - RNA, 18 nt, Human
caagaaacccaagaaacc

SEQ ID NO: 1295190 - RNA, 25 nt, Human
caagaaacccaagaaacccucccca

SEQ ID NO: 1295191 - RNA, 25 nt, Human
caagaaacccuccccacggagcacc

SEQ ID NO: 1295192 - RNA, 18 nt, Human
caagggacugccaggcug

SEQ ID NO: 1295193 - RNA, 18 nt, Human
cacacccaggcccaggcu

SEQ ID NO: 1295194 - RNA, 22 nt, Human
cacagcccagcuguccagcugu

SEQ ID NO: 1295195 - RNA, 20 nt, Human
cacagcuuaacacgagcuuu

SEQ ID NO: 1295196 - RNA, 19 nt, Human
cacagucuccgugcucccc

SEQ ID NO: 1295197 - RNA, 22 nt, Human
cacccagccaugagggauccac

SEQ ID NO: 1295198 - RNA, 25 nt, Human
cacccaggcccaggcucggaagggc

SEQ ID NO: 1295199 - RNA, 22 nt, Human
cacccagucagccccgggaccu

SEQ ID NO: 1295200 - RNA, 23 nt, Human
caccccuaagggggugcuguggc

SEQ ID NO: 1295201 - RNA, 19 nt, Human
cacccuguaccuacacagc

SEQ ID NO: 1295202 - RNA, 21 nt, Human
caccggacggggccucguggu

SEQ ID NO: 1295203 - RNA, 21 nt, Human
caccucccccacugaauaagc

SEQ ID NO: 1295204 - RNA, 22 nt, Human
caccuccggcacuggggcucac

SEQ ID NO: 1295205 - RNA, 18 nt, Human
cacucacaaagcugaaca

SEQ ID NO: 1295206 - RNA, 20 nt, Human
cacucuccagcccggcuccc

SEQ ID NO: 1295207 - RNA, 22 nt, Human
cacucuccagcccggcuccccu

SEQ ID NO: 1295208 - RNA, 21 nt, Human
cagaaggcgaaggaggagcag

SEQ ID NO: 1295209 - RNA, 22 nt, Human
cagagccggaacaaaagacaga

SEQ ID NO: 1295210 - RNA, 22 nt, Human
cagcagugacagggcuugguca

SEQ ID NO: 1295211 - RNA, 24 nt, Human
cagccccgggacccucuggucugu

SEQ ID NO: 1295212 - RNA, 20 nt, Human
cagcuccagggaaguggccu

SEQ ID NO: 1295213 - RNA, 23 nt, Human
caggcccaggcucggaagggccu

SEQ ID NO: 1295214 - RNA, 23 nt, Human
cagggcccuccccuggacaaggg

SEQ ID NO: 1295215 - RNA, 18 nt, Human
caggggugggugaagggg

SEQ ID NO: 1295216 - RNA, 24 nt, Human
caugagggauccacccccagaacc

SEQ ID NO: 1295217 - RNA, 21 nt, Human
cauggcacccagccaugaggg

SEQ ID NO: 1295218 - RNA, 22 nt, Human
cauggcacccagccaugaggga

SEQ ID NO: 1295219 - RNA, 24 nt, Human
ccacagcccagcuguccagcuguu

SEQ ID NO: 1295220 - RNA, 23 nt, Human
ccacccagucagccccgggaccc

SEQ ID NO: 1295221 - RNA, 18 nt, Human
ccacccccagaacccaaa

SEQ ID NO: 1295222 - RNA, 23 nt, Human
ccacugaauaagcccucaaccuu

SEQ ID NO: 1295223 - RNA, 19 nt, Human
ccacuuccucaucaccccu

SEQ ID NO: 1295224 - RNA, 21 nt, Human
ccaggccacagucuccgugcu

SEQ ID NO: 1295225 - RNA, 19 nt, Human
cccaaaucccaggggccuc

SEQ ID NO: 1295226 - RNA, 22 nt, Human
cccaacagcucccacugccucu

SEQ ID NO: 1295227 - RNA, 22 nt, Human
cccagaacccaaacacaccagg

SEQ ID NO: 1295228 - RNA, 22 nt, Human
cccaggagugcaauugcugggg

SEQ ID NO: 1295229 - RNA, 21 nt, Human
cccauuguucguggauuucca

SEQ ID NO: 1295230 - RNA, 20 nt, Human
ccccaacagcucccacugcc

SEQ ID NO: 1295231 - RNA, 20 nt, Human
ccccacucuccagcccggcu

SEQ ID NO: 1295232 - RNA, 27 nt, Human
ccccagaacccaaacacaccaggcccc

SEQ ID NO: 1295233 - RNA, 22 nt, Human
cccccagaacccaaacacacca

SEQ ID NO: 1295234 - RNA, 20 nt, Human
ccccgucggcugaagacccc

SEQ ID NO: 1295235 - RNA, 20 nt, Human
ccccugcagaagcuucugga

SEQ ID NO: 1295236 - RNA, 22 nt, Human
ccccugcagaagcuucuggaac

SEQ ID NO: 1295237 - RNA, 18 nt, Human
ccccuggacaagggucca

SEQ ID NO: 1295238 - RNA, 21 nt, Human
ccccuguccugcccacagccc

SEQ ID NO: 1295239 - RNA, 22 nt, Human
cccucaaccucgccccacucac

SEQ ID NO: 1295240 - RNA, 18 nt, Human
cccucauccacacccagg

SEQ ID NO: 1295241 - RNA, 22 nt, Human
cccugagcccacguuccuucuc

SEQ ID NO: 1295242 - RNA, 20 nt, Human
cccugccgugcaccuccccc

SEQ ID NO: 1295243 - RNA, 19 nt, Human
ccgccccuguggccugacc

SEQ ID NO: 1295244 - RNA, 19 nt, Human
ccucccccuccaccggggc

SEQ ID NO: 1295245 - RNA, 24 nt, Human
ccucgccccacucacaaagcugaa

SEQ ID NO: 1295246 - RNA, 23 nt, Human
ccugcccgggguccucccugagc

SEQ ID NO: 1295247 - RNA, 18 nt, Human
ccugcggaugaagugggg

SEQ ID NO: 1295248 - RNA, 22 nt, Human
ccugcuggugcaggaaugccaa

SEQ ID NO: 1295249 - RNA, 22 nt, Human
ccuggcagguguccccgccccu

SEQ ID NO: 1295250 - RNA, 18 nt, Human
ccuggggcuggggcaggu

SEQ ID NO: 1295251 - RNA, 21 nt, Human
ccuguccugcccacagcccag

SEQ ID NO: 1295252 - RNA, 19 nt, Human
ccuucccaguugaggaagc

SEQ ID NO: 1295253 - RNA, 22 nt, Human
cgagggcugugguggccuugcu

SEQ ID NO: 1295254 - RNA, 20 nt, Human
cgcacagcccgagagagccc

SEQ ID NO: 1295255 - RNA, 19 nt, Human
cggcuccccaacagcuccc

SEQ ID NO: 1295256 - RNA, 24 nt, Human
cguaaaguggggacagcaaaaugc

SEQ ID NO: 1295257 - RNA, 24 nt, Human
cucacaaagcugaacacauaugaa

SEQ ID NO: 1295258 - RNA, 22 nt, Human
cucagaguccuggggcuggggc

SEQ ID NO: 1295259 - RNA, 27 nt, Human
cucagccucaguccucugcugggagcc

SEQ ID NO: 1295260 - RNA, 22 nt, Human
cucagggugucugccccgucgg

SEQ ID NO: 1295261 - RNA, 18 nt, Human
cuccaaggguacuggccc

SEQ ID NO: 1295262 - RNA, 20 nt, Human
cucccucagcccguccugcu

SEQ ID NO: 1295263 - RNA, 22 nt, Human
cucccuggcagccggggccugg

SEQ ID NO: 1295264 - RNA, 20 nt, Human
cuccgugcuccccacucucc

SEQ ID NO: 1295265 - RNA, 20 nt, Human
cucgcugggagcugccccca

SEQ ID NO: 1295266 - RNA, 21 nt, Human
cucggaagggccucccccucc

SEQ ID NO: 1295267 - RNA, 21 nt, Human
cucucgcugggagcugccccc

SEQ ID NO: 1295268 - RNA, 24 nt, Human
cucugcguugggcagccucucucc

SEQ ID NO: 1295269 - RNA, 28 nt, Human
cugaagacccccucucccuggcagccgg

SEQ ID NO: 1295270 - RNA, 23 nt, Human
cugacugggaccacggcucccca

SEQ ID NO: 1295271 - RNA, 19 nt, Human
cugcacucagaguccuggg

SEQ ID NO: 1295272 - RNA, 19 nt, Human
cugcacucagaguccuggg

SEQ ID NO: 1295273 - RNA, 21 nt, Human
cugccgugcaccucccccacu

SEQ ID NO: 1295274 - RNA, 24 nt, Human
cugcuugcuccuucauucauucac

SEQ ID NO: 1295275 - RNA, 20 nt, Human
cuggcaccauccaggccaca

SEQ ID NO: 1295276 - RNA, 22 nt, Human
cuggcuucaagaaacccaagaa

SEQ ID NO: 1295277 - RNA, 19 nt, Human
cuguggccccccuucccag

SEQ ID NO: 1295278 - RNA, 18 nt, Human
cuucucaacaaccagauc

SEQ ID NO: 1295279 - RNA, 21 nt, Human
cuuguccccugcuuggguccu

SEQ ID NO: 1295280 - RNA, 21 nt, Human
gaacccaaacacaccaggccc

SEQ ID NO: 1295281 - RNA, 22 nt, Human
gagagaccugcccucauccaca

SEQ ID NO: 1295282 - RNA, 18 nt, Human
gagcccauuguucgugga

SEQ ID NO: 1295283 - RNA, 22 nt, Human
gagccggaacaaaagacagaga

SEQ ID NO: 1295284 - RNA, 22 nt, Human
gcacuggugaggcgccucccuc

SEQ ID NO: 1295285 - RNA, 19 nt, Human
gccaggcuguuuccacagu

SEQ ID NO: 1295286 - RNA, 25 nt, Human
gccccacucacaaagcugaacacaa

SEQ ID NO: 1295287 - RNA, 19 nt, Human
gcccggcuccccucuugcu

SEQ ID NO: 1295288 - RNA, 20 nt, Human
gcccgggguccucccugagc

SEQ ID NO: 1295289 - RNA, 26 nt, Human
gccucguggucagccccgcaagggcg

SEQ ID NO: 1295290 - RNA, 19 nt, Human
gccuuaaaccacccugagc

SEQ ID NO: 1295291 - RNA, 21 nt, Human
gcuccagggaaguggccugcu

SEQ ID NO: 1295292 - RNA, 20 nt, Human
gcuggcaucugcugggcuuc

SEQ ID NO: 1295293 - RNA, 19 nt, Human
gcuguuacugugaggcugg

SEQ ID NO: 1295294 - RNA, 21 nt, Human
ggaagggccucccccuccacc

SEQ ID NO: 1295295 - RNA, 18 nt, Human
ggacccucuggucugugc

SEQ ID NO: 1295296 - RNA, 27 nt, Human
ggcagaaggcgaaggaggagggacccc

SEQ ID NO: 1295297 - RNA, 24 nt, Human
gggagcuggugcuguauuagucag

SEQ ID NO: 1295298 - RNA, 23 nt, Human
gggauccacccccagaacccaaa

SEQ ID NO: 1295299 - RNA, 18 nt, Human
gggcagcagugacagggc

SEQ ID NO: 1295300 - RNA, 19 nt, Human
gggcagccucucuccuguu

SEQ ID NO: 1295301 - RNA, 24 nt, Human
gggcagggauucccgagcugagcg

SEQ ID NO: 1295302 - RNA, 18 nt, Human
gggccccacguguggcug

SEQ ID NO: 1295303 - RNA, 19 nt, Human
gggcuggggcagguucaga

SEQ ID NO: 1295304 - RNA, 21 nt, Human
gggcuggggcagguucagauc

SEQ ID NO: 1295305 - RNA, 22 nt, Human
gggggugcuguggccccccuuc

SEQ ID NO: 1295306 - RNA, 19 nt, Human
gguacuggcccugccgugc

SEQ ID NO: 1295307 - RNA, 23 nt, Human
ggugcuguggccccccuucccag

SEQ ID NO: 1295308 - RNA, 21 nt, Human
gugaggaggcagcccugcccg

SEQ ID NO: 1295309 - RNA, 28 nt, Human
gugaugcugggcgcuggcacuggugagg

SEQ ID NO: 1295310 - RNA, 18 nt, Human
guggggcgagggcugugg

SEQ ID NO: 1295311 - RNA, 18 nt, Human
guuccaccggacggggcc

SEQ ID NO: 1295312 - RNA, 19 nt, Human
uaagcccucaaccucgccc

SEQ ID NO: 1295313 - RNA, 25 nt, Human
uaagcccucaaccucgccccacuca

SEQ ID NO: 1295314 - RNA, 18 nt, Human
uacuggcccugccgugca

SEQ ID NO: 1295315 - RNA, 22 nt, Human
uacuuacccaaaucccaggggc

SEQ ID NO: 1295316 - RNA, 18 nt, Human
ucagccagaguccccugu

SEQ ID NO: 1295317 - RNA, 19 nt, Human
uccacacccaggcccaggc

SEQ ID NO: 1295318 - RNA, 19 nt, Human
uccacccccagaacccaaa

SEQ ID NO: 1295319 - RNA, 23 nt, Human
uccacccccagaacccaaacaca

SEQ ID NO: 1295320 - RNA, 22 nt, Human
uccccaacagcucccacugccu

SEQ ID NO: 1295321 - RNA, 21 nt, Human
uccccacggagcaccuuggcu

SEQ ID NO: 1295322 - RNA, 25 nt, Human
ucccccacugaggugcugguggggg

SEQ ID NO: 1295323 - RNA, 23 nt, Human
uccccgccccuguggccugaccc

SEQ ID NO: 1295324 - RNA, 19 nt, Human
uccccuggacaagggucca

SEQ ID NO: 1295325 - RNA, 18 nt, Human
ucccucagcccguccugc

SEQ ID NO: 1295326 - RNA, 20 nt, Human
ucccuggcagccggggccug

SEQ ID NO: 1295327 - RNA, 21 nt, Human
ucccuggcagccggggccugg

SEQ ID NO: 1295328 - RNA, 19 nt, Human
ucccuguggggcgagggcu

SEQ ID NO: 1295329 - RNA, 25 nt, Human
ucucagggugucugccccgucggcu

SEQ ID NO: 1295330 - RNA, 22 nt, Human
ucugagcuccaguguccaaagg

SEQ ID NO: 1295331 - RNA, 18 nt, Human
ucugcguugggcagccuc

SEQ ID NO: 1295332 - RNA, 22 nt, Human
ugaacacauaugaacgcggcuu

SEQ ID NO: 1295333 - RNA, 20 nt, Human
ugaacuugcaguauccccca

SEQ ID NO: 1295334 - RNA, 24 nt, Human
ugagcuccaguguccaaaggccga

SEQ ID NO: 1295335 - RNA, 18 nt, Human
ugaggaggcagcccugcc

SEQ ID NO: 1295336 - RNA, 18 nt, Human
ugaggcuggugcuugaac

SEQ ID NO: 1295337 - RNA, 18 nt, Human
ugauuuaugaggagaggu

SEQ ID NO: 1295338 - RNA, 19 nt, Human
ugcaccucccccacugaau

SEQ ID NO: 1295339 - RNA, 25 nt, Human
ugcaccucccccacugaauaagccc

SEQ ID NO: 1295340 - RNA, 24 nt, Human
ugccaggcuguuuccacaguggcc

SEQ ID NO: 1295341 - RNA, 19 nt, Human
ugcccccacccagucagcc

SEQ ID NO: 1295342 - RNA, 21 nt, Human
ugcccgggguccucccugagc

SEQ ID NO: 1295343 - RNA, 23 nt, Human
ugcguugggcagccucucuccug

SEQ ID NO: 1295344 - RNA, 24 nt, Human
ugcuggcaucugcugggcuucugg

SEQ ID NO: 1295345 - RNA, 19 nt, Human
ugcugguggggggcaggga

SEQ ID NO: 1295346 - RNA, 18 nt, Human
uggcagggcccuccccug

SEQ ID NO: 1295347 - RNA, 23 nt, Human
uggcaucugcugggcuucugguc

SEQ ID NO: 1295348 - RNA, 25 nt, Human
uggggucagcuccagggaaguggcc

SEQ ID NO: 1295349 - RNA, 22 nt, Human
ugggguugggcauccuggcagg

SEQ ID NO: 1295350 - RNA, 22 nt, Human
uggucagccccgcaagggcggg

SEQ ID NO: 1295351 - RNA, 23 nt, Human
uguauaggaagcauggugcuggg

SEQ ID NO: 1295352 - RNA, 21 nt, Human
ugucugccccgucggcugaag

SEQ ID NO: 1295353 - RNA, 22 nt, Human
uguggccccccuucccaguuga

SEQ ID NO: 1295354 - RNA, 19 nt, Human
uguggccugacccuccaag

SEQ ID NO: 1295355 - RNA, 24 nt, Human
uguggggcgagggcugugguggcc

SEQ ID NO: 1295356 - RNA, 19 nt, Human
ugugggguagcugcggcug

SEQ ID NO: 1295357 - RNA, 20 nt, Human
uucagccagaguccccuguc

SEQ ID NO: 1295358 - RNA, 26 nt, Human
uucuggucagcccucagaaagcuuac

SEQ ID NO: 1295359 - RNA, 18 nt, Human
uugcuccuucauucauuc

SEQ ID NO: 1295360 - RNA, 24 nt, Human
uugcugcacucagaguccuggggc

SEQ ID NO: 1295361 - RNA, 21 nt, Human
uugcugucggggcuuacugcu

SEQ ID NO: 1295362 - RNA, 21 nt, Human
uuuaugaggagagguuuagcu

SEQ ID NO: 1295363 - RNA, 20 nt, Human
aacucaugcuuguucuccuc

SEQ ID NO: 1295364 - RNA, 24 nt, Human
aagcaccacaaucucaacucaugc

SEQ ID NO: 1295365 - RNA, 20 nt, Human
cccaaugccuccugcccucc

SEQ ID NO: 1295366 - RNA, 23 nt, Human
cccaaugccuccugcccuccugc

SEQ ID NO: 1295367 - RNA, 28 nt, Human
ccucugugaaaacaaagggauguugcuc

SEQ ID NO: 1295368 - RNA, 23 nt, Human
cucuccuucaaaugcagccccaa

SEQ ID NO: 1295369 - RNA, 23 nt, Human
gagcagcagguuucugaucugga

SEQ ID NO: 1295370 - RNA, 21 nt, Human
gaggagaacugccuuucccca

SEQ ID NO: 1295371 - RNA, 24 nt, Human
uagaggagaacugccuuuccccau

SEQ ID NO: 1295372 - RNA, 19 nt, Human
uccuucaaaugcagcccca

SEQ ID NO: 1295373 - RNA, 21 nt, Human
uccuuugccauguggcuuugc

SEQ ID NO: 1295374 - RNA, 20 nt, Human
ucugccuucucugucauuga

SEQ ID NO: 1295375 - RNA, 20 nt, Human
ugaaaacaaagggauguugc

SEQ ID NO: 1295376 - RNA, 23 nt, Human
uguugcucuccuucaaaugcagc

SEQ ID NO: 1295377 - RNA, 18 nt, Human
accacagacucugacuug

SEQ ID NO: 1295378 - RNA, 20 nt, Human
accaucuuuucaucaugcaa

SEQ ID NO: 1295379 - RNA, 19 nt, Human
ccaucuuuucaucaugcaa

SEQ ID NO: 1295380 - RNA, 23 nt, Human
gggcuacauuuucugaacaagag

SEQ ID NO: 1295381 - RNA, 23 nt, Human
ucaugcaacauuggcuucccaca

SEQ ID NO: 1295382 - RNA, 24 nt, Human
uccgccagaguggucuaacugugc

SEQ ID NO: 1295383 - RNA, 20 nt, Human
ucuaggucuucacuuaauuu

SEQ ID NO: 1295384 - RNA, 20 nt, Human
uucaucaugcaacauuggcu

SEQ ID NO: 1295385 - RNA, 21 nt, Human
caccgccccuccggggggccc

SEQ ID NO: 1295386 - RNA, 18 nt, Human
ccuccggggggcccgggg

SEQ ID NO: 1295387 - RNA, 22 nt, Human
ccuccggggggcccggggacuc

SEQ ID NO: 1295388 - RNA, 21 nt, Human
ggccagcuucugugggacgcu

SEQ ID NO: 1295389 - RNA, 23 nt, Human
gugggacgcuggcgcgcacaccg

SEQ ID NO: 1295390 - RNA, 18 nt, Human
aaccagaggugucguccc

SEQ ID NO: 1295391 - RNA, 18 nt, Human
acacaggaaaucaaauac

SEQ ID NO: 1295392 - RNA, 19 nt, Human
accuuaagaaaaguuagag

SEQ ID NO: 1295393 - RNA, 23 nt, Human
acuuccccgccccaccccccgac

SEQ ID NO: 1295394 - RNA, 22 nt, Human
agagcacuuccccgccccaccc

SEQ ID NO: 1295395 - RNA, 19 nt, Human
agggaggccuuccacagug

SEQ ID NO: 1295396 - RNA, 25 nt, Human
caacaaaaccuuaagaaaaguuaga

SEQ ID NO: 1295397 - RNA, 21 nt, Human
caacacacacaggaaaucaaa

SEQ ID NO: 1295398 - RNA, 19 nt, Human
caauaagucuauccgggcu

SEQ ID NO: 1295399 - RNA, 19 nt, Human
cacacaggaaaucaaauac

SEQ ID NO: 1295400 - RNA, 21 nt, Human
cacagauggcaaaaagccgac

SEQ ID NO: 1295401 - RNA, 24 nt, Human
caccccccgaccccacaacgugcc

SEQ ID NO: 1295402 - RNA, 20 nt, Human
cacuuccccgccccaccccc

SEQ ID NO: 1295403 - RNA, 19 nt, Human
ccagaggugucgucccucu

SEQ ID NO: 1295404 - RNA, 19 nt, Human
ccccgaccccacaacgugc

SEQ ID NO: 1295405 - RNA, 20 nt, Human
ccccgccccaccccccgacc

SEQ ID NO: 1295406 - RNA, 26 nt, Human
ccccgccccaccccccgaccccacaa

SEQ ID NO: 1295407 - RNA, 21 nt, Human
cccgccccaccccccgacccc

SEQ ID NO: 1295408 - RNA, 23 nt, Human
cgccccaccccccgaccccacaa

SEQ ID NO: 1295409 - RNA, 24 nt, Human
cgccccaccccccgaccccacaac

SEQ ID NO: 1295410 - RNA, 19 nt, Human
cgcugaaugacuccacugc

SEQ ID NO: 1295411 - RNA, 18 nt, Human
gcacuugaagggcuagca

SEQ ID NO: 1295412 - RNA, 19 nt, Human
gccccaccccccgacccca

SEQ ID NO: 1295413 - RNA, 26 nt, Human
gggaacacuauuuucaguuggacauc

SEQ ID NO: 1295414 - RNA, 22 nt, Human
guguguguuuuuagaaacuucu

SEQ ID NO: 1295415 - RNA, 24 nt, Human
guuuuuggcaauaagucuauccgg

SEQ ID NO: 1295416 - RNA, 21 nt, Human
uaaaacugcaaggguaaaaug

SEQ ID NO: 1295417 - RNA, 22 nt, Human
uaaaaugcccuuaaugccaggg

SEQ ID NO: 1295418 - RNA, 23 nt, Human
uaacagcuucgaaaagaucuuaa

SEQ ID NO: 1295419 - RNA, 25 nt, Human
uaagaaaaguuagagcacuuccccg

SEQ ID NO: 1295420 - RNA, 24 nt, Human
uaauacauacauacauaguacaua

SEQ ID NO: 1295421 - RNA, 23 nt, Human
uacauacauacauaguacauaga

SEQ ID NO: 1295422 - RNA, 20 nt, Human
uaccagcauuuacacgucag

SEQ ID NO: 1295423 - RNA, 23 nt, Human
ucaaguucugccacccugugugg

SEQ ID NO: 1295424 - RNA, 24 nt, Human
uccacaguguccguacaggccgug

SEQ ID NO: 1295425 - RNA, 22 nt, Human
uccccgccccaccccccgaccc

SEQ ID NO: 1295426 - RNA, 23 nt, Human
uccccgccccaccccccgacccc

SEQ ID NO: 1295427 - RNA, 23 nt, Human
ugcccuuaaugccagggcaacac

SEQ ID NO: 1295428 - RNA, 24 nt, Human
uuccccgccccaccccccgacccc

SEQ ID NO: 1295429 - RNA, 22 nt, Human
uucuuuugaaagcuauuuuuug

SEQ ID NO: 1295430 - RNA, 19 nt, Human
uugaaaaaccagagguguc

SEQ ID NO: 1295431 - RNA, 24 nt, Human
aacauggggugagguggagagggg

SEQ ID NO: 1295432 - RNA, 24 nt, Human
aaccuggagccaaggcagggggcu

SEQ ID NO: 1295433 - RNA, 23 nt, Human
aagcaggauuagucaaaaccagg

SEQ ID NO: 1295434 - RNA, 20 nt, Human
aaggaagagaggcagcgggg

SEQ ID NO: 1295435 - RNA, 23 nt, Human
aaugccaaagccagggagucgga

SEQ ID NO: 1295436 - RNA, 23 nt, Human
acaccgcaacccugcuccagcug

SEQ ID NO: 1295437 - RNA, 22 nt, Human
acccugggacgcccugccgcca

SEQ ID NO: 1295438 - RNA, 24 nt, Human
agaaaguuccuacguggcuuaaaa

SEQ ID NO: 1295439 - RNA, 23 nt, Human
agagccacacauggauguaccag

SEQ ID NO: 1295440 - RNA, 24 nt, Human
agaggcagcggggguuugggggcc

SEQ ID NO: 1295441 - RNA, 19 nt, Human
agagucugggguggccaug

SEQ ID NO: 1295442 - RNA, 21 nt, Human
agcaagagugacccugggcau

SEQ ID NO: 1295443 - RNA, 20 nt, Human
agccccuuccagcucucccc

SEQ ID NO: 1295444 - RNA, 21 nt, Human
agcccuucggcugcuucuacc

SEQ ID NO: 1295445 - RNA, 18 nt, Human
agccgaugccaggguggc

SEQ ID NO: 1295446 - RNA, 18 nt, Human
aggaagagaggcagcggg

SEQ ID NO: 1295447 - RNA, 21 nt, Human
aggcagcggggguuugggggc

SEQ ID NO: 1295448 - RNA, 24 nt, Human
aggcauggagaccaccccccaggg

SEQ ID NO: 1295449 - RNA, 22 nt, Human
aggcugacgccuggggccccag

SEQ ID NO: 1295450 - RNA, 22 nt, Human
aggggcuauugccucuccugcc

SEQ ID NO: 1295451 - RNA, 18 nt, Human
aggguccaccuaucccuc

SEQ ID NO: 1295452 - RNA, 24 nt, Human
agguaguuuccugcccccggcccc

SEQ ID NO: 1295453 - RNA, 22 nt, Human
agguggagaggggcuauggggu

SEQ ID NO: 1295454 - RNA, 20 nt, Human
aggugggggauggggggaag

SEQ ID NO: 1295455 - RNA, 19 nt, Human
auaaaaaacagaagccaag

SEQ ID NO: 1295456 - RNA, 25 nt, Human
auaacaacccuuuucuuuguccucc

SEQ ID NO: 1295457 - RNA, 21 nt, Human
aucugccgucagcucucucca

SEQ ID NO: 1295458 - RNA, 18 nt, Human
cacacguggaagcgguga

SEQ ID NO: 1295459 - RNA, 24 nt, Human
cacccugggacgcccugccgccac

SEQ ID NO: 1295460 - RNA, 20 nt, Human
caccguggagacaccgcaac

SEQ ID NO: 1295461 - RNA, 22 nt, Human
cagagucugggguggccauggg

SEQ ID NO: 1295462 - RNA, 24 nt, Human
cagaucccggcagccaggcccaga

SEQ ID NO: 1295463 - RNA, 21 nt, Human
cagcccagccuccagagcucc

SEQ ID NO: 1295464 - RNA, 22 nt, Human
cagccuccagagcuccgauucc

SEQ ID NO: 1295465 - RNA, 18 nt, Human
cagcgcagggguggaagg

SEQ ID NO: 1295466 - RNA, 24 nt, Human
cagcggguagcaagagugacccug

SEQ ID NO: 1295467 - RNA, 21 nt, Human
caggcauggagaccacccccc

SEQ ID NO: 1295468 - RNA, 24 nt, Human
cauagaaacaucugcaggccuggg

SEQ ID NO: 1295469 - RNA, 22 nt, Human
ccacaggggcuauugccucucc

SEQ ID NO: 1295470 - RNA, 20 nt, Human
ccagagcuuuaacuuuggau

SEQ ID NO: 1295471 - RNA, 22 nt, Human
ccagccuccagagcuccgauuc

SEQ ID NO: 1295472 - RNA, 22 nt, Human
ccagcugguccugcaauugcca

SEQ ID NO: 1295473 - RNA, 18 nt, Human
ccaggcccagagagggaa

SEQ ID NO: 1295474 - RNA, 21 nt, Human
ccagggagucggaguccaggg

SEQ ID NO: 1295475 - RNA, 24 nt, Human
ccccagaucccggcagccaggccc

SEQ ID NO: 1295476 - RNA, 19 nt, Human
ccccaucaccucgcagcug

SEQ ID NO: 1295477 - RNA, 18 nt, Human
ccccccagggcucugggg

SEQ ID NO: 1295478 - RNA, 20 nt, Human
ccccccagggcucuggggug

SEQ ID NO: 1295479 - RNA, 20 nt, Human
ccccggccccuccccugacc

SEQ ID NO: 1295480 - RNA, 18 nt, Human
cccugccgccacccgcgu

SEQ ID NO: 1295481 - RNA, 20 nt, Human
cccugcuccagcugguccug

SEQ ID NO: 1295482 - RNA, 23 nt, Human
ccgcacccugggacgcccugccg

SEQ ID NO: 1295483 - RNA, 24 nt, Human
ccugcccccggccccuccccugac

SEQ ID NO: 1295484 - RNA, 21 nt, Human
ccugccgccacccgcgucucg

SEQ ID NO: 1295485 - RNA, 19 nt, Human
ccugcuccagcugguccug

SEQ ID NO: 1295486 - RNA, 24 nt, Human
cgagagcaccguggagacaccggu

SEQ ID NO: 1295487 - RNA, 23 nt, Human
cgcagcugugacucagaaagacc

SEQ ID NO: 1295488 - RNA, 21 nt, Human
cgcccugccgccacccgcguc

SEQ ID NO: 1295489 - RNA, 18 nt, Human
cggggccuucuggggcug

SEQ ID NO: 1295490 - RNA, 18 nt, Human
cuccugccacccagcucc

SEQ ID NO: 1295491 - RNA, 18 nt, Human
cugcuuccgggcacgccc

SEQ ID NO: 1295492 - RNA, 21 nt, Human
cuggggcugauuuguguggga

SEQ ID NO: 1295493 - RNA, 18 nt, Human
cugggguggccaugggca

SEQ ID NO: 1295494 - RNA, 19 nt, Human
cuugggagccagcaggcug

SEQ ID NO: 1295495 - RNA, 22 nt, Human
gaagagaggcagcggggguuug

SEQ ID NO: 1295496 - RNA, 22 nt, Human
gagagcaccguggagacaccgc

SEQ ID NO: 1295497 - RNA, 19 nt, Human
gagaggaaaggagguggcc

SEQ ID NO: 1295498 - RNA, 21 nt, Human
gagaggcagcggggguuuggg

SEQ ID NO: 1295499 - RNA, 20 nt, Human
gagcaccgaucgcuuuggcu

SEQ ID NO: 1295500 - RNA, 20 nt, Human
gagcuccgauuccgucccag

SEQ ID NO: 1295501 - RNA, 23 nt, Human
gagggcagugggggcagaagggg

SEQ ID NO: 1295502 - RNA, 21 nt, Human
gaucagagucugggguggcca

SEQ ID NO: 1295503 - RNA, 18 nt, Human
gcagcggggguuuggggg

SEQ ID NO: 1295504 - RNA, 19 nt, Human
gcagugggggcagaagggg

SEQ ID NO: 1295505 - RNA, 23 nt, Human
gcgagagcaccguggagacaccg

SEQ ID NO: 1295506 - RNA, 20 nt, Human
gcuauugccucuccugccac

SEQ ID NO: 1295507 - RNA, 21 nt, Human
gcuccugagagugaauccuga

SEQ ID NO: 1295508 - RNA, 24 nt, Human
gcucugaagccuagaaaaagcccc

SEQ ID NO: 1295509 - RNA, 19 nt, Human
ggaaagacaaaaauaacaa

SEQ ID NO: 1295510 - RNA, 23 nt, Human
ggaaagagcugggggagcuuaag

SEQ ID NO: 1295511 - RNA, 18 nt, Human
ggacccaggggucccugg

SEQ ID NO: 1295512 - RNA, 18 nt, Human
ggccuggaugagggcagu

SEQ ID NO: 1295513 - RNA, 23 nt, Human
gggagcaccgaucgcuuuggcuu

SEQ ID NO: 1295514 - RNA, 21 nt, Human
gggauggggggaaggaagaga

SEQ ID NO: 1295515 - RNA, 19 nt, Human
gggcaaggccacagggaug

SEQ ID NO: 1295516 - RNA, 23 nt, Human
gggcagaaggggucuggaucagc

SEQ ID NO: 1295517 - RNA, 22 nt, Human
gggcagugggggcagaaggggu

SEQ ID NO: 1295518 - RNA, 24 nt, Human
ggggcucagcugucccucugggag

SEQ ID NO: 1295519 - RNA, 20 nt, Human
gggggaaggaagagaggcag

SEQ ID NO: 1295520 - RNA, 19 nt, Human
ggucccuggccacugucag

SEQ ID NO: 1295521 - RNA, 19 nt, Human
ggugagguggagaggggcu

SEQ ID NO: 1295522 - RNA, 19 nt, Human
guggaagguggcgagagga

SEQ ID NO: 1295523 - RNA, 20 nt, Human
uaaaagaauuaagccagagg

SEQ ID NO: 1295524 - RNA, 24 nt, Human
uaacaacccuuuucuuuguccucc

SEQ ID NO: 1295525 - RNA, 23 nt, Human
uaccaaccuggagccaaggcagg

SEQ ID NO: 1295526 - RNA, 26 nt, Human
uaccaggagcucugccccucauagaa

SEQ ID NO: 1295527 - RNA, 27 nt, Human
uaucccucaagaaaguuccuacguggc

SEQ ID NO: 1295528 - RNA, 18 nt, Human
ucagaaagaccagcagag

SEQ ID NO: 1295529 - RNA, 19 nt, Human
ucagcugucccucugggag

SEQ ID NO: 1295530 - RNA, 23 nt, Human
ucaggagcccuucggcugcuucu

SEQ ID NO: 1295531 - RNA, 20 nt, Human
uccagcugguccugcaauug

SEQ ID NO: 1295532 - RNA, 24 nt, Human
ucccagaggguucucgcgggugcc

SEQ ID NO: 1295533 - RNA, 18 nt, Human
ucccucaagaaaguuccu

SEQ ID NO: 1295534 - RNA, 22 nt, Human
ucccuggccacugucaggagcc

SEQ ID NO: 1295535 - RNA, 22 nt, Human
ucucgccgugcggggucacuug

SEQ ID NO: 1295536 - RNA, 21 nt, Human
ucugaagccuagaaaaagccc

SEQ ID NO: 1295537 - RNA, 18 nt, Human
ucuggggcugauuugugu

SEQ ID NO: 1295538 - RNA, 24 nt, Human
ugacccugggcaucaacauggggu

SEQ ID NO: 1295539 - RNA, 20 nt, Human
ugacucagaaagaccagcag

SEQ ID NO: 1295540 - RNA, 20 nt, Human
ugagaaacagacaagcggga

SEQ ID NO: 1295541 - RNA, 22 nt, Human
ugagagugaauccugacacggg

SEQ ID NO: 1295542 - RNA, 22 nt, Human
ugaggaugugugcagagagggc

SEQ ID NO: 1295543 - RNA, 19 nt, Human
ugagggcagugggggcaga

SEQ ID NO: 1295544 - RNA, 23 nt, Human
ugagggcagugggggcagaaggg

SEQ ID NO: 1295545 - RNA, 23 nt, Human
ugagguggagaggggcuaugggg

SEQ ID NO: 1295546 - RNA, 18 nt, Human
ugcaaacaaggaggccgc

SEQ ID NO: 1295547 - RNA, 19 nt, Human
ugcagagagggccgcggaa

SEQ ID NO: 1295548 - RNA, 24 nt, Human
ugcccccggccccuccccugaccc

SEQ ID NO: 1295549 - RNA, 18 nt, Human
ugcuccagcugguccugc

SEQ ID NO: 1295550 - RNA, 23 nt, Human
ugcugccaaccaacacaacacac

SEQ ID NO: 1295551 - RNA, 24 nt, Human
uggaagguggcgagaggaaaggag

SEQ ID NO: 1295552 - RNA, 22 nt, Human
uggagaggggcuaugggguucc

SEQ ID NO: 1295553 - RNA, 23 nt, Human
uggaucagccuugcugccaacca

SEQ ID NO: 1295554 - RNA, 21 nt, Human
uggaugagggcagugggggca

SEQ ID NO: 1295555 - RNA, 28 nt, Human
uggcaggcauggagaccaccccccucuu

SEQ ID NO: 1295556 - RNA, 18 nt, Human
ugggaggcggcacagaaa

SEQ ID NO: 1295557 - RNA, 24 nt, Human
uggggucagcacagcgcaggggug

SEQ ID NO: 1295558 - RNA, 23 nt, Human
ugugacucagaaagaccagcaga

SEQ ID NO: 1295559 - RNA, 23 nt, Human
uguggcgcucugcuuccgggcac

SEQ ID NO: 1295560 - RNA, 18 nt, Human
uuagcccacgaggagaug

SEQ ID NO: 1295561 - RNA, 21 nt, Human
uuccaaggacuggagccgcgg

SEQ ID NO: 1295562 - RNA, 22 nt, Human
uugcccaggcccugcaaacaag

SEQ ID NO: 1295563 - RNA, 20 nt, Human
aacagcccugugagguagga

SEQ ID NO: 1295564 - RNA, 20 nt, Human
aagaacaaauccaaagccca

SEQ ID NO: 1295565 - RNA, 19 nt, Human
aagcccagugcagcagcuc

SEQ ID NO: 1295566 - RNA, 21 nt, Human
aaggcaucucguccugggucg

SEQ ID NO: 1295567 - RNA, 21 nt, Human
accccgcacgguggccccagc

SEQ ID NO: 1295568 - RNA, 18 nt, Human
agcucugagcucaggccu

SEQ ID NO: 1295569 - RNA, 23 nt, Human
aggcugggggcgauguugaggcc

SEQ ID NO: 1295570 - RNA, 21 nt, Human
aucacauggggaguucagggu

SEQ ID NO: 1295571 - RNA, 18 nt, Human
cacauggggaguucaggg

SEQ ID NO: 1295572 - RNA, 20 nt, Human
caccaaggguaggcugccgg

SEQ ID NO: 1295573 - RNA, 20 nt, Human
cacccgcagcacuuuaaucc

SEQ ID NO: 1295574 - RNA, 18 nt, Human
caucacauggggaguuca

SEQ ID NO: 1295575 - RNA, 18 nt, Human
cauggccacaucucccca

SEQ ID NO: 1295576 - RNA, 21 nt, Human
ccagcucugagcccguuggca

SEQ ID NO: 1295577 - RNA, 18 nt, Human
ccccaaccacucagcccg

SEQ ID NO: 1295578 - RNA, 18 nt, Human
ccucagcugugccuuucc

SEQ ID NO: 1295579 - RNA, 18 nt, Human
ccuggccucuuccccucc

SEQ ID NO: 1295580 - RNA, 22 nt, Human
ccuggccucuuccccucccuuu

SEQ ID NO: 1295581 - RNA, 20 nt, Human
ccuguacuugaaacacugaa

SEQ ID NO: 1295582 - RNA, 22 nt, Human
cgccccagcacaucccuggcac

SEQ ID NO: 1295583 - RNA, 26 nt, Human
cgccccagcacaucccuggcacacgg

SEQ ID NO: 1295584 - RNA, 26 nt, Human
cguccugggucgcaacacccagcagc

SEQ ID NO: 1295585 - RNA, 19 nt, Human
cucacaagaacaaauccaa

SEQ ID NO: 1295586 - RNA, 25 nt, Human
cucacccgcagcacuuuaaucccca

SEQ ID NO: 1295587 - RNA, 26 nt, Human
cucacccgcagcacuuuaauccccac

SEQ ID NO: 1295588 - RNA, 24 nt, Human
cuuccccucccuuuaguaacccca

SEQ ID NO: 1295589 - RNA, 22 nt, Human
gaacaaauccaaagcccagugc

SEQ ID NO: 1295590 - RNA, 23 nt, Human
gaacaaauccaaagcccagugca

SEQ ID NO: 1295591 - RNA, 23 nt, Human
gaggccgaagccagccacagugc

SEQ ID NO: 1295592 - RNA, 24 nt, Human
gauccagagcagcccggggagccc

SEQ ID NO: 1295593 - RNA, 18 nt, Human
gcccagugcagcagcucu

SEQ ID NO: 1295594 - RNA, 22 nt, Human
gcucugagcucaggccugccgu

SEQ ID NO: 1295595 - RNA, 20 nt, Human
ggaaaggacacagcaguggg

SEQ ID NO: 1295596 - RNA, 23 nt, Human
ggggaaaccgagacacacauuca

SEQ ID NO: 1295597 - RNA, 24 nt, Human
gguaggcugccgggugcacaggga

SEQ ID NO: 1295598 - RNA, 18 nt, Human
guggccccagccagcugg

SEQ ID NO: 1295599 - RNA, 18 nt, Human
uaaccccaucagcagcag

SEQ ID NO: 1295600 - RNA, 27 nt, Human
uagcacaagaccauggccacaucuccc

SEQ ID NO: 1295601 - RNA, 24 nt, Human
ucagcggcccaccuggccucuucc

SEQ ID NO: 1295602 - RNA, 18 nt, Human
ucaggccugccgugcccc

SEQ ID NO: 1295603 - RNA, 22 nt, Human
ucaggguuagccuggaguacga

SEQ ID NO: 1295604 - RNA, 22 nt, Human
uccccacaacagcccugugagg

SEQ ID NO: 1295605 - RNA, 23 nt, Human
ucccgcugcggcucggcgaaagc

SEQ ID NO: 1295606 - RNA, 18 nt, Human
uccugggauccagagcag

SEQ ID NO: 1295607 - RNA, 21 nt, Human
ucucuagcacaagaccauggc

SEQ ID NO: 1295608 - RNA, 19 nt, Human
ugccucagcugugccuuuc

SEQ ID NO: 1295609 - RNA, 21 nt, Human
uggcaccccgcacgguggccc

SEQ ID NO: 1295610 - RNA, 18 nt, Human
uggcccagucagcggccc

SEQ ID NO: 1295611 - RNA, 21 nt, Human
uucaggguuagccuggaguac

SEQ ID NO: 1295612 - RNA, 20 nt, Human
uugaaacacugaacgugaug

SEQ ID NO: 1295613 - RNA, 21 nt, Human
uuguaccgccaucucuagcac

SEQ ID NO: 1295614 - RNA, 23 nt, Human
aacuccugggcucaagcaauccu

SEQ ID NO: 1295615 - RNA, 25 nt, Human
aagcaauccuucugccucaaccucc

SEQ ID NO: 1295616 - RNA, 18 nt, Human
acucugucacccaagcuc

SEQ ID NO: 1295617 - RNA, 19 nt, Human
acucugucacccaagcuca

SEQ ID NO: 1295618 - RNA, 25 nt, Human
acucugucacccaagcucaagugca

SEQ ID NO: 1295619 - RNA, 25 nt, Human
acuuuguugcccaggcuguucucaa

SEQ ID NO: 1295620 - RNA, 20 nt, Human
agugcagaggcgugaucuug

SEQ ID NO: 1295621 - RNA, 24 nt, Human
agugcagaggcgugaucuuggcuc

SEQ ID NO: 1295622 - RNA, 33 nt, Human
caaccaccuaggcucaagagauucucccagcug

SEQ ID NO: 1295623 - RNA, 23 nt, Human
caagcaauccuucugccucaacc

SEQ ID NO: 1295624 - RNA, 28 nt, Human
caagcaauccuucugccucaaccuccca

SEQ ID NO: 1295625 - RNA, 23 nt, Human
cacccaagcucaagugcagaggc

SEQ ID NO: 1295626 - RNA, 19 nt, Human
cacuuuguugcccaggcug

SEQ ID NO: 1295627 - RNA, 24 nt, Human
cacuuuguugcccaggcuguucuc

SEQ ID NO: 1295628 - RNA, 24 nt, Human
cagccucaaccaccuaggcucaag

SEQ ID NO: 1295629 - RNA, 18 nt, Human
ccucaaccaccuaggcuc

SEQ ID NO: 1295630 - RNA, 21 nt, Human
ccugggcucaagcaauccuuc

SEQ ID NO: 1295631 - RNA, 19 nt, Human
ccuucugccucaaccuccc

SEQ ID NO: 1295632 - RNA, 24 nt, Human
cucaagcaauccuucugccucaac

SEQ ID NO: 1295633 - RNA, 18 nt, Human
cucacugcagccucaacc

SEQ ID NO: 1295634 - RNA, 21 nt, Human
cuccugggcucaagcaauccu

SEQ ID NO: 1295635 - RNA, 23 nt, Human
cugcagccucaaccaccuaggcu

SEQ ID NO: 1295636 - RNA, 18 nt, Human
cuucugccucaaccuccc

SEQ ID NO: 1295637 - RNA, 22 nt, Human
cuuggcucacugcagccucaac

SEQ ID NO: 1295638 - RNA, 18 nt, Human
gauagggucuuacucugu

SEQ ID NO: 1295639 - RNA, 22 nt, Human
gcagaggcgugaucuuggcuca

SEQ ID NO: 1295640 - RNA, 18 nt, Human
gccucaaccucccaaaug

SEQ ID NO: 1295641 - RNA, 19 nt, Human
gcucaagugcagaggcgug

SEQ ID NO: 1295642 - RNA, 22 nt, Human
gggcucaagcaauccuucugcc

SEQ ID NO: 1295643 - RNA, 24 nt, Human
uacaggugagugccaccacaccca

SEQ ID NO: 1295644 - RNA, 19 nt, Human
ucaagagauucucccagcc

SEQ ID NO: 1295645 - RNA, 24 nt, Human
ucacugcagccucaaccaccuagg

SEQ ID NO: 1295646 - RNA, 18 nt, Human
uccugggcucaagcaauc

SEQ ID NO: 1295647 - RNA, 20 nt, Human
uccugggcucaagcaauccu

SEQ ID NO: 1295648 - RNA, 20 nt, Human
uccugggcucaagcaauccu

SEQ ID NO: 1295649 - RNA, 21 nt, Human
uccugggcucaagcaauccuu

SEQ ID NO: 1295650 - RNA, 24 nt, Human
uccugggcucaagcaauccuucug

SEQ ID NO: 1295651 - RNA, 21 nt, Human
ucuaguuuuuguagagauugg

SEQ ID NO: 1295652 - RNA, 23 nt, Human
ucucaaacuccugggcucaagca

SEQ ID NO: 1295653 - RNA, 19 nt, Human
ucucacuuuguugcccagg

SEQ ID NO: 1295654 - RNA, 21 nt, Human
ucucacuuuguugcccaggcu

SEQ ID NO: 1295655 - RNA, 22 nt, Human
ucucacuuuguugcccaggcug

SEQ ID NO: 1295656 - RNA, 26 nt, Human
ucucacuuuguugcccaggcuguucu

SEQ ID NO: 1295657 - RNA, 27 nt, Human
ucucacuuuguugcccaggcuguucuc

SEQ ID NO: 1295658 - RNA, 19 nt, Human
ucucccagcccagccuccu

SEQ ID NO: 1295659 - RNA, 24 nt, Human
ucugucacccaagcucaagugcag

SEQ ID NO: 1295660 - RNA, 18 nt, Human
ucuuacucugucacccaa

SEQ ID NO: 1295661 - RNA, 24 nt, Human
ucuuacucugucacccaagcucaa

SEQ ID NO: 1295662 - RNA, 20 nt, Human
ugaaggcuuuguagcccugg

SEQ ID NO: 1295663 - RNA, 23 nt, Human
ugaaggcuuuguagcccugggaa

SEQ ID NO: 1295664 - RNA, 22 nt, Human
ugagauagggucuuacucuguc

SEQ ID NO: 1295665 - RNA, 18 nt, Human
ugagugccaccacaccca

SEQ ID NO: 1295666 - RNA, 18 nt, Human
ugcagaggcgugaucuug

SEQ ID NO: 1295667 - RNA, 19 nt, Human
ugccaccacacccagcuau

SEQ ID NO: 1295668 - RNA, 26 nt, Human
ugccucaaccucccaaauggugcugg

SEQ ID NO: 1295669 - RNA, 24 nt, Human
ugggcucaagcaauccuucugccu

SEQ ID NO: 1295670 - RNA, 23 nt, Human
ugggucucacuuuguugcccagg

SEQ ID NO: 1295671 - RNA, 22 nt, Human
uguugcccaggcuguucucaaa

SEQ ID NO: 1295672 - RNA, 19 nt, Human
uuaguacaggugagugcca

SEQ ID NO: 1295673 - RNA, 20 nt, Human
uucugccucaaccucccaaa

SEQ ID NO: 1295674 - RNA, 24 nt, Human
uugggucucacuuuguugcccagg

SEQ ID NO: 1295675 - RNA, 23 nt, Human
uuuguugcccaggcuguucucaa

SEQ ID NO: 1295676 - RNA, 24 nt, Human
uuuguugcccaggcuguucucaaa

SEQ ID NO: 1295677 - RNA, 23 nt, Human
cuaaguguguauaaaauaccagc

SEQ ID NO: 1295678 - RNA, 20 nt, Human
aagcccacccagagucauac

SEQ ID NO: 1295679 - RNA, 23 nt, Human
aaguguuggagcggguucaagcc

SEQ ID NO: 1295680 - RNA, 23 nt, Human
agagaaccccccgcaccaccuca

SEQ ID NO: 1295681 - RNA, 18 nt, Human
caaacacgcgagcgcggc

SEQ ID NO: 1295682 - RNA, 20 nt, Human
caaagcgguggagagacccg

SEQ ID NO: 1295683 - RNA, 21 nt, Human
caagccaaguccucuggcacc

SEQ ID NO: 1295684 - RNA, 23 nt, Human
caccagcgcccacugcugggucc

SEQ ID NO: 1295685 - RNA, 25 nt, Human
caccagcgcccacugcuggguccaa

SEQ ID NO: 1295686 - RNA, 18 nt, Human
caccagcgucccuaagcc

SEQ ID NO: 1295687 - RNA, 21 nt, Human
caccucagcaaagggcuugug

SEQ ID NO: 1295688 - RNA, 19 nt, Human
cagcaaagggcuugugugu

SEQ ID NO: 1295689 - RNA, 20 nt, Human
ccacgcuccauuucaccaaa

SEQ ID NO: 1295690 - RNA, 25 nt, Human
ccagcgcccccuccaggcgcacucc

SEQ ID NO: 1295691 - RNA, 22 nt, Human
cccacgcuccauuucaccaaaa

SEQ ID NO: 1295692 - RNA, 20 nt, Human
cccacugcuggguccaaggc

SEQ ID NO: 1295693 - RNA, 22 nt, Human
cccagagucauaccauucugcc

SEQ ID NO: 1295694 - RNA, 22 nt, Human
ccccccgcaccaccucagcaaa

SEQ ID NO: 1295695 - RNA, 21 nt, Human
ccccugguccugacuuccacu

SEQ ID NO: 1295696 - RNA, 23 nt, Human
ccuccaggcgcacuccgcaaaca

SEQ ID NO: 1295697 - RNA, 18 nt, Human
ccugacuuccacuccacg

SEQ ID NO: 1295698 - RNA, 19 nt, Human
cucagcaaagggcuugugu

SEQ ID NO: 1295699 - RNA, 20 nt, Human
gagcugccacccacgcucca

SEQ ID NO: 1295700 - RNA, 24 nt, Human
gaggaguuacaguucuuucucacg

SEQ ID NO: 1295701 - RNA, 18 nt, Human
gaucaggacgacugggac

SEQ ID NO: 1295702 - RNA, 24 nt, Human
gcauuucugcaccuucgacacaca

SEQ ID NO: 1295703 - RNA, 20 nt, Human
gccaacuaccugcccuuagc

SEQ ID NO: 1295704 - RNA, 19 nt, Human
gcccuuagcaagcguggag

SEQ ID NO: 1295705 - RNA, 20 nt, Human
gcgagcgcggcgaccgcccc

SEQ ID NO: 1295706 - RNA, 19 nt, Human
guggagagaaccccccgca

SEQ ID NO: 1295707 - RNA, 19 nt, Human
guggagagacccgcccagc

SEQ ID NO: 1295708 - RNA, 27 nt, Human
uagcaagcguggagagaaccccccucu

SEQ ID NO: 1295709 - RNA, 21 nt, Human
ucccuaagcccacccagaguc

SEQ ID NO: 1295710 - RNA, 19 nt, Human
uggagagaaccccccgcac

SEQ ID NO: 1295711 - RNA, 23 nt, Human
uggagcggguucaagccaagucc

SEQ ID NO: 1295712 - RNA, 19 nt, Human
uggggcgaccccugguccu

SEQ ID NO: 1295713 - RNA, 22 nt, Human
ugguccugacuuccacuccacg

SEQ ID NO: 1295714 - RNA, 23 nt, Human
uucaaagucagccaacuaccugc

SEQ ID NO: 1295715 - RNA, 21 nt, Human
uugugcuguuccuuagggcau

SEQ ID NO: 1295716 - RNA, 18 nt, Human
auagucccugcacuuguu

SEQ ID NO: 1295717 - RNA, 20 nt, Human
auugcguguugggaaaaccc

SEQ ID NO: 1295718 - RNA, 19 nt, Human
cuaugugacuguacucacc

SEQ ID NO: 1295719 - RNA, 18 nt, Human
gucccugcacuuguuuau

SEQ ID NO: 1295720 - RNA, 20 nt, Human
uagggcuuuaaccauccuug

SEQ ID NO: 1295721 - RNA, 21 nt, Human
ugggaaaacccgauguaggug

SEQ ID NO: 1295722 - RNA, 18 nt, Human
ccccaggggcagggcucc

SEQ ID NO: 1295723 - RNA, 22 nt, Human
cggggcugcagagucagcagag

SEQ ID NO: 1295724 - RNA, 24 nt, Human
cggggcugcagagucagcagaggg

SEQ ID NO: 1295725 - RNA, 18 nt, Human
gccgggacaauugccugg

SEQ ID NO: 1295726 - RNA, 18 nt, Human
ggcagggcuccugucugc

SEQ ID NO: 1295727 - RNA, 21 nt, Human
ggccugcggggcugcagaguc

SEQ ID NO: 1295728 - RNA, 22 nt, Human
ggguagauccaaggccccaggc

SEQ ID NO: 1295729 - RNA, 21 nt, Human
gguagauccaaggccccaggc

SEQ ID NO: 1295730 - RNA, 18 nt, Human
gucuggaggagcguaaaa

SEQ ID NO: 1295731 - RNA, 27 nt, Human
ugcggggcugcagagucagggucgguc

SEQ ID NO: 1295732 - RNA, 21 nt, Human
ccuucuccuucuuuuucuuuu

SEQ ID NO: 1295733 - RNA, 20 nt, Human
ccuucuuuuucuuuucaacc

SEQ ID NO: 1295734 - RNA, 18 nt, Human
gcugaguacuuccucuua

SEQ ID NO: 1295735 - RNA, 21 nt, Human
guugcaaaaaccuucuccuuc

SEQ ID NO: 1295736 - RNA, 22 nt, Human
uacguggccuuucuuguguucu

SEQ ID NO: 1295737 - RNA, 20 nt, Human
uggauuuagcggcugaguac

SEQ ID NO: 1295738 - RNA, 22 nt, Human
uuagcggcugaguacuuccucu

SEQ ID NO: 1295739 - RNA, 21 nt, Human
uucagcaccacuugaaguaag

SEQ ID NO: 1295740 - RNA, 23 nt, Human
uucuccuucuuuuucuuuucaaa

SEQ ID NO: 1295741 - RNA, 19 nt, Human
accaagaaguuugccaugg

SEQ ID NO: 1295742 - RNA, 22 nt, Human
caacaacaccaagaaguuugcc

SEQ ID NO: 1295743 - RNA, 23 nt, Human
caacaccaagaaguuugccaugg

SEQ ID NO: 1295744 - RNA, 26 nt, Human
cauuuuuaucgccugcuuuuuggggg

SEQ ID NO: 1295745 - RNA, 24 nt, Human
cuccaguuacaacaacaccaagaa

SEQ ID NO: 1295746 - RNA, 18 nt, Human
ggcacaggcgcugccagc

SEQ ID NO: 1295747 - RNA, 24 nt, Human
ugucucauccucauccaagcucca

SEQ ID NO: 1295748 - RNA, 21 nt, Human
aaccacucuucaagcaucuga

SEQ ID NO: 1295749 - RNA, 20 nt, Human
aaccucucuccuccugucac

SEQ ID NO: 1295750 - RNA, 21 nt, Human
aagcaucugauccagcaauuc

SEQ ID NO: 1295751 - RNA, 22 nt, Human
agaagacucagggcaggggagc

SEQ ID NO: 1295752 - RNA, 20 nt, Human
agggcaggggagcaagcugg

SEQ ID NO: 1295753 - RNA, 22 nt, Human
auuggaaccacucuucaagcau

SEQ ID NO: 1295754 - RNA, 18 nt, Human
caccugcagccacaucuc

SEQ ID NO: 1295755 - RNA, 21 nt, Human
cauugaaccucucuccuccug

SEQ ID NO: 1295756 - RNA, 21 nt, Human
ccaucugaauaaguucauccc

SEQ ID NO: 1295757 - RNA, 18 nt, Human
ccuccugucaccugcagc

SEQ ID NO: 1295758 - RNA, 21 nt, Human
cuucaagcaucugauccagca

SEQ ID NO: 1295759 - RNA, 18 nt, Human
gguuauuaccaggaugac

SEQ ID NO: 1295760 - RNA, 21 nt, Human
ucaagcaucugauccagcaau

SEQ ID NO: 1295761 - RNA, 21 nt, Human
uccucagagcucacguaagca

SEQ ID NO: 1295762 - RNA, 21 nt, Human
uccuccugucaccugcagcca

SEQ ID NO: 1295763 - RNA, 23 nt, Human
uccucugucacuggcugcugaac

SEQ ID NO: 1295764 - RNA, 21 nt, Human
ucuccucugucacuggcugcu

SEQ ID NO: 1295765 - RNA, 22 nt, Human
ugaaccucucuccuccugucac

SEQ ID NO: 1295766 - RNA, 18 nt, Human
ugaacuggacagacuugg

SEQ ID NO: 1295767 - RNA, 19 nt, Human
ugaacuggacagacuuggc

SEQ ID NO: 1295768 - RNA, 19 nt, Human
ugccagaggccugguccuc

SEQ ID NO: 1295769 - RNA, 19 nt, Human
ugcugugcaucuacacaaa

SEQ ID NO: 1295770 - RNA, 22 nt, Human
uucagcugcaggacaaugcugc

SEQ ID NO: 1295771 - RNA, 23 nt, Human
uucaucccaagcugauucugaug

SEQ ID NO: 1295772 - RNA, 24 nt, Human
aaagugcugggauuacaggcauga

SEQ ID NO: 1295773 - RNA, 23 nt, Human
aagucuaaguuugaauucuggcu

SEQ ID NO: 1295774 - RNA, 19 nt, Human
aagugcugggauuacaggc

SEQ ID NO: 1295775 - RNA, 21 nt, Human
aagugcugggauuacaggcau

SEQ ID NO: 1295776 - RNA, 26 nt, Human
aagugcugggauuacaggcaugagcc

SEQ ID NO: 1295777 - RNA, 23 nt, Human
accucagccucccaaagugcugg

SEQ ID NO: 1295778 - RNA, 18 nt, Human
acgagguuucaccauguu

SEQ ID NO: 1295779 - RNA, 20 nt, Human
acgagguuucaccauguuug

SEQ ID NO: 1295780 - RNA, 24 nt, Human
acgagguuucaccauguuugccag

SEQ ID NO: 1295781 - RNA, 22 nt, Human
agguuucaccauguuugccagg

SEQ ID NO: 1295782 - RNA, 22 nt, Human
aguagagacgagguuucaccau

SEQ ID NO: 1295783 - RNA, 18 nt, Human
agugcugggauuacaggc

SEQ ID NO: 1295784 - RNA, 20 nt, Human
augagccaccacgccuggcc

SEQ ID NO: 1295785 - RNA, 24 nt, Human
augauccgcccaccucagccuccc

SEQ ID NO: 1295786 - RNA, 18 nt, Human
auguuugccaggaugguc

SEQ ID NO: 1295787 - RNA, 24 nt, Human
caaagugcugggauuacaggcaug

SEQ ID NO: 1295788 - RNA, 18 nt, Human
caccauguuugccaggau

SEQ ID NO: 1295789 - RNA, 19 nt, Human
caccauguuugccaggaug

SEQ ID NO: 1295790 - RNA, 24 nt, Human
caccauguuugccaggauggucuc

SEQ ID NO: 1295791 - RNA, 24 nt, Human
caugauccgcccaccucagccucc

SEQ ID NO: 1295792 - RNA, 23 nt, Human
ccaaagugcugggauuacaggca

SEQ ID NO: 1295793 - RNA, 24 nt, Human
ccaaagugcugggauuacaggcau

SEQ ID NO: 1295794 - RNA, 24 nt, Human
cccaaagugcugggauuacaggca

SEQ ID NO: 1295795 - RNA, 26 nt, Human
ccgcccaccucagccucccaaagugc

SEQ ID NO: 1295796 - RNA, 20 nt, Human
cuccugaccucaugauccgc

SEQ ID NO: 1295797 - RNA, 19 nt, Human
cucuuucacaguccuuccu

SEQ ID NO: 1295798 - RNA, 22 nt, Human
gaccucaugauccgcccaccuc

SEQ ID NO: 1295799 - RNA, 18 nt, Human
gauuacaggcaugagcca

SEQ ID NO: 1295800 - RNA, 21 nt, Human
gauuacaggcaugagccacca

SEQ ID NO: 1295801 - RNA, 22 nt, Human
gauuacaggcaugagccaccac

SEQ ID NO: 1295802 - RNA, 19 nt, Human
ggauuacaggcaugagcca

SEQ ID NO: 1295803 - RNA, 20 nt, Human
ggucucgaucuccugaccuc

SEQ ID NO: 1295804 - RNA, 24 nt, Human
gguuucaccauguuugccaggaug

SEQ ID NO: 1295805 - RNA, 22 nt, Human
uacaggcaugagccaccacgcc

SEQ ID NO: 1295806 - RNA, 22 nt, Human
uagagacgagguuucaccaugu

SEQ ID NO: 1295807 - RNA, 24 nt, Human
uaguagagacgagguuucaccaug

SEQ ID NO: 1295808 - RNA, 26 nt, Human
uaguagagacgagguuucaccauguu

SEQ ID NO: 1295809 - RNA, 18 nt, Human
ucagccucccaaagugcu

SEQ ID NO: 1295810 - RNA, 24 nt, Human
ucccaaagugcugggauuacaggc

SEQ ID NO: 1295811 - RNA, 21 nt, Human
uccgcccaccucagccuccca

SEQ ID NO: 1295812 - RNA, 23 nt, Human
ugaaaauaccauggcuuuauuuu

SEQ ID NO: 1295813 - RNA, 26 nt, Human
ugaaagcauugaguaugauaggaaca

SEQ ID NO: 1295814 - RNA, 23 nt, Human
ugaccucaugauccgcccaccuc

SEQ ID NO: 1295815 - RNA, 24 nt, Human
ugauccgcccaccucagccuccca

SEQ ID NO: 1295816 - RNA, 23 nt, Human
ugccaggauggucucgaucuccu

SEQ ID NO: 1295817 - RNA, 20 nt, Human
uggaacccaaguacuugaaa

SEQ ID NO: 1295818 - RNA, 18 nt, Human
ugggauuacaggcaugag

SEQ ID NO: 1295819 - RNA, 19 nt, Human
ugggauuacaggcaugagc

SEQ ID NO: 1295820 - RNA, 22 nt, Human
ugggauuacaggcaugagccac

SEQ ID NO: 1295821 - RNA, 23 nt, Human
ugggauuacaggcaugagccacc

SEQ ID NO: 1295822 - RNA, 24 nt, Human
ugggauuacaggcaugagccacca

SEQ ID NO: 1295823 - RNA, 24 nt, Human
ugggauuacaggcaugagccacca

SEQ ID NO: 1295824 - RNA, 24 nt, Human
uuaguagagacgagguuucaccau

SEQ ID NO: 1295825 - RNA, 19 nt, Human
uuucaccauguuugccagg

SEQ ID NO: 1295826 - RNA, 20 nt, Human
uuucaccauguuugccagga

SEQ ID NO: 1295827 - RNA, 20 nt, Human
uuucagaagauuacuuacuu

SEQ ID NO: 1295828 - RNA, 24 nt, Human
uuuuuaguagagacgagguuucac

SEQ ID NO: 1295829 - RNA, 24 nt, Human
aaaaaaaagacaacaaaacuagga

SEQ ID NO: 1295830 - RNA, 24 nt, Human
aaaaccaaauauggcggcagggaa

SEQ ID NO: 1295831 - RNA, 24 nt, Human
aaagacugagaaaaaaaaagacaa

SEQ ID NO: 1295832 - RNA, 24 nt, Human
aacaacugacaggugagacccaca

SEQ ID NO: 1295833 - RNA, 24 nt, Human
aaccaaauauggcggcagggaaau

SEQ ID NO: 1295834 - RNA, 20 nt, Human
aagacugagaaaaaaaaaga

SEQ ID NO: 1295835 - RNA, 18 nt, Human
aagagaaaaggguccccg

SEQ ID NO: 1295836 - RNA, 21 nt, Human
aagaugggggaguugagaagg

SEQ ID NO: 1295837 - RNA, 19 nt, Human
aagcaggucacuuguaagg

SEQ ID NO: 1295838 - RNA, 22 nt, Human
aaucaaguugugcagcugggca

SEQ ID NO: 1295839 - RNA, 25 nt, Human
acccucagaauggaggaaacaauuu

SEQ ID NO: 1295840 - RNA, 27 nt, Human
accugacgaugaaacccucagaaugga

SEQ ID NO: 1295841 - RNA, 21 nt, Human
acuaggaagccacagaaacac

SEQ ID NO: 1295842 - RNA, 27 nt, Human
agaaaaaaaaagacaacaaaacuagga

SEQ ID NO: 1295843 - RNA, 21 nt, Human
agacaacaaaacuaggaagcc

SEQ ID NO: 1295844 - RNA, 21 nt, Human
agacaacaaaacuaggaagcc

SEQ ID NO: 1295845 - RNA, 23 nt, Human
agacaacaaaacuaggaagccac

SEQ ID NO: 1295846 - RNA, 21 nt, Human
agacccacagguggagagggc

SEQ ID NO: 1295847 - RNA, 19 nt, Human
agagaaaaggguccccgag

SEQ ID NO: 1295848 - RNA, 22 nt, Human
agcaauauuuugcaguucugau

SEQ ID NO: 1295849 - RNA, 23 nt, Human
caacaaaacuaggaagccacaga

SEQ ID NO: 1295850 - RNA, 22 nt, Human
cagcaugggggugacaaccgcg

SEQ ID NO: 1295851 - RNA, 24 nt, Human
cccgagaugggaagaaaaccaaau

SEQ ID NO: 1295852 - RNA, 20 nt, Human
ccgagaugggaagaaaacca

SEQ ID NO: 1295853 - RNA, 26 nt, Human
cucagaauggaggaaacaauuuuaga

SEQ ID NO: 1295854 - RNA, 20 nt, Human
gagaaaaaaaaagacaacaa

SEQ ID NO: 1295855 - RNA, 24 nt, Human
gugcagcugggcaucuaaaagacu

SEQ ID NO: 1295856 - RNA, 20 nt, Human
uaaacucagcaaacaacuga

SEQ ID NO: 1295857 - RNA, 19 nt, Human
uaagagaaaaggguccccg

SEQ ID NO: 1295858 - RNA, 23 nt, Human
uaggaagccacagaaacacgggu

SEQ ID NO: 1295859 - RNA, 23 nt, Human
ucagcaaacaacugacaggugag

SEQ ID NO: 1295860 - RNA, 19 nt, Human
ucccuguuucucaggcugu

SEQ ID NO: 1295861 - RNA, 24 nt, Human
ucuaaaagacugagaaaaaaaaag

SEQ ID NO: 1295862 - RNA, 22 nt, Human
ugagaaaaaaaaagacaacaaa

SEQ ID NO: 1295863 - RNA, 18 nt, Human
uggcugaaugauauagag

SEQ ID NO: 1295864 - RNA, 23 nt, Human
ugggaagaaaaccaaauauggcg

SEQ ID NO: 1295865 - RNA, 24 nt, Human
uuucucaggcuguagacgaagggg

SEQ ID NO: 1295866 - RNA, 22 nt, Human
ucucaguccccuagaggcccgc

SEQ ID NO: 1295867 - RNA, 24 nt, Human
aauauagucagaaguaaaaacaua

SEQ ID NO: 1295868 - RNA, 19 nt, Human
agucagaaguaaaaacaua

SEQ ID NO: 1295869 - RNA, 23 nt, Human
uagucagaaguaaaaacauacaa

SEQ ID NO: 1295870 - RNA, 23 nt, Human
uauagucagaaguaaaaacauac

SEQ ID NO: 1295871 - RNA, 18 nt, Human
ucagaaguaaaaacauac

SEQ ID NO: 1295872 - RNA, 18 nt, Human
aaauagccccgcgcccac

SEQ ID NO: 1295873 - RNA, 19 nt, Human
acccagcccgcccuccgcc

SEQ ID NO: 1295874 - RNA, 21 nt, Human
agacccaguccccccacccag

SEQ ID NO: 1295875 - RNA, 23 nt, Human
agaggguggcguuguagggcucc

SEQ ID NO: 1295876 - RNA, 21 nt, Human
agccccgcgcccaccucccuc

SEQ ID NO: 1295877 - RNA, 21 nt, Human
aggaggagcagacgcgcagcg

SEQ ID NO: 1295878 - RNA, 24 nt, Human
aggcgggauuaggacggcaggaga

SEQ ID NO: 1295879 - RNA, 18 nt, Human
aggugguucaggucacca

SEQ ID NO: 1295880 - RNA, 18 nt, Human
auuuguucauccaccucc

SEQ ID NO: 1295881 - RNA, 22 nt, Human
caaagccgggcaugaagaaaug

SEQ ID NO: 1295882 - RNA, 21 nt, Human
caaggcccgguacugcuggcu

SEQ ID NO: 1295883 - RNA, 22 nt, Human
caaggcccgguacugcuggcug

SEQ ID NO: 1295884 - RNA, 19 nt, Human
cacacaggugcacccaccu

SEQ ID NO: 1295885 - RNA, 19 nt, Human
cacccaccuguggaucccc

SEQ ID NO: 1295886 - RNA, 19 nt, Human
cacguuggggaaagcugcu

SEQ ID NO: 1295887 - RNA, 18 nt, Human
cagacccaguccccccac

SEQ ID NO: 1295888 - RNA, 21 nt, Human
cagcgacccagcccgcccucc

SEQ ID NO: 1295889 - RNA, 24 nt, Human
caucucauccaugcccucgcccgu

SEQ ID NO: 1295890 - RNA, 25 nt, Human
ccaucccagacccaguccccccacc

SEQ ID NO: 1295891 - RNA, 19 nt, Human
cccagggagugggucagcu

SEQ ID NO: 1295892 - RNA, 20 nt, Human
ccccgcgcccaccucccucc

SEQ ID NO: 1295893 - RNA, 19 nt, Human
ccgcgcccaccucccuccg

SEQ ID NO: 1295894 - RNA, 23 nt, Human
cgcagcgacccagcccgcccucc

SEQ ID NO: 1295895 - RNA, 23 nt, Human
cuccaccacgguguccgacaccu

SEQ ID NO: 1295896 - RNA, 18 nt, Human
cucccagaauaagcaaca

SEQ ID NO: 1295897 - RNA, 27 nt, Human
cucccggaucuuacugagcagaagggu

SEQ ID NO: 1295898 - RNA, 22 nt, Human
cuccucggccguggcauccuga

SEQ ID NO: 1295899 - RNA, 24 nt, Human
cucucggccucggugaauuccauc

SEQ ID NO: 1295900 - RNA, 19 nt, Human
cugagcagaaggguaccca

SEQ ID NO: 1295901 - RNA, 26 nt, Human
gaagcgcaggcacguggugaccccac

SEQ ID NO: 1295902 - RNA, 19 nt, Human
gccgggcaugaagaaaugc

SEQ ID NO: 1295903 - RNA, 21 nt, Human
gcuccaccacgguguccgaca

SEQ ID NO: 1295904 - RNA, 20 nt, Human
ggaaagcucagguguccuug

SEQ ID NO: 1295905 - RNA, 24 nt, Human
ggcucccagaauaagcaacagcuu

SEQ ID NO: 1295906 - RNA, 24 nt, Human
gggcaugaagaaaugcagccgggg

SEQ ID NO: 1295907 - RNA, 22 nt, Human
gggcaugcgaccccugaaaaug

SEQ ID NO: 1295908 - RNA, 23 nt, Human
ggggcaaagccgggcaugaagaa

SEQ ID NO: 1295909 - RNA, 20 nt, Human
ggucacaggcagccaucaug

SEQ ID NO: 1295910 - RNA, 20 nt, Human
gguucaggucaccauaggug

SEQ ID NO: 1295911 - RNA, 18 nt, Human
guucauccaccucccuca

SEQ ID NO: 1295912 - RNA, 24 nt, Human
uaagcaacagcuuuacuuccacac

SEQ ID NO: 1295913 - RNA, 22 nt, Human
uagggcuccaccacgguguccg

SEQ ID NO: 1295914 - RNA, 19 nt, Human
ucacaggcagccaucaugu

SEQ ID NO: 1295915 - RNA, 20 nt, Human
ucagacaccaggucguucau

SEQ ID NO: 1295916 - RNA, 21 nt, Human
ucauguugcucucggccucgg

SEQ ID NO: 1295917 - RNA, 22 nt, Human
ucccagacccaguccccccacc

SEQ ID NO: 1295918 - RNA, 23 nt, Human
ucccagacccaguccccccaccc

SEQ ID NO: 1295919 - RNA, 19 nt, Human
ucccucaugggcaugcgac

SEQ ID NO: 1295920 - RNA, 20 nt, Human
uccgcaggucagcauucagc

SEQ ID NO: 1295921 - RNA, 18 nt, Human
ucggauucggcucccaga

SEQ ID NO: 1295922 - RNA, 19 nt, Human
ugagaaggaggagcagacg

SEQ ID NO: 1295923 - RNA, 21 nt, Human
ugagcugguggacugagaggg

SEQ ID NO: 1295924 - RNA, 19 nt, Human
ugccccggcuggucagugg

SEQ ID NO: 1295925 - RNA, 22 nt, Human
ugcucucggccucggugaauuc

SEQ ID NO: 1295926 - RNA, 22 nt, Human
ugcuguaaacugcucugagaca

SEQ ID NO: 1295927 - RNA, 18 nt, Human
uggcccgggaagcgcagg

SEQ ID NO: 1295928 - RNA, 23 nt, Human
uggcguuguagggcuccaccacg

SEQ ID NO: 1295929 - RNA, 23 nt, Human
uggggaaagcugcucgcuggaga

SEQ ID NO: 1295930 - RNA, 19 nt, Human
uguucauccaccucccuca

SEQ ID NO: 1295931 - RNA, 24 nt, Human
uguuggaaagcucagguguccuug

SEQ ID NO: 1295932 - RNA, 21 nt, Human
uuccacacaggugcacccacc

SEQ ID NO: 1295933 - RNA, 19 nt, Human
uuccacacaggugcacccu

SEQ ID NO: 1295934 - RNA, 21 nt, Human
uuuguucauccaccucccuca

SEQ ID NO: 1295935 - RNA, 22 nt, Human
aaaacuacaacaaagaaaaagu

SEQ ID NO: 1295936 - RNA, 18 nt, Human
aaaagacagcagauacug

SEQ ID NO: 1295937 - RNA, 24 nt, Human
aacuacaacaaagaaaaaguugaa

SEQ ID NO: 1295938 - RNA, 20 nt, Human
aagcuggagaaaagagcuga

SEQ ID NO: 1295939 - RNA, 24 nt, Human
acaaaagacagcagauacugguaa

SEQ ID NO: 1295940 - RNA, 22 nt, Human
acaaaauaauuccucagacaaa

SEQ ID NO: 1295941 - RNA, 24 nt, Human
acgaaguuacaguucucaagugug

SEQ ID NO: 1295942 - RNA, 21 nt, Human
acuccaggacuaaauauggca

SEQ ID NO: 1295943 - RNA, 21 nt, Human
agaacccaaaaugagggccuc

SEQ ID NO: 1295944 - RNA, 19 nt, Human
agauacugguaaaagcuuc

SEQ ID NO: 1295945 - RNA, 18 nt, Human
agauucauuaagugguag

SEQ ID NO: 1295946 - RNA, 24 nt, Human
auaauuacaaaagacagcagauac

SEQ ID NO: 1295947 - RNA, 19 nt, Human
caaaagacagcagauacug

SEQ ID NO: 1295948 - RNA, 20 nt, Human
caaaauaauuccucagacaa

SEQ ID NO: 1295949 - RNA, 22 nt, Human
caaaaugagggccucgcgcucg

SEQ ID NO: 1295950 - RNA, 18 nt, Human
caaacacccagaaauagg

SEQ ID NO: 1295951 - RNA, 19 nt, Human
cacgcuccucuucccccuc

SEQ ID NO: 1295952 - RNA, 24 nt, Human
cacugcaaaagcuggagaaaagag

SEQ ID NO: 1295953 - RNA, 24 nt, Human
cauggaucaaggccauauuuucaa

SEQ ID NO: 1295954 - RNA, 22 nt, Human
ccagccgccgccgcugccgccg

SEQ ID NO: 1295955 - RNA, 23 nt, Human
ccagccgccgccgcugccgccgu

SEQ ID NO: 1295956 - RNA, 22 nt, Human
ccgagagccgccgccgccgccg

SEQ ID NO: 1295957 - RNA, 23 nt, Human
ccgccgccgccgccgcugccugg

SEQ ID NO: 1295958 - RNA, 18 nt, Human
ccgccgccgcugccgccg

SEQ ID NO: 1295959 - RNA, 19 nt, Human
ccgccgccgcugccugggc

SEQ ID NO: 1295960 - RNA, 25 nt, Human
ccgccgcugccugggccucuccccg

SEQ ID NO: 1295961 - RNA, 21 nt, Human
ccucuucccccucucgcucuc

SEQ ID NO: 1295962 - RNA, 21 nt, Human
cgagaagagucaacuuugugu

SEQ ID NO: 1295963 - RNA, 19 nt, Human
cgccgccgccgccgcugcc

SEQ ID NO: 1295964 - RNA, 22 nt, Human
cgccgccgcugccgccguucgc

SEQ ID NO: 1295965 - RNA, 21 nt, Human
cgcuugcacgcuccucuuccc

SEQ ID NO: 1295966 - RNA, 18 nt, Human
cuaguggcugacauucuu

SEQ ID NO: 1295967 - RNA, 18 nt, Human
cucugauuugucuggcua

SEQ ID NO: 1295968 - RNA, 19 nt, Human
cuggugaaauccaccaagc

SEQ ID NO: 1295969 - RNA, 19 nt, Human
gagggccucgcgcucggga

SEQ ID NO: 1295970 - RNA, 21 nt, Human
gccgccgccgccgccgcugcc

SEQ ID NO: 1295971 - RNA, 22 nt, Human
gccgccgccgccgccgcugccu

SEQ ID NO: 1295972 - RNA, 21 nt, Human
gcgcucgggagucggaggaag

SEQ ID NO: 1295973 - RNA, 22 nt, Human
gcuccucuucccccucucgcuc

SEQ ID NO: 1295974 - RNA, 22 nt, Human
gguaaaagcuucaggacagaaa

SEQ ID NO: 1295975 - RNA, 19 nt, Human
uaacuggugaaauccacca

SEQ ID NO: 1295976 - RNA, 19 nt, Human
uaaggaugccaggacacug

SEQ ID NO: 1295977 - RNA, 22 nt, Human
uaauuccucagacaaaugcaca

SEQ ID NO: 1295978 - RNA, 28 nt, Human
uacaccaaacaguuugaagacaagggaa

SEQ ID NO: 1295979 - RNA, 20 nt, Human
uagcaaacaaaauaauuccu

SEQ ID NO: 1295980 - RNA, 23 nt, Human
uagcaaacaaaauaauuccucag

SEQ ID NO: 1295981 - RNA, 21 nt, Human
uaggucucugauccacgcuag

SEQ ID NO: 1295982 - RNA, 21 nt, Human
ucaaagaguuaaugaauccuu

SEQ ID NO: 1295983 - RNA, 23 nt, Human
ucuuugacuuauuaggcauuucc

SEQ ID NO: 1295984 - RNA, 22 nt, Human
ugaagaguauaagggcagaugc

SEQ ID NO: 1295985 - RNA, 23 nt, Human
ugaagcagugugacucuuacauc

SEQ ID NO: 1295986 - RNA, 24 nt, Human
ugaauccuugcauucauucagucu

SEQ ID NO: 1295987 - RNA, 21 nt, Human
ugagaacccaaaaugagggcc

SEQ ID NO: 1295988 - RNA, 20 nt, Human
ugagguacauuuacucaaaa

SEQ ID NO: 1295989 - RNA, 26 nt, Human
uggauagcuguuacucugauuugucu

SEQ ID NO: 1295990 - RNA, 18 nt, Human
uggcaugauuauuuugcu

SEQ ID NO: 1295991 - RNA, 19 nt, Human
uggggggaggagggaagaa

SEQ ID NO: 1295992 - RNA, 23 nt, Human
uggggggaggagggaagaagaau

SEQ ID NO: 1295993 - RNA, 21 nt, Human
ugucaccuuaagcagaaaaga

SEQ ID NO: 1295994 - RNA, 24 nt, Human
uguguuaaaguguucaaagauguc

SEQ ID NO: 1295995 - RNA, 21 nt, Human
uguuuggugaagaguauaagg

SEQ ID NO: 1295996 - RNA, 25 nt, Human
uuaauccauggaucaaggccauauu

SEQ ID NO: 1295997 - RNA, 19 nt, Human
uuacucugauuugucuggc

SEQ ID NO: 1295998 - RNA, 20 nt, Human
uuaguauuuaacaaauucaa

SEQ ID NO: 1295999 - RNA, 20 nt, Human
uucaccgcaacccgagagcc

SEQ ID NO: 1296000 - RNA, 24 nt, Human
uuccuugcccuuuaggucucugau

SEQ ID NO: 1296001 - RNA, 21 nt, Human
uugagauucauuaagugguag

SEQ ID NO: 1296002 - RNA, 21 nt, Human
caccggcggaguccgccuccc

SEQ ID NO: 1296003 - RNA, 19 nt, Human
ccacuagcaacccuccucg

SEQ ID NO: 1296004 - RNA, 23 nt, Human
cccgggacgaugaggcccggucc

SEQ ID NO: 1296005 - RNA, 20 nt, Human
cccuccucgcgagcgguuca

SEQ ID NO: 1296006 - RNA, 21 nt, Human
ccggcggaguccgccuccccc

SEQ ID NO: 1296007 - RNA, 19 nt, Human
cucccgggacgaugaggcc

SEQ ID NO: 1296008 - RNA, 19 nt, Human
gccagcucgcuggucagcg

SEQ ID NO: 1296009 - RNA, 18 nt, Human
gcggaguccgccuccccc

SEQ ID NO: 1296010 - RNA, 22 nt, Human
uccacuagcaacccuccucgcg

SEQ ID NO: 1296011 - RNA, 23 nt, Human
uccacuagcaacccuccucgcga

SEQ ID NO: 1296012 - RNA, 19 nt, Human
ucccgggacgaugaggccc

SEQ ID NO: 1296013 - RNA, 18 nt, Human
aaacgcuccuugcucuuc

SEQ ID NO: 1296014 - RNA, 19 nt, Human
acgaaacauguagagaugc

SEQ ID NO: 1296015 - RNA, 21 nt, Human
agcccugcaucuacacccucc

SEQ ID NO: 1296016 - RNA, 23 nt, Human
augcacaacacgucuuucuggcu

SEQ ID NO: 1296017 - RNA, 25 nt, Human
caacacgucuuucuggcugagacuu

SEQ ID NO: 1296018 - RNA, 22 nt, Human
caccaaaauagaugggcaugac

SEQ ID NO: 1296019 - RNA, 23 nt, Human
caccaaaauagaugggcaugacg

SEQ ID NO: 1296020 - RNA, 25 nt, Human
cagcccugcaucuacacccuccuga

SEQ ID NO: 1296021 - RNA, 23 nt, Human
cagccgcgccccccagccggagg

SEQ ID NO: 1296022 - RNA, 24 nt, Human
ccagaagucuccauccagccuucc

SEQ ID NO: 1296023 - RNA, 21 nt, Human
ccauccagccuuccaguggau

SEQ ID NO: 1296024 - RNA, 22 nt, Human
ccccagccggaggccccuuggg

SEQ ID NO: 1296025 - RNA, 20 nt, Human
cccuccugagcccaccuucc

SEQ ID NO: 1296026 - RNA, 19 nt, Human
cccugcaucuacacccucc

SEQ ID NO: 1296027 - RNA, 20 nt, Human
ccgcgccccccagccggagg

SEQ ID NO: 1296028 - RNA, 19 nt, Human
ccugcaucuacacccuccu

SEQ ID NO: 1296029 - RNA, 18 nt, Human
ccugggagcugcuucuaa

SEQ ID NO: 1296030 - RNA, 23 nt, Human
ccuuuccauuugacuuucccaaa

SEQ ID NO: 1296031 - RNA, 23 nt, Human
cggccagugcucagcacauggua

SEQ ID NO: 1296032 - RNA, 19 nt, Human
cuccgcagccgcgcccccc

SEQ ID NO: 1296033 - RNA, 21 nt, Human
cuggggguuugccuccuucag

SEQ ID NO: 1296034 - RNA, 24 nt, Human
gaacuccgcagccgcgccccccag

SEQ ID NO: 1296035 - RNA, 18 nt, Human
gagcugcuucuaacaccc

SEQ ID NO: 1296036 - RNA, 23 nt, Human
gccuuccaguggauuccugacuc

SEQ ID NO: 1296037 - RNA, 21 nt, Human
gggcagcagacaaugggugug

SEQ ID NO: 1296038 - RNA, 18 nt, Human
gguacagcuccuccucug

SEQ ID NO: 1296039 - RNA, 24 nt, Human
ggugcuggggagggacucacaggg

SEQ ID NO: 1296040 - RNA, 19 nt, Human
guagagaugcugcuggccc

SEQ ID NO: 1296041 - RNA, 20 nt, Human
uagagaugcugcuggcccau

SEQ ID NO: 1296042 - RNA, 24 nt, Human
ucauuccugggagcugcuucuaac

SEQ ID NO: 1296043 - RNA, 19 nt, Human
uccaggacggucccgucuc

SEQ ID NO: 1296044 - RNA, 21 nt, Human
ucuaacaccaccaaaauagau

SEQ ID NO: 1296045 - RNA, 22 nt, Human
ucuuucuggcugagacuucugg

SEQ ID NO: 1296046 - RNA, 18 nt, Human
ugcaaacgcuccuugcuc

SEQ ID NO: 1296047 - RNA, 19 nt, Human
ugccacgaaacauguagag

SEQ ID NO: 1296048 - RNA, 22 nt, Human
uggcuucuggauacucagcccu

SEQ ID NO: 1296049 - RNA, 21 nt, Human
uggggguuugccuccuucagu

SEQ ID NO: 1296050 - RNA, 21 nt, Human
ugguugauaccaugcaaacgc

SEQ ID NO: 1296051 - RNA, 21 nt, Human
ugugcaggugcuggggaggga

SEQ ID NO: 1296052 - RNA, 24 nt, Human
uuccagaagucuccauccagccuu

SEQ ID NO: 1296053 - RNA, 18 nt, Human
uuccuggccuuuccauuu

SEQ ID NO: 1296054 - RNA, 19 nt, Human
uugacuuucccaaacuggg

SEQ ID NO: 1296055 - RNA, 22 nt, Human
uuucccaaacuggguacagcuc

SEQ ID NO: 1296056 - RNA, 21 nt, Human
aaggauucagaggaugaauuc

SEQ ID NO: 1296057 - RNA, 22 nt, Human
cccccugcguccugggccuccg

SEQ ID NO: 1296058 - RNA, 19 nt, Human
ccucccccugcguccuggg

SEQ ID NO: 1296059 - RNA, 21 nt, Human
cugcagggggccagggccggc

SEQ ID NO: 1296060 - RNA, 18 nt, Human
gccacacucuucucuucc

SEQ ID NO: 1296061 - RNA, 19 nt, Human
gcugcagggggccagggcc

SEQ ID NO: 1296062 - RNA, 22 nt, Human
gugcuagauuucuaggaggcca

SEQ ID NO: 1296063 - RNA, 21 nt, Human
uagauuucuaggaggccacac

SEQ ID NO: 1296064 - RNA, 19 nt, Human
uaggaggccacacucuucu

SEQ ID NO: 1296065 - RNA, 20 nt, Human
ucccccugcguccugggccu

SEQ ID NO: 1296066 - RNA, 20 nt, Human
uccucaguuuaccauaacac

SEQ ID NO: 1296067 - RNA, 22 nt, Human
uccugggccuccggggcuccug

SEQ ID NO: 1296068 - RNA, 20 nt, Human
ucuucucuuccuguuccucc

SEQ ID NO: 1296069 - RNA, 23 nt, Human
uuccucccccugcguccugggcc

SEQ ID NO: 1296070 - RNA, 21 nt, Human
aaaaaccaaaacaaaacaaaa

SEQ ID NO: 1296071 - RNA, 25 nt, Human
aaaaaccaaaacaaaacaaaacaaa

SEQ ID NO: 1296072 - RNA, 23 nt, Human
aaaacaaaacaaaacaaaauacc

SEQ ID NO: 1296073 - RNA, 26 nt, Human
aaaaggccagauggcugcagugggca

SEQ ID NO: 1296074 - RNA, 18 nt, Human
aaacaaaacaaaacaaaa

SEQ ID NO: 1296075 - RNA, 24 nt, Human
aaacaaaacaaaacaaaauaccaa

SEQ ID NO: 1296076 - RNA, 19 nt, Human
aaacaagaagcagacgagg

SEQ ID NO: 1296077 - RNA, 23 nt, Human
aaaccaaaacaaaacaaaacaaa

SEQ ID NO: 1296078 - RNA, 24 nt, Human
aaaccaaaacaaaacaaaacaaaa

SEQ ID NO: 1296079 - RNA, 24 nt, Human
aacaaaacaaaauaccaagaacag

SEQ ID NO: 1296080 - RNA, 24 nt, Human
aaccauaacaaaaacuguccuccu

SEQ ID NO: 1296081 - RNA, 24 nt, Human
acaaaacaaaacaaaauaccaaga

SEQ ID NO: 1296082 - RNA, 23 nt, Human
acaagaagcagacgagggggcuc

SEQ ID NO: 1296083 - RNA, 22 nt, Human
acacacuauacuuaaaaggcca

SEQ ID NO: 1296084 - RNA, 20 nt, Human
acaggaacggaagcaccacc

SEQ ID NO: 1296085 - RNA, 21 nt, Human
accacccuucugauggagagc

SEQ ID NO: 1296086 - RNA, 30 nt, Human
accccaccucuauucccuguggccuccaag

SEQ ID NO: 1296087 - RNA, 23 nt, Human
acccccaagggcaugccucuggc

SEQ ID NO: 1296088 - RNA, 21 nt, Human
acccgaccccccaacccuggc

SEQ ID NO: 1296089 - RNA, 21 nt, Human
acccuggcgggaccuuccagg

SEQ ID NO: 1296090 - RNA, 20 nt, Human
acuugauccaugacuuguga

SEQ ID NO: 1296091 - RNA, 19 nt, Human
agaagagucacagagaggc

SEQ ID NO: 1296092 - RNA, 19 nt, Human
agaaggccacauacccggg

SEQ ID NO: 1296093 - RNA, 23 nt, Human
agaaugcuuucacacccaggaac

SEQ ID NO: 1296094 - RNA, 22 nt, Human
agcggucucuucccugaguggc

SEQ ID NO: 1296095 - RNA, 18 nt, Human
aggagguggccugggcag

SEQ ID NO: 1296096 - RNA, 18 nt, Human
aggcagaguccgcagccc

SEQ ID NO: 1296097 - RNA, 23 nt, Human
aggcagcaggggccaggccccuu

SEQ ID NO: 1296098 - RNA, 24 nt, Human
aggcugaaggaggcagaaggccac

SEQ ID NO: 1296099 - RNA, 22 nt, Human
agggccgagacuugagucagaa

SEQ ID NO: 1296100 - RNA, 20 nt, Human
agggggcucaggggggcggg

SEQ ID NO: 1296101 - RNA, 21 nt, Human
auccucaugacaguuuuacac

SEQ ID NO: 1296102 - RNA, 22 nt, Human
augccucuggcuucaugaaccu

SEQ ID NO: 1296103 - RNA, 20 nt, Human
auucccuguggccuccaaaa

SEQ ID NO: 1296104 - RNA, 24 nt, Human
caaaacaaaacaaaacaaaauacc

SEQ ID NO: 1296105 - RNA, 27 nt, Human
caaaacaaaauaccaagaacagaucac

SEQ ID NO: 1296106 - RNA, 21 nt, Human
caaaacaaaauaccaagaacc

SEQ ID NO: 1296107 - RNA, 21 nt, Human
caaaauaccaagaacagauca

SEQ ID NO: 1296108 - RNA, 19 nt, Human
cacacacguacgccagcca

SEQ ID NO: 1296109 - RNA, 21 nt, Human
cacaggaacggaagcaccacc

SEQ ID NO: 1296110 - RNA, 29 nt, Human
cacaugcauucacacacacaugccuggcg

SEQ ID NO: 1296111 - RNA, 19 nt, Human
caccaggcuccucgcuucc

SEQ ID NO: 1296112 - RNA, 18 nt, Human
cacccuucucccgaccaa

SEQ ID NO: 1296113 - RNA, 24 nt, Human
caccucuauucccuguggccucca

SEQ ID NO: 1296114 - RNA, 18 nt, Human
cagaaccuucuggagcag

SEQ ID NO: 1296115 - RNA, 25 nt, Human
cagaaccuucuggagcaguacgcau

SEQ ID NO: 1296116 - RNA, 22 nt, Human
cagacgagggggcucagggggg

SEQ ID NO: 1296117 - RNA, 25 nt, Human
cagaggcccugagcaacaucgggcg

SEQ ID NO: 1296118 - RNA, 20 nt, Human
cagaggcccugagcaacauu

SEQ ID NO: 1296119 - RNA, 28 nt, Human
cagcacgcccacaucaaagguguccccc

SEQ ID NO: 1296120 - RNA, 19 nt, Human
cagcggucucuucccugag

SEQ ID NO: 1296121 - RNA, 20 nt, Human
cagcugggugggcguguggg

SEQ ID NO: 1296122 - RNA, 19 nt, Human
caggaacggaagcaccacc

SEQ ID NO: 1296123 - RNA, 25 nt, Human
caggccccuuccacagcacugccuc

SEQ ID NO: 1296124 - RNA, 20 nt, Human
caggggugggcuggggcccu

SEQ ID NO: 1296125 - RNA, 22 nt, Human
caguggcugcucauggagcugc

SEQ ID NO: 1296126 - RNA, 18 nt, Human
ccacugcagucccaggag

SEQ ID NO: 1296127 - RNA, 21 nt, Human
ccacugcagucccaggaggug

SEQ ID NO: 1296128 - RNA, 19 nt, Human
ccccaagggcaugccucug

SEQ ID NO: 1296129 - RNA, 24 nt, Human
cccccaagggcaugccucuggcuu

SEQ ID NO: 1296130 - RNA, 22 nt, Human
ccccuaaaccauaacaaaaacu

SEQ ID NO: 1296131 - RNA, 20 nt, Human
ccccucacgaugcacauggc

SEQ ID NO: 1296132 - RNA, 18 nt, Human
ccccuggcucugcccagg

SEQ ID NO: 1296133 - RNA, 20 nt, Human
cccgaccccccaacccuggc

SEQ ID NO: 1296134 - RNA, 24 nt, Human
cccgaccccccaacccuggcggga

SEQ ID NO: 1296135 - RNA, 20 nt, Human
ccgcagcccgagggagcuuc

SEQ ID NO: 1296136 - RNA, 22 nt, Human
ccggaaaugcgacacacuauac

SEQ ID NO: 1296137 - RNA, 19 nt, Human
ccucacgaugcacauggcu

SEQ ID NO: 1296138 - RNA, 20 nt, Human
ccucagggccgagacuugag

SEQ ID NO: 1296139 - RNA, 21 nt, Human
ccucaugacaguuuuacacuu

SEQ ID NO: 1296140 - RNA, 19 nt, Human
ccucccucuguacuugauc

SEQ ID NO: 1296141 - RNA, 26 nt, Human
ccuccuuaccccaaaagugcuggagg

SEQ ID NO: 1296142 - RNA, 22 nt, Human
ccucucacccuucucccgacca

SEQ ID NO: 1296143 - RNA, 18 nt, Human
ccucugacuggagacagg

SEQ ID NO: 1296144 - RNA, 19 nt, Human
ccucugccagccacuaccc

SEQ ID NO: 1296145 - RNA, 20 nt, Human
ccucugccagccacuacccc

SEQ ID NO: 1296146 - RNA, 19 nt, Human
ccucuggcuucaugaaccu

SEQ ID NO: 1296147 - RNA, 22 nt, Human
ccugggacuucauaaaccaucc

SEQ ID NO: 1296148 - RNA, 22 nt, Human
cgaccaacccccaagggcaugc

SEQ ID NO: 1296149 - RNA, 20 nt, Human
cgaggaaacugaggcugaag

SEQ ID NO: 1296150 - RNA, 22 nt, Human
cgcaggggugggcuggggcccu

SEQ ID NO: 1296151 - RNA, 20 nt, Human
cggcggaggacacacagcug

SEQ ID NO: 1296152 - RNA, 22 nt, Human
cuaaugcucagacccaggaggc

SEQ ID NO: 1296153 - RNA, 26 nt, Human
cucacccuucucccgaccaaccccca

SEQ ID NO: 1296154 - RNA, 22 nt, Human
cuccccagaucucugagugcuc

SEQ ID NO: 1296155 - RNA, 21 nt, Human
cuccgaaccaagggagagcuc

SEQ ID NO: 1296156 - RNA, 24 nt, Human
cuccgaaccaagggagagcucucc

SEQ ID NO: 1296157 - RNA, 21 nt, Human
cucugcccagggacaccccuc

SEQ ID NO: 1296158 - RNA, 23 nt, Human
cucuucccagaggcccugagcaa

SEQ ID NO: 1296159 - RNA, 22 nt, Human
cugauuauccccuauuugcacg

SEQ ID NO: 1296160 - RNA, 21 nt, Human
cugcccacccccgccgagcug

SEQ ID NO: 1296161 - RNA, 27 nt, Human
cugggugggcgugugggagugcagggg

SEQ ID NO: 1296162 - RNA, 19 nt, Human
cuuagaguccccacugcag

SEQ ID NO: 1296163 - RNA, 18 nt, Human
cuucacacugggcugcua

SEQ ID NO: 1296164 - RNA, 29 nt, Human
cuugauccaugacuugugaguugaacgcg

SEQ ID NO: 1296165 - RNA, 19 nt, Human
gaaaauuuccccuaaacca

SEQ ID NO: 1296166 - RNA, 25 nt, Human
gaaaauuuccccuaaaccauaacaa

SEQ ID NO: 1296167 - RNA, 23 nt, Human
gaacggaagcaccaccccaccuc

SEQ ID NO: 1296168 - RNA, 22 nt, Human
gaccugcagggcccacaccacc

SEQ ID NO: 1296169 - RNA, 19 nt, Human
gagguggccugggcaggca

SEQ ID NO: 1296170 - RNA, 26 nt, Human
gcagacauuagcagcagagcugcacc

SEQ ID NO: 1296171 - RNA, 23 nt, Human
ggacaccccucuccugguucuaa

SEQ ID NO: 1296172 - RNA, 18 nt, Human
ggccagauggcugcaggc

SEQ ID NO: 1296173 - RNA, 22 nt, Human
ggcgugugggagugcaggugug

SEQ ID NO: 1296174 - RNA, 21 nt, Human
gggcccacaccacccuucuga

SEQ ID NO: 1296175 - RNA, 21 nt, Human
ggggagaaucgcaggcagcag

SEQ ID NO: 1296176 - RNA, 18 nt, Human
gguaggaccugcagggcc

SEQ ID NO: 1296177 - RNA, 19 nt, Human
guaugcgcacacacguacg

SEQ ID NO: 1296178 - RNA, 18 nt, Human
uacccggggagaaucgca

SEQ ID NO: 1296179 - RNA, 20 nt, Human
uagaguccccacugcagucc

SEQ ID NO: 1296180 - RNA, 20 nt, Human
uauccccuauuugcacguuc

SEQ ID NO: 1296181 - RNA, 26 nt, Human
uaugcgcacacacguacgccagccaa

SEQ ID NO: 1296182 - RNA, 24 nt, Human
uauucccuguggccuccaaaagag

SEQ ID NO: 1296183 - RNA, 19 nt, Human
ucaaggccgagggguagga

SEQ ID NO: 1296184 - RNA, 18 nt, Human
ucacuugccauggacauc

SEQ ID NO: 1296185 - RNA, 19 nt, Human
ucagaggguggagguccuc

SEQ ID NO: 1296186 - RNA, 22 nt, Human
ucaugaaaauuuccccuaaacc

SEQ ID NO: 1296187 - RNA, 26 nt, Human
uccaaaagagcugggcaaccucugcc

SEQ ID NO: 1296188 - RNA, 28 nt, Human
ucccaccuucagacccuccuccuccccc

SEQ ID NO: 1296189 - RNA, 20 nt, Human
ucccagaggcccugagcaag

SEQ ID NO: 1296190 - RNA, 19 nt, Human
uccccagaucucugagugc

SEQ ID NO: 1296191 - RNA, 22 nt, Human
uccccucugcaccuggugagga

SEQ ID NO: 1296192 - RNA, 20 nt, Human
ucccuccuggacauggaaac

SEQ ID NO: 1296193 - RNA, 20 nt, Human
ucccucugacuggagacagg

SEQ ID NO: 1296194 - RNA, 18 nt, Human
ucccucuguacuugaucc

SEQ ID NO: 1296195 - RNA, 21 nt, Human
ucccugaguggcagguguggu

SEQ ID NO: 1296196 - RNA, 23 nt, Human
ucccugaguggcagguguggucc

SEQ ID NO: 1296197 - RNA, 18 nt, Human
uccgaaccaagggagagc

SEQ ID NO: 1296198 - RNA, 26 nt, Human
uccgcagcccgagggagcuucaaggc

SEQ ID NO: 1296199 - RNA, 25 nt, Human
uccucgcuuccuccccagaucucug

SEQ ID NO: 1296200 - RNA, 23 nt, Human
ucuauucccuguggccuccaaaa

SEQ ID NO: 1296201 - RNA, 29 nt, Human
ucucacccuucucccgaccaacccccaag

SEQ ID NO: 1296202 - RNA, 23 nt, Human
ucuccguccugagcucgcugccc

SEQ ID NO: 1296203 - RNA, 23 nt, Human
ucugcccagggacaccccucucc

SEQ ID NO: 1296204 - RNA, 18 nt, Human
ucuggagcaguacgcauu

SEQ ID NO: 1296205 - RNA, 23 nt, Human
ucuggcuucaugaaccuucgggg

SEQ ID NO: 1296206 - RNA, 19 nt, Human
ugagcaacaucgggcgacg

SEQ ID NO: 1296207 - RNA, 22 nt, Human
ugaguucugaguccucagggcc

SEQ ID NO: 1296208 - RNA, 21 nt, Human
ugcaccccuggcucugcccag

SEQ ID NO: 1296209 - RNA, 24 nt, Human
ugccccacaucuauuucugccaaa

SEQ ID NO: 1296210 - RNA, 27 nt, Human
ugcccugcccacccccgccgagcuuca

SEQ ID NO: 1296211 - RNA, 22 nt, Human
ugccuggcgggaucgcagagga

SEQ ID NO: 1296212 - RNA, 24 nt, Human
ugccuggcgggaucgcagaggaug

SEQ ID NO: 1296213 - RNA, 19 nt, Human
ugcucauggagcugcccuc

SEQ ID NO: 1296214 - RNA, 22 nt, Human
uggaaaacugaaaggucagagg

SEQ ID NO: 1296215 - RNA, 23 nt, Human
uggaggaaagaugguugcaugac

SEQ ID NO: 1296216 - RNA, 19 nt, Human
uggcaggagugggcagaag

SEQ ID NO: 1296217 - RNA, 21 nt, Human
uggcaggagugggcagaaugg

SEQ ID NO: 1296218 - RNA, 21 nt, Human
uggcagguguggucccuggga

SEQ ID NO: 1296219 - RNA, 20 nt, Human
uggccuccaaaagagcuggg

SEQ ID NO: 1296220 - RNA, 21 nt, Human
uggcgggaccuuccagggcug

SEQ ID NO: 1296221 - RNA, 18 nt, Human
uggcuagcagagcucaug

SEQ ID NO: 1296222 - RNA, 19 nt, Human
ugggcaaccucugccagcc

SEQ ID NO: 1296223 - RNA, 20 nt, Human
ugggcaggcaggcaucauug

SEQ ID NO: 1296224 - RNA, 24 nt, Human
ugucagcagacauuagcagcagag

SEQ ID NO: 1296225 - RNA, 26 nt, Human
uuugcacaugcauucacacacacaug

SEQ ID NO: 1296226 - RNA, 24 nt, Human
aggccgaggcgggaggaucacuug

SEQ ID NO: 1296227 - RNA, 22 nt, Human
aggccgggcacaguggcucacg

SEQ ID NO: 1296228 - RNA, 18 nt, Human
aggcgggaggaucacuug

SEQ ID NO: 1296229 - RNA, 19 nt, Human
aggcgggaggaucacuuga

SEQ ID NO: 1296230 - RNA, 24 nt, Human
aguggcucacgccuguaauuccag

SEQ ID NO: 1296231 - RNA, 24 nt, Human
cacgccuguaauuccagcacuucg

SEQ ID NO: 1296232 - RNA, 24 nt, Human
cagcacuucgggaggccgaggcgg

SEQ ID NO: 1296233 - RNA, 22 nt, Human
ccuguaauuccagcacuucggg

SEQ ID NO: 1296234 - RNA, 23 nt, Human
cgccuguaauuccagcacuucgg

SEQ ID NO: 1296235 - RNA, 24 nt, Human
cucacgccuguaauuccagcacuu

SEQ ID NO: 1296236 - RNA, 23 nt, Human
gggaggccgaggcgggaggauca

SEQ ID NO: 1296237 - RNA, 18 nt, Human
gggcacaguggcucacgc

SEQ ID NO: 1296238 - RNA, 24 nt, Human
gggcacaguggcucacgccuguaa

SEQ ID NO: 1296239 - RNA, 22 nt, Human
ucacgccuguaauuccagcacu

SEQ ID NO: 1296240 - RNA, 22 nt, Human
uggcucacgccuguaauuccag

SEQ ID NO: 1296241 - RNA, 24 nt, Human
uggcucacgccuguaauuccagca

SEQ ID NO: 1296242 - RNA, 20 nt, Human
aaaaaagaacauagaaacac

SEQ ID NO: 1296243 - RNA, 18 nt, Human
aaaaggccacaaucugaa

SEQ ID NO: 1296244 - RNA, 26 nt, Human
aaaaggccacaaucugaaaacaaaug

SEQ ID NO: 1296245 - RNA, 21 nt, Human
aaccauaaaguugcaaugggg

SEQ ID NO: 1296246 - RNA, 18 nt, Human
aagaacauagaaacacca

SEQ ID NO: 1296247 - RNA, 21 nt, Human
aagaagaguuaauacuaaaau

SEQ ID NO: 1296248 - RNA, 22 nt, Human
aagcuacaaauuauuuaaaauu

SEQ ID NO: 1296249 - RNA, 20 nt, Human
aagucauuaaagugcuucuc

SEQ ID NO: 1296250 - RNA, 21 nt, Human
aagugcuucucaacaaauucu

SEQ ID NO: 1296251 - RNA, 20 nt, Human
acaaucugaaaacaaauggc

SEQ ID NO: 1296252 - RNA, 22 nt, Human
acgcagcuucauggacaugcgg

SEQ ID NO: 1296253 - RNA, 26 nt, Human
acugcugggcugcuugucuccuuagg

SEQ ID NO: 1296254 - RNA, 22 nt, Human
agaauaaaacucccccugcccu

SEQ ID NO: 1296255 - RNA, 20 nt, Human
agaaucucuggguaggagcc

SEQ ID NO: 1296256 - RNA, 20 nt, Human
agacauuggagaggccaggu

SEQ ID NO: 1296257 - RNA, 18 nt, Human
aggccacaaucugaaaac

SEQ ID NO: 1296258 - RNA, 20 nt, Human
auaaaacucccccugcccuc

SEQ ID NO: 1296259 - RNA, 20 nt, Human
aucuucuucaucucuuauug

SEQ ID NO: 1296260 - RNA, 24 nt, Human
auggacaugcggcuuuugcuaguu

SEQ ID NO: 1296261 - RNA, 20 nt, Human
caacaaauucuuuuucuucu

SEQ ID NO: 1296262 - RNA, 19 nt, Human
cacagccaagaaaugagac

SEQ ID NO: 1296263 - RNA, 24 nt, Human
caccugcacagccaagaaaugaga

SEQ ID NO: 1296264 - RNA, 22 nt, Human
cagccaauaauaaaaggccaca

SEQ ID NO: 1296265 - RNA, 26 nt, Human
cagugauaccacuugaaaugcaaaac

SEQ ID NO: 1296266 - RNA, 18 nt, Human
ccuucagauaaacagaac

SEQ ID NO: 1296267 - RNA, 20 nt, Human
cuaaagaccauuuauuuuga

SEQ ID NO: 1296268 - RNA, 20 nt, Human
cugaaaacaaauggcauuua

SEQ ID NO: 1296269 - RNA, 22 nt, Human
cugugggaguuucacuggguag

SEQ ID NO: 1296270 - RNA, 24 nt, Human
cuucauggacaugcggcuuuugcu

SEQ ID NO: 1296271 - RNA, 22 nt, Human
gaaaggguuaacccuauguucg

SEQ ID NO: 1296272 - RNA, 19 nt, Human
gacauuggagaggccaggu

SEQ ID NO: 1296273 - RNA, 23 nt, Human
gcuugucuccuuaggauuuauug

SEQ ID NO: 1296274 - RNA, 19 nt, Human
guagaauaaaacucccccu

SEQ ID NO: 1296275 - RNA, 19 nt, Human
uaaaacucccccugcccuc

SEQ ID NO: 1296276 - RNA, 21 nt, Human
uaaaaggccacaaucugaaaa

SEQ ID NO: 1296277 - RNA, 23 nt, Human
uaaaaggccacaaucugaaaaca

SEQ ID NO: 1296278 - RNA, 22 nt, Human
uagaauaaaacucccccugccc

SEQ ID NO: 1296279 - RNA, 23 nt, Human
uauaacauggcaucaccugcaca

SEQ ID NO: 1296280 - RNA, 18 nt, Human
ucacuggguagaaucucu

SEQ ID NO: 1296281 - RNA, 18 nt, Human
ucucuguaagcauucagg

SEQ ID NO: 1296282 - RNA, 19 nt, Human
ucucuguaagcauucagga

SEQ ID NO: 1296283 - RNA, 22 nt, Human
ugaaacaauaaauaacuuaaau

SEQ ID NO: 1296284 - RNA, 25 nt, Human
ugaaacaauaaauaacuuaaaucuu

SEQ ID NO: 1296285 - RNA, 24 nt, Human
ugaaggccugaaaggguuaacccu

SEQ ID NO: 1296286 - RNA, 19 nt, Human
ugagaugcuaaagaccauu

SEQ ID NO: 1296287 - RNA, 19 nt, Human
ugcacacagguuguggagc

SEQ ID NO: 1296288 - RNA, 19 nt, Human
ugcuuugggaagaagaguu

SEQ ID NO: 1296289 - RNA, 21 nt, Human
uggauauaacauggcaucacc

SEQ ID NO: 1296290 - RNA, 18 nt, Human
uggcugagccagaggaac

SEQ ID NO: 1296291 - RNA, 23 nt, Human
uggcugagccagaggaacgacgc

SEQ ID NO: 1296292 - RNA, 20 nt, Human
uggguagaaucucuggguag

SEQ ID NO: 1296293 - RNA, 21 nt, Human
uguagaauaaaacuccccccu

SEQ ID NO: 1296294 - RNA, 28 nt, Human
uguagaauaaaacucccccugcccucaa

SEQ ID NO: 1296295 - RNA, 19 nt, Human
uguuauggcagacaugaag

SEQ ID NO: 1296296 - RNA, 23 nt, Human
uuaagcuacaaauuauuuaaaau

SEQ ID NO: 1296297 - RNA, 22 nt, Human
uuaauacuaaaaugauuucagu

SEQ ID NO: 1296298 - RNA, 21 nt, Human
uucaggacuaguaacacccaa

SEQ ID NO: 1296299 - RNA, 18 nt, Human
uucuguguauuaacaggu

SEQ ID NO: 1296300 - RNA, 22 nt, Human
uugcuguaacuuuacaaaugcu

SEQ ID NO: 1296301 - RNA, 22 nt, Human
uugguacaguuucucuaaaucu

SEQ ID NO: 1296302 - RNA, 23 nt, Human
agugcaguggcuugggaaccucc

SEQ ID NO: 1296303 - RNA, 20 nt, Human
cggccugcagagcccuccuc

SEQ ID NO: 1296304 - RNA, 22 nt, Human
guggcuugggaaccucccguuc

SEQ ID NO: 1296305 - RNA, 19 nt, Human
ugcagagcccuccuccuac

SEQ ID NO: 1296306 - RNA, 18 nt, Human
aaggaaccgggagacugg

SEQ ID NO: 1296307 - RNA, 23 nt, Human
aagugcuucccggcgucuaaucc

SEQ ID NO: 1296308 - RNA, 18 nt, Human
accagagucagcucuguc

SEQ ID NO: 1296309 - RNA, 18 nt, Human
acccgcggcgcuccgcuc

SEQ ID NO: 1296310 - RNA, 21 nt, Human
agagggaggauggagcauggu

SEQ ID NO: 1296311 - RNA, 22 nt, Human
agccaggcccucagugcaagcc

SEQ ID NO: 1296312 - RNA, 19 nt, Human
aggcaguuaccuucagccu

SEQ ID NO: 1296313 - RNA, 20 nt, Human
agggaggauggagcauggug

SEQ ID NO: 1296314 - RNA, 25 nt, Human
auccucgcuguuccccccuccaccg

SEQ ID NO: 1296315 - RNA, 18 nt, Human
auggagcauggugaagca

SEQ ID NO: 1296316 - RNA, 22 nt, Human
caacaaggucagcuggccccuu

SEQ ID NO: 1296317 - RNA, 23 nt, Human
caaccuugccaggaagucagaga

SEQ ID NO: 1296318 - RNA, 19 nt, Human
cacacauagccacacaugg

SEQ ID NO: 1296319 - RNA, 18 nt, Human
cacuucuguuucucucug

SEQ ID NO: 1296320 - RNA, 21 nt, Human
ccaaccccucuugccacuguc

SEQ ID NO: 1296321 - RNA, 19 nt, Human
ccacagcuuucuggagugg

SEQ ID NO: 1296322 - RNA, 18 nt, Human
cccccuccaccggcgccc

SEQ ID NO: 1296323 - RNA, 28 nt, Human
ccccucuugccacugucgucccauugac

SEQ ID NO: 1296324 - RNA, 18 nt, Human
cccuaaggcuuccucuuc

SEQ ID NO: 1296325 - RNA, 23 nt, Human
cccuucacacggucacacauagc

SEQ ID NO: 1296326 - RNA, 18 nt, Human
ccggccaacaaggucagc

SEQ ID NO: 1296327 - RNA, 18 nt, Human
ccucagcacuucuguuuc

SEQ ID NO: 1296328 - RNA, 25 nt, Human
ccuccuauggauaaauauucgaggc

SEQ ID NO: 1296329 - RNA, 21 nt, Human
ccucgaaaggauggaagcagg

SEQ ID NO: 1296330 - RNA, 21 nt, Human
ccugggaugagaugugcacgc

SEQ ID NO: 1296331 - RNA, 23 nt, Human
ccuuuuuggcagccccagcccug

SEQ ID NO: 1296332 - RNA, 23 nt, Human
cucggcagcuccucucucccucc

SEQ ID NO: 1296333 - RNA, 19 nt, Human
cuggccccuuccuagcugg

SEQ ID NO: 1296334 - RNA, 23 nt, Human
cuggcuuuggaacagucugggca

SEQ ID NO: 1296335 - RNA, 23 nt, Human
gagcauggugaagcacagguggc

SEQ ID NO: 1296336 - RNA, 22 nt, Human
gagugaagcaggaaggaaccgg

SEQ ID NO: 1296337 - RNA, 19 nt, Human
gcagcuccucucucccucc

SEQ ID NO: 1296338 - RNA, 24 nt, Human
gcaggaaggaaccgggagacugga

SEQ ID NO: 1296339 - RNA, 21 nt, Human
ggaagagagggaggauggagc

SEQ ID NO: 1296340 - RNA, 18 nt, Human
ggagcauggugaagcaca

SEQ ID NO: 1296341 - RNA, 21 nt, Human
ggcagccccagcccuggcuuu

SEQ ID NO: 1296342 - RNA, 24 nt, Human
gguggaagagagggaggauggagc

SEQ ID NO: 1296343 - RNA, 18 nt, Human
gugaagcacagguggccu

SEQ ID NO: 1296344 - RNA, 23 nt, Human
uacaauaaagaccccuaaggcuu

SEQ ID NO: 1296345 - RNA, 19 nt, Human
uauuucacagaauggugac

SEQ ID NO: 1296346 - RNA, 19 nt, Human
ucccuccugggaugagaug

SEQ ID NO: 1296347 - RNA, 21 nt, Human
uccucgcuguuccccccucca

SEQ ID NO: 1296348 - RNA, 21 nt, Human
ucgaaaggauggaagcagggc

SEQ ID NO: 1296349 - RNA, 18 nt, Human
ugagaugugcacgcgaug

SEQ ID NO: 1296350 - RNA, 19 nt, Human
ugcagccagucugcuuucu

SEQ ID NO: 1296351 - RNA, 26 nt, Human
ugcuugugggggaugucagcaguggg

SEQ ID NO: 1296352 - RNA, 20 nt, Human
uggaagagagggaggaugga

SEQ ID NO: 1296353 - RNA, 19 nt, Human
uggccuuuuuggcagcccc

SEQ ID NO: 1296354 - RNA, 18 nt, Human
uggggaggagugaagcag

SEQ ID NO: 1296355 - RNA, 18 nt, Human
uggggaggagugaagcag

SEQ ID NO: 1296356 - RNA, 19 nt, Human
uggggagguggaagagagg

SEQ ID NO: 1296357 - RNA, 20 nt, Human
ugucuucugucccugcagcc

SEQ ID NO: 1296358 - RNA, 24 nt, Human
uguuccccccuccaccggcgccca

SEQ ID NO: 1296359 - RNA, 21 nt, Human
uucacacggucacacauagcc

SEQ ID NO: 1296360 - RNA, 19 nt, Human
uucccggcgucuaauccuc

SEQ ID NO: 1296361 - RNA, 20 nt, Human
uuggcagccccagcccuggc

SEQ ID NO: 1296362 - RNA, 22 nt, Human
uuuuuggcagccccagcccugg

SEQ ID NO: 1296363 - RNA, 22 nt, Human
ccagcaacagcucugacaaccc

SEQ ID NO: 1296364 - RNA, 18 nt, Human
aguaaacugaguucaugu

SEQ ID NO: 1296365 - RNA, 19 nt, Human
ugaaguaaacugaguucau

SEQ ID NO: 1296366 - RNA, 24 nt, Human
ugaaguaaacugaguucaugugaa

SEQ ID NO: 1296367 - RNA, 24 nt, Human
aagcaaaagcuauuucuaccaaag

SEQ ID NO: 1296368 - RNA, 22 nt, Human
acuuaauauaaagcaaaagcua

SEQ ID NO: 1296369 - RNA, 24 nt, Human
auaaagauaaaauaugccauaaua

SEQ ID NO: 1296370 - RNA, 18 nt, Human
caaaggacauugauaaac

SEQ ID NO: 1296371 - RNA, 21 nt, Human
caaauagagagaauauauaug

SEQ ID NO: 1296372 - RNA, 24 nt, Human
caauacauaaagauaaaauaugcc

SEQ ID NO: 1296373 - RNA, 31 nt, Human
cagaugaaucucucucugccuccaaaauccu

SEQ ID NO: 1296374 - RNA, 22 nt, Human
cauaaagauaaaauaugccaua

SEQ ID NO: 1296375 - RNA, 25 nt, Human
ccaucacuugucuaaauuuuacuca

SEQ ID NO: 1296376 - RNA, 24 nt, Human
ccuccaaaauccucagucaugcag

SEQ ID NO: 1296377 - RNA, 19 nt, Human
cgagauagccccucacuga

SEQ ID NO: 1296378 - RNA, 21 nt, Human
cgggccuccgcgucuccagga

SEQ ID NO: 1296379 - RNA, 19 nt, Human
cucaaaauuggagaguugg

SEQ ID NO: 1296380 - RNA, 24 nt, Human
cuccccaauuaaggugucucucuu

SEQ ID NO: 1296381 - RNA, 22 nt, Human
cucccgagcaagucuuucccua

SEQ ID NO: 1296382 - RNA, 23 nt, Human
cucugcaauucuuccucucccca

SEQ ID NO: 1296383 - RNA, 21 nt, Human
gaagagacucgcgcuaccuuu

SEQ ID NO: 1296384 - RNA, 18 nt, Human
gcaguaugaauaauuaac

SEQ ID NO: 1296385 - RNA, 22 nt, Human
ggagaguuggauuccagaccaa

SEQ ID NO: 1296386 - RNA, 18 nt, Human
gggccuccgcgucuccag

SEQ ID NO: 1296387 - RNA, 18 nt, Human
ggugagcgcgcugaaggc

SEQ ID NO: 1296388 - RNA, 21 nt, Human
uaaagcaaaagcuauuucuac

SEQ ID NO: 1296389 - RNA, 22 nt, Human
uaagagcaaagcauucuggaca

SEQ ID NO: 1296390 - RNA, 22 nt, Human
uagaccuccauugguguuccaa

SEQ ID NO: 1296391 - RNA, 20 nt, Human
uagcagacagauuuuuaaac

SEQ ID NO: 1296392 - RNA, 19 nt, Human
uauuaaacugaaauucugu

SEQ ID NO: 1296393 - RNA, 27 nt, Human
uccagaccaagacacugucacuagagc

SEQ ID NO: 1296394 - RNA, 20 nt, Human
ucccuuaaaaucccuuagac

SEQ ID NO: 1296395 - RNA, 22 nt, Human
ucccuuaaaaucccuuagacuc

SEQ ID NO: 1296396 - RNA, 18 nt, Human
ucccuuagacuugcuccc

SEQ ID NO: 1296397 - RNA, 21 nt, Human
ucccuuagacuugcucccgag

SEQ ID NO: 1296398 - RNA, 23 nt, Human
ucugcaauucuuccucuccccaa

SEQ ID NO: 1296399 - RNA, 21 nt, Human
ugaagaagccuccuacaagga

SEQ ID NO: 1296400 - RNA, 20 nt, Human
ugaauuagaagaguauauca

SEQ ID NO: 1296401 - RNA, 19 nt, Human
ugauugaaagcuguuugau

SEQ ID NO: 1296402 - RNA, 19 nt, Human
uggacgcggugagcgcgcu

SEQ ID NO: 1296403 - RNA, 24 nt, Human
uggugugggagaugugccaagugg

SEQ ID NO: 1296404 - RNA, 22 nt, Human
ugucaaauaaagcgaagguuuc

SEQ ID NO: 1296405 - RNA, 19 nt, Human
ugucacuagagcucccuag

SEQ ID NO: 1296406 - RNA, 18 nt, Human
uuaaacugaaauucuguc

SEQ ID NO: 1296407 - RNA, 21 nt, Human
aagagggacuuguauucgaug

SEQ ID NO: 1296408 - RNA, 25 nt, Human
aagcagagccgggcaacuucaggaa

SEQ ID NO: 1296409 - RNA, 24 nt, Human
agauguuaggaagguacacaagcc

SEQ ID NO: 1296410 - RNA, 21 nt, Human
agccuggcaccaaacagccuu

SEQ ID NO: 1296411 - RNA, 21 nt, Human
aguaaaacaaggcucuucuga

SEQ ID NO: 1296412 - RNA, 19 nt, Human
caaaggauuggcuauaauc

SEQ ID NO: 1296413 - RNA, 26 nt, Human
caaggcucuucugacguccuuuggag

SEQ ID NO: 1296414 - RNA, 27 nt, Human
caccgcaacucgccucagauccuccca

SEQ ID NO: 1296415 - RNA, 18 nt, Human
cagaccacagaaaccauc

SEQ ID NO: 1296416 - RNA, 22 nt, Human
cagaccacagaaaccauccgua

SEQ ID NO: 1296417 - RNA, 24 nt, Human
cagaccacagaaaccauccguaaa

SEQ ID NO: 1296418 - RNA, 20 nt, Human
cagcaauaaagaacccuaau

SEQ ID NO: 1296419 - RNA, 18 nt, Human
ccucacuuguggaggugg

SEQ ID NO: 1296420 - RNA, 19 nt, Human
ccucacuuguggaggugga

SEQ ID NO: 1296421 - RNA, 23 nt, Human
cgggcaacuucaggaaagcucau

SEQ ID NO: 1296422 - RNA, 19 nt, Human
cucaggaaugaacacauca

SEQ ID NO: 1296423 - RNA, 21 nt, Human
cuucugcuuuugcagccacag

SEQ ID NO: 1296424 - RNA, 25 nt, Human
gagcacccucauaauguuggaaaua

SEQ ID NO: 1296425 - RNA, 20 nt, Human
gccacaguuuguaauuagcu

SEQ ID NO: 1296426 - RNA, 19 nt, Human
gugcugccggcuucugcuu

SEQ ID NO: 1296427 - RNA, 20 nt, Human
uaaaacaaggcucuucugac

SEQ ID NO: 1296428 - RNA, 19 nt, Human
uagagagcacccucauaau

SEQ ID NO: 1296429 - RNA, 18 nt, Human
ucagaccacagaaaccau

SEQ ID NO: 1296430 - RNA, 21 nt, Human
ucaggaaugaacacaucauca

SEQ ID NO: 1296431 - RNA, 20 nt, Human
ucaucagagagacguugggu

SEQ ID NO: 1296432 - RNA, 20 nt, Human
uccacaaauagagauguuag

SEQ ID NO: 1296433 - RNA, 18 nt, Human
ucuuuggcagauaaaccu

SEQ ID NO: 1296434 - RNA, 20 nt, Human
ugacguccuuuggaguuuca

SEQ ID NO: 1296435 - RNA, 21 nt, Human
uggagguggauuuaguaucag

SEQ ID NO: 1296436 - RNA, 24 nt, Human
uguaauuagcucaggaaugaacac

SEQ ID NO: 1296437 - RNA, 20 nt, Human
uuuuaauucagcaaagcagg

SEQ ID NO: 1296438 - RNA, 22 nt, Human
acggauuuggucguauuaggcg

SEQ ID NO: 1296439 - RNA, 26 nt, Human
aucaaugaccccuucauugaccucaa

SEQ ID NO: 1296440 - RNA, 22 nt, Human
aucaucucugcccccucugcug

SEQ ID NO: 1296441 - RNA, 24 nt, Human
auuguugccaucaaugaccccuuc

SEQ ID NO: 1296442 - RNA, 27 nt, Human
caacaaccucaagaucgucagcaaugc

SEQ ID NO: 1296443 - RNA, 21 nt, Human
caaggagugggacuccuggac

SEQ ID NO: 1296444 - RNA, 19 nt, Human
cacccauggcaaauuccau

SEQ ID NO: 1296445 - RNA, 23 nt, Human
cacccccuccuccaccaccacgg

SEQ ID NO: 1296446 - RNA, 19 nt, Human
cacccccuccuccaccuuc

SEQ ID NO: 1296447 - RNA, 19 nt, Human
cacccccuccuccaccuuc

SEQ ID NO: 1296448 - RNA, 25 nt, Human
cacccccuccuccaccuucaaugcu

SEQ ID NO: 1296449 - RNA, 23 nt, Human
cauggcccacauggccuccaagg

SEQ ID NO: 1296450 - RNA, 18 nt, Human
cauguagaaggcuggggc

SEQ ID NO: 1296451 - RNA, 19 nt, Human
cccccuccuccaccuucaa

SEQ ID NO: 1296452 - RNA, 19 nt, Human
ccuccaccuucaaugcugg

SEQ ID NO: 1296453 - RNA, 23 nt, Human
ccuccgauuucaacagugacacc

SEQ ID NO: 1296454 - RNA, 22 nt, Human
cucaacgaccacuuuguaauga

SEQ ID NO: 1296455 - RNA, 19 nt, Human
cuccagcgagagcacaagg

SEQ ID NO: 1296456 - RNA, 21 nt, Human
cuccuggaccaccaacuccag

SEQ ID NO: 1296457 - RNA, 23 nt, Human
cugagcaccagguggucuccucc

SEQ ID NO: 1296458 - RNA, 21 nt, Human
cugcccccucugcugaugccc

SEQ ID NO: 1296459 - RNA, 22 nt, Human
cugcccccucugcugaugcccc

SEQ ID NO: 1296460 - RNA, 24 nt, Human
cuggugcugaguacgucguggagu

SEQ ID NO: 1296461 - RNA, 21 nt, Human
cuucaaugcuggggcuggcau

SEQ ID NO: 1296462 - RNA, 26 nt, Human
gaccacuuuguaaugaauuuggcuac

SEQ ID NO: 1296463 - RNA, 23 nt, Human
gaccucauggcccacauggccuc

SEQ ID NO: 1296464 - RNA, 18 nt, Human
gcaggggggagccaaaag

SEQ ID NO: 1296465 - RNA, 19 nt, Human
gcccacauggccuccaagg

SEQ ID NO: 1296466 - RNA, 24 nt, Human
gcucauuugcaggggggagccaaa

SEQ ID NO: 1296467 - RNA, 24 nt, Human
uaaaguggauauuguugccaucaa

SEQ ID NO: 1296468 - RNA, 23 nt, Human
uagaaggcuggggcucauuugcc

SEQ ID NO: 1296469 - RNA, 24 nt, Human
ucaagaucgucagcaaugccuccu

SEQ ID NO: 1296470 - RNA, 22 nt, Human
ucaaugaccccuucauugaccu

SEQ ID NO: 1296471 - RNA, 19 nt, Human
uccgauuucaacagugaca

SEQ ID NO: 1296472 - RNA, 23 nt, Human
ugaaggucggagucaacggauuu

SEQ ID NO: 1296473 - RNA, 19 nt, Human
ugaccccuucauugaccuc

SEQ ID NO: 1296474 - RNA, 24 nt, Human
ugagaacgggaaauuugucaucaa

SEQ ID NO: 1296475 - RNA, 24 nt, Human
uggccuccaaggagugggacuccu

SEQ ID NO: 1296476 - RNA, 20 nt, Human
uggcgucuucaccaccaugu

SEQ ID NO: 1296477 - RNA, 24 nt, Human
uggugcugaguacgucguggaguc

SEQ ID NO: 1296478 - RNA, 22 nt, Human
uguugccaucaaugaccccuuc

SEQ ID NO: 1296479 - RNA, 23 nt, Human
uuccaguaugauuccacccaugg

SEQ ID NO: 1296480 - RNA, 19 nt, Human
uuccugccacacucagucc

SEQ ID NO: 1296481 - RNA, 28 nt, Human
aaaaaagaauuccucuaaucaugucacc

SEQ ID NO: 1296482 - RNA, 24 nt, Human
aaaaaagccaaaacugacaaacac

SEQ ID NO: 1296483 - RNA, 18 nt, Human
aaaaagacauacaaucua

SEQ ID NO: 1296484 - RNA, 25 nt, Human
aaaaagacauacaaucuaacacaga

SEQ ID NO: 1296485 - RNA, 24 nt, Human
aaaaauuaaccauauuuugucccu

SEQ ID NO: 1296486 - RNA, 21 nt, Human
aaaagaaaacucaauucagaa

SEQ ID NO: 1296487 - RNA, 24 nt, Human
aaaagaauaaagaauaucuacaaa

SEQ ID NO: 1296488 - RNA, 21 nt, Human
aaacaagccacugcuuccuca

SEQ ID NO: 1296489 - RNA, 21 nt, Human
aaacaauggcaucaaauggac

SEQ ID NO: 1296490 - RNA, 24 nt, Human
aaauauuggcagcuugaauaagcu

SEQ ID NO: 1296491 - RNA, 22 nt, Human
aacaaaggagaaaaaagccaaa

SEQ ID NO: 1296492 - RNA, 21 nt, Human
aacacgaaacauugacuaaua

SEQ ID NO: 1296493 - RNA, 23 nt, Human
aacagagcagcagaagcaucaag

SEQ ID NO: 1296494 - RNA, 24 nt, Human
aacagagcagcagaagcaucaaga

SEQ ID NO: 1296495 - RNA, 22 nt, Human
aacucaauucagaaaugaagaa

SEQ ID NO: 1296496 - RNA, 21 nt, Human
aagaauuccucuaaucauguc

SEQ ID NO: 1296497 - RNA, 24 nt, Human
aauaaagaauaucuacaaaaggga

SEQ ID NO: 1296498 - RNA, 26 nt, Human
aauucagagguauacuucugauuugg

SEQ ID NO: 1296499 - RNA, 18 nt, Human
acaaaacaaaaaaaagag

SEQ ID NO: 1296500 - RNA, 20 nt, Human
acaacaaaggagaaaaaagc

SEQ ID NO: 1296501 - RNA, 23 nt, Human
acaacaaaggagaaaaaagccaa

SEQ ID NO: 1296502 - RNA, 25 nt, Human
acaucaagaaaagaaaacucaauuc

SEQ ID NO: 1296503 - RNA, 21 nt, Human
acccccagagcaucucaauau

SEQ ID NO: 1296504 - RNA, 19 nt, Human
acugcuuccucaaagcaag

SEQ ID NO: 1296505 - RNA, 24 nt, Human
agaaaauccguggugaaaccugaa

SEQ ID NO: 1296506 - RNA, 18 nt, Human
agaaaauuaguuucaggg

SEQ ID NO: 1296507 - RNA, 20 nt, Human
agaaaugaagaaaacuggca

SEQ ID NO: 1296508 - RNA, 25 nt, Human
agaauacaacaaaggagaaaaaagc

SEQ ID NO: 1296509 - RNA, 24 nt, Human
agauggauugguagaggugugucg

SEQ ID NO: 1296510 - RNA, 18 nt, Human
agcaaggaggcaaguacu

SEQ ID NO: 1296511 - RNA, 27 nt, Human
agcaaggaggcaaguacugaagaagaa

SEQ ID NO: 1296512 - RNA, 25 nt, Human
agcagaagcaucaagaucaggucca

SEQ ID NO: 1296513 - RNA, 21 nt, Human
agggacaauuuucauacuaaa

SEQ ID NO: 1296514 - RNA, 24 nt, Human
agucucuuuuuuguggagagaagg

SEQ ID NO: 1296515 - RNA, 19 nt, Human
auaaugcggaacacgaaac

SEQ ID NO: 1296516 - RNA, 18 nt, Human
auacaaucuaacacagac

SEQ ID NO: 1296517 - RNA, 20 nt, Human
aucaaaauggguaaguccuu

SEQ ID NO: 1296518 - RNA, 20 nt, Human
auccagggaaucccagaaau

SEQ ID NO: 1296519 - RNA, 22 nt, Human
caaagcaaggaccaggcuccaa

SEQ ID NO: 1296520 - RNA, 21 nt, Human
caaaggagaaaaaagccaaaa

SEQ ID NO: 1296521 - RNA, 23 nt, Human
caaauaaugcggaacacgaaaca

SEQ ID NO: 1296522 - RNA, 19 nt, Human
caacaucaagaaaagaaaa

SEQ ID NO: 1296523 - RNA, 21 nt, Human
caagaucagguccaaagaguu

SEQ ID NO: 1296524 - RNA, 23 nt, Human
caccacauaaauacugggcaaca

SEQ ID NO: 1296525 - RNA, 19 nt, Human
cacccuuucacuugaucuc

SEQ ID NO: 1296526 - RNA, 22 nt, Human
caccuucagcuaucaaucauuu

SEQ ID NO: 1296527 - RNA, 23 nt, Human
cagagcaucucaauaucccuggc

SEQ ID NO: 1296528 - RNA, 21 nt, Human
cagcaguuccuuaggagccaa

SEQ ID NO: 1296529 - RNA, 22 nt, Human
cagcaguuccuuaggagccaac

SEQ ID NO: 1296530 - RNA, 22 nt, Human
caucaagaaaagaaaacucaau

SEQ ID NO: 1296531 - RNA, 22 nt, Human
caucaagacaauacauaaagaa

SEQ ID NO: 1296532 - RNA, 20 nt, Human
caugcuuauuccuucacaaa

SEQ ID NO: 1296533 - RNA, 23 nt, Human
cauugccaagaaaaccucucagc

SEQ ID NO: 1296534 - RNA, 20 nt, Human
ccaacagagcagcagaagca

SEQ ID NO: 1296535 - RNA, 22 nt, Human
ccagagcaucucaauaucccug

SEQ ID NO: 1296536 - RNA, 20 nt, Human
cccucaggugguuaaaggcc

SEQ ID NO: 1296537 - RNA, 22 nt, Human
ccucaaaaacaaaacaaaaaaa

SEQ ID NO: 1296538 - RNA, 21 nt, Human
ccucacauugccaagaaaacc

SEQ ID NO: 1296539 - RNA, 21 nt, Human
ccuguaggucgaaccaacacu

SEQ ID NO: 1296540 - RNA, 19 nt, Human
ccuuccuuccucuuccucc

SEQ ID NO: 1296541 - RNA, 19 nt, Human
ccuuccuuccucuuccucc

SEQ ID NO: 1296542 - RNA, 23 nt, Human
ccuuucacuugaucucccucuca

SEQ ID NO: 1296543 - RNA, 21 nt, Human
cgaaccaacacucaauccaug

SEQ ID NO: 1296544 - RNA, 19 nt, Human
cuaacacagacugaguggg

SEQ ID NO: 1296545 - RNA, 19 nt, Human
cucaaaagaugauaaacaa

SEQ ID NO: 1296546 - RNA, 20 nt, Human
cucaaaagaugauaaacaau

SEQ ID NO: 1296547 - RNA, 21 nt, Human
cucaaaagaugauaaacaaug

SEQ ID NO: 1296548 - RNA, 21 nt, Human
cucaauucagaaaugaagaaa

SEQ ID NO: 1296549 - RNA, 22 nt, Human
cucacuaccaccuucagcuauc

SEQ ID NO: 1296550 - RNA, 19 nt, Human
cucauauaaugaauccagg

SEQ ID NO: 1296551 - RNA, 22 nt, Human
cuggccaccuacagcaaaauau

SEQ ID NO: 1296552 - RNA, 21 nt, Human
cuguaagcugauuccaaaagc

SEQ ID NO: 1296553 - RNA, 23 nt, Human
cuuccucaaagcaaggaccaggc

SEQ ID NO: 1296554 - RNA, 20 nt, Human
cuucuugaaacaagccacug

SEQ ID NO: 1296555 - RNA, 21 nt, Human
gaaaccugaacauucuacccc

SEQ ID NO: 1296556 - RNA, 19 nt, Human
gaacauucuaccccugcuu

SEQ ID NO: 1296557 - RNA, 22 nt, Human
gaaggaaaccaacaucaagaaa

SEQ ID NO: 1296558 - RNA, 19 nt, Human
gacuggagacagcuagggu

SEQ ID NO: 1296559 - RNA, 22 nt, Human
ggagaagggcuaucauacaaca

SEQ ID NO: 1296560 - RNA, 22 nt, Human
ggcagguauacaauauaccccc

SEQ ID NO: 1296561 - RNA, 24 nt, Human
ggggcaaauucuagacuaaagaaa

SEQ ID NO: 1296562 - RNA, 24 nt, Human
gucaccaucucauauaaugaaucc

SEQ ID NO: 1296563 - RNA, 24 nt, Human
gucucuuuuuuguggagagaaggg

SEQ ID NO: 1296564 - RNA, 25 nt, Human
uaaaaaagcaaaagaauaaagaaua

SEQ ID NO: 1296565 - RNA, 22 nt, Human
uaaaaaucugaccccaaggaau

SEQ ID NO: 1296566 - RNA, 23 nt, Human
uaaagcuuaguugaaucucuaaa

SEQ ID NO: 1296567 - RNA, 20 nt, Human
uaaaguaacuuuaaaaaucu

SEQ ID NO: 1296568 - RNA, 22 nt, Human
uaaaguguccucacuaccaccu

SEQ ID NO: 1296569 - RNA, 18 nt, Human
uaagggcaaaugguucaa

SEQ ID NO: 1296570 - RNA, 19 nt, Human
uaauaaugaagcagaaaaa

SEQ ID NO: 1296571 - RNA, 23 nt, Human
uaccccugcuuuggagaagggcu

SEQ ID NO: 1296572 - RNA, 20 nt, Human
uacugggagauuaaguccau

SEQ ID NO: 1296573 - RNA, 18 nt, Human
uauacaauauacccccag

SEQ ID NO: 1296574 - RNA, 18 nt, Human
uaugaaggaaaccaacau

SEQ ID NO: 1296575 - RNA, 23 nt, Human
uaugagaaacaaaacuggccacc

SEQ ID NO: 1296576 - RNA, 21 nt, Human
ucaauucagaaaugaagaaaa

SEQ ID NO: 1296577 - RNA, 19 nt, Human
ucagaaaugaagaaaacug

SEQ ID NO: 1296578 - RNA, 22 nt, Human
ucagaaguggcuucuugaaaca

SEQ ID NO: 1296579 - RNA, 21 nt, Human
ucagagguauacuucugauuu

SEQ ID NO: 1296580 - RNA, 24 nt, Human
ucauacaacauucagucagcugaa

SEQ ID NO: 1296581 - RNA, 23 nt, Human
uccauauucccaacaaggcuacg

SEQ ID NO: 1296582 - RNA, 23 nt, Human
ucccaacuacugggagauuaagu

SEQ ID NO: 1296583 - RNA, 19 nt, Human
ucccucucagucucuuuuu

SEQ ID NO: 1296584 - RNA, 18 nt, Human
uccguggugaaaccugaa

SEQ ID NO: 1296585 - RNA, 18 nt, Human
uccugagcugcucagccc

SEQ ID NO: 1296586 - RNA, 25 nt, Human
uccuuaggagccaacaugacaggug

SEQ ID NO: 1296587 - RNA, 20 nt, Human
uccuuccuuccucuuccucc

SEQ ID NO: 1296588 - RNA, 18 nt, Human
ucgaaccaacacucaauc

SEQ ID NO: 1296589 - RNA, 20 nt, Human
ucuagacuaaagaaaugauc

SEQ ID NO: 1296590 - RNA, 24 nt, Human
ucuuccaaaugacaacuugaucac

SEQ ID NO: 1296591 - RNA, 25 nt, Human
ugaaacaagccacugcuuccucaaa

SEQ ID NO: 1296592 - RNA, 19 nt, Human
ugaagaagaaaagggacaa

SEQ ID NO: 1296593 - RNA, 23 nt, Human
ugaccccaaggaauccaggacac

SEQ ID NO: 1296594 - RNA, 23 nt, Human
ugagccgcuuacaacagcaguuc

SEQ ID NO: 1296595 - RNA, 19 nt, Human
ugaucucccucucagucuc

SEQ ID NO: 1296596 - RNA, 22 nt, Human
uggguagauucuuagaucagaa

SEQ ID NO: 1296597 - RNA, 21 nt, Human
uguccucacuaccaccuucag

SEQ ID NO: 1296598 - RNA, 23 nt, Human
uuauaaaguaacuuuaaaaaucu

SEQ ID NO: 1296599 - RNA, 22 nt, Human
uuaucuccucaaaaacaaaaca

SEQ ID NO: 1296600 - RNA, 24 nt, Human
uucagaggccaacagagcagcaga

SEQ ID NO: 1296601 - RNA, 19 nt, Human
uuccaaucuauuacgccug

SEQ ID NO: 1296602 - RNA, 20 nt, Human
uuuaaaacaucucccaacua

SEQ ID NO: 1296603 - RNA, 21 nt, Human
uuuaaaguguccucacuacca

SEQ ID NO: 1296604 - RNA, 24 nt, Human
uuuuaaaacaucucccaacuacug

SEQ ID NO: 1296605 - RNA, 20 nt, Human
cuccaacacucugcucuagc

SEQ ID NO: 1296606 - RNA, 21 nt, Human
gauuguuccuggucuccaaca

SEQ ID NO: 1296607 - RNA, 22 nt, Human
gcaaagcacagauuccaaccuu

SEQ ID NO: 1296608 - RNA, 22 nt, Human
uagcacacugugacuacaccuc

SEQ ID NO: 1296609 - RNA, 20 nt, Human
ucuccaacacucugcucuag

SEQ ID NO: 1296610 - RNA, 26 nt, Human
ucuucugauuguuccuggucuccaac

SEQ ID NO: 1296611 - RNA, 19 nt, Human
uuccuggucuccaacacuc

SEQ ID NO: 1296612 - RNA, 20 nt, Human
aacgcugagcugggcaggcc

SEQ ID NO: 1296613 - RNA, 20 nt, Human
aagagaaagggaauucuaaa

SEQ ID NO: 1296614 - RNA, 18 nt, Human
aagccggcgccgggcagc

SEQ ID NO: 1296615 - RNA, 20 nt, Human
aagggacagaggaggaccca

SEQ ID NO: 1296616 - RNA, 23 nt, Human
aaggggagggaaagagagaggga

SEQ ID NO: 1296617 - RNA, 23 nt, Human
acccucggccggcccccagcccu

SEQ ID NO: 1296618 - RNA, 20 nt, Human
agaggaaggcagggggaggg

SEQ ID NO: 1296619 - RNA, 19 nt, Human
agagggaaggacgcagggc

SEQ ID NO: 1296620 - RNA, 21 nt, Human
agagggacugggucccaaggc

SEQ ID NO: 1296621 - RNA, 23 nt, Human
aggacgcagggccagggugggga

SEQ ID NO: 1296622 - RNA, 28 nt, Human
aggcagggggagggucagaaggucgacc

SEQ ID NO: 1296623 - RNA, 21 nt, Human
aggcagggggagggucagagg

SEQ ID NO: 1296624 - RNA, 19 nt, Human
caagaccggcccuccgccc

SEQ ID NO: 1296625 - RNA, 20 nt, Human
cacgacuuggccagcagagc

SEQ ID NO: 1296626 - RNA, 24 nt, Human
caggaagggccgcacacuuuggca

SEQ ID NO: 1296627 - RNA, 18 nt, Human
caggccagucuaguacaa

SEQ ID NO: 1296628 - RNA, 24 nt, Human
ccaggccagucuaguacaaaguua

SEQ ID NO: 1296629 - RNA, 22 nt, Human
cccacgacuuggccagcagagc

SEQ ID NO: 1296630 - RNA, 26 nt, Human
cccaucucgcucgcaccacccggaag

SEQ ID NO: 1296631 - RNA, 23 nt, Human
cccuccgccccaucucgcucgca

SEQ ID NO: 1296632 - RNA, 18 nt, Human
ccgcgcccugcggccugc

SEQ ID NO: 1296633 - RNA, 18 nt, Human
ccgcgcccugcggccugc

SEQ ID NO: 1296634 - RNA, 18 nt, Human
ccuugggccagaccgcuc

SEQ ID NO: 1296635 - RNA, 18 nt, Human
cggaagccggcgccgggc

SEQ ID NO: 1296636 - RNA, 19 nt, Human
cuaguacaaaguuaaggag

SEQ ID NO: 1296637 - RNA, 26 nt, Human
cucccgaagacccucggccggccccc

SEQ ID NO: 1296638 - RNA, 20 nt, Human
gaaggcucugaguggugggg

SEQ ID NO: 1296639 - RNA, 18 nt, Human
gaagggacagaggaggac

SEQ ID NO: 1296640 - RNA, 18 nt, Human
gagaaagggaauucuaaa

SEQ ID NO: 1296641 - RNA, 23 nt, Human
gagccggggcaaaagucugggaa

SEQ ID NO: 1296642 - RNA, 21 nt, Human
gcaaaagucugggaaggggag

SEQ ID NO: 1296643 - RNA, 20 nt, Human
gcaagaggaaggcaggggga

SEQ ID NO: 1296644 - RNA, 18 nt, Human
gcaaugaagggacagagg

SEQ ID NO: 1296645 - RNA, 22 nt, Human
ggaauguaccauguuguuagca

SEQ ID NO: 1296646 - RNA, 22 nt, Human
ggaggacccacgacuuggccag

SEQ ID NO: 1296647 - RNA, 20 nt, Human
ggaggagggggcggacuacc

SEQ ID NO: 1296648 - RNA, 21 nt, Human
ggaggagggggcggacuaccc

SEQ ID NO: 1296649 - RNA, 18 nt, Human
ggaggcugcucagacugu

SEQ ID NO: 1296650 - RNA, 20 nt, Human
ggaugguggggaggaggggg

SEQ ID NO: 1296651 - RNA, 21 nt, Human
ggcccccagcccuugggccag

SEQ ID NO: 1296652 - RNA, 22 nt, Human
ggccggcccccagcccuugggc

SEQ ID NO: 1296653 - RNA, 23 nt, Human
gggaggaugguggggaggagggg

SEQ ID NO: 1296654 - RNA, 20 nt, Human
ggggagggaaagagagaggg

SEQ ID NO: 1296655 - RNA, 19 nt, Human
gguagcagcggcggacggc

SEQ ID NO: 1296656 - RNA, 18 nt, Human
guagcagcggcggacggc

SEQ ID NO: 1296657 - RNA, 24 nt, Human
uaauaaauaauaugaaacagacuu

SEQ ID NO: 1296658 - RNA, 25 nt, Human
uagggaggaugguggggaggagggg

SEQ ID NO: 1296659 - RNA, 25 nt, Human
uagggaggaugguggggaggagggg

SEQ ID NO: 1296660 - RNA, 26 nt, Human
ucccaaggcaagaggaaggcaggggg

SEQ ID NO: 1296661 - RNA, 18 nt, Human
ucccgaagacccucggcc

SEQ ID NO: 1296662 - RNA, 19 nt, Human
uccgccccaucucgcucgc

SEQ ID NO: 1296663 - RNA, 23 nt, Human
ucuccgcgcccugcggccugcuc

SEQ ID NO: 1296664 - RNA, 19 nt, Human
ucucgcucgcaccacccgg

SEQ ID NO: 1296665 - RNA, 23 nt, Human
ucugcaagaccggcccuccgccc

SEQ ID NO: 1296666 - RNA, 20 nt, Human
ugaaacagacugauaacgcu

SEQ ID NO: 1296667 - RNA, 28 nt, Human
ugaaacagacugauaacgcugagcuggg

SEQ ID NO: 1296668 - RNA, 18 nt, Human
ugggauggguggagaagg

SEQ ID NO: 1296669 - RNA, 22 nt, Human
ugggauggguggagaagggcca

SEQ ID NO: 1296670 - RNA, 20 nt, Human
uggggacaaguguuggcuuc

SEQ ID NO: 1296671 - RNA, 22 nt, Human
uggggaggagggggcggacuac

SEQ ID NO: 1296672 - RNA, 18 nt, Human
ugggucccaaggcaagag

SEQ ID NO: 1296673 - RNA, 19 nt, Human
ugggucccaaggcaagagg

SEQ ID NO: 1296674 - RNA, 18 nt, Human
uggguggagaagggccaa

SEQ ID NO: 1296675 - RNA, 21 nt, Human
uggguggagaagggccaaagu

SEQ ID NO: 1296676 - RNA, 19 nt, Human
uggugaugucaggaagggc

SEQ ID NO: 1296677 - RNA, 19 nt, Human
uguggugaugucaggaagg

SEQ ID NO: 1296678 - RNA, 22 nt, Human
aaaaaaaaaagaaaaagaaaag

SEQ ID NO: 1296679 - RNA, 23 nt, Human
aaaaagugcucugacuugaauaa

SEQ ID NO: 1296680 - RNA, 24 nt, Human
aaaagaaaaagaaaaguuugccag

SEQ ID NO: 1296681 - RNA, 19 nt, Human
aaacacacacucacgugca

SEQ ID NO: 1296682 - RNA, 26 nt, Human
aaacaggaaauacacaaaggggaccc

SEQ ID NO: 1296683 - RNA, 20 nt, Human
aaaguuugccaggccuaaag

SEQ ID NO: 1296684 - RNA, 23 nt, Human
aaauucucaugaaacuaaauucc

SEQ ID NO: 1296685 - RNA, 21 nt, Human
aagaaaaguuugccaggccua

SEQ ID NO: 1296686 - RNA, 22 nt, Human
aagcaggguucuaggccgggcg

SEQ ID NO: 1296687 - RNA, 24 nt, Human
aagcgugguggugggcaccuguag

SEQ ID NO: 1296688 - RNA, 21 nt, Human
aaugcggugaaaccccgucuc

SEQ ID NO: 1296689 - RNA, 18 nt, Human
acaccaaaaaguugucca

SEQ ID NO: 1296690 - RNA, 19 nt, Human
acacuugacacucgaaaug

SEQ ID NO: 1296691 - RNA, 20 nt, Human
accagugucaaaauaggaug

SEQ ID NO: 1296692 - RNA, 24 nt, Human
accccgucucuacuaaaaauacaa

SEQ ID NO: 1296693 - RNA, 24 nt, Human
accccgucucuccuaaaaauacaa

SEQ ID NO: 1296694 - RNA, 23 nt, Human
accuguagucccagcuacucagg

SEQ ID NO: 1296695 - RNA, 20 nt, Human
agaaaaagaaaaguuugcca

SEQ ID NO: 1296696 - RNA, 23 nt, Human
agaagauaaaaacagcucuuucc

SEQ ID NO: 1296697 - RNA, 26 nt, Human
agaggcugggagugguuaagaagaua

SEQ ID NO: 1296698 - RNA, 20 nt, Human
agccaagcgugguggugggc

SEQ ID NO: 1296699 - RNA, 22 nt, Human
agccaagcgugguggugggcac

SEQ ID NO: 1296700 - RNA, 19 nt, Human
agccugccagacaaaaacc

SEQ ID NO: 1296701 - RNA, 23 nt, Human
agccuguaaucccagaacuuugg

SEQ ID NO: 1296702 - RNA, 23 nt, Human
agcgugguggugcaugccuguaa

SEQ ID NO: 1296703 - RNA, 22 nt, Human
aggaggaguaacacaagaccug

SEQ ID NO: 1296704 - RNA, 22 nt, Human
aggaggccgaggcggguagauc

SEQ ID NO: 1296705 - RNA, 20 nt, Human
aggcaggaguuaaugcugaa

SEQ ID NO: 1296706 - RNA, 21 nt, Human
aggcaggaguuaaugcugaau

SEQ ID NO: 1296707 - RNA, 21 nt, Human
aggccgaggcggguagaucgc

SEQ ID NO: 1296708 - RNA, 21 nt, Human
aggccgaggcggguggaucac

SEQ ID NO: 1296709 - RNA, 19 nt, Human
aggccugggauuaggggcu

SEQ ID NO: 1296710 - RNA, 22 nt, Human
aggcggguagaucgccugaggu

SEQ ID NO: 1296711 - RNA, 26 nt, Human
aggcggguagaucgccugaggucagg

SEQ ID NO: 1296712 - RNA, 24 nt, Human
aggcggguggaucacgaggucagg

SEQ ID NO: 1296713 - RNA, 21 nt, Human
aggcugaggcaggaguuaaug

SEQ ID NO: 1296714 - RNA, 24 nt, Human
aguggcucaagccuguaaucccag

SEQ ID NO: 1296715 - RNA, 21 nt, Human
auacacaaagaaaaacaugcc

SEQ ID NO: 1296716 - RNA, 24 nt, Human
aucagauaguucaguauaaaccag

SEQ ID NO: 1296717 - RNA, 24 nt, Human
augaaaaacaggaaauacacaaag

SEQ ID NO: 1296718 - RNA, 22 nt, Human
caaaacuuguuucaaagcaaac

SEQ ID NO: 1296719 - RNA, 19 nt, Human
caaaauaggaugcaggaac

SEQ ID NO: 1296720 - RNA, 20 nt, Human
caaaauaggaugcaggaacu

SEQ ID NO: 1296721 - RNA, 24 nt, Human
caaagcaaacugaauucuguauau

SEQ ID NO: 1296722 - RNA, 26 nt, Human
caaccaaaacuuguuucaaagcaaac

SEQ ID NO: 1296723 - RNA, 19 nt, Human
caagaucuucuuacaacca

SEQ ID NO: 1296724 - RNA, 24 nt, Human
caagccuguaaucccagaacuuug

SEQ ID NO: 1296725 - RNA, 23 nt, Human
caaggccugggauuaggggcugg

SEQ ID NO: 1296726 - RNA, 23 nt, Human
cacaaagaaaaacaugccagagg

SEQ ID NO: 1296727 - RNA, 20 nt, Human
cacacaugcauacacauaua

SEQ ID NO: 1296728 - RNA, 31 nt, Human
cacacucacgugcacacaugcauacacauag

SEQ ID NO: 1296729 - RNA, 18 nt, Human
cacauauacacacacacc

SEQ ID NO: 1296730 - RNA, 24 nt, Human
caccuguagucccagcuacucagg

SEQ ID NO: 1296731 - RNA, 26 nt, Human
cacgugcacacaugcauacacauaua

SEQ ID NO: 1296732 - RNA, 24 nt, Human
cagaacuuugggaggccgaggcgg

SEQ ID NO: 1296733 - RNA, 22 nt, Human
cagacaaaaaccgcucaaguau

SEQ ID NO: 1296734 - RNA, 31 nt, Human
cagacaaaaaccgcucaaguauuuauuagaa

SEQ ID NO: 1296735 - RNA, 22 nt, Human
cagcuacucaggaggccgaggc

SEQ ID NO: 1296736 - RNA, 24 nt, Human
cagcuacucaggaggccgaggcgg

SEQ ID NO: 1296737 - RNA, 24 nt, Human
cagcuacuugggaggcugaggcag

SEQ ID NO: 1296738 - RNA, 25 nt, Human
caguuauaaaaaaaaaaaagaaaaa

SEQ ID NO: 1296739 - RNA, 31 nt, Human
cauacacauauacacacacaccccugagcag

SEQ ID NO: 1296740 - RNA, 24 nt, Human
cauacaguguuuauuaguugucag

SEQ ID NO: 1296741 - RNA, 18 nt, Human
caugccagagguaggugc

SEQ ID NO: 1296742 - RNA, 24 nt, Human
caugccuguaaucccagcuacuug

SEQ ID NO: 1296743 - RNA, 20 nt, Human
cauggucccuuggggaauca

SEQ ID NO: 1296744 - RNA, 18 nt, Human
ccccacagcucaccccag

SEQ ID NO: 1296745 - RNA, 19 nt, Human
ccgcgucccgcgcucggga

SEQ ID NO: 1296746 - RNA, 22 nt, Human
ccuguaaucccagaacuuuggg

SEQ ID NO: 1296747 - RNA, 21 nt, Human
ccuguaaucccagcuacuugg

SEQ ID NO: 1296748 - RNA, 22 nt, Human
ccuguaaucccagcuacuuggg

SEQ ID NO: 1296749 - RNA, 21 nt, Human
ccuguagucccagcuacucag

SEQ ID NO: 1296750 - RNA, 21 nt, Human
ccuuguaacuggccuccccca

SEQ ID NO: 1296751 - RNA, 26 nt, Human
cgaggcggguagaucgccugagguca

SEQ ID NO: 1296752 - RNA, 24 nt, Human
cgaggcggguggaucacgagguca

SEQ ID NO: 1296753 - RNA, 23 nt, Human
cgccugaggucaggaguucaaga

SEQ ID NO: 1296754 - RNA, 24 nt, Human
cggguagaucgccugaggucagga

SEQ ID NO: 1296755 - RNA, 22 nt, Human
cuacaguguguacaccaaggcc

SEQ ID NO: 1296756 - RNA, 26 nt, Human
cuaggccgggcgcaguggcucaagcc

SEQ ID NO: 1296757 - RNA, 24 nt, Human
cucaagccuguaaucccagaacuu

SEQ ID NO: 1296758 - RNA, 18 nt, Human
cucaggaggccgaggcgg

SEQ ID NO: 1296759 - RNA, 20 nt, Human
cucccccacagcucacccca

SEQ ID NO: 1296760 - RNA, 21 nt, Human
cucccccacagcucaccccag

SEQ ID NO: 1296761 - RNA, 22 nt, Human
cugaagauucaucuuuuaucuu

SEQ ID NO: 1296762 - RNA, 25 nt, Human
cugaagauucaucuuuuaucuuuug

SEQ ID NO: 1296763 - RNA, 22 nt, Human
gaaaaacaggaaauacacaaag

SEQ ID NO: 1296764 - RNA, 22 nt, Human
gaaaaguuugccaggccuaaag

SEQ ID NO: 1296765 - RNA, 22 nt, Human
gaaacacacacucacgugcaca

SEQ ID NO: 1296766 - RNA, 26 nt, Human
gaaauacacaaagaaaaacaugccag

SEQ ID NO: 1296767 - RNA, 21 nt, Human
gaagaguagaggcugggagug

SEQ ID NO: 1296768 - RNA, 19 nt, Human
gagcgugguggugcaugcc

SEQ ID NO: 1296769 - RNA, 22 nt, Human
gaggaggaguaacacaagaccu

SEQ ID NO: 1296770 - RNA, 23 nt, Human
gaucgccugaggucaggaguuca

SEQ ID NO: 1296771 - RNA, 24 nt, Human
gaucgccugaggucaggaguucaa

SEQ ID NO: 1296772 - RNA, 19 nt, Human
gaugcaggaacuggaaaaa

SEQ ID NO: 1296773 - RNA, 24 nt, Human
gccugaggucaggaguucaagacc

SEQ ID NO: 1296774 - RNA, 20 nt, Human
gccuguaaucccagcuacuu

SEQ ID NO: 1296775 - RNA, 24 nt, Human
gcgucgcuucgcccuccuccccca

SEQ ID NO: 1296776 - RNA, 19 nt, Human
gcuaaugcggugaaacccc

SEQ ID NO: 1296777 - RNA, 24 nt, Human
gcuaaugcggugaaaccccgucuc

SEQ ID NO: 1296778 - RNA, 24 nt, Human
ggaaaaagaaacacacacucacgu

SEQ ID NO: 1296779 - RNA, 21 nt, Human
ggaggccgaggcggguagauc

SEQ ID NO: 1296780 - RNA, 22 nt, Human
ggauuaggggcugggaagagua

SEQ ID NO: 1296781 - RNA, 23 nt, Human
ggcgcaguggcucaagccuguaa

SEQ ID NO: 1296782 - RNA, 21 nt, Human
ggcugggaagaguagaggcug

SEQ ID NO: 1296783 - RNA, 20 nt, Human
gggcaccuguagucccagcu

SEQ ID NO: 1296784 - RNA, 22 nt, Human
ggguucuaggccgggcgcagug

SEQ ID NO: 1296785 - RNA, 21 nt, Human
ggugcaugccuguaaucccag

SEQ ID NO: 1296786 - RNA, 21 nt, Human
gguggaucacgaggucaggag

SEQ ID NO: 1296787 - RNA, 24 nt, Human
gguggugcaugccuguaaucccag

SEQ ID NO: 1296788 - RNA, 24 nt, Human
gguggugggcaccuguagucccag

SEQ ID NO: 1296789 - RNA, 23 nt, Human
guguauaugaauauguacacaua

SEQ ID NO: 1296790 - RNA, 22 nt, Human
uaaaaaaaaaaaagaaaaagaa

SEQ ID NO: 1296791 - RNA, 22 nt, Human
uaaaaagcguauguguugaaaa

SEQ ID NO: 1296792 - RNA, 19 nt, Human
uaacacaagaccuguaaac

SEQ ID NO: 1296793 - RNA, 22 nt, Human
uaacuagauuauuuccacugag

SEQ ID NO: 1296794 - RNA, 19 nt, Human
uaagccaagcgugguggug

SEQ ID NO: 1296795 - RNA, 22 nt, Human
uaaugcggugaaaccccgucuc

SEQ ID NO: 1296796 - RNA, 25 nt, Human
uacaaaagucauaaaaguacaaacc

SEQ ID NO: 1296797 - RNA, 31 nt, Human
uacacauauacacacacaccccugagcauag

SEQ ID NO: 1296798 - RNA, 20 nt, Human
uacaguaaauacuuugaagu

SEQ ID NO: 1296799 - RNA, 23 nt, Human
uacuuugaaguauauuuuuaugg

SEQ ID NO: 1296800 - RNA, 24 nt, Human
uagaucgccugaggucaggaguuc

SEQ ID NO: 1296801 - RNA, 24 nt, Human
uaggccgggcgcaguggcucaagc

SEQ ID NO: 1296802 - RNA, 24 nt, Human
uaggggcugggaagaguagaggcu

SEQ ID NO: 1296803 - RNA, 18 nt, Human
uagugauaccccgucucu

SEQ ID NO: 1296804 - RNA, 21 nt, Human
uauaauaaaauuuucaacaga

SEQ ID NO: 1296805 - RNA, 22 nt, Human
uauggcacagcaauaauauucc

SEQ ID NO: 1296806 - RNA, 20 nt, Human
uauugcuauuuaaaaaaaag

SEQ ID NO: 1296807 - RNA, 18 nt, Human
ucacgaggucaggagauc

SEQ ID NO: 1296808 - RNA, 24 nt, Human
ucacgaggucaggagaucgagacc

SEQ ID NO: 1296809 - RNA, 23 nt, Human
ucgccugaggucaggaguucaag

SEQ ID NO: 1296810 - RNA, 21 nt, Human
ucucuacuaaaaauacaaaaa

SEQ ID NO: 1296811 - RNA, 21 nt, Human
ugaaaaacaggaaauacacaa

SEQ ID NO: 1296812 - RNA, 23 nt, Human
ugaaaccccgucucuccuaaaaa

SEQ ID NO: 1296813 - RNA, 24 nt, Human
ugacaccaaaaaguuguccaucau

SEQ ID NO: 1296814 - RNA, 18 nt, Human
ugacauggaggcgggucu

SEQ ID NO: 1296815 - RNA, 22 nt, Human
ugaggcaggaguuaaugcugaa

SEQ ID NO: 1296816 - RNA, 24 nt, Human
ugaggcaggaguuaaugcugaauu

SEQ ID NO: 1296817 - RNA, 22 nt, Human
ugcacacaugcauacacauaua

SEQ ID NO: 1296818 - RNA, 25 nt, Human
ugcacacaugcauacacauauacac

SEQ ID NO: 1296819 - RNA, 22 nt, Human
ugcaggaacuggaaaaagaaac

SEQ ID NO: 1296820 - RNA, 25 nt, Human
ugcauacacauauacacacacaccc

SEQ ID NO: 1296821 - RNA, 25 nt, Human
ugcauacacauauacacacacaccc

SEQ ID NO: 1296822 - RNA, 23 nt, Human
ugccucuggguccuuucaggugu

SEQ ID NO: 1296823 - RNA, 23 nt, Human
ugccuguaaucccagcuacuugg

SEQ ID NO: 1296824 - RNA, 24 nt, Human
ugccuguaaucccagcuacuuggg

SEQ ID NO: 1296825 - RNA, 23 nt, Human
uggaaaaagaaacacacacucac

SEQ ID NO: 1296826 - RNA, 21 nt, Human
uggaaaaauaauuaaagcuaa

SEQ ID NO: 1296827 - RNA, 20 nt, Human
uggccucccccacagcucac

SEQ ID NO: 1296828 - RNA, 21 nt, Human
uggcucaagccuguaauccca

SEQ ID NO: 1296829 - RNA, 22 nt, Human
uggcucaagccuguaaucccag

SEQ ID NO: 1296830 - RNA, 23 nt, Human
ugggaggccgaggcggguggauc

SEQ ID NO: 1296831 - RNA, 24 nt, Human
ugggaggccgaggcggguggauca

SEQ ID NO: 1296832 - RNA, 19 nt, Human
ugggaggcugaggcaggag

SEQ ID NO: 1296833 - RNA, 19 nt, Human
ugggaggcugaggcaggag

SEQ ID NO: 1296834 - RNA, 21 nt, Human
uggugcaugccuguaauccca

SEQ ID NO: 1296835 - RNA, 22 nt, Human
uggugcaugccuguaaucccag

SEQ ID NO: 1296836 - RNA, 22 nt, Human
uggugggcaccuguagucccag

SEQ ID NO: 1296837 - RNA, 24 nt, Human
ugguggugcaugccuguaauccca

SEQ ID NO: 1296838 - RNA, 24 nt, Human
ugguggugggcaccuguaguccca

SEQ ID NO: 1296839 - RNA, 20 nt, Human
uguacacauacaguguuuau

SEQ ID NO: 1296840 - RNA, 18 nt, Human
uuaaagcaaaaaaguaug

SEQ ID NO: 1296841 - RNA, 22 nt, Human
uuaccacugaagauucaucuuu

SEQ ID NO: 1296842 - RNA, 24 nt, Human
uuagucgagcgugguggugcaugc

SEQ ID NO: 1296843 - RNA, 24 nt, Human
uuaguugucaguaaaaauucucau

SEQ ID NO: 1296844 - RNA, 25 nt, Human
uucaaccaaaacuuguuucaaagca

SEQ ID NO: 1296845 - RNA, 25 nt, Human
uugggaggccgaggcggguggauca

SEQ ID NO: 1296846 - RNA, 20 nt, Human
uugggaggcugaggcaggag

SEQ ID NO: 1296847 - RNA, 22 nt, Human
uuguaacuggccucccccacag

SEQ ID NO: 1296848 - RNA, 19 nt, Human
uuuaacuccgcuuugguag

SEQ ID NO: 1296849 - RNA, 23 nt, Human
aaauauucuuccaggucguuucc

SEQ ID NO: 1296850 - RNA, 19 nt, Human
aagaggccuggggcguccu

SEQ ID NO: 1296851 - RNA, 19 nt, Human
aauaauugccaucuuuaca

SEQ ID NO: 1296852 - RNA, 24 nt, Human
accccaguuccccuguccccccag

SEQ ID NO: 1296853 - RNA, 23 nt, Human
agaaacacaaauaaucuaaaaaa

SEQ ID NO: 1296854 - RNA, 20 nt, Human
aggguccagucuagaucuuc

SEQ ID NO: 1296855 - RNA, 19 nt, Human
aucuguuugguuguacuag

SEQ ID NO: 1296856 - RNA, 21 nt, Human
caaaccaggguccagucuaga

SEQ ID NO: 1296857 - RNA, 19 nt, Human
caggguccagucuagaucu

SEQ ID NO: 1296858 - RNA, 19 nt, Human
ccccuguccccccagcucc

SEQ ID NO: 1296859 - RNA, 18 nt, Human
cccugccccagccucucc

SEQ ID NO: 1296860 - RNA, 19 nt, Human
cccugccccagccucuccc

SEQ ID NO: 1296861 - RNA, 22 nt, Human
cccuggccaagaggccuggggc

SEQ ID NO: 1296862 - RNA, 24 nt, Human
cguccuccggaccccaguuccccu

SEQ ID NO: 1296863 - RNA, 20 nt, Human
cuaaaaaauaaaagcaccaa

SEQ ID NO: 1296864 - RNA, 19 nt, Human
gaguaugugugugugugug

SEQ ID NO: 1296865 - RNA, 21 nt, Human
gcccugccccagccucuccca

SEQ ID NO: 1296866 - RNA, 21 nt, Human
gggaggcccuggccaagaggc

SEQ ID NO: 1296867 - RNA, 19 nt, Human
gucccugagcgcagugucu

SEQ ID NO: 1296868 - RNA, 20 nt, Human
uccccuguccccccagcucc

SEQ ID NO: 1296869 - RNA, 23 nt, Human
ucccugagcgcagugucucucca

SEQ ID NO: 1296870 - RNA, 20 nt, Human
ucuccaguuguuccagaaau

SEQ ID NO: 1296871 - RNA, 19 nt, Human
ucucccaucaagccguccc

SEQ ID NO: 1296872 - RNA, 29 nt, Human
ugugugagaguauguguguguguguguaa

SEQ ID NO: 1296873 - RNA, 22 nt, Human
uguguguguguauuugcuuuuc

SEQ ID NO: 1296874 - RNA, 20 nt, Human
uucacguugcaucugguuau

SEQ ID NO: 1296875 - RNA, 21 nt, Human
uuccugugugagaguaugugu

SEQ ID NO: 1296876 - RNA, 22 nt, Human
agagcaucucccuugaagccuc

SEQ ID NO: 1296877 - RNA, 22 nt, Human
aguaguuuugaggcauguucuu

SEQ ID NO: 1296878 - RNA, 25 nt, Human
aucucccuugaagccucacucacca

SEQ ID NO: 1296879 - RNA, 20 nt, Human
augcugcucaugaccaggag

SEQ ID NO: 1296880 - RNA, 20 nt, Human
caaagagcaucucccuugaa

SEQ ID NO: 1296881 - RNA, 20 nt, Human
cacccugucucuuuauuaaa

SEQ ID NO: 1296882 - RNA, 22 nt, Human
caggacaaagagcaucucccuu

SEQ ID NO: 1296883 - RNA, 24 nt, Human
cccacaaacggaagugguuaacga

SEQ ID NO: 1296884 - RNA, 18 nt, Human
ccugugaugaauccagaa

SEQ ID NO: 1296885 - RNA, 18 nt, Human
cucccuugaagccucacu

SEQ ID NO: 1296886 - RNA, 18 nt, Human
cugaggcuggaggguccu

SEQ ID NO: 1296887 - RNA, 20 nt, Human
cuugcuggcugaggcuggag

SEQ ID NO: 1296888 - RNA, 19 nt, Human
ugaccaggagguccccaca

SEQ ID NO: 1296889 - RNA, 20 nt, Human
ugaccaggagguccccacaa

SEQ ID NO: 1296890 - RNA, 23 nt, Human
ugaccaggagguccccacaaacg

SEQ ID NO: 1296891 - RNA, 18 nt, Human
uggcaggagguaugccuu

SEQ ID NO: 1296892 - RNA, 19 nt, Human
uugaaggcuucgggaugau

SEQ ID NO: 1296893 - RNA, 19 nt, Human
uugcuggcugaggcuggag

SEQ ID NO: 1296894 - RNA, 20 nt, Human
agcacacagacaacccagca

SEQ ID NO: 1296895 - RNA, 19 nt, Human
aaacaaaagcagaaaggga

SEQ ID NO: 1296896 - RNA, 22 nt, Human
aaacaaaagcagaaagggacua

SEQ ID NO: 1296897 - RNA, 24 nt, Human
aaacaucuuuuuuggcuagaaaca

SEQ ID NO: 1296898 - RNA, 24 nt, Human
aagaaccccuuaaacguaaguuga

SEQ ID NO: 1296899 - RNA, 20 nt, Human
aagcagaaagggacuaucug

SEQ ID NO: 1296900 - RNA, 19 nt, Human
aggugugaagauccuugaa

SEQ ID NO: 1296901 - RNA, 21 nt, Human
aggugugaagauccuugaacu

SEQ ID NO: 1296902 - RNA, 18 nt, Human
cacuggaucuucuuuccu

SEQ ID NO: 1296903 - RNA, 22 nt, Human
ccauuuguggacuaacuaucuc

SEQ ID NO: 1296904 - RNA, 19 nt, Human
ccugccgaagaaggaugaa

SEQ ID NO: 1296905 - RNA, 23 nt, Human
cuagaaacaaaagcagaaaggga

SEQ ID NO: 1296906 - RNA, 18 nt, Human
gaagaaggaugaagugcu

SEQ ID NO: 1296907 - RNA, 24 nt, Human
gggguaguugcagguguaggccua

SEQ ID NO: 1296908 - RNA, 18 nt, Human
gugaagauccuugaacug

SEQ ID NO: 1296909 - RNA, 23 nt, Human
uagaaacaaaagcagaaagggac

SEQ ID NO: 1296910 - RNA, 18 nt, Human
ucacuggaucuucuuucc

SEQ ID NO: 1296911 - RNA, 24 nt, Human
uccaacaccacuuaucaugucaga

SEQ ID NO: 1296912 - RNA, 22 nt, Human
ugaaacugggguaguugcaggu

SEQ ID NO: 1296913 - RNA, 25 nt, Human
ugcaguaagaggugcuuuggguccu

SEQ ID NO: 1296914 - RNA, 26 nt, Human
ugguguuugcagaagagaugucuccc

SEQ ID NO: 1296915 - RNA, 19 nt, Human
ugugaagauccuugaacug

SEQ ID NO: 1296916 - RNA, 23 nt, Human
ugugaagauccuugaacuggggg

SEQ ID NO: 1296917 - RNA, 23 nt, Human
uguguuuauggauugacauucca

SEQ ID NO: 1296918 - RNA, 24 nt, Human
uguguuuauggauugacauuccau

SEQ ID NO: 1296919 - RNA, 25 nt, Human
uucauugucucaguuugucuggugu

SEQ ID NO: 1296920 - RNA, 21 nt, Human
uuggguccugcggaaguucau

SEQ ID NO: 1296921 - RNA, 19 nt, Human
uuggugccugccgaagaag

SEQ ID NO: 1296922 - RNA, 18 nt, Human
acgcgcugcucggcgcag

SEQ ID NO: 1296923 - RNA, 22 nt, Human
aggggugaccgggcggcggcgg

SEQ ID NO: 1296924 - RNA, 22 nt, Human
cacacacgcgcugcucggcgca

SEQ ID NO: 1296925 - RNA, 24 nt, Human
cacacgcgcugcucggcgcagccg

SEQ ID NO: 1296926 - RNA, 20 nt, Human
ccuccgggacacccagcgag

SEQ ID NO: 1296927 - RNA, 19 nt, Human
cgggacacccagcgagagg

SEQ ID NO: 1296928 - RNA, 19 nt, Human
cugcucggcgcagccgucu

SEQ ID NO: 1296929 - RNA, 21 nt, Human
gagaggggugaccgggcggcg

SEQ ID NO: 1296930 - RNA, 25 nt, Human
ggacuucugcacacacgcgcugcuc

SEQ ID NO: 1296931 - RNA, 23 nt, Human
aaagcggugagguuugaggaggg

SEQ ID NO: 1296932 - RNA, 22 nt, Human
accccagcuccagcccuggucu

SEQ ID NO: 1296933 - RNA, 21 nt, Human
accuucauaaggugguauggg

SEQ ID NO: 1296934 - RNA, 19 nt, Human
acgccuccacccgguccug

SEQ ID NO: 1296935 - RNA, 25 nt, Human
acuggucccgucuccucgcagaacc

SEQ ID NO: 1296936 - RNA, 22 nt, Human
agaggaaggagggggaucagag

SEQ ID NO: 1296937 - RNA, 18 nt, Human
aggaggggcagaagcagg

SEQ ID NO: 1296938 - RNA, 20 nt, Human
aggcagagaagagauggagu

SEQ ID NO: 1296939 - RNA, 27 nt, Human
aggcagagaagagauggagucuuaggg

SEQ ID NO: 1296940 - RNA, 19 nt, Human
agggggagggaggagagga

SEQ ID NO: 1296941 - RNA, 23 nt, Human
cagcuccagcccuggucuugucu

SEQ ID NO: 1296942 - RNA, 19 nt, Human
ccagaggcagagaagagau

SEQ ID NO: 1296943 - RNA, 21 nt, Human
ccagcuccagcccuggucuug

SEQ ID NO: 1296944 - RNA, 21 nt, Human
ccaggagggccagaggcagag

SEQ ID NO: 1296945 - RNA, 22 nt, Human
ccagggccuagaggugcuuccu

SEQ ID NO: 1296946 - RNA, 24 nt, Human
ccagggugagcgagggguccaggg

SEQ ID NO: 1296947 - RNA, 20 nt, Human
cccccuccccucuuccaccc

SEQ ID NO: 1296948 - RNA, 22 nt, Human
cccucuuccaccccagcuccag

SEQ ID NO: 1296949 - RNA, 24 nt, Human
cccucuuccccacgacagaagaag

SEQ ID NO: 1296950 - RNA, 20 nt, Human
ccuccacccgguccugccug

SEQ ID NO: 1296951 - RNA, 28 nt, Human
cuccccucuuccaccccagcuccagccc

SEQ ID NO: 1296952 - RNA, 21 nt, Human
cucguagagacgccuccaccc

SEQ ID NO: 1296953 - RNA, 18 nt, Human
cucuuccaccccagcucc

SEQ ID NO: 1296954 - RNA, 20 nt, Human
cuggucuugucuuuucaucc

SEQ ID NO: 1296955 - RNA, 21 nt, Human
cuuccaccccagcuccagccc

SEQ ID NO: 1296956 - RNA, 21 nt, Human
cuuuuuuuuuuuuuuccaggg

SEQ ID NO: 1296957 - RNA, 24 nt, Human
gaagagccaggagggccagaggca

SEQ ID NO: 1296958 - RNA, 19 nt, Human
gagaagagauggagucuua

SEQ ID NO: 1296959 - RNA, 24 nt, Human
gagaggaaggagggggaucagagc

SEQ ID NO: 1296960 - RNA, 18 nt, Human
gaggaaggagggggauca

SEQ ID NO: 1296961 - RNA, 19 nt, Human
gaggagaggaaggaggggg

SEQ ID NO: 1296962 - RNA, 21 nt, Human
gaggagaggaaggagggggau

SEQ ID NO: 1296963 - RNA, 19 nt, Human
gcccuggucuugucuuuuc

SEQ ID NO: 1296964 - RNA, 20 nt, Human
gcccuggucuugucuuuuca

SEQ ID NO: 1296965 - RNA, 22 nt, Human
gcccuggucuugucuuuucauc

SEQ ID NO: 1296966 - RNA, 22 nt, Human
gccuccacccgguccugccugu

SEQ ID NO: 1296967 - RNA, 20 nt, Human
ggaaugcagccagugucccc

SEQ ID NO: 1296968 - RNA, 18 nt, Human
ggagaggaaggaggggga

SEQ ID NO: 1296969 - RNA, 23 nt, Human
ggagggaggagaggaaggagggg

SEQ ID NO: 1296970 - RNA, 24 nt, Human
ggccuagaggugcuuccugggggc

SEQ ID NO: 1296971 - RNA, 18 nt, Human
ggcgggggaaugcagcca

SEQ ID NO: 1296972 - RNA, 19 nt, Human
gggcagaagcagggccggc

SEQ ID NO: 1296973 - RNA, 20 nt, Human
gggcagaagcagggccggca

SEQ ID NO: 1296974 - RNA, 19 nt, Human
gggccagggugagcgaggg

SEQ ID NO: 1296975 - RNA, 19 nt, Human
ggggagggaggagaggaag

SEQ ID NO: 1296976 - RNA, 24 nt, Human
ggggagggaggagaggaaggaggg

SEQ ID NO: 1296977 - RNA, 21 nt, Human
gguaugggggguuggggucag

SEQ ID NO: 1296978 - RNA, 24 nt, Human
gugucccccuccccucuuccaccc

SEQ ID NO: 1296979 - RNA, 19 nt, Human
uaugggggguuggggucag

SEQ ID NO: 1296980 - RNA, 19 nt, Human
ucacuggucccgucuccuc

SEQ ID NO: 1296981 - RNA, 21 nt, Human
ucaggggaaaaagucaagggg

SEQ ID NO: 1296982 - RNA, 19 nt, Human
uccaccccagcuccagccc

SEQ ID NO: 1296983 - RNA, 22 nt, Human
uccagggccuagaggugcuucc

SEQ ID NO: 1296984 - RNA, 24 nt, Human
uccagggggagggaggagaggaag

SEQ ID NO: 1296985 - RNA, 21 nt, Human
ucccccuccccucuuccaccc

SEQ ID NO: 1296986 - RNA, 22 nt, Human
ucccccuccccucuuccacccc

SEQ ID NO: 1296987 - RNA, 24 nt, Human
ugcagccagugucccccuccccuc

SEQ ID NO: 1296988 - RNA, 23 nt, Human
ugcucguagagacgccuccaccc

SEQ ID NO: 1296989 - RNA, 18 nt, Human
ugucaggggaaaaaguca

SEQ ID NO: 1296990 - RNA, 23 nt, Human
ugucuuuucaucccucuucccca

SEQ ID NO: 1296991 - RNA, 22 nt, Human
uuucuuuuccuuuuuuuuuuuu

SEQ ID NO: 1296992 - RNA, 24 nt, Human
uuuuuuuuuuccagggggagggag

SEQ ID NO: 1296993 - RNA, 28 nt, Human
aagccaguucuggaccagcuugccgcug

SEQ ID NO: 1296994 - RNA, 23 nt, Human
gugggcugaaugaacugcuuucu

SEQ ID NO: 1296995 - RNA, 20 nt, Human
aacaacuuuucacaagccga

SEQ ID NO: 1296996 - RNA, 20 nt, Human
caaacuguauccagcuuuau

SEQ ID NO: 1296997 - RNA, 18 nt, Human
cagcuuuauuaaagauac

SEQ ID NO: 1296998 - RNA, 22 nt, Human
ccacuguaaaacccaaugaagu

SEQ ID NO: 1296999 - RNA, 27 nt, Human
cucgaaauggaaccacugcucuuuuga

SEQ ID NO: 1297000 - RNA, 21 nt, Human
ggcaucacuggaaaguccaga

SEQ ID NO: 1297001 - RNA, 21 nt, Human
gggcagacagucguuaacagu

SEQ ID NO: 1297002 - RNA, 20 nt, Human
ucaggaagugaaaugaaagu

SEQ ID NO: 1297003 - RNA, 21 nt, Human
ucaggcaggacaugggcagac

SEQ ID NO: 1297004 - RNA, 20 nt, Human
ugccaaaaaucagaaagcca

SEQ ID NO: 1297005 - RNA, 22 nt, Human
ugccaaaaaucagaaagccacu

SEQ ID NO: 1297006 - RNA, 24 nt, Human
ugccaaaaaucagaaagccacugu

SEQ ID NO: 1297007 - RNA, 23 nt, Human
uggaaccacugcucuuuugacag

SEQ ID NO: 1297008 - RNA, 18 nt, Human
uggcaucacuggaaaguc

SEQ ID NO: 1297009 - RNA, 22 nt, Human
uucccuucuucaguggacugcc

SEQ ID NO: 1297010 - RNA, 29 nt, Human
uuuagagugaggguugacauuucacauuu

SEQ ID NO: 1297011 - RNA, 23 nt, Human
agggaaguguuggaccauuucca

SEQ ID NO: 1297012 - RNA, 26 nt, Human
ccagcccacuucccugugacaucacc

SEQ ID NO: 1297013 - RNA, 21 nt, Human
cccacuucccugugacaucac

SEQ ID NO: 1297014 - RNA, 18 nt, Human
cccagcccacuucccugu

SEQ ID NO: 1297015 - RNA, 21 nt, Human
ucccugugacaucaccuaccu

SEQ ID NO: 1297016 - RNA, 20 nt, Human
uggagagggaaguguuggac

SEQ ID NO: 1297017 - RNA, 21 nt, Human
ugugacaucaccuaccugguc

SEQ ID NO: 1297018 - RNA, 22 nt, Human
uuggagagggaaguguuggacc

SEQ ID NO: 1297019 - RNA, 20 nt, Human
aagcccaaguccaggagcuu

SEQ ID NO: 1297020 - RNA, 24 nt, Human
aggcuguuacuugcugcuggggcg

SEQ ID NO: 1297021 - RNA, 20 nt, Human
cagcugcuaagcccaagucc

SEQ ID NO: 1297022 - RNA, 19 nt, Human
ccugugagcggguggggau

SEQ ID NO: 1297023 - RNA, 22 nt, Human
ccugugagcggguggggauggg

SEQ ID NO: 1297024 - RNA, 18 nt, Human
ccuuguccugagcugcuc

SEQ ID NO: 1297025 - RNA, 24 nt, Human
ccuuguccugagcugcucuuucuc

SEQ ID NO: 1297026 - RNA, 21 nt, Human
cucaggaaacugauggcugga

SEQ ID NO: 1297027 - RNA, 23 nt, Human
cugccaggcaggcuguuacuugc

SEQ ID NO: 1297028 - RNA, 20 nt, Human
gcuggauacuccuugcucag

SEQ ID NO: 1297029 - RNA, 18 nt, Human
gcuguuacuugcugcugg

SEQ ID NO: 1297030 - RNA, 20 nt, Human
guccugagcugcucuuucuc

SEQ ID NO: 1297031 - RNA, 18 nt, Human
gugcaaggcucgcugcca

SEQ ID NO: 1297032 - RNA, 20 nt, Human
ugccugugagcgggugggga

SEQ ID NO: 1297033 - RNA, 23 nt, Human
ugccugugagcggguggggaugg

SEQ ID NO: 1297034 - RNA, 27 nt, Human
ugcuggggcgguguccuuguccugagc

SEQ ID NO: 1297035 - RNA, 21 nt, Human
uguccuuguccugagcugcuc

SEQ ID NO: 1297036 - RNA, 22 nt, Human
uguccuuguccugagcugcucu

SEQ ID NO: 1297037 - RNA, 20 nt, Human
ugugagcggguggggauggg

SEQ ID NO: 1297038 - RNA, 26 nt, Human
ugugagcggguggggaugggcccgug

SEQ ID NO: 1297039 - RNA, 23 nt, Human
uguuauggggaaaaggcaagagg

SEQ ID NO: 1297040 - RNA, 21 nt, Human
agaggucuuaaaacccugcuc

SEQ ID NO: 1297041 - RNA, 18 nt, Human
caaggacucaucauuuuu

SEQ ID NO: 1297042 - RNA, 19 nt, Human
caggugcagugaaaagagg

SEQ ID NO: 1297043 - RNA, 25 nt, Human
cccugcuccaaguuuccaguugggg

SEQ ID NO: 1297044 - RNA, 24 nt, Human
uaacuucuauguuccaggugcccc

SEQ ID NO: 1297045 - RNA, 20 nt, Human
ucagcagagggcacaacuga

SEQ ID NO: 1297046 - RNA, 19 nt, Human
uucaaagugagaaagcaga

SEQ ID NO: 1297047 - RNA, 22 nt, Human
aaaaaaaaaaaaaagcccagag

SEQ ID NO: 1297048 - RNA, 29 nt, Human
aaaaaaaaaaaagcccagaguucaaaaga

SEQ ID NO: 1297049 - RNA, 19 nt, Human
aaaaaaaaaaagcccagag

SEQ ID NO: 1297050 - RNA, 26 nt, Human
aaaaaaaaaaagcccagaguucaagg

SEQ ID NO: 1297051 - RNA, 20 nt, Human
aaaaaaagaaaaaauauaua

SEQ ID NO: 1297052 - RNA, 23 nt, Human
aaaaaagcccagaguucaaggcu

SEQ ID NO: 1297053 - RNA, 24 nt, Human
aaucgcuugauugggggaggugga

SEQ ID NO: 1297054 - RNA, 18 nt, Human
aauuagccaggcauggug

SEQ ID NO: 1297055 - RNA, 24 nt, Human
acuauauucauacuuggaagcacu

SEQ ID NO: 1297056 - RNA, 24 nt, Human
acugcacuccagccuggacgacag

SEQ ID NO: 1297057 - RNA, 26 nt, Human
acugcacuccagccuggacgacagag

SEQ ID NO: 1297058 - RNA, 18 nt, Human
acugcauuccagccuggg

SEQ ID NO: 1297059 - RNA, 18 nt, Human
acugcauuccagccuggg

SEQ ID NO: 1297060 - RNA, 22 nt, Human
agaaaaaaaaaugcagauagag

SEQ ID NO: 1297061 - RNA, 18 nt, Human
agccaggcaugguggugc

SEQ ID NO: 1297062 - RNA, 24 nt, Human
agcccagaguucaaggcugcagug

SEQ ID NO: 1297063 - RNA, 25 nt, Human
agccuggacgacagagcugagacuc

SEQ ID NO: 1297064 - RNA, 22 nt, Human
aggcaugguggugcacaccuaa

SEQ ID NO: 1297065 - RNA, 24 nt, Human
aggcugagacaggacaaucgcuug

SEQ ID NO: 1297066 - RNA, 24 nt, Human
agguggaggcuacagugagccgag

SEQ ID NO: 1297067 - RNA, 22 nt, Human
auagagaaaacuuuuagaguca

SEQ ID NO: 1297068 - RNA, 20 nt, Human
aucucaaaaaaaaaaaaaag

SEQ ID NO: 1297069 - RNA, 22 nt, Human
aucucaaccggaaccucugacu

SEQ ID NO: 1297070 - RNA, 22 nt, Human
caaucgcuugauugggggaggu

SEQ ID NO: 1297071 - RNA, 21 nt, Human
caccuaaaaucccagcuacuc

SEQ ID NO: 1297072 - RNA, 25 nt, Human
caccuaaaaucccagcuacucugga

SEQ ID NO: 1297073 - RNA, 18 nt, Human
cacugcacuccagccugg

SEQ ID NO: 1297074 - RNA, 18 nt, Human
cacugcacuccagccugg

SEQ ID NO: 1297075 - RNA, 19 nt, Human
cacugcacuccagccugga

SEQ ID NO: 1297076 - RNA, 19 nt, Human
cacugcacuccagccugga

SEQ ID NO: 1297077 - RNA, 20 nt, Human
cacugcacuccagccuggac

SEQ ID NO: 1297078 - RNA, 21 nt, Human
cacugcacuccagccuggacg

SEQ ID NO: 1297079 - RNA, 22 nt, Human
cacugcacuccagccuggacga

SEQ ID NO: 1297080 - RNA, 23 nt, Human
cacugcacuccagccuggacgac

SEQ ID NO: 1297081 - RNA, 24 nt, Human
cacugcacuccagccuggacgaca

SEQ ID NO: 1297082 - RNA, 19 nt, Human
cacugcauuccagccuggg

SEQ ID NO: 1297083 - RNA, 19 nt, Human
cacugcauuccagccuggg

SEQ ID NO: 1297084 - RNA, 23 nt, Human
cacugcauuccagccugggagca

SEQ ID NO: 1297085 - RNA, 24 nt, Human
cacugcauuccagccugggagcaa

SEQ ID NO: 1297086 - RNA, 22 nt, Human
cagaguucaaggcugcagugcc

SEQ ID NO: 1297087 - RNA, 19 nt, Human
cagccugggagcaaaguga

SEQ ID NO: 1297088 - RNA, 20 nt, Human
cauagaaauacagaaccagu

SEQ ID NO: 1297089 - RNA, 24 nt, Human
caugagucacugcacuccagccug

SEQ ID NO: 1297090 - RNA, 19 nt, Human
ccacugcauuccagccugg

SEQ ID NO: 1297091 - RNA, 20 nt, Human
ccacugcauuccagccuggg

SEQ ID NO: 1297092 - RNA, 20 nt, Human
ccacugcauuccagccuggg

SEQ ID NO: 1297093 - RNA, 22 nt, Human
ccacugcauuccagccugggag

SEQ ID NO: 1297094 - RNA, 23 nt, Human
ccacugcauuccagccugggagc

SEQ ID NO: 1297095 - RNA, 28 nt, Human
ccucugaauagccacugcauuccagccu

SEQ ID NO: 1297096 - RNA, 21 nt, Human
cgccgcggcccggcagggggc

SEQ ID NO: 1297097 - RNA, 24 nt, Human
cucaaaaaaaaaaaaaagcccaga

SEQ ID NO: 1297098 - RNA, 26 nt, Human
cuccaucucaaaaaaaaaaaaaagcc

SEQ ID NO: 1297099 - RNA, 22 nt, Human
cuguugauaauagcugcuucuc

SEQ ID NO: 1297100 - RNA, 24 nt, Human
gaauagccacugcauuccagccug

SEQ ID NO: 1297101 - RNA, 24 nt, Human
gagacaugagucacugcacuccag

SEQ ID NO: 1297102 - RNA, 24 nt, Human
gcacuccagccuggacgacagagc

SEQ ID NO: 1297103 - RNA, 21 nt, Human
ggagguggaggcuacagugag

SEQ ID NO: 1297104 - RNA, 24 nt, Human
ggggagguggaggcuacagugagc

SEQ ID NO: 1297105 - RNA, 23 nt, Human
ggugugucucccaacuugaucuc

SEQ ID NO: 1297106 - RNA, 21 nt, Human
guggugcacaccuaaaauccc

SEQ ID NO: 1297107 - RNA, 24 nt, Human
guuacaucacaguuguccucgacu

SEQ ID NO: 1297108 - RNA, 21 nt, Human
uaaaaauacaaaaauuagcca

SEQ ID NO: 1297109 - RNA, 23 nt, Human
uaaaauagaaaaaaaaaugcaga

SEQ ID NO: 1297110 - RNA, 20 nt, Human
uagagucagauccaaacauu

SEQ ID NO: 1297111 - RNA, 23 nt, Human
ucaaaaaaaaaaaaaagcccaga

SEQ ID NO: 1297112 - RNA, 23 nt, Human
ucaaaaaaaaaaaaaagcccaga

SEQ ID NO: 1297113 - RNA, 24 nt, Human
ucaaaaaaaaaaaaaagcccagag

SEQ ID NO: 1297114 - RNA, 18 nt, Human
ucacugcacuccagccug

SEQ ID NO: 1297115 - RNA, 21 nt, Human
ucacugcacuccagccuggac

SEQ ID NO: 1297116 - RNA, 24 nt, Human
ucacugcacuccagccuggacgac

SEQ ID NO: 1297117 - RNA, 25 nt, Human
uccagccuggacgacagagcugaga

SEQ ID NO: 1297118 - RNA, 22 nt, Human
uccaucucaaaaaaaaaaaaaa

SEQ ID NO: 1297119 - RNA, 23 nt, Human
uccaucucaaaaaaaaaaaaaag

SEQ ID NO: 1297120 - RNA, 24 nt, Human
ucgcuugauugggggagguggagg

SEQ ID NO: 1297121 - RNA, 26 nt, Human
ucuccuauagagaaaacuuuuagagu

SEQ ID NO: 1297122 - RNA, 21 nt, Human
ucucuacuaaaaauacaaaaa

SEQ ID NO: 1297123 - RNA, 18 nt, Human
ucuguuuuguuuuguuug

SEQ ID NO: 1297124 - RNA, 21 nt, Human
ugaauagccacugcauuccag

SEQ ID NO: 1297125 - RNA, 19 nt, Human
ugauugggggagguggagg

SEQ ID NO: 1297126 - RNA, 21 nt, Human
ugcccaaugauuaagccucug

SEQ ID NO: 1297127 - RNA, 25 nt, Human
ugcccaaugauuaagccucugaaua

SEQ ID NO: 1297128 - RNA, 22 nt, Human
uggugcacaccuaaaaucccag

SEQ ID NO: 1297129 - RNA, 23 nt, Human
ugguggugcacaccuaaaauccc

SEQ ID NO: 1297130 - RNA, 19 nt, Human
uguauaauuggcaugcaua

SEQ ID NO: 1297131 - RNA, 21 nt, Human
uguccucgacuacagaaacag

SEQ ID NO: 1297132 - RNA, 21 nt, Human
ugucucuaaaaaaagaaaaaa

SEQ ID NO: 1297133 - RNA, 18 nt, Human
uugcugacaccgcccucg

SEQ ID NO: 1297134 - RNA, 23 nt, Human
uuuaaaaacaagauuuuccauuu

SEQ ID NO: 1297135 - RNA, 27 nt, Human
uuugcugacaccgcccucggaaguaaa

SEQ ID NO: 1297136 - RNA, 21 nt, Human
aaacacaaaugaaaacucacc

SEQ ID NO: 1297137 - RNA, 24 nt, Human
aaacucacacccacccacccccaa

SEQ ID NO: 1297138 - RNA, 21 nt, Human
aaaugaaaacucacacccacc

SEQ ID NO: 1297139 - RNA, 20 nt, Human
aacacaaaugaaaacucaca

SEQ ID NO: 1297140 - RNA, 22 nt, Human
aagcagagugccagggagugag

SEQ ID NO: 1297141 - RNA, 25 nt, Human
aagcagagugccagggagugaggag

SEQ ID NO: 1297142 - RNA, 19 nt, Human
aagcggauccugggcagcg

SEQ ID NO: 1297143 - RNA, 24 nt, Human
acacccacccacccccaagugcau

SEQ ID NO: 1297144 - RNA, 18 nt, Human
acagcgagaggccgagua

SEQ ID NO: 1297145 - RNA, 18 nt, Human
acccacccacccccaagu

SEQ ID NO: 1297146 - RNA, 19 nt, Human
acuccaccagcaggcccac

SEQ ID NO: 1297147 - RNA, 20 nt, Human
acuccaccagcaggcccacc

SEQ ID NO: 1297148 - RNA, 19 nt, Human
agaaagcagagugccaggg

SEQ ID NO: 1297149 - RNA, 22 nt, Human
agaagaaagcagagugccaggg

SEQ ID NO: 1297150 - RNA, 24 nt, Human
agaagaaagcagagugccagggag

SEQ ID NO: 1297151 - RNA, 23 nt, Human
agcacaaggaaaaccaggagaga

SEQ ID NO: 1297152 - RNA, 19 nt, Human
aggagcaggagaaacccau

SEQ ID NO: 1297153 - RNA, 20 nt, Human
auccuuucuuuuuuuuuucu

SEQ ID NO: 1297154 - RNA, 21 nt, Human
caacgguguggucagcagccc

SEQ ID NO: 1297155 - RNA, 19 nt, Human
caagucccuagcacagcga

SEQ ID NO: 1297156 - RNA, 20 nt, Human
caccagcaacggugugguca

SEQ ID NO: 1297157 - RNA, 21 nt, Human
caccagcaacgguguggucag

SEQ ID NO: 1297158 - RNA, 22 nt, Human
cacccccaagugcaugucucca

SEQ ID NO: 1297159 - RNA, 25 nt, Human
cagcaggcccacccuuccagucaag

SEQ ID NO: 1297160 - RNA, 19 nt, Human
cagcgccagccccgaggag

SEQ ID NO: 1297161 - RNA, 22 nt, Human
ccaagugcaugucuccaucacu

SEQ ID NO: 1297162 - RNA, 21 nt, Human
ccaccagcaggcccacccuuc

SEQ ID NO: 1297163 - RNA, 19 nt, Human
ccauuugaaaauauccuuu

SEQ ID NO: 1297164 - RNA, 22 nt, Human
cccaucaucgacaagggcuguc

SEQ ID NO: 1297165 - RNA, 24 nt, Human
ccccaacuccaccagcaggcccac

SEQ ID NO: 1297166 - RNA, 20 nt, Human
cccccaagugcaugucucca

SEQ ID NO: 1297167 - RNA, 18 nt, Human
ccugggcagcgccagccc

SEQ ID NO: 1297168 - RNA, 18 nt, Human
cucacacccacccacccc

SEQ ID NO: 1297169 - RNA, 21 nt, Human
cugucccaagucaauggaaag

SEQ ID NO: 1297170 - RNA, 24 nt, Human
gaaaacucacacccacccaccccc

SEQ ID NO: 1297171 - RNA, 18 nt, Human
gaaagggaaagggugggg

SEQ ID NO: 1297172 - RNA, 22 nt, Human
gaagguuggggggacccagcaa

SEQ ID NO: 1297173 - RNA, 19 nt, Human
gacaagggcugucccaagu

SEQ ID NO: 1297174 - RNA, 18 nt, Human
gagagucugccuccagga

SEQ ID NO: 1297175 - RNA, 19 nt, Human
gccgaguacgccgaggccc

SEQ ID NO: 1297176 - RNA, 20 nt, Human
ggacucagagagucagacag

SEQ ID NO: 1297177 - RNA, 18 nt, Human
ggaggagcaggagaaacc

SEQ ID NO: 1297178 - RNA, 22 nt, Human
ggauccugggcagcgccagccc

SEQ ID NO: 1297179 - RNA, 18 nt, Human
uagaagugacggagagaa

SEQ ID NO: 1297180 - RNA, 20 nt, Human
ucacacccacccacccccaa

SEQ ID NO: 1297181 - RNA, 23 nt, Human
ucacacccacccacccccaagug

SEQ ID NO: 1297182 - RNA, 22 nt, Human
ucuccauugguggccccagcuc

SEQ ID NO: 1297183 - RNA, 22 nt, Human
ucugaauaaaguuggaaaaaga

SEQ ID NO: 1297184 - RNA, 19 nt, Human
ucugccucguauguucaga

SEQ ID NO: 1297185 - RNA, 20 nt, Human
ugaaaauauccuuucuuuuu

SEQ ID NO: 1297186 - RNA, 18 nt, Human
ugacggagagaagacuug

SEQ ID NO: 1297187 - RNA, 18 nt, Human
ugacggagagaagacuug

SEQ ID NO: 1297188 - RNA, 18 nt, Human
uggcuugaacucuuaggg

SEQ ID NO: 1297189 - RNA, 26 nt, Human
uggggguuaggggaagguugggggga

SEQ ID NO: 1297190 - RNA, 21 nt, Human
uguggucagcagccccaacuc

SEQ ID NO: 1297191 - RNA, 20 nt, Human
uucugccucguauguucaga

SEQ ID NO: 1297192 - RNA, 18 nt, Human
uuugaaaauauccuuucu

SEQ ID NO: 1297193 - RNA, 19 nt, Human
aaaaaaaaaaaaaauuagc

SEQ ID NO: 1297194 - RNA, 22 nt, Human
aaaccccaucucuacuaaaaaa

SEQ ID NO: 1297195 - RNA, 20 nt, Human
aaagcacauaucuuuuacaa

SEQ ID NO: 1297196 - RNA, 19 nt, Human
aacauggcgaaaccccauc

SEQ ID NO: 1297197 - RNA, 20 nt, Human
aacauggcgaaaccccaucu

SEQ ID NO: 1297198 - RNA, 21 nt, Human
aacauggcgaaaccccaucuc

SEQ ID NO: 1297199 - RNA, 21 nt, Human
aacauggcgaaaccccaucuc

SEQ ID NO: 1297200 - RNA, 19 nt, Human
aagaaaccggucaggcagg

SEQ ID NO: 1297201 - RNA, 20 nt, Human
aagcaaugaagaucgagcca

SEQ ID NO: 1297202 - RNA, 21 nt, Human
aaguagacuuaugauuaugga

SEQ ID NO: 1297203 - RNA, 23 nt, Human
aaguagacuuaugauuauggaau

SEQ ID NO: 1297204 - RNA, 24 nt, Human
aauacaaaaaaaaaaaaaauuagc

SEQ ID NO: 1297205 - RNA, 20 nt, Human
acaaaagguagucaaaaaca

SEQ ID NO: 1297206 - RNA, 19 nt, Human
acacuuugggaggcacagg

SEQ ID NO: 1297207 - RNA, 25 nt, Human
accccaucucuacuaaaaaauacaa

SEQ ID NO: 1297208 - RNA, 23 nt, Human
acuaaaaaauacaaaaaaaaaaa

SEQ ID NO: 1297209 - RNA, 19 nt, Human
agaagaaaggaagaaaccg

SEQ ID NO: 1297210 - RNA, 20 nt, Human
agaagaaaggaagaaaccgg

SEQ ID NO: 1297211 - RNA, 24 nt, Human
agaguggauccuuaguugaauucu

SEQ ID NO: 1297212 - RNA, 19 nt, Human
aggcagaguggauccuuag

SEQ ID NO: 1297213 - RNA, 18 nt, Human
aggcaggcagaguggauc

SEQ ID NO: 1297214 - RNA, 21 nt, Human
aggcaggcagaguggauccuu

SEQ ID NO: 1297215 - RNA, 24 nt, Human
aggcgggcggaucacgaggucagg

SEQ ID NO: 1297216 - RNA, 23 nt, Human
aguggcucacgccuguaauccca

SEQ ID NO: 1297217 - RNA, 24 nt, Human
caacacuuugggaggcacaggcgg

SEQ ID NO: 1297218 - RNA, 25 nt, Human
cacaggcgggcggaucacgagguca

SEQ ID NO: 1297219 - RNA, 26 nt, Human
caccagaacagaaggaauacugccag

SEQ ID NO: 1297220 - RNA, 24 nt, Human
cacgccuguaaucccaacacuuug

SEQ ID NO: 1297221 - RNA, 20 nt, Human
cacugcagagcagcuggggu

SEQ ID NO: 1297222 - RNA, 18 nt, Human
cacuuugggaggcacagg

SEQ ID NO: 1297223 - RNA, 23 nt, Human
cagaacagaaggaauacugccag

SEQ ID NO: 1297224 - RNA, 18 nt, Human
caggcaggcagaguggau

SEQ ID NO: 1297225 - RNA, 26 nt, Human
cauaucuccggccugagauggucaau

SEQ ID NO: 1297226 - RNA, 23 nt, Human
ccagaacagaaggaauacugcca

SEQ ID NO: 1297227 - RNA, 23 nt, Human
ccagaccauccuggcuaacaugg

SEQ ID NO: 1297228 - RNA, 23 nt, Human
ccagcccugaaucuuggagcaga

SEQ ID NO: 1297229 - RNA, 24 nt, Human
ccuggcuaacauggcgaaacccca

SEQ ID NO: 1297230 - RNA, 19 nt, Human
cgaaaccccaucucuacua

SEQ ID NO: 1297231 - RNA, 24 nt, Human
cgccuguaaucccaacacuuuggg

SEQ ID NO: 1297232 - RNA, 19 nt, Human
cuacuaaaaaauacaaaaa

SEQ ID NO: 1297233 - RNA, 22 nt, Human
cuacuaaaaaauacaaaaaaaa

SEQ ID NO: 1297234 - RNA, 22 nt, Human
cucacgccuguaaucccaacac

SEQ ID NO: 1297235 - RNA, 24 nt, Human
cucacgccuguaaucccaacacuu

SEQ ID NO: 1297236 - RNA, 21 nt, Human
cuggaggcugggcacaguggc

SEQ ID NO: 1297237 - RNA, 23 nt, Human
cuggcuaacauggcgaaacccca

SEQ ID NO: 1297238 - RNA, 22 nt, Human
gagagagaagaaaggaagaaac

SEQ ID NO: 1297239 - RNA, 18 nt, Human
gaugagagagaagaaagg

SEQ ID NO: 1297240 - RNA, 24 nt, Human
gcuaacauggcgaaaccccaucuc

SEQ ID NO: 1297241 - RNA, 19 nt, Human
gcuggaggcugggcacagu

SEQ ID NO: 1297242 - RNA, 19 nt, Human
gcugggcacaguggcucac

SEQ ID NO: 1297243 - RNA, 24 nt, Human
ggccacaaaagguagucaaaaaca

SEQ ID NO: 1297244 - RNA, 21 nt, Human
ggcggaucacgaggucaggag

SEQ ID NO: 1297245 - RNA, 18 nt, Human
gggcacaguggcucacgc

SEQ ID NO: 1297246 - RNA, 24 nt, Human
gggcacaguggcucacgccuguaa

SEQ ID NO: 1297247 - RNA, 23 nt, Human
ggguugcaccucagcugucuaua

SEQ ID NO: 1297248 - RNA, 23 nt, Human
ggugagaggaaacacagaaggga

SEQ ID NO: 1297249 - RNA, 21 nt, Human
guugggcauaucuccggccug

SEQ ID NO: 1297250 - RNA, 20 nt, Human
guuuccuggcucauugugga

SEQ ID NO: 1297251 - RNA, 20 nt, Human
uaaaaaaaucaugcuggagg

SEQ ID NO: 1297252 - RNA, 24 nt, Human
uaacauggcgaaaccccaucucua

SEQ ID NO: 1297253 - RNA, 24 nt, Human
uaaccaaauacuuaaaagcacaua

SEQ ID NO: 1297254 - RNA, 19 nt, Human
uagcuuacuacagaaugau

SEQ ID NO: 1297255 - RNA, 18 nt, Human
ucacgaggucaggagauc

SEQ ID NO: 1297256 - RNA, 24 nt, Human
ucacgaggucaggagauccagacc

SEQ ID NO: 1297257 - RNA, 25 nt, Human
ucaggugagaggaaacacagaaggg

SEQ ID NO: 1297258 - RNA, 21 nt, Human
uccagaggaaagcaaugaaga

SEQ ID NO: 1297259 - RNA, 22 nt, Human
ucucugaagauacguguauugc

SEQ ID NO: 1297260 - RNA, 18 nt, Human
ucugugcaccaggaggau

SEQ ID NO: 1297261 - RNA, 19 nt, Human
ugaaagugcccacaauagg

SEQ ID NO: 1297262 - RNA, 20 nt, Human
ugcuggaggcugggcacagu

SEQ ID NO: 1297263 - RNA, 21 nt, Human
uggcucacgccuguaauccca

SEQ ID NO: 1297264 - RNA, 24 nt, Human
uggcucacgccuguaaucccaaca

SEQ ID NO: 1297265 - RNA, 19 nt, Human
ugggaggcacaggcgggcg

SEQ ID NO: 1297266 - RNA, 24 nt, Human
ugggaggcacaggcgggcggauca

SEQ ID NO: 1297267 - RNA, 18 nt, Human
uggggccuugaaagugcc

SEQ ID NO: 1297268 - RNA, 18 nt, Human
uggucacccgucagaauc

SEQ ID NO: 1297269 - RNA, 23 nt, Human
uuaaaagcacauaucuuuuacaa

SEQ ID NO: 1297270 - RNA, 23 nt, Human
uuauggaaucauaauuuccuugu

SEQ ID NO: 1297271 - RNA, 21 nt, Human
uugcacaauaaccaaauacuu

SEQ ID NO: 1297272 - RNA, 20 nt, Human
aaagugacgggucagccccg

SEQ ID NO: 1297273 - RNA, 19 nt, Human
aagcugcugggacugaggu

SEQ ID NO: 1297274 - RNA, 18 nt, Human
aaugcugaagagccagga

SEQ ID NO: 1297275 - RNA, 22 nt, Human
aaugcugaagagccaggagagg

SEQ ID NO: 1297276 - RNA, 20 nt, Human
acucuacuccacuauggucc

SEQ ID NO: 1297277 - RNA, 19 nt, Human
agaagcugcugggacugag

SEQ ID NO: 1297278 - RNA, 22 nt, Human
agcggcagcuaggcccagcgcg

SEQ ID NO: 1297279 - RNA, 22 nt, Human
aggaacagugggaacacauuuc

SEQ ID NO: 1297280 - RNA, 25 nt, Human
cacaguacccucagcuuaaaaugag

SEQ ID NO: 1297281 - RNA, 23 nt, Human
cacccauuccugggggcccucca

SEQ ID NO: 1297282 - RNA, 19 nt, Human
cagcgcgcgcacgaagggg

SEQ ID NO: 1297283 - RNA, 24 nt, Human
cagugagccuuuauccguggcggc

SEQ ID NO: 1297284 - RNA, 20 nt, Human
ccagaagugaauacucuacu

SEQ ID NO: 1297285 - RNA, 23 nt, Human
ccauuccugggggcccuccauuc

SEQ ID NO: 1297286 - RNA, 22 nt, Human
ccccacuacuaauuggcaucug

SEQ ID NO: 1297287 - RNA, 21 nt, Human
ccccgaggucacucgcgcccc

SEQ ID NO: 1297288 - RNA, 18 nt, Human
ccccgccccguuccgaga

SEQ ID NO: 1297289 - RNA, 22 nt, Human
cccgccccguuccgagagaggg

SEQ ID NO: 1297290 - RNA, 21 nt, Human
cccucagcuuaaaaugaggau

SEQ ID NO: 1297291 - RNA, 18 nt, Human
cccugugcccaaagcucc

SEQ ID NO: 1297292 - RNA, 23 nt, Human
ccugagcggcagcuaggcccagc

SEQ ID NO: 1297293 - RNA, 19 nt, Human
ccugccagugcccuucccu

SEQ ID NO: 1297294 - RNA, 22 nt, Human
ccugugcccaaagcuccagccc

SEQ ID NO: 1297295 - RNA, 23 nt, Human
ccuuccccgccccguuccgagag

SEQ ID NO: 1297296 - RNA, 23 nt, Human
cgacagaaaaggguuucugucuc

SEQ ID NO: 1297297 - RNA, 18 nt, Human
cgcucggucccccugcgg

SEQ ID NO: 1297298 - RNA, 19 nt, Human
cuaccgaucugcaguugcg

SEQ ID NO: 1297299 - RNA, 22 nt, Human
cuauggucccugugcccaaagc

SEQ ID NO: 1297300 - RNA, 23 nt, Human
cuccaauagccuccgcucggucc

SEQ ID NO: 1297301 - RNA, 21 nt, Human
cuccacuauggucccugugcc

SEQ ID NO: 1297302 - RNA, 22 nt, Human
cuggaaggagcuaugguucuca

SEQ ID NO: 1297303 - RNA, 18 nt, Human
cugggggcccuccauuca

SEQ ID NO: 1297304 - RNA, 20 nt, Human
gacccugagcggcagcuagg

SEQ ID NO: 1297305 - RNA, 22 nt, Human
gagaagaaugcugaagagccag

SEQ ID NO: 1297306 - RNA, 18 nt, Human
gcaaggagaggacgcgac

SEQ ID NO: 1297307 - RNA, 20 nt, Human
gcccuggucuggggcugcgg

SEQ ID NO: 1297308 - RNA, 21 nt, Human
ggaaggcuccuguuucagccc

SEQ ID NO: 1297309 - RNA, 18 nt, Human
ggccagaagugaauacuc

SEQ ID NO: 1297310 - RNA, 22 nt, Human
ggccagaagugaauacucuacu

SEQ ID NO: 1297311 - RNA, 19 nt, Human
gggggcccuccauucagug

SEQ ID NO: 1297312 - RNA, 22 nt, Human
gucagccccgacccugagcggc

SEQ ID NO: 1297313 - RNA, 19 nt, Human
gucuggacaaucucuaagg

SEQ ID NO: 1297314 - RNA, 22 nt, Human
uaccgaucugcaguugcguccu

SEQ ID NO: 1297315 - RNA, 21 nt, Human
ucagcuuaaaaugaggaugcu

SEQ ID NO: 1297316 - RNA, 25 nt, Human
uccaauagccuccgcucgguccccc

SEQ ID NO: 1297317 - RNA, 27 nt, Human
ucccccugcggcucgcaaggagaggac

SEQ ID NO: 1297318 - RNA, 21 nt, Human
ucccugugcccaaagcuccag

SEQ ID NO: 1297319 - RNA, 18 nt, Human
ucuccaggagcgggccgg

SEQ ID NO: 1297320 - RNA, 23 nt, Human
ucucuaagguucuucuagaaugg

SEQ ID NO: 1297321 - RNA, 18 nt, Human
ucugcaguugcguccuuu

SEQ ID NO: 1297322 - RNA, 18 nt, Human
ugaggaugcuggucugga

SEQ ID NO: 1297323 - RNA, 20 nt, Human
ugagggagagaagcugcugg

SEQ ID NO: 1297324 - RNA, 21 nt, Human
ugagggagagaagcugcuggg

SEQ ID NO: 1297325 - RNA, 20 nt, Human
ugcggcuccaauagccuccg

SEQ ID NO: 1297326 - RNA, 22 nt, Human
ugcguccuuuccugccagugcc

SEQ ID NO: 1297327 - RNA, 23 nt, Human
uggcggccuccggcuaccgaucu

SEQ ID NO: 1297328 - RNA, 20 nt, Human
uggcucugugacuuucuugc

SEQ ID NO: 1297329 - RNA, 22 nt, Human
ugggggcccuccauucaguguu

SEQ ID NO: 1297330 - RNA, 25 nt, Human
uuccugggggcccuccauucagugu

SEQ ID NO: 1297331 - RNA, 19 nt, Human
uugcguccuuuccugccag

SEQ ID NO: 1297332 - RNA, 19 nt, Human
uuuauccguggcggccucc

SEQ ID NO: 1297333 - RNA, 28 nt, Human
ggauauaggugcuacuuagguuucacuu

SEQ ID NO: 1297334 - RNA, 20 nt, Human
guuuuauauuggauauaggu

SEQ ID NO: 1297335 - RNA, 18 nt, Human
uucacuuucauauaaaaa

SEQ ID NO: 1297336 - RNA, 19 nt, Human
acccgggcagcgcccuucu

SEQ ID NO: 1297337 - RNA, 21 nt, Human
agcacccgggcagcgcccuuc

SEQ ID NO: 1297338 - RNA, 18 nt, Human
aggaagaaacugguaccc

SEQ ID NO: 1297339 - RNA, 19 nt, Human
auggcucuggucauggcuc

SEQ ID NO: 1297340 - RNA, 22 nt, Human
cacgcggccgcggaggcucacc

SEQ ID NO: 1297341 - RNA, 20 nt, Human
cacgggcaggaagcgcagga

SEQ ID NO: 1297342 - RNA, 20 nt, Human
cagcacccgggcagcgcccu

SEQ ID NO: 1297343 - RNA, 22 nt, Human
caggaagaaacugguacccuua

SEQ ID NO: 1297344 - RNA, 20 nt, Human
cccggcuucagccgcgacca

SEQ ID NO: 1297345 - RNA, 21 nt, Human
cccggcuucagccgcgaccac

SEQ ID NO: 1297346 - RNA, 21 nt, Human
gaggcucaccugagggcucac

SEQ ID NO: 1297347 - RNA, 19 nt, Human
gcaggaagcgcagggcggc

SEQ ID NO: 1297348 - RNA, 18 nt, Human
gcagggcggcuuggaggc

SEQ ID NO: 1297349 - RNA, 19 nt, Human
gcccaggcccggcuucagc

SEQ ID NO: 1297350 - RNA, 19 nt, Human
gggaagauggagccgggcu

SEQ ID NO: 1297351 - RNA, 21 nt, Human
guggcagcccguggcgggcac

SEQ ID NO: 1297352 - RNA, 20 nt, Human
ugcccaggcccggcuucagc

SEQ ID NO: 1297353 - RNA, 23 nt, Human
uggcagcccguggcgggcacugu

SEQ ID NO: 1297354 - RNA, 20 nt, Human
uggccagagauaaggcacug

SEQ ID NO: 1297355 - RNA, 18 nt, Human
uggcucaggaagaaacug

SEQ ID NO: 1297356 - RNA, 19 nt, Human
uggcucaggaagaaacugg

SEQ ID NO: 1297357 - RNA, 23 nt, Human
ugggaauggcucuggucauggcu

SEQ ID NO: 1297358 - RNA, 18 nt, Human
ugucagacacgggcagga

SEQ ID NO: 1297359 - RNA, 23 nt, Human
uuccuugaguggcagcccguggc

SEQ ID NO: 1297360 - RNA, 23 nt, Human
aaucucagaauucauuuucuuuu

SEQ ID NO: 1297361 - RNA, 21 nt, Human
cccgacaucuucccaauggac

SEQ ID NO: 1297362 - RNA, 24 nt, Human
cuuguaauauucuggcauucugcu

SEQ ID NO: 1297363 - RNA, 24 nt, Human
gaauugguucuugucuucuguggu

SEQ ID NO: 1297364 - RNA, 26 nt, Human
ucuucccaauggaccuuccaguaccu

SEQ ID NO: 1297365 - RNA, 18 nt, Human
aaaugaccuuccugcauc

SEQ ID NO: 1297366 - RNA, 20 nt, Human
aagcauuuggcagacaaucc

SEQ ID NO: 1297367 - RNA, 18 nt, Human
acgcugccaacucuugcc

SEQ ID NO: 1297368 - RNA, 27 nt, Human
auaauaauggugauaauuuucuuggug

SEQ ID NO: 1297369 - RNA, 26 nt, Human
caaccgcacgcugccaacucuugcca

SEQ ID NO: 1297370 - RNA, 24 nt, Human
caaccugaucaaacaacucccaag

SEQ ID NO: 1297371 - RNA, 19 nt, Human
ccaaggucuucccagcucc

SEQ ID NO: 1297372 - RNA, 18 nt, Human
cgcuauuaaaaaaggauc

SEQ ID NO: 1297373 - RNA, 21 nt, Human
cugggccaugcugccauuuug

SEQ ID NO: 1297374 - RNA, 19 nt, Human
gccaacucuugccacaaga

SEQ ID NO: 1297375 - RNA, 22 nt, Human
ucacugccagucacacuccugg

SEQ ID NO: 1297376 - RNA, 23 nt, Human
ucacugccagucacacuccuggg

SEQ ID NO: 1297377 - RNA, 32 nt, Human
ucugaugauaauaauggugauaauuuucuuuu

SEQ ID NO: 1297378 - RNA, 18 nt, Human
uuaaaugaccuuccugca

SEQ ID NO: 1297379 - RNA, 23 nt, Human
uuggaugcauugacauaccaacc

SEQ ID NO: 1297380 - RNA, 22 nt, Human
cccgcgcggccaggggcgccuc

SEQ ID NO: 1297381 - RNA, 24 nt, Human
cugcccggggcggcggcugggcug

SEQ ID NO: 1297382 - RNA, 21 nt, Human
gggcggcggcugggcuguccg

SEQ ID NO: 1297383 - RNA, 21 nt, Human
ugaagggagccuccuccuuga

SEQ ID NO: 1297384 - RNA, 22 nt, Human
aguaaguagguggcgggagaaa

SEQ ID NO: 1297385 - RNA, 24 nt, Human
aaagugcugggauaacaggcguga

SEQ ID NO: 1297386 - RNA, 23 nt, Human
aacccagaugccccaacucuccu

SEQ ID NO: 1297387 - RNA, 21 nt, Human
aaccgcccccacaacaggccc

SEQ ID NO: 1297388 - RNA, 18 nt, Human
aauaaguacugaacaccu

SEQ ID NO: 1297389 - RNA, 19 nt, Human
acaggccccggugugugau

SEQ ID NO: 1297390 - RNA, 21 nt, Human
acaggcgugagccacugcgcc

SEQ ID NO: 1297391 - RNA, 24 nt, Human
accuugugaucugccugccucggc

SEQ ID NO: 1297392 - RNA, 24 nt, Human
acggaguuuccccauguuggccag

SEQ ID NO: 1297393 - RNA, 21 nt, Human
acuacaccuauuaaagacguu

SEQ ID NO: 1297394 - RNA, 20 nt, Human
agaagcacuuccagaagaau

SEQ ID NO: 1297395 - RNA, 22 nt, Human
agccaugcaagccucaggcccu

SEQ ID NO: 1297396 - RNA, 24 nt, Human
agcgauucuccugccucagccucc

SEQ ID NO: 1297397 - RNA, 22 nt, Human
aguagagacggaguuuccccau

SEQ ID NO: 1297398 - RNA, 18 nt, Human
aguagcugggauuacagg

SEQ ID NO: 1297399 - RNA, 18 nt, Human
agugcaguggcgugaucu

SEQ ID NO: 1297400 - RNA, 20 nt, Human
agugcaguggcgugaucuug

SEQ ID NO: 1297401 - RNA, 24 nt, Human
agugcaguggcgugaucuugacuc

SEQ ID NO: 1297402 - RNA, 18 nt, Human
auuacaggugcauaccau

SEQ ID NO: 1297403 - RNA, 24 nt, Human
auuuuuguauuuuuaguagagacg

SEQ ID NO: 1297404 - RNA, 22 nt, Human
caaaccagcagccagaggcuga

SEQ ID NO: 1297405 - RNA, 24 nt, Human
caaagugcugggauaacaggcgug

SEQ ID NO: 1297406 - RNA, 19 nt, Human
caagccucaggcccucugu

SEQ ID NO: 1297407 - RNA, 22 nt, Human
caagcgauucuccugccucagc

SEQ ID NO: 1297408 - RNA, 21 nt, Human
cacgcucggcuaauuuuugua

SEQ ID NO: 1297409 - RNA, 30 nt, Human
cacucauauuucaaaccagcagccagaggg

SEQ ID NO: 1297410 - RNA, 22 nt, Human
cacugcuaacccagaugcccca

SEQ ID NO: 1297411 - RNA, 19 nt, Human
caguggcgugaucuugacu

SEQ ID NO: 1297412 - RNA, 22 nt, Human
ccaaagugcugggauaacaggc

SEQ ID NO: 1297413 - RNA, 24 nt, Human
ccaaagugcugggauaacaggcgu

SEQ ID NO: 1297414 - RNA, 20 nt, Human
ccaacucuccucacucauau

SEQ ID NO: 1297415 - RNA, 21 nt, Human
ccacugcgccuggccuacuua

SEQ ID NO: 1297416 - RNA, 20 nt, Human
cccagguucaagcgauucuc

SEQ ID NO: 1297417 - RNA, 23 nt, Human
cccagguucaagcgauucuccug

SEQ ID NO: 1297418 - RNA, 24 nt, Human
ccccauguuggccaggauggucuc

SEQ ID NO: 1297419 - RNA, 23 nt, Human
cccgaguagcugggauuacaggu

SEQ ID NO: 1297420 - RNA, 24 nt, Human
cccgaguagcugggauuacaggug

SEQ ID NO: 1297421 - RNA, 20 nt, Human
cccucuguuucuaccucugc

SEQ ID NO: 1297422 - RNA, 21 nt, Human
ccgaguagcugggauuacagg

SEQ ID NO: 1297423 - RNA, 24 nt, Human
ccgcccagguucaagcgauucucc

SEQ ID NO: 1297424 - RNA, 22 nt, Human
ccgcccccacaacaggccccgg

SEQ ID NO: 1297425 - RNA, 24 nt, Human
ccgcccccacaacaggccccggug

SEQ ID NO: 1297426 - RNA, 23 nt, Human
ccugccucagccucccgaguagc

SEQ ID NO: 1297427 - RNA, 24 nt, Human
cggaguuuccccauguuggccagg

SEQ ID NO: 1297428 - RNA, 26 nt, Human
cuacugcacucccuucuccccaaguc

SEQ ID NO: 1297429 - RNA, 18 nt, Human
cucacugcaaccucugcc

SEQ ID NO: 1297430 - RNA, 23 nt, Human
cucagccucccgaguagcuggga

SEQ ID NO: 1297431 - RNA, 23 nt, Human
cucaggcccucuguuucuaccuc

SEQ ID NO: 1297432 - RNA, 20 nt, Human
cugcaaccucugccgcccag

SEQ ID NO: 1297433 - RNA, 24 nt, Human
cugcaaccucugccgcccagguuc

SEQ ID NO: 1297434 - RNA, 24 nt, Human
cugcacccauuaacucgucauuua

SEQ ID NO: 1297435 - RNA, 23 nt, Human
cugccucagccucccgaguagcu

SEQ ID NO: 1297436 - RNA, 23 nt, Human
cugccucggccucccaaagugcu

SEQ ID NO: 1297437 - RNA, 24 nt, Human
cuuacccucaaccgcccccacaac

SEQ ID NO: 1297438 - RNA, 22 nt, Human
gaccuugugaucugccugccuc

SEQ ID NO: 1297439 - RNA, 24 nt, Human
gaccuugugaucugccugccucgg

SEQ ID NO: 1297440 - RNA, 20 nt, Human
gagacggaguuuccccaugu

SEQ ID NO: 1297441 - RNA, 26 nt, Human
gaguagcugggauuacaggugcauac

SEQ ID NO: 1297442 - RNA, 18 nt, Human
gauaacaggcgugagcca

SEQ ID NO: 1297443 - RNA, 22 nt, Human
gauaacaggcgugagccacugc

SEQ ID NO: 1297444 - RNA, 22 nt, Human
gauaacaggcgugagccacugc

SEQ ID NO: 1297445 - RNA, 20 nt, Human
gaugcaaggugguagagagc

SEQ ID NO: 1297446 - RNA, 21 nt, Human
gcaaggugguagagagcagau

SEQ ID NO: 1297447 - RNA, 24 nt, Human
gcgauucuccugccucagccuccc

SEQ ID NO: 1297448 - RNA, 19 nt, Human
ggcgugaucuugacucacu

SEQ ID NO: 1297449 - RNA, 22 nt, Human
ggcuguagugcaguggcgugau

SEQ ID NO: 1297450 - RNA, 18 nt, Human
ggguacgugugcacaacg

SEQ ID NO: 1297451 - RNA, 24 nt, Human
guccaggcuguagugcaguggcgu

SEQ ID NO: 1297452 - RNA, 26 nt, Human
uaacagaagcacuuccagaagaauuc

SEQ ID NO: 1297453 - RNA, 19 nt, Human
uaacagaugcaagguggua

SEQ ID NO: 1297454 - RNA, 24 nt, Human
uaacuacugcacucccuucucccc

SEQ ID NO: 1297455 - RNA, 24 nt, Human
uaauuuuuguauuuuuaguagaga

SEQ ID NO: 1297456 - RNA, 21 nt, Human
uacugcacucccuucucccca

SEQ ID NO: 1297457 - RNA, 21 nt, Human
uaggaaaaaaucuagcuucua

SEQ ID NO: 1297458 - RNA, 24 nt, Human
uaguagagacggaguuuccccaug

SEQ ID NO: 1297459 - RNA, 23 nt, Human
uauaaacacugcuaacccagaug

SEQ ID NO: 1297460 - RNA, 20 nt, Human
ucaaaccagcagccagaggc

SEQ ID NO: 1297461 - RNA, 22 nt, Human
ucaaccgcccccacaacaggcc

SEQ ID NO: 1297462 - RNA, 18 nt, Human
ucacugcaaccucugccg

SEQ ID NO: 1297463 - RNA, 21 nt, Human
ucacugcaaccucugccgccc

SEQ ID NO: 1297464 - RNA, 24 nt, Human
ucacugcaaccucugccgcccagg

SEQ ID NO: 1297465 - RNA, 20 nt, Human
ucagccucccgaguagcugg

SEQ ID NO: 1297466 - RNA, 24 nt, Human
ucccaaagugcugggauaacaggc

SEQ ID NO: 1297467 - RNA, 23 nt, Human
ucccgaguagcugggauuacagg

SEQ ID NO: 1297468 - RNA, 24 nt, Human
ucccgaguagcugggauuacaggu

SEQ ID NO: 1297469 - RNA, 18 nt, Human
ucggccucccaaagugcu

SEQ ID NO: 1297470 - RNA, 24 nt, Human
ucguccaggcuguagugcaguggc

SEQ ID NO: 1297471 - RNA, 21 nt, Human
ucuccucacucauauuucaaa

SEQ ID NO: 1297472 - RNA, 24 nt, Human
ucuccugccucagccucccgagua

SEQ ID NO: 1297473 - RNA, 19 nt, Human
ucugcugggagagauaggg

SEQ ID NO: 1297474 - RNA, 19 nt, Human
ucuugcucugucguccagg

SEQ ID NO: 1297475 - RNA, 22 nt, Human
ucuugcucugucguccaggcug

SEQ ID NO: 1297476 - RNA, 23 nt, Human
ucuugcucugucguccaggcugu

SEQ ID NO: 1297477 - RNA, 18 nt, Human
ugagacagagucuugcuc

SEQ ID NO: 1297478 - RNA, 22 nt, Human
ugagacagagucuugcucuguc

SEQ ID NO: 1297479 - RNA, 21 nt, Human
ugcagguuuguuacauaugua

SEQ ID NO: 1297480 - RNA, 24 nt, Human
ugccucagccucccgaguagcugg

SEQ ID NO: 1297481 - RNA, 21 nt, Human
ugccucggccucccaaagugc

SEQ ID NO: 1297482 - RNA, 24 nt, Human
ugccucggccucccaaagugcugg

SEQ ID NO: 1297483 - RNA, 21 nt, Human
ugcgccuggccuacuuaguuu

SEQ ID NO: 1297484 - RNA, 24 nt, Human
ugcucugucguccaggcuguagug

SEQ ID NO: 1297485 - RNA, 24 nt, Human
uggccaggauggucucgaucucuu

SEQ ID NO: 1297486 - RNA, 20 nt, Human
ugggagagauagggcugaau

SEQ ID NO: 1297487 - RNA, 19 nt, Human
ugggauaacaggcgugagc

SEQ ID NO: 1297488 - RNA, 22 nt, Human
ugggauaacaggcgugagccac

SEQ ID NO: 1297489 - RNA, 22 nt, Human
ugggauaacaggcgugagccac

SEQ ID NO: 1297490 - RNA, 24 nt, Human
ugggauaacaggcgugagccacug

SEQ ID NO: 1297491 - RNA, 21 nt, Human
ugggauuacaggugcauacca

SEQ ID NO: 1297492 - RNA, 21 nt, Human
ugggauuacaggugcauacca

SEQ ID NO: 1297493 - RNA, 22 nt, Human
ugggauuacaggugcauaccau

SEQ ID NO: 1297494 - RNA, 24 nt, Human
ugggauuacaggugcauaccauca

SEQ ID NO: 1297495 - RNA, 21 nt, Human
ugguagagagcagauuaggaa

SEQ ID NO: 1297496 - RNA, 19 nt, Human
uguagugcaguggcgugau

SEQ ID NO: 1297497 - RNA, 19 nt, Human
uguagugcaguggcgugau

SEQ ID NO: 1297498 - RNA, 28 nt, Human
uguagugcaguggcgugauggcucuagc

SEQ ID NO: 1297499 - RNA, 21 nt, Human
ugucguccaggcuguagugca

SEQ ID NO: 1297500 - RNA, 18 nt, Human
uguuacauauguauacau

SEQ ID NO: 1297501 - RNA, 19 nt, Human
uguuacauauguauacaug

SEQ ID NO: 1297502 - RNA, 18 nt, Human
uuaguagagacggaguuu

SEQ ID NO: 1297503 - RNA, 24 nt, Human
uuaguagagacggaguuuccccau

SEQ ID NO: 1297504 - RNA, 21 nt, Human
uucaagcgauucuccugccuc

SEQ ID NO: 1297505 - RNA, 23 nt, Human
uucaagcgauucuccugccucag

SEQ ID NO: 1297506 - RNA, 24 nt, Human
uucaagcgauucuccugccucagc

SEQ ID NO: 1297507 - RNA, 23 nt, Human
uuguauuuuuaguagagacggag

SEQ ID NO: 1297508 - RNA, 25 nt, Human
uuuauucaaacuaagucaugaaauc

SEQ ID NO: 1297509 - RNA, 19 nt, Human
uuuccccauguuggccagg

SEQ ID NO: 1297510 - RNA, 19 nt, Human
uuuuuaguagagacggagu

SEQ ID NO: 1297511 - RNA, 20 nt, Human
uuuuuguauuuuuaguagag

SEQ ID NO: 1297512 - RNA, 20 nt, Human
uuuuuuuuuuugagacagag

SEQ ID NO: 1297513 - RNA, 24 nt, Human
uuuuuuuuuuuugagacagagucu

SEQ ID NO: 1297514 - RNA, 22 nt, Human
aaaaaucccagucaacagguuc

SEQ ID NO: 1297515 - RNA, 22 nt, Human
agauacaaagaucacuguaacu

SEQ ID NO: 1297516 - RNA, 22 nt, Human
agccgcgcgaccccagcagggc

SEQ ID NO: 1297517 - RNA, 19 nt, Human
auggaauacacaaaaggga

SEQ ID NO: 1297518 - RNA, 21 nt, Human
auuuuugcuguugccugcaac

SEQ ID NO: 1297519 - RNA, 19 nt, Human
caaagccacuuuuagacaa

SEQ ID NO: 1297520 - RNA, 20 nt, Human
caaagccgcgcgaccccagc

SEQ ID NO: 1297521 - RNA, 18 nt, Human
caauggauuuaagagguu

SEQ ID NO: 1297522 - RNA, 21 nt, Human
caggagccacgcagguuaccg

SEQ ID NO: 1297523 - RNA, 22 nt, Human
cagucagggcaagggaaagaga

SEQ ID NO: 1297524 - RNA, 19 nt, Human
cauaucuauccaacacagu

SEQ ID NO: 1297525 - RNA, 22 nt, Human
cauuucccuguuucuucuaaaa

SEQ ID NO: 1297526 - RNA, 18 nt, Human
ccaaagccgcgcgacccc

SEQ ID NO: 1297527 - RNA, 21 nt, Human
ccagcagggcuucagauccga

SEQ ID NO: 1297528 - RNA, 22 nt, Human
ccuccaguccccuccagaugcg

SEQ ID NO: 1297529 - RNA, 23 nt, Human
ccuguuucuucuaaaaguucucc

SEQ ID NO: 1297530 - RNA, 18 nt, Human
cuaucaggagccacgcag

SEQ ID NO: 1297531 - RNA, 27 nt, Human
cuggcuucugcgagcauccuuggggcc

SEQ ID NO: 1297532 - RNA, 19 nt, Human
gaguucccaguugcucuuc

SEQ ID NO: 1297533 - RNA, 19 nt, Human
ggcugggguugggggcugg

SEQ ID NO: 1297534 - RNA, 20 nt, Human
uacagcauucaaacaaagcc

SEQ ID NO: 1297535 - RNA, 21 nt, Human
uacuccaacagucagggcaag

SEQ ID NO: 1297536 - RNA, 19 nt, Human
uauaugaagagagaaggua

SEQ ID NO: 1297537 - RNA, 22 nt, Human
ucacuguaacugucagagaggu

SEQ ID NO: 1297538 - RNA, 19 nt, Human
uccaaacgcuaucaggagc

SEQ ID NO: 1297539 - RNA, 24 nt, Human
ucuucagucucccccgcguucuuc

SEQ ID NO: 1297540 - RNA, 20 nt, Human
uggcuucugcgagcauccuu

SEQ ID NO: 1297541 - RNA, 20 nt, Human
uggcuucugcgagcauccuu

SEQ ID NO: 1297542 - RNA, 22 nt, Human
uuccaaacgcuaucaggagcca

SEQ ID NO: 1297543 - RNA, 20 nt, Human
uuguacagcauucaaacaaa

SEQ ID NO: 1297544 - RNA, 22 nt, Human
agugagaaagacuagagagaaa

SEQ ID NO: 1297545 - RNA, 25 nt, Human
auggcagacaagauacaagucccac

SEQ ID NO: 1297546 - RNA, 21 nt, Human
caagguauuauugccagcaug

SEQ ID NO: 1297547 - RNA, 23 nt, Human
caccuagagucucugauguaggg

SEQ ID NO: 1297548 - RNA, 23 nt, Human
cagaaugagcaacaggcugaaaa

SEQ ID NO: 1297549 - RNA, 20 nt, Human
cagcaugggacagaaugagc

SEQ ID NO: 1297550 - RNA, 18 nt, Human
caggaagggcaaaauccc

SEQ ID NO: 1297551 - RNA, 24 nt, Human
cccuauaccccaggaagggcaaaa

SEQ ID NO: 1297552 - RNA, 21 nt, Human
gagcaauucaaaauaagggua

SEQ ID NO: 1297553 - RNA, 20 nt, Human
ggcagacaagauacaagucc

SEQ ID NO: 1297554 - RNA, 18 nt, Human
gguaaugggcugacaagg

SEQ ID NO: 1297555 - RNA, 23 nt, Human
gugauuuuuugaaaacaaacugg

SEQ ID NO: 1297556 - RNA, 24 nt, Human
uaccccaggaagggcaaaauccca

SEQ ID NO: 1297557 - RNA, 22 nt, Human
uaucauauugcuauggacauug

SEQ ID NO: 1297558 - RNA, 22 nt, Human
ucaauauuucugauccccuaua

SEQ ID NO: 1297559 - RNA, 22 nt, Human
ucuuguguugcaauuuuuuaau

SEQ ID NO: 1297560 - RNA, 22 nt, Human
ugacaagguauuauugccagca

SEQ ID NO: 1297561 - RNA, 27 nt, Human
ugacaagguauuauugccagcauggga

SEQ ID NO: 1297562 - RNA, 18 nt, Human
ugagaaagacuagagaga

SEQ ID NO: 1297563 - RNA, 23 nt, Human
ugagcaacaggcugaaaaguuuu

SEQ ID NO: 1297564 - RNA, 21 nt, Human
uguacaagugagaaagacuag

SEQ ID NO: 1297565 - RNA, 20 nt, Human
uguucugauauggcagacaa

SEQ ID NO: 1297566 - RNA, 20 nt, Human
uuuuugaaaacaaacugggu

SEQ ID NO: 1297567 - RNA, 24 nt, Human
aaaguauugggauuacaggcauga

SEQ ID NO: 1297568 - RNA, 19 nt, Human
aaagugcuaggauuauagg

SEQ ID NO: 1297569 - RNA, 19 nt, Human
aagccauucuuagaucugg

SEQ ID NO: 1297570 - RNA, 21 nt, Human
aaguauugggauuacaggcau

SEQ ID NO: 1297571 - RNA, 26 nt, Human
aaguauugggauuacaggcaugagcu

SEQ ID NO: 1297572 - RNA, 20 nt, Human
aagugcuucacuugccucag

SEQ ID NO: 1297573 - RNA, 20 nt, Human
acaccugguuaauuuuuuua

SEQ ID NO: 1297574 - RNA, 19 nt, Human
acugcagccucaaccuccu

SEQ ID NO: 1297575 - RNA, 21 nt, Human
agagacgugcaccaccacacc

SEQ ID NO: 1297576 - RNA, 26 nt, Human
agcagcaucucaaaagggcugacugg

SEQ ID NO: 1297577 - RNA, 18 nt, Human
agccucaaccuccugggc

SEQ ID NO: 1297578 - RNA, 22 nt, Human
aggggagaagcugggcaaagag

SEQ ID NO: 1297579 - RNA, 20 nt, Human
agggugauugguaccugaaa

SEQ ID NO: 1297580 - RNA, 23 nt, Human
aggucuucagcaugacuugguuu

SEQ ID NO: 1297581 - RNA, 23 nt, Human
aguagcugggauuacaggcaugu

SEQ ID NO: 1297582 - RNA, 19 nt, Human
agucagcagcaucucaaaa

SEQ ID NO: 1297583 - RNA, 24 nt, Human
aguggcaugaucuuaguucacugc

SEQ ID NO: 1297584 - RNA, 18 nt, Human
aguggugugaucuuggcu

SEQ ID NO: 1297585 - RNA, 23 nt, Human
augggguuuugccauguuggcca

SEQ ID NO: 1297586 - RNA, 24 nt, Human
augggguuuugccauguuggccag

SEQ ID NO: 1297587 - RNA, 23 nt, Human
augggugcaguggcaugaucuua

SEQ ID NO: 1297588 - RNA, 24 nt, Human
auguuugcauuuuuaguagagaug

SEQ ID NO: 1297589 - RNA, 19 nt, Human
auucuguugcccaagaugg

SEQ ID NO: 1297590 - RNA, 24 nt, Human
caaaguauugggauuacaggcaug

SEQ ID NO: 1297591 - RNA, 24 nt, Human
caaagugcuaggauuauaggcaua

SEQ ID NO: 1297592 - RNA, 22 nt, Human
caagugauucuccugucucagc

SEQ ID NO: 1297593 - RNA, 19 nt, Human
caccugguuaauuuuuuua

SEQ ID NO: 1297594 - RNA, 24 nt, Human
cacuaaguugcccaggcuggucuu

SEQ ID NO: 1297595 - RNA, 23 nt, Human
cacucaggaauuucucccucuca

SEQ ID NO: 1297596 - RNA, 19 nt, Human
cacugcagccucaaccucc

SEQ ID NO: 1297597 - RNA, 21 nt, Human
cacuguaaccuccaccuccug

SEQ ID NO: 1297598 - RNA, 23 nt, Human
cacuguaaccuccaccuccuggg

SEQ ID NO: 1297599 - RNA, 23 nt, Human
cagcagcaucucaaaagggcuga

SEQ ID NO: 1297600 - RNA, 23 nt, Human
cagccucaaccuccugggcucaa

SEQ ID NO: 1297601 - RNA, 24 nt, Human
cagccucaaccuccugggcucaag

SEQ ID NO: 1297602 - RNA, 20 nt, Human
cagccuccugaguagcugag

SEQ ID NO: 1297603 - RNA, 22 nt, Human
caugccuguuuuuuucuggagg

SEQ ID NO: 1297604 - RNA, 24 nt, Human
cauguuggccaggcuggucucgaa

SEQ ID NO: 1297605 - RNA, 24 nt, Human
ccaaaguauugggauuacaggcau

SEQ ID NO: 1297606 - RNA, 24 nt, Human
ccaaagugcuaggauuauaggcau

SEQ ID NO: 1297607 - RNA, 24 nt, Human
ccaccuccuggguucaagugauuc

SEQ ID NO: 1297608 - RNA, 19 nt, Human
ccauguuggccaggcuggu

SEQ ID NO: 1297609 - RNA, 23 nt, Human
ccauguuggccaggcuggucucg

SEQ ID NO: 1297610 - RNA, 24 nt, Human
cccaaaguauugggauuacaggca

SEQ ID NO: 1297611 - RNA, 20 nt, Human
ccccgggcaucucguuccca

SEQ ID NO: 1297612 - RNA, 23 nt, Human
cccgaguagcugggauuacaggc

SEQ ID NO: 1297613 - RNA, 24 nt, Human
cccgaguagcugggauuacaggca

SEQ ID NO: 1297614 - RNA, 23 nt, Human
ccgaguagcugggauuacaggca

SEQ ID NO: 1297615 - RNA, 24 nt, Human
ccgaguagcugggauuacaggcau

SEQ ID NO: 1297616 - RNA, 18 nt, Human
ccucaaccuccugggcuc

SEQ ID NO: 1297617 - RNA, 19 nt, Human
ccucacuaaguugcccagg

SEQ ID NO: 1297618 - RNA, 22 nt, Human
ccuccaccuccuggguucaagu

SEQ ID NO: 1297619 - RNA, 26 nt, Human
ccuccuaccuuggccucccaaagugc

SEQ ID NO: 1297620 - RNA, 24 nt, Human
ccuccuggguucaagugauucucc

SEQ ID NO: 1297621 - RNA, 21 nt, Human
ccucucacccaaccucagcuc

SEQ ID NO: 1297622 - RNA, 24 nt, Human
ccugccacagccuccugaguagcu

SEQ ID NO: 1297623 - RNA, 20 nt, Human
ccuggccucaagccauccuc

SEQ ID NO: 1297624 - RNA, 20 nt, Human
ccugggcucaagccaucuuc

SEQ ID NO: 1297625 - RNA, 23 nt, Human
ccugggcucaagccaucuuccug

SEQ ID NO: 1297626 - RNA, 23 nt, Human
ccuggguucaagugauucuccuc

SEQ ID NO: 1297627 - RNA, 23 nt, Human
ccuggguucaagugauucuccug

SEQ ID NO: 1297628 - RNA, 21 nt, Human
ccuguauggucauuaucacuc

SEQ ID NO: 1297629 - RNA, 24 nt, Human
cucaagccauccuccuaccuuggc

SEQ ID NO: 1297630 - RNA, 21 nt, Human
cucaagccaucuuccugccac

SEQ ID NO: 1297631 - RNA, 24 nt, Human
cucacuguaaccuccaccuccugg

SEQ ID NO: 1297632 - RNA, 26 nt, Human
cucacuguaaccuccaccuccugggu

SEQ ID NO: 1297633 - RNA, 24 nt, Human
cucagccucccgaguagcugggau

SEQ ID NO: 1297634 - RNA, 18 nt, Human
cuccaagugguggaaaag

SEQ ID NO: 1297635 - RNA, 19 nt, Human
cuccuggccucaagccauc

SEQ ID NO: 1297636 - RNA, 20 nt, Human
cuccuggguucaagugauuc

SEQ ID NO: 1297637 - RNA, 21 nt, Human
cuccuggguucaagugauucu

SEQ ID NO: 1297638 - RNA, 19 nt, Human
cugcagccccagccugaag

SEQ ID NO: 1297639 - RNA, 20 nt, Human
cugcagccccagccugaagc

SEQ ID NO: 1297640 - RNA, 27 nt, Human
cugcagccccagccugaagccauucuu

SEQ ID NO: 1297641 - RNA, 21 nt, Human
cuguaaccuccaccuccuggg

SEQ ID NO: 1297642 - RNA, 24 nt, Human
cuguaaccuccaccuccuggguuc

SEQ ID NO: 1297643 - RNA, 23 nt, Human
cugucucagccucccgaguagcu

SEQ ID NO: 1297644 - RNA, 19 nt, Human
cuuuauaggugcuuucuug

SEQ ID NO: 1297645 - RNA, 24 nt, Human
gaccucaagugcuucacuugccuc

SEQ ID NO: 1297646 - RNA, 20 nt, Human
gagaugggguuuugccaugu

SEQ ID NO: 1297647 - RNA, 25 nt, Human
gaguagcugggauuacaggcaugug

SEQ ID NO: 1297648 - RNA, 21 nt, Human
gauuacaggcaugagcuacua

SEQ ID NO: 1297649 - RNA, 24 nt, Human
gauuacaggcaugagcuacuaugc

SEQ ID NO: 1297650 - RNA, 18 nt, Human
gauuacaggcaugugcca

SEQ ID NO: 1297651 - RNA, 24 nt, Human
gauuacaggcaugugccaccaugc

SEQ ID NO: 1297652 - RNA, 18 nt, Human
gauuauaggcauaagcca

SEQ ID NO: 1297653 - RNA, 21 nt, Human
gauuauaggcauaagccaaug

SEQ ID NO: 1297654 - RNA, 21 nt, Human
gauucuccugucucagccucc

SEQ ID NO: 1297655 - RNA, 22 nt, Human
gcaaagaggugacugcagcccc

SEQ ID NO: 1297656 - RNA, 18 nt, Human
gcagcaucucaaaagggc

SEQ ID NO: 1297657 - RNA, 21 nt, Human
gcagccugcugggauuuccag

SEQ ID NO: 1297658 - RNA, 18 nt, Human
gcagguuuuaucugagcg

SEQ ID NO: 1297659 - RNA, 20 nt, Human
gccauguuggccaggcuggu

SEQ ID NO: 1297660 - RNA, 22 nt, Human
gccauguuggccaggcuggucu

SEQ ID NO: 1297661 - RNA, 18 nt, Human
gccucaaccuccugggcu

SEQ ID NO: 1297662 - RNA, 23 nt, Human
gcuggucucgaacuccugaccuc

SEQ ID NO: 1297663 - RNA, 23 nt, Human
gcuggucuugaacuccuggccuc

SEQ ID NO: 1297664 - RNA, 24 nt, Human
ggauuacaggcaugagcuacuaug

SEQ ID NO: 1297665 - RNA, 24 nt, Human
ggauuacaggcaugugccaccaug

SEQ ID NO: 1297666 - RNA, 24 nt, Human
ggauuauaggcauaagccaaugug

SEQ ID NO: 1297667 - RNA, 24 nt, Human
ggcuggucucgaacuccugaccuc

SEQ ID NO: 1297668 - RNA, 24 nt, Human
ggcuggucuugaacuccuggccuc

SEQ ID NO: 1297669 - RNA, 31 nt, Human
ggcugugguacaguggugugaucuuggcucc

SEQ ID NO: 1297670 - RNA, 21 nt, Human
gggagaagcugggcaaagagg

SEQ ID NO: 1297671 - RNA, 19 nt, Human
gggcaggggagaagcuggg

SEQ ID NO: 1297672 - RNA, 22 nt, Human
gggguuuugccauguuggccag

SEQ ID NO: 1297673 - RNA, 23 nt, Human
gggguuuugccauguuggccagg

SEQ ID NO: 1297674 - RNA, 22 nt, Human
ggguuuugccauguuggccagg

SEQ ID NO: 1297675 - RNA, 19 nt, Human
ggucucgaacuccugaccu

SEQ ID NO: 1297676 - RNA, 19 nt, Human
ggugcaguggcaugaucuu

SEQ ID NO: 1297677 - RNA, 19 nt, Human
guacaguggugugaucuug

SEQ ID NO: 1297678 - RNA, 23 nt, Human
guacaguggugugaucuuggcuc

SEQ ID NO: 1297679 - RNA, 23 nt, Human
guagagaugggguuuugccaugu

SEQ ID NO: 1297680 - RNA, 18 nt, Human
guagcugggauuacaggc

SEQ ID NO: 1297681 - RNA, 20 nt, Human
guagcugggauuacaggcau

SEQ ID NO: 1297682 - RNA, 24 nt, Human
gugauucuccugucucagccuccc

SEQ ID NO: 1297683 - RNA, 20 nt, Human
gugcaguggcaugaucuuag

SEQ ID NO: 1297684 - RNA, 21 nt, Human
gugcuucacuugccucagccu

SEQ ID NO: 1297685 - RNA, 24 nt, Human
gugcuucacuugccucagccuccc

SEQ ID NO: 1297686 - RNA, 21 nt, Human
gugugaucuuggcucacugua

SEQ ID NO: 1297687 - RNA, 21 nt, Human
guugcccaggcuggucuugaa

SEQ ID NO: 1297688 - RNA, 19 nt, Human
uaacuuggcagauaagugg

SEQ ID NO: 1297689 - RNA, 24 nt, Human
uaaguugcccaggcuggucuugaa

SEQ ID NO: 1297690 - RNA, 24 nt, Human
uaauguuugcauuuuuaguagaga

SEQ ID NO: 1297691 - RNA, 23 nt, Human
uaauuuuuuuauuuuuuauagag

SEQ ID NO: 1297692 - RNA, 24 nt, Human
uaauuuuuuuauuuuuuauagaga

SEQ ID NO: 1297693 - RNA, 24 nt, Human
uacaggcaugagcuacuaugccca

SEQ ID NO: 1297694 - RNA, 24 nt, Human
uacaggcaugugccaccaugccca

SEQ ID NO: 1297695 - RNA, 19 nt, Human
uacaguggugugaucuugg

SEQ ID NO: 1297696 - RNA, 18 nt, Human
uagaagagcucuugggug

SEQ ID NO: 1297697 - RNA, 22 nt, Human
uagagaugggguuuugccaugu

SEQ ID NO: 1297698 - RNA, 21 nt, Human
uaggauuauaggcauaagcca

SEQ ID NO: 1297699 - RNA, 23 nt, Human
uaggauuauaggcauaagccaau

SEQ ID NO: 1297700 - RNA, 24 nt, Human
uaguagagaugggguuuugccaug

SEQ ID NO: 1297701 - RNA, 23 nt, Human
uaguucacugcagccucaaccuc

SEQ ID NO: 1297702 - RNA, 24 nt, Human
uaguucacugcagccucaaccucc

SEQ ID NO: 1297703 - RNA, 25 nt, Human
ucaagccauccuccuaccuuggccu

SEQ ID NO: 1297704 - RNA, 20 nt, Human
ucacugcagccucaaccucc

SEQ ID NO: 1297705 - RNA, 23 nt, Human
ucacugcagccucaaccuccugg

SEQ ID NO: 1297706 - RNA, 24 nt, Human
ucacugcagccucaaccuccuggg

SEQ ID NO: 1297707 - RNA, 23 nt, Human
ucacuguaaccuccaccuccugg

SEQ ID NO: 1297708 - RNA, 24 nt, Human
ucacuguaaccuccaccuccuggg

SEQ ID NO: 1297709 - RNA, 25 nt, Human
ucacuguaaccuccaccuccugggu

SEQ ID NO: 1297710 - RNA, 27 nt, Human
ucacuguaaccuccaccuccuggguuc

SEQ ID NO: 1297711 - RNA, 20 nt, Human
ucagccucccgaguagcugg

SEQ ID NO: 1297712 - RNA, 19 nt, Human
uccaggucuucagcaugac

SEQ ID NO: 1297713 - RNA, 24 nt, Human
ucccaaaguauugggauuacaggc

SEQ ID NO: 1297714 - RNA, 24 nt, Human
ucccaaagugcuaggauuauaggc

SEQ ID NO: 1297715 - RNA, 24 nt, Human
ucccgaguagcugggauuacaggc

SEQ ID NO: 1297716 - RNA, 20 nt, Human
uccugggcucaagccaucuu

SEQ ID NO: 1297717 - RNA, 22 nt, Human
uccugggcucaagccaucuucc

SEQ ID NO: 1297718 - RNA, 22 nt, Human
uccugggcucaagccaucuucc

SEQ ID NO: 1297719 - RNA, 24 nt, Human
uccugggcucaagccaucuuccug

SEQ ID NO: 1297720 - RNA, 21 nt, Human
uccuggguucaagugauucuc

SEQ ID NO: 1297721 - RNA, 24 nt, Human
uccuggguucaagugauucuccug

SEQ ID NO: 1297722 - RNA, 19 nt, Human
ucucauucuguugcccaag

SEQ ID NO: 1297723 - RNA, 20 nt, Human
ucucauucuguugcccaaga

SEQ ID NO: 1297724 - RNA, 23 nt, Human
ucucauucuguugcccaagaugg

SEQ ID NO: 1297725 - RNA, 23 nt, Human
ucucauucuguugcccaagaugg

SEQ ID NO: 1297726 - RNA, 24 nt, Human
ucucauucuguugcccaagauggg

SEQ ID NO: 1297727 - RNA, 24 nt, Human
ucuccugucucagccucccgagua

SEQ ID NO: 1297728 - RNA, 21 nt, Human
ucucgaacuccugaccucaag

SEQ ID NO: 1297729 - RNA, 23 nt, Human
ucucuucucuguugccuuuguuc

SEQ ID NO: 1297730 - RNA, 21 nt, Human
ucugcucucuucucuguugcc

SEQ ID NO: 1297731 - RNA, 24 nt, Human
ucugcucucuucucuguugccuuu

SEQ ID NO: 1297732 - RNA, 21 nt, Human
ucuugaacuccuggccucaag

SEQ ID NO: 1297733 - RNA, 22 nt, Human
ugaauccauggcuuaacacugg

SEQ ID NO: 1297734 - RNA, 20 nt, Human
ugaccucaagugcuucacuu

SEQ ID NO: 1297735 - RNA, 20 nt, Human
ugacugcagccccagccuga

SEQ ID NO: 1297736 - RNA, 19 nt, Human
ugacuugguuucucagugg

SEQ ID NO: 1297737 - RNA, 24 nt, Human
ugagacuagagacgugcaccacca

SEQ ID NO: 1297738 - RNA, 20 nt, Human
ugauucuccugucucagccu

SEQ ID NO: 1297739 - RNA, 23 nt, Human
ugcagccugcugggauuuccagg

SEQ ID NO: 1297740 - RNA, 22 nt, Human
ugcaguggcaugaucuuaguuc

SEQ ID NO: 1297741 - RNA, 24 nt, Human
ugccacagccuccugaguagcuga

SEQ ID NO: 1297742 - RNA, 24 nt, Human
ugccauguuggccaggcuggucuc

SEQ ID NO: 1297743 - RNA, 26 nt, Human
ugccauguuggccaggcuggucucga

SEQ ID NO: 1297744 - RNA, 23 nt, Human
ugcccaagaugggugcaguggca

SEQ ID NO: 1297745 - RNA, 24 nt, Human
ugcccaggcuggucuugaacuccu

SEQ ID NO: 1297746 - RNA, 24 nt, Human
ugccucagccucccaaaguauugg

SEQ ID NO: 1297747 - RNA, 23 nt, Human
ugcugggauuuccaggucuucag

SEQ ID NO: 1297748 - RNA, 24 nt, Human
ugcuucacuugccucagccuccca

SEQ ID NO: 1297749 - RNA, 21 nt, Human
uggcagauaaguggguaguca

SEQ ID NO: 1297750 - RNA, 19 nt, Human
uggcaugaucuuaguucac

SEQ ID NO: 1297751 - RNA, 24 nt, Human
uggccaggcuggucucgaacuccu

SEQ ID NO: 1297752 - RNA, 20 nt, Human
uggccucaagccauccuccu

SEQ ID NO: 1297753 - RNA, 21 nt, Human
uggccucaagccauccuccua

SEQ ID NO: 1297754 - RNA, 18 nt, Human
ugggauuacaggcaugag

SEQ ID NO: 1297755 - RNA, 19 nt, Human
ugggauuacaggcaugagc

SEQ ID NO: 1297756 - RNA, 19 nt, Human
ugggauuacaggcaugagc

SEQ ID NO: 1297757 - RNA, 21 nt, Human
ugggauuacaggcaugagcua

SEQ ID NO: 1297758 - RNA, 22 nt, Human
ugggauuacaggcaugagcuac

SEQ ID NO: 1297759 - RNA, 22 nt, Human
ugggauuacaggcaugagcuac

SEQ ID NO: 1297760 - RNA, 23 nt, Human
ugggauuacaggcaugagcuacu

SEQ ID NO: 1297761 - RNA, 24 nt, Human
ugggauuacaggcaugagcuacua

SEQ ID NO: 1297762 - RNA, 26 nt, Human
ugggauuacaggcaugagcuacuaug

SEQ ID NO: 1297763 - RNA, 18 nt, Human
ugggauuacaggcaugug

SEQ ID NO: 1297764 - RNA, 21 nt, Human
ugggauuacaggcaugugcca

SEQ ID NO: 1297765 - RNA, 22 nt, Human
ugggauuacaggcaugugccac

SEQ ID NO: 1297766 - RNA, 24 nt, Human
ugggauuacaggcaugugccacca

SEQ ID NO: 1297767 - RNA, 20 nt, Human
uggggcuuguguacaggugc

SEQ ID NO: 1297768 - RNA, 24 nt, Human
ugggguuuugccauguuggccagg

SEQ ID NO: 1297769 - RNA, 23 nt, Human
ugggugcaguggcaugaucuuag

SEQ ID NO: 1297770 - RNA, 21 nt, Human
uggguggaaccuuuaaggaug

SEQ ID NO: 1297771 - RNA, 20 nt, Human
uggguucaagugauucuccu

SEQ ID NO: 1297772 - RNA, 24 nt, Human
uggguucaagugauucuccugucu

SEQ ID NO: 1297773 - RNA, 22 nt, Human
ugguacaguggugugaucuugg

SEQ ID NO: 1297774 - RNA, 24 nt, Human
uggugugaucuuggcucacuguaa

SEQ ID NO: 1297775 - RNA, 24 nt, Human
ugucucagccucccgaguagcugg

SEQ ID NO: 1297776 - RNA, 24 nt, Human
ugugguacaguggugugaucuugg

SEQ ID NO: 1297777 - RNA, 22 nt, Human
uguuuuuauuuuuuuagagaca

SEQ ID NO: 1297778 - RNA, 18 nt, Human
uuaguagagaugggguuu

SEQ ID NO: 1297779 - RNA, 22 nt, Human
uuaguagagaugggguuuugcc

SEQ ID NO: 1297780 - RNA, 24 nt, Human
uuaguagagaugggguuuugccau

SEQ ID NO: 1297781 - RNA, 26 nt, Human
uuauagagacggggccucacuaaguu

SEQ ID NO: 1297782 - RNA, 23 nt, Human
uucaagugauucuccugucucag

SEQ ID NO: 1297783 - RNA, 24 nt, Human
uucacugcagccucaaccuccugg

SEQ ID NO: 1297784 - RNA, 23 nt, Human
uucucccucucacccaaccucag

SEQ ID NO: 1297785 - RNA, 19 nt, Human
uucuuucguugcucaggcu

SEQ ID NO: 1297786 - RNA, 23 nt, Human
uugcucaggcugugguacagugg

SEQ ID NO: 1297787 - RNA, 24 nt, Human
uugcucaggcugugguacaguggu

SEQ ID NO: 1297788 - RNA, 18 nt, Human
uuggccucccaaagugcu

SEQ ID NO: 1297789 - RNA, 21 nt, Human
uuguguacaggugcuuacugu

SEQ ID NO: 1297790 - RNA, 18 nt, Human
uuugacaggcucccucca

SEQ ID NO: 1297791 - RNA, 18 nt, Human
uuugcauuuuuaguagag

SEQ ID NO: 1297792 - RNA, 23 nt, Human
uuuugccauguuggccaggcugg

SEQ ID NO: 1297793 - RNA, 21 nt, Human
uuuuuaguagagaugggguuu

SEQ ID NO: 1297794 - RNA, 24 nt, Human
uuuuuaguagagaugggguuuugc

SEQ ID NO: 1297795 - RNA, 22 nt, Human
cugucucagcagauaagcaacu

SEQ ID NO: 1297796 - RNA, 25 nt, Human
gguccaagcaacaguaauuuuuuuu

SEQ ID NO: 1297797 - RNA, 19 nt, Human
gucaagaacugcugucuca

SEQ ID NO: 1297798 - RNA, 18 nt, Human
uagcuggggucaagaacu

SEQ ID NO: 1297799 - RNA, 20 nt, Human
uguagcuggggucaagaacu

SEQ ID NO: 1297800 - RNA, 24 nt, Human
aaaauacucccucuuuuccaauua

SEQ ID NO: 1297801 - RNA, 22 nt, Human
aaauacucccucuuuuccaauu

SEQ ID NO: 1297802 - RNA, 20 nt, Human
acagcaacauauugcaagca

SEQ ID NO: 1297803 - RNA, 19 nt, Human
agcagcauaugcccuccac

SEQ ID NO: 1297804 - RNA, 19 nt, Human
caccucugccuuccagguu

SEQ ID NO: 1297805 - RNA, 21 nt, Human
cagcauaugcccuccaacguu

SEQ ID NO: 1297806 - RNA, 19 nt, Human
ccagguucaagcgacucuc

SEQ ID NO: 1297807 - RNA, 22 nt, Human
ccagguucaagcgacucuccug

SEQ ID NO: 1297808 - RNA, 22 nt, Human
ccuuccagguucaagcgacucu

SEQ ID NO: 1297809 - RNA, 21 nt, Human
cgcgaucucagcucacugcca

SEQ ID NO: 1297810 - RNA, 22 nt, Human
cuguaagaauccagcugucuuc

SEQ ID NO: 1297811 - RNA, 18 nt, Human
gacugcagaaguagcugu

SEQ ID NO: 1297812 - RNA, 22 nt, Human
gccaccucugccuuccagguuc

SEQ ID NO: 1297813 - RNA, 20 nt, Human
uaacccacagauaaguauca

SEQ ID NO: 1297814 - RNA, 24 nt, Human
uaacccacagauaaguaucacaaa

SEQ ID NO: 1297815 - RNA, 18 nt, Human
ucacugccaccucugccu

SEQ ID NO: 1297816 - RNA, 19 nt, Human
ucacugccaccucugccuu

SEQ ID NO: 1297817 - RNA, 24 nt, Human
ucacugccaccucugccuuccagg

SEQ ID NO: 1297818 - RNA, 24 nt, Human
uggcgcgaucucagcucacugcca

SEQ ID NO: 1297819 - RNA, 25 nt, Human
uuaaaauacucccucuuuuccaauu

SEQ ID NO: 1297820 - RNA, 26 nt, Human
uuaaagagauuaaaaaaaaaaaaacc

SEQ ID NO: 1297821 - RNA, 18 nt, Human
uucaagcgacucuccugc

SEQ ID NO: 1297822 - RNA, 24 nt, Human
uuccagguucaagcgacucuccug

SEQ ID NO: 1297823 - RNA, 25 nt, Human
auagucucugaaaauccuccucauu

SEQ ID NO: 1297824 - RNA, 19 nt, Human
auucccugcaugccuuuga

SEQ ID NO: 1297825 - RNA, 22 nt, Human
cauauaaaugacaaaauugcca

SEQ ID NO: 1297826 - RNA, 19 nt, Human
ccuuuagcuauuucuccca

SEQ ID NO: 1297827 - RNA, 21 nt, Human
cgcuggaugggauucccugca

SEQ ID NO: 1297828 - RNA, 21 nt, Human
cucccauauaaaugacaaaau

SEQ ID NO: 1297829 - RNA, 24 nt, Human
cucuccagggcucucacaucagcu

SEQ ID NO: 1297830 - RNA, 19 nt, Human
cugcaugccuuugacugau

SEQ ID NO: 1297831 - RNA, 22 nt, Human
cuuuauacuacaccuuuagcua

SEQ ID NO: 1297832 - RNA, 23 nt, Human
uaaaaaaugagaaauaaaagccc

SEQ ID NO: 1297833 - RNA, 20 nt, Human
ucugaaaauccuccucauug

SEQ ID NO: 1297834 - RNA, 20 nt, Human
ugagaaauaaaagccccaaa

SEQ ID NO: 1297835 - RNA, 24 nt, Human
ugcuaguguguuuucuaacuguau

SEQ ID NO: 1297836 - RNA, 21 nt, Human
uuugacugauguuucucucca

SEQ ID NO: 1297837 - RNA, 22 nt, Human
aaagccaaaaccagcagagcca

SEQ ID NO: 1297838 - RNA, 22 nt, Human
aacaagaagagagucauugugg

SEQ ID NO: 1297839 - RNA, 21 nt, Human
aacuuggcucuuggagaguga

SEQ ID NO: 1297840 - RNA, 22 nt, Human
aagaaggaaaucaggucugaga

SEQ ID NO: 1297841 - RNA, 20 nt, Human
aagguuacagagaaggaaag

SEQ ID NO: 1297842 - RNA, 21 nt, Human
acaaugaugaaggcagguggc

SEQ ID NO: 1297843 - RNA, 19 nt, Human
acacagcacagacgccugc

SEQ ID NO: 1297844 - RNA, 18 nt, Human
acaguaccuggaaggaga

SEQ ID NO: 1297845 - RNA, 21 nt, Human
acaucccugaaccaagggccu

SEQ ID NO: 1297846 - RNA, 20 nt, Human
accuauguucuuucuucccu

SEQ ID NO: 1297847 - RNA, 24 nt, Human
acgacugcccuuccccgugccccu

SEQ ID NO: 1297848 - RNA, 22 nt, Human
acgcggugucuuucagaggguc

SEQ ID NO: 1297849 - RNA, 23 nt, Human
acucccucaccuccaaggauccu

SEQ ID NO: 1297850 - RNA, 24 nt, Human
acugacugcucccugagggaaggu

SEQ ID NO: 1297851 - RNA, 21 nt, Human
acuggacugacugcucccuga

SEQ ID NO: 1297852 - RNA, 22 nt, Human
acuuuuuugugguacacuuguu

SEQ ID NO: 1297853 - RNA, 21 nt, Human
agaaggaaaucaggucugaga

SEQ ID NO: 1297854 - RNA, 18 nt, Human
agacaaacggacgccaga

SEQ ID NO: 1297855 - RNA, 19 nt, Human
agacucaaaggcccugggg

SEQ ID NO: 1297856 - RNA, 25 nt, Human
agagcaggggacaggggagcaacuu

SEQ ID NO: 1297857 - RNA, 23 nt, Human
agaggaagacccugaggcucaga

SEQ ID NO: 1297858 - RNA, 22 nt, Human
agaguuuggcuuuuauucuaaa

SEQ ID NO: 1297859 - RNA, 18 nt, Human
agcaaaacaggaacuccc

SEQ ID NO: 1297860 - RNA, 20 nt, Human
agcaaaacaggaacucccuc

SEQ ID NO: 1297861 - RNA, 18 nt, Human
agcacagggccuggccag

SEQ ID NO: 1297862 - RNA, 22 nt, Human
agcaggggacaggggagcaacu

SEQ ID NO: 1297863 - RNA, 22 nt, Human
agccaaaaccagcagagccaca

SEQ ID NO: 1297864 - RNA, 26 nt, Human
agccacaagcaaaacaggaacucccu

SEQ ID NO: 1297865 - RNA, 21 nt, Human
agcccagcggccagcugcugg

SEQ ID NO: 1297866 - RNA, 20 nt, Human
aggaacucccucaccuccaa

SEQ ID NO: 1297867 - RNA, 22 nt, Human
aggaagaaggaaaucaggucug

SEQ ID NO: 1297868 - RNA, 23 nt, Human
aggaagaaggaaaucaggucuga

SEQ ID NO: 1297869 - RNA, 21 nt, Human
aggaggccucagccugagccc

SEQ ID NO: 1297870 - RNA, 24 nt, Human
aggcaggaggaggccucagccuga

SEQ ID NO: 1297871 - RNA, 18 nt, Human
aggcagguggcugggccc

SEQ ID NO: 1297872 - RNA, 20 nt, Human
aggcucgagcuccgcggcga

SEQ ID NO: 1297873 - RNA, 24 nt, Human
aggcugagcucccaccuggaagcc

SEQ ID NO: 1297874 - RNA, 21 nt, Human
aucagucacugcacaggcccc

SEQ ID NO: 1297875 - RNA, 21 nt, Human
caaaacaggaacucccucacc

SEQ ID NO: 1297876 - RNA, 18 nt, Human
caaaaccagcagagccac

SEQ ID NO: 1297877 - RNA, 21 nt, Human
caagaagagagucauuguggc

SEQ ID NO: 1297878 - RNA, 19 nt, Human
cacacacacaggggcgaga

SEQ ID NO: 1297879 - RNA, 18 nt, Human
caccucugagucccuucc

SEQ ID NO: 1297880 - RNA, 22 nt, Human
cagagaaggaaagccaaaacca

SEQ ID NO: 1297881 - RNA, 19 nt, Human
cagcaccgccuccugugug

SEQ ID NO: 1297882 - RNA, 20 nt, Human
cagcaggccagcccucccuu

SEQ ID NO: 1297883 - RNA, 20 nt, Human
cagcugcuggucugccuccc

SEQ ID NO: 1297884 - RNA, 22 nt, Human
cagcuguacguggcuggguaug

SEQ ID NO: 1297885 - RNA, 22 nt, Human
caggccccgacgacugcccuuc

SEQ ID NO: 1297886 - RNA, 19 nt, Human
caggggagcaacuuggcuc

SEQ ID NO: 1297887 - RNA, 18 nt, Human
cagggguaugugugugcg

SEQ ID NO: 1297888 - RNA, 19 nt, Human
cauccaaacacgccgggca

SEQ ID NO: 1297889 - RNA, 22 nt, Human
caugcacuggcacacccacgug

SEQ ID NO: 1297890 - RNA, 20 nt, Human
cauucccagaguugcgacug

SEQ ID NO: 1297891 - RNA, 18 nt, Human
ccaaauaggcucgagcuc

SEQ ID NO: 1297892 - RNA, 19 nt, Human
ccacaagcaaaacaggaac

SEQ ID NO: 1297893 - RNA, 19 nt, Human
cccacaagcuuagugcagc

SEQ ID NO: 1297894 - RNA, 19 nt, Human
ccccucuaguccucauucc

SEQ ID NO: 1297895 - RNA, 18 nt, Human
ccccugagacuugggcug

SEQ ID NO: 1297896 - RNA, 19 nt, Human
ccccuuggcgcugcccuga

SEQ ID NO: 1297897 - RNA, 22 nt, Human
cccguccagcccccucuagucc

SEQ ID NO: 1297898 - RNA, 21 nt, Human
cccuggggugggaacacucug

SEQ ID NO: 1297899 - RNA, 18 nt, Human
cccuuggcgcugcccuga

SEQ ID NO: 1297900 - RNA, 20 nt, Human
ccucgcuguccguccgugcc

SEQ ID NO: 1297901 - RNA, 20 nt, Human
ccucuaguccucauucccuc

SEQ ID NO: 1297902 - RNA, 19 nt, Human
ccuggaagcccagcugggc

SEQ ID NO: 1297903 - RNA, 21 nt, Human
ccuggccagcauagaucucug

SEQ ID NO: 1297904 - RNA, 25 nt, Human
ccuggggggagguggacagaggaag

SEQ ID NO: 1297905 - RNA, 20 nt, Human
cgagugguacgggcacgggg

SEQ ID NO: 1297906 - RNA, 21 nt, Human
cgccaaauaggcucgagcucc

SEQ ID NO: 1297907 - RNA, 20 nt, Human
cgcugaggccucggacagac

SEQ ID NO: 1297908 - RNA, 21 nt, Human
cgggcacggggagcccgcgug

SEQ ID NO: 1297909 - RNA, 18 nt, Human
cgggcgggaagcuuccgc

SEQ ID NO: 1297910 - RNA, 24 nt, Human
cgugugcauggaugggcucgcaca

SEQ ID NO: 1297911 - RNA, 27 nt, Human
cucagccugagcccgcggccccuuggc

SEQ ID NO: 1297912 - RNA, 21 nt, Human
cucauucccagaguugcgacu

SEQ ID NO: 1297913 - RNA, 18 nt, Human
cuccaaggauccugguau

SEQ ID NO: 1297914 - RNA, 21 nt, Human
cuccacuggacugacugcucc

SEQ ID NO: 1297915 - RNA, 24 nt, Human
cucccgcgcugggucccaggguuc

SEQ ID NO: 1297916 - RNA, 23 nt, Human
cuccgauaaucugcuuucccgag

SEQ ID NO: 1297917 - RNA, 21 nt, Human
cucugggauaggggcagguug

SEQ ID NO: 1297918 - RNA, 21 nt, Human
cugcccacaagcuuagugcag

SEQ ID NO: 1297919 - RNA, 21 nt, Human
cugcccugaacuggccuggga

SEQ ID NO: 1297920 - RNA, 23 nt, Human
cugcggccuucucuccacucucu

SEQ ID NO: 1297921 - RNA, 19 nt, Human
cugcuggucugccucccgc

SEQ ID NO: 1297922 - RNA, 22 nt, Human
cugggucccaggguucgcgcuc

SEQ ID NO: 1297923 - RNA, 18 nt, Human
cugugguuccaauucuca

SEQ ID NO: 1297924 - RNA, 18 nt, Human
gaacacucuggaacaaga

SEQ ID NO: 1297925 - RNA, 18 nt, Human
gaacccuccaaccgccuc

SEQ ID NO: 1297926 - RNA, 21 nt, Human
gaacucccucaccuccaagga

SEQ ID NO: 1297927 - RNA, 21 nt, Human
gacagacaaacggacgccaga

SEQ ID NO: 1297928 - RNA, 18 nt, Human
gagacuauuucagacugu

SEQ ID NO: 1297929 - RNA, 21 nt, Human
gagguggacagaggaagaccc

SEQ ID NO: 1297930 - RNA, 19 nt, Human
gaguugcgacugaugccaa

SEQ ID NO: 1297931 - RNA, 18 nt, Human
gauaaagagaaaugacaa

SEQ ID NO: 1297932 - RNA, 18 nt, Human
gccccggcaggcaggcga

SEQ ID NO: 1297933 - RNA, 19 nt, Human
gcccgcgugcccccagcaa

SEQ ID NO: 1297934 - RNA, 25 nt, Human
gcccugaacuggccugggagggggu

SEQ ID NO: 1297935 - RNA, 19 nt, Human
gcccuggggugggaacacu

SEQ ID NO: 1297936 - RNA, 24 nt, Human
gccuggguuuacaaaacaaaccuc

SEQ ID NO: 1297937 - RNA, 22 nt, Human
gcucgguccuggcguucacagc

SEQ ID NO: 1297938 - RNA, 18 nt, Human
gcugcggccuucucucca

SEQ ID NO: 1297939 - RNA, 23 nt, Human
gcuuuguuugcugcuguauaucu

SEQ ID NO: 1297940 - RNA, 19 nt, Human
ggaaagccaaaaccagcag

SEQ ID NO: 1297941 - RNA, 20 nt, Human
ggacagacaaacggacgcca

SEQ ID NO: 1297942 - RNA, 22 nt, Human
ggacaggggagcaacuuggcuc

SEQ ID NO: 1297943 - RNA, 22 nt, Human
ggagacgccaaauaggcucgag

SEQ ID NO: 1297944 - RNA, 21 nt, Human
ggagcaacuuggcucuuggag

SEQ ID NO: 1297945 - RNA, 18 nt, Human
ggaugggcucgcacacuu

SEQ ID NO: 1297946 - RNA, 22 nt, Human
ggcagcuuugccggacacgggg

SEQ ID NO: 1297947 - RNA, 20 nt, Human
ggccugaagugggugggugg

SEQ ID NO: 1297948 - RNA, 22 nt, Human
ggcgcacacucaguggccccgg

SEQ ID NO: 1297949 - RNA, 23 nt, Human
gggcgcacacucaguggccccgg

SEQ ID NO: 1297950 - RNA, 21 nt, Human
ggggccucagugguucucucc

SEQ ID NO: 1297951 - RNA, 19 nt, Human
ggguaugugugcaggggua

SEQ ID NO: 1297952 - RNA, 21 nt, Human
gggugacgggggcgcgcccgc

SEQ ID NO: 1297953 - RNA, 23 nt, Human
ggguuuacaaaacaaaccucuuu

SEQ ID NO: 1297954 - RNA, 24 nt, Human
ggugacgggggcgcgcccgcggaa

SEQ ID NO: 1297955 - RNA, 19 nt, Human
gugguucucucccuccauc

SEQ ID NO: 1297956 - RNA, 23 nt, Human
gugugcauggaugggcucgcaca

SEQ ID NO: 1297957 - RNA, 22 nt, Human
uaaacuguagccuuuggcaguu

SEQ ID NO: 1297958 - RNA, 26 nt, Human
uaauagaaccuguggauggggcugcu

SEQ ID NO: 1297959 - RNA, 23 nt, Human
uaaucaccaccgccucaugacaa

SEQ ID NO: 1297960 - RNA, 22 nt, Human
uaauuuguggagauuuuucgau

SEQ ID NO: 1297961 - RNA, 21 nt, Human
uacgggcacggggagcccgcg

SEQ ID NO: 1297962 - RNA, 21 nt, Human
uacguggcuggguaugugugc

SEQ ID NO: 1297963 - RNA, 21 nt, Human
uagaaccuguggauggggcug

SEQ ID NO: 1297964 - RNA, 23 nt, Human
uagagggggagucagacaacaca

SEQ ID NO: 1297965 - RNA, 23 nt, Human
uagcacauuauuuaaaagugcug

SEQ ID NO: 1297966 - RNA, 18 nt, Human
uagccacaagcaaaacag

SEQ ID NO: 1297967 - RNA, 23 nt, Human
uaugugugcagggguaugugugu

SEQ ID NO: 1297968 - RNA, 21 nt, Human
ucagucacugcacaggccccu

SEQ ID NO: 1297969 - RNA, 21 nt, Human
ucaucggccgccuccggacac

SEQ ID NO: 1297970 - RNA, 22 nt, Human
uccaaacacgccgggcacaccg

SEQ ID NO: 1297971 - RNA, 18 nt, Human
uccacggcagagaugggg

SEQ ID NO: 1297972 - RNA, 19 nt, Human
ucccaggguagcucaccuu

SEQ ID NO: 1297973 - RNA, 22 nt, Human
ucccgacccccuggccugagcu

SEQ ID NO: 1297974 - RNA, 23 nt, Human
uccgcccccaugggcacagcggg

SEQ ID NO: 1297975 - RNA, 18 nt, Human
uccucauucccucauucc

SEQ ID NO: 1297976 - RNA, 21 nt, Human
uccucauucccucauucccag

SEQ ID NO: 1297977 - RNA, 22 nt, Human
ucguaagcugcgcugaggccuc

SEQ ID NO: 1297978 - RNA, 20 nt, Human
ucuauaauuuccugucgcuu

SEQ ID NO: 1297979 - RNA, 18 nt, Human
ucucagagcuccuggcca

SEQ ID NO: 1297980 - RNA, 19 nt, Human
ucucagagcuccuggccaa

SEQ ID NO: 1297981 - RNA, 24 nt, Human
ucucagagcuccuggccaaggagu

SEQ ID NO: 1297982 - RNA, 21 nt, Human
ucugggguccaugacagugug

SEQ ID NO: 1297983 - RNA, 23 nt, Human
ucuuucuucccucagcauucuuc

SEQ ID NO: 1297984 - RNA, 22 nt, Human
ugacgggcacaucccugaacca

SEQ ID NO: 1297985 - RNA, 20 nt, Human
ugacuugcguacagccaccc

SEQ ID NO: 1297986 - RNA, 21 nt, Human
ugagggaagguaccauggcug

SEQ ID NO: 1297987 - RNA, 23 nt, Human
ugaggggaaggaggaguuaccgu

SEQ ID NO: 1297988 - RNA, 20 nt, Human
ugaugaaggcagguggcugg

SEQ ID NO: 1297989 - RNA, 25 nt, Human
ugcccuuccccgugccccucucuca

SEQ ID NO: 1297990 - RNA, 19 nt, Human
ugccugcccaucagcgcuc

SEQ ID NO: 1297991 - RNA, 20 nt, Human
ugcggaggagauggggggag

SEQ ID NO: 1297992 - RNA, 19 nt, Human
ugcuggucugccucccgcg

SEQ ID NO: 1297993 - RNA, 20 nt, Human
uggaagcccagcugggcugc

SEQ ID NO: 1297994 - RNA, 18 nt, Human
uggaggggacaguagacu

SEQ ID NO: 1297995 - RNA, 20 nt, Human
uggcacacccacguguccaa

SEQ ID NO: 1297996 - RNA, 21 nt, Human
uggcugcagugaggaagaagg

SEQ ID NO: 1297997 - RNA, 19 nt, Human
uggcugggcccguccagcc

SEQ ID NO: 1297998 - RNA, 20 nt, Human
ugggagggggugacgggggc

SEQ ID NO: 1297999 - RNA, 21 nt, Human
ugggagggggugacgggggcg

SEQ ID NO: 1298000 - RNA, 20 nt, Human
ugggaugcguucucagaaac

SEQ ID NO: 1298001 - RNA, 23 nt, Human
ugggugggaacccuggugcacag

SEQ ID NO: 1298002 - RNA, 21 nt, Human
uggguuuacaaaacaaaccuc

SEQ ID NO: 1298003 - RNA, 20 nt, Human
ugguaaugaucagucacugc

SEQ ID NO: 1298004 - RNA, 18 nt, Human
ugguggggcuggaguggc

SEQ ID NO: 1298005 - RNA, 20 nt, Human
ugguggggcuggaguggcug

SEQ ID NO: 1298006 - RNA, 19 nt, Human
ugugcagggguaugugugu

SEQ ID NO: 1298007 - RNA, 23 nt, Human
ugugguacacuuguuugacacac

SEQ ID NO: 1298008 - RNA, 24 nt, Human
ugugguuccaauucucacaggcug

SEQ ID NO: 1298009 - RNA, 19 nt, Human
ugugugcagggguaugugu

SEQ ID NO: 1298010 - RNA, 22 nt, Human
ugugugugcggaggagaugggg

SEQ ID NO: 1298011 - RNA, 22 nt, Human
uguucuccgcccccaugggccu

SEQ ID NO: 1298012 - RNA, 22 nt, Human
uuagugcagcaccgccuccugu

SEQ ID NO: 1298013 - RNA, 21 nt, Human
uuauucuaaauucagugggau

SEQ ID NO: 1298014 - RNA, 24 nt, Human
uucacagcccagcggccagcugcu

SEQ ID NO: 1298015 - RNA, 25 nt, Human
uucucagagcuccuggccaaggagu

SEQ ID NO: 1298016 - RNA, 18 nt, Human
uucugccaguaauccugg

SEQ ID NO: 1298017 - RNA, 22 nt, Human
uuggaagguuacagagaaggaa

SEQ ID NO: 1298018 - RNA, 21 nt, Human
uuggggcauuucugagggaag

SEQ ID NO: 1298019 - RNA, 18 nt, Human
uugguggggcuggagugg

SEQ ID NO: 1298020 - RNA, 19 nt, Human
uugguggggcuggaguggc

SEQ ID NO: 1298021 - RNA, 19 nt, Human
uuuauauauuaugcuucca

SEQ ID NO: 1298022 - RNA, 18 nt, Human
aaucgcuugaaccuggga

SEQ ID NO: 1298023 - RNA, 24 nt, Human
aaucgcuugaaccugggaggcaga

SEQ ID NO: 1298024 - RNA, 23 nt, Human
accuauaguuccagcuacucggg

SEQ ID NO: 1298025 - RNA, 23 nt, Human
acugcagagagccacucacugau

SEQ ID NO: 1298026 - RNA, 22 nt, Human
agaaucgcuugaaccugggagg

SEQ ID NO: 1298027 - RNA, 19 nt, Human
agccacucacugauuuuca

SEQ ID NO: 1298028 - RNA, 22 nt, Human
aggcaggagaaucgcuugaacc

SEQ ID NO: 1298029 - RNA, 24 nt, Human
aggcaggagaaucgcuugaaccug

SEQ ID NO: 1298030 - RNA, 20 nt, Human
aggcugaggcaggagaaucg

SEQ ID NO: 1298031 - RNA, 24 nt, Human
aggcugaggcaggagaaucgcuug

SEQ ID NO: 1298032 - RNA, 24 nt, Human
cagcuacucgggaggcugaggcag

SEQ ID NO: 1298033 - RNA, 21 nt, Human
ccccuagaugaccuauaguuc

SEQ ID NO: 1298034 - RNA, 21 nt, Human
ccuauaguuccagcuacucgg

SEQ ID NO: 1298035 - RNA, 21 nt, Human
gagagccacucacugauuuuc

SEQ ID NO: 1298036 - RNA, 18 nt, Human
gucucaauccucauacuu

SEQ ID NO: 1298037 - RNA, 25 nt, Human
guugcuagagugaauaaccuuguga

SEQ ID NO: 1298038 - RNA, 27 nt, Human
ucaauccucauacuucuguuuuccccu

SEQ ID NO: 1298039 - RNA, 18 nt, Human
ucgcuugaaccugggagg

SEQ ID NO: 1298040 - RNA, 24 nt, Human
ucgggaggcugaggcaggagaauc

SEQ ID NO: 1298041 - RNA, 20 nt, Human
ugaggcaggagaaucgcuug

SEQ ID NO: 1298042 - RNA, 24 nt, Human
ugaggcaggagaaucgcuugaacc

SEQ ID NO: 1298043 - RNA, 24 nt, Human
ugaggcaggagaaucgcuugaacc

SEQ ID NO: 1298044 - RNA, 19 nt, Human
uguaaccacugcagagagc

SEQ ID NO: 1298045 - RNA, 19 nt, Human
uuagaacauaguauauauu

SEQ ID NO: 1298046 - RNA, 23 nt, Human
uuuuuuaguugcuagagugaaua

SEQ ID NO: 1298047 - RNA, 22 nt, Human
cagucucuucuccucuuucaaa

SEQ ID NO: 1298048 - RNA, 19 nt, Human
ggaguacagacucaauucg

SEQ ID NO: 1298049 - RNA, 22 nt, Human
ucgaacaguguauccacagcuu

SEQ ID NO: 1298050 - RNA, 22 nt, Human
uuuccagucucuucuccucuuu

SEQ ID NO: 1298051 - RNA, 25 nt, Human
aagcaucaggauuacacuuuaaaga

SEQ ID NO: 1298052 - RNA, 20 nt, Human
aagggcuggcaaaauccagg

SEQ ID NO: 1298053 - RNA, 20 nt, Human
acaauacaagggguaggcac

SEQ ID NO: 1298054 - RNA, 24 nt, Human
accagcaccaacuucaucuggaaa

SEQ ID NO: 1298055 - RNA, 23 nt, Human
acuggaacagcaaaagggcuggu

SEQ ID NO: 1298056 - RNA, 20 nt, Human
aguuacaauuuuagcugcuu

SEQ ID NO: 1298057 - RNA, 19 nt, Human
auuagagguauaagcuuug

SEQ ID NO: 1298058 - RNA, 19 nt, Human
auucagagaugauauuuuu

SEQ ID NO: 1298059 - RNA, 19 nt, Human
auuuguuucugcuucccuu

SEQ ID NO: 1298060 - RNA, 19 nt, Human
caacuucaucuggaaaggc

SEQ ID NO: 1298061 - RNA, 21 nt, Human
caagucuccgccugaugguaa

SEQ ID NO: 1298062 - RNA, 23 nt, Human
caauacaagggguaggcacugag

SEQ ID NO: 1298063 - RNA, 23 nt, Human
cacuuuaaagacugucuucugcc

SEQ ID NO: 1298064 - RNA, 20 nt, Human
cagaggacuaccauaguuuc

SEQ ID NO: 1298065 - RNA, 21 nt, Human
cagagucagaaccacagguac

SEQ ID NO: 1298066 - RNA, 25 nt, Human
cagcaaaagggcuggcaaaauccag

SEQ ID NO: 1298067 - RNA, 19 nt, Human
caucuggaaaggcaguucc

SEQ ID NO: 1298068 - RNA, 19 nt, Human
ccccaauaaaucgaaguaa

SEQ ID NO: 1298069 - RNA, 19 nt, Human
ccguggccuucuccucuuc

SEQ ID NO: 1298070 - RNA, 24 nt, Human
ccguggccuucuccucuucugacu

SEQ ID NO: 1298071 - RNA, 19 nt, Human
ccucugcaucaguacuguu

SEQ ID NO: 1298072 - RNA, 21 nt, Human
ccuucuccucuucugacucug

SEQ ID NO: 1298073 - RNA, 27 nt, Human
cgauuuucaagucuccgccugauggua

SEQ ID NO: 1298074 - RNA, 22 nt, Human
cguggccuucuccucuucugaa

SEQ ID NO: 1298075 - RNA, 23 nt, Human
cuuucuggaacaacagacucuga

SEQ ID NO: 1298076 - RNA, 21 nt, Human
gagaugauauuuuugauauga

SEQ ID NO: 1298077 - RNA, 18 nt, Human
uaaaauuccagaggacua

SEQ ID NO: 1298078 - RNA, 23 nt, Human
uaaggcagauaaucgcagcauca

SEQ ID NO: 1298079 - RNA, 18 nt, Human
uacuagauaaugaacugc

SEQ ID NO: 1298080 - RNA, 18 nt, Human
uagcguaccucccacauu

SEQ ID NO: 1298081 - RNA, 24 nt, Human
uagcguaccucccacauuaaugcu

SEQ ID NO: 1298082 - RNA, 21 nt, Human
uauaaguauccaguauaucag

SEQ ID NO: 1298083 - RNA, 19 nt, Human
ucagaaagagaugaaucuu

SEQ ID NO: 1298084 - RNA, 20 nt, Human
ucagagucagaaccacaggu

SEQ ID NO: 1298085 - RNA, 24 nt, Human
ucuggaaugagccccccacucucc

SEQ ID NO: 1298086 - RNA, 23 nt, Human
ucuguaccguggccuucuccucu

SEQ ID NO: 1298087 - RNA, 21 nt, Human
ucuuccugggagacaggaacu

SEQ ID NO: 1298088 - RNA, 20 nt, Human
ugaaucuuguugucuuucug

SEQ ID NO: 1298089 - RNA, 25 nt, Human
uggaacagcaaaagggcuggcaaaa

SEQ ID NO: 1298090 - RNA, 24 nt, Human
uggauaagcaacuacaguacaaua

SEQ ID NO: 1298091 - RNA, 25 nt, Human
ugggagacaggaacaccagcaccaa

SEQ ID NO: 1298092 - RNA, 26 nt, Human
uguuucguucuucugcuuuaauuuua

SEQ ID NO: 1298093 - RNA, 19 nt, Human
uuagacguuuucuguaccg

SEQ ID NO: 1298094 - RNA, 19 nt, Human
uucagagucagagucagaa

SEQ ID NO: 1298095 - RNA, 21 nt, Human
uucucucucauuauuguccca

SEQ ID NO: 1298096 - RNA, 20 nt, Human
uugaauauuuggcgaacauc

SEQ ID NO: 1298097 - RNA, 21 nt, Human
uugcauuguuuuuuccaagca

SEQ ID NO: 1298098 - RNA, 21 nt, Human
uuuaaagacugucuucugccu

SEQ ID NO: 1298099 - RNA, 23 nt, Human
uuuauuagagguauaagcuuugg

SEQ ID NO: 1298100 - RNA, 23 nt, Human
caacuucacugaaaggauuagau

SEQ ID NO: 1298101 - RNA, 25 nt, Human
gaccacugcuuccugcauucacuuu

SEQ ID NO: 1298102 - RNA, 27 nt, Human
ucccuguaauuucagguaaaucucugg

SEQ ID NO: 1298103 - RNA, 22 nt, Human
ugagcccagugugaccacugcu

SEQ ID NO: 1298104 - RNA, 23 nt, Human
ugagcccagugugaccacugcuu

SEQ ID NO: 1298105 - RNA, 18 nt, Human
ugugaccacugcuuccug

SEQ ID NO: 1298106 - RNA, 21 nt, Human
uucacuuuaccccagugugac

SEQ ID NO: 1298107 - RNA, 22 nt, Human
caccaguuacauagggcugccc

SEQ ID NO: 1298108 - RNA, 18 nt, Human
ccucuuccuucucuuugc

SEQ ID NO: 1298109 - RNA, 23 nt, Human
uuccucuuccuucucuuugcaga

SEQ ID NO: 1298110 - RNA, 24 nt, Human
uuccucuuccuucucuuugcagac

SEQ ID NO: 1298111 - RNA, 22 nt, Human
aggcggcggugcagcgcggcgg

SEQ ID NO: 1298112 - RNA, 23 nt, Human
agguccucaacacaggggggucu

SEQ ID NO: 1298113 - RNA, 18 nt, Human
aguacugauuugagguug

SEQ ID NO: 1298114 - RNA, 21 nt, Human
aucggcuuuccucaucuaggu

SEQ ID NO: 1298115 - RNA, 20 nt, Human
cggugcgguggcccagcgcg

SEQ ID NO: 1298116 - RNA, 21 nt, Human
cuccugcuggugccacggggc

SEQ ID NO: 1298117 - RNA, 18 nt, Human
cuuguggugggaaggaac

SEQ ID NO: 1298118 - RNA, 19 nt, Human
gcagcggcggcuugcaggg

SEQ ID NO: 1298119 - RNA, 26 nt, Human
gccgcaacuuaucgcauuuugcgugc

SEQ ID NO: 1298120 - RNA, 22 nt, Human
gcggugcgguggcccagcgcgg

SEQ ID NO: 1298121 - RNA, 19 nt, Human
ggcggcggugcagcgcggc

SEQ ID NO: 1298122 - RNA, 21 nt, Human
uaguggacuguccaucggcuu

SEQ ID NO: 1298123 - RNA, 22 nt, Human
uaucgcauucccucaguacuga

SEQ ID NO: 1298124 - RNA, 22 nt, Human
ugggaaggaacacauucuccug

SEQ ID NO: 1298125 - RNA, 18 nt, Human
uuggcggugcagguccuc

SEQ ID NO: 1298126 - RNA, 19 nt, Human
aagcggagguugcaaugag

SEQ ID NO: 1298127 - RNA, 24 nt, Human
aauugcuugaauccaggaagcgga

SEQ ID NO: 1298128 - RNA, 25 nt, Human
acacagcaagacucuguccauaaaa

SEQ ID NO: 1298129 - RNA, 24 nt, Human
acaccacugcacucuagcuugggc

SEQ ID NO: 1298130 - RNA, 21 nt, Human
accacagguuccuucccaaca

SEQ ID NO: 1298131 - RNA, 24 nt, Human
accacugcacucuagcuugggcga

SEQ ID NO: 1298132 - RNA, 18 nt, Human
acugcacucuagcuuggg

SEQ ID NO: 1298133 - RNA, 25 nt, Human
acugcacucuagcuugggcgacaca

SEQ ID NO: 1298134 - RNA, 20 nt, Human
acuuuaacgggaaagaaaaa

SEQ ID NO: 1298135 - RNA, 20 nt, Human
agagaagccagcacaaaccc

SEQ ID NO: 1298136 - RNA, 25 nt, Human
agagaagccagcacaaaccggaccc

SEQ ID NO: 1298137 - RNA, 24 nt, Human
agccuguagucccagcuacuuggg

SEQ ID NO: 1298138 - RNA, 24 nt, Human
agcuugggcgacacagcaagacuc

SEQ ID NO: 1298139 - RNA, 20 nt, Human
agguuccuucccaacagucc

SEQ ID NO: 1298140 - RNA, 23 nt, Human
agugauagagaagccagcacaaa

SEQ ID NO: 1298141 - RNA, 24 nt, Human
augacaccacugcacucuagcuug

SEQ ID NO: 1298142 - RNA, 20 nt, Human
auggguguaauguguguaag

SEQ ID NO: 1298143 - RNA, 24 nt, Human
caaaaguccacaguccaaagucuc

SEQ ID NO: 1298144 - RNA, 19 nt, Human
cacugcacucuagcuuggg

SEQ ID NO: 1298145 - RNA, 21 nt, Human
cacugcacucuagcuugggcg

SEQ ID NO: 1298146 - RNA, 22 nt, Human
cacugcacucuagcuugggcga

SEQ ID NO: 1298147 - RNA, 23 nt, Human
cacugcacucuagcuugggcgac

SEQ ID NO: 1298148 - RNA, 24 nt, Human
cacugcacucuagcuugggcgaca

SEQ ID NO: 1298149 - RNA, 22 nt, Human
cagcacaaacccacuuuaacgg

SEQ ID NO: 1298150 - RNA, 24 nt, Human
ccacagguuccuucccaacagucc

SEQ ID NO: 1298151 - RNA, 20 nt, Human
ccacugcacucuagcuuggg

SEQ ID NO: 1298152 - RNA, 21 nt, Human
ccacugcacucuagcuugggc

SEQ ID NO: 1298153 - RNA, 21 nt, Human
ccacugcacucuagcuugggc

SEQ ID NO: 1298154 - RNA, 23 nt, Human
ccacugcacucuagcuugggcga

SEQ ID NO: 1298155 - RNA, 24 nt, Human
ccacugcacucuagcuugggcgac

SEQ ID NO: 1298156 - RNA, 21 nt, Human
cccaaaaguccacaguccaaa

SEQ ID NO: 1298157 - RNA, 18 nt, Human
cccaggaacuccaaaaau

SEQ ID NO: 1298158 - RNA, 18 nt, Human
ccuguagucccagcuacu

SEQ ID NO: 1298159 - RNA, 21 nt, Human
ccuguagucccagcuacuugg

SEQ ID NO: 1298160 - RNA, 21 nt, Human
cgggaaagaaaaaguacuuau

SEQ ID NO: 1298161 - RNA, 29 nt, Human
cuuuugcugcgucagcuucauuuuuaacu

SEQ ID NO: 1298162 - RNA, 19 nt, Human
gagguugcaaugagcccag

SEQ ID NO: 1298163 - RNA, 19 nt, Human
ggagguugcaaugagccca

SEQ ID NO: 1298164 - RNA, 20 nt, Human
ggagguugcaaugagcccag

SEQ ID NO: 1298165 - RNA, 22 nt, Human
ggcaugagaauugcuugaaucc

SEQ ID NO: 1298166 - RNA, 19 nt, Human
guuuuauggguguaaugug

SEQ ID NO: 1298167 - RNA, 18 nt, Human
uaauagugguaacagacu

SEQ ID NO: 1298168 - RNA, 20 nt, Human
uagagaagccagcacaaacc

SEQ ID NO: 1298169 - RNA, 24 nt, Human
uagcuugggcgacacagcaagacu

SEQ ID NO: 1298170 - RNA, 20 nt, Human
uaguuccuuggcacugccuu

SEQ ID NO: 1298171 - RNA, 21 nt, Human
uauggguguaauguguguaag

SEQ ID NO: 1298172 - RNA, 23 nt, Human
uauguguagggcccgaacagagu

SEQ ID NO: 1298173 - RNA, 21 nt, Human
uccacaguccaaagucucauc

SEQ ID NO: 1298174 - RNA, 27 nt, Human
uccacaguccaaagucucaucugagac

SEQ ID NO: 1298175 - RNA, 27 nt, Human
ugaaaucuaauuuuagauguuguuucu

SEQ ID NO: 1298176 - RNA, 23 nt, Human
ugacccaggaacuccaaaaaugu

SEQ ID NO: 1298177 - RNA, 22 nt, Human
ugagugauagagaagccagcac

SEQ ID NO: 1298178 - RNA, 19 nt, Human
ugcuugaauccaggaagcg

SEQ ID NO: 1298179 - RNA, 20 nt, Human
uguaguuucaauaaaacauu

SEQ ID NO: 1298180 - RNA, 25 nt, Human
uguguaagagguaggaaguguugcc

SEQ ID NO: 1298181 - RNA, 21 nt, Human
uguuuuauggguguaaugugu

SEQ ID NO: 1298182 - RNA, 18 nt, Human
uucuuuuaguuccuuggc

SEQ ID NO: 1298183 - RNA, 24 nt, Human
uugcuugaauccaggaagcggagg

SEQ ID NO: 1298184 - RNA, 29 nt, Human
aaaaaaacaaaaaaugaaaaacaaaaaag

SEQ ID NO: 1298185 - RNA, 22 nt, Human
aaaaaacaaaaaaugaaaaaca

SEQ ID NO: 1298186 - RNA, 23 nt, Human
aaaacaaaaaaugaaaaacaaaa

SEQ ID NO: 1298187 - RNA, 24 nt, Human
aaaacaaaaaaugaaaaacaaaaa

SEQ ID NO: 1298188 - RNA, 21 nt, Human
aaacuacaguuuaaucauuug

SEQ ID NO: 1298189 - RNA, 18 nt, Human
aagaaaagagaguuuaaa

SEQ ID NO: 1298190 - RNA, 22 nt, Human
aagaaaagagaguuuaaaacac

SEQ ID NO: 1298191 - RNA, 25 nt, Human
aagaggaagcaggagcagacagaga

SEQ ID NO: 1298192 - RNA, 21 nt, Human
aagcagaagcugaaaaaacaa

SEQ ID NO: 1298193 - RNA, 23 nt, Human
aagcagaagcugaaaaaacaauu

SEQ ID NO: 1298194 - RNA, 25 nt, Human
aagcagaagcugaaaaaagggaccc

SEQ ID NO: 1298195 - RNA, 20 nt, Human
aaguacaacaaaaccgaugc

SEQ ID NO: 1298196 - RNA, 19 nt, Human
aagucugcucuucuauaac

SEQ ID NO: 1298197 - RNA, 23 nt, Human
aauaucaucaccaaccucaaacu

SEQ ID NO: 1298198 - RNA, 18 nt, Human
acacaaaccaggaugugg

SEQ ID NO: 1298199 - RNA, 22 nt, Human
acaguuuaaucauuugagggag

SEQ ID NO: 1298200 - RNA, 20 nt, Human
acccaugcagccuaaugcca

SEQ ID NO: 1298201 - RNA, 24 nt, Human
accccuaccccgggaaaaaaaaac

SEQ ID NO: 1298202 - RNA, 20 nt, Human
acuacaguuuaaucauuuga

SEQ ID NO: 1298203 - RNA, 20 nt, Human
agcacuuuaggguugguuga

SEQ ID NO: 1298204 - RNA, 21 nt, Human
aggaagccaacaagaggaagc

SEQ ID NO: 1298205 - RNA, 19 nt, Human
aggcaaaacacaaaccagg

SEQ ID NO: 1298206 - RNA, 23 nt, Human
agggggguaggagaagguuggag

SEQ ID NO: 1298207 - RNA, 23 nt, Human
auacuguaauccagaaaucugcu

SEQ ID NO: 1298208 - RNA, 23 nt, Human
aucuguaccuacaucacucuuca

SEQ ID NO: 1298209 - RNA, 19 nt, Human
caaaauacugaaauugacu

SEQ ID NO: 1298210 - RNA, 23 nt, Human
caaaauacugaaauugacugaua

SEQ ID NO: 1298211 - RNA, 18 nt, Human
caaauacuguaauccaga

SEQ ID NO: 1298212 - RNA, 24 nt, Human
caacaaaauacugaaauugacuga

SEQ ID NO: 1298213 - RNA, 24 nt, Human
caacaaacuugauggaaacucuaa

SEQ ID NO: 1298214 - RNA, 24 nt, Human
caagagcacuuuaggguugguuga

SEQ ID NO: 1298215 - RNA, 22 nt, Human
caaguacaacaaaaccgaugcu

SEQ ID NO: 1298216 - RNA, 19 nt, Human
caauaugcaccccuacccc

SEQ ID NO: 1298217 - RNA, 21 nt, Human
cacaagcagaagcugaaaaaa

SEQ ID NO: 1298218 - RNA, 20 nt, Human
caggacccucagaauguuua

SEQ ID NO: 1298219 - RNA, 18 nt, Human
cagggggguaggagaagg

SEQ ID NO: 1298220 - RNA, 24 nt, Human
cauaaaacguccaggacccucaga

SEQ ID NO: 1298221 - RNA, 20 nt, Human
caucugugcaucuguaccua

SEQ ID NO: 1298222 - RNA, 22 nt, Human
ccaacaagaggaagcaggagca

SEQ ID NO: 1298223 - RNA, 21 nt, Human
ccaaccucaaacuggaacuaa

SEQ ID NO: 1298224 - RNA, 23 nt, Human
ccaaguacaacaaaaccgaugcu

SEQ ID NO: 1298225 - RNA, 21 nt, Human
ccaugcagccuaaugccaugu

SEQ ID NO: 1298226 - RNA, 19 nt, Human
cccaugcagccuaaugcca

SEQ ID NO: 1298227 - RNA, 21 nt, Human
cccaugcagccuaaugccaug

SEQ ID NO: 1298228 - RNA, 23 nt, Human
ccuaaugccauguugcuucucug

SEQ ID NO: 1298229 - RNA, 20 nt, Human
ccuucaagaccagcugcuac

SEQ ID NO: 1298230 - RNA, 19 nt, Human
cggcuccauuaucuccagg

SEQ ID NO: 1298231 - RNA, 18 nt, Human
cuaauagaaauaaucaua

SEQ ID NO: 1298232 - RNA, 26 nt, Human
cuacuagaaugauucuaauuuacugg

SEQ ID NO: 1298233 - RNA, 22 nt, Human
cucacaacaaacuugauggaaa

SEQ ID NO: 1298234 - RNA, 23 nt, Human
cucagcgguggggccaacucgau

SEQ ID NO: 1298235 - RNA, 19 nt, Human
gaacacaguacacacaucc

SEQ ID NO: 1298236 - RNA, 21 nt, Human
gaagucacaagcagaagcuga

SEQ ID NO: 1298237 - RNA, 21 nt, Human
gagaguuuaaaacacugcagg

SEQ ID NO: 1298238 - RNA, 23 nt, Human
gccauguugcuucucuggcacua

SEQ ID NO: 1298239 - RNA, 24 nt, Human
ggcacaggaagccaacaagaggaa

SEQ ID NO: 1298240 - RNA, 22 nt, Human
ggcgaacagaaauuaagaagaa

SEQ ID NO: 1298241 - RNA, 22 nt, Human
gggaaaaaaaaacaaaaaauga

SEQ ID NO: 1298242 - RNA, 22 nt, Human
ggguaggagaagguuggaggga

SEQ ID NO: 1298243 - RNA, 25 nt, Human
guaaaagacggcuccauuaucucca

SEQ ID NO: 1298244 - RNA, 23 nt, Human
gugaacacaguacacacauccaa

SEQ ID NO: 1298245 - RNA, 19 nt, Human
uaaaacguccaggacccuc

SEQ ID NO: 1298246 - RNA, 20 nt, Human
uaagucugcucuucuauaac

SEQ ID NO: 1298247 - RNA, 21 nt, Human
uaagucugcucuucuauaacc

SEQ ID NO: 1298248 - RNA, 24 nt, Human
uacaucacucuucaguuuaccaaa

SEQ ID NO: 1298249 - RNA, 21 nt, Human
uaccccgggaaaaaaaaacaa

SEQ ID NO: 1298250 - RNA, 24 nt, Human
uaccccgggaaaaaaaaacaaaaa

SEQ ID NO: 1298251 - RNA, 22 nt, Human
uacuguaauccagaaaucugcu

SEQ ID NO: 1298252 - RNA, 22 nt, Human
uacuuggcuauauaaaguuuaa

SEQ ID NO: 1298253 - RNA, 24 nt, Human
uagaauaaaaaucuuugucaaagc

SEQ ID NO: 1298254 - RNA, 18 nt, Human
uaggagaagguuggaggg

SEQ ID NO: 1298255 - RNA, 18 nt, Human
uaggcaaaacacaaacca

SEQ ID NO: 1298256 - RNA, 23 nt, Human
uaggcaaaacacaaaccaggaug

SEQ ID NO: 1298257 - RNA, 27 nt, Human
uauacuuuggcaguuuuuuuuuggugg

SEQ ID NO: 1298258 - RNA, 18 nt, Human
uaucuccagggcaugagg

SEQ ID NO: 1298259 - RNA, 18 nt, Human
ucaagcaauuauaaaagc

SEQ ID NO: 1298260 - RNA, 22 nt, Human
ucaguuuaccaaagccucucau

SEQ ID NO: 1298261 - RNA, 20 nt, Human
ucaucaccaaccucaaacug

SEQ ID NO: 1298262 - RNA, 19 nt, Human
uccagggcaugaggaaaau

SEQ ID NO: 1298263 - RNA, 24 nt, Human
uccagggcaugaggaaaauacagg

SEQ ID NO: 1298264 - RNA, 24 nt, Human
uccuaguaacucacaacaaacuug

SEQ ID NO: 1298265 - RNA, 21 nt, Human
ucuguaccuacaucacucuuc

SEQ ID NO: 1298266 - RNA, 21 nt, Human
ucuuugucaaagcucaacaaa

SEQ ID NO: 1298267 - RNA, 19 nt, Human
ugaaaaacaaaaaagucuc

SEQ ID NO: 1298268 - RNA, 22 nt, Human
ugacaaauacuguaauccagaa

SEQ ID NO: 1298269 - RNA, 18 nt, Human
ugaguaaaagacggcucc

SEQ ID NO: 1298270 - RNA, 19 nt, Human
ugcugggcuggcgcagggc

SEQ ID NO: 1298271 - RNA, 20 nt, Human
uggaacuaauagaaauaauc

SEQ ID NO: 1298272 - RNA, 20 nt, Human
ugggauguaacuggcagaaa

SEQ ID NO: 1298273 - RNA, 22 nt, Human
uguaacuggcagaaacaagcac

SEQ ID NO: 1298274 - RNA, 27 nt, Human
ugugcaucuguaccuacaucacucuuc

SEQ ID NO: 1298275 - RNA, 22 nt, Human
uuaaaacacugcagggggguag

SEQ ID NO: 1298276 - RNA, 21 nt, Human
uuauuuacuuuaucuucccua

SEQ ID NO: 1298277 - RNA, 23 nt, Human
uucuacaucugugcaucuguacc

SEQ ID NO: 1298278 - RNA, 21 nt, Human
uucucuggcacuaccuccuag

SEQ ID NO: 1298279 - RNA, 21 nt, Human
uugaggcgaacagaaauuaag

SEQ ID NO: 1298280 - RNA, 20 nt, Human
uuuuuggugguuuuuguuuu

SEQ ID NO: 1298281 - RNA, 21 nt, Human
cccgcgagccgcccgcggccg

SEQ ID NO: 1298282 - RNA, 23 nt, Human
acagcagcaguugaugucacacu

SEQ ID NO: 1298283 - RNA, 22 nt, Human
acugaaauccacggagcugcag

SEQ ID NO: 1298284 - RNA, 24 nt, Human
agaaaagacacugaaauccacgga

SEQ ID NO: 1298285 - RNA, 22 nt, Human
agacacugaaauccacggagcu

SEQ ID NO: 1298286 - RNA, 21 nt, Human
aggcagaaaagacacugaaau

SEQ ID NO: 1298287 - RNA, 24 nt, Human
aggcagaaaagacacugaaaucca

SEQ ID NO: 1298288 - RNA, 20 nt, Human
ugaaauccacggagcugcag

SEQ ID NO: 1298289 - RNA, 21 nt, Human
aaaccggucccauuucccgca

SEQ ID NO: 1298290 - RNA, 22 nt, Human
caccagccucggagccggaccc

SEQ ID NO: 1298291 - RNA, 23 nt, Human
ccagcguugaagccugagcucug

SEQ ID NO: 1298292 - RNA, 20 nt, Human
cccccagcucucggugggcg

SEQ ID NO: 1298293 - RNA, 18 nt, Human
ccccgcccugggcucccc

SEQ ID NO: 1298294 - RNA, 19 nt, Human
cccugggcucccccagcuc

SEQ ID NO: 1298295 - RNA, 23 nt, Human
ccgugcccaccagccucggagcc

SEQ ID NO: 1298296 - RNA, 19 nt, Human
ccuccccgcccugggcucc

SEQ ID NO: 1298297 - RNA, 21 nt, Human
cgcccugggcucccccagcuc

SEQ ID NO: 1298298 - RNA, 20 nt, Human
cggccgcgcccuccccgccc

SEQ ID NO: 1298299 - RNA, 21 nt, Human
cggcgcucgcuccggccgcgc

SEQ ID NO: 1298300 - RNA, 21 nt, Human
cucagcgccgcgaagaacaaa

SEQ ID NO: 1298301 - RNA, 19 nt, Human
cucccaggcugauuucugg

SEQ ID NO: 1298302 - RNA, 19 nt, Human
cuccggccgcgcccucccc

SEQ ID NO: 1298303 - RNA, 20 nt, Human
cucggagccggacccagcuu

SEQ ID NO: 1298304 - RNA, 20 nt, Human
cucucggugggcgccgcguc

SEQ ID NO: 1298305 - RNA, 22 nt, Human
gaacaagucaaaccggucccau

SEQ ID NO: 1298306 - RNA, 21 nt, Human
gacccagcuucucccaggcug

SEQ ID NO: 1298307 - RNA, 19 nt, Human
gccgcgcccuccccgcccu

SEQ ID NO: 1298308 - RNA, 18 nt, Human
gccugagcucuguggcug

SEQ ID NO: 1298309 - RNA, 23 nt, Human
ggugggaggcuaaacuaaccgcc

SEQ ID NO: 1298310 - RNA, 20 nt, Human
ucagcgccgcgaagaacaaa

SEQ ID NO: 1298311 - RNA, 20 nt, Human
ucccgggcggcgcucgcucc

SEQ ID NO: 1298312 - RNA, 24 nt, Human
ucccgggcggcgcucgcuccggcc

SEQ ID NO: 1298313 - RNA, 18 nt, Human
ugauuucuggccuggccc

SEQ ID NO: 1298314 - RNA, 24 nt, Human
ugccagggguucuggcggggcucg

SEQ ID NO: 1298315 - RNA, 19 nt, Human
uggggccgugcccaccagc

SEQ ID NO: 1298316 - RNA, 18 nt, Human
uggugggugggaggcuaa

SEQ ID NO: 1298317 - RNA, 25 nt, Human
aaaccaaaccaaacaaacacacaaa

SEQ ID NO: 1298318 - RNA, 28 nt, Human
aaaccaaaccaaacaaacacacaaaaaa

SEQ ID NO: 1298319 - RNA, 19 nt, Human
aacaugacgaaaccccauc

SEQ ID NO: 1298320 - RNA, 21 nt, Human
aacaugacgaaaccccaucuc

SEQ ID NO: 1298321 - RNA, 21 nt, Human
aacaugacgaaaccccaucuc

SEQ ID NO: 1298322 - RNA, 19 nt, Human
aacuucugccucccgguuc

SEQ ID NO: 1298323 - RNA, 18 nt, Human
aagagaugguucagagac

SEQ ID NO: 1298324 - RNA, 18 nt, Human
aagggguuucacuauguu

SEQ ID NO: 1298325 - RNA, 20 nt, Human
aagggguuucacuauguugg

SEQ ID NO: 1298326 - RNA, 24 nt, Human
aagggguuucacuauguuggccag

SEQ ID NO: 1298327 - RNA, 24 nt, Human
aaugugcugggguuacaggcguga

SEQ ID NO: 1298328 - RNA, 18 nt, Human
acgaaaccccaucucuac

SEQ ID NO: 1298329 - RNA, 25 nt, Human
acgggcgcccgccaccacaccuggc

SEQ ID NO: 1298330 - RNA, 24 nt, Human
acuauguuggccaggcuggucuug

SEQ ID NO: 1298331 - RNA, 25 nt, Human
acucuguugcccaggcuggagugca

SEQ ID NO: 1298332 - RNA, 26 nt, Human
acuucaaagaacggucggcuucgggg

SEQ ID NO: 1298333 - RNA, 20 nt, Human
agagaagggguuucacuaug

SEQ ID NO: 1298334 - RNA, 23 nt, Human
agagucucacucuguugcccagg

SEQ ID NO: 1298335 - RNA, 22 nt, Human
agcacuuugggaggcugaggug

SEQ ID NO: 1298336 - RNA, 19 nt, Human
agccacaguaucgggcagc

SEQ ID NO: 1298337 - RNA, 24 nt, Human
agccugggcaacaugacgaaaccc

SEQ ID NO: 1298338 - RNA, 20 nt, Human
agcgaggagacagacuggga

SEQ ID NO: 1298339 - RNA, 21 nt, Human
aggaguuggagaccagccugg

SEQ ID NO: 1298340 - RNA, 24 nt, Human
aggcugaggugugaggaucacuug

SEQ ID NO: 1298341 - RNA, 25 nt, Human
aggcuggagugcaguggugugaucu

SEQ ID NO: 1298342 - RNA, 22 nt, Human
agggaaaccccaggggaggcgg

SEQ ID NO: 1298343 - RNA, 24 nt, Human
agggguuucacuauguuggccagg

SEQ ID NO: 1298344 - RNA, 18 nt, Human
aguagcugggauuacggg

SEQ ID NO: 1298345 - RNA, 19 nt, Human
agugcaguggugugaucuc

SEQ ID NO: 1298346 - RNA, 20 nt, Human
agugcaguggugugaucucg

SEQ ID NO: 1298347 - RNA, 23 nt, Human
agugcaguggugugaucucggcu

SEQ ID NO: 1298348 - RNA, 24 nt, Human
agugcaguggugugaucucggcuc

SEQ ID NO: 1298349 - RNA, 24 nt, Human
auacaaaccaaaccaaacaaacac

SEQ ID NO: 1298350 - RNA, 19 nt, Human
augcaccccuccuggccag

SEQ ID NO: 1298351 - RNA, 23 nt, Human
auuggagagauuaagugagagga

SEQ ID NO: 1298352 - RNA, 21 nt, Human
caaacaaacacacaaaaaacu

SEQ ID NO: 1298353 - RNA, 21 nt, Human
caacucacccaagaagagccu

SEQ ID NO: 1298354 - RNA, 20 nt, Human
caagaagagccuaauggucg

SEQ ID NO: 1298355 - RNA, 25 nt, Human
caagaagagccuaauggucgcaaga

SEQ ID NO: 1298356 - RNA, 24 nt, Human
caccacaccuggcuaauuuuugua

SEQ ID NO: 1298357 - RNA, 20 nt, Human
cacccaagaagagccuaaug

SEQ ID NO: 1298358 - RNA, 21 nt, Human
cacuauguuggccaggcuggu

SEQ ID NO: 1298359 - RNA, 24 nt, Human
cacuauguuggccaggcuggucuu

SEQ ID NO: 1298360 - RNA, 24 nt, Human
cacucuguugcccaggcuggagug

SEQ ID NO: 1298361 - RNA, 18 nt, Human
cacugcaacuucugccuc

SEQ ID NO: 1298362 - RNA, 21 nt, Human
cacugcaacuucugccucccg

SEQ ID NO: 1298363 - RNA, 19 nt, Human
cagcacccaagggcggcug

SEQ ID NO: 1298364 - RNA, 21 nt, Human
cagcacuuugggaggcugagg

SEQ ID NO: 1298365 - RNA, 23 nt, Human
cagcacuuugggaggcugaggug

SEQ ID NO: 1298366 - RNA, 28 nt, Human
cagccgacacgccccacccccugaaagg

SEQ ID NO: 1298367 - RNA, 21 nt, Human
cagccgacacgccccaccccg

SEQ ID NO: 1298368 - RNA, 24 nt, Human
caggcuggaguccaagagaugguu

SEQ ID NO: 1298369 - RNA, 19 nt, Human
ccaaacaaacacacaaaaa

SEQ ID NO: 1298370 - RNA, 21 nt, Human
ccaaacaaacacacaaaaaac

SEQ ID NO: 1298371 - RNA, 22 nt, Human
ccaaacaaacacacaaaaaacg

SEQ ID NO: 1298372 - RNA, 18 nt, Human
ccaacccgacccggccca

SEQ ID NO: 1298373 - RNA, 22 nt, Human
ccaaugugcugggguuacaggc

SEQ ID NO: 1298374 - RNA, 24 nt, Human
ccaaugugcugggguuacaggcgu

SEQ ID NO: 1298375 - RNA, 20 nt, Human
ccacaguaucgggcagccag

SEQ ID NO: 1298376 - RNA, 19 nt, Human
ccaggccucgggaggcagc

SEQ ID NO: 1298377 - RNA, 22 nt, Human
cccagcacgcagcacccaaggg

SEQ ID NO: 1298378 - RNA, 19 nt, Human
cccaggcuggagugcagug

SEQ ID NO: 1298379 - RNA, 20 nt, Human
cccaggcuggagugcagugg

SEQ ID NO: 1298380 - RNA, 22 nt, Human
ccccuggauuccgguugacgga

SEQ ID NO: 1298381 - RNA, 23 nt, Human
cccgaguagcugggauuacgggc

SEQ ID NO: 1298382 - RNA, 24 nt, Human
cccgaguagcugggauuacgggcg

SEQ ID NO: 1298383 - RNA, 22 nt, Human
cccgguucaagcaauucuccug

SEQ ID NO: 1298384 - RNA, 21 nt, Human
cccuucauccacgacggacag

SEQ ID NO: 1298385 - RNA, 18 nt, Human
ccgcugccccgccugcgc

SEQ ID NO: 1298386 - RNA, 23 nt, Human
ccucccgguucaagcaauucucc

SEQ ID NO: 1298387 - RNA, 24 nt, Human
ccuccuggccagccuugccgggcg

SEQ ID NO: 1298388 - RNA, 24 nt, Human
ccugggcaacaugacgaaacccca

SEQ ID NO: 1298389 - RNA, 21 nt, Human
cgacccggcccagcacgcagg

SEQ ID NO: 1298390 - RNA, 19 nt, Human
cgacggacaggaagggcga

SEQ ID NO: 1298391 - RNA, 21 nt, Human
cgccgcugccccgccugcgcc

SEQ ID NO: 1298392 - RNA, 23 nt, Human
cuaauuuuuguauuuuuaguaga

SEQ ID NO: 1298393 - RNA, 24 nt, Human
cucacucuguugcccaggcuggag

SEQ ID NO: 1298394 - RNA, 24 nt, Human
cucacugcaacuucugccucccgg

SEQ ID NO: 1298395 - RNA, 19 nt, Human
cuccugaucucaagacauc

SEQ ID NO: 1298396 - RNA, 24 nt, Human
cucuucgcuguaaucccagcacuu

SEQ ID NO: 1298397 - RNA, 21 nt, Human
cugaucucaagacaucugcug

SEQ ID NO: 1298398 - RNA, 23 nt, Human
cugcaacuucugccucccgguuc

SEQ ID NO: 1298399 - RNA, 21 nt, Human
cugccccgccugcgccgaaag

SEQ ID NO: 1298400 - RNA, 18 nt, Human
cuggccagccuugccggg

SEQ ID NO: 1298401 - RNA, 23 nt, Human
cugguucagccucccgaguagcu

SEQ ID NO: 1298402 - RNA, 21 nt, Human
cuguaaucccagcacuuuggg

SEQ ID NO: 1298403 - RNA, 24 nt, Human
cuucgcuguaaucccagcacuuug

SEQ ID NO: 1298404 - RNA, 22 nt, Human
gaagggguuucacuauguuggc

SEQ ID NO: 1298405 - RNA, 24 nt, Human
gacaucugcccgccucggccuccc

SEQ ID NO: 1298406 - RNA, 21 nt, Human
gacggacaggaagggcgaccc

SEQ ID NO: 1298407 - RNA, 19 nt, Human
gacuugugguacaggcccu

SEQ ID NO: 1298408 - RNA, 20 nt, Human
gagaaguacugaggccugag

SEQ ID NO: 1298409 - RNA, 21 nt, Human
gagacgcuccucccgaggccu

SEQ ID NO: 1298410 - RNA, 22 nt, Human
gaguagcugggauuacgggcgc

SEQ ID NO: 1298411 - RNA, 24 nt, Human
gaucacuugaguccaggaguugga

SEQ ID NO: 1298412 - RNA, 18 nt, Human
gauuacgggcgcccgcca

SEQ ID NO: 1298413 - RNA, 18 nt, Human
gcaaugcgcgugcccagu

SEQ ID NO: 1298414 - RNA, 23 nt, Human
gcagaauagacaguugaguggau

SEQ ID NO: 1298415 - RNA, 19 nt, Human
gccccaacccgacccggcc

SEQ ID NO: 1298416 - RNA, 23 nt, Human
gccucggccucccaaugugcugg

SEQ ID NO: 1298417 - RNA, 25 nt, Human
ggaaggccccaacccgacccggccc

SEQ ID NO: 1298418 - RNA, 22 nt, Human
ggagaaugcaccccuccuggcc

SEQ ID NO: 1298419 - RNA, 24 nt, Human
ggagaaugcaccccuccuggccag

SEQ ID NO: 1298420 - RNA, 24 nt, Human
ggagacagacugggacaccgagca

SEQ ID NO: 1298421 - RNA, 22 nt, Human
ggagacgguaauaaccuggggg

SEQ ID NO: 1298422 - RNA, 22 nt, Human
ggagacgguaauaaccuggggg

SEQ ID NO: 1298423 - RNA, 24 nt, Human
ggcagaauagacaguugaguggau

SEQ ID NO: 1298424 - RNA, 24 nt, Human
ggcuggaagcgcaaugcgcgugcc

SEQ ID NO: 1298425 - RNA, 22 nt, Human
ggcuggagugcaguggugugau

SEQ ID NO: 1298426 - RNA, 24 nt, Human
ggcuggucuugaacuccugaucuc

SEQ ID NO: 1298427 - RNA, 18 nt, Human
ggggaggcggaggccagc

SEQ ID NO: 1298428 - RNA, 23 nt, Human
ggggaggcggaggccagcgggga

SEQ ID NO: 1298429 - RNA, 22 nt, Human
gggguuucacuauguuggccag

SEQ ID NO: 1298430 - RNA, 23 nt, Human
gggguuucacuauguuggccagg

SEQ ID NO: 1298431 - RNA, 22 nt, Human
ggguuucacuauguuggccagg

SEQ ID NO: 1298432 - RNA, 24 nt, Human
gguuacaggcgugagccacaguau

SEQ ID NO: 1298433 - RNA, 22 nt, Human
gguucagccucccgaguagcug

SEQ ID NO: 1298434 - RNA, 18 nt, Human
guagcugggauuacgggc

SEQ ID NO: 1298435 - RNA, 22 nt, Human
guggcucuucgcuguaauccca

SEQ ID NO: 1298436 - RNA, 24 nt, Human
guucucgguagcagccgacacgcc

SEQ ID NO: 1298437 - RNA, 24 nt, Human
uaauuuuuguauuuuuaguagaga

SEQ ID NO: 1298438 - RNA, 19 nt, Human
uacaagaacgacacuguau

SEQ ID NO: 1298439 - RNA, 24 nt, Human
uacgggcgcccgccaccacaccug

SEQ ID NO: 1298440 - RNA, 21 nt, Human
uacugaggccugagaaggcuc

SEQ ID NO: 1298441 - RNA, 22 nt, Human
uagagaagggguuucacuaugu

SEQ ID NO: 1298442 - RNA, 24 nt, Human
uagagucucacucuguugcccagg

SEQ ID NO: 1298443 - RNA, 24 nt, Human
uaguagagaagggguuucacuaug

SEQ ID NO: 1298444 - RNA, 19 nt, Human
uauguaggaaggccccaac

SEQ ID NO: 1298445 - RNA, 24 nt, Human
uauguuggccaggcuggucuugaa

SEQ ID NO: 1298446 - RNA, 22 nt, Human
ucacuauguuggccaggcuggu

SEQ ID NO: 1298447 - RNA, 24 nt, Human
ucacucuguugcccaggcuggagu

SEQ ID NO: 1298448 - RNA, 19 nt, Human
ucacugcaacuucugccuc

SEQ ID NO: 1298449 - RNA, 23 nt, Human
ucacugcaacuucugccucccgg

SEQ ID NO: 1298450 - RNA, 24 nt, Human
ucacugcaacuucugccucccggu

SEQ ID NO: 1298451 - RNA, 20 nt, Human
ucagccucccgaguagcugg

SEQ ID NO: 1298452 - RNA, 21 nt, Human
ucagucugcaggcuuuuugag

SEQ ID NO: 1298453 - RNA, 21 nt, Human
ucaguuuccugcuuauguggg

SEQ ID NO: 1298454 - RNA, 22 nt, Human
uccaggaguuggagaccagccu

SEQ ID NO: 1298455 - RNA, 24 nt, Human
ucccaaugugcugggguuacaggc

SEQ ID NO: 1298456 - RNA, 24 nt, Human
ucccgaguagcugggauuacgggc

SEQ ID NO: 1298457 - RNA, 20 nt, Human
ucccgguucaagcaauucuc

SEQ ID NO: 1298458 - RNA, 23 nt, Human
ucccgguucaagcaauucuccug

SEQ ID NO: 1298459 - RNA, 22 nt, Human
uccgguugacggacgcgucccc

SEQ ID NO: 1298460 - RNA, 22 nt, Human
uccucuagucagccucaggcuu

SEQ ID NO: 1298461 - RNA, 23 nt, Human
ucggccucccaaugugcuggggu

SEQ ID NO: 1298462 - RNA, 26 nt, Human
ucuacaaaaaauacaaaccaaaccaa

SEQ ID NO: 1298463 - RNA, 23 nt, Human
ucucacucuguugcccaggcugg

SEQ ID NO: 1298464 - RNA, 24 nt, Human
ucucacucuguugcccaggcugga

SEQ ID NO: 1298465 - RNA, 26 nt, Human
ucucacucuguugcccaggcuggagu

SEQ ID NO: 1298466 - RNA, 23 nt, Human
ucucgguagcagccgacacgccc

SEQ ID NO: 1298467 - RNA, 19 nt, Human
ucugcaggcuuuuugagga

SEQ ID NO: 1298468 - RNA, 23 nt, Human
ucugccucccgguucaagcaauu

SEQ ID NO: 1298469 - RNA, 18 nt, Human
ucuguugcccaggcugga

SEQ ID NO: 1298470 - RNA, 21 nt, Human
ucuugaacuccugaucucaag

SEQ ID NO: 1298471 - RNA, 21 nt, Human
ugaggaauucaggguagggcu

SEQ ID NO: 1298472 - RNA, 18 nt, Human
ugcccaggcuggagugca

SEQ ID NO: 1298473 - RNA, 21 nt, Human
ugcccaggcuggagugcagug

SEQ ID NO: 1298474 - RNA, 24 nt, Human
ugcccaggcuggagugcaguggug

SEQ ID NO: 1298475 - RNA, 20 nt, Human
ugcgaggcagaauagacagg

SEQ ID NO: 1298476 - RNA, 23 nt, Human
uggagacgguaauaaccuggggg

SEQ ID NO: 1298477 - RNA, 19 nt, Human
uggagugcaguggugugau

SEQ ID NO: 1298478 - RNA, 23 nt, Human
uggagugcaguggugugaucucg

SEQ ID NO: 1298479 - RNA, 24 nt, Human
uggagugcaguggugugaucucgg

SEQ ID NO: 1298480 - RNA, 24 nt, Human
uggccaggcuggucuugaacuccu

SEQ ID NO: 1298481 - RNA, 22 nt, Human
uggcucuucgcuguaaucccag

SEQ ID NO: 1298482 - RNA, 24 nt, Human
uggcucuucgcuguaaucccagca

SEQ ID NO: 1298483 - RNA, 24 nt, Human
ugggaggcugaggugugaggauca

SEQ ID NO: 1298484 - RNA, 21 nt, Human
ugggauuacgggcgcccgcca

SEQ ID NO: 1298485 - RNA, 22 nt, Human
ugggauuacgggcgcccgccac

SEQ ID NO: 1298486 - RNA, 24 nt, Human
ugggauuacgggcgcccgccacca

SEQ ID NO: 1298487 - RNA, 22 nt, Human
ugggcaacaugacgaaacccca

SEQ ID NO: 1298488 - RNA, 18 nt, Human
ugggguuacaggcgugag

SEQ ID NO: 1298489 - RNA, 19 nt, Human
ugggguuacaggcgugagc

SEQ ID NO: 1298490 - RNA, 21 nt, Human
ugggguuacaggcgugagcca

SEQ ID NO: 1298491 - RNA, 22 nt, Human
ugggguuacaggcgugagccac

SEQ ID NO: 1298492 - RNA, 23 nt, Human
ugggguuacaggcgugagccaca

SEQ ID NO: 1298493 - RNA, 24 nt, Human
ugggguuacaggcgugagccacag

SEQ ID NO: 1298494 - RNA, 24 nt, Human
uguggcucuucgcuguaaucccag

SEQ ID NO: 1298495 - RNA, 21 nt, Human
uguggggauauguaagguugu

SEQ ID NO: 1298496 - RNA, 21 nt, Human
uguugcccaggcuggagugca

SEQ ID NO: 1298497 - RNA, 20 nt, Human
uuacugggguggcgaugguu

SEQ ID NO: 1298498 - RNA, 18 nt, Human
uuaguagagaagggguuu

SEQ ID NO: 1298499 - RNA, 21 nt, Human
uuaguagagaagggguuucac

SEQ ID NO: 1298500 - RNA, 21 nt, Human
uuaguagagaagggguuucac

SEQ ID NO: 1298501 - RNA, 24 nt, Human
uuaguagagaagggguuucacuau

SEQ ID NO: 1298502 - RNA, 24 nt, Human
uucagccucccgaguagcugggau

SEQ ID NO: 1298503 - RNA, 18 nt, Human
uugaguggauauuggcca

SEQ ID NO: 1298504 - RNA, 24 nt, Human
uugcccaggcuggagugcaguggu

SEQ ID NO: 1298505 - RNA, 25 nt, Human
uugggaggcugaggugugaggauca

SEQ ID NO: 1298506 - RNA, 24 nt, Human
uuucacuauguuggccaggcuggu

SEQ ID NO: 1298507 - RNA, 24 nt, Human
uuuuuaguagagaagggguuucac

SEQ ID NO: 1298508 - RNA, 20 nt, Human
uuuuuguauuuuuaguagag

SEQ ID NO: 1298509 - RNA, 24 nt, Human
cugcagcagagguuaugaguccac

SEQ ID NO: 1298510 - RNA, 22 nt, Human
cuguaaucagagguuggagggc

SEQ ID NO: 1298511 - RNA, 21 nt, Human
ucccuuucaaaacuguaauca

SEQ ID NO: 1298512 - RNA, 22 nt, Human
ucuuugguuucacacuuagauu

SEQ ID NO: 1298513 - RNA, 18 nt, Human
aggcaucccucuccccga

SEQ ID NO: 1298514 - RNA, 20 nt, Human
caccccgccgcccacuucuc

SEQ ID NO: 1298515 - RNA, 18 nt, Human
ccacccgggccggcggcc

SEQ ID NO: 1298516 - RNA, 20 nt, Human
ccccauggccuguccgcgcc

SEQ ID NO: 1298517 - RNA, 23 nt, Human
ccccauggccuguccgcgccgcc

SEQ ID NO: 1298518 - RNA, 19 nt, Human
cccccgccaccccgccgcc

SEQ ID NO: 1298519 - RNA, 21 nt, Human
cccgcacccgccgcgagcgcg

SEQ ID NO: 1298520 - RNA, 18 nt, Human
cccuguacggggaagggc

SEQ ID NO: 1298521 - RNA, 18 nt, Human
ccgcccguggggucgggg

SEQ ID NO: 1298522 - RNA, 20 nt, Human
ccgcugccgccgcuggggcc

SEQ ID NO: 1298523 - RNA, 22 nt, Human
ccgcuggcccggcccggguccc

SEQ ID NO: 1298524 - RNA, 18 nt, Human
ccgcuggggcccgcaggg

SEQ ID NO: 1298525 - RNA, 18 nt, Human
ccgggucguccgcagcgc

SEQ ID NO: 1298526 - RNA, 23 nt, Human
cgccggcggccccuagcggacac

SEQ ID NO: 1298527 - RNA, 19 nt, Human
cgcggccuccgggacggcc

SEQ ID NO: 1298528 - RNA, 19 nt, Human
cgcucuccgcugccgccgc

SEQ ID NO: 1298529 - RNA, 18 nt, Human
cggggauccgcccugccc

SEQ ID NO: 1298530 - RNA, 23 nt, Human
cuguccgcgccgcccgccccguc

SEQ ID NO: 1298531 - RNA, 24 nt, Human
gagggcaagccagcgcggggcggu

SEQ ID NO: 1298532 - RNA, 24 nt, Human
gcacacacccucggugacaaauaa

SEQ ID NO: 1298533 - RNA, 20 nt, Human
gccccgcccguggggucggg

SEQ ID NO: 1298534 - RNA, 18 nt, Human
gcccgcaggguggucugg

SEQ ID NO: 1298535 - RNA, 18 nt, Human
gcccggggcucccgcugg

SEQ ID NO: 1298536 - RNA, 24 nt, Human
gcucuccgcugccgccgcuggggc

SEQ ID NO: 1298537 - RNA, 18 nt, Human
gcugccgccgcuggggcc

SEQ ID NO: 1298538 - RNA, 18 nt, Human
ggacacgcgcgcggccuc

SEQ ID NO: 1298539 - RNA, 21 nt, Human
ggagaacaggagggcaagcca

SEQ ID NO: 1298540 - RNA, 21 nt, Human
ggcggccccuagcggacacgc

SEQ ID NO: 1298541 - RNA, 22 nt, Human
gggcgguagugcccaggcaucc

SEQ ID NO: 1298542 - RNA, 24 nt, Human
ucaggcccggggcucccgcuggcc

SEQ ID NO: 1298543 - RNA, 23 nt, Human
uccaacuuuauugcucuggagaa

SEQ ID NO: 1298544 - RNA, 21 nt, Human
uccgcagcgcaggcccggggc

SEQ ID NO: 1298545 - RNA, 22 nt, Human
uccgcccugcccuguacgggga

SEQ ID NO: 1298546 - RNA, 19 nt, Human
uccgcugccgccgcugggg

SEQ ID NO: 1298547 - RNA, 20 nt, Human
uccgcugccgccgcuggggc

SEQ ID NO: 1298548 - RNA, 21 nt, Human
ucggggaggaccccgcacccg

SEQ ID NO: 1298549 - RNA, 20 nt, Human
ugcccaggcaucccucuccc

SEQ ID NO: 1298550 - RNA, 22 nt, Human
uggagaacaggagggcaagcca

SEQ ID NO: 1298551 - RNA, 22 nt, Human
uggcccgccaccgcuggcccgg

SEQ ID NO: 1298552 - RNA, 19 nt, Human
uggggcccgcagggugguc

SEQ ID NO: 1298553 - RNA, 21 nt, Human
uguccgcgccgcccgccccgu

SEQ ID NO: 1298554 - RNA, 24 nt, Human
aaaaaaaaaaaaaaaagaaaagaa

SEQ ID NO: 1298555 - RNA, 22 nt, Human
aagaaagaaaccacccuuccca

SEQ ID NO: 1298556 - RNA, 21 nt, Human
acccguggcagguggccaggu

SEQ ID NO: 1298557 - RNA, 22 nt, Human
acuugcuggcuguuaccuccca

SEQ ID NO: 1298558 - RNA, 22 nt, Human
agaaaaaaaaggaaagaaagaa

SEQ ID NO: 1298559 - RNA, 18 nt, Human
agaaaagaaaaaaaagga

SEQ ID NO: 1298560 - RNA, 23 nt, Human
agaaaagaaaaaaaaggaaagaa

SEQ ID NO: 1298561 - RNA, 18 nt, Human
agagaggcagcagagcag

SEQ ID NO: 1298562 - RNA, 20 nt, Human
aggaaagaaagaaaccaccc

SEQ ID NO: 1298563 - RNA, 18 nt, Human
aggcagugcaggcccagg

SEQ ID NO: 1298564 - RNA, 21 nt, Human
aggcagugcaggcccaggggc

SEQ ID NO: 1298565 - RNA, 20 nt, Human
aggccccagguccaggccaa

SEQ ID NO: 1298566 - RNA, 22 nt, Human
agguucacagcagcaacagccc

SEQ ID NO: 1298567 - RNA, 20 nt, Human
caagccagccagcgcugccc

SEQ ID NO: 1298568 - RNA, 20 nt, Human
caauucaggccccaggucca

SEQ ID NO: 1298569 - RNA, 24 nt, Human
cacaaaaaaaaaaaaaaaaaagaa

SEQ ID NO: 1298570 - RNA, 26 nt, Human
cacaauucaggccccagguccaggcc

SEQ ID NO: 1298571 - RNA, 18 nt, Human
cagcagagaggcagcaga

SEQ ID NO: 1298572 - RNA, 23 nt, Human
cagcauugaaggacaggggaguc

SEQ ID NO: 1298573 - RNA, 24 nt, Human
cagcauugaaggacaggggagugc

SEQ ID NO: 1298574 - RNA, 24 nt, Human
caggccccagguccaggccaaggg

SEQ ID NO: 1298575 - RNA, 19 nt, Human
caggggucaaggucagagg

SEQ ID NO: 1298576 - RNA, 22 nt, Human
ccaggccaagggggccacaccu

SEQ ID NO: 1298577 - RNA, 22 nt, Human
cccaugguuuggcucuuagggc

SEQ ID NO: 1298578 - RNA, 21 nt, Human
cgaagcacaaaaaaaaaaaaa

SEQ ID NO: 1298579 - RNA, 19 nt, Human
cuccaagugggaccagccc

SEQ ID NO: 1298580 - RNA, 26 nt, Human
cucccaagccagccagcgcugcccaa

SEQ ID NO: 1298581 - RNA, 23 nt, Human
gaaagaaaccacccuucccacaa

SEQ ID NO: 1298582 - RNA, 20 nt, Human
gaagcacaaaaaaaaaaaaa

SEQ ID NO: 1298583 - RNA, 22 nt, Human
gcagccaaaggucaggguucag

SEQ ID NO: 1298584 - RNA, 22 nt, Human
gcaggcccaggggcugaggugg

SEQ ID NO: 1298585 - RNA, 21 nt, Human
gccaaggcagccaaaggucag

SEQ ID NO: 1298586 - RNA, 20 nt, Human
gcuggcuguuaccucccaag

SEQ ID NO: 1298587 - RNA, 23 nt, Human
ggccaagggggccacaccugcag

SEQ ID NO: 1298588 - RNA, 20 nt, Human
ggcucuuagggccuggcugg

SEQ ID NO: 1298589 - RNA, 20 nt, Human
gggaugagagagaucagggg

SEQ ID NO: 1298590 - RNA, 25 nt, Human
ucacucaguuuugguacucuggcca

SEQ ID NO: 1298591 - RNA, 21 nt, Human
ucccaagccagccagcgcugc

SEQ ID NO: 1298592 - RNA, 22 nt, Human
ucccaagccagccagcgcugcc

SEQ ID NO: 1298593 - RNA, 19 nt, Human
ucccacaauucaggcccca

SEQ ID NO: 1298594 - RNA, 25 nt, Human
uccgaagcacaaaaaaaaaaaaaaa

SEQ ID NO: 1298595 - RNA, 28 nt, Human
uccgaagcacaaaaaaaaaaaaaaaaaa

SEQ ID NO: 1298596 - RNA, 27 nt, Human
ucuccgaagcacaaaaaaaaaaaaaaa

SEQ ID NO: 1298597 - RNA, 20 nt, Human
ugaaggacaggacccguggc

SEQ ID NO: 1298598 - RNA, 20 nt, Human
ugguccagcagagaggcagc

SEQ ID NO: 1298599 - RNA, 22 nt, Human
uucagacauguaggccaaagcc

SEQ ID NO: 1298600 - RNA, 21 nt, Human
aaucacugaagucuuuaucga

SEQ ID NO: 1298601 - RNA, 19 nt, Human
cuuuaaguuccaauucuuc

SEQ ID NO: 1298602 - RNA, 20 nt, Human
uaucuggaaaaaucacugaa

SEQ ID NO: 1298603 - RNA, 27 nt, Human
uggcuuuaaguuccaauucuuccccuu

SEQ ID NO: 1298604 - RNA, 21 nt, Human
aaguccucuuuucuccacaga

SEQ ID NO: 1298605 - RNA, 21 nt, Human
aggggcccaggugguuccaga

SEQ ID NO: 1298606 - RNA, 18 nt, Human
caaacagggaaggggugg

SEQ ID NO: 1298607 - RNA, 26 nt, Human
cacuuccgccaccaaauaaggggcua

SEQ ID NO: 1298608 - RNA, 20 nt, Human
cagacacagacaucaguggc

SEQ ID NO: 1298609 - RNA, 24 nt, Human
cagccgccgccgcccgcgcugggg

SEQ ID NO: 1298610 - RNA, 27 nt, Human
caguggcuuuuuuacucccugaagucc

SEQ ID NO: 1298611 - RNA, 21 nt, Human
cagugugaccacagugcccuc

SEQ ID NO: 1298612 - RNA, 21 nt, Human
cccgcccagccgccgccgccc

SEQ ID NO: 1298613 - RNA, 18 nt, Human
ccgccgccgcccgcgcug

SEQ ID NO: 1298614 - RNA, 27 nt, Human
ccugaaguccucuuuucuccacagaau

SEQ ID NO: 1298615 - RNA, 22 nt, Human
cgcuggggucccgcugccgcuc

SEQ ID NO: 1298616 - RNA, 23 nt, Human
cucccgcccagccgccgccgccc

SEQ ID NO: 1298617 - RNA, 19 nt, Human
gcagcaguuccugcccucu

SEQ ID NO: 1298618 - RNA, 18 nt, Human
ggggcucccgcccagccg

SEQ ID NO: 1298619 - RNA, 23 nt, Human
gugggccugacucuccgggggcu

SEQ ID NO: 1298620 - RNA, 21 nt, Human
ucaguggcuuuuuuacucccu

SEQ ID NO: 1298621 - RNA, 19 nt, Human
ucccgcccagccgccgccg

SEQ ID NO: 1298622 - RNA, 21 nt, Human
ucuuuucuccacagaauauuu

SEQ ID NO: 1298623 - RNA, 22 nt, Human
ugcccucaggggcccagguggu

SEQ ID NO: 1298624 - RNA, 18 nt, Human
uggcagcaguuccugccc

SEQ ID NO: 1298625 - RNA, 20 nt, Human
uggcgggcacggguguuugg

SEQ ID NO: 1298626 - RNA, 23 nt, Human
ugggccugacucuccgggggcug

SEQ ID NO: 1298627 - RNA, 24 nt, Human
ugggccugacucuccgggggcugg

SEQ ID NO: 1298628 - RNA, 18 nt, Human
uggggucccgcugccgcc

SEQ ID NO: 1298629 - RNA, 18 nt, Human
uuccugaggagggcccag

SEQ ID NO: 1298630 - RNA, 24 nt, Human
uggucaggaagcgcacgaucauug

SEQ ID NO: 1298631 - RNA, 22 nt, Human
agcucugcagcauggcagcccu

SEQ ID NO: 1298632 - RNA, 18 nt, Human
agguggggaagaggccau

SEQ ID NO: 1298633 - RNA, 23 nt, Human
caaagucagcuccucagugccac

SEQ ID NO: 1298634 - RNA, 21 nt, Human
cacagcuuugaccucaggccc

SEQ ID NO: 1298635 - RNA, 19 nt, Human
cagcauggcagcccuaccc

SEQ ID NO: 1298636 - RNA, 19 nt, Human
cagcauggcagcccuaccc

SEQ ID NO: 1298637 - RNA, 21 nt, Human
cagcauggcagcccuaccccc

SEQ ID NO: 1298638 - RNA, 22 nt, Human
cagcauggcagcccuacccccg

SEQ ID NO: 1298639 - RNA, 24 nt, Human
cagcucugcagcauggcagcccua

SEQ ID NO: 1298640 - RNA, 21 nt, Human
cagcugacagaugccuugugc

SEQ ID NO: 1298641 - RNA, 25 nt, Human
cccccgagcaccccaggugugccag

SEQ ID NO: 1298642 - RNA, 22 nt, Human
ccccgagcaccccaggugugcc

SEQ ID NO: 1298643 - RNA, 24 nt, Human
cccgagcaccccaggugugccagg

SEQ ID NO: 1298644 - RNA, 23 nt, Human
ccuacccccgagcaccccaggug

SEQ ID NO: 1298645 - RNA, 21 nt, Human
ccucagugccacaucagcccu

SEQ ID NO: 1298646 - RNA, 22 nt, Human
cuaaacccaaagucagcuccuc

SEQ ID NO: 1298647 - RNA, 18 nt, Human
cuccugggaccugcagcu

SEQ ID NO: 1298648 - RNA, 21 nt, Human
cuccugggaccugcagcugcu

SEQ ID NO: 1298649 - RNA, 24 nt, Human
cuccugggaccugcagcugcuaug

SEQ ID NO: 1298650 - RNA, 21 nt, Human
cugauaccaagagggccuucc

SEQ ID NO: 1298651 - RNA, 21 nt, Human
cuggugguggugguggcuguu

SEQ ID NO: 1298652 - RNA, 19 nt, Human
gaagaggccauggggagag

SEQ ID NO: 1298653 - RNA, 23 nt, Human
gagagcccugauaccaagagggc

SEQ ID NO: 1298654 - RNA, 19 nt, Human
gcaggagacaggggugaug

SEQ ID NO: 1298655 - RNA, 21 nt, Human
uaaauuaaaauuucgcccugg

SEQ ID NO: 1298656 - RNA, 25 nt, Human
ucagcaggagacaggggugaugagc

SEQ ID NO: 1298657 - RNA, 19 nt, Human
ucagcccugcacauucagc

SEQ ID NO: 1298658 - RNA, 23 nt, Human
ucagugccacaucagcccugcag

SEQ ID NO: 1298659 - RNA, 19 nt, Human
ugacagaugccuugugccc

SEQ ID NO: 1298660 - RNA, 20 nt, Human
ugagcuauggggccacaacc

SEQ ID NO: 1298661 - RNA, 22 nt, Human
uggcagcccuacccccgagcac

SEQ ID NO: 1298662 - RNA, 22 nt, Human
uggugguggugguggcuguugg

SEQ ID NO: 1298663 - RNA, 23 nt, Human
acuccagaagcugcugcugcugc

SEQ ID NO: 1298664 - RNA, 21 nt, Human
agaagcugcugcugcugccca

SEQ ID NO: 1298665 - RNA, 20 nt, Human
aggagcggcugcugaaggcc

SEQ ID NO: 1298666 - RNA, 19 nt, Human
caaggagcugaugugggca

SEQ ID NO: 1298667 - RNA, 21 nt, Human
caaggagcugaugugggcacc

SEQ ID NO: 1298668 - RNA, 24 nt, Human
cuccagaagcugcugcugcugccc

SEQ ID NO: 1298669 - RNA, 24 nt, Human
gggcaccgggaccacugguguagg

SEQ ID NO: 1298670 - RNA, 22 nt, Human
ugaaggcccaggggccagagau

SEQ ID NO: 1298671 - RNA, 21 nt, Human
ugccuaggccacuccagaagc

SEQ ID NO: 1298672 - RNA, 22 nt, Human
ugccuaggccacuccagaagcu

SEQ ID NO: 1298673 - RNA, 19 nt, Human
ugggagaagcucaaggagc

SEQ ID NO: 1298674 - RNA, 19 nt, Human
ugggagaagcucaaggagc

SEQ ID NO: 1298675 - RNA, 24 nt, Human
ugggagaagcucaaggagcugaug

SEQ ID NO: 1298676 - RNA, 20 nt, Human
aaaagaaaacaagccagcga

SEQ ID NO: 1298677 - RNA, 22 nt, Human
aaagaaaacaagccagcgaggg

SEQ ID NO: 1298678 - RNA, 22 nt, Human
acccucacccccaggagccugc

SEQ ID NO: 1298679 - RNA, 18 nt, Human
agaccccgcagggcccag

SEQ ID NO: 1298680 - RNA, 18 nt, Human
agauaggagguguccaga

SEQ ID NO: 1298681 - RNA, 21 nt, Human
agcagauaggagguguccaga

SEQ ID NO: 1298682 - RNA, 23 nt, Human
agcugggccugggccacaggagu

SEQ ID NO: 1298683 - RNA, 25 nt, Human
aucgcccuccuccacuaguguccaa

SEQ ID NO: 1298684 - RNA, 26 nt, Human
caaaagaaaacaagccagcgagggca

SEQ ID NO: 1298685 - RNA, 23 nt, Human
caaucccagggaccacccccagu

SEQ ID NO: 1298686 - RNA, 18 nt, Human
cacaggagcugggccugg

SEQ ID NO: 1298687 - RNA, 18 nt, Human
caccuggucucccggggc

SEQ ID NO: 1298688 - RNA, 18 nt, Human
cagaagcuggaucaccgc

SEQ ID NO: 1298689 - RNA, 23 nt, Human
cagacccucacccccaggagccu

SEQ ID NO: 1298690 - RNA, 18 nt, Human
cagcaaaaacagacucag

SEQ ID NO: 1298691 - RNA, 21 nt, Human
cagcaaaaacagacucagaca

SEQ ID NO: 1298692 - RNA, 25 nt, Human
cagcaaaaacagacucagacagacc

SEQ ID NO: 1298693 - RNA, 28 nt, Human
cagcaaaaacagacucagacagacccuc

SEQ ID NO: 1298694 - RNA, 30 nt, Human
cagcaaaaacagacucagacagacccucaa

SEQ ID NO: 1298695 - RNA, 18 nt, Human
cagcagccacaggagcug

SEQ ID NO: 1298696 - RNA, 29 nt, Human
cagccacaggagcugggccugggccacag

SEQ ID NO: 1298697 - RNA, 24 nt, Human
cagcccagcagccacaggagcugg

SEQ ID NO: 1298698 - RNA, 19 nt, Human
cagccguaccagcugcggc

SEQ ID NO: 1298699 - RNA, 25 nt, Human
caggagccugcucccaaccggggcc

SEQ ID NO: 1298700 - RNA, 21 nt, Human
caucgcccuccuccacuagug

SEQ ID NO: 1298701 - RNA, 22 nt, Human
ccaaaagaaaacaagccagcga

SEQ ID NO: 1298702 - RNA, 19 nt, Human
cccaaaagaaaacaagcca

SEQ ID NO: 1298703 - RNA, 20 nt, Human
cccccaggagccugcuccca

SEQ ID NO: 1298704 - RNA, 20 nt, Human
ccgcagggcccagcccagca

SEQ ID NO: 1298705 - RNA, 19 nt, Human
ccgcgccuccucagggcug

SEQ ID NO: 1298706 - RNA, 20 nt, Human
ccgcgccuccucagggcugu

SEQ ID NO: 1298707 - RNA, 18 nt, Human
ccguaccagcugcggcuu

SEQ ID NO: 1298708 - RNA, 19 nt, Human
ccugcagaccccgcagggc

SEQ ID NO: 1298709 - RNA, 18 nt, Human
ccugcucccaaccggggc

SEQ ID NO: 1298710 - RNA, 18 nt, Human
cuagagcagcaaaaacag

SEQ ID NO: 1298711 - RNA, 18 nt, Human
cucccccucucccuccuc

SEQ ID NO: 1298712 - RNA, 21 nt, Human
gagccugcucccaaccggggc

SEQ ID NO: 1298713 - RNA, 21 nt, Human
gcaaaaacagacucagacaga

SEQ ID NO: 1298714 - RNA, 20 nt, Human
gccuccucagggcugugcuc

SEQ ID NO: 1298715 - RNA, 21 nt, Human
gcguccaucgcccuccuccac

SEQ ID NO: 1298716 - RNA, 19 nt, Human
ggagccugcucccaaccgg

SEQ ID NO: 1298717 - RNA, 18 nt, Human
ggagugugccuuggcccc

SEQ ID NO: 1298718 - RNA, 21 nt, Human
ggccacaggagugagcagaua

SEQ ID NO: 1298719 - RNA, 23 nt, Human
ggcgacagagcuacaggagugug

SEQ ID NO: 1298720 - RNA, 21 nt, Human
gggcugaaggcguccaucgcc

SEQ ID NO: 1298721 - RNA, 23 nt, Human
ggugccuggggcugaaggcgucc

SEQ ID NO: 1298722 - RNA, 21 nt, Human
guaaggcuacgcucccccucu

SEQ ID NO: 1298723 - RNA, 22 nt, Human
guccagaagcuggaucaccgca

SEQ ID NO: 1298724 - RNA, 18 nt, Human
uaacuuaccccgucucag

SEQ ID NO: 1298725 - RNA, 23 nt, Human
uaccccgucucagggaucuugcu

SEQ ID NO: 1298726 - RNA, 23 nt, Human
ucacccccaggagccugcuccca

SEQ ID NO: 1298727 - RNA, 21 nt, Human
uccacuaguguccaaucccag

SEQ ID NO: 1298728 - RNA, 23 nt, Human
ucccugcagaccccgcagggccc

SEQ ID NO: 1298729 - RNA, 23 nt, Human
ugagcagauaggagguguccaga

SEQ ID NO: 1298730 - RNA, 25 nt, Human
ugagcagauaggagguguccagaag

SEQ ID NO: 1298731 - RNA, 24 nt, Human
ugccggccagcugggugccugggg

SEQ ID NO: 1298732 - RNA, 18 nt, Human
ugggccugggccacagga

SEQ ID NO: 1298733 - RNA, 21 nt, Human
ugggugccuggggcugaaggc

SEQ ID NO: 1298734 - RNA, 24 nt, Human
ugucccugcagaccccgcagggcc

SEQ ID NO: 1298735 - RNA, 19 nt, Human
accggugacuuuccauccc

SEQ ID NO: 1298736 - RNA, 24 nt, Human
acuugaaggaggccuuucccaucu

SEQ ID NO: 1298737 - RNA, 20 nt, Human
agaaauuggcacaaaugcua

SEQ ID NO: 1298738 - RNA, 22 nt, Human
agaccgaggcauacuugaagga

SEQ ID NO: 1298739 - RNA, 19 nt, Human
agcagccucauucuuaaau

SEQ ID NO: 1298740 - RNA, 21 nt, Human
aggaggccuuucccaucucag

SEQ ID NO: 1298741 - RNA, 23 nt, Human
ccuuucccaucucagcagccuca

SEQ ID NO: 1298742 - RNA, 26 nt, Human
cggugacuuuccaucccuugaaccaa

SEQ ID NO: 1298743 - RNA, 21 nt, Human
cuugaaccaaggcguguuagc

SEQ ID NO: 1298744 - RNA, 20 nt, Human
cuuucaguuuauccaagacc

SEQ ID NO: 1298745 - RNA, 19 nt, Human
gaggccuuucccaucucag

SEQ ID NO: 1298746 - RNA, 24 nt, Human
gcaaaggugaccaccauaccaggu

SEQ ID NO: 1298747 - RNA, 21 nt, Human
gcacaaaugcuacugugucgg

SEQ ID NO: 1298748 - RNA, 25 nt, Human
uccagcauguugucaucauuccaac

SEQ ID NO: 1298749 - RNA, 20 nt, Human
ugacaggcacaagggcuugu

SEQ ID NO: 1298750 - RNA, 20 nt, Human
uuggugguaggacgcagucc

SEQ ID NO: 1298751 - RNA, 24 nt, Human
accacucccaccccugccccaccc

SEQ ID NO: 1298752 - RNA, 18 nt, Human
acucccaccccugcccca

SEQ ID NO: 1298753 - RNA, 22 nt, Human
acucccaccccugccccacccc

SEQ ID NO: 1298754 - RNA, 19 nt, Human
agcggcucccacccggccc

SEQ ID NO: 1298755 - RNA, 23 nt, Human
agggggccuuccccgccacuggg

SEQ ID NO: 1298756 - RNA, 19 nt, Human
cacugcccaggccuggcug

SEQ ID NO: 1298757 - RNA, 22 nt, Human
cacugggaauucugcccuccca

SEQ ID NO: 1298758 - RNA, 19 nt, Human
ccaccauccggcccugacc

SEQ ID NO: 1298759 - RNA, 21 nt, Human
ccaccccugccccaccccugc

SEQ ID NO: 1298760 - RNA, 25 nt, Human
ccacucccaccccugccccaccccu

SEQ ID NO: 1298761 - RNA, 22 nt, Human
cccugccccaccccugccgcaa

SEQ ID NO: 1298762 - RNA, 18 nt, Human
ccgcagcagcuucccggg

SEQ ID NO: 1298763 - RNA, 19 nt, Human
ccucgcccuccucuccucc

SEQ ID NO: 1298764 - RNA, 21 nt, Human
ccuggcuggagcggcucccac

SEQ ID NO: 1298765 - RNA, 18 nt, Human
ccuuccccgccacuggga

SEQ ID NO: 1298766 - RNA, 20 nt, Human
cggcaccgccucucucgccu

SEQ ID NO: 1298767 - RNA, 23 nt, Human
cggcccucgcccuccucuccucc

SEQ ID NO: 1298768 - RNA, 21 nt, Human
cucccaggucucggcaccgcc

SEQ ID NO: 1298769 - RNA, 20 nt, Human
gaccugugcacguggaucuc

SEQ ID NO: 1298770 - RNA, 24 nt, Human
gagcggcucccacccggcccccuu

SEQ ID NO: 1298771 - RNA, 19 nt, Human
gccuucggcccucgcccuc

SEQ ID NO: 1298772 - RNA, 21 nt, Human
uaccacucccaccccugcccc

SEQ ID NO: 1298773 - RNA, 18 nt, Human
ucccacccggcccccuuc

SEQ ID NO: 1298774 - RNA, 22 nt, Human
ucccaggucucggcaccgccuc

SEQ ID NO: 1298775 - RNA, 24 nt, Human
uccccgaccugugcacguggaucu

SEQ ID NO: 1298776 - RNA, 18 nt, Human
ucgcccuccucuccuccc

SEQ ID NO: 1298777 - RNA, 19 nt, Human
ucgcccuccucuccucccc

SEQ ID NO: 1298778 - RNA, 23 nt, Human
ucggcaccgccucucucgccuuc

SEQ ID NO: 1298779 - RNA, 25 nt, Human
ugcccaggccuggcuggagcggcuc

SEQ ID NO: 1298780 - RNA, 19 nt, Human
uucugcccucccagccagg

SEQ ID NO: 1298781 - RNA, 19 nt, Human
aaagagccuagcugggaac

SEQ ID NO: 1298782 - RNA, 19 nt, Human
aagcuccuaggaagcagua

SEQ ID NO: 1298783 - RNA, 23 nt, Human
acagcucaaagccucucugucuc

SEQ ID NO: 1298784 - RNA, 24 nt, Human
agaggguagggguggggggagucc

SEQ ID NO: 1298785 - RNA, 21 nt, Human
agcaguagggagggaguuagg

SEQ ID NO: 1298786 - RNA, 18 nt, Human
agcuccagcucugccagc

SEQ ID NO: 1298787 - RNA, 21 nt, Human
aggccuguuggggaacagccc

SEQ ID NO: 1298788 - RNA, 19 nt, Human
aggguagggguggggggag

SEQ ID NO: 1298789 - RNA, 24 nt, Human
agguugugucccaucugguucuuu

SEQ ID NO: 1298790 - RNA, 26 nt, Human
aguagcaaaugagucaguagccggug

SEQ ID NO: 1298791 - RNA, 26 nt, Human
aucucccucuccccuuuccuucccaa

SEQ ID NO: 1298792 - RNA, 21 nt, Human
caacaggagagccuacaccuc

SEQ ID NO: 1298793 - RNA, 23 nt, Human
caacaggagagccuacaccuccc

SEQ ID NO: 1298794 - RNA, 25 nt, Human
caacaggagagccuacaccucccac

SEQ ID NO: 1298795 - RNA, 22 nt, Human
caauucuugucuugguugggaa

SEQ ID NO: 1298796 - RNA, 18 nt, Human
cagcccccaucagagccc

SEQ ID NO: 1298797 - RNA, 24 nt, Human
cagcuuccucagccguucaaagag

SEQ ID NO: 1298798 - RNA, 18 nt, Human
caggucguccccguaacu

SEQ ID NO: 1298799 - RNA, 21 nt, Human
ccacugcccgcgugcucccgc

SEQ ID NO: 1298800 - RNA, 22 nt, Human
ccccaacaggagagccuacacc

SEQ ID NO: 1298801 - RNA, 21 nt, Human
ccccucaugggaagacauggu

SEQ ID NO: 1298802 - RNA, 18 nt, Human
cccggcccuccagcuucc

SEQ ID NO: 1298803 - RNA, 19 nt, Human
ccgcagccgccgguacagc

SEQ ID NO: 1298804 - RNA, 21 nt, Human
ccggcccuccagcuuccucag

SEQ ID NO: 1298805 - RNA, 18 nt, Human
ccuagcugggaacagggg

SEQ ID NO: 1298806 - RNA, 22 nt, Human
ccucuccccuuuccuucccaac

SEQ ID NO: 1298807 - RNA, 21 nt, Human
cgacuucuggggccuagcacc

SEQ ID NO: 1298808 - RNA, 18 nt, Human
cgcucgaagcguuggcag

SEQ ID NO: 1298809 - RNA, 21 nt, Human
cgcucuccugggcuucagcgu

SEQ ID NO: 1298810 - RNA, 23 nt, Human
cggaagccacccggcccuccagc

SEQ ID NO: 1298811 - RNA, 23 nt, Human
cguagucggccagugcccgcagc

SEQ ID NO: 1298812 - RNA, 21 nt, Human
cuucuggggccuagcaccauu

SEQ ID NO: 1298813 - RNA, 19 nt, Human
cuugggaaucucccucucc

SEQ ID NO: 1298814 - RNA, 32 nt, Human
cuugggaaucucccucuccccuuuccuucccc

SEQ ID NO: 1298815 - RNA, 18 nt, Human
gaacagcccccaucagag

SEQ ID NO: 1298816 - RNA, 20 nt, Human
gaggguagggguggggggag

SEQ ID NO: 1298817 - RNA, 19 nt, Human
gccuagcugggaacagggg

SEQ ID NO: 1298818 - RNA, 20 nt, Human
gccuugggaagggcacuagu

SEQ ID NO: 1298819 - RNA, 24 nt, Human
gcguuggcagcacagcugcuggug

SEQ ID NO: 1298820 - RNA, 18 nt, Human
gcugguggcucucggcgg

SEQ ID NO: 1298821 - RNA, 20 nt, Human
gggcaggguccuuaaugggg

SEQ ID NO: 1298822 - RNA, 22 nt, Human
gggggcugaggaacagcucaaa

SEQ ID NO: 1298823 - RNA, 22 nt, Human
guggcucucggcgggccgcacc

SEQ ID NO: 1298824 - RNA, 24 nt, Human
uaacucgcccgaggaacugaccga

SEQ ID NO: 1298825 - RNA, 20 nt, Human
uaauucuggguucacauuuu

SEQ ID NO: 1298826 - RNA, 18 nt, Human
uacagagugaccccucau

SEQ ID NO: 1298827 - RNA, 20 nt, Human
ucaaagccucucugucucag

SEQ ID NO: 1298828 - RNA, 23 nt, Human
ucaccaguuuuauccaaaggcug

SEQ ID NO: 1298829 - RNA, 21 nt, Human
ucccaacaccaucccccaaca

SEQ ID NO: 1298830 - RNA, 24 nt, Human
ucccccaacaggagagccuacacc

SEQ ID NO: 1298831 - RNA, 26 nt, Human
ucccccaacaggagagccuacaccuc

SEQ ID NO: 1298832 - RNA, 19 nt, Human
uccccguaacucgcccgag

SEQ ID NO: 1298833 - RNA, 18 nt, Human
uccuuaauggggguugca

SEQ ID NO: 1298834 - RNA, 20 nt, Human
ucgaaaagaggagacccggc

SEQ ID NO: 1298835 - RNA, 18 nt, Human
ucugccaggccuguugga

SEQ ID NO: 1298836 - RNA, 20 nt, Human
ucuggggccuagcaccauuc

SEQ ID NO: 1298837 - RNA, 20 nt, Human
ucugguggguuuguuguaac

SEQ ID NO: 1298838 - RNA, 24 nt, Human
ucuucugaaaaaacaaggggcagu

SEQ ID NO: 1298839 - RNA, 19 nt, Human
ucuuggcucagguguuugg

SEQ ID NO: 1298840 - RNA, 18 nt, Human
ugaagaggagucuuggcu

SEQ ID NO: 1298841 - RNA, 25 nt, Human
ugacuugggugggaaaacuagugag

SEQ ID NO: 1298842 - RNA, 24 nt, Human
ugagggaagggguuguugaacuag

SEQ ID NO: 1298843 - RNA, 25 nt, Human
ugagggaagggguuguugaacuagg

SEQ ID NO: 1298844 - RNA, 26 nt, Human
ugagggaagggguuguugaacuaggu

SEQ ID NO: 1298845 - RNA, 19 nt, Human
uggcggagucggagaggcg

SEQ ID NO: 1298846 - RNA, 18 nt, Human
ugggaaaacuagugacuu

SEQ ID NO: 1298847 - RNA, 24 nt, Human
ugggaaagagccuagcugggaaca

SEQ ID NO: 1298848 - RNA, 18 nt, Human
ugggaacaggggucguuu

SEQ ID NO: 1298849 - RNA, 23 nt, Human
ugggaaucucccucuccccuuuc

SEQ ID NO: 1298850 - RNA, 19 nt, Human
uucuuugacagugacuugg

SEQ ID NO: 1298851 - RNA, 19 nt, Human
uuggcauguuaauuuuuau

SEQ ID NO: 1298852 - RNA, 20 nt, Human
uuggcucuuucugaagagga

SEQ ID NO: 1298853 - RNA, 21 nt, Human
uuucugaagaggagucuuggc

SEQ ID NO: 1298854 - RNA, 20 nt, Human
aagcaggugcggugacacgu

SEQ ID NO: 1298855 - RNA, 21 nt, Human
aagcccauuuucccugggugg

SEQ ID NO: 1298856 - RNA, 22 nt, Human
accaugguggcgggagcgggcg

SEQ ID NO: 1298857 - RNA, 20 nt, Human
agaaaagcccguguccugaa

SEQ ID NO: 1298858 - RNA, 23 nt, Human
agccccucgacgcugcgcagcuc

SEQ ID NO: 1298859 - RNA, 18 nt, Human
cacagaaaagcccguguc

SEQ ID NO: 1298860 - RNA, 21 nt, Human
cacuaacccaagugcccugcg

SEQ ID NO: 1298861 - RNA, 22 nt, Human
cagagcccuccugcagccccuc

SEQ ID NO: 1298862 - RNA, 25 nt, Human
caugagcaccuggugaaucuccugc

SEQ ID NO: 1298863 - RNA, 18 nt, Human
ccccuugcccccggccug

SEQ ID NO: 1298864 - RNA, 18 nt, Human
cccgccgcgccacuaacc

SEQ ID NO: 1298865 - RNA, 20 nt, Human
cccgccgcgccacuaaccca

SEQ ID NO: 1298866 - RNA, 21 nt, Human
cccgccgcgccacuaacccaa

SEQ ID NO: 1298867 - RNA, 18 nt, Human
cccgguccaugagcaccu

SEQ ID NO: 1298868 - RNA, 21 nt, Human
cccuccugcagccccucgacg

SEQ ID NO: 1298869 - RNA, 18 nt, Human
ccgcgccgcccgccgcgc

SEQ ID NO: 1298870 - RNA, 18 nt, Human
ccgcgccgcccgccgcgc

SEQ ID NO: 1298871 - RNA, 21 nt, Human
ccggccgccccuugcccccgg

SEQ ID NO: 1298872 - RNA, 19 nt, Human
ccggccucgucaagcccau

SEQ ID NO: 1298873 - RNA, 18 nt, Human
ccucagcgcccuccccac

SEQ ID NO: 1298874 - RNA, 26 nt, Human
ccuccuucuucaggcucucugggcag

SEQ ID NO: 1298875 - RNA, 18 nt, Human
ccugaaugacaaugacuu

SEQ ID NO: 1298876 - RNA, 21 nt, Human
ccugcaccaucuccugggggg

SEQ ID NO: 1298877 - RNA, 18 nt, Human
cgccgcgccacuaaccca

SEQ ID NO: 1298878 - RNA, 22 nt, Human
cggccgccccuugcccccggcc

SEQ ID NO: 1298879 - RNA, 18 nt, Human
cggccgcgcccggccgcc

SEQ ID NO: 1298880 - RNA, 20 nt, Human
cggccggggcggccgccggc

SEQ ID NO: 1298881 - RNA, 21 nt, Human
cggccugcgagccguguuccc

SEQ ID NO: 1298882 - RNA, 24 nt, Human
cuccaaggauccccuguuuucucc

SEQ ID NO: 1298883 - RNA, 22 nt, Human
cugcagccccucgacgcugcgc

SEQ ID NO: 1298884 - RNA, 21 nt, Human
cuuccaccacacgcagcacag

SEQ ID NO: 1298885 - RNA, 21 nt, Human
gacccucagcgcccuccccac

SEQ ID NO: 1298886 - RNA, 20 nt, Human
gagcaugacugauggcagcu

SEQ ID NO: 1298887 - RNA, 27 nt, Human
gagcaugacugauggcagcucggccgc

SEQ ID NO: 1298888 - RNA, 26 nt, Human
gcgcagcuccgagaaguggucgccuc

SEQ ID NO: 1298889 - RNA, 19 nt, Human
gcuaauccuccccucucca

SEQ ID NO: 1298890 - RNA, 19 nt, Human
gcucgaucccaggggcgag

SEQ ID NO: 1298891 - RNA, 20 nt, Human
gcuguccgcgccgcccgccg

SEQ ID NO: 1298892 - RNA, 23 nt, Human
ggccgguggucucaucucccggg

SEQ ID NO: 1298893 - RNA, 24 nt, Human
ggugaaucuccugcaccaucuccu

SEQ ID NO: 1298894 - RNA, 23 nt, Human
gugaaucuccugcaccaucuccu

SEQ ID NO: 1298895 - RNA, 20 nt, Human
ucacagaaaagcccgugucc

SEQ ID NO: 1298896 - RNA, 19 nt, Human
uccagcacguugccaucca

SEQ ID NO: 1298897 - RNA, 21 nt, Human
uccagcacguugccauccagg

SEQ ID NO: 1298898 - RNA, 22 nt, Human
uccaggugcagugagaagcagg

SEQ ID NO: 1298899 - RNA, 18 nt, Human
uccgcgccgcccgccgcg

SEQ ID NO: 1298900 - RNA, 18 nt, Human
uccugcaccaucuccugg

SEQ ID NO: 1298901 - RNA, 18 nt, Human
uccuggggggacaccugc

SEQ ID NO: 1298902 - RNA, 19 nt, Human
ucgacgcugcgcagcuccg

SEQ ID NO: 1298903 - RNA, 19 nt, Human
ucgcgugacccucagcgcc

SEQ ID NO: 1298904 - RNA, 20 nt, Human
ugacccucagcgcccucccc

SEQ ID NO: 1298905 - RNA, 24 nt, Human
ugacuuccuggccgguggucucau

SEQ ID NO: 1298906 - RNA, 25 nt, Human
ugcccccggccugcgagccguguuc

SEQ ID NO: 1298907 - RNA, 23 nt, Human
ugcgcgccgcggcugcugaggga

SEQ ID NO: 1298908 - RNA, 19 nt, Human
uggcucggccgccgccgcc

SEQ ID NO: 1298909 - RNA, 20 nt, Human
uucuucaggcucucugggca

SEQ ID NO: 1298910 - RNA, 25 nt, Human
aaaaaaaaacaaaaacaaaaccuuu

SEQ ID NO: 1298911 - RNA, 22 nt, Human
aacacaucaaauuaccggcgug

SEQ ID NO: 1298912 - RNA, 19 nt, Human
aaggagcuccgcacacaag

SEQ ID NO: 1298913 - RNA, 18 nt, Human
aguucucccgcacuucuc

SEQ ID NO: 1298914 - RNA, 28 nt, Human
cacauacacuagcaaggagcuccgcaca

SEQ ID NO: 1298915 - RNA, 18 nt, Human
cacuucucucccauccca

SEQ ID NO: 1298916 - RNA, 24 nt, Human
ccaguaaaaacaacgcacugggca

SEQ ID NO: 1298917 - RNA, 21 nt, Human
ccgcacacaagcuccuccagu

SEQ ID NO: 1298918 - RNA, 21 nt, Human
ccguaaaaaaaaacaaaaaca

SEQ ID NO: 1298919 - RNA, 21 nt, Human
ccuaagacccugaggaucagg

SEQ ID NO: 1298920 - RNA, 24 nt, Human
ccuacggguccccaucagggucaa

SEQ ID NO: 1298921 - RNA, 23 nt, Human
ccuccuaagacccugaggaucag

SEQ ID NO: 1298922 - RNA, 20 nt, Human
ccuuccuugucuaacucgag

SEQ ID NO: 1298923 - RNA, 23 nt, Human
cgccagcgaagccuaacacggcc

SEQ ID NO: 1298924 - RNA, 19 nt, Human
cuccgaccauaccuccuaa

SEQ ID NO: 1298925 - RNA, 19 nt, Human
cuccgcacacaagcuccuc

SEQ ID NO: 1298926 - RNA, 18 nt, Human
cuccgugaggggcaaagc

SEQ ID NO: 1298927 - RNA, 20 nt, Human
gaccauaccuccuaagaccc

SEQ ID NO: 1298928 - RNA, 21 nt, Human
gaggggcaaagcucccgggga

SEQ ID NO: 1298929 - RNA, 19 nt, Human
gcagugcaucucaacacau

SEQ ID NO: 1298930 - RNA, 23 nt, Human
gcuuucguuccaaagacauuagu

SEQ ID NO: 1298931 - RNA, 23 nt, Human
guugcuguggccacuuaguuccg

SEQ ID NO: 1298932 - RNA, 19 nt, Human
uagcaaggagcuccgcaca

SEQ ID NO: 1298933 - RNA, 18 nt, Human
uaggagccugaugcggca

SEQ ID NO: 1298934 - RNA, 22 nt, Human
ucagggucaacuaacguucucc

SEQ ID NO: 1298935 - RNA, 23 nt, Human
ucucccaucccaacacauacacu

SEQ ID NO: 1298936 - RNA, 25 nt, Human
ucuccgaccauaccuccuaagaccc

SEQ ID NO: 1298937 - RNA, 18 nt, Human
ugcaucucaacacaucaa

SEQ ID NO: 1298938 - RNA, 19 nt, Human
ugucaucccuacucuuuca

SEQ ID NO: 1298939 - RNA, 19 nt, Human
uucaaaucacauaccucua

SEQ ID NO: 1298940 - RNA, 23 nt, Human
uuccaaagacauuaguuuauaga

SEQ ID NO: 1298941 - RNA, 27 nt, Human
caucaaagaagggaaaaagcaagagau

SEQ ID NO: 1298942 - RNA, 22 nt, Human
caucaaagaagggaaaaagcag

SEQ ID NO: 1298943 - RNA, 22 nt, Human
cuaaggguuugcagccuccucu

SEQ ID NO: 1298944 - RNA, 21 nt, Human
cuggcucuaggacacaggguc

SEQ ID NO: 1298945 - RNA, 22 nt, Human
gcugggcuggggaaaagacaac

SEQ ID NO: 1298946 - RNA, 20 nt, Human
ggaaaaagcaagagauggca

SEQ ID NO: 1298947 - RNA, 22 nt, Human
guuugcagccuccucuccaucu

SEQ ID NO: 1298948 - RNA, 21 nt, Human
uaggacacagcuguguucugg

SEQ ID NO: 1298949 - RNA, 21 nt, Human
ucagcacaggcuccuccucac

SEQ ID NO: 1298950 - RNA, 20 nt, Human
ucuaggacacagcuguguuc

SEQ ID NO: 1298951 - RNA, 22 nt, Human
ucucagcacaggcuccuccuca

SEQ ID NO: 1298952 - RNA, 19 nt, Human
uggggcugagaagucucag

SEQ ID NO: 1298953 - RNA, 24 nt, Human
uuugcagccuccucuccaucuucu

SEQ ID NO: 1298954 - RNA, 22 nt, Human
ccacuccccagaccuucucccg

SEQ ID NO: 1298955 - RNA, 23 nt, Human
ccccacuccccagaccuucuccc

SEQ ID NO: 1298956 - RNA, 19 nt, Human
ggacugacaucagcuggua

SEQ ID NO: 1298957 - RNA, 23 nt, Human
ggcggacugacaucagcugguau

SEQ ID NO: 1298958 - RNA, 23 nt, Human
uccaagagcuugagauccccacu

SEQ ID NO: 1298959 - RNA, 18 nt, Human
cacccgccucuuucagag

SEQ ID NO: 1298960 - RNA, 23 nt, Human
ucagagcaauugcagccacagcc

SEQ ID NO: 1298961 - RNA, 19 nt, Human
uucagagcaauugcagcca

SEQ ID NO: 1298962 - RNA, 23 nt, Human
aaacaucuccccuauucccagau

SEQ ID NO: 1298963 - RNA, 23 nt, Human
aaagcugacccaauaccuacagu

SEQ ID NO: 1298964 - RNA, 20 nt, Human
aaaggaaagagacugcugcc

SEQ ID NO: 1298965 - RNA, 23 nt, Human
aacuuccaacucuaaaauaucug

SEQ ID NO: 1298966 - RNA, 22 nt, Human
aagcaggcauucucauucacuu

SEQ ID NO: 1298967 - RNA, 21 nt, Human
aagcugacccaauaccuacag

SEQ ID NO: 1298968 - RNA, 25 nt, Human
acccugcaacccagcgauuagacug

SEQ ID NO: 1298969 - RNA, 18 nt, Human
accuaccagaaaccucaa

SEQ ID NO: 1298970 - RNA, 20 nt, Human
acggcaugaaagcugacccc

SEQ ID NO: 1298971 - RNA, 25 nt, Human
acucugugcuuacucauauucagga

SEQ ID NO: 1298972 - RNA, 19 nt, Human
acugcauaacuuccaacuc

SEQ ID NO: 1298973 - RNA, 20 nt, Human
acuucaaugaacauuugcac

SEQ ID NO: 1298974 - RNA, 21 nt, Human
agaaaauggcagaacaguuac

SEQ ID NO: 1298975 - RNA, 23 nt, Human
agaaaauggcagaacaguuacaa

SEQ ID NO: 1298976 - RNA, 22 nt, Human
agacaaaaauaaauaguagauc

SEQ ID NO: 1298977 - RNA, 24 nt, Human
agacaaaaauaaauaguagaucua

SEQ ID NO: 1298978 - RNA, 25 nt, Human
agacaaaaauaaauaguagaucuaa

SEQ ID NO: 1298979 - RNA, 22 nt, Human
agagaauggaaucaagugacac

SEQ ID NO: 1298980 - RNA, 18 nt, Human
agcaaagaaaguggcuca

SEQ ID NO: 1298981 - RNA, 18 nt, Human
aggaaaaaaaaggaaagg

SEQ ID NO: 1298982 - RNA, 25 nt, Human
aggaaaaauaauauauuuuaaaugc

SEQ ID NO: 1298983 - RNA, 21 nt, Human
augcugcagacagcaaagaaa

SEQ ID NO: 1298984 - RNA, 18 nt, Human
caacaguucugccuucag

SEQ ID NO: 1298985 - RNA, 24 nt, Human
caggaaugagguauggguguuaug

SEQ ID NO: 1298986 - RNA, 20 nt, Human
caggcauucucauucacuac

SEQ ID NO: 1298987 - RNA, 22 nt, Human
caggcauucucauucacuacuu

SEQ ID NO: 1298988 - RNA, 22 nt, Human
caggucacaggccacccugcaa

SEQ ID NO: 1298989 - RNA, 21 nt, Human
ccagagcaaacgaccaggaag

SEQ ID NO: 1298990 - RNA, 18 nt, Human
cccaauaccuacaguacc

SEQ ID NO: 1298991 - RNA, 23 nt, Human
cccugguucaugugaccaagggg

SEQ ID NO: 1298992 - RNA, 24 nt, Human
cccuucucaaaagauacaauuaaa

SEQ ID NO: 1298993 - RNA, 22 nt, Human
ccugcaacccagcgauuagacu

SEQ ID NO: 1298994 - RNA, 20 nt, Human
ccuuaaugccaugcagcuag

SEQ ID NO: 1298995 - RNA, 20 nt, Human
cgcauauccuaagaaaauaa

SEQ ID NO: 1298996 - RNA, 21 nt, Human
cggcaugaaagcugacccaau

SEQ ID NO: 1298997 - RNA, 22 nt, Human
cuacuuguauaacuccaaccuu

SEQ ID NO: 1298998 - RNA, 23 nt, Human
cuccaacaguucugccuucagcc

SEQ ID NO: 1298999 - RNA, 23 nt, Human
cucuagguaaacucugugcuuac

SEQ ID NO: 1299000 - RNA, 21 nt, Human
cucuaugacuguagacuugcu

SEQ ID NO: 1299001 - RNA, 23 nt, Human
cugacccaauaccuacaguacca

SEQ ID NO: 1299002 - RNA, 21 nt, Human
cuuccaacucuaaaauaucug

SEQ ID NO: 1299003 - RNA, 19 nt, Human
cuucuuuuaaaagucagga

SEQ ID NO: 1299004 - RNA, 19 nt, Human
gaaagagacugcugccucu

SEQ ID NO: 1299005 - RNA, 20 nt, Human
gaccaaggggggucuggggu

SEQ ID NO: 1299006 - RNA, 26 nt, Human
gagcaaacgaccaggaaggaagcaac

SEQ ID NO: 1299007 - RNA, 23 nt, Human
gcaaagaaaguggcucagaaacg

SEQ ID NO: 1299008 - RNA, 21 nt, Human
gccugggauggaagggaugga

SEQ ID NO: 1299009 - RNA, 25 nt, Human
gcguguacacacauacacaaacgua

SEQ ID NO: 1299010 - RNA, 21 nt, Human
gcucagaaacgauguaaagag

SEQ ID NO: 1299011 - RNA, 19 nt, Human
ggagauggccagcagggaa

SEQ ID NO: 1299012 - RNA, 19 nt, Human
ggcaggucacaggccaccc

SEQ ID NO: 1299013 - RNA, 21 nt, Human
gggauggaagggauggagaga

SEQ ID NO: 1299014 - RNA, 18 nt, Human
gggggugaaggaagaagg

SEQ ID NO: 1299015 - RNA, 19 nt, Human
ggugaaggaagaaggaaga

SEQ ID NO: 1299016 - RNA, 22 nt, Human
uaaaacaacaacaacucuugaa

SEQ ID NO: 1299017 - RNA, 24 nt, Human
uaaaacacuucuguuggcacuucc

SEQ ID NO: 1299018 - RNA, 18 nt, Human
uaauaggcaccuaccaga

SEQ ID NO: 1299019 - RNA, 23 nt, Human
uaauucauccaaacaucuccccu

SEQ ID NO: 1299020 - RNA, 24 nt, Human
uaauucauccaaacaucuccccua

SEQ ID NO: 1299021 - RNA, 24 nt, Human
uacacacauacacaaacguacugg

SEQ ID NO: 1299022 - RNA, 19 nt, Human
uaccagaaaccucaacauc

SEQ ID NO: 1299023 - RNA, 18 nt, Human
uaccuacaguaccagucc

SEQ ID NO: 1299024 - RNA, 18 nt, Human
uagaaaggaaaaaaaagg

SEQ ID NO: 1299025 - RNA, 22 nt, Human
uagacuugcugacuuuacucug

SEQ ID NO: 1299026 - RNA, 23 nt, Human
uagcaagcaaagaauaaaaggga

SEQ ID NO: 1299027 - RNA, 26 nt, Human
uauaagagcauuuaccagaaagacag

SEQ ID NO: 1299028 - RNA, 21 nt, Human
uaugacuguagacuugcugac

SEQ ID NO: 1299029 - RNA, 18 nt, Human
ucaaugaacauuugcaca

SEQ ID NO: 1299030 - RNA, 22 nt, Human
uccaaauacucaccggccuuca

SEQ ID NO: 1299031 - RNA, 18 nt, Human
uccaggauguagagaagc

SEQ ID NO: 1299032 - RNA, 21 nt, Human
ugaagccccuggggcacaggu

SEQ ID NO: 1299033 - RNA, 21 nt, Human
ugaccaaggggggucuggggu

SEQ ID NO: 1299034 - RNA, 19 nt, Human
ugaugauucuuuaugcucu

SEQ ID NO: 1299035 - RNA, 19 nt, Human
uggauaacagauaacuccu

SEQ ID NO: 1299036 - RNA, 20 nt, Human
uggcaauuuggagauauaug

SEQ ID NO: 1299037 - RNA, 22 nt, Human
ugggauggaagggauggagaga

SEQ ID NO: 1299038 - RNA, 19 nt, Human
uguacauacauguaacagg

SEQ ID NO: 1299039 - RNA, 24 nt, Human
ugugaccaaggggggucugggguu

SEQ ID NO: 1299040 - RNA, 18 nt, Human
uguggaagaaccacucca

SEQ ID NO: 1299041 - RNA, 21 nt, Human
uucccagauguuuauauuguu

SEQ ID NO: 1299042 - RNA, 21 nt, Human
uucuguuggcacuuccacacu

SEQ ID NO: 1299043 - RNA, 21 nt, Human
uugaguucaggauaccaaguc

SEQ ID NO: 1299044 - RNA, 22 nt, Human
uuuucccaauuuucuaaaaccu

SEQ ID NO: 1299045 - RNA, 22 nt, Human
ccggcaacaaaagcgucccgag

SEQ ID NO: 1299046 - RNA, 24 nt, Human
cggggccuccggagcggguggccg

SEQ ID NO: 1299047 - RNA, 24 nt, Human
cuccggagcggguggccgauaccu

SEQ ID NO: 1299048 - RNA, 20 nt, Human
gcggggccuccggagcgggu

SEQ ID NO: 1299049 - RNA, 22 nt, Human
ggccuccggagcggguggccga

SEQ ID NO: 1299050 - RNA, 18 nt, Human
gggggucgaggcggggaa

SEQ ID NO: 1299051 - RNA, 24 nt, Human
ucuccggcaacaaaagcgucccga

SEQ ID NO: 1299052 - RNA, 18 nt, Human
uggcggggccuccggagc

SEQ ID NO: 1299053 - RNA, 25 nt, Human
aggaaaaugaguccuuuuuucuuuu

SEQ ID NO: 1299054 - RNA, 21 nt, Human
aguccuuuuuucuuuuuccag

SEQ ID NO: 1299055 - RNA, 24 nt, Human
caggcgccucccuccucgcgccuc

SEQ ID NO: 1299056 - RNA, 22 nt, Human
ccaaccggcggcuuccggcugc

SEQ ID NO: 1299057 - RNA, 19 nt, Human
ccaguacacgccgcugggc

SEQ ID NO: 1299058 - RNA, 20 nt, Human
ccaguacacgccgcugggcg

SEQ ID NO: 1299059 - RNA, 21 nt, Human
ccaguacacgccgcugggcgc

SEQ ID NO: 1299060 - RNA, 19 nt, Human
cccagucgccgcugcaaag

SEQ ID NO: 1299061 - RNA, 22 nt, Human
cccgcaccgcugccugcuugcg

SEQ ID NO: 1299062 - RNA, 24 nt, Human
cccuccaagcgcccccucucggca

SEQ ID NO: 1299063 - RNA, 26 nt, Human
ccgcggcaacgccaggcgccucccuc

SEQ ID NO: 1299064 - RNA, 22 nt, Human
ccgcugcaaagacaguuuccca

SEQ ID NO: 1299065 - RNA, 24 nt, Human
ccgguggcccuccaagcgcccccu

SEQ ID NO: 1299066 - RNA, 18 nt, Human
ccuccaagcgcccccucu

SEQ ID NO: 1299067 - RNA, 23 nt, Human
ccuccuggagggcgggguuugcg

SEQ ID NO: 1299068 - RNA, 24 nt, Human
cgaagccgccgguggcccuccaag

SEQ ID NO: 1299069 - RNA, 19 nt, Human
cgccgcugcaaagacaguu

SEQ ID NO: 1299070 - RNA, 21 nt, Human
cgcguaccguccacacagagc

SEQ ID NO: 1299071 - RNA, 18 nt, Human
cggcgcaggggcggagcc

SEQ ID NO: 1299072 - RNA, 21 nt, Human
cuuuuuucuuuuuccagcuga

SEQ ID NO: 1299073 - RNA, 24 nt, Human
gcaggggcggagccuccuggaggg

SEQ ID NO: 1299074 - RNA, 20 nt, Human
gcguaccguccacacagagc

SEQ ID NO: 1299075 - RNA, 20 nt, Human
gcugccaaguuuugauacca

SEQ ID NO: 1299076 - RNA, 23 nt, Human
gggcgggguuugcguucacccgc

SEQ ID NO: 1299077 - RNA, 24 nt, Human
uagacagacaagcagauuguuaaa

SEQ ID NO: 1299078 - RNA, 18 nt, Human
ucacagaaaucccaguac

SEQ ID NO: 1299079 - RNA, 19 nt, Human
ucaccagcugccaaguuuu

SEQ ID NO: 1299080 - RNA, 23 nt, Human
ucccagcgccgcggcaacgccag

SEQ ID NO: 1299081 - RNA, 19 nt, Human
ucgaagccgccgguggccc

SEQ ID NO: 1299082 - RNA, 18 nt, Human
ucucggcagccucugcuc

SEQ ID NO: 1299083 - RNA, 19 nt, Human
ugagaaaccucaaguccuu

SEQ ID NO: 1299084 - RNA, 23 nt, Human
ugcccgggcgcgacgcgcugcgg

SEQ ID NO: 1299085 - RNA, 18 nt, Human
ugcucacagaaaucccag

SEQ ID NO: 1299086 - RNA, 24 nt, Human
uuaaaggacacagcauauuaguuu

SEQ ID NO: 1299087 - RNA, 19 nt, Human
uugccgccuagcaaccgcc

SEQ ID NO: 1299088 - RNA, 20 nt, Human
uuuuccagcugacacucuga

SEQ ID NO: 1299089 - RNA, 24 nt, Human
acagcaccucugcuguggggggca

SEQ ID NO: 1299090 - RNA, 21 nt, Human
agaacagcaccucugcugugg

SEQ ID NO: 1299091 - RNA, 25 nt, Human
agcacccccuacaccagaccuccug

SEQ ID NO: 1299092 - RNA, 23 nt, Human
caggagcacccccuacaccagac

SEQ ID NO: 1299093 - RNA, 23 nt, Human
ccucuucagacagggccucagac

SEQ ID NO: 1299094 - RNA, 19 nt, Human
cucagaccuaaggcaggag

SEQ ID NO: 1299095 - RNA, 23 nt, Human
gcugggcccucuucagacagggc

SEQ ID NO: 1299096 - RNA, 22 nt, Human
gggacggaggauggacggagga

SEQ ID NO: 1299097 - RNA, 19 nt, Human
ggggcugggcccucuucag

SEQ ID NO: 1299098 - RNA, 22 nt, Human
guggggggcaucuagcaugggg

SEQ ID NO: 1299099 - RNA, 22 nt, Human
ucagacagggccucagaccuaa

SEQ ID NO: 1299100 - RNA, 20 nt, Human
ucagaccuaaggcaggagca

SEQ ID NO: 1299101 - RNA, 20 nt, Human
uccugggucacaggaaaugc

SEQ ID NO: 1299102 - RNA, 18 nt, Human
ugcagcucuuucugcaga

SEQ ID NO: 1299103 - RNA, 22 nt, Human
uugcagcucuuucugcagaugg

SEQ ID NO: 1299104 - RNA, 22 nt, Human
aaaaaggcagaguaacucagug

SEQ ID NO: 1299105 - RNA, 30 nt, Human
aaacacagcacaaaaggauuaauucacacc

SEQ ID NO: 1299106 - RNA, 22 nt, Human
aaagaauaaaaacgucaaaaag

SEQ ID NO: 1299107 - RNA, 22 nt, Human
aaccucagacaaucuucggcug

SEQ ID NO: 1299108 - RNA, 20 nt, Human
aaguccauuaaccgugaaag

SEQ ID NO: 1299109 - RNA, 20 nt, Human
aaugaaaguuaaagucuugg

SEQ ID NO: 1299110 - RNA, 22 nt, Human
agcacaaaaggauuaauucaca

SEQ ID NO: 1299111 - RNA, 21 nt, Human
agcuaauacugauuaaacaca

SEQ ID NO: 1299112 - RNA, 24 nt, Human
aguuaaaaaauccaacaauuucag

SEQ ID NO: 1299113 - RNA, 20 nt, Human
cacagugaaacaggugcaug

SEQ ID NO: 1299114 - RNA, 24 nt, Human
cagagaaaaauccagugacuuguu

SEQ ID NO: 1299115 - RNA, 21 nt, Human
cagagugggccggccccugcc

SEQ ID NO: 1299116 - RNA, 20 nt, Human
cagcaaccucagacaaucuu

SEQ ID NO: 1299117 - RNA, 24 nt, Human
cauauaaaucuaccaggcuaugga

SEQ ID NO: 1299118 - RNA, 18 nt, Human
cauauguaaccacaggaa

SEQ ID NO: 1299119 - RNA, 23 nt, Human
ccucgcucguaaacuucagcggc

SEQ ID NO: 1299120 - RNA, 23 nt, Human
ccuuuacauucacuauucacagu

SEQ ID NO: 1299121 - RNA, 25 nt, Human
cgggagccagccucugucuucucaa

SEQ ID NO: 1299122 - RNA, 24 nt, Human
cucccugcgccggucggcagagac

SEQ ID NO: 1299123 - RNA, 21 nt, Human
cuccugagcucugaacucuga

SEQ ID NO: 1299124 - RNA, 18 nt, Human
cugacacacaaagaauaa

SEQ ID NO: 1299125 - RNA, 22 nt, Human
cuucccccacuauuugaaaucu

SEQ ID NO: 1299126 - RNA, 18 nt, Human
cuuuuuuuuuuuuuuuug

SEQ ID NO: 1299127 - RNA, 20 nt, Human
gaaaaaaaaacauaauagga

SEQ ID NO: 1299128 - RNA, 20 nt, Human
gaacuucuaaaccaauaccc

SEQ ID NO: 1299129 - RNA, 21 nt, Human
gagacagagaagugguaggag

SEQ ID NO: 1299130 - RNA, 22 nt, Human
gccacagcacagcuguguacca

SEQ ID NO: 1299131 - RNA, 19 nt, Human
ggcacuucuucauuaaguc

SEQ ID NO: 1299132 - RNA, 20 nt, Human
ggcccggaagccucaaggcg

SEQ ID NO: 1299133 - RNA, 20 nt, Human
ggcuguauauccuuaagguu

SEQ ID NO: 1299134 - RNA, 20 nt, Human
gggaggaguccggcgcgcac

SEQ ID NO: 1299135 - RNA, 20 nt, Human
ggggaaaggccucugcgggc

SEQ ID NO: 1299136 - RNA, 18 nt, Human
gggucucggcggaaccaa

SEQ ID NO: 1299137 - RNA, 21 nt, Human
guaaggaaaaggcagcccucc

SEQ ID NO: 1299138 - RNA, 22 nt, Human
guagaauauacauauauaauuc

SEQ ID NO: 1299139 - RNA, 23 nt, Human
gucaaaaaggcagaguaacucag

SEQ ID NO: 1299140 - RNA, 20 nt, Human
uaaacacagcacaaaaggau

SEQ ID NO: 1299141 - RNA, 20 nt, Human
uaaccacaggaauucuacag

SEQ ID NO: 1299142 - RNA, 21 nt, Human
uagccagcaaccucagacaau

SEQ ID NO: 1299143 - RNA, 18 nt, Human
ucagaaugcauggaugca

SEQ ID NO: 1299144 - RNA, 22 nt, Human
ucagaguucugagguugcugac

SEQ ID NO: 1299145 - RNA, 20 nt, Human
ucccugcgccggucggcaga

SEQ ID NO: 1299146 - RNA, 18 nt, Human
ucugaaauacaguuucuu

SEQ ID NO: 1299147 - RNA, 18 nt, Human
ucuuuuuuuuuuuuuuuu

SEQ ID NO: 1299148 - RNA, 23 nt, Human
ucuuuuuuuuuuuuuuuuguuuu

SEQ ID NO: 1299149 - RNA, 23 nt, Human
ucuuuuuuuuuuuuuuuuguuuu

SEQ ID NO: 1299150 - RNA, 19 nt, Human
ugaaaaauaaaguuagcca

SEQ ID NO: 1299151 - RNA, 18 nt, Human
ugacacacaaagaauaaa

SEQ ID NO: 1299152 - RNA, 20 nt, Human
ugacacacaaagaauaaaaa

SEQ ID NO: 1299153 - RNA, 24 nt, Human
ugacacgcgugcugacagagaaaa

SEQ ID NO: 1299154 - RNA, 25 nt, Human
ugacugagccacagcacagcugugu

SEQ ID NO: 1299155 - RNA, 22 nt, Human
ugaguaacugcacugcccucgc

SEQ ID NO: 1299156 - RNA, 23 nt, Human
ugcccucgcucguaaacuucagc

SEQ ID NO: 1299157 - RNA, 21 nt, Human
ugccgggagccagccucuguc

SEQ ID NO: 1299158 - RNA, 24 nt, Human
uggcuccugagcucugaacucuuu

SEQ ID NO: 1299159 - RNA, 21 nt, Human
ugguaggagcugaguuugacg

SEQ ID NO: 1299160 - RNA, 23 nt, Human
aaaaaggccucucucucguguuu

SEQ ID NO: 1299161 - RNA, 19 nt, Human
acccagcuugcaguccagc

SEQ ID NO: 1299162 - RNA, 21 nt, Human
accccccccggcaccuugcug

SEQ ID NO: 1299163 - RNA, 24 nt, Human
accuccuucaggaccucgcaguug

SEQ ID NO: 1299164 - RNA, 20 nt, Human
acgaagcggcgcugggacag

SEQ ID NO: 1299165 - RNA, 21 nt, Human
agcaccagguccagggucucg

SEQ ID NO: 1299166 - RNA, 19 nt, Human
agcaggagccccuccagga

SEQ ID NO: 1299167 - RNA, 19 nt, Human
aggacccucuguggccuga

SEQ ID NO: 1299168 - RNA, 19 nt, Human
aggagggcagcugagggcc

SEQ ID NO: 1299169 - RNA, 19 nt, Human
auggaugcgcugccagccc

SEQ ID NO: 1299170 - RNA, 22 nt, Human
auucaucuccagcagccauacc

SEQ ID NO: 1299171 - RNA, 22 nt, Human
caaacaaggugaaaaaggccuc

SEQ ID NO: 1299172 - RNA, 18 nt, Human
caccagcagcggguucug

SEQ ID NO: 1299173 - RNA, 19 nt, Human
cacccgcgccugaggcccc

SEQ ID NO: 1299174 - RNA, 22 nt, Human
caccgugugcuccuucagcagc

SEQ ID NO: 1299175 - RNA, 18 nt, Human
cagcccacaagguccugg

SEQ ID NO: 1299176 - RNA, 21 nt, Human
caggaagaugccuuugcccug

SEQ ID NO: 1299177 - RNA, 21 nt, Human
caguaggagcugaugauugug

SEQ ID NO: 1299178 - RNA, 21 nt, Human
cauagccguggccaaagaaga

SEQ ID NO: 1299179 - RNA, 20 nt, Human
ccagcagcggguucuggaug

SEQ ID NO: 1299180 - RNA, 18 nt, Human
cccagcuugcaguccagc

SEQ ID NO: 1299181 - RNA, 22 nt, Human
ccccggccgggugcuguggggc

SEQ ID NO: 1299182 - RNA, 23 nt, Human
cccgcgccugaggcccccggaac

SEQ ID NO: 1299183 - RNA, 22 nt, Human
ccgcgccugaggcccccggaac

SEQ ID NO: 1299184 - RNA, 19 nt, Human
ccggagcaggaagaugccu

SEQ ID NO: 1299185 - RNA, 26 nt, Human
ccggagcaggaagaugccuuugcccu

SEQ ID NO: 1299186 - RNA, 24 nt, Human
ccggcggcguuagugucauccgag

SEQ ID NO: 1299187 - RNA, 20 nt, Human
ccgugugcuccuucagcagc

SEQ ID NO: 1299188 - RNA, 19 nt, Human
ccucaccguugugcaggag

SEQ ID NO: 1299189 - RNA, 22 nt, Human
ccuggccuggaccccccccggc

SEQ ID NO: 1299190 - RNA, 18 nt, Human
ccuugcucauggcccgug

SEQ ID NO: 1299191 - RNA, 21 nt, Human
cgaggccccgggccuuccaga

SEQ ID NO: 1299192 - RNA, 20 nt, Human
cgcugggacagcagaggcaa

SEQ ID NO: 1299193 - RNA, 20 nt, Human
cuccacaccgugugcuccuu

SEQ ID NO: 1299194 - RNA, 22 nt, Human
cuccugguuccggagcaggaag

SEQ ID NO: 1299195 - RNA, 21 nt, Human
cucuugaccucacaccacuuc

SEQ ID NO: 1299196 - RNA, 23 nt, Human
cugcagggcggcaacuuccuccu

SEQ ID NO: 1299197 - RNA, 22 nt, Human
cuggaaugggggucguaaaggc

SEQ ID NO: 1299198 - RNA, 25 nt, Human
cuggaccccccccggcaccuugcug

SEQ ID NO: 1299199 - RNA, 22 nt, Human
cuugaccucacaccacuucagc

SEQ ID NO: 1299200 - RNA, 20 nt, Human
gcgccugaggcccccggaac

SEQ ID NO: 1299201 - RNA, 22 nt, Human
gcggcaacuuccuccugguucc

SEQ ID NO: 1299202 - RNA, 18 nt, Human
gcuccacaccgugugcuc

SEQ ID NO: 1299203 - RNA, 21 nt, Human
ggaccccccccggcaccuugc

SEQ ID NO: 1299204 - RNA, 22 nt, Human
ggcagcugagggcccggcggcg

SEQ ID NO: 1299205 - RNA, 21 nt, Human
ggcccggcggcguuaguguca

SEQ ID NO: 1299206 - RNA, 24 nt, Human
gggcggcaacuuccuccugguucc

SEQ ID NO: 1299207 - RNA, 18 nt, Human
gguauccugggcuugucc

SEQ ID NO: 1299208 - RNA, 19 nt, Human
uccaauguagaagaagggc

SEQ ID NO: 1299209 - RNA, 21 nt, Human
uccaauguagaagaagggccc

SEQ ID NO: 1299210 - RNA, 22 nt, Human
uccaggagggcagcugagggcc

SEQ ID NO: 1299211 - RNA, 21 nt, Human
uccaugcuccacaccgugugc

SEQ ID NO: 1299212 - RNA, 22 nt, Human
ucgcaguuggugugcagggcug

SEQ ID NO: 1299213 - RNA, 24 nt, Human
ucuccagcagccauaccuugaagu

SEQ ID NO: 1299214 - RNA, 21 nt, Human
ucuccuucccggaagcugccg

SEQ ID NO: 1299215 - RNA, 24 nt, Human
ucucguguuugagguccaggcggu

SEQ ID NO: 1299216 - RNA, 23 nt, Human
ucugcaccacccgcgccugaggc

SEQ ID NO: 1299217 - RNA, 21 nt, Human
ucuguggccugagguauccug

SEQ ID NO: 1299218 - RNA, 19 nt, Human
ucuucuggccgcgcaggcu

SEQ ID NO: 1299219 - RNA, 22 nt, Human
ucuugugguggauggggucguc

SEQ ID NO: 1299220 - RNA, 19 nt, Human
ugaaaaaggccucucucuc

SEQ ID NO: 1299221 - RNA, 20 nt, Human
ugaggcgagcauagccgugg

SEQ ID NO: 1299222 - RNA, 21 nt, Human
ugagggcccggcggcguuagu

SEQ ID NO: 1299223 - RNA, 21 nt, Human
ugagguauccugggcuugucc

SEQ ID NO: 1299224 - RNA, 25 nt, Human
ugccagcccuugcuuuugcaguagg

SEQ ID NO: 1299225 - RNA, 23 nt, Human
ugcgcugccagcccuugcuuuug

SEQ ID NO: 1299226 - RNA, 23 nt, Human
ugcuguggggcgauggcuuccca

SEQ ID NO: 1299227 - RNA, 21 nt, Human
uggaugcgcugccagcccuug

SEQ ID NO: 1299228 - RNA, 21 nt, Human
uggccgccgaggucgcuggaa

SEQ ID NO: 1299229 - RNA, 18 nt, Human
ugggaagcugguacagca

SEQ ID NO: 1299230 - RNA, 23 nt, Human
uggguuagaauucaucuccagca

SEQ ID NO: 1299231 - RNA, 19 nt, Human
ugguuggaggcugugggcu

SEQ ID NO: 1299232 - RNA, 21 nt, Human
ugucaaaggacgcacgaccug

SEQ ID NO: 1299233 - RNA, 23 nt, Human
ugucaaaggacgcacgaccugcc

SEQ ID NO: 1299234 - RNA, 20 nt, Human
ugucauggaugcgcugccag

SEQ ID NO: 1299235 - RNA, 20 nt, Human
ugugcaggagcacgaagcgg

SEQ ID NO: 1299236 - RNA, 23 nt, Human
uucccaccccccagcaggagccc

SEQ ID NO: 1299237 - RNA, 22 nt, Human
uugcaguccagcuugggcuugg

SEQ ID NO: 1299238 - RNA, 20 nt, Human
aaccuccaccuccugggcuc

SEQ ID NO: 1299239 - RNA, 24 nt, Human
aaggugcugagaucacagguguga

SEQ ID NO: 1299240 - RNA, 21 nt, Human
acaggugcccaccaccacacc

SEQ ID NO: 1299241 - RNA, 22 nt, Human
accauagggagaugucuucuca

SEQ ID NO: 1299242 - RNA, 18 nt, Human
accauguuggccaggcug

SEQ ID NO: 1299243 - RNA, 23 nt, Human
accuaucagguacuggaggugaa

SEQ ID NO: 1299244 - RNA, 24 nt, Human
acucuguugcccaggcuggagugc

SEQ ID NO: 1299245 - RNA, 18 nt, Human
agaacucaagggacagga

SEQ ID NO: 1299246 - RNA, 19 nt, Human
agaucacaggugugagcca

SEQ ID NO: 1299247 - RNA, 20 nt, Human
agcuaugacagagaggggca

SEQ ID NO: 1299248 - RNA, 18 nt, Human
aggaaggagaugaguugg

SEQ ID NO: 1299249 - RNA, 21 nt, Human
aggaaggcagguuugggcugg

SEQ ID NO: 1299250 - RNA, 25 nt, Human
aggcuggagugcaguggcaugaucu

SEQ ID NO: 1299251 - RNA, 24 nt, Human
aggugauccaccugccucggccuc

SEQ ID NO: 1299252 - RNA, 26 nt, Human
aggugcugagaucacaggugugagcc

SEQ ID NO: 1299253 - RNA, 22 nt, Human
aguagagaugggguuucaccau

SEQ ID NO: 1299254 - RNA, 18 nt, Human
agugcaguggcaugaucu

SEQ ID NO: 1299255 - RNA, 19 nt, Human
agugcaguggcaugaucuc

SEQ ID NO: 1299256 - RNA, 21 nt, Human
agugcaguggcaugaucuccg

SEQ ID NO: 1299257 - RNA, 22 nt, Human
augacagagaggggcaggguac

SEQ ID NO: 1299258 - RNA, 22 nt, Human
augggguuucaccauguuggcc

SEQ ID NO: 1299259 - RNA, 24 nt, Human
augggguuucaccauguuggccag

SEQ ID NO: 1299260 - RNA, 18 nt, Human
auucuccugccucagccu

SEQ ID NO: 1299261 - RNA, 18 nt, Human
auucuccugccucagccu

SEQ ID NO: 1299262 - RNA, 21 nt, Human
auucuccugccucagccuccc

SEQ ID NO: 1299263 - RNA, 24 nt, Human
auuuuuguauuuuuaguagagaug

SEQ ID NO: 1299264 - RNA, 26 nt, Human
caaacuccugaccuaaggugauccaa

SEQ ID NO: 1299265 - RNA, 20 nt, Human
caaccuccaccuccugggcu

SEQ ID NO: 1299266 - RNA, 23 nt, Human
caaccuccaccuccugggcucaa

SEQ ID NO: 1299267 - RNA, 24 nt, Human
caaccuccaccuccugggcucaag

SEQ ID NO: 1299268 - RNA, 22 nt, Human
caagauauucuccugccucagc

SEQ ID NO: 1299269 - RNA, 19 nt, Human
caaggugcugagaucacag

SEQ ID NO: 1299270 - RNA, 24 nt, Human
caaggugcugagaucacaggugug

SEQ ID NO: 1299271 - RNA, 20 nt, Human
caagugauucuccugccuca

SEQ ID NO: 1299272 - RNA, 22 nt, Human
caagugauucuccugccucagc

SEQ ID NO: 1299273 - RNA, 23 nt, Human
caaugugugccaggacagauagu

SEQ ID NO: 1299274 - RNA, 19 nt, Human
cacagaacucaagggacag

SEQ ID NO: 1299275 - RNA, 19 nt, Human
cacaggugugagccaccac

SEQ ID NO: 1299276 - RNA, 24 nt, Human
caccacaccuggcuaauuuuugua

SEQ ID NO: 1299277 - RNA, 21 nt, Human
caccauguuggccaggcuggu

SEQ ID NO: 1299278 - RNA, 24 nt, Human
caccauguuggccaggcuggucuc

SEQ ID NO: 1299279 - RNA, 27 nt, Human
caccauguuggccaggcuggucucaaa

SEQ ID NO: 1299280 - RNA, 21 nt, Human
cacugcaaccuccaccuccug

SEQ ID NO: 1299281 - RNA, 23 nt, Human
cacugcaaccuccaccuccuggg

SEQ ID NO: 1299282 - RNA, 20 nt, Human
cacuggacauuucgcacccu

SEQ ID NO: 1299283 - RNA, 24 nt, Human
caggugcccaccaccacaccuggc

SEQ ID NO: 1299284 - RNA, 24 nt, Human
cauguuggccaggcuggucucaaa

SEQ ID NO: 1299285 - RNA, 20 nt, Human
cauuguaacacagacaaagc

SEQ ID NO: 1299286 - RNA, 24 nt, Human
ccaccuccugggcucaagugauuc

SEQ ID NO: 1299287 - RNA, 19 nt, Human
cccaggcuggagugcagug

SEQ ID NO: 1299288 - RNA, 23 nt, Human
cccaggcuggagugcaguggcau

SEQ ID NO: 1299289 - RNA, 22 nt, Human
ccuccaccuccugggcucaagu

SEQ ID NO: 1299290 - RNA, 24 nt, Human
ccucccagguucaagauauucucc

SEQ ID NO: 1299291 - RNA, 21 nt, Human
ccuccugggcucaagugauuc

SEQ ID NO: 1299292 - RNA, 24 nt, Human
ccuccugggcucaagugauucucc

SEQ ID NO: 1299293 - RNA, 21 nt, Human
ccugaccuaaggugauccacc

SEQ ID NO: 1299294 - RNA, 23 nt, Human
ccugaccuaaggugauccaccug

SEQ ID NO: 1299295 - RNA, 24 nt, Human
ccugccucagccucccgaguaagu

SEQ ID NO: 1299296 - RNA, 23 nt, Human
ccugggcucaagugauucuccuc

SEQ ID NO: 1299297 - RNA, 23 nt, Human
ccugggcucaagugauucuccug

SEQ ID NO: 1299298 - RNA, 23 nt, Human
cuaaggugauccaccugccucgg

SEQ ID NO: 1299299 - RNA, 23 nt, Human
cuaauuuuuguauuuuuaguaga

SEQ ID NO: 1299300 - RNA, 23 nt, Human
cucaagugauucuccugccucag

SEQ ID NO: 1299301 - RNA, 24 nt, Human
cucaagugauucuccugccucagc

SEQ ID NO: 1299302 - RNA, 24 nt, Human
cucacugcaaccuccaccuccugg

SEQ ID NO: 1299303 - RNA, 27 nt, Human
cucacugcaaccuccaccuccugggcu

SEQ ID NO: 1299304 - RNA, 18 nt, Human
cuccugccucagccuccc

SEQ ID NO: 1299305 - RNA, 21 nt, Human
cuccugggcucaagugauucu

SEQ ID NO: 1299306 - RNA, 21 nt, Human
cucgcaaggugcugagaucac

SEQ ID NO: 1299307 - RNA, 18 nt, Human
cugcaaccuccaccuccu

SEQ ID NO: 1299308 - RNA, 24 nt, Human
cugcaaccuccaccuccugggcuc

SEQ ID NO: 1299309 - RNA, 21 nt, Human
cuggaucuugauauguguuuc

SEQ ID NO: 1299310 - RNA, 24 nt, Human
cuggggagcccaccucccagguuc

SEQ ID NO: 1299311 - RNA, 19 nt, Human
cuguugcccaggcuggagu

SEQ ID NO: 1299312 - RNA, 19 nt, Human
cuuguggagugggggcugu

SEQ ID NO: 1299313 - RNA, 21 nt, Human
cuuguggagugggggcugugu

SEQ ID NO: 1299314 - RNA, 20 nt, Human
cuuuuguauuuuuaguagag

SEQ ID NO: 1299315 - RNA, 19 nt, Human
gacacagaacucaagggac

SEQ ID NO: 1299316 - RNA, 18 nt, Human
gacagauaguucuggggc

SEQ ID NO: 1299317 - RNA, 21 nt, Human
gacaggaaggagaugaguugg

SEQ ID NO: 1299318 - RNA, 24 nt, Human
gaccuaaggugauccaccugccuc

SEQ ID NO: 1299319 - RNA, 25 nt, Human
gagaccugggcuugggaggcauccc

SEQ ID NO: 1299320 - RNA, 20 nt, Human
gagaugaguuggaggcuggg

SEQ ID NO: 1299321 - RNA, 20 nt, Human
gagaugggguuucaccaugu

SEQ ID NO: 1299322 - RNA, 24 nt, Human
gagaugggguuucaccauguuggc

SEQ ID NO: 1299323 - RNA, 20 nt, Human
gaggcugggacagggguccc

SEQ ID NO: 1299324 - RNA, 19 nt, Human
gaguuggaggcugggacag

SEQ ID NO: 1299325 - RNA, 18 nt, Human
gaucacaggugugagcca

SEQ ID NO: 1299326 - RNA, 21 nt, Human
gauucuccugccucagccucc

SEQ ID NO: 1299327 - RNA, 24 nt, Human
gcaaggugcugagaucacaggugu

SEQ ID NO: 1299328 - RNA, 20 nt, Human
gcccaggcuggagugcagug

SEQ ID NO: 1299329 - RNA, 21 nt, Human
gccugguuuggggaauguucg

SEQ ID NO: 1299330 - RNA, 25 nt, Human
gcuggagugcaguggcaugaucucc

SEQ ID NO: 1299331 - RNA, 22 nt, Human
gcuugggaggcaucccaggugg

SEQ ID NO: 1299332 - RNA, 25 nt, Human
ggacaggggucccugccagggaugc

SEQ ID NO: 1299333 - RNA, 20 nt, Human
ggagacagacaagauggggg

SEQ ID NO: 1299334 - RNA, 24 nt, Human
gggaggcaucccagguggacagug

SEQ ID NO: 1299335 - RNA, 19 nt, Human
gggcuaggaaggcagguuu

SEQ ID NO: 1299336 - RNA, 22 nt, Human
gggcucaagugauucuccugcc

SEQ ID NO: 1299337 - RNA, 22 nt, Human
gggguuucaccauguuggccag

SEQ ID NO: 1299338 - RNA, 20 nt, Human
gggguuuugcuuuaaagccu

SEQ ID NO: 1299339 - RNA, 18 nt, Human
ggguuucaccauguuggc

SEQ ID NO: 1299340 - RNA, 22 nt, Human
ggguuucaccauguuggccagg

SEQ ID NO: 1299341 - RNA, 23 nt, Human
guagagaugggguuucaccaugu

SEQ ID NO: 1299342 - RNA, 19 nt, Human
gugauccaccugccucggc

SEQ ID NO: 1299343 - RNA, 22 nt, Human
gugauccaccugccucggccuc

SEQ ID NO: 1299344 - RNA, 24 nt, Human
gugauucuccugccucagccuccc

SEQ ID NO: 1299345 - RNA, 21 nt, Human
gugcugagaucacagguguga

SEQ ID NO: 1299346 - RNA, 21 nt, Human
gugugagccaccacgcugggc

SEQ ID NO: 1299347 - RNA, 22 nt, Human
uaacuuuuguauuuuuaguaga

SEQ ID NO: 1299348 - RNA, 24 nt, Human
uaauuuuuguauuuuuaguagaga

SEQ ID NO: 1299349 - RNA, 22 nt, Human
uacaggugcccaccaccacacc

SEQ ID NO: 1299350 - RNA, 24 nt, Human
uacucuguugcccaggcuggagug

SEQ ID NO: 1299351 - RNA, 22 nt, Human
uagagaugggguuucaccaugu

SEQ ID NO: 1299352 - RNA, 25 nt, Human
uaggaaggcagguuugggcuggaga

SEQ ID NO: 1299353 - RNA, 24 nt, Human
uaguagagaugggguuucaccaug

SEQ ID NO: 1299354 - RNA, 26 nt, Human
uaguagagaugggguuucaccauguu

SEQ ID NO: 1299355 - RNA, 19 nt, Human
uauguguuucucaguugga

SEQ ID NO: 1299356 - RNA, 23 nt, Human
ucacugcaaccuccaccuccugg

SEQ ID NO: 1299357 - RNA, 24 nt, Human
ucacugcaaccuccaccuccuggg

SEQ ID NO: 1299358 - RNA, 25 nt, Human
ucacugcaaccuccaccuccugggc

SEQ ID NO: 1299359 - RNA, 27 nt, Human
ucacugcaaccuccaccuccugggcuc

SEQ ID NO: 1299360 - RNA, 22 nt, Human
uccaaagaagcaagucuuacua

SEQ ID NO: 1299361 - RNA, 19 nt, Human
uccaaaggaccgacggacc

SEQ ID NO: 1299362 - RNA, 20 nt, Human
uccaaaggaccgacggaccu

SEQ ID NO: 1299363 - RNA, 24 nt, Human
ucccagguggacagugguugaggu

SEQ ID NO: 1299364 - RNA, 21 nt, Human
ucccagguucaagauauucuc

SEQ ID NO: 1299365 - RNA, 24 nt, Human
ucccagguucaagauauucuccug

SEQ ID NO: 1299366 - RNA, 23 nt, Human
ucccgaguaagugggauuacagg

SEQ ID NO: 1299367 - RNA, 24 nt, Human
ucccgaguaagugggauuacaggu

SEQ ID NO: 1299368 - RNA, 21 nt, Human
uccugggcucaagugauucuc

SEQ ID NO: 1299369 - RNA, 22 nt, Human
uccugggcucaagugauucucc

SEQ ID NO: 1299370 - RNA, 24 nt, Human
uccugggcucaagugauucuccug

SEQ ID NO: 1299371 - RNA, 24 nt, Human
ucgcaaggugcugagaucacaggu

SEQ ID NO: 1299372 - RNA, 22 nt, Human
ucuagacuccauccuccauucc

SEQ ID NO: 1299373 - RNA, 25 nt, Human
ucuccugccucagccucccaaguaa

SEQ ID NO: 1299374 - RNA, 18 nt, Human
ucuguugcccaggcugga

SEQ ID NO: 1299375 - RNA, 24 nt, Human
ucuguugcccaggcuggagugcag

SEQ ID NO: 1299376 - RNA, 22 nt, Human
ucuuacucuguugcccaggcug

SEQ ID NO: 1299377 - RNA, 23 nt, Human
ucuuacucuguugcccaggcugg

SEQ ID NO: 1299378 - RNA, 24 nt, Human
ucuuacucuguugcccaggcugga

SEQ ID NO: 1299379 - RNA, 19 nt, Human
ugacacagaacucaaggga

SEQ ID NO: 1299380 - RNA, 18 nt, Human
ugacagagaggggcaggg

SEQ ID NO: 1299381 - RNA, 22 nt, Human
ugaccgugauugccugggauga

SEQ ID NO: 1299382 - RNA, 24 nt, Human
ugaccuaaggugauccaccugccu

SEQ ID NO: 1299383 - RNA, 22 nt, Human
ugagaucacaggugugagccac

SEQ ID NO: 1299384 - RNA, 24 nt, Human
ugagaucacaggugugagccacca

SEQ ID NO: 1299385 - RNA, 23 nt, Human
ugaucuccgcucacugcaaccuc

SEQ ID NO: 1299386 - RNA, 19 nt, Human
ugccaggacagauaguucu

SEQ ID NO: 1299387 - RNA, 21 nt, Human
ugccaggacagauaguucugg

SEQ ID NO: 1299388 - RNA, 18 nt, Human
ugcccaggcuggagugca

SEQ ID NO: 1299389 - RNA, 22 nt, Human
ugcccaggcuggagugcagugg

SEQ ID NO: 1299390 - RNA, 24 nt, Human
ugcccaggcuggagugcaguggca

SEQ ID NO: 1299391 - RNA, 21 nt, Human
ugcccugggcuuuaauuauuu

SEQ ID NO: 1299392 - RNA, 24 nt, Human
ugccucagccucccaaguaacugg

SEQ ID NO: 1299393 - RNA, 24 nt, Human
ugccucagccucccgaguaagugg

SEQ ID NO: 1299394 - RNA, 22 nt, Human
ugccugggaugagaguggagac

SEQ ID NO: 1299395 - RNA, 21 nt, Human
ugccugguuuggggaauguuc

SEQ ID NO: 1299396 - RNA, 24 nt, Human
ugcugagaucacaggugugagcca

SEQ ID NO: 1299397 - RNA, 22 nt, Human
uggaaaggacaggaaguugaug

SEQ ID NO: 1299398 - RNA, 24 nt, Human
uggagucuuacucuguugcccagg

SEQ ID NO: 1299399 - RNA, 19 nt, Human
uggagugcaguggcaugau

SEQ ID NO: 1299400 - RNA, 22 nt, Human
uggagugcaguggcaugaucuc

SEQ ID NO: 1299401 - RNA, 23 nt, Human
uggagugcaguggcaugaucucc

SEQ ID NO: 1299402 - RNA, 24 nt, Human
uggagugcaguggcaugaucuccg

SEQ ID NO: 1299403 - RNA, 24 nt, Human
uggccaggcuggucucaaacuccu

SEQ ID NO: 1299404 - RNA, 24 nt, Human
ugggaaugcaggugcgugccacca

SEQ ID NO: 1299405 - RNA, 20 nt, Human
ugggaugagaguggagacag

SEQ ID NO: 1299406 - RNA, 21 nt, Human
ugggauuacaggugcccacca

SEQ ID NO: 1299407 - RNA, 24 nt, Human
ugggauuacaggugcccaccacca

SEQ ID NO: 1299408 - RNA, 18 nt, Human
ugggcucaagugauucuc

SEQ ID NO: 1299409 - RNA, 24 nt, Human
ugggcucaagugauucuccugccu

SEQ ID NO: 1299410 - RNA, 20 nt, Human
ugggcuggagaccugggcuu

SEQ ID NO: 1299411 - RNA, 24 nt, Human
ugggguuucaccauguuggccagg

SEQ ID NO: 1299412 - RNA, 21 nt, Human
uguauuuuuaguagagauggg

SEQ ID NO: 1299413 - RNA, 18 nt, Human
ugucuggaaaggacagga

SEQ ID NO: 1299414 - RNA, 24 nt, Human
ugucuggaaaggacaggaaguuga

SEQ ID NO: 1299415 - RNA, 22 nt, Human
ugugacacagaacucaagggac

SEQ ID NO: 1299416 - RNA, 18 nt, Human
uuaguagagaugggguuu

SEQ ID NO: 1299417 - RNA, 22 nt, Human
uuaguagagaugggguuucacc

SEQ ID NO: 1299418 - RNA, 24 nt, Human
uuaguagagaugggguuucaccau

SEQ ID NO: 1299419 - RNA, 21 nt, Human
uucaagauauucuccugccuc

SEQ ID NO: 1299420 - RNA, 19 nt, Human
uuccaaagaagcaagucuu

SEQ ID NO: 1299421 - RNA, 19 nt, Human
uugauauguguuucucagu

SEQ ID NO: 1299422 - RNA, 20 nt, Human
uuggaggcugggacaggggu

SEQ ID NO: 1299423 - RNA, 21 nt, Human
uugggaggcaucccaggugga

SEQ ID NO: 1299424 - RNA, 22 nt, Human
uuuaaagauggagucuuacucu

SEQ ID NO: 1299425 - RNA, 24 nt, Human
uuuaaagccuggggagcccaccuc

SEQ ID NO: 1299426 - RNA, 24 nt, Human
uuucaccauguuggccaggcuggu

SEQ ID NO: 1299427 - RNA, 22 nt, Human
uuugcuuuaaagccuggggagc

SEQ ID NO: 1299428 - RNA, 24 nt, Human
uuuuuaguagagaugggguuucac

SEQ ID NO: 1299429 - RNA, 20 nt, Human
uuuuuguauuuuuaguagag

SEQ ID NO: 1299430 - RNA, 18 nt, Human
aauaucccccagagaugg

SEQ ID NO: 1299431 - RNA, 24 nt, Human
aaucacacgcuggccgcccucgag

SEQ ID NO: 1299432 - RNA, 20 nt, Human
accucgggacccaaaggagc

SEQ ID NO: 1299433 - RNA, 22 nt, Human
accucgggacccaaaggagcug

SEQ ID NO: 1299434 - RNA, 18 nt, Human
agccagggcugccauagc

SEQ ID NO: 1299435 - RNA, 18 nt, Human
aggaggaagggggcuuga

SEQ ID NO: 1299436 - RNA, 19 nt, Human
aggaggaagggggcuugag

SEQ ID NO: 1299437 - RNA, 25 nt, Human
aggaggaagggggcuugagccccaa

SEQ ID NO: 1299438 - RNA, 22 nt, Human
cagggagaaaagguacucaggc

SEQ ID NO: 1299439 - RNA, 24 nt, Human
caucauggaauuugcccaguaggg

SEQ ID NO: 1299440 - RNA, 20 nt, Human
ccagggagaaaagguacuca

SEQ ID NO: 1299441 - RNA, 18 nt, Human
ccucgggacccaaaggag

SEQ ID NO: 1299442 - RNA, 24 nt, Human
ccugggaagcaggagagcuuggag

SEQ ID NO: 1299443 - RNA, 21 nt, Human
cugccugcucugcuggggccc

SEQ ID NO: 1299444 - RNA, 21 nt, Human
cugccugcucugcuggggccc

SEQ ID NO: 1299445 - RNA, 21 nt, Human
cuggacaggaccuugugagac

SEQ ID NO: 1299446 - RNA, 22 nt, Human
cuugagccccaagggccccgac

SEQ ID NO: 1299447 - RNA, 22 nt, Human
gaaccuacgagaauauccccca

SEQ ID NO: 1299448 - RNA, 24 nt, Human
gacaugggccgacuccaggaggaa

SEQ ID NO: 1299449 - RNA, 19 nt, Human
gaggaggaagggggcuuga

SEQ ID NO: 1299450 - RNA, 18 nt, Human
gccccaagggccccgacg

SEQ ID NO: 1299451 - RNA, 20 nt, Human
gcccuggggagggcaacagc

SEQ ID NO: 1299452 - RNA, 20 nt, Human
gccugagccaguucuggggu

SEQ ID NO: 1299453 - RNA, 19 nt, Human
gggaagcaggagagcuugg

SEQ ID NO: 1299454 - RNA, 21 nt, Human
gggaagcaggagagcuuggag

SEQ ID NO: 1299455 - RNA, 21 nt, Human
ggggagggcaacagcauaggc

SEQ ID NO: 1299456 - RNA, 27 nt, Human
uccaggaggaaucacacgcuggccgcc

SEQ ID NO: 1299457 - RNA, 19 nt, Human
ucccccagagauggcaccu

SEQ ID NO: 1299458 - RNA, 23 nt, Human
ucugcuggggcccuuguugcaga

SEQ ID NO: 1299459 - RNA, 23 nt, Human
ugagcaccagcucagggucugac

SEQ ID NO: 1299460 - RNA, 19 nt, Human
ugcuggggcccuuguugca

SEQ ID NO: 1299461 - RNA, 21 nt, Human
ugcuggggcccuuguugcaga

SEQ ID NO: 1299462 - RNA, 23 nt, Human
uggccugagccaguucuggggug

SEQ ID NO: 1299463 - RNA, 24 nt, Human
ugugagaccggaggaggaaggggg

SEQ ID NO: 1299464 - RNA, 22 nt, Human
uuggagcagaaggccagggaga

SEQ ID NO: 1299465 - RNA, 24 nt, Human
uugugagaccggaggaggaagggg

SEQ ID NO: 1299466 - RNA, 20 nt, Human
aacacacuggguccccagca

SEQ ID NO: 1299467 - RNA, 18 nt, Human
aagaagccaauaucacug

SEQ ID NO: 1299468 - RNA, 21 nt, Human
acacuggguccccagcacagu

SEQ ID NO: 1299469 - RNA, 18 nt, Human
accacauuggaggccugg

SEQ ID NO: 1299470 - RNA, 21 nt, Human
acccagcaacacacugggucc

SEQ ID NO: 1299471 - RNA, 22 nt, Human
agaagugugauguucccauccc

SEQ ID NO: 1299472 - RNA, 19 nt, Human
agaccuggacaggauggca

SEQ ID NO: 1299473 - RNA, 20 nt, Human
agcagucacagcucagcugg

SEQ ID NO: 1299474 - RNA, 22 nt, Human
agggagcaagggagggaugcag

SEQ ID NO: 1299475 - RNA, 20 nt, Human
agguagcagagacccuggca

SEQ ID NO: 1299476 - RNA, 23 nt, Human
caacacacuggguccccagcaca

SEQ ID NO: 1299477 - RNA, 20 nt, Human
cagaaagggugagcaggaug

SEQ ID NO: 1299478 - RNA, 19 nt, Human
cagaauccagcucaaccac

SEQ ID NO: 1299479 - RNA, 21 nt, Human
cagagacccuggcaaccuccu

SEQ ID NO: 1299480 - RNA, 18 nt, Human
cagcaacacacugggucc

SEQ ID NO: 1299481 - RNA, 21 nt, Human
cagcagggagcaagggaggga

SEQ ID NO: 1299482 - RNA, 21 nt, Human
cauccccagaauccagcucaa

SEQ ID NO: 1299483 - RNA, 18 nt, Human
cauuggaggccuggguga

SEQ ID NO: 1299484 - RNA, 25 nt, Human
ccaggugaucccauuccuggccaau

SEQ ID NO: 1299485 - RNA, 22 nt, Human
ccauccccagaauccagcucaa

SEQ ID NO: 1299486 - RNA, 22 nt, Human
cccagguugggguacaugagac

SEQ ID NO: 1299487 - RNA, 20 nt, Human
ccucugagaagugugauguu

SEQ ID NO: 1299488 - RNA, 18 nt, Human
cucaaagagagauaagaa

SEQ ID NO: 1299489 - RNA, 19 nt, Human
cugccccagaggcuugggg

SEQ ID NO: 1299490 - RNA, 19 nt, Human
gacaggauggcagaaaggg

SEQ ID NO: 1299491 - RNA, 20 nt, Human
gagaagugugauguucccau

SEQ ID NO: 1299492 - RNA, 26 nt, Human
gaggggacccagcaacacacuggguc

SEQ ID NO: 1299493 - RNA, 20 nt, Human
gauggcagaaagggugagca

SEQ ID NO: 1299494 - RNA, 23 nt, Human
gauggcagaaagggugagcagga

SEQ ID NO: 1299495 - RNA, 21 nt, Human
gggacccagcaacacacuggg

SEQ ID NO: 1299496 - RNA, 20 nt, Human
gggcagggaggcucuggaug

SEQ ID NO: 1299497 - RNA, 27 nt, Human
guagcagagacccuggcaaccuccuuc

SEQ ID NO: 1299498 - RNA, 22 nt, Human
gugggcccuucauggaaggggc

SEQ ID NO: 1299499 - RNA, 23 nt, Human
uacaugagaccugccccagaggc

SEQ ID NO: 1299500 - RNA, 19 nt, Human
ucaggagcagauugacaag

SEQ ID NO: 1299501 - RNA, 26 nt, Human
uccccagaauccagcucaaccacauc

SEQ ID NO: 1299502 - RNA, 19 nt, Human
uccccagcacagucuuggg

SEQ ID NO: 1299503 - RNA, 20 nt, Human
ucggugaugaggugaugagu

SEQ ID NO: 1299504 - RNA, 22 nt, Human
ugaccaggugaucccauuccug

SEQ ID NO: 1299505 - RNA, 19 nt, Human
ugagggaccacccagcagg

SEQ ID NO: 1299506 - RNA, 24 nt, Human
ugccccagaggcuugggguucagc

SEQ ID NO: 1299507 - RNA, 18 nt, Human
uggcucugguggcuccac

SEQ ID NO: 1299508 - RNA, 24 nt, Human
uggcucugguggcuccacguucug

SEQ ID NO: 1299509 - RNA, 22 nt, Human
uggcugguggggacaucaaagu

SEQ ID NO: 1299510 - RNA, 18 nt, Human
uggguccccagcacaguc

SEQ ID NO: 1299511 - RNA, 22 nt, Human
uggguccccagcacagucuugg

SEQ ID NO: 1299512 - RNA, 19 nt, Human
uguguacaguagccaugug

SEQ ID NO: 1299513 - RNA, 19 nt, Human
uguucccauccccagaauc

SEQ ID NO: 1299514 - RNA, 20 nt, Human
uucauggaaggggcagggag

SEQ ID NO: 1299515 - RNA, 23 nt, Human
uucauggaaggggcagggaggcu

SEQ ID NO: 1299516 - RNA, 23 nt, Human
uuugacccauuuuuauagaaagc

SEQ ID NO: 1299517 - RNA, 24 nt, Human
aggcccacaggaguagaggggcug

SEQ ID NO: 1299518 - RNA, 21 nt, Human
aguagaggggcugcagcugau

SEQ ID NO: 1299519 - RNA, 21 nt, Human
cagaguaagggcuccagagac

SEQ ID NO: 1299520 - RNA, 20 nt, Human
ccugaggcuccuucacucua

SEQ ID NO: 1299521 - RNA, 18 nt, Human
gaggcccacaggaguaga

SEQ ID NO: 1299522 - RNA, 22 nt, Human
gagugaccugaggcuccuucac

SEQ ID NO: 1299523 - RNA, 25 nt, Human
uagaagaagauagucucugaggccc

SEQ ID NO: 1299524 - RNA, 20 nt, Human
ucaaacaggugauaacaagc

SEQ ID NO: 1299525 - RNA, 19 nt, Human
ugaccugaggcuccuucac

SEQ ID NO: 1299526 - RNA, 23 nt, Human
ugagagggaaagagagcucaaac

SEQ ID NO: 1299527 - RNA, 23 nt, Human
uuccuucuagaagaagauagucu

SEQ ID NO: 1299528 - RNA, 24 nt, Human
agccccugagcucuguccaagcag

SEQ ID NO: 1299529 - RNA, 19 nt, Human
agcucuguccaagcagcag

SEQ ID NO: 1299530 - RNA, 20 nt, Human
aggaagguuugcaccaggac

SEQ ID NO: 1299531 - RNA, 25 nt, Human
caagcagcagcaguucccaacagag

SEQ ID NO: 1299532 - RNA, 25 nt, Human
cagcaguucccaacagagcucuggu

SEQ ID NO: 1299533 - RNA, 20 nt, Human
ccggacagccagggcugggc

SEQ ID NO: 1299534 - RNA, 18 nt, Human
cucugagccccugagcuc

SEQ ID NO: 1299535 - RNA, 23 nt, Human
cucugcucugagccccugagcuc

SEQ ID NO: 1299536 - RNA, 18 nt, Human
cuguguuuccaacucugc

SEQ ID NO: 1299537 - RNA, 22 nt, Human
gcagcagcaguucccaacagag

SEQ ID NO: 1299538 - RNA, 22 nt, Human
gcucuguccaagcagcagcagu

SEQ ID NO: 1299539 - RNA, 19 nt, Human
ggucccggaaagccggaca

SEQ ID NO: 1299540 - RNA, 19 nt, Human
guucccaacagagcucugg

SEQ ID NO: 1299541 - RNA, 20 nt, Human
ugagccccugagcucugucc

SEQ ID NO: 1299542 - RNA, 22 nt, Human
ugagccccugagcucuguccaa

SEQ ID NO: 1299543 - RNA, 23 nt, Human
ugcacuguguuuccaacucugcu

SEQ ID NO: 1299544 - RNA, 18 nt, Human
ugcucugagccccugagc

SEQ ID NO: 1299545 - RNA, 19 nt, Human
uugcacuguguuuccaacu

SEQ ID NO: 1299546 - RNA, 23 nt, Human
caucccccauccgcaccguagaa

SEQ ID NO: 1299547 - RNA, 18 nt, Human
ccauccgcaccguagaac

SEQ ID NO: 1299548 - RNA, 23 nt, Human
cugccccaucccccauccgcacc

SEQ ID NO: 1299549 - RNA, 26 nt, Human
cugccccaucccccauccgcaccgua

SEQ ID NO: 1299550 - RNA, 18 nt, Human
ugccccaucccccauccg

SEQ ID NO: 1299551 - RNA, 19 nt, Human
aaaaaacuuuacaaggaca

SEQ ID NO: 1299552 - RNA, 21 nt, Human
aaaaaacuuuacaaggacagu

SEQ ID NO: 1299553 - RNA, 22 nt, Human
aaaaaggagccaaaugguauca

SEQ ID NO: 1299554 - RNA, 19 nt, Human
aaacucccaaaagaccccg

SEQ ID NO: 1299555 - RNA, 20 nt, Human
aaacucccaaaagaccccgg

SEQ ID NO: 1299556 - RNA, 24 nt, Human
aaacuuuacaaggacagugacugu

SEQ ID NO: 1299557 - RNA, 20 nt, Human
aaagggucucucuaccuaca

SEQ ID NO: 1299558 - RNA, 20 nt, Human
aagaugcccagaguccguag

SEQ ID NO: 1299559 - RNA, 18 nt, Human
acucccucugugaccuug

SEQ ID NO: 1299560 - RNA, 20 nt, Human
agccagggcugcgcggaagc

SEQ ID NO: 1299561 - RNA, 23 nt, Human
aggaguuucuuccugcaggaccu

SEQ ID NO: 1299562 - RNA, 23 nt, Human
agggauggggccgggaauccauu

SEQ ID NO: 1299563 - RNA, 20 nt, Human
aguuucuuccugcaggaccu

SEQ ID NO: 1299564 - RNA, 21 nt, Human
caaacucuggaugagggcugg

SEQ ID NO: 1299565 - RNA, 23 nt, Human
caaacucuggaugagggcugggg

SEQ ID NO: 1299566 - RNA, 23 nt, Human
caagggaaaaaggacgggggagg

SEQ ID NO: 1299567 - RNA, 24 nt, Human
cacugccugccuggaacggccacu

SEQ ID NO: 1299568 - RNA, 20 nt, Human
caguggaaagaugcccagag

SEQ ID NO: 1299569 - RNA, 18 nt, Human
ccaaaagaccccggagua

SEQ ID NO: 1299570 - RNA, 20 nt, Human
cccaaaagaccccggaguac

SEQ ID NO: 1299571 - RNA, 23 nt, Human
ccccggaguacgucggaggugag

SEQ ID NO: 1299572 - RNA, 25 nt, Human
ccuuggcugaaccaagaccgggguc

SEQ ID NO: 1299573 - RNA, 20 nt, Human
cgacaauagcaaucuuuucc

SEQ ID NO: 1299574 - RNA, 19 nt, Human
cgggggaggcaugcaagag

SEQ ID NO: 1299575 - RNA, 21 nt, Human
cuacucggcugcaaacucugg

SEQ ID NO: 1299576 - RNA, 21 nt, Human
gaauccauucaggaaagcugg

SEQ ID NO: 1299577 - RNA, 18 nt, Human
gacagugacuguucugcc

SEQ ID NO: 1299578 - RNA, 23 nt, Human
gaggugaguacgacaauagcaau

SEQ ID NO: 1299579 - RNA, 18 nt, Human
gcaguggaaagaugccca

SEQ ID NO: 1299580 - RNA, 20 nt, Human
gcugaaccaagacgacacug

SEQ ID NO: 1299581 - RNA, 20 nt, Human
ggaagcuaucacucccucug

SEQ ID NO: 1299582 - RNA, 21 nt, Human
gggcuggggauugagagcuuc

SEQ ID NO: 1299583 - RNA, 21 nt, Human
ggggauugagagcuucccaga

SEQ ID NO: 1299584 - RNA, 27 nt, Human
gugaguacgacaauagcaaucuuuucc

SEQ ID NO: 1299585 - RNA, 22 nt, Human
uagccagggcugcgcggaagcu

SEQ ID NO: 1299586 - RNA, 25 nt, Human
uccguagccagggcugcgcggaagc

SEQ ID NO: 1299587 - RNA, 18 nt, Human
ucuggaugagggcugggg

SEQ ID NO: 1299588 - RNA, 23 nt, Human
ugagggauggggccgggaaucca

SEQ ID NO: 1299589 - RNA, 24 nt, Human
ugagggauggggccgggaauccau

SEQ ID NO: 1299590 - RNA, 22 nt, Human
ugccccagaggaaaaacgaucc

SEQ ID NO: 1299591 - RNA, 19 nt, Human
uggcaagggaaaaaggacg

SEQ ID NO: 1299592 - RNA, 19 nt, Human
uggcaagggaaaaaggacg

SEQ ID NO: 1299593 - RNA, 20 nt, Human
uggcugaaccaagacgacac

SEQ ID NO: 1299594 - RNA, 31 nt, Human
ugucaccagggaacuggcaagggaaaaaggg

SEQ ID NO: 1299595 - RNA, 21 nt, Human
uuggcugaaccaagacgacac

SEQ ID NO: 1299596 - RNA, 23 nt, Human
uuucuuccugcaggaccuggauu

SEQ ID NO: 1299597 - RNA, 18 nt, Human
aaccaggcaaggcuggca

SEQ ID NO: 1299598 - RNA, 22 nt, Human
aaugcacucgaaacacguuuaa

SEQ ID NO: 1299599 - RNA, 18 nt, Human
acacaaaucgagcaaaua

SEQ ID NO: 1299600 - RNA, 18 nt, Human
agcaagaaggcgagaacc

SEQ ID NO: 1299601 - RNA, 21 nt, Human
agcaggacaaacccaaaccca

SEQ ID NO: 1299602 - RNA, 18 nt, Human
aggaagagcaagaaggcg

SEQ ID NO: 1299603 - RNA, 25 nt, Human
aggcaggaaggugagcagacuccag

SEQ ID NO: 1299604 - RNA, 20 nt, Human
aggggcuugaggcaggaagg

SEQ ID NO: 1299605 - RNA, 26 nt, Human
agguggcucaggggacaggacagagg

SEQ ID NO: 1299606 - RNA, 19 nt, Human
auagauugugagcuuuaca

SEQ ID NO: 1299607 - RNA, 19 nt, Human
aucugauguccucccucca

SEQ ID NO: 1299608 - RNA, 22 nt, Human
aucugauguccucccuccaccc

SEQ ID NO: 1299609 - RNA, 19 nt, Human
auggagacaaggcgucugc

SEQ ID NO: 1299610 - RNA, 19 nt, Human
caaacccaaacccaucucc

SEQ ID NO: 1299611 - RNA, 20 nt, Human
caaaucgagcaaauaugacu

SEQ ID NO: 1299612 - RNA, 22 nt, Human
cacagcaggacaaacccaaacc

SEQ ID NO: 1299613 - RNA, 26 nt, Human
cacagcaggacaaacccaaacccauc

SEQ ID NO: 1299614 - RNA, 23 nt, Human
caccugaccugagaguggcgggc

SEQ ID NO: 1299615 - RNA, 21 nt, Human
cagacuccagaguucaagaga

SEQ ID NO: 1299616 - RNA, 18 nt, Human
cagagcacagcaggacaa

SEQ ID NO: 1299617 - RNA, 27 nt, Human
cagcaagcugcuuccucgacgaugccu

SEQ ID NO: 1299618 - RNA, 19 nt, Human
cagcaggacaaacccaaac

SEQ ID NO: 1299619 - RNA, 21 nt, Human
cagcaggacaaacccaaaccc

SEQ ID NO: 1299620 - RNA, 21 nt, Human
cuccacccguaacuccccuga

SEQ ID NO: 1299621 - RNA, 22 nt, Human
cuggaccacgugggagaggggc

SEQ ID NO: 1299622 - RNA, 19 nt, Human
cugggcacuugaccaggug

SEQ ID NO: 1299623 - RNA, 18 nt, Human
cuggggaggcuggagucc

SEQ ID NO: 1299624 - RNA, 21 nt, Human
gagaaccaaguguucaggaac

SEQ ID NO: 1299625 - RNA, 24 nt, Human
gcacagcaggacaaacccaaaccc

SEQ ID NO: 1299626 - RNA, 18 nt, Human
ggagaggggcuugaggca

SEQ ID NO: 1299627 - RNA, 19 nt, Human
ggagcagagcacagcagga

SEQ ID NO: 1299628 - RNA, 22 nt, Human
guccucccuccacccguaacuc

SEQ ID NO: 1299629 - RNA, 19 nt, Human
guggcucaggggacaggac

SEQ ID NO: 1299630 - RNA, 22 nt, Human
uaaaagaguagauauggagaca

SEQ ID NO: 1299631 - RNA, 21 nt, Human
uaagaaaauccccagcagcug

SEQ ID NO: 1299632 - RNA, 23 nt, Human
uacaagaaugggaagaaauuauc

SEQ ID NO: 1299633 - RNA, 22 nt, Human
uaccuggaagauacucuuuaac

SEQ ID NO: 1299634 - RNA, 24 nt, Human
uccacccguaacuccccugaaauc

SEQ ID NO: 1299635 - RNA, 23 nt, Human
ucccucugauuaaacaggaguug

SEQ ID NO: 1299636 - RNA, 25 nt, Human
ucugcaggcacacgagagucgcugg

SEQ ID NO: 1299637 - RNA, 18 nt, Human
ugagauggaauuuaaaau

SEQ ID NO: 1299638 - RNA, 20 nt, Human
uggcucaggggacaggacag

SEQ ID NO: 1299639 - RNA, 25 nt, Human
uguggccaguauugagaaccaagug

SEQ ID NO: 1299640 - RNA, 21 nt, Human
uguggcuguggccaguauuga

SEQ ID NO: 1299641 - RNA, 21 nt, Human
uuccucgacgaugccuuugau

SEQ ID NO: 1299642 - RNA, 20 nt, Human
aaagaucuaaaagcugagga

SEQ ID NO: 1299643 - RNA, 21 nt, Human
aacacugcauucaagagugaa

SEQ ID NO: 1299644 - RNA, 28 nt, Human
auuuuucuuucuuuuuuuuuuuuuuuuu

SEQ ID NO: 1299645 - RNA, 20 nt, Human
caccuacugcuucuuccucu

SEQ ID NO: 1299646 - RNA, 23 nt, Human
cagaaggauaaagcuuugcggug

SEQ ID NO: 1299647 - RNA, 18 nt, Human
cagcuccaguuggaauga

SEQ ID NO: 1299648 - RNA, 23 nt, Human
cauaaagaucuaaaagcugagga

SEQ ID NO: 1299649 - RNA, 19 nt, Human
ccucccgucacugaugcug

SEQ ID NO: 1299650 - RNA, 23 nt, Human
ccuugcaaaugaauuuuucuuuc

SEQ ID NO: 1299651 - RNA, 18 nt, Human
uaaagaucuaaaagcuga

SEQ ID NO: 1299652 - RNA, 18 nt, Human
ucccgucacugaugcugg

SEQ ID NO: 1299653 - RNA, 21 nt, Human
ucugcgaggcggaaucaaguc

SEQ ID NO: 1299654 - RNA, 18 nt, Human
ucuuuuuuuuuuuuuuuu

SEQ ID NO: 1299655 - RNA, 23 nt, Human
ugaauucuugaaacacugcauuc

SEQ ID NO: 1299656 - RNA, 22 nt, Human
ugagacggaaucuugcucuguc

SEQ ID NO: 1299657 - RNA, 19 nt, Human
uggaaugacuggggguguc

SEQ ID NO: 1299658 - RNA, 21 nt, Human
uuccuuuuugggggcugccuu

SEQ ID NO: 1299659 - RNA, 29 nt, Human
uucuuucuuuuuuuuuuuuuuuuugagaa

SEQ ID NO: 1299660 - RNA, 24 nt, Human
uuucuuuuuuuuuuuuuuuuuggg

SEQ ID NO: 1299661 - RNA, 21 nt, Human
uuuuugggggcugccuuuagu

SEQ ID NO: 1299662 - RNA, 24 nt, Human
uuuuuuuuuuuugagacggaaucu

SEQ ID NO: 1299663 - RNA, 22 nt, Human
uuuuuuuuuuuuuugagacgga

SEQ ID NO: 1299664 - RNA, 23 nt, Human
aaagcuccaugagggugacaugg

SEQ ID NO: 1299665 - RNA, 20 nt, Human
acaugguggaaccccaauuc

SEQ ID NO: 1299666 - RNA, 22 nt, Human
accggugggggcggagccgcgu

SEQ ID NO: 1299667 - RNA, 18 nt, Human
cacccugaaggcggaucc

SEQ ID NO: 1299668 - RNA, 21 nt, Human
ccaaacaaggcuaacgaaagc

SEQ ID NO: 1299669 - RNA, 23 nt, Human
ccccaauucacccugaaggcgga

SEQ ID NO: 1299670 - RNA, 19 nt, Human
ccccuuuguaucccaaaca

SEQ ID NO: 1299671 - RNA, 23 nt, Human
ccgcagggcugaucucuccagcu

SEQ ID NO: 1299672 - RNA, 18 nt, Human
cgagaggcuggcggugga

SEQ ID NO: 1299673 - RNA, 22 nt, Human
cuccagcugggcugggcuuugg

SEQ ID NO: 1299674 - RNA, 18 nt, Human
cugaucucuccagcuggg

SEQ ID NO: 1299675 - RNA, 21 nt, Human
gcugggcugggcuuuggggac

SEQ ID NO: 1299676 - RNA, 19 nt, Human
ggaaauccuguucacuggc

SEQ ID NO: 1299677 - RNA, 22 nt, Human
ggggagggcgucgggggucggg

SEQ ID NO: 1299678 - RNA, 21 nt, Human
gggugacaugguggaacccca

SEQ ID NO: 1299679 - RNA, 18 nt, Human
ggugacaugguggaaccc

SEQ ID NO: 1299680 - RNA, 18 nt, Human
ggugcccgcagccggccu

SEQ ID NO: 1299681 - RNA, 19 nt, Human
gugcccgcagccggccucg

SEQ ID NO: 1299682 - RNA, 20 nt, Human
guggagugcgcggcaggacc

SEQ ID NO: 1299683 - RNA, 22 nt, Human
ucacuggcucuugaucuuucuc

SEQ ID NO: 1299684 - RNA, 23 nt, Human
ucccuggcugggaaauccuguuc

SEQ ID NO: 1299685 - RNA, 22 nt, Human
ucuccuaauuaccggugggggc

SEQ ID NO: 1299686 - RNA, 18 nt, Human
ugacaugguggaacccca

SEQ ID NO: 1299687 - RNA, 22 nt, Human
ugacaugguggaaccccaauuc

SEQ ID NO: 1299688 - RNA, 24 nt, Human
uggaaccccaauucacccugaagg

SEQ ID NO: 1299689 - RNA, 21 nt, Human
ugggaaauccuguucacuggc

SEQ ID NO: 1299690 - RNA, 22 nt, Human
ugggggcggagccgcgucucca

SEQ ID NO: 1299691 - RNA, 22 nt, Human
uugaaaaucuccuaauuaccgg

SEQ ID NO: 1299692 - RNA, 19 nt, Human
uugcaggugcccgcagccg

SEQ ID NO: 1299693 - RNA, 21 nt, Human
agaccgcggggcagaugggac

SEQ ID NO: 1299694 - RNA, 21 nt, Human
aggcaggcacacaggagaagg

SEQ ID NO: 1299695 - RNA, 23 nt, Human
agggggcugaggguggagaggcc

SEQ ID NO: 1299696 - RNA, 21 nt, Human
cagaugggaccgcugccuccc

SEQ ID NO: 1299697 - RNA, 23 nt, Human
caggcacacaggagaagggcugg

SEQ ID NO: 1299698 - RNA, 23 nt, Human
ccgcugccucccugccuccuggg

SEQ ID NO: 1299699 - RNA, 24 nt, Human
cgaagggacugaagcagggggcug

SEQ ID NO: 1299700 - RNA, 19 nt, Human
gaccgcugccucccugccu

SEQ ID NO: 1299701 - RNA, 18 nt, Human
gcagaugggaccgcugcc

SEQ ID NO: 1299702 - RNA, 24 nt, Human
guggcggcggcaggaggcaggcac

SEQ ID NO: 1299703 - RNA, 21 nt, Human
ugaagcagggggcugagggug

SEQ ID NO: 1299704 - RNA, 21 nt, Human
cagggugcuccaggaggucaa

SEQ ID NO: 1299705 - RNA, 22 nt, Human
agugcugcuauaaauauucuuc

SEQ ID NO: 1299706 - RNA, 21 nt, Human
ccugaaggcaccucucuguga

SEQ ID NO: 1299707 - RNA, 20 nt, Human
ucugaguggcuucccagcuu

SEQ ID NO: 1299708 - RNA, 25 nt, Human
ucuucuaaaugucuucuggugaaca

SEQ ID NO: 1299709 - RNA, 19 nt, Human
uggugaacaucugccaguu

SEQ ID NO: 1299710 - RNA, 19 nt, Human
uucuggugaacaucugcca

SEQ ID NO: 1299711 - RNA, 21 nt, Human
cagaauguccaagaagagccc

SEQ ID NO: 1299712 - RNA, 18 nt, Human
cagugcucucgguauuug

SEQ ID NO: 1299713 - RNA, 24 nt, Human
ccccagggacuccagaauguccaa

SEQ ID NO: 1299714 - RNA, 20 nt, Human
cuccagaauguccaagaaga

SEQ ID NO: 1299715 - RNA, 19 nt, Human
ugagcuucagacuucccuu

SEQ ID NO: 1299716 - RNA, 23 nt, Human
ugcagugcucucgguauuuguua

SEQ ID NO: 1299717 - RNA, 20 nt, Human
aauuugcagacgaacuccuu

SEQ ID NO: 1299718 - RNA, 19 nt, Human
acucaagcuggggaugggc

SEQ ID NO: 1299719 - RNA, 19 nt, Human
aggcucgaggggauggcag

SEQ ID NO: 1299720 - RNA, 21 nt, Human
caccucucuuccuuccugugu

SEQ ID NO: 1299721 - RNA, 22 nt, Human
caccucucuuccuuccuguguu

SEQ ID NO: 1299722 - RNA, 20 nt, Human
caggcucgaggggauggcag

SEQ ID NO: 1299723 - RNA, 21 nt, Human
cugcaccucucuuccuuccug

SEQ ID NO: 1299724 - RNA, 24 nt, Human
cuuugagauguucccauagacuga

SEQ ID NO: 1299725 - RNA, 23 nt, Human
ggcgagaaggcccagaacucaag

SEQ ID NO: 1299726 - RNA, 20 nt, Human
gugcugaggagggaggugag

SEQ ID NO: 1299727 - RNA, 22 nt, Human
uacaggcucgaggggauggcag

SEQ ID NO: 1299728 - RNA, 21 nt, Human
uagaauuugcagacgaacucc

SEQ ID NO: 1299729 - RNA, 19 nt, Human
ucccauagacugaggccgu

SEQ ID NO: 1299730 - RNA, 21 nt, Human
ugaggagggaggugagugagc

SEQ ID NO: 1299731 - RNA, 18 nt, Human
uggcgagaaggcccagaa

SEQ ID NO: 1299732 - RNA, 19 nt, Human
uggcgagaaggcccagaac

SEQ ID NO: 1299733 - RNA, 23 nt, Human
cugaagacgcucauucugaaaga

SEQ ID NO: 1299734 - RNA, 22 nt, Human
aaagcuuuugggccucagggag

SEQ ID NO: 1299735 - RNA, 23 nt, Human
acaagucugacacuuaaagcuuu

SEQ ID NO: 1299736 - RNA, 22 nt, Human
acgcagccucaggaaacguggg

SEQ ID NO: 1299737 - RNA, 23 nt, Human
agacagcaccaucucggggucca

SEQ ID NO: 1299738 - RNA, 21 nt, Human
aggcagacaaaggggucaaca

SEQ ID NO: 1299739 - RNA, 20 nt, Human
agggugcuuccacuggcuuu

SEQ ID NO: 1299740 - RNA, 21 nt, Human
aucuucuuccacacagaguuc

SEQ ID NO: 1299741 - RNA, 22 nt, Human
auggagcccuguucaucuggag

SEQ ID NO: 1299742 - RNA, 22 nt, Human
cacauggauccgcuggcaugga

SEQ ID NO: 1299743 - RNA, 21 nt, Human
caccaagcaggagcgggcccc

SEQ ID NO: 1299744 - RNA, 20 nt, Human
cagacaaaggggucaacaug

SEQ ID NO: 1299745 - RNA, 19 nt, Human
cagccccagggaggucagg

SEQ ID NO: 1299746 - RNA, 21 nt, Human
cagccucaggaaacguggggg

SEQ ID NO: 1299747 - RNA, 18 nt, Human
cccccggagggugcuucc

SEQ ID NO: 1299748 - RNA, 20 nt, Human
ccccucccucacauggaucc

SEQ ID NO: 1299749 - RNA, 23 nt, Human
cccucugaucuucaucuucuucc

SEQ ID NO: 1299750 - RNA, 21 nt, Human
ccuccaagacuuccccgcaag

SEQ ID NO: 1299751 - RNA, 25 nt, Human
ccuccaagacuuccccgcaaguggg

SEQ ID NO: 1299752 - RNA, 25 nt, Human
cgcaagugggcccagggaacacuag

SEQ ID NO: 1299753 - RNA, 20 nt, Human
cguccagaacgugucuuuac

SEQ ID NO: 1299754 - RNA, 18 nt, Human
cuuugcagggaccaccug

SEQ ID NO: 1299755 - RNA, 19 nt, Human
gagggugcuuccacuggcu

SEQ ID NO: 1299756 - RNA, 18 nt, Human
gccucaggaaacgugggg

SEQ ID NO: 1299757 - RNA, 20 nt, Human
ggagggugcuuccacuggcu

SEQ ID NO: 1299758 - RNA, 19 nt, Human
ggccccucccucacaugga

SEQ ID NO: 1299759 - RNA, 21 nt, Human
ggcggugauaucugcgagcac

SEQ ID NO: 1299760 - RNA, 21 nt, Human
gucgggccaguccccccuucc

SEQ ID NO: 1299761 - RNA, 22 nt, Human
guucaucuggagccuugggggc

SEQ ID NO: 1299762 - RNA, 21 nt, Human
uaaaaugucgggccagucccc

SEQ ID NO: 1299763 - RNA, 22 nt, Human
ucacauggauccgcuggcaugg

SEQ ID NO: 1299764 - RNA, 18 nt, Human
ucagaaucugacagauga

SEQ ID NO: 1299765 - RNA, 20 nt, Human
ucccucugaucuucaucuuc

SEQ ID NO: 1299766 - RNA, 22 nt, Human
uccgcuggcauggacagcccca

SEQ ID NO: 1299767 - RNA, 23 nt, Human
ucucuguacaaaccccugagcag

SEQ ID NO: 1299768 - RNA, 20 nt, Human
ucugcgagcaccugucuuca

SEQ ID NO: 1299769 - RNA, 18 nt, Human
ugacagaugaccauccgc

SEQ ID NO: 1299770 - RNA, 18 nt, Human
ugagcaggagguuggcau

SEQ ID NO: 1299771 - RNA, 21 nt, Human
ugccucucccucugaucuuca

SEQ ID NO: 1299772 - RNA, 22 nt, Human
uggagccuugggggcugggacu

SEQ ID NO: 1299773 - RNA, 20 nt, Human
ugggaugugcaucgguugga

SEQ ID NO: 1299774 - RNA, 19 nt, Human
ugggccucagggagcagcu

SEQ ID NO: 1299775 - RNA, 19 nt, Human
uggggggugggggcguggg

SEQ ID NO: 1299776 - RNA, 20 nt, Human
uggggggugggggcguggga

SEQ ID NO: 1299777 - RNA, 20 nt, Human
uucacugggcgguuccucca

SEQ ID NO: 1299778 - RNA, 19 nt, Human
uuccacacagaguucugag

SEQ ID NO: 1299779 - RNA, 26 nt, Human
uuccuccaggccagacgcagccucag

SEQ ID NO: 1299780 - RNA, 21 nt, Human
uucuuccacacagaguucuga

SEQ ID NO: 1299781 - RNA, 22 nt, Human
aagggaagaccguacagcgcga

SEQ ID NO: 1299782 - RNA, 19 nt, Human
agaaugaguggcagggaca

SEQ ID NO: 1299783 - RNA, 21 nt, Human
agaaugaguggcagggacagg

SEQ ID NO: 1299784 - RNA, 21 nt, Human
cgcagccaggguguggguggg

SEQ ID NO: 1299785 - RNA, 19 nt, Human
cgcgauggggaccagggcg

SEQ ID NO: 1299786 - RNA, 20 nt, Human
cgggagcugcgguucuuccu

SEQ ID NO: 1299787 - RNA, 23 nt, Human
gaccagggcggcgggccgcagcc

SEQ ID NO: 1299788 - RNA, 22 nt, Human
gcccucgguguuggaagggaag

SEQ ID NO: 1299789 - RNA, 21 nt, Human
gcugcgguucuuccuccuccg

SEQ ID NO: 1299790 - RNA, 23 nt, Human
ggagcugcgguucuuccuccucc

SEQ ID NO: 1299791 - RNA, 19 nt, Human
gggugugggugggcgacgg

SEQ ID NO: 1299792 - RNA, 22 nt, Human
uggaagggaagaccguacagcg

SEQ ID NO: 1299793 - RNA, 19 nt, Human
uggcagggacagggcggcc

SEQ ID NO: 1299794 - RNA, 19 nt, Human
uggcagggacagggcggcc

SEQ ID NO: 1299795 - RNA, 24 nt, Human
ugggugggcgacggucaaggugcc

SEQ ID NO: 1299796 - RNA, 20 nt, Human
uuccuccuccgcccucaccg

SEQ ID NO: 1299797 - RNA, 20 nt, Human
aaaccuugaauggccuggcg

SEQ ID NO: 1299798 - RNA, 19 nt, Human
acuggcuggcacagggagg

SEQ ID NO: 1299799 - RNA, 19 nt, Human
auggcuucugagucggacu

SEQ ID NO: 1299800 - RNA, 22 nt, Human
auucuguuuggaucugauauuu

SEQ ID NO: 1299801 - RNA, 25 nt, Human
ccuggggcugcugguuucuugccuu

SEQ ID NO: 1299802 - RNA, 23 nt, Human
cuggccuugcugcuuucccuggg

SEQ ID NO: 1299803 - RNA, 21 nt, Human
uaagggcugccggugggaacu

SEQ ID NO: 1299804 - RNA, 19 nt, Human
uacugggacaucccugagc

SEQ ID NO: 1299805 - RNA, 22 nt, Human
uagcaauuugccaaauggagca

SEQ ID NO: 1299806 - RNA, 22 nt, Human
ucccugagcugaauggcuucug

SEQ ID NO: 1299807 - RNA, 26 nt, Human
ucccugagcugaauggcuucugaguc

SEQ ID NO: 1299808 - RNA, 21 nt, Human
ucggacuggcuggcacaggga

SEQ ID NO: 1299809 - RNA, 20 nt, Human
ugaugugaagaugaagaguu

SEQ ID NO: 1299810 - RNA, 21 nt, Human
ugcuuuuuuuccuucuccuga

SEQ ID NO: 1299811 - RNA, 18 nt, Human
ugggaacaaggcaggugu

SEQ ID NO: 1299812 - RNA, 20 nt, Human
ugggacaucccugagcugaa

SEQ ID NO: 1299813 - RNA, 19 nt, Human
uguacugggacaucccuga

SEQ ID NO: 1299814 - RNA, 21 nt, Human
ugugcuuaagggcugccggug

SEQ ID NO: 1299815 - RNA, 20 nt, Human
uuucuugccuuugcugccgu

SEQ ID NO: 1299816 - RNA, 25 nt, Human
cagaggguuuuuccucuuguaacuu

SEQ ID NO: 1299817 - RNA, 20 nt, Human
cuuuucuucucucagcuuuc

SEQ ID NO: 1299818 - RNA, 21 nt, Human
cuuuucuucucucagcuuucu

SEQ ID NO: 1299819 - RNA, 23 nt, Human
gaggguuuuuccucuuguaacuu

SEQ ID NO: 1299820 - RNA, 20 nt, Human
uccccaggcuugcuuaauuu

SEQ ID NO: 1299821 - RNA, 23 nt, Human
ugaucuucagaggguuuuuccuc

SEQ ID NO: 1299822 - RNA, 24 nt, Human
uguuucuguauccucugguaacag

SEQ ID NO: 1299823 - RNA, 20 nt, Human
uucuucucucagcuuucuca

SEQ ID NO: 1299824 - RNA, 21 nt, Human
cccugggccggagaaagacuc

SEQ ID NO: 1299825 - RNA, 25 nt, Human
ccugggccggagaaagaccgggguc

SEQ ID NO: 1299826 - RNA, 21 nt, Human
gcgucgcuucagccuccgagg

SEQ ID NO: 1299827 - RNA, 23 nt, Human
ugccuccggcgucgcuucagccu

SEQ ID NO: 1299828 - RNA, 22 nt, Human
aaaaguacauaaagcccacaaa

SEQ ID NO: 1299829 - RNA, 20 nt, Human
aacauacuccaaauguaaga

SEQ ID NO: 1299830 - RNA, 22 nt, Human
acaaaaauuaugaugcagcccu

SEQ ID NO: 1299831 - RNA, 19 nt, Human
accucggacuucccagccu

SEQ ID NO: 1299832 - RNA, 20 nt, Human
agaaagaccaaauacauauu

SEQ ID NO: 1299833 - RNA, 22 nt, Human
agacgucugacccugcaccucc

SEQ ID NO: 1299834 - RNA, 22 nt, Human
agaguagcucacagaacucagg

SEQ ID NO: 1299835 - RNA, 22 nt, Human
agccacagcacaaaacauaguu

SEQ ID NO: 1299836 - RNA, 21 nt, Human
aggaaagggcuuuauuuacua

SEQ ID NO: 1299837 - RNA, 20 nt, Human
aggcaaaaguacauaaagcc

SEQ ID NO: 1299838 - RNA, 22 nt, Human
aggcaaaaguacauaaagccca

SEQ ID NO: 1299839 - RNA, 23 nt, Human
aggucccaaagguuuuaggagcu

SEQ ID NO: 1299840 - RNA, 19 nt, Human
auacacacacagacgucug

SEQ ID NO: 1299841 - RNA, 19 nt, Human
auauauauauauauauaua

SEQ ID NO: 1299842 - RNA, 19 nt, Human
auauauauauauauauaua

SEQ ID NO: 1299843 - RNA, 19 nt, Human
auauauauauauauauaua

SEQ ID NO: 1299844 - RNA, 19 nt, Human
auauauauauauauauaua

SEQ ID NO: 1299845 - RNA, 19 nt, Human
auauauauauauauauaua

SEQ ID NO: 1299846 - RNA, 19 nt, Human
auauauauauauauauaua

SEQ ID NO: 1299847 - RNA, 19 nt, Human
auauauauauauauauaua

SEQ ID NO: 1299848 - RNA, 19 nt, Human
auauauauauauauauaua

SEQ ID NO: 1299849 - RNA, 19 nt, Human
auauauauauauauauaua

SEQ ID NO: 1299850 - RNA, 19 nt, Human
auauauauauauauauaua

SEQ ID NO: 1299851 - RNA, 19 nt, Human
auauauauauauauauaua

SEQ ID NO: 1299852 - RNA, 19 nt, Human
auauauauauauauauaua

SEQ ID NO: 1299853 - RNA, 19 nt, Human
auauauauauauauauaua

SEQ ID NO: 1299854 - RNA, 19 nt, Human
auauauauauauauauaua

SEQ ID NO: 1299855 - RNA, 19 nt, Human
auauauauauauauauaua

SEQ ID NO: 1299856 - RNA, 19 nt, Human
auauauauauauauauaua

SEQ ID NO: 1299857 - RNA, 19 nt, Human
auauauauauauauauaua

SEQ ID NO: 1299858 - RNA, 19 nt, Human
auauauauauauauauaua

SEQ ID NO: 1299859 - RNA, 19 nt, Human
auauauauauauauauaua

SEQ ID NO: 1299860 - RNA, 19 nt, Human
auauauauauauauauaua

SEQ ID NO: 1299861 - RNA, 19 nt, Human
auauauauauauauauaua

SEQ ID NO: 1299862 - RNA, 19 nt, Human
auauauauauauauauaua

SEQ ID NO: 1299863 - RNA, 19 nt, Human
auauauauauauauauaua

SEQ ID NO: 1299864 - RNA, 19 nt, Human
auauauauauauauauaua

SEQ ID NO: 1299865 - RNA, 21 nt, Human
aucccuguucugucccugcca

SEQ ID NO: 1299866 - RNA, 20 nt, Human
auuuaggccuacugagcccc

SEQ ID NO: 1299867 - RNA, 21 nt, Human
caaaaguacauaaagcccaca

SEQ ID NO: 1299868 - RNA, 22 nt, Human
caaauguaagaaaauacagaga

SEQ ID NO: 1299869 - RNA, 19 nt, Human
caagagcaccuuugucacc

SEQ ID NO: 1299870 - RNA, 23 nt, Human
caagcugauaguacuaagaagca

SEQ ID NO: 1299871 - RNA, 20 nt, Human
caaugcagaagcucucugaa

SEQ ID NO: 1299872 - RNA, 18 nt, Human
cagaaccugagcaugcug

SEQ ID NO: 1299873 - RNA, 23 nt, Human
cagaacugugagaaauaaauuuc

SEQ ID NO: 1299874 - RNA, 22 nt, Human
cagccuccagaacugugagaaa

SEQ ID NO: 1299875 - RNA, 21 nt, Human
caggaacagguuugggggaag

SEQ ID NO: 1299876 - RNA, 23 nt, Human
caggaauaggaagaaagaccaaa

SEQ ID NO: 1299877 - RNA, 23 nt, Human
cagguuaagagcucagucccaua

SEQ ID NO: 1299878 - RNA, 20 nt, Human
cauacacauauauauguaca

SEQ ID NO: 1299879 - RNA, 22 nt, Human
cauauauacauacacauauaua

SEQ ID NO: 1299880 - RNA, 23 nt, Human
cauucacacucaacacugaacac

SEQ ID NO: 1299881 - RNA, 21 nt, Human
cauucgcguacuaccagacac

SEQ ID NO: 1299882 - RNA, 25 nt, Human
ccaaauguaagaaaauacagagaca

SEQ ID NO: 1299883 - RNA, 18 nt, Human
ccaagcugauaguacuaa

SEQ ID NO: 1299884 - RNA, 23 nt, Human
ccacuguaagguaugagccacag

SEQ ID NO: 1299885 - RNA, 21 nt, Human
cccaagcugauaguacuaaga

SEQ ID NO: 1299886 - RNA, 22 nt, Human
ccccaaggucugggaguggggc

SEQ ID NO: 1299887 - RNA, 22 nt, Human
cccccaacuucagacaccaguc

SEQ ID NO: 1299888 - RNA, 19 nt, Human
ccccucuuccuuccccaag

SEQ ID NO: 1299889 - RNA, 18 nt, Human
cccguggcaaccagaccc

SEQ ID NO: 1299890 - RNA, 23 nt, Human
ccuauucugaggccauucagaag

SEQ ID NO: 1299891 - RNA, 20 nt, Human
ccuccagaacugugagaaau

SEQ ID NO: 1299892 - RNA, 22 nt, Human
ccucuaaacacaugguugguuc

SEQ ID NO: 1299893 - RNA, 21 nt, Human
ccugaccucggacuucccagc

SEQ ID NO: 1299894 - RNA, 18 nt, Human
ccuuccccaaggucuggg

SEQ ID NO: 1299895 - RNA, 24 nt, Human
cgacucaaccuucagccccucuuc

SEQ ID NO: 1299896 - RNA, 18 nt, Human
cuaccacuguaagguaug

SEQ ID NO: 1299897 - RNA, 21 nt, Human
cuacugagccccucuccacca

SEQ ID NO: 1299898 - RNA, 18 nt, Human
cucaacacugaacacucc

SEQ ID NO: 1299899 - RNA, 28 nt, Human
cuguguguguguauauauauauaaugua

SEQ ID NO: 1299900 - RNA, 28 nt, Human
cuuccaggggaguauuuucaguauacaa

SEQ ID NO: 1299901 - RNA, 20 nt, Human
cuuugggcucaccacuccuc

SEQ ID NO: 1299902 - RNA, 19 nt, Human
gaaccugagcaugcuggca

SEQ ID NO: 1299903 - RNA, 23 nt, Human
gacaguguccccagaccuuuagc

SEQ ID NO: 1299904 - RNA, 18 nt, Human
gagcuuccacggccccuu

SEQ ID NO: 1299905 - RNA, 22 nt, Human
gcaaaaguacauaaagcccaca

SEQ ID NO: 1299906 - RNA, 18 nt, Human
gccagauggaggcacagg

SEQ ID NO: 1299907 - RNA, 22 nt, Human
ggagaugcacagagggaaaaug

SEQ ID NO: 1299908 - RNA, 24 nt, Human
gggaggucccaaagguuuuaggag

SEQ ID NO: 1299909 - RNA, 22 nt, Human
ggucccaaagguuuuaggagcu

SEQ ID NO: 1299910 - RNA, 21 nt, Human
gguuugggggaaggggcacgg

SEQ ID NO: 1299911 - RNA, 19 nt, Human
guauauauauauauauaua

SEQ ID NO: 1299912 - RNA, 19 nt, Human
guguauauauauauauaua

SEQ ID NO: 1299913 - RNA, 20 nt, Human
guguguauauauauauauau

SEQ ID NO: 1299914 - RNA, 25 nt, Human
uaaaaucagaagaaaauacauaaac

SEQ ID NO: 1299915 - RNA, 26 nt, Human
uaacccccaagcugauaguacuaaga

SEQ ID NO: 1299916 - RNA, 28 nt, Human
uaacucagaaacagccagauggaggcac

SEQ ID NO: 1299917 - RNA, 20 nt, Human
uaagagacauagacuaccac

SEQ ID NO: 1299918 - RNA, 19 nt, Human
uaagcacugugccuaagga

SEQ ID NO: 1299919 - RNA, 20 nt, Human
uaagcacugugccuaaggac

SEQ ID NO: 1299920 - RNA, 19 nt, Human
uaagguaugagccacagca

SEQ ID NO: 1299921 - RNA, 20 nt, Human
uacauacacauauauaugua

SEQ ID NO: 1299922 - RNA, 22 nt, Human
uacauacacauauauauguaca

SEQ ID NO: 1299923 - RNA, 21 nt, Human
uacguagaaaaaacaaaccuu

SEQ ID NO: 1299924 - RNA, 27 nt, Human
uaguagcccaaacgcacuaagacauac

SEQ ID NO: 1299925 - RNA, 18 nt, Human
uauaaauauauauuucug

SEQ ID NO: 1299926 - RNA, 22 nt, Human
uauacauacacauauauaugua

SEQ ID NO: 1299927 - RNA, 23 nt, Human
uauacauacacauauauauguac

SEQ ID NO: 1299928 - RNA, 25 nt, Human
uauacauacacauauauauguacau

SEQ ID NO: 1299929 - RNA, 24 nt, Human
uauauacauacacauauauaugua

SEQ ID NO: 1299930 - RNA, 19 nt, Human
uauauauauauauauauau

SEQ ID NO: 1299931 - RNA, 19 nt, Human
uauauauauauauauauau

SEQ ID NO: 1299932 - RNA, 19 nt, Human
uauauauauauauauauau

SEQ ID NO: 1299933 - RNA, 19 nt, Human
uauauauauauauauauau

SEQ ID NO: 1299934 - RNA, 19 nt, Human
uauauauauauauauauau

SEQ ID NO: 1299935 - RNA, 19 nt, Human
uauauauauauauauauau

SEQ ID NO: 1299936 - RNA, 19 nt, Human
uauauauauauauauauau

SEQ ID NO: 1299937 - RNA, 19 nt, Human
uauauauauauauauauau

SEQ ID NO: 1299938 - RNA, 19 nt, Human
uauauauauauauauauau

SEQ ID NO: 1299939 - RNA, 19 nt, Human
uauauauauauauauauau

SEQ ID NO: 1299940 - RNA, 19 nt, Human
uauauauauauauauauau

SEQ ID NO: 1299941 - RNA, 19 nt, Human
uauauauauauauauauau

SEQ ID NO: 1299942 - RNA, 19 nt, Human
uauauauauauauauauau

SEQ ID NO: 1299943 - RNA, 19 nt, Human
uauauauauauauauauau

SEQ ID NO: 1299944 - RNA, 19 nt, Human
uauauauauauauauauau

SEQ ID NO: 1299945 - RNA, 19 nt, Human
uauauauauauauauauau

SEQ ID NO: 1299946 - RNA, 24 nt, Human
uauauuucuguguguguguauaua

SEQ ID NO: 1299947 - RNA, 22 nt, Human
uaucaucagucuauuauaaaau

SEQ ID NO: 1299948 - RNA, 21 nt, Human
uaugagccacagcacaaaaca

SEQ ID NO: 1299949 - RNA, 18 nt, Human
uauguacauacuaacaug

SEQ ID NO: 1299950 - RNA, 18 nt, Human
uauguacauauauacaua

SEQ ID NO: 1299951 - RNA, 24 nt, Human
uauucugaaaacucuacccccuca

SEQ ID NO: 1299952 - RNA, 24 nt, Human
ucaguuugccaucauguuucauga

SEQ ID NO: 1299953 - RNA, 18 nt, Human
ucauauucuugcaacuug

SEQ ID NO: 1299954 - RNA, 23 nt, Human
uccacaauuucauacauccuuaa

SEQ ID NO: 1299955 - RNA, 19 nt, Human
uccccaaggucugggagug

SEQ ID NO: 1299956 - RNA, 21 nt, Human
uccccagcagguuaagagcuc

SEQ ID NO: 1299957 - RNA, 23 nt, Human
ucccuaaucccuguucugucccc

SEQ ID NO: 1299958 - RNA, 23 nt, Human
ucccuaaucccuguucugucccu

SEQ ID NO: 1299959 - RNA, 22 nt, Human
ucccugccacauacacacacag

SEQ ID NO: 1299960 - RNA, 23 nt, Human
ucccugccacauacacacacaga

SEQ ID NO: 1299961 - RNA, 21 nt, Human
uccuugccaccaacugugugg

SEQ ID NO: 1299962 - RNA, 18 nt, Human
ucugacguggcuacaaag

SEQ ID NO: 1299963 - RNA, 19 nt, Human
ucuuguaaacauacuccaa

SEQ ID NO: 1299964 - RNA, 20 nt, Human
ugagaacugagaucuucaga

SEQ ID NO: 1299965 - RNA, 25 nt, Human
ugagaagucagcaagcaguuugcaa

SEQ ID NO: 1299966 - RNA, 22 nt, Human
ugagcaugccacucaacaccau

SEQ ID NO: 1299967 - RNA, 21 nt, Human
ugccaguacugcuuuggacag

SEQ ID NO: 1299968 - RNA, 25 nt, Human
ugcuagaguagcucacagaacucag

SEQ ID NO: 1299969 - RNA, 22 nt, Human
uggaaaauugcucucaccagaa

SEQ ID NO: 1299970 - RNA, 20 nt, Human
uggacaguguccccagaccu

SEQ ID NO: 1299971 - RNA, 19 nt, Human
uggagaugcacagagggaa

SEQ ID NO: 1299972 - RNA, 20 nt, Human
uggagaugcacagagggaaa

SEQ ID NO: 1299973 - RNA, 19 nt, Human
ugggaggucccaaagguuu

SEQ ID NO: 1299974 - RNA, 18 nt, Human
uguauauauauauauaua

SEQ ID NO: 1299975 - RNA, 22 nt, Human
uguauauauauauauauauaua

SEQ ID NO: 1299976 - RNA, 18 nt, Human
uguguauauauauauaua

SEQ ID NO: 1299977 - RNA, 20 nt, Human
uguguauauauauauauaua

SEQ ID NO: 1299978 - RNA, 20 nt, Human
uguguauauauauauauaua

SEQ ID NO: 1299979 - RNA, 22 nt, Human
uguguauauauauauauauaua

SEQ ID NO: 1299980 - RNA, 18 nt, Human
uguguguauauauauaua

SEQ ID NO: 1299981 - RNA, 24 nt, Human
uguguguauauauauauauauaac

SEQ ID NO: 1299982 - RNA, 18 nt, Human
uguguguguauauauaua

SEQ ID NO: 1299983 - RNA, 24 nt, Human
uguguguguauauauauauauaau

SEQ ID NO: 1299984 - RNA, 23 nt, Human
uguguguguguauauauauauau

SEQ ID NO: 1299985 - RNA, 24 nt, Human
uuagguaucauauucuugcaacuu

SEQ ID NO: 1299986 - RNA, 30 nt, Human
uuauguacauauauacauacacauauauag

SEQ ID NO: 1299987 - RNA, 18 nt, Human
uucaccuuuuaucaaugc

SEQ ID NO: 1299988 - RNA, 23 nt, Human
uuccacuugagagcuucaaagca

SEQ ID NO: 1299989 - RNA, 20 nt, Human
uucccaugauuuccuucuca

SEQ ID NO: 1299990 - RNA, 23 nt, Human
uucccguggcaaccagacccuau

SEQ ID NO: 1299991 - RNA, 22 nt, Human
uugcauuauuucugauaaaugu

SEQ ID NO: 1299992 - RNA, 22 nt, Human
uuuagguugaagaaaaugcuaa

SEQ ID NO: 1299993 - RNA, 24 nt, Human
uuuaugggaagcuuuauucuuagg

SEQ ID NO: 1299994 - RNA, 20 nt, Human
uuugcaaccuggaaaauugc

SEQ ID NO: 1299995 - RNA, 18 nt, Human
uuugcacuuuccaccaug

SEQ ID NO: 1299996 - RNA, 26 nt, Human
aucuuccuccaggcccucuaguguca

SEQ ID NO: 1299997 - RNA, 20 nt, Human
uccuccaggcccucuagugu

SEQ ID NO: 1299998 - RNA, 20 nt, Human
ucggacccccgcugucggug

SEQ ID NO: 1299999 - RNA, 23 nt, Human
ucugauggguuuauuuuaugaug

SEQ ID NO: 1300000 - RNA, 25 nt, Human
aagagaccacagguaggcaguggga

SEQ ID NO: 1300001 - RNA, 24 nt, Human
agaccaguguugagggaagucagg

SEQ ID NO: 1300002 - RNA, 20 nt, Human
agagaccacagguaggcaug

SEQ ID NO: 1300003 - RNA, 23 nt, Human
agggaccuaugcugcucaaggcc

SEQ ID NO: 1300004 - RNA, 19 nt, Human
agucagggaccccaaacgg

SEQ ID NO: 1300005 - RNA, 23 nt, Human
caaggcucaguggaagagaccag

SEQ ID NO: 1300006 - RNA, 24 nt, Human
gagggaccuaugcugcucaaggcc

SEQ ID NO: 1300007 - RNA, 21 nt, Human
ggaagucaucuucugcaaggg

SEQ ID NO: 1300008 - RNA, 20 nt, Human
gguguccaagagaccacagg

SEQ ID NO: 1300009 - RNA, 22 nt, Human
uaacauucacucccagaagagu

SEQ ID NO: 1300010 - RNA, 26 nt, Human
uccaagagaccacagguaggcaugga

SEQ ID NO: 1300011 - RNA, 18 nt, Human
ugaggaggcuuuuugucu

SEQ ID NO: 1300012 - RNA, 19 nt, Human
uucccaggaagucaucuuc

SEQ ID NO: 1300013 - RNA, 24 nt, Human
aaaagaaccaacauggaugcaugg

SEQ ID NO: 1300014 - RNA, 21 nt, Human
aaacaggcacucacacuuuca

SEQ ID NO: 1300015 - RNA, 19 nt, Human
aaauacaaaaagcaagccc

SEQ ID NO: 1300016 - RNA, 18 nt, Human
aaaugaagcuaacaaaua

SEQ ID NO: 1300017 - RNA, 21 nt, Human
aaaugggaauaauaagaauau

SEQ ID NO: 1300018 - RNA, 19 nt, Human
aaccugcaaagguacccuc

SEQ ID NO: 1300019 - RNA, 20 nt, Human
aacugcccacauuuuugcca

SEQ ID NO: 1300020 - RNA, 19 nt, Human
aacuuccucuucuucucug

SEQ ID NO: 1300021 - RNA, 20 nt, Human
aagaacccuccuggggaaga

SEQ ID NO: 1300022 - RNA, 18 nt, Human
aagcacaggcuucucuug

SEQ ID NO: 1300023 - RNA, 20 nt, Human
aagccuuccuuacaaacacc

SEQ ID NO: 1300024 - RNA, 24 nt, Human
aaggccacaaaaaaucagaacgua

SEQ ID NO: 1300025 - RNA, 25 nt, Human
aaguaccuucuaacuacugaucuac

SEQ ID NO: 1300026 - RNA, 24 nt, Human
aagugaucugcccaccuuggccuc

SEQ ID NO: 1300027 - RNA, 24 nt, Human
aagugauucuccugccucacccuc

SEQ ID NO: 1300028 - RNA, 23 nt, Human
aagugcaggauucagggcagggg

SEQ ID NO: 1300029 - RNA, 24 nt, Human
aauaauaaucauaaucaugaaaau

SEQ ID NO: 1300030 - RNA, 21 nt, Human
aauagaaggauucugccugga

SEQ ID NO: 1300031 - RNA, 19 nt, Human
aauaucuacuuaaucucaa

SEQ ID NO: 1300032 - RNA, 19 nt, Human
aaugcugggauuacaggug

SEQ ID NO: 1300033 - RNA, 27 nt, Human
acaaaaagcaagcccauggaugucaac

SEQ ID NO: 1300034 - RNA, 21 nt, Human
acacuugcagguuaacagccu

SEQ ID NO: 1300035 - RNA, 18 nt, Human
acagccucaggggaagac

SEQ ID NO: 1300036 - RNA, 18 nt, Human
acagcucauugcagccuc

SEQ ID NO: 1300037 - RNA, 21 nt, Human
acaggguuucaccauguuggc

SEQ ID NO: 1300038 - RNA, 24 nt, Human
acaggguuucaccauguuggccag

SEQ ID NO: 1300039 - RNA, 25 nt, Human
acaggguuucaccauguuggccagg

SEQ ID NO: 1300040 - RNA, 18 nt, Human
accacuguccuggccugu

SEQ ID NO: 1300041 - RNA, 28 nt, Human
accacuguccuggccuguuuccugucag

SEQ ID NO: 1300042 - RNA, 23 nt, Human
accauguuggccagguuggucuc

SEQ ID NO: 1300043 - RNA, 22 nt, Human
acccacucuuuugcccuuccca

SEQ ID NO: 1300044 - RNA, 25 nt, Human
acccaggcuggaagugcaguggcau

SEQ ID NO: 1300045 - RNA, 18 nt, Human
acccuccagaguagcugg

SEQ ID NO: 1300046 - RNA, 23 nt, Human
acccuguaaaagccuuccuuaca

SEQ ID NO: 1300047 - RNA, 24 nt, Human
accuggcuaauuuuuuuguauuuu

SEQ ID NO: 1300048 - RNA, 18 nt, Human
acgggguuuugauauguu

SEQ ID NO: 1300049 - RNA, 19 nt, Human
acgggguuuugauauguug

SEQ ID NO: 1300050 - RNA, 24 nt, Human
acgggguuuugauauguugcucag

SEQ ID NO: 1300051 - RNA, 28 nt, Human
acuaucuuauauucacacauguguuggu

SEQ ID NO: 1300052 - RNA, 25 nt, Human
acucuguugcccaggcuggaguuca

SEQ ID NO: 1300053 - RNA, 21 nt, Human
acugcaaccuuccucuccugg

SEQ ID NO: 1300054 - RNA, 22 nt, Human
acugcaaccuuccucuccuggg

SEQ ID NO: 1300055 - RNA, 26 nt, Human
acugugucacccaggcuggaagugca

SEQ ID NO: 1300056 - RNA, 21 nt, Human
agaccuuugaaaagggcuuau

SEQ ID NO: 1300057 - RNA, 20 nt, Human
agagaccuaccaccaggaua

SEQ ID NO: 1300058 - RNA, 19 nt, Human
agagagggugaagcucuga

SEQ ID NO: 1300059 - RNA, 23 nt, Human
agcacaaauacagcccagaaaca

SEQ ID NO: 1300060 - RNA, 21 nt, Human
agcccacauuugcauuauguc

SEQ ID NO: 1300061 - RNA, 23 nt, Human
agccccuucccaucuugucuuug

SEQ ID NO: 1300062 - RNA, 19 nt, Human
agcuggguaaugagagacc

SEQ ID NO: 1300063 - RNA, 19 nt, Human
aggaaugugguaguaaagg

SEQ ID NO: 1300064 - RNA, 24 nt, Human
aggcaaucugcccaccuuggucuc

SEQ ID NO: 1300065 - RNA, 23 nt, Human
aggcaggaguaucacuucaaccc

SEQ ID NO: 1300066 - RNA, 18 nt, Human
aggcuaaacuuuuuucuu

SEQ ID NO: 1300067 - RNA, 22 nt, Human
aggcucaggugauccuccuacc

SEQ ID NO: 1300068 - RNA, 18 nt, Human
aggcugagauagcuccca

SEQ ID NO: 1300069 - RNA, 19 nt, Human
aggcugaggcaggaguauc

SEQ ID NO: 1300070 - RNA, 24 nt, Human
agggacuacaggcaugagccacca

SEQ ID NO: 1300071 - RNA, 24 nt, Human
agggauccuccugccucagccucc

SEQ ID NO: 1300072 - RNA, 22 nt, Human
aggggacuugggacucacacag

SEQ ID NO: 1300073 - RNA, 19 nt, Human
aguaccuucuaacuacuga

SEQ ID NO: 1300074 - RNA, 23 nt, Human
aguagcuggaauuauagacgugu

SEQ ID NO: 1300075 - RNA, 18 nt, Human
aguagcugggauuacagg

SEQ ID NO: 1300076 - RNA, 23 nt, Human
agugcaguggcaugaacacagcu

SEQ ID NO: 1300077 - RNA, 24 nt, Human
agugcaguggcaugaacacagcuc

SEQ ID NO: 1300078 - RNA, 24 nt, Human
aguggcaugaucucagcuuacugc

SEQ ID NO: 1300079 - RNA, 23 nt, Human
aucauucaauaauaaucauaauc

SEQ ID NO: 1300080 - RNA, 22 nt, Human
aucccagccaaucugauugcaa

SEQ ID NO: 1300081 - RNA, 20 nt, Human
aucucacucuguugcccagg

SEQ ID NO: 1300082 - RNA, 18 nt, Human
aucucacucuuuccuuag

SEQ ID NO: 1300083 - RNA, 23 nt, Human
aucuuccuauguuguccaggcug

SEQ ID NO: 1300084 - RNA, 18 nt, Human
augaaauaagcuuagccc

SEQ ID NO: 1300085 - RNA, 24 nt, Human
augaacacagcucauugcagccuc

SEQ ID NO: 1300086 - RNA, 19 nt, Human
augcaauacuuuuuuuugg

SEQ ID NO: 1300087 - RNA, 22 nt, Human
auguacccuacaaauauguaua

SEQ ID NO: 1300088 - RNA, 20 nt, Human
augucuccugccucauaagu

SEQ ID NO: 1300089 - RNA, 19 nt, Human
auguggggauaaaagaacc

SEQ ID NO: 1300090 - RNA, 20 nt, Human
auucagggcagggguccucu

SEQ ID NO: 1300091 - RNA, 20 nt, Human
auuuggagacagaaucucac

SEQ ID NO: 1300092 - RNA, 21 nt, Human
caaaauaucacauguacccuu

SEQ ID NO: 1300093 - RNA, 24 nt, Human
caaauugcugggaugacuggcaug

SEQ ID NO: 1300094 - RNA, 18 nt, Human
caacuccauagaaauuca

SEQ ID NO: 1300095 - RNA, 21 nt, Human
caacuccauagaaauucagcu

SEQ ID NO: 1300096 - RNA, 21 nt, Human
caagcauauaaagcccauuuc

SEQ ID NO: 1300097 - RNA, 22 nt, Human
caagggauccuccugccucagc

SEQ ID NO: 1300098 - RNA, 20 nt, Human
caagugauucuccugccuca

SEQ ID NO: 1300099 - RNA, 20 nt, Human
caauggcaguuaaugcuuau

SEQ ID NO: 1300100 - RNA, 23 nt, Human
cacaaagccauccaagcauauaa

SEQ ID NO: 1300101 - RNA, 19 nt, Human
cacacaaguguuccagaag

SEQ ID NO: 1300102 - RNA, 23 nt, Human
cacacaauacacccauguaauaa

SEQ ID NO: 1300103 - RNA, 20 nt, Human
cacaguuugcacuuugaaau

SEQ ID NO: 1300104 - RNA, 24 nt, Human
caccacaccuggcuaauuuuugua

SEQ ID NO: 1300105 - RNA, 21 nt, Human
caccauguuggccagguuggu

SEQ ID NO: 1300106 - RNA, 22 nt, Human
caccauguuggccagguugguc

SEQ ID NO: 1300107 - RNA, 24 nt, Human
caccauguuggccagguuggucuc

SEQ ID NO: 1300108 - RNA, 23 nt, Human
cacccacucuuuugcccuuccca

SEQ ID NO: 1300109 - RNA, 22 nt, Human
caccuucucaagugcaggauuc

SEQ ID NO: 1300110 - RNA, 20 nt, Human
caccuuucauucagucucag

SEQ ID NO: 1300111 - RNA, 19 nt, Human
cacuacacauuguaugcau

SEQ ID NO: 1300112 - RNA, 22 nt, Human
cacucuguugcccaggcuggag

SEQ ID NO: 1300113 - RNA, 21 nt, Human
cacuuaaaaaaugcacugaga

SEQ ID NO: 1300114 - RNA, 20 nt, Human
cacuuacccugauacagaaa

SEQ ID NO: 1300115 - RNA, 19 nt, Human
cacuuugaaauggacccag

SEQ ID NO: 1300116 - RNA, 23 nt, Human
cagaagauugccuacagaggcaa

SEQ ID NO: 1300117 - RNA, 21 nt, Human
cagaaguugguuaauggacac

SEQ ID NO: 1300118 - RNA, 24 nt, Human
cagaaucucacucuguugcccagg

SEQ ID NO: 1300119 - RNA, 19 nt, Human
cagcaucacacaauacacc

SEQ ID NO: 1300120 - RNA, 21 nt, Human
cagcaucacacaauacaccca

SEQ ID NO: 1300121 - RNA, 18 nt, Human
cagccaccacgcacagcc

SEQ ID NO: 1300122 - RNA, 19 nt, Human
cagccuccugaguagcugg

SEQ ID NO: 1300123 - RNA, 24 nt, Human
cagcuacucaggaggcugaggcag

SEQ ID NO: 1300124 - RNA, 24 nt, Human
caggaggcugaggcaggaguauca

SEQ ID NO: 1300125 - RNA, 18 nt, Human
cagggccugguccaugga

SEQ ID NO: 1300126 - RNA, 24 nt, Human
cagggucucacugugucacccagg

SEQ ID NO: 1300127 - RNA, 24 nt, Human
caggguuucaccauguuggccagg

SEQ ID NO: 1300128 - RNA, 19 nt, Human
caguggcaugaucucagcu

SEQ ID NO: 1300129 - RNA, 21 nt, Human
cauaacaagcugcaaacaaga

SEQ ID NO: 1300130 - RNA, 22 nt, Human
cauaaugcugggauuacaggug

SEQ ID NO: 1300131 - RNA, 23 nt, Human
caugaacacagcucauugcagcc

SEQ ID NO: 1300132 - RNA, 22 nt, Human
caugcaccacuguccuggccug

SEQ ID NO: 1300133 - RNA, 20 nt, Human
caugggcagggccuggucca

SEQ ID NO: 1300134 - RNA, 21 nt, Human
cauuuuaaacuaacacugagu

SEQ ID NO: 1300135 - RNA, 22 nt, Human
cauuuuagaccacugagcacuu

SEQ ID NO: 1300136 - RNA, 23 nt, Human
ccaaauacaaaaagcaagcccau

SEQ ID NO: 1300137 - RNA, 18 nt, Human
ccacaaagccauccaagc

SEQ ID NO: 1300138 - RNA, 22 nt, Human
ccacaaggucaaaguugagugu

SEQ ID NO: 1300139 - RNA, 21 nt, Human
ccagagaggcaccuucucaag

SEQ ID NO: 1300140 - RNA, 19 nt, Human
ccagaguagcugggauuac

SEQ ID NO: 1300141 - RNA, 22 nt, Human
ccagaguagcugggauuacagg

SEQ ID NO: 1300142 - RNA, 23 nt, Human
ccagaguagcugggauuacaggu

SEQ ID NO: 1300143 - RNA, 24 nt, Human
ccagaguagcugggauuacaggug

SEQ ID NO: 1300144 - RNA, 23 nt, Human
ccagccaccacgcacagccacaa

SEQ ID NO: 1300145 - RNA, 20 nt, Human
ccaggguacagucaguggag

SEQ ID NO: 1300146 - RNA, 21 nt, Human
ccauaaugcugggauuacagg

SEQ ID NO: 1300147 - RNA, 24 nt, Human
cccaaguagcagggacuacaggca

SEQ ID NO: 1300148 - RNA, 22 nt, Human
cccacauuugcauuaugucuaa

SEQ ID NO: 1300149 - RNA, 19 nt, Human
cccaggcuggaguucagug

SEQ ID NO: 1300150 - RNA, 21 nt, Human
cccaucauuuguuugcuguug

SEQ ID NO: 1300151 - RNA, 21 nt, Human
cccaugguccaccuuuuuauu

SEQ ID NO: 1300152 - RNA, 24 nt, Human
ccccccguucagccagcacugagc

SEQ ID NO: 1300153 - RNA, 21 nt, Human
cccuaggccccaugcaagcuc

SEQ ID NO: 1300154 - RNA, 23 nt, Human
cccuccgaaaucuaaaaugaaag

SEQ ID NO: 1300155 - RNA, 23 nt, Human
cccugagugcccagcaugugccc

SEQ ID NO: 1300156 - RNA, 18 nt, Human
cccugauacagaaagaag

SEQ ID NO: 1300157 - RNA, 25 nt, Human
cccuucagaaagcagauccuugggc

SEQ ID NO: 1300158 - RNA, 23 nt, Human
ccuaccucagccucccaaguagc

SEQ ID NO: 1300159 - RNA, 22 nt, Human
ccuauguuguccaggcuggucu

SEQ ID NO: 1300160 - RNA, 26 nt, Human
ccuccaaauacaaaaagcaagcccau

SEQ ID NO: 1300161 - RNA, 26 nt, Human
ccuccuaccucagccucccaaguagc

SEQ ID NO: 1300162 - RNA, 19 nt, Human
ccugaguagcuggaauuau

SEQ ID NO: 1300163 - RNA, 19 nt, Human
ccugauccaugaaucucug

SEQ ID NO: 1300164 - RNA, 23 nt, Human
ccugcauagacaaaaugaaauaa

SEQ ID NO: 1300165 - RNA, 23 nt, Human
ccugccucagccuccugaguagc

SEQ ID NO: 1300166 - RNA, 24 nt, Human
ccugccucagccuccugaguagcu

SEQ ID NO: 1300167 - RNA, 23 nt, Human
ccuggguucaagugauucuccuc

SEQ ID NO: 1300168 - RNA, 23 nt, Human
ccuggguucaagugauucuccug

SEQ ID NO: 1300169 - RNA, 21 nt, Human
ccuggugcucuccuacccccc

SEQ ID NO: 1300170 - RNA, 18 nt, Human
ccuguaaaagccuuccuu

SEQ ID NO: 1300171 - RNA, 21 nt, Human
ccuguaaucccagcuacucag

SEQ ID NO: 1300172 - RNA, 20 nt, Human
ccuucugcuuuuagucauuu

SEQ ID NO: 1300173 - RNA, 22 nt, Human
ccuugggucccuuuuccuuagc

SEQ ID NO: 1300174 - RNA, 19 nt, Human
cgaaaagaaugacauugag

SEQ ID NO: 1300175 - RNA, 24 nt, Human
cgggguuuugauauguugcucagg

SEQ ID NO: 1300176 - RNA, 23 nt, Human
cucaaggccacaaaaaaucagaa

SEQ ID NO: 1300177 - RNA, 18 nt, Human
cucaagggauccuccugc

SEQ ID NO: 1300178 - RNA, 24 nt, Human
cucaagugaucugcccaccuuggc

SEQ ID NO: 1300179 - RNA, 24 nt, Human
cucacucuguugcccaggcuggag

SEQ ID NO: 1300180 - RNA, 24 nt, Human
cucaggugauccuccuaccucagc

SEQ ID NO: 1300181 - RNA, 23 nt, Human
cucccauggccaggguuccugca

SEQ ID NO: 1300182 - RNA, 20 nt, Human
cuccuggguucaagugauuc

SEQ ID NO: 1300183 - RNA, 21 nt, Human
cuccuggguucaagugauucu

SEQ ID NO: 1300184 - RNA, 23 nt, Human
cuccuggguucaagugauucucc

SEQ ID NO: 1300185 - RNA, 18 nt, Human
cucuggacuacaauuugc

SEQ ID NO: 1300186 - RNA, 23 nt, Human
cugcaaccuuccucuccuggguu

SEQ ID NO: 1300187 - RNA, 20 nt, Human
cugcagucccuacucuaagc

SEQ ID NO: 1300188 - RNA, 19 nt, Human
cuggaagugcaguggcaug

SEQ ID NO: 1300189 - RNA, 21 nt, Human
cuggacaaguucccuuuuaug

SEQ ID NO: 1300190 - RNA, 24 nt, Human
cuggaguucaguggcaugaucuca

SEQ ID NO: 1300191 - RNA, 23 nt, Human
cuuagcucaaggccacaaaaaau

SEQ ID NO: 1300192 - RNA, 22 nt, Human
cuucccaaaagaaucagacacu

SEQ ID NO: 1300193 - RNA, 24 nt, Human
gaaaauauauguaaagaccuuuga

SEQ ID NO: 1300194 - RNA, 18 nt, Human
gaacguaaauuccagccc

SEQ ID NO: 1300195 - RNA, 22 nt, Human
gaagaggccaugcaggcucagg

SEQ ID NO: 1300196 - RNA, 23 nt, Human
gaagccccuucccaucuugucuu

SEQ ID NO: 1300197 - RNA, 18 nt, Human
gaaguagcaacuccauag

SEQ ID NO: 1300198 - RNA, 23 nt, Human
gaaguggagaacaaagauaagug

SEQ ID NO: 1300199 - RNA, 24 nt, Human
gaccuaccaccaggauaguucaaa

SEQ ID NO: 1300200 - RNA, 21 nt, Human
gacuacaggcaugagccacca

SEQ ID NO: 1300201 - RNA, 22 nt, Human
gacucaagugaucugcccaccu

SEQ ID NO: 1300202 - RNA, 19 nt, Human
gagagaccuaccaccagga

SEQ ID NO: 1300203 - RNA, 19 nt, Human
gagagggugaagcucugag

SEQ ID NO: 1300204 - RNA, 22 nt, Human
gagagugaaaguuaccugaggu

SEQ ID NO: 1300205 - RNA, 24 nt, Human
gagcucaggcaaucugcccaccuu

SEQ ID NO: 1300206 - RNA, 26 nt, Human
gaguagcugggauuacaggugcacac

SEQ ID NO: 1300207 - RNA, 24 nt, Human
gagugugguggcacaugccuguaa

SEQ ID NO: 1300208 - RNA, 18 nt, Human
gauuacaggugccagcca

SEQ ID NO: 1300209 - RNA, 23 nt, Human
gcagaugcuacugcaguuuguau

SEQ ID NO: 1300210 - RNA, 24 nt, Human
gcccaggcuggaguucaguggcau

SEQ ID NO: 1300211 - RNA, 19 nt, Human
gccccuucccaucuugucu

SEQ ID NO: 1300212 - RNA, 19 nt, Human
gcucuaauaaugcaguuga

SEQ ID NO: 1300213 - RNA, 18 nt, Human
gcuggaagugcaguggca

SEQ ID NO: 1300214 - RNA, 21 nt, Human
ggaaagauguggaauguucuc

SEQ ID NO: 1300215 - RNA, 20 nt, Human
ggacagguggacaaaugcuc

SEQ ID NO: 1300216 - RNA, 19 nt, Human
ggacuacaggcaugagcca

SEQ ID NO: 1300217 - RNA, 21 nt, Human
ggcacaugccuguaaucccag

SEQ ID NO: 1300218 - RNA, 18 nt, Human
ggcagggguccucuugcc

SEQ ID NO: 1300219 - RNA, 23 nt, Human
ggcucaggugauccuccuaccuc

SEQ ID NO: 1300220 - RNA, 23 nt, Human
gggacuacaggcaugagccacca

SEQ ID NO: 1300221 - RNA, 24 nt, Human
gggauccuccugccucagccuccu

SEQ ID NO: 1300222 - RNA, 19 nt, Human
gggcagggccugguccaug

SEQ ID NO: 1300223 - RNA, 23 nt, Human
gggguuuugauauguugcucagg

SEQ ID NO: 1300224 - RNA, 22 nt, Human
ggguuucaccauguuggccagg

SEQ ID NO: 1300225 - RNA, 19 nt, Human
gguaagaacccuccugggg

SEQ ID NO: 1300226 - RNA, 24 nt, Human
gugauccuccuaccucagccuccc

SEQ ID NO: 1300227 - RNA, 19 nt, Human
gugauucuccugccucacc

SEQ ID NO: 1300228 - RNA, 22 nt, Human
gugccuccacacccagcuuaca

SEQ ID NO: 1300229 - RNA, 23 nt, Human
guggcacaugccuguaaucccag

SEQ ID NO: 1300230 - RNA, 20 nt, Human
guggcaugaggagcuguggg

SEQ ID NO: 1300231 - RNA, 20 nt, Human
guggccugcugaguauuagc

SEQ ID NO: 1300232 - RNA, 19 nt, Human
guguccuaauacauaugua

SEQ ID NO: 1300233 - RNA, 21 nt, Human
guguccuaauacauauguaug

SEQ ID NO: 1300234 - RNA, 19 nt, Human
guuguuccuggugcucucc

SEQ ID NO: 1300235 - RNA, 21 nt, Human
guuugaggugauggauaugca

SEQ ID NO: 1300236 - RNA, 22 nt, Human
uaaaagaaccaacauggaugca

SEQ ID NO: 1300237 - RNA, 26 nt, Human
uaaaagccuuccuuacaaacaccucc

SEQ ID NO: 1300238 - RNA, 18 nt, Human
uaaacaagguacagagaa

SEQ ID NO: 1300239 - RNA, 24 nt, Human
uaaaccugcaaagguacccuccga

SEQ ID NO: 1300240 - RNA, 25 nt, Human
uaaacuccugaacucaagggauccu

SEQ ID NO: 1300241 - RNA, 19 nt, Human
uaaagggagagcugaucau

SEQ ID NO: 1300242 - RNA, 22 nt, Human
uaaaguagcuucaaaacccauu

SEQ ID NO: 1300243 - RNA, 23 nt, Human
uaaaguagcuucaaaacccauuu

SEQ ID NO: 1300244 - RNA, 24 nt, Human
uaaauacuuucacuuaaaaaaugc

SEQ ID NO: 1300245 - RNA, 22 nt, Human
uaacaauaacuuauauauuuca

SEQ ID NO: 1300246 - RNA, 22 nt, Human
uaacaguuagaaguggagaaaa

SEQ ID NO: 1300247 - RNA, 21 nt, Human
uaauuaucaaguaaaaucuca

SEQ ID NO: 1300248 - RNA, 22 nt, Human
uaauuuuuguauuuuuuguaga

SEQ ID NO: 1300249 - RNA, 24 nt, Human
uaauuuuuguauuuuuuguagaga

SEQ ID NO: 1300250 - RNA, 21 nt, Human
uacaaaaagcaagcccaugga

SEQ ID NO: 1300251 - RNA, 22 nt, Human
uacaaacaccuccaguagaucc

SEQ ID NO: 1300252 - RNA, 24 nt, Human
uacagaaagaagguguaaaauuuc

SEQ ID NO: 1300253 - RNA, 23 nt, Human
uacagcccagaaacacuugcagg

SEQ ID NO: 1300254 - RNA, 22 nt, Human
uacaggcaugagccaccacacc

SEQ ID NO: 1300255 - RNA, 21 nt, Human
uaccccaaaucucagcaucac

SEQ ID NO: 1300256 - RNA, 23 nt, Human
uaccccaaaucucagcaucacac

SEQ ID NO: 1300257 - RNA, 23 nt, Human
uaccucagccucccaaguagcag

SEQ ID NO: 1300258 - RNA, 23 nt, Human
uacugcaaccuuccucuccuggg

SEQ ID NO: 1300259 - RNA, 24 nt, Human
uacuuuuuuuuggaaauaggguga

SEQ ID NO: 1300260 - RNA, 20 nt, Human
uagaauucucugauuucuug

SEQ ID NO: 1300261 - RNA, 24 nt, Human
uagacgugugccuccacacccagc

SEQ ID NO: 1300262 - RNA, 20 nt, Human
uagauccuccaaccacuuuc

SEQ ID NO: 1300263 - RNA, 22 nt, Human
uagauccuccaaccacuuucag

SEQ ID NO: 1300264 - RNA, 25 nt, Human
uagcucccauggccaggguuccuuc

SEQ ID NO: 1300265 - RNA, 22 nt, Human
uaggcacaggguuucaccaugu

SEQ ID NO: 1300266 - RNA, 24 nt, Human
uaguaggcacaggguuucaccaug

SEQ ID NO: 1300267 - RNA, 26 nt, Human
uauauaauauauaacuauauagugau

SEQ ID NO: 1300268 - RNA, 19 nt, Human
uaucaugucuccugccuca

SEQ ID NO: 1300269 - RNA, 24 nt, Human
uaucccucaucuacaaaaugggaa

SEQ ID NO: 1300270 - RNA, 24 nt, Human
uauguucccugcaccacuggugcc

SEQ ID NO: 1300271 - RNA, 24 nt, Human
uauguugcucaggcuugucucaaa

SEQ ID NO: 1300272 - RNA, 24 nt, Human
uauguuguccaggcuggucuuaaa

SEQ ID NO: 1300273 - RNA, 18 nt, Human
uauuaggaaugccuuguu

SEQ ID NO: 1300274 - RNA, 24 nt, Human
uauuuggagacagaaucucacucu

SEQ ID NO: 1300275 - RNA, 25 nt, Human
uauuuggagacagaaucucacucug

SEQ ID NO: 1300276 - RNA, 23 nt, Human
ucaaaacccauuugcaaauagau

SEQ ID NO: 1300277 - RNA, 26 nt, Human
ucaaaacccauuugcaaauagaugua

SEQ ID NO: 1300278 - RNA, 23 nt, Human
ucaaaauacauaugaguacaauc

SEQ ID NO: 1300279 - RNA, 22 nt, Human
ucaacccuccaccacuucaggu

SEQ ID NO: 1300280 - RNA, 19 nt, Human
ucaagugauucuccugccu

SEQ ID NO: 1300281 - RNA, 21 nt, Human
ucaccauguuggccagguugg

SEQ ID NO: 1300282 - RNA, 23 nt, Human
ucaccccuucagaaagcagaucc

SEQ ID NO: 1300283 - RNA, 24 nt, Human
ucacucuguugcccaggcuggagu

SEQ ID NO: 1300284 - RNA, 27 nt, Human
ucagaaagcagauccuugggcaccauu

SEQ ID NO: 1300285 - RNA, 22 nt, Human
ucagccuccugaguagcuggaa

SEQ ID NO: 1300286 - RNA, 23 nt, Human
ucagcucaccuuucauucagucu

SEQ ID NO: 1300287 - RNA, 22 nt, Human
ucagucucagacaccgugagaa

SEQ ID NO: 1300288 - RNA, 19 nt, Human
ucauauccagcuucccaaa

SEQ ID NO: 1300289 - RNA, 19 nt, Human
uccacaaagccauccaagc

SEQ ID NO: 1300290 - RNA, 20 nt, Human
uccacaauucucaccccuuc

SEQ ID NO: 1300291 - RNA, 19 nt, Human
uccacuguacaaauaaaau

SEQ ID NO: 1300292 - RNA, 24 nt, Human
uccagaguagcugggauuacaggu

SEQ ID NO: 1300293 - RNA, 25 nt, Human
uccaguagauccuccaaccacuuuc

SEQ ID NO: 1300294 - RNA, 24 nt, Human
ucccaaauugcugggaugacuggc

SEQ ID NO: 1300295 - RNA, 24 nt, Human
ucccaaguagcagggacuacaggc

SEQ ID NO: 1300296 - RNA, 18 nt, Human
ucccagccaaucugauug

SEQ ID NO: 1300297 - RNA, 23 nt, Human
ucccauaaugcugggauuacagg

SEQ ID NO: 1300298 - RNA, 25 nt, Human
ucccugcaccacuggugccuauuuc

SEQ ID NO: 1300299 - RNA, 26 nt, Human
uccuccugccucagccuccugaguag

SEQ ID NO: 1300300 - RNA, 19 nt, Human
uccuggguucaagugauuc

SEQ ID NO: 1300301 - RNA, 21 nt, Human
uccuggguucaagugauucuc

SEQ ID NO: 1300302 - RNA, 24 nt, Human
uccuggguucaagugauucuccug

SEQ ID NO: 1300303 - RNA, 19 nt, Human
uccuugaagaagcuucauu

SEQ ID NO: 1300304 - RNA, 23 nt, Human
ucucaaacuccugagcucaggca

SEQ ID NO: 1300305 - RNA, 24 nt, Human
ucucaccccuucagaaagcagauc

SEQ ID NO: 1300306 - RNA, 23 nt, Human
ucucacucuguugcccaggcugg

SEQ ID NO: 1300307 - RNA, 24 nt, Human
ucucacucuguugcccaggcugga

SEQ ID NO: 1300308 - RNA, 26 nt, Human
ucucacucuguugcccaggcuggagu

SEQ ID NO: 1300309 - RNA, 27 nt, Human
ucucacucuguugcccaggcuggaguu

SEQ ID NO: 1300310 - RNA, 22 nt, Human
ucucacugugucacccaggcug

SEQ ID NO: 1300311 - RNA, 24 nt, Human
ucucacugugucacccaggcugga

SEQ ID NO: 1300312 - RNA, 22 nt, Human
ucuccaggcucaggugauccuc

SEQ ID NO: 1300313 - RNA, 25 nt, Human
ucuccaggcucaggugauccuccua

SEQ ID NO: 1300314 - RNA, 18 nt, Human
ucucugauuucuuggugc

SEQ ID NO: 1300315 - RNA, 19 nt, Human
ucucuugugcugccagcaa

SEQ ID NO: 1300316 - RNA, 21 nt, Human
ucugcccaccuuggucuccca

SEQ ID NO: 1300317 - RNA, 19 nt, Human
ucugugaagaccuguaccc

SEQ ID NO: 1300318 - RNA, 18 nt, Human
ucuguugcccaggcugga

SEQ ID NO: 1300319 - RNA, 19 nt, Human
ucuuccuauguuguccagg

SEQ ID NO: 1300320 - RNA, 21 nt, Human
ucuuccuauguuguccaggcu

SEQ ID NO: 1300321 - RNA, 23 nt, Human
ucuuccuauguuguccaggcugg

SEQ ID NO: 1300322 - RNA, 24 nt, Human
ucuuccuauguuguccaggcuggu

SEQ ID NO: 1300323 - RNA, 23 nt, Human
ucuucuucucugagauuucuaga

SEQ ID NO: 1300324 - RNA, 21 nt, Human
ugaaauggacccagggaagag

SEQ ID NO: 1300325 - RNA, 20 nt, Human
ugaacacagcucauugcagc

SEQ ID NO: 1300326 - RNA, 24 nt, Human
ugaacucaagggauccuccugccu

SEQ ID NO: 1300327 - RNA, 20 nt, Human
ugaagaccuguacccucagu

SEQ ID NO: 1300328 - RNA, 23 nt, Human
ugaagauuauagcaauauuuuug

SEQ ID NO: 1300329 - RNA, 19 nt, Human
ugacuucauauccagcuuc

SEQ ID NO: 1300330 - RNA, 22 nt, Human
ugagaagcuuugcauacccuug

SEQ ID NO: 1300331 - RNA, 19 nt, Human
ugagaucaacccuccacca

SEQ ID NO: 1300332 - RNA, 22 nt, Human
ugagaucaacccuccaccacuu

SEQ ID NO: 1300333 - RNA, 24 nt, Human
ugagcacaaauacagcccagaaac

SEQ ID NO: 1300334 - RNA, 24 nt, Human
ugagccagcaggaaggaucucaca

SEQ ID NO: 1300335 - RNA, 19 nt, Human
ugaggcaggaguaucacuu

SEQ ID NO: 1300336 - RNA, 24 nt, Human
ugaggcaggaguaucacuucaacc

SEQ ID NO: 1300337 - RNA, 25 nt, Human
ugaggcaggaguaucacuucaaccc

SEQ ID NO: 1300338 - RNA, 18 nt, Human
ugaggucagacacugugc

SEQ ID NO: 1300339 - RNA, 18 nt, Human
ugagugggccaggguaca

SEQ ID NO: 1300340 - RNA, 24 nt, Human
ugaucugcccaccuuggccuccca

SEQ ID NO: 1300341 - RNA, 19 nt, Human
ugauuugaucacuacacau

SEQ ID NO: 1300342 - RNA, 19 nt, Human
ugcaaaaagagauuggaaa

SEQ ID NO: 1300343 - RNA, 18 nt, Human
ugcaugggcagggccugg

SEQ ID NO: 1300344 - RNA, 21 nt, Human
ugcauguaucaaaauaucaca

SEQ ID NO: 1300345 - RNA, 18 nt, Human
ugccagcaguucucuucc

SEQ ID NO: 1300346 - RNA, 19 nt, Human
ugccauucaauuucugcag

SEQ ID NO: 1300347 - RNA, 19 nt, Human
ugccauucaauuucugcag

SEQ ID NO: 1300348 - RNA, 21 nt, Human
ugcccaggcuggaguucagug

SEQ ID NO: 1300349 - RNA, 24 nt, Human
ugcccaggcuggaguucaguggca

SEQ ID NO: 1300350 - RNA, 24 nt, Human
ugccucagccuccugaguagcugg

SEQ ID NO: 1300351 - RNA, 24 nt, Human
ugccucauaaguaccacuggacaa

SEQ ID NO: 1300352 - RNA, 19 nt, Human
ugccugagcacaaauacag

SEQ ID NO: 1300353 - RNA, 28 nt, Human
ugccugagcacaaauacagcccagaaac

SEQ ID NO: 1300354 - RNA, 18 nt, Human
ugccuggauuugcaugug

SEQ ID NO: 1300355 - RNA, 24 nt, Human
ugccuguaaucccagcuacucagg

SEQ ID NO: 1300356 - RNA, 21 nt, Human
ugcucuccuaccccccguuca

SEQ ID NO: 1300357 - RNA, 20 nt, Human
ugcugagggaaacagggugg

SEQ ID NO: 1300358 - RNA, 20 nt, Human
ugcugggauuacaggugcca

SEQ ID NO: 1300359 - RNA, 23 nt, Human
ugcugugagauauccacagaacu

SEQ ID NO: 1300360 - RNA, 21 nt, Human
uggaaggaacagaaaaauuuc

SEQ ID NO: 1300361 - RNA, 24 nt, Human
uggaauuauagacgugugccucca

SEQ ID NO: 1300362 - RNA, 24 nt, Human
uggacacaaaaauacaguuagaug

SEQ ID NO: 1300363 - RNA, 18 nt, Human
uggacucaagugaucugc

SEQ ID NO: 1300364 - RNA, 22 nt, Human
uggacucaagugaucugcccac

SEQ ID NO: 1300365 - RNA, 22 nt, Human
uggagacagaaucucacucugu

SEQ ID NO: 1300366 - RNA, 19 nt, Human
uggaguucaguggcaugau

SEQ ID NO: 1300367 - RNA, 19 nt, Human
uggaguucaguggcaugau

SEQ ID NO: 1300368 - RNA, 21 nt, Human
uggcacaugccuguaauccca

SEQ ID NO: 1300369 - RNA, 22 nt, Human
uggcacaugccuguaaucccag

SEQ ID NO: 1300370 - RNA, 24 nt, Human
uggcaugaucucagcuuacugcaa

SEQ ID NO: 1300371 - RNA, 24 nt, Human
uggccagguuggucucaaacuccu

SEQ ID NO: 1300372 - RNA, 19 nt, Human
ugggacagggucucacugu

SEQ ID NO: 1300373 - RNA, 21 nt, Human
ugggagagcauuaggcugaga

SEQ ID NO: 1300374 - RNA, 18 nt, Human
ugggaucuuccuauguug

SEQ ID NO: 1300375 - RNA, 24 nt, Human
ugggaucuuccuauguuguccagg

SEQ ID NO: 1300376 - RNA, 21 nt, Human
ugggauuacaggugcacacca

SEQ ID NO: 1300377 - RNA, 19 nt, Human
ugggauuacaggugcacca

SEQ ID NO: 1300378 - RNA, 22 nt, Human
ugggauuacaggugccagccac

SEQ ID NO: 1300379 - RNA, 24 nt, Human
ugggauuacaggugccagccacca

SEQ ID NO: 1300380 - RNA, 21 nt, Human
uggggauaaaagaaccaacau

SEQ ID NO: 1300381 - RNA, 23 nt, Human
uggguucaagugauucuccugcc

SEQ ID NO: 1300382 - RNA, 19 nt, Human
ugguaagaacccuccuggg

SEQ ID NO: 1300383 - RNA, 24 nt, Human
ugguggcacaugccuguaauccca

SEQ ID NO: 1300384 - RNA, 25 nt, Human
uguaaaagccuuccuuacaaacacc

SEQ ID NO: 1300385 - RNA, 18 nt, Human
uguaauaaaccugcaaag

SEQ ID NO: 1300386 - RNA, 24 nt, Human
uguagagacgggguuuugauaugu

SEQ ID NO: 1300387 - RNA, 20 nt, Human
uguauucauaacaagcugca

SEQ ID NO: 1300388 - RNA, 24 nt, Human
uguccaggcuggucuuaaacuccu

SEQ ID NO: 1300389 - RNA, 23 nt, Human
ugucucaaacucuuggacucaac

SEQ ID NO: 1300390 - RNA, 25 nt, Human
ugugucacccaggcuggaagugcag

SEQ ID NO: 1300391 - RNA, 24 nt, Human
uguguguuguuccuggugcucucc

SEQ ID NO: 1300392 - RNA, 25 nt, Human
uguuaugacaccuccaaauacaaaa

SEQ ID NO: 1300393 - RNA, 24 nt, Human
uuacugcaaccuuccucuccuggg

SEQ ID NO: 1300394 - RNA, 18 nt, Human
uuagcccacccacaggug

SEQ ID NO: 1300395 - RNA, 22 nt, Human
uuaggcugagauagcucccaug

SEQ ID NO: 1300396 - RNA, 24 nt, Human
uuaguaggcacaggguuucaccau

SEQ ID NO: 1300397 - RNA, 21 nt, Human
uucaagugauucuccugccuc

SEQ ID NO: 1300398 - RNA, 23 nt, Human
uucaagugauucuccugccucac

SEQ ID NO: 1300399 - RNA, 18 nt, Human
uucaaguuaguuuacccu

SEQ ID NO: 1300400 - RNA, 24 nt, Human
uucacccuguaaaagccuuccuua

SEQ ID NO: 1300401 - RNA, 27 nt, Human
uucauucauaccccaaaucucagcauc

SEQ ID NO: 1300402 - RNA, 19 nt, Human
uugcagccucuacaucucc

SEQ ID NO: 1300403 - RNA, 21 nt, Human
uugccauucaauuucugcagu

SEQ ID NO: 1300404 - RNA, 21 nt, Human
uugcugggaugacuggcaugc

SEQ ID NO: 1300405 - RNA, 22 nt, Human
uuguagagacgggguuuugaua

SEQ ID NO: 1300406 - RNA, 24 nt, Human
uuguagagacgggguuuugauaug

SEQ ID NO: 1300407 - RNA, 19 nt, Human
uuucaccauguuggccagg

SEQ ID NO: 1300408 - RNA, 20 nt, Human
uuucaccauguuggccaggu

SEQ ID NO: 1300409 - RNA, 23 nt, Human
uuugccaggucccugagugccca

SEQ ID NO: 1300410 - RNA, 20 nt, Human
uuuguagagacgggguuuug

SEQ ID NO: 1300411 - RNA, 24 nt, Human
uuuguagagacgggguuuugauau

SEQ ID NO: 1300412 - RNA, 18 nt, Human
uuuucacauugcuaaguu

SEQ ID NO: 1300413 - RNA, 19 nt, Human
uuuugauauguugcucagg

SEQ ID NO: 1300414 - RNA, 24 nt, Human
uuuuuaguaggcacaggguuucac

SEQ ID NO: 1300415 - RNA, 20 nt, Human
uuuuuguauuuuuuguagag

SEQ ID NO: 1300416 - RNA, 23 nt, Human
uuuuuguauuuuuuguagagacg

SEQ ID NO: 1300417 - RNA, 21 nt, Human
uuuuuuguagagacgggguuu

SEQ ID NO: 1300418 - RNA, 22 nt, Human
uuuuuuguauuuuuaguaggca

SEQ ID NO: 1300419 - RNA, 19 nt, Human
agcuguucaggcuuuuuag

SEQ ID NO: 1300420 - RNA, 24 nt, Human
agcuuccucagcuguucaggcuuu

SEQ ID NO: 1300421 - RNA, 21 nt, Human
aggcuuuuuaggagacucuga

SEQ ID NO: 1300422 - RNA, 23 nt, Human
caaaauggcuccucaggcucuca

SEQ ID NO: 1300423 - RNA, 19 nt, Human
caacacuccaaugaagagc

SEQ ID NO: 1300424 - RNA, 23 nt, Human
cagcuguucaggcuuuuuaggag

SEQ ID NO: 1300425 - RNA, 19 nt, Human
cccauugcucaaaauggcu

SEQ ID NO: 1300426 - RNA, 18 nt, Human
ccccauugcucaaaaugg

SEQ ID NO: 1300427 - RNA, 18 nt, Human
gagcuuccucagcuguuc

SEQ ID NO: 1300428 - RNA, 23 nt, Human
ucaggcuuuuuaggagacucuga

SEQ ID NO: 1300429 - RNA, 18 nt, Human
uuccucagcuguucaggc

SEQ ID NO: 1300430 - RNA, 23 nt, Human
aggucuguggagcgcagccagca

SEQ ID NO: 1300431 - RNA, 25 nt, Human
cagccagcaccuccacugccaagau

SEQ ID NO: 1300432 - RNA, 20 nt, Human
cagcuccucagccucagccu

SEQ ID NO: 1300433 - RNA, 23 nt, Human
ccggcggggacacagcucucccu

SEQ ID NO: 1300434 - RNA, 22 nt, Human
ccucagccucagccugcugcuu

SEQ ID NO: 1300435 - RNA, 23 nt, Human
ccucagccugcugcuuccuuuuu

SEQ ID NO: 1300436 - RNA, 25 nt, Human
ccuccugcccgggcuggcucuggga

SEQ ID NO: 1300437 - RNA, 22 nt, Human
cgcagccagcaccuccacugcc

SEQ ID NO: 1300438 - RNA, 20 nt, Human
cggcaggggggguggggggc

SEQ ID NO: 1300439 - RNA, 26 nt, Human
gacacagcucucccuuguuccugacc

SEQ ID NO: 1300440 - RNA, 21 nt, Human
gcagccagcaccuccacugcc

SEQ ID NO: 1300441 - RNA, 18 nt, Human
gcaggggggguggggggc

SEQ ID NO: 1300442 - RNA, 21 nt, Human
gcccgggcuggcucuggucgc

SEQ ID NO: 1300443 - RNA, 21 nt, Human
gcggggacacagcucucccuu

SEQ ID NO: 1300444 - RNA, 21 nt, Human
ggcaggggggguggggggcgc

SEQ ID NO: 1300445 - RNA, 20 nt, Human
gggguggggggcgccggcgg

SEQ ID NO: 1300446 - RNA, 25 nt, Human
uccccggcaggggggguggggggcg

SEQ ID NO: 1300447 - RNA, 21 nt, Human
ucccuuguuccugccgccagc

SEQ ID NO: 1300448 - RNA, 23 nt, Human
uccucagccucagccugcugcuu

SEQ ID NO: 1300449 - RNA, 19 nt, Human
ugcccgggcuggcucuggu

SEQ ID NO: 1300450 - RNA, 25 nt, Human
uggagcgcagccagcaccuccacug

SEQ ID NO: 1300451 - RNA, 18 nt, Human
uggggggcgccggcgggg

SEQ ID NO: 1300452 - RNA, 21 nt, Human
uuccugccgccagcuccucag

SEQ ID NO: 1300453 - RNA, 24 nt, Human
aaaaaaaaaaacagugccuucaga

SEQ ID NO: 1300454 - RNA, 18 nt, Human
aaaaaaaacagugccuuc

SEQ ID NO: 1300455 - RNA, 23 nt, Human
aaaaagacagagcuauuaacuua

SEQ ID NO: 1300456 - RNA, 24 nt, Human
aaaacauuuaauacauaaaaaagc

SEQ ID NO: 1300457 - RNA, 20 nt, Human
aacaccuagagaaagaacuc

SEQ ID NO: 1300458 - RNA, 24 nt, Human
aagaaagugaaaaaaugaggccgg

SEQ ID NO: 1300459 - RNA, 19 nt, Human
aagcaugcacccaccaugc

SEQ ID NO: 1300460 - RNA, 21 nt, Human
aagcaugcacccaccaugccc

SEQ ID NO: 1300461 - RNA, 25 nt, Human
aagcgauccucccaccucagccucc

SEQ ID NO: 1300462 - RNA, 24 nt, Human
aagggggaaaaaaaaacccaaaag

SEQ ID NO: 1300463 - RNA, 23 nt, Human
aaggguuuuuuuuucuuaaggga

SEQ ID NO: 1300464 - RNA, 21 nt, Human
aaucugcccacuuuggccacc

SEQ ID NO: 1300465 - RNA, 27 nt, Human
aauugcucucccggauuuaaucccuac

SEQ ID NO: 1300466 - RNA, 24 nt, Human
acagaguaagacucugucucaaaa

SEQ ID NO: 1300467 - RNA, 18 nt, Human
acaggguuucaccauguu

SEQ ID NO: 1300468 - RNA, 19 nt, Human
acaggguuucaccauguug

SEQ ID NO: 1300469 - RNA, 24 nt, Human
acaggguuucaccauguugcccag

SEQ ID NO: 1300470 - RNA, 24 nt, Human
accauguugcccaggcuggucucg

SEQ ID NO: 1300471 - RNA, 25 nt, Human
accauguugcccaggcuggucucga

SEQ ID NO: 1300472 - RNA, 23 nt, Human
accucagccuccucaguagcugg

SEQ ID NO: 1300473 - RNA, 21 nt, Human
agaagcauggguaaaagggcc

SEQ ID NO: 1300474 - RNA, 21 nt, Human
agaaugcagaaaaugccuucc

SEQ ID NO: 1300475 - RNA, 23 nt, Human
agacaggguuucaccauguugcc

SEQ ID NO: 1300476 - RNA, 24 nt, Human
agccugggugacagaguaagacuc

SEQ ID NO: 1300477 - RNA, 23 nt, Human
agcuuuuuuuuuguauuuuuggu

SEQ ID NO: 1300478 - RNA, 22 nt, Human
aggcaagaaugcagaaaaugcc

SEQ ID NO: 1300479 - RNA, 18 nt, Human
aggugggagcgcaguggu

SEQ ID NO: 1300480 - RNA, 24 nt, Human
aguggugcagaucacgaggucagg

SEQ ID NO: 1300481 - RNA, 19 nt, Human
auagcuagagacuaaagaa

SEQ ID NO: 1300482 - RNA, 22 nt, Human
auagugcaaacaccaaaaagac

SEQ ID NO: 1300483 - RNA, 20 nt, Human
augcagaaaaugccuuccuc

SEQ ID NO: 1300484 - RNA, 19 nt, Human
auucaagguugcuaugagg

SEQ ID NO: 1300485 - RNA, 24 nt, Human
auugcaguggugccaucucagcuc

SEQ ID NO: 1300486 - RNA, 24 nt, Human
caaaagaaacacuucgauucucau

SEQ ID NO: 1300487 - RNA, 23 nt, Human
caaccuccaccucccaggcucaa

SEQ ID NO: 1300488 - RNA, 24 nt, Human
caaccuccaccucccaggcucaag

SEQ ID NO: 1300489 - RNA, 24 nt, Human
caagaccauccuggcuaagacggu

SEQ ID NO: 1300490 - RNA, 22 nt, Human
caagcaugcacccaccaugccc

SEQ ID NO: 1300491 - RNA, 27 nt, Human
caagcgauccucccaccucagccuccu

SEQ ID NO: 1300492 - RNA, 22 nt, Human
cacagcaaggugguuuuaucag

SEQ ID NO: 1300493 - RNA, 18 nt, Human
caccaaaaagacagagcu

SEQ ID NO: 1300494 - RNA, 24 nt, Human
caccauguugcccaggcuggucuc

SEQ ID NO: 1300495 - RNA, 19 nt, Human
cacccaccaugcccagcuu

SEQ ID NO: 1300496 - RNA, 21 nt, Human
cacugcaaccuccaccuccca

SEQ ID NO: 1300497 - RNA, 23 nt, Human
cagaacaccuagagaaagaacuc

SEQ ID NO: 1300498 - RNA, 23 nt, Human
cagaacaccuagagaaaggggag

SEQ ID NO: 1300499 - RNA, 19 nt, Human
cagagcgcaagcaaucugc

SEQ ID NO: 1300500 - RNA, 19 nt, Human
cagagcgcaagcaaucugc

SEQ ID NO: 1300501 - RNA, 18 nt, Human
cagcaaggugguuuuauc

SEQ ID NO: 1300502 - RNA, 24 nt, Human
caggguuucaccauguugcccagg

SEQ ID NO: 1300503 - RNA, 24 nt, Human
caguaaucaaacaggcucugccag

SEQ ID NO: 1300504 - RNA, 19 nt, Human
cagucucccaaaaaguuau

SEQ ID NO: 1300505 - RNA, 21 nt, Human
cauagcuagagacuaaagaaa

SEQ ID NO: 1300506 - RNA, 23 nt, Human
cauguugcccaggcuggucucga

SEQ ID NO: 1300507 - RNA, 24 nt, Human
cauguugcccaggcuggucucgag

SEQ ID NO: 1300508 - RNA, 26 nt, Human
cauguugcccaggcuggucucgagcu

SEQ ID NO: 1300509 - RNA, 22 nt, Human
ccaccucagccuccucaguagc

SEQ ID NO: 1300510 - RNA, 24 nt, Human
ccaccucccaggcucaagcgaucc

SEQ ID NO: 1300511 - RNA, 20 nt, Human
cccaggcucaagcgauccuc

SEQ ID NO: 1300512 - RNA, 21 nt, Human
ccccagagcuugguacaccuc

SEQ ID NO: 1300513 - RNA, 21 nt, Human
cccuaucccccaucacacaca

SEQ ID NO: 1300514 - RNA, 22 nt, Human
ccgccuaacucugcaacagaaa

SEQ ID NO: 1300515 - RNA, 24 nt, Human
ccucccaccucagccuccucagua

SEQ ID NO: 1300516 - RNA, 22 nt, Human
ccugggugacagaguaagacuc

SEQ ID NO: 1300517 - RNA, 21 nt, Human
cgccuggccugaccucaauuu

SEQ ID NO: 1300518 - RNA, 24 nt, Human
cucaagcgauccucccaccucagc

SEQ ID NO: 1300519 - RNA, 24 nt, Human
cucaauacuuaacucuaccucuac

SEQ ID NO: 1300520 - RNA, 24 nt, Human
cucacugcaaccuccaccucccag

SEQ ID NO: 1300521 - RNA, 24 nt, Human
cucagccuccucaguagcugggac

SEQ ID NO: 1300522 - RNA, 25 nt, Human
cucccaggcucaagcgauccuccca

SEQ ID NO: 1300523 - RNA, 25 nt, Human
cucucagaacaccuagagaaagaac

SEQ ID NO: 1300524 - RNA, 19 nt, Human
cucugucucaaaaaaaaaa

SEQ ID NO: 1300525 - RNA, 23 nt, Human
cugaucagaaauauuugucuguu

SEQ ID NO: 1300526 - RNA, 22 nt, Human
cugcaacagaaacauuucccag

SEQ ID NO: 1300527 - RNA, 23 nt, Human
cugcaaccuccaccucccaggcu

SEQ ID NO: 1300528 - RNA, 18 nt, Human
gacaagcaugcacccacc

SEQ ID NO: 1300529 - RNA, 24 nt, Human
gacagaguaagacucugucucaaa

SEQ ID NO: 1300530 - RNA, 20 nt, Human
gaugagguagaaaaggguag

SEQ ID NO: 1300531 - RNA, 22 nt, Human
gcaaccuccaccucccaggcuc

SEQ ID NO: 1300532 - RNA, 18 nt, Human
gcagaaaaugccuuccuc

SEQ ID NO: 1300533 - RNA, 20 nt, Human
gccuaacucugcaacagaaa

SEQ ID NO: 1300534 - RNA, 22 nt, Human
gccuaacucugcaacagaaaca

SEQ ID NO: 1300535 - RNA, 23 nt, Human
gcuggaauaacaggagugaacca

SEQ ID NO: 1300536 - RNA, 19 nt, Human
ggacuaucugaucagaaau

SEQ ID NO: 1300537 - RNA, 23 nt, Human
gggaaaaaaaaacccaaaagaaa

SEQ ID NO: 1300538 - RNA, 23 nt, Human
gguauaaaagcaauauccagaaa

SEQ ID NO: 1300539 - RNA, 21 nt, Human
ggugcagaucacgaggucagg

SEQ ID NO: 1300540 - RNA, 21 nt, Human
guagagacaggguuucaccau

SEQ ID NO: 1300541 - RNA, 22 nt, Human
guagagacaggguuucaccaug

SEQ ID NO: 1300542 - RNA, 19 nt, Human
gugcagaucacgaggucag

SEQ ID NO: 1300543 - RNA, 18 nt, Human
guuacuuuaaaaugcugu

SEQ ID NO: 1300544 - RNA, 24 nt, Human
guuucaccauguugcccaggcugg

SEQ ID NO: 1300545 - RNA, 28 nt, Human
uaaaaaaaaaaacagugccuucagauaa

SEQ ID NO: 1300546 - RNA, 23 nt, Human
uaaaaaagcacaauuaaaaagua

SEQ ID NO: 1300547 - RNA, 23 nt, Human
uaaaugacacaguaaagguggaa

SEQ ID NO: 1300548 - RNA, 18 nt, Human
uaacucccuaucccccau

SEQ ID NO: 1300549 - RNA, 18 nt, Human
uaagaaggaagccugacc

SEQ ID NO: 1300550 - RNA, 25 nt, Human
uacaacaaaugaugagguagaaaag

SEQ ID NO: 1300551 - RNA, 19 nt, Human
uaccccagagcuugguaca

SEQ ID NO: 1300552 - RNA, 22 nt, Human
uagagacaggguuucaccaugu

SEQ ID NO: 1300553 - RNA, 18 nt, Human
uagcgaaagacugaaguu

SEQ ID NO: 1300554 - RNA, 21 nt, Human
uaggcaagaaugcagaaaaug

SEQ ID NO: 1300555 - RNA, 22 nt, Human
uaggggcucuaauaagauguua

SEQ ID NO: 1300556 - RNA, 21 nt, Human
ucaaagaaagaauaccuaaac

SEQ ID NO: 1300557 - RNA, 24 nt, Human
ucaagacuggcacucaauacuuaa

SEQ ID NO: 1300558 - RNA, 22 nt, Human
ucaagguugcuaugaggucuac

SEQ ID NO: 1300559 - RNA, 21 nt, Human
ucaccauguugcccaggcugg

SEQ ID NO: 1300560 - RNA, 22 nt, Human
ucacccaggugggagcgcagga

SEQ ID NO: 1300561 - RNA, 18 nt, Human
ucacgaggucaggagauc

SEQ ID NO: 1300562 - RNA, 24 nt, Human
ucacgaggucaggagaucaagacc

SEQ ID NO: 1300563 - RNA, 24 nt, Human
ucacugcaaccuccaccucccagg

SEQ ID NO: 1300564 - RNA, 25 nt, Human
ucacugcaaccuccaccucccaggc

SEQ ID NO: 1300565 - RNA, 27 nt, Human
ucacugcaaccuccaccucccaggcuc

SEQ ID NO: 1300566 - RNA, 25 nt, Human
ucagcucacugcaaccuccaccucc

SEQ ID NO: 1300567 - RNA, 25 nt, Human
ucaguagcugggacaagccgggguc

SEQ ID NO: 1300568 - RNA, 18 nt, Human
ucaucuagugagcuggcc

SEQ ID NO: 1300569 - RNA, 24 nt, Human
uccagccugggugacagaguaaga

SEQ ID NO: 1300570 - RNA, 21 nt, Human
ucccaggcucaagcgauccuc

SEQ ID NO: 1300571 - RNA, 21 nt, Human
uccuggcuaagacggugaaac

SEQ ID NO: 1300572 - RNA, 20 nt, Human
uccuuuuuuuugagacagag

SEQ ID NO: 1300573 - RNA, 26 nt, Human
ucugcaacagaaacauuucccaggac

SEQ ID NO: 1300574 - RNA, 19 nt, Human
ucugucacccaggugggag

SEQ ID NO: 1300575 - RNA, 24 nt, Human
ucugucacccaggugggagcgcag

SEQ ID NO: 1300576 - RNA, 22 nt, Human
ugaaaaaaugaggcaaacuaca

SEQ ID NO: 1300577 - RNA, 30 nt, Human
ugaaaagaaagugaaaaaaugaggcaaaac

SEQ ID NO: 1300578 - RNA, 19 nt, Human
ugagacagcgucucuguca

SEQ ID NO: 1300579 - RNA, 22 nt, Human
ugagguauucugaauauauacc

SEQ ID NO: 1300580 - RNA, 21 nt, Human
ugaugagguagaaaaggguag

SEQ ID NO: 1300581 - RNA, 25 nt, Human
ugauuuuaaaagggggaaaaaaaaa

SEQ ID NO: 1300582 - RNA, 21 nt, Human
ugcccaggcuggucucgagcu

SEQ ID NO: 1300583 - RNA, 25 nt, Human
ugccuuccucuuuccucaucuagug

SEQ ID NO: 1300584 - RNA, 22 nt, Human
ugcuaugaggucuaccuugcca

SEQ ID NO: 1300585 - RNA, 20 nt, Human
uggaaggguuuuuuuuucuu

SEQ ID NO: 1300586 - RNA, 24 nt, Human
uggaauaacaggagugaaccaccg

SEQ ID NO: 1300587 - RNA, 28 nt, Human
uggauugcaguggugccauccuagcacg

SEQ ID NO: 1300588 - RNA, 21 nt, Human
ugggacaagcaugcacccacc

SEQ ID NO: 1300589 - RNA, 23 nt, Human
ugguagagacaggguuucaccau

SEQ ID NO: 1300590 - RNA, 24 nt, Human
ugguagagacaggguuucaccaug

SEQ ID NO: 1300591 - RNA, 24 nt, Human
uggugccaucucagcucacugcaa

SEQ ID NO: 1300592 - RNA, 22 nt, Human
uguaagaaggaagccugaccuc

SEQ ID NO: 1300593 - RNA, 22 nt, Human
uguauacugcuuuuuauauaug

SEQ ID NO: 1300594 - RNA, 23 nt, Human
uuaucuaaagauacuguaguuac

SEQ ID NO: 1300595 - RNA, 21 nt, Human
uugagacagagucucugucac

SEQ ID NO: 1300596 - RNA, 21 nt, Human
uugagacagcgucucugucac

SEQ ID NO: 1300597 - RNA, 24 nt, Human
uugguagagacaggguuucaccau

SEQ ID NO: 1300598 - RNA, 19 nt, Human
uuuaaaagggggaaaaaaa

SEQ ID NO: 1300599 - RNA, 24 nt, Human
uuucaccauguugcccaggcuggu

SEQ ID NO: 1300600 - RNA, 23 nt, Human
uuucuuagugcugagacaacagg

SEQ ID NO: 1300601 - RNA, 22 nt, Human
uuuuugguagagacaggguuuc

SEQ ID NO: 1300602 - RNA, 24 nt, Human
uuuuugguagagacaggguuucac

SEQ ID NO: 1300603 - RNA, 21 nt, Human
uuuuuguauuuuugguagaga

SEQ ID NO: 1300604 - RNA, 21 nt, Human
uuuuuuguauuuuugguagag

SEQ ID NO: 1300605 - RNA, 24 nt, Human
uuuuuuguauuuuugguagagaca

SEQ ID NO: 1300606 - RNA, 24 nt, Human
uuuuuuuuguauuuuugguagaga

SEQ ID NO: 1300607 - RNA, 22 nt, Human
uuuuuuuuucuuaagggagacc

SEQ ID NO: 1300608 - RNA, 24 nt, Human
auaccaggucccugaggguuugag

SEQ ID NO: 1300609 - RNA, 23 nt, Human
aucauuugcuucuuuuuuuuuuu

SEQ ID NO: 1300610 - RNA, 19 nt, Human
auggagggagcugauuaca

SEQ ID NO: 1300611 - RNA, 22 nt, Human
caaauagcaguuguugugugaa

SEQ ID NO: 1300612 - RNA, 20 nt, Human
caaugcaugcagaauauaua

SEQ ID NO: 1300613 - RNA, 21 nt, Human
caggaagcaacuacuaaccuu

SEQ ID NO: 1300614 - RNA, 20 nt, Human
cuuagggcuggggaacaaaa

SEQ ID NO: 1300615 - RNA, 22 nt, Human
gggaacaaaagggaagagaugg

SEQ ID NO: 1300616 - RNA, 20 nt, Human
gggcuggggaacaaaaggga

SEQ ID NO: 1300617 - RNA, 18 nt, Human
uaaacacaggaagcaacu

SEQ ID NO: 1300618 - RNA, 24 nt, Human
uauagggagagguuauagaucugg

SEQ ID NO: 1300619 - RNA, 24 nt, Human
ucauuugcuucuuuuuuuuuuuuu

SEQ ID NO: 1300620 - RNA, 29 nt, Human
ucauuugcuucuuuuuuuuuuuuuccuuu

SEQ ID NO: 1300621 - RNA, 21 nt, Human
uccguacacaucugcugauug

SEQ ID NO: 1300622 - RNA, 18 nt, Human
ugaagagggccauggaga

SEQ ID NO: 1300623 - RNA, 22 nt, Human
ugucuugguaucauuugcuucu

SEQ ID NO: 1300624 - RNA, 22 nt, Human
uugagccuacuucaaugcaugc

SEQ ID NO: 1300625 - RNA, 19 nt, Human
uuggguaauaaggcugaag

SEQ ID NO: 1300626 - RNA, 22 nt, Human
aaaaacacaagcauuugacaag

SEQ ID NO: 1300627 - RNA, 22 nt, Human
aaaaagaggauucauacccuag

SEQ ID NO: 1300628 - RNA, 23 nt, Human
aaauaaugcaaguucuggcccuc

SEQ ID NO: 1300629 - RNA, 19 nt, Human
aaauacacaccugugcaca

SEQ ID NO: 1300630 - RNA, 19 nt, Human
aacauuuuccuaacaagua

SEQ ID NO: 1300631 - RNA, 23 nt, Human
aacuaucagaauuaaguaagcaa

SEQ ID NO: 1300632 - RNA, 19 nt, Human
aagcacauaaggguugcuu

SEQ ID NO: 1300633 - RNA, 20 nt, Human
aagcuuuugagagcaaacca

SEQ ID NO: 1300634 - RNA, 26 nt, Human
aaguacuaaaaugcugcaaauuaacu

SEQ ID NO: 1300635 - RNA, 20 nt, Human
aagugaagaaguaaaguuuu

SEQ ID NO: 1300636 - RNA, 21 nt, Human
aaguguaaaaacacaagcauu

SEQ ID NO: 1300637 - RNA, 31 nt, Human
acacacacacgcaaacacacacacacacaca

SEQ ID NO: 1300638 - RNA, 33 nt, Human
acacacacgcaaacacacacacacacacacagu

SEQ ID NO: 1300639 - RNA, 24 nt, Human
acacacgcaaacacacacacacac

SEQ ID NO: 1300640 - RNA, 19 nt, Human
acauaguccucucuguuuc

SEQ ID NO: 1300641 - RNA, 26 nt, Human
accugugcacauacacacacacgcaa

SEQ ID NO: 1300642 - RNA, 18 nt, Human
acucacaaacauuuuccu

SEQ ID NO: 1300643 - RNA, 23 nt, Human
acuuuuuucugugcgcucugcuu

SEQ ID NO: 1300644 - RNA, 22 nt, Human
agaaaaaugaucagaaccugaa

SEQ ID NO: 1300645 - RNA, 18 nt, Human
agaaucacuggggagaag

SEQ ID NO: 1300646 - RNA, 20 nt, Human
agguaaguggaagcuguugg

SEQ ID NO: 1300647 - RNA, 21 nt, Human
aguguucuguaaguuucccuu

SEQ ID NO: 1300648 - RNA, 22 nt, Human
auagcugaagaggguuaaguau

SEQ ID NO: 1300649 - RNA, 23 nt, Human
auguccagugcuccagacugaau

SEQ ID NO: 1300650 - RNA, 22 nt, Human
augucuccugucagagugagca

SEQ ID NO: 1300651 - RNA, 22 nt, Human
caaaaugaucccugauuuauga

SEQ ID NO: 1300652 - RNA, 27 nt, Human
cacacaaauacacaccugugcacauac

SEQ ID NO: 1300653 - RNA, 18 nt, Human
cacacacacacacacaca

SEQ ID NO: 1300654 - RNA, 22 nt, Human
cacacacacgcaaacacacaca

SEQ ID NO: 1300655 - RNA, 22 nt, Human
ccacauaguccucucuguuucu

SEQ ID NO: 1300656 - RNA, 25 nt, Human
ccacauaguccucucuguuucugug

SEQ ID NO: 1300657 - RNA, 19 nt, Human
ccagucucucuuaugaguc

SEQ ID NO: 1300658 - RNA, 23 nt, Human
ccugaauuuuaacagagaaaggg

SEQ ID NO: 1300659 - RNA, 20 nt, Human
cugaccaaaaauaaauaaua

SEQ ID NO: 1300660 - RNA, 21 nt, Human
cugcugggguuaacuaugugu

SEQ ID NO: 1300661 - RNA, 22 nt, Human
cuuauaaaccccaacuucuugc

SEQ ID NO: 1300662 - RNA, 20 nt, Human
cuuuccacauaguccucucu

SEQ ID NO: 1300663 - RNA, 19 nt, Human
gaaaaaaaaaaaaaagagg

SEQ ID NO: 1300664 - RNA, 21 nt, Human
gaauggucuuucaccaauaaa

SEQ ID NO: 1300665 - RNA, 25 nt, Human
gcacauacacacacacgcaaacaca

SEQ ID NO: 1300666 - RNA, 25 nt, Human
gcaggcuucccugcugguaaggcuu

SEQ ID NO: 1300667 - RNA, 20 nt, Human
gguaugccauaaaguaugcc

SEQ ID NO: 1300668 - RNA, 18 nt, Human
guaaugcauucaaagccc

SEQ ID NO: 1300669 - RNA, 23 nt, Human
gugaaaaaaaaaaaaaagaggau

SEQ ID NO: 1300670 - RNA, 18 nt, Human
uaaaaaagcucaauacaa

SEQ ID NO: 1300671 - RNA, 21 nt, Human
uaaaaacacaagcauuugaca

SEQ ID NO: 1300672 - RNA, 25 nt, Human
uaaaaacacaagcauuugacaaggu

SEQ ID NO: 1300673 - RNA, 23 nt, Human
uaaaaagaaagaugacccugaca

SEQ ID NO: 1300674 - RNA, 19 nt, Human
uaaaauuguuuugaaauau

SEQ ID NO: 1300675 - RNA, 22 nt, Human
uaacugguaacuaaauucauaa

SEQ ID NO: 1300676 - RNA, 18 nt, Human
uaaguauagaucucagag

SEQ ID NO: 1300677 - RNA, 18 nt, Human
uaauagcugaagaggguu

SEQ ID NO: 1300678 - RNA, 19 nt, Human
uaaugcaaguucuggcccu

SEQ ID NO: 1300679 - RNA, 23 nt, Human
uacaaguacuaaaaugcugcaaa

SEQ ID NO: 1300680 - RNA, 19 nt, Human
uacacacaaacacaagugu

SEQ ID NO: 1300681 - RNA, 26 nt, Human
uacacacacacgcaaacacacacaca

SEQ ID NO: 1300682 - RNA, 22 nt, Human
uacccaauuaguagagaguuua

SEQ ID NO: 1300683 - RNA, 31 nt, Human
uaccuuauaaaccccaacuucuugcuaaauu

SEQ ID NO: 1300684 - RNA, 26 nt, Human
uagacacacaaauacacaccugugca

SEQ ID NO: 1300685 - RNA, 18 nt, Human
uauaaucaaauguuaacu

SEQ ID NO: 1300686 - RNA, 19 nt, Human
uauaaucaaauguuaacuc

SEQ ID NO: 1300687 - RNA, 19 nt, Human
uaucgcccaccaaaaugaa

SEQ ID NO: 1300688 - RNA, 22 nt, Human
uauguaaugcauucaaagcccc

SEQ ID NO: 1300689 - RNA, 25 nt, Human
uauuauguaaugcauucaaagcccc

SEQ ID NO: 1300690 - RNA, 24 nt, Human
ucaaagcccccaaaguuuuccaag

SEQ ID NO: 1300691 - RNA, 20 nt, Human
ucaaauguuaacucaauaau

SEQ ID NO: 1300692 - RNA, 22 nt, Human
ucagaaccugaauuuuaacaga

SEQ ID NO: 1300693 - RNA, 21 nt, Human
uccacagugaaaacccugaau

SEQ ID NO: 1300694 - RNA, 23 nt, Human
uccacagugaaaacccugaauaa

SEQ ID NO: 1300695 - RNA, 24 nt, Human
uccacagugaaaacccugaauaaa

SEQ ID NO: 1300696 - RNA, 22 nt, Human
ucucagagaccaaauaacugcu

SEQ ID NO: 1300697 - RNA, 19 nt, Human
ucuguagaguuagcugaug

SEQ ID NO: 1300698 - RNA, 21 nt, Human
ugaauuuucagaagaaggauc

SEQ ID NO: 1300699 - RNA, 19 nt, Human
ugagugcauuuuguauuuc

SEQ ID NO: 1300700 - RNA, 24 nt, Human
ugcacugcccagcuucuaacuacc

SEQ ID NO: 1300701 - RNA, 25 nt, Human
ugcuuuauuuauguccagugcucca

SEQ ID NO: 1300702 - RNA, 20 nt, Human
ugcuuuccauugggggaagg

SEQ ID NO: 1300703 - RNA, 23 nt, Human
uggaauggucuuucaccaauaaa

SEQ ID NO: 1300704 - RNA, 25 nt, Human
uggcuuagaaaaaugaucagaaccu

SEQ ID NO: 1300705 - RNA, 20 nt, Human
uggggugaaaaaaaaaaaaa

SEQ ID NO: 1300706 - RNA, 22 nt, Human
uggggugaaaaaaaaaaaaaag

SEQ ID NO: 1300707 - RNA, 21 nt, Human
uguaauucccacguguguaua

SEQ ID NO: 1300708 - RNA, 24 nt, Human
uguaucgcccaccaaaaugaaauc

SEQ ID NO: 1300709 - RNA, 22 nt, Human
ugugcacauacacacacacgca

SEQ ID NO: 1300710 - RNA, 26 nt, Human
ugugcacauacacacacacgcaaaca

SEQ ID NO: 1300711 - RNA, 18 nt, Human
uuacucguuuucccacaa

SEQ ID NO: 1300712 - RNA, 21 nt, Human
uucaaagcccccaaaguuuuc

SEQ ID NO: 1300713 - RNA, 25 nt, Human
uucaagacccugaacaaacugcaaa

SEQ ID NO: 1300714 - RNA, 19 nt, Human
uucaaguagauugaguuua

SEQ ID NO: 1300715 - RNA, 24 nt, Human
uucauaaaguacuuugaaaguuua

SEQ ID NO: 1300716 - RNA, 21 nt, Human
uuccugguggaugcacuugag

SEQ ID NO: 1300717 - RNA, 26 nt, Human
uugaggaacauucaaauaaguagaaa

SEQ ID NO: 1300718 - RNA, 26 nt, Human
uuuaauuuacuauuucugaccaaaaa

SEQ ID NO: 1300719 - RNA, 23 nt, Human
uuucaaguagauugaguuuacuu

SEQ ID NO: 1300720 - RNA, 25 nt, Human
uuugaaauauguacuuuaccuuuaa

SEQ ID NO: 1300721 - RNA, 19 nt, Human
uuugaaaugucacagcagc

SEQ ID NO: 1300722 - RNA, 20 nt, Human
uuugaaaugucacagcagca

SEQ ID NO: 1300723 - RNA, 20 nt, Human
uuuuggacuuaggaaaacug

SEQ ID NO: 1300724 - RNA, 24 nt, Human
uuuuuugagguaugccauaaagua

SEQ ID NO: 1300725 - RNA, 23 nt, Human
cacccaaaccacagguugcagaa

SEQ ID NO: 1300726 - RNA, 23 nt, Human
cccaaaccacagguugcagaaaa

SEQ ID NO: 1300727 - RNA, 18 nt, Human
ccucacacccaaaccaca

SEQ ID NO: 1300728 - RNA, 22 nt, Human
cucccucuuccucacacccaaa

SEQ ID NO: 1300729 - RNA, 24 nt, Human
ucacacccaaaccacagguugcaa

SEQ ID NO: 1300730 - RNA, 24 nt, Human
ucccucuuccucacacccaaacca

SEQ ID NO: 1300731 - RNA, 24 nt, Human
uccucacacccaaaccacagguug

SEQ ID NO: 1300732 - RNA, 22 nt, Human
aaacagaagaaaaccagauucu

SEQ ID NO: 1300733 - RNA, 19 nt, Human
acagaagaaaaccagauuc

SEQ ID NO: 1300734 - RNA, 22 nt, Human
caaacagaagaaaaccagauuc

SEQ ID NO: 1300735 - RNA, 22 nt, Human
uauagcucaguaucaaauccaa

SEQ ID NO: 1300736 - RNA, 22 nt, Human
uaucaaauccaaacagaagaaa

SEQ ID NO: 1300737 - RNA, 24 nt, Human
ucaaauccaaacagaagaaaacca

SEQ ID NO: 1300738 - RNA, 19 nt, Human
uccaaacagaagaaaacca

SEQ ID NO: 1300739 - RNA, 22 nt, Human
ugaauccaguauagcucaguau

SEQ ID NO: 1300740 - RNA, 19 nt, Human
uguacuugguugcuuguga

SEQ ID NO: 1300741 - RNA, 25 nt, Human
ugucagugaauccaguauagcucag

SEQ ID NO: 1300742 - RNA, 19 nt, Human
uugguugcuugugauuuau

SEQ ID NO: 1300743 - RNA, 22 nt, Human
aaacagaagaaaaccagauucu

SEQ ID NO: 1300744 - RNA, 19 nt, Human
acagaagaaaaccagauuc

SEQ ID NO: 1300745 - RNA, 22 nt, Human
uauagcucaguaucaaauccaa

SEQ ID NO: 1300746 - RNA, 22 nt, Human
uaucaaauccaaacagaagaaa

SEQ ID NO: 1300747 - RNA, 24 nt, Human
ucaaauccaaacagaagaaaacca

SEQ ID NO: 1300748 - RNA, 19 nt, Human
uccaaacagaagaaaacca

SEQ ID NO: 1300749 - RNA, 22 nt, Human
ugaauccaguauagcucaguau

SEQ ID NO: 1300750 - RNA, 19 nt, Human
uguacuugguugcuuguga

SEQ ID NO: 1300751 - RNA, 25 nt, Human
ugucagugaauccaguauagcucag

SEQ ID NO: 1300752 - RNA, 19 nt, Human
uugguugcuugugauuuau

SEQ ID NO: 1300753 - RNA, 24 nt, Human
aaagagccugggggagaggggagg

SEQ ID NO: 1300754 - RNA, 21 nt, Human
aaauggccggggagggggugc

SEQ ID NO: 1300755 - RNA, 23 nt, Human
accagugcccccucccuccccag

SEQ ID NO: 1300756 - RNA, 21 nt, Human
agagccugggggagaggggag

SEQ ID NO: 1300757 - RNA, 19 nt, Human
agagcucugcccagccgcu

SEQ ID NO: 1300758 - RNA, 18 nt, Human
agaggagccccugccccu

SEQ ID NO: 1300759 - RNA, 24 nt, Human
agccugggggagaggggagggcca

SEQ ID NO: 1300760 - RNA, 18 nt, Human
aggggcagggcugggggu

SEQ ID NO: 1300761 - RNA, 22 nt, Human
caaggggacgccccccggcccg

SEQ ID NO: 1300762 - RNA, 20 nt, Human
cagaauuuccagggucaagc

SEQ ID NO: 1300763 - RNA, 19 nt, Human
cagcagcaguuuggggguu

SEQ ID NO: 1300764 - RNA, 21 nt, Human
cagcagcaguuuggggguugg

SEQ ID NO: 1300765 - RNA, 19 nt, Human
caggguggggguggagggg

SEQ ID NO: 1300766 - RNA, 22 nt, Human
cagugcccccucccuccccagg

SEQ ID NO: 1300767 - RNA, 21 nt, Human
ccaaggggcagggcugggggu

SEQ ID NO: 1300768 - RNA, 22 nt, Human
cccagccgcucuaguccaaggg

SEQ ID NO: 1300769 - RNA, 23 nt, Human
cccccugcugagccugcucauuc

SEQ ID NO: 1300770 - RNA, 21 nt, Human
ccccgcgccgggcggcggccc

SEQ ID NO: 1300771 - RNA, 18 nt, Human
cccguggggcucggggga

SEQ ID NO: 1300772 - RNA, 20 nt, Human
ccgcugccggcugcccgggc

SEQ ID NO: 1300773 - RNA, 19 nt, Human
ccucgcccgcggcucccuc

SEQ ID NO: 1300774 - RNA, 24 nt, Human
cgaaauggacaaggccggaggucc

SEQ ID NO: 1300775 - RNA, 18 nt, Human
cggcccggggggcgccag

SEQ ID NO: 1300776 - RNA, 23 nt, Human
cggccgggcauggcccguggggc

SEQ ID NO: 1300777 - RNA, 22 nt, Human
cgggaccgggaccgcggggccg

SEQ ID NO: 1300778 - RNA, 24 nt, Human
cggggccguggggggcgcggggcg

SEQ ID NO: 1300779 - RNA, 20 nt, Human
cggggggcgccagcgcgggg

SEQ ID NO: 1300780 - RNA, 21 nt, Human
cuccccagggcugaggccucu

SEQ ID NO: 1300781 - RNA, 22 nt, Human
cuccccagggcugaggccucug

SEQ ID NO: 1300782 - RNA, 23 nt, Human
cuccccagggcugaggccucugc

SEQ ID NO: 1300783 - RNA, 18 nt, Human
cucccuggccggcuuccc

SEQ ID NO: 1300784 - RNA, 21 nt, Human
cucgcucccuggccggcuucc

SEQ ID NO: 1300785 - RNA, 18 nt, Human
cugagccugcucauuccc

SEQ ID NO: 1300786 - RNA, 18 nt, Human
cugccccccugcugagcc

SEQ ID NO: 1300787 - RNA, 18 nt, Human
cugcccgggccccgaucg

SEQ ID NO: 1300788 - RNA, 20 nt, Human
gaaagagccugggggagagg

SEQ ID NO: 1300789 - RNA, 21 nt, Human
gagccccugccccuguuuaga

SEQ ID NO: 1300790 - RNA, 26 nt, Human
gagccucaggguggggguggaggggg

SEQ ID NO: 1300791 - RNA, 19 nt, Human
gagggggauggcccagaau

SEQ ID NO: 1300792 - RNA, 21 nt, Human
gaucccucgcccgcggcuccc

SEQ ID NO: 1300793 - RNA, 19 nt, Human
gcccgggccccgaucgcuc

SEQ ID NO: 1300794 - RNA, 21 nt, Human
gcggccaaggggcagggcugg

SEQ ID NO: 1300795 - RNA, 18 nt, Human
gcggggcgcgggccggug

SEQ ID NO: 1300796 - RNA, 23 nt, Human
gcggggcgcgggccggugggcuc

SEQ ID NO: 1300797 - RNA, 18 nt, Human
gcucccuggccggcuucc

SEQ ID NO: 1300798 - RNA, 18 nt, Human
gcucgggggacgugggug

SEQ ID NO: 1300799 - RNA, 19 nt, Human
gcucugaaggcgggguggg

SEQ ID NO: 1300800 - RNA, 18 nt, Human
ggacgugggugaugcggc

SEQ ID NO: 1300801 - RNA, 19 nt, Human
ggagaggggagggcagacu

SEQ ID NO: 1300802 - RNA, 19 nt, Human
ggcagacuagggguggggc

SEQ ID NO: 1300803 - RNA, 26 nt, Human
ggcccggggggcgccagcgcggggcc

SEQ ID NO: 1300804 - RNA, 25 nt, Human
gggagaggggagggcagacuagggg

SEQ ID NO: 1300805 - RNA, 18 nt, Human
gggcauggcccguggggc

SEQ ID NO: 1300806 - RNA, 21 nt, Human
gggcugggggugcacaggcgu

SEQ ID NO: 1300807 - RNA, 19 nt, Human
gggggagaggggagggcag

SEQ ID NO: 1300808 - RNA, 19 nt, Human
ggguuccccgcagcagcag

SEQ ID NO: 1300809 - RNA, 22 nt, Human
ggguuccccgcagcagcaguuu

SEQ ID NO: 1300810 - RNA, 19 nt, Human
ggguuggagaggcuggggg

SEQ ID NO: 1300811 - RNA, 22 nt, Human
gugcggguacccccccaccugc

SEQ ID NO: 1300812 - RNA, 19 nt, Human
uccuccaggcgacauagaa

SEQ ID NO: 1300813 - RNA, 21 nt, Human
ucugcggccaaggggcagggc

SEQ ID NO: 1300814 - RNA, 21 nt, Human
ugcccccucccuccccagggc

SEQ ID NO: 1300815 - RNA, 24 nt, Human
uggagggggauggcccagaauuuc

SEQ ID NO: 1300816 - RNA, 21 nt, Human
uggcagaggagccccugcccc

SEQ ID NO: 1300817 - RNA, 21 nt, Human
uggcagggcccaaguuucccc

SEQ ID NO: 1300818 - RNA, 24 nt, Human
uggggggcgcggggcgcgggccgg

SEQ ID NO: 1300819 - RNA, 20 nt, Human
uggggguuggagaggcuggg

SEQ ID NO: 1300820 - RNA, 23 nt, Human
uggggguuggagaggcugggggc

SEQ ID NO: 1300821 - RNA, 18 nt, Human
uuagagcucugcccagcc

SEQ ID NO: 1300822 - RNA, 19 nt, Human
uuagagcucugcccagccg

SEQ ID NO: 1300823 - RNA, 23 nt, Human
uuggcagggcccaaguuuccccc

SEQ ID NO: 1300824 - RNA, 20 nt, Human
aaccacauucccgccaaguc

SEQ ID NO: 1300825 - RNA, 21 nt, Human
acaggcaccagccaccacgcc

SEQ ID NO: 1300826 - RNA, 21 nt, Human
acggggcgggggcggcucugc

SEQ ID NO: 1300827 - RNA, 18 nt, Human
acgggguuucacuguguu

SEQ ID NO: 1300828 - RNA, 19 nt, Human
acgggguuucacuguguua

SEQ ID NO: 1300829 - RNA, 20 nt, Human
acgggguuucacuguguuag

SEQ ID NO: 1300830 - RNA, 24 nt, Human
acgggguuucacuguguuagccag

SEQ ID NO: 1300831 - RNA, 21 nt, Human
acuguguggccuccuggcccc

SEQ ID NO: 1300832 - RNA, 21 nt, Human
agaaaaccacauucccgccaa

SEQ ID NO: 1300833 - RNA, 19 nt, Human
agccccgccccuccugccc

SEQ ID NO: 1300834 - RNA, 22 nt, Human
agcgaugggacagcaucuggaa

SEQ ID NO: 1300835 - RNA, 21 nt, Human
agucaaggaagagcggggcuu

SEQ ID NO: 1300836 - RNA, 20 nt, Human
agugaggaagcaggauucag

SEQ ID NO: 1300837 - RNA, 21 nt, Human
aucacuguguggccuccuggc

SEQ ID NO: 1300838 - RNA, 21 nt, Human
augugugaccgaaaaaggagg

SEQ ID NO: 1300839 - RNA, 20 nt, Human
caaaggauggacuugguguu

SEQ ID NO: 1300840 - RNA, 18 nt, Human
caacaggaaucccucagg

SEQ ID NO: 1300841 - RNA, 19 nt, Human
caacccacuggcacgucug

SEQ ID NO: 1300842 - RNA, 22 nt, Human
cacgccauucuccugccucagc

SEQ ID NO: 1300843 - RNA, 21 nt, Human
cacugcaagcuccuccuccug

SEQ ID NO: 1300844 - RNA, 19 nt, Human
cacuguguggccuccuggc

SEQ ID NO: 1300845 - RNA, 18 nt, Human
cacuguguuagccaggau

SEQ ID NO: 1300846 - RNA, 19 nt, Human
cacuguguuagccaggaug

SEQ ID NO: 1300847 - RNA, 24 nt, Human
cacuguguuagccaggauggucuc

SEQ ID NO: 1300848 - RNA, 23 nt, Human
cagauagcugggacuacaggcac

SEQ ID NO: 1300849 - RNA, 18 nt, Human
cagcacggugggccugac

SEQ ID NO: 1300850 - RNA, 19 nt, Human
caggagcaggaguccugug

SEQ ID NO: 1300851 - RNA, 20 nt, Human
ccacaaacgcguuguuccgc

SEQ ID NO: 1300852 - RNA, 20 nt, Human
ccaccacgcccggcuaauuu

SEQ ID NO: 1300853 - RNA, 20 nt, Human
ccagcugaucuuacauuuua

SEQ ID NO: 1300854 - RNA, 24 nt, Human
cccagauagcugggacuacaggca

SEQ ID NO: 1300855 - RNA, 21 nt, Human
ccccgugcagggcccugggcc

SEQ ID NO: 1300856 - RNA, 23 nt, Human
ccccugagcaccagcacgguggg

SEQ ID NO: 1300857 - RNA, 22 nt, Human
cccgccaagucugccuuccuca

SEQ ID NO: 1300858 - RNA, 18 nt, Human
cccucaccuuugaagaaa

SEQ ID NO: 1300859 - RNA, 19 nt, Human
cccuggcagcucccccuac

SEQ ID NO: 1300860 - RNA, 24 nt, Human
cccugggccgaagccccgccccuc

SEQ ID NO: 1300861 - RNA, 19 nt, Human
ccgccccuccugccccugc

SEQ ID NO: 1300862 - RNA, 18 nt, Human
ccucagggcuucuggaag

SEQ ID NO: 1300863 - RNA, 23 nt, Human
ccuccugccccugccggcugggc

SEQ ID NO: 1300864 - RNA, 19 nt, Human
ccuccuggccccauccuaa

SEQ ID NO: 1300865 - RNA, 19 nt, Human
ccuggcagcucccccuacc

SEQ ID NO: 1300866 - RNA, 19 nt, Human
ccuggccccauccuaaggc

SEQ ID NO: 1300867 - RNA, 19 nt, Human
ccuggccccguccuaaggc

SEQ ID NO: 1300868 - RNA, 19 nt, Human
ccuggccccguccuaaggc

SEQ ID NO: 1300869 - RNA, 22 nt, Human
ccuggccccguccuaaggcaag

SEQ ID NO: 1300870 - RNA, 18 nt, Human
cgccccuccugccccugc

SEQ ID NO: 1300871 - RNA, 25 nt, Human
cggugggccugacggggcgggggcg

SEQ ID NO: 1300872 - RNA, 18 nt, Human
cguccuaaggcgagugcc

SEQ ID NO: 1300873 - RNA, 21 nt, Human
cuaugcuguccucaaggucaa

SEQ ID NO: 1300874 - RNA, 23 nt, Human
cucacugcaagcuccuccuccug

SEQ ID NO: 1300875 - RNA, 20 nt, Human
cuccugccucagccucccag

SEQ ID NO: 1300876 - RNA, 21 nt, Human
cuccuggguucacgccauucu

SEQ ID NO: 1300877 - RNA, 21 nt, Human
cucgggacucugagcgauggg

SEQ ID NO: 1300878 - RNA, 22 nt, Human
cugagcaccagcacggugggcc

SEQ ID NO: 1300879 - RNA, 21 nt, Human
cugcagaggguggcuccuucu

SEQ ID NO: 1300880 - RNA, 23 nt, Human
cugccucagccucccagauagcu

SEQ ID NO: 1300881 - RNA, 23 nt, Human
cuggguaaccaacaggaaucccu

SEQ ID NO: 1300882 - RNA, 19 nt, Human
cuguggggcuggacgggag

SEQ ID NO: 1300883 - RNA, 22 nt, Human
cuucagggcuccugcagagggu

SEQ ID NO: 1300884 - RNA, 24 nt, Human
cuucugaccucgugaucugcccgc

SEQ ID NO: 1300885 - RNA, 21 nt, Human
gaagccccgccccuccugccc

SEQ ID NO: 1300886 - RNA, 22 nt, Human
gaccucgugaucugcccgccuc

SEQ ID NO: 1300887 - RNA, 24 nt, Human
gaccucgugaucugcccgccucgg

SEQ ID NO: 1300888 - RNA, 20 nt, Human
gcaagcgccuggccuccugg

SEQ ID NO: 1300889 - RNA, 22 nt, Human
gcaagcuccuccuccuggguuc

SEQ ID NO: 1300890 - RNA, 23 nt, Human
gcccggcuaauuuuuuguauuuu

SEQ ID NO: 1300891 - RNA, 20 nt, Human
gcccucuucuuguggaguuc

SEQ ID NO: 1300892 - RNA, 20 nt, Human
gccucggccucccaaagugg

SEQ ID NO: 1300893 - RNA, 22 nt, Human
gcucacugcaagcuccuccucc

SEQ ID NO: 1300894 - RNA, 19 nt, Human
gcucagagccccugggccc

SEQ ID NO: 1300895 - RNA, 20 nt, Human
gcucagagccccugggcccc

SEQ ID NO: 1300896 - RNA, 22 nt, Human
gcuguggggcuggacgggagac

SEQ ID NO: 1300897 - RNA, 18 nt, Human
ggaaaugcucagagcccc

SEQ ID NO: 1300898 - RNA, 19 nt, Human
ggcagcucccccuaccccc

SEQ ID NO: 1300899 - RNA, 21 nt, Human
ggcggcuccucagggcuucug

SEQ ID NO: 1300900 - RNA, 21 nt, Human
ggcgggggcggcucugcagga

SEQ ID NO: 1300901 - RNA, 23 nt, Human
gggguuucacuguguuagccagg

SEQ ID NO: 1300902 - RNA, 22 nt, Human
ggguuucacuguguuagccagg

SEQ ID NO: 1300903 - RNA, 20 nt, Human
ggucucgaucuucugaccuc

SEQ ID NO: 1300904 - RNA, 23 nt, Human
guagagacgggguuucacugugu

SEQ ID NO: 1300905 - RNA, 24 nt, Human
gugaucugcccgccucggccuccc

SEQ ID NO: 1300906 - RNA, 20 nt, Human
gugcucccagcaggaugcag

SEQ ID NO: 1300907 - RNA, 23 nt, Human
guggguguauccuguggcgucac

SEQ ID NO: 1300908 - RNA, 23 nt, Human
uaaguuacagaaaccacaguuga

SEQ ID NO: 1300909 - RNA, 24 nt, Human
uaauuuuuuguauuuuuaguagag

SEQ ID NO: 1300910 - RNA, 23 nt, Human
uacaggcaccagccaccacgccc

SEQ ID NO: 1300911 - RNA, 20 nt, Human
uaguagagacgggguuucac

SEQ ID NO: 1300912 - RNA, 24 nt, Human
uaguagagacgggguuucacugug

SEQ ID NO: 1300913 - RNA, 24 nt, Human
ucacugcaagcuccuccuccuggg

SEQ ID NO: 1300914 - RNA, 20 nt, Human
ucacuggggcccacaggugg

SEQ ID NO: 1300915 - RNA, 24 nt, Human
ucacuguguuagccaggauggucu

SEQ ID NO: 1300916 - RNA, 21 nt, Human
ucagggcuucuggaagguugu

SEQ ID NO: 1300917 - RNA, 20 nt, Human
uccauaugcuguggucaucg

SEQ ID NO: 1300918 - RNA, 23 nt, Human
ucccacaaacgcguuguuccgcc

SEQ ID NO: 1300919 - RNA, 24 nt, Human
ucccagauagcugggacuacaggc

SEQ ID NO: 1300920 - RNA, 27 nt, Human
ucccccuacccccucaccuuugaagaa

SEQ ID NO: 1300921 - RNA, 21 nt, Human
ucccgccaagucugccuuccu

SEQ ID NO: 1300922 - RNA, 22 nt, Human
ucccucaggcuguggggcugga

SEQ ID NO: 1300923 - RNA, 22 nt, Human
uccuaaggcaagcgccuggccu

SEQ ID NO: 1300924 - RNA, 22 nt, Human
uccuaaggcaagugccuggccu

SEQ ID NO: 1300925 - RNA, 22 nt, Human
uccuaaggcgagugccuggccu

SEQ ID NO: 1300926 - RNA, 20 nt, Human
uccucagggcuucuggaagg

SEQ ID NO: 1300927 - RNA, 25 nt, Human
uccuccuggguucacgccauucucc

SEQ ID NO: 1300928 - RNA, 24 nt, Human
uccuggguucacgccauucuccug

SEQ ID NO: 1300929 - RNA, 26 nt, Human
ucuccugccucagccucccagauagc

SEQ ID NO: 1300930 - RNA, 19 nt, Human
ucuggguaaccaacaggaa

SEQ ID NO: 1300931 - RNA, 19 nt, Human
ucuugugaggcgcuggccc

SEQ ID NO: 1300932 - RNA, 20 nt, Human
ucuugugaggcgcuggcccu

SEQ ID NO: 1300933 - RNA, 23 nt, Human
ugaggcgcuggcccucuucuugu

SEQ ID NO: 1300934 - RNA, 21 nt, Human
ugccggcugggcccuggcagc

SEQ ID NO: 1300935 - RNA, 24 nt, Human
ugccucagccucccagauagcugg

SEQ ID NO: 1300936 - RNA, 23 nt, Human
ugcuguggucaucgucucuuugu

SEQ ID NO: 1300937 - RNA, 22 nt, Human
uggcagcucccccuacccccuc

SEQ ID NO: 1300938 - RNA, 20 nt, Human
uggcccgaaacaaacugcgg

SEQ ID NO: 1300939 - RNA, 20 nt, Human
uggccuccuggccccauccu

SEQ ID NO: 1300940 - RNA, 19 nt, Human
uggccuccuggccccgucc

SEQ ID NO: 1300941 - RNA, 19 nt, Human
uggccuccuggccccgucc

SEQ ID NO: 1300942 - RNA, 20 nt, Human
uggccuccuggccccguccu

SEQ ID NO: 1300943 - RNA, 20 nt, Human
uggccuccuggccccguccu

SEQ ID NO: 1300944 - RNA, 21 nt, Human
ugggacuacaggcaccagcca

SEQ ID NO: 1300945 - RNA, 22 nt, Human
ugggacuacaggcaccagccac

SEQ ID NO: 1300946 - RNA, 24 nt, Human
ugggacuacaggcaccagccacca

SEQ ID NO: 1300947 - RNA, 19 nt, Human
ugggaugcuccauccaggg

SEQ ID NO: 1300948 - RNA, 20 nt, Human
uggggcccacaggugguggu

SEQ ID NO: 1300949 - RNA, 20 nt, Human
uggguucacgccauucuccu

SEQ ID NO: 1300950 - RNA, 21 nt, Human
uguauuuuuaguagagacggg

SEQ ID NO: 1300951 - RNA, 24 nt, Human
ugucaaagucaaggaagagcgggg

SEQ ID NO: 1300952 - RNA, 20 nt, Human
ugucucgggacucugagcga

SEQ ID NO: 1300953 - RNA, 18 nt, Human
uuaguagagacgggguuu

SEQ ID NO: 1300954 - RNA, 21 nt, Human
uuaguagagacgggguuucac

SEQ ID NO: 1300955 - RNA, 21 nt, Human
uuaguagagacgggguuucac

SEQ ID NO: 1300956 - RNA, 24 nt, Human
uuaguagagacgggguuucacugu

SEQ ID NO: 1300957 - RNA, 21 nt, Human
uucacuguguuagccaggaug

SEQ ID NO: 1300958 - RNA, 22 nt, Human
uucuccugccucagccucccag

SEQ ID NO: 1300959 - RNA, 20 nt, Human
uugaagaaaaccacauuccc

SEQ ID NO: 1300960 - RNA, 20 nt, Human
uugaucuugugaggcgcugg

SEQ ID NO: 1300961 - RNA, 23 nt, Human
uuguauuuuuaguagagacgggg

SEQ ID NO: 1300962 - RNA, 19 nt, Human
uuucacuguguuagccagg

SEQ ID NO: 1300963 - RNA, 18 nt, Human
uuugcugggcccucccug

SEQ ID NO: 1300964 - RNA, 24 nt, Human
uuuuuaguagagacgggguuucac

SEQ ID NO: 1300965 - RNA, 21 nt, Human
uuuuuguauuuuuaguagaga

SEQ ID NO: 1300966 - RNA, 24 nt, Human
uuuuuuguauuuuuaguagagacg

SEQ ID NO: 1300967 - RNA, 21 nt, Human
uuggucacagugauuauucuu

SEQ ID NO: 1300968 - RNA, 23 nt, Human
aaaaauuagccaggcaguggugg

SEQ ID NO: 1300969 - RNA, 24 nt, Human
aaagguugcagugagcugagaucg

SEQ ID NO: 1300970 - RNA, 21 nt, Human
aacacuugaaauagcuucuaa

SEQ ID NO: 1300971 - RNA, 19 nt, Human
aacauggugaaaccccauc

SEQ ID NO: 1300972 - RNA, 20 nt, Human
aacauggugaaaccccaucu

SEQ ID NO: 1300973 - RNA, 20 nt, Human
aacauggugaaaccccaucu

SEQ ID NO: 1300974 - RNA, 21 nt, Human
aacauggugaaaccccaucuc

SEQ ID NO: 1300975 - RNA, 23 nt, Human
aagaaaaaaaauuauuucuucca

SEQ ID NO: 1300976 - RNA, 22 nt, Human
aagagguuccacucagaaucca

SEQ ID NO: 1300977 - RNA, 26 nt, Human
aagcgggcggaucacuugaggucagg

SEQ ID NO: 1300978 - RNA, 24 nt, Human
aaucacuugagcccgggagacaaa

SEQ ID NO: 1300979 - RNA, 21 nt, Human
acaaaacuaugaagaaaaaaa

SEQ ID NO: 1300980 - RNA, 21 nt, Human
accacacuccagccuggugag

SEQ ID NO: 1300981 - RNA, 23 nt, Human
acucagaauccaacagaaccuuu

SEQ ID NO: 1300982 - RNA, 24 nt, Human
acuugaggucaggaguuugagacc

SEQ ID NO: 1300983 - RNA, 20 nt, Human
agacaaagguugcagugagc

SEQ ID NO: 1300984 - RNA, 24 nt, Human
agacaaagguugcagugagcugag

SEQ ID NO: 1300985 - RNA, 22 nt, Human
agccuggccaacauggugaaac

SEQ ID NO: 1300986 - RNA, 24 nt, Human
agccuggccaacauggugaaaccc

SEQ ID NO: 1300987 - RNA, 20 nt, Human
aggaguuugagaccagccug

SEQ ID NO: 1300988 - RNA, 25 nt, Human
aggcaaaaaguauagaaaggggacc

SEQ ID NO: 1300989 - RNA, 24 nt, Human
aggcugagggaggagaaucacuug

SEQ ID NO: 1300990 - RNA, 18 nt, Human
agggaggagaaucacuug

SEQ ID NO: 1300991 - RNA, 24 nt, Human
agggaggagaaucacuugagcccg

SEQ ID NO: 1300992 - RNA, 20 nt, Human
aguuguaacaauagcucugg

SEQ ID NO: 1300993 - RNA, 24 nt, Human
aucacuugaggucaggaguuugag

SEQ ID NO: 1300994 - RNA, 22 nt, Human
aucccaacacuuuggaaggcca

SEQ ID NO: 1300995 - RNA, 24 nt, Human
aucgugcuaccacacuccagccug

SEQ ID NO: 1300996 - RNA, 19 nt, Human
augccuguaaucccaacac

SEQ ID NO: 1300997 - RNA, 24 nt, Human
auuugaagauuucaccuuccacuu

SEQ ID NO: 1300998 - RNA, 18 nt, Human
caaaaacaccauuuuucc

SEQ ID NO: 1300999 - RNA, 18 nt, Human
caaaggcaaaaaguauag

SEQ ID NO: 1301000 - RNA, 26 nt, Human
caaaggcaaaaaguauagaaagacag

SEQ ID NO: 1301001 - RNA, 20 nt, Human
caaagucagaugcuuguccc

SEQ ID NO: 1301002 - RNA, 24 nt, Human
caacauggugaaaccccaucucua

SEQ ID NO: 1301003 - RNA, 24 nt, Human
caagcgggcggaucacuugagguc

SEQ ID NO: 1301004 - RNA, 24 nt, Human
caccaacgauuguugauucgugcu

SEQ ID NO: 1301005 - RNA, 20 nt, Human
caccuguaaucucagcugcu

SEQ ID NO: 1301006 - RNA, 24 nt, Human
caccuguaaucucagcugcuuggg

SEQ ID NO: 1301007 - RNA, 18 nt, Human
cacuccagccuggugagu

SEQ ID NO: 1301008 - RNA, 23 nt, Human
cacuugaggucaggaguuugaga

SEQ ID NO: 1301009 - RNA, 21 nt, Human
caguuguaacaauagcucugg

SEQ ID NO: 1301010 - RNA, 20 nt, Human
caugccuguaaucccaacac

SEQ ID NO: 1301011 - RNA, 24 nt, Human
caugccuguaaucccaacacuuug

SEQ ID NO: 1301012 - RNA, 24 nt, Human
ccaagcgggcggaucacuugaggu

SEQ ID NO: 1301013 - RNA, 26 nt, Human
ccaagcgggcggaucacuugagguca

SEQ ID NO: 1301014 - RNA, 24 nt, Human
ccagaaaguucugcuccagcaguu

SEQ ID NO: 1301015 - RNA, 19 nt, Human
ccaggaccugcagcgguga

SEQ ID NO: 1301016 - RNA, 21 nt, Human
ccugcaguuucuccaggaccu

SEQ ID NO: 1301017 - RNA, 23 nt, Human
ccuggccaacauggugaaacccc

SEQ ID NO: 1301018 - RNA, 24 nt, Human
ccuggccaacauggugaaacccca

SEQ ID NO: 1301019 - RNA, 24 nt, Human
cggaucacuugaggucaggaguuu

SEQ ID NO: 1301020 - RNA, 27 nt, Human
cggaucacuugaggucaggaguuugag

SEQ ID NO: 1301021 - RNA, 24 nt, Human
cgggagacaaagguugcagugagc

SEQ ID NO: 1301022 - RNA, 18 nt, Human
cgggcggaucacuugagg

SEQ ID NO: 1301023 - RNA, 24 nt, Human
cgggcggaucacuugaggucagga

SEQ ID NO: 1301024 - RNA, 24 nt, Human
cucaugccuguaaucccaacacuu

SEQ ID NO: 1301025 - RNA, 19 nt, Human
cuggaucaaagucaccaac

SEQ ID NO: 1301026 - RNA, 23 nt, Human
cuggccaacauggugaaacccca

SEQ ID NO: 1301027 - RNA, 21 nt, Human
cuguaaucucagcugcuuggg

SEQ ID NO: 1301028 - RNA, 23 nt, Human
gagaaucacuugagcccgggaga

SEQ ID NO: 1301029 - RNA, 23 nt, Human
gagaucgugcuaccacacuccag

SEQ ID NO: 1301030 - RNA, 24 nt, Human
gaucacuugaggucaggaguuuga

SEQ ID NO: 1301031 - RNA, 24 nt, Human
gccaacauggugaaaccccaucuc

SEQ ID NO: 1301032 - RNA, 18 nt, Human
gcuaccacacuccagccu

SEQ ID NO: 1301033 - RNA, 22 nt, Human
ggaucacuugaggucaggaguu

SEQ ID NO: 1301034 - RNA, 22 nt, Human
ggaucacuugaggucaggaguu

SEQ ID NO: 1301035 - RNA, 19 nt, Human
ggucaggaguuugagacca

SEQ ID NO: 1301036 - RNA, 23 nt, Human
gguggcucaugccuguaauccca

SEQ ID NO: 1301037 - RNA, 25 nt, Human
uaaaauaauauaauucaugggacuu

SEQ ID NO: 1301038 - RNA, 19 nt, Human
uaacuggaggaacuggagc

SEQ ID NO: 1301039 - RNA, 22 nt, Human
uaccaaaaauauaaaaaauuag

SEQ ID NO: 1301040 - RNA, 26 nt, Human
uaccaaaaauauaaaaaauuagccag

SEQ ID NO: 1301041 - RNA, 24 nt, Human
uaccacacuccagccuggugagua

SEQ ID NO: 1301042 - RNA, 26 nt, Human
uauagaaagacaguggugguuaauuu

SEQ ID NO: 1301043 - RNA, 24 nt, Human
ucaaucuugaaauccaaaggcaua

SEQ ID NO: 1301044 - RNA, 25 nt, Human
ucacuugagcccgggagacaaaggu

SEQ ID NO: 1301045 - RNA, 25 nt, Human
ucaguuguaacaauagcucugguuc

SEQ ID NO: 1301046 - RNA, 21 nt, Human
uccaggguaacuggagaacuc

SEQ ID NO: 1301047 - RNA, 21 nt, Human
ucuccaauuugaagauuucac

SEQ ID NO: 1301048 - RNA, 24 nt, Human
ucucuaccaaaaauauaaaaaauu

SEQ ID NO: 1301049 - RNA, 23 nt, Human
ucuucaagcagcaucuccaauuu

SEQ ID NO: 1301050 - RNA, 23 nt, Human
ugagaccagccuggccaacaugg

SEQ ID NO: 1301051 - RNA, 24 nt, Human
ugagaccagccuggccaacauggu

SEQ ID NO: 1301052 - RNA, 24 nt, Human
ugagcccgggagacaaagguugca

SEQ ID NO: 1301053 - RNA, 19 nt, Human
ugagggaggagaaucacuu

SEQ ID NO: 1301054 - RNA, 20 nt, Human
ugagggaggagaaucacuug

SEQ ID NO: 1301055 - RNA, 24 nt, Human
ugagggaggagaaucacuugagcc

SEQ ID NO: 1301056 - RNA, 18 nt, Human
ugaggucaggaguuugag

SEQ ID NO: 1301057 - RNA, 20 nt, Human
ugaucuacaaaaauuuucuu

SEQ ID NO: 1301058 - RNA, 20 nt, Human
ugcaccuguaaucucagcug

SEQ ID NO: 1301059 - RNA, 18 nt, Human
ugcaguuucuccaggacc

SEQ ID NO: 1301060 - RNA, 23 nt, Human
ugccuguaaucccaacacuuugg

SEQ ID NO: 1301061 - RNA, 21 nt, Human
ugcuuguggacuugcugcugc

SEQ ID NO: 1301062 - RNA, 23 nt, Human
uggaaggccaagcgggcggauca

SEQ ID NO: 1301063 - RNA, 18 nt, Human
uggaggaacuggagcauc

SEQ ID NO: 1301064 - RNA, 22 nt, Human
uggcaugcaccuguaaucucag

SEQ ID NO: 1301065 - RNA, 24 nt, Human
uggccaacauggugaaaccccauc

SEQ ID NO: 1301066 - RNA, 21 nt, Human
uggccagaaaguucugcucca

SEQ ID NO: 1301067 - RNA, 21 nt, Human
uggcucaugccuguaauccca

SEQ ID NO: 1301068 - RNA, 24 nt, Human
uggcucaugccuguaaucccaaca

SEQ ID NO: 1301069 - RNA, 24 nt, Human
ugggaggcugagggaggagaauca

SEQ ID NO: 1301070 - RNA, 24 nt, Human
ugguggcaugcaccuguaaucuca

SEQ ID NO: 1301071 - RNA, 19 nt, Human
uggugguuaauuugaauuc

SEQ ID NO: 1301072 - RNA, 23 nt, Human
uuagcaagguaaugagcuucuuu

SEQ ID NO: 1301073 - RNA, 18 nt, Human
uugcagugagcugagauc

SEQ ID NO: 1301074 - RNA, 21 nt, Human
uugcagugagcugagaucgug

SEQ ID NO: 1301075 - RNA, 22 nt, Human
uugcagugagcugagaucgugc

SEQ ID NO: 1301076 - RNA, 22 nt, Human
uugcagugagcugagaucgugc

SEQ ID NO: 1301077 - RNA, 25 nt, Human
uugggaggcugagggaggagaauca

SEQ ID NO: 1301078 - RNA, 23 nt, Human
uuguaacaauagcucugguucuc

SEQ ID NO: 1301079 - RNA, 22 nt, Human
uuuaaaugauucuguuucucag

SEQ ID NO: 1301080 - RNA, 23 nt, Human
uuucagguggcucaugccuguaa

SEQ ID NO: 1301081 - RNA, 23 nt, Human
uuuucagguggcucaugccugua

SEQ ID NO: 1301082 - RNA, 20 nt, Human
aagcggacaggugggcgagu

SEQ ID NO: 1301083 - RNA, 23 nt, Human
agaugaucuguugacuccagagc

SEQ ID NO: 1301084 - RNA, 19 nt, Human
aggcagguggagucaggga

SEQ ID NO: 1301085 - RNA, 20 nt, Human
ccacaauucccagcugucaa

SEQ ID NO: 1301086 - RNA, 18 nt, Human
ccacuugcugagggugaa

SEQ ID NO: 1301087 - RNA, 24 nt, Human
cccaucgccacagagucucugagu

SEQ ID NO: 1301088 - RNA, 24 nt, Human
cucacuuagcaaaacuuccuuuuc

SEQ ID NO: 1301089 - RNA, 19 nt, Human
cuggaugucuucuggccag

SEQ ID NO: 1301090 - RNA, 19 nt, Human
gcggacaggugggcgagug

SEQ ID NO: 1301091 - RNA, 18 nt, Human
gcugucaauacaggaggg

SEQ ID NO: 1301092 - RNA, 18 nt, Human
gguggagucagggacugg

SEQ ID NO: 1301093 - RNA, 21 nt, Human
uccacuugcugagggugaagu

SEQ ID NO: 1301094 - RNA, 18 nt, Human
ucccagcugucaauacag

SEQ ID NO: 1301095 - RNA, 22 nt, Human
uggcuacauuuggggacagcac

SEQ ID NO: 1301096 - RNA, 23 nt, Human
ugucaauacaggaggggacuuug

SEQ ID NO: 1301097 - RNA, 22 nt, Human
ugucuuaucucuaagagcucca

SEQ ID NO: 1301098 - RNA, 18 nt, Human
ugucuucuggccagugaa

SEQ ID NO: 1301099 - RNA, 21 nt, Human
uguucugggcaccuggaggca

SEQ ID NO: 1301100 - RNA, 18 nt, Human
uguugacuccagagcagc

SEQ ID NO: 1301101 - RNA, 21 nt, Human
uugguuuggggaaaagaugau

SEQ ID NO: 1301102 - RNA, 21 nt, Human
uuucucagaaccagacaccuc

SEQ ID NO: 1301103 - RNA, 20 nt, Human
aaagcccaggaggggagaca

SEQ ID NO: 1301104 - RNA, 20 nt, Human
aacacggugaaaccccgucu

SEQ ID NO: 1301105 - RNA, 21 nt, Human
aacacggugaaaccccgucuc

SEQ ID NO: 1301106 - RNA, 25 nt, Human
acagggcaggaggaaagcccaggag

SEQ ID NO: 1301107 - RNA, 24 nt, Human
accccgucucuacuaaaaauacaa

SEQ ID NO: 1301108 - RNA, 19 nt, Human
acccuuugguggcugagaa

SEQ ID NO: 1301109 - RNA, 21 nt, Human
acccuuugguggcugagaagc

SEQ ID NO: 1301110 - RNA, 25 nt, Human
aggcagagaggugaagaucuuaggg

SEQ ID NO: 1301111 - RNA, 20 nt, Human
aggccaagcagcugggcuga

SEQ ID NO: 1301112 - RNA, 21 nt, Human
aggccaagcagcugggcugag

SEQ ID NO: 1301113 - RNA, 24 nt, Human
aggcgcgcggaucacgaggucagg

SEQ ID NO: 1301114 - RNA, 21 nt, Human
aggcugcugcccacagggcag

SEQ ID NO: 1301115 - RNA, 19 nt, Human
aggugccgggaaauuaugc

SEQ ID NO: 1301116 - RNA, 19 nt, Human
auaacuaacaccauaauaa

SEQ ID NO: 1301117 - RNA, 22 nt, Human
auuaugcugugagagggucagg

SEQ ID NO: 1301118 - RNA, 20 nt, Human
caagcagcugggcugagucc

SEQ ID NO: 1301119 - RNA, 22 nt, Human
caagcagcugggcugaguccca

SEQ ID NO: 1301120 - RNA, 22 nt, Human
caccauaauaaccagaguucca

SEQ ID NO: 1301121 - RNA, 18 nt, Human
caccuguagucccagcug

SEQ ID NO: 1301122 - RNA, 25 nt, Human
caccuguagucccagcugcucgcga

SEQ ID NO: 1301123 - RNA, 24 nt, Human
caggccgggugcggcggcucgggc

SEQ ID NO: 1301124 - RNA, 18 nt, Human
ccaggaggggagacaaga

SEQ ID NO: 1301125 - RNA, 25 nt, Human
ccaucugagaggagaggagagugag

SEQ ID NO: 1301126 - RNA, 23 nt, Human
cccacagggcaggaggaaagccc

SEQ ID NO: 1301127 - RNA, 18 nt, Human
cccuuugguggcugagaa

SEQ ID NO: 1301128 - RNA, 20 nt, Human
ccucaauccucaggcccaag

SEQ ID NO: 1301129 - RNA, 23 nt, Human
ccuggcuaacacggugaaacccc

SEQ ID NO: 1301130 - RNA, 24 nt, Human
ccuggcuaacacggugaaaccccg

SEQ ID NO: 1301131 - RNA, 20 nt, Human
ccuguagucccagcugcucg

SEQ ID NO: 1301132 - RNA, 20 nt, Human
ccugugacucugaggaacgc

SEQ ID NO: 1301133 - RNA, 24 nt, Human
cgagaccauccuggcuaacacggu

SEQ ID NO: 1301134 - RNA, 19 nt, Human
cgcucagggcacugggcgg

SEQ ID NO: 1301135 - RNA, 23 nt, Human
cggaucacgaggucaggaaaucg

SEQ ID NO: 1301136 - RNA, 22 nt, Human
cggcucgggccuguaaucccag

SEQ ID NO: 1301137 - RNA, 24 nt, Human
cggcucgggccuguaaucccagca

SEQ ID NO: 1301138 - RNA, 21 nt, Human
cgggcaccuguagucccagcu

SEQ ID NO: 1301139 - RNA, 24 nt, Human
cgggccuguaaucccagcacuuug

SEQ ID NO: 1301140 - RNA, 24 nt, Human
cucgggccuguaaucccagcacuu

SEQ ID NO: 1301141 - RNA, 18 nt, Human
cuggcuaacacggugaaa

SEQ ID NO: 1301142 - RNA, 22 nt, Human
cugugagagggucaggccaagc

SEQ ID NO: 1301143 - RNA, 20 nt, Human
cuuagggaagccccugaccc

SEQ ID NO: 1301144 - RNA, 20 nt, Human
gaagccccugacccagccua

SEQ ID NO: 1301145 - RNA, 18 nt, Human
gacccagccuaggcugcu

SEQ ID NO: 1301146 - RNA, 24 nt, Human
gaucacgaggucaggaaaucgaga

SEQ ID NO: 1301147 - RNA, 18 nt, Human
gccaagcagcugggcuga

SEQ ID NO: 1301148 - RNA, 19 nt, Human
gccgggugcggcggcucgg

SEQ ID NO: 1301149 - RNA, 19 nt, Human
gcgcggaucacgaggucag

SEQ ID NO: 1301150 - RNA, 20 nt, Human
gcggcggcucgggccuguaa

SEQ ID NO: 1301151 - RNA, 24 nt, Human
gcuaacacggugaaaccccgucuc

SEQ ID NO: 1301152 - RNA, 20 nt, Human
ggcaccuguagucccagcug

SEQ ID NO: 1301153 - RNA, 23 nt, Human
ggccuguaaucccagcacuuugg

SEQ ID NO: 1301154 - RNA, 24 nt, Human
ggcggcucgggccuguaaucccag

SEQ ID NO: 1301155 - RNA, 21 nt, Human
ggcgggcaccuguagucccag

SEQ ID NO: 1301156 - RNA, 22 nt, Human
ggcgugguggcgggcaccugua

SEQ ID NO: 1301157 - RNA, 20 nt, Human
ggggcaguagggaggcagag

SEQ ID NO: 1301158 - RNA, 24 nt, Human
gguggcgggcaccuguagucccag

SEQ ID NO: 1301159 - RNA, 22 nt, Human
uaacacggugaaaccccgucuc

SEQ ID NO: 1301160 - RNA, 24 nt, Human
uaacacggugaaaccccgucucua

SEQ ID NO: 1301161 - RNA, 23 nt, Human
uaggccucaauccucaggcccaa

SEQ ID NO: 1301162 - RNA, 24 nt, Human
ucacgaggucaggaaaucgagacc

SEQ ID NO: 1301163 - RNA, 30 nt, Human
ucagaacaacaccugcaggccgggugcggg

SEQ ID NO: 1301164 - RNA, 21 nt, Human
uccucaggcccaagauacuug

SEQ ID NO: 1301165 - RNA, 22 nt, Human
ucucuacuaaaaauacaaaaaa

SEQ ID NO: 1301166 - RNA, 20 nt, Human
ucuuagggaagccccugacc

SEQ ID NO: 1301167 - RNA, 26 nt, Human
ugagaggagaggagagugagaagggg

SEQ ID NO: 1301168 - RNA, 21 nt, Human
uggggcaguagggaggcagag

SEQ ID NO: 1301169 - RNA, 24 nt, Human
ugguggcgggcaccuguaguccca

SEQ ID NO: 1301170 - RNA, 22 nt, Human
ugugacucugaggaacgccugc

SEQ ID NO: 1301171 - RNA, 18 nt, Human
uuagccgggcgugguggc

SEQ ID NO: 1301172 - RNA, 24 nt, Human
uuagccgggcgugguggcgggcac

SEQ ID NO: 1301173 - RNA, 18 nt, Human
uuccaucugagaggagag

SEQ ID NO: 1301174 - RNA, 23 nt, Human
ggaugcuuuuuuuuuaaguuccu

SEQ ID NO: 1301175 - RNA, 25 nt, Human
cauagaauagucaagaccacagaga

SEQ ID NO: 1301176 - RNA, 22 nt, Human
gaauagucaagaccacagagac

SEQ ID NO: 1301177 - RNA, 23 nt, Human
acagggacuguugccaucuccca

SEQ ID NO: 1301178 - RNA, 22 nt, Human
agaaacaggggaggcagagcca

SEQ ID NO: 1301179 - RNA, 20 nt, Human
agacaaccaugggaaccacu

SEQ ID NO: 1301180 - RNA, 22 nt, Human
agagaguagaggccagagccca

SEQ ID NO: 1301181 - RNA, 20 nt, Human
agagccagagggaggagaga

SEQ ID NO: 1301182 - RNA, 21 nt, Human
agaggccagagcccaggcagg

SEQ ID NO: 1301183 - RNA, 22 nt, Human
agaguagaggccagagcccagg

SEQ ID NO: 1301184 - RNA, 21 nt, Human
aggaagugucucccugacgga

SEQ ID NO: 1301185 - RNA, 20 nt, Human
aggcaggauacagcaccgug

SEQ ID NO: 1301186 - RNA, 20 nt, Human
aggccagagcccaggcagga

SEQ ID NO: 1301187 - RNA, 24 nt, Human
aggggugggguuccuaaagggugg

SEQ ID NO: 1301188 - RNA, 22 nt, Human
caagcacugccacagagggcuc

SEQ ID NO: 1301189 - RNA, 20 nt, Human
caccgccacagacauaaggg

SEQ ID NO: 1301190 - RNA, 20 nt, Human
caccgugccaccgccacaga

SEQ ID NO: 1301191 - RNA, 23 nt, Human
cagcaccgugccaccgccacaga

SEQ ID NO: 1301192 - RNA, 21 nt, Human
caggccccugagaaacagggg

SEQ ID NO: 1301193 - RNA, 20 nt, Human
caugcgcauuggcugagccg

SEQ ID NO: 1301194 - RNA, 23 nt, Human
ccacagagggcuccugcuuugcc

SEQ ID NO: 1301195 - RNA, 22 nt, Human
ccagagcccaggcaggauacag

SEQ ID NO: 1301196 - RNA, 20 nt, Human
ccaggcaggauacagcaccg

SEQ ID NO: 1301197 - RNA, 19 nt, Human
cccaagcacugccacagag

SEQ ID NO: 1301198 - RNA, 19 nt, Human
ccgacacccaagcacugcc

SEQ ID NO: 1301199 - RNA, 21 nt, Human
ccucagagccccgacacccaa

SEQ ID NO: 1301200 - RNA, 25 nt, Human
ccucagagccccgacacccaagcac

SEQ ID NO: 1301201 - RNA, 19 nt, Human
cgacacccaagcacugcca

SEQ ID NO: 1301202 - RNA, 19 nt, Human
cgcgccucgcgcaugcgca

SEQ ID NO: 1301203 - RNA, 23 nt, Human
cgggagaaaccgcucgcgccucg

SEQ ID NO: 1301204 - RNA, 18 nt, Human
cguggagaggugaggccg

SEQ ID NO: 1301205 - RNA, 25 nt, Human
gaaacaggggaggcagagccagagg

SEQ ID NO: 1301206 - RNA, 19 nt, Human
gacguucccgucgaccccg

SEQ ID NO: 1301207 - RNA, 18 nt, Human
gacugguuucuaagacaa

SEQ ID NO: 1301208 - RNA, 19 nt, Human
gaggcagagccagagggag

SEQ ID NO: 1301209 - RNA, 20 nt, Human
gccagagcgagaggcaucca

SEQ ID NO: 1301210 - RNA, 24 nt, Human
gccccugagaaacaggggaggcag

SEQ ID NO: 1301211 - RNA, 19 nt, Human
ggacugggaagucaucuuu

SEQ ID NO: 1301212 - RNA, 19 nt, Human
ggaggagagaguagaggcc

SEQ ID NO: 1301213 - RNA, 19 nt, Human
gggaggcagagccagaggg

SEQ ID NO: 1301214 - RNA, 19 nt, Human
ggggaggcagagccagagg

SEQ ID NO: 1301215 - RNA, 24 nt, Human
uaaggggugggguuccuaaagggu

SEQ ID NO: 1301216 - RNA, 21 nt, Human
uacagcaccgugccaccgcca

SEQ ID NO: 1301217 - RNA, 18 nt, Human
uccagugacagggacugu

SEQ ID NO: 1301218 - RNA, 19 nt, Human
ugccacagagggcuccugc

SEQ ID NO: 1301219 - RNA, 19 nt, Human
ugugacgggagaaaccgcu

SEQ ID NO: 1301220 - RNA, 24 nt, Human
uucccggcuuccucuugcugacug

SEQ ID NO: 1301221 - RNA, 22 nt, Human
acucuaugaucccagagagagg

SEQ ID NO: 1301222 - RNA, 19 nt, Human
acugcaacuuccaugaugc

SEQ ID NO: 1301223 - RNA, 26 nt, Human
agaguggaguccagguggcacccacu

SEQ ID NO: 1301224 - RNA, 20 nt, Human
caccuuggacucuaugaucc

SEQ ID NO: 1301225 - RNA, 30 nt, Human
cagaugacaguguucagcugagaaaguccc

SEQ ID NO: 1301226 - RNA, 21 nt, Human
ccaauggcuccucggucuucu

SEQ ID NO: 1301227 - RNA, 21 nt, Human
ccacugcccgagcaucauguu

SEQ ID NO: 1301228 - RNA, 25 nt, Human
ccagagcuucucugcaggcauccaa

SEQ ID NO: 1301229 - RNA, 22 nt, Human
ccccagagcuucucugcaggca

SEQ ID NO: 1301230 - RNA, 20 nt, Human
cguaucuucagaucuuuuca

SEQ ID NO: 1301231 - RNA, 21 nt, Human
cuuggccugguauucuuuggc

SEQ ID NO: 1301232 - RNA, 18 nt, Human
gccugguauucuuuggcu

SEQ ID NO: 1301233 - RNA, 22 nt, Human
ucauauagcuagauccaguaga

SEQ ID NO: 1301234 - RNA, 23 nt, Human
uccaugaugcaagaauuucucuu

SEQ ID NO: 1301235 - RNA, 24 nt, Human
ucguguuguguugaauuccaaugg

SEQ ID NO: 1301236 - RNA, 22 nt, Human
ucucugcaggcauccaaggggc

SEQ ID NO: 1301237 - RNA, 19 nt, Human
ucuggguucuugccugaag

SEQ ID NO: 1301238 - RNA, 21 nt, Human
ugaauaccagggugaauggaa

SEQ ID NO: 1301239 - RNA, 23 nt, Human
ugacugaagccccagagcuucuc

SEQ ID NO: 1301240 - RNA, 21 nt, Human
ugaucccagagagaggggaga

SEQ ID NO: 1301241 - RNA, 18 nt, Human
ugccugaagcucuggcag

SEQ ID NO: 1301242 - RNA, 21 nt, Human
ugccugaagcucuggcagaug

SEQ ID NO: 1301243 - RNA, 24 nt, Human
uggcagaugacaguguucagcuga

SEQ ID NO: 1301244 - RNA, 18 nt, Human
uggccgagaggccacaga

SEQ ID NO: 1301245 - RNA, 24 nt, Human
uggccugguauucuuuggcuuauu

SEQ ID NO: 1301246 - RNA, 21 nt, Human
ugggauuggccgagaggccac

SEQ ID NO: 1301247 - RNA, 21 nt, Human
uuauuuugucaugucuggggu

SEQ ID NO: 1301248 - RNA, 21 nt, Human
uugucaugucugggguuucau

SEQ ID NO: 1301249 - RNA, 18 nt, Human
aagccaaauauaagucac

SEQ ID NO: 1301250 - RNA, 25 nt, Human
agacaggaaagaaauguugcaucga

SEQ ID NO: 1301251 - RNA, 18 nt, Human
cagaaauggagcuguuca

SEQ ID NO: 1301252 - RNA, 21 nt, Human
cauaagucaguagccaggggc

SEQ ID NO: 1301253 - RNA, 20 nt, Human
caugugcacagaaauggagc

SEQ ID NO: 1301254 - RNA, 24 nt, Human
cuagugagggagggagccuucuuc

SEQ ID NO: 1301255 - RNA, 30 nt, Human
cuuggaaauccuguccauagauucuuccuu

SEQ ID NO: 1301256 - RNA, 24 nt, Human
gcgcaucuggaacaaugcauacag

SEQ ID NO: 1301257 - RNA, 23 nt, Human
uacaaacagcccagacaggaaag

SEQ ID NO: 1301258 - RNA, 20 nt, Human
ugcacagaaauggagcuguu

SEQ ID NO: 1301259 - RNA, 18 nt, Human
uggcaagagcgcaucugg

SEQ ID NO: 1301260 - RNA, 19 nt, Human
uguccauagauucuuccuu

SEQ ID NO: 1301261 - RNA, 21 nt, Human
uuccaccaacaugugcacaga

SEQ ID NO: 1301262 - RNA, 21 nt, Human
aaaaucccaaaagagcccuuu

SEQ ID NO: 1301263 - RNA, 21 nt, Human
agaaaaaucccaaaagagccc

SEQ ID NO: 1301264 - RNA, 21 nt, Human
agagcccuuugcucuuuuucu

SEQ ID NO: 1301265 - RNA, 19 nt, Human
aggaaagagaaaaauccca

SEQ ID NO: 1301266 - RNA, 22 nt, Human
aggaaagagaaaaaucccaaaa

SEQ ID NO: 1301267 - RNA, 20 nt, Human
auacuccccuuuccuucuca

SEQ ID NO: 1301268 - RNA, 19 nt, Human
cauaguacuugcgcaaggc

SEQ ID NO: 1301269 - RNA, 23 nt, Human
cccaaaagagcccuuugcucuuu

SEQ ID NO: 1301270 - RNA, 18 nt, Human
uacugcuguuccagguca

SEQ ID NO: 1301271 - RNA, 21 nt, Human
uccaggucagagagagagcuc

SEQ ID NO: 1301272 - RNA, 19 nt, Human
ucccaaaagagcccuuugc

SEQ ID NO: 1301273 - RNA, 20 nt, Human
ucuuuuucuugugcucucug

SEQ ID NO: 1301274 - RNA, 23 nt, Human
ugucaaggaaagagaaaaauccc

SEQ ID NO: 1301275 - RNA, 21 nt, Human
uuccaggucagagagagagcu

SEQ ID NO: 1301276 - RNA, 19 nt, Human
aaccaauccgacacccgcc

SEQ ID NO: 1301277 - RNA, 25 nt, Human
aggagaauccuguugggggaggcgg

SEQ ID NO: 1301278 - RNA, 18 nt, Human
aggcgggggccggugguc

SEQ ID NO: 1301279 - RNA, 22 nt, Human
auaaagcccccagccggacgcu

SEQ ID NO: 1301280 - RNA, 23 nt, Human
ccaaaggagaauccuguuggggg

SEQ ID NO: 1301281 - RNA, 19 nt, Human
ccagcaggcugaagagagg

SEQ ID NO: 1301282 - RNA, 21 nt, Human
cccccagccggacgcugccgc

SEQ ID NO: 1301283 - RNA, 18 nt, Human
cccccuaauaaagccccc

SEQ ID NO: 1301284 - RNA, 23 nt, Human
ccggugcccccuaauaaagcccc

SEQ ID NO: 1301285 - RNA, 18 nt, Human
ccuaauaaagcccccagc

SEQ ID NO: 1301286 - RNA, 21 nt, Human
ccuguugggggaggcgggggc

SEQ ID NO: 1301287 - RNA, 23 nt, Human
cuaccgggguuuggcaacuuccg

SEQ ID NO: 1301288 - RNA, 23 nt, Human
cucuuggcuuuaaaauaaccacc

SEQ ID NO: 1301289 - RNA, 19 nt, Human
cuguggcccaaaggagaau

SEQ ID NO: 1301290 - RNA, 21 nt, Human
cuguugggggaggcgggggcc

SEQ ID NO: 1301291 - RNA, 25 nt, Human
cuuuaaaauaaccaccaaguagaaa

SEQ ID NO: 1301292 - RNA, 24 nt, Human
gcgggggccgguggucgcuaacca

SEQ ID NO: 1301293 - RNA, 18 nt, Human
ggaggcgggggccggugg

SEQ ID NO: 1301294 - RNA, 24 nt, Human
uaaguuuacagcuugguaaauuua

SEQ ID NO: 1301295 - RNA, 18 nt, Human
uacaaagaguaaaccugg

SEQ ID NO: 1301296 - RNA, 24 nt, Human
uacagcuugguaaauuuagccucu

SEQ ID NO: 1301297 - RNA, 24 nt, Human
uagcagcacccggugcccccuaau

SEQ ID NO: 1301298 - RNA, 23 nt, Human
uagccucuuggcuuuaaaauaac

SEQ ID NO: 1301299 - RNA, 18 nt, Human
uguagcagcacccggugc

SEQ ID NO: 1301300 - RNA, 21 nt, Human
uguugggggaggcgggggccg

SEQ ID NO: 1301301 - RNA, 25 nt, Human
uucccaaaaggaaaacuuucccaaa

SEQ ID NO: 1301302 - RNA, 18 nt, Human
uuuaaaauaaccaccaag

SEQ ID NO: 1301303 - RNA, 19 nt, Human
aacacggagaaaccccguc

SEQ ID NO: 1301304 - RNA, 20 nt, Human
aacacggagaaaccccgucu

SEQ ID NO: 1301305 - RNA, 20 nt, Human
acaagggugaaacuccgucu

SEQ ID NO: 1301306 - RNA, 21 nt, Human
acaagggugaaacuccgucuc

SEQ ID NO: 1301307 - RNA, 20 nt, Human
acaccauugcacuccagccu

SEQ ID NO: 1301308 - RNA, 23 nt, Human
accauguugcccaggcggucugg

SEQ ID NO: 1301309 - RNA, 22 nt, Human
accgggggcacgguggcucacg

SEQ ID NO: 1301310 - RNA, 22 nt, Human
accgggggcgcgguggcucacg

SEQ ID NO: 1301311 - RNA, 18 nt, Human
accggguuucaccauguu

SEQ ID NO: 1301312 - RNA, 19 nt, Human
accggguuucaccauguug

SEQ ID NO: 1301313 - RNA, 24 nt, Human
accggguuucaccauguugcccag

SEQ ID NO: 1301314 - RNA, 22 nt, Human
accucugccucuuggguucaag

SEQ ID NO: 1301315 - RNA, 25 nt, Human
acuccagccuggacaacaaggguga

SEQ ID NO: 1301316 - RNA, 18 nt, Human
agcccgaccaacacggag

SEQ ID NO: 1301317 - RNA, 18 nt, Human
agcuaccacgccaggccg

SEQ ID NO: 1301318 - RNA, 18 nt, Human
aggcaggagaaucaccua

SEQ ID NO: 1301319 - RNA, 23 nt, Human
aggcaggagaaucaccuaaaucc

SEQ ID NO: 1301320 - RNA, 24 nt, Human
aggcaggagaaucaccuaaauccg

SEQ ID NO: 1301321 - RNA, 20 nt, Human
aggccgagguugcggugggc

SEQ ID NO: 1301322 - RNA, 24 nt, Human
aggccgagguugcggugggcaaag

SEQ ID NO: 1301323 - RNA, 21 nt, Human
aggcggaggcggguggaucac

SEQ ID NO: 1301324 - RNA, 22 nt, Human
aggcggguggaucacccgaggu

SEQ ID NO: 1301325 - RNA, 26 nt, Human
aggcggguggaucacccgaggucagg

SEQ ID NO: 1301326 - RNA, 18 nt, Human
aggcggucuggaacuccu

SEQ ID NO: 1301327 - RNA, 23 nt, Human
agguugcggugggcaaagaucac

SEQ ID NO: 1301328 - RNA, 24 nt, Human
agugcaauggcaugaucucggcuc

SEQ ID NO: 1301329 - RNA, 24 nt, Human
aucacaccauugcacuccagccug

SEQ ID NO: 1301330 - RNA, 18 nt, Human
auugcacuccagccugga

SEQ ID NO: 1301331 - RNA, 25 nt, Human
auugcacuccagccuggacaacaag

SEQ ID NO: 1301332 - RNA, 22 nt, Human
caagcgauuuucuugccucagc

SEQ ID NO: 1301333 - RNA, 19 nt, Human
cacagcuaacuugcccucc

SEQ ID NO: 1301334 - RNA, 19 nt, Human
caccaggaagcgcagccgg

SEQ ID NO: 1301335 - RNA, 18 nt, Human
caccauguugcccaggcg

SEQ ID NO: 1301336 - RNA, 21 nt, Human
caccauguugcccaggcgguc

SEQ ID NO: 1301337 - RNA, 30 nt, Human
caccauguugcccaggcggucuggaacucc

SEQ ID NO: 1301338 - RNA, 19 nt, Human
cacgccaccaggaagcgca

SEQ ID NO: 1301339 - RNA, 19 nt, Human
cacgccugcaaucccagca

SEQ ID NO: 1301340 - RNA, 19 nt, Human
cacgccugcaaucccagca

SEQ ID NO: 1301341 - RNA, 20 nt, Human
cacuccagccuggacaacaa

SEQ ID NO: 1301342 - RNA, 23 nt, Human
cacuccagccuggacaacaaggg

SEQ ID NO: 1301343 - RNA, 25 nt, Human
cacuccagccuggacaacaagggug

SEQ ID NO: 1301344 - RNA, 23 nt, Human
cacugcgaccucugccucuuggg

SEQ ID NO: 1301345 - RNA, 21 nt, Human
cagagaccggguuucaccaug

SEQ ID NO: 1301346 - RNA, 22 nt, Human
cagcggccuuggguuugggcuc

SEQ ID NO: 1301347 - RNA, 27 nt, Human
cagcggccuuggguuugggcuccagcc

SEQ ID NO: 1301348 - RNA, 21 nt, Human
cagcuaacuugcccuccgcgc

SEQ ID NO: 1301349 - RNA, 22 nt, Human
cauguugcccaggcggucugga

SEQ ID NO: 1301350 - RNA, 23 nt, Human
cauguugcccaggcggucuggaa

SEQ ID NO: 1301351 - RNA, 18 nt, Human
cauugcacuccagccugg

SEQ ID NO: 1301352 - RNA, 20 nt, Human
cauugcacuccagccuggac

SEQ ID NO: 1301353 - RNA, 21 nt, Human
cauugcacuccagccuggaca

SEQ ID NO: 1301354 - RNA, 19 nt, Human
ccauugcacuccagccugg

SEQ ID NO: 1301355 - RNA, 20 nt, Human
ccauugcacuccagccugga

SEQ ID NO: 1301356 - RNA, 21 nt, Human
ccauugcacuccagccuggac

SEQ ID NO: 1301357 - RNA, 22 nt, Human
ccauugcacuccagccuggaca

SEQ ID NO: 1301358 - RNA, 23 nt, Human
ccauugcacuccagccuggacaa

SEQ ID NO: 1301359 - RNA, 22 nt, Human
cccaggcuggagugcaauggca

SEQ ID NO: 1301360 - RNA, 18 nt, Human
ccccagccgggcccccuc

SEQ ID NO: 1301361 - RNA, 19 nt, Human
ccccagccgggcccccucg

SEQ ID NO: 1301362 - RNA, 19 nt, Human
ccccucgcgccgcugcggc

SEQ ID NO: 1301363 - RNA, 21 nt, Human
cccuccgcgccauuccacgcc

SEQ ID NO: 1301364 - RNA, 23 nt, Human
ccgaucuauuccuuucugguuac

SEQ ID NO: 1301365 - RNA, 19 nt, Human
ccggaccggcgcccagccc

SEQ ID NO: 1301366 - RNA, 24 nt, Human
ccggguuucaccauguugcccagg

SEQ ID NO: 1301367 - RNA, 19 nt, Human
ccuccgcgccauuccacgc

SEQ ID NO: 1301368 - RNA, 21 nt, Human
ccugcaaucccagcacccagg

SEQ ID NO: 1301369 - RNA, 24 nt, Human
cgagguugcggugggcaaagauca

SEQ ID NO: 1301370 - RNA, 26 nt, Human
cgccaggccgaucuauuccuuucugg

SEQ ID NO: 1301371 - RNA, 23 nt, Human
cgccugcaaucccagcacccagg

SEQ ID NO: 1301372 - RNA, 27 nt, Human
cggaggcggguggaucacccgagguca

SEQ ID NO: 1301373 - RNA, 19 nt, Human
cggcaucggcgaagaggcc

SEQ ID NO: 1301374 - RNA, 21 nt, Human
cggcggcagcggcccuaggac

SEQ ID NO: 1301375 - RNA, 21 nt, Human
cgggaggccgagguugcggug

SEQ ID NO: 1301376 - RNA, 24 nt, Human
cgggaggccgagguugcggugggc

SEQ ID NO: 1301377 - RNA, 24 nt, Human
cggguggaucacccgaggucagga

SEQ ID NO: 1301378 - RNA, 22 nt, Human
cggguuucaccauguugcccag

SEQ ID NO: 1301379 - RNA, 19 nt, Human
cucaagcgaucugccacac

SEQ ID NO: 1301380 - RNA, 23 nt, Human
cucacgccugcaaucccagcacc

SEQ ID NO: 1301381 - RNA, 23 nt, Human
cucacgccugcaaucccagcacc

SEQ ID NO: 1301382 - RNA, 24 nt, Human
cucacgccugcaaucccagcaccc

SEQ ID NO: 1301383 - RNA, 24 nt, Human
cucacgccugcaaucccagcaccc

SEQ ID NO: 1301384 - RNA, 24 nt, Human
cucacugcgaccucugccucuugg

SEQ ID NO: 1301385 - RNA, 20 nt, Human
cucgcgccgcugcggcugcu

SEQ ID NO: 1301386 - RNA, 24 nt, Human
cugcgaccucugccucuuggguuc

SEQ ID NO: 1301387 - RNA, 24 nt, Human
cuggagugcaauggcaugaucucg

SEQ ID NO: 1301388 - RNA, 18 nt, Human
cugggaucacaaggggga

SEQ ID NO: 1301389 - RNA, 19 nt, Human
cuugccggaccggcgccca

SEQ ID NO: 1301390 - RNA, 21 nt, Human
gacagucccaggcuggagugc

SEQ ID NO: 1301391 - RNA, 27 nt, Human
gaggcgggcguaucacuccccaagggg

SEQ ID NO: 1301392 - RNA, 19 nt, Human
gagguugcggugggcaaag

SEQ ID NO: 1301393 - RNA, 24 nt, Human
gaucacccgaggucaggagcuuga

SEQ ID NO: 1301394 - RNA, 23 nt, Human
gcaggagaaucaccuaaauccgg

SEQ ID NO: 1301395 - RNA, 19 nt, Human
gccugucaggggacagucc

SEQ ID NO: 1301396 - RNA, 23 nt, Human
gcggcccuaggacucggcgggcg

SEQ ID NO: 1301397 - RNA, 18 nt, Human
gcggccuuggguuugggc

SEQ ID NO: 1301398 - RNA, 22 nt, Human
gcggucuggaacuccuaggcuc

SEQ ID NO: 1301399 - RNA, 19 nt, Human
gcuggagugcaauggcaug

SEQ ID NO: 1301400 - RNA, 21 nt, Human
ggaccggcgcccagcccucca

SEQ ID NO: 1301401 - RNA, 23 nt, Human
ggcgcgguggcucacgccugcaa

SEQ ID NO: 1301402 - RNA, 21 nt, Human
ggcucacgccugcaaucccag

SEQ ID NO: 1301403 - RNA, 19 nt, Human
ggcuccagccccagccggg

SEQ ID NO: 1301404 - RNA, 24 nt, Human
gggcacgguggcucacgccugcaa

SEQ ID NO: 1301405 - RNA, 22 nt, Human
ggguuucaccauguugcccagg

SEQ ID NO: 1301406 - RNA, 21 nt, Human
gguggaucacccgaggucagg

SEQ ID NO: 1301407 - RNA, 24 nt, Human
gguggcucacgccugcaaucccag

SEQ ID NO: 1301408 - RNA, 24 nt, Human
gguggcucacgccugcaaucccag

SEQ ID NO: 1301409 - RNA, 24 nt, Human
gugaaacuccgucucaaaacagag

SEQ ID NO: 1301410 - RNA, 23 nt, Human
ucaaaacagagaccggguuucac

SEQ ID NO: 1301411 - RNA, 19 nt, Human
ucaagcgauuuucuugccu

SEQ ID NO: 1301412 - RNA, 23 nt, Human
ucacaccauugcacuccagccug

SEQ ID NO: 1301413 - RNA, 31 nt, Human
ucacaccauugcacuccagccuggacaacaa

SEQ ID NO: 1301414 - RNA, 22 nt, Human
ucacagcuaacuugcccuccgc

SEQ ID NO: 1301415 - RNA, 18 nt, Human
ucacccgaggucaggagc

SEQ ID NO: 1301416 - RNA, 19 nt, Human
ucacccgaggucaggagcu

SEQ ID NO: 1301417 - RNA, 24 nt, Human
ucacugcgaccucugccucuuggg

SEQ ID NO: 1301418 - RNA, 24 nt, Human
ucccaggcuggagugcaauggcau

SEQ ID NO: 1301419 - RNA, 19 nt, Human
uccgggaggccgagguugc

SEQ ID NO: 1301420 - RNA, 18 nt, Human
uccuaggcucaagcgauc

SEQ ID NO: 1301421 - RNA, 20 nt, Human
uccuaggcucaagcgaucug

SEQ ID NO: 1301422 - RNA, 21 nt, Human
ucgcgccgcugcggcugcugc

SEQ ID NO: 1301423 - RNA, 23 nt, Human
ucggcgaagaggccuugccggac

SEQ ID NO: 1301424 - RNA, 23 nt, Human
ucggcggcagcggcccuaggacu

SEQ ID NO: 1301425 - RNA, 21 nt, Human
ugcaaucccagcacccaggga

SEQ ID NO: 1301426 - RNA, 21 nt, Human
ugcaaucccagcacccaggga

SEQ ID NO: 1301427 - RNA, 19 nt, Human
ugcacuccagccuggacaa

SEQ ID NO: 1301428 - RNA, 20 nt, Human
ugcggugggcaaagaucaac

SEQ ID NO: 1301429 - RNA, 19 nt, Human
uggagugcaauggcaugau

SEQ ID NO: 1301430 - RNA, 24 nt, Human
uggagugcaauggcaugaucucgg

SEQ ID NO: 1301431 - RNA, 23 nt, Human
uggaucacccgaggucaggagcu

SEQ ID NO: 1301432 - RNA, 24 nt, Human
uggaucacccgaggucaggagcuu

SEQ ID NO: 1301433 - RNA, 27 nt, Human
uggaucacccgaggucaggagcuugag

SEQ ID NO: 1301434 - RNA, 22 nt, Human
uggcucacgccugcaaucccag

SEQ ID NO: 1301435 - RNA, 24 nt, Human
uggcucacgccugcaaucccagca

SEQ ID NO: 1301436 - RNA, 24 nt, Human
uggcucacgccugcaaucccagca

SEQ ID NO: 1301437 - RNA, 23 nt, Human
uggguucaagcgauuuucuugcc

SEQ ID NO: 1301438 - RNA, 24 nt, Human
uggguucaagcgauuuucuugccu

SEQ ID NO: 1301439 - RNA, 23 nt, Human
uuacuaaauuggaccgggggcgc

SEQ ID NO: 1301440 - RNA, 23 nt, Human
uucaagcgauuuucuugccucag

SEQ ID NO: 1301441 - RNA, 19 nt, Human
uugggcuccagccccagcc

SEQ ID NO: 1301442 - RNA, 20 nt, Human
uuucaccauguugcccaggc

SEQ ID NO: 1301443 - RNA, 20 nt, Human
cgacaggagcucauacggca

SEQ ID NO: 1301444 - RNA, 23 nt, Human
cgacaggagcucauacggcagag

SEQ ID NO: 1301445 - RNA, 22 nt, Human
aaaaaagaaaaaugcuaaagga

SEQ ID NO: 1301446 - RNA, 18 nt, Human
aaaaagcucccccaaaag

SEQ ID NO: 1301447 - RNA, 19 nt, Human
aaauaaacuuaaacuauaa

SEQ ID NO: 1301448 - RNA, 21 nt, Human
aacauuaaaaaagcauggcag

SEQ ID NO: 1301449 - RNA, 23 nt, Human
aauucuuggccuuuaaacaacuc

SEQ ID NO: 1301450 - RNA, 19 nt, Human
acaaaguaauaaacagugc

SEQ ID NO: 1301451 - RNA, 27 nt, Human
acacagaaaauggaggaaaggggaccc

SEQ ID NO: 1301452 - RNA, 21 nt, Human
acuuuccucuucugugagauu

SEQ ID NO: 1301453 - RNA, 24 nt, Human
aggcuguuuccaauucuuggccuu

SEQ ID NO: 1301454 - RNA, 23 nt, Human
agucuaacauucaaaggaaguaa

SEQ ID NO: 1301455 - RNA, 23 nt, Human
augccagagugaacaucagugag

SEQ ID NO: 1301456 - RNA, 22 nt, Human
cacuuuccucuucugugagauu

SEQ ID NO: 1301457 - RNA, 19 nt, Human
cagccuauuccaaaccaaa

SEQ ID NO: 1301458 - RNA, 19 nt, Human
cagccuauuccaaaccaaa

SEQ ID NO: 1301459 - RNA, 21 nt, Human
cagugagagccacagacacac

SEQ ID NO: 1301460 - RNA, 25 nt, Human
cagugcacacuugggggcaaacuac

SEQ ID NO: 1301461 - RNA, 18 nt, Human
ccaaaccaaagagaacag

SEQ ID NO: 1301462 - RNA, 21 nt, Human
ccacuuuccucuucugugaga

SEQ ID NO: 1301463 - RNA, 19 nt, Human
ccagaggaggccacuuucc

SEQ ID NO: 1301464 - RNA, 21 nt, Human
cucccaucaccaauacacaga

SEQ ID NO: 1301465 - RNA, 22 nt, Human
cuuaaacuauaaauuagaaaca

SEQ ID NO: 1301466 - RNA, 20 nt, Human
gaagagcucacugugauuaa

SEQ ID NO: 1301467 - RNA, 22 nt, Human
gaggaggccacuuuccucuucu

SEQ ID NO: 1301468 - RNA, 22 nt, Human
uaaauuagaaacacaaauaauc

SEQ ID NO: 1301469 - RNA, 19 nt, Human
uacaaaguaauaaacagug

SEQ ID NO: 1301470 - RNA, 21 nt, Human
uagaaacacaaauaaucauga

SEQ ID NO: 1301471 - RNA, 20 nt, Human
ucugaaugcuguagugaaua

SEQ ID NO: 1301472 - RNA, 23 nt, Human
ucuugagcagcuguuugaugaug

SEQ ID NO: 1301473 - RNA, 22 nt, Human
ugaaauuaaaaaagaaaaaugc

SEQ ID NO: 1301474 - RNA, 28 nt, Human
ugaacucccaccacguaagggcaaacuc

SEQ ID NO: 1301475 - RNA, 24 nt, Human
ugaauauacaugcugcaauaacau

SEQ ID NO: 1301476 - RNA, 21 nt, Human
uggcagccuauuccaaaccaa

SEQ ID NO: 1301477 - RNA, 18 nt, Human
uggccuuuaaacaacucu

SEQ ID NO: 1301478 - RNA, 18 nt, Human
ugggcaaagagugggucu

SEQ ID NO: 1301479 - RNA, 23 nt, Human
uuaaaaaagaaaaaugcuaaagg

SEQ ID NO: 1301480 - RNA, 21 nt, Human
uugagcuaaggaagagcucac

SEQ ID NO: 1301481 - RNA, 22 nt, Human
uuggccuuuaaacaacucuaaa

SEQ ID NO: 1301482 - RNA, 20 nt, Human
uuuaaaaauuucuugagcag

SEQ ID NO: 1301483 - RNA, 21 nt, Human
aagcccuggacacguaggagu

SEQ ID NO: 1301484 - RNA, 18 nt, Human
agacccuccucugcacuc

SEQ ID NO: 1301485 - RNA, 18 nt, Human
agauguuaagguccaacc

SEQ ID NO: 1301486 - RNA, 18 nt, Human
agccccugccagacccuc

SEQ ID NO: 1301487 - RNA, 23 nt, Human
agcuaggcggccugagcagcccc

SEQ ID NO: 1301488 - RNA, 21 nt, Human
caccccuuccucccugcacag

SEQ ID NO: 1301489 - RNA, 22 nt, Human
cagacccuccucugcacuccuc

SEQ ID NO: 1301490 - RNA, 20 nt, Human
ccaaggaagggguggaguug

SEQ ID NO: 1301491 - RNA, 23 nt, Human
ccagacccuccucugcacuccuc

SEQ ID NO: 1301492 - RNA, 22 nt, Human
cccaagcccuggacacguagga

SEQ ID NO: 1301493 - RNA, 19 nt, Human
ccccugccagacccuccuc

SEQ ID NO: 1301494 - RNA, 22 nt, Human
cccugcacagcucuggcucuuc

SEQ ID NO: 1301495 - RNA, 23 nt, Human
ccucucaccccuuccucccugca

SEQ ID NO: 1301496 - RNA, 18 nt, Human
ccucugcacuccucugcc

SEQ ID NO: 1301497 - RNA, 24 nt, Human
ccucugcacuccucugccuaaguc

SEQ ID NO: 1301498 - RNA, 21 nt, Human
ccugccagacccuccucugca

SEQ ID NO: 1301499 - RNA, 21 nt, Human
cggcccaagcccuggacacgu

SEQ ID NO: 1301500 - RNA, 19 nt, Human
cucucaccccuuccucccu

SEQ ID NO: 1301501 - RNA, 19 nt, Human
cugagcagccccugccaga

SEQ ID NO: 1301502 - RNA, 21 nt, Human
cugcacagcucuggcucuucc

SEQ ID NO: 1301503 - RNA, 18 nt, Human
cuuccucccugcacagcu

SEQ ID NO: 1301504 - RNA, 22 nt, Human
gggcaaggccaaggaaggggug

SEQ ID NO: 1301505 - RNA, 22 nt, Human
uaggcgggcaggggcaaggcca

SEQ ID NO: 1301506 - RNA, 23 nt, Human
ucuaggugugggggccccccucu

SEQ ID NO: 1301507 - RNA, 21 nt, Human
ugagcagccccugccagaccc

SEQ ID NO: 1301508 - RNA, 23 nt, Human
ugccagacccuccucugcacucc

SEQ ID NO: 1301509 - RNA, 20 nt, Human
uggcaaaggggcagcuaggc

SEQ ID NO: 1301510 - RNA, 24 nt, Human
uguaggcgggcaggggcaaggcca

SEQ ID NO: 1301511 - RNA, 22 nt, Human
uuagggaacacucuuccuucag

SEQ ID NO: 1301512 - RNA, 18 nt, Human
acaggggagccugacggg

SEQ ID NO: 1301513 - RNA, 24 nt, Human
acccgcgcuaccuccuccagaccc

SEQ ID NO: 1301514 - RNA, 18 nt, Human
acccggagggcggcgggg

SEQ ID NO: 1301515 - RNA, 19 nt, Human
acccuccccgcucccuggg

SEQ ID NO: 1301516 - RNA, 20 nt, Human
accuccuccagacccgcgcg

SEQ ID NO: 1301517 - RNA, 18 nt, Human
acugacaacugugcuuuc

SEQ ID NO: 1301518 - RNA, 19 nt, Human
agguucugguuggggcagc

SEQ ID NO: 1301519 - RNA, 25 nt, Human
agucugcugggacacagagcugggu

SEQ ID NO: 1301520 - RNA, 20 nt, Human
caaucaggcaggcaggggca

SEQ ID NO: 1301521 - RNA, 22 nt, Human
caaucugucguagcuccccacu

SEQ ID NO: 1301522 - RNA, 23 nt, Human
caccacgugcccgagccgggggc

SEQ ID NO: 1301523 - RNA, 22 nt, Human
cacccggggaccgcuccuagcc

SEQ ID NO: 1301524 - RNA, 18 nt, Human
cagcgaauucccgcuucc

SEQ ID NO: 1301525 - RNA, 19 nt, Human
cagguccgcgguggaggcg

SEQ ID NO: 1301526 - RNA, 20 nt, Human
cauccaagguucugguuggg

SEQ ID NO: 1301527 - RNA, 22 nt, Human
cauccaagguucugguuggggc

SEQ ID NO: 1301528 - RNA, 18 nt, Human
ccacuggcaguguguaug

SEQ ID NO: 1301529 - RNA, 19 nt, Human
ccagacccgcgcuaccucc

SEQ ID NO: 1301530 - RNA, 21 nt, Human
ccagggugacggugguuagag

SEQ ID NO: 1301531 - RNA, 23 nt, Human
ccagguccaccaguuuuccccug

SEQ ID NO: 1301532 - RNA, 22 nt, Human
ccccgcauugugccuccagacc

SEQ ID NO: 1301533 - RNA, 28 nt, Human
ccccgggccgcagauauaccagggcucc

SEQ ID NO: 1301534 - RNA, 21 nt, Human
ccccuccggccccacgcgucc

SEQ ID NO: 1301535 - RNA, 24 nt, Human
cccgcugcgcuccagccccgggcc

SEQ ID NO: 1301536 - RNA, 20 nt, Human
cccuccggccucgcgucucc

SEQ ID NO: 1301537 - RNA, 21 nt, Human
cccucuggcgacuccggccgc

SEQ ID NO: 1301538 - RNA, 21 nt, Human
ccgcauugugccuccagaccc

SEQ ID NO: 1301539 - RNA, 19 nt, Human
ccgccaccacgugcccgag

SEQ ID NO: 1301540 - RNA, 21 nt, Human
ccgcugcgcuccagccccggg

SEQ ID NO: 1301541 - RNA, 22 nt, Human
ccgcugcgcuccagccccgggc

SEQ ID NO: 1301542 - RNA, 23 nt, Human
ccggagagacccggagggcggcg

SEQ ID NO: 1301543 - RNA, 19 nt, Human
ccuccagacccgcgcuacc

SEQ ID NO: 1301544 - RNA, 20 nt, Human
ccuuccucccucugaucuca

SEQ ID NO: 1301545 - RNA, 24 nt, Human
cgagaggaaauaggcccggcaggu

SEQ ID NO: 1301546 - RNA, 26 nt, Human
cgcacugucuccuccgguccugcgug

SEQ ID NO: 1301547 - RNA, 23 nt, Human
cgcauugugccuccagacccgcg

SEQ ID NO: 1301548 - RNA, 20 nt, Human
cggcggggcccggggucucc

SEQ ID NO: 1301549 - RNA, 24 nt, Human
cuccagacccgcgcguccccucug

SEQ ID NO: 1301550 - RNA, 22 nt, Human
cugcagccccgcauugugccuc

SEQ ID NO: 1301551 - RNA, 19 nt, Human
cugcgcuccagccccgggc

SEQ ID NO: 1301552 - RNA, 23 nt, Human
cuggcacuuccgcaagcagccuu

SEQ ID NO: 1301553 - RNA, 19 nt, Human
cuggggcagguccgcggug

SEQ ID NO: 1301554 - RNA, 23 nt, Human
cuggggcagguccgcgguggagg

SEQ ID NO: 1301555 - RNA, 21 nt, Human
cugguuggggcagccacaagg

SEQ ID NO: 1301556 - RNA, 22 nt, Human
gaaggugcucucuguuugaggg

SEQ ID NO: 1301557 - RNA, 18 nt, Human
gacccgcgcuaccuccuc

SEQ ID NO: 1301558 - RNA, 20 nt, Human
gacugacaacugugcuuucu

SEQ ID NO: 1301559 - RNA, 21 nt, Human
gagcuggguggauuuccagcu

SEQ ID NO: 1301560 - RNA, 22 nt, Human
gaggcugcugaagucgucccag

SEQ ID NO: 1301561 - RNA, 21 nt, Human
gagugggaggaaggucugagu

SEQ ID NO: 1301562 - RNA, 18 nt, Human
gauccgcacugucuccuc

SEQ ID NO: 1301563 - RNA, 21 nt, Human
gccagugagcacccggggacc

SEQ ID NO: 1301564 - RNA, 19 nt, Human
gcccggggucuccuuccuc

SEQ ID NO: 1301565 - RNA, 19 nt, Human
gccgccaccacgugcccga

SEQ ID NO: 1301566 - RNA, 19 nt, Human
gcuuucuuaggguggaguu

SEQ ID NO: 1301567 - RNA, 25 nt, Human
ggacccggagagacccggagggcgg

SEQ ID NO: 1301568 - RNA, 18 nt, Human
ggcacuuccgcaagcagc

SEQ ID NO: 1301569 - RNA, 18 nt, Human
gggaagucgggaggguac

SEQ ID NO: 1301570 - RNA, 18 nt, Human
gggcuggggcagguccgc

SEQ ID NO: 1301571 - RNA, 24 nt, Human
ggggcuggggcagguccgcggugg

SEQ ID NO: 1301572 - RNA, 24 nt, Human
gggugacugacaacugugcuuucu

SEQ ID NO: 1301573 - RNA, 22 nt, Human
uccagccacagcaguggagaaa

SEQ ID NO: 1301574 - RNA, 26 nt, Human
uccagcucuuccuguggggggccgcc

SEQ ID NO: 1301575 - RNA, 20 nt, Human
ucccugggguuguguuuccg

SEQ ID NO: 1301576 - RNA, 18 nt, Human
uccuuccucccucugauc

SEQ ID NO: 1301577 - RNA, 24 nt, Human
ucugcugggacacagagcugggug

SEQ ID NO: 1301578 - RNA, 23 nt, Human
ugacugacaacugugcuuucuua

SEQ ID NO: 1301579 - RNA, 24 nt, Human
ugagcuagggggcguggccccagg

SEQ ID NO: 1301580 - RNA, 26 nt, Human
ugaggggugacugacaacugugcuuu

SEQ ID NO: 1301581 - RNA, 22 nt, Human
ugagucuuggugguaucuugug

SEQ ID NO: 1301582 - RNA, 19 nt, Human
ugcugggacacagagcugg

SEQ ID NO: 1301583 - RNA, 22 nt, Human
uggcagccagagggccggggag

SEQ ID NO: 1301584 - RNA, 21 nt, Human
ugggagcggcuguaaauaaua

SEQ ID NO: 1301585 - RNA, 24 nt, Human
ugggaggaaggucugagucuuugg

SEQ ID NO: 1301586 - RNA, 23 nt, Human
ugggucuccagggugacgguggu

SEQ ID NO: 1301587 - RNA, 25 nt, Human
ugguuggggcagccacaaggugucu

SEQ ID NO: 1301588 - RNA, 20 nt, Human
uguccagccacagcagugga

SEQ ID NO: 1301589 - RNA, 24 nt, Human
uuccgcaagcagccuuuccagcug

SEQ ID NO: 1301590 - RNA, 20 nt, Human
uuuuccccugucccguggag

SEQ ID NO: 1301591 - RNA, 19 nt, Human
aaagugcuaggauuacagg

SEQ ID NO: 1301592 - RNA, 24 nt, Human
aaagugcuaggauuacagguguga

SEQ ID NO: 1301593 - RNA, 20 nt, Human
aacggagacuuguucuugug

SEQ ID NO: 1301594 - RNA, 23 nt, Human
aagaaggaggaccagaaaugaag

SEQ ID NO: 1301595 - RNA, 28 nt, Human
aagcagaaacgugaaagaaaagggaccc

SEQ ID NO: 1301596 - RNA, 19 nt, Human
aagugcuaggauuacaggu

SEQ ID NO: 1301597 - RNA, 23 nt, Human
acacaccuguguggguaccaaca

SEQ ID NO: 1301598 - RNA, 18 nt, Human
acgccuggccuccgcgug

SEQ ID NO: 1301599 - RNA, 21 nt, Human
agaaagcagaaacgugaaaga

SEQ ID NO: 1301600 - RNA, 22 nt, Human
aggcagcugcccaacucugccc

SEQ ID NO: 1301601 - RNA, 23 nt, Human
aggugugagucaccacgccuggc

SEQ ID NO: 1301602 - RNA, 21 nt, Human
augggccaggggggcacuuuc

SEQ ID NO: 1301603 - RNA, 24 nt, Human
caaagugcuaggauuacaggugug

SEQ ID NO: 1301604 - RNA, 19 nt, Human
caacacugccgaugcuccc

SEQ ID NO: 1301605 - RNA, 19 nt, Human
caccacgccuggccuccgc

SEQ ID NO: 1301606 - RNA, 27 nt, Human
cagcaagguucucuccccaucagguuc

SEQ ID NO: 1301607 - RNA, 21 nt, Human
ccaaagugcuaggauuacagg

SEQ ID NO: 1301608 - RNA, 24 nt, Human
ccaaagugcuaggauuacaggugu

SEQ ID NO: 1301609 - RNA, 23 nt, Human
ccauguggggcccccagcaaggu

SEQ ID NO: 1301610 - RNA, 21 nt, Human
cccagcaagguucucucccca

SEQ ID NO: 1301611 - RNA, 25 nt, Human
ccuggcccauguggggguccccugg

SEQ ID NO: 1301612 - RNA, 22 nt, Human
cucugcccuggcugccccuggc

SEQ ID NO: 1301613 - RNA, 19 nt, Human
gaagaaggaggaccagaaa

SEQ ID NO: 1301614 - RNA, 18 nt, Human
gagcaagcacaaaaccac

SEQ ID NO: 1301615 - RNA, 18 nt, Human
gauuacaggugugaguca

SEQ ID NO: 1301616 - RNA, 21 nt, Human
gauuacaggugugagucacca

SEQ ID NO: 1301617 - RNA, 22 nt, Human
gauuacaggugugagucaccac

SEQ ID NO: 1301618 - RNA, 21 nt, Human
gcaucugucucucucaugcuc

SEQ ID NO: 1301619 - RNA, 20 nt, Human
gccuggccuccgcguggccu

SEQ ID NO: 1301620 - RNA, 21 nt, Human
gcuuugucucucucucucucu

SEQ ID NO: 1301621 - RNA, 22 nt, Human
ggauuacaggugugagucacca

SEQ ID NO: 1301622 - RNA, 24 nt, Human
ggcuggucuugaacuccugagcuc

SEQ ID NO: 1301623 - RNA, 21 nt, Human
ggcuguuguucccacaacaca

SEQ ID NO: 1301624 - RNA, 18 nt, Human
gguugaccaggcuggucu

SEQ ID NO: 1301625 - RNA, 22 nt, Human
gguugaccaggcuggucuugaa

SEQ ID NO: 1301626 - RNA, 20 nt, Human
gugagcaagcacaaaaccac

SEQ ID NO: 1301627 - RNA, 23 nt, Human
uacaggugugagucaccacgccu

SEQ ID NO: 1301628 - RNA, 21 nt, Human
uaccaacacugccgaugcucc

SEQ ID NO: 1301629 - RNA, 18 nt, Human
uaggauuacaggugugag

SEQ ID NO: 1301630 - RNA, 18 nt, Human
uaggauuacaggugugag

SEQ ID NO: 1301631 - RNA, 22 nt, Human
uaggauuacaggugugagucac

SEQ ID NO: 1301632 - RNA, 24 nt, Human
uaggauuacaggugugagucacca

SEQ ID NO: 1301633 - RNA, 26 nt, Human
ucaaaacacaccuguguggguaccaa

SEQ ID NO: 1301634 - RNA, 18 nt, Human
ucagaaagcagaaacgug

SEQ ID NO: 1301635 - RNA, 23 nt, Human
ucccaaagugcuaggauuacagg

SEQ ID NO: 1301636 - RNA, 22 nt, Human
uccccaucagguuccaagaaga

SEQ ID NO: 1301637 - RNA, 22 nt, Human
uccgcguggccuuuggcuuggg

SEQ ID NO: 1301638 - RNA, 21 nt, Human
ucucaggcagcugcccaacuc

SEQ ID NO: 1301639 - RNA, 21 nt, Human
ucuugaacuccugagcucaug

SEQ ID NO: 1301640 - RNA, 21 nt, Human
ucuuggccucccaaagugcua

SEQ ID NO: 1301641 - RNA, 24 nt, Human
ugaccaggcuggucuugaacuccu

SEQ ID NO: 1301642 - RNA, 18 nt, Human
ugagcaagcacaaaacca

SEQ ID NO: 1301643 - RNA, 19 nt, Human
ugagcaagcacaaaaccac

SEQ ID NO: 1301644 - RNA, 26 nt, Human
ugaggugugugggcaucucccacgga

SEQ ID NO: 1301645 - RNA, 24 nt, Human
ugcuaggauuacaggugugaguca

SEQ ID NO: 1301646 - RNA, 21 nt, Human
ugugagucaccacgccuggcc

SEQ ID NO: 1301647 - RNA, 20 nt, Human
uucuucucagaaagcagaaa

SEQ ID NO: 1301648 - RNA, 21 nt, Human
uuguagagacaagguugacca

SEQ ID NO: 1301649 - RNA, 20 nt, Human
uuuuuuguagagacaagguu

SEQ ID NO: 1301650 - RNA, 20 nt, Human
aaaaaugcuaaaaucaucug

SEQ ID NO: 1301651 - RNA, 23 nt, Human
aaaaugcuaaaaucaucugagcc

SEQ ID NO: 1301652 - RNA, 21 nt, Human
aaucaucugagccuucauuga

SEQ ID NO: 1301653 - RNA, 20 nt, Human
cuccgcccagcuuugacccc

SEQ ID NO: 1301654 - RNA, 20 nt, Human
cuggaguaccugaggcugag

SEQ ID NO: 1301655 - RNA, 21 nt, Human
gagcagguaacucacggcacc

SEQ ID NO: 1301656 - RNA, 20 nt, Human
uaccugaggcugagacuggc

SEQ ID NO: 1301657 - RNA, 22 nt, Human
uauugcuaaaaaaaugcuaaaa

SEQ ID NO: 1301658 - RNA, 20 nt, Human
ucaguauggugguugcugaa

SEQ ID NO: 1301659 - RNA, 21 nt, Human
ugagcagguaacucacggcac

SEQ ID NO: 1301660 - RNA, 25 nt, Human
ugaguugggaucuuuuugcuggugu

SEQ ID NO: 1301661 - RNA, 22 nt, Human
ugaugacuacugaucaguaugg

SEQ ID NO: 1301662 - RNA, 21 nt, Human
ugcuaaaaaaaugcuaaaauc

SEQ ID NO: 1301663 - RNA, 18 nt, Human
ugcugcugcuugucacug

SEQ ID NO: 1301664 - RNA, 21 nt, Human
ugcugcugcuugucacuggag

SEQ ID NO: 1301665 - RNA, 24 nt, Human
uggaguaccugaggcugagacugg

SEQ ID NO: 1301666 - RNA, 24 nt, Human
ugguugcugaagguugaacuggcu

SEQ ID NO: 1301667 - RNA, 27 nt, Human
uuauugcuaaaaaaaugcuaaaaucau

SEQ ID NO: 1301668 - RNA, 19 nt, Human
uugcugaagguugaacugg

SEQ ID NO: 1301669 - RNA, 20 nt, Human
aaacauuacccaaucaaaac

SEQ ID NO: 1301670 - RNA, 19 nt, Human
aacauuccaguugcugagu

SEQ ID NO: 1301671 - RNA, 18 nt, Human
aagaacagaaacauuacc

SEQ ID NO: 1301672 - RNA, 20 nt, Human
aaucacuagagaaugagaaa

SEQ ID NO: 1301673 - RNA, 18 nt, Human
accuaagaaauuucaguc

SEQ ID NO: 1301674 - RNA, 20 nt, Human
acgcaugggaaauauucuuu

SEQ ID NO: 1301675 - RNA, 21 nt, Human
ccaaauauuaauaaacauucc

SEQ ID NO: 1301676 - RNA, 21 nt, Human
cccuucucaauuccaaaaauc

SEQ ID NO: 1301677 - RNA, 30 nt, Human
ccugagaccuccuuaacaguuuuccacuuu

SEQ ID NO: 1301678 - RNA, 20 nt, Human
cuacccuucucaauuccaaa

SEQ ID NO: 1301679 - RNA, 20 nt, Human
cuugccuaguauccugaagu

SEQ ID NO: 1301680 - RNA, 19 nt, Human
gaaguauauuuuccaaaua

SEQ ID NO: 1301681 - RNA, 20 nt, Human
gagcuacuguugccuaucag

SEQ ID NO: 1301682 - RNA, 24 nt, Human
gguaacucaaaaauuagcuugaaa

SEQ ID NO: 1301683 - RNA, 21 nt, Human
uaaagugaaauaucccccucu

SEQ ID NO: 1301684 - RNA, 25 nt, Human
uauaaucaaaucuugacauucuacc

SEQ ID NO: 1301685 - RNA, 24 nt, Human
uauucuugccuaguauccugaagu

SEQ ID NO: 1301686 - RNA, 20 nt, Human
ucccuaccuaagaaauuuca

SEQ ID NO: 1301687 - RNA, 22 nt, Human
ucuacccuucucaauuccaaaa

SEQ ID NO: 1301688 - RNA, 25 nt, Human
ucuacccuucucaauuccaaaaauc

SEQ ID NO: 1301689 - RNA, 24 nt, Human
ucugacucccuuaacaaguagcaa

SEQ ID NO: 1301690 - RNA, 26 nt, Human
ugaaaaugccuuaagcucuauaccau

SEQ ID NO: 1301691 - RNA, 18 nt, Human
ugagcaugaaaaugccuu

SEQ ID NO: 1301692 - RNA, 18 nt, Human
uggaaguauauuuuccaa

SEQ ID NO: 1301693 - RNA, 21 nt, Human
uggaaguauauuuuccaaaua

SEQ ID NO: 1301694 - RNA, 22 nt, Human
ugguaacucaaaaauuagcuug

SEQ ID NO: 1301695 - RNA, 22 nt, Human
uucaguaggagcuacuguugcc

SEQ ID NO: 1301696 - RNA, 21 nt, Human
uucuugccuaguauccugaag

SEQ ID NO: 1301697 - RNA, 18 nt, Human
uuucaguaggagcuacug

SEQ ID NO: 1301698 - RNA, 19 nt, Human
uuuucuaaauucccugggu

SEQ ID NO: 1301699 - RNA, 22 nt, Human
cagguauccaccugucagugcc

SEQ ID NO: 1301700 - RNA, 22 nt, Human
cagugccacagccacugguggu

SEQ ID NO: 1301701 - RNA, 22 nt, Human
cccuggcucccuggggccucuc

SEQ ID NO: 1301702 - RNA, 21 nt, Human
cccuggggccucuccaaacac

SEQ ID NO: 1301703 - RNA, 21 nt, Human
ccugucagugccacagccacu

SEQ ID NO: 1301704 - RNA, 23 nt, Human
ccugucagugccacagccacugg

SEQ ID NO: 1301705 - RNA, 21 nt, Human
cuaaggaaagagaagccaggu

SEQ ID NO: 1301706 - RNA, 18 nt, Human
cucccuggggccucucca

SEQ ID NO: 1301707 - RNA, 19 nt, Human
cucccuggggccucuccaa

SEQ ID NO: 1301708 - RNA, 22 nt, Human
cugcuggcucccuggcucccug

SEQ ID NO: 1301709 - RNA, 22 nt, Human
cuggggccucuccaaacaccag

SEQ ID NO: 1301710 - RNA, 19 nt, Human
uagcuucuacaucccuggu

SEQ ID NO: 1301711 - RNA, 18 nt, Human
ucuccaaacaccaggguu

SEQ ID NO: 1301712 - RNA, 24 nt, Human
uggcucccuggcucccuggggccu

SEQ ID NO: 1301713 - RNA, 19 nt, Human
uggggccucuccaaacacc

SEQ ID NO: 1301714 - RNA, 19 nt, Human
ugucagugccacagccacu

SEQ ID NO: 1301715 - RNA, 22 nt, Human
aaaaggaaaagaacagcaaaag

SEQ ID NO: 1301716 - RNA, 21 nt, Human
aaacagaaauaaaagauacua

SEQ ID NO: 1301717 - RNA, 23 nt, Human
aaacagaaauaaaagauacuauc

SEQ ID NO: 1301718 - RNA, 22 nt, Human
aaagaacagcaaaagucaggag

SEQ ID NO: 1301719 - RNA, 19 nt, Human
aacacagcucucccugucu

SEQ ID NO: 1301720 - RNA, 20 nt, Human
aacacagcucucccugucuc

SEQ ID NO: 1301721 - RNA, 20 nt, Human
aaccuaaacccgccuuccuu

SEQ ID NO: 1301722 - RNA, 18 nt, Human
aagaagugauagaguuuc

SEQ ID NO: 1301723 - RNA, 22 nt, Human
aagcacuuuauuuuuuauauau

SEQ ID NO: 1301724 - RNA, 20 nt, Human
aaguuuuucauucuuccuug

SEQ ID NO: 1301725 - RNA, 19 nt, Human
acacagcucucccugucuc

SEQ ID NO: 1301726 - RNA, 19 nt, Human
accauguauaugacaggau

SEQ ID NO: 1301727 - RNA, 22 nt, Human
accuuacgaauccaaagaacug

SEQ ID NO: 1301728 - RNA, 23 nt, Human
acuauagagaguugaaaccuaaa

SEQ ID NO: 1301729 - RNA, 22 nt, Human
acugccagaggcccauaccggc

SEQ ID NO: 1301730 - RNA, 20 nt, Human
agaagcuggacuagagacgg

SEQ ID NO: 1301731 - RNA, 22 nt, Human
agcccagaaacacagcucuccc

SEQ ID NO: 1301732 - RNA, 18 nt, Human
aggacgucauuuuguaaa

SEQ ID NO: 1301733 - RNA, 22 nt, Human
augugccacccagucacagagu

SEQ ID NO: 1301734 - RNA, 20 nt, Human
caacaccuguaguugaauau

SEQ ID NO: 1301735 - RNA, 20 nt, Human
caacuuuacugccgcagccc

SEQ ID NO: 1301736 - RNA, 19 nt, Human
cacagcucucccugucucc

SEQ ID NO: 1301737 - RNA, 19 nt, Human
caccaugaucuucaucaca

SEQ ID NO: 1301738 - RNA, 27 nt, Human
caccuaugaugccauguaccaaauuca

SEQ ID NO: 1301739 - RNA, 18 nt, Human
cagcaguggcaaugggac

SEQ ID NO: 1301740 - RNA, 22 nt, Human
cagcucucccugucuccaacuc

SEQ ID NO: 1301741 - RNA, 23 nt, Human
cagcucucccugucuccaacucc

SEQ ID NO: 1301742 - RNA, 22 nt, Human
cauuuuguaaaguuuaacuucu

SEQ ID NO: 1301743 - RNA, 23 nt, Human
ccaccagauuguacauacugugu

SEQ ID NO: 1301744 - RNA, 23 nt, Human
ccauuuuugaggugcaagcaguu

SEQ ID NO: 1301745 - RNA, 18 nt, Human
cccuugcaaaaggaaaag

SEQ ID NO: 1301746 - RNA, 21 nt, Human
cccuugcaaaaggaaaagaac

SEQ ID NO: 1301747 - RNA, 20 nt, Human
ccucacuugauuugaaaggg

SEQ ID NO: 1301748 - RNA, 19 nt, Human
ccuuccgguggagcugccu

SEQ ID NO: 1301749 - RNA, 18 nt, Human
ccuuccugcccuuuccca

SEQ ID NO: 1301750 - RNA, 18 nt, Human
cgccuuaagccauucagc

SEQ ID NO: 1301751 - RNA, 18 nt, Human
cguaggucaaaagggucu

SEQ ID NO: 1301752 - RNA, 18 nt, Human
cucccugucuccaacucc

SEQ ID NO: 1301753 - RNA, 22 nt, Human
cucucccugucuccaacuccag

SEQ ID NO: 1301754 - RNA, 19 nt, Human
gaggauguggaggcccugc

SEQ ID NO: 1301755 - RNA, 20 nt, Human
gcaaaagucaggagcaguaa

SEQ ID NO: 1301756 - RNA, 18 nt, Human
gcaguggcaaugggacuc

SEQ ID NO: 1301757 - RNA, 22 nt, Human
ggcacccccuugcaaaaggaaa

SEQ ID NO: 1301758 - RNA, 18 nt, Human
ggccugacucggugugcg

SEQ ID NO: 1301759 - RNA, 18 nt, Human
gggcggcaaugacagaag

SEQ ID NO: 1301760 - RNA, 25 nt, Human
uaaaacaugaaacuauaaauuuagg

SEQ ID NO: 1301761 - RNA, 24 nt, Human
uaaaguaagaucuccuugccucuu

SEQ ID NO: 1301762 - RNA, 21 nt, Human
uaagagcuguuacuuuuucag

SEQ ID NO: 1301763 - RNA, 22 nt, Human
uacacagacauccauaugcagc

SEQ ID NO: 1301764 - RNA, 18 nt, Human
uacauauacacagacauc

SEQ ID NO: 1301765 - RNA, 24 nt, Human
uacauauacacagacauccauaug

SEQ ID NO: 1301766 - RNA, 22 nt, Human
uaccaggcaucucaguaacucc

SEQ ID NO: 1301767 - RNA, 19 nt, Human
uagaagcuggacuagagac

SEQ ID NO: 1301768 - RNA, 18 nt, Human
uagaggcccagaucccau

SEQ ID NO: 1301769 - RNA, 22 nt, Human
uauacacagacauccauaugca

SEQ ID NO: 1301770 - RNA, 21 nt, Human
uauauguauauaccauguaua

SEQ ID NO: 1301771 - RNA, 23 nt, Human
uauauugucauaauauauugagu

SEQ ID NO: 1301772 - RNA, 28 nt, Human
uaugacaggauguuuguccugggacacc

SEQ ID NO: 1301773 - RNA, 20 nt, Human
uauguauauaccauguauau

SEQ ID NO: 1301774 - RNA, 18 nt, Human
uccaguaagcccuccuca

SEQ ID NO: 1301775 - RNA, 23 nt, Human
ucccagguggucugaagucaggu

SEQ ID NO: 1301776 - RNA, 21 nt, Human
ucccaucacaaaguuuuucau

SEQ ID NO: 1301777 - RNA, 23 nt, Human
ucgaccugcucaccacuggugau

SEQ ID NO: 1301778 - RNA, 23 nt, Human
ucucaguaacuccuagacuuuuu

SEQ ID NO: 1301779 - RNA, 19 nt, Human
ucuccaacuccaguaagcc

SEQ ID NO: 1301780 - RNA, 18 nt, Human
ucuguguuaaaacaugaa

SEQ ID NO: 1301781 - RNA, 18 nt, Human
ucuuaaacgcugaucuua

SEQ ID NO: 1301782 - RNA, 20 nt, Human
ucuuaaccguuucuuggcuu

SEQ ID NO: 1301783 - RNA, 18 nt, Human
ugaaggacaucuauuucc

SEQ ID NO: 1301784 - RNA, 21 nt, Human
ugauauccauuuuugaggugc

SEQ ID NO: 1301785 - RNA, 20 nt, Human
ugauauguauaguacauaua

SEQ ID NO: 1301786 - RNA, 23 nt, Human
ugaugccaacuuuacugccgcag

SEQ ID NO: 1301787 - RNA, 23 nt, Human
ugauggaaguuuuguagauaagu

SEQ ID NO: 1301788 - RNA, 24 nt, Human
ugaugugccacccagucacagagu

SEQ ID NO: 1301789 - RNA, 19 nt, Human
ugcaaaaggaaaagaacag

SEQ ID NO: 1301790 - RNA, 18 nt, Human
ugccagugaaggacaucu

SEQ ID NO: 1301791 - RNA, 19 nt, Human
ugccuuggaggauguggag

SEQ ID NO: 1301792 - RNA, 20 nt, Human
ugcggccacuucggcacugc

SEQ ID NO: 1301793 - RNA, 18 nt, Human
uggcacauuuuccccagc

SEQ ID NO: 1301794 - RNA, 21 nt, Human
uguggaggcccugcacccaag

SEQ ID NO: 1301795 - RNA, 20 nt, Human
uguggcuuuuuuuguucacc

SEQ ID NO: 1301796 - RNA, 23 nt, Human
ugugugcuugguugauauguaua

SEQ ID NO: 1301797 - RNA, 19 nt, Human
uugaaaccuaaacccgccu

SEQ ID NO: 1301798 - RNA, 23 nt, Human
uuggcacccccuugcaaaaggaa

SEQ ID NO: 1301799 - RNA, 28 nt, Human
uuuuguuuugguuuuuuauuuuuugucu

SEQ ID NO: 1301800 - RNA, 19 nt, Human
aagcacccagcccaacuga

SEQ ID NO: 1301801 - RNA, 20 nt, Human
acccagcccaacugagcuug

SEQ ID NO: 1301802 - RNA, 22 nt, Human
ccagugcaaacuggacugggaa

SEQ ID NO: 1301803 - RNA, 22 nt, Human
cccaacugagcuugaaugcccu

SEQ ID NO: 1301804 - RNA, 19 nt, Human
cgggagacaaaguugaacc

SEQ ID NO: 1301805 - RNA, 22 nt, Human
cugaugaccucugauguucucu

SEQ ID NO: 1301806 - RNA, 21 nt, Human
cuuuuggcuuugaauaaucuu

SEQ ID NO: 1301807 - RNA, 20 nt, Human
gaagcacccagcccaacuga

SEQ ID NO: 1301808 - RNA, 23 nt, Human
gggcugcaccagugcaaacuggg

SEQ ID NO: 1301809 - RNA, 20 nt, Human
ucauuggucaauacaggcaa

SEQ ID NO: 1301810 - RNA, 21 nt, Human
ucucuuggaagcacccagccc

SEQ ID NO: 1301811 - RNA, 21 nt, Human
ugaaggguuucugcaagagaa

SEQ ID NO: 1301812 - RNA, 18 nt, Human
uguuggcuuuuggcuuug

SEQ ID NO: 1301813 - RNA, 23 nt, Human
uuggaagcacccagcccaacuga

SEQ ID NO: 1301814 - RNA, 21 nt, Human
aacaccuucccauucuucagc

SEQ ID NO: 1301815 - RNA, 19 nt, Human
aaccaggcgggcacuggcc

SEQ ID NO: 1301816 - RNA, 21 nt, Human
aacuccaccccgcuccaccuc

SEQ ID NO: 1301817 - RNA, 22 nt, Human
aagagcacccagucuuggacuc

SEQ ID NO: 1301818 - RNA, 19 nt, Human
aaggcagggcggccaggug

SEQ ID NO: 1301819 - RNA, 23 nt, Human
acaaggacuguggccacuggaca

SEQ ID NO: 1301820 - RNA, 21 nt, Human
acaaugagacacagcgggcac

SEQ ID NO: 1301821 - RNA, 18 nt, Human
acacagccacuguguccc

SEQ ID NO: 1301822 - RNA, 18 nt, Human
acgggguggcucugggcc

SEQ ID NO: 1301823 - RNA, 20 nt, Human
acucaacaccuucccauucu

SEQ ID NO: 1301824 - RNA, 20 nt, Human
agagagccauggcaugcagg

SEQ ID NO: 1301825 - RNA, 24 nt, Human
agaggcccuuugguggagaagccc

SEQ ID NO: 1301826 - RNA, 21 nt, Human
agaguccugacuggcacccuc

SEQ ID NO: 1301827 - RNA, 19 nt, Human
agcauuccugggacucgug

SEQ ID NO: 1301828 - RNA, 18 nt, Human
agccuggguggugaguuc

SEQ ID NO: 1301829 - RNA, 23 nt, Human
agcuccgggccagauggcucucc

SEQ ID NO: 1301830 - RNA, 19 nt, Human
aggaagguucagagccuca

SEQ ID NO: 1301831 - RNA, 19 nt, Human
aggcaaagaugggagcaga

SEQ ID NO: 1301832 - RNA, 18 nt, Human
auccucaacugaaacccc

SEQ ID NO: 1301833 - RNA, 18 nt, Human
caacugaaaccccugcca

SEQ ID NO: 1301834 - RNA, 19 nt, Human
caacugaaaccccugccag

SEQ ID NO: 1301835 - RNA, 19 nt, Human
cacagccacuguguccccc

SEQ ID NO: 1301836 - RNA, 21 nt, Human
cacaggaagguucagagccuc

SEQ ID NO: 1301837 - RNA, 21 nt, Human
cacagucugucuccuucaggg

SEQ ID NO: 1301838 - RNA, 25 nt, Human
caccagugggugcucccacacagcc

SEQ ID NO: 1301839 - RNA, 19 nt, Human
cagcagcagcagcagcccc

SEQ ID NO: 1301840 - RNA, 20 nt, Human
cagccugggagcagcagcag

SEQ ID NO: 1301841 - RNA, 25 nt, Human
cagucuucucccccagcuucccucc

SEQ ID NO: 1301842 - RNA, 18 nt, Human
cagugggcugcucucacc

SEQ ID NO: 1301843 - RNA, 19 nt, Human
caucaggaguggccagggg

SEQ ID NO: 1301844 - RNA, 21 nt, Human
caucugaaccccgcuaaaggc

SEQ ID NO: 1301845 - RNA, 23 nt, Human
caugucagucuggcucacacugg

SEQ ID NO: 1301846 - RNA, 22 nt, Human
ccacuaggcagcagugugaccc

SEQ ID NO: 1301847 - RNA, 22 nt, Human
ccagaccagacgggacucaggg

SEQ ID NO: 1301848 - RNA, 20 nt, Human
ccauugugcucccaggaaau

SEQ ID NO: 1301849 - RNA, 21 nt, Human
cccacacagccacuguguccc

SEQ ID NO: 1301850 - RNA, 23 nt, Human
cccacacagccacuguguccccc

SEQ ID NO: 1301851 - RNA, 26 nt, Human
cccaugguggaggcaaagaugggagc

SEQ ID NO: 1301852 - RNA, 18 nt, Human
ccccaggcagugggcugc

SEQ ID NO: 1301853 - RNA, 22 nt, Human
ccccauugccauugaacgccug

SEQ ID NO: 1301854 - RNA, 23 nt, Human
cccccugucacaaccaggcgggc

SEQ ID NO: 1301855 - RNA, 19 nt, Human
ccccuggggacgggguggc

SEQ ID NO: 1301856 - RNA, 19 nt, Human
ccccuggggacgggguggc

SEQ ID NO: 1301857 - RNA, 21 nt, Human
ccccuggggacgggguggcuc

SEQ ID NO: 1301858 - RNA, 24 nt, Human
ccccuggggacgggguggggcgcg

SEQ ID NO: 1301859 - RNA, 25 nt, Human
ccccuggggacgggguggggcgcug

SEQ ID NO: 1301860 - RNA, 18 nt, Human
cccguagcgguucugggc

SEQ ID NO: 1301861 - RNA, 22 nt, Human
cccuccacucugagucuggccu

SEQ ID NO: 1301862 - RNA, 22 nt, Human
cccuuugguggagaagcccagg

SEQ ID NO: 1301863 - RNA, 18 nt, Human
ccuaucccgcugccagga

SEQ ID NO: 1301864 - RNA, 18 nt, Human
ccugcagcacagccccag

SEQ ID NO: 1301865 - RNA, 20 nt, Human
ccugcagcacagccccagcc

SEQ ID NO: 1301866 - RNA, 20 nt, Human
ccuugaguggcacaggaagg

SEQ ID NO: 1301867 - RNA, 23 nt, Human
cgcugccaggaaauggacacagg

SEQ ID NO: 1301868 - RNA, 21 nt, Human
cggcgggaaggcagggcggcc

SEQ ID NO: 1301869 - RNA, 19 nt, Human
cgugcuguucucugccacg

SEQ ID NO: 1301870 - RNA, 21 nt, Human
cucaauggauucuggauguug

SEQ ID NO: 1301871 - RNA, 19 nt, Human
cucgugggcacgggaaggg

SEQ ID NO: 1301872 - RNA, 21 nt, Human
cugaaaccccugccagcauca

SEQ ID NO: 1301873 - RNA, 21 nt, Human
cugcagcacagccccagccug

SEQ ID NO: 1301874 - RNA, 21 nt, Human
cuucaggggcccaauuucccc

SEQ ID NO: 1301875 - RNA, 18 nt, Human
gaaauggauggcucaggc

SEQ ID NO: 1301876 - RNA, 23 nt, Human
gacacaggcggcucacccuccac

SEQ ID NO: 1301877 - RNA, 19 nt, Human
gagccaguugggcccuugg

SEQ ID NO: 1301878 - RNA, 21 nt, Human
gagccugcagcacagccccag

SEQ ID NO: 1301879 - RNA, 19 nt, Human
gcagcacagccccagccug

SEQ ID NO: 1301880 - RNA, 25 nt, Human
gcagcaccagugggugcucccacac

SEQ ID NO: 1301881 - RNA, 20 nt, Human
gcagugguacucgugggcac

SEQ ID NO: 1301882 - RNA, 22 nt, Human
gccaggugcagggagccaucug

SEQ ID NO: 1301883 - RNA, 25 nt, Human
gccccuggggacgggguggcucugg

SEQ ID NO: 1301884 - RNA, 22 nt, Human
gccuugaguggcacaggaaggu

SEQ ID NO: 1301885 - RNA, 21 nt, Human
gcuaaaggcagcuguuucaca

SEQ ID NO: 1301886 - RNA, 21 nt, Human
ggaaggcagggcggccaggug

SEQ ID NO: 1301887 - RNA, 20 nt, Human
ggaagggaggcuccggcggg

SEQ ID NO: 1301888 - RNA, 21 nt, Human
ggagggggggguggcucccag

SEQ ID NO: 1301889 - RNA, 21 nt, Human
gggaaggcagggcggccaggu

SEQ ID NO: 1301890 - RNA, 19 nt, Human
ggggacgggguggcucugg

SEQ ID NO: 1301891 - RNA, 24 nt, Human
ggggugcugcccaugguggaggca

SEQ ID NO: 1301892 - RNA, 23 nt, Human
guacuauuguugugagucagccu

SEQ ID NO: 1301893 - RNA, 24 nt, Human
gugcugcccaugguggaggcaaag

SEQ ID NO: 1301894 - RNA, 20 nt, Human
guggcucugggcccccuguc

SEQ ID NO: 1301895 - RNA, 22 nt, Human
uauucagggcugugccauugug

SEQ ID NO: 1301896 - RNA, 19 nt, Human
ucagccagaccagacggga

SEQ ID NO: 1301897 - RNA, 20 nt, Human
ucagucuucucccccagcuu

SEQ ID NO: 1301898 - RNA, 21 nt, Human
uccaccccgcuccaccucaau

SEQ ID NO: 1301899 - RNA, 20 nt, Human
ucccaugucagucuggcucc

SEQ ID NO: 1301900 - RNA, 22 nt, Human
ucccauucuucagccagaccag

SEQ ID NO: 1301901 - RNA, 23 nt, Human
ucccauucuucagccagaccaga

SEQ ID NO: 1301902 - RNA, 24 nt, Human
ucccccagcuucccuccacucuga

SEQ ID NO: 1301903 - RNA, 18 nt, Human
ucccuccacucugagucu

SEQ ID NO: 1301904 - RNA, 20 nt, Human
ucugggccacgcagugguac

SEQ ID NO: 1301905 - RNA, 21 nt, Human
ugacacugcuggccaggagca

SEQ ID NO: 1301906 - RNA, 18 nt, Human
ugacccggugguuggcag

SEQ ID NO: 1301907 - RNA, 19 nt, Human
ugauguggaggaugccacc

SEQ ID NO: 1301908 - RNA, 25 nt, Human
ugcaggccccuggggacgggguggc

SEQ ID NO: 1301909 - RNA, 19 nt, Human
ugccaggaaauggacacag

SEQ ID NO: 1301910 - RNA, 26 nt, Human
ugcucccaggaaauggauggcucagg

SEQ ID NO: 1301911 - RNA, 19 nt, Human
ugcuggagggggggguggc

SEQ ID NO: 1301912 - RNA, 21 nt, Human
uggagcuccgggccagauggc

SEQ ID NO: 1301913 - RNA, 24 nt, Human
uggaggaugccacuaggcagcagu

SEQ ID NO: 1301914 - RNA, 19 nt, Human
uggaggcaaagaugggagc

SEQ ID NO: 1301915 - RNA, 19 nt, Human
uggagggggggguggcucc

SEQ ID NO: 1301916 - RNA, 20 nt, Human
uggagggggggguggcuccc

SEQ ID NO: 1301917 - RNA, 20 nt, Human
uggaugcccaccacaacccc

SEQ ID NO: 1301918 - RNA, 22 nt, Human
uggaugcccaccacaaccccag

SEQ ID NO: 1301919 - RNA, 20 nt, Human
uggcacugcugcccggaggc

SEQ ID NO: 1301920 - RNA, 22 nt, Human
uggccaggggcacaucacacaa

SEQ ID NO: 1301921 - RNA, 24 nt, Human
uggccugguuggagcccgugcugu

SEQ ID NO: 1301922 - RNA, 23 nt, Human
uggcugcaagagcacccagucuu

SEQ ID NO: 1301923 - RNA, 21 nt, Human
ugggcccccugucacaaccag

SEQ ID NO: 1301924 - RNA, 20 nt, Human
ugggcugauaaagccugggu

SEQ ID NO: 1301925 - RNA, 18 nt, Human
uggugaguucagucuucu

SEQ ID NO: 1301926 - RNA, 21 nt, Human
ugucacaaccaggcgggcacu

SEQ ID NO: 1301927 - RNA, 22 nt, Human
ugucauagagagcagccgguuc

SEQ ID NO: 1301928 - RNA, 18 nt, Human
uguguagaggaaggagcu

SEQ ID NO: 1301929 - RNA, 19 nt, Human
uguguagaggaaggagcug

SEQ ID NO: 1301930 - RNA, 24 nt, Human
uguguagaggaaggagcugacacu

SEQ ID NO: 1301931 - RNA, 24 nt, Human
uucagggcugugccauugugcucc

SEQ ID NO: 1301932 - RNA, 20 nt, Human
uucccaggacucaacaccuu

SEQ ID NO: 1301933 - RNA, 21 nt, Human
uucucccccagcuucccucca

SEQ ID NO: 1301934 - RNA, 21 nt, Human
uuggcaguauucagggcugug

SEQ ID NO: 1301935 - RNA, 24 nt, Human
accaguccuacuccucccaacccc

SEQ ID NO: 1301936 - RNA, 23 nt, Human
acucuuucacccucucuucaggg

SEQ ID NO: 1301937 - RNA, 19 nt, Human
acuggagcccgcgcggccc

SEQ ID NO: 1301938 - RNA, 28 nt, Human
agaccaguccuacuccucccaaccccca

SEQ ID NO: 1301939 - RNA, 22 nt, Human
agccaggaggccccagccaggc

SEQ ID NO: 1301940 - RNA, 20 nt, Human
agcccucggccagauuccuu

SEQ ID NO: 1301941 - RNA, 19 nt, Human
aggaggccccagccaggca

SEQ ID NO: 1301942 - RNA, 23 nt, Human
auucucucucucucagucgggcc

SEQ ID NO: 1301943 - RNA, 24 nt, Human
caagcccucggccagauuccuuua

SEQ ID NO: 1301944 - RNA, 21 nt, Human
cagcgacucuuucacccucuc

SEQ ID NO: 1301945 - RNA, 20 nt, Human
caggguggggagaaacgggg

SEQ ID NO: 1301946 - RNA, 24 nt, Human
ccaaacagcuccugggugcagcga

SEQ ID NO: 1301947 - RNA, 22 nt, Human
cccaacccccaaaagauggcau

SEQ ID NO: 1301948 - RNA, 22 nt, Human
ccucuagacuccgaugugccac

SEQ ID NO: 1301949 - RNA, 19 nt, Human
cuugggaaaagggagacaa

SEQ ID NO: 1301950 - RNA, 21 nt, Human
gagcuugcggugcgugcucag

SEQ ID NO: 1301951 - RNA, 24 nt, Human
gaggguagaugagacucaagaaug

SEQ ID NO: 1301952 - RNA, 19 nt, Human
ggcuggagcuugcggugcg

SEQ ID NO: 1301953 - RNA, 19 nt, Human
guccuacuccucccaaccc

SEQ ID NO: 1301954 - RNA, 24 nt, Human
uaacagguuauucucucucucuca

SEQ ID NO: 1301955 - RNA, 28 nt, Human
uaacagguuauucucucucucucaguuc

SEQ ID NO: 1301956 - RNA, 23 nt, Human
uacacaucacggaaaccuauggg

SEQ ID NO: 1301957 - RNA, 23 nt, Human
uagaaaaggcggcgagaauccug

SEQ ID NO: 1301958 - RNA, 22 nt, Human
uagaccaaacagcuccugggug

SEQ ID NO: 1301959 - RNA, 22 nt, Human
uagaugagacucaagaaugaua

SEQ ID NO: 1301960 - RNA, 22 nt, Human
ucagaccaguccuacuccuccc

SEQ ID NO: 1301961 - RNA, 21 nt, Human
ucccaacccccaaaagauggc

SEQ ID NO: 1301962 - RNA, 24 nt, Human
uccuacuccucccaacccccaaaa

SEQ ID NO: 1301963 - RNA, 20 nt, Human
uccugggugcagcgacucuu

SEQ ID NO: 1301964 - RNA, 23 nt, Human
ugcucagccaggaggccccagcc

SEQ ID NO: 1301965 - RNA, 21 nt, Human
uucaggguggggagaaacggg

SEQ ID NO: 1301966 - RNA, 18 nt, Human
uugcggugcgugcucagc

SEQ ID NO: 1301967 - RNA, 26 nt, Human
uuuagaccaaacagcuccugggugca

SEQ ID NO: 1301968 - RNA, 20 nt, Human
aaaaaccuacuuguacugcu

SEQ ID NO: 1301969 - RNA, 19 nt, Human
aaaaagaaaacaaaaccaa

SEQ ID NO: 1301970 - RNA, 20 nt, Human
aaaaagccuacauccaaauc

SEQ ID NO: 1301971 - RNA, 24 nt, Human
aaaagaaaaauuucaaauagaaag

SEQ ID NO: 1301972 - RNA, 25 nt, Human
aaacaaaacagauaaaaagaaaaca

SEQ ID NO: 1301973 - RNA, 23 nt, Human
aaacaaaaccaaaaauccagagc

SEQ ID NO: 1301974 - RNA, 26 nt, Human
aaacaaaaccaaaaauccagagccca

SEQ ID NO: 1301975 - RNA, 29 nt, Human
aaacagauaaaaagaaaacaaaaccaaag

SEQ ID NO: 1301976 - RNA, 26 nt, Human
aaaccucuaaaauuccuuccaauucu

SEQ ID NO: 1301977 - RNA, 21 nt, Human
aacaaccagaugauguccacc

SEQ ID NO: 1301978 - RNA, 21 nt, Human
aacugggaucacaggggccug

SEQ ID NO: 1301979 - RNA, 22 nt, Human
aagccuacauccaaauccccag

SEQ ID NO: 1301980 - RNA, 18 nt, Human
aagggaaugugaggaagg

SEQ ID NO: 1301981 - RNA, 19 nt, Human
aaggggcgagugacugggg

SEQ ID NO: 1301982 - RNA, 18 nt, Human
aaguccuagaaagaggug

SEQ ID NO: 1301983 - RNA, 24 nt, Human
aauguauaaaaauucccauugaaa

SEQ ID NO: 1301984 - RNA, 30 nt, Human
acaaaacagauaaaaagaaaacaaaaccaa

SEQ ID NO: 1301985 - RNA, 22 nt, Human
acacaacuccaacuagaaaacc

SEQ ID NO: 1301986 - RNA, 22 nt, Human
acccugcuaguucuaaauccuc

SEQ ID NO: 1301987 - RNA, 23 nt, Human
agacaaagaaucugggcccaggg

SEQ ID NO: 1301988 - RNA, 21 nt, Human
agacaaagucauuugggccca

SEQ ID NO: 1301989 - RNA, 21 nt, Human
agacagguugcuaaagccaaa

SEQ ID NO: 1301990 - RNA, 23 nt, Human
agagaaaauauggucucuggagg

SEQ ID NO: 1301991 - RNA, 19 nt, Human
agagaaguuagaaaaagcc

SEQ ID NO: 1301992 - RNA, 20 nt, Human
agaggugggaguguggggug

SEQ ID NO: 1301993 - RNA, 18 nt, Human
agaguaaaccaauauugc

SEQ ID NO: 1301994 - RNA, 21 nt, Human
agcaccacccagacaggcagc

SEQ ID NO: 1301995 - RNA, 25 nt, Human
agcuguguuucccuuaccacuggcu

SEQ ID NO: 1301996 - RNA, 18 nt, Human
aggaaaaacaagcccagg

SEQ ID NO: 1301997 - RNA, 21 nt, Human
aggaaaagaugaaaaaagucc

SEQ ID NO: 1301998 - RNA, 25 nt, Human
aggaaaagaugaaaaaaguccagag

SEQ ID NO: 1301999 - RNA, 21 nt, Human
aggaagugacaggguccaagg

SEQ ID NO: 1302000 - RNA, 25 nt, Human
aggagaaagaggcagaagaaucugg

SEQ ID NO: 1302001 - RNA, 21 nt, Human
aggagggacaggggaacaaaa

SEQ ID NO: 1302002 - RNA, 20 nt, Human
aggcagaagaaucuggcuug

SEQ ID NO: 1302003 - RNA, 21 nt, Human
aggcagaagaaucuggcuugg

SEQ ID NO: 1302004 - RNA, 18 nt, Human
aggggaacaaaagaaaaa

SEQ ID NO: 1302005 - RNA, 18 nt, Human
agguccagagggcaagag

SEQ ID NO: 1302006 - RNA, 26 nt, Human
aggugggagugugggguggaggaggg

SEQ ID NO: 1302007 - RNA, 20 nt, Human
agugcagagggauggggaaa

SEQ ID NO: 1302008 - RNA, 19 nt, Human
caaaaccaaaaauccagag

SEQ ID NO: 1302009 - RNA, 20 nt, Human
caaaaccaaaaauccagagc

SEQ ID NO: 1302010 - RNA, 24 nt, Human
caaagugaaguccuagaaagaggu

SEQ ID NO: 1302011 - RNA, 23 nt, Human
caaccaaaaccaaaaauaaaaca

SEQ ID NO: 1302012 - RNA, 18 nt, Human
caacgaggaaacuuucuc

SEQ ID NO: 1302013 - RNA, 23 nt, Human
cacaguaccuaacacauaguagg

SEQ ID NO: 1302014 - RNA, 22 nt, Human
cacccugcuaguucuaaauccu

SEQ ID NO: 1302015 - RNA, 24 nt, Human
caccuggaggcacccaccaugaaa

SEQ ID NO: 1302016 - RNA, 21 nt, Human
cagaacugggaucacaggggc

SEQ ID NO: 1302017 - RNA, 21 nt, Human
cagcaaugagacaccuguggu

SEQ ID NO: 1302018 - RNA, 24 nt, Human
cagcaccacccagacaggcagcag

SEQ ID NO: 1302019 - RNA, 19 nt, Human
cagcagggccacaaagaaa

SEQ ID NO: 1302020 - RNA, 22 nt, Human
ccaaaccauucuccacauaccc

SEQ ID NO: 1302021 - RNA, 20 nt, Human
ccaagaaagaggaaaacuga

SEQ ID NO: 1302022 - RNA, 28 nt, Human
ccagagucuucugggacugccuggccaa

SEQ ID NO: 1302023 - RNA, 18 nt, Human
ccaggccaaaaguacaug

SEQ ID NO: 1302024 - RNA, 21 nt, Human
ccaggccaaaaguacaugcag

SEQ ID NO: 1302025 - RNA, 19 nt, Human
cccagacaggcagcagggc

SEQ ID NO: 1302026 - RNA, 18 nt, Human
cccagggagacaaaguca

SEQ ID NO: 1302027 - RNA, 23 nt, Human
cccauguccccagauuccagaca

SEQ ID NO: 1302028 - RNA, 22 nt, Human
ccccagauuccagacaaaacuc

SEQ ID NO: 1302029 - RNA, 20 nt, Human
ccccauguccccagauucca

SEQ ID NO: 1302030 - RNA, 28 nt, Human
ccuaacacauaguaggcacucaauaaau

SEQ ID NO: 1302031 - RNA, 25 nt, Human
ccugacccuaaucucaaaacccaac

SEQ ID NO: 1302032 - RNA, 21 nt, Human
ccuggaggcacccaccaugaa

SEQ ID NO: 1302033 - RNA, 23 nt, Human
ccuguacaagaagaaucugugug

SEQ ID NO: 1302034 - RNA, 19 nt, Human
cgaguacaacaccucccuu

SEQ ID NO: 1302035 - RNA, 21 nt, Human
cuaaagccaaaccccaugucc

SEQ ID NO: 1302036 - RNA, 24 nt, Human
cuaaagccaaaccccaugucccca

SEQ ID NO: 1302037 - RNA, 23 nt, Human
cuaaauccucuuuugggugcuug

SEQ ID NO: 1302038 - RNA, 25 nt, Human
cuagaaaaccucuaaaauuccuucc

SEQ ID NO: 1302039 - RNA, 20 nt, Human
cucaaagaauguuucagacc

SEQ ID NO: 1302040 - RNA, 18 nt, Human
cucaaccuccaaaccauu

SEQ ID NO: 1302041 - RNA, 21 nt, Human
cucugcucacucagggccugg

SEQ ID NO: 1302042 - RNA, 21 nt, Human
cuucauuuucuuucccucuca

SEQ ID NO: 1302043 - RNA, 20 nt, Human
cuucgucgggccagcaccac

SEQ ID NO: 1302044 - RNA, 19 nt, Human
cuucugggacugccuggcc

SEQ ID NO: 1302045 - RNA, 26 nt, Human
gaaaaguagaaacaaccagaugaugu

SEQ ID NO: 1302046 - RNA, 19 nt, Human
gaagggaaugugaggaagg

SEQ ID NO: 1302047 - RNA, 24 nt, Human
gaaguuagaaaaagccuacaucca

SEQ ID NO: 1302048 - RNA, 22 nt, Human
gagagaaaauauggucucugga

SEQ ID NO: 1302049 - RNA, 22 nt, Human
gagggauggggaaaauguugag

SEQ ID NO: 1302050 - RNA, 19 nt, Human
gcaggugucuccuguccag

SEQ ID NO: 1302051 - RNA, 19 nt, Human
gccagauucaaaggggcac

SEQ ID NO: 1302052 - RNA, 21 nt, Human
ggaaaaacaagcccaggcugg

SEQ ID NO: 1302053 - RNA, 18 nt, Human
ggaaaaacaagcccaggg

SEQ ID NO: 1302054 - RNA, 20 nt, Human
ggagggagagaaaauauggu

SEQ ID NO: 1302055 - RNA, 18 nt, Human
ggagggguuguugauguu

SEQ ID NO: 1302056 - RNA, 22 nt, Human
ggaggucuagggcagguuccug

SEQ ID NO: 1302057 - RNA, 22 nt, Human
ggagugugggguggaggaggga

SEQ ID NO: 1302058 - RNA, 22 nt, Human
gggcaagagaacagaacuggga

SEQ ID NO: 1302059 - RNA, 24 nt, Human
gguagggguggcuggagaccacag

SEQ ID NO: 1302060 - RNA, 23 nt, Human
gucguuuagggaaauaaauacug

SEQ ID NO: 1302061 - RNA, 18 nt, Human
gugcacuguuccauuuuu

SEQ ID NO: 1302062 - RNA, 19 nt, Human
gugguuguccucaaccucc

SEQ ID NO: 1302063 - RNA, 18 nt, Human
guguuugggaguguuacu

SEQ ID NO: 1302064 - RNA, 19 nt, Human
uaaggagagguggagggaa

SEQ ID NO: 1302065 - RNA, 21 nt, Human
uaaggagagguggagggaagg

SEQ ID NO: 1302066 - RNA, 18 nt, Human
uacgguucuaugauucca

SEQ ID NO: 1302067 - RNA, 21 nt, Human
uagaaaaagccuacauccaaa

SEQ ID NO: 1302068 - RNA, 19 nt, Human
uagaaacaaccagaugaug

SEQ ID NO: 1302069 - RNA, 24 nt, Human
uagaaacaggaucauugccuaagc

SEQ ID NO: 1302070 - RNA, 19 nt, Human
uagggccaagacagguugc

SEQ ID NO: 1302071 - RNA, 19 nt, Human
uaggggcagaggaguuggg

SEQ ID NO: 1302072 - RNA, 21 nt, Human
ucaaaacccaaccuggcaagc

SEQ ID NO: 1302073 - RNA, 20 nt, Human
ucaaaggggcacauggccuu

SEQ ID NO: 1302074 - RNA, 21 nt, Human
ucauuuucuuucccucucacc

SEQ ID NO: 1302075 - RNA, 19 nt, Human
uccaacuagaaaaccucua

SEQ ID NO: 1302076 - RNA, 24 nt, Human
uccacauacccaugaccugacccu

SEQ ID NO: 1302077 - RNA, 20 nt, Human
ucccuuggaggugggcccuu

SEQ ID NO: 1302078 - RNA, 20 nt, Human
ucuagggcagguuccuggga

SEQ ID NO: 1302079 - RNA, 21 nt, Human
ucuguguuucccaaauucuug

SEQ ID NO: 1302080 - RNA, 22 nt, Human
ugaacgaauaaaugauugguga

SEQ ID NO: 1302081 - RNA, 19 nt, Human
ugaaguccuagaaagaggu

SEQ ID NO: 1302082 - RNA, 20 nt, Human
ugagguggaggaaaagauga

SEQ ID NO: 1302083 - RNA, 20 nt, Human
ugcacuguuccauuuuuucc

SEQ ID NO: 1302084 - RNA, 20 nt, Human
ugcagagggauggggaaaau

SEQ ID NO: 1302085 - RNA, 19 nt, Human
ugcaggagagcucaucuug

SEQ ID NO: 1302086 - RNA, 25 nt, Human
ugccuguacaagaagaaucugugug

SEQ ID NO: 1302087 - RNA, 19 nt, Human
uggagcaggugucuccugu

SEQ ID NO: 1302088 - RNA, 19 nt, Human
uggaggagggacaggggaa

SEQ ID NO: 1302089 - RNA, 22 nt, Human
uggcuggagaccacagggacac

SEQ ID NO: 1302090 - RNA, 24 nt, Human
ugggacugccuggccaaauuccag

SEQ ID NO: 1302091 - RNA, 19 nt, Human
ugggagugugggguggagg

SEQ ID NO: 1302092 - RNA, 24 nt, Human
ugggguagggguggcuggagacca

SEQ ID NO: 1302093 - RNA, 23 nt, Human
uggguagaagccaagaaagagga

SEQ ID NO: 1302094 - RNA, 23 nt, Human
ugggugcuugguaaggagaggug

SEQ ID NO: 1302095 - RNA, 18 nt, Human
ugguaaggagagguggag

SEQ ID NO: 1302096 - RNA, 19 nt, Human
uguacaagaagaaucugug

SEQ ID NO: 1302097 - RNA, 21 nt, Human
uguacugcuuaucucaggcca

SEQ ID NO: 1302098 - RNA, 18 nt, Human
uguccagagcuuugaagu

SEQ ID NO: 1302099 - RNA, 24 nt, Human
uguggauuuuggggaaccaauagg

SEQ ID NO: 1302100 - RNA, 19 nt, Human
ugugggguggaggagggac

SEQ ID NO: 1302101 - RNA, 20 nt, Human
uguugguagaaacaggauca

SEQ ID NO: 1302102 - RNA, 22 nt, Human
uuaagacacaguucuguaacuu

SEQ ID NO: 1302103 - RNA, 22 nt, Human
uuaccacuggcuuaucagugcc

SEQ ID NO: 1302104 - RNA, 21 nt, Human
uuagaaaaagccuacauccaa

SEQ ID NO: 1302105 - RNA, 22 nt, Human
uucccuuggaggugggcccuug

SEQ ID NO: 1302106 - RNA, 23 nt, Human
uuccugggauaaggugcaguguu

SEQ ID NO: 1302107 - RNA, 23 nt, Human
uucuaaauccucuuuugggugcu

SEQ ID NO: 1302108 - RNA, 22 nt, Human
uugcuaaagccaaaccccaugu

SEQ ID NO: 1302109 - RNA, 19 nt, Human
uuugucaauucaguuauag

SEQ ID NO: 1302110 - RNA, 21 nt, Human
uuuguggguagaagccaagaa

SEQ ID NO: 1302111 - RNA, 22 nt, Human
aaacccuccaaauccacucucc

SEQ ID NO: 1302112 - RNA, 23 nt, Human
cacugagaccuuuccgaguuuaa

SEQ ID NO: 1302113 - RNA, 19 nt, Human
cagacgcagcccugcaacu

SEQ ID NO: 1302114 - RNA, 20 nt, Human
ccugcaacuuugcugugcac

SEQ ID NO: 1302115 - RNA, 18 nt, Human
gcccugcaacuuugcugu

SEQ ID NO: 1302116 - RNA, 21 nt, Human
guagugcagacgcagcccugc

SEQ ID NO: 1302117 - RNA, 22 nt, Human
gugcagacgcagcccugcaacu

SEQ ID NO: 1302118 - RNA, 21 nt, Human
uaaacccuccaaauccacucu

SEQ ID NO: 1302119 - RNA, 21 nt, Human
ugaagguuuuugauuccuucc

SEQ ID NO: 1302120 - RNA, 25 nt, Human
ugaagguuuuugauuccuuccauaa

SEQ ID NO: 1302121 - RNA, 24 nt, Human
ugcaggaaaacuuguugaucagug

SEQ ID NO: 1302122 - RNA, 18 nt, Human
uuuaaacccuccaaaucc

SEQ ID NO: 1302123 - RNA, 20 nt, Human
aagauagccagugcugcucc

SEQ ID NO: 1302124 - RNA, 26 nt, Human
aagcgaccuugacguguauugaaggu

SEQ ID NO: 1302125 - RNA, 24 nt, Human
acacugcgcuucaggaaaucucaa

SEQ ID NO: 1302126 - RNA, 25 nt, Human
accuggcucgugagugcgucugggu

SEQ ID NO: 1302127 - RNA, 26 nt, Human
acugcgggagaggcggaacccacuug

SEQ ID NO: 1302128 - RNA, 18 nt, Human
agaacaucacagcugugg

SEQ ID NO: 1302129 - RNA, 22 nt, Human
agaacaucacagcugugguccc

SEQ ID NO: 1302130 - RNA, 19 nt, Human
agcgaagcuggcagggagc

SEQ ID NO: 1302131 - RNA, 18 nt, Human
aggugcuggccuugguug

SEQ ID NO: 1302132 - RNA, 24 nt, Human
augcaguuuugaaaaccuggaaac

SEQ ID NO: 1302133 - RNA, 18 nt, Human
augguuuggggaagggag

SEQ ID NO: 1302134 - RNA, 24 nt, Human
auuucuguuuucuaaaacuggaag

SEQ ID NO: 1302135 - RNA, 19 nt, Human
caaguccugggggaugugc

SEQ ID NO: 1302136 - RNA, 23 nt, Human
cacagcuguggucccagaugaga

SEQ ID NO: 1302137 - RNA, 23 nt, Human
cagaacaucacagcugugguccc

SEQ ID NO: 1302138 - RNA, 24 nt, Human
cagccgccaauauaaacgaauaaa

SEQ ID NO: 1302139 - RNA, 19 nt, Human
ccaagugauuuuaccuccc

SEQ ID NO: 1302140 - RNA, 21 nt, Human
ccacguucaagcuuguguguc

SEQ ID NO: 1302141 - RNA, 19 nt, Human
ccauauugcacagcagaac

SEQ ID NO: 1302142 - RNA, 22 nt, Human
cccccauacccccaggaccugg

SEQ ID NO: 1302143 - RNA, 22 nt, Human
ccccgggcugcgcaggcuccuc

SEQ ID NO: 1302144 - RNA, 25 nt, Human
ccucuaagaggccacguucaagcuu

SEQ ID NO: 1302145 - RNA, 20 nt, Human
ccuggcagcccccauacccc

SEQ ID NO: 1302146 - RNA, 22 nt, Human
ccugggccccgggcugcgcagg

SEQ ID NO: 1302147 - RNA, 19 nt, Human
cgccccuggcagcccccau

SEQ ID NO: 1302148 - RNA, 19 nt, Human
cgggagaggcggaacccac

SEQ ID NO: 1302149 - RNA, 23 nt, Human
cgggagaggcggaacccacuugc

SEQ ID NO: 1302150 - RNA, 23 nt, Human
cuacuucugaauuacuucucaac

SEQ ID NO: 1302151 - RNA, 18 nt, Human
cucgugagugcgucuggg

SEQ ID NO: 1302152 - RNA, 25 nt, Human
cugaauuacuucucaacuguauggu

SEQ ID NO: 1302153 - RNA, 22 nt, Human
cuggggccgagcugaggggcug

SEQ ID NO: 1302154 - RNA, 21 nt, Human
cuucaggaaaucucaaguucc

SEQ ID NO: 1302155 - RNA, 23 nt, Human
gaaaggugacccauauuguaaua

SEQ ID NO: 1302156 - RNA, 20 nt, Human
gaaggugugugugccaaaug

SEQ ID NO: 1302157 - RNA, 23 nt, Human
gagaaaagaaauacucucaacgu

SEQ ID NO: 1302158 - RNA, 19 nt, Human
gagcuccucuaagaggcca

SEQ ID NO: 1302159 - RNA, 20 nt, Human
gaggcgggaaauaggcuggg

SEQ ID NO: 1302160 - RNA, 21 nt, Human
gcaggccccccaggagagggc

SEQ ID NO: 1302161 - RNA, 27 nt, Human
gccgagcugaggggcugaacacagcag

SEQ ID NO: 1302162 - RNA, 20 nt, Human
gccucuccuccugggccccg

SEQ ID NO: 1302163 - RNA, 20 nt, Human
gcuggacacaggaaagccca

SEQ ID NO: 1302164 - RNA, 23 nt, Human
gcuggcagggagcagacuggcuu

SEQ ID NO: 1302165 - RNA, 18 nt, Human
ggacaggaguguuuguca

SEQ ID NO: 1302166 - RNA, 18 nt, Human
ggaugugcucugcccagc

SEQ ID NO: 1302167 - RNA, 23 nt, Human
ggcuggggccgagcugaggggcu

SEQ ID NO: 1302168 - RNA, 22 nt, Human
gguacuucugguaccguguuga

SEQ ID NO: 1302169 - RNA, 19 nt, Human
uaacguacccacauuuugc

SEQ ID NO: 1302170 - RNA, 23 nt, Human
uaccaguguuuacauaucugaca

SEQ ID NO: 1302171 - RNA, 23 nt, Human
uaccuccaccuuuacuaaagucu

SEQ ID NO: 1302172 - RNA, 20 nt, Human
uacuguuuucuuaauaagcg

SEQ ID NO: 1302173 - RNA, 21 nt, Human
uagccagugcugcucccaggu

SEQ ID NO: 1302174 - RNA, 25 nt, Human
uagccagugcugcucccagguggua

SEQ ID NO: 1302175 - RNA, 23 nt, Human
ucaaauggaggcgggaaauaggc

SEQ ID NO: 1302176 - RNA, 23 nt, Human
ucacucugggcgguguuuccugu

SEQ ID NO: 1302177 - RNA, 22 nt, Human
ucagcacucggccccccacugc

SEQ ID NO: 1302178 - RNA, 23 nt, Human
ucauuuuucauacuguuuucuua

SEQ ID NO: 1302179 - RNA, 27 nt, Human
uccugggccccgggcugcgcaggcucc

SEQ ID NO: 1302180 - RNA, 22 nt, Human
ucgccugcccagcaggcccccc

SEQ ID NO: 1302181 - RNA, 21 nt, Human
ucgcuggacacaggaaagccc

SEQ ID NO: 1302182 - RNA, 20 nt, Human
ucuaaaacuggaagcgaccu

SEQ ID NO: 1302183 - RNA, 19 nt, Human
ucuucuggccuacuucuga

SEQ ID NO: 1302184 - RNA, 21 nt, Human
ugacaucgagcuccucuaaga

SEQ ID NO: 1302185 - RNA, 21 nt, Human
ugacccauauugcacagcaga

SEQ ID NO: 1302186 - RNA, 19 nt, Human
ugagaugcagauuucuguu

SEQ ID NO: 1302187 - RNA, 20 nt, Human
ugagaugcagauuucuguuu

SEQ ID NO: 1302188 - RNA, 21 nt, Human
ugaggggcugaacacagcagu

SEQ ID NO: 1302189 - RNA, 19 nt, Human
uggcagcccccauaccccc

SEQ ID NO: 1302190 - RNA, 19 nt, Human
ugggccccgggcugcgcag

SEQ ID NO: 1302191 - RNA, 22 nt, Human
ugggggaugugcucugcccagc

SEQ ID NO: 1302192 - RNA, 22 nt, Human
ugucuggauuuucuuguaccag

SEQ ID NO: 1302193 - RNA, 23 nt, Human
uguggacaggaguguuugucauu

SEQ ID NO: 1302194 - RNA, 19 nt, Human
uugaaaaccuggaaacauc

SEQ ID NO: 1302195 - RNA, 24 nt, Human
uugguuucucucugccccgugugg

SEQ ID NO: 1302196 - RNA, 21 nt, Human
ugaauuaaaugucuuucuuga

SEQ ID NO: 1302197 - RNA, 24 nt, Human
acaccgcaauggccgaggaccagu

SEQ ID NO: 1302198 - RNA, 23 nt, Human
acugaaacacaccgcaauggccg

SEQ ID NO: 1302199 - RNA, 20 nt, Human
acuuagguucaaguucuuuc

SEQ ID NO: 1302200 - RNA, 21 nt, Human
caacuccuccacaagcgcgcu

SEQ ID NO: 1302201 - RNA, 20 nt, Human
caccgcaauggccgaggacc

SEQ ID NO: 1302202 - RNA, 26 nt, Human
cacuaucauuacuaaagagcugaaag

SEQ ID NO: 1302203 - RNA, 19 nt, Human
cauuacuaaagagcugaaa

SEQ ID NO: 1302204 - RNA, 21 nt, Human
ccuccacaacuccuccacaag

SEQ ID NO: 1302205 - RNA, 21 nt, Human
gacuuaacagaaagggagguu

SEQ ID NO: 1302206 - RNA, 21 nt, Human
ggucgucgacaggcguccucc

SEQ ID NO: 1302207 - RNA, 22 nt, Human
guccuccacaacuccuccacaa

SEQ ID NO: 1302208 - RNA, 26 nt, Human
guuacaauuaaacuauucuaaagacu

SEQ ID NO: 1302209 - RNA, 24 nt, Human
uccuccacaacuccuccacaagcg

SEQ ID NO: 1302210 - RNA, 21 nt, Human
uuaaacuauucuaaagacuua

SEQ ID NO: 1302211 - RNA, 22 nt, Human
uucaccugagguggccccuucu

SEQ ID NO: 1302212 - RNA, 20 nt, Human
uucuuuaggaauaguugcua

SEQ ID NO: 1302213 - RNA, 18 nt, Human
uugacaguguuagagaga

SEQ ID NO: 1302214 - RNA, 30 nt, Human
uuuagauuugacuuaacagaaagggagguu

SEQ ID NO: 1302215 - RNA, 23 nt, Human
uuugacuuaacagaaagggaggu

SEQ ID NO: 1302216 - RNA, 21 nt, Human
aagccuccuagggccacccag

SEQ ID NO: 1302217 - RNA, 19 nt, Human
aagggccagagcuaagagu

SEQ ID NO: 1302218 - RNA, 23 nt, Human
acacuggaugggguggggugggg

SEQ ID NO: 1302219 - RNA, 23 nt, Human
accaagaaaucccuuccccacuc

SEQ ID NO: 1302220 - RNA, 19 nt, Human
agaaaucccuuccccacuc

SEQ ID NO: 1302221 - RNA, 19 nt, Human
agcugagcccccuucuuuu

SEQ ID NO: 1302222 - RNA, 26 nt, Human
aggcacagcaagggggccacgauggc

SEQ ID NO: 1302223 - RNA, 21 nt, Human
agggggccacgauggcuucca

SEQ ID NO: 1302224 - RNA, 22 nt, Human
agguuuucagcacagagugcuc

SEQ ID NO: 1302225 - RNA, 18 nt, Human
aucccuuccccacucugg

SEQ ID NO: 1302226 - RNA, 18 nt, Human
caagcccagagggcagac

SEQ ID NO: 1302227 - RNA, 19 nt, Human
caaggccccuacccaagcc

SEQ ID NO: 1302228 - RNA, 22 nt, Human
cacagcccccauuccgggcagg

SEQ ID NO: 1302229 - RNA, 23 nt, Human
cacccagccaaaguccagagagc

SEQ ID NO: 1302230 - RNA, 21 nt, Human
cacuggauggggugggguggg

SEQ ID NO: 1302231 - RNA, 18 nt, Human
cagagagcugugaagagg

SEQ ID NO: 1302232 - RNA, 20 nt, Human
cagcugagcccccuucuuuu

SEQ ID NO: 1302233 - RNA, 21 nt, Human
caggcacagcaagggggccac

SEQ ID NO: 1302234 - RNA, 18 nt, Human
ccaagaaaucccuucccc

SEQ ID NO: 1302235 - RNA, 19 nt, Human
ccaggcaacguccgugagc

SEQ ID NO: 1302236 - RNA, 20 nt, Human
ccaggcacagcaagggggcc

SEQ ID NO: 1302237 - RNA, 18 nt, Human
ccaugggucuggcuucau

SEQ ID NO: 1302238 - RNA, 20 nt, Human
cccaagcccagagggcagac

SEQ ID NO: 1302239 - RNA, 24 nt, Human
cccaagcccagagggcagacagcu

SEQ ID NO: 1302240 - RNA, 22 nt, Human
cccccauuccgggcaggcuucu

SEQ ID NO: 1302241 - RNA, 18 nt, Human
ccuacccaagcccagagg

SEQ ID NO: 1302242 - RNA, 20 nt, Human
ccucucggccaugggucugg

SEQ ID NO: 1302243 - RNA, 24 nt, Human
ccugcgcccuggcccaccaucagc

SEQ ID NO: 1302244 - RNA, 23 nt, Human
cgcccuggcccaccaucagcaac

SEQ ID NO: 1302245 - RNA, 18 nt, Human
cugggaucuucaaagaga

SEQ ID NO: 1302246 - RNA, 19 nt, Human
gaagacuuccucugcuucc

SEQ ID NO: 1302247 - RNA, 21 nt, Human
gagcccccuucuuuuugaccc

SEQ ID NO: 1302248 - RNA, 21 nt, Human
gagcuaagaguggcagccacg

SEQ ID NO: 1302249 - RNA, 22 nt, Human
gagggccacccagcuguggucc

SEQ ID NO: 1302250 - RNA, 24 nt, Human
gcuggaguggaagggccagagcua

SEQ ID NO: 1302251 - RNA, 21 nt, Human
ggaagggccagagcuaagagu

SEQ ID NO: 1302252 - RNA, 19 nt, Human
ggacaccgugagguucaaa

SEQ ID NO: 1302253 - RNA, 22 nt, Human
ggaguggaagggccagagcuaa

SEQ ID NO: 1302254 - RNA, 25 nt, Human
gggaggaagacuuccucugcuuccu

SEQ ID NO: 1302255 - RNA, 19 nt, Human
gggcagacagcugagcccc

SEQ ID NO: 1302256 - RNA, 21 nt, Human
ggucagcagacacggugggcu

SEQ ID NO: 1302257 - RNA, 22 nt, Human
uaagaguggcagccacguggcg

SEQ ID NO: 1302258 - RNA, 22 nt, Human
uacccaagcccagagggcagac

SEQ ID NO: 1302259 - RNA, 21 nt, Human
uaguccaaggccccuacccaa

SEQ ID NO: 1302260 - RNA, 23 nt, Human
ucaaaaccaagaaaucccuuccc

SEQ ID NO: 1302261 - RNA, 19 nt, Human
uccaaggccccuacccaag

SEQ ID NO: 1302262 - RNA, 19 nt, Human
ugacaagaagggcaguugg

SEQ ID NO: 1302263 - RNA, 21 nt, Human
ugccccagagggcucaccauc

SEQ ID NO: 1302264 - RNA, 19 nt, Human
uggcccagugaccaggcaa

SEQ ID NO: 1302265 - RNA, 23 nt, Human
ugggagggagaccugcgcccugg

SEQ ID NO: 1302266 - RNA, 19 nt, Human
ugggaucuucaaagagagc

SEQ ID NO: 1302267 - RNA, 18 nt, Human
ugggccucaguuuccccc

SEQ ID NO: 1302268 - RNA, 20 nt, Human
aaaacacagguaaaggugcc

SEQ ID NO: 1302269 - RNA, 24 nt, Human
aaaacacagguaaaggugccacca

SEQ ID NO: 1302270 - RNA, 20 nt, Human
aaccuggccugguuugugca

SEQ ID NO: 1302271 - RNA, 20 nt, Human
aaggugccaccagccagagg

SEQ ID NO: 1302272 - RNA, 25 nt, Human
accuugcucaccuucuacuugucca

SEQ ID NO: 1302273 - RNA, 21 nt, Human
acguugggaugaccugccugc

SEQ ID NO: 1302274 - RNA, 22 nt, Human
agaagagagaaggagagaagag

SEQ ID NO: 1302275 - RNA, 18 nt, Human
agccaggaauggguggga

SEQ ID NO: 1302276 - RNA, 24 nt, Human
agccaggaaugggugggagaccug

SEQ ID NO: 1302277 - RNA, 26 nt, Human
aggcaagaagaagagaagagggaccc

SEQ ID NO: 1302278 - RNA, 20 nt, Human
aggcagaaaagugacaccuc

SEQ ID NO: 1302279 - RNA, 22 nt, Human
agugcugagguacaaggaagga

SEQ ID NO: 1302280 - RNA, 22 nt, Human
aguggggaggaguggcuggggc

SEQ ID NO: 1302281 - RNA, 21 nt, Human
caaaacacagguaaaggugcc

SEQ ID NO: 1302282 - RNA, 21 nt, Human
caaacccaggcaucucugcac

SEQ ID NO: 1302283 - RNA, 21 nt, Human
caagcacaggagggaggcuga

SEQ ID NO: 1302284 - RNA, 18 nt, Human
cacaggagggaggcugag

SEQ ID NO: 1302285 - RNA, 19 nt, Human
caccucggcccccuccaga

SEQ ID NO: 1302286 - RNA, 20 nt, Human
caccuugcucaccuucuacu

SEQ ID NO: 1302287 - RNA, 27 nt, Human
cagcaagccccccugccccgcaggcuc

SEQ ID NO: 1302288 - RNA, 18 nt, Human
cagccagagguuucaggc

SEQ ID NO: 1302289 - RNA, 24 nt, Human
cagccagagguuucaggcagaaaa

SEQ ID NO: 1302290 - RNA, 18 nt, Human
cagcccccugccaccucg

SEQ ID NO: 1302291 - RNA, 18 nt, Human
cagcccccugccaccucg

SEQ ID NO: 1302292 - RNA, 22 nt, Human
cagcccccugccaccucggccc

SEQ ID NO: 1302293 - RNA, 20 nt, Human
caggcaucucugcacucucu

SEQ ID NO: 1302294 - RNA, 21 nt, Human
caguggggaggaguggcuggg

SEQ ID NO: 1302295 - RNA, 19 nt, Human
caugccagcccccugccac

SEQ ID NO: 1302296 - RNA, 20 nt, Human
ccaaaccugggcacagucac

SEQ ID NO: 1302297 - RNA, 18 nt, Human
ccagagugcugagguaca

SEQ ID NO: 1302298 - RNA, 19 nt, Human
ccaggcaucucugcacucu

SEQ ID NO: 1302299 - RNA, 19 nt, Human
cccagcaagccccccugcc

SEQ ID NO: 1302300 - RNA, 20 nt, Human
cccaggcacagcugcagcca

SEQ ID NO: 1302301 - RNA, 20 nt, Human
cccccugccaccucggcccc

SEQ ID NO: 1302302 - RNA, 21 nt, Human
ccccugccaccucggcccccu

SEQ ID NO: 1302303 - RNA, 22 nt, Human
cccgcccucccaggcacagcug

SEQ ID NO: 1302304 - RNA, 22 nt, Human
ccgugcgucuccucucagcugc

SEQ ID NO: 1302305 - RNA, 22 nt, Human
ccucagagcuggugggagccag

SEQ ID NO: 1302306 - RNA, 23 nt, Human
ccucagagcuggugggagccagg

SEQ ID NO: 1302307 - RNA, 19 nt, Human
ccucaggauucuguaacac

SEQ ID NO: 1302308 - RNA, 22 nt, Human
ccugcagaaaggagcuacccac

SEQ ID NO: 1302309 - RNA, 24 nt, Human
ccugccaccucggcccccuccaga

SEQ ID NO: 1302310 - RNA, 23 nt, Human
ccuucuacuuguccacauaccuc

SEQ ID NO: 1302311 - RNA, 22 nt, Human
ccuuugaucucucggagcagcu

SEQ ID NO: 1302312 - RNA, 20 nt, Human
cgcaggcucaguuguaccug

SEQ ID NO: 1302313 - RNA, 18 nt, Human
cgccugggcacuaugggc

SEQ ID NO: 1302314 - RNA, 21 nt, Human
cguugggaugaccugccugca

SEQ ID NO: 1302315 - RNA, 20 nt, Human
cucaauuaagcuccuuuaaa

SEQ ID NO: 1302316 - RNA, 24 nt, Human
cucagaggcccagcaagccccccu

SEQ ID NO: 1302317 - RNA, 19 nt, Human
cucaggacaagaacucagg

SEQ ID NO: 1302318 - RNA, 22 nt, Human
cugaaaggacccauuugugaug

SEQ ID NO: 1302319 - RNA, 23 nt, Human
cugcaguggggaggaguggcugg

SEQ ID NO: 1302320 - RNA, 21 nt, Human
cugccaccucggcccccucca

SEQ ID NO: 1302321 - RNA, 19 nt, Human
cugguuugugcaagcucag

SEQ ID NO: 1302322 - RNA, 21 nt, Human
gaaccugaaaggacccauuug

SEQ ID NO: 1302323 - RNA, 18 nt, Human
gagcagcuggagaucaug

SEQ ID NO: 1302324 - RNA, 25 nt, Human
gagcccacuccaaauucagauccaa

SEQ ID NO: 1302325 - RNA, 24 nt, Human
gcaaaacacagguaaaggugccac

SEQ ID NO: 1302326 - RNA, 21 nt, Human
gcaaacccaggcaucucugca

SEQ ID NO: 1302327 - RNA, 23 nt, Human
gcaagccccccugccccgcaggc

SEQ ID NO: 1302328 - RNA, 18 nt, Human
gccccgcccucccaggca

SEQ ID NO: 1302329 - RNA, 23 nt, Human
gcucaauaaagcaccucuucacc

SEQ ID NO: 1302330 - RNA, 24 nt, Human
gcugagguacaaggaaggaaccug

SEQ ID NO: 1302331 - RNA, 20 nt, Human
ggacucaggacaagaacuca

SEQ ID NO: 1302332 - RNA, 24 nt, Human
ggcugcaguggggaggaguggcug

SEQ ID NO: 1302333 - RNA, 21 nt, Human
gggcacagcuacccaccgugc

SEQ ID NO: 1302334 - RNA, 23 nt, Human
gugauggcagcaguggcccacgu

SEQ ID NO: 1302335 - RNA, 18 nt, Human
guggagcaguugcuaugg

SEQ ID NO: 1302336 - RNA, 19 nt, Human
gugggagccaggaaugggg

SEQ ID NO: 1302337 - RNA, 18 nt, Human
uaacauaaacagggcuga

SEQ ID NO: 1302338 - RNA, 22 nt, Human
uaacccagugggcccgagcaag

SEQ ID NO: 1302339 - RNA, 24 nt, Human
uaucaggcaggagccccgcccucc

SEQ ID NO: 1302340 - RNA, 25 nt, Human
uccaaguugaggccaaaccgggguc

SEQ ID NO: 1302341 - RNA, 23 nt, Human
uccuggacucaggacaagaacuc

SEQ ID NO: 1302342 - RNA, 21 nt, Human
ucucagaggcccagcaagccc

SEQ ID NO: 1302343 - RNA, 23 nt, Human
ucucugcuuccagagcccacucc

SEQ ID NO: 1302344 - RNA, 18 nt, Human
ucugcugugauucugggg

SEQ ID NO: 1302345 - RNA, 25 nt, Human
ugagguacaaggaaggaaccugaaa

SEQ ID NO: 1302346 - RNA, 18 nt, Human
ugcacucucagaggccca

SEQ ID NO: 1302347 - RNA, 23 nt, Human
ugcaguggggaggaguggcuggg

SEQ ID NO: 1302348 - RNA, 24 nt, Human
ugccugauucgugaaucauucauu

SEQ ID NO: 1302349 - RNA, 25 nt, Human
ugcucaccuucuacuuguccacaua

SEQ ID NO: 1302350 - RNA, 20 nt, Human
uggacagaacuaacccagug

SEQ ID NO: 1302351 - RNA, 18 nt, Human
uggagacacuggcugcag

SEQ ID NO: 1302352 - RNA, 22 nt, Human
uggcaagcacaggagggaggcu

SEQ ID NO: 1302353 - RNA, 21 nt, Human
uggccggaaggcccuccucag

SEQ ID NO: 1302354 - RNA, 19 nt, Human
uggcugcaguggggaggag

SEQ ID NO: 1302355 - RNA, 25 nt, Human
uggcugcaguggggaggaguggcug

SEQ ID NO: 1302356 - RNA, 19 nt, Human
uggcuggggcugugcacuc

SEQ ID NO: 1302357 - RNA, 20 nt, Human
uggcuggggcugugcacucc

SEQ ID NO: 1302358 - RNA, 19 nt, Human
ugggaugaccugccugcag

SEQ ID NO: 1302359 - RNA, 21 nt, Human
ugggcacagucacaaccuggc

SEQ ID NO: 1302360 - RNA, 19 nt, Human
ugggcccgagcaaaacaca

SEQ ID NO: 1302361 - RNA, 18 nt, Human
ugugauggcagcaguggc

SEQ ID NO: 1302362 - RNA, 19 nt, Human
ugugauucugggggcugcc

SEQ ID NO: 1302363 - RNA, 19 nt, Human
uucaggcagaaaagugaca

SEQ ID NO: 1302364 - RNA, 19 nt, Human
uucuacuuguccacauacc

SEQ ID NO: 1302365 - RNA, 19 nt, Human
uucuugccaaauugcaggc

SEQ ID NO: 1302366 - RNA, 22 nt, Human
uugcuaagccuucuaaugaccc

SEQ ID NO: 1302367 - RNA, 21 nt, Human
acaacaaauggggagacugga

SEQ ID NO: 1302368 - RNA, 18 nt, Human
ucucugagcggucagcuc

SEQ ID NO: 1302369 - RNA, 24 nt, Human
uuacaacaaauggggagacuggac

SEQ ID NO: 1302370 - RNA, 21 nt, Human
cugugcagagcccugggggag

SEQ ID NO: 1302371 - RNA, 22 nt, Human
cugugcagagcccugggggagc

SEQ ID NO: 1302372 - RNA, 20 nt, Human
gacaaugaggcuguaagcac

SEQ ID NO: 1302373 - RNA, 20 nt, Human
gagacacggccagcuccagu

SEQ ID NO: 1302374 - RNA, 22 nt, Human
gcuguaagcaccuggaggugga

SEQ ID NO: 1302375 - RNA, 19 nt, Human
ggagcacucucacagacuc

SEQ ID NO: 1302376 - RNA, 22 nt, Human
ggccaugagccugugcagagcc

SEQ ID NO: 1302377 - RNA, 21 nt, Human
ucagacaaugaggcuguaagc

SEQ ID NO: 1302378 - RNA, 18 nt, Human
ucccagagacacggccag

SEQ ID NO: 1302379 - RNA, 20 nt, Human
ucccagagacacggccagcu

SEQ ID NO: 1302380 - RNA, 24 nt, Human
ucucacagacuccagguuucccag

SEQ ID NO: 1302381 - RNA, 21 nt, Human
ucuucagacaaugaggcugua

SEQ ID NO: 1302382 - RNA, 23 nt, Human
gaccacagcuaucauaauguucu

SEQ ID NO: 1302383 - RNA, 22 nt, Human
ucucaucuucuucaaacuuguu

SEQ ID NO: 1302384 - RNA, 23 nt, Human
uucaaacuuguuaaucauagacu

SEQ ID NO: 1302385 - RNA, 21 nt, Human
uucuugauuucgugucucauc

SEQ ID NO: 1302386 - RNA, 20 nt, Human
uuuggauuuuuuucugccuu

SEQ ID NO: 1302387 - RNA, 21 nt, Human
aaaaguuccuucuugucuuug

SEQ ID NO: 1302388 - RNA, 23 nt, Human
aaaguuccuucuugucuuugccu

SEQ ID NO: 1302389 - RNA, 20 nt, Human
agcuggaaaaugccaggacu

SEQ ID NO: 1302390 - RNA, 18 nt, Human
caccagcaugaggagccc

SEQ ID NO: 1302391 - RNA, 23 nt, Human
cuccuuccauguccacuggcggg

SEQ ID NO: 1302392 - RNA, 23 nt, Human
cugcugcuucugcauucagggcg

SEQ ID NO: 1302393 - RNA, 24 nt, Human
cuucuugucuuugccuaauuuaac

SEQ ID NO: 1302394 - RNA, 20 nt, Human
gagcaguggcagcgggguug

SEQ ID NO: 1302395 - RNA, 21 nt, Human
gcggcacuccuuccaugucca

SEQ ID NO: 1302396 - RNA, 22 nt, Human
ggcucaggagcaguggcagcgg

SEQ ID NO: 1302397 - RNA, 18 nt, Human
ucaggagcaguggcagcg

SEQ ID NO: 1302398 - RNA, 25 nt, Human
uccuggagauuaaaugagauuuucc

SEQ ID NO: 1302399 - RNA, 23 nt, Human
ucucacaaauaguaucuuagucu

SEQ ID NO: 1302400 - RNA, 23 nt, Human
ucugagcuggaaaaugccaggac

SEQ ID NO: 1302401 - RNA, 19 nt, Human
uggcagcgggguugcacca

SEQ ID NO: 1302402 - RNA, 25 nt, Human
aacaagaagugaaggaagagggacc

SEQ ID NO: 1302403 - RNA, 20 nt, Human
aaggaagaagacuggugaca

SEQ ID NO: 1302404 - RNA, 20 nt, Human
acaggcacaccucacuuccc

SEQ ID NO: 1302405 - RNA, 18 nt, Human
accucacuucccagacag

SEQ ID NO: 1302406 - RNA, 18 nt, Human
accucacuuccuagacag

SEQ ID NO: 1302407 - RNA, 21 nt, Human
agaaagaucacacacaaggcu

SEQ ID NO: 1302408 - RNA, 22 nt, Human
agaauccagugaaaauggcugc

SEQ ID NO: 1302409 - RNA, 23 nt, Human
agcuucaucauuucucccugaag

SEQ ID NO: 1302410 - RNA, 24 nt, Human
agguaaacaaaucuucuggucaag

SEQ ID NO: 1302411 - RNA, 22 nt, Human
auccgaauaugcuaccuuucug

SEQ ID NO: 1302412 - RNA, 23 nt, Human
caacaagaagugaaggaagaaga

SEQ ID NO: 1302413 - RNA, 21 nt, Human
cacacacaaggcugucacuuc

SEQ ID NO: 1302414 - RNA, 20 nt, Human
cacagcagccgggcagaggc

SEQ ID NO: 1302415 - RNA, 24 nt, Human
cagaaagaucacacacaaggcugg

SEQ ID NO: 1302416 - RNA, 21 nt, Human
cagaggcgcuccucacuuccc

SEQ ID NO: 1302417 - RNA, 24 nt, Human
cagcagagacgcaccucacuuccu

SEQ ID NO: 1302418 - RNA, 22 nt, Human
cggcagccaggcacaggcacac

SEQ ID NO: 1302419 - RNA, 21 nt, Human
cgggcagcagagacgcaccuc

SEQ ID NO: 1302420 - RNA, 21 nt, Human
cucugaaggaugcaguugagg

SEQ ID NO: 1302421 - RNA, 25 nt, Human
gaaaaaaaaaagaaauagcacucug

SEQ ID NO: 1302422 - RNA, 23 nt, Human
guaaacaaaucuucuggucaaga

SEQ ID NO: 1302423 - RNA, 24 nt, Human
guugauuuucuucugauagcuuca

SEQ ID NO: 1302424 - RNA, 23 nt, Human
uagguaaacaaaucuucugguca

SEQ ID NO: 1302425 - RNA, 21 nt, Human
ucaagagaaaaaaaaaagaaa

SEQ ID NO: 1302426 - RNA, 22 nt, Human
ugcggcagccaggcacaggcac

SEQ ID NO: 1302427 - RNA, 18 nt, Human
uggggagggcagaaagau

SEQ ID NO: 1302428 - RNA, 21 nt, Human
ugguagguaaacaaaucuucu

SEQ ID NO: 1302429 - RNA, 22 nt, Human
uggucaagagaaaaaaaaaaga

SEQ ID NO: 1302430 - RNA, 18 nt, Human
aacccugacagguaaaaa

SEQ ID NO: 1302431 - RNA, 19 nt, Human
acccugacagguaaaaaaa

SEQ ID NO: 1302432 - RNA, 18 nt, Human
cccgucagcaccugcuga

SEQ ID NO: 1302433 - RNA, 18 nt, Human
cccugacagguaaaaaaa

SEQ ID NO: 1302434 - RNA, 20 nt, Human
gccuuucugcuucuccagga

SEQ ID NO: 1302435 - RNA, 19 nt, Human
uuguacccgucagcaccug

SEQ ID NO: 1302436 - RNA, 18 nt, Human
gcaggcugggaggaggga

SEQ ID NO: 1302437 - RNA, 26 nt, Human
uauuaauucuguagcagguuaaggga

SEQ ID NO: 1302438 - RNA, 22 nt, Human
acgcagcucaggaacuggagga

SEQ ID NO: 1302439 - RNA, 20 nt, Human
cuuuguaccuguuguccuuc

SEQ ID NO: 1302440 - RNA, 19 nt, Human
guccgaacgcagcucagga

SEQ ID NO: 1302441 - RNA, 22 nt, Human
uacaauacgacagggguccgaa

SEQ ID NO: 1302442 - RNA, 18 nt, Human
uagguguccaaguagaaa

SEQ ID NO: 1302443 - RNA, 22 nt, Human
aaguccccuuuuggagaugccc

SEQ ID NO: 1302444 - RNA, 20 nt, Human
uggaaggaaauuccacccgc

SEQ ID NO: 1302445 - RNA, 19 nt, Human
aaauaaauuuaaacuauaa

SEQ ID NO: 1302446 - RNA, 19 nt, Human
aaauaaauuuaaacuauaa

SEQ ID NO: 1302447 - RNA, 19 nt, Human
aaauaaauuuaaacuauaa

SEQ ID NO: 1302448 - RNA, 19 nt, Human
aaauaaauuuaaacuauaa

SEQ ID NO: 1302449 - RNA, 18 nt, Human
aacagcuucuccaccucu

SEQ ID NO: 1302450 - RNA, 18 nt, Human
aacagcuucuccaccucu

SEQ ID NO: 1302451 - RNA, 18 nt, Human
aagaugccagagugaaca

SEQ ID NO: 1302452 - RNA, 23 nt, Human
agccucuccugcuccuccugccg

SEQ ID NO: 1302453 - RNA, 19 nt, Human
caccucuuccagcagccuc

SEQ ID NO: 1302454 - RNA, 19 nt, Human
caccucuuccagcagccuc

SEQ ID NO: 1302455 - RNA, 26 nt, Human
cagcagccucucccucuccagcagcc

SEQ ID NO: 1302456 - RNA, 23 nt, Human
ccagcagccucuccugcuccucc

SEQ ID NO: 1302457 - RNA, 21 nt, Human
cccgcagccucuccagcuccu

SEQ ID NO: 1302458 - RNA, 19 nt, Human
ccuccugccgccucuccug

SEQ ID NO: 1302459 - RNA, 21 nt, Human
ccucuccagcagccucuccug

SEQ ID NO: 1302460 - RNA, 23 nt, Human
ccucuccagcuccugcagagucu

SEQ ID NO: 1302461 - RNA, 23 nt, Human
cuaacagcuucuccaccucuucc

SEQ ID NO: 1302462 - RNA, 23 nt, Human
cuaacagcuucuccaccucuucc

SEQ ID NO: 1302463 - RNA, 19 nt, Human
cuccuccugccgccucucc

SEQ ID NO: 1302464 - RNA, 24 nt, Human
cugcuccuccugccgccucuccug

SEQ ID NO: 1302465 - RNA, 22 nt, Human
cuuaaauguuuuguuuuuuuuu

SEQ ID NO: 1302466 - RNA, 19 nt, Human
gccacagccucucauccug

SEQ ID NO: 1302467 - RNA, 20 nt, Human
ggauauuaaccccuuaaaug

SEQ ID NO: 1302468 - RNA, 22 nt, Human
uaaaagaugccagagugaacau

SEQ ID NO: 1302469 - RNA, 20 nt, Human
uaaauuagaaacacaaauaa

SEQ ID NO: 1302470 - RNA, 27 nt, Human
uaaauuagaaacacaaauaaauuuaaa

SEQ ID NO: 1302471 - RNA, 27 nt, Human
uaaauuagaaacacaaauaaauuuaaa

SEQ ID NO: 1302472 - RNA, 27 nt, Human
uaaauuagaaacacaaauaaauuuaaa

SEQ ID NO: 1302473 - RNA, 27 nt, Human
uaaauuagaaacacaaauaaauuuaaa

SEQ ID NO: 1302474 - RNA, 18 nt, Human
uagaaacacaaauaaaca

SEQ ID NO: 1302475 - RNA, 18 nt, Human
uccagcagccucucccuc

SEQ ID NO: 1302476 - RNA, 22 nt, Human
uccagcagccucucccucucca

SEQ ID NO: 1302477 - RNA, 19 nt, Human
ucccucuccagcagccucu

SEQ ID NO: 1302478 - RNA, 18 nt, Human
ucuaacagcuucuccacc

SEQ ID NO: 1302479 - RNA, 18 nt, Human
ucuaacagcuucuccacc

SEQ ID NO: 1302480 - RNA, 21 nt, Human
ucuaacagcuucuccaccucu

SEQ ID NO: 1302481 - RNA, 21 nt, Human
ucuaacagcuucuccaccucu

SEQ ID NO: 1302482 - RNA, 24 nt, Human
ucuccaccucuuccagcagccucu

SEQ ID NO: 1302483 - RNA, 24 nt, Human
ucuccaccucuuccagcagccucu

SEQ ID NO: 1302484 - RNA, 19 nt, Human
ucuccagcucccgcagccu

SEQ ID NO: 1302485 - RNA, 19 nt, Human
ucuccagcucccgcagccu

SEQ ID NO: 1302486 - RNA, 22 nt, Human
ucuccugcuccuccugccgccu

SEQ ID NO: 1302487 - RNA, 26 nt, Human
ucuccuguucuaacagcuucuccacc

SEQ ID NO: 1302488 - RNA, 26 nt, Human
ucuccuguucuaacagcuucuccacc

SEQ ID NO: 1302489 - RNA, 24 nt, Human
ucuuccagcagccucucccucucc

SEQ ID NO: 1302490 - RNA, 23 nt, Human
ucuuccagcagccucuccugccc

SEQ ID NO: 1302491 - RNA, 22 nt, Human
ugaacaugagagaaacacccac

SEQ ID NO: 1302492 - RNA, 19 nt, Human
ugagagaaacacccacucu

SEQ ID NO: 1302493 - RNA, 22 nt, Human
uuuaaacuauaaauuagaaaca

SEQ ID NO: 1302494 - RNA, 22 nt, Human
uuuaaacuauaaauuagaaaca

SEQ ID NO: 1302495 - RNA, 22 nt, Human
uuuaaacuauaaauuagaaaca

SEQ ID NO: 1302496 - RNA, 22 nt, Human
uuuaaacuauaaauuagaaaca

SEQ ID NO: 1302497 - RNA, 20 nt, Human
ccuccaaaccucugaagcgc

SEQ ID NO: 1302498 - RNA, 19 nt, Human
ccucugaagcgcuccgugc

SEQ ID NO: 1302499 - RNA, 20 nt, Human
gcggcgggguaagcuggagc

SEQ ID NO: 1302500 - RNA, 19 nt, Human
uccgugcacgcgacgcggc

SEQ ID NO: 1302501 - RNA, 18 nt, Human
ugagguuccggcccccuc

SEQ ID NO: 1302502 - RNA, 22 nt, Human
uggagcccucgccgcgagcccu

SEQ ID NO: 1302503 - RNA, 20 nt, Human
uuugagguuccggcccccuc

SEQ ID NO: 1302504 - RNA, 23 nt, Human
aaacaaaaugcaauuuuccccau

SEQ ID NO: 1302505 - RNA, 23 nt, Human
aaggcaaagacaguaggaggccu

SEQ ID NO: 1302506 - RNA, 18 nt, Human
accaccuccaccauaaca

SEQ ID NO: 1302507 - RNA, 22 nt, Human
accauaacaauuucuagaaaca

SEQ ID NO: 1302508 - RNA, 21 nt, Human
aggaggccuucuaagaaggga

SEQ ID NO: 1302509 - RNA, 25 nt, Human
auguaaacaaaaugcaauuuucccc

SEQ ID NO: 1302510 - RNA, 19 nt, Human
caccacauguaaacaaaau

SEQ ID NO: 1302511 - RNA, 21 nt, Human
cacccagaccaccuccaccau

SEQ ID NO: 1302512 - RNA, 20 nt, Human
ccgaggcucgcccggccggc

SEQ ID NO: 1302513 - RNA, 20 nt, Human
ccgccgcggccucgcggacc

SEQ ID NO: 1302514 - RNA, 21 nt, Human
ccgccgcggccucgcggaccu

SEQ ID NO: 1302515 - RNA, 19 nt, Human
ccgggucgcccgcgcuucg

SEQ ID NO: 1302516 - RNA, 20 nt, Human
ccgggucgcccgcgcuucgc

SEQ ID NO: 1302517 - RNA, 26 nt, Human
ccucgcggaccuggcccgcccgaccc

SEQ ID NO: 1302518 - RNA, 25 nt, Human
ccuucagacucacccagaccaccuc

SEQ ID NO: 1302519 - RNA, 19 nt, Human
cgcccggccggcugcuccc

SEQ ID NO: 1302520 - RNA, 19 nt, Human
cgugcaggugcgacggccg

SEQ ID NO: 1302521 - RNA, 19 nt, Human
gcaaagacaguaggaggcc

SEQ ID NO: 1302522 - RNA, 19 nt, Human
gcccggccggcugcucccc

SEQ ID NO: 1302523 - RNA, 23 nt, Human
ggaccuggcccgcccgacccccg

SEQ ID NO: 1302524 - RNA, 19 nt, Human
ugcacagcugccgccgcgg

SEQ ID NO: 1302525 - RNA, 23 nt, Human
uggcccgcccgacccccgggucg

SEQ ID NO: 1302526 - RNA, 23 nt, Human
uguucaccacauguaaacaaaau

SEQ ID NO: 1302527 - RNA, 18 nt, Human
uuuaaagggaguuaaaac

SEQ ID NO: 1302528 - RNA, 20 nt, Human
aaaaaaacaacaaccaaaca

SEQ ID NO: 1302529 - RNA, 22 nt, Human
aaaaacagcaggcggcucaggc

SEQ ID NO: 1302530 - RNA, 21 nt, Human
aaacaaaaaauuaaaaucaac

SEQ ID NO: 1302531 - RNA, 24 nt, Human
aaacaaaaaauuaaaaucaacuua

SEQ ID NO: 1302532 - RNA, 24 nt, Human
aaagugcugggauuacagguguga

SEQ ID NO: 1302533 - RNA, 23 nt, Human
aacaaaauucaaacaggagcaga

SEQ ID NO: 1302534 - RNA, 24 nt, Human
aacaaccaaacaacaauaacaaaa

SEQ ID NO: 1302535 - RNA, 26 nt, Human
aacaaccaaacaacaauaacaaaauu

SEQ ID NO: 1302536 - RNA, 18 nt, Human
aaccaaacaacaauaaca

SEQ ID NO: 1302537 - RNA, 25 nt, Human
aagcaauucuccugccucagccucc

SEQ ID NO: 1302538 - RNA, 24 nt, Human
aaguagcugggauuacaggcaugu

SEQ ID NO: 1302539 - RNA, 18 nt, Human
aagugcugggauuacagg

SEQ ID NO: 1302540 - RNA, 19 nt, Human
aagugcugggauuacaggu

SEQ ID NO: 1302541 - RNA, 26 nt, Human
aagugcugggauuacaggugugagcc

SEQ ID NO: 1302542 - RNA, 27 nt, Human
aaugacaggaacggaaaagggagggcc

SEQ ID NO: 1302543 - RNA, 24 nt, Human
aauuuuguauuuuuagcagagaug

SEQ ID NO: 1302544 - RNA, 19 nt, Human
acacagucuuccuccaucc

SEQ ID NO: 1302545 - RNA, 26 nt, Human
accacuuacccagccuuccgaagcac

SEQ ID NO: 1302546 - RNA, 19 nt, Human
acccaggcuggagugcagu

SEQ ID NO: 1302547 - RNA, 25 nt, Human
acccgccuuggccucccaaagugcu

SEQ ID NO: 1302548 - RNA, 18 nt, Human
acccucauuuccaagacc

SEQ ID NO: 1302549 - RNA, 21 nt, Human
acuuaaaaaaacaacaaccaa

SEQ ID NO: 1302550 - RNA, 21 nt, Human
agagauggggcugaggcauag

SEQ ID NO: 1302551 - RNA, 22 nt, Human
agaggcucgcuggccacgaacg

SEQ ID NO: 1302552 - RNA, 22 nt, Human
agauggggcugaggcauagggg

SEQ ID NO: 1302553 - RNA, 24 nt, Human
agcagaacaauggggucaaagaaa

SEQ ID NO: 1302554 - RNA, 23 nt, Human
agcagagauggggcugaggcaua

SEQ ID NO: 1302555 - RNA, 22 nt, Human
agcagagaugggguuuugccau

SEQ ID NO: 1302556 - RNA, 25 nt, Human
agcguccacauagccagcggacagc

SEQ ID NO: 1302557 - RNA, 21 nt, Human
agcuggugguguccagacugu

SEQ ID NO: 1302558 - RNA, 21 nt, Human
agcuggugguguccagacugu

SEQ ID NO: 1302559 - RNA, 19 nt, Human
aggagaaagaggacgauaa

SEQ ID NO: 1302560 - RNA, 20 nt, Human
aggagaaagaggacgauaaa

SEQ ID NO: 1302561 - RNA, 19 nt, Human
aggcuggagugcaguggca

SEQ ID NO: 1302562 - RNA, 21 nt, Human
aggggcuugaaggcgagaggc

SEQ ID NO: 1302563 - RNA, 24 nt, Human
aggugauccacccgccuuggccuc

SEQ ID NO: 1302564 - RNA, 23 nt, Human
aggugugagccaccgugcccggc

SEQ ID NO: 1302565 - RNA, 23 nt, Human
aguagcugggauuacaggcaugu

SEQ ID NO: 1302566 - RNA, 18 nt, Human
agucuuccuccauccugu

SEQ ID NO: 1302567 - RNA, 20 nt, Human
agugcaguggcacgaccuug

SEQ ID NO: 1302568 - RNA, 23 nt, Human
agugcaguggcacgaccuuggcu

SEQ ID NO: 1302569 - RNA, 24 nt, Human
agugcaguggcacgaccuuggcuc

SEQ ID NO: 1302570 - RNA, 23 nt, Human
augggguuuugccauguugguca

SEQ ID NO: 1302571 - RNA, 24 nt, Human
augggguuuugccauguuggucag

SEQ ID NO: 1302572 - RNA, 21 nt, Human
auucuccugccucagccuccc

SEQ ID NO: 1302573 - RNA, 19 nt, Human
caaaauucaaacaggagca

SEQ ID NO: 1302574 - RNA, 24 nt, Human
caaacaacaauaacaaaauucaaa

SEQ ID NO: 1302575 - RNA, 24 nt, Human
caaagugcugggauuacaggugug

SEQ ID NO: 1302576 - RNA, 21 nt, Human
caacaaccaaacaacaauaac

SEQ ID NO: 1302577 - RNA, 20 nt, Human
caaccuccaccucccagguu

SEQ ID NO: 1302578 - RNA, 23 nt, Human
caaccuccaccucccagguucaa

SEQ ID NO: 1302579 - RNA, 23 nt, Human
caacuuaaaaaaacaacaaccaa

SEQ ID NO: 1302580 - RNA, 24 nt, Human
caacuuaaaaaaacaacaaccaaa

SEQ ID NO: 1302581 - RNA, 22 nt, Human
caagcaauucuccugccucagc

SEQ ID NO: 1302582 - RNA, 18 nt, Human
caaugcugcagggcugag

SEQ ID NO: 1302583 - RNA, 20 nt, Human
cacauagccagcggacagcu

SEQ ID NO: 1302584 - RNA, 23 nt, Human
cacccgccuuggccucccaaagu

SEQ ID NO: 1302585 - RNA, 24 nt, Human
cacccgccuuggccucccaaagug

SEQ ID NO: 1302586 - RNA, 25 nt, Human
caccugcauuauuacauauccuucc

SEQ ID NO: 1302587 - RNA, 21 nt, Human
cacugcaaccuccaccuccca

SEQ ID NO: 1302588 - RNA, 22 nt, Human
cagagaugggguuuugccaugu

SEQ ID NO: 1302589 - RNA, 18 nt, Human
cagcaacaaggacagggg

SEQ ID NO: 1302590 - RNA, 19 nt, Human
cagcaacaaggacaggggc

SEQ ID NO: 1302591 - RNA, 23 nt, Human
cagcaaugcccccaggaggcaga

SEQ ID NO: 1302592 - RNA, 24 nt, Human
cagccuuccgaagcacuuuuccca

SEQ ID NO: 1302593 - RNA, 26 nt, Human
cagcucgggacacaacuuugggcagg

SEQ ID NO: 1302594 - RNA, 26 nt, Human
caggaaaaacagcaggcggcucaggc

SEQ ID NO: 1302595 - RNA, 19 nt, Human
caggaacggaaagguucuc

SEQ ID NO: 1302596 - RNA, 19 nt, Human
cagggcagcagaacaaugg

SEQ ID NO: 1302597 - RNA, 25 nt, Human
cagggcugagaggcugugagccaga

SEQ ID NO: 1302598 - RNA, 19 nt, Human
cagguaagcucccuacaaa

SEQ ID NO: 1302599 - RNA, 20 nt, Human
caguucccagagcugugguu

SEQ ID NO: 1302600 - RNA, 24 nt, Human
cauguuggucaggcuggucuugaa

SEQ ID NO: 1302601 - RNA, 22 nt, Human
cauuguuggcauagaggguggg

SEQ ID NO: 1302602 - RNA, 21 nt, Human
ccaaagugcugggauuacagg

SEQ ID NO: 1302603 - RNA, 21 nt, Human
ccaaagugcugggauuacagg

SEQ ID NO: 1302604 - RNA, 24 nt, Human
ccaaagugcugggauuacaggugu

SEQ ID NO: 1302605 - RNA, 23 nt, Human
ccaaguagcugggauuacaggca

SEQ ID NO: 1302606 - RNA, 24 nt, Human
ccaaguagcugggauuacaggcau

SEQ ID NO: 1302607 - RNA, 20 nt, Human
ccaccaaacccggcaaauuu

SEQ ID NO: 1302608 - RNA, 27 nt, Human
ccaccucccagguucaagcaauucuuu

SEQ ID NO: 1302609 - RNA, 19 nt, Human
ccauguuggucaggcuggu

SEQ ID NO: 1302610 - RNA, 21 nt, Human
ccauguuggucaggcuggucu

SEQ ID NO: 1302611 - RNA, 23 nt, Human
cccaaguagcugggauuacaggc

SEQ ID NO: 1302612 - RNA, 24 nt, Human
cccaaguagcugggauuacaggca

SEQ ID NO: 1302613 - RNA, 23 nt, Human
cccagguucaagcaauucuccug

SEQ ID NO: 1302614 - RNA, 21 nt, Human
ccccugcgaugaaggcuccug

SEQ ID NO: 1302615 - RNA, 20 nt, Human
cccuucuuacuuuuuucacc

SEQ ID NO: 1302616 - RNA, 19 nt, Human
ccuccaugcccagcuggug

SEQ ID NO: 1302617 - RNA, 24 nt, Human
ccucccagguucaagcaauucucc

SEQ ID NO: 1302618 - RNA, 21 nt, Human
ccuccuccaccacucugcguc

SEQ ID NO: 1302619 - RNA, 22 nt, Human
ccugaccucaggugauccaccc

SEQ ID NO: 1302620 - RNA, 23 nt, Human
ccugaccucaggugauccacccg

SEQ ID NO: 1302621 - RNA, 23 nt, Human
ccugccucagccucccaaguagc

SEQ ID NO: 1302622 - RNA, 24 nt, Human
ccugccucagccucccaaguagcu

SEQ ID NO: 1302623 - RNA, 19 nt, Human
ccugcgaugaaggcuccug

SEQ ID NO: 1302624 - RNA, 21 nt, Human
ccuguaauuggcuccugaagc

SEQ ID NO: 1302625 - RNA, 19 nt, Human
ccuucggaccuccuccacc

SEQ ID NO: 1302626 - RNA, 19 nt, Human
cggccacuugaagccaggc

SEQ ID NO: 1302627 - RNA, 24 nt, Human
cucacugcaaccuccaccucccag

SEQ ID NO: 1302628 - RNA, 23 nt, Human
cucagccucccaaguagcuggga

SEQ ID NO: 1302629 - RNA, 24 nt, Human
cucaggugauccacccgccuuggc

SEQ ID NO: 1302630 - RNA, 25 nt, Human
cuccaaugacaggaacgggguaccc

SEQ ID NO: 1302631 - RNA, 20 nt, Human
cuccaggaccccuccaugcc

SEQ ID NO: 1302632 - RNA, 18 nt, Human
cuccaugcccagcuggug

SEQ ID NO: 1302633 - RNA, 24 nt, Human
cugcaaccuccaccucccagguuc

SEQ ID NO: 1302634 - RNA, 24 nt, Human
cugcacaggcaccccugcgaugaa

SEQ ID NO: 1302635 - RNA, 18 nt, Human
cugcccugaggaggaggg

SEQ ID NO: 1302636 - RNA, 22 nt, Human
cugcgaugaaggcuccugguuu

SEQ ID NO: 1302637 - RNA, 25 nt, Human
cuggcucugccccagcguccacauu

SEQ ID NO: 1302638 - RNA, 18 nt, Human
cugucacccaggcuggag

SEQ ID NO: 1302639 - RNA, 22 nt, Human
gacaggcugcacaggccggacc

SEQ ID NO: 1302640 - RNA, 23 nt, Human
gaccucaggugauccacccgccu

SEQ ID NO: 1302641 - RNA, 19 nt, Human
gaccuuggcucacugcaac

SEQ ID NO: 1302642 - RNA, 24 nt, Human
gagaugggguuuugccauguuggu

SEQ ID NO: 1302643 - RNA, 24 nt, Human
gaggacgauaaaggccagaagcac

SEQ ID NO: 1302644 - RNA, 21 nt, Human
gagggggugagaggcugaggc

SEQ ID NO: 1302645 - RNA, 18 nt, Human
gauuacaggcaugugcca

SEQ ID NO: 1302646 - RNA, 18 nt, Human
gauuacaggugugagcca

SEQ ID NO: 1302647 - RNA, 20 nt, Human
gauuacaggugugagccacc

SEQ ID NO: 1302648 - RNA, 21 nt, Human
gauuacaggugugagccaccg

SEQ ID NO: 1302649 - RNA, 22 nt, Human
gcaaccuccaccucccagguuc

SEQ ID NO: 1302650 - RNA, 23 nt, Human
gcagagaugggguuuugccaugu

SEQ ID NO: 1302651 - RNA, 19 nt, Human
gcaguggcacgaccuuggc

SEQ ID NO: 1302652 - RNA, 20 nt, Human
gccauguuggucaggcuggu

SEQ ID NO: 1302653 - RNA, 24 nt, Human
gccauguuggucaggcuggucuug

SEQ ID NO: 1302654 - RNA, 22 nt, Human
gcccugaggaggagggggugag

SEQ ID NO: 1302655 - RNA, 22 nt, Human
gccggcccaccacaaucacagg

SEQ ID NO: 1302656 - RNA, 22 nt, Human
gccuuggccucccaaagugcug

SEQ ID NO: 1302657 - RNA, 25 nt, Human
gcucugucacccaggcuggagugca

SEQ ID NO: 1302658 - RNA, 19 nt, Human
gcuggagugcaguggcacg

SEQ ID NO: 1302659 - RNA, 23 nt, Human
gcuggucuugaacuccugaccuc

SEQ ID NO: 1302660 - RNA, 23 nt, Human
ggaaaaacagcaggcggcucagg

SEQ ID NO: 1302661 - RNA, 23 nt, Human
ggacaggcugcacaggcaccccu

SEQ ID NO: 1302662 - RNA, 24 nt, Human
ggacaggcugcacaggccggaccc

SEQ ID NO: 1302663 - RNA, 18 nt, Human
ggaccccuccaugcccag

SEQ ID NO: 1302664 - RNA, 20 nt, Human
ggaccccuccaugcccagcu

SEQ ID NO: 1302665 - RNA, 18 nt, Human
ggaccuccuccaccacuc

SEQ ID NO: 1302666 - RNA, 21 nt, Human
ggaggaagcccagcaggaaaa

SEQ ID NO: 1302667 - RNA, 20 nt, Human
ggaggagggggugagaggcu

SEQ ID NO: 1302668 - RNA, 19 nt, Human
ggauuacaggcaugugcca

SEQ ID NO: 1302669 - RNA, 21 nt, Human
ggcaaagggccagaggagaaa

SEQ ID NO: 1302670 - RNA, 21 nt, Human
ggccacuugaagccaggcaaa

SEQ ID NO: 1302671 - RNA, 24 nt, Human
ggcuggucuugaacuccugaccuc

SEQ ID NO: 1302672 - RNA, 22 nt, Human
gggguuuugccauguuggucag

SEQ ID NO: 1302673 - RNA, 23 nt, Human
gggguuuugccauguuggucagg

SEQ ID NO: 1302674 - RNA, 22 nt, Human
ggguuuugccauguuggucagg

SEQ ID NO: 1302675 - RNA, 19 nt, Human
ggucuugaacuccugaccu

SEQ ID NO: 1302676 - RNA, 18 nt, Human
guagcugggauuacaggc

SEQ ID NO: 1302677 - RNA, 24 nt, Human
gugauccacccgccuuggccuccc

SEQ ID NO: 1302678 - RNA, 21 nt, Human
uaagcucccuacaaacucaca

SEQ ID NO: 1302679 - RNA, 23 nt, Human
uacaggugugagccaccgugccc

SEQ ID NO: 1302680 - RNA, 24 nt, Human
uagcagagaugggguuuugccaug

SEQ ID NO: 1302681 - RNA, 22 nt, Human
uauucuauuaucuuucuuccca

SEQ ID NO: 1302682 - RNA, 24 nt, Human
ucacccaggcuggagugcaguggc

SEQ ID NO: 1302683 - RNA, 24 nt, Human
ucacugcaaccuccaccucccagg

SEQ ID NO: 1302684 - RNA, 25 nt, Human
ucacugcaaccuccaccucccaggu

SEQ ID NO: 1302685 - RNA, 26 nt, Human
ucacugcaaccuccaccucccagguu

SEQ ID NO: 1302686 - RNA, 18 nt, Human
ucagccucccaaguagcu

SEQ ID NO: 1302687 - RNA, 20 nt, Human
ucagccucccaaguagcugg

SEQ ID NO: 1302688 - RNA, 18 nt, Human
uccaacgccaccuucagc

SEQ ID NO: 1302689 - RNA, 23 nt, Human
uccacauccacaaugcugcaggg

SEQ ID NO: 1302690 - RNA, 22 nt, Human
uccaggaccccuccaugcccag

SEQ ID NO: 1302691 - RNA, 19 nt, Human
uccauuuauuccccacuuc

SEQ ID NO: 1302692 - RNA, 23 nt, Human
ucccaaagugcugggauuacagg

SEQ ID NO: 1302693 - RNA, 24 nt, Human
ucccaaguagcugggauuacaggc

SEQ ID NO: 1302694 - RNA, 21 nt, Human
ucccagguucaagcaauucuc

SEQ ID NO: 1302695 - RNA, 24 nt, Human
ucccagguucaagcaauucuccug

SEQ ID NO: 1302696 - RNA, 23 nt, Human
uccugagguggcccgccuucgga

SEQ ID NO: 1302697 - RNA, 23 nt, Human
ucgguggcuggaaugcccagagc

SEQ ID NO: 1302698 - RNA, 26 nt, Human
ucuccugccucagccucccaaguagc

SEQ ID NO: 1302699 - RNA, 23 nt, Human
ucucugugacacugcucauaccc

SEQ ID NO: 1302700 - RNA, 23 nt, Human
ucugaacauuguuggcauagagg

SEQ ID NO: 1302701 - RNA, 24 nt, Human
ucugucacccaggcuggagugcag

SEQ ID NO: 1302702 - RNA, 23 nt, Human
ucuugaacuccugaccucaggug

SEQ ID NO: 1302703 - RNA, 22 nt, Human
ucuugcucugucacccaggcug

SEQ ID NO: 1302704 - RNA, 23 nt, Human
ucuugcucugucacccaggcugg

SEQ ID NO: 1302705 - RNA, 24 nt, Human
ucuugcucugucacccaggcugga

SEQ ID NO: 1302706 - RNA, 21 nt, Human
ugaagccaggcaaagggccag

SEQ ID NO: 1302707 - RNA, 21 nt, Human
ugaccucaggugauccacccg

SEQ ID NO: 1302708 - RNA, 24 nt, Human
ugaccucaggugauccacccgccu

SEQ ID NO: 1302709 - RNA, 19 nt, Human
ugaggaggagggggugaga

SEQ ID NO: 1302710 - RNA, 22 nt, Human
ugcccagagccugugccaugac

SEQ ID NO: 1302711 - RNA, 20 nt, Human
ugccccagcguccacauagc

SEQ ID NO: 1302712 - RNA, 23 nt, Human
ugccccagcguccacauagccag

SEQ ID NO: 1302713 - RNA, 22 nt, Human
ugcccugaggaggaggggguga

SEQ ID NO: 1302714 - RNA, 24 nt, Human
ugccucagccucccaaguagcugg

SEQ ID NO: 1302715 - RNA, 24 nt, Human
ugcucugucacccaggcuggagug

SEQ ID NO: 1302716 - RNA, 24 nt, Human
ugcugggauuacaggugugagcca

SEQ ID NO: 1302717 - RNA, 22 nt, Human
uggaaugcccagagccugugcc

SEQ ID NO: 1302718 - RNA, 23 nt, Human
uggagugcaguggcacgaccuug

SEQ ID NO: 1302719 - RNA, 24 nt, Human
uggagugcaguggcacgaccuugg

SEQ ID NO: 1302720 - RNA, 20 nt, Human
uggcuccugaagcugcuccu

SEQ ID NO: 1302721 - RNA, 18 nt, Human
ugggauuacaggcaugug

SEQ ID NO: 1302722 - RNA, 21 nt, Human
ugggauuacaggcaugugcca

SEQ ID NO: 1302723 - RNA, 22 nt, Human
ugggauuacaggcaugugccac

SEQ ID NO: 1302724 - RNA, 24 nt, Human
ugggauuacaggcaugugccacca

SEQ ID NO: 1302725 - RNA, 18 nt, Human
ugggauuacaggugugag

SEQ ID NO: 1302726 - RNA, 21 nt, Human
ugggauuacaggugugagcca

SEQ ID NO: 1302727 - RNA, 22 nt, Human
ugggauuacaggugugagccac

SEQ ID NO: 1302728 - RNA, 23 nt, Human
ugggauuacaggugugagccacc

SEQ ID NO: 1302729 - RNA, 23 nt, Human
ugggauuacaggugugagccacc

SEQ ID NO: 1302730 - RNA, 24 nt, Human
ugggauuacaggugugagccaccg

SEQ ID NO: 1302731 - RNA, 20 nt, Human
ugggcaggucacagggcagc

SEQ ID NO: 1302732 - RNA, 20 nt, Human
uggggcagcaacaaggacag

SEQ ID NO: 1302733 - RNA, 24 nt, Human
uggggcagcaacaaggacaggggc

SEQ ID NO: 1302734 - RNA, 24 nt, Human
ugggguuuugccauguuggucagg

SEQ ID NO: 1302735 - RNA, 24 nt, Human
uggucaggcuggucuugaacuccu

SEQ ID NO: 1302736 - RNA, 24 nt, Human
uuaaaaucaacuuaaaaaaacaac

SEQ ID NO: 1302737 - RNA, 22 nt, Human
uuaagauuuuccuucuuccuuc

SEQ ID NO: 1302738 - RNA, 26 nt, Human
uuacuuuuuucaccugcauuauuaca

SEQ ID NO: 1302739 - RNA, 18 nt, Human
uuagcagagaugggguuu

SEQ ID NO: 1302740 - RNA, 22 nt, Human
uuagcagagaugggguuuugcc

SEQ ID NO: 1302741 - RNA, 24 nt, Human
uuagcagagaugggguuuugccau

SEQ ID NO: 1302742 - RNA, 21 nt, Human
uucaagcaauucuccugccuc

SEQ ID NO: 1302743 - RNA, 24 nt, Human
uucaagcaauucuccugccucagc

SEQ ID NO: 1302744 - RNA, 20 nt, Human
uuccaagaccacuuacccag

SEQ ID NO: 1302745 - RNA, 22 nt, Human
uucccagagcugugguuccaac

SEQ ID NO: 1302746 - RNA, 22 nt, Human
uucgguggcuggaaugcccaga

SEQ ID NO: 1302747 - RNA, 24 nt, Human
uugccauguuggucaggcuggucu

SEQ ID NO: 1302748 - RNA, 24 nt, Human
uugcucugucacccaggcuggagu

SEQ ID NO: 1302749 - RNA, 18 nt, Human
uuggccucccaaagugcu

SEQ ID NO: 1302750 - RNA, 23 nt, Human
uuguauuuuuagcagagaugggg

SEQ ID NO: 1302751 - RNA, 21 nt, Human
uuuaagauuuuccuucuuccu

SEQ ID NO: 1302752 - RNA, 23 nt, Human
uuuccuucuuccuucucauuucu

SEQ ID NO: 1302753 - RNA, 23 nt, Human
uuuugccauguuggucaggcugg

SEQ ID NO: 1302754 - RNA, 21 nt, Human
uuuuuagcagagaugggguuu

SEQ ID NO: 1302755 - RNA, 21 nt, Human
uuuuuagcagagaugggguuu

SEQ ID NO: 1302756 - RNA, 18 nt, Human
aaaauuagcugggcaugg

SEQ ID NO: 1302757 - RNA, 21 nt, Human
aaacagcgucagugaagaaaa

SEQ ID NO: 1302758 - RNA, 21 nt, Human
aaacugaaaaggagaagcugg

SEQ ID NO: 1302759 - RNA, 27 nt, Human
aaccugcccuuccuuaccgccccucug

SEQ ID NO: 1302760 - RNA, 20 nt, Human
aagaaaaaacggguccagca

SEQ ID NO: 1302761 - RNA, 22 nt, Human
aagaaaaaacggguccagcaga

SEQ ID NO: 1302762 - RNA, 19 nt, Human
aagaagcgcaggccaggcg

SEQ ID NO: 1302763 - RNA, 22 nt, Human
aagcagaagaaggggccacggg

SEQ ID NO: 1302764 - RNA, 18 nt, Human
aagcaggaaggagaagga

SEQ ID NO: 1302765 - RNA, 28 nt, Human
aagcaggaaggagaaggagaagggaccc

SEQ ID NO: 1302766 - RNA, 21 nt, Human
aagggaaggggaggggaggac

SEQ ID NO: 1302767 - RNA, 22 nt, Human
aaggugagcggcgcuggcgccc

SEQ ID NO: 1302768 - RNA, 19 nt, Human
aaucaaggcagcugaccug

SEQ ID NO: 1302769 - RNA, 21 nt, Human
aauguuaaaacacagaaaaga

SEQ ID NO: 1302770 - RNA, 22 nt, Human
acaaugacccacucgauagacc

SEQ ID NO: 1302771 - RNA, 23 nt, Human
acccagagcgcccccacccacac

SEQ ID NO: 1302772 - RNA, 24 nt, Human
acccugucucuacaaaaaauacaa

SEQ ID NO: 1302773 - RNA, 19 nt, Human
accugcccuuccuuaccgc

SEQ ID NO: 1302774 - RNA, 24 nt, Human
acucuccaauagccaaaugcaauc

SEQ ID NO: 1302775 - RNA, 24 nt, Human
acuugaggucaggaguuugagacc

SEQ ID NO: 1302776 - RNA, 22 nt, Human
agaaaagaucuggcauuacaaa

SEQ ID NO: 1302777 - RNA, 29 nt, Human
agaaaagaucuggcauuacaaagucccag

SEQ ID NO: 1302778 - RNA, 20 nt, Human
agagaaauagaugaaaggua

SEQ ID NO: 1302779 - RNA, 24 nt, Human
agagagcaggaccaugugcugguc

SEQ ID NO: 1302780 - RNA, 20 nt, Human
agagagccagccuugccagg

SEQ ID NO: 1302781 - RNA, 20 nt, Human
agagcaggaacugucacgca

SEQ ID NO: 1302782 - RNA, 18 nt, Human
agagcgcccccacccaca

SEQ ID NO: 1302783 - RNA, 21 nt, Human
agagcgcccccacccacacug

SEQ ID NO: 1302784 - RNA, 27 nt, Human
agcacagggcagcccugguaggggggg

SEQ ID NO: 1302785 - RNA, 24 nt, Human
agcaguuugggaggccaagguggg

SEQ ID NO: 1302786 - RNA, 19 nt, Human
agcugugugaccccagcca

SEQ ID NO: 1302787 - RNA, 22 nt, Human
aggaaggaacauaccaguguuu

SEQ ID NO: 1302788 - RNA, 21 nt, Human
aggaauguuaaaacacagaaa

SEQ ID NO: 1302789 - RNA, 20 nt, Human
aggagaagcugggcccccaa

SEQ ID NO: 1302790 - RNA, 20 nt, Human
aggaguuugagaccaacuug

SEQ ID NO: 1302791 - RNA, 21 nt, Human
aggccaagguggguggaucac

SEQ ID NO: 1302792 - RNA, 23 nt, Human
aggccaggccuugggcagcccug

SEQ ID NO: 1302793 - RNA, 22 nt, Human
aggccucugugacuuggaaaca

SEQ ID NO: 1302794 - RNA, 20 nt, Human
aggcgcggaccccagcaacc

SEQ ID NO: 1302795 - RNA, 24 nt, Human
aggcgcuagcacagggcagcccug

SEQ ID NO: 1302796 - RNA, 24 nt, Human
aggcggcagccaccacaaugaccc

SEQ ID NO: 1302797 - RNA, 21 nt, Human
agggaggggaggcuaaggggc

SEQ ID NO: 1302798 - RNA, 22 nt, Human
agggaggggaggcuaaggggcc

SEQ ID NO: 1302799 - RNA, 23 nt, Human
aggggcgggguggggcaagcugg

SEQ ID NO: 1302800 - RNA, 20 nt, Human
agggggggagugaggggccg

SEQ ID NO: 1302801 - RNA, 23 nt, Human
agguggguggaucacuugagguc

SEQ ID NO: 1302802 - RNA, 20 nt, Human
agugaagaaaauaugcacag

SEQ ID NO: 1302803 - RNA, 23 nt, Human
aguggaugggaggaaggaaggga

SEQ ID NO: 1302804 - RNA, 24 nt, Human
aguggcucacgccuguaaucccag

SEQ ID NO: 1302805 - RNA, 24 nt, Human
aguuugggaggccaaggugggugg

SEQ ID NO: 1302806 - RNA, 20 nt, Human
aucacuugaggucaggaguu

SEQ ID NO: 1302807 - RNA, 22 nt, Human
augcuccucccaccccaccccu

SEQ ID NO: 1302808 - RNA, 18 nt, Human
auguuaaaacacagaaaa

SEQ ID NO: 1302809 - RNA, 23 nt, Human
auuacaaagucccaaccacaugg

SEQ ID NO: 1302810 - RNA, 22 nt, Human
auuccuucacuucccugcagcu

SEQ ID NO: 1302811 - RNA, 22 nt, Human
caaacugaaaaggagaagcugg

SEQ ID NO: 1302812 - RNA, 22 nt, Human
caacauggagaaacccugucuc

SEQ ID NO: 1302813 - RNA, 24 nt, Human
caacauggagaaacccugucucua

SEQ ID NO: 1302814 - RNA, 18 nt, Human
caacccucuccaccagcc

SEQ ID NO: 1302815 - RNA, 23 nt, Human
caaccggcaggcaggccaggccu

SEQ ID NO: 1302816 - RNA, 19 nt, Human
caacuugggcaacauggag

SEQ ID NO: 1302817 - RNA, 19 nt, Human
caagcuggccccgucccuc

SEQ ID NO: 1302818 - RNA, 19 nt, Human
caagggaaggggaggggag

SEQ ID NO: 1302819 - RNA, 23 nt, Human
caaggugagcggcgcuggcgccc

SEQ ID NO: 1302820 - RNA, 24 nt, Human
caagguggguggaucacuugaggu

SEQ ID NO: 1302821 - RNA, 26 nt, Human
caagguggguggaucacuugagguca

SEQ ID NO: 1302822 - RNA, 22 nt, Human
cacacagcuuguaaagggcaga

SEQ ID NO: 1302823 - RNA, 23 nt, Human
cacauggaacguguccuagaggc

SEQ ID NO: 1302824 - RNA, 19 nt, Human
caccgacaaccggcaggca

SEQ ID NO: 1302825 - RNA, 24 nt, Human
cacgccuguaaucccagcaguuug

SEQ ID NO: 1302826 - RNA, 23 nt, Human
cacuugaggucaggaguuugaga

SEQ ID NO: 1302827 - RNA, 20 nt, Human
cagaagaaaaaacgggucca

SEQ ID NO: 1302828 - RNA, 24 nt, Human
cagcacagccucgugggccuccaa

SEQ ID NO: 1302829 - RNA, 24 nt, Human
cagcaguuugggaggccaaggugg

SEQ ID NO: 1302830 - RNA, 19 nt, Human
cagccacagacacugggcc

SEQ ID NO: 1302831 - RNA, 18 nt, Human
cagcccccuccggccccc

SEQ ID NO: 1302832 - RNA, 20 nt, Human
cagccuaagucucuaagucu

SEQ ID NO: 1302833 - RNA, 23 nt, Human
caggcacugcuuccgagccccuc

SEQ ID NO: 1302834 - RNA, 21 nt, Human
caggcaggccaggccuugggc

SEQ ID NO: 1302835 - RNA, 26 nt, Human
caggccccuuuccucccucccuuuuc

SEQ ID NO: 1302836 - RNA, 23 nt, Human
caggccgggcagaguggcucacg

SEQ ID NO: 1302837 - RNA, 19 nt, Human
caggcuccccugaaacgcc

SEQ ID NO: 1302838 - RNA, 18 nt, Human
cagggcagcccugguagg

SEQ ID NO: 1302839 - RNA, 18 nt, Human
cauuaaccaagccgggua

SEQ ID NO: 1302840 - RNA, 26 nt, Human
cauuacaaagucccaaccacauggaa

SEQ ID NO: 1302841 - RNA, 24 nt, Human
ccaaagagaaaggaugcagagaaa

SEQ ID NO: 1302842 - RNA, 19 nt, Human
ccaagccggguaaugaaug

SEQ ID NO: 1302843 - RNA, 21 nt, Human
ccacauucuguccuuugaucc

SEQ ID NO: 1302844 - RNA, 25 nt, Human
ccacccagagcgcccccacccacac

SEQ ID NO: 1302845 - RNA, 20 nt, Human
ccagaagaaaaaacgggucc

SEQ ID NO: 1302846 - RNA, 22 nt, Human
ccagagaaccugcccuuccuua

SEQ ID NO: 1302847 - RNA, 22 nt, Human
ccagcagcugugugaccccagc

SEQ ID NO: 1302848 - RNA, 19 nt, Human
ccagcaguuugggaggcca

SEQ ID NO: 1302849 - RNA, 21 nt, Human
ccaggccccuuuccucccucc

SEQ ID NO: 1302850 - RNA, 19 nt, Human
cccacacugcuccgaaugc

SEQ ID NO: 1302851 - RNA, 18 nt, Human
cccacccacacugcuccg

SEQ ID NO: 1302852 - RNA, 19 nt, Human
cccacccacacugcuccga

SEQ ID NO: 1302853 - RNA, 22 nt, Human
cccacccacacugcuccgaaug

SEQ ID NO: 1302854 - RNA, 18 nt, Human
cccacgguugcccccagc

SEQ ID NO: 1302855 - RNA, 26 nt, Human
ccccagagaaccugcccuuccuuacc

SEQ ID NO: 1302856 - RNA, 22 nt, Human
cccccacccacacugcuccgaa

SEQ ID NO: 1302857 - RNA, 23 nt, Human
ccccccagaagagagaagcagca

SEQ ID NO: 1302858 - RNA, 27 nt, Human
ccccugaaugaugacaucaggccccug

SEQ ID NO: 1302859 - RNA, 18 nt, Human
ccccuuuccucccucccu

SEQ ID NO: 1302860 - RNA, 19 nt, Human
ccccuuuccucccucccuu

SEQ ID NO: 1302861 - RNA, 21 nt, Human
ccccuuuccucccucccuuuu

SEQ ID NO: 1302862 - RNA, 19 nt, Human
cccugaaacgccaagcucu

SEQ ID NO: 1302863 - RNA, 21 nt, Human
ccuccaggccccuuuccuccc

SEQ ID NO: 1302864 - RNA, 19 nt, Human
ccucccaccccaccccugc

SEQ ID NO: 1302865 - RNA, 19 nt, Human
ccucccucaaguccccagg

SEQ ID NO: 1302866 - RNA, 21 nt, Human
ccucccucaaguccccaggcu

SEQ ID NO: 1302867 - RNA, 21 nt, Human
ccucuuccuucagcauguuca

SEQ ID NO: 1302868 - RNA, 21 nt, Human
ccuggcccccugguuucuuuc

SEQ ID NO: 1302869 - RNA, 23 nt, Human
ccuggccugugugggcuccagag

SEQ ID NO: 1302870 - RNA, 23 nt, Human
ccuugggcagcccuggcuggucc

SEQ ID NO: 1302871 - RNA, 24 nt, Human
cgccuguaaucccagcaguuuggg

SEQ ID NO: 1302872 - RNA, 19 nt, Human
cggcaggcaggccaggccu

SEQ ID NO: 1302873 - RNA, 24 nt, Human
cgggagggaggggaggcuaagggg

SEQ ID NO: 1302874 - RNA, 22 nt, Human
cgggccccagagaaccugccgg

SEQ ID NO: 1302875 - RNA, 20 nt, Human
cuagagcuggucuccuccac

SEQ ID NO: 1302876 - RNA, 21 nt, Human
cucacgccuguaaucccagca

SEQ ID NO: 1302877 - RNA, 21 nt, Human
cucacgccuguaaucccagca

SEQ ID NO: 1302878 - RNA, 21 nt, Human
cuccuccacccagagcgcccc

SEQ ID NO: 1302879 - RNA, 23 nt, Human
cuccucccaccccaccccugcaa

SEQ ID NO: 1302880 - RNA, 24 nt, Human
cugacccagcagcugugugacccc

SEQ ID NO: 1302881 - RNA, 21 nt, Human
cuggcccccugguuucuuucc

SEQ ID NO: 1302882 - RNA, 19 nt, Human
cugguuucuuuccaaggcu

SEQ ID NO: 1302883 - RNA, 26 nt, Human
cugguuucuuuccaaggcuccucauu

SEQ ID NO: 1302884 - RNA, 23 nt, Human
cuguacucaacagagacaggaac

SEQ ID NO: 1302885 - RNA, 18 nt, Human
cugucaucagaaccgcau

SEQ ID NO: 1302886 - RNA, 25 nt, Human
cugucucuacaaaaaauacaaaaag

SEQ ID NO: 1302887 - RNA, 21 nt, Human
cuucccauggcacugguaccu

SEQ ID NO: 1302888 - RNA, 18 nt, Human
gaaggaagggagggaggg

SEQ ID NO: 1302889 - RNA, 19 nt, Human
gaaggggaggggaggacgg

SEQ ID NO: 1302890 - RNA, 25 nt, Human
gacguggaagcaggaaggagaagga

SEQ ID NO: 1302891 - RNA, 21 nt, Human
gacuuggaaacagcgucagug

SEQ ID NO: 1302892 - RNA, 18 nt, Human
gagaaccugccaguccgg

SEQ ID NO: 1302893 - RNA, 19 nt, Human
gagaagcaagggaagggga

SEQ ID NO: 1302894 - RNA, 21 nt, Human
gaggggaggacgggagaaggc

SEQ ID NO: 1302895 - RNA, 24 nt, Human
gaucacuugaggucaggaguuuga

SEQ ID NO: 1302896 - RNA, 20 nt, Human
gauggguagaugauggaugg

SEQ ID NO: 1302897 - RNA, 18 nt, Human
gcaaaacccucccagaca

SEQ ID NO: 1302898 - RNA, 19 nt, Human
gcacagggcagcccuggua

SEQ ID NO: 1302899 - RNA, 18 nt, Human
gcagaagaaggggccacg

SEQ ID NO: 1302900 - RNA, 20 nt, Human
gcagagagccagccuugcca

SEQ ID NO: 1302901 - RNA, 19 nt, Human
gcagccaccacaaugaccc

SEQ ID NO: 1302902 - RNA, 19 nt, Human
gcaucagaggguuuucagg

SEQ ID NO: 1302903 - RNA, 24 nt, Human
gcaugguggucccagcuacuuggg

SEQ ID NO: 1302904 - RNA, 21 nt, Human
gccaagcucuggguggaaguu

SEQ ID NO: 1302905 - RNA, 21 nt, Human
gccccagagaaccugcccuuc

SEQ ID NO: 1302906 - RNA, 21 nt, Human
gcccccaaagagaaaggaugc

SEQ ID NO: 1302907 - RNA, 22 nt, Human
gcccgggcaaaacccucccaga

SEQ ID NO: 1302908 - RNA, 18 nt, Human
gccugugcgggccccaga

SEQ ID NO: 1302909 - RNA, 22 nt, Human
gcuccucccaccccaccccugc

SEQ ID NO: 1302910 - RNA, 18 nt, Human
gcuuggagagaaagaagc

SEQ ID NO: 1302911 - RNA, 21 nt, Human
ggacgggagaaggcaguggga

SEQ ID NO: 1302912 - RNA, 21 nt, Human
ggacguggaagcaggaaggag

SEQ ID NO: 1302913 - RNA, 19 nt, Human
ggagggaggggaggcuaag

SEQ ID NO: 1302914 - RNA, 21 nt, Human
ggaggggaggcacuccugugg

SEQ ID NO: 1302915 - RNA, 22 nt, Human
ggaucacuugaggucaggaguu

SEQ ID NO: 1302916 - RNA, 20 nt, Human
ggaugcccacgguugccccc

SEQ ID NO: 1302917 - RNA, 18 nt, Human
ggcaucagaggguuuuca

SEQ ID NO: 1302918 - RNA, 18 nt, Human
ggccgggcuggggagggc

SEQ ID NO: 1302919 - RNA, 19 nt, Human
ggccgggcuggggagggcc

SEQ ID NO: 1302920 - RNA, 19 nt, Human
ggccuugggcagcccuggc

SEQ ID NO: 1302921 - RNA, 24 nt, Human
gggaaggggaggggaggacgggag

SEQ ID NO: 1302922 - RNA, 22 nt, Human
gggaggggaggacgggagaagg

SEQ ID NO: 1302923 - RNA, 24 nt, Human
gggcagaguggcucacgccuguaa

SEQ ID NO: 1302924 - RNA, 19 nt, Human
gggccgggagggaggggag

SEQ ID NO: 1302925 - RNA, 19 nt, Human
gggcgggguggggcaagcu

SEQ ID NO: 1302926 - RNA, 22 nt, Human
gggcucaguuuccaaacaaaag

SEQ ID NO: 1302927 - RNA, 20 nt, Human
gggcuuccagaacgcagucu

SEQ ID NO: 1302928 - RNA, 18 nt, Human
ggggaggggaggacggga

SEQ ID NO: 1302929 - RNA, 19 nt, Human
ggggaggggcggggugggg

SEQ ID NO: 1302930 - RNA, 23 nt, Human
ggggcgggguggggcaagcuggc

SEQ ID NO: 1302931 - RNA, 19 nt, Human
ggucaggaguuugagacca

SEQ ID NO: 1302932 - RNA, 24 nt, Human
ggucccccuccuccuccaggcccc

SEQ ID NO: 1302933 - RNA, 21 nt, Human
gguggaucacuugaggucagg

SEQ ID NO: 1302934 - RNA, 22 nt, Human
gguggcggggccuggagagaga

SEQ ID NO: 1302935 - RNA, 27 nt, Human
guccuagaggcuccucaacaggcauca

SEQ ID NO: 1302936 - RNA, 23 nt, Human
guccuggccugugcaggccccag

SEQ ID NO: 1302937 - RNA, 19 nt, Human
gucuggaggggaugcaggg

SEQ ID NO: 1302938 - RNA, 18 nt, Human
gugcugggccccauggag

SEQ ID NO: 1302939 - RNA, 19 nt, Human
gugcugggccccauggagc

SEQ ID NO: 1302940 - RNA, 18 nt, Human
guggcggggccuggagag

SEQ ID NO: 1302941 - RNA, 20 nt, Human
guuugggaggccaagguggg

SEQ ID NO: 1302942 - RNA, 23 nt, Human
uaaaagauggggugacacucucc

SEQ ID NO: 1302943 - RNA, 18 nt, Human
uaaccaaggcccccaucc

SEQ ID NO: 1302944 - RNA, 21 nt, Human
uacaaagucccaaccacaugg

SEQ ID NO: 1302945 - RNA, 20 nt, Human
uaccaguguuuccugaucaa

SEQ ID NO: 1302946 - RNA, 23 nt, Human
uagaagaccccagguaauaaaga

SEQ ID NO: 1302947 - RNA, 21 nt, Human
ucacacagcuuguaaagggca

SEQ ID NO: 1302948 - RNA, 19 nt, Human
ucacuugaggucaggaguu

SEQ ID NO: 1302949 - RNA, 21 nt, Human
ucagcccccuccggccccccc

SEQ ID NO: 1302950 - RNA, 20 nt, Human
uccaccagccuaagucucua

SEQ ID NO: 1302951 - RNA, 23 nt, Human
ucccagacacgugugaaggccuc

SEQ ID NO: 1302952 - RNA, 20 nt, Human
uccgaacucaacagagacag

SEQ ID NO: 1302953 - RNA, 24 nt, Human
uccuccacccagagcgcccccacc

SEQ ID NO: 1302954 - RNA, 22 nt, Human
uccucccaccccaccccugcaa

SEQ ID NO: 1302955 - RNA, 19 nt, Human
uccuggccugugcaggccc

SEQ ID NO: 1302956 - RNA, 20 nt, Human
uccuugaggggcugcauucu

SEQ ID NO: 1302957 - RNA, 24 nt, Human
ucucugcuguggaggggaggggcg

SEQ ID NO: 1302958 - RNA, 18 nt, Human
ucucugggcucaguuucc

SEQ ID NO: 1302959 - RNA, 23 nt, Human
ucuguacucaacagagacaggaa

SEQ ID NO: 1302960 - RNA, 18 nt, Human
ugaaacgccaagcucugg

SEQ ID NO: 1302961 - RNA, 18 nt, Human
ugaccagcagucacgcac

SEQ ID NO: 1302962 - RNA, 23 nt, Human
ugacuuggaaacagcgucaguga

SEQ ID NO: 1302963 - RNA, 24 nt, Human
ugagaccaacuugggcaacaugga

SEQ ID NO: 1302964 - RNA, 23 nt, Human
ugaggccugggcagggcuuccag

SEQ ID NO: 1302965 - RNA, 18 nt, Human
ugaggucaggaguuugag

SEQ ID NO: 1302966 - RNA, 18 nt, Human
ugaguggaugggaggaag

SEQ ID NO: 1302967 - RNA, 21 nt, Human
ugcaagugcccgggcaaaacc

SEQ ID NO: 1302968 - RNA, 19 nt, Human
ugcacaggccgggcagagu

SEQ ID NO: 1302969 - RNA, 19 nt, Human
ugcccgggcaaaacccucc

SEQ ID NO: 1302970 - RNA, 24 nt, Human
ugcccgggcaaaacccucccagac

SEQ ID NO: 1302971 - RNA, 24 nt, Human
ugccggucuguacucaacagagac

SEQ ID NO: 1302972 - RNA, 21 nt, Human
ugcuccucccaccccaccccu

SEQ ID NO: 1302973 - RNA, 21 nt, Human
ugcugggccccauggagccag

SEQ ID NO: 1302974 - RNA, 24 nt, Human
ugcuggucuguacucgagagagac

SEQ ID NO: 1302975 - RNA, 19 nt, Human
ugcuguggaggggaggggc

SEQ ID NO: 1302976 - RNA, 19 nt, Human
uggaagcaggaaggagaag

SEQ ID NO: 1302977 - RNA, 18 nt, Human
uggagagagaggcagcca

SEQ ID NO: 1302978 - RNA, 23 nt, Human
uggaucacuugaggucaggaguu

SEQ ID NO: 1302979 - RNA, 24 nt, Human
uggaucacuugaggucaggaguuu

SEQ ID NO: 1302980 - RNA, 27 nt, Human
uggaucacuugaggucaggaguuugag

SEQ ID NO: 1302981 - RNA, 21 nt, Human
uggaugggaggaaggaaggga

SEQ ID NO: 1302982 - RNA, 22 nt, Human
uggcauuacaaagucccaacca

SEQ ID NO: 1302983 - RNA, 21 nt, Human
uggccagaagaaaaaacgggu

SEQ ID NO: 1302984 - RNA, 23 nt, Human
uggcgaguguguggugugcccgc

SEQ ID NO: 1302985 - RNA, 24 nt, Human
uggcgaguguguggugugcccgcu

SEQ ID NO: 1302986 - RNA, 22 nt, Human
uggcucacgccuguaaucccag

SEQ ID NO: 1302987 - RNA, 24 nt, Human
uggcucacgccuguaaucccagca

SEQ ID NO: 1302988 - RNA, 21 nt, Human
uggcugaacagagguggcggg

SEQ ID NO: 1302989 - RNA, 21 nt, Human
ugggaccagguuugguuaggu

SEQ ID NO: 1302990 - RNA, 26 nt, Human
ugggaccagguuugguuagguaggcg

SEQ ID NO: 1302991 - RNA, 23 nt, Human
ugggagagggaaaucaaggcagc

SEQ ID NO: 1302992 - RNA, 19 nt, Human
ugggaggaaggaagggagg

SEQ ID NO: 1302993 - RNA, 26 nt, Human
ugggaggaaggaagggagggagggag

SEQ ID NO: 1302994 - RNA, 23 nt, Human
ugggaggccaagguggguggauc

SEQ ID NO: 1302995 - RNA, 24 nt, Human
ugggaggccaagguggguggauca

SEQ ID NO: 1302996 - RNA, 20 nt, Human
ugggcaacauggagaaaccc

SEQ ID NO: 1302997 - RNA, 22 nt, Human
ugggcauucaggcugugucugu

SEQ ID NO: 1302998 - RNA, 21 nt, Human
ugggccuccaaugaugcccaa

SEQ ID NO: 1302999 - RNA, 19 nt, Human
ugggcuggagcccagcgaa

SEQ ID NO: 1303000 - RNA, 22 nt, Human
uggggagggccagggggucagg

SEQ ID NO: 1303001 - RNA, 18 nt, Human
ugggugaguggaugggag

SEQ ID NO: 1303002 - RNA, 24 nt, Human
uggguggaucacuugaggucagga

SEQ ID NO: 1303003 - RNA, 21 nt, Human
uggucucugggcucaguuucc

SEQ ID NO: 1303004 - RNA, 22 nt, Human
uguucagcacagccucgugggc

SEQ ID NO: 1303005 - RNA, 18 nt, Human
uuagcugggcaugguggu

SEQ ID NO: 1303006 - RNA, 19 nt, Human
uuccaaggcuccucauucc

SEQ ID NO: 1303007 - RNA, 19 nt, Human
uuccccuggcccccugguu

SEQ ID NO: 1303008 - RNA, 22 nt, Human
uuccugaguuucuccagaggaa

SEQ ID NO: 1303009 - RNA, 19 nt, Human
uugggcaacauggagaaac

SEQ ID NO: 1303010 - RNA, 19 nt, Human
uuguggucucugggcucag

SEQ ID NO: 1303011 - RNA, 20 nt, Human
uuuccaggcacugcuuccga

SEQ ID NO: 1303012 - RNA, 18 nt, Human
agccagccgcucacccuc

SEQ ID NO: 1303013 - RNA, 31 nt, Human
ccuccgugaugaugucagcacuugcugcuuu

SEQ ID NO: 1303014 - RNA, 19 nt, Human
ugaugucagcacuugcugc

SEQ ID NO: 1303015 - RNA, 23 nt, Human
uucccagccagccagccgcucac

SEQ ID NO: 1303016 - RNA, 22 nt, Human
aacucaacuuucccacauuacc

SEQ ID NO: 1303017 - RNA, 21 nt, Human
acccaggcaaauaguuuucca

SEQ ID NO: 1303018 - RNA, 22 nt, Human
aggcaaauaguuuuccaguuuc

SEQ ID NO: 1303019 - RNA, 19 nt, Human
cauuuuaguugagucaaga

SEQ ID NO: 1303020 - RNA, 24 nt, Human
cccacauuaccuucaucaucacaa

SEQ ID NO: 1303021 - RNA, 24 nt, Human
uaaagugaauaacagcacugucaa

SEQ ID NO: 1303022 - RNA, 18 nt, Human
ucagugcaaaggaagcug

SEQ ID NO: 1303023 - RNA, 19 nt, Human
ucucccaacucaacuuucc

SEQ ID NO: 1303024 - RNA, 22 nt, Human
ugagaauacugaauaccaucca

SEQ ID NO: 1303025 - RNA, 19 nt, Human
ugcaaaggaagcugguaaa

SEQ ID NO: 1303026 - RNA, 23 nt, Human
ugggagcaaggcucucccaacuc

SEQ ID NO: 1303027 - RNA, 20 nt, Human
ccgcggcuggggacggaggc

SEQ ID NO: 1303028 - RNA, 19 nt, Human
gccacucuucggguggauu

SEQ ID NO: 1303029 - RNA, 21 nt, Human
uaccuaagugaagaggagagc

SEQ ID NO: 1303030 - RNA, 22 nt, Human
uucccgagccgcggcuggggac

SEQ ID NO: 1303031 - RNA, 18 nt, Human
ccccuccuuccuccagcc

SEQ ID NO: 1303032 - RNA, 19 nt, Human
ccccuccuuccuccagccc

SEQ ID NO: 1303033 - RNA, 21 nt, Human
cccuccuuccuccagccccca

SEQ ID NO: 1303034 - RNA, 18 nt, Human
ugcccggggccucccgca

SEQ ID NO: 1303035 - RNA, 19 nt, Human
cagagaauccuucuccuuc

SEQ ID NO: 1303036 - RNA, 19 nt, Human
gccacucugcuuccuguca

SEQ ID NO: 1303037 - RNA, 26 nt, Human
gcuuaauuaaguuuuuagugcauacu

SEQ ID NO: 1303038 - RNA, 21 nt, Human
ggguuggugcuugccacacuu

SEQ ID NO: 1303039 - RNA, 20 nt, Human
ugccacacuucuuauagaaa

SEQ ID NO: 1303040 - RNA, 23 nt, Human
aaacagcucaaaggggugucccg

SEQ ID NO: 1303041 - RNA, 21 nt, Human
aagaagauccuggggcucaga

SEQ ID NO: 1303042 - RNA, 20 nt, Human
aagugcccugccagaggucc

SEQ ID NO: 1303043 - RNA, 20 nt, Human
agaggucccugccagccccg

SEQ ID NO: 1303044 - RNA, 22 nt, Human
agcaauggggauaaggaagaga

SEQ ID NO: 1303045 - RNA, 21 nt, Human
agccccgggcuccuguagccu

SEQ ID NO: 1303046 - RNA, 21 nt, Human
aggacgcguacgaggggccca

SEQ ID NO: 1303047 - RNA, 18 nt, Human
aggaggcagagaggguag

SEQ ID NO: 1303048 - RNA, 18 nt, Human
aggcaggaggcagagagg

SEQ ID NO: 1303049 - RNA, 19 nt, Human
aggcggggcgaggcggggc

SEQ ID NO: 1303050 - RNA, 22 nt, Human
aggucccugccagccccgggcu

SEQ ID NO: 1303051 - RNA, 22 nt, Human
agucgggcagcaugucaagucc

SEQ ID NO: 1303052 - RNA, 18 nt, Human
caaagggcgaggaguucc

SEQ ID NO: 1303053 - RNA, 22 nt, Human
cagcccgggucccuccgaaagc

SEQ ID NO: 1303054 - RNA, 19 nt, Human
cagcgcaggauaagagggu

SEQ ID NO: 1303055 - RNA, 19 nt, Human
cagcgccgggaccccacgc

SEQ ID NO: 1303056 - RNA, 23 nt, Human
ccagaggucccugccagccccgg

SEQ ID NO: 1303057 - RNA, 20 nt, Human
ccccacgcacugagcagagc

SEQ ID NO: 1303058 - RNA, 19 nt, Human
ccccgggcuccuguagccu

SEQ ID NO: 1303059 - RNA, 27 nt, Human
ccuccgaaagcugagagggagaagggg

SEQ ID NO: 1303060 - RNA, 21 nt, Human
cgacaggcagucgggcagcau

SEQ ID NO: 1303061 - RNA, 19 nt, Human
cgcacugagcagagcggca

SEQ ID NO: 1303062 - RNA, 24 nt, Human
cgcccucuaagcgggaaacagcuc

SEQ ID NO: 1303063 - RNA, 18 nt, Human
cgccggcagggggcggcg

SEQ ID NO: 1303064 - RNA, 21 nt, Human
cggcagggggcggcguccgcc

SEQ ID NO: 1303065 - RNA, 20 nt, Human
cggcccaggcgugcgcgcaa

SEQ ID NO: 1303066 - RNA, 20 nt, Human
cggcgaggacguggcgcccc

SEQ ID NO: 1303067 - RNA, 18 nt, Human
cgggccguggccccugcc

SEQ ID NO: 1303068 - RNA, 22 nt, Human
cucccugagcaauggggauaag

SEQ ID NO: 1303069 - RNA, 18 nt, Human
cuccgaaagcugagaggg

SEQ ID NO: 1303070 - RNA, 24 nt, Human
cucgcccucggccgacaggcaguc

SEQ ID NO: 1303071 - RNA, 20 nt, Human
cugcagcccuugggcggagg

SEQ ID NO: 1303072 - RNA, 23 nt, Human
cugccagccccgggcuccuguag

SEQ ID NO: 1303073 - RNA, 18 nt, Human
gacacugagggcgcggga

SEQ ID NO: 1303074 - RNA, 24 nt, Human
gacacugagggcgcgggaucgggc

SEQ ID NO: 1303075 - RNA, 19 nt, Human
gacagcgcaggauaagagg

SEQ ID NO: 1303076 - RNA, 18 nt, Human
gagcagagcggcacgagc

SEQ ID NO: 1303077 - RNA, 24 nt, Human
gagccgggccguggccccugccaa

SEQ ID NO: 1303078 - RNA, 19 nt, Human
gcaagaagauccuggggcu

SEQ ID NO: 1303079 - RNA, 18 nt, Human
gcaaggacgcguacgagg

SEQ ID NO: 1303080 - RNA, 19 nt, Human
gcagagcggcacgagcacc

SEQ ID NO: 1303081 - RNA, 22 nt, Human
gcagugcaaacaccucaucuac

SEQ ID NO: 1303082 - RNA, 24 nt, Human
gccccgggcuccuguagccuccgg

SEQ ID NO: 1303083 - RNA, 18 nt, Human
gcccgcgcgacgcguccc

SEQ ID NO: 1303084 - RNA, 18 nt, Human
gcccgggacagcgcagga

SEQ ID NO: 1303085 - RNA, 20 nt, Human
gcggccgggacacugagggc

SEQ ID NO: 1303086 - RNA, 18 nt, Human
ggacacggaucgcugacc

SEQ ID NO: 1303087 - RNA, 21 nt, Human
ggaucgggcgagggaagaggc

SEQ ID NO: 1303088 - RNA, 22 nt, Human
ggcaaagggcgaggaguucccg

SEQ ID NO: 1303089 - RNA, 18 nt, Human
ggcgagggaagaggcggg

SEQ ID NO: 1303090 - RNA, 19 nt, Human
ggcgccccggcaggugcac

SEQ ID NO: 1303091 - RNA, 19 nt, Human
ggggcgaggcggggcgggg

SEQ ID NO: 1303092 - RNA, 23 nt, Human
guggccccugccagcagccggcg

SEQ ID NO: 1303093 - RNA, 19 nt, Human
uaagcgggaaacagcucaa

SEQ ID NO: 1303094 - RNA, 21 nt, Human
uaaggaagagaggcccgggac

SEQ ID NO: 1303095 - RNA, 20 nt, Human
uacgaggggcccacgcggcg

SEQ ID NO: 1303096 - RNA, 20 nt, Human
uccgaaagcugagagggaga

SEQ ID NO: 1303097 - RNA, 24 nt, Human
ucgcugcagcccuugggcggaggg

SEQ ID NO: 1303098 - RNA, 30 nt, Human
ucuaccugcaggcaggaggcagagaggguu

SEQ ID NO: 1303099 - RNA, 31 nt, Human
ucugcagcaggggcaagaagauccuggggcc

SEQ ID NO: 1303100 - RNA, 22 nt, Human
ugagcagagcggcacgagcacc

SEQ ID NO: 1303101 - RNA, 19 nt, Human
ugcaaacaccucaucuacc

SEQ ID NO: 1303102 - RNA, 20 nt, Human
ugcgcgcaaggacgcguacg

SEQ ID NO: 1303103 - RNA, 21 nt, Human
uucccggccgcuguaccugac

SEQ ID NO: 1303104 - RNA, 22 nt, Human
uucggccuaugguggccccagc

SEQ ID NO: 1303105 - RNA, 27 nt, Human
aaggcaaaacaucuguguuauuacgga

SEQ ID NO: 1303106 - RNA, 22 nt, Human
agcccccucagacugaauguua

SEQ ID NO: 1303107 - RNA, 24 nt, Human
cacaagcccccucagacugaaugu

SEQ ID NO: 1303108 - RNA, 21 nt, Human
cggacacaagcccccucagac

SEQ ID NO: 1303109 - RNA, 18 nt, Human
cccuuucuuucucucucc

SEQ ID NO: 1303110 - RNA, 24 nt, Human
aaaaggaagggguuggaaacaaaa

SEQ ID NO: 1303111 - RNA, 20 nt, Human
aaaggcccaaagcauccaag

SEQ ID NO: 1303112 - RNA, 21 nt, Human
aaugauaaggugcaggcagaa

SEQ ID NO: 1303113 - RNA, 23 nt, Human
aauguaacaaagaaagaguugaa

SEQ ID NO: 1303114 - RNA, 22 nt, Human
acaggcaacauuaagccucuga

SEQ ID NO: 1303115 - RNA, 22 nt, Human
accagucauaaccuauggagca

SEQ ID NO: 1303116 - RNA, 24 nt, Human
acuuuuauaauuaaccacugaagu

SEQ ID NO: 1303117 - RNA, 21 nt, Human
agacacuugggacaaaaggug

SEQ ID NO: 1303118 - RNA, 18 nt, Human
agaggaacagagauggcc

SEQ ID NO: 1303119 - RNA, 20 nt, Human
agaggaacagagauggccug

SEQ ID NO: 1303120 - RNA, 20 nt, Human
agcagucaaaggcccaaagc

SEQ ID NO: 1303121 - RNA, 23 nt, Human
agccaaacaguuaaaaagucaga

SEQ ID NO: 1303122 - RNA, 24 nt, Human
aggaaggagggcagcggaagagga

SEQ ID NO: 1303123 - RNA, 21 nt, Human
aggaagugaucuauaccaagg

SEQ ID NO: 1303124 - RNA, 20 nt, Human
aggacacccaaacaugugcc

SEQ ID NO: 1303125 - RNA, 21 nt, Human
aggagggcagcggaagaggag

SEQ ID NO: 1303126 - RNA, 22 nt, Human
aggagggcagcggaagaggagg

SEQ ID NO: 1303127 - RNA, 19 nt, Human
aggcagaaucacgggugac

SEQ ID NO: 1303128 - RNA, 21 nt, Human
auccaagcccagugggcuucu

SEQ ID NO: 1303129 - RNA, 23 nt, Human
auggagcagucaaaggcccaaag

SEQ ID NO: 1303130 - RNA, 24 nt, Human
auggggcaacagugaccugggcaa

SEQ ID NO: 1303131 - RNA, 18 nt, Human
auuacugccaccaccucu

SEQ ID NO: 1303132 - RNA, 21 nt, Human
caccagucauaaccuauggag

SEQ ID NO: 1303133 - RNA, 21 nt, Human
cagcggaagaggaggcaugcc

SEQ ID NO: 1303134 - RNA, 19 nt, Human
cagugggaacugaggacug

SEQ ID NO: 1303135 - RNA, 20 nt, Human
cauuaagccucugaggggga

SEQ ID NO: 1303136 - RNA, 22 nt, Human
ccaaagcauccaagcccagugg

SEQ ID NO: 1303137 - RNA, 23 nt, Human
ccacaauuacugccaccaccucu

SEQ ID NO: 1303138 - RNA, 19 nt, Human
ccacuggagaaccugauug

SEQ ID NO: 1303139 - RNA, 19 nt, Human
ccagacuggaaccacgauu

SEQ ID NO: 1303140 - RNA, 19 nt, Human
ccagagaagaagcuccuuc

SEQ ID NO: 1303141 - RNA, 22 nt, Human
ccccugagcgaaccugaggcuc

SEQ ID NO: 1303142 - RNA, 18 nt, Human
ccuuucccacccugaaga

SEQ ID NO: 1303143 - RNA, 21 nt, Human
cucaggaaaauggaggcagau

SEQ ID NO: 1303144 - RNA, 21 nt, Human
cucucacucuagaacuggacc

SEQ ID NO: 1303145 - RNA, 21 nt, Human
cugagucccuucuccuucaga

SEQ ID NO: 1303146 - RNA, 22 nt, Human
cugcaaccagacuggaaccacg

SEQ ID NO: 1303147 - RNA, 21 nt, Human
cugcccucuucaacuccaagu

SEQ ID NO: 1303148 - RNA, 19 nt, Human
cuggagaaccugauugucc

SEQ ID NO: 1303149 - RNA, 18 nt, Human
cuggagauaacaaaagga

SEQ ID NO: 1303150 - RNA, 22 nt, Human
cuggagcauggguaagguuccu

SEQ ID NO: 1303151 - RNA, 23 nt, Human
cuggagcauggguaagguuccug

SEQ ID NO: 1303152 - RNA, 23 nt, Human
cugucaggggcagcuugggccac

SEQ ID NO: 1303153 - RNA, 25 nt, Human
gaaaagagaggacacccaaacaugu

SEQ ID NO: 1303154 - RNA, 20 nt, Human
gaaaauggaggcagauaccc

SEQ ID NO: 1303155 - RNA, 22 nt, Human
gaagcuccuucuccagccgccc

SEQ ID NO: 1303156 - RNA, 18 nt, Human
gaauaguagaaacaaaac

SEQ ID NO: 1303157 - RNA, 19 nt, Human
gaauaguagaaacaaaaca

SEQ ID NO: 1303158 - RNA, 19 nt, Human
gaccggcagacacuuggga

SEQ ID NO: 1303159 - RNA, 18 nt, Human
gagaagaagcuccuucuc

SEQ ID NO: 1303160 - RNA, 21 nt, Human
gagcgaaccugaggcucccac

SEQ ID NO: 1303161 - RNA, 21 nt, Human
gcaaacuuuccaaacggaaaa

SEQ ID NO: 1303162 - RNA, 18 nt, Human
gcagugggaacugaggac

SEQ ID NO: 1303163 - RNA, 21 nt, Human
gcagugggaacugaggacugg

SEQ ID NO: 1303164 - RNA, 22 nt, Human
gccaagucaggugggccagguu

SEQ ID NO: 1303165 - RNA, 19 nt, Human
gccauagcaucaaacugga

SEQ ID NO: 1303166 - RNA, 26 nt, Human
gccccugagcgaaccugaggcuccca

SEQ ID NO: 1303167 - RNA, 18 nt, Human
ggaacugagcggcugaua

SEQ ID NO: 1303168 - RNA, 22 nt, Human
ggacaaaagguggugugcccgg

SEQ ID NO: 1303169 - RNA, 25 nt, Human
ggauuuuaucagaaaagagaggaca

SEQ ID NO: 1303170 - RNA, 18 nt, Human
ggcacgggguugggaagg

SEQ ID NO: 1303171 - RNA, 23 nt, Human
gggcaacagugaccugggcaaaa

SEQ ID NO: 1303172 - RNA, 18 nt, Human
ggucgaccggcagacacu

SEQ ID NO: 1303173 - RNA, 26 nt, Human
ggugggccagguucuccgaacauggg

SEQ ID NO: 1303174 - RNA, 25 nt, Human
guccugugccaggugaaggacgcug

SEQ ID NO: 1303175 - RNA, 18 nt, Human
uacacaucacaaugaugg

SEQ ID NO: 1303176 - RNA, 23 nt, Human
uacauugaaaaaaggaaagacau

SEQ ID NO: 1303177 - RNA, 24 nt, Human
uacauugaaaaaaggaaagacauu

SEQ ID NO: 1303178 - RNA, 23 nt, Human
uagaacuggaccaccccagagga

SEQ ID NO: 1303179 - RNA, 19 nt, Human
uagccaccgccaggcccug

SEQ ID NO: 1303180 - RNA, 18 nt, Human
uaguagaaacaaaacaca

SEQ ID NO: 1303181 - RNA, 19 nt, Human
uaucagaaaagagaggaca

SEQ ID NO: 1303182 - RNA, 23 nt, Human
uccacaggcaacauuaagccucu

SEQ ID NO: 1303183 - RNA, 24 nt, Human
uccacaggcaacauuaagccucug

SEQ ID NO: 1303184 - RNA, 21 nt, Human
ucccagugugccugacucccu

SEQ ID NO: 1303185 - RNA, 22 nt, Human
ucuaaagugaauucugugcuga

SEQ ID NO: 1303186 - RNA, 22 nt, Human
ucuagaacuggaccaccccaga

SEQ ID NO: 1303187 - RNA, 22 nt, Human
ucuauaccaagguuugcaggga

SEQ ID NO: 1303188 - RNA, 26 nt, Human
ucugcaaccagacuggaaccacgauu

SEQ ID NO: 1303189 - RNA, 19 nt, Human
ucugcaggcgcugccaccg

SEQ ID NO: 1303190 - RNA, 22 nt, Human
ucuugcauguccugugccaggu

SEQ ID NO: 1303191 - RNA, 24 nt, Human
ugaaaaaaggaaagacauuuuuuc

SEQ ID NO: 1303192 - RNA, 18 nt, Human
ugaaaaguagguaacgaa

SEQ ID NO: 1303193 - RNA, 19 nt, Human
ugaccugggcaaaaggcug

SEQ ID NO: 1303194 - RNA, 18 nt, Human
ugaggacuggagggcgug

SEQ ID NO: 1303195 - RNA, 18 nt, Human
ugcaccugggauccucga

SEQ ID NO: 1303196 - RNA, 21 nt, Human
ugccaggugaaggacgcugga

SEQ ID NO: 1303197 - RNA, 24 nt, Human
ugcccagaagaaaguuaauggcaa

SEQ ID NO: 1303198 - RNA, 24 nt, Human
ugccugacucccuuucucucacuc

SEQ ID NO: 1303199 - RNA, 19 nt, Human
ugccuugcuccaagucugg

SEQ ID NO: 1303200 - RNA, 20 nt, Human
ugcugccccugagcgaaccu

SEQ ID NO: 1303201 - RNA, 21 nt, Human
uggaucgggacagauuuccag

SEQ ID NO: 1303202 - RNA, 18 nt, Human
ugggagggcccugggucc

SEQ ID NO: 1303203 - RNA, 22 nt, Human
ugggcugggaugggcacugcuc

SEQ ID NO: 1303204 - RNA, 25 nt, Human
uguccugugccaggugaaggacgcu

SEQ ID NO: 1303205 - RNA, 21 nt, Human
ugugccugacucccuuucucu

SEQ ID NO: 1303206 - RNA, 23 nt, Human
ugugcugagucccuucuccuuca

SEQ ID NO: 1303207 - RNA, 20 nt, Human
ugugcugucaggggcagcuu

SEQ ID NO: 1303208 - RNA, 23 nt, Human
ugugcugucaggggcagcuuggg

SEQ ID NO: 1303209 - RNA, 24 nt, Human
ugugcugucaggggcagcuugggc

SEQ ID NO: 1303210 - RNA, 23 nt, Human
uuaacacuagcagaggaguccaa

SEQ ID NO: 1303211 - RNA, 21 nt, Human
uuaaucaucuggcuugcaaaa

SEQ ID NO: 1303212 - RNA, 24 nt, Human
uuaguggacugacuccaagguugc

SEQ ID NO: 1303213 - RNA, 18 nt, Human
uucagggccucaaggggc

SEQ ID NO: 1303214 - RNA, 19 nt, Human
uucugugcugagucccuuc

SEQ ID NO: 1303215 - RNA, 21 nt, Human
uugagcucaggaaaauggagg

SEQ ID NO: 1303216 - RNA, 23 nt, Human
uugcagggaagucgaauguucuc

SEQ ID NO: 1303217 - RNA, 22 nt, Human
uugcugccccugagcgaaccug

SEQ ID NO: 1303218 - RNA, 18 nt, Human
uugcuugaagcccucuga

SEQ ID NO: 1303219 - RNA, 23 nt, Human
uugggccacuuugcugccccuga

SEQ ID NO: 1303220 - RNA, 19 nt, Human
uuugcagaaaucacugcag

SEQ ID NO: 1303221 - RNA, 21 nt, Human
uuugcagaaaucacugcagau

SEQ ID NO: 1303222 - RNA, 26 nt, Human
aaaaacugaucaauucuuucucuaua

SEQ ID NO: 1303223 - RNA, 19 nt, Human
aagaauucuuuacauacgc

SEQ ID NO: 1303224 - RNA, 19 nt, Human
acugaucaauucuuucucu

SEQ ID NO: 1303225 - RNA, 20 nt, Human
agaauucuuuacauacgccc

SEQ ID NO: 1303226 - RNA, 23 nt, Human
agcugccaaagcgagcugagcag

SEQ ID NO: 1303227 - RNA, 18 nt, Human
aggaagggauaggaaggg

SEQ ID NO: 1303228 - RNA, 21 nt, Human
aggaagggauaggaagggggc

SEQ ID NO: 1303229 - RNA, 20 nt, Human
caaaugacgcaacugaaccc

SEQ ID NO: 1303230 - RNA, 21 nt, Human
caagcugccaaagcgagcuga

SEQ ID NO: 1303231 - RNA, 21 nt, Human
cgagguuggaaagaaucugcc

SEQ ID NO: 1303232 - RNA, 28 nt, Human
cuagauaauagcacaggcgguuuucuuu

SEQ ID NO: 1303233 - RNA, 23 nt, Human
cuccccgguugcgcgugcgcacu

SEQ ID NO: 1303234 - RNA, 18 nt, Human
cugaucaauucuuucucu

SEQ ID NO: 1303235 - RNA, 23 nt, Human
cuuugguguccaagcaaaaacug

SEQ ID NO: 1303236 - RNA, 21 nt, Human
gcggagcgcagagacgcgcug

SEQ ID NO: 1303237 - RNA, 25 nt, Human
gcggagcgcagagacgcgcugaagc

SEQ ID NO: 1303238 - RNA, 23 nt, Human
gcugauuggcggcgacgcgggag

SEQ ID NO: 1303239 - RNA, 19 nt, Human
ggauaggaagggggcggag

SEQ ID NO: 1303240 - RNA, 24 nt, Human
gguuggaaagaaucugccaguagu

SEQ ID NO: 1303241 - RNA, 21 nt, Human
uacgcccaccaagcugccaaa

SEQ ID NO: 1303242 - RNA, 20 nt, Human
ugcgcgugcgcacugugcag

SEQ ID NO: 1303243 - RNA, 19 nt, Human
uggaaagaaucugccagua

SEQ ID NO: 1303244 - RNA, 19 nt, Human
uucuuuacauacgcccacc

SEQ ID NO: 1303245 - RNA, 19 nt, Human
uuuuccuuugguguccaag

SEQ ID NO: 1303246 - RNA, 22 nt, Human
aaagacaaaggcccuuaaggga

SEQ ID NO: 1303247 - RNA, 19 nt, Human
aacacggugaagagcuucc

SEQ ID NO: 1303248 - RNA, 21 nt, Human
aacacggugaagagcuuccgu

SEQ ID NO: 1303249 - RNA, 23 nt, Human
aagaggagacagggcugagggga

SEQ ID NO: 1303250 - RNA, 19 nt, Human
aagccucgcuggcagcucc

SEQ ID NO: 1303251 - RNA, 21 nt, Human
aaggagggaggcaccagcagg

SEQ ID NO: 1303252 - RNA, 23 nt, Human
acauuuucccagguccccugcca

SEQ ID NO: 1303253 - RNA, 20 nt, Human
acccaaacagaccugacuag

SEQ ID NO: 1303254 - RNA, 26 nt, Human
acccagagcagcccugcggcccuccu

SEQ ID NO: 1303255 - RNA, 22 nt, Human
accucagacccaaacagaccug

SEQ ID NO: 1303256 - RNA, 18 nt, Human
acugcagaagaggagaca

SEQ ID NO: 1303257 - RNA, 26 nt, Human
agaacagacacggugaagaaggagau

SEQ ID NO: 1303258 - RNA, 20 nt, Human
agaagccaagagagcaggca

SEQ ID NO: 1303259 - RNA, 19 nt, Human
agaauguuccaugcaccuc

SEQ ID NO: 1303260 - RNA, 19 nt, Human
agacacggugaagaaggag

SEQ ID NO: 1303261 - RNA, 21 nt, Human
agacccaaacagaccugacua

SEQ ID NO: 1303262 - RNA, 27 nt, Human
agacccaaacagaccugacuagguggu

SEQ ID NO: 1303263 - RNA, 21 nt, Human
agacccagagcagcccugcgg

SEQ ID NO: 1303264 - RNA, 19 nt, Human
agcagcgcgccuggcacgc

SEQ ID NO: 1303265 - RNA, 22 nt, Human
agcccugcggcccuccuacccg

SEQ ID NO: 1303266 - RNA, 19 nt, Human
agcugcuuugggaagaaug

SEQ ID NO: 1303267 - RNA, 20 nt, Human
agcuggggaugcccucuagg

SEQ ID NO: 1303268 - RNA, 20 nt, Human
caccucagacccaaacagac

SEQ ID NO: 1303269 - RNA, 20 nt, Human
caccuccuggcugaaagggg

SEQ ID NO: 1303270 - RNA, 22 nt, Human
cacgccgaaccacgcgcccuug

SEQ ID NO: 1303271 - RNA, 19 nt, Human
cagcccugcggcccuccua

SEQ ID NO: 1303272 - RNA, 18 nt, Human
cagcgcgccuggcacgcc

SEQ ID NO: 1303273 - RNA, 22 nt, Human
caggauagggggcgaucggucg

SEQ ID NO: 1303274 - RNA, 19 nt, Human
ccaugcaccucagacccaa

SEQ ID NO: 1303275 - RNA, 25 nt, Human
ccaugugcccgaggcuguucaccgg

SEQ ID NO: 1303276 - RNA, 18 nt, Human
ccccaggaaacuuugggg

SEQ ID NO: 1303277 - RNA, 21 nt, Human
ccgaucauacuucacuucacu

SEQ ID NO: 1303278 - RNA, 19 nt, Human
ccucuaggcuggguccugc

SEQ ID NO: 1303279 - RNA, 22 nt, Human
cgaagggagacagaagccaaga

SEQ ID NO: 1303280 - RNA, 21 nt, Human
cgcggaggccccaggaaacuu

SEQ ID NO: 1303281 - RNA, 19 nt, Human
cuccauccuggccccuggc

SEQ ID NO: 1303282 - RNA, 18 nt, Human
cuccccugggcuggcucc

SEQ ID NO: 1303283 - RNA, 24 nt, Human
cuccuccauccuggccccuggcug

SEQ ID NO: 1303284 - RNA, 23 nt, Human
cugaaaagaggcuguccgaucau

SEQ ID NO: 1303285 - RNA, 19 nt, Human
cugcggcccuccuacccgc

SEQ ID NO: 1303286 - RNA, 27 nt, Human
cugcugggcuuuuuucccuucugaggc

SEQ ID NO: 1303287 - RNA, 24 nt, Human
cuggccccuggcuguuaaggucgc

SEQ ID NO: 1303288 - RNA, 19 nt, Human
cugggcuuuuuucccuucu

SEQ ID NO: 1303289 - RNA, 26 nt, Human
cugggcuuuuuucccuucugaggcuc

SEQ ID NO: 1303290 - RNA, 22 nt, Human
gacucgccccggguccccuccg

SEQ ID NO: 1303291 - RNA, 22 nt, Human
gauauccacgcuggauuggaug

SEQ ID NO: 1303292 - RNA, 21 nt, Human
gaucauacuucacuucacagg

SEQ ID NO: 1303293 - RNA, 20 nt, Human
gcagcccugcggcccuccua

SEQ ID NO: 1303294 - RNA, 20 nt, Human
gccaaagacaaaggcccuua

SEQ ID NO: 1303295 - RNA, 20 nt, Human
gccccggguccccuccgccc

SEQ ID NO: 1303296 - RNA, 22 nt, Human
gccccggguccccuccgcccgc

SEQ ID NO: 1303297 - RNA, 24 nt, Human
gcugaaucuggccuccccugggcu

SEQ ID NO: 1303298 - RNA, 19 nt, Human
gcugggccgacugcgcccc

SEQ ID NO: 1303299 - RNA, 23 nt, Human
ggagacagggcugaggggagaga

SEQ ID NO: 1303300 - RNA, 21 nt, Human
ggccccuggcuguuacaacuu

SEQ ID NO: 1303301 - RNA, 23 nt, Human
ggcucuccuccggcgggcccucc

SEQ ID NO: 1303302 - RNA, 24 nt, Human
gggauauccacgcuggauuggaug

SEQ ID NO: 1303303 - RNA, 19 nt, Human
ggguccccuccgcccgccc

SEQ ID NO: 1303304 - RNA, 20 nt, Human
ggugugacaagaacagacac

SEQ ID NO: 1303305 - RNA, 18 nt, Human
gugacugcgaagagggcg

SEQ ID NO: 1303306 - RNA, 21 nt, Human
uaaaugugcagaucccaacug

SEQ ID NO: 1303307 - RNA, 19 nt, Human
uacauuuucccaggucccc

SEQ ID NO: 1303308 - RNA, 24 nt, Human
uacccagaauguuccaugcaccuc

SEQ ID NO: 1303309 - RNA, 18 nt, Human
uacuagucagugcugcua

SEQ ID NO: 1303310 - RNA, 23 nt, Human
uauuccaauccugugaccuuggc

SEQ ID NO: 1303311 - RNA, 19 nt, Human
ucagacccaaacagaccug

SEQ ID NO: 1303312 - RNA, 21 nt, Human
ucauguucuccuccuuuccag

SEQ ID NO: 1303313 - RNA, 18 nt, Human
uccaauccugugaccuug

SEQ ID NO: 1303314 - RNA, 23 nt, Human
uccaccuccuggcugaaaggggg

SEQ ID NO: 1303315 - RNA, 18 nt, Human
ucccagaugggcagauua

SEQ ID NO: 1303316 - RNA, 18 nt, Human
uccccugggcuggcuccc

SEQ ID NO: 1303317 - RNA, 18 nt, Human
ucccgacgucccgcugcc

SEQ ID NO: 1303318 - RNA, 23 nt, Human
ucccucaggggcaggcaaggggu

SEQ ID NO: 1303319 - RNA, 18 nt, Human
uccuacccgccaugugcc

SEQ ID NO: 1303320 - RNA, 18 nt, Human
uccucugucuccauuguc

SEQ ID NO: 1303321 - RNA, 22 nt, Human
ucuccuccuuuccagcuugaag

SEQ ID NO: 1303322 - RNA, 20 nt, Human
ugaaaagaggcuguccgauc

SEQ ID NO: 1303323 - RNA, 20 nt, Human
ugacaagaacagacacggug

SEQ ID NO: 1303324 - RNA, 20 nt, Human
ugacucgccccggguccccu

SEQ ID NO: 1303325 - RNA, 23 nt, Human
ugaggcucuugcauguccugggg

SEQ ID NO: 1303326 - RNA, 19 nt, Human
ugcagggugggaccugcug

SEQ ID NO: 1303327 - RNA, 20 nt, Human
ugcccucuaggcuggguccu

SEQ ID NO: 1303328 - RNA, 23 nt, Human
ugcuaggccaaugggccaaagac

SEQ ID NO: 1303329 - RNA, 19 nt, Human
ugcuuugggaagaauggag

SEQ ID NO: 1303330 - RNA, 23 nt, Human
uggcacgccgaaccacgcgcccu

SEQ ID NO: 1303331 - RNA, 22 nt, Human
uggccccuggcuguuacaacuu

SEQ ID NO: 1303332 - RNA, 23 nt, Human
uggcucccgacgucccgcugccu

SEQ ID NO: 1303333 - RNA, 22 nt, Human
uggcugugcagggugggaccug

SEQ ID NO: 1303334 - RNA, 21 nt, Human
ugggaccugcugucucggcca

SEQ ID NO: 1303335 - RNA, 24 nt, Human
ugggaggugauggcaagcagcggg

SEQ ID NO: 1303336 - RNA, 19 nt, Human
uguccugggguggcuuggc

SEQ ID NO: 1303337 - RNA, 22 nt, Human
ugucuggggcgagcggacaggg

SEQ ID NO: 1303338 - RNA, 19 nt, Human
ugugcagaucccaacugca

SEQ ID NO: 1303339 - RNA, 19 nt, Human
uugucauaaaagcugaaaa

SEQ ID NO: 1303340 - RNA, 22 nt, Human
uuuccagcuugaagcuggggca

SEQ ID NO: 1303341 - RNA, 22 nt, Human
ccaaugauggugugaaacucuc

SEQ ID NO: 1303342 - RNA, 23 nt, Human
ugauggugugaaacucucaguga

SEQ ID NO: 1303343 - RNA, 26 nt, Human
gaaccgagagccaggacgcgcaggga

SEQ ID NO: 1303344 - RNA, 18 nt, Human
gagcugacgcugcaggug

SEQ ID NO: 1303345 - RNA, 18 nt, Human
aagcgccgucccgggcca

SEQ ID NO: 1303346 - RNA, 21 nt, Human
acacauguaccagacagucaa

SEQ ID NO: 1303347 - RNA, 19 nt, Human
agggaggacugcucugggc

SEQ ID NO: 1303348 - RNA, 23 nt, Human
cacauguaccagacagucaagca

SEQ ID NO: 1303349 - RNA, 20 nt, Human
cagguaggacacauguacca

SEQ ID NO: 1303350 - RNA, 22 nt, Human
cccgcgcucaucuucccggagc

SEQ ID NO: 1303351 - RNA, 18 nt, Human
cucggccauggcccucgg

SEQ ID NO: 1303352 - RNA, 24 nt, Human
gcccugccuggcugcaagcgccgu

SEQ ID NO: 1303353 - RNA, 19 nt, Human
uaccagacagucaagcagg

SEQ ID NO: 1303354 - RNA, 23 nt, Human
aagguacuuuuaucaaacuucgg

SEQ ID NO: 1303355 - RNA, 18 nt, Human
ccgccccgccgcgcgccc

SEQ ID NO: 1303356 - RNA, 24 nt, Human
ccgccuccgccccgccgcgcgccc

SEQ ID NO: 1303357 - RNA, 21 nt, Human
ccgccuccgccuccgccccgc

SEQ ID NO: 1303358 - RNA, 18 nt, Human
ccgcgccgccgccgccgc

SEQ ID NO: 1303359 - RNA, 19 nt, Human
ccgcgccgccgccgccgcu

SEQ ID NO: 1303360 - RNA, 21 nt, Human
ccgcgccgccgccgccgcucu

SEQ ID NO: 1303361 - RNA, 21 nt, Human
ccgcgccgccgccgccgcucu

SEQ ID NO: 1303362 - RNA, 19 nt, Human
ccgcgcgcccucccgcugc

SEQ ID NO: 1303363 - RNA, 25 nt, Human
ccgcugccgacccgcgccgccgccg

SEQ ID NO: 1303364 - RNA, 18 nt, Human
ccucccgcugccgacccg

SEQ ID NO: 1303365 - RNA, 24 nt, Human
cuuuuaucaugucuacaguaauug

SEQ ID NO: 1303366 - RNA, 23 nt, Human
gccgacccgcgccgccgccgccg

SEQ ID NO: 1303367 - RNA, 22 nt, Human
ugccgacccgcgccgccgccgc

SEQ ID NO: 1303368 - RNA, 20 nt, Human
uucucggcgccgacuccgcc

SEQ ID NO: 1303369 - RNA, 27 nt, Human
ccaacaaagaaacauuucaaaauuaaa

SEQ ID NO: 1303370 - RNA, 22 nt, Human
ucagaguucaccucaauaucuc

SEQ ID NO: 1303371 - RNA, 19 nt, Human
uuaaaguuccaggacacuc

SEQ ID NO: 1303372 - RNA, 23 nt, Human
agccgcucggagcugcugggcuu

SEQ ID NO: 1303373 - RNA, 22 nt, Human
aggugcugcaaaccggucugcc

SEQ ID NO: 1303374 - RNA, 23 nt, Human
caagcgggaacccgcgcccgagc

SEQ ID NO: 1303375 - RNA, 21 nt, Human
cacacaccggcugagacgccc

SEQ ID NO: 1303376 - RNA, 18 nt, Human
cugaagcuccggccgcug

SEQ ID NO: 1303377 - RNA, 21 nt, Human
cugcugcuccucucggucccc

SEQ ID NO: 1303378 - RNA, 18 nt, Human
cugcugggcuuuggcggc

SEQ ID NO: 1303379 - RNA, 20 nt, Human
gaacccgcgcccgagcccgg

SEQ ID NO: 1303380 - RNA, 20 nt, Human
gcccgagcccggcgggcgcc

SEQ ID NO: 1303381 - RNA, 18 nt, Human
gccgcugcugcuccucuc

SEQ ID NO: 1303382 - RNA, 19 nt, Human
ggaacccgcgcccgagccc

SEQ ID NO: 1303383 - RNA, 18 nt, Human
ggacaggcgcccgguccc

SEQ ID NO: 1303384 - RNA, 19 nt, Human
ggacaggcgcccggucccc

SEQ ID NO: 1303385 - RNA, 20 nt, Human
ucucgguccccgguucccgg

SEQ ID NO: 1303386 - RNA, 22 nt, Human
ugagacgcccagcccacugcgg

SEQ ID NO: 1303387 - RNA, 19 nt, Human
ucaaauccuuugugcuguu

SEQ ID NO: 1303388 - RNA, 18 nt, Human
aagcagccaugguggggc

SEQ ID NO: 1303389 - RNA, 20 nt, Human
agcagccaugguggggccag

SEQ ID NO: 1303390 - RNA, 23 nt, Human
aggacaucccaguggcuuugaag

SEQ ID NO: 1303391 - RNA, 26 nt, Human
aggcaagcagccaugguggggccagg

SEQ ID NO: 1303392 - RNA, 23 nt, Human
auggagauggggagcuggucaug

SEQ ID NO: 1303393 - RNA, 22 nt, Human
ccagccagucaagacggucaau

SEQ ID NO: 1303394 - RNA, 24 nt, Human
ccaggugccuggaggacaucccag

SEQ ID NO: 1303395 - RNA, 23 nt, Human
cccaggugccuggaggacauccc

SEQ ID NO: 1303396 - RNA, 22 nt, Human
gaaacucgagcuucauaaacca

SEQ ID NO: 1303397 - RNA, 19 nt, Human
gggacccaggugccuggag

SEQ ID NO: 1303398 - RNA, 19 nt, Human
gggagcuggucaugggacc

SEQ ID NO: 1303399 - RNA, 24 nt, Human
ggggagcuggucaugggacccagg

SEQ ID NO: 1303400 - RNA, 23 nt, Human
uaaaccagugaaaugccuacccc

SEQ ID NO: 1303401 - RNA, 18 nt, Human
uaccccuauggagauggg

SEQ ID NO: 1303402 - RNA, 20 nt, Human
ugaaaugccuaccccuaugg

SEQ ID NO: 1303403 - RNA, 24 nt, Human
uggucaugggacccaggugccugg

SEQ ID NO: 1303404 - RNA, 27 nt, Human
uuuuuuuuuuuuuuuuuuuuuuugggg

SEQ ID NO: 1303405 - RNA, 19 nt, Human
cuggggcuguguccagagg

SEQ ID NO: 1303406 - RNA, 20 nt, Human
cugugcccccaugcccgggc

SEQ ID NO: 1303407 - RNA, 21 nt, Human
gaccaggcugguccuacccag

SEQ ID NO: 1303408 - RNA, 18 nt, Human
uacccagguccuggggcu

SEQ ID NO: 1303409 - RNA, 20 nt, Human
uccugaccaguggcccuggg

SEQ ID NO: 1303410 - RNA, 25 nt, Human
uccuggggcuguguccagagggugg

SEQ ID NO: 1303411 - RNA, 21 nt, Human
ugaccaguggcccuggggagg

SEQ ID NO: 1303412 - RNA, 25 nt, Human
ugcccgggcauaucgaaugcggagg

SEQ ID NO: 1303413 - RNA, 19 nt, Human
uggggcuguguccagaggg

SEQ ID NO: 1303414 - RNA, 21 nt, Human
uuaggccugugcccccaugcc

SEQ ID NO: 1303415 - RNA, 19 nt, Human
guccccaguaaauauuugc

SEQ ID NO: 1303416 - RNA, 18 nt, Human
ugcuucagcugcuucugc

SEQ ID NO: 1303417 - RNA, 20 nt, Human
aaaaccaaaggaaggcagga

SEQ ID NO: 1303418 - RNA, 18 nt, Human
aaaggaaggcaggacucu

SEQ ID NO: 1303419 - RNA, 22 nt, Human
aaaguaaaaccaaaggaaggca

SEQ ID NO: 1303420 - RNA, 18 nt, Human
aaggaaggcaggacucug

SEQ ID NO: 1303421 - RNA, 19 nt, Human
aggcaggacucugcguggc

SEQ ID NO: 1303422 - RNA, 24 nt, Human
cugaguucaaaguaaaaccaaagg

SEQ ID NO: 1303423 - RNA, 23 nt, Human
gcgacggccaccuggucuucuau

SEQ ID NO: 1303424 - RNA, 20 nt, Human
ucacuuauuccauuaggaga

SEQ ID NO: 1303425 - RNA, 18 nt, Human
uucaaaguaaaaccaaag

SEQ ID NO: 1303426 - RNA, 21 nt, Human
aaauguguuugcacaguuugg

SEQ ID NO: 1303427 - RNA, 18 nt, Human
acccacgcggcggccgcg

SEQ ID NO: 1303428 - RNA, 26 nt, Human
agacccggcgaggccccccuccgaga

SEQ ID NO: 1303429 - RNA, 26 nt, Human
agacugcagccuccccccagcccucc

SEQ ID NO: 1303430 - RNA, 18 nt, Human
agggagggggugggcagg

SEQ ID NO: 1303431 - RNA, 18 nt, Human
agggagggggugggcagg

SEQ ID NO: 1303432 - RNA, 22 nt, Human
agggagggggugggcagggagg

SEQ ID NO: 1303433 - RNA, 19 nt, Human
cagcuccucuccguccccu

SEQ ID NO: 1303434 - RNA, 27 nt, Human
caggaaggccccuggaaagcacugaag

SEQ ID NO: 1303435 - RNA, 19 nt, Human
caggaaggcccugcagcag

SEQ ID NO: 1303436 - RNA, 18 nt, Human
cagggagggggugggcag

SEQ ID NO: 1303437 - RNA, 18 nt, Human
ccccccuccgagacugca

SEQ ID NO: 1303438 - RNA, 19 nt, Human
ccgagacugcagccucccc

SEQ ID NO: 1303439 - RNA, 21 nt, Human
ccuccagacccggcgaggccc

SEQ ID NO: 1303440 - RNA, 18 nt, Human
ccuccugcagcuccucuc

SEQ ID NO: 1303441 - RNA, 19 nt, Human
ccuccugcagcuccucucc

SEQ ID NO: 1303442 - RNA, 20 nt, Human
cuacacuguaacuagcagca

SEQ ID NO: 1303443 - RNA, 20 nt, Human
cuccagacccggcgaggccc

SEQ ID NO: 1303444 - RNA, 21 nt, Human
cuccgagacugcagccucccc

SEQ ID NO: 1303445 - RNA, 20 nt, Human
cugcagccuccccccagccc

SEQ ID NO: 1303446 - RNA, 23 nt, Human
cugcagccuccccccagcccucc

SEQ ID NO: 1303447 - RNA, 20 nt, Human
gacccggcgaggccccccuc

SEQ ID NO: 1303448 - RNA, 23 nt, Human
gacugcagccuccccccagcccu

SEQ ID NO: 1303449 - RNA, 21 nt, Human
gagacugcagccuccccccag

SEQ ID NO: 1303450 - RNA, 18 nt, Human
gaucgauacggcagggag

SEQ ID NO: 1303451 - RNA, 22 nt, Human
gcagcuccucuccguccccucc

SEQ ID NO: 1303452 - RNA, 23 nt, Human
gcagggaggguccugaacacaug

SEQ ID NO: 1303453 - RNA, 19 nt, Human
gccgcgguggaggaucagg

SEQ ID NO: 1303454 - RNA, 18 nt, Human
gcggcagggggaacgggc

SEQ ID NO: 1303455 - RNA, 18 nt, Human
gcugcugggcugcugggc

SEQ ID NO: 1303456 - RNA, 22 nt, Human
gcugggcacaggaaggccccug

SEQ ID NO: 1303457 - RNA, 19 nt, Human
gcugggcugcugggccggg

SEQ ID NO: 1303458 - RNA, 20 nt, Human
ggcaggaaggcccugcagca

SEQ ID NO: 1303459 - RNA, 19 nt, Human
ggcagggaggguccugaac

SEQ ID NO: 1303460 - RNA, 24 nt, Human
ggcagggaggguccugaacacaug

SEQ ID NO: 1303461 - RNA, 19 nt, Human
uacggcagggagggggugg

SEQ ID NO: 1303462 - RNA, 23 nt, Human
uaguggccuagcuccaacucugu

SEQ ID NO: 1303463 - RNA, 26 nt, Human
uccccccagcccuccugcagcucccc

SEQ ID NO: 1303464 - RNA, 18 nt, Human
uccucuccguccccuccu

SEQ ID NO: 1303465 - RNA, 21 nt, Human
ucuguccaggcaggaaggccc

SEQ ID NO: 1303466 - RNA, 23 nt, Human
ugagaggacagacccacgcggcg

SEQ ID NO: 1303467 - RNA, 18 nt, Human
uggccuagcuccaacucu

SEQ ID NO: 1303468 - RNA, 19 nt, Human
ugucucugcuguccccucc

SEQ ID NO: 1303469 - RNA, 19 nt, Human
ugugggcugcugggcugcu

SEQ ID NO: 1303470 - RNA, 18 nt, Human
cuccaauauucuucaguu

SEQ ID NO: 1303471 - RNA, 22 nt, Human
cacauaauucccaaacuucacc

SEQ ID NO: 1303472 - RNA, 21 nt, Human
caccuccaaaucuccuuccaa

SEQ ID NO: 1303473 - RNA, 20 nt, Human
uccaaaucuccuuccaaguu

SEQ ID NO: 1303474 - RNA, 20 nt, Human
ucccaaacuucaccuccaaa

SEQ ID NO: 1303475 - RNA, 23 nt, Human
ucuguguuguuuuggcugggccu

SEQ ID NO: 1303476 - RNA, 25 nt, Human
ucuguguuguuuuggcugggccuug

SEQ ID NO: 1303477 - RNA, 23 nt, Human
uggcugggccuugcacacauucu

SEQ ID NO: 1303478 - RNA, 21 nt, Human
ugggccuugcacacauucuug

SEQ ID NO: 1303479 - RNA, 21 nt, Human
uuccaaguucuguguuguuuu

SEQ ID NO: 1303480 - RNA, 20 nt, Human
uucuguguuguuuuggcugg

SEQ ID NO: 1303481 - RNA, 19 nt, Human
uucuugucuucugaucaau

SEQ ID NO: 1303482 - RNA, 19 nt, Human
uuggcugggccuugcacac

SEQ ID NO: 1303483 - RNA, 19 nt, Human
uccugggccugucugagga

SEQ ID NO: 1303484 - RNA, 22 nt, Human
aaugucacugucccugccccac

SEQ ID NO: 1303485 - RNA, 22 nt, Human
acagacagacggagccaccaag

SEQ ID NO: 1303486 - RNA, 18 nt, Human
acccgcgggcggacggac

SEQ ID NO: 1303487 - RNA, 23 nt, Human
acccgcgggcggacggacagaca

SEQ ID NO: 1303488 - RNA, 20 nt, Human
agacagacggagccaccaag

SEQ ID NO: 1303489 - RNA, 24 nt, Human
cggacggacagacagacggagcca

SEQ ID NO: 1303490 - RNA, 21 nt, Human
ucucccauaauucugugcauc

SEQ ID NO: 1303491 - RNA, 20 nt, Human
ugggacuacagaaaugucac

SEQ ID NO: 1303492 - RNA, 20 nt, Human
ugggacuacagaaaugucac

SEQ ID NO: 1303493 - RNA, 21 nt, Human
ugggacuacagaaaugucacu

SEQ ID NO: 1303494 - RNA, 22 nt, Human
ugggacuacagaaaugucacug

SEQ ID NO: 1303495 - RNA, 22 nt, Human
caccagcccuugccccgcccac

SEQ ID NO: 1303496 - RNA, 20 nt, Human
cagagcccggcgagcucucc

SEQ ID NO: 1303497 - RNA, 18 nt, Human
ccccgcccacccuggugg

SEQ ID NO: 1303498 - RNA, 18 nt, Human
cgccucagagcccggcga

SEQ ID NO: 1303499 - RNA, 19 nt, Human
gaggaagccgcugcguucc

SEQ ID NO: 1303500 - RNA, 20 nt, Human
gcgagcucuccucagccuag

SEQ ID NO: 1303501 - RNA, 18 nt, Human
uaggaggaagccgcugcg

SEQ ID NO: 1303502 - RNA, 23 nt, Human
ucagagcccggcgagcucuccuc

SEQ ID NO: 1303503 - RNA, 18 nt, Human
uccugcgccucagagccc

SEQ ID NO: 1303504 - RNA, 18 nt, Human
ucggugauugguggagca

SEQ ID NO: 1303505 - RNA, 22 nt, Human
ugccccgcccacccugguggcu

SEQ ID NO: 1303506 - RNA, 23 nt, Human
ugccccgcccacccugguggcug

SEQ ID NO: 1303507 - RNA, 25 nt, Human
aaguacuuucuucucuuugucccug

SEQ ID NO: 1303508 - RNA, 19 nt, Human
aaugauaaggaacaggaaa

SEQ ID NO: 1303509 - RNA, 27 nt, Human
acaaugaugauaagaaguacuuucuuc

SEQ ID NO: 1303510 - RNA, 22 nt, Human
agaccuucauucuucuggauuu

SEQ ID NO: 1303511 - RNA, 23 nt, Human
aggaaaugucgcaacaaguucuc

SEQ ID NO: 1303512 - RNA, 27 nt, Human
caacaaguucuccugacaaugaggucc

SEQ ID NO: 1303513 - RNA, 20 nt, Human
caggaaaugucgcaacaagu

SEQ ID NO: 1303514 - RNA, 26 nt, Human
gaaguacuuucuucucuuugucccug

SEQ ID NO: 1303515 - RNA, 21 nt, Human
gacgguugcaaaaugaaucuc

SEQ ID NO: 1303516 - RNA, 23 nt, Human
gcaaacccgauagucaauuucca

SEQ ID NO: 1303517 - RNA, 26 nt, Human
uacuuucuucucuuugucccugcaga

SEQ ID NO: 1303518 - RNA, 24 nt, Human
ucaauuuccagcucagcuuugaua

SEQ ID NO: 1303519 - RNA, 19 nt, Human
uccaaaugauaaggaacag

SEQ ID NO: 1303520 - RNA, 23 nt, Human
aggcagggagcccugaucccauu

SEQ ID NO: 1303521 - RNA, 20 nt, Human
agggacuaggggucugggcc

SEQ ID NO: 1303522 - RNA, 24 nt, Human
aucccauugcccucccucuccccg

SEQ ID NO: 1303523 - RNA, 21 nt, Human
caaggcagggagcccugaucc

SEQ ID NO: 1303524 - RNA, 22 nt, Human
ccuaggccagggcucaacagac

SEQ ID NO: 1303525 - RNA, 20 nt, Human
cgcccaggacggccuggcag

SEQ ID NO: 1303526 - RNA, 23 nt, Human
ggccuggcaggcagauccaaguc

SEQ ID NO: 1303527 - RNA, 21 nt, Human
gucauguugcuuccugcagcg

SEQ ID NO: 1303528 - RNA, 23 nt, Human
ucccauugcccucccucuccccg

SEQ ID NO: 1303529 - RNA, 25 nt, Human
ucccauugcccucccucuccccgug

SEQ ID NO: 1303530 - RNA, 25 nt, Human
uggcaggcagauccaaguccccucu

SEQ ID NO: 1303531 - RNA, 21 nt, Human
uuccugcagcgcccaggacgg

SEQ ID NO: 1303532 - RNA, 23 nt, Human
aggcacugguagaggguggggcc

SEQ ID NO: 1303533 - RNA, 20 nt, Human
gcgguaguggaaggacuugu

SEQ ID NO: 1303534 - RNA, 20 nt, Human
gggucaggguggagaagucc

SEQ ID NO: 1303535 - RNA, 22 nt, Human
ggguggggcccuggugggaggc

SEQ ID NO: 1303536 - RNA, 22 nt, Human
gucaggguggagaaguccaggg

SEQ ID NO: 1303537 - RNA, 21 nt, Human
ugcgguaguggaaggacuugu

SEQ ID NO: 1303538 - RNA, 23 nt, Human
ugcgguaguggaaggacuuguca

SEQ ID NO: 1303539 - RNA, 22 nt, Human
uggcgcuugagcugggucaggg

SEQ ID NO: 1303540 - RNA, 19 nt, Human
ugguagaggguggggcccu

SEQ ID NO: 1303541 - RNA, 23 nt, Human
uucgugggccuugagcucgcugg

SEQ ID NO: 1303542 - RNA, 25 nt, Human
uucgugggccuugagcucgcugggg

SEQ ID NO: 1303543 - RNA, 23 nt, Human
aaaaaacaaaacaaaaacaaaaa

SEQ ID NO: 1303544 - RNA, 22 nt, Human
aaaaacaaaaaaaccuucaaag

SEQ ID NO: 1303545 - RNA, 25 nt, Human
aaaacaaaaacaaaaaaaccuucaa

SEQ ID NO: 1303546 - RNA, 21 nt, Human
aaaacaaaacaaaaacaaaaa

SEQ ID NO: 1303547 - RNA, 26 nt, Human
aaacaaaaacaaaaaaaccuucaaag

SEQ ID NO: 1303548 - RNA, 26 nt, Human
aaacaaaacaaaaacaaaaaaaccuu

SEQ ID NO: 1303549 - RNA, 24 nt, Human
aaacacaacauaggcauuaauauu

SEQ ID NO: 1303550 - RNA, 19 nt, Human
aacauggugaaaccccguc

SEQ ID NO: 1303551 - RNA, 20 nt, Human
aacauggugaaaccccgucu

SEQ ID NO: 1303552 - RNA, 21 nt, Human
aacauggugaaaccccgucuc

SEQ ID NO: 1303553 - RNA, 23 nt, Human
aagagaaaggaggcuugggugca

SEQ ID NO: 1303554 - RNA, 24 nt, Human
aagcgcuugaacccagaaggcaga

SEQ ID NO: 1303555 - RNA, 23 nt, Human
acaaaaacaaaaaaaccuucaaa

SEQ ID NO: 1303556 - RNA, 24 nt, Human
acaaaacaaaaacaaaaaaaccuu

SEQ ID NO: 1303557 - RNA, 27 nt, Human
acaaaacaaaaacaaaaaaaccuucaa

SEQ ID NO: 1303558 - RNA, 28 nt, Human
acaaaacaaaaacaaaaaaaccuucaaa

SEQ ID NO: 1303559 - RNA, 24 nt, Human
accccgucucuacuaaaaauacaa

SEQ ID NO: 1303560 - RNA, 24 nt, Human
accugaggucaggaguucgagacc

SEQ ID NO: 1303561 - RNA, 18 nt, Human
acgccacugcacuccagc

SEQ ID NO: 1303562 - RNA, 18 nt, Human
acuccagccugggagaca

SEQ ID NO: 1303563 - RNA, 18 nt, Human
acugcacuccagccuggg

SEQ ID NO: 1303564 - RNA, 18 nt, Human
acugcacuccagccuggg

SEQ ID NO: 1303565 - RNA, 27 nt, Human
acugcacuccagccugggagacaacag

SEQ ID NO: 1303566 - RNA, 20 nt, Human
agagguugcagugagccaag

SEQ ID NO: 1303567 - RNA, 23 nt, Human
agagguugcagugagccaagauc

SEQ ID NO: 1303568 - RNA, 24 nt, Human
agagguugcagugagccaagauca

SEQ ID NO: 1303569 - RNA, 20 nt, Human
agaucaacucuaauacgaaa

SEQ ID NO: 1303570 - RNA, 23 nt, Human
agccaggcgugguggcaggcgcc

SEQ ID NO: 1303571 - RNA, 22 nt, Human
agccuggccaacauggugaaac

SEQ ID NO: 1303572 - RNA, 24 nt, Human
agccuggccaacauggugaaaccc

SEQ ID NO: 1303573 - RNA, 22 nt, Human
aggcaaaagagaaaggagggac

SEQ ID NO: 1303574 - RNA, 19 nt, Human
aggcagagguugcagugag

SEQ ID NO: 1303575 - RNA, 24 nt, Human
aggcagagguugcagugagccaag

SEQ ID NO: 1303576 - RNA, 18 nt, Human
aggcaggagaagcgcuug

SEQ ID NO: 1303577 - RNA, 24 nt, Human
aggcaggagaagcgcuugaaccca

SEQ ID NO: 1303578 - RNA, 25 nt, Human
aggcaggagaagcgcuugaacccag

SEQ ID NO: 1303579 - RNA, 18 nt, Human
aggcagguggaucaccug

SEQ ID NO: 1303580 - RNA, 22 nt, Human
aggcagguggaucaccugaggu

SEQ ID NO: 1303581 - RNA, 26 nt, Human
aggcagguggaucaccugaggucagg

SEQ ID NO: 1303582 - RNA, 24 nt, Human
aggcgugguggcaggcgccuguaa

SEQ ID NO: 1303583 - RNA, 24 nt, Human
aggcugaggcaggagaagcgcuug

SEQ ID NO: 1303584 - RNA, 24 nt, Human
agugacucacgccuguaaucccag

SEQ ID NO: 1303585 - RNA, 19 nt, Human
auacaccauccauaaagaa

SEQ ID NO: 1303586 - RNA, 24 nt, Human
aucacgccacugcacuccagccug

SEQ ID NO: 1303587 - RNA, 23 nt, Human
caaaaacaaaaaaaccuucaaag

SEQ ID NO: 1303588 - RNA, 24 nt, Human
caaaacaaaaacaaaaaaaccuuc

SEQ ID NO: 1303589 - RNA, 19 nt, Human
caacagccaaacuccaucu

SEQ ID NO: 1303590 - RNA, 24 nt, Human
caacauggugaaaccccgucucua

SEQ ID NO: 1303591 - RNA, 24 nt, Human
caagaucacgccacugcacuccag

SEQ ID NO: 1303592 - RNA, 24 nt, Human
caaggcagguggaucaccugaggu

SEQ ID NO: 1303593 - RNA, 26 nt, Human
caaggcagguggaucaccugagguca

SEQ ID NO: 1303594 - RNA, 22 nt, Human
cacaguccagaaagugcuucuc

SEQ ID NO: 1303595 - RNA, 23 nt, Human
caccugaggucaggaguucgaga

SEQ ID NO: 1303596 - RNA, 24 nt, Human
cacgccuguaaucccagcacuuug

SEQ ID NO: 1303597 - RNA, 18 nt, Human
cacugcacuccagccugg

SEQ ID NO: 1303598 - RNA, 19 nt, Human
cacugcacuccagccuggg

SEQ ID NO: 1303599 - RNA, 22 nt, Human
cacugcacuccagccugggaga

SEQ ID NO: 1303600 - RNA, 25 nt, Human
cacugcacuccagccugggagacaa

SEQ ID NO: 1303601 - RNA, 25 nt, Human
cacugcacuccagccugggagacaa

SEQ ID NO: 1303602 - RNA, 21 nt, Human
cagcacuuugagaggccaagg

SEQ ID NO: 1303603 - RNA, 24 nt, Human
cagcacuuugagaggccaaggcag

SEQ ID NO: 1303604 - RNA, 24 nt, Human
cagcuacuugggaggcugaggcag

SEQ ID NO: 1303605 - RNA, 24 nt, Human
cagguggaucaccugaggucagga

SEQ ID NO: 1303606 - RNA, 24 nt, Human
caucucaaaaaacaaaacaaaaac

SEQ ID NO: 1303607 - RNA, 19 nt, Human
ccacugcacuccagccugg

SEQ ID NO: 1303608 - RNA, 20 nt, Human
ccacugcacuccagccuggg

SEQ ID NO: 1303609 - RNA, 22 nt, Human
ccacugcacuccagccugggag

SEQ ID NO: 1303610 - RNA, 24 nt, Human
ccacugcacuccagccugggagac

SEQ ID NO: 1303611 - RNA, 22 nt, Human
ccugaggucaggaguucgagac

SEQ ID NO: 1303612 - RNA, 23 nt, Human
ccuggccaacauggugaaacccc

SEQ ID NO: 1303613 - RNA, 24 nt, Human
ccuggccaacauggugaaaccccg

SEQ ID NO: 1303614 - RNA, 19 nt, Human
ccuguaaucccagcuacuu

SEQ ID NO: 1303615 - RNA, 21 nt, Human
ccuguaaucccagcuacuugg

SEQ ID NO: 1303616 - RNA, 24 nt, Human
cgagaccagccuggccaacauggu

SEQ ID NO: 1303617 - RNA, 26 nt, Human
cgccacugcacuccagccugggagac

SEQ ID NO: 1303618 - RNA, 23 nt, Human
cgccuguaaucccagcuacuugg

SEQ ID NO: 1303619 - RNA, 24 nt, Human
cgccuguaaucccagcuacuuggg

SEQ ID NO: 1303620 - RNA, 19 nt, Human
cguggcagcacucuccucc

SEQ ID NO: 1303621 - RNA, 23 nt, Human
cuaauacgaaauccaucugcaau

SEQ ID NO: 1303622 - RNA, 22 nt, Human
cucacgccuguaaucccagcac

SEQ ID NO: 1303623 - RNA, 24 nt, Human
cucacgccuguaaucccagcacuu

SEQ ID NO: 1303624 - RNA, 19 nt, Human
cucagcaggaaaagaaaaa

SEQ ID NO: 1303625 - RNA, 23 nt, Human
cuccaucucaaaaaacaaaacaa

SEQ ID NO: 1303626 - RNA, 20 nt, Human
cuuaaacacaacauaggcau

SEQ ID NO: 1303627 - RNA, 20 nt, Human
gagauuccccacaaaaaccg

SEQ ID NO: 1303628 - RNA, 18 nt, Human
gagguugcagugagccaa

SEQ ID NO: 1303629 - RNA, 21 nt, Human
gaucaccugaggucaggaguu

SEQ ID NO: 1303630 - RNA, 24 nt, Human
gaucaccugaggucaggaguucga

SEQ ID NO: 1303631 - RNA, 22 nt, Human
gcaggagaagcgcuugaaccca

SEQ ID NO: 1303632 - RNA, 24 nt, Human
gccaacauggugaaaccccgucuc

SEQ ID NO: 1303633 - RNA, 20 nt, Human
gccaagaucacgccacugca

SEQ ID NO: 1303634 - RNA, 19 nt, Human
gcuucucaauggcagauuc

SEQ ID NO: 1303635 - RNA, 21 nt, Human
ggagaagcgcuugaacccaga

SEQ ID NO: 1303636 - RNA, 21 nt, Human
ggcaggcgccuguaaucccag

SEQ ID NO: 1303637 - RNA, 24 nt, Human
gggugcagugacucacgccuguaa

SEQ ID NO: 1303638 - RNA, 24 nt, Human
gguggcaggcgccuguaaucccag

SEQ ID NO: 1303639 - RNA, 20 nt, Human
uaggcaaaagagaaaggagg

SEQ ID NO: 1303640 - RNA, 21 nt, Human
ucaaaaaacaaaacaaaaaca

SEQ ID NO: 1303641 - RNA, 20 nt, Human
ucaacacaugaauagcagac

SEQ ID NO: 1303642 - RNA, 20 nt, Human
ucaccugaggucaggaguuc

SEQ ID NO: 1303643 - RNA, 23 nt, Human
ucacgccacugcacuccagccug

SEQ ID NO: 1303644 - RNA, 24 nt, Human
ucagaugcgagaucaacucuaaua

SEQ ID NO: 1303645 - RNA, 19 nt, Human
ucagcagauaauagcacuu

SEQ ID NO: 1303646 - RNA, 21 nt, Human
ucagcagauaauagcacuuuu

SEQ ID NO: 1303647 - RNA, 20 nt, Human
uccacaguccagaaagugcu

SEQ ID NO: 1303648 - RNA, 25 nt, Human
ucucaaaaaacaaaacaaaaacaaa

SEQ ID NO: 1303649 - RNA, 24 nt, Human
ucucuacuaaaaauacaaaaaauu

SEQ ID NO: 1303650 - RNA, 21 nt, Human
ugaauaaacugagaaugugga

SEQ ID NO: 1303651 - RNA, 23 nt, Human
ugaauaaacugagaauguggaag

SEQ ID NO: 1303652 - RNA, 21 nt, Human
ugacucacgccuguaauccca

SEQ ID NO: 1303653 - RNA, 22 nt, Human
ugacucacgccuguaaucccag

SEQ ID NO: 1303654 - RNA, 24 nt, Human
ugacucacgccuguaaucccagca

SEQ ID NO: 1303655 - RNA, 24 nt, Human
ugagaggccaaggcagguggauca

SEQ ID NO: 1303656 - RNA, 24 nt, Human
ugaggcaggagaagcgcuugaacc

SEQ ID NO: 1303657 - RNA, 25 nt, Human
ugaggcaggagaagcgcuugaaccc

SEQ ID NO: 1303658 - RNA, 24 nt, Human
uggaucaccugaggucaggaguuc

SEQ ID NO: 1303659 - RNA, 27 nt, Human
uggaucaccugaggucaggaguucgag

SEQ ID NO: 1303660 - RNA, 22 nt, Human
uggcaggcgccuguaaucccag

SEQ ID NO: 1303661 - RNA, 24 nt, Human
uggccaacauggugaaaccccguc

SEQ ID NO: 1303662 - RNA, 18 nt, Human
ugggaggcugaggcagga

SEQ ID NO: 1303663 - RNA, 19 nt, Human
ugggaggcugaggcaggag

SEQ ID NO: 1303664 - RNA, 24 nt, Human
ugguggcaggcgccuguaauccca

SEQ ID NO: 1303665 - RNA, 20 nt, Human
uugcagugagccaagaucac

SEQ ID NO: 1303666 - RNA, 21 nt, Human
uugcguggcagcacucuccuc

SEQ ID NO: 1303667 - RNA, 23 nt, Human
uuuuauuagcaguacucagcagg

SEQ ID NO: 1303668 - RNA, 18 nt, Human
aaaaagcuguaugugugu

SEQ ID NO: 1303669 - RNA, 23 nt, Human
aacagguuuauuuagcucuguuc

SEQ ID NO: 1303670 - RNA, 26 nt, Human
aacauuucuuuuuuuucuuugggggc

SEQ ID NO: 1303671 - RNA, 24 nt, Human
aacucaaucaacagcgggccgcaa

SEQ ID NO: 1303672 - RNA, 19 nt, Human
aagcaggaggaaguagcug

SEQ ID NO: 1303673 - RNA, 25 nt, Human
aagcgauucuccugacccagccucc

SEQ ID NO: 1303674 - RNA, 18 nt, Human
aaguagcugggauuacag

SEQ ID NO: 1303675 - RNA, 24 nt, Human
aaguagcugggauuacagucaugc

SEQ ID NO: 1303676 - RNA, 20 nt, Human
acaauaaagauauuccugga

SEQ ID NO: 1303677 - RNA, 18 nt, Human
agcaggauggucccagga

SEQ ID NO: 1303678 - RNA, 20 nt, Human
agccacccaauccuacccaa

SEQ ID NO: 1303679 - RNA, 23 nt, Human
agcgauucuccugacccagccuc

SEQ ID NO: 1303680 - RNA, 23 nt, Human
agugcaguggcgugaucuuggcu

SEQ ID NO: 1303681 - RNA, 24 nt, Human
agugcaguggcgugaucuuggcuc

SEQ ID NO: 1303682 - RNA, 18 nt, Human
auauacagagaucucugc

SEQ ID NO: 1303683 - RNA, 20 nt, Human
augaagcugagaacacgccu

SEQ ID NO: 1303684 - RNA, 22 nt, Human
caaaccgauugaugguaaagca

SEQ ID NO: 1303685 - RNA, 23 nt, Human
caaagcagaagaauauacagaga

SEQ ID NO: 1303686 - RNA, 23 nt, Human
caaccuccaccucccaguuaaag

SEQ ID NO: 1303687 - RNA, 23 nt, Human
caaguugccagaggauuuuuagc

SEQ ID NO: 1303688 - RNA, 20 nt, Human
cacugcaaccuccaccuccc

SEQ ID NO: 1303689 - RNA, 18 nt, Human
cagcgggccgcaagguuc

SEQ ID NO: 1303690 - RNA, 22 nt, Human
caggagucaucuucccacuucc

SEQ ID NO: 1303691 - RNA, 21 nt, Human
caggauggucccaggacccaa

SEQ ID NO: 1303692 - RNA, 23 nt, Human
ccaauccuacccaaccacaguau

SEQ ID NO: 1303693 - RNA, 24 nt, Human
ccacccaauccuacccaaccacag

SEQ ID NO: 1303694 - RNA, 18 nt, Human
ccaccuaugaagcugaga

SEQ ID NO: 1303695 - RNA, 23 nt, Human
cccaaccacaguaucucuuggga

SEQ ID NO: 1303696 - RNA, 22 nt, Human
cccaaguagcugggauuacagu

SEQ ID NO: 1303697 - RNA, 25 nt, Human
cccaauccuacccaaccacaguauc

SEQ ID NO: 1303698 - RNA, 18 nt, Human
cccgccgugccucugaaa

SEQ ID NO: 1303699 - RNA, 20 nt, Human
ccgcaagguucaaggcugca

SEQ ID NO: 1303700 - RNA, 26 nt, Human
ccggugacaauaaagauauuccugga

SEQ ID NO: 1303701 - RNA, 23 nt, Human
ccucccaguuaaagcgauucucc

SEQ ID NO: 1303702 - RNA, 23 nt, Human
ccucugaaaaaugggaggugaca

SEQ ID NO: 1303703 - RNA, 23 nt, Human
ccugacccagccucccaaguagc

SEQ ID NO: 1303704 - RNA, 22 nt, Human
ccugucgauugccuggcugagg

SEQ ID NO: 1303705 - RNA, 24 nt, Human
cucacugcaaccuccaccucccag

SEQ ID NO: 1303706 - RNA, 20 nt, Human
cucgcucgcugcuucuccug

SEQ ID NO: 1303707 - RNA, 21 nt, Human
cucuucucuccuucuuugcca

SEQ ID NO: 1303708 - RNA, 22 nt, Human
cugcaaccuccaccucccaguu

SEQ ID NO: 1303709 - RNA, 21 nt, Human
cuggagacaaggaacucuguu

SEQ ID NO: 1303710 - RNA, 23 nt, Human
cuucuccuucuccuucuucuuuu

SEQ ID NO: 1303711 - RNA, 18 nt, Human
cuucucuccuucuuugcc

SEQ ID NO: 1303712 - RNA, 18 nt, Human
cuucuucuuuuugaggug

SEQ ID NO: 1303713 - RNA, 18 nt, Human
gaacucaaucaacagcgg

SEQ ID NO: 1303714 - RNA, 30 nt, Human
gaaugcaccaccuaugaagcugagaacacc

SEQ ID NO: 1303715 - RNA, 21 nt, Human
gacaguuuuucuucuggagac

SEQ ID NO: 1303716 - RNA, 20 nt, Human
gacccagccucccaaguagc

SEQ ID NO: 1303717 - RNA, 18 nt, Human
gacgggguucuaagacag

SEQ ID NO: 1303718 - RNA, 18 nt, Human
gagcuuccugcugugcuc

SEQ ID NO: 1303719 - RNA, 24 nt, Human
gauuacagucaugcaccaccaugc

SEQ ID NO: 1303720 - RNA, 23 nt, Human
gcaaagcagaagaauauacagag

SEQ ID NO: 1303721 - RNA, 24 nt, Human
gcaaagcagaagaauauacagaga

SEQ ID NO: 1303722 - RNA, 20 nt, Human
gcaaccuccaccucccaguu

SEQ ID NO: 1303723 - RNA, 18 nt, Human
gcugcugaugugggcaga

SEQ ID NO: 1303724 - RNA, 20 nt, Human
gcuugauauaagaaagauug

SEQ ID NO: 1303725 - RNA, 20 nt, Human
ggaauccaagcagggggacc

SEQ ID NO: 1303726 - RNA, 25 nt, Human
ggacccagagagauuuaucuggugg

SEQ ID NO: 1303727 - RNA, 20 nt, Human
ggagacaaggaacucuguuc

SEQ ID NO: 1303728 - RNA, 18 nt, Human
gucacacaccacugccac

SEQ ID NO: 1303729 - RNA, 18 nt, Human
gucccaggagucaucuuc

SEQ ID NO: 1303730 - RNA, 25 nt, Human
uaaauugauaagcggugguacguca

SEQ ID NO: 1303731 - RNA, 21 nt, Human
uaagacagcggaacucaauca

SEQ ID NO: 1303732 - RNA, 19 nt, Human
uagcuguggccuuaucccu

SEQ ID NO: 1303733 - RNA, 18 nt, Human
uaucaugcuagcaggacc

SEQ ID NO: 1303734 - RNA, 28 nt, Human
ucaagguaguuuaaguacaacuucuccu

SEQ ID NO: 1303735 - RNA, 20 nt, Human
ucacacaccacugccacaau

SEQ ID NO: 1303736 - RNA, 19 nt, Human
ucacugcaaccuccaccuc

SEQ ID NO: 1303737 - RNA, 23 nt, Human
ucacugcaaccuccaccucccag

SEQ ID NO: 1303738 - RNA, 24 nt, Human
ucacugcaaccuccaccucccagu

SEQ ID NO: 1303739 - RNA, 26 nt, Human
ucacugcaaccuccaccucccaguua

SEQ ID NO: 1303740 - RNA, 20 nt, Human
ucagacaggccuuuaugagc

SEQ ID NO: 1303741 - RNA, 19 nt, Human
ucagccacccaauccuacc

SEQ ID NO: 1303742 - RNA, 24 nt, Human
ucaggaauguagauaaucuccuuc

SEQ ID NO: 1303743 - RNA, 20 nt, Human
uccagaaccugaugccuuac

SEQ ID NO: 1303744 - RNA, 23 nt, Human
ucccaaguagcugggauuacagu

SEQ ID NO: 1303745 - RNA, 20 nt, Human
ucccaguuaaagcgauucuc

SEQ ID NO: 1303746 - RNA, 23 nt, Human
ucccaguuaaagcgauucuccug

SEQ ID NO: 1303747 - RNA, 21 nt, Human
ucccuuggacccuuguucagc

SEQ ID NO: 1303748 - RNA, 27 nt, Human
uccguggcuguaagagggccggggucc

SEQ ID NO: 1303749 - RNA, 18 nt, Human
ucgcucgcugcuucuccu

SEQ ID NO: 1303750 - RNA, 22 nt, Human
ucuccuagcugcauaucaugcu

SEQ ID NO: 1303751 - RNA, 18 nt, Human
ucugggaagcucugaacu

SEQ ID NO: 1303752 - RNA, 21 nt, Human
ucuucucuucucuccuucuuu

SEQ ID NO: 1303753 - RNA, 18 nt, Human
ucuucuuuuugaggugga

SEQ ID NO: 1303754 - RNA, 24 nt, Human
ucuugcucuguuucccacucugga

SEQ ID NO: 1303755 - RNA, 19 nt, Human
ucuuuuuuuucuuuccacc

SEQ ID NO: 1303756 - RNA, 24 nt, Human
ugacccagccucccaaguagcugg

SEQ ID NO: 1303757 - RNA, 22 nt, Human
ugagguggagucuugcucuguu

SEQ ID NO: 1303758 - RNA, 22 nt, Human
ugcaaagcagaagaauauacag

SEQ ID NO: 1303759 - RNA, 22 nt, Human
ugcaguggcgugaucuuggcuc

SEQ ID NO: 1303760 - RNA, 21 nt, Human
ugcaugcggaauccaagcagg

SEQ ID NO: 1303761 - RNA, 20 nt, Human
ugccuuacugaagagagcac

SEQ ID NO: 1303762 - RNA, 19 nt, Human
uggagugcaguggcgugau

SEQ ID NO: 1303763 - RNA, 23 nt, Human
uggagugcaguggcgugaucuug

SEQ ID NO: 1303764 - RNA, 24 nt, Human
uggagugcaguggcgugaucuugg

SEQ ID NO: 1303765 - RNA, 21 nt, Human
ugggauuacagucaugcacca

SEQ ID NO: 1303766 - RNA, 24 nt, Human
ugggauuacagucaugcaccacca

SEQ ID NO: 1303767 - RNA, 23 nt, Human
uguaaggcccuguggaugcaaag

SEQ ID NO: 1303768 - RNA, 22 nt, Human
ugugaagaagcagcaagaaugc

SEQ ID NO: 1303769 - RNA, 20 nt, Human
ugugaggggagaauguggca

SEQ ID NO: 1303770 - RNA, 21 nt, Human
ugugaggggagaauguggcau

SEQ ID NO: 1303771 - RNA, 20 nt, Human
ugugugugaggggagaaugu

SEQ ID NO: 1303772 - RNA, 22 nt, Human
uguuucuuuccaaugucuggcu

SEQ ID NO: 1303773 - RNA, 21 nt, Human
uguuuguuuuuuguuuuuuuu

SEQ ID NO: 1303774 - RNA, 24 nt, Human
uucccacucuggagugcaguggcg

SEQ ID NO: 1303775 - RNA, 20 nt, Human
uucccaggcuccagaaccug

SEQ ID NO: 1303776 - RNA, 19 nt, Human
uucuccugacccagccucc

SEQ ID NO: 1303777 - RNA, 25 nt, Human
uugguauucuacucagcugagcagg

SEQ ID NO: 1303778 - RNA, 20 nt, Human
uuguuuguuuguuuguuuuu

SEQ ID NO: 1303779 - RNA, 26 nt, Human
uuguuuguuuguuuuuuguuuuuuuu

SEQ ID NO: 1303780 - RNA, 23 nt, Human
uuuaucuggugaccuuucugcau

SEQ ID NO: 1303781 - RNA, 22 nt, Human
uuugagguggagucuugcucug

SEQ ID NO: 1303782 - RNA, 20 nt, Human
uuuuuguuuguuuguuuuuu

SEQ ID NO: 1303783 - RNA, 22 nt, Human
uuuuuuuguuuguuuguuuuuu

SEQ ID NO: 1303784 - RNA, 19 nt, Human
agacaguaggaggaggugg

SEQ ID NO: 1303785 - RNA, 20 nt, Human
agcacagaagacaguaggag

SEQ ID NO: 1303786 - RNA, 24 nt, Human
aggaaagggaccagaugaagagga

SEQ ID NO: 1303787 - RNA, 18 nt, Human
ccuuccucucuggggccu

SEQ ID NO: 1303788 - RNA, 21 nt, Human
gcuucuagggacaauaaccga

SEQ ID NO: 1303789 - RNA, 24 nt, Human
uaaaacucagguuccacucaacaa

SEQ ID NO: 1303790 - RNA, 18 nt, Human
uccacucaacaaggaagu

SEQ ID NO: 1303791 - RNA, 21 nt, Human
ugaagaggagcagaagauccu

SEQ ID NO: 1303792 - RNA, 20 nt, Human
ugagacacaagcagagggaa

SEQ ID NO: 1303793 - RNA, 19 nt, Human
uggaaggaaagggaccaga

SEQ ID NO: 1303794 - RNA, 25 nt, Human
cagcagcagcugcuuugccacaguu

SEQ ID NO: 1303795 - RNA, 19 nt, Human
gcagcagcagcugcuuugc

SEQ ID NO: 1303796 - RNA, 20 nt, Human
uacuggcagcagcagcugcu

SEQ ID NO: 1303797 - RNA, 21 nt, Human
ugccaugccaaacucuauuuc

SEQ ID NO: 1303798 - RNA, 22 nt, Human
cagccacagcgauguucuagcc

SEQ ID NO: 1303799 - RNA, 18 nt, Human
caggagcugauguggagg

SEQ ID NO: 1303800 - RNA, 23 nt, Human
ccucccgcgugcgcuccugcgcu

SEQ ID NO: 1303801 - RNA, 22 nt, Human
ccugcgcuuccaccagaccuua

SEQ ID NO: 1303802 - RNA, 20 nt, Human
cuccgccgcggaacucacag

SEQ ID NO: 1303803 - RNA, 19 nt, Human
cucuuuuuguuuuccaccc

SEQ ID NO: 1303804 - RNA, 21 nt, Human
ucccgcgugcgcuccugcgcu

SEQ ID NO: 1303805 - RNA, 26 nt, Human
uccgccgcggaacucacagagguugg

SEQ ID NO: 1303806 - RNA, 19 nt, Human
uucccccgccauagccucc

SEQ ID NO: 1303807 - RNA, 18 nt, Human
uuuccacccggccuggcu

SEQ ID NO: 1303808 - RNA, 23 nt, Human
uuuguuuuccacccggccuggcu

SEQ ID NO: 1303809 - RNA, 23 nt, Human
uuuucagcgccgggugagggucc

SEQ ID NO: 1303810 - RNA, 20 nt, Human
aaaaccauucaccaaagaca

SEQ ID NO: 1303811 - RNA, 21 nt, Human
aaaaggacugacuuucagaga

SEQ ID NO: 1303812 - RNA, 22 nt, Human
aaauuauacagcauuuucacaa

SEQ ID NO: 1303813 - RNA, 20 nt, Human
aacagagugagacuccaucu

SEQ ID NO: 1303814 - RNA, 22 nt, Human
aaugauggagguaaaccaagga

SEQ ID NO: 1303815 - RNA, 24 nt, Human
aauugcuugaacccgggaggcaga

SEQ ID NO: 1303816 - RNA, 22 nt, Human
acagaacacaggcuccaaacau

SEQ ID NO: 1303817 - RNA, 23 nt, Human
acagagugagacuccaucucaaa

SEQ ID NO: 1303818 - RNA, 24 nt, Human
acagagugagacuccaucucaaaa

SEQ ID NO: 1303819 - RNA, 19 nt, Human
acagcauuuucacaaaguu

SEQ ID NO: 1303820 - RNA, 21 nt, Human
acagugcagagcauuuuugaa

SEQ ID NO: 1303821 - RNA, 24 nt, Human
accuugccucuacuaaaaauacaa

SEQ ID NO: 1303822 - RNA, 24 nt, Human
acuccagccugggcaacagaguga

SEQ ID NO: 1303823 - RNA, 24 nt, Human
acugguaaaaauauacagauguua

SEQ ID NO: 1303824 - RNA, 26 nt, Human
agagcauuuuugaacugauaaacaag

SEQ ID NO: 1303825 - RNA, 24 nt, Human
agagguuucagugagccgagaucg

SEQ ID NO: 1303826 - RNA, 20 nt, Human
agccaggcaugguggugggc

SEQ ID NO: 1303827 - RNA, 24 nt, Human
agccugggcaacagagugagacuc

SEQ ID NO: 1303828 - RNA, 21 nt, Human
aggaggguggggguuuuaaaa

SEQ ID NO: 1303829 - RNA, 21 nt, Human
aggcagagguuucagugagcc

SEQ ID NO: 1303830 - RNA, 24 nt, Human
aggcagagguuucagugagccgag

SEQ ID NO: 1303831 - RNA, 23 nt, Human
aggcagggaauugcuugaacccg

SEQ ID NO: 1303832 - RNA, 18 nt, Human
aggcagguggaucacagg

SEQ ID NO: 1303833 - RNA, 19 nt, Human
aggcagguggaucacaggg

SEQ ID NO: 1303834 - RNA, 24 nt, Human
aggcagguggaucacagggucagg

SEQ ID NO: 1303835 - RNA, 24 nt, Human
aggcaugguggugggcaccuguaa

SEQ ID NO: 1303836 - RNA, 23 nt, Human
aggcugaggcagggaauugcuug

SEQ ID NO: 1303837 - RNA, 18 nt, Human
agguggaucacaggguca

SEQ ID NO: 1303838 - RNA, 24 nt, Human
agguggaucacagggucaggaguu

SEQ ID NO: 1303839 - RNA, 24 nt, Human
aguggugcacgccuguaaucccag

SEQ ID NO: 1303840 - RNA, 26 nt, Human
auaaaaccauucaccaaagacaugcu

SEQ ID NO: 1303841 - RNA, 20 nt, Human
aucacagggucaggaguucc

SEQ ID NO: 1303842 - RNA, 22 nt, Human
aucccagcacuuugggaagcca

SEQ ID NO: 1303843 - RNA, 24 nt, Human
aucgugccauugcacuccagccug

SEQ ID NO: 1303844 - RNA, 24 nt, Human
auugcacuccagccugggcaacag

SEQ ID NO: 1303845 - RNA, 25 nt, Human
caaaggucuuuuuuuuuuuuuuaag

SEQ ID NO: 1303846 - RNA, 20 nt, Human
caacagguccauaucaaaaa

SEQ ID NO: 1303847 - RNA, 25 nt, Human
caacagguccauaucaaaaaaagaa

SEQ ID NO: 1303848 - RNA, 22 nt, Human
caacaugugaagggcgucucuu

SEQ ID NO: 1303849 - RNA, 18 nt, Human
caaggaggguggggguuu

SEQ ID NO: 1303850 - RNA, 20 nt, Human
caaggcagguggaucacagg

SEQ ID NO: 1303851 - RNA, 24 nt, Human
caaggcagguggaucacaggguca

SEQ ID NO: 1303852 - RNA, 18 nt, Human
caccuguaaucccagcua

SEQ ID NO: 1303853 - RNA, 21 nt, Human
caccuguaaucccagcuauuc

SEQ ID NO: 1303854 - RNA, 22 nt, Human
cacgccuguaaucccagcacuu

SEQ ID NO: 1303855 - RNA, 24 nt, Human
cacgccuguaaucccagcacuuug

SEQ ID NO: 1303856 - RNA, 22 nt, Human
cacuccagccugggcaacagag

SEQ ID NO: 1303857 - RNA, 24 nt, Human
cacuccagccugggcaacagagug

SEQ ID NO: 1303858 - RNA, 18 nt, Human
cagaacacaggcuccaaa

SEQ ID NO: 1303859 - RNA, 19 nt, Human
cagaacacaggcuccaaac

SEQ ID NO: 1303860 - RNA, 24 nt, Human
cagcacuuugggaagccaaggcag

SEQ ID NO: 1303861 - RNA, 25 nt, Human
cagcacuuugggaagccaaggcagg

SEQ ID NO: 1303862 - RNA, 19 nt, Human
cagcaguggcuucaugaga

SEQ ID NO: 1303863 - RNA, 19 nt, Human
cagugagccgagaucgugc

SEQ ID NO: 1303864 - RNA, 20 nt, Human
cagugagccgagaucgugcc

SEQ ID NO: 1303865 - RNA, 19 nt, Human
caugccaagucguucuucc

SEQ ID NO: 1303866 - RNA, 22 nt, Human
cauucaccaaagacaugcuuaa

SEQ ID NO: 1303867 - RNA, 19 nt, Human
cauugcacuccagccuggg

SEQ ID NO: 1303868 - RNA, 21 nt, Human
cauugcacuccagccugggca

SEQ ID NO: 1303869 - RNA, 22 nt, Human
cauugcacuccagccugggcaa

SEQ ID NO: 1303870 - RNA, 24 nt, Human
cauugcacuccagccugggcaaca

SEQ ID NO: 1303871 - RNA, 23 nt, Human
ccaaagacaugcuuaauuuuuga

SEQ ID NO: 1303872 - RNA, 19 nt, Human
ccagccaggcaugguggug

SEQ ID NO: 1303873 - RNA, 20 nt, Human
ccauugcacuccagccuggg

SEQ ID NO: 1303874 - RNA, 21 nt, Human
ccauugcacuccagccugggc

SEQ ID NO: 1303875 - RNA, 22 nt, Human
ccauugcacuccagccugggca

SEQ ID NO: 1303876 - RNA, 23 nt, Human
ccauugcacuccagccugggcaa

SEQ ID NO: 1303877 - RNA, 24 nt, Human
ccauugcacuccagccugggcaac

SEQ ID NO: 1303878 - RNA, 21 nt, Human
cccagcaguggcuucaugaga

SEQ ID NO: 1303879 - RNA, 22 nt, Human
ccugggcaacagagugagacuc

SEQ ID NO: 1303880 - RNA, 22 nt, Human
ccuguaaucccagcacuuuggg

SEQ ID NO: 1303881 - RNA, 18 nt, Human
cuacuauaaauuugaauc

SEQ ID NO: 1303882 - RNA, 18 nt, Human
cucaaaaaaaaaaaaaaa

SEQ ID NO: 1303883 - RNA, 19 nt, Human
cuccaucucaaaaaaaaaa

SEQ ID NO: 1303884 - RNA, 20 nt, Human
cucuacuaaaaauacaaaaa

SEQ ID NO: 1303885 - RNA, 24 nt, Human
cuugaccaagauggugaaaccuug

SEQ ID NO: 1303886 - RNA, 23 nt, Human
gaaaaagccuaugauuuugguua

SEQ ID NO: 1303887 - RNA, 19 nt, Human
gaaaccuugccucuacuaa

SEQ ID NO: 1303888 - RNA, 23 nt, Human
gaccaagauggugaaaccuugcc

SEQ ID NO: 1303889 - RNA, 23 nt, Human
gagaucgugccauugcacuccag

SEQ ID NO: 1303890 - RNA, 19 nt, Human
gaucacaaucacagauuua

SEQ ID NO: 1303891 - RNA, 22 nt, Human
gaucacagggucaggaguucca

SEQ ID NO: 1303892 - RNA, 24 nt, Human
gaucacagggucaggaguuccaga

SEQ ID NO: 1303893 - RNA, 18 nt, Human
gcaauuaaaugcuuuucu

SEQ ID NO: 1303894 - RNA, 20 nt, Human
gcacgccuguaaucccagca

SEQ ID NO: 1303895 - RNA, 24 nt, Human
gcacuccagccugggcaacagagu

SEQ ID NO: 1303896 - RNA, 22 nt, Human
gccauugcacuccagccugggc

SEQ ID NO: 1303897 - RNA, 24 nt, Human
gccauugcacuccagccugggcaa

SEQ ID NO: 1303898 - RNA, 21 nt, Human
gcuggacucaguggugcacgc

SEQ ID NO: 1303899 - RNA, 20 nt, Human
ggagguaaaccaaggagggu

SEQ ID NO: 1303900 - RNA, 23 nt, Human
ggagguaaaccaaggaggguggg

SEQ ID NO: 1303901 - RNA, 19 nt, Human
ggcaccuguaaucccagcu

SEQ ID NO: 1303902 - RNA, 24 nt, Human
gguggugggcaccuguaaucccag

SEQ ID NO: 1303903 - RNA, 19 nt, Human
gucuagaguguauguaagg

SEQ ID NO: 1303904 - RNA, 19 nt, Human
guggaucacagggucagga

SEQ ID NO: 1303905 - RNA, 23 nt, Human
guggaucacagggucaggaguuc

SEQ ID NO: 1303906 - RNA, 22 nt, Human
guggugcacgccuguaauccca

SEQ ID NO: 1303907 - RNA, 24 nt, Human
guuuugguagaaguggucugagaa

SEQ ID NO: 1303908 - RNA, 18 nt, Human
uaaaacagacaguuaaca

SEQ ID NO: 1303909 - RNA, 23 nt, Human
uaaaacagacaguuaacauaaua

SEQ ID NO: 1303910 - RNA, 20 nt, Human
uaaaagacaaaucaaccuuc

SEQ ID NO: 1303911 - RNA, 21 nt, Human
uaacauuaugggcuucuccuc

SEQ ID NO: 1303912 - RNA, 18 nt, Human
uacugaucuaucuuaacg

SEQ ID NO: 1303913 - RNA, 25 nt, Human
uauaugcaaacagucacaauaugca

SEQ ID NO: 1303914 - RNA, 18 nt, Human
uauugaguagauaaaagg

SEQ ID NO: 1303915 - RNA, 18 nt, Human
uauuucuuacaugccaag

SEQ ID NO: 1303916 - RNA, 24 nt, Human
ucacagggucaggaguuccagacc

SEQ ID NO: 1303917 - RNA, 22 nt, Human
ucaccaaagacaugcuuaauuu

SEQ ID NO: 1303918 - RNA, 23 nt, Human
ucauuguuguuuuuuaaugaugg

SEQ ID NO: 1303919 - RNA, 23 nt, Human
uccagccugggcaacagagugag

SEQ ID NO: 1303920 - RNA, 24 nt, Human
uccagccugggcaacagagugaga

SEQ ID NO: 1303921 - RNA, 23 nt, Human
uccaucucaaaaaaaaaaaaaaa

SEQ ID NO: 1303922 - RNA, 29 nt, Human
uccaucucaaaaaaaaaaaaaaaagaaaa

SEQ ID NO: 1303923 - RNA, 23 nt, Human
ucgugccauugcacuccagccug

SEQ ID NO: 1303924 - RNA, 18 nt, Human
ucucaaaaaaaaaaaaaa

SEQ ID NO: 1303925 - RNA, 18 nt, Human
ucugaaaauaaaaccgau

SEQ ID NO: 1303926 - RNA, 26 nt, Human
ucugcaguuuacugguugacugcacu

SEQ ID NO: 1303927 - RNA, 25 nt, Human
ucuuccauucuggagaacaccucuu

SEQ ID NO: 1303928 - RNA, 18 nt, Human
ugaaaauaaaaccgauau

SEQ ID NO: 1303929 - RNA, 22 nt, Human
ugaacugauaaacaagaauaua

SEQ ID NO: 1303930 - RNA, 19 nt, Human
ugaccaagauggugaaacc

SEQ ID NO: 1303931 - RNA, 22 nt, Human
ugagaccaagugucuacuuugc

SEQ ID NO: 1303932 - RNA, 22 nt, Human
ugagccgagaucgugccauugc

SEQ ID NO: 1303933 - RNA, 23 nt, Human
ugaggcagggaauugcuugaacc

SEQ ID NO: 1303934 - RNA, 23 nt, Human
ugaggcagggaauugcuugaacc

SEQ ID NO: 1303935 - RNA, 24 nt, Human
ugaggcagggaauugcuugaaccc

SEQ ID NO: 1303936 - RNA, 22 nt, Human
ugcacuccagccugggcaacag

SEQ ID NO: 1303937 - RNA, 22 nt, Human
ugcacuccagccugggcaacag

SEQ ID NO: 1303938 - RNA, 22 nt, Human
ugccacaacauaauuaauaaac

SEQ ID NO: 1303939 - RNA, 23 nt, Human
ugccacaacauaauuaauaaaca

SEQ ID NO: 1303940 - RNA, 22 nt, Human
uggaucacagggucaggaguuc

SEQ ID NO: 1303941 - RNA, 24 nt, Human
ugggaagccaaggcagguggauca

SEQ ID NO: 1303942 - RNA, 21 nt, Human
uggugcacgccuguaauccca

SEQ ID NO: 1303943 - RNA, 22 nt, Human
uggugcacgccuguaaucccag

SEQ ID NO: 1303944 - RNA, 24 nt, Human
uggugcacgccuguaaucccagca

SEQ ID NO: 1303945 - RNA, 22 nt, Human
uggugggcaccuguaaucccag

SEQ ID NO: 1303946 - RNA, 24 nt, Human
ugguggugggcaccuguaauccca

SEQ ID NO: 1303947 - RNA, 18 nt, Human
ugucuuauauguuuuagg

SEQ ID NO: 1303948 - RNA, 19 nt, Human
uguuuugguagaagugguc

SEQ ID NO: 1303949 - RNA, 20 nt, Human
uuauacagcauuuucacaaa

SEQ ID NO: 1303950 - RNA, 22 nt, Human
uucaaaaguugacauuaucaga

SEQ ID NO: 1303951 - RNA, 27 nt, Human
uugaccaagauggugaaaccuugccuc

SEQ ID NO: 1303952 - RNA, 18 nt, Human
uugcuugaacccgggagg

SEQ ID NO: 1303953 - RNA, 24 nt, Human
uugcuugaacccgggaggcagagg

SEQ ID NO: 1303954 - RNA, 24 nt, Human
uuucacaaaguucaaugcacagaa

SEQ ID NO: 1303955 - RNA, 18 nt, Human
aacacacacaacacacac

SEQ ID NO: 1303956 - RNA, 21 nt, Human
acacaacacacacacacaaaa

SEQ ID NO: 1303957 - RNA, 29 nt, Human
acacacacacacaacccaaacacacacaa

SEQ ID NO: 1303958 - RNA, 24 nt, Human
acagagugagacucugucucaaaa

SEQ ID NO: 1303959 - RNA, 23 nt, Human
acucugucucaaaaacacacaca

SEQ ID NO: 1303960 - RNA, 19 nt, Human
acuggagugcaauggcgug

SEQ ID NO: 1303961 - RNA, 23 nt, Human
agcugggugucguggugcgugcc

SEQ ID NO: 1303962 - RNA, 23 nt, Human
aggccgggagugggguggaaggg

SEQ ID NO: 1303963 - RNA, 24 nt, Human
aggccgggagugggguggaagggu

SEQ ID NO: 1303964 - RNA, 21 nt, Human
aggccuggugucaggccggga

SEQ ID NO: 1303965 - RNA, 18 nt, Human
aggcgggaggaucaccug

SEQ ID NO: 1303966 - RNA, 20 nt, Human
agugcaauggcgugaucucg

SEQ ID NO: 1303967 - RNA, 24 nt, Human
agugcaauggcgugaucucggcuc

SEQ ID NO: 1303968 - RNA, 25 nt, Human
caaaaacacacacacacacaaccca

SEQ ID NO: 1303969 - RNA, 20 nt, Human
cacaacacacacacacaaaa

SEQ ID NO: 1303970 - RNA, 21 nt, Human
cacaacacacacacacaaaau

SEQ ID NO: 1303971 - RNA, 20 nt, Human
cacacaacccaaacacacac

SEQ ID NO: 1303972 - RNA, 22 nt, Human
cacacaacccaaacacacacaa

SEQ ID NO: 1303973 - RNA, 25 nt, Human
cacacaacccaaacacacacaacac

SEQ ID NO: 1303974 - RNA, 24 nt, Human
cacacacaaaaucagcuggguguc

SEQ ID NO: 1303975 - RNA, 21 nt, Human
cacacacaacacacacacaca

SEQ ID NO: 1303976 - RNA, 23 nt, Human
cacacacaacacacacacacaaa

SEQ ID NO: 1303977 - RNA, 23 nt, Human
cacacacaacccaaacacacaca

SEQ ID NO: 1303978 - RNA, 19 nt, Human
cacacacacacaacccaaa

SEQ ID NO: 1303979 - RNA, 21 nt, Human
cacugcaaccuccgccuccug

SEQ ID NO: 1303980 - RNA, 23 nt, Human
cacugcaaccuccgccuccuggg

SEQ ID NO: 1303981 - RNA, 25 nt, Human
cccaaacacacacaacacacacaca

SEQ ID NO: 1303982 - RNA, 20 nt, Human
ccgggagugggguggaaggg

SEQ ID NO: 1303983 - RNA, 19 nt, Human
ccuccgccuccugggugac

SEQ ID NO: 1303984 - RNA, 22 nt, Human
ccugggugacagagugagacuc

SEQ ID NO: 1303985 - RNA, 21 nt, Human
ccuguagugccagcuacuugg

SEQ ID NO: 1303986 - RNA, 22 nt, Human
ccuguagugccagcuacuuggg

SEQ ID NO: 1303987 - RNA, 20 nt, Human
ccugucucagcaugaugccc

SEQ ID NO: 1303988 - RNA, 27 nt, Human
cucaaaaacacacacacacacaaccca

SEQ ID NO: 1303989 - RNA, 24 nt, Human
cucacugcaaccuccgccuccugg

SEQ ID NO: 1303990 - RNA, 22 nt, Human
cugcaaccuccgccuccugggu

SEQ ID NO: 1303991 - RNA, 23 nt, Human
cugcugccgcucucguaagcagc

SEQ ID NO: 1303992 - RNA, 19 nt, Human
cugucucagcaugaugccc

SEQ ID NO: 1303993 - RNA, 20 nt, Human
cugucucagcaugaugcccc

SEQ ID NO: 1303994 - RNA, 24 nt, Human
gacagagugagacucugucucaaa

SEQ ID NO: 1303995 - RNA, 19 nt, Human
gaucaccugaacccaggaa

SEQ ID NO: 1303996 - RNA, 20 nt, Human
gaucaccugaacccaggaag

SEQ ID NO: 1303997 - RNA, 24 nt, Human
gcccaaacuggagugcaauggcgu

SEQ ID NO: 1303998 - RNA, 23 nt, Human
gccuccugggugacagagugaga

SEQ ID NO: 1303999 - RNA, 27 nt, Human
gcucccugcugcugccgcucucguaag

SEQ ID NO: 1304000 - RNA, 20 nt, Human
gcucucguaagcagcaagcu

SEQ ID NO: 1304001 - RNA, 21 nt, Human
gcucuuguugcccaaacugga

SEQ ID NO: 1304002 - RNA, 24 nt, Human
gugacagagugagacucugucuca

SEQ ID NO: 1304003 - RNA, 18 nt, Human
guggugcgugccuguagu

SEQ ID NO: 1304004 - RNA, 22 nt, Human
guggugcgugccuguagugcca

SEQ ID NO: 1304005 - RNA, 23 nt, Human
ucaaaaacacacacacacacaac

SEQ ID NO: 1304006 - RNA, 23 nt, Human
ucacugcaaccuccgccuccugg

SEQ ID NO: 1304007 - RNA, 24 nt, Human
ucacugcaaccuccgccuccuggg

SEQ ID NO: 1304008 - RNA, 25 nt, Human
ucacugcaaccuccgccuccugggu

SEQ ID NO: 1304009 - RNA, 20 nt, Human
ucagcugggugucguggugc

SEQ ID NO: 1304010 - RNA, 22 nt, Human
ucagcugggugucguggugcga

SEQ ID NO: 1304011 - RNA, 18 nt, Human
ucccaaaauggauggaag

SEQ ID NO: 1304012 - RNA, 21 nt, Human
uccgccuccugggugacagag

SEQ ID NO: 1304013 - RNA, 23 nt, Human
uccgccuccugggugacagagug

SEQ ID NO: 1304014 - RNA, 19 nt, Human
ugagaagagcuagcccagc

SEQ ID NO: 1304015 - RNA, 21 nt, Human
ugagaagagcuagcccagcug

SEQ ID NO: 1304016 - RNA, 23 nt, Human
ugagacagaguuuugcucuuguu

SEQ ID NO: 1304017 - RNA, 20 nt, Human
ugaggcgggaggaucaccug

SEQ ID NO: 1304018 - RNA, 21 nt, Human
ugaggcgggaggaucaccuga

SEQ ID NO: 1304019 - RNA, 24 nt, Human
ugaggcgggaggaucaccugaacc

SEQ ID NO: 1304020 - RNA, 21 nt, Human
ugcccaaacuggagugcaaug

SEQ ID NO: 1304021 - RNA, 23 nt, Human
ugccuguagugccagcuacuugg

SEQ ID NO: 1304022 - RNA, 24 nt, Human
ugccuguagugccagcuacuuggg

SEQ ID NO: 1304023 - RNA, 18 nt, Human
uggaagggccccaaaaug

SEQ ID NO: 1304024 - RNA, 18 nt, Human
uggaagggucccaaaaug

SEQ ID NO: 1304025 - RNA, 19 nt, Human
uggagugcaauggcgugau

SEQ ID NO: 1304026 - RNA, 23 nt, Human
uggagugcaauggcgugaucucg

SEQ ID NO: 1304027 - RNA, 24 nt, Human
uggagugcaauggcgugaucucgg

SEQ ID NO: 1304028 - RNA, 20 nt, Human
uggcgugaucucggcucacu

SEQ ID NO: 1304029 - RNA, 19 nt, Human
uggcucuccugucucagca

SEQ ID NO: 1304030 - RNA, 24 nt, Human
uggcugaggcgggaggaucaccug

SEQ ID NO: 1304031 - RNA, 22 nt, Human
ugggguggaagggucccaaaau

SEQ ID NO: 1304032 - RNA, 21 nt, Human
ugggugacagagugagacucu

SEQ ID NO: 1304033 - RNA, 18 nt, Human
uggguggcugaggcggga

SEQ ID NO: 1304034 - RNA, 24 nt, Human
uggguggcugaggcgggaggauca

SEQ ID NO: 1304035 - RNA, 24 nt, Human
uggugcgugccuguagugccagcu

SEQ ID NO: 1304036 - RNA, 21 nt, Human
uggugucaggccgggaguggg

SEQ ID NO: 1304037 - RNA, 20 nt, Human
uguugcccaaacuggagugc

SEQ ID NO: 1304038 - RNA, 23 nt, Human
uuaacauauuuuuuccuacaggg

SEQ ID NO: 1304039 - RNA, 23 nt, Human
uugcucuuguugcccaaacugga

SEQ ID NO: 1304040 - RNA, 25 nt, Human
uuggguggcugaggcgggaggauca

SEQ ID NO: 1304041 - RNA, 23 nt, Human
uuguugcccaaacuggagugcaa

SEQ ID NO: 1304042 - RNA, 24 nt, Human
uuugcucuuguugcccaaacugga

SEQ ID NO: 1304043 - RNA, 24 nt, Human
uuuugcucuuguugcccaaacugg

SEQ ID NO: 1304044 - RNA, 23 nt, Human
aaaaggacaaauauuuagccaga

SEQ ID NO: 1304045 - RNA, 22 nt, Human
aaagaaaugaggcagaaaguau

SEQ ID NO: 1304046 - RNA, 23 nt, Human
aaagaaaugaggcagaaaguauc

SEQ ID NO: 1304047 - RNA, 24 nt, Human
aaagaaaugaggcagaaaguaucu

SEQ ID NO: 1304048 - RNA, 21 nt, Human
aacaaaaagccacuuuugacc

SEQ ID NO: 1304049 - RNA, 19 nt, Human
aacaaaaggaccagcuaaa

SEQ ID NO: 1304050 - RNA, 19 nt, Human
aagccacuuuugaccaauu

SEQ ID NO: 1304051 - RNA, 21 nt, Human
aagccugcuacugcccccuga

SEQ ID NO: 1304052 - RNA, 21 nt, Human
acaaaaagccacuuuugacca

SEQ ID NO: 1304053 - RNA, 22 nt, Human
acagacagcaugauaccugagc

SEQ ID NO: 1304054 - RNA, 20 nt, Human
acauagccagucuuuccccu

SEQ ID NO: 1304055 - RNA, 21 nt, Human
accaauugcucccuacauaga

SEQ ID NO: 1304056 - RNA, 25 nt, Human
accaggcaaauuuaugcagugcguu

SEQ ID NO: 1304057 - RNA, 21 nt, Human
agacagcaugauaccugagca

SEQ ID NO: 1304058 - RNA, 19 nt, Human
agauggaggcgaauuugga

SEQ ID NO: 1304059 - RNA, 18 nt, Human
agcaaauaaaucaacuac

SEQ ID NO: 1304060 - RNA, 18 nt, Human
agccugcuacugcccccu

SEQ ID NO: 1304061 - RNA, 24 nt, Human
aucaucuccuuaucaauacagccc

SEQ ID NO: 1304062 - RNA, 23 nt, Human
caaaaggaccagcuaaaaugaca

SEQ ID NO: 1304063 - RNA, 21 nt, Human
caaagcaucuuugucuucccg

SEQ ID NO: 1304064 - RNA, 23 nt, Human
caaagccugcuacugcccccuga

SEQ ID NO: 1304065 - RNA, 27 nt, Human
caaauaaaucaacuaccaugaucagaa

SEQ ID NO: 1304066 - RNA, 22 nt, Human
caacuaccaugaucagaagggc

SEQ ID NO: 1304067 - RNA, 21 nt, Human
caccgagcccacuaggccucc

SEQ ID NO: 1304068 - RNA, 24 nt, Human
cagcuaaaaugacauuaacugaua

SEQ ID NO: 1304069 - RNA, 21 nt, Human
caucuccuuaucaauacagcc

SEQ ID NO: 1304070 - RNA, 19 nt, Human
cauuuuguuuuuccugcuu

SEQ ID NO: 1304071 - RNA, 26 nt, Human
ccacgcaccgagcccacuaggccucc

SEQ ID NO: 1304072 - RNA, 19 nt, Human
ccacugccgucaucgccgc

SEQ ID NO: 1304073 - RNA, 19 nt, Human
ccagaaaagaaaugaggca

SEQ ID NO: 1304074 - RNA, 24 nt, Human
ccccgaaaaaucucaugaacccac

SEQ ID NO: 1304075 - RNA, 20 nt, Human
ccccgagccgccgccgaccc

SEQ ID NO: 1304076 - RNA, 23 nt, Human
ccccugagcuuccugcauuucuc

SEQ ID NO: 1304077 - RNA, 19 nt, Human
ccccuuguggaaacaaaaa

SEQ ID NO: 1304078 - RNA, 22 nt, Human
ccgagcccacuaggccuccacu

SEQ ID NO: 1304079 - RNA, 24 nt, Human
ccugagcaaauaaaucaacuacca

SEQ ID NO: 1304080 - RNA, 19 nt, Human
ccugcuacugcccccugag

SEQ ID NO: 1304081 - RNA, 19 nt, Human
cgccuuaaaaauagaaaca

SEQ ID NO: 1304082 - RNA, 20 nt, Human
cggaaacuguucuggaccaa

SEQ ID NO: 1304083 - RNA, 22 nt, Human
cggagccgggcgggggaggacg

SEQ ID NO: 1304084 - RNA, 19 nt, Human
cggcuccucagguacuccc

SEQ ID NO: 1304085 - RNA, 21 nt, Human
cgggagccgggccccccgcuu

SEQ ID NO: 1304086 - RNA, 21 nt, Human
cguagcccgcggguggacccc

SEQ ID NO: 1304087 - RNA, 19 nt, Human
cuccucagguacucccggc

SEQ ID NO: 1304088 - RNA, 18 nt, Human
cuccuuaucaauacagcc

SEQ ID NO: 1304089 - RNA, 21 nt, Human
cugaguggcuaugcuguggaa

SEQ ID NO: 1304090 - RNA, 22 nt, Human
cuuaaaaauagaaacaaaagga

SEQ ID NO: 1304091 - RNA, 21 nt, Human
gaaaauaacugauuuagaagc

SEQ ID NO: 1304092 - RNA, 21 nt, Human
gacugucauuaggauuuccau

SEQ ID NO: 1304093 - RNA, 20 nt, Human
gauucuuucuacugcacccc

SEQ ID NO: 1304094 - RNA, 18 nt, Human
gcaaagcaucuuugucuu

SEQ ID NO: 1304095 - RNA, 18 nt, Human
gcaccgagcccacuaggc

SEQ ID NO: 1304096 - RNA, 23 nt, Human
gccgacccacgcaccgagcccac

SEQ ID NO: 1304097 - RNA, 18 nt, Human
ggagccgggccccccgcu

SEQ ID NO: 1304098 - RNA, 22 nt, Human
ggcaucuuguugcauguaguug

SEQ ID NO: 1304099 - RNA, 19 nt, Human
guggcggagccgggcgggg

SEQ ID NO: 1304100 - RNA, 21 nt, Human
uaaaaauagaaacaaaaggac

SEQ ID NO: 1304101 - RNA, 20 nt, Human
uaaaaugacauuaacugaua

SEQ ID NO: 1304102 - RNA, 20 nt, Human
uccaaaauaaccagaaaaga

SEQ ID NO: 1304103 - RNA, 23 nt, Human
ucccaaaauugacuaauccaaaa

SEQ ID NO: 1304104 - RNA, 19 nt, Human
uccccgaaaaaucucauga

SEQ ID NO: 1304105 - RNA, 20 nt, Human
ucuaaaaaaucuccaucuuu

SEQ ID NO: 1304106 - RNA, 24 nt, Human
ugagcuuccugcauuucucuuuuc

SEQ ID NO: 1304107 - RNA, 22 nt, Human
ugcaaagccugcuacugccccc

SEQ ID NO: 1304108 - RNA, 22 nt, Human
ugcaauuagcaaagaggaaaug

SEQ ID NO: 1304109 - RNA, 20 nt, Human
uggaagagaucugcuaagca

SEQ ID NO: 1304110 - RNA, 21 nt, Human
uggaaggcuguuuuacaagag

SEQ ID NO: 1304111 - RNA, 23 nt, Human
uggauuaucuagcauguuaguuu

SEQ ID NO: 1304112 - RNA, 22 nt, Human
uuagcgaccauuuuguuuuucc

SEQ ID NO: 1304113 - RNA, 27 nt, Human
uucaaagcauuauuggugcaauuagca

SEQ ID NO: 1304114 - RNA, 20 nt, Human
uucaccuccuuguuguaugg

SEQ ID NO: 1304115 - RNA, 21 nt, Human
uuccuagguugacucuuauau

SEQ ID NO: 1304116 - RNA, 23 nt, Human
uuccugcauuucucuuuucuuga

SEQ ID NO: 1304117 - RNA, 22 nt, Human
uuggugcaauuagcaaagagga

SEQ ID NO: 1304118 - RNA, 20 nt, Human
uugugugcuuccuguuugcu

SEQ ID NO: 1304119 - RNA, 23 nt, Human
uuucuugaaaaaucagugcuuga

SEQ ID NO: 1304120 - RNA, 18 nt, Human
uuuuuccugcuuucucuc

SEQ ID NO: 1304121 - RNA, 26 nt, Human
caguagaaauggaaucagaaaacaua

SEQ ID NO: 1304122 - RNA, 25 nt, Human
cuaaauguguggaaaacugcagaca

SEQ ID NO: 1304123 - RNA, 22 nt, Human
ucagaaaacauauuaacuuuag

SEQ ID NO: 1304124 - RNA, 21 nt, Human
uucaucugaaacauugauugu

SEQ ID NO: 1304125 - RNA, 20 nt, Human
aaaaggaacagggaaguugc

SEQ ID NO: 1304126 - RNA, 22 nt, Human
agcagagugcaggacaguccag

SEQ ID NO: 1304127 - RNA, 22 nt, Human
aggaacaguuggaaagccaaag

SEQ ID NO: 1304128 - RNA, 26 nt, Human
aggaacaguuggaaagccaaagagac

SEQ ID NO: 1304129 - RNA, 18 nt, Human
aggagccgcgcuccccgc

SEQ ID NO: 1304130 - RNA, 19 nt, Human
agggaaccccggaaggagc

SEQ ID NO: 1304131 - RNA, 21 nt, Human
caaacugcagagcccaggcaa

SEQ ID NO: 1304132 - RNA, 21 nt, Human
cacggucgccugugcccgggc

SEQ ID NO: 1304133 - RNA, 19 nt, Human
cacuaaaguugagcagagu

SEQ ID NO: 1304134 - RNA, 18 nt, Human
cccgcccuccaguaaggc

SEQ ID NO: 1304135 - RNA, 19 nt, Human
ccgcgccaguuaauggcug

SEQ ID NO: 1304136 - RNA, 23 nt, Human
ccugugcccgggcaccccggagc

SEQ ID NO: 1304137 - RNA, 21 nt, Human
cgugcggugcucccacauccu

SEQ ID NO: 1304138 - RNA, 21 nt, Human
cuacccggaggcgcugggcgg

SEQ ID NO: 1304139 - RNA, 19 nt, Human
cuccacggucgccugugcc

SEQ ID NO: 1304140 - RNA, 22 nt, Human
cugggcugugcgccccgccggc

SEQ ID NO: 1304141 - RNA, 22 nt, Human
cuuugguucccacccgcccucc

SEQ ID NO: 1304142 - RNA, 26 nt, Human
gagcaaagcaacguuuaugaaaagga

SEQ ID NO: 1304143 - RNA, 20 nt, Human
gcaaccgcugggcugugcgc

SEQ ID NO: 1304144 - RNA, 22 nt, Human
gccggcgccgguaggagccgcg

SEQ ID NO: 1304145 - RNA, 23 nt, Human
gccggcgccgguaggagccgcgc

SEQ ID NO: 1304146 - RNA, 21 nt, Human
gcugugcgccccgccggcgcc

SEQ ID NO: 1304147 - RNA, 21 nt, Human
ggaacagggaaguugcaugga

SEQ ID NO: 1304148 - RNA, 22 nt, Human
uccucugagagcaagaggcaga

SEQ ID NO: 1304149 - RNA, 19 nt, Human
uccuggccucuccucucca

SEQ ID NO: 1304150 - RNA, 23 nt, Human
ugagagcaagaggcagauggugc

SEQ ID NO: 1304151 - RNA, 20 nt, Human
ugagaggaggaaaacugaga

SEQ ID NO: 1304152 - RNA, 24 nt, Human
uggaguaaacucuacugagaggag

SEQ ID NO: 1304153 - RNA, 19 nt, Human
cagaauuggaacagaagca

SEQ ID NO: 1304154 - RNA, 19 nt, Human
cauuuaaaaaaucucuaaa

SEQ ID NO: 1304155 - RNA, 21 nt, Human
cucacauuuauaucaauuuuu

SEQ ID NO: 1304156 - RNA, 20 nt, Human
ucagaauuggaacagaagca

SEQ ID NO: 1304157 - RNA, 24 nt, Human
uuaaaaaaucucuaaaucucuuua

SEQ ID NO: 1304158 - RNA, 22 nt, Human
aucagcuuccuuugaugauaac

SEQ ID NO: 1304159 - RNA, 21 nt, Human
cgguugcuauuaaauuccuuc

SEQ ID NO: 1304160 - RNA, 23 nt, Human
uaacuugcaauuucaauacuccg

SEQ ID NO: 1304161 - RNA, 21 nt, Human
ugccagaaaaaugugcuauga

SEQ ID NO: 1304162 - RNA, 22 nt, Human
uucaaguguucuucaaucucag

SEQ ID NO: 1304163 - RNA, 19 nt, Human
aaauagccuguguguaaag

SEQ ID NO: 1304164 - RNA, 27 nt, Human
cacagaauacaaacucagacccuuuga

SEQ ID NO: 1304165 - RNA, 27 nt, Human
cgagcucuuccacucgucucaccacac

SEQ ID NO: 1304166 - RNA, 23 nt, Human
guacaacaaagacagcuuuuuga

SEQ ID NO: 1304167 - RNA, 22 nt, Human
gucucaccacacuagagacugc

SEQ ID NO: 1304168 - RNA, 20 nt, Human
uaaguugcuguaugugggcc

SEQ ID NO: 1304169 - RNA, 20 nt, Human
uauuuaugauuacccagcua

SEQ ID NO: 1304170 - RNA, 19 nt, Human
ucagacccuuugauccacu

SEQ ID NO: 1304171 - RNA, 21 nt, Human
uccacacaggaguuucaauuu

SEQ ID NO: 1304172 - RNA, 19 nt, Human
ucuuccacucgucucacca

SEQ ID NO: 1304173 - RNA, 21 nt, Human
uuaguaguacaacaaagacag

SEQ ID NO: 1304174 - RNA, 28 nt, Human
uuaguaguacaacaaagacagcuuuuuu

SEQ ID NO: 1304175 - RNA, 20 nt, Human
uucaccggcagcuucgcuaa

SEQ ID NO: 1304176 - RNA, 28 nt, Human
aaacagagagagagcacggcauaccugg

SEQ ID NO: 1304177 - RNA, 18 nt, Human
accagcacugugcccauc

SEQ ID NO: 1304178 - RNA, 22 nt, Human
accuccaacuccaguaggccac

SEQ ID NO: 1304179 - RNA, 27 nt, Human
agagcacggcauaccugggcacaccag

SEQ ID NO: 1304180 - RNA, 19 nt, Human
aggcacugaauuuuuuuuu

SEQ ID NO: 1304181 - RNA, 24 nt, Human
aguauucagggcaaaaucuaugca

SEQ ID NO: 1304182 - RNA, 20 nt, Human
augagguaaagacccgaaac

SEQ ID NO: 1304183 - RNA, 18 nt, Human
auugcuauaacucuuagg

SEQ ID NO: 1304184 - RNA, 24 nt, Human
caaaaauagauucagucucuccuu

SEQ ID NO: 1304185 - RNA, 23 nt, Human
caaaucccaaaauacucugggag

SEQ ID NO: 1304186 - RNA, 21 nt, Human
caccacuggaaacagagagag

SEQ ID NO: 1304187 - RNA, 22 nt, Human
caccacuggaaacagagagaga

SEQ ID NO: 1304188 - RNA, 26 nt, Human
cacuggaaacagagagagagcacggc

SEQ ID NO: 1304189 - RNA, 21 nt, Human
cauguuguucaaaucccaaaa

SEQ ID NO: 1304190 - RNA, 21 nt, Human
ccagaaccagcacugugccca

SEQ ID NO: 1304191 - RNA, 19 nt, Human
cugugagaccuccaacucc

SEQ ID NO: 1304192 - RNA, 23 nt, Human
gaaaauaaauccuuuuucaugga

SEQ ID NO: 1304193 - RNA, 20 nt, Human
gccuuaaaauuaccaccacu

SEQ ID NO: 1304194 - RNA, 22 nt, Human
ggagauaggggccaaaaaaaga

SEQ ID NO: 1304195 - RNA, 24 nt, Human
ggccuuaaaauuaccaccacugga

SEQ ID NO: 1304196 - RNA, 21 nt, Human
uaaccauguuguucaaauccc

SEQ ID NO: 1304197 - RNA, 22 nt, Human
uaaucaaaauaggauuuuuaca

SEQ ID NO: 1304198 - RNA, 23 nt, Human
uacuuuuagcuucaggauuaacc

SEQ ID NO: 1304199 - RNA, 19 nt, Human
ucucuucuccccagggagc

SEQ ID NO: 1304200 - RNA, 30 nt, Human
ucuucuggugcugcugugagaccuccaacu

SEQ ID NO: 1304201 - RNA, 18 nt, Human
ugaauauucucuucuccc

SEQ ID NO: 1304202 - RNA, 20 nt, Human
ugagaaggauuagcauaaua

SEQ ID NO: 1304203 - RNA, 18 nt, Human
ugagguaaagacccgaaa

SEQ ID NO: 1304204 - RNA, 18 nt, Human
uuaccaccacuggaaaca

SEQ ID NO: 1304205 - RNA, 19 nt, Human
uuccagaaccagcacugug

SEQ ID NO: 1304206 - RNA, 21 nt, Human
aagaagccggaguugaaggcg

SEQ ID NO: 1304207 - RNA, 18 nt, Human
aagcaaagggcgaggagc

SEQ ID NO: 1304208 - RNA, 21 nt, Human
aggacggggcggauuaggggu

SEQ ID NO: 1304209 - RNA, 22 nt, Human
aggggcucacgccugaucucgg

SEQ ID NO: 1304210 - RNA, 19 nt, Human
agugcggggacagccaggu

SEQ ID NO: 1304211 - RNA, 19 nt, Human
caacccgaagaaaucgccc

SEQ ID NO: 1304212 - RNA, 19 nt, Human
cagagguaagcuguacccc

SEQ ID NO: 1304213 - RNA, 21 nt, Human
cccgaagaaaucgcccucuuu

SEQ ID NO: 1304214 - RNA, 21 nt, Human
ccgcuucuccccacacagauc

SEQ ID NO: 1304215 - RNA, 19 nt, Human
cucacgccugaucucggac

SEQ ID NO: 1304216 - RNA, 19 nt, Human
gagugcggggacagccagg

SEQ ID NO: 1304217 - RNA, 20 nt, Human
gaguugaaggcgcgaacgca

SEQ ID NO: 1304218 - RNA, 20 nt, Human
gcauccucgccuucgggaga

SEQ ID NO: 1304219 - RNA, 25 nt, Human
gggcgaggagcccccgcuggcagcc

SEQ ID NO: 1304220 - RNA, 23 nt, Human
ggggaacugaagaagccggaguu

SEQ ID NO: 1304221 - RNA, 19 nt, Human
uaaggcagggaccucgagc

SEQ ID NO: 1304222 - RNA, 19 nt, Human
uagcuccccagggaggggc

SEQ ID NO: 1304223 - RNA, 24 nt, Human
uaggggucuggcagggugggaggg

SEQ ID NO: 1304224 - RNA, 25 nt, Human
ucggagugcggggacagccaggugu

SEQ ID NO: 1304225 - RNA, 21 nt, Human
uggcauccucgccuucgggag

SEQ ID NO: 1304226 - RNA, 19 nt, Human
ugggaggggcucacgccug

SEQ ID NO: 1304227 - RNA, 24 nt, Human
ugguugaguggagcugaguccuuu

SEQ ID NO: 1304228 - RNA, 20 nt, Human
uguaccccggauuguggcau

SEQ ID NO: 1304229 - RNA, 22 nt, Human
uuguggcauccucgccuucggg

SEQ ID NO: 1304230 - RNA, 24 nt, Human
aaaagacagaaaacaaaaaugagc

SEQ ID NO: 1304231 - RNA, 24 nt, Human
aacaaaaaugagcuuuaaguaaac

SEQ ID NO: 1304232 - RNA, 20 nt, Human
aaggaauauaccaaaagagc

SEQ ID NO: 1304233 - RNA, 25 nt, Human
aaugagcuuuaaguaaacaaaacua

SEQ ID NO: 1304234 - RNA, 24 nt, Human
acagaaaacaaaaaugagcuuuaa

SEQ ID NO: 1304235 - RNA, 18 nt, Human
acuuuuauccugaacugg

SEQ ID NO: 1304236 - RNA, 25 nt, Human
agaaaaagaaaaauguuggauaaaa

SEQ ID NO: 1304237 - RNA, 28 nt, Human
agacagaaaacaaaaaugaggggacccc

SEQ ID NO: 1304238 - RNA, 20 nt, Human
augccuucauacauaucuug

SEQ ID NO: 1304239 - RNA, 20 nt, Human
auuccauugucucuuccccu

SEQ ID NO: 1304240 - RNA, 23 nt, Human
auuccauugucucuuccccucca

SEQ ID NO: 1304241 - RNA, 22 nt, Human
caagugacauacaaagagaaug

SEQ ID NO: 1304242 - RNA, 28 nt, Human
cagcaaacuuuuauccugaacuggguuc

SEQ ID NO: 1304243 - RNA, 20 nt, Human
cagguaggaaaaaaaauguu

SEQ ID NO: 1304244 - RNA, 23 nt, Human
caguaaauagaagccauuucugu

SEQ ID NO: 1304245 - RNA, 21 nt, Human
cuauaagauaacaauguccaa

SEQ ID NO: 1304246 - RNA, 21 nt, Human
cucaggaauaaaaucaucucc

SEQ ID NO: 1304247 - RNA, 22 nt, Human
gaaaaaauauuuacacagauua

SEQ ID NO: 1304248 - RNA, 20 nt, Human
gaauaaucagaauugaccug

SEQ ID NO: 1304249 - RNA, 19 nt, Human
uaaauagaagccauuucug

SEQ ID NO: 1304250 - RNA, 21 nt, Human
uaacaaacuauaagauaacaa

SEQ ID NO: 1304251 - RNA, 24 nt, Human
uaacaauguccaaaauuugaaacc

SEQ ID NO: 1304252 - RNA, 19 nt, Human
ucagagggauagaucauuc

SEQ ID NO: 1304253 - RNA, 19 nt, Human
uccaagugacauacaaaga

SEQ ID NO: 1304254 - RNA, 21 nt, Human
uccauugucucuuccccucca

SEQ ID NO: 1304255 - RNA, 18 nt, Human
ucuccuggcagcaaacuu

SEQ ID NO: 1304256 - RNA, 28 nt, Human
ucuccuggcagcaaacuuuuauccugag

SEQ ID NO: 1304257 - RNA, 23 nt, Human
ucucuuccccuccacucucucaa

SEQ ID NO: 1304258 - RNA, 28 nt, Human
ugaaaaauauaauccaagugacauacaa

SEQ ID NO: 1304259 - RNA, 23 nt, Human
uggauaaaaccuuaaaaguagaa

SEQ ID NO: 1304260 - RNA, 21 nt, Human
uggcagcaaacuuuuauccug

SEQ ID NO: 1304261 - RNA, 23 nt, Human
uucuucuuuacaucaagccuuaa

SEQ ID NO: 1304262 - RNA, 22 nt, Human
uuuaaaauaaauauuaucagag

SEQ ID NO: 1304263 - RNA, 20 nt, Human
uuuaaguaaacaaaacuaca

SEQ ID NO: 1304264 - RNA, 26 nt, Human
aaaacagaaugaaaauugugaggccc

SEQ ID NO: 1304265 - RNA, 26 nt, Human
aaacagaaugaaaauugugaggccca

SEQ ID NO: 1304266 - RNA, 22 nt, Human
aagcauacagucagaauaagcc

SEQ ID NO: 1304267 - RNA, 18 nt, Human
agaaaacagaaugaaaau

SEQ ID NO: 1304268 - RNA, 24 nt, Human
agcagaaaugaaaauauauaguuu

SEQ ID NO: 1304269 - RNA, 22 nt, Human
aggaaaugcauuuuuuucucuc

SEQ ID NO: 1304270 - RNA, 18 nt, Human
aggaaucagaguugcauu

SEQ ID NO: 1304271 - RNA, 20 nt, Human
aggaaucagaguugcauuuu

SEQ ID NO: 1304272 - RNA, 23 nt, Human
aggcccaaggcagcuagcagcag

SEQ ID NO: 1304273 - RNA, 19 nt, Human
caaggcagcuagcagcaga

SEQ ID NO: 1304274 - RNA, 21 nt, Human
caguuuauugaaaaggaugau

SEQ ID NO: 1304275 - RNA, 19 nt, Human
ccaguccaguuucuuucca

SEQ ID NO: 1304276 - RNA, 21 nt, Human
gaauaagccuaucuaaggucc

SEQ ID NO: 1304277 - RNA, 21 nt, Human
gcagaaaugaaaauauauagu

SEQ ID NO: 1304278 - RNA, 20 nt, Human
guugaugguggugaugggcc

SEQ ID NO: 1304279 - RNA, 18 nt, Human
uaaggucccuugcugcaa

SEQ ID NO: 1304280 - RNA, 23 nt, Human
uagaaaagaugaaugcuacugug

SEQ ID NO: 1304281 - RNA, 25 nt, Human
uagcagcagaaaugaaaauauauag

SEQ ID NO: 1304282 - RNA, 23 nt, Human
uaguugaugguggugaugggcca

SEQ ID NO: 1304283 - RNA, 19 nt, Human
uaugcaaaaugaauacagu

SEQ ID NO: 1304284 - RNA, 23 nt, Human
ucuaaggucccuugcugcaaggu

SEQ ID NO: 1304285 - RNA, 21 nt, Human
ugguggucucaaaacuuaaaa

SEQ ID NO: 1304286 - RNA, 22 nt, Human
ugguggugaugggccacagugu

SEQ ID NO: 1304287 - RNA, 25 nt, Human
ugguggugaugggccacaguguggu

SEQ ID NO: 1304288 - RNA, 18 nt, Human
uuaauuuuggggaaaaaa

SEQ ID NO: 1304289 - RNA, 22 nt, Human
uugaauggagagaggaaaggua

SEQ ID NO: 1304290 - RNA, 21 nt, Human
uugaugguggugaugggccac

SEQ ID NO: 1304291 - RNA, 22 nt, Human
uuuauugaaaaggaugauacag

SEQ ID NO: 1304292 - RNA, 23 nt, Human
uuuccaaacucacauuuguugaa

SEQ ID NO: 1304293 - RNA, 18 nt, Human
uuuuggggaaaaaagcaa

SEQ ID NO: 1304294 - RNA, 19 nt, Human
uggcagcauuccuuauaau

SEQ ID NO: 1304295 - RNA, 20 nt, Human
aacacaggugaagcucauca

SEQ ID NO: 1304296 - RNA, 23 nt, Human
aacacaggugaagcucaucaucu

SEQ ID NO: 1304297 - RNA, 21 nt, Human
caagcaacagagaccacagca

SEQ ID NO: 1304298 - RNA, 21 nt, Human
caccagcagcuguccguaacc

SEQ ID NO: 1304299 - RNA, 21 nt, Human
cacgcaagcaacagagaccac

SEQ ID NO: 1304300 - RNA, 20 nt, Human
cacggcucagccgucgcccc

SEQ ID NO: 1304301 - RNA, 22 nt, Human
ccagcagcuguccguaaccaaa

SEQ ID NO: 1304302 - RNA, 21 nt, Human
cccacggcucagccgucgccc

SEQ ID NO: 1304303 - RNA, 24 nt, Human
ccguaaccaaaaccaccuuccuca

SEQ ID NO: 1304304 - RNA, 26 nt, Human
cgaaaaccgagcacgcaagcaacaga

SEQ ID NO: 1304305 - RNA, 18 nt, Human
cgagcacgcaagcaacag

SEQ ID NO: 1304306 - RNA, 19 nt, Human
cgagcacgcaagcaacaga

SEQ ID NO: 1304307 - RNA, 21 nt, Human
cguaaccaaaaccaccuuccu

SEQ ID NO: 1304308 - RNA, 22 nt, Human
uccgagacugacccagcggcuc

SEQ ID NO: 1304309 - RNA, 22 nt, Human
ugacccagcggcuccacccacg

SEQ ID NO: 1304310 - RNA, 19 nt, Human
aaacagaagaaaaagccuc

SEQ ID NO: 1304311 - RNA, 26 nt, Human
aaacagaagaaaaagccucaaaucug

SEQ ID NO: 1304312 - RNA, 27 nt, Human
aaacagaagaaaaagccucaaaucuga

SEQ ID NO: 1304313 - RNA, 23 nt, Human
aagcacucuucugggucaauguu

SEQ ID NO: 1304314 - RNA, 20 nt, Human
acagagaaaaggaacccaga

SEQ ID NO: 1304315 - RNA, 21 nt, Human
accuucagaagccaagaggaa

SEQ ID NO: 1304316 - RNA, 22 nt, Human
agaaacagaagaaaaagccuca

SEQ ID NO: 1304317 - RNA, 24 nt, Human
agguagccccaaaacuccagcuga

SEQ ID NO: 1304318 - RNA, 21 nt, Human
augcuuucauuuuguacugug

SEQ ID NO: 1304319 - RNA, 19 nt, Human
caagaggaaagcacucuuc

SEQ ID NO: 1304320 - RNA, 18 nt, Human
cagaagaaaaagccucaa

SEQ ID NO: 1304321 - RNA, 24 nt, Human
cauuuuuauaaaaaggaaaguauu

SEQ ID NO: 1304322 - RNA, 21 nt, Human
ccaaaacuccagcugauguua

SEQ ID NO: 1304323 - RNA, 24 nt, Human
ccagaaacagaagaaaaagccuca

SEQ ID NO: 1304324 - RNA, 22 nt, Human
ccagcugauguuacaagagucu

SEQ ID NO: 1304325 - RNA, 24 nt, Human
ccccaaaacuccagcugauguuac

SEQ ID NO: 1304326 - RNA, 20 nt, Human
cugggucaauguucuucucu

SEQ ID NO: 1304327 - RNA, 20 nt, Human
cuggucccuuuugucauugu

SEQ ID NO: 1304328 - RNA, 19 nt, Human
ggaaagaucacauauuuuu

SEQ ID NO: 1304329 - RNA, 25 nt, Human
uaaggccagaaacagaagaaaaagc

SEQ ID NO: 1304330 - RNA, 25 nt, Human
uacagagaaaaggaacccagacagu

SEQ ID NO: 1304331 - RNA, 25 nt, Human
uaccuucagaagccaagaggaaagc

SEQ ID NO: 1304332 - RNA, 22 nt, Human
ucaaaaauuacaacuccgugag

SEQ ID NO: 1304333 - RNA, 27 nt, Human
ucccuuuugucauuguuucucuguaau

SEQ ID NO: 1304334 - RNA, 22 nt, Human
ucugaaaaguacuacagagaaa

SEQ ID NO: 1304335 - RNA, 18 nt, Human
ugaaaaguacuacagaga

SEQ ID NO: 1304336 - RNA, 24 nt, Human
ugaaaaguacuacagagaaaagga

SEQ ID NO: 1304337 - RNA, 18 nt, Human
ugagaguuguuuuuuauu

SEQ ID NO: 1304338 - RNA, 22 nt, Human
ugauagguagccccaaaacucc

SEQ ID NO: 1304339 - RNA, 21 nt, Human
uguccuguccuaagaggaaag

SEQ ID NO: 1304340 - RNA, 22 nt, Human
uucuuggcccauucuugccuuc

SEQ ID NO: 1304341 - RNA, 22 nt, Human
aacaaagccagucgugccugaa

SEQ ID NO: 1304342 - RNA, 21 nt, Human
acaaccucacccaacaaagcc

SEQ ID NO: 1304343 - RNA, 20 nt, Human
accacaacaaccucacccaa

SEQ ID NO: 1304344 - RNA, 22 nt, Human
accacaacaaccucacccaaca

SEQ ID NO: 1304345 - RNA, 22 nt, Human
acccaacaaagccagucgugcc

SEQ ID NO: 1304346 - RNA, 19 nt, Human
agccacaggaacaccacaa

SEQ ID NO: 1304347 - RNA, 21 nt, Human
aguaaugccaucagugggcac

SEQ ID NO: 1304348 - RNA, 19 nt, Human
caagacugaagaauuaaca

SEQ ID NO: 1304349 - RNA, 21 nt, Human
cacaacaaccucacccaacaa

SEQ ID NO: 1304350 - RNA, 19 nt, Human
caccacaacaaccucaccc

SEQ ID NO: 1304351 - RNA, 21 nt, Human
cacugcuaaugcaagacugaa

SEQ ID NO: 1304352 - RNA, 22 nt, Human
caggaacaccacaacaaccuca

SEQ ID NO: 1304353 - RNA, 22 nt, Human
caucagugggcacugcuaaugc

SEQ ID NO: 1304354 - RNA, 23 nt, Human
ccacaggaacaccacaacaaccu

SEQ ID NO: 1304355 - RNA, 19 nt, Human
ccagggugauggucuuucc

SEQ ID NO: 1304356 - RNA, 22 nt, Human
ccauucaacgaaaccuuuauua

SEQ ID NO: 1304357 - RNA, 19 nt, Human
ccuaaguuggggcaaaugg

SEQ ID NO: 1304358 - RNA, 19 nt, Human
ccugcaaagaugagccucu

SEQ ID NO: 1304359 - RNA, 19 nt, Human
cuaaugcaagacugaagaa

SEQ ID NO: 1304360 - RNA, 19 nt, Human
gacucuuucuggaugcugu

SEQ ID NO: 1304361 - RNA, 23 nt, Human
ggauacgaggaugcugcgaauca

SEQ ID NO: 1304362 - RNA, 23 nt, Human
ucacccaacaaagccagucgugc

SEQ ID NO: 1304363 - RNA, 19 nt, Human
ucaggcgcaggaccaggug

SEQ ID NO: 1304364 - RNA, 24 nt, Human
ucagggucuucacgaagaucuuca

SEQ ID NO: 1304365 - RNA, 19 nt, Human
ugaaacuuguaauuucuaa

SEQ ID NO: 1304366 - RNA, 23 nt, Human
ugcuaaugcaagacugaagaauu

SEQ ID NO: 1304367 - RNA, 21 nt, Human
ugcugcgaaucacguccagcc

SEQ ID NO: 1304368 - RNA, 20 nt, Human
uucacgaagaucuucauacc

SEQ ID NO: 1304369 - RNA, 19 nt, Human
uucauccuggaucuuggcu

SEQ ID NO: 1304370 - RNA, 20 nt, Human
uucauccuggaucuuggcuu

SEQ ID NO: 1304371 - RNA, 22 nt, Human
uuuucgauggugucacugggcu

SEQ ID NO: 1304372 - RNA, 18 nt, Human
aaaaccaaugaaaauuug

SEQ ID NO: 1304373 - RNA, 22 nt, Human
aaaaccaaugaaaauuugccau

SEQ ID NO: 1304374 - RNA, 25 nt, Human
aaaaccaaugaaaauuugccauggc

SEQ ID NO: 1304375 - RNA, 25 nt, Human
aaccaaugaaaauuugccauggccu

SEQ ID NO: 1304376 - RNA, 23 nt, Human
accaaauauuaauauucacaugu

SEQ ID NO: 1304377 - RNA, 22 nt, Human
auaaaaccaaugaaaauuugcc

SEQ ID NO: 1304378 - RNA, 20 nt, Human
caccaaauauuaauauucac

SEQ ID NO: 1304379 - RNA, 22 nt, Human
cagcagucuuucucuggcaucc

SEQ ID NO: 1304380 - RNA, 20 nt, Human
caugggaauauguauucuuu

SEQ ID NO: 1304381 - RNA, 23 nt, Human
gggaauauguauucuuucaacuc

SEQ ID NO: 1304382 - RNA, 26 nt, Human
ucagggcagguaugaucugguucaua

SEQ ID NO: 1304383 - RNA, 25 nt, Human
ucuauaaucaugaauaagauaaaac

SEQ ID NO: 1304384 - RNA, 21 nt, Human
ugaucugguucauaucaguag

SEQ ID NO: 1304385 - RNA, 20 nt, Human
ugcagcagucuuucucuggc

SEQ ID NO: 1304386 - RNA, 21 nt, Human
ugggaauauguauucuuucaa

SEQ ID NO: 1304387 - RNA, 21 nt, Human
accacagaggguaccugagac

SEQ ID NO: 1304388 - RNA, 20 nt, Human
aguaguuucuuaauuuucau

SEQ ID NO: 1304389 - RNA, 20 nt, Human
augcagugguuuuugucuau

SEQ ID NO: 1304390 - RNA, 19 nt, Human
caaauaguaguaguuucuu

SEQ ID NO: 1304391 - RNA, 23 nt, Human
caaguccaccaaagguaggcgau

SEQ ID NO: 1304392 - RNA, 18 nt, Human
cagaggguaccugagacc

SEQ ID NO: 1304393 - RNA, 21 nt, Human
cagcaguacucaauggguggu

SEQ ID NO: 1304394 - RNA, 21 nt, Human
caggaagucuauaaggucaaa

SEQ ID NO: 1304395 - RNA, 23 nt, Human
ccacugggauaauucuguuucau

SEQ ID NO: 1304396 - RNA, 24 nt, Human
cuccagcaucuucuguccaguacc

SEQ ID NO: 1304397 - RNA, 21 nt, Human
uaacccacugggauaauucug

SEQ ID NO: 1304398 - RNA, 22 nt, Human
uaccacaugugagguucauuug

SEQ ID NO: 1304399 - RNA, 23 nt, Human
uagcagcaguacucaaugggugg

SEQ ID NO: 1304400 - RNA, 22 nt, Human
uaucccuuuuuggagauaacuu

SEQ ID NO: 1304401 - RNA, 22 nt, Human
ucuuaccacuggacaggagaga

SEQ ID NO: 1304402 - RNA, 24 nt, Human
uuucuccagcaucuucuguccagu

SEQ ID NO: 1304403 - RNA, 19 nt, Human
cggagcuccucaaaggaag

SEQ ID NO: 1304404 - RNA, 21 nt, Human
guugucucuguugcuuucuuc

SEQ ID NO: 1304405 - RNA, 21 nt, Human
uagcaguauuugguuucauac

SEQ ID NO: 1304406 - RNA, 20 nt, Human
ugcuuuuuucuuuguccucc

SEQ ID NO: 1304407 - RNA, 21 nt, Human
uuaauagcaguauuugguuuc

SEQ ID NO: 1304408 - RNA, 20 nt, Human
aaaguggagaguugggggug

SEQ ID NO: 1304409 - RNA, 18 nt, Human
aacaccccuguugcauuc

SEQ ID NO: 1304410 - RNA, 18 nt, Human
acagcccagggaaggccc

SEQ ID NO: 1304411 - RNA, 18 nt, Human
agguggggcucuucacug

SEQ ID NO: 1304412 - RNA, 20 nt, Human
cacagguggaggggcuggaa

SEQ ID NO: 1304413 - RNA, 18 nt, Human
caccgugccccccaaggc

SEQ ID NO: 1304414 - RNA, 22 nt, Human
cacuuugcaccgugccccccaa

SEQ ID NO: 1304415 - RNA, 23 nt, Human
cagcacagcccagggaaggccca

SEQ ID NO: 1304416 - RNA, 22 nt, Human
cccccgcaacaccccuguugca

SEQ ID NO: 1304417 - RNA, 26 nt, Human
ccugugccugcagcacagcccaggga

SEQ ID NO: 1304418 - RNA, 25 nt, Human
gcacagcccagggaagggggaacgc

SEQ ID NO: 1304419 - RNA, 20 nt, Human
ggagaguugggggugagggg

SEQ ID NO: 1304420 - RNA, 18 nt, Human
gugaccccgagguggggc

SEQ ID NO: 1304421 - RNA, 20 nt, Human
guggagaguugggggugagg

SEQ ID NO: 1304422 - RNA, 22 nt, Human
guggagaguugggggugagggg

SEQ ID NO: 1304423 - RNA, 19 nt, Human
ugaccccgagguggggcuc

SEQ ID NO: 1304424 - RNA, 18 nt, Human
ugcccccgcaacaccccu

SEQ ID NO: 1304425 - RNA, 22 nt, Human
uggagaguugggggugaggggc

SEQ ID NO: 1304426 - RNA, 21 nt, Human
agcagaagccccaucccagga

SEQ ID NO: 1304427 - RNA, 21 nt, Human
aggcaggaggcagcucugggg

SEQ ID NO: 1304428 - RNA, 24 nt, Human
agugccaggcaggaggcagcucug

SEQ ID NO: 1304429 - RNA, 21 nt, Human
ccaggaggggaguguggcggc

SEQ ID NO: 1304430 - RNA, 24 nt, Human
ugagugagcccgggagcagaagcc

SEQ ID NO: 1304431 - RNA, 22 nt, Human
uggcggcagugccaggcaggag

SEQ ID NO: 1304432 - RNA, 18 nt, Human
uguggcggcagugccagg

SEQ ID NO: 1304433 - RNA, 19 nt, Human
aaacaggcauacaacacgc

SEQ ID NO: 1304434 - RNA, 22 nt, Human
aaacaggcauacaacacgcagc

SEQ ID NO: 1304435 - RNA, 18 nt, Human
aagagucuggcuccuggc

SEQ ID NO: 1304436 - RNA, 24 nt, Human
acacagaugcucccacguggucca

SEQ ID NO: 1304437 - RNA, 19 nt, Human
accccaccucccugcugca

SEQ ID NO: 1304438 - RNA, 21 nt, Human
accccaccucccugcugcagc

SEQ ID NO: 1304439 - RNA, 21 nt, Human
acucuauugcccaggcuggag

SEQ ID NO: 1304440 - RNA, 25 nt, Human
acucuauugcccaggcuggagugca

SEQ ID NO: 1304441 - RNA, 24 nt, Human
acuuuaugacuaaaacaggcaguc

SEQ ID NO: 1304442 - RNA, 18 nt, Human
agugcaguggugcaaucg

SEQ ID NO: 1304443 - RNA, 21 nt, Human
agugcaguggugcaaucggcu

SEQ ID NO: 1304444 - RNA, 22 nt, Human
agugcaguggugcaaucggcuc

SEQ ID NO: 1304445 - RNA, 28 nt, Human
auacaacacgcagcauaaacacacccaa

SEQ ID NO: 1304446 - RNA, 26 nt, Human
caacacgcagcauaaacacacccaaa

SEQ ID NO: 1304447 - RNA, 21 nt, Human
cagcagaaguggcacugcucc

SEQ ID NO: 1304448 - RNA, 24 nt, Human
cagggucuuacucuauugcccagg

SEQ ID NO: 1304449 - RNA, 23 nt, Human
cauaaacacacccaaaugagacu

SEQ ID NO: 1304450 - RNA, 27 nt, Human
cauacaacacgcagcauaaacacaccc

SEQ ID NO: 1304451 - RNA, 18 nt, Human
cccaccccaccucccugc

SEQ ID NO: 1304452 - RNA, 24 nt, Human
cccugcugcagcgcuagaaaaaga

SEQ ID NO: 1304453 - RNA, 20 nt, Human
gcagcauaaacacacccaaa

SEQ ID NO: 1304454 - RNA, 21 nt, Human
gcauacaacacgcagcauaaa

SEQ ID NO: 1304455 - RNA, 19 nt, Human
gcccaggcuggagugcagu

SEQ ID NO: 1304456 - RNA, 19 nt, Human
uauugcccaggcuggagug

SEQ ID NO: 1304457 - RNA, 18 nt, Human
ucacugcagccuugaacu

SEQ ID NO: 1304458 - RNA, 21 nt, Human
ucagcccagcagaaguggcac

SEQ ID NO: 1304459 - RNA, 21 nt, Human
ucccugcugcagcgcuagaaa

SEQ ID NO: 1304460 - RNA, 24 nt, Human
ucuauugcccaggcuggagugcag

SEQ ID NO: 1304461 - RNA, 21 nt, Human
ucuccgcugcaggucagccca

SEQ ID NO: 1304462 - RNA, 23 nt, Human
ucuuacucuauugcccaggcugg

SEQ ID NO: 1304463 - RNA, 24 nt, Human
ucuuacucuauugcccaggcugga

SEQ ID NO: 1304464 - RNA, 22 nt, Human
ucuuccuuggggaggaagaugg

SEQ ID NO: 1304465 - RNA, 22 nt, Human
ugcacacagaugcucccacgug

SEQ ID NO: 1304466 - RNA, 20 nt, Human
ugcaguggugcaaucggcuc

SEQ ID NO: 1304467 - RNA, 18 nt, Human
ugcccaggcuggagugca

SEQ ID NO: 1304468 - RNA, 21 nt, Human
ugcccaggcuggagugcagug

SEQ ID NO: 1304469 - RNA, 24 nt, Human
ugcccaggcuggagugcaguggug

SEQ ID NO: 1304470 - RNA, 22 nt, Human
ugcugcagcgcuagaaaaagaa

SEQ ID NO: 1304471 - RNA, 20 nt, Human
uggagugcaguggugcaauc

SEQ ID NO: 1304472 - RNA, 21 nt, Human
uggagugcaguggugcaaucg

SEQ ID NO: 1304473 - RNA, 22 nt, Human
uggagugcaguggugcaaucgg

SEQ ID NO: 1304474 - RNA, 23 nt, Human
uggcaggcgcugaggaucagcag

SEQ ID NO: 1304475 - RNA, 28 nt, Human
uggcaggcgcugaggaucagcagaucug

SEQ ID NO: 1304476 - RNA, 18 nt, Human
uggggaggaagaugggcc

SEQ ID NO: 1304477 - RNA, 22 nt, Human
uggugcaaucggcucacugcag

SEQ ID NO: 1304478 - RNA, 24 nt, Human
uuacucuauugcccaggcuggagu

SEQ ID NO: 1304479 - RNA, 24 nt, Human
uugcccaggcuggagugcaguggu

SEQ ID NO: 1304480 - RNA, 23 nt, Human
aacacauucacguaaaacucuca

SEQ ID NO: 1304481 - RNA, 22 nt, Human
cacucugccaaccuggcccacc

SEQ ID NO: 1304482 - RNA, 19 nt, Human
ccuggcccacccacagagc

SEQ ID NO: 1304483 - RNA, 21 nt, Human
uaaaacucucaaaggcggcca

SEQ ID NO: 1304484 - RNA, 23 nt, Human
uauacaacacauucacguaaaac

SEQ ID NO: 1304485 - RNA, 20 nt, Human
ugccaaccuggcccacccac

SEQ ID NO: 1304486 - RNA, 21 nt, Human
uguauacaacacauucacgua

SEQ ID NO: 1304487 - RNA, 23 nt, Human
uguauacaacacauucacguagu

SEQ ID NO: 1304488 - RNA, 24 nt, Human
uucuuugccaguguuguauacaac

SEQ ID NO: 1304489 - RNA, 18 nt, Human
aaagucacuuucagacca

SEQ ID NO: 1304490 - RNA, 23 nt, Human
aaauggccaugaaaaucaaucuu

SEQ ID NO: 1304491 - RNA, 20 nt, Human
aacacagcaaaauccugucu

SEQ ID NO: 1304492 - RNA, 20 nt, Human
aacacagcaaaauccugucu

SEQ ID NO: 1304493 - RNA, 21 nt, Human
aagcaagacauaggcacagag

SEQ ID NO: 1304494 - RNA, 22 nt, Human
aaguaaaugcaguaauggaaac

SEQ ID NO: 1304495 - RNA, 21 nt, Human
acauacaaaugaaagauacca

SEQ ID NO: 1304496 - RNA, 19 nt, Human
accagucugggcaacacag

SEQ ID NO: 1304497 - RNA, 22 nt, Human
acugcaacauuuucuaaaccca

SEQ ID NO: 1304498 - RNA, 19 nt, Human
agacugaggugggaggaug

SEQ ID NO: 1304499 - RNA, 21 nt, Human
agagauaacggaugagaaagc

SEQ ID NO: 1304500 - RNA, 24 nt, Human
agagauacaaacuuuaugaccucc

SEQ ID NO: 1304501 - RNA, 18 nt, Human
agagcaacucacaaggaa

SEQ ID NO: 1304502 - RNA, 19 nt, Human
agauacaaacuuuaugacc

SEQ ID NO: 1304503 - RNA, 19 nt, Human
agauauggaaauagggaac

SEQ ID NO: 1304504 - RNA, 21 nt, Human
agaugacaaauauacaaggca

SEQ ID NO: 1304505 - RNA, 23 nt, Human
agcuaggugugguggcaugugcc

SEQ ID NO: 1304506 - RNA, 20 nt, Human
aggaguuugagaccagucug

SEQ ID NO: 1304507 - RNA, 19 nt, Human
aggcaaagcagggagucca

SEQ ID NO: 1304508 - RNA, 20 nt, Human
aggcauugaagccugacacu

SEQ ID NO: 1304509 - RNA, 19 nt, Human
aggcuucaauccccuccca

SEQ ID NO: 1304510 - RNA, 24 nt, Human
agucugggcaacacagcaaaaucc

SEQ ID NO: 1304511 - RNA, 24 nt, Human
aucuguccuuuuuuuuuuuuuuuu

SEQ ID NO: 1304512 - RNA, 28 nt, Human
aucuguccuuuuuuuuuuuuuuuuuuuu

SEQ ID NO: 1304513 - RNA, 22 nt, Human
auugugcuuucuuccacagaac

SEQ ID NO: 1304514 - RNA, 22 nt, Human
auugugcuuucuuccacagggg

SEQ ID NO: 1304515 - RNA, 21 nt, Human
caaaaaagcaagacauaggca

SEQ ID NO: 1304516 - RNA, 19 nt, Human
caacacagcaaaauccugu

SEQ ID NO: 1304517 - RNA, 21 nt, Human
caacacagcaaaauccugucu

SEQ ID NO: 1304518 - RNA, 21 nt, Human
caagguggaaucccagaggcc

SEQ ID NO: 1304519 - RNA, 24 nt, Human
cacagcaaaauccugucuuaaaaa

SEQ ID NO: 1304520 - RNA, 19 nt, Human
cacagcauucuucuaucuc

SEQ ID NO: 1304521 - RNA, 18 nt, Human
caccauuuaaaaacuucc

SEQ ID NO: 1304522 - RNA, 22 nt, Human
cagcaaaaaagcaagacauagg

SEQ ID NO: 1304523 - RNA, 25 nt, Human
cagcaaaaaagcaagacauaggcac

SEQ ID NO: 1304524 - RNA, 26 nt, Human
cagcaaaaaagcaagacauaggcaca

SEQ ID NO: 1304525 - RNA, 21 nt, Human
cagccucuacccaucaaucau

SEQ ID NO: 1304526 - RNA, 22 nt, Human
cauucaaaucccuuacuuguuc

SEQ ID NO: 1304527 - RNA, 21 nt, Human
ccaacacagggcacuugaaga

SEQ ID NO: 1304528 - RNA, 18 nt, Human
ccacaaaagacaggcugg

SEQ ID NO: 1304529 - RNA, 20 nt, Human
ccacagaugacaaauauaca

SEQ ID NO: 1304530 - RNA, 24 nt, Human
ccaucuguccuuuuuuuuuuuuuu

SEQ ID NO: 1304531 - RNA, 18 nt, Human
cccagagacacacucuca

SEQ ID NO: 1304532 - RNA, 22 nt, Human
cccaggucuccaaaucacuuuc

SEQ ID NO: 1304533 - RNA, 21 nt, Human
ccccagagacacacucucacc

SEQ ID NO: 1304534 - RNA, 21 nt, Human
cccccagagacacacucucac

SEQ ID NO: 1304535 - RNA, 21 nt, Human
cccgaagugccugggaacugg

SEQ ID NO: 1304536 - RNA, 18 nt, Human
ccucucagccacccucuc

SEQ ID NO: 1304537 - RNA, 18 nt, Human
ccucuuguccggggaacc

SEQ ID NO: 1304538 - RNA, 21 nt, Human
ccugcugucugguuccacuac

SEQ ID NO: 1304539 - RNA, 24 nt, Human
ccuuuugugaggugacgacgaagu

SEQ ID NO: 1304540 - RNA, 24 nt, Human
ccuuuuuuuuuuuuuuuuuuuuaa

SEQ ID NO: 1304541 - RNA, 24 nt, Human
cgaagugaaaucgccuacucuguu

SEQ ID NO: 1304542 - RNA, 21 nt, Human
cucagggaucauugugcgggu

SEQ ID NO: 1304543 - RNA, 23 nt, Human
cugcagauugggaauaauugugc

SEQ ID NO: 1304544 - RNA, 21 nt, Human
cuggaggcuucaauccccucc

SEQ ID NO: 1304545 - RNA, 21 nt, Human
cugggcaacacagcaaaaucc

SEQ ID NO: 1304546 - RNA, 21 nt, Human
cuguaaucucugaaggccucc

SEQ ID NO: 1304547 - RNA, 23 nt, Human
cuguccuuuuuuuuuuuuuuuuu

SEQ ID NO: 1304548 - RNA, 18 nt, Human
cuuucagaccaauggcuu

SEQ ID NO: 1304549 - RNA, 19 nt, Human
gaacucagcaaaaaagcaa

SEQ ID NO: 1304550 - RNA, 19 nt, Human
gacagaggaauugcuuuuu

SEQ ID NO: 1304551 - RNA, 24 nt, Human
gaucucuugaacccaggaguuuga

SEQ ID NO: 1304552 - RNA, 23 nt, Human
gcaguaauggaaacaguaagaac

SEQ ID NO: 1304553 - RNA, 21 nt, Human
gccacauacaaaugaaagaua

SEQ ID NO: 1304554 - RNA, 26 nt, Human
gccacccucucgcuucucauggauuc

SEQ ID NO: 1304555 - RNA, 24 nt, Human
gccugggaacuggaggccucuguc

SEQ ID NO: 1304556 - RNA, 22 nt, Human
ggaaccuuggccaacacagggc

SEQ ID NO: 1304557 - RNA, 24 nt, Human
ggggaaccuuggccaacacagggc

SEQ ID NO: 1304558 - RNA, 22 nt, Human
gguccacaaaagacaggcuggu

SEQ ID NO: 1304559 - RNA, 18 nt, Human
guccuguaaucucugaag

SEQ ID NO: 1304560 - RNA, 20 nt, Human
uaaaacaaugguugaagagc

SEQ ID NO: 1304561 - RNA, 23 nt, Human
uaaaauaaaugguuguaaggagc

SEQ ID NO: 1304562 - RNA, 21 nt, Human
uaaaauguuccauacaaggca

SEQ ID NO: 1304563 - RNA, 27 nt, Human
uaaacccaucuguccuuuuuuuuuuuu

SEQ ID NO: 1304564 - RNA, 20 nt, Human
uaaagauagagauacaaacu

SEQ ID NO: 1304565 - RNA, 19 nt, Human
uaaaucucuagcugccaca

SEQ ID NO: 1304566 - RNA, 20 nt, Human
uaaaugaauccuauuauugc

SEQ ID NO: 1304567 - RNA, 22 nt, Human
uagaagaaaagcauaguaucau

SEQ ID NO: 1304568 - RNA, 18 nt, Human
uauuucauucaaaucccu

SEQ ID NO: 1304569 - RNA, 19 nt, Human
ucaaaucccuuacuuguuc

SEQ ID NO: 1304570 - RNA, 21 nt, Human
ucauucaaaucccuuacuugu

SEQ ID NO: 1304571 - RNA, 23 nt, Human
uccaacaucucuauugaaugaga

SEQ ID NO: 1304572 - RNA, 20 nt, Human
uccacuaccugguaucuggu

SEQ ID NO: 1304573 - RNA, 23 nt, Human
uccuauuauugcaaaccuuugau

SEQ ID NO: 1304574 - RNA, 18 nt, Human
uccuuuuuuuuuuuuuuu

SEQ ID NO: 1304575 - RNA, 18 nt, Human
uccuuuuuuuuuuuuuuu

SEQ ID NO: 1304576 - RNA, 20 nt, Human
ucucauggauucaccuggag

SEQ ID NO: 1304577 - RNA, 24 nt, Human
ucucugaaggccuccauuuccccc

SEQ ID NO: 1304578 - RNA, 23 nt, Human
ucucuugaacccaggaguuugag

SEQ ID NO: 1304579 - RNA, 18 nt, Human
ucuguccuuuuuuuuuuu

SEQ ID NO: 1304580 - RNA, 24 nt, Human
ucuugaacccaggaguuugagacc

SEQ ID NO: 1304581 - RNA, 23 nt, Human
ugaacccaggaguuugagaccag

SEQ ID NO: 1304582 - RNA, 21 nt, Human
ugaagauaagagauaacggau

SEQ ID NO: 1304583 - RNA, 25 nt, Human
ugaagauaagagauaacggaugaga

SEQ ID NO: 1304584 - RNA, 18 nt, Human
ugacaauggaauugauga

SEQ ID NO: 1304585 - RNA, 24 nt, Human
ugaggugggaggauggaucucuug

SEQ ID NO: 1304586 - RNA, 24 nt, Human
ugcaaucaugccaaauggccauga

SEQ ID NO: 1304587 - RNA, 18 nt, Human
ugccugggaacuggaggc

SEQ ID NO: 1304588 - RNA, 23 nt, Human
ugccugucaucccagcuuucagg

SEQ ID NO: 1304589 - RNA, 23 nt, Human
uggaucucuugaacccaggaguu

SEQ ID NO: 1304590 - RNA, 24 nt, Human
uggaucucuugaacccaggaguuu

SEQ ID NO: 1304591 - RNA, 24 nt, Human
uggcaugugccugucaucccagcu

SEQ ID NO: 1304592 - RNA, 22 nt, Human
uggccaaacacuucuuuguauc

SEQ ID NO: 1304593 - RNA, 21 nt, Human
ugggaaaguuuaauuuuuugc

SEQ ID NO: 1304594 - RNA, 26 nt, Human
ugggaggauggaucucuugaacccag

SEQ ID NO: 1304595 - RNA, 21 nt, Human
ugguccuucucuauguucuga

SEQ ID NO: 1304596 - RNA, 22 nt, Human
uguccuuuuuuuuuuuuuuuuu

SEQ ID NO: 1304597 - RNA, 23 nt, Human
uguggccaaacacuucuuuguau

SEQ ID NO: 1304598 - RNA, 24 nt, Human
uguggccaaacacuucuuuguauc

SEQ ID NO: 1304599 - RNA, 23 nt, Human
uuaaaagagcacuugaugcccag

SEQ ID NO: 1304600 - RNA, 20 nt, Human
uuaaggaccugcugucuggu

SEQ ID NO: 1304601 - RNA, 20 nt, Human
uuacuaauugaccacagcau

SEQ ID NO: 1304602 - RNA, 22 nt, Human
uuauauauagugcuuuguccuu

SEQ ID NO: 1304603 - RNA, 19 nt, Human
uucacugauagaagaaaag

SEQ ID NO: 1304604 - RNA, 20 nt, Human
uucacugcaacauuuucuaa

SEQ ID NO: 1304605 - RNA, 23 nt, Human
uucacugcaacauuuucuaaacc

SEQ ID NO: 1304606 - RNA, 18 nt, Human
uucaggagacugaggugg

SEQ ID NO: 1304607 - RNA, 18 nt, Human
uuccagcacugucuuagg

SEQ ID NO: 1304608 - RNA, 24 nt, Human
uucccauaggaucucugguuuuau

SEQ ID NO: 1304609 - RNA, 23 nt, Human
uugcucccuaacuuuguucugga

SEQ ID NO: 1304610 - RNA, 22 nt, Human
uugguccuucucuauguucuga

SEQ ID NO: 1304611 - RNA, 22 nt, Human
uuucagaccaauggcuuuagca

SEQ ID NO: 1304612 - RNA, 21 nt, Human
uuuuccuuccuuggaggucuu

SEQ ID NO: 1304613 - RNA, 22 nt, Human
uuuuuuuuuuuuaaaugaaucc

SEQ ID NO: 1304614 - RNA, 23 nt, Human
uuuuuuuuuuuuuuuuuuaaaug

SEQ ID NO: 1304615 - RNA, 18 nt, Human
aaugcuggcaccgacaua

SEQ ID NO: 1304616 - RNA, 19 nt, Human
acugugugccuggcacugu

SEQ ID NO: 1304617 - RNA, 19 nt, Human
agaggcccuuggagaagcc

SEQ ID NO: 1304618 - RNA, 24 nt, Human
ccccacccaccgaaggguuuacaa

SEQ ID NO: 1304619 - RNA, 23 nt, Human
cugcugucacaaugcuggcaccg

SEQ ID NO: 1304620 - RNA, 20 nt, Human
cugucacaaugcuggcaccg

SEQ ID NO: 1304621 - RNA, 25 nt, Human
gugagaucggacacacacacacaaa

SEQ ID NO: 1304622 - RNA, 19 nt, Human
uacaauauacuugugagau

SEQ ID NO: 1304623 - RNA, 18 nt, Human
uaggauauggcccccacc

SEQ ID NO: 1304624 - RNA, 18 nt, Human
uauggcccccacccaccg

SEQ ID NO: 1304625 - RNA, 19 nt, Human
ugcuggcaccgacauaaga

SEQ ID NO: 1304626 - RNA, 21 nt, Human
ugcugucacaaugcuggcacc

SEQ ID NO: 1304627 - RNA, 19 nt, Human
aacaaaaaugaagcgucug

SEQ ID NO: 1304628 - RNA, 24 nt, Human
aacaacaaaaaugaagcgucugga

SEQ ID NO: 1304629 - RNA, 22 nt, Human
aacacagugcacgcgccgucuc

SEQ ID NO: 1304630 - RNA, 19 nt, Human
aacccaggaccaggaacac

SEQ ID NO: 1304631 - RNA, 23 nt, Human
acaacaaaaaugaagcgucugga

SEQ ID NO: 1304632 - RNA, 24 nt, Human
accucacccucuuugugcccugcc

SEQ ID NO: 1304633 - RNA, 18 nt, Human
agcccaagagaguggcga

SEQ ID NO: 1304634 - RNA, 19 nt, Human
augaagcgucuggaaggcc

SEQ ID NO: 1304635 - RNA, 22 nt, Human
caccagucugcuacgggucccc

SEQ ID NO: 1304636 - RNA, 21 nt, Human
cagcccaaauugagccagaga

SEQ ID NO: 1304637 - RNA, 23 nt, Human
caggaccaggaacacagugcacg

SEQ ID NO: 1304638 - RNA, 24 nt, Human
ccagagaaaaagaucgcaaagacc

SEQ ID NO: 1304639 - RNA, 22 nt, Human
cccaaauugagccagagaaaaa

SEQ ID NO: 1304640 - RNA, 21 nt, Human
cccccagcccaagagaguggc

SEQ ID NO: 1304641 - RNA, 21 nt, Human
ccccgcuuccucuaacaccca

SEQ ID NO: 1304642 - RNA, 21 nt, Human
cccugccgcaaacccaaacaa

SEQ ID NO: 1304643 - RNA, 18 nt, Human
ccgcaaacccaaacaaca

SEQ ID NO: 1304644 - RNA, 21 nt, Human
ccgcaaacccaaacaacaaaa

SEQ ID NO: 1304645 - RNA, 21 nt, Human
ccggagggagccacuacggca

SEQ ID NO: 1304646 - RNA, 19 nt, Human
ccucacccucuuugugccc

SEQ ID NO: 1304647 - RNA, 21 nt, Human
ccucuggaacccaggaccagg

SEQ ID NO: 1304648 - RNA, 21 nt, Human
ccuucuccuucuuuuucuuuu

SEQ ID NO: 1304649 - RNA, 21 nt, Human
cugccgcaaacccaaacaaca

SEQ ID NO: 1304650 - RNA, 22 nt, Human
cuggaaggccucucaguuagcc

SEQ ID NO: 1304651 - RNA, 27 nt, Human
gaacacagugcacgcgccgucuccccg

SEQ ID NO: 1304652 - RNA, 21 nt, Human
gaaucagcccaaauugagccg

SEQ ID NO: 1304653 - RNA, 20 nt, Human
gcuuccucuaacacccacca

SEQ ID NO: 1304654 - RNA, 21 nt, Human
guugcgagaaccuucuccuuc

SEQ ID NO: 1304655 - RNA, 19 nt, Human
uccggucggggacgcuggg

SEQ ID NO: 1304656 - RNA, 23 nt, Human
ucuccccgcuuccucuaacaccc

SEQ ID NO: 1304657 - RNA, 26 nt, Human
ucuggaacccaggaccaggaacacag

SEQ ID NO: 1304658 - RNA, 22 nt, Human
ugcgagaaccuucuccuucuuu

SEQ ID NO: 1304659 - RNA, 18 nt, Human
uggaacccaggaccagga

SEQ ID NO: 1304660 - RNA, 24 nt, Human
uggaacccaggaccaggaacacag

SEQ ID NO: 1304661 - RNA, 22 nt, Human
ugguuuuguaacaguugcgaga

SEQ ID NO: 1304662 - RNA, 23 nt, Human
uucuccuucuuuuucuuuucaaa

SEQ ID NO: 1304663 - RNA, 18 nt, Human
aaaaaaagaaacagaacc

SEQ ID NO: 1304664 - RNA, 19 nt, Human
aaaaagaaacagaacccau

SEQ ID NO: 1304665 - RNA, 18 nt, Human
aaacgaugccucagucga

SEQ ID NO: 1304666 - RNA, 19 nt, Human
aaagaaacagaacccauug

SEQ ID NO: 1304667 - RNA, 24 nt, Human
aaagugccgggaucacaggcggga

SEQ ID NO: 1304668 - RNA, 25 nt, Human
aaccucacggcccacacccagucuc

SEQ ID NO: 1304669 - RNA, 19 nt, Human
aacuuagaucuaccaguga

SEQ ID NO: 1304670 - RNA, 25 nt, Human
aagaggcacagccgcagcccaggac

SEQ ID NO: 1304671 - RNA, 23 nt, Human
aagcaacggugucugagcagaaa

SEQ ID NO: 1304672 - RNA, 19 nt, Human
aaguagcugggacuacagg

SEQ ID NO: 1304673 - RNA, 20 nt, Human
aaguagcugggacuacaggc

SEQ ID NO: 1304674 - RNA, 25 nt, Human
aaguagcugggacuacaggcgcccg

SEQ ID NO: 1304675 - RNA, 26 nt, Human
aagugccgggaucacaggcgggagcc

SEQ ID NO: 1304676 - RNA, 23 nt, Human
acaggcgcccgccaccacgcccg

SEQ ID NO: 1304677 - RNA, 19 nt, Human
acgcugcagcgauacuccc

SEQ ID NO: 1304678 - RNA, 18 nt, Human
acgggguuucaccguguu

SEQ ID NO: 1304679 - RNA, 19 nt, Human
acgggguuucaccguguua

SEQ ID NO: 1304680 - RNA, 20 nt, Human
acgggguuucaccguguuag

SEQ ID NO: 1304681 - RNA, 24 nt, Human
acgggguuucaccguguuagccag

SEQ ID NO: 1304682 - RNA, 18 nt, Human
acugcaagcuccgccucc

SEQ ID NO: 1304683 - RNA, 23 nt, Human
acugcuaguugagacuaaaauag

SEQ ID NO: 1304684 - RNA, 19 nt, Human
agauguagaggcccggggc

SEQ ID NO: 1304685 - RNA, 23 nt, Human
aggcccggggcgcuugugggcaa

SEQ ID NO: 1304686 - RNA, 25 nt, Human
aggcuggagugcaguggugccaucu

SEQ ID NO: 1304687 - RNA, 20 nt, Human
agugcaguggugccaucucg

SEQ ID NO: 1304688 - RNA, 24 nt, Human
agugcaguggugccaucucggcuc

SEQ ID NO: 1304689 - RNA, 20 nt, Human
augugccgcacaagguuuuc

SEQ ID NO: 1304690 - RNA, 23 nt, Human
auucucagcauacacaacucuga

SEQ ID NO: 1304691 - RNA, 26 nt, Human
caaagugccgggaucacaggcgggag

SEQ ID NO: 1304692 - RNA, 23 nt, Human
caagagauguagaggcccggggc

SEQ ID NO: 1304693 - RNA, 21 nt, Human
cacagagcaggacgcugcagc

SEQ ID NO: 1304694 - RNA, 18 nt, Human
caccguguuagccaggau

SEQ ID NO: 1304695 - RNA, 24 nt, Human
caccguguuagccaggauggucuc

SEQ ID NO: 1304696 - RNA, 22 nt, Human
cacgccauucuccugccucagc

SEQ ID NO: 1304697 - RNA, 24 nt, Human
cagagucuugcucuguugcccagg

SEQ ID NO: 1304698 - RNA, 19 nt, Human
cagccaagagccaaaggug

SEQ ID NO: 1304699 - RNA, 18 nt, Human
cagcgauacucccucccu

SEQ ID NO: 1304700 - RNA, 18 nt, Human
caggaugucuuagaggca

SEQ ID NO: 1304701 - RNA, 21 nt, Human
caggcgcccgccaccacgccc

SEQ ID NO: 1304702 - RNA, 20 nt, Human
ccaaagugccgggaucacag

SEQ ID NO: 1304703 - RNA, 21 nt, Human
ccaggcacagagcaggacgcu

SEQ ID NO: 1304704 - RNA, 21 nt, Human
ccaucugggaucggggagcaa

SEQ ID NO: 1304705 - RNA, 23 nt, Human
cccaaguagcugggacuacaggc

SEQ ID NO: 1304706 - RNA, 23 nt, Human
cccaaguagcugggacuacaggc

SEQ ID NO: 1304707 - RNA, 21 nt, Human
cccacacccagucucuccgac

SEQ ID NO: 1304708 - RNA, 19 nt, Human
cccaggcuggagugcagug

SEQ ID NO: 1304709 - RNA, 22 nt, Human
cccucaccacuuccauccucuc

SEQ ID NO: 1304710 - RNA, 20 nt, Human
ccgcccggccggauuuggca

SEQ ID NO: 1304711 - RNA, 24 nt, Human
ccuaaaccucacggcccacaccca

SEQ ID NO: 1304712 - RNA, 24 nt, Human
ccuaaagccuccuaaaccucacgg

SEQ ID NO: 1304713 - RNA, 24 nt, Human
ccucaccacuuccauccucucaga

SEQ ID NO: 1304714 - RNA, 22 nt, Human
ccucacggcccacacccagucu

SEQ ID NO: 1304715 - RNA, 21 nt, Human
ccugaggcaaaugugccgcac

SEQ ID NO: 1304716 - RNA, 23 nt, Human
ccugccucagccucccaaguagc

SEQ ID NO: 1304717 - RNA, 24 nt, Human
ccugccucagccucccaaguagcu

SEQ ID NO: 1304718 - RNA, 22 nt, Human
cgaagggagauaggaaccugcc

SEQ ID NO: 1304719 - RNA, 26 nt, Human
cgcagcccaggacccaugcugaugcc

SEQ ID NO: 1304720 - RNA, 18 nt, Human
cgccggggagcccagugc

SEQ ID NO: 1304721 - RNA, 19 nt, Human
cgccucccggguucacgcc

SEQ ID NO: 1304722 - RNA, 24 nt, Human
cgccucggccucccaaagugccgg

SEQ ID NO: 1304723 - RNA, 19 nt, Human
cggacuccagccaagagcc

SEQ ID NO: 1304724 - RNA, 24 nt, Human
cgggguuucaccguguuagccagg

SEQ ID NO: 1304725 - RNA, 20 nt, Human
cuaaaccucacggcccacac

SEQ ID NO: 1304726 - RNA, 23 nt, Human
cuaaaccucacggcccacaccca

SEQ ID NO: 1304727 - RNA, 24 nt, Human
cucagccucccaaguagcugggac

SEQ ID NO: 1304728 - RNA, 21 nt, Human
cucccggguucacgccauucu

SEQ ID NO: 1304729 - RNA, 24 nt, Human
cuccugaccucgugauccgcccgc

SEQ ID NO: 1304730 - RNA, 20 nt, Human
cugcagcgauacucccuccc

SEQ ID NO: 1304731 - RNA, 21 nt, Human
cuuccuucuccuaaagccucc

SEQ ID NO: 1304732 - RNA, 21 nt, Human
cuugcucuguugcccaggcug

SEQ ID NO: 1304733 - RNA, 22 nt, Human
gaccucgugauccgcccgccuc

SEQ ID NO: 1304734 - RNA, 22 nt, Human
gaccucgugauccgcccgccuc

SEQ ID NO: 1304735 - RNA, 24 nt, Human
gaccucgugauccgcccgccucgg

SEQ ID NO: 1304736 - RNA, 22 nt, Human
gacuccagccaagagccaaagg

SEQ ID NO: 1304737 - RNA, 21 nt, Human
gagacagagucuugcucuguu

SEQ ID NO: 1304738 - RNA, 24 nt, Human
gagacgggguuucaccguguuagc

SEQ ID NO: 1304739 - RNA, 23 nt, Human
gauccaguaauauaaccaggcac

SEQ ID NO: 1304740 - RNA, 21 nt, Human
gcaagcaacggugucugagca

SEQ ID NO: 1304741 - RNA, 19 nt, Human
gccacguucugugcuuucg

SEQ ID NO: 1304742 - RNA, 23 nt, Human
gcccggcuaauuuuuuguauuuu

SEQ ID NO: 1304743 - RNA, 25 nt, Human
gccucccggguucacgccauucucc

SEQ ID NO: 1304744 - RNA, 25 nt, Human
gcucuguugcccaggcuggagugca

SEQ ID NO: 1304745 - RNA, 21 nt, Human
gcuggagugcaguggugccag

SEQ ID NO: 1304746 - RNA, 20 nt, Human
ggagcccagugcagucuucc

SEQ ID NO: 1304747 - RNA, 24 nt, Human
ggauggucucgaucuccugaccuc

SEQ ID NO: 1304748 - RNA, 23 nt, Human
gggguuucaccguguuagccagg

SEQ ID NO: 1304749 - RNA, 23 nt, Human
guagagacgggguuucaccgugu

SEQ ID NO: 1304750 - RNA, 24 nt, Human
gugauccgcccgccucggccuccc

SEQ ID NO: 1304751 - RNA, 22 nt, Human
guggguuggacaaggggagggc

SEQ ID NO: 1304752 - RNA, 19 nt, Human
gugucagcauggggaggaa

SEQ ID NO: 1304753 - RNA, 22 nt, Human
uaaaaaaagaaacagaacccau

SEQ ID NO: 1304754 - RNA, 23 nt, Human
uaaaccucacggcccacacccag

SEQ ID NO: 1304755 - RNA, 20 nt, Human
uaaacuaccaagagauguag

SEQ ID NO: 1304756 - RNA, 24 nt, Human
uaacuggaacaguuuuuuuaauuc

SEQ ID NO: 1304757 - RNA, 24 nt, Human
uaauuuuuuguauuuuuaguagag

SEQ ID NO: 1304758 - RNA, 25 nt, Human
uaauuuuuuguauuuuuaguagaga

SEQ ID NO: 1304759 - RNA, 23 nt, Human
uacaggcgcccgccaccacgccc

SEQ ID NO: 1304760 - RNA, 21 nt, Human
uaguagagacgggguuucacc

SEQ ID NO: 1304761 - RNA, 24 nt, Human
uaguagagacgggguuucaccgug

SEQ ID NO: 1304762 - RNA, 25 nt, Human
uaguagagacgggguuucaccgugu

SEQ ID NO: 1304763 - RNA, 26 nt, Human
uaguagagacgggguuucaccguugg

SEQ ID NO: 1304764 - RNA, 24 nt, Human
ucaccguguuagccaggauggucu

SEQ ID NO: 1304765 - RNA, 18 nt, Human
ucacugcaagcuccgccu

SEQ ID NO: 1304766 - RNA, 19 nt, Human
ucacugcaagcuccgccuc

SEQ ID NO: 1304767 - RNA, 24 nt, Human
ucacugcaagcuccgccucccggg

SEQ ID NO: 1304768 - RNA, 20 nt, Human
ucagccucccaaguagcugg

SEQ ID NO: 1304769 - RNA, 21 nt, Human
uccauccucucagauaagauc

SEQ ID NO: 1304770 - RNA, 24 nt, Human
ucccaaagugccgggaucacaggc

SEQ ID NO: 1304771 - RNA, 24 nt, Human
ucccaaguagcugggacuacaggc

SEQ ID NO: 1304772 - RNA, 21 nt, Human
ucccggguucacgccauucuc

SEQ ID NO: 1304773 - RNA, 24 nt, Human
ucccggguucacgccauucuccug

SEQ ID NO: 1304774 - RNA, 26 nt, Human
ucuccugccucagccucccaaguagc

SEQ ID NO: 1304775 - RNA, 20 nt, Human
ucucucaucugugaaaugga

SEQ ID NO: 1304776 - RNA, 23 nt, Human
ucugugcuuucggacuccagcca

SEQ ID NO: 1304777 - RNA, 18 nt, Human
ucuguugcccaggcugga

SEQ ID NO: 1304778 - RNA, 24 nt, Human
ucuguugcccaggcuggagugcag

SEQ ID NO: 1304779 - RNA, 22 nt, Human
ucuuccuucuccuaaagccucc

SEQ ID NO: 1304780 - RNA, 23 nt, Human
ucuuccuucuccuaaagccuccu

SEQ ID NO: 1304781 - RNA, 22 nt, Human
ucuugcucuguugcccaggcug

SEQ ID NO: 1304782 - RNA, 22 nt, Human
ucuugcucuguugcccaggcug

SEQ ID NO: 1304783 - RNA, 23 nt, Human
ucuugcucuguugcccaggcugg

SEQ ID NO: 1304784 - RNA, 24 nt, Human
ucuugcucuguugcccaggcugga

SEQ ID NO: 1304785 - RNA, 22 nt, Human
ugaccgugaauuaacuggaaca

SEQ ID NO: 1304786 - RNA, 21 nt, Human
ugauuuggaaacgaugccuca

SEQ ID NO: 1304787 - RNA, 22 nt, Human
ugcaguggugccaucucggcuc

SEQ ID NO: 1304788 - RNA, 24 nt, Human
ugccaagcaggaugucuuagaggc

SEQ ID NO: 1304789 - RNA, 18 nt, Human
ugcccaggcuggagugca

SEQ ID NO: 1304790 - RNA, 21 nt, Human
ugcccaggcuggagugcagug

SEQ ID NO: 1304791 - RNA, 24 nt, Human
ugcccaggcuggagugcaguggug

SEQ ID NO: 1304792 - RNA, 20 nt, Human
ugccgggaucacaggcggga

SEQ ID NO: 1304793 - RNA, 24 nt, Human
ugccucagccucccaaguagcugg

SEQ ID NO: 1304794 - RNA, 24 nt, Human
ugcucuguugcccaggcuggagug

SEQ ID NO: 1304795 - RNA, 20 nt, Human
uggaccuuuagcaaacacuu

SEQ ID NO: 1304796 - RNA, 28 nt, Human
uggagugcaguggugccauccuagcacg

SEQ ID NO: 1304797 - RNA, 23 nt, Human
uggagugcaguggugccaucucg

SEQ ID NO: 1304798 - RNA, 24 nt, Human
uggagugcaguggugccaucucgg

SEQ ID NO: 1304799 - RNA, 23 nt, Human
uggauucucagcauacacaacuc

SEQ ID NO: 1304800 - RNA, 22 nt, Human
uggcaagcuugccugauaacug

SEQ ID NO: 1304801 - RNA, 28 nt, Human
uggcaagcuugccugauaacuggccugg

SEQ ID NO: 1304802 - RNA, 21 nt, Human
ugggacuacaggcgcccgcca

SEQ ID NO: 1304803 - RNA, 22 nt, Human
ugggacuacaggcgcccgccac

SEQ ID NO: 1304804 - RNA, 24 nt, Human
ugggacuacaggcgcccgccacca

SEQ ID NO: 1304805 - RNA, 24 nt, Human
uuaauucuuaaaaaaagaaacaga

SEQ ID NO: 1304806 - RNA, 18 nt, Human
uuaguagagacgggguuu

SEQ ID NO: 1304807 - RNA, 22 nt, Human
uuaguagagacgggguuucacc

SEQ ID NO: 1304808 - RNA, 24 nt, Human
uuaguagagacgggguuucaccgu

SEQ ID NO: 1304809 - RNA, 18 nt, Human
uucuggguggaauuuugc

SEQ ID NO: 1304810 - RNA, 24 nt, Human
uugcccaggcuggagugcaguggu

SEQ ID NO: 1304811 - RNA, 24 nt, Human
uugcucuguugcccaggcuggagu

SEQ ID NO: 1304812 - RNA, 20 nt, Human
uugcuggauugaugucuggc

SEQ ID NO: 1304813 - RNA, 23 nt, Human
uuguauuuuuaguagagacgggg

SEQ ID NO: 1304814 - RNA, 19 nt, Human
uuucaccguguuagccagg

SEQ ID NO: 1304815 - RNA, 24 nt, Human
uuuuuaguagagacgggguuucac

SEQ ID NO: 1304816 - RNA, 21 nt, Human
uuuuuguauuuuuaguagaga

SEQ ID NO: 1304817 - RNA, 24 nt, Human
uuuuuuguauuuuuaguagagacg

SEQ ID NO: 1304818 - RNA, 19 nt, Human
aggggaaggggagaaaggg

SEQ ID NO: 1304819 - RNA, 26 nt, Human
aggggaaggggagaaaggguucggag

SEQ ID NO: 1304820 - RNA, 23 nt, Human
cggagagaggccagugagcggcg

SEQ ID NO: 1304821 - RNA, 23 nt, Human
gagaaaggguucggagagaggcc

SEQ ID NO: 1304822 - RNA, 22 nt, Human
gaggccagugagcggcgaagga

SEQ ID NO: 1304823 - RNA, 21 nt, Human
gggagcggaagcucaagaaag

SEQ ID NO: 1304824 - RNA, 25 nt, Human
aaacaaaaacuuaaauuuuuacagc

SEQ ID NO: 1304825 - RNA, 21 nt, Human
uaaaagaaauacauuucuguu

SEQ ID NO: 1304826 - RNA, 19 nt, Human
uaaauuauauuuugaaaaa

SEQ ID NO: 1304827 - RNA, 19 nt, Human
uacacaucccaaauugcac

SEQ ID NO: 1304828 - RNA, 18 nt, Human
uacagcuuugugguuuuu

SEQ ID NO: 1304829 - RNA, 22 nt, Human
uaguaaaaauaaaauuagcaua

SEQ ID NO: 1304830 - RNA, 27 nt, Human
uauacacaucccaaauugcacacaucc

SEQ ID NO: 1304831 - RNA, 19 nt, Human
uauucuacgaguaaaaaca

SEQ ID NO: 1304832 - RNA, 24 nt, Human
ucaaaagaauauacacaucccaaa

SEQ ID NO: 1304833 - RNA, 18 nt, Human
ugcaucagucaaaagaau

SEQ ID NO: 1304834 - RNA, 25 nt, Human
ugccuuauucaucuaauuuucuuca

SEQ ID NO: 1304835 - RNA, 22 nt, Human
uggggaaacauuaaacauuaaa

SEQ ID NO: 1304836 - RNA, 24 nt, Human
uguggggaaacauuaaacauuaaa

SEQ ID NO: 1304837 - RNA, 19 nt, Human
uuacagcuuugugguuuuu

SEQ ID NO: 1304838 - RNA, 20 nt, Human
accaagugaugcccucccug

SEQ ID NO: 1304839 - RNA, 23 nt, Human
caaggccccuaacuuggaugugg

SEQ ID NO: 1304840 - RNA, 21 nt, Human
ggcaggcguugaucgagucug

SEQ ID NO: 1304841 - RNA, 21 nt, Human
ugaaguguucuuuuccaugca

SEQ ID NO: 1304842 - RNA, 19 nt, Human
uuccaugcacaaggccccu

SEQ ID NO: 1304843 - RNA, 21 nt, Human
aaaaagcagaacaaagaucac

SEQ ID NO: 1304844 - RNA, 18 nt, Human
aaagagaaaguacaaaga

SEQ ID NO: 1304845 - RNA, 22 nt, Human
aagcagaacaaagaucacaugg

SEQ ID NO: 1304846 - RNA, 22 nt, Human
aaggguuucaaaaggggagggg

SEQ ID NO: 1304847 - RNA, 20 nt, Human
acaaggcaaagggcaaaagc

SEQ ID NO: 1304848 - RNA, 21 nt, Human
aggcaaagggcaaaagcagaa

SEQ ID NO: 1304849 - RNA, 23 nt, Human
aucacauauuggugggaccauga

SEQ ID NO: 1304850 - RNA, 20 nt, Human
augacaaggcaaagggcaaa

SEQ ID NO: 1304851 - RNA, 22 nt, Human
auuuuccauaagugucagcugg

SEQ ID NO: 1304852 - RNA, 22 nt, Human
caaaaagcagaacaaagaucaa

SEQ ID NO: 1304853 - RNA, 18 nt, Human
caaaagcagaacuacuga

SEQ ID NO: 1304854 - RNA, 18 nt, Human
caaaagcagaacuacuga

SEQ ID NO: 1304855 - RNA, 18 nt, Human
caacaaagaugacaaggc

SEQ ID NO: 1304856 - RNA, 18 nt, Human
gaccaugaugcccaccug

SEQ ID NO: 1304857 - RNA, 23 nt, Human
gcagaacaaagaucacaugcuuc

SEQ ID NO: 1304858 - RNA, 26 nt, Human
gcagaacaaagaucacaugcuucuga

SEQ ID NO: 1304859 - RNA, 23 nt, Human
gcagaacuacugauaagggucca

SEQ ID NO: 1304860 - RNA, 19 nt, Human
ggcaaaaagcagaacaaag

SEQ ID NO: 1304861 - RNA, 23 nt, Human
uacaaagagaggaauuuuacagc

SEQ ID NO: 1304862 - RNA, 18 nt, Human
ucacaugcuucaaagggc

SEQ ID NO: 1304863 - RNA, 23 nt, Human
uccaacaaagaugacaaggcaaa

SEQ ID NO: 1304864 - RNA, 23 nt, Human
ugagaaauaaagagaaaguacaa

SEQ ID NO: 1304865 - RNA, 23 nt, Human
ugagggaacaggacaaagggcaa

SEQ ID NO: 1304866 - RNA, 19 nt, Human
uggcugagaaauaaagaga

SEQ ID NO: 1304867 - RNA, 25 nt, Human
uggcugagaaauaaagagaaaguac

SEQ ID NO: 1304868 - RNA, 22 nt, Human
uucaaagggcaaaaagcagaac

SEQ ID NO: 1304869 - RNA, 22 nt, Human
agaaaaagaaaugaaaagagga

SEQ ID NO: 1304870 - RNA, 21 nt, Human
agcuggaagagcagggagggg

SEQ ID NO: 1304871 - RNA, 19 nt, Human
agggagggggcuggugcca

SEQ ID NO: 1304872 - RNA, 25 nt, Human
agugcaucagagccuggcagcugga

SEQ ID NO: 1304873 - RNA, 23 nt, Human
caggccaggaaugacagccccua

SEQ ID NO: 1304874 - RNA, 23 nt, Human
cggagaaaaagaaaugaaaagag

SEQ ID NO: 1304875 - RNA, 18 nt, Human
gagcagggagggggcugg

SEQ ID NO: 1304876 - RNA, 21 nt, Human
gagcaggugaggcaugcucuu

SEQ ID NO: 1304877 - RNA, 23 nt, Human
ggaaugacagccccuagaccacg

SEQ ID NO: 1304878 - RNA, 22 nt, Human
ggagccacggaaggcuguugag

SEQ ID NO: 1304879 - RNA, 22 nt, Human
ggaggagaaggagguggaagug

SEQ ID NO: 1304880 - RNA, 27 nt, Human
ucaggccaggaaugacagccccuagac

SEQ ID NO: 1304881 - RNA, 18 nt, Human
ugaaaagaggaugcggug

SEQ ID NO: 1304882 - RNA, 20 nt, Human
uggaagagcagggagggggc

SEQ ID NO: 1304883 - RNA, 19 nt, Human
uggaggagaaggaggugga

SEQ ID NO: 1304884 - RNA, 21 nt, Human
uggcagcuggaagagcaggga

SEQ ID NO: 1304885 - RNA, 18 nt, Human
uuagcccaugggcaaaug

SEQ ID NO: 1304886 - RNA, 22 nt, Human
aacagccccauaacaaaagaga

SEQ ID NO: 1304887 - RNA, 21 nt, Human
aacuagauguuccugagacaa

SEQ ID NO: 1304888 - RNA, 26 nt, Human
aagagagaaugacaagagaagcaaag

SEQ ID NO: 1304889 - RNA, 24 nt, Human
aagcaaaggcagaaaccccugaua

SEQ ID NO: 1304890 - RNA, 21 nt, Human
accacuuuucaguugaaaaag

SEQ ID NO: 1304891 - RNA, 27 nt, Human
acccccagccuccaagccucucuccau

SEQ ID NO: 1304892 - RNA, 19 nt, Human
agaggagaggagggaggaa

SEQ ID NO: 1304893 - RNA, 20 nt, Human
agcagccagcuaccucccuu

SEQ ID NO: 1304894 - RNA, 23 nt, Human
agccccauaacaaaagagaacua

SEQ ID NO: 1304895 - RNA, 24 nt, Human
aggaagaagaaaguauacuccucc

SEQ ID NO: 1304896 - RNA, 19 nt, Human
aggaggauguucucuucug

SEQ ID NO: 1304897 - RNA, 24 nt, Human
aggcagaaaccccugauaaaccca

SEQ ID NO: 1304898 - RNA, 22 nt, Human
aggcgcagagcuggagacaggc

SEQ ID NO: 1304899 - RNA, 18 nt, Human
aggcugugugugcaccag

SEQ ID NO: 1304900 - RNA, 25 nt, Human
augacaagagaagcaaaggcagaaa

SEQ ID NO: 1304901 - RNA, 24 nt, Human
caaaagagaacuacugaucugagc

SEQ ID NO: 1304902 - RNA, 23 nt, Human
cacagaaucagagauccagucuc

SEQ ID NO: 1304903 - RNA, 19 nt, Human
cacccccagccuccaagcc

SEQ ID NO: 1304904 - RNA, 22 nt, Human
cagagauccagucucacuuuuc

SEQ ID NO: 1304905 - RNA, 19 nt, Human
cagaggagaggagggagga

SEQ ID NO: 1304906 - RNA, 19 nt, Human
cagcggcaagagagaauga

SEQ ID NO: 1304907 - RNA, 18 nt, Human
cagcuaccucccuucucu

SEQ ID NO: 1304908 - RNA, 24 nt, Human
cagcucaauguuuggcuucucuca

SEQ ID NO: 1304909 - RNA, 21 nt, Human
cagcuuuguccuuccuggagg

SEQ ID NO: 1304910 - RNA, 25 nt, Human
cauuuuuguuuuauuuuucugaaaa

SEQ ID NO: 1304911 - RNA, 23 nt, Human
ccaguuccacguggcugcagagg

SEQ ID NO: 1304912 - RNA, 22 nt, Human
cccuucucuuccucccccgcug

SEQ ID NO: 1304913 - RNA, 18 nt, Human
ccucccuucucuuccucc

SEQ ID NO: 1304914 - RNA, 20 nt, Human
ccucccuucucuuccucccc

SEQ ID NO: 1304915 - RNA, 22 nt, Human
cgagaggaccgccucacuagug

SEQ ID NO: 1304916 - RNA, 19 nt, Human
cuaccucccuucucuuccu

SEQ ID NO: 1304917 - RNA, 21 nt, Human
cucacccccagccuccaagcc

SEQ ID NO: 1304918 - RNA, 22 nt, Human
cucacuuuuccacaaaucucca

SEQ ID NO: 1304919 - RNA, 19 nt, Human
cuccaagccucucuccauu

SEQ ID NO: 1304920 - RNA, 21 nt, Human
cuccaagccucucuccauuuc

SEQ ID NO: 1304921 - RNA, 21 nt, Human
cuccaaggcugugugugcacc

SEQ ID NO: 1304922 - RNA, 22 nt, Human
cuuggguggaagggaccaugcu

SEQ ID NO: 1304923 - RNA, 24 nt, Human
cuuucucuguguuucugaaacaag

SEQ ID NO: 1304924 - RNA, 18 nt, Human
gaacugauaggaggaugu

SEQ ID NO: 1304925 - RNA, 22 nt, Human
gagaaugacaagagaagcaaag

SEQ ID NO: 1304926 - RNA, 24 nt, Human
gagaaugacaagagaagcaaaggc

SEQ ID NO: 1304927 - RNA, 23 nt, Human
gaggcgcagagcuggagacaggc

SEQ ID NO: 1304928 - RNA, 19 nt, Human
gauccggcccaccacuguu

SEQ ID NO: 1304929 - RNA, 18 nt, Human
gcagagcuggagacaggc

SEQ ID NO: 1304930 - RNA, 18 nt, Human
gcuuuguccuuccuggag

SEQ ID NO: 1304931 - RNA, 19 nt, Human
ggagaggagggaggaagaa

SEQ ID NO: 1304932 - RNA, 26 nt, Human
ggggacuuuggcuaagacuauuaggu

SEQ ID NO: 1304933 - RNA, 19 nt, Human
guggcaguccaguggaagg

SEQ ID NO: 1304934 - RNA, 18 nt, Human
gugguagcagagucgagg

SEQ ID NO: 1304935 - RNA, 24 nt, Human
uaaccccucccaacuccucacacc

SEQ ID NO: 1304936 - RNA, 22 nt, Human
uacugaucugagcauaggaaag

SEQ ID NO: 1304937 - RNA, 25 nt, Human
uagaagcaucuuuuugggacauccu

SEQ ID NO: 1304938 - RNA, 20 nt, Human
uagaggcucuaccacuuuuc

SEQ ID NO: 1304939 - RNA, 22 nt, Human
uagcagagucgaggcugucuug

SEQ ID NO: 1304940 - RNA, 21 nt, Human
uaguauucucggaugcaaccu

SEQ ID NO: 1304941 - RNA, 23 nt, Human
uaucagcuuuguccuuccuggag

SEQ ID NO: 1304942 - RNA, 24 nt, Human
uaucuugagacucacccccagccu

SEQ ID NO: 1304943 - RNA, 25 nt, Human
ucagcucaauguuuggcuucucuca

SEQ ID NO: 1304944 - RNA, 27 nt, Human
uccaagccucucuccauuucucuaacc

SEQ ID NO: 1304945 - RNA, 20 nt, Human
uccacguggcugcagaggcc

SEQ ID NO: 1304946 - RNA, 24 nt, Human
ucucacuuuuccacaaaucuccaa

SEQ ID NO: 1304947 - RNA, 19 nt, Human
ugaaauuaacggauguguc

SEQ ID NO: 1304948 - RNA, 21 nt, Human
ugagacucacccccagccucc

SEQ ID NO: 1304949 - RNA, 24 nt, Human
ugagacucacccccagccuccaag

SEQ ID NO: 1304950 - RNA, 19 nt, Human
ugagagggaccaguuggug

SEQ ID NO: 1304951 - RNA, 22 nt, Human
ugaguguucuccacuccuccua

SEQ ID NO: 1304952 - RNA, 21 nt, Human
ugcagaggccucacaaucauc

SEQ ID NO: 1304953 - RNA, 19 nt, Human
ugccacuggggacuuuggc

SEQ ID NO: 1304954 - RNA, 26 nt, Human
ugcuucugcucuuuccuaugguuuca

SEQ ID NO: 1304955 - RNA, 18 nt, Human
uggaacagccccauaaca

SEQ ID NO: 1304956 - RNA, 21 nt, Human
uggaacagccccauaacaaaa

SEQ ID NO: 1304957 - RNA, 27 nt, Human
uggaaggaaggucuuuugaggucaacc

SEQ ID NO: 1304958 - RNA, 22 nt, Human
uggaagggaccaugcugaccuc

SEQ ID NO: 1304959 - RNA, 20 nt, Human
ugucacagaaucagagaucc

SEQ ID NO: 1304960 - RNA, 22 nt, Human
ugucuccuuuggaacagcccca

SEQ ID NO: 1304961 - RNA, 20 nt, Human
ugucuuguauccugguuuca

SEQ ID NO: 1304962 - RNA, 24 nt, Human
ugucuugugcuucugcucuuuccu

SEQ ID NO: 1304963 - RNA, 21 nt, Human
uguuguggcaguccaguggaa

SEQ ID NO: 1304964 - RNA, 21 nt, Human
uguuguuuugaacugauagga

SEQ ID NO: 1304965 - RNA, 23 nt, Human
uuaaccccucccaacuccucaca

SEQ ID NO: 1304966 - RNA, 27 nt, Human
uuagguuugcuuucaacuagauguucc

SEQ ID NO: 1304967 - RNA, 19 nt, Human
uucucaguuaccauuauuu

SEQ ID NO: 1304968 - RNA, 22 nt, Human
uuugaggucacuuagaagcauc

SEQ ID NO: 1304969 - RNA, 24 nt, Human
acaaacuuuuaaaaaugcucagag

SEQ ID NO: 1304970 - RNA, 20 nt, Human
acuuuuaaaaaugcucagag

SEQ ID NO: 1304971 - RNA, 21 nt, Human
ccauuggggaaaauaagccuu

SEQ ID NO: 1304972 - RNA, 18 nt, Human
gaaaaucugguuaaauua

SEQ ID NO: 1304973 - RNA, 23 nt, Human
uaaacaaacuuuuaaaaaugcuc

SEQ ID NO: 1304974 - RNA, 24 nt, Human
ugaacuucuaaagcuauaucaagu

SEQ ID NO: 1304975 - RNA, 24 nt, Human
ugaugaguguuggguugaucaccu

SEQ ID NO: 1304976 - RNA, 19 nt, Human
ugcuuuacauauucagaaa

SEQ ID NO: 1304977 - RNA, 24 nt, Human
ugucagaaaaucugguuaaauuag

SEQ ID NO: 1304978 - RNA, 23 nt, Human
uguggaauuguaaacaaacuuuu

SEQ ID NO: 1304979 - RNA, 21 nt, Human
uuaaaaaauacaauguaauaa

SEQ ID NO: 1304980 - RNA, 20 nt, Human
uuuacauuuaaaaaauacaa

SEQ ID NO: 1304981 - RNA, 22 nt, Human
aaaugccagaaagaaaugaacu

SEQ ID NO: 1304982 - RNA, 20 nt, Human
agagguuuccuggucccugg

SEQ ID NO: 1304983 - RNA, 21 nt, Human
cagaaagaaaugaacugggua

SEQ ID NO: 1304984 - RNA, 18 nt, Human
caggcgggcuuccugccu

SEQ ID NO: 1304985 - RNA, 19 nt, Human
ccagcacucaagcaagagg

SEQ ID NO: 1304986 - RNA, 19 nt, Human
cuucuggccugaguuccag

SEQ ID NO: 1304987 - RNA, 25 nt, Human
ggagaggacggucggagcuucauug

SEQ ID NO: 1304988 - RNA, 23 nt, Human
ggaggggacauuuaagcuucaga

SEQ ID NO: 1304989 - RNA, 18 nt, Human
cagcagggggucgugccu

SEQ ID NO: 1304990 - RNA, 23 nt, Human
ccccgcagcagugggucgugccu

SEQ ID NO: 1304991 - RNA, 19 nt, Human
ccccucagcagggggucgu

SEQ ID NO: 1304992 - RNA, 18 nt, Human
ccccuuguccacuugucc

SEQ ID NO: 1304993 - RNA, 23 nt, Human
ccuuguccacuuguccuccuuca

SEQ ID NO: 1304994 - RNA, 21 nt, Human
cgggaacaggcaaguuauuuu

SEQ ID NO: 1304995 - RNA, 20 nt, Human
cugcagcagggguccgugcc

SEQ ID NO: 1304996 - RNA, 25 nt, Human
cuuguccuccuucacuaaucgguug

SEQ ID NO: 1304997 - RNA, 27 nt, Human
uauuuuaaaucuguaucuucuguuguc

SEQ ID NO: 1304998 - RNA, 24 nt, Human
uccgcagcagggggaucaugcccu

SEQ ID NO: 1304999 - RNA, 19 nt, Human
ucgugccugugaacagccc

SEQ ID NO: 1305000 - RNA, 27 nt, Human
ucuguaucuucuguugucaagaucugu

SEQ ID NO: 1305001 - RNA, 24 nt, Human
aagcacgucuaagagccuuaugag

SEQ ID NO: 1305002 - RNA, 18 nt, Human
caaccuccgggaccaucu

SEQ ID NO: 1305003 - RNA, 19 nt, Human
caagaagaugggugaccac

SEQ ID NO: 1305004 - RNA, 20 nt, Human
cacaggcugggaggcccaga

SEQ ID NO: 1305005 - RNA, 25 nt, Human
cagccuccgaccgcccuccaauuuc

SEQ ID NO: 1305006 - RNA, 21 nt, Human
cagugggucugucucuugcuu

SEQ ID NO: 1305007 - RNA, 21 nt, Human
ccacaggcugggaggcccaga

SEQ ID NO: 1305008 - RNA, 22 nt, Human
ccaccugacgaaccuccacagg

SEQ ID NO: 1305009 - RNA, 20 nt, Human
ccuagaugaggaagugaagc

SEQ ID NO: 1305010 - RNA, 18 nt, Human
ccuccacaggcugggagg

SEQ ID NO: 1305011 - RNA, 24 nt, Human
cuaagagccuuaugagcccagcga

SEQ ID NO: 1305012 - RNA, 25 nt, Human
cucaucaagaagaugggugaccacc

SEQ ID NO: 1305013 - RNA, 22 nt, Human
cucuccacuugcaaccuccggg

SEQ ID NO: 1305014 - RNA, 24 nt, Human
cuucugggaccugccagcaccguu

SEQ ID NO: 1305015 - RNA, 21 nt, Human
gaccaccugacgaaccuccac

SEQ ID NO: 1305016 - RNA, 25 nt, Human
gaccgcccuccaauuuccucuccac

SEQ ID NO: 1305017 - RNA, 21 nt, Human
gcgaguaucucuucgaaaggc

SEQ ID NO: 1305018 - RNA, 20 nt, Human
gggaggcccagaggcugggc

SEQ ID NO: 1305019 - RNA, 21 nt, Human
gggcugggcgaguaucucuuc

SEQ ID NO: 1305020 - RNA, 26 nt, Human
gggucugucucuugcuucaacagugu

SEQ ID NO: 1305021 - RNA, 21 nt, Human
uaagagccuuaugagcccagc

SEQ ID NO: 1305022 - RNA, 21 nt, Human
ucaagaagaugggugaccacc

SEQ ID NO: 1305023 - RNA, 21 nt, Human
uccagccuccgaccgcccucc

SEQ ID NO: 1305024 - RNA, 19 nt, Human
uccuggagacucacuuccu

SEQ ID NO: 1305025 - RNA, 24 nt, Human
uccuggagacucacuuccuagaug

SEQ ID NO: 1305026 - RNA, 21 nt, Human
ucugccuaagccucucccucc

SEQ ID NO: 1305027 - RNA, 22 nt, Human
ucugccuaagccucucccucca

SEQ ID NO: 1305028 - RNA, 23 nt, Human
ucugugacuuccuggagacucac

SEQ ID NO: 1305029 - RNA, 19 nt, Human
ugaagcucaucaagaagau

SEQ ID NO: 1305030 - RNA, 19 nt, Human
ugacuuccuggagacucac

SEQ ID NO: 1305031 - RNA, 20 nt, Human
ugccagcaccguuuuugucc

SEQ ID NO: 1305032 - RNA, 22 nt, Human
uggacggaacagauccggggac

SEQ ID NO: 1305033 - RNA, 23 nt, Human
uuggacggaacagauccggggac

SEQ ID NO: 1305034 - RNA, 24 nt, Human
uuuggacggaacagauccggggac

SEQ ID NO: 1305035 - RNA, 20 nt, Human
aaaggagaggcuacugcugc

SEQ ID NO: 1305036 - RNA, 22 nt, Human
aaggagaggcuacugcugcugc

SEQ ID NO: 1305037 - RNA, 23 nt, Human
agcacaaaagcgacagaagccca

SEQ ID NO: 1305038 - RNA, 19 nt, Human
agcagggaggacagagccc

SEQ ID NO: 1305039 - RNA, 20 nt, Human
agcccagagggcgagggucc

SEQ ID NO: 1305040 - RNA, 22 nt, Human
aggagaggcuacugcugcugcu

SEQ ID NO: 1305041 - RNA, 23 nt, Human
caaaagcgacagaagcccagagg

SEQ ID NO: 1305042 - RNA, 23 nt, Human
cacaaaagcgacagaagcccaga

SEQ ID NO: 1305043 - RNA, 18 nt, Human
cagcacaaaagcgacaga

SEQ ID NO: 1305044 - RNA, 22 nt, Human
ccaagggccuggaguggccaag

SEQ ID NO: 1305045 - RNA, 19 nt, Human
cccuggccccuuuccugga

SEQ ID NO: 1305046 - RNA, 19 nt, Human
cccugguugcugccugcuc

SEQ ID NO: 1305047 - RNA, 23 nt, Human
ccggcugugcccuggccccuuuc

SEQ ID NO: 1305048 - RNA, 22 nt, Human
ccuggaguggccaagggcggug

SEQ ID NO: 1305049 - RNA, 20 nt, Human
ccugugugggacucggaggc

SEQ ID NO: 1305050 - RNA, 18 nt, Human
cgagggucccaggagccu

SEQ ID NO: 1305051 - RNA, 20 nt, Human
cgccggcugugcccuggccc

SEQ ID NO: 1305052 - RNA, 19 nt, Human
cgguggggaaacggaggcc

SEQ ID NO: 1305053 - RNA, 20 nt, Human
gccggcugugcccuggcccc

SEQ ID NO: 1305054 - RNA, 19 nt, Human
ggaaacggaggccucaaaa

SEQ ID NO: 1305055 - RNA, 22 nt, Human
ggaaacggaggccucaaaagga

SEQ ID NO: 1305056 - RNA, 19 nt, Human
ggaagcagggaggacagag

SEQ ID NO: 1305057 - RNA, 18 nt, Human
uacugcugcugcuucugc

SEQ ID NO: 1305058 - RNA, 18 nt, Human
ucgccggcugugcccugg

SEQ ID NO: 1305059 - RNA, 24 nt, Human
ucggaggcuccgcggugucgccgg

SEQ ID NO: 1305060 - RNA, 18 nt, Human
ugagucaggggugcgagg

SEQ ID NO: 1305061 - RNA, 18 nt, Human
ugccugcucucucggcca

SEQ ID NO: 1305062 - RNA, 19 nt, Human
ugcugcugcuucugcuugc

SEQ ID NO: 1305063 - RNA, 23 nt, Human
uggaggaagcagggaggacagag

SEQ ID NO: 1305064 - RNA, 22 nt, Human
ugucccggugacugggugaggc

SEQ ID NO: 1305065 - RNA, 20 nt, Human
uugcugggccugugugggac

SEQ ID NO: 1305066 - RNA, 19 nt, Human
uuuggaggaagcagggagg

SEQ ID NO: 1305067 - RNA, 25 nt, Human
aaacugaaaugaaugaagcagucug

SEQ ID NO: 1305068 - RNA, 23 nt, Human
aaagggaaaugguaggagaagga

SEQ ID NO: 1305069 - RNA, 22 nt, Human
aagaggccaggcuaauggaaua

SEQ ID NO: 1305070 - RNA, 28 nt, Human
aagaggccaggcuaauggaauacagaca

SEQ ID NO: 1305071 - RNA, 19 nt, Human
aagcagccccucguuuguu

SEQ ID NO: 1305072 - RNA, 21 nt, Human
aagcagccccucguuuguuga

SEQ ID NO: 1305073 - RNA, 19 nt, Human
aauacagacaccagagagg

SEQ ID NO: 1305074 - RNA, 18 nt, Human
acauugaggcccagagcc

SEQ ID NO: 1305075 - RNA, 25 nt, Human
acugaagucacagaaacugaguuug

SEQ ID NO: 1305076 - RNA, 20 nt, Human
agagagggacugaagucaca

SEQ ID NO: 1305077 - RNA, 19 nt, Human
agagcaaggcagcaucugu

SEQ ID NO: 1305078 - RNA, 21 nt, Human
agcagaagacaguucaugugu

SEQ ID NO: 1305079 - RNA, 19 nt, Human
aggcagcaucugucuuggg

SEQ ID NO: 1305080 - RNA, 19 nt, Human
aggcaggggaggugcuggg

SEQ ID NO: 1305081 - RNA, 21 nt, Human
aggcaggggaggugcuggggg

SEQ ID NO: 1305082 - RNA, 21 nt, Human
aggcaggugccugugugguca

SEQ ID NO: 1305083 - RNA, 20 nt, Human
aggggaggugcugggggacc

SEQ ID NO: 1305084 - RNA, 20 nt, Human
aucccugucccugguuccuc

SEQ ID NO: 1305085 - RNA, 26 nt, Human
caacagagauugucuggaggauggcc

SEQ ID NO: 1305086 - RNA, 18 nt, Human
cacagaaacugaguuugc

SEQ ID NO: 1305087 - RNA, 21 nt, Human
cagaacaaagugggguccucu

SEQ ID NO: 1305088 - RNA, 24 nt, Human
cagaacaaagugggguccucuucc

SEQ ID NO: 1305089 - RNA, 26 nt, Human
cagaaucagcaucuccucuuuccugg

SEQ ID NO: 1305090 - RNA, 20 nt, Human
cagcaaaccucaaauaaaau

SEQ ID NO: 1305091 - RNA, 21 nt, Human
cagcaaaccucaaauaaaaua

SEQ ID NO: 1305092 - RNA, 19 nt, Human
caggacgcaguagauucug

SEQ ID NO: 1305093 - RNA, 23 nt, Human
cagggccagacccacacgcugcu

SEQ ID NO: 1305094 - RNA, 21 nt, Human
cagguguguguccuucuggcu

SEQ ID NO: 1305095 - RNA, 22 nt, Human
cccacacgcugcucaccgaggc

SEQ ID NO: 1305096 - RNA, 22 nt, Human
cccuggggcuggccaucgagcc

SEQ ID NO: 1305097 - RNA, 19 nt, Human
ccucggaggcuggcgcggc

SEQ ID NO: 1305098 - RNA, 22 nt, Human
cgagagcaaggcagcaucuguc

SEQ ID NO: 1305099 - RNA, 21 nt, Human
cggcggagcguuaggggagga

SEQ ID NO: 1305100 - RNA, 22 nt, Human
cggguaggagggaucagcugga

SEQ ID NO: 1305101 - RNA, 19 nt, Human
cguggccgagggccagugc

SEQ ID NO: 1305102 - RNA, 21 nt, Human
cucagaaucauggcgggaggc

SEQ ID NO: 1305103 - RNA, 18 nt, Human
cugcuggcgggagcuggc

SEQ ID NO: 1305104 - RNA, 20 nt, Human
cuggagcugacggaggucaa

SEQ ID NO: 1305105 - RNA, 19 nt, Human
cuguggaaaugcugagucu

SEQ ID NO: 1305106 - RNA, 21 nt, Human
gaagggacaggcgagagcaag

SEQ ID NO: 1305107 - RNA, 22 nt, Human
gagaauguggaguggcucuggg

SEQ ID NO: 1305108 - RNA, 27 nt, Human
gagagcaaggcagcaucugucuuggga

SEQ ID NO: 1305109 - RNA, 19 nt, Human
gaugcaucagggaagaggc

SEQ ID NO: 1305110 - RNA, 23 nt, Human
gcacauggcuggggaggccucag

SEQ ID NO: 1305111 - RNA, 19 nt, Human
gcacugggcccagagcagu

SEQ ID NO: 1305112 - RNA, 19 nt, Human
gccgcaggcgauccuggag

SEQ ID NO: 1305113 - RNA, 19 nt, Human
gcgcaaauaagaugacuga

SEQ ID NO: 1305114 - RNA, 21 nt, Human
gcguagcuugcuuguggcccc

SEQ ID NO: 1305115 - RNA, 19 nt, Human
gcgugcaggcagaggccag

SEQ ID NO: 1305116 - RNA, 19 nt, Human
ggaaaugcugagucugugu

SEQ ID NO: 1305117 - RNA, 28 nt, Human
ggaaaugguaggagaaggaccgguaccc

SEQ ID NO: 1305118 - RNA, 21 nt, Human
ggacaucgaguccacaggugu

SEQ ID NO: 1305119 - RNA, 21 nt, Human
ggcuuggaaacauugcuggua

SEQ ID NO: 1305120 - RNA, 20 nt, Human
guaaccccgaggcaggugcc

SEQ ID NO: 1305121 - RNA, 22 nt, Human
gucagccuggagcuggagcuga

SEQ ID NO: 1305122 - RNA, 19 nt, Human
guccagacaaggguagaag

SEQ ID NO: 1305123 - RNA, 22 nt, Human
uaaaaugagaacauugaggccc

SEQ ID NO: 1305124 - RNA, 24 nt, Human
uaagccaggugcuggggaaacuga

SEQ ID NO: 1305125 - RNA, 23 nt, Human
uacagacaccagagagggacuga

SEQ ID NO: 1305126 - RNA, 20 nt, Human
uagauucuggucaccgggua

SEQ ID NO: 1305127 - RNA, 21 nt, Human
ucagccuggagcuggagcuga

SEQ ID NO: 1305128 - RNA, 18 nt, Human
uccacagguguguguccu

SEQ ID NO: 1305129 - RNA, 23 nt, Human
ucccugguuccucuucacucauu

SEQ ID NO: 1305130 - RNA, 20 nt, Human
ucccuuagagaacugcugaa

SEQ ID NO: 1305131 - RNA, 23 nt, Human
ucccuuagagaacugcugaauuc

SEQ ID NO: 1305132 - RNA, 21 nt, Human
uccuggaggagaagcugaagc

SEQ ID NO: 1305133 - RNA, 25 nt, Human
ucucacaguguuucuuggggcuuca

SEQ ID NO: 1305134 - RNA, 24 nt, Human
ucuuaggucacugcagcaaaccuc

SEQ ID NO: 1305135 - RNA, 18 nt, Human
ugaaaugaaugaagcagu

SEQ ID NO: 1305136 - RNA, 23 nt, Human
ugaaaugaaugaagcagucugug

SEQ ID NO: 1305137 - RNA, 20 nt, Human
ugaaauguuaaaagcugugg

SEQ ID NO: 1305138 - RNA, 21 nt, Human
ugaaauguuaaaagcugugga

SEQ ID NO: 1305139 - RNA, 24 nt, Human
ugagaacauugaggcccagagcca

SEQ ID NO: 1305140 - RNA, 21 nt, Human
ugagucugugucuuuccccuu

SEQ ID NO: 1305141 - RNA, 24 nt, Human
ugcagcaaaccucaaauaaaauaa

SEQ ID NO: 1305142 - RNA, 18 nt, Human
ugcaucagggaagaggcc

SEQ ID NO: 1305143 - RNA, 19 nt, Human
ugcaucagggaagaggcca

SEQ ID NO: 1305144 - RNA, 21 nt, Human
ugcaucagggaagaggccagg

SEQ ID NO: 1305145 - RNA, 24 nt, Human
ugcuuguggccccuuagugugccc

SEQ ID NO: 1305146 - RNA, 18 nt, Human
uggaaaugcugagucugu

SEQ ID NO: 1305147 - RNA, 21 nt, Human
uggaauacagacaccagagag

SEQ ID NO: 1305148 - RNA, 22 nt, Human
uggaguggcucuggggcguagc

SEQ ID NO: 1305149 - RNA, 20 nt, Human
uggcagcccugggccaggcg

SEQ ID NO: 1305150 - RNA, 26 nt, Human
uggcagcuuugggaacuguggaguuu

SEQ ID NO: 1305151 - RNA, 20 nt, Human
uggccccuuagugugcccuc

SEQ ID NO: 1305152 - RNA, 23 nt, Human
uggcgggcggagucacccugggg

SEQ ID NO: 1305153 - RNA, 19 nt, Human
uggggaaacugaaaugaau

SEQ ID NO: 1305154 - RNA, 20 nt, Human
uguccuucuggcucaccucg

SEQ ID NO: 1305155 - RNA, 19 nt, Human
ugucuggaggauggccccu

SEQ ID NO: 1305156 - RNA, 21 nt, Human
uuaagccaggugcuggggaaa

SEQ ID NO: 1305157 - RNA, 18 nt, Human
uucuuacguggcagcagc

SEQ ID NO: 1305158 - RNA, 21 nt, Human
uugcucaccaaggcugucauu

SEQ ID NO: 1305159 - RNA, 20 nt, Human
uuguggaaguucuucuuggg

SEQ ID NO: 1305160 - RNA, 21 nt, Human
gagcgcgauguacgaggaggg

SEQ ID NO: 1305161 - RNA, 18 nt, Human
uguacgaggaggggggcu

SEQ ID NO: 1305162 - RNA, 20 nt, Human
caacagguuucuccgucugu

SEQ ID NO: 1305163 - RNA, 21 nt, Human
ccaacagguuucuccgucuuu

SEQ ID NO: 1305164 - RNA, 21 nt, Human
guuguaccaacagguuucucc

SEQ ID NO: 1305165 - RNA, 25 nt, Human
ucuguagcaggagugaugaugagac

SEQ ID NO: 1305166 - RNA, 22 nt, Human
aaaaaaaaaacugcccagaaaa

SEQ ID NO: 1305167 - RNA, 18 nt, Human
aaaaaaaaacugcccaga

SEQ ID NO: 1305168 - RNA, 21 nt, Human
aaaaaacugcccagaaaaccc

SEQ ID NO: 1305169 - RNA, 21 nt, Human
ccaguaauuaagcaaaaggga

SEQ ID NO: 1305170 - RNA, 25 nt, Human
cucuuuaaaaaaaaaacugcccaga

SEQ ID NO: 1305171 - RNA, 21 nt, Human
uaaaaaaaaaacugcccagaa

SEQ ID NO: 1305172 - RNA, 24 nt, Human
uaauccucuucuuacuccaacucu

SEQ ID NO: 1305173 - RNA, 24 nt, Human
uuuauuugccuuuccuuuuuaauc

SEQ ID NO: 1305174 - RNA, 18 nt, Human
acaaagcccuuuccagug

SEQ ID NO: 1305175 - RNA, 20 nt, Human
agcgcgccgagcaccgggcg

SEQ ID NO: 1305176 - RNA, 18 nt, Human
aggcguggcuuauucagu

SEQ ID NO: 1305177 - RNA, 19 nt, Human
agguccccccggucccgca

SEQ ID NO: 1305178 - RNA, 19 nt, Human
ccagcggcugugcugcggc

SEQ ID NO: 1305179 - RNA, 21 nt, Human
cccccggucccgcacccuacc

SEQ ID NO: 1305180 - RNA, 21 nt, Human
ccccggucccgcacccuaccc

SEQ ID NO: 1305181 - RNA, 19 nt, Human
ccccucugccuccaggucc

SEQ ID NO: 1305182 - RNA, 18 nt, Human
cccgcacccuacccugcg

SEQ ID NO: 1305183 - RNA, 19 nt, Human
cccgcgcggggucugaggc

SEQ ID NO: 1305184 - RNA, 21 nt, Human
cgcacgcccugccggguaagc

SEQ ID NO: 1305185 - RNA, 19 nt, Human
cgccauggagccggcgccc

SEQ ID NO: 1305186 - RNA, 22 nt, Human
cggcuccccgagcccggucgcc

SEQ ID NO: 1305187 - RNA, 19 nt, Human
cgguucuccccucugccuc

SEQ ID NO: 1305188 - RNA, 24 nt, Human
cugccuccagguccccccgguccc

SEQ ID NO: 1305189 - RNA, 19 nt, Human
cugcgcacgcccugccggg

SEQ ID NO: 1305190 - RNA, 19 nt, Human
gagagaggacuaggcagug

SEQ ID NO: 1305191 - RNA, 23 nt, Human
gagcccggucgccauggagccgg

SEQ ID NO: 1305192 - RNA, 21 nt, Human
gagcgcgcccuggacgcugcc

SEQ ID NO: 1305193 - RNA, 23 nt, Human
gagcgcgccgagcaccgggcggc

SEQ ID NO: 1305194 - RNA, 20 nt, Human
gcacgcccugccggguaagc

SEQ ID NO: 1305195 - RNA, 19 nt, Human
gcgccccgcgcggggucug

SEQ ID NO: 1305196 - RNA, 20 nt, Human
gcugcgggaccagcgggcgg

SEQ ID NO: 1305197 - RNA, 18 nt, Human
gcugugcugcggcgcgga

SEQ ID NO: 1305198 - RNA, 22 nt, Human
ggaccagcgggcgggcggcucc

SEQ ID NO: 1305199 - RNA, 19 nt, Human
uccccccggucccgcaccc

SEQ ID NO: 1305200 - RNA, 24 nt, Human
ucccggaaggcugcgggaccagcg

SEQ ID NO: 1305201 - RNA, 19 nt, Human
ugccggcaccgcuuccucc

SEQ ID NO: 1305202 - RNA, 21 nt, Human
ugggaggcguggcuuauucag

SEQ ID NO: 1305203 - RNA, 22 nt, Human
uuccucccggaaggcugcggga

SEQ ID NO: 1305204 - RNA, 27 nt, Human
aacacauaaauaauccaaccugaacgg

SEQ ID NO: 1305205 - RNA, 19 nt, Human
aagguggugggaaacugga

SEQ ID NO: 1305206 - RNA, 18 nt, Human
accgauccuggagucucu

SEQ ID NO: 1305207 - RNA, 18 nt, Human
agagaggguuaaagugcu

SEQ ID NO: 1305208 - RNA, 19 nt, Human
agagggaggggagaguggc

SEQ ID NO: 1305209 - RNA, 27 nt, Human
aggaagagggaggggagaguggcccaa

SEQ ID NO: 1305210 - RNA, 22 nt, Human
aggggaugggggaaggaagagg

SEQ ID NO: 1305211 - RNA, 22 nt, Human
augggggaaggaagagggaggg

SEQ ID NO: 1305212 - RNA, 23 nt, Human
auucuggagcugagucuggggaa

SEQ ID NO: 1305213 - RNA, 21 nt, Human
cacccuucccccagcuuccca

SEQ ID NO: 1305214 - RNA, 19 nt, Human
cagggauucuuuuccaccc

SEQ ID NO: 1305215 - RNA, 21 nt, Human
ccacaacacauaaauaaucca

SEQ ID NO: 1305216 - RNA, 20 nt, Human
ccugcucucugcucugguuu

SEQ ID NO: 1305217 - RNA, 18 nt, Human
ccuggagcgcagaaccug

SEQ ID NO: 1305218 - RNA, 20 nt, Human
ccugucuucccuccaauccc

SEQ ID NO: 1305219 - RNA, 23 nt, Human
cgaagaagguauucuggagcuga

SEQ ID NO: 1305220 - RNA, 20 nt, Human
cucccaccccugccuggccc

SEQ ID NO: 1305221 - RNA, 19 nt, Human
gaagagaggguuaaagugc

SEQ ID NO: 1305222 - RNA, 21 nt, Human
gaaggaagagggaggggagag

SEQ ID NO: 1305223 - RNA, 22 nt, Human
gaaggaagagggaggggagagu

SEQ ID NO: 1305224 - RNA, 23 nt, Human
gaccugucuucccuccaaucccc

SEQ ID NO: 1305225 - RNA, 22 nt, Human
gcagcgaagaagguauucugga

SEQ ID NO: 1305226 - RNA, 22 nt, Human
ggaaaggggaugggggaaggaa

SEQ ID NO: 1305227 - RNA, 19 nt, Human
ggaagguggggaggaaagg

SEQ ID NO: 1305228 - RNA, 21 nt, Human
ggccuggagcgcagaaccugc

SEQ ID NO: 1305229 - RNA, 18 nt, Human
ggcucucccaccccugcc

SEQ ID NO: 1305230 - RNA, 23 nt, Human
gggaagagaggguuaaagugcug

SEQ ID NO: 1305231 - RNA, 23 nt, Human
gggaagguggggaggaaagggga

SEQ ID NO: 1305232 - RNA, 23 nt, Human
ggggaugggggaaggaagaggga

SEQ ID NO: 1305233 - RNA, 19 nt, Human
guccugcucucugcucugg

SEQ ID NO: 1305234 - RNA, 22 nt, Human
gucuagaccugucuucccucca

SEQ ID NO: 1305235 - RNA, 22 nt, Human
uccaagguggugggaaacugga

SEQ ID NO: 1305236 - RNA, 19 nt, Human
ucccccagcuucccaauuc

SEQ ID NO: 1305237 - RNA, 25 nt, Human
ucccccagcuucccaauucuaccag

SEQ ID NO: 1305238 - RNA, 21 nt, Human
ucucugacuccggccuggagc

SEQ ID NO: 1305239 - RNA, 22 nt, Human
ugagucuggggaagguggggag

SEQ ID NO: 1305240 - RNA, 24 nt, Human
ugagucuggggaagguggggagga

SEQ ID NO: 1305241 - RNA, 21 nt, Human
ugggaggaguccaagguggug

SEQ ID NO: 1305242 - RNA, 25 nt, Human
uggggaagguggggaggaaaggggg

SEQ ID NO: 1305243 - RNA, 22 nt, Human
uggggaggaaaggggauggggg

SEQ ID NO: 1305244 - RNA, 22 nt, Human
ugggggaaggaagagggagggg

SEQ ID NO: 1305245 - RNA, 23 nt, Human
acagggacuguugccaucuccca

SEQ ID NO: 1305246 - RNA, 22 nt, Human
accgcucccgccucgcgcaugc

SEQ ID NO: 1305247 - RNA, 22 nt, Human
agaaacaggggaggcagagcca

SEQ ID NO: 1305248 - RNA, 20 nt, Human
agacaaccaugggaaccacu

SEQ ID NO: 1305249 - RNA, 22 nt, Human
agagaguagaggccagagccca

SEQ ID NO: 1305250 - RNA, 20 nt, Human
agagccagagggaggagaga

SEQ ID NO: 1305251 - RNA, 21 nt, Human
agaggccagagcccaggcagg

SEQ ID NO: 1305252 - RNA, 22 nt, Human
agaguagaggccagagcccagg

SEQ ID NO: 1305253 - RNA, 21 nt, Human
aggaagugucucccugacgga

SEQ ID NO: 1305254 - RNA, 20 nt, Human
aggcaggauacagcaccgug

SEQ ID NO: 1305255 - RNA, 19 nt, Human
aggcauuuggccagagcga

SEQ ID NO: 1305256 - RNA, 20 nt, Human
aggccagagcccaggcagga

SEQ ID NO: 1305257 - RNA, 24 nt, Human
aggggugggguuccuaaagggugg

SEQ ID NO: 1305258 - RNA, 20 nt, Human
caccgccacagacauaaggg

SEQ ID NO: 1305259 - RNA, 21 nt, Human
caccgugccaccgccacagac

SEQ ID NO: 1305260 - RNA, 23 nt, Human
cagcaccgugccaccgccacaga

SEQ ID NO: 1305261 - RNA, 21 nt, Human
caggccccugagaaacagggg

SEQ ID NO: 1305262 - RNA, 20 nt, Human
caugcgcauuggcugagccg

SEQ ID NO: 1305263 - RNA, 23 nt, Human
ccacagagggcuccugcuuugcc

SEQ ID NO: 1305264 - RNA, 22 nt, Human
ccagagcccaggcaggauacag

SEQ ID NO: 1305265 - RNA, 19 nt, Human
ccaggcaggauacagcacc

SEQ ID NO: 1305266 - RNA, 19 nt, Human
cccaagcacugccacagag

SEQ ID NO: 1305267 - RNA, 19 nt, Human
ccgacacccaagcacugcc

SEQ ID NO: 1305268 - RNA, 21 nt, Human
ccucagagccccgacacccaa

SEQ ID NO: 1305269 - RNA, 25 nt, Human
ccucagagccccgacacccaagcac

SEQ ID NO: 1305270 - RNA, 19 nt, Human
cgacacccaagcacugcca

SEQ ID NO: 1305271 - RNA, 23 nt, Human
cgggagaaaccgcucccgccucg

SEQ ID NO: 1305272 - RNA, 18 nt, Human
cguggagaggugaggccg

SEQ ID NO: 1305273 - RNA, 25 nt, Human
gaaacaggggaggcagagccagagg

SEQ ID NO: 1305274 - RNA, 19 nt, Human
gacguucccgucgaccccg

SEQ ID NO: 1305275 - RNA, 18 nt, Human
gacugguuucuaagacaa

SEQ ID NO: 1305276 - RNA, 19 nt, Human
gaggcagagccagagggag

SEQ ID NO: 1305277 - RNA, 19 nt, Human
gcacugccacagagggcuc

SEQ ID NO: 1305278 - RNA, 20 nt, Human
gccagagcgagaggcaucca

SEQ ID NO: 1305279 - RNA, 24 nt, Human
gccccugagaaacaggggaggcag

SEQ ID NO: 1305280 - RNA, 19 nt, Human
ggacugggaagucaucuuu

SEQ ID NO: 1305281 - RNA, 19 nt, Human
ggaggagagaguagaggcc

SEQ ID NO: 1305282 - RNA, 19 nt, Human
gggaggcagagccagaggg

SEQ ID NO: 1305283 - RNA, 24 nt, Human
uaaggggugggguuccuaaagggu

SEQ ID NO: 1305284 - RNA, 21 nt, Human
uacagcaccgugccaccgcca

SEQ ID NO: 1305285 - RNA, 18 nt, Human
uccagugacagggacugu

SEQ ID NO: 1305286 - RNA, 19 nt, Human
ugccacagagggcuccugc

SEQ ID NO: 1305287 - RNA, 19 nt, Human
ugugacgggagaaaccgcu

SEQ ID NO: 1305288 - RNA, 24 nt, Human
uucccggcuuccucuugcugacug

SEQ ID NO: 1305289 - RNA, 18 nt, Human
aaagugcugggauuacaa

SEQ ID NO: 1305290 - RNA, 24 nt, Human
aaagugcugggauuacaaguguga

SEQ ID NO: 1305291 - RNA, 19 nt, Human
aacugaacucccaggugcc

SEQ ID NO: 1305292 - RNA, 20 nt, Human
aagcguguuggggucuccuc

SEQ ID NO: 1305293 - RNA, 19 nt, Human
aaguagcugggauuauagg

SEQ ID NO: 1305294 - RNA, 24 nt, Human
aaguagcugggauuauaggcacac

SEQ ID NO: 1305295 - RNA, 24 nt, Human
aagugauccgccugccuuggcuuc

SEQ ID NO: 1305296 - RNA, 18 nt, Human
aagugcugggauuacaag

SEQ ID NO: 1305297 - RNA, 19 nt, Human
aagugcugggauuacaagu

SEQ ID NO: 1305298 - RNA, 26 nt, Human
aagugcugggauuacaagugugagcc

SEQ ID NO: 1305299 - RNA, 22 nt, Human
aauagagacaggguuucaccau

SEQ ID NO: 1305300 - RNA, 21 nt, Human
aaucaggaaggucggaaucuc

SEQ ID NO: 1305301 - RNA, 18 nt, Human
acaggguuucaccauguu

SEQ ID NO: 1305302 - RNA, 21 nt, Human
acaggguuucaccauguuggc

SEQ ID NO: 1305303 - RNA, 24 nt, Human
acaggguuucaccauguuggccag

SEQ ID NO: 1305304 - RNA, 18 nt, Human
accacuguccaaaagcau

SEQ ID NO: 1305305 - RNA, 18 nt, Human
accauguuggccaggcug

SEQ ID NO: 1305306 - RNA, 23 nt, Human
acccaggcuggaguguaguggug

SEQ ID NO: 1305307 - RNA, 20 nt, Human
acccuucuuuuuuuucuucu

SEQ ID NO: 1305308 - RNA, 21 nt, Human
accgccuggcuaauuuuugua

SEQ ID NO: 1305309 - RNA, 25 nt, Human
acucugucacccagacuggagugca

SEQ ID NO: 1305310 - RNA, 24 nt, Human
aggcacacaccacuaccgccuggc

SEQ ID NO: 1305311 - RNA, 19 nt, Human
aggcucaagugauucuccu

SEQ ID NO: 1305312 - RNA, 24 nt, Human
agugcaguagcacgaucucggcuc

SEQ ID NO: 1305313 - RNA, 24 nt, Human
agugcugggauuacaagugugagc

SEQ ID NO: 1305314 - RNA, 21 nt, Human
aguguaguggugcaaucucag

SEQ ID NO: 1305315 - RNA, 20 nt, Human
aguuauucuccugccucagc

SEQ ID NO: 1305316 - RNA, 18 nt, Human
aucucacucugucaccca

SEQ ID NO: 1305317 - RNA, 24 nt, Human
auuuuuguacuuuuaguagagaug

SEQ ID NO: 1305318 - RNA, 24 nt, Human
caaagugcugggauuacaagugug

SEQ ID NO: 1305319 - RNA, 23 nt, Human
caaccucuuccucccaggcucaa

SEQ ID NO: 1305320 - RNA, 22 nt, Human
caagugauccgccugccuuggc

SEQ ID NO: 1305321 - RNA, 22 nt, Human
caagugauucuccugucuuagc

SEQ ID NO: 1305322 - RNA, 21 nt, Human
caccauguuggccaggcuggu

SEQ ID NO: 1305323 - RNA, 24 nt, Human
caccauguuggccaggcuggucuc

SEQ ID NO: 1305324 - RNA, 27 nt, Human
caccauguuggccaggcuggucucaaa

SEQ ID NO: 1305325 - RNA, 24 nt, Human
cacccaggcuggaguguaguggug

SEQ ID NO: 1305326 - RNA, 23 nt, Human
cacucugucacccagacuggagu

SEQ ID NO: 1305327 - RNA, 24 nt, Human
cacucugucacccagacuggagug

SEQ ID NO: 1305328 - RNA, 21 nt, Human
cacugcaaccucuuccuccca

SEQ ID NO: 1305329 - RNA, 24 nt, Human
cacugcacccagccugaauuucuc

SEQ ID NO: 1305330 - RNA, 24 nt, Human
caggguuucaccauguuggccagg

SEQ ID NO: 1305331 - RNA, 28 nt, Human
caucucccggauuccaguuauucuccuu

SEQ ID NO: 1305332 - RNA, 24 nt, Human
cauguuggccaggcuggucucaaa

SEQ ID NO: 1305333 - RNA, 24 nt, Human
cauuuuguacuuuuaauagagaca

SEQ ID NO: 1305334 - RNA, 20 nt, Human
ccaaagugcugggauuacaa

SEQ ID NO: 1305335 - RNA, 21 nt, Human
ccaaagugcugggauuacaag

SEQ ID NO: 1305336 - RNA, 24 nt, Human
ccaaagugcugggauuacaagugu

SEQ ID NO: 1305337 - RNA, 19 nt, Human
ccacugcacccagccugaa

SEQ ID NO: 1305338 - RNA, 20 nt, Human
ccacugcacccagccugaau

SEQ ID NO: 1305339 - RNA, 23 nt, Human
ccagcagaggcuguguccucucc

SEQ ID NO: 1305340 - RNA, 24 nt, Human
ccaguuauucuccugccucagccu

SEQ ID NO: 1305341 - RNA, 20 nt, Human
cccaaccucagaccacuguc

SEQ ID NO: 1305342 - RNA, 23 nt, Human
cccaaguagcugggauuauaggc

SEQ ID NO: 1305343 - RNA, 24 nt, Human
cccaaguagcugggauuauaggca

SEQ ID NO: 1305344 - RNA, 23 nt, Human
cccaggcucaagugauucuccuc

SEQ ID NO: 1305345 - RNA, 20 nt, Human
ccgccuggcuaauuuuugua

SEQ ID NO: 1305346 - RNA, 21 nt, Human
ccucaagugauccgccugccu

SEQ ID NO: 1305347 - RNA, 24 nt, Human
ccucccaggcucaagugauucucc

SEQ ID NO: 1305348 - RNA, 24 nt, Human
ccucucagguagcugggauuacag

SEQ ID NO: 1305349 - RNA, 22 nt, Human
ccugccuuggcuucccaaagug

SEQ ID NO: 1305350 - RNA, 22 nt, Human
ccuggagauccugggugaaugg

SEQ ID NO: 1305351 - RNA, 18 nt, Human
ccuggccucaagugaucc

SEQ ID NO: 1305352 - RNA, 18 nt, Human
ccuggccucaagugaucc

SEQ ID NO: 1305353 - RNA, 21 nt, Human
ccuggccucaagugauccgcc

SEQ ID NO: 1305354 - RNA, 23 nt, Human
ccuggccucaagugauccgccug

SEQ ID NO: 1305355 - RNA, 23 nt, Human
cucaagugauccgccugccuugg

SEQ ID NO: 1305356 - RNA, 18 nt, Human
cucaagugauucuccugu

SEQ ID NO: 1305357 - RNA, 24 nt, Human
cucacugcaacaugcaucucccgg

SEQ ID NO: 1305358 - RNA, 19 nt, Human
cucacugcaaccucuuccu

SEQ ID NO: 1305359 - RNA, 24 nt, Human
cucacugcaaccucuuccucccag

SEQ ID NO: 1305360 - RNA, 24 nt, Human
cucagccucucagguagcugggau

SEQ ID NO: 1305361 - RNA, 23 nt, Human
cucagguagcugggauuacaggu

SEQ ID NO: 1305362 - RNA, 24 nt, Human
cucagguagcugggauuacaggug

SEQ ID NO: 1305363 - RNA, 20 nt, Human
cucaugccaaccuggcaacc

SEQ ID NO: 1305364 - RNA, 19 nt, Human
cucccaggcucaagugauu

SEQ ID NO: 1305365 - RNA, 25 nt, Human
cucccaggcucaagugauucuccug

SEQ ID NO: 1305366 - RNA, 20 nt, Human
cucccaggugccgacagagu

SEQ ID NO: 1305367 - RNA, 23 nt, Human
cucccggauuccaguuauucucc

SEQ ID NO: 1305368 - RNA, 24 nt, Human
cuccugccacugucccaaccucag

SEQ ID NO: 1305369 - RNA, 23 nt, Human
cugcaaccucuuccucccaggcu

SEQ ID NO: 1305370 - RNA, 24 nt, Human
cugcaaccucuuccucccaggcuc

SEQ ID NO: 1305371 - RNA, 20 nt, Human
cugccaggcugaucucuugu

SEQ ID NO: 1305372 - RNA, 23 nt, Human
cugccucagccucucagguagcu

SEQ ID NO: 1305373 - RNA, 19 nt, Human
cugggugaaugguaucucc

SEQ ID NO: 1305374 - RNA, 23 nt, Human
cugucuuagccucccaaguagcu

SEQ ID NO: 1305375 - RNA, 23 nt, Human
cuuagccucccaaguagcuggga

SEQ ID NO: 1305376 - RNA, 18 nt, Human
cuuccucccaggcucaag

SEQ ID NO: 1305377 - RNA, 21 nt, Human
cuugcuuugucacccaggcug

SEQ ID NO: 1305378 - RNA, 24 nt, Human
cuugcuuugucacccaggcuggag

SEQ ID NO: 1305379 - RNA, 19 nt, Human
cuuuuaguagagauggggu

SEQ ID NO: 1305380 - RNA, 22 nt, Human
gacagaaucuugcuuugucacc

SEQ ID NO: 1305381 - RNA, 18 nt, Human
gauuacaagugugagcca

SEQ ID NO: 1305382 - RNA, 19 nt, Human
gauuacaagugugagccac

SEQ ID NO: 1305383 - RNA, 23 nt, Human
gauuacaagugugagccacugca

SEQ ID NO: 1305384 - RNA, 18 nt, Human
gauuacaggugccugcca

SEQ ID NO: 1305385 - RNA, 21 nt, Human
gccauaaugcccagcuccauu

SEQ ID NO: 1305386 - RNA, 22 nt, Human
gccuuggcuucccaaagugcug

SEQ ID NO: 1305387 - RNA, 24 nt, Human
gccuuggcuucccaaagugcuggg

SEQ ID NO: 1305388 - RNA, 21 nt, Human
gcucacugcaaccucuuccuc

SEQ ID NO: 1305389 - RNA, 23 nt, Human
gcuggucucaaacuccuggccuc

SEQ ID NO: 1305390 - RNA, 24 nt, Human
gcuugaagcguguuggggucuccu

SEQ ID NO: 1305391 - RNA, 24 nt, Human
ggcuggucucaaacuccuggccuc

SEQ ID NO: 1305392 - RNA, 22 nt, Human
ggguuucaccauguuggccagg

SEQ ID NO: 1305393 - RNA, 18 nt, Human
guagcugggauuacaggu

SEQ ID NO: 1305394 - RNA, 20 nt, Human
guagcugggauuacaggugc

SEQ ID NO: 1305395 - RNA, 18 nt, Human
guagcugggauuauaggc

SEQ ID NO: 1305396 - RNA, 18 nt, Human
guccaacugaacucccag

SEQ ID NO: 1305397 - RNA, 24 nt, Human
gugauucuccugucuuagccuccc

SEQ ID NO: 1305398 - RNA, 23 nt, Human
uaacugccaggcugaucucuugu

SEQ ID NO: 1305399 - RNA, 24 nt, Human
uaauagagacaggguuucaccaug

SEQ ID NO: 1305400 - RNA, 26 nt, Human
uaauagagacaggguuucaccauguu

SEQ ID NO: 1305401 - RNA, 24 nt, Human
uaauuuuuguacuuuuaguagaga

SEQ ID NO: 1305402 - RNA, 24 nt, Human
uacaagugugagccacugcaccca

SEQ ID NO: 1305403 - RNA, 21 nt, Human
uagagacaggguuucaccaug

SEQ ID NO: 1305404 - RNA, 22 nt, Human
uagagacaggguuucaccaugu

SEQ ID NO: 1305405 - RNA, 19 nt, Human
uauucuccugccucagccu

SEQ ID NO: 1305406 - RNA, 24 nt, Human
ucacccaggcuggaguguaguggu

SEQ ID NO: 1305407 - RNA, 24 nt, Human
ucacugcaacaugcaucucccgga

SEQ ID NO: 1305408 - RNA, 24 nt, Human
ucacugcaaccucuuccucccagg

SEQ ID NO: 1305409 - RNA, 25 nt, Human
ucaggaugggaaagaaaaguagggu

SEQ ID NO: 1305410 - RNA, 21 nt, Human
ucagguagcugggauuacagg

SEQ ID NO: 1305411 - RNA, 18 nt, Human
ucccaaagugcugggauu

SEQ ID NO: 1305412 - RNA, 23 nt, Human
ucccaaagugcugggauuacaag

SEQ ID NO: 1305413 - RNA, 24 nt, Human
ucccaaguagcugggauuauaggc

SEQ ID NO: 1305414 - RNA, 21 nt, Human
ucccaggcucaagugauucuc

SEQ ID NO: 1305415 - RNA, 24 nt, Human
ucccaggcucaagugauucuccug

SEQ ID NO: 1305416 - RNA, 21 nt, Human
ucccaggugccgacagagucc

SEQ ID NO: 1305417 - RNA, 18 nt, Human
uccccagguucuccuucc

SEQ ID NO: 1305418 - RNA, 21 nt, Human
uccccagguucuccuuccuga

SEQ ID NO: 1305419 - RNA, 21 nt, Human
ucccggauuccaguuauucuc

SEQ ID NO: 1305420 - RNA, 24 nt, Human
ucccggauuccaguuauucuccug

SEQ ID NO: 1305421 - RNA, 21 nt, Human
uccugggugaaugguaucucc

SEQ ID NO: 1305422 - RNA, 18 nt, Human
uccuuggucuucuucugg

SEQ ID NO: 1305423 - RNA, 24 nt, Human
ucucacucugucacccagacugga

SEQ ID NO: 1305424 - RNA, 26 nt, Human
ucucacucugucacccagacuggagu

SEQ ID NO: 1305425 - RNA, 27 nt, Human
ucucacucugucacccagacuggagug

SEQ ID NO: 1305426 - RNA, 23 nt, Human
ucucagguagcugggauuacagg

SEQ ID NO: 1305427 - RNA, 24 nt, Human
ucucagguagcugggauuacaggu

SEQ ID NO: 1305428 - RNA, 24 nt, Human
ucuccugccucagccucucaggua

SEQ ID NO: 1305429 - RNA, 26 nt, Human
ucuccugucuuagccucccaaguagc

SEQ ID NO: 1305430 - RNA, 24 nt, Human
ucugucacccagacuggagugcag

SEQ ID NO: 1305431 - RNA, 19 nt, Human
ucuuccucccaggcucaag

SEQ ID NO: 1305432 - RNA, 22 nt, Human
ucuugcuuugucacccaggcug

SEQ ID NO: 1305433 - RNA, 23 nt, Human
ucuugcuuugucacccaggcugg

SEQ ID NO: 1305434 - RNA, 24 nt, Human
ucuugcuuugucacccaggcugga

SEQ ID NO: 1305435 - RNA, 18 nt, Human
ucuuuuuuuuuuuuuuuu

SEQ ID NO: 1305436 - RNA, 21 nt, Human
ugaauuucuccauucuuccca

SEQ ID NO: 1305437 - RNA, 23 nt, Human
ugacccuucuuuuuuuucuucuu

SEQ ID NO: 1305438 - RNA, 22 nt, Human
ugcaguagcacgaucucggcuc

SEQ ID NO: 1305439 - RNA, 24 nt, Human
ugccucagccucucagguagcugg

SEQ ID NO: 1305440 - RNA, 19 nt, Human
ugccuuggcuucccaaagu

SEQ ID NO: 1305441 - RNA, 27 nt, Human
ugcugggauuacaagugugagccacug

SEQ ID NO: 1305442 - RNA, 24 nt, Human
ugcuuugucacccaggcuggagug

SEQ ID NO: 1305443 - RNA, 23 nt, Human
uggagugcaguagcacgaucucg

SEQ ID NO: 1305444 - RNA, 24 nt, Human
uggagugcaguagcacgaucucgg

SEQ ID NO: 1305445 - RNA, 23 nt, Human
uggaguguaguggugcaaucuca

SEQ ID NO: 1305446 - RNA, 24 nt, Human
uggaguguaguggugcaaucucag

SEQ ID NO: 1305447 - RNA, 24 nt, Human
uggccaggcuggucucaaacuccu

SEQ ID NO: 1305448 - RNA, 18 nt, Human
uggccucaagugauccgc

SEQ ID NO: 1305449 - RNA, 24 nt, Human
uggccucaagugauccgccugccu

SEQ ID NO: 1305450 - RNA, 19 nt, Human
ugggagaagucaggagugg

SEQ ID NO: 1305451 - RNA, 24 nt, Human
ugggagaagucaggaguggagaac

SEQ ID NO: 1305452 - RNA, 19 nt, Human
ugggauuacaagugugagc

SEQ ID NO: 1305453 - RNA, 21 nt, Human
ugggauuacaagugugagcca

SEQ ID NO: 1305454 - RNA, 22 nt, Human
ugggauuacaagugugagccac

SEQ ID NO: 1305455 - RNA, 22 nt, Human
ugggauuacaagugugagccac

SEQ ID NO: 1305456 - RNA, 24 nt, Human
ugggauuacaagugugagccacug

SEQ ID NO: 1305457 - RNA, 19 nt, Human
ugggauuacaggugccugc

SEQ ID NO: 1305458 - RNA, 21 nt, Human
ugggauuacaggugccugcca

SEQ ID NO: 1305459 - RNA, 21 nt, Human
ugggauuacaggugccugcca

SEQ ID NO: 1305460 - RNA, 22 nt, Human
ugggauuacaggugccugccau

SEQ ID NO: 1305461 - RNA, 21 nt, Human
ugggauuauaggcacacacca

SEQ ID NO: 1305462 - RNA, 22 nt, Human
ugggauuauaggcacacaccac

SEQ ID NO: 1305463 - RNA, 24 nt, Human
uggugcaaucucagcucacugcaa

SEQ ID NO: 1305464 - RNA, 20 nt, Human
uguacaugcccguuucagag

SEQ ID NO: 1305465 - RNA, 22 nt, Human
uguaguggugcaaucucagcuc

SEQ ID NO: 1305466 - RNA, 19 nt, Human
ugucacccaggcuggagug

SEQ ID NO: 1305467 - RNA, 21 nt, Human
uguccaaaagcaucuucaggg

SEQ ID NO: 1305468 - RNA, 22 nt, Human
ugucccagcagaggcugugucc

SEQ ID NO: 1305469 - RNA, 19 nt, Human
uguccuggagauccugggu

SEQ ID NO: 1305470 - RNA, 24 nt, Human
uuaauagagacaggguuucaccau

SEQ ID NO: 1305471 - RNA, 18 nt, Human
uuaguagagaugggguuu

SEQ ID NO: 1305472 - RNA, 21 nt, Human
uuccaguuauucuccugccuc

SEQ ID NO: 1305473 - RNA, 18 nt, Human
uuccugaccucugacccu

SEQ ID NO: 1305474 - RNA, 23 nt, Human
uucuucccacacacccuccccag

SEQ ID NO: 1305475 - RNA, 19 nt, Human
uugaagcguguuggggucu

SEQ ID NO: 1305476 - RNA, 24 nt, Human
uugaagcguguuggggucuccucu

SEQ ID NO: 1305477 - RNA, 24 nt, Human
uugcuuugucacccaggcuggagu

SEQ ID NO: 1305478 - RNA, 24 nt, Human
uuucaccauguuggccaggcuggu

SEQ ID NO: 1305479 - RNA, 20 nt, Human
uuuuuguacuuuuaguagag

SEQ ID NO: 1305480 - RNA, 26 nt, Human
uuuuuuuuuuuugagauagcaucuca

SEQ ID NO: 1305481 - RNA, 27 nt, Human
uuuuuuuuuuuuuuuuuuuuuuugggg

SEQ ID NO: 1305482 - RNA, 27 nt, Human
accccaccccugcuccuuggaggacaa

SEQ ID NO: 1305483 - RNA, 21 nt, Human
aucuuugucccaggccaggag

SEQ ID NO: 1305484 - RNA, 23 nt, Human
augguccagguucuucuagauga

SEQ ID NO: 1305485 - RNA, 24 nt, Human
cacaaaugguuccucuccuccuuc

SEQ ID NO: 1305486 - RNA, 22 nt, Human
cccaccccugcuccuuggagga

SEQ ID NO: 1305487 - RNA, 19 nt, Human
ccccuggguccgguguucu

SEQ ID NO: 1305488 - RNA, 23 nt, Human
ccccuggguccgguguucuucuc

SEQ ID NO: 1305489 - RNA, 20 nt, Human
ccgaugaccucaggccucca

SEQ ID NO: 1305490 - RNA, 25 nt, Human
ccucaagcagccuguugaaggccuc

SEQ ID NO: 1305491 - RNA, 19 nt, Human
cuagaaguaccccacccca

SEQ ID NO: 1305492 - RNA, 22 nt, Human
cucuccuccuuccugaugucug

SEQ ID NO: 1305493 - RNA, 19 nt, Human
ggacuccuagaaguacccc

SEQ ID NO: 1305494 - RNA, 23 nt, Human
uaaaguuccugcugaaaauccac

SEQ ID NO: 1305495 - RNA, 19 nt, Human
uaccccaccccaccccugc

SEQ ID NO: 1305496 - RNA, 22 nt, Human
uagaugaucugcacaaaugguu

SEQ ID NO: 1305497 - RNA, 20 nt, Human
ucaagcagccuguugaaggc

SEQ ID NO: 1305498 - RNA, 25 nt, Human
ucucaggccgaugaccucaggccuc

SEQ ID NO: 1305499 - RNA, 21 nt, Human
ucugcacaaaugguuccucuc

SEQ ID NO: 1305500 - RNA, 22 nt, Human
ugaucugcacaaaugguuccuc

SEQ ID NO: 1305501 - RNA, 23 nt, Human
uggaauaaaguuccugcugaaaa

SEQ ID NO: 1305502 - RNA, 19 nt, Human
agaggcggaggggagaugg

SEQ ID NO: 1305503 - RNA, 19 nt, Human
aggcggaggggagaugggu

SEQ ID NO: 1305504 - RNA, 24 nt, Human
aggcggaggggagaugggucggcu

SEQ ID NO: 1305505 - RNA, 18 nt, Human
cagccggggcgcgggcgg

SEQ ID NO: 1305506 - RNA, 21 nt, Human
ccagccguuccuauggcgaca

SEQ ID NO: 1305507 - RNA, 24 nt, Human
cccgggcuccgcucggccgcuccc

SEQ ID NO: 1305508 - RNA, 18 nt, Human
ccgcucccucuccgcaga

SEQ ID NO: 1305509 - RNA, 19 nt, Human
gcagccaaagaggcggagg

SEQ ID NO: 1305510 - RNA, 18 nt, Human
ggagucuccgggacccgg

SEQ ID NO: 1305511 - RNA, 22 nt, Human
ggccggaggugcaacugcagcc

SEQ ID NO: 1305512 - RNA, 18 nt, Human
ggcgcgggcgguugcgcu

SEQ ID NO: 1305513 - RNA, 21 nt, Human
ggcggaggggagauggguccc

SEQ ID NO: 1305514 - RNA, 23 nt, Human
gggacagccggggcgcgggcggu

SEQ ID NO: 1305515 - RNA, 24 nt, Human
uaaccuccaacgccagccguuccu

SEQ ID NO: 1305516 - RNA, 22 nt, Human
ucuccgggacccgggcuccgcu

SEQ ID NO: 1305517 - RNA, 18 nt, Human
uggccggaggugcaacug

SEQ ID NO: 1305518 - RNA, 30 nt, Human
caccuuugccaucuccccauguucccaauu

SEQ ID NO: 1305519 - RNA, 23 nt, Human
ccacucucccuuugaucugcauu

SEQ ID NO: 1305520 - RNA, 18 nt, Human
ccccauguucccaauuca

SEQ ID NO: 1305521 - RNA, 19 nt, Human
cugcauuuguauuucuucu

SEQ ID NO: 1305522 - RNA, 20 nt, Human
gaauaucucuugaagucugg

SEQ ID NO: 1305523 - RNA, 18 nt, Human
gauguucuucaguggcag

SEQ ID NO: 1305524 - RNA, 24 nt, Human
gccaucuccccauguucccaauuc

SEQ ID NO: 1305525 - RNA, 21 nt, Human
gucuggaaaucucaaccacuc

SEQ ID NO: 1305526 - RNA, 22 nt, Human
uaacuggugaacgccaucaauc

SEQ ID NO: 1305527 - RNA, 18 nt, Human
ucagguugucuuucaguc

SEQ ID NO: 1305528 - RNA, 20 nt, Human
ucaguugcccccacaacuaa

SEQ ID NO: 1305529 - RNA, 24 nt, Human
ucaucuucaccuuugccaucuccc

SEQ ID NO: 1305530 - RNA, 19 nt, Human
ucucaaccacucucccuuu

SEQ ID NO: 1305531 - RNA, 21 nt, Human
ugcauuuguauuucuucuggg

SEQ ID NO: 1305532 - RNA, 22 nt, Human
ugucuucguugccuuccuugau

SEQ ID NO: 1305533 - RNA, 27 nt, Human
uuaauggccucucuuaugucuucguug

SEQ ID NO: 1305534 - RNA, 21 nt, Human
uucaccuuugccaucucccca

SEQ ID NO: 1305535 - RNA, 18 nt, Human
uuccuugauauuuucagu

SEQ ID NO: 1305536 - RNA, 26 nt, Human
uugccuuccuugauauuuucaguugc

SEQ ID NO: 1305537 - RNA, 21 nt, Human
uuguuuuuaauggccucucuu

SEQ ID NO: 1305538 - RNA, 19 nt, Human
aaggcugaagauuacugac

SEQ ID NO: 1305539 - RNA, 21 nt, Human
aauuuccuccucaacacaggc

SEQ ID NO: 1305540 - RNA, 19 nt, Human
accggcgagcggcuccucc

SEQ ID NO: 1305541 - RNA, 23 nt, Human
agacaggcugcucaggucggacc

SEQ ID NO: 1305542 - RNA, 24 nt, Human
agacaggcugcucaggucggaccc

SEQ ID NO: 1305543 - RNA, 18 nt, Human
auaauuuccuccucaaca

SEQ ID NO: 1305544 - RNA, 20 nt, Human
caaggccgaagaaaacauuc

SEQ ID NO: 1305545 - RNA, 23 nt, Human
caguuccaaguggaaggcugaag

SEQ ID NO: 1305546 - RNA, 19 nt, Human
cccugaacugccuugaccc

SEQ ID NO: 1305547 - RNA, 20 nt, Human
ccgugggccucucucugucu

SEQ ID NO: 1305548 - RNA, 22 nt, Human
ccucucucugucugaagacagg

SEQ ID NO: 1305549 - RNA, 24 nt, Human
cucaacacaggcuggagauauacu

SEQ ID NO: 1305550 - RNA, 23 nt, Human
cuuugacccugaacugccuugac

SEQ ID NO: 1305551 - RNA, 19 nt, Human
gcccggccccuccccuccc

SEQ ID NO: 1305552 - RNA, 18 nt, Human
gcggaggcggcaaaaccg

SEQ ID NO: 1305553 - RNA, 20 nt, Human
gcugcgaaggcaaaggcgga

SEQ ID NO: 1305554 - RNA, 23 nt, Human
gcugcgaaggcaaaggcggaggc

SEQ ID NO: 1305555 - RNA, 19 nt, Human
ggccccuccccuccccgcc

SEQ ID NO: 1305556 - RNA, 19 nt, Human
ggcuccucccgcccggccc

SEQ ID NO: 1305557 - RNA, 18 nt, Human
gugggccucucucugucu

SEQ ID NO: 1305558 - RNA, 24 nt, Human
uacuuugacccugaacugccuuga

SEQ ID NO: 1305559 - RNA, 21 nt, Human
ucccgcccggcccggcccggc

SEQ ID NO: 1305560 - RNA, 20 nt, Human
ucucucugucugaagacagg

SEQ ID NO: 1305561 - RNA, 24 nt, Human
ucuuuucauuauuauuguaauaau

SEQ ID NO: 1305562 - RNA, 18 nt, Human
ugcccuggaggcggcugc

SEQ ID NO: 1305563 - RNA, 25 nt, Human
ugccuugacccuuaauugauaacuc

SEQ ID NO: 1305564 - RNA, 18 nt, Human
ugguucuuuggagaaaua

SEQ ID NO: 1305565 - RNA, 23 nt, Human
uucaaggccgaagaaaacauuca

SEQ ID NO: 1305566 - RNA, 21 nt, Human
uuccaaguggaaggcugaaga

SEQ ID NO: 1305567 - RNA, 25 nt, Human
uuuauugcuauuaucacucuuuuca

SEQ ID NO: 1305568 - RNA, 19 nt, Human
aagcacucagaaaaggggc

SEQ ID NO: 1305569 - RNA, 23 nt, Human
acuuccaagcacucagaaaaggg

SEQ ID NO: 1305570 - RNA, 25 nt, Human
agagaggcaaccgcucugugucuuc

SEQ ID NO: 1305571 - RNA, 19 nt, Human
aggaaucacagguuaaucu

SEQ ID NO: 1305572 - RNA, 18 nt, Human
aggagagagcaggcggug

SEQ ID NO: 1305573 - RNA, 19 nt, Human
auccugccguuuucuucug

SEQ ID NO: 1305574 - RNA, 24 nt, Human
cacucagaaaaggggcauggccuc

SEQ ID NO: 1305575 - RNA, 26 nt, Human
cagcugcacugccagaaucggagcgc

SEQ ID NO: 1305576 - RNA, 22 nt, Human
caggaaggccuggguuuuggug

SEQ ID NO: 1305577 - RNA, 19 nt, Human
caggagagagcaggcggug

SEQ ID NO: 1305578 - RNA, 23 nt, Human
ccuccacguccuccagggcggcu

SEQ ID NO: 1305579 - RNA, 19 nt, Human
cgccucugaauuuauaccc

SEQ ID NO: 1305580 - RNA, 23 nt, Human
cggacaggaacuggcucuuuccg

SEQ ID NO: 1305581 - RNA, 21 nt, Human
cggcagcggugacccagggcc

SEQ ID NO: 1305582 - RNA, 21 nt, Human
cgggggaaaaggcguggucac

SEQ ID NO: 1305583 - RNA, 24 nt, Human
cuccaggacuguggcugccucccc

SEQ ID NO: 1305584 - RNA, 21 nt, Human
cuggcccuggaucuuucagga

SEQ ID NO: 1305585 - RNA, 20 nt, Human
cuggucaaacucccaaaaau

SEQ ID NO: 1305586 - RNA, 18 nt, Human
gcugaguucgugcgcgug

SEQ ID NO: 1305587 - RNA, 20 nt, Human
ggccagccaggaaucacagg

SEQ ID NO: 1305588 - RNA, 18 nt, Human
gggggaaaaggcgugguc

SEQ ID NO: 1305589 - RNA, 20 nt, Human
ggugcauggacggacaggaa

SEQ ID NO: 1305590 - RNA, 24 nt, Human
ggugcauggacggacaggaacugg

SEQ ID NO: 1305591 - RNA, 23 nt, Human
ucagaaaucguuggcugaguucg

SEQ ID NO: 1305592 - RNA, 21 nt, Human
uccaggaaggccuggguuuug

SEQ ID NO: 1305593 - RNA, 21 nt, Human
ucccacagcugcacugccaga

SEQ ID NO: 1305594 - RNA, 20 nt, Human
uccccaauccuggggaaccu

SEQ ID NO: 1305595 - RNA, 18 nt, Human
uccccuagcaccuccagg

SEQ ID NO: 1305596 - RNA, 24 nt, Human
ucuccaggacuguggcugccuccc

SEQ ID NO: 1305597 - RNA, 18 nt, Human
ugagaagggcguuguggg

SEQ ID NO: 1305598 - RNA, 22 nt, Human
ugagcuuccaacuccccaaucc

SEQ ID NO: 1305599 - RNA, 23 nt, Human
ugagcuuccaacuccccaauccu

SEQ ID NO: 1305600 - RNA, 18 nt, Human
ugauuccggguccugucc

SEQ ID NO: 1305601 - RNA, 21 nt, Human
ugggaggacaagcgagucuca

SEQ ID NO: 1305602 - RNA, 19 nt, Human
uggucaaacucccaaaaau

SEQ ID NO: 1305603 - RNA, 22 nt, Human
ugugggcagcuccaugccaugg

SEQ ID NO: 1305604 - RNA, 22 nt, Human
uguucaggcucaggccucucca

SEQ ID NO: 1305605 - RNA, 19 nt, Human
ugaagucauuguucuuaua

SEQ ID NO: 1305606 - RNA, 20 nt, Human
ugggguccccuuccuuugcc

SEQ ID NO: 1305607 - RNA, 22 nt, Human
ugggguccccuuccuuugccag

SEQ ID NO: 1305608 - RNA, 21 nt, Human
uuugaagucauuguucuuaua

SEQ ID NO: 1305609 - RNA, 24 nt, Human
acggcgcuggucggcugaggcagg

SEQ ID NO: 1305610 - RNA, 22 nt, Human
aggacggggacaggggcgacgg

SEQ ID NO: 1305611 - RNA, 27 nt, Human
caccacagcgucaggggcugaggcccg

SEQ ID NO: 1305612 - RNA, 24 nt, Human
ccccgcuccucccacuucucuuuc

SEQ ID NO: 1305613 - RNA, 18 nt, Human
ccucccacuucucuuucc

SEQ ID NO: 1305614 - RNA, 21 nt, Human
ccucccacuucucuuuccuug

SEQ ID NO: 1305615 - RNA, 18 nt, Human
ccuccgcagcauccucgc

SEQ ID NO: 1305616 - RNA, 24 nt, Human
ccucugcggccuuucccuccucuc

SEQ ID NO: 1305617 - RNA, 18 nt, Human
ccuuggucugggcugcac

SEQ ID NO: 1305618 - RNA, 21 nt, Human
cgacggcgaggcgcggcggag

SEQ ID NO: 1305619 - RNA, 25 nt, Human
cggagcaggacucucggcuucuccu

SEQ ID NO: 1305620 - RNA, 24 nt, Human
cggccucugcggccuuucccuccu

SEQ ID NO: 1305621 - RNA, 22 nt, Human
cggcgaggcgcggcggagucac

SEQ ID NO: 1305622 - RNA, 18 nt, Human
cggcgccggagcaggacu

SEQ ID NO: 1305623 - RNA, 23 nt, Human
cucgcggccucugcggccuuucc

SEQ ID NO: 1305624 - RNA, 24 nt, Human
cucgcggccucugcggccuuuccc

SEQ ID NO: 1305625 - RNA, 22 nt, Human
cugcggccuuucccuccucucg

SEQ ID NO: 1305626 - RNA, 20 nt, Human
gagcguagucguccugagcc

SEQ ID NO: 1305627 - RNA, 19 nt, Human
gcugcaaccgccacggccg

SEQ ID NO: 1305628 - RNA, 21 nt, Human
ggugcuccggcggcgccggag

SEQ ID NO: 1305629 - RNA, 21 nt, Human
ucagugaagaaauuagcaggg

SEQ ID NO: 1305630 - RNA, 22 nt, Human
ucccuuauagaaaugguggagu

SEQ ID NO: 1305631 - RNA, 25 nt, Human
uccgcagcauccucgcggccucugc

SEQ ID NO: 1305632 - RNA, 18 nt, Human
uccugagccgcggaggac

SEQ ID NO: 1305633 - RNA, 21 nt, Human
ucugcggccuuucccuccucu

SEQ ID NO: 1305634 - RNA, 22 nt, Human
uggagucagugaagaaauuagc

SEQ ID NO: 1305635 - RNA, 18 nt, Human
uggucggcugaggcaggc

SEQ ID NO: 1305636 - RNA, 23 nt, Human
uggucugggcugcacaacuaggc

SEQ ID NO: 1305637 - RNA, 23 nt, Human
uucucuuuccuuggucugggcug

SEQ ID NO: 1305638 - RNA, 22 nt, Human
ccucuaagauuauaguuauuaa

SEQ ID NO: 1305639 - RNA, 23 nt, Human
aaaacaccagcaccaagaguuca

SEQ ID NO: 1305640 - RNA, 20 nt, Human
aacaccagcaccaagaguuc

SEQ ID NO: 1305641 - RNA, 18 nt, Human
aagaauggccucaaccuc

SEQ ID NO: 1305642 - RNA, 18 nt, Human
agaguucauccugguccu

SEQ ID NO: 1305643 - RNA, 19 nt, Human
agugaacaugggcaggaua

SEQ ID NO: 1305644 - RNA, 21 nt, Human
auaaagcuuccacccuccccu

SEQ ID NO: 1305645 - RNA, 18 nt, Human
caaaacaccagcaccaag

SEQ ID NO: 1305646 - RNA, 23 nt, Human
caaaacaccagcaccaagaguuc

SEQ ID NO: 1305647 - RNA, 20 nt, Human
cacaucuucagcaccuggga

SEQ ID NO: 1305648 - RNA, 26 nt, Human
caccagcaccaagaguucauccuggu

SEQ ID NO: 1305649 - RNA, 18 nt, Human
caggccagaaaauaucac

SEQ ID NO: 1305650 - RNA, 18 nt, Human
caggggcucuuucugccc

SEQ ID NO: 1305651 - RNA, 18 nt, Human
caguccuucuccuccguu

SEQ ID NO: 1305652 - RNA, 26 nt, Human
ccaaaacaccagcaccaagaguucau

SEQ ID NO: 1305653 - RNA, 20 nt, Human
ccaaaauccuucuuuauccu

SEQ ID NO: 1305654 - RNA, 18 nt, Human
ccaggccagaaaauauca

SEQ ID NO: 1305655 - RNA, 20 nt, Human
cccuccaaaauccuucuuua

SEQ ID NO: 1305656 - RNA, 26 nt, Human
cccuuccagaagaaccuuccccucca

SEQ ID NO: 1305657 - RNA, 19 nt, Human
cuagacuucaacccuacaa

SEQ ID NO: 1305658 - RNA, 19 nt, Human
cugccaguccuucuccucc

SEQ ID NO: 1305659 - RNA, 18 nt, Human
cugcccaaaacaccagca

SEQ ID NO: 1305660 - RNA, 22 nt, Human
cugggaucugccaguccuucuc

SEQ ID NO: 1305661 - RNA, 21 nt, Human
cuuccacccuccccuuccaga

SEQ ID NO: 1305662 - RNA, 20 nt, Human
cuuccagaagaaccuucccc

SEQ ID NO: 1305663 - RNA, 24 nt, Human
gaaagccaggccagaaaauaucac

SEQ ID NO: 1305664 - RNA, 19 nt, Human
gagagggaaagccaggcca

SEQ ID NO: 1305665 - RNA, 21 nt, Human
gcccaaaacaccagcaccaag

SEQ ID NO: 1305666 - RNA, 18 nt, Human
gcugaauaaagcuuccac

SEQ ID NO: 1305667 - RNA, 26 nt, Human
uaaagcuuccacccuccccuuccaga

SEQ ID NO: 1305668 - RNA, 18 nt, Human
uaaggcauuuccgaaguc

SEQ ID NO: 1305669 - RNA, 25 nt, Human
ucaacccuacaauggagugaacaug

SEQ ID NO: 1305670 - RNA, 19 nt, Human
uccaaaauccuucuuuauc

SEQ ID NO: 1305671 - RNA, 19 nt, Human
uccacccuccccuuccaga

SEQ ID NO: 1305672 - RNA, 22 nt, Human
uccagaagaaccuuccccucca

SEQ ID NO: 1305673 - RNA, 23 nt, Human
ucugagagggaaagccaggccag

SEQ ID NO: 1305674 - RNA, 19 nt, Human
ucuucagcaccugggaucu

SEQ ID NO: 1305675 - RNA, 18 nt, Human
ugaauuacaacaccuagu

SEQ ID NO: 1305676 - RNA, 23 nt, Human
ugagagaaaagaagccucaggcu

SEQ ID NO: 1305677 - RNA, 22 nt, Human
ugggaaaugagagaaaagaagc

SEQ ID NO: 1305678 - RNA, 19 nt, Human
uucaagaauggccucaacc

SEQ ID NO: 1305679 - RNA, 20 nt, Human
uuuccgaaguccuuccaugg

SEQ ID NO: 1305680 - RNA, 20 nt, Human
aauaccggcggggaggggag

SEQ ID NO: 1305681 - RNA, 18 nt, Human
accggcggggaggggagg

SEQ ID NO: 1305682 - RNA, 25 nt, Human
agcagccggcgucuccgccagcgcc

SEQ ID NO: 1305683 - RNA, 22 nt, Human
ccugcuccuuccacugcggccg

SEQ ID NO: 1305684 - RNA, 24 nt, Human
cggcggggaggggaggagcagccg

SEQ ID NO: 1305685 - RNA, 18 nt, Human
cggggaggggaggagcag

SEQ ID NO: 1305686 - RNA, 23 nt, Human
cuaacuguggaugugucuucucc

SEQ ID NO: 1305687 - RNA, 21 nt, Human
gaagaaagugcuaacugugga

SEQ ID NO: 1305688 - RNA, 24 nt, Human
gcagccggcgucuccgccagcgcc

SEQ ID NO: 1305689 - RNA, 25 nt, Human
gccugcuccuuccacugcggccgcc

SEQ ID NO: 1305690 - RNA, 18 nt, Human
uaccggcggggaggggag

SEQ ID NO: 1305691 - RNA, 21 nt, Human
uggaugugucuucuccagaga

SEQ ID NO: 1305692 - RNA, 18 nt, Human
augagucagucguuucuu

SEQ ID NO: 1305693 - RNA, 18 nt, Human
ugagucagucguuucuuc

SEQ ID NO: 1305694 - RNA, 28 nt, Human
aaacaaaaaugggacauccaaacuccag

SEQ ID NO: 1305695 - RNA, 25 nt, Human
aauguaggaguuccuccagguacca

SEQ ID NO: 1305696 - RNA, 22 nt, Human
accaucaguuucccuaguucug

SEQ ID NO: 1305697 - RNA, 20 nt, Human
aggcugucuggccuugggau

SEQ ID NO: 1305698 - RNA, 20 nt, Human
ccaucaguuucccuaguucu

SEQ ID NO: 1305699 - RNA, 23 nt, Human
ggaguuccuccagguacucacuu

SEQ ID NO: 1305700 - RNA, 26 nt, Human
uaaaacaaaaaugggacauccaaacc

SEQ ID NO: 1305701 - RNA, 18 nt, Human
uaggaguuccuccaggua

SEQ ID NO: 1305702 - RNA, 18 nt, Human
uaguucagauggaucuua

SEQ ID NO: 1305703 - RNA, 18 nt, Human
uaguucagauggaucuua

SEQ ID NO: 1305704 - RNA, 22 nt, Human
uaguucagauggaucuuaccag

SEQ ID NO: 1305705 - RNA, 24 nt, Human
uaucacaguuaaaauuauaguuaa

SEQ ID NO: 1305706 - RNA, 19 nt, Human
uauuuaauagagggacacc

SEQ ID NO: 1305707 - RNA, 24 nt, Human
ucuggccuugggauuccaggagga

SEQ ID NO: 1305708 - RNA, 22 nt, Human
uccaccucgcuggaaauaccgc

SEQ ID NO: 1305709 - RNA, 21 nt, Human
gaugcuguccgggcugaugcg

SEQ ID NO: 1305710 - RNA, 21 nt, Human
ugaugcuguccgggcugaugc

SEQ ID NO: 1305711 - RNA, 19 nt, Human
aaauaaacuuaaacuauaa

SEQ ID NO: 1305712 - RNA, 23 nt, Human
aaccucuagcucccuuucggcuu

SEQ ID NO: 1305713 - RNA, 26 nt, Human
aagccacagagacccacucucuuuua

SEQ ID NO: 1305714 - RNA, 19 nt, Human
aagcccuuuuuaggucauc

SEQ ID NO: 1305715 - RNA, 21 nt, Human
aaguauuaaauagugcaaacu

SEQ ID NO: 1305716 - RNA, 24 nt, Human
aaucucuggauuugaaccucuagc

SEQ ID NO: 1305717 - RNA, 26 nt, Human
acaaagaaaucauguuacuucuucca

SEQ ID NO: 1305718 - RNA, 18 nt, Human
agaaugccaccacugccc

SEQ ID NO: 1305719 - RNA, 19 nt, Human
agaaugccaccacugcccc

SEQ ID NO: 1305720 - RNA, 21 nt, Human
agacagagaucuaaccaggcg

SEQ ID NO: 1305721 - RNA, 20 nt, Human
agcacugaucaacaccucca

SEQ ID NO: 1305722 - RNA, 20 nt, Human
agcucccuuucggcuuucug

SEQ ID NO: 1305723 - RNA, 24 nt, Human
agugcaaacuuggggcaaaccaca

SEQ ID NO: 1305724 - RNA, 23 nt, Human
aguucucggccuuuaaacaacuc

SEQ ID NO: 1305725 - RNA, 22 nt, Human
augagcccagagcacauacaaa

SEQ ID NO: 1305726 - RNA, 23 nt, Human
augcugccauuuguuuuccuguc

SEQ ID NO: 1305727 - RNA, 19 nt, Human
auucuuggcaacagaacaa

SEQ ID NO: 1305728 - RNA, 19 nt, Human
auuuaaaaagcucccccaa

SEQ ID NO: 1305729 - RNA, 23 nt, Human
caaaaucccaccaagcacugauc

SEQ ID NO: 1305730 - RNA, 21 nt, Human
caacagaacaaaugaaacaca

SEQ ID NO: 1305731 - RNA, 19 nt, Human
caacugcugcagcucauga

SEQ ID NO: 1305732 - RNA, 24 nt, Human
caccaagcacugaucaacaccucc

SEQ ID NO: 1305733 - RNA, 24 nt, Human
cagagugaacaucagugaaagcca

SEQ ID NO: 1305734 - RNA, 21 nt, Human
caucaaaaaagaguacaacug

SEQ ID NO: 1305735 - RNA, 18 nt, Human
cauguccccagaaugcca

SEQ ID NO: 1305736 - RNA, 18 nt, Human
ccaaaccgagcagucaug

SEQ ID NO: 1305737 - RNA, 21 nt, Human
ccagaaguggcugucucaugg

SEQ ID NO: 1305738 - RNA, 21 nt, Human
ccagaaugccaccacugcccc

SEQ ID NO: 1305739 - RNA, 18 nt, Human
ccagagcacauacaaauc

SEQ ID NO: 1305740 - RNA, 22 nt, Human
ccagcugauguuccacuuguuc

SEQ ID NO: 1305741 - RNA, 23 nt, Human
cccagaaugccaccacugccccu

SEQ ID NO: 1305742 - RNA, 23 nt, Human
cccaggcugggagugggugagac

SEQ ID NO: 1305743 - RNA, 24 nt, Human
ccccagaaugccaccacugccccu

SEQ ID NO: 1305744 - RNA, 27 nt, Human
ccccagaaugccaccacugccccugcc

SEQ ID NO: 1305745 - RNA, 18 nt, Human
ccccaggcugggaguggg

SEQ ID NO: 1305746 - RNA, 18 nt, Human
cccguggauaccuguugc

SEQ ID NO: 1305747 - RNA, 19 nt, Human
cccguggauaccuguugcu

SEQ ID NO: 1305748 - RNA, 23 nt, Human
ccucuagcucccuuucgggggcc

SEQ ID NO: 1305749 - RNA, 18 nt, Human
ccugccccgggacaggcc

SEQ ID NO: 1305750 - RNA, 18 nt, Human
cggccuuuaaacaacucu

SEQ ID NO: 1305751 - RNA, 22 nt, Human
cuaaaggaacuacaauaguaca

SEQ ID NO: 1305752 - RNA, 21 nt, Human
cucccaucaccaauacacaga

SEQ ID NO: 1305753 - RNA, 20 nt, Human
cucccuuucggcuuucuguu

SEQ ID NO: 1305754 - RNA, 18 nt, Human
cucuacaucugagugucc

SEQ ID NO: 1305755 - RNA, 24 nt, Human
cucuacaucugagugucccccaaa

SEQ ID NO: 1305756 - RNA, 21 nt, Human
cugaucaacaccuccagucac

SEQ ID NO: 1305757 - RNA, 21 nt, Human
cugcaaugaauguugcagacg

SEQ ID NO: 1305758 - RNA, 22 nt, Human
cugccauuuguuuuccuguucc

SEQ ID NO: 1305759 - RNA, 24 nt, Human
cuggggggugagccuucuucccca

SEQ ID NO: 1305760 - RNA, 22 nt, Human
cuuaaacuauaaauuagaaaca

SEQ ID NO: 1305761 - RNA, 22 nt, Human
cuucuuccccaggcugggagug

SEQ ID NO: 1305762 - RNA, 20 nt, Human
gagcaaacaaagaaaucaug

SEQ ID NO: 1305763 - RNA, 19 nt, Human
gagcacauacaaauccuaa

SEQ ID NO: 1305764 - RNA, 19 nt, Human
gagcccagagcacauacaa

SEQ ID NO: 1305765 - RNA, 21 nt, Human
gaguuucuucugccauugcag

SEQ ID NO: 1305766 - RNA, 19 nt, Human
gcaacagaacaaaugaaac

SEQ ID NO: 1305767 - RNA, 26 nt, Human
gcuggaacaccagggcuguuucucug

SEQ ID NO: 1305768 - RNA, 21 nt, Human
ggaugcugccauuuguuuucc

SEQ ID NO: 1305769 - RNA, 19 nt, Human
ggccagauccuuggacucu

SEQ ID NO: 1305770 - RNA, 19 nt, Human
ggggaugggguggacucug

SEQ ID NO: 1305771 - RNA, 20 nt, Human
ggggaugggguggacucugg

SEQ ID NO: 1305772 - RNA, 23 nt, Human
guggggagggaggcgggcuuggg

SEQ ID NO: 1305773 - RNA, 25 nt, Human
uaaaaacacauggcagccuauucca

SEQ ID NO: 1305774 - RNA, 21 nt, Human
uaaaggaacuacaauaguaca

SEQ ID NO: 1305775 - RNA, 20 nt, Human
uaaauuagaaacacaaauaa

SEQ ID NO: 1305776 - RNA, 20 nt, Human
uaagaagaaugccaaccagu

SEQ ID NO: 1305777 - RNA, 27 nt, Human
uaagcuaggaaagguuuuccacaucca

SEQ ID NO: 1305778 - RNA, 19 nt, Human
uacaaaguauuaaauagug

SEQ ID NO: 1305779 - RNA, 23 nt, Human
uacaaauccuaaaggaacuacaa

SEQ ID NO: 1305780 - RNA, 19 nt, Human
uacauuaagaagaaugcca

SEQ ID NO: 1305781 - RNA, 21 nt, Human
uacauuaagaagaaugccaac

SEQ ID NO: 1305782 - RNA, 24 nt, Human
uagaaacacaaauaaucauaagug

SEQ ID NO: 1305783 - RNA, 19 nt, Human
uagcagaacauaggcaaau

SEQ ID NO: 1305784 - RNA, 23 nt, Human
uagcagaugauguagggcucucc

SEQ ID NO: 1305785 - RNA, 21 nt, Human
uaguuuugugcaaauaguggg

SEQ ID NO: 1305786 - RNA, 20 nt, Human
ucaucaaaaaagaguacaac

SEQ ID NO: 1305787 - RNA, 23 nt, Human
uccccagaaugccaccacugccc

SEQ ID NO: 1305788 - RNA, 18 nt, Human
uccccaggcugggagugg

SEQ ID NO: 1305789 - RNA, 23 nt, Human
ucccccaaaauguuauuacuccc

SEQ ID NO: 1305790 - RNA, 22 nt, Human
ucggccuuuaaacaacucuaaa

SEQ ID NO: 1305791 - RNA, 22 nt, Human
ucucugccaauauucuuuuaac

SEQ ID NO: 1305792 - RNA, 20 nt, Human
ucucuggauuugaaccucua

SEQ ID NO: 1305793 - RNA, 24 nt, Human
ucuggggggugagccuucuucccc

SEQ ID NO: 1305794 - RNA, 21 nt, Human
ucuucugaucuuuacuaaaua

SEQ ID NO: 1305795 - RNA, 25 nt, Human
ucuucuguuguuucaaagauuugau

SEQ ID NO: 1305796 - RNA, 28 nt, Human
ugaacucccaccacguaagggcaaacuc

SEQ ID NO: 1305797 - RNA, 21 nt, Human
ugaagagcucacugugauuaa

SEQ ID NO: 1305798 - RNA, 24 nt, Human
ugaauauacaugcuucaauaacau

SEQ ID NO: 1305799 - RNA, 21 nt, Human
ugacagcagagagagcccgcu

SEQ ID NO: 1305800 - RNA, 22 nt, Human
ugagagaauguuucguguggua

SEQ ID NO: 1305801 - RNA, 21 nt, Human
ugagggaaaggcuguuuccag

SEQ ID NO: 1305802 - RNA, 21 nt, Human
ugaguggcaaccaccagaagu

SEQ ID NO: 1305803 - RNA, 20 nt, Human
ugaucaacaccuccagucac

SEQ ID NO: 1305804 - RNA, 18 nt, Human
ugauguagggcucucccc

SEQ ID NO: 1305805 - RNA, 21 nt, Human
ugccaccacugccccugcccc

SEQ ID NO: 1305806 - RNA, 23 nt, Human
ugccccugccccgggacaggccc

SEQ ID NO: 1305807 - RNA, 24 nt, Human
ugcuucaauaacauuaaaaacaca

SEQ ID NO: 1305808 - RNA, 21 nt, Human
uggaagacagagaucuaacca

SEQ ID NO: 1305809 - RNA, 23 nt, Human
uggacucuggggggugagccuuc

SEQ ID NO: 1305810 - RNA, 20 nt, Human
uggcaacagaacaaaugaaa

SEQ ID NO: 1305811 - RNA, 23 nt, Human
ugggagugggugagacgagacuc

SEQ ID NO: 1305812 - RNA, 22 nt, Human
uggggagggaggcgggcuuggg

SEQ ID NO: 1305813 - RNA, 18 nt, Human
uguuucuucuguuguuuc

SEQ ID NO: 1305814 - RNA, 20 nt, Human
uuuaaaaauuucuugagcag

SEQ ID NO: 1305815 - RNA, 18 nt, Human
uuuccaguucucggccuu

SEQ ID NO: 1305816 - RNA, 23 nt, Human
uuuccuguaggaaguggaagaca

SEQ ID NO: 1305817 - RNA, 23 nt, Human
ccacuucccacacacaaacuuuc

SEQ ID NO: 1305818 - RNA, 20 nt, Human
cccaucaaccccuaugauga

SEQ ID NO: 1305819 - RNA, 21 nt, Human
cugcuuccacuucccacacac

SEQ ID NO: 1305820 - RNA, 19 nt, Human
gacuguguuuguugaaaag

SEQ ID NO: 1305821 - RNA, 21 nt, Human
gcccaucaaccccuaugauga

SEQ ID NO: 1305822 - RNA, 21 nt, Human
uagaauaaagcuggcccauca

SEQ ID NO: 1305823 - RNA, 18 nt, Human
ucccacacacaaacuuuc

SEQ ID NO: 1305824 - RNA, 22 nt, Human
ucccacacacaaacuuucuaau

SEQ ID NO: 1305825 - RNA, 18 nt, Human
uuuguugaaaagaacaga

SEQ ID NO: 1305826 - RNA, 24 nt, Human
aagcgcucucggggaugcgggggu

SEQ ID NO: 1305827 - RNA, 20 nt, Human
caccaagcgcucucggggau

SEQ ID NO: 1305828 - RNA, 19 nt, Human
cagcgccccggccccagcc

SEQ ID NO: 1305829 - RNA, 24 nt, Human
ccccagcccgcaccccgaaguggc

SEQ ID NO: 1305830 - RNA, 21 nt, Human
ccccggccccagcccgcaccc

SEQ ID NO: 1305831 - RNA, 21 nt, Human
ccccggccccagcccgcaccu

SEQ ID NO: 1305832 - RNA, 18 nt, Human
cccgcaccccgaaguggc

SEQ ID NO: 1305833 - RNA, 23 nt, Human
cccggccccagcccgcaccgguu

SEQ ID NO: 1305834 - RNA, 22 nt, Human
cuaagccugaagacacagcgug

SEQ ID NO: 1305835 - RNA, 22 nt, Human
aagagcgccccggagcccacaa

SEQ ID NO: 1305836 - RNA, 24 nt, Human
aaggagcccacuggucucacaggc

SEQ ID NO: 1305837 - RNA, 21 nt, Human
acaagggaagagcgccccgga

SEQ ID NO: 1305838 - RNA, 21 nt, Human
acacagacaguggccucaggc

SEQ ID NO: 1305839 - RNA, 19 nt, Human
acagacaguggccucaggc

SEQ ID NO: 1305840 - RNA, 19 nt, Human
acggaacuggaagcucuaa

SEQ ID NO: 1305841 - RNA, 19 nt, Human
agcagaccccuggcaucug

SEQ ID NO: 1305842 - RNA, 23 nt, Human
aggaguugccuucuauggugaca

SEQ ID NO: 1305843 - RNA, 21 nt, Human
aguggccucaggcagcccggc

SEQ ID NO: 1305844 - RNA, 18 nt, Human
aguggguggggacagcug

SEQ ID NO: 1305845 - RNA, 21 nt, Human
cacaaguaggaguugccuucu

SEQ ID NO: 1305846 - RNA, 22 nt, Human
cacuaauucccaucaggccgaa

SEQ ID NO: 1305847 - RNA, 19 nt, Human
cagagcccccugucuucug

SEQ ID NO: 1305848 - RNA, 20 nt, Human
cagugcgucucccuccuccu

SEQ ID NO: 1305849 - RNA, 23 nt, Human
caguggccucaggcagcccggcu

SEQ ID NO: 1305850 - RNA, 25 nt, Human
caugcccccuccaccgccccuccug

SEQ ID NO: 1305851 - RNA, 20 nt, Human
ccagacaugcccccuccacc

SEQ ID NO: 1305852 - RNA, 21 nt, Human
cccccugucuucuggccucau

SEQ ID NO: 1305853 - RNA, 19 nt, Human
ccccggagcccacaauggg

SEQ ID NO: 1305854 - RNA, 20 nt, Human
ccccuccaccgccccuccug

SEQ ID NO: 1305855 - RNA, 21 nt, Human
cccuccagacaugcccccucc

SEQ ID NO: 1305856 - RNA, 25 nt, Human
cccuccagacaugcccccuccaccg

SEQ ID NO: 1305857 - RNA, 18 nt, Human
ccggagcccacaaugggc

SEQ ID NO: 1305858 - RNA, 22 nt, Human
ccuaagacggaacuggaagcuc

SEQ ID NO: 1305859 - RNA, 21 nt, Human
ccuccagacaugcccccucca

SEQ ID NO: 1305860 - RNA, 22 nt, Human
ccuccagacaugcccccuccac

SEQ ID NO: 1305861 - RNA, 21 nt, Human
ccugcguugaugcuagagcag

SEQ ID NO: 1305862 - RNA, 20 nt, Human
cgagcgcuccccgugccuca

SEQ ID NO: 1305863 - RNA, 21 nt, Human
cgccacagacucugauugcuc

SEQ ID NO: 1305864 - RNA, 23 nt, Human
cuccaccgccccuccugaggacg

SEQ ID NO: 1305865 - RNA, 24 nt, Human
cuucacgcagagcccccugucuuc

SEQ ID NO: 1305866 - RNA, 27 nt, Human
gagcgccccggagcccacaaugggcac

SEQ ID NO: 1305867 - RNA, 21 nt, Human
ggacgcucaucuuugaaaaug

SEQ ID NO: 1305868 - RNA, 24 nt, Human
ggcaggggcuggugggcuucacgc

SEQ ID NO: 1305869 - RNA, 18 nt, Human
uaagacggaacuggaagc

SEQ ID NO: 1305870 - RNA, 21 nt, Human
uaggaguugccuucuauggug

SEQ ID NO: 1305871 - RNA, 18 nt, Human
uauuucagucuaaucuga

SEQ ID NO: 1305872 - RNA, 26 nt, Human
ucacgcagagcccccugucuucuggc

SEQ ID NO: 1305873 - RNA, 23 nt, Human
ucagcacaagggaagagcgcccc

SEQ ID NO: 1305874 - RNA, 22 nt, Human
uccccgugccucaggucccucc

SEQ ID NO: 1305875 - RNA, 19 nt, Human
ucgccacagacucugauug

SEQ ID NO: 1305876 - RNA, 22 nt, Human
ucuauggugacauggcuucucu

SEQ ID NO: 1305877 - RNA, 24 nt, Human
ugccucaggucccuccagacaugc

SEQ ID NO: 1305878 - RNA, 23 nt, Human
uguaguggguggggacagcugac

SEQ ID NO: 1305879 - RNA, 20 nt, Human
uuagaaaaaugaaugcagug

SEQ ID NO: 1305880 - RNA, 26 nt, Human
uugaaaauguccuaagacggaacugg

SEQ ID NO: 1305881 - RNA, 24 nt, Human
acauaguuccuugccucuggggac

SEQ ID NO: 1305882 - RNA, 19 nt, Human
acccagagcagagugaacc

SEQ ID NO: 1305883 - RNA, 23 nt, Human
acccagagcagagugaaccccag

SEQ ID NO: 1305884 - RNA, 18 nt, Human
accccagaaaugcugagg

SEQ ID NO: 1305885 - RNA, 23 nt, Human
acugugccuggccuuggggcugg

SEQ ID NO: 1305886 - RNA, 18 nt, Human
agaaggagggaggaaggg

SEQ ID NO: 1305887 - RNA, 19 nt, Human
agaaggagggaggaaggga

SEQ ID NO: 1305888 - RNA, 21 nt, Human
agagagaaggagggaggaagg

SEQ ID NO: 1305889 - RNA, 19 nt, Human
agguagacagagagaagga

SEQ ID NO: 1305890 - RNA, 20 nt, Human
cacaguacccagagcagagu

SEQ ID NO: 1305891 - RNA, 23 nt, Human
cacaguacccagagcagagugaa

SEQ ID NO: 1305892 - RNA, 21 nt, Human
cacauaguuccuugccucugg

SEQ ID NO: 1305893 - RNA, 19 nt, Human
cagagagaaggagggagga

SEQ ID NO: 1305894 - RNA, 22 nt, Human
cagagugaaccccagaaaugcu

SEQ ID NO: 1305895 - RNA, 22 nt, Human
ccagagcagagugaaccccaga

SEQ ID NO: 1305896 - RNA, 23 nt, Human
cccagagcagagugaaccccaga

SEQ ID NO: 1305897 - RNA, 21 nt, Human
ccccagaaaugcugagguaga

SEQ ID NO: 1305898 - RNA, 18 nt, Human
ccgggcuuaguccuugca

SEQ ID NO: 1305899 - RNA, 24 nt, Human
cugccucuggguuuaauuuauguu

SEQ ID NO: 1305900 - RNA, 23 nt, Human
cuguguuuuucuccuugaaccac

SEQ ID NO: 1305901 - RNA, 20 nt, Human
gaagggaaguugauggcugu

SEQ ID NO: 1305902 - RNA, 22 nt, Human
gagugaaccccagaaaugcuga

SEQ ID NO: 1305903 - RNA, 21 nt, Human
ggaguccuuuacacaguaccc

SEQ ID NO: 1305904 - RNA, 18 nt, Human
ggccuuggggcugggaac

SEQ ID NO: 1305905 - RNA, 19 nt, Human
ggccuuggggcugggaaca

SEQ ID NO: 1305906 - RNA, 25 nt, Human
gggaggaagggagaccuacaggcuu

SEQ ID NO: 1305907 - RNA, 19 nt, Human
ggggcugggaacacuggag

SEQ ID NO: 1305908 - RNA, 22 nt, Human
gguagacagagagaaggaggga

SEQ ID NO: 1305909 - RNA, 24 nt, Human
guugauggcuguggaguccuuuac

SEQ ID NO: 1305910 - RNA, 26 nt, Human
uaacugugaggaggagaaacucggag

SEQ ID NO: 1305911 - RNA, 19 nt, Human
ucacaggugagaagggaga

SEQ ID NO: 1305912 - RNA, 18 nt, Human
uccuugcaguccccgcac

SEQ ID NO: 1305913 - RNA, 26 nt, Human
ugaaccacugugauguaaagaaaucu

SEQ ID NO: 1305914 - RNA, 20 nt, Human
ugaagggaaguugauggcug

SEQ ID NO: 1305915 - RNA, 18 nt, Human
ugagguagacagagagaa

SEQ ID NO: 1305916 - RNA, 21 nt, Human
ugagguagacagagagaagga

SEQ ID NO: 1305917 - RNA, 24 nt, Human
uguaaagaaaucucagcucuuuca

SEQ ID NO: 1305918 - RNA, 24 nt, Human
uguggcgcugacugccucuggguu

SEQ ID NO: 1305919 - RNA, 21 nt, Human
uugauggcuguggaguccuuu

SEQ ID NO: 1305920 - RNA, 24 nt, Human
uuucuccuugaaccacugugaugu

SEQ ID NO: 1305921 - RNA, 18 nt, Human
aaggagcuggccugauuu

SEQ ID NO: 1305922 - RNA, 20 nt, Human
aaggagcuggccugauuugg

SEQ ID NO: 1305923 - RNA, 21 nt, Human
acacaguaguacuagggccca

SEQ ID NO: 1305924 - RNA, 18 nt, Human
accccauggguuacagaa

SEQ ID NO: 1305925 - RNA, 26 nt, Human
agaaauaauugaaagggaucuccagc

SEQ ID NO: 1305926 - RNA, 23 nt, Human
agaguguaaggaggccccuucuu

SEQ ID NO: 1305927 - RNA, 21 nt, Human
agauuccacccauagcagccc

SEQ ID NO: 1305928 - RNA, 20 nt, Human
auagaguguaaggaggcccc

SEQ ID NO: 1305929 - RNA, 21 nt, Human
caacccuucagacuuaggaca

SEQ ID NO: 1305930 - RNA, 18 nt, Human
cacccauagcagccccuc

SEQ ID NO: 1305931 - RNA, 22 nt, Human
cagaaggagcuggccugauuug

SEQ ID NO: 1305932 - RNA, 19 nt, Human
cagauggaggagaccccau

SEQ ID NO: 1305933 - RNA, 20 nt, Human
cauggguuacagaaggagcu

SEQ ID NO: 1305934 - RNA, 21 nt, Human
ccacagcguggaaggugggcg

SEQ ID NO: 1305935 - RNA, 19 nt, Human
cccauagcagccccucuuc

SEQ ID NO: 1305936 - RNA, 18 nt, Human
ccccagaaggggcacagg

SEQ ID NO: 1305937 - RNA, 20 nt, Human
ccuaugcuucagcaauagag

SEQ ID NO: 1305938 - RNA, 20 nt, Human
gaaggggcacagggucuucc

SEQ ID NO: 1305939 - RNA, 21 nt, Human
gaaggugggcggcaggugcac

SEQ ID NO: 1305940 - RNA, 20 nt, Human
ggagaaggggucccuaugcu

SEQ ID NO: 1305941 - RNA, 20 nt, Human
ggucuuccacacuguggcug

SEQ ID NO: 1305942 - RNA, 22 nt, Human
guuacagaaggagcuggccuga

SEQ ID NO: 1305943 - RNA, 23 nt, Human
uaacacaaaacaaugucugcauc

SEQ ID NO: 1305944 - RNA, 22 nt, Human
uggaaggugggcggcaggugca

SEQ ID NO: 1305945 - RNA, 19 nt, Human
uggccugauuuggagaagg

SEQ ID NO: 1305946 - RNA, 18 nt, Human
uggcucuaggccaacccu

SEQ ID NO: 1305947 - RNA, 24 nt, Human
uguaaaaacaauaacacaaaacaa

SEQ ID NO: 1305948 - RNA, 22 nt, Human
agggccacugcuaguucuuggu

SEQ ID NO: 1305949 - RNA, 21 nt, Human
aguuugaacaagcuccuccca

SEQ ID NO: 1305950 - RNA, 19 nt, Human
caccagaaguggcuguguc

SEQ ID NO: 1305951 - RNA, 18 nt, Human
cacguagccucuccuccu

SEQ ID NO: 1305952 - RNA, 20 nt, Human
cacguagccucuccuccugu

SEQ ID NO: 1305953 - RNA, 21 nt, Human
ccagaaguggcugugucaggg

SEQ ID NO: 1305954 - RNA, 20 nt, Human
ccccaggugagugguaacca

SEQ ID NO: 1305955 - RNA, 22 nt, Human
ccuccugucuccuguucaggag

SEQ ID NO: 1305956 - RNA, 23 nt, Human
cguagccucuccuccugucuccu

SEQ ID NO: 1305957 - RNA, 22 nt, Human
cuggaaugccagggcucuuccu

SEQ ID NO: 1305958 - RNA, 22 nt, Human
cuguuagcuccugcuggaaugc

SEQ ID NO: 1305959 - RNA, 22 nt, Human
gccuggagcugucuucccacac

SEQ ID NO: 1305960 - RNA, 26 nt, Human
gcuggaaugccagggcucuuccucug

SEQ ID NO: 1305961 - RNA, 21 nt, Human
ggaaugccagggcucuuccuc

SEQ ID NO: 1305962 - RNA, 22 nt, Human
ggccagggguucagccgucugg

SEQ ID NO: 1305963 - RNA, 19 nt, Human
ggcucuggggccagggguu

SEQ ID NO: 1305964 - RNA, 25 nt, Human
gggggcucuggggccagggguucag

SEQ ID NO: 1305965 - RNA, 21 nt, Human
ggucucaucuuguagcugcuc

SEQ ID NO: 1305966 - RNA, 23 nt, Human
uccucugccaauaugcuuuuaac

SEQ ID NO: 1305967 - RNA, 19 nt, Human
ucucaucuuguagcugcuc

SEQ ID NO: 1305968 - RNA, 28 nt, Human
ucucuagcuccuuccuuagggggccgcc

SEQ ID NO: 1305969 - RNA, 20 nt, Human
ucuguaccagauguaucuca

SEQ ID NO: 1305970 - RNA, 23 nt, Human
ucuguaccagauguaucucaugc

SEQ ID NO: 1305971 - RNA, 22 nt, Human
ugaacaagcuccucccaagcuu

SEQ ID NO: 1305972 - RNA, 21 nt, Human
ugagugguaaccaccagaagu

SEQ ID NO: 1305973 - RNA, 22 nt, Human
ugaguugacugauuauugcgga

SEQ ID NO: 1305974 - RNA, 24 nt, Human
uggaaugccagggcucuuccucug

SEQ ID NO: 1305975 - RNA, 26 nt, Human
uggaaugccagggcucuuccucugac

SEQ ID NO: 1305976 - RNA, 25 nt, Human
uguaccagauguaucucaugcuucu

SEQ ID NO: 1305977 - RNA, 24 nt, Human
uguucaggagacucaacaucugau

SEQ ID NO: 1305978 - RNA, 19 nt, Human
uuccaccucagccuggagc

SEQ ID NO: 1305979 - RNA, 22 nt, Human
gcaguagacgcagcaaagaaag

SEQ ID NO: 1305980 - RNA, 20 nt, Human
gucuuaagugucaucuggcc

SEQ ID NO: 1305981 - RNA, 24 nt, Human
ucuuaagugucaucuggcaucuuc

SEQ ID NO: 1305982 - RNA, 19 nt, Human
agccacagaguucacggcu

SEQ ID NO: 1305983 - RNA, 22 nt, Human
auggaaaccucugguggaggcc

SEQ ID NO: 1305984 - RNA, 23 nt, Human
cuagaacuacagcccguccccca

SEQ ID NO: 1305985 - RNA, 21 nt, Human
gaacuacagcccgucccccag

SEQ ID NO: 1305986 - RNA, 20 nt, Human
gaggcagccacagaguucac

SEQ ID NO: 1305987 - RNA, 21 nt, Human
gggcagauggaaaccucuggu

SEQ ID NO: 1305988 - RNA, 20 nt, Human
ugaguuaaaaucagguucua

SEQ ID NO: 1305989 - RNA, 20 nt, Human
aagauugccugugacgcugu

SEQ ID NO: 1305990 - RNA, 23 nt, Human
acuccggccccgaggcucucccg

SEQ ID NO: 1305991 - RNA, 18 nt, Human
agcgcagcguucuggaag

SEQ ID NO: 1305992 - RNA, 18 nt, Human
augguaguagaagcaaga

SEQ ID NO: 1305993 - RNA, 23 nt, Human
augguaguagaagcaagauugcc

SEQ ID NO: 1305994 - RNA, 21 nt, Human
cagcgcccacgcgacuccggc

SEQ ID NO: 1305995 - RNA, 22 nt, Human
cccccagcgcccacgcgacucc

SEQ ID NO: 1305996 - RNA, 19 nt, Human
ccgccccgcccccagcgcc

SEQ ID NO: 1305997 - RNA, 20 nt, Human
ccgccccgcccccagcgccc

SEQ ID NO: 1305998 - RNA, 23 nt, Human
ccgucacccaggucuccagaacc

SEQ ID NO: 1305999 - RNA, 22 nt, Human
cgccccgcccccagcgcccacg

SEQ ID NO: 1306000 - RNA, 18 nt, Human
cggccccgaggcucuccc

SEQ ID NO: 1306001 - RNA, 20 nt, Human
cucccgagcgcagcguucug

SEQ ID NO: 1306002 - RNA, 21 nt, Human
cugagggcagcagucggccuu

SEQ ID NO: 1306003 - RNA, 24 nt, Human
cuugcccucugacugccagcuggg

SEQ ID NO: 1306004 - RNA, 23 nt, Human
gagaugcucuugcccucugacug

SEQ ID NO: 1306005 - RNA, 20 nt, Human
gcagugggcgcccgccccgc

SEQ ID NO: 1306006 - RNA, 22 nt, Human
gccccgauaacugagggcagca

SEQ ID NO: 1306007 - RNA, 25 nt, Human
gggcagcagucggccuugggcguuc

SEQ ID NO: 1306008 - RNA, 24 nt, Human
uacauuucuccuuuuccaugcugc

SEQ ID NO: 1306009 - RNA, 19 nt, Human
uaguagaagcaagauugcc

SEQ ID NO: 1306010 - RNA, 24 nt, Human
uccaugcugcacugcacccuggaa

SEQ ID NO: 1306011 - RNA, 19 nt, Human
ucgagaugcucuugcccuc

SEQ ID NO: 1306012 - RNA, 23 nt, Human
ucugacugccagcuggguuuggu

SEQ ID NO: 1306013 - RNA, 21 nt, Human
ucuuucauuugccucuucagg

SEQ ID NO: 1306014 - RNA, 23 nt, Human
ugagggcagcagucggccuuggg

SEQ ID NO: 1306015 - RNA, 24 nt, Human
ugagggcagcagucggccuugggc

SEQ ID NO: 1306016 - RNA, 23 nt, Human
uggaauuggccuguaugcgcugc

SEQ ID NO: 1306017 - RNA, 19 nt, Human
uuucauuugccucuucagg

SEQ ID NO: 1306018 - RNA, 18 nt, Human
aacagcuucuccaccucu

SEQ ID NO: 1306019 - RNA, 20 nt, Human
cacauagccucuccuccugu

SEQ ID NO: 1306020 - RNA, 19 nt, Human
caccucuuccagcagccuc

SEQ ID NO: 1306021 - RNA, 19 nt, Human
caccucuuccagcagccuc

SEQ ID NO: 1306022 - RNA, 18 nt, Human
cacguagccucuccuccu

SEQ ID NO: 1306023 - RNA, 26 nt, Human
cagcagccucucccucuccagcagcc

SEQ ID NO: 1306024 - RNA, 20 nt, Human
cagcucccgcagagucuccu

SEQ ID NO: 1306025 - RNA, 23 nt, Human
caggagcuucuccaccucuucca

SEQ ID NO: 1306026 - RNA, 20 nt, Human
ccagcagccucucccucucc

SEQ ID NO: 1306027 - RNA, 22 nt, Human
ccuccugccgccucuccuguuc

SEQ ID NO: 1306028 - RNA, 21 nt, Human
ccucuccagcagccucuccug

SEQ ID NO: 1306029 - RNA, 23 nt, Human
ccucuccagcucccgcagagucu

SEQ ID NO: 1306030 - RNA, 23 nt, Human
ccucuccuccuguucacacagcc

SEQ ID NO: 1306031 - RNA, 21 nt, Human
ccucuccugcuccuccugccg

SEQ ID NO: 1306032 - RNA, 23 nt, Human
cuaacagcuucuccaccucuucc

SEQ ID NO: 1306033 - RNA, 19 nt, Human
cuccuccugccgccucucc

SEQ ID NO: 1306034 - RNA, 24 nt, Human
cugcuccuccugccgccucuccug

SEQ ID NO: 1306035 - RNA, 20 nt, Human
gaagccucuccugcuccagg

SEQ ID NO: 1306036 - RNA, 23 nt, Human
gagcuccuccaccucguccagga

SEQ ID NO: 1306037 - RNA, 19 nt, Human
gccacagccucucauccug

SEQ ID NO: 1306038 - RNA, 19 nt, Human
ggagcuccuccaccucguc

SEQ ID NO: 1306039 - RNA, 19 nt, Human
ucacacagccucuccucau

SEQ ID NO: 1306040 - RNA, 21 nt, Human
ucacacagccucuccuccugu

SEQ ID NO: 1306041 - RNA, 21 nt, Human
ucacguagccucuccuccugu

SEQ ID NO: 1306042 - RNA, 18 nt, Human
uccagcagccucucccuc

SEQ ID NO: 1306043 - RNA, 22 nt, Human
uccagcagccucucccucucca

SEQ ID NO: 1306044 - RNA, 24 nt, Human
uccagcagccucuccugcuccucc

SEQ ID NO: 1306045 - RNA, 19 nt, Human
ucccucuccagcagccucu

SEQ ID NO: 1306046 - RNA, 18 nt, Human
ucuaacagcuucuccacc

SEQ ID NO: 1306047 - RNA, 21 nt, Human
ucuaacagcuucuccaccucu

SEQ ID NO: 1306048 - RNA, 24 nt, Human
ucuccaccucuuccagcagccucu

SEQ ID NO: 1306049 - RNA, 24 nt, Human
ucuccaccucuuccagcagccucu

SEQ ID NO: 1306050 - RNA, 20 nt, Human
ucuccagcucccgcagaguc

SEQ ID NO: 1306051 - RNA, 19 nt, Human
ucuccagcucccgcagccu

SEQ ID NO: 1306052 - RNA, 22 nt, Human
ucuccugcuccuccugccgccu

SEQ ID NO: 1306053 - RNA, 24 nt, Human
ucuccugcugccacagccucucau

SEQ ID NO: 1306054 - RNA, 26 nt, Human
ucuccuguucuaacagcuucuccacc

SEQ ID NO: 1306055 - RNA, 23 nt, Human
ucuuccagcagccucuccugccc

SEQ ID NO: 1306056 - RNA, 27 nt, Human
ugcccuggcagcuucuccuguucacac

SEQ ID NO: 1306057 - RNA, 23 nt, Human
uuaccgaagccucuccugcucca

SEQ ID NO: 1306058 - RNA, 24 nt, Human
aagcuccaguucuggggccuggcc

SEQ ID NO: 1306059 - RNA, 19 nt, Human
agcagugacagagaaugca

SEQ ID NO: 1306060 - RNA, 23 nt, Human
agcagugacagagaaugcaggug

SEQ ID NO: 1306061 - RNA, 18 nt, Human
caccucaguggcuuuggc

SEQ ID NO: 1306062 - RNA, 18 nt, Human
cagcccagcgggcggcaa

SEQ ID NO: 1306063 - RNA, 23 nt, Human
ccagcgggcggcaagcucuucuu

SEQ ID NO: 1306064 - RNA, 23 nt, Human
gcagcccagcgggcggcaagcuc

SEQ ID NO: 1306065 - RNA, 21 nt, Human
gcccagcgggcggcaagcucu

SEQ ID NO: 1306066 - RNA, 20 nt, Human
guucuggggccuggcccucu

SEQ ID NO: 1306067 - RNA, 18 nt, Human
ucuugacaaggggacuga

SEQ ID NO: 1306068 - RNA, 23 nt, Human
uggcuuuggcugucugggagagg

SEQ ID NO: 1306069 - RNA, 22 nt, Human
uggggccuggcccucuguggca

SEQ ID NO: 1306070 - RNA, 18 nt, Human
ugucgcccguguggucca

SEQ ID NO: 1306071 - RNA, 22 nt, Human
aaauggcuuucuaccauaaaga

SEQ ID NO: 1306072 - RNA, 19 nt, Human
auuguauuuucuugaagaa

SEQ ID NO: 1306073 - RNA, 23 nt, Human
ccucuugaagugcagauauagcc

SEQ ID NO: 1306074 - RNA, 20 nt, Human
gaauaggcuugggggcugcc

SEQ ID NO: 1306075 - RNA, 19 nt, Human
guuacauuugggcucugag

SEQ ID NO: 1306076 - RNA, 22 nt, Human
ugugaccaaauggcuuucuacc

SEQ ID NO: 1306077 - RNA, 21 nt, Human
uguggcuuuuaauauuguauu

SEQ ID NO: 1306078 - RNA, 19 nt, Human
uucacaacugguuuuacag

SEQ ID NO: 1306079 - RNA, 22 nt, Human
aaacauaguacagcauuucuca

SEQ ID NO: 1306080 - RNA, 23 nt, Human
aaacuggcacucacugcggcaca

SEQ ID NO: 1306081 - RNA, 18 nt, Human
aacuuagcgucucuuccu

SEQ ID NO: 1306082 - RNA, 22 nt, Human
acaauaguuacuggaaaaaccc

SEQ ID NO: 1306083 - RNA, 24 nt, Human
agagggaauuuuuuuaaccugcca

SEQ ID NO: 1306084 - RNA, 23 nt, Human
agcgucucuuccugguaaauggc

SEQ ID NO: 1306085 - RNA, 24 nt, Human
aggaaaaaaaaccaugauuaucac

SEQ ID NO: 1306086 - RNA, 20 nt, Human
caacagcauuaggugguuag

SEQ ID NO: 1306087 - RNA, 23 nt, Human
caagcaccguuuaauccaggacu

SEQ ID NO: 1306088 - RNA, 24 nt, Human
cacuauuacaaaaacuauucagaa

SEQ ID NO: 1306089 - RNA, 23 nt, Human
cagaccucuggaaucagaaacuc

SEQ ID NO: 1306090 - RNA, 24 nt, Human
cagagggaauuuuuuuaaccugcc

SEQ ID NO: 1306091 - RNA, 20 nt, Human
caggacuucaaauaaguuuc

SEQ ID NO: 1306092 - RNA, 21 nt, Human
ccagaccucuggaaucagaaa

SEQ ID NO: 1306093 - RNA, 21 nt, Human
ccucaguguguguagccaggg

SEQ ID NO: 1306094 - RNA, 26 nt, Human
cucaaaguguggucacuggaccaaca

SEQ ID NO: 1306095 - RNA, 22 nt, Human
cugcggcacaccggcccuuuuu

SEQ ID NO: 1306096 - RNA, 21 nt, Human
cuucaggccacgcaugcuucc

SEQ ID NO: 1306097 - RNA, 18 nt, Human
gccuggaacacggugagg

SEQ ID NO: 1306098 - RNA, 22 nt, Human
gggcagagacaggaaagugagg

SEQ ID NO: 1306099 - RNA, 24 nt, Human
uaaauaggaaaaaaaaccaugauu

SEQ ID NO: 1306100 - RNA, 18 nt, Human
uaacuggacgccuggaac

SEQ ID NO: 1306101 - RNA, 18 nt, Human
uacagcauuucucaaagu

SEQ ID NO: 1306102 - RNA, 23 nt, Human
uaucguaauaaauaggaaaaaaa

SEQ ID NO: 1306103 - RNA, 18 nt, Human
ucauucaaacuggcacuc

SEQ ID NO: 1306104 - RNA, 24 nt, Human
ucguaauaaauaggaaaaaaaacc

SEQ ID NO: 1306105 - RNA, 20 nt, Human
ugaggugagaauuuuuaaau

SEQ ID NO: 1306106 - RNA, 18 nt, Human
ugcucgguucccauguga

SEQ ID NO: 1306107 - RNA, 25 nt, Human
uuagagacauucccauuaagggcag

SEQ ID NO: 1306108 - RNA, 18 nt, Human
uuagcgucucuuccuggu

SEQ ID NO: 1306109 - RNA, 21 nt, Human
uucccauuaagggcagagacu

SEQ ID NO: 1306110 - RNA, 19 nt, Human
uugcucgguucccauguga

SEQ ID NO: 1306111 - RNA, 21 nt, Human
uuuuaaaccauaaaugaggug

SEQ ID NO: 1306112 - RNA, 23 nt, Human
aggcacucucauuugcuucuguu

SEQ ID NO: 1306113 - RNA, 20 nt, Human
auuugcuucuguugcuuuuu

SEQ ID NO: 1306114 - RNA, 20 nt, Human
ccccacaaugaccacuucca

SEQ ID NO: 1306115 - RNA, 24 nt, Human
ccuacuccuggacucggccagcua

SEQ ID NO: 1306116 - RNA, 18 nt, Human
ccuggacucggccagcua

SEQ ID NO: 1306117 - RNA, 21 nt, Human
ccugggucacacaaacgggaa

SEQ ID NO: 1306118 - RNA, 19 nt, Human
ccuucagcucaaaauuuac

SEQ ID NO: 1306119 - RNA, 24 nt, Human
cuggaggugauagggguuucucuu

SEQ ID NO: 1306120 - RNA, 20 nt, Human
gaaugccccacaaugaccac

SEQ ID NO: 1306121 - RNA, 23 nt, Human
ggaaugccccacaaugaccacuu

SEQ ID NO: 1306122 - RNA, 22 nt, Human
gucacacaaacgggaaugcccc

SEQ ID NO: 1306123 - RNA, 20 nt, Human
ucacacaaacgggaaugccc

SEQ ID NO: 1306124 - RNA, 18 nt, Human
ugagauagaaucucgcuc

SEQ ID NO: 1306125 - RNA, 29 nt, Human
ugcuuuuuuuuuuuuuuuuuuuuugagaa

SEQ ID NO: 1306126 - RNA, 25 nt, Human
uuuuuuuuuuuugagauagaaucuc

SEQ ID NO: 1306127 - RNA, 18 nt, Human
uuuuuuuuuuuuuuuuug

SEQ ID NO: 1306128 - RNA, 20 nt, Human
acagacaaugacuaacagag

SEQ ID NO: 1306129 - RNA, 19 nt, Human
accacaauaacaacacgga

SEQ ID NO: 1306130 - RNA, 19 nt, Human
agcagccagacgccgcuac

SEQ ID NO: 1306131 - RNA, 21 nt, Human
agccagagccucccggacucc

SEQ ID NO: 1306132 - RNA, 21 nt, Human
aguggagaggcggggcccgga

SEQ ID NO: 1306133 - RNA, 18 nt, Human
cacugaguauacacauuc

SEQ ID NO: 1306134 - RNA, 19 nt, Human
cagccagacgccgcuacca

SEQ ID NO: 1306135 - RNA, 20 nt, Human
ccccgcggacgccaaaguca

SEQ ID NO: 1306136 - RNA, 18 nt, Human
cccgcggacgccaaaguc

SEQ ID NO: 1306137 - RNA, 20 nt, Human
ccgccgaguggagaggcggg

SEQ ID NO: 1306138 - RNA, 20 nt, Human
ccgcgacuggagcagccaga

SEQ ID NO: 1306139 - RNA, 24 nt, Human
ccuacacugaguauacacauucaa

SEQ ID NO: 1306140 - RNA, 22 nt, Human
ccucccggacuccggagccgcc

SEQ ID NO: 1306141 - RNA, 21 nt, Human
ccugaguuuccugcccaccag

SEQ ID NO: 1306142 - RNA, 26 nt, Human
cgcgggcagcggcgcgcaggccaggc

SEQ ID NO: 1306143 - RNA, 20 nt, Human
cuccggagccgccggggucc

SEQ ID NO: 1306144 - RNA, 22 nt, Human
cuccugaguuuccugcccacca

SEQ ID NO: 1306145 - RNA, 19 nt, Human
cugaguuuccugcccacca

SEQ ID NO: 1306146 - RNA, 18 nt, Human
gcagccagacgccgcuac

SEQ ID NO: 1306147 - RNA, 25 nt, Human
gcagccagagccucccggacuccgg

SEQ ID NO: 1306148 - RNA, 24 nt, Human
gcgcaggccaggcgcuaggacucg

SEQ ID NO: 1306149 - RNA, 18 nt, Human
gggcagcggcgcgcaggc

SEQ ID NO: 1306150 - RNA, 22 nt, Human
uaaaauuaguagaaauggcuuc

SEQ ID NO: 1306151 - RNA, 24 nt, Human
uagauuaaauauuacuccugaguu

SEQ ID NO: 1306152 - RNA, 18 nt, Human
uauaugccagaagacaga

SEQ ID NO: 1306153 - RNA, 18 nt, Human
uaugccagaagacagaac

SEQ ID NO: 1306154 - RNA, 18 nt, Human
uccaauauugcacuugau

SEQ ID NO: 1306155 - RNA, 26 nt, Human
ucccggacuccggagccgccgggguc

SEQ ID NO: 1306156 - RNA, 19 nt, Human
ugccagaagacagaacacu

SEQ ID NO: 1306157 - RNA, 19 nt, Human
uggcuuccaauauugcacu

SEQ ID NO: 1306158 - RNA, 20 nt, Human
uuauaugccagaagacagaa

SEQ ID NO: 1306159 - RNA, 20 nt, Human
uugagguaaggacugggaau

SEQ ID NO: 1306160 - RNA, 24 nt, Human
caaaugacccuuucgugcagccca

SEQ ID NO: 1306161 - RNA, 21 nt, Human
ggguuuacaaguuuaucucca

SEQ ID NO: 1306162 - RNA, 19 nt, Human
uacaauaauggcagugaaa

SEQ ID NO: 1306163 - RNA, 18 nt, Human
ucaacacuuacaugcaau

SEQ ID NO: 1306164 - RNA, 20 nt, Human
ucagucaacacuuacaugca

SEQ ID NO: 1306165 - RNA, 19 nt, Human
uccaaaugacccuuucgug

SEQ ID NO: 1306166 - RNA, 19 nt, Human
ugggaagaauaacauuaug

SEQ ID NO: 1306167 - RNA, 20 nt, Human
aaaaggaaagacuuucucau

SEQ ID NO: 1306168 - RNA, 21 nt, Human
acccgcucuguguucuacgcc

SEQ ID NO: 1306169 - RNA, 24 nt, Human
agaagcacaaacaugguuucucca

SEQ ID NO: 1306170 - RNA, 26 nt, Human
agaagcacaaacaugguuucuccaaa

SEQ ID NO: 1306171 - RNA, 20 nt, Human
agccagaugaucuggugggc

SEQ ID NO: 1306172 - RNA, 22 nt, Human
caaaacaugagaucggcuuagc

SEQ ID NO: 1306173 - RNA, 21 nt, Human
caagaauuggucacagucuca

SEQ ID NO: 1306174 - RNA, 23 nt, Human
caccuccaaggugucaacuccaa

SEQ ID NO: 1306175 - RNA, 22 nt, Human
cagcaggugcuucucaaggcuu

SEQ ID NO: 1306176 - RNA, 24 nt, Human
cagcugggcagcuuggacugcucu

SEQ ID NO: 1306177 - RNA, 21 nt, Human
ccaccuccaaggugucaacuc

SEQ ID NO: 1306178 - RNA, 24 nt, Human
ccaccuccaaggugucaacuccuu

SEQ ID NO: 1306179 - RNA, 21 nt, Human
ccuccaaggugucaacuccaa

SEQ ID NO: 1306180 - RNA, 21 nt, Human
cuuggacugcucccacagucc

SEQ ID NO: 1306181 - RNA, 21 nt, Human
gagcaggccauuugcuguccu

SEQ ID NO: 1306182 - RNA, 18 nt, Human
ggauugaacugaagaagc

SEQ ID NO: 1306183 - RNA, 21 nt, Human
uccaaaaaaggaaagacuuuc

SEQ ID NO: 1306184 - RNA, 22 nt, Human
ucugcagcugggcagcuuggac

SEQ ID NO: 1306185 - RNA, 24 nt, Human
ucugcagcugggcagcuuggacug

SEQ ID NO: 1306186 - RNA, 21 nt, Human
ucuuggcagcagugguucuga

SEQ ID NO: 1306187 - RNA, 24 nt, Human
ugcaacagguucaucagguggacc

SEQ ID NO: 1306188 - RNA, 21 nt, Human
uggaccuuuuggccccuucug

SEQ ID NO: 1306189 - RNA, 22 nt, Human
ugggccuggaagcgcuggcugu

SEQ ID NO: 1306190 - RNA, 19 nt, Human
uggugggccuggaagcgcu

SEQ ID NO: 1306191 - RNA, 24 nt, Human
ugucaagaauuggucacagucuca

SEQ ID NO: 1306192 - RNA, 21 nt, Human
ugucagcaucuuggcagcagu

SEQ ID NO: 1306193 - RNA, 18 nt, Human
uuaaccaccuccaaggug

SEQ ID NO: 1306194 - RNA, 19 nt, Human
aacacaguaucugcaucuc

SEQ ID NO: 1306195 - RNA, 20 nt, Human
aaggaaacacaguaucugca

SEQ ID NO: 1306196 - RNA, 23 nt, Human
agcaaggaaacacaguaucugca

SEQ ID NO: 1306197 - RNA, 22 nt, Human
caaaugucacauucugggaaug

SEQ ID NO: 1306198 - RNA, 22 nt, Human
cagguccgugaaggggaauuca

SEQ ID NO: 1306199 - RNA, 28 nt, Human
cccagcauccuuaggcuucagguccguu

SEQ ID NO: 1306200 - RNA, 18 nt, Human
ccgagcucuguuccugcu

SEQ ID NO: 1306201 - RNA, 26 nt, Human
cucaugggaggcuguugucuuguagg

SEQ ID NO: 1306202 - RNA, 18 nt, Human
cugccgagcucuguuccu

SEQ ID NO: 1306203 - RNA, 19 nt, Human
cuuguaggcacaaaaguac

SEQ ID NO: 1306204 - RNA, 18 nt, Human
gcacaaaaguaccuccca

SEQ ID NO: 1306205 - RNA, 20 nt, Human
gcucuguuccugcuuguacc

SEQ ID NO: 1306206 - RNA, 19 nt, Human
gugaccaccagcugcaagu

SEQ ID NO: 1306207 - RNA, 21 nt, Human
uaaccuuggccagcacgaucc

SEQ ID NO: 1306208 - RNA, 18 nt, Human
ugaaggggaauucagcuu

SEQ ID NO: 1306209 - RNA, 22 nt, Human
ugucacauucugggaaugagcc

SEQ ID NO: 1306210 - RNA, 22 nt, Human
uuaguggccagggcugucuucu

SEQ ID NO: 1306211 - RNA, 21 nt, Human
aagaaggcuuucuccaaagcc

SEQ ID NO: 1306212 - RNA, 22 nt, Human
acuagccugcagcccuucuaac

SEQ ID NO: 1306213 - RNA, 21 nt, Human
agaaggcuuucuccaaagccc

SEQ ID NO: 1306214 - RNA, 21 nt, Human
ccagcucagccuggagucucu

SEQ ID NO: 1306215 - RNA, 24 nt, Human
ccuggaagggggggccgggaagcu

SEQ ID NO: 1306216 - RNA, 22 nt, Human
ccuucuaacauggugaccuggg

SEQ ID NO: 1306217 - RNA, 21 nt, Human
cggccuggaagggggggccgg

SEQ ID NO: 1306218 - RNA, 20 nt, Human
gaccugggccuacggaaggc

SEQ ID NO: 1306219 - RNA, 22 nt, Human
gcccuucuaacauggugaccug

SEQ ID NO: 1306220 - RNA, 19 nt, Human
gccuggagucucuuggaca

SEQ ID NO: 1306221 - RNA, 20 nt, Human
gccuggagucucuuggacac

SEQ ID NO: 1306222 - RNA, 19 nt, Human
ggccuggaagggggggccg

SEQ ID NO: 1306223 - RNA, 21 nt, Human
gggccgggaagcugagagcac

SEQ ID NO: 1306224 - RNA, 20 nt, Human
ucuccaaagccccucggcug

SEQ ID NO: 1306225 - RNA, 21 nt, Human
ucuccaaagccccucggcugc

SEQ ID NO: 1306226 - RNA, 21 nt, Human
ugagagcacuagccugcagcc

SEQ ID NO: 1306227 - RNA, 23 nt, Human
uggagucucuuggacacaggguc

SEQ ID NO: 1306228 - RNA, 23 nt, Human
uucuccaaagccccucggcugca

SEQ ID NO: 1306229 - RNA, 23 nt, Human
uuccguagaaauucuaggcacug

SEQ ID NO: 1306230 - RNA, 21 nt, Human
agcaccugccgcaaccuuggu

SEQ ID NO: 1306231 - RNA, 22 nt, Human
aggggaagcaccugccgcaacc

SEQ ID NO: 1306232 - RNA, 20 nt, Human
aguauccaacccagacucac

SEQ ID NO: 1306233 - RNA, 25 nt, Human
ccucuggguggccaucgucuugucc

SEQ ID NO: 1306234 - RNA, 21 nt, Human
gaagcaccugccgcaaccuug

SEQ ID NO: 1306235 - RNA, 22 nt, Human
ugaugggggucugcuggggggu

SEQ ID NO: 1306236 - RNA, 22 nt, Human
aaagugcccccacgugauaccu

SEQ ID NO: 1306237 - RNA, 18 nt, Human
acagcagagggaagcugg

SEQ ID NO: 1306238 - RNA, 22 nt, Human
acccagugcccacaaccaacua

SEQ ID NO: 1306239 - RNA, 22 nt, Human
agcaguggcgguagcgguagcc

SEQ ID NO: 1306240 - RNA, 24 nt, Human
agcuaagacgaaagugcccccacg

SEQ ID NO: 1306241 - RNA, 22 nt, Human
auggccauaggauugggagcac

SEQ ID NO: 1306242 - RNA, 21 nt, Human
caaggaucccccgcagcagcc

SEQ ID NO: 1306243 - RNA, 22 nt, Human
caagucccagagaccuuaggga

SEQ ID NO: 1306244 - RNA, 18 nt, Human
cagcaguggcgguagcgg

SEQ ID NO: 1306245 - RNA, 23 nt, Human
cagcucccucaaguagcagggcc

SEQ ID NO: 1306246 - RNA, 20 nt, Human
cagggccagggcaucccagu

SEQ ID NO: 1306247 - RNA, 23 nt, Human
ccacacgccugucagguucagca

SEQ ID NO: 1306248 - RNA, 20 nt, Human
ccacgugauaccucuaaccc

SEQ ID NO: 1306249 - RNA, 23 nt, Human
cccagugcccacaaccaacuacc

SEQ ID NO: 1306250 - RNA, 20 nt, Human
cccucagaguccacuucacu

SEQ ID NO: 1306251 - RNA, 21 nt, Human
cccucagaguccacuucacuc

SEQ ID NO: 1306252 - RNA, 20 nt, Human
ccucuuucuuuuuauuuaaa

SEQ ID NO: 1306253 - RNA, 18 nt, Human
cgaagcaacagccguggc

SEQ ID NO: 1306254 - RNA, 30 nt, Human; identical to SEQ ID NO: 349988

SEQ ID NO: 1306255 - RNA, 23 nt, Human
cggccuccgcggcccucugcccu

SEQ ID NO: 1306256 - RNA, 21 nt, Human
cuccgcggcccucugcccucc

SEQ ID NO: 1306257 - RNA, 21 nt, Human
cugcggccuccgcggcccucu

SEQ ID NO: 1306258 - RNA, 21 nt, Human
gaccggaaagggccacaagga

SEQ ID NO: 1306259 - RNA, 24 nt, Human
gcagcaguguggccugaugggggg

SEQ ID NO: 1306260 - RNA, 25 nt, Human
ggcagcaguguggccugaugggggg

SEQ ID NO: 1306261 - RNA, 23 nt, Human
uaacccagugcccacaaccaacu

SEQ ID NO: 1306262 - RNA, 24 nt, Human
uaaccgaagcaacagccguggcac

SEQ ID NO: 1306263 - RNA, 21 nt, Human
uagcgguagcccucagagucc

SEQ ID NO: 1306264 - RNA, 21 nt, Human
ucccccgcagcagccgugggu

SEQ ID NO: 1306265 - RNA, 18 nt, Human
ugcaacugcggccuccgc

SEQ ID NO: 1306266 - RNA, 19 nt, Human
uggcacagcagagggaagc

SEQ ID NO: 1306267 - RNA, 22 nt, Human
uggcagcaguguggccugaugg

SEQ ID NO: 1306268 - RNA, 19 nt, Human
uggccugauggggggacua

SEQ ID NO: 1306269 - RNA, 24 nt, Human
uggcgguagcgguagcccucagag

SEQ ID NO: 1306270 - RNA, 21 nt, Human
uuuuauuuaaauaaccgaagc

SEQ ID NO: 1306271 - RNA, 18 nt, Human
aaaauacucucgccuguc

SEQ ID NO: 1306272 - RNA, 22 nt, Human
aaaguaugccaucugugguucg

SEQ ID NO: 1306273 - RNA, 21 nt, Human
aagcaccaucacacagguuga

SEQ ID NO: 1306274 - RNA, 19 nt, Human
agguugaugagugcagcug

SEQ ID NO: 1306275 - RNA, 21 nt, Human
caccugauagguguggugauc

SEQ ID NO: 1306276 - RNA, 21 nt, Human
cagcaggaaacaaucaagaaa

SEQ ID NO: 1306277 - RNA, 19 nt, Human
cugucugccauggcagggu

SEQ ID NO: 1306278 - RNA, 22 nt, Human
gaagcaccaucacacagguuga

SEQ ID NO: 1306279 - RNA, 25 nt, Human
gacagcaggaaacaaucaagaaaga

SEQ ID NO: 1306280 - RNA, 18 nt, Human
gccugucugccauggcag

SEQ ID NO: 1306281 - RNA, 21 nt, Human
ggaaacaaucaagaaagaccg

SEQ ID NO: 1306282 - RNA, 20 nt, Human
gugcagcugacccauagaac

SEQ ID NO: 1306283 - RNA, 20 nt, Human
ugcagcugacccauagaacu

SEQ ID NO: 1306284 - RNA, 26 nt, Human
uggaaaauacucucgccugucugcca

SEQ ID NO: 1306285 - RNA, 23 nt, Human
aagaugucuuccaggacaauuuu

SEQ ID NO: 1306286 - RNA, 18 nt, Human
acuccgcaggugucuuga

SEQ ID NO: 1306287 - RNA, 25 nt, Human
aggagguggcugguggcccauccug

SEQ ID NO: 1306288 - RNA, 20 nt, Human
agguggcugguggcccaucc

SEQ ID NO: 1306289 - RNA, 23 nt, Human
cagcugugagguagggccaguag

SEQ ID NO: 1306290 - RNA, 25 nt, Human
cauccgcugaggguagagcugaggg

SEQ ID NO: 1306291 - RNA, 22 nt, Human
cauucugaccucaagaagucag

SEQ ID NO: 1306292 - RNA, 21 nt, Human
ccgcugaggguagagcugagg

SEQ ID NO: 1306293 - RNA, 19 nt, Human
ccuccuggcucucugcugu

SEQ ID NO: 1306294 - RNA, 22 nt, Human
ccuccuggcucucugcuguaca

SEQ ID NO: 1306295 - RNA, 21 nt, Human
cuccacugccgccauucugac

SEQ ID NO: 1306296 - RNA, 24 nt, Human
ggguagagcugaggguggaagggg

SEQ ID NO: 1306297 - RNA, 18 nt, Human
uagagcagacacuuggaa

SEQ ID NO: 1306298 - RNA, 18 nt, Human
uccgcaggugucuugaga

SEQ ID NO: 1306299 - RNA, 18 nt, Human
ugaguuggaggagguggc

SEQ ID NO: 1306300 - RNA, 23 nt, Human
uggaaggugucuugaggcucagg

SEQ ID NO: 1306301 - RNA, 24 nt, Human
uuuuuaaaguuucagcugugaggu

SEQ ID NO: 1306302 - RNA, 18 nt, Human
caggagccuccugagggg

SEQ ID NO: 1306303 - RNA, 26 nt, Human
caggagccuccugaggggcucuguua

SEQ ID NO: 1306304 - RNA, 31 nt, Human
ccccuccugggcaggagccuccugaggggcu

SEQ ID NO: 1306305 - RNA, 18 nt, Human
ccugaggggcucugucuu

SEQ ID NO: 1306306 - RNA, 24 nt, Human
cuccucgucauucucacucccgaa

SEQ ID NO: 1306307 - RNA, 23 nt, Human
uccugggcaggagccuccugagg

SEQ ID NO: 1306308 - RNA, 24 nt, Human
ucuucagccccuucucgugaaggg

SEQ ID NO: 1306309 - RNA, 19 nt, Human
cacaaagaaaaaugacccc

SEQ ID NO: 1306310 - RNA, 18 nt, Human
uaugaugaaaauuuagaa

SEQ ID NO: 1306311 - RNA, 19 nt, Human
ucuggaaaaacugucuuca

SEQ ID NO: 1306312 - RNA, 21 nt, Human
ugaaaaauaagcuucagcgga

SEQ ID NO: 1306313 - RNA, 20 nt, Human
ugcaucagcaauaccauaca

SEQ ID NO: 1306314 - RNA, 19 nt, Human
ugggaagaacaauuuagcu

SEQ ID NO: 1306315 - RNA, 24 nt, Human
aaaaaaaaaaaagguauuuacuaa

SEQ ID NO: 1306316 - RNA, 21 nt, Human
aaaaacagaugaagguggccg

SEQ ID NO: 1306317 - RNA, 19 nt, Human
aaaacagaugaagguggcc

SEQ ID NO: 1306318 - RNA, 20 nt, Human
aaaugugaacaaucaaaacc

SEQ ID NO: 1306319 - RNA, 19 nt, Human
accugcaucugcccccucc

SEQ ID NO: 1306320 - RNA, 21 nt, Human
accugcaucugcccccuccag

SEQ ID NO: 1306321 - RNA, 19 nt, Human
acugcacugcagcagccgg

SEQ ID NO: 1306322 - RNA, 21 nt, Human
acugcacugcagcagccggca

SEQ ID NO: 1306323 - RNA, 21 nt, Human
agaacaggaaaaaagucugaa

SEQ ID NO: 1306324 - RNA, 22 nt, Human
agaaguaauauuucagacuaga

SEQ ID NO: 1306325 - RNA, 19 nt, Human
caggagauaaccugagauu

SEQ ID NO: 1306326 - RNA, 19 nt, Human
cauugaacaggaacaaggc

SEQ ID NO: 1306327 - RNA, 20 nt, Human
cauugaacaggaacaaggcu

SEQ ID NO: 1306328 - RNA, 27 nt, Human
ccauuuugccacuauuauucauauuaa

SEQ ID NO: 1306329 - RNA, 19 nt, Human
cccagagaaaaccacagac

SEQ ID NO: 1306330 - RNA, 21 nt, Human
cccgcguggucggcgucuucc

SEQ ID NO: 1306331 - RNA, 19 nt, Human
ccugcaucugcccccucca

SEQ ID NO: 1306332 - RNA, 23 nt, Human
ccugcaucugcccccuccagaag

SEQ ID NO: 1306333 - RNA, 20 nt, Human
cggcgucuuccugcaccggg

SEQ ID NO: 1306334 - RNA, 23 nt, Human
cguggucggcgucuuccugcacc

SEQ ID NO: 1306335 - RNA, 22 nt, Human
cuacugcacugcagcagccggc

SEQ ID NO: 1306336 - RNA, 18 nt, Human
cuccagcagcuacugcac

SEQ ID NO: 1306337 - RNA, 18 nt, Human
cuucggguacccuucugu

SEQ ID NO: 1306338 - RNA, 19 nt, Human
gaacaggaaaaaagucuga

SEQ ID NO: 1306339 - RNA, 20 nt, Human
gaacaggaaaaaagucugaa

SEQ ID NO: 1306340 - RNA, 19 nt, Human
gacuagaacaggaaaaaag

SEQ ID NO: 1306341 - RNA, 19 nt, Human
gcagcagccggcaccugca

SEQ ID NO: 1306342 - RNA, 22 nt, Human
ggccuccucagccuccagcagc

SEQ ID NO: 1306343 - RNA, 21 nt, Human
uaaaacuucaucugcccaaaa

SEQ ID NO: 1306344 - RNA, 26 nt, Human
uaaaucuucauuucgauugaguucua

SEQ ID NO: 1306345 - RNA, 24 nt, Human
uacugcacugcagcagccggcacc

SEQ ID NO: 1306346 - RNA, 22 nt, Human
uauaaaacuucaucugcccaaa

SEQ ID NO: 1306347 - RNA, 22 nt, Human
ucaccacucugcugggaaaaac

SEQ ID NO: 1306348 - RNA, 22 nt, Human
uccugcaccggguccgggccuc

SEQ ID NO: 1306349 - RNA, 19 nt, Human
ucugcccccuccagaagcu

SEQ ID NO: 1306350 - RNA, 20 nt, Human
uggcccagagaaaaccacag

SEQ ID NO: 1306351 - RNA, 21 nt, Human
ugggaaaaacagaugaaggug

SEQ ID NO: 1306352 - RNA, 21 nt, Human
ugggaaaaacagaugaaggug

SEQ ID NO: 1306353 - RNA, 18 nt, Human
ugugaacaaucaaaacca

SEQ ID NO: 1306354 - RNA, 22 nt, Human
uuacuaaaauaacaaauugugu

SEQ ID NO: 1306355 - RNA, 20 nt, Human
uucagacuagaacaggaaaa

SEQ ID NO: 1306356 - RNA, 21 nt, Human
uucucauuucuucggguaccc

SEQ ID NO: 1306357 - RNA, 23 nt, Human
agcuccgcggcccccacggcccc

SEQ ID NO: 1306358 - RNA, 18 nt, Human
cagggcagcuccgcggcc

SEQ ID NO: 1306359 - RNA, 23 nt, Human
cccacggccccgcacccucugcc

SEQ ID NO: 1306360 - RNA, 24 nt, Human
ccccacggccccgcacccucugcc

SEQ ID NO: 1306361 - RNA, 23 nt, Human
ccccgcacccucugccuccccgc

SEQ ID NO: 1306362 - RNA, 23 nt, Human
ccccgcgggugcugccgccgcuu

SEQ ID NO: 1306363 - RNA, 18 nt, Human
ccgcacccucugccuccc

SEQ ID NO: 1306364 - RNA, 23 nt, Human
cggcccccacggccccgcacccu

SEQ ID NO: 1306365 - RNA, 21 nt, Human
cuaccgggcgcuggggccagg

SEQ ID NO: 1306366 - RNA, 21 nt, Human
cugccgccuagucugggcuga

SEQ ID NO: 1306367 - RNA, 23 nt, Human
gcugccgccgcuugcugaaaugc

SEQ ID NO: 1306368 - RNA, 18 nt, Human
ggccaggcccucgggucc

SEQ ID NO: 1306369 - RNA, 20 nt, Human
ggggccaggcccucgggucc

SEQ ID NO: 1306370 - RNA, 22 nt, Human
ggucccgccgguccgggcugcc

SEQ ID NO: 1306371 - RNA, 19 nt, Human
ggugcugccgccgcuugcu

SEQ ID NO: 1306372 - RNA, 20 nt, Human
uccccgcgggugcugccgcc

SEQ ID NO: 1306373 - RNA, 21 nt, Human
uccccgcgggugcugccgccg

SEQ ID NO: 1306374 - RNA, 19 nt, Human
ucccgccgguccgggcugc

SEQ ID NO: 1306375 - RNA, 21 nt, Human
uggcuggcccuggagccgcug

SEQ ID NO: 1306376 - RNA, 18 nt, Human
aaacaacagaaaaccucc

SEQ ID NO: 1306377 - RNA, 18 nt, Human
aaccacagagccgaucug

SEQ ID NO: 1306378 - RNA, 18 nt, Human
aagacagugacccuaaac

SEQ ID NO: 1306379 - RNA, 22 nt, Human
aagccagagagagccccaaggc

SEQ ID NO: 1306380 - RNA, 25 nt, Human
aagugauccucccaccucagccuuc

SEQ ID NO: 1306381 - RNA, 21 nt, Human
acaacagaaaaccuccauaga

SEQ ID NO: 1306382 - RNA, 19 nt, Human
acccaggcuggagugcagu

SEQ ID NO: 1306383 - RNA, 23 nt, Human
acccaggcuggagugcaguggug

SEQ ID NO: 1306384 - RNA, 21 nt, Human
acugcaaccucugccuccugg

SEQ ID NO: 1306385 - RNA, 21 nt, Human
acugcaaccucugccuccugg

SEQ ID NO: 1306386 - RNA, 22 nt, Human
acugcaaccucugccuccuggg

SEQ ID NO: 1306387 - RNA, 24 nt, Human
agcagcugauggaagagaaccaca

SEQ ID NO: 1306388 - RNA, 19 nt, Human
agcugauggaagagaacca

SEQ ID NO: 1306389 - RNA, 22 nt, Human
aggaaugcaauaauaaaaaaga

SEQ ID NO: 1306390 - RNA, 18 nt, Human
aggaugauagcucacugu

SEQ ID NO: 1306391 - RNA, 25 nt, Human
aggcuggagugcaguggugcgaucu

SEQ ID NO: 1306392 - RNA, 21 nt, Human
agggagaagccagagagagcc

SEQ ID NO: 1306393 - RNA, 18 nt, Human
aguagcugggacuacaga

SEQ ID NO: 1306394 - RNA, 21 nt, Human
agucccacuccuuucccucug

SEQ ID NO: 1306395 - RNA, 24 nt, Human
agugauucuccugacucagccucc

SEQ ID NO: 1306396 - RNA, 19 nt, Human
agugcaguggugcgaucuc

SEQ ID NO: 1306397 - RNA, 23 nt, Human
agugcaguggugcgaucucaacu

SEQ ID NO: 1306398 - RNA, 18 nt, Human
auagcucacuguagccuc

SEQ ID NO: 1306399 - RNA, 28 nt, Human
caacuccugggcucaagugauccucccu

SEQ ID NO: 1306400 - RNA, 20 nt, Human
caagugauccucccaccuca

SEQ ID NO: 1306401 - RNA, 27 nt, Human
caagugauccucccaccucagccuucc

SEQ ID NO: 1306402 - RNA, 22 nt, Human
caagugauucuccugacucagc

SEQ ID NO: 1306403 - RNA, 24 nt, Human
caauggguuccacuagccaagcuu

SEQ ID NO: 1306404 - RNA, 21 nt, Human
cacccaggcuggagugcagug

SEQ ID NO: 1306405 - RNA, 23 nt, Human
caccuuccagacagccccggaca

SEQ ID NO: 1306406 - RNA, 23 nt, Human
caggaaugcaauaauaaaaaaga

SEQ ID NO: 1306407 - RNA, 24 nt, Human
caugauaaaauuuggaccacaggg

SEQ ID NO: 1306408 - RNA, 25 nt, Human
ccaacuccugggcucaagugauccu

SEQ ID NO: 1306409 - RNA, 19 nt, Human
cccgaguagcugggacuac

SEQ ID NO: 1306410 - RNA, 22 nt, Human
cccuuuugccuuuuucuguucc

SEQ ID NO: 1306411 - RNA, 19 nt, Human
ccucccaccucagccuucc

SEQ ID NO: 1306412 - RNA, 24 nt, Human
ccuccuggguucaagugauucucc

SEQ ID NO: 1306413 - RNA, 20 nt, Human
ccucugagccaguagauggg

SEQ ID NO: 1306414 - RNA, 22 nt, Human
ccucugccuccuggguucaagu

SEQ ID NO: 1306415 - RNA, 19 nt, Human
ccucuggcuuuggcauccu

SEQ ID NO: 1306416 - RNA, 23 nt, Human
ccugacucagccucccgaguagc

SEQ ID NO: 1306417 - RNA, 22 nt, Human
ccugggcucaagugauccuccc

SEQ ID NO: 1306418 - RNA, 23 nt, Human
ccuggguucaagugauucuccuc

SEQ ID NO: 1306419 - RNA, 23 nt, Human
ccuggguucaagugauucuccug

SEQ ID NO: 1306420 - RNA, 20 nt, Human
ccuucucugccacccucacc

SEQ ID NO: 1306421 - RNA, 21 nt, Human
ccuuuugccuuuuucuguucc

SEQ ID NO: 1306422 - RNA, 24 nt, Human
cucaagugauccucccaccucagc

SEQ ID NO: 1306423 - RNA, 21 nt, Human
cucacuguagccuccaacucc

SEQ ID NO: 1306424 - RNA, 24 nt, Human
cucacuguagccuccaacuccugg

SEQ ID NO: 1306425 - RNA, 24 nt, Human
cucagccucccgaguagcugggac

SEQ ID NO: 1306426 - RNA, 20 nt, Human
cuccuggguucaagugauuc

SEQ ID NO: 1306427 - RNA, 21 nt, Human
cuccuggguucaagugauucu

SEQ ID NO: 1306428 - RNA, 24 nt, Human
cucgcucugucacccaggcuggag

SEQ ID NO: 1306429 - RNA, 20 nt, Human
cucugucacccaggcuggag

SEQ ID NO: 1306430 - RNA, 21 nt, Human
cucuuuuuuuuuucuccuuuu

SEQ ID NO: 1306431 - RNA, 23 nt, Human
cugacucagccucccgaguagcu

SEQ ID NO: 1306432 - RNA, 23 nt, Human
cugcaaccucugccuccuggguu

SEQ ID NO: 1306433 - RNA, 24 nt, Human
cugcaaccucugccuccuggguuc

SEQ ID NO: 1306434 - RNA, 23 nt, Human
cugccuccuggguucaagugauu

SEQ ID NO: 1306435 - RNA, 21 nt, Human
gagggcgagcugggcuucuuc

SEQ ID NO: 1306436 - RNA, 22 nt, Human
gaguagcugggacuacagacag

SEQ ID NO: 1306437 - RNA, 21 nt, Human
gagugcaguggugcgaucuca

SEQ ID NO: 1306438 - RNA, 22 nt, Human
gcaaccucugccuccuggguuc

SEQ ID NO: 1306439 - RNA, 22 nt, Human
gcucaagugauccucccaccuc

SEQ ID NO: 1306440 - RNA, 25 nt, Human
gcucugucacccaggcuggagugca

SEQ ID NO: 1306441 - RNA, 18 nt, Human
gcucuuuuuuuuuucucc

SEQ ID NO: 1306442 - RNA, 23 nt, Human
ggagaagccagagagagccccaa

SEQ ID NO: 1306443 - RNA, 23 nt, Human
gggagaagccagagagagcccca

SEQ ID NO: 1306444 - RNA, 19 nt, Human
gggcgagggcgagcugggc

SEQ ID NO: 1306445 - RNA, 21 nt, Human
gggcucaagugauccucccac

SEQ ID NO: 1306446 - RNA, 22 nt, Human
gggcucaagugauccucccacc

SEQ ID NO: 1306447 - RNA, 24 nt, Human
gugauccucccaccucagccuucc

SEQ ID NO: 1306448 - RNA, 24 nt, Human
gugauucuccugacucagccuccc

SEQ ID NO: 1306449 - RNA, 21 nt, Human
uacugcaaccucugccuccug

SEQ ID NO: 1306450 - RNA, 23 nt, Human
uacugcaaccucugccuccuggg

SEQ ID NO: 1306451 - RNA, 24 nt, Human
uagcucacuguagccuccaacucc

SEQ ID NO: 1306452 - RNA, 19 nt, Human
uagcugggacuacagacag

SEQ ID NO: 1306453 - RNA, 22 nt, Human
ucacccaggcuggagugcagug

SEQ ID NO: 1306454 - RNA, 21 nt, Human
ucaccuuccagacagccccgg

SEQ ID NO: 1306455 - RNA, 24 nt, Human
ucacuguagccuccaacuccuggg

SEQ ID NO: 1306456 - RNA, 23 nt, Human
ucagccucccgaguagcugggac

SEQ ID NO: 1306457 - RNA, 19 nt, Human
uccagacagccccggacac

SEQ ID NO: 1306458 - RNA, 18 nt, Human
ucccgaguagcugggacu

SEQ ID NO: 1306459 - RNA, 23 nt, Human
ucccuuuugccuuuuucuguucc

SEQ ID NO: 1306460 - RNA, 21 nt, Human
uccugggcucaagugauccuc

SEQ ID NO: 1306461 - RNA, 22 nt, Human
uccugggcucaagugauccucc

SEQ ID NO: 1306462 - RNA, 24 nt, Human
uccugggcucaagugauccuccca

SEQ ID NO: 1306463 - RNA, 21 nt, Human
uccuggguucaagugauucuc

SEQ ID NO: 1306464 - RNA, 24 nt, Human
uccuggguucaagugauucuccug

SEQ ID NO: 1306465 - RNA, 24 nt, Human
ucgcucugucacccaggcuggagu

SEQ ID NO: 1306466 - RNA, 23 nt, Human
ucucagugcucagggacaggaau

SEQ ID NO: 1306467 - RNA, 19 nt, Human
ucucgcucugucacccagg

SEQ ID NO: 1306468 - RNA, 23 nt, Human
ucucgcucugucacccaggcugg

SEQ ID NO: 1306469 - RNA, 24 nt, Human
ucucgcucugucacccaggcugga

SEQ ID NO: 1306470 - RNA, 26 nt, Human
ucucgcucugucacccaggcuggagu

SEQ ID NO: 1306471 - RNA, 27 nt, Human
ucucgcucugucacccaggcuggagug

SEQ ID NO: 1306472 - RNA, 24 nt, Human
ucugucacccaggcuggagugcag

SEQ ID NO: 1306473 - RNA, 22 nt, Human
ucuuuuuuuuuucuccuuuuua

SEQ ID NO: 1306474 - RNA, 20 nt, Human
ugacucagccucccgaguag

SEQ ID NO: 1306475 - RNA, 24 nt, Human
ugacucagccucccgaguagcugg

SEQ ID NO: 1306476 - RNA, 22 nt, Human
ugagauggagucucgcucuguc

SEQ ID NO: 1306477 - RNA, 23 nt, Human
ugauggaagagaaccacagggug

SEQ ID NO: 1306478 - RNA, 20 nt, Human
ugauucuccugacucagccu

SEQ ID NO: 1306479 - RNA, 27 nt, Human
ugcaauaauaaaaaagaaaagaagguc

SEQ ID NO: 1306480 - RNA, 22 nt, Human
ugccuccuggguucaagugauu

SEQ ID NO: 1306481 - RNA, 20 nt, Human
uggaagagaaccacagggug

SEQ ID NO: 1306482 - RNA, 21 nt, Human
uggaccacagggagaagccag

SEQ ID NO: 1306483 - RNA, 20 nt, Human
uggaccacagggagaagccg

SEQ ID NO: 1306484 - RNA, 23 nt, Human
uggagugcaguggugcgaucuca

SEQ ID NO: 1306485 - RNA, 24 nt, Human
ugggcucaagugauccucccaccu

SEQ ID NO: 1306486 - RNA, 23 nt, Human
uggguucaagugauucuccugac

SEQ ID NO: 1306487 - RNA, 24 nt, Human
uggugcgaucucaacuuacugcaa

SEQ ID NO: 1306488 - RNA, 18 nt, Human
uguucaaacaacagaaaa

SEQ ID NO: 1306489 - RNA, 24 nt, Human
uuacugcaaccucugccuccuggg

SEQ ID NO: 1306490 - RNA, 21 nt, Human
uucaaacaacagaaaaccucc

SEQ ID NO: 1306491 - RNA, 23 nt, Human
uucaagugauucuccugacucag

SEQ ID NO: 1306492 - RNA, 24 nt, Human
uucaagugauucuccugacucagc

SEQ ID NO: 1306493 - RNA, 23 nt, Human
uucuugggggucacccgaggcug

SEQ ID NO: 1306494 - RNA, 22 nt, Human
uugccuuuuucuguuccuguau

SEQ ID NO: 1306495 - RNA, 23 nt, Human
uugucucaucccagggaugggag

SEQ ID NO: 1306496 - RNA, 19 nt, Human
aaagugcuaggauuacaag

SEQ ID NO: 1306497 - RNA, 20 nt, Human
aaagugcuaggauuacaagg

SEQ ID NO: 1306498 - RNA, 21 nt, Human
aaagugcuaggauuacaaggg

SEQ ID NO: 1306499 - RNA, 23 nt, Human
aaccugguccuuccugcugucac

SEQ ID NO: 1306500 - RNA, 22 nt, Human
aagugcuaggauuacaagggcu

SEQ ID NO: 1306501 - RNA, 25 nt, Human
acagcuggguguccuaccggggccc

SEQ ID NO: 1306502 - RNA, 20 nt, Human
acaggccugcgaggggucgg

SEQ ID NO: 1306503 - RNA, 22 nt, Human
accccccccccccaaaagaaug

SEQ ID NO: 1306504 - RNA, 18 nt, Human
acgcagguguuccgggcu

SEQ ID NO: 1306505 - RNA, 25 nt, Human
acuauguugcccaggcuggucucaa

SEQ ID NO: 1306506 - RNA, 25 nt, Human
acucauucuuuuuuuuuuuuuuuuu

SEQ ID NO: 1306507 - RNA, 19 nt, Human
acuccgugccccgcacccc

SEQ ID NO: 1306508 - RNA, 21 nt, Human
acuccgugccccgcacccccc

SEQ ID NO: 1306509 - RNA, 18 nt, Human
acugcacucuagccuggg

SEQ ID NO: 1306510 - RNA, 24 nt, Human
agaagccagagauuguagugagcu

SEQ ID NO: 1306511 - RNA, 22 nt, Human
agaccgaggccgaggugcugga

SEQ ID NO: 1306512 - RNA, 19 nt, Human
agagauuguagugagcuca

SEQ ID NO: 1306513 - RNA, 25 nt, Human
agaggaugagagaaagacaaaaagg

SEQ ID NO: 1306514 - RNA, 23 nt, Human
agcugaggcaggagacucacuug

SEQ ID NO: 1306515 - RNA, 18 nt, Human
aggcaggagacucacuug

SEQ ID NO: 1306516 - RNA, 22 nt, Human
aggcaggagacucacuugaacc

SEQ ID NO: 1306517 - RNA, 18 nt, Human
agggagcgcuggggagga

SEQ ID NO: 1306518 - RNA, 24 nt, Human
aucucacucuguagccaggcugga

SEQ ID NO: 1306519 - RNA, 19 nt, Human
auucuagucauucauucac

SEQ ID NO: 1306520 - RNA, 25 nt, Human
caaagugcuaggauuacaagggcua

SEQ ID NO: 1306521 - RNA, 20 nt, Human
caaguaauucuccugccuca

SEQ ID NO: 1306522 - RNA, 22 nt, Human
caaguaauucuccugccucagc

SEQ ID NO: 1306523 - RNA, 22 nt, Human
caagugauccuccugccucggc

SEQ ID NO: 1306524 - RNA, 27 nt, Human
caagugauccuccugccucggccuccc

SEQ ID NO: 1306525 - RNA, 28 nt, Human
caagugauccuccugccucggccuccca

SEQ ID NO: 1306526 - RNA, 21 nt, Human
caccgcccgcagaccgaggcc

SEQ ID NO: 1306527 - RNA, 19 nt, Human
caccuccaggcaguccaga

SEQ ID NO: 1306528 - RNA, 19 nt, Human
caccuuguccgaguuccau

SEQ ID NO: 1306529 - RNA, 19 nt, Human
cacuauguugcccaggcug

SEQ ID NO: 1306530 - RNA, 24 nt, Human
cacuauguugcccaggcuggucuc

SEQ ID NO: 1306531 - RNA, 27 nt, Human
cacuauguugcccaggcuggucucaaa

SEQ ID NO: 1306532 - RNA, 21 nt, Human
cacucuguagccaggcuggag

SEQ ID NO: 1306533 - RNA, 22 nt, Human
cacucuguagccaggcuggagu

SEQ ID NO: 1306534 - RNA, 23 nt, Human
cacugaaaccucugccucccaag

SEQ ID NO: 1306535 - RNA, 18 nt, Human
cacugcacucuagccugg

SEQ ID NO: 1306536 - RNA, 19 nt, Human
cacugcacucuagccuggg

SEQ ID NO: 1306537 - RNA, 20 nt, Human
cacugcacucuagccugggc

SEQ ID NO: 1306538 - RNA, 21 nt, Human
cacugcacucuagccugggcc

SEQ ID NO: 1306539 - RNA, 20 nt, Human
cacugcacuucacaguuugc

SEQ ID NO: 1306540 - RNA, 24 nt, Human
cagccgcacccugcuccuguuggc

SEQ ID NO: 1306541 - RNA, 20 nt, Human
cagccuccugaguagcugag

SEQ ID NO: 1306542 - RNA, 24 nt, Human
caggcuggagugcagugaccacga

SEQ ID NO: 1306543 - RNA, 26 nt, Human
cagggccaaggaggcuuggauggagc

SEQ ID NO: 1306544 - RNA, 21 nt, Human
cauaacauggugaaaggcaaa

SEQ ID NO: 1306545 - RNA, 22 nt, Human
caucaugucgcccaagcucuuc

SEQ ID NO: 1306546 - RNA, 21 nt, Human
cauucuuuuuuuuuuuuuuuu

SEQ ID NO: 1306547 - RNA, 19 nt, Human
ccaaagugcuaggauuaca

SEQ ID NO: 1306548 - RNA, 20 nt, Human
ccacugcacucuagccuggg

SEQ ID NO: 1306549 - RNA, 20 nt, Human
ccacugcacucuagccuggg

SEQ ID NO: 1306550 - RNA, 21 nt, Human
ccacugcacucuagccugggc

SEQ ID NO: 1306551 - RNA, 24 nt, Human
ccagcccgcgcucuuccgcacccc

SEQ ID NO: 1306552 - RNA, 22 nt, Human
ccaggagcccuggucuggggga

SEQ ID NO: 1306553 - RNA, 19 nt, Human
ccccgcacccccccccccc

SEQ ID NO: 1306554 - RNA, 20 nt, Human
ccccgcacccccccccccca

SEQ ID NO: 1306555 - RNA, 23 nt, Human
ccccgcaccccccccccccaaaa

SEQ ID NO: 1306556 - RNA, 23 nt, Human
ccccgugcuagacuccgugcccc

SEQ ID NO: 1306557 - RNA, 18 nt, Human
cccgcacccccccccccc

SEQ ID NO: 1306558 - RNA, 20 nt, Human
cccgcgcucuuccgcacccc

SEQ ID NO: 1306559 - RNA, 18 nt, Human
cccuguguccgugucccg

SEQ ID NO: 1306560 - RNA, 20 nt, Human
ccgcaccccccccccccaaa

SEQ ID NO: 1306561 - RNA, 21 nt, Human
ccgcaccccccccccccaaaa

SEQ ID NO: 1306562 - RNA, 23 nt, Human
ccgcccgcagaccgaggccgagg

SEQ ID NO: 1306563 - RNA, 21 nt, Human
ccgcucgguucccgcgugccc

SEQ ID NO: 1306564 - RNA, 18 nt, Human
ccgucaccagcuuccugu

SEQ ID NO: 1306565 - RNA, 22 nt, Human
ccguguauuguccccugugucc

SEQ ID NO: 1306566 - RNA, 22 nt, Human
ccucaagugauccuccugccuc

SEQ ID NO: 1306567 - RNA, 21 nt, Human
ccuccagaauguaccguucau

SEQ ID NO: 1306568 - RNA, 22 nt, Human
ccuccaggcaguccagaacgug

SEQ ID NO: 1306569 - RNA, 24 nt, Human
ccucccaaguucaaguaauucucc

SEQ ID NO: 1306570 - RNA, 26 nt, Human
ccuccugccucggccucccaaagugc

SEQ ID NO: 1306571 - RNA, 18 nt, Human
ccuggccucaagugaucc

SEQ ID NO: 1306572 - RNA, 21 nt, Human
ccuggccucaagugauccucc

SEQ ID NO: 1306573 - RNA, 22 nt, Human
ccuggccucaagugauccuccu

SEQ ID NO: 1306574 - RNA, 23 nt, Human
ccuggccucaagugauccuccug

SEQ ID NO: 1306575 - RNA, 22 nt, Human
cgcaccccccccccccaaaaga

SEQ ID NO: 1306576 - RNA, 22 nt, Human
cgcaccccuccagaauguaccg

SEQ ID NO: 1306577 - RNA, 24 nt, Human
cuaccggggcccuggccuggacug

SEQ ID NO: 1306578 - RNA, 24 nt, Human
cucaagugauccuccugccucggc

SEQ ID NO: 1306579 - RNA, 22 nt, Human
cucacugaaaccucugccuccc

SEQ ID NO: 1306580 - RNA, 23 nt, Human
cucacugaaaccucugccuccca

SEQ ID NO: 1306581 - RNA, 23 nt, Human
cuccagcccgcgcucuuccgcac

SEQ ID NO: 1306582 - RNA, 18 nt, Human
cugaaaccucugccuccc

SEQ ID NO: 1306583 - RNA, 24 nt, Human
cugaaaccucugccucccaaguuc

SEQ ID NO: 1306584 - RNA, 22 nt, Human
cugcaccuaugugcccggcacc

SEQ ID NO: 1306585 - RNA, 25 nt, Human
cugcccacccguguauuguccccug

SEQ ID NO: 1306586 - RNA, 23 nt, Human
cugccucagccuccugaguagcu

SEQ ID NO: 1306587 - RNA, 23 nt, Human
cugccucggccucccaaagugcu

SEQ ID NO: 1306588 - RNA, 24 nt, Human
cugugccugcgcuucuucucuccc

SEQ ID NO: 1306589 - RNA, 21 nt, Human
cuuuuuuuuuuuuuuuuuuuu

SEQ ID NO: 1306590 - RNA, 24 nt, Human
gacagucucacuauguugcccagg

SEQ ID NO: 1306591 - RNA, 20 nt, Human
gacuccgugccccgcacccc

SEQ ID NO: 1306592 - RNA, 21 nt, Human
gagaaagacaaaaaggggcca

SEQ ID NO: 1306593 - RNA, 19 nt, Human
gagacucacuugaaccaga

SEQ ID NO: 1306594 - RNA, 20 nt, Human
gagcucacgccacugcacuc

SEQ ID NO: 1306595 - RNA, 23 nt, Human
gagcucacgccacugcacucuag

SEQ ID NO: 1306596 - RNA, 22 nt, Human
gcaguccagaacgugggcaaca

SEQ ID NO: 1306597 - RNA, 20 nt, Human
gccacugcacucuagccugg

SEQ ID NO: 1306598 - RNA, 20 nt, Human
gccucagccuccugaguagc

SEQ ID NO: 1306599 - RNA, 18 nt, Human
gccugcgaggggucgggg

SEQ ID NO: 1306600 - RNA, 22 nt, Human
gccugggccccgugcuagacuc

SEQ ID NO: 1306601 - RNA, 20 nt, Human
gcugcagcccaccgugcgcc

SEQ ID NO: 1306602 - RNA, 20 nt, Human
gcuggagugcagugaccacg

SEQ ID NO: 1306603 - RNA, 23 nt, Human
gcuggucucaaacuccuggccuc

SEQ ID NO: 1306604 - RNA, 18 nt, Human
gcuuggauggagccgcug

SEQ ID NO: 1306605 - RNA, 21 nt, Human
gcuuggauggagccgcugcag

SEQ ID NO: 1306606 - RNA, 20 nt, Human
ggagcagagcgcgcagacgc

SEQ ID NO: 1306607 - RNA, 23 nt, Human
ggccacuggcacgcccacguagg

SEQ ID NO: 1306608 - RNA, 22 nt, Human
ggccucaagugauccuccugcc

SEQ ID NO: 1306609 - RNA, 24 nt, Human
ggcuggucucaaacuccuggccuc

SEQ ID NO: 1306610 - RNA, 19 nt, Human
ggggagggggcugccagga

SEQ ID NO: 1306611 - RNA, 25 nt, Human
ggggcgggcgaagagcgguggggaa

SEQ ID NO: 1306612 - RNA, 23 nt, Human
guaauucuccugccucagccucc

SEQ ID NO: 1306613 - RNA, 18 nt, Human
guagccaggcuggagugc

SEQ ID NO: 1306614 - RNA, 21 nt, Human
gucagggacggagccuaaggg

SEQ ID NO: 1306615 - RNA, 18 nt, Human
uaaaccuagcagaaccug

SEQ ID NO: 1306616 - RNA, 22 nt, Human
uaaguuagagacagucucacua

SEQ ID NO: 1306617 - RNA, 20 nt, Human
uaauucuccugccucagccu

SEQ ID NO: 1306618 - RNA, 26 nt, Human
uagaacagaaauuuauuuucucacag

SEQ ID NO: 1306619 - RNA, 24 nt, Human
uagcagaaccugguccuuccugcu

SEQ ID NO: 1306620 - RNA, 23 nt, Human
uauguugcccaggcuggucucaa

SEQ ID NO: 1306621 - RNA, 24 nt, Human
uauguugcccaggcuggucucaaa

SEQ ID NO: 1306622 - RNA, 23 nt, Human
ucacgccacugcacucuagccug

SEQ ID NO: 1306623 - RNA, 24 nt, Human
ucacucuguagccaggcuggagug

SEQ ID NO: 1306624 - RNA, 18 nt, Human
ucacugaaaccucugccu

SEQ ID NO: 1306625 - RNA, 19 nt, Human
ucacugaaaccucugccuc

SEQ ID NO: 1306626 - RNA, 24 nt, Human
ucacugaaaccucugccucccaag

SEQ ID NO: 1306627 - RNA, 23 nt, Human
ucagccuccugaguagcugaggc

SEQ ID NO: 1306628 - RNA, 25 nt, Human
ucagccuccugaguagcugaggcag

SEQ ID NO: 1306629 - RNA, 18 nt, Human
ucauucauucacucacuc

SEQ ID NO: 1306630 - RNA, 25 nt, Human
uccaacccaggucugcuuuggugac

SEQ ID NO: 1306631 - RNA, 19 nt, Human
uccagaauguaccguucau

SEQ ID NO: 1306632 - RNA, 22 nt, Human
uccagcccgcgcucuuccgcac

SEQ ID NO: 1306633 - RNA, 20 nt, Human
uccagggccaaggaggcuug

SEQ ID NO: 1306634 - RNA, 23 nt, Human
ucccaaagugcuaggauuacaag

SEQ ID NO: 1306635 - RNA, 21 nt, Human
ucccaaguucaaguaauucuc

SEQ ID NO: 1306636 - RNA, 24 nt, Human
ucccaaguucaaguaauucuccug

SEQ ID NO: 1306637 - RNA, 19 nt, Human
ucucacuauguugcccagg

SEQ ID NO: 1306638 - RNA, 23 nt, Human
ucucacuauguugcccaggcugg

SEQ ID NO: 1306639 - RNA, 24 nt, Human
ucucacuauguugcccaggcuggu

SEQ ID NO: 1306640 - RNA, 26 nt, Human
ucucacuauguugcccaggcuggucu

SEQ ID NO: 1306641 - RNA, 27 nt, Human
ucucacuauguugcccaggcuggucuc

SEQ ID NO: 1306642 - RNA, 23 nt, Human
ucucacucuguagccaggcugga

SEQ ID NO: 1306643 - RNA, 22 nt, Human
ucucaggcugcaccuaugugcc

SEQ ID NO: 1306644 - RNA, 24 nt, Human
ucuccugccucagccuccugagua

SEQ ID NO: 1306645 - RNA, 18 nt, Human
ucuguagccaggcuggag

SEQ ID NO: 1306646 - RNA, 23 nt, Human
ucuguagccaggcuggagugcag

SEQ ID NO: 1306647 - RNA, 19 nt, Human
ugaaaccucugccucccaa

SEQ ID NO: 1306648 - RNA, 25 nt, Human
ugagagaaagacaaaaaggggccag

SEQ ID NO: 1306649 - RNA, 18 nt, Human
ugagagccacuguuccug

SEQ ID NO: 1306650 - RNA, 20 nt, Human
ugaggcaggagacucacuug

SEQ ID NO: 1306651 - RNA, 24 nt, Human
ugaggcaggagacucacuugaacc

SEQ ID NO: 1306652 - RNA, 23 nt, Human
ugcacagcuggguguccuaccgg

SEQ ID NO: 1306653 - RNA, 23 nt, Human
ugccaacccgccccguuccacgc

SEQ ID NO: 1306654 - RNA, 18 nt, Human
ugccaggagcccuggucu

SEQ ID NO: 1306655 - RNA, 22 nt, Human
ugccaggagcccuggucugggg

SEQ ID NO: 1306656 - RNA, 24 nt, Human
ugcccaggcuggucucaaacuccu

SEQ ID NO: 1306657 - RNA, 22 nt, Human
ugccccgcacccccccccccca

SEQ ID NO: 1306658 - RNA, 24 nt, Human
ugccccgcaccccccccccccaaa

SEQ ID NO: 1306659 - RNA, 24 nt, Human
ugccucagccuccugaguagcuga

SEQ ID NO: 1306660 - RNA, 27 nt, Human
ugccucccaaguucaaguaauucuuuu

SEQ ID NO: 1306661 - RNA, 21 nt, Human
ugccucggccucccaaagugc

SEQ ID NO: 1306662 - RNA, 23 nt, Human
ugccucggccucccaaagugcua

SEQ ID NO: 1306663 - RNA, 24 nt, Human
ugccucggccucccaaagugcuag

SEQ ID NO: 1306664 - RNA, 24 nt, Human
ugccugcgcuucuucucucccgac

SEQ ID NO: 1306665 - RNA, 20 nt, Human
ugcuaggauuacaagggcua

SEQ ID NO: 1306666 - RNA, 18 nt, Human
uggauggagccgcugcag

SEQ ID NO: 1306667 - RNA, 18 nt, Human
uggccucaagugauccuc

SEQ ID NO: 1306668 - RNA, 20 nt, Human
uggccucaagugauccuccu

SEQ ID NO: 1306669 - RNA, 24 nt, Human
uggccucaagugauccuccugccu

SEQ ID NO: 1306670 - RNA, 18 nt, Human
ugggaaguccaaggucau

SEQ ID NO: 1306671 - RNA, 20 nt, Human
ugggccggguuggacugggc

SEQ ID NO: 1306672 - RNA, 19 nt, Human
uggggaggaccagggaggc

SEQ ID NO: 1306673 - RNA, 21 nt, Human
uggggaggaccagggaggcug

SEQ ID NO: 1306674 - RNA, 21 nt, Human
ugggggacuccagcccgcgcu

SEQ ID NO: 1306675 - RNA, 19 nt, Human
ugggggcccugcugagcgc

SEQ ID NO: 1306676 - RNA, 22 nt, Human
uguauuguccccuguguccgug

SEQ ID NO: 1306677 - RNA, 18 nt, Human
uguccccuguguccgugu

SEQ ID NO: 1306678 - RNA, 21 nt, Human
uucaaguaauucuccugccuc

SEQ ID NO: 1306679 - RNA, 23 nt, Human
uucaaguaauucuccugccucag

SEQ ID NO: 1306680 - RNA, 24 nt, Human
uucaaguaauucuccugccucagc

SEQ ID NO: 1306681 - RNA, 19 nt, Human
uucccgcgugccccgccgu

SEQ ID NO: 1306682 - RNA, 27 nt, Human
uucuuuuuuuuuuuuuuuuuuuugggg

SEQ ID NO: 1306683 - RNA, 23 nt, Human
uugaaccagaagccagagauugu

SEQ ID NO: 1306684 - RNA, 26 nt, Human
uuuuuuuuuuuugagauggaaucuca

SEQ ID NO: 1306685 - RNA, 20 nt, Human
uuuuuuuuuuuuuuuugaga

SEQ ID NO: 1306686 - RNA, 19 nt, Human
acacagcgagacuucgucu

SEQ ID NO: 1306687 - RNA, 20 nt, Human
acacagcgagacuucgucuc

SEQ ID NO: 1306688 - RNA, 20 nt, Human
acacagcgagacuucgucuc

SEQ ID NO: 1306689 - RNA, 22 nt, Human
agccugggugacacagcgagac

SEQ ID NO: 1306690 - RNA, 23 nt, Human
agccugggugacacagcgagacu

SEQ ID NO: 1306691 - RNA, 22 nt, Human
caccacaauggccucagaggac

SEQ ID NO: 1306692 - RNA, 18 nt, Human
cagcgagacuucgucucg

SEQ ID NO: 1306693 - RNA, 22 nt, Human
ccacuucccaccauucugaugc

SEQ ID NO: 1306694 - RNA, 20 nt, Human
ccccaguccucccacucugc

SEQ ID NO: 1306695 - RNA, 21 nt, Human
ccccguguccuccuucaccaa

SEQ ID NO: 1306696 - RNA, 20 nt, Human
ccugggugacacagcgagac

SEQ ID NO: 1306697 - RNA, 21 nt, Human
ccugggugacacagcgagacu

SEQ ID NO: 1306698 - RNA, 19 nt, Human
ccuugggcuacucagugcc

SEQ ID NO: 1306699 - RNA, 20 nt, Human
cuagaccccaguccucccac

SEQ ID NO: 1306700 - RNA, 23 nt, Human
gaccccaguccucccacucugcg

SEQ ID NO: 1306701 - RNA, 20 nt, Human
gaccccguguccuccuucac

SEQ ID NO: 1306702 - RNA, 24 nt, Human
gcaugguggugggcgccugugguc

SEQ ID NO: 1306703 - RNA, 18 nt, Human
uagaccccaguccuccca

SEQ ID NO: 1306704 - RNA, 20 nt, Human
ucccagcaggcugcuagacc

SEQ ID NO: 1306705 - RNA, 21 nt, Human
aaaaaagaaaaacugaacuuc

SEQ ID NO: 1306706 - RNA, 21 nt, Human
aaacggaucagagggaaagcu

SEQ ID NO: 1306707 - RNA, 22 nt, Human
aaaguuugauuuaggcuuaaag

SEQ ID NO: 1306708 - RNA, 26 nt, Human
aagaaaaauauuuaaaauaaagaaaa

SEQ ID NO: 1306709 - RNA, 22 nt, Human
acacccccgcaccccugcaagc

SEQ ID NO: 1306710 - RNA, 23 nt, Human
accaggcagggccgcccggaguc

SEQ ID NO: 1306711 - RNA, 19 nt, Human
accccggaccgcccagucu

SEQ ID NO: 1306712 - RNA, 18 nt, Human
accccuggggugggucug

SEQ ID NO: 1306713 - RNA, 21 nt, Human
acugcccccggccuccagcac

SEQ ID NO: 1306714 - RNA, 19 nt, Human
acuucgaucuucuucucca

SEQ ID NO: 1306715 - RNA, 20 nt, Human
agaaaugucauucuggucgu

SEQ ID NO: 1306716 - RNA, 19 nt, Human
agccuggcagggcggagcc

SEQ ID NO: 1306717 - RNA, 27 nt, Human
agcuucguuucuuacucggauggagac

SEQ ID NO: 1306718 - RNA, 20 nt, Human
aggcaggccccggugcagcc

SEQ ID NO: 1306719 - RNA, 25 nt, Human
aggcgacaggccugcgguuuucaca

SEQ ID NO: 1306720 - RNA, 20 nt, Human
agggcggagccuaggccgcg

SEQ ID NO: 1306721 - RNA, 19 nt, Human
aggggacagggaugcggua

SEQ ID NO: 1306722 - RNA, 20 nt, Human
caauuuaaaaguggccgccu

SEQ ID NO: 1306723 - RNA, 23 nt, Human
cacccccgcaccccugcaagcuc

SEQ ID NO: 1306724 - RNA, 27 nt, Human
cacgaguccgcggagcgccagucacac

SEQ ID NO: 1306725 - RNA, 24 nt, Human
cacugcacugcccacgaguuugcc

SEQ ID NO: 1306726 - RNA, 24 nt, Human
cacugcccacgaguuugcggggug

SEQ ID NO: 1306727 - RNA, 20 nt, Human
caggacccacuaggugggcc

SEQ ID NO: 1306728 - RNA, 26 nt, Human
caggcgagcuucccucgucgcggccc

SEQ ID NO: 1306729 - RNA, 23 nt, Human
ccacuaggugggccgcucggccc

SEQ ID NO: 1306730 - RNA, 18 nt, Human
ccagcacugcacugccca

SEQ ID NO: 1306731 - RNA, 22 nt, Human
ccccagguccgcaggccgccuc

SEQ ID NO: 1306732 - RNA, 19 nt, Human
cccccgcaccccugcaagc

SEQ ID NO: 1306733 - RNA, 22 nt, Human
cccccgcaccccugcaagcucc

SEQ ID NO: 1306734 - RNA, 23 nt, Human
cccccgcaccccugcaagcuccc

SEQ ID NO: 1306735 - RNA, 23 nt, Human
ccccgcaccccugcaagcucccg

SEQ ID NO: 1306736 - RNA, 25 nt, Human
ccccggccgaacccuacauguccuc

SEQ ID NO: 1306737 - RNA, 19 nt, Human
cccucgcacccgcccucug

SEQ ID NO: 1306738 - RNA, 22 nt, Human
cccugcggguccgccacugccc

SEQ ID NO: 1306739 - RNA, 20 nt, Human
cccuggggugggucugaccc

SEQ ID NO: 1306740 - RNA, 21 nt, Human
ccgcaccccugcaagcucccc

SEQ ID NO: 1306741 - RNA, 22 nt, Human
ccgccacugcccccggccucca

SEQ ID NO: 1306742 - RNA, 22 nt, Human
ccgcccucugcucugccgcucc

SEQ ID NO: 1306743 - RNA, 20 nt, Human
ccgccuaggcgacaggccug

SEQ ID NO: 1306744 - RNA, 22 nt, Human
ccgcgcgcggacucggcuuccc

SEQ ID NO: 1306745 - RNA, 19 nt, Human
ccucauauacucgcccgga

SEQ ID NO: 1306746 - RNA, 22 nt, Human
ccuccagcacugcacugcccac

SEQ ID NO: 1306747 - RNA, 20 nt, Human
cgagcagagaggugggagac

SEQ ID NO: 1306748 - RNA, 21 nt, Human
cgaggggacagggaugcggua

SEQ ID NO: 1306749 - RNA, 22 nt, Human
cgcccagucucagccuaaaaac

SEQ ID NO: 1306750 - RNA, 23 nt, Human
cgccccgggguuggagguuccca

SEQ ID NO: 1306751 - RNA, 19 nt, Human
cggccgaacccuacauguc

SEQ ID NO: 1306752 - RNA, 23 nt, Human
cuccagcacugcacugcccacga

SEQ ID NO: 1306753 - RNA, 23 nt, Human
cucggccccaagccuggcagggc

SEQ ID NO: 1306754 - RNA, 18 nt, Human
gaaccccggaccgcccag

SEQ ID NO: 1306755 - RNA, 19 nt, Human
gacaagguuacccugcggg

SEQ ID NO: 1306756 - RNA, 22 nt, Human
gagguucccacggagccgggaa

SEQ ID NO: 1306757 - RNA, 21 nt, Human
gccuaggccgcgcgccccggg

SEQ ID NO: 1306758 - RNA, 24 nt, Human
gcgacccuuuccugcuggccuucu

SEQ ID NO: 1306759 - RNA, 21 nt, Human
gcggagcgccagucacacccc

SEQ ID NO: 1306760 - RNA, 23 nt, Human
gcggggugugagcgccgaaggag

SEQ ID NO: 1306761 - RNA, 22 nt, Human
ggaaaagucagcucguacguuu

SEQ ID NO: 1306762 - RNA, 18 nt, Human
ggcugcugggggcucggg

SEQ ID NO: 1306763 - RNA, 20 nt, Human
ggggaaagguggggcgggaa

SEQ ID NO: 1306764 - RNA, 22 nt, Human
gguaguaggggaaagguggggc

SEQ ID NO: 1306765 - RNA, 19 nt, Human
ggugugagcgccgaaggag

SEQ ID NO: 1306766 - RNA, 22 nt, Human
gguuuucacaguguaaaacgga

SEQ ID NO: 1306767 - RNA, 18 nt, Human
guagguuuccccuaggaa

SEQ ID NO: 1306768 - RNA, 20 nt, Human
uacugcggauggcaccggaa

SEQ ID NO: 1306769 - RNA, 23 nt, Human
uauaaacgaaaauaaaaguuuga

SEQ ID NO: 1306770 - RNA, 24 nt, Human
ucacacccccgcaccccugcaagc

SEQ ID NO: 1306771 - RNA, 23 nt, Human
ucagccuaaaaacuuggauccaa

SEQ ID NO: 1306772 - RNA, 18 nt, Human
uccccaggucaggaccca

SEQ ID NO: 1306773 - RNA, 26 nt, Human
ucccugaagcgggacuuacucaaccu

SEQ ID NO: 1306774 - RNA, 24 nt, Human
uccgcaggccgccucccuucccuc

SEQ ID NO: 1306775 - RNA, 18 nt, Human
uccgcgacccuuuccugc

SEQ ID NO: 1306776 - RNA, 25 nt, Human
uccgcggagcgccagucacaccccc

SEQ ID NO: 1306777 - RNA, 25 nt, Human
uccuacgguuguggaugugccaguc

SEQ ID NO: 1306778 - RNA, 19 nt, Human
uccugggugugcgggaguc

SEQ ID NO: 1306779 - RNA, 19 nt, Human
ucgcacccgcccucugcuc

SEQ ID NO: 1306780 - RNA, 18 nt, Human
ucgcggagggaagcgagg

SEQ ID NO: 1306781 - RNA, 19 nt, Human
ucugccgcucccgguccug

SEQ ID NO: 1306782 - RNA, 21 nt, Human
ucugucuuucccagaaagcgg

SEQ ID NO: 1306783 - RNA, 23 nt, Human
ugcugggggcucgggaggugcgc

SEQ ID NO: 1306784 - RNA, 19 nt, Human
uggcugaggcaauggcacc

SEQ ID NO: 1306785 - RNA, 22 nt, Human
uucacaguguaaaacggaucag

SEQ ID NO: 1306786 - RNA, 20 nt, Human
uuccccaggucaggacccac

SEQ ID NO: 1306787 - RNA, 24 nt, Human
uucccuggugucaccaaauaaaca

SEQ ID NO: 1306788 - RNA, 18 nt, Human
uucuggucguuccucccu

SEQ ID NO: 1306789 - RNA, 23 nt, Human
uugguuuuucgucuauuugcuuc

SEQ ID NO: 1306790 - RNA, 19 nt, Human
aaaaaagaaaaacugaacu

SEQ ID NO: 1306791 - RNA, 18 nt, Human
aaacgaaaauaaaaguuu

SEQ ID NO: 1306792 - RNA, 21 nt, Human
aaacggaucagagggaaagcu

SEQ ID NO: 1306793 - RNA, 22 nt, Human
aaaguuugauuuaggcuuaaag

SEQ ID NO: 1306794 - RNA, 26 nt, Human
aagaaaaauauuuaaaauaaagaaaa

SEQ ID NO: 1306795 - RNA, 23 nt, Human
aagcagauagcagcaggcaucag

SEQ ID NO: 1306796 - RNA, 19 nt, Human
accccggaccgcccagucu

SEQ ID NO: 1306797 - RNA, 18 nt, Human
accccuggggugggucug

SEQ ID NO: 1306798 - RNA, 21 nt, Human
acugcccccggccuccagcac

SEQ ID NO: 1306799 - RNA, 19 nt, Human
acuucgaucuucuucucca

SEQ ID NO: 1306800 - RNA, 20 nt, Human
agaaaugucauucuggucgu

SEQ ID NO: 1306801 - RNA, 20 nt, Human
agacaagguuacccugcggg

SEQ ID NO: 1306802 - RNA, 19 nt, Human
agccuggcagggcggagcc

SEQ ID NO: 1306803 - RNA, 25 nt, Human
aggcgacaggccugcgguuuucaca

SEQ ID NO: 1306804 - RNA, 20 nt, Human
caauuuaaaaguggccgccu

SEQ ID NO: 1306805 - RNA, 24 nt, Human
cacugcacugcccacgaguuugcc

SEQ ID NO: 1306806 - RNA, 24 nt, Human
cacugcccacgaguuugcggggug

SEQ ID NO: 1306807 - RNA, 24 nt, Human
cagcaggcaucagcacacuccggc

SEQ ID NO: 1306808 - RNA, 28 nt, Human
cagcuucguuucuuacucggauggagac

SEQ ID NO: 1306809 - RNA, 20 nt, Human
caggacccacuaggugggcc

SEQ ID NO: 1306810 - RNA, 22 nt, Human
cagggcggagccuaggccgcgc

SEQ ID NO: 1306811 - RNA, 23 nt, Human
ccacuaggugggccgcucggccc

SEQ ID NO: 1306812 - RNA, 18 nt, Human
ccagcacugcacugccca

SEQ ID NO: 1306813 - RNA, 18 nt, Human
ccccaggucaggacccac

SEQ ID NO: 1306814 - RNA, 22 nt, Human
ccccagguccgcaggccgccuc

SEQ ID NO: 1306815 - RNA, 24 nt, Human
cccgccgcuacagggagaagugcg

SEQ ID NO: 1306816 - RNA, 24 nt, Human
cccgguggugccaccuuaagaguc

SEQ ID NO: 1306817 - RNA, 19 nt, Human
cccucgcacccgcccucug

SEQ ID NO: 1306818 - RNA, 22 nt, Human
cccugcggguccgccacugccc

SEQ ID NO: 1306819 - RNA, 20 nt, Human
cccuggggugggucugaccc

SEQ ID NO: 1306820 - RNA, 22 nt, Human
ccgccacugcccccggccucca

SEQ ID NO: 1306821 - RNA, 22 nt, Human
ccgcccucugcucugccgcucc

SEQ ID NO: 1306822 - RNA, 20 nt, Human
ccgccuaggcgacaggccug

SEQ ID NO: 1306823 - RNA, 22 nt, Human
ccgcgcgcggacucggcuuccc

SEQ ID NO: 1306824 - RNA, 19 nt, Human
ccucauauacucgcccgga

SEQ ID NO: 1306825 - RNA, 22 nt, Human
ccuccagcacugcacugcccac

SEQ ID NO: 1306826 - RNA, 22 nt, Human
cgcccagucucagccuaaaaac

SEQ ID NO: 1306827 - RNA, 23 nt, Human
cgccccgggguuggagguuccca

SEQ ID NO: 1306828 - RNA, 21 nt, Human
cgcccggaauuuucaaucucg

SEQ ID NO: 1306829 - RNA, 23 nt, Human
cuccagcacugcacugcccacga

SEQ ID NO: 1306830 - RNA, 23 nt, Human
cucggccccaagccuggcagggc

SEQ ID NO: 1306831 - RNA, 22 nt, Human
cugucgaaaucgcuagcugcgc

SEQ ID NO: 1306832 - RNA, 18 nt, Human
gaaccccggaccgcccag

SEQ ID NO: 1306833 - RNA, 19 nt, Human
gagcacaguuaccaaugcc

SEQ ID NO: 1306834 - RNA, 22 nt, Human
gagguucccacggagccgggaa

SEQ ID NO: 1306835 - RNA, 21 nt, Human
gccuaggccgcgcgccccggg

SEQ ID NO: 1306836 - RNA, 23 nt, Human
gcggggugugagcgccgaaggag

SEQ ID NO: 1306837 - RNA, 20 nt, Human
gcugcggguugcgcgcgggc

SEQ ID NO: 1306838 - RNA, 22 nt, Human
ggaaaagucagcucguacguuu

SEQ ID NO: 1306839 - RNA, 19 nt, Human
ggugugagcgccgaaggag

SEQ ID NO: 1306840 - RNA, 22 nt, Human
gguuuucacaguguaaaacgga

SEQ ID NO: 1306841 - RNA, 21 nt, Human
gugggcugcugggggcucggg

SEQ ID NO: 1306842 - RNA, 21 nt, Human
uacucgcccggaauuuucaau

SEQ ID NO: 1306843 - RNA, 20 nt, Human
uacugcggauggcaccggaa

SEQ ID NO: 1306844 - RNA, 23 nt, Human
uauaaacgaaaauaaaaguuuga

SEQ ID NO: 1306845 - RNA, 23 nt, Human
ucagccuaaaaacuuggauccaa

SEQ ID NO: 1306846 - RNA, 26 nt, Human
ucccugaagcgggacuuacucaaccu

SEQ ID NO: 1306847 - RNA, 24 nt, Human
uccgcaggccgccucccuucccuc

SEQ ID NO: 1306848 - RNA, 18 nt, Human
uccgcgacccuuuccugc

SEQ ID NO: 1306849 - RNA, 27 nt, Human
uccgcgacccuuuccugcuggccuucu

SEQ ID NO: 1306850 - RNA, 25 nt, Human
uccuacgguuguggaugugccaguc

SEQ ID NO: 1306851 - RNA, 19 nt, Human
uccugggugugcgggaguc

SEQ ID NO: 1306852 - RNA, 19 nt, Human
ucgcacccgcccucugcuc

SEQ ID NO: 1306853 - RNA, 19 nt, Human
ucugccgcucccgguccug

SEQ ID NO: 1306854 - RNA, 21 nt, Human
ucugucuuucccagaaagcgg

SEQ ID NO: 1306855 - RNA, 23 nt, Human
ugcugggggcucgggaggugcgc

SEQ ID NO: 1306856 - RNA, 22 nt, Human
uucacaguguaaaacggaucag

SEQ ID NO: 1306857 - RNA, 24 nt, Human
uucccuggugucaccaaauaaaca

SEQ ID NO: 1306858 - RNA, 18 nt, Human
uucuggucguuccucccu

SEQ ID NO: 1306859 - RNA, 23 nt, Human
uugguuuuucgucuauuugcuuc

SEQ ID NO: 1306860 - RNA, 20 nt, Human
aaacaagcccacuucaugua

SEQ ID NO: 1306861 - RNA, 24 nt, Human
aaagugcagggauuucaggcauga

SEQ ID NO: 1306862 - RNA, 24 nt, Human
aaagugcugggauuacaggcguga

SEQ ID NO: 1306863 - RNA, 24 nt, Human
aaagugcugggauuacaggcguga

SEQ ID NO: 1306864 - RNA, 19 nt, Human
aaccccaucucugccacac

SEQ ID NO: 1306865 - RNA, 24 nt, Human
aaccucaggugaucugcuugccuc

SEQ ID NO: 1306866 - RNA, 19 nt, Human
aagugcugggauuacaggc

SEQ ID NO: 1306867 - RNA, 19 nt, Human
aagugcugggauuacaggc

SEQ ID NO: 1306868 - RNA, 19 nt, Human
aagugcugggauuacaggc

SEQ ID NO: 1306869 - RNA, 19 nt, Human
aagugcugggauuacaggc

SEQ ID NO: 1306870 - RNA, 26 nt, Human
aagugcugggauuacaggcgugagcc

SEQ ID NO: 1306871 - RNA, 26 nt, Human
aagugcugggauuacaggcgugagcc

SEQ ID NO: 1306872 - RNA, 19 nt, Human
acagaccacaccccauagu

SEQ ID NO: 1306873 - RNA, 19 nt, Human
acaggguuucaccauguug

SEQ ID NO: 1306874 - RNA, 20 nt, Human
acaggguuucaccauguugu

SEQ ID NO: 1306875 - RNA, 24 nt, Human
acaggguuucaccauguuguccag

SEQ ID NO: 1306876 - RNA, 20 nt, Human
acaggguuucaucguauugg

SEQ ID NO: 1306877 - RNA, 23 nt, Human
acaggguuucaucguauuggcca

SEQ ID NO: 1306878 - RNA, 24 nt, Human
acaggguuucaucguauuggccag

SEQ ID NO: 1306879 - RNA, 19 nt, Human
accacaaccccaucucugc

SEQ ID NO: 1306880 - RNA, 20 nt, Human
accauguuguccaggcuggu

SEQ ID NO: 1306881 - RNA, 20 nt, Human
acccagggcuggguacuuuu

SEQ ID NO: 1306882 - RNA, 23 nt, Human
accccgccucauccccaccagcc

SEQ ID NO: 1306883 - RNA, 22 nt, Human
acccgccucagccucccaaagu

SEQ ID NO: 1306884 - RNA, 24 nt, Human
accucaugaucugccugccuuggc

SEQ ID NO: 1306885 - RNA, 21 nt, Human
accucugagaagucagaugaa

SEQ ID NO: 1306886 - RNA, 18 nt, Human
acgggguuucuccauguu

SEQ ID NO: 1306887 - RNA, 19 nt, Human
acgggguuucuccauguug

SEQ ID NO: 1306888 - RNA, 27 nt, Human
acgggguuucuccauguuguuggucag

SEQ ID NO: 1306889 - RNA, 27 nt, Human
acucugucacccaggcuagagugcaau

SEQ ID NO: 1306890 - RNA, 26 nt, Human
agaaagcagaccucugagaagucaga

SEQ ID NO: 1306891 - RNA, 18 nt, Human
agacaggguuucaucgua

SEQ ID NO: 1306892 - RNA, 19 nt, Human
agagacaggguuucaucgu

SEQ ID NO: 1306893 - RNA, 21 nt, Human
agccggcguuuugccccuugc

SEQ ID NO: 1306894 - RNA, 18 nt, Human
agccuccugaguagcuag

SEQ ID NO: 1306895 - RNA, 20 nt, Human
aggcaugcaccaccacaccc

SEQ ID NO: 1306896 - RNA, 20 nt, Human
aggcaugcaccaccacgccc

SEQ ID NO: 1306897 - RNA, 20 nt, Human
agggaagggggucaggguuc

SEQ ID NO: 1306898 - RNA, 21 nt, Human
agggggucaggguuccugcag

SEQ ID NO: 1306899 - RNA, 24 nt, Human
aggugauccacccgccucagccuc

SEQ ID NO: 1306900 - RNA, 24 nt, Human
aggugaucugcuugccucggccuc

SEQ ID NO: 1306901 - RNA, 21 nt, Human
aguagcuaggauuacaggcau

SEQ ID NO: 1306902 - RNA, 23 nt, Human
aguagcugggauuacagucaugu

SEQ ID NO: 1306903 - RNA, 24 nt, Human
agugauucuccugccucagccucc

SEQ ID NO: 1306904 - RNA, 21 nt, Human
agugcaauggugcgaucucag

SEQ ID NO: 1306905 - RNA, 18 nt, Human
agugcugggauuacaggc

SEQ ID NO: 1306906 - RNA, 18 nt, Human
agugcugggauuacaggc

SEQ ID NO: 1306907 - RNA, 24 nt, Human
aucguauuggccaggcuggucucg

SEQ ID NO: 1306908 - RNA, 19 nt, Human
aucugccugccuuggccuc

SEQ ID NO: 1306909 - RNA, 24 nt, Human
augagaaagcagaccucugagaaa

SEQ ID NO: 1306910 - RNA, 23 nt, Human
auuuugcucgucgcccaggcugg

SEQ ID NO: 1306911 - RNA, 24 nt, Human
auuuugcucgucgcccaggcugga

SEQ ID NO: 1306912 - RNA, 22 nt, Human
auuuuuguauuuuuaguagaga

SEQ ID NO: 1306913 - RNA, 24 nt, Human
auuuuuguauuuuuaguagagaca

SEQ ID NO: 1306914 - RNA, 24 nt, Human
caaagugcagggauuucaggcaug

SEQ ID NO: 1306915 - RNA, 24 nt, Human
caaagugcugggauuacaggcgug

SEQ ID NO: 1306916 - RNA, 24 nt, Human
caaagugcugggauuacaggcgug

SEQ ID NO: 1306917 - RNA, 23 nt, Human
caaccuccaccucccggguucaa

SEQ ID NO: 1306918 - RNA, 21 nt, Human
caaccuccggcuccuggguuc

SEQ ID NO: 1306919 - RNA, 22 nt, Human
caagugauucuccugccucagc

SEQ ID NO: 1306920 - RNA, 21 nt, Human
cacacaguugugacccuaucc

SEQ ID NO: 1306921 - RNA, 22 nt, Human
cacaguugugacccuauccucc

SEQ ID NO: 1306922 - RNA, 23 nt, Human
cacaguugugacccuauccuccc

SEQ ID NO: 1306923 - RNA, 21 nt, Human
caccacaaccuccggcuccug

SEQ ID NO: 1306924 - RNA, 22 nt, Human
caccaccacgcccagguaauuu

SEQ ID NO: 1306925 - RNA, 19 nt, Human
caccaugccugauuuuugu

SEQ ID NO: 1306926 - RNA, 21 nt, Human
caccauguuguccaggcuggu

SEQ ID NO: 1306927 - RNA, 24 nt, Human
caccauguuguccaggcugguuuu

SEQ ID NO: 1306928 - RNA, 31 nt, Human
caccauguuguccaggcugguuuugaacucc

SEQ ID NO: 1306929 - RNA, 24 nt, Human
caccccauagucccugggccucca

SEQ ID NO: 1306930 - RNA, 23 nt, Human
caccccgccucauccccaccagc

SEQ ID NO: 1306931 - RNA, 23 nt, Human
cacccgccucagccucccaaagu

SEQ ID NO: 1306932 - RNA, 22 nt, Human
cacucugucacccaggcuagag

SEQ ID NO: 1306933 - RNA, 23 nt, Human
cacucugucacccaggcuagagu

SEQ ID NO: 1306934 - RNA, 21 nt, Human
cacugcaaccuccaccucccg

SEQ ID NO: 1306935 - RNA, 23 nt, Human
cacugcaaccuccaccucccggg

SEQ ID NO: 1306936 - RNA, 22 nt, Human
cagaggccuccugaggccuccu

SEQ ID NO: 1306937 - RNA, 19 nt, Human
cagccuccugaguagcuag

SEQ ID NO: 1306938 - RNA, 24 nt, Human
caggaucgggaugaaggcugcuga

SEQ ID NO: 1306939 - RNA, 23 nt, Human
cagggcuggguacuuuuuggggu

SEQ ID NO: 1306940 - RNA, 18 nt, Human
caggguuccugcaggaag

SEQ ID NO: 1306941 - RNA, 24 nt, Human
caggguuucaccauguuguccagg

SEQ ID NO: 1306942 - RNA, 24 nt, Human
caggguuucaucguauuggccagg

SEQ ID NO: 1306943 - RNA, 22 nt, Human
cauccccaccagccaccccggc

SEQ ID NO: 1306944 - RNA, 21 nt, Human
cauccccuccuucccacagcc

SEQ ID NO: 1306945 - RNA, 23 nt, Human
caugagccaccucgccuuucagc

SEQ ID NO: 1306946 - RNA, 21 nt, Human
caugaucugccugccuuggcc

SEQ ID NO: 1306947 - RNA, 21 nt, Human
caugccugauuuuuguauuuu

SEQ ID NO: 1306948 - RNA, 24 nt, Human
cauguuguccaggcugguuuugaa

SEQ ID NO: 1306949 - RNA, 20 nt, Human
cauguuguuggucaggcugg

SEQ ID NO: 1306950 - RNA, 24 nt, Human
ccaaagugcagggauuucaggcau

SEQ ID NO: 1306951 - RNA, 22 nt, Human
ccaaagugcugggauuacaggc

SEQ ID NO: 1306952 - RNA, 22 nt, Human
ccaaagugcugggauuacaggc

SEQ ID NO: 1306953 - RNA, 22 nt, Human
ccaaagugcugggauuacaggc

SEQ ID NO: 1306954 - RNA, 22 nt, Human
ccaaagugcugggauuacaggc

SEQ ID NO: 1306955 - RNA, 24 nt, Human
ccaaagugcugggauuacaggcgu

SEQ ID NO: 1306956 - RNA, 24 nt, Human
ccaaagugcugggauuacaggcgu

SEQ ID NO: 1306957 - RNA, 21 nt, Human
ccacaaccccaucucugccac

SEQ ID NO: 1306958 - RNA, 23 nt, Human
ccacaaccuccggcuccuggguu

SEQ ID NO: 1306959 - RNA, 24 nt, Human
ccacaaccuccggcuccuggguuc

SEQ ID NO: 1306960 - RNA, 26 nt, Human
ccacccgccucagccucccaaagugc

SEQ ID NO: 1306961 - RNA, 24 nt, Human
ccaccucccggguucaagugauuc

SEQ ID NO: 1306962 - RNA, 18 nt, Human
ccacgguggucugaccug

SEQ ID NO: 1306963 - RNA, 20 nt, Human
ccagccaccccggcuuggga

SEQ ID NO: 1306964 - RNA, 22 nt, Human
ccauguuguuggucaggcuggu

SEQ ID NO: 1306965 - RNA, 25 nt, Human
ccauguuguuggucaggcuggucuc

SEQ ID NO: 1306966 - RNA, 26 nt, Human
ccauguuguuggucaggcuggucucg

SEQ ID NO: 1306967 - RNA, 26 nt, Human
cccacacaaugaagguuuaugaagcu

SEQ ID NO: 1306968 - RNA, 23 nt, Human
cccacagcccugcuugcucugga

SEQ ID NO: 1306969 - RNA, 19 nt, Human
cccaccccgccucaucccc

SEQ ID NO: 1306970 - RNA, 20 nt, Human
cccagauuccagggccucca

SEQ ID NO: 1306971 - RNA, 21 nt, Human
cccauagucccugggccucca

SEQ ID NO: 1306972 - RNA, 19 nt, Human
ccccaagcccagagugcuc

SEQ ID NO: 1306973 - RNA, 21 nt, Human
ccccagauuccagggccucca

SEQ ID NO: 1306974 - RNA, 19 nt, Human
cccccagaguagaaaaccc

SEQ ID NO: 1306975 - RNA, 21 nt, Human
cccccagaguagaaaacccag

SEQ ID NO: 1306976 - RNA, 22 nt, Human
cccccagaguagaaaacccagg

SEQ ID NO: 1306977 - RNA, 22 nt, Human
cccgaguagcugggauuacagu

SEQ ID NO: 1306978 - RNA, 23 nt, Human
cccggguucaagugauucuccuc

SEQ ID NO: 1306979 - RNA, 23 nt, Human
cccggguucaagugauucuccug

SEQ ID NO: 1306980 - RNA, 24 nt, Human
cccuaggccacuuuccuaagccuu

SEQ ID NO: 1306981 - RNA, 22 nt, Human
ccucagauccaugaccuggccg

SEQ ID NO: 1306982 - RNA, 21 nt, Human
ccuccaccacaaccccaucuc

SEQ ID NO: 1306983 - RNA, 19 nt, Human
ccucccaaagugcagggau

SEQ ID NO: 1306984 - RNA, 21 nt, Human
ccucccggguucaagugauuc

SEQ ID NO: 1306985 - RNA, 24 nt, Human
ccucccggguucaagugauucucc

SEQ ID NO: 1306986 - RNA, 22 nt, Human
ccuccgagagucccgcuuuaga

SEQ ID NO: 1306987 - RNA, 23 nt, Human
ccuccugaggccuccuacucccc

SEQ ID NO: 1306988 - RNA, 22 nt, Human
ccugaccucaggugauccaccc

SEQ ID NO: 1306989 - RNA, 23 nt, Human
ccugaccucaggugauccacccg

SEQ ID NO: 1306990 - RNA, 21 nt, Human
ccugaccucaugaucugccug

SEQ ID NO: 1306991 - RNA, 23 nt, Human
ccugaguagcuaggauuacaggc

SEQ ID NO: 1306992 - RNA, 24 nt, Human
ccugaguagcuaggauuacaggca

SEQ ID NO: 1306993 - RNA, 23 nt, Human
ccugccucagccuccugaguagc

SEQ ID NO: 1306994 - RNA, 24 nt, Human
ccugccucaggcucccgaguagcu

SEQ ID NO: 1306995 - RNA, 22 nt, Human
ccugccuuggccucccaaagug

SEQ ID NO: 1306996 - RNA, 19 nt, Human
ccugcugcuguggccucug

SEQ ID NO: 1306997 - RNA, 22 nt, Human
ccugcuucacagaccacacccc

SEQ ID NO: 1306998 - RNA, 19 nt, Human
ccuuccuagacgugcagga

SEQ ID NO: 1306999 - RNA, 23 nt, Human
cgccucagccucccaaagugcag

SEQ ID NO: 1307000 - RNA, 24 nt, Human
cgcucuuguugcccaggcuggagu

SEQ ID NO: 1307001 - RNA, 21 nt, Human
cgcuuuagagaaacacgaagg

SEQ ID NO: 1307002 - RNA, 20 nt, Human
cggcagggcuggaaggagcc

SEQ ID NO: 1307003 - RNA, 29 nt, Human
cggcuaguuuuguauuuuuaguagagacg

SEQ ID NO: 1307004 - RNA, 24 nt, Human
cgggaugaaggcugcugaguccca

SEQ ID NO: 1307005 - RNA, 18 nt, Human
cguauuggccaggcuggu

SEQ ID NO: 1307006 - RNA, 19 nt, Human
cguggucccugcccacugg

SEQ ID NO: 1307007 - RNA, 18 nt, Human
cguuuugccccuugcccc

SEQ ID NO: 1307008 - RNA, 24 nt, Human
cucacugcaaccuccaccucccgg

SEQ ID NO: 1307009 - RNA, 24 nt, Human
cucacugcaaccuccacuucccga

SEQ ID NO: 1307010 - RNA, 22 nt, Human
cucauccccaccagccaccccg

SEQ ID NO: 1307011 - RNA, 18 nt, Human
cucaugaucugccugccu

SEQ ID NO: 1307012 - RNA, 24 nt, Human
cuccugaccucaugaucugccugc

SEQ ID NO: 1307013 - RNA, 24 nt, Human
cuccugaguagcuaggauuacagg

SEQ ID NO: 1307014 - RNA, 21 nt, Human
cuccuggguucaagcaauucu

SEQ ID NO: 1307015 - RNA, 18 nt, Human
cucgucgcccaggcugga

SEQ ID NO: 1307016 - RNA, 19 nt, Human
cucgucgcccaggcuggag

SEQ ID NO: 1307017 - RNA, 21 nt, Human
cugagagggaugugcgcagca

SEQ ID NO: 1307018 - RNA, 24 nt, Human
cugaguagcuaggauuacaggcau

SEQ ID NO: 1307019 - RNA, 18 nt, Human
cugagucccaccccgccu

SEQ ID NO: 1307020 - RNA, 23 nt, Human
cugcaaccuccaccucccggguu

SEQ ID NO: 1307021 - RNA, 24 nt, Human
cugcaaccuccaccucccggguuc

SEQ ID NO: 1307022 - RNA, 23 nt, Human
cugcaaccuccacuucccgaauu

SEQ ID NO: 1307023 - RNA, 24 nt, Human
cugcaaccuccacuucccgaauuc

SEQ ID NO: 1307024 - RNA, 23 nt, Human
cugccucagccuccugaguagcu

SEQ ID NO: 1307025 - RNA, 23 nt, Human
cugccuuggccucccaaagugcu

SEQ ID NO: 1307026 - RNA, 19 nt, Human
cugcuguggccucugucgu

SEQ ID NO: 1307027 - RNA, 23 nt, Human
cuggagcacaguggugcgauccu

SEQ ID NO: 1307028 - RNA, 23 nt, Human
cugggccuccagagcaaagggaa

SEQ ID NO: 1307029 - RNA, 20 nt, Human
cuguggccucugucgugguc

SEQ ID NO: 1307030 - RNA, 24 nt, Human
cuugccucggccucccaaagugcu

SEQ ID NO: 1307031 - RNA, 24 nt, Human
cuuguugcccaggcuggagugcaa

SEQ ID NO: 1307032 - RNA, 18 nt, Human
gaaccugcuucacagacc

SEQ ID NO: 1307033 - RNA, 18 nt, Human
gaagggggucaggguucc

SEQ ID NO: 1307034 - RNA, 23 nt, Human
gacaggguuucaccauguugucc

SEQ ID NO: 1307035 - RNA, 22 nt, Human
gacccuauccucccuaggccac

SEQ ID NO: 1307036 - RNA, 24 nt, Human
gaccucaggugauccacccgccuc

SEQ ID NO: 1307037 - RNA, 21 nt, Human
gaccucaugaucugccugccu

SEQ ID NO: 1307038 - RNA, 20 nt, Human
gagacgggguuucuccaugu

SEQ ID NO: 1307039 - RNA, 19 nt, Human
gagggaagauggagccggc

SEQ ID NO: 1307040 - RNA, 22 nt, Human
gaguagcuaggauuacaggcau

SEQ ID NO: 1307041 - RNA, 24 nt, Human
gaguagcuaggauuacaggcaugc

SEQ ID NO: 1307042 - RNA, 25 nt, Human
gaguagcugggauuacagucaugug

SEQ ID NO: 1307043 - RNA, 18 nt, Human
gauuacaggcgugagcca

SEQ ID NO: 1307044 - RNA, 18 nt, Human
gauuacaggcgugagcca

SEQ ID NO: 1307045 - RNA, 21 nt, Human
gauuacaggcgugagccacca

SEQ ID NO: 1307046 - RNA, 22 nt, Human
gauuacaggcgugagccaccac

SEQ ID NO: 1307047 - RNA, 21 nt, Human
gauuacaggcgugagccaccg

SEQ ID NO: 1307048 - RNA, 22 nt, Human
gauuacaggcgugagccaccgu

SEQ ID NO: 1307049 - RNA, 22 nt, Human
gauuacagucaugugccaccau

SEQ ID NO: 1307050 - RNA, 20 nt, Human
gauuucaggcaugagccacc

SEQ ID NO: 1307051 - RNA, 22 nt, Human
gcaaccuccacuucccgaauuc

SEQ ID NO: 1307052 - RNA, 19 nt, Human
gccagaggccuccugaggc

SEQ ID NO: 1307053 - RNA, 20 nt, Human
gcccaggcuggagcacagug

SEQ ID NO: 1307054 - RNA, 19 nt, Human
gcccaggcuggagugcaau

SEQ ID NO: 1307055 - RNA, 18 nt, Human
gccucugucguggucccg

SEQ ID NO: 1307056 - RNA, 19 nt, Human
gccuggggagggcccagau

SEQ ID NO: 1307057 - RNA, 22 nt, Human
gccuuggccucccaaagugcug

SEQ ID NO: 1307058 - RNA, 24 nt, Human
gcuagagugcaauggcacgaucua

SEQ ID NO: 1307059 - RNA, 19 nt, Human
gcucgucgcccaggcugga

SEQ ID NO: 1307060 - RNA, 24 nt, Human
gcucuuguugcccaggcuggagug

SEQ ID NO: 1307061 - RNA, 30 nt, Human
gcuggagugcaauggugcgaucucagcucc

SEQ ID NO: 1307062 - RNA, 23 nt, Human
gcuggucucgaacucccaaccuc

SEQ ID NO: 1307063 - RNA, 23 nt, Human
gcuggucucgagcuccugaccuc

SEQ ID NO: 1307064 - RNA, 23 nt, Human
gcugguuuugaacuccugaccuc

SEQ ID NO: 1307065 - RNA, 18 nt, Human
ggaaaggaagggaagggg

SEQ ID NO: 1307066 - RNA, 19 nt, Human
ggaaaggaagggaaggggg

SEQ ID NO: 1307067 - RNA, 18 nt, Human
ggaagggaagggggucag

SEQ ID NO: 1307068 - RNA, 22 nt, Human
ggaauuuugcucgucgcccagg

SEQ ID NO: 1307069 - RNA, 23 nt, Human
ggaccagaaucagggaggaggga

SEQ ID NO: 1307070 - RNA, 22 nt, Human
ggauuacaggcaugcaccacca

SEQ ID NO: 1307071 - RNA, 19 nt, Human
ggauuacaggcgugagcca

SEQ ID NO: 1307072 - RNA, 21 nt, Human
ggccguggucccugcccacug

SEQ ID NO: 1307073 - RNA, 21 nt, Human
ggccugggcuccauuccugcc

SEQ ID NO: 1307074 - RNA, 26 nt, Human
ggcuaguuuuguauuuuuaguagaga

SEQ ID NO: 1307075 - RNA, 22 nt, Human
ggcuccuggguucaagcaauuc

SEQ ID NO: 1307076 - RNA, 24 nt, Human
ggcuggucucgagcuccugaccuc

SEQ ID NO: 1307077 - RNA, 24 nt, Human
ggcugguuuugaacuccugaccuc

SEQ ID NO: 1307078 - RNA, 22 nt, Human
ggguucaagugauucuccugcc

SEQ ID NO: 1307079 - RNA, 23 nt, Human
ggguucaagugauucuccugccu

SEQ ID NO: 1307080 - RNA, 25 nt, Human
ggguuucuccauguuguuggucagg

SEQ ID NO: 1307081 - RNA, 19 nt, Human
ggucucgagcuccugaccu

SEQ ID NO: 1307082 - RNA, 20 nt, Human
guagaaugugcugggaaugc

SEQ ID NO: 1307083 - RNA, 23 nt, Human
guagagacgggguuucuccaugu

SEQ ID NO: 1307084 - RNA, 20 nt, Human
guagcuaggauuacaggcau

SEQ ID NO: 1307085 - RNA, 24 nt, Human
gugauccacccgccucagccuccc

SEQ ID NO: 1307086 - RNA, 23 nt, Human
gugauucuccugccucagccucc

SEQ ID NO: 1307087 - RNA, 23 nt, Human
guuucaccauguuguccaggcug

SEQ ID NO: 1307088 - RNA, 24 nt, Human
guuucaccauguuguccaggcugg

SEQ ID NO: 1307089 - RNA, 25 nt, Human
uaauuuuauuuuugagauggaguuu

SEQ ID NO: 1307090 - RNA, 26 nt, Human
uaauuuucuuguauuuuugguagaga

SEQ ID NO: 1307091 - RNA, 23 nt, Human
uacaggcaugcaccaccacaccc

SEQ ID NO: 1307092 - RNA, 24 nt, Human
uacaggcaugcaccaccacgccca

SEQ ID NO: 1307093 - RNA, 22 nt, Human
uacaggcgugagccaccacacc

SEQ ID NO: 1307094 - RNA, 23 nt, Human
uacaggcgugagccaccgugacc

SEQ ID NO: 1307095 - RNA, 22 nt, Human
uacagucaugugccaccaugcc

SEQ ID NO: 1307096 - RNA, 19 nt, Human
uagaaacaggaugcccuuc

SEQ ID NO: 1307097 - RNA, 22 nt, Human
uagagacaggguuucaccaugu

SEQ ID NO: 1307098 - RNA, 21 nt, Human
uaggauuacaggcaugcacca

SEQ ID NO: 1307099 - RNA, 24 nt, Human
uaggauuacaggcaugcaccacca

SEQ ID NO: 1307100 - RNA, 24 nt, Human
uaguagagacaggguuucaccaug

SEQ ID NO: 1307101 - RNA, 26 nt, Human
uaguagagacaggguuucaccauguu

SEQ ID NO: 1307102 - RNA, 24 nt, Human
uaguagagacgggguuucuccaug

SEQ ID NO: 1307103 - RNA, 19 nt, Human
uauuggccaggcuggucuc

SEQ ID NO: 1307104 - RNA, 25 nt, Human
uauuuugagacagagucucacucug

SEQ ID NO: 1307105 - RNA, 19 nt, Human
ucaagugauucuccugccu

SEQ ID NO: 1307106 - RNA, 27 nt, Human
ucaccacaaccuccggcuccuggguuc

SEQ ID NO: 1307107 - RNA, 23 nt, Human
ucacugcaaccuccaccucccgg

SEQ ID NO: 1307108 - RNA, 24 nt, Human
ucacugcaaccuccaccucccggg

SEQ ID NO: 1307109 - RNA, 25 nt, Human
ucacugcaaccuccaccucccgggu

SEQ ID NO: 1307110 - RNA, 27 nt, Human
ucacugcaaccuccaccucccggguuc

SEQ ID NO: 1307111 - RNA, 18 nt, Human
ucacugcaaccuccacuu

SEQ ID NO: 1307112 - RNA, 19 nt, Human
ucacugcaaccuccacuuc

SEQ ID NO: 1307113 - RNA, 21 nt, Human
ucacugcaaccuccacuuccc

SEQ ID NO: 1307114 - RNA, 22 nt, Human
ucacugcaaccuccacuucccg

SEQ ID NO: 1307115 - RNA, 24 nt, Human
ucacugcaaccuccacuucccgaa

SEQ ID NO: 1307116 - RNA, 21 nt, Human
uccacccgccucagccuccca

SEQ ID NO: 1307117 - RNA, 24 nt, Human
ucccaaagugcagggauuucaggc

SEQ ID NO: 1307118 - RNA, 24 nt, Human
ucccaaagugcugggauuacaggc

SEQ ID NO: 1307119 - RNA, 24 nt, Human
ucccaaagugcugggauuacaggc

SEQ ID NO: 1307120 - RNA, 18 nt, Human
ucccacagcccugcuugc

SEQ ID NO: 1307121 - RNA, 19 nt, Human
ucccaccccgccucauccc

SEQ ID NO: 1307122 - RNA, 21 nt, Human
ucccgaauucaagcgauucuc

SEQ ID NO: 1307123 - RNA, 24 nt, Human
ucccgaauucaagcgauucuccug

SEQ ID NO: 1307124 - RNA, 23 nt, Human
ucccgagggccuggggagggccc

SEQ ID NO: 1307125 - RNA, 22 nt, Human
ucccgaguagcugggauuacag

SEQ ID NO: 1307126 - RNA, 23 nt, Human
ucccgaguagcugggauuacagu

SEQ ID NO: 1307127 - RNA, 21 nt, Human
ucccggguucaagugauucuc

SEQ ID NO: 1307128 - RNA, 24 nt, Human
ucccggguucaagugauucuccug

SEQ ID NO: 1307129 - RNA, 19 nt, Human
ucccuaggccacuuuccua

SEQ ID NO: 1307130 - RNA, 21 nt, Human
ucccuugcugcccaucuguga

SEQ ID NO: 1307131 - RNA, 19 nt, Human
uccugaguagcuaggauua

SEQ ID NO: 1307132 - RNA, 24 nt, Human
uccugaguagcuaggauuacaggc

SEQ ID NO: 1307133 - RNA, 19 nt, Human
uccuggguucaagcaauuc

SEQ ID NO: 1307134 - RNA, 22 nt, Human
ucgcucuuguugcccaggcugg

SEQ ID NO: 1307135 - RNA, 23 nt, Human
ucgcucuuguugcccaggcugga

SEQ ID NO: 1307136 - RNA, 19 nt, Human
ucucacucugucacccagg

SEQ ID NO: 1307137 - RNA, 22 nt, Human
ucucacucugucacccaggcua

SEQ ID NO: 1307138 - RNA, 26 nt, Human
ucucacucugucacccaggcuagagu

SEQ ID NO: 1307139 - RNA, 27 nt, Human
ucucacucugucacccaggcuagagug

SEQ ID NO: 1307140 - RNA, 24 nt, Human
ucuccugccucagccuccugagua

SEQ ID NO: 1307141 - RNA, 22 nt, Human
ucugagaagucagaugaaaggu

SEQ ID NO: 1307142 - RNA, 24 nt, Human
ucugucacccaggcuagagugcaa

SEQ ID NO: 1307143 - RNA, 22 nt, Human
ucuuguugcccaggcuggagug

SEQ ID NO: 1307144 - RNA, 19 nt, Human
ugaagccccagauuccaga

SEQ ID NO: 1307145 - RNA, 21 nt, Human
ugaccucaggugauccacccg

SEQ ID NO: 1307146 - RNA, 24 nt, Human
ugaccucaggugauccacccgccu

SEQ ID NO: 1307147 - RNA, 23 nt, Human
ugaccuggccggguaaggaaagg

SEQ ID NO: 1307148 - RNA, 20 nt, Human
ugagaaacaagcccacuuca

SEQ ID NO: 1307149 - RNA, 18 nt, Human
ugagaaagcagaccucug

SEQ ID NO: 1307150 - RNA, 26 nt, Human
ugagaaagcagaccucugagaaguca

SEQ ID NO: 1307151 - RNA, 18 nt, Human
ugagacagagucucacuc

SEQ ID NO: 1307152 - RNA, 22 nt, Human
ugagacagagucucacucuguc

SEQ ID NO: 1307153 - RNA, 21 nt, Human
ugaggccuccuacuccccaag

SEQ ID NO: 1307154 - RNA, 23 nt, Human
ugagucccaccccgccucauccc

SEQ ID NO: 1307155 - RNA, 20 nt, Human
ugauucuccugccucagccu

SEQ ID NO: 1307156 - RNA, 24 nt, Human
ugauuuuuguauuuuuaguagaga

SEQ ID NO: 1307157 - RNA, 24 nt, Human
ugcacagugaaccugcuucacaga

SEQ ID NO: 1307158 - RNA, 18 nt, Human
ugcccaggcuggagugca

SEQ ID NO: 1307159 - RNA, 21 nt, Human
ugcccaggcuggagugcaaug

SEQ ID NO: 1307160 - RNA, 24 nt, Human
ugcccaggcuggagugcaauggug

SEQ ID NO: 1307161 - RNA, 24 nt, Human
ugccucagccuccugaguagcuag

SEQ ID NO: 1307162 - RNA, 21 nt, Human
ugccucaggcucccgaguagc

SEQ ID NO: 1307163 - RNA, 24 nt, Human
ugccucaggcucccgaguagcugg

SEQ ID NO: 1307164 - RNA, 21 nt, Human
ugccucggccucccaaagugc

SEQ ID NO: 1307165 - RNA, 24 nt, Human
ugccucggccucccaaagugcugg

SEQ ID NO: 1307166 - RNA, 18 nt, Human
ugccugccuuggccuccc

SEQ ID NO: 1307167 - RNA, 23 nt, Human
ugcgcagcaccuccgagaguccc

SEQ ID NO: 1307168 - RNA, 24 nt, Human
ugcugggauuacaggcgugagcca

SEQ ID NO: 1307169 - RNA, 24 nt, Human
ugcugggauuacaggcgugagcca

SEQ ID NO: 1307170 - RNA, 22 nt, Human
uggaaggagccugagagggaug

SEQ ID NO: 1307171 - RNA, 21 nt, Human
uggaaggaugcacccuaucag

SEQ ID NO: 1307172 - RNA, 23 nt, Human
uggaauuuugcucgucgcccagg

SEQ ID NO: 1307173 - RNA, 19 nt, Human
uggaggcugauggggucac

SEQ ID NO: 1307174 - RNA, 23 nt, Human
uggagugcaauggugcgaucuca

SEQ ID NO: 1307175 - RNA, 24 nt, Human
uggagugcaauggugcgaucucag

SEQ ID NO: 1307176 - RNA, 24 nt, Human
uggccaggcuggucucgagcuccu

SEQ ID NO: 1307177 - RNA, 23 nt, Human
uggcguucugucucaucacucug

SEQ ID NO: 1307178 - RNA, 22 nt, Human
ugggagggaagauggagccggc

SEQ ID NO: 1307179 - RNA, 18 nt, Human
ugggauuacaggcgugag

SEQ ID NO: 1307180 - RNA, 18 nt, Human
ugggauuacaggcgugag

SEQ ID NO: 1307181 - RNA, 19 nt, Human
ugggauuacaggcgugagc

SEQ ID NO: 1307182 - RNA, 21 nt, Human
ugggauuacaggcgugagcca

SEQ ID NO: 1307183 - RNA, 22 nt, Human
ugggauuacaggcgugagccac

SEQ ID NO: 1307184 - RNA, 22 nt, Human
ugggauuacaggcgugagccac

SEQ ID NO: 1307185 - RNA, 23 nt, Human
ugggauuacaggcgugagccacc

SEQ ID NO: 1307186 - RNA, 23 nt, Human
ugggauuacaggcgugagccacc

SEQ ID NO: 1307187 - RNA, 23 nt, Human
ugggauuacaggcgugagccacc

SEQ ID NO: 1307188 - RNA, 24 nt, Human
ugggauuacaggcgugagccacca

SEQ ID NO: 1307189 - RNA, 24 nt, Human
ugggauuacaggcgugagccaccg

SEQ ID NO: 1307190 - RNA, 18 nt, Human
ugggauuacagucaugug

SEQ ID NO: 1307191 - RNA, 24 nt, Human
ugggauuacagucaugugccacca

SEQ ID NO: 1307192 - RNA, 25 nt, Human
uggggagggcccagauggggaaucu

SEQ ID NO: 1307193 - RNA, 22 nt, Human
ugguagagacaggguuucaucg

SEQ ID NO: 1307194 - RNA, 23 nt, Human
uggucaggcuggucucgaacucc

SEQ ID NO: 1307195 - RNA, 24 nt, Human
uggugcgaucucagcucaccacaa

SEQ ID NO: 1307196 - RNA, 20 nt, Human
uguaacagaacucagggucu

SEQ ID NO: 1307197 - RNA, 20 nt, Human
ugucacccaggcuagagugc

SEQ ID NO: 1307198 - RNA, 24 nt, Human
uguccaggcugguuuugaacuccu

SEQ ID NO: 1307199 - RNA, 20 nt, Human
ugugagaaacaagcccacuu

SEQ ID NO: 1307200 - RNA, 20 nt, Human
uguugcccaggcuggagugc

SEQ ID NO: 1307201 - RNA, 24 nt, Human
uuaguagagacaggguuucaccau

SEQ ID NO: 1307202 - RNA, 18 nt, Human
uuaguagagacgggguuu

SEQ ID NO: 1307203 - RNA, 24 nt, Human
uuaguagagacgggguuucuccau

SEQ ID NO: 1307204 - RNA, 21 nt, Human
uucaagcgauucuccugccuc

SEQ ID NO: 1307205 - RNA, 23 nt, Human
uucaagcgauucuccugccucag

SEQ ID NO: 1307206 - RNA, 25 nt, Human
uucaagcgauucuccugccucaggc

SEQ ID NO: 1307207 - RNA, 21 nt, Human
uucaagugauucuccugccuc

SEQ ID NO: 1307208 - RNA, 23 nt, Human
uucaagugauucuccugccucag

SEQ ID NO: 1307209 - RNA, 24 nt, Human
uucaagugauucuccugccucagc

SEQ ID NO: 1307210 - RNA, 18 nt, Human
uucacagaccacacccca

SEQ ID NO: 1307211 - RNA, 19 nt, Human
uucacagaccacaccccau

SEQ ID NO: 1307212 - RNA, 24 nt, Human
uucgcucuuguugcccaggcugga

SEQ ID NO: 1307213 - RNA, 20 nt, Human
uucuacaggcaugcaccacc

SEQ ID NO: 1307214 - RNA, 23 nt, Human
uucuccugccucaggcucccgag

SEQ ID NO: 1307215 - RNA, 21 nt, Human
uucuuguauuuuugguagaga

SEQ ID NO: 1307216 - RNA, 20 nt, Human
uugagcccggugacucaggu

SEQ ID NO: 1307217 - RNA, 24 nt, Human
uugccucggccucccaaagugcug

SEQ ID NO: 1307218 - RNA, 20 nt, Human
uugcucgucgcccaggcugg

SEQ ID NO: 1307219 - RNA, 21 nt, Human
uugcucgucgcccaggcugga

SEQ ID NO: 1307220 - RNA, 18 nt, Human
uuggccucccaaagugcu

SEQ ID NO: 1307221 - RNA, 24 nt, Human
uugguagagacaggguuucaucgu

SEQ ID NO: 1307222 - RNA, 23 nt, Human
uuguauuuuuaguagagacgggg

SEQ ID NO: 1307223 - RNA, 24 nt, Human
uuuaugaagccccagauuccaggg

SEQ ID NO: 1307224 - RNA, 23 nt, Human
uuucaccauguuguccaggcugg

SEQ ID NO: 1307225 - RNA, 24 nt, Human
uuucaccauguuguccaggcuggu

SEQ ID NO: 1307226 - RNA, 23 nt, Human
uuucaucguauuggccaggcugu

SEQ ID NO: 1307227 - RNA, 24 nt, Human
uuucgcucuuguugcccaggcugg

SEQ ID NO: 1307228 - RNA, 21 nt, Human
uuucuuguauuuuugguagag

SEQ ID NO: 1307229 - RNA, 24 nt, Human
uuucuuguauuuuugguagagaca

SEQ ID NO: 1307230 - RNA, 21 nt, Human
uuuugcucgucgcccaggcug

SEQ ID NO: 1307231 - RNA, 23 nt, Human
uuuugcucgucgcccaggcugga

SEQ ID NO: 1307232 - RNA, 19 nt, Human
uuuuguauuuuuaguagag

SEQ ID NO: 1307233 - RNA, 20 nt, Human
uuuuguauuuuuaguagaga

SEQ ID NO: 1307234 - RNA, 24 nt, Human
uuuuuaguagagacaggguuucac

SEQ ID NO: 1307235 - RNA, 22 nt, Human
uuuuuaguagagacgggguuuc

SEQ ID NO: 1307236 - RNA, 22 nt, Human
uuuuugguagagacaggguuuc

SEQ ID NO: 1307237 - RNA, 24 nt, Human
uuuuugguagagacaggguuucau

SEQ ID NO: 1307238 - RNA, 20 nt, Human
uuuuuguauuuuuaguagag

SEQ ID NO: 1307239 - RNA, 18 nt, Human
aagaaccuucugcuguca

SEQ ID NO: 1307240 - RNA, 21 nt, Human
acaaugaugacccuccccgag

SEQ ID NO: 1307241 - RNA, 24 nt, Human
acagcagcucccagacccgccggc

SEQ ID NO: 1307242 - RNA, 21 nt, Human
acccccaccugggaccccagc

SEQ ID NO: 1307243 - RNA, 18 nt, Human
agagcagcagcagggggc

SEQ ID NO: 1307244 - RNA, 22 nt, Human
agagggccauggagggucccac

SEQ ID NO: 1307245 - RNA, 19 nt, Human
agcagcgccugcagacagg

SEQ ID NO: 1307246 - RNA, 19 nt, Human
agccagaagcgacggcggc

SEQ ID NO: 1307247 - RNA, 21 nt, Human
aggcaggcugguggcugggag

SEQ ID NO: 1307248 - RNA, 24 nt, Human
aggcaggcugguggcugggagggc

SEQ ID NO: 1307249 - RNA, 33 nt, Human
aggcaggcugguggcugggagggcuccaugucg

SEQ ID NO: 1307250 - RNA, 21 nt, Human
agggaaaacggauucagagca

SEQ ID NO: 1307251 - RNA, 25 nt, Human
agggaucuggagucagaaccggggg

SEQ ID NO: 1307252 - RNA, 22 nt, Human
agucagaaccgggggaaggcag

SEQ ID NO: 1307253 - RNA, 22 nt, Human
auccccccgaauccccccacca

SEQ ID NO: 1307254 - RNA, 28 nt, Human
augguuuaucacaaugaugacccucccc

SEQ ID NO: 1307255 - RNA, 23 nt, Human
caaccaacucaaggacagcagcu

SEQ ID NO: 1307256 - RNA, 21 nt, Human
caaggacagcagcucccagac

SEQ ID NO: 1307257 - RNA, 24 nt, Human
caaugaugacccuccccgaggccu

SEQ ID NO: 1307258 - RNA, 19 nt, Human
cacaaugaugacccucccc

SEQ ID NO: 1307259 - RNA, 23 nt, Human
cacccacagggaaaacggauuca

SEQ ID NO: 1307260 - RNA, 18 nt, Human
caccugggcugagcagug

SEQ ID NO: 1307261 - RNA, 21 nt, Human
cagaacccagcuucccagggc

SEQ ID NO: 1307262 - RNA, 18 nt, Human
cagacccgccggcugcug

SEQ ID NO: 1307263 - RNA, 22 nt, Human
cagacccgccggcugcuggggu

SEQ ID NO: 1307264 - RNA, 19 nt, Human
cagcagcagggggcgggca

SEQ ID NO: 1307265 - RNA, 20 nt, Human
cagcagcagggggcgggcag

SEQ ID NO: 1307266 - RNA, 22 nt, Human
cagcagcagggggcgggcaggg

SEQ ID NO: 1307267 - RNA, 21 nt, Human
cagcagcgccugcagacaggc

SEQ ID NO: 1307268 - RNA, 23 nt, Human
cagcagcgccugcagacaggcgu

SEQ ID NO: 1307269 - RNA, 22 nt, Human
cagcuucccagggcccaaccaa

SEQ ID NO: 1307270 - RNA, 18 nt, Human
cagugagucuucaggguc

SEQ ID NO: 1307271 - RNA, 18 nt, Human
caucuacgguuccacacc

SEQ ID NO: 1307272 - RNA, 22 nt, Human
ccacccccaccugggaccccag

SEQ ID NO: 1307273 - RNA, 20 nt, Human
ccaccugggaccccagcugu

SEQ ID NO: 1307274 - RNA, 23 nt, Human
ccacugggcaccaggccuggucc

SEQ ID NO: 1307275 - RNA, 23 nt, Human
ccagccccaggcacagcucagaa

SEQ ID NO: 1307276 - RNA, 24 nt, Human
ccaggccugguccauggggagcga

SEQ ID NO: 1307277 - RNA, 20 nt, Human
cccaccagagggccauggag

SEQ ID NO: 1307278 - RNA, 18 nt, Human
cccacccccaccugggac

SEQ ID NO: 1307279 - RNA, 22 nt, Human
cccacccccaccugggacccca

SEQ ID NO: 1307280 - RNA, 24 nt, Human
ccccaccugggaccccagcuguac

SEQ ID NO: 1307281 - RNA, 24 nt, Human
ccccaggcacagcucagaaggcuc

SEQ ID NO: 1307282 - RNA, 22 nt, Human
cccccagccccaggcacagcuc

SEQ ID NO: 1307283 - RNA, 18 nt, Human
ccccccgaauccccccac

SEQ ID NO: 1307284 - RNA, 18 nt, Human
ccccccgaauccccccac

SEQ ID NO: 1307285 - RNA, 27 nt, Human
cccccgaauccccccaccagagggcca

SEQ ID NO: 1307286 - RNA, 18 nt, Human
ccccgaggccucuccuac

SEQ ID NO: 1307287 - RNA, 23 nt, Human
ccccgaggccucuccuacgguaa

SEQ ID NO: 1307288 - RNA, 20 nt, Human
cccgaauccccccaccagag

SEQ ID NO: 1307289 - RNA, 27 nt, Human
ccucacuuuauccccccgaaucccccc

SEQ ID NO: 1307290 - RNA, 19 nt, Human
ccuccccgaggccucuccu

SEQ ID NO: 1307291 - RNA, 20 nt, Human
ccuccccgaggccucuccua

SEQ ID NO: 1307292 - RNA, 22 nt, Human
ccugggaccccagcuguacagg

SEQ ID NO: 1307293 - RNA, 24 nt, Human
ccuucugcugucauuaaccgcgau

SEQ ID NO: 1307294 - RNA, 18 nt, Human
cgacaaagaaccuucugc

SEQ ID NO: 1307295 - RNA, 19 nt, Human
cgacagugaacauggaggc

SEQ ID NO: 1307296 - RNA, 24 nt, Human
cgucaggaagcuucgcugcugagg

SEQ ID NO: 1307297 - RNA, 25 nt, Human
cguccaugcuggccugauagcccca

SEQ ID NO: 1307298 - RNA, 18 nt, Human
cucacuuuauccccccga

SEQ ID NO: 1307299 - RNA, 22 nt, Human
gagcagcagcagggggcgggca

SEQ ID NO: 1307300 - RNA, 18 nt, Human
gcagcagcagggggcggg

SEQ ID NO: 1307301 - RNA, 22 nt, Human
gcagcagcgccugcagacaggc

SEQ ID NO: 1307302 - RNA, 21 nt, Human
gcagcucccagacccgccggc

SEQ ID NO: 1307303 - RNA, 18 nt, Human
gcccuguccccccagccc

SEQ ID NO: 1307304 - RNA, 22 nt, Human
gcugccagaacccagcuuccca

SEQ ID NO: 1307305 - RNA, 21 nt, Human
gcugcugggguuccagggccc

SEQ ID NO: 1307306 - RNA, 22 nt, Human
ggcccaaccaacucaaggacag

SEQ ID NO: 1307307 - RNA, 23 nt, Human
ggcugggagggcuccaugugggc

SEQ ID NO: 1307308 - RNA, 23 nt, Human
gguccauggggagcgacaaagaa

SEQ ID NO: 1307309 - RNA, 21 nt, Human
ucacaaugaugacccuccccg

SEQ ID NO: 1307310 - RNA, 21 nt, Human
ucaccugggcugagcagugag

SEQ ID NO: 1307311 - RNA, 19 nt, Human
ucccagggcccaaccaacu

SEQ ID NO: 1307312 - RNA, 22 nt, Human
ucccagggcccaaccaacucaa

SEQ ID NO: 1307313 - RNA, 24 nt, Human
uccccccagccccaggcacagcuc

SEQ ID NO: 1307314 - RNA, 24 nt, Human
ucugcacaauccucacuuuauccc

SEQ ID NO: 1307315 - RNA, 21 nt, Human
ugagucuucagggucugcccc

SEQ ID NO: 1307316 - RNA, 21 nt, Human
ugcacaauccucacuuuaucc

SEQ ID NO: 1307317 - RNA, 18 nt, Human
ugcugggguuccagggcc

SEQ ID NO: 1307318 - RNA, 19 nt, Human
uggcuccugucccaccccc

SEQ ID NO: 1307319 - RNA, 20 nt, Human
uggcugggagggcuccaugu

SEQ ID NO: 1307320 - RNA, 24 nt, Human
uggcugggagggcuccaugugggc

SEQ ID NO: 1307321 - RNA, 21 nt, Human
ugggaccccagcuguacaggc

SEQ ID NO: 1307322 - RNA, 21 nt, Human
ugggccuggcugaggagccag

SEQ ID NO: 1307323 - RNA, 18 nt, Human
ugggcugggcugggaggc

SEQ ID NO: 1307324 - RNA, 21 nt, Human
ugggguuccagggcccugucc

SEQ ID NO: 1307325 - RNA, 20 nt, Human
ugguccauggggagcgacaa

SEQ ID NO: 1307326 - RNA, 21 nt, Human
uuccagggcccugucccccca

SEQ ID NO: 1307327 - RNA, 18 nt, Human
aaaaaaaaguuguccaaa

SEQ ID NO: 1307328 - RNA, 20 nt, Human
aaaacauuuucaaaagagcu

SEQ ID NO: 1307329 - RNA, 21 nt, Human
aaacuaaaaggagcuaccugg

SEQ ID NO: 1307330 - RNA, 20 nt, Human
aaaugaccuaaaacuaaagc

SEQ ID NO: 1307331 - RNA, 19 nt, Human
aaggcuugucucuaccuuu

SEQ ID NO: 1307332 - RNA, 19 nt, Human
aagggaagcugguuaccaa

SEQ ID NO: 1307333 - RNA, 19 nt, Human
cacucugccuagcacuuac

SEQ ID NO: 1307334 - RNA, 24 nt, Human
ccaaaagccuuucuaaccagguua

SEQ ID NO: 1307335 - RNA, 24 nt, Human
ccccaaaaaauauaacuauccuag

SEQ ID NO: 1307336 - RNA, 21 nt, Human
ccuuuguuagcuucucuggcu

SEQ ID NO: 1307337 - RNA, 22 nt, Human
cuaauauaugucuccuucaucu

SEQ ID NO: 1307338 - RNA, 18 nt, Human
cugcuaaguuggucaaaa

SEQ ID NO: 1307339 - RNA, 21 nt, Human
cuggacuugcuguuaucagaa

SEQ ID NO: 1307340 - RNA, 20 nt, Human
cuggcacaaacucacgaaga

SEQ ID NO: 1307341 - RNA, 20 nt, Human
cugggaaacaaaguucaucc

SEQ ID NO: 1307342 - RNA, 22 nt, Human
gaguauuuaaagaaaaagcuag

SEQ ID NO: 1307343 - RNA, 23 nt, Human
gauggcacuuaaaaaaaaguugu

SEQ ID NO: 1307344 - RNA, 18 nt, Human
ggggcccucagcaaaccc

SEQ ID NO: 1307345 - RNA, 23 nt, Human
uaaagcuacaagguaaaggcaca

SEQ ID NO: 1307346 - RNA, 25 nt, Human
uaaauaaagcggaaaaugcaggaaa

SEQ ID NO: 1307347 - RNA, 21 nt, Human
uagaaagugcaccuguaagaa

SEQ ID NO: 1307348 - RNA, 22 nt, Human
uagaaagugcaccuguaagaaa

SEQ ID NO: 1307349 - RNA, 21 nt, Human
uagaacccccaaaaaauauaa

SEQ ID NO: 1307350 - RNA, 21 nt, Human
uagaacccccaaaaaauauaa

SEQ ID NO: 1307351 - RNA, 22 nt, Human
uagaacccccaaaaaauauaac

SEQ ID NO: 1307352 - RNA, 22 nt, Human
uauaaaaacugcuuuugucugc

SEQ ID NO: 1307353 - RNA, 20 nt, Human
ucaaaagagcugaccuaaua

SEQ ID NO: 1307354 - RNA, 20 nt, Human
uccaaaagccuuucuaaccu

SEQ ID NO: 1307355 - RNA, 25 nt, Human
uccaaauauuucaacuuuuuuugga

SEQ ID NO: 1307356 - RNA, 22 nt, Human
uccaacuucaauguuguagaac

SEQ ID NO: 1307357 - RNA, 18 nt, Human
uccuuuagcuaguuugau

SEQ ID NO: 1307358 - RNA, 22 nt, Human
ugauguaugguaaauggcuagg

SEQ ID NO: 1307359 - RNA, 18 nt, Human
uggaaggagccuucuggg

SEQ ID NO: 1307360 - RNA, 24 nt, Human
uggaaggagccuucuggggcccuc

SEQ ID NO: 1307361 - RNA, 18 nt, Human
uggaauagcuuauuaaca

SEQ ID NO: 1307362 - RNA, 18 nt, Human
uggaaugcuauccuuaaa

SEQ ID NO: 1307363 - RNA, 23 nt, Human
uguuaucagaaugcuuuuucacu

SEQ ID NO: 1307364 - RNA, 18 nt, Human
uuagggucauguguuagg

SEQ ID NO: 1307365 - RNA, 20 nt, Human
uucaaaagagcugaccuaau

SEQ ID NO: 1307366 - RNA, 23 nt, Human
uuccccuauacuaggauucagca

SEQ ID NO: 1307367 - RNA, 20 nt, Human
uuucaucacuaacaauuucu

SEQ ID NO: 1307368 - RNA, 23 nt, Human
acacacacauucagauuugcgcg

SEQ ID NO: 1307369 - RNA, 22 nt, Human
aggacaaugggagguaucgggc

SEQ ID NO: 1307370 - RNA, 21 nt, Human
cagccaauagcaaacgggcuc

SEQ ID NO: 1307371 - RNA, 20 nt, Human
ccccggagacagccaauagc

SEQ ID NO: 1307372 - RNA, 22 nt, Human
uuggcgguagccaauaggagcc

SEQ ID NO: 1307373 - RNA, 20 nt, Human
aaagcaucccauaagcugaa

SEQ ID NO: 1307374 - RNA, 23 nt, Human
aaccuaucuagaaacaaaacuuc

SEQ ID NO: 1307375 - RNA, 19 nt, Human
acugcagcuuccuucuccu

SEQ ID NO: 1307376 - RNA, 19 nt, Human
agcaucccauaagcugaaa

SEQ ID NO: 1307377 - RNA, 26 nt, Human
aggcuuuaacugucaagagaugugag

SEQ ID NO: 1307378 - RNA, 23 nt, Human
agguauuugguuccuaggaaucu

SEQ ID NO: 1307379 - RNA, 18 nt, Human
caaccuaucuagaaacaa

SEQ ID NO: 1307380 - RNA, 18 nt, Human
ccugaaaaucaaaggaaa

SEQ ID NO: 1307381 - RNA, 24 nt, Human
cuaugaacuaaugcuuuaucuccc

SEQ ID NO: 1307382 - RNA, 18 nt, Human
gccacugggcuggaaucc

SEQ ID NO: 1307383 - RNA, 18 nt, Human
gccaggccacugggcugg

SEQ ID NO: 1307384 - RNA, 18 nt, Human
uaagcugaaaucuggugc

SEQ ID NO: 1307385 - RNA, 19 nt, Human
uacacuuaaaauuaagcuc

SEQ ID NO: 1307386 - RNA, 22 nt, Human
uacagauauaugaaaaugccaa

SEQ ID NO: 1307387 - RNA, 19 nt, Human
uagauaaaauaccugaaaa

SEQ ID NO: 1307388 - RNA, 21 nt, Human
ucaaacaaccuaucuagaaac

SEQ ID NO: 1307389 - RNA, 24 nt, Human
ucaagagugugauaugcaaggucg

SEQ ID NO: 1307390 - RNA, 24 nt, Human
ucccauaagcugaaaucuggugcu

SEQ ID NO: 1307391 - RNA, 26 nt, Human
uccuaaaugcagccacagagcaauca

SEQ ID NO: 1307392 - RNA, 20 nt, Human
ucgagacccaaguccucaau

SEQ ID NO: 1307393 - RNA, 21 nt, Human
ugaauacaugcaaggugguua

SEQ ID NO: 1307394 - RNA, 22 nt, Human
ugaccugaguccaaggagggua

SEQ ID NO: 1307395 - RNA, 22 nt, Human
ugaguccaaggaggguaggcac

SEQ ID NO: 1307396 - RNA, 25 nt, Human
ugggcuggaaucagucauccuagag

SEQ ID NO: 1307397 - RNA, 21 nt, Human
ugguuccuaggaaucugccgg

SEQ ID NO: 1307398 - RNA, 29 nt, Human
uugaagguucuguuuuaugcuacacuuaa

SEQ ID NO: 1307399 - RNA, 21 nt, Human
aagccuugucacaaguguggu

SEQ ID NO: 1307400 - RNA, 18 nt, Human
acaugcaccccaccacag

SEQ ID NO: 1307401 - RNA, 19 nt, Human
cucuuuaggcacugguucu

SEQ ID NO: 1307402 - RNA, 24 nt, Human
cuuacaguuccuguggucucucuc

SEQ ID NO: 1307403 - RNA, 19 nt, Human
gaacgccagcagcauccuc

SEQ ID NO: 1307404 - RNA, 19 nt, Human
gacaucuucaggggacuca

SEQ ID NO: 1307405 - RNA, 25 nt, Human
gcugcccgaggggccgccgccgucg

SEQ ID NO: 1307406 - RNA, 18 nt, Human
uaccuggaucgucugacc

SEQ ID NO: 1307407 - RNA, 23 nt, Human
uagcccggaugucgcugcccccu

SEQ ID NO: 1307408 - RNA, 21 nt, Human
uagcugcccgaggggccgccg

SEQ ID NO: 1307409 - RNA, 23 nt, Human
ucacaagugugguuugaacgcca

SEQ ID NO: 1307410 - RNA, 24 nt, Human
ucacaugcaccccaccacaggaga

SEQ ID NO: 1307411 - RNA, 24 nt, Human
ucccuuacaguuccuguggucucu

SEQ ID NO: 1307412 - RNA, 25 nt, Human
ucccuuacaguuccuguggucucuc

SEQ ID NO: 1307413 - RNA, 20 nt, Human
ugaacagaaagccuugucac

SEQ ID NO: 1307414 - RNA, 20 nt, Human
uguggucucucucuuuaggc

SEQ ID NO: 1307415 - RNA, 25 nt, Human
uguggucucucucuuuaggcacugg

SEQ ID NO: 1307416 - RNA, 19 nt, Human
uuggccccgggaggaggau

SEQ ID NO: 1307417 - RNA, 18 nt, Human
aaagucaacaugcuucuc

SEQ ID NO: 1307418 - RNA, 24 nt, Human
aacccugcucugccccagccccac

SEQ ID NO: 1307419 - RNA, 20 nt, Human
acccggccggccaucccgcc

SEQ ID NO: 1307420 - RNA, 18 nt, Human
acccugcucugccccagc

SEQ ID NO: 1307421 - RNA, 18 nt, Human
acuccaccagcaagcagc

SEQ ID NO: 1307422 - RNA, 18 nt, Human
agacgugagggucacccg

SEQ ID NO: 1307423 - RNA, 18 nt, Human
agagccccgccgagcccc

SEQ ID NO: 1307424 - RNA, 25 nt, Human
agaggagucugcccagccuugggag

SEQ ID NO: 1307425 - RNA, 21 nt, Human
agcggcccaugggcggcgggc

SEQ ID NO: 1307426 - RNA, 18 nt, Human
aggaacccugcucugccc

SEQ ID NO: 1307427 - RNA, 23 nt, Human
aggaacccugcucugccccagcc

SEQ ID NO: 1307428 - RNA, 22 nt, Human
agggaggguggacgcggguggg

SEQ ID NO: 1307429 - RNA, 21 nt, Human
caccagcaagcagcaguacca

SEQ ID NO: 1307430 - RNA, 22 nt, Human
cacgccccauucccaucccacc

SEQ ID NO: 1307431 - RNA, 25 nt, Human
cagagccccgccgagccccgcgccc

SEQ ID NO: 1307432 - RNA, 19 nt, Human
cagcagcuucugagaggag

SEQ ID NO: 1307433 - RNA, 23 nt, Human
cagcaguaccagcgccauccucg

SEQ ID NO: 1307434 - RNA, 21 nt, Human
cagcucaagcgaggcgcgcag

SEQ ID NO: 1307435 - RNA, 18 nt, Human
cagcucagccccugcucc

SEQ ID NO: 1307436 - RNA, 19 nt, Human
caggggaugcgucuugcau

SEQ ID NO: 1307437 - RNA, 20 nt, Human
cauugacccugagcuguggc

SEQ ID NO: 1307438 - RNA, 23 nt, Human
cccacgccccauucccaucccac

SEQ ID NO: 1307439 - RNA, 24 nt, Human
cccaugcuggauaaccagcaggag

SEQ ID NO: 1307440 - RNA, 20 nt, Human
ccccagccccacgccccauu

SEQ ID NO: 1307441 - RNA, 23 nt, Human
ccccaggaacccugcucugcccc

SEQ ID NO: 1307442 - RNA, 25 nt, Human
ccccaggaacccugcucugccccag

SEQ ID NO: 1307443 - RNA, 23 nt, Human
ccccgccgagccccgcgcccccu

SEQ ID NO: 1307444 - RNA, 18 nt, Human
ccccgcgcccccuacccg

SEQ ID NO: 1307445 - RNA, 19 nt, Human
ccccuccuccccacccacc

SEQ ID NO: 1307446 - RNA, 19 nt, Human
ccccugcuccaggcuaggg

SEQ ID NO: 1307447 - RNA, 19 nt, Human
cccggugcugcccgguccc

SEQ ID NO: 1307448 - RNA, 19 nt, Human
cccuccuccccacccaccg

SEQ ID NO: 1307449 - RNA, 18 nt, Human
cccugcuccaggcuaggg

SEQ ID NO: 1307450 - RNA, 24 nt, Human
cccugggcuucagggaaguugccc

SEQ ID NO: 1307451 - RNA, 18 nt, Human
ccgccgagccccgcgccc

SEQ ID NO: 1307452 - RNA, 19 nt, Human
ccgccgagccccgcgcccc

SEQ ID NO: 1307453 - RNA, 21 nt, Human
ccgcgcccccuacccggccgg

SEQ ID NO: 1307454 - RNA, 18 nt, Human
ccgcgcgcccggugcugc

SEQ ID NO: 1307455 - RNA, 18 nt, Human
ccggcccgccgcccccgg

SEQ ID NO: 1307456 - RNA, 22 nt, Human
ccucuggaucagggagggugga

SEQ ID NO: 1307457 - RNA, 21 nt, Human
cgagccccgcgcccccuaccc

SEQ ID NO: 1307458 - RNA, 19 nt, Human
cgccgggacgagcggccca

SEQ ID NO: 1307459 - RNA, 18 nt, Human
cggccgccucuagccugc

SEQ ID NO: 1307460 - RNA, 21 nt, Human
cggcgggcggcugcguggcgc

SEQ ID NO: 1307461 - RNA, 20 nt, Human
cggcgggcuggcggcgggcg

SEQ ID NO: 1307462 - RNA, 26 nt, Human
cggcggggcccccucccuuggaagcc

SEQ ID NO: 1307463 - RNA, 21 nt, Human
cgucagagccccgccgagccc

SEQ ID NO: 1307464 - RNA, 22 nt, Human
cgucagagccccgccgagcccc

SEQ ID NO: 1307465 - RNA, 23 nt, Human
cuagccugcaagccaggccgcgc

SEQ ID NO: 1307466 - RNA, 20 nt, Human
cuccuccccacccaccgccc

SEQ ID NO: 1307467 - RNA, 24 nt, Human
cuccucccgcugccucggccgccu

SEQ ID NO: 1307468 - RNA, 20 nt, Human
cucugccccagccccacgcc

SEQ ID NO: 1307469 - RNA, 22 nt, Human
cugcucugccccagccccacgc

SEQ ID NO: 1307470 - RNA, 27 nt, Human
cuggaucagggaggguggacgcgggug

SEQ ID NO: 1307471 - RNA, 24 nt, Human
cuugcauugacccugagcuguggc

SEQ ID NO: 1307472 - RNA, 20 nt, Human
gaccacagcagaacccuuca

SEQ ID NO: 1307473 - RNA, 22 nt, Human
gcagcaguaccagcgccauccu

SEQ ID NO: 1307474 - RNA, 20 nt, Human
gcccgcgccgcgcuccgggg

SEQ ID NO: 1307475 - RNA, 19 nt, Human
gcccuuggguugggggagg

SEQ ID NO: 1307476 - RNA, 18 nt, Human
gccucggacuccaccagc

SEQ ID NO: 1307477 - RNA, 19 nt, Human
gcgcucgcggcuggcuccg

SEQ ID NO: 1307478 - RNA, 18 nt, Human
gcggcccaugggcggcgg

SEQ ID NO: 1307479 - RNA, 19 nt, Human
gcgggggugggagagggcc

SEQ ID NO: 1307480 - RNA, 20 nt, Human
gcuccgggggggaaucgggg

SEQ ID NO: 1307481 - RNA, 22 nt, Human
gcucggggcccgcgucccgcuc

SEQ ID NO: 1307482 - RNA, 28 nt, Human
ggacgcgggugggacuugggggacugcc

SEQ ID NO: 1307483 - RNA, 23 nt, Human
ggagucacguuuucccagccucc

SEQ ID NO: 1307484 - RNA, 23 nt, Human
ggccggcgcgagaggaggggccg

SEQ ID NO: 1307485 - RNA, 18 nt, Human
ggcggcgggcuggcggcg

SEQ ID NO: 1307486 - RNA, 18 nt, Human
ggcggcgggcuggcggcg

SEQ ID NO: 1307487 - RNA, 23 nt, Human
gggcccccucccuuggaagcccc

SEQ ID NO: 1307488 - RNA, 19 nt, Human
gggcggcgggcuggcggcg

SEQ ID NO: 1307489 - RNA, 24 nt, Human
gggcgggggugggagagggccugg

SEQ ID NO: 1307490 - RNA, 19 nt, Human
ggggccccuccuccccacc

SEQ ID NO: 1307491 - RNA, 19 nt, Human
ggggcgggggugggagagg

SEQ ID NO: 1307492 - RNA, 19 nt, Human
ggggugggagagggccugg

SEQ ID NO: 1307493 - RNA, 24 nt, Human
ggguugggggaggggugcugcugg

SEQ ID NO: 1307494 - RNA, 22 nt, Human
ggucugggccugcucggggccc

SEQ ID NO: 1307495 - RNA, 18 nt, Human
guccccggcccgccgccc

SEQ ID NO: 1307496 - RNA, 18 nt, Human
uaccagggcugccccagg

SEQ ID NO: 1307497 - RNA, 21 nt, Human
uaccagggcugccccaggaac

SEQ ID NO: 1307498 - RNA, 19 nt, Human
ucagccccugcuccaggcu

SEQ ID NO: 1307499 - RNA, 23 nt, Human
ucaggccccgcgcugcccgcgcc

SEQ ID NO: 1307500 - RNA, 27 nt, Human
ucaggccccgcgcugcccgcgccgcgc

SEQ ID NO: 1307501 - RNA, 19 nt, Human
ucaggccucggacuccacc

SEQ ID NO: 1307502 - RNA, 21 nt, Human
uccaguggcggcugcugcugc

SEQ ID NO: 1307503 - RNA, 22 nt, Human
ucccaccgacgugggcccuggg

SEQ ID NO: 1307504 - RNA, 20 nt, Human
ucccagccucccaguggacg

SEQ ID NO: 1307505 - RNA, 20 nt, Human
ucccgccucuggaucaggga

SEQ ID NO: 1307506 - RNA, 23 nt, Human
ucccuuggaagcccccaggaaaa

SEQ ID NO: 1307507 - RNA, 19 nt, Human
uccgcgcgcccggugcugc

SEQ ID NO: 1307508 - RNA, 24 nt, Human
uccuccccacccaccgcccuaccc

SEQ ID NO: 1307509 - RNA, 22 nt, Human
uccucggggggccccuccuccc

SEQ ID NO: 1307510 - RNA, 19 nt, Human
ucggccgccucuagccugc

SEQ ID NO: 1307511 - RNA, 21 nt, Human
ucggggggccccuccucccca

SEQ ID NO: 1307512 - RNA, 19 nt, Human
ucugaacuggggaggaggg

SEQ ID NO: 1307513 - RNA, 21 nt, Human
ucugccccagccccacgcccc

SEQ ID NO: 1307514 - RNA, 21 nt, Human
ugacccugagcuguggcgccu

SEQ ID NO: 1307515 - RNA, 21 nt, Human
ugagaggagucugcccagccu

SEQ ID NO: 1307516 - RNA, 21 nt, Human
ugcauucugaacuggggagga

SEQ ID NO: 1307517 - RNA, 21 nt, Human
ugcccgcgccgcgcuccgggg

SEQ ID NO: 1307518 - RNA, 24 nt, Human
ugcccuuggguugggggaggggug

SEQ ID NO: 1307519 - RNA, 21 nt, Human
ugccucggccgccucuagccu

SEQ ID NO: 1307520 - RNA, 23 nt, Human
uggaagcccccaggaaaagucaa

SEQ ID NO: 1307521 - RNA, 21 nt, Human
uggcggcgggcggcugcgugg

SEQ ID NO: 1307522 - RNA, 25 nt, Human
ugggagagggccugggaccacagca

SEQ ID NO: 1307523 - RNA, 23 nt, Human
aaaaaucaccucagaaaacugcc

SEQ ID NO: 1307524 - RNA, 19 nt, Human
aaaucaccucagaaaacug

SEQ ID NO: 1307525 - RNA, 20 nt, Human
aaaugacuguuuuauuucca

SEQ ID NO: 1307526 - RNA, 23 nt, Human
aauaguuuugcauuugcuaucau

SEQ ID NO: 1307527 - RNA, 22 nt, Human
agacaugaaaagagcaggccag

SEQ ID NO: 1307528 - RNA, 22 nt, Human
agauaaaagugaaagcugucug

SEQ ID NO: 1307529 - RNA, 22 nt, Human
aggccagguggauuacuugagg

SEQ ID NO: 1307530 - RNA, 23 nt, Human
aggccagguggauuacuugaggu

SEQ ID NO: 1307531 - RNA, 22 nt, Human
aguaauggauucucccaggcac

SEQ ID NO: 1307532 - RNA, 20 nt, Human
aguuuuuuuuuuuuuuuuuu

SEQ ID NO: 1307533 - RNA, 22 nt, Human
auguuaagacaugaaaagagca

SEQ ID NO: 1307534 - RNA, 18 nt, Human
cagcaaaugcuggacucu

SEQ ID NO: 1307535 - RNA, 24 nt, Human
caggccagguggauuacuugaggu

SEQ ID NO: 1307536 - RNA, 24 nt, Human
cagguggauuacuugaggucagga

SEQ ID NO: 1307537 - RNA, 22 nt, Human
caguaauggauucucccaggca

SEQ ID NO: 1307538 - RNA, 23 nt, Human
cuuaagccaggaguauaacuacu

SEQ ID NO: 1307539 - RNA, 19 nt, Human
gagaggcagaacaaaaaga

SEQ ID NO: 1307540 - RNA, 18 nt, Human
gauuacuugaggucagga

SEQ ID NO: 1307541 - RNA, 22 nt, Human
gauuacuugaggucaggaguuu

SEQ ID NO: 1307542 - RNA, 24 nt, Human
gauuacuugaggucaggaguuuga

SEQ ID NO: 1307543 - RNA, 22 nt, Human
gcagcuuuuagagguaggaauu

SEQ ID NO: 1307544 - RNA, 22 nt, Human
ggauuacuugaggucaggaguu

SEQ ID NO: 1307545 - RNA, 21 nt, Human
gucuacucacuacguagcaac

SEQ ID NO: 1307546 - RNA, 20 nt, Human
guggauuacuugaggucagg

SEQ ID NO: 1307547 - RNA, 18 nt, Human
uaacuacuucaaauacac

SEQ ID NO: 1307548 - RNA, 20 nt, Human
uacuauacccaagagaaagu

SEQ ID NO: 1307549 - RNA, 20 nt, Human
uagagguaggaauuccuucu

SEQ ID NO: 1307550 - RNA, 18 nt, Human
uaggaauuccuucucuac

SEQ ID NO: 1307551 - RNA, 21 nt, Human
ucacuaccuuuucaguuuuuu

SEQ ID NO: 1307552 - RNA, 23 nt, Human
ucagcaaaugcuggacucucccu

SEQ ID NO: 1307553 - RNA, 18 nt, Human
uccacaaguaaaguagau

SEQ ID NO: 1307554 - RNA, 18 nt, Human
ucucccaggcacuaaacu

SEQ ID NO: 1307555 - RNA, 25 nt, Human
ugaaaagagcaggccagguggauua

SEQ ID NO: 1307556 - RNA, 22 nt, Human
ugaaagcugucugaggcuuacu

SEQ ID NO: 1307557 - RNA, 19 nt, Human
ugaggcuuacuauacccaa

SEQ ID NO: 1307558 - RNA, 18 nt, Human
ugaggucaggaguuugag

SEQ ID NO: 1307559 - RNA, 19 nt, Human
uggauuacuugaggucagg

SEQ ID NO: 1307560 - RNA, 23 nt, Human
uggauuacuugaggucaggaguu

SEQ ID NO: 1307561 - RNA, 24 nt, Human
uggauuacuugaggucaggaguuu

SEQ ID NO: 1307562 - RNA, 25 nt, Human
uguagaaucugugucagcaaaugcu

SEQ ID NO: 1307563 - RNA, 18 nt, Human
ugugucagcaaaugcugg

SEQ ID NO: 1307564 - RNA, 19 nt, Human
uugagaggcagaacaaaaa

SEQ ID NO: 1307565 - RNA, 24 nt, Human
uuugagaggcagaacaaaaagaaa

SEQ ID NO: 1307566 - RNA, 25 nt, Human
uuuuuuuuuuuuuuuuuuuuuaagg

SEQ ID NO: 1307567 - RNA, 18 nt, Human
accuggggcacagccggg

SEQ ID NO: 1307568 - RNA, 18 nt, Human
agacaggauacauagggg

SEQ ID NO: 1307569 - RNA, 23 nt, Human
agacaggauacauaggggauuau

SEQ ID NO: 1307570 - RNA, 26 nt, Human
agaguccuuuucucuuucuccucugg

SEQ ID NO: 1307571 - RNA, 19 nt, Human
aguccuuuucucuuucuuu

SEQ ID NO: 1307572 - RNA, 18 nt, Human
cccucagucucugaaagu

SEQ ID NO: 1307573 - RNA, 25 nt, Human
ccuccugucucccucccuggcuuca

SEQ ID NO: 1307574 - RNA, 21 nt, Human
ccugcccuccugucucccucc

SEQ ID NO: 1307575 - RNA, 22 nt, Human
cucccuggcuucacccacaagg

SEQ ID NO: 1307576 - RNA, 18 nt, Human
cugcggcgaggcgaggag

SEQ ID NO: 1307577 - RNA, 19 nt, Human
gacaggauacauaggggau

SEQ ID NO: 1307578 - RNA, 22 nt, Human
gaggagauguggggagaggaag

SEQ ID NO: 1307579 - RNA, 20 nt, Human
gcccuccugucucccucccu

SEQ ID NO: 1307580 - RNA, 19 nt, Human
ggaccuggggcacagccgg

SEQ ID NO: 1307581 - RNA, 21 nt, Human
ggcgaggagauguggggagag

SEQ ID NO: 1307582 - RNA, 24 nt, Human
ggcugauuucugugggagcucucu

SEQ ID NO: 1307583 - RNA, 19 nt, Human
ggggagaggaagagcggcg

SEQ ID NO: 1307584 - RNA, 21 nt, Human
uaugauacgauacucaaaacc

SEQ ID NO: 1307585 - RNA, 21 nt, Human
uccacgaugugcucauuuagg

SEQ ID NO: 1307586 - RNA, 18 nt, Human
uccuccugcccuccuguc

SEQ ID NO: 1307587 - RNA, 23 nt, Human
ucucuaggcagaacccucagucu

SEQ ID NO: 1307588 - RNA, 18 nt, Human
ucucugaaagucggguuc

SEQ ID NO: 1307589 - RNA, 20 nt, Human
ucucugaaagucggguucgu

SEQ ID NO: 1307590 - RNA, 21 nt, Human
ucugaguagccuauagagucc

SEQ ID NO: 1307591 - RNA, 19 nt, Human
ugaaacguucucagguccc

SEQ ID NO: 1307592 - RNA, 24 nt, Human
ugaugacguuauuggaugaaacgu

SEQ ID NO: 1307593 - RNA, 22 nt, Human
uggggcacagccgggcccacug

SEQ ID NO: 1307594 - RNA, 20 nt, Human
ugucucccucccuggcuuca

SEQ ID NO: 1307595 - RNA, 22 nt, Human
uguggggagaggaagagcggcc

SEQ ID NO: 1307596 - RNA, 26 nt, Human
uucucuuucuuucccuuggugaggag

SEQ ID NO: 1307597 - RNA, 18 nt, Human
agucaguccagagcugcc

SEQ ID NO: 1307598 - RNA, 18 nt, Human
aguccagagcugcccagu

SEQ ID NO: 1307599 - RNA, 21 nt, Human
caccugcagucaguccagagc

SEQ ID NO: 1307600 - RNA, 18 nt, Human
cccagucuugaauauaau

SEQ ID NO: 1307601 - RNA, 19 nt, Human
cgggcgggucggcgcugcc

SEQ ID NO: 1307602 - RNA, 24 nt, Human
gacgcgcagggcccggcggugggc

SEQ ID NO: 1307603 - RNA, 20 nt, Human
gcccggcggugggcgggcgg

SEQ ID NO: 1307604 - RNA, 25 nt, Human
ggacaucaccugcagucaguccaga

SEQ ID NO: 1307605 - RNA, 22 nt, Human
ggagacccccgcccucaacuga

SEQ ID NO: 1307606 - RNA, 19 nt, Human
ugaauauaaucauggccaa

SEQ ID NO: 1307607 - RNA, 21 nt, Human
ugggcgggcgggucggcgccu

SEQ ID NO: 1307608 - RNA, 21 nt, Human
aaaccgacaccuucggccucg

SEQ ID NO: 1307609 - RNA, 20 nt, Human
aagcagcaucaagccccggg

SEQ ID NO: 1307610 - RNA, 25 nt, Human
aagcagcaucaagccccgggucccc

SEQ ID NO: 1307611 - RNA, 21 nt, Human
agaccaacauggagaaggcca

SEQ ID NO: 1307612 - RNA, 18 nt, Human
agugccgccgcagccgcc

SEQ ID NO: 1307613 - RNA, 20 nt, Human
auggagaaggccaacccgga

SEQ ID NO: 1307614 - RNA, 19 nt, Human
caagccccggguccccgcc

SEQ ID NO: 1307615 - RNA, 21 nt, Human
ccaccagcaguauauugauaa

SEQ ID NO: 1307616 - RNA, 21 nt, Human
ccacugggccaggcccaagca

SEQ ID NO: 1307617 - RNA, 20 nt, Human
ccaggcccaagcagcaucaa

SEQ ID NO: 1307618 - RNA, 22 nt, Human
cccaccagcaguauauugauaa

SEQ ID NO: 1307619 - RNA, 21 nt, Human
ccccgccccuucacguucccg

SEQ ID NO: 1307620 - RNA, 22 nt, Human
cccggaagugccgccgcagccg

SEQ ID NO: 1307621 - RNA, 20 nt, Human
ccgaaccaagcgcccgcagc

SEQ ID NO: 1307622 - RNA, 18 nt, Human
ccgcagccgcccgcccgg

SEQ ID NO: 1307623 - RNA, 22 nt, Human
ccuuucaguuguguauauauuu

SEQ ID NO: 1307624 - RNA, 19 nt, Human
cgaaccaagcgcccgcagc

SEQ ID NO: 1307625 - RNA, 25 nt, Human
cgagaccaacauggagaaggccaac

SEQ ID NO: 1307626 - RNA, 18 nt, Human
cgcagccgcccgcccggu

SEQ ID NO: 1307627 - RNA, 19 nt, Human
cgcccgcgucgcgcgccuc

SEQ ID NO: 1307628 - RNA, 23 nt, Human
cucggaauaggguucuuugaaaa

SEQ ID NO: 1307629 - RNA, 23 nt, Human
gaggccccgccccuucacguucc

SEQ ID NO: 1307630 - RNA, 20 nt, Human
ggagaaggccaacccggaag

SEQ ID NO: 1307631 - RNA, 23 nt, Human
gggccaggcccaagcagcaucaa

SEQ ID NO: 1307632 - RNA, 23 nt, Human
ucccuaggacccgccacugggcc

SEQ ID NO: 1307633 - RNA, 23 nt, Human
ucuguauuuuaaaaaccgacacc

SEQ ID NO: 1307634 - RNA, 21 nt, Human
ugaccucgaggccccgccccu

SEQ ID NO: 1307635 - RNA, 24 nt, Human
ugugggauggcagcuugcccaagg

SEQ ID NO: 1307636 - RNA, 20 nt, Human
uguguauauauuugaggugu

SEQ ID NO: 1307637 - RNA, 21 nt, Human
uugcccaagguuaaacagcaa

SEQ ID NO: 1307638 - RNA, 22 nt, Human
uuguguauauauuugaggugug

SEQ ID NO: 1307639 - RNA, 24 nt, Human
uuguguauauauuugagguguggu

SEQ ID NO: 1307640 - RNA, 19 nt, Human
uuucuuguuguccuuaugu

SEQ ID NO: 1307641 - RNA, 21 nt, Human
cccauaccccagugcaguuga

SEQ ID NO: 1307642 - RNA, 26 nt, Human
uugacaaucacgucugcgccuucucu

SEQ ID NO: 1307643 - RNA, 23 nt, Human
aaauguccucauggaucuucucc

SEQ ID NO: 1307644 - RNA, 22 nt, Human
acagucugcguucugcaucagc

SEQ ID NO: 1307645 - RNA, 21 nt, Human
agcgcagggugauggugcugg

SEQ ID NO: 1307646 - RNA, 18 nt, Human
agcucuucccccaugcuc

SEQ ID NO: 1307647 - RNA, 21 nt, Human
augugcaggaucuggucugug

SEQ ID NO: 1307648 - RNA, 21 nt, Human
cacagcacaaagccaucuaga

SEQ ID NO: 1307649 - RNA, 23 nt, Human
cacagcccgggggauguagugcu

SEQ ID NO: 1307650 - RNA, 19 nt, Human
cagcacagcccgggggaug

SEQ ID NO: 1307651 - RNA, 19 nt, Human
caucuuguccugguuggga

SEQ ID NO: 1307652 - RNA, 19 nt, Human
cauggaucuucucccucug

SEQ ID NO: 1307653 - RNA, 19 nt, Human
cauuguccauguagcuggg

SEQ ID NO: 1307654 - RNA, 20 nt, Human
ccaccacguugcucaucuug

SEQ ID NO: 1307655 - RNA, 18 nt, Human
ccaugagcugcugcacaa

SEQ ID NO: 1307656 - RNA, 21 nt, Human
cccagcaaugaacugacacag

SEQ ID NO: 1307657 - RNA, 25 nt, Human
ccucauggaucuucucccucuggga

SEQ ID NO: 1307658 - RNA, 23 nt, Human
ccucugggagaaucugcuggccc

SEQ ID NO: 1307659 - RNA, 22 nt, Human
ccucuugagugugaggagugaa

SEQ ID NO: 1307660 - RNA, 22 nt, Human
cgacagguagauguucucuggg

SEQ ID NO: 1307661 - RNA, 19 nt, Human
cuggucugugauguuaaaa

SEQ ID NO: 1307662 - RNA, 20 nt, Human
cugguucagggcuguguugu

SEQ ID NO: 1307663 - RNA, 23 nt, Human
gagaaucugcuggcccaguuguu

SEQ ID NO: 1307664 - RNA, 18 nt, Human
gagagaaggauggguucu

SEQ ID NO: 1307665 - RNA, 22 nt, Human
gaggauggaguggaucaccugg

SEQ ID NO: 1307666 - RNA, 18 nt, Human
gagugaauuauaaagcug

SEQ ID NO: 1307667 - RNA, 20 nt, Human
gcagggugauggugcuggcc

SEQ ID NO: 1307668 - RNA, 23 nt, Human
gcuccugggugccccaggagaug

SEQ ID NO: 1307669 - RNA, 20 nt, Human
ggcuguguugugcagcacca

SEQ ID NO: 1307670 - RNA, 19 nt, Human
gggcuccagguccagcagc

SEQ ID NO: 1307671 - RNA, 23 nt, Human
gucacuaccaucugccuccuggu

SEQ ID NO: 1307672 - RNA, 24 nt, Human
guccuugaacauguccuccuugcg

SEQ ID NO: 1307673 - RNA, 20 nt, Human
gugcagcaccaccacacagg

SEQ ID NO: 1307674 - RNA, 18 nt, Human
uaggagcccaggccagaa

SEQ ID NO: 1307675 - RNA, 21 nt, Human
ucacuaccaucugccuccugg

SEQ ID NO: 1307676 - RNA, 22 nt, Human
ucagccucuugagugugaggag

SEQ ID NO: 1307677 - RNA, 19 nt, Human
uccugguugggaaacacug

SEQ ID NO: 1307678 - RNA, 24 nt, Human
uccugguugggaaacacugaguau

SEQ ID NO: 1307679 - RNA, 18 nt, Human
ugagagaaggauggguuc

SEQ ID NO: 1307680 - RNA, 23 nt, Human
ugaggagugaauuauaaagcugg

SEQ ID NO: 1307681 - RNA, 22 nt, Human
ugaggcgaugaggccuaugagg

SEQ ID NO: 1307682 - RNA, 21 nt, Human
ugcagcaccaccacacagucu

SEQ ID NO: 1307683 - RNA, 19 nt, Human
ugccugguagaaaaagaug

SEQ ID NO: 1307684 - RNA, 23 nt, Human
ugccugguagaaaaagauguccu

SEQ ID NO: 1307685 - RNA, 20 nt, Human
ugcucaucgucugccuggua

SEQ ID NO: 1307686 - RNA, 21 nt, Human
uggacaccagcugguuggucu

SEQ ID NO: 1307687 - RNA, 24 nt, Human
uggaucaccuggggcuccaggucc

SEQ ID NO: 1307688 - RNA, 23 nt, Human
ugggguagcgcagggugauggug

SEQ ID NO: 1307689 - RNA, 22 nt, Human
ugguagaaaaagauguccuugu

SEQ ID NO: 1307690 - RNA, 25 nt, Human
uguccaucucaucaaaguuguccuu

SEQ ID NO: 1307691 - RNA, 18 nt, Human
uugggaaacacugaguau

SEQ ID NO: 1307692 - RNA, 23 nt, Human
caggagucuucuuuucagugucc

SEQ ID NO: 1307693 - RNA, 18 nt, Human
ccagagcaggagucuucu

SEQ ID NO: 1307694 - RNA, 24 nt, Human
aaacccuaccuaaagacuaagaag

SEQ ID NO: 1307695 - RNA, 18 nt, Human
aaauaacuuucuaagaca

SEQ ID NO: 1307696 - RNA, 19 nt, Human
aacaagaauaacuucccau

SEQ ID NO: 1307697 - RNA, 18 nt, Human
aagacaaaugacaaaggc

SEQ ID NO: 1307698 - RNA, 22 nt, Human
aagaugaccuuuacauaaaaau

SEQ ID NO: 1307699 - RNA, 22 nt, Human
agcaaaggcagaaaguauucau

SEQ ID NO: 1307700 - RNA, 21 nt, Human
caacaggaaccuuuacacucc

SEQ ID NO: 1307701 - RNA, 23 nt, Human
cacuuuagccugguggggaaagc

SEQ ID NO: 1307702 - RNA, 26 nt, Human
cagaagaaacaagaauaacuucccau

SEQ ID NO: 1307703 - RNA, 19 nt, Human
cccuucguucuuuuuccuc

SEQ ID NO: 1307704 - RNA, 20 nt, Human
cccuucguucuuuuuccucu

SEQ ID NO: 1307705 - RNA, 21 nt, Human
ccucucagaagaaacaagaau

SEQ ID NO: 1307706 - RNA, 25 nt, Human
ccucucagaagaaacaagaauaacu

SEQ ID NO: 1307707 - RNA, 19 nt, Human
cuaucauuagcaaaggcag

SEQ ID NO: 1307708 - RNA, 20 nt, Human
cuguuaaugauggugaaccu

SEQ ID NO: 1307709 - RNA, 19 nt, Human
cuuuuuccucucagaagaa

SEQ ID NO: 1307710 - RNA, 18 nt, Human
gauucucgacaugauguu

SEQ ID NO: 1307711 - RNA, 18 nt, Human
gcugaaauacgaacucug

SEQ ID NO: 1307712 - RNA, 22 nt, Human
uaagaagcacuuuagccuggug

SEQ ID NO: 1307713 - RNA, 24 nt, Human
uaagacaaaugacaaaggcuuuuu

SEQ ID NO: 1307714 - RNA, 25 nt, Human
uagaauaacuaucauuagcaaaggc

SEQ ID NO: 1307715 - RNA, 26 nt, Human
uagaauaacuaucauuagcaaaggca

SEQ ID NO: 1307716 - RNA, 20 nt, Human
uaggaaggauaaacaaagcu

SEQ ID NO: 1307717 - RNA, 24 nt, Human
uauagaaugaaaauauaccuuuag

SEQ ID NO: 1307718 - RNA, 20 nt, Human
uauaucauugaugaagcucc

SEQ ID NO: 1307719 - RNA, 23 nt, Human
uaucauuagcaaaggcagaaagu

SEQ ID NO: 1307720 - RNA, 23 nt, Human
uauguaacauaauuauagaauga

SEQ ID NO: 1307721 - RNA, 24 nt, Human
ucuguucuguguguccuuuggaga

SEQ ID NO: 1307722 - RNA, 21 nt, Human
ugaaauuaaauguuccccuuc

SEQ ID NO: 1307723 - RNA, 22 nt, Human
ugaaauuaaauguuccccuucg

SEQ ID NO: 1307724 - RNA, 19 nt, Human
ugaaguucaaaacccuacc

SEQ ID NO: 1307725 - RNA, 20 nt, Human
ugauucucgacaugauguuu

SEQ ID NO: 1307726 - RNA, 22 nt, Human
ugcagagcuuuagagcaagcac

SEQ ID NO: 1307727 - RNA, 22 nt, Human
uggaauaaagacuggaaaauuu

SEQ ID NO: 1307728 - RNA, 21 nt, Human
uuaaauguuccccuucguucu

SEQ ID NO: 1307729 - RNA, 23 nt, Human
uuacugcauucaaauccccggau

SEQ ID NO: 1307730 - RNA, 26 nt, Human
uuaguaaagacauauuuuuucacuau

SEQ ID NO: 1307731 - RNA, 24 nt, Human
uuuacaucagaaggccuuucuaaa

SEQ ID NO: 1307732 - RNA, 19 nt, Human
uuuucaugaauucuuuggu

SEQ ID NO: 1307733 - RNA, 21 nt, Human
cacuuucucuuccuucucauc

SEQ ID NO: 1307734 - RNA, 20 nt, Human
cagcucacuuucucuuccuu

SEQ ID NO: 1307735 - RNA, 23 nt, Human
cccgcccagcucacuuucucuuc

SEQ ID NO: 1307736 - RNA, 23 nt, Human
ccuccuugcccaacuccuccucu

SEQ ID NO: 1307737 - RNA, 19 nt, Human
cuccuccuugcccaacucc

SEQ ID NO: 1307738 - RNA, 20 nt, Human
ucacuuucucuuccuucuca

SEQ ID NO: 1307739 - RNA, 18 nt, Human
uccuccuucuccucuauc

SEQ ID NO: 1307740 - RNA, 24 nt, Human
ucuccucuucuuccuccucuuccc

SEQ ID NO: 1307741 - RNA, 18 nt, Human
ucugucuccucuucuucc

SEQ ID NO: 1307742 - RNA, 20 nt, Human
ucugucuccucuucuuccuc

SEQ ID NO: 1307743 - RNA, 18 nt, Human
ucuuccuccucuuccucc

SEQ ID NO: 1307744 - RNA, 22 nt, Human
ucuuccuccucuuccuccucca

SEQ ID NO: 1307745 - RNA, 20 nt, Human
ugggcccgaugcccgcccag

SEQ ID NO: 1307746 - RNA, 23 nt, Human
uuccuccucuuccuccuccaacu

SEQ ID NO: 1307747 - RNA, 27 nt, Human
aaaaauggcaaagagagaccgguaccc

SEQ ID NO: 1307748 - RNA, 23 nt, Human
aaaccagucauaggccaucacac

SEQ ID NO: 1307749 - RNA, 21 nt, Human
acagccagcccagagaaagca

SEQ ID NO: 1307750 - RNA, 19 nt, Human
acagguuggagaggaagaa

SEQ ID NO: 1307751 - RNA, 21 nt, Human
accgcacuuccgccucccucg

SEQ ID NO: 1307752 - RNA, 23 nt, Human
agagaaagcagccaccugcuaga

SEQ ID NO: 1307753 - RNA, 18 nt, Human
agaggaagaaguacaugg

SEQ ID NO: 1307754 - RNA, 23 nt, Human
agaggaagaaguacaugggggug

SEQ ID NO: 1307755 - RNA, 25 nt, Human
agccugcauaggagaugacucugcu

SEQ ID NO: 1307756 - RNA, 25 nt, Human
aggaagaaguacaugggggugugga

SEQ ID NO: 1307757 - RNA, 20 nt, Human
auucaauaacugguuuucca

SEQ ID NO: 1307758 - RNA, 19 nt, Human
caaaaauggcaaagagaga

SEQ ID NO: 1307759 - RNA, 21 nt, Human
caaggacagguuggagaggaa

SEQ ID NO: 1307760 - RNA, 18 nt, Human
cacauggacaggaacagc

SEQ ID NO: 1307761 - RNA, 22 nt, Human
caccgcacuuccgccucccucg

SEQ ID NO: 1307762 - RNA, 21 nt, Human
cagagaaagcagccaccugcu

SEQ ID NO: 1307763 - RNA, 20 nt, Human
cagcccagagaaagcagcca

SEQ ID NO: 1307764 - RNA, 23 nt, Human
cagcccagagaaagcagccaccu

SEQ ID NO: 1307765 - RNA, 19 nt, Human
cagccugcauaggagauga

SEQ ID NO: 1307766 - RNA, 26 nt, Human
caugucucucuuccaugccuccaaaa

SEQ ID NO: 1307767 - RNA, 23 nt, Human
ccaggaugaugagcagguucccc

SEQ ID NO: 1307768 - RNA, 18 nt, Human
cccugagacuucaacaac

SEQ ID NO: 1307769 - RNA, 23 nt, Human
ccuccaaaaauggcaaagagaga

SEQ ID NO: 1307770 - RNA, 26 nt, Human
ccucccacagccagcccagagaaagc

SEQ ID NO: 1307771 - RNA, 25 nt, Human
cggccggguccccaccucgggagcc

SEQ ID NO: 1307772 - RNA, 19 nt, Human
cuuccaugccuccaaaaau

SEQ ID NO: 1307773 - RNA, 22 nt, Human
gaaagcagccaccugcuagaac

SEQ ID NO: 1307774 - RNA, 21 nt, Human
ggguguggaggugggagucag

SEQ ID NO: 1307775 - RNA, 22 nt, Human
gguguggaggugggagucaggg

SEQ ID NO: 1307776 - RNA, 21 nt, Human
uacauggggguguggaggugg

SEQ ID NO: 1307777 - RNA, 21 nt, Human
uagcgggugacagauggcuac

SEQ ID NO: 1307778 - RNA, 23 nt, Human
uccaaaaauggcaaagagagaca

SEQ ID NO: 1307779 - RNA, 18 nt, Human
ucccacagccagcccaga

SEQ ID NO: 1307780 - RNA, 26 nt, Human
uggauccccugagacuucaacaacuc

SEQ ID NO: 1307781 - RNA, 18 nt, Human
uggauguccacaaucauc

SEQ ID NO: 1307782 - RNA, 18 nt, Human
uggggguguggagguggg

SEQ ID NO: 1307783 - RNA, 24 nt, Human
uguggaggugggagucagggcugg

SEQ ID NO: 1307784 - RNA, 18 nt, Human
aagagagagcugcauaug

SEQ ID NO: 1307785 - RNA, 20 nt, Human
aagugguagcuucuucuuau

SEQ ID NO: 1307786 - RNA, 18 nt, Human
acagaaagcccacaguug

SEQ ID NO: 1307787 - RNA, 21 nt, Human
agagcuggugugggagccuca

SEQ ID NO: 1307788 - RNA, 20 nt, Human
agccucaggccccagagagc

SEQ ID NO: 1307789 - RNA, 19 nt, Human
aggccaggggagagcuggu

SEQ ID NO: 1307790 - RNA, 18 nt, Human
agugguagcuucuucuua

SEQ ID NO: 1307791 - RNA, 18 nt, Human
aguguggauggaagaaca

SEQ ID NO: 1307792 - RNA, 19 nt, Human
aguuaugcagcgcacagcc

SEQ ID NO: 1307793 - RNA, 23 nt, Human
aguugauggugccugucagcugg

SEQ ID NO: 1307794 - RNA, 18 nt, Human
auggagacuggggaagac

SEQ ID NO: 1307795 - RNA, 23 nt, Human
cacacucacauugugucugugug

SEQ ID NO: 1307796 - RNA, 22 nt, Human
cagacuccaaagcuaugagaag

SEQ ID NO: 1307797 - RNA, 20 nt, Human
cagccuacauggcuguacag

SEQ ID NO: 1307798 - RNA, 21 nt, Human
cagccuacauggcuguacagg

SEQ ID NO: 1307799 - RNA, 20 nt, Human
cagcgcacagccuacauggc

SEQ ID NO: 1307800 - RNA, 23 nt, Human
caggagugagcugccuucuuugu

SEQ ID NO: 1307801 - RNA, 20 nt, Human
caggcaugcaccugguuuua

SEQ ID NO: 1307802 - RNA, 22 nt, Human
caggccccagagagcccucggg

SEQ ID NO: 1307803 - RNA, 24 nt, Human
cauaguccagguggccgcugacca

SEQ ID NO: 1307804 - RNA, 19 nt, Human
cauucuuguccccaggccu

SEQ ID NO: 1307805 - RNA, 21 nt, Human
ccauacugaaugcaauucagc

SEQ ID NO: 1307806 - RNA, 21 nt, Human
ccccagagagcccucgggacc

SEQ ID NO: 1307807 - RNA, 19 nt, Human
ccccugcaguagccguuga

SEQ ID NO: 1307808 - RNA, 23 nt, Human
ccccuuccuuccauuuccuuucc

SEQ ID NO: 1307809 - RNA, 19 nt, Human
cccgaggguauaagagaga

SEQ ID NO: 1307810 - RNA, 21 nt, Human
cccuggaguuaugcagcgcac

SEQ ID NO: 1307811 - RNA, 21 nt, Human
ccgguccugggacucuaaccu

SEQ ID NO: 1307812 - RNA, 19 nt, Human
ccucgggaccuccugaugg

SEQ ID NO: 1307813 - RNA, 20 nt, Human
ccucuggggacaggcagcuu

SEQ ID NO: 1307814 - RNA, 20 nt, Human
ccugcagcagcacgggcugu

SEQ ID NO: 1307815 - RNA, 19 nt, Human
ccugggaggaacccgaggg

SEQ ID NO: 1307816 - RNA, 18 nt, Human
ccuguccugcagcagcac

SEQ ID NO: 1307817 - RNA, 18 nt, Human
ccuuccauuuccuuuccc

SEQ ID NO: 1307818 - RNA, 21 nt, Human
cgaggguauaagagagagcug

SEQ ID NO: 1307819 - RNA, 25 nt, Human
cgguccugggacucuaaccugugcu

SEQ ID NO: 1307820 - RNA, 25 nt, Human
cuccaaauuccccuuccuuccauuu

SEQ ID NO: 1307821 - RNA, 21 nt, Human
cucccggacaccaccuuccgg

SEQ ID NO: 1307822 - RNA, 20 nt, Human
cuccuaagagcaggagugag

SEQ ID NO: 1307823 - RNA, 18 nt, Human
cuccuguccugcagcagc

SEQ ID NO: 1307824 - RNA, 23 nt, Human
cugcucuguugcugccaguugau

SEQ ID NO: 1307825 - RNA, 21 nt, Human
cugggacucuaaccugugcuu

SEQ ID NO: 1307826 - RNA, 19 nt, Human
cuggggacaggcagcuucc

SEQ ID NO: 1307827 - RNA, 24 nt, Human
cuucccaagggugggcguguucuc

SEQ ID NO: 1307828 - RNA, 22 nt, Human
cuuuccauguaaaauucauucu

SEQ ID NO: 1307829 - RNA, 21 nt, Human
gagcaggagugagcugccuuc

SEQ ID NO: 1307830 - RNA, 26 nt, Human
gagcaggagugagcugccuucuuugu

SEQ ID NO: 1307831 - RNA, 22 nt, Human
gcugcaccgaggaugugcggua

SEQ ID NO: 1307832 - RNA, 22 nt, Human
ggaagaacaggcaugcaccugg

SEQ ID NO: 1307833 - RNA, 20 nt, Human
uaccugcgccugcucuguug

SEQ ID NO: 1307834 - RNA, 26 nt, Human
uaggaaagaggccuguggaaauccug

SEQ ID NO: 1307835 - RNA, 23 nt, Human
uaguccagguggccgcugaccac

SEQ ID NO: 1307836 - RNA, 19 nt, Human
ucaccaugcucuguuagug

SEQ ID NO: 1307837 - RNA, 23 nt, Human
uccaaauuccccuuccuuccauu

SEQ ID NO: 1307838 - RNA, 25 nt, Human
uccaaauuccccuuccuuccauuuc

SEQ ID NO: 1307839 - RNA, 20 nt, Human
ucccaaugcuuggcuucucc

SEQ ID NO: 1307840 - RNA, 21 nt, Human
ucccggacaccaccuuccgga

SEQ ID NO: 1307841 - RNA, 30 nt, Human
ucccggacaccaccuuccggaaaggcuccu

SEQ ID NO: 1307842 - RNA, 21 nt, Human
uccucccggacaccaccuucc

SEQ ID NO: 1307843 - RNA, 22 nt, Human
ucucccuccacaggcgcaccca

SEQ ID NO: 1307844 - RNA, 18 nt, Human
ucuccuaagagcaggagu

SEQ ID NO: 1307845 - RNA, 25 nt, Human
ucuccuaagagcaggagugagcugc

SEQ ID NO: 1307846 - RNA, 21 nt, Human
ugaaugcaauucagcauguau

SEQ ID NO: 1307847 - RNA, 19 nt, Human
ugaggccaggggagagcug

SEQ ID NO: 1307848 - RNA, 21 nt, Human
ugcagcagcacgggcuguagg

SEQ ID NO: 1307849 - RNA, 21 nt, Human
ugcuuggcauaguccaggugg

SEQ ID NO: 1307850 - RNA, 19 nt, Human
ugcuugguugacucugcag

SEQ ID NO: 1307851 - RNA, 24 nt, Human
ugcuugguugacucugcaggucuc

SEQ ID NO: 1307852 - RNA, 18 nt, Human
uggaagaacaggcaugca

SEQ ID NO: 1307853 - RNA, 19 nt, Human
ugggaggaacccgagggua

SEQ ID NO: 1307854 - RNA, 20 nt, Human
uggugccugucagcuggugg

SEQ ID NO: 1307855 - RNA, 21 nt, Human
ugguggggcuccucuggggac

SEQ ID NO: 1307856 - RNA, 18 nt, Human
uggugugggagccucagg

SEQ ID NO: 1307857 - RNA, 18 nt, Human
uguaaaauucauucuugu

SEQ ID NO: 1307858 - RNA, 21 nt, Human
ugugacucaugucccuggagu

SEQ ID NO: 1307859 - RNA, 23 nt, Human
uuauugaggccaggggagagcug

SEQ ID NO: 1307860 - RNA, 20 nt, Human
uuauuuauugcuguuguuau

SEQ ID NO: 1307861 - RNA, 21 nt, Human
uucauucuuguccccaggccu

SEQ ID NO: 1307862 - RNA, 21 nt, Human
uuccauuuccuuucccuuuca

SEQ ID NO: 1307863 - RNA, 21 nt, Human
uuccccuuccuuccauuuccu

SEQ ID NO: 1307864 - RNA, 22 nt, Human
uuuauugcuguuguuauccccu

SEQ ID NO: 1307865 - RNA, 24 nt, Human
aaaaaagacaacaaaacuagaaag

SEQ ID NO: 1307866 - RNA, 23 nt, Human
aaaccaaauauggcagcagggaa

SEQ ID NO: 1307867 - RNA, 24 nt, Human
aaagacugagaaaaaaaaagacaa

SEQ ID NO: 1307868 - RNA, 22 nt, Human
aaagagaaaaggguccccaaga

SEQ ID NO: 1307869 - RNA, 24 nt, Human
aaccaaauauggcagcagggaaau

SEQ ID NO: 1307870 - RNA, 26 nt, Human
aacccucagaauggaggaaacaauuu

SEQ ID NO: 1307871 - RNA, 19 nt, Human
aagagaaaaggguccccaa

SEQ ID NO: 1307872 - RNA, 21 nt, Human
aagaugggagaguugagaagg

SEQ ID NO: 1307873 - RNA, 19 nt, Human
aagcaggucacuuguaagg

SEQ ID NO: 1307874 - RNA, 19 nt, Human
accugaugaagaaacccuc

SEQ ID NO: 1307875 - RNA, 21 nt, Human
acuagaaaggcacagaaacac

SEQ ID NO: 1307876 - RNA, 18 nt, Human
agaaaaaaaaagacaaca

SEQ ID NO: 1307877 - RNA, 24 nt, Human
agaaaaaaaaagacaacaaaacua

SEQ ID NO: 1307878 - RNA, 22 nt, Human
agacaacaaaacuagaaaggca

SEQ ID NO: 1307879 - RNA, 21 nt, Human
agacccacagguggagagggc

SEQ ID NO: 1307880 - RNA, 20 nt, Human
agagaaaaggguccccaaga

SEQ ID NO: 1307881 - RNA, 26 nt, Human
agaugaagggggucagcaugggggug

SEQ ID NO: 1307882 - RNA, 20 nt, Human
agcgggugacagauggcuac

SEQ ID NO: 1307883 - RNA, 24 nt, Human
aggaaacaauuuuagagaaagaga

SEQ ID NO: 1307884 - RNA, 23 nt, Human
caacaaaacuagaaaggcacaga

SEQ ID NO: 1307885 - RNA, 23 nt, Human
cagcaauauuuugcaguucugac

SEQ ID NO: 1307886 - RNA, 20 nt, Human
cagcaugggggugaccagug

SEQ ID NO: 1307887 - RNA, 19 nt, Human
caggcgagacccacaggug

SEQ ID NO: 1307888 - RNA, 20 nt, Human
ccaagaugggaagaaaacca

SEQ ID NO: 1307889 - RNA, 24 nt, Human
ccaagaugggaagaaaaccaaaua

SEQ ID NO: 1307890 - RNA, 24 nt, Human
cccaagaugggaagaaaaccaaau

SEQ ID NO: 1307891 - RNA, 30 nt, Human
cucagaauggaggaaacaauuuuagagaaa

SEQ ID NO: 1307892 - RNA, 20 nt, Human
gaaagagaaaagggucccca

SEQ ID NO: 1307893 - RNA, 18 nt, Human
gaugggagaguugagaag

SEQ ID NO: 1307894 - RNA, 21 nt, Human
gcuguagaugaagggggucag

SEQ ID NO: 1307895 - RNA, 24 nt, Human
gugcagcugggagucuaaaagacu

SEQ ID NO: 1307896 - RNA, 23 nt, Human
uaaaagacugagaaaaaaaaaga

SEQ ID NO: 1307897 - RNA, 20 nt, Human
uaaacucagcaaacaacuga

SEQ ID NO: 1307898 - RNA, 22 nt, Human
uagaugaagggggucagcaugg

SEQ ID NO: 1307899 - RNA, 21 nt, Human
uagcgggugacagauggcuac

SEQ ID NO: 1307900 - RNA, 20 nt, Human
ucagcaaacaacugacaggc

SEQ ID NO: 1307901 - RNA, 23 nt, Human
ucagcaaacaacugacaggcgag

SEQ ID NO: 1307902 - RNA, 24 nt, Human
ucuaaaagacugagaaaaaaaaag

SEQ ID NO: 1307903 - RNA, 20 nt, Human
ugaagggggucagcaugggg

SEQ ID NO: 1307904 - RNA, 22 nt, Human
ugaagggggucagcaugggggu

SEQ ID NO: 1307905 - RNA, 19 nt, Human
ugaauagaagcaauucaca

SEQ ID NO: 1307906 - RNA, 23 nt, Human
ugaauagaagcaauucacaagua

SEQ ID NO: 1307907 - RNA, 22 nt, Human
ugagaaaaaaaaagacaacaaa

SEQ ID NO: 1307908 - RNA, 23 nt, Human
ugggaagaaaaccaaauauggca

SEQ ID NO: 1307909 - RNA, 24 nt, Human
uuucucaggcuguagaugaagggg

SEQ ID NO: 1307910 - RNA, 20 nt, Human
aacaaggacuguuaaaaaug

SEQ ID NO: 1307911 - RNA, 18 nt, Human
aagagcauuggaaaagaa

SEQ ID NO: 1307912 - RNA, 21 nt, Human
caccguacaaucauuaagagc

SEQ ID NO: 1307913 - RNA, 20 nt, Human
gacuguuaaaaaugguagcu

SEQ ID NO: 1307914 - RNA, 19 nt, Human
gaggaauccuggcuucugg

SEQ ID NO: 1307915 - RNA, 18 nt, Human
uaacaaggacuguuaaaa

SEQ ID NO: 1307916 - RNA, 24 nt, Human
uaacaaggacuguuaaaaauggua

SEQ ID NO: 1307917 - RNA, 21 nt, Human
uaacugcagaguucagagagg

SEQ ID NO: 1307918 - RNA, 18 nt, Human
uaagugcaauuaagacug

SEQ ID NO: 1307919 - RNA, 20 nt, Human
ucuccacaucaucuuacaga

SEQ ID NO: 1307920 - RNA, 20 nt, Human
uggaaaagaaugaaauagca

SEQ ID NO: 1307921 - RNA, 20 nt, Human
uuaaaaaugguagcuuucuu

SEQ ID NO: 1307922 - RNA, 23 nt, Human
uuacagaguucuacuguaaccaa

SEQ ID NO: 1307923 - RNA, 24 nt, Human
uucuucuccuuuuccuuacucucc

SEQ ID NO: 1307924 - RNA, 20 nt, Human
uaacuuugaucuuucugagg

SEQ ID NO: 1307925 - RNA, 23 nt, Human
ccuuccagcuacagggcucauuu

SEQ ID NO: 1307926 - RNA, 19 nt, Human
uuguucuaauuugccuucc

SEQ ID NO: 1307927 - RNA, 23 nt, Human
uuugccuuccagcuacagggcuc

SEQ ID NO: 1307928 - RNA, 22 nt, Human
aagagcuggugaccgcggagac

SEQ ID NO: 1307929 - RNA, 18 nt, Human
aggacaggggaaggcggu

SEQ ID NO: 1307930 - RNA, 21 nt, Human
cagaaccgcacccugcucuuc

SEQ ID NO: 1307931 - RNA, 31 nt, Human
cuacgcgcacugucuccccaucuucacccuc

SEQ ID NO: 1307932 - RNA, 21 nt, Human
cugcucuucagugcaccagug

SEQ ID NO: 1307933 - RNA, 19 nt, Human
gaaggggaccucugcccuc

SEQ ID NO: 1307934 - RNA, 19 nt, Human
gcagcuggcagggaggggg

SEQ ID NO: 1307935 - RNA, 24 nt, Human
ggacaggggcuucaggacagggga

SEQ ID NO: 1307936 - RNA, 24 nt, Human
ggcggugggggcagcuggcaggga

SEQ ID NO: 1307937 - RNA, 27 nt, Human
ggcggugggggcagcuggcagggaggg

SEQ ID NO: 1307938 - RNA, 20 nt, Human
gggggcagcuggcagggagg

SEQ ID NO: 1307939 - RNA, 18 nt, Human
uaucccaagucacucggg

SEQ ID NO: 1307940 - RNA, 21 nt, Human
ucccuuguagaguucugugcc

SEQ ID NO: 1307941 - RNA, 22 nt, Human
ucuaucccaagucacucgggag

SEQ ID NO: 1307942 - RNA, 18 nt, Human
ugucuggggcggauggua

SEQ ID NO: 1307943 - RNA, 18 nt, Human
acaaaggugccugaguga

SEQ ID NO: 1307944 - RNA, 18 nt, Human
agccacuuugugaccaug

SEQ ID NO: 1307945 - RNA, 22 nt, Human
agggagcagcuugcacaaaggc

SEQ ID NO: 1307946 - RNA, 21 nt, Human
cuccuccuucuccccagagga

SEQ ID NO: 1307947 - RNA, 23 nt, Human
gaaucagccuucacagaagcuga

SEQ ID NO: 1307948 - RNA, 19 nt, Human
gguagagggagcagcuugc

SEQ ID NO: 1307949 - RNA, 21 nt, Human
uagaucuugaagacagcagca

SEQ ID NO: 1307950 - RNA, 25 nt, Human
uagaucuugaagacagcagcagcuu

SEQ ID NO: 1307951 - RNA, 19 nt, Human
ucagccuucacagaagcug

SEQ ID NO: 1307952 - RNA, 22 nt, Human
ucuccccagaggagacaaaggu

SEQ ID NO: 1307953 - RNA, 25 nt, Human
ugaagacagcagcagcuugacaaau

SEQ ID NO: 1307954 - RNA, 21 nt, Human
ugagcagcuccuccuucuccc

SEQ ID NO: 1307955 - RNA, 18 nt, Human
ugagugguggcagccacu

SEQ ID NO: 1307956 - RNA, 19 nt, Human
ugagugguggcagccacuu

SEQ ID NO: 1307957 - RNA, 20 nt, Human
ugagugguggcagccacuuu

SEQ ID NO: 1307958 - RNA, 24 nt, Human
ugaugagggugagcagcuccuccu

SEQ ID NO: 1307959 - RNA, 23 nt, Human
uucacagaagcugaugcuguaga

SEQ ID NO: 1307960 - RNA, 24 nt, Human
uuccagguagagggagcagcuugc

SEQ ID NO: 1307961 - RNA, 24 nt, Human
uugaagacagcagcagcuugacaa

SEQ ID NO: 1307962 - RNA, 18 nt, Human
agguagcuccgggcgggg

SEQ ID NO: 1307963 - RNA, 18 nt, Human
cagcagcugcaacagccg

SEQ ID NO: 1307964 - RNA, 25 nt, Human
cagcagcugcaacagccgcacgaag

SEQ ID NO: 1307965 - RNA, 26 nt, Human
cgcagcagcugcaacagccgcacgaa

SEQ ID NO: 1307966 - RNA, 24 nt, Human
aaaaaucuauaaagaacugaaaca

SEQ ID NO: 1307967 - RNA, 19 nt, Human
aaacaacaugauccacagc

SEQ ID NO: 1307968 - RNA, 21 nt, Human
aacaacaugauccacagccuu

SEQ ID NO: 1307969 - RNA, 22 nt, Human
aacuacugagugaaauuagacc

SEQ ID NO: 1307970 - RNA, 25 nt, Human
acagaugcaaaauucaguuuaaaaa

SEQ ID NO: 1307971 - RNA, 26 nt, Human
agaacugaaacaacaugauccacagc

SEQ ID NO: 1307972 - RNA, 23 nt, Human
agaguuuucucaaacaggucauu

SEQ ID NO: 1307973 - RNA, 21 nt, Human
agggguuucuccccuauauca

SEQ ID NO: 1307974 - RNA, 19 nt, Human
cacucagcuguacuuuggc

SEQ ID NO: 1307975 - RNA, 21 nt, Human
caugauccacagccuuguuuu

SEQ ID NO: 1307976 - RNA, 23 nt, Human
cauggugguagugagucaucuuc

SEQ ID NO: 1307977 - RNA, 21 nt, Human
cccuuguuuucccuugacucc

SEQ ID NO: 1307978 - RNA, 18 nt, Human
ccuaaacccaauauagga

SEQ ID NO: 1307979 - RNA, 24 nt, Human
cuucucauauucuaaggauuccau

SEQ ID NO: 1307980 - RNA, 18 nt, Human
gcccuuguuuucccuuga

SEQ ID NO: 1307981 - RNA, 18 nt, Human
uacugagugaaauuagac

SEQ ID NO: 1307982 - RNA, 19 nt, Human
uauuuuggcuuuaucuucc

SEQ ID NO: 1307983 - RNA, 21 nt, Human
ucugucuacaaggaguaacau

SEQ ID NO: 1307984 - RNA, 20 nt, Human
ugaaacaacaugauccacag

SEQ ID NO: 1307985 - RNA, 18 nt, Human
ugagagcaggugguaagc

SEQ ID NO: 1307986 - RNA, 23 nt, Human
ugagagcaggugguaagcuucua

SEQ ID NO: 1307987 - RNA, 19 nt, Human
uggacauggugguagugag

SEQ ID NO: 1307988 - RNA, 20 nt, Human
ugucaagggguuucuccccu

SEQ ID NO: 1307989 - RNA, 23 nt, Human
ugucuacaaggaguaacauuuaa

SEQ ID NO: 1307990 - RNA, 19 nt, Human
uuggagguuggacauggug

SEQ ID NO: 1307991 - RNA, 26 nt, Human
uugguucaacuuuccccuuuccauuu

SEQ ID NO: 1307992 - RNA, 18 nt, Human
uuuauucuucauguacac

SEQ ID NO: 1307993 - RNA, 20 nt, Human
aguagcuacacugacacuua

SEQ ID NO: 1307994 - RNA, 21 nt, Human
cauggcuaaauuaaaauucuc

SEQ ID NO: 1307995 - RNA, 22 nt, Human
cuacaguagcuacacugacacu

SEQ ID NO: 1307996 - RNA, 25 nt, Human
uaacaagucuuauuucuuuagaucu

SEQ ID NO: 1307997 - RNA, 21 nt, Human
uaaguccauaccaauaacaaa

SEQ ID NO: 1307998 - RNA, 24 nt, Human
uagaucucuccuucauaaaaucuu

SEQ ID NO: 1307999 - RNA, 21 nt, Human
uaucagaauuugcuugaaaaa

SEQ ID NO: 1308000 - RNA, 20 nt, Human
ugucucuagggacucuguuu

SEQ ID NO: 1308001 - RNA, 21 nt, Human
uuaauccaugacauccaaguu

SEQ ID NO: 1308002 - RNA, 21 nt, Human
uuucuuuagaucucuccuuca

SEQ ID NO: 1308003 - RNA, 28 nt, Human
uuuuuaauccaugacauccaaguucacc

SEQ ID NO: 1308004 - RNA, 21 nt, Human
ccgcugacccuggucuuccuc

SEQ ID NO: 1308005 - RNA, 22 nt, Human
cggaccgugccgccgcugaccc

SEQ ID NO: 1308006 - RNA, 20 nt, Human
gcggaacggaccgugccgcc

SEQ ID NO: 1308007 - RNA, 19 nt, Human
gcuggggucacaggagagg

SEQ ID NO: 1308008 - RNA, 24 nt, Human
aaacacagcuucaggaaagacugg

SEQ ID NO: 1308009 - RNA, 27 nt, Human
acacagcuucaggaaagagggaacgcc

SEQ ID NO: 1308010 - RNA, 19 nt, Human
aggcagguguucccuucca

SEQ ID NO: 1308011 - RNA, 20 nt, Human
caugaaaaguccagaggaaa

SEQ ID NO: 1308012 - RNA, 19 nt, Human
ccuccauuucuccaccaca

SEQ ID NO: 1308013 - RNA, 21 nt, Human
cucucucccuccauuucucca

SEQ ID NO: 1308014 - RNA, 20 nt, Human
gaaagcaauuuauuggcuca

SEQ ID NO: 1308015 - RNA, 20 nt, Human
ucaggaacuguugauuucuc

SEQ ID NO: 1308016 - RNA, 18 nt, Human
ucccuccauuucuccacc

SEQ ID NO: 1308017 - RNA, 19 nt, Human
uucaggaaagacuggaucc

SEQ ID NO: 1308018 - RNA, 24 nt, Human
aaugaucuccagguaccuuuacac

SEQ ID NO: 1308019 - RNA, 22 nt, Human
accccagccacccuugguccca

SEQ ID NO: 1308020 - RNA, 23 nt, Human
accccagccacccuuggucccaa

SEQ ID NO: 1308021 - RNA, 24 nt, Human
accccagccacccuuggucccagc

SEQ ID NO: 1308022 - RNA, 20 nt, Human
aucacauaagaaacacauau

SEQ ID NO: 1308023 - RNA, 21 nt, Human
aucugugaggacagucccccc

SEQ ID NO: 1308024 - RNA, 18 nt, Human
cacauaagaaacacauau

SEQ ID NO: 1308025 - RNA, 23 nt, Human
caccccagccacccuugguccca

SEQ ID NO: 1308026 - RNA, 26 nt, Human
cacugcaaacagccggcggcuccuca

SEQ ID NO: 1308027 - RNA, 20 nt, Human
caucagcaaagggaagcccc

SEQ ID NO: 1308028 - RNA, 18 nt, Human
cauccggguuccaucagc

SEQ ID NO: 1308029 - RNA, 21 nt, Human
ccaccugugcacucccugagc

SEQ ID NO: 1308030 - RNA, 26 nt, Human
ccagcacacgcccgggcgcgcagcca

SEQ ID NO: 1308031 - RNA, 20 nt, Human
ccagccacccuuggucccag

SEQ ID NO: 1308032 - RNA, 26 nt, Human
cccagccacccuuggucccagcugcc

SEQ ID NO: 1308033 - RNA, 22 nt, Human
cccugcuagggcuaggccacag

SEQ ID NO: 1308034 - RNA, 18 nt, Human
cccuuggucccagcugcc

SEQ ID NO: 1308035 - RNA, 19 nt, Human
ccucccgccuacccugcua

SEQ ID NO: 1308036 - RNA, 22 nt, Human
ccuccgcgucgcuggcgggagc

SEQ ID NO: 1308037 - RNA, 23 nt, Human
cggaggggccucagcccauggug

SEQ ID NO: 1308038 - RNA, 18 nt, Human
gcccaugguggugggggg

SEQ ID NO: 1308039 - RNA, 19 nt, Human
gcccgggcgcgcagccagg

SEQ ID NO: 1308040 - RNA, 18 nt, Human
gcuccuuccccuccuccc

SEQ ID NO: 1308041 - RNA, 19 nt, Human
ggagcccgggcugguggcc

SEQ ID NO: 1308042 - RNA, 25 nt, Human
ggagcuccuuccccuccucccgccu

SEQ ID NO: 1308043 - RNA, 23 nt, Human
ggccucagcccaugguggugggg

SEQ ID NO: 1308044 - RNA, 19 nt, Human
ggccuugaggcagagcugg

SEQ ID NO: 1308045 - RNA, 23 nt, Human
uaggccacagauacacagggcga

SEQ ID NO: 1308046 - RNA, 19 nt, Human
ucacaaggugaggagcccg

SEQ ID NO: 1308047 - RNA, 23 nt, Human
ucacaaggugaggagcccgggcu

SEQ ID NO: 1308048 - RNA, 22 nt, Human
uccccccagccccugugccucc

SEQ ID NO: 1308049 - RNA, 24 nt, Human
ucccugagcggaaaugccugacuc

SEQ ID NO: 1308050 - RNA, 21 nt, Human
ucugugaggacagucccccca

SEQ ID NO: 1308051 - RNA, 21 nt, Human
ugaacgcagaguccaugggcc

SEQ ID NO: 1308052 - RNA, 23 nt, Human
ugaaugacaaugaucuccaggua

SEQ ID NO: 1308053 - RNA, 21 nt, Human
ugaggcagagcuggaagcugc

SEQ ID NO: 1308054 - RNA, 21 nt, Human
ugcugggucgaggggaaucag

SEQ ID NO: 1308055 - RNA, 25 nt, Human
uggaagcugcuacgcggaggggccu

SEQ ID NO: 1308056 - RNA, 19 nt, Human
uggagagaugggcacagag

SEQ ID NO: 1308057 - RNA, 20 nt, Human
uggcccuggagagaugggca

SEQ ID NO: 1308058 - RNA, 24 nt, Human
ugguggugggggggcaccccagcc

SEQ ID NO: 1308059 - RNA, 23 nt, Human
uugaggcagagcuggaagcugcu

SEQ ID NO: 1308060 - RNA, 21 nt, Human
uuuaaaauacaccuuuuuaca

SEQ ID NO: 1308061 - RNA, 18 nt, Human
aacacagcagagcaggag

SEQ ID NO: 1308062 - RNA, 24 nt, Human
aacccuccccagagcugggagcca

SEQ ID NO: 1308063 - RNA, 23 nt, Human
aagaaggagauagagggggaagg

SEQ ID NO: 1308064 - RNA, 24 nt, Human
aagaaggagauagagggggaagga

SEQ ID NO: 1308065 - RNA, 24 nt, Human
aagaugauaccucugcauuuucug

SEQ ID NO: 1308066 - RNA, 26 nt, Human
acccuccccagagcugggagccauug

SEQ ID NO: 1308067 - RNA, 20 nt, Human
agaaagaaacacaucucaaa

SEQ ID NO: 1308068 - RNA, 20 nt, Human
agagggggaaggaggaaaca

SEQ ID NO: 1308069 - RNA, 20 nt, Human
agcugggaaacuccaacuuu

SEQ ID NO: 1308070 - RNA, 21 nt, Human
aggcagaaagaaacacaucuc

SEQ ID NO: 1308071 - RNA, 18 nt, Human
agggggaaggaggaaaca

SEQ ID NO: 1308072 - RNA, 20 nt, Human
agggggaaggaggaaacagc

SEQ ID NO: 1308073 - RNA, 22 nt, Human
agguccuuagaacacagcagag

SEQ ID NO: 1308074 - RNA, 22 nt, Human
auccgcaaacgggcauuuccuu

SEQ ID NO: 1308075 - RNA, 21 nt, Human
auuugcucacugccaggaugg

SEQ ID NO: 1308076 - RNA, 23 nt, Human
caaugucaaaguaaaugcacuuc

SEQ ID NO: 1308077 - RNA, 22 nt, Human
cagaaagaaacacaucucaaag

SEQ ID NO: 1308078 - RNA, 19 nt, Human
cagccccacaggccugcug

SEQ ID NO: 1308079 - RNA, 21 nt, Human
caggaaccaacggccagcucc

SEQ ID NO: 1308080 - RNA, 18 nt, Human
ccaaaaguaguuacaagc

SEQ ID NO: 1308081 - RNA, 19 nt, Human
ccaagaaagaugauaccuc

SEQ ID NO: 1308082 - RNA, 21 nt, Human
cccacaggccugcugcggcca

SEQ ID NO: 1308083 - RNA, 19 nt, Human
cguggcucaaacccucccc

SEQ ID NO: 1308084 - RNA, 21 nt, Human
cuccccagcguuuucuuuuuc

SEQ ID NO: 1308085 - RNA, 18 nt, Human
cuguggcuggaauggagg

SEQ ID NO: 1308086 - RNA, 21 nt, Human
cuucugcugaagccaguacaa

SEQ ID NO: 1308087 - RNA, 18 nt, Human
gaaaagguguaauacccu

SEQ ID NO: 1308088 - RNA, 20 nt, Human
gaacugcgugugggauuugc

SEQ ID NO: 1308089 - RNA, 21 nt, Human
gacagaagggaaagaaggaga

SEQ ID NO: 1308090 - RNA, 20 nt, Human
ggaauggaggcagaaagaaa

SEQ ID NO: 1308091 - RNA, 21 nt, Human
ggauuugcucacugccaggau

SEQ ID NO: 1308092 - RNA, 18 nt, Human
gggaaggaggaaacagcg

SEQ ID NO: 1308093 - RNA, 18 nt, Human
uacaagccugguuaucug

SEQ ID NO: 1308094 - RNA, 23 nt, Human
uagaacacagcagagcaggagca

SEQ ID NO: 1308095 - RNA, 24 nt, Human
uaguuacaagcuauaucaauguca

SEQ ID NO: 1308096 - RNA, 21 nt, Human
ucaaaguaaaugcacuucauc

SEQ ID NO: 1308097 - RNA, 22 nt, Human
ucagagcuuggagcggcccccg

SEQ ID NO: 1308098 - RNA, 21 nt, Human
uccccagccccacaggccugc

SEQ ID NO: 1308099 - RNA, 23 nt, Human
ucuuuugauguaaagauggaagu

SEQ ID NO: 1308100 - RNA, 20 nt, Human
ugagaucaaaguguuagggg

SEQ ID NO: 1308101 - RNA, 19 nt, Human
ugcauuuucugguggaaaa

SEQ ID NO: 1308102 - RNA, 18 nt, Human
uggcgcuguccccagccc

SEQ ID NO: 1308103 - RNA, 21 nt, Human
ugggauuugcucacugccagg

SEQ ID NO: 1308104 - RNA, 22 nt, Human
uguuaaaaugggacgcuuucaa

SEQ ID NO: 1308105 - RNA, 23 nt, Human
uuucccgagaagagcuccagcuc

SEQ ID NO: 1308106 - RNA, 23 nt, Human
agcuguaucccaggcuuuugggu

SEQ ID NO: 1308107 - RNA, 24 nt, Human
cuuuugaaaccagcuguaucccag

SEQ ID NO: 1308108 - RNA, 22 nt, Human
uugaaaccagcuguaucccagg

SEQ ID NO: 1308109 - RNA, 25 nt, Human
aaacccuuuccucccaacccugagg

SEQ ID NO: 1308110 - RNA, 21 nt, Human
aacccuuuccucccaacccug

SEQ ID NO: 1308111 - RNA, 20 nt, Human
aggcaaacaggcuuucgaag

SEQ ID NO: 1308112 - RNA, 19 nt, Human
agggguaggugagggucgc

SEQ ID NO: 1308113 - RNA, 21 nt, Human
aguggcacagucaucccaggg

SEQ ID NO: 1308114 - RNA, 22 nt, Human
aguggcacagucaucccaggga

SEQ ID NO: 1308115 - RNA, 23 nt, Human
aguugcugggcggcgguggagau

SEQ ID NO: 1308116 - RNA, 22 nt, Human
cagagauuccuuuucucggccc

SEQ ID NO: 1308117 - RNA, 21 nt, Human
cagucaucccagggacccaga

SEQ ID NO: 1308118 - RNA, 21 nt, Human
cccaacccugaggcaaacagg

SEQ ID NO: 1308119 - RNA, 27 nt, Human
ccuugguacuuuccaaacccuuuccuc

SEQ ID NO: 1308120 - RNA, 21 nt, Human
cggcccgaacccgcugugcgg

SEQ ID NO: 1308121 - RNA, 23 nt, Human
cuaguaaaguccaagaaucaaaa

SEQ ID NO: 1308122 - RNA, 20 nt, Human
cugaggcaaacaggcuuucg

SEQ ID NO: 1308123 - RNA, 24 nt, Human
gaggagccagcgggccgcaagcaa

SEQ ID NO: 1308124 - RNA, 19 nt, Human
gcccagcugcgccugugcc

SEQ ID NO: 1308125 - RNA, 20 nt, Human
gccugugccuugggcucucc

SEQ ID NO: 1308126 - RNA, 24 nt, Human
gggcggcgguggagauagcggcgg

SEQ ID NO: 1308127 - RNA, 27 nt, Human
gggcggcgguggagauagcggcgguga

SEQ ID NO: 1308128 - RNA, 22 nt, Human
uccaaacccuuuccucccaacc

SEQ ID NO: 1308129 - RNA, 21 nt, Human
uccucagaugcgucuuuggag

SEQ ID NO: 1308130 - RNA, 22 nt, Human
ucuccugacacggcccauccgg

SEQ ID NO: 1308131 - RNA, 26 nt, Human
ugaggcaaacaggcuuucgaagaccc

SEQ ID NO: 1308132 - RNA, 23 nt, Human
ugccugagcuucugagugagccu

SEQ ID NO: 1308133 - RNA, 23 nt, Human
uuccaaacccuuuccucccaacc

SEQ ID NO: 1308134 - RNA, 21 nt, Human
aaccuggggcagccagggggc

SEQ ID NO: 1308135 - RNA, 25 nt, Human
acagucaggccccugaccucacacc

SEQ ID NO: 1308136 - RNA, 25 nt, Human
agccagccuccagcugccauaccug

SEQ ID NO: 1308137 - RNA, 23 nt, Human
caaccuggggcagccagggggcu

SEQ ID NO: 1308138 - RNA, 20 nt, Human
cacagucaggccccugaccu

SEQ ID NO: 1308139 - RNA, 26 nt, Human
cacagucaggccccugaccucacacc

SEQ ID NO: 1308140 - RNA, 18 nt, Human
cagcugccauaccugcug

SEQ ID NO: 1308141 - RNA, 21 nt, Human
caggccccugaccucacaccg

SEQ ID NO: 1308142 - RNA, 22 nt, Human
cagucaggccccugaccucaca

SEQ ID NO: 1308143 - RNA, 20 nt, Human
cauccagccagccuccagcu

SEQ ID NO: 1308144 - RNA, 18 nt, Human
ccaaugaggucaguuccc

SEQ ID NO: 1308145 - RNA, 22 nt, Human
ccagagacugguagaugaccac

SEQ ID NO: 1308146 - RNA, 27 nt, Human
cccucuccacuuauacuccucuccuca

SEQ ID NO: 1308147 - RNA, 24 nt, Human
cuccagcugccauaccugcugccc

SEQ ID NO: 1308148 - RNA, 19 nt, Human
cucuccacuuauacuccuc

SEQ ID NO: 1308149 - RNA, 18 nt, Human
gucacaaccuggggcagc

SEQ ID NO: 1308150 - RNA, 18 nt, Human
uccagccagccuccagcu

SEQ ID NO: 1308151 - RNA, 22 nt, Human
ucuccaggauuccacucagucc

SEQ ID NO: 1308152 - RNA, 22 nt, Human
ucuuuccaggagaccaggcugg

SEQ ID NO: 1308153 - RNA, 19 nt, Human
ugguagaugaccacuuuau

SEQ ID NO: 1308154 - RNA, 23 nt, Human
uuauacuccucuccucacaaauc

SEQ ID NO: 1308155 - RNA, 20 nt, Human
aagaaacuuacacauacccc

SEQ ID NO: 1308156 - RNA, 19 nt, Human
aagaaagacaggaacauaa

SEQ ID NO: 1308157 - RNA, 23 nt, Human
aagcaacacgguguacuaugaug

SEQ ID NO: 1308158 - RNA, 20 nt, Human
aauaaagcucuuuuaccuuu

SEQ ID NO: 1308159 - RNA, 19 nt, Human
aauuguguguggaucucaa

SEQ ID NO: 1308160 - RNA, 24 nt, Human
acagccuaugcaccuucccuuccu

SEQ ID NO: 1308161 - RNA, 21 nt, Human
acuaacaucaagaaagacagg

SEQ ID NO: 1308162 - RNA, 19 nt, Human
agaaacuuacacauacccc

SEQ ID NO: 1308163 - RNA, 19 nt, Human
agaaacuuacacauacccc

SEQ ID NO: 1308164 - RNA, 19 nt, Human
agaaggaagaggacaaugg

SEQ ID NO: 1308165 - RNA, 21 nt, Human
agaaggaagaggacaauggag

SEQ ID NO: 1308166 - RNA, 26 nt, Human
agagcagaaaaugucuugcuugcauu

SEQ ID NO: 1308167 - RNA, 22 nt, Human
agaggacaauggaguaccuaca

SEQ ID NO: 1308168 - RNA, 22 nt, Human
agauaagaggcaaaacugagag

SEQ ID NO: 1308169 - RNA, 20 nt, Human
agcugacugcauuaaucuca

SEQ ID NO: 1308170 - RNA, 20 nt, Human
auuguguguggaucucaaaa

SEQ ID NO: 1308171 - RNA, 21 nt, Human
caaauaccuuugguauauucu

SEQ ID NO: 1308172 - RNA, 19 nt, Human
cacucuguuauuaacaacc

SEQ ID NO: 1308173 - RNA, 24 nt, Human
cacucuguuauuaacaaccucacu

SEQ ID NO: 1308174 - RNA, 21 nt, Human
cagaaggaagaggacaaugga

SEQ ID NO: 1308175 - RNA, 23 nt, Human
caggguacacuaccccagcacuu

SEQ ID NO: 1308176 - RNA, 27 nt, Human
cauagaaucaaaagaggauuccaauaa

SEQ ID NO: 1308177 - RNA, 24 nt, Human
caucaagaaagacaggaacauaau

SEQ ID NO: 1308178 - RNA, 23 nt, Human
caucacucuguuauuaacaaccu

SEQ ID NO: 1308179 - RNA, 25 nt, Human
ccccagcacuucugggggcugugcc

SEQ ID NO: 1308180 - RNA, 22 nt, Human
cuaaccaacacauagaaucaaa

SEQ ID NO: 1308181 - RNA, 24 nt, Human
cuaaccaacacauagaaucaaaag

SEQ ID NO: 1308182 - RNA, 24 nt, Human
cucaugugaaagauaagaggcaaa

SEQ ID NO: 1308183 - RNA, 18 nt, Human
cugcauuaaucucaccgu

SEQ ID NO: 1308184 - RNA, 24 nt, Human
cugccccagaaggaagaggacaau

SEQ ID NO: 1308185 - RNA, 23 nt, Human
cuguuaacaucagagcagaaaau

SEQ ID NO: 1308186 - RNA, 22 nt, Human
cuuaaagaacugcuguaguccu

SEQ ID NO: 1308187 - RNA, 23 nt, Human
gaaaagaauuuuuuuaaagugaa

SEQ ID NO: 1308188 - RNA, 22 nt, Human
gaagauacacaugcuauaccuc

SEQ ID NO: 1308189 - RNA, 24 nt, Human
gaguuuuccucaggguacacuacc

SEQ ID NO: 1308190 - RNA, 21 nt, Human
uaacuuuuuacuagucacacu

SEQ ID NO: 1308191 - RNA, 21 nt, Human
uaagagaagcauaaauuuaug

SEQ ID NO: 1308192 - RNA, 21 nt, Human
uaccccagcacuucugggggc

SEQ ID NO: 1308193 - RNA, 24 nt, Human
uaccucauuguagaauuuuucacu

SEQ ID NO: 1308194 - RNA, 22 nt, Human
ucaguauagacagcuuuucuca

SEQ ID NO: 1308195 - RNA, 23 nt, Human
uccucaugugaaagauaagaggc

SEQ ID NO: 1308196 - RNA, 23 nt, Human
ucucugugaguuuuccucagggu

SEQ ID NO: 1308197 - RNA, 23 nt, Human
ugaaagauaagaggcaaaacuga

SEQ ID NO: 1308198 - RNA, 20 nt, Human
ugagagggcuaguaucccuu

SEQ ID NO: 1308199 - RNA, 22 nt, Human
ugccccagaaggaagaggacaa

SEQ ID NO: 1308200 - RNA, 21 nt, Human
ugguucacagcuaagcaacac

SEQ ID NO: 1308201 - RNA, 18 nt, Human
uuaaaaauugcaucacuc

SEQ ID NO: 1308202 - RNA, 21 nt, Human
uuauaaugugucucccagucu

SEQ ID NO: 1308203 - RNA, 21 nt, Human
uucugggggcugugccgucug

SEQ ID NO: 1308204 - RNA, 20 nt, Human
uugcuaucugcuaaccaaca

SEQ ID NO: 1308205 - RNA, 18 nt, Human
uugguccuugaauugugu

SEQ ID NO: 1308206 - RNA, 26 nt, Human
uuuuucagagucauccuucggaaauc

SEQ ID NO: 1308207 - RNA, 24 nt, Human
ucuugagcaacugucgugggcccc

SEQ ID NO: 1308208 - RNA, 21 nt, Human
uggcauguugugcucagcucc

SEQ ID NO: 1308209 - RNA, 22 nt, Human
cucugaagggcaaugggaaggg

SEQ ID NO: 1308210 - RNA, 19 nt, Human
gcuggggcagggaggcuuc

SEQ ID NO: 1308211 - RNA, 19 nt, Human
ugggaagggugcuggggca

SEQ ID NO: 1308212 - RNA, 24 nt, Human
accgcagccaccucagccggccca

SEQ ID NO: 1308213 - RNA, 19 nt, Human
agccuuguccuaagggagc

SEQ ID NO: 1308214 - RNA, 23 nt, Human
aggcacuuuucaugcuguugaca

SEQ ID NO: 1308215 - RNA, 18 nt, Human
agguuuggcaaacaagcu

SEQ ID NO: 1308216 - RNA, 18 nt, Human
caccgcccaaagcaaggu

SEQ ID NO: 1308217 - RNA, 22 nt, Human
caccuguggaugucuuagaggc

SEQ ID NO: 1308218 - RNA, 22 nt, Human
caggagccucauuuacucccau

SEQ ID NO: 1308219 - RNA, 23 nt, Human
ccgcccaaagcaagguuuggcaa

SEQ ID NO: 1308220 - RNA, 23 nt, Human
cgcccaaagcaagguuuggcaaa

SEQ ID NO: 1308221 - RNA, 24 nt, Human
cuccacagucaccacacgcugauc

SEQ ID NO: 1308222 - RNA, 23 nt, Human
cuucucuagaguuucuggauuuc

SEQ ID NO: 1308223 - RNA, 20 nt, Human
gaggaaccuggggcucagga

SEQ ID NO: 1308224 - RNA, 18 nt, Human
gggcucaggaugggcgcc

SEQ ID NO: 1308225 - RNA, 21 nt, Human
gggggaggucagcguggggaa

SEQ ID NO: 1308226 - RNA, 21 nt, Human
gugaggaaccuggggcucagg

SEQ ID NO: 1308227 - RNA, 25 nt, Human
uaccgcagccaccucagccggccca

SEQ ID NO: 1308228 - RNA, 21 nt, Human
uccacagucaccacacgcuga

SEQ ID NO: 1308229 - RNA, 19 nt, Human
uccaccgcccaaagcaagg

SEQ ID NO: 1308230 - RNA, 20 nt, Human
uccaccgcccaaagcaaggu

SEQ ID NO: 1308231 - RNA, 19 nt, Human
uccagggcuggugcuggcg

SEQ ID NO: 1308232 - RNA, 23 nt, Human
uccagggcuggugcuggcgagcc

SEQ ID NO: 1308233 - RNA, 23 nt, Human
ucuaugggggaggucagcguggg

SEQ ID NO: 1308234 - RNA, 20 nt, Human
ugacaugugaggaaccuggg

SEQ ID NO: 1308235 - RNA, 22 nt, Human
ugacaugugaggaaccuggggc

SEQ ID NO: 1308236 - RNA, 19 nt, Human
ugaggaaccuggggcucag

SEQ ID NO: 1308237 - RNA, 20 nt, Human
ugaggaaccuggggcucagg

SEQ ID NO: 1308238 - RNA, 18 nt, Human
ugccagcaugagaucgca

SEQ ID NO: 1308239 - RNA, 20 nt, Human
ugcucugagggacagagccu

SEQ ID NO: 1308240 - RNA, 20 nt, Human
ugcuggcgagccccggccgc

SEQ ID NO: 1308241 - RNA, 22 nt, Human
ugcuggcgagccccggccgcgc

SEQ ID NO: 1308242 - RNA, 21 nt, Human
uggauuucccaggagccucau

SEQ ID NO: 1308243 - RNA, 23 nt, Human
ugggacaugauauucugucucca

SEQ ID NO: 1308244 - RNA, 21 nt, Human
uggugcuggcgagccccggcc

SEQ ID NO: 1308245 - RNA, 18 nt, Human
ugugaggaaccuggggcu

SEQ ID NO: 1308246 - RNA, 20 nt, Human
ugugcuguguguaaaugccu

SEQ ID NO: 1308247 - RNA, 26 nt, Human
uugacaugugaggaaccuggggcuca

SEQ ID NO: 1308248 - RNA, 23 nt, Human
uuuaacacugcacaccuguggau

SEQ ID NO: 1308249 - RNA, 23 nt, Human
aagcacccccaaccuggggcagg

SEQ ID NO: 1308250 - RNA, 20 nt, Human
agcgucucuccaaagcaccc

SEQ ID NO: 1308251 - RNA, 23 nt, Human
aggugccuuucgggucugcuggc

SEQ ID NO: 1308252 - RNA, 21 nt, Human
caccccuuuaucccgcugcag

SEQ ID NO: 1308253 - RNA, 23 nt, Human
caccuucagaccugaguuggguc

SEQ ID NO: 1308254 - RNA, 18 nt, Human
ccuccaggugccuuucgg

SEQ ID NO: 1308255 - RNA, 19 nt, Human
ccuccaggugcuccaucgu

SEQ ID NO: 1308256 - RNA, 18 nt, Human
ccuggcccgagaaggggg

SEQ ID NO: 1308257 - RNA, 18 nt, Human
cggagauagggguggcag

SEQ ID NO: 1308258 - RNA, 27 nt, Human
cuuucgggucugcuggccuccaggugc

SEQ ID NO: 1308259 - RNA, 18 nt, Human
gagauagggguggcagcu

SEQ ID NO: 1308260 - RNA, 20 nt, Human
guaggugggagggacuuccu

SEQ ID NO: 1308261 - RNA, 21 nt, Human
uccaaagcacccccaaccugg

SEQ ID NO: 1308262 - RNA, 24 nt, Human
uccaaagcacccccaaccuggggc

SEQ ID NO: 1308263 - RNA, 19 nt, Human
ucccacaccccuuuauccc

SEQ ID NO: 1308264 - RNA, 18 nt, Human
uggggcaggugucucagg

SEQ ID NO: 1308265 - RNA, 20 nt, Human
uggggcaggugucucaggcc

SEQ ID NO: 1308266 - RNA, 23 nt, Human
ugucucaggccucuccaucggag

SEQ ID NO: 1308267 - RNA, 28 nt, Human
aaaaauaacauucuugcccguaaccucc

SEQ ID NO: 1308268 - RNA, 22 nt, Human
ccuccuauagacaccagaaaaa

SEQ ID NO: 1308269 - RNA, 24 nt, Human
ccuccuauagacaccagaaaaagu

SEQ ID NO: 1308270 - RNA, 21 nt, Human
ugggagaacuugccgagcgcc

SEQ ID NO: 1308271 - RNA, 20 nt, Human
uucaaaaauaacauucuugc

SEQ ID NO: 1308272 - RNA, 25 nt, Human
aaaacaaagaaacaaaaaaacaaaa

SEQ ID NO: 1308273 - RNA, 23 nt, Human
aaaacaccaaaacuucuagaaga

SEQ ID NO: 1308274 - RNA, 22 nt, Human
aaaagcacacuuucccuccccc

SEQ ID NO: 1308275 - RNA, 24 nt, Human
aaacaaaaaaacaaaacaccaaaa

SEQ ID NO: 1308276 - RNA, 22 nt, Human
aaacaccaaaacuucuagaaga

SEQ ID NO: 1308277 - RNA, 23 nt, Human
aaacagaagaaacccuugugauc

SEQ ID NO: 1308278 - RNA, 22 nt, Human
aaacuccucaugauacuacacu

SEQ ID NO: 1308279 - RNA, 24 nt, Human
aaagugcugggauuacagguguga

SEQ ID NO: 1308280 - RNA, 23 nt, Human
aacaaagaaacaaaaaaacaaaa

SEQ ID NO: 1308281 - RNA, 18 nt, Human
aagaaacaaaaaaacaaa

SEQ ID NO: 1308282 - RNA, 22 nt, Human
aagaacaaauugauagacugga

SEQ ID NO: 1308283 - RNA, 21 nt, Human
aagaugcuccacaucacuagu

SEQ ID NO: 1308284 - RNA, 21 nt, Human
aagugauucuccugccucagc

SEQ ID NO: 1308285 - RNA, 18 nt, Human
aagugcugggauuacagg

SEQ ID NO: 1308286 - RNA, 19 nt, Human
aagugcugggauuacaggu

SEQ ID NO: 1308287 - RNA, 26 nt, Human
aagugcugggauuacaggugugagcc

SEQ ID NO: 1308288 - RNA, 24 nt, Human
aaucgcuugaaccugggaggugga

SEQ ID NO: 1308289 - RNA, 20 nt, Human
aaugacacaaauacucaacu

SEQ ID NO: 1308290 - RNA, 21 nt, Human
accaaaaaugcaauccauaaa

SEQ ID NO: 1308291 - RNA, 24 nt, Human
accuugugaucugccugucuuggc

SEQ ID NO: 1308292 - RNA, 20 nt, Human
acgggguuucaucauguugg

SEQ ID NO: 1308293 - RNA, 22 nt, Human
acgggguuucaucauguugguc

SEQ ID NO: 1308294 - RNA, 23 nt, Human
acgggguuucaucauguuggucu

SEQ ID NO: 1308295 - RNA, 24 nt, Human
acgggguuucaucauguuggucug

SEQ ID NO: 1308296 - RNA, 25 nt, Human
acgggguuucaucauguuggucugg

SEQ ID NO: 1308297 - RNA, 25 nt, Human
acuccagccugggcaacgagaguga

SEQ ID NO: 1308298 - RNA, 25 nt, Human
acucuguugccuaggcuggagugca

SEQ ID NO: 1308299 - RNA, 24 nt, Human
acuuucccucccccaucaagagac

SEQ ID NO: 1308300 - RNA, 22 nt, Human
agaaucgcuugaaccugggagg

SEQ ID NO: 1308301 - RNA, 22 nt, Human
agacauuucacccaagaaaaua

SEQ ID NO: 1308302 - RNA, 23 nt, Human
agacgggguuucaucauguuggu

SEQ ID NO: 1308303 - RNA, 23 nt, Human
agaggugauucuaauauuucuuu

SEQ ID NO: 1308304 - RNA, 18 nt, Human
agagugaaacucugucuc

SEQ ID NO: 1308305 - RNA, 21 nt, Human
aggaggcuagugaaagcuaug

SEQ ID NO: 1308306 - RNA, 19 nt, Human
aggaggcugaggcaagaga

SEQ ID NO: 1308307 - RNA, 22 nt, Human
aggcaagagaaucgcuugaacc

SEQ ID NO: 1308308 - RNA, 24 nt, Human
aggcaagagaaucgcuugaaccug

SEQ ID NO: 1308309 - RNA, 24 nt, Human
aggcugaggcaagagaaucgcuug

SEQ ID NO: 1308310 - RNA, 25 nt, Human
aggcuggagugcaguggcacaaucu

SEQ ID NO: 1308311 - RNA, 20 nt, Human
agguggaggaugcggugagc

SEQ ID NO: 1308312 - RNA, 22 nt, Human
aguacagacgggguuucaucau

SEQ ID NO: 1308313 - RNA, 24 nt, Human
agugauucuccugccucagccucc

SEQ ID NO: 1308314 - RNA, 20 nt, Human
agugcaguggcacaaucucg

SEQ ID NO: 1308315 - RNA, 24 nt, Human
agugcaguggcacaaucucggcuc

SEQ ID NO: 1308316 - RNA, 21 nt, Human
auaggcacccgccaccaugcc

SEQ ID NO: 1308317 - RNA, 24 nt, Human
aucaaucuauucccaucauugaau

SEQ ID NO: 1308318 - RNA, 24 nt, Human
aucgcgccauugcacuccagccug

SEQ ID NO: 1308319 - RNA, 24 nt, Human
aucucacuuuucuagagaauccaa

SEQ ID NO: 1308320 - RNA, 23 nt, Human
auugcacuccagccugggcaacg

SEQ ID NO: 1308321 - RNA, 24 nt, Human
auugcacuccagccugggcaacga

SEQ ID NO: 1308322 - RNA, 20 nt, Human
auuugaucagacauuucacc

SEQ ID NO: 1308323 - RNA, 24 nt, Human
caaaaaaacaaagaaacaaaaaaa

SEQ ID NO: 1308324 - RNA, 27 nt, Human
caaaaaaacaaagaaacaaaaaaacaa

SEQ ID NO: 1308325 - RNA, 23 nt, Human
caaaacaccaaaacuucuagaag

SEQ ID NO: 1308326 - RNA, 24 nt, Human
caaaacaccaaaacuucuagaaga

SEQ ID NO: 1308327 - RNA, 20 nt, Human
caaaacuucuagaagaaaac

SEQ ID NO: 1308328 - RNA, 23 nt, Human
caaaagcacacuuucccuccccc

SEQ ID NO: 1308329 - RNA, 24 nt, Human
caaagaacuaaguuucagccagua

SEQ ID NO: 1308330 - RNA, 20 nt, Human
caaagugcugggauuacagg

SEQ ID NO: 1308331 - RNA, 23 nt, Human
caaagugcugggauuacaggugu

SEQ ID NO: 1308332 - RNA, 24 nt, Human
caaagugcugggauuacaggugug

SEQ ID NO: 1308333 - RNA, 26 nt, Human
caacagauuugaucagacauuucacc

SEQ ID NO: 1308334 - RNA, 18 nt, Human
caaccccauuuaggaggc

SEQ ID NO: 1308335 - RNA, 23 nt, Human
caacgagagugaaacucugucuc

SEQ ID NO: 1308336 - RNA, 24 nt, Human
caacuuuucaacucuaaaguacug

SEQ ID NO: 1308337 - RNA, 21 nt, Human
caaucaaucuauucccaucau

SEQ ID NO: 1308338 - RNA, 22 nt, Human
cacaaaagggcuccauccaagu

SEQ ID NO: 1308339 - RNA, 19 nt, Human
cacaugauagaauccaccu

SEQ ID NO: 1308340 - RNA, 23 nt, Human
caccaaaaaugcaauccauaaaa

SEQ ID NO: 1308341 - RNA, 22 nt, Human
caccaaaacuucuagaagaaaa

SEQ ID NO: 1308342 - RNA, 24 nt, Human
caccaugccuggcuaauuuuugua

SEQ ID NO: 1308343 - RNA, 23 nt, Human
cacuccagccugggcaacgagag

SEQ ID NO: 1308344 - RNA, 24 nt, Human
cacuccagccugggcaacgagagu

SEQ ID NO: 1308345 - RNA, 25 nt, Human
cacuccagccugggcaacgagagug

SEQ ID NO: 1308346 - RNA, 24 nt, Human
cacucuguugccuaggcuggagug

SEQ ID NO: 1308347 - RNA, 21 nt, Human
cacugcaaccuccgccuccca

SEQ ID NO: 1308348 - RNA, 23 nt, Human
cacuuucccucccccaucaagag

SEQ ID NO: 1308349 - RNA, 23 nt, Human
cagacauuucacccaagaaaaua

SEQ ID NO: 1308350 - RNA, 19 nt, Human
cagccucccgaguagcgga

SEQ ID NO: 1308351 - RNA, 22 nt, Human
cauacuuguacacaaaagcaca

SEQ ID NO: 1308352 - RNA, 24 nt, Human
caucauguuggucuggcuggucuc

SEQ ID NO: 1308353 - RNA, 21 nt, Human
cauguuggucuggcuggucuc

SEQ ID NO: 1308354 - RNA, 22 nt, Human
cauguuggucuggcuggucucg

SEQ ID NO: 1308355 - RNA, 19 nt, Human
cauugcacuccagccuggg

SEQ ID NO: 1308356 - RNA, 21 nt, Human
cauugcacuccagccugggca

SEQ ID NO: 1308357 - RNA, 22 nt, Human
cauugcacuccagccugggcaa

SEQ ID NO: 1308358 - RNA, 23 nt, Human
cauugcacuccagccugggcaac

SEQ ID NO: 1308359 - RNA, 24 nt, Human
cauugcacuccagccugggcaacg

SEQ ID NO: 1308360 - RNA, 24 nt, Human
cauugcacuccagccugggcaacg

SEQ ID NO: 1308361 - RNA, 20 nt, Human
ccaaaacuucuagaagaaaa

SEQ ID NO: 1308362 - RNA, 20 nt, Human
ccauugcacuccagccuggg

SEQ ID NO: 1308363 - RNA, 21 nt, Human
ccauugcacuccagccugggc

SEQ ID NO: 1308364 - RNA, 23 nt, Human
ccauugcacuccagccugggcaa

SEQ ID NO: 1308365 - RNA, 24 nt, Human
ccauugcacuccagccugggcaac

SEQ ID NO: 1308366 - RNA, 24 nt, Human
ccgccucccauguuuaagugauuc

SEQ ID NO: 1308367 - RNA, 23 nt, Human
ccucaugauacuacacuugaucu

SEQ ID NO: 1308368 - RNA, 24 nt, Human
ccucccauguuuaagugauucucc

SEQ ID NO: 1308369 - RNA, 25 nt, Human
ccucccccaucaagagacaaccaaa

SEQ ID NO: 1308370 - RNA, 20 nt, Human
ccuccuggaaugggaccugg

SEQ ID NO: 1308371 - RNA, 21 nt, Human
ccugaccuugugaucugccug

SEQ ID NO: 1308372 - RNA, 23 nt, Human
ccugccucagccucccgaguagc

SEQ ID NO: 1308373 - RNA, 22 nt, Human
ccugucuuggccucucaaagug

SEQ ID NO: 1308374 - RNA, 24 nt, Human
cgccauugcacuccagccugggca

SEQ ID NO: 1308375 - RNA, 24 nt, Human
cuaauggcaauuagauaaucuuuu

SEQ ID NO: 1308376 - RNA, 19 nt, Human
cucaaauguucuguacagc

SEQ ID NO: 1308377 - RNA, 21 nt, Human
cucaacucugauguacaaaau

SEQ ID NO: 1308378 - RNA, 24 nt, Human
cucacucuguugccuaggcuggag

SEQ ID NO: 1308379 - RNA, 23 nt, Human
cucccccaucaagagacaaccaa

SEQ ID NO: 1308380 - RNA, 24 nt, Human
cuccugaccuugugaucugccugu

SEQ ID NO: 1308381 - RNA, 24 nt, Human
cugcaaccuccgccucccauguuu

SEQ ID NO: 1308382 - RNA, 27 nt, Human
cugucucaaaaaaacaaagaaacaaaa

SEQ ID NO: 1308383 - RNA, 22 nt, Human
cuucuagaagaaaacagaagaa

SEQ ID NO: 1308384 - RNA, 19 nt, Human
cuugaaccugggaggugga

SEQ ID NO: 1308385 - RNA, 24 nt, Human
cuuggccucucaaagugcugggau

SEQ ID NO: 1308386 - RNA, 24 nt, Human
cuuuucuagagaauccaaacuagg

SEQ ID NO: 1308387 - RNA, 21 nt, Human
gaccuugugaucugccugucu

SEQ ID NO: 1308388 - RNA, 24 nt, Human
gaccuugugaucugccugucuugg

SEQ ID NO: 1308389 - RNA, 19 nt, Human
gagagugaaacucugucuc

SEQ ID NO: 1308390 - RNA, 23 nt, Human
gagagugaaacucugucucaaaa

SEQ ID NO: 1308391 - RNA, 23 nt, Human
gagaucgcgccauugcacuccag

SEQ ID NO: 1308392 - RNA, 23 nt, Human
gaggaugcggugagcugagaucg

SEQ ID NO: 1308393 - RNA, 20 nt, Human
gagugcaguggcacaaucuc

SEQ ID NO: 1308394 - RNA, 18 nt, Human
gauuacaggugugagcca

SEQ ID NO: 1308395 - RNA, 22 nt, Human
gauuacaggugugagccacugc

SEQ ID NO: 1308396 - RNA, 22 nt, Human
gauuacaggugugagccacugc

SEQ ID NO: 1308397 - RNA, 18 nt, Human
gccacugcgcccggccac

SEQ ID NO: 1308398 - RNA, 22 nt, Human
gccauugcacuccagccugggc

SEQ ID NO: 1308399 - RNA, 24 nt, Human
gccauugcacuccagccugggcaa

SEQ ID NO: 1308400 - RNA, 20 nt, Human
gccuaggcuggagugcagug

SEQ ID NO: 1308401 - RNA, 20 nt, Human
gccucagccucccgaguagc

SEQ ID NO: 1308402 - RNA, 19 nt, Human
gcuggagugcaguggcaca

SEQ ID NO: 1308403 - RNA, 18 nt, Human
ggaggaugcggugagcug

SEQ ID NO: 1308404 - RNA, 24 nt, Human
ggaggaugcggugagcugagaucg

SEQ ID NO: 1308405 - RNA, 24 nt, Human
ggcuggucucgaacuccugaccuu

SEQ ID NO: 1308406 - RNA, 22 nt, Human
ggggcccuugcuccagugucuc

SEQ ID NO: 1308407 - RNA, 26 nt, Human
ggggcccuugcuccagugucucuagu

SEQ ID NO: 1308408 - RNA, 23 nt, Human
gggguuucaucauguuggucugg

SEQ ID NO: 1308409 - RNA, 22 nt, Human
ggguuucaucauguuggucugg

SEQ ID NO: 1308410 - RNA, 20 nt, Human
ggucucgaacuccugaccuu

SEQ ID NO: 1308411 - RNA, 24 nt, Human
gucucuaguugguguccacucauc

SEQ ID NO: 1308412 - RNA, 22 nt, Human
gucuuggccucucaaagugcug

SEQ ID NO: 1308413 - RNA, 24 nt, Human
gugauucuccugccucagccuccc

SEQ ID NO: 1308414 - RNA, 24 nt, Human
guguauuuccaaagaacuaaguuu

SEQ ID NO: 1308415 - RNA, 21 nt, Human
uaaaauacugcaccaaaaaug

SEQ ID NO: 1308416 - RNA, 20 nt, Human
uaagugauucuccugccuca

SEQ ID NO: 1308417 - RNA, 22 nt, Human
uaagugauucuccugccucagc

SEQ ID NO: 1308418 - RNA, 24 nt, Human
uaauuuuuguauuuuuaguacaga

SEQ ID NO: 1308419 - RNA, 19 nt, Human
uacaggugugagccacugc

SEQ ID NO: 1308420 - RNA, 23 nt, Human
uacaggugugagccacugcgccc

SEQ ID NO: 1308421 - RNA, 18 nt, Human
uaggaggcuagugaaagc

SEQ ID NO: 1308422 - RNA, 18 nt, Human
uaggaguuuuggaaaucu

SEQ ID NO: 1308423 - RNA, 24 nt, Human
uaguacagacgggguuucaucaug

SEQ ID NO: 1308424 - RNA, 20 nt, Human
uaucaauagugguuuaaaaa

SEQ ID NO: 1308425 - RNA, 20 nt, Human
uaugugaauggcaaauaagc

SEQ ID NO: 1308426 - RNA, 21 nt, Human
ucaaaaaaacaaagaaacaaa

SEQ ID NO: 1308427 - RNA, 20 nt, Human
ucaaagugcugggauuacag

SEQ ID NO: 1308428 - RNA, 21 nt, Human
ucaaagugcugggauuacagg

SEQ ID NO: 1308429 - RNA, 24 nt, Human
ucaaagugcugggauuacaggugu

SEQ ID NO: 1308430 - RNA, 19 nt, Human
ucacacuguggggcccuug

SEQ ID NO: 1308431 - RNA, 21 nt, Human
ucacacuguggggcccuugcu

SEQ ID NO: 1308432 - RNA, 24 nt, Human
ucacucuguugccuaggcuggagu

SEQ ID NO: 1308433 - RNA, 18 nt, Human
ucacugcaaccuccgccu

SEQ ID NO: 1308434 - RNA, 19 nt, Human
ucacugcaaccuccgccuc

SEQ ID NO: 1308435 - RNA, 22 nt, Human
ucacugcaaccuccgccuccca

SEQ ID NO: 1308436 - RNA, 24 nt, Human
ucacugcaaccuccgccucccaug

SEQ ID NO: 1308437 - RNA, 27 nt, Human
ucacugcaaccuccgccucccauguuu

SEQ ID NO: 1308438 - RNA, 21 nt, Human
ucagccucccgaguagcggag

SEQ ID NO: 1308439 - RNA, 22 nt, Human
ucagucccaaucucaaauguuc

SEQ ID NO: 1308440 - RNA, 23 nt, Human
uccaggaaaaugacaccagcaag

SEQ ID NO: 1308441 - RNA, 24 nt, Human
ucccauguuuaagugauucuccug

SEQ ID NO: 1308442 - RNA, 23 nt, Human
ucccgaguagcggaguuauaggc

SEQ ID NO: 1308443 - RNA, 23 nt, Human
ucgcgccauugcacuccagccug

SEQ ID NO: 1308444 - RNA, 24 nt, Human
ucgcuugaaccugggagguggagg

SEQ ID NO: 1308445 - RNA, 21 nt, Human
ucuagaagaaaacagaagaaa

SEQ ID NO: 1308446 - RNA, 23 nt, Human
ucucaaagugcugggauuacagg

SEQ ID NO: 1308447 - RNA, 24 nt, Human
ucucaaagugcugggauuacaggu

SEQ ID NO: 1308448 - RNA, 23 nt, Human
ucucacucuguugccuaggcugg

SEQ ID NO: 1308449 - RNA, 24 nt, Human
ucucacucuguugccuaggcugga

SEQ ID NO: 1308450 - RNA, 24 nt, Human
ucuccugccucagccucccgagua

SEQ ID NO: 1308451 - RNA, 25 nt, Human
ucucuuaccccuccaaacagcuuca

SEQ ID NO: 1308452 - RNA, 24 nt, Human
ucuguugccuaggcuggagugcag

SEQ ID NO: 1308453 - RNA, 18 nt, Human
ucuuuuuuuuuuuuuuuu

SEQ ID NO: 1308454 - RNA, 26 nt, Human
ucuuuuuuuuuuuuuuuuuuuuuuuu

SEQ ID NO: 1308455 - RNA, 26 nt, Human
ugaauuuucugguuuuacuuguguau

SEQ ID NO: 1308456 - RNA, 21 nt, Human
ugacaccagcaaguuaacucc

SEQ ID NO: 1308457 - RNA, 22 nt, Human
ugagauggagucucacucuguu

SEQ ID NO: 1308458 - RNA, 22 nt, Human
ugagcugagaucgcgccauugc

SEQ ID NO: 1308459 - RNA, 20 nt, Human
ugaggcaagagaaucgcuug

SEQ ID NO: 1308460 - RNA, 24 nt, Human
ugaggcaagagaaucgcuugaacc

SEQ ID NO: 1308461 - RNA, 25 nt, Human
ugaggcaagagaaucgcuugaaccu

SEQ ID NO: 1308462 - RNA, 24 nt, Human
ugagguaacagaucccaugagaua

SEQ ID NO: 1308463 - RNA, 21 nt, Human
ugaucagacauuucacccaag

SEQ ID NO: 1308464 - RNA, 21 nt, Human
ugaucugaauuuucugguuuu

SEQ ID NO: 1308465 - RNA, 20 nt, Human
ugauucuccugccucagccu

SEQ ID NO: 1308466 - RNA, 23 nt, Human
ugcacuccagccugggcaacgag

SEQ ID NO: 1308467 - RNA, 19 nt, Human
ugccuaggcuggagugcag

SEQ ID NO: 1308468 - RNA, 20 nt, Human
ugccuaggcuggagugcagu

SEQ ID NO: 1308469 - RNA, 21 nt, Human
ugccuaggcuggagugcagug

SEQ ID NO: 1308470 - RNA, 22 nt, Human
ugccuaggcuggagugcagugg

SEQ ID NO: 1308471 - RNA, 24 nt, Human
ugccuaggcuggagugcaguggca

SEQ ID NO: 1308472 - RNA, 23 nt, Human
ugccucagccucccgaguagcgg

SEQ ID NO: 1308473 - RNA, 24 nt, Human
ugcugggauuacaggugugagcca

SEQ ID NO: 1308474 - RNA, 24 nt, Human
uggagugcaguggcacaaucucgg

SEQ ID NO: 1308475 - RNA, 24 nt, Human
uggcacaaucucggcucacugcaa

SEQ ID NO: 1308476 - RNA, 23 nt, Human
ugggagaaaauauuugcauauga

SEQ ID NO: 1308477 - RNA, 25 nt, Human
ugggagaaaauauuugcauaugaua

SEQ ID NO: 1308478 - RNA, 21 nt, Human
ugggagguggaggaugcggug

SEQ ID NO: 1308479 - RNA, 24 nt, Human
ugggagguggaggaugcggugagc

SEQ ID NO: 1308480 - RNA, 18 nt, Human
ugggauuacaggugugag

SEQ ID NO: 1308481 - RNA, 19 nt, Human
ugggauuacaggugugagc

SEQ ID NO: 1308482 - RNA, 21 nt, Human
ugggauuacaggugugagcca

SEQ ID NO: 1308483 - RNA, 22 nt, Human
ugggauuacaggugugagccac

SEQ ID NO: 1308484 - RNA, 22 nt, Human
ugggauuacaggugugagccac

SEQ ID NO: 1308485 - RNA, 24 nt, Human
ugggauuacaggugugagccacug

SEQ ID NO: 1308486 - RNA, 22 nt, Human
uggggugggauuccaauauauc

SEQ ID NO: 1308487 - RNA, 24 nt, Human
uggguaaacaguaugagaauaucc

SEQ ID NO: 1308488 - RNA, 24 nt, Human
uggucuggcuggucucgaacuccu

SEQ ID NO: 1308489 - RNA, 21 nt, Human
ugucacacuguggggcccuug

SEQ ID NO: 1308490 - RNA, 22 nt, Human
ugucacacuguggggcccuugc

SEQ ID NO: 1308491 - RNA, 24 nt, Human
uguucucuuaccccuccaaacagc

SEQ ID NO: 1308492 - RNA, 20 nt, Human
uguugccuaggcuggagugc

SEQ ID NO: 1308493 - RNA, 20 nt, Human
uuaaaaauuucugcuccuua

SEQ ID NO: 1308494 - RNA, 20 nt, Human
uuaaaauuuuuuaugcugac

SEQ ID NO: 1308495 - RNA, 24 nt, Human
uuaguacagacgggguuucaucau

SEQ ID NO: 1308496 - RNA, 19 nt, Human
uuauaggcacccgccacca

SEQ ID NO: 1308497 - RNA, 20 nt, Human
uuauaggcacccgccaccau

SEQ ID NO: 1308498 - RNA, 19 nt, Human
uucugccacaaaagggcuc

SEQ ID NO: 1308499 - RNA, 24 nt, Human
uugaaccugggagguggaggaugc

SEQ ID NO: 1308500 - RNA, 23 nt, Human
uuguauuuuuaguacagacgggg

SEQ ID NO: 1308501 - RNA, 23 nt, Human
uuuaagugauucuccugccucag

SEQ ID NO: 1308502 - RNA, 22 nt, Human
uuuacauaccuucgugcugggc

SEQ ID NO: 1308503 - RNA, 23 nt, Human
uuuagcaucaucaaccccauuua

SEQ ID NO: 1308504 - RNA, 25 nt, Human
uuuauaauaauguaucaauaguggu

SEQ ID NO: 1308505 - RNA, 21 nt, Human
uuucaucauguuggucuggcu

SEQ ID NO: 1308506 - RNA, 23 nt, Human
uuuucagucucuguaauccccuu

SEQ ID NO: 1308507 - RNA, 24 nt, Human
uuuuuaguacagacgggguuucau

SEQ ID NO: 1308508 - RNA, 20 nt, Human
uuuuuguauuuuuaguacag

SEQ ID NO: 1308509 - RNA, 23 nt, Human
uuuuuguauuuuuaguacagacg

SEQ ID NO: 1308510 - RNA, 26 nt, Human
uuuuuuuuuuuugagauggagucuca

SEQ ID NO: 1308511 - RNA, 22 nt, Human
uuuuuuuuuuuuuugagaugga

SEQ ID NO: 1308512 - RNA, 18 nt, Human
uuuuuuuuuuuuuuuuug

SEQ ID NO: 1308513 - RNA, 24 nt, Human
uggccugcuuuuagaugacaguga

SEQ ID NO: 1308514 - RNA, 24 nt, Human
aaagugcugagauuacaggcauga

SEQ ID NO: 1308515 - RNA, 26 nt, Human
aagugcugagauuacaggcaugagcc

SEQ ID NO: 1308516 - RNA, 18 nt, Human
acgggguuuccccguguu

SEQ ID NO: 1308517 - RNA, 24 nt, Human
acgggguuuccccguguuaaacag

SEQ ID NO: 1308518 - RNA, 22 nt, Human
agauuacaggcaugagccaccg

SEQ ID NO: 1308519 - RNA, 24 nt, Human
agauuacaggcaugagccaccgug

SEQ ID NO: 1308520 - RNA, 20 nt, Human
aguagagacgggguuucccc

SEQ ID NO: 1308521 - RNA, 31 nt, Human
augauccgcccgccucggcguuggccucccc

SEQ ID NO: 1308522 - RNA, 24 nt, Human
caaagugcugagauuacaggcaug

SEQ ID NO: 1308523 - RNA, 23 nt, Human
cagccaacaaccccucuccuuuu

SEQ ID NO: 1308524 - RNA, 23 nt, Human
ccaaagugcugagauuacaggca

SEQ ID NO: 1308525 - RNA, 24 nt, Human
ccaaagugcugagauuacaggcau

SEQ ID NO: 1308526 - RNA, 22 nt, Human
ccguguuaaacaggauggucuc

SEQ ID NO: 1308527 - RNA, 21 nt, Human
cucccaaagugcugagauuac

SEQ ID NO: 1308528 - RNA, 24 nt, Human
cuccugaccucaugauccgcccgc

SEQ ID NO: 1308529 - RNA, 22 nt, Human
gaccucaugauccgcccgccuc

SEQ ID NO: 1308530 - RNA, 18 nt, Human
gauuacaggcaugagcca

SEQ ID NO: 1308531 - RNA, 24 nt, Human
gauuacaggcaugagccaccgugc

SEQ ID NO: 1308532 - RNA, 21 nt, Human
gcguuggccucccaaagugcu

SEQ ID NO: 1308533 - RNA, 20 nt, Human
ggucucgaucuccugaccuc

SEQ ID NO: 1308534 - RNA, 23 nt, Human
guagagacgggguuuccccgugu

SEQ ID NO: 1308535 - RNA, 22 nt, Human
uaaacaggauggucucgaucuc

SEQ ID NO: 1308536 - RNA, 24 nt, Human
uacaggcaugagccaccgugccca

SEQ ID NO: 1308537 - RNA, 21 nt, Human
uaguagagacgggguuucccc

SEQ ID NO: 1308538 - RNA, 22 nt, Human
uaguagagacgggguuuccccg

SEQ ID NO: 1308539 - RNA, 24 nt, Human
uaguagagacgggguuuccccgug

SEQ ID NO: 1308540 - RNA, 26 nt, Human
uaguagagacgggguuuccccguugg

SEQ ID NO: 1308541 - RNA, 24 nt, Human
ucccaaagugcugagauuacaggc

SEQ ID NO: 1308542 - RNA, 24 nt, Human
uccccguguuaaacaggauggucu

SEQ ID NO: 1308543 - RNA, 21 nt, Human
ugagauuacaggcaugagcca

SEQ ID NO: 1308544 - RNA, 22 nt, Human
ugagauuacaggcaugagccac

SEQ ID NO: 1308545 - RNA, 23 nt, Human
ugagauuacaggcaugagccacc

SEQ ID NO: 1308546 - RNA, 24 nt, Human
ugagauuacaggcaugagccaccg

SEQ ID NO: 1308547 - RNA, 26 nt, Human
ugagauuacaggcaugagccaccgug

SEQ ID NO: 1308548 - RNA, 21 nt, Human
uguauuuuuaguagagacggg

SEQ ID NO: 1308549 - RNA, 18 nt, Human
uuaguagagacgggguuu

SEQ ID NO: 1308550 - RNA, 22 nt, Human
uuaguagagacgggguuucccc

SEQ ID NO: 1308551 - RNA, 24 nt, Human
uuaguagagacgggguuuccccgu

SEQ ID NO: 1308552 - RNA, 22 nt, Human
uuuuuaguagagacgggguuuc

SEQ ID NO: 1308553 - RNA, 21 nt, Human
uuuuuguauuuuuaguagaga

SEQ ID NO: 1308554 - RNA, 21 nt, Human
uuuuuuguauuuuuaguagag

SEQ ID NO: 1308555 - RNA, 24 nt, Human
uuuuuuguauuuuuaguagagacg

SEQ ID NO: 1308556 - RNA, 23 nt, Human
aaggugccugagaguaggacagg

SEQ ID NO: 1308557 - RNA, 18 nt, Human
acuugggagaggaugguc

SEQ ID NO: 1308558 - RNA, 18 nt, Human
agcucagggaggcuggug

SEQ ID NO: 1308559 - RNA, 23 nt, Human
aggacaggggucacuaagaaaaa

SEQ ID NO: 1308560 - RNA, 19 nt, Human
aggauauaaggugccugag

SEQ ID NO: 1308561 - RNA, 20 nt, Human
auggucagugccaguccugg

SEQ ID NO: 1308562 - RNA, 23 nt, Human
caacuuuaucagagagccaaggg

SEQ ID NO: 1308563 - RNA, 19 nt, Human
ccugagaguaggacagggg

SEQ ID NO: 1308564 - RNA, 19 nt, Human
gagaggauggucagugcca

SEQ ID NO: 1308565 - RNA, 18 nt, Human
gcacccacagcuccaacu

SEQ ID NO: 1308566 - RNA, 20 nt, Human
gcagagagagacugggugga

SEQ ID NO: 1308567 - RNA, 24 nt, Human
ggacaggggucacuaagaaaaaaa

SEQ ID NO: 1308568 - RNA, 19 nt, Human
gugaaaugcugcacccaca

SEQ ID NO: 1308569 - RNA, 18 nt, Human
ucacuguaaagggguggc

SEQ ID NO: 1308570 - RNA, 22 nt, Human
ucagagagccaagggaggccuu

SEQ ID NO: 1308571 - RNA, 24 nt, Human
ucagagagccaagggaggccuuug

SEQ ID NO: 1308572 - RNA, 20 nt, Human
ugaaaugcugcacccacagc

SEQ ID NO: 1308573 - RNA, 21 nt, Human
ugaaaugcugcacccacagcu

SEQ ID NO: 1308574 - RNA, 24 nt, Human
ugaaaugcugcacccacagcuccu

SEQ ID NO: 1308575 - RNA, 20 nt, Human
uuacuugggagaggaugguc

SEQ ID NO: 1308576 - RNA, 21 nt, Human
aagagcuuuccggggccuggg

SEQ ID NO: 1308577 - RNA, 21 nt, Human
acaguccuccgcuuccugccu

SEQ ID NO: 1308578 - RNA, 26 nt, Human
accucgaggcagguccuggagagaag

SEQ ID NO: 1308579 - RNA, 23 nt, Human
agccuuggcaaacagauagcacu

SEQ ID NO: 1308580 - RNA, 20 nt, Human
caaaguccccaaaggccuuc

SEQ ID NO: 1308581 - RNA, 22 nt, Human
caaggucuccacguuguucagg

SEQ ID NO: 1308582 - RNA, 22 nt, Human
caccugauucucuccacacccc

SEQ ID NO: 1308583 - RNA, 20 nt, Human
cagaguccccaucgcuccuc

SEQ ID NO: 1308584 - RNA, 21 nt, Human
cagauccugcacagagucccc

SEQ ID NO: 1308585 - RNA, 18 nt, Human
cagccccuguucugugug

SEQ ID NO: 1308586 - RNA, 27 nt, Human
cagugugucuccucucugucacagucc

SEQ ID NO: 1308587 - RNA, 18 nt, Human
caucgcuccucccucuac

SEQ ID NO: 1308588 - RNA, 19 nt, Human
ccaaaggccuucuccucag

SEQ ID NO: 1308589 - RNA, 25 nt, Human
ccagccgauaaaaguccuggggcuc

SEQ ID NO: 1308590 - RNA, 23 nt, Human
ccccaucgcuccucccucuacag

SEQ ID NO: 1308591 - RNA, 19 nt, Human
ccccugcccucucccgagc

SEQ ID NO: 1308592 - RNA, 21 nt, Human
cccgagccuggugccggucca

SEQ ID NO: 1308593 - RNA, 22 nt, Human
ccuggagagaagggaagcagau

SEQ ID NO: 1308594 - RNA, 20 nt, Human
ccuggagcgaucuacugccc

SEQ ID NO: 1308595 - RNA, 21 nt, Human
cuccacaccuggggccaggug

SEQ ID NO: 1308596 - RNA, 18 nt, Human
cuccucucugucacaguc

SEQ ID NO: 1308597 - RNA, 21 nt, Human
cugauucucuccacaccccgc

SEQ ID NO: 1308598 - RNA, 22 nt, Human
cugcacagaguccccaucgcuc

SEQ ID NO: 1308599 - RNA, 25 nt, Human
cuucugcccuacauccccaagaguc

SEQ ID NO: 1308600 - RNA, 18 nt, Human
gaagcagauccugcacag

SEQ ID NO: 1308601 - RNA, 18 nt, Human
gcacagaguccccaucga

SEQ ID NO: 1308602 - RNA, 21 nt, Human
gcacucacgggccuccuccau

SEQ ID NO: 1308603 - RNA, 19 nt, Human
gccaccagccgauaaaagu

SEQ ID NO: 1308604 - RNA, 19 nt, Human
gcucaccugauucucucca

SEQ ID NO: 1308605 - RNA, 23 nt, Human
ggucaggccccugcccucucccg

SEQ ID NO: 1308606 - RNA, 19 nt, Human
gucacaguccuccgcuucc

SEQ ID NO: 1308607 - RNA, 24 nt, Human
uaaccagggggaagugcagcacaa

SEQ ID NO: 1308608 - RNA, 23 nt, Human
ucaccugauucucuccacacccc

SEQ ID NO: 1308609 - RNA, 23 nt, Human
ucaggccccugcccucucccgaa

SEQ ID NO: 1308610 - RNA, 24 nt, Human
uccaaaaacacacaaggagagccc

SEQ ID NO: 1308611 - RNA, 23 nt, Human
uccaagcugcaauucugcaagag

SEQ ID NO: 1308612 - RNA, 23 nt, Human
uccccaucgcuccucccucuaca

SEQ ID NO: 1308613 - RNA, 22 nt, Human
ucccuggagcgaucuacugccc

SEQ ID NO: 1308614 - RNA, 23 nt, Human
uccggggccuggggcaccucgag

SEQ ID NO: 1308615 - RNA, 21 nt, Human
uccucagccuuggcaaacaga

SEQ ID NO: 1308616 - RNA, 22 nt, Human
ucuccucagcuguuugucgcuc

SEQ ID NO: 1308617 - RNA, 21 nt, Human
ucugcccuacauccccaagag

SEQ ID NO: 1308618 - RNA, 22 nt, Human
ugacaaaguccccaaaggccuu

SEQ ID NO: 1308619 - RNA, 18 nt, Human
ugagcagugugucuccuc

SEQ ID NO: 1308620 - RNA, 20 nt, Human
ugagcagugugucuccucuc

SEQ ID NO: 1308621 - RNA, 19 nt, Human
ugagggccaccagccgaua

SEQ ID NO: 1308622 - RNA, 18 nt, Human
ugauucucuccacacccc

SEQ ID NO: 1308623 - RNA, 20 nt, Human
ugcccaucuucuccaaaaac

SEQ ID NO: 1308624 - RNA, 23 nt, Human
ugcccaucuucuccaaaaacaca

SEQ ID NO: 1308625 - RNA, 20 nt, Human
uggcaaacagauagcacuca

SEQ ID NO: 1308626 - RNA, 24 nt, Human
uggucaggccccugcccucucccg

SEQ ID NO: 1308627 - RNA, 21 nt, Human
ugucuccucucugucacaguc

SEQ ID NO: 1308628 - RNA, 21 nt, Human
uucugcccuacauccccaaga

SEQ ID NO: 1308629 - RNA, 25 nt, Human
uucugugucuggggugggcucugug

SEQ ID NO: 1308630 - RNA, 22 nt, Human
aaaaagacaaagcuacaacaga

SEQ ID NO: 1308631 - RNA, 24 nt, Human
aagaaaaauaaaaagacaaagcua

SEQ ID NO: 1308632 - RNA, 18 nt, Human
acuaccacaauuuacagg

SEQ ID NO: 1308633 - RNA, 22 nt, Human
cgcucucucucuccugcuaaga

SEQ ID NO: 1308634 - RNA, 25 nt, Human
cugacuauggaucaucguuccuucu

SEQ ID NO: 1308635 - RNA, 20 nt, Human
cuuuccugacaacuccucgc

SEQ ID NO: 1308636 - RNA, 18 nt, Human
gcuaugacaguccugaac

SEQ ID NO: 1308637 - RNA, 22 nt, Human
uaagcugcaguaacuuuucuga

SEQ ID NO: 1308638 - RNA, 23 nt, Human
uaugacaguccugaacaagaagg

SEQ ID NO: 1308639 - RNA, 18 nt, Human
ucuuuuuuuuuuuuuuug

SEQ ID NO: 1308640 - RNA, 21 nt, Human
uggcuaugacaguccugaaca

SEQ ID NO: 1308641 - RNA, 24 nt, Human
uguaaugaaaagaaaaauaaaaag

SEQ ID NO: 1308642 - RNA, 21 nt, Human
ugucucaaaguaaccugcagc

SEQ ID NO: 1308643 - RNA, 20 nt, Human
uucuuuuuuuuuuuuuuugu

SEQ ID NO: 1308644 - RNA, 24 nt, Human
uucuuuuuuuuuuuuuuugugaaa

SEQ ID NO: 1308645 - RNA, 18 nt, Human
uugcaaacuguggcuaug

SEQ ID NO: 1308646 - RNA, 22 nt, Human
uuuuuuuuuuuuuuugugaaaa

SEQ ID NO: 1308647 - RNA, 22 nt, Human
aaaaaacccgauccuugaaggc

SEQ ID NO: 1308648 - RNA, 20 nt, Human
aaaacccgauccuugaaggc

SEQ ID NO: 1308649 - RNA, 25 nt, Human
aagugaucuucccaccucggccucc

SEQ ID NO: 1308650 - RNA, 22 nt, Human
agccccugcggccccaggucag

SEQ ID NO: 1308651 - RNA, 23 nt, Human
agcuccugcgccccucucugcug

SEQ ID NO: 1308652 - RNA, 20 nt, Human
agggccggccuggacagagc

SEQ ID NO: 1308653 - RNA, 18 nt, Human
aggugccucugagggcac

SEQ ID NO: 1308654 - RNA, 23 nt, Human
aguacaggccugacucugagggu

SEQ ID NO: 1308655 - RNA, 27 nt, Human
caagugaucuucccaccucggccuccc

SEQ ID NO: 1308656 - RNA, 20 nt, Human
cagccccugcggccccaggu

SEQ ID NO: 1308657 - RNA, 22 nt, Human
ccucugagggcacugggacggc

SEQ ID NO: 1308658 - RNA, 24 nt, Human
ccugaccucaagugaucuucccac

SEQ ID NO: 1308659 - RNA, 20 nt, Human
ccugcgccccucucugcugu

SEQ ID NO: 1308660 - RNA, 24 nt, Human
cucaagugaucuucccaccucggc

SEQ ID NO: 1308661 - RNA, 23 nt, Human
cugggacggcgguggccugcacc

SEQ ID NO: 1308662 - RNA, 24 nt, Human
gaccucaagugaucuucccaccuc

SEQ ID NO: 1308663 - RNA, 23 nt, Human
gagggcacugggacggcgguggc

SEQ ID NO: 1308664 - RNA, 19 nt, Human
gcggcagcuccugcgcccc

SEQ ID NO: 1308665 - RNA, 21 nt, Human
gcugcaaccccucauuuucuu

SEQ ID NO: 1308666 - RNA, 19 nt, Human
ggcagcuccugcgccccuc

SEQ ID NO: 1308667 - RNA, 22 nt, Human
gggcacugggacggcgguggcc

SEQ ID NO: 1308668 - RNA, 23 nt, Human
gggcacugggacggcgguggccu

SEQ ID NO: 1308669 - RNA, 20 nt, Human
gggggcucuuggguccuggg

SEQ ID NO: 1308670 - RNA, 18 nt, Human
gggugcagaugaauuggg

SEQ ID NO: 1308671 - RNA, 20 nt, Human
ggucucaaacuccugaccuc

SEQ ID NO: 1308672 - RNA, 24 nt, Human
gugaucuucccaccucggccuccc

SEQ ID NO: 1308673 - RNA, 19 nt, Human
gugcugcccugguguucgg

SEQ ID NO: 1308674 - RNA, 23 nt, Human
guggccugcaccugcccagccca

SEQ ID NO: 1308675 - RNA, 19 nt, Human
uacaggccugacucugagg

SEQ ID NO: 1308676 - RNA, 21 nt, Human
uaccggccuaggucagccuga

SEQ ID NO: 1308677 - RNA, 27 nt, Human
uccuuggggugcagaugaauuggggug

SEQ ID NO: 1308678 - RNA, 18 nt, Human
ugaccucaagugaucuuc

SEQ ID NO: 1308679 - RNA, 20 nt, Human
ugaccucaagugaucuuccc

SEQ ID NO: 1308680 - RNA, 21 nt, Human
ugaccucaagugaucuuccca

SEQ ID NO: 1308681 - RNA, 24 nt, Human
ugaccucaagugaucuucccaccu

SEQ ID NO: 1308682 - RNA, 21 nt, Human
ugacgaugauuaaaaaaaccc

SEQ ID NO: 1308683 - RNA, 18 nt, Human
ugauuaaaaaaacccgau

SEQ ID NO: 1308684 - RNA, 27 nt, Human
ugcugcccugguguucgguggucaacc

SEQ ID NO: 1308685 - RNA, 23 nt, Human
uggcagggaaccgagcccacagu

SEQ ID NO: 1308686 - RNA, 25 nt, Human
uggcagggaaccgagcccacagugg

SEQ ID NO: 1308687 - RNA, 20 nt, Human
uggggugcagaugaauuggg

SEQ ID NO: 1308688 - RNA, 23 nt, Human
uggguccuggggcgcugcaaccc

SEQ ID NO: 1308689 - RNA, 20 nt, Human
ugguguucgggggcucuugg

SEQ ID NO: 1308690 - RNA, 21 nt, Human
uguccaggauggucucaaacu

SEQ ID NO: 1308691 - RNA, 23 nt, Human
uguccuggccgcggcagcuccug

SEQ ID NO: 1308692 - RNA, 24 nt, Human
uuccuuggggugcagaugaauugg

SEQ ID NO: 1308693 - RNA, 18 nt, Human
uuggguccuggggcgcug

SEQ ID NO: 1308694 - RNA, 21 nt, Human
aaaaagauaauuuacagauua

SEQ ID NO: 1308695 - RNA, 22 nt, Human
aaaacagacagguauuaggaug

SEQ ID NO: 1308696 - RNA, 24 nt, Human
aaaacagacagguauuaggaugua

SEQ ID NO: 1308697 - RNA, 23 nt, Human
aaacuccugggcuaaagcaaucc

SEQ ID NO: 1308698 - RNA, 19 nt, Human
aaagugcugggauuacagg

SEQ ID NO: 1308699 - RNA, 20 nt, Human
aaagugcugggauuacaggc

SEQ ID NO: 1308700 - RNA, 23 nt, Human
aaagugcugggauuacaggcgua

SEQ ID NO: 1308701 - RNA, 24 nt, Human
aaagugcugggauuauaggcauga

SEQ ID NO: 1308702 - RNA, 19 nt, Human
aaauagcugcugcacucca

SEQ ID NO: 1308703 - RNA, 24 nt, Human
aaauagcugcugcacuccagccug

SEQ ID NO: 1308704 - RNA, 25 nt, Human
aagcaauccucccaccuugaccucc

SEQ ID NO: 1308705 - RNA, 21 nt, Human
aagcagcugggacuacaaggu

SEQ ID NO: 1308706 - RNA, 25 nt, Human
aagcagcugggacuacaagguauac

SEQ ID NO: 1308707 - RNA, 25 nt, Human
aaggagaaauaggaaggaaccagac

SEQ ID NO: 1308708 - RNA, 24 nt, Human
aaggcacugccuguaucccagagc

SEQ ID NO: 1308709 - RNA, 19 nt, Human
aagugcugggauuacaggc

SEQ ID NO: 1308710 - RNA, 19 nt, Human
aagugcugggauuacaggc

SEQ ID NO: 1308711 - RNA, 26 nt, Human
aagugcugggauuacaggcguaagcc

SEQ ID NO: 1308712 - RNA, 19 nt, Human
aagugcugggauuauaggc

SEQ ID NO: 1308713 - RNA, 21 nt, Human
aagugcugggauuauaggcau

SEQ ID NO: 1308714 - RNA, 19 nt, Human
aaguggugggauuacagcu

SEQ ID NO: 1308715 - RNA, 24 nt, Human
aauagagcaagacucugucucaaa

SEQ ID NO: 1308716 - RNA, 20 nt, Human
acacugcacuccagccugag

SEQ ID NO: 1308717 - RNA, 21 nt, Human
acacugcacuccagccugagc

SEQ ID NO: 1308718 - RNA, 24 nt, Human
acaugcucccucuucuuuccauuu

SEQ ID NO: 1308719 - RNA, 24 nt, Human
accauguuggcccggcuggucucg

SEQ ID NO: 1308720 - RNA, 25 nt, Human
accccaagaauauaaaaauaaaaau

SEQ ID NO: 1308721 - RNA, 19 nt, Human
accccggcacugcugcccu

SEQ ID NO: 1308722 - RNA, 22 nt, Human
accuccaccucccaggcuccag

SEQ ID NO: 1308723 - RNA, 24 nt, Human
acucagagagacuccugaaaaaga

SEQ ID NO: 1308724 - RNA, 18 nt, Human
acugcacuccagccugag

SEQ ID NO: 1308725 - RNA, 24 nt, Human
acugcacuccagccugagcaauag

SEQ ID NO: 1308726 - RNA, 21 nt, Human
acugcagugagccgagaucgc

SEQ ID NO: 1308727 - RNA, 21 nt, Human
agaaauaggaaggaaccagac

SEQ ID NO: 1308728 - RNA, 18 nt, Human
agaauauaaaaauaaaaa

SEQ ID NO: 1308729 - RNA, 18 nt, Human
agagcaagacucugucuc

SEQ ID NO: 1308730 - RNA, 22 nt, Human
agagcaagacucugucucaaaa

SEQ ID NO: 1308731 - RNA, 24 nt, Human
agcacuuagggaggcugagguggg

SEQ ID NO: 1308732 - RNA, 22 nt, Human
agccacucgggaguugaaaaua

SEQ ID NO: 1308733 - RNA, 24 nt, Human
agccugagcaauagagcaagacuc

SEQ ID NO: 1308734 - RNA, 22 nt, Human
agccugggcaaaauagugagac

SEQ ID NO: 1308735 - RNA, 23 nt, Human
agccugggcaaaauagugagacc

SEQ ID NO: 1308736 - RNA, 23 nt, Human
agccugggcaacauaggauaacu

SEQ ID NO: 1308737 - RNA, 24 nt, Human
agcugcugcacuccagccugggca

SEQ ID NO: 1308738 - RNA, 22 nt, Human
agcugggacuacaagguauaca

SEQ ID NO: 1308739 - RNA, 23 nt, Human
aggaaaggagaaauaggaaggaa

SEQ ID NO: 1308740 - RNA, 23 nt, Human
aggacuacaggagugagccacca

SEQ ID NO: 1308741 - RNA, 21 nt, Human
aggaguuggagaccagccugg

SEQ ID NO: 1308742 - RNA, 21 nt, Human
aggcaugagccgccacaccca

SEQ ID NO: 1308743 - RNA, 24 nt, Human
aggcugagguggcaggaucgauug

SEQ ID NO: 1308744 - RNA, 24 nt, Human
aggcugaggugggaggauugcuug

SEQ ID NO: 1308745 - RNA, 24 nt, Human
aggucgagacugcagugagccgag

SEQ ID NO: 1308746 - RNA, 24 nt, Human
agugacucacaccuguaaucucag

SEQ ID NO: 1308747 - RNA, 20 nt, Human
agugcaguggcacaaucuug

SEQ ID NO: 1308748 - RNA, 24 nt, Human
agugcaguggcacaaucuuggcuc

SEQ ID NO: 1308749 - RNA, 18 nt, Human
agugcugggauuacaggc

SEQ ID NO: 1308750 - RNA, 21 nt, Human
aucauuucuuucuuuuuccug

SEQ ID NO: 1308751 - RNA, 24 nt, Human
aucgcaacacugcacuccagccug

SEQ ID NO: 1308752 - RNA, 23 nt, Human
augaggcaacauggaagcgugaa

SEQ ID NO: 1308753 - RNA, 23 nt, Human
auugcuugagcccaggaguugga

SEQ ID NO: 1308754 - RNA, 24 nt, Human
caaagugcugggauuacaggcgua

SEQ ID NO: 1308755 - RNA, 24 nt, Human
caaagugcugggauuauaggcaug

SEQ ID NO: 1308756 - RNA, 21 nt, Human
caacauaggauaacugguauc

SEQ ID NO: 1308757 - RNA, 18 nt, Human
caaccuccaccucccagg

SEQ ID NO: 1308758 - RNA, 20 nt, Human
caaccuccaccucccaggcu

SEQ ID NO: 1308759 - RNA, 23 nt, Human
caaccuccaccucccaggcucca

SEQ ID NO: 1308760 - RNA, 24 nt, Human
cacaccuguaaucucagcacuuag

SEQ ID NO: 1308761 - RNA, 22 nt, Human
caccacguccagcuaguuuuua

SEQ ID NO: 1308762 - RNA, 18 nt, Human
caccauguuggcccggcu

SEQ ID NO: 1308763 - RNA, 24 nt, Human
caccauguuggcccggcuggucuc

SEQ ID NO: 1308764 - RNA, 28 nt, Human
caccucccaggcuccagcaauccuccuu

SEQ ID NO: 1308765 - RNA, 23 nt, Human
caccuguaaucucagcacuuagg

SEQ ID NO: 1308766 - RNA, 23 nt, Human
caccuguaaucucagcacuuagg

SEQ ID NO: 1308767 - RNA, 21 nt, Human
cacgcaccuacagguaguccc

SEQ ID NO: 1308768 - RNA, 23 nt, Human
cacuccagccugagcaauagagc

SEQ ID NO: 1308769 - RNA, 20 nt, Human
cacuccagccugggcaaaau

SEQ ID NO: 1308770 - RNA, 19 nt, Human
cacugcacuccagccugag

SEQ ID NO: 1308771 - RNA, 20 nt, Human
cacugcacuccagccugagc

SEQ ID NO: 1308772 - RNA, 21 nt, Human
cacugcacuccagccugagca

SEQ ID NO: 1308773 - RNA, 22 nt, Human
cacugcacuccagccugagcaa

SEQ ID NO: 1308774 - RNA, 27 nt, Human
cacugcacuccagccugagcaauagag

SEQ ID NO: 1308775 - RNA, 22 nt, Human
cacugccuguaucccagagcac

SEQ ID NO: 1308776 - RNA, 24 nt, Human
cacugccuguaucccagagcaccc

SEQ ID NO: 1308777 - RNA, 20 nt, Human
cacugcugcccuugcagaga

SEQ ID NO: 1308778 - RNA, 22 nt, Human
cacuuauccuccugaguagcca

SEQ ID NO: 1308779 - RNA, 22 nt, Human
cagacaugcucccucuucuuuc

SEQ ID NO: 1308780 - RNA, 24 nt, Human
cagcacuuagggaggcugaggugg

SEQ ID NO: 1308781 - RNA, 18 nt, Human
cagcucccugagccagaa

SEQ ID NO: 1308782 - RNA, 24 nt, Human
cagggucuggcucuguugcccagg

SEQ ID NO: 1308783 - RNA, 18 nt, Human
cagguauuaggauguacu

SEQ ID NO: 1308784 - RNA, 21 nt, Human
cagguuggacuugaacuccug

SEQ ID NO: 1308785 - RNA, 22 nt, Human
cagugagccgagaucgcaacac

SEQ ID NO: 1308786 - RNA, 21 nt, Human
caguggccugcaugccccacu

SEQ ID NO: 1308787 - RNA, 19 nt, Human
cagugguaucucauuuuug

SEQ ID NO: 1308788 - RNA, 24 nt, Human
cauuauguuccccaggcuggucuc

SEQ ID NO: 1308789 - RNA, 21 nt, Human
cauugcaaucucuaccuccug

SEQ ID NO: 1308790 - RNA, 22 nt, Human
ccaaagugcugggauuacaggc

SEQ ID NO: 1308791 - RNA, 22 nt, Human
ccaaagugcugggauuacaggc

SEQ ID NO: 1308792 - RNA, 24 nt, Human
ccaaagugcugggauuacaggcgu

SEQ ID NO: 1308793 - RNA, 24 nt, Human
ccaaagugcugggauuauaggcau

SEQ ID NO: 1308794 - RNA, 27 nt, Human
ccaccucccaggcuccagcaauccuuu

SEQ ID NO: 1308795 - RNA, 21 nt, Human
ccacugugcccagcccugaau

SEQ ID NO: 1308796 - RNA, 26 nt, Human
ccagcaauccuccugccucauccucc

SEQ ID NO: 1308797 - RNA, 24 nt, Human
ccaggcuccagcaauccuccugcc

SEQ ID NO: 1308798 - RNA, 24 nt, Human
cccaagaauauaaaaauaaaaaua

SEQ ID NO: 1308799 - RNA, 22 nt, Human
cccagagcaccccggcacugcu

SEQ ID NO: 1308800 - RNA, 21 nt, Human
cccaggcuccagcaauccucc

SEQ ID NO: 1308801 - RNA, 22 nt, Human
ccgaaguggugggauuacagcu

SEQ ID NO: 1308802 - RNA, 24 nt, Human
ccgaaguggugggauuacagcuau

SEQ ID NO: 1308803 - RNA, 27 nt, Human
ccuacagguagucccagcuacuccaga

SEQ ID NO: 1308804 - RNA, 19 nt, Human
ccucauccucccaagcagc

SEQ ID NO: 1308805 - RNA, 19 nt, Human
ccucccaccuugaccuccc

SEQ ID NO: 1308806 - RNA, 22 nt, Human
ccucccaccuugaccucccgaa

SEQ ID NO: 1308807 - RNA, 20 nt, Human
ccugaccucaagugauucac

SEQ ID NO: 1308808 - RNA, 20 nt, Human
ccugaccucaagugauucac

SEQ ID NO: 1308809 - RNA, 22 nt, Human
ccugagcaauagagcaagacuc

SEQ ID NO: 1308810 - RNA, 20 nt, Human
ccuggaaucaagggauccgc

SEQ ID NO: 1308811 - RNA, 19 nt, Human
ccugucuagccacucggga

SEQ ID NO: 1308812 - RNA, 21 nt, Human
ccugucuagccacucgggagu

SEQ ID NO: 1308813 - RNA, 24 nt, Human
cgagaucgcaacacugcacuccag

SEQ ID NO: 1308814 - RNA, 22 nt, Human
cgugcugcccagguuggacuug

SEQ ID NO: 1308815 - RNA, 21 nt, Human
cucaagugauucacucgccuc

SEQ ID NO: 1308816 - RNA, 22 nt, Human
cucacaccuguaaucucagcac

SEQ ID NO: 1308817 - RNA, 24 nt, Human
cucacaccuguaaucucagcacuu

SEQ ID NO: 1308818 - RNA, 19 nt, Human
cucauugcaaucucuaccu

SEQ ID NO: 1308819 - RNA, 19 nt, Human
cuccagcaauccuccugcc

SEQ ID NO: 1308820 - RNA, 19 nt, Human
cuccugaccucaagugauu

SEQ ID NO: 1308821 - RNA, 24 nt, Human
cuccugaguagccaggacuacagg

SEQ ID NO: 1308822 - RNA, 21 nt, Human
cucugugcuaagucacccuuc

SEQ ID NO: 1308823 - RNA, 21 nt, Human
cugaaaaagauaauuuacaga

SEQ ID NO: 1308824 - RNA, 20 nt, Human
cugaagggacugauaaggua

SEQ ID NO: 1308825 - RNA, 18 nt, Human
cugcacuccagccugggc

SEQ ID NO: 1308826 - RNA, 19 nt, Human
cugcacuccagccugggca

SEQ ID NO: 1308827 - RNA, 20 nt, Human
cugcacuccagccugggcaa

SEQ ID NO: 1308828 - RNA, 21 nt, Human
cugcacuccagccugggcaaa

SEQ ID NO: 1308829 - RNA, 20 nt, Human
cugcagugagccgagaucgc

SEQ ID NO: 1308830 - RNA, 25 nt, Human
cugccucauccucccaagcagcugg

SEQ ID NO: 1308831 - RNA, 21 nt, Human
cugcugcacuccagccugggc

SEQ ID NO: 1308832 - RNA, 24 nt, Human
cugcugcccuugcagagaucagug

SEQ ID NO: 1308833 - RNA, 18 nt, Human
cuuggccggguguggugg

SEQ ID NO: 1308834 - RNA, 21 nt, Human
gaaccagacagacaugcuccc

SEQ ID NO: 1308835 - RNA, 18 nt, Human
gaaguggugggauuacag

SEQ ID NO: 1308836 - RNA, 24 nt, Human
gaccucaagugauucacucgccuc

SEQ ID NO: 1308837 - RNA, 18 nt, Human
gacuacaggagugagcca

SEQ ID NO: 1308838 - RNA, 24 nt, Human
gagacugcagugagccgagaucgg

SEQ ID NO: 1308839 - RNA, 25 nt, Human
gagcaccccggcacugcugcccuug

SEQ ID NO: 1308840 - RNA, 24 nt, Human
gagccgccacacccagccuuuuug

SEQ ID NO: 1308841 - RNA, 21 nt, Human
gaggugggaggauugcuugag

SEQ ID NO: 1308842 - RNA, 24 nt, Human
gaggugggaggauugcuugagccc

SEQ ID NO: 1308843 - RNA, 25 nt, Human
gaguagccaggacuacaggagugag

SEQ ID NO: 1308844 - RNA, 18 nt, Human
gauuaaguauuuacagug

SEQ ID NO: 1308845 - RNA, 19 nt, Human
gauuacagcuauaaaccac

SEQ ID NO: 1308846 - RNA, 21 nt, Human
gauuacagcuauaaaccacug

SEQ ID NO: 1308847 - RNA, 18 nt, Human
gauuacaggcguaagcca

SEQ ID NO: 1308848 - RNA, 21 nt, Human
gauuacaggcguaagccacca

SEQ ID NO: 1308849 - RNA, 21 nt, Human
gauuauaggcaugagccgcca

SEQ ID NO: 1308850 - RNA, 22 nt, Human
gauuauaggcaugagccgccac

SEQ ID NO: 1308851 - RNA, 24 nt, Human
gauugcuugagcccaggaguugga

SEQ ID NO: 1308852 - RNA, 18 nt, Human
gcaaccuccaccucccag

SEQ ID NO: 1308853 - RNA, 22 nt, Human
gcaaccuccaccucccaggcuc

SEQ ID NO: 1308854 - RNA, 24 nt, Human
gcacuccagccugagcaauagagc

SEQ ID NO: 1308855 - RNA, 20 nt, Human
gcccagguuguagugcagug

SEQ ID NO: 1308856 - RNA, 24 nt, Human
gccugggaggucgagacugcagug

SEQ ID NO: 1308857 - RNA, 21 nt, Human
gcucauugcaaucucuaccuc

SEQ ID NO: 1308858 - RNA, 25 nt, Human
gcugcacuccagccugggcaaaaua

SEQ ID NO: 1308859 - RNA, 24 nt, Human
gcugcugcacuccagccugggcaa

SEQ ID NO: 1308860 - RNA, 23 nt, Human
gcuggucucgaacuccugaccuc

SEQ ID NO: 1308861 - RNA, 18 nt, Human
ggaaaaccccccuugcug

SEQ ID NO: 1308862 - RNA, 22 nt, Human
ggaaccagacagacaugcuccc

SEQ ID NO: 1308863 - RNA, 22 nt, Human
ggacuacaggagugagccacca

SEQ ID NO: 1308864 - RNA, 24 nt, Human
ggacuacaggagugagccaccaug

SEQ ID NO: 1308865 - RNA, 22 nt, Human
ggaguuggagaccagccugggc

SEQ ID NO: 1308866 - RNA, 19 nt, Human
ggauuacaggcguaagcca

SEQ ID NO: 1308867 - RNA, 20 nt, Human
ggcaggaucgauugagccug

SEQ ID NO: 1308868 - RNA, 21 nt, Human
ggcugggcacagugacucaca

SEQ ID NO: 1308869 - RNA, 22 nt, Human
ggcugggcacagugacucacac

SEQ ID NO: 1308870 - RNA, 24 nt, Human
ggcuggucucgaacuccugaccuc

SEQ ID NO: 1308871 - RNA, 21 nt, Human
gggaggcugaggugggaggau

SEQ ID NO: 1308872 - RNA, 24 nt, Human
gggcacagugacucacaccuguaa

SEQ ID NO: 1308873 - RNA, 19 nt, Human
ggggguuucaccauguugg

SEQ ID NO: 1308874 - RNA, 24 nt, Human
ggggguuucaccauguuggcccgg

SEQ ID NO: 1308875 - RNA, 18 nt, Human
gggguuucaccauguugg

SEQ ID NO: 1308876 - RNA, 23 nt, Human
gggguuucaccauguuggcccgg

SEQ ID NO: 1308877 - RNA, 19 nt, Human
ggucucgaacuccugaccu

SEQ ID NO: 1308878 - RNA, 22 nt, Human
guagagacggggguuucaccau

SEQ ID NO: 1308879 - RNA, 23 nt, Human
guagagacggggguuucaccaug

SEQ ID NO: 1308880 - RNA, 19 nt, Human
guuucuuggccgggugugg

SEQ ID NO: 1308881 - RNA, 20 nt, Human
uaaaacuccaguacugauca

SEQ ID NO: 1308882 - RNA, 23 nt, Human
uaaaagauuaccugggccggggc

SEQ ID NO: 1308883 - RNA, 23 nt, Human
uaagauaauacuaaaggugaauu

SEQ ID NO: 1308884 - RNA, 23 nt, Human
uaagcaugauucucuuaggcacu

SEQ ID NO: 1308885 - RNA, 19 nt, Human
uaauaagauaauacuaaag

SEQ ID NO: 1308886 - RNA, 24 nt, Human
uaauuuuaguauuuuggguagaga

SEQ ID NO: 1308887 - RNA, 24 nt, Human
uacagcuauaaaccacugugccca

SEQ ID NO: 1308888 - RNA, 24 nt, Human
uacaggagugagccaccaugccca

SEQ ID NO: 1308889 - RNA, 24 nt, Human
uacaggcguaagccaccacgucca

SEQ ID NO: 1308890 - RNA, 20 nt, Human
uaccugggcgugguggcacg

SEQ ID NO: 1308891 - RNA, 19 nt, Human
uacuccagaggcugaggug

SEQ ID NO: 1308892 - RNA, 21 nt, Human
uagagacggggguuucaccau

SEQ ID NO: 1308893 - RNA, 22 nt, Human
uagagacggggguuucaccaug

SEQ ID NO: 1308894 - RNA, 21 nt, Human
uaggaaggaaccagacagaca

SEQ ID NO: 1308895 - RNA, 20 nt, Human
uaggacagcucccugagcca

SEQ ID NO: 1308896 - RNA, 20 nt, Human
uaucccagagcaccccggca

SEQ ID NO: 1308897 - RNA, 23 nt, Human
uauguuccccaggcuggucucaa

SEQ ID NO: 1308898 - RNA, 24 nt, Human
uauguuccccaggcuggucucaaa

SEQ ID NO: 1308899 - RNA, 20 nt, Human
uauuaguaucuucaacaacc

SEQ ID NO: 1308900 - RNA, 19 nt, Human
ucauugcaaucucuaccuc

SEQ ID NO: 1308901 - RNA, 22 nt, Human
ucauugcaaucucuaccuccug

SEQ ID NO: 1308902 - RNA, 25 nt, Human
ucauugcaaucucuaccuccugagc

SEQ ID NO: 1308903 - RNA, 24 nt, Human
ucccaaagugcugggauuacaggc

SEQ ID NO: 1308904 - RNA, 24 nt, Human
ucccaaagugcugggauuauaggc

SEQ ID NO: 1308905 - RNA, 21 nt, Human
ucccaggcuccagcaauccuc

SEQ ID NO: 1308906 - RNA, 25 nt, Human
uccccaggcuggucucaaacuccug

SEQ ID NO: 1308907 - RNA, 22 nt, Human
ucccgaaguggugggauuacag

SEQ ID NO: 1308908 - RNA, 18 nt, Human
ucccugagccagaagacu

SEQ ID NO: 1308909 - RNA, 18 nt, Human
ucccuguggggugaaacu

SEQ ID NO: 1308910 - RNA, 24 nt, Human
uccuccugccucauccucccaagc

SEQ ID NO: 1308911 - RNA, 20 nt, Human
ucgcaacacugcacuccagc

SEQ ID NO: 1308912 - RNA, 24 nt, Human
ucgccucggacucccaaagugcug

SEQ ID NO: 1308913 - RNA, 19 nt, Human
ucggacucccaaagugcug

SEQ ID NO: 1308914 - RNA, 21 nt, Human
ucucaaacuccugggcuaaag

SEQ ID NO: 1308915 - RNA, 24 nt, Human
ucucauuauguuccccaggcuggu

SEQ ID NO: 1308916 - RNA, 21 nt, Human
ucucgaacuccugaccucaag

SEQ ID NO: 1308917 - RNA, 20 nt, Human
ucucggccucccaaagugcu

SEQ ID NO: 1308918 - RNA, 19 nt, Human
ucuggcucuguugcccagg

SEQ ID NO: 1308919 - RNA, 24 nt, Human
ucuggcucuguugcccagguugua

SEQ ID NO: 1308920 - RNA, 21 nt, Human
ucuucgugcugcccagguugg

SEQ ID NO: 1308921 - RNA, 22 nt, Human
ucuucgugcugcccagguugga

SEQ ID NO: 1308922 - RNA, 20 nt, Human
ugaccucaagugauucacuc

SEQ ID NO: 1308923 - RNA, 24 nt, Human
ugaccucaagugauucacucgccu

SEQ ID NO: 1308924 - RNA, 22 nt, Human
ugacucacaccuguaaucucag

SEQ ID NO: 1308925 - RNA, 24 nt, Human
ugacucacaccuguaaucucagca

SEQ ID NO: 1308926 - RNA, 22 nt, Human
ugagacagggucuggcucuguu

SEQ ID NO: 1308927 - RNA, 22 nt, Human
ugagaccccaagaauauaaaaa

SEQ ID NO: 1308928 - RNA, 23 nt, Human
ugagcccaggaguuggagaccag

SEQ ID NO: 1308929 - RNA, 18 nt, Human
ugagccugggaggucgag

SEQ ID NO: 1308930 - RNA, 24 nt, Human
ugagccugggaggucgagacugca

SEQ ID NO: 1308931 - RNA, 18 nt, Human
ugaggaaaggagaaauag

SEQ ID NO: 1308932 - RNA, 24 nt, Human
ugagguggcaggaucgauugagcc

SEQ ID NO: 1308933 - RNA, 20 nt, Human
ugaggugggaggauugcuug

SEQ ID NO: 1308934 - RNA, 22 nt, Human
ugaggugggaggauugcuugag

SEQ ID NO: 1308935 - RNA, 23 nt, Human
ugaggugggaggauugcuugagc

SEQ ID NO: 1308936 - RNA, 24 nt, Human
ugaggugggaggauugcuugagcc

SEQ ID NO: 1308937 - RNA, 24 nt, Human
ugaguagccaggacuacaggagug

SEQ ID NO: 1308938 - RNA, 20 nt, Human
ugcaaccuccaccucccagg

SEQ ID NO: 1308939 - RNA, 22 nt, Human
ugcagagaucaguggccugcau

SEQ ID NO: 1308940 - RNA, 24 nt, Human
ugcccagguuggacuugaacuccu

SEQ ID NO: 1308941 - RNA, 24 nt, Human
ugccccacuuguugaaccucucug

SEQ ID NO: 1308942 - RNA, 22 nt, Human
ugcccuugcagagaucaguggc

SEQ ID NO: 1308943 - RNA, 24 nt, Human
ugccucauccucccaagcagcugg

SEQ ID NO: 1308944 - RNA, 28 nt, Human
ugccucauccucccaagcagcugggacu

SEQ ID NO: 1308945 - RNA, 20 nt, Human
ugcugcacuccagccugggc

SEQ ID NO: 1308946 - RNA, 24 nt, Human
ugcugggauuacaggcguaagcca

SEQ ID NO: 1308947 - RNA, 24 nt, Human
uggcacaaucuuggcucauugcaa

SEQ ID NO: 1308948 - RNA, 26 nt, Human
uggcacgcaccuacagguagucccag

SEQ ID NO: 1308949 - RNA, 24 nt, Human
uggcccggcuggucucgaacuccu

SEQ ID NO: 1308950 - RNA, 24 nt, Human
ugggaggucgagacugcagugagc

SEQ ID NO: 1308951 - RNA, 22 nt, Human
ugggauuacagcuauaaaccac

SEQ ID NO: 1308952 - RNA, 24 nt, Human
ugggauuacagcuauaaaccacug

SEQ ID NO: 1308953 - RNA, 18 nt, Human
ugggauuacaggcguaag

SEQ ID NO: 1308954 - RNA, 19 nt, Human
ugggauuacaggcguaagc

SEQ ID NO: 1308955 - RNA, 22 nt, Human
ugggauuacaggcguaagccac

SEQ ID NO: 1308956 - RNA, 24 nt, Human
ugggauuacaggcguaagccacca

SEQ ID NO: 1308957 - RNA, 18 nt, Human
ugggauuauaggcaugag

SEQ ID NO: 1308958 - RNA, 19 nt, Human
ugggauuauaggcaugagc

SEQ ID NO: 1308959 - RNA, 21 nt, Human
ugggauuauaggcaugagccg

SEQ ID NO: 1308960 - RNA, 22 nt, Human
ugggauuauaggcaugagccgc

SEQ ID NO: 1308961 - RNA, 23 nt, Human
ugggauuauaggcaugagccgcc

SEQ ID NO: 1308962 - RNA, 24 nt, Human
ugggauuauaggcaugagccgcca

SEQ ID NO: 1308963 - RNA, 22 nt, Human
ugggcaaaauagugagacccca

SEQ ID NO: 1308964 - RNA, 25 nt, Human
uguagagacggggguuucaccaugu

SEQ ID NO: 1308965 - RNA, 24 nt, Human
uguagugcaguggcacaaucuugg

SEQ ID NO: 1308966 - RNA, 24 nt, Human
uuaagccauccuuccacuuauccu

SEQ ID NO: 1308967 - RNA, 24 nt, Human
uuaauuaaauaaaauaaaacucca

SEQ ID NO: 1308968 - RNA, 18 nt, Human
uuaccugggcgugguggc

SEQ ID NO: 1308969 - RNA, 20 nt, Human
uuagcuaacacagugguuaa

SEQ ID NO: 1308970 - RNA, 20 nt, Human
uuagggaggcugagguggga

SEQ ID NO: 1308971 - RNA, 23 nt, Human
uucaccuucucaacugucuucaa

SEQ ID NO: 1308972 - RNA, 23 nt, Human
uucagccugcaaauagcugcugc

SEQ ID NO: 1308973 - RNA, 21 nt, Human
uuccugaagggcuggaugagg

SEQ ID NO: 1308974 - RNA, 22 nt, Human
uugagacagggucuggcucugu

SEQ ID NO: 1308975 - RNA, 25 nt, Human
uugagacagggucuggcucuguugc

SEQ ID NO: 1308976 - RNA, 18 nt, Human
uugcaaccuccaccuccc

SEQ ID NO: 1308977 - RNA, 23 nt, Human
uugcaaccuccaccucccaggcu

SEQ ID NO: 1308978 - RNA, 21 nt, Human
uugcuugagcccaggaguugg

SEQ ID NO: 1308979 - RNA, 25 nt, Human
uuguagagacggggguuucaccaug

SEQ ID NO: 1308980 - RNA, 28 nt, Human
uuguugaaccucucugugcuuggacccc

SEQ ID NO: 1308981 - RNA, 21 nt, Human
uuucaccauguuggcccggcu

SEQ ID NO: 1308982 - RNA, 24 nt, Human
uuucuucgugcugcccagguugga

SEQ ID NO: 1308983 - RNA, 19 nt, Human
uuucuuuuuuuacagaugg

SEQ ID NO: 1308984 - RNA, 24 nt, Human
uuugcaaccuccaccucccaggcu

SEQ ID NO: 1308985 - RNA, 25 nt, Human
uuuguagagacggggguuucaccau

SEQ ID NO: 1308986 - RNA, 24 nt, Human
uuuguucaccuucucaacugucuu

SEQ ID NO: 1308987 - RNA, 26 nt, Human
uuuucuuuuuuuacagaugggucuca

SEQ ID NO: 1308988 - RNA, 24 nt, Human
uuuuugcaaccuccaccucccagg

SEQ ID NO: 1308989 - RNA, 25 nt, Human
uuuuuuguagagacggggguuucac

SEQ ID NO: 1308990 - RNA, 23 nt, Human
uuuuuuuuugagacagggucugg

SEQ ID NO: 1308991 - RNA, 23 nt, Human
uuuuuuuuuuuugagacaggguc

SEQ ID NO: 1308992 - RNA, 25 nt, Human
uuuuuuuuuuuuuuuugagacaggg

SEQ ID NO: 1308993 - RNA, 31 nt, Human
uuuuuuuuuuuuuuuugagacagggucuggg

SEQ ID NO: 1308994 - RNA, 23 nt, Human
caccaaugguacccccaaauuca

SEQ ID NO: 1308995 - RNA, 25 nt, Human
ccaccaaugguacccccaaauucac

SEQ ID NO: 1308996 - RNA, 24 nt, Human
ugaaauaccaccaaugguaccccc

SEQ ID NO: 1308997 - RNA, 22 nt, Human
ugcagaaccugaaauaccacca

SEQ ID NO: 1308998 - RNA, 21 nt, Human
acacagcaggcccggcgggcc

SEQ ID NO: 1308999 - RNA, 20 nt, Human
acacggcucuugcuaacacc

SEQ ID NO: 1309000 - RNA, 23 nt, Human
acacggcucuugcuaacaccucu

SEQ ID NO: 1309001 - RNA, 23 nt, Human
agcacacggcucuugcuaacacc

SEQ ID NO: 1309002 - RNA, 20 nt, Human
agcuggggacagagagggug

SEQ ID NO: 1309003 - RNA, 27 nt, Human
aggaggcccaggccugggccguagccc

SEQ ID NO: 1309004 - RNA, 19 nt, Human
caagcuggcagacccugcc

SEQ ID NO: 1309005 - RNA, 25 nt, Human
cagcagcaggaggcccaggccuggg

SEQ ID NO: 1309006 - RNA, 20 nt, Human
ccacagaaacucugacacag

SEQ ID NO: 1309007 - RNA, 19 nt, Human
ccaggccccuggucggagg

SEQ ID NO: 1309008 - RNA, 19 nt, Human
ccccuggucggaggggugg

SEQ ID NO: 1309009 - RNA, 20 nt, Human
ccuggaguuagagcaguggc

SEQ ID NO: 1309010 - RNA, 24 nt, Human
cucaaagagagacuuccucaaaga

SEQ ID NO: 1309011 - RNA, 26 nt, Human
cucaaagggagguccucaaagagaga

SEQ ID NO: 1309012 - RNA, 23 nt, Human
cugacacagcaggcccggcgggc

SEQ ID NO: 1309013 - RNA, 21 nt, Human
gcaaugcccgcccuggccaga

SEQ ID NO: 1309014 - RNA, 21 nt, Human
gcagcaggaggcccaggccug

SEQ ID NO: 1309015 - RNA, 20 nt, Human
ggacagagagggugugggga

SEQ ID NO: 1309016 - RNA, 18 nt, Human
uaaaagaggcagcaaugc

SEQ ID NO: 1309017 - RNA, 20 nt, Human
uaaaagaggcagcaaugccc

SEQ ID NO: 1309018 - RNA, 24 nt, Human
ucaaagagagacuuccucaaagau

SEQ ID NO: 1309019 - RNA, 23 nt, Human
ucccccggccacagaaacucuga

SEQ ID NO: 1309020 - RNA, 19 nt, Human
ucccggggcugagucaccc

SEQ ID NO: 1309021 - RNA, 23 nt, Human
ugaccccucagccuuuucuuccc

SEQ ID NO: 1309022 - RNA, 23 nt, Human
uggaguuagagcaguggcccccg

SEQ ID NO: 1309023 - RNA, 19 nt, Human
ugggucagcagcaggaggc

SEQ ID NO: 1309024 - RNA, 22 nt, Human
gcacagguaggagcauguccuc

SEQ ID NO: 1309025 - RNA, 28 nt, Human
uaggagcauguccucugcguggccucug

SEQ ID NO: 1309026 - RNA, 19 nt, Human
uccaggaggcaccccaggc

SEQ ID NO: 1309027 - RNA, 21 nt, Human
ugcguggccucugcacuggaa

SEQ ID NO: 1309028 - RNA, 21 nt, Human
aaacaaguucuccgugcccuu

SEQ ID NO: 1309029 - RNA, 20 nt, Human
aaagccuuggagaucucaca

SEQ ID NO: 1309030 - RNA, 24 nt, Human
auguacugguguauaugugugugu

SEQ ID NO: 1309031 - RNA, 19 nt, Human
cagcagggcgggugugcuc

SEQ ID NO: 1309032 - RNA, 19 nt, Human
ccacucggggggagggcgg

SEQ ID NO: 1309033 - RNA, 18 nt, Human
ccuucuuuagacuaugcu

SEQ ID NO: 1309034 - RNA, 19 nt, Human
cgaggacgccacucggggg

SEQ ID NO: 1309035 - RNA, 23 nt, Human
cucucccaucccagcagugacug

SEQ ID NO: 1309036 - RNA, 24 nt, Human
gaaaacagcugugcacagcagggc

SEQ ID NO: 1309037 - RNA, 20 nt, Human
guguauguacugguguauau

SEQ ID NO: 1309038 - RNA, 22 nt, Human
uaagagacacacaagcaaacga

SEQ ID NO: 1309039 - RNA, 18 nt, Human
uagaaaacagcugugcac

SEQ ID NO: 1309040 - RNA, 22 nt, Human
ucucuauauuagaaaacagcug

SEQ ID NO: 1309041 - RNA, 22 nt, Human
uguaagagacacacaagcaaac

SEQ ID NO: 1309042 - RNA, 19 nt, Human
uguauguacugguguauau

SEQ ID NO: 1309043 - RNA, 22 nt, Human
uguguguaugucgguguaugua

SEQ ID NO: 1309044 - RNA, 21 nt, Human
uucuuuagacuaugcuaguug

SEQ ID NO: 1309045 - RNA, 19 nt, Human
aggcucucccaggccacau

SEQ ID NO: 1309046 - RNA, 21 nt, Human
cacuccuugcuuggcguccuc

SEQ ID NO: 1309047 - RNA, 21 nt, Human
cagaaucaccacuccuugcuu

SEQ ID NO: 1309048 - RNA, 23 nt, Human
cauucgagcccgucuacccccag

SEQ ID NO: 1309049 - RNA, 18 nt, Human
ccccuaggcucucccagg

SEQ ID NO: 1309050 - RNA, 21 nt, Human
ccccuggggcccccuaggcuc

SEQ ID NO: 1309051 - RNA, 20 nt, Human
cccuccaaagccagcacucc

SEQ ID NO: 1309052 - RNA, 20 nt, Human
cccuggggcccccuaggcuc

SEQ ID NO: 1309053 - RNA, 21 nt, Human
ccucuugccucccccucguaa

SEQ ID NO: 1309054 - RNA, 21 nt, Human
ccugcaggugcaggguggugg

SEQ ID NO: 1309055 - RNA, 23 nt, Human
cgagcccgucuacccccagcuga

SEQ ID NO: 1309056 - RNA, 18 nt, Human
gaaguuuaaaggcucaca

SEQ ID NO: 1309057 - RNA, 21 nt, Human
gcacuccugugccaaagcccc

SEQ ID NO: 1309058 - RNA, 22 nt, Human
gccucccccucguaauuaguuc

SEQ ID NO: 1309059 - RNA, 20 nt, Human
ggaggugugggcagaggacc

SEQ ID NO: 1309060 - RNA, 21 nt, Human
ucccaggccacauucgagccc

SEQ ID NO: 1309061 - RNA, 21 nt, Human
ucccuccaaagccagcacucc

SEQ ID NO: 1309062 - RNA, 24 nt, Human
ucccuccuagggcacugucugugu

SEQ ID NO: 1309063 - RNA, 22 nt, Human
ugaaggccacagucccuccaaa

SEQ ID NO: 1309064 - RNA, 18 nt, Human
ugccaaagccccugcagg

SEQ ID NO: 1309065 - RNA, 18 nt, Human
ugugccaaagccccugca

SEQ ID NO: 1309066 - RNA, 26 nt, Human
aggcuuuaaggaauuuuauuccugau

SEQ ID NO: 1309067 - RNA, 22 nt, Human
ccagggaagugcugaugaaaau

SEQ ID NO: 1309068 - RNA, 26 nt, Human
ugauucaagugcugcgaaaauguuga

SEQ ID NO: 1309069 - RNA, 20 nt, Human
agcccuuucacaguugaccu

SEQ ID NO: 1309070 - RNA, 20 nt, Human
ugagauuuuugaaaucugga

SEQ ID NO: 1309071 - RNA, 21 nt, Human
aaguagccucgaugugaaagu

SEQ ID NO: 1309072 - RNA, 18 nt, Human
aagucacagucgggacac

SEQ ID NO: 1309073 - RNA, 18 nt, Human
acaaagaaggaccccagg

SEQ ID NO: 1309074 - RNA, 19 nt, Human
acacugguuccugucacug

SEQ ID NO: 1309075 - RNA, 21 nt, Human
accagccccucuguccuccug

SEQ ID NO: 1309076 - RNA, 23 nt, Human
agagaagccacaccugagaccag

SEQ ID NO: 1309077 - RNA, 18 nt, Human
agcacaaagaaggacccc

SEQ ID NO: 1309078 - RNA, 22 nt, Human
agccacaccugagaccagcccc

SEQ ID NO: 1309079 - RNA, 20 nt, Human
caaagaaggaccccaggaca

SEQ ID NO: 1309080 - RNA, 21 nt, Human
cagccccucuguccuccugcc

SEQ ID NO: 1309081 - RNA, 21 nt, Human
cggugcagacgggagcacaga

SEQ ID NO: 1309082 - RNA, 18 nt, Human
cuccugccucugcaugca

SEQ ID NO: 1309083 - RNA, 24 nt, Human
gaaauccuaucacguccucaggcu

SEQ ID NO: 1309084 - RNA, 18 nt, Human
ggagcacagagaggguga

SEQ ID NO: 1309085 - RNA, 18 nt, Human
ggugcagcacaaagaagg

SEQ ID NO: 1309086 - RNA, 20 nt, Human
gucacagucgggacacuggu

SEQ ID NO: 1309087 - RNA, 21 nt, Human
guccuugugugucccugaggg

SEQ ID NO: 1309088 - RNA, 22 nt, Human
ucccugcaggaggcagaagggg

SEQ ID NO: 1309089 - RNA, 25 nt, Human
ucugcaugcagcgucccugcaggag

SEQ ID NO: 1309090 - RNA, 20 nt, Human
ugaaauccuaucacguccuc

SEQ ID NO: 1309091 - RNA, 23 nt, Human
ugagaccagccccucuguccucc

SEQ ID NO: 1309092 - RNA, 18 nt, Human
ugagagaagccacaccug

SEQ ID NO: 1309093 - RNA, 18 nt, Human
ugaggaggauggagaugg

SEQ ID NO: 1309094 - RNA, 19 nt, Human
uggggcgggaaugaaaucc

SEQ ID NO: 1309095 - RNA, 19 nt, Human
uggggugcacaggcagcuu

SEQ ID NO: 1309096 - RNA, 23 nt, Human
aaacaaaaaaaugcaugcucuaa

SEQ ID NO: 1309097 - RNA, 24 nt, Human
aaacaaaaaaaugcaugcucuaau

SEQ ID NO: 1309098 - RNA, 21 nt, Human
aagaaagaaaauaauggcaga

SEQ ID NO: 1309099 - RNA, 22 nt, Human
aagaaagcaaacaaaaaaaugc

SEQ ID NO: 1309100 - RNA, 20 nt, Human
acaguuugagaucguuuucc

SEQ ID NO: 1309101 - RNA, 23 nt, Human
agaaagcaaacaaaaaaaugcau

SEQ ID NO: 1309102 - RNA, 21 nt, Human
aucaagauucccacaguuuga

SEQ ID NO: 1309103 - RNA, 25 nt, Human
cacaguuugagaucguuuuccaucc

SEQ ID NO: 1309104 - RNA, 20 nt, Human
gaaagcaaacaaaaaaaugc

SEQ ID NO: 1309105 - RNA, 20 nt, Human
uaaagaaagaaaauaauggc

SEQ ID NO: 1309106 - RNA, 23 nt, Human
ugaaaagaaagcaaacaaaaaaa

SEQ ID NO: 1309107 - RNA, 19 nt, Human
uuugagaucguuuuccauc

SEQ ID NO: 1309108 - RNA, 20 nt, Human
gcugucacuuggucucugcc

SEQ ID NO: 1309109 - RNA, 24 nt, Human
uauagcccuaaaguuaaaagcaag

SEQ ID NO: 1309110 - RNA, 20 nt, Human
ucagugugagugcguuuggg

SEQ ID NO: 1309111 - RNA, 22 nt, Human
uggcugucacuuggucucugcc

SEQ ID NO: 1309112 - RNA, 19 nt, Human
uggggcagguccaacuggc

SEQ ID NO: 1309113 - RNA, 23 nt, Human
uggggcagguccaacuggcuguc

SEQ ID NO: 1309114 - RNA, 24 nt, Human
uucaaauuggucaguaaauuggaa

SEQ ID NO: 1309115 - RNA, 26 nt, Human
uuccagaaauaacugacgauugucuu

SEQ ID NO: 1309116 - RNA, 18 nt, Human
uuggggcagguccaacug

SEQ ID NO: 1309117 - RNA, 22 nt, Human
uuggggcagguccaacuggcug

SEQ ID NO: 1309118 - RNA, 22 nt, Human
aaacaggccaagaaauguccac

SEQ ID NO: 1309119 - RNA, 24 nt, Human
aaagugcugggauuacagguguga

SEQ ID NO: 1309120 - RNA, 24 nt, Human
aagaaaacccacaggaaaacaggc

SEQ ID NO: 1309121 - RNA, 19 nt, Human
aaguagcugggacuacaga

SEQ ID NO: 1309122 - RNA, 26 nt, Human
aaguagcugggacuacagaugccugc

SEQ ID NO: 1309123 - RNA, 18 nt, Human
aagugcugggauuacagg

SEQ ID NO: 1309124 - RNA, 19 nt, Human
aagugcugggauuacaggu

SEQ ID NO: 1309125 - RNA, 26 nt, Human
aagugcugggauuacaggugugaacc

SEQ ID NO: 1309126 - RNA, 18 nt, Human
acucugucacccaggcug

SEQ ID NO: 1309127 - RNA, 25 nt, Human
acucugucacccaggcuggagugua

SEQ ID NO: 1309128 - RNA, 23 nt, Human
acugugaguccucuuucccacuc

SEQ ID NO: 1309129 - RNA, 20 nt, Human
agaugccugccaucacgccc

SEQ ID NO: 1309130 - RNA, 25 nt, Human
aggugauccucccacuucagcuucc

SEQ ID NO: 1309131 - RNA, 19 nt, Human
aggugugaaccacugugcc

SEQ ID NO: 1309132 - RNA, 21 nt, Human
agugacgaggcagccaaauga

SEQ ID NO: 1309133 - RNA, 20 nt, Human
aguguaguggcacgaucaug

SEQ ID NO: 1309134 - RNA, 23 nt, Human
auaucaugcugaagaaaacccac

SEQ ID NO: 1309135 - RNA, 18 nt, Human
aucucacucugucaccca

SEQ ID NO: 1309136 - RNA, 24 nt, Human
auggucagcuggcuaacugugagu

SEQ ID NO: 1309137 - RNA, 21 nt, Human
caaagguaaauacccaaccca

SEQ ID NO: 1309138 - RNA, 24 nt, Human
caaagugcugggauuacaggugug

SEQ ID NO: 1309139 - RNA, 20 nt, Human
caagcuccugagcucagucu

SEQ ID NO: 1309140 - RNA, 24 nt, Human
caagcuccugagcucagucugccu

SEQ ID NO: 1309141 - RNA, 23 nt, Human
cacucugucacccaggcuggagu

SEQ ID NO: 1309142 - RNA, 24 nt, Human
cacucugucacccaggcuggagug

SEQ ID NO: 1309143 - RNA, 24 nt, Human
cacuucagcuucccaaguagcugg

SEQ ID NO: 1309144 - RNA, 26 nt, Human
caggccaagaaauguccacugcauga

SEQ ID NO: 1309145 - RNA, 19 nt, Human
caugucauguguguacaac

SEQ ID NO: 1309146 - RNA, 23 nt, Human
cauguugcccaggcuggucucaa

SEQ ID NO: 1309147 - RNA, 24 nt, Human
cauguugcccaggcuggucucaag

SEQ ID NO: 1309148 - RNA, 20 nt, Human
cauuugggguuccucugcuc

SEQ ID NO: 1309149 - RNA, 21 nt, Human
ccaaagugcugggauuacagg

SEQ ID NO: 1309150 - RNA, 21 nt, Human
ccaaagugcugggauuacagg

SEQ ID NO: 1309151 - RNA, 24 nt, Human
ccaaagugcugggauuacaggugu

SEQ ID NO: 1309152 - RNA, 21 nt, Human
ccacaggaaaacaggccaaga

SEQ ID NO: 1309153 - RNA, 24 nt, Human
ccaccuccagagcucaggugaucc

SEQ ID NO: 1309154 - RNA, 25 nt, Human
ccaggccaagggugaucuuuaaaca

SEQ ID NO: 1309155 - RNA, 19 nt, Human
ccauguugcccaggcuggu

SEQ ID NO: 1309156 - RNA, 22 nt, Human
cccaagaaucaccuuuaaaaca

SEQ ID NO: 1309157 - RNA, 23 nt, Human
cccaagaaucaccuuuaaaacaa

SEQ ID NO: 1309158 - RNA, 23 nt, Human
cccaaguagcugggacuacagau

SEQ ID NO: 1309159 - RNA, 23 nt, Human
ccucccacuucagcuucccaagu

SEQ ID NO: 1309160 - RNA, 21 nt, Human
cuaggccucccaaagugcugg

SEQ ID NO: 1309161 - RNA, 24 nt, Human
cucacucugucacccaggcuggag

SEQ ID NO: 1309162 - RNA, 24 nt, Human
cucaggugauccucccacuucagc

SEQ ID NO: 1309163 - RNA, 23 nt, Human
cugaacuuuaaucaucuuuagca

SEQ ID NO: 1309164 - RNA, 22 nt, Human
cugugaguccucuuucccacuc

SEQ ID NO: 1309165 - RNA, 20 nt, Human
gaagaaaacccacaggaaaa

SEQ ID NO: 1309166 - RNA, 20 nt, Human
gagacaggaucucacucugu

SEQ ID NO: 1309167 - RNA, 24 nt, Human
gagcucaggugauccucccacuuc

SEQ ID NO: 1309168 - RNA, 24 nt, Human
gagugaccgcugcuacaggucacu

SEQ ID NO: 1309169 - RNA, 19 nt, Human
gauuacaggugugaaccac

SEQ ID NO: 1309170 - RNA, 21 nt, Human
gauuacaggugugaaccacug

SEQ ID NO: 1309171 - RNA, 20 nt, Human
gccauguugcccaggcuggu

SEQ ID NO: 1309172 - RNA, 23 nt, Human
gggguuccucugcucagccgcug

SEQ ID NO: 1309173 - RNA, 25 nt, Human
gggugauuuuuuuuuuuuuuugaga

SEQ ID NO: 1309174 - RNA, 22 nt, Human
ggguuuuugccauguugcccag

SEQ ID NO: 1309175 - RNA, 23 nt, Human
ggguuuuugccauguugcccagg

SEQ ID NO: 1309176 - RNA, 21 nt, Human
ggucagcuggcuaacugugag

SEQ ID NO: 1309177 - RNA, 21 nt, Human
gguuccucugcucagccgcug

SEQ ID NO: 1309178 - RNA, 24 nt, Human
guggguuuuugccauguugcccag

SEQ ID NO: 1309179 - RNA, 23 nt, Human
uaauuuuuguacuuuuuguagag

SEQ ID NO: 1309180 - RNA, 24 nt, Human
uaauuuuuguacuuuuuguagagg

SEQ ID NO: 1309181 - RNA, 21 nt, Human
uacagaccaugaauuaacaaa

SEQ ID NO: 1309182 - RNA, 22 nt, Human
uagagguggguuuuugccaugu

SEQ ID NO: 1309183 - RNA, 21 nt, Human
uaguagcccauggucuauucu

SEQ ID NO: 1309184 - RNA, 24 nt, Human
uauuauuucgcacacucugaaaug

SEQ ID NO: 1309185 - RNA, 18 nt, Human
ucaagcuccugagcucag

SEQ ID NO: 1309186 - RNA, 24 nt, Human
ucacccaggcuggaguguaguggc

SEQ ID NO: 1309187 - RNA, 24 nt, Human
ucacucugucacccaggcuggagu

SEQ ID NO: 1309188 - RNA, 19 nt, Human
ucauggcagccuccaccuc

SEQ ID NO: 1309189 - RNA, 22 nt, Human
ucauggcagccuccaccuccag

SEQ ID NO: 1309190 - RNA, 19 nt, Human
uccacaauuaaauaagaga

SEQ ID NO: 1309191 - RNA, 23 nt, Human
ucccaaagugcugggauuacagg

SEQ ID NO: 1309192 - RNA, 18 nt, Human
ucccaaguagcugggacu

SEQ ID NO: 1309193 - RNA, 20 nt, Human
ucucaagcuccugagcucag

SEQ ID NO: 1309194 - RNA, 23 nt, Human
ucucacucugucacccaggcugg

SEQ ID NO: 1309195 - RNA, 24 nt, Human
ucucacucugucacccaggcugga

SEQ ID NO: 1309196 - RNA, 26 nt, Human
ucucacucugucacccaggcuggagu

SEQ ID NO: 1309197 - RNA, 27 nt, Human
ucucacucugucacccaggcuggagug

SEQ ID NO: 1309198 - RNA, 24 nt, Human
ucugucacccaggcuggaguguag

SEQ ID NO: 1309199 - RNA, 20 nt, Human
ugagacaggaucucacucug

SEQ ID NO: 1309200 - RNA, 22 nt, Human
ugagacaggaucucacucuguc

SEQ ID NO: 1309201 - RNA, 19 nt, Human
ugaguccucuuucccacuc

SEQ ID NO: 1309202 - RNA, 24 nt, Human
ugccauguugcccaggcuggucuc

SEQ ID NO: 1309203 - RNA, 24 nt, Human
ugcccaggcuggucucaagcuccu

SEQ ID NO: 1309204 - RNA, 28 nt, Human
ugcccaggcuggucucaagcuccugagc

SEQ ID NO: 1309205 - RNA, 23 nt, Human
ugcugggauuacaggugugaacc

SEQ ID NO: 1309206 - RNA, 24 nt, Human
uggaacuucagucauggucagcug

SEQ ID NO: 1309207 - RNA, 21 nt, Human
uggaguguaguggcacgauca

SEQ ID NO: 1309208 - RNA, 24 nt, Human
uggaguguaguggcacgaucaugg

SEQ ID NO: 1309209 - RNA, 18 nt, Human
uggcagccuccaccucca

SEQ ID NO: 1309210 - RNA, 22 nt, Human
uggcagccuccaccuccagagc

SEQ ID NO: 1309211 - RNA, 22 nt, Human
uggcucauggcagccuccaccu

SEQ ID NO: 1309212 - RNA, 21 nt, Human
ugggacuacagaugccugcca

SEQ ID NO: 1309213 - RNA, 24 nt, Human
ugggacuacagaugccugccauca

SEQ ID NO: 1309214 - RNA, 22 nt, Human
ugggauuacaggugugaaccac

SEQ ID NO: 1309215 - RNA, 22 nt, Human
ugggauuacaggugugaaccac

SEQ ID NO: 1309216 - RNA, 22 nt, Human
ugggauuacaggugugaaccac

SEQ ID NO: 1309217 - RNA, 24 nt, Human
ugggauuacaggugugaaccacug

SEQ ID NO: 1309218 - RNA, 30 nt, Human
ugggauuacaggugugaaccacugugccaa

SEQ ID NO: 1309219 - RNA, 19 nt, Human
uggguuuuugccauguugc

SEQ ID NO: 1309220 - RNA, 24 nt, Human
uggguuuuugccauguugcccagg

SEQ ID NO: 1309221 - RNA, 24 nt, Human
uguagagguggguuuuugccaugu

SEQ ID NO: 1309222 - RNA, 23 nt, Human
uguaguggcacgaucauggcuca

SEQ ID NO: 1309223 - RNA, 18 nt, Human
uguccaagucauuugggg

SEQ ID NO: 1309224 - RNA, 23 nt, Human
uuaacaaaugucuucaaacccaa

SEQ ID NO: 1309225 - RNA, 24 nt, Human
uucagcuucccaaguagcugggac

SEQ ID NO: 1309226 - RNA, 25 nt, Human
uuuguacuuuuuguagagguggguu

SEQ ID NO: 1309227 - RNA, 24 nt, Human
uuuguagagguggguuuuugccau

SEQ ID NO: 1309228 - RNA, 21 nt, Human
uuuucuagacaaagguaaaua

SEQ ID NO: 1309229 - RNA, 23 nt, Human
uuuugccauguugcccaggcugg

SEQ ID NO: 1309230 - RNA, 23 nt, Human
uuuuugccauguugcccaggcug

SEQ ID NO: 1309231 - RNA, 24 nt, Human
uuuuugccauguugcccaggcugg

SEQ ID NO: 1309232 - RNA, 22 nt, Human
uuuuuuuuuuugagacaggauc

SEQ ID NO: 1309233 - RNA, 20 nt, Human
uuuuuuuuuuugagacaggg

SEQ ID NO: 1309234 - RNA, 26 nt, Human
uuuuuuuuuuuugagacaggaucuca

SEQ ID NO: 1309235 - RNA, 19 nt, Human
aaaacaggguaagcacaug

SEQ ID NO: 1309236 - RNA, 18 nt, Human
acuggggcaggcaggcgg

SEQ ID NO: 1309237 - RNA, 21 nt, Human
agcaagcugucagcagggcag

SEQ ID NO: 1309238 - RNA, 22 nt, Human
aggcaggcggcacagcaagcug

SEQ ID NO: 1309239 - RNA, 22 nt, Human
augggcaaaacaggguaagcac

SEQ ID NO: 1309240 - RNA, 19 nt, Human
caggguaagcacaugggcc

SEQ ID NO: 1309241 - RNA, 20 nt, Human
ccgccacguccagggcccgc

SEQ ID NO: 1309242 - RNA, 25 nt, Human
ccgccacguccagggcccgcucccc

SEQ ID NO: 1309243 - RNA, 24 nt, Human
ggcauugacccgcaacacugagcu

SEQ ID NO: 1309244 - RNA, 18 nt, Human
gggcaggagaccggcagg

SEQ ID NO: 1309245 - RNA, 24 nt, Human
gugcaguuacgugcuagaugcucc

SEQ ID NO: 1309246 - RNA, 22 nt, Human
ucugccgccacguccagggccc

SEQ ID NO: 1309247 - RNA, 21 nt, Human
ucuucaugggcaaaacagggu

SEQ ID NO: 1309248 - RNA, 20 nt, Human
ugccgccacguccagggccc

SEQ ID NO: 1309249 - RNA, 19 nt, Human
uugguggugagggcgugca

SEQ ID NO: 1309250 - RNA, 20 nt, Human
uugguggugagggcgugcaa

SEQ ID NO: 1309251 - RNA, 19 nt, Human
acacacuucaggaucacgc

SEQ ID NO: 1309252 - RNA, 18 nt, Human
ugaaauaaaaguauacac

SEQ ID NO: 1309253 - RNA, 21 nt, Human
ugaauugaagaaaaaaggcca

SEQ ID NO: 1309254 - RNA, 20 nt, Human
ugagaaacgaacacacacac

SEQ ID NO: 1309255 - RNA, 21 nt, Human
uuugaauugaagaaaaaaggc

SEQ ID NO: 1309256 - RNA, 19 nt, Human
aaaaaacuuccaugcccuu

SEQ ID NO: 1309257 - RNA, 19 nt, Human
aaagagcuaauacacagac

SEQ ID NO: 1309258 - RNA, 20 nt, Human
aaagcaaaagaacgaaaugc

SEQ ID NO: 1309259 - RNA, 19 nt, Human
aagcaaaagaacgaaaugc

SEQ ID NO: 1309260 - RNA, 22 nt, Human
aagcagagaagacaggaggucc

SEQ ID NO: 1309261 - RNA, 19 nt, Human
acaaagcaaaagaacgaaa

SEQ ID NO: 1309262 - RNA, 26 nt, Human
acaaagcaaaagaacgaaaugcgcaa

SEQ ID NO: 1309263 - RNA, 20 nt, Human
acaaagucuaccaugcaccc

SEQ ID NO: 1309264 - RNA, 19 nt, Human
acacuauccccaugucccc

SEQ ID NO: 1309265 - RNA, 19 nt, Human
acucaugcugggggcaaag

SEQ ID NO: 1309266 - RNA, 26 nt, Human
acuuccaugcccuuccauuccccucc

SEQ ID NO: 1309267 - RNA, 18 nt, Human
agcagauauuaauguucu

SEQ ID NO: 1309268 - RNA, 22 nt, Human
agcuuccaacucacaacacugc

SEQ ID NO: 1309269 - RNA, 23 nt, Human
aggcgacgcccgucgcaacucca

SEQ ID NO: 1309270 - RNA, 19 nt, Human
augcacccagaagcagaga

SEQ ID NO: 1309271 - RNA, 24 nt, Human
caacuccaggccaccgagugcacc

SEQ ID NO: 1309272 - RNA, 23 nt, Human
caacuccgagagaacagaccaaa

SEQ ID NO: 1309273 - RNA, 19 nt, Human
ccacacuauccccaugucc

SEQ ID NO: 1309274 - RNA, 21 nt, Human
ccacaucauccuuguugccua

SEQ ID NO: 1309275 - RNA, 22 nt, Human
ccagcagauauuaauguucucc

SEQ ID NO: 1309276 - RNA, 21 nt, Human
cccaccaacuccgagagaagg

SEQ ID NO: 1309277 - RNA, 19 nt, Human
cccauggcugcagcgggga

SEQ ID NO: 1309278 - RNA, 18 nt, Human
ccccauggcugcagcggg

SEQ ID NO: 1309279 - RNA, 20 nt, Human
ccccgaggcuaggcgacgcc

SEQ ID NO: 1309280 - RNA, 23 nt, Human
cccuuccauuccccucccuccaa

SEQ ID NO: 1309281 - RNA, 24 nt, Human
ccggaacagcuccugcaucccaag

SEQ ID NO: 1309282 - RNA, 21 nt, Human
ccgggaccgcucuggcccaac

SEQ ID NO: 1309283 - RNA, 20 nt, Human
ccuacagcaauggucugccc

SEQ ID NO: 1309284 - RNA, 21 nt, Human
ccuacagcaauggucugccuu

SEQ ID NO: 1309285 - RNA, 22 nt, Human
ccucgaacuugaacugcucuuc

SEQ ID NO: 1309286 - RNA, 22 nt, Human
cgagagaacagaccaaacuaac

SEQ ID NO: 1309287 - RNA, 26 nt, Human
cgccgagggccccauggcugcagcgg

SEQ ID NO: 1309288 - RNA, 21 nt, Human
cgcgcgucuugcuguggcccc

SEQ ID NO: 1309289 - RNA, 22 nt, Human
cggaacagcuccugcaucccaa

SEQ ID NO: 1309290 - RNA, 22 nt, Human
cuuccauuccccucccuccaaa

SEQ ID NO: 1309291 - RNA, 23 nt, Human
gaagcagagaagacaggaggucc

SEQ ID NO: 1309292 - RNA, 19 nt, Human
gaccccgaggcuaggcgac

SEQ ID NO: 1309293 - RNA, 19 nt, Human
gcaaagaauggaaagagcu

SEQ ID NO: 1309294 - RNA, 19 nt, Human
gcccuuccauuccccuccc

SEQ ID NO: 1309295 - RNA, 18 nt, Human
gucgcaacuccaggccac

SEQ ID NO: 1309296 - RNA, 24 nt, Human
uacucgcacugcagaguccacgcg

SEQ ID NO: 1309297 - RNA, 25 nt, Human
uagggugcccaccaacuccgagaga

SEQ ID NO: 1309298 - RNA, 22 nt, Human
uauuaaaugcucaauucucaaa

SEQ ID NO: 1309299 - RNA, 19 nt, Human
ucacaguggcaaugcauuu

SEQ ID NO: 1309300 - RNA, 19 nt, Human
ucacugagcaccacggggc

SEQ ID NO: 1309301 - RNA, 22 nt, Human
uccccauguccccgauaauugu

SEQ ID NO: 1309302 - RNA, 19 nt, Human
uccgagagaacagaccaaa

SEQ ID NO: 1309303 - RNA, 21 nt, Human
uccgagagaacagaccaaacu

SEQ ID NO: 1309304 - RNA, 20 nt, Human
uccuuguugccuacagcaau

SEQ ID NO: 1309305 - RNA, 19 nt, Human
ucgcgcgucuugcuguggc

SEQ ID NO: 1309306 - RNA, 23 nt, Human
ucucaaaauuauauauauauuuu

SEQ ID NO: 1309307 - RNA, 22 nt, Human
ucugccggggccuccucucccu

SEQ ID NO: 1309308 - RNA, 27 nt, Human
ugaccagagacguuuacaauuuauacc

SEQ ID NO: 1309309 - RNA, 21 nt, Human
ugcacccagaagcagagaaga

SEQ ID NO: 1309310 - RNA, 19 nt, Human
ugcaucccaagcacguagc

SEQ ID NO: 1309311 - RNA, 24 nt, Human
ugccacaaagucuaccaugcaccc

SEQ ID NO: 1309312 - RNA, 18 nt, Human
ugcgcagccugaccagag

SEQ ID NO: 1309313 - RNA, 23 nt, Human
uggaaagagcuaauacacagaca

SEQ ID NO: 1309314 - RNA, 22 nt, Human
uggucugcccaucaggacucca

SEQ ID NO: 1309315 - RNA, 20 nt, Human
ugugcgccagaacucgcgcg

SEQ ID NO: 1309316 - RNA, 21 nt, Human
uguucuccccuuuaguguuca

SEQ ID NO: 1309317 - RNA, 22 nt, Human
uucuccagcaagaagacgcugg

SEQ ID NO: 1309318 - RNA, 19 nt, Human
uuggcgcugugcgccagaa

SEQ ID NO: 1309319 - RNA, 23 nt, Human
uuuguaguccucacaucccagau

SEQ ID NO: 1309320 - RNA, 19 nt, Human
aaaaucccuccaugcuaac

SEQ ID NO: 1309321 - RNA, 19 nt, Human
acuccacuacccagccaau

SEQ ID NO: 1309322 - RNA, 24 nt, Human
aucaucccucucuccuacaaauuc

SEQ ID NO: 1309323 - RNA, 23 nt, Human
caacacuccacuacccagccaau

SEQ ID NO: 1309324 - RNA, 22 nt, Human
cacuacccagccaaugguagcc

SEQ ID NO: 1309325 - RNA, 31 nt, Human
cacuccacuacccagccaaugguagcccuaa

SEQ ID NO: 1309326 - RNA, 19 nt, Human
ccaaugguagcccuaaaau

SEQ ID NO: 1309327 - RNA, 18 nt, Human
cgacuaacuccaggcugc

SEQ ID NO: 1309328 - RNA, 19 nt, Human
cgacuaacuccaggcugcc

SEQ ID NO: 1309329 - RNA, 24 nt, Human
cuaaaaucccuccaugcuaacugg

SEQ ID NO: 1309330 - RNA, 25 nt, Human
cuguauauacaccucucgcgauccc

SEQ ID NO: 1309331 - RNA, 21 nt, Human
gcccuaaaaucccuccaugcu

SEQ ID NO: 1309332 - RNA, 21 nt, Human
ggacgagacaaucacgccccu

SEQ ID NO: 1309333 - RNA, 21 nt, Human
uaaaaucccuccaugcuaacu

SEQ ID NO: 1309334 - RNA, 18 nt, Human
ucaaucaucccucucucc

SEQ ID NO: 1309335 - RNA, 19 nt, Human
ucacauacuucucccagca

SEQ ID NO: 1309336 - RNA, 23 nt, Human
ucuccuacaaauuccucugcuac

SEQ ID NO: 1309337 - RNA, 19 nt, Human
uuuuccaucucacauacuu

SEQ ID NO: 1309338 - RNA, 20 nt, Human
acgucgccgcgcgggcuggg

SEQ ID NO: 1309339 - RNA, 24 nt, Human
augucagggacgaagucuuuuccc

SEQ ID NO: 1309340 - RNA, 21 nt, Human
ccccgcuccgggccccgcccc

SEQ ID NO: 1309341 - RNA, 19 nt, Human
cccuggagcuggaaggccc

SEQ ID NO: 1309342 - RNA, 18 nt, Human
ccgcgcgggcugggccuc

SEQ ID NO: 1309343 - RNA, 19 nt, Human
ccgcuccgggccccgcccc

SEQ ID NO: 1309344 - RNA, 18 nt, Human
ccgggccccgccccugcc

SEQ ID NO: 1309345 - RNA, 19 nt, Human
ccugggucgggauuugggg

SEQ ID NO: 1309346 - RNA, 19 nt, Human
cgcgggcugggccuccaag

SEQ ID NO: 1309347 - RNA, 23 nt, Human
cgcgggcugggccuccaaggccc

SEQ ID NO: 1309348 - RNA, 26 nt, Human
cucggccccgccccgaagccgguucc

SEQ ID NO: 1309349 - RNA, 18 nt, Human
gccccugccugggucggg

SEQ ID NO: 1309350 - RNA, 22 nt, Human
gccgcgcgggcugggccuccaa

SEQ ID NO: 1309351 - RNA, 22 nt, Human
ggagcuggaaggcccagaagug

SEQ ID NO: 1309352 - RNA, 19 nt, Human
guggcuucaaaugcccucg

SEQ ID NO: 1309353 - RNA, 19 nt, Human
guggguggccgucagucgg

SEQ ID NO: 1309354 - RNA, 22 nt, Human
uccaaggccccgcuccgggccc

SEQ ID NO: 1309355 - RNA, 20 nt, Human
uccgggccccgccccugccu

SEQ ID NO: 1309356 - RNA, 20 nt, Human
uggguugcggccacgcaggc

SEQ ID NO: 1309357 - RNA, 20 nt, Human
uugcggugguucauuucuuc

SEQ ID NO: 1309358 - RNA, 20 nt, Human
aaacaaaaucucaagcugug

SEQ ID NO: 1309359 - RNA, 24 nt, Human
aaagugcugggauuauaggcauga

SEQ ID NO: 1309360 - RNA, 18 nt, Human
aacaacaacaggaggcuu

SEQ ID NO: 1309361 - RNA, 22 nt, Human
aagcagacagaucugggaauca

SEQ ID NO: 1309362 - RNA, 25 nt, Human
aagcgauucuccugccucagccucc

SEQ ID NO: 1309363 - RNA, 22 nt, Human
aaguagcugggauuauaagcau

SEQ ID NO: 1309364 - RNA, 24 nt, Human
aaguagcugggauuauaagcaugc

SEQ ID NO: 1309365 - RNA, 19 nt, Human
aagugcugggauuauaggc

SEQ ID NO: 1309366 - RNA, 21 nt, Human
aagugcugggauuauaggcau

SEQ ID NO: 1309367 - RNA, 19 nt, Human
acaggguuuccucauguug

SEQ ID NO: 1309368 - RNA, 21 nt, Human
acaguggcauaaucucggcuc

SEQ ID NO: 1309369 - RNA, 24 nt, Human
acccacgcuggaguacaguggcau

SEQ ID NO: 1309370 - RNA, 25 nt, Human
acccgccuuggccucccaaagugcu

SEQ ID NO: 1309371 - RNA, 24 nt, Human
acucugucacccacgcuggaguac

SEQ ID NO: 1309372 - RNA, 18 nt, Human
agacaggguuuccucaug

SEQ ID NO: 1309373 - RNA, 21 nt, Human
agcaagcagacagaucuggga

SEQ ID NO: 1309374 - RNA, 21 nt, Human
aggacccgcaguagccgggau

SEQ ID NO: 1309375 - RNA, 21 nt, Human
aggcaugagccaccaugccca

SEQ ID NO: 1309376 - RNA, 22 nt, Human
aggccaaagugcacuuuuaauc

SEQ ID NO: 1309377 - RNA, 24 nt, Human
aguacaguggcauaaucucggcuc

SEQ ID NO: 1309378 - RNA, 21 nt, Human
aguagccgggaugcgcucccc

SEQ ID NO: 1309379 - RNA, 24 nt, Human
auaagcaugcaccaacacacccag

SEQ ID NO: 1309380 - RNA, 24 nt, Human
auuuuuguauuuuuaguagagaca

SEQ ID NO: 1309381 - RNA, 24 nt, Human
caaagugcugggauuauaggcaug

SEQ ID NO: 1309382 - RNA, 24 nt, Human
caacacacccagcuaauuuuugua

SEQ ID NO: 1309383 - RNA, 22 nt, Human
caacaggaggcuuugacucagc

SEQ ID NO: 1309384 - RNA, 23 nt, Human
caaccuccaccuccuggguucaa

SEQ ID NO: 1309385 - RNA, 22 nt, Human
caagcgauucuccugccucagc

SEQ ID NO: 1309386 - RNA, 22 nt, Human
cacacagugaaacuaaacaaaa

SEQ ID NO: 1309387 - RNA, 21 nt, Human
cacagagauggaauggcaaca

SEQ ID NO: 1309388 - RNA, 22 nt, Human
cacagugaaacuaaacaaaauc

SEQ ID NO: 1309389 - RNA, 23 nt, Human
cacccgccuuggccucccaaagu

SEQ ID NO: 1309390 - RNA, 24 nt, Human
cacccgccuuggccucccaaagug

SEQ ID NO: 1309391 - RNA, 18 nt, Human
cacgcaaacuucuucuug

SEQ ID NO: 1309392 - RNA, 21 nt, Human
cacugcaaccuccaccuccug

SEQ ID NO: 1309393 - RNA, 23 nt, Human
cacugcaaccuccaccuccuggg

SEQ ID NO: 1309394 - RNA, 20 nt, Human
cagcugccguaaggcuccgc

SEQ ID NO: 1309395 - RNA, 20 nt, Human
caggcagcacccccucacca

SEQ ID NO: 1309396 - RNA, 19 nt, Human
caggguuuccucauguugg

SEQ ID NO: 1309397 - RNA, 24 nt, Human
ccaaagugcugggauuauaggcau

SEQ ID NO: 1309398 - RNA, 24 nt, Human
ccaccuccuggguucaagcgauuc

SEQ ID NO: 1309399 - RNA, 21 nt, Human
ccaggacccgcaguagccggg

SEQ ID NO: 1309400 - RNA, 19 nt, Human
cccaaguagcugggauuau

SEQ ID NO: 1309401 - RNA, 20 nt, Human
cccacgcuggaguacagugg

SEQ ID NO: 1309402 - RNA, 19 nt, Human
cccuaacaacaacaggagg

SEQ ID NO: 1309403 - RNA, 24 nt, Human
ccucauguuggccacgcuagucuu

SEQ ID NO: 1309404 - RNA, 19 nt, Human
ccuccaccuccuggguuca

SEQ ID NO: 1309405 - RNA, 24 nt, Human
ccuccuggguucaagcgauucucc

SEQ ID NO: 1309406 - RNA, 23 nt, Human
ccugccucagccucccaaguagc

SEQ ID NO: 1309407 - RNA, 24 nt, Human
ccugccucagccucccaaguagcu

SEQ ID NO: 1309408 - RNA, 23 nt, Human
ccuggguucaagcgauucuccug

SEQ ID NO: 1309409 - RNA, 21 nt, Human
cggaagacuuuuccugucucc

SEQ ID NO: 1309410 - RNA, 26 nt, Human
cuacucaugacucaaaacggaagacu

SEQ ID NO: 1309411 - RNA, 24 nt, Human
cucacucugucacccacgcuggag

SEQ ID NO: 1309412 - RNA, 24 nt, Human
cucacugcaaccuccaccuccugg

SEQ ID NO: 1309413 - RNA, 26 nt, Human
cucacugcaaccuccaccuccugggu

SEQ ID NO: 1309414 - RNA, 23 nt, Human
cucagccucccaaguagcuggga

SEQ ID NO: 1309415 - RNA, 21 nt, Human
cuccuggguucaagcgauucu

SEQ ID NO: 1309416 - RNA, 23 nt, Human
cugaauuucauaaaaauaugaag

SEQ ID NO: 1309417 - RNA, 23 nt, Human
cugcaaccuccaccuccuggguu

SEQ ID NO: 1309418 - RNA, 24 nt, Human
cugcaaccuccaccuccuggguuc

SEQ ID NO: 1309419 - RNA, 18 nt, Human
cuggagaacuucacgcaa

SEQ ID NO: 1309420 - RNA, 20 nt, Human
gagacaggguuuccucaugu

SEQ ID NO: 1309421 - RNA, 21 nt, Human
gauuauaggcaugagccacca

SEQ ID NO: 1309422 - RNA, 22 nt, Human
gauuauaggcaugagccaccau

SEQ ID NO: 1309423 - RNA, 21 nt, Human
gauucuccugccucagccucc

SEQ ID NO: 1309424 - RNA, 22 nt, Human
gccuuggccucccaaagugcug

SEQ ID NO: 1309425 - RNA, 24 nt, Human
gcgauucuccugccucagccuccc

SEQ ID NO: 1309426 - RNA, 23 nt, Human
gcuagucuugaacuccuagccuc

SEQ ID NO: 1309427 - RNA, 24 nt, Human
gcucuggggaagcaugcugagcuc

SEQ ID NO: 1309428 - RNA, 19 nt, Human
gcuggaguacaguggcaua

SEQ ID NO: 1309429 - RNA, 24 nt, Human
ggauuauaggcaugagccaccaug

SEQ ID NO: 1309430 - RNA, 21 nt, Human
gggaaucacugaggaugcucu

SEQ ID NO: 1309431 - RNA, 24 nt, Human
gugagccacccgccuuggccuccc

SEQ ID NO: 1309432 - RNA, 24 nt, Human
uaauuuuuguauuuuuaguagaga

SEQ ID NO: 1309433 - RNA, 22 nt, Human
uagagacaggguuuccucaugu

SEQ ID NO: 1309434 - RNA, 24 nt, Human
uagcagcuagcuacugguuucuua

SEQ ID NO: 1309435 - RNA, 24 nt, Human
uaguagagacaggguuuccucaug

SEQ ID NO: 1309436 - RNA, 19 nt, Human
ucaagcgauucuccugccu

SEQ ID NO: 1309437 - RNA, 23 nt, Human
ucacugcaaccuccaccuccugg

SEQ ID NO: 1309438 - RNA, 23 nt, Human
ucacugcaaccuccaccuccugg

SEQ ID NO: 1309439 - RNA, 24 nt, Human
ucacugcaaccuccaccuccuggg

SEQ ID NO: 1309440 - RNA, 27 nt, Human
ucacugcaaccuccaccuccuggguuc

SEQ ID NO: 1309441 - RNA, 18 nt, Human
ucagccucccaaguagcu

SEQ ID NO: 1309442 - RNA, 20 nt, Human
ucagccucccaaguagcugg

SEQ ID NO: 1309443 - RNA, 22 nt, Human
uccacagcaagcagacagaucu

SEQ ID NO: 1309444 - RNA, 24 nt, Human
ucccaaagugcugggauuauaggc

SEQ ID NO: 1309445 - RNA, 18 nt, Human
uccgcaggugaagaccca

SEQ ID NO: 1309446 - RNA, 22 nt, Human
uccgcaggugaagacccaggac

SEQ ID NO: 1309447 - RNA, 18 nt, Human
uccuagccucaagugagc

SEQ ID NO: 1309448 - RNA, 21 nt, Human
uccuggguucaagcgauucuc

SEQ ID NO: 1309449 - RNA, 24 nt, Human
uccuggguucaagcgauucuccug

SEQ ID NO: 1309450 - RNA, 19 nt, Human
uccuuagauccaugccagc

SEQ ID NO: 1309451 - RNA, 24 nt, Human
ucucacucugucacccacgcugga

SEQ ID NO: 1309452 - RNA, 26 nt, Human
ucuccugccucagccucccaaguagc

SEQ ID NO: 1309453 - RNA, 24 nt, Human
ucugucacccacgcuggaguacag

SEQ ID NO: 1309454 - RNA, 21 nt, Human
ucuugaacuccuagccucaag

SEQ ID NO: 1309455 - RNA, 18 nt, Human
ugaaaugagaaaagauca

SEQ ID NO: 1309456 - RNA, 18 nt, Human
ugaaguguuaacacagag

SEQ ID NO: 1309457 - RNA, 19 nt, Human
ugagaagagcccugaaaug

SEQ ID NO: 1309458 - RNA, 18 nt, Human
ugagacagagucucacuc

SEQ ID NO: 1309459 - RNA, 22 nt, Human
ugagacagagucucacucuguc

SEQ ID NO: 1309460 - RNA, 23 nt, Human
ugagugaaauauaaucuccugaa

SEQ ID NO: 1309461 - RNA, 20 nt, Human
ugccagccucucacaaauua

SEQ ID NO: 1309462 - RNA, 24 nt, Human
ugccucagccucccaaguagcugg

SEQ ID NO: 1309463 - RNA, 24 nt, Human
uggaguacaguggcauaaucucgg

SEQ ID NO: 1309464 - RNA, 22 nt, Human
uggcaacagacuuuaugaaagc

SEQ ID NO: 1309465 - RNA, 24 nt, Human
uggccacgcuagucuugaacuccu

SEQ ID NO: 1309466 - RNA, 21 nt, Human
ugggauuauaagcaugcacca

SEQ ID NO: 1309467 - RNA, 23 nt, Human
ugggauuauaagcaugcaccaac

SEQ ID NO: 1309468 - RNA, 18 nt, Human
ugggauuauaggcaugag

SEQ ID NO: 1309469 - RNA, 22 nt, Human
ugggauuauaggcaugagccac

SEQ ID NO: 1309470 - RNA, 23 nt, Human
ugggauuauaggcaugagccacc

SEQ ID NO: 1309471 - RNA, 24 nt, Human
ugggauuauaggcaugagccacca

SEQ ID NO: 1309472 - RNA, 25 nt, Human
ugggauuauaggcaugagccaccau

SEQ ID NO: 1309473 - RNA, 23 nt, Human
uggguucaagcgauucuccugcc

SEQ ID NO: 1309474 - RNA, 24 nt, Human
uggguucaagcgauucuccugccu

SEQ ID NO: 1309475 - RNA, 24 nt, Human
uuaguagagacaggguuuccucau

SEQ ID NO: 1309476 - RNA, 21 nt, Human
uucaagcgauucuccugccuc

SEQ ID NO: 1309477 - RNA, 23 nt, Human
uucaagcgauucuccugccucag

SEQ ID NO: 1309478 - RNA, 24 nt, Human
uucaagcgauucuccugccucagc

SEQ ID NO: 1309479 - RNA, 18 nt, Human
uuggccucccaaagugcu

SEQ ID NO: 1309480 - RNA, 23 nt, Human
uugguggcugugaaccucuccau

SEQ ID NO: 1309481 - RNA, 24 nt, Human
uuuaguagagacaggguuuccuca

SEQ ID NO: 1309482 - RNA, 21 nt, Human
uuuccucauguuggccacgcu

SEQ ID NO: 1309483 - RNA, 20 nt, Human
uuuccugucuccugauccuu

SEQ ID NO: 1309484 - RNA, 24 nt, Human
uuugacucagccacauuccccagg

SEQ ID NO: 1309485 - RNA, 20 nt, Human
uuuuuguauuuuuaguagag

SEQ ID NO: 1309486 - RNA, 23 nt, Human
agaagccgggggaggaggcgggg

SEQ ID NO: 1309487 - RNA, 21 nt, Human
agccgggggaggaggcggggg

SEQ ID NO: 1309488 - RNA, 20 nt, Human
cgguagaagccgggggagga

SEQ ID NO: 1309489 - RNA, 19 nt, Human
gcgccccgguagaagccgg

SEQ ID NO: 1309490 - RNA, 18 nt, Human
gggggaggaggcgggggc

SEQ ID NO: 1309491 - RNA, 19 nt, Human
aaacagaggcccaggaaac

SEQ ID NO: 1309492 - RNA, 25 nt, Human
aaauauccugcugagaaacugaccc

SEQ ID NO: 1309493 - RNA, 22 nt, Human
aaguccacagccacauccucaa

SEQ ID NO: 1309494 - RNA, 21 nt, Human
agagucucuccaacccaugau

SEQ ID NO: 1309495 - RNA, 22 nt, Human
aggggcaggcggggcacucacg

SEQ ID NO: 1309496 - RNA, 21 nt, Human
augaacuacagacacacuccu

SEQ ID NO: 1309497 - RNA, 22 nt, Human
auguggaaucuggcugagggcu

SEQ ID NO: 1309498 - RNA, 24 nt, Human
cacagccacauccucaaagacccu

SEQ ID NO: 1309499 - RNA, 19 nt, Human
cauuucuggugaacguggc

SEQ ID NO: 1309500 - RNA, 21 nt, Human
ccacugaguccaugucccggg

SEQ ID NO: 1309501 - RNA, 20 nt, Human
ccucaaagaccacugagucc

SEQ ID NO: 1309502 - RNA, 21 nt, Human
cggcuaggacagaggcguccc

SEQ ID NO: 1309503 - RNA, 24 nt, Human
cuaaaacagaggcccaggaaacau

SEQ ID NO: 1309504 - RNA, 23 nt, Human
cuccuugaguguccacuuucagg

SEQ ID NO: 1309505 - RNA, 25 nt, Human
cugagcagaauccagcaaagcccac

SEQ ID NO: 1309506 - RNA, 26 nt, Human
cugagcagaauccagcaaagcccacu

SEQ ID NO: 1309507 - RNA, 19 nt, Human
gaacuacagacacacuccu

SEQ ID NO: 1309508 - RNA, 25 nt, Human
gacugucccaaauuuuuccuaaaaa

SEQ ID NO: 1309509 - RNA, 20 nt, Human
gaguuucaucaucuacugag

SEQ ID NO: 1309510 - RNA, 19 nt, Human
gucuccagcaucacaucuc

SEQ ID NO: 1309511 - RNA, 19 nt, Human
uaaaacagaggcccaggaa

SEQ ID NO: 1309512 - RNA, 20 nt, Human
uaaaacagaggcccaggaaa

SEQ ID NO: 1309513 - RNA, 24 nt, Human
uaaaacagaggcccaggaaacauu

SEQ ID NO: 1309514 - RNA, 23 nt, Human
uaaauauccugcugagaaacuga

SEQ ID NO: 1309515 - RNA, 19 nt, Human
uacuguuuuacuccaggug

SEQ ID NO: 1309516 - RNA, 20 nt, Human
uagaggucccucugagcaga

SEQ ID NO: 1309517 - RNA, 21 nt, Human
ucacagagucucuccaaccca

SEQ ID NO: 1309518 - RNA, 22 nt, Human
uccaacccaugauuucuacuga

SEQ ID NO: 1309519 - RNA, 26 nt, Human
ucccucugagcagaauccagcaaagc

SEQ ID NO: 1309520 - RNA, 20 nt, Human
ucuacugagauuucuccccu

SEQ ID NO: 1309521 - RNA, 21 nt, Human
ucuccacauugaucauuacuu

SEQ ID NO: 1309522 - RNA, 21 nt, Human
ugaacuacagacacacuccuu

SEQ ID NO: 1309523 - RNA, 18 nt, Human
ugagcgcgacaggaaccg

SEQ ID NO: 1309524 - RNA, 19 nt, Human
ugauaugguuuguguccag

SEQ ID NO: 1309525 - RNA, 18 nt, Human
ugcccacauuccuggcac

SEQ ID NO: 1309526 - RNA, 21 nt, Human
ugcuaagacugucccaaauuu

SEQ ID NO: 1309527 - RNA, 19 nt, Human
ugcugagaaacugacccac

SEQ ID NO: 1309528 - RNA, 20 nt, Human
uggcugagggcuucuccaca

SEQ ID NO: 1309529 - RNA, 19 nt, Human
uguggaaucuggcugaggg

SEQ ID NO: 1309530 - RNA, 21 nt, Human
uuacuccagguggaauuuucu

SEQ ID NO: 1309531 - RNA, 23 nt, Human
uugcaaaugaacuacagacacac

SEQ ID NO: 1309532 - RNA, 19 nt, Human
cccccacagggugucucca

SEQ ID NO: 1309533 - RNA, 19 nt, Human
gagcgguagggaggcggcc

SEQ ID NO: 1309534 - RNA, 21 nt, Human
gggaggcggccaaaugcgacg

SEQ ID NO: 1309535 - RNA, 18 nt, Human
uggagcgguagggaggcg

SEQ ID NO: 1309536 - RNA, 18 nt, Human
ugucgcaguccgacuggc

SEQ ID NO: 1309537 - RNA, 22 nt, Human
ugucuccaucuucccuauuuau

SEQ ID NO: 1309538 - RNA, 20 nt, Human
aaaccaggcuguccggaaag

SEQ ID NO: 1309539 - RNA, 21 nt, Human
aacaauaagccgaagaaggga

SEQ ID NO: 1309540 - RNA, 19 nt, Human
aagaagggaaaccaggcug

SEQ ID NO: 1309541 - RNA, 21 nt, Human
aaggguggagggugagggugg

SEQ ID NO: 1309542 - RNA, 22 nt, Human
acaaacaagggcuggggacaca

SEQ ID NO: 1309543 - RNA, 20 nt, Human
aggagggcagggggccaaag

SEQ ID NO: 1309544 - RNA, 18 nt, Human
agggagaggagggcaggg

SEQ ID NO: 1309545 - RNA, 21 nt, Human
agggagaggagggcagggggc

SEQ ID NO: 1309546 - RNA, 22 nt, Human
agggagaggagggcagggggcc

SEQ ID NO: 1309547 - RNA, 24 nt, Human
caauaagccgaagaagggaaacca

SEQ ID NO: 1309548 - RNA, 24 nt, Human
cagaacucaaaaucugaaaucuga

SEQ ID NO: 1309549 - RNA, 22 nt, Human
ccaaaaaucagaacucaaaauc

SEQ ID NO: 1309550 - RNA, 23 nt, Human
ccuucugccuuuauuucccugau

SEQ ID NO: 1309551 - RNA, 22 nt, Human
gagcauccgaggucagcagcaa

SEQ ID NO: 1309552 - RNA, 20 nt, Human
gcacacacguccccaauccc

SEQ ID NO: 1309553 - RNA, 20 nt, Human
ggagaggagggcagggggcc

SEQ ID NO: 1309554 - RNA, 18 nt, Human
ggagggagaggagggcag

SEQ ID NO: 1309555 - RNA, 19 nt, Human
ggagggugaggguggaggg

SEQ ID NO: 1309556 - RNA, 24 nt, Human
gguccaucugggagggagaggagg

SEQ ID NO: 1309557 - RNA, 23 nt, Human
ucacugccuucugccuuuauucu

SEQ ID NO: 1309558 - RNA, 18 nt, Human
ucagcagcaaagggugga

SEQ ID NO: 1309559 - RNA, 24 nt, Human
ucccauagcacacacguccccaau

SEQ ID NO: 1309560 - RNA, 20 nt, Human
uccccaaucccagaaacuuu

SEQ ID NO: 1309561 - RNA, 24 nt, Human
uccccaaucccagaaacuuuacuc

SEQ ID NO: 1309562 - RNA, 21 nt, Human
ucccugaucucugucccuucc

SEQ ID NO: 1309563 - RNA, 21 nt, Human
uccuuguuuacaaacaagggc

SEQ ID NO: 1309564 - RNA, 18 nt, Human
ucugauggaacaauaagc

SEQ ID NO: 1309565 - RNA, 22 nt, Human
ugaccaaaaaucagaacucaaa

SEQ ID NO: 1309566 - RNA, 22 nt, Human
ugaggguggagggcaccccugg

SEQ ID NO: 1309567 - RNA, 19 nt, Human
ugaucucugucccuuccuu

SEQ ID NO: 1309568 - RNA, 19 nt, Human
uggaacaauaagccgaaga

SEQ ID NO: 1309569 - RNA, 23 nt, Human
ugggagggagaggagggcagggg

SEQ ID NO: 1309570 - RNA, 24 nt, Human
aaaucaucagugaagagagagaac

SEQ ID NO: 1309571 - RNA, 24 nt, Human
aacgggccaggcccugggggacuc

SEQ ID NO: 1309572 - RNA, 19 nt, Human
aagcaaagaggaccagcca

SEQ ID NO: 1309573 - RNA, 19 nt, Human
aagcaaagaggaccagcca

SEQ ID NO: 1309574 - RNA, 20 nt, Human
acuaagcaaagaggaccagc

SEQ ID NO: 1309575 - RNA, 25 nt, Human
acuucaaaggugucauuuuggaggg

SEQ ID NO: 1309576 - RNA, 19 nt, Human
agaggaaggagaaggaaag

SEQ ID NO: 1309577 - RNA, 21 nt, Human
agaguccguccgacuccgccc

SEQ ID NO: 1309578 - RNA, 21 nt, Human
aggcaggaaugaaucugcccg

SEQ ID NO: 1309579 - RNA, 22 nt, Human
aggcaggaaugaaucugcccga

SEQ ID NO: 1309580 - RNA, 24 nt, Human
agugaagagagagaacugcaagga

SEQ ID NO: 1309581 - RNA, 19 nt, Human
aucucuucaucuucuuucu

SEQ ID NO: 1309582 - RNA, 18 nt, Human
auuuuaaauugcauccaa

SEQ ID NO: 1309583 - RNA, 22 nt, Human
caaggagaagggagaguggggg

SEQ ID NO: 1309584 - RNA, 21 nt, Human
cagaaggacucugccuccccu

SEQ ID NO: 1309585 - RNA, 19 nt, Human
caggacccgcgggaauccu

SEQ ID NO: 1309586 - RNA, 23 nt, Human
caggcagcacaugagaggagcca

SEQ ID NO: 1309587 - RNA, 23 nt, Human
caucccccagcucgauacacaac

SEQ ID NO: 1309588 - RNA, 20 nt, Human
cauuuuggaggcugcucugg

SEQ ID NO: 1309589 - RNA, 26 nt, Human
ccagugcacgcuggcagccgcgggag

SEQ ID NO: 1309590 - RNA, 19 nt, Human
cccgagucccugcccagaa

SEQ ID NO: 1309591 - RNA, 24 nt, Human
cccgcaccggacgcgcucucaggg

SEQ ID NO: 1309592 - RNA, 18 nt, Human
cccugggccucagugccc

SEQ ID NO: 1309593 - RNA, 24 nt, Human
ccgacuccgcccgcaccggacgcg

SEQ ID NO: 1309594 - RNA, 23 nt, Human
ccgcgggaggcgaggcgggcgcg

SEQ ID NO: 1309595 - RNA, 18 nt, Human
ccgggcagacgcgccgag

SEQ ID NO: 1309596 - RNA, 22 nt, Human
ccugggccucagugcccgggag

SEQ ID NO: 1309597 - RNA, 22 nt, Human
cgacuccgcccgcaccggacgc

SEQ ID NO: 1309598 - RNA, 23 nt, Human
cgacuccgcccgcaccggacgcg

SEQ ID NO: 1309599 - RNA, 20 nt, Human
cguccgacuccgcccgcacc

SEQ ID NO: 1309600 - RNA, 24 nt, Human
cucagggcagaggaggucggcgga

SEQ ID NO: 1309601 - RNA, 20 nt, Human
cuggauggaauccaaggguc

SEQ ID NO: 1309602 - RNA, 21 nt, Human
cuucuccucccuuuacauccc

SEQ ID NO: 1309603 - RNA, 21 nt, Human
gagcagucgcgccggaaccga

SEQ ID NO: 1309604 - RNA, 23 nt, Human
gcaccggacgcgcucucagggcu

SEQ ID NO: 1309605 - RNA, 19 nt, Human
gcccgcaccggacgcgcuc

SEQ ID NO: 1309606 - RNA, 21 nt, Human
gccggaaccgagccgcgaauc

SEQ ID NO: 1309607 - RNA, 20 nt, Human
gccucagugcccgggagaag

SEQ ID NO: 1309608 - RNA, 22 nt, Human
gcgaauccgcgccgccucgcgc

SEQ ID NO: 1309609 - RNA, 21 nt, Human
gcgccggaaccgagccgcgaa

SEQ ID NO: 1309610 - RNA, 22 nt, Human
ggaaauguggggcaggcaggaa

SEQ ID NO: 1309611 - RNA, 20 nt, Human
guggggcaggcaggaaugaa

SEQ ID NO: 1309612 - RNA, 19 nt, Human
uaagcaaagaggaccagcc

SEQ ID NO: 1309613 - RNA, 19 nt, Human
uaagcaaagaggaccagcc

SEQ ID NO: 1309614 - RNA, 18 nt, Human
uagaggaaggagaaggaa

SEQ ID NO: 1309615 - RNA, 21 nt, Human
uccgacuccgcccgcaccgga

SEQ ID NO: 1309616 - RNA, 20 nt, Human
ucgauacacaacuucaaagg

SEQ ID NO: 1309617 - RNA, 18 nt, Human
ucuuucuucuccucccuu

SEQ ID NO: 1309618 - RNA, 22 nt, Human
ugagaggagccauauccagggc

SEQ ID NO: 1309619 - RNA, 23 nt, Human
ugagaggagccauauccagggcg

SEQ ID NO: 1309620 - RNA, 20 nt, Human
ugcccgcgcgaggcgugaag

SEQ ID NO: 1309621 - RNA, 22 nt, Human
uggcagccgcgggaggcgaggc

SEQ ID NO: 1309622 - RNA, 25 nt, Human
uggggcaggcaggaaugaaucugcc

SEQ ID NO: 1309623 - RNA, 22 nt, Human
aagaaucuuuauugaacuugcu

SEQ ID NO: 1309624 - RNA, 21 nt, Human
aagcccacaucucagaagcac

SEQ ID NO: 1309625 - RNA, 23 nt, Human
acuuccaagaaucuuuauugaac

SEQ ID NO: 1309626 - RNA, 22 nt, Human
caaccacaucagaggaguuuuc

SEQ ID NO: 1309627 - RNA, 19 nt, Human
cacuggcgacagggagggc

SEQ ID NO: 1309628 - RNA, 22 nt, Human
cagcagucaggaucacacguac

SEQ ID NO: 1309629 - RNA, 24 nt, Human
cgacagggagggccccagcuggca

SEQ ID NO: 1309630 - RNA, 24 nt, Human
uagcaacagcgugugcaagcccac

SEQ ID NO: 1309631 - RNA, 21 nt, Human
uggaaaaaaaaaagugcccac

SEQ ID NO: 1309632 - RNA, 23 nt, Human
uggaaaaaaaaaagugcccacug

SEQ ID NO: 1309633 - RNA, 25 nt, Human
uggcgacagggagggccccagcugg

SEQ ID NO: 1309634 - RNA, 21 nt, Human
ugggcugcuuaucugggaagc

SEQ ID NO: 1309635 - RNA, 18 nt, Human
ugucugaaggagccaggg

SEQ ID NO: 1309636 - RNA, 21 nt, Human
caggccccgggccccccuccc

SEQ ID NO: 1309637 - RNA, 24 nt, Human
caucagggccaauucaguucugcc

SEQ ID NO: 1309638 - RNA, 23 nt, Human
caugcagagacucccugccccca

SEQ ID NO: 1309639 - RNA, 24 nt, Human
cccaggccccgggccccccucccu

SEQ ID NO: 1309640 - RNA, 22 nt, Human
cccauauaucccagcugacgcc

SEQ ID NO: 1309641 - RNA, 21 nt, Human
cucccugcccccauauauccc

SEQ ID NO: 1309642 - RNA, 19 nt, Human
gcagagacucccugccccc

SEQ ID NO: 1309643 - RNA, 20 nt, Human
gccccgggccccccucccuu

SEQ ID NO: 1309644 - RNA, 20 nt, Human
gggaguuggcuggggcuggg

SEQ ID NO: 1309645 - RNA, 23 nt, Human
ucaaacaucggccaugcagagac

SEQ ID NO: 1309646 - RNA, 22 nt, Human
ucagugccgggaguuggcuggg

SEQ ID NO: 1309647 - RNA, 23 nt, Human
ucccagcugacgccccaggcccc

SEQ ID NO: 1309648 - RNA, 21 nt, Human
ucccuugcaggccaucagggc

SEQ ID NO: 1309649 - RNA, 19 nt, Human
uguaguguucagugccggg

SEQ ID NO: 1309650 - RNA, 22 nt, Human
aggccuuucccgcgcucucugc

SEQ ID NO: 1309651 - RNA, 22 nt, Human
agguagggcaggggcuucgggc

SEQ ID NO: 1309652 - RNA, 18 nt, Human
aguaacugaacaacucau

SEQ ID NO: 1309653 - RNA, 20 nt, Human
caggggcuucgggcuggugg

SEQ ID NO: 1309654 - RNA, 21 nt, Human
ccaaguaacugaacaacucau

SEQ ID NO: 1309655 - RNA, 18 nt, Human
ccgcgcgucuucuccucc

SEQ ID NO: 1309656 - RNA, 20 nt, Human
cuguccgcgcgucuucuccu

SEQ ID NO: 1309657 - RNA, 18 nt, Human
uccuccagguagggcagg

SEQ ID NO: 1309658 - RNA, 23 nt, Human
ucuccuccagguagggcaggggc

SEQ ID NO: 1309659 - RNA, 19 nt, Human
ugcgacgugggcaccgcca

SEQ ID NO: 1309660 - RNA, 18 nt, Human
ugggacaggacagcaucc

SEQ ID NO: 1309661 - RNA, 22 nt, Human
uguccgcgcgucuucuccucca

SEQ ID NO: 1309662 - RNA, 20 nt, Human
ugucuuuuuuguuauuguug

SEQ ID NO: 1309663 - RNA, 21 nt, Human
uuagcuguccgcgcgucuucu

SEQ ID NO: 1309664 - RNA, 26 nt, Human
uuuuguuauuguugccaaguaacuga

SEQ ID NO: 1309665 - RNA, 25 nt, Human
uuuuuuguuauuguugccaaguaac

SEQ ID NO: 1309666 - RNA, 20 nt, Human
aaacccagggcccgcggcaa

SEQ ID NO: 1309667 - RNA, 23 nt, Human
aacccagggcccgcggcaaaaaa

SEQ ID NO: 1309668 - RNA, 18 nt, Human
aagacaccagccacuuac

SEQ ID NO: 1309669 - RNA, 21 nt, Human
aagacaccagccacuuaccaa

SEQ ID NO: 1309670 - RNA, 24 nt, Human
aagagaaagccaggcugcuucaaa

SEQ ID NO: 1309671 - RNA, 24 nt, Human
aagcaaccaccagcccugggaccc

SEQ ID NO: 1309672 - RNA, 22 nt, Human
acagaugggcggacagacagac

SEQ ID NO: 1309673 - RNA, 20 nt, Human
accaagagaaagccaggcug

SEQ ID NO: 1309674 - RNA, 20 nt, Human
agacccaaagcaaccaccag

SEQ ID NO: 1309675 - RNA, 18 nt, Human
agagaaagccaggcugcu

SEQ ID NO: 1309676 - RNA, 18 nt, Human
aggcugcuucaaacccag

SEQ ID NO: 1309677 - RNA, 19 nt, Human
caaagcaaccaccagcccu

SEQ ID NO: 1309678 - RNA, 24 nt, Human
caaagcaaccaccagcccugggac

SEQ ID NO: 1309679 - RNA, 23 nt, Human
caaccaccagcccugggacccug

SEQ ID NO: 1309680 - RNA, 21 nt, Human
cacaggcuguugaggcaggag

SEQ ID NO: 1309681 - RNA, 22 nt, Human
caccacacaggcuguugaggca

SEQ ID NO: 1309682 - RNA, 21 nt, Human
cagccccacaccggcuuugcc

SEQ ID NO: 1309683 - RNA, 18 nt, Human
caggcuguugaggcagga

SEQ ID NO: 1309684 - RNA, 20 nt, Human
ccagggcccgcggcaaaaaa

SEQ ID NO: 1309685 - RNA, 21 nt, Human
cccagaaggagaggggaggcc

SEQ ID NO: 1309686 - RNA, 18 nt, Human
ccccagccccacaccggc

SEQ ID NO: 1309687 - RNA, 22 nt, Human
ccggccggggagucuggaagcc

SEQ ID NO: 1309688 - RNA, 20 nt, Human
ccugggacccugagacauga

SEQ ID NO: 1309689 - RNA, 25 nt, Human
cggcuuugccaccacacaggcuguu

SEQ ID NO: 1309690 - RNA, 21 nt, Human
cugcggcccagaaggagaggg

SEQ ID NO: 1309691 - RNA, 23 nt, Human
gacaaagaggacaguaagagaaa

SEQ ID NO: 1309692 - RNA, 22 nt, Human
gccggguccccuccuggagaac

SEQ ID NO: 1309693 - RNA, 26 nt, Human
gcggcccagaaggagaggggaggccg

SEQ ID NO: 1309694 - RNA, 20 nt, Human
ggacagauggacaaacaggu

SEQ ID NO: 1309695 - RNA, 18 nt, Human
ggagggacagaugggugg

SEQ ID NO: 1309696 - RNA, 19 nt, Human
ggcugagcucagauugcag

SEQ ID NO: 1309697 - RNA, 22 nt, Human
ggugggggcugaagacagacac

SEQ ID NO: 1309698 - RNA, 25 nt, Human
guagcuguagacccaaagcaaccac

SEQ ID NO: 1309699 - RNA, 24 nt, Human
uaagacaccagccacuuaccaagg

SEQ ID NO: 1309700 - RNA, 26 nt, Human
uaagagaaagauggucagauagacaa

SEQ ID NO: 1309701 - RNA, 26 nt, Human
uaccaagagaaagccaggcugcuuca

SEQ ID NO: 1309702 - RNA, 24 nt, Human
uagauagacucacagguaauugga

SEQ ID NO: 1309703 - RNA, 19 nt, Human
uagcuguagacccaaagca

SEQ ID NO: 1309704 - RNA, 22 nt, Human
uagcuguagacccaaagcaacc

SEQ ID NO: 1309705 - RNA, 21 nt, Human
ugaauggacagacggcuggca

SEQ ID NO: 1309706 - RNA, 19 nt, Human
uggcagcuguggcgagcug

SEQ ID NO: 1309707 - RNA, 20 nt, Human
uggcaucuaggccuucgccu

SEQ ID NO: 1309708 - RNA, 22 nt, Human
ugggacccugagacaugaccuc

SEQ ID NO: 1309709 - RNA, 23 nt, Human
ugggacccugagacaugaccucc

SEQ ID NO: 1309710 - RNA, 21 nt, Human
uguagacccaaagcaaccacc

SEQ ID NO: 1309711 - RNA, 23 nt, Human
aaacuucuuuauagucucugcuu

SEQ ID NO: 1309712 - RNA, 18 nt, Human
acuaaccgaaacaccauu

SEQ ID NO: 1309713 - RNA, 21 nt, Human
acuacgggcuacaggcaagga

SEQ ID NO: 1309714 - RNA, 26 nt, Human
agcagcuaugggcucauucaguucug

SEQ ID NO: 1309715 - RNA, 20 nt, Human
auugcacuuagaaccguuac

SEQ ID NO: 1309716 - RNA, 21 nt, Human
ccucagcaauaugcucggccu

SEQ ID NO: 1309717 - RNA, 18 nt, Human
cucauugcacuuagaacc

SEQ ID NO: 1309718 - RNA, 18 nt, Human
cuccugcuaugagcuagg

SEQ ID NO: 1309719 - RNA, 25 nt, Human
cucuucuuucucuucuucugguuuu

SEQ ID NO: 1309720 - RNA, 23 nt, Human
cuuucucuucuucugguuuuucu

SEQ ID NO: 1309721 - RNA, 18 nt, Human
uagaaccguuacuaaccg

SEQ ID NO: 1309722 - RNA, 24 nt, Human
uagucucugcuucagacaagauuu

SEQ ID NO: 1309723 - RNA, 22 nt, Human
ucauuauucuccucugaagccu

SEQ ID NO: 1309724 - RNA, 20 nt, Human
ucugguuuuucuucuggauu

SEQ ID NO: 1309725 - RNA, 23 nt, Human
ucuuucucuucuucugguuuuuc

SEQ ID NO: 1309726 - RNA, 27 nt, Human
ucuuucucuucuucugguuuuucuucc

SEQ ID NO: 1309727 - RNA, 18 nt, Human
ugacagcagggagaaacu

SEQ ID NO: 1309728 - RNA, 21 nt, Human
uggaaggaagcagcuaugggc

SEQ ID NO: 1309729 - RNA, 22 nt, Human
uuacuaaccgaaacaccauuug

SEQ ID NO: 1309730 - RNA, 19 nt, Human
uuccagaggcagcuggaag

SEQ ID NO: 1309731 - RNA, 20 nt, Human
uuccucagcaauaugcucgg

SEQ ID NO: 1309732 - RNA, 23 nt, Human
uugacagcagggagaaacuucuu

SEQ ID NO: 1309733 - RNA, 18 nt, Human
acagugagcucugucauu

SEQ ID NO: 1309734 - RNA, 23 nt, Human
agcuccagguugcuggacugaag

SEQ ID NO: 1309735 - RNA, 20 nt, Human
agcugugggggcugcagggg

SEQ ID NO: 1309736 - RNA, 22 nt, Human
aggugggcgguggggcugggcu

SEQ ID NO: 1309737 - RNA, 21 nt, Human
aguggaguugggaagggccgg

SEQ ID NO: 1309738 - RNA, 23 nt, Human
caggggcuguuugugugucaaag

SEQ ID NO: 1309739 - RNA, 24 nt, Human
cccaucagcuggcugucuuugccc

SEQ ID NO: 1309740 - RNA, 25 nt, Human
cccgugcaccugcuugauggggccg

SEQ ID NO: 1309741 - RNA, 19 nt, Human
cccugagcacagugagcuc

SEQ ID NO: 1309742 - RNA, 20 nt, Human
ccugggagcccgagaggagg

SEQ ID NO: 1309743 - RNA, 18 nt, Human
ccuggggucaguucugug

SEQ ID NO: 1309744 - RNA, 20 nt, Human
ccuggggucaguucugugga

SEQ ID NO: 1309745 - RNA, 20 nt, Human
cucugugcugacucaggcuc

SEQ ID NO: 1309746 - RNA, 20 nt, Human
cuggggucaguucuguggag

SEQ ID NO: 1309747 - RNA, 18 nt, Human
gagcccgagaggaggcag

SEQ ID NO: 1309748 - RNA, 21 nt, Human
gagcugugggggcugcagggg

SEQ ID NO: 1309749 - RNA, 23 nt, Human
gaggauccuggggucaguucugu

SEQ ID NO: 1309750 - RNA, 18 nt, Human
gauaggugggcggugggg

SEQ ID NO: 1309751 - RNA, 18 nt, Human
gcggagaccucugucuca

SEQ ID NO: 1309752 - RNA, 23 nt, Human
gcgguggggcugggcuuggcuuc

SEQ ID NO: 1309753 - RNA, 20 nt, Human
gcucugugcugacucaggcu

SEQ ID NO: 1309754 - RNA, 18 nt, Human
ggagaccucugucucagg

SEQ ID NO: 1309755 - RNA, 19 nt, Human
ggcugcaggggaggggagu

SEQ ID NO: 1309756 - RNA, 26 nt, Human
gggccggggugggaccugucagcuuc

SEQ ID NO: 1309757 - RNA, 18 nt, Human
ggggauaggugggcggug

SEQ ID NO: 1309758 - RNA, 20 nt, Human
ggggcugggcuuggcuucag

SEQ ID NO: 1309759 - RNA, 20 nt, Human
ggggugggaccugucagcuu

SEQ ID NO: 1309760 - RNA, 23 nt, Human
guggugucagaggaguggccggg

SEQ ID NO: 1309761 - RNA, 20 nt, Human
gugucagaggaguggccggg

SEQ ID NO: 1309762 - RNA, 20 nt, Human
ucccaucagcuggcugucuu

SEQ ID NO: 1309763 - RNA, 23 nt, Human
ucccaucagcuggcugucuuugc

SEQ ID NO: 1309764 - RNA, 20 nt, Human
ucugagcccggacuguugcc

SEQ ID NO: 1309765 - RNA, 18 nt, Human
ucugccuggcagaagugu

SEQ ID NO: 1309766 - RNA, 18 nt, Human
ucugugcugacucaggcu

SEQ ID NO: 1309767 - RNA, 20 nt, Human
ucuuccaggccuggcugccu

SEQ ID NO: 1309768 - RNA, 22 nt, Human
ucuuccaggccuggcugccugg

SEQ ID NO: 1309769 - RNA, 25 nt, Human
ugaagaggacgucaguacaugguuc

SEQ ID NO: 1309770 - RNA, 19 nt, Human
ugacucaggcucugccugg

SEQ ID NO: 1309771 - RNA, 22 nt, Human
ugcaggggaggggaguuguagg

SEQ ID NO: 1309772 - RNA, 19 nt, Human
ugccccagaacaguggucg

SEQ ID NO: 1309773 - RNA, 18 nt, Human
ugccugggacccuggcug

SEQ ID NO: 1309774 - RNA, 21 nt, Human
ugcggagaccucugucucagg

SEQ ID NO: 1309775 - RNA, 23 nt, Human
uggauuugcugcggagaccucug

SEQ ID NO: 1309776 - RNA, 18 nt, Human
uggccgggccugggagcc

SEQ ID NO: 1309777 - RNA, 22 nt, Human
ugggaagggccggggugggacc

SEQ ID NO: 1309778 - RNA, 19 nt, Human
ugggaccugucagcuucca

SEQ ID NO: 1309779 - RNA, 22 nt, Human
ugggagcccgagaggaggcagc

SEQ ID NO: 1309780 - RNA, 21 nt, Human
ugggggcugcaggggagggga

SEQ ID NO: 1309781 - RNA, 18 nt, Human
uggguggauuugcugcgg

SEQ ID NO: 1309782 - RNA, 18 nt, Human
ugucaaagcuccagguug

SEQ ID NO: 1309783 - RNA, 21 nt, Human
uucugagcccggacuguugcc

SEQ ID NO: 1309784 - RNA, 19 nt, Human
acuacaguuucuuagaauu

SEQ ID NO: 1309785 - RNA, 21 nt, Human
caguuucuuagaauuuccugc

SEQ ID NO: 1309786 - RNA, 25 nt, Human
uuuccugccguugauguuuuucuug

SEQ ID NO: 1309787 - RNA, 18 nt, Human
uuucuugaauacacugaa

SEQ ID NO: 1309788 - RNA, 25 nt, Human
aaaaacaucucaaggcaucacaggg

SEQ ID NO: 1309789 - RNA, 19 nt, Human
aaaaugaaggccuagaagg

SEQ ID NO: 1309790 - RNA, 20 nt, Human
aacaugccgaaaccccgucu

SEQ ID NO: 1309791 - RNA, 21 nt, Human
aacaugccgaaaccccgucuc

SEQ ID NO: 1309792 - RNA, 18 nt, Human
aaucgcuugaaccuggga

SEQ ID NO: 1309793 - RNA, 24 nt, Human
aaucgcuugaaccugggaggcaga

SEQ ID NO: 1309794 - RNA, 26 nt, Human
acaaaacaaaauaaaacaaacaaaaa

SEQ ID NO: 1309795 - RNA, 18 nt, Human
acccugaggucaggagag

SEQ ID NO: 1309796 - RNA, 23 nt, Human
acuaauacaaaaauuagccccgu

SEQ ID NO: 1309797 - RNA, 21 nt, Human
acucaaaaacaaaacaaaaua

SEQ ID NO: 1309798 - RNA, 22 nt, Human
agaaucgcuugaaccugggagg

SEQ ID NO: 1309799 - RNA, 24 nt, Human
agccuaggugacaaagccagacuc

SEQ ID NO: 1309800 - RNA, 24 nt, Human
aggcaagguggcucacgccuguaa

SEQ ID NO: 1309801 - RNA, 22 nt, Human
aggcaggagaaucgcuugaacc

SEQ ID NO: 1309802 - RNA, 24 nt, Human
aggcaggagaaucgcuugaaccug

SEQ ID NO: 1309803 - RNA, 21 nt, Human
aggccgaggugggcugaucac

SEQ ID NO: 1309804 - RNA, 19 nt, Human
auggggccaaagaaaaggg

SEQ ID NO: 1309805 - RNA, 20 nt, Human
caaaaaaaaaaagagagaaa

SEQ ID NO: 1309806 - RNA, 24 nt, Human
caaaaacaaaacaaaauaaaacaa

SEQ ID NO: 1309807 - RNA, 24 nt, Human
caaaacaaaauaaaacaaacaaaa

SEQ ID NO: 1309808 - RNA, 25 nt, Human
caaaauuucaaagauaaagcaacau

SEQ ID NO: 1309809 - RNA, 22 nt, Human
caacauaaaauauggggccaaa

SEQ ID NO: 1309810 - RNA, 24 nt, Human
caacaugccgaaaccccgucucua

SEQ ID NO: 1309811 - RNA, 18 nt, Human
caacuuccagcuccaucc

SEQ ID NO: 1309812 - RNA, 24 nt, Human
cacaccuguaaucucagcuacuug

SEQ ID NO: 1309813 - RNA, 20 nt, Human
caccuguaaucucagcuacu

SEQ ID NO: 1309814 - RNA, 24 nt, Human
caccuguaaucucagcuacuuggg

SEQ ID NO: 1309815 - RNA, 24 nt, Human
cacgccuguaaucccggcacuuug

SEQ ID NO: 1309816 - RNA, 20 nt, Human
cacuacaugccagccuaggu

SEQ ID NO: 1309817 - RNA, 20 nt, Human
cagcaaaggcugguuguggc

SEQ ID NO: 1309818 - RNA, 21 nt, Human
cagcaaaggcugguuguggca

SEQ ID NO: 1309819 - RNA, 22 nt, Human
caggagagacuggccuggccaa

SEQ ID NO: 1309820 - RNA, 21 nt, Human
cauauaacaguuaagaaaaaa

SEQ ID NO: 1309821 - RNA, 18 nt, Human
caugcaauucgaacccau

SEQ ID NO: 1309822 - RNA, 21 nt, Human
ccagccuaggugacaaagcca

SEQ ID NO: 1309823 - RNA, 23 nt, Human
ccccgugugguggcacacaccug

SEQ ID NO: 1309824 - RNA, 21 nt, Human
cccuaaguuuucauaaccaaa

SEQ ID NO: 1309825 - RNA, 23 nt, Human
ccuggccaacaugccgaaacccc

SEQ ID NO: 1309826 - RNA, 24 nt, Human
ccuggccaacaugccgaaaccccg

SEQ ID NO: 1309827 - RNA, 21 nt, Human
ccuguaaucucagcuacuugg

SEQ ID NO: 1309828 - RNA, 25 nt, Human
cgaggugggcugaucacccugaggu

SEQ ID NO: 1309829 - RNA, 27 nt, Human
cgaggugggcugaucacccugagguca

SEQ ID NO: 1309830 - RNA, 18 nt, Human
cgccuguaaucccggcac

SEQ ID NO: 1309831 - RNA, 24 nt, Human
cggcacuuugugaggccgaggugg

SEQ ID NO: 1309832 - RNA, 22 nt, Human
cucacgccuguaaucccggcac

SEQ ID NO: 1309833 - RNA, 24 nt, Human
cucacgccuguaaucccggcacuu

SEQ ID NO: 1309834 - RNA, 24 nt, Human
cugggaggcagagauugcagauca

SEQ ID NO: 1309835 - RNA, 21 nt, Human
cuguaaucucagcuacuuggg

SEQ ID NO: 1309836 - RNA, 18 nt, Human
gaucacccugaggucagg

SEQ ID NO: 1309837 - RNA, 19 nt, Human
gaucacccugaggucagga

SEQ ID NO: 1309838 - RNA, 19 nt, Human
gcacuuugugaggccgagg

SEQ ID NO: 1309839 - RNA, 23 nt, Human
gcacuuugugaggccgagguggg

SEQ ID NO: 1309840 - RNA, 24 nt, Human
gcagaucaugccacuacaugccag

SEQ ID NO: 1309841 - RNA, 22 nt, Human
gccaaaauguagauucaaucca

SEQ ID NO: 1309842 - RNA, 23 nt, Human
gccagccuaggugacaaagccag

SEQ ID NO: 1309843 - RNA, 23 nt, Human
gccuggccaacaugccgaaaccc

SEQ ID NO: 1309844 - RNA, 22 nt, Human
ggauuucaggcauaaaacaaug

SEQ ID NO: 1309845 - RNA, 19 nt, Human
ggcucacgccuguaauccc

SEQ ID NO: 1309846 - RNA, 20 nt, Human
gggcugaggcaggagaaucg

SEQ ID NO: 1309847 - RNA, 24 nt, Human
gggcugaggcaggagaaucgcuug

SEQ ID NO: 1309848 - RNA, 23 nt, Human
ggugacaaagccagacucaaaaa

SEQ ID NO: 1309849 - RNA, 22 nt, Human
gguggcucacgccuguaauccc

SEQ ID NO: 1309850 - RNA, 24 nt, Human
gguggcucacgccuguaaucccgg

SEQ ID NO: 1309851 - RNA, 18 nt, Human
gguuguggcaaaguuuca

SEQ ID NO: 1309852 - RNA, 24 nt, Human
uaaaacaaacaaaaaaacugcaua

SEQ ID NO: 1309853 - RNA, 24 nt, Human
uaaaacaaacaaaaaaacugcaua

SEQ ID NO: 1309854 - RNA, 21 nt, Human
uaaaaugaaggccuagaagga

SEQ ID NO: 1309855 - RNA, 19 nt, Human
uaaccaaaaaaaaaaagag

SEQ ID NO: 1309856 - RNA, 22 nt, Human
uaacuucugacucuaguuuccc

SEQ ID NO: 1309857 - RNA, 25 nt, Human
uacaugccagccuaggugacaaagc

SEQ ID NO: 1309858 - RNA, 23 nt, Human
uacuuggggggcugaggcaggag

SEQ ID NO: 1309859 - RNA, 18 nt, Human
ucaauccaacauuaugcc

SEQ ID NO: 1309860 - RNA, 22 nt, Human
ucacgccuguaaucccggcacu

SEQ ID NO: 1309861 - RNA, 19 nt, Human
ucaucuagaauuauuuggu

SEQ ID NO: 1309862 - RNA, 21 nt, Human
ucaugaaaaacaaaaaaaaac

SEQ ID NO: 1309863 - RNA, 22 nt, Human
ucauucgaacccauucgugcau

SEQ ID NO: 1309864 - RNA, 28 nt, Human
ucauugcauccuuuucauggggcccucc

SEQ ID NO: 1309865 - RNA, 23 nt, Human
ucauuucaaacugcaugaugugg

SEQ ID NO: 1309866 - RNA, 20 nt, Human
ucccggcacuuugugaggcc

SEQ ID NO: 1309867 - RNA, 18 nt, Human
ucgcuugaaccugggagg

SEQ ID NO: 1309868 - RNA, 18 nt, Human
ugaaggccuagaaggauc

SEQ ID NO: 1309869 - RNA, 20 nt, Human
ugaggcaggagaaucgcuug

SEQ ID NO: 1309870 - RNA, 24 nt, Human
ugaggcaggagaaucgcuugaacc

SEQ ID NO: 1309871 - RNA, 25 nt, Human
ugaggcaggagaaucgcuugaaccu

SEQ ID NO: 1309872 - RNA, 18 nt, Human
ugaggucaggagagacug

SEQ ID NO: 1309873 - RNA, 21 nt, Human
ugaggucaggagagacuggcc

SEQ ID NO: 1309874 - RNA, 19 nt, Human
ugaucacccugaggucagg

SEQ ID NO: 1309875 - RNA, 22 nt, Human
uggcacacaccuguaaucucag

SEQ ID NO: 1309876 - RNA, 24 nt, Human
uggccuggccaacaugccgaaacc

SEQ ID NO: 1309877 - RNA, 20 nt, Human
uggcucacgccuguaauccc

SEQ ID NO: 1309878 - RNA, 24 nt, Human
uggcucacgccuguaaucccggca

SEQ ID NO: 1309879 - RNA, 23 nt, Human
ugggaggcagagauugcagauca

SEQ ID NO: 1309880 - RNA, 23 nt, Human
uggggggcugaggcaggagaauc

SEQ ID NO: 1309881 - RNA, 23 nt, Human
ugguggcacacaccuguaaucuc

SEQ ID NO: 1309882 - RNA, 24 nt, Human
ugguggcacacaccuguaaucuca

SEQ ID NO: 1309883 - RNA, 20 nt, Human
ugugaggccgaggugggcug

SEQ ID NO: 1309884 - RNA, 20 nt, Human
ugugcuacagcaaaggcugg

SEQ ID NO: 1309885 - RNA, 21 nt, Human
uucauaaccaaaaaaaaaaag

SEQ ID NO: 1309886 - RNA, 22 nt, Human
uugaccuuuugaaacauccaaa

SEQ ID NO: 1309887 - RNA, 24 nt, Human
uuggggggcugaggcaggagaauc

SEQ ID NO: 1309888 - RNA, 19 nt, Human
aggagcuggccgcugaggg

SEQ ID NO: 1309889 - RNA, 23 nt, Human
cacccuaagaugggaagggcagg

SEQ ID NO: 1309890 - RNA, 20 nt, Human
ccaccaaggcuggccugaga

SEQ ID NO: 1309891 - RNA, 19 nt, Human
cgacacccuaagaugggaa

SEQ ID NO: 1309892 - RNA, 24 nt, Human
cuagaaaccucccaccaaggcugg

SEQ ID NO: 1309893 - RNA, 22 nt, Human
cucccaccaaggcuggccugag

SEQ ID NO: 1309894 - RNA, 21 nt, Human
ggcgaggagcuggccgcugag

SEQ ID NO: 1309895 - RNA, 19 nt, Human
ggguggcgagcgggcugag

SEQ ID NO: 1309896 - RNA, 21 nt, Human
uaacgaacuuuggaaugauau

SEQ ID NO: 1309897 - RNA, 20 nt, Human
uauucauuuaaaacaaacuu

SEQ ID NO: 1309898 - RNA, 18 nt, Human
uccuagaaaccucccacc

SEQ ID NO: 1309899 - RNA, 24 nt, Human
ucucuuuauugagggaauaagagu

SEQ ID NO: 1309900 - RNA, 26 nt, Human
ugagggaauaagagucugucucagac

SEQ ID NO: 1309901 - RNA, 20 nt, Human
ugagguggcuacggccgagg

SEQ ID NO: 1309902 - RNA, 22 nt, Human
ugagguggcuacggccgagggg

SEQ ID NO: 1309903 - RNA, 19 nt, Human
uggcuacggccgaggggag

SEQ ID NO: 1309904 - RNA, 21 nt, Human
ugggaagggcagggagcgaau

SEQ ID NO: 1309905 - RNA, 20 nt, Human
ccaaaacagaauccucccug

SEQ ID NO: 1309906 - RNA, 24 nt, Human
cccaaaacagaauccucccugagg

SEQ ID NO: 1309907 - RNA, 22 nt, Human
gugaugcaggcggagacccugc

SEQ ID NO: 1309908 - RNA, 22 nt, Human
ucccaaaacagaauccucccug

SEQ ID NO: 1309909 - RNA, 22 nt, Human
ucccugagguagucggagagca

SEQ ID NO: 1309910 - RNA, 25 nt, Human
uugaacccuuaucaauagguuuugg

SEQ ID NO: 1309911 - RNA, 23 nt, Human
aaaaugcuucuaaccucagucug

SEQ ID NO: 1309912 - RNA, 26 nt, Human
auaaaauuaucuucuugcugccaaag

SEQ ID NO: 1309913 - RNA, 23 nt, Human
auuuucaggaagaggcaaaacuu

SEQ ID NO: 1309914 - RNA, 18 nt, Human
ccaaagaaaaugcuucua

SEQ ID NO: 1309915 - RNA, 31 nt, Human
cuucuugcugccaaagaaaaugcuucuaacu

SEQ ID NO: 1309916 - RNA, 24 nt, Human
cuugcugccaaagaaaaugcuucu

SEQ ID NO: 1309917 - RNA, 23 nt, Human
uauaagauuuuauuaaaccuuua

SEQ ID NO: 1309918 - RNA, 18 nt, Human
ucaggaagaggcaaaacu

SEQ ID NO: 1309919 - RNA, 19 nt, Human
ucaugucucucucucucuu

SEQ ID NO: 1309920 - RNA, 18 nt, Human
ucucucucucucucucua

SEQ ID NO: 1309921 - RNA, 20 nt, Human
uucuaaccucagucugguag

SEQ ID NO: 1309922 - RNA, 22 nt, Human
uuucaggaagaggcaaaacuuc

SEQ ID NO: 1309923 - RNA, 21 nt, Human
aauaaugguugccaggaggga

SEQ ID NO: 1309924 - RNA, 24 nt, Human
accugaagcuggaagaagugagga

SEQ ID NO: 1309925 - RNA, 24 nt, Human
agaagaacagagcugaaacccagg

SEQ ID NO: 1309926 - RNA, 18 nt, Human
agagcugaaacccagggu

SEQ ID NO: 1309927 - RNA, 22 nt, Human
agccaucaaaagcaaggagcaa

SEQ ID NO: 1309928 - RNA, 19 nt, Human
aggggcgagaggaaggggg

SEQ ID NO: 1309929 - RNA, 23 nt, Human
caagugauagaauaauagaaaca

SEQ ID NO: 1309930 - RNA, 23 nt, Human
ccagggugcacacacuguguggu

SEQ ID NO: 1309931 - RNA, 19 nt, Human
cgagaggaagggggccaca

SEQ ID NO: 1309932 - RNA, 26 nt, Human
cucguggugauggaaggguucucccu

SEQ ID NO: 1309933 - RNA, 19 nt, Human
gaauaauagaaacagagaa

SEQ ID NO: 1309934 - RNA, 22 nt, Human
gagauauuaccacugggggaaa

SEQ ID NO: 1309935 - RNA, 22 nt, Human
gagggaaggagguggcaggggc

SEQ ID NO: 1309936 - RNA, 22 nt, Human
gcugaaacccaggguggccugg

SEQ ID NO: 1309937 - RNA, 19 nt, Human
gcugugauguugugccacc

SEQ ID NO: 1309938 - RNA, 22 nt, Human
gguugccaggagggaaggaggu

SEQ ID NO: 1309939 - RNA, 19 nt, Human
uacuuugagauccuggcug

SEQ ID NO: 1309940 - RNA, 24 nt, Human
uccaaaccaugggaugcgacucag

SEQ ID NO: 1309941 - RNA, 22 nt, Human
uccggagagcucugccaaguga

SEQ ID NO: 1309942 - RNA, 24 nt, Human
uggaagaagugaggacccgugacg

SEQ ID NO: 1309943 - RNA, 23 nt, Human
agacuaacaaauccaccuuggca

SEQ ID NO: 1309944 - RNA, 26 nt, Human
caccaaggagacugcagucaaauaaa

SEQ ID NO: 1309945 - RNA, 18 nt, Human
caccaccugugccucugc

SEQ ID NO: 1309946 - RNA, 18 nt, Human
caccaccugugccucugc

SEQ ID NO: 1309947 - RNA, 22 nt, Human
cgaaaaguacugaaaaugcuau

SEQ ID NO: 1309948 - RNA, 26 nt, Human
cgccucuacugucugccaccaccugu

SEQ ID NO: 1309949 - RNA, 19 nt, Human
cuacugucugccaccaccu

SEQ ID NO: 1309950 - RNA, 24 nt, Human
cucacagcuuuggccacgcacucc

SEQ ID NO: 1309951 - RNA, 20 nt, Human
gacuugggcaauguggccag

SEQ ID NO: 1309952 - RNA, 21 nt, Human
gggcaauguggccaggagggc

SEQ ID NO: 1309953 - RNA, 20 nt, Human
ggucagaaaaaucaacauuu

SEQ ID NO: 1309954 - RNA, 27 nt, Human
uaaauacauaauacagaagccugugug

SEQ ID NO: 1309955 - RNA, 18 nt, Human
uauuagcugaauuuguga

SEQ ID NO: 1309956 - RNA, 20 nt, Human
uauuucaaauauauuuucac

SEQ ID NO: 1309957 - RNA, 19 nt, Human
uauuuuucccauuuuguuu

SEQ ID NO: 1309958 - RNA, 22 nt, Human
ugaguuauccuuauuuuuccca

SEQ ID NO: 1309959 - RNA, 24 nt, Human
ugaguuauccuuauuuuucccauu

SEQ ID NO: 1309960 - RNA, 19 nt, Human
ugccaccaccugugccucu

SEQ ID NO: 1309961 - RNA, 18 nt, Human
uguccuaggccgaggcua

SEQ ID NO: 1309962 - RNA, 24 nt, Human
uuagcugaauuugugauuuccuuu

SEQ ID NO: 1309963 - RNA, 24 nt, Human
uuauggucagaaaaaucaacauuu

SEQ ID NO: 1309964 - RNA, 25 nt, Human
aaaucaaagccacuauggcaaagaa

SEQ ID NO: 1309965 - RNA, 24 nt, Human
aaauucuuuuuaucucccccaccc

SEQ ID NO: 1309966 - RNA, 24 nt, Human
aauucuccacauauuuguauuuuu

SEQ ID NO: 1309967 - RNA, 24 nt, Human
auaugacgcacaaagccaaaaugg

SEQ ID NO: 1309968 - RNA, 19 nt, Human
aucucccccaccccacaaa

SEQ ID NO: 1309969 - RNA, 20 nt, Human
caaaacagggauuuuuaaac

SEQ ID NO: 1309970 - RNA, 24 nt, Human
caaagaaacaggagauuguacaga

SEQ ID NO: 1309971 - RNA, 25 nt, Human
caaagaaacaggagauuguacagau

SEQ ID NO: 1309972 - RNA, 22 nt, Human
caccccacaaaccaguaauuca

SEQ ID NO: 1309973 - RNA, 19 nt, Human
cacuauggcaaagaaacag

SEQ ID NO: 1309974 - RNA, 18 nt, Human
cagcuaauccaucccacu

SEQ ID NO: 1309975 - RNA, 23 nt, Human
caggacaaaacagggauuuuuaa

SEQ ID NO: 1309976 - RNA, 24 nt, Human
cauauaaucccaaaucaaagccac

SEQ ID NO: 1309977 - RNA, 27 nt, Human
ccaccccacaaaccaguaauucagcaa

SEQ ID NO: 1309978 - RNA, 23 nt, Human
cuuuuuaucucccccaccccaca

SEQ ID NO: 1309979 - RNA, 21 nt, Human
cuuuuuggcagaaucauccaa

SEQ ID NO: 1309980 - RNA, 20 nt, Human
gggauuuuuaaacuuuuuuu

SEQ ID NO: 1309981 - RNA, 19 nt, Human
uaaaauuucaggacaaaac

SEQ ID NO: 1309982 - RNA, 20 nt, Human
ucacagcuaauccaucccac

SEQ ID NO: 1309983 - RNA, 24 nt, Human
ucauccaaagaguuuuucacagcu

SEQ ID NO: 1309984 - RNA, 22 nt, Human
ugagaccaaaauucuccacaua

SEQ ID NO: 1309985 - RNA, 24 nt, Human
uggcaaagaaacaggagauuguac

SEQ ID NO: 1309986 - RNA, 24 nt, Human
uguacagaugguaaggcgaccauc

SEQ ID NO: 1309987 - RNA, 21 nt, Human
uucuuuuuaucucccccaccc

SEQ ID NO: 1309988 - RNA, 19 nt, Human
gaaggaacuuuugggggcu

SEQ ID NO: 1309989 - RNA, 20 nt, Human
uggaaggaacuuuugggggc

SEQ ID NO: 1309990 - RNA, 22 nt, Human
uggaaggaacuuuugggggcug

SEQ ID NO: 1309991 - RNA, 19 nt, Human
aacaacaaaaaacccagag

SEQ ID NO: 1309992 - RNA, 21 nt, Human
aaccacacaacaacaaaaaac

SEQ ID NO: 1309993 - RNA, 27 nt, Human
aaccacacaacaacaaaaaacccagag

SEQ ID NO: 1309994 - RNA, 29 nt, Human
aaccacacaacaacaaaaaacccagagug

SEQ ID NO: 1309995 - RNA, 25 nt, Human
aauaauaaccacacaacaacaaaaa

SEQ ID NO: 1309996 - RNA, 22 nt, Human
acaacaaaaaacccagagugaa

SEQ ID NO: 1309997 - RNA, 23 nt, Human
acaacaaguuugggauaagguuc

SEQ ID NO: 1309998 - RNA, 21 nt, Human
agacuuagagaggcccaucua

SEQ ID NO: 1309999 - RNA, 21 nt, Human
auuugacuugugucacugagg

SEQ ID NO: 1310000 - RNA, 21 nt, Human
caaaaaacccagagugaaacu

SEQ ID NO: 1310001 - RNA, 25 nt, Human
caacaaaaaacccagagugaaacua

SEQ ID NO: 1310002 - RNA, 26 nt, Human
caacaacaaaaaacccagagugaaac

SEQ ID NO: 1310003 - RNA, 27 nt, Human
caacaacaaaaaacccagagugaaacu

SEQ ID NO: 1310004 - RNA, 21 nt, Human
ccacacaacaacaaaaaaccc

SEQ ID NO: 1310005 - RNA, 22 nt, Human
ccacacaacaacaaaaaaccca

SEQ ID NO: 1310006 - RNA, 24 nt, Human
ccacacaacaacaaaaaacccaga

SEQ ID NO: 1310007 - RNA, 19 nt, Human
gagaauaauaaccacacaa

SEQ ID NO: 1310008 - RNA, 22 nt, Human
gagaauaauaaccacacaacaa

SEQ ID NO: 1310009 - RNA, 21 nt, Human
ucauugugaucccaacuuuca

SEQ ID NO: 1310010 - RNA, 20 nt, Human
ucuaggugguaaaaaacgcu

SEQ ID NO: 1310011 - RNA, 25 nt, Human
ugagcaaauagacuuagagaggccc

SEQ ID NO: 1310012 - RNA, 18 nt, Human
uggcuuccaucacuccuu

SEQ ID NO: 1310013 - RNA, 23 nt, Human
uucauugagcaaauagacuuaga

SEQ ID NO: 1310014 - RNA, 25 nt, Human
aaaaaaaaaaaacaaacaaacaaac

SEQ ID NO: 1310015 - RNA, 26 nt, Human
aaaaaaaaaaaacaaacaaacaaaca

SEQ ID NO: 1310016 - RNA, 28 nt, Human
aaaaaaaaaacuacugugggaaaaagga

SEQ ID NO: 1310017 - RNA, 25 nt, Human
aaaaaaaacaaacaaacaaacaaaa

SEQ ID NO: 1310018 - RNA, 28 nt, Human
aaaaaaacaaacaaacaaacaaaaaaaa

SEQ ID NO: 1310019 - RNA, 19 nt, Human
aaaaagccugauacacuaa

SEQ ID NO: 1310020 - RNA, 21 nt, Human
aaaaagccugauacacuaaac

SEQ ID NO: 1310021 - RNA, 19 nt, Human
aacuaacuaaaaaaagccu

SEQ ID NO: 1310022 - RNA, 21 nt, Human
aagaaucauuaucauaggaag

SEQ ID NO: 1310023 - RNA, 18 nt, Human
aagcaauucgagcaaaaa

SEQ ID NO: 1310024 - RNA, 24 nt, Human
aagggucauuucaaaaaucagagg

SEQ ID NO: 1310025 - RNA, 22 nt, Human
aauaacagcagguuuagaggaa

SEQ ID NO: 1310026 - RNA, 22 nt, Human
aaucauuaucauaggaagcaaa

SEQ ID NO: 1310027 - RNA, 25 nt, Human
aaugucuucccuaaaaguggguaac

SEQ ID NO: 1310028 - RNA, 24 nt, Human
accauguccagcuaauuuuuugua

SEQ ID NO: 1310029 - RNA, 19 nt, Human
acccaggcuggagugcagu

SEQ ID NO: 1310030 - RNA, 18 nt, Human
acgggguuucaacguguu

SEQ ID NO: 1310031 - RNA, 19 nt, Human
acgggguuucaacguguua

SEQ ID NO: 1310032 - RNA, 20 nt, Human
acgggguuucaacguguuag

SEQ ID NO: 1310033 - RNA, 24 nt, Human
agcuuagagcaagaauaaucacaa

SEQ ID NO: 1310034 - RNA, 25 nt, Human
aggcuggagugcaguggcacgaucu

SEQ ID NO: 1310035 - RNA, 21 nt, Human
agggaaguuucagcuuagagc

SEQ ID NO: 1310036 - RNA, 18 nt, Human
aguagagacgggguuuca

SEQ ID NO: 1310037 - RNA, 22 nt, Human
aguagagacgggguuucaacgu

SEQ ID NO: 1310038 - RNA, 21 nt, Human
agucugggauuacaggcguga

SEQ ID NO: 1310039 - RNA, 20 nt, Human
agugcaguggcacgaucucg

SEQ ID NO: 1310040 - RNA, 23 nt, Human
agugcaguggcacgaucucggcu

SEQ ID NO: 1310041 - RNA, 24 nt, Human
agugcaguggcacgaucucggcuc

SEQ ID NO: 1310042 - RNA, 22 nt, Human
augaaaaacuuacaaaaagucu

SEQ ID NO: 1310043 - RNA, 21 nt, Human
caaaauggaccagaagaauca

SEQ ID NO: 1310044 - RNA, 24 nt, Human
caaauacauaugcucagauuuacc

SEQ ID NO: 1310045 - RNA, 20 nt, Human
caaccucugccuccuggguu

SEQ ID NO: 1310046 - RNA, 18 nt, Human
caacguguuaggcaggau

SEQ ID NO: 1310047 - RNA, 24 nt, Human
caacguguuaggcaggauggucuc

SEQ ID NO: 1310048 - RNA, 21 nt, Human
cacugcaaccucugccuccug

SEQ ID NO: 1310049 - RNA, 23 nt, Human
cacugcaaccucugccuccuggg

SEQ ID NO: 1310050 - RNA, 19 nt, Human
cagcagguuuagaggaaga

SEQ ID NO: 1310051 - RNA, 22 nt, Human
caggauggucuccgucucuuga

SEQ ID NO: 1310052 - RNA, 19 nt, Human
caggugcccuaugaagucc

SEQ ID NO: 1310053 - RNA, 24 nt, Human
cagguuuagaggaagaggaaaaaa

SEQ ID NO: 1310054 - RNA, 22 nt, Human
caugccauucuccugccucagc

SEQ ID NO: 1310055 - RNA, 24 nt, Human
ccacaaaaaguuaaaagaaauaac

SEQ ID NO: 1310056 - RNA, 21 nt, Human
ccacagucugggauuacaggc

SEQ ID NO: 1310057 - RNA, 21 nt, Human
ccacagucugggauuacaggc

SEQ ID NO: 1310058 - RNA, 23 nt, Human
ccacagucugggauuacaggcgu

SEQ ID NO: 1310059 - RNA, 18 nt, Human
ccacugcacccggccaga

SEQ ID NO: 1310060 - RNA, 27 nt, Human
cccacaaaaaguuaaaagaaauaacag

SEQ ID NO: 1310061 - RNA, 24 nt, Human
cccacagucugggauuacaggcgu

SEQ ID NO: 1310062 - RNA, 20 nt, Human
ccucugccuccuggguucau

SEQ ID NO: 1310063 - RNA, 24 nt, Human
ccugauuagcugggacuacaggca

SEQ ID NO: 1310064 - RNA, 24 nt, Human
cggccagacuuuaaaaaaaaaaaa

SEQ ID NO: 1310065 - RNA, 24 nt, Human
cucacugcaaccucugccuccugg

SEQ ID NO: 1310066 - RNA, 22 nt, Human
cuccugccucagccuccugauu

SEQ ID NO: 1310067 - RNA, 21 nt, Human
cuccuggguucaugccauucu

SEQ ID NO: 1310068 - RNA, 24 nt, Human
cucuugacuucgugaucugcccgc

SEQ ID NO: 1310069 - RNA, 19 nt, Human
cugauuagcugggacuaca

SEQ ID NO: 1310070 - RNA, 24 nt, Human
cugcaaccucugccuccuggguuc

SEQ ID NO: 1310071 - RNA, 23 nt, Human
cugccucagccuccugauuagcu

SEQ ID NO: 1310072 - RNA, 18 nt, Human
cugucacccaggcuggag

SEQ ID NO: 1310073 - RNA, 25 nt, Human
cuugacuucgugaucugcccgccug

SEQ ID NO: 1310074 - RNA, 27 nt, Human
cuuuaaaaaaaaaaaacaaacaaacaa

SEQ ID NO: 1310075 - RNA, 22 nt, Human
gaaaaacuuacaaaaagucugu

SEQ ID NO: 1310076 - RNA, 21 nt, Human
gaagaggaaaaaauaauaaga

SEQ ID NO: 1310077 - RNA, 24 nt, Human
gacuacaggcacccguuaccaugu

SEQ ID NO: 1310078 - RNA, 23 nt, Human
gacuucgugaucugcccgccugg

SEQ ID NO: 1310079 - RNA, 21 nt, Human
gagauggagucuugcucuguc

SEQ ID NO: 1310080 - RNA, 22 nt, Human
gauacacuaaacaaaacccaaa

SEQ ID NO: 1310081 - RNA, 18 nt, Human
gauuacaggcgugagcca

SEQ ID NO: 1310082 - RNA, 19 nt, Human
gauuacaggcgugagccac

SEQ ID NO: 1310083 - RNA, 23 nt, Human
gauuacaggcgugagccacugca

SEQ ID NO: 1310084 - RNA, 22 nt, Human
gcaaccucugccuccuggguuc

SEQ ID NO: 1310085 - RNA, 25 nt, Human
gcucugucacccaggcuggagugca

SEQ ID NO: 1310086 - RNA, 19 nt, Human
gcuggagugcaguggcacg

SEQ ID NO: 1310087 - RNA, 23 nt, Human
ggguuuaauuuuucccacaaaaa

SEQ ID NO: 1310088 - RNA, 26 nt, Human
uaaaaaaaaaaaacaaacaaacaaac

SEQ ID NO: 1310089 - RNA, 23 nt, Human
uaacuaaaaaaagccugauacac

SEQ ID NO: 1310090 - RNA, 25 nt, Human
uaagcuaagagaacagaaaaaauga

SEQ ID NO: 1310091 - RNA, 24 nt, Human
uaauuuuuuguauuuuuaguagag

SEQ ID NO: 1310092 - RNA, 25 nt, Human
uaauuuuuuguauuuuuaguagaga

SEQ ID NO: 1310093 - RNA, 24 nt, Human
uacaggcacccguuaccaugucca

SEQ ID NO: 1310094 - RNA, 19 nt, Human
uacaggcgugagccacugc

SEQ ID NO: 1310095 - RNA, 23 nt, Human
uacaggcgugagccacugcaccc

SEQ ID NO: 1310096 - RNA, 19 nt, Human
uaccucagccaccuuucac

SEQ ID NO: 1310097 - RNA, 24 nt, Human
uaggcaggauggucuccgucucuu

SEQ ID NO: 1310098 - RNA, 19 nt, Human
uaguagagacgggguuuca

SEQ ID NO: 1310099 - RNA, 22 nt, Human
uaguagagacgggguuucaacg

SEQ ID NO: 1310100 - RNA, 24 nt, Human
uaguagagacgggguuucaacgug

SEQ ID NO: 1310101 - RNA, 22 nt, Human
uaugcaguugcaaaauguguga

SEQ ID NO: 1310102 - RNA, 22 nt, Human
uauguauagaaaagucuacacu

SEQ ID NO: 1310103 - RNA, 24 nt, Human
ucacccaggcuggagugcaguggc

SEQ ID NO: 1310104 - RNA, 24 nt, Human
ucacugcaaccucugccuccuggg

SEQ ID NO: 1310105 - RNA, 25 nt, Human
ucacugcaaccucugccuccugggu

SEQ ID NO: 1310106 - RNA, 18 nt, Human
ucaugccauucuccugcc

SEQ ID NO: 1310107 - RNA, 23 nt, Human
ucccacagucugggauuacaggc

SEQ ID NO: 1310108 - RNA, 24 nt, Human
uccugauuagcugggacuacaggc

SEQ ID NO: 1310109 - RNA, 21 nt, Human
uccuggguucaugccauucuc

SEQ ID NO: 1310110 - RNA, 24 nt, Human
uccuggguucaugccauucuccug

SEQ ID NO: 1310111 - RNA, 24 nt, Human
ucugucacccaggcuggagugcag

SEQ ID NO: 1310112 - RNA, 23 nt, Human
ucuugcucugucacccaggcugg

SEQ ID NO: 1310113 - RNA, 24 nt, Human
ucuugcucugucacccaggcugga

SEQ ID NO: 1310114 - RNA, 22 nt, Human
ugaaacuuugguuuagagguaa

SEQ ID NO: 1310115 - RNA, 20 nt, Human
ugaaaugcgggaaaccacag

SEQ ID NO: 1310116 - RNA, 21 nt, Human
ugaaguccugucccuuuagaa

SEQ ID NO: 1310117 - RNA, 23 nt, Human
ugacuucgugaucugcccgccug

SEQ ID NO: 1310118 - RNA, 24 nt, Human
ugagauaucuuaaugaauaacauc

SEQ ID NO: 1310119 - RNA, 24 nt, Human
ugccucagccuccugauuagcugg

SEQ ID NO: 1310120 - RNA, 19 nt, Human
ugccuccuggguucaugcc

SEQ ID NO: 1310121 - RNA, 24 nt, Human
ugcucugucacccaggcuggagug

SEQ ID NO: 1310122 - RNA, 22 nt, Human
uggaaaagaaacuaacaugcua

SEQ ID NO: 1310123 - RNA, 19 nt, Human
uggagucuugcucugucac

SEQ ID NO: 1310124 - RNA, 23 nt, Human
uggagugcaguggcacgaucucg

SEQ ID NO: 1310125 - RNA, 24 nt, Human
uggagugcaguggcacgaucucgg

SEQ ID NO: 1310126 - RNA, 18 nt, Human
ugggacuacaggcacccg

SEQ ID NO: 1310127 - RNA, 24 nt, Human
ugggacuacaggcacccguuacca

SEQ ID NO: 1310128 - RNA, 25 nt, Human
ugggacuacaggcacccguuaccau

SEQ ID NO: 1310129 - RNA, 18 nt, Human
ugggauuacaggcgugag

SEQ ID NO: 1310130 - RNA, 19 nt, Human
ugggauuacaggcgugagc

SEQ ID NO: 1310131 - RNA, 21 nt, Human
ugggauuacaggcgugagcca

SEQ ID NO: 1310132 - RNA, 22 nt, Human
ugggauuacaggcgugagccac

SEQ ID NO: 1310133 - RNA, 22 nt, Human
ugggauuacaggcgugagccac

SEQ ID NO: 1310134 - RNA, 24 nt, Human
ugggauuacaggcgugagccacug

SEQ ID NO: 1310135 - RNA, 26 nt, Human
ugggauuacaggcgugagccacugca

SEQ ID NO: 1310136 - RNA, 21 nt, Human
uguauuuuuaguagagacggg

SEQ ID NO: 1310137 - RNA, 23 nt, Human
ugucugaagaccuagaaauguca

SEQ ID NO: 1310138 - RNA, 24 nt, Human
uuaauuuuucccacaaaaaguuaa

SEQ ID NO: 1310139 - RNA, 18 nt, Human
uuaguagagacgggguuu

SEQ ID NO: 1310140 - RNA, 20 nt, Human
uuaguagagacgggguuuca

SEQ ID NO: 1310141 - RNA, 22 nt, Human
uuaguagagacgggguuucaac

SEQ ID NO: 1310142 - RNA, 24 nt, Human
uuaguagagacgggguuucaacgu

SEQ ID NO: 1310143 - RNA, 19 nt, Human
uucaugccauucuccugcc

SEQ ID NO: 1310144 - RNA, 19 nt, Human
uucgagcaaaaaucaagga

SEQ ID NO: 1310145 - RNA, 24 nt, Human
uugcucugucacccaggcuggagu

SEQ ID NO: 1310146 - RNA, 26 nt, Human
uuuaaaaaaaaaaaacaaacaaacaa

SEQ ID NO: 1310147 - RNA, 22 nt, Human
uuuuuaguagagacgggguuuc

SEQ ID NO: 1310148 - RNA, 21 nt, Human
uuuuuguauuuuuaguagaga

SEQ ID NO: 1310149 - RNA, 24 nt, Human
uuuuuuguauuuuuaguagagacg

SEQ ID NO: 1310150 - RNA, 21 nt, Human
aacccuuuguuggaaugcuuu

SEQ ID NO: 1310151 - RNA, 22 nt, Human
aacccuuuguuggaaugcuuuc

SEQ ID NO: 1310152 - RNA, 19 nt, Human
caacaaauaucuuuuucac

SEQ ID NO: 1310153 - RNA, 24 nt, Human
caguccuugacuuuuuugcccaua

SEQ ID NO: 1310154 - RNA, 22 nt, Human
cauaaacaugaguauuuguaua

SEQ ID NO: 1310155 - RNA, 23 nt, Human
ccugaucuuugauaaucuucucu

SEQ ID NO: 1310156 - RNA, 19 nt, Human
cguggcugcauccaccucc

SEQ ID NO: 1310157 - RNA, 21 nt, Human
cguggcugcauccaccuccuc

SEQ ID NO: 1310158 - RNA, 18 nt, Human
gccuugcauucguggcug

SEQ ID NO: 1310159 - RNA, 22 nt, Human
gucacaaauacaguccuugacu

SEQ ID NO: 1310160 - RNA, 18 nt, Human
guggcagcuaggcccugc

SEQ ID NO: 1310161 - RNA, 25 nt, Human
guucuccuugguuccacaacuuuuc

SEQ ID NO: 1310162 - RNA, 30 nt, Human
uccuugguuccacaacuuuuccauccaccu

SEQ ID NO: 1310163 - RNA, 22 nt, Human
ucucuuagcugauguuuuucag

SEQ ID NO: 1310164 - RNA, 18 nt, Human
ugcauccaccuccuccac

SEQ ID NO: 1310165 - RNA, 19 nt, Human
uggcugaguucaugaaucu

SEQ ID NO: 1310166 - RNA, 19 nt, Human
uguuguaaccuguagcuuc

SEQ ID NO: 1310167 - RNA, 19 nt, Human
uugcauucguggcugcauc

SEQ ID NO: 1310168 - RNA, 27 nt, Human
uuucuugccacugccucagucaugauu

SEQ ID NO: 1310169 - RNA, 23 nt, Human
uuuucaguguuuucuuuaaugcc

SEQ ID NO: 1310170 - RNA, 24 nt, Human
uuuuccauccaccuuguguggccu

SEQ ID NO: 1310171 - RNA, 22 nt, Human
aaaaaacuuagcccaugcugac

SEQ ID NO: 1310172 - RNA, 21 nt, Human
aaaaacaaaaagaaacaagca

SEQ ID NO: 1310173 - RNA, 23 nt, Human
aaaacaaaaagaaacaagcagaa

SEQ ID NO: 1310174 - RNA, 24 nt, Human
aaaacaaaaagaaacaagcagaaa

SEQ ID NO: 1310175 - RNA, 25 nt, Human
aaaaggccaagaauaagcaguggga

SEQ ID NO: 1310176 - RNA, 25 nt, Human
aaacaagaaaggaggaaaagggacc

SEQ ID NO: 1310177 - RNA, 22 nt, Human
aaacuccaagcagaagccccag

SEQ ID NO: 1310178 - RNA, 23 nt, Human
aaacuggaaagagaagauucugg

SEQ ID NO: 1310179 - RNA, 23 nt, Human
aaagagaagauucuggaagagaa

SEQ ID NO: 1310180 - RNA, 19 nt, Human
aaagugcugggauuacaga

SEQ ID NO: 1310181 - RNA, 24 nt, Human
aaagugcugggauuacagacauga

SEQ ID NO: 1310182 - RNA, 21 nt, Human
aagaggccugcuuugggcuag

SEQ ID NO: 1310183 - RNA, 24 nt, Human
aagagguuucgccauguuggccag

SEQ ID NO: 1310184 - RNA, 18 nt, Human
aagcagaagccccagaga

SEQ ID NO: 1310185 - RNA, 24 nt, Human
aagcagacaacacugucugccaga

SEQ ID NO: 1310186 - RNA, 23 nt, Human
aagcagcuccagccaguucugcc

SEQ ID NO: 1310187 - RNA, 24 nt, Human
aagcagcuccagccaguucugccc

SEQ ID NO: 1310188 - RNA, 18 nt, Human
aaggacccaagaugccag

SEQ ID NO: 1310189 - RNA, 21 nt, Human
aagugcugggauuacagacau

SEQ ID NO: 1310190 - RNA, 24 nt, Human
aaucugcaagucuguuagggaguu

SEQ ID NO: 1310191 - RNA, 19 nt, Human
acaaagugcugggauuaca

SEQ ID NO: 1310192 - RNA, 24 nt, Human
acaaagugcugggauuacagacau

SEQ ID NO: 1310193 - RNA, 18 nt, Human
acagaguagaucgcaggg

SEQ ID NO: 1310194 - RNA, 23 nt, Human
acaggugcccaccaccacgcccg

SEQ ID NO: 1310195 - RNA, 21 nt, Human
acaugaaccacugcgccuggc

SEQ ID NO: 1310196 - RNA, 19 nt, Human
acccaggcuggagugcaau

SEQ ID NO: 1310197 - RNA, 19 nt, Human
acugcaagacccuccuggg

SEQ ID NO: 1310198 - RNA, 23 nt, Human
agagaacacauucaagacccaaa

SEQ ID NO: 1310199 - RNA, 18 nt, Human
agagaagauucuggaaga

SEQ ID NO: 1310200 - RNA, 24 nt, Human
agagguuucgccauguuggccagg

SEQ ID NO: 1310201 - RNA, 26 nt, Human
agcccuggcuuuuccuccaaaaacaa

SEQ ID NO: 1310202 - RNA, 23 nt, Human
aggaggaaaagaauuugggcuaa

SEQ ID NO: 1310203 - RNA, 24 nt, Human
aggaggaaaagaauuugggcuaaa

SEQ ID NO: 1310204 - RNA, 20 nt, Human
aggugcccaccaccacgccc

SEQ ID NO: 1310205 - RNA, 19 nt, Human
agguguuauaaacaagccu

SEQ ID NO: 1310206 - RNA, 18 nt, Human
aguagcugggauuacagg

SEQ ID NO: 1310207 - RNA, 19 nt, Human
agugauuuccauuuuccua

SEQ ID NO: 1310208 - RNA, 24 nt, Human
agugcaauggcacaaucuuggcuc

SEQ ID NO: 1310209 - RNA, 21 nt, Human
aguggagagaguuccugaccu

SEQ ID NO: 1310210 - RNA, 22 nt, Human
auaacaaucucauuuauccucc

SEQ ID NO: 1310211 - RNA, 22 nt, Human
aucaacuucugucaggcccaca

SEQ ID NO: 1310212 - RNA, 22 nt, Human
auccucaauguacugcuuucuc

SEQ ID NO: 1310213 - RNA, 22 nt, Human
aucucauuuauccucccagcaa

SEQ ID NO: 1310214 - RNA, 23 nt, Human
augacugcaagacccuccugggc

SEQ ID NO: 1310215 - RNA, 23 nt, Human
augccucccagagcaagcucacc

SEQ ID NO: 1310216 - RNA, 18 nt, Human
auucuccugccucagccu

SEQ ID NO: 1310217 - RNA, 22 nt, Human
auuuuugcauuuuuaguagaga

SEQ ID NO: 1310218 - RNA, 18 nt, Human
caaaaacaaaaagaaaca

SEQ ID NO: 1310219 - RNA, 23 nt, Human
caaaaacaaaaagaaacaagcag

SEQ ID NO: 1310220 - RNA, 27 nt, Human
caaaaagaaacaagcagaaaucucauu

SEQ ID NO: 1310221 - RNA, 23 nt, Human
caaagugcugggauuacagacau

SEQ ID NO: 1310222 - RNA, 24 nt, Human
caaagugcugggauuacagacaug

SEQ ID NO: 1310223 - RNA, 18 nt, Human
caacuccugggggugauc

SEQ ID NO: 1310224 - RNA, 19 nt, Human
caagcagaagccccagaga

SEQ ID NO: 1310225 - RNA, 24 nt, Human
caagcagaagccccagagaaacua

SEQ ID NO: 1310226 - RNA, 20 nt, Human
caagugauucuccugccuca

SEQ ID NO: 1310227 - RNA, 22 nt, Human
caagugauucuccugccucagc

SEQ ID NO: 1310228 - RNA, 23 nt, Human
cacauucaagacccaaauaucaa

SEQ ID NO: 1310229 - RNA, 24 nt, Human
caccucagccucacaaagugcugg

SEQ ID NO: 1310230 - RNA, 24 nt, Human
caccugaauucucugaaaauaauu

SEQ ID NO: 1310231 - RNA, 21 nt, Human
cacugcaacuucugccuccca

SEQ ID NO: 1310232 - RNA, 21 nt, Human
cacugcaacuucugccuccca

SEQ ID NO: 1310233 - RNA, 23 nt, Human
cagaaaacguacccacuuuucac

SEQ ID NO: 1310234 - RNA, 19 nt, Human
cagagaaaagcaaccaaag

SEQ ID NO: 1310235 - RNA, 21 nt, Human
cagcacagacagcccugagca

SEQ ID NO: 1310236 - RNA, 23 nt, Human
cagcucacccacaucaagagccu

SEQ ID NO: 1310237 - RNA, 19 nt, Human
caggugcccaccaccacgc

SEQ ID NO: 1310238 - RNA, 21 nt, Human
caggugcccaccaccacgccc

SEQ ID NO: 1310239 - RNA, 19 nt, Human
caguccugagccaacuccu

SEQ ID NO: 1310240 - RNA, 22 nt, Human
caugcugacugccccccuccug

SEQ ID NO: 1310241 - RNA, 21 nt, Human
cauggcacuguccaaccucug

SEQ ID NO: 1310242 - RNA, 24 nt, Human
cauguuggccaggcuggucuugaa

SEQ ID NO: 1310243 - RNA, 22 nt, Human
ccaggaaacuauccuuccaagg

SEQ ID NO: 1310244 - RNA, 21 nt, Human
ccaucagcucuggguuacagg

SEQ ID NO: 1310245 - RNA, 19 nt, Human
ccauguuggccaggcuggu

SEQ ID NO: 1310246 - RNA, 21 nt, Human
ccauguuggccaggcuggucu

SEQ ID NO: 1310247 - RNA, 21 nt, Human
ccauguuggccaggcuggucu

SEQ ID NO: 1310248 - RNA, 21 nt, Human
cccaccaccacgcccggcuga

SEQ ID NO: 1310249 - RNA, 21 nt, Human
cccagaaaaucuggaaggcug

SEQ ID NO: 1310250 - RNA, 19 nt, Human
cccaugcugacugcccccc

SEQ ID NO: 1310251 - RNA, 20 nt, Human
cccaugcugacugccccccu

SEQ ID NO: 1310252 - RNA, 19 nt, Human
ccccucugcuuuccagucc

SEQ ID NO: 1310253 - RNA, 23 nt, Human
cccgaguagcugggauuacaggu

SEQ ID NO: 1310254 - RNA, 24 nt, Human
cccgaguagcugggauuacaggug

SEQ ID NO: 1310255 - RNA, 23 nt, Human
cccggcugauuuuugcauuuuua

SEQ ID NO: 1310256 - RNA, 21 nt, Human
ccgaguagcugggauuacagg

SEQ ID NO: 1310257 - RNA, 23 nt, Human
ccucaucagaaaacguacccacu

SEQ ID NO: 1310258 - RNA, 24 nt, Human
ccucccacguucaagugauucucc

SEQ ID NO: 1310259 - RNA, 19 nt, Human
ccucccagcaacuuggagu

SEQ ID NO: 1310260 - RNA, 20 nt, Human
ccuccuggugguaucuggga

SEQ ID NO: 1310261 - RNA, 23 nt, Human
ccugccucagccucccgaguagc

SEQ ID NO: 1310262 - RNA, 19 nt, Human
ccugggcaagaacaaaaaa

SEQ ID NO: 1310263 - RNA, 27 nt, Human
cgccauguuggccaggcuggucuugaa

SEQ ID NO: 1310264 - RNA, 24 nt, Human
cguuagaggccauuugucauuugc

SEQ ID NO: 1310265 - RNA, 23 nt, Human
cucacugcaacuucugccuccca

SEQ ID NO: 1310266 - RNA, 24 nt, Human
cucagccucccgaguagcugggau

SEQ ID NO: 1310267 - RNA, 19 nt, Human
cuccaaaaacaaaaagaaa

SEQ ID NO: 1310268 - RNA, 19 nt, Human
cuccaaaaacaaaaagaaa

SEQ ID NO: 1310269 - RNA, 18 nt, Human
cuccaagcagaagcccca

SEQ ID NO: 1310270 - RNA, 25 nt, Human
cucccuccaaugggcccccucugcu

SEQ ID NO: 1310271 - RNA, 22 nt, Human
cuccugaccucgugaucugccc

SEQ ID NO: 1310272 - RNA, 19 nt, Human
cuccugggcccucugcaua

SEQ ID NO: 1310273 - RNA, 22 nt, Human
cugaaggucauagccagagugg

SEQ ID NO: 1310274 - RNA, 24 nt, Human
cugcaacuucugccucccacguuc

SEQ ID NO: 1310275 - RNA, 19 nt, Human
cugcaagacccuccugggc

SEQ ID NO: 1310276 - RNA, 20 nt, Human
cugccccccuccugaccagg

SEQ ID NO: 1310277 - RNA, 23 nt, Human
cugccucagccucccgaguagcu

SEQ ID NO: 1310278 - RNA, 24 nt, Human
cuuaucacccaggcuggagugcaa

SEQ ID NO: 1310279 - RNA, 21 nt, Human
cuucccauucccucuuuagcc

SEQ ID NO: 1310280 - RNA, 22 nt, Human
cuugcucuuaucacccaggcug

SEQ ID NO: 1310281 - RNA, 24 nt, Human
cuugcucuuaucacccaggcugga

SEQ ID NO: 1310282 - RNA, 19 nt, Human
gaaaagcaaccaaagaggc

SEQ ID NO: 1310283 - RNA, 21 nt, Human
gaacucgagaaggauagauuu

SEQ ID NO: 1310284 - RNA, 22 nt, Human
gaagagguuucgccauguuggc

SEQ ID NO: 1310285 - RNA, 22 nt, Human
gaccucgugaucugcccaccuc

SEQ ID NO: 1310286 - RNA, 24 nt, Human
gaccucgugaucugcccaccucag

SEQ ID NO: 1310287 - RNA, 23 nt, Human
gagagggcacugaaugcaagacu

SEQ ID NO: 1310288 - RNA, 24 nt, Human
gagaguuccugaccuuugcauggu

SEQ ID NO: 1310289 - RNA, 25 nt, Human
gagccaacuccugggggugaucuug

SEQ ID NO: 1310290 - RNA, 22 nt, Human
gagguuucgccauguuggccag

SEQ ID NO: 1310291 - RNA, 23 nt, Human
gagguuucgccauguuggccagg

SEQ ID NO: 1310292 - RNA, 19 nt, Human
gagugcaauggcacaaucu

SEQ ID NO: 1310293 - RNA, 22 nt, Human
gauuacagacaugaaccacugc

SEQ ID NO: 1310294 - RNA, 21 nt, Human
gauucuccugccucagccucc

SEQ ID NO: 1310295 - RNA, 21 nt, Human
gcagcuccagccaguucugcc

SEQ ID NO: 1310296 - RNA, 24 nt, Human
gccaagugauuuccauuuuccuau

SEQ ID NO: 1310297 - RNA, 18 nt, Human
gccaugguguuggaagaa

SEQ ID NO: 1310298 - RNA, 21 nt, Human
gcucacugcaacuucugccuc

SEQ ID NO: 1310299 - RNA, 21 nt, Human
gcucuuaucacccaggcugga

SEQ ID NO: 1310300 - RNA, 24 nt, Human
gcucuuaucacccaggcuggagug

SEQ ID NO: 1310301 - RNA, 19 nt, Human
gcuggagugcaauggcaca

SEQ ID NO: 1310302 - RNA, 23 nt, Human
gcuggucuugaacuccugaccuc

SEQ ID NO: 1310303 - RNA, 21 nt, Human
gcuuugggcuaggcaaagggg

SEQ ID NO: 1310304 - RNA, 19 nt, Human
ggaagacagcucacccaca

SEQ ID NO: 1310305 - RNA, 26 nt, Human
ggaccaaaccaagaacucgcagggaa

SEQ ID NO: 1310306 - RNA, 22 nt, Human
ggcaucuucaaaaccagcagca

SEQ ID NO: 1310307 - RNA, 20 nt, Human
ggccagagcuugugccaugu

SEQ ID NO: 1310308 - RNA, 24 nt, Human
ggcuggucuugaacuccugaccuc

SEQ ID NO: 1310309 - RNA, 24 nt, Human
gggcaagaacaaaaaauagucuuu

SEQ ID NO: 1310310 - RNA, 19 nt, Human
ggucuugaacuccugaccu

SEQ ID NO: 1310311 - RNA, 21 nt, Human
gugaucugcccaccucagccu

SEQ ID NO: 1310312 - RNA, 24 nt, Human
gugauucuccugccucagccuccc

SEQ ID NO: 1310313 - RNA, 24 nt, Human
guuucauucuacuauuaagaacaa

SEQ ID NO: 1310314 - RNA, 23 nt, Human
uacaggugcccaccaccacgccc

SEQ ID NO: 1310315 - RNA, 19 nt, Human
uaccauagacgagguugga

SEQ ID NO: 1310316 - RNA, 18 nt, Human
uacuuuuuguuggaagga

SEQ ID NO: 1310317 - RNA, 21 nt, Human
uagagaugcuauucucuccau

SEQ ID NO: 1310318 - RNA, 19 nt, Human
uagaggcaucucacccaua

SEQ ID NO: 1310319 - RNA, 22 nt, Human
uagguaauguucuuguguuucc

SEQ ID NO: 1310320 - RNA, 24 nt, Human
uaguagagaagagguuucgccaug

SEQ ID NO: 1310321 - RNA, 19 nt, Human
uagugacacaugugaguuu

SEQ ID NO: 1310322 - RNA, 21 nt, Human
uagugcaucuuaggugcuggg

SEQ ID NO: 1310323 - RNA, 23 nt, Human
uagugugaggaacuccugggagg

SEQ ID NO: 1310324 - RNA, 20 nt, Human
uaucacccaggcuggagugc

SEQ ID NO: 1310325 - RNA, 25 nt, Human
uauucuaccacucuuuuugccuaaa

SEQ ID NO: 1310326 - RNA, 21 nt, Human
ucaaaaccagcagcaccugaa

SEQ ID NO: 1310327 - RNA, 18 nt, Human
ucaagugauucuccugcc

SEQ ID NO: 1310328 - RNA, 18 nt, Human
ucacaaagugcugggauu

SEQ ID NO: 1310329 - RNA, 18 nt, Human
ucacccaggcuggagugc

SEQ ID NO: 1310330 - RNA, 18 nt, Human
ucacugcaacuucugccu

SEQ ID NO: 1310331 - RNA, 19 nt, Human
ucacugcaacuucugccuc

SEQ ID NO: 1310332 - RNA, 22 nt, Human
ucacugcaacuucugccuccca

SEQ ID NO: 1310333 - RNA, 24 nt, Human
ucacugcaacuucugccucccacg

SEQ ID NO: 1310334 - RNA, 20 nt, Human
ucagccucccgaguagcugg

SEQ ID NO: 1310335 - RNA, 24 nt, Human
ucauuugccuucccauucccucuu

SEQ ID NO: 1310336 - RNA, 22 nt, Human
uccaaccucugaaaggagcaca

SEQ ID NO: 1310337 - RNA, 24 nt, Human
ucccacguucaagugauucuccug

SEQ ID NO: 1310338 - RNA, 21 nt, Human
ucccagcagggcaggccccuu

SEQ ID NO: 1310339 - RNA, 23 nt, Human
ucccgaguagcugggauuacagg

SEQ ID NO: 1310340 - RNA, 24 nt, Human
ucccgaguagcugggauuacaggu

SEQ ID NO: 1310341 - RNA, 18 nt, Human
ucccuccaaugggccccc

SEQ ID NO: 1310342 - RNA, 20 nt, Human
uccuucuucuuuccccuuca

SEQ ID NO: 1310343 - RNA, 22 nt, Human
uccuucuucuuuccccuucccu

SEQ ID NO: 1310344 - RNA, 22 nt, Human
ucgccauguuggccaggcuggu

SEQ ID NO: 1310345 - RNA, 24 nt, Human
ucgccauguuggccaggcuggucu

SEQ ID NO: 1310346 - RNA, 22 nt, Human
ucuagggaccaaaccaagaacu

SEQ ID NO: 1310347 - RNA, 24 nt, Human
ucuccugccucagccucccgagua

SEQ ID NO: 1310348 - RNA, 22 nt, Human
ucuccuggacagcaucaguccc

SEQ ID NO: 1310349 - RNA, 19 nt, Human
ucugcccaccucagccuca

SEQ ID NO: 1310350 - RNA, 22 nt, Human
ucugcccaccucagccucacaa

SEQ ID NO: 1310351 - RNA, 19 nt, Human
ucuguaaaaaacuuagccc

SEQ ID NO: 1310352 - RNA, 24 nt, Human
ucuuaaacuccaagcagaagcccc

SEQ ID NO: 1310353 - RNA, 20 nt, Human
ucuuaucacccaggcuggag

SEQ ID NO: 1310354 - RNA, 19 nt, Human
ucuugaacuccugaccucg

SEQ ID NO: 1310355 - RNA, 24 nt, Human
ucuugcucuuaucacccaggcugg

SEQ ID NO: 1310356 - RNA, 25 nt, Human
ucuugcucuuaucacccaggcugga

SEQ ID NO: 1310357 - RNA, 24 nt, Human
ugaaaauuuuacuaccaaacauau

SEQ ID NO: 1310358 - RNA, 18 nt, Human
ugacccaaaguggagcag

SEQ ID NO: 1310359 - RNA, 21 nt, Human
ugacugcaagacccuccuggg

SEQ ID NO: 1310360 - RNA, 25 nt, Human
ugagcaaaggcccagcuggucacag

SEQ ID NO: 1310361 - RNA, 21 nt, Human
ugagugggaacucgagaagga

SEQ ID NO: 1310362 - RNA, 23 nt, Human
ugaguuccacauaacacauuauu

SEQ ID NO: 1310363 - RNA, 22 nt, Human
ugaucugcccaccucagccuca

SEQ ID NO: 1310364 - RNA, 18 nt, Human
ugcauaauguugaguggc

SEQ ID NO: 1310365 - RNA, 24 nt, Human
ugccucagccucccgaguagcugg

SEQ ID NO: 1310366 - RNA, 21 nt, Human
ugcucuuaucacccaggcugg

SEQ ID NO: 1310367 - RNA, 24 nt, Human
ugcucuuaucacccaggcuggagu

SEQ ID NO: 1310368 - RNA, 23 nt, Human
ugcugggauuacagacaugaacc

SEQ ID NO: 1310369 - RNA, 21 nt, Human
uggaaagagaagauucuggaa

SEQ ID NO: 1310370 - RNA, 22 nt, Human
uggaaagagaagauucuggaag

SEQ ID NO: 1310371 - RNA, 18 nt, Human
uggaagaagggggaaggg

SEQ ID NO: 1310372 - RNA, 18 nt, Human
uggaagaagggggaaggu

SEQ ID NO: 1310373 - RNA, 24 nt, Human
uggagugcaauggcacaaucuugg

SEQ ID NO: 1310374 - RNA, 22 nt, Human
uggagugggcuauaaggggagg

SEQ ID NO: 1310375 - RNA, 24 nt, Human
uggcacaaucuuggcucacugcaa

SEQ ID NO: 1310376 - RNA, 24 nt, Human
uggccaggcuggucuugaacuccu

SEQ ID NO: 1310377 - RNA, 25 nt, Human
ugggaagacagcucacccacaucaa

SEQ ID NO: 1310378 - RNA, 21 nt, Human
ugggauuacagacaugaacca

SEQ ID NO: 1310379 - RNA, 23 nt, Human
ugggauuacagacaugaaccacu

SEQ ID NO: 1310380 - RNA, 24 nt, Human
ugggauuacagacaugaaccacug

SEQ ID NO: 1310381 - RNA, 24 nt, Human
ugggauuacagacaugaaccacug

SEQ ID NO: 1310382 - RNA, 21 nt, Human
ugggauuacaggugcccacca

SEQ ID NO: 1310383 - RNA, 24 nt, Human
ugggauuacaggugcccaccacca

SEQ ID NO: 1310384 - RNA, 22 nt, Human
uggggaaaaacaagaaaggagg

SEQ ID NO: 1310385 - RNA, 24 nt, Human
uggggacugguacugucuuggauu

SEQ ID NO: 1310386 - RNA, 22 nt, Human
ugguuagugacacaugugaguu

SEQ ID NO: 1310387 - RNA, 23 nt, Human
uguaaaaaacuuagcccaugcug

SEQ ID NO: 1310388 - RNA, 24 nt, Human
uguccaacacugcuagaggcaucu

SEQ ID NO: 1310389 - RNA, 26 nt, Human
ugugaggaacuccugggaggggucug

SEQ ID NO: 1310390 - RNA, 22 nt, Human
uguuuccccugggggaaauacc

SEQ ID NO: 1310391 - RNA, 21 nt, Human
uuaaacuccaagcagaagccc

SEQ ID NO: 1310392 - RNA, 24 nt, Human
uuaguagagaagagguuucgccau

SEQ ID NO: 1310393 - RNA, 25 nt, Human
uucaaaaccagcagcaccugaauuc

SEQ ID NO: 1310394 - RNA, 21 nt, Human
uucaagugauucuccugccuc

SEQ ID NO: 1310395 - RNA, 23 nt, Human
uucaagugauucuccugccucag

SEQ ID NO: 1310396 - RNA, 24 nt, Human
uucaagugauucuccugccucagc

SEQ ID NO: 1310397 - RNA, 24 nt, Human
uuccuccaguaauaaagggaaagc

SEQ ID NO: 1310398 - RNA, 24 nt, Human
uucuaggaagggugauaagagcua

SEQ ID NO: 1310399 - RNA, 22 nt, Human
uucucuccauggcaaacuucag

SEQ ID NO: 1310400 - RNA, 23 nt, Human
uucugugaaugguaucaauagua

SEQ ID NO: 1310401 - RNA, 23 nt, Human
uugaaggucauaacuauuaagug

SEQ ID NO: 1310402 - RNA, 24 nt, Human
uugaaggucauaacuauuaagugg

SEQ ID NO: 1310403 - RNA, 22 nt, Human
uugcaacguuagaggccauuug

SEQ ID NO: 1310404 - RNA, 23 nt, Human
uuucauucuacuauuaagaacaa

SEQ ID NO: 1310405 - RNA, 24 nt, Human
uuucgccauguuggccaggcuggu

SEQ ID NO: 1310406 - RNA, 22 nt, Human
uuuuuaguagagaagagguuuc

SEQ ID NO: 1310407 - RNA, 20 nt, Human
uuuuugcauuuuuaguagag

SEQ ID NO: 1310408 - RNA, 20 nt, Human
cucuuuuugggccaccgacc

SEQ ID NO: 1310409 - RNA, 24 nt, Human
guguuucuuuuuuuuuuuuuuuuu

SEQ ID NO: 1310410 - RNA, 18 nt, Human
ucuuuuuuuuuuuuuuuu

SEQ ID NO: 1310411 - RNA, 30 nt, Human
uuguguuucuuuuuuuuuuuuuuuuuuuuc

SEQ ID NO: 1310412 - RNA, 19 nt, Human
aaagauaugcacacaacuu

SEQ ID NO: 1310413 - RNA, 22 nt, Human
agccuggaagcgcucaccagug

SEQ ID NO: 1310414 - RNA, 23 nt, Human
agggaggauguuggcagggcugg

SEQ ID NO: 1310415 - RNA, 18 nt, Human
cacagggaggauguuggc

SEQ ID NO: 1310416 - RNA, 18 nt, Human
ccccgggccacgacugcc

SEQ ID NO: 1310417 - RNA, 19 nt, Human
cccuugaaugugggcugga

SEQ ID NO: 1310418 - RNA, 19 nt, Human
cuauaccaaaaaaaagcag

SEQ ID NO: 1310419 - RNA, 23 nt, Human
cugaggugaugcuuacuuccucu

SEQ ID NO: 1310420 - RNA, 21 nt, Human
cuuacuuccucuccccuugaa

SEQ ID NO: 1310421 - RNA, 23 nt, Human
gacugaggcugggggcugcccuc

SEQ ID NO: 1310422 - RNA, 18 nt, Human
gggaggauguuggcaggg

SEQ ID NO: 1310423 - RNA, 18 nt, Human
gggggcugcccucagagg

SEQ ID NO: 1310424 - RNA, 18 nt, Human
uaccaaaaaaaagcaguu

SEQ ID NO: 1310425 - RNA, 24 nt, Human
uaccugaauuugcaaaucagacau

SEQ ID NO: 1310426 - RNA, 18 nt, Human
ucaccagugcaacguucu

SEQ ID NO: 1310427 - RNA, 25 nt, Human
uccccgggccacgacugccauggcu

SEQ ID NO: 1310428 - RNA, 19 nt, Human
ugauccccgggccacgacu

SEQ ID NO: 1310429 - RNA, 18 nt, Human
ugccauggcuuguggcug

SEQ ID NO: 1310430 - RNA, 22 nt, Human
uggaaugauccccgggccacga

SEQ ID NO: 1310431 - RNA, 19 nt, Human
uggacugaggcugggggcu

SEQ ID NO: 1310432 - RNA, 19 nt, Human
uggcugcagugcugcuccu

SEQ ID NO: 1310433 - RNA, 18 nt, Human
ugugccugaggugaugcu

SEQ ID NO: 1310434 - RNA, 19 nt, Human
ugugccugaggugaugcuu

SEQ ID NO: 1310435 - RNA, 22 nt, Human
uuaauguugcugcuguaaauag

SEQ ID NO: 1310436 - RNA, 20 nt, Human
uugucuuaaagauaugcaca

SEQ ID NO: 1310437 - RNA, 21 nt, Human
uuuaaagauauaccugaauuu

SEQ ID NO: 1310438 - RNA, 21 nt, Human
agcuaauagccagcgcagucc

SEQ ID NO: 1310439 - RNA, 18 nt, Human
aguagguggaguuguaug

SEQ ID NO: 1310440 - RNA, 19 nt, Human
cauuccuguucugguggag

SEQ ID NO: 1310441 - RNA, 22 nt, Human
cuaauagccagcgcaguccuuc

SEQ ID NO: 1310442 - RNA, 22 nt, Human
cugugugaugagcaucuuucuc

SEQ ID NO: 1310443 - RNA, 23 nt, Human
cuguuacuuucuuuuacuuucuc

SEQ ID NO: 1310444 - RNA, 22 nt, Human
gagaugaaccuguuugcuaagg

SEQ ID NO: 1310445 - RNA, 24 nt, Human
ggagggauaucaacuguuucuuuu

SEQ ID NO: 1310446 - RNA, 18 nt, Human
gguaggugguaguuggca

SEQ ID NO: 1310447 - RNA, 24 nt, Human
uaguccugauaguucuggagauga

SEQ ID NO: 1310448 - RNA, 19 nt, Human
uccagagccuguguuauuc

SEQ ID NO: 1310449 - RNA, 22 nt, Human
uccuuugacauuccuguucugg

SEQ ID NO: 1310450 - RNA, 23 nt, Human
ucuguuuuucucuuuacuuucuc

SEQ ID NO: 1310451 - RNA, 18 nt, Human
ucuuggagauugagaugc

SEQ ID NO: 1310452 - RNA, 22 nt, Human
ugagcaucuuucuccagagccu

SEQ ID NO: 1310453 - RNA, 23 nt, Human
ugaugagcaucuuucuccagagc

SEQ ID NO: 1310454 - RNA, 19 nt, Human
uggagaugaaccuguuugc

SEQ ID NO: 1310455 - RNA, 18 nt, Human
uguauggggaguguagaa

SEQ ID NO: 1310456 - RNA, 23 nt, Human
uucugguggagaagcugugugau

SEQ ID NO: 1310457 - RNA, 20 nt, Human
agaaugcagcuucccuucgc

SEQ ID NO: 1310458 - RNA, 21 nt, Human
caccugccaccuucucaucuu

SEQ ID NO: 1310459 - RNA, 19 nt, Human
caucuaucuucccaugucc

SEQ ID NO: 1310460 - RNA, 22 nt, Human
ccccagugcacaccugccaccu

SEQ ID NO: 1310461 - RNA, 24 nt, Human
cguucuggucucuucauagcccca

SEQ ID NO: 1310462 - RNA, 21 nt, Human
cuccagugauccuguuccacc

SEQ ID NO: 1310463 - RNA, 24 nt, Human
uaauagcagaaugcagcuucccuu

SEQ ID NO: 1310464 - RNA, 22 nt, Human
uccuagggcagagaaagauggc

SEQ ID NO: 1310465 - RNA, 19 nt, Human
uccuguuccacccagcuuc

SEQ ID NO: 1310466 - RNA, 22 nt, Human
ugacuguaagagguguuucuuc

SEQ ID NO: 1310467 - RNA, 25 nt, Human
ugauccuguuccacccagcuucuuc

SEQ ID NO: 1310468 - RNA, 21 nt, Human
uuaggagucuggguuccaggg

SEQ ID NO: 1310469 - RNA, 21 nt, Human
aaaagucuuucagaugaguuc

SEQ ID NO: 1310470 - RNA, 20 nt, Human
aacacagugaugcccugucu

SEQ ID NO: 1310471 - RNA, 21 nt, Human
aacacagugaugcccugucuc

SEQ ID NO: 1310472 - RNA, 20 nt, Human
aagaagcaucuuugaacucc

SEQ ID NO: 1310473 - RNA, 18 nt, Human
aagacgagauguucaagc

SEQ ID NO: 1310474 - RNA, 20 nt, Human
aaggaccaguaaagccagua

SEQ ID NO: 1310475 - RNA, 18 nt, Human
acuacguccauuaaagcu

SEQ ID NO: 1310476 - RNA, 24 nt, Human
acuuugggagaccgaggugggcag

SEQ ID NO: 1310477 - RNA, 25 nt, Human
agaauaccuugccuucaaguaaauu

SEQ ID NO: 1310478 - RNA, 21 nt, Human
agaccgaggugggcagauugc

SEQ ID NO: 1310479 - RNA, 24 nt, Human
agcacuuugggagaccgagguggg

SEQ ID NO: 1310480 - RNA, 24 nt, Human
aguggcucacuccuguaaucccag

SEQ ID NO: 1310481 - RNA, 22 nt, Human
caagaccaagcagcaacacagu

SEQ ID NO: 1310482 - RNA, 25 nt, Human
caagaccaagcagcaacacagugcc

SEQ ID NO: 1310483 - RNA, 27 nt, Human
caagaccaagcagcaacacagugccaa

SEQ ID NO: 1310484 - RNA, 24 nt, Human
cacuccacguuaacacaugcucaa

SEQ ID NO: 1310485 - RNA, 24 nt, Human
cacuccuguaaucccagcacuuug

SEQ ID NO: 1310486 - RNA, 24 nt, Human
cagcacuuugggagaccgaggugg

SEQ ID NO: 1310487 - RNA, 19 nt, Human
cagugccagagcagguggu

SEQ ID NO: 1310488 - RNA, 19 nt, Human
cccaggaaaaaucaucuac

SEQ ID NO: 1310489 - RNA, 22 nt, Human
ccccaaggaccaguaaagccag

SEQ ID NO: 1310490 - RNA, 22 nt, Human
ccuguaaucccagcacuuuggg

SEQ ID NO: 1310491 - RNA, 25 nt, Human
cgaggugggcagauugcuugagcca

SEQ ID NO: 1310492 - RNA, 20 nt, Human
cgugaccagggcuuagccaa

SEQ ID NO: 1310493 - RNA, 24 nt, Human
cucacuccuguaaucccagcacuu

SEQ ID NO: 1310494 - RNA, 20 nt, Human
cuccaagaagcaucuuugaa

SEQ ID NO: 1310495 - RNA, 24 nt, Human
cugaacacaagaccaagcagcaac

SEQ ID NO: 1310496 - RNA, 24 nt, Human
cugagacagacguugcucuuuuac

SEQ ID NO: 1310497 - RNA, 22 nt, Human
cuuccacaggucuaaaaaugga

SEQ ID NO: 1310498 - RNA, 22 nt, Human
gaacagacauaaugcuugaaac

SEQ ID NO: 1310499 - RNA, 21 nt, Human
gaacuccucccaugcaggccc

SEQ ID NO: 1310500 - RNA, 22 nt, Human
gaccaagcagcaacacagugcc

SEQ ID NO: 1310501 - RNA, 24 nt, Human
gagccaguucaagaccagccuugg

SEQ ID NO: 1310502 - RNA, 20 nt, Human
ggacuagaagcuugacugag

SEQ ID NO: 1310503 - RNA, 18 nt, Human
ggcagggcgcaguggcuc

SEQ ID NO: 1310504 - RNA, 24 nt, Human
gggcgcaguggcucacuccuguaa

SEQ ID NO: 1310505 - RNA, 19 nt, Human
gucucggguaggcuccacc

SEQ ID NO: 1310506 - RNA, 20 nt, Human
uaauauaccacuccacguua

SEQ ID NO: 1310507 - RNA, 22 nt, Human
uacuguguuucauuaaucccac

SEQ ID NO: 1310508 - RNA, 20 nt, Human
uauagaauaccuugccuuca

SEQ ID NO: 1310509 - RNA, 25 nt, Human
ucaggcagggcgcaguggcucacuc

SEQ ID NO: 1310510 - RNA, 21 nt, Human
ucauauccucccauaucagaa

SEQ ID NO: 1310511 - RNA, 20 nt, Human
ucuggacuagaagcuugacu

SEQ ID NO: 1310512 - RNA, 18 nt, Human
ugaaacaaaaucucucac

SEQ ID NO: 1310513 - RNA, 19 nt, Human
ugaggggaagauggcauga

SEQ ID NO: 1310514 - RNA, 21 nt, Human
ugaugccagccuucaggauuu

SEQ ID NO: 1310515 - RNA, 25 nt, Human
ugcuaaggacgcugugggagucgcu

SEQ ID NO: 1310516 - RNA, 25 nt, Human
uggauacuugugauaugaugcucca

SEQ ID NO: 1310517 - RNA, 22 nt, Human
uggcagccuccccaaggaccag

SEQ ID NO: 1310518 - RNA, 21 nt, Human
uggcucacuccuguaauccca

SEQ ID NO: 1310519 - RNA, 24 nt, Human
uggcucacuccuguaaucccagca

SEQ ID NO: 1310520 - RNA, 22 nt, Human
ugggagaccgaggugggcagau

SEQ ID NO: 1310521 - RNA, 24 nt, Human
ugggagaccgaggugggcagauug

SEQ ID NO: 1310522 - RNA, 21 nt, Human
uguucaagcacguuauucaac

SEQ ID NO: 1310523 - RNA, 20 nt, Human
uugaaacaaaaucucucacu

SEQ ID NO: 1310524 - RNA, 19 nt, Human
uugaagccuaaguaaaugu

SEQ ID NO: 1310525 - RNA, 20 nt, Human
uugcaacuuucuuccugauu

SEQ ID NO: 1310526 - RNA, 18 nt, Human
uugcacuugaggggaaga

SEQ ID NO: 1310527 - RNA, 21 nt, Human
uuggcagccuccccaaggacg

SEQ ID NO: 1310528 - RNA, 23 nt, Human
uuucccauuuuacuacauucacu

SEQ ID NO: 1310529 - RNA, 18 nt, Human
uuucuuaucuuccacagg

SEQ ID NO: 1310530 - RNA, 21 nt, Human
acacagcaagaaggagcagag

SEQ ID NO: 1310531 - RNA, 22 nt, Human
acacagcaagaaggagcagaga

SEQ ID NO: 1310532 - RNA, 24 nt, Human
agaagaaaaaacuguuccagagag

SEQ ID NO: 1310533 - RNA, 24 nt, Human
aggagcagagaugggauuugaagu

SEQ ID NO: 1310534 - RNA, 19 nt, Human
cagaagaaaaaacuguucc

SEQ ID NO: 1310535 - RNA, 21 nt, Human
ugaauucucagaacaaccuua

SEQ ID NO: 1310536 - RNA, 22 nt, Human
ugagguagguaugauuucaacu

SEQ ID NO: 1310537 - RNA, 24 nt, Human
ugggauuugaaguuggcuacauga

SEQ ID NO: 1310538 - RNA, 22 nt, Human
uuuccagaagaaaaaacuguuc

SEQ ID NO: 1310539 - RNA, 24 nt, Human
aaaauaacaacuccauuaugccca

SEQ ID NO: 1310540 - RNA, 23 nt, Human
aaauaacaacuccauuaugccca

SEQ ID NO: 1310541 - RNA, 18 nt, Human
cugaauaaggugaagucc

SEQ ID NO: 1310542 - RNA, 22 nt, Human
gggcacuggagcauacagaucu

SEQ ID NO: 1310543 - RNA, 24 nt, Human
uaaaauaacaacuccauuaugccc

SEQ ID NO: 1310544 - RNA, 23 nt, Human
uacuucuaaaauaacaacuccuu

SEQ ID NO: 1310545 - RNA, 21 nt, Human
ucuaaaauaacaacuccauua

SEQ ID NO: 1310546 - RNA, 18 nt, Human
ugcccaguauuaauuuga

SEQ ID NO: 1310547 - RNA, 19 nt, Human
aggcaggguaagagaccag

SEQ ID NO: 1310548 - RNA, 23 nt, Human
gugugaggcaggguaagagaccc

SEQ ID NO: 1310549 - RNA, 20 nt, Human
ugaggcaggguaagagacca

SEQ ID NO: 1310550 - RNA, 18 nt, Human
aagaaagagaaaggagaa

SEQ ID NO: 1310551 - RNA, 22 nt, Human
aagaaagagaaaggagaacagu

SEQ ID NO: 1310552 - RNA, 23 nt, Human
aaggaccucacagcccuaaagau

SEQ ID NO: 1310553 - RNA, 21 nt, Human
aaggagaagaaaaugcaggag

SEQ ID NO: 1310554 - RNA, 23 nt, Human
acaaggagaagaaaaugcaggag

SEQ ID NO: 1310555 - RNA, 19 nt, Human
accaucauccccacaugcc

SEQ ID NO: 1310556 - RNA, 18 nt, Human
acuacacucaguuuuugc

SEQ ID NO: 1310557 - RNA, 18 nt, Human
agaagaaagagaaaggag

SEQ ID NO: 1310558 - RNA, 23 nt, Human
agaccaucauccccacaugccag

SEQ ID NO: 1310559 - RNA, 22 nt, Human
agaggaaggaugucaucaagag

SEQ ID NO: 1310560 - RNA, 20 nt, Human
aggagaagaaaaugcaggag

SEQ ID NO: 1310561 - RNA, 22 nt, Human
aggaggaggagguguccacacu

SEQ ID NO: 1310562 - RNA, 25 nt, Human
aggcagaagaaagagaaaggggacc

SEQ ID NO: 1310563 - RNA, 19 nt, Human
aggcugugaugaccuucag

SEQ ID NO: 1310564 - RNA, 23 nt, Human
caaggaccaguaguggugagcac

SEQ ID NO: 1310565 - RNA, 18 nt, Human
caccagugccucuuccau

SEQ ID NO: 1310566 - RNA, 20 nt, Human
caccagugccucuuccaucc

SEQ ID NO: 1310567 - RNA, 21 nt, Human
caccagugccucuuccauccc

SEQ ID NO: 1310568 - RNA, 19 nt, Human
cagcagcaggacuccugca

SEQ ID NO: 1310569 - RNA, 19 nt, Human
caggaggaggaggugucca

SEQ ID NO: 1310570 - RNA, 19 nt, Human
caucaagagaggcugugau

SEQ ID NO: 1310571 - RNA, 23 nt, Human
caugaaagggaacuauaagcaga

SEQ ID NO: 1310572 - RNA, 20 nt, Human
ccagugccucuuccaucccc

SEQ ID NO: 1310573 - RNA, 20 nt, Human
ccccacaugccagcagcagg

SEQ ID NO: 1310574 - RNA, 18 nt, Human
ccccaugaggggaggacc

SEQ ID NO: 1310575 - RNA, 21 nt, Human
cccuaaagaucaugaaaggga

SEQ ID NO: 1310576 - RNA, 21 nt, Human
gagcacacacugaggcugagc

SEQ ID NO: 1310577 - RNA, 19 nt, Human
gcagaagaaagagaaagga

SEQ ID NO: 1310578 - RNA, 19 nt, Human
ggaggaggagguguccaca

SEQ ID NO: 1310579 - RNA, 21 nt, Human
guuccaccagugccucuucca

SEQ ID NO: 1310580 - RNA, 24 nt, Human
uagcaucgguuccaccagugccuc

SEQ ID NO: 1310581 - RNA, 24 nt, Human
uccauccccaacacagaugaggag

SEQ ID NO: 1310582 - RNA, 21 nt, Human
uccccaacacagaugaggagg

SEQ ID NO: 1310583 - RNA, 18 nt, Human
ugaaggcacaccaggaca

SEQ ID NO: 1310584 - RNA, 19 nt, Human
ugagcagaagaggaaggau

SEQ ID NO: 1310585 - RNA, 18 nt, Human
ugaggggaggaccaggcc

SEQ ID NO: 1310586 - RNA, 27 nt, Human
ugugaaggcacaccaggacaaccccca

SEQ ID NO: 1310587 - RNA, 23 nt, Human
uguuccaguccuucaaugucuuc

SEQ ID NO: 1310588 - RNA, 20 nt, Human
ugauuucuuggauucccccu

SEQ ID NO: 1310589 - RNA, 23 nt, Human
uuucuuggauucccccucguaua

SEQ ID NO: 1310590 - RNA, 20 nt, Human
agcagcagccaagugcugag

SEQ ID NO: 1310591 - RNA, 21 nt, Human
cggcagcagcagccaagugcu

SEQ ID NO: 1310592 - RNA, 24 nt, Human
cggcagcagcagccaagugcugag

SEQ ID NO: 1310593 - RNA, 22 nt, Human
gccaagugcugaguggauugag

SEQ ID NO: 1310594 - RNA, 21 nt, Human
uccagaaggcacuagaagcuc

SEQ ID NO: 1310595 - RNA, 18 nt, Human
ugaguggauugagugcca

SEQ ID NO: 1310596 - RNA, 24 nt, Human
acucaggggcggccucagguuugg

SEQ ID NO: 1310597 - RNA, 19 nt, Human
agguggcguaggcggggag

SEQ ID NO: 1310598 - RNA, 18 nt, Human
ugcccagacucaggggcg

SEQ ID NO: 1310599 - RNA, 22 nt, Human
uggcggagcagcggcuggggcc

SEQ ID NO: 1310600 - RNA, 21 nt, Human
uuaggcuugcaggccgcggag

SEQ ID NO: 1310601 - RNA, 23 nt, Human
uuggcggagcagcggcuggggcc

SEQ ID NO: 1310602 - RNA, 19 nt, Human
acugcagccucaaccuccu

SEQ ID NO: 1310603 - RNA, 21 nt, Human
acugcucugacucugucucca

SEQ ID NO: 1310604 - RNA, 18 nt, Human
agcgcagaaaucgaaaac

SEQ ID NO: 1310605 - RNA, 19 nt, Human
aggaggcugccuggcuggg

SEQ ID NO: 1310606 - RNA, 18 nt, Human
aggcaggagugcaguggc

SEQ ID NO: 1310607 - RNA, 20 nt, Human
agugcaguggcgcgaucaua

SEQ ID NO: 1310608 - RNA, 22 nt, Human
agugcaguggcgcgaucauacc

SEQ ID NO: 1310609 - RNA, 18 nt, Human
auaccucacugcagccuc

SEQ ID NO: 1310610 - RNA, 21 nt, Human
caaccccagcaacuucuuugg

SEQ ID NO: 1310611 - RNA, 25 nt, Human
caaccuccugggcucaugugauccu

SEQ ID NO: 1310612 - RNA, 20 nt, Human
caccgugugcccgaggaggc

SEQ ID NO: 1310613 - RNA, 19 nt, Human
cacugcagccucaaccucc

SEQ ID NO: 1310614 - RNA, 23 nt, Human
cagccucaaccuccugggcucau

SEQ ID NO: 1310615 - RNA, 22 nt, Human
ccacccuugacugcucugacuc

SEQ ID NO: 1310616 - RNA, 22 nt, Human
cccaggcaggagugcaguggcg

SEQ ID NO: 1310617 - RNA, 22 nt, Human
cccucccacgaaccuucuccca

SEQ ID NO: 1310618 - RNA, 22 nt, Human
ccggcgccuucaccgugugccc

SEQ ID NO: 1310619 - RNA, 18 nt, Human
ccucaaccuccugggcuc

SEQ ID NO: 1310620 - RNA, 20 nt, Human
ccucccacgaaccuucuccc

SEQ ID NO: 1310621 - RNA, 19 nt, Human
ccucccgccucagcguccc

SEQ ID NO: 1310622 - RNA, 20 nt, Human
ccuggcagggagggacgggc

SEQ ID NO: 1310623 - RNA, 24 nt, Human
cgccauuagcuuugaggaggguuc

SEQ ID NO: 1310624 - RNA, 20 nt, Human
cggccgaagcggcgccgcgg

SEQ ID NO: 1310625 - RNA, 18 nt, Human
cgugugcccgaggaggcu

SEQ ID NO: 1310626 - RNA, 24 nt, Human
cucacugcagccucaaccuccugg

SEQ ID NO: 1310627 - RNA, 20 nt, Human
cucaguugcccaggcaggag

SEQ ID NO: 1310628 - RNA, 18 nt, Human
cucaugugauccucccgc

SEQ ID NO: 1310629 - RNA, 22 nt, Human
cucccauuuuacugaggcccag

SEQ ID NO: 1310630 - RNA, 22 nt, Human
cuccuggcgguucuccgcuccg

SEQ ID NO: 1310631 - RNA, 23 nt, Human
cugacaagagugcagucccucuc

SEQ ID NO: 1310632 - RNA, 22 nt, Human
cugcagccucaaccuccugggc

SEQ ID NO: 1310633 - RNA, 21 nt, Human
cuggccuccuggaagggcugg

SEQ ID NO: 1310634 - RNA, 20 nt, Human
cugggcuccagccuccuggc

SEQ ID NO: 1310635 - RNA, 19 nt, Human
gagaguuuguccucugcgg

SEQ ID NO: 1310636 - RNA, 21 nt, Human
gagugcagucccucucgaggc

SEQ ID NO: 1310637 - RNA, 20 nt, Human
gcccaggcaggagugcagug

SEQ ID NO: 1310638 - RNA, 19 nt, Human
gcuccgcaaccccagcaac

SEQ ID NO: 1310639 - RNA, 27 nt, Human
gcucuucgcuguuagggcuucccugac

SEQ ID NO: 1310640 - RNA, 19 nt, Human
ggagggacgggcuugggcc

SEQ ID NO: 1310641 - RNA, 18 nt, Human
ggagugcaguggcgcgau

SEQ ID NO: 1310642 - RNA, 21 nt, Human
gguggcagagacaggcaguga

SEQ ID NO: 1310643 - RNA, 24 nt, Human
gugauccucccgccucagcguccc

SEQ ID NO: 1310644 - RNA, 24 nt, Human
uaccucacugcagccucaaccucc

SEQ ID NO: 1310645 - RNA, 23 nt, Human
ucacugcagccucaaccuccugg

SEQ ID NO: 1310646 - RNA, 24 nt, Human
ucacugcagccucaaccuccuggg

SEQ ID NO: 1310647 - RNA, 28 nt, Human
uccauuuuuauuuuggaggccccuccca

SEQ ID NO: 1310648 - RNA, 19 nt, Human
ucccacgaaccuucuccca

SEQ ID NO: 1310649 - RNA, 22 nt, Human
ucccacgaaccuucucccauuu

SEQ ID NO: 1310650 - RNA, 23 nt, Human
ucccguguacccagauauggcgg

SEQ ID NO: 1310651 - RNA, 22 nt, Human
uccgcaaccccagcaacuucuu

SEQ ID NO: 1310652 - RNA, 21 nt, Human
uccgcuccgcaaccccagcaa

SEQ ID NO: 1310653 - RNA, 22 nt, Human
uccugggcucaugugauccucc

SEQ ID NO: 1310654 - RNA, 24 nt, Human
uccugggcucaugugauccucccg

SEQ ID NO: 1310655 - RNA, 19 nt, Human
ucuccgcuccgcaacccca

SEQ ID NO: 1310656 - RNA, 22 nt, Human
ugaagcgccauuagcuuugagg

SEQ ID NO: 1310657 - RNA, 19 nt, Human
ugacucugucuccagcagc

SEQ ID NO: 1310658 - RNA, 24 nt, Human
ugauggcagugucaggugcacucu

SEQ ID NO: 1310659 - RNA, 23 nt, Human
ugcacagggagcugagccccucc

SEQ ID NO: 1310660 - RNA, 18 nt, Human
ugcccaggcaggagugca

SEQ ID NO: 1310661 - RNA, 19 nt, Human
uggaagggcuggaagcucc

SEQ ID NO: 1310662 - RNA, 28 nt, Human
uggaggccccucccacgaaccuucuccc

SEQ ID NO: 1310663 - RNA, 26 nt, Human
uggaggccccucccacgaaccuuuuc

SEQ ID NO: 1310664 - RNA, 22 nt, Human
uggcagagacaggcagugauac

SEQ ID NO: 1310665 - RNA, 24 nt, Human
ugggcucaugugauccucccgccu

SEQ ID NO: 1310666 - RNA, 19 nt, Human
ugggcuccagccuccuggc

SEQ ID NO: 1310667 - RNA, 18 nt, Human
uuugaagcgccauuagcu

SEQ ID NO: 1310668 - RNA, 20 nt, Human
gcuaugaaacagccaugggg

SEQ ID NO: 1310669 - RNA, 23 nt, Human
gugguacagagggcuaugaaaca

SEQ ID NO: 1310670 - RNA, 22 nt, Human
aacagggagggaggaugcaacc

SEQ ID NO: 1310671 - RNA, 24 nt, Human
aagauccggaacagggagggagga

SEQ ID NO: 1310672 - RNA, 19 nt, Human
agccggugccaaucagacu

SEQ ID NO: 1310673 - RNA, 19 nt, Human
aggcaggggaugcgagggc

SEQ ID NO: 1310674 - RNA, 25 nt, Human
aggcugcagccgaaaugggggucgg

SEQ ID NO: 1310675 - RNA, 20 nt, Human
aggcuggagccggaauggga

SEQ ID NO: 1310676 - RNA, 23 nt, Human
ccggaacagggagggaggaugca

SEQ ID NO: 1310677 - RNA, 22 nt, Human
cgcaagauaagauccggaacag

SEQ ID NO: 1310678 - RNA, 18 nt, Human
cugcagccgaaauggggg

SEQ ID NO: 1310679 - RNA, 22 nt, Human
cuugagucaucagcuggcgaug

SEQ ID NO: 1310680 - RNA, 20 nt, Human
gagcaaguagaaugggccau

SEQ ID NO: 1310681 - RNA, 18 nt, Human
gaugcgagggcaggucca

SEQ ID NO: 1310682 - RNA, 18 nt, Human
gcgcuggcgcaagauaag

SEQ ID NO: 1310683 - RNA, 18 nt, Human
ggagccggugccaaucag

SEQ ID NO: 1310684 - RNA, 24 nt, Human
ucuugagucaucagcuggcgaugg

SEQ ID NO: 1310685 - RNA, 23 nt, Human
ugaggucuggcuacgggauccug

SEQ ID NO: 1310686 - RNA, 22 nt, Human
auccuuaguggggcuguuugag

SEQ ID NO: 1310687 - RNA, 22 nt, Human
caggcauccuauccccagccuc

SEQ ID NO: 1310688 - RNA, 18 nt, Human
ccucccaagagggccggg

SEQ ID NO: 1310689 - RNA, 22 nt, Human
gaggagccggggcacguuccag

SEQ ID NO: 1310690 - RNA, 18 nt, Human
ggacaggcauccuauccc

SEQ ID NO: 1310691 - RNA, 24 nt, Human
ggaggagccggggcacguuccagg

SEQ ID NO: 1310692 - RNA, 22 nt, Human
ggaugugaaagcuguuugugau

SEQ ID NO: 1310693 - RNA, 21 nt, Human
uaaagcuaccacagauauaag

SEQ ID NO: 1310694 - RNA, 22 nt, Human
uccccagccucuuccugucuuc

SEQ ID NO: 1310695 - RNA, 22 nt, Human
ugaucccugcccuuucuaccuc

SEQ ID NO: 1310696 - RNA, 21 nt, Human
uuaguggaugugaaagcuguu

SEQ ID NO: 1310697 - RNA, 19 nt, Human
uuccuuaucuuucaaaugg

SEQ ID NO: 1310698 - RNA, 24 nt, Human
uugagagccucccaagagggccgg

SEQ ID NO: 1310699 - RNA, 22 nt, Human
uugugaucaguaaagcuaccac

SEQ ID NO: 1310700 - RNA, 20 nt, Human
aggaggaucuauaugaugug

SEQ ID NO: 1310701 - RNA, 19 nt, Human
gacacaggagaugggaagg

SEQ ID NO: 1310702 - RNA, 20 nt, Human
ugaggaggaucuauaugaug

SEQ ID NO: 1310703 - RNA, 18 nt, Human
ugauguggucaaaucacu

SEQ ID NO: 1310704 - RNA, 22 nt, Human
uguggucaaaucacuuucagcc

SEQ ID NO: 1310705 - RNA, 22 nt, Human
aaaccgaagcccaacuguaagc

SEQ ID NO: 1310706 - RNA, 19 nt, Human
aaccuaagaaacccagacu

SEQ ID NO: 1310707 - RNA, 22 nt, Human
aagaaacccagacugcgcaaac

SEQ ID NO: 1310708 - RNA, 21 nt, Human
aagccccgcgucaggccggga

SEQ ID NO: 1310709 - RNA, 22 nt, Human
acccccuaaaccuaagaaaccc

SEQ ID NO: 1310710 - RNA, 23 nt, Human
agaaacccacccaacccccuaaa

SEQ ID NO: 1310711 - RNA, 21 nt, Human
agagaaacccacccaaccccc

SEQ ID NO: 1310712 - RNA, 23 nt, Human
agagaaacccacccaacccccua

SEQ ID NO: 1310713 - RNA, 24 nt, Human
agagaaacccacccaacccccuaa

SEQ ID NO: 1310714 - RNA, 20 nt, Human
agcaagaccagcgugcccgc

SEQ ID NO: 1310715 - RNA, 21 nt, Human
aggccgggagcgggacagaga

SEQ ID NO: 1310716 - RNA, 21 nt, Human
cacccaacccccuaaaccuaa

SEQ ID NO: 1310717 - RNA, 21 nt, Human
caccgcacccccagagaaacc

SEQ ID NO: 1310718 - RNA, 23 nt, Human
cacgauacugcuucuccccgcag

SEQ ID NO: 1310719 - RNA, 26 nt, Human
cagacugcgcaaaccgaagcccaacu

SEQ ID NO: 1310720 - RNA, 23 nt, Human
cagcggguggguauuccuggggc

SEQ ID NO: 1310721 - RNA, 19 nt, Human
ccaacccccuaaaccuaag

SEQ ID NO: 1310722 - RNA, 21 nt, Human
ccacccaacccccuaaaccua

SEQ ID NO: 1310723 - RNA, 23 nt, Human
ccacccaacccccuaaaccuaag

SEQ ID NO: 1310724 - RNA, 19 nt, Human
ccagagaaacccacccaac

SEQ ID NO: 1310725 - RNA, 21 nt, Human
cccaacccccuaaaccuaaga

SEQ ID NO: 1310726 - RNA, 26 nt, Human
cccacccaacccccuaaaccuaagaa

SEQ ID NO: 1310727 - RNA, 27 nt, Human
cccaccgcacccccagagaaacccacc

SEQ ID NO: 1310728 - RNA, 24 nt, Human
cccagagaaacccacccaaccccc

SEQ ID NO: 1310729 - RNA, 21 nt, Human
ccccagagaaacccacccaac

SEQ ID NO: 1310730 - RNA, 24 nt, Human
ccccagagaaacccacccaacccc

SEQ ID NO: 1310731 - RNA, 24 nt, Human
cccccagagaaacccacccaaccc

SEQ ID NO: 1310732 - RNA, 18 nt, Human
cccccagagaaacccacu

SEQ ID NO: 1310733 - RNA, 23 nt, Human
cccccuaaaccuaagaaacccag

SEQ ID NO: 1310734 - RNA, 24 nt, Human
cccccuaaaccuaagaaacccaga

SEQ ID NO: 1310735 - RNA, 19 nt, Human
ccccuaaaccuaagaaacc

SEQ ID NO: 1310736 - RNA, 21 nt, Human
cgcacccccagagaaacccac

SEQ ID NO: 1310737 - RNA, 25 nt, Human
cgcacccccagagaaacccacccaa

SEQ ID NO: 1310738 - RNA, 19 nt, Human
cgcagcagcggcugccgau

SEQ ID NO: 1310739 - RNA, 18 nt, Human
cugcuucuccccgcagca

SEQ ID NO: 1310740 - RNA, 23 nt, Human
cuggaagccccgcgucaggccgg

SEQ ID NO: 1310741 - RNA, 19 nt, Human
gagccgccgcgcgaaaccg

SEQ ID NO: 1310742 - RNA, 20 nt, Human
gcacccccagagaaacccac

SEQ ID NO: 1310743 - RNA, 20 nt, Human
gccgccgcgcgaaaccggcg

SEQ ID NO: 1310744 - RNA, 24 nt, Human
guauuccuggggcuccguggacgu

SEQ ID NO: 1310745 - RNA, 22 nt, Human
uaagaaacccagacugcgcaaa

SEQ ID NO: 1310746 - RNA, 18 nt, Human
ucaggccgggagcgggac

SEQ ID NO: 1310747 - RNA, 20 nt, Human
uccccgcagcagcggcugcc

SEQ ID NO: 1310748 - RNA, 27 nt, Human
ugcgcaaaccgaagcccaacuguaagc

SEQ ID NO: 1310749 - RNA, 18 nt, Human
uggggcuccguggacguu

SEQ ID NO: 1310750 - RNA, 24 nt, Human
aaaacucaccagcccaacaaaccc

SEQ ID NO: 1310751 - RNA, 23 nt, Human
aaacccccccagccccagugucc

SEQ ID NO: 1310752 - RNA, 22 nt, Human
aaacucaccagcccaacaaacc

SEQ ID NO: 1310753 - RNA, 27 nt, Human
accagcccaacaaacccccccagcccc

SEQ ID NO: 1310754 - RNA, 23 nt, Human
agacaagaggagaacggcgacgg

SEQ ID NO: 1310755 - RNA, 18 nt, Human
agcccaacaaaccccccc

SEQ ID NO: 1310756 - RNA, 19 nt, Human
augacuggguaucuucggc

SEQ ID NO: 1310757 - RNA, 20 nt, Human
caacaaacccccccagcccc

SEQ ID NO: 1310758 - RNA, 20 nt, Human
caccagcccaacaaaccccc

SEQ ID NO: 1310759 - RNA, 21 nt, Human
cagcccaacaaacccccccag

SEQ ID NO: 1310760 - RNA, 18 nt, Human
cagugucccccccaacgc

SEQ ID NO: 1310761 - RNA, 21 nt, Human
caugacuggguaucuucggcc

SEQ ID NO: 1310762 - RNA, 22 nt, Human
ccaacaaacccccccagcccca

SEQ ID NO: 1310763 - RNA, 23 nt, Human
ccagccccagugucccccccaac

SEQ ID NO: 1310764 - RNA, 19 nt, Human
cccagccccaguguccccc

SEQ ID NO: 1310765 - RNA, 23 nt, Human
ccccagccccaguguccccccca

SEQ ID NO: 1310766 - RNA, 19 nt, Human
cccccagccccaguguccc

SEQ ID NO: 1310767 - RNA, 22 nt, Human
cccccucuggggcccucaaccu

SEQ ID NO: 1310768 - RNA, 18 nt, Human
ccccgggucagggcucuc

SEQ ID NO: 1310769 - RNA, 19 nt, Human
ccucuggggcccucaaccu

SEQ ID NO: 1310770 - RNA, 21 nt, Human
cucgaaaacucaccagcccaa

SEQ ID NO: 1310771 - RNA, 19 nt, Human
cucucugggcguccccuca

SEQ ID NO: 1310772 - RNA, 18 nt, Human
gacuggguaucuucggcc

SEQ ID NO: 1310773 - RNA, 21 nt, Human
gaggagaacggcgacggagug

SEQ ID NO: 1310774 - RNA, 18 nt, Human
gcccugggccucuucaaa

SEQ ID NO: 1310775 - RNA, 20 nt, Human
gcccugggccucuucaaauc

SEQ ID NO: 1310776 - RNA, 21 nt, Human
ggcccugggccucuucaaauc

SEQ ID NO: 1310777 - RNA, 21 nt, Human
gucagggcucucugggcgucc

SEQ ID NO: 1310778 - RNA, 18 nt, Human
ucaccagcccaacaaacc

SEQ ID NO: 1310779 - RNA, 26 nt, Human
ucgcugcaguauccacuuggugcucc

SEQ ID NO: 1310780 - RNA, 22 nt, Human
ugcuucccccucuggggcccuc

SEQ ID NO: 1310781 - RNA, 18 nt, Human
agcaagugcagccccagg

SEQ ID NO: 1310782 - RNA, 19 nt, Human
agcaccagcagcuuccacc

SEQ ID NO: 1310783 - RNA, 19 nt, Human
agccacgagauccccgcgc

SEQ ID NO: 1310784 - RNA, 21 nt, Human
agcccuggccagcuggccugu

SEQ ID NO: 1310785 - RNA, 25 nt, Human
agcccuggccagcuggccuguggga

SEQ ID NO: 1310786 - RNA, 21 nt, Human
aggccucaggucugugcgcag

SEQ ID NO: 1310787 - RNA, 20 nt, Human
aggcucggggcagugggcag

SEQ ID NO: 1310788 - RNA, 20 nt, Human
agggcuuuggcgucugggcc

SEQ ID NO: 1310789 - RNA, 18 nt, Human
agguccuggacacaaggc

SEQ ID NO: 1310790 - RNA, 18 nt, Human
caagcgcccgcgggaccg

SEQ ID NO: 1310791 - RNA, 26 nt, Human
cacagauccaggggcccaggagcccu

SEQ ID NO: 1310792 - RNA, 20 nt, Human
cacgagauccccgcgccucc

SEQ ID NO: 1310793 - RNA, 22 nt, Human
cagcccuggccagcuggccugu

SEQ ID NO: 1310794 - RNA, 20 nt, Human
cagccucccucugugccaag

SEQ ID NO: 1310795 - RNA, 21 nt, Human
cagcgaggggcucccgaggcg

SEQ ID NO: 1310796 - RNA, 21 nt, Human
cagcggagccacgagaucccc

SEQ ID NO: 1310797 - RNA, 25 nt, Human
caugugcguggagggguacgugugg

SEQ ID NO: 1310798 - RNA, 20 nt, Human
ccaggacacacaucuggggg

SEQ ID NO: 1310799 - RNA, 24 nt, Human
ccaggcaccucugagaacugucac

SEQ ID NO: 1310800 - RNA, 24 nt, Human
ccccgcgccuccggcugacguccg

SEQ ID NO: 1310801 - RNA, 19 nt, Human
ccccggcucggcccaggug

SEQ ID NO: 1310802 - RNA, 24 nt, Human
ccccuccgcaggccacagugacag

SEQ ID NO: 1310803 - RNA, 19 nt, Human
cccgcccccccgcagagga

SEQ ID NO: 1310804 - RNA, 19 nt, Human
cccguccccuccgcaggcc

SEQ ID NO: 1310805 - RNA, 20 nt, Human
cccguguccgugguggggag

SEQ ID NO: 1310806 - RNA, 23 nt, Human
cccugugcagggcugagcaccag

SEQ ID NO: 1310807 - RNA, 20 nt, Human
ccgggagcugcgccucagac

SEQ ID NO: 1310808 - RNA, 20 nt, Human
ccgggucuccagccucccuc

SEQ ID NO: 1310809 - RNA, 18 nt, Human
ccgucugggccagcagcc

SEQ ID NO: 1310810 - RNA, 25 nt, Human
ccuccugcccucucucccacgguua

SEQ ID NO: 1310811 - RNA, 20 nt, Human
ccucugagaacugucacggg

SEQ ID NO: 1310812 - RNA, 20 nt, Human
ccuugcccugccuuucacag

SEQ ID NO: 1310813 - RNA, 20 nt, Human
ccuuggccuccccgcccccc

SEQ ID NO: 1310814 - RNA, 22 nt, Human
cgaccacuccugggugggagcc

SEQ ID NO: 1310815 - RNA, 18 nt, Human
cgagauccccgcgccucc

SEQ ID NO: 1310816 - RNA, 22 nt, Human
cgaggggcucccgaggcggccc

SEQ ID NO: 1310817 - RNA, 21 nt, Human
cggcucggcccaggugugcgg

SEQ ID NO: 1310818 - RNA, 20 nt, Human
cuccagccucccucugugcc

SEQ ID NO: 1310819 - RNA, 25 nt, Human
cucggcccaggugugcgggccgcgg

SEQ ID NO: 1310820 - RNA, 19 nt, Human
cugaccccucugugcacgc

SEQ ID NO: 1310821 - RNA, 20 nt, Human
cugaccccucugugcacgcc

SEQ ID NO: 1310822 - RNA, 22 nt, Human
cugagcaccagcagcuuccacc

SEQ ID NO: 1310823 - RNA, 19 nt, Human
cuuuggggguauucugcgg

SEQ ID NO: 1310824 - RNA, 20 nt, Human
gaacaagcgcccgcgggacc

SEQ ID NO: 1310825 - RNA, 20 nt, Human
gacccggcccgggcccgugg

SEQ ID NO: 1310826 - RNA, 20 nt, Human
gacuguggggaugguucagg

SEQ ID NO: 1310827 - RNA, 19 nt, Human
gagcaagugcagccccagg

SEQ ID NO: 1310828 - RNA, 19 nt, Human
gagccgaguggggcgccca

SEQ ID NO: 1310829 - RNA, 20 nt, Human
gagccgaguggggcgcccag

SEQ ID NO: 1310830 - RNA, 23 nt, Human
gaggccggguggccugggcgggg

SEQ ID NO: 1310831 - RNA, 19 nt, Human
gauggacccggcccgggcc

SEQ ID NO: 1310832 - RNA, 24 nt, Human
gcagccccagguuggaggcgagcg

SEQ ID NO: 1310833 - RNA, 24 nt, Human
gcagcccuggccagcuggccugug

SEQ ID NO: 1310834 - RNA, 18 nt, Human
gccugugggagccaggcu

SEQ ID NO: 1310835 - RNA, 21 nt, Human
gcggcagauggugcccacauc

SEQ ID NO: 1310836 - RNA, 18 nt, Human
gcgggguccgaggaggcc

SEQ ID NO: 1310837 - RNA, 22 nt, Human
ggagcccguguccguggugggg

SEQ ID NO: 1310838 - RNA, 21 nt, Human
ggagggcuuuggcgucugggc

SEQ ID NO: 1310839 - RNA, 18 nt, Human
ggcaaggcugacgggagg

SEQ ID NO: 1310840 - RNA, 21 nt, Human
ggccggguggccugggcgggg

SEQ ID NO: 1310841 - RNA, 18 nt, Human
ggcugacguccgggcgcc

SEQ ID NO: 1310842 - RNA, 20 nt, Human
gggcaaggcugacgggaggg

SEQ ID NO: 1310843 - RNA, 22 nt, Human
gggcagcccuggccagcuggcc

SEQ ID NO: 1310844 - RNA, 24 nt, Human
gggcagcccuggccagcuggccug

SEQ ID NO: 1310845 - RNA, 21 nt, Human
gguaggcuuuucucgagggcc

SEQ ID NO: 1310846 - RNA, 20 nt, Human
gugacaggagggcuuuggcg

SEQ ID NO: 1310847 - RNA, 21 nt, Human
gugcaugggcuggugcggugc

SEQ ID NO: 1310848 - RNA, 18 nt, Human
gugggauggagcugggga

SEQ ID NO: 1310849 - RNA, 19 nt, Human
guggggaugguucagggcu

SEQ ID NO: 1310850 - RNA, 20 nt, Human
gugugcggcaggcaugugcg

SEQ ID NO: 1310851 - RNA, 22 nt, Human
gugugcggcaggcaugugcgug

SEQ ID NO: 1310852 - RNA, 18 nt, Human
ucccagaggcuccuccug

SEQ ID NO: 1310853 - RNA, 20 nt, Human
uccccgcccccccgcagagg

SEQ ID NO: 1310854 - RNA, 22 nt, Human
uccccgcgccuccggcugacgu

SEQ ID NO: 1310855 - RNA, 25 nt, Human
ucccgaggcggccccggcucggccc

SEQ ID NO: 1310856 - RNA, 23 nt, Human
ucccgugacccugugcagggcug

SEQ ID NO: 1310857 - RNA, 21 nt, Human
uccgggguaggcuuuucucga

SEQ ID NO: 1310858 - RNA, 20 nt, Human
uccuccugcccucucuccca

SEQ ID NO: 1310859 - RNA, 18 nt, Human
uccuggacacaaggccuc

SEQ ID NO: 1310860 - RNA, 18 nt, Human
ucucgagggccaccugac

SEQ ID NO: 1310861 - RNA, 21 nt, Human
ugacaggagggcuuuggcguc

SEQ ID NO: 1310862 - RNA, 25 nt, Human
ugacaggagggcuuuggcgucuggg

SEQ ID NO: 1310863 - RNA, 24 nt, Human
ugacguccgggcgcccagggucug

SEQ ID NO: 1310864 - RNA, 23 nt, Human
ugagcagguggccugcugcuuca

SEQ ID NO: 1310865 - RNA, 23 nt, Human
ugcgauccauccgggagcugcgc

SEQ ID NO: 1310866 - RNA, 22 nt, Human
uggaggcgagcgugugcauggg

SEQ ID NO: 1310867 - RNA, 19 nt, Human
uggccagcuggccuguggg

SEQ ID NO: 1310868 - RNA, 23 nt, Human
uggcccggacauugcugagccga

SEQ ID NO: 1310869 - RNA, 23 nt, Human
uggccugggcgggguccgaggag

SEQ ID NO: 1310870 - RNA, 21 nt, Human
uggccugugggagccaggcuc

SEQ ID NO: 1310871 - RNA, 18 nt, Human
uggcgucugggccccccu

SEQ ID NO: 1310872 - RNA, 20 nt, Human
ugggauggagcuggggaugc

SEQ ID NO: 1310873 - RNA, 22 nt, Human
ugggggcaccguugcuguccca

SEQ ID NO: 1310874 - RNA, 18 nt, Human
uggggguauucugcgggg

SEQ ID NO: 1310875 - RNA, 21 nt, Human
ugggugggguucuuccggggu

SEQ ID NO: 1310876 - RNA, 24 nt, Human
uggucucgggagugacugugggga

SEQ ID NO: 1310877 - RNA, 18 nt, Human
uggugcccacaucugucu

SEQ ID NO: 1310878 - RNA, 22 nt, Human
uggugcccacaucugucugguc

SEQ ID NO: 1310879 - RNA, 19 nt, Human
ugugcggcaggcaugugcg

SEQ ID NO: 1310880 - RNA, 23 nt, Human
uguggggaugguucagggcuggg

SEQ ID NO: 1310881 - RNA, 21 nt, Human
uugcugagccgaguggggcgc

SEQ ID NO: 1310882 - RNA, 21 nt, Human
aggcaguccgugguuuggagc

SEQ ID NO: 1310883 - RNA, 22 nt, Human
cgcagcgggcucuggccaucag

SEQ ID NO: 1310884 - RNA, 21 nt, Human
gagcuuccccaggaguuuggg

SEQ ID NO: 1310885 - RNA, 23 nt, Human
gggcucuggccaucaggcagucc

SEQ ID NO: 1310886 - RNA, 21 nt, Human
uccccaggaguuugggaacug

SEQ ID NO: 1310887 - RNA, 24 nt, Human
ucuggccaucaggcaguccguggu

SEQ ID NO: 1310888 - RNA, 21 nt, Human
ugguuuggagcuuccccagga

SEQ ID NO: 1310889 - RNA, 25 nt, Human
aaccgccuucugaugaauuaauuca

SEQ ID NO: 1310890 - RNA, 22 nt, Human
ccgccuucugaugaauuaauuc

SEQ ID NO: 1310891 - RNA, 21 nt, Human
cugaugaauuaauucacgugc

SEQ ID NO: 1310892 - RNA, 22 nt, Human
aaccuccuucuuucccccucug

SEQ ID NO: 1310893 - RNA, 21 nt, Human
accuccuucuuucccccucug

SEQ ID NO: 1310894 - RNA, 21 nt, Human
caucuugucuuucugcagcca

SEQ ID NO: 1310895 - RNA, 21 nt, Human
cccccucugcacucuugccac

SEQ ID NO: 1310896 - RNA, 22 nt, Human
ccccucugcacucuugccacaa

SEQ ID NO: 1310897 - RNA, 21 nt, Human
gugcuuucuccaucuccuccu

SEQ ID NO: 1310898 - RNA, 18 nt, Human
ucuguuuacugugcuuuc

SEQ ID NO: 1310899 - RNA, 24 nt, Human
ugcuuucuccaucuccuccuccca

SEQ ID NO: 1310900 - RNA, 22 nt, Human
uuucccccucugcacucuugcc

SEQ ID NO: 1310901 - RNA, 19 nt, Human
auccgaaucagccaauagg

SEQ ID NO: 1310902 - RNA, 22 nt, Human
cccuccauuucccaagagcaaa

SEQ ID NO: 1310903 - RNA, 18 nt, Human
ccgggcucagggcauucc

SEQ ID NO: 1310904 - RNA, 21 nt, Human
cgaaucagccaauaggaauuc

SEQ ID NO: 1310905 - RNA, 24 nt, Human
cgacccggaccacgcgggagccgg

SEQ ID NO: 1310906 - RNA, 18 nt, Human
cuccgcccgacccggacc

SEQ ID NO: 1310907 - RNA, 19 nt, Human
gacccggaccacgcgggag

SEQ ID NO: 1310908 - RNA, 19 nt, Human
gaggaacagguguucucug

SEQ ID NO: 1310909 - RNA, 20 nt, Human
guaaagcaucuuggaucccc

SEQ ID NO: 1310910 - RNA, 25 nt, Human
ugaggaacagguguucucugggugu

SEQ ID NO: 1310911 - RNA, 18 nt, Human
uucccggcuugggccucc

SEQ ID NO: 1310912 - RNA, 19 nt, Human
accugagugugcagagcca

SEQ ID NO: 1310913 - RNA, 21 nt, Human
auauuucuguaucuacuauca

SEQ ID NO: 1310914 - RNA, 23 nt, Human
cagagccaguuuaagaaugaggu

SEQ ID NO: 1310915 - RNA, 23 nt, Human
ccccagcgagucaucuguugcuu

SEQ ID NO: 1310916 - RNA, 20 nt, Human
gguucugugggcaguaagag

SEQ ID NO: 1310917 - RNA, 23 nt, Human
ucccaagaaccaacccuccugcc

SEQ ID NO: 1310918 - RNA, 21 nt, Human
uggcacauaccugagugugca

SEQ ID NO: 1310919 - RNA, 18 nt, Human
uucugugggcaguaagag

SEQ ID NO: 1310920 - RNA, 18 nt, Human
aaguugccgauguugaag

SEQ ID NO: 1310921 - RNA, 18 nt, Human
agacaccaaggagcuccc

SEQ ID NO: 1310922 - RNA, 22 nt, Human
agaggguccuuguucacaaagg

SEQ ID NO: 1310923 - RNA, 24 nt, Human
auccucuuccgguaugccucguca

SEQ ID NO: 1310924 - RNA, 20 nt, Human
cacauaagccuccagguugc

SEQ ID NO: 1310925 - RNA, 19 nt, Human
ccaccagguagcacagccu

SEQ ID NO: 1310926 - RNA, 24 nt, Human
ccagcuucuggugcagagccugua

SEQ ID NO: 1310927 - RNA, 18 nt, Human
ccccgcgcagggcugucc

SEQ ID NO: 1310928 - RNA, 19 nt, Human
cccgccgccgccgccgccg

SEQ ID NO: 1310929 - RNA, 20 nt, Human
ccgcccgaccgcccggcucc

SEQ ID NO: 1310930 - RNA, 20 nt, Human
ccgcccgccgccgccgccgc

SEQ ID NO: 1310931 - RNA, 18 nt, Human
ccgccgccgcccgaccgc

SEQ ID NO: 1310932 - RNA, 20 nt, Human
ccgccgccgcccgaccgccc

SEQ ID NO: 1310933 - RNA, 25 nt, Human
ccgccgccgccgcccgaccgcccgg

SEQ ID NO: 1310934 - RNA, 18 nt, Human
ccgccgccgccgccgccg

SEQ ID NO: 1310935 - RNA, 18 nt, Human
ccgccgccgccgccgccg

SEQ ID NO: 1310936 - RNA, 18 nt, Human
ccgccgccgccgccgccg

SEQ ID NO: 1310937 - RNA, 18 nt, Human
ccgccgccgccgccgccg

SEQ ID NO: 1310938 - RNA, 18 nt, Human
ccgccgccgccgccgccg

SEQ ID NO: 1310939 - RNA, 18 nt, Human
ccgccgccgccgccgccg

SEQ ID NO: 1310940 - RNA, 18 nt, Human
ccgccgccgccgccgccg

SEQ ID NO: 1310941 - RNA, 18 nt, Human
ccgccgccgccgccgccg

SEQ ID NO: 1310942 - RNA, 23 nt, Human
ccgccgccgccgccgccgcccga

SEQ ID NO: 1310943 - RNA, 24 nt, Human
ccgccgccgccgccgccgccgccc

SEQ ID NO: 1310944 - RNA, 24 nt, Human
ccgccgccgccgccgccgccgccg

SEQ ID NO: 1310945 - RNA, 24 nt, Human
ccgccgccgccgccgccgccgccg

SEQ ID NO: 1310946 - RNA, 24 nt, Human
ccgccgccgccgccgccgccgccg

SEQ ID NO: 1310947 - RNA, 24 nt, Human
ccgccgccgccgccgccgccgccg

SEQ ID NO: 1310948 - RNA, 24 nt, Human
ccgccgccgccgccgccgccgccg

SEQ ID NO: 1310949 - RNA, 24 nt, Human
ccgccgccgccgccgccgccgccg

SEQ ID NO: 1310950 - RNA, 18 nt, Human
ccgcggaccggggcgccg

SEQ ID NO: 1310951 - RNA, 24 nt, Human
cgccgcccgccgccgccgccgccg

SEQ ID NO: 1310952 - RNA, 24 nt, Human
cgccgcccgccgccgccgccgccg

SEQ ID NO: 1310953 - RNA, 19 nt, Human
cgccgccgccgccgccgcc

SEQ ID NO: 1310954 - RNA, 19 nt, Human
cgcgcagggcuguccugua

SEQ ID NO: 1310955 - RNA, 24 nt, Human
cggugggccgccccgcgcagggcu

SEQ ID NO: 1310956 - RNA, 19 nt, Human
cugggccaguguguagggg

SEQ ID NO: 1310957 - RNA, 20 nt, Human
cuucagccuggagacagggc

SEQ ID NO: 1310958 - RNA, 18 nt, Human
ggcccgaugugccgcagc

SEQ ID NO: 1310959 - RNA, 26 nt, Human
ggcugguggcuugguccccggagggc

SEQ ID NO: 1310960 - RNA, 20 nt, Human
ucacagggggcgaugcggcc

SEQ ID NO: 1310961 - RNA, 24 nt, Human
ucccuguggauggaggcugguggc

SEQ ID NO: 1310962 - RNA, 21 nt, Human
uggcccaggucuucuucagcc

SEQ ID NO: 1310963 - RNA, 21 nt, Human
uggcccaggucuucuucagcc

SEQ ID NO: 1310964 - RNA, 24 nt, Human
uggcccaggucuucuucagccugg

SEQ ID NO: 1310965 - RNA, 21 nt, Human
cgggugggcagcgucuugucc

SEQ ID NO: 1310966 - RNA, 18 nt, Human
gacacucgcgcugcgccu

SEQ ID NO: 1310967 - RNA, 18 nt, Human
gcccccaagggaggggac

SEQ ID NO: 1310968 - RNA, 20 nt, Human
uccuccccgcggcgggguuu

SEQ ID NO: 1310969 - RNA, 22 nt, Human
ucgcgggugggcagcgucuugu

SEQ ID NO: 1310970 - RNA, 22 nt, Human
ugagaggggccgggggaagggg

SEQ ID NO: 1310971 - RNA, 23 nt, Human
aagcaaauucuucucagcagcuc

SEQ ID NO: 1310972 - RNA, 19 nt, Human
aauucuucucagcagcucu

SEQ ID NO: 1310973 - RNA, 20 nt, Human
agaggugcgcgccaggagcc

SEQ ID NO: 1310974 - RNA, 21 nt, Human
agcaaauucuucucagcagcu

SEQ ID NO: 1310975 - RNA, 19 nt, Human
aggagaagggagcagaggu

SEQ ID NO: 1310976 - RNA, 22 nt, Human
aggcgcaggugugcgggcugcc

SEQ ID NO: 1310977 - RNA, 23 nt, Human
agggguccugagcagaaugccuc

SEQ ID NO: 1310978 - RNA, 18 nt, Human
agugggggagguggggag

SEQ ID NO: 1310979 - RNA, 18 nt, Human
caaccuccagauccuccc

SEQ ID NO: 1310980 - RNA, 23 nt, Human
cagaacauggucuagaagggcaa

SEQ ID NO: 1310981 - RNA, 23 nt, Human
cagagaacaaccuccagauccuc

SEQ ID NO: 1310982 - RNA, 24 nt, Human
caggauggcucucaacacccaggc

SEQ ID NO: 1310983 - RNA, 19 nt, Human
caguacagcugucccuggg

SEQ ID NO: 1310984 - RNA, 19 nt, Human
ccugagcagaaugccucca

SEQ ID NO: 1310985 - RNA, 21 nt, Human
cgcgccaggagccaggcuggu

SEQ ID NO: 1310986 - RNA, 20 nt, Human
cuccgugguccuaacguggg

SEQ ID NO: 1310987 - RNA, 24 nt, Human
cugcagagaacaaccuccagaucc

SEQ ID NO: 1310988 - RNA, 22 nt, Human
gaagccugacacgccaguccca

SEQ ID NO: 1310989 - RNA, 23 nt, Human
gcagugggggagguggggagggg

SEQ ID NO: 1310990 - RNA, 18 nt, Human
gcgcaggugugcgggcug

SEQ ID NO: 1310991 - RNA, 19 nt, Human
gcgcgccaggagccaggcu

SEQ ID NO: 1310992 - RNA, 21 nt, Human
ggcgcaggugugcgggcugcc

SEQ ID NO: 1310993 - RNA, 24 nt, Human
ggcgcaggugugcgggcugccucu

SEQ ID NO: 1310994 - RNA, 20 nt, Human
ggcugaauucggaaagcaaa

SEQ ID NO: 1310995 - RNA, 22 nt, Human
gggaagccugacacgccagucc

SEQ ID NO: 1310996 - RNA, 20 nt, Human
gggagcagaggugcgcgcca

SEQ ID NO: 1310997 - RNA, 20 nt, Human
gggcacugugagcugggaua

SEQ ID NO: 1310998 - RNA, 20 nt, Human
gggggucaggguggugguca

SEQ ID NO: 1310999 - RNA, 20 nt, Human
ggguagugaggagaagggag

SEQ ID NO: 1311000 - RNA, 18 nt, Human
gguccugagcagaaugcc

SEQ ID NO: 1311001 - RNA, 22 nt, Human
gguucucugcagagaacaaccu

SEQ ID NO: 1311002 - RNA, 22 nt, Human
uacugguggccaccccaggggc

SEQ ID NO: 1311003 - RNA, 19 nt, Human
uaguaguuuuuuucccggu

SEQ ID NO: 1311004 - RNA, 21 nt, Human
uauaauacugucauacuggug

SEQ ID NO: 1311005 - RNA, 21 nt, Human
ucagggugguggucagucucc

SEQ ID NO: 1311006 - RNA, 22 nt, Human
uccugagcagaaugccuccagc

SEQ ID NO: 1311007 - RNA, 25 nt, Human
uccuggaguaacgcgcaguggggga

SEQ ID NO: 1311008 - RNA, 22 nt, Human
ucucuuguuaaauauuuucgau

SEQ ID NO: 1311009 - RNA, 21 nt, Human
ucuguugaaaaagacuugcag

SEQ ID NO: 1311010 - RNA, 23 nt, Human
ugaaguucuguugaaaaagacuu

SEQ ID NO: 1311011 - RNA, 18 nt, Human
ugagauggaaacacagcc

SEQ ID NO: 1311012 - RNA, 22 nt, Human
ugaggagaagggagcagaggug

SEQ ID NO: 1311013 - RNA, 18 nt, Human
ugggauagggguccugag

SEQ ID NO: 1311014 - RNA, 18 nt, Human
uggggggucaggguggug

SEQ ID NO: 1311015 - RNA, 24 nt, Human
uuauacgugcacucggcauauccu

SEQ ID NO: 1311016 - RNA, 22 nt, Human
uuauuaucucuuguuaaauauu

SEQ ID NO: 1311017 - RNA, 18 nt, Human
uucuucucagcagcucua

SEQ ID NO: 1311018 - RNA, 20 nt, Human
aaggagccccugccaccugc

SEQ ID NO: 1311019 - RNA, 24 nt, Human
acagaagcgccacagccggggagc

SEQ ID NO: 1311020 - RNA, 26 nt, Human
agagucccugcaucugcucccugccu

SEQ ID NO: 1311021 - RNA, 18 nt, Human
agcuguguguggcggcug

SEQ ID NO: 1311022 - RNA, 18 nt, Human
aggaggaggaaaccugaa

SEQ ID NO: 1311023 - RNA, 19 nt, Human
aggcagagucccugcaucu

SEQ ID NO: 1311024 - RNA, 22 nt, Human
aggcagagucccugcaucugcu

SEQ ID NO: 1311025 - RNA, 20 nt, Human
aggguucccuaacuuuuccc

SEQ ID NO: 1311026 - RNA, 22 nt, Human
aggguucccuaacuuuucccuu

SEQ ID NO: 1311027 - RNA, 21 nt, Human
agucaucuagagagcaaauac

SEQ ID NO: 1311028 - RNA, 22 nt, Human
auccacagaagcgccacagccg

SEQ ID NO: 1311029 - RNA, 25 nt, Human
augaggcagagucccugcaucugcu

SEQ ID NO: 1311030 - RNA, 23 nt, Human
augauccaucuucagaguuucuc

SEQ ID NO: 1311031 - RNA, 23 nt, Human
caacacaccuguuuacaaaggca

SEQ ID NO: 1311032 - RNA, 18 nt, Human
cacugcaggucagaaucg

SEQ ID NO: 1311033 - RNA, 22 nt, Human
cagacuucucugacacaugagg

SEQ ID NO: 1311034 - RNA, 20 nt, Human
cagagcccaguuuucgaggc

SEQ ID NO: 1311035 - RNA, 23 nt, Human
cagcccgaggccagcuggcugca

SEQ ID NO: 1311036 - RNA, 27 nt, Human
cagggugcacacaucccugcaggucuc

SEQ ID NO: 1311037 - RNA, 20 nt, Human
caucauggcuggccgcuggg

SEQ ID NO: 1311038 - RNA, 19 nt, Human
ccacaguccccuccaaguc

SEQ ID NO: 1311039 - RNA, 26 nt, Human
ccaccgucaauuggaccgcacccgcc

SEQ ID NO: 1311040 - RNA, 21 nt, Human
cccacauccacagaagcgcca

SEQ ID NO: 1311041 - RNA, 20 nt, Human
ccccagcucaccucccugga

SEQ ID NO: 1311042 - RNA, 24 nt, Human
cccgccauguuugcagcccgaggc

SEQ ID NO: 1311043 - RNA, 21 nt, Human
ccggaagagcacucugagagg

SEQ ID NO: 1311044 - RNA, 18 nt, Human
ccugaaucggagccuggg

SEQ ID NO: 1311045 - RNA, 18 nt, Human
ccuggucugaagcugaga

SEQ ID NO: 1311046 - RNA, 21 nt, Human
cgaacacagggacccucagac

SEQ ID NO: 1311047 - RNA, 23 nt, Human
cgccauguuugcagcccgaggcc

SEQ ID NO: 1311048 - RNA, 22 nt, Human
cgggagcuggaggccaaggagc

SEQ ID NO: 1311049 - RNA, 21 nt, Human
cuccagggcccccagcucacc

SEQ ID NO: 1311050 - RNA, 26 nt, Human
cuccagggcccccagcucaccucccu

SEQ ID NO: 1311051 - RNA, 18 nt, Human
cuccucagucccacaguc

SEQ ID NO: 1311052 - RNA, 20 nt, Human
cucucugcucugcgcuccuc

SEQ ID NO: 1311053 - RNA, 22 nt, Human
cucuuggcuccuggucugaagc

SEQ ID NO: 1311054 - RNA, 23 nt, Human
cugaggaggaggaaaccugaagg

SEQ ID NO: 1311055 - RNA, 18 nt, Human
cugcucccugccuggccu

SEQ ID NO: 1311056 - RNA, 20 nt, Human
cuggucugaagcugagauug

SEQ ID NO: 1311057 - RNA, 19 nt, Human
cuucggagucaccgcacag

SEQ ID NO: 1311058 - RNA, 24 nt, Human
gaaccacgccaacuacaacguccc

SEQ ID NO: 1311059 - RNA, 21 nt, Human
gaaucucuggcacggaagcuu

SEQ ID NO: 1311060 - RNA, 18 nt, Human
gaccauauuuacucuacc

SEQ ID NO: 1311061 - RNA, 21 nt, Human
gacgccgggcaccugggcggg

SEQ ID NO: 1311062 - RNA, 22 nt, Human
gagcaaauacacaguaauuccc

SEQ ID NO: 1311063 - RNA, 20 nt, Human
gagcacucugagaggcuggg

SEQ ID NO: 1311064 - RNA, 25 nt, Human
gagcuccagcgucuguuuucuaguc

SEQ ID NO: 1311065 - RNA, 21 nt, Human
gaggcugaggaaagaccccga

SEQ ID NO: 1311066 - RNA, 19 nt, Human
gauccaucuucagaguuuc

SEQ ID NO: 1311067 - RNA, 19 nt, Human
gcggcuggugggccgggcu

SEQ ID NO: 1311068 - RNA, 18 nt, Human
gcucaccucccuggaugg

SEQ ID NO: 1311069 - RNA, 20 nt, Human
gggcacagcggaagggcugc

SEQ ID NO: 1311070 - RNA, 19 nt, Human
gggcaggucucuuggcucc

SEQ ID NO: 1311071 - RNA, 24 nt, Human
gggcagugggcaggcaaggucugc

SEQ ID NO: 1311072 - RNA, 21 nt, Human
gggguugacuguugggucacc

SEQ ID NO: 1311073 - RNA, 22 nt, Human
ggucaccuuuuaauuggaccau

SEQ ID NO: 1311074 - RNA, 23 nt, Human
gguuuugugaccgccuuuuucag

SEQ ID NO: 1311075 - RNA, 18 nt, Human
gucauggccaugauccau

SEQ ID NO: 1311076 - RNA, 24 nt, Human
gucccugcaucugcucccugccug

SEQ ID NO: 1311077 - RNA, 25 nt, Human
guucggugggacacgaacacagggg

SEQ ID NO: 1311078 - RNA, 21 nt, Human
uccagcgucuguuuucuaguc

SEQ ID NO: 1311079 - RNA, 19 nt, Human
ucccacaguccccuccaag

SEQ ID NO: 1311080 - RNA, 21 nt, Human
uccccuccaagucacgggagc

SEQ ID NO: 1311081 - RNA, 23 nt, Human
ucccucaccagaauucaaugagg

SEQ ID NO: 1311082 - RNA, 24 nt, Human
ucccugcaggucucggggcuccug

SEQ ID NO: 1311083 - RNA, 19 nt, Human
uccggaagagcacucugag

SEQ ID NO: 1311084 - RNA, 22 nt, Human
uccuggggguuuugugaccgcc

SEQ ID NO: 1311085 - RNA, 19 nt, Human
ucuccagggcccccagcuc

SEQ ID NO: 1311086 - RNA, 19 nt, Human
ucugaagcugagauuggag

SEQ ID NO: 1311087 - RNA, 19 nt, Human
ucugcucccugccuggccu

SEQ ID NO: 1311088 - RNA, 18 nt, Human
ucugcugugcggaggcug

SEQ ID NO: 1311089 - RNA, 20 nt, Human
ucuucagaguuucucuuucu

SEQ ID NO: 1311090 - RNA, 20 nt, Human
ugaccacacccucauguguu

SEQ ID NO: 1311091 - RNA, 23 nt, Human
ugaccacacccucauguguuuuc

SEQ ID NO: 1311092 - RNA, 19 nt, Human
ugagaggcugggccccauc

SEQ ID NO: 1311093 - RNA, 21 nt, Human
ugaggaaagaccccgagagcg

SEQ ID NO: 1311094 - RNA, 19 nt, Human
ugaggaggaggaaaccuga

SEQ ID NO: 1311095 - RNA, 22 nt, Human
ugcaccucucaggguucccuaa

SEQ ID NO: 1311096 - RNA, 18 nt, Human
ugcaggucucggggcucc

SEQ ID NO: 1311097 - RNA, 22 nt, Human
ugcggaggcugccggucgacgc

SEQ ID NO: 1311098 - RNA, 22 nt, Human
ugcucugcgcuccucaguccca

SEQ ID NO: 1311099 - RNA, 18 nt, Human
uggaagggacccagucuc

SEQ ID NO: 1311100 - RNA, 23 nt, Human
uggauggcgcuuucggggaucug

SEQ ID NO: 1311101 - RNA, 19 nt, Human
uggcggagguuggagauuc

SEQ ID NO: 1311102 - RNA, 21 nt, Human
uggcugcaggugcaggacuag

SEQ ID NO: 1311103 - RNA, 23 nt, Human
ugggcagugggcaggcaaggucu

SEQ ID NO: 1311104 - RNA, 21 nt, Human
uucaacacaccuguuuacaaa

SEQ ID NO: 1311105 - RNA, 23 nt, Human
uucucaggagagugaaaugaggg

SEQ ID NO: 1311106 - RNA, 24 nt, Human
uucucugacacaugagggcucuga

SEQ ID NO: 1311107 - RNA, 19 nt, Human
uugugaccgccuuuuucag

SEQ ID NO: 1311108 - RNA, 23 nt, Human
uuuacaaaggcauuccagagccc

SEQ ID NO: 1311109 - RNA, 19 nt, Human
uuuccuggcgcguuuccgg

SEQ ID NO: 1311110 - RNA, 18 nt, Human
uuucucuuucuuccccac

SEQ ID NO: 1311111 - RNA, 23 nt, Human
uuuuucagggguugacuguuggg

SEQ ID NO: 1311112 - RNA, 22 nt, Human
aaacccaccaggcuugcaggga

SEQ ID NO: 1311113 - RNA, 22 nt, Human
aacauucugucccacgggaucc

SEQ ID NO: 1311114 - RNA, 23 nt, Human
aagcaggaaucgggccagacagc

SEQ ID NO: 1311115 - RNA, 24 nt, Human
aagccaccagacaugaccuggaau

SEQ ID NO: 1311116 - RNA, 18 nt, Human
aagguguggaggcaagug

SEQ ID NO: 1311117 - RNA, 18 nt, Human
acaaggacucugugucag

SEQ ID NO: 1311118 - RNA, 18 nt, Human
acccacauagugucgagc

SEQ ID NO: 1311119 - RNA, 20 nt, Human
acccccaggccccuguucac

SEQ ID NO: 1311120 - RNA, 22 nt, Human
acccuggcgcagccugcucuuc

SEQ ID NO: 1311121 - RNA, 23 nt, Human
acucaauaaaguuugaaaagguc

SEQ ID NO: 1311122 - RNA, 21 nt, Human
acucuggugaaaacccugcua

SEQ ID NO: 1311123 - RNA, 24 nt, Human
agacuggagcccccccagcccguc

SEQ ID NO: 1311124 - RNA, 19 nt, Human
agagcuggaaggcagggug

SEQ ID NO: 1311125 - RNA, 24 nt, Human
agagcuggaaggcagggugugugc

SEQ ID NO: 1311126 - RNA, 25 nt, Human
agcacccuccugacaguuggcgcca

SEQ ID NO: 1311127 - RNA, 18 nt, Human
agcacucucccaagcucu

SEQ ID NO: 1311128 - RNA, 21 nt, Human
agcccucuuuguccuccgccc

SEQ ID NO: 1311129 - RNA, 21 nt, Human
agccgcgcggacccuggccuc

SEQ ID NO: 1311130 - RNA, 20 nt, Human
agccugcgggacaaacucgg

SEQ ID NO: 1311131 - RNA, 18 nt, Human
aggagaccugcagaagga

SEQ ID NO: 1311132 - RNA, 20 nt, Human
aggagccaccagggcugggu

SEQ ID NO: 1311133 - RNA, 23 nt, Human
aggcacuuccucugcacugagcu

SEQ ID NO: 1311134 - RNA, 28 nt, Human
aggcaugaagccaccagacaugaccugg

SEQ ID NO: 1311135 - RNA, 19 nt, Human
aggcuccccgcuucuucac

SEQ ID NO: 1311136 - RNA, 23 nt, Human
auaugccaggcagcaggcagagc

SEQ ID NO: 1311137 - RNA, 18 nt, Human
augaagcccaggaacacu

SEQ ID NO: 1311138 - RNA, 18 nt, Human
augggcccugaccagugc

SEQ ID NO: 1311139 - RNA, 21 nt, Human
caagcucugcggccugggcca

SEQ ID NO: 1311140 - RNA, 19 nt, Human
cacagucccccccaccccc

SEQ ID NO: 1311141 - RNA, 18 nt, Human
caccaacagaugcaucca

SEQ ID NO: 1311142 - RNA, 23 nt, Human
caccuggcaggugugcaccuggc

SEQ ID NO: 1311143 - RNA, 20 nt, Human
caccuggguccccucacugc

SEQ ID NO: 1311144 - RNA, 18 nt, Human
caccuuggaaaacgucgg

SEQ ID NO: 1311145 - RNA, 25 nt, Human
cacuccacaccuggguccccucacu

SEQ ID NO: 1311146 - RNA, 23 nt, Human
cacucugaaaagcaggaaucggg

SEQ ID NO: 1311147 - RNA, 18 nt, Human
cacugugcccaagccgcg

SEQ ID NO: 1311148 - RNA, 23 nt, Human
caggaacacuggucaaaugcugc

SEQ ID NO: 1311149 - RNA, 24 nt, Human
caggaaggucccugagccagggca

SEQ ID NO: 1311150 - RNA, 19 nt, Human
caggcagagcuggaaggca

SEQ ID NO: 1311151 - RNA, 19 nt, Human
cagucccccccacccccac

SEQ ID NO: 1311152 - RNA, 22 nt, Human
caucaagucuccacuccacacc

SEQ ID NO: 1311153 - RNA, 19 nt, Human
caucaggguauucccaagg

SEQ ID NO: 1311154 - RNA, 21 nt, Human
caugaagccaccagacaugac

SEQ ID NO: 1311155 - RNA, 20 nt, Human
ccaccagcucacagucuggc

SEQ ID NO: 1311156 - RNA, 18 nt, Human
ccacgcuccccugacccg

SEQ ID NO: 1311157 - RNA, 23 nt, Human
ccagacaaggacucugugucaga

SEQ ID NO: 1311158 - RNA, 21 nt, Human
ccaggcagcaggcagagcugg

SEQ ID NO: 1311159 - RNA, 18 nt, Human
ccaugucgcucacacacc

SEQ ID NO: 1311160 - RNA, 22 nt, Human
cccaagcucugcggccugggcc

SEQ ID NO: 1311161 - RNA, 24 nt, Human
cccacccccaccagcucacagucu

SEQ ID NO: 1311162 - RNA, 24 nt, Human
cccagcccguccacuccacccucu

SEQ ID NO: 1311163 - RNA, 23 nt, Human
cccaggucacagcugccuggcuu

SEQ ID NO: 1311164 - RNA, 25 nt, Human
cccagugaucgcuaaaaacauagcc

SEQ ID NO: 1311165 - RNA, 19 nt, Human
ccccacgcagucucucucc

SEQ ID NO: 1311166 - RNA, 21 nt, Human
ccccacgcagucucucucccg

SEQ ID NO: 1311167 - RNA, 18 nt, Human
ccccagcccguccacucc

SEQ ID NO: 1311168 - RNA, 24 nt, Human
ccccagcggcgacccucggugguc

SEQ ID NO: 1311169 - RNA, 22 nt, Human
cccccagcccguccacuccacc

SEQ ID NO: 1311170 - RNA, 23 nt, Human
cccccccacccccaccagcucac

SEQ ID NO: 1311171 - RNA, 21 nt, Human
cccccccagcccguccacucc

SEQ ID NO: 1311172 - RNA, 23 nt, Human
cccccggcacccccaggccccug

SEQ ID NO: 1311173 - RNA, 22 nt, Human
ccccggcacccccaggccccug

SEQ ID NO: 1311174 - RNA, 24 nt, Human
ccccgugugccccgcuccugccgg

SEQ ID NO: 1311175 - RNA, 21 nt, Human
ccccucgaggccucgccgccu

SEQ ID NO: 1311176 - RNA, 22 nt, Human
ccccugagguccccgugugccc

SEQ ID NO: 1311177 - RNA, 21 nt, Human
cccgcauugcuccugcuggcc

SEQ ID NO: 1311178 - RNA, 22 nt, Human
cccguuccucacaguggcuguc

SEQ ID NO: 1311179 - RNA, 19 nt, Human
cccuugggaaucuuggguc

SEQ ID NO: 1311180 - RNA, 19 nt, Human
cccuugggagaacuugggg

SEQ ID NO: 1311181 - RNA, 18 nt, Human
ccgcguggcggcuggggc

SEQ ID NO: 1311182 - RNA, 22 nt, Human
ccggcucuccccacgcagucuc

SEQ ID NO: 1311183 - RNA, 20 nt, Human
ccucacaguggcugucgguc

SEQ ID NO: 1311184 - RNA, 21 nt, Human
ccuccgggccacgcuccccug

SEQ ID NO: 1311185 - RNA, 20 nt, Human
ccucuaagcuaggggacaaa

SEQ ID NO: 1311186 - RNA, 20 nt, Human
ccucucggauagagaccaug

SEQ ID NO: 1311187 - RNA, 25 nt, Human
ccugaugcugggcccaugucgcucc

SEQ ID NO: 1311188 - RNA, 26 nt, Human
ccuggcucuggagucugcuuagaguc

SEQ ID NO: 1311189 - RNA, 21 nt, Human
ccugggccacccgcugaagag

SEQ ID NO: 1311190 - RNA, 21 nt, Human
ccuguaguuggggucuagaac

SEQ ID NO: 1311191 - RNA, 21 nt, Human
ccuguucacccuccucagccc

SEQ ID NO: 1311192 - RNA, 20 nt, Human
ccuucacaugggucccagac

SEQ ID NO: 1311193 - RNA, 21 nt, Human
cgcagccugcucuucuccuuc

SEQ ID NO: 1311194 - RNA, 19 nt, Human
cgccagcacccuccugacu

SEQ ID NO: 1311195 - RNA, 22 nt, Human
cggcucacagucccccccaccc

SEQ ID NO: 1311196 - RNA, 19 nt, Human
cgugggaacuuggcccugg

SEQ ID NO: 1311197 - RNA, 20 nt, Human
cucacagucccccccacccc

SEQ ID NO: 1311198 - RNA, 22 nt, Human
cucacagucccccccaccccca

SEQ ID NO: 1311199 - RNA, 21 nt, Human
cucaggcacuuccucugcacu

SEQ ID NO: 1311200 - RNA, 23 nt, Human
cucaucagcagcucuuggugcga

SEQ ID NO: 1311201 - RNA, 20 nt, Human
cuccacaccuggguccccuc

SEQ ID NO: 1311202 - RNA, 23 nt, Human
cuccacccucucggauagagacc

SEQ ID NO: 1311203 - RNA, 22 nt, Human
cuccccacuccccacagucagu

SEQ ID NO: 1311204 - RNA, 24 nt, Human
cucugcacugagcuucacuaacuc

SEQ ID NO: 1311205 - RNA, 21 nt, Human
cucugugcucggcgucucuuc

SEQ ID NO: 1311206 - RNA, 19 nt, Human
cucuuccuucugcucaucu

SEQ ID NO: 1311207 - RNA, 24 nt, Human
cugcaggagccaccagggcugggu

SEQ ID NO: 1311208 - RNA, 22 nt, Human
cugcgggacaaacucgggccag

SEQ ID NO: 1311209 - RNA, 21 nt, Human
cuggcaacucacacucauugc

SEQ ID NO: 1311210 - RNA, 21 nt, Human
cuggggcugcaggagccacca

SEQ ID NO: 1311211 - RNA, 19 nt, Human
cuuccgaagcagcuugggg

SEQ ID NO: 1311212 - RNA, 19 nt, Human
cuugauggucgguucacuu

SEQ ID NO: 1311213 - RNA, 25 nt, Human
cuuggggaacguucauggguguucu

SEQ ID NO: 1311214 - RNA, 20 nt, Human
gaaaaggucuuaugagccaa

SEQ ID NO: 1311215 - RNA, 22 nt, Human
gaccagcacucucccaagcucu

SEQ ID NO: 1311216 - RNA, 20 nt, Human
gacgcagacagcccaccugg

SEQ ID NO: 1311217 - RNA, 23 nt, Human
gacuugcuuuccucgcugagcac

SEQ ID NO: 1311218 - RNA, 19 nt, Human
gagacaccguggcugccuu

SEQ ID NO: 1311219 - RNA, 24 nt, Human
gagcccgcguggcggcuggggcgg

SEQ ID NO: 1311220 - RNA, 23 nt, Human
gagcuggaaggcagggugugugc

SEQ ID NO: 1311221 - RNA, 19 nt, Human
gagggcucggaagccccug

SEQ ID NO: 1311222 - RNA, 24 nt, Human
gcccguuccucacaguggcugucg

SEQ ID NO: 1311223 - RNA, 19 nt, Human
gcccugaguuuuuucuccg

SEQ ID NO: 1311224 - RNA, 22 nt, Human
gccuccuucccugcucucuucc

SEQ ID NO: 1311225 - RNA, 24 nt, Human
gccugaugcugggcccaugucgcu

SEQ ID NO: 1311226 - RNA, 18 nt, Human
gccugcuuugggcuccag

SEQ ID NO: 1311227 - RNA, 20 nt, Human
gcuaggcugccgugggaacu

SEQ ID NO: 1311228 - RNA, 24 nt, Human
gcucacagucccccccacccccac

SEQ ID NO: 1311229 - RNA, 21 nt, Human
gcugguuccaucccugcucca

SEQ ID NO: 1311230 - RNA, 23 nt, Human
gcugucggucucugcuggggaga

SEQ ID NO: 1311231 - RNA, 21 nt, Human
ggagacucacagggggucucg

SEQ ID NO: 1311232 - RNA, 19 nt, Human
ggagcccccccagcccguc

SEQ ID NO: 1311233 - RNA, 27 nt, Human
ggagcccccccagcccguccacuccac

SEQ ID NO: 1311234 - RNA, 24 nt, Human
ggagguguugggcaauucggaauu

SEQ ID NO: 1311235 - RNA, 18 nt, Human
ggcaagugggggugccca

SEQ ID NO: 1311236 - RNA, 20 nt, Human
ggccagacagcugggugggu

SEQ ID NO: 1311237 - RNA, 18 nt, Human
ggcccccggcacccccag

SEQ ID NO: 1311238 - RNA, 21 nt, Human
ggcccugaccagugcccucau

SEQ ID NO: 1311239 - RNA, 18 nt, Human
ggccugggccacccgcug

SEQ ID NO: 1311240 - RNA, 20 nt, Human
ggcucacagucccccccacc

SEQ ID NO: 1311241 - RNA, 22 nt, Human
gggacauccgaguggggcuggg

SEQ ID NO: 1311242 - RNA, 23 nt, Human
gggauccucggggcacucuggug

SEQ ID NO: 1311243 - RNA, 23 nt, Human
gggcacucuggugaaaacccugc

SEQ ID NO: 1311244 - RNA, 20 nt, Human
gggccagacagcuggguggg

SEQ ID NO: 1311245 - RNA, 21 nt, Human
gggccagacagcugggugggu

SEQ ID NO: 1311246 - RNA, 22 nt, Human
ggggcacucuggugaaaacccu

SEQ ID NO: 1311247 - RNA, 21 nt, Human
gguagguaccuaccgccuucc

SEQ ID NO: 1311248 - RNA, 19 nt, Human
ggucuuucaggguccccug

SEQ ID NO: 1311249 - RNA, 21 nt, Human
gguguggaggcaagugggggu

SEQ ID NO: 1311250 - RNA, 24 nt, Human
guaccuaccgccuuccuggguggc

SEQ ID NO: 1311251 - RNA, 18 nt, Human
guccacguagcuguagcu

SEQ ID NO: 1311252 - RNA, 22 nt, Human
guccccgugugccccgcuccug

SEQ ID NO: 1311253 - RNA, 22 nt, Human
gucccuucuucuucaugugacc

SEQ ID NO: 1311254 - RNA, 18 nt, Human
gucuagaaccauggcuuc

SEQ ID NO: 1311255 - RNA, 21 nt, Human
uaccugaagguagguaccuac

SEQ ID NO: 1311256 - RNA, 23 nt, Human
uagguaccuaccgccuuccuggg

SEQ ID NO: 1311257 - RNA, 18 nt, Human
ucacaacauucuguccca

SEQ ID NO: 1311258 - RNA, 18 nt, Human
ucacaugggucccagacu

SEQ ID NO: 1311259 - RNA, 23 nt, Human
ucacuagggugggcuuuuugggg

SEQ ID NO: 1311260 - RNA, 18 nt, Human
ucacucugcugggacagc

SEQ ID NO: 1311261 - RNA, 20 nt, Human
ucagaggcacuuucaaaggg

SEQ ID NO: 1311262 - RNA, 21 nt, Human
ucaggguauucccaaggugcu

SEQ ID NO: 1311263 - RNA, 19 nt, Human
ucagucgcaugcuccuggu

SEQ ID NO: 1311264 - RNA, 18 nt, Human
ucauaugccaggcagcag

SEQ ID NO: 1311265 - RNA, 25 nt, Human
ucauaugccaggcagcaggcagagc

SEQ ID NO: 1311266 - RNA, 24 nt, Human
ucauuuuuggccccuuccuucaca

SEQ ID NO: 1311267 - RNA, 23 nt, Human
uccacagcuacaaugaugagggc

SEQ ID NO: 1311268 - RNA, 23 nt, Human
uccacccucucggauagagacca

SEQ ID NO: 1311269 - RNA, 21 nt, Human
uccacuccacaccuggguccc

SEQ ID NO: 1311270 - RNA, 23 nt, Human
ucccaggaaggucccugagccag

SEQ ID NO: 1311271 - RNA, 18 nt, Human
ucccccaggagaccugca

SEQ ID NO: 1311272 - RNA, 26 nt, Human
ucccccccacccccaccagcucacag

SEQ ID NO: 1311273 - RNA, 18 nt, Human
uccccgugugccccgcuc

SEQ ID NO: 1311274 - RNA, 21 nt, Human
ucccgggggcuccucugugcu

SEQ ID NO: 1311275 - RNA, 19 nt, Human
ucccugaagcuugagcccc

SEQ ID NO: 1311276 - RNA, 21 nt, Human
ucccuguggaaggcuccccgc

SEQ ID NO: 1311277 - RNA, 25 nt, Human
uccgaagcagcuugggggaccagca

SEQ ID NO: 1311278 - RNA, 29 nt, Human
uccggcucuccccacgcagucucucuccc

SEQ ID NO: 1311279 - RNA, 19 nt, Human
uccucugcacugagcuuca

SEQ ID NO: 1311280 - RNA, 18 nt, Human
uccuggguucugcuuucu

SEQ ID NO: 1311281 - RNA, 18 nt, Human
uccuugcaggggggaggu

SEQ ID NO: 1311282 - RNA, 21 nt, Human
ucggaagccccuguccagggc

SEQ ID NO: 1311283 - RNA, 24 nt, Human
ucggggccugaagagccccagcgg

SEQ ID NO: 1311284 - RNA, 22 nt, Human
ucuagaacuauugacucaauaa

SEQ ID NO: 1311285 - RNA, 18 nt, Human
ucugcaggggaugugggg

SEQ ID NO: 1311286 - RNA, 24 nt, Human
ucugcaggggauguggggagcugg

SEQ ID NO: 1311287 - RNA, 21 nt, Human
ucugcccugcugcuuugcaga

SEQ ID NO: 1311288 - RNA, 21 nt, Human
ucugggcuuugcucugacuug

SEQ ID NO: 1311289 - RNA, 21 nt, Human
ugaccagugcccucaugugcc

SEQ ID NO: 1311290 - RNA, 21 nt, Human
ugagacaccguggcugccuug

SEQ ID NO: 1311291 - RNA, 22 nt, Human
ugagcacauacuuugaugugua

SEQ ID NO: 1311292 - RNA, 19 nt, Human
ugagccccggcucacaguc

SEQ ID NO: 1311293 - RNA, 21 nt, Human
ugagugcaggauuugaaaugg

SEQ ID NO: 1311294 - RNA, 24 nt, Human
ugcaccuggcucuggagucugcuu

SEQ ID NO: 1311295 - RNA, 21 nt, Human
ugcagggacccugcagauggg

SEQ ID NO: 1311296 - RNA, 22 nt, Human
ugcaugaagcccaggaacacug

SEQ ID NO: 1311297 - RNA, 21 nt, Human
ugcccaagccgcgcggacccu

SEQ ID NO: 1311298 - RNA, 21 nt, Human
ugccuugggguuccuggguuc

SEQ ID NO: 1311299 - RNA, 20 nt, Human
ugcggagcccgcguggcggc

SEQ ID NO: 1311300 - RNA, 21 nt, Human
ugcggagcccgcguggcggcu

SEQ ID NO: 1311301 - RNA, 26 nt, Human
ugcggagcccgcguggcggcuggggc

SEQ ID NO: 1311302 - RNA, 19 nt, Human
ugcuaggcugccgugggaa

SEQ ID NO: 1311303 - RNA, 23 nt, Human
ugcuuagagucuuuggcggcucu

SEQ ID NO: 1311304 - RNA, 20 nt, Human
ugcuucugugucucucucuc

SEQ ID NO: 1311305 - RNA, 25 nt, Human
uggacagaaaugccccagaggugcu

SEQ ID NO: 1311306 - RNA, 18 nt, Human
uggagaaacuaaacugga

SEQ ID NO: 1311307 - RNA, 24 nt, Human
uggaugcuggcuuuacuacccagg

SEQ ID NO: 1311308 - RNA, 20 nt, Human
uggcaggggacauccgagug

SEQ ID NO: 1311309 - RNA, 18 nt, Human
uggcgccagcacccuccu

SEQ ID NO: 1311310 - RNA, 18 nt, Human
uggcuccccacuccccac

SEQ ID NO: 1311311 - RNA, 18 nt, Human
uggcugcggagcuggcgc

SEQ ID NO: 1311312 - RNA, 21 nt, Human
uggcugcggagcuggcgccag

SEQ ID NO: 1311313 - RNA, 19 nt, Human
uggcuucuucggcugccuu

SEQ ID NO: 1311314 - RNA, 23 nt, Human
uggcuuguggacgcagacagccc

SEQ ID NO: 1311315 - RNA, 25 nt, Human
ugggacucaggggcuugggacccug

SEQ ID NO: 1311316 - RNA, 22 nt, Human
ugggccacccgcugaagagccc

SEQ ID NO: 1311317 - RNA, 18 nt, Human
uggggagccccucggggc

SEQ ID NO: 1311318 - RNA, 19 nt, Human
uggggcugcaggagccacc

SEQ ID NO: 1311319 - RNA, 20 nt, Human
uggggcugcaggagccacca

SEQ ID NO: 1311320 - RNA, 26 nt, Human
ugggucugcagggcgucccgggguuu

SEQ ID NO: 1311321 - RNA, 19 nt, Human
uggguuucccaagacagcc

SEQ ID NO: 1311322 - RNA, 19 nt, Human
ugguaggugacuugcuuuc

SEQ ID NO: 1311323 - RNA, 20 nt, Human
uggugcgaguugggugccuu

SEQ ID NO: 1311324 - RNA, 21 nt, Human
uguagcuuccaagagaaacca

SEQ ID NO: 1311325 - RNA, 24 nt, Human
uguccagggccuguauguaugucu

SEQ ID NO: 1311326 - RNA, 18 nt, Human
ugugcagccuccuuggag

SEQ ID NO: 1311327 - RNA, 22 nt, Human
ugugcagccuccuuggaggucc

SEQ ID NO: 1311328 - RNA, 22 nt, Human
uguugggcaauucggaauugga

SEQ ID NO: 1311329 - RNA, 24 nt, Human
uguuugcugguuccaucccugcuc

SEQ ID NO: 1311330 - RNA, 21 nt, Human
uguuuugagucucuuugcguu

SEQ ID NO: 1311331 - RNA, 22 nt, Human
uuccuggguucugcuuucuggg

SEQ ID NO: 1311332 - RNA, 23 nt, Human
uucgggggccuccuccgggccac

SEQ ID NO: 1311333 - RNA, 18 nt, Human
uugauggucgguucacuu

SEQ ID NO: 1311334 - RNA, 22 nt, Human
uugcugguuccaucccugcucc

SEQ ID NO: 1311335 - RNA, 21 nt, Human
uuggaagucugagcagcagcc

SEQ ID NO: 1311336 - RNA, 18 nt, Human
uugucccucuggcucccc

SEQ ID NO: 1311337 - RNA, 21 nt, Human
uuuccucgcugagcacauacu

SEQ ID NO: 1311338 - RNA, 19 nt, Human
uuucugcuccacagcuaca

SEQ ID NO: 1311339 - RNA, 23 nt, Human
uuugaagugucuauugcgcuuga

SEQ ID NO: 1311340 - RNA, 20 nt, Human
uuuuuucuccguuguuuuga

SEQ ID NO: 1311341 - RNA, 21 nt, Human
aaauguugauaagcaagagcu

SEQ ID NO: 1311342 - RNA, 21 nt, Human
ccucucuaaugacacucuucu

SEQ ID NO: 1311343 - RNA, 26 nt, Human
cuaaugacacucuucuccaguuuccc

SEQ ID NO: 1311344 - RNA, 22 nt, Human
ucccuuguucccaucuucuucu

SEQ ID NO: 1311345 - RNA, 22 nt, Human
ccuccguguagcaccucagccc

SEQ ID NO: 1311346 - RNA, 18 nt, Human
cguguagcaccucagccc

SEQ ID NO: 1311347 - RNA, 21 nt, Human
ucccccucggcggguggaggc

SEQ ID NO: 1311348 - RNA, 24 nt, Human
uguagcaccucagcccaugcuucu

SEQ ID NO: 1311349 - RNA, 25 nt, Human
aaaaggaagaaaguuccagguggag

SEQ ID NO: 1311350 - RNA, 21 nt, Human
aaaguuccagguggagucugg

SEQ ID NO: 1311351 - RNA, 23 nt, Human
aaaugccagggucacaauauacc

SEQ ID NO: 1311352 - RNA, 22 nt, Human
acacauuucuuucuuacuguuc

SEQ ID NO: 1311353 - RNA, 23 nt, Human
acuauacuccagccuggucacag

SEQ ID NO: 1311354 - RNA, 25 nt, Human
acuauacuccagccuggucacaggg

SEQ ID NO: 1311355 - RNA, 23 nt, Human
agcuauauggaggcugagguggg

SEQ ID NO: 1311356 - RNA, 24 nt, Human
aggaucgcuugagcccaggaguuu

SEQ ID NO: 1311357 - RNA, 24 nt, Human
aggcugaggugggaggaucgcuug

SEQ ID NO: 1311358 - RNA, 22 nt, Human
aggcuggcaaguccaagaucaa

SEQ ID NO: 1311359 - RNA, 23 nt, Human
aggcuggcaaguccaagaucaag

SEQ ID NO: 1311360 - RNA, 23 nt, Human
aggugggaggaucgcuugagccc

SEQ ID NO: 1311361 - RNA, 23 nt, Human
auacuccagccuggucacagggg

SEQ ID NO: 1311362 - RNA, 24 nt, Human
aucaugccacuauacuccagccug

SEQ ID NO: 1311363 - RNA, 20 nt, Human
aucgcuugagcccaggaguu

SEQ ID NO: 1311364 - RNA, 22 nt, Human
augccacuauacuccagccugg

SEQ ID NO: 1311365 - RNA, 23 nt, Human
cacuauacuccagccuggucaca

SEQ ID NO: 1311366 - RNA, 19 nt, Human
cagcaugugcacguggcaa

SEQ ID NO: 1311367 - RNA, 19 nt, Human
ccacuauacuccagccugg

SEQ ID NO: 1311368 - RNA, 19 nt, Human
ccacuauacuccagccugg

SEQ ID NO: 1311369 - RNA, 20 nt, Human
ccacuauacuccagccuggu

SEQ ID NO: 1311370 - RNA, 22 nt, Human
ccaggaguuugaggcugcagug

SEQ ID NO: 1311371 - RNA, 24 nt, Human
ccaucugcaagcuggagaaucaga

SEQ ID NO: 1311372 - RNA, 18 nt, Human
cccaccagcuauauggag

SEQ ID NO: 1311373 - RNA, 21 nt, Human
ccgguggcauggaaguccaag

SEQ ID NO: 1311374 - RNA, 23 nt, Human
cgaaaaggaagaaaguuccaggu

SEQ ID NO: 1311375 - RNA, 20 nt, Human
cuggagaaucagagaagccg

SEQ ID NO: 1311376 - RNA, 18 nt, Human
gagcccaggaguuugagg

SEQ ID NO: 1311377 - RNA, 21 nt, Human
gagccggcagcugagggccga

SEQ ID NO: 1311378 - RNA, 24 nt, Human
gaucgcuugagcccaggaguuuga

SEQ ID NO: 1311379 - RNA, 23 nt, Human
gcaggcacaucuggugucugaug

SEQ ID NO: 1311380 - RNA, 21 nt, Human
ggaggcugaggugggaggauc

SEQ ID NO: 1311381 - RNA, 22 nt, Human
ggaucgcuugagcccaggaguu

SEQ ID NO: 1311382 - RNA, 20 nt, Human
ggccgagcagggguuaggcc

SEQ ID NO: 1311383 - RNA, 18 nt, Human
ggccgaggccgagcaggg

SEQ ID NO: 1311384 - RNA, 23 nt, Human
gggccgaggccgagcagggguua

SEQ ID NO: 1311385 - RNA, 22 nt, Human
ggucacaggggucugggaaaga

SEQ ID NO: 1311386 - RNA, 27 nt, Human
gucacaauauaccaucugcaagcugga

SEQ ID NO: 1311387 - RNA, 24 nt, Human
uaaacaacacacauuucuuucuua

SEQ ID NO: 1311388 - RNA, 18 nt, Human
uaccaucugcaagcugga

SEQ ID NO: 1311389 - RNA, 22 nt, Human
uacuccagccuggucacagggg

SEQ ID NO: 1311390 - RNA, 21 nt, Human
ucaauccacagaggaagaaaa

SEQ ID NO: 1311391 - RNA, 24 nt, Human
ucacaggggucugggaaagacaga

SEQ ID NO: 1311392 - RNA, 21 nt, Human
uccccaccagcuauauggagg

SEQ ID NO: 1311393 - RNA, 19 nt, Human
ucgcuugagcccaggaguu

SEQ ID NO: 1311394 - RNA, 24 nt, Human
ucgcuugagcccaggaguuugagg

SEQ ID NO: 1311395 - RNA, 21 nt, Human
ucggaugguuugcaugugcuc

SEQ ID NO: 1311396 - RNA, 20 nt, Human
ucuuacuguucugaaggcuu

SEQ ID NO: 1311397 - RNA, 22 nt, Human
ugagcccaggaguuugaggcug

SEQ ID NO: 1311398 - RNA, 18 nt, Human
ugaggucgaggacgugcc

SEQ ID NO: 1311399 - RNA, 18 nt, Human
ugaggugggaggaucgcu

SEQ ID NO: 1311400 - RNA, 20 nt, Human
ugaggugggaggaucgcuug

SEQ ID NO: 1311401 - RNA, 23 nt, Human
ugaggugggaggaucgcuugagc

SEQ ID NO: 1311402 - RNA, 24 nt, Human
ugaggugggaggaucgcuugagcc

SEQ ID NO: 1311403 - RNA, 23 nt, Human
ugcaagcuggagaaucagagaag

SEQ ID NO: 1311404 - RNA, 21 nt, Human
ugcacaagaaguuuauuguca

SEQ ID NO: 1311405 - RNA, 19 nt, Human
uggcagagagcaagcucuu

SEQ ID NO: 1311406 - RNA, 20 nt, Human
ugggaaagacagaggcuuug

SEQ ID NO: 1311407 - RNA, 18 nt, Human
uucaaguacaaauaguaa

SEQ ID NO: 1311408 - RNA, 20 nt, Human
uucauguguuagaaacuugg

SEQ ID NO: 1311409 - RNA, 21 nt, Human
uuccagguggagucuggugga

SEQ ID NO: 1311410 - RNA, 22 nt, Human
uuugcugaggacagucuucuug

SEQ ID NO: 1311411 - RNA, 18 nt, Human
uuuuuaccucacaacagu

SEQ ID NO: 1311412 - RNA, 20 nt, Human
aaaaccugagauugugaaga

SEQ ID NO: 1311413 - RNA, 24 nt, Human
aaagugcugggauuacagguguga

SEQ ID NO: 1311414 - RNA, 27 nt, Human
aaccucuuuaagacucugucuuuguca

SEQ ID NO: 1311415 - RNA, 23 nt, Human
aagcagucuucccgucucagacu

SEQ ID NO: 1311416 - RNA, 19 nt, Human
aagcauccuacaaugcccc

SEQ ID NO: 1311417 - RNA, 25 nt, Human
aagugauccucccaccucagccucc

SEQ ID NO: 1311418 - RNA, 18 nt, Human
aagugcugggauuacagg

SEQ ID NO: 1311419 - RNA, 19 nt, Human
aagugcugggauuacaggu

SEQ ID NO: 1311420 - RNA, 18 nt, Human
accacaccuggcuaauuu

SEQ ID NO: 1311421 - RNA, 19 nt, Human
acggagcaguaaguacaga

SEQ ID NO: 1311422 - RNA, 19 nt, Human
acguugcccaggcuggucu

SEQ ID NO: 1311423 - RNA, 19 nt, Human
acguugcccaggcuggucu

SEQ ID NO: 1311424 - RNA, 24 nt, Human
acuaguccccaacggcaugugugc

SEQ ID NO: 1311425 - RNA, 24 nt, Human
acucuauccagccucaacuguuuu

SEQ ID NO: 1311426 - RNA, 19 nt, Human
acugcagccucuaccuccu

SEQ ID NO: 1311427 - RNA, 22 nt, Human
agcaucuguugcucuaggcaac

SEQ ID NO: 1311428 - RNA, 18 nt, Human
aggcaaggucuugcuacg

SEQ ID NO: 1311429 - RNA, 23 nt, Human
aggcaaggucuugcuacguugcc

SEQ ID NO: 1311430 - RNA, 23 nt, Human
aggcuggugcaggagacacauug

SEQ ID NO: 1311431 - RNA, 21 nt, Human
aggguucagggggacugcggg

SEQ ID NO: 1311432 - RNA, 22 nt, Human
aguacagaguucuggagaggga

SEQ ID NO: 1311433 - RNA, 23 nt, Human
aguagcugagaccacaggcaugu

SEQ ID NO: 1311434 - RNA, 20 nt, Human
agugacggagcaguaaguac

SEQ ID NO: 1311435 - RNA, 20 nt, Human
agugcaguggugcgaucccg

SEQ ID NO: 1311436 - RNA, 23 nt, Human
agugcaguggugcgaucccggcu

SEQ ID NO: 1311437 - RNA, 24 nt, Human
agugcaguggugcgaucccggcuc

SEQ ID NO: 1311438 - RNA, 21 nt, Human
aguggggcugggagguggcug

SEQ ID NO: 1311439 - RNA, 24 nt, Human
aucacuuugcaauaaaaccugagg

SEQ ID NO: 1311440 - RNA, 24 nt, Human
caaagugcugggauuacaggugug

SEQ ID NO: 1311441 - RNA, 24 nt, Human
caaggucuugcuacguugcccagg

SEQ ID NO: 1311442 - RNA, 20 nt, Human
caagugauccucccaccuca

SEQ ID NO: 1311443 - RNA, 27 nt, Human
caagugauccucccaccucagccuccc

SEQ ID NO: 1311444 - RNA, 19 nt, Human
caaucucugguuucuuugc

SEQ ID NO: 1311445 - RNA, 21 nt, Human
cacauguggucagcaaaucca

SEQ ID NO: 1311446 - RNA, 24 nt, Human
caccucagccucccgaguagcuga

SEQ ID NO: 1311447 - RNA, 26 nt, Human
caccuguagcugucaccucugugcca

SEQ ID NO: 1311448 - RNA, 23 nt, Human
cacugcagccucuaccuccuggg

SEQ ID NO: 1311449 - RNA, 22 nt, Human
cacuggccauuccccacccuga

SEQ ID NO: 1311450 - RNA, 21 nt, Human
cacuuugcaauaaaaccugag

SEQ ID NO: 1311451 - RNA, 23 nt, Human
cagccucuaccuccuggguucaa

SEQ ID NO: 1311452 - RNA, 18 nt, Human
cagccuuucuucuaucgc

SEQ ID NO: 1311453 - RNA, 19 nt, Human
cagggcuuuucagccaggg

SEQ ID NO: 1311454 - RNA, 18 nt, Human
cagugcaccuguguuugg

SEQ ID NO: 1311455 - RNA, 18 nt, Human
caguguccuuccaccacc

SEQ ID NO: 1311456 - RNA, 24 nt, Human
cauuuucaauugauucauuggggg

SEQ ID NO: 1311457 - RNA, 20 nt, Human
ccaaaggagagacaaucuug

SEQ ID NO: 1311458 - RNA, 21 nt, Human
ccaaagugcugggauuacagg

SEQ ID NO: 1311459 - RNA, 21 nt, Human
ccaaagugcugggauuacagg

SEQ ID NO: 1311460 - RNA, 24 nt, Human
ccaaagugcugggauuacaggugu

SEQ ID NO: 1311461 - RNA, 22 nt, Human
ccauuccccacccugaucugga

SEQ ID NO: 1311462 - RNA, 21 nt, Human
cccaacggcaugugugccacu

SEQ ID NO: 1311463 - RNA, 23 nt, Human
cccaccucagccucccgaguagc

SEQ ID NO: 1311464 - RNA, 24 nt, Human
cccaccucagccucccgaguagcu

SEQ ID NO: 1311465 - RNA, 20 nt, Human
cccagccuggaugccagugu

SEQ ID NO: 1311466 - RNA, 19 nt, Human
cccaggcuggagugcagug

SEQ ID NO: 1311467 - RNA, 19 nt, Human
ccccaacggcaugugugcc

SEQ ID NO: 1311468 - RNA, 21 nt, Human
cccccagagaacacguggcca

SEQ ID NO: 1311469 - RNA, 22 nt, Human
cccccagagaacacguggccau

SEQ ID NO: 1311470 - RNA, 20 nt, Human
ccccccagagaacacguggc

SEQ ID NO: 1311471 - RNA, 18 nt, Human
cccuggagagcaggaugg

SEQ ID NO: 1311472 - RNA, 21 nt, Human
ccuacaaugccccggacaacu

SEQ ID NO: 1311473 - RNA, 24 nt, Human
ccucccaccucagccucccgagua

SEQ ID NO: 1311474 - RNA, 24 nt, Human
ccuccuggguucaagugauccucc

SEQ ID NO: 1311475 - RNA, 22 nt, Human
ccucuaccuccuggguucaagu

SEQ ID NO: 1311476 - RNA, 21 nt, Human
ccucugugcuauaguacugcu

SEQ ID NO: 1311477 - RNA, 22 nt, Human
ccuggguucaagugauccuccc

SEQ ID NO: 1311478 - RNA, 23 nt, Human
ccuggguucaagugauccuccca

SEQ ID NO: 1311479 - RNA, 19 nt, Human
cggcuggaggagguggugc

SEQ ID NO: 1311480 - RNA, 24 nt, Human
cggggaguggggcugggagguggc

SEQ ID NO: 1311481 - RNA, 24 nt, Human
cucacugcagccucuaccuccugg

SEQ ID NO: 1311482 - RNA, 19 nt, Human
cucagcaucuuuuaacuca

SEQ ID NO: 1311483 - RNA, 20 nt, Human
cucugugcuauaguacugcu

SEQ ID NO: 1311484 - RNA, 23 nt, Human
cugcagccucuaccuccuggguu

SEQ ID NO: 1311485 - RNA, 18 nt, Human
cugcccggaacauggcgg

SEQ ID NO: 1311486 - RNA, 20 nt, Human
cugcggggaguggggcuggg

SEQ ID NO: 1311487 - RNA, 25 nt, Human
cuucagggcuuuucagccagggggu

SEQ ID NO: 1311488 - RNA, 19 nt, Human
gaguaaucccaaagugcug

SEQ ID NO: 1311489 - RNA, 27 nt, Human
gaguagcugagaccacaggcauguauu

SEQ ID NO: 1311490 - RNA, 18 nt, Human
gauuacaggugugaguca

SEQ ID NO: 1311491 - RNA, 20 nt, Human
gauuacaggugugagucacu

SEQ ID NO: 1311492 - RNA, 24 nt, Human
gauuacaggugugagucacucuau

SEQ ID NO: 1311493 - RNA, 20 nt, Human
gauuuugccccccagagaac

SEQ ID NO: 1311494 - RNA, 20 nt, Human
gcacauguggucagcaaauc

SEQ ID NO: 1311495 - RNA, 20 nt, Human
gcagaaugagccgcucaccc

SEQ ID NO: 1311496 - RNA, 19 nt, Human
gcccaggcuggagugcagu

SEQ ID NO: 1311497 - RNA, 20 nt, Human
gcccaggcuggagugcagug

SEQ ID NO: 1311498 - RNA, 23 nt, Human
gcccaggcuggagugcaguggug

SEQ ID NO: 1311499 - RNA, 19 nt, Human
gcgcggggagggugagggg

SEQ ID NO: 1311500 - RNA, 21 nt, Human
gcuaauuuuuucccuuuuucu

SEQ ID NO: 1311501 - RNA, 21 nt, Human
gcucacugcagccucuaccuc

SEQ ID NO: 1311502 - RNA, 24 nt, Human
ggaaagcgcggggagggugagggg

SEQ ID NO: 1311503 - RNA, 20 nt, Human
ggaaauguguagucuuugag

SEQ ID NO: 1311504 - RNA, 23 nt, Human
ggacugcggggaguggggcuggg

SEQ ID NO: 1311505 - RNA, 19 nt, Human
ggagguggcuguuugcaca

SEQ ID NO: 1311506 - RNA, 21 nt, Human
ggagguggcuguuugcacaug

SEQ ID NO: 1311507 - RNA, 21 nt, Human
ggcaaggucuugcuacguugc

SEQ ID NO: 1311508 - RNA, 24 nt, Human
ggcuggaggagguggugcuacugg

SEQ ID NO: 1311509 - RNA, 20 nt, Human
ggcuggucuugaacuccuga

SEQ ID NO: 1311510 - RNA, 18 nt, Human
gggaguggggcugggagg

SEQ ID NO: 1311511 - RNA, 18 nt, Human
ggggaguggggcugggag

SEQ ID NO: 1311512 - RNA, 19 nt, Human
gucucaaucucugguuucu

SEQ ID NO: 1311513 - RNA, 24 nt, Human
gugauccucccaccucagccuccc

SEQ ID NO: 1311514 - RNA, 18 nt, Human
uaaucccaaagugcuggg

SEQ ID NO: 1311515 - RNA, 21 nt, Human
uacagaguucuggagagggaa

SEQ ID NO: 1311516 - RNA, 24 nt, Human
uaccuccuggguucaagugauccu

SEQ ID NO: 1311517 - RNA, 19 nt, Human
uacguugcccaggcugguc

SEQ ID NO: 1311518 - RNA, 23 nt, Human
uacguugcccaggcuggucuuga

SEQ ID NO: 1311519 - RNA, 24 nt, Human
uacguugcccaggcuggucuugaa

SEQ ID NO: 1311520 - RNA, 22 nt, Human
uagaggcaaggucuugcuacgu

SEQ ID NO: 1311521 - RNA, 18 nt, Human
uagcccaggcuggagugc

SEQ ID NO: 1311522 - RNA, 23 nt, Human
uaguacugcuuuuuuuuuuccuu

SEQ ID NO: 1311523 - RNA, 18 nt, Human
uaugucuuuacuucaggg

SEQ ID NO: 1311524 - RNA, 23 nt, Human
ucacugcagccucuaccuccugg

SEQ ID NO: 1311525 - RNA, 24 nt, Human
ucacugcagccucuaccuccuggg

SEQ ID NO: 1311526 - RNA, 18 nt, Human
ucagcagcguugucccug

SEQ ID NO: 1311527 - RNA, 23 nt, Human
ucagugcaccuguguuuggggcu

SEQ ID NO: 1311528 - RNA, 26 nt, Human
ucagugcaccuguguuuggggcuuug

SEQ ID NO: 1311529 - RNA, 23 nt, Human
ucccaaagugcugggauuacagg

SEQ ID NO: 1311530 - RNA, 24 nt, Human
ucccgaguagcugagaccacaggc

SEQ ID NO: 1311531 - RNA, 19 nt, Human
ucccuggagagcaggaugg

SEQ ID NO: 1311532 - RNA, 20 nt, Human
ucccuuuuucuagaggcaag

SEQ ID NO: 1311533 - RNA, 20 nt, Human
uccugaguucaagcagucuu

SEQ ID NO: 1311534 - RNA, 21 nt, Human
uccuggguucaagugauccuc

SEQ ID NO: 1311535 - RNA, 23 nt, Human
ucuccaaugauaguuccugauuu

SEQ ID NO: 1311536 - RNA, 23 nt, Human
ucucugguuucuuugcucagugc

SEQ ID NO: 1311537 - RNA, 19 nt, Human
ucuguagcccaggcuggag

SEQ ID NO: 1311538 - RNA, 20 nt, Human
ucuguagcccaggcuggagu

SEQ ID NO: 1311539 - RNA, 24 nt, Human
ucuguagcccaggcuggagugcag

SEQ ID NO: 1311540 - RNA, 22 nt, Human
ucuucuaucgcuccucuccaau

SEQ ID NO: 1311541 - RNA, 24 nt, Human
ucuugaacuccugaguucaagcag

SEQ ID NO: 1311542 - RNA, 23 nt, Human
ucuugcuacguugcccaggcugg

SEQ ID NO: 1311543 - RNA, 24 nt, Human
ucuugcuacguugcccaggcuggu

SEQ ID NO: 1311544 - RNA, 24 nt, Human
ugaacuccugaguucaagcagucu

SEQ ID NO: 1311545 - RNA, 23 nt, Human
ugacgggauuucuuuaguuucug

SEQ ID NO: 1311546 - RNA, 18 nt, Human
ugagaagcagauuagcca

SEQ ID NO: 1311547 - RNA, 24 nt, Human
ugagaccacaggcauguauuacca

SEQ ID NO: 1311548 - RNA, 23 nt, Human
ugagggaaugucauuuugucuca

SEQ ID NO: 1311549 - RNA, 21 nt, Human
ugaguucaagcagucuucccg

SEQ ID NO: 1311550 - RNA, 23 nt, Human
ugcacugugucagccuuucuucu

SEQ ID NO: 1311551 - RNA, 24 nt, Human
ugcccaggcuggucuugaacuccu

SEQ ID NO: 1311552 - RNA, 27 nt, Human
ugcccaggcuggucuugaacuccugag

SEQ ID NO: 1311553 - RNA, 22 nt, Human
ugcccggaacauggcgguaaga

SEQ ID NO: 1311554 - RNA, 19 nt, Human
ugcggggaguggggcuggg

SEQ ID NO: 1311555 - RNA, 27 nt, Human
ugcuacguugcccaggcuggucuugaa

SEQ ID NO: 1311556 - RNA, 18 nt, Human
ugcugggauuacaggugu

SEQ ID NO: 1311557 - RNA, 24 nt, Human
ugcugggauuacaggugugaguca

SEQ ID NO: 1311558 - RNA, 18 nt, Human
ugcuuuuagucuugguga

SEQ ID NO: 1311559 - RNA, 18 nt, Human
uggagacaauuuuggugg

SEQ ID NO: 1311560 - RNA, 24 nt, Human
uggagugcaguggugcgaucccgg

SEQ ID NO: 1311561 - RNA, 23 nt, Human
uggcuaauuuuuucccuuuuucu

SEQ ID NO: 1311562 - RNA, 21 nt, Human
uggcuguuugcacaugugguc

SEQ ID NO: 1311563 - RNA, 23 nt, Human
ugggagguggcuguuugcacaug

SEQ ID NO: 1311564 - RNA, 18 nt, Human
ugggauuacaggugugag

SEQ ID NO: 1311565 - RNA, 18 nt, Human
ugggauuacaggugugag

SEQ ID NO: 1311566 - RNA, 21 nt, Human
ugggauuacaggugugaguca

SEQ ID NO: 1311567 - RNA, 22 nt, Human
ugggauuacaggugugagucac

SEQ ID NO: 1311568 - RNA, 22 nt, Human
ugggauuacaggugugagucac

SEQ ID NO: 1311569 - RNA, 23 nt, Human
ugggauuacaggugugagucacu

SEQ ID NO: 1311570 - RNA, 25 nt, Human
ugggauuacaggugugagucacucu

SEQ ID NO: 1311571 - RNA, 23 nt, Human
uggguucaagugauccucccacc

SEQ ID NO: 1311572 - RNA, 24 nt, Human
uggguucaagugauccucccaccu

SEQ ID NO: 1311573 - RNA, 24 nt, Human
uggugcgaucccggcucacugcag

SEQ ID NO: 1311574 - RNA, 18 nt, Human
ugucccuggagagcagga

SEQ ID NO: 1311575 - RNA, 24 nt, Human
ugugccacuggccauuccccaccc

SEQ ID NO: 1311576 - RNA, 23 nt, Human
uucaagugauccucccaccucag

SEQ ID NO: 1311577 - RNA, 24 nt, Human
uucaagugauccucccaccucagc

SEQ ID NO: 1311578 - RNA, 18 nt, Human
uucauugucauuaccagu

SEQ ID NO: 1311579 - RNA, 21 nt, Human
uucuaucgcuccucuccaaug

SEQ ID NO: 1311580 - RNA, 21 nt, Human
uuggaaauguguagucuuuga

SEQ ID NO: 1311581 - RNA, 23 nt, Human
uuggugguugcggcuggaggagg

SEQ ID NO: 1311582 - RNA, 19 nt, Human
uugucccuggagagcagga

SEQ ID NO: 1311583 - RNA, 21 nt, Human
uuuccuuucucuuucuccacc

SEQ ID NO: 1311584 - RNA, 24 nt, Human
uuuucagccagggggugauuuugc

SEQ ID NO: 1311585 - RNA, 23 nt, Human
uuuuucagcagcguugucccugg

SEQ ID NO: 1311586 - RNA, 18 nt, Human
aagagggauccagaacca

SEQ ID NO: 1311587 - RNA, 22 nt, Human
aagcagugugcccacuuaggag

SEQ ID NO: 1311588 - RNA, 18 nt, Human
agcgaagagggauccaga

SEQ ID NO: 1311589 - RNA, 21 nt, Human
caacagaagcagugugcccac

SEQ ID NO: 1311590 - RNA, 27 nt, Human
cccgcggccguagcacagccggggucc

SEQ ID NO: 1311591 - RNA, 25 nt, Human
cgaagagggauccagaaccagggcc

SEQ ID NO: 1311592 - RNA, 20 nt, Human
cuggggugguggugaggccu

SEQ ID NO: 1311593 - RNA, 24 nt, Human
cuggggugguggugaggccuggac

SEQ ID NO: 1311594 - RNA, 20 nt, Human
cuugcccucggcucagcggg

SEQ ID NO: 1311595 - RNA, 21 nt, Human
gcaacaacagaagcagugugc

SEQ ID NO: 1311596 - RNA, 20 nt, Human
ggcccgcggccguagcacag

SEQ ID NO: 1311597 - RNA, 19 nt, Human
ggcgugggagcgaagaggg

SEQ ID NO: 1311598 - RNA, 18 nt, Human
gggagcgaagagggaucc

SEQ ID NO: 1311599 - RNA, 22 nt, Human
gguuacgagagcaacaacagaa

SEQ ID NO: 1311600 - RNA, 21 nt, Human
uggggugguggugaggccugg

SEQ ID NO: 1311601 - RNA, 20 nt, Human
uggugugcucccagacggcg

SEQ ID NO: 1311602 - RNA, 22 nt, Human
uuccugaggccgagaggguccu

SEQ ID NO: 1311603 - RNA, 24 nt, Human
aaaguguugggauuucaggcauga

SEQ ID NO: 1311604 - RNA, 23 nt, Human
aaguagagaugcacaccaccaca

SEQ ID NO: 1311605 - RNA, 23 nt, Human
agcuauuuuuuuuuuuuuuuuuu

SEQ ID NO: 1311606 - RNA, 24 nt, Human
agcuggucucaaacuccugggcuc

SEQ ID NO: 1311607 - RNA, 23 nt, Human
aggaagaaacagauagaaccucc

SEQ ID NO: 1311608 - RNA, 24 nt, Human
aggcgaucugcccaucuuggccuc

SEQ ID NO: 1311609 - RNA, 22 nt, Human
aguucucacuauguuguccagg

SEQ ID NO: 1311610 - RNA, 18 nt, Human
augggguuucaccauguu

SEQ ID NO: 1311611 - RNA, 19 nt, Human
augggguuucaccauguug

SEQ ID NO: 1311612 - RNA, 21 nt, Human
augggguuucaccauguugca

SEQ ID NO: 1311613 - RNA, 23 nt, Human
caaccuuugccucccaggcucaa

SEQ ID NO: 1311614 - RNA, 19 nt, Human
cacaccaccacacucagcu

SEQ ID NO: 1311615 - RNA, 24 nt, Human
caccauguugcacaagcuggucuc

SEQ ID NO: 1311616 - RNA, 27 nt, Human
caccauguugcacaagcuggucucaaa

SEQ ID NO: 1311617 - RNA, 24 nt, Human
caccucagccuccugaguggcugg

SEQ ID NO: 1311618 - RNA, 18 nt, Human
cacuauguuguccaggcu

SEQ ID NO: 1311619 - RNA, 18 nt, Human
cacugcaaccuuugccuc

SEQ ID NO: 1311620 - RNA, 21 nt, Human
cacugcaaccuuugccuccca

SEQ ID NO: 1311621 - RNA, 23 nt, Human
cagaguggcacaaucucagcuca

SEQ ID NO: 1311622 - RNA, 24 nt, Human
cauguugcacaagcuggucucaaa

SEQ ID NO: 1311623 - RNA, 19 nt, Human
ccaaaguguugggauuuca

SEQ ID NO: 1311624 - RNA, 24 nt, Human
ccaaaguguugggauuucaggcau

SEQ ID NO: 1311625 - RNA, 23 nt, Human
ccaccucagccuccugaguggcu

SEQ ID NO: 1311626 - RNA, 23 nt, Human
cccaccucagccuccugaguggc

SEQ ID NO: 1311627 - RNA, 18 nt, Human
cccaggcucaagccaucc

SEQ ID NO: 1311628 - RNA, 22 nt, Human
cccaucuuggccucccaaagug

SEQ ID NO: 1311629 - RNA, 19 nt, Human
ccgcgcccgccuucccugc

SEQ ID NO: 1311630 - RNA, 26 nt, Human
ccgcgcccgccuucccugcaccaagg

SEQ ID NO: 1311631 - RNA, 21 nt, Human
ccuccgcgcccgccuucccug

SEQ ID NO: 1311632 - RNA, 26 nt, Human
ccuccugaguggcuggaaguagagau

SEQ ID NO: 1311633 - RNA, 23 nt, Human
ccugcaccaagcaaacugcaaga

SEQ ID NO: 1311634 - RNA, 23 nt, Human
ccugggcucaggcgaucugccca

SEQ ID NO: 1311635 - RNA, 24 nt, Human
cgaucugcccaucuuggccuccca

SEQ ID NO: 1311636 - RNA, 24 nt, Human
cucaagccauccucccaccucagc

SEQ ID NO: 1311637 - RNA, 24 nt, Human
cucacugcaaccuuugccucccag

SEQ ID NO: 1311638 - RNA, 24 nt, Human
cucacugcaaccuuugccucccag

SEQ ID NO: 1311639 - RNA, 20 nt, Human
cucaggcgaucugcccaucu

SEQ ID NO: 1311640 - RNA, 25 nt, Human
cucccaggcucaagccauccuccca

SEQ ID NO: 1311641 - RNA, 22 nt, Human
cuccugaguggcuggaaguaga

SEQ ID NO: 1311642 - RNA, 20 nt, Human
cuccugggcucaggcgaucu

SEQ ID NO: 1311643 - RNA, 23 nt, Human
cugcaaccuuugccucccaggcu

SEQ ID NO: 1311644 - RNA, 18 nt, Human
gaaacagauagaaccucc

SEQ ID NO: 1311645 - RNA, 20 nt, Human
gagaugggguuucaccaugu

SEQ ID NO: 1311646 - RNA, 23 nt, Human
gagaugggguuucaccauguugc

SEQ ID NO: 1311647 - RNA, 19 nt, Human
gaggaagaaacagauagaa

SEQ ID NO: 1311648 - RNA, 22 nt, Human
gcaaccuuugccucccaggcuc

SEQ ID NO: 1311649 - RNA, 21 nt, Human
gguagagaugggguuucacca

SEQ ID NO: 1311650 - RNA, 22 nt, Human
guagagaugaguucucacuaug

SEQ ID NO: 1311651 - RNA, 19 nt, Human
guagagaugggguuucacc

SEQ ID NO: 1311652 - RNA, 21 nt, Human
guagagaugggguuucaccau

SEQ ID NO: 1311653 - RNA, 22 nt, Human
guagagaugggguuucaccaug

SEQ ID NO: 1311654 - RNA, 23 nt, Human
guagagaugggguuucaccaugu

SEQ ID NO: 1311655 - RNA, 24 nt, Human
guucucacuauguuguccaggcug

SEQ ID NO: 1311656 - RNA, 22 nt, Human
uagagaugggguuucaccaugu

SEQ ID NO: 1311657 - RNA, 24 nt, Human
uaugacugacaacuuacaucacaa

SEQ ID NO: 1311658 - RNA, 18 nt, Human
uauguuguccaggcugga

SEQ ID NO: 1311659 - RNA, 21 nt, Human
uauguuguccaggcuggagca

SEQ ID NO: 1311660 - RNA, 23 nt, Human
uauguuguccaggcuggagcaga

SEQ ID NO: 1311661 - RNA, 25 nt, Human
ucaagccauccucccaccucagccu

SEQ ID NO: 1311662 - RNA, 18 nt, Human
ucaauuuaaaauacauca

SEQ ID NO: 1311663 - RNA, 19 nt, Human
ucacugcaaccuuugccuc

SEQ ID NO: 1311664 - RNA, 24 nt, Human
ucacugcaaccuuugccucccagg

SEQ ID NO: 1311665 - RNA, 25 nt, Human
ucacugcaaccuuugccucccaggc

SEQ ID NO: 1311666 - RNA, 22 nt, Human
ucagccuccugaguggcuggaa

SEQ ID NO: 1311667 - RNA, 24 nt, Human
ucagcuauuuuuuuuuuuuuuuuu

SEQ ID NO: 1311668 - RNA, 27 nt, Human
ucagcucacugcaaccuuugccuccca

SEQ ID NO: 1311669 - RNA, 21 nt, Human
ucaggcaugacccaccacgcc

SEQ ID NO: 1311670 - RNA, 21 nt, Human
uccaggcuggagcagaguggc

SEQ ID NO: 1311671 - RNA, 24 nt, Human
ucccaaaguguugggauuucaggc

SEQ ID NO: 1311672 - RNA, 18 nt, Human
ucccaggcucaagccauc

SEQ ID NO: 1311673 - RNA, 26 nt, Human
uccucccaccucagccuccugagugg

SEQ ID NO: 1311674 - RNA, 20 nt, Human
ucucaaacuccugggcucag

SEQ ID NO: 1311675 - RNA, 22 nt, Human
ucucacuauguuguccaggcug

SEQ ID NO: 1311676 - RNA, 23 nt, Human
ucucacuauguuguccaggcugg

SEQ ID NO: 1311677 - RNA, 24 nt, Human
ucucacuauguuguccaggcugga

SEQ ID NO: 1311678 - RNA, 24 nt, Human
ugccucccaggcucaagccauccu

SEQ ID NO: 1311679 - RNA, 24 nt, Human
uggcacaaucucagcucacugcaa

SEQ ID NO: 1311680 - RNA, 24 nt, Human
ugggauuucaggcaugacccacca

SEQ ID NO: 1311681 - RNA, 18 nt, Human
ugggguuucaccauguug

SEQ ID NO: 1311682 - RNA, 24 nt, Human
ugguagagaugggguuucaccaug

SEQ ID NO: 1311683 - RNA, 24 nt, Human
uguccaggcuggagcagaguggca

SEQ ID NO: 1311684 - RNA, 24 nt, Human
uugguagagaugggguuucaccau

SEQ ID NO: 1311685 - RNA, 24 nt, Human
uuguagagaugaguucucacuaug

SEQ ID NO: 1311686 - RNA, 24 nt, Human
uuuguagagaugaguucucacuau

SEQ ID NO: 1311687 - RNA, 24 nt, Human
uuuuugguagagaugggguuucac

SEQ ID NO: 1311688 - RNA, 23 nt, Human
uuuuuugguagagaugggguuuc

SEQ ID NO: 1311689 - RNA, 24 nt, Human
uuuuuuuuuuuuuuugguagagau

SEQ ID NO: 1311690 - RNA, 20 nt, Human
uuuuuuuuuuuuuuuuuggu

SEQ ID NO: 1311691 - RNA, 22 nt, Human
uuuuuuuuuuuuuuuuugguag

SEQ ID NO: 1311692 - RNA, 28 nt, Human
uuuuuuuuuuuuuuuuuuuuuuuggggg

SEQ ID NO: 1311693 - RNA, 23 nt, Human
aaaaaaaaaaaaaaaaaaaagag

SEQ ID NO: 1311694 - RNA, 27 nt, Human
aaaaaaaaaaaaaacaggaaaacuauu

SEQ ID NO: 1311695 - RNA, 23 nt, Human
aaaaaaaacaggaaaacuauuca

SEQ ID NO: 1311696 - RNA, 20 nt, Human
aaaaaaaaccacugcagucu

SEQ ID NO: 1311697 - RNA, 22 nt, Human
aaaaaccacugcagucuaagcc

SEQ ID NO: 1311698 - RNA, 24 nt, Human
aaaaaggagacauuacaaguguua

SEQ ID NO: 1311699 - RNA, 25 nt, Human
aaaaaggagacauuacaaguguuaa

SEQ ID NO: 1311700 - RNA, 26 nt, Human
aaaaauacucuacccagcaaagcuau

SEQ ID NO: 1311701 - RNA, 21 nt, Human
aaaacaaacaccaauucuucu

SEQ ID NO: 1311702 - RNA, 23 nt, Human
aaaaccuaugggauacagcaaaa

SEQ ID NO: 1311703 - RNA, 19 nt, Human
aaaaggacaaacaagguca

SEQ ID NO: 1311704 - RNA, 21 nt, Human
aaacaaacaccaauucuucuc

SEQ ID NO: 1311705 - RNA, 21 nt, Human
aaacaaccacagaccaagggc

SEQ ID NO: 1311706 - RNA, 18 nt, Human
aaacaaggucauuauaug

SEQ ID NO: 1311707 - RNA, 25 nt, Human
aaacagaaaacgugaacugacccaa

SEQ ID NO: 1311708 - RNA, 27 nt, Human
aaacagaaaacgugaacugacccaaaa

SEQ ID NO: 1311709 - RNA, 21 nt, Human
aaacagaaaucaaaaauaauc

SEQ ID NO: 1311710 - RNA, 25 nt, Human
aaacagaaaucaaaaauaaucagga

SEQ ID NO: 1311711 - RNA, 24 nt, Human
aaacagcaagagaaaggcaucaag

SEQ ID NO: 1311712 - RNA, 23 nt, Human
aaagaaccaaacacaaauccugg

SEQ ID NO: 1311713 - RNA, 24 nt, Human
aaagaagccaccuggagucccagg

SEQ ID NO: 1311714 - RNA, 21 nt, Human
aaagacauaccugacugagac

SEQ ID NO: 1311715 - RNA, 22 nt, Human
aaagccucaccacagccuccaa

SEQ ID NO: 1311716 - RNA, 24 nt, Human
aacaaacaccaauucuucucaaac

SEQ ID NO: 1311717 - RNA, 24 nt, Human
aacaaguuccucauuuccaucuga

SEQ ID NO: 1311718 - RNA, 22 nt, Human
aacacaagcgcauccagagaca

SEQ ID NO: 1311719 - RNA, 19 nt, Human
aacauggugaaacccgucu

SEQ ID NO: 1311720 - RNA, 20 nt, Human
aacauggugaaacccgucuc

SEQ ID NO: 1311721 - RNA, 23 nt, Human
aaccaaaaaaaaaaaaaaaaaaa

SEQ ID NO: 1311722 - RNA, 21 nt, Human
aaccaaagaagccaccuggag

SEQ ID NO: 1311723 - RNA, 21 nt, Human
aaccaaaugcaacagagacaa

SEQ ID NO: 1311724 - RNA, 24 nt, Human
aaccaccaaaaaaaaccacugcag

SEQ ID NO: 1311725 - RNA, 20 nt, Human
aaccuaaugaugcaccucaa

SEQ ID NO: 1311726 - RNA, 21 nt, Human
aaccucaauuuuugacuucug

SEQ ID NO: 1311727 - RNA, 18 nt, Human
aaccucugccuguuuccc

SEQ ID NO: 1311728 - RNA, 26 nt, Human
aacuacuucccauugggucccuccca

SEQ ID NO: 1311729 - RNA, 25 nt, Human
aacuucaauauccuacucucagcau

SEQ ID NO: 1311730 - RNA, 19 nt, Human
aagaaagaaaaaagaauga

SEQ ID NO: 1311731 - RNA, 20 nt, Human
aagaagaagaaauuuggaaa

SEQ ID NO: 1311732 - RNA, 21 nt, Human
aagaagccaccuggaguccca

SEQ ID NO: 1311733 - RNA, 22 nt, Human
aagcaagaacaaaucaaacaca

SEQ ID NO: 1311734 - RNA, 22 nt, Human
aagcaagucaugucucacaugg

SEQ ID NO: 1311735 - RNA, 19 nt, Human
aaggagccuggcacagugg

SEQ ID NO: 1311736 - RNA, 24 nt, Human
aagugugguggcucacgccuguaa

SEQ ID NO: 1311737 - RNA, 21 nt, Human
aaucauaugcuaacaaauugg

SEQ ID NO: 1311738 - RNA, 23 nt, Human
aaucuaggcagcaguucccaaac

SEQ ID NO: 1311739 - RNA, 20 nt, Human
acaaacaaggucauuauaug

SEQ ID NO: 1311740 - RNA, 22 nt, Human
acaaaguauaacaauuccaaau

SEQ ID NO: 1311741 - RNA, 25 nt, Human
acaauuccaaauaugcaugcaacca

SEQ ID NO: 1311742 - RNA, 21 nt, Human
acacacaccacccaggagccc

SEQ ID NO: 1311743 - RNA, 25 nt, Human
acagagugagacuccauugcuaaaa

SEQ ID NO: 1311744 - RNA, 23 nt, Human
acaggacccaugcaagcccaaaa

SEQ ID NO: 1311745 - RNA, 19 nt, Human
accaaaaaaaaaaaaaaaa

SEQ ID NO: 1311746 - RNA, 30 nt, Human
accaaaaaaguagaaagauuucaaauaaag

SEQ ID NO: 1311747 - RNA, 22 nt, Human
accauaucaaaaggauauacaa

SEQ ID NO: 1311748 - RNA, 18 nt, Human
acccagaaucaaagccaa

SEQ ID NO: 1311749 - RNA, 22 nt, Human
acccaugcaagcccaaaaucca

SEQ ID NO: 1311750 - RNA, 19 nt, Human
accccacauuucccuucug

SEQ ID NO: 1311751 - RNA, 25 nt, Human
acuacuucccauugggucccuccca

SEQ ID NO: 1311752 - RNA, 21 nt, Human
acucaaggcugaggcaggagg

SEQ ID NO: 1311753 - RNA, 24 nt, Human
acuccagccugggugacagaguga

SEQ ID NO: 1311754 - RNA, 23 nt, Human
acugcacuccagccuggugacag

SEQ ID NO: 1311755 - RNA, 25 nt, Human
acugcacuccagccuggugacagag

SEQ ID NO: 1311756 - RNA, 24 nt, Human
acuguacuccagccugggugacag

SEQ ID NO: 1311757 - RNA, 26 nt, Human
acuguacuccagccugggugacagag

SEQ ID NO: 1311758 - RNA, 23 nt, Human
acuuacuacugagaggccugagg

SEQ ID NO: 1311759 - RNA, 23 nt, Human
agaaaaccaccaaacugcaacca

SEQ ID NO: 1311760 - RNA, 20 nt, Human
agaaaacgugaacugaccca

SEQ ID NO: 1311761 - RNA, 20 nt, Human
agaaagauuucaaauaaaca

SEQ ID NO: 1311762 - RNA, 21 nt, Human
agaaucacguuggaaggcaag

SEQ ID NO: 1311763 - RNA, 22 nt, Human
agaauugguugaacacgggagg

SEQ ID NO: 1311764 - RNA, 23 nt, Human
agacaaaaagaaagaaaagggac

SEQ ID NO: 1311765 - RNA, 19 nt, Human
agacaacauaacaaagaac

SEQ ID NO: 1311766 - RNA, 19 nt, Human
agacauuacaaguguuacc

SEQ ID NO: 1311767 - RNA, 18 nt, Human
agagacaaaaaaaaugca

SEQ ID NO: 1311768 - RNA, 22 nt, Human
agaggauacagugagcugagau

SEQ ID NO: 1311769 - RNA, 24 nt, Human
agaggauacagugagcugagauug

SEQ ID NO: 1311770 - RNA, 19 nt, Human
agcaagaacaaaucaaaca

SEQ ID NO: 1311771 - RNA, 24 nt, Human
agcagcagaauauacaaucaucuc

SEQ ID NO: 1311772 - RNA, 25 nt, Human
agccacugaaugacucacaggcacc

SEQ ID NO: 1311773 - RNA, 20 nt, Human
agccugccacacacaccacc

SEQ ID NO: 1311774 - RNA, 22 nt, Human
agccuggccaacauggugaaac

SEQ ID NO: 1311775 - RNA, 24 nt, Human
agccuggccaacauggugaaaccc

SEQ ID NO: 1311776 - RNA, 24 nt, Human
agccugggugacagagugagacuc

SEQ ID NO: 1311777 - RNA, 21 nt, Human
agccuggugacagagcuagac

SEQ ID NO: 1311778 - RNA, 18 nt, Human
aggaagaaacagaaaacg

SEQ ID NO: 1311779 - RNA, 21 nt, Human
aggacccaugcaagcccaaaa

SEQ ID NO: 1311780 - RNA, 19 nt, Human
aggcaaagagagagcuuga

SEQ ID NO: 1311781 - RNA, 23 nt, Human
aggcaccacccaugccaauuaca

SEQ ID NO: 1311782 - RNA, 20 nt, Human
aggcagaggauacagugagc

SEQ ID NO: 1311783 - RNA, 24 nt, Human
aggcagaggauacagugagcugag

SEQ ID NO: 1311784 - RNA, 24 nt, Human
aggcaggagaauugguugaacacg

SEQ ID NO: 1311785 - RNA, 18 nt, Human
aggcaggaggaccauuug

SEQ ID NO: 1311786 - RNA, 19 nt, Human
aggccacagcuccacuccu

SEQ ID NO: 1311787 - RNA, 24 nt, Human
aggcggguagaucacgaggucagg

SEQ ID NO: 1311788 - RNA, 20 nt, Human
aggcugaggcaggagaauug

SEQ ID NO: 1311789 - RNA, 24 nt, Human
aggcugaggcaggaggaccauuug

SEQ ID NO: 1311790 - RNA, 18 nt, Human
aggucaccuggagaacua

SEQ ID NO: 1311791 - RNA, 21 nt, Human
agugaggcuaaccaaaaaaaa

SEQ ID NO: 1311792 - RNA, 24 nt, Human
auaaaccacuagugaggcuaacca

SEQ ID NO: 1311793 - RNA, 26 nt, Human
auauucagguaucuuuuagcaacacc

SEQ ID NO: 1311794 - RNA, 19 nt, Human
aucacgaggucaggaguuc

SEQ ID NO: 1311795 - RNA, 21 nt, Human
aucagauacccuaaaucucaa

SEQ ID NO: 1311796 - RNA, 23 nt, Human
aucaguuacccuaaaucucucaa

SEQ ID NO: 1311797 - RNA, 24 nt, Human
aucaugccacuguacuccagccug

SEQ ID NO: 1311798 - RNA, 27 nt, Human
aucucaacaaccaccaaaaaaaaccac

SEQ ID NO: 1311799 - RNA, 21 nt, Human
augaaauaccugaaaaaaauu

SEQ ID NO: 1311800 - RNA, 23 nt, Human
augagaucugaguggggacacag

SEQ ID NO: 1311801 - RNA, 25 nt, Human
augcaaccaacacaagcgcauccag

SEQ ID NO: 1311802 - RNA, 22 nt, Human
augccacuguacuccagccugg

SEQ ID NO: 1311803 - RNA, 21 nt, Human
augccgaggcggguagaucac

SEQ ID NO: 1311804 - RNA, 21 nt, Human
auucuggggucuggaggaugg

SEQ ID NO: 1311805 - RNA, 23 nt, Human
auugccaaacaaaggggcuacag

SEQ ID NO: 1311806 - RNA, 24 nt, Human
auugugccacugcacuccagccug

SEQ ID NO: 1311807 - RNA, 20 nt, Human
auuuauccauugucuacaua

SEQ ID NO: 1311808 - RNA, 30 nt, Human; identical to SEQ ID NO: 1243708

SEQ ID NO: 1311809 - RNA, 21 nt, Human
caaaacaaagaauuucugaac

SEQ ID NO: 1311810 - RNA, 22 nt, Human
caaaacaaagaauuucugaacc

SEQ ID NO: 1311811 - RNA, 23 nt, Human
caaaaccaaaccauaucauucug

SEQ ID NO: 1311812 - RNA, 21 nt, Human
caaaagacaaagagaaaaugc

SEQ ID NO: 1311813 - RNA, 19 nt, Human
caaaauugauaaaccacua

SEQ ID NO: 1311814 - RNA, 24 nt, Human
caaacacacaauuaguagaaagaa

SEQ ID NO: 1311815 - RNA, 23 nt, Human
caaaccauaucauucugccccug

SEQ ID NO: 1311816 - RNA, 21 nt, Human
caaagagaaaaugcuaaaaac

SEQ ID NO: 1311817 - RNA, 23 nt, Human
caacaaccaccaaaaaaaaccac

SEQ ID NO: 1311818 - RNA, 23 nt, Human
caacauggugaaacccgucucua

SEQ ID NO: 1311819 - RNA, 22 nt, Human
cacaacacaugggaauucaaga

SEQ ID NO: 1311820 - RNA, 26 nt, Human
cacaacacaugggaauucaagaugag

SEQ ID NO: 1311821 - RNA, 20 nt, Human
cacagcuccacuccuguggc

SEQ ID NO: 1311822 - RNA, 23 nt, Human
caccaaaaaaguagaaagauuuc

SEQ ID NO: 1311823 - RNA, 19 nt, Human
caccacagccuccaauaac

SEQ ID NO: 1311824 - RNA, 21 nt, Human
caccacagccuccaauaacaa

SEQ ID NO: 1311825 - RNA, 18 nt, Human
caccuggagucccaggga

SEQ ID NO: 1311826 - RNA, 19 nt, Human
caccuggagucccagggau

SEQ ID NO: 1311827 - RNA, 24 nt, Human
cacgccuguaaucccagcacuuug

SEQ ID NO: 1311828 - RNA, 22 nt, Human
cacuccagccuggugacagagc

SEQ ID NO: 1311829 - RNA, 18 nt, Human
cacugcacuccagccugg

SEQ ID NO: 1311830 - RNA, 18 nt, Human
cacugcacuccagccugg

SEQ ID NO: 1311831 - RNA, 18 nt, Human
cacugcacuccagccugg

SEQ ID NO: 1311832 - RNA, 23 nt, Human
cacugcacuccagccuggugaca

SEQ ID NO: 1311833 - RNA, 24 nt, Human
cacugcacuccagccuggugacag

SEQ ID NO: 1311834 - RNA, 18 nt, Human
cacugccagcaaccaaag

SEQ ID NO: 1311835 - RNA, 19 nt, Human
cacuguacuccagccuggg

SEQ ID NO: 1311836 - RNA, 19 nt, Human
cacuguacuccagccuggg

SEQ ID NO: 1311837 - RNA, 19 nt, Human
cacuguacuccagccuggg

SEQ ID NO: 1311838 - RNA, 22 nt, Human
cacuguacuccagccuggguga

SEQ ID NO: 1311839 - RNA, 23 nt, Human
cacuguacuccagccugggugac

SEQ ID NO: 1311840 - RNA, 24 nt, Human
cacuguacuccagccugggugaca

SEQ ID NO: 1311841 - RNA, 25 nt, Human
cacuguacuccagccugggugacag

SEQ ID NO: 1311842 - RNA, 24 nt, Human
cagaaaauggaaacacaucaugca

SEQ ID NO: 1311843 - RNA, 23 nt, Human
cagagacucaaggcugaggcagg

SEQ ID NO: 1311844 - RNA, 21 nt, Human
cagagcuggugcucacacuua

SEQ ID NO: 1311845 - RNA, 22 nt, Human
cagauaaaacagacuuuaaguc

SEQ ID NO: 1311846 - RNA, 25 nt, Human
cagcaaaagcaguacuaggaggaaa

SEQ ID NO: 1311847 - RNA, 19 nt, Human
cagcaaacuccugccuggg

SEQ ID NO: 1311848 - RNA, 24 nt, Human
cagcacuuugagaugccgaggcgg

SEQ ID NO: 1311849 - RNA, 21 nt, Human
cagcaggggcaaaaagccacc

SEQ ID NO: 1311850 - RNA, 21 nt, Human
cagcaguucccaaaccucaau

SEQ ID NO: 1311851 - RNA, 27 nt, Human
cagcaugggaaagaccugcccccauga

SEQ ID NO: 1311852 - RNA, 24 nt, Human
cagcuacucaggaggcugaggcag

SEQ ID NO: 1311853 - RNA, 21 nt, Human
caggacccaugcaagcccaaa

SEQ ID NO: 1311854 - RNA, 20 nt, Human
caggaguucgagagcagccu

SEQ ID NO: 1311855 - RNA, 21 nt, Human
caggggcaaaaagccaccagu

SEQ ID NO: 1311856 - RNA, 25 nt, Human
caggucccucccacaacauguggga

SEQ ID NO: 1311857 - RNA, 23 nt, Human
cauaacaaagaaccaaacacaaa

SEQ ID NO: 1311858 - RNA, 27 nt, Human
cauauucagguaucuuuuagcaacacc

SEQ ID NO: 1311859 - RNA, 22 nt, Human
caucaccacuaaagaaaaccac

SEQ ID NO: 1311860 - RNA, 23 nt, Human
caugacucaauuacuucccacca

SEQ ID NO: 1311861 - RNA, 25 nt, Human
caugcaggucauacugauguaugac

SEQ ID NO: 1311862 - RNA, 18 nt, Human
cauggccuugggagaaaa

SEQ ID NO: 1311863 - RNA, 24 nt, Human
cauguuauccuacccccccucacc

SEQ ID NO: 1311864 - RNA, 25 nt, Human
cauucugccccuggcccuucccaaa

SEQ ID NO: 1311865 - RNA, 18 nt, Human
cauugcggaagucaagga

SEQ ID NO: 1311866 - RNA, 21 nt, Human
cauuugaucccaggaguucaa

SEQ ID NO: 1311867 - RNA, 22 nt, Human
ccaaaaaaaaaaaaaaaaaaaa

SEQ ID NO: 1311868 - RNA, 23 nt, Human
ccaaaaaaaaaaaaaaaaaaaaa

SEQ ID NO: 1311869 - RNA, 21 nt, Human
ccaaaccauaucaaaaggaua

SEQ ID NO: 1311870 - RNA, 20 nt, Human
ccaaaccauaucauucugcc

SEQ ID NO: 1311871 - RNA, 20 nt, Human
ccaaaccauaucauucugcc

SEQ ID NO: 1311872 - RNA, 20 nt, Human
ccaaacugcaaccauaaaua

SEQ ID NO: 1311873 - RNA, 23 nt, Human
ccaaagaagccaccuggaguccc

SEQ ID NO: 1311874 - RNA, 22 nt, Human
ccaacacaagcgcauccagaga

SEQ ID NO: 1311875 - RNA, 26 nt, Human
ccaauaacaacugcagucuggccaag

SEQ ID NO: 1311876 - RNA, 21 nt, Human
ccaccaaaaaaaaccacugca

SEQ ID NO: 1311877 - RNA, 18 nt, Human
ccacccagaaucaaagcc

SEQ ID NO: 1311878 - RNA, 21 nt, Human
ccacuaaagaaaaccaccaaa

SEQ ID NO: 1311879 - RNA, 22 nt, Human
ccacugaaugacucacaggcac

SEQ ID NO: 1311880 - RNA, 18 nt, Human
ccacugcacuccagccug

SEQ ID NO: 1311881 - RNA, 19 nt, Human
ccacugcacuccagccugg

SEQ ID NO: 1311882 - RNA, 19 nt, Human
ccacugcacuccagccugg

SEQ ID NO: 1311883 - RNA, 20 nt, Human
ccacugcacuccagccuggu

SEQ ID NO: 1311884 - RNA, 23 nt, Human
ccacugcacuccagccuggugac

SEQ ID NO: 1311885 - RNA, 20 nt, Human
ccacuguacuccagccuggg

SEQ ID NO: 1311886 - RNA, 20 nt, Human
ccacuguacuccagccuggg

SEQ ID NO: 1311887 - RNA, 21 nt, Human
ccacuguacuccagccugggu

SEQ ID NO: 1311888 - RNA, 21 nt, Human
ccacuguacuccagccugggu

SEQ ID NO: 1311889 - RNA, 23 nt, Human
ccacuguacuccagccuggguga

SEQ ID NO: 1311890 - RNA, 24 nt, Human
ccacuguacuccagccugggugac

SEQ ID NO: 1311891 - RNA, 22 nt, Human
ccauaaauaaugagagaaaaaa

SEQ ID NO: 1311892 - RNA, 20 nt, Human
cccaaaaugaauagcagguu

SEQ ID NO: 1311893 - RNA, 18 nt, Human
cccaaaggagaaaagccc

SEQ ID NO: 1311894 - RNA, 22 nt, Human
cccaugcaagcccaaaauccag

SEQ ID NO: 1311895 - RNA, 22 nt, Human
cccgucucuacuaaaaauacaa

SEQ ID NO: 1311896 - RNA, 24 nt, Human
cccuaguauugacacaccuggucc

SEQ ID NO: 1311897 - RNA, 22 nt, Human
ccuacauugggaagugaaagaa

SEQ ID NO: 1311898 - RNA, 21 nt, Human
ccuaguagaguuucuccauga

SEQ ID NO: 1311899 - RNA, 21 nt, Human
ccuauagucccagcuacucag

SEQ ID NO: 1311900 - RNA, 21 nt, Human
ccuccuggcuccuuucacggg

SEQ ID NO: 1311901 - RNA, 23 nt, Human
ccuccuggcuccuuucacggguu

SEQ ID NO: 1311902 - RNA, 22 nt, Human
ccuggccaacauggugaaaccc

SEQ ID NO: 1311903 - RNA, 23 nt, Human
ccuggccaacauggugaaacccg

SEQ ID NO: 1311904 - RNA, 22 nt, Human
ccugggugacagagugagacuc

SEQ ID NO: 1311905 - RNA, 18 nt, Human
cgaccccacauuucccuu

SEQ ID NO: 1311906 - RNA, 24 nt, Human
cgagagcagccuggccaacauggu

SEQ ID NO: 1311907 - RNA, 24 nt, Human
cgaggcggguagaucacgagguca

SEQ ID NO: 1311908 - RNA, 18 nt, Human
cgccuguaaucccagcac

SEQ ID NO: 1311909 - RNA, 25 nt, Human
cgcugcccauggucccuaguauuga

SEQ ID NO: 1311910 - RNA, 23 nt, Human
cuaaacaaccacagaccaagggc

SEQ ID NO: 1311911 - RNA, 21 nt, Human
cuagagaucagccugccacac

SEQ ID NO: 1311912 - RNA, 25 nt, Human
cuagagaucagccugccacacacac

SEQ ID NO: 1311913 - RNA, 21 nt, Human
cucaaaaguccacaguccaaa

SEQ ID NO: 1311914 - RNA, 18 nt, Human
cucaaagcuccacuaggu

SEQ ID NO: 1311915 - RNA, 20 nt, Human
cucaaggcugaggcaggagg

SEQ ID NO: 1311916 - RNA, 22 nt, Human
cucacgccuguaaucccagcac

SEQ ID NO: 1311917 - RNA, 24 nt, Human
cucacgccuguaaucccagcacuu

SEQ ID NO: 1311918 - RNA, 22 nt, Human
cuccaucaggcuaacagggaau

SEQ ID NO: 1311919 - RNA, 23 nt, Human
cuggugccugaauguaccauccg

SEQ ID NO: 1311920 - RNA, 23 nt, Human
cugugcacccacaggcucaacac

SEQ ID NO: 1311921 - RNA, 18 nt, Human
cuguuccaaccucugccu

SEQ ID NO: 1311922 - RNA, 23 nt, Human
cuucugagcccuccaaacuguuc

SEQ ID NO: 1311923 - RNA, 22 nt, Human
cuuuuaaaaccaucagaucuca

SEQ ID NO: 1311924 - RNA, 23 nt, Human
gaaaaaauauaaauaacauagca

SEQ ID NO: 1311925 - RNA, 23 nt, Human
gaaaaaggagacauuacaagugu

SEQ ID NO: 1311926 - RNA, 19 nt, Human
gaaaaccaccaaacugcaa

SEQ ID NO: 1311927 - RNA, 18 nt, Human
gaaagggauaaauuccca

SEQ ID NO: 1311928 - RNA, 27 nt, Human
gaaaucucuuccaaauuuucccacauu

SEQ ID NO: 1311929 - RNA, 19 nt, Human
gaacaaucauaugcuaaca

SEQ ID NO: 1311930 - RNA, 21 nt, Human
gaacuaggaagaaacagaaaa

SEQ ID NO: 1311931 - RNA, 25 nt, Human
gacagagugagacuccauugcuaaa

SEQ ID NO: 1311932 - RNA, 18 nt, Human
gacucaaggcugaggcag

SEQ ID NO: 1311933 - RNA, 23 nt, Human
gagaauugguugaacacgggagg

SEQ ID NO: 1311934 - RNA, 23 nt, Human
gagacaaaaaaaaugcaaagaau

SEQ ID NO: 1311935 - RNA, 23 nt, Human
gagaugccgaggcggguagauca

SEQ ID NO: 1311936 - RNA, 22 nt, Human
gagcagggaaacuccuccuuuu

SEQ ID NO: 1311937 - RNA, 18 nt, Human
gagcccuccaaacuguuc

SEQ ID NO: 1311938 - RNA, 22 nt, Human
gaucacgaggucaggaguucga

SEQ ID NO: 1311939 - RNA, 24 nt, Human
gaucacgaggucaggaguucgaga

SEQ ID NO: 1311940 - RNA, 21 nt, Human
gcaaacuauaccacuguaccc

SEQ ID NO: 1311941 - RNA, 20 nt, Human
gcaaagcuauccuucacaaa

SEQ ID NO: 1311942 - RNA, 23 nt, Human
gcacuccagccuggugacagagc

SEQ ID NO: 1311943 - RNA, 18 nt, Human
gcaggagaauugguugaa

SEQ ID NO: 1311944 - RNA, 25 nt, Human
gccacacacaccacccaggagccca

SEQ ID NO: 1311945 - RNA, 19 nt, Human
gccacuguacuccagccug

SEQ ID NO: 1311946 - RNA, 24 nt, Human
gccacuguacuccagccuggguga

SEQ ID NO: 1311947 - RNA, 21 nt, Human
gccucaccacagccuccaaua

SEQ ID NO: 1311948 - RNA, 24 nt, Human
gccugccuacccaccaccagaacc

SEQ ID NO: 1311949 - RNA, 19 nt, Human
gccuggcacaguggcucac

SEQ ID NO: 1311950 - RNA, 21 nt, Human
ggaggcagaggauacagugag

SEQ ID NO: 1311951 - RNA, 19 nt, Human
ggaguucuggauggagaug

SEQ ID NO: 1311952 - RNA, 24 nt, Human
ggccaacauggugaaacccgucuc

SEQ ID NO: 1311953 - RNA, 20 nt, Human
ggccuugggagaaaaaaggc

SEQ ID NO: 1311954 - RNA, 21 nt, Human
ggcucacgccuguaaucccag

SEQ ID NO: 1311955 - RNA, 23 nt, Human
gguagaucacgaggucaggaguu

SEQ ID NO: 1311956 - RNA, 21 nt, Human
ggucccucccacaacacaugg

SEQ ID NO: 1311957 - RNA, 24 nt, Human
gguggcucacgccuguaaucccag

SEQ ID NO: 1311958 - RNA, 24 nt, Human
gguugcacgugccuauagucccag

SEQ ID NO: 1311959 - RNA, 23 nt, Human
gguuuaaccccccuccuggcucc

SEQ ID NO: 1311960 - RNA, 18 nt, Human
gguuuaauggacuuacac

SEQ ID NO: 1311961 - RNA, 21 nt, Human
guaaauacaacucaaaauggu

SEQ ID NO: 1311962 - RNA, 24 nt, Human
guacuccagccugggugacagagu

SEQ ID NO: 1311963 - RNA, 20 nt, Human
gugaagggauggaaaaagau

SEQ ID NO: 1311964 - RNA, 24 nt, Human
uaaaaaaauguaagccaaaaauac

SEQ ID NO: 1311965 - RNA, 21 nt, Human
uaaaaaggacaaacaagguca

SEQ ID NO: 1311966 - RNA, 19 nt, Human
uaaaacauaacaggaguca

SEQ ID NO: 1311967 - RNA, 25 nt, Human
uaaacagaaaauggaaacagggacc

SEQ ID NO: 1311968 - RNA, 19 nt, Human
uaaaccacuagugaggcua

SEQ ID NO: 1311969 - RNA, 24 nt, Human
uaaaucucucaaguucaaaauucc

SEQ ID NO: 1311970 - RNA, 23 nt, Human
uaaguucagcauuaacucaaaag

SEQ ID NO: 1311971 - RNA, 24 nt, Human
uaauaaagggaucaauucagcaac

SEQ ID NO: 1311972 - RNA, 22 nt, Human
uaauaacugaaaacuuccugaa

SEQ ID NO: 1311973 - RNA, 24 nt, Human
uaauuuacuguauuaguccauuuu

SEQ ID NO: 1311974 - RNA, 22 nt, Human
uacaaaagaaagaggcuuaaug

SEQ ID NO: 1311975 - RNA, 19 nt, Human
uacaaucagaaaugaaaaa

SEQ ID NO: 1311976 - RNA, 24 nt, Human
uacaggacccaugcaagcccaaag

SEQ ID NO: 1311977 - RNA, 19 nt, Human
uacaucagauaaaacagac

SEQ ID NO: 1311978 - RNA, 23 nt, Human
uacccaccaccagaaccuguaua

SEQ ID NO: 1311979 - RNA, 19 nt, Human
uacccacccagaaucaaag

SEQ ID NO: 1311980 - RNA, 25 nt, Human
uacccuaaaucucucaaguucaaaa

SEQ ID NO: 1311981 - RNA, 20 nt, Human
uaccugaaaaaaauucagaa

SEQ ID NO: 1311982 - RNA, 22 nt, Human
uacuccagccugggugacagag

SEQ ID NO: 1311983 - RNA, 24 nt, Human
uacuccagccugggugacagagug

SEQ ID NO: 1311984 - RNA, 23 nt, Human
uacuucccaccaggucccuccca

SEQ ID NO: 1311985 - RNA, 22 nt, Human
uagaucacgaggucaggaguuc

SEQ ID NO: 1311986 - RNA, 21 nt, Human
uagcaacaccccacuucuggu

SEQ ID NO: 1311987 - RNA, 25 nt, Human
uagcaacaccccacuucugguacua

SEQ ID NO: 1311988 - RNA, 19 nt, Human
uagcagaaccaaaugcaac

SEQ ID NO: 1311989 - RNA, 24 nt, Human
uagcagguuugaaucaguaacaaa

SEQ ID NO: 1311990 - RNA, 22 nt, Human
uaguccauuuucacacagcuga

SEQ ID NO: 1311991 - RNA, 21 nt, Human
uauaaagaaaaacaaacacca

SEQ ID NO: 1311992 - RNA, 20 nt, Human
uauaacaaucagcauuuugg

SEQ ID NO: 1311993 - RNA, 18 nt, Human
uauccaaugaacacugua

SEQ ID NO: 1311994 - RNA, 22 nt, Human
uauccuucacaaaugaaggagc

SEQ ID NO: 1311995 - RNA, 24 nt, Human
uaugaaauaccugaaaaaaauuca

SEQ ID NO: 1311996 - RNA, 20 nt, Human
uauuaaagaaacucagggag

SEQ ID NO: 1311997 - RNA, 20 nt, Human
ucaaagauagagcuucugca

SEQ ID NO: 1311998 - RNA, 20 nt, Human
ucaaagauagagcuucugcu

SEQ ID NO: 1311999 - RNA, 21 nt, Human
ucaacaaccaccaaaaaaaac

SEQ ID NO: 1312000 - RNA, 19 nt, Human
ucacaggcaccacccaugc

SEQ ID NO: 1312001 - RNA, 18 nt, Human
ucacgaggucaggaguuc

SEQ ID NO: 1312002 - RNA, 24 nt, Human
ucacgaggucaggaguucgagagc

SEQ ID NO: 1312003 - RNA, 21 nt, Human
ucagacaaaaagaaagaaaaa

SEQ ID NO: 1312004 - RNA, 20 nt, Human
ucagcagaaaccuuacuggc

SEQ ID NO: 1312005 - RNA, 23 nt, Human
ucaguaacaaaaugucucccaaa

SEQ ID NO: 1312006 - RNA, 19 nt, Human
ucagugcccacaaacgcug

SEQ ID NO: 1312007 - RNA, 19 nt, Human
ucauaugcuaacaaauugg

SEQ ID NO: 1312008 - RNA, 23 nt, Human
ucaugccacuguacuccagccug

SEQ ID NO: 1312009 - RNA, 21 nt, Human
uccacaguccaaagucucauu

SEQ ID NO: 1312010 - RNA, 21 nt, Human
uccacauagcugaggaagcug

SEQ ID NO: 1312011 - RNA, 22 nt, Human
uccagagacucaaggcugaggc

SEQ ID NO: 1312012 - RNA, 23 nt, Human
uccagccugggugacagagugag

SEQ ID NO: 1312013 - RNA, 24 nt, Human
uccagccugggugacagagugaga

SEQ ID NO: 1312014 - RNA, 23 nt, Human
uccagucagacaaaaagaaagaa

SEQ ID NO: 1312015 - RNA, 22 nt, Human
uccauucugacuguucuacuga

SEQ ID NO: 1312016 - RNA, 22 nt, Human
ucccacauuuuccugucuccuu

SEQ ID NO: 1312017 - RNA, 18 nt, Human
ucccaccaggucccuccc

SEQ ID NO: 1312018 - RNA, 19 nt, Human
ucccagacauacacagccu

SEQ ID NO: 1312019 - RNA, 21 nt, Human
ucccagacauacacagccuac

SEQ ID NO: 1312020 - RNA, 20 nt, Human
ucccagcacuuugagaugcc

SEQ ID NO: 1312021 - RNA, 18 nt, Human
ucccaggaguucaaggcu

SEQ ID NO: 1312022 - RNA, 18 nt, Human
ucccauauaaaagccaau

SEQ ID NO: 1312023 - RNA, 19 nt, Human
uccuguggcuuuguauggu

SEQ ID NO: 1312024 - RNA, 22 nt, Human
ucgagagcagccuggccaacau

SEQ ID NO: 1312025 - RNA, 23 nt, Human
ucgagagcagccuggccaacaug

SEQ ID NO: 1312026 - RNA, 23 nt, Human
ucuaagccacugaaugacucaca

SEQ ID NO: 1312027 - RNA, 18 nt, Human
ucucaaacuauucccaaa

SEQ ID NO: 1312028 - RNA, 19 nt, Human
ucucaaguucaaauacccu

SEQ ID NO: 1312029 - RNA, 22 nt, Human
ucucuacuaaaaauacaaaauu

SEQ ID NO: 1312030 - RNA, 24 nt, Human
ucugccccuggcccuucccaaauc

SEQ ID NO: 1312031 - RNA, 18 nt, Human
ucuggccaaguguggugg

SEQ ID NO: 1312032 - RNA, 24 nt, Human
ucuggccaagugugguggcucacg

SEQ ID NO: 1312033 - RNA, 21 nt, Human
ucugggaguucuggauggaga

SEQ ID NO: 1312034 - RNA, 25 nt, Human
ucuuuuagcaacaccccacuucugg

SEQ ID NO: 1312035 - RNA, 22 nt, Human
ugaaaccaaucaugccuuccca

SEQ ID NO: 1312036 - RNA, 22 nt, Human
ugaacuaauaacugaaaacuuc

SEQ ID NO: 1312037 - RNA, 23 nt, Human
ugaauagcagguuugaaucagua

SEQ ID NO: 1312038 - RNA, 19 nt, Human
ugaauguaccauccgggga

SEQ ID NO: 1312039 - RNA, 20 nt, Human
ugaccaaaaacugaaauucu

SEQ ID NO: 1312040 - RNA, 20 nt, Human
ugacccaaaaugaauagcag

SEQ ID NO: 1312041 - RNA, 18 nt, Human
ugacuccaugucugacau

SEQ ID NO: 1312042 - RNA, 18 nt, Human
ugagacuuggguggggac

SEQ ID NO: 1312043 - RNA, 24 nt, Human
ugagaggccugaggaaacgccugc

SEQ ID NO: 1312044 - RNA, 24 nt, Human
ugagauugugccacugcacuccag

SEQ ID NO: 1312045 - RNA, 19 nt, Human
ugagcaauuuacaaaagaa

SEQ ID NO: 1312046 - RNA, 22 nt, Human
ugagcugagauugugccacugc

SEQ ID NO: 1312047 - RNA, 21 nt, Human
ugaggaagccuaagaaucacg

SEQ ID NO: 1312048 - RNA, 20 nt, Human
ugaggcaggaggaccauuug

SEQ ID NO: 1312049 - RNA, 24 nt, Human
ugcaagaaauaugaaaaaggaaac

SEQ ID NO: 1312050 - RNA, 24 nt, Human
ugccuauagucccagcuacucagg

SEQ ID NO: 1312051 - RNA, 20 nt, Human
uggaaacuguacaaauauau

SEQ ID NO: 1312052 - RNA, 19 nt, Human
uggcagcaggcaaagagag

SEQ ID NO: 1312053 - RNA, 23 nt, Human
uggccaacauggugaaacccguc

SEQ ID NO: 1312054 - RNA, 22 nt, Human
uggcucacaucugcaauuccag

SEQ ID NO: 1312055 - RNA, 22 nt, Human
uggcucacgccuguaaucccag

SEQ ID NO: 1312056 - RNA, 24 nt, Human
uggcucacgccuguaaucccagca

SEQ ID NO: 1312057 - RNA, 18 nt, Human
ugggaaagaccugccccc

SEQ ID NO: 1312058 - RNA, 22 nt, Human
ugggacacauaugugaccaaaa

SEQ ID NO: 1312059 - RNA, 23 nt, Human
ugggaguucuggauggagaugag

SEQ ID NO: 1312060 - RNA, 18 nt, Human
uggguggggacaaaacca

SEQ ID NO: 1312061 - RNA, 24 nt, Human
ugguggcucacgccuguaauccca

SEQ ID NO: 1312062 - RNA, 24 nt, Human
ugguuuaaccccccuccuggcucc

SEQ ID NO: 1312063 - RNA, 24 nt, Human
ugucuccuucugagcccuccaaac

SEQ ID NO: 1312064 - RNA, 18 nt, Human
ugugcacccacaggcuca

SEQ ID NO: 1312065 - RNA, 18 nt, Human
ugugccaguuccuaacaa

SEQ ID NO: 1312066 - RNA, 23 nt, Human
uguuaccaaagaaauaaaaagga

SEQ ID NO: 1312067 - RNA, 21 nt, Human
uuaccaaagaaauaaaaagga

SEQ ID NO: 1312068 - RNA, 18 nt, Human
uuacuggaauaaaaccag

SEQ ID NO: 1312069 - RNA, 18 nt, Human
uuagcugggcaugguugc

SEQ ID NO: 1312070 - RNA, 21 nt, Human
uuagcugggcaugguugcacg

SEQ ID NO: 1312071 - RNA, 19 nt, Human
uuauagcaauaaaugccua

SEQ ID NO: 1312072 - RNA, 18 nt, Human
uucaaaaccaucagaccu

SEQ ID NO: 1312073 - RNA, 22 nt, Human
uuccaggcacacagugcaagcu

SEQ ID NO: 1312074 - RNA, 19 nt, Human
uucccagauaagcaaaaga

SEQ ID NO: 1312075 - RNA, 24 nt, Human
uucccauauaaaagccaauccaua

SEQ ID NO: 1312076 - RNA, 22 nt, Human
uuccucauuuccaucugagaca

SEQ ID NO: 1312077 - RNA, 24 nt, Human
uuccugaaugcuuccaaaugcagg

SEQ ID NO: 1312078 - RNA, 23 nt, Human
uucuccagcaacagauccaauga

SEQ ID NO: 1312079 - RNA, 22 nt, Human
uucuucucaaacuauucccaaa

SEQ ID NO: 1312080 - RNA, 22 nt, Human
uuuaugcugauuucuacccaau

SEQ ID NO: 1312081 - RNA, 21 nt, Human
uuucagaauauuucauccagc

SEQ ID NO: 1312082 - RNA, 23 nt, Human
uuucccaguuccaaagucacuuc

SEQ ID NO: 1312083 - RNA, 20 nt, Human
uuuccugucuccuucugagc

SEQ ID NO: 1312084 - RNA, 19 nt, Human
uuuuuugaaaaguuaaaca

SEQ ID NO: 1312085 - RNA, 24 nt, Human
aagcaagugaccacgaaggccagg

SEQ ID NO: 1312086 - RNA, 23 nt, Human
aagugaccacgaaggccagguug

SEQ ID NO: 1312087 - RNA, 19 nt, Human
agagccgggugucaguggc

SEQ ID NO: 1312088 - RNA, 19 nt, Human
agcaagugaccacgaaggc

SEQ ID NO: 1312089 - RNA, 18 nt, Human
aggccagguuggcaagga

SEQ ID NO: 1312090 - RNA, 18 nt, Human
auggugguggaggugaag

SEQ ID NO: 1312091 - RNA, 23 nt, Human
caaggaaaaagcgcacgagcaca

SEQ ID NO: 1312092 - RNA, 24 nt, Human
ugaagcaagugaccacgaaggcca

SEQ ID NO: 1312093 - RNA, 20 nt, Human
aaauucuccuuuuucuuuuc

SEQ ID NO: 1312094 - RNA, 20 nt, Human
accacagcugccucccacca

SEQ ID NO: 1312095 - RNA, 18 nt, Human
agacagcagcaggaacuc

SEQ ID NO: 1312096 - RNA, 20 nt, Human
caccacagcugccucccacc

SEQ ID NO: 1312097 - RNA, 19 nt, Human
cagcuccugcaccacagcu

SEQ ID NO: 1312098 - RNA, 26 nt, Human
ccaaagguaauccucucagugcaagc

SEQ ID NO: 1312099 - RNA, 18 nt, Human
ccucccaccacuuccaga

SEQ ID NO: 1312100 - RNA, 25 nt, Human
ccucccaccacuuccagaccaccaa

SEQ ID NO: 1312101 - RNA, 24 nt, Human
cucaauguggauucuguuugaaga

SEQ ID NO: 1312102 - RNA, 18 nt, Human
cugccucccaccacuucc

SEQ ID NO: 1312103 - RNA, 23 nt, Human
cugccucccaccacuuccagacc

SEQ ID NO: 1312104 - RNA, 20 nt, Human
uggcaacaccauuccaaggg

SEQ ID NO: 1312105 - RNA, 19 nt, Human
acccacacccccaccuacc

SEQ ID NO: 1312106 - RNA, 18 nt, Human
acccagcaccagggagcc

SEQ ID NO: 1312107 - RNA, 22 nt, Human
accucccuucaccuccucaaga

SEQ ID NO: 1312108 - RNA, 19 nt, Human
agaggaagaaaaauuagag

SEQ ID NO: 1312109 - RNA, 20 nt, Human
agaggaagaaaaauuagagg

SEQ ID NO: 1312110 - RNA, 18 nt, Human
agcaaggugucugggguc

SEQ ID NO: 1312111 - RNA, 18 nt, Human
aggccagaaacccagcac

SEQ ID NO: 1312112 - RNA, 25 nt, Human
caccaaaggccagaaacccagcacc

SEQ ID NO: 1312113 - RNA, 19 nt, Human
cacccauguauagcagagc

SEQ ID NO: 1312114 - RNA, 23 nt, Human
cagcaccagggagccacaggaga

SEQ ID NO: 1312115 - RNA, 21 nt, Human
ccaaaagagaggccucaagga

SEQ ID NO: 1312116 - RNA, 21 nt, Human
cccaaaagagaggccucaagg

SEQ ID NO: 1312117 - RNA, 22 nt, Human
cccacacccccaccuaccuccc

SEQ ID NO: 1312118 - RNA, 21 nt, Human
cccaccuaccucccuucaccu

SEQ ID NO: 1312119 - RNA, 20 nt, Human
ccccaccuaccucccuucac

SEQ ID NO: 1312120 - RNA, 27 nt, Human
ccccaccuaccucccuucaccuccuca

SEQ ID NO: 1312121 - RNA, 22 nt, Human
cccgcgggcagccagaacugga

SEQ ID NO: 1312122 - RNA, 22 nt, Human
cccucaucacccacacccccac

SEQ ID NO: 1312123 - RNA, 21 nt, Human
cccuucaccuccucaagauca

SEQ ID NO: 1312124 - RNA, 21 nt, Human
ccuaccucccuucaccuccuc

SEQ ID NO: 1312125 - RNA, 24 nt, Human
ccuccacucccacccauguauagc

SEQ ID NO: 1312126 - RNA, 19 nt, Human
ccuugcucugugaggccug

SEQ ID NO: 1312127 - RNA, 18 nt, Human
cucacaguuccagguggg

SEQ ID NO: 1312128 - RNA, 23 nt, Human
cucacaguuccaggugggguggc

SEQ ID NO: 1312129 - RNA, 21 nt, Human
cucaucacccacacccccacc

SEQ ID NO: 1312130 - RNA, 23 nt, Human
cucaucacccacacccccaccua

SEQ ID NO: 1312131 - RNA, 18 nt, Human
gccuccacucccacccau

SEQ ID NO: 1312132 - RNA, 21 nt, Human
gggaugccuugcucugugagg

SEQ ID NO: 1312133 - RNA, 18 nt, Human
gggcagccagaacuggag

SEQ ID NO: 1312134 - RNA, 21 nt, Human
guccuguaguguccucucuca

SEQ ID NO: 1312135 - RNA, 24 nt, Human
uaggaugucaccaaaggccagaaa

SEQ ID NO: 1312136 - RNA, 19 nt, Human
uccccaaaagagaggccuc

SEQ ID NO: 1312137 - RNA, 22 nt, Human
ugccuugcucugugaggccugg

SEQ ID NO: 1312138 - RNA, 18 nt, Human
uggaaagaggcccgcggg

SEQ ID NO: 1312139 - RNA, 19 nt, Human
uggaaagaggcccgcgggc

SEQ ID NO: 1312140 - RNA, 18 nt, Human
uggcggccuccacuccca

SEQ ID NO: 1312141 - RNA, 23 nt, Human
uggcugguuggaaagaggcccgc

SEQ ID NO: 1312142 - RNA, 23 nt, Human
ugggagagggagcaaggugucug

SEQ ID NO: 1312143 - RNA, 18 nt, Human
ugucuggggucccugcuu

SEQ ID NO: 1312144 - RNA, 18 nt, Human
uugggguuuggccucccu

SEQ ID NO: 1312145 - RNA, 20 nt, Human
aaacacacacaaccccagug

SEQ ID NO: 1312146 - RNA, 22 nt, Human
aaacacacacaaccccagugug

SEQ ID NO: 1312147 - RNA, 21 nt, Human
aaacaggaucugugugaugug

SEQ ID NO: 1312148 - RNA, 24 nt, Human
aaacugaguacaaggacgaucuua

SEQ ID NO: 1312149 - RNA, 21 nt, Human
aaaggaaacacacacaacccc

SEQ ID NO: 1312150 - RNA, 24 nt, Human
aaauacaagaggcugcuaggagcc

SEQ ID NO: 1312151 - RNA, 24 nt, Human
aacauaugugguuugauccucagc

SEQ ID NO: 1312152 - RNA, 22 nt, Human
aaggaaacacacacaaccccag

SEQ ID NO: 1312153 - RNA, 23 nt, Human
acaggacaaccccaaauuccaca

SEQ ID NO: 1312154 - RNA, 25 nt, Human
accccugagacguccguaagguagg

SEQ ID NO: 1312155 - RNA, 20 nt, Human
acugaguacaaggacgaucu

SEQ ID NO: 1312156 - RNA, 24 nt, Human
agaagccuaaacugaguacaagga

SEQ ID NO: 1312157 - RNA, 23 nt, Human
agaggcaggcugugucugguucc

SEQ ID NO: 1312158 - RNA, 21 nt, Human
agcagaagaugcaagggugug

SEQ ID NO: 1312159 - RNA, 22 nt, Human
agccuaaacugaguacaaggac

SEQ ID NO: 1312160 - RNA, 21 nt, Human
aggacaaccccaaauuccaca

SEQ ID NO: 1312161 - RNA, 24 nt, Human
agggccugcaggggacagcauagg

SEQ ID NO: 1312162 - RNA, 23 nt, Human
aggggacagcauaggcccaaagc

SEQ ID NO: 1312163 - RNA, 24 nt, Human
agguaggaaugccaaacaggaucu

SEQ ID NO: 1312164 - RNA, 20 nt, Human
caaacaggaucugugugaug

SEQ ID NO: 1312165 - RNA, 25 nt, Human
caaugggcuuuaccucuggauaaac

SEQ ID NO: 1312166 - RNA, 19 nt, Human
caccuggaagggggguuuu

SEQ ID NO: 1312167 - RNA, 20 nt, Human
cagaagaugcaagggugugu

SEQ ID NO: 1312168 - RNA, 20 nt, Human
cagcuggcuggccucagagc

SEQ ID NO: 1312169 - RNA, 25 nt, Human
caggaucugugugaugugucaacuc

SEQ ID NO: 1312170 - RNA, 22 nt, Human
ccaaagcuagaggaagcuugga

SEQ ID NO: 1312171 - RNA, 19 nt, Human
cccaaagcuagaggaagcc

SEQ ID NO: 1312172 - RNA, 20 nt, Human
cccccagcugaggauugaga

SEQ ID NO: 1312173 - RNA, 23 nt, Human
cccccagcugaggauugagaggc

SEQ ID NO: 1312174 - RNA, 19 nt, Human
ccucuggauaaacuuagaa

SEQ ID NO: 1312175 - RNA, 19 nt, Human
ccugucaccccugagacgu

SEQ ID NO: 1312176 - RNA, 18 nt, Human
cgaaaagcagucuguagc

SEQ ID NO: 1312177 - RNA, 24 nt, Human
cgcuggguccugcggggcucugca

SEQ ID NO: 1312178 - RNA, 18 nt, Human
cguuuuucucuucugccu

SEQ ID NO: 1312179 - RNA, 21 nt, Human
cuacaagaucccagcccucca

SEQ ID NO: 1312180 - RNA, 22 nt, Human
cuuagaaacuuuccauccaaac

SEQ ID NO: 1312181 - RNA, 24 nt, Human
cuucguuuuucucuucugccuuca

SEQ ID NO: 1312182 - RNA, 18 nt, Human
gaacccucgaugcugcuc

SEQ ID NO: 1312183 - RNA, 23 nt, Human
gaugcugcuccauacugggggca

SEQ ID NO: 1312184 - RNA, 21 nt, Human
gcaggcugugucugguuccau

SEQ ID NO: 1312185 - RNA, 23 nt, Human
gcccccagcugaggauugagagg

SEQ ID NO: 1312186 - RNA, 21 nt, Human
gcccuacaagaucccagcccu

SEQ ID NO: 1312187 - RNA, 19 nt, Human
gccuaaacugaguacaagg

SEQ ID NO: 1312188 - RNA, 19 nt, Human
ggacaaccccaaauuccac

SEQ ID NO: 1312189 - RNA, 19 nt, Human
ggacagcauaggcccaaag

SEQ ID NO: 1312190 - RNA, 18 nt, Human
ggccagguggcugaggag

SEQ ID NO: 1312191 - RNA, 18 nt, Human
gggcucagaaaggagcaa

SEQ ID NO: 1312192 - RNA, 18 nt, Human
gggguuuugggaaacggg

SEQ ID NO: 1312193 - RNA, 22 nt, Human
uaccaaaggaaacacacacaac

SEQ ID NO: 1312194 - RNA, 25 nt, Human
uacugcaggccaccauggcgcuagc

SEQ ID NO: 1312195 - RNA, 22 nt, Human
uagcagcgucugcuauggcaac

SEQ ID NO: 1312196 - RNA, 21 nt, Human
uaggagcccccagcugaggau

SEQ ID NO: 1312197 - RNA, 18 nt, Human
uaggcccaaagcuagagg

SEQ ID NO: 1312198 - RNA, 21 nt, Human
uagguggcuguuccguuaccc

SEQ ID NO: 1312199 - RNA, 21 nt, Human
uauguugccaagaagccuaaa

SEQ ID NO: 1312200 - RNA, 19 nt, Human
uccaacacggacaccugga

SEQ ID NO: 1312201 - RNA, 22 nt, Human
uccagaauauaccaaaggaaac

SEQ ID NO: 1312202 - RNA, 21 nt, Human
uccaggagaagacagcuggcu

SEQ ID NO: 1312203 - RNA, 23 nt, Human
uccguuacccaggcuaugcuguc

SEQ ID NO: 1312204 - RNA, 22 nt, Human
uccucagccaggacgcacaggc

SEQ ID NO: 1312205 - RNA, 20 nt, Human
ucguuuuucucuucugccuu

SEQ ID NO: 1312206 - RNA, 18 nt, Human
ucucauccaggagaagac

SEQ ID NO: 1312207 - RNA, 22 nt, Human
ucugcauacugcaggccaccau

SEQ ID NO: 1312208 - RNA, 23 nt, Human
ucugcuauggcaacacccauuag

SEQ ID NO: 1312209 - RNA, 19 nt, Human
ucuguauguugccaagaag

SEQ ID NO: 1312210 - RNA, 19 nt, Human
ugacugcagccuugucugu

SEQ ID NO: 1312211 - RNA, 22 nt, Human
ugcuaggagcccccagcugagg

SEQ ID NO: 1312212 - RNA, 19 nt, Human
ugcugucucaguggccagg

SEQ ID NO: 1312213 - RNA, 27 nt, Human
uggacccucccauuugacugcagccuu

SEQ ID NO: 1312214 - RNA, 19 nt, Human
uggccagguggcugaggag

SEQ ID NO: 1312215 - RNA, 21 nt, Human
ugguuugauccucagccagga

SEQ ID NO: 1312216 - RNA, 20 nt, Human
ugugaugugucaacucugag

SEQ ID NO: 1312217 - RNA, 23 nt, Human
uuagaaacuuuccauccaaacga

SEQ ID NO: 1312218 - RNA, 24 nt, Human
aaaccccaagguggacacugcccc

SEQ ID NO: 1312219 - RNA, 19 nt, Human
aacaaaccccaagguggac

SEQ ID NO: 1312220 - RNA, 23 nt, Human
acugccccggcgccccuuccccc

SEQ ID NO: 1312221 - RNA, 27 nt, Human
caaaccccaagguggacacugccccgg

SEQ ID NO: 1312222 - RNA, 21 nt, Human
caacaaaccccaagguggaca

SEQ ID NO: 1312223 - RNA, 22 nt, Human
caacaaaccccaagguggacac

SEQ ID NO: 1312224 - RNA, 22 nt, Human
caaccggauuguagaccugcca

SEQ ID NO: 1312225 - RNA, 18 nt, Human
caagguggacacugcccc

SEQ ID NO: 1312226 - RNA, 24 nt, Human
cacccugaaucacccacugcgagc

SEQ ID NO: 1312227 - RNA, 22 nt, Human
caccggagcgcagugucucggg

SEQ ID NO: 1312228 - RNA, 18 nt, Human
caccucccccaacagggc

SEQ ID NO: 1312229 - RNA, 23 nt, Human
caccucccccaacagggccuuuc

SEQ ID NO: 1312230 - RNA, 20 nt, Human
cagcuccgggcccaccuccc

SEQ ID NO: 1312231 - RNA, 22 nt, Human
cagcuccgggcccaccuccccc

SEQ ID NO: 1312232 - RNA, 21 nt, Human
ccagcuccgggcccaccuccc

SEQ ID NO: 1312233 - RNA, 19 nt, Human
cccaagguggacacugccc

SEQ ID NO: 1312234 - RNA, 18 nt, Human
cccacugcgagcccuucc

SEQ ID NO: 1312235 - RNA, 18 nt, Human
cccagagccaacaaaccc

SEQ ID NO: 1312236 - RNA, 19 nt, Human
ccccuuccccccggacccc

SEQ ID NO: 1312237 - RNA, 24 nt, Human
cccugaaucacccacugcgagccc

SEQ ID NO: 1312238 - RNA, 20 nt, Human
ccugaaucacccacugcgag

SEQ ID NO: 1312239 - RNA, 20 nt, Human
cggcggcccacugccugccc

SEQ ID NO: 1312240 - RNA, 19 nt, Human
cugcccagagccaacaaac

SEQ ID NO: 1312241 - RNA, 21 nt, Human
cugcccagagccaacaaaccc

SEQ ID NO: 1312242 - RNA, 25 nt, Human
gaccugccagcuccgggcccaccuc

SEQ ID NO: 1312243 - RNA, 22 nt, Human
gcccagagccaacaaaccccaa

SEQ ID NO: 1312244 - RNA, 26 nt, Human
gccccggcgccccuuccccccggacc

SEQ ID NO: 1312245 - RNA, 20 nt, Human
gccccuuccccccggacccc

SEQ ID NO: 1312246 - RNA, 24 nt, Human
gccccuuccccccggaccccgcag

SEQ ID NO: 1312247 - RNA, 20 nt, Human
ggcguccgcucgccggccuc

SEQ ID NO: 1312248 - RNA, 23 nt, Human
ucccgcucggcggcccacugccu

SEQ ID NO: 1312249 - RNA, 21 nt, Human
ugaaucacccacugcgagccc

SEQ ID NO: 1312250 - RNA, 24 nt, Human
ugccccggcgccccuuccccccgg

SEQ ID NO: 1312251 - RNA, 23 nt, Human
uggacacugccccggcgccccuu

SEQ ID NO: 1312252 - RNA, 19 nt, Human
uguaaaucugauaauauug

SEQ ID NO: 1312253 - RNA, 33 nt, Human
aaaaaaaaaaaaaaaauugcuuggcaaaaagga

SEQ ID NO: 1312254 - RNA, 19 nt, Human
aacauggugaaaccccguc

SEQ ID NO: 1312255 - RNA, 20 nt, Human
aacauggugaaaccccgucu

SEQ ID NO: 1312256 - RNA, 21 nt, Human
aacauggugaaaccccgucuc

SEQ ID NO: 1312257 - RNA, 24 nt, Human
acagagcgacgcuccgucucaaaa

SEQ ID NO: 1312258 - RNA, 24 nt, Human
accccgucucuacuaaaaauacaa

SEQ ID NO: 1312259 - RNA, 24 nt, Human
accugaggucaggaguucgagacc

SEQ ID NO: 1312260 - RNA, 24 nt, Human
acucaggaggcggagguugcagug

SEQ ID NO: 1312261 - RNA, 19 nt, Human
agaauaaaguccagauucc

SEQ ID NO: 1312262 - RNA, 21 nt, Human
agagucauguugugaaaugcc

SEQ ID NO: 1312263 - RNA, 21 nt, Human
agccgcaggcugcacagccuc

SEQ ID NO: 1312264 - RNA, 22 nt, Human
agccuggccaacauggugaaac

SEQ ID NO: 1312265 - RNA, 24 nt, Human
agccuggccaacauggugaaaccc

SEQ ID NO: 1312266 - RNA, 21 nt, Human
aggcaggagaaucgcuugaac

SEQ ID NO: 1312267 - RNA, 23 nt, Human
aggcaggagaaucgcuugaacuc

SEQ ID NO: 1312268 - RNA, 25 nt, Human
aggccggacccaaccagucagggaa

SEQ ID NO: 1312269 - RNA, 19 nt, Human
aggccucggaggccggacc

SEQ ID NO: 1312270 - RNA, 22 nt, Human
aggccucggaggccggacccaa

SEQ ID NO: 1312271 - RNA, 21 nt, Human
aggcggagguugcagugagcc

SEQ ID NO: 1312272 - RNA, 24 nt, Human
aggcggagguugcagugagccgag

SEQ ID NO: 1312273 - RNA, 20 nt, Human
aggcugaggcaggagaaucg

SEQ ID NO: 1312274 - RNA, 24 nt, Human
aggcugaggcaggagaaucgcuug

SEQ ID NO: 1312275 - RNA, 23 nt, Human
aucucuuaguccaccuuuuaaaa

SEQ ID NO: 1312276 - RNA, 24 nt, Human
auuccacuccagccagggcgacag

SEQ ID NO: 1312277 - RNA, 24 nt, Human
caacauggugaaaccccgucucua

SEQ ID NO: 1312278 - RNA, 18 nt, Human
caccugaggucaggaguu

SEQ ID NO: 1312279 - RNA, 19 nt, Human
caccugaggucaggaguuc

SEQ ID NO: 1312280 - RNA, 21 nt, Human
caccugaggucaggaguucga

SEQ ID NO: 1312281 - RNA, 21 nt, Human
caccugaggucaggaguucga

SEQ ID NO: 1312282 - RNA, 23 nt, Human
caccugaggucaggaguucgaga

SEQ ID NO: 1312283 - RNA, 23 nt, Human
cacuccagccagggcgacagagc

SEQ ID NO: 1312284 - RNA, 21 nt, Human
cacuuaaaacucccuccaaaa

SEQ ID NO: 1312285 - RNA, 20 nt, Human
cagccagggcgacagagcga

SEQ ID NO: 1312286 - RNA, 19 nt, Human
cagggguucuccaaggccc

SEQ ID NO: 1312287 - RNA, 18 nt, Human
cauuccacuccagccagg

SEQ ID NO: 1312288 - RNA, 22 nt, Human
cauuccacuccagccagggcga

SEQ ID NO: 1312289 - RNA, 23 nt, Human
cauuccacuccagccagggcgac

SEQ ID NO: 1312290 - RNA, 24 nt, Human
cauuccacuccagccagggcgaca

SEQ ID NO: 1312291 - RNA, 21 nt, Human
ccacaugcuucauuuccaaaa

SEQ ID NO: 1312292 - RNA, 22 nt, Human
ccugaggucaggaguucgagac

SEQ ID NO: 1312293 - RNA, 23 nt, Human
ccuggccaacauggugaaacccc

SEQ ID NO: 1312294 - RNA, 24 nt, Human
ccuggccaacauggugaaaccccg

SEQ ID NO: 1312295 - RNA, 22 nt, Human
ccuguaaucccagcuacuaggg

SEQ ID NO: 1312296 - RNA, 23 nt, Human
cgacgcuccgucucaaaaaaaaa

SEQ ID NO: 1312297 - RNA, 24 nt, Human
cgagaccagccuggccaacauggu

SEQ ID NO: 1312298 - RNA, 23 nt, Human
cgccuguaaucccagcuacuagg

SEQ ID NO: 1312299 - RNA, 24 nt, Human
cgcuccacaugcuucauuuccaaa

SEQ ID NO: 1312300 - RNA, 21 nt, Human
cggaaaaggcgggguacaggc

SEQ ID NO: 1312301 - RNA, 24 nt, Human
cggcggcccuggggcucggucucu

SEQ ID NO: 1312302 - RNA, 18 nt, Human
cucaaaaaaaaaaaaaaa

SEQ ID NO: 1312303 - RNA, 22 nt, Human
cucacaaccgcccagagggcac

SEQ ID NO: 1312304 - RNA, 25 nt, Human
cucagcaaaacuccgcgggagaccc

SEQ ID NO: 1312305 - RNA, 19 nt, Human
cuccgucucaaaaaaaaaa

SEQ ID NO: 1312306 - RNA, 18 nt, Human
cuggggcucggucucuuc

SEQ ID NO: 1312307 - RNA, 24 nt, Human
gacagagcgacgcuccgucucaaa

SEQ ID NO: 1312308 - RNA, 23 nt, Human
gagaaucgcuugaacucaggagg

SEQ ID NO: 1312309 - RNA, 22 nt, Human
gagguugcagugagccgagauc

SEQ ID NO: 1312310 - RNA, 23 nt, Human
gcagggguucuccaaggcccuca

SEQ ID NO: 1312311 - RNA, 24 nt, Human
gccaacauggugaaaccccgucuc

SEQ ID NO: 1312312 - RNA, 22 nt, Human
ggaggcggagguugcagugagc

SEQ ID NO: 1312313 - RNA, 18 nt, Human
ggagguugcagugagccg

SEQ ID NO: 1312314 - RNA, 20 nt, Human
ggagguugcagugagccgag

SEQ ID NO: 1312315 - RNA, 22 nt, Human
ggagguugcagugagccgagau

SEQ ID NO: 1312316 - RNA, 23 nt, Human
ggagguugcagugagccgagauc

SEQ ID NO: 1312317 - RNA, 24 nt, Human
ggagguugcagugagccgagauca

SEQ ID NO: 1312318 - RNA, 21 nt, Human
ggcgcgcgccuguaaucccag

SEQ ID NO: 1312319 - RNA, 22 nt, Human
gggaggcugaggcaggagaauc

SEQ ID NO: 1312320 - RNA, 24 nt, Human
gguggcgcgcgccuguaaucccag

SEQ ID NO: 1312321 - RNA, 19 nt, Human
guugcagugagccgagauc

SEQ ID NO: 1312322 - RNA, 18 nt, Human
uacuagggaggcugaggc

SEQ ID NO: 1312323 - RNA, 19 nt, Human
uacuagggaggcugaggca

SEQ ID NO: 1312324 - RNA, 20 nt, Human
uaguccaccuuuuaaaaaac

SEQ ID NO: 1312325 - RNA, 20 nt, Human
ucagaauaaaguccagauuu

SEQ ID NO: 1312326 - RNA, 22 nt, Human
ucaggaggcggagguugcagug

SEQ ID NO: 1312327 - RNA, 18 nt, Human
ucccuccaaaagugaagg

SEQ ID NO: 1312328 - RNA, 23 nt, Human
uccgucucaaaaaaaaaaaaaaa

SEQ ID NO: 1312329 - RNA, 25 nt, Human
uccgucucaaaaaaaaaaaaaaaaa

SEQ ID NO: 1312330 - RNA, 24 nt, Human
ucgcuugaacucaggaggcggagg

SEQ ID NO: 1312331 - RNA, 20 nt, Human
ucggaggccggacccaaccg

SEQ ID NO: 1312332 - RNA, 22 nt, Human
ucucuacuaaaaauacaaaaaa

SEQ ID NO: 1312333 - RNA, 20 nt, Human
ugaggcaggagaaucgcuug

SEQ ID NO: 1312334 - RNA, 23 nt, Human
ugaggcaggagaaucgcuugaac

SEQ ID NO: 1312335 - RNA, 23 nt, Human
ugaggcaggagaaucgcuugaac

SEQ ID NO: 1312336 - RNA, 25 nt, Human
ugaggcaggagaaucgcuugaacuc

SEQ ID NO: 1312337 - RNA, 21 nt, Human
ugcacagccucacaaccgccc

SEQ ID NO: 1312338 - RNA, 18 nt, Human
ugcagggguucuccaagg

SEQ ID NO: 1312339 - RNA, 24 nt, Human
uggccaacauggugaaaccccguc

SEQ ID NO: 1312340 - RNA, 21 nt, Human
uggcgcgcgccuguaauccca

SEQ ID NO: 1312341 - RNA, 22 nt, Human
uggcgcgcgccuguaaucccag

SEQ ID NO: 1312342 - RNA, 24 nt, Human
ugguggcgcgcgccuguaauccca

SEQ ID NO: 1312343 - RNA, 24 nt, Human
uugaacucaggaggcggagguugc

SEQ ID NO: 1312344 - RNA, 18 nt, Human
uugcagugagccgagauc

SEQ ID NO: 1312345 - RNA, 20 nt, Human
uugcagugagccgagaucac

SEQ ID NO: 1312346 - RNA, 21 nt, Human
uugcagugagccgagaucacg

SEQ ID NO: 1312347 - RNA, 20 nt, Human
accuggcccaggaucucaug

SEQ ID NO: 1312348 - RNA, 21 nt, Human
accuguuuugguccugggagc

SEQ ID NO: 1312349 - RNA, 23 nt, Human
agggcacugcccagggcagccuu

SEQ ID NO: 1312350 - RNA, 24 nt, Human
agggcacugcccagggcagccuuu

SEQ ID NO: 1312351 - RNA, 22 nt, Human
auccucucaagaccugaggcug

SEQ ID NO: 1312352 - RNA, 26 nt, Human
cauccggaaguccuccuccuuucccc

SEQ ID NO: 1312353 - RNA, 25 nt, Human
ccaccuggauggccagccugguugu

SEQ ID NO: 1312354 - RNA, 21 nt, Human
ccugggcuggcuucccggagc

SEQ ID NO: 1312355 - RNA, 21 nt, Human
ccugguugucagcucuuccau

SEQ ID NO: 1312356 - RNA, 22 nt, Human
cgcagggcacugcccagggcag

SEQ ID NO: 1312357 - RNA, 22 nt, Human
cggagagcugggcaaaggaugg

SEQ ID NO: 1312358 - RNA, 22 nt, Human
cucagacagagucuuauccucc

SEQ ID NO: 1312359 - RNA, 22 nt, Human
gaccuguuuugguccugggagc

SEQ ID NO: 1312360 - RNA, 20 nt, Human
gcacugcccagggcagccuu

SEQ ID NO: 1312361 - RNA, 21 nt, Human
gcagaccuguuuugguccugg

SEQ ID NO: 1312362 - RNA, 21 nt, Human
ggcagaccuguuuugguccug

SEQ ID NO: 1312363 - RNA, 20 nt, Human
gggcaaaggauggguccuuc

SEQ ID NO: 1312364 - RNA, 23 nt, Human
gggcacugcccagggcagccuuu

SEQ ID NO: 1312365 - RNA, 20 nt, Human
gggcagaccuguuuuggucc

SEQ ID NO: 1312366 - RNA, 23 nt, Human
gggcagccuuuagcauuucauuc

SEQ ID NO: 1312367 - RNA, 25 nt, Human
uacauccggaaguccuccuccuuuc

SEQ ID NO: 1312368 - RNA, 19 nt, Human
uccuccuccuuuccccgca

SEQ ID NO: 1312369 - RNA, 19 nt, Human
uccuccuuuccccgcaggg

SEQ ID NO: 1312370 - RNA, 18 nt, Human
ugagcuggcugcccuggg

SEQ ID NO: 1312371 - RNA, 23 nt, Human
ugcaggaagacacuuuucaccug

SEQ ID NO: 1312372 - RNA, 21 nt, Human
ugcccagggcagccuuuagca

SEQ ID NO: 1312373 - RNA, 20 nt, Human
ugccgcagggccugcaggaa

SEQ ID NO: 1312374 - RNA, 24 nt, Human
uggccagccugguugucagcucuu

SEQ ID NO: 1312375 - RNA, 22 nt, Human
uucugguagaagugguugagcu

SEQ ID NO: 1312376 - RNA, 23 nt, Human
uugugccuguuguuagagguggg

SEQ ID NO: 1312377 - RNA, 21 nt, Human
uuuagcauuucauucuccucc

SEQ ID NO: 1312378 - RNA, 20 nt, Human
agccuauccggaagaaguuc

SEQ ID NO: 1312379 - RNA, 26 nt, Human
uaagucccaacacgaacagccaggaa

SEQ ID NO: 1312380 - RNA, 25 nt, Human
ucccaacacgaacagccaggguacc

SEQ ID NO: 1312381 - RNA, 21 nt, Human
ucugaacaagccuauccggaa

SEQ ID NO: 1312382 - RNA, 25 nt, Human
ugguaagucccaacacgaacagcca

SEQ ID NO: 1312383 - RNA, 22 nt, Human
acucccucgucuuccagaaccu

SEQ ID NO: 1312384 - RNA, 19 nt, Human
cacuccugguucuacuccc

SEQ ID NO: 1312385 - RNA, 23 nt, Human
gccacucagcccacacuccuggg

SEQ ID NO: 1312386 - RNA, 20 nt, Human
gcccagcgccacucagccca

SEQ ID NO: 1312387 - RNA, 22 nt, Human
ucuacucccucgucuuccagaa

SEQ ID NO: 1312388 - RNA, 19 nt, Human
aaaaagaaauuccuagccc

SEQ ID NO: 1312389 - RNA, 20 nt, Human
aaaagaaauuccuagcccuu

SEQ ID NO: 1312390 - RNA, 23 nt, Human
aaacugggaaggacaacaggaga

SEQ ID NO: 1312391 - RNA, 21 nt, Human
aaagucuuucccuucucuagc

SEQ ID NO: 1312392 - RNA, 18 nt, Human
aacauuaagggaauuagc

SEQ ID NO: 1312393 - RNA, 18 nt, Human
acuuguggaccuccccuc

SEQ ID NO: 1312394 - RNA, 19 nt, Human
acuuuggcaucucugugaa

SEQ ID NO: 1312395 - RNA, 22 nt, Human
agaggguuuaacccuguccuau

SEQ ID NO: 1312396 - RNA, 23 nt, Human
aggagcuggaucaguagacacca

SEQ ID NO: 1312397 - RNA, 22 nt, Human
aggaggcauagacagggaaacc

SEQ ID NO: 1312398 - RNA, 19 nt, Human
aggcauagacagggaaacc

SEQ ID NO: 1312399 - RNA, 22 nt, Human
agggaaaaggggagguugggga

SEQ ID NO: 1312400 - RNA, 21 nt, Human
agggguuggcuucucucuucu

SEQ ID NO: 1312401 - RNA, 22 nt, Human
agguuuccggcgcugcagguuu

SEQ ID NO: 1312402 - RNA, 18 nt, Human
aguugcuagcuugggccu

SEQ ID NO: 1312403 - RNA, 25 nt, Human
aucacuagcaauacaccuacaauga

SEQ ID NO: 1312404 - RNA, 19 nt, Human
auugucuuuguugugcugu

SEQ ID NO: 1312405 - RNA, 23 nt, Human
caaacuccuucagcuacuagcaa

SEQ ID NO: 1312406 - RNA, 23 nt, Human
caaagcuaaaacagucaaagcuc

SEQ ID NO: 1312407 - RNA, 22 nt, Human
caaauaaagacucaggauuaaa

SEQ ID NO: 1312408 - RNA, 21 nt, Human
cacucgaucaccucuacacuu

SEQ ID NO: 1312409 - RNA, 24 nt, Human
caggacgacagucugggguccuuu

SEQ ID NO: 1312410 - RNA, 22 nt, Human
caggagcuggaucaguagacac

SEQ ID NO: 1312411 - RNA, 19 nt, Human
cagggccaggugguggcgc

SEQ ID NO: 1312412 - RNA, 21 nt, Human
ccaggugguggcgccaaaguc

SEQ ID NO: 1312413 - RNA, 21 nt, Human
ccauaagcuuguaugccgggu

SEQ ID NO: 1312414 - RNA, 23 nt, Human
ccccagggcuacacguucucccu

SEQ ID NO: 1312415 - RNA, 24 nt, Human
ccccuguggcaggcccauaauacu

SEQ ID NO: 1312416 - RNA, 18 nt, Human
cccuguccuauugauccc

SEQ ID NO: 1312417 - RNA, 19 nt, Human
ccuacaaugaggguuuuaa

SEQ ID NO: 1312418 - RNA, 20 nt, Human
cgagcucccugaaaaagaaa

SEQ ID NO: 1312419 - RNA, 21 nt, Human
cgcauacauaacaagaaguag

SEQ ID NO: 1312420 - RNA, 18 nt, Human
cggcggcccaggaggggu

SEQ ID NO: 1312421 - RNA, 20 nt, Human
cgugccaaaccucuacaggc

SEQ ID NO: 1312422 - RNA, 23 nt, Human
cuccauaagcuuguaugccgggu

SEQ ID NO: 1312423 - RNA, 22 nt, Human
cucccagguuuccggcgcugca

SEQ ID NO: 1312424 - RNA, 19 nt, Human
cuuaagagccgagcucccu

SEQ ID NO: 1312425 - RNA, 22 nt, Human
cuugugccccuguggcaggccc

SEQ ID NO: 1312426 - RNA, 19 nt, Human
gaaguuuucugaugaacca

SEQ ID NO: 1312427 - RNA, 22 nt, Human
gagccgagcucccugaaaaaga

SEQ ID NO: 1312428 - RNA, 23 nt, Human
gccacucauuaucuuuccaguuu

SEQ ID NO: 1312429 - RNA, 24 nt, Human
ggacgacagucugggguccuuucc

SEQ ID NO: 1312430 - RNA, 21 nt, Human
gggaaaaggggagguugggga

SEQ ID NO: 1312431 - RNA, 18 nt, Human
gggagguuggggagaaac

SEQ ID NO: 1312432 - RNA, 21 nt, Human
gggagguuggggagaaacugg

SEQ ID NO: 1312433 - RNA, 20 nt, Human
ggguugucugggcuuggucu

SEQ ID NO: 1312434 - RNA, 21 nt, Human
gucuuuuucagaaguucuggu

SEQ ID NO: 1312435 - RNA, 23 nt, Human
uaauugucuuuguugugcuguua

SEQ ID NO: 1312436 - RNA, 25 nt, Human
uacacguucucccuuuuuccaaagg

SEQ ID NO: 1312437 - RNA, 23 nt, Human
uacuucuguuuuuuccagcuuuu

SEQ ID NO: 1312438 - RNA, 24 nt, Human
uagcaauacaccuacaaugagggu

SEQ ID NO: 1312439 - RNA, 24 nt, Human
ucacuagcaauacaccuacaauga

SEQ ID NO: 1312440 - RNA, 21 nt, Human
ucagcuacuagcaaguagucu

SEQ ID NO: 1312441 - RNA, 21 nt, Human
uccacaaacuccuucagcuac

SEQ ID NO: 1312442 - RNA, 24 nt, Human
uccacaaacuccuucagcuacuag

SEQ ID NO: 1312443 - RNA, 19 nt, Human
uccacaguggacacaaaga

SEQ ID NO: 1312444 - RNA, 21 nt, Human
uccacaguggacacaaagagg

SEQ ID NO: 1312445 - RNA, 21 nt, Human
ucccugaaaaagaaauuccua

SEQ ID NO: 1312446 - RNA, 26 nt, Human
ucccugaaaaagaaauuccuagcccu

SEQ ID NO: 1312447 - RNA, 19 nt, Human
ucccuuuuuccaaagggga

SEQ ID NO: 1312448 - RNA, 21 nt, Human
uccuucagcuacuagcaagua

SEQ ID NO: 1312449 - RNA, 20 nt, Human
uccuugaucauuuauuugua

SEQ ID NO: 1312450 - RNA, 23 nt, Human
ucucauaccauauuuccccccuu

SEQ ID NO: 1312451 - RNA, 24 nt, Human
ucugaugaaccaaaguagcaacaa

SEQ ID NO: 1312452 - RNA, 19 nt, Human
ugaaccaaaguagcaacaa

SEQ ID NO: 1312453 - RNA, 23 nt, Human
ugaaugauccuuucagggggcca

SEQ ID NO: 1312454 - RNA, 21 nt, Human
ugacuauguuuuuaaccaccu

SEQ ID NO: 1312455 - RNA, 19 nt, Human
ugcaugagccuaagcaguu

SEQ ID NO: 1312456 - RNA, 19 nt, Human
ugcucaggacgacagucug

SEQ ID NO: 1312457 - RNA, 22 nt, Human
uggaaaccauuuuucaaauaaa

SEQ ID NO: 1312458 - RNA, 22 nt, Human
uggacccugccucgcauuaugc

SEQ ID NO: 1312459 - RNA, 18 nt, Human
uguggaccuccccucuaa

SEQ ID NO: 1312460 - RNA, 19 nt, Human
uguuauacaacuucugucc

SEQ ID NO: 1312461 - RNA, 21 nt, Human
uguuuugggagagcacuugug

SEQ ID NO: 1312462 - RNA, 18 nt, Human
uuaaccaccuguccuuga

SEQ ID NO: 1312463 - RNA, 25 nt, Human
uuacuaaauggauucuuuucagugu

SEQ ID NO: 1312464 - RNA, 23 nt, Human
uuacuucuguuuuuuccagcuuu

SEQ ID NO: 1312465 - RNA, 21 nt, Human
uuccggcgcugcagguuuuac

SEQ ID NO: 1312466 - RNA, 18 nt, Human
uucuacgugaaaaaguca

SEQ ID NO: 1312467 - RNA, 20 nt, Human
uugcuuucucccuuuuuugc

SEQ ID NO: 1312468 - RNA, 18 nt, Human
uuguaggcagcaguuggu

SEQ ID NO: 1312469 - RNA, 23 nt, Human
uugucuuuuucagaaguucuggu

SEQ ID NO: 1312470 - RNA, 22 nt, Human
uuuacaaaccccugacucauga

SEQ ID NO: 1312471 - RNA, 25 nt, Human
uuuagugggaguucucacucucauc

SEQ ID NO: 1312472 - RNA, 18 nt, Human
uuuuaagggcugacaacu

SEQ ID NO: 1312473 - RNA, 24 nt, Human
uuuuacacagcuguggugguucca

SEQ ID NO: 1312474 - RNA, 23 nt, Human
uuuucagaaguucugguguuggc

SEQ ID NO: 1312475 - RNA, 19 nt, Human
uuuuccacaaacuccuuca

SEQ ID NO: 1312476 - RNA, 27 nt, Human
uuuuccacaaacuccuucagcuacuag

SEQ ID NO: 1312477 - RNA, 19 nt, Human
uuuuuagugggaguucuca

SEQ ID NO: 1312478 - RNA, 20 nt, Human
aaaaccugagauugugaaga

SEQ ID NO: 1312479 - RNA, 24 nt, Human
aaagugcugggauuacagguguga

SEQ ID NO: 1312480 - RNA, 23 nt, Human
aagcagucuucccgucucagacu

SEQ ID NO: 1312481 - RNA, 25 nt, Human
aagugauccucccaccucagccucc

SEQ ID NO: 1312482 - RNA, 18 nt, Human
aagugcugggauuacagg

SEQ ID NO: 1312483 - RNA, 19 nt, Human
aagugcugggauuacaggu

SEQ ID NO: 1312484 - RNA, 27 nt, Human
aauggaaagcggggggagggugagggg

SEQ ID NO: 1312485 - RNA, 18 nt, Human
accacaccuggcuaauuu

SEQ ID NO: 1312486 - RNA, 19 nt, Human
acggagcaguaaguacaga

SEQ ID NO: 1312487 - RNA, 24 nt, Human
acuaguccccaacggcaugugugc

SEQ ID NO: 1312488 - RNA, 24 nt, Human
acucuauccagccucaacuguuuu

SEQ ID NO: 1312489 - RNA, 19 nt, Human
acugcagccucuaccuccu

SEQ ID NO: 1312490 - RNA, 22 nt, Human
agcaucuguugcucuaggcaac

SEQ ID NO: 1312491 - RNA, 18 nt, Human
aggcaaggucuugcuacg

SEQ ID NO: 1312492 - RNA, 23 nt, Human
aggcaaggucuugcuacguugcc

SEQ ID NO: 1312493 - RNA, 23 nt, Human
aggcuggugcaggagacacauug

SEQ ID NO: 1312494 - RNA, 21 nt, Human
aggguucagggggacugcggg

SEQ ID NO: 1312495 - RNA, 22 nt, Human
aguacagaguucuggagaggga

SEQ ID NO: 1312496 - RNA, 23 nt, Human
aguagcugagaccacaggcaugu

SEQ ID NO: 1312497 - RNA, 25 nt, Human
aguagcugagaccacaggcauguau

SEQ ID NO: 1312498 - RNA, 20 nt, Human
agugacggagcaguaaguac

SEQ ID NO: 1312499 - RNA, 20 nt, Human
agugcaguggugcgaucccg

SEQ ID NO: 1312500 - RNA, 23 nt, Human
agugcaguggugcgaucccggcu

SEQ ID NO: 1312501 - RNA, 24 nt, Human
agugcaguggugcgaucccggcuc

SEQ ID NO: 1312502 - RNA, 20 nt, Human
agugcugggauuacaggugu

SEQ ID NO: 1312503 - RNA, 21 nt, Human
aguggggcugggagguggcug

SEQ ID NO: 1312504 - RNA, 24 nt, Human
aucacuuugcaauaaaaccugagg

SEQ ID NO: 1312505 - RNA, 26 nt, Human
auggaaagcggggggagggugagggg

SEQ ID NO: 1312506 - RNA, 24 nt, Human
caaagugcugggauuacaggugug

SEQ ID NO: 1312507 - RNA, 24 nt, Human
caaggucuugcuacguugcccagg

SEQ ID NO: 1312508 - RNA, 27 nt, Human
caagugauccucccaccucagccuccc

SEQ ID NO: 1312509 - RNA, 19 nt, Human
caaucucugguuucuuugc

SEQ ID NO: 1312510 - RNA, 21 nt, Human
cacauguggucagcaaaucca

SEQ ID NO: 1312511 - RNA, 24 nt, Human
caccucagccucccgaguagcuga

SEQ ID NO: 1312512 - RNA, 26 nt, Human
caccuguagcugucaccucugugcca

SEQ ID NO: 1312513 - RNA, 23 nt, Human
cacugcagccucuaccuccuggg

SEQ ID NO: 1312514 - RNA, 22 nt, Human
cacuggccauuccccacccuga

SEQ ID NO: 1312515 - RNA, 21 nt, Human
cacuuugcaauaaaaccugag

SEQ ID NO: 1312516 - RNA, 23 nt, Human
cagccucuaccuccuggguucaa

SEQ ID NO: 1312517 - RNA, 18 nt, Human
cagccuuucuucuaucgc

SEQ ID NO: 1312518 - RNA, 19 nt, Human
cagggcuuuucagccaggg

SEQ ID NO: 1312519 - RNA, 18 nt, Human
cagugcaccuguguuugg

SEQ ID NO: 1312520 - RNA, 18 nt, Human
caguguccuuccaccacc

SEQ ID NO: 1312521 - RNA, 21 nt, Human
cauuccccacccugaucugga

SEQ ID NO: 1312522 - RNA, 24 nt, Human
cauuuucaauugauucauuggggg

SEQ ID NO: 1312523 - RNA, 20 nt, Human
ccaaaggagagacaaucuug

SEQ ID NO: 1312524 - RNA, 21 nt, Human
ccaaagugcugggauuacagg

SEQ ID NO: 1312525 - RNA, 21 nt, Human
ccaaagugcugggauuacagg

SEQ ID NO: 1312526 - RNA, 24 nt, Human
ccaaagugcugggauuacaggugu

SEQ ID NO: 1312527 - RNA, 21 nt, Human
cccaacggcaugugugccacu

SEQ ID NO: 1312528 - RNA, 23 nt, Human
cccaccucagccucccgaguagc

SEQ ID NO: 1312529 - RNA, 24 nt, Human
cccaccucagccucccgaguagcu

SEQ ID NO: 1312530 - RNA, 20 nt, Human
cccagccuggaugccagugu

SEQ ID NO: 1312531 - RNA, 19 nt, Human
cccaggcuggagugcagug

SEQ ID NO: 1312532 - RNA, 19 nt, Human
ccccaacggcaugugugcc

SEQ ID NO: 1312533 - RNA, 21 nt, Human
cccccagagaacacguggcca

SEQ ID NO: 1312534 - RNA, 22 nt, Human
cccccagagaacacguggccau

SEQ ID NO: 1312535 - RNA, 20 nt, Human
ccccccagagaacacguggc

SEQ ID NO: 1312536 - RNA, 18 nt, Human
cccuggagagcaggaugg

SEQ ID NO: 1312537 - RNA, 19 nt, Human
cccuuuuucuagaggcaag

SEQ ID NO: 1312538 - RNA, 21 nt, Human
ccuacaaugccccggacaacu

SEQ ID NO: 1312539 - RNA, 24 nt, Human
ccuccuggguucaagugauccucc

SEQ ID NO: 1312540 - RNA, 22 nt, Human
ccucuaccuccuggguucaagu

SEQ ID NO: 1312541 - RNA, 21 nt, Human
ccucugugcuauaguacugcu

SEQ ID NO: 1312542 - RNA, 25 nt, Human
ccucuuuaagacucugucuuuguca

SEQ ID NO: 1312543 - RNA, 22 nt, Human
ccuggguucaagugauccuccc

SEQ ID NO: 1312544 - RNA, 19 nt, Human
cggcuggaggagguggugc

SEQ ID NO: 1312545 - RNA, 24 nt, Human
cggggaguggggcugggagguggc

SEQ ID NO: 1312546 - RNA, 23 nt, Human
cuaagcauccuacaaugccccuc

SEQ ID NO: 1312547 - RNA, 24 nt, Human
cucacugcagccucuaccuccugg

SEQ ID NO: 1312548 - RNA, 20 nt, Human
cucugugcuauaguacugcu

SEQ ID NO: 1312549 - RNA, 23 nt, Human
cugcagccucuaccuccuggguu

SEQ ID NO: 1312550 - RNA, 18 nt, Human
cugcccggaacauggcgg

SEQ ID NO: 1312551 - RNA, 20 nt, Human
cugcggggaguggggcuggg

SEQ ID NO: 1312552 - RNA, 25 nt, Human
cuucagggcuuuucagccagggggu

SEQ ID NO: 1312553 - RNA, 19 nt, Human
gaguaaucccaaagugcug

SEQ ID NO: 1312554 - RNA, 22 nt, Human
gauauaauuuuaggaccuggau

SEQ ID NO: 1312555 - RNA, 18 nt, Human
gauuacaggugugaguca

SEQ ID NO: 1312556 - RNA, 20 nt, Human
gauuacaggugugagucacu

SEQ ID NO: 1312557 - RNA, 24 nt, Human
gauuacaggugugagucacucuau

SEQ ID NO: 1312558 - RNA, 20 nt, Human
gcagaaugagccgcucaccc

SEQ ID NO: 1312559 - RNA, 19 nt, Human
gcccaggcuggagugcagu

SEQ ID NO: 1312560 - RNA, 20 nt, Human
gcccaggcuggagugcagug

SEQ ID NO: 1312561 - RNA, 23 nt, Human
gcccaggcuggagugcaguggug

SEQ ID NO: 1312562 - RNA, 21 nt, Human
gcuaauuuuuucccuuuuucu

SEQ ID NO: 1312563 - RNA, 24 nt, Human
gcuacguugcccaggcuggucuug

SEQ ID NO: 1312564 - RNA, 21 nt, Human
gcucacugcagccucuaccuc

SEQ ID NO: 1312565 - RNA, 23 nt, Human
gcuggaggagguggugcuacugg

SEQ ID NO: 1312566 - RNA, 19 nt, Human
gcuguuugcacaugugguc

SEQ ID NO: 1312567 - RNA, 19 nt, Human
ggaaauguguagucuuuga

SEQ ID NO: 1312568 - RNA, 23 nt, Human
ggacugcggggaguggggcuggg

SEQ ID NO: 1312569 - RNA, 19 nt, Human
ggagguggcuguuugcaca

SEQ ID NO: 1312570 - RNA, 21 nt, Human
ggagguggcuguuugcacaug

SEQ ID NO: 1312571 - RNA, 21 nt, Human
ggcaaggucuugcuacguugc

SEQ ID NO: 1312572 - RNA, 20 nt, Human
ggcuggucuugaacuccuga

SEQ ID NO: 1312573 - RNA, 18 nt, Human
gggaguggggcugggagg

SEQ ID NO: 1312574 - RNA, 18 nt, Human
ggggaguggggcugggag

SEQ ID NO: 1312575 - RNA, 24 nt, Human
gggggagggugaggggucauucug

SEQ ID NO: 1312576 - RNA, 19 nt, Human
gucucaaucucugguuucu

SEQ ID NO: 1312577 - RNA, 24 nt, Human
gugauccucccaccucagccuccc

SEQ ID NO: 1312578 - RNA, 21 nt, Human
uacagaguucuggagagggaa

SEQ ID NO: 1312579 - RNA, 24 nt, Human
uaccuccuggguucaagugauccu

SEQ ID NO: 1312580 - RNA, 23 nt, Human
uacguugcccaggcuggucuuga

SEQ ID NO: 1312581 - RNA, 24 nt, Human
uacguugcccaggcuggucuugaa

SEQ ID NO: 1312582 - RNA, 22 nt, Human
uagaggcaaggucuugcuacgu

SEQ ID NO: 1312583 - RNA, 18 nt, Human
uagcccaggcuggagugc

SEQ ID NO: 1312584 - RNA, 23 nt, Human
uaguacugcuuuuuuuuuuccuu

SEQ ID NO: 1312585 - RNA, 18 nt, Human
uaugucuuuacuucaggg

SEQ ID NO: 1312586 - RNA, 24 nt, Human
ucacugcagccucuaccuccuggg

SEQ ID NO: 1312587 - RNA, 25 nt, Human
ucacugcagccucuaccuccugggu

SEQ ID NO: 1312588 - RNA, 18 nt, Human
ucagcagcguugucccug

SEQ ID NO: 1312589 - RNA, 18 nt, Human
ucagcaucuuuuaacuca

SEQ ID NO: 1312590 - RNA, 23 nt, Human
ucagugcaccuguguuuggggcu

SEQ ID NO: 1312591 - RNA, 26 nt, Human
ucagugcaccuguguuuggggcuuug

SEQ ID NO: 1312592 - RNA, 23 nt, Human
ucccaaagugcugggauuacagg

SEQ ID NO: 1312593 - RNA, 24 nt, Human
ucccgaguagcugagaccacaggc

SEQ ID NO: 1312594 - RNA, 19 nt, Human
ucccuggagagcaggaugg

SEQ ID NO: 1312595 - RNA, 26 nt, Human
uccucccaccucagccucccgaguag

SEQ ID NO: 1312596 - RNA, 20 nt, Human
uccugaguucaagcagucuu

SEQ ID NO: 1312597 - RNA, 21 nt, Human
uccuggguucaagugauccuc

SEQ ID NO: 1312598 - RNA, 24 nt, Human
uccuggguucaagugauccuccca

SEQ ID NO: 1312599 - RNA, 23 nt, Human
ucuccaaugauaguuccugauuu

SEQ ID NO: 1312600 - RNA, 23 nt, Human
ucucugguuucuuugcucagugc

SEQ ID NO: 1312601 - RNA, 19 nt, Human
ucuguagcccaggcuggag

SEQ ID NO: 1312602 - RNA, 20 nt, Human
ucuguagcccaggcuggagu

SEQ ID NO: 1312603 - RNA, 24 nt, Human
ucuguagcccaggcuggagugcag

SEQ ID NO: 1312604 - RNA, 22 nt, Human
ucuucuaucgcuccucuccaau

SEQ ID NO: 1312605 - RNA, 24 nt, Human
ucuugaacuccugaguucaagcag

SEQ ID NO: 1312606 - RNA, 23 nt, Human
ucuugcuacguugcccaggcugg

SEQ ID NO: 1312607 - RNA, 24 nt, Human
ucuugcuacguugcccaggcuggu

SEQ ID NO: 1312608 - RNA, 24 nt, Human
ugaacuccugaguucaagcagucu

SEQ ID NO: 1312609 - RNA, 23 nt, Human
ugacgggauuucuuuaguuucug

SEQ ID NO: 1312610 - RNA, 18 nt, Human
ugagaagcagauuagcca

SEQ ID NO: 1312611 - RNA, 24 nt, Human
ugagaccacaggcauguauuacca

SEQ ID NO: 1312612 - RNA, 23 nt, Human
ugagggaaugucauuuugucuca

SEQ ID NO: 1312613 - RNA, 21 nt, Human
ugaguucaagcagucuucccg

SEQ ID NO: 1312614 - RNA, 23 nt, Human
ugcacugugucagccuuucuucu

SEQ ID NO: 1312615 - RNA, 24 nt, Human
ugcccaggcuggucuugaacuccu

SEQ ID NO: 1312616 - RNA, 27 nt, Human
ugcccaggcuggucuugaacuccugag

SEQ ID NO: 1312617 - RNA, 22 nt, Human
ugcccggaacauggcgguaaga

SEQ ID NO: 1312618 - RNA, 19 nt, Human
ugcggggaguggggcuggg

SEQ ID NO: 1312619 - RNA, 24 nt, Human
ugcuacguugcccaggcuggucuu

SEQ ID NO: 1312620 - RNA, 27 nt, Human
ugcuacguugcccaggcuggucuugaa

SEQ ID NO: 1312621 - RNA, 24 nt, Human
ugcugggauuacaggugugaguca

SEQ ID NO: 1312622 - RNA, 18 nt, Human
ugcuuuuagucuugguga

SEQ ID NO: 1312623 - RNA, 18 nt, Human
uggagacaauuuuggugg

SEQ ID NO: 1312624 - RNA, 24 nt, Human
uggagugcaguggugcgaucccgg

SEQ ID NO: 1312625 - RNA, 23 nt, Human
uggcuaauuuuuucccuuuuucu

SEQ ID NO: 1312626 - RNA, 23 nt, Human
ugggagguggcuguuugcacaug

SEQ ID NO: 1312627 - RNA, 18 nt, Human
ugggauuacaggugugag

SEQ ID NO: 1312628 - RNA, 18 nt, Human
ugggauuacaggugugag

SEQ ID NO: 1312629 - RNA, 21 nt, Human
ugggauuacaggugugaguca

SEQ ID NO: 1312630 - RNA, 22 nt, Human
ugggauuacaggugugagucac

SEQ ID NO: 1312631 - RNA, 22 nt, Human
ugggauuacaggugugagucac

SEQ ID NO: 1312632 - RNA, 23 nt, Human
ugggauuacaggugugagucacu

SEQ ID NO: 1312633 - RNA, 25 nt, Human
ugggauuacaggugugagucacucu

SEQ ID NO: 1312634 - RNA, 23 nt, Human
uggguucaagugauccucccacc

SEQ ID NO: 1312635 - RNA, 24 nt, Human
uggguucaagugauccucccaccu

SEQ ID NO: 1312636 - RNA, 24 nt, Human
uggugcgaucccggcucacugcag

SEQ ID NO: 1312637 - RNA, 19 nt, Human
ugguugcggcuggaggagg

SEQ ID NO: 1312638 - RNA, 18 nt, Human
ugucccuggagagcagga

SEQ ID NO: 1312639 - RNA, 24 nt, Human
ugugccacuggccauuccccaccc

SEQ ID NO: 1312640 - RNA, 23 nt, Human
uucaagugauccucccaccucag

SEQ ID NO: 1312641 - RNA, 24 nt, Human
uucaagugauccucccaccucagc

SEQ ID NO: 1312642 - RNA, 18 nt, Human
uucauugucauuaccagu

SEQ ID NO: 1312643 - RNA, 21 nt, Human
uucuaucgcuccucuccaaug

SEQ ID NO: 1312644 - RNA, 22 nt, Human
uugcacauguggucagcaaauc

SEQ ID NO: 1312645 - RNA, 21 nt, Human
uuggaaauguguagucuuuga

SEQ ID NO: 1312646 - RNA, 23 nt, Human
uuggugguugcggcuggaggagg

SEQ ID NO: 1312647 - RNA, 19 nt, Human
uugucccuggagagcagga

SEQ ID NO: 1312648 - RNA, 24 nt, Human
uuuucagccagggggugauuuugc

SEQ ID NO: 1312649 - RNA, 23 nt, Human
uuuuucagcagcguugucccugg

SEQ ID NO: 1312650 - RNA, 21 nt, Human
aagaggaaagaaauuucccag

SEQ ID NO: 1312651 - RNA, 18 nt, Human
acuuauguuuguuaguaa

SEQ ID NO: 1312652 - RNA, 18 nt, Human
agaaggaagugggcuuga

SEQ ID NO: 1312653 - RNA, 20 nt, Human
agaaggaagugggcuugagc

SEQ ID NO: 1312654 - RNA, 23 nt, Human
agcccgcagcccugggcagcccc

SEQ ID NO: 1312655 - RNA, 24 nt, Human
aggaagaggaaagaaauuucccag

SEQ ID NO: 1312656 - RNA, 21 nt, Human
agggagcucccuccacaggga

SEQ ID NO: 1312657 - RNA, 23 nt, Human
agggaggcacaggaaaaggagga

SEQ ID NO: 1312658 - RNA, 21 nt, Human
aguggcugcagcuggagccug

SEQ ID NO: 1312659 - RNA, 20 nt, Human
auggaggaaacuuuaucuuc

SEQ ID NO: 1312660 - RNA, 22 nt, Human
cacuaaacuccucuaaagccca

SEQ ID NO: 1312661 - RNA, 18 nt, Human
cagcccugggcagccccg

SEQ ID NO: 1312662 - RNA, 18 nt, Human
cccgcagcccugggcagc

SEQ ID NO: 1312663 - RNA, 22 nt, Human
ccgcagcccugggcagccccgg

SEQ ID NO: 1312664 - RNA, 18 nt, Human
ccuggagcccgcagcccu

SEQ ID NO: 1312665 - RNA, 19 nt, Human
cgggugcugagcgccgggc

SEQ ID NO: 1312666 - RNA, 19 nt, Human
cuccacagggaggcacagg

SEQ ID NO: 1312667 - RNA, 22 nt, Human
cuggugcaggacugaacuggga

SEQ ID NO: 1312668 - RNA, 20 nt, Human
cuucaaaguggcugcagcug

SEQ ID NO: 1312669 - RNA, 18 nt, Human
gaggcacaggaaaaggag

SEQ ID NO: 1312670 - RNA, 18 nt, Human
gagguggcuggcgggugc

SEQ ID NO: 1312671 - RNA, 22 nt, Human
gcagcgcucugggugccuggag

SEQ ID NO: 1312672 - RNA, 20 nt, Human
gcccauugucucugaaugac

SEQ ID NO: 1312673 - RNA, 18 nt, Human
gccuggagcccgcagccc

SEQ ID NO: 1312674 - RNA, 18 nt, Human
gcucugggugccuggagc

SEQ ID NO: 1312675 - RNA, 20 nt, Human
ggagguggcuggcgggugcu

SEQ ID NO: 1312676 - RNA, 21 nt, Human
ggcacaggaaaaggagaagga

SEQ ID NO: 1312677 - RNA, 23 nt, Human
ggcgggugcugagcgccgggccu

SEQ ID NO: 1312678 - RNA, 20 nt, Human
gggaaaaggaacuggugcag

SEQ ID NO: 1312679 - RNA, 20 nt, Human
gucgcagcgcucugggugcc

SEQ ID NO: 1312680 - RNA, 18 nt, Human
uacaagguacuuauguuu

SEQ ID NO: 1312681 - RNA, 22 nt, Human
uccacagggaggcacaggaaaa

SEQ ID NO: 1312682 - RNA, 23 nt, Human
ucucugggcuuuucauguuucag

SEQ ID NO: 1312683 - RNA, 24 nt, Human
ucucugggcuuuucauguuucagu

SEQ ID NO: 1312684 - RNA, 22 nt, Human
ugaaugacuguuugcugaagca

SEQ ID NO: 1312685 - RNA, 24 nt, Human
ugccuggagcccgcagcccugggc

SEQ ID NO: 1312686 - RNA, 21 nt, Human
uggcgggugcugagcgccggg

SEQ ID NO: 1312687 - RNA, 24 nt, Human
uguggucgcagcgcucugggugcc

SEQ ID NO: 1312688 - RNA, 18 nt, Human
uucaaaguggcugcagcu

SEQ ID NO: 1312689 - RNA, 21 nt, Human
uuucucaccucaaacacuugg

SEQ ID NO: 1312690 - RNA, 21 nt, Human
aaaaaaccccaaacaccucca

SEQ ID NO: 1312691 - RNA, 21 nt, Human
aaaacaccauggagucaaaga

SEQ ID NO: 1312692 - RNA, 24 nt, Human
aaacagaaacugucuuuuauaauc

SEQ ID NO: 1312693 - RNA, 21 nt, Human
aaacagccggcaacggaaacg

SEQ ID NO: 1312694 - RNA, 22 nt, Human
aaacagccggcaacggaaacga

SEQ ID NO: 1312695 - RNA, 28 nt, Human
aaacagccggcaacggaaacgacggaac

SEQ ID NO: 1312696 - RNA, 21 nt, Human
aaauacugaagaugagaaaau

SEQ ID NO: 1312697 - RNA, 23 nt, Human
aacaaagaaaaccauaaagaaac

SEQ ID NO: 1312698 - RNA, 24 nt, Human
aacaucuauuuacuuuuuugaugc

SEQ ID NO: 1312699 - RNA, 21 nt, Human
aaccuucauuaaaaauugcuu

SEQ ID NO: 1312700 - RNA, 21 nt, Human
aagaaaaccauaaagaaacac

SEQ ID NO: 1312701 - RNA, 23 nt, Human
aagagcuuugaaaaagauaccaa

SEQ ID NO: 1312702 - RNA, 21 nt, Human
aagaggaaaagaaacagcagc

SEQ ID NO: 1312703 - RNA, 24 nt, Human
aauaaaacuauauaaaaugcacag

SEQ ID NO: 1312704 - RNA, 26 nt, Human
aauacugucauucucucaucaguuau

SEQ ID NO: 1312705 - RNA, 19 nt, Human
aaucaagccaucuaguccg

SEQ ID NO: 1312706 - RNA, 18 nt, Human
acagaaaaaaaccccaaa

SEQ ID NO: 1312707 - RNA, 22 nt, Human
accaaauuuuuaaaauaauuuu

SEQ ID NO: 1312708 - RNA, 23 nt, Human
acuggcacacucucuucaaccug

SEQ ID NO: 1312709 - RNA, 24 nt, Human
agaaaaaaaccccaaacaccucca

SEQ ID NO: 1312710 - RNA, 22 nt, Human
agaaaucauucccauaaaaauc

SEQ ID NO: 1312711 - RNA, 20 nt, Human
agacaaaaaucccaauuccu

SEQ ID NO: 1312712 - RNA, 22 nt, Human
agacaaaauuaaaaacagccau

SEQ ID NO: 1312713 - RNA, 20 nt, Human
agaggggaucuuuggaagga

SEQ ID NO: 1312714 - RNA, 19 nt, Human
aggaaaagaaacagcagcc

SEQ ID NO: 1312715 - RNA, 21 nt, Human
aggagaacuuaaacuuugcug

SEQ ID NO: 1312716 - RNA, 18 nt, Human
agggggagcaggagcugc

SEQ ID NO: 1312717 - RNA, 22 nt, Human
aguccgcgcucauuaggacaaa

SEQ ID NO: 1312718 - RNA, 24 nt, Human
auaaaaaucagacaaaauuaaaaa

SEQ ID NO: 1312719 - RNA, 21 nt, Human
auaaauaugaaaauggaaagu

SEQ ID NO: 1312720 - RNA, 24 nt, Human
auggugccaguaagacacugauuu

SEQ ID NO: 1312721 - RNA, 21 nt, Human
auugagcaagcucuauaauga

SEQ ID NO: 1312722 - RNA, 25 nt, Human
caaaagaugaacagaauugcuuucc

SEQ ID NO: 1312723 - RNA, 22 nt, Human
caaaauuaaaaacagccauuuc

SEQ ID NO: 1312724 - RNA, 24 nt, Human
caaacaaagaaaaccauaaagaaa

SEQ ID NO: 1312725 - RNA, 20 nt, Human
caaacaccuccagucaucau

SEQ ID NO: 1312726 - RNA, 20 nt, Human
caaacagccggcaacggaaa

SEQ ID NO: 1312727 - RNA, 18 nt, Human
caaaguagacaaaaaucc

SEQ ID NO: 1312728 - RNA, 22 nt, Human
caagaggaaaagaaacagcagc

SEQ ID NO: 1312729 - RNA, 24 nt, Human
cacagaaacccaaaaggaggcccu

SEQ ID NO: 1312730 - RNA, 20 nt, Human
caccgaggcauccggggcaa

SEQ ID NO: 1312731 - RNA, 20 nt, Human
caccuccagucaucauuccu

SEQ ID NO: 1312732 - RNA, 23 nt, Human
cacguagaaaaaauacauacaaa

SEQ ID NO: 1312733 - RNA, 25 nt, Human
cacugauuguccacuagcuuucuua

SEQ ID NO: 1312734 - RNA, 22 nt, Human
cacuguggcauuuuaaagugug

SEQ ID NO: 1312735 - RNA, 20 nt, Human
cagaaaaaaaccccaaacac

SEQ ID NO: 1312736 - RNA, 25 nt, Human
cagaaacccaaaaggaggcccuaau

SEQ ID NO: 1312737 - RNA, 22 nt, Human
cagccggcaacggaaacgacgg

SEQ ID NO: 1312738 - RNA, 19 nt, Human
cauacauagguagagaaga

SEQ ID NO: 1312739 - RNA, 24 nt, Human
cauagguagagaagaaaacacuaa

SEQ ID NO: 1312740 - RNA, 20 nt, Human
caucuuauuuuccaauugga

SEQ ID NO: 1312741 - RNA, 27 nt, Human
ccauuuccaaacuaaaaaccaaaaaaa

SEQ ID NO: 1312742 - RNA, 27 nt, Human
cccacugcaaacagccggcaacggaaa

SEQ ID NO: 1312743 - RNA, 20 nt, Human
cccagggcucugggcgucuc

SEQ ID NO: 1312744 - RNA, 19 nt, Human
ccccacugcaaacagccgg

SEQ ID NO: 1312745 - RNA, 21 nt, Human
ccccagggcucugggcgucuc

SEQ ID NO: 1312746 - RNA, 21 nt, Human
ccccggguucccgcagaaccc

SEQ ID NO: 1312747 - RNA, 20 nt, Human
cccgccggcccaggcgcccc

SEQ ID NO: 1312748 - RNA, 23 nt, Human
cccgcgcgcucucagugcagccg

SEQ ID NO: 1312749 - RNA, 25 nt, Human
cccgcgcgcucucagugcagccgca

SEQ ID NO: 1312750 - RNA, 20 nt, Human
cccucgcgcgccgcccgcgg

SEQ ID NO: 1312751 - RNA, 18 nt, Human
ccgaccccccucgcgcgc

SEQ ID NO: 1312752 - RNA, 23 nt, Human
ccggggcaagaggaaaagaaaca

SEQ ID NO: 1312753 - RNA, 23 nt, Human
cgcacaaagacccgccggcccag

SEQ ID NO: 1312754 - RNA, 21 nt, Human
cgccugagcaccccagggcuc

SEQ ID NO: 1312755 - RNA, 26 nt, Human
cgccugagcaccccagggcucugggc

SEQ ID NO: 1312756 - RNA, 21 nt, Human
cggggcaagaggaaaagaaac

SEQ ID NO: 1312757 - RNA, 18 nt, Human
cucaggucuugcucuauc

SEQ ID NO: 1312758 - RNA, 20 nt, Human
cucauguugcauucuaauuu

SEQ ID NO: 1312759 - RNA, 19 nt, Human
cucugcgccgaccccccuc

SEQ ID NO: 1312760 - RNA, 30 nt, Human
cugaaaagcuaaauugccacuauuguaauu

SEQ ID NO: 1312761 - RNA, 19 nt, Human
cuucaagcuauuuuaguau

SEQ ID NO: 1312762 - RNA, 18 nt, Human
gaaaaaaaccccaaacac

SEQ ID NO: 1312763 - RNA, 27 nt, Human
gaaaaagauuguuuucuaaacuguaaa

SEQ ID NO: 1312764 - RNA, 21 nt, Human
gaaaagaaacagcagccaccu

SEQ ID NO: 1312765 - RNA, 25 nt, Human
gaaagaggucugucaacagacacgg

SEQ ID NO: 1312766 - RNA, 18 nt, Human
gaacaaaagugaagagua

SEQ ID NO: 1312767 - RNA, 19 nt, Human
gaagguagacacaauuaua

SEQ ID NO: 1312768 - RNA, 19 nt, Human
gacaaaagcgcagaacugc

SEQ ID NO: 1312769 - RNA, 21 nt, Human
gacaguuugcuuggcuucuag

SEQ ID NO: 1312770 - RNA, 22 nt, Human
gagcuuugaaaaagauaccaac

SEQ ID NO: 1312771 - RNA, 19 nt, Human
gcaaacagccggcaacgga

SEQ ID NO: 1312772 - RNA, 20 nt, Human
gccgaccccccucgcgcgcc

SEQ ID NO: 1312773 - RNA, 23 nt, Human
gccgcaccgaggcauccggggca

SEQ ID NO: 1312774 - RNA, 22 nt, Human
gccgcccgcgaaugggagggca

SEQ ID NO: 1312775 - RNA, 21 nt, Human
gcucugggcgucucugcgccg

SEQ ID NO: 1312776 - RNA, 18 nt, Human
ggagguggauuuaaagaa

SEQ ID NO: 1312777 - RNA, 22 nt, Human
ggagguggauuuaaagaacaua

SEQ ID NO: 1312778 - RNA, 24 nt, Human
ggcucugggcgucucugcgccgac

SEQ ID NO: 1312779 - RNA, 19 nt, Human
gggagcaggagcugccucg

SEQ ID NO: 1312780 - RNA, 19 nt, Human
guagaaauagaagauacag

SEQ ID NO: 1312781 - RNA, 26 nt, Human
uaaaaacaaaaaagcuagucaccaau

SEQ ID NO: 1312782 - RNA, 25 nt, Human
uaaaaagcaaauacugaagaugaga

SEQ ID NO: 1312783 - RNA, 29 nt, Human
uaaaaaucagacaaaauuaaaaacagcca

SEQ ID NO: 1312784 - RNA, 27 nt, Human
uaaaauuuuccccuucuuuacuuaaag

SEQ ID NO: 1312785 - RNA, 22 nt, Human
uaaagaacauauuauugagcaa

SEQ ID NO: 1312786 - RNA, 23 nt, Human
uaaauucuguugaaugugcaaaa

SEQ ID NO: 1312787 - RNA, 21 nt, Human
uaacauuccaaacaaaaugac

SEQ ID NO: 1312788 - RNA, 18 nt, Human
uaagcaaaaacagaauga

SEQ ID NO: 1312789 - RNA, 20 nt, Human
uacaacugauaaaaagcaaa

SEQ ID NO: 1312790 - RNA, 19 nt, Human
uacaucaccauauuuaugu

SEQ ID NO: 1312791 - RNA, 18 nt, Human
uacccccaauuucuccca

SEQ ID NO: 1312792 - RNA, 24 nt, Human
uacuuuuacaccaacgggcuaagu

SEQ ID NO: 1312793 - RNA, 18 nt, Human
uagaauuucugaaauauu

SEQ ID NO: 1312794 - RNA, 24 nt, Human
uaguaguugggucuaaccuguacc

SEQ ID NO: 1312795 - RNA, 21 nt, Human
uaucugaaaugguugcagauu

SEQ ID NO: 1312796 - RNA, 27 nt, Human
uauguaaaauuccaacuacauauguca

SEQ ID NO: 1312797 - RNA, 20 nt, Human
ucaaaacacaaagauaagca

SEQ ID NO: 1312798 - RNA, 21 nt, Human
ucaagccaucuaguccgcgcu

SEQ ID NO: 1312799 - RNA, 22 nt, Human
ucaauaaucacagaaacccaaa

SEQ ID NO: 1312800 - RNA, 18 nt, Human
ucacagaaacccaaaagg

SEQ ID NO: 1312801 - RNA, 21 nt, Human
ucacuuaacauuccaaacaaa

SEQ ID NO: 1312802 - RNA, 25 nt, Human
ucagugcagccgcaccgaggcaucc

SEQ ID NO: 1312803 - RNA, 20 nt, Human
ucauauguagguagagcggu

SEQ ID NO: 1312804 - RNA, 19 nt, Human
uccaaaguagacaaaaauc

SEQ ID NO: 1312805 - RNA, 20 nt, Human
uccggggcaagaggaaaaga

SEQ ID NO: 1312806 - RNA, 20 nt, Human
ucgcacaaagacccgccggc

SEQ ID NO: 1312807 - RNA, 18 nt, Human
ucucucugcuguaucucu

SEQ ID NO: 1312808 - RNA, 20 nt, Human
ucucugcgccgaccccccuc

SEQ ID NO: 1312809 - RNA, 18 nt, Human
ugaaaugguugcagauua

SEQ ID NO: 1312810 - RNA, 23 nt, Human
ugaauacagaaaaaaaccccaaa

SEQ ID NO: 1312811 - RNA, 21 nt, Human
ugagauguccccuacaagaaa

SEQ ID NO: 1312812 - RNA, 19 nt, Human
ugagcaccccagggcucug

SEQ ID NO: 1312813 - RNA, 24 nt, Human
ugaugaaguuguauuucacugaau

SEQ ID NO: 1312814 - RNA, 19 nt, Human
ugcagaaagagcgcauagc

SEQ ID NO: 1312815 - RNA, 25 nt, Human
ugcauucuaauuuaccuggcuaacc

SEQ ID NO: 1312816 - RNA, 19 nt, Human
uggaaaguaagccuccccu

SEQ ID NO: 1312817 - RNA, 23 nt, Human
uggaagaucaaaacacaaagaua

SEQ ID NO: 1312818 - RNA, 26 nt, Human
uggaagaucaaaacacaaagauaagc

SEQ ID NO: 1312819 - RNA, 22 nt, Human
uggaaggauaagguaccuuugg

SEQ ID NO: 1312820 - RNA, 25 nt, Human
uggagguggauuuaaagaacauauu

SEQ ID NO: 1312821 - RNA, 21 nt, Human
uggcuucuagacucaaacccu

SEQ ID NO: 1312822 - RNA, 18 nt, Human
uguaaaacgcaccaagaa

SEQ ID NO: 1312823 - RNA, 22 nt, Human
uguaaaacgcaccaagaagaaa

SEQ ID NO: 1312824 - RNA, 22 nt, Human
uguguaaaacgcaccaagaaga

SEQ ID NO: 1312825 - RNA, 23 nt, Human
uuaaaaaaugaauacagaaaaaa

SEQ ID NO: 1312826 - RNA, 23 nt, Human
uuaaaaacaaaaaagcuagucac

SEQ ID NO: 1312827 - RNA, 27 nt, Human
uuaaaaacagccauuuccaaacuaaaa

SEQ ID NO: 1312828 - RNA, 28 nt, Human
uuaaaauuuuccccuucuuuacuuaaag

SEQ ID NO: 1312829 - RNA, 21 nt, Human
uuaaacacuugauauauaccc

SEQ ID NO: 1312830 - RNA, 19 nt, Human
uucaacacaaacaucaaaa

SEQ ID NO: 1312831 - RNA, 23 nt, Human
uucccauaaaaaucucaucacua

SEQ ID NO: 1312832 - RNA, 18 nt, Human
uuccuagaagggaaaaaa

SEQ ID NO: 1312833 - RNA, 19 nt, Human
uuccucuggacuagggccu

SEQ ID NO: 1312834 - RNA, 23 nt, Human
uuccucuggacuagggccugagg

SEQ ID NO: 1312835 - RNA, 20 nt, Human
uucucaaaggggagaaagag

SEQ ID NO: 1312836 - RNA, 18 nt, Human
uugaauacuuuaacagaa

SEQ ID NO: 1312837 - RNA, 26 nt, Human
uugccacuauuguaauaaagugaacc

SEQ ID NO: 1312838 - RNA, 22 nt, Human
uugguauagguucacugauacc

SEQ ID NO: 1312839 - RNA, 25 nt, Human
uuuaauacaaauaccugauuuauac

SEQ ID NO: 1312840 - RNA, 21 nt, Human
uuuccccacugcaaacagccg

SEQ ID NO: 1312841 - RNA, 24 nt, Human
uuugagcaaaucuuugaugaaguu

SEQ ID NO: 1312842 - RNA, 21 nt, Human
aaacacauuaugguagguagc

SEQ ID NO: 1312843 - RNA, 24 nt, Human
aacacauuaugguagguagcagca

SEQ ID NO: 1312844 - RNA, 19 nt, Human
acaggaaugaggaaagaau

SEQ ID NO: 1312845 - RNA, 22 nt, Human
acaggaaugaggaaagaaugac

SEQ ID NO: 1312846 - RNA, 22 nt, Human
agagcacacaucccuuccauuc

SEQ ID NO: 1312847 - RNA, 22 nt, Human
agcccaauuuccuuugaguacc

SEQ ID NO: 1312848 - RNA, 25 nt, Human
agggagaguuaaggaauuccuuugg

SEQ ID NO: 1312849 - RNA, 29 nt, Human
agguaggaagguagguaaaguccgcuuug

SEQ ID NO: 1312850 - RNA, 22 nt, Human
cagaaucuuaacugaguaugac

SEQ ID NO: 1312851 - RNA, 18 nt, Human
caggcuacuguaugggga

SEQ ID NO: 1312852 - RNA, 24 nt, Human
ccacaccaaaauggaauaaaaaag

SEQ ID NO: 1312853 - RNA, 21 nt, Human
cguccacaccaaaauggaaua

SEQ ID NO: 1312854 - RNA, 22 nt, Human
cguccacaccaaaauggaauaa

SEQ ID NO: 1312855 - RNA, 22 nt, Human
cuucuugcugugucaucucucu

SEQ ID NO: 1312856 - RNA, 21 nt, Human
cuugcugugucaucucucuuc

SEQ ID NO: 1312857 - RNA, 21 nt, Human
gcaggagggagacacaguucu

SEQ ID NO: 1312858 - RNA, 21 nt, Human
ggucacaggaaugaggaaaga

SEQ ID NO: 1312859 - RNA, 18 nt, Human
guccacaccaaaauggaa

SEQ ID NO: 1312860 - RNA, 23 nt, Human
uaaaaaaguaauccagucaaaga

SEQ ID NO: 1312861 - RNA, 24 nt, Human
ucaaagaaagguugagauccugua

SEQ ID NO: 1312862 - RNA, 24 nt, Human
ucaacgguugcaucuguuuuuuuu

SEQ ID NO: 1312863 - RNA, 24 nt, Human
ucacaggaaugaggaaagaaugac

SEQ ID NO: 1312864 - RNA, 21 nt, Human
ucacuccaggcuacuguaugg

SEQ ID NO: 1312865 - RNA, 18 nt, Human
ucaucucucuucucaggg

SEQ ID NO: 1312866 - RNA, 18 nt, Human
uccacaccaaaauggaau

SEQ ID NO: 1312867 - RNA, 20 nt, Human
uggaauaaaaaaguaaucca

SEQ ID NO: 1312868 - RNA, 22 nt, Human
uggauucuuggcauccacguuc

SEQ ID NO: 1312869 - RNA, 20 nt, Human
uggcauccacguucuugugg

SEQ ID NO: 1312870 - RNA, 22 nt, Human
ugguagguagguaggaagguag

SEQ ID NO: 1312871 - RNA, 21 nt, Human
uguccaguacaaaucagccca

SEQ ID NO: 1312872 - RNA, 24 nt, Human
uuucucgcagauggucacaggaau

SEQ ID NO: 1312873 - RNA, 20 nt, Human
acaggccugugccaccgcgc

SEQ ID NO: 1312874 - RNA, 19 nt, Human
acugcagccucaaacuccu

SEQ ID NO: 1312875 - RNA, 22 nt, Human
acugcagccucaaacuccuggg

SEQ ID NO: 1312876 - RNA, 18 nt, Human
agacagggucucaauaug

SEQ ID NO: 1312877 - RNA, 23 nt, Human
aguacagugacacgaucauagcu

SEQ ID NO: 1312878 - RNA, 18 nt, Human
auagcuuacugcagccuc

SEQ ID NO: 1312879 - RNA, 20 nt, Human
auccucccgccucagccucc

SEQ ID NO: 1312880 - RNA, 23 nt, Human
caaacuccugggcccacgccauc

SEQ ID NO: 1312881 - RNA, 20 nt, Human
cagccucaaacuccugggcc

SEQ ID NO: 1312882 - RNA, 20 nt, Human
cagccuccugaguagcuggg

SEQ ID NO: 1312883 - RNA, 24 nt, Human
caggaucuugcucuguugcccagg

SEQ ID NO: 1312884 - RNA, 19 nt, Human
cccaggcuggaguacagug

SEQ ID NO: 1312885 - RNA, 23 nt, Human
cccgccucagccuccugaguagc

SEQ ID NO: 1312886 - RNA, 23 nt, Human
ccgccucagccuccugaguagcu

SEQ ID NO: 1312887 - RNA, 22 nt, Human
ccgguggggcguagacccuucc

SEQ ID NO: 1312888 - RNA, 19 nt, Human
ccucaaacuccugggccca

SEQ ID NO: 1312889 - RNA, 23 nt, Human
ccuuccagauggcuggcucugcc

SEQ ID NO: 1312890 - RNA, 24 nt, Human
cgccucagccuccugaguagcugg

SEQ ID NO: 1312891 - RNA, 23 nt, Human
cggucuucaagcuuaucuccccu

SEQ ID NO: 1312892 - RNA, 24 nt, Human
cucagccuccugaguagcugggac

SEQ ID NO: 1312893 - RNA, 24 nt, Human
cuccugaguagcugggaccacagg

SEQ ID NO: 1312894 - RNA, 20 nt, Human
cuccugggcccacgccaucu

SEQ ID NO: 1312895 - RNA, 23 nt, Human
cugcagccucaaacuccugggcc

SEQ ID NO: 1312896 - RNA, 21 nt, Human
cuuacugcagccucaaacucc

SEQ ID NO: 1312897 - RNA, 21 nt, Human
cuugcucuguugcccaggcug

SEQ ID NO: 1312898 - RNA, 25 nt, Human
gaguagcugggaccacaggccugug

SEQ ID NO: 1312899 - RNA, 19 nt, Human
gaucauagcuuacugcagc

SEQ ID NO: 1312900 - RNA, 20 nt, Human
gcccaggcuggaguacagug

SEQ ID NO: 1312901 - RNA, 25 nt, Human
gcucuguugcccaggcuggaguaca

SEQ ID NO: 1312902 - RNA, 20 nt, Human
ggaguacagugacacgauca

SEQ ID NO: 1312903 - RNA, 23 nt, Human
gggggacagugcaguuggagcuu

SEQ ID NO: 1312904 - RNA, 20 nt, Human
uaaccagcgaccgguggggc

SEQ ID NO: 1312905 - RNA, 21 nt, Human
uaagacaggaucuugcucugu

SEQ ID NO: 1312906 - RNA, 22 nt, Human
uaagacaggaucuugcucuguu

SEQ ID NO: 1312907 - RNA, 22 nt, Human
uagagacagggucucaauaugu

SEQ ID NO: 1312908 - RNA, 24 nt, Human
uagcuuacugcagccucaaacucc

SEQ ID NO: 1312909 - RNA, 23 nt, Human
ucagccuccugaguagcugggac

SEQ ID NO: 1312910 - RNA, 18 nt, Human
uccacggucuucaagcuu

SEQ ID NO: 1312911 - RNA, 25 nt, Human
uccacggucuucaagcuuaucuccc

SEQ ID NO: 1312912 - RNA, 19 nt, Human
uccccuuguucucuccgca

SEQ ID NO: 1312913 - RNA, 26 nt, Human
uccucccgccucagccuccugaguag

SEQ ID NO: 1312914 - RNA, 24 nt, Human
uccugaguagcugggaccacaggc

SEQ ID NO: 1312915 - RNA, 18 nt, Human
ucuguugcccaggcugga

SEQ ID NO: 1312916 - RNA, 23 nt, Human
ucuugcucuguugcccaggcugg

SEQ ID NO: 1312917 - RNA, 24 nt, Human
ucuugcucuguugcccaggcugga

SEQ ID NO: 1312918 - RNA, 18 nt, Human
ucuuugggggacagugca

SEQ ID NO: 1312919 - RNA, 21 nt, Human
ugcccaggcuggaguacagug

SEQ ID NO: 1312920 - RNA, 24 nt, Human
ugcccaggcuggaguacagugaca

SEQ ID NO: 1312921 - RNA, 22 nt, Human
ugcucuguugcccaggcuggag

SEQ ID NO: 1312922 - RNA, 22 nt, Human
ugcugguccacggucuucaagc

SEQ ID NO: 1312923 - RNA, 18 nt, Human
uggcuuguuguuuuguag

SEQ ID NO: 1312924 - RNA, 23 nt, Human
ugggaccacaggccugugccacc

SEQ ID NO: 1312925 - RNA, 24 nt, Human
ugggaccacaggccugugccaccg

SEQ ID NO: 1312926 - RNA, 23 nt, Human
uggggcguagacccuuccagaug

SEQ ID NO: 1312927 - RNA, 24 nt, Human
uguagagacagggucucaauaugu

SEQ ID NO: 1312928 - RNA, 24 nt, Human
uuacugcagccucaaacuccuggg

SEQ ID NO: 1312929 - RNA, 24 nt, Human
uugcucuguugcccaggcuggagu

SEQ ID NO: 1312930 - RNA, 22 nt, Human
uuguagagacagggucucaaua

SEQ ID NO: 1312931 - RNA, 18 nt, Human
uuuguagagacagggucu

SEQ ID NO: 1312932 - RNA, 24 nt, Human
uuuguagagacagggucucaauau

SEQ ID NO: 1312933 - RNA, 18 nt, Human
uuuuuuuuuuaagacagg

SEQ ID NO: 1312934 - RNA, 24 nt, Human
uuuuuuuuuuuuaagacaggaucu

SEQ ID NO: 1312935 - RNA, 25 nt, Human
uuuuuuuuuuuuuuuuuuuuuaagg

SEQ ID NO: 1312936 - RNA, 22 nt, Human
agcucugagcccagaguuuccc

SEQ ID NO: 1312937 - RNA, 27 nt, Human
aggggcaggccccaggaucccccaagg

SEQ ID NO: 1312938 - RNA, 19 nt, Human
cacgggaagacagauccca

SEQ ID NO: 1312939 - RNA, 23 nt, Human
cagcagccaugugggggcacccc

SEQ ID NO: 1312940 - RNA, 22 nt, Human
cagccucccuggugagggugac

SEQ ID NO: 1312941 - RNA, 21 nt, Human
caggccccaggauccugaaga

SEQ ID NO: 1312942 - RNA, 21 nt, Human
ccccuguggcggccaaaaccu

SEQ ID NO: 1312943 - RNA, 21 nt, Human
cccucagcccauugcugaagu

SEQ ID NO: 1312944 - RNA, 21 nt, Human
cuucuguccugugaccaaagg

SEQ ID NO: 1312945 - RNA, 22 nt, Human
cuuggcccagcuucuguccugu

SEQ ID NO: 1312946 - RNA, 21 nt, Human
gccccaggauccugaagacac

SEQ ID NO: 1312947 - RNA, 19 nt, Human
ggguuuggggcaaggagug

SEQ ID NO: 1312948 - RNA, 24 nt, Human
gugcagcagccaugugggggcacc

SEQ ID NO: 1312949 - RNA, 22 nt, Human
uaaauucccguccuggcauuca

SEQ ID NO: 1312950 - RNA, 23 nt, Human
uccugaagacacacgggaagaca

SEQ ID NO: 1312951 - RNA, 22 nt, Human
uccuuacuuccucaggcuucug

SEQ ID NO: 1312952 - RNA, 23 nt, Human
ugaggccuuccucaagaggaagc

SEQ ID NO: 1312953 - RNA, 18 nt, Human
ugcugaaguugaauuaga

SEQ ID NO: 1312954 - RNA, 19 nt, Human
uguccugugaccaaaggcg

SEQ ID NO: 1312955 - RNA, 22 nt, Human
ugugaccaaaggcgggucuucu

SEQ ID NO: 1312956 - RNA, 20 nt, Human
uuccgggccucgguuuucuc

SEQ ID NO: 1312957 - RNA, 23 nt, Human
uuccucaagaggaagccaggagg

SEQ ID NO: 1312958 - RNA, 23 nt, Human
uuccucaggcuucuggguuuggg

SEQ ID NO: 1312959 - RNA, 23 nt, Human
uuccucaggcuucuggguuuggg

SEQ ID NO: 1312960 - RNA, 19 nt, Human
uucuggguuuggggcaagg

SEQ ID NO: 1312961 - RNA, 20 nt, Human
aaaaggacccaggagcgggg

SEQ ID NO: 1312962 - RNA, 18 nt, Human
aaggacccaggagcgggg

SEQ ID NO: 1312963 - RNA, 26 nt, Human
acccuggcacccccggcgcguucucc

SEQ ID NO: 1312964 - RNA, 25 nt, Human
acuccagugugcgggacccuggcac

SEQ ID NO: 1312965 - RNA, 25 nt, Human
acuggacugagugcccgggagugcc

SEQ ID NO: 1312966 - RNA, 19 nt, Human
agaggcccggggagaucag

SEQ ID NO: 1312967 - RNA, 24 nt, Human
agaucuaauauguuguggaaauaa

SEQ ID NO: 1312968 - RNA, 22 nt, Human
agccagucccaaaaaggaccca

SEQ ID NO: 1312969 - RNA, 25 nt, Human
auuaagcaguggaaaaugugcucaa

SEQ ID NO: 1312970 - RNA, 26 nt, Human
caccacggggaggcgccgccacucca

SEQ ID NO: 1312971 - RNA, 25 nt, Human
cagagacaaggccguccaacccguc

SEQ ID NO: 1312972 - RNA, 19 nt, Human
caggcccucugucuaccag

SEQ ID NO: 1312973 - RNA, 18 nt, Human
cagguggcucgcaaggag

SEQ ID NO: 1312974 - RNA, 26 nt, Human
ccaaaaaggacccaggagcggggaca

SEQ ID NO: 1312975 - RNA, 20 nt, Human
cccaggagcggggacaccac

SEQ ID NO: 1312976 - RNA, 20 nt, Human
cccuuucccucucuuuaccc

SEQ ID NO: 1312977 - RNA, 18 nt, Human
ccuucuuccuuuuuuugc

SEQ ID NO: 1312978 - RNA, 21 nt, Human
cgugcuuguaaaauugaguuc

SEQ ID NO: 1312979 - RNA, 18 nt, Human
cuccagugugcgggaccc

SEQ ID NO: 1312980 - RNA, 18 nt, Human
cuuuccuucuuccuuuuu

SEQ ID NO: 1312981 - RNA, 18 nt, Human
gagaaaacagaggcccgg

SEQ ID NO: 1312982 - RNA, 21 nt, Human
ggaggcgccgccacuccagug

SEQ ID NO: 1312983 - RNA, 28 nt, Human
gguccaucuuuccuucuucccucugaag

SEQ ID NO: 1312984 - RNA, 22 nt, Human
gugccagagccagucccaaaaa

SEQ ID NO: 1312985 - RNA, 24 nt, Human
uaacucuacuaaagcagaaugaga

SEQ ID NO: 1312986 - RNA, 19 nt, Human
uaauauguuguggaaauaa

SEQ ID NO: 1312987 - RNA, 21 nt, Human
uacuggacugagugcccggga

SEQ ID NO: 1312988 - RNA, 22 nt, Human
uagaccccugacccugcccccg

SEQ ID NO: 1312989 - RNA, 22 nt, Human
uauacagacuauuucacagacc

SEQ ID NO: 1312990 - RNA, 21 nt, Human
uaugugggccuucccagauuu

SEQ ID NO: 1312991 - RNA, 19 nt, Human
ucaaggcuucauauuuuua

SEQ ID NO: 1312992 - RNA, 21 nt, Human
uccaucuuuccuucuuccuuu

SEQ ID NO: 1312993 - RNA, 23 nt, Human
uccuccaucgccagaugcuccug

SEQ ID NO: 1312994 - RNA, 22 nt, Human
ucucuugucuucucauccucca

SEQ ID NO: 1312995 - RNA, 22 nt, Human
ugacccugcccccgucauucuc

SEQ ID NO: 1312996 - RNA, 20 nt, Human
ugcgucaggcccucugucua

SEQ ID NO: 1312997 - RNA, 19 nt, Human
uggaagaggugacuuaaua

SEQ ID NO: 1312998 - RNA, 23 nt, Human
ugucuucucauccuccaucgcca

SEQ ID NO: 1312999 - RNA, 19 nt, Human
uucacagaugagaaaacag

SEQ ID NO: 1313000 - RNA, 20 nt, Human
uucacagaugagaaaacaga

SEQ ID NO: 1313001 - RNA, 24 nt, Human
uucacagaugagaaaacagaggcc

SEQ ID NO: 1313002 - RNA, 24 nt, Human
uuccuucuuccuuuuuuugcacau

SEQ ID NO: 1313003 - RNA, 24 nt, Human
uuugcacauuugcauuuauaucuu

SEQ ID NO: 1313004 - RNA, 18 nt, Human
uuugugaggcccuuuccc

SEQ ID NO: 1313005 - RNA, 24 nt, Human
aaacagaaacaaaauuaaagccca

SEQ ID NO: 1313006 - RNA, 20 nt, Human
aaaccuaaaguaagccaaua

SEQ ID NO: 1313007 - RNA, 25 nt, Human
aaaguaagccaauacuguacuuagg

SEQ ID NO: 1313008 - RNA, 22 nt, Human
aacaaaacaaaacaaacuaccc

SEQ ID NO: 1313009 - RNA, 26 nt, Human
aacaaguacauuuugcuguagucaga

SEQ ID NO: 1313010 - RNA, 18 nt, Human
aacaugauucaucuccuc

SEQ ID NO: 1313011 - RNA, 23 nt, Human
aagaaaccuaaaguaagccaaua

SEQ ID NO: 1313012 - RNA, 21 nt, Human
aagagucagauuggaggcuuu

SEQ ID NO: 1313013 - RNA, 24 nt, Human
aagcaaaaauaugcucgaaagcaa

SEQ ID NO: 1313014 - RNA, 19 nt, Human
aaggaaagaaaacacggua

SEQ ID NO: 1313015 - RNA, 20 nt, Human
aaguuuaaaggcuacauucc

SEQ ID NO: 1313016 - RNA, 22 nt, Human
aauaugcucgaaagcaaacacc

SEQ ID NO: 1313017 - RNA, 18 nt, Human
acccacagggacgcggcc

SEQ ID NO: 1313018 - RNA, 19 nt, Human
acuaguuuuaucagaucuc

SEQ ID NO: 1313019 - RNA, 18 nt, Human
acuuuccacaacaaaaca

SEQ ID NO: 1313020 - RNA, 19 nt, Human
agaaaaucuaaauugagaa

SEQ ID NO: 1313021 - RNA, 25 nt, Human
agaaaccuaaaguaagccaauacug

SEQ ID NO: 1313022 - RNA, 22 nt, Human
augccaaaacuaaagcaaaaca

SEQ ID NO: 1313023 - RNA, 27 nt, Human
caaaacaaacuacccuaacucuaauau

SEQ ID NO: 1313024 - RNA, 19 nt, Human
caaaacuaaagcaaaacaa

SEQ ID NO: 1313025 - RNA, 26 nt, Human
caaacagaaacaaaauuaaagcccau

SEQ ID NO: 1313026 - RNA, 18 nt, Human
caacaaaacaaaacaaac

SEQ ID NO: 1313027 - RNA, 21 nt, Human
caacaaaacaaaacaaacuac

SEQ ID NO: 1313028 - RNA, 24 nt, Human
caagaaguaaacuauaaguacaaa

SEQ ID NO: 1313029 - RNA, 20 nt, Human
cacaacaaaacaaaacaaac

SEQ ID NO: 1313030 - RNA, 21 nt, Human
caccaaauaaucagcggucac

SEQ ID NO: 1313031 - RNA, 26 nt, Human
cacuuccauuucuaaucgcuuagagg

SEQ ID NO: 1313032 - RNA, 24 nt, Human
cacuuuccacaacaaaacaaaaca

SEQ ID NO: 1313033 - RNA, 23 nt, Human
caucuuuaaacagaaguuauucc

SEQ ID NO: 1313034 - RNA, 23 nt, Human
cccaaacagaaacaaaauuaaag

SEQ ID NO: 1313035 - RNA, 19 nt, Human
ccgcugccggcagcugcgc

SEQ ID NO: 1313036 - RNA, 19 nt, Human
ccuccuccucguccuccuc

SEQ ID NO: 1313037 - RNA, 20 nt, Human
ccucguccuccuccucgucc

SEQ ID NO: 1313038 - RNA, 18 nt, Human
ccuguucgagaugugaga

SEQ ID NO: 1313039 - RNA, 18 nt, Human
cuaaagcaaaacaaaaua

SEQ ID NO: 1313040 - RNA, 19 nt, Human
cuaaggcuuaucugaaaac

SEQ ID NO: 1313041 - RNA, 25 nt, Human
cugcgcgccggggagguccuccucc

SEQ ID NO: 1313042 - RNA, 19 nt, Human
gaaagcaaacaccaacaaa

SEQ ID NO: 1313043 - RNA, 20 nt, Human
gcaaaacaaaauauccuguu

SEQ ID NO: 1313044 - RNA, 22 nt, Human
uaaaaguuacaaaacaacuucu

SEQ ID NO: 1313045 - RNA, 20 nt, Human
uaaagcaaaacaaaauaucc

SEQ ID NO: 1313046 - RNA, 21 nt, Human
uaaauaaagagucagauugga

SEQ ID NO: 1313047 - RNA, 23 nt, Human
uaauaucaugguagccaauaucu

SEQ ID NO: 1313048 - RNA, 23 nt, Human
uacagaugccaaaacuaaagcaa

SEQ ID NO: 1313049 - RNA, 24 nt, Human
uacagaugccaaaacuaaagcaaa

SEQ ID NO: 1313050 - RNA, 21 nt, Human
uacuguacuuaggacuguauu

SEQ ID NO: 1313051 - RNA, 24 nt, Human
uagcaaaguggaauaagaaacaag

SEQ ID NO: 1313052 - RNA, 20 nt, Human
ucacuuuccgguuuguagcu

SEQ ID NO: 1313053 - RNA, 19 nt, Human
uccauacuuugagugaagu

SEQ ID NO: 1313054 - RNA, 19 nt, Human
uccccaaacagaaacaaaa

SEQ ID NO: 1313055 - RNA, 21 nt, Human
ucgaaagcaaacaccaacaaa

SEQ ID NO: 1313056 - RNA, 23 nt, Human
ucugucuuuagaggaggcaaacu

SEQ ID NO: 1313057 - RNA, 23 nt, Human
ucuuucaaauaaaaacagaacaa

SEQ ID NO: 1313058 - RNA, 23 nt, Human
ugaacauguacauucaaaauuuc

SEQ ID NO: 1313059 - RNA, 20 nt, Human
ugauucaucuccucuguauu

SEQ ID NO: 1313060 - RNA, 22 nt, Human
ugccaaaacuaaagcaaaacaa

SEQ ID NO: 1313061 - RNA, 21 nt, Human
uggaauaagaaacaaguacau

SEQ ID NO: 1313062 - RNA, 21 nt, Human
uggcaugauuaucuguucugg

SEQ ID NO: 1313063 - RNA, 20 nt, Human
uggugaaugucaacauuugc

SEQ ID NO: 1313064 - RNA, 22 nt, Human
uguacagaugccaaaacuaaag

SEQ ID NO: 1313065 - RNA, 23 nt, Human
uucaagcuuuuacauuauagacu

SEQ ID NO: 1313066 - RNA, 24 nt, Human
uuucagaagggucuaugacacuuc

SEQ ID NO: 1313067 - RNA, 23 nt, Human
agccagccugcgccgcuggcccc

SEQ ID NO: 1313068 - RNA, 21 nt, Human
aggcacgggcagaaaccaggg

SEQ ID NO: 1313069 - RNA, 20 nt, Human
aggggccuagcaccugggcc

SEQ ID NO: 1313070 - RNA, 22 nt, Human
ccacuggaaaccaggcuggggu

SEQ ID NO: 1313071 - RNA, 20 nt, Human
cgaguuccaggugggcaugg

SEQ ID NO: 1313072 - RNA, 22 nt, Human
cgcugcacuaugggagccccuc

SEQ ID NO: 1313073 - RNA, 24 nt, Human
cuagcaccugggccagcagccaga

SEQ ID NO: 1313074 - RNA, 20 nt, Human
cugcgccgcuggccccaggc

SEQ ID NO: 1313075 - RNA, 19 nt, Human
cuggccccaggcagugagg

SEQ ID NO: 1313076 - RNA, 24 nt, Human
cuggccccaggcagugaggggccu

SEQ ID NO: 1313077 - RNA, 24 nt, Human
gagaggcacgggcagaaaccaggg

SEQ ID NO: 1313078 - RNA, 23 nt, Human
uauacccauccucucaucugaaa

SEQ ID NO: 1313079 - RNA, 19 nt, Human
ucagagccagcucccucug

SEQ ID NO: 1313080 - RNA, 19 nt, Human
ucccucugcuugcagggag

SEQ ID NO: 1313081 - RNA, 20 nt, Human
ucccucugcuugcagggagg

SEQ ID NO: 1313082 - RNA, 22 nt, Human
ugaggggccuagcaccugggcc

SEQ ID NO: 1313083 - RNA, 19 nt, Human
ugcagggaggugugaugga

SEQ ID NO: 1313084 - RNA, 20 nt, Human
ugcagggaggugugauggag

SEQ ID NO: 1313085 - RNA, 18 nt, Human
uggcaggcccugcacuca

SEQ ID NO: 1313086 - RNA, 19 nt, Human
aaaacucccaggcaggcac

SEQ ID NO: 1313087 - RNA, 19 nt, Human
aaaagaugaauacaaaacu

SEQ ID NO: 1313088 - RNA, 22 nt, Human
aaauaccccagagaaaugcauc

SEQ ID NO: 1313089 - RNA, 19 nt, Human
aagagucuaacaggcagag

SEQ ID NO: 1313090 - RNA, 24 nt, Human
aaguaagagucuaacaggcagagc

SEQ ID NO: 1313091 - RNA, 21 nt, Human
acaaaaaagaacccauauuaa

SEQ ID NO: 1313092 - RNA, 23 nt, Human
acaacuauacaaaagaugaauac

SEQ ID NO: 1313093 - RNA, 22 nt, Human
acaaugaaaauagguacccaaa

SEQ ID NO: 1313094 - RNA, 19 nt, Human
acacaaaaaagaacccaua

SEQ ID NO: 1313095 - RNA, 24 nt, Human
agagaaaugcauccagaacuuaaa

SEQ ID NO: 1313096 - RNA, 19 nt, Human
agagucuaacaggcagagc

SEQ ID NO: 1313097 - RNA, 21 nt, Human
agcgagggaaaauagaaaaga

SEQ ID NO: 1313098 - RNA, 18 nt, Human
aggcaggcacaggcaggg

SEQ ID NO: 1313099 - RNA, 20 nt, Human
aggcugggucagcagcaggg

SEQ ID NO: 1313100 - RNA, 29 nt, Human
auacaaaagaugaauacaaaagggacccc

SEQ ID NO: 1313101 - RNA, 23 nt, Human
caaaaaagaacccauauuaaaau

SEQ ID NO: 1313102 - RNA, 19 nt, Human
caccgugccaccuuggucc

SEQ ID NO: 1313103 - RNA, 21 nt, Human
caccgugccaccuuggucccc

SEQ ID NO: 1313104 - RNA, 24 nt, Human
caccgugccaccuugguccccuca

SEQ ID NO: 1313105 - RNA, 20 nt, Human
caccuugguccccucaaccc

SEQ ID NO: 1313106 - RNA, 22 nt, Human
cagcagggcggcggccggggga

SEQ ID NO: 1313107 - RNA, 21 nt, Human
ccagagaaaugcauccagaaa

SEQ ID NO: 1313108 - RNA, 21 nt, Human
cccaaauaccccagagaaaug

SEQ ID NO: 1313109 - RNA, 18 nt, Human
ccccaguaccaccgugcc

SEQ ID NO: 1313110 - RNA, 19 nt, Human
cccccaguaccaccgugcc

SEQ ID NO: 1313111 - RNA, 21 nt, Human
cccccaguaccaccgugccac

SEQ ID NO: 1313112 - RNA, 21 nt, Human
ccccucaacccuggggguagg

SEQ ID NO: 1313113 - RNA, 26 nt, Human
cucgacuuuaaugguucagauaguuu

SEQ ID NO: 1313114 - RNA, 18 nt, Human
gccaucgucccguggacc

SEQ ID NO: 1313115 - RNA, 19 nt, Human
gccgggggaccucgggggc

SEQ ID NO: 1313116 - RNA, 21 nt, Human
ggacaaggcccaccgucuccc

SEQ ID NO: 1313117 - RNA, 22 nt, Human
ggcccaccgucucccacgcucu

SEQ ID NO: 1313118 - RNA, 20 nt, Human
gggucagcagcagggcggcg

SEQ ID NO: 1313119 - RNA, 19 nt, Human
guguggucgggugucccug

SEQ ID NO: 1313120 - RNA, 23 nt, Human
uaaaaauaagccccaaauacccc

SEQ ID NO: 1313121 - RNA, 22 nt, Human
uaaaucacacaaaaaagaaccc

SEQ ID NO: 1313122 - RNA, 19 nt, Human
uaagccccaaauaccccag

SEQ ID NO: 1313123 - RNA, 22 nt, Human
uaagccccaaauaccccagaga

SEQ ID NO: 1313124 - RNA, 21 nt, Human
uaccaccgugccaccuugguc

SEQ ID NO: 1313125 - RNA, 25 nt, Human
uaccccagagaaaugcauccagaag

SEQ ID NO: 1313126 - RNA, 21 nt, Human
uaggagggcacugccccagcg

SEQ ID NO: 1313127 - RNA, 24 nt, Human
uccacaacuauacaaaagaugaau

SEQ ID NO: 1313128 - RNA, 18 nt, Human
ugaaaauagguacccaaa

SEQ ID NO: 1313129 - RNA, 19 nt, Human
ugaaaauagguacccaaag

SEQ ID NO: 1313130 - RNA, 18 nt, Human
uggggguaggagggcacu

SEQ ID NO: 1313131 - RNA, 20 nt, Human
uguggucgggugucccugcc

SEQ ID NO: 1313132 - RNA, 21 nt, Human
uguggucgggugucccugccc

SEQ ID NO: 1313133 - RNA, 25 nt, Human
uguggucgggugucccugccgcacc

SEQ ID NO: 1313134 - RNA, 24 nt, Human
cacucagaaugcuuuauuuuacua

SEQ ID NO: 1313135 - RNA, 22 nt, Human
uaccugcuccuggccagcuuua

SEQ ID NO: 1313136 - RNA, 20 nt, Human
caccaaggccacuacaguca

SEQ ID NO: 1313137 - RNA, 22 nt, Human
caccuuuucucuucucucauca

SEQ ID NO: 1313138 - RNA, 22 nt, Human
cagucacagggcucuuucccag

SEQ ID NO: 1313139 - RNA, 20 nt, Human
ccaccuuuucucuucucuca

SEQ ID NO: 1313140 - RNA, 20 nt, Human
cccaccuuuucucuucucuc

SEQ ID NO: 1313141 - RNA, 24 nt, Human
cucuuucccagauauauaugaacg

SEQ ID NO: 1313142 - RNA, 21 nt, Human
uauaugaacgguuuuccugau

SEQ ID NO: 1313143 - RNA, 20 nt, Human
uuccugauuucaccagauug

SEQ ID NO: 1313144 - RNA, 24 nt, Human
uuuccugauuucaccagauugucc

SEQ ID NO: 1313145 - RNA, 22 nt, Human
aaaaaaaaaaucaguaauagga

SEQ ID NO: 1313146 - RNA, 22 nt, Human
aaaaaacuggucucacagcuua

SEQ ID NO: 1313147 - RNA, 19 nt, Human
aaaaagggacacaacuggg

SEQ ID NO: 1313148 - RNA, 24 nt, Human
aaacauuucaaagcaauggaauuc

SEQ ID NO: 1313149 - RNA, 22 nt, Human
aaaugaggcugcaaacuacccc

SEQ ID NO: 1313150 - RNA, 18 nt, Human
aaaugcacaggacaacac

SEQ ID NO: 1313151 - RNA, 20 nt, Human
aacuaccccugaauggccac

SEQ ID NO: 1313152 - RNA, 18 nt, Human
aagcaauggaauucaaaa

SEQ ID NO: 1313153 - RNA, 26 nt, Human
caaggaaaguuaaaaaaaaaaaucag

SEQ ID NO: 1313154 - RNA, 20 nt, Human
caggcucaagggcagccucc

SEQ ID NO: 1313155 - RNA, 18 nt, Human
cauuguagcugcuucugc

SEQ ID NO: 1313156 - RNA, 30 nt, Human; identical to SEQ ID NO: 1154252

SEQ ID NO: 1313157 - RNA, 20 nt, Human
ccccugacggccauuguagc

SEQ ID NO: 1313158 - RNA, 18 nt, Human
ccuccugcuguaaggaau

SEQ ID NO: 1313159 - RNA, 22 nt, Human
ccugacggccauuguagcugcu

SEQ ID NO: 1313160 - RNA, 18 nt, Human
cuuggcccuggcuauagc

SEQ ID NO: 1313161 - RNA, 27 nt, Human
gccccugacggccauuguagcugcuuc

SEQ ID NO: 1313162 - RNA, 22 nt, Human
ggcuauagcaggacccacaacc

SEQ ID NO: 1313163 - RNA, 24 nt, Human
uaaaaaaaaaaaucaguaauagga

SEQ ID NO: 1313164 - RNA, 28 nt, Human
uacaaaugaggcugcaaacuaccccuga

SEQ ID NO: 1313165 - RNA, 18 nt, Human
uaccauggguacugggua

SEQ ID NO: 1313166 - RNA, 22 nt, Human
uaccccugaauggccacgauuu

SEQ ID NO: 1313167 - RNA, 18 nt, Human
uccuggagcuuggcccug

SEQ ID NO: 1313168 - RNA, 21 nt, Human
ugcaaacuaccccugaauggc

SEQ ID NO: 1313169 - RNA, 23 nt, Human
ugcacaggacaacacaauaaugu

SEQ ID NO: 1313170 - RNA, 19 nt, Human
uguaaggaaucaaagcuua

SEQ ID NO: 1313171 - RNA, 23 nt, Human
uucaaagcaauggaauucaaaaa

SEQ ID NO: 1313172 - RNA, 23 nt, Human
aagcugccaaucucuccuggagc

SEQ ID NO: 1313173 - RNA, 18 nt, Human
aguucugucaucagagga

SEQ ID NO: 1313174 - RNA, 22 nt, Human
cacugcccacagaaaaggccaa

SEQ ID NO: 1313175 - RNA, 22 nt, Human
cagaaaaggccaauccuugaua

SEQ ID NO: 1313176 - RNA, 20 nt, Human
ccgggagcugggggguuguu

SEQ ID NO: 1313177 - RNA, 22 nt, Human
gagcgggugggacuaaggaggg

SEQ ID NO: 1313178 - RNA, 23 nt, Human
gagggccccgggagcuggggggu

SEQ ID NO: 1313179 - RNA, 22 nt, Human
ggagcgggugggacuaaggagg

SEQ ID NO: 1313180 - RNA, 19 nt, Human
ggugggacuaaggagggcc

SEQ ID NO: 1313181 - RNA, 23 nt, Human
uagggccgcgugugagagacaaa

SEQ ID NO: 1313182 - RNA, 18 nt, Human
ucuggcgcaggugcgaga

SEQ ID NO: 1313183 - RNA, 22 nt, Human
ugcccacagaaaaggccaaucc

SEQ ID NO: 1313184 - RNA, 22 nt, Human
uugauaguucauuuucacugaa

SEQ ID NO: 1313185 - RNA, 18 nt, Human
aaaugcaccuugguggca

SEQ ID NO: 1313186 - RNA, 19 nt, Human
aagaggggggcuggugaac

SEQ ID NO: 1313187 - RNA, 23 nt, Human
aagaggggggcuggugaacaaaa

SEQ ID NO: 1313188 - RNA, 19 nt, Human
aagccucaggcccccucug

SEQ ID NO: 1313189 - RNA, 18 nt, Human
aagggccccagcuucuuc

SEQ ID NO: 1313190 - RNA, 18 nt, Human
acauuucauccuggcucu

SEQ ID NO: 1313191 - RNA, 18 nt, Human
agagagcagccuuuuugg

SEQ ID NO: 1313192 - RNA, 23 nt, Human
agcugaagccugcagcuccacgg

SEQ ID NO: 1313193 - RNA, 22 nt, Human
aggcaaaacuggugaaggccug

SEQ ID NO: 1313194 - RNA, 19 nt, Human
aggcagcugaagccugcag

SEQ ID NO: 1313195 - RNA, 21 nt, Human
aggcggcccagauagaaggcg

SEQ ID NO: 1313196 - RNA, 20 nt, Human
agggaauagguggguggagg

SEQ ID NO: 1313197 - RNA, 22 nt, Human
agggagccauguggucaggccu

SEQ ID NO: 1313198 - RNA, 25 nt, Human
aggggggcuggugaacaaaagaagg

SEQ ID NO: 1313199 - RNA, 20 nt, Human
aggugggcagacagguaagc

SEQ ID NO: 1313200 - RNA, 18 nt, Human
agguguggaagggaaaau

SEQ ID NO: 1313201 - RNA, 21 nt, Human
augagaacugccccucacuga

SEQ ID NO: 1313202 - RNA, 18 nt, Human
caaaagcaggcgaagggc

SEQ ID NO: 1313203 - RNA, 21 nt, Human
cacagccuggcucagccaccc

SEQ ID NO: 1313204 - RNA, 27 nt, Human
cacgcaguugccaaacccgugguuguc

SEQ ID NO: 1313205 - RNA, 21 nt, Human
cagccaugagaacugccccuc

SEQ ID NO: 1313206 - RNA, 21 nt, Human
caggcgcuccgugcacagccu

SEQ ID NO: 1313207 - RNA, 19 nt, Human
cagggcaggcgagggagcc

SEQ ID NO: 1313208 - RNA, 21 nt, Human
caggugggcagacagguaagc

SEQ ID NO: 1313209 - RNA, 23 nt, Human
ccaaaggcaaaacuggugaaggc

SEQ ID NO: 1313210 - RNA, 19 nt, Human
ccacuggcgguguccucuc

SEQ ID NO: 1313211 - RNA, 18 nt, Human
ccagccaugagaacugcc

SEQ ID NO: 1313212 - RNA, 18 nt, Human
cccacagggucugggcca

SEQ ID NO: 1313213 - RNA, 19 nt, Human
cccagaacuuccagagagu

SEQ ID NO: 1313214 - RNA, 22 nt, Human
ccccucuggucucuccaggguc

SEQ ID NO: 1313215 - RNA, 25 nt, Human
ccucaggacccugggccccaccggg

SEQ ID NO: 1313216 - RNA, 19 nt, Human
ccucaggcccccucugguc

SEQ ID NO: 1313217 - RNA, 23 nt, Human
ccucugacauuucauccuggcuc

SEQ ID NO: 1313218 - RNA, 20 nt, Human
ccuggaccaugaaggugacc

SEQ ID NO: 1313219 - RNA, 21 nt, Human
ccuggaucaucugaauuuccc

SEQ ID NO: 1313220 - RNA, 23 nt, Human
ccuggcccuuguuccagacaggu

SEQ ID NO: 1313221 - RNA, 18 nt, Human
ccuggcucagccacccgg

SEQ ID NO: 1313222 - RNA, 23 nt, Human
ccuucgccaucuaauugaagccc

SEQ ID NO: 1313223 - RNA, 19 nt, Human
cggcccagauagaaggcga

SEQ ID NO: 1313224 - RNA, 23 nt, Human
cguugguggucuccaggcggccc

SEQ ID NO: 1313225 - RNA, 18 nt, Human
cucugacauuucauccug

SEQ ID NO: 1313226 - RNA, 21 nt, Human
cuggaccaugaaggugaccag

SEQ ID NO: 1313227 - RNA, 22 nt, Human
cugggcugguggacaaaagagg

SEQ ID NO: 1313228 - RNA, 21 nt, Human
cuggugaacaaaagaaggagg

SEQ ID NO: 1313229 - RNA, 21 nt, Human
cugguggacaaaagagggggg

SEQ ID NO: 1313230 - RNA, 22 nt, Human
gacucccagcuguaugaucuua

SEQ ID NO: 1313231 - RNA, 20 nt, Human
gagcugggugagggagcggg

SEQ ID NO: 1313232 - RNA, 18 nt, Human
gaggagcugggugaggga

SEQ ID NO: 1313233 - RNA, 24 nt, Human
gagugaguaaucaguguguccagg

SEQ ID NO: 1313234 - RNA, 22 nt, Human
gaucaucugaauuucccuuuga

SEQ ID NO: 1313235 - RNA, 22 nt, Human
gcacagccuggcucagccaccc

SEQ ID NO: 1313236 - RNA, 21 nt, Human
gccuggugcuccccuguggcc

SEQ ID NO: 1313237 - RNA, 18 nt, Human
gcgcuggucguuccaguu

SEQ ID NO: 1313238 - RNA, 19 nt, Human
gcugguggacaaaagaggg

SEQ ID NO: 1313239 - RNA, 18 nt, Human
gcuuguuucucaggcugg

SEQ ID NO: 1313240 - RNA, 22 nt, Human
ggacaaaagaggggggcuggug

SEQ ID NO: 1313241 - RNA, 19 nt, Human
ggccagcaccccgccuuuc

SEQ ID NO: 1313242 - RNA, 25 nt, Human
ggccgcugcagugaagccucaggcc

SEQ ID NO: 1313243 - RNA, 21 nt, Human
gggcagacagguaagcagagc

SEQ ID NO: 1313244 - RNA, 22 nt, Human
gggcugguggacaaaagagggg

SEQ ID NO: 1313245 - RNA, 18 nt, Human
gguguccucuccuucgcc

SEQ ID NO: 1313246 - RNA, 21 nt, Human
guuccuggucucgaagucacu

SEQ ID NO: 1313247 - RNA, 23 nt, Human
guugguggucuccaggcggccca

SEQ ID NO: 1313248 - RNA, 22 nt, Human
uaacacucacucccuggcccuc

SEQ ID NO: 1313249 - RNA, 24 nt, Human
uacccugccugccugggccccagc

SEQ ID NO: 1313250 - RNA, 23 nt, Human
uaggugagcccgauccagaaguu

SEQ ID NO: 1313251 - RNA, 21 nt, Human
ucacuggccucccugccucuc

SEQ ID NO: 1313252 - RNA, 22 nt, Human
ucacuggccucccugccucucu

SEQ ID NO: 1313253 - RNA, 19 nt, Human
uccacgcaguugccaaacc

SEQ ID NO: 1313254 - RNA, 23 nt, Human
uccacgcaguugccaaacccgug

SEQ ID NO: 1313255 - RNA, 24 nt, Human
ucccagcuguaugaucuuaugcaa

SEQ ID NO: 1313256 - RNA, 24 nt, Human
uccgugcacagccuggcucagcca

SEQ ID NO: 1313257 - RNA, 21 nt, Human
uccucugacauuucauccugg

SEQ ID NO: 1313258 - RNA, 19 nt, Human
ucggguuuugcagcgcugg

SEQ ID NO: 1313259 - RNA, 20 nt, Human
ucuuggggagacccagaacu

SEQ ID NO: 1313260 - RNA, 22 nt, Human
ugaagacaccaugaagcagucu

SEQ ID NO: 1313261 - RNA, 20 nt, Human
ugaaggcagcugaagccugg

SEQ ID NO: 1313262 - RNA, 20 nt, Human
ugaaggugaccaggaaaggg

SEQ ID NO: 1313263 - RNA, 20 nt, Human
ugaggagcugggugagggaa

SEQ ID NO: 1313264 - RNA, 23 nt, Human
ugauaaccccuugugggugaugu

SEQ ID NO: 1313265 - RNA, 21 nt, Human
ugcaaguuacucaaucucucu

SEQ ID NO: 1313266 - RNA, 23 nt, Human
uggaagagagcagccuuuuugga

SEQ ID NO: 1313267 - RNA, 19 nt, Human
uggacaaaagaggggggcu

SEQ ID NO: 1313268 - RNA, 20 nt, Human
uggcccagcggaaggagucc

SEQ ID NO: 1313269 - RNA, 22 nt, Human
ugggugaugucugaggagcugg

SEQ ID NO: 1313270 - RNA, 21 nt, Human
uggguggaggccgcugcagug

SEQ ID NO: 1313271 - RNA, 20 nt, Human
uggucaggccucaggacccu

SEQ ID NO: 1313272 - RNA, 19 nt, Human
ugguggacaaaagaggggg

SEQ ID NO: 1313273 - RNA, 30 nt, Human
uguaauaggugucugccucugaagacaccc

SEQ ID NO: 1313274 - RNA, 18 nt, Human
ugucugaggagcugggug

SEQ ID NO: 1313275 - RNA, 20 nt, Human
ugucugaggagcugggugag

SEQ ID NO: 1313276 - RNA, 19 nt, Human
uguggucaggccucaggac

SEQ ID NO: 1313277 - RNA, 19 nt, Human
uguggucaggccucaggac

SEQ ID NO: 1313278 - RNA, 18 nt, Human
uucauaauuuaauacccc

SEQ ID NO: 1313279 - RNA, 22 nt, Human
uuccuggucucgaagucacugu

SEQ ID NO: 1313280 - RNA, 20 nt, Human
uuucggguuuugcagcgcug

SEQ ID NO: 1313281 - RNA, 23 nt, Human
aaauggcccagaugcacaaaagc

SEQ ID NO: 1313282 - RNA, 24 nt, Human
auaacaacaguagauuaaugacca

SEQ ID NO: 1313283 - RNA, 22 nt, Human
caaaagcucuagcacucuuguu

SEQ ID NO: 1313284 - RNA, 21 nt, Human
caggucacuuccaccuugcag

SEQ ID NO: 1313285 - RNA, 23 nt, Human
ccuugcagguucuuagauucuuc

SEQ ID NO: 1313286 - RNA, 20 nt, Human
gcccagaugcacaaaagcuc

SEQ ID NO: 1313287 - RNA, 18 nt, Human
gcuacaucugcuuuugac

SEQ ID NO: 1313288 - RNA, 22 nt, Human
uaguaguccucccacugagcuu

SEQ ID NO: 1313289 - RNA, 23 nt, Human
uaguaguccucccacugagcuuu

SEQ ID NO: 1313290 - RNA, 21 nt, Human
ugcacaaaagcucuagcacuc

SEQ ID NO: 1313291 - RNA, 20 nt, Human
uugcagguucuuagauucuu

SEQ ID NO: 1313292 - RNA, 23 nt, Human
aaagagauggaccuccuggacca

SEQ ID NO: 1313293 - RNA, 25 nt, Human
aaagagauggaccuccuggaccaag

SEQ ID NO: 1313294 - RNA, 21 nt, Human
aggagagcaugucccuccucc

SEQ ID NO: 1313295 - RNA, 29 nt, Human
caaagagauggaccuccuggaccaacugg

SEQ ID NO: 1313296 - RNA, 23 nt, Human
caaggacaaagagcacaaucugg

SEQ ID NO: 1313297 - RNA, 21 nt, Human
caccguagugacuccccgaca

SEQ ID NO: 1313298 - RNA, 22 nt, Human
cccgacagcucugucccugccc

SEQ ID NO: 1313299 - RNA, 23 nt, Human
cccugcccggcucagacucuccu

SEQ ID NO: 1313300 - RNA, 21 nt, Human
ccuggaccaaggacaaagagc

SEQ ID NO: 1313301 - RNA, 22 nt, Human
cuccuaugcagcuaggaguaag

SEQ ID NO: 1313302 - RNA, 19 nt, Human
cuccuggaccaaggacaaa

SEQ ID NO: 1313303 - RNA, 21 nt, Human
gaccaaggacaaagagcacaa

SEQ ID NO: 1313304 - RNA, 19 nt, Human
uagugacuccccgacagcu

SEQ ID NO: 1313305 - RNA, 23 nt, Human
uccccgacagcucugucccuggc

SEQ ID NO: 1313306 - RNA, 20 nt, Human
ucuccuaugcagcuaggagu

SEQ ID NO: 1313307 - RNA, 21 nt, Human
uuagaggaaacugaugcucaa

SEQ ID NO: 1313308 - RNA, 22 nt, Human
acuggccucccugccuggcccc

SEQ ID NO: 1313309 - RNA, 25 nt, Human
agagcaggcgccacuucuggaaccu

SEQ ID NO: 1313310 - RNA, 19 nt, Human
agagugaccucaagucacu

SEQ ID NO: 1313311 - RNA, 22 nt, Human
aggaagagugaccucaagucac

SEQ ID NO: 1313312 - RNA, 23 nt, Human
augcacccuccuccagcauccaa

SEQ ID NO: 1313313 - RNA, 18 nt, Human
caacucauggguccaccu

SEQ ID NO: 1313314 - RNA, 24 nt, Human
cacaccaccagcuuucccggggcu

SEQ ID NO: 1313315 - RNA, 24 nt, Human
cacucgugugaccacgcgggguug

SEQ ID NO: 1313316 - RNA, 20 nt, Human
cagcucccgggugcugcccu

SEQ ID NO: 1313317 - RNA, 24 nt, Human
ccauggcccucugcaccgccuccu

SEQ ID NO: 1313318 - RNA, 19 nt, Human
cccgggugcugcccucagg

SEQ ID NO: 1313319 - RNA, 18 nt, Human
cccuggggcugauguggg

SEQ ID NO: 1313320 - RNA, 21 nt, Human
ccugccuggccccuuccaugc

SEQ ID NO: 1313321 - RNA, 21 nt, Human
ccugugaaaacccacgucaga

SEQ ID NO: 1313322 - RNA, 23 nt, Human
ccugugaaaacccacgucagacc

SEQ ID NO: 1313323 - RNA, 22 nt, Human
ccuuccaugcacccuccuccag

SEQ ID NO: 1313324 - RNA, 18 nt, Human
cgucagaccauggcccuc

SEQ ID NO: 1313325 - RNA, 19 nt, Human
cugcaccgccuccugcaag

SEQ ID NO: 1313326 - RNA, 24 nt, Human
cugcaccgccuccugcaaggcaug

SEQ ID NO: 1313327 - RNA, 22 nt, Human
cuucucugaaggaccccaacuc

SEQ ID NO: 1313328 - RNA, 20 nt, Human
cuucuggaaccuuccccacc

SEQ ID NO: 1313329 - RNA, 21 nt, Human
cuucuggaaccuuccccacca

SEQ ID NO: 1313330 - RNA, 22 nt, Human
gcacccuccuccagcauccaag

SEQ ID NO: 1313331 - RNA, 18 nt, Human
gcagcugcugcucacugg

SEQ ID NO: 1313332 - RNA, 23 nt, Human
gcaugcaguggaggaagagugac

SEQ ID NO: 1313333 - RNA, 22 nt, Human
gcuugcacuggagccacaccac

SEQ ID NO: 1313334 - RNA, 19 nt, Human
ggagcagggauguagguuu

SEQ ID NO: 1313335 - RNA, 20 nt, Human
uccaagucccaucacacuuu

SEQ ID NO: 1313336 - RNA, 20 nt, Human
ucucugaaggaccccaacuc

SEQ ID NO: 1313337 - RNA, 25 nt, Human
ugaaggaccccaacucaugggucca

SEQ ID NO: 1313338 - RNA, 19 nt, Human
ugaccacgcgggguugccc

SEQ ID NO: 1313339 - RNA, 20 nt, Human
ugcaguggaggaagagugac

SEQ ID NO: 1313340 - RNA, 22 nt, Human
uggccccuuccaugcacccucc

SEQ ID NO: 1313341 - RNA, 20 nt, Human
uggggcugauguggggggca

SEQ ID NO: 1313342 - RNA, 20 nt, Human
ugugaaaacccacgucagac

SEQ ID NO: 1313343 - RNA, 18 nt, Human
uuccaugcacccuccucc

SEQ ID NO: 1313344 - RNA, 20 nt, Human
cagcgcggggacaccggcag

SEQ ID NO: 1313345 - RNA, 20 nt, Human
ccccgggaccagcagcgcgg

SEQ ID NO: 1313346 - RNA, 21 nt, Human
aagccaugauguaaugaacaa

SEQ ID NO: 1313347 - RNA, 20 nt, Human
aagggcccaaaagccaugau

SEQ ID NO: 1313348 - RNA, 19 nt, Human
acaaugugggcaccagaac

SEQ ID NO: 1313349 - RNA, 22 nt, Human
caucacaauuuuucugaaccaa

SEQ ID NO: 1313350 - RNA, 18 nt, Human
cccaaagggcccaaaagc

SEQ ID NO: 1313351 - RNA, 21 nt, Human
cuccagagggcuuccuuuagg

SEQ ID NO: 1313352 - RNA, 22 nt, Human
gaggcucagcuccagagggcuu

SEQ ID NO: 1313353 - RNA, 22 nt, Human
gaggucccaaagggcccaaaag

SEQ ID NO: 1313354 - RNA, 21 nt, Human
ucccaaagggcccaaaagcca

SEQ ID NO: 1313355 - RNA, 23 nt, Human
cgaggccaggugucuugcacuca

SEQ ID NO: 1313356 - RNA, 20 nt, Human
cgcuggagacgaggccaggu

SEQ ID NO: 1313357 - RNA, 18 nt, Human
cuggggggggacaggggc

SEQ ID NO: 1313358 - RNA, 20 nt, Human
gcgugcucuggggggggaca

SEQ ID NO: 1313359 - RNA, 23 nt, Human
ggacaggggcugggucagggcag

SEQ ID NO: 1313360 - RNA, 22 nt, Human
gggcaggcgucugaccaugaag

SEQ ID NO: 1313361 - RNA, 22 nt, Human
ugcucuggggggggacaggggc

SEQ ID NO: 1313362 - RNA, 18 nt, Human
uggagacgaggccaggug

SEQ ID NO: 1313363 - RNA, 19 nt, Human
uggggggggacaggggcug

SEQ ID NO: 1313364 - RNA, 19 nt, Human
uggggggggacaggggcug

SEQ ID NO: 1313365 - RNA, 21 nt, Human
uggggggggacaggggcuggg

SEQ ID NO: 1313366 - RNA, 20 nt, Human
aagacccugacccugcuccg

SEQ ID NO: 1313367 - RNA, 23 nt, Human
aagcccagcaggcccaggaguga

SEQ ID NO: 1313368 - RNA, 23 nt, Human
acaagcagcaccgccagcuuagc

SEQ ID NO: 1313369 - RNA, 29 nt, Human
accccaaagggcggcugccacacagaggg

SEQ ID NO: 1313370 - RNA, 19 nt, Human
agagcuggggggaucugga

SEQ ID NO: 1313371 - RNA, 20 nt, Human
agcaggugcaccccugcucc

SEQ ID NO: 1313372 - RNA, 21 nt, Human
agccacaagcccagcaggccc

SEQ ID NO: 1313373 - RNA, 19 nt, Human
aggcccaggagugaggcga

SEQ ID NO: 1313374 - RNA, 19 nt, Human
agugguagauggugaagau

SEQ ID NO: 1313375 - RNA, 18 nt, Human
caccccugcuccagccac

SEQ ID NO: 1313376 - RNA, 23 nt, Human
caccccugcuccagccacgaggg

SEQ ID NO: 1313377 - RNA, 19 nt, Human
cagaaaaagaggaugaagg

SEQ ID NO: 1313378 - RNA, 23 nt, Human
ccacacagaggauccagcugugu

SEQ ID NO: 1313379 - RNA, 21 nt, Human
ccaccagcgucacaagcagca

SEQ ID NO: 1313380 - RNA, 21 nt, Human
ccagccccaccgagcacacgc

SEQ ID NO: 1313381 - RNA, 18 nt, Human
ccccaaagggcggcugcc

SEQ ID NO: 1313382 - RNA, 23 nt, Human
ccgccgcagcuucugcugcaucc

SEQ ID NO: 1313383 - RNA, 23 nt, Human
ccuugugcuggggccgcgggaug

SEQ ID NO: 1313384 - RNA, 21 nt, Human
cgcuccagccccaccgagcac

SEQ ID NO: 1313385 - RNA, 18 nt, Human
cggcgcuggggcgccugc

SEQ ID NO: 1313386 - RNA, 19 nt, Human
cggcgcuggggcgccugcu

SEQ ID NO: 1313387 - RNA, 26 nt, Human
cggcggacccuggggauaggaggugc

SEQ ID NO: 1313388 - RNA, 22 nt, Human
cucggcggacccuggggauagg

SEQ ID NO: 1313389 - RNA, 24 nt, Human
cugcugcauccgcagguaggagac

SEQ ID NO: 1313390 - RNA, 18 nt, Human
cuguaaaaaaucguggcu

SEQ ID NO: 1313391 - RNA, 18 nt, Human
gaagauggccacagccug

SEQ ID NO: 1313392 - RNA, 25 nt, Human
gaaggugagcagcaggugcaccccc

SEQ ID NO: 1313393 - RNA, 20 nt, Human
gacacaggggcccagaaaaa

SEQ ID NO: 1313394 - RNA, 21 nt, Human
gagagcuggggggaucuggag

SEQ ID NO: 1313395 - RNA, 22 nt, Human
gagcggggccgggucgcaagaa

SEQ ID NO: 1313396 - RNA, 23 nt, Human
gagcggggccgggucgcaagaag

SEQ ID NO: 1313397 - RNA, 18 nt, Human
gcucucggcggacccugg

SEQ ID NO: 1313398 - RNA, 19 nt, Human
ggagaccgcggcggccacc

SEQ ID NO: 1313399 - RNA, 19 nt, Human
ggggccgcgggaugcaggg

SEQ ID NO: 1313400 - RNA, 23 nt, Human
gguccgaggccgagagcuggggg

SEQ ID NO: 1313401 - RNA, 25 nt, Human
gguccgaggccgagagcugggggga

SEQ ID NO: 1313402 - RNA, 21 nt, Human
ggugaagauggccacagccug

SEQ ID NO: 1313403 - RNA, 18 nt, Human
guccaguuuuguucaggg

SEQ ID NO: 1313404 - RNA, 20 nt, Human
gugaggcgacugaggcgucc

SEQ ID NO: 1313405 - RNA, 22 nt, Human
gugcaccccugcuccagccacg

SEQ ID NO: 1313406 - RNA, 18 nt, Human
guggcucucggcggaccc

SEQ ID NO: 1313407 - RNA, 21 nt, Human
uaagccagccgcuccagcccc

SEQ ID NO: 1313408 - RNA, 22 nt, Human
uaggagaccgcggcggccacca

SEQ ID NO: 1313409 - RNA, 24 nt, Human
ucagggugcugcccacaccccaaa

SEQ ID NO: 1313410 - RNA, 18 nt, Human
uccagccccaccgagcac

SEQ ID NO: 1313411 - RNA, 22 nt, Human
uccgaggccgagagcugggggg

SEQ ID NO: 1313412 - RNA, 21 nt, Human
uccgcagguaggagaccgcgg

SEQ ID NO: 1313413 - RNA, 22 nt, Human
ucucguccgaguuguccuccuc

SEQ ID NO: 1313414 - RNA, 24 nt, Human
ucucguccgaguuguccuccucca

SEQ ID NO: 1313415 - RNA, 21 nt, Human
ucuucguacaagauucccagg

SEQ ID NO: 1313416 - RNA, 19 nt, Human
ugaagauggccacagccug

SEQ ID NO: 1313417 - RNA, 18 nt, Human
ugagcagcaggugcaccc

SEQ ID NO: 1313418 - RNA, 24 nt, Human
ugaguccaguuuuguucagggugc

SEQ ID NO: 1313419 - RNA, 22 nt, Human
ugcugcccacaccccaaagggc

SEQ ID NO: 1313420 - RNA, 22 nt, Human
uggcgcggggccacgccccgcc

SEQ ID NO: 1313421 - RNA, 23 nt, Human
aaacauuuagaacuaguggaaua

SEQ ID NO: 1313422 - RNA, 20 nt, Human
agacucaagauauucaacag

SEQ ID NO: 1313423 - RNA, 19 nt, Human
agugcccagauugcucuuc

SEQ ID NO: 1313424 - RNA, 20 nt, Human
auaaaucucugcaacaggaa

SEQ ID NO: 1313425 - RNA, 18 nt, Human
cacugagagaggcacagg

SEQ ID NO: 1313426 - RNA, 23 nt, Human
cagaaccuccagauuuaugccac

SEQ ID NO: 1313427 - RNA, 23 nt, Human
ccagaucagccugaauacuucac

SEQ ID NO: 1313428 - RNA, 19 nt, Human
ccagugguaacagugccca

SEQ ID NO: 1313429 - RNA, 24 nt, Human
cugcaacaggaauuucuaaagccu

SEQ ID NO: 1313430 - RNA, 21 nt, Human
uaucccuuuugauucucaggg

SEQ ID NO: 1313431 - RNA, 19 nt, Human
ucacugagagaggcacagg

SEQ ID NO: 1313432 - RNA, 23 nt, Human
ucacuggaaacauacaauguugu

SEQ ID NO: 1313433 - RNA, 19 nt, Human
ucagauuauuucugcuuca

SEQ ID NO: 1313434 - RNA, 23 nt, Human
ucauuuguaugccucucaagccu

SEQ ID NO: 1313435 - RNA, 23 nt, Human
ucugcaacaggaauuucuaaagc

SEQ ID NO: 1313436 - RNA, 23 nt, Human
uguaugccucucaagccugucuu

SEQ ID NO: 1313437 - RNA, 21 nt, Human
uucaaaaugcagaaggaaggg

SEQ ID NO: 1313438 - RNA, 22 nt, Human
uucauuauuucaucauucucca

SEQ ID NO: 1313439 - RNA, 23 nt, Human
uuugcagaaccuccagauuuaug

SEQ ID NO: 1313440 - RNA, 19 nt, Human
acaaccgcacaaggccaaa

SEQ ID NO: 1313441 - RNA, 26 nt, Human
agaaguucugcuguuuuugauguccc

SEQ ID NO: 1313442 - RNA, 21 nt, Human
agagaacgagcuggacguugg

SEQ ID NO: 1313443 - RNA, 19 nt, Human
cucuguggugagaaggccc

SEQ ID NO: 1313444 - RNA, 20 nt, Human
ugagaaggcccagagaacgg

SEQ ID NO: 1313445 - RNA, 18 nt, Human
ugagagaugacccagagg

SEQ ID NO: 1313446 - RNA, 22 nt, Human
aaguauaugauggcauugaagg

SEQ ID NO: 1313447 - RNA, 21 nt, Human
cauaggaugaagcuugacuga

SEQ ID NO: 1313448 - RNA, 19 nt, Human
cucuccuguaugaauucua

SEQ ID NO: 1313449 - RNA, 23 nt, Human
gaacaugaaguaaaggcuuugcc

SEQ ID NO: 1313450 - RNA, 24 nt, Human
gaaguauaugauggcauugaaggg

SEQ ID NO: 1313451 - RNA, 18 nt, Human
gaccacagagugaagacc

SEQ ID NO: 1313452 - RNA, 22 nt, Human
uccaguaugaguucacugagga

SEQ ID NO: 1313453 - RNA, 18 nt, Human
ugaaguaaaggcuuugcc

SEQ ID NO: 1313454 - RNA, 20 nt, Human
ugcauggaaugaccacagag

SEQ ID NO: 1313455 - RNA, 18 nt, Human
ugucacagucaugauauu

SEQ ID NO: 1313456 - RNA, 22 nt, Human
ugucacauucuucacauuugua

SEQ ID NO: 1313457 - RNA, 21 nt, Human
ugugagguuucucuccuguau

SEQ ID NO: 1313458 - RNA, 19 nt, Human
uuuguaagguuucucucca

SEQ ID NO: 1313459 - RNA, 19 nt, Human
uuuguaagguuucucucca

SEQ ID NO: 1313460 - RNA, 19 nt, Human
aaaaaccuugccacauuca

SEQ ID NO: 1313461 - RNA, 19 nt, Human
aaaaaccuugccacauuca

SEQ ID NO: 1313462 - RNA, 21 nt, Human
aaacaaaaaacagacugggaa

SEQ ID NO: 1313463 - RNA, 23 nt, Human
aaacagacugggaaaggugcuca

SEQ ID NO: 1313464 - RNA, 24 nt, Human
aaagugcugggauuacagguguga

SEQ ID NO: 1313465 - RNA, 21 nt, Human
aaccaagcagggaaaauagaa

SEQ ID NO: 1313466 - RNA, 30 nt, Human; identical to SEQ ID NO: 596555

SEQ ID NO: 1313467 - RNA, 24 nt, Human
aagugaucuaccugucuuggccuc

SEQ ID NO: 1313468 - RNA, 18 nt, Human
aagugcugggauuacagg

SEQ ID NO: 1313469 - RNA, 19 nt, Human
aagugcugggauuacaggu

SEQ ID NO: 1313470 - RNA, 26 nt, Human
aagugcugggauuacaggugugagcc

SEQ ID NO: 1313471 - RNA, 23 nt, Human
aauuuugaacaaaggucuugcca

SEQ ID NO: 1313472 - RNA, 23 nt, Human
acaauacaauaucagcaccaaaa

SEQ ID NO: 1313473 - RNA, 21 nt, Human
acauucauuacacuuguaaca

SEQ ID NO: 1313474 - RNA, 23 nt, Human
accugucuuggccucccaaagug

SEQ ID NO: 1313475 - RNA, 18 nt, Human
acugaggacuuugugaca

SEQ ID NO: 1313476 - RNA, 19 nt, Human
agaaauauggguuuuagga

SEQ ID NO: 1313477 - RNA, 22 nt, Human
agaaggaaauuuaccucaccaa

SEQ ID NO: 1313478 - RNA, 22 nt, Human
agcaaugaacuagcaaaagaaa

SEQ ID NO: 1313479 - RNA, 18 nt, Human
agccaccgcaccuggccu

SEQ ID NO: 1313480 - RNA, 20 nt, Human
aguaaaguuucccuaugaca

SEQ ID NO: 1313481 - RNA, 19 nt, Human
agugccauuuacuucuggc

SEQ ID NO: 1313482 - RNA, 20 nt, Human
auauaccacuugaacagaau

SEQ ID NO: 1313483 - RNA, 18 nt, Human
auaugacuuuuguaagau

SEQ ID NO: 1313484 - RNA, 24 nt, Human
caaagugcugggauuacaggugug

SEQ ID NO: 1313485 - RNA, 26 nt, Human
caaccaaaauacuacugugacuaaua

SEQ ID NO: 1313486 - RNA, 25 nt, Human
caacucaaacugaacucaaugcuga

SEQ ID NO: 1313487 - RNA, 22 nt, Human
caagugaucuaccugucuuggc

SEQ ID NO: 1313488 - RNA, 22 nt, Human
caauagaaagaccauugaugaa

SEQ ID NO: 1313489 - RNA, 18 nt, Human
caaugguuguagcauuac

SEQ ID NO: 1313490 - RNA, 24 nt, Human
cacauucauuacacuuguaacauu

SEQ ID NO: 1313491 - RNA, 23 nt, Human
caccaaaaauucguugaauuuuc

SEQ ID NO: 1313492 - RNA, 18 nt, Human
cacccgaaugccuuguca

SEQ ID NO: 1313493 - RNA, 18 nt, Human
caccuggccuaauccucu

SEQ ID NO: 1313494 - RNA, 24 nt, Human
cagacuaaagaucuugccacacau

SEQ ID NO: 1313495 - RNA, 21 nt, Human
cagagcaaugaacuagcaaaa

SEQ ID NO: 1313496 - RNA, 24 nt, Human
cagugugaauucuaguauguugug

SEQ ID NO: 1313497 - RNA, 25 nt, Human
caugaaccugaaauaaaggcuuuga

SEQ ID NO: 1313498 - RNA, 21 nt, Human
ccaaagugcugggauuacagg

SEQ ID NO: 1313499 - RNA, 21 nt, Human
ccaaagugcugggauuacagg

SEQ ID NO: 1313500 - RNA, 24 nt, Human
ccaaagugcugggauuacaggugu

SEQ ID NO: 1313501 - RNA, 24 nt, Human
ccacacauaugacuuuuguaagau

SEQ ID NO: 1313502 - RNA, 25 nt, Human
ccgcaccuggccuaauccucuuaac

SEQ ID NO: 1313503 - RNA, 24 nt, Human
ccucuuaacauaaacacuuuaauc

SEQ ID NO: 1313504 - RNA, 21 nt, Human
ccugaucucaagugaucuacc

SEQ ID NO: 1313505 - RNA, 23 nt, Human
ccugaucucaagugaucuaccug

SEQ ID NO: 1313506 - RNA, 24 nt, Human
cucaaaaucagaaaaaguaaaauu

SEQ ID NO: 1313507 - RNA, 23 nt, Human
cucaagugaucuaccugucuugg

SEQ ID NO: 1313508 - RNA, 20 nt, Human
cucuccagugugaauucuag

SEQ ID NO: 1313509 - RNA, 18 nt, Human
cugaccacugaaggcucu

SEQ ID NO: 1313510 - RNA, 22 nt, Human
cugggaaaggugcucaccucug

SEQ ID NO: 1313511 - RNA, 23 nt, Human
cugggaaaggugcucaccucugu

SEQ ID NO: 1313512 - RNA, 23 nt, Human
cugucuuggccucccaaagugcu

SEQ ID NO: 1313513 - RNA, 20 nt, Human
cuugacugaagaccuugcca

SEQ ID NO: 1313514 - RNA, 19 nt, Human
cuugcacgguuucucucca

SEQ ID NO: 1313515 - RNA, 19 nt, Human
cuuguaacauuucucucca

SEQ ID NO: 1313516 - RNA, 19 nt, Human
cuuguaagguuucucucca

SEQ ID NO: 1313517 - RNA, 19 nt, Human
gaaaauagaauccuuuucc

SEQ ID NO: 1313518 - RNA, 22 nt, Human
gaccucagacuaaagaucuugc

SEQ ID NO: 1313519 - RNA, 20 nt, Human
gagaaggaaauuuaccucac

SEQ ID NO: 1313520 - RNA, 18 nt, Human
gauuacaggugugagcca

SEQ ID NO: 1313521 - RNA, 22 nt, Human
gauuacaggugugagccaccgc

SEQ ID NO: 1313522 - RNA, 23 nt, Human
gauuacaggugugagccaccgca

SEQ ID NO: 1313523 - RNA, 21 nt, Human
gcaaaagaaaugaaaugccuc

SEQ ID NO: 1313524 - RNA, 20 nt, Human
gcaaugaacuagcaaaagaa

SEQ ID NO: 1313525 - RNA, 22 nt, Human
gucuuggccucccaaagugcug

SEQ ID NO: 1313526 - RNA, 21 nt, Human
uaaacaaaauagauggagaag

SEQ ID NO: 1313527 - RNA, 18 nt, Human
uaaaugauuacauaaccc

SEQ ID NO: 1313528 - RNA, 18 nt, Human
uacacuuguaacauuucu

SEQ ID NO: 1313529 - RNA, 22 nt, Human
uacaggugugagccaccgcacc

SEQ ID NO: 1313530 - RNA, 23 nt, Human
uacaggugugagccaccgcaccu

SEQ ID NO: 1313531 - RNA, 23 nt, Human
uaccucaaaaaugaauuuccuga

SEQ ID NO: 1313532 - RNA, 23 nt, Human
uaccugucuuggccucccaaagu

SEQ ID NO: 1313533 - RNA, 21 nt, Human
uagccagagcaaugaacuagc

SEQ ID NO: 1313534 - RNA, 23 nt, Human
uagccagagcaaugaacuagcaa

SEQ ID NO: 1313535 - RNA, 18 nt, Human
ucaacacaauacccauaa

SEQ ID NO: 1313536 - RNA, 25 nt, Human
ucaauuaaaaaccuugccacauuca

SEQ ID NO: 1313537 - RNA, 22 nt, Human
ucagcaucugaucaucauagaa

SEQ ID NO: 1313538 - RNA, 23 nt, Human
ucccaaagugcugggauuacagg

SEQ ID NO: 1313539 - RNA, 18 nt, Human
ucccauacuuauuagaaa

SEQ ID NO: 1313540 - RNA, 21 nt, Human
ucccuaugacauggauugcuu

SEQ ID NO: 1313541 - RNA, 21 nt, Human
ucuaugguuucucuccaguau

SEQ ID NO: 1313542 - RNA, 20 nt, Human
ucuuggccucccaaagugcu

SEQ ID NO: 1313543 - RNA, 19 nt, Human
ugaagaaacaaaaaacaga

SEQ ID NO: 1313544 - RNA, 21 nt, Human
ugaaugaccuuaugcauuaca

SEQ ID NO: 1313545 - RNA, 19 nt, Human
ugaauuuugaacaaagguc

SEQ ID NO: 1313546 - RNA, 24 nt, Human
ugacacaaucaucacccuugugag

SEQ ID NO: 1313547 - RNA, 19 nt, Human
ugacaugaucuucugugua

SEQ ID NO: 1313548 - RNA, 20 nt, Human
ugacauggauugcuugaugg

SEQ ID NO: 1313549 - RNA, 21 nt, Human
ugacugaccacugaaggcucu

SEQ ID NO: 1313550 - RNA, 18 nt, Human
ugagaaauucauacauug

SEQ ID NO: 1313551 - RNA, 18 nt, Human
ugaggcaugaaccugaaa

SEQ ID NO: 1313552 - RNA, 22 nt, Human
ugauauaccacuugaacagaau

SEQ ID NO: 1313553 - RNA, 24 nt, Human
ugaucucaagugaucuaccugucu

SEQ ID NO: 1313554 - RNA, 24 nt, Human
ugcugggauuacaggugugagcca

SEQ ID NO: 1313555 - RNA, 18 nt, Human
uggaaaaauuaauacugu

SEQ ID NO: 1313556 - RNA, 24 nt, Human
uggccaggcugcucucaaacuccu

SEQ ID NO: 1313557 - RNA, 18 nt, Human
ugggauuacaggugugag

SEQ ID NO: 1313558 - RNA, 19 nt, Human
ugggauuacaggugugagc

SEQ ID NO: 1313559 - RNA, 21 nt, Human
ugggauuacaggugugagcca

SEQ ID NO: 1313560 - RNA, 22 nt, Human
ugggauuacaggugugagccac

SEQ ID NO: 1313561 - RNA, 23 nt, Human
ugggauuacaggugugagccacc

SEQ ID NO: 1313562 - RNA, 24 nt, Human
ugggauuacaggugugagccaccg

SEQ ID NO: 1313563 - RNA, 18 nt, Human
uguaagguuucucuccgg

SEQ ID NO: 1313564 - RNA, 18 nt, Human
uguaagguuuuucuccga

SEQ ID NO: 1313565 - RNA, 19 nt, Human
ugucacacucaucacacuu

SEQ ID NO: 1313566 - RNA, 22 nt, Human
ugucacauucuucacauuugua

SEQ ID NO: 1313567 - RNA, 21 nt, Human
ugugagguuucuuucuuguau

SEQ ID NO: 1313568 - RNA, 23 nt, Human
uguguaaugaggcaugaaccuga

SEQ ID NO: 1313569 - RNA, 21 nt, Human
uguguagaaaaucacaaagag

SEQ ID NO: 1313570 - RNA, 23 nt, Human
uuaagucaacucaaacugaacuc

SEQ ID NO: 1313571 - RNA, 21 nt, Human
uuacugaggacuuugugacaa

SEQ ID NO: 1313572 - RNA, 21 nt, Human
uuccuguaggaucucacauga

SEQ ID NO: 1313573 - RNA, 18 nt, Human
uucuccuaugucuuucaa

SEQ ID NO: 1313574 - RNA, 23 nt, Human
uuuccuguaggaucucacaugau

SEQ ID NO: 1313575 - RNA, 19 nt, Human
uuucuuguaugaauucacc

SEQ ID NO: 1313576 - RNA, 24 nt, Human
uuugcacaauacaauaucagcacc

SEQ ID NO: 1313577 - RNA, 19 nt, Human
uuuguaagguuucucucca

SEQ ID NO: 1313578 - RNA, 19 nt, Human
uuuguacgguuucucucca

SEQ ID NO: 1313579 - RNA, 24 nt, Human
uuuguugaagaaacaaaaaacaga

SEQ ID NO: 1313580 - RNA, 21 nt, Human
augugcagagcacggaagacc

SEQ ID NO: 1313581 - RNA, 19 nt, Human
ggccaaacuggguccuggu

SEQ ID NO: 1313582 - RNA, 21 nt, Human
agggcaggagaggacaggggu

SEQ ID NO: 1313583 - RNA, 20 nt, Human
cccuaagggcaggagaggac

SEQ ID NO: 1313584 - RNA, 20 nt, Human
gggcaggagaggacaggggu

SEQ ID NO: 1313585 - RNA, 24 nt, Human
aaaaaugacuccugauucuguuaa

SEQ ID NO: 1313586 - RNA, 24 nt, Human
agguaguaauuguacuccuaauug

SEQ ID NO: 1313587 - RNA, 22 nt, Human
agucgcuggugaugagugucuu

SEQ ID NO: 1313588 - RNA, 19 nt, Human
aguuaauauuguaaacggc

SEQ ID NO: 1313589 - RNA, 22 nt, Human
auaguaauggcaaaugagugcc

SEQ ID NO: 1313590 - RNA, 23 nt, Human
auuuuuauuucuaaugcugaaga

SEQ ID NO: 1313591 - RNA, 22 nt, Human
ccuccaaggccuaguugaugaa

SEQ ID NO: 1313592 - RNA, 23 nt, Human
cucaucaugaacacuguaguuga

SEQ ID NO: 1313593 - RNA, 23 nt, Human
cugaagagaaaugcauuguucac

SEQ ID NO: 1313594 - RNA, 23 nt, Human
cugccccaaguugacugguaaaa

SEQ ID NO: 1313595 - RNA, 20 nt, Human
gcugccccaaguugacuggu

SEQ ID NO: 1313596 - RNA, 24 nt, Human
guacagcagucgcuggugaugagu

SEQ ID NO: 1313597 - RNA, 21 nt, Human
uaaauggacccccugagguaa

SEQ ID NO: 1313598 - RNA, 23 nt, Human
ugagugccauugcucaucaugaa

SEQ ID NO: 1313599 - RNA, 20 nt, Human
uguacuacuaauuuuuuagg

SEQ ID NO: 1313600 - RNA, 18 nt, Human
aaccagugaucacaucuc

SEQ ID NO: 1313601 - RNA, 18 nt, Human
aagcagcccgcgccuccc

SEQ ID NO: 1313602 - RNA, 20 nt, Human
aagcagcccgcgccucccaa

SEQ ID NO: 1313603 - RNA, 19 nt, Human
aauaccuaccuucucuggc

SEQ ID NO: 1313604 - RNA, 21 nt, Human
aaugaaagagcucugaaagua

SEQ ID NO: 1313605 - RNA, 20 nt, Human
aaugagaggagcaacugaaa

SEQ ID NO: 1313606 - RNA, 18 nt, Human
aaugugagggcagaagga

SEQ ID NO: 1313607 - RNA, 19 nt, Human
accuucucuggccauuguc

SEQ ID NO: 1313608 - RNA, 23 nt, Human
acucucagccucaguuuccccau

SEQ ID NO: 1313609 - RNA, 24 nt, Human
agagaaauaaaagguggggggccu

SEQ ID NO: 1313610 - RNA, 24 nt, Human
agagauaauucggggcuccuucag

SEQ ID NO: 1313611 - RNA, 24 nt, Human
agcagcccgcgccucccaagcagc

SEQ ID NO: 1313612 - RNA, 20 nt, Human
agccugggggaaggggcugg

SEQ ID NO: 1313613 - RNA, 23 nt, Human
agccugggggaaggggcuggcuc

SEQ ID NO: 1313614 - RNA, 23 nt, Human
aggcuuaaaccaggucagccugg

SEQ ID NO: 1313615 - RNA, 18 nt, Human
agguagacagugaggagg

SEQ ID NO: 1313616 - RNA, 22 nt, Human
auuccaccaggccuugggugaa

SEQ ID NO: 1313617 - RNA, 22 nt, Human
caacgcggccggcagcgccgag

SEQ ID NO: 1313618 - RNA, 19 nt, Human
caagaggaagcaugaacag

SEQ ID NO: 1313619 - RNA, 21 nt, Human
caauggcuugagaagcccccc

SEQ ID NO: 1313620 - RNA, 23 nt, Human
cacgcuccuacccuucucuuuuc

SEQ ID NO: 1313621 - RNA, 20 nt, Human
cagcaacuccaagccagugu

SEQ ID NO: 1313622 - RNA, 19 nt, Human
cagccucaguuuccccauc

SEQ ID NO: 1313623 - RNA, 19 nt, Human
caggucagccugggggaag

SEQ ID NO: 1313624 - RNA, 19 nt, Human
caucagagauuguuauucu

SEQ ID NO: 1313625 - RNA, 20 nt, Human
caucuggggugcuggugacc

SEQ ID NO: 1313626 - RNA, 18 nt, Human
cccacuccuuuuccagcc

SEQ ID NO: 1313627 - RNA, 21 nt, Human
ccccaagcagcccgcgccucc

SEQ ID NO: 1313628 - RNA, 23 nt, Human
ccccacuccuccuugggaccacc

SEQ ID NO: 1313629 - RNA, 20 nt, Human
ccccaucucuaaaauaaggc

SEQ ID NO: 1313630 - RNA, 19 nt, Human
ccccgccgcgccgcccccc

SEQ ID NO: 1313631 - RNA, 21 nt, Human
ccccgccgcgccgccccccaa

SEQ ID NO: 1313632 - RNA, 23 nt, Human
ccccgccgcgccgccccccaagc

SEQ ID NO: 1313633 - RNA, 23 nt, Human
ccccuagaucccuggcggugaca

SEQ ID NO: 1313634 - RNA, 19 nt, Human
cccgccgcgccgcccccca

SEQ ID NO: 1313635 - RNA, 18 nt, Human
cccgcgggccccgccgcg

SEQ ID NO: 1313636 - RNA, 24 nt, Human
ccgccccccaagcagcccgcgccu

SEQ ID NO: 1313637 - RNA, 20 nt, Human
ccgccgcgccgccccccaag

SEQ ID NO: 1313638 - RNA, 20 nt, Human
ccgccuggcuuggguuucca

SEQ ID NO: 1313639 - RNA, 25 nt, Human
ccgccuggcuuggguuuccagcugc

SEQ ID NO: 1313640 - RNA, 23 nt, Human
ccgcgccccccacccuguuuagg

SEQ ID NO: 1313641 - RNA, 18 nt, Human
ccgcgccgccccccaagc

SEQ ID NO: 1313642 - RNA, 18 nt, Human
ccgcgccgccccccaagc

SEQ ID NO: 1313643 - RNA, 18 nt, Human
ccuacccuucucuuuucc

SEQ ID NO: 1313644 - RNA, 21 nt, Human
ccuggaaguguagggaggggu

SEQ ID NO: 1313645 - RNA, 21 nt, Human
cgccgccccccaagcagcccg

SEQ ID NO: 1313646 - RNA, 22 nt, Human
cgccuggcuuggguuuccagcu

SEQ ID NO: 1313647 - RNA, 21 nt, Human
cuaaaaccuguaggggugccc

SEQ ID NO: 1313648 - RNA, 22 nt, Human
cuaaaaccuguaggggugcccc

SEQ ID NO: 1313649 - RNA, 27 nt, Human
cucucagccucaguuuccccaucuccu

SEQ ID NO: 1313650 - RNA, 22 nt, Human
cugaaagucucaaauucaggcu

SEQ ID NO: 1313651 - RNA, 22 nt, Human
cugcguccgcgccccccacccu

SEQ ID NO: 1313652 - RNA, 22 nt, Human
cuggcuuggguuuccagcugca

SEQ ID NO: 1313653 - RNA, 19 nt, Human
cuuuccgcaaccccccacu

SEQ ID NO: 1313654 - RNA, 22 nt, Human
gagauaauucggggcuccuuca

SEQ ID NO: 1313655 - RNA, 20 nt, Human
gagcagcccgcgggccccgc

SEQ ID NO: 1313656 - RNA, 26 nt, Human
gaggaagcaugaacagcuggucccau

SEQ ID NO: 1313657 - RNA, 19 nt, Human
gaggagagaaauaaaaggu

SEQ ID NO: 1313658 - RNA, 20 nt, Human
gcagcccaaggaccaaggca

SEQ ID NO: 1313659 - RNA, 19 nt, Human
gcagcccgcgggccccgcc

SEQ ID NO: 1313660 - RNA, 24 nt, Human
gccaggacagcaacuccaagccag

SEQ ID NO: 1313661 - RNA, 20 nt, Human
gcuccuacccuucucuuuuc

SEQ ID NO: 1313662 - RNA, 20 nt, Human
gcucugaaugugagggcaga

SEQ ID NO: 1313663 - RNA, 21 nt, Human
gcuuacuuaccuacucucagc

SEQ ID NO: 1313664 - RNA, 18 nt, Human
gcuuuauuccaccaggcc

SEQ ID NO: 1313665 - RNA, 25 nt, Human
ggaggaggaugcugucaggggaggg

SEQ ID NO: 1313666 - RNA, 21 nt, Human
ggcuggcuccuuccagggucu

SEQ ID NO: 1313667 - RNA, 28 nt, Human
gggcaacgcggccggcagccgggccccc

SEQ ID NO: 1313668 - RNA, 23 nt, Human
uaaaauaaggcuaccaauaccua

SEQ ID NO: 1313669 - RNA, 23 nt, Human
uaccaauaccuaccuucucuggc

SEQ ID NO: 1313670 - RNA, 18 nt, Human
uaccuaccuucucuggcc

SEQ ID NO: 1313671 - RNA, 20 nt, Human
uagaucccuggcggugacag

SEQ ID NO: 1313672 - RNA, 25 nt, Human
uagcugagugcccuuggacagcuua

SEQ ID NO: 1313673 - RNA, 23 nt, Human
uauagaugggaccccagcccccc

SEQ ID NO: 1313674 - RNA, 24 nt, Human
uauagaugggaccccagccccccc

SEQ ID NO: 1313675 - RNA, 20 nt, Human
ucagagauuguuauucucca

SEQ ID NO: 1313676 - RNA, 23 nt, Human
ucaguuggggauccccacaaauu

SEQ ID NO: 1313677 - RNA, 22 nt, Human
uccauaggugcccccauucuaa

SEQ ID NO: 1313678 - RNA, 22 nt, Human
uccgcaaccccccacuccuccu

SEQ ID NO: 1313679 - RNA, 20 nt, Human
uccuuccagggucuuccucc

SEQ ID NO: 1313680 - RNA, 18 nt, Human
uccuugggaccaccuugg

SEQ ID NO: 1313681 - RNA, 18 nt, Human
uccuugggaccaccuugg

SEQ ID NO: 1313682 - RNA, 21 nt, Human
uccuuggucaggccacgaaac

SEQ ID NO: 1313683 - RNA, 23 nt, Human
uccuuuuccagccuuguggcugg

SEQ ID NO: 1313684 - RNA, 20 nt, Human
ucucacagaaguaguucugg

SEQ ID NO: 1313685 - RNA, 20 nt, Human
ucucuuuuccucucacagaa

SEQ ID NO: 1313686 - RNA, 22 nt, Human
ucucuuuuccucucacagaagu

SEQ ID NO: 1313687 - RNA, 22 nt, Human
ugaccuggccuagagauaauuc

SEQ ID NO: 1313688 - RNA, 23 nt, Human
ugagaggagcaacugaaagucuc

SEQ ID NO: 1313689 - RNA, 24 nt, Human
ugagaggagcaacugaaagucuca

SEQ ID NO: 1313690 - RNA, 22 nt, Human
ugagaugggcaguggagggcca

SEQ ID NO: 1313691 - RNA, 23 nt, Human
ugagaugggcaguggagggcccc

SEQ ID NO: 1313692 - RNA, 19 nt, Human
ugagggcagaaggaggagg

SEQ ID NO: 1313693 - RNA, 22 nt, Human
ugcccacuccuuuuccagccuu

SEQ ID NO: 1313694 - RNA, 18 nt, Human
ugcccuggaaguguaggg

SEQ ID NO: 1313695 - RNA, 20 nt, Human
uggccuagagauaauucggg

SEQ ID NO: 1313696 - RNA, 18 nt, Human
uggcuccugaccuggccu

SEQ ID NO: 1313697 - RNA, 18 nt, Human
uggcuggcucucauccuc

SEQ ID NO: 1313698 - RNA, 19 nt, Human
uggcuggcucucauccucc

SEQ ID NO: 1313699 - RNA, 20 nt, Human
ugggacagguggcggggguc

SEQ ID NO: 1313700 - RNA, 18 nt, Human
ugggaccccagcccccca

SEQ ID NO: 1313701 - RNA, 26 nt, Human
uggguuuccagcugcagggcacgcuc

SEQ ID NO: 1313702 - RNA, 21 nt, Human
uguggcuggcucucauccucc

SEQ ID NO: 1313703 - RNA, 19 nt, Human
uguuagcugagugcccuug

SEQ ID NO: 1313704 - RNA, 22 nt, Human
uuaggaguuccuguuuggagau

SEQ ID NO: 1313705 - RNA, 18 nt, Human
uuccagggucuuccucca

SEQ ID NO: 1313706 - RNA, 24 nt, Human
uuccgcaaccccccacuccuccuu

SEQ ID NO: 1313707 - RNA, 22 nt, Human
uucugggcaagaggaagcauga

SEQ ID NO: 1313708 - RNA, 19 nt, Human
uuuggagguagacagugag

SEQ ID NO: 1313709 - RNA, 23 nt, Human
aaaugucuuuauaaguacauacc

SEQ ID NO: 1313710 - RNA, 24 nt, Human
uauauauauggagauauauauaca

SEQ ID NO: 1313711 - RNA, 20 nt, Human
ucaaaaaaaauauagaaaca

SEQ ID NO: 1313712 - RNA, 18 nt, Human
ucaaaauuauacagccau

SEQ ID NO: 1313713 - RNA, 23 nt, Human
ugaagucuacauuucccuugucu

SEQ ID NO: 1313714 - RNA, 25 nt, Human
uguuuaugaagucuacauuucccuu

SEQ ID NO: 1313715 - RNA, 19 nt, Human
uuaaggguaaucauugggu

SEQ ID NO: 1313716 - RNA, 23 nt, Human
ccaugcggggcagguccugucgg

SEQ ID NO: 1313717 - RNA, 24 nt, Human
uauauauauggagauauauauaca

SEQ ID NO: 1313718 - RNA, 23 nt, Human
ugaagucuacauuucccuugucu

SEQ ID NO: 1313719 - RNA, 25 nt, Human
uguuuaugaagucuacauuucccuu

SEQ ID NO: 1313720 - RNA, 19 nt, Human
uuaaggguaaucauugggu

SEQ ID NO: 1313721 - RNA, 23 nt, Human
aguauugaugaaacugguuuucu

SEQ ID NO: 1313722 - RNA, 25 nt, Human
augguauagauauguuauucaaaac

SEQ ID NO: 1313723 - RNA, 19 nt, Human
gaaacugguuuucagacaa

SEQ ID NO: 1313724 - RNA, 24 nt, Human
uagaauggcaauuucacuuaaaau

SEQ ID NO: 1313725 - RNA, 22 nt, Human
ucccuugcuuuagggaggagag

SEQ ID NO: 1313726 - RNA, 24 nt, Human
aacccaauuuuauuuagaaaccag

SEQ ID NO: 1313727 - RNA, 18 nt, Human
aacuccuguuccguuccc

SEQ ID NO: 1313728 - RNA, 19 nt, Human
aaggguuccggaacaucug

SEQ ID NO: 1313729 - RNA, 23 nt, Human
aagguguuaagagucgccauggg

SEQ ID NO: 1313730 - RNA, 18 nt, Human
acaaaaccuccugccucu

SEQ ID NO: 1313731 - RNA, 23 nt, Human
acacacacacgcgcacacacaca

SEQ ID NO: 1313732 - RNA, 18 nt, Human
accauguccacaaaaccu

SEQ ID NO: 1313733 - RNA, 24 nt, Human
accuccugccucugcuccccaggc

SEQ ID NO: 1313734 - RNA, 24 nt, Human
accugaguacaagggcgcagucug

SEQ ID NO: 1313735 - RNA, 24 nt, Human
acgagguuuggagaaucgaaacug

SEQ ID NO: 1313736 - RNA, 20 nt, Human
acuccuguuccguucccugu

SEQ ID NO: 1313737 - RNA, 24 nt, Human
agagcuccaccagcccuguccaca

SEQ ID NO: 1313738 - RNA, 25 nt, Human
agagcuccaccagcccuguccacaa

SEQ ID NO: 1313739 - RNA, 21 nt, Human
agagucgccauggggguggcu

SEQ ID NO: 1313740 - RNA, 19 nt, Human
agcuccaccagcccugucc

SEQ ID NO: 1313741 - RNA, 19 nt, Human
agcuccaccagcccugucc

SEQ ID NO: 1313742 - RNA, 18 nt, Human
aggaccucagagacagac

SEQ ID NO: 1313743 - RNA, 20 nt, Human
aggaggauguagggacccuc

SEQ ID NO: 1313744 - RNA, 19 nt, Human
agggagggaaggaggagga

SEQ ID NO: 1313745 - RNA, 18 nt, Human
agguggagcugccuugag

SEQ ID NO: 1313746 - RNA, 20 nt, Human
auaaaauauccuaccgcccc

SEQ ID NO: 1313747 - RNA, 22 nt, Human
aucagcagccuugaccugugug

SEQ ID NO: 1313748 - RNA, 21 nt, Human
aucaggaagggagggaaggag

SEQ ID NO: 1313749 - RNA, 21 nt, Human
auccuccuggaagaagggguc

SEQ ID NO: 1313750 - RNA, 24 nt, Human
cacacacacacgcuccuccuuccc

SEQ ID NO: 1313751 - RNA, 23 nt, Human
cacgcgcacacacacacacgcuc

SEQ ID NO: 1313752 - RNA, 19 nt, Human
cacuucugggcgggcuccu

SEQ ID NO: 1313753 - RNA, 19 nt, Human
cagcauuuggcucuguggc

SEQ ID NO: 1313754 - RNA, 22 nt, Human
cagcugguaggaccucagagac

SEQ ID NO: 1313755 - RNA, 25 nt, Human
caggacaaauggucauaccugagua

SEQ ID NO: 1313756 - RNA, 21 nt, Human
ccccaucagcagccuugaccu

SEQ ID NO: 1313757 - RNA, 18 nt, Human
cccccagagcuccaccag

SEQ ID NO: 1313758 - RNA, 24 nt, Human
cccccaggagugaccacgugagga

SEQ ID NO: 1313759 - RNA, 21 nt, Human
ccccgcagagcuccaccagcc

SEQ ID NO: 1313760 - RNA, 21 nt, Human
ccccgcagagguccaucaacc

SEQ ID NO: 1313761 - RNA, 19 nt, Human
ccuccugccucugcucccc

SEQ ID NO: 1313762 - RNA, 19 nt, Human
ccuccugccucugcucccc

SEQ ID NO: 1313763 - RNA, 22 nt, Human
ccuccugccucugcucccccca

SEQ ID NO: 1313764 - RNA, 19 nt, Human
ccuccuuccccagccucuu

SEQ ID NO: 1313765 - RNA, 21 nt, Human
ccuccuuccccagccucuuac

SEQ ID NO: 1313766 - RNA, 23 nt, Human
ccuccuugcugccgagucaggga

SEQ ID NO: 1313767 - RNA, 22 nt, Human
ccucugcuccccccagagcucc

SEQ ID NO: 1313768 - RNA, 18 nt, Human
ccuggcccuggggaucac

SEQ ID NO: 1313769 - RNA, 18 nt, Human
ccuggcccuggggaucac

SEQ ID NO: 1313770 - RNA, 21 nt, Human
ccuggggaucacgucucuagu

SEQ ID NO: 1313771 - RNA, 26 nt, Human
ccuguacacacacacgcgcacacagu

SEQ ID NO: 1313772 - RNA, 24 nt, Human
ccuguacacacacacgcgcacagg

SEQ ID NO: 1313773 - RNA, 25 nt, Human
ccuguacugcgggguuuuacaaggg

SEQ ID NO: 1313774 - RNA, 19 nt, Human
ccuguuccguucccuguuc

SEQ ID NO: 1313775 - RNA, 21 nt, Human
cuaguuuacggaggaaguggc

SEQ ID NO: 1313776 - RNA, 23 nt, Human
cuccugccucugcuccccaggcc

SEQ ID NO: 1313777 - RNA, 23 nt, Human
cuccugccucugcuccccccaga

SEQ ID NO: 1313778 - RNA, 24 nt, Human
cugaauucuuccuugucugggaaa

SEQ ID NO: 1313779 - RNA, 21 nt, Human
cugagcaccuacuuugcagca

SEQ ID NO: 1313780 - RNA, 24 nt, Human
cugagcccaagaggugagugcuga

SEQ ID NO: 1313781 - RNA, 19 nt, Human
cugcagcauuuggcucugu

SEQ ID NO: 1313782 - RNA, 18 nt, Human
cugcagugaugucugcag

SEQ ID NO: 1313783 - RNA, 18 nt, Human
cugcagugaugucugcag

SEQ ID NO: 1313784 - RNA, 18 nt, Human
cugcagugaugucugcag

SEQ ID NO: 1313785 - RNA, 21 nt, Human
cuggaguuuucaggacccugc

SEQ ID NO: 1313786 - RNA, 19 nt, Human
cuggggcugaugagccucu

SEQ ID NO: 1313787 - RNA, 23 nt, Human
cuggggcugaugagccucugucc

SEQ ID NO: 1313788 - RNA, 22 nt, Human
gaaaaguuggaaggugcuacau

SEQ ID NO: 1313789 - RNA, 24 nt, Human
gacuuuagagagagaauugcaucc

SEQ ID NO: 1313790 - RNA, 24 nt, Human
gagccucuguccccuaggaauuuu

SEQ ID NO: 1313791 - RNA, 20 nt, Human
gagcuccaccagcccugucc

SEQ ID NO: 1313792 - RNA, 18 nt, Human
gagugcugagugguggcg

SEQ ID NO: 1313793 - RNA, 19 nt, Human
gagugcugccucugcucag

SEQ ID NO: 1313794 - RNA, 27 nt, Human
gcagagcuccaccagcccuguccacaa

SEQ ID NO: 1313795 - RNA, 21 nt, Human
gcccgagugcugccucugcuc

SEQ ID NO: 1313796 - RNA, 21 nt, Human
gccuucccugcuuuuccacuc

SEQ ID NO: 1313797 - RNA, 24 nt, Human
ggaaaaguuggaaggugcuacauu

SEQ ID NO: 1313798 - RNA, 27 nt, Human
ggaggaggauguagggacccucuaggg

SEQ ID NO: 1313799 - RNA, 21 nt, Human
ggaguuuucaggacccugcuu

SEQ ID NO: 1313800 - RNA, 18 nt, Human
ggcaucaggaagggaggg

SEQ ID NO: 1313801 - RNA, 23 nt, Human
gggaaggaggaggauguagggac

SEQ ID NO: 1313802 - RNA, 19 nt, Human
gggcaugggggucggcugg

SEQ ID NO: 1313803 - RNA, 26 nt, Human
guacacacacacgcgcacacacacac

SEQ ID NO: 1313804 - RNA, 23 nt, Human
guuugccuucccugcuuuuccac

SEQ ID NO: 1313805 - RNA, 20 nt, Human
uaaaauauccuaccgccccc

SEQ ID NO: 1313806 - RNA, 18 nt, Human
uaagguguuuucucuuua

SEQ ID NO: 1313807 - RNA, 24 nt, Human
uacacacacacgcgcacacacaca

SEQ ID NO: 1313808 - RNA, 24 nt, Human
ucagagacagaccuggcccugggg

SEQ ID NO: 1313809 - RNA, 21 nt, Human
ucagcagccuugaccugugug

SEQ ID NO: 1313810 - RNA, 18 nt, Human
uccacaaaaucuccuccg

SEQ ID NO: 1313811 - RNA, 19 nt, Human
ucccagaggaggcuccugg

SEQ ID NO: 1313812 - RNA, 21 nt, Human
ucccagaggaggcuccugggg

SEQ ID NO: 1313813 - RNA, 18 nt, Human
ucccagcugguaggaccu

SEQ ID NO: 1313814 - RNA, 18 nt, Human
uccccagccucuuaccug

SEQ ID NO: 1313815 - RNA, 21 nt, Human
ucccugagcaccuacuuugca

SEQ ID NO: 1313816 - RNA, 22 nt, Human
ucccuguacugcgggguuuuac

SEQ ID NO: 1313817 - RNA, 23 nt, Human
ucccuguuccccucggguccucc

SEQ ID NO: 1313818 - RNA, 20 nt, Human
uccuccgucuucuccccgca

SEQ ID NO: 1313819 - RNA, 20 nt, Human
uccugccucugcucccccca

SEQ ID NO: 1313820 - RNA, 24 nt, Human
uccugggggcaccagccccucagc

SEQ ID NO: 1313821 - RNA, 27 nt, Human
ucuggaguuuucaggacccugcuuuua

SEQ ID NO: 1313822 - RNA, 18 nt, Human
ucugggcgggcuccuggg

SEQ ID NO: 1313823 - RNA, 22 nt, Human
ucuguggcucuucugcccugaa

SEQ ID NO: 1313824 - RNA, 23 nt, Human
ugaagggggugccgggcaugggg

SEQ ID NO: 1313825 - RNA, 24 nt, Human
ugagcaccuacuuugcagcaggcu

SEQ ID NO: 1313826 - RNA, 18 nt, Human
ugagccucuguccccuag

SEQ ID NO: 1313827 - RNA, 20 nt, Human
ugccucugcuccccaggcca

SEQ ID NO: 1313828 - RNA, 18 nt, Human
ugccugcugggccggcca

SEQ ID NO: 1313829 - RNA, 23 nt, Human
ugccuggggcugaugagccucug

SEQ ID NO: 1313830 - RNA, 21 nt, Human
uggcucuguggcucuucugcc

SEQ ID NO: 1313831 - RNA, 25 nt, Human
uguacacacacacgcgcacacacac

SEQ ID NO: 1313832 - RNA, 25 nt, Human
uguacacacacacgcgcacacacag

SEQ ID NO: 1313833 - RNA, 20 nt, Human
uguacauaaaugcccaggaa

SEQ ID NO: 1313834 - RNA, 19 nt, Human
ugucucaggaaguugccug

SEQ ID NO: 1313835 - RNA, 19 nt, Human
ugucugcucugagcauguc

SEQ ID NO: 1313836 - RNA, 25 nt, Human
ugucugggaaagccacaucucucug

SEQ ID NO: 1313837 - RNA, 22 nt, Human
uuaaauggauauucccugagca

SEQ ID NO: 1313838 - RNA, 21 nt, Human
uuccauccucccuccugaauu

SEQ ID NO: 1313839 - RNA, 25 nt, Human
uucccagaggaggcuccugggggca

SEQ ID NO: 1313840 - RNA, 27 nt, Human
uuggagaaucgaaacuggcuccguggg

SEQ ID NO: 1313841 - RNA, 23 nt, Human
uuggcucuguggcucuucugccc

SEQ ID NO: 1313842 - RNA, 18 nt, Human
uuguucccucaucaguuu

SEQ ID NO: 1313843 - RNA, 18 nt, Human
uuucaggacccugcuuuu

SEQ ID NO: 1313844 - RNA, 24 nt, Human
aacaaauacugggccccaguucuu

SEQ ID NO: 1313845 - RNA, 23 nt, Human
aagaacacugggagugaagagaa

SEQ ID NO: 1313846 - RNA, 18 nt, Human
aagagaaggcgcagugaa

SEQ ID NO: 1313847 - RNA, 18 nt, Human
acuaauggucaucaaugg

SEQ ID NO: 1313848 - RNA, 24 nt, Human
agagaaaacaaaaauagcacacua

SEQ ID NO: 1313849 - RNA, 21 nt, Human
aggcgcccaucaucccuguuu

SEQ ID NO: 1313850 - RNA, 23 nt, Human
agggcacauuuucuguauccaaa

SEQ ID NO: 1313851 - RNA, 19 nt, Human
aggguaauugggcaggagg

SEQ ID NO: 1313852 - RNA, 19 nt, Human
aggugcacggggagaaggg

SEQ ID NO: 1313853 - RNA, 21 nt, Human
cagaacacugaaaggucaacc

SEQ ID NO: 1313854 - RNA, 21 nt, Human
cauccccaccacguggcccuc

SEQ ID NO: 1313855 - RNA, 20 nt, Human
ccaugccuguguuccauccc

SEQ ID NO: 1313856 - RNA, 20 nt, Human
ccccaccacguggcccuccc

SEQ ID NO: 1313857 - RNA, 25 nt, Human
cgccugggcagguuagugacugccc

SEQ ID NO: 1313858 - RNA, 20 nt, Human
cucuguggcaguccuggagg

SEQ ID NO: 1313859 - RNA, 20 nt, Human
cucuguggcaguccuggagg

SEQ ID NO: 1313860 - RNA, 20 nt, Human
cuugcucuguggcaguccug

SEQ ID NO: 1313861 - RNA, 21 nt, Human
gagaugaauccaaaaugaauc

SEQ ID NO: 1313862 - RNA, 21 nt, Human
uaauuuucuucuucauagaga

SEQ ID NO: 1313863 - RNA, 21 nt, Human
uacguacuguccaugccugug

SEQ ID NO: 1313864 - RNA, 20 nt, Human
uagcacacuaauggucauca

SEQ ID NO: 1313865 - RNA, 25 nt, Human
uccaaaaugaaucagacagcggcuc

SEQ ID NO: 1313866 - RNA, 20 nt, Human
uccaugccuguguuccaucc

SEQ ID NO: 1313867 - RNA, 18 nt, Human
ucuguauccaaaacagcc

SEQ ID NO: 1313868 - RNA, 21 nt, Human
ucuugcucuguggcaguccug

SEQ ID NO: 1313869 - RNA, 23 nt, Human
ucuugcucuguggcaguccugga

SEQ ID NO: 1313870 - RNA, 18 nt, Human
ugaaucagacagcggcuc

SEQ ID NO: 1313871 - RNA, 24 nt, Human
ugcaaagaacacugggagugaaga

SEQ ID NO: 1313872 - RNA, 20 nt, Human
ugcacagugcacgagaugaa

SEQ ID NO: 1313873 - RNA, 22 nt, Human
ugggagugcagaacacugaaag

SEQ ID NO: 1313874 - RNA, 23 nt, Human
ugggcaggagggaaacucgccug

SEQ ID NO: 1313875 - RNA, 25 nt, Human
uguguuccauccccaccacguggcc

SEQ ID NO: 1313876 - RNA, 21 nt, Human
uguuuauuucuuuguuuacgu

SEQ ID NO: 1313877 - RNA, 21 nt, Human
aaaggaacuuuuuacuuucua

SEQ ID NO: 1313878 - RNA, 23 nt, Human
aagaagggaaacuuugaaaagga

SEQ ID NO: 1313879 - RNA, 21 nt, Human
agaggaccucuugcccuuuuc

SEQ ID NO: 1313880 - RNA, 24 nt, Human
agcugguuuuugcucuggggaagu

SEQ ID NO: 1313881 - RNA, 25 nt, Human
cacuucaucucugcugggacccugu

SEQ ID NO: 1313882 - RNA, 19 nt, Human
ccaugugucucauguccug

SEQ ID NO: 1313883 - RNA, 21 nt, Human
cccacauguucuagccuggcc

SEQ ID NO: 1313884 - RNA, 18 nt, Human
ccccauaggcuuaccuga

SEQ ID NO: 1313885 - RNA, 18 nt, Human
cccuuuucuuucaugacc

SEQ ID NO: 1313886 - RNA, 20 nt, Human
ccucuugcccuuuucuuuca

SEQ ID NO: 1313887 - RNA, 20 nt, Human
ccuucuggguucuggcccca

SEQ ID NO: 1313888 - RNA, 24 nt, Human
cuaacacuuaugauuuauucuuua

SEQ ID NO: 1313889 - RNA, 21 nt, Human
cucacagauagcacugugcgu

SEQ ID NO: 1313890 - RNA, 19 nt, Human
cuccugggugaagcugguu

SEQ ID NO: 1313891 - RNA, 21 nt, Human
cugaugaauuggcugggcuga

SEQ ID NO: 1313892 - RNA, 19 nt, Human
cugggagguccucagugca

SEQ ID NO: 1313893 - RNA, 23 nt, Human
cugguucacuucaucucugcugg

SEQ ID NO: 1313894 - RNA, 21 nt, Human
gaaccugggagguccucagug

SEQ ID NO: 1313895 - RNA, 18 nt, Human
ggcccagagcuuggaacc

SEQ ID NO: 1313896 - RNA, 26 nt, Human
ggcccagagcuuggaaccugggaggu

SEQ ID NO: 1313897 - RNA, 25 nt, Human
ucaguguccggcucaccuccagguu

SEQ ID NO: 1313898 - RNA, 22 nt, Human
ucaugaacacagaacugcucac

SEQ ID NO: 1313899 - RNA, 18 nt, Human
ucuagccuggcccagagc

SEQ ID NO: 1313900 - RNA, 24 nt, Human
ucugcugggacccuguggccccca

SEQ ID NO: 1313901 - RNA, 24 nt, Human
ugaacacagaacugcucacagaua

SEQ ID NO: 1313902 - RNA, 22 nt, Human
ugcucuggggaagucuccaucc

SEQ ID NO: 1313903 - RNA, 23 nt, Human
uguggcccccauaggcuuaccug

SEQ ID NO: 1313904 - RNA, 21 nt, Human
uguucuagccuggcccagagc

SEQ ID NO: 1313905 - RNA, 18 nt, Human
uucucccagcaucuucag

SEQ ID NO: 1313906 - RNA, 19 nt, Human
uuucaccauugugcaugau

SEQ ID NO: 1313907 - RNA, 21 nt, Human
uuuugcucuggggaagucucc

SEQ ID NO: 1313908 - RNA, 18 nt, Human
ucgauuggaucucucuga

SEQ ID NO: 1313909 - RNA, 25 nt, Human
uuuuuuauucuucugagauguucca

SEQ ID NO: 1313910 - RNA, 18 nt, Human
ucugcgugguuaaggaag

SEQ ID NO: 1313911 - RNA, 18 nt, Human
ugcgugguuaaggaaggu

SEQ ID NO: 1313912 - RNA, 22 nt, Human
aaaccgaauuucuaggcugcaa

SEQ ID NO: 1313913 - RNA, 19 nt, Human
aaagugcugggauuacaga

SEQ ID NO: 1313914 - RNA, 24 nt, Human
aaagugcugggauuacagauguga

SEQ ID NO: 1313915 - RNA, 20 nt, Human
aagaaauuccaagacuguca

SEQ ID NO: 1313916 - RNA, 18 nt, Human
aagugcugggauuacaga

SEQ ID NO: 1313917 - RNA, 26 nt, Human
aagugcugggauuacagaugugagcc

SEQ ID NO: 1313918 - RNA, 24 nt, Human
acacauuccgccuuccaaguuucu

SEQ ID NO: 1313919 - RNA, 22 nt, Human
acagcaaugguuugccucaugc

SEQ ID NO: 1313920 - RNA, 18 nt, Human
acaggguuucaccaugug

SEQ ID NO: 1313921 - RNA, 19 nt, Human
acaggguuucaccaugugg

SEQ ID NO: 1313922 - RNA, 24 nt, Human
acaggguuucaccaugugggccag

SEQ ID NO: 1313923 - RNA, 24 nt, Human
accaugugggccaggcuggucucg

SEQ ID NO: 1313924 - RNA, 19 nt, Human
acccaggcuggagugcagu

SEQ ID NO: 1313925 - RNA, 21 nt, Human
acccuccgucuccccacaggc

SEQ ID NO: 1313926 - RNA, 23 nt, Human
accucugccucccaaagugcugg

SEQ ID NO: 1313927 - RNA, 18 nt, Human
acucugucacccaggcug

SEQ ID NO: 1313928 - RNA, 24 nt, Human
acucugucacccaggcuggagugc

SEQ ID NO: 1313929 - RNA, 20 nt, Human
agacaggguuucaccaugug

SEQ ID NO: 1313930 - RNA, 22 nt, Human
agagacaggguuucaccaugug

SEQ ID NO: 1313931 - RNA, 23 nt, Human
agcagcugggauuacaggcgugu

SEQ ID NO: 1313932 - RNA, 19 nt, Human
agccaccacaccuggucug

SEQ ID NO: 1313933 - RNA, 24 nt, Human
aggaagacugugcuccaaauuauu

SEQ ID NO: 1313934 - RNA, 24 nt, Human
aggcgauccgcccaccucugccuc

SEQ ID NO: 1313935 - RNA, 25 nt, Human
aggcuggagugcaguggcgugaucu

SEQ ID NO: 1313936 - RNA, 22 nt, Human
aguagagacaggguuucaccau

SEQ ID NO: 1313937 - RNA, 19 nt, Human
agugcaguggcgugaucuc

SEQ ID NO: 1313938 - RNA, 20 nt, Human
agugcaguggcgugaucucg

SEQ ID NO: 1313939 - RNA, 23 nt, Human
agugcaguggcgugaucucggcu

SEQ ID NO: 1313940 - RNA, 24 nt, Human
agugcaguggcgugaucucggcuc

SEQ ID NO: 1313941 - RNA, 24 nt, Human
auuuuuguauuuuuaguagagaca

SEQ ID NO: 1313942 - RNA, 22 nt, Human
caaaaucaggcuaaaccuccag

SEQ ID NO: 1313943 - RNA, 24 nt, Human
caaagugcugggauuacagaugug

SEQ ID NO: 1313944 - RNA, 21 nt, Human
caccaugugggccaggcuggu

SEQ ID NO: 1313945 - RNA, 24 nt, Human
caccaugugggccaggcuggucuc

SEQ ID NO: 1313946 - RNA, 27 nt, Human
cacccaugugccaccaucacugggcac

SEQ ID NO: 1313947 - RNA, 18 nt, Human
cacgaaaacacauuccgc

SEQ ID NO: 1313948 - RNA, 24 nt, Human
cacuacgcccggcuaauuuuugua

SEQ ID NO: 1313949 - RNA, 22 nt, Human
cacucugucacccaggcuggag

SEQ ID NO: 1313950 - RNA, 23 nt, Human
cacucugucacccaggcuggagu

SEQ ID NO: 1313951 - RNA, 21 nt, Human
cacugcaaccuccgccucccg

SEQ ID NO: 1313952 - RNA, 23 nt, Human
cacugcaaccuccgccucccggg

SEQ ID NO: 1313953 - RNA, 18 nt, Human
caggguuucaccaugugg

SEQ ID NO: 1313954 - RNA, 24 nt, Human
caggguuucaccaugugggccagg

SEQ ID NO: 1313955 - RNA, 21 nt, Human
caugucuaggcaccaggaaga

SEQ ID NO: 1313956 - RNA, 21 nt, Human
ccaaagugcugggauuacaga

SEQ ID NO: 1313957 - RNA, 22 nt, Human
ccaaagugcugggauuacagau

SEQ ID NO: 1313958 - RNA, 24 nt, Human
ccaaagugcugggauuacagaugu

SEQ ID NO: 1313959 - RNA, 19 nt, Human
ccacaggcucuggggugac

SEQ ID NO: 1313960 - RNA, 22 nt, Human
ccagaaacaccugcguuuugaa

SEQ ID NO: 1313961 - RNA, 21 nt, Human
cccaggcuggagugcaguggc

SEQ ID NO: 1313962 - RNA, 19 nt, Human
ccccacaggcucuggggug

SEQ ID NO: 1313963 - RNA, 19 nt, Human
cccgagcagcugggauuac

SEQ ID NO: 1313964 - RNA, 24 nt, Human
cccgagcagcugggauuacaggcg

SEQ ID NO: 1313965 - RNA, 23 nt, Human
cccucugucgcccaggcuggagu

SEQ ID NO: 1313966 - RNA, 24 nt, Human
cccucugucgcccaggcuggagug

SEQ ID NO: 1313967 - RNA, 22 nt, Human
ccgagcagcugggauuacaggc

SEQ ID NO: 1313968 - RNA, 24 nt, Human
ccgagcagcugggauuacaggcgu

SEQ ID NO: 1313969 - RNA, 18 nt, Human
ccguccccacccaugugc

SEQ ID NO: 1313970 - RNA, 21 nt, Human
ccuaccaauggucacugcuau

SEQ ID NO: 1313971 - RNA, 19 nt, Human
ccuccgccucccggguuca

SEQ ID NO: 1313972 - RNA, 19 nt, Human
ccucugccucccgagcagc

SEQ ID NO: 1313973 - RNA, 21 nt, Human
ccucugucgcccaggcuggag

SEQ ID NO: 1313974 - RNA, 24 nt, Human
ccugaucucaggcgauccgcccac

SEQ ID NO: 1313975 - RNA, 24 nt, Human
cgauccgcccaccucugccuccca

SEQ ID NO: 1313976 - RNA, 21 nt, Human
cgcccaugcugcccuucaagg

SEQ ID NO: 1313977 - RNA, 19 nt, Human
cgccucccggguucacgcc

SEQ ID NO: 1313978 - RNA, 22 nt, Human
cuaggagaaagagaacaagaaa

SEQ ID NO: 1313979 - RNA, 23 nt, Human
cuaggcaccaggaagacugugcu

SEQ ID NO: 1313980 - RNA, 24 nt, Human
cucacucugucacccaggcuggag

SEQ ID NO: 1313981 - RNA, 24 nt, Human
cucacugcaaccuccgccucccgg

SEQ ID NO: 1313982 - RNA, 21 nt, Human
cucaggcgauccgcccaccuc

SEQ ID NO: 1313983 - RNA, 24 nt, Human
cucaggcgauccgcccaccucugc

SEQ ID NO: 1313984 - RNA, 21 nt, Human
cucccggguucacgccauucu

SEQ ID NO: 1313985 - RNA, 19 nt, Human
cucugucgcccaggcugga

SEQ ID NO: 1313986 - RNA, 21 nt, Human
cucuguucuuaaauacucuuc

SEQ ID NO: 1313987 - RNA, 23 nt, Human
cugcaaccuccgccucccggguu

SEQ ID NO: 1313988 - RNA, 24 nt, Human
cugcaaccuccgccucccggguuc

SEQ ID NO: 1313989 - RNA, 23 nt, Human
cugccucccgagcagcugggauu

SEQ ID NO: 1313990 - RNA, 19 nt, Human
cugucacccaggcuggagu

SEQ ID NO: 1313991 - RNA, 24 nt, Human
cuugcucuguuacccaggcuggag

SEQ ID NO: 1313992 - RNA, 22 nt, Human
gaaacaccugcguuuugaaaca

SEQ ID NO: 1313993 - RNA, 22 nt, Human
gagaacccuaggagaaagagaa

SEQ ID NO: 1313994 - RNA, 23 nt, Human
gagaacgagaacccuaggagaaa

SEQ ID NO: 1313995 - RNA, 24 nt, Human
gagacaggguuucaccaugugggc

SEQ ID NO: 1313996 - RNA, 27 nt, Human
gagcagcugggauuacaggcguguguc

SEQ ID NO: 1313997 - RNA, 18 nt, Human
gagugcagugguacaauc

SEQ ID NO: 1313998 - RNA, 18 nt, Human
gauuacagaugugagcca

SEQ ID NO: 1313999 - RNA, 21 nt, Human
gauuacagaugugagccacca

SEQ ID NO: 1314000 - RNA, 19 nt, Human
gauuacaggcgugugucac

SEQ ID NO: 1314001 - RNA, 18 nt, Human
gcagcugggauuacaggc

SEQ ID NO: 1314002 - RNA, 22 nt, Human
gcccggcuaauuuuuguauuuu

SEQ ID NO: 1314003 - RNA, 25 nt, Human
gcucuguuacccaggcuggagugca

SEQ ID NO: 1314004 - RNA, 19 nt, Human
gcuggagugcaguggcgug

SEQ ID NO: 1314005 - RNA, 21 nt, Human
gcugggauuacagaugugagc

SEQ ID NO: 1314006 - RNA, 19 nt, Human
ggcuaaaccuccagaaacc

SEQ ID NO: 1314007 - RNA, 22 nt, Human
ggcuggagugcaguggcgugau

SEQ ID NO: 1314008 - RNA, 24 nt, Human
ggcuggucucgaacuccugaucuc

SEQ ID NO: 1314009 - RNA, 24 nt, Human
gggccaggcuggucucgaacuccu

SEQ ID NO: 1314010 - RNA, 22 nt, Human
gucagguacuaaacggagaggg

SEQ ID NO: 1314011 - RNA, 18 nt, Human
guggcuccguccccaccc

SEQ ID NO: 1314012 - RNA, 21 nt, Human
uaaaccagaaacaccugcguu

SEQ ID NO: 1314013 - RNA, 24 nt, Human
uaauuuuuguauuuuuaguagaga

SEQ ID NO: 1314014 - RNA, 22 nt, Human
uacagaugugagccaccacacc

SEQ ID NO: 1314015 - RNA, 21 nt, Human
uacccaggcuggagugcagug

SEQ ID NO: 1314016 - RNA, 24 nt, Human
uacccaggcuggagugcaguggcg

SEQ ID NO: 1314017 - RNA, 22 nt, Human
uagagacagggucucacucugu

SEQ ID NO: 1314018 - RNA, 22 nt, Human
uagagacaggguuucaccaugu

SEQ ID NO: 1314019 - RNA, 24 nt, Human
uaguagagacaggguuucaccaug

SEQ ID NO: 1314020 - RNA, 25 nt, Human
uaguagagacaggguuucaccaugu

SEQ ID NO: 1314021 - RNA, 22 nt, Human
ucacccaggcuggagugcagug

SEQ ID NO: 1314022 - RNA, 24 nt, Human
ucacccucugucgcccaggcugga

SEQ ID NO: 1314023 - RNA, 23 nt, Human
ucacugcaaccuccgccucccgg

SEQ ID NO: 1314024 - RNA, 24 nt, Human
ucacugcaaccuccgccucccggg

SEQ ID NO: 1314025 - RNA, 25 nt, Human
ucacugcaaccuccgccucccgggu

SEQ ID NO: 1314026 - RNA, 26 nt, Human
ucacugcaaccuccgccucccggguu

SEQ ID NO: 1314027 - RNA, 18 nt, Human
ucccaaagugcugggauu

SEQ ID NO: 1314028 - RNA, 23 nt, Human
ucccaaagugcugggauuacaga

SEQ ID NO: 1314029 - RNA, 21 nt, Human
ucccacagcaaugguuugccu

SEQ ID NO: 1314030 - RNA, 24 nt, Human
ucccgagcagcugggauuacaggc

SEQ ID NO: 1314031 - RNA, 19 nt, Human
ucccggccaccauggcccu

SEQ ID NO: 1314032 - RNA, 21 nt, Human
ucccggguucacgccauucuc

SEQ ID NO: 1314033 - RNA, 24 nt, Human
ucccggguucacgccauucuccug

SEQ ID NO: 1314034 - RNA, 18 nt, Human
ucgcccaggcuggagugc

SEQ ID NO: 1314035 - RNA, 22 nt, Human
ucucacucugucacccaggcug

SEQ ID NO: 1314036 - RNA, 23 nt, Human
ucucacucugucacccaggcugg

SEQ ID NO: 1314037 - RNA, 24 nt, Human
ucucacucugucacccaggcugga

SEQ ID NO: 1314038 - RNA, 26 nt, Human
ucucacucugucacccaggcuggagu

SEQ ID NO: 1314039 - RNA, 27 nt, Human
ucucacucugucacccaggcuggagug

SEQ ID NO: 1314040 - RNA, 23 nt, Human
ucuccugccucugccucccgagc

SEQ ID NO: 1314041 - RNA, 23 nt, Human
ucucgaacuccugaucucaggcg

SEQ ID NO: 1314042 - RNA, 25 nt, Human
ucugcagcuccaacaacagcucacc

SEQ ID NO: 1314043 - RNA, 24 nt, Human
ucugucacccaggcuggagugcag

SEQ ID NO: 1314044 - RNA, 24 nt, Human
ucuguuacccaggcuggagugcag

SEQ ID NO: 1314045 - RNA, 18 nt, Human
ucuguucuuaaauacucu

SEQ ID NO: 1314046 - RNA, 23 nt, Human
ucuugcucuguuacccaggcugg

SEQ ID NO: 1314047 - RNA, 24 nt, Human
ucuugcucuguuacccaggcugga

SEQ ID NO: 1314048 - RNA, 20 nt, Human
ugaaacagguggucagguac

SEQ ID NO: 1314049 - RNA, 18 nt, Human
ugagacagagucuugcuc

SEQ ID NO: 1314050 - RNA, 22 nt, Human
ugagacagagucuugcucuguu

SEQ ID NO: 1314051 - RNA, 18 nt, Human
ugaucucaggcgauccgc

SEQ ID NO: 1314052 - RNA, 24 nt, Human
ugccucugccucccgagcagcugg

SEQ ID NO: 1314053 - RNA, 24 nt, Human
ugcucuguuacccaggcuggagug

SEQ ID NO: 1314054 - RNA, 18 nt, Human
ugcugggauuacagaugu

SEQ ID NO: 1314055 - RNA, 24 nt, Human
ugcugggauuacagaugugagcca

SEQ ID NO: 1314056 - RNA, 19 nt, Human
uggagugcaguggcgugau

SEQ ID NO: 1314057 - RNA, 23 nt, Human
uggagugcaguggcgugaucucg

SEQ ID NO: 1314058 - RNA, 24 nt, Human
uggagugcaguggcgugaucucgg

SEQ ID NO: 1314059 - RNA, 18 nt, Human
uggagugcagugguacaa

SEQ ID NO: 1314060 - RNA, 19 nt, Human
uggagugcagugguacaau

SEQ ID NO: 1314061 - RNA, 20 nt, Human
uggcgugaucucggcucacu

SEQ ID NO: 1314062 - RNA, 18 nt, Human
uggcuccguccccaccca

SEQ ID NO: 1314063 - RNA, 18 nt, Human
ugggauuacagaugugag

SEQ ID NO: 1314064 - RNA, 19 nt, Human
ugggauuacagaugugagc

SEQ ID NO: 1314065 - RNA, 22 nt, Human
ugggauuacagaugugagccac

SEQ ID NO: 1314066 - RNA, 24 nt, Human
ugggauuacagaugugagccacca

SEQ ID NO: 1314067 - RNA, 18 nt, Human
ugggauuacaggcgugug

SEQ ID NO: 1314068 - RNA, 21 nt, Human
ugggauuacaggcguguguca

SEQ ID NO: 1314069 - RNA, 22 nt, Human
ugggauuacaggcgugugucac

SEQ ID NO: 1314070 - RNA, 22 nt, Human
ugggauuacaggcgugugucac

SEQ ID NO: 1314071 - RNA, 24 nt, Human
ugggauuacaggcgugugucacua

SEQ ID NO: 1314072 - RNA, 22 nt, Human
uguaccacgugggaggggccuu

SEQ ID NO: 1314073 - RNA, 24 nt, Human
uuacccaggcuggagugcaguggc

SEQ ID NO: 1314074 - RNA, 24 nt, Human
uuaguagagacaggguuucaccau

SEQ ID NO: 1314075 - RNA, 19 nt, Human
uuauuuuuuugagacagag

SEQ ID NO: 1314076 - RNA, 28 nt, Human
uucuuuuuuuuuuuuuuagagacagggg

SEQ ID NO: 1314077 - RNA, 24 nt, Human
uugcucuguuacccaggcuggagu

SEQ ID NO: 1314078 - RNA, 24 nt, Human
uuucaccaugugggccaggcuggu

SEQ ID NO: 1314079 - RNA, 21 nt, Human
uuuucuuuuuuuugaggaguc

SEQ ID NO: 1314080 - RNA, 24 nt, Human
uuuuuaguagagacaggguuucac

SEQ ID NO: 1314081 - RNA, 20 nt, Human
uuuuuguauuuuuaguagag

SEQ ID NO: 1314082 - RNA, 27 nt, Human
uuuuuuuuuuuuagagacagggucuca

SEQ ID NO: 1314083 - RNA, 21 nt, Human
cgcccgcgggggaggccgccu

SEQ ID NO: 1314084 - RNA, 19 nt, Human
cgccuccucccggcagccc

SEQ ID NO: 1314085 - RNA, 20 nt, Human
ggcagcccgcccccuccggg

SEQ ID NO: 1314086 - RNA, 23 nt, Human
ucccggcagcccgcccccuccgg

SEQ ID NO: 1314087 - RNA, 21 nt, Human
uccggggccacccaggaccaa

SEQ ID NO: 1314088 - RNA, 24 nt, Human
uccggggccacccaggaccaagag

SEQ ID NO: 1314089 - RNA, 21 nt, Human
aaucuguuucuucccacucug

SEQ ID NO: 1314090 - RNA, 23 nt, Human
gccagaauccaaaggccagaacu

SEQ ID NO: 1314091 - RNA, 19 nt, Human
ucaccaguuuugauguucu

SEQ ID NO: 1314092 - RNA, 20 nt, Human
ucagaacagaaggggaucaa

SEQ ID NO: 1314093 - RNA, 24 nt, Human
uccaaaggccagaacuugcggacc

SEQ ID NO: 1314094 - RNA, 21 nt, Human
ucuguuucuucccacucugug

SEQ ID NO: 1314095 - RNA, 22 nt, Human
ugacaggugugacuaccagguc

SEQ ID NO: 1314096 - RNA, 19 nt, Human
ugccuuagcaguauugaag

SEQ ID NO: 1314097 - RNA, 19 nt, Human
acagacgaggaacguugcg

SEQ ID NO: 1314098 - RNA, 18 nt, Human
aggaagucuggaguccag

SEQ ID NO: 1314099 - RNA, 23 nt, Human
aggagcgugcacagcucccgugc

SEQ ID NO: 1314100 - RNA, 20 nt, Human
aggaggcggugagcguccug

SEQ ID NO: 1314101 - RNA, 21 nt, Human
cacccgaacauaaagcucccg

SEQ ID NO: 1314102 - RNA, 18 nt, Human
ccaagcagcacccgaaca

SEQ ID NO: 1314103 - RNA, 18 nt, Human
ccccaagcagcacccgaa

SEQ ID NO: 1314104 - RNA, 20 nt, Human
ccccaagcagcacccgaaca

SEQ ID NO: 1314105 - RNA, 20 nt, Human
ccucaucugugaaguggagc

SEQ ID NO: 1314106 - RNA, 20 nt, Human
ccuccacacucuccacugca

SEQ ID NO: 1314107 - RNA, 18 nt, Human
ccuggcugccuuccagag

SEQ ID NO: 1314108 - RNA, 18 nt, Human
cgaggaacguugcggggg

SEQ ID NO: 1314109 - RNA, 22 nt, Human
cuguccccaagcagcacccgaa

SEQ ID NO: 1314110 - RNA, 23 nt, Human
gagcagcagccccugaugugccc

SEQ ID NO: 1314111 - RNA, 24 nt, Human
gcagcagccccugaugugcccucu

SEQ ID NO: 1314112 - RNA, 18 nt, Human
gcuguccccaagcagcac

SEQ ID NO: 1314113 - RNA, 21 nt, Human
gugaaguggagcagcagcccc

SEQ ID NO: 1314114 - RNA, 21 nt, Human
uaggaagagcuguccccaagc

SEQ ID NO: 1314115 - RNA, 20 nt, Human
uccccaagcagcacccgaac

SEQ ID NO: 1314116 - RNA, 19 nt, Human
ugaaguggagcagcagccc

SEQ ID NO: 1314117 - RNA, 22 nt, Human
ugaaguggagcagcagccccug

SEQ ID NO: 1314118 - RNA, 21 nt, Human
ugaggagcgugcacagcuccc

SEQ ID NO: 1314119 - RNA, 19 nt, Human
ugagguggccgugcuucag

SEQ ID NO: 1314120 - RNA, 24 nt, Human
ugcacagcucccgugcagcgacca

SEQ ID NO: 1314121 - RNA, 18 nt, Human
ugcccgaagaggaggcgg

SEQ ID NO: 1314122 - RNA, 20 nt, Human
ugcccgaagaggaggcggug

SEQ ID NO: 1314123 - RNA, 18 nt, Human
ugcuucaguccuggcugc

SEQ ID NO: 1314124 - RNA, 21 nt, Human
uugaaccuucuugaccucucu

SEQ ID NO: 1314125 - RNA, 21 nt, Human
aagggagaagaaaucagagag

SEQ ID NO: 1314126 - RNA, 23 nt, Human
agacaccaaaaggcucugcagcc

SEQ ID NO: 1314127 - RNA, 26 nt, Human
aggaacacacagggaggcauucagac

SEQ ID NO: 1314128 - RNA, 19 nt, Human
aggaaggaacacacaggga

SEQ ID NO: 1314129 - RNA, 20 nt, Human
aggaaggaacacacagggaa

SEQ ID NO: 1314130 - RNA, 23 nt, Human
caaucugucauucacggaucccu

SEQ ID NO: 1314131 - RNA, 19 nt, Human
caccaaaaggcucugcagc

SEQ ID NO: 1314132 - RNA, 20 nt, Human
ccaaccaugccuuggccccc

SEQ ID NO: 1314133 - RNA, 20 nt, Human
ccccaaccaugccuuggccc

SEQ ID NO: 1314134 - RNA, 21 nt, Human
cccccaaccaugccuuggccc

SEQ ID NO: 1314135 - RNA, 24 nt, Human
cggaucccugaggaaggaacacac

SEQ ID NO: 1314136 - RNA, 21 nt, Human
gaagggagaagaaaucagaga

SEQ ID NO: 1314137 - RNA, 22 nt, Human
gaagggagaagaaaucagagag

SEQ ID NO: 1314138 - RNA, 20 nt, Human
gccccagggcugagccccca

SEQ ID NO: 1314139 - RNA, 27 nt, Human
ggcgaagggagaagaaaagggagggcc

SEQ ID NO: 1314140 - RNA, 22 nt, Human
gggcugagcccccagcccagcc

SEQ ID NO: 1314141 - RNA, 20 nt, Human
ggugcugugggcgaagggag

SEQ ID NO: 1314142 - RNA, 23 nt, Human
ucccccaaccaugccuuggcccc

SEQ ID NO: 1314143 - RNA, 18 nt, Human
ucugcagcccagguuggc

SEQ ID NO: 1314144 - RNA, 18 nt, Human
ugagcccccagcccagcc

SEQ ID NO: 1314145 - RNA, 25 nt, Human
ugcagcccagguuggcccugcuucu

SEQ ID NO: 1314146 - RNA, 21 nt, Human
ugggugcugugggcgaaggga

SEQ ID NO: 1314147 - RNA, 21 nt, Human
ugugggcgaagggagaagaaa

SEQ ID NO: 1314148 - RNA, 19 nt, Human
uugggauagcagcuccccc

SEQ ID NO: 1314149 - RNA, 22 nt, Human
aaggguuuggcuuuauuguugc

SEQ ID NO: 1314150 - RNA, 21 nt, Human
acagagcccccaaagggugcc

SEQ ID NO: 1314151 - RNA, 22 nt, Human
agagccagaccaagggccccug

SEQ ID NO: 1314152 - RNA, 19 nt, Human
agccuggaguaugccagcu

SEQ ID NO: 1314153 - RNA, 19 nt, Human
aggcggcggggcagggcug

SEQ ID NO: 1314154 - RNA, 20 nt, Human
aggcggcggggcagggcugg

SEQ ID NO: 1314155 - RNA, 20 nt, Human
cagagcccccaaagggugcc

SEQ ID NO: 1314156 - RNA, 19 nt, Human
caggcccagcccuggaggc

SEQ ID NO: 1314157 - RNA, 23 nt, Human
ccaguguuuuuucaguggguggc

SEQ ID NO: 1314158 - RNA, 19 nt, Human
cccagcggagucccaggag

SEQ ID NO: 1314159 - RNA, 18 nt, Human
cccaugcuugcugugggg

SEQ ID NO: 1314160 - RNA, 21 nt, Human
cccccaaagggugccuggucc

SEQ ID NO: 1314161 - RNA, 20 nt, Human
ccucaguuuccccagcugga

SEQ ID NO: 1314162 - RNA, 21 nt, Human
ccugccaggucgaggcugcgc

SEQ ID NO: 1314163 - RNA, 25 nt, Human
ccuggaggcccaggagagccagacc

SEQ ID NO: 1314164 - RNA, 19 nt, Human
cgcggccacgugguugugg

SEQ ID NO: 1314165 - RNA, 24 nt, Human
cuauaucugucacccaguguuuuu

SEQ ID NO: 1314166 - RNA, 21 nt, Human
gagccucaguuuccccagcug

SEQ ID NO: 1314167 - RNA, 19 nt, Human
gaguuugggguagggugug

SEQ ID NO: 1314168 - RNA, 19 nt, Human
gcccaggagagccagacca

SEQ ID NO: 1314169 - RNA, 20 nt, Human
gccucaguuuccccagcugg

SEQ ID NO: 1314170 - RNA, 21 nt, Human
gcgcggccacgugguuguggg

SEQ ID NO: 1314171 - RNA, 24 nt, Human
gcggcggggcagggcuggaggcac

SEQ ID NO: 1314172 - RNA, 21 nt, Human
ggcccaggagagccagaccaa

SEQ ID NO: 1314173 - RNA, 23 nt, Human
ggccccuggugggcguugucucc

SEQ ID NO: 1314174 - RNA, 22 nt, Human
ggcguugucuccucaguccacg

SEQ ID NO: 1314175 - RNA, 21 nt, Human
gggcagggcuggaggcacgcg

SEQ ID NO: 1314176 - RNA, 22 nt, Human
gguuguggggaggaguccgugg

SEQ ID NO: 1314177 - RNA, 19 nt, Human
guugcugccuccaucugug

SEQ ID NO: 1314178 - RNA, 24 nt, Human
ucacccaguguuuuuucagugggu

SEQ ID NO: 1314179 - RNA, 23 nt, Human
ucaggcccgguguggcgaccagg

SEQ ID NO: 1314180 - RNA, 28 nt, Human
ucaggcccgguguggcgaccaggucacg

SEQ ID NO: 1314181 - RNA, 19 nt, Human
ucccaggagucugagcugc

SEQ ID NO: 1314182 - RNA, 22 nt, Human
ucccugcaaucacacguggcuu

SEQ ID NO: 1314183 - RNA, 22 nt, Human
uccgugcugagugcuggaaggg

SEQ ID NO: 1314184 - RNA, 18 nt, Human
uccguggacagagccccc

SEQ ID NO: 1314185 - RNA, 23 nt, Human
ucugagcugcucugcugggccuc

SEQ ID NO: 1314186 - RNA, 25 nt, Human
ugagggucccuauaucugucaccca

SEQ ID NO: 1314187 - RNA, 19 nt, Human
ugccucugugucucggcca

SEQ ID NO: 1314188 - RNA, 19 nt, Human
ugcugagugcuggaagggu

SEQ ID NO: 1314189 - RNA, 19 nt, Human
uggacagagcccccaaagg

SEQ ID NO: 1314190 - RNA, 22 nt, Human
uggggaggaguccguggacaga

SEQ ID NO: 1314191 - RNA, 19 nt, Human
ugugagggucccuauaucu

SEQ ID NO: 1314192 - RNA, 23 nt, Human
uguggcgaccaggucacgggcac

SEQ ID NO: 1314193 - RNA, 23 nt, Human
ugugugccucaagaccucaaaau

SEQ ID NO: 1314194 - RNA, 24 nt, Human
ugugugccucaagaccucaaaauu

SEQ ID NO: 1314195 - RNA, 23 nt, Human
uguuuggugaccccagugugugc

SEQ ID NO: 1314196 - RNA, 21 nt, Human
aaagcuugaaaauaaaaguuu

SEQ ID NO: 1314197 - RNA, 24 nt, Human
aagcugaggugggaggauuucuug

SEQ ID NO: 1314198 - RNA, 31 nt, Human
accacugcacucaaaaaaaaaaaaaaaaaaa

SEQ ID NO: 1314199 - RNA, 24 nt, Human
agcacuuugggaggccaagguggg

SEQ ID NO: 1314200 - RNA, 21 nt, Human
aggccaagguggguggaucac

SEQ ID NO: 1314201 - RNA, 24 nt, Human
caacaauggcaccacugcacucaa

SEQ ID NO: 1314202 - RNA, 21 nt, Human
caagguggguggaucacuuga

SEQ ID NO: 1314203 - RNA, 23 nt, Human
caagguggguggaucacuugagu

SEQ ID NO: 1314204 - RNA, 20 nt, Human
caauaacugcaauaaacuuu

SEQ ID NO: 1314205 - RNA, 24 nt, Human
caccuguagucccagcuacucugg

SEQ ID NO: 1314206 - RNA, 24 nt, Human
cacgccuguaaucccagcacuuug

SEQ ID NO: 1314207 - RNA, 20 nt, Human
cacugcacucaaaaaaaaaa

SEQ ID NO: 1314208 - RNA, 24 nt, Human
cagcacuuugggaggccaaggugg

SEQ ID NO: 1314209 - RNA, 22 nt, Human
ccuguaaucccagcacuuuggg

SEQ ID NO: 1314210 - RNA, 22 nt, Human
ccuguagucccagcuacucugg

SEQ ID NO: 1314211 - RNA, 23 nt, Human
ccuguagucccagcuacucugga

SEQ ID NO: 1314212 - RNA, 23 nt, Human
cgccuguaaucccagcacuuugg

SEQ ID NO: 1314213 - RNA, 22 nt, Human
cucacgccuguaaucccagcac

SEQ ID NO: 1314214 - RNA, 24 nt, Human
cucacgccuguaaucccagcacuu

SEQ ID NO: 1314215 - RNA, 20 nt, Human
cugcacucaaaaaaaaaaaa

SEQ ID NO: 1314216 - RNA, 23 nt, Human
cugcacucaaaaaaaaaaaaaaa

SEQ ID NO: 1314217 - RNA, 25 nt, Human
cugcacucaaaaaaaaaaaaaaaaa

SEQ ID NO: 1314218 - RNA, 18 nt, Human
gagcaacaauggcaccac

SEQ ID NO: 1314219 - RNA, 23 nt, Human
gaucacuugaguucaagaccaga

SEQ ID NO: 1314220 - RNA, 20 nt, Human
gauuucuugagccuggaaga

SEQ ID NO: 1314221 - RNA, 24 nt, Human
gccuggaagauugaggcugcagug

SEQ ID NO: 1314222 - RNA, 20 nt, Human
ggcugcagugagcaacaaug

SEQ ID NO: 1314223 - RNA, 24 nt, Human
gguggcucacgccuguaaucccag

SEQ ID NO: 1314224 - RNA, 23 nt, Human
gguuugguggcucacgccuguaa

SEQ ID NO: 1314225 - RNA, 22 nt, Human
guggcaugcaccuguaguccca

SEQ ID NO: 1314226 - RNA, 22 nt, Human
guggcuggguuugguggcucaa

SEQ ID NO: 1314227 - RNA, 22 nt, Human
uaccuaaaguaaaauugguggc

SEQ ID NO: 1314228 - RNA, 23 nt, Human
ugaaagacuuuaaaauuuauuuu

SEQ ID NO: 1314229 - RNA, 24 nt, Human
ugagccuggaagauugaggcugca

SEQ ID NO: 1314230 - RNA, 24 nt, Human
ugaggugggaggauuucuugagcc

SEQ ID NO: 1314231 - RNA, 25 nt, Human
ugcaccuguagucccagcuacucug

SEQ ID NO: 1314232 - RNA, 23 nt, Human
uggaagcugaggugggaggauuu

SEQ ID NO: 1314233 - RNA, 20 nt, Human
uggaucacuugaguucaaga

SEQ ID NO: 1314234 - RNA, 21 nt, Human
uggaucacuugaguucaagac

SEQ ID NO: 1314235 - RNA, 26 nt, Human
uggaucacuugaguucaagaccagac

SEQ ID NO: 1314236 - RNA, 22 nt, Human
uggcaugcaccuguagucccag

SEQ ID NO: 1314237 - RNA, 24 nt, Human
uggcucacgccuguaaucccagca

SEQ ID NO: 1314238 - RNA, 22 nt, Human
ugggaggauuucuugagccugg

SEQ ID NO: 1314239 - RNA, 23 nt, Human
ugggaggccaagguggguggauc

SEQ ID NO: 1314240 - RNA, 24 nt, Human
ugggaggccaagguggguggauca

SEQ ID NO: 1314241 - RNA, 25 nt, Human
uugguggcucacgccuguaauccca

SEQ ID NO: 1314242 - RNA, 18 nt, Human
aaguagccaucucugaag

SEQ ID NO: 1314243 - RNA, 22 nt, Human
aggcagaugagggccuuggggu

SEQ ID NO: 1314244 - RNA, 18 nt, Human
aggucuccucugccaucu

SEQ ID NO: 1314245 - RNA, 21 nt, Human
cagcucaagccgcagggggcc

SEQ ID NO: 1314246 - RNA, 21 nt, Human
ccagcaaacccuuuauggacu

SEQ ID NO: 1314247 - RNA, 23 nt, Human
ccagcacagagacgggauggcug

SEQ ID NO: 1314248 - RNA, 20 nt, Human
ccauccagcacagagacggg

SEQ ID NO: 1314249 - RNA, 19 nt, Human
ccaugugacaaaugaguug

SEQ ID NO: 1314250 - RNA, 20 nt, Human
ccccaucuaaaggucuccuc

SEQ ID NO: 1314251 - RNA, 21 nt, Human
ccgcagcucaagccgcagggg

SEQ ID NO: 1314252 - RNA, 22 nt, Human
ccuuuauggacugauuuucuca

SEQ ID NO: 1314253 - RNA, 21 nt, Human
cgaaguagccaucucugaagc

SEQ ID NO: 1314254 - RNA, 20 nt, Human
cgcagcucaagccgcagggg

SEQ ID NO: 1314255 - RNA, 18 nt, Human
cuacacucuaaaaguagg

SEQ ID NO: 1314256 - RNA, 21 nt, Human
cuggaggagacagcucuccuu

SEQ ID NO: 1314257 - RNA, 18 nt, Human
cugggugacagccaggcu

SEQ ID NO: 1314258 - RNA, 23 nt, Human
cuuaggcugguguuggccccagc

SEQ ID NO: 1314259 - RNA, 20 nt, Human
gcugggacaugugaccgccc

SEQ ID NO: 1314260 - RNA, 24 nt, Human
ggacaaaggcagaugagggccuug

SEQ ID NO: 1314261 - RNA, 24 nt, Human
ggauggcugggugacagccaggcu

SEQ ID NO: 1314262 - RNA, 18 nt, Human
uccaccagcuggaggaga

SEQ ID NO: 1314263 - RNA, 20 nt, Human
uccaggaggaggauaggaag

SEQ ID NO: 1314264 - RNA, 24 nt, Human
uccgcagcucaagccgcagggggc

SEQ ID NO: 1314265 - RNA, 23 nt, Human
ucuaaaggucuccucugccaucu

SEQ ID NO: 1314266 - RNA, 24 nt, Human
ucugccaucugcucugggaguugg

SEQ ID NO: 1314267 - RNA, 20 nt, Human
uggcugggugacagccaggc

SEQ ID NO: 1314268 - RNA, 22 nt, Human
ugggacaaaggcagaugagggc

SEQ ID NO: 1314269 - RNA, 20 nt, Human
ugggacaccacgaggacgaa

SEQ ID NO: 1314270 - RNA, 21 nt, Human
ugguguuggccccagcaaacc

SEQ ID NO: 1314271 - RNA, 18 nt, Human
uuggccagugugauccug

SEQ ID NO: 1314272 - RNA, 21 nt, Human
agauccuuggcaaggcuguuc

SEQ ID NO: 1314273 - RNA, 21 nt, Human
uccuuggcaaggcuguucuga

SEQ ID NO: 1314274 - RNA, 22 nt, Human
ccucuaagauuauaguuauuaa

SEQ ID NO: 1314275 - RNA, 21 nt, Human
accacagccuucagcagcgac

SEQ ID NO: 1314276 - RNA, 19 nt, Human
acugggauggggugaacgg

SEQ ID NO: 1314277 - RNA, 22 nt, Human
agacuugaaaagccguugggcg

SEQ ID NO: 1314278 - RNA, 18 nt, Human
auagagcccugggccguc

SEQ ID NO: 1314279 - RNA, 20 nt, Human
auagagcccugggccgucug

SEQ ID NO: 1314280 - RNA, 18 nt, Human
caagugcaucgcccgccc

SEQ ID NO: 1314281 - RNA, 19 nt, Human
caccacagccuucagcagc

SEQ ID NO: 1314282 - RNA, 21 nt, Human
caccacagccuucagcagcga

SEQ ID NO: 1314283 - RNA, 23 nt, Human
cagcagguuuucacccuggugcc

SEQ ID NO: 1314284 - RNA, 21 nt, Human
cagccuccgaccucucagacc

SEQ ID NO: 1314285 - RNA, 22 nt, Human
cagcgacacucgcagccuccga

SEQ ID NO: 1314286 - RNA, 19 nt, Human
caggcagcgcuccaccccc

SEQ ID NO: 1314287 - RNA, 20 nt, Human
cccgcggcgucgcccuugac

SEQ ID NO: 1314288 - RNA, 21 nt, Human
cccgcggcgucgcccuugaca

SEQ ID NO: 1314289 - RNA, 24 nt, Human
cccgguccaccacagccuucagca

SEQ ID NO: 1314290 - RNA, 19 nt, Human
cccguccuuuggccgccug

SEQ ID NO: 1314291 - RNA, 18 nt, Human
cccugggccgucuggccc

SEQ ID NO: 1314292 - RNA, 21 nt, Human
ccguggaaacugggauggggu

SEQ ID NO: 1314293 - RNA, 22 nt, Human
ccucagggucaagugcaucgcc

SEQ ID NO: 1314294 - RNA, 21 nt, Human
ccugggcucaagguccgcucc

SEQ ID NO: 1314295 - RNA, 19 nt, Human
cggcgucgcccuugacagg

SEQ ID NO: 1314296 - RNA, 19 nt, Human
cguugggcgcgcgccugca

SEQ ID NO: 1314297 - RNA, 18 nt, Human
cucaagguccgcuccucu

SEQ ID NO: 1314298 - RNA, 22 nt, Human
cucagggucaagugcaucgccc

SEQ ID NO: 1314299 - RNA, 21 nt, Human
cuccacaauccgcgauccagc

SEQ ID NO: 1314300 - RNA, 20 nt, Human
cugcacggcgguugcugccc

SEQ ID NO: 1314301 - RNA, 18 nt, Human
cugcagcuccgaugccgg

SEQ ID NO: 1314302 - RNA, 21 nt, Human
cugcgcgccaggcagcgcucc

SEQ ID NO: 1314303 - RNA, 18 nt, Human
cuuguacaucucucugga

SEQ ID NO: 1314304 - RNA, 19 nt, Human
gagcuggcgggccugguac

SEQ ID NO: 1314305 - RNA, 20 nt, Human
gcacucuguauccacacgga

SEQ ID NO: 1314306 - RNA, 22 nt, Human
gcccgcccacuugagggguugc

SEQ ID NO: 1314307 - RNA, 19 nt, Human
gcccugggccgucuggccc

SEQ ID NO: 1314308 - RNA, 22 nt, Human
gcugcagcuccgaugccggccu

SEQ ID NO: 1314309 - RNA, 23 nt, Human
gcugcagcuccgaugccggccug

SEQ ID NO: 1314310 - RNA, 22 nt, Human
uacacacugcaggucacuacuc

SEQ ID NO: 1314311 - RNA, 19 nt, Human
ucagaccgagugagacuug

SEQ ID NO: 1314312 - RNA, 20 nt, Human
uccacaauccgcgauccagc

SEQ ID NO: 1314313 - RNA, 22 nt, Human
ucccggaagccgcucccugggc

SEQ ID NO: 1314314 - RNA, 19 nt, Human
ucccugggcucaagguccg

SEQ ID NO: 1314315 - RNA, 25 nt, Human
ucccugggcucaagguccgcuccuc

SEQ ID NO: 1314316 - RNA, 20 nt, Human
uccgaccucucagaccgagu

SEQ ID NO: 1314317 - RNA, 19 nt, Human
uccgcgcuacacaucuaga

SEQ ID NO: 1314318 - RNA, 21 nt, Human
ugagacuugaaaagccguugg

SEQ ID NO: 1314319 - RNA, 22 nt, Human
ugagacuugaaaagccguuggg

SEQ ID NO: 1314320 - RNA, 21 nt, Human
uggauccugggcccuggcacu

SEQ ID NO: 1314321 - RNA, 22 nt, Human
uggauccugggcccuggcacug

SEQ ID NO: 1314322 - RNA, 22 nt, Human
ugggcccuggcacugggcacuc

SEQ ID NO: 1314323 - RNA, 22 nt, Human
ugggcucaagguccgcuccucu

SEQ ID NO: 1314324 - RNA, 24 nt, Human
ugguaaccgggaugguaucgagca

SEQ ID NO: 1314325 - RNA, 21 nt, Human
aagaagggccauucgccgaug

SEQ ID NO: 1314326 - RNA, 18 nt, Human
cagccuccagaaugggaa

SEQ ID NO: 1314327 - RNA, 22 nt, Human
caugaaagaaucaguauuaaca

SEQ ID NO: 1314328 - RNA, 21 nt, Human
ccgcagcaguuuugaggccug

SEQ ID NO: 1314329 - RNA, 22 nt, Human
ccgcagcaguuuugaggccugc

SEQ ID NO: 1314330 - RNA, 23 nt, Human
gucuugucaucucccacagccuc

SEQ ID NO: 1314331 - RNA, 21 nt, Human
ucaguauuaacaaaacauuaa

SEQ ID NO: 1314332 - RNA, 21 nt, Human
ucagugucuggacuuccaggu

SEQ ID NO: 1314333 - RNA, 22 nt, Human
ucaucucccacagccuccagaa

SEQ ID NO: 1314334 - RNA, 26 nt, Human
ugucuugucaucucccacagccucca

SEQ ID NO: 1314335 - RNA, 18 nt, Human
uucagugucuggacuucc

SEQ ID NO: 1314336 - RNA, 21 nt, Human
uucagugucuggacuuccagg

SEQ ID NO: 1314337 - RNA, 22 nt, Human
uugaggccugcguucagugucu

SEQ ID NO: 1314338 - RNA, 20 nt, Human
agaacagucaggagaauuag

SEQ ID NO: 1314339 - RNA, 19 nt, Human
aucuaaagugggcacagga

SEQ ID NO: 1314340 - RNA, 18 nt, Human
caaggacuucuuuuugau

SEQ ID NO: 1314341 - RNA, 18 nt, Human
caccagacccagcagcag

SEQ ID NO: 1314342 - RNA, 23 nt, Human
cagcagcagcagccacuucaugg

SEQ ID NO: 1314343 - RNA, 19 nt, Human
ccagacccagcagcagcag

SEQ ID NO: 1314344 - RNA, 33 nt, Human; identical to SEQ ID NO: 1260239

SEQ ID NO: 1314345 - RNA, 21 nt, Human
cuggcuggguugagguugugc

SEQ ID NO: 1314346 - RNA, 22 nt, Human
cuucaugguucuucccgggucc

SEQ ID NO: 1314347 - RNA, 21 nt, Human
gaccuccacacuccccuggga

SEQ ID NO: 1314348 - RNA, 21 nt, Human
gagguggcugaagagacuuag

SEQ ID NO: 1314349 - RNA, 20 nt, Human
gauacaucuaaagugggcac

SEQ ID NO: 1314350 - RNA, 30 nt, Human; identical to SEQ ID NO: 1260245

SEQ ID NO: 1314351 - RNA, 21 nt, Human
gccaccagacccagcagcagc

SEQ ID NO: 1314352 - RNA, 25 nt, Human
ggacagaggccagaucuuccuggga

SEQ ID NO: 1314353 - RNA, 18 nt, Human
ggacagggaacagggcca

SEQ ID NO: 1314354 - RNA, 25 nt, Human
uaaagugggcacaggacagaggcca

SEQ ID NO: 1314355 - RNA, 24 nt, Human
uacaugaugcacucagagagcgcc

SEQ ID NO: 1314356 - RNA, 20 nt, Human
uaccagggugggagccuccc

SEQ ID NO: 1314357 - RNA, 22 nt, Human
ucuucccgggucccaacucgag

SEQ ID NO: 1314358 - RNA, 19 nt, Human
ugggaagaacagucaggag

SEQ ID NO: 1314359 - RNA, 21 nt, Human
ugggcacaggacagaggccag

SEQ ID NO: 1314360 - RNA, 25 nt, Human
acuccuccagcuccaccccuugccg

SEQ ID NO: 1314361 - RNA, 27 nt, Human
acucugcauguauucuccucuuccccu

SEQ ID NO: 1314362 - RNA, 20 nt, Human
acuuggcaacauuucagccc

SEQ ID NO: 1314363 - RNA, 19 nt, Human
agggggaccggggcaagcc

SEQ ID NO: 1314364 - RNA, 21 nt, Human
caccccagccccagccaccau

SEQ ID NO: 1314365 - RNA, 19 nt, Human
caccccuugccggcuaccu

SEQ ID NO: 1314366 - RNA, 22 nt, Human
cagaaaaggaccugacuuggca

SEQ ID NO: 1314367 - RNA, 20 nt, Human
cagccaccaucagaaaagga

SEQ ID NO: 1314368 - RNA, 26 nt, Human
cagccaccaucagaaaaggaccugac

SEQ ID NO: 1314369 - RNA, 18 nt, Human
cagccuggacucguucac

SEQ ID NO: 1314370 - RNA, 21 nt, Human
cagccuggacucguucacaaa

SEQ ID NO: 1314371 - RNA, 19 nt, Human
caucagaaaaggaccugac

SEQ ID NO: 1314372 - RNA, 22 nt, Human
ccagccccagccaccaucagaa

SEQ ID NO: 1314373 - RNA, 20 nt, Human
ccccagccccagccaccauc

SEQ ID NO: 1314374 - RNA, 21 nt, Human
cccugagcucaccccagcccc

SEQ ID NO: 1314375 - RNA, 21 nt, Human
ccuccagcuccaccccuugcc

SEQ ID NO: 1314376 - RNA, 23 nt, Human
ccugagcucaccccagccccagc

SEQ ID NO: 1314377 - RNA, 21 nt, Human
ccuugccggcuaccuuuucuu

SEQ ID NO: 1314378 - RNA, 22 nt, Human
ccuugccggcuaccuuuucuug

SEQ ID NO: 1314379 - RNA, 18 nt, Human
cggggcaagccgguuggg

SEQ ID NO: 1314380 - RNA, 19 nt, Human
cucacaauuuucugcagcc

SEQ ID NO: 1314381 - RNA, 26 nt, Human
cucacaauuuucugcagccuggacuc

SEQ ID NO: 1314382 - RNA, 21 nt, Human
cucaccccagccccagccacc

SEQ ID NO: 1314383 - RNA, 19 nt, Human
cuccucuuccccucccuga

SEQ ID NO: 1314384 - RNA, 18 nt, Human
cucugcauguauucuccu

SEQ ID NO: 1314385 - RNA, 20 nt, Human
cuuggcaacauuucagcccu

SEQ ID NO: 1314386 - RNA, 21 nt, Human
gacuccuccagcuccaccccu

SEQ ID NO: 1314387 - RNA, 21 nt, Human
gagacuccuccagcuccaccc

SEQ ID NO: 1314388 - RNA, 22 nt, Human
gauuuccucaucgauaacgcuc

SEQ ID NO: 1314389 - RNA, 24 nt, Human
ggaccggggcaagccgguugggga

SEQ ID NO: 1314390 - RNA, 21 nt, Human
ugcauguauucuccucuuccc

SEQ ID NO: 1314391 - RNA, 23 nt, Human
uuggcaacauuucagcccuucuc

SEQ ID NO: 1314392 - RNA, 24 nt, Human
aaagauagccaauaagggcuuaag

SEQ ID NO: 1314393 - RNA, 22 nt, Human
acuuuaaauauuaaaagaagaa

SEQ ID NO: 1314394 - RNA, 24 nt, Human
agagcagaacuggugggacuugag

SEQ ID NO: 1314395 - RNA, 22 nt, Human
agauagccaauaagggcuuaag

SEQ ID NO: 1314396 - RNA, 18 nt, Human
agcagggugaggcucagg

SEQ ID NO: 1314397 - RNA, 21 nt, Human
agcagggugaggcucaggugg

SEQ ID NO: 1314398 - RNA, 23 nt, Human
agcuauaugaucucuccaagcag

SEQ ID NO: 1314399 - RNA, 18 nt, Human
aggggguggggagcacaa

SEQ ID NO: 1314400 - RNA, 21 nt, Human
aggggguggggagcacaaggg

SEQ ID NO: 1314401 - RNA, 22 nt, Human
agguaggggguggggagcacaa

SEQ ID NO: 1314402 - RNA, 24 nt, Human
agguaggggguggggagcacaagg

SEQ ID NO: 1314403 - RNA, 22 nt, Human
caauaagggcuuaagaaaggga

SEQ ID NO: 1314404 - RNA, 26 nt, Human
caggaggaguagaaauuucuuauggc

SEQ ID NO: 1314405 - RNA, 21 nt, Human
ccacucagggcucaacagcag

SEQ ID NO: 1314406 - RNA, 20 nt, Human
ccgccgccugggcuugcugc

SEQ ID NO: 1314407 - RNA, 23 nt, Human
cuccuuauucuuaaggagcaaag

SEQ ID NO: 1314408 - RNA, 19 nt, Human
cucugaaacaggcuggaag

SEQ ID NO: 1314409 - RNA, 22 nt, Human
cugccuaauucauuagcuauau

SEQ ID NO: 1314410 - RNA, 19 nt, Human
cuucaaaaaauagcucccc

SEQ ID NO: 1314411 - RNA, 18 nt, Human
gcaacaagauggccaggc

SEQ ID NO: 1314412 - RNA, 24 nt, Human
gccaauaagggcuuaagaaaggga

SEQ ID NO: 1314413 - RNA, 20 nt, Human
gcugcguucuccuucgcagu

SEQ ID NO: 1314414 - RNA, 22 nt, Human
gcuugcugcguucuccuucgca

SEQ ID NO: 1314415 - RNA, 19 nt, Human
ggccauggcaauccucuuc

SEQ ID NO: 1314416 - RNA, 19 nt, Human
gggcuacauucccccagua

SEQ ID NO: 1314417 - RNA, 19 nt, Human
guccuccagccuuuccacc

SEQ ID NO: 1314418 - RNA, 21 nt, Human
uaggggguggggagcacaagg

SEQ ID NO: 1314419 - RNA, 22 nt, Human
uaggggguggggagcacaaggg

SEQ ID NO: 1314420 - RNA, 23 nt, Human
uaggggguggggagcacaagggc

SEQ ID NO: 1314421 - RNA, 20 nt, Human
uaguggucucugaaacaggc

SEQ ID NO: 1314422 - RNA, 19 nt, Human
uccaagcagcaacaagagg

SEQ ID NO: 1314423 - RNA, 18 nt, Human
uccuccagccuuuccacc

SEQ ID NO: 1314424 - RNA, 24 nt, Human
uccuuauucuuaaggagcaaaggu

SEQ ID NO: 1314425 - RNA, 19 nt, Human
ucucugaaacaggcuggaa

SEQ ID NO: 1314426 - RNA, 18 nt, Human
ugaaagcauuacagucug

SEQ ID NO: 1314427 - RNA, 19 nt, Human
ugaucucuccaagcagcaa

SEQ ID NO: 1314428 - RNA, 22 nt, Human
ugaucucuccaagcagcaacaa

SEQ ID NO: 1314429 - RNA, 20 nt, Human
ugcugcguucuccuucgcag

SEQ ID NO: 1314430 - RNA, 18 nt, Human
uggagguagggggugggg

SEQ ID NO: 1314431 - RNA, 19 nt, Human
uggcaauccucuuccuauu

SEQ ID NO: 1314432 - RNA, 21 nt, Human
ugggacuugagggaagggucc

SEQ ID NO: 1314433 - RNA, 19 nt, Human
uggggagcacaagggcuac

SEQ ID NO: 1314434 - RNA, 21 nt, Human
uggugggacuugagggaaggg

SEQ ID NO: 1314435 - RNA, 24 nt, Human
uggugggacuugagggaagggucc

SEQ ID NO: 1314436 - RNA, 23 nt, Human
uuaaacaagcaugguuuaaaaau

SEQ ID NO: 1314437 - RNA, 21 nt, Human
uuccccuagccacucagggcu

SEQ ID NO: 1314438 - RNA, 21 nt, Human
uucgcaguccucauucuccuu

SEQ ID NO: 1314439 - RNA, 22 nt, Human
uugcugcguucuccuucgcagu

SEQ ID NO: 1314440 - RNA, 19 nt, Human
cccgccguggacccuccuu

SEQ ID NO: 1314441 - RNA, 20 nt, Human
cccgccguggacccuccuug

SEQ ID NO: 1314442 - RNA, 21 nt, Human
ccguggacccuccuuggguua

SEQ ID NO: 1314443 - RNA, 25 nt, Human
ccuuggguuauuucgagcugugggg

SEQ ID NO: 1314444 - RNA, 21 nt, Human
cuacccgccguggacccuccu

SEQ ID NO: 1314445 - RNA, 22 nt, Human
aaccauuuuaaagcucagcccc

SEQ ID NO: 1314446 - RNA, 23 nt, Human
aaugccagccacgugggcagcag

SEQ ID NO: 1314447 - RNA, 23 nt, Human
acccuccccagacacccauccug

SEQ ID NO: 1314448 - RNA, 23 nt, Human
agcccuugacccuccccagacac

SEQ ID NO: 1314449 - RNA, 23 nt, Human
auuuuaaagcucagccccagccc

SEQ ID NO: 1314450 - RNA, 22 nt, Human
cagcagccugugaugucccacu

SEQ ID NO: 1314451 - RNA, 19 nt, Human
ccagcccuugacccucccc

SEQ ID NO: 1314452 - RNA, 28 nt, Human
cucagccccagcccuugacccuccccag

SEQ ID NO: 1314453 - RNA, 21 nt, Human
cucagccccagcccuugaccu

SEQ ID NO: 1314454 - RNA, 23 nt, Human
gcucagccccagcccuugacccu

SEQ ID NO: 1314455 - RNA, 24 nt, Human
ggccauggagggcugagagaggga

SEQ ID NO: 1314456 - RNA, 21 nt, Human
uaaagcucagccccagcccuu

SEQ ID NO: 1314457 - RNA, 20 nt, Human
uccccagacacccauccugg

SEQ ID NO: 1314458 - RNA, 22 nt, Human
ugugaugucccacucugugaca

SEQ ID NO: 1314459 - RNA, 18 nt, Human
uuaaagcucagccccagc

SEQ ID NO: 1314460 - RNA, 18 nt, Human
aaaaacagaaaagagcac

SEQ ID NO: 1314461 - RNA, 25 nt, Human
aaaaacagaaaagagcaccgguacc

SEQ ID NO: 1314462 - RNA, 22 nt, Human
aaacagaaaagagcaccuucag

SEQ ID NO: 1314463 - RNA, 24 nt, Human
accuucagagauagaugugagagg

SEQ ID NO: 1314464 - RNA, 21 nt, Human
agaaaagagcaccuucagaga

SEQ ID NO: 1314465 - RNA, 24 nt, Human
aggagggcaggagggaggaaaugu

SEQ ID NO: 1314466 - RNA, 20 nt, Human
caggagggcaggagggagga

SEQ ID NO: 1314467 - RNA, 23 nt, Human
ccaggcgccuugcuaguugcugg

SEQ ID NO: 1314468 - RNA, 23 nt, Human
ccaugaugcaaaaacagaaaaga

SEQ ID NO: 1314469 - RNA, 18 nt, Human
cucccagcaaggaacaag

SEQ ID NO: 1314470 - RNA, 22 nt, Human
gaaaagagcaccuucagagaua

SEQ ID NO: 1314471 - RNA, 21 nt, Human
gagggcaggagggaggaaaug

SEQ ID NO: 1314472 - RNA, 21 nt, Human
gagggcaggagggaggaaaug

SEQ ID NO: 1314473 - RNA, 22 nt, Human
gcaaaaacagaaaagagcaccu

SEQ ID NO: 1314474 - RNA, 22 nt, Human
ggaaaggcucugcguugcaaug

SEQ ID NO: 1314475 - RNA, 25 nt, Human
guugcaauguaaaacgauuccaacc

SEQ ID NO: 1314476 - RNA, 19 nt, Human
uaauagaggacagaguccc

SEQ ID NO: 1314477 - RNA, 23 nt, Human
uaccaggcgccuugcuaguugcu

SEQ ID NO: 1314478 - RNA, 25 nt, Human
uaguugcuggggacucccagcaagg

SEQ ID NO: 1314479 - RNA, 21 nt, Human
ucacugaaugauuacagugua

SEQ ID NO: 1314480 - RNA, 21 nt, Human
ucccagcaaggaacaagaugg

SEQ ID NO: 1314481 - RNA, 19 nt, Human
ucugcguugcaauguaaaa

SEQ ID NO: 1314482 - RNA, 19 nt, Human
ugcaaaaacagaaaagagc

SEQ ID NO: 1314483 - RNA, 22 nt, Human
uggauucuaauaagaacaguuc

SEQ ID NO: 1314484 - RNA, 24 nt, Human
uugcuaguugcuggggacucccag

SEQ ID NO: 1314485 - RNA, 22 nt, Human
agugaacugauaagaugagcac

SEQ ID NO: 1314486 - RNA, 25 nt, Human
cacacacuaaguuggacccacaagu

SEQ ID NO: 1314487 - RNA, 19 nt, Human
cacuaaguuggaccuuccc

SEQ ID NO: 1314488 - RNA, 23 nt, Human
cguagauucucugcacacacuaa

SEQ ID NO: 1314489 - RNA, 22 nt, Human
gacuuuuaaccugucacaauuc

SEQ ID NO: 1314490 - RNA, 20 nt, Human
uuuacagagugaacugauaa

SEQ ID NO: 1314491 - RNA, 20 nt, Human
aaaauuacaacuguguacca

SEQ ID NO: 1314492 - RNA, 22 nt, Human
aaauagacuuccuucugaccca

SEQ ID NO: 1314493 - RNA, 23 nt, Human
aagcgugcagcuuuucccccugg

SEQ ID NO: 1314494 - RNA, 21 nt, Human
acccacucuucuccuaggccu

SEQ ID NO: 1314495 - RNA, 19 nt, Human
agacuuccuucugacccac

SEQ ID NO: 1314496 - RNA, 23 nt, Human
aggaguucauuguuaguucugga

SEQ ID NO: 1314497 - RNA, 18 nt, Human
aggauggaaggcaacacc

SEQ ID NO: 1314498 - RNA, 21 nt, Human
auagacuuccuucugacccac

SEQ ID NO: 1314499 - RNA, 19 nt, Human
auggaaggcaacacccaca

SEQ ID NO: 1314500 - RNA, 22 nt, Human
caaauagacuuccuucugaccc

SEQ ID NO: 1314501 - RNA, 23 nt, Human
caccaagcgugcagcuuuucccc

SEQ ID NO: 1314502 - RNA, 18 nt, Human
caguccggugguuggccu

SEQ ID NO: 1314503 - RNA, 22 nt, Human
cauccacaaaguccauggucaa

SEQ ID NO: 1314504 - RNA, 23 nt, Human
ccagaaaaaccugggucaccaaa

SEQ ID NO: 1314505 - RNA, 20 nt, Human
ccagugcaagucauugucuu

SEQ ID NO: 1314506 - RNA, 24 nt, Human
ccagugcaagucauugucuuucuc

SEQ ID NO: 1314507 - RNA, 18 nt, Human
cccacugacccacucuuc

SEQ ID NO: 1314508 - RNA, 19 nt, Human
cccccuggggcuuuggcug

SEQ ID NO: 1314509 - RNA, 18 nt, Human
ccuguauuucaaggaggg

SEQ ID NO: 1314510 - RNA, 22 nt, Human
cgacacugucagauauugucca

SEQ ID NO: 1314511 - RNA, 18 nt, Human
cggugguuggccuuucug

SEQ ID NO: 1314512 - RNA, 21 nt, Human
cugacccacucuucuccuagg

SEQ ID NO: 1314513 - RNA, 24 nt, Human
cugacccacucuucuccuaggccu

SEQ ID NO: 1314514 - RNA, 22 nt, Human
cugcgaugccccuguauuucaa

SEQ ID NO: 1314515 - RNA, 19 nt, Human
cugggucccugauugguuc

SEQ ID NO: 1314516 - RNA, 22 nt, Human
gagagaagaugagaauuggaaa

SEQ ID NO: 1314517 - RNA, 23 nt, Human
gauaaaagggagaagaggagaga

SEQ ID NO: 1314518 - RNA, 20 nt, Human
ggccgagagguagcaccaag

SEQ ID NO: 1314519 - RNA, 24 nt, Human
gggagaagaggagagaagaugaga

SEQ ID NO: 1314520 - RNA, 24 nt, Human
ggguuguaggugguagagguguuc

SEQ ID NO: 1314521 - RNA, 22 nt, Human
ggugguuggccuuucugggguu

SEQ ID NO: 1314522 - RNA, 18 nt, Human
gguucccagugcaaguca

SEQ ID NO: 1314523 - RNA, 20 nt, Human
uagacuuccuucugacccac

SEQ ID NO: 1314524 - RNA, 19 nt, Human
uauuucaaggaggguauca

SEQ ID NO: 1314525 - RNA, 20 nt, Human
uccacaaaguccauggucaa

SEQ ID NO: 1314526 - RNA, 19 nt, Human
uccauggucaaaauuacaa

SEQ ID NO: 1314527 - RNA, 26 nt, Human
uccuuugcuucaucgucugcacugac

SEQ ID NO: 1314528 - RNA, 25 nt, Human
ugaaagagacacaggauggaaggca

SEQ ID NO: 1314529 - RNA, 21 nt, Human
ugagaauuggaaaaagaggau

SEQ ID NO: 1314530 - RNA, 20 nt, Human
uggaaugaacacaucuccuc

SEQ ID NO: 1314531 - RNA, 24 nt, Human
uggaaugaacacaucuccucuggg

SEQ ID NO: 1314532 - RNA, 23 nt, Human
uggagguguacuggcagcuggug

SEQ ID NO: 1314533 - RNA, 18 nt, Human
uggcagcuggugcuauag

SEQ ID NO: 1314534 - RNA, 24 nt, Human
ugguagagguguucugagcucugu

SEQ ID NO: 1314535 - RNA, 18 nt, Human
ugucaguccggugguugg

SEQ ID NO: 1314536 - RNA, 18 nt, Human
ugucaguccggugguugg

SEQ ID NO: 1314537 - RNA, 24 nt, Human
uucaaggaggguaucacuguucau

SEQ ID NO: 1314538 - RNA, 19 nt, Human
uugguucccagugcaaguc

SEQ ID NO: 1314539 - RNA, 24 nt, Human
agacuccgccacccugaaccaaga

SEQ ID NO: 1314540 - RNA, 21 nt, Human
cuaaagacuccgccacccuga

SEQ ID NO: 1314541 - RNA, 19 nt, Human
gccacuaccagaccuauca

SEQ ID NO: 1314542 - RNA, 24 nt, Human
cagcaugagcgcauccuguccccu

SEQ ID NO: 1314543 - RNA, 21 nt, Human
ccuguccccugggcugcgugg

SEQ ID NO: 1314544 - RNA, 20 nt, Human
gaacacugucucaccacuga

SEQ ID NO: 1314545 - RNA, 27 nt, Human
uccaccaccacaugugugcacucgaac

SEQ ID NO: 1314546 - RNA, 22 nt, Human
ugcacucgaacacugucucacc

SEQ ID NO: 1314547 - RNA, 20 nt, Human
accccucccuccugcaucuc

SEQ ID NO: 1314548 - RNA, 25 nt, Human
accccucccuccugcaucuccccug

SEQ ID NO: 1314549 - RNA, 20 nt, Human
cccacccugugccuuccuug

SEQ ID NO: 1314550 - RNA, 20 nt, Human
ccccagaucuacaccccucc

SEQ ID NO: 1314551 - RNA, 24 nt, Human
cccccauucccacccugugccuuc

SEQ ID NO: 1314552 - RNA, 24 nt, Human
cuugcaagcugccaaaacaugaug

SEQ ID NO: 1314553 - RNA, 21 nt, Human
ggcagagagggagagaagggc

SEQ ID NO: 1314554 - RNA, 24 nt, Human
gggcagagagggagagaagggcuc

SEQ ID NO: 1314555 - RNA, 24 nt, Human
uacaccccucccuccugcaucucc

SEQ ID NO: 1314556 - RNA, 24 nt, Human
uccccagaucuacaccccucccuc

SEQ ID NO: 1314557 - RNA, 24 nt, Human
ugcgggcagagagggagagaaggg

SEQ ID NO: 1314558 - RNA, 25 nt, Human
ugcgggcagagagggagagaagggc

SEQ ID NO: 1314559 - RNA, 20 nt, Human
uggccucugguuguucuguu

SEQ ID NO: 1314560 - RNA, 24 nt, Human
caagaaugggcaauaggcucccaa

SEQ ID NO: 1314561 - RNA, 18 nt, Human
cugaaaggucuuugucaa

SEQ ID NO: 1314562 - RNA, 21 nt, Human
uguugcaaaaacaagaccauc

SEQ ID NO: 1314563 - RNA, 20 nt, Human
agggccgcccucccgccucg

SEQ ID NO: 1314564 - RNA, 18 nt, Human
caacagggccgcccuccc

SEQ ID NO: 1314565 - RNA, 19 nt, Human
ccccgcacagccgcccucc

SEQ ID NO: 1314566 - RNA, 22 nt, Human
cccgcgagcgccccgcacagcc

SEQ ID NO: 1314567 - RNA, 21 nt, Human
ccucccgccucgcugaagccc

SEQ ID NO: 1314568 - RNA, 22 nt, Human
ccucccgccucgcugaagcccg

SEQ ID NO: 1314569 - RNA, 23 nt, Human
cgagcgccccgcacagccgcccu

SEQ ID NO: 1314570 - RNA, 18 nt, Human
cgcgaugaaggccuagcg

SEQ ID NO: 1314571 - RNA, 22 nt, Human
cuucauggucaugucuuuuacc

SEQ ID NO: 1314572 - RNA, 20 nt, Human
ggcaacagggccgcccuccc

SEQ ID NO: 1314573 - RNA, 23 nt, Human
ggcagcagggaaagcgucuccag

SEQ ID NO: 1314574 - RNA, 20 nt, Human
ggccggcagcagggaaagcg

SEQ ID NO: 1314575 - RNA, 22 nt, Human
gucaugucuuuuaccagcuuuu

SEQ ID NO: 1314576 - RNA, 24 nt, Human
ucgcggccggcagcagggaaagcg

SEQ ID NO: 1314577 - RNA, 24 nt, Human
uggucaugucuuuuaccagcuuuu

SEQ ID NO: 1314578 - RNA, 19 nt, Human
acagagccugccaggugcu

SEQ ID NO: 1314579 - RNA, 26 nt, Human
augaguccaccuccucucccugcucc

SEQ ID NO: 1314580 - RNA, 23 nt, Human
cacuuuucuccgggacccagggg

SEQ ID NO: 1314581 - RNA, 21 nt, Human
ccuccucucccugcucuuccc

SEQ ID NO: 1314582 - RNA, 21 nt, Human
ccuuccccgccaggucucucc

SEQ ID NO: 1314583 - RNA, 22 nt, Human
cucccugcucuucccgcaggga

SEQ ID NO: 1314584 - RNA, 19 nt, Human
ucccugcucuucccgcagg

SEQ ID NO: 1314585 - RNA, 23 nt, Human
uccucucccugcucuucccgcag

SEQ ID NO: 1314586 - RNA, 19 nt, Human
ucgaugccccuuccccgcc

SEQ ID NO: 1314587 - RNA, 22 nt, Human
ucuccgggacccaggggacgug

SEQ ID NO: 1314588 - RNA, 22 nt, Human
ugccagaugaguccaccuccuu

SEQ ID NO: 1314589 - RNA, 20 nt, Human
acagaguccagccccaccuc

SEQ ID NO: 1314590 - RNA, 18 nt, Human
agccccaccucuuccaga

SEQ ID NO: 1314591 - RNA, 23 nt, Human
ccagacccugagcaggguaccgg

SEQ ID NO: 1314592 - RNA, 21 nt, Human
ucgagggugauggcgacagag

SEQ ID NO: 1314593 - RNA, 18 nt, Human
agggauuaaaucauauau

SEQ ID NO: 1314594 - RNA, 20 nt, Human
agggauuaaaucauauauuu

SEQ ID NO: 1314595 - RNA, 19 nt, Human
cacugcuugugaaagauuc

SEQ ID NO: 1314596 - RNA, 19 nt, Human
ccaauagugauauguugca

SEQ ID NO: 1314597 - RNA, 23 nt, Human
ccucccggagcagaggcuggagu

SEQ ID NO: 1314598 - RNA, 23 nt, Human
cuugccauucuucaggaauguua

SEQ ID NO: 1314599 - RNA, 22 nt, Human
gagggccucccggagcagaggc

SEQ ID NO: 1314600 - RNA, 19 nt, Human
gccagucucuggagaugga

SEQ ID NO: 1314601 - RNA, 22 nt, Human
uaacacauuggcauggccaaca

SEQ ID NO: 1314602 - RNA, 23 nt, Human
ucucuggagauggauauuggucu

SEQ ID NO: 1314603 - RNA, 22 nt, Human
ucuuuuaucuaaaucuacauuu

SEQ ID NO: 1314604 - RNA, 20 nt, Human
ugcaaaagcuguaaaaauuc

SEQ ID NO: 1314605 - RNA, 23 nt, Human
uguugcaaaagcuguaaaaauuc

SEQ ID NO: 1314606 - RNA, 18 nt, Human
uucaucuuuugccagcuc

SEQ ID NO: 1314607 - RNA, 19 nt, Human
uugcagggugaugcacagu

SEQ ID NO: 1314608 - RNA, 20 nt, Human
uugccagcucaauuuucuuc

SEQ ID NO: 1314609 - RNA, 28 nt, Human
uuucauuaucaucacugcuugugaaaga

SEQ ID NO: 1314610 - RNA, 18 nt, Human
aguaaauggauaacaaua

SEQ ID NO: 1314611 - RNA, 21 nt, Human
ggaacaaacucuucaaccucc

SEQ ID NO: 1314612 - RNA, 26 nt, Human
uaaauggauaacaauauuuugucauu

SEQ ID NO: 1314613 - RNA, 22 nt, Human
accaccgggccuucccuuugga

SEQ ID NO: 1314614 - RNA, 21 nt, Human
agcacuggauccuggaccacc

SEQ ID NO: 1314615 - RNA, 19 nt, Human
auccuggaccaccgggccu

SEQ ID NO: 1314616 - RNA, 20 nt, Human
cacagcccggucuagccgcu

SEQ ID NO: 1314617 - RNA, 21 nt, Human
cacagcccggucuagccgcua

SEQ ID NO: 1314618 - RNA, 26 nt, Human
cacagcccggucuagccgcuacgccc

SEQ ID NO: 1314619 - RNA, 23 nt, Human
caccgggccuucccuuuggacuc

SEQ ID NO: 1314620 - RNA, 22 nt, Human
ccugagaggacccggcaggcca

SEQ ID NO: 1314621 - RNA, 27 nt, Human
cgcccgagcucaagucugacucgaaac

SEQ ID NO: 1314622 - RNA, 22 nt, Human
uccuggaccaccgggccuuccc

SEQ ID NO: 1314623 - RNA, 21 nt, Human
ugggugccugagaggacccgg

SEQ ID NO: 1314624 - RNA, 18 nt, Human
aaucuagggaucuuccuc

SEQ ID NO: 1314625 - RNA, 21 nt, Human
uaacuguauauucgugucuug

SEQ ID NO: 1314626 - RNA, 21 nt, Human
ugauggaaacaaaucuaggga

SEQ ID NO: 1314627 - RNA, 20 nt, Human
ugcuacugcuccaaccacgc

SEQ ID NO: 1314628 - RNA, 21 nt, Human
uugcuacugcuccaaccacgc

SEQ ID NO: 1314629 - RNA, 20 nt, Human
uuucaucauuuucucuggga

SEQ ID NO: 1314630 - RNA, 21 nt, Human
ccagaacagcagcugggaaga

SEQ ID NO: 1314631 - RNA, 24 nt, Human
aaagaaaaacuguauccuguagca

SEQ ID NO: 1314632 - RNA, 21 nt, Human
acgcugggcuuuacuuggacu

SEQ ID NO: 1314633 - RNA, 18 nt, Human
aggaaagaaaaagaaaaa

SEQ ID NO: 1314634 - RNA, 20 nt, Human
agugcugucuucaaaaaugg

SEQ ID NO: 1314635 - RNA, 19 nt, Human
caaagaugacaacaucaau

SEQ ID NO: 1314636 - RNA, 18 nt, Human
caacaucaauauucuccu

SEQ ID NO: 1314637 - RNA, 24 nt, Human
caucaaggaaagaaaaagaaaaac

SEQ ID NO: 1314638 - RNA, 24 nt, Human
cuccucuacagugcugucuucaaa

SEQ ID NO: 1314639 - RNA, 18 nt, Human
gggcuuuacuuggacuuu

SEQ ID NO: 1314640 - RNA, 22 nt, Human
uacuucauuguuaguaaccuug

SEQ ID NO: 1314641 - RNA, 30 nt, Human
ucagaccaucaaggaaagaaaaagaaaaaa

SEQ ID NO: 1314642 - RNA, 22 nt, Human
ugaacuccuucacgcugggcuu

SEQ ID NO: 1314643 - RNA, 20 nt, Human
ugacaacaucaauauucucc

SEQ ID NO: 1314644 - RNA, 25 nt, Human
uuacuuggacuuuuccagaaauuau

SEQ ID NO: 1314645 - RNA, 26 nt, Human
uuacuuggacuuuuccagaaauuaug

SEQ ID NO: 1314646 - RNA, 18 nt, Human
aacauggcugcucuccuc

SEQ ID NO: 1314647 - RNA, 24 nt, Human
aaccaaaccaugugcuugcccuag

SEQ ID NO: 1314648 - RNA, 20 nt, Human
agcaagaaagaagcugcagg

SEQ ID NO: 1314649 - RNA, 25 nt, Human
cacuccacucuucagcugcuauccc

SEQ ID NO: 1314650 - RNA, 21 nt, Human
cauggagagaaaacauggcug

SEQ ID NO: 1314651 - RNA, 23 nt, Human
ccaaucccauccagcaaacugcu

SEQ ID NO: 1314652 - RNA, 19 nt, Human
ccuucaauaagcccuggag

SEQ ID NO: 1314653 - RNA, 19 nt, Human
ccuuugugggaauaaaccc

SEQ ID NO: 1314654 - RNA, 21 nt, Human
cugcaggcuaagaagcugcau

SEQ ID NO: 1314655 - RNA, 19 nt, Human
cuuuauaugaccugccccu

SEQ ID NO: 1314656 - RNA, 18 nt, Human
gaaucaauuuaaaccaaa

SEQ ID NO: 1314657 - RNA, 19 nt, Human
gcccagggccccuccucac

SEQ ID NO: 1314658 - RNA, 23 nt, Human
gcccagggccccuccucacgugc

SEQ ID NO: 1314659 - RNA, 18 nt, Human
ggaauaaacccuuuagac

SEQ ID NO: 1314660 - RNA, 27 nt, Human
ucaucucccaucuuggagccaauccca

SEQ ID NO: 1314661 - RNA, 18 nt, Human
ucauggagagaaaacaug

SEQ ID NO: 1314662 - RNA, 27 nt, Human
uccacucuucagcugcuauccccaaaa

SEQ ID NO: 1314663 - RNA, 18 nt, Human
ucuucuggugcugcaagg

SEQ ID NO: 1314664 - RNA, 24 nt, Human
ugagaacgggugacaggccuucaa

SEQ ID NO: 1314665 - RNA, 23 nt, Human
ugcccacccucaauugaguucug

SEQ ID NO: 1314666 - RNA, 19 nt, Human
uggagagaaaacauggcug

SEQ ID NO: 1314667 - RNA, 20 nt, Human
uguuccaugcaucucacucc

SEQ ID NO: 1314668 - RNA, 20 nt, Human
uucuucuggugcugcaagga

SEQ ID NO: 1314669 - RNA, 24 nt, Human
uugaguucugagaaaaccuaagaa

SEQ ID NO: 1314670 - RNA, 21 nt, Human
acucugaggcuuggggauggg

SEQ ID NO: 1314671 - RNA, 18 nt, Human
aggagaaggcuggcccgg

SEQ ID NO: 1314672 - RNA, 24 nt, Human
cacgcagacuggaggcauucagac

SEQ ID NO: 1314673 - RNA, 19 nt, Human
ccccggagcugcagacuga

SEQ ID NO: 1314674 - RNA, 18 nt, Human
cccgggcugcuccacucc

SEQ ID NO: 1314675 - RNA, 19 nt, Human
cccgggcugcuccacuccc

SEQ ID NO: 1314676 - RNA, 20 nt, Human
cccgggcugcuccacucccc

SEQ ID NO: 1314677 - RNA, 18 nt, Human
ccugcgcgacggccacac

SEQ ID NO: 1314678 - RNA, 18 nt, Human
cuggagauccuuccgucc

SEQ ID NO: 1314679 - RNA, 23 nt, Human
cuggcccgggcugcuccacuccc

SEQ ID NO: 1314680 - RNA, 18 nt, Human
gcuccacuccccggagcu

SEQ ID NO: 1314681 - RNA, 21 nt, Human
ggcccgggcugcuccacuccc

SEQ ID NO: 1314682 - RNA, 19 nt, Human
ggggaugggucggaaggaa

SEQ ID NO: 1314683 - RNA, 23 nt, Human
uagucgaugugccugcgaagccc

SEQ ID NO: 1314684 - RNA, 21 nt, Human
uccgucccuacaggagaaggc

SEQ ID NO: 1314685 - RNA, 21 nt, Human
ugcuccacuccccggagcugc

SEQ ID NO: 1314686 - RNA, 24 nt, Human
uguagucgaugugccugcgaagcc

SEQ ID NO: 1314687 - RNA, 22 nt, Human
ugugccugcgaagcccaggcuc

SEQ ID NO: 1314688 - RNA, 21 nt, Human
uuccuucccuucuggaguucc

SEQ ID NO: 1314689 - RNA, 20 nt, Human
uuccuugaguaugaguuaua

SEQ ID NO: 1314690 - RNA, 20 nt, Human
accacagaguagcugcaaga

SEQ ID NO: 1314691 - RNA, 23 nt, Human
aggaggggcaggagacagagcuc

SEQ ID NO: 1314692 - RNA, 24 nt, Human
aggccccgagcugacacccccugg

SEQ ID NO: 1314693 - RNA, 20 nt, Human
aggccggaccaauccagaga

SEQ ID NO: 1314694 - RNA, 20 nt, Human
cacagcaggaggggcaggag

SEQ ID NO: 1314695 - RNA, 21 nt, Human
cacccccugggcccccauucc

SEQ ID NO: 1314696 - RNA, 18 nt, Human
ccaauccagagacggugc

SEQ ID NO: 1314697 - RNA, 20 nt, Human
ccacagcaggaggggcagga

SEQ ID NO: 1314698 - RNA, 24 nt, Human
ccccgagcugacacccccugggcc

SEQ ID NO: 1314699 - RNA, 26 nt, Human
ccccgagcugacacccccugggcccc

SEQ ID NO: 1314700 - RNA, 21 nt, Human
cugaccacagaguagcugcaa

SEQ ID NO: 1314701 - RNA, 20 nt, Human
gaaggccggaccaauccaga

SEQ ID NO: 1314702 - RNA, 21 nt, Human
gaggcugucguuuauugcaga

SEQ ID NO: 1314703 - RNA, 20 nt, Human
gccggaccaauccagagacg

SEQ ID NO: 1314704 - RNA, 22 nt, Human
gcugugggcucugugcucagca

SEQ ID NO: 1314705 - RNA, 21 nt, Human
ggcaggagacagagcucagga

SEQ ID NO: 1314706 - RNA, 22 nt, Human
gggcaggagacagagcucagga

SEQ ID NO: 1314707 - RNA, 24 nt, Human
uagcugcaagaggcaaggccccga

SEQ ID NO: 1314708 - RNA, 20 nt, Human
ucagggaggugaagaggcag

SEQ ID NO: 1314709 - RNA, 22 nt, Human
uccgcgggaugacggcuccaga

SEQ ID NO: 1314710 - RNA, 21 nt, Human
ucggcuccgcgccgcagaccg

SEQ ID NO: 1314711 - RNA, 19 nt, Human
uggaggacccggccugacc

SEQ ID NO: 1314712 - RNA, 21 nt, Human
ugggcugugggcucugugcuc

SEQ ID NO: 1314713 - RNA, 20 nt, Human
uuccugaugguggaggaccc

SEQ ID NO: 1314714 - RNA, 21 nt, Human
cagagcucagcuggcagcugc

SEQ ID NO: 1314715 - RNA, 19 nt, Human
cagcaccugcuccuccugu

SEQ ID NO: 1314716 - RNA, 20 nt, Human
ggaguaccccuggugacaga

SEQ ID NO: 1314717 - RNA, 20 nt, Human
ugggguccagggaccugaaa

SEQ ID NO: 1314718 - RNA, 24 nt, Human
uguccgcccacagaaacuccuuca

SEQ ID NO: 1314719 - RNA, 22 nt, Human
agacagaaauaggacaaccgcc

SEQ ID NO: 1314720 - RNA, 24 nt, Human
cccugucuucuagccuugggcugg

SEQ ID NO: 1314721 - RNA, 18 nt, Human
ccgccccagcagcguagu

SEQ ID NO: 1314722 - RNA, 22 nt, Human
cugggcauccgaggggcgcuga

SEQ ID NO: 1314723 - RNA, 26 nt, Human
gcccagcacaccacacugggcauccg

SEQ ID NO: 1314724 - RNA, 18 nt, Human
gccuugugaugcugaugg

SEQ ID NO: 1314725 - RNA, 19 nt, Human
ggacaaccgccccagcagc

SEQ ID NO: 1314726 - RNA, 20 nt, Human
gggcauccgaggggcgcuga

SEQ ID NO: 1314727 - RNA, 24 nt, Human
uccgaggggcgcugacagcuugga

SEQ ID NO: 1314728 - RNA, 19 nt, Human
ucuucuagccuugggcugg

SEQ ID NO: 1314729 - RNA, 19 nt, Human
ugggcuggauucagggaag

SEQ ID NO: 1314730 - RNA, 24 nt, Human
aaaccccugagcucaagugauccu

SEQ ID NO: 1314731 - RNA, 20 nt, Human
aacauccucucacucuuugc

SEQ ID NO: 1314732 - RNA, 24 nt, Human
aaggugcuuggauuauaggcauga

SEQ ID NO: 1314733 - RNA, 24 nt, Human
acuguguugcccaggcuggucuga

SEQ ID NO: 1314734 - RNA, 20 nt, Human
agcucaagugauccuccuac

SEQ ID NO: 1314735 - RNA, 20 nt, Human
aggcaugagccaccaugucc

SEQ ID NO: 1314736 - RNA, 21 nt, Human
aggcaugagccaccauguccg

SEQ ID NO: 1314737 - RNA, 19 nt, Human
aucacuguguugcccaggc

SEQ ID NO: 1314738 - RNA, 19 nt, Human
auccucucacucuuugcua

SEQ ID NO: 1314739 - RNA, 19 nt, Human
caagugauccuccuaccuu

SEQ ID NO: 1314740 - RNA, 27 nt, Human
caagugauccuccuaccuuggccuccu

SEQ ID NO: 1314741 - RNA, 19 nt, Human
cacuguguugcccaggcug

SEQ ID NO: 1314742 - RNA, 21 nt, Human
cacuguguugcccaggcuggu

SEQ ID NO: 1314743 - RNA, 22 nt, Human
cacuguguugcccaggcugguc

SEQ ID NO: 1314744 - RNA, 25 nt, Human
caugagccaccauguccggccuugu

SEQ ID NO: 1314745 - RNA, 21 nt, Human
ccacuuagcaauguauauugg

SEQ ID NO: 1314746 - RNA, 18 nt, Human
ccuccuaccuuggccucc

SEQ ID NO: 1314747 - RNA, 20 nt, Human
ccugagcucaagugauccuc

SEQ ID NO: 1314748 - RNA, 24 nt, Human
cucaagugauccuccuaccuuggc

SEQ ID NO: 1314749 - RNA, 23 nt, Human
cuguagguggaaucacuggguca

SEQ ID NO: 1314750 - RNA, 20 nt, Human
cuuggauuauaggcaugagc

SEQ ID NO: 1314751 - RNA, 22 nt, Human
gagcucaagugauccuccuacc

SEQ ID NO: 1314752 - RNA, 21 nt, Human
gauuauaggcaugagccacca

SEQ ID NO: 1314753 - RNA, 24 nt, Human
gauuauaggcaugagccaccaugu

SEQ ID NO: 1314754 - RNA, 27 nt, Human
gcccaggcuggucugaaaccccugagc

SEQ ID NO: 1314755 - RNA, 23 nt, Human
gcuggucugaaaccccugagcuc

SEQ ID NO: 1314756 - RNA, 20 nt, Human
ggaaauaaacauuugaaaac

SEQ ID NO: 1314757 - RNA, 22 nt, Human
ggauuauaggcaugagccacca

SEQ ID NO: 1314758 - RNA, 24 nt, Human
ggauuauaggcaugagccaccaug

SEQ ID NO: 1314759 - RNA, 21 nt, Human
gugcuuggauuauaggcauga

SEQ ID NO: 1314760 - RNA, 21 nt, Human
guuauauauauauuuauauau

SEQ ID NO: 1314761 - RNA, 20 nt, Human
uaaaaauaagacuauaauaa

SEQ ID NO: 1314762 - RNA, 22 nt, Human
uagccucuuagcuuucuuuccu

SEQ ID NO: 1314763 - RNA, 20 nt, Human
uauauauuuauauauauaua

SEQ ID NO: 1314764 - RNA, 19 nt, Human
uauggcugcaaagaaagua

SEQ ID NO: 1314765 - RNA, 24 nt, Human
ucaagugauccuccuaccuuggcc

SEQ ID NO: 1314766 - RNA, 20 nt, Human
ucacaugguucaaaauugaa

SEQ ID NO: 1314767 - RNA, 23 nt, Human
ucugcagaagaaguuuauggauu

SEQ ID NO: 1314768 - RNA, 18 nt, Human
ugagcucaagugauccuc

SEQ ID NO: 1314769 - RNA, 22 nt, Human
ugcuaucacuguguugcccagg

SEQ ID NO: 1314770 - RNA, 23 nt, Human
uggauuauaggcaugagccacca

SEQ ID NO: 1314771 - RNA, 19 nt, Human
uguguuauauauauauuua

SEQ ID NO: 1314772 - RNA, 23 nt, Human
uguguuauauauauauuuauaua

SEQ ID NO: 1314773 - RNA, 22 nt, Human
uguguugcccaggcuggucuga

SEQ ID NO: 1314774 - RNA, 23 nt, Human
uguguugcccaggcuggucugaa

SEQ ID NO: 1314775 - RNA, 18 nt, Human
uuaacauccucucacucu

SEQ ID NO: 1314776 - RNA, 25 nt, Human
uugaaaacaacaauacauuugguga

SEQ ID NO: 1314777 - RNA, 18 nt, Human
uuggauuauaggcaugag

SEQ ID NO: 1314778 - RNA, 24 nt, Human
uuggauuauaggcaugagccacca

SEQ ID NO: 1314779 - RNA, 21 nt, Human
uuguguaucucugcagaagaa

SEQ ID NO: 1314780 - RNA, 25 nt, Human
uuugaccccuagccucuuagcuuuc

SEQ ID NO: 1314781 - RNA, 28 nt, Human
uuugucaccuuuuuuccacuuagcaaug

SEQ ID NO: 1314782 - RNA, 19 nt, Human
cacuggguggcaggggcca

SEQ ID NO: 1314783 - RNA, 24 nt, Human
ccacuggguggcaggggccaguuu

SEQ ID NO: 1314784 - RNA, 21 nt, Human
ccgcacuccaguaugaccaag

SEQ ID NO: 1314785 - RNA, 23 nt, Human
ccgcacuccaguaugaccaagag

SEQ ID NO: 1314786 - RNA, 20 nt, Human
cuggguggcaggggccaguu

SEQ ID NO: 1314787 - RNA, 22 nt, Human
gccgcacuccaguaugaccaag

SEQ ID NO: 1314788 - RNA, 21 nt, Human
gcugcgugcccugccgcacuc

SEQ ID NO: 1314789 - RNA, 27 nt, Human
ugcccugccgcacuccaguaugaccaa

SEQ ID NO: 1314790 - RNA, 21 nt, Human
uggcaggggccaguuucagca

SEQ ID NO: 1314791 - RNA, 18 nt, Human
uggguggcaggggccagu

SEQ ID NO: 1314792 - RNA, 19 nt, Human
aagcaagccagcaggcaga

SEQ ID NO: 1314793 - RNA, 23 nt, Human
acccuaugcucaaaaacccacug

SEQ ID NO: 1314794 - RNA, 26 nt, Human
aggagccgaaggucgagaggggaacu

SEQ ID NO: 1314795 - RNA, 23 nt, Human
aggcagacacacaacacacccaa

SEQ ID NO: 1314796 - RNA, 18 nt, Human
aggccaggguuccccuuc

SEQ ID NO: 1314797 - RNA, 20 nt, Human
aggcuccccgccaacuccuc

SEQ ID NO: 1314798 - RNA, 22 nt, Human
caagggcacccuaugcucaaaa

SEQ ID NO: 1314799 - RNA, 22 nt, Human
cacacaacacacccaagggcac

SEQ ID NO: 1314800 - RNA, 24 nt, Human
cacacaacacacccaagggcaccc

SEQ ID NO: 1314801 - RNA, 24 nt, Human
cacccaagggcacccuaugcucaa

SEQ ID NO: 1314802 - RNA, 22 nt, Human
cagcaggcagacacacaacaca

SEQ ID NO: 1314803 - RNA, 23 nt, Human
cagcaggcagacacacaacacac

SEQ ID NO: 1314804 - RNA, 19 nt, Human
caggguuccccuuccuuuc

SEQ ID NO: 1314805 - RNA, 25 nt, Human
caugccuguguccccucucccacuc

SEQ ID NO: 1314806 - RNA, 22 nt, Human
ccagcaggcagacacacaacac

SEQ ID NO: 1314807 - RNA, 23 nt, Human
ccaggguuccccuuccuuuccuc

SEQ ID NO: 1314808 - RNA, 21 nt, Human
ccaugccuguguccccucucc

SEQ ID NO: 1314809 - RNA, 22 nt, Human
ccaugccuguguccccucuccc

SEQ ID NO: 1314810 - RNA, 22 nt, Human
cccaaggccaggguuccccuuc

SEQ ID NO: 1314811 - RNA, 24 nt, Human
ccccagaaguagcuggagggaccc

SEQ ID NO: 1314812 - RNA, 20 nt, Human
cccccagaaguagcuggagg

SEQ ID NO: 1314813 - RNA, 22 nt, Human
cccccgaaugccuggagacaga

SEQ ID NO: 1314814 - RNA, 20 nt, Human
ccccuuccuuuccucugucc

SEQ ID NO: 1314815 - RNA, 19 nt, Human
ccgaaggucgagaggggaa

SEQ ID NO: 1314816 - RNA, 23 nt, Human
ccugggacgucuuauggcccagc

SEQ ID NO: 1314817 - RNA, 21 nt, Human
ccuguguccccucucccacuc

SEQ ID NO: 1314818 - RNA, 19 nt, Human
ccuuuccucuguccaauuc

SEQ ID NO: 1314819 - RNA, 22 nt, Human
cuggagggaccucaggcccccg

SEQ ID NO: 1314820 - RNA, 24 nt, Human
cuuauggcccagcugggggacaag

SEQ ID NO: 1314821 - RNA, 23 nt, Human
gaaaguggcugacagagcccccc

SEQ ID NO: 1314822 - RNA, 18 nt, Human
gacaagaagggguccuga

SEQ ID NO: 1314823 - RNA, 19 nt, Human
gcaggcagacacacaacac

SEQ ID NO: 1314824 - RNA, 24 nt, Human
gcaggcagacacacaacacaccca

SEQ ID NO: 1314825 - RNA, 19 nt, Human
gcugacagagcccccccag

SEQ ID NO: 1314826 - RNA, 18 nt, Human
gguccugaggagccgaag

SEQ ID NO: 1314827 - RNA, 20 nt, Human
gugguccugaggagccgaag

SEQ ID NO: 1314828 - RNA, 20 nt, Human
uaacuuaagcaagccagcag

SEQ ID NO: 1314829 - RNA, 23 nt, Human
uaagcaagccagcaggcagacac

SEQ ID NO: 1314830 - RNA, 22 nt, Human
uauggcccagcugggggacaag

SEQ ID NO: 1314831 - RNA, 18 nt, Human
ucccugagaaaguggcug

SEQ ID NO: 1314832 - RNA, 22 nt, Human
ucugugaugaaaaucccaaggc

SEQ ID NO: 1314833 - RNA, 20 nt, Human
ugaggccagaucggggaaag

SEQ ID NO: 1314834 - RNA, 23 nt, Human
ugaugaaaaucccaaggccaggg

SEQ ID NO: 1314835 - RNA, 19 nt, Human
ugccuguguccccucuccc

SEQ ID NO: 1314836 - RNA, 24 nt, Human
ugccuguguccccucucccacucc

SEQ ID NO: 1314837 - RNA, 19 nt, Human
uggagacagaggggucccc

SEQ ID NO: 1314838 - RNA, 23 nt, Human
uggagacagaggggucccccagu

SEQ ID NO: 1314839 - RNA, 23 nt, Human
uggcugacagagcccccccagaa

SEQ ID NO: 1314840 - RNA, 22 nt, Human
uggcugggaaauccggcugagg

SEQ ID NO: 1314841 - RNA, 19 nt, Human
uguccccucucccacuccu

SEQ ID NO: 1314842 - RNA, 21 nt, Human
aaaaacaaaaacaaaaccccc

SEQ ID NO: 1314843 - RNA, 23 nt, Human
aaaacaaaaacaaaacccccagu

SEQ ID NO: 1314844 - RNA, 20 nt, Human
aacccccaguauuauuccca

SEQ ID NO: 1314845 - RNA, 21 nt, Human
aagcaggcucuguagaggucu

SEQ ID NO: 1314846 - RNA, 23 nt, Human
acaagcaggcucuguagaggucu

SEQ ID NO: 1314847 - RNA, 23 nt, Human
agacaguucaaaaacaaaaacaa

SEQ ID NO: 1314848 - RNA, 22 nt, Human
agggggcuuaugcaauccugga

SEQ ID NO: 1314849 - RNA, 22 nt, Human
aucuucuucuggaucuuuacug

SEQ ID NO: 1314850 - RNA, 26 nt, Human
augguacacaaaauaagagcagucac

SEQ ID NO: 1314851 - RNA, 23 nt, Human
caaaaacaaaaacaaaaccccca

SEQ ID NO: 1314852 - RNA, 24 nt, Human
caaaaacaaaaacaaaacccccag

SEQ ID NO: 1314853 - RNA, 18 nt, Human
cacagucagccggucauc

SEQ ID NO: 1314854 - RNA, 21 nt, Human
cacuggaaguggggagaaaau

SEQ ID NO: 1314855 - RNA, 21 nt, Human
cagaaaacaaagggucacucc

SEQ ID NO: 1314856 - RNA, 19 nt, Human
cagccggucaucugagauc

SEQ ID NO: 1314857 - RNA, 21 nt, Human
cagcgguuguuggcuuauggu

SEQ ID NO: 1314858 - RNA, 23 nt, Human
cagggggcuuaugcaauccugga

SEQ ID NO: 1314859 - RNA, 20 nt, Human
cauaagcaggaccaauguua

SEQ ID NO: 1314860 - RNA, 20 nt, Human
ccaaaaguccaaauuugggg

SEQ ID NO: 1314861 - RNA, 23 nt, Human
ccaaauuugggguaaucuucuuc

SEQ ID NO: 1314862 - RNA, 19 nt, Human
cuagaauauaccgauagcc

SEQ ID NO: 1314863 - RNA, 18 nt, Human
cuccaaccacagucagcc

SEQ ID NO: 1314864 - RNA, 19 nt, Human
cuggaucuuuacugccugg

SEQ ID NO: 1314865 - RNA, 24 nt, Human
cuguguuuuuagcaucuuugggag

SEQ ID NO: 1314866 - RNA, 28 nt, Human
gaaaauggugaaaggcaggccgguaccc

SEQ ID NO: 1314867 - RNA, 24 nt, Human
gaacauuugagacaguucaaaaac

SEQ ID NO: 1314868 - RNA, 18 nt, Human
gaauagguuuuccugccc

SEQ ID NO: 1314869 - RNA, 25 nt, Human
ggaauagguuuuccugcccagcagu

SEQ ID NO: 1314870 - RNA, 18 nt, Human
gggaaggcgcugagcaga

SEQ ID NO: 1314871 - RNA, 23 nt, Human
ggguaugcaguacagcaccgauu

SEQ ID NO: 1314872 - RNA, 24 nt, Human
guguuccaauggguagccaugagg

SEQ ID NO: 1314873 - RNA, 18 nt, Human
guuugcgcuuggcuccuc

SEQ ID NO: 1314874 - RNA, 22 nt, Human
uaacaaaacccguucauacaag

SEQ ID NO: 1314875 - RNA, 23 nt, Human
uagaggucuccaggaauagguuu

SEQ ID NO: 1314876 - RNA, 18 nt, Human
uagccaucuuuguuaaac

SEQ ID NO: 1314877 - RNA, 19 nt, Human
uagggcuaacaaaacccgu

SEQ ID NO: 1314878 - RNA, 18 nt, Human
ucaaugcccacagaagga

SEQ ID NO: 1314879 - RNA, 19 nt, Human
uccaaauuugggguaaucu

SEQ ID NO: 1314880 - RNA, 20 nt, Human
uccaaauuugggguaaucuu

SEQ ID NO: 1314881 - RNA, 22 nt, Human
ucccuguggucccuccauccug

SEQ ID NO: 1314882 - RNA, 24 nt, Human
uccugcuguuugcgcuuggcuccu

SEQ ID NO: 1314883 - RNA, 18 nt, Human
uccuuuuccgcugcuucc

SEQ ID NO: 1314884 - RNA, 19 nt, Human
ucuggaucuuuacugccug

SEQ ID NO: 1314885 - RNA, 19 nt, Human
ucuugguggucccuguggu

SEQ ID NO: 1314886 - RNA, 21 nt, Human
ugaaaggcaggcagucucccg

SEQ ID NO: 1314887 - RNA, 23 nt, Human
ugagacaguucaaaaacaaaaac

SEQ ID NO: 1314888 - RNA, 24 nt, Human
uggguagccaugagggggaaggcg

SEQ ID NO: 1314889 - RNA, 24 nt, Human
uguguuuuuagcaucuuugggaga

SEQ ID NO: 1314890 - RNA, 19 nt, Human
uguuccuuuaccaagaaua

SEQ ID NO: 1314891 - RNA, 20 nt, Human
uuaccauuuccuuggaaaac

SEQ ID NO: 1314892 - RNA, 22 nt, Human
uucaaaaacaaaaacaaaaccc

SEQ ID NO: 1314893 - RNA, 19 nt, Human
uuccgcugcuuccugcugc

SEQ ID NO: 1314894 - RNA, 21 nt, Human
uugauuucagguguucucaga

SEQ ID NO: 1314895 - RNA, 26 nt, Human
aagacaguuaugacauugacacaugc

SEQ ID NO: 1314896 - RNA, 21 nt, Human
caauguacuccuucuucccca

SEQ ID NO: 1314897 - RNA, 22 nt, Human
cacaugcaugagcuauuauaca

SEQ ID NO: 1314898 - RNA, 24 nt, Human
ccagagugcagaagcguauaaaga

SEQ ID NO: 1314899 - RNA, 25 nt, Human
cccccuucaauguacuccuucuucc

SEQ ID NO: 1314900 - RNA, 21 nt, Human
ccccucguagcuggugggaau

SEQ ID NO: 1314901 - RNA, 24 nt, Human
cccgugccucaggaccugccccuc

SEQ ID NO: 1314902 - RNA, 23 nt, Human
ggccacugggugccaaucccccu

SEQ ID NO: 1314903 - RNA, 23 nt, Human
uaugacauugacacaugcauggu

SEQ ID NO: 1314904 - RNA, 18 nt, Human
ucccgugccucaggaccu

SEQ ID NO: 1314905 - RNA, 24 nt, Human
ugacacaugcaugagcuauuauac

SEQ ID NO: 1314906 - RNA, 24 nt, Human
ugauucugucaucaccacaucuug

SEQ ID NO: 1314907 - RNA, 23 nt, Human
ugcacgguggggaggacagggau

SEQ ID NO: 1314908 - RNA, 22 nt, Human
ugccguccauguuauaaugcac

SEQ ID NO: 1314909 - RNA, 22 nt, Human
uggugggaaugccguccauguu

SEQ ID NO: 1314910 - RNA, 22 nt, Human
gcucugaaaagagccuuugggu

SEQ ID NO: 1314911 - RNA, 21 nt, Human
ugaguggcucugaaaagagcc

SEQ ID NO: 1314912 - RNA, 27 nt, Human
ccuuugguuccuuuggggggcuccggc

SEQ ID NO: 1314913 - RNA, 26 nt, Human
ugaguugcugcaaacuaauccaggcu

SEQ ID NO: 1314914 - RNA, 20 nt, Human
ugaaaagagccuuuggggug

SEQ ID NO: 1314915 - RNA, 18 nt, Human
uaaaaagggccuuuuguu

SEQ ID NO: 1314916 - RNA, 22 nt, Human
uaaaaagggccuuuuguugaua

SEQ ID NO: 1314917 - RNA, 23 nt, Human
ugggggcccuaaaaagggccuuu

SEQ ID NO: 1314918 - RNA, 24 nt, Human
ugggggcccuaaaaagggccuuuu

SEQ ID NO: 1314919 - RNA, 20 nt, Human
aagagcugagcgaaccagcg

SEQ ID NO: 1314920 - RNA, 18 nt, Human
acacggagccaagaccag

SEQ ID NO: 1314921 - RNA, 22 nt, Human
agccaagaccagagccggcgca

SEQ ID NO: 1314922 - RNA, 24 nt, Human
caccagcaccuuugcagcuuugcc

SEQ ID NO: 1314923 - RNA, 19 nt, Human
cacggagccaagaccagag

SEQ ID NO: 1314924 - RNA, 23 nt, Human
ccucggggcacuugccgccgccc

SEQ ID NO: 1314925 - RNA, 21 nt, Human
ccuguggcagaagcaccagca

SEQ ID NO: 1314926 - RNA, 24 nt, Human
cgccuugacugaggguggccgggc

SEQ ID NO: 1314927 - RNA, 20 nt, Human
cggggcacuugccgccgccc

SEQ ID NO: 1314928 - RNA, 21 nt, Human
cggggcacuugccgccgcccu

SEQ ID NO: 1314929 - RNA, 18 nt, Human
gagccaagaccagagccg

SEQ ID NO: 1314930 - RNA, 18 nt, Human
gcacuugccgccgcccug

SEQ ID NO: 1314931 - RNA, 19 nt, Human
gcagaagcaccagcaccug

SEQ ID NO: 1314932 - RNA, 18 nt, Human
gccgccgcccugcaggcg

SEQ ID NO: 1314933 - RNA, 22 nt, Human
ggagccaagaccagagccggcg

SEQ ID NO: 1314934 - RNA, 19 nt, Human
ggcgucgggggcggugcag

SEQ ID NO: 1314935 - RNA, 21 nt, Human
ggggcacuugccgccgcccug

SEQ ID NO: 1314936 - RNA, 18 nt, Human
ugcagcuuugcccagcac

SEQ ID NO: 1314937 - RNA, 23 nt, Human
uggcagaagcaccagcaccuggg

SEQ ID NO: 1314938 - RNA, 23 nt, Human
uggcagggagcaagagcugagcg

SEQ ID NO: 1314939 - RNA, 24 nt, Human
uggcagggagcaagagcugagcga

SEQ ID NO: 1314940 - RNA, 25 nt, Human
uggcagggagcaagagcugagcgaa

SEQ ID NO: 1314941 - RNA, 21 nt, Human
uggggugccugcuauccugug

SEQ ID NO: 1314942 - RNA, 23 nt, Human
ugucgugcuggggcacacggagc

SEQ ID NO: 1314943 - RNA, 21 nt, Human
uguggcagaagcaccagcacc

SEQ ID NO: 1314944 - RNA, 19 nt, Human
aacucccuuucuacuaggc

SEQ ID NO: 1314945 - RNA, 26 nt, Human
ccccuuauguauuauauaauaagaac

SEQ ID NO: 1314946 - RNA, 22 nt, Human
aacugcuagaagagaauaagcu

SEQ ID NO: 1314947 - RNA, 21 nt, Human
agccuuuggggcuuuguugcg

SEQ ID NO: 1314948 - RNA, 25 nt, Human
cuuuggggcuuuguugcgguuuuca

SEQ ID NO: 1314949 - RNA, 27 nt, Human
cuuuggggcuuuguugcgguuuucaca

SEQ ID NO: 1314950 - RNA, 18 nt, Human
gcuuuguugcgguuuuca

SEQ ID NO: 1314951 - RNA, 22 nt, Human
ggcaagaaacugcuagaagaga

SEQ ID NO: 1314952 - RNA, 24 nt, Human
ggcuuuguugcgguuuucacacgc

SEQ ID NO: 1314953 - RNA, 19 nt, Human
uggcaagaaacugcuagaa

SEQ ID NO: 1314954 - RNA, 24 nt, Human
uggcaagaaacugcuagaagagaa

SEQ ID NO: 1314955 - RNA, 21 nt, Human
uggguggcucugaaaagagcc

SEQ ID NO: 1314956 - RNA, 21 nt, Human
uguugcgguuuucacacgcca

SEQ ID NO: 1314957 - RNA, 18 nt, Human
aggggcucugaaaagagc

SEQ ID NO: 1314958 - RNA, 21 nt, Human
cuucuugggcugauaggaaua

SEQ ID NO: 1314959 - RNA, 20 nt, Human
gcucugaaaagagccuuuug

SEQ ID NO: 1314960 - RNA, 18 nt, Human
guuggacagacuucuugg

SEQ ID NO: 1314961 - RNA, 20 nt, Human
ugaaaagagccuuuuggggu

SEQ ID NO: 1314962 - RNA, 20 nt, Human
ugaaaagagccuuuuggggu

SEQ ID NO: 1314963 - RNA, 18 nt, Human
aaacccaagauagagcag

SEQ ID NO: 1314964 - RNA, 22 nt, Human
aaacccaagauagagcagggga

SEQ ID NO: 1314965 - RNA, 20 nt, Human
aagaaacccaagauagagca

SEQ ID NO: 1314966 - RNA, 25 nt, Human
agccuuuggaagcuuggaagcaauu

SEQ ID NO: 1314967 - RNA, 24 nt, Human
gaaaagagccuuuggaagcuugga

SEQ ID NO: 1314968 - RNA, 23 nt, Human
gcaauuaagaaacccaagauaga

SEQ ID NO: 1314969 - RNA, 19 nt, Human
uuggaagcuuggaagcaau

SEQ ID NO: 1314970 - RNA, 22 nt, Human
uacuaagucgccuuuucccaag

SEQ ID NO: 1314971 - RNA, 24 nt, Human
aaaaagcacuccaugcacaaaaca

SEQ ID NO: 1314972 - RNA, 22 nt, Human
aaagcacuccaugcacaaaaca

SEQ ID NO: 1314973 - RNA, 22 nt, Human
acagcggccuccugcgcucccu

SEQ ID NO: 1314974 - RNA, 30 nt, Human
agaaagaaaagauauuuauuauaaaaugcu

SEQ ID NO: 1314975 - RNA, 24 nt, Human
caaaaagcacuccaugcacaaaac

SEQ ID NO: 1314976 - RNA, 25 nt, Human
caaaaagcacuccaugcacaaaaca

SEQ ID NO: 1314977 - RNA, 25 nt, Human
caccccugccccaggcaaucagucc

SEQ ID NO: 1314978 - RNA, 22 nt, Human
cccaaaaagcacuccaugcaca

SEQ ID NO: 1314979 - RNA, 28 nt, Human
cccaaaaagcacuccaugcacaaaacac

SEQ ID NO: 1314980 - RNA, 21 nt, Human
cccaagcuuagcgcccaagag

SEQ ID NO: 1314981 - RNA, 24 nt, Human
ccccggcggccucgacugccaccc

SEQ ID NO: 1314982 - RNA, 22 nt, Human
cccggagagcugcagccucacc

SEQ ID NO: 1314983 - RNA, 23 nt, Human
ccuccccagcgcuaccgccgccc

SEQ ID NO: 1314984 - RNA, 22 nt, Human
ccuccugcgcucccucccaagc

SEQ ID NO: 1314985 - RNA, 22 nt, Human
ccucgacugccaccccugcccc

SEQ ID NO: 1314986 - RNA, 18 nt, Human
cgacugccaccccugccc

SEQ ID NO: 1314987 - RNA, 21 nt, Human
cgacugccaccccugccccag

SEQ ID NO: 1314988 - RNA, 22 nt, Human
cuccugcgcucccucccaagcu

SEQ ID NO: 1314989 - RNA, 20 nt, Human
cugcagccucaccucggccc

SEQ ID NO: 1314990 - RNA, 19 nt, Human
gagcugcagccucaccucg

SEQ ID NO: 1314991 - RNA, 19 nt, Human
ggccucgacugccaccccu

SEQ ID NO: 1314992 - RNA, 21 nt, Human
ggugacgugaaccggaaagga

SEQ ID NO: 1314993 - RNA, 18 nt, Human
uaaaaugcaauacugcgc

SEQ ID NO: 1314994 - RNA, 24 nt, Human
uaaauaaacacacuguuuaaacca

SEQ ID NO: 1314995 - RNA, 22 nt, Human
uauaaaaugcaauacugcgcau

SEQ ID NO: 1314996 - RNA, 24 nt, Human
uauaucgaugaucucugugaauac

SEQ ID NO: 1314997 - RNA, 20 nt, Human
ucccaaaaagcacuccaugc

SEQ ID NO: 1314998 - RNA, 19 nt, Human
ucccaagcuuagcgcccaa

SEQ ID NO: 1314999 - RNA, 25 nt, Human
ucgaugaucucugugaauacuuccc

SEQ ID NO: 1315000 - RNA, 22 nt, Human
ucuccuccuccuccccagcgcu

SEQ ID NO: 1315001 - RNA, 18 nt, Human
ugacccagggaaggacac

SEQ ID NO: 1315002 - RNA, 24 nt, Human
ugacgugaaccggaaaggaaggac

SEQ ID NO: 1315003 - RNA, 19 nt, Human
ugcagguggagcaacagag

SEQ ID NO: 1315004 - RNA, 23 nt, Human
uggcugcagguggagcaacagag

SEQ ID NO: 1315005 - RNA, 24 nt, Human
uggcugcagguggagcaacagagg

SEQ ID NO: 1315006 - RNA, 23 nt, Human
uuuaaaccacccuccccccauuu

SEQ ID NO: 1315007 - RNA, 18 nt, Human
uuugaaaagaaagaaaag

SEQ ID NO: 1315008 - RNA, 27 nt, Human
aaaacaaacagacaugacacacacaaa

SEQ ID NO: 1315009 - RNA, 20 nt, Human
aaacagacaugacacacacu

SEQ ID NO: 1315010 - RNA, 20 nt, Human
aacagacaugacacacacaa

SEQ ID NO: 1315011 - RNA, 23 nt, Human
agccagcaaccccagaaaacccu

SEQ ID NO: 1315012 - RNA, 18 nt, Human
aucugccuaaugcuuucc

SEQ ID NO: 1315013 - RNA, 20 nt, Human
aucugccuaaugcuuuccuc

SEQ ID NO: 1315014 - RNA, 18 nt, Human
augaaguggcugccuuug

SEQ ID NO: 1315015 - RNA, 20 nt, Human
cauuucuuagcaagcaaggu

SEQ ID NO: 1315016 - RNA, 19 nt, Human
cccuuuuccuuuuccucuc

SEQ ID NO: 1315017 - RNA, 19 nt, Human
ccuucccuuuuccuuuucc

SEQ ID NO: 1315018 - RNA, 19 nt, Human
ccuuuuccucucagaaaag

SEQ ID NO: 1315019 - RNA, 24 nt, Human
cucaaccucucuccuuuucucuuu

SEQ ID NO: 1315020 - RNA, 25 nt, Human
cucaaccucucuccuuuucucuuuu

SEQ ID NO: 1315021 - RNA, 23 nt, Human
cucgcucgcucaaccucucuccu

SEQ ID NO: 1315022 - RNA, 25 nt, Human
cucuccuuuucucuuuuaccauuaa

SEQ ID NO: 1315023 - RNA, 18 nt, Human
cucuccuuuuucucuccc

SEQ ID NO: 1315024 - RNA, 18 nt, Human
cuggugguacagugccuu

SEQ ID NO: 1315025 - RNA, 19 nt, Human
cugucuccucauccucaca

SEQ ID NO: 1315026 - RNA, 22 nt, Human
cuguggguucuucucaggcaca

SEQ ID NO: 1315027 - RNA, 21 nt, Human
gaaaaacaaacagacaugaca

SEQ ID NO: 1315028 - RNA, 19 nt, Human
gaaauacaacccccaugaa

SEQ ID NO: 1315029 - RNA, 21 nt, Human
gagaagcacauuuaaucuuua

SEQ ID NO: 1315030 - RNA, 20 nt, Human
gaggcucuccuuuuucucuc

SEQ ID NO: 1315031 - RNA, 19 nt, Human
gauggaaagggcuacuugu

SEQ ID NO: 1315032 - RNA, 21 nt, Human
gcuagucugucaucaucacac

SEQ ID NO: 1315033 - RNA, 22 nt, Human
uaauaauaauaauggcccuuuc

SEQ ID NO: 1315034 - RNA, 19 nt, Human
uagucugucaucaucacac

SEQ ID NO: 1315035 - RNA, 23 nt, Human
ucacauguacauuccaucugccu

SEQ ID NO: 1315036 - RNA, 22 nt, Human
uccucauccucacauguacauu

SEQ ID NO: 1315037 - RNA, 19 nt, Human
ucucgcucgcucaaccucu

SEQ ID NO: 1315038 - RNA, 21 nt, Human
ugaaaaacaaacagacaugac

SEQ ID NO: 1315039 - RNA, 26 nt, Human
ugaaaaacaaacagacaugacacaca

SEQ ID NO: 1315040 - RNA, 20 nt, Human
ugaaauacaacccccaugaa

SEQ ID NO: 1315041 - RNA, 20 nt, Human
ugagcucagaggcucuccuu

SEQ ID NO: 1315042 - RNA, 20 nt, Human
ugagcucagaggcucuccuu

SEQ ID NO: 1315043 - RNA, 25 nt, Human
ugccuuggaaagagaaaucaggagu

SEQ ID NO: 1315044 - RNA, 27 nt, Human
ugccuuggaaagagaaaucaggaguga

SEQ ID NO: 1315045 - RNA, 20 nt, Human
ugccuugguccucaaggagg

SEQ ID NO: 1315046 - RNA, 20 nt, Human
ugcuuuccucucuuaauuga

SEQ ID NO: 1315047 - RNA, 20 nt, Human
uggaaagagaaaucaggagu

SEQ ID NO: 1315048 - RNA, 22 nt, Human
uuaaucuuuacuggcuccccua

SEQ ID NO: 1315049 - RNA, 26 nt, Human
uucccuuuuccuuuuccucucagaaa

SEQ ID NO: 1315050 - RNA, 21 nt, Human
uugaaaaacaaacagacauga

SEQ ID NO: 1315051 - RNA, 23 nt, Human
uugccccauuucuuagcaagcaa

SEQ ID NO: 1315052 - RNA, 22 nt, Human
aaaacccacaacccacaggaug

SEQ ID NO: 1315053 - RNA, 21 nt, Human
aaacaaaaaacccacaaccca

SEQ ID NO: 1315054 - RNA, 22 nt, Human
aaacccacaacccacaggaugg

SEQ ID NO: 1315055 - RNA, 19 nt, Human
caaaaaacccacaacccac

SEQ ID NO: 1315056 - RNA, 22 nt, Human
caaaaaacccacaacccacagg

SEQ ID NO: 1315057 - RNA, 23 nt, Human
caaaaaacccacaacccacagga

SEQ ID NO: 1315058 - RNA, 22 nt, Human
gagaaaacaaaaaacccacaac

SEQ ID NO: 1315059 - RNA, 18 nt, Human
ggagaaaacaaaaaaccc

SEQ ID NO: 1315060 - RNA, 31 nt, Human
ggagaaaacaaaaaacccacaacccacaggg

SEQ ID NO: 1315061 - RNA, 18 nt, Human
uacaucaagacaucuccc

SEQ ID NO: 1315062 - RNA, 21 nt, Human
uacaucaagacaucucccagg

SEQ ID NO: 1315063 - RNA, 22 nt, Human
uucauggaagauaaucuucucc

SEQ ID NO: 1315064 - RNA, 23 nt, Human
aaccuggccaaguuuggcuucag

SEQ ID NO: 1315065 - RNA, 22 nt, Human
aggagucacagugcugacccca

SEQ ID NO: 1315066 - RNA, 18 nt, Human
auggagcccuggauuucc

SEQ ID NO: 1315067 - RNA, 19 nt, Human
auggagcccuggauuucca

SEQ ID NO: 1315068 - RNA, 19 nt, Human
caagauggagcccuggauu

SEQ ID NO: 1315069 - RNA, 19 nt, Human
cacacacuuugcagcaaca

SEQ ID NO: 1315070 - RNA, 21 nt, Human
cacuucuuccagugagcccca

SEQ ID NO: 1315071 - RNA, 24 nt, Human
ccaacccugcucagacucuuccuc

SEQ ID NO: 1315072 - RNA, 21 nt, Human
cccugcucagacucuuccucc

SEQ ID NO: 1315073 - RNA, 23 nt, Human
cccugcucagacucuuccuccaa

SEQ ID NO: 1315074 - RNA, 22 nt, Human
cccuggauuuccaagucuuucc

SEQ ID NO: 1315075 - RNA, 19 nt, Human
ccugcucagacucuuccuc

SEQ ID NO: 1315076 - RNA, 24 nt, Human
cucaggccauagugaccaggccag

SEQ ID NO: 1315077 - RNA, 18 nt, Human
ggcuaccguccugcccag

SEQ ID NO: 1315078 - RNA, 18 nt, Human
ucaggccauagugaccag

SEQ ID NO: 1315079 - RNA, 30 nt, Human
uccaagucuuuccaacccugcucagacucu

SEQ ID NO: 1315080 - RNA, 23 nt, Human
ugagccccagugucugagcuuug

SEQ ID NO: 1315081 - RNA, 23 nt, Human
ugcagaauaccagacaauggcua

SEQ ID NO: 1315082 - RNA, 20 nt, Human
uggagcccuggauuuccaag

SEQ ID NO: 1315083 - RNA, 18 nt, Human
uucacuucuuccagugag

SEQ ID NO: 1315084 - RNA, 24 nt, Human
uuccaagucuuuccaacccugcuc

SEQ ID NO: 1315085 - RNA, 18 nt, Human
uucuuccagugagcccca

SEQ ID NO: 1315086 - RNA, 18 nt, Human
cccucauccagauucaac

SEQ ID NO: 1315087 - RNA, 18 nt, Human
cccugcgcgccccggccg

SEQ ID NO: 1315088 - RNA, 27 nt, Human
ccgcugggcaacguggagcgcucccug

SEQ ID NO: 1315089 - RNA, 21 nt, Human
cggagccgcugggcaacgugg

SEQ ID NO: 1315090 - RNA, 22 nt, Human
ggccgagcuccugcccgaugcc

SEQ ID NO: 1315091 - RNA, 23 nt, Human
guggagcgcucccugcgcgcccc

SEQ ID NO: 1315092 - RNA, 30 nt, Human
uauuaugaaaauuucaaauuuacauagaag

SEQ ID NO: 1315093 - RNA, 19 nt, Human
ucccugcgcgccccggccg

SEQ ID NO: 1315094 - RNA, 22 nt, Human
ucgaacagaaguugaguuuucc

SEQ ID NO: 1315095 - RNA, 23 nt, Human
ugagugugaagauccacaagucg

SEQ ID NO: 1315096 - RNA, 26 nt, Human
ugcccgcggcuucgugcccgcggccu

SEQ ID NO: 1315097 - RNA, 18 nt, Human
uuuguuucugagugugaa

SEQ ID NO: 1315098 - RNA, 23 nt, Human
aaaaaaacaaacaaccccaucaa

SEQ ID NO: 1315099 - RNA, 25 nt, Human
aaaaaaacaaacaaccccaucaaaa

SEQ ID NO: 1315100 - RNA, 27 nt, Human
aaaaaacacaugaaaaaaugcucauca

SEQ ID NO: 1315101 - RNA, 19 nt, Human
aaacaaccccaucaaaaag

SEQ ID NO: 1315102 - RNA, 27 nt, Human
aaacuaccaucagagugaacaggcaag

SEQ ID NO: 1315103 - RNA, 26 nt, Human
aaagagaacgcaaaagaaacuaccau

SEQ ID NO: 1315104 - RNA, 21 nt, Human
aaccuacaaaaugggagaaaa

SEQ ID NO: 1315105 - RNA, 24 nt, Human
aacgcaaaagaaacuaccaucaga

SEQ ID NO: 1315106 - RNA, 26 nt, Human
aagaaaaaaacaaacaaccccaucaa

SEQ ID NO: 1315107 - RNA, 19 nt, Human
aauucacaagaaaaaaaca

SEQ ID NO: 1315108 - RNA, 20 nt, Human
acaagaaaaaaacaaacaac

SEQ ID NO: 1315109 - RNA, 22 nt, Human
agacauuuaugcagccaaaaaa

SEQ ID NO: 1315110 - RNA, 23 nt, Human
augcagccaaaaaacacaugaaa

SEQ ID NO: 1315111 - RNA, 24 nt, Human
caaaaagugggcgaaggacaugaa

SEQ ID NO: 1315112 - RNA, 21 nt, Human
caaacaaccccaucaaaaagu

SEQ ID NO: 1315113 - RNA, 27 nt, Human
caaacaaccccaucaaaaagugggcga

SEQ ID NO: 1315114 - RNA, 26 nt, Human
caaccccaucaaaaagugggcgaagg

SEQ ID NO: 1315115 - RNA, 22 nt, Human
cacaagaaaaaaacaaacaacc

SEQ ID NO: 1315116 - RNA, 26 nt, Human
cagagugaacaggcaaccuacaaaau

SEQ ID NO: 1315117 - RNA, 21 nt, Human
cagcauaguugcuugcagaac

SEQ ID NO: 1315118 - RNA, 20 nt, Human
caucaagagagagcagcaua

SEQ ID NO: 1315119 - RNA, 21 nt, Human
caugaacagacacuucucaaa

SEQ ID NO: 1315120 - RNA, 18 nt, Human
ccaucaagagagagcagc

SEQ ID NO: 1315121 - RNA, 18 nt, Human
cugaacuuggaagcugga

SEQ ID NO: 1315122 - RNA, 26 nt, Human
gaaaaaaacaaacaaccccaucaaaa

SEQ ID NO: 1315123 - RNA, 23 nt, Human
gaaacuaccaucagagugaacag

SEQ ID NO: 1315124 - RNA, 24 nt, Human
gagaacgcaaaagaaaccgguacc

SEQ ID NO: 1315125 - RNA, 21 nt, Human
gccaaaaaacacaugaaaaaa

SEQ ID NO: 1315126 - RNA, 23 nt, Human
gccaaaaaacacaugaaaaaaug

SEQ ID NO: 1315127 - RNA, 21 nt, Human
ggaaagagaacgcaaaagaaa

SEQ ID NO: 1315128 - RNA, 24 nt, Human
ggagaaaagcacaggauguagagg

SEQ ID NO: 1315129 - RNA, 23 nt, Human
gggaaagagaacgcaaaagaaac

SEQ ID NO: 1315130 - RNA, 20 nt, Human
uauccagaaucuacaacgaa

SEQ ID NO: 1315131 - RNA, 24 nt, Human
uauucggcauaaucuucucccuca

SEQ ID NO: 1315132 - RNA, 25 nt, Human
ucauuuucaucuucaccaucaagag

SEQ ID NO: 1315133 - RNA, 23 nt, Human
uccaggguggagagaaacuagga

SEQ ID NO: 1315134 - RNA, 24 nt, Human
ucugacaaagggcuaauauccaga

SEQ ID NO: 1315135 - RNA, 21 nt, Human
ucuggauagagguuuugauuu

SEQ ID NO: 1315136 - RNA, 24 nt, Human
ucuucuguaacaucauaggguagg

SEQ ID NO: 1315137 - RNA, 22 nt, Human
ugaacaggcaaccuacaaaaug

SEQ ID NO: 1315138 - RNA, 19 nt, Human
ugacaaagggcuaauaucc

SEQ ID NO: 1315139 - RNA, 20 nt, Human
ugaguuuuauuuugucuugu

SEQ ID NO: 1315140 - RNA, 25 nt, Human
ugcagccaaaaaacacaugaaaaaa

SEQ ID NO: 1315141 - RNA, 19 nt, Human
ugcucucgaauguuccagg

SEQ ID NO: 1315142 - RNA, 18 nt, Human
uggaagcuggauuuuccu

SEQ ID NO: 1315143 - RNA, 22 nt, Human
ugggagaaaauuuucgcaaccu

SEQ ID NO: 1315144 - RNA, 18 nt, Human
ugucuugucuggauagag

SEQ ID NO: 1315145 - RNA, 22 nt, Human
uucacaagaaaaaaacaaacaa

SEQ ID NO: 1315146 - RNA, 22 nt, Human
uucgcaaccuacucaucugacc

SEQ ID NO: 1315147 - RNA, 18 nt, Human
uucuguaacaucauaggg

SEQ ID NO: 1315148 - RNA, 22 nt, Human
uuugcucucgaauguuccaggg

SEQ ID NO: 1315149 - RNA, 23 nt, Human
cacgcauccguggaguccagagc

SEQ ID NO: 1315150 - RNA, 26 nt, Human
cauagcccacauuccucugcccacgc

SEQ ID NO: 1315151 - RNA, 19 nt, Human
ggaguccagagcccagaaa

SEQ ID NO: 1315152 - RNA, 20 nt, Human
ggcugaucagcucaugcaga

SEQ ID NO: 1315153 - RNA, 21 nt, Human
guccagagcccagaaagccuc

SEQ ID NO: 1315154 - RNA, 20 nt, Human
uauuaugacuacauagccca

SEQ ID NO: 1315155 - RNA, 22 nt, Human
ucaagagcgaaguguggcacaa

SEQ ID NO: 1315156 - RNA, 23 nt, Human
ucaagagcgaaguguggcacaga

SEQ ID NO: 1315157 - RNA, 30 nt, Human
aaaaauauucucaaguacaaaaaccaaaag

SEQ ID NO: 1315158 - RNA, 26 nt, Human
aaaaggaagauauaagggaaaaagga

SEQ ID NO: 1315159 - RNA, 22 nt, Human
aaaauacaaccaauguacucug

SEQ ID NO: 1315160 - RNA, 21 nt, Human
aaacaaaaggccuagaccaca

SEQ ID NO: 1315161 - RNA, 24 nt, Human
aaacaaaaggccuagaccacaaau

SEQ ID NO: 1315162 - RNA, 22 nt, Human
aaacagaagggaauuuuuaagg

SEQ ID NO: 1315163 - RNA, 19 nt, Human
aaaggccuagaccacaaau

SEQ ID NO: 1315164 - RNA, 21 nt, Human
aaauaaacaaacacaagauag

SEQ ID NO: 1315165 - RNA, 20 nt, Human
aaccaauguacucugacuug

SEQ ID NO: 1315166 - RNA, 23 nt, Human
aagcaaauaaacaaacacaagau

SEQ ID NO: 1315167 - RNA, 23 nt, Human
aagcaaauaaacaaacacaaggg

SEQ ID NO: 1315168 - RNA, 24 nt, Human
aaguuauuguauucuacuuggaau

SEQ ID NO: 1315169 - RNA, 24 nt, Human
aauacauuucaaaaucaaauauaa

SEQ ID NO: 1315170 - RNA, 21 nt, Human
acaaaaggccuagaccacaaa

SEQ ID NO: 1315171 - RNA, 19 nt, Human
accacaaauuacccaguua

SEQ ID NO: 1315172 - RNA, 18 nt, Human
agaaaacaaaaggccuag

SEQ ID NO: 1315173 - RNA, 21 nt, Human
agaaauuuaauauuuggacaa

SEQ ID NO: 1315174 - RNA, 23 nt, Human
agaaauuuaauauuuggacaaaa

SEQ ID NO: 1315175 - RNA, 22 nt, Human
agaccagaucagagcagccagg

SEQ ID NO: 1315176 - RNA, 21 nt, Human
agcaaauaaacaaacacaaga

SEQ ID NO: 1315177 - RNA, 20 nt, Human
agcagccaggugccagagac

SEQ ID NO: 1315178 - RNA, 21 nt, Human
agcagccaggugccagagacu

SEQ ID NO: 1315179 - RNA, 18 nt, Human
agcuccuaacagcagauu

SEQ ID NO: 1315180 - RNA, 22 nt, Human
aggaagauauaagggaaaaagg

SEQ ID NO: 1315181 - RNA, 22 nt, Human
aggaccccaaaaugcaauccaa

SEQ ID NO: 1315182 - RNA, 24 nt, Human
aggagaacgcagguuuccaaugaa

SEQ ID NO: 1315183 - RNA, 18 nt, Human
aggugccagagacugggc

SEQ ID NO: 1315184 - RNA, 22 nt, Human
auucaaaauacaaccuuuuaaa

SEQ ID NO: 1315185 - RNA, 18 nt, Human
caaaaugcaauccaauau

SEQ ID NO: 1315186 - RNA, 20 nt, Human
cagagcagccaggugccaga

SEQ ID NO: 1315187 - RNA, 19 nt, Human
cagcagaauccucauucau

SEQ ID NO: 1315188 - RNA, 21 nt, Human
cauauggaugauauucaaaau

SEQ ID NO: 1315189 - RNA, 23 nt, Human
cauguaagaaacagaagggaauu

SEQ ID NO: 1315190 - RNA, 24 nt, Human
cauucaucucguccaugaagacca

SEQ ID NO: 1315191 - RNA, 24 nt, Human
cucacuacaacaaaguaauucacc

SEQ ID NO: 1315192 - RNA, 20 nt, Human
cuccgcgcugagaccagauc

SEQ ID NO: 1315193 - RNA, 20 nt, Human
cuuuagucuaccacauuugu

SEQ ID NO: 1315194 - RNA, 22 nt, Human
cuuuaugguuaucugccaugcu

SEQ ID NO: 1315195 - RNA, 18 nt, Human
gagcaauuucagacguag

SEQ ID NO: 1315196 - RNA, 22 nt, Human
gcgaccggguagaacggacgcc

SEQ ID NO: 1315197 - RNA, 24 nt, Human
ggggaaauuucuuagguuuuuucc

SEQ ID NO: 1315198 - RNA, 21 nt, Human
guuuacuuuuuagugaaguuu

SEQ ID NO: 1315199 - RNA, 20 nt, Human
guuuuaagccucaagaaaau

SEQ ID NO: 1315200 - RNA, 23 nt, Human
uaaaauuaccuuuuaaacuaaca

SEQ ID NO: 1315201 - RNA, 18 nt, Human
uaaacaaacacaagauag

SEQ ID NO: 1315202 - RNA, 21 nt, Human
uacaaccaauguacucugacu

SEQ ID NO: 1315203 - RNA, 21 nt, Human
uagaccacaaauuacccaguu

SEQ ID NO: 1315204 - RNA, 23 nt, Human
uagaguaauuacagucauuccag

SEQ ID NO: 1315205 - RNA, 22 nt, Human
uauauuacuaugauguuuuaaa

SEQ ID NO: 1315206 - RNA, 24 nt, Human
uauuuccauuuuuuaaaaaaaggg

SEQ ID NO: 1315207 - RNA, 23 nt, Human
ucaccaaaaauauucucaaguac

SEQ ID NO: 1315208 - RNA, 26 nt, Human
ucacuacaacaaaguaauucaccaaa

SEQ ID NO: 1315209 - RNA, 19 nt, Human
uccaaugaacucccucagg

SEQ ID NO: 1315210 - RNA, 22 nt, Human
uccauuaucucaaaauugagcu

SEQ ID NO: 1315211 - RNA, 20 nt, Human
ucccucagggcagcagaauc

SEQ ID NO: 1315212 - RNA, 24 nt, Human
uccgcgcugagaccagaucagagc

SEQ ID NO: 1315213 - RNA, 18 nt, Human
ucucguccaugaagacca

SEQ ID NO: 1315214 - RNA, 19 nt, Human
ucucguccaugaagaccaa

SEQ ID NO: 1315215 - RNA, 19 nt, Human
ugaaaaaaaaccauacuau

SEQ ID NO: 1315216 - RNA, 24 nt, Human
ugaaaaaacuguuuuaugaaagca

SEQ ID NO: 1315217 - RNA, 20 nt, Human
ugaaauagaaauuuaauauu

SEQ ID NO: 1315218 - RNA, 25 nt, Human
ugaaguacuaaauugaacaaggcca

SEQ ID NO: 1315219 - RNA, 22 nt, Human
ugagaccagaucagagcagcca

SEQ ID NO: 1315220 - RNA, 18 nt, Human
uggccugauagucuacau

SEQ ID NO: 1315221 - RNA, 21 nt, Human
uggccugauagucuacauuug

SEQ ID NO: 1315222 - RNA, 22 nt, Human
uggccugauagucuacauuuga

SEQ ID NO: 1315223 - RNA, 22 nt, Human
uuaaaagcaaauaaacaaacac

SEQ ID NO: 1315224 - RNA, 22 nt, Human
uuaaaagcaaauaaacaaacac

SEQ ID NO: 1315225 - RNA, 19 nt, Human
uuagaaaacaaaaggccua

SEQ ID NO: 1315226 - RNA, 25 nt, Human
uucaaauucuaaaauagcagcuuuu

SEQ ID NO: 1315227 - RNA, 24 nt, Human
uucuacaaaaauacaauauaggag

SEQ ID NO: 1315228 - RNA, 22 nt, Human
uuuugcauccuaauuuaaccuu

SEQ ID NO: 1315229 - RNA, 20 nt, Human
aacuucagcuucuuuaacac

SEQ ID NO: 1315230 - RNA, 18 nt, Human
aaggcaacauuuauuuga

SEQ ID NO: 1315231 - RNA, 22 nt, Human
acacaaauuuccuaacaccuau

SEQ ID NO: 1315232 - RNA, 20 nt, Human
acagagccuauuaaucguga

SEQ ID NO: 1315233 - RNA, 26 nt, Human
acagcaauaccuuggccaccuccaau

SEQ ID NO: 1315234 - RNA, 18 nt, Human
acccaaagcaauggcucc

SEQ ID NO: 1315235 - RNA, 22 nt, Human
accucgacgccuuaauucauca

SEQ ID NO: 1315236 - RNA, 24 nt, Human
auagagggaucacauacagauaca

SEQ ID NO: 1315237 - RNA, 19 nt, Human
auccaaacucuucucaaca

SEQ ID NO: 1315238 - RNA, 26 nt, Human
augauagagggaucacauacagauac

SEQ ID NO: 1315239 - RNA, 25 nt, Human
augaucaaugcauuuuuguaucacc

SEQ ID NO: 1315240 - RNA, 20 nt, Human
cacacgcaaaccaacaugcc

SEQ ID NO: 1315241 - RNA, 22 nt, Human
cacaguggacugaaaaccagaa

SEQ ID NO: 1315242 - RNA, 22 nt, Human
caccauggcuugaacaaacuca

SEQ ID NO: 1315243 - RNA, 21 nt, Human
cagcaauaccuuggccaccuc

SEQ ID NO: 1315244 - RNA, 23 nt, Human
cagcaauaccuuggccaccucca

SEQ ID NO: 1315245 - RNA, 26 nt, Human
caugaucaaugcauuuuuguaucacc

SEQ ID NO: 1315246 - RNA, 18 nt, Human
ccaaguagaauaagagug

SEQ ID NO: 1315247 - RNA, 19 nt, Human
ccaccucgacgccuuaauu

SEQ ID NO: 1315248 - RNA, 23 nt, Human
ccagauccucccagugggugacc

SEQ ID NO: 1315249 - RNA, 24 nt, Human
cccaaagcaauggcuccuccauuc

SEQ ID NO: 1315250 - RNA, 23 nt, Human
ccuaacaccuauucacaguggac

SEQ ID NO: 1315251 - RNA, 23 nt, Human
cgccuuaauucaucaaccaaucc

SEQ ID NO: 1315252 - RNA, 20 nt, Human
cguacuucuagcaugggcuc

SEQ ID NO: 1315253 - RNA, 20 nt, Human
cuaaggcagaaguggugguu

SEQ ID NO: 1315254 - RNA, 18 nt, Human
cuccaaugcaagcugagg

SEQ ID NO: 1315255 - RNA, 20 nt, Human
cuccaaugcaagcugaucca

SEQ ID NO: 1315256 - RNA, 20 nt, Human
cugcuuucuucagugcccca

SEQ ID NO: 1315257 - RNA, 21 nt, Human
gagcucacuggucucuucagg

SEQ ID NO: 1315258 - RNA, 21 nt, Human
gcagaaguggugguuacuugg

SEQ ID NO: 1315259 - RNA, 18 nt, Human
gccaguuguggcagcugc

SEQ ID NO: 1315260 - RNA, 22 nt, Human
gccuuaauucaucaaccaaucc

SEQ ID NO: 1315261 - RNA, 25 nt, Human
gcuucauucaccucuaccaaaucca

SEQ ID NO: 1315262 - RNA, 20 nt, Human
guucagaaauacauauuuca

SEQ ID NO: 1315263 - RNA, 18 nt, Human
uacuggggagcaaaagcu

SEQ ID NO: 1315264 - RNA, 18 nt, Human
uacuuggcaagaauacaa

SEQ ID NO: 1315265 - RNA, 25 nt, Human
uacuuggcaagaauacaauuucuuu

SEQ ID NO: 1315266 - RNA, 26 nt, Human
uagcaaggacaggaccaauacccaug

SEQ ID NO: 1315267 - RNA, 27 nt, Human
ucaagauccaaacucuucucaacagcc

SEQ ID NO: 1315268 - RNA, 27 nt, Human
ucagaaauacauauuucacugguacaa

SEQ ID NO: 1315269 - RNA, 22 nt, Human
ucagcuauccccgaugcauucc

SEQ ID NO: 1315270 - RNA, 21 nt, Human
uccaaugcaagcugauccaac

SEQ ID NO: 1315271 - RNA, 24 nt, Human
ucuucaggcugugcucugaaugau

SEQ ID NO: 1315272 - RNA, 25 nt, Human
ucuuuaacacaaauuuccuaacacc

SEQ ID NO: 1315273 - RNA, 22 nt, Human
ugaaaaccagaaccacagagcc

SEQ ID NO: 1315274 - RNA, 19 nt, Human
ugaaugaugacagcaauac

SEQ ID NO: 1315275 - RNA, 19 nt, Human
ugauagcaaggacaggacc

SEQ ID NO: 1315276 - RNA, 19 nt, Human
ugcauucccugcagugaca

SEQ ID NO: 1315277 - RNA, 18 nt, Human
uggcaagaauacaauuuc

SEQ ID NO: 1315278 - RNA, 18 nt, Human
uggcaagaauacaauuuc

SEQ ID NO: 1315279 - RNA, 19 nt, Human
uggcagcugcucugaaggu

SEQ ID NO: 1315280 - RNA, 20 nt, Human
uggccaguuguggcagcugc

SEQ ID NO: 1315281 - RNA, 24 nt, Human
uguggcagcugcucugaaggucaa

SEQ ID NO: 1315282 - RNA, 25 nt, Human
uguggcagcugcucugaaggucacu

SEQ ID NO: 1315283 - RNA, 19 nt, Human
uucacaguggacugaaaaa

SEQ ID NO: 1315284 - RNA, 19 nt, Human
uucaccucuaccaaaucca

SEQ ID NO: 1315285 - RNA, 19 nt, Human
uucaugaucaaugcauuuu

SEQ ID NO: 1315286 - RNA, 24 nt, Human
uuccuccgcauaaaacaacuucag

SEQ ID NO: 1315287 - RNA, 18 nt, Human
uucuuaacagcaucuuca

SEQ ID NO: 1315288 - RNA, 19 nt, Human
uuucuucagugccccacug

SEQ ID NO: 1315289 - RNA, 30 nt, Human
acucugaggaaacgccaauuucagagaaag

SEQ ID NO: 1315290 - RNA, 19 nt, Human
gagaaaauggaguauggcc

SEQ ID NO: 1315291 - RNA, 19 nt, Human
cgccggaccacgcuggggg

SEQ ID NO: 1315292 - RNA, 21 nt, Human
uauuuucauccgcaucuguca

SEQ ID NO: 1315293 - RNA, 30 nt, Human
uauuuucauccgcaucugucacuucugauu

SEQ ID NO: 1315294 - RNA, 18 nt, Human
ucgccggaccacgcuggg

SEQ ID NO: 1315295 - RNA, 23 nt, Human
ucgccggaccacgcugggggcuu

SEQ ID NO: 1315296 - RNA, 22 nt, Human
ucugcaaggcucgccggaccac

SEQ ID NO: 1315297 - RNA, 22 nt, Human
ugggggcuuuguccugacuggu

SEQ ID NO: 1315298 - RNA, 22 nt, Human
ccgcagcaguucucgaacuggc

SEQ ID NO: 1315299 - RNA, 22 nt, Human
cuuggcccgggcggcacucggc

SEQ ID NO: 1315300 - RNA, 24 nt, Human
gcagcaguucucgaacuggccucc

SEQ ID NO: 1315301 - RNA, 19 nt, Human
ggccucuccgcagcaguuc

SEQ ID NO: 1315302 - RNA, 24 nt, Human
ucuccgcagcaguucucgaacugg

SEQ ID NO: 1315303 - RNA, 19 nt, Human
uggcccgggcggcacucgg

SEQ ID NO: 1315304 - RNA, 21 nt, Human
uggcccgggcggcacucggcc

SEQ ID NO: 1315305 - RNA, 25 nt, Human
aaaaugagaagcguaacaguuucca

SEQ ID NO: 1315306 - RNA, 23 nt, Human
aaacaagccacaaaacaguuuua

SEQ ID NO: 1315307 - RNA, 24 nt, Human
aaacacagaaucaugcuaccccuu

SEQ ID NO: 1315308 - RNA, 23 nt, Human
aagcagagggggaggaggucaaa

SEQ ID NO: 1315309 - RNA, 19 nt, Human
acaaaacaguuuuagaaaa

SEQ ID NO: 1315310 - RNA, 22 nt, Human
auuucacagcugaaacaucacu

SEQ ID NO: 1315311 - RNA, 20 nt, Human
cacugcuuuaaaacacagaa

SEQ ID NO: 1315312 - RNA, 21 nt, Human
cagcccgggcagucguugcgg

SEQ ID NO: 1315313 - RNA, 18 nt, Human
cauuucacagcugaaaca

SEQ ID NO: 1315314 - RNA, 19 nt, Human
ccccucccgcagcccgggc

SEQ ID NO: 1315315 - RNA, 25 nt, Human
ccccuucauaagcagagggggagga

SEQ ID NO: 1315316 - RNA, 22 nt, Human
ccuccccucccgcagcccgggc

SEQ ID NO: 1315317 - RNA, 19 nt, Human
cuccuccccucccgcagcc

SEQ ID NO: 1315318 - RNA, 19 nt, Human
cucuccuccccucccgcag

SEQ ID NO: 1315319 - RNA, 21 nt, Human
gagaagcguaacaguuuccau

SEQ ID NO: 1315320 - RNA, 19 nt, Human
gggggaggaggucaaacag

SEQ ID NO: 1315321 - RNA, 25 nt, Human
uaaaaugagaagcguaacaguuucc

SEQ ID NO: 1315322 - RNA, 20 nt, Human
uaagcagagggggaggaggu

SEQ ID NO: 1315323 - RNA, 22 nt, Human
uacaaaacaagccacaaaacag

SEQ ID NO: 1315324 - RNA, 23 nt, Human
uacaaaacaagccacaaaacagu

SEQ ID NO: 1315325 - RNA, 21 nt, Human
uccaugcacucagccuagagc

SEQ ID NO: 1315326 - RNA, 22 nt, Human
ucccgcagcccgggcagucguu

SEQ ID NO: 1315327 - RNA, 24 nt, Human
ugccaaacguuugcuuuaucuucu

SEQ ID NO: 1315328 - RNA, 20 nt, Human
ugcuacauaccaauuaggag

SEQ ID NO: 1315329 - RNA, 20 nt, Human
uuugccaaacguuugcuuua

SEQ ID NO: 1315330 - RNA, 22 nt, Human
uuugcuacauaccaauuaggag

SEQ ID NO: 1315331 - RNA, 22 nt, Human
aagcaggagaaucgcuugaacc

SEQ ID NO: 1315332 - RNA, 24 nt, Human
aagcaggagaaucgcuugaaccug

SEQ ID NO: 1315333 - RNA, 25 nt, Human
aagcaggagaaucgcuugaaccugg

SEQ ID NO: 1315334 - RNA, 18 nt, Human
aaucgcuugaaccuggga

SEQ ID NO: 1315335 - RNA, 24 nt, Human
aaucgcuugaaccugggaggcaga

SEQ ID NO: 1315336 - RNA, 23 nt, Human
acagagcgagacuccgucuaaaa

SEQ ID NO: 1315337 - RNA, 23 nt, Human
acugcccuccagccuggcaacag

SEQ ID NO: 1315338 - RNA, 23 nt, Human
acugcccuccagccuggcaacag

SEQ ID NO: 1315339 - RNA, 19 nt, Human
agaguuuuccucagucuaa

SEQ ID NO: 1315340 - RNA, 21 nt, Human
agccuggcaacagagcgagac

SEQ ID NO: 1315341 - RNA, 23 nt, Human
agccuggcaacagagcgagacuc

SEQ ID NO: 1315342 - RNA, 23 nt, Human
agcugggcaugguggcaugcgcc

SEQ ID NO: 1315343 - RNA, 24 nt, Human
aggcagagguugcagaaagccaag

SEQ ID NO: 1315344 - RNA, 24 nt, Human
aggcugaagcaggagaaucgcuug

SEQ ID NO: 1315345 - RNA, 22 nt, Human
agguaaucaaaaguaccaaagc

SEQ ID NO: 1315346 - RNA, 18 nt, Human
auaacaaugagugaagau

SEQ ID NO: 1315347 - RNA, 21 nt, Human
auccuuuauggcuuuuugcug

SEQ ID NO: 1315348 - RNA, 24 nt, Human
aucgugccacugcccuccagccug

SEQ ID NO: 1315349 - RNA, 19 nt, Human
augaaaggcacacauaaua

SEQ ID NO: 1315350 - RNA, 21 nt, Human
cagcuuccgcggcccccgccc

SEQ ID NO: 1315351 - RNA, 23 nt, Human
cauaauagccaguuuuaaagagc

SEQ ID NO: 1315352 - RNA, 25 nt, Human
ccaaagcacugauaaugagucacca

SEQ ID NO: 1315353 - RNA, 19 nt, Human
ccacugcccuccagccugg

SEQ ID NO: 1315354 - RNA, 19 nt, Human
ccacugcccuccagccugg

SEQ ID NO: 1315355 - RNA, 20 nt, Human
ccacugcccuccagccuggc

SEQ ID NO: 1315356 - RNA, 21 nt, Human
ccuggcaacagagcgagacuc

SEQ ID NO: 1315357 - RNA, 23 nt, Human
ccuggcaacagagcgagacuccg

SEQ ID NO: 1315358 - RNA, 23 nt, Human
ccugggaggcagagguugcagaa

SEQ ID NO: 1315359 - RNA, 21 nt, Human
ccuguagucccagcuacucag

SEQ ID NO: 1315360 - RNA, 19 nt, Human
cgccuguagucccagcuac

SEQ ID NO: 1315361 - RNA, 24 nt, Human
cgccuguagucccagcuacucaga

SEQ ID NO: 1315362 - RNA, 20 nt, Human
cgucuaaaaaaaaaaaaaaa

SEQ ID NO: 1315363 - RNA, 19 nt, Human
cgugccacugcccuccagc

SEQ ID NO: 1315364 - RNA, 20 nt, Human
cugaaguacuaaagugacac

SEQ ID NO: 1315365 - RNA, 18 nt, Human
cuguaucacuuauucgaa

SEQ ID NO: 1315366 - RNA, 24 nt, Human
cuucuugucaguugcugcuaugac

SEQ ID NO: 1315367 - RNA, 25 nt, Human
cuuuauggcuuuuugcuguaucacu

SEQ ID NO: 1315368 - RNA, 23 nt, Human
gaaacacagguaaucaaaaguac

SEQ ID NO: 1315369 - RNA, 23 nt, Human
gagaaucgcuugaaccugggagg

SEQ ID NO: 1315370 - RNA, 20 nt, Human
gaggcagagguugcagaaag

SEQ ID NO: 1315371 - RNA, 22 nt, Human
ggagaguuuuccucagucuaag

SEQ ID NO: 1315372 - RNA, 24 nt, Human
gggcaugguggcaugcgccuguag

SEQ ID NO: 1315373 - RNA, 24 nt, Human
gguggcaugcgccuguagucccag

SEQ ID NO: 1315374 - RNA, 18 nt, Human
gucgggcggcagcucggg

SEQ ID NO: 1315375 - RNA, 24 nt, Human
gugcaagagaacaaaguccacaca

SEQ ID NO: 1315376 - RNA, 22 nt, Human
uaaagugacacuaauacugaaa

SEQ ID NO: 1315377 - RNA, 25 nt, Human
uaagucccauaacaaugagugaaga

SEQ ID NO: 1315378 - RNA, 19 nt, Human
uacucagaaggcugaagca

SEQ ID NO: 1315379 - RNA, 20 nt, Human
uagcugggcaugguggcaug

SEQ ID NO: 1315380 - RNA, 20 nt, Human
uaucugguuuaacaaaaagu

SEQ ID NO: 1315381 - RNA, 24 nt, Human
ucaaaacaucuauaauuucuuaca

SEQ ID NO: 1315382 - RNA, 20 nt, Human
ucaaaaguaccaaagcacug

SEQ ID NO: 1315383 - RNA, 22 nt, Human
uccagccuggcaacagagcgag

SEQ ID NO: 1315384 - RNA, 23 nt, Human
uccagccuggcaacagagcgaga

SEQ ID NO: 1315385 - RNA, 22 nt, Human
uccgucuaaaaaaaaaaaaaaa

SEQ ID NO: 1315386 - RNA, 25 nt, Human
uccgucuaaaaaaaaaaaaaaaaaa

SEQ ID NO: 1315387 - RNA, 18 nt, Human
ucgcagcuuccgcggccc

SEQ ID NO: 1315388 - RNA, 18 nt, Human
ucgcuugaaccugggagg

SEQ ID NO: 1315389 - RNA, 20 nt, Human
ucgugccacugcccuccagc

SEQ ID NO: 1315390 - RNA, 23 nt, Human
ucgugccacugcccuccagccug

SEQ ID NO: 1315391 - RNA, 21 nt, Human
ucuaaaaaaaaaaaaaaaaaa

SEQ ID NO: 1315392 - RNA, 22 nt, Human
ugaaaggcacacauaauagcca

SEQ ID NO: 1315393 - RNA, 24 nt, Human
ugaaccugggaggcagagguugca

SEQ ID NO: 1315394 - RNA, 22 nt, Human
ugaacuaaaaauauaaccacaa

SEQ ID NO: 1315395 - RNA, 20 nt, Human
ugaagcaggagaaucgcuug

SEQ ID NO: 1315396 - RNA, 24 nt, Human
ugaagcaggagaaucgcuugaacc

SEQ ID NO: 1315397 - RNA, 21 nt, Human
ugaaguacuaaagugacacua

SEQ ID NO: 1315398 - RNA, 20 nt, Human
ugagaacaaugaacuaaaaa

SEQ ID NO: 1315399 - RNA, 19 nt, Human
ugagucaccaucaucaaga

SEQ ID NO: 1315400 - RNA, 21 nt, Human
uggcaugcgccuguaguccca

SEQ ID NO: 1315401 - RNA, 24 nt, Human
ugguggcaugcgccuguaguccca

SEQ ID NO: 1315402 - RNA, 24 nt, Human
uuagcauuaaaugagaacaaugaa

SEQ ID NO: 1315403 - RNA, 22 nt, Human
uuagcugggcaugguggcaugc

SEQ ID NO: 1315404 - RNA, 24 nt, Human
uugaaccugggaggcagagguugc

SEQ ID NO: 1315405 - RNA, 24 nt, Human
aaaccggucauagggccaucacac

SEQ ID NO: 1315406 - RNA, 20 nt, Human
aacaagacaacagaacuaga

SEQ ID NO: 1315407 - RNA, 21 nt, Human
aacaagacaacagaacuagaa

SEQ ID NO: 1315408 - RNA, 22 nt, Human
aacagaacuagaaagccacaga

SEQ ID NO: 1315409 - RNA, 21 nt, Human
acaagacaacagaacuagaaa

SEQ ID NO: 1315410 - RNA, 19 nt, Human
acagguuggagaggaagaa

SEQ ID NO: 1315411 - RNA, 21 nt, Human
agacaacaagacaacagaacu

SEQ ID NO: 1315412 - RNA, 21 nt, Human
agacaacagaacuagaaagcc

SEQ ID NO: 1315413 - RNA, 21 nt, Human
agacaacagaacuagaaagcc

SEQ ID NO: 1315414 - RNA, 23 nt, Human
agacaacagaacuagaaagccac

SEQ ID NO: 1315415 - RNA, 21 nt, Human
agaggaagaaguacauggggg

SEQ ID NO: 1315416 - RNA, 23 nt, Human
agaggaagaaguacaugggggug

SEQ ID NO: 1315417 - RNA, 25 nt, Human
aggaagaaguacaugggggugugga

SEQ ID NO: 1315418 - RNA, 20 nt, Human
agguaauuugcaaggcaauc

SEQ ID NO: 1315419 - RNA, 22 nt, Human
aggugggcgccgggccggcggg

SEQ ID NO: 1315420 - RNA, 21 nt, Human
caacagaacuagaaagccaca

SEQ ID NO: 1315421 - RNA, 21 nt, Human
caaggacagguuggagaggaa

SEQ ID NO: 1315422 - RNA, 19 nt, Human
cagcccgcauaggagauga

SEQ ID NO: 1315423 - RNA, 18 nt, Human
cauggguucaugauggcu

SEQ ID NO: 1315424 - RNA, 26 nt, Human
caugucuuucuuccaugccuccaaaa

SEQ ID NO: 1315425 - RNA, 19 nt, Human
cccgcggcugggaggaggg

SEQ ID NO: 1315426 - RNA, 23 nt, Human
ccuccaaaaauggcaaaaagaga

SEQ ID NO: 1315427 - RNA, 18 nt, Human
ccugccccgcggcuggga

SEQ ID NO: 1315428 - RNA, 18 nt, Human
cuccaaaaauggcaaaaa

SEQ ID NO: 1315429 - RNA, 19 nt, Human
cuccaaaaauggcaaaaag

SEQ ID NO: 1315430 - RNA, 20 nt, Human
gcaaaaagagacaucugagu

SEQ ID NO: 1315431 - RNA, 19 nt, Human
gcggcccaaguuugacccg

SEQ ID NO: 1315432 - RNA, 19 nt, Human
ggcaaaaagagacaucuga

SEQ ID NO: 1315433 - RNA, 20 nt, Human
gggggcgcgcgcagcggcgg

SEQ ID NO: 1315434 - RNA, 22 nt, Human
ggucauagggccaucacacuca

SEQ ID NO: 1315435 - RNA, 26 nt, Human
uaaaagacugagacaacaagacaaca

SEQ ID NO: 1315436 - RNA, 21 nt, Human
uacauggggguguggaggugg

SEQ ID NO: 1315437 - RNA, 23 nt, Human
uccaaaaauggcaaaaagagaca

SEQ ID NO: 1315438 - RNA, 18 nt, Human
ucuggcguuuccgcagac

SEQ ID NO: 1315439 - RNA, 20 nt, Human
ugacccgacuuuucuggcgu

SEQ ID NO: 1315440 - RNA, 21 nt, Human
ugacccgacuuuucuggcguu

SEQ ID NO: 1315441 - RNA, 21 nt, Human
ugagacaacaagacaacagaa

SEQ ID NO: 1315442 - RNA, 23 nt, Human
ugccuccaaaaauggcaaaaaga

SEQ ID NO: 1315443 - RNA, 18 nt, Human
uggauguccacaaucauc

SEQ ID NO: 1315444 - RNA, 18 nt, Human
uggggguguggagguggg

SEQ ID NO: 1315445 - RNA, 26 nt, Human
ugugcagcugggagucuaaaagacug

SEQ ID NO: 1315446 - RNA, 20 nt, Human
agaagaaggaacauggcucg

SEQ ID NO: 1315447 - RNA, 23 nt, Human
agugagaagcaccagaagaagga

SEQ ID NO: 1315448 - RNA, 23 nt, Human
cccaccaaguccagugagaagca

SEQ ID NO: 1315449 - RNA, 19 nt, Human
cccgacagcauucccccuu

SEQ ID NO: 1315450 - RNA, 20 nt, Human
ccugcucagucccgacagca

SEQ ID NO: 1315451 - RNA, 20 nt, Human
ugcucagucccgacagcauu

SEQ ID NO: 1315452 - RNA, 22 nt, Human
ugcucagucccgacagcauucc

SEQ ID NO: 1315453 - RNA, 22 nt, Human
uggcucgcugucuuagagcccu

SEQ ID NO: 1315454 - RNA, 23 nt, Human
aaccccgucucuacuacaaauac

SEQ ID NO: 1315455 - RNA, 20 nt, Human
aagauggugaaaccccgucu

SEQ ID NO: 1315456 - RNA, 21 nt, Human
aagauggugaaaccccgucuc

SEQ ID NO: 1315457 - RNA, 23 nt, Human
aggaguucaaaacuauccuggcc

SEQ ID NO: 1315458 - RNA, 24 nt, Human
caagauggugaaaccccgucucua

SEQ ID NO: 1315459 - RNA, 20 nt, Human
cacuuuauuaaaagcagggu

SEQ ID NO: 1315460 - RNA, 23 nt, Human
ccuggccaagauggugaaacccc

SEQ ID NO: 1315461 - RNA, 24 nt, Human
ccuggccaagauggugaaaccccg

SEQ ID NO: 1315462 - RNA, 19 nt, Human
gcaggguuuuggccgggcg

SEQ ID NO: 1315463 - RNA, 24 nt, Human
gccaagauggugaaaccccgucuc

SEQ ID NO: 1315464 - RNA, 18 nt, Human
ggccaagauggugaaacc

SEQ ID NO: 1315465 - RNA, 24 nt, Human
gggcgcgguggcucacgucugugg

SEQ ID NO: 1315466 - RNA, 22 nt, Human
uauccuggccaagauggugaaa

SEQ ID NO: 1315467 - RNA, 19 nt, Human
uuuauuaaaagcaggguuu

SEQ ID NO: 1315468 - RNA, 24 nt, Human
uuuggccgggcgcgguggcucacg

SEQ ID NO: 1315469 - RNA, 21 nt, Human
caccgaacuaccuccuuucgc

SEQ ID NO: 1315470 - RNA, 18 nt, Human
ccacuggcuccuucccuc

SEQ ID NO: 1315471 - RNA, 25 nt, Human
cccgcgagcaccuugccuuugagga

SEQ ID NO: 1315472 - RNA, 20 nt, Human
ccgaacuaccuccuuucgcc

SEQ ID NO: 1315473 - RNA, 22 nt, Human
ccgauguccacuggcuccuucc

SEQ ID NO: 1315474 - RNA, 21 nt, Human
cgagcaccuugccuuugagga

SEQ ID NO: 1315475 - RNA, 24 nt, Human
gcaccgaacuaccuccuuucgccu

SEQ ID NO: 1315476 - RNA, 18 nt, Human
uaacuugcaggcagcccc

SEQ ID NO: 1315477 - RNA, 18 nt, Human
uaauguauccgaugucca

SEQ ID NO: 1315478 - RNA, 24 nt, Human
uccaccgcaccgaacuaccuccuu

SEQ ID NO: 1315479 - RNA, 25 nt, Human
ucgccuacaaaacguagguggggac

SEQ ID NO: 1315480 - RNA, 20 nt, Human
ccaacuccccaacugcacac

SEQ ID NO: 1315481 - RNA, 19 nt, Human
ccuucucuccccaacuccc

SEQ ID NO: 1315482 - RNA, 23 nt, Human
ucugccuucucuccccaacuccc

SEQ ID NO: 1315483 - RNA, 18 nt, Human
ugcauggggggagugcca

SEQ ID NO: 1315484 - RNA, 24 nt, Human
aaagagcugggauuacagguguga

SEQ ID NO: 1315485 - RNA, 21 nt, Human
aagagcugggauuacaggugu

SEQ ID NO: 1315486 - RNA, 24 nt, Human
aagugauccgccugccucggccuc

SEQ ID NO: 1315487 - RNA, 23 nt, Human
accauguuggucaggcuggucuc

SEQ ID NO: 1315488 - RNA, 24 nt, Human
agagcugggauuacaggugugagc

SEQ ID NO: 1315489 - RNA, 21 nt, Human
aguagcugggauuacaggcau

SEQ ID NO: 1315490 - RNA, 20 nt, Human
agugcaguggugccaucuug

SEQ ID NO: 1315491 - RNA, 23 nt, Human
aguggugccaucuugacucacug

SEQ ID NO: 1315492 - RNA, 18 nt, Human
auggagugcaguggugcc

SEQ ID NO: 1315493 - RNA, 21 nt, Human
auggaguuucaccauguuggu

SEQ ID NO: 1315494 - RNA, 24 nt, Human
auggaguuucaccauguuggucag

SEQ ID NO: 1315495 - RNA, 19 nt, Human
augucauuuauuuauuuau

SEQ ID NO: 1315496 - RNA, 22 nt, Human
augucuaagccucccgaguagc

SEQ ID NO: 1315497 - RNA, 23 nt, Human
augucuaagccucccgaguagcu

SEQ ID NO: 1315498 - RNA, 22 nt, Human
auugcugugacaaauuucaaac

SEQ ID NO: 1315499 - RNA, 19 nt, Human
auuuauuugccugcaugau

SEQ ID NO: 1315500 - RNA, 24 nt, Human
auuuuuauauuuuuaguagagaug

SEQ ID NO: 1315501 - RNA, 24 nt, Human
caaagagcugggauuacaggugug

SEQ ID NO: 1315502 - RNA, 23 nt, Human
caaccuccaccuccuggguucaa

SEQ ID NO: 1315503 - RNA, 22 nt, Human
caagugauccgccugccucggc

SEQ ID NO: 1315504 - RNA, 20 nt, Human
caagugauucucaugucuaa

SEQ ID NO: 1315505 - RNA, 21 nt, Human
caccauguuggucaggcuggu

SEQ ID NO: 1315506 - RNA, 24 nt, Human
caccauguuggucaggcuggucuc

SEQ ID NO: 1315507 - RNA, 24 nt, Human
cacccaggauggagugcaguggug

SEQ ID NO: 1315508 - RNA, 21 nt, Human
cacugcaaccuccaccuccug

SEQ ID NO: 1315509 - RNA, 23 nt, Human
cacugcaaccuccaccuccuggg

SEQ ID NO: 1315510 - RNA, 25 nt, Human
caggauggagugcaguggugccauc

SEQ ID NO: 1315511 - RNA, 23 nt, Human
caugcaucaccaugcccggcuaa

SEQ ID NO: 1315512 - RNA, 20 nt, Human
ccaaagagcugggauuacag

SEQ ID NO: 1315513 - RNA, 21 nt, Human
ccaaagagcugggauuacagg

SEQ ID NO: 1315514 - RNA, 21 nt, Human
ccaaagagcugggauuacagg

SEQ ID NO: 1315515 - RNA, 24 nt, Human
ccaaagagcugggauuacaggugu

SEQ ID NO: 1315516 - RNA, 24 nt, Human
ccaccuccuggguucaagugauuc

SEQ ID NO: 1315517 - RNA, 18 nt, Human
ccccuuuucaaauuuuuc

SEQ ID NO: 1315518 - RNA, 23 nt, Human
cccgaguagcugggauuacaggc

SEQ ID NO: 1315519 - RNA, 24 nt, Human
cccgaguagcugggauuacaggca

SEQ ID NO: 1315520 - RNA, 23 nt, Human
ccgaguagcugggauuacaggca

SEQ ID NO: 1315521 - RNA, 24 nt, Human
ccgaguagcugggauuacaggcau

SEQ ID NO: 1315522 - RNA, 22 nt, Human
ccuccaccuccuggguucaagu

SEQ ID NO: 1315523 - RNA, 18 nt, Human
ccugaccucaagugaucc

SEQ ID NO: 1315524 - RNA, 21 nt, Human
ccugaccucaagugauccgcc

SEQ ID NO: 1315525 - RNA, 23 nt, Human
ccugaccucaagugauccgccug

SEQ ID NO: 1315526 - RNA, 23 nt, Human
ccuggguucaagugauucucaug

SEQ ID NO: 1315527 - RNA, 19 nt, Human
cggccuccaaagagcuggg

SEQ ID NO: 1315528 - RNA, 24 nt, Human
cuaagccucccgaguagcugggau

SEQ ID NO: 1315529 - RNA, 23 nt, Human
cucaagugauccgccugccucgg

SEQ ID NO: 1315530 - RNA, 24 nt, Human
cucacugcaaccuccaccuccugg

SEQ ID NO: 1315531 - RNA, 26 nt, Human
cucacugcaaccuccaccuccugggu

SEQ ID NO: 1315532 - RNA, 26 nt, Human
cuccugaccucaagugauccgccugc

SEQ ID NO: 1315533 - RNA, 20 nt, Human
cuccuggguucaagugauuc

SEQ ID NO: 1315534 - RNA, 21 nt, Human
cuccuggguucaagugauucu

SEQ ID NO: 1315535 - RNA, 18 nt, Human
cugcaacauuucucuucu

SEQ ID NO: 1315536 - RNA, 19 nt, Human
cugcaacauuucucuucuc

SEQ ID NO: 1315537 - RNA, 25 nt, Human
cugcaacauuucucuucuuuguuuu

SEQ ID NO: 1315538 - RNA, 18 nt, Human
cugcaaccuccaccuccu

SEQ ID NO: 1315539 - RNA, 23 nt, Human
cugcaaccuccaccuccuggguu

SEQ ID NO: 1315540 - RNA, 24 nt, Human
cugcaaccuccaccuccuggguuc

SEQ ID NO: 1315541 - RNA, 24 nt, Human
gaccucaagugauccgccugccuc

SEQ ID NO: 1315542 - RNA, 24 nt, Human
gagauggaguuucaccauguuggu

SEQ ID NO: 1315543 - RNA, 24 nt, Human
gaguagcugggauuacaggcaugc

SEQ ID NO: 1315544 - RNA, 22 nt, Human
gauuacaggcaugcaucaccau

SEQ ID NO: 1315545 - RNA, 18 nt, Human
gauuacaggugugagcca

SEQ ID NO: 1315546 - RNA, 22 nt, Human
gauuacaggugugagccacagc

SEQ ID NO: 1315547 - RNA, 20 nt, Human
gccucggccuccaaagagcu

SEQ ID NO: 1315548 - RNA, 19 nt, Human
gcucugucacccaggaugg

SEQ ID NO: 1315549 - RNA, 23 nt, Human
gcuggucucaaacuccugaccuc

SEQ ID NO: 1315550 - RNA, 22 nt, Human
ggaguuucaccauguuggucag

SEQ ID NO: 1315551 - RNA, 24 nt, Human
ggauuacaggcaugcaucaccaug

SEQ ID NO: 1315552 - RNA, 24 nt, Human
ggcuggucucaaacuccugaccuc

SEQ ID NO: 1315553 - RNA, 20 nt, Human
guagcugggauuacaggcau

SEQ ID NO: 1315554 - RNA, 24 nt, Human
uaauuuuuauauuuuuaguagaga

SEQ ID NO: 1315555 - RNA, 23 nt, Human
uacaggcaugcaucaccaugccc

SEQ ID NO: 1315556 - RNA, 23 nt, Human
uacaggugugagccacagcgucu

SEQ ID NO: 1315557 - RNA, 22 nt, Human
uacuuuugcuucuuauuccuug

SEQ ID NO: 1315558 - RNA, 22 nt, Human
uagagauggaguuucaccaugu

SEQ ID NO: 1315559 - RNA, 24 nt, Human
uaguagagauggaguuucaccaug

SEQ ID NO: 1315560 - RNA, 26 nt, Human
uaguagagauggaguuucaccauguu

SEQ ID NO: 1315561 - RNA, 29 nt, Human
ucaaacauuccaauuauuacagucacuaa

SEQ ID NO: 1315562 - RNA, 22 nt, Human
ucaaauacuacuuuugcuucuu

SEQ ID NO: 1315563 - RNA, 21 nt, Human
ucaagugauccgccugccucg

SEQ ID NO: 1315564 - RNA, 23 nt, Human
ucacugcaaccuccaccuccugg

SEQ ID NO: 1315565 - RNA, 24 nt, Human
ucacugcaaccuccaccuccuggg

SEQ ID NO: 1315566 - RNA, 25 nt, Human
ucacugcaaccuccaccuccugggu

SEQ ID NO: 1315567 - RNA, 27 nt, Human
ucacugcaaccuccaccuccuggguuc

SEQ ID NO: 1315568 - RNA, 22 nt, Human
uccaaagagcugggauuacagg

SEQ ID NO: 1315569 - RNA, 24 nt, Human
uccaaagagcugggauuacaggug

SEQ ID NO: 1315570 - RNA, 24 nt, Human
ucccgaguagcugggauuacaggc

SEQ ID NO: 1315571 - RNA, 21 nt, Human
uccuggguucaagugauucuc

SEQ ID NO: 1315572 - RNA, 24 nt, Human
uccuggguucaagugauucucaug

SEQ ID NO: 1315573 - RNA, 24 nt, Human
ucugucacccaggauggagugcag

SEQ ID NO: 1315574 - RNA, 20 nt, Human
ucuugcucugucacccagga

SEQ ID NO: 1315575 - RNA, 24 nt, Human
ucuugcucugucacccaggaugga

SEQ ID NO: 1315576 - RNA, 18 nt, Human
ugaccucaagugauccgc

SEQ ID NO: 1315577 - RNA, 24 nt, Human
ugaccucaagugauccgccugccu

SEQ ID NO: 1315578 - RNA, 19 nt, Human
ugauaaagcaaacauggua

SEQ ID NO: 1315579 - RNA, 24 nt, Human
ugcccggcuaauuuuuauauuuuu

SEQ ID NO: 1315580 - RNA, 24 nt, Human
ugcucugucacccaggauggagug

SEQ ID NO: 1315581 - RNA, 18 nt, Human
uggagugcaguggugcca

SEQ ID NO: 1315582 - RNA, 28 nt, Human
uggagugcaguggugccauccuagcacg

SEQ ID NO: 1315583 - RNA, 23 nt, Human
uggagugcaguggugccaucuug

SEQ ID NO: 1315584 - RNA, 28 nt, Human
uggagugcaguggugccauggcucuagc

SEQ ID NO: 1315585 - RNA, 24 nt, Human
uggaguuucaccauguuggucagg

SEQ ID NO: 1315586 - RNA, 21 nt, Human
ugggauuacaggcaugcauca

SEQ ID NO: 1315587 - RNA, 24 nt, Human
ugggauuacaggcaugcaucacca

SEQ ID NO: 1315588 - RNA, 18 nt, Human
ugggauuacaggugugag

SEQ ID NO: 1315589 - RNA, 19 nt, Human
ugggauuacaggugugagc

SEQ ID NO: 1315590 - RNA, 21 nt, Human
ugggauuacaggugugagcca

SEQ ID NO: 1315591 - RNA, 22 nt, Human
ugggauuacaggugugagccac

SEQ ID NO: 1315592 - RNA, 22 nt, Human
ugggauuacaggugugagccac

SEQ ID NO: 1315593 - RNA, 23 nt, Human
ugggauuacaggugugagccaca

SEQ ID NO: 1315594 - RNA, 24 nt, Human
ugggauuacaggugugagccacag

SEQ ID NO: 1315595 - RNA, 27 nt, Human
ugggauuacaggugugagccacagcgu

SEQ ID NO: 1315596 - RNA, 23 nt, Human
uggguucaagugauucucauguc

SEQ ID NO: 1315597 - RNA, 24 nt, Human
uggguucaagugauucucaugucu

SEQ ID NO: 1315598 - RNA, 24 nt, Human
uggucaggcuggucucaaacuccu

SEQ ID NO: 1315599 - RNA, 21 nt, Human
ugucacccaggauggagugca

SEQ ID NO: 1315600 - RNA, 18 nt, Human
uuaguagagauggaguuu

SEQ ID NO: 1315601 - RNA, 24 nt, Human
uuaguagagauggaguuucaccau

SEQ ID NO: 1315602 - RNA, 24 nt, Human
uuucaccauguuggucaggcuggu

SEQ ID NO: 1315603 - RNA, 26 nt, Human
uuucuuauuuauuuauuuauuuuuug

SEQ ID NO: 1315604 - RNA, 24 nt, Human
uuuuuaguagagauggaguuucac

SEQ ID NO: 1315605 - RNA, 20 nt, Human
uuuuuauauuuuuaguagag

SEQ ID NO: 1315606 - RNA, 24 nt, Human
aaacggccacacccuuucuagagc

SEQ ID NO: 1315607 - RNA, 18 nt, Human
accaccaacuccucagca

SEQ ID NO: 1315608 - RNA, 19 nt, Human
aggaaugugaggaaaacag

SEQ ID NO: 1315609 - RNA, 18 nt, Human
caacuccucagcaccucc

SEQ ID NO: 1315610 - RNA, 19 nt, Human
caacuccucagcaccuccu

SEQ ID NO: 1315611 - RNA, 26 nt, Human
cagccaauguaaaacggccacacccu

SEQ ID NO: 1315612 - RNA, 20 nt, Human
gaaugugaggaaaacagcca

SEQ ID NO: 1315613 - RNA, 27 nt, Human
uaaaacggccacacccuuucuagagcc

SEQ ID NO: 1315614 - RNA, 25 nt, Human
ucccuugucugcugcuaccaccaac

SEQ ID NO: 1315615 - RNA, 22 nt, Human
uccuuucagcuucaacuucagc

SEQ ID NO: 1315616 - RNA, 24 nt, Human
ugaggaaugugaggaaaacagcca

SEQ ID NO: 1315617 - RNA, 18 nt, Human
ugauucuauccauuucuc

SEQ ID NO: 1315618 - RNA, 21 nt, Human
ugauucuauccauuucuccuc

SEQ ID NO: 1315619 - RNA, 18 nt, Human
ugcuugaggaaugugagg

SEQ ID NO: 1315620 - RNA, 19 nt, Human
uucucuaugaauccuuuca

SEQ ID NO: 1315621 - RNA, 27 nt, Human
uugacaauaaccaugauucuauccauu

SEQ ID NO: 1315622 - RNA, 22 nt, Human
acuccaguggucuggagguaag

SEQ ID NO: 1315623 - RNA, 21 nt, Human
acuccuccccuucucucuccc

SEQ ID NO: 1315624 - RNA, 21 nt, Human
agccauggcucuagggcaagu

SEQ ID NO: 1315625 - RNA, 21 nt, Human
agcccucggcgguggcggcgg

SEQ ID NO: 1315626 - RNA, 18 nt, Human
cauggcucuagggcaagu

SEQ ID NO: 1315627 - RNA, 24 nt, Human
cccacucauuacugccuggucucc

SEQ ID NO: 1315628 - RNA, 20 nt, Human
cccuacuccuccccuucucu

SEQ ID NO: 1315629 - RNA, 20 nt, Human
cccucccacccuacuccucc

SEQ ID NO: 1315630 - RNA, 18 nt, Human
cccucggcgguggcggcg

SEQ ID NO: 1315631 - RNA, 23 nt, Human
ccgcggcggugguggcuccgggc

SEQ ID NO: 1315632 - RNA, 24 nt, Human
ccggcaggggcgugugccccuucu

SEQ ID NO: 1315633 - RNA, 18 nt, Human
ccucccacccuacuccuc

SEQ ID NO: 1315634 - RNA, 20 nt, Human
ccuccccuucucucucccca

SEQ ID NO: 1315635 - RNA, 21 nt, Human
cggcgagcuccagcccucggc

SEQ ID NO: 1315636 - RNA, 19 nt, Human
cuacuccuccccuucucuc

SEQ ID NO: 1315637 - RNA, 21 nt, Human
cuccccuucucucuccccacu

SEQ ID NO: 1315638 - RNA, 18 nt, Human
cuccgggcuggggucgcc

SEQ ID NO: 1315639 - RNA, 21 nt, Human
cucggcgguggcggcggccgu

SEQ ID NO: 1315640 - RNA, 19 nt, Human
cugcgggccgugggggaug

SEQ ID NO: 1315641 - RNA, 18 nt, Human
gccgugggggaugggggc

SEQ ID NO: 1315642 - RNA, 18 nt, Human
gccguggugagugugagg

SEQ ID NO: 1315643 - RNA, 21 nt, Human
gcggcggugguggcuccgggc

SEQ ID NO: 1315644 - RNA, 18 nt, Human
gcggugguggcuccgggc

SEQ ID NO: 1315645 - RNA, 22 nt, Human
gcggugguggcuccgggcuggg

SEQ ID NO: 1315646 - RNA, 20 nt, Human
ggcggugguggcuccgggcu

SEQ ID NO: 1315647 - RNA, 21 nt, Human
ggcggugguggcuccgggcug

SEQ ID NO: 1315648 - RNA, 18 nt, Human
ggggaugggggcggcgag

SEQ ID NO: 1315649 - RNA, 24 nt, Human
ggucucgcccuuccaccuuuuccc

SEQ ID NO: 1315650 - RNA, 20 nt, Human
gucucugucguucccuccca

SEQ ID NO: 1315651 - RNA, 23 nt, Human
gugccccuucuggagcgucucug

SEQ ID NO: 1315652 - RNA, 19 nt, Human
guggcuccgggcugggguc

SEQ ID NO: 1315653 - RNA, 21 nt, Human
guggcuccgggcuggggucgc

SEQ ID NO: 1315654 - RNA, 19 nt, Human
uccaggguccggcaggggc

SEQ ID NO: 1315655 - RNA, 19 nt, Human
ucccacccuacuccucccc

SEQ ID NO: 1315656 - RNA, 22 nt, Human
uccccuucucucuccccacuca

SEQ ID NO: 1315657 - RNA, 24 nt, Human
ucggccgcggcggugguggcuccu

SEQ ID NO: 1315658 - RNA, 23 nt, Human
ucggcgguggcggcggccguagg

SEQ ID NO: 1315659 - RNA, 22 nt, Human
ugccccuucuggagcgucucug

SEQ ID NO: 1315660 - RNA, 26 nt, Human
ugccccuucuggagcgucucugucgu

SEQ ID NO: 1315661 - RNA, 19 nt, Human
ugccuggucucgcccuucc

SEQ ID NO: 1315662 - RNA, 21 nt, Human
uggcggcggccguaggugugg

SEQ ID NO: 1315663 - RNA, 21 nt, Human
ugguggcuccgggcugggguc

SEQ ID NO: 1315664 - RNA, 20 nt, Human
uuucccagccauggcucuag

SEQ ID NO: 1315665 - RNA, 19 nt, Human
cugcuguuuuuaucugucu

SEQ ID NO: 1315666 - RNA, 20 nt, Human
uacacugagcucuaugggau

SEQ ID NO: 1315667 - RNA, 25 nt, Human
caagaggaaaucuguccacacagug

SEQ ID NO: 1315668 - RNA, 21 nt, Human
caccuggaauccauugggcuc

SEQ ID NO: 1315669 - RNA, 21 nt, Human
gaugaaaugucuuugcugugg

SEQ ID NO: 1315670 - RNA, 23 nt, Human
ggaaacaaagguggugguggugg

SEQ ID NO: 1315671 - RNA, 23 nt, Human
uccacacagugggcugaugaaau

SEQ ID NO: 1315672 - RNA, 21 nt, Human
ugaugaaaugucuuugcugug

SEQ ID NO: 1315673 - RNA, 20 nt, Human
uuacauuuuagaacaccugg

SEQ ID NO: 1315674 - RNA, 26 nt, Human
aacacaacuuuuccuaaugauaucag

SEQ ID NO: 1315675 - RNA, 20 nt, Human
aagccaaagccaacacaacu

SEQ ID NO: 1315676 - RNA, 18 nt, Human
auucucagaauaaccugg

SEQ ID NO: 1315677 - RNA, 26 nt, Human
caaagaguugcaagccaaagccaaca

SEQ ID NO: 1315678 - RNA, 28 nt, Human
caagccaaagccaacacaacuuuuccua

SEQ ID NO: 1315679 - RNA, 21 nt, Human
cagagauucucauuggguggg

SEQ ID NO: 1315680 - RNA, 23 nt, Human
ccaaagaguugcaagccaaagcc

SEQ ID NO: 1315681 - RNA, 18 nt, Human
cucgcugaauuccugcca

SEQ ID NO: 1315682 - RNA, 23 nt, Human
cuguaaauucucucgcugaauuc

SEQ ID NO: 1315683 - RNA, 22 nt, Human
cuugcugacaugaaagaauaaa

SEQ ID NO: 1315684 - RNA, 24 nt, Human
cuuucuguaaauucucucgcugaa

SEQ ID NO: 1315685 - RNA, 18 nt, Human
uacacugacacuacugcc

SEQ ID NO: 1315686 - RNA, 23 nt, Human
ucgcugaauuccugccaaagagu

SEQ ID NO: 1315687 - RNA, 22 nt, Human
ucucagaauaaccuggagcuuu

SEQ ID NO: 1315688 - RNA, 22 nt, Human
ugccaaagaguugcaagccaag

SEQ ID NO: 1315689 - RNA, 21 nt, Human
ugcgugcuuuuuuagcaaaua

SEQ ID NO: 1315690 - RNA, 21 nt, Human
uucagcuguagugcaauuugc

SEQ ID NO: 1315691 - RNA, 21 nt, Human
uuucacagguacucauuuaau

SEQ ID NO: 1315692 - RNA, 22 nt, Human
aaagaaagaagccccuaaacaa

SEQ ID NO: 1315693 - RNA, 20 nt, Human
aaagugcugggauuauaggc

SEQ ID NO: 1315694 - RNA, 23 nt, Human
aaagugcugggauuauaggcgua

SEQ ID NO: 1315695 - RNA, 23 nt, Human
aaauuaccgaagaugcccgaagc

SEQ ID NO: 1315696 - RNA, 19 nt, Human
aagaaagaagccccuaaac

SEQ ID NO: 1315697 - RNA, 20 nt, Human
aagaagccccuaaacaauua

SEQ ID NO: 1315698 - RNA, 22 nt, Human
aagccccuaaacaauuaauauu

SEQ ID NO: 1315699 - RNA, 24 nt, Human
aagugauccgcccgccucggccuc

SEQ ID NO: 1315700 - RNA, 19 nt, Human
aagugcugggauuauaggc

SEQ ID NO: 1315701 - RNA, 19 nt, Human
aagugcugggauuauaggc

SEQ ID NO: 1315702 - RNA, 26 nt, Human
aagugcugggauuauaggcguaagcc

SEQ ID NO: 1315703 - RNA, 24 nt, Human
aauuuguuuguauuuuuaguagag

SEQ ID NO: 1315704 - RNA, 18 nt, Human
accagccccccgccccuc

SEQ ID NO: 1315705 - RNA, 24 nt, Human
acccaggcuguagugcaauggcgu

SEQ ID NO: 1315706 - RNA, 19 nt, Human
accgaccugaaggccgcac

SEQ ID NO: 1315707 - RNA, 23 nt, Human
acgccaccacgcccggcuaauuu

SEQ ID NO: 1315708 - RNA, 18 nt, Human
acgggguuucaccauauu

SEQ ID NO: 1315709 - RNA, 20 nt, Human
acgggguuucaccauauugg

SEQ ID NO: 1315710 - RNA, 24 nt, Human
acgggguuucaccauauuggccag

SEQ ID NO: 1315711 - RNA, 19 nt, Human
acguucgaagggcguuggc

SEQ ID NO: 1315712 - RNA, 23 nt, Human
acuggucuccaacuccugaccuc

SEQ ID NO: 1315713 - RNA, 26 nt, Human
agaacuuucccagaaucuugccacau

SEQ ID NO: 1315714 - RNA, 21 nt, Human
agcagcgaggccuagccaaga

SEQ ID NO: 1315715 - RNA, 18 nt, Human
agccccccgccccucccc

SEQ ID NO: 1315716 - RNA, 24 nt, Human
agcgauucuccugccucagccucc

SEQ ID NO: 1315717 - RNA, 20 nt, Human
aggcguaagccaccgcgccc

SEQ ID NO: 1315718 - RNA, 20 nt, Human
aggcguacgccaccacgccc

SEQ ID NO: 1315719 - RNA, 22 nt, Human
aguagagacgggguuucaccau

SEQ ID NO: 1315720 - RNA, 19 nt, Human
aguagcugggacuauaggc

SEQ ID NO: 1315721 - RNA, 19 nt, Human
agugcaauggcgugaucuc

SEQ ID NO: 1315722 - RNA, 24 nt, Human
auuuguuuguauuuuuaguagaga

SEQ ID NO: 1315723 - RNA, 24 nt, Human
caaagugcugggauuauaggcgua

SEQ ID NO: 1315724 - RNA, 20 nt, Human
caagcgauucuccugccuca

SEQ ID NO: 1315725 - RNA, 22 nt, Human
caagcgauucuccugccucagc

SEQ ID NO: 1315726 - RNA, 21 nt, Human
caccauauuggccagacuggu

SEQ ID NO: 1315727 - RNA, 24 nt, Human
caccauauuggccagacuggucuc

SEQ ID NO: 1315728 - RNA, 27 nt, Human
caccauauuggccagacuggucuccaa

SEQ ID NO: 1315729 - RNA, 18 nt, Human
cagccccccgccccuccc

SEQ ID NO: 1315730 - RNA, 24 nt, Human
cauauuggccagacuggucuccaa

SEQ ID NO: 1315731 - RNA, 22 nt, Human
ccaaagugcugggauuauaggc

SEQ ID NO: 1315732 - RNA, 24 nt, Human
ccaaagugcugggauuauaggcgu

SEQ ID NO: 1315733 - RNA, 20 nt, Human
ccagacuggucuccaacucc

SEQ ID NO: 1315734 - RNA, 18 nt, Human
ccccccgccccuccccaa

SEQ ID NO: 1315735 - RNA, 23 nt, Human
ccccccgccccuccccaaaaaaa

SEQ ID NO: 1315736 - RNA, 21 nt, Human
ccccuccccaaaaaaagccua

SEQ ID NO: 1315737 - RNA, 19 nt, Human
cccgaguagcugggacuau

SEQ ID NO: 1315738 - RNA, 24 nt, Human
cccgaguagcugggacuauaggcg

SEQ ID NO: 1315739 - RNA, 20 nt, Human
ccgcaccagccccccgcccc

SEQ ID NO: 1315740 - RNA, 18 nt, Human
ccgccagcgcgagccucu

SEQ ID NO: 1315741 - RNA, 21 nt, Human
ccgccccuccccaaaaaaagc

SEQ ID NO: 1315742 - RNA, 18 nt, Human
ccugaccucaagugaucc

SEQ ID NO: 1315743 - RNA, 19 nt, Human
ccugaccucaagugauccg

SEQ ID NO: 1315744 - RNA, 22 nt, Human
ccugaccucaagugauccgccc

SEQ ID NO: 1315745 - RNA, 23 nt, Human
ccugccucagccucccgaguagc

SEQ ID NO: 1315746 - RNA, 23 nt, Human
ccuggguucaagcgauucuccug

SEQ ID NO: 1315747 - RNA, 18 nt, Human
cgcaguauccgggcucgg

SEQ ID NO: 1315748 - RNA, 24 nt, Human
cgccucggccucccaaagugcugg

SEQ ID NO: 1315749 - RNA, 22 nt, Human
cggagcaaggaagaacuuuccc

SEQ ID NO: 1315750 - RNA, 20 nt, Human
cggcguugcuggggugucgg

SEQ ID NO: 1315751 - RNA, 23 nt, Human
cgggguuucaccauauuggccag

SEQ ID NO: 1315752 - RNA, 18 nt, Human
cucaaacucaaguucagc

SEQ ID NO: 1315753 - RNA, 24 nt, Human
cucagccucccgaguagcugggac

SEQ ID NO: 1315754 - RNA, 19 nt, Human
cuccccaaaaaaagccuaa

SEQ ID NO: 1315755 - RNA, 26 nt, Human
cuccugaccucaagugauccgcccgc

SEQ ID NO: 1315756 - RNA, 29 nt, Human
cucugucacccaggcuguagugcaauggg

SEQ ID NO: 1315757 - RNA, 23 nt, Human
cugccucagccucccgaguagcu

SEQ ID NO: 1315758 - RNA, 24 nt, Human
cugcgggugaccgaccugaaggcc

SEQ ID NO: 1315759 - RNA, 23 nt, Human
cuggacgggaagccucuucaggc

SEQ ID NO: 1315760 - RNA, 24 nt, Human
cuuccuggguucaagcgauucucc

SEQ ID NO: 1315761 - RNA, 22 nt, Human
gaagccucuucaggcgcugcgg

SEQ ID NO: 1315762 - RNA, 24 nt, Human
gaccucaagugauccgcccgccuc

SEQ ID NO: 1315763 - RNA, 18 nt, Human
gacucuggacgggaagcc

SEQ ID NO: 1315764 - RNA, 21 nt, Human
gagacggagucuugcucuguc

SEQ ID NO: 1315765 - RNA, 24 nt, Human
gagacgggguuucaccauauuggc

SEQ ID NO: 1315766 - RNA, 21 nt, Human
gaggccuagccaagagcgggc

SEQ ID NO: 1315767 - RNA, 22 nt, Human
gaugcuucuugcgcacccccac

SEQ ID NO: 1315768 - RNA, 18 nt, Human
gauuauaggcguaagcca

SEQ ID NO: 1315769 - RNA, 22 nt, Human
gauuauaggcguaagccaccgc

SEQ ID NO: 1315770 - RNA, 19 nt, Human
gcaacggaaagaucagcca

SEQ ID NO: 1315771 - RNA, 21 nt, Human
gcaaggaagaacuuucccaga

SEQ ID NO: 1315772 - RNA, 24 nt, Human
gcgauucuccugccucagccuccc

SEQ ID NO: 1315773 - RNA, 21 nt, Human
gcgcacggugguugaugaggu

SEQ ID NO: 1315774 - RNA, 21 nt, Human
gcguuggcggaaauuaccgaa

SEQ ID NO: 1315775 - RNA, 24 nt, Human
gcucaggccgccagcgcgagccuc

SEQ ID NO: 1315776 - RNA, 19 nt, Human
ggacuauaggcguacgcca

SEQ ID NO: 1315777 - RNA, 22 nt, Human
ggauuauaggcguaagccaccg

SEQ ID NO: 1315778 - RNA, 18 nt, Human
guagugacaaagaaagaa

SEQ ID NO: 1315779 - RNA, 24 nt, Human
gugauccgcccgccucggccuccc

SEQ ID NO: 1315780 - RNA, 24 nt, Human
uaacggcagcagcgcgagcccaaa

SEQ ID NO: 1315781 - RNA, 21 nt, Human
uaacguaucucuuaaaucucu

SEQ ID NO: 1315782 - RNA, 18 nt, Human
uacaggaagcaguuccuc

SEQ ID NO: 1315783 - RNA, 24 nt, Human
uacuguuuguguuucuucugcauc

SEQ ID NO: 1315784 - RNA, 21 nt, Human
uagccaagagcgggcagaaga

SEQ ID NO: 1315785 - RNA, 23 nt, Human
uaguagagacgggguuucaccau

SEQ ID NO: 1315786 - RNA, 25 nt, Human
uaguagagacgggguuucaccauau

SEQ ID NO: 1315787 - RNA, 19 nt, Human
ucaagcgauucuccugccu

SEQ ID NO: 1315788 - RNA, 23 nt, Human
ucagccucccgaguagcugggac

SEQ ID NO: 1315789 - RNA, 24 nt, Human
uccaaggcaaacucaaacucaagu

SEQ ID NO: 1315790 - RNA, 24 nt, Human
ucccaaagugcugggauuauaggc

SEQ ID NO: 1315791 - RNA, 24 nt, Human
ucccgaguagcugggacuauaggc

SEQ ID NO: 1315792 - RNA, 23 nt, Human
uccgcaccagccccccgccccuc

SEQ ID NO: 1315793 - RNA, 20 nt, Human
uccuggguucaagcgauucu

SEQ ID NO: 1315794 - RNA, 21 nt, Human
uccuggguucaagcgauucuc

SEQ ID NO: 1315795 - RNA, 24 nt, Human
uccuggguucaagcgauucuccug

SEQ ID NO: 1315796 - RNA, 18 nt, Human
ucggccucccaaagugcu

SEQ ID NO: 1315797 - RNA, 24 nt, Human
ucuccugccucagccucccgagua

SEQ ID NO: 1315798 - RNA, 24 nt, Human
ucugucacccaggcuguagugcaa

SEQ ID NO: 1315799 - RNA, 19 nt, Human
ucuugcucugucacccagg

SEQ ID NO: 1315800 - RNA, 22 nt, Human
ucuugcucugucacccaggcug

SEQ ID NO: 1315801 - RNA, 27 nt, Human
ucuugcucugucacccaggcuguagug

SEQ ID NO: 1315802 - RNA, 19 nt, Human
ugaaggccgcacuggagca

SEQ ID NO: 1315803 - RNA, 20 nt, Human
ugaaugcaacggaaagauca

SEQ ID NO: 1315804 - RNA, 21 nt, Human
ugaccuauuuuacuguuugug

SEQ ID NO: 1315805 - RNA, 18 nt, Human
ugaccucaagugauccgc

SEQ ID NO: 1315806 - RNA, 24 nt, Human
ugaccucaagugauccgcccgccu

SEQ ID NO: 1315807 - RNA, 21 nt, Human
ugaggagucggcguugcuggg

SEQ ID NO: 1315808 - RNA, 21 nt, Human
ugcacuacucuccaggagugu

SEQ ID NO: 1315809 - RNA, 21 nt, Human
ugcccgaagccgucgggacgg

SEQ ID NO: 1315810 - RNA, 24 nt, Human
ugccucagccucccgaguagcugg

SEQ ID NO: 1315811 - RNA, 24 nt, Human
ugcucugucacccaggcuguagug

SEQ ID NO: 1315812 - RNA, 24 nt, Human
uggccagacuggucuccaacuccu

SEQ ID NO: 1315813 - RNA, 18 nt, Human
uggcuuccaaggcaaacu

SEQ ID NO: 1315814 - RNA, 22 nt, Human
ugggacuauaggcguacgccac

SEQ ID NO: 1315815 - RNA, 24 nt, Human
ugggacuauaggcguacgccacca

SEQ ID NO: 1315816 - RNA, 18 nt, Human
ugggauuauaggcguaag

SEQ ID NO: 1315817 - RNA, 19 nt, Human
ugggauuauaggcguaagc

SEQ ID NO: 1315818 - RNA, 21 nt, Human
ugggauuauaggcguaagcca

SEQ ID NO: 1315819 - RNA, 22 nt, Human
ugggauuauaggcguaagccac

SEQ ID NO: 1315820 - RNA, 23 nt, Human
ugggauuauaggcguaagccacc

SEQ ID NO: 1315821 - RNA, 24 nt, Human
ugggauuauaggcguaagccaccg

SEQ ID NO: 1315822 - RNA, 23 nt, Human
uggguucaagcgauucuccugcc

SEQ ID NO: 1315823 - RNA, 24 nt, Human
uggguucaagcgauucuccugccu

SEQ ID NO: 1315824 - RNA, 19 nt, Human
uguagugcaauggcgugau

SEQ ID NO: 1315825 - RNA, 23 nt, Human
uguagugcaauggcgugaucuca

SEQ ID NO: 1315826 - RNA, 18 nt, Human
uuaguagagacgggguuu

SEQ ID NO: 1315827 - RNA, 22 nt, Human
uuaguagagacgggguuucacc

SEQ ID NO: 1315828 - RNA, 24 nt, Human
uuaguagagacgggguuucaccau

SEQ ID NO: 1315829 - RNA, 21 nt, Human
uucaagcgauucuccugccuc

SEQ ID NO: 1315830 - RNA, 23 nt, Human
uucaagcgauucuccugccucag

SEQ ID NO: 1315831 - RNA, 24 nt, Human
uucaagcgauucuccugccucagc

SEQ ID NO: 1315832 - RNA, 20 nt, Human
uucagggcgcuugcauuuuc

SEQ ID NO: 1315833 - RNA, 22 nt, Human
uugccacugauuuugcaucaug

SEQ ID NO: 1315834 - RNA, 23 nt, Human
uuguauuuuuaguagagacgggg

SEQ ID NO: 1315835 - RNA, 21 nt, Human
uuucaccauauuggccagacu

SEQ ID NO: 1315836 - RNA, 19 nt, Human
uuuguauuuuuaguagaga

SEQ ID NO: 1315837 - RNA, 20 nt, Human
uuuguauuuuuaguagagac

SEQ ID NO: 1315838 - RNA, 24 nt, Human
uuuuuaguagagacgggguuucac

SEQ ID NO: 1315839 - RNA, 19 nt, Human
aaagguagcagucauuaaa

SEQ ID NO: 1315840 - RNA, 20 nt, Human
aaugguaccagcgaggggcc

SEQ ID NO: 1315841 - RNA, 21 nt, Human
agaucccuggccccacaacag

SEQ ID NO: 1315842 - RNA, 24 nt, Human
agaucccuggccccacaacagcuc

SEQ ID NO: 1315843 - RNA, 23 nt, Human
agcccagcccacugccaguacag

SEQ ID NO: 1315844 - RNA, 21 nt, Human
agcgagggugauugggucgag

SEQ ID NO: 1315845 - RNA, 24 nt, Human
auggaaauagcaccugccagugcc

SEQ ID NO: 1315846 - RNA, 21 nt, Human
augucacuguggcugaggcug

SEQ ID NO: 1315847 - RNA, 21 nt, Human
caacagcuccucugcagcgcu

SEQ ID NO: 1315848 - RNA, 23 nt, Human
caacucgcacauacaggagaaaa

SEQ ID NO: 1315849 - RNA, 20 nt, Human
cacauaugcacaguaaacac

SEQ ID NO: 1315850 - RNA, 20 nt, Human
cacugcuagaacagccugga

SEQ ID NO: 1315851 - RNA, 19 nt, Human
cagccaggggacuuccaca

SEQ ID NO: 1315852 - RNA, 22 nt, Human
cagcuagcccuucuugcuguuc

SEQ ID NO: 1315853 - RNA, 24 nt, Human
cagcuuccucccucugcagugucu

SEQ ID NO: 1315854 - RNA, 23 nt, Human
caguguuuuggaccccaggccca

SEQ ID NO: 1315855 - RNA, 27 nt, Human
ccagcagucucgcuugggcagcuuccu

SEQ ID NO: 1315856 - RNA, 20 nt, Human
cccacauguggucaccaagc

SEQ ID NO: 1315857 - RNA, 18 nt, Human
ccccacagucugucuucu

SEQ ID NO: 1315858 - RNA, 22 nt, Human
ccccagagaguguccuggaggc

SEQ ID NO: 1315859 - RNA, 23 nt, Human
ccccaggcccaucuggcuggacc

SEQ ID NO: 1315860 - RNA, 25 nt, Human
ccccaggcccaucuggcuggaccag

SEQ ID NO: 1315861 - RNA, 22 nt, Human
cccucucaucccuucucccuca

SEQ ID NO: 1315862 - RNA, 20 nt, Human
cccucugcagugucucccca

SEQ ID NO: 1315863 - RNA, 20 nt, Human
cccuucucccucaggauccc

SEQ ID NO: 1315864 - RNA, 20 nt, Human
ccucccagugcgaggacaga

SEQ ID NO: 1315865 - RNA, 21 nt, Human
ccucucaucccuucucccuca

SEQ ID NO: 1315866 - RNA, 24 nt, Human
ccuggccccacaacagcuccucug

SEQ ID NO: 1315867 - RNA, 21 nt, Human
ccuucuugcuguuccuucccc

SEQ ID NO: 1315868 - RNA, 25 nt, Human
ccuucuugcuguuccuuccccagag

SEQ ID NO: 1315869 - RNA, 26 nt, Human
cgccaaagccuccaguacugcuucag

SEQ ID NO: 1315870 - RNA, 20 nt, Human
cuagugguaauugaugggcc

SEQ ID NO: 1315871 - RNA, 27 nt, Human
cucaucccuucucccucaggaucccaa

SEQ ID NO: 1315872 - RNA, 19 nt, Human
cuccuccaugauacacuuc

SEQ ID NO: 1315873 - RNA, 26 nt, Human
cuccucugcagcuucccuguggccua

SEQ ID NO: 1315874 - RNA, 20 nt, Human
cucgccaaagccuccaguac

SEQ ID NO: 1315875 - RNA, 21 nt, Human
cucucagcucaggagucucau

SEQ ID NO: 1315876 - RNA, 18 nt, Human
cugaggcuggggcuggug

SEQ ID NO: 1315877 - RNA, 21 nt, Human
cuggccccacaacagcuccuc

SEQ ID NO: 1315878 - RNA, 22 nt, Human
gagaguguccuggaggcccagc

SEQ ID NO: 1315879 - RNA, 26 nt, Human
gagccagucccacauguggucaccaa

SEQ ID NO: 1315880 - RNA, 25 nt, Human
gcuaagggcuuguacaugcggcagc

SEQ ID NO: 1315881 - RNA, 22 nt, Human
gcucgggaucccccucucaucc

SEQ ID NO: 1315882 - RNA, 19 nt, Human
gcuggggcuggugagaugu

SEQ ID NO: 1315883 - RNA, 18 nt, Human
ggccauggaaauagcacc

SEQ ID NO: 1315884 - RNA, 21 nt, Human
ggccugucuucugaguccagc

SEQ ID NO: 1315885 - RNA, 20 nt, Human
gugccgccuuugcucgccaa

SEQ ID NO: 1315886 - RNA, 21 nt, Human
uacaggagaaaaucaguguuu

SEQ ID NO: 1315887 - RNA, 18 nt, Human
uagcaccugccagugccg

SEQ ID NO: 1315888 - RNA, 19 nt, Human
uagcaccugccagugccgc

SEQ ID NO: 1315889 - RNA, 23 nt, Human
ucaggagucucauucugcucccc

SEQ ID NO: 1315890 - RNA, 24 nt, Human
ucaucccuucucccucaggauccc

SEQ ID NO: 1315891 - RNA, 24 nt, Human
uccccagacagcguggcaauacug

SEQ ID NO: 1315892 - RNA, 21 nt, Human
ucccuggccccacaacagcuc

SEQ ID NO: 1315893 - RNA, 26 nt, Human
ucccuguggccuaagauccugucucu

SEQ ID NO: 1315894 - RNA, 21 nt, Human
ucucgacucagaagcaggggu

SEQ ID NO: 1315895 - RNA, 24 nt, Human
ucugcagcgcugugguugaccugg

SEQ ID NO: 1315896 - RNA, 18 nt, Human
ucuggagagucagaguca

SEQ ID NO: 1315897 - RNA, 21 nt, Human
ucugucuucuccucugcagcu

SEQ ID NO: 1315898 - RNA, 18 nt, Human
ucuucugaguccagcugg

SEQ ID NO: 1315899 - RNA, 21 nt, Human
ugcggccagggcucgggaucc

SEQ ID NO: 1315900 - RNA, 23 nt, Human
uggauucguagggguugaggauc

SEQ ID NO: 1315901 - RNA, 21 nt, Human
uggcagcccagcccacugcca

SEQ ID NO: 1315902 - RNA, 19 nt, Human
uguccuggaggcccagcua

SEQ ID NO: 1315903 - RNA, 24 nt, Human
uuccacauaugcacaguaaacacc

SEQ ID NO: 1315904 - RNA, 21 nt, Human
uuccccagagaguguccugga

SEQ ID NO: 1315905 - RNA, 22 nt, Human
uugcuggguugugugguaaagu

SEQ ID NO: 1315906 - RNA, 19 nt, Human
uuggcagccaggggacuuc

SEQ ID NO: 1315907 - RNA, 21 nt, Human
uuugcaaaccgucccgauugc

SEQ ID NO: 1315908 - RNA, 23 nt, Human
aaagauaaacaaauuagaggcca

SEQ ID NO: 1315909 - RNA, 19 nt, Human
aaaguuaggcuaggaaagg

SEQ ID NO: 1315910 - RNA, 23 nt, Human
aagaaagagucagccaggaggca

SEQ ID NO: 1315911 - RNA, 24 nt, Human
aagaagcaugagcugggccuggug

SEQ ID NO: 1315912 - RNA, 21 nt, Human
aagaagucuguggccuacaga

SEQ ID NO: 1315913 - RNA, 23 nt, Human
aagcagcaaacgcuaggccugga

SEQ ID NO: 1315914 - RNA, 18 nt, Human
aagccuuugggaggaaga

SEQ ID NO: 1315915 - RNA, 20 nt, Human
aagcggccgagaggcaggag

SEQ ID NO: 1315916 - RNA, 21 nt, Human
aagcggccgagaggcaggagc

SEQ ID NO: 1315917 - RNA, 24 nt, Human
aagcuuguuuuccugcaacuggau

SEQ ID NO: 1315918 - RNA, 19 nt, Human
aaguggugggccuggaggg

SEQ ID NO: 1315919 - RNA, 19 nt, Human
aaguuaggcaaaaggcuga

SEQ ID NO: 1315920 - RNA, 22 nt, Human
aaucaucaucccuucuucagcc

SEQ ID NO: 1315921 - RNA, 19 nt, Human
aaugagccaugauaggacc

SEQ ID NO: 1315922 - RNA, 21 nt, Human
acaacagagggagacccugaa

SEQ ID NO: 1315923 - RNA, 24 nt, Human
accaagaugcaggagcugggccug

SEQ ID NO: 1315924 - RNA, 25 nt, Human
accacaaauggaagaaaggccauga

SEQ ID NO: 1315925 - RNA, 22 nt, Human
acccggagaggccgccaagagg

SEQ ID NO: 1315926 - RNA, 18 nt, Human
acgggaggcagaggcugg

SEQ ID NO: 1315927 - RNA, 19 nt, Human
acgggccuguagacgcacu

SEQ ID NO: 1315928 - RNA, 18 nt, Human
acuacacuccagccuugg

SEQ ID NO: 1315929 - RNA, 18 nt, Human
acuacacuccagccuugg

SEQ ID NO: 1315930 - RNA, 19 nt, Human
acuacacuccagccuugga

SEQ ID NO: 1315931 - RNA, 25 nt, Human
acuacacuccagccuuggacaacag

SEQ ID NO: 1315932 - RNA, 19 nt, Human
acuacacuccagccuuggg

SEQ ID NO: 1315933 - RNA, 21 nt, Human
acuggauugugagggccagag

SEQ ID NO: 1315934 - RNA, 18 nt, Human
agaaaguucagggccugg

SEQ ID NO: 1315935 - RNA, 21 nt, Human
agaacgacuugggccugcaga

SEQ ID NO: 1315936 - RNA, 23 nt, Human
agaaguuaggcaaaaggcugauu

SEQ ID NO: 1315937 - RNA, 26 nt, Human
agacagaaguuaggcaaaagggaccc

SEQ ID NO: 1315938 - RNA, 19 nt, Human
agacgggccuguagacgca

SEQ ID NO: 1315939 - RNA, 21 nt, Human
agagcagggccugcagaggcu

SEQ ID NO: 1315940 - RNA, 24 nt, Human
agaggccagugugaggcaagaccu

SEQ ID NO: 1315941 - RNA, 20 nt, Human
agaggcugccagcagcucag

SEQ ID NO: 1315942 - RNA, 23 nt, Human
agauaaacaaauuagaggccaag

SEQ ID NO: 1315943 - RNA, 24 nt, Human
agaugggagaaucacuucagccug

SEQ ID NO: 1315944 - RNA, 24 nt, Human
agcaccuguagucucagccacgug

SEQ ID NO: 1315945 - RNA, 20 nt, Human
agcagcaaacgcuaggccug

SEQ ID NO: 1315946 - RNA, 20 nt, Human
agcgccccagugacguagcc

SEQ ID NO: 1315947 - RNA, 18 nt, Human
agcugggcccggagaagc

SEQ ID NO: 1315948 - RNA, 20 nt, Human
agcugggccuguucaugcca

SEQ ID NO: 1315949 - RNA, 22 nt, Human
agcugugccuguggaggcuguu

SEQ ID NO: 1315950 - RNA, 22 nt, Human
aggcaaaaggcugauuugagga

SEQ ID NO: 1315951 - RNA, 19 nt, Human
aggcacuaggccuggaaau

SEQ ID NO: 1315952 - RNA, 18 nt, Human
aggcagcaguugugccug

SEQ ID NO: 1315953 - RNA, 22 nt, Human
aggcaggaagaaauuuggccug

SEQ ID NO: 1315954 - RNA, 23 nt, Human
aggcaggaagaaauuuggccugg

SEQ ID NO: 1315955 - RNA, 18 nt, Human
aggcaggagacgggccug

SEQ ID NO: 1315956 - RNA, 20 nt, Human
aggcaggagacgggccugua

SEQ ID NO: 1315957 - RNA, 23 nt, Human
aggcaggagcugggccugcagag

SEQ ID NO: 1315958 - RNA, 22 nt, Human
aggcaggagcuucgccugagga

SEQ ID NO: 1315959 - RNA, 25 nt, Human
aggcaggagcuucgccugaggaugc

SEQ ID NO: 1315960 - RNA, 19 nt, Human
aggcaggaggagcugggcc

SEQ ID NO: 1315961 - RNA, 21 nt, Human
aggcaggaggagcugggccug

SEQ ID NO: 1315962 - RNA, 19 nt, Human
aggcaggaggccgggccuu

SEQ ID NO: 1315963 - RNA, 20 nt, Human
aggcaugagcugggcugggc

SEQ ID NO: 1315964 - RNA, 22 nt, Human
aggccggagcugggccugggga

SEQ ID NO: 1315965 - RNA, 23 nt, Human
aggccggagcugggccuggggaa

SEQ ID NO: 1315966 - RNA, 19 nt, Human
aggggccaccaagaugcag

SEQ ID NO: 1315967 - RNA, 21 nt, Human
aggugggucugagccuggcag

SEQ ID NO: 1315968 - RNA, 19 nt, Human
aguucugggccuggagagg

SEQ ID NO: 1315969 - RNA, 19 nt, Human
aucugggucuggagggucc

SEQ ID NO: 1315970 - RNA, 19 nt, Human
augaacuggacaggaacug

SEQ ID NO: 1315971 - RNA, 20 nt, Human
auggagcugugccuguggag

SEQ ID NO: 1315972 - RNA, 21 nt, Human
augggccugaagaggccacug

SEQ ID NO: 1315973 - RNA, 20 nt, Human
caaagcagcaaacgcuaggc

SEQ ID NO: 1315974 - RNA, 18 nt, Human
caacagagggagacccug

SEQ ID NO: 1315975 - RNA, 18 nt, Human
caacuggauggucccacg

SEQ ID NO: 1315976 - RNA, 24 nt, Human
caagagcugggcuuggaaaagccc

SEQ ID NO: 1315977 - RNA, 21 nt, Human
caccaggaagcagaagguggg

SEQ ID NO: 1315978 - RNA, 21 nt, Human
caccaggaggcagcaguuggg

SEQ ID NO: 1315979 - RNA, 19 nt, Human
caccuggcaugaggugugc

SEQ ID NO: 1315980 - RNA, 23 nt, Human
caccuguagucucagccacgugg

SEQ ID NO: 1315981 - RNA, 24 nt, Human
caccuguagucucagccacguggg

SEQ ID NO: 1315982 - RNA, 22 nt, Human
cacuggguggcaggagcugggu

SEQ ID NO: 1315983 - RNA, 25 nt, Human
cacuggguggcaggagcugggugug

SEQ ID NO: 1315984 - RNA, 18 nt, Human
cagaugaguuucgucucc

SEQ ID NO: 1315985 - RNA, 22 nt, Human
cagcaguugggacuagagaggc

SEQ ID NO: 1315986 - RNA, 23 nt, Human
cagccuuggacaacagagggaga

SEQ ID NO: 1315987 - RNA, 22 nt, Human
cagcuguagucccagcuacugg

SEQ ID NO: 1315988 - RNA, 23 nt, Human
cagcuguagucccagcuacuggg

SEQ ID NO: 1315989 - RNA, 20 nt, Human
caggaagcagaaggugggcc

SEQ ID NO: 1315990 - RNA, 18 nt, Human
caggcugcaaaaggcaaa

SEQ ID NO: 1315991 - RNA, 24 nt, Human
cagggccuggagaggaugcaaagc

SEQ ID NO: 1315992 - RNA, 21 nt, Human
cagugugaggcaagaccuggg

SEQ ID NO: 1315993 - RNA, 21 nt, Human
ccaccgaaagucaaaagcggg

SEQ ID NO: 1315994 - RNA, 19 nt, Human
ccaccgugaggcaaaugcu

SEQ ID NO: 1315995 - RNA, 19 nt, Human
ccacugaacuccauccuga

SEQ ID NO: 1315996 - RNA, 18 nt, Human
ccacugugaggcagaggc

SEQ ID NO: 1315997 - RNA, 19 nt, Human
ccagcacugggaaacuagg

SEQ ID NO: 1315998 - RNA, 23 nt, Human
cccagugacguagccgagguacc

SEQ ID NO: 1315999 - RNA, 18 nt, Human
ccccaugggccugaagag

SEQ ID NO: 1316000 - RNA, 22 nt, Human
cccggagaagcccccaugaggc

SEQ ID NO: 1316001 - RNA, 21 nt, Human
cccucauuuuccauuccccag

SEQ ID NO: 1316002 - RNA, 19 nt, Human
cccuugugaagcaugagcu

SEQ ID NO: 1316003 - RNA, 21 nt, Human
ccgaaaggcaggagcuucgcc

SEQ ID NO: 1316004 - RNA, 24 nt, Human
ccuggcaugaggugugcccagagg

SEQ ID NO: 1316005 - RNA, 25 nt, Human
ccuggccuauggguacugaguggga

SEQ ID NO: 1316006 - RNA, 19 nt, Human
cgacaugaggcaggagcug

SEQ ID NO: 1316007 - RNA, 22 nt, Human
cgagaagacugcccagcuccag

SEQ ID NO: 1316008 - RNA, 19 nt, Human
cgcaagaaccacaaaugga

SEQ ID NO: 1316009 - RNA, 24 nt, Human
cgccccagugacguagccgaacac

SEQ ID NO: 1316010 - RNA, 20 nt, Human
cgccgggaggcaggagcugg

SEQ ID NO: 1316011 - RNA, 20 nt, Human
cgccgggaggcaugagcugg

SEQ ID NO: 1316012 - RNA, 21 nt, Human
cggcaacacacaggaccuggc

SEQ ID NO: 1316013 - RNA, 22 nt, Human
cgggagcugggccugccgaagc

SEQ ID NO: 1316014 - RNA, 19 nt, Human
cgggaggcagaggcugggc

SEQ ID NO: 1316015 - RNA, 23 nt, Human
cgggaggcagaggcugggccugg

SEQ ID NO: 1316016 - RNA, 22 nt, Human
cgggaggcaugagcugggcugg

SEQ ID NO: 1316017 - RNA, 24 nt, Human
cgggaggcaugagcugggcugggc

SEQ ID NO: 1316018 - RNA, 22 nt, Human
cuacuacacuccagccuuggac

SEQ ID NO: 1316019 - RNA, 19 nt, Human
cucaagggaaucuucagcu

SEQ ID NO: 1316020 - RNA, 21 nt, Human
cuccaggaaccguagcgcccc

SEQ ID NO: 1316021 - RNA, 18 nt, Human
cugaagaggccacuggca

SEQ ID NO: 1316022 - RNA, 18 nt, Human
cugccaggaggcaagagc

SEQ ID NO: 1316023 - RNA, 23 nt, Human
cuggaagguugaggcugcaguca

SEQ ID NO: 1316024 - RNA, 21 nt, Human
cuggcaugaggugugcccaga

SEQ ID NO: 1316025 - RNA, 20 nt, Human
cugggccaaaaaaggcuguu

SEQ ID NO: 1316026 - RNA, 19 nt, Human
cugggccucaagaaucugc

SEQ ID NO: 1316027 - RNA, 18 nt, Human
cugggccuggaggggcca

SEQ ID NO: 1316028 - RNA, 20 nt, Human
cuggggcagcugccaugagg

SEQ ID NO: 1316029 - RNA, 19 nt, Human
gaaaguucugggccuggag

SEQ ID NO: 1316030 - RNA, 24 nt, Human
gaacuggacaggaacugggccaaa

SEQ ID NO: 1316031 - RNA, 19 nt, Human
gaacugggccaaaaaaggc

SEQ ID NO: 1316032 - RNA, 19 nt, Human
gacaggaggcaggagcugg

SEQ ID NO: 1316033 - RNA, 21 nt, Human
gacaugaggcaggagcugagu

SEQ ID NO: 1316034 - RNA, 25 nt, Human
gacuucagaaaguucagggccugga

SEQ ID NO: 1316035 - RNA, 19 nt, Human
gaggcaggaggagcugggc

SEQ ID NO: 1316036 - RNA, 18 nt, Human
gaggcuguugugaggcag

SEQ ID NO: 1316037 - RNA, 21 nt, Human
gagugacagggcaagguccug

SEQ ID NO: 1316038 - RNA, 21 nt, Human
gaguuucgucuccuccacugg

SEQ ID NO: 1316039 - RNA, 18 nt, Human
gauugcuugagccuggga

SEQ ID NO: 1316040 - RNA, 22 nt, Human
gauugcuugagccugggaguuu

SEQ ID NO: 1316041 - RNA, 27 nt, Human
gcaaagcagcaaacgcuaggccuggaa

SEQ ID NO: 1316042 - RNA, 21 nt, Human
gcaagagcagggccugcagag

SEQ ID NO: 1316043 - RNA, 18 nt, Human
gcagauucguggccuggg

SEQ ID NO: 1316044 - RNA, 21 nt, Human
gcaggagcugggccugcagag

SEQ ID NO: 1316045 - RNA, 22 nt, Human
gcaguaggcucaucugcggaga

SEQ ID NO: 1316046 - RNA, 21 nt, Human
gcccagcuccaggaaccguag

SEQ ID NO: 1316047 - RNA, 24 nt, Human
gccgaaaggcaggagcuucgccug

SEQ ID NO: 1316048 - RNA, 21 nt, Human
gccgggagaggucaacuugag

SEQ ID NO: 1316049 - RNA, 22 nt, Human
gccgggagaggucaacuugagg

SEQ ID NO: 1316050 - RNA, 24 nt, Human
gccugcagaagccuuuggcgacug

SEQ ID NO: 1316051 - RNA, 19 nt, Human
gccuggacaggcugcaaaa

SEQ ID NO: 1316052 - RNA, 19 nt, Human
gccuggagaggaugcaaag

SEQ ID NO: 1316053 - RNA, 22 nt, Human
gccuggagaguaugaccugagg

SEQ ID NO: 1316054 - RNA, 18 nt, Human
gcgggagcugggccugcc

SEQ ID NO: 1316055 - RNA, 19 nt, Human
gcugaaaggcaggagcuug

SEQ ID NO: 1316056 - RNA, 20 nt, Human
gcugcagucagcugugauag

SEQ ID NO: 1316057 - RNA, 20 nt, Human
gcugcugggagacacgcagg

SEQ ID NO: 1316058 - RNA, 24 nt, Human
gcuguagucccagcuacugggaag

SEQ ID NO: 1316059 - RNA, 18 nt, Human
ggaaggccgccgggaggc

SEQ ID NO: 1316060 - RNA, 20 nt, Human
ggaaggcugacaugguagga

SEQ ID NO: 1316061 - RNA, 18 nt, Human
ggacuguagaggccgacg

SEQ ID NO: 1316062 - RNA, 21 nt, Human
ggagaggccgacuggaggaag

SEQ ID NO: 1316063 - RNA, 21 nt, Human
ggaggaaguccagggccugga

SEQ ID NO: 1316064 - RNA, 23 nt, Human
ggaggauaagcucguccuggaga

SEQ ID NO: 1316065 - RNA, 18 nt, Human
ggaggcagaggcugggcc

SEQ ID NO: 1316066 - RNA, 26 nt, Human
ggaggcaggagcugggccucccaagg

SEQ ID NO: 1316067 - RNA, 26 nt, Human
ggaggcaggcacuaggccucccaagg

SEQ ID NO: 1316068 - RNA, 18 nt, Human
ggaguuugaggcuauaau

SEQ ID NO: 1316069 - RNA, 19 nt, Human
ggcaggagcugggccugca

SEQ ID NO: 1316070 - RNA, 22 nt, Human
ggcaugguggcaagcaccugua

SEQ ID NO: 1316071 - RNA, 20 nt, Human
ggccuggagaggcugccggg

SEQ ID NO: 1316072 - RNA, 21 nt, Human
ggccuggagaguaugaccuga

SEQ ID NO: 1316073 - RNA, 19 nt, Human
ggccuggggaagccgacuu

SEQ ID NO: 1316074 - RNA, 18 nt, Human
ggccuggggaggccaccg

SEQ ID NO: 1316075 - RNA, 20 nt, Human
ggcugggaggcaggagcugg

SEQ ID NO: 1316076 - RNA, 19 nt, Human
gggaggaagagcuuggccu

SEQ ID NO: 1316077 - RNA, 20 nt, Human
gggaggcaugagcugggcug

SEQ ID NO: 1316078 - RNA, 23 nt, Human
gggaggcaugagcugggcugggc

SEQ ID NO: 1316079 - RNA, 19 nt, Human
gggcaugguggcaagcacc

SEQ ID NO: 1316080 - RNA, 18 nt, Human
gggccuggagggucuacu

SEQ ID NO: 1316081 - RNA, 19 nt, Human
gggcugggccgaaagaggc

SEQ ID NO: 1316082 - RNA, 20 nt, Human
gggcuucaagaaagagucag

SEQ ID NO: 1316083 - RNA, 18 nt, Human
gguaggauugcuugagcc

SEQ ID NO: 1316084 - RNA, 21 nt, Human
gguggcugugguggcucguug

SEQ ID NO: 1316085 - RNA, 23 nt, Human
ggugugcccagagggacagaggc

SEQ ID NO: 1316086 - RNA, 19 nt, Human
guaugcgucaaaaagcaaa

SEQ ID NO: 1316087 - RNA, 23 nt, Human
gucuacugugugguaagagucug

SEQ ID NO: 1316088 - RNA, 18 nt, Human
gugaggcagaggcuggcc

SEQ ID NO: 1316089 - RNA, 19 nt, Human
gugaggcagaggcugggcc

SEQ ID NO: 1316090 - RNA, 24 nt, Human
guuuucggaggaugccaugaggca

SEQ ID NO: 1316091 - RNA, 21 nt, Human
uaaacaaauuagaggccaaga

SEQ ID NO: 1316092 - RNA, 22 nt, Human
uacaaaggcaauugcgaggcag

SEQ ID NO: 1316093 - RNA, 25 nt, Human
uacuacacuccagccuuggacaaca

SEQ ID NO: 1316094 - RNA, 20 nt, Human
uagaggcugccgaaaggcag

SEQ ID NO: 1316095 - RNA, 20 nt, Human
uagaggcugcugaaaggcag

SEQ ID NO: 1316096 - RNA, 20 nt, Human
uagcacuacuacacuccagc

SEQ ID NO: 1316097 - RNA, 22 nt, Human
uaggaagagcugggcccggaga

SEQ ID NO: 1316098 - RNA, 18 nt, Human
uaggguuuauccaucuug

SEQ ID NO: 1316099 - RNA, 25 nt, Human
ucaaagcugggccuguucaugccac

SEQ ID NO: 1316100 - RNA, 19 nt, Human
ucagaaaguucagggccug

SEQ ID NO: 1316101 - RNA, 21 nt, Human
ucauuuuccauuccccagcau

SEQ ID NO: 1316102 - RNA, 22 nt, Human
uccaaauauuaguugggcaugg

SEQ ID NO: 1316103 - RNA, 24 nt, Human
uccacagugaggcagaugcugggc

SEQ ID NO: 1316104 - RNA, 20 nt, Human
uccgcugugaggcagaggcu

SEQ ID NO: 1316105 - RNA, 18 nt, Human
uccugcaacuggaugguc

SEQ ID NO: 1316106 - RNA, 19 nt, Human
ucuuuuagcaugagcuggg

SEQ ID NO: 1316107 - RNA, 18 nt, Human
ugaaaccacaggacagua

SEQ ID NO: 1316108 - RNA, 19 nt, Human
ugaaaggcaggagcuuggc

SEQ ID NO: 1316109 - RNA, 20 nt, Human
ugaaagguugggagcuuggc

SEQ ID NO: 1316110 - RNA, 22 nt, Human
ugaaagguugggagcuuggcuu

SEQ ID NO: 1316111 - RNA, 20 nt, Human
ugacaggaggcaggagcugg

SEQ ID NO: 1316112 - RNA, 21 nt, Human
ugacaggaggcaggagcuggg

SEQ ID NO: 1316113 - RNA, 21 nt, Human
ugacagggcaagguccuguuu

SEQ ID NO: 1316114 - RNA, 18 nt, Human
ugacaugguaggauugcu

SEQ ID NO: 1316115 - RNA, 22 nt, Human
ugacgagaagacugcccagcuc

SEQ ID NO: 1316116 - RNA, 18 nt, Human
ugagaacgacuugggccu

SEQ ID NO: 1316117 - RNA, 21 nt, Human
ugagaugggagaaucacuuca

SEQ ID NO: 1316118 - RNA, 21 nt, Human
ugagaugggagaaucacuuca

SEQ ID NO: 1316119 - RNA, 22 nt, Human
ugagaugggagaaucacuucag

SEQ ID NO: 1316120 - RNA, 22 nt, Human
ugagccugggaguuugaggcua

SEQ ID NO: 1316121 - RNA, 22 nt, Human
ugagcuggauguagagaggcca

SEQ ID NO: 1316122 - RNA, 19 nt, Human
ugagcugggccuggugagg

SEQ ID NO: 1316123 - RNA, 23 nt, Human
ugagcuuggucuguagaggcuga

SEQ ID NO: 1316124 - RNA, 25 nt, Human
ugaggaugccacagugagacaccau

SEQ ID NO: 1316125 - RNA, 18 nt, Human
ugaggcaagaccugggcc

SEQ ID NO: 1316126 - RNA, 22 nt, Human
ugaggcaagaccugggccuguc

SEQ ID NO: 1316127 - RNA, 18 nt, Human
ugaggcagaggcugggcc

SEQ ID NO: 1316128 - RNA, 18 nt, Human
ugaggcagaggcugggcc

SEQ ID NO: 1316129 - RNA, 18 nt, Human
ugaggcagaugcugggcc

SEQ ID NO: 1316130 - RNA, 18 nt, Human
ugaggcaggagacgggcc

SEQ ID NO: 1316131 - RNA, 20 nt, Human
ugaggcaggagacgggccuc

SEQ ID NO: 1316132 - RNA, 20 nt, Human
ugaggcaggagacgggccug

SEQ ID NO: 1316133 - RNA, 18 nt, Human
ugaggcaggagcugaguu

SEQ ID NO: 1316134 - RNA, 20 nt, Human
ugaggcaguaggcucaucug

SEQ ID NO: 1316135 - RNA, 24 nt, Human
ugaggcugcugggaggccgaaggu

SEQ ID NO: 1316136 - RNA, 21 nt, Human
ugagguccccaugccuggccu

SEQ ID NO: 1316137 - RNA, 23 nt, Human
ugauggagcugugccuguggagg

SEQ ID NO: 1316138 - RNA, 24 nt, Human
ugccaccaggaagcagaagguggg

SEQ ID NO: 1316139 - RNA, 20 nt, Human
ugcccagagggacagaggca

SEQ ID NO: 1316140 - RNA, 21 nt, Human
ugcccagucaguuucucuucc

SEQ ID NO: 1316141 - RNA, 23 nt, Human
ugccuggagaggucaccgugagg

SEQ ID NO: 1316142 - RNA, 23 nt, Human
ugccuguagacucagccaauagg

SEQ ID NO: 1316143 - RNA, 19 nt, Human
ugcugggagacacgcagga

SEQ ID NO: 1316144 - RNA, 20 nt, Human
ugcugggaggccgaaggugg

SEQ ID NO: 1316145 - RNA, 24 nt, Human
uggaaaagccccugggaggcaaga

SEQ ID NO: 1316146 - RNA, 23 nt, Human
uggaagaaaggccaugaaaccac

SEQ ID NO: 1316147 - RNA, 19 nt, Human
uggaagguugaggcugcag

SEQ ID NO: 1316148 - RNA, 22 nt, Human
uggaagguugaggcugcaguca

SEQ ID NO: 1316149 - RNA, 20 nt, Human
uggagaggccgacuggaggg

SEQ ID NO: 1316150 - RNA, 20 nt, Human
uggagaggcugacucgagga

SEQ ID NO: 1316151 - RNA, 18 nt, Human
uggagaggucaccgugag

SEQ ID NO: 1316152 - RNA, 18 nt, Human
uggaggaaguccagggcc

SEQ ID NO: 1316153 - RNA, 21 nt, Human
uggaggaaguccagggccugg

SEQ ID NO: 1316154 - RNA, 23 nt, Human
uggaggaaguuuugggacuggag

SEQ ID NO: 1316155 - RNA, 22 nt, Human
uggcaagcaccuguagucucag

SEQ ID NO: 1316156 - RNA, 22 nt, Human
uggcagcuuucuccaacuuugg

SEQ ID NO: 1316157 - RNA, 21 nt, Human
uggcaggagcuggguguguag

SEQ ID NO: 1316158 - RNA, 22 nt, Human
uggcaggcgggagcugggccug

SEQ ID NO: 1316159 - RNA, 24 nt, Human
uggccuggggcagcugccaugagg

SEQ ID NO: 1316160 - RNA, 22 nt, Human
ugggaggaagagcuuggccugg

SEQ ID NO: 1316161 - RNA, 18 nt, Human
ugggaggcaggagcuggg

SEQ ID NO: 1316162 - RNA, 20 nt, Human
ugggaggcaggaggagcugg

SEQ ID NO: 1316163 - RNA, 21 nt, Human
ugggaggcaggaggagcuggg

SEQ ID NO: 1316164 - RNA, 20 nt, Human
ugggaggccgaagguggcug

SEQ ID NO: 1316165 - RNA, 18 nt, Human
ugggagguugagauggga

SEQ ID NO: 1316166 - RNA, 24 nt, Human
ugggagguugagaugggagaauca

SEQ ID NO: 1316167 - RNA, 20 nt, Human
ugggccaaaaaaggcuguug

SEQ ID NO: 1316168 - RNA, 22 nt, Human
ugggccgggagaggucaacuug

SEQ ID NO: 1316169 - RNA, 20 nt, Human
ugggccuaaagagaccauug

SEQ ID NO: 1316170 - RNA, 21 nt, Human
ugggccugcagagggugacuu

SEQ ID NO: 1316171 - RNA, 24 nt, Human
ugggccuggaaaggcccuugugac

SEQ ID NO: 1316172 - RNA, 18 nt, Human
ugggccuggaaaggcugu

SEQ ID NO: 1316173 - RNA, 20 nt, Human
ugggccuggaaaggcuguug

SEQ ID NO: 1316174 - RNA, 18 nt, Human
ugggccuggagaggcugc

SEQ ID NO: 1316175 - RNA, 18 nt, Human
ugggccuggagaggcugc

SEQ ID NO: 1316176 - RNA, 24 nt, Human
ugggccuggugaggucgacuucag

SEQ ID NO: 1316177 - RNA, 18 nt, Human
uggggaggccaccgugag

SEQ ID NO: 1316178 - RNA, 23 nt, Human
ugggggguccacagugaggcaga

SEQ ID NO: 1316179 - RNA, 18 nt, Human
uggguggcaggagcuggg

SEQ ID NO: 1316180 - RNA, 22 nt, Human
uggguggcaggagcugggugug

SEQ ID NO: 1316181 - RNA, 22 nt, Human
uggucuuugucucuuagaaggu

SEQ ID NO: 1316182 - RNA, 23 nt, Human
ugguggcaagcaccuguagucuc

SEQ ID NO: 1316183 - RNA, 24 nt, Human
ugguggcaagcaccuguagucuca

SEQ ID NO: 1316184 - RNA, 21 nt, Human
uguagacucagccaauaggaa

SEQ ID NO: 1316185 - RNA, 18 nt, Human
ugugaggcagaggcuggg

SEQ ID NO: 1316186 - RNA, 18 nt, Human
ugugccuguagacucagc

SEQ ID NO: 1316187 - RNA, 21 nt, Human
uguugagguccccaugccugg

SEQ ID NO: 1316188 - RNA, 27 nt, Human
uguugugaggaaugagccccaugggag

SEQ ID NO: 1316189 - RNA, 25 nt, Human
uuaaggacauucugggccuggacag

SEQ ID NO: 1316190 - RNA, 18 nt, Human
uuaguugggcaugguggc

SEQ ID NO: 1316191 - RNA, 20 nt, Human
uucagaaaguucagggccug

SEQ ID NO: 1316192 - RNA, 22 nt, Human
uucagggccuggagagaaggcu

SEQ ID NO: 1316193 - RNA, 18 nt, Human
uucaugccaccaggaagc

SEQ ID NO: 1316194 - RNA, 24 nt, Human
uuccccagcauuggcggguucugg

SEQ ID NO: 1316195 - RNA, 24 nt, Human
uugcuugagccugggaguuugagg

SEQ ID NO: 1316196 - RNA, 21 nt, Human
uuuaagaagucuguggccuac

SEQ ID NO: 1316197 - RNA, 24 nt, Human
uuuaagaagucuguggccuacaga

SEQ ID NO: 1316198 - RNA, 23 nt, Human
aggaaagguaauaucuaugaugu

SEQ ID NO: 1316199 - RNA, 23 nt, Human
aguaauacagcagcaagaaaaga

SEQ ID NO: 1316200 - RNA, 25 nt, Human
caagaaaagacugcccuugacagua

SEQ ID NO: 1316201 - RNA, 20 nt, Human
cacgggugccaacauucggg

SEQ ID NO: 1316202 - RNA, 21 nt, Human
cagcagcaagaaaagacugcc

SEQ ID NO: 1316203 - RNA, 25 nt, Human
ccuccaguaucuuuaaaguaaucau

SEQ ID NO: 1316204 - RNA, 19 nt, Human
gauucuugaccaucuccuc

SEQ ID NO: 1316205 - RNA, 21 nt, Human
gccacgggugccaacauucgg

SEQ ID NO: 1316206 - RNA, 18 nt, Human
guacagguuuaaggggag

SEQ ID NO: 1316207 - RNA, 18 nt, Human
guuccagaaaacccaugg

SEQ ID NO: 1316208 - RNA, 18 nt, Human
uacccaaugucuucauca

SEQ ID NO: 1316209 - RNA, 21 nt, Human
uagguuccagaaaacccaugg

SEQ ID NO: 1316210 - RNA, 19 nt, Human
uccaacuuccuuaaacagc

SEQ ID NO: 1316211 - RNA, 19 nt, Human
ucuagguuccagaaaaccc

SEQ ID NO: 1316212 - RNA, 18 nt, Human
ugacaagugacgggaagg

SEQ ID NO: 1316213 - RNA, 24 nt, Human
ugacaagugacgggaaggcuaaua

SEQ ID NO: 1316214 - RNA, 22 nt, Human
aacauaaugacacuaaaaacug

SEQ ID NO: 1316215 - RNA, 20 nt, Human
agcauuuucaaacaguucug

SEQ ID NO: 1316216 - RNA, 28 nt, Human
auacaagggccgggcgcgguggcucaug

SEQ ID NO: 1316217 - RNA, 19 nt, Human
augccuguaaucccagcac

SEQ ID NO: 1316218 - RNA, 20 nt, Human
caaauauguagcagcaacau

SEQ ID NO: 1316219 - RNA, 18 nt, Human
cagcacuuggagaggcgg

SEQ ID NO: 1316220 - RNA, 20 nt, Human
caugccuguaaucccagcac

SEQ ID NO: 1316221 - RNA, 23 nt, Human
caugccuguaaucccagcacuug

SEQ ID NO: 1316222 - RNA, 24 nt, Human
ccaaauauguagcagcaacauaau

SEQ ID NO: 1316223 - RNA, 24 nt, Human
cucaugccuguaaucccagcacuu

SEQ ID NO: 1316224 - RNA, 25 nt, Human
gccaacucuguggcucuuucaucau

SEQ ID NO: 1316225 - RNA, 21 nt, Human
gccccguugccugggcugcag

SEQ ID NO: 1316226 - RNA, 23 nt, Human
ggccgggcgcgguggcucaugcc

SEQ ID NO: 1316227 - RNA, 23 nt, Human
ggcgcgguggcucaugccuguaa

SEQ ID NO: 1316228 - RNA, 23 nt, Human
gguggcucaugccuguaauccca

SEQ ID NO: 1316229 - RNA, 24 nt, Human
gguggcucaugccuguaaucccag

SEQ ID NO: 1316230 - RNA, 18 nt, Human
gucuccauaaagucaaag

SEQ ID NO: 1316231 - RNA, 22 nt, Human
uaaaaaagaauccuccuuuguc

SEQ ID NO: 1316232 - RNA, 24 nt, Human
uaagaugaguaaaaaagaauccuc

SEQ ID NO: 1316233 - RNA, 26 nt, Human
ucagcaaacgaugguguucgucuccu

SEQ ID NO: 1316234 - RNA, 22 nt, Human
ucaugccuguaaucccagcacu

SEQ ID NO: 1316235 - RNA, 23 nt, Human
uccgcagccccguugccugggcu

SEQ ID NO: 1316236 - RNA, 24 nt, Human
ugccugggcugcagguccacugac

SEQ ID NO: 1316237 - RNA, 22 nt, Human
ugccuguaaucccagcacuugg

SEQ ID NO: 1316238 - RNA, 22 nt, Human
uggcucaugccuguaaucccag

SEQ ID NO: 1316239 - RNA, 24 nt, Human
uggcucaugccuguaaucccagca

SEQ ID NO: 1316240 - RNA, 24 nt, Human
cuccagugacuucuccagcuucgc

SEQ ID NO: 1316241 - RNA, 22 nt, Human
gagaugcuccagugacuucucc

SEQ ID NO: 1316242 - RNA, 24 nt, Human
gaugcuccagugacuucuccagcu

SEQ ID NO: 1316243 - RNA, 24 nt, Human
accaagaugcaggagcugggccug

SEQ ID NO: 1316244 - RNA, 19 nt, Human
aggggccaccaagaugcag

SEQ ID NO: 1316245 - RNA, 18 nt, Human
ccacugugaggcagaggc

SEQ ID NO: 1316246 - RNA, 19 nt, Human
cgggaggcagaggcugggc

SEQ ID NO: 1316247 - RNA, 23 nt, Human
cgggaggcagaggcugggccugg

SEQ ID NO: 1316248 - RNA, 18 nt, Human
cugggccuggaggggcca

SEQ ID NO: 1316249 - RNA, 22 nt, Human
cugugaggcagaggcugggcgu

SEQ ID NO: 1316250 - RNA, 19 nt, Human
gacgggaggcagaggcugg

SEQ ID NO: 1316251 - RNA, 18 nt, Human
ggacuguagaggccgacg

SEQ ID NO: 1316252 - RNA, 18 nt, Human
ggaggcagaggcugggcc

SEQ ID NO: 1316253 - RNA, 20 nt, Human
gggcgugaagaaucugcugu

SEQ ID NO: 1316254 - RNA, 19 nt, Human
gugaggcagaggcugggcg

SEQ ID NO: 1316255 - RNA, 20 nt, Human
uccacugugaggcagaggcu

SEQ ID NO: 1316256 - RNA, 20 nt, Human
ugaggcagaggcugggcgug

SEQ ID NO: 1316257 - RNA, 18 nt, Human
ugugaggcagaggcuggg

SEQ ID NO: 1316258 - RNA, 22 nt, Human
ugugaggcagaggcugggcgug

SEQ ID NO: 1316259 - RNA, 19 nt, Human
aagaggcccugcagcuggc

SEQ ID NO: 1316260 - RNA, 20 nt, Human
acggcaacaggacagcgugc

SEQ ID NO: 1316261 - RNA, 22 nt, Human
aggggccucugagaugaugggc

SEQ ID NO: 1316262 - RNA, 18 nt, Human
caacacgcccagcccauc

SEQ ID NO: 1316263 - RNA, 21 nt, Human
cacgcccagcccaucagcucu

SEQ ID NO: 1316264 - RNA, 21 nt, Human
cagcccaucauccuggagaug

SEQ ID NO: 1316265 - RNA, 20 nt, Human
cagcucaguuccacagccga

SEQ ID NO: 1316266 - RNA, 20 nt, Human
cagcuggcuggcuggcugga

SEQ ID NO: 1316267 - RNA, 22 nt, Human
caggacagcgugcugggcagaa

SEQ ID NO: 1316268 - RNA, 27 nt, Human
caggggccucugagaugaugggcucug

SEQ ID NO: 1316269 - RNA, 21 nt, Human
cccagcccaucagcucuucuu

SEQ ID NO: 1316270 - RNA, 25 nt, Human
ccucugagaugaugggcucugguuc

SEQ ID NO: 1316271 - RNA, 24 nt, Human
ccugcacagguucugcguccgcag

SEQ ID NO: 1316272 - RNA, 20 nt, Human
ccugcagcuggcuggcuggc

SEQ ID NO: 1316273 - RNA, 21 nt, Human
cggcaagaggcccugcagcug

SEQ ID NO: 1316274 - RNA, 20 nt, Human
cugggcucugaggguccugg

SEQ ID NO: 1316275 - RNA, 20 nt, Human
cuucgaaggacauccagggg

SEQ ID NO: 1316276 - RNA, 18 nt, Human
gcaaggcuggcucuucuu

SEQ ID NO: 1316277 - RNA, 20 nt, Human
gcagcuggcuggcuggcugg

SEQ ID NO: 1316278 - RNA, 18 nt, Human
gcccugcagcuggcuggc

SEQ ID NO: 1316279 - RNA, 19 nt, Human
gcuggcagcccaucauccu

SEQ ID NO: 1316280 - RNA, 20 nt, Human
ggagauguaaacccuccugc

SEQ ID NO: 1316281 - RNA, 18 nt, Human
ggcucugaggguccuggu

SEQ ID NO: 1316282 - RNA, 21 nt, Human
ggcugcauccucugcaguugc

SEQ ID NO: 1316283 - RNA, 22 nt, Human
gugagccaacacgcccagccca

SEQ ID NO: 1316284 - RNA, 24 nt, Human
guuccuggccuguguuaccguguc

SEQ ID NO: 1316285 - RNA, 24 nt, Human
uaagcagguggcugcauccucugc

SEQ ID NO: 1316286 - RNA, 27 nt, Human
ucagugaccaggagcguuccccgggac

SEQ ID NO: 1316287 - RNA, 19 nt, Human
ugaugggcucugguuccug

SEQ ID NO: 1316288 - RNA, 19 nt, Human
ugcaaggcuggcucuucuu

SEQ ID NO: 1316289 - RNA, 18 nt, Human
uggcagcccaucauccug

SEQ ID NO: 1316290 - RNA, 20 nt, Human
uggcuggcuggcuggacagc

SEQ ID NO: 1316291 - RNA, 20 nt, Human
ugggugugaugaagaugaug

SEQ ID NO: 1316292 - RNA, 19 nt, Human
ugugaugaagaugaugaca

SEQ ID NO: 1316293 - RNA, 24 nt, Human
aaggcccugugguccuucugcccc

SEQ ID NO: 1316294 - RNA, 20 nt, Human
agaaaaacccccgcgaggcu

SEQ ID NO: 1316295 - RNA, 24 nt, Human
caaagcagggccaaacccugaacc

SEQ ID NO: 1316296 - RNA, 22 nt, Human
cagcccggggcaaagcagggcc

SEQ ID NO: 1316297 - RNA, 20 nt, Human
caggaucaggccgccgccuc

SEQ ID NO: 1316298 - RNA, 25 nt, Human
ccagugacaucaaagucagcuuucc

SEQ ID NO: 1316299 - RNA, 18 nt, Human
cccagugacaucaaaguc

SEQ ID NO: 1316300 - RNA, 19 nt, Human
cccugaaccgcuauagccc

SEQ ID NO: 1316301 - RNA, 26 nt, Human
cccugaaccgcuauagcccacgcccu

SEQ ID NO: 1316302 - RNA, 21 nt, Human
ccucuagugccagcccggggc

SEQ ID NO: 1316303 - RNA, 21 nt, Human
ccuucugccccaggaucaggc

SEQ ID NO: 1316304 - RNA, 23 nt, Human
cgggacaagcgaacguugugggg

SEQ ID NO: 1316305 - RNA, 18 nt, Human
cuagugccagcccggggc

SEQ ID NO: 1316306 - RNA, 21 nt, Human
cuauagcccacgcccucuugc

SEQ ID NO: 1316307 - RNA, 19 nt, Human
gcaaagcagggccaaaccc

SEQ ID NO: 1316308 - RNA, 21 nt, Human
gcccacgcccucuugccaaua

SEQ ID NO: 1316309 - RNA, 19 nt, Human
ggcacaggcucuuguccug

SEQ ID NO: 1316310 - RNA, 18 nt, Human
ggcucuuguccuguuugg

SEQ ID NO: 1316311 - RNA, 20 nt, Human
gggcacaggcucuuguccug

SEQ ID NO: 1316312 - RNA, 20 nt, Human
gguuggggcaagauggggcc

SEQ ID NO: 1316313 - RNA, 22 nt, Human
gguuggggcaagauggggccuc

SEQ ID NO: 1316314 - RNA, 18 nt, Human
uagcccacgcccucuugc

SEQ ID NO: 1316315 - RNA, 21 nt, Human
ucuugcauugcaggaaggccc

SEQ ID NO: 1316316 - RNA, 21 nt, Human
ucuuggucgggacaagcgaac

SEQ ID NO: 1316317 - RNA, 21 nt, Human
ugagaaaaacccccgcgaggc

SEQ ID NO: 1316318 - RNA, 19 nt, Human
uggucgggacaagcgaacg

SEQ ID NO: 1316319 - RNA, 24 nt, Human
ugguugguuggggcaagauggggc

SEQ ID NO: 1316320 - RNA, 19 nt, Human
uugugugggcacaggcucu

SEQ ID NO: 1316321 - RNA, 20 nt, Human
caaaaaguugccaugaccca

SEQ ID NO: 1316322 - RNA, 24 nt, Human
caagaaggagcaagucacaucuua

SEQ ID NO: 1316323 - RNA, 22 nt, Human
gggagcuccucuuuuuaaaacc

SEQ ID NO: 1316324 - RNA, 18 nt, Human
ucacagucaugauggaag

SEQ ID NO: 1316325 - RNA, 18 nt, Human
uggaaggcaagaaggagc

SEQ ID NO: 1316326 - RNA, 22 nt, Human
uucauugugccaaaaaguugcc

SEQ ID NO: 1316327 - RNA, 22 nt, Human
ccagauuuccuauuuacaugac

SEQ ID NO: 1316328 - RNA, 18 nt, Human
ccauaccugaagggcugu

SEQ ID NO: 1316329 - RNA, 20 nt, Human
aaaaacaucuuucaaucucc

SEQ ID NO: 1316330 - RNA, 23 nt, Human
aaaaagaaaaucgcugcacucau

SEQ ID NO: 1316331 - RNA, 21 nt, Human
aaaagauguguuuagacagaa

SEQ ID NO: 1316332 - RNA, 29 nt, Human
aaacuccuuuuuuuuuuuuuuuuuuuuuu

SEQ ID NO: 1316333 - RNA, 27 nt, Human
aagcaaacuccuuuuuuuuuuuuuuuu

SEQ ID NO: 1316334 - RNA, 19 nt, Human
aaucucccgacaaaagcaa

SEQ ID NO: 1316335 - RNA, 20 nt, Human
acaaaaagaaaaucgcugca

SEQ ID NO: 1316336 - RNA, 18 nt, Human
acaaagaaagaaacaaaa

SEQ ID NO: 1316337 - RNA, 21 nt, Human
acucuucugucuucuuguccu

SEQ ID NO: 1316338 - RNA, 21 nt, Human
agcaaacuccuuuuuuuuuuu

SEQ ID NO: 1316339 - RNA, 18 nt, Human
agucuguagucaccacag

SEQ ID NO: 1316340 - RNA, 22 nt, Human
aucagcuggaacagcucuuucu

SEQ ID NO: 1316341 - RNA, 22 nt, Human
aucucccgacaaaagcaaacuc

SEQ ID NO: 1316342 - RNA, 19 nt, Human
augacugauuacaaaaaua

SEQ ID NO: 1316343 - RNA, 20 nt, Human
caaagaaagaaacaaaaaca

SEQ ID NO: 1316344 - RNA, 21 nt, Human
caaucucccgacaaaagcaaa

SEQ ID NO: 1316345 - RNA, 19 nt, Human
cacucuagggcaguaugcu

SEQ ID NO: 1316346 - RNA, 19 nt, Human
ccuacaaaaagaaaaucgc

SEQ ID NO: 1316347 - RNA, 18 nt, Human
cgaccugaagaauggcug

SEQ ID NO: 1316348 - RNA, 19 nt, Human
cuaaccaaauguaacugca

SEQ ID NO: 1316349 - RNA, 19 nt, Human
cuagaucagcuggaacagc

SEQ ID NO: 1316350 - RNA, 20 nt, Human
cucacuagagcauuccucua

SEQ ID NO: 1316351 - RNA, 19 nt, Human
cucagagcaggauagagaa

SEQ ID NO: 1316352 - RNA, 18 nt, Human
cugugguccugacguggg

SEQ ID NO: 1316353 - RNA, 22 nt, Human
cuuucuggcagugacauuuuga

SEQ ID NO: 1316354 - RNA, 23 nt, Human
gaguggguacuacuugaagugga

SEQ ID NO: 1316355 - RNA, 18 nt, Human
gccuggggggucuguggu

SEQ ID NO: 1316356 - RNA, 19 nt, Human
gcugggccuggggggucug

SEQ ID NO: 1316357 - RNA, 20 nt, Human
gggccuggggggucuguggu

SEQ ID NO: 1316358 - RNA, 24 nt, Human
gggggucugugguccugacguggg

SEQ ID NO: 1316359 - RNA, 24 nt, Human
uaagaagccaaugacugauuacaa

SEQ ID NO: 1316360 - RNA, 19 nt, Human
uacaaagaaagaaacaaaa

SEQ ID NO: 1316361 - RNA, 23 nt, Human
uacaaagaaagaaacaaaaacau

SEQ ID NO: 1316362 - RNA, 23 nt, Human
uacacuggacgucagcaaacacc

SEQ ID NO: 1316363 - RNA, 26 nt, Human
uagccugugcacuucuguucagauga

SEQ ID NO: 1316364 - RNA, 20 nt, Human
ucaaucucccgacaaaagca

SEQ ID NO: 1316365 - RNA, 21 nt, Human
ucaauuucuacaagaaaucaa

SEQ ID NO: 1316366 - RNA, 24 nt, Human
ucagagcaggauagagaaauuuau

SEQ ID NO: 1316367 - RNA, 18 nt, Human
uccuuuuuuuuuuuuuuu

SEQ ID NO: 1316368 - RNA, 21 nt, Human
ucuagggcaguaugcucuaga

SEQ ID NO: 1316369 - RNA, 21 nt, Human
ucuguacaaguagccugugca

SEQ ID NO: 1316370 - RNA, 22 nt, Human
ucuguagucaccacagagaaga

SEQ ID NO: 1316371 - RNA, 18 nt, Human
ugcugggccugggggguc

SEQ ID NO: 1316372 - RNA, 24 nt, Human
uggcagugacauuuugauuugaac

SEQ ID NO: 1316373 - RNA, 18 nt, Human
uguuauauuucacacaca

SEQ ID NO: 1316374 - RNA, 23 nt, Human
uuaaauuucacauuccuuuaaaa

SEQ ID NO: 1316375 - RNA, 23 nt, Human
uuagccucagagcaggauagaga

SEQ ID NO: 1316376 - RNA, 21 nt, Human
uuguccuacaaaaagaaaauc

SEQ ID NO: 1316377 - RNA, 24 nt, Human
uuuugcuccaaaugcuacgaccug

SEQ ID NO: 1316378 - RNA, 20 nt, Human
uuuuuuuuuuuuuugcucca

SEQ ID NO: 1316379 - RNA, 23 nt, Human
uuuuuuuuuuuuuuuugcuccaa

SEQ ID NO: 1316380 - RNA, 20 nt, Human
uuuuuuuuuuuuuuuuugcu

SEQ ID NO: 1316381 - RNA, 27 nt, Human
uuuuuuuuuuuuuuuuuuuuuuugggg

SEQ ID NO: 1316382 - RNA, 18 nt, Human
acaaagguuccaagggac

SEQ ID NO: 1316383 - RNA, 24 nt, Human
agauaggaagcggcgggcucgggg

SEQ ID NO: 1316384 - RNA, 19 nt, Human
aggaagcggcgggcucggg

SEQ ID NO: 1316385 - RNA, 24 nt, Human
cgcggcggacgggaagccgaugcc

SEQ ID NO: 1316386 - RNA, 21 nt, Human
cgcugagauaggaagcggcgg

SEQ ID NO: 1316387 - RNA, 23 nt, Human
cggcagggcgcugagauaggaag

SEQ ID NO: 1316388 - RNA, 20 nt, Human
gcggacgggaagccgaugcc

SEQ ID NO: 1316389 - RNA, 20 nt, Human
gcggcggcggcggcagggcg

SEQ ID NO: 1316390 - RNA, 23 nt, Human
gcugggccgcggcggcggcggca

SEQ ID NO: 1316391 - RNA, 20 nt, Human
uuuuuuuuuuugagcaaagc

SEQ ID NO: 1316392 - RNA, 18 nt, Human
uuuuuuuuuuuuuuuuug

SEQ ID NO: 1316393 - RNA, 25 nt, Human
aagugaagagucccccucccacccu

SEQ ID NO: 1316394 - RNA, 24 nt, Human
caaucaccaaugucccucccuagc

SEQ ID NO: 1316395 - RNA, 23 nt, Human
ccucgggcugcaacacuuagccc

SEQ ID NO: 1316396 - RNA, 23 nt, Human
cugccagccagagaggugaaagu

SEQ ID NO: 1316397 - RNA, 22 nt, Human
cuuggccugucugggcuggaug

SEQ ID NO: 1316398 - RNA, 20 nt, Human
gucugggcuggaugggagcc

SEQ ID NO: 1316399 - RNA, 21 nt, Human
ugcaacacuuagcccaggacu

SEQ ID NO: 1316400 - RNA, 18 nt, Human
ugccaaucaccaaugucc

SEQ ID NO: 1316401 - RNA, 23 nt, Human
uguggcacuccaggucucuggac

SEQ ID NO: 1316402 - RNA, 19 nt, Human
aaacaaggaucuccggaac

SEQ ID NO: 1316403 - RNA, 22 nt, Human
aaacaucuuccagaucaucacc

SEQ ID NO: 1316404 - RNA, 22 nt, Human
aacaucuuccagaucaucacca

SEQ ID NO: 1316405 - RNA, 18 nt, Human
caccccuuuuggcugcug

SEQ ID NO: 1316406 - RNA, 21 nt, Human
caggacaacauugggcauggg

SEQ ID NO: 1316407 - RNA, 19 nt, Human
caucaccagccucgcuguc

SEQ ID NO: 1316408 - RNA, 23 nt, Human
caucuuccagaucaucaccagcc

SEQ ID NO: 1316409 - RNA, 18 nt, Human
cauugggcaugggucucu

SEQ ID NO: 1316410 - RNA, 22 nt, Human
ccucugguguuguaccuggcuu

SEQ ID NO: 1316411 - RNA, 21 nt, Human
ccuuuucuuacuuccugccuc

SEQ ID NO: 1316412 - RNA, 20 nt, Human
cggcaccaggaucuguguuu

SEQ ID NO: 1316413 - RNA, 20 nt, Human
cucugguguuguaccuggcu

SEQ ID NO: 1316414 - RNA, 24 nt, Human
cugccucuggcucuguccaccccu

SEQ ID NO: 1316415 - RNA, 22 nt, Human
cugguggacccagguuuccucu

SEQ ID NO: 1316416 - RNA, 23 nt, Human
cuuccugccucuggcucugucca

SEQ ID NO: 1316417 - RNA, 21 nt, Human
ggcaugggucucugucucugc

SEQ ID NO: 1316418 - RNA, 26 nt, Human
ggcucuguccaccccuuuuggcugcu

SEQ ID NO: 1316419 - RNA, 18 nt, Human
guaccuggcuuugccagc

SEQ ID NO: 1316420 - RNA, 19 nt, Human
guggacccagguuuccucu

SEQ ID NO: 1316421 - RNA, 20 nt, Human
uaccuggcuuugccagcaac

SEQ ID NO: 1316422 - RNA, 22 nt, Human
ucuguccaccccuuuuggcugc

SEQ ID NO: 1316423 - RNA, 21 nt, Human
ucuguguuuuccuuuucuuac

SEQ ID NO: 1316424 - RNA, 23 nt, Human
ugguggacccagguuuccucugg

SEQ ID NO: 1316425 - RNA, 18 nt, Human
ugguguuguaccuggcuu

SEQ ID NO: 1316426 - RNA, 19 nt, Human
ugucucugcugucugagca

SEQ ID NO: 1316427 - RNA, 21 nt, Human
ugucugagcacaccgaaaauu

SEQ ID NO: 1316428 - RNA, 23 nt, Human
uuccagaucaucaccagccucgc

SEQ ID NO: 1316429 - RNA, 21 nt, Human
uuccucugguguuguaccugg

SEQ ID NO: 1316430 - RNA, 26 nt, Human
aaaagauaaacaaauuagaggccaag

SEQ ID NO: 1316431 - RNA, 23 nt, Human
aaagauaaacaaauuagaggcca

SEQ ID NO: 1316432 - RNA, 23 nt, Human
aaauaaauuaccuaccaaaauau

SEQ ID NO: 1316433 - RNA, 20 nt, Human
aagcggccgagaggcaggag

SEQ ID NO: 1316434 - RNA, 21 nt, Human
aagcggccgagaggcaggagc

SEQ ID NO: 1316435 - RNA, 21 nt, Human
aaguggccgaaaggcaggagc

SEQ ID NO: 1316436 - RNA, 20 nt, Human
agaggcaggaggccgggccc

SEQ ID NO: 1316437 - RNA, 18 nt, Human
aggcaggaggccgggccu

SEQ ID NO: 1316438 - RNA, 22 nt, Human
aggcaggaggccgggccugcaa

SEQ ID NO: 1316439 - RNA, 24 nt, Human
aggcaggaggccgggccugcaaag

SEQ ID NO: 1316440 - RNA, 26 nt, Human
auaauaaggaaaauaaaauaaaaaau

SEQ ID NO: 1316441 - RNA, 23 nt, Human
auggugcagaaacucacuccaaa

SEQ ID NO: 1316442 - RNA, 20 nt, Human
caaaaaguugccaugaccca

SEQ ID NO: 1316443 - RNA, 21 nt, Human
caggcaggagcuggaccuggu

SEQ ID NO: 1316444 - RNA, 18 nt, Human
cccgugcaggccuuugag

SEQ ID NO: 1316445 - RNA, 22 nt, Human
cgggagcugggccugccgaagc

SEQ ID NO: 1316446 - RNA, 18 nt, Human
cuaaagaggccacuggca

SEQ ID NO: 1316447 - RNA, 18 nt, Human
cugaagaggccacuggca

SEQ ID NO: 1316448 - RNA, 18 nt, Human
cugggccuaaagaggcca

SEQ ID NO: 1316449 - RNA, 25 nt, Human
gccgaaaggcaggagcuuuggacug

SEQ ID NO: 1316450 - RNA, 18 nt, Human
gcgggagcugggccugcc

SEQ ID NO: 1316451 - RNA, 21 nt, Human
ggaagggaaaaacggggccug

SEQ ID NO: 1316452 - RNA, 20 nt, Human
ggaggccgggccugcaaagg

SEQ ID NO: 1316453 - RNA, 19 nt, Human
gugaggcagaggcugggcc

SEQ ID NO: 1316454 - RNA, 21 nt, Human
uaaacaaauuagaggccaaga

SEQ ID NO: 1316455 - RNA, 20 nt, Human
uaaauaauaaggaaaauaaa

SEQ ID NO: 1316456 - RNA, 20 nt, Human
uccgcugugaggcagaggcu

SEQ ID NO: 1316457 - RNA, 19 nt, Human
ugaaguggccgaaaggcag

SEQ ID NO: 1316458 - RNA, 18 nt, Human
ugagaggcaggaggccgg

SEQ ID NO: 1316459 - RNA, 18 nt, Human
ugaggcagaggcugggcc

SEQ ID NO: 1316460 - RNA, 18 nt, Human
ugaggcagaggcugggcc

SEQ ID NO: 1316461 - RNA, 25 nt, Human
ugccggaagggaaaaacggggccug

SEQ ID NO: 1316462 - RNA, 22 nt, Human
uggcaggcaggagcuggaccug

SEQ ID NO: 1316463 - RNA, 22 nt, Human
uggcaggcgggagcugggccug

SEQ ID NO: 1316464 - RNA, 21 nt, Human
uggcauggugcagaaacucac

SEQ ID NO: 1316465 - RNA, 20 nt, Human
ugggccuaaagaggccacug

SEQ ID NO: 1316466 - RNA, 18 nt, Human
uggggaggccacagugag

SEQ ID NO: 1316467 - RNA, 18 nt, Human
ugugaggaaugagcuggg

SEQ ID NO: 1316468 - RNA, 18 nt, Human
ugugaggcagaggcuggg

SEQ ID NO: 1316469 - RNA, 22 nt, Human
uucacugugccaaaaaguugcc

SEQ ID NO: 1316470 - RNA, 18 nt, Human
uugugaggaaugagcugg

SEQ ID NO: 1316471 - RNA, 20 nt, Human
aaaagaagaaaauaugucag

SEQ ID NO: 1316472 - RNA, 19 nt, Human
aaaaucaagauacuggcca

SEQ ID NO: 1316473 - RNA, 22 nt, Human
aaacagcuggaccacaagucgu

SEQ ID NO: 1316474 - RNA, 18 nt, Human
aaagacuagagaagaggc

SEQ ID NO: 1316475 - RNA, 23 nt, Human
aacuacaucccuuuucugcucuc

SEQ ID NO: 1316476 - RNA, 20 nt, Human
aagcagccaugcccuucagg

SEQ ID NO: 1316477 - RNA, 19 nt, Human
acaauggcaacuacauccc

SEQ ID NO: 1316478 - RNA, 21 nt, Human
acaugacagugcauauacaua

SEQ ID NO: 1316479 - RNA, 22 nt, Human
acucauuucguucuucuuuucu

SEQ ID NO: 1316480 - RNA, 26 nt, Human
agaaauccaaaaucaagauacuggcc

SEQ ID NO: 1316481 - RNA, 18 nt, Human
agagcagcuguccuauug

SEQ ID NO: 1316482 - RNA, 22 nt, Human
agccggaacuugauaagacacc

SEQ ID NO: 1316483 - RNA, 24 nt, Human
auagcaacugcccagcgugaacaa

SEQ ID NO: 1316484 - RNA, 20 nt, Human
aucacaaucuccaauuuauc

SEQ ID NO: 1316485 - RNA, 19 nt, Human
auccuuggcaaucccaugg

SEQ ID NO: 1316486 - RNA, 23 nt, Human
aucuguuuauggaagagcagcug

SEQ ID NO: 1316487 - RNA, 22 nt, Human
caaacaauugaaaagaagaaaa

SEQ ID NO: 1316488 - RNA, 28 nt, Human
cacacagccggaacuugauaagacaccc

SEQ ID NO: 1316489 - RNA, 20 nt, Human
cacugucaccuucacagagg

SEQ ID NO: 1316490 - RNA, 20 nt, Human
cacugucaccuucacagagg

SEQ ID NO: 1316491 - RNA, 25 nt, Human
cagaacccucucuuccaugccagcc

SEQ ID NO: 1316492 - RNA, 19 nt, Human
cagaauagcaacugcccag

SEQ ID NO: 1316493 - RNA, 24 nt, Human
cagaauagccaaaggcuuaggagc

SEQ ID NO: 1316494 - RNA, 21 nt, Human
cagccggaacuugauaagaca

SEQ ID NO: 1316495 - RNA, 22 nt, Human
cauccaauacuuaaccacagcc

SEQ ID NO: 1316496 - RNA, 21 nt, Human
cauuuucauuucuagagaggg

SEQ ID NO: 1316497 - RNA, 20 nt, Human
ccaaaggcuuaggagcagcc

SEQ ID NO: 1316498 - RNA, 22 nt, Human
ccaauacuuaaccacagccaaa

SEQ ID NO: 1316499 - RNA, 18 nt, Human
cccagaaagaagauaaug

SEQ ID NO: 1316500 - RNA, 19 nt, Human
cccaugcugcacacagccg

SEQ ID NO: 1316501 - RNA, 22 nt, Human
cccaugcugcacacagccggaa

SEQ ID NO: 1316502 - RNA, 23 nt, Human
ccccaaagaauugugauacuacc

SEQ ID NO: 1316503 - RNA, 20 nt, Human
ccggaacuugauaagacacc

SEQ ID NO: 1316504 - RNA, 26 nt, Human
cucaauuucuuaaaguggagccccaa

SEQ ID NO: 1316505 - RNA, 24 nt, Human
cucuucaaagauauuucaugauga

SEQ ID NO: 1316506 - RNA, 21 nt, Human
cucuuuccugaggcuuccuag

SEQ ID NO: 1316507 - RNA, 24 nt, Human
cuucagggugaaucaaacaauuga

SEQ ID NO: 1316508 - RNA, 20 nt, Human
cuucccuugucuuuucucuc

SEQ ID NO: 1316509 - RNA, 19 nt, Human
gauaagacacccagaaaga

SEQ ID NO: 1316510 - RNA, 23 nt, Human
gcacaaaacccagaauuacugca

SEQ ID NO: 1316511 - RNA, 21 nt, Human
gccccauccccauuccucaug

SEQ ID NO: 1316512 - RNA, 18 nt, Human
gcugcuaucaagcugucu

SEQ ID NO: 1316513 - RNA, 19 nt, Human
gucaccuucacagagggca

SEQ ID NO: 1316514 - RNA, 22 nt, Human
uaaaguggagccccaaagaauu

SEQ ID NO: 1316515 - RNA, 18 nt, Human
uaacgcaggauggagucu

SEQ ID NO: 1316516 - RNA, 18 nt, Human
uaagguagguaggucuca

SEQ ID NO: 1316517 - RNA, 21 nt, Human
uaaucauauccagucacagga

SEQ ID NO: 1316518 - RNA, 18 nt, Human
uagacaaggaugcaugua

SEQ ID NO: 1316519 - RNA, 22 nt, Human
uauaggcaagcccgguauuccu

SEQ ID NO: 1316520 - RNA, 22 nt, Human
uaucacccaugcugcacacagc

SEQ ID NO: 1316521 - RNA, 21 nt, Human
uaucccacaagggucccacca

SEQ ID NO: 1316522 - RNA, 21 nt, Human
ucacaaucuccaauuuaucca

SEQ ID NO: 1316523 - RNA, 26 nt, Human
ucaucacaaucuccaauuuauccagg

SEQ ID NO: 1316524 - RNA, 21 nt, Human
uccaauacuuaaccacagcca

SEQ ID NO: 1316525 - RNA, 24 nt, Human
uccagucacaggaugugcuuaaaa

SEQ ID NO: 1316526 - RNA, 24 nt, Human
ucccuugucuuuucucucuucaaa

SEQ ID NO: 1316527 - RNA, 22 nt, Human
ucccuuuucugcucucuuggga

SEQ ID NO: 1316528 - RNA, 23 nt, Human
ucucuuuccugaggcuuccuagg

SEQ ID NO: 1316529 - RNA, 22 nt, Human
ugaaucaaacaauugaaaagaa

SEQ ID NO: 1316530 - RNA, 20 nt, Human
ugagaaauccaaaaucaaga

SEQ ID NO: 1316531 - RNA, 18 nt, Human
ugcaauaaacagcuggac

SEQ ID NO: 1316532 - RNA, 22 nt, Human
ugcacaaaacccagaauuacug

SEQ ID NO: 1316533 - RNA, 22 nt, Human
ugcacugaacagaauagccaaa

SEQ ID NO: 1316534 - RNA, 21 nt, Human
ugccagccccauccccauucc

SEQ ID NO: 1316535 - RNA, 22 nt, Human
ugcggucagucaucuucccacc

SEQ ID NO: 1316536 - RNA, 18 nt, Human
uggaagauuugaaagcug

SEQ ID NO: 1316537 - RNA, 19 nt, Human
uggaagauuugaaagcugg

SEQ ID NO: 1316538 - RNA, 20 nt, Human
uggcuguugcugaacagcag

SEQ ID NO: 1316539 - RNA, 18 nt, Human
ugggaggacguuguaaug

SEQ ID NO: 1316540 - RNA, 27 nt, Human
ugucauuguucucguuucuuuugagcc

SEQ ID NO: 1316541 - RNA, 24 nt, Human
uguggauguuacuuuccugucuuu

SEQ ID NO: 1316542 - RNA, 23 nt, Human
uguuuugcauuucaugaaaucuc

SEQ ID NO: 1316543 - RNA, 22 nt, Human
uucaugaaaucucagagucaga

SEQ ID NO: 1316544 - RNA, 19 nt, Human
uucucaguucugagagauu

SEQ ID NO: 1316545 - RNA, 19 nt, Human
uuggaagauuugaaagcug

SEQ ID NO: 1316546 - RNA, 21 nt, Human
uuuaaaauaugcacaaaaccc

SEQ ID NO: 1316547 - RNA, 20 nt, Human
uuuaucuguccaccuaucuu

SEQ ID NO: 1316548 - RNA, 18 nt, Human
uuucacugaggcuuacac

SEQ ID NO: 1316549 - RNA, 23 nt, Human
uuuugcauuucaugaaaucucag

SEQ ID NO: 1316550 - RNA, 19 nt, Human
agcagcaucaccagauggc

SEQ ID NO: 1316551 - RNA, 24 nt, Human
auccugguggguauggguaccugg

SEQ ID NO: 1316552 - RNA, 18 nt, Human
cacagcacagggcagggc

SEQ ID NO: 1316553 - RNA, 22 nt, Human
cacagcacagggcagggcugga

SEQ ID NO: 1316554 - RNA, 21 nt, Human
cagcaggcucagggguggcgc

SEQ ID NO: 1316555 - RNA, 24 nt, Human
cagggcuggacccaagcuuagguu

SEQ ID NO: 1316556 - RNA, 23 nt, Human
gaccaugggucaucaagcucuuu

SEQ ID NO: 1316557 - RNA, 19 nt, Human
gcacagggcagggcuggac

SEQ ID NO: 1316558 - RNA, 23 nt, Human
gccagagggcaggaacaggguca

SEQ ID NO: 1316559 - RNA, 21 nt, Human
gcccuguggaccauggguccc

SEQ ID NO: 1316560 - RNA, 22 nt, Human
gcucagggguggcgcacugggg

SEQ ID NO: 1316561 - RNA, 23 nt, Human
gggcuggacccaagcuuagguuc

SEQ ID NO: 1316562 - RNA, 28 nt, Human
ggggggcuggaucccaggcuuuugggag

SEQ ID NO: 1316563 - RNA, 19 nt, Human
guggccagagggcaggaac

SEQ ID NO: 1316564 - RNA, 21 nt, Human
uaccugcggagagucagcagc

SEQ ID NO: 1316565 - RNA, 21 nt, Human
uauggguaccugcggagaguc

SEQ ID NO: 1316566 - RNA, 21 nt, Human
ucagggguggcgcacuggggc

SEQ ID NO: 1316567 - RNA, 19 nt, Human
uggcagagagccuagugcc

SEQ ID NO: 1316568 - RNA, 21 nt, Human
uggccagagggcaggaacagg

SEQ ID NO: 1316569 - RNA, 20 nt, Human
uggcgggggggcuggauccc

SEQ ID NO: 1316570 - RNA, 19 nt, Human
uggguaccugcggagaguc

SEQ ID NO: 1316571 - RNA, 21 nt, Human
uggguaccugcggagagucag

SEQ ID NO: 1316572 - RNA, 25 nt, Human
ugguagcgucuguagcuuaggcagg

SEQ ID NO: 1316573 - RNA, 19 nt, Human
cagcugcagccgggggacg

SEQ ID NO: 1316574 - RNA, 19 nt, Human
gcagcugcagccgggggac

SEQ ID NO: 1316575 - RNA, 22 nt, Human
acaggcaagaaccugggugggu

SEQ ID NO: 1316576 - RNA, 19 nt, Human
agaugagccccccaccccc

SEQ ID NO: 1316577 - RNA, 28 nt, Human
auggcgcaccaggagaugagccccccac

SEQ ID NO: 1316578 - RNA, 22 nt, Human
caacaggcaagaaccugggugg

SEQ ID NO: 1316579 - RNA, 18 nt, Human
caaggcuccuuccacugg

SEQ ID NO: 1316580 - RNA, 18 nt, Human
cacuggaguugccuuugc

SEQ ID NO: 1316581 - RNA, 19 nt, Human
cagaaggaugcagauggcg

SEQ ID NO: 1316582 - RNA, 18 nt, Human
cagcccagaaggaugcag

SEQ ID NO: 1316583 - RNA, 26 nt, Human
cauccuucagcccuggaggugcgccc

SEQ ID NO: 1316584 - RNA, 23 nt, Human
ccccaggcuauccaaggcuccuu

SEQ ID NO: 1316585 - RNA, 23 nt, Human
ccccccaccccccaggcuaucca

SEQ ID NO: 1316586 - RNA, 18 nt, Human
ccuuccacuggaguugcc

SEQ ID NO: 1316587 - RNA, 30 nt, Human
cgcaccaggagaugagccccccaccccccu

SEQ ID NO: 1316588 - RNA, 23 nt, Human
gaaggaugcagauggcgcaccag

SEQ ID NO: 1316589 - RNA, 19 nt, Human
gcccuggaggugcgcccug

SEQ ID NO: 1316590 - RNA, 18 nt, Human
ucccagcccagaaggaug

SEQ ID NO: 1316591 - RNA, 19 nt, Human
ugagccccccaccccccag

SEQ ID NO: 1316592 - RNA, 19 nt, Human
ugagccccccaccccccag

SEQ ID NO: 1316593 - RNA, 22 nt, Human
ugggugggugcccggcccugca

SEQ ID NO: 1316594 - RNA, 21 nt, Human
aaacgccccuguccuggacca

SEQ ID NO: 1316595 - RNA, 26 nt, Human
aaaugccggaagucccgccccaagcu

SEQ ID NO: 1316596 - RNA, 19 nt, Human
agcuagguccagcuggccc

SEQ ID NO: 1316597 - RNA, 25 nt, Human
caacccacaggaaacgccccugucc

SEQ ID NO: 1316598 - RNA, 19 nt, Human
cccgccccaagcuucgcaa

SEQ ID NO: 1316599 - RNA, 23 nt, Human
cgcaacccacaggaaacgccccu

SEQ ID NO: 1316600 - RNA, 24 nt, Human
cuuguaguuaauguaguuuuucuc

SEQ ID NO: 1316601 - RNA, 22 nt, Human
gccccagggcccgccgucgcac

SEQ ID NO: 1316602 - RNA, 23 nt, Human
uagguccagcuggccccacuccu

SEQ ID NO: 1316603 - RNA, 28 nt, Human
ucacagacacgucccauccaaaugccgg

SEQ ID NO: 1316604 - RNA, 21 nt, Human
uccuggaccaucauuggcccc

SEQ ID NO: 1316605 - RNA, 19 nt, Human
uggaccaucauuggcccca

SEQ ID NO: 1316606 - RNA, 21 nt, Human
aagcuccaggagcugauaugg

SEQ ID NO: 1316607 - RNA, 21 nt, Human
agcugauaugggcaccaggcc

SEQ ID NO: 1316608 - RNA, 18 nt, Human
aggcgcggcaccgagggc

SEQ ID NO: 1316609 - RNA, 18 nt, Human
caggagcugauaugggca

SEQ ID NO: 1316610 - RNA, 19 nt, Human
ccccggaagcugcugcugc

SEQ ID NO: 1316611 - RNA, 20 nt, Human
ccccggaagcugcugcugcc

SEQ ID NO: 1316612 - RNA, 22 nt, Human
cggggaugcggggggcagcggg

SEQ ID NO: 1316613 - RNA, 21 nt, Human
gagcggggaugcggggggcag

SEQ ID NO: 1316614 - RNA, 20 nt, Human
gcuccgagcguuggagcgga

SEQ ID NO: 1316615 - RNA, 20 nt, Human
ggaagcugcugcugccgccc

SEQ ID NO: 1316616 - RNA, 20 nt, Human
ggagcggggaugcggggggc

SEQ ID NO: 1316617 - RNA, 19 nt, Human
ggaugcggggggcagcggg

SEQ ID NO: 1316618 - RNA, 22 nt, Human
ggccaccccggaagcugcugcu

SEQ ID NO: 1316619 - RNA, 22 nt, Human
ugcccaggccaccccggaagcu

SEQ ID NO: 1316620 - RNA, 19 nt, Human
ugcggggggcagcgggcug

SEQ ID NO: 1316621 - RNA, 21 nt, Human
ugcggggggcagcgggcuggg

SEQ ID NO: 1316622 - RNA, 19 nt, Human
uuggagcggagcggggaug

SEQ ID NO: 1316623 - RNA, 21 nt, Human
uuggagcggagcggggaugcg

SEQ ID NO: 1316624 - RNA, 26 nt, Human
agaagcagcaggaggaaccauguggc

SEQ ID NO: 1316625 - RNA, 20 nt, Human
aggucuucuuagcuccaccu

SEQ ID NO: 1316626 - RNA, 20 nt, Human
cagcaggaggaaccaugugg

SEQ ID NO: 1316627 - RNA, 24 nt, Human
caggcauccuucgugugaccaaaa

SEQ ID NO: 1316628 - RNA, 28 nt, Human
caggcauccuucgugugaccaaaauucu

SEQ ID NO: 1316629 - RNA, 25 nt, Human
ccaaaauucuccgaccuuggauguu

SEQ ID NO: 1316630 - RNA, 18 nt, Human
cccgcaucacaucacacc

SEQ ID NO: 1316631 - RNA, 19 nt, Human
cccgcaucacaucacacca

SEQ ID NO: 1316632 - RNA, 20 nt, Human
cccgcaucacaucacaccac

SEQ ID NO: 1316633 - RNA, 21 nt, Human
cccgcaucacaucacaccaca

SEQ ID NO: 1316634 - RNA, 21 nt, Human
cgacuuuccuccccgaucccc

SEQ ID NO: 1316635 - RNA, 18 nt, Human
cgcaucacaucacaccac

SEQ ID NO: 1316636 - RNA, 22 nt, Human
cgcaucacaucacaccacaucu

SEQ ID NO: 1316637 - RNA, 22 nt, Human
cucuguuuugcgcucuccucug

SEQ ID NO: 1316638 - RNA, 24 nt, Human
gauguuucugaggucuucuuagcu

SEQ ID NO: 1316639 - RNA, 21 nt, Human
gcaucacaucacaccacaucu

SEQ ID NO: 1316640 - RNA, 19 nt, Human
ucccagcaccacgcucucc

SEQ ID NO: 1316641 - RNA, 21 nt, Human
uccgccggcuucccccugccc

SEQ ID NO: 1316642 - RNA, 21 nt, Human
ucugagcuugagucuuuugcc

SEQ ID NO: 1316643 - RNA, 21 nt, Human
ugugaccaaaauucuccgacc

SEQ ID NO: 1316644 - RNA, 25 nt, Human
uuccuccccgauccccuuuccgccg

SEQ ID NO: 1316645 - RNA, 22 nt, Human
agcaccgguuccuccaccaccc

SEQ ID NO: 1316646 - RNA, 18 nt, Human
agggcuggccaggcagag

SEQ ID NO: 1316647 - RNA, 19 nt, Human
cacgguguggcccgagggc

SEQ ID NO: 1316648 - RNA, 21 nt, Human
cugagcaccgguuccuccacc

SEQ ID NO: 1316649 - RNA, 22 nt, Human
gaagggacagagggucacggug

SEQ ID NO: 1316650 - RNA, 20 nt, Human
gcccugggucccagccuggu

SEQ ID NO: 1316651 - RNA, 19 nt, Human
gucacgguguggcccgagg

SEQ ID NO: 1316652 - RNA, 22 nt, Human
uccaccacccacauauggugau

SEQ ID NO: 1316653 - RNA, 18 nt, Human
uggccaggcagagcgggu

SEQ ID NO: 1316654 - RNA, 19 nt, Human
uggcccugggucccagccu

SEQ ID NO: 1316655 - RNA, 18 nt, Human
ugguacccagcaccuuca

SEQ ID NO: 1316656 - RNA, 22 nt, Human
uggugaugcauagacacguugu

SEQ ID NO: 1316657 - RNA, 19 nt, Human
uuacugcacuugacggaga

SEQ ID NO: 1316658 - RNA, 27 nt, Human
uugaagaguugccagcgggccaggagg

SEQ ID NO: 1316659 - RNA, 18 nt, Human
ccagggcuaggggggggg

SEQ ID NO: 1316660 - RNA, 23 nt, Human
cuagggggggggcccagcagggc

SEQ ID NO: 1316661 - RNA, 18 nt, Human
gcaaagccuucucagaag

SEQ ID NO: 1316662 - RNA, 18 nt, Human
gccucggcagguacgagg

SEQ ID NO: 1316663 - RNA, 22 nt, Human
ggggcccagcagggccuggggc

SEQ ID NO: 1316664 - RNA, 20 nt, Human
uaccuccagcaacuuaguca

SEQ ID NO: 1316665 - RNA, 19 nt, Human
uccagggcuaggggggggg

SEQ ID NO: 1316666 - RNA, 21 nt, Human
cgaagggcuugccugcccaca

SEQ ID NO: 1316667 - RNA, 21 nt, Human
cugacacgaggggaggggucu

SEQ ID NO: 1316668 - RNA, 18 nt, Human
gagcugccugagcugaca

SEQ ID NO: 1316669 - RNA, 24 nt, Human
uaaggaagcgguacgaacuccacg

SEQ ID NO: 1316670 - RNA, 24 nt, Human
uagccuguggccaccccggagaug

SEQ ID NO: 1316671 - RNA, 25 nt, Human
uagccuguggccaccccggagauga

SEQ ID NO: 1316672 - RNA, 21 nt, Human
uagcgagucuuaucauugucc

SEQ ID NO: 1316673 - RNA, 23 nt, Human
ucacaugacucuagacacuuggu

SEQ ID NO: 1316674 - RNA, 21 nt, Human
ucccggagcucuagggccuca

SEQ ID NO: 1316675 - RNA, 18 nt, Human
ucgggggccucgagcucc

SEQ ID NO: 1316676 - RNA, 18 nt, Human
ucuagacacuugguggaa

SEQ ID NO: 1316677 - RNA, 24 nt, Human
ugacacgaggggaggggucugugu

SEQ ID NO: 1316678 - RNA, 24 nt, Human
ugacuugggccaauuacacgacug

SEQ ID NO: 1316679 - RNA, 19 nt, Human
ugagcugacacgaggggag

SEQ ID NO: 1316680 - RNA, 24 nt, Human
ugaggcgagaaaaacaaugacuug

SEQ ID NO: 1316681 - RNA, 21 nt, Human
uggccaccccggagaugacac

SEQ ID NO: 1316682 - RNA, 25 nt, Human
aaacaucaccuccucaaugaaguuu

SEQ ID NO: 1316683 - RNA, 26 nt, Human
aaagaauggaagaauagacagaggga

SEQ ID NO: 1316684 - RNA, 18 nt, Human
aaauauuggaagccuaca

SEQ ID NO: 1316685 - RNA, 21 nt, Human
aacccaaaagcaaacguuugg

SEQ ID NO: 1316686 - RNA, 21 nt, Human
aagaaggccagugggcagugc

SEQ ID NO: 1316687 - RNA, 23 nt, Human
aagcagaugugggagcagcccac

SEQ ID NO: 1316688 - RNA, 26 nt, Human
aagcauugggauuacagguguaagcc

SEQ ID NO: 1316689 - RNA, 18 nt, Human
aauccagucaccauguug

SEQ ID NO: 1316690 - RNA, 23 nt, Human
accacuucccuauggagccccua

SEQ ID NO: 1316691 - RNA, 23 nt, Human
acuucccuauggagccccuacug

SEQ ID NO: 1316692 - RNA, 18 nt, Human
acuuggcucugucuauaa

SEQ ID NO: 1316693 - RNA, 26 nt, Human
agacaggaauaaguaaaucaacccaa

SEQ ID NO: 1316694 - RNA, 21 nt, Human
agccagcaccaacgcuggaca

SEQ ID NO: 1316695 - RNA, 26 nt, Human
aggaauagcaggaggaccuacuucag

SEQ ID NO: 1316696 - RNA, 18 nt, Human
aggcacugaaggaagacc

SEQ ID NO: 1316697 - RNA, 21 nt, Human
aggucaucgaaacgauacagc

SEQ ID NO: 1316698 - RNA, 21 nt, Human
agucucgcuauguugcccagg

SEQ ID NO: 1316699 - RNA, 18 nt, Human
auguugcccaggcugguc

SEQ ID NO: 1316700 - RNA, 24 nt, Human
caaagcauugggauuacaggugua

SEQ ID NO: 1316701 - RNA, 22 nt, Human
caagaacuucuuucuagguaga

SEQ ID NO: 1316702 - RNA, 24 nt, Human
cacagucucgcuauguugcccagg

SEQ ID NO: 1316703 - RNA, 23 nt, Human
cacuucccuauggagccccuacu

SEQ ID NO: 1316704 - RNA, 19 nt, Human
cagaggaaauaaaagaagg

SEQ ID NO: 1316705 - RNA, 25 nt, Human
cagccuucagccccagacugagccu

SEQ ID NO: 1316706 - RNA, 22 nt, Human
cagucucgcuauguugcccagg

SEQ ID NO: 1316707 - RNA, 22 nt, Human
caguggauggauggauguuugg

SEQ ID NO: 1316708 - RNA, 20 nt, Human
caugugaacaaacacgugcg

SEQ ID NO: 1316709 - RNA, 21 nt, Human
ccaaagcauugggauuacagg

SEQ ID NO: 1316710 - RNA, 24 nt, Human
ccaaagcauugggauuacaggugu

SEQ ID NO: 1316711 - RNA, 21 nt, Human
ccagcaccaacgcuggacaug

SEQ ID NO: 1316712 - RNA, 23 nt, Human
cccacauggagaggaacugaggu

SEQ ID NO: 1316713 - RNA, 33 nt, Human
cccagccuucagccccagacugagccucaaccg

SEQ ID NO: 1316714 - RNA, 27 nt, Human
ccccagccuucagccccagacugagcc

SEQ ID NO: 1316715 - RNA, 21 nt, Human
ccuaaugccugcccucuugga

SEQ ID NO: 1316716 - RNA, 21 nt, Human
ccucucacugacagauggggc

SEQ ID NO: 1316717 - RNA, 22 nt, Human
ccugcacacaguacuuucuaag

SEQ ID NO: 1316718 - RNA, 31 nt, Human
cgcuauguugcccaggcuggucaugaacucc

SEQ ID NO: 1316719 - RNA, 20 nt, Human
cuagagccacagaaucugug

SEQ ID NO: 1316720 - RNA, 19 nt, Human
cugacagauggggcacagg

SEQ ID NO: 1316721 - RNA, 28 nt, Human
cuuccagucuggucagggaaggaaaacc

SEQ ID NO: 1316722 - RNA, 23 nt, Human
cuuucuaaguucacucaaugcca

SEQ ID NO: 1316723 - RNA, 20 nt, Human
gaaauaaaagaaggccagug

SEQ ID NO: 1316724 - RNA, 18 nt, Human
gaagccuacauauuuuuc

SEQ ID NO: 1316725 - RNA, 22 nt, Human
gaggaauagcaggaggaccuac

SEQ ID NO: 1316726 - RNA, 18 nt, Human
gaggggaaguacgugaag

SEQ ID NO: 1316727 - RNA, 21 nt, Human
gauggauggauguuuggaugg

SEQ ID NO: 1316728 - RNA, 21 nt, Human
gauggauguuuggauggaugg

SEQ ID NO: 1316729 - RNA, 30 nt, Human
gaugugggagcagcccacauggagaggaaa

SEQ ID NO: 1316730 - RNA, 18 nt, Human
gauuacagguguaagcca

SEQ ID NO: 1316731 - RNA, 21 nt, Human
gauuacagguguaagccacug

SEQ ID NO: 1316732 - RNA, 24 nt, Human
gauuacagguguaagccacugugc

SEQ ID NO: 1316733 - RNA, 20 nt, Human
gccccagacugagccucaac

SEQ ID NO: 1316734 - RNA, 18 nt, Human
gccgaagcagauguggga

SEQ ID NO: 1316735 - RNA, 23 nt, Human
ggaaauaaaagaaggccaguggg

SEQ ID NO: 1316736 - RNA, 24 nt, Human
ggaaugagguucuucaggagagga

SEQ ID NO: 1316737 - RNA, 20 nt, Human
ggagaggaauagcaggagga

SEQ ID NO: 1316738 - RNA, 18 nt, Human
ggauggaagguuguaugg

SEQ ID NO: 1316739 - RNA, 18 nt, Human
ggauggguggaugaaugg

SEQ ID NO: 1316740 - RNA, 24 nt, Human
ggauuacagguguaagccacugug

SEQ ID NO: 1316741 - RNA, 25 nt, Human
gggaaugagguucuucaggagagga

SEQ ID NO: 1316742 - RNA, 21 nt, Human
gguaggcucugggguaggcac

SEQ ID NO: 1316743 - RNA, 18 nt, Human
gguauucccuaggggugu

SEQ ID NO: 1316744 - RNA, 19 nt, Human
gguggaugaauggaggaag

SEQ ID NO: 1316745 - RNA, 22 nt, Human
gugcgcccugagaggacuucag

SEQ ID NO: 1316746 - RNA, 20 nt, Human
guggauggauggauguuugg

SEQ ID NO: 1316747 - RNA, 21 nt, Human
gugggccagguaggcucuggg

SEQ ID NO: 1316748 - RNA, 23 nt, Human
uaaaagaaggccagugggcagug

SEQ ID NO: 1316749 - RNA, 22 nt, Human
uaaagcucucaccucggucucc

SEQ ID NO: 1316750 - RNA, 26 nt, Human
uaaagcucucaccucggucucccaaa

SEQ ID NO: 1316751 - RNA, 21 nt, Human
uaaguaaaucaacccaaaagc

SEQ ID NO: 1316752 - RNA, 24 nt, Human
uaaguaaaucaacccaaaagcaaa

SEQ ID NO: 1316753 - RNA, 27 nt, Human
uaaguaaaucaacccaaaagcaaacgu

SEQ ID NO: 1316754 - RNA, 24 nt, Human
uacagguguaagccacugugccca

SEQ ID NO: 1316755 - RNA, 27 nt, Human
uagaagaguauauaaaaguguuaaaaa

SEQ ID NO: 1316756 - RNA, 18 nt, Human
uaggacaaaacuuuugac

SEQ ID NO: 1316757 - RNA, 25 nt, Human
uaugauggacauuccucucacugac

SEQ ID NO: 1316758 - RNA, 19 nt, Human
uauguugcccaggcugguc

SEQ ID NO: 1316759 - RNA, 23 nt, Human
uauguugcccaggcuggucauga

SEQ ID NO: 1316760 - RNA, 24 nt, Human
uauguugcccaggcuggucaugaa

SEQ ID NO: 1316761 - RNA, 19 nt, Human
ucaacccaaaagcaaacgu

SEQ ID NO: 1316762 - RNA, 22 nt, Human
ucaaugaaguuuacccaaaacc

SEQ ID NO: 1316763 - RNA, 25 nt, Human
ucaggagaggaauagcaggaggacc

SEQ ID NO: 1316764 - RNA, 18 nt, Human
ucagggagacaggaauaa

SEQ ID NO: 1316765 - RNA, 23 nt, Human
ucccaaagcauugggauuacagg

SEQ ID NO: 1316766 - RNA, 21 nt, Human
ucucacucucuauacucgccc

SEQ ID NO: 1316767 - RNA, 19 nt, Human
ucucgcuauguugcccagg

SEQ ID NO: 1316768 - RNA, 23 nt, Human
ucucgcuauguugcccaggcugg

SEQ ID NO: 1316769 - RNA, 24 nt, Human
ucucgcuauguugcccaggcuggu

SEQ ID NO: 1316770 - RNA, 26 nt, Human
ucucgcuauguugcccaggcugguca

SEQ ID NO: 1316771 - RNA, 27 nt, Human
ucucgcuauguugcccaggcuggucau

SEQ ID NO: 1316772 - RNA, 18 nt, Human
ugaaguuuacccaaaacc

SEQ ID NO: 1316773 - RNA, 19 nt, Human
ugaauggaggaagggcaga

SEQ ID NO: 1316774 - RNA, 24 nt, Human
ugaggucagaugacagccagcacc

SEQ ID NO: 1316775 - RNA, 18 nt, Human
ugauccuuacaauaacau

SEQ ID NO: 1316776 - RNA, 21 nt, Human
ugccauggauuuguucagugg

SEQ ID NO: 1316777 - RNA, 22 nt, Human
ugccugcccucuuggagcuucc

SEQ ID NO: 1316778 - RNA, 26 nt, Human
uggaagaauagacagagggaugggug

SEQ ID NO: 1316779 - RNA, 19 nt, Human
uggagaggaacugagguca

SEQ ID NO: 1316780 - RNA, 21 nt, Human
ugggauuacagguguaagcca

SEQ ID NO: 1316781 - RNA, 22 nt, Human
ugggauuacagguguaagccac

SEQ ID NO: 1316782 - RNA, 22 nt, Human
ugggauuacagguguaagccac

SEQ ID NO: 1316783 - RNA, 22 nt, Human
ugggauuacagguguaagccac

SEQ ID NO: 1316784 - RNA, 24 nt, Human
ugggauuacagguguaagccacug

SEQ ID NO: 1316785 - RNA, 25 nt, Human
ugucaggcugugucucuccagggau

SEQ ID NO: 1316786 - RNA, 19 nt, Human
uguuacauagccauagaaa

SEQ ID NO: 1316787 - RNA, 23 nt, Human
uucagccccagacugagccucaa

SEQ ID NO: 1316788 - RNA, 24 nt, Human
uucaggagaggaauagcaggagga

SEQ ID NO: 1316789 - RNA, 18 nt, Human
uuccagucuggucaggga

SEQ ID NO: 1316790 - RNA, 23 nt, Human
uucccuauggagccccuacugug

SEQ ID NO: 1316791 - RNA, 21 nt, Human
uugggauuacagguguaagcc

SEQ ID NO: 1316792 - RNA, 23 nt, Human
uuuacaguaugauggacauuccu

SEQ ID NO: 1316793 - RNA, 19 nt, Human
uuugggguaguuuguuaca

SEQ ID NO: 1316794 - RNA, 20 nt, Human
uuuguuacauagccauagaa

SEQ ID NO: 1316795 - RNA, 19 nt, Human
uuuguucaguggauggaug

SEQ ID NO: 1316796 - RNA, 26 nt, Human
aagagccccggcggcggcggcggcgg

SEQ ID NO: 1316797 - RNA, 21 nt, Human
agucccuggccgugcggcucc

SEQ ID NO: 1316798 - RNA, 22 nt, Human
cgcagcgccggguccuucgccc

SEQ ID NO: 1316799 - RNA, 21 nt, Human
cgcagcuccgcgggggaccuc

SEQ ID NO: 1316800 - RNA, 20 nt, Human
cgccggguccuucgcccggc

SEQ ID NO: 1316801 - RNA, 22 nt, Human
cggcuccuggcacgcgacuccc

SEQ ID NO: 1316802 - RNA, 20 nt, Human
gaaagcugcaagcccggcgc

SEQ ID NO: 1316803 - RNA, 18 nt, Human
gccaagagccccggcggc

SEQ ID NO: 1316804 - RNA, 20 nt, Human
gccccggcggcggcggcggc

SEQ ID NO: 1316805 - RNA, 19 nt, Human
gccugugccgggaaucucc

SEQ ID NO: 1316806 - RNA, 24 nt, Human
gcgcagcuccgcggggggggaacc

SEQ ID NO: 1316807 - RNA, 25 nt, Human
gcgcagcuccgcggggggggaacgc

SEQ ID NO: 1316808 - RNA, 19 nt, Human
gcggcggcggcggcggccc

SEQ ID NO: 1316809 - RNA, 23 nt, Human
gcggcggcggcggcggcccgccc

SEQ ID NO: 1316810 - RNA, 22 nt, Human
gcuccuggcacgcgacucccag

SEQ ID NO: 1316811 - RNA, 23 nt, Human
guggugcgugucugucugucagu

SEQ ID NO: 1316812 - RNA, 24 nt, Human
guuugccaagagccccggcggcgg

SEQ ID NO: 1316813 - RNA, 22 nt, Human
ucagcguugcugugacuuuggc

SEQ ID NO: 1316814 - RNA, 21 nt, Human
ucccuggccgugcggcuccug

SEQ ID NO: 1316815 - RNA, 19 nt, Human
uccgcgcagcugcgagcgc

SEQ ID NO: 1316816 - RNA, 18 nt, Human
uccgcgggggaccucugc

SEQ ID NO: 1316817 - RNA, 21 nt, Human
ugucugucagucagucccugg

SEQ ID NO: 1316818 - RNA, 23 nt, Human
uugcugugacuuuggccugugcc

SEQ ID NO: 1316819 - RNA, 18 nt, Human
aaacuuccagcuucccca

SEQ ID NO: 1316820 - RNA, 22 nt, Human
aaaggccuuugucccuagcuug

SEQ ID NO: 1316821 - RNA, 22 nt, Human
aagacccagagggcucacccag

SEQ ID NO: 1316822 - RNA, 20 nt, Human
agacccagagggcucaccca

SEQ ID NO: 1316823 - RNA, 20 nt, Human
caaaacucugccgucuuccc

SEQ ID NO: 1316824 - RNA, 21 nt, Human
caacauguuucaauccugccu

SEQ ID NO: 1316825 - RNA, 20 nt, Human
caccaucaggcuggcagaau

SEQ ID NO: 1316826 - RNA, 24 nt, Human
cagagucgaggcucaaggacagcu

SEQ ID NO: 1316827 - RNA, 21 nt, Human
cagcagaaaacauagacccuu

SEQ ID NO: 1316828 - RNA, 23 nt, Human
cagcagcaggugccagcugauag

SEQ ID NO: 1316829 - RNA, 20 nt, Human
ccagagucgaggcucaagga

SEQ ID NO: 1316830 - RNA, 22 nt, Human
cccagagucgaggcucaaggac

SEQ ID NO: 1316831 - RNA, 20 nt, Human
ccccagaaauuaugggcaga

SEQ ID NO: 1316832 - RNA, 24 nt, Human
ccuccucuuccugcccagcuccag

SEQ ID NO: 1316833 - RNA, 22 nt, Human
ccugaccuuccggagccggugu

SEQ ID NO: 1316834 - RNA, 19 nt, Human
cucacccagagucgaggcu

SEQ ID NO: 1316835 - RNA, 19 nt, Human
cucagcggcuccaucccuc

SEQ ID NO: 1316836 - RNA, 18 nt, Human
cuccugcuggucacuggg

SEQ ID NO: 1316837 - RNA, 21 nt, Human
cucuacuuccugaguguucag

SEQ ID NO: 1316838 - RNA, 22 nt, Human
cucuacuuccugaguguucagg

SEQ ID NO: 1316839 - RNA, 22 nt, Human
cugcuagcaggagacacacgaa

SEQ ID NO: 1316840 - RNA, 21 nt, Human
cuuccugcccagcuccaggga

SEQ ID NO: 1316841 - RNA, 24 nt, Human
ggguucuagcagggcucucaggcc

SEQ ID NO: 1316842 - RNA, 18 nt, Human
uagcagggcucucaggcc

SEQ ID NO: 1316843 - RNA, 21 nt, Human
ucaaaacucugccgucuuccc

SEQ ID NO: 1316844 - RNA, 18 nt, Human
ucagcggcuccaucccuc

SEQ ID NO: 1316845 - RNA, 19 nt, Human
ucagcggcuccaucccucc

SEQ ID NO: 1316846 - RNA, 20 nt, Human
uccagcuuccccagaaauua

SEQ ID NO: 1316847 - RNA, 21 nt, Human
ucccugaccuuccggagccgg

SEQ ID NO: 1316848 - RNA, 23 nt, Human
ucucagcggcuccaucccuccuc

SEQ ID NO: 1316849 - RNA, 22 nt, Human
ugauagaugacaacuacaacau

SEQ ID NO: 1316850 - RNA, 22 nt, Human
ugccagcugauagaugacaacu

SEQ ID NO: 1316851 - RNA, 21 nt, Human
uuccggagccgguguuugugg

SEQ ID NO: 1316852 - RNA, 19 nt, Human
uuguguccagaguguauac

SEQ ID NO: 1316853 - RNA, 21 nt, Human
caaaaacgagacgccaaaucc

SEQ ID NO: 1316854 - RNA, 23 nt, Human
caaaaacgagacgccaaauccca

SEQ ID NO: 1316855 - RNA, 23 nt, Human
ccaccagcacaguucucaggagu

SEQ ID NO: 1316856 - RNA, 18 nt, Human
cccagugcuguucuaagg

SEQ ID NO: 1316857 - RNA, 20 nt, Human
ccugcuggucucccagugcu

SEQ ID NO: 1316858 - RNA, 21 nt, Human
ccuucgcucucaggucagagg

SEQ ID NO: 1316859 - RNA, 24 nt, Human
cucccagugcuguucuaagggucc

SEQ ID NO: 1316860 - RNA, 26 nt, Human
cucccagugcuguucuaaggguccac

SEQ ID NO: 1316861 - RNA, 23 nt, Human
guucucaggaguccugcuggucu

SEQ ID NO: 1316862 - RNA, 21 nt, Human
uagccaaaaacgagacgccaa

SEQ ID NO: 1316863 - RNA, 22 nt, Human
uagccaaaaacgagacgccaaa

SEQ ID NO: 1316864 - RNA, 22 nt, Human
uagcguuuuacaggagagugaa

SEQ ID NO: 1316865 - RNA, 24 nt, Human
uauggaaaaagccaaugacaauca

SEQ ID NO: 1316866 - RNA, 19 nt, Human
uggucucccagugcuguuc

SEQ ID NO: 1316867 - RNA, 22 nt, Human
aacuguaaacauuuauugaaca

SEQ ID NO: 1316868 - RNA, 23 nt, Human
accagcuccccgcucacauacac

SEQ ID NO: 1316869 - RNA, 21 nt, Human
agaguuggcgugggugagggg

SEQ ID NO: 1316870 - RNA, 22 nt, Human
agccccagcagcggcaacagcc

SEQ ID NO: 1316871 - RNA, 20 nt, Human
auacaccugcaccuugauca

SEQ ID NO: 1316872 - RNA, 24 nt, Human
cagccccagcucugcgccgcgccu

SEQ ID NO: 1316873 - RNA, 23 nt, Human
cagccgcgcgaggacgcuggggc

SEQ ID NO: 1316874 - RNA, 21 nt, Human
cagcggcaacagccgcgcgag

SEQ ID NO: 1316875 - RNA, 20 nt, Human
ccccagcucugcgccgcgcc

SEQ ID NO: 1316876 - RNA, 19 nt, Human
ccccgcucacauacaccug

SEQ ID NO: 1316877 - RNA, 19 nt, Human
cccgccuggucccgcucgc

SEQ ID NO: 1316878 - RNA, 22 nt, Human
cccggccccgcgcagccccagc

SEQ ID NO: 1316879 - RNA, 19 nt, Human
ccugcgggcuggggggcuc

SEQ ID NO: 1316880 - RNA, 22 nt, Human
cgcccggccccgcgcagcccca

SEQ ID NO: 1316881 - RNA, 24 nt, Human
cucugcgccgcgccucgcagcucc

SEQ ID NO: 1316882 - RNA, 25 nt, Human
gaaggaagaagaguuggcgugggug

SEQ ID NO: 1316883 - RNA, 19 nt, Human
gagcagcagccccagcagc

SEQ ID NO: 1316884 - RNA, 21 nt, Human
gagcagcagccccagcagcgg

SEQ ID NO: 1316885 - RNA, 19 nt, Human
gaggcccgggccaggggca

SEQ ID NO: 1316886 - RNA, 23 nt, Human
gcccggccccgcgcagccccagc

SEQ ID NO: 1316887 - RNA, 18 nt, Human
gcuggggggcuccggcgg

SEQ ID NO: 1316888 - RNA, 19 nt, Human
ggcuggggggcuccggcgg

SEQ ID NO: 1316889 - RNA, 21 nt, Human
ggggggcuccggcggcgacuu

SEQ ID NO: 1316890 - RNA, 23 nt, Human
gggugagggggagccuuaccggg

SEQ ID NO: 1316891 - RNA, 21 nt, Human
ggucucuacaccuaggucagg

SEQ ID NO: 1316892 - RNA, 21 nt, Human
ucaggaucuccugcgggcugg

SEQ ID NO: 1316893 - RNA, 18 nt, Human
uccauggcucccgccugg

SEQ ID NO: 1316894 - RNA, 18 nt, Human
ucccgcucgcccggcccc

SEQ ID NO: 1316895 - RNA, 21 nt, Human
ucgcccggccccgcgcagccc

SEQ ID NO: 1316896 - RNA, 20 nt, Human
ucuccugcgggcuggggggc

SEQ ID NO: 1316897 - RNA, 18 nt, Human
ugacuugcccaaggacac

SEQ ID NO: 1316898 - RNA, 22 nt, Human
ugacuugcccaaggacacccag

SEQ ID NO: 1316899 - RNA, 21 nt, Human
ugagggggagccuuaccggga

SEQ ID NO: 1316900 - RNA, 23 nt, Human
ugcgccgcgccucgcagcuccgg

SEQ ID NO: 1316901 - RNA, 22 nt, Human
uguaaacauuuauugaacaccu

SEQ ID NO: 1316902 - RNA, 20 nt, Human
uguacuguguuuuuucacuu

SEQ ID NO: 1316903 - RNA, 25 nt, Human
agggggcagagaggagaaagaggcu

SEQ ID NO: 1316904 - RNA, 24 nt, Human
auugaaacacuuggccaguggggg

SEQ ID NO: 1316905 - RNA, 19 nt, Human
ccagugggggaugggggaa

SEQ ID NO: 1316906 - RNA, 23 nt, Human
cccagucagacagguccccuaca

SEQ ID NO: 1316907 - RNA, 24 nt, Human
ccucccucucggaacucccuuccc

SEQ ID NO: 1316908 - RNA, 22 nt, Human
cuucugcuggguccuaguagag

SEQ ID NO: 1316909 - RNA, 22 nt, Human
gaaacacuuggccaguggggga

SEQ ID NO: 1316910 - RNA, 23 nt, Human
gggcagagaggagaaagaggcuu

SEQ ID NO: 1316911 - RNA, 18 nt, Human
gggcagggggcagagagg

SEQ ID NO: 1316912 - RNA, 18 nt, Human
ggggaugggggaagggau

SEQ ID NO: 1316913 - RNA, 19 nt, Human
uagaggcagacagcagggg

SEQ ID NO: 1316914 - RNA, 21 nt, Human
ucccagucagacagguccccu

SEQ ID NO: 1316915 - RNA, 19 nt, Human
ucccucucggaacucccuu

SEQ ID NO: 1316916 - RNA, 19 nt, Human
ugccagaagggaguggcuc

SEQ ID NO: 1316917 - RNA, 19 nt, Human
ugccagaagggaguggcuc

SEQ ID NO: 1316918 - RNA, 24 nt, Human
ugccagaagggaguggcucacacu

SEQ ID NO: 1316919 - RNA, 18 nt, Human
ugggggaugggggaaggg

SEQ ID NO: 1316920 - RNA, 19 nt, Human
uguggggggcagggggcag

SEQ ID NO: 1316921 - RNA, 22 nt, Human
aaagcauuaaauccuuuacuga

SEQ ID NO: 1316922 - RNA, 24 nt, Human
aagagaccagaauggcgaucuugc

SEQ ID NO: 1316923 - RNA, 21 nt, Human
auuaccaucagauuauuuacu

SEQ ID NO: 1316924 - RNA, 22 nt, Human
auuauuuugccccuggcuuuca

SEQ ID NO: 1316925 - RNA, 20 nt, Human
cacaagagaccagaauggcg

SEQ ID NO: 1316926 - RNA, 23 nt, Human
cacucugcauuuaaauccaucuc

SEQ ID NO: 1316927 - RNA, 21 nt, Human
cagaagcugagaucagcauug

SEQ ID NO: 1316928 - RNA, 23 nt, Human
ccagaauggcgaucuugccuucc

SEQ ID NO: 1316929 - RNA, 20 nt, Human
ccuaaaaacccaggcccaag

SEQ ID NO: 1316930 - RNA, 20 nt, Human
cugguaucuucauguuagaa

SEQ ID NO: 1316931 - RNA, 22 nt, Human
uaaguccucccucaggaaugaa

SEQ ID NO: 1316932 - RNA, 20 nt, Human
uauuuugccccuggcuuuca

SEQ ID NO: 1316933 - RNA, 22 nt, Human
ugccuaaaaacccaggcccaag

SEQ ID NO: 1316934 - RNA, 25 nt, Human
uucauacacucugcauuuaaaucca

SEQ ID NO: 1316935 - RNA, 24 nt, Human
uucauuagugccuaaaaacccagg

SEQ ID NO: 1316936 - RNA, 25 nt, Human
aagucucuuaacagguauucaguuc

SEQ ID NO: 1316937 - RNA, 19 nt, Human
agaagagcaguuuucugag

SEQ ID NO: 1316938 - RNA, 21 nt, Human
agacacugaacgggguugcug

SEQ ID NO: 1316939 - RNA, 22 nt, Human
agacaggagggagaaaaguggg

SEQ ID NO: 1316940 - RNA, 19 nt, Human
agcagagggcuccccacaa

SEQ ID NO: 1316941 - RNA, 21 nt, Human
agccacuuucucuuaaccagu

SEQ ID NO: 1316942 - RNA, 19 nt, Human
aggagggagaaaagugggu

SEQ ID NO: 1316943 - RNA, 22 nt, Human
aggggucccgagggucccaucu

SEQ ID NO: 1316944 - RNA, 22 nt, Human
aggucaucuuucucagcagccu

SEQ ID NO: 1316945 - RNA, 18 nt, Human
aucugaaguccaugcauc

SEQ ID NO: 1316946 - RNA, 27 nt, Human
cagagggcuccccacaaaagcagacac

SEQ ID NO: 1316947 - RNA, 18 nt, Human
cagcagccugcuuggcug

SEQ ID NO: 1316948 - RNA, 20 nt, Human
cccaagucucuuaacaggua

SEQ ID NO: 1316949 - RNA, 23 nt, Human
cccaucucgucagcacccagggg

SEQ ID NO: 1316950 - RNA, 22 nt, Human
ccccacaaaagcagacacugaa

SEQ ID NO: 1316951 - RNA, 20 nt, Human
cggcuaguggucagcacugc

SEQ ID NO: 1316952 - RNA, 21 nt, Human
cugcgaguccuccaggggucc

SEQ ID NO: 1316953 - RNA, 18 nt, Human
gaagagcaguuuucugag

SEQ ID NO: 1316954 - RNA, 24 nt, Human
ggaaagaagaaggguggcccagag

SEQ ID NO: 1316955 - RNA, 21 nt, Human
ggcaaguuacaguuaugucau

SEQ ID NO: 1316956 - RNA, 23 nt, Human
gucucuuaacagguauucaguuc

SEQ ID NO: 1316957 - RNA, 18 nt, Human
guggcccagagacaggag

SEQ ID NO: 1316958 - RNA, 24 nt, Human
ucagcacugcgaguccuccagggg

SEQ ID NO: 1316959 - RNA, 19 nt, Human
ucccgagggucccaucucg

SEQ ID NO: 1316960 - RNA, 19 nt, Human
ugccaagaagagcaguuuu

SEQ ID NO: 1316961 - RNA, 20 nt, Human
ugucaugaacaaacuauagc

SEQ ID NO: 1316962 - RNA, 22 nt, Human
uugcuguaucagccacuuucuc

SEQ ID NO: 1316963 - RNA, 18 nt, Human
uuugaccccccaagucuc

SEQ ID NO: 1316964 - RNA, 24 nt, Human
aagccgcaccacacuuggacuucu

SEQ ID NO: 1316965 - RNA, 21 nt, Human
aagaaaucccccaauccacag

SEQ ID NO: 1316966 - RNA, 20 nt, Human
acaggucaguggaaacaaga

SEQ ID NO: 1316967 - RNA, 25 nt, Human
acauucauuacauucauaagguuuu

SEQ ID NO: 1316968 - RNA, 19 nt, Human
agcagcagaaaaauuuucc

SEQ ID NO: 1316969 - RNA, 23 nt, Human
aggauuucuccauucaugacauc

SEQ ID NO: 1316970 - RNA, 26 nt, Human
aggcgaggccggacagugccggagga

SEQ ID NO: 1316971 - RNA, 19 nt, Human
aucuguaaggucucucccc

SEQ ID NO: 1316972 - RNA, 24 nt, Human
augaagggcuaauuuuucacugaa

SEQ ID NO: 1316973 - RNA, 18 nt, Human
auucauaggguuuucccu

SEQ ID NO: 1316974 - RNA, 20 nt, Human
cauagggcuucuccccugug

SEQ ID NO: 1316975 - RNA, 24 nt, Human
caucacagaaacauuuuccaccuu

SEQ ID NO: 1316976 - RNA, 21 nt, Human
caugcauagcauucauagggc

SEQ ID NO: 1316977 - RNA, 21 nt, Human
cauucauuacauccaaaaggu

SEQ ID NO: 1316978 - RNA, 20 nt, Human
cauucauuacauccauaggg

SEQ ID NO: 1316979 - RNA, 23 nt, Human
cauucauuacauccauaggguug

SEQ ID NO: 1316980 - RNA, 21 nt, Human
cauucauuacauucauaaggu

SEQ ID NO: 1316981 - RNA, 19 nt, Human
ccacagccacgaugacuuc

SEQ ID NO: 1316982 - RNA, 23 nt, Human
ccacauucauuguauucaaaagg

SEQ ID NO: 1316983 - RNA, 22 nt, Human
cccuccacgugcgcggccucac

SEQ ID NO: 1316984 - RNA, 21 nt, Human
ccgucuggaaaugcccacugc

SEQ ID NO: 1316985 - RNA, 19 nt, Human
ccguuuccgcacgguccug

SEQ ID NO: 1316986 - RNA, 19 nt, Human
ccucaaagauacuuucucc

SEQ ID NO: 1316987 - RNA, 22 nt, Human
cuccuacaucuuccugucacuu

SEQ ID NO: 1316988 - RNA, 24 nt, Human
cugagcaggguccagaugaugcca

SEQ ID NO: 1316989 - RNA, 18 nt, Human
cugucacuuuagccacaa

SEQ ID NO: 1316990 - RNA, 19 nt, Human
gacccggggugccucccuc

SEQ ID NO: 1316991 - RNA, 21 nt, Human
gaggacccggggugccucccu

SEQ ID NO: 1316992 - RNA, 22 nt, Human
gcagcagaaaaauuuuccacau

SEQ ID NO: 1316993 - RNA, 24 nt, Human
gcucuacaaaguucugacuucacc

SEQ ID NO: 1316994 - RNA, 23 nt, Human
ggaaggagacagcgagauucuga

SEQ ID NO: 1316995 - RNA, 19 nt, Human
ggaaugcaauacccuacug

SEQ ID NO: 1316996 - RNA, 24 nt, Human
guauucaaaagguugcucccaauu

SEQ ID NO: 1316997 - RNA, 18 nt, Human
gucacaucccuaaaugac

SEQ ID NO: 1316998 - RNA, 21 nt, Human
gucucuccccugugugaauuc

SEQ ID NO: 1316999 - RNA, 21 nt, Human
uaauucuuuaaauuccaucug

SEQ ID NO: 1317000 - RNA, 19 nt, Human
uagcagcagaaaaauuuuc

SEQ ID NO: 1317001 - RNA, 22 nt, Human
uagucacaucccuaaaugacac

SEQ ID NO: 1317002 - RNA, 19 nt, Human
uauuugcauguuuucuguc

SEQ ID NO: 1317003 - RNA, 21 nt, Human
ucacccagaugacucuggcuu

SEQ ID NO: 1317004 - RNA, 22 nt, Human
ucacccagaugacucuggcuuc

SEQ ID NO: 1317005 - RNA, 19 nt, Human
uccacauucauuacaucca

SEQ ID NO: 1317006 - RNA, 24 nt, Human
ucccacauucauuacauccaaaag

SEQ ID NO: 1317007 - RNA, 23 nt, Human
ucccuaaaugacacugaucccug

SEQ ID NO: 1317008 - RNA, 22 nt, Human
uccucaaagauacuuucuccac

SEQ ID NO: 1317009 - RNA, 26 nt, Human
ucucugaugucuugugugggcugacu

SEQ ID NO: 1317010 - RNA, 24 nt, Human
ucuggaaaugcccacugcuacuag

SEQ ID NO: 1317011 - RNA, 25 nt, Human
ugaagcccauagucacaucccuaaa

SEQ ID NO: 1317012 - RNA, 20 nt, Human
ugacucuggcuucgaaauuu

SEQ ID NO: 1317013 - RNA, 18 nt, Human
ugaguaauaaaaaaugac

SEQ ID NO: 1317014 - RNA, 21 nt, Human
ugcaauacccuacugagacaa

SEQ ID NO: 1317015 - RNA, 22 nt, Human
ugcaauacccuacugagacaag

SEQ ID NO: 1317016 - RNA, 19 nt, Human
ugccucccuccacgugcgc

SEQ ID NO: 1317017 - RNA, 23 nt, Human
ugccucccuccacgugcgcggcc

SEQ ID NO: 1317018 - RNA, 19 nt, Human
ugccugucuccaauuugag

SEQ ID NO: 1317019 - RNA, 20 nt, Human
uggauguguuugcugaugag

SEQ ID NO: 1317020 - RNA, 19 nt, Human
uguaaggucucuccccugu

SEQ ID NO: 1317021 - RNA, 19 nt, Human
ugucuccaauuugaggauc

SEQ ID NO: 1317022 - RNA, 24 nt, Human
ugugugucuucucagauguucugu

SEQ ID NO: 1317023 - RNA, 21 nt, Human
uguguguucuuagauguuuag

SEQ ID NO: 1317024 - RNA, 20 nt, Human
uucacugaaggauuucucca

SEQ ID NO: 1317025 - RNA, 21 nt, Human
uucucagggaaagcuuuccca

SEQ ID NO: 1317026 - RNA, 19 nt, Human
uuuuccacaaacauuacau

SEQ ID NO: 1317027 - RNA, 19 nt, Human
aaaucugcccacaucuagc

SEQ ID NO: 1317028 - RNA, 20 nt, Human
acaucuagcucugauugcuu

SEQ ID NO: 1317029 - RNA, 19 nt, Human
auccagaauuuugagaaaa

SEQ ID NO: 1317030 - RNA, 19 nt, Human
caacacugcuuacaucuug

SEQ ID NO: 1317031 - RNA, 20 nt, Human
cacacagccuucaugaccgc

SEQ ID NO: 1317032 - RNA, 23 nt, Human
cacacagccuucaugaccgccag

SEQ ID NO: 1317033 - RNA, 22 nt, Human
cacugcuuauugauugccccuc

SEQ ID NO: 1317034 - RNA, 19 nt, Human
cagccuucaugaccgccag

SEQ ID NO: 1317035 - RNA, 24 nt, Human
ccaucuacaaguuaaggagagagg

SEQ ID NO: 1317036 - RNA, 18 nt, Human
ccuauuucuuugcauguc

SEQ ID NO: 1317037 - RNA, 20 nt, Human
ccuucaugaccgccaggguu

SEQ ID NO: 1317038 - RNA, 22 nt, Human
ccuugcacugcacacagccuuc

SEQ ID NO: 1317039 - RNA, 19 nt, Human
cuagguacagccuugcacu

SEQ ID NO: 1317040 - RNA, 22 nt, Human
cugcccuuuguggauuauuccg

SEQ ID NO: 1317041 - RNA, 18 nt, Human
cuuggauuuuucuucucc

SEQ ID NO: 1317042 - RNA, 18 nt, Human
ggagagagggcucaaaag

SEQ ID NO: 1317043 - RNA, 23 nt, Human
guggagggagguggccaucuaca

SEQ ID NO: 1317044 - RNA, 23 nt, Human
gugguuuagugguguuuucaaau

SEQ ID NO: 1317045 - RNA, 19 nt, Human
uacagggacuuucaggcug

SEQ ID NO: 1317046 - RNA, 23 nt, Human
uagacuucuagcauccagaauuu

SEQ ID NO: 1317047 - RNA, 23 nt, Human
uagcauccagaauuuugagaaaa

SEQ ID NO: 1317048 - RNA, 23 nt, Human
uagcuuggauuuuucuucuccca

SEQ ID NO: 1317049 - RNA, 23 nt, Human
uauugauugccccuccuccaccc

SEQ ID NO: 1317050 - RNA, 23 nt, Human
ucaaaagaaaccaacacugcuua

SEQ ID NO: 1317051 - RNA, 21 nt, Human
ucaaaucugcccacaucuagc

SEQ ID NO: 1317052 - RNA, 19 nt, Human
ucacuggucauagauugug

SEQ ID NO: 1317053 - RNA, 24 nt, Human
ucuggagaaggcacagucuugggu

SEQ ID NO: 1317054 - RNA, 19 nt, Human
ugacuuaaacucuauuucc

SEQ ID NO: 1317055 - RNA, 20 nt, Human
ugcacacagccuucaugacc

SEQ ID NO: 1317056 - RNA, 18 nt, Human
ugcaugucuuguaauugu

SEQ ID NO: 1317057 - RNA, 18 nt, Human
ugccccuccuccacccca

SEQ ID NO: 1317058 - RNA, 20 nt, Human
ugccccuccuccaccccagg

SEQ ID NO: 1317059 - RNA, 22 nt, Human
uguagagauuucuccgggucag

SEQ ID NO: 1317060 - RNA, 28 nt, Human
ugugcagccucguguuuauaucuuugag

SEQ ID NO: 1317061 - RNA, 20 nt, Human
uguguuuguggcuuggaggc

SEQ ID NO: 1317062 - RNA, 20 nt, Human
uuagugguguuuucaaaucu

SEQ ID NO: 1317063 - RNA, 18 nt, Human
uugauugccccuccucca

SEQ ID NO: 1317064 - RNA, 21 nt, Human
uugccccuccuccaccccagg

SEQ ID NO: 1317065 - RNA, 26 nt, Human
aggcgaggccggacagugccggagga

SEQ ID NO: 1317066 - RNA, 22 nt, Human
cccuccacgugcgcggccucac

SEQ ID NO: 1317067 - RNA, 21 nt, Human
ccgucuggaaaugcccacugc

SEQ ID NO: 1317068 - RNA, 21 nt, Human
cucagggaagagaaaauccaa

SEQ ID NO: 1317069 - RNA, 22 nt, Human
cuccuacaucuuccugucacuu

SEQ ID NO: 1317070 - RNA, 18 nt, Human
cugucacuuuagccacaa

SEQ ID NO: 1317071 - RNA, 19 nt, Human
gacccggggugccucccuc

SEQ ID NO: 1317072 - RNA, 20 nt, Human
gaggacccggggugccuccc

SEQ ID NO: 1317073 - RNA, 20 nt, Human
gugccucccuccacgugcgc

SEQ ID NO: 1317074 - RNA, 22 nt, Human
uccaagacugaaagcuccuaca

SEQ ID NO: 1317075 - RNA, 24 nt, Human
ucuggaaaugcccacugcuacuag

SEQ ID NO: 1317076 - RNA, 23 nt, Human
ugccucccuccacgugcgcggcc

SEQ ID NO: 1317077 - RNA, 18 nt, Human
aggcggcgguuggguccg

SEQ ID NO: 1317078 - RNA, 22 nt, Human
aggcggcgguuggguccguggc

SEQ ID NO: 1317079 - RNA, 24 nt, Human
caguugugaacagguuuggugccg

SEQ ID NO: 1317080 - RNA, 18 nt, Human
ccaggcggcggucccuuu

SEQ ID NO: 1317081 - RNA, 23 nt, Human
ggcgguuggguccguggcucugg

SEQ ID NO: 1317082 - RNA, 20 nt, Human
uauguugcccagauuggucu

SEQ ID NO: 1317083 - RNA, 24 nt, Human
uauguugcccagauuggucuugaa

SEQ ID NO: 1317084 - RNA, 22 nt, Human
ucgcaguugugaacagguuugg

SEQ ID NO: 1317085 - RNA, 24 nt, Human
ugcccagauuggucuugaacuccu

SEQ ID NO: 1317086 - RNA, 18 nt, Human
uuauuuauuuauuuauuu

SEQ ID NO: 1317087 - RNA, 18 nt, Human
uuauuuauuuauuuauuu

SEQ ID NO: 1317088 - RNA, 19 nt, Human
uuauuuauuuauuuauuua

SEQ ID NO: 1317089 - RNA, 19 nt, Human
uuauuuauuuauuuauuua

SEQ ID NO: 1317090 - RNA, 19 nt, Human
uuauuuauuuauuuauuua

SEQ ID NO: 1317091 - RNA, 19 nt, Human
uuauuuauuuauuuauuua

SEQ ID NO: 1317092 - RNA, 25 nt, Human
uuauuuauuuauuuauuuauuuauu

SEQ ID NO: 1317093 - RNA, 25 nt, Human
uuauuuauuuauuuauuuauuuauu

SEQ ID NO: 1317094 - RNA, 25 nt, Human
uuauuuauuuauuuauuuauuuauu

SEQ ID NO: 1317095 - RNA, 25 nt, Human
uuauuuauuuauuuauuuauuuauu

SEQ ID NO: 1317096 - RNA, 30 nt, Human
uuauuuauuuauuuauuuauuuauuuuuug

SEQ ID NO: 1317097 - RNA, 18 nt, Human
uugcccagauuggucuug

SEQ ID NO: 1317098 - RNA, 22 nt, Human
uuuauuuauuuauuuauuuauu

SEQ ID NO: 1317099 - RNA, 22 nt, Human
uuuauuuauuuauuuauuuauu

SEQ ID NO: 1317100 - RNA, 22 nt, Human
uuuauuuauuuauuuauuuauu

SEQ ID NO: 1317101 - RNA, 23 nt, Human
uuuuauuuauuuauuuauuuauu

SEQ ID NO: 1317102 - RNA, 21 nt, Human
cggaaucuccugccauuaugg

SEQ ID NO: 1317103 - RNA, 22 nt, Human
ucuuggaacgcaaacaaaccuu

SEQ ID NO: 1317104 - RNA, 21 nt, Human
uggaacgcaaacaaaccuucc

SEQ ID NO: 1317105 - RNA, 18 nt, Human
agacccaggacgcugcag

SEQ ID NO: 1317106 - RNA, 22 nt, Human
auucaaaauccaugucaacccc

SEQ ID NO: 1317107 - RNA, 21 nt, Human
caaugggcacccucacuguuc

SEQ ID NO: 1317108 - RNA, 23 nt, Human
cagaaaucucauguaacuuuaau

SEQ ID NO: 1317109 - RNA, 20 nt, Human
cagguuaaaggccaaggcac

SEQ ID NO: 1317110 - RNA, 21 nt, Human
ccaugucaaccccaaucaugu

SEQ ID NO: 1317111 - RNA, 19 nt, Human
ccccgacggcugcgggccc

SEQ ID NO: 1317112 - RNA, 21 nt, Human
ccucacgacuggcugggccaa

SEQ ID NO: 1317113 - RNA, 19 nt, Human
cgccccggggagcccuucc

SEQ ID NO: 1317114 - RNA, 23 nt, Human
cuuccgggccccgacggcugcgg

SEQ ID NO: 1317115 - RNA, 21 nt, Human
ggagcccuuccgggccccgac

SEQ ID NO: 1317116 - RNA, 21 nt, Human
ggcagcauccugggccacagu

SEQ ID NO: 1317117 - RNA, 20 nt, Human
uagcuggauuccaguccaca

SEQ ID NO: 1317118 - RNA, 24 nt, Human
aaccacaacaccaaggugaagccc

SEQ ID NO: 1317119 - RNA, 29 nt, Human
aaggacgccaccuuuaaucugcugcuccc

SEQ ID NO: 1317120 - RNA, 23 nt, Human
aggagcauuuccaguggucuuca

SEQ ID NO: 1317121 - RNA, 20 nt, Human
aggagcgagacuugggagug

SEQ ID NO: 1317122 - RNA, 22 nt, Human
cacaacaccaaggugaagcccu

SEQ ID NO: 1317123 - RNA, 22 nt, Human
cagcccacagcuucuccgcgaa

SEQ ID NO: 1317124 - RNA, 24 nt, Human
cagcccacagcuucuccgcgaaau

SEQ ID NO: 1317125 - RNA, 21 nt, Human
cccauucuccagcccacagcu

SEQ ID NO: 1317126 - RNA, 19 nt, Human
cucaagacugaaaaugagg

SEQ ID NO: 1317127 - RNA, 20 nt, Human
gaagcauuucucuuuuuccu

SEQ ID NO: 1317128 - RNA, 18 nt, Human
gauaugcagaauuguaac

SEQ ID NO: 1317129 - RNA, 26 nt, Human
uaccuucuccaccuucccauucucca

SEQ ID NO: 1317130 - RNA, 23 nt, Human
uaggugggguugacucaucuccc

SEQ ID NO: 1317131 - RNA, 23 nt, Human
uccagcccacagcuucuccgcga

SEQ ID NO: 1317132 - RNA, 22 nt, Human
ugaaaaugaggagcgagacuug

SEQ ID NO: 1317133 - RNA, 23 nt, Human
ugagggaaggguuccuaaaaagg

SEQ ID NO: 1317134 - RNA, 20 nt, Human
ugcuuuauaaucauuugggu

SEQ ID NO: 1317135 - RNA, 21 nt, Human
uugcugcugaaggacgccacc

SEQ ID NO: 1317136 - RNA, 22 nt, Human
uugugauugucaucaauuucug

SEQ ID NO: 1317137 - RNA, 19 nt, Human
uuucugagggaaggguucc

SEQ ID NO: 1317138 - RNA, 18 nt, Human
uuucuugugauugucauc

SEQ ID NO: 1317139 - RNA, 19 nt, Human
cacucagccucucccuggc

SEQ ID NO: 1317140 - RNA, 24 nt, Human
cuugggcccgugcacucagccucu

SEQ ID NO: 1317141 - RNA, 21 nt, Human
ugcacucagccucucccuggc

SEQ ID NO: 1317142 - RNA, 23 nt, Human
ugcacucagccucucccuggcuu

SEQ ID NO: 1317143 - RNA, 19 nt, Human
aacauuuaauaaacugugg

SEQ ID NO: 1317144 - RNA, 24 nt, Human
aggguggggagcacgaagccuggg

SEQ ID NO: 1317145 - RNA, 27 nt, Human
ccaaaugguggccucacagucuucucc

SEQ ID NO: 1317146 - RNA, 18 nt, Human
ccuauggcaggggcugga

SEQ ID NO: 1317147 - RNA, 24 nt, Human
gcauuauagaaccaugaaaaacaa

SEQ ID NO: 1317148 - RNA, 19 nt, Human
ggcuggggguggggagaac

SEQ ID NO: 1317149 - RNA, 23 nt, Human
ggcuggggguggggagaacuugc

SEQ ID NO: 1317150 - RNA, 22 nt, Human
gggagaacuugccaaggguggg

SEQ ID NO: 1317151 - RNA, 18 nt, Human
ggggcuggggguggggag

SEQ ID NO: 1317152 - RNA, 18 nt, Human
uagaaccaugaaaaacaa

SEQ ID NO: 1317153 - RNA, 24 nt, Human
uagaaccaugaaaaacaauuucuc

SEQ ID NO: 1317154 - RNA, 22 nt, Human
ucaguguggcccaaaugguggc

SEQ ID NO: 1317155 - RNA, 24 nt, Human
ucaguguggcccaaaugguggccu

SEQ ID NO: 1317156 - RNA, 19 nt, Human
ugaaaaacaauuucucagc

SEQ ID NO: 1317157 - RNA, 18 nt, Human
ugcauuauagaaccauga

SEQ ID NO: 1317158 - RNA, 18 nt, Human
uggcaggggcuggacuug

SEQ ID NO: 1317159 - RNA, 21 nt, Human
ugggccuauggcaggggcugg

SEQ ID NO: 1317160 - RNA, 18 nt, Human
uggggagcacgaagccug

SEQ ID NO: 1317161 - RNA, 23 nt, Human
uggggcuggggguggggagaacu

SEQ ID NO: 1317162 - RNA, 18 nt, Human
aggagagauaaaugcaaa

SEQ ID NO: 1317163 - RNA, 22 nt, Human
cacaauauuccacaaaugccac

SEQ ID NO: 1317164 - RNA, 24 nt, Human
cacacaauauuccacaaaugccac

SEQ ID NO: 1317165 - RNA, 20 nt, Human
caugaaaauccuaaaaagug

SEQ ID NO: 1317166 - RNA, 18 nt, Human
ccuuuggugucucauugc

SEQ ID NO: 1317167 - RNA, 19 nt, Human
guacuagaauguuucugga

SEQ ID NO: 1317168 - RNA, 21 nt, Human
guuuuauuaucucuuuuuccu

SEQ ID NO: 1317169 - RNA, 20 nt, Human
uaggaagaauaauuuuagug

SEQ ID NO: 1317170 - RNA, 25 nt, Human
uaucucuuuuuccugaaaagucuuc

SEQ ID NO: 1317171 - RNA, 19 nt, Human
ucuaguccuuuggugucuc

SEQ ID NO: 1317172 - RNA, 18 nt, Human
ugaggcaauauauuuuuu

SEQ ID NO: 1317173 - RNA, 18 nt, Human
ugcauuuuauuucuguuu

SEQ ID NO: 1317174 - RNA, 18 nt, Human
uggagaaaccagugaggc

SEQ ID NO: 1317175 - RNA, 23 nt, Human
uggcacacaauauuccacaaaug

SEQ ID NO: 1317176 - RNA, 23 nt, Human
uguacuagaauguuucuggaaag

SEQ ID NO: 1317177 - RNA, 19 nt, Human
uuauuaucucuuuuuccug

SEQ ID NO: 1317178 - RNA, 19 nt, Human
uuccacaaaugccacaaag

SEQ ID NO: 1317179 - RNA, 18 nt, Human
uucuaguccuuugguguc

SEQ ID NO: 1317180 - RNA, 23 nt, Human
cagugccuugcauuguaugcgga

SEQ ID NO: 1317181 - RNA, 24 nt, Human
gacgugcugcuuggggccagccug

SEQ ID NO: 1317182 - RNA, 26 nt, Human
gaggggaacaggagcaaaccacaggc

SEQ ID NO: 1317183 - RNA, 21 nt, Human
ggccagccugguguggccagu

SEQ ID NO: 1317184 - RNA, 21 nt, Human
ugcuuggggccagccuggugu

SEQ ID NO: 1317185 - RNA, 22 nt, Human
gggaauaugugggagaaaugga

SEQ ID NO: 1317186 - RNA, 18 nt, Human
uaugugggagaaauggaa

SEQ ID NO: 1317187 - RNA, 20 nt, Human
uaugugggagaaauggaagc

SEQ ID NO: 1317188 - RNA, 23 nt, Human
uaugugggagaaauggaagcagu

SEQ ID NO: 1317189 - RNA, 23 nt, Human
aagccacuaaucccuaaaacugg

SEQ ID NO: 1317190 - RNA, 19 nt, Human
uccacaaagccacuaaucc

SEQ ID NO: 1317191 - RNA, 18 nt, Human
uccuccacaaagccacua

SEQ ID NO: 1317192 - RNA, 20 nt, Human
acuuugaggacauuacugag

SEQ ID NO: 1317193 - RNA, 24 nt, Human
caagcaaagcacuuagcagggucc

SEQ ID NO: 1317194 - RNA, 18 nt, Human
caccugcugggugacugg

SEQ ID NO: 1317195 - RNA, 22 nt, Human
cacgaugcccgagacgccacuc

SEQ ID NO: 1317196 - RNA, 25 nt, Human
caucucugcucuugcacuuugagga

SEQ ID NO: 1317197 - RNA, 19 nt, Human
ccaaauugccagcaucucu

SEQ ID NO: 1317198 - RNA, 18 nt, Human
cccgagacgccacuccgg

SEQ ID NO: 1317199 - RNA, 18 nt, Human
cccuggacaaagggagga

SEQ ID NO: 1317200 - RNA, 18 nt, Human
cggaacauggacgguuac

SEQ ID NO: 1317201 - RNA, 19 nt, Human
gaacauggacgguuacacc

SEQ ID NO: 1317202 - RNA, 21 nt, Human
gcugcaccaagaugcccagca

SEQ ID NO: 1317203 - RNA, 20 nt, Human
ggguccuuggcacacaacag

SEQ ID NO: 1317204 - RNA, 20 nt, Human
gguacccuggacaaagggag

SEQ ID NO: 1317205 - RNA, 19 nt, Human
ggugguguagacagcacgg

SEQ ID NO: 1317206 - RNA, 20 nt, Human
guggaagggcagcccaucca

SEQ ID NO: 1317207 - RNA, 21 nt, Human
uagcaggguccuuggcacaca

SEQ ID NO: 1317208 - RNA, 23 nt, Human
uccaugcccacgaugcccgagac

SEQ ID NO: 1317209 - RNA, 24 nt, Human
ucugaucaccugcugggugacugg

SEQ ID NO: 1317210 - RNA, 20 nt, Human
ugagauuucaucacgauauu

SEQ ID NO: 1317211 - RNA, 21 nt, Human
ugcaauaccaugacagucgau

SEQ ID NO: 1317212 - RNA, 18 nt, Human
ugcaccaagaugcccagc

SEQ ID NO: 1317213 - RNA, 20 nt, Human
ugcccgagacgccacuccgg

SEQ ID NO: 1317214 - RNA, 20 nt, Human
ugcugggugacuggcaggcg

SEQ ID NO: 1317215 - RNA, 19 nt, Human
uggcaggcgggugguguag

SEQ ID NO: 1317216 - RNA, 23 nt, Human
uucaagcaaagcacuuagcaggg

SEQ ID NO: 1317217 - RNA, 23 nt, Human
uucuggaucaucucggcgugggu

SEQ ID NO: 1317218 - RNA, 18 nt, Human
augcuugagacuuggcag

SEQ ID NO: 1317219 - RNA, 27 nt, Human
cacucccuuccuuaugcgguagccuua

SEQ ID NO: 1317220 - RNA, 22 nt, Human
cucccuuccuuaugcgguagcc

SEQ ID NO: 1317221 - RNA, 19 nt, Human
aaccacgcugggcagcggc

SEQ ID NO: 1317222 - RNA, 19 nt, Human
aaccaggugauguuugggg

SEQ ID NO: 1317223 - RNA, 23 nt, Human
aaccccuccaggcauucguccac

SEQ ID NO: 1317224 - RNA, 24 nt, Human
aaccuggccauccuccuggaccug

SEQ ID NO: 1317225 - RNA, 27 nt, Human
aaccuggccauccuccuggaccugcag

SEQ ID NO: 1317226 - RNA, 21 nt, Human
aacuuccucucugcccuccca

SEQ ID NO: 1317227 - RNA, 24 nt, Human
aaggucacugaggcauuuuccagu

SEQ ID NO: 1317228 - RNA, 21 nt, Human
aaggugaaguuccuguccgcc

SEQ ID NO: 1317229 - RNA, 20 nt, Human
aaguguagaugcccucgucc

SEQ ID NO: 1317230 - RNA, 19 nt, Human
aaguuccuccgugccuccc

SEQ ID NO: 1317231 - RNA, 18 nt, Human
aaguucuucaccagcaac

SEQ ID NO: 1317232 - RNA, 18 nt, Human
aaucuguagguucccccc

SEQ ID NO: 1317233 - RNA, 21 nt, Human
acacagcgguagcucccagca

SEQ ID NO: 1317234 - RNA, 19 nt, Human
acacaggagcugcacuagg

SEQ ID NO: 1317235 - RNA, 20 nt, Human
acacugaaguuccuccgugc

SEQ ID NO: 1317236 - RNA, 24 nt, Human
acacugaaguuccuccgugccucc

SEQ ID NO: 1317237 - RNA, 21 nt, Human
acagguuccaccagguaggag

SEQ ID NO: 1317238 - RNA, 23 nt, Human
accagcugggcugaaggccacgc

SEQ ID NO: 1317239 - RNA, 19 nt, Human
accauggucaccagcuccc

SEQ ID NO: 1317240 - RNA, 18 nt, Human
acccggaagcucuucuca

SEQ ID NO: 1317241 - RNA, 22 nt, Human
acccugagggugaagagcuucu

SEQ ID NO: 1317242 - RNA, 20 nt, Human
acccuguccuuccgccagcu

SEQ ID NO: 1317243 - RNA, 19 nt, Human
accgcagcucugugcuacc

SEQ ID NO: 1317244 - RNA, 20 nt, Human
accucccggcguucucugcc

SEQ ID NO: 1317245 - RNA, 24 nt, Human
accuccuccaaguccucguucuca

SEQ ID NO: 1317246 - RNA, 25 nt, Human
accuccuucacgccgaccuccgcca

SEQ ID NO: 1317247 - RNA, 24 nt, Human
accucgccugucucguuggagccg

SEQ ID NO: 1317248 - RNA, 22 nt, Human
accucuuccaccagcuccuuca

SEQ ID NO: 1317249 - RNA, 19 nt, Human
accugguagagccuguggg

SEQ ID NO: 1317250 - RNA, 20 nt, Human
accugugugggggccagugg

SEQ ID NO: 1317251 - RNA, 18 nt, Human
acgcaggaguaccuccca

SEQ ID NO: 1317252 - RNA, 18 nt, Human
acgggguuucccagggcc

SEQ ID NO: 1317253 - RNA, 19 nt, Human
acuccauccuggaccacag

SEQ ID NO: 1317254 - RNA, 21 nt, Human
acugccggugauccugagaac

SEQ ID NO: 1317255 - RNA, 26 nt, Human
agacaaguguacagcccagcaucccu

SEQ ID NO: 1317256 - RNA, 21 nt, Human
agcacaaguguagaugcccuc

SEQ ID NO: 1317257 - RNA, 19 nt, Human
agcaccagggagccgccgu

SEQ ID NO: 1317258 - RNA, 21 nt, Human
agcacccguguggcucugcug

SEQ ID NO: 1317259 - RNA, 21 nt, Human
agcacugcuaccacgaagucc

SEQ ID NO: 1317260 - RNA, 21 nt, Human
agccaccuggcucacugucuc

SEQ ID NO: 1317261 - RNA, 18 nt, Human
agccagcucacguggaug

SEQ ID NO: 1317262 - RNA, 18 nt, Human
agccaguccucgcccacc

SEQ ID NO: 1317263 - RNA, 23 nt, Human
agccgugggcucggggagaaagg

SEQ ID NO: 1317264 - RNA, 21 nt, Human
agcugcaacugccgaccgccc

SEQ ID NO: 1317265 - RNA, 19 nt, Human
agcugguuguagugacagu

SEQ ID NO: 1317266 - RNA, 24 nt, Human
aggaaccagcaccuccacacugaa

SEQ ID NO: 1317267 - RNA, 23 nt, Human
aggaagaccucuucacccaggga

SEQ ID NO: 1317268 - RNA, 22 nt, Human
aggaagacgugcuugugggcua

SEQ ID NO: 1317269 - RNA, 22 nt, Human
aggaccaggggcugcccauccu

SEQ ID NO: 1317270 - RNA, 22 nt, Human
aggaguagagcccagaaucacc

SEQ ID NO: 1317271 - RNA, 21 nt, Human
aggaucaccacuuucuucgcc

SEQ ID NO: 1317272 - RNA, 18 nt, Human
aggcagcccauucuggag

SEQ ID NO: 1317273 - RNA, 18 nt, Human
aggcagggcaggcugggg

SEQ ID NO: 1317274 - RNA, 23 nt, Human
aggcaggguggugaacacaggca

SEQ ID NO: 1317275 - RNA, 23 nt, Human
aggccagcccccuccccggggag

SEQ ID NO: 1317276 - RNA, 22 nt, Human
aggcugcaggaaaggagcugug

SEQ ID NO: 1317277 - RNA, 24 nt, Human
aggcuggggugugggcggucaggg

SEQ ID NO: 1317278 - RNA, 20 nt, Human
agggcaggcuggggcccugc

SEQ ID NO: 1317279 - RNA, 21 nt, Human
agggccucccggaaggacagg

SEQ ID NO: 1317280 - RNA, 21 nt, Human
agggguggggcugccccgggc

SEQ ID NO: 1317281 - RNA, 23 nt, Human
agggucagguuggaggggcuggg

SEQ ID NO: 1317282 - RNA, 23 nt, Human
agguacaacagccuccccacagc

SEQ ID NO: 1317283 - RNA, 19 nt, Human
agguaccgccccgagucug

SEQ ID NO: 1317284 - RNA, 18 nt, Human
aggucacaguuggcucag

SEQ ID NO: 1317285 - RNA, 21 nt, Human
aggugcacgcggcggcgggcc

SEQ ID NO: 1317286 - RNA, 18 nt, Human
aggugccugcauccccag

SEQ ID NO: 1317287 - RNA, 18 nt, Human
agguguccuccccggggc

SEQ ID NO: 1317288 - RNA, 23 nt, Human
agguucucggccacacagcugua

SEQ ID NO: 1317289 - RNA, 23 nt, Human
aguaccaggauggugaggugcac

SEQ ID NO: 1317290 - RNA, 19 nt, Human
agucuccacguucuccagc

SEQ ID NO: 1317291 - RNA, 18 nt, Human
aucauggucacggugaag

SEQ ID NO: 1317292 - RNA, 19 nt, Human
auccagccaccugccagca

SEQ ID NO: 1317293 - RNA, 22 nt, Human
auccgguaaccccuggggcagc

SEQ ID NO: 1317294 - RNA, 24 nt, Human
aucggccucacaguccagccgcaa

SEQ ID NO: 1317295 - RNA, 20 nt, Human
augaacucggagcuggaagu

SEQ ID NO: 1317296 - RNA, 24 nt, Human
augcugcugaccccggagugugcc

SEQ ID NO: 1317297 - RNA, 19 nt, Human
auugcucaccacgcauuca

SEQ ID NO: 1317298 - RNA, 20 nt, Human
caaacggggccccguccuuc

SEQ ID NO: 1317299 - RNA, 21 nt, Human
caaacuuccucucugcccucc

SEQ ID NO: 1317300 - RNA, 22 nt, Human
caacaaggguuccccauccuuc

SEQ ID NO: 1317301 - RNA, 21 nt, Human
caacagccuccccacagccga

SEQ ID NO: 1317302 - RNA, 21 nt, Human
caacaggacacugagcuggaa

SEQ ID NO: 1317303 - RNA, 21 nt, Human
caacugccgaccgccccuagu

SEQ ID NO: 1317304 - RNA, 22 nt, Human
caagacuugcccguccuccagg

SEQ ID NO: 1317305 - RNA, 19 nt, Human
caaguccaggccuugaacc

SEQ ID NO: 1317306 - RNA, 22 nt, Human
caaguguagaugcccucguccc

SEQ ID NO: 1317307 - RNA, 20 nt, Human
caaguucuucaccagcaacu

SEQ ID NO: 1317308 - RNA, 19 nt, Human
caauccgcagcuguccgcc

SEQ ID NO: 1317309 - RNA, 26 nt, Human
cacagccacgcaggaguaccucccag

SEQ ID NO: 1317310 - RNA, 22 nt, Human
cacagcccagcucucacacucc

SEQ ID NO: 1317311 - RNA, 21 nt, Human
cacagccgacacgugcuggag

SEQ ID NO: 1317312 - RNA, 18 nt, Human
cacagccggccccaucag

SEQ ID NO: 1317313 - RNA, 19 nt, Human
cacagcgguagcucccagc

SEQ ID NO: 1317314 - RNA, 19 nt, Human
cacaggcauccuguccuuc

SEQ ID NO: 1317315 - RNA, 23 nt, Human
cacagucuagcugaaugcugccu

SEQ ID NO: 1317316 - RNA, 23 nt, Human
caccaggaccgcauccuggggac

SEQ ID NO: 1317317 - RNA, 20 nt, Human
caccaggguccccgagccgu

SEQ ID NO: 1317318 - RNA, 22 nt, Human
caccccaaaucugcagccuggg

SEQ ID NO: 1317319 - RNA, 23 nt, Human
caccccagccagcuccucggcug

SEQ ID NO: 1317320 - RNA, 21 nt, Human
cacccgcaucagaggccccac

SEQ ID NO: 1317321 - RNA, 22 nt, Human
cacccuccuggauccuggggaa

SEQ ID NO: 1317322 - RNA, 20 nt, Human
caccggagcacucugcagga

SEQ ID NO: 1317323 - RNA, 18 nt, Human
caccgugcaccgcgcugc

SEQ ID NO: 1317324 - RNA, 19 nt, Human
caccuccuucacgccgacc

SEQ ID NO: 1317325 - RNA, 22 nt, Human
caccucggccccggcagugccc

SEQ ID NO: 1317326 - RNA, 20 nt, Human
caccuggaacaccggagcac

SEQ ID NO: 1317327 - RNA, 21 nt, Human
caccugucccaagccuucagc

SEQ ID NO: 1317328 - RNA, 19 nt, Human
cacgacacgagaggcaggg

SEQ ID NO: 1317329 - RNA, 23 nt, Human
cacgcccgaagccagacacucca

SEQ ID NO: 1317330 - RNA, 20 nt, Human
cacgccgaccuccgccaagg

SEQ ID NO: 1317331 - RNA, 19 nt, Human
cacgggcuggccgucccgc

SEQ ID NO: 1317332 - RNA, 22 nt, Human
cacggucaccuccucaucugca

SEQ ID NO: 1317333 - RNA, 21 nt, Human
cacggucggagcugguauacc

SEQ ID NO: 1317334 - RNA, 18 nt, Human
cacgugaccucgggguuu

SEQ ID NO: 1317335 - RNA, 20 nt, Human
cacguggaugggcggggagc

SEQ ID NO: 1317336 - RNA, 21 nt, Human
cacuccaaggucaaggugcug

SEQ ID NO: 1317337 - RNA, 19 nt, Human
cacugaaguuccuccgugc

SEQ ID NO: 1317338 - RNA, 23 nt, Human
cacugagcugcaccagcuucugg

SEQ ID NO: 1317339 - RNA, 21 nt, Human
cacugcuaccacgaaguccuu

SEQ ID NO: 1317340 - RNA, 19 nt, Human
cacuggacagguuugccug

SEQ ID NO: 1317341 - RNA, 20 nt, Human
cacuggauaguggguacugg

SEQ ID NO: 1317342 - RNA, 22 nt, Human
cagagagaugggguuguugaca

SEQ ID NO: 1317343 - RNA, 22 nt, Human
cagagaguggccauucagggcu

SEQ ID NO: 1317344 - RNA, 24 nt, Human
cagcacaaguguagaaggcugacc

SEQ ID NO: 1317345 - RNA, 20 nt, Human
cagcacaggagggggcaugg

SEQ ID NO: 1317346 - RNA, 28 nt, Human
cagcacauucaccgugugcagccuggcc

SEQ ID NO: 1317347 - RNA, 20 nt, Human
cagcaccuccuccucugcca

SEQ ID NO: 1317348 - RNA, 22 nt, Human
cagcagguagguguccuccccg

SEQ ID NO: 1317349 - RNA, 21 nt, Human
cagccacacgaucucagggac

SEQ ID NO: 1317350 - RNA, 20 nt, Human
cagccaccaggagcuguggg

SEQ ID NO: 1317351 - RNA, 24 nt, Human
cagccagacaaguguacagcccag

SEQ ID NO: 1317352 - RNA, 18 nt, Human
cagccucagcacacuccc

SEQ ID NO: 1317353 - RNA, 24 nt, Human
cagccucagcacacucccgucugu

SEQ ID NO: 1317354 - RNA, 21 nt, Human
cagccugguggccuucucugc

SEQ ID NO: 1317355 - RNA, 24 nt, Human
cagcgaagccacagccugucccca

SEQ ID NO: 1317356 - RNA, 23 nt, Human
cagcgccacaggccucccagcca

SEQ ID NO: 1317357 - RNA, 28 nt, Human
cagcggcuucaccaccggggaggcuugc

SEQ ID NO: 1317358 - RNA, 18 nt, Human
cagcuccucggcugggcg

SEQ ID NO: 1317359 - RNA, 21 nt, Human
cagcuccucggcugggcggcc

SEQ ID NO: 1317360 - RNA, 21 nt, Human
cagcuggauguuccuggaggc

SEQ ID NO: 1317361 - RNA, 22 nt, Human
cagcugggccugucccagguac

SEQ ID NO: 1317362 - RNA, 21 nt, Human
cagcugggcugaaggccacgc

SEQ ID NO: 1317363 - RNA, 24 nt, Human
cagcugggcuugcggccacacagg

SEQ ID NO: 1317364 - RNA, 19 nt, Human
cagcuucuguccguccuuc

SEQ ID NO: 1317365 - RNA, 25 nt, Human
caggaaaggagcugugauguucuca

SEQ ID NO: 1317366 - RNA, 25 nt, Human
caggacaacauccuggcgguccucg

SEQ ID NO: 1317367 - RNA, 21 nt, Human
caggaccagcugcccuggggc

SEQ ID NO: 1317368 - RNA, 20 nt, Human
caggaccugcagccgugggc

SEQ ID NO: 1317369 - RNA, 23 nt, Human
caggagccgguaggcgcccugcu

SEQ ID NO: 1317370 - RNA, 19 nt, Human
caggcugcgguccccaggc

SEQ ID NO: 1317371 - RNA, 21 nt, Human
cagggagccacgaaccaccac

SEQ ID NO: 1317372 - RNA, 20 nt, Human
cagggcagcaaggcuggggu

SEQ ID NO: 1317373 - RNA, 21 nt, Human
cagggcccaguagaugggggc

SEQ ID NO: 1317374 - RNA, 19 nt, Human
cagggggacccuguccuuc

SEQ ID NO: 1317375 - RNA, 19 nt, Human
cagggucagguuggagggg

SEQ ID NO: 1317376 - RNA, 20 nt, Human
cagguacaacagccucccca

SEQ ID NO: 1317377 - RNA, 23 nt, Human
cagguagguguccuccccggggc

SEQ ID NO: 1317378 - RNA, 19 nt, Human
cagguccuggcugcuguuc

SEQ ID NO: 1317379 - RNA, 19 nt, Human
cagguuggaggggcugggg

SEQ ID NO: 1317380 - RNA, 19 nt, Human
cagucaugcugccccagcu

SEQ ID NO: 1317381 - RNA, 23 nt, Human
cagucgcccuucacccaggaccu

SEQ ID NO: 1317382 - RNA, 22 nt, Human
cagucuccacguucuccagcca

SEQ ID NO: 1317383 - RNA, 24 nt, Human
caucagaaagcugggcuugcucaa

SEQ ID NO: 1317384 - RNA, 18 nt, Human
cauccuggcgguccucgc

SEQ ID NO: 1317385 - RNA, 21 nt, Human
caugcacagacaccuccaccu

SEQ ID NO: 1317386 - RNA, 19 nt, Human
cauggcacugcccgcacug

SEQ ID NO: 1317387 - RNA, 25 nt, Human
cauguagcuggcggcgucggccacc

SEQ ID NO: 1317388 - RNA, 22 nt, Human
ccacacagcuguacaggccacu

SEQ ID NO: 1317389 - RNA, 24 nt, Human
ccacagccuguccccaaggcgcag

SEQ ID NO: 1317390 - RNA, 25 nt, Human
ccacaucuucacagccggccccauc

SEQ ID NO: 1317391 - RNA, 21 nt, Human
ccaccgcgcucacagccacgc

SEQ ID NO: 1317392 - RNA, 18 nt, Human
ccacgacacgagaggcag

SEQ ID NO: 1317393 - RNA, 23 nt, Human
ccacgcaccacacagucuagcug

SEQ ID NO: 1317394 - RNA, 18 nt, Human
ccacgcacuccagcgcca

SEQ ID NO: 1317395 - RNA, 22 nt, Human
ccacgcacuccagcgccacagg

SEQ ID NO: 1317396 - RNA, 23 nt, Human
ccacgcacuccagcgccacaggc

SEQ ID NO: 1317397 - RNA, 22 nt, Human
ccacgcaggaguaccucccaga

SEQ ID NO: 1317398 - RNA, 23 nt, Human
ccacgucugcaccggccaauccu

SEQ ID NO: 1317399 - RNA, 19 nt, Human
ccacgugaucuugggcgcu

SEQ ID NO: 1317400 - RNA, 21 nt, Human
ccacguucuccagccacaggc

SEQ ID NO: 1317401 - RNA, 20 nt, Human
ccacucucucuggccagggc

SEQ ID NO: 1317402 - RNA, 21 nt, Human
ccacugccuccagcugcaggc

SEQ ID NO: 1317403 - RNA, 23 nt, Human
ccacugccuccagcugcaggcug

SEQ ID NO: 1317404 - RNA, 21 nt, Human
ccagaacacugagcugcacca

SEQ ID NO: 1317405 - RNA, 22 nt, Human
ccagacacuccaaggucacuga

SEQ ID NO: 1317406 - RNA, 18 nt, Human
ccagcagguagguguccu

SEQ ID NO: 1317407 - RNA, 21 nt, Human
ccagcucagcacaggaggggg

SEQ ID NO: 1317408 - RNA, 24 nt, Human
ccaggauggugggagccaacagga

SEQ ID NO: 1317409 - RNA, 21 nt, Human
ccaggcauucguccacaucuu

SEQ ID NO: 1317410 - RNA, 22 nt, Human
ccaggccgaccacaaagcgggg

SEQ ID NO: 1317411 - RNA, 18 nt, Human
ccaguggccagggucacc

SEQ ID NO: 1317412 - RNA, 23 nt, Human
ccaguggccagggucaccccaaa

SEQ ID NO: 1317413 - RNA, 26 nt, Human
ccaucaaggaccuugaucaccuccuc

SEQ ID NO: 1317414 - RNA, 21 nt, Human
ccauccuuccaccaacggagg

SEQ ID NO: 1317415 - RNA, 18 nt, Human
ccauggcacugcccgcac

SEQ ID NO: 1317416 - RNA, 20 nt, Human
cccacagcauugcuggccuu

SEQ ID NO: 1317417 - RNA, 20 nt, Human
cccacagcauugcuggccuu

SEQ ID NO: 1317418 - RNA, 21 nt, Human
cccacagcauugcuggccuug

SEQ ID NO: 1317419 - RNA, 25 nt, Human
cccacagccgacacgugcuggaggc

SEQ ID NO: 1317420 - RNA, 22 nt, Human
cccacagucggggaggcagccg

SEQ ID NO: 1317421 - RNA, 21 nt, Human
cccaccacguugcugcauuca

SEQ ID NO: 1317422 - RNA, 22 nt, Human
cccaccacguugcugcauucac

SEQ ID NO: 1317423 - RNA, 23 nt, Human
cccaccacguugcugcauucaca

SEQ ID NO: 1317424 - RNA, 19 nt, Human
cccaccucauugcucacca

SEQ ID NO: 1317425 - RNA, 22 nt, Human
cccagaaucacccuccuggauc

SEQ ID NO: 1317426 - RNA, 23 nt, Human
cccagaucucacugucauguccu

SEQ ID NO: 1317427 - RNA, 19 nt, Human
cccagcugcaacugccgac

SEQ ID NO: 1317428 - RNA, 20 nt, Human
cccaggugauguugggcuca

SEQ ID NO: 1317429 - RNA, 19 nt, Human
ccccaaaggcugccagggc

SEQ ID NO: 1317430 - RNA, 25 nt, Human
ccccacagccgacacgugcuggagg

SEQ ID NO: 1317431 - RNA, 23 nt, Human
ccccagccagcuccucggcuggg

SEQ ID NO: 1317432 - RNA, 23 nt, Human
ccccaggccugcucaccaggguc

SEQ ID NO: 1317433 - RNA, 18 nt, Human
ccccaucagccacccgga

SEQ ID NO: 1317434 - RNA, 20 nt, Human
cccccacagcauugcuggcc

SEQ ID NO: 1317435 - RNA, 20 nt, Human
cccccagggaagaccugcag

SEQ ID NO: 1317436 - RNA, 20 nt, Human
cccccgagcuccuagcuggg

SEQ ID NO: 1317437 - RNA, 24 nt, Human
cccccgggagaccacaccgugcac

SEQ ID NO: 1317438 - RNA, 23 nt, Human
cccccgggcucuccagccucagc

SEQ ID NO: 1317439 - RNA, 18 nt, Human
ccccgcacagggcacacc

SEQ ID NO: 1317440 - RNA, 18 nt, Human
ccccgggcucuccagccu

SEQ ID NO: 1317441 - RNA, 22 nt, Human
ccccucccaggauggugggagc

SEQ ID NO: 1317442 - RNA, 18 nt, Human
ccccugagguccaacacu

SEQ ID NO: 1317443 - RNA, 18 nt, Human
ccccuggggcuccccucu

SEQ ID NO: 1317444 - RNA, 19 nt, Human
ccccuuguaggacaggagc

SEQ ID NO: 1317445 - RNA, 19 nt, Human
cccgcagagccuggguccg

SEQ ID NO: 1317446 - RNA, 22 nt, Human
cccggaagcucuucucaauugc

SEQ ID NO: 1317447 - RNA, 24 nt, Human
cccggcccacggcguucucagccg

SEQ ID NO: 1317448 - RNA, 21 nt, Human
cccgugcugugacaugugagg

SEQ ID NO: 1317449 - RNA, 22 nt, Human
cccucaggcagaauuucaaacc

SEQ ID NO: 1317450 - RNA, 23 nt, Human
cccucaggcagaauuucaaaccc

SEQ ID NO: 1317451 - RNA, 22 nt, Human
cccucggcgcccgacacaggcu

SEQ ID NO: 1317452 - RNA, 20 nt, Human
cccuggggcuccccucucac

SEQ ID NO: 1317453 - RNA, 23 nt, Human
cccuuguaggacaggagccuccu

SEQ ID NO: 1317454 - RNA, 23 nt, Human
ccgcacggccuccccagccacgu

SEQ ID NO: 1317455 - RNA, 18 nt, Human
ccgcagagccuggguccg

SEQ ID NO: 1317456 - RNA, 21 nt, Human
ccgcaucgucccuccaaggug

SEQ ID NO: 1317457 - RNA, 22 nt, Human
ccgcccagcagacauagguccc

SEQ ID NO: 1317458 - RNA, 20 nt, Human
ccgccccgggccuccuccuc

SEQ ID NO: 1317459 - RNA, 18 nt, Human
ccgcccguccuuccacca

SEQ ID NO: 1317460 - RNA, 19 nt, Human
ccgccuugccucaguccug

SEQ ID NO: 1317461 - RNA, 20 nt, Human
ccgcgcugcucuccacaggc

SEQ ID NO: 1317462 - RNA, 19 nt, Human
ccggaggugggggcccaug

SEQ ID NO: 1317463 - RNA, 24 nt, Human
ccggccccaucagccacccggaag

SEQ ID NO: 1317464 - RNA, 21 nt, Human
ccgugcaccgcgcugcucucc

SEQ ID NO: 1317465 - RNA, 20 nt, Human
ccuacagguuccaccaggua

SEQ ID NO: 1317466 - RNA, 20 nt, Human
ccuagcaccuccugagcggc

SEQ ID NO: 1317467 - RNA, 18 nt, Human
ccuccacggaguacugca

SEQ ID NO: 1317468 - RNA, 23 nt, Human
ccuccagcugcaggcugggcccc

SEQ ID NO: 1317469 - RNA, 22 nt, Human
ccuccaggaccugcagccgugg

SEQ ID NO: 1317470 - RNA, 23 nt, Human
ccuccaugacggccaccucgccu

SEQ ID NO: 1317471 - RNA, 19 nt, Human
ccuccccagccucguugcu

SEQ ID NO: 1317472 - RNA, 23 nt, Human
ccucccggaaggacaggcugccu

SEQ ID NO: 1317473 - RNA, 25 nt, Human
ccucccgggacaggaucucgaaggc

SEQ ID NO: 1317474 - RNA, 18 nt, Human
ccuccucugccacugccc

SEQ ID NO: 1317475 - RNA, 20 nt, Human
ccuccucugccacugcccga

SEQ ID NO: 1317476 - RNA, 22 nt, Human
ccuccucugccacugcccgaaa

SEQ ID NO: 1317477 - RNA, 21 nt, Human
ccucgcccaccgcgcucacag

SEQ ID NO: 1317478 - RNA, 26 nt, Human
ccucucacgaccaggaacgcccgggc

SEQ ID NO: 1317479 - RNA, 20 nt, Human
ccucugccacugcccgaacc

SEQ ID NO: 1317480 - RNA, 20 nt, Human
ccucuggccacgcacuccag

SEQ ID NO: 1317481 - RNA, 25 nt, Human
ccucugggcggugccagccugguuc

SEQ ID NO: 1317482 - RNA, 20 nt, Human
ccucugggcuggcaugggca

SEQ ID NO: 1317483 - RNA, 20 nt, Human
ccugcaagacuugcccgucc

SEQ ID NO: 1317484 - RNA, 25 nt, Human
ccugcaccccagccagcuccucggc

SEQ ID NO: 1317485 - RNA, 25 nt, Human
ccugcagcuggaggaaccugccccg

SEQ ID NO: 1317486 - RNA, 24 nt, Human
ccugcauccgguaaccccuggggc

SEQ ID NO: 1317487 - RNA, 22 nt, Human
ccugccggaaccugcccccagu

SEQ ID NO: 1317488 - RNA, 21 nt, Human
ccugcugaccagcugggcuga

SEQ ID NO: 1317489 - RNA, 20 nt, Human
ccuggcucgauguugggggg

SEQ ID NO: 1317490 - RNA, 22 nt, Human
ccugggcccgcuccacaugcag

SEQ ID NO: 1317491 - RNA, 19 nt, Human
ccugggggccgggggccgu

SEQ ID NO: 1317492 - RNA, 21 nt, Human
ccuguggcguugcacuccaga

SEQ ID NO: 1317493 - RNA, 19 nt, Human
ccuuccuucugccagguga

SEQ ID NO: 1317494 - RNA, 21 nt, Human
ccuuguaccacgugaccuccu

SEQ ID NO: 1317495 - RNA, 18 nt, Human
ccuuguugacugggccug

SEQ ID NO: 1317496 - RNA, 23 nt, Human
cgaagccagacacuccaagguca

SEQ ID NO: 1317497 - RNA, 21 nt, Human
cgaccaggaacgcccgggcug

SEQ ID NO: 1317498 - RNA, 23 nt, Human
cgagggguggggcugccccgggc

SEQ ID NO: 1317499 - RNA, 23 nt, Human
cgcaucgucccuccaaggugcca

SEQ ID NO: 1317500 - RNA, 19 nt, Human
cgccccgggccuccuccuc

SEQ ID NO: 1317501 - RNA, 22 nt, Human
cgcccguccuuccaccagcuca

SEQ ID NO: 1317502 - RNA, 21 nt, Human
cgcccugcugcaggcggaagu

SEQ ID NO: 1317503 - RNA, 20 nt, Human
cgcccuucacccaggaccug

SEQ ID NO: 1317504 - RNA, 18 nt, Human
cgccugggccgguugcag

SEQ ID NO: 1317505 - RNA, 19 nt, Human
cgcugggagagcgggaggg

SEQ ID NO: 1317506 - RNA, 19 nt, Human
cggauggugggcgggggca

SEQ ID NO: 1317507 - RNA, 19 nt, Human
cggcaggaguagagcccag

SEQ ID NO: 1317508 - RNA, 21 nt, Human
cggcccccccgggagaccaca

SEQ ID NO: 1317509 - RNA, 23 nt, Human
cggcugcccaucggccucacagu

SEQ ID NO: 1317510 - RNA, 22 nt, Human
cggggaggcagcgguaggaccc

SEQ ID NO: 1317511 - RNA, 22 nt, Human
cguccuggcccuccaaguucuu

SEQ ID NO: 1317512 - RNA, 24 nt, Human
cgugacuccgccccgggccuccuu

SEQ ID NO: 1317513 - RNA, 20 nt, Human
cguugaaguccuggucgucc

SEQ ID NO: 1317514 - RNA, 19 nt, Human
cguugcacuccagaguggc

SEQ ID NO: 1317515 - RNA, 22 nt, Human
cuagcaccuccugagcggcccc

SEQ ID NO: 1317516 - RNA, 24 nt, Human
cuaugcacuggagggucacaggcu

SEQ ID NO: 1317517 - RNA, 19 nt, Human
cucaaacuuccucucugcc

SEQ ID NO: 1317518 - RNA, 24 nt, Human
cucacacuccaaggucaaggugcu

SEQ ID NO: 1317519 - RNA, 24 nt, Human
cucaugcacagacaccuccaccuc

SEQ ID NO: 1317520 - RNA, 23 nt, Human
cuccaccucggccccggcagugc

SEQ ID NO: 1317521 - RNA, 18 nt, Human
cuccagccucugcccacc

SEQ ID NO: 1317522 - RNA, 18 nt, Human
cuccagccuggucagggc

SEQ ID NO: 1317523 - RNA, 24 nt, Human
cuccagcugcaggcugggccccug

SEQ ID NO: 1317524 - RNA, 22 nt, Human
cuccccgagcucauuggugacc

SEQ ID NO: 1317525 - RNA, 22 nt, Human
cuccccuggggcuccccucuca

SEQ ID NO: 1317526 - RNA, 19 nt, Human
cuccccuguagcaaacucc

SEQ ID NO: 1317527 - RNA, 24 nt, Human
cucccggcguucucugcccgcacc

SEQ ID NO: 1317528 - RNA, 24 nt, Human
cucccgggacaggaucucgaaggc

SEQ ID NO: 1317529 - RNA, 22 nt, Human
cuccgccccgggccuccuccuc

SEQ ID NO: 1317530 - RNA, 23 nt, Human
cuccgggaauugugugugggcgu

SEQ ID NO: 1317531 - RNA, 21 nt, Human
cuccucaucugcacuguccuc

SEQ ID NO: 1317532 - RNA, 20 nt, Human
cuccuccucugccacugccc

SEQ ID NO: 1317533 - RNA, 23 nt, Human
cuccuggaccugcaggugagggc

SEQ ID NO: 1317534 - RNA, 18 nt, Human
cucgcagcucaggacagc

SEQ ID NO: 1317535 - RNA, 25 nt, Human
cucggccggcagcauugagggcuuc

SEQ ID NO: 1317536 - RNA, 22 nt, Human
cucuccagccucagcacacucc

SEQ ID NO: 1317537 - RNA, 21 nt, Human
cugacuuuacagcuguauaaa

SEQ ID NO: 1317538 - RNA, 22 nt, Human
cugcaacugccgaccgccccua

SEQ ID NO: 1317539 - RNA, 18 nt, Human
cugcagcugcaggcccag

SEQ ID NO: 1317540 - RNA, 24 nt, Human
cugcaggcggaaguccagcuucug

SEQ ID NO: 1317541 - RNA, 22 nt, Human
cugccggaaccugcccccaguc

SEQ ID NO: 1317542 - RNA, 24 nt, Human
cugcucgaggcucugggacaacaa

SEQ ID NO: 1317543 - RNA, 27 nt, Human
cugcugcaggcggaaguccagcuucug

SEQ ID NO: 1317544 - RNA, 19 nt, Human
cugcuggccacacagcugu

SEQ ID NO: 1317545 - RNA, 20 nt, Human
cuggacagguuugccuggag

SEQ ID NO: 1317546 - RNA, 22 nt, Human
cuggaggugggauccccauggc

SEQ ID NO: 1317547 - RNA, 20 nt, Human
cuggccugcugaccagcugg

SEQ ID NO: 1317548 - RNA, 24 nt, Human
cugggccccugcucgaggcucugg

SEQ ID NO: 1317549 - RNA, 26 nt, Human
cugggccccugcucgaggcucuggga

SEQ ID NO: 1317550 - RNA, 18 nt, Human
cuggggcuccaccuggaa

SEQ ID NO: 1317551 - RNA, 24 nt, Human
cugguggccuucucugcggccccc

SEQ ID NO: 1317552 - RNA, 27 nt, Human
cugguuguagugacagucguccaaccc

SEQ ID NO: 1317553 - RNA, 24 nt, Human
cuguagcguccagugugggcagcc

SEQ ID NO: 1317554 - RNA, 22 nt, Human
cugucauguccuggggcuccac

SEQ ID NO: 1317555 - RNA, 22 nt, Human
cugucccagguacaacagccuc

SEQ ID NO: 1317556 - RNA, 18 nt, Human
cugugcuaccugccacau

SEQ ID NO: 1317557 - RNA, 23 nt, Human
cuucagccacaucaguguggggc

SEQ ID NO: 1317558 - RNA, 19 nt, Human
cuucagccaggccacgucc

SEQ ID NO: 1317559 - RNA, 19 nt, Human
cuugcccguccuccaggac

SEQ ID NO: 1317560 - RNA, 22 nt, Human
cuuggucuucaccuccuucacg

SEQ ID NO: 1317561 - RNA, 22 nt, Human
gaacacaggcaguaccaggaug

SEQ ID NO: 1317562 - RNA, 20 nt, Human
gaagccacagccugucccca

SEQ ID NO: 1317563 - RNA, 19 nt, Human
gaaggccgggggaaccaga

SEQ ID NO: 1317564 - RNA, 20 nt, Human
gaaguuccuccgugccuccc

SEQ ID NO: 1317565 - RNA, 20 nt, Human
gaccacgagcacccgcauca

SEQ ID NO: 1317566 - RNA, 20 nt, Human
gaccaggaacgcccgggcug

SEQ ID NO: 1317567 - RNA, 23 nt, Human
gacccuguccuuccgccagcuca

SEQ ID NO: 1317568 - RNA, 24 nt, Human
gacccuguccuuccgccagcucac

SEQ ID NO: 1317569 - RNA, 25 nt, Human
gacugucaccucuuccaccagcucc

SEQ ID NO: 1317570 - RNA, 29 nt, Human
gagaacucucccauccacugaggcacucc

SEQ ID NO: 1317571 - RNA, 19 nt, Human
gagaccugugugggcugga

SEQ ID NO: 1317572 - RNA, 21 nt, Human
gagcagcuggauguuccugga

SEQ ID NO: 1317573 - RNA, 23 nt, Human
gagcagcuggauguuccuggagg

SEQ ID NO: 1317574 - RNA, 20 nt, Human
gagcccuuccuucugccagg

SEQ ID NO: 1317575 - RNA, 22 nt, Human
gagccugaggccuggcagggaa

SEQ ID NO: 1317576 - RNA, 18 nt, Human
gagcuccuagcugggcgc

SEQ ID NO: 1317577 - RNA, 21 nt, Human
gagcucugggcccuccccagc

SEQ ID NO: 1317578 - RNA, 19 nt, Human
gagcugcaccagcuucugg

SEQ ID NO: 1317579 - RNA, 21 nt, Human
gagcugugauguucucacccc

SEQ ID NO: 1317580 - RNA, 23 nt, Human
gaggcagcgguaggacccgagca

SEQ ID NO: 1317581 - RNA, 21 nt, Human
gaggccauucucgaucacugg

SEQ ID NO: 1317582 - RNA, 22 nt, Human
gagggccuggcuguccuuguac

SEQ ID NO: 1317583 - RNA, 21 nt, Human
gagguggcugccccgcagugg

SEQ ID NO: 1317584 - RNA, 23 nt, Human
gagugugccuccugcaucacgcu

SEQ ID NO: 1317585 - RNA, 18 nt, Human
gaugccaggcagagguag

SEQ ID NO: 1317586 - RNA, 20 nt, Human
gcaagaaggcgugggagccu

SEQ ID NO: 1317587 - RNA, 20 nt, Human
gcacaaguguagaugcccuc

SEQ ID NO: 1317588 - RNA, 21 nt, Human
gcaccaaaacuuucagcgcca

SEQ ID NO: 1317589 - RNA, 21 nt, Human
gcacccguguggcucugcugu

SEQ ID NO: 1317590 - RNA, 20 nt, Human
gcacugcuaccacgaagucc

SEQ ID NO: 1317591 - RNA, 20 nt, Human
gcacuggagggucacaggcu

SEQ ID NO: 1317592 - RNA, 18 nt, Human
gcacugguaucgucccuc

SEQ ID NO: 1317593 - RNA, 24 nt, Human
gcacugguaucgucccucaucccc

SEQ ID NO: 1317594 - RNA, 22 nt, Human
gcagcacaaguguagaugcccu

SEQ ID NO: 1317595 - RNA, 18 nt, Human
gcagcugcaggcccaguu

SEQ ID NO: 1317596 - RNA, 23 nt, Human
gcagcuggauguuccuggaggcc

SEQ ID NO: 1317597 - RNA, 20 nt, Human
gcaggcggaaguccagcuuc

SEQ ID NO: 1317598 - RNA, 18 nt, Human
gcagggcagcagcaccuc

SEQ ID NO: 1317599 - RNA, 23 nt, Human
gcaguggaaggccaucuuugauc

SEQ ID NO: 1317600 - RNA, 27 nt, Human
gccagccugguucucugcccggcagaa

SEQ ID NO: 1317601 - RNA, 18 nt, Human
gcccagcaucccuaaccu

SEQ ID NO: 1317602 - RNA, 23 nt, Human
gcccaguucagcccccacgggcu

SEQ ID NO: 1317603 - RNA, 23 nt, Human
gccccgcacagggcacaccaugg

SEQ ID NO: 1317604 - RNA, 18 nt, Human
gcccgggcuguggcagag

SEQ ID NO: 1317605 - RNA, 20 nt, Human
gcccgggcuguggcagagcc

SEQ ID NO: 1317606 - RNA, 21 nt, Human
gcccucgucccucagguccac

SEQ ID NO: 1317607 - RNA, 22 nt, Human
gcccuggggcuccugggauccc

SEQ ID NO: 1317608 - RNA, 19 nt, Human
gccucgcacgggaguucca

SEQ ID NO: 1317609 - RNA, 22 nt, Human
gccucgcccaccucauugcuca

SEQ ID NO: 1317610 - RNA, 21 nt, Human
gccugguaggaccuggguacu

SEQ ID NO: 1317611 - RNA, 23 nt, Human
gccuucggugguggacaggucug

SEQ ID NO: 1317612 - RNA, 25 nt, Human
gccuugcaaggcaagaaggcguggg

SEQ ID NO: 1317613 - RNA, 21 nt, Human
gcgagcugggggucacgggcu

SEQ ID NO: 1317614 - RNA, 19 nt, Human
gcggcugcccaucggccuc

SEQ ID NO: 1317615 - RNA, 22 nt, Human
gcgguggccgcccaccuuagga

SEQ ID NO: 1317616 - RNA, 23 nt, Human
gcucacagccacgcaggaguacc

SEQ ID NO: 1317617 - RNA, 27 nt, Human
gcugcaaugcaggaguaguggccaguc

SEQ ID NO: 1317618 - RNA, 21 nt, Human
gcugccuccuacagguuccac

SEQ ID NO: 1317619 - RNA, 18 nt, Human
gcuucccccgccucgcuc

SEQ ID NO: 1317620 - RNA, 19 nt, Human
ggaacaccggagcacucug

SEQ ID NO: 1317621 - RNA, 19 nt, Human
ggaccacaggugccaucau

SEQ ID NO: 1317622 - RNA, 22 nt, Human
ggaccugcagccgugggcucgg

SEQ ID NO: 1317623 - RNA, 20 nt, Human
ggagcagcuggauguuccug

SEQ ID NO: 1317624 - RNA, 20 nt, Human
ggagccaacaggacacugag

SEQ ID NO: 1317625 - RNA, 21 nt, Human
ggaggcacauggacggucacc

SEQ ID NO: 1317626 - RNA, 18 nt, Human
ggaggcggcccccccggg

SEQ ID NO: 1317627 - RNA, 19 nt, Human
ggaggggcugggggcgaug

SEQ ID NO: 1317628 - RNA, 20 nt, Human
ggaggugggggcccaugucc

SEQ ID NO: 1317629 - RNA, 19 nt, Human
ggcaggcuggguggcagug

SEQ ID NO: 1317630 - RNA, 18 nt, Human
ggcauggcguggcucugg

SEQ ID NO: 1317631 - RNA, 22 nt, Human
ggccacgcacuccagcgccaca

SEQ ID NO: 1317632 - RNA, 23 nt, Human
ggccgggggaugccugaggccuc

SEQ ID NO: 1317633 - RNA, 18 nt, Human
ggccuggcaccgcagggc

SEQ ID NO: 1317634 - RNA, 19 nt, Human
ggccuugacgaucggagcc

SEQ ID NO: 1317635 - RNA, 21 nt, Human
ggcgauggugaccacgagcac

SEQ ID NO: 1317636 - RNA, 23 nt, Human
ggcgcaggcugcgguccccaggc

SEQ ID NO: 1317637 - RNA, 24 nt, Human
ggcuggggcccugcauccgguaac

SEQ ID NO: 1317638 - RNA, 18 nt, Human
ggcugggggcaccggugg

SEQ ID NO: 1317639 - RNA, 18 nt, Human
gggaagaccugcaggcca

SEQ ID NO: 1317640 - RNA, 21 nt, Human
gggcagcaaggcuggggugug

SEQ ID NO: 1317641 - RNA, 19 nt, Human
gggcaggagccgguaggcg

SEQ ID NO: 1317642 - RNA, 21 nt, Human
gggcauggcguggcucuggca

SEQ ID NO: 1317643 - RNA, 20 nt, Human
gggccgggggccgugaggag

SEQ ID NO: 1317644 - RNA, 20 nt, Human
gggcgauggugaccacgagc

SEQ ID NO: 1317645 - RNA, 20 nt, Human
gggcguggggaccccugagg

SEQ ID NO: 1317646 - RNA, 24 nt, Human
gggcugcacagcgaagccacagcc

SEQ ID NO: 1317647 - RNA, 18 nt, Human
ggggagccugaggccugg

SEQ ID NO: 1317648 - RNA, 23 nt, Human
ggggcaccugcaccugcaaggug

SEQ ID NO: 1317649 - RNA, 20 nt, Human
ggggcauggcguggcucugg

SEQ ID NO: 1317650 - RNA, 22 nt, Human
gggggaaccagaacacugagcu

SEQ ID NO: 1317651 - RNA, 21 nt, Human
gggggaacgugcaccuccagc

SEQ ID NO: 1317652 - RNA, 22 nt, Human
gggggcgauggugaccacgagc

SEQ ID NO: 1317653 - RNA, 20 nt, Human
gggugugggcggucaggguc

SEQ ID NO: 1317654 - RNA, 21 nt, Human
ggucagggucagguuggaggg

SEQ ID NO: 1317655 - RNA, 24 nt, Human
ggugauccugagaaccuggccauc

SEQ ID NO: 1317656 - RNA, 21 nt, Human
ggugauguuuggggugggcac

SEQ ID NO: 1317657 - RNA, 20 nt, Human
gguggcauugcaggucagcc

SEQ ID NO: 1317658 - RNA, 18 nt, Human
gguggggcugccccgggc

SEQ ID NO: 1317659 - RNA, 19 nt, Human
guagcucccagcaucagaa

SEQ ID NO: 1317660 - RNA, 19 nt, Human
guaggagaaagccuccccu

SEQ ID NO: 1317661 - RNA, 20 nt, Human
guaggugggacauaaacauc

SEQ ID NO: 1317662 - RNA, 27 nt, Human
gucacacuccagcgucaggacaucggg

SEQ ID NO: 1317663 - RNA, 21 nt, Human
gucauguccuggggcuccacc

SEQ ID NO: 1317664 - RNA, 22 nt, Human
gucugggaggccauucucgauc

SEQ ID NO: 1317665 - RNA, 18 nt, Human
gugaacuuccccucggcg

SEQ ID NO: 1317666 - RNA, 18 nt, Human
gugcugugacaugugagg

SEQ ID NO: 1317667 - RNA, 18 nt, Human
gugcuugugggcuacgcc

SEQ ID NO: 1317668 - RNA, 23 nt, Human
guggaugcugcugaccccggagu

SEQ ID NO: 1317669 - RNA, 19 nt, Human
gugggggccaguggccagg

SEQ ID NO: 1317670 - RNA, 18 nt, Human
gugguccuccaugacggc

SEQ ID NO: 1317671 - RNA, 23 nt, Human
guguccuccccggggcugacagg

SEQ ID NO: 1317672 - RNA, 20 nt, Human
guucuccagccuggucaggg

SEQ ID NO: 1317673 - RNA, 19 nt, Human
uaagaugggcagucugucc

SEQ ID NO: 1317674 - RNA, 23 nt, Human
uaagaugggcagucuguccauca

SEQ ID NO: 1317675 - RNA, 22 nt, Human
uacagcccagcaucccuaaccu

SEQ ID NO: 1317676 - RNA, 24 nt, Human
uaccacgaaguccuugcgggccuc

SEQ ID NO: 1317677 - RNA, 21 nt, Human
uaccucccggcguucucugcc

SEQ ID NO: 1317678 - RNA, 23 nt, Human
uaccugggcuuccuggaucucca

SEQ ID NO: 1317679 - RNA, 19 nt, Human
uacgccggcagaguugcgg

SEQ ID NO: 1317680 - RNA, 18 nt, Human
uagcguccagugugggca

SEQ ID NO: 1317681 - RNA, 20 nt, Human
uagcguccagugugggcagc

SEQ ID NO: 1317682 - RNA, 18 nt, Human
uagcucccagcaucagaa

SEQ ID NO: 1317683 - RNA, 18 nt, Human
uagcugaaugcugccucc

SEQ ID NO: 1317684 - RNA, 27 nt, Human
uaguggguacuggggagccugaggccu

SEQ ID NO: 1317685 - RNA, 20 nt, Human
uauggucuuccaccggcgcc

SEQ ID NO: 1317686 - RNA, 19 nt, Human
ucaaucuguagguuccccc

SEQ ID NO: 1317687 - RNA, 19 nt, Human
ucaccaggguccccgagcc

SEQ ID NO: 1317688 - RNA, 25 nt, Human
ucacccagggagagggccuggcugu

SEQ ID NO: 1317689 - RNA, 18 nt, Human
ucaccuccucaucugcac

SEQ ID NO: 1317690 - RNA, 21 nt, Human
ucacugagacguucacugcag

SEQ ID NO: 1317691 - RNA, 18 nt, Human
ucacugucucugucuugg

SEQ ID NO: 1317692 - RNA, 22 nt, Human
ucagaggccccacguuugcugg

SEQ ID NO: 1317693 - RNA, 21 nt, Human
ucagguuggaggggcuggggg

SEQ ID NO: 1317694 - RNA, 20 nt, Human
ucauuggccacaacggacac

SEQ ID NO: 1317695 - RNA, 18 nt, Human
uccaaguucuucaccagc

SEQ ID NO: 1317696 - RNA, 19 nt, Human
uccaccagaccaccagggg

SEQ ID NO: 1317697 - RNA, 21 nt, Human
uccaccagcucagcacaggag

SEQ ID NO: 1317698 - RNA, 24 nt, Human
uccaccgaacacuccaggaccagc

SEQ ID NO: 1317699 - RNA, 25 nt, Human
uccacgacacgagaggcaggggaac

SEQ ID NO: 1317700 - RNA, 19 nt, Human
uccacggaguacugcagga

SEQ ID NO: 1317701 - RNA, 19 nt, Human
uccagcgucagggacugcc

SEQ ID NO: 1317702 - RNA, 21 nt, Human
uccauccuucagccacaucag

SEQ ID NO: 1317703 - RNA, 18 nt, Human
ucccacgaugguggucac

SEQ ID NO: 1317704 - RNA, 18 nt, Human
ucccagagucggaggccu

SEQ ID NO: 1317705 - RNA, 18 nt, Human
ucccagccacagccuuca

SEQ ID NO: 1317706 - RNA, 19 nt, Human
ucccagguacaacagccuc

SEQ ID NO: 1317707 - RNA, 18 nt, Human
ucccaucgggcagggucc

SEQ ID NO: 1317708 - RNA, 21 nt, Human
uccccagaaggcuggauggug

SEQ ID NO: 1317709 - RNA, 22 nt, Human
uccccaggcaggguggugaaca

SEQ ID NO: 1317710 - RNA, 18 nt, Human
uccccauccuucauccac

SEQ ID NO: 1317711 - RNA, 24 nt, Human
uccccauggcacugcccgcacugu

SEQ ID NO: 1317712 - RNA, 22 nt, Human
uccccgagccgucugcucccug

SEQ ID NO: 1317713 - RNA, 18 nt, Human
uccccgagucaccagcuc

SEQ ID NO: 1317714 - RNA, 21 nt, Human
uccccgagucaccagcuccca

SEQ ID NO: 1317715 - RNA, 20 nt, Human
uccccuaugcacuggagggu

SEQ ID NO: 1317716 - RNA, 19 nt, Human
ucccggaaggacaggcugc

SEQ ID NO: 1317717 - RNA, 20 nt, Human
ucccggaaggacaggcugcc

SEQ ID NO: 1317718 - RNA, 21 nt, Human
ucccggaguccgacagccgug

SEQ ID NO: 1317719 - RNA, 18 nt, Human
ucccggcguucucugccc

SEQ ID NO: 1317720 - RNA, 19 nt, Human
ucccucagguccaccuucu

SEQ ID NO: 1317721 - RNA, 22 nt, Human
ucccuccaaggugccaggcccc

SEQ ID NO: 1317722 - RNA, 22 nt, Human
ucccucugggcggugccagccu

SEQ ID NO: 1317723 - RNA, 23 nt, Human
ucccucugggcggugccagccug

SEQ ID NO: 1317724 - RNA, 19 nt, Human
ucccucuugcucuccccag

SEQ ID NO: 1317725 - RNA, 24 nt, Human
ucccuguauuccgugacuccgccc

SEQ ID NO: 1317726 - RNA, 22 nt, Human
uccgacagccgugcucucccca

SEQ ID NO: 1317727 - RNA, 21 nt, Human
uccgcacggccuccccagcca

SEQ ID NO: 1317728 - RNA, 23 nt, Human
uccgcacggccuccccagccacg

SEQ ID NO: 1317729 - RNA, 24 nt, Human
uccgggaauugugugugggcgucc

SEQ ID NO: 1317730 - RNA, 23 nt, Human
uccucaaugugagggggcuccau

SEQ ID NO: 1317731 - RNA, 18 nt, Human
uccugagccagcugggcc

SEQ ID NO: 1317732 - RNA, 19 nt, Human
uccugagcggccccggcuc

SEQ ID NO: 1317733 - RNA, 25 nt, Human
uccuggaccugcaggugagggccuc

SEQ ID NO: 1317734 - RNA, 18 nt, Human
uccuggauccuggggaag

SEQ ID NO: 1317735 - RNA, 23 nt, Human
uccuggaucuccagccucugccc

SEQ ID NO: 1317736 - RNA, 24 nt, Human
uccuggggaccucugggagccugc

SEQ ID NO: 1317737 - RNA, 21 nt, Human
uccuggggcuccaccuggaac

SEQ ID NO: 1317738 - RNA, 21 nt, Human
uccuucagccaagugaccgug

SEQ ID NO: 1317739 - RNA, 24 nt, Human
ucgcauguguacaucccggagucc

SEQ ID NO: 1317740 - RNA, 20 nt, Human
ucggccacacacauguagcu

SEQ ID NO: 1317741 - RNA, 23 nt, Human
ucguggugccaggagaggguggg

SEQ ID NO: 1317742 - RNA, 23 nt, Human
ucucaaucuguagguucccccca

SEQ ID NO: 1317743 - RNA, 23 nt, Human
ucuccagccgcgacucguugcuc

SEQ ID NO: 1317744 - RNA, 21 nt, Human
ucuccagccucugcccacccc

SEQ ID NO: 1317745 - RNA, 18 nt, Human
ucucggccacacagcugu

SEQ ID NO: 1317746 - RNA, 23 nt, Human
ucucugaguggccggccugguuc

SEQ ID NO: 1317747 - RNA, 19 nt, Human
ucugagggggaacgugcac

SEQ ID NO: 1317748 - RNA, 19 nt, Human
ucugcagcccguggguacc

SEQ ID NO: 1317749 - RNA, 19 nt, Human
ucugcagcugcaggcccag

SEQ ID NO: 1317750 - RNA, 19 nt, Human
ucugcagcugcaggcccag

SEQ ID NO: 1317751 - RNA, 21 nt, Human
ucugcccgcaccagggggauc

SEQ ID NO: 1317752 - RNA, 19 nt, Human
ucugcccucccagccaggu

SEQ ID NO: 1317753 - RNA, 24 nt, Human
ucuugcucuccccagccagguugg

SEQ ID NO: 1317754 - RNA, 20 nt, Human
ugaagagacagguugguggc

SEQ ID NO: 1317755 - RNA, 22 nt, Human
ugacaggcuccuccccucggaa

SEQ ID NO: 1317756 - RNA, 21 nt, Human
ugacagucacggucaccuccu

SEQ ID NO: 1317757 - RNA, 20 nt, Human
ugaccaacacagggccuggc

SEQ ID NO: 1317758 - RNA, 19 nt, Human
ugacuccgccccgggccuc

SEQ ID NO: 1317759 - RNA, 18 nt, Human
ugagacguucacugcagg

SEQ ID NO: 1317760 - RNA, 22 nt, Human
ugagcuugggcuguggguggcc

SEQ ID NO: 1317761 - RNA, 18 nt, Human
ugagggcuucgcaugugu

SEQ ID NO: 1317762 - RNA, 19 nt, Human
ugaguccugggggccgggg

SEQ ID NO: 1317763 - RNA, 22 nt, Human
ugauccaguggauguccggcac

SEQ ID NO: 1317764 - RNA, 20 nt, Human
ugcaccugcagggcuuucag

SEQ ID NO: 1317765 - RNA, 21 nt, Human
ugcacuggagggucacaggcu

SEQ ID NO: 1317766 - RNA, 23 nt, Human
ugcacuguccucggccccuccca

SEQ ID NO: 1317767 - RNA, 22 nt, Human
ugcagagauaguuuccagcauc

SEQ ID NO: 1317768 - RNA, 22 nt, Human
ugcagccacuggauagugggua

SEQ ID NO: 1317769 - RNA, 25 nt, Human
ugcagcggugaccgccugggguguu

SEQ ID NO: 1317770 - RNA, 22 nt, Human
ugcaggcucugacccugguucu

SEQ ID NO: 1317771 - RNA, 25 nt, Human
ugccacacagcgguagcucccagca

SEQ ID NO: 1317772 - RNA, 22 nt, Human
ugccagcgucugccaauugcac

SEQ ID NO: 1317773 - RNA, 21 nt, Human
ugccaggugauguugggcugg

SEQ ID NO: 1317774 - RNA, 24 nt, Human
ugccuccagcugcaggcugggccc

SEQ ID NO: 1317775 - RNA, 22 nt, Human
ugccugcauccccagucuccac

SEQ ID NO: 1317776 - RNA, 18 nt, Human
ugccuggaggaccugcag

SEQ ID NO: 1317777 - RNA, 20 nt, Human
ugccuggaggaccugcagga

SEQ ID NO: 1317778 - RNA, 18 nt, Human
ugccuugcuccaggacac

SEQ ID NO: 1317779 - RNA, 21 nt, Human
ugccuugcuccaggacacggu

SEQ ID NO: 1317780 - RNA, 25 nt, Human
ugccuugcuccaggacacggucgga

SEQ ID NO: 1317781 - RNA, 18 nt, Human
ugcgagggguggggcugc

SEQ ID NO: 1317782 - RNA, 23 nt, Human
ugcgcugggagagcgggaggggc

SEQ ID NO: 1317783 - RNA, 18 nt, Human
ugcugcuguggaugcugc

SEQ ID NO: 1317784 - RNA, 19 nt, Human
ugcugguggggagcagggc

SEQ ID NO: 1317785 - RNA, 19 nt, Human
uggacaggucugggaggcc

SEQ ID NO: 1317786 - RNA, 18 nt, Human
uggagauggaagggggga

SEQ ID NO: 1317787 - RNA, 24 nt, Human
uggaggagggugcgcugggagagc

SEQ ID NO: 1317788 - RNA, 21 nt, Human
uggaugccucccccgggcucu

SEQ ID NO: 1317789 - RNA, 21 nt, Human
uggauguccggcacugggucu

SEQ ID NO: 1317790 - RNA, 19 nt, Human
uggcaggcgaagaggccug

SEQ ID NO: 1317791 - RNA, 18 nt, Human
uggcaggcuggguggcag

SEQ ID NO: 1317792 - RNA, 20 nt, Human
uggcaggcuggguggcagug

SEQ ID NO: 1317793 - RNA, 23 nt, Human
uggcaugggcaauccgcagcugu

SEQ ID NO: 1317794 - RNA, 18 nt, Human
uggccagagccguggagg

SEQ ID NO: 1317795 - RNA, 21 nt, Human
uggcccagcgggcugccgucc

SEQ ID NO: 1317796 - RNA, 18 nt, Human
uggccggccugguucagu

SEQ ID NO: 1317797 - RNA, 23 nt, Human
uggcguggcucuggcacuccagg

SEQ ID NO: 1317798 - RNA, 21 nt, Human
uggcuggauucucagggaacc

SEQ ID NO: 1317799 - RNA, 25 nt, Human
ugggagcagcuggauguuccuggag

SEQ ID NO: 1317800 - RNA, 21 nt, Human
ugggaggaaccagcaccucca

SEQ ID NO: 1317801 - RNA, 19 nt, Human
ugggcugaguccugggggc

SEQ ID NO: 1317802 - RNA, 19 nt, Human
ugggcuggaucuggagcag

SEQ ID NO: 1317803 - RNA, 23 nt, Human
ugggcuguggguggccugugacg

SEQ ID NO: 1317804 - RNA, 21 nt, Human
uggggaaguggagggacuggc

SEQ ID NO: 1317805 - RNA, 22 nt, Human
uggggagauguggugagcaucu

SEQ ID NO: 1317806 - RNA, 20 nt, Human
uggggccaggccgaccacaa

SEQ ID NO: 1317807 - RNA, 21 nt, Human
uggggcuccugggauccaggg

SEQ ID NO: 1317808 - RNA, 18 nt, Human
ugggggaagggaaggcca

SEQ ID NO: 1317809 - RNA, 18 nt, Human
ugggggcaccgguggcau

SEQ ID NO: 1317810 - RNA, 21 nt, Human
ugggggccgggggccgugagg

SEQ ID NO: 1317811 - RNA, 21 nt, Human
ugggguguucucgcagagcug

SEQ ID NO: 1317812 - RNA, 21 nt, Human
ugggguucucaaauguugggg

SEQ ID NO: 1317813 - RNA, 25 nt, Human
ugggucuccacgcaccacacagucu

SEQ ID NO: 1317814 - RNA, 22 nt, Human
ugggugccaggcaggaggaaga

SEQ ID NO: 1317815 - RNA, 23 nt, Human
uggucggccgggggaugccugag

SEQ ID NO: 1317816 - RNA, 19 nt, Human
uggugaggugcacgcggcg

SEQ ID NO: 1317817 - RNA, 19 nt, Human
ugguucugcagcugcaggc

SEQ ID NO: 1317818 - RNA, 20 nt, Human
ugucccaggugauguugggc

SEQ ID NO: 1317819 - RNA, 21 nt, Human
uguccuccccggggcugacag

SEQ ID NO: 1317820 - RNA, 23 nt, Human
ugugcagcuguagucgccgcugu

SEQ ID NO: 1317821 - RNA, 18 nt, Human
ugugccuccugcaucacg

SEQ ID NO: 1317822 - RNA, 21 nt, Human
ugugggcguccuccugcagca

SEQ ID NO: 1317823 - RNA, 19 nt, Human
ugugggcucuccaguggcc

SEQ ID NO: 1317824 - RNA, 22 nt, Human
uguuguucuccagccuggucag

SEQ ID NO: 1317825 - RNA, 21 nt, Human
uucacugagacguucacugca

SEQ ID NO: 1317826 - RNA, 20 nt, Human
uucagccaccaggagcugug

SEQ ID NO: 1317827 - RNA, 23 nt, Human
uuccaccagaccaccaggggcuu

SEQ ID NO: 1317828 - RNA, 22 nt, Human
uuccaccagcuccuucagcacc

SEQ ID NO: 1317829 - RNA, 21 nt, Human
uuccuccgugccuccccagcc

SEQ ID NO: 1317830 - RNA, 19 nt, Human
uuccuggaucuccagccuc

SEQ ID NO: 1317831 - RNA, 22 nt, Human
uuccuucugggcauucaggauc

SEQ ID NO: 1317832 - RNA, 26 nt, Human
uucucagccacgcacguguaggugcc

SEQ ID NO: 1317833 - RNA, 20 nt, Human
uucuccagccacaggcuccc

SEQ ID NO: 1317834 - RNA, 19 nt, Human
uucuccagccuggucaggg

SEQ ID NO: 1317835 - RNA, 19 nt, Human
uucucgaucacugguggga

SEQ ID NO: 1317836 - RNA, 23 nt, Human
uucucggccacacacauguagcu

SEQ ID NO: 1317837 - RNA, 24 nt, Human
uucuggaacauggggggcaccugg

SEQ ID NO: 1317838 - RNA, 19 nt, Human
uugaaccaggugauguuug

SEQ ID NO: 1317839 - RNA, 20 nt, Human
uugaaccaggugauguuugg

SEQ ID NO: 1317840 - RNA, 21 nt, Human
uugaaccaugugagcuugggc

SEQ ID NO: 1317841 - RNA, 21 nt, Human
uugcugacuuuacagcuguau

SEQ ID NO: 1317842 - RNA, 24 nt, Human
uuuccggccauuuaucaccccagu

SEQ ID NO: 1317843 - RNA, 18 nt, Human
uuuggagauggaaggggg

SEQ ID NO: 1317844 - RNA, 24 nt, Human
agugacacauguuucuucccuccu

SEQ ID NO: 1317845 - RNA, 18 nt, Human
gagugacacauguuucuu

SEQ ID NO: 1317846 - RNA, 18 nt, Human
accuuaaaaagaucagaa

SEQ ID NO: 1317847 - RNA, 20 nt, Human
aggucugcagccgcccgcag

SEQ ID NO: 1317848 - RNA, 23 nt, Human
aggucugcagccgcccgcagccu

SEQ ID NO: 1317849 - RNA, 19 nt, Human
auuccgguccccucccgcc

SEQ ID NO: 1317850 - RNA, 21 nt, Human
cacaggcuauaaauaugaagc

SEQ ID NO: 1317851 - RNA, 25 nt, Human
ccagugaaccuuaaaaagaucagaa

SEQ ID NO: 1317852 - RNA, 23 nt, Human
ccgccgcgugccucucgccgucc

SEQ ID NO: 1317853 - RNA, 23 nt, Human
cgccgcgugccucucgccguccc

SEQ ID NO: 1317854 - RNA, 22 nt, Human
cggcgggccggucuccgcuccc

SEQ ID NO: 1317855 - RNA, 19 nt, Human
cggcgucgggggcggcggg

SEQ ID NO: 1317856 - RNA, 22 nt, Human
cgggccggucuccgcucccagg

SEQ ID NO: 1317857 - RNA, 18 nt, Human
cuccgagccccggcugcg

SEQ ID NO: 1317858 - RNA, 21 nt, Human
cugcggauuccgguccccucc

SEQ ID NO: 1317859 - RNA, 22 nt, Human
gcggcgucgggggcggcgggcc

SEQ ID NO: 1317860 - RNA, 22 nt, Human
ggcggcgggccggucuccgcuc

SEQ ID NO: 1317861 - RNA, 22 nt, Human
gugaaccuuaaaaagaucagaa

SEQ ID NO: 1317862 - RNA, 25 nt, Human
uaccacaggcuauaaauaugaagca

SEQ ID NO: 1317863 - RNA, 20 nt, Human
ucgccgcccgucguucugcc

SEQ ID NO: 1317864 - RNA, 23 nt, Human
ucgggggcggcgggccggucucc

SEQ ID NO: 1317865 - RNA, 21 nt, Human
ugaagcaauauuucagcaaga

SEQ ID NO: 1317866 - RNA, 21 nt, Human
ugaugguaaaaacuaaaaacc

SEQ ID NO: 1317867 - RNA, 20 nt, Human
ugguuaauacaccagugaac

SEQ ID NO: 1317868 - RNA, 20 nt, Human
aaaguuuuaguagauuuucc

SEQ ID NO: 1317869 - RNA, 24 nt, Human
acgaggaaccacacuucgugagcc

SEQ ID NO: 1317870 - RNA, 23 nt, Human
agaccuauguucauucucucugg

SEQ ID NO: 1317871 - RNA, 19 nt, Human
caacacugagaagaucaaa

SEQ ID NO: 1317872 - RNA, 21 nt, Human
caacacugagaagaucaaaua

SEQ ID NO: 1317873 - RNA, 18 nt, Human
cacugagaagaucaaaua

SEQ ID NO: 1317874 - RNA, 21 nt, Human
cucucuggauuaauggugaaa

SEQ ID NO: 1317875 - RNA, 27 nt, Human
gaaccacacuucgugaggugcccuagc

SEQ ID NO: 1317876 - RNA, 24 nt, Human
ucucucuggauuaauggugaaagu

SEQ ID NO: 1317877 - RNA, 20 nt, Human
ucugagaccuauguucauuc

SEQ ID NO: 1317878 - RNA, 28 nt, Human
uggaaaaagugcugacacuaugcucauu

SEQ ID NO: 1317879 - RNA, 22 nt, Human
uuaguagauuuuccaacacuga

SEQ ID NO: 1317880 - RNA, 22 nt, Human
uuccugagcaaugaacugaaua

SEQ ID NO: 1317881 - RNA, 23 nt, Human
accccgaagagcaggcugaagag

SEQ ID NO: 1317882 - RNA, 18 nt, Human
agcgggccuuccgcgagg

SEQ ID NO: 1317883 - RNA, 19 nt, Human
cacgaagaccccgaagagc

SEQ ID NO: 1317884 - RNA, 20 nt, Human
ccagcugguagacacgaaga

SEQ ID NO: 1317885 - RNA, 21 nt, Human
cgaagagcaggcugaagagca

SEQ ID NO: 1317886 - RNA, 22 nt, Human
cgagcgggccuuccgcgaggcc

SEQ ID NO: 1317887 - RNA, 23 nt, Human
cgagcgggccuuccgcgaggccu

SEQ ID NO: 1317888 - RNA, 18 nt, Human
gaagaccccgaagagcag

SEQ ID NO: 1317889 - RNA, 21 nt, Human
gaagagcaccagcgagcgggc

SEQ ID NO: 1317890 - RNA, 25 nt, Human
gaccccgaagagcaggcugaagagc

SEQ ID NO: 1317891 - RNA, 22 nt, Human
uagacacgaagaccccgaagag

SEQ ID NO: 1317892 - RNA, 20 nt, Human
uccgcgaggccuccucagcc

SEQ ID NO: 1317893 - RNA, 20 nt, Human
aggcacuucuugaggacagc

SEQ ID NO: 1317894 - RNA, 23 nt, Human
cuuaaggcacuucuugaggacag

SEQ ID NO: 1317895 - RNA, 18 nt, Human
ugagauuacaagagaguu

SEQ ID NO: 1317896 - RNA, 20 nt, Human
ugaggacagcugagauuaca

SEQ ID NO: 1317897 - RNA, 22 nt, Human
aaacaaucagaaaaagagggac

SEQ ID NO: 1317898 - RNA, 19 nt, Human
aacaaucagaaaaagaggg

SEQ ID NO: 1317899 - RNA, 19 nt, Human
acauuguccucauaaaucc

SEQ ID NO: 1317900 - RNA, 19 nt, Human
accaaaaccaugaucgagu

SEQ ID NO: 1317901 - RNA, 20 nt, Human
cacauuguccucauaaaucc

SEQ ID NO: 1317902 - RNA, 21 nt, Human
ccagcaucauccugauaccaa

SEQ ID NO: 1317903 - RNA, 22 nt, Human
ccauuccuucugaaacuauucc

SEQ ID NO: 1317904 - RNA, 18 nt, Human
cccugggaugcaaggcug

SEQ ID NO: 1317905 - RNA, 24 nt, Human
cugauaccaaaaccaugaucgagu

SEQ ID NO: 1317906 - RNA, 20 nt, Human
gagguacaaagaggagcugg

SEQ ID NO: 1317907 - RNA, 20 nt, Human
gccugaguccaucacuuucc

SEQ ID NO: 1317908 - RNA, 22 nt, Human
gcuauaagccugaguccaucac

SEQ ID NO: 1317909 - RNA, 24 nt, Human
ggagcagaaaauucaggcccugug

SEQ ID NO: 1317910 - RNA, 22 nt, Human
guauuccaucacaucaacagaa

SEQ ID NO: 1317911 - RNA, 23 nt, Human
uauuccaaacaaucagaaaaaga

SEQ ID NO: 1317912 - RNA, 19 nt, Human
ucccugggaugcaaggcug

SEQ ID NO: 1317913 - RNA, 21 nt, Human
ugcaccagagguacaaagagg

SEQ ID NO: 1317914 - RNA, 21 nt, Human
ugccuaugcuauaagccugag

SEQ ID NO: 1317915 - RNA, 24 nt, Human
uucaacauacacaaaucaguaaac

SEQ ID NO: 1317916 - RNA, 23 nt, Human
uugcaccagagguacaaagagga

SEQ ID NO: 1317917 - RNA, 22 nt, Human
uuuaauaguugagcuguggagu

SEQ ID NO: 1317918 - RNA, 25 nt, Human
uuuaugaggccagcaucauccugau

SEQ ID NO: 1317919 - RNA, 26 nt, Human
aacagaauuaaaacucccaagggucu

SEQ ID NO: 1317920 - RNA, 21 nt, Human
aagcaguggaggccccacagg

SEQ ID NO: 1317921 - RNA, 22 nt, Human
agcaguggaggccccacagggc

SEQ ID NO: 1317922 - RNA, 18 nt, Human
cacagggcaaguacaaaa

SEQ ID NO: 1317923 - RNA, 19 nt, Human
cacagggcaaguacaaaac

SEQ ID NO: 1317924 - RNA, 21 nt, Human
cacagggcaaguacaaaacag

SEQ ID NO: 1317925 - RNA, 26 nt, Human
gucucccauagaaaagcaguggaggc

SEQ ID NO: 1317926 - RNA, 18 nt, Human
ccacuggugcugcauccu

SEQ ID NO: 1317927 - RNA, 22 nt, Human
cugcauccuuugcugggggccu

SEQ ID NO: 1317928 - RNA, 21 nt, Human
uuggucacagugauuauucuu

SEQ ID NO: 1317929 - RNA, 21 nt, Human
aaaaacaucaaaacuauaagc

SEQ ID NO: 1317930 - RNA, 20 nt, Human
aaaauggacaaauguuagaa

SEQ ID NO: 1317931 - RNA, 22 nt, Human
aacagacacauuuuacuaaaau

SEQ ID NO: 1317932 - RNA, 18 nt, Human
aaccugccucccauucua

SEQ ID NO: 1317933 - RNA, 23 nt, Human
aacuaaaaucaauuaguaagaca

SEQ ID NO: 1317934 - RNA, 19 nt, Human
aacuguuaccccauccuuu

SEQ ID NO: 1317935 - RNA, 25 nt, Human
aagcgauucuccugccucagccucc

SEQ ID NO: 1317936 - RNA, 24 nt, Human
aaggugcugggauuauagguuuga

SEQ ID NO: 1317937 - RNA, 23 nt, Human
acagugcccggccuacaucugcu

SEQ ID NO: 1317938 - RNA, 22 nt, Human
accauguuggagguuggucucg

SEQ ID NO: 1317939 - RNA, 19 nt, Human
acccugguaaauauuaugg

SEQ ID NO: 1317940 - RNA, 19 nt, Human
acgggguuucaccauguug

SEQ ID NO: 1317941 - RNA, 20 nt, Human
acgggguuucaccauguugg

SEQ ID NO: 1317942 - RNA, 22 nt, Human
acgggguuucaccauguuggag

SEQ ID NO: 1317943 - RNA, 24 nt, Human
acgggguuucaccauguuggaggu

SEQ ID NO: 1317944 - RNA, 19 nt, Human
acuacaggugugugccacu

SEQ ID NO: 1317945 - RNA, 23 nt, Human
acugugcuauugcauagcaacag

SEQ ID NO: 1317946 - RNA, 18 nt, Human
agaaaaccugagaugaug

SEQ ID NO: 1317947 - RNA, 19 nt, Human
agaaaacuauuuaucuauu

SEQ ID NO: 1317948 - RNA, 19 nt, Human
agaaaugcauuuucgucuu

SEQ ID NO: 1317949 - RNA, 18 nt, Human
agacagaaucuugcuaug

SEQ ID NO: 1317950 - RNA, 21 nt, Human
agagacagaaucuugcuaugu

SEQ ID NO: 1317951 - RNA, 23 nt, Human
agcacaaucucagcucacugcaa

SEQ ID NO: 1317952 - RNA, 21 nt, Human
agcaccaucuuguaaaaugau

SEQ ID NO: 1317953 - RNA, 23 nt, Human
agcagcugggacuacaggugugu

SEQ ID NO: 1317954 - RNA, 24 nt, Human
agcgauucuccugccucagccucc

SEQ ID NO: 1317955 - RNA, 23 nt, Human
aggagaucauaaaaacaucaaaa

SEQ ID NO: 1317956 - RNA, 18 nt, Human
agggcaaaccugccuccc

SEQ ID NO: 1317957 - RNA, 24 nt, Human
aggugauccacccaccuuggccuc

SEQ ID NO: 1317958 - RNA, 26 nt, Human
aggugcugggauuauagguuugagcu

SEQ ID NO: 1317959 - RNA, 25 nt, Human
agguuggagugcagcagcacaaucu

SEQ ID NO: 1317960 - RNA, 23 nt, Human
agguuugagcuacagugcccggc

SEQ ID NO: 1317961 - RNA, 23 nt, Human
aguaacugggacugcaggcgcac

SEQ ID NO: 1317962 - RNA, 23 nt, Human
agugcaacuguuugucucucauc

SEQ ID NO: 1317963 - RNA, 24 nt, Human
agugcagcagcacaaucucagcuc

SEQ ID NO: 1317964 - RNA, 19 nt, Human
aucaaguguugcagguuua

SEQ ID NO: 1317965 - RNA, 22 nt, Human
caaaaccacugugcuauugcau

SEQ ID NO: 1317966 - RNA, 22 nt, Human
caagcgauucuccugccucagc

SEQ ID NO: 1317967 - RNA, 18 nt, Human
caaggugcugggauuaua

SEQ ID NO: 1317968 - RNA, 22 nt, Human
caagugaucuuccugccucagc

SEQ ID NO: 1317969 - RNA, 24 nt, Human
cacaccaccaugcccagcuaauuu

SEQ ID NO: 1317970 - RNA, 24 nt, Human
caccaugcccagcuaauuuuugua

SEQ ID NO: 1317971 - RNA, 22 nt, Human
caccauguuggagguuggucuc

SEQ ID NO: 1317972 - RNA, 18 nt, Human
cacugcaaccuuugccuc

SEQ ID NO: 1317973 - RNA, 21 nt, Human
cacugcaaccuuugccuccca

SEQ ID NO: 1317974 - RNA, 23 nt, Human
cacugcagauuugaacuccuggg

SEQ ID NO: 1317975 - RNA, 18 nt, Human
cagcagcacaaucucagc

SEQ ID NO: 1317976 - RNA, 23 nt, Human
cagccucccaaguaacugggacu

SEQ ID NO: 1317977 - RNA, 26 nt, Human
caguguaagauaacaccuucagauua

SEQ ID NO: 1317978 - RNA, 24 nt, Human
caucugcuuuuuauacucucuccu

SEQ ID NO: 1317979 - RNA, 18 nt, Human
caugugcagcuuuacaug

SEQ ID NO: 1317980 - RNA, 19 nt, Human
cauuccaugugggccugcg

SEQ ID NO: 1317981 - RNA, 21 nt, Human
cauuccaugugggccugcgcu

SEQ ID NO: 1317982 - RNA, 19 nt, Human
cauuuucgucuucauggaa

SEQ ID NO: 1317983 - RNA, 18 nt, Human
ccaaggugcugggauuau

SEQ ID NO: 1317984 - RNA, 22 nt, Human
ccaaggugcugggauuauaggu

SEQ ID NO: 1317985 - RNA, 24 nt, Human
cccaaggugcugggauuauagguu

SEQ ID NO: 1317986 - RNA, 24 nt, Human
cccaaguaacugggacugcaggcg

SEQ ID NO: 1317987 - RNA, 20 nt, Human
cccagguucaagcgauucuc

SEQ ID NO: 1317988 - RNA, 23 nt, Human
cccagguucaagcgauucuccug

SEQ ID NO: 1317989 - RNA, 24 nt, Human
cccauuaaaagugaaccccagaca

SEQ ID NO: 1317990 - RNA, 21 nt, Human
ccccagaaauagacucuuacu

SEQ ID NO: 1317991 - RNA, 20 nt, Human
ccccgcuaccagucuuccuc

SEQ ID NO: 1317992 - RNA, 19 nt, Human
ccucagccucaggagcagc

SEQ ID NO: 1317993 - RNA, 24 nt, Human
ccucccagguucaagcgauucucc

SEQ ID NO: 1317994 - RNA, 24 nt, Human
ccucccuuugcuucaaauuguccc

SEQ ID NO: 1317995 - RNA, 24 nt, Human
ccugaccucaggugauccacccac

SEQ ID NO: 1317996 - RNA, 18 nt, Human
ccugcgcuacuuuucugu

SEQ ID NO: 1317997 - RNA, 18 nt, Human
ccuggaagcccccucccc

SEQ ID NO: 1317998 - RNA, 22 nt, Human
ccuggguucaagugaucuuccu

SEQ ID NO: 1317999 - RNA, 23 nt, Human
ccuggguucaagugaucuuccug

SEQ ID NO: 1318000 - RNA, 22 nt, Human
ccugguaaauauuauggaaaag

SEQ ID NO: 1318001 - RNA, 23 nt, Human
cgcacaccaccaugcccagcuaa

SEQ ID NO: 1318002 - RNA, 20 nt, Human
cggauguguguccucaaccu

SEQ ID NO: 1318003 - RNA, 20 nt, Human
cgugacugaggcauuuggac

SEQ ID NO: 1318004 - RNA, 19 nt, Human
cuaaacccauuaaaaguga

SEQ ID NO: 1318005 - RNA, 18 nt, Human
cuaaaguuauggccaggu

SEQ ID NO: 1318006 - RNA, 26 nt, Human
cuaagauaaaugcagaucugacuguc

SEQ ID NO: 1318007 - RNA, 24 nt, Human
cucacugcaaccuuugccucccag

SEQ ID NO: 1318008 - RNA, 24 nt, Human
cucacugcaaccuuugccucccag

SEQ ID NO: 1318009 - RNA, 24 nt, Human
cucaggugauccacccaccuuggc

SEQ ID NO: 1318010 - RNA, 23 nt, Human
cuccugccucagccucccaagua

SEQ ID NO: 1318011 - RNA, 23 nt, Human
cugcaaccuuugccucccagguu

SEQ ID NO: 1318012 - RNA, 24 nt, Human
cugcaaccuuugccucccagguuc

SEQ ID NO: 1318013 - RNA, 24 nt, Human
cugcuuagggcaaaccugccuccc

SEQ ID NO: 1318014 - RNA, 19 nt, Human
cuggaagcccccuccccgc

SEQ ID NO: 1318015 - RNA, 27 nt, Human
cuggcucuucccaugugggggacgauc

SEQ ID NO: 1318016 - RNA, 21 nt, Human
gaaacugcuuagggcaaaccu

SEQ ID NO: 1318017 - RNA, 20 nt, Human
gaaccccagacaaacuaaaa

SEQ ID NO: 1318018 - RNA, 24 nt, Human
gacacgaaauagccagguaaacac

SEQ ID NO: 1318019 - RNA, 24 nt, Human
gaccucaggugauccacccaccuu

SEQ ID NO: 1318020 - RNA, 21 nt, Human
gacuacaggugugugccacug

SEQ ID NO: 1318021 - RNA, 24 nt, Human
gacuacaggugugugccacugugc

SEQ ID NO: 1318022 - RNA, 24 nt, Human
gacugcaggcgcacaccaccaugc

SEQ ID NO: 1318023 - RNA, 21 nt, Human
gagauggagucuugcucuguc

SEQ ID NO: 1318024 - RNA, 20 nt, Human
gagcagcugggacuacaggu

SEQ ID NO: 1318025 - RNA, 26 nt, Human
gagcagcugggacuacaggugugugc

SEQ ID NO: 1318026 - RNA, 22 nt, Human
gcaaccuuugccucccagguuc

SEQ ID NO: 1318027 - RNA, 24 nt, Human
gcacugcagauuugaacuccuggg

SEQ ID NO: 1318028 - RNA, 19 nt, Human
gcagcugggacuacaggug

SEQ ID NO: 1318029 - RNA, 22 nt, Human
gcccagcuaauuuuuguauuuu

SEQ ID NO: 1318030 - RNA, 24 nt, Human
gcgauucuccugccucagccuccc

SEQ ID NO: 1318031 - RNA, 20 nt, Human
gcuauugaaggacucuagau

SEQ ID NO: 1318032 - RNA, 19 nt, Human
gcucugucgcccagguugg

SEQ ID NO: 1318033 - RNA, 22 nt, Human
ggacgcugaucaucucauuuuu

SEQ ID NO: 1318034 - RNA, 20 nt, Human
ggacuacaggugugugccac

SEQ ID NO: 1318035 - RNA, 23 nt, Human
ggagucuugcucugucgcccagg

SEQ ID NO: 1318036 - RNA, 19 nt, Human
gguacgggguuucaccaug

SEQ ID NO: 1318037 - RNA, 23 nt, Human
gguagagagacaaaacuuaugug

SEQ ID NO: 1318038 - RNA, 19 nt, Human
ggucucgaacuccugaccu

SEQ ID NO: 1318039 - RNA, 24 nt, Human
ggugcugggauuauagguuugagc

SEQ ID NO: 1318040 - RNA, 24 nt, Human
gguuggucucgaacuccugaccuc

SEQ ID NO: 1318041 - RNA, 24 nt, Human
gugauccacccaccuuggccuccc

SEQ ID NO: 1318042 - RNA, 21 nt, Human
gugaucuuccugccucagccu

SEQ ID NO: 1318043 - RNA, 19 nt, Human
guuuggacaccaaucauuc

SEQ ID NO: 1318044 - RNA, 23 nt, Human
uaaaaacaucaaaacuauaagcc

SEQ ID NO: 1318045 - RNA, 18 nt, Human
uaaaagaaguuacuguuu

SEQ ID NO: 1318046 - RNA, 19 nt, Human
uaacugggacugcaggcgc

SEQ ID NO: 1318047 - RNA, 23 nt, Human
uaacuguaaaauuucugucuccu

SEQ ID NO: 1318048 - RNA, 19 nt, Human
uaagauaaaugcagaucug

SEQ ID NO: 1318049 - RNA, 21 nt, Human
uaauuuuuguauuuuuauuag

SEQ ID NO: 1318050 - RNA, 23 nt, Human
uaccccauccuuuuuauguuucu

SEQ ID NO: 1318051 - RNA, 21 nt, Human
uacucauguaagaaaaucaca

SEQ ID NO: 1318052 - RNA, 21 nt, Human
uagcaauuacagauguacuca

SEQ ID NO: 1318053 - RNA, 20 nt, Human
uagguacgggguuucaccau

SEQ ID NO: 1318054 - RNA, 21 nt, Human
uagguacgggguuucaccaug

SEQ ID NO: 1318055 - RNA, 19 nt, Human
uaguaagacaaagcacauc

SEQ ID NO: 1318056 - RNA, 19 nt, Human
uaucagcuagcugggcucu

SEQ ID NO: 1318057 - RNA, 18 nt, Human
uauguuacccagauugga

SEQ ID NO: 1318058 - RNA, 24 nt, Human
uauuagguacgggguuucaccaug

SEQ ID NO: 1318059 - RNA, 19 nt, Human
ucaagugaucuuccugccu

SEQ ID NO: 1318060 - RNA, 19 nt, Human
ucacugcaaccuuugccuc

SEQ ID NO: 1318061 - RNA, 24 nt, Human
ucacugcaaccuuugccucccagg

SEQ ID NO: 1318062 - RNA, 25 nt, Human
ucacugcaaccuuugccucccaggu

SEQ ID NO: 1318063 - RNA, 27 nt, Human
ucagcucacugcaaccuuugccuccca

SEQ ID NO: 1318064 - RNA, 19 nt, Human
ucaucuaucugugaccugg

SEQ ID NO: 1318065 - RNA, 23 nt, Human
ucccaaggugcugggauuauagg

SEQ ID NO: 1318066 - RNA, 24 nt, Human
ucccaaguaacugggacugcaggc

SEQ ID NO: 1318067 - RNA, 21 nt, Human
ucccagguucaagcgauucuc

SEQ ID NO: 1318068 - RNA, 24 nt, Human
ucccagguucaagcgauucuccug

SEQ ID NO: 1318069 - RNA, 22 nt, Human
ucccuaaaauguauaaaaccaa

SEQ ID NO: 1318070 - RNA, 21 nt, Human
uccugccucagccucaggagc

SEQ ID NO: 1318071 - RNA, 20 nt, Human
uccuggguucaagugaucuu

SEQ ID NO: 1318072 - RNA, 24 nt, Human
uccuggguucaagugaucuuccug

SEQ ID NO: 1318073 - RNA, 18 nt, Human
ucgcccagguuggagugc

SEQ ID NO: 1318074 - RNA, 20 nt, Human
ucucacuucgaucucuucca

SEQ ID NO: 1318075 - RNA, 23 nt, Human
ucucgaacuccugaccucaggug

SEQ ID NO: 1318076 - RNA, 20 nt, Human
ucugguaaguauugugaaag

SEQ ID NO: 1318077 - RNA, 24 nt, Human
ucugucgcccagguuggagugcag

SEQ ID NO: 1318078 - RNA, 19 nt, Human
ucugugaucuggcucuucc

SEQ ID NO: 1318079 - RNA, 23 nt, Human
ucugugaucuggcucuucccaug

SEQ ID NO: 1318080 - RNA, 23 nt, Human
ucuugcuauguuacccagauugg

SEQ ID NO: 1318081 - RNA, 24 nt, Human
ucuugcuauguuacccagauugga

SEQ ID NO: 1318082 - RNA, 23 nt, Human
ucuugcucugucgcccagguugg

SEQ ID NO: 1318083 - RNA, 24 nt, Human
ucuugcucugucgcccagguugga

SEQ ID NO: 1318084 - RNA, 21 nt, Human
ucuugggccuccaaaaucacu

SEQ ID NO: 1318085 - RNA, 21 nt, Human
ugaccucaggugauccaccca

SEQ ID NO: 1318086 - RNA, 24 nt, Human
ugaccucaggugauccacccaccu

SEQ ID NO: 1318087 - RNA, 18 nt, Human
ugaccuggaagcccccuc

SEQ ID NO: 1318088 - RNA, 19 nt, Human
ugagagcuccagagacuug

SEQ ID NO: 1318089 - RNA, 24 nt, Human
ugauccacccaccuuggccuccca

SEQ ID NO: 1318090 - RNA, 23 nt, Human
ugauuuacaguguaagauaacac

SEQ ID NO: 1318091 - RNA, 21 nt, Human
ugccucagccucaggagcagc

SEQ ID NO: 1318092 - RNA, 24 nt, Human
ugccucagccucaggagcagcugg

SEQ ID NO: 1318093 - RNA, 24 nt, Human
ugccucagccucccaaguaacugg

SEQ ID NO: 1318094 - RNA, 21 nt, Human
ugcuauugaaggacucuagau

SEQ ID NO: 1318095 - RNA, 24 nt, Human
ugcucugucgcccagguuggagug

SEQ ID NO: 1318096 - RNA, 25 nt, Human
ugcucuuguuuccuuucuaguucuc

SEQ ID NO: 1318097 - RNA, 20 nt, Human
uggaauuugggguauuaaga

SEQ ID NO: 1318098 - RNA, 22 nt, Human
uggagguuggucucgaacuccu

SEQ ID NO: 1318099 - RNA, 23 nt, Human
uggagucuugcucugucgcccag

SEQ ID NO: 1318100 - RNA, 24 nt, Human
uggagucuugcucugucgcccagg

SEQ ID NO: 1318101 - RNA, 21 nt, Human
ugggacuacaggugugugcca

SEQ ID NO: 1318102 - RNA, 22 nt, Human
ugggacuacaggugugugccac

SEQ ID NO: 1318103 - RNA, 22 nt, Human
ugggacuacaggugugugccac

SEQ ID NO: 1318104 - RNA, 22 nt, Human
ugggacuacaggugugugccac

SEQ ID NO: 1318105 - RNA, 24 nt, Human
ugggacuacaggugugugccacug

SEQ ID NO: 1318106 - RNA, 22 nt, Human
ugggacugcaggcgcacaccac

SEQ ID NO: 1318107 - RNA, 18 nt, Human
ugggauuauagguuugag

SEQ ID NO: 1318108 - RNA, 19 nt, Human
ugggauuauagguuugagc

SEQ ID NO: 1318109 - RNA, 22 nt, Human
ugggauuauagguuugagcuac

SEQ ID NO: 1318110 - RNA, 22 nt, Human
ugggauuauagguuugagcuac

SEQ ID NO: 1318111 - RNA, 23 nt, Human
uggguucaagugaucuuccugcc

SEQ ID NO: 1318112 - RNA, 24 nt, Human
uggguucaagugaucuuccugccu

SEQ ID NO: 1318113 - RNA, 24 nt, Human
uuaaaaugugucaguuugguuaca

SEQ ID NO: 1318114 - RNA, 18 nt, Human
uuaacaaaggaguaaucu

SEQ ID NO: 1318115 - RNA, 23 nt, Human
uuaaccauuuacagacguauuua

SEQ ID NO: 1318116 - RNA, 21 nt, Human
uuaggacacgaaauagccagg

SEQ ID NO: 1318117 - RNA, 24 nt, Human
uuauuagguacgggguuucaccau

SEQ ID NO: 1318118 - RNA, 21 nt, Human
uucaagcgauucuccugccuc

SEQ ID NO: 1318119 - RNA, 23 nt, Human
uucaagcgauucuccugccucag

SEQ ID NO: 1318120 - RNA, 24 nt, Human
uucaagcgauucuccugccucagc

SEQ ID NO: 1318121 - RNA, 21 nt, Human
uucaagugaucuuccugccuc

SEQ ID NO: 1318122 - RNA, 23 nt, Human
uucaagugaucuuccugccucag

SEQ ID NO: 1318123 - RNA, 24 nt, Human
uucaagugaucuuccugccucagc

SEQ ID NO: 1318124 - RNA, 22 nt, Human
uuccugccucagccucaggagc

SEQ ID NO: 1318125 - RNA, 18 nt, Human
uuggccucccaaggugcu

SEQ ID NO: 1318126 - RNA, 20 nt, Human
uugggguauuaagaauagaa

SEQ ID NO: 1318127 - RNA, 23 nt, Human
uuuaaaaacaacaauauacacaa

SEQ ID NO: 1318128 - RNA, 21 nt, Human
uuuaacauucauuucccauua

SEQ ID NO: 1318129 - RNA, 21 nt, Human
uuucagaaaaauaaaaccuaa

SEQ ID NO: 1318130 - RNA, 24 nt, Human
uuugagagguagugaggaaagaaa

SEQ ID NO: 1318131 - RNA, 20 nt, Human
uuuuauggauuuuguaauuu

SEQ ID NO: 1318132 - RNA, 24 nt, Human
uuuuuauuagguacgggguuucac

SEQ ID NO: 1318133 - RNA, 18 nt, Human
uuuuuguauuuuuauuag

SEQ ID NO: 1318134 - RNA, 22 nt, Human
cagucugcagacccaggcucac

SEQ ID NO: 1318135 - RNA, 27 nt, Human
ccgccgucguccccgcgcggugguccg

SEQ ID NO: 1318136 - RNA, 20 nt, Human
cgucaaaaacgcgcccuacu

SEQ ID NO: 1318137 - RNA, 19 nt, Human
gagcagccugcggcgggcg

SEQ ID NO: 1318138 - RNA, 19 nt, Human
gcgcggugguccggcaggu

SEQ ID NO: 1318139 - RNA, 19 nt, Human
gggcggggaacagucugca

SEQ ID NO: 1318140 - RNA, 20 nt, Human
gucugcagacccaggcucac

SEQ ID NO: 1318141 - RNA, 24 nt, Human
ucagcuggggcagagggcggggaa

SEQ ID NO: 1318142 - RNA, 18 nt, Human
uccggauuccgaccgucc

SEQ ID NO: 1318143 - RNA, 18 nt, Human
ucugcagacccaggcuca

SEQ ID NO: 1318144 - RNA, 18 nt, Human
ucuuccggauuccgaccg

SEQ ID NO: 1318145 - RNA, 18 nt, Human
agcuuggugggcggcugc

SEQ ID NO: 1318146 - RNA, 18 nt, Human
aggaagacggucccuucc

SEQ ID NO: 1318147 - RNA, 18 nt, Human
ccacgaaaaaauauuccc

SEQ ID NO: 1318148 - RNA, 22 nt, Human
cccaaccacuagccuguacaau

SEQ ID NO: 1318149 - RNA, 23 nt, Human
ccugugguaacacuucuccauga

SEQ ID NO: 1318150 - RNA, 26 nt, Human
ccuuaggcuccgaagagaugggcccc

SEQ ID NO: 1318151 - RNA, 19 nt, Human
ccuuguccauggccugugg

SEQ ID NO: 1318152 - RNA, 23 nt, Human
cugcgcagggcuggaccugggcu

SEQ ID NO: 1318153 - RNA, 19 nt, Human
cuggcggacagaugucagg

SEQ ID NO: 1318154 - RNA, 21 nt, Human
gaaaaaauauuccccaaccac

SEQ ID NO: 1318155 - RNA, 22 nt, Human
gaccugggcuggauccuuaggc

SEQ ID NO: 1318156 - RNA, 21 nt, Human
gcagggcuggaccugggcugg

SEQ ID NO: 1318157 - RNA, 18 nt, Human
gcggugcuggcggacaga

SEQ ID NO: 1318158 - RNA, 18 nt, Human
gcuaaggaagacgguccc

SEQ ID NO: 1318159 - RNA, 21 nt, Human
gcucgucuucuggcagcuugg

SEQ ID NO: 1318160 - RNA, 21 nt, Human
ggccuuguccauggccugugg

SEQ ID NO: 1318161 - RNA, 21 nt, Human
gggcggcugcgcagggcugga

SEQ ID NO: 1318162 - RNA, 22 nt, Human
gggcggugcuggcggacagaug

SEQ ID NO: 1318163 - RNA, 20 nt, Human
ggugggcggcugcgcagggc

SEQ ID NO: 1318164 - RNA, 23 nt, Human
uaaggaagacggucccuuccacg

SEQ ID NO: 1318165 - RNA, 24 nt, Human
uggaccugggcuggauccuuaggc

SEQ ID NO: 1318166 - RNA, 22 nt, Human
aaucucgcucuugccgcucugg

SEQ ID NO: 1318167 - RNA, 22 nt, Human
aggcacacaggagaagggcugg

SEQ ID NO: 1318168 - RNA, 21 nt, Human
aggcaggcacacaggagaagg

SEQ ID NO: 1318169 - RNA, 23 nt, Human
agguaggccagcuccuccuugag

SEQ ID NO: 1318170 - RNA, 24 nt, Human
caacaggcuccucuguuuccguuc

SEQ ID NO: 1318171 - RNA, 19 nt, Human
cacaccuggggcagcgccc

SEQ ID NO: 1318172 - RNA, 19 nt, Human
cagccccuggaucugggac

SEQ ID NO: 1318173 - RNA, 20 nt, Human
cagcugcaugcaguagcggu

SEQ ID NO: 1318174 - RNA, 22 nt, Human
caggaugaggcucagguccaca

SEQ ID NO: 1318175 - RNA, 23 nt, Human
cagggucagcucauccagcaccc

SEQ ID NO: 1318176 - RNA, 24 nt, Human
ccgcacugccgaucagccccugga

SEQ ID NO: 1318177 - RNA, 25 nt, Human
ccgccagguugcccuccagggaugc

SEQ ID NO: 1318178 - RNA, 22 nt, Human
ccgggguucacaggcuuccuuu

SEQ ID NO: 1318179 - RNA, 18 nt, Human
ccucugucuugcugaaga

SEQ ID NO: 1318180 - RNA, 25 nt, Human
cucgugguucuucuucagguaggcc

SEQ ID NO: 1318181 - RNA, 19 nt, Human
cucuguuuccguuccccug

SEQ ID NO: 1318182 - RNA, 21 nt, Human
cuggaucugggacagcugcau

SEQ ID NO: 1318183 - RNA, 19 nt, Human
cuguuuccguuccccuggg

SEQ ID NO: 1318184 - RNA, 21 nt, Human
gaagaggggccccaaguagug

SEQ ID NO: 1318185 - RNA, 18 nt, Human
gccaucuucucauacugc

SEQ ID NO: 1318186 - RNA, 22 nt, Human
gguucagcuccucugucuugcu

SEQ ID NO: 1318187 - RNA, 24 nt, Human
guggcggcggcaggaggcaggcac

SEQ ID NO: 1318188 - RNA, 20 nt, Human
uaguguagggcugccggggu

SEQ ID NO: 1318189 - RNA, 20 nt, Human
ucaccgcccaccuggccucg

SEQ ID NO: 1318190 - RNA, 23 nt, Human
ucaccgcccaccuggccucgcgg

SEQ ID NO: 1318191 - RNA, 18 nt, Human
ucagguccacaccugggg

SEQ ID NO: 1318192 - RNA, 26 nt, Human
uccacaccuggggcagcgcccaucuc

SEQ ID NO: 1318193 - RNA, 23 nt, Human
uccucuguuuccguuccccuggg

SEQ ID NO: 1318194 - RNA, 23 nt, Human
ucggcauccuugcgguucuucuu

SEQ ID NO: 1318195 - RNA, 24 nt, Human
ucguucaggaugaggcucaggucc

SEQ ID NO: 1318196 - RNA, 20 nt, Human
ucuccacauugaucucaccg

SEQ ID NO: 1318197 - RNA, 21 nt, Human
ucucgcucuugccgcucugga

SEQ ID NO: 1318198 - RNA, 21 nt, Human
ugcaguagcgguucucugucu

SEQ ID NO: 1318199 - RNA, 19 nt, Human
uggaaagaagaggggcccc

SEQ ID NO: 1318200 - RNA, 23 nt, Human
uggaaagaagaggggccccaagu

SEQ ID NO: 1318201 - RNA, 20 nt, Human
ugggacagcugcaugcagua

SEQ ID NO: 1318202 - RNA, 23 nt, Human
uguuuccguuccccugggcuuuc

SEQ ID NO: 1318203 - RNA, 23 nt, Human
uucucauacugcucacguaucuc

SEQ ID NO: 1318204 - RNA, 24 nt, Human
uugcgguucuucuuugccaucuuc

SEQ ID NO: 1318205 - RNA, 26 nt, Human
cagagcccggaucuucgcgcggagcc

SEQ ID NO: 1318206 - RNA, 19 nt, Human
ccgcuggauacgaggaccc

SEQ ID NO: 1318207 - RNA, 18 nt, Human
cgcccgcuggauacgagg

SEQ ID NO: 1318208 - RNA, 18 nt, Human
cgcuggauacgaggaccc

SEQ ID NO: 1318209 - RNA, 24 nt, Human
cuucgcgcggagcccgccagaguc

SEQ ID NO: 1318210 - RNA, 21 nt, Human
aaacaaguguccccggacccg

SEQ ID NO: 1318211 - RNA, 22 nt, Human
aaaccccgucucuacuaaaaaa

SEQ ID NO: 1318212 - RNA, 20 nt, Human
aacacggugaaaccccgucu

SEQ ID NO: 1318213 - RNA, 21 nt, Human
aacacggugaaaccccgucuc

SEQ ID NO: 1318214 - RNA, 23 nt, Human
aaccucagugaaguaggagauau

SEQ ID NO: 1318215 - RNA, 21 nt, Human
aagaaaaaaaacaacccugca

SEQ ID NO: 1318216 - RNA, 18 nt, Human
aagcagaguuugcagaga

SEQ ID NO: 1318217 - RNA, 24 nt, Human
aaugaugugaacccaggaagcaga

SEQ ID NO: 1318218 - RNA, 20 nt, Human
acagagcgagacuccgucuc

SEQ ID NO: 1318219 - RNA, 24 nt, Human
acagagcgagacuccgucucaaga

SEQ ID NO: 1318220 - RNA, 18 nt, Human
accccgucucuacuaaaa

SEQ ID NO: 1318221 - RNA, 24 nt, Human
acgccacgcaugucuaggaccagc

SEQ ID NO: 1318222 - RNA, 24 nt, Human
acuccgucucaagaaaaaaaacaa

SEQ ID NO: 1318223 - RNA, 18 nt, Human
acugcacuccagccugag

SEQ ID NO: 1318224 - RNA, 24 nt, Human
acugcacuccagccugaguuacag

SEQ ID NO: 1318225 - RNA, 22 nt, Human
agaucgcgccacugcacuccag

SEQ ID NO: 1318226 - RNA, 24 nt, Human
agcacuuugggaggccgaggcagg

SEQ ID NO: 1318227 - RNA, 24 nt, Human
agcagaguuugcagagagcccaga

SEQ ID NO: 1318228 - RNA, 24 nt, Human
aggcagaucacgaggucaggagau

SEQ ID NO: 1318229 - RNA, 21 nt, Human
aggcaggagaaugaugugaac

SEQ ID NO: 1318230 - RNA, 24 nt, Human
aggcaggagaaugaugugaaccca

SEQ ID NO: 1318231 - RNA, 26 nt, Human
aggcaggcagaucacgaggucaggag

SEQ ID NO: 1318232 - RNA, 23 nt, Human
aggccgaggcaggcagaucacga

SEQ ID NO: 1318233 - RNA, 19 nt, Human
aggcugaggcaggagaaug

SEQ ID NO: 1318234 - RNA, 24 nt, Human
aucgcgccacugcacuccagccug

SEQ ID NO: 1318235 - RNA, 22 nt, Human
augagaugggccagggacaugg

SEQ ID NO: 1318236 - RNA, 24 nt, Human
cacgccuguaaucccagcacuuug

SEQ ID NO: 1318237 - RNA, 23 nt, Human
cacuccagccugaguuacagagc

SEQ ID NO: 1318238 - RNA, 24 nt, Human
cacuccagccugaguuacagagcg

SEQ ID NO: 1318239 - RNA, 18 nt, Human
cacugcacuccagccuga

SEQ ID NO: 1318240 - RNA, 19 nt, Human
cacugcacuccagccugag

SEQ ID NO: 1318241 - RNA, 19 nt, Human
cacugcacuccagccugag

SEQ ID NO: 1318242 - RNA, 24 nt, Human
cacugcacuccagccugaguuaca

SEQ ID NO: 1318243 - RNA, 23 nt, Human
cacugucccugggcaucugggag

SEQ ID NO: 1318244 - RNA, 24 nt, Human
cagcacuuugggaggccgaggcag

SEQ ID NO: 1318245 - RNA, 25 nt, Human
cagcacuuugggaggccgaggcagg

SEQ ID NO: 1318246 - RNA, 19 nt, Human
cagccucaagccccuuccu

SEQ ID NO: 1318247 - RNA, 24 nt, Human
cagcuacucgggaggcugaggcag

SEQ ID NO: 1318248 - RNA, 22 nt, Human
caggcagaucacgaggucagga

SEQ ID NO: 1318249 - RNA, 26 nt, Human
cagucaauuauugcuuuaaauggcac

SEQ ID NO: 1318250 - RNA, 19 nt, Human
ccacagccccgacgccacg

SEQ ID NO: 1318251 - RNA, 20 nt, Human
ccacugcacuccagccugag

SEQ ID NO: 1318252 - RNA, 20 nt, Human
ccacugcacuccagccugag

SEQ ID NO: 1318253 - RNA, 21 nt, Human
ccacugcacuccagccugagu

SEQ ID NO: 1318254 - RNA, 20 nt, Human
ccagaucacugucccugggc

SEQ ID NO: 1318255 - RNA, 23 nt, Human
ccaggaagcagaguuugcagaga

SEQ ID NO: 1318256 - RNA, 20 nt, Human
ccccgacgccacgcaugucu

SEQ ID NO: 1318257 - RNA, 21 nt, Human
ccccgacgccacgcaugucua

SEQ ID NO: 1318258 - RNA, 24 nt, Human
ccccuccugcugcaugucugaaag

SEQ ID NO: 1318259 - RNA, 23 nt, Human
cccgaccgugccacagccccgac

SEQ ID NO: 1318260 - RNA, 23 nt, Human
cccgucucuacuaaaaaaauaca

SEQ ID NO: 1318261 - RNA, 21 nt, Human
cccugcagucaauuauugcuu

SEQ ID NO: 1318262 - RNA, 23 nt, Human
ccuggcuaacacggugaaacccc

SEQ ID NO: 1318263 - RNA, 24 nt, Human
ccuggcuaacacggugaaaccccg

SEQ ID NO: 1318264 - RNA, 21 nt, Human
ccuguagucccagcuacucgg

SEQ ID NO: 1318265 - RNA, 24 nt, Human
cgagacuauccuggcuaacacggu

SEQ ID NO: 1318266 - RNA, 24 nt, Human
cgaggcaggcagaucacgagguca

SEQ ID NO: 1318267 - RNA, 26 nt, Human
cgccacugcacuccagccugaguuac

SEQ ID NO: 1318268 - RNA, 24 nt, Human
cgccuguaaucccagcacuuuggg

SEQ ID NO: 1318269 - RNA, 23 nt, Human
cgccuguagucccagcuacucgg

SEQ ID NO: 1318270 - RNA, 24 nt, Human
cgccuguagucccagcuacucggg

SEQ ID NO: 1318271 - RNA, 25 nt, Human
cuaaaaaaauacaaaaaaaucagcc

SEQ ID NO: 1318272 - RNA, 20 nt, Human
cuacuaaaaaaauacaaaaa

SEQ ID NO: 1318273 - RNA, 23 nt, Human
cucaagccccuuccuuccagauc

SEQ ID NO: 1318274 - RNA, 22 nt, Human
cucacgccuguaaucccagcac

SEQ ID NO: 1318275 - RNA, 24 nt, Human
cucacgccuguaaucccagcacuu

SEQ ID NO: 1318276 - RNA, 18 nt, Human
cuggcuaacacggugaaa

SEQ ID NO: 1318277 - RNA, 20 nt, Human
gaguucuaggaaaacagccu

SEQ ID NO: 1318278 - RNA, 23 nt, Human
gaucuccaguccucacaaaccuc

SEQ ID NO: 1318279 - RNA, 24 nt, Human
gcacuccagccugaguuacagagc

SEQ ID NO: 1318280 - RNA, 18 nt, Human
gcagaugucuguaagugg

SEQ ID NO: 1318281 - RNA, 22 nt, Human
gcaggagaaugaugugaaccca

SEQ ID NO: 1318282 - RNA, 19 nt, Human
gcaucugggaggaggcaga

SEQ ID NO: 1318283 - RNA, 21 nt, Human
gccacugcacuccagccugag

SEQ ID NO: 1318284 - RNA, 19 nt, Human
gcccagaucgcgccacugc

SEQ ID NO: 1318285 - RNA, 24 nt, Human
gcuaacacggugaaaccccgucuc

SEQ ID NO: 1318286 - RNA, 22 nt, Human
ggcaccuucccccuccugcugc

SEQ ID NO: 1318287 - RNA, 19 nt, Human
gggcguggucgugggcgcc

SEQ ID NO: 1318288 - RNA, 24 nt, Human
gggcguggucgugggcgccuguag

SEQ ID NO: 1318289 - RNA, 24 nt, Human
ggucgugggcgccuguagucccag

SEQ ID NO: 1318290 - RNA, 22 nt, Human
gucucaagaaaaaaaacaaccc

SEQ ID NO: 1318291 - RNA, 23 nt, Human
guggcucacgccuguaaucccag

SEQ ID NO: 1318292 - RNA, 19 nt, Human
gugggcgccuguaguccca

SEQ ID NO: 1318293 - RNA, 22 nt, Human
uaacacggugaaaccccgucuc

SEQ ID NO: 1318294 - RNA, 24 nt, Human
uaacacggugaaaccccgucucua

SEQ ID NO: 1318295 - RNA, 24 nt, Human
uacagagcgagacuccgucucaag

SEQ ID NO: 1318296 - RNA, 18 nt, Human
uacauguucgaucuccag

SEQ ID NO: 1318297 - RNA, 18 nt, Human
uaggaaaacagccucaag

SEQ ID NO: 1318298 - RNA, 19 nt, Human
uaggagauaucauucccau

SEQ ID NO: 1318299 - RNA, 18 nt, Human
ucacgaggucaggagauc

SEQ ID NO: 1318300 - RNA, 23 nt, Human
ucacgaggucaggagaucgagac

SEQ ID NO: 1318301 - RNA, 24 nt, Human
ucacgaggucaggagaucgagacu

SEQ ID NO: 1318302 - RNA, 23 nt, Human
uccagccugaguuacagagcgag

SEQ ID NO: 1318303 - RNA, 24 nt, Human
uccagccugaguuacagagcgaga

SEQ ID NO: 1318304 - RNA, 23 nt, Human
ucgcgccacugcacuccagccug

SEQ ID NO: 1318305 - RNA, 24 nt, Human
ugaggcaggagaaugaugugaacc

SEQ ID NO: 1318306 - RNA, 25 nt, Human
ugaggcaggagaaugaugugaaccc

SEQ ID NO: 1318307 - RNA, 23 nt, Human
ugcagucaauuauugcuuuaaau

SEQ ID NO: 1318308 - RNA, 24 nt, Human
uggcucacgccuguaaucccagca

SEQ ID NO: 1318309 - RNA, 20 nt, Human
ugggaggccgaggcaggcag

SEQ ID NO: 1318310 - RNA, 24 nt, Human
ugggaggccgaggcaggcagauca

SEQ ID NO: 1318311 - RNA, 24 nt, Human
uggucgugggcgccuguaguccca

SEQ ID NO: 1318312 - RNA, 21 nt, Human
ugugauccagugccugauucc

SEQ ID NO: 1318313 - RNA, 19 nt, Human
ugugaugugcugcagccaa

SEQ ID NO: 1318314 - RNA, 25 nt, Human
uugggaggccgaggcaggcagauca

SEQ ID NO: 1318315 - RNA, 23 nt, Human
aaagccaguacagacaaugaguu

SEQ ID NO: 1318316 - RNA, 18 nt, Human
aaaugugccuugcuuugu

SEQ ID NO: 1318317 - RNA, 24 nt, Human
aagaaacugaauguaaaguccauu

SEQ ID NO: 1318318 - RNA, 19 nt, Human
aauccuguccccuucauca

SEQ ID NO: 1318319 - RNA, 19 nt, Human
acauggagcuugggcaaca

SEQ ID NO: 1318320 - RNA, 21 nt, Human
acuuguuuuacagcucccugu

SEQ ID NO: 1318321 - RNA, 18 nt, Human
agaaggugggucuugacc

SEQ ID NO: 1318322 - RNA, 19 nt, Human
aguagcucaucuagaaucc

SEQ ID NO: 1318323 - RNA, 18 nt, Human
aguugcgguauuucuugg

SEQ ID NO: 1318324 - RNA, 25 nt, Human
caaugaguuccacauuuagaaauuu

SEQ ID NO: 1318325 - RNA, 24 nt, Human
cacacugccagcuccccacacacu

SEQ ID NO: 1318326 - RNA, 24 nt, Human
cagaaagaauaagccucuugggua

SEQ ID NO: 1318327 - RNA, 21 nt, Human
cagaauacccagggcacauac

SEQ ID NO: 1318328 - RNA, 20 nt, Human
cagaguggaguagcucaucu

SEQ ID NO: 1318329 - RNA, 22 nt, Human
cagggucagcucauccccaucc

SEQ ID NO: 1318330 - RNA, 20 nt, Human
caucacacugccagcucccc

SEQ ID NO: 1318331 - RNA, 18 nt, Human
cauccaauuucuuuagag

SEQ ID NO: 1318332 - RNA, 25 nt, Human
cauuuuacagaugcagagccagagg

SEQ ID NO: 1318333 - RNA, 19 nt, Human
ccagcuccccacacacugc

SEQ ID NO: 1318334 - RNA, 23 nt, Human
ccagggcacauacgcuuaugcaa

SEQ ID NO: 1318335 - RNA, 19 nt, Human
ccagggucagcucaucccc

SEQ ID NO: 1318336 - RNA, 18 nt, Human
ccucaaagccaguacagc

SEQ ID NO: 1318337 - RNA, 19 nt, Human
cgugaugaggucaagaagg

SEQ ID NO: 1318338 - RNA, 20 nt, Human
cucuagcuucuccccauuuc

SEQ ID NO: 1318339 - RNA, 27 nt, Human
cuuccaacuaauuugguaacauauuug

SEQ ID NO: 1318340 - RNA, 24 nt, Human
cuuucagcgaccgugaugagguca

SEQ ID NO: 1318341 - RNA, 18 nt, Human
cuuuucaacucugccugu

SEQ ID NO: 1318342 - RNA, 20 nt, Human
gccugucaucucagccggga

SEQ ID NO: 1318343 - RNA, 20 nt, Human
gcugugagacuugauggcag

SEQ ID NO: 1318344 - RNA, 21 nt, Human
ggguguucagguagucaucca

SEQ ID NO: 1318345 - RNA, 19 nt, Human
gucagcucauccccaucca

SEQ ID NO: 1318346 - RNA, 21 nt, Human
guccuuaaaccauucaaacua

SEQ ID NO: 1318347 - RNA, 19 nt, Human
gugcagcuagaagugcugg

SEQ ID NO: 1318348 - RNA, 19 nt, Human
uaugcaagcacacacauag

SEQ ID NO: 1318349 - RNA, 20 nt, Human
uaugcaagcacacacauagc

SEQ ID NO: 1318350 - RNA, 27 nt, Human
ucaaagccaguacagacaaugaguucc

SEQ ID NO: 1318351 - RNA, 18 nt, Human
ucaacucugccuguacua

SEQ ID NO: 1318352 - RNA, 20 nt, Human
ucaacugcuauggucuuccu

SEQ ID NO: 1318353 - RNA, 23 nt, Human
ucaagaaggaguuuucucugaaa

SEQ ID NO: 1318354 - RNA, 21 nt, Human
ucuucuuucucuagcuucucc

SEQ ID NO: 1318355 - RNA, 22 nt, Human
ucuuggccacaaucuuaggaag

SEQ ID NO: 1318356 - RNA, 20 nt, Human
ucuuuggguugaaauccuag

SEQ ID NO: 1318357 - RNA, 30 nt, Human
ugaaagaguaaaagggccuuuauucaaacu

SEQ ID NO: 1318358 - RNA, 18 nt, Human
ugagaaggugggucuuga

SEQ ID NO: 1318359 - RNA, 20 nt, Human
ugaguagaggggcaaccaug

SEQ ID NO: 1318360 - RNA, 18 nt, Human
ugaugaggucaagaagga

SEQ ID NO: 1318361 - RNA, 20 nt, Human
ugcacauaugauaagaaggc

SEQ ID NO: 1318362 - RNA, 27 nt, Human
ugcgccgggaccccuugucuuccccaa

SEQ ID NO: 1318363 - RNA, 22 nt, Human
ugcuaccagugcuugauuucag

SEQ ID NO: 1318364 - RNA, 18 nt, Human
ugcugggauucaaaccca

SEQ ID NO: 1318365 - RNA, 23 nt, Human
uggaguagcucaucuagaauccu

SEQ ID NO: 1318366 - RNA, 22 nt, Human
uggcaugaaagaguaaaagggc

SEQ ID NO: 1318367 - RNA, 23 nt, Human
ugggauucaaacccaggccggga

SEQ ID NO: 1318368 - RNA, 22 nt, Human
ugggucuugaccacauggagcu

SEQ ID NO: 1318369 - RNA, 21 nt, Human
ugucacacgggcugugugaca

SEQ ID NO: 1318370 - RNA, 19 nt, Human
ugugcagcuagaagugcug

SEQ ID NO: 1318371 - RNA, 24 nt, Human
uucaacaaaaagaaagcugugaga

SEQ ID NO: 1318372 - RNA, 21 nt, Human
uucaucacacugccagcuccc

SEQ ID NO: 1318373 - RNA, 24 nt, Human
uugcugagacaugaugugcugcac

SEQ ID NO: 1318374 - RNA, 18 nt, Human
aagcaacaggagaacauc

SEQ ID NO: 1318375 - RNA, 28 nt, Human
acccccucccucccacuucucucuccag

SEQ ID NO: 1318376 - RNA, 24 nt, Human
agcauuaaggccaguggcuacagu

SEQ ID NO: 1318377 - RNA, 18 nt, Human
cacccccucccucccacu

SEQ ID NO: 1318378 - RNA, 20 nt, Human
cauuaaggccaguggcuaca

SEQ ID NO: 1318379 - RNA, 24 nt, Human
cccccucccucccacuucucucuc

SEQ ID NO: 1318380 - RNA, 24 nt, Human
ccccucccucccacuucucucucc

SEQ ID NO: 1318381 - RNA, 21 nt, Human
ccucccucccacuucucucuc

SEQ ID NO: 1318382 - RNA, 18 nt, Human
ccuggucuccgccuccau

SEQ ID NO: 1318383 - RNA, 21 nt, Human
cucgaaguggggaagcaacag

SEQ ID NO: 1318384 - RNA, 26 nt, Human
cucgaaguggggaagcaacaggagaa

SEQ ID NO: 1318385 - RNA, 21 nt, Human
cuugucacccccucccuccca

SEQ ID NO: 1318386 - RNA, 26 nt, Human
gcuugucacccccucccucccacuuc

SEQ ID NO: 1318387 - RNA, 25 nt, Human
gggaagcaacaggagaacaucuugc

SEQ ID NO: 1318388 - RNA, 21 nt, Human
ugaagcagcaaccucucgaag

SEQ ID NO: 1318389 - RNA, 19 nt, Human
ugcccaggacuaggggcag

SEQ ID NO: 1318390 - RNA, 26 nt, Human
ugcuugucacccccucccucccacuu

SEQ ID NO: 1318391 - RNA, 18 nt, Human
uggcuggggcugugcuug

SEQ ID NO: 1318392 - RNA, 25 nt, Human
ugugcuugucacccccucccuccca

SEQ ID NO: 1318393 - RNA, 21 nt, Human
accaacacaaucucaguggau

SEQ ID NO: 1318394 - RNA, 20 nt, Human
agagcgcgaagccuccaagc

SEQ ID NO: 1318395 - RNA, 20 nt, Human
caccugcagcauggcuguuc

SEQ ID NO: 1318396 - RNA, 25 nt, Human
cacuuuauaaacacauuugauuauc

SEQ ID NO: 1318397 - RNA, 19 nt, Human
cagccacccacuccucgcc

SEQ ID NO: 1318398 - RNA, 24 nt, Human
ccacccacuccucgccguagcuga

SEQ ID NO: 1318399 - RNA, 25 nt, Human
cgcgaagccuccaagccugcugcag

SEQ ID NO: 1318400 - RNA, 22 nt, Human
cugcugcaggccccgccuccuu

SEQ ID NO: 1318401 - RNA, 19 nt, Human
cuucagccacccacuccuc

SEQ ID NO: 1318402 - RNA, 21 nt, Human
gggaaagggcacuggguggug

SEQ ID NO: 1318403 - RNA, 22 nt, Human
uagcacaacacauauggacuuu

SEQ ID NO: 1318404 - RNA, 27 nt, Human
uaggcuccguaacaaccaacacaaucu

SEQ ID NO: 1318405 - RNA, 23 nt, Human
uccaaagccucguucucauuucc

SEQ ID NO: 1318406 - RNA, 24 nt, Human
uccaacacuuuauaaacacauuug

SEQ ID NO: 1318407 - RNA, 22 nt, Human
uccaaugcugugcuccaaagcc

SEQ ID NO: 1318408 - RNA, 19 nt, Human
uccucucauguuacuggca

SEQ ID NO: 1318409 - RNA, 23 nt, Human
ucucagcugccgcugcugccggg

SEQ ID NO: 1318410 - RNA, 22 nt, Human
uggcuguucauugugacagagg

SEQ ID NO: 1318411 - RNA, 21 nt, Human
uggcuucagccacccacuccu

SEQ ID NO: 1318412 - RNA, 19 nt, Human
uuuguuugcucucucauga

SEQ ID NO: 1318413 - RNA, 20 nt, Human
acaaagaugucuuccuaaau

SEQ ID NO: 1318414 - RNA, 19 nt, Human
ccuggagguccaccuggac

SEQ ID NO: 1318415 - RNA, 22 nt, Human
ccuugcggcugcugugcuccuc

SEQ ID NO: 1318416 - RNA, 23 nt, Human
cuugcuguccugcuucagcaagg

SEQ ID NO: 1318417 - RNA, 21 nt, Human
ugaaaaaagacaaagaugucu

SEQ ID NO: 1318418 - RNA, 18 nt, Human
ugcuguuguggccacugc

SEQ ID NO: 1318419 - RNA, 24 nt, Human
ugguggauuccuccuguucagccu

SEQ ID NO: 1318420 - RNA, 19 nt, Human
ugugcuguuguggccacug

SEQ ID NO: 1318421 - RNA, 23 nt, Human
uguggccacugccgggacuggug

SEQ ID NO: 1318422 - RNA, 19 nt, Human
uuccuugcggcugcugugc

SEQ ID NO: 1318423 - RNA, 21 nt, Human
aagagcccagggggcugguac

SEQ ID NO: 1318424 - RNA, 25 nt, Human
agagcccagggggcugggaccaaag

SEQ ID NO: 1318425 - RNA, 19 nt, Human
agcuggagacgcaagagcc

SEQ ID NO: 1318426 - RNA, 21 nt, Human
agcuggagacgcaagagccca

SEQ ID NO: 1318427 - RNA, 23 nt, Human
aggccgggguccagggcccuucc

SEQ ID NO: 1318428 - RNA, 20 nt, Human
aggcucuguggcugcaaucu

SEQ ID NO: 1318429 - RNA, 24 nt, Human
ccagagcguggaguugcggaggca

SEQ ID NO: 1318430 - RNA, 20 nt, Human
ccagggcccuucccugcagc

SEQ ID NO: 1318431 - RNA, 22 nt, Human
ccaguacaagaagagguucucg

SEQ ID NO: 1318432 - RNA, 21 nt, Human
ccgggguccagggcccuuccc

SEQ ID NO: 1318433 - RNA, 26 nt, Human
ccugcagcuggagcaggcucuguggc

SEQ ID NO: 1318434 - RNA, 18 nt, Human
cucggagcuggagcagcu

SEQ ID NO: 1318435 - RNA, 21 nt, Human
cugcagcuggagcaggcucug

SEQ ID NO: 1318436 - RNA, 18 nt, Human
gagcuggagacgcaagag

SEQ ID NO: 1318437 - RNA, 22 nt, Human
ggcugcaaucuggugagcugga

SEQ ID NO: 1318438 - RNA, 24 nt, Human
guccagggcccuucccugcagcug

SEQ ID NO: 1318439 - RNA, 20 nt, Human
uacaagaagagguucucgga

SEQ ID NO: 1318440 - RNA, 23 nt, Human
uacaagaagagguucucggagcu

SEQ ID NO: 1318441 - RNA, 19 nt, Human
ucagcucccaauccccaga

SEQ ID NO: 1318442 - RNA, 21 nt, Human
ucuguggcugcaaucugguga

SEQ ID NO: 1318443 - RNA, 19 nt, Human
ugcccggguugucgcgggc

SEQ ID NO: 1318444 - RNA, 21 nt, Human
uguuggagagauccggagagc

SEQ ID NO: 1318445 - RNA, 21 nt, Human
uucccugcagcuggagcaggc

SEQ ID NO: 1318446 - RNA, 21 nt, Human
aagagcccagggggcugguac

SEQ ID NO: 1318447 - RNA, 19 nt, Human
agcuggagacgcaagagcc

SEQ ID NO: 1318448 - RNA, 23 nt, Human
aggccgggguccagggcccuucc

SEQ ID NO: 1318449 - RNA, 20 nt, Human
aggcucuguggcugcaaucu

SEQ ID NO: 1318450 - RNA, 24 nt, Human
ccagagcguggaguugcggaggca

SEQ ID NO: 1318451 - RNA, 20 nt, Human
ccagggcccuucccugcagc

SEQ ID NO: 1318452 - RNA, 22 nt, Human
ccaguacaagaagagguucucg

SEQ ID NO: 1318453 - RNA, 21 nt, Human
ccgggguccagggcccuuccc

SEQ ID NO: 1318454 - RNA, 26 nt, Human
ccugcagcuggagcaggcucuguggc

SEQ ID NO: 1318455 - RNA, 18 nt, Human
cucggagcuggagcagcu

SEQ ID NO: 1318456 - RNA, 21 nt, Human
cugcagcuggagcaggcucug

SEQ ID NO: 1318457 - RNA, 23 nt, Human
gagcccagggggcugggaccaag

SEQ ID NO: 1318458 - RNA, 18 nt, Human
gagcuggagacgcaagag

SEQ ID NO: 1318459 - RNA, 22 nt, Human
gagcuggagacgcaagagccca

SEQ ID NO: 1318460 - RNA, 22 nt, Human
ggcugcaaucuggugagcugga

SEQ ID NO: 1318461 - RNA, 24 nt, Human
guccagggcccuucccugcagcug

SEQ ID NO: 1318462 - RNA, 20 nt, Human
uacaagaagagguucucgga

SEQ ID NO: 1318463 - RNA, 23 nt, Human
uacaagaagagguucucggagcu

SEQ ID NO: 1318464 - RNA, 19 nt, Human
ucagcucccaauccccaga

SEQ ID NO: 1318465 - RNA, 21 nt, Human
ucuguggcugcaaucugguga

SEQ ID NO: 1318466 - RNA, 19 nt, Human
ugcccggguugucgcgggc

SEQ ID NO: 1318467 - RNA, 21 nt, Human
uguuggagagauccggagagc

SEQ ID NO: 1318468 - RNA, 21 nt, Human
uucccugcagcuggagcaggc

SEQ ID NO: 1318469 - RNA, 26 nt, Human
aaaccaaagcauuaaucccaggucug

SEQ ID NO: 1318470 - RNA, 24 nt, Human
aaccaaagcauuaaucccaggucu

SEQ ID NO: 1318471 - RNA, 24 nt, Human
aagcccccaacugcuuagcaaacu

SEQ ID NO: 1318472 - RNA, 25 nt, Human
aagccccucccuaagccagaugauc

SEQ ID NO: 1318473 - RNA, 19 nt, Human
aauuccuaucccuucaccc

SEQ ID NO: 1318474 - RNA, 26 nt, Human
acaucuggacccaagcccccaacugc

SEQ ID NO: 1318475 - RNA, 23 nt, Human
acccaggaaccccucccccuccu

SEQ ID NO: 1318476 - RNA, 24 nt, Human
accucaagccccucccuaagccag

SEQ ID NO: 1318477 - RNA, 28 nt, Human
caacaggguucucccaggcucgaggcuu

SEQ ID NO: 1318478 - RNA, 21 nt, Human
caggaagccccugcaccucaa

SEQ ID NO: 1318479 - RNA, 18 nt, Human
ccaaagcauuaaucccag

SEQ ID NO: 1318480 - RNA, 19 nt, Human
cccaggcucgaggcuuccu

SEQ ID NO: 1318481 - RNA, 21 nt, Human
ccccugcaccucaagccccuc

SEQ ID NO: 1318482 - RNA, 22 nt, Human
ccuaucccuucacccaggaacc

SEQ ID NO: 1318483 - RNA, 21 nt, Human
ccugaggucucccaaaccaaa

SEQ ID NO: 1318484 - RNA, 19 nt, Human
cugcaccucaagccccucc

SEQ ID NO: 1318485 - RNA, 23 nt, Human
gcaccucaagccccucccuaagc

SEQ ID NO: 1318486 - RNA, 23 nt, Human
ggaagccccugcaccucaagccc

SEQ ID NO: 1318487 - RNA, 23 nt, Human
uagcaaacuuugccucuggacuu

SEQ ID NO: 1318488 - RNA, 21 nt, Human
ucccaggcucgaggcuuccug

SEQ ID NO: 1318489 - RNA, 18 nt, Human
uccuaucccuucacccag

SEQ ID NO: 1318490 - RNA, 21 nt, Human
uccuaucccuucacccaggaa

SEQ ID NO: 1318491 - RNA, 23 nt, Human
ucggcucaggaagccccugcacc

SEQ ID NO: 1318492 - RNA, 22 nt, Human
ucucccaggcucgaggcuuccu

SEQ ID NO: 1318493 - RNA, 23 nt, Human
ugccucuggacuugagagaauuc

SEQ ID NO: 1318494 - RNA, 18 nt, Human
uggggacaucuggaccca

SEQ ID NO: 1318495 - RNA, 21 nt, Human
caaaaucuuggagugcccaaa

SEQ ID NO: 1318496 - RNA, 21 nt, Human
gagaggucucucccaaaaucu

SEQ ID NO: 1318497 - RNA, 21 nt, Human
gagaggucucucccaaaaucu

SEQ ID NO: 1318498 - RNA, 21 nt, Human
uagugggucccugcuccucuu

SEQ ID NO: 1318499 - RNA, 19 nt, Human
aaacagguaacuaaguccu

SEQ ID NO: 1318500 - RNA, 23 nt, Human
aaacggacacuggaguugaugcu

SEQ ID NO: 1318501 - RNA, 22 nt, Human
acaaaaccagagaaaacggaca

SEQ ID NO: 1318502 - RNA, 18 nt, Human
auaaaacaguuggcaaug

SEQ ID NO: 1318503 - RNA, 18 nt, Human
caguugacuuuagaugac

SEQ ID NO: 1318504 - RNA, 19 nt, Human
caguugacuuuagaugaca

SEQ ID NO: 1318505 - RNA, 22 nt, Human
ucaucugggcuccugauuugga

SEQ ID NO: 1318506 - RNA, 19 nt, Human
ugaaaaacuaagaauccca

SEQ ID NO: 1318507 - RNA, 23 nt, Human
ugaaaggaauaaaacaguuggca

SEQ ID NO: 1318508 - RNA, 21 nt, Human
ugaugaagagagagucuuuuu

SEQ ID NO: 1318509 - RNA, 21 nt, Human
uuagaugacacugaaacaggu

SEQ ID NO: 1318510 - RNA, 25 nt, Human
uucuuuaaguucaucugggcuccug

SEQ ID NO: 1318511 - RNA, 21 nt, Human
uugaaaaacuaagaaucccau

SEQ ID NO: 1318512 - RNA, 22 nt, Human
uuggcaauggcaucucgcuucu

SEQ ID NO: 1318513 - RNA, 20 nt, Human
aaggggcucuauguugguug

SEQ ID NO: 1318514 - RNA, 26 nt, Human
aaggugcccuugccacauguuuccgg

SEQ ID NO: 1318515 - RNA, 22 nt, Human
agaaauguuggaggccuaaguc

SEQ ID NO: 1318516 - RNA, 20 nt, Human
caagcaguggcuacuagaga

SEQ ID NO: 1318517 - RNA, 18 nt, Human
cagcaugacagacauugg

SEQ ID NO: 1318518 - RNA, 23 nt, Human
cagcaugacagacauuggugaug

SEQ ID NO: 1318519 - RNA, 22 nt, Human
ccgaugaauugaauuucugugc

SEQ ID NO: 1318520 - RNA, 18 nt, Human
cucuccucccagcuaugg

SEQ ID NO: 1318521 - RNA, 18 nt, Human
gaggccuaaguucugggc

SEQ ID NO: 1318522 - RNA, 20 nt, Human
uaacaggugcaagaaugccu

SEQ ID NO: 1318523 - RNA, 21 nt, Human
uccucccagcuauggcuccag

SEQ ID NO: 1318524 - RNA, 30 nt, Human
ucucccgcaagcaguggcuacuagagaaau

SEQ ID NO: 1318525 - RNA, 20 nt, Human
ugacuugagucacaaagaug

SEQ ID NO: 1318526 - RNA, 21 nt, Human
ugacuugagucacaaagaugg

SEQ ID NO: 1318527 - RNA, 21 nt, Human
uggaaaggggcucuauguugg

SEQ ID NO: 1318528 - RNA, 22 nt, Human
uggaaaggggcucuauguuggu

SEQ ID NO: 1318529 - RNA, 20 nt, Human
ugguguuggccuugauguuc

SEQ ID NO: 1318530 - RNA, 24 nt, Human
ugguuggugaaccacauccaaaga

SEQ ID NO: 1318531 - RNA, 22 nt, Human
aacauauuggcuuuucauccuc

SEQ ID NO: 1318532 - RNA, 22 nt, Human
acaguagagcauuucauuggcc

SEQ ID NO: 1318533 - RNA, 23 nt, Human
auuggcuuuucauccucauguuu

SEQ ID NO: 1318534 - RNA, 19 nt, Human
caacuauaaugagcagagc

SEQ ID NO: 1318535 - RNA, 23 nt, Human
cacaguagagcauuucauuggcc

SEQ ID NO: 1318536 - RNA, 18 nt, Human
cccccaguucccgcugcu

SEQ ID NO: 1318537 - RNA, 23 nt, Human
gaagcucuucccgcuuuucacuu

SEQ ID NO: 1318538 - RNA, 24 nt, Human
uaauucgaaauauguuugcacuua

SEQ ID NO: 1318539 - RNA, 21 nt, Human
uaauuuagggaaacaugcaau

SEQ ID NO: 1318540 - RNA, 18 nt, Human
ugacuggaggccgugggc

SEQ ID NO: 1318541 - RNA, 21 nt, Human
uucaaggaaaaaagagaguca

SEQ ID NO: 1318542 - RNA, 25 nt, Human
aaaaugagcaacugugauaacaaau

SEQ ID NO: 1318543 - RNA, 19 nt, Human
aaggagacagagcuaccag

SEQ ID NO: 1318544 - RNA, 23 nt, Human
aaguaugaaacaacuuugauaga

SEQ ID NO: 1318545 - RNA, 27 nt, Human
aauccacugccacuucugcugaaacaa

SEQ ID NO: 1318546 - RNA, 20 nt, Human
cacacauuaacauccacacu

SEQ ID NO: 1318547 - RNA, 22 nt, Human
cacauuaacauccacacugugc

SEQ ID NO: 1318548 - RNA, 22 nt, Human
cacuucugcugaaacaaaaguc

SEQ ID NO: 1318549 - RNA, 19 nt, Human
cucucucaauccuauuaaa

SEQ ID NO: 1318550 - RNA, 21 nt, Human
cugaaacaaaagucaacugau

SEQ ID NO: 1318551 - RNA, 19 nt, Human
cugccacuucugcugaaac

SEQ ID NO: 1318552 - RNA, 25 nt, Human
gauaacaaauaaaacuuggagagaa

SEQ ID NO: 1318553 - RNA, 18 nt, Human
gcuauuuccuuauucaag

SEQ ID NO: 1318554 - RNA, 24 nt, Human
uaagucugagggaaauuacccaaa

SEQ ID NO: 1318555 - RNA, 24 nt, Human
uaauguuuucuucuugcucaguuu

SEQ ID NO: 1318556 - RNA, 21 nt, Human
uagauagagacuaaaauggcu

SEQ ID NO: 1318557 - RNA, 20 nt, Human
ugagggaaauuacccaaaau

SEQ ID NO: 1318558 - RNA, 23 nt, Human
uggagagaaaaaaguuggcuauu

SEQ ID NO: 1318559 - RNA, 20 nt, Human
uucaaauagcucucucaauc

SEQ ID NO: 1318560 - RNA, 20 nt, Human
uucaaggagacagagcuacc

SEQ ID NO: 1318561 - RNA, 18 nt, Human
aacuuuuauuuuagguuu

SEQ ID NO: 1318562 - RNA, 23 nt, Human
aacuuuuauuuuagguuugggga

SEQ ID NO: 1318563 - RNA, 21 nt, Human
uuaacuuuuauuuuagguuug

SEQ ID NO: 1318564 - RNA, 23 nt, Human
aaacuucugaccucaggcaaucc

SEQ ID NO: 1318565 - RNA, 24 nt, Human
aaagugcugggauuacaggcauga

SEQ ID NO: 1318566 - RNA, 21 nt, Human
aaaucucccuuaucucuaccu

SEQ ID NO: 1318567 - RNA, 18 nt, Human
aaaucuccuucagaggcc

SEQ ID NO: 1318568 - RNA, 19 nt, Human
aacauggcaaaacccaucu

SEQ ID NO: 1318569 - RNA, 21 nt, Human
aaccaaagaguaguaagacag

SEQ ID NO: 1318570 - RNA, 20 nt, Human
aaccuccuucaggaagcuaa

SEQ ID NO: 1318571 - RNA, 23 nt, Human
aagauuaaaaguuacacaaaucu

SEQ ID NO: 1318572 - RNA, 26 nt, Human
aagcacuaggauuacaguugugagcc

SEQ ID NO: 1318573 - RNA, 22 nt, Human
aaguagcugagauuacaggcau

SEQ ID NO: 1318574 - RNA, 25 nt, Human
aaguagcugagauuacaggcauucg

SEQ ID NO: 1318575 - RNA, 19 nt, Human
aagugcugggauuacaggc

SEQ ID NO: 1318576 - RNA, 21 nt, Human
aagugcugggauuacaggcau

SEQ ID NO: 1318577 - RNA, 26 nt, Human
aagugcugggauuacaggcaugagcc

SEQ ID NO: 1318578 - RNA, 24 nt, Human
acagagcaagaccuugucucaaaa

SEQ ID NO: 1318579 - RNA, 24 nt, Human
acagagggagacuccaucucaaaa

SEQ ID NO: 1318580 - RNA, 18 nt, Human
accaacaagaggucuugc

SEQ ID NO: 1318581 - RNA, 18 nt, Human
accacgccuggcuaauuu

SEQ ID NO: 1318582 - RNA, 18 nt, Human
accauguuggccaggcug

SEQ ID NO: 1318583 - RNA, 24 nt, Human
accggaggucaggaguucaagacc

SEQ ID NO: 1318584 - RNA, 28 nt, Human
accuugucucaaaaaaaaaaaaaaaaaa

SEQ ID NO: 1318585 - RNA, 25 nt, Human
acucugucucccaggcuggaaagca

SEQ ID NO: 1318586 - RNA, 26 nt, Human
acugcacucuagaaccugggcaacag

SEQ ID NO: 1318587 - RNA, 18 nt, Human
acugcagccuugaccucc

SEQ ID NO: 1318588 - RNA, 18 nt, Human
acuuguuuuccaggcugg

SEQ ID NO: 1318589 - RNA, 21 nt, Human
acuuguuuuccaggcuggagu

SEQ ID NO: 1318590 - RNA, 24 nt, Human
acuuugggaggcagaggugggcag

SEQ ID NO: 1318591 - RNA, 22 nt, Human
agauucuccugucucagccucc

SEQ ID NO: 1318592 - RNA, 24 nt, Human
agcacuuugggaggcagagguggg

SEQ ID NO: 1318593 - RNA, 24 nt, Human
agcacuuugggaggccgagguggg

SEQ ID NO: 1318594 - RNA, 19 nt, Human
agccaggugugguggugau

SEQ ID NO: 1318595 - RNA, 20 nt, Human
agccuccugccucgaccucc

SEQ ID NO: 1318596 - RNA, 23 nt, Human
agcuccuugggaggcugagacag

SEQ ID NO: 1318597 - RNA, 19 nt, Human
aggaggaugagagagcccu

SEQ ID NO: 1318598 - RNA, 24 nt, Human
aggcaauccgcccguguuggccuc

SEQ ID NO: 1318599 - RNA, 24 nt, Human
aggcacgguggcucacaccuauaa

SEQ ID NO: 1318600 - RNA, 21 nt, Human
aggcagaggugggcagaucac

SEQ ID NO: 1318601 - RNA, 21 nt, Human
aggccgaggugggagaaucac

SEQ ID NO: 1318602 - RNA, 24 nt, Human
aggccgaggugggagaaucacuug

SEQ ID NO: 1318603 - RNA, 20 nt, Human
aggcggagguugcagugagc

SEQ ID NO: 1318604 - RNA, 24 nt, Human
aggcggagguugcagugagcugag

SEQ ID NO: 1318605 - RNA, 18 nt, Human
aggugggagaaucacuug

SEQ ID NO: 1318606 - RNA, 23 nt, Human
aggugggagaaucacuuggaccc

SEQ ID NO: 1318607 - RNA, 22 nt, Human
aggugggcagaucaccggaggu

SEQ ID NO: 1318608 - RNA, 24 nt, Human
aggugugguggugaucgccuguaa

SEQ ID NO: 1318609 - RNA, 21 nt, Human
agugcaauggcgcgauuucag

SEQ ID NO: 1318610 - RNA, 18 nt, Human
agugcugggauuacaggc

SEQ ID NO: 1318611 - RNA, 22 nt, Human
auaaaucuccuucagaggccag

SEQ ID NO: 1318612 - RNA, 25 nt, Human
auaauaauaacuuccuaaguaugcc

SEQ ID NO: 1318613 - RNA, 18 nt, Human
auacugaaaaaugucaga

SEQ ID NO: 1318614 - RNA, 20 nt, Human
auccucccgccucagccuuc

SEQ ID NO: 1318615 - RNA, 18 nt, Human
augggguuucaccauguu

SEQ ID NO: 1318616 - RNA, 22 nt, Human
augggguuucaccauguuggcc

SEQ ID NO: 1318617 - RNA, 24 nt, Human
caaagcacuaggauuacaguugug

SEQ ID NO: 1318618 - RNA, 24 nt, Human
caaagugcugggauuacaggcaug

SEQ ID NO: 1318619 - RNA, 20 nt, Human
caacaaacuuauuuuugauu

SEQ ID NO: 1318620 - RNA, 20 nt, Human
caaccucugccucccggguu

SEQ ID NO: 1318621 - RNA, 22 nt, Human
caagagauucuccugucucagc

SEQ ID NO: 1318622 - RNA, 26 nt, Human
cacaccuauaaucccccagcacuuug

SEQ ID NO: 1318623 - RNA, 22 nt, Human
cacacuuguuuuccaggcugga

SEQ ID NO: 1318624 - RNA, 26 nt, Human
caccacugcacucuagaaccugggca

SEQ ID NO: 1318625 - RNA, 24 nt, Human
caccaugcccagcuaauuuuugua

SEQ ID NO: 1318626 - RNA, 21 nt, Human
caccauguuggccaggcuggu

SEQ ID NO: 1318627 - RNA, 24 nt, Human
caccauguuggccaggcuggucuc

SEQ ID NO: 1318628 - RNA, 23 nt, Human
caccggaggucaggaguucaaga

SEQ ID NO: 1318629 - RNA, 25 nt, Human
caccuauaaucccccagcacuuugg

SEQ ID NO: 1318630 - RNA, 23 nt, Human
cacucugucucccaggcuggaaa

SEQ ID NO: 1318631 - RNA, 24 nt, Human
cacucugucucccaggcuggaaag

SEQ ID NO: 1318632 - RNA, 21 nt, Human
cacugcaaccucugccucccg

SEQ ID NO: 1318633 - RNA, 23 nt, Human
cacugcaaccucugccucccggg

SEQ ID NO: 1318634 - RNA, 20 nt, Human
cacugcacucuagaaccugg

SEQ ID NO: 1318635 - RNA, 21 nt, Human
cacugcacucuagaaccuggg

SEQ ID NO: 1318636 - RNA, 25 nt, Human
cacugcacucuagaaccugggcaac

SEQ ID NO: 1318637 - RNA, 26 nt, Human
cacugcacucuagaaccugggcaaca

SEQ ID NO: 1318638 - RNA, 19 nt, Human
cacugcagccuugaccucc

SEQ ID NO: 1318639 - RNA, 18 nt, Human
cacuuguuuuccaggcug

SEQ ID NO: 1318640 - RNA, 24 nt, Human
cagaucaccggaggucaggaguuc

SEQ ID NO: 1318641 - RNA, 24 nt, Human
cagcacuuugggaggcagaggugg

SEQ ID NO: 1318642 - RNA, 24 nt, Human
cagcacuuugggaggccgaggugg

SEQ ID NO: 1318643 - RNA, 22 nt, Human
cagcagaauugcuucagcccag

SEQ ID NO: 1318644 - RNA, 24 nt, Human
cagccuugaccuccuaggcucaaa

SEQ ID NO: 1318645 - RNA, 20 nt, Human
caggcauucgccaccaugcc

SEQ ID NO: 1318646 - RNA, 23 nt, Human
caguugugagccaccacauccag

SEQ ID NO: 1318647 - RNA, 24 nt, Human
cauaccuguaguaacagcacuuug

SEQ ID NO: 1318648 - RNA, 24 nt, Human
cauguuggccaggcuggucucaaa

SEQ ID NO: 1318649 - RNA, 23 nt, Human
ccaaagugcugggauuacaggca

SEQ ID NO: 1318650 - RNA, 24 nt, Human
ccaaagugcugggauuacaggcau

SEQ ID NO: 1318651 - RNA, 23 nt, Human
ccaaguagcugagauuacaggca

SEQ ID NO: 1318652 - RNA, 24 nt, Human
ccaaguagcugagauuacaggcau

SEQ ID NO: 1318653 - RNA, 22 nt, Human
ccacugcacucuagaaccuggg

SEQ ID NO: 1318654 - RNA, 22 nt, Human
ccacugcacucuagaaccuggg

SEQ ID NO: 1318655 - RNA, 23 nt, Human
ccacugcacucuagaaccugggc

SEQ ID NO: 1318656 - RNA, 26 nt, Human
ccacugcacucuagaaccugggcaac

SEQ ID NO: 1318657 - RNA, 22 nt, Human
ccagaccaacaagaggucuugc

SEQ ID NO: 1318658 - RNA, 18 nt, Human
ccaggcuggagugcaaug

SEQ ID NO: 1318659 - RNA, 24 nt, Human
cccaaagugcugggauuacaggca

SEQ ID NO: 1318660 - RNA, 19 nt, Human
cccaaguagcugagauuac

SEQ ID NO: 1318661 - RNA, 24 nt, Human
cccaaguagcugagauuacaggca

SEQ ID NO: 1318662 - RNA, 19 nt, Human
cccaggaggcggagguugc

SEQ ID NO: 1318663 - RNA, 21 nt, Human
ccccacccagucccagggacu

SEQ ID NO: 1318664 - RNA, 21 nt, Human
cccccacccagucccagggac

SEQ ID NO: 1318665 - RNA, 20 nt, Human
cccccagcacuuugggaggc

SEQ ID NO: 1318666 - RNA, 24 nt, Human
cccgccucagccuucugaguagcu

SEQ ID NO: 1318667 - RNA, 23 nt, Human
cccggguucaagagauucuccug

SEQ ID NO: 1318668 - RNA, 22 nt, Human
cccguguuggccucccaaagug

SEQ ID NO: 1318669 - RNA, 20 nt, Human
ccucccaaagcacuaggauu

SEQ ID NO: 1318670 - RNA, 24 nt, Human
ccucccgccucagccuucugagua

SEQ ID NO: 1318671 - RNA, 24 nt, Human
ccucccggguucaagagauucucc

SEQ ID NO: 1318672 - RNA, 22 nt, Human
ccuccugccucgaccucccaaa

SEQ ID NO: 1318673 - RNA, 24 nt, Human
ccuccugccucgaccucccaaagc

SEQ ID NO: 1318674 - RNA, 21 nt, Human
ccugccucgaccucccaaagc

SEQ ID NO: 1318675 - RNA, 21 nt, Human
ccuggucucaagggagccucc

SEQ ID NO: 1318676 - RNA, 18 nt, Human
ccuguaaccccagcuccu

SEQ ID NO: 1318677 - RNA, 19 nt, Human
ccuguaaccccagcuccuu

SEQ ID NO: 1318678 - RNA, 24 nt, Human
ccugucucagccucccaaguagcu

SEQ ID NO: 1318679 - RNA, 19 nt, Human
ccuugaccuccuaggcuca

SEQ ID NO: 1318680 - RNA, 20 nt, Human
ccuugaccuccuaggcucaa

SEQ ID NO: 1318681 - RNA, 24 nt, Human
ccuugucucaaaaaaaaaaaaaaa

SEQ ID NO: 1318682 - RNA, 22 nt, Human
cgaggugggagaaucacuugga

SEQ ID NO: 1318683 - RNA, 20 nt, Human
cgccgccccccacccagucc

SEQ ID NO: 1318684 - RNA, 23 nt, Human
cgccucagccuucugaguagcuu

SEQ ID NO: 1318685 - RNA, 24 nt, Human
cgccuguaaccccagcuccuuggg

SEQ ID NO: 1318686 - RNA, 18 nt, Human
cucaaaaaaaaaaaaaaa

SEQ ID NO: 1318687 - RNA, 26 nt, Human
cucaaaaaaaaaaaaaaaaaaaaaaa

SEQ ID NO: 1318688 - RNA, 24 nt, Human
cucaaacaauccucccgccucagc

SEQ ID NO: 1318689 - RNA, 24 nt, Human
cucacaccuauaaucccccagcac

SEQ ID NO: 1318690 - RNA, 24 nt, Human
cucacugcaaccucugccucccgg

SEQ ID NO: 1318691 - RNA, 21 nt, Human
cucacugcagccuugaccucc

SEQ ID NO: 1318692 - RNA, 23 nt, Human
cucauuagagauuugaagccaga

SEQ ID NO: 1318693 - RNA, 21 nt, Human
cucccaaguagcugagauuac

SEQ ID NO: 1318694 - RNA, 25 nt, Human
cuccuaggcucaaacaauccucccg

SEQ ID NO: 1318695 - RNA, 25 nt, Human
cuccugucucagccucccaaguagc

SEQ ID NO: 1318696 - RNA, 20 nt, Human
cugaaaaaugucagaaugua

SEQ ID NO: 1318697 - RNA, 21 nt, Human
cugaccucaggcaauccgccc

SEQ ID NO: 1318698 - RNA, 19 nt, Human
cugcaaccucugccucccg

SEQ ID NO: 1318699 - RNA, 24 nt, Human
cugcaaccucugccucccggguuc

SEQ ID NO: 1318700 - RNA, 22 nt, Human
cugcagccuugaccuccuaggc

SEQ ID NO: 1318701 - RNA, 23 nt, Human
cugcagccuugaccuccuaggcu

SEQ ID NO: 1318702 - RNA, 21 nt, Human
cuggucucaaacuccuggucu

SEQ ID NO: 1318703 - RNA, 23 nt, Human
cuucugaccucaggcaauccgcc

SEQ ID NO: 1318704 - RNA, 26 nt, Human
cuucugaccucaggcaauccgcccgu

SEQ ID NO: 1318705 - RNA, 22 nt, Human
cuuugcaguuccgccgcccccc

SEQ ID NO: 1318706 - RNA, 24 nt, Human
cuuuuaguagaaaugggguuucac

SEQ ID NO: 1318707 - RNA, 18 nt, Human
gaacacuaaucggauugg

SEQ ID NO: 1318708 - RNA, 21 nt, Human
gaggcggagguugcagugagc

SEQ ID NO: 1318709 - RNA, 25 nt, Human
gaggugggcagaucaccggagguca

SEQ ID NO: 1318710 - RNA, 23 nt, Human
gagguugcagugagcugagaucg

SEQ ID NO: 1318711 - RNA, 21 nt, Human
gaucaaugaagauuaaaaguu

SEQ ID NO: 1318712 - RNA, 23 nt, Human
gaucaccggaggucaggaguuca

SEQ ID NO: 1318713 - RNA, 24 nt, Human
gaucaccggaggucaggaguucaa

SEQ ID NO: 1318714 - RNA, 20 nt, Human
gauuaagccaaaucucccuu

SEQ ID NO: 1318715 - RNA, 18 nt, Human
gauuacaggcaugagcca

SEQ ID NO: 1318716 - RNA, 22 nt, Human
gauuacaggcaugagccacugc

SEQ ID NO: 1318717 - RNA, 23 nt, Human
gauuacaggcaugagccacugca

SEQ ID NO: 1318718 - RNA, 24 nt, Human
gauuacaggcauucgccaccaugc

SEQ ID NO: 1318719 - RNA, 18 nt, Human
gauuacaguugugagcca

SEQ ID NO: 1318720 - RNA, 21 nt, Human
gauuacaguugugagccacca

SEQ ID NO: 1318721 - RNA, 22 nt, Human
gcaguuccgccgccccccaccc

SEQ ID NO: 1318722 - RNA, 23 nt, Human
gccacugcacccggccaacaaac

SEQ ID NO: 1318723 - RNA, 24 nt, Human
gcccaggaggcggagguugcagug

SEQ ID NO: 1318724 - RNA, 19 nt, Human
gccucagccuucugaguag

SEQ ID NO: 1318725 - RNA, 23 nt, Human
gccucgaccucccaaagcacuag

SEQ ID NO: 1318726 - RNA, 19 nt, Human
gccuugaccuccuaggcuc

SEQ ID NO: 1318727 - RNA, 21 nt, Human
gcucacugcagccuugaccuc

SEQ ID NO: 1318728 - RNA, 19 nt, Human
gcuggagugcaauggcgcg

SEQ ID NO: 1318729 - RNA, 22 nt, Human
ggagguugcagugagcugagau

SEQ ID NO: 1318730 - RNA, 24 nt, Human
ggagguugcagugagcugagaucg

SEQ ID NO: 1318731 - RNA, 22 nt, Human
ggauuacaggcaugagccacug

SEQ ID NO: 1318732 - RNA, 22 nt, Human
ggauuacaguugugagccacca

SEQ ID NO: 1318733 - RNA, 25 nt, Human
ggcagaucaccggaggucaggaguu

SEQ ID NO: 1318734 - RNA, 21 nt, Human
ggccaggcacgguggcucaca

SEQ ID NO: 1318735 - RNA, 24 nt, Human
ggcuggucucaaacuccuggucuc

SEQ ID NO: 1318736 - RNA, 24 nt, Human
ggcuggucucaaacuucugaccuc

SEQ ID NO: 1318737 - RNA, 24 nt, Human
gggggucuuguuacguugcccagg

SEQ ID NO: 1318738 - RNA, 22 nt, Human
gggguuucaccauguuggccag

SEQ ID NO: 1318739 - RNA, 18 nt, Human
ggguuucaccauguuggc

SEQ ID NO: 1318740 - RNA, 22 nt, Human
ggguuucaccauguuggccagg

SEQ ID NO: 1318741 - RNA, 19 nt, Human
ggucucaaacuucugaccu

SEQ ID NO: 1318742 - RNA, 21 nt, Human
guguuggccucccaaagugcu

SEQ ID NO: 1318743 - RNA, 22 nt, Human
guugcagugagcugagaucguc

SEQ ID NO: 1318744 - RNA, 20 nt, Human
uaaaaauacaaaauuuagcc

SEQ ID NO: 1318745 - RNA, 21 nt, Human
uaaaaauacaaaauuuagcca

SEQ ID NO: 1318746 - RNA, 19 nt, Human
uaauaccauacguuaauau

SEQ ID NO: 1318747 - RNA, 22 nt, Human
uaauuuuuguacuuuuaguaga

SEQ ID NO: 1318748 - RNA, 22 nt, Human
uacaggcacgugcuaccacgcc

SEQ ID NO: 1318749 - RNA, 23 nt, Human
uacaggcaugagccacugcaccc

SEQ ID NO: 1318750 - RNA, 24 nt, Human
uacaggcauucgccaccaugccca

SEQ ID NO: 1318751 - RNA, 24 nt, Human
uacaguugugagccaccacaucca

SEQ ID NO: 1318752 - RNA, 24 nt, Human
uaccacgccuggcuaauuuuuaau

SEQ ID NO: 1318753 - RNA, 23 nt, Human
uacguugcccaggcuggucucaa

SEQ ID NO: 1318754 - RNA, 24 nt, Human
uacguugcccaggcuggucucaaa

SEQ ID NO: 1318755 - RNA, 22 nt, Human
uacucuauucacuugguauuua

SEQ ID NO: 1318756 - RNA, 22 nt, Human
uagaaaugggguuucaccaugu

SEQ ID NO: 1318757 - RNA, 20 nt, Human
uagccaaauauuuuuaguua

SEQ ID NO: 1318758 - RNA, 22 nt, Human
uaggauuacaguugugagccac

SEQ ID NO: 1318759 - RNA, 24 nt, Human
uaggauuacaguugugagccacca

SEQ ID NO: 1318760 - RNA, 26 nt, Human
uaguaagacagugaaauuuaggagga

SEQ ID NO: 1318761 - RNA, 24 nt, Human
uaguagaaaugggguuucaccaug

SEQ ID NO: 1318762 - RNA, 26 nt, Human
uaguagaaaugggguuucaccauguu

SEQ ID NO: 1318763 - RNA, 22 nt, Human
ucaaaaaaaaaaaaaaaaaaaa

SEQ ID NO: 1318764 - RNA, 23 nt, Human
ucaaaaaaaaaaaaaaaaaaaaa

SEQ ID NO: 1318765 - RNA, 23 nt, Human
ucacacuuguuuuccaggcugga

SEQ ID NO: 1318766 - RNA, 23 nt, Human
ucaccggaggucaggaguucaag

SEQ ID NO: 1318767 - RNA, 24 nt, Human
ucacugcaaccucugccucccggg

SEQ ID NO: 1318768 - RNA, 25 nt, Human
ucacugcaaccucugccucccgggu

SEQ ID NO: 1318769 - RNA, 19 nt, Human
ucacugcagccuugaccuc

SEQ ID NO: 1318770 - RNA, 23 nt, Human
ucacugcagccuugaccuccuag

SEQ ID NO: 1318771 - RNA, 24 nt, Human
ucacugcagccuugaccuccuagg

SEQ ID NO: 1318772 - RNA, 21 nt, Human
ucagccucccaaguagcugag

SEQ ID NO: 1318773 - RNA, 23 nt, Human
ucagccuucugaguagcuugggc

SEQ ID NO: 1318774 - RNA, 18 nt, Human
ucaggaagcuaagccaug

SEQ ID NO: 1318775 - RNA, 23 nt, Human
ucaugcaccacugcacucuagaa

SEQ ID NO: 1318776 - RNA, 19 nt, Human
uccagcuuggugacagagg

SEQ ID NO: 1318777 - RNA, 24 nt, Human
ucccaaagugcugggauuacaggc

SEQ ID NO: 1318778 - RNA, 24 nt, Human
ucccaaguagcugagauuacaggc

SEQ ID NO: 1318779 - RNA, 21 nt, Human
ucccggguucaagagauucuc

SEQ ID NO: 1318780 - RNA, 24 nt, Human
ucccggguucaagagauucuccug

SEQ ID NO: 1318781 - RNA, 20 nt, Human
uccugccucgaccucccaaa

SEQ ID NO: 1318782 - RNA, 19 nt, Human
uccuucaggaagcuaagcc

SEQ ID NO: 1318783 - RNA, 19 nt, Human
ucucaaaaaaaaaaaaaaa

SEQ ID NO: 1318784 - RNA, 21 nt, Human
ucucacucugucucccaggcu

SEQ ID NO: 1318785 - RNA, 23 nt, Human
ucucacucugucucccaggcugg

SEQ ID NO: 1318786 - RNA, 24 nt, Human
ucucacucugucucccaggcugga

SEQ ID NO: 1318787 - RNA, 20 nt, Human
ucucuacuaaaaauacaaaa

SEQ ID NO: 1318788 - RNA, 23 nt, Human
ucugaguagcuugggcuacaggc

SEQ ID NO: 1318789 - RNA, 24 nt, Human
ucugaguagcuugggcuacaggca

SEQ ID NO: 1318790 - RNA, 20 nt, Human
ucuuacacacucuaaaagac

SEQ ID NO: 1318791 - RNA, 23 nt, Human
ucuuguuacguugcccaggcugg

SEQ ID NO: 1318792 - RNA, 24 nt, Human
ucuuguuacguugcccaggcuggu

SEQ ID NO: 1318793 - RNA, 21 nt, Human
ugaccucaggcaauccgcccg

SEQ ID NO: 1318794 - RNA, 24 nt, Human
ugaccuccuaggcucaaacaaucc

SEQ ID NO: 1318795 - RNA, 25 nt, Human
ugaccuccuaggcucaaacaauccu

SEQ ID NO: 1318796 - RNA, 20 nt, Human
ugagacagggucucacucug

SEQ ID NO: 1318797 - RNA, 22 nt, Human
ugagacagggucucacucuguc

SEQ ID NO: 1318798 - RNA, 19 nt, Human
ugagauuacaggcauucgc

SEQ ID NO: 1318799 - RNA, 21 nt, Human
ugagauuacaggcauucgcca

SEQ ID NO: 1318800 - RNA, 22 nt, Human
ugagauuacaggcauucgccac

SEQ ID NO: 1318801 - RNA, 24 nt, Human
ugagauuacaggcauucgccacca

SEQ ID NO: 1318802 - RNA, 24 nt, Human
ugcaaugagccgugaucaugcacc

SEQ ID NO: 1318803 - RNA, 24 nt, Human
ugcccaggcuggucucaaacuccu

SEQ ID NO: 1318804 - RNA, 23 nt, Human
ugccucgaccucccaaagcacua

SEQ ID NO: 1318805 - RNA, 24 nt, Human
ugccucgaccucccaaagcacuag

SEQ ID NO: 1318806 - RNA, 24 nt, Human
uggaaagcaauggcacaauauugg

SEQ ID NO: 1318807 - RNA, 23 nt, Human
uggagugcaauggcgcgauuuca

SEQ ID NO: 1318808 - RNA, 24 nt, Human
uggagugcaauggcgcgauuucag

SEQ ID NO: 1318809 - RNA, 23 nt, Human
uggcacaauauuggcucacugca

SEQ ID NO: 1318810 - RNA, 24 nt, Human
uggccaggcuggucucaaacuucu

SEQ ID NO: 1318811 - RNA, 24 nt, Human
uggcgcgauuucagcucacugcaa

SEQ ID NO: 1318812 - RNA, 20 nt, Human
uggcucacaccuauaauccc

SEQ ID NO: 1318813 - RNA, 24 nt, Human
uggcucacugcagccuugaccucc

SEQ ID NO: 1318814 - RNA, 18 nt, Human
ugggaggcagaggugggc

SEQ ID NO: 1318815 - RNA, 20 nt, Human
ugggaggcagaggugggcag

SEQ ID NO: 1318816 - RNA, 24 nt, Human
ugggaggcagaggugggcagauca

SEQ ID NO: 1318817 - RNA, 19 nt, Human
ugggaggccgaggugggag

SEQ ID NO: 1318818 - RNA, 24 nt, Human
ugggaggccgaggugggagaauca

SEQ ID NO: 1318819 - RNA, 18 nt, Human
ugggaggcugagacagca

SEQ ID NO: 1318820 - RNA, 20 nt, Human
ugggaggcugagacagcaga

SEQ ID NO: 1318821 - RNA, 18 nt, Human
ugggauuacaggcaugag

SEQ ID NO: 1318822 - RNA, 19 nt, Human
ugggauuacaggcaugagc

SEQ ID NO: 1318823 - RNA, 21 nt, Human
ugggauuacaggcaugagcca

SEQ ID NO: 1318824 - RNA, 22 nt, Human
ugggauuacaggcaugagccac

SEQ ID NO: 1318825 - RNA, 22 nt, Human
ugggauuacaggcaugagccac

SEQ ID NO: 1318826 - RNA, 24 nt, Human
ugggauuacaggcaugagccacug

SEQ ID NO: 1318827 - RNA, 24 nt, Human
ugggauuacaggcaugagccacug

SEQ ID NO: 1318828 - RNA, 26 nt, Human
ugggauuacaggcaugagccacugca

SEQ ID NO: 1318829 - RNA, 24 nt, Human
ugggcagaucaccggaggucagga

SEQ ID NO: 1318830 - RNA, 23 nt, Human
ugggcuacaggcacgugcuacca

SEQ ID NO: 1318831 - RNA, 24 nt, Human
ugggguuucaccauguuggccagg

SEQ ID NO: 1318832 - RNA, 24 nt, Human
ugucucagccucccaaguagcuga

SEQ ID NO: 1318833 - RNA, 21 nt, Human
uguguacaacuaugaagauca

SEQ ID NO: 1318834 - RNA, 24 nt, Human
uguuacguugcccaggcuggucuc

SEQ ID NO: 1318835 - RNA, 27 nt, Human
uguuacguugcccaggcuggucucaaa

SEQ ID NO: 1318836 - RNA, 26 nt, Human
uguucuacuuauauaaaucuccuuca

SEQ ID NO: 1318837 - RNA, 18 nt, Human
uguucuuguucuugguca

SEQ ID NO: 1318838 - RNA, 18 nt, Human
uuaguagaaaugggguuu

SEQ ID NO: 1318839 - RNA, 22 nt, Human
uuaguagaaaugggguuucacc

SEQ ID NO: 1318840 - RNA, 24 nt, Human
uuaguagaaaugggguuucaccau

SEQ ID NO: 1318841 - RNA, 23 nt, Human
uuccaggcuggagugcaauggcg

SEQ ID NO: 1318842 - RNA, 21 nt, Human
uucuuguucuuggucauuuca

SEQ ID NO: 1318843 - RNA, 21 nt, Human
uugaaaaauacuuugcaguuc

SEQ ID NO: 1318844 - RNA, 22 nt, Human
uugagacagggucucacucugu

SEQ ID NO: 1318845 - RNA, 19 nt, Human
uugcagugagcugagaucg

SEQ ID NO: 1318846 - RNA, 20 nt, Human
uugcagugagcugagaucgu

SEQ ID NO: 1318847 - RNA, 22 nt, Human
uugcagugagcugagaucgucc

SEQ ID NO: 1318848 - RNA, 21 nt, Human
uugcucuuucccucaauugcc

SEQ ID NO: 1318849 - RNA, 24 nt, Human
uugcuucagcccaggaggcggagg

SEQ ID NO: 1318850 - RNA, 19 nt, Human
uugggaggcagaggugggc

SEQ ID NO: 1318851 - RNA, 25 nt, Human
uugggaggccgaggugggagaauca

SEQ ID NO: 1318852 - RNA, 23 nt, Human
uugggaggcugagacagcagaau

SEQ ID NO: 1318853 - RNA, 23 nt, Human
uuguuuuccaggcuggagugcaa

SEQ ID NO: 1318854 - RNA, 21 nt, Human
uuuacauugguauuuuggcca

SEQ ID NO: 1318855 - RNA, 18 nt, Human
uuuagccagguguggugg

SEQ ID NO: 1318856 - RNA, 23 nt, Human
uuucacacuuguuuuccaggcug

SEQ ID NO: 1318857 - RNA, 24 nt, Human
uuucaccauguuggccaggcuggu

SEQ ID NO: 1318858 - RNA, 25 nt, Human
uuuguuguuguugagacagggucuc

SEQ ID NO: 1318859 - RNA, 22 nt, Human
uuuuuucuacacuauauuugag

SEQ ID NO: 1318860 - RNA, 19 nt, Human
aaacuagaagggaaaggug

SEQ ID NO: 1318861 - RNA, 19 nt, Human
aaacuguacagucaccaga

SEQ ID NO: 1318862 - RNA, 21 nt, Human
aagggaaagguguuuuccuca

SEQ ID NO: 1318863 - RNA, 19 nt, Human
caagaggaagucucucaaa

SEQ ID NO: 1318864 - RNA, 21 nt, Human
cagaugucucggcucaaggga

SEQ ID NO: 1318865 - RNA, 26 nt, Human
cagaugucucggcucaagggaguuuc

SEQ ID NO: 1318866 - RNA, 21 nt, Human
ccaagguggccauguguguca

SEQ ID NO: 1318867 - RNA, 21 nt, Human
ccacaaggcuuuugugccaag

SEQ ID NO: 1318868 - RNA, 26 nt, Human
cccuccuccugggagccaagaggaag

SEQ ID NO: 1318869 - RNA, 20 nt, Human
ccuucccccaaaaacaacaa

SEQ ID NO: 1318870 - RNA, 20 nt, Human
cugggggucaggucccaaca

SEQ ID NO: 1318871 - RNA, 24 nt, Human
cuguuagugacaugugccccuucc

SEQ ID NO: 1318872 - RNA, 18 nt, Human
cuuuugugccaagguggc

SEQ ID NO: 1318873 - RNA, 23 nt, Human
gccccuucccccaaaaacaacaa

SEQ ID NO: 1318874 - RNA, 19 nt, Human
ggaaagguguuuuccucac

SEQ ID NO: 1318875 - RNA, 22 nt, Human
gugccccuucccccaaaaacaa

SEQ ID NO: 1318876 - RNA, 26 nt, Human
uaacaacauagcuuaaaaaaaaaaaa

SEQ ID NO: 1318877 - RNA, 18 nt, Human
uagcuuaaaaaaaaaaaa

SEQ ID NO: 1318878 - RNA, 25 nt, Human
ucccaacagaugucucggcucaagg

SEQ ID NO: 1318879 - RNA, 23 nt, Human
ucccccaaaaacaacaaugaagu

SEQ ID NO: 1318880 - RNA, 18 nt, Human
uccucacauaaauccagc

SEQ ID NO: 1318881 - RNA, 21 nt, Human
ucucaaaacuagaagggaaag

SEQ ID NO: 1318882 - RNA, 19 nt, Human
ugacaugugccccuucccc

SEQ ID NO: 1318883 - RNA, 18 nt, Human
ugccaagguggccaugug

SEQ ID NO: 1318884 - RNA, 26 nt, Human
ugccaagguggccaugugugucagag

SEQ ID NO: 1318885 - RNA, 19 nt, Human
ugccccuucccccaaaaac

SEQ ID NO: 1318886 - RNA, 19 nt, Human
uguucugugugcuaacaac

SEQ ID NO: 1318887 - RNA, 19 nt, Human
uuccucacauaaauccagc

SEQ ID NO: 1318888 - RNA, 18 nt, Human
uuucuauaccacaaggcu

SEQ ID NO: 1318889 - RNA, 27 nt, Human
aaaauauccucccucaugccccaaccg

SEQ ID NO: 1318890 - RNA, 20 nt, Human
aaaccuaauccacacccuug

SEQ ID NO: 1318891 - RNA, 23 nt, Human
aagcagcaccagcugauaagaac

SEQ ID NO: 1318892 - RNA, 18 nt, Human
accaauagcugccuccaa

SEQ ID NO: 1318893 - RNA, 24 nt, Human
agccaagaaagggguacagcuuga

SEQ ID NO: 1318894 - RNA, 22 nt, Human
agccacuccuaacaagggccua

SEQ ID NO: 1318895 - RNA, 23 nt, Human
aggaaacuguauccaagguuaca

SEQ ID NO: 1318896 - RNA, 22 nt, Human
aggaagcagcaccagcuccagu

SEQ ID NO: 1318897 - RNA, 20 nt, Human
aggugguggugaucagcaca

SEQ ID NO: 1318898 - RNA, 21 nt, Human
aggugguggugaucagcacag

SEQ ID NO: 1318899 - RNA, 19 nt, Human
caaagcagcucuguuuggc

SEQ ID NO: 1318900 - RNA, 20 nt, Human
caacuggagcaagcaggugg

SEQ ID NO: 1318901 - RNA, 21 nt, Human
caaucccaggcuccuucccaa

SEQ ID NO: 1318902 - RNA, 22 nt, Human
cacccugccagguucuccuccu

SEQ ID NO: 1318903 - RNA, 25 nt, Human
cacccuugggcugacuuagaugggg

SEQ ID NO: 1318904 - RNA, 21 nt, Human
cacggaaacacaucuuaccac

SEQ ID NO: 1318905 - RNA, 24 nt, Human
cagcacugacaugcacggaaacac

SEQ ID NO: 1318906 - RNA, 21 nt, Human
cagcaggcacccacccugcca

SEQ ID NO: 1318907 - RNA, 23 nt, Human
cauauggcucaggaagcagcacc

SEQ ID NO: 1318908 - RNA, 26 nt, Human
caucuuuacagcuggagagcugagag

SEQ ID NO: 1318909 - RNA, 23 nt, Human
ccaacuccagaaacaacuggagc

SEQ ID NO: 1318910 - RNA, 19 nt, Human
ccaccccuggaauuccccu

SEQ ID NO: 1318911 - RNA, 22 nt, Human
ccagaaacaacuggagcaagca

SEQ ID NO: 1318912 - RNA, 19 nt, Human
ccagcugugucccaccccu

SEQ ID NO: 1318913 - RNA, 18 nt, Human
cccugccagguucuccuc

SEQ ID NO: 1318914 - RNA, 23 nt, Human
cccugcccuggucuggacucccc

SEQ ID NO: 1318915 - RNA, 21 nt, Human
ccuucccaacuacagcaggcu

SEQ ID NO: 1318916 - RNA, 23 nt, Human
cgcuuagaauccaauagccacuc

SEQ ID NO: 1318917 - RNA, 19 nt, Human
cuaauccacacccuugggc

SEQ ID NO: 1318918 - RNA, 19 nt, Human
cuacagcaggcucuaacug

SEQ ID NO: 1318919 - RNA, 23 nt, Human
cucauaauggaaagagccaaaaa

SEQ ID NO: 1318920 - RNA, 22 nt, Human
cugccuccaacuccagaaacaa

SEQ ID NO: 1318921 - RNA, 24 nt, Human
cugccuccaacuccagaaacaacu

SEQ ID NO: 1318922 - RNA, 19 nt, Human
cugggagagacagagggaa

SEQ ID NO: 1318923 - RNA, 24 nt, Human
cuggucuggacucccccagcugug

SEQ ID NO: 1318924 - RNA, 20 nt, Human
gaaaggcccugauauaagga

SEQ ID NO: 1318925 - RNA, 21 nt, Human
gagggcugaagaacagcugag

SEQ ID NO: 1318926 - RNA, 23 nt, Human
gcaaccaauagcugccuccaacu

SEQ ID NO: 1318927 - RNA, 21 nt, Human
gccaccgcgcucccuagucuc

SEQ ID NO: 1318928 - RNA, 22 nt, Human
gcucauaauggaaagagccaaa

SEQ ID NO: 1318929 - RNA, 19 nt, Human
ggagcaagcaggugguggu

SEQ ID NO: 1318930 - RNA, 21 nt, Human
ggaggagguuguuucacugag

SEQ ID NO: 1318931 - RNA, 21 nt, Human
ggugguggugaucagcacagg

SEQ ID NO: 1318932 - RNA, 20 nt, Human
gucuggacucccccagcugu

SEQ ID NO: 1318933 - RNA, 19 nt, Human
uaaagaaaagugcuguuuu

SEQ ID NO: 1318934 - RNA, 25 nt, Human
uacagcaggcucuaacuggugcagg

SEQ ID NO: 1318935 - RNA, 21 nt, Human
uagcaaacaggcuaaaaccuc

SEQ ID NO: 1318936 - RNA, 23 nt, Human
uagcagcacugacaugcacggaa

SEQ ID NO: 1318937 - RNA, 25 nt, Human
uagccacuccuaacaagggccuagg

SEQ ID NO: 1318938 - RNA, 21 nt, Human
uauaaggagucaugcugacuc

SEQ ID NO: 1318939 - RNA, 27 nt, Human
ucacugaggguugguggggcgguuccg

SEQ ID NO: 1318940 - RNA, 24 nt, Human
uccacacccuugggcugacuuaga

SEQ ID NO: 1318941 - RNA, 25 nt, Human
uccccaaagcagcucuguuuggcuu

SEQ ID NO: 1318942 - RNA, 20 nt, Human
uccgaauguuaucagcagca

SEQ ID NO: 1318943 - RNA, 22 nt, Human
uccuucccaacuacagcaggcu

SEQ ID NO: 1318944 - RNA, 18 nt, Human
ugccagguucuccuccug

SEQ ID NO: 1318945 - RNA, 22 nt, Human
ugcccuggucuggacuccccca

SEQ ID NO: 1318946 - RNA, 25 nt, Human
ugccuccaacuccagaaacaacugg

SEQ ID NO: 1318947 - RNA, 22 nt, Human
ugcggagaggucaagacagcug

SEQ ID NO: 1318948 - RNA, 24 nt, Human
uggaaagagccaaaaauuuuggug

SEQ ID NO: 1318949 - RNA, 20 nt, Human
uggcuugugagucuccuuuc

SEQ ID NO: 1318950 - RNA, 21 nt, Human
uggugaggagcugcccaccag

SEQ ID NO: 1318951 - RNA, 21 nt, Human
ugguggugaucagcacaggug

SEQ ID NO: 1318952 - RNA, 23 nt, Human
uugugagucuccuuucccugccc

SEQ ID NO: 1318953 - RNA, 21 nt, Human
uuuaaaauauccucccucaug

SEQ ID NO: 1318954 - RNA, 20 nt, Human
aaacagggaaaccgacgugg

SEQ ID NO: 1318955 - RNA, 23 nt, Human
aaacgagcacauaggagggcguu

SEQ ID NO: 1318956 - RNA, 20 nt, Human
aaagucugggauugggugug

SEQ ID NO: 1318957 - RNA, 21 nt, Human
aaagucugggauugggugugu

SEQ ID NO: 1318958 - RNA, 24 nt, Human
aaagugcugggauuacaggcguga

SEQ ID NO: 1318959 - RNA, 19 nt, Human
aacagcuggagcccugagc

SEQ ID NO: 1318960 - RNA, 23 nt, Human
aacccgccucugcagcguuccug

SEQ ID NO: 1318961 - RNA, 22 nt, Human
aagagccccuugcccccacuga

SEQ ID NO: 1318962 - RNA, 19 nt, Human
aagcaggcccuacacagug

SEQ ID NO: 1318963 - RNA, 24 nt, Human
aagugaucuacccgcuucagccuc

SEQ ID NO: 1318964 - RNA, 19 nt, Human
aagugcugggauuacaggc

SEQ ID NO: 1318965 - RNA, 19 nt, Human
aagugcugggauuacaggc

SEQ ID NO: 1318966 - RNA, 26 nt, Human
aagugcugggauuacaggcgugagcc

SEQ ID NO: 1318967 - RNA, 18 nt, Human
acaggguuucaccauguu

SEQ ID NO: 1318968 - RNA, 23 nt, Human
acaggguuucaccauguuggcca

SEQ ID NO: 1318969 - RNA, 24 nt, Human
acaggguuucaccauguuggccag

SEQ ID NO: 1318970 - RNA, 18 nt, Human
accauguuggccaggcug

SEQ ID NO: 1318971 - RNA, 21 nt, Human
agacaacagcuggagcccuga

SEQ ID NO: 1318972 - RNA, 22 nt, Human
agagggaacuucaaggaagugu

SEQ ID NO: 1318973 - RNA, 29 nt, Human
agcaaggugcauggggacagugguauguu

SEQ ID NO: 1318974 - RNA, 21 nt, Human
agcagcuguacccccaaaaag

SEQ ID NO: 1318975 - RNA, 18 nt, Human
agcgagacacuaagagac

SEQ ID NO: 1318976 - RNA, 18 nt, Human
aggcagcaggccaggccu

SEQ ID NO: 1318977 - RNA, 20 nt, Human
aucaaacagggaaaccgacg

SEQ ID NO: 1318978 - RNA, 24 nt, Human
auuucuguauuuuugguagagaca

SEQ ID NO: 1318979 - RNA, 24 nt, Human
caaagugcugggauuacaggcgug

SEQ ID NO: 1318980 - RNA, 20 nt, Human
caagaugaugcccaggcaga

SEQ ID NO: 1318981 - RNA, 22 nt, Human
caagcaggucauaaagagcaag

SEQ ID NO: 1318982 - RNA, 21 nt, Human
caccauguuggccaggcuggu

SEQ ID NO: 1318983 - RNA, 22 nt, Human
caccauguuggccaggcugguc

SEQ ID NO: 1318984 - RNA, 27 nt, Human
caccauguuggccaggcuggucugaaa

SEQ ID NO: 1318985 - RNA, 19 nt, Human
cagagggaacuucaaggaa

SEQ ID NO: 1318986 - RNA, 20 nt, Human
cagcuccuucacagcagcgg

SEQ ID NO: 1318987 - RNA, 21 nt, Human
caggcagcagagacgcaccuu

SEQ ID NO: 1318988 - RNA, 21 nt, Human
caggccaccuccagagccaaa

SEQ ID NO: 1318989 - RNA, 24 nt, Human
caggguuucaccauguuggccagg

SEQ ID NO: 1318990 - RNA, 18 nt, Human
caggucauaaagagcaag

SEQ ID NO: 1318991 - RNA, 26 nt, Human
cauaaagagcaagaugaugcccaggc

SEQ ID NO: 1318992 - RNA, 22 nt, Human
caucuucaucaucaaacaggga

SEQ ID NO: 1318993 - RNA, 27 nt, Human
cauucugaaauucccaaagauuugagg

SEQ ID NO: 1318994 - RNA, 20 nt, Human
ccaaagugcugggauuacag

SEQ ID NO: 1318995 - RNA, 22 nt, Human
ccaaagugcugggauuacaggc

SEQ ID NO: 1318996 - RNA, 22 nt, Human
ccaaagugcugggauuacaggc

SEQ ID NO: 1318997 - RNA, 24 nt, Human
ccaaagugcugggauuacaggcgu

SEQ ID NO: 1318998 - RNA, 22 nt, Human
ccaccacaccguggaacuccag

SEQ ID NO: 1318999 - RNA, 22 nt, Human
ccagcuuccuccgccccaaccu

SEQ ID NO: 1319000 - RNA, 28 nt, Human
cccacagcgccuacgucgaaggcuccca

SEQ ID NO: 1319001 - RNA, 22 nt, Human
ccccaaaaagauuauccucuuc

SEQ ID NO: 1319002 - RNA, 23 nt, Human
ccccaaaaagauuauccucuuca

SEQ ID NO: 1319003 - RNA, 26 nt, Human
cccccacugaacaggccaccuccaga

SEQ ID NO: 1319004 - RNA, 23 nt, Human
ccccgcccaacccgccucugcag

SEQ ID NO: 1319005 - RNA, 21 nt, Human
cccuaggccaagcaccguggc

SEQ ID NO: 1319006 - RNA, 24 nt, Human
ccgcuucagccucccaaagugcug

SEQ ID NO: 1319007 - RNA, 21 nt, Human
ccuccgccccaaccuagggua

SEQ ID NO: 1319008 - RNA, 23 nt, Human
ccucgucaucuucugugaaucua

SEQ ID NO: 1319009 - RNA, 22 nt, Human
ccucuagaauuuuagaaacgag

SEQ ID NO: 1319010 - RNA, 20 nt, Human
ccugaccucaagugaucuac

SEQ ID NO: 1319011 - RNA, 22 nt, Human
ccugaccucaagugaucuaccc

SEQ ID NO: 1319012 - RNA, 20 nt, Human
cgccccccgcccaacccgcc

SEQ ID NO: 1319013 - RNA, 24 nt, Human
cgcuucagccucccaaagugcugg

SEQ ID NO: 1319014 - RNA, 20 nt, Human
cguggaacuccagaccaccc

SEQ ID NO: 1319015 - RNA, 22 nt, Human
cuggcgucagccccuauccucc

SEQ ID NO: 1319016 - RNA, 22 nt, Human
cuucacagcagcggauuuugcu

SEQ ID NO: 1319017 - RNA, 23 nt, Human
cuucuuagcagcuguacccccaa

SEQ ID NO: 1319018 - RNA, 20 nt, Human
cuugagguccccucucucca

SEQ ID NO: 1319019 - RNA, 24 nt, Human
gaccucaagugaucuacccgcuuc

SEQ ID NO: 1319020 - RNA, 22 nt, Human
gagaagaggcagcaggccaggc

SEQ ID NO: 1319021 - RNA, 18 nt, Human
gagacaaugucugcuucu

SEQ ID NO: 1319022 - RNA, 26 nt, Human
gauaacugaggugacuacaaaagaaa

SEQ ID NO: 1319023 - RNA, 18 nt, Human
gauuacaggcgugagcca

SEQ ID NO: 1319024 - RNA, 19 nt, Human
gauuacaggcgugagccac

SEQ ID NO: 1319025 - RNA, 22 nt, Human
gauuacaggcgugagccacugc

SEQ ID NO: 1319026 - RNA, 20 nt, Human
gcccaacccgccucugcagc

SEQ ID NO: 1319027 - RNA, 18 nt, Human
gcccugagcugggagagu

SEQ ID NO: 1319028 - RNA, 21 nt, Human
gcccugagcugggagagugga

SEQ ID NO: 1319029 - RNA, 21 nt, Human
gcucacccuaggccaagcacc

SEQ ID NO: 1319030 - RNA, 23 nt, Human
gcuggucugaaacuccugaccuc

SEQ ID NO: 1319031 - RNA, 22 nt, Human
gcuuucucuugucuuugagcuu

SEQ ID NO: 1319032 - RNA, 21 nt, Human
ggaaagcucagaaaaguuaaa

SEQ ID NO: 1319033 - RNA, 19 nt, Human
ggagacccuuccgcuagcc

SEQ ID NO: 1319034 - RNA, 22 nt, Human
ggcacacaugacuggaaagaaa

SEQ ID NO: 1319035 - RNA, 19 nt, Human
ggccaagcaccguggcacc

SEQ ID NO: 1319036 - RNA, 24 nt, Human
ggcuggucugaaacuccugaccuc

SEQ ID NO: 1319037 - RNA, 22 nt, Human
ggguuucaccauguuggccagg

SEQ ID NO: 1319038 - RNA, 21 nt, Human
gguagagacaggguuucacca

SEQ ID NO: 1319039 - RNA, 21 nt, Human
guagagacaggguuucaccau

SEQ ID NO: 1319040 - RNA, 22 nt, Human
guagagacaggguuucaccaug

SEQ ID NO: 1319041 - RNA, 19 nt, Human
gucggucagcuuggggggu

SEQ ID NO: 1319042 - RNA, 24 nt, Human
gugaucuacccgcuucagccuccc

SEQ ID NO: 1319043 - RNA, 20 nt, Human
guggaacuccagaccacccc

SEQ ID NO: 1319044 - RNA, 20 nt, Human
guucuagguugaaggcucac

SEQ ID NO: 1319045 - RNA, 20 nt, Human
uaagcaggcccuacacagug

SEQ ID NO: 1319046 - RNA, 24 nt, Human
uaauuucuguauuuuugguagaga

SEQ ID NO: 1319047 - RNA, 19 nt, Human
uacaauaucauaacuuuaa

SEQ ID NO: 1319048 - RNA, 21 nt, Human
uacaggcgugagccacugcgc

SEQ ID NO: 1319049 - RNA, 22 nt, Human
uacaggcgugagccacugcgcu

SEQ ID NO: 1319050 - RNA, 23 nt, Human
uagaauuuuagaaacgagcacau

SEQ ID NO: 1319051 - RNA, 22 nt, Human
uagagacaggguuucaccaugu

SEQ ID NO: 1319052 - RNA, 27 nt, Human
uagcucgggccgaaccccgccagcgag

SEQ ID NO: 1319053 - RNA, 21 nt, Human
uaggccaagcaccguggcacc

SEQ ID NO: 1319054 - RNA, 19 nt, Human
uauccucuucaucuucauc

SEQ ID NO: 1319055 - RNA, 24 nt, Human
uauguagcuucguuuuacugagga

SEQ ID NO: 1319056 - RNA, 20 nt, Human
ucacugcugaacaacagggc

SEQ ID NO: 1319057 - RNA, 20 nt, Human
ucacuuaagcuguacuuggg

SEQ ID NO: 1319058 - RNA, 21 nt, Human
uccagagccaaauggcgagaa

SEQ ID NO: 1319059 - RNA, 23 nt, Human
uccagagccaaauggcgagaagu

SEQ ID NO: 1319060 - RNA, 24 nt, Human
ucccaaagugcugggauuacaggc

SEQ ID NO: 1319061 - RNA, 23 nt, Human
uccccucucuccagacccgccga

SEQ ID NO: 1319062 - RNA, 24 nt, Human
ucccgcgccgcugccucgggccuu

SEQ ID NO: 1319063 - RNA, 20 nt, Human
uccgccuaccagcuccuuca

SEQ ID NO: 1319064 - RNA, 19 nt, Human
uccuccagcuuccuccgcc

SEQ ID NO: 1319065 - RNA, 18 nt, Human
ucgaaggcucccaggcug

SEQ ID NO: 1319066 - RNA, 21 nt, Human
ucgggccuugggcggcagcgc

SEQ ID NO: 1319067 - RNA, 21 nt, Human
ucuacccgcuucagccuccca

SEQ ID NO: 1319068 - RNA, 18 nt, Human
ugaacaggccaccuccag

SEQ ID NO: 1319069 - RNA, 20 nt, Human
ugaccucaagugaucuaccc

SEQ ID NO: 1319070 - RNA, 22 nt, Human
ugaccucaagugaucuacccgc

SEQ ID NO: 1319071 - RNA, 24 nt, Human
ugaccucaagugaucuacccgcuu

SEQ ID NO: 1319072 - RNA, 24 nt, Human
ugaggugauaacugaggucggaac

SEQ ID NO: 1319073 - RNA, 19 nt, Human
ugaugcccaggcagaucag

SEQ ID NO: 1319074 - RNA, 20 nt, Human
ugcugaacaacagggcagau

SEQ ID NO: 1319075 - RNA, 24 nt, Human
ugcugggauuacaggcgugagcca

SEQ ID NO: 1319076 - RNA, 19 nt, Human
uggaacuccagaccacccc

SEQ ID NO: 1319077 - RNA, 23 nt, Human
uggagcccugagcugggagagug

SEQ ID NO: 1319078 - RNA, 19 nt, Human
uggcagccaagcaggucau

SEQ ID NO: 1319079 - RNA, 24 nt, Human
uggccaggcuggucugaaacuccu

SEQ ID NO: 1319080 - RNA, 18 nt, Human
ugggauuacaggcgugag

SEQ ID NO: 1319081 - RNA, 19 nt, Human
ugggauuacaggcgugagc

SEQ ID NO: 1319082 - RNA, 21 nt, Human
ugggauuacaggcgugagcca

SEQ ID NO: 1319083 - RNA, 22 nt, Human
ugggauuacaggcgugagccac

SEQ ID NO: 1319084 - RNA, 22 nt, Human
ugggauuacaggcgugagccac

SEQ ID NO: 1319085 - RNA, 24 nt, Human
ugggauuacaggcgugagccacug

SEQ ID NO: 1319086 - RNA, 24 nt, Human
ugggauuacaggcgugagccacug

SEQ ID NO: 1319087 - RNA, 24 nt, Human
ugguagagacaggguuucaccaug

SEQ ID NO: 1319088 - RNA, 22 nt, Human
uguuauguacaaucuaucacaa

SEQ ID NO: 1319089 - RNA, 20 nt, Human
uuagaaacgagcacauagga

SEQ ID NO: 1319090 - RNA, 23 nt, Human
uucugugaaucuacuagcaaaca

SEQ ID NO: 1319091 - RNA, 23 nt, Human
uugagguccccucucuccagacc

SEQ ID NO: 1319092 - RNA, 23 nt, Human
uugcugcaagagaagaggcagca

SEQ ID NO: 1319093 - RNA, 24 nt, Human
uuggaggcuuuugcuuucucuugu

SEQ ID NO: 1319094 - RNA, 24 nt, Human
uugguagagacaggguuucaccau

SEQ ID NO: 1319095 - RNA, 24 nt, Human
uuucaccauguuggccaggcuggu

SEQ ID NO: 1319096 - RNA, 20 nt, Human
uuucuguauuuuugguagag

SEQ ID NO: 1319097 - RNA, 22 nt, Human
uuuuugguagagacaggguuuc

SEQ ID NO: 1319098 - RNA, 24 nt, Human
uuuuugguagagacaggguuucac

SEQ ID NO: 1319099 - RNA, 19 nt, Human
ccgcgagcucugcgggggc

SEQ ID NO: 1319100 - RNA, 20 nt, Human
cgcgagcucugcgggggccg

SEQ ID NO: 1319101 - RNA, 20 nt, Human
gccucugucuagaacccugg

SEQ ID NO: 1319102 - RNA, 19 nt, Human
gggccgacacggggcggcg

SEQ ID NO: 1319103 - RNA, 19 nt, Human
ugcgggggccgacacgggg

SEQ ID NO: 1319104 - RNA, 24 nt, Human
uggccaagacuggccucugucuag

SEQ ID NO: 1319105 - RNA, 26 nt, Human
aaaagcaaagcaaaaagguuacagaa

SEQ ID NO: 1319106 - RNA, 19 nt, Human
aaacagguauauauuuucu

SEQ ID NO: 1319107 - RNA, 19 nt, Human
aaagcaaaaagguuacaga

SEQ ID NO: 1319108 - RNA, 20 nt, Human
aaguuaugaucccuucagaa

SEQ ID NO: 1319109 - RNA, 21 nt, Human
acacacacacacucacacaca

SEQ ID NO: 1319110 - RNA, 18 nt, Human
acacacucacacacacuc

SEQ ID NO: 1319111 - RNA, 20 nt, Human
agaaaaagaauugauuucac

SEQ ID NO: 1319112 - RNA, 19 nt, Human
agaaggaggaggaggagga

SEQ ID NO: 1319113 - RNA, 20 nt, Human
agaaggaggaggaggaggac

SEQ ID NO: 1319114 - RNA, 18 nt, Human
agaggagaaggaggagga

SEQ ID NO: 1319115 - RNA, 21 nt, Human
agcaaagcaaaaagguuacag

SEQ ID NO: 1319116 - RNA, 19 nt, Human
agcuccuuugcuuucugcu

SEQ ID NO: 1319117 - RNA, 19 nt, Human
aggacucaagaccaaaagc

SEQ ID NO: 1319118 - RNA, 22 nt, Human
aggaggaagaagaggagaagga

SEQ ID NO: 1319119 - RNA, 23 nt, Human
aggaggaggaggaccuggcucca

SEQ ID NO: 1319120 - RNA, 21 nt, Human
agguauauauuuucuugccaa

SEQ ID NO: 1319121 - RNA, 22 nt, Human
augaaacagguauauauuuucu

SEQ ID NO: 1319122 - RNA, 23 nt, Human
augaaacagguauauauuuucuu

SEQ ID NO: 1319123 - RNA, 24 nt, Human
auucuuuuuuguauaauuuucccu

SEQ ID NO: 1319124 - RNA, 22 nt, Human
caaagcaaaaagguuacagaaa

SEQ ID NO: 1319125 - RNA, 28 nt, Human
cacacacacacucacacacacucaugca

SEQ ID NO: 1319126 - RNA, 20 nt, Human
cacacacacucacacacacu

SEQ ID NO: 1319127 - RNA, 21 nt, Human
cacacacacucaugcacacuc

SEQ ID NO: 1319128 - RNA, 18 nt, Human
cacccuuuucuagcuccu

SEQ ID NO: 1319129 - RNA, 21 nt, Human
cacuccuuucucuuccuuugc

SEQ ID NO: 1319130 - RNA, 19 nt, Human
ccacuccuuucucuuccuu

SEQ ID NO: 1319131 - RNA, 24 nt, Human
cccauggccucuccugaaucuucu

SEQ ID NO: 1319132 - RNA, 19 nt, Human
ccccauggccucuccugaa

SEQ ID NO: 1319133 - RNA, 19 nt, Human
ccuccccauggccucuccu

SEQ ID NO: 1319134 - RNA, 23 nt, Human
cucaagaccaaaagccuuaagaa

SEQ ID NO: 1319135 - RNA, 21 nt, Human
cucaugcacacucuccacucc

SEQ ID NO: 1319136 - RNA, 21 nt, Human
cuccagcugcccacacucucc

SEQ ID NO: 1319137 - RNA, 21 nt, Human
cugcaauaggcagguggagga

SEQ ID NO: 1319138 - RNA, 23 nt, Human
cuuaagaacuuaauaaaagcaaa

SEQ ID NO: 1319139 - RNA, 19 nt, Human
cuuucugcugcucugcaau

SEQ ID NO: 1319140 - RNA, 23 nt, Human
gaaggaggaggaggaggaccugg

SEQ ID NO: 1319141 - RNA, 21 nt, Human
gacaguccuucuuuccaguuu

SEQ ID NO: 1319142 - RNA, 18 nt, Human
gaggaagaagaggagaag

SEQ ID NO: 1319143 - RNA, 18 nt, Human
gaggaagaagaggagaag

SEQ ID NO: 1319144 - RNA, 22 nt, Human
gaggaggaggaccuggcuccag

SEQ ID NO: 1319145 - RNA, 20 nt, Human
gaggaggaggaggaccuggc

SEQ ID NO: 1319146 - RNA, 22 nt, Human
gaggaggaggaggaccuggcuc

SEQ ID NO: 1319147 - RNA, 22 nt, Human
gcaaagcaaaaagguuacagaa

SEQ ID NO: 1319148 - RNA, 21 nt, Human
ggagaaggaggaggaggagga

SEQ ID NO: 1319149 - RNA, 20 nt, Human
ggaggaggaggaggaccugg

SEQ ID NO: 1319150 - RNA, 23 nt, Human
ggaggaggaggaggaccuggcuc

SEQ ID NO: 1319151 - RNA, 18 nt, Human
gguuacagaaaaagaauu

SEQ ID NO: 1319152 - RNA, 19 nt, Human
uaaccagugaagaugaaac

SEQ ID NO: 1319153 - RNA, 21 nt, Human
uacagaaaaagaauugauuuc

SEQ ID NO: 1319154 - RNA, 19 nt, Human
uagcaugauaaauuuuuau

SEQ ID NO: 1319155 - RNA, 24 nt, Human
uaggcagguggaggaggaaaggaa

SEQ ID NO: 1319156 - RNA, 21 nt, Human
ucaugcacacucuccacuccu

SEQ ID NO: 1319157 - RNA, 18 nt, Human
uccuuugcuuucugcugc

SEQ ID NO: 1319158 - RNA, 24 nt, Human
ucuaggacucaagaccaaaagccu

SEQ ID NO: 1319159 - RNA, 18 nt, Human
ugcaucuuaucuaggacu

SEQ ID NO: 1319160 - RNA, 18 nt, Human
uggaggaggaaaggaaga

SEQ ID NO: 1319161 - RNA, 19 nt, Human
uuugccuccccauggccuc

SEQ ID NO: 1319162 - RNA, 21 nt, Human
aaacgaacaggacacaucccc

SEQ ID NO: 1319163 - RNA, 21 nt, Human
accacucaaacgaacaggaca

SEQ ID NO: 1319164 - RNA, 23 nt, Human
agcucgaugucguugugcccggc

SEQ ID NO: 1319165 - RNA, 19 nt, Human
aggcggcgucgaugucggc

SEQ ID NO: 1319166 - RNA, 21 nt, Human
agguuccuggugcgcagggcc

SEQ ID NO: 1319167 - RNA, 18 nt, Human
auccccaguggaggcccu

SEQ ID NO: 1319168 - RNA, 22 nt, Human
augcagccccuggggggccggc

SEQ ID NO: 1319169 - RNA, 21 nt, Human
caaacgaacaggacacauccc

SEQ ID NO: 1319170 - RNA, 21 nt, Human
cacaugcagccccuggggggc

SEQ ID NO: 1319171 - RNA, 20 nt, Human
caccgccuuggggcagcgcu

SEQ ID NO: 1319172 - RNA, 21 nt, Human
cagcucugggccuagguuccu

SEQ ID NO: 1319173 - RNA, 18 nt, Human
ccacaugcagccccuggg

SEQ ID NO: 1319174 - RNA, 26 nt, Human
ccacucaaacgaacaggacacauccc

SEQ ID NO: 1319175 - RNA, 18 nt, Human
ccaguggaggcccugggc

SEQ ID NO: 1319176 - RNA, 23 nt, Human
cccccagcugccaccuggauguc

SEQ ID NO: 1319177 - RNA, 23 nt, Human
cccccgggccgcccggggggucc

SEQ ID NO: 1319178 - RNA, 19 nt, Human
ccccuggggggccggcgcg

SEQ ID NO: 1319179 - RNA, 21 nt, Human
cccgggccgcccggggggucc

SEQ ID NO: 1319180 - RNA, 21 nt, Human
cccugggcacgcucuggccuc

SEQ ID NO: 1319181 - RNA, 19 nt, Human
cccugggucggggcggggu

SEQ ID NO: 1319182 - RNA, 19 nt, Human
ccgcuaggcgcgcuggcug

SEQ ID NO: 1319183 - RNA, 26 nt, Human
ccggcgcccuccacccacagcggcuc

SEQ ID NO: 1319184 - RNA, 19 nt, Human
ccuccgugccguggaugau

SEQ ID NO: 1319185 - RNA, 25 nt, Human
ccugcuacaggcaggagcccccagc

SEQ ID NO: 1319186 - RNA, 19 nt, Human
cgacgcaggcgcuccaggu

SEQ ID NO: 1319187 - RNA, 25 nt, Human
cgcucuggccucccccucacagcuc

SEQ ID NO: 1319188 - RNA, 24 nt, Human
cggggcggggucccccgggccgcc

SEQ ID NO: 1319189 - RNA, 18 nt, Human
cgggggccgccuuauugc

SEQ ID NO: 1319190 - RNA, 23 nt, Human
cgggggccgccuuauugcugagg

SEQ ID NO: 1319191 - RNA, 23 nt, Human
cggggugagguccgggggccgcc

SEQ ID NO: 1319192 - RNA, 18 nt, Human
cucucggaaggccugccc

SEQ ID NO: 1319193 - RNA, 22 nt, Human
cugagguccggccgguuggggc

SEQ ID NO: 1319194 - RNA, 24 nt, Human
cugccaccuggaugucaccacuca

SEQ ID NO: 1319195 - RNA, 18 nt, Human
gagguccggccgguuggg

SEQ ID NO: 1319196 - RNA, 23 nt, Human
gcugagguccggccgguuggggc

SEQ ID NO: 1319197 - RNA, 20 nt, Human
gcuggcugggcagcuccugg

SEQ ID NO: 1319198 - RNA, 19 nt, Human
ggucggggcgggguccccc

SEQ ID NO: 1319199 - RNA, 23 nt, Human
gucguugugcccggcgcccucca

SEQ ID NO: 1319200 - RNA, 18 nt, Human
gugcgagaagucgaucac

SEQ ID NO: 1319201 - RNA, 23 nt, Human
uagagguuccucucggaaggccu

SEQ ID NO: 1319202 - RNA, 22 nt, Human
ucaccucguccuccgugccgug

SEQ ID NO: 1319203 - RNA, 23 nt, Human
ucaccugcuacaggcaggagcug

SEQ ID NO: 1319204 - RNA, 24 nt, Human
uccccaguggaggcccugggcacg

SEQ ID NO: 1319205 - RNA, 18 nt, Human
ucccccgggccgcccggg

SEQ ID NO: 1319206 - RNA, 19 nt, Human
ucggcauagagguuccucu

SEQ ID NO: 1319207 - RNA, 18 nt, Human
ugagguccgggggccgcc

SEQ ID NO: 1319208 - RNA, 23 nt, Human
uggaugaugagcacgggcgacgu

SEQ ID NO: 1319209 - RNA, 20 nt, Human
uggggcagcgcucguagagc

SEQ ID NO: 1319210 - RNA, 22 nt, Human
uggggggccggcgcggggugag

SEQ ID NO: 1319211 - RNA, 20 nt, Human
uucacguauuuucuucuugc

SEQ ID NO: 1319212 - RNA, 23 nt, Human
uuccucucggaaggccugcccga

SEQ ID NO: 1319213 - RNA, 18 nt, Human
uugugcccggcgcccucc

SEQ ID NO: 1319214 - RNA, 24 nt, Human
aacaaguccauuuucauuguuagu

SEQ ID NO: 1319215 - RNA, 24 nt, Human
acaccaagaauuaccaaggcagca

SEQ ID NO: 1319216 - RNA, 25 nt, Human
acagcaccagaggcugcauuccuac

SEQ ID NO: 1319217 - RNA, 22 nt, Human
agaaagaaaagccacaugaaga

SEQ ID NO: 1319218 - RNA, 20 nt, Human
agcagcgcacagccaggccu

SEQ ID NO: 1319219 - RNA, 21 nt, Human
cacaaugcgccuuuccagaac

SEQ ID NO: 1319220 - RNA, 19 nt, Human
cacagcagcgcacagccag

SEQ ID NO: 1319221 - RNA, 20 nt, Human
caccaccuuguaaccuugua

SEQ ID NO: 1319222 - RNA, 19 nt, Human
caccagaggcugcauuccu

SEQ ID NO: 1319223 - RNA, 22 nt, Human
cacugcuucagcccugcucaga

SEQ ID NO: 1319224 - RNA, 19 nt, Human
cagaacacagcagcgcaca

SEQ ID NO: 1319225 - RNA, 25 nt, Human
cagcaccagaggcugcauuccuacu

SEQ ID NO: 1319226 - RNA, 24 nt, Human
cagcagcgcacagccaggccuggg

SEQ ID NO: 1319227 - RNA, 23 nt, Human
cagcgcacagccaggccuggggc

SEQ ID NO: 1319228 - RNA, 27 nt, Human
cauuucugugcuucuggaagccaaaaa

SEQ ID NO: 1319229 - RNA, 21 nt, Human
ccagaacacagcagcgcacag

SEQ ID NO: 1319230 - RNA, 24 nt, Human
cugcacucuggcuuugccuuugag

SEQ ID NO: 1319231 - RNA, 20 nt, Human
cugcuucagcccugcucaga

SEQ ID NO: 1319232 - RNA, 22 nt, Human
gccuggggcagagggaucacuc

SEQ ID NO: 1319233 - RNA, 23 nt, Human
uaugcagagagaaaggccacacc

SEQ ID NO: 1319234 - RNA, 19 nt, Human
ucagaaugucuccaccacc

SEQ ID NO: 1319235 - RNA, 20 nt, Human
uccaagcugcacucuggcuu

SEQ ID NO: 1319236 - RNA, 21 nt, Human
ugagaugcuaugcagagagaa

SEQ ID NO: 1319237 - RNA, 26 nt, Human
ugcuccaagcugcacucuggcuuugc

SEQ ID NO: 1319238 - RNA, 19 nt, Human
uggagaaagaaaagccaca

SEQ ID NO: 1319239 - RNA, 20 nt, Human
uggggcagagggaucacuca

SEQ ID NO: 1319240 - RNA, 20 nt, Human
uucagcaucuuauugggcuc

SEQ ID NO: 1319241 - RNA, 25 nt, Human
uucuuugcuccaagcugcacucugg

SEQ ID NO: 1319242 - RNA, 18 nt, Human
uugcuccaagcugcacuc

SEQ ID NO: 1319243 - RNA, 18 nt, Human
uuguuaguuucuccuuca

SEQ ID NO: 1319244 - RNA, 18 nt, Human
aaaggaccugcugugaag

SEQ ID NO: 1319245 - RNA, 18 nt, Human
accucugccugaacuccc

SEQ ID NO: 1319246 - RNA, 21 nt, Human
aggugccggggauugcagagu

SEQ ID NO: 1319247 - RNA, 25 nt, Human
ccugcugugaaggguccugcugcuc

SEQ ID NO: 1319248 - RNA, 23 nt, Human
cucucucccugagagagcccuau

SEQ ID NO: 1319249 - RNA, 20 nt, Human
cucugccugaacuccccacu

SEQ ID NO: 1319250 - RNA, 18 nt, Human
gacaaggcauaccucccu

SEQ ID NO: 1319251 - RNA, 24 nt, Human
ugaacuccccacugcuggcagccu

SEQ ID NO: 1319252 - RNA, 19 nt, Human
ugccugaacuccccacugc

SEQ ID NO: 1319253 - RNA, 22 nt, Human
ugccugaacuccccacugcugg

SEQ ID NO: 1319254 - RNA, 21 nt, Human
ugugaaggguccugcugcucu

SEQ ID NO: 1319255 - RNA, 26 nt, Human
acacaggcccaggagagggggaacgc

SEQ ID NO: 1319256 - RNA, 19 nt, Human
agcccggugggcaggaugc

SEQ ID NO: 1319257 - RNA, 22 nt, Human
aggcccaggagagguggcagca

SEQ ID NO: 1319258 - RNA, 23 nt, Human
ccaggagagguggcagcaggggu

SEQ ID NO: 1319259 - RNA, 19 nt, Human
gcuggucucugcagaguga

SEQ ID NO: 1319260 - RNA, 19 nt, Human
uagccccuacgugugaccc

SEQ ID NO: 1319261 - RNA, 18 nt, Human
uauugcuccucuuggcuc

SEQ ID NO: 1319262 - RNA, 18 nt, Human
uccagaaaggacacaggc

SEQ ID NO: 1319263 - RNA, 22 nt, Human
ucuccaaguggagcccgguggg

SEQ ID NO: 1319264 - RNA, 25 nt, Human
ucuggagcacaccuucuuaauuucc

SEQ ID NO: 1319265 - RNA, 20 nt, Human
ugacccacaggccucccacg

SEQ ID NO: 1319266 - RNA, 23 nt, Human
uggcagcaggggucccacacugg

SEQ ID NO: 1319267 - RNA, 19 nt, Human
aacacagggguaggaaucu

SEQ ID NO: 1319268 - RNA, 24 nt, Human
aacacuuugggaggccgagguggg

SEQ ID NO: 1319269 - RNA, 19 nt, Human
aacauggugaaaccccguc

SEQ ID NO: 1319270 - RNA, 20 nt, Human
aacauggugaaaccccgucu

SEQ ID NO: 1319271 - RNA, 21 nt, Human
aacauggugaaaccccgucuc

SEQ ID NO: 1319272 - RNA, 21 nt, Human
aaccagaaaagaaucucuuua

SEQ ID NO: 1319273 - RNA, 24 nt, Human
aaccugcucuuuccuuaaauucug

SEQ ID NO: 1319274 - RNA, 18 nt, Human
aagcaacuucuuauggca

SEQ ID NO: 1319275 - RNA, 24 nt, Human
aagcugaggcaggagaauugcuug

SEQ ID NO: 1319276 - RNA, 18 nt, Human
aauuagccaggcauggug

SEQ ID NO: 1319277 - RNA, 23 nt, Human
aauugcuugacccgggaggugga

SEQ ID NO: 1319278 - RNA, 25 nt, Human
acagagcaagacucccaucucaaaa

SEQ ID NO: 1319279 - RNA, 21 nt, Human
acaugcaggucuccguggucc

SEQ ID NO: 1319280 - RNA, 26 nt, Human
acauggccccagcucacugagcuccu

SEQ ID NO: 1319281 - RNA, 24 nt, Human
accccgucucuacuaaaaauacaa

SEQ ID NO: 1319282 - RNA, 19 nt, Human
acccugaacugaggaagag

SEQ ID NO: 1319283 - RNA, 24 nt, Human
accucugcacuccagccugggcga

SEQ ID NO: 1319284 - RNA, 18 nt, Human
agaaauacaaacccacag

SEQ ID NO: 1319285 - RNA, 23 nt, Human
agcaaugggccaccccuagcccc

SEQ ID NO: 1319286 - RNA, 20 nt, Human
agccaggcaugguggugggc

SEQ ID NO: 1319287 - RNA, 25 nt, Human
agccauguaaccccuagugguaacu

SEQ ID NO: 1319288 - RNA, 22 nt, Human
agccuggccaacauggugaaac

SEQ ID NO: 1319289 - RNA, 24 nt, Human
agccuggccaacauggugaaaccc

SEQ ID NO: 1319290 - RNA, 24 nt, Human
agccugggcgacagagcaagacuc

SEQ ID NO: 1319291 - RNA, 19 nt, Human
agccuucuccacacuggcc

SEQ ID NO: 1319292 - RNA, 24 nt, Human
aggacgggagcugggcuggguccu

SEQ ID NO: 1319293 - RNA, 23 nt, Human
aggagacuccggggcucggggac

SEQ ID NO: 1319294 - RNA, 18 nt, Human
aggcaggagaauugcuug

SEQ ID NO: 1319295 - RNA, 23 nt, Human
aggcaggagaauugcuugacccg

SEQ ID NO: 1319296 - RNA, 24 nt, Human
aggcaggagaauugcuugacccgg

SEQ ID NO: 1319297 - RNA, 24 nt, Human
aggcaugguggugggcaccuguaa

SEQ ID NO: 1319298 - RNA, 23 nt, Human
aggccccugagcauccccugccc

SEQ ID NO: 1319299 - RNA, 20 nt, Human
aggccgaggugggcggauca

SEQ ID NO: 1319300 - RNA, 24 nt, Human
aggccucccugcacaugcaggucu

SEQ ID NO: 1319301 - RNA, 22 nt, Human
agggugaggcgggcagaaaagc

SEQ ID NO: 1319302 - RNA, 24 nt, Human
agguggagguugcagugagcugag

SEQ ID NO: 1319303 - RNA, 24 nt, Human
aucgcaccucugcacuccagccug

SEQ ID NO: 1319304 - RNA, 21 nt, Human
augagaaagcccuagucucag

SEQ ID NO: 1319305 - RNA, 20 nt, Human
auggccccagcucacugagc

SEQ ID NO: 1319306 - RNA, 18 nt, Human
auuccugccugcaacccc

SEQ ID NO: 1319307 - RNA, 21 nt, Human
caacacuuugggaggccgagg

SEQ ID NO: 1319308 - RNA, 24 nt, Human
caacacuuugggaggccgaggugg

SEQ ID NO: 1319309 - RNA, 21 nt, Human
caacaggccuggcaauuuauc

SEQ ID NO: 1319310 - RNA, 24 nt, Human
caacauggugaaaccccgucucua

SEQ ID NO: 1319311 - RNA, 24 nt, Human
caaccccagcuucacaggcaauuc

SEQ ID NO: 1319312 - RNA, 22 nt, Human
caagaaauacaaacccacaggg

SEQ ID NO: 1319313 - RNA, 24 nt, Human
caagaccagccuggccaacauggu

SEQ ID NO: 1319314 - RNA, 22 nt, Human
caagacucccaucucaaaaaaa

SEQ ID NO: 1319315 - RNA, 24 nt, Human
caagacucccaucucaaaaaaaag

SEQ ID NO: 1319316 - RNA, 22 nt, Human
caagagucaccugcuagaacac

SEQ ID NO: 1319317 - RNA, 23 nt, Human
caagcccuuugcaaaagagcuga

SEQ ID NO: 1319318 - RNA, 21 nt, Human
caaggacccccaggugaccgg

SEQ ID NO: 1319319 - RNA, 22 nt, Human
caaugggccaccccuagccccg

SEQ ID NO: 1319320 - RNA, 21 nt, Human
cacacaagcuugaugccacca

SEQ ID NO: 1319321 - RNA, 23 nt, Human
cacagggacauggccccagcuca

SEQ ID NO: 1319322 - RNA, 18 nt, Human
caccagaugggaugggcu

SEQ ID NO: 1319323 - RNA, 25 nt, Human
caccccuagccccggagcagcucag

SEQ ID NO: 1319324 - RNA, 23 nt, Human
caccuguaauuccagcuacucgg

SEQ ID NO: 1319325 - RNA, 24 nt, Human
caccuguaauuccagcuacucggg

SEQ ID NO: 1319326 - RNA, 24 nt, Human
cacgccuguaaucccaacacuuug

SEQ ID NO: 1319327 - RNA, 20 nt, Human
cacuccagccugggcgacag

SEQ ID NO: 1319328 - RNA, 23 nt, Human
cacuccagccugggcgacagagc

SEQ ID NO: 1319329 - RNA, 19 nt, Human
cagaugggaugggcugggg

SEQ ID NO: 1319330 - RNA, 18 nt, Human
cagcaaugggccaccccu

SEQ ID NO: 1319331 - RNA, 21 nt, Human
cagcccgaggcgaggaggcca

SEQ ID NO: 1319332 - RNA, 22 nt, Human
cagcccgaggcgaggaggccag

SEQ ID NO: 1319333 - RNA, 19 nt, Human
caggaaggccccugggcug

SEQ ID NO: 1319334 - RNA, 20 nt, Human
caggccccugagcauccccu

SEQ ID NO: 1319335 - RNA, 21 nt, Human
caggggcuccaugaauauucc

SEQ ID NO: 1319336 - RNA, 21 nt, Human
caguuccugggcccggggccu

SEQ ID NO: 1319337 - RNA, 27 nt, Human
cauccuuaccaaggacccccaggugac

SEQ ID NO: 1319338 - RNA, 23 nt, Human
caucucaaaaaaaagauugcaac

SEQ ID NO: 1319339 - RNA, 18 nt, Human
cauuugaggucagguguu

SEQ ID NO: 1319340 - RNA, 21 nt, Human
ccacagcagggguuucgagga

SEQ ID NO: 1319341 - RNA, 22 nt, Human
ccagaaauucuaaaggaagcaa

SEQ ID NO: 1319342 - RNA, 19 nt, Human
ccaggcccauucccuccug

SEQ ID NO: 1319343 - RNA, 22 nt, Human
ccaggccucccugcacaugcag

SEQ ID NO: 1319344 - RNA, 18 nt, Human
ccaggccuggcugcccau

SEQ ID NO: 1319345 - RNA, 18 nt, Human
ccaucggcaggcugccag

SEQ ID NO: 1319346 - RNA, 21 nt, Human
ccccagcucacugagcuccug

SEQ ID NO: 1319347 - RNA, 18 nt, Human
cccccccgcagccuugca

SEQ ID NO: 1319348 - RNA, 23 nt, Human
ccccgcgaagcccugccuagccc

SEQ ID NO: 1319349 - RNA, 19 nt, Human
ccccggagcagcucagccc

SEQ ID NO: 1319350 - RNA, 21 nt, Human
ccccggagcagcucagccccc

SEQ ID NO: 1319351 - RNA, 21 nt, Human
ccccuagccccggagcagcuc

SEQ ID NO: 1319352 - RNA, 23 nt, Human
cccgcgaagcccugccuagcccc

SEQ ID NO: 1319353 - RNA, 21 nt, Human
cccgggagguggagguugcag

SEQ ID NO: 1319354 - RNA, 18 nt, Human
cccggggccucugcaggc

SEQ ID NO: 1319355 - RNA, 24 nt, Human
cccuuugcaaaagagcugacuucc

SEQ ID NO: 1319356 - RNA, 18 nt, Human
ccuagccccuuggcgugg

SEQ ID NO: 1319357 - RNA, 21 nt, Human
ccuagcucugcugcccuggga

SEQ ID NO: 1319358 - RNA, 22 nt, Human
ccuccaccaccccaugcugccu

SEQ ID NO: 1319359 - RNA, 23 nt, Human
ccuccaccaccccaugcugccua

SEQ ID NO: 1319360 - RNA, 23 nt, Human
ccuccaccaccccaugcugccua

SEQ ID NO: 1319361 - RNA, 18 nt, Human
ccucccucaguagcuggg

SEQ ID NO: 1319362 - RNA, 21 nt, Human
ccuccugccagcugcaucucc

SEQ ID NO: 1319363 - RNA, 20 nt, Human
ccucugcacuccagccuggg

SEQ ID NO: 1319364 - RNA, 21 nt, Human
ccucugcacuccagccugggc

SEQ ID NO: 1319365 - RNA, 24 nt, Human
ccucugcacuccagccugggcgac

SEQ ID NO: 1319366 - RNA, 22 nt, Human
ccucugcaggccuccaccaccc

SEQ ID NO: 1319367 - RNA, 23 nt, Human
ccucugcaggccuccaccacccc

SEQ ID NO: 1319368 - RNA, 21 nt, Human
ccugcaaccccagcuucacag

SEQ ID NO: 1319369 - RNA, 18 nt, Human
ccuggaggccagggcagg

SEQ ID NO: 1319370 - RNA, 23 nt, Human
ccuggccaacauggugaaacccc

SEQ ID NO: 1319371 - RNA, 24 nt, Human
ccuggccaacauggugaaaccccg

SEQ ID NO: 1319372 - RNA, 19 nt, Human
ccuggcugcccauccucug

SEQ ID NO: 1319373 - RNA, 22 nt, Human
ccugggcgacagagcaagacuc

SEQ ID NO: 1319374 - RNA, 22 nt, Human
ccuguaaucccaacacuuuggg

SEQ ID NO: 1319375 - RNA, 21 nt, Human
ccuguaauuccagcuacucgg

SEQ ID NO: 1319376 - RNA, 21 nt, Human
cgaggcgaggaggccagguca

SEQ ID NO: 1319377 - RNA, 24 nt, Human
cgaggugggcggaucauuugaggu

SEQ ID NO: 1319378 - RNA, 26 nt, Human
cgaggugggcggaucauuugagguca

SEQ ID NO: 1319379 - RNA, 23 nt, Human
cgccuguaaucccaacacuuugg

SEQ ID NO: 1319380 - RNA, 24 nt, Human
cggaucauuugaggucagguguuc

SEQ ID NO: 1319381 - RNA, 29 nt, Human
cgggagguggagguugcagugacaacggu

SEQ ID NO: 1319382 - RNA, 24 nt, Human
cgggagguggagguugcagugagc

SEQ ID NO: 1319383 - RNA, 18 nt, Human
cggugucuguggcaaccc

SEQ ID NO: 1319384 - RNA, 21 nt, Human
cuagccccggagcagcucagc

SEQ ID NO: 1319385 - RNA, 22 nt, Human
cucacgccuguaaucccaacac

SEQ ID NO: 1319386 - RNA, 24 nt, Human
cucacgccuguaaucccaacacuu

SEQ ID NO: 1319387 - RNA, 20 nt, Human
cuccaccaccccaugcugcc

SEQ ID NO: 1319388 - RNA, 19 nt, Human
cuccugccagcugcaucuc

SEQ ID NO: 1319389 - RNA, 23 nt, Human
cucugugccuacaaccugcucuu

SEQ ID NO: 1319390 - RNA, 23 nt, Human
cugcacuccagccugggcgacag

SEQ ID NO: 1319391 - RNA, 25 nt, Human
cugcacuccagccugggcgacagag

SEQ ID NO: 1319392 - RNA, 23 nt, Human
cugcaggccccugagcauccccu

SEQ ID NO: 1319393 - RNA, 19 nt, Human
cugcuggagaccuugggcc

SEQ ID NO: 1319394 - RNA, 18 nt, Human
cugggacaguaaggggaa

SEQ ID NO: 1319395 - RNA, 21 nt, Human
cuguaauuccagcuacucggg

SEQ ID NO: 1319396 - RNA, 24 nt, Human
cugucaugagcagacauaagaccu

SEQ ID NO: 1319397 - RNA, 18 nt, Human
cuuggagaaugaggaagg

SEQ ID NO: 1319398 - RNA, 18 nt, Human
gagcaagacucccaucuc

SEQ ID NO: 1319399 - RNA, 20 nt, Human
gagcagacauaagaccucau

SEQ ID NO: 1319400 - RNA, 23 nt, Human
gagguugcagugagcugagaucg

SEQ ID NO: 1319401 - RNA, 18 nt, Human
gagucaccugcuagaaca

SEQ ID NO: 1319402 - RNA, 19 nt, Human
gaucauuugaggucaggug

SEQ ID NO: 1319403 - RNA, 24 nt, Human
gaucauuugaggucagguguucaa

SEQ ID NO: 1319404 - RNA, 24 nt, Human
gcacuccagccugggcgacagagc

SEQ ID NO: 1319405 - RNA, 24 nt, Human
gccaacauggugaaaccccgucuc

SEQ ID NO: 1319406 - RNA, 20 nt, Human
gcccagggcuuucuccgacc

SEQ ID NO: 1319407 - RNA, 18 nt, Human
gcccugaggagggaaggc

SEQ ID NO: 1319408 - RNA, 22 nt, Human
gcccugggccuggugcaagauu

SEQ ID NO: 1319409 - RNA, 21 nt, Human
gcucugcuggagaccuugggc

SEQ ID NO: 1319410 - RNA, 21 nt, Human
gcugccaggcagacaggguag

SEQ ID NO: 1319411 - RNA, 20 nt, Human
ggacgggagcugggcugggu

SEQ ID NO: 1319412 - RNA, 22 nt, Human
ggagguugcagugagcugagau

SEQ ID NO: 1319413 - RNA, 24 nt, Human
ggagguugcagugagcugagaucg

SEQ ID NO: 1319414 - RNA, 23 nt, Human
ggaucauuugaggucagguguuc

SEQ ID NO: 1319415 - RNA, 21 nt, Human
ggcaagaaauacaaacccaca

SEQ ID NO: 1319416 - RNA, 22 nt, Human
ggcaagaaauacaaacccacag

SEQ ID NO: 1319417 - RNA, 18 nt, Human
ggccaggccccgcgaagc

SEQ ID NO: 1319418 - RNA, 21 nt, Human
ggcccagggcuuucuccgacc

SEQ ID NO: 1319419 - RNA, 21 nt, Human
ggcggaucauuugaggucagg

SEQ ID NO: 1319420 - RNA, 20 nt, Human
ggcucacgccuguaauccca

SEQ ID NO: 1319421 - RNA, 18 nt, Human
gggagaccugcaggcccc

SEQ ID NO: 1319422 - RNA, 20 nt, Human
gggaggccgaggugggcgga

SEQ ID NO: 1319423 - RNA, 24 nt, Human
gggggugaccuuagggaggguaaa

SEQ ID NO: 1319424 - RNA, 18 nt, Human
ggguaggaaucuuaggug

SEQ ID NO: 1319425 - RNA, 22 nt, Human
gggugaccuuagggaggguaaa

SEQ ID NO: 1319426 - RNA, 19 nt, Human
ggguuucgaggagacuccg

SEQ ID NO: 1319427 - RNA, 23 nt, Human
ggugagguggcucacgccuguaa

SEQ ID NO: 1319428 - RNA, 19 nt, Human
gguggagguugcagugagc

SEQ ID NO: 1319429 - RNA, 23 nt, Human
gguggcucacgccuguaauccca

SEQ ID NO: 1319430 - RNA, 24 nt, Human
gguggugggcaccuguaauuccag

SEQ ID NO: 1319431 - RNA, 23 nt, Human
guccaugcuggcccucaggggcu

SEQ ID NO: 1319432 - RNA, 22 nt, Human
gugaccccuccugguccaugcu

SEQ ID NO: 1319433 - RNA, 18 nt, Human
gugcuugaacuuggggag

SEQ ID NO: 1319434 - RNA, 22 nt, Human
gugcuuuaaggcagcccgaggc

SEQ ID NO: 1319435 - RNA, 19 nt, Human
guugcagugagcugagauc

SEQ ID NO: 1319436 - RNA, 21 nt, Human
uaaaaauacaaaaauuagcca

SEQ ID NO: 1319437 - RNA, 23 nt, Human
uaaaagaggacccuagcucugcu

SEQ ID NO: 1319438 - RNA, 24 nt, Human
uagcggugcuuuaaggcagcccga

SEQ ID NO: 1319439 - RNA, 20 nt, Human
uagcgguguggcuuuggcuu

SEQ ID NO: 1319440 - RNA, 28 nt, Human
ucaccugcuagaacacagggguaggaau

SEQ ID NO: 1319441 - RNA, 21 nt, Human
ucacugagcuccugagugguc

SEQ ID NO: 1319442 - RNA, 18 nt, Human
ucaguaucaucuaucaaa

SEQ ID NO: 1319443 - RNA, 24 nt, Human
ucaguaucaucuaucaaauaggcc

SEQ ID NO: 1319444 - RNA, 26 nt, Human
uccaagaacccugaacugaggaagag

SEQ ID NO: 1319445 - RNA, 19 nt, Human
uccacacccugccgccggc

SEQ ID NO: 1319446 - RNA, 19 nt, Human
uccaccaccccaugcugcc

SEQ ID NO: 1319447 - RNA, 24 nt, Human
uccagccugggcgacagagcaaga

SEQ ID NO: 1319448 - RNA, 25 nt, Human
uccaugcugugacccacagcagggg

SEQ ID NO: 1319449 - RNA, 18 nt, Human
ucccgggacugcugugaa

SEQ ID NO: 1319450 - RNA, 22 nt, Human
ucccugcacaugcaggucuccg

SEQ ID NO: 1319451 - RNA, 20 nt, Human
ucccuggaggcccagggcuu

SEQ ID NO: 1319452 - RNA, 21 nt, Human
ucccuggaggcccagggcuuu

SEQ ID NO: 1319453 - RNA, 22 nt, Human
uccucugagaccuguugaugag

SEQ ID NO: 1319454 - RNA, 18 nt, Human
uccugggcccggggccuc

SEQ ID NO: 1319455 - RNA, 19 nt, Human
uccugggcccggggccucu

SEQ ID NO: 1319456 - RNA, 31 nt, Human
ucgcaccucugcacuccagccugggcgacaa

SEQ ID NO: 1319457 - RNA, 24 nt, Human
ucucacacaagcccuuugcaaaag

SEQ ID NO: 1319458 - RNA, 21 nt, Human
ucucuacuaaaaauacaaaaa

SEQ ID NO: 1319459 - RNA, 21 nt, Human
ucugccagcaaugggccaccc

SEQ ID NO: 1319460 - RNA, 21 nt, Human
ucugcuggagaccuugggcca

SEQ ID NO: 1319461 - RNA, 22 nt, Human
ugagaucgcaccucugcacucc

SEQ ID NO: 1319462 - RNA, 24 nt, Human
ugagaucgcaccucugcacuccag

SEQ ID NO: 1319463 - RNA, 23 nt, Human
ugagcaaauccaagaacccugaa

SEQ ID NO: 1319464 - RNA, 18 nt, Human
ugagcauccccugcccca

SEQ ID NO: 1319465 - RNA, 22 nt, Human
ugagcugagaucgcaccucugc

SEQ ID NO: 1319466 - RNA, 23 nt, Human
ugaggcaggagaauugcuugacc

SEQ ID NO: 1319467 - RNA, 24 nt, Human
ugaggcaggagaauugcuugaccc

SEQ ID NO: 1319468 - RNA, 22 nt, Human
ugaggucagguguucaagacca

SEQ ID NO: 1319469 - RNA, 24 nt, Human
ugauacaacugaaaacauaacccu

SEQ ID NO: 1319470 - RNA, 20 nt, Human
ugcacaugcaggucuccgug

SEQ ID NO: 1319471 - RNA, 20 nt, Human
ugcucuuuccuuaaauucug

SEQ ID NO: 1319472 - RNA, 18 nt, Human
ugcuugaacuuggggagg

SEQ ID NO: 1319473 - RNA, 21 nt, Human
uggagaaugaggaaggggacg

SEQ ID NO: 1319474 - RNA, 18 nt, Human
uggagguugcagugagcu

SEQ ID NO: 1319475 - RNA, 24 nt, Human
uggccaacauggugaaaccccguc

SEQ ID NO: 1319476 - RNA, 21 nt, Human
uggcucacgccuguaauccca

SEQ ID NO: 1319477 - RNA, 24 nt, Human
uggcucacgccuguaaucccaaca

SEQ ID NO: 1319478 - RNA, 19 nt, Human
ugggaacagaguggcacca

SEQ ID NO: 1319479 - RNA, 18 nt, Human
ugggaagggggugaccuu

SEQ ID NO: 1319480 - RNA, 19 nt, Human
ugggaggccgaggugggcg

SEQ ID NO: 1319481 - RNA, 24 nt, Human
ugggaggccgaggugggcggauca

SEQ ID NO: 1319482 - RNA, 20 nt, Human
ugggcugggggcuccagggc

SEQ ID NO: 1319483 - RNA, 21 nt, Human
ugggcugggggcuccagggca

SEQ ID NO: 1319484 - RNA, 22 nt, Human
uggugggcaccuguaauuccag

SEQ ID NO: 1319485 - RNA, 24 nt, Human
ugguggugggcaccuguaauucca

SEQ ID NO: 1319486 - RNA, 21 nt, Human
uguagaugggaagggggugac

SEQ ID NO: 1319487 - RNA, 23 nt, Human
uguaucuguuuauugcuuuuaag

SEQ ID NO: 1319488 - RNA, 19 nt, Human
ugucaugagcagacauaag

SEQ ID NO: 1319489 - RNA, 21 nt, Human
uguccccucccucaguagcug

SEQ ID NO: 1319490 - RNA, 19 nt, Human
ugugacccacagcaggggu

SEQ ID NO: 1319491 - RNA, 23 nt, Human
uguucaagaccagccuggccaac

SEQ ID NO: 1319492 - RNA, 24 nt, Human
uuagccaggcaugguggugggcac

SEQ ID NO: 1319493 - RNA, 23 nt, Human
uuagggcauuggaucuggaagga

SEQ ID NO: 1319494 - RNA, 24 nt, Human
uuccagcuacucgggaagcugagg

SEQ ID NO: 1319495 - RNA, 21 nt, Human
uuccugggcccggggccucug

SEQ ID NO: 1319496 - RNA, 22 nt, Human
uuccugggcccggggccucugc

SEQ ID NO: 1319497 - RNA, 23 nt, Human
uugacccgggagguggagguugc

SEQ ID NO: 1319498 - RNA, 19 nt, Human
uugcagugagcugagaucg

SEQ ID NO: 1319499 - RNA, 20 nt, Human
uugcagugagcugagaucgc

SEQ ID NO: 1319500 - RNA, 22 nt, Human
uugcagugagcugagaucgcac

SEQ ID NO: 1319501 - RNA, 23 nt, Human
uugcaguuacaacacaaguugaa

SEQ ID NO: 1319502 - RNA, 23 nt, Human
uugcuugacccgggagguggagg

SEQ ID NO: 1319503 - RNA, 25 nt, Human
uugggaggccgaggugggcggauca

SEQ ID NO: 1319504 - RNA, 23 nt, Human
uuugaggucagguguucaagacc

SEQ ID NO: 1319505 - RNA, 20 nt, Human
aaccagagccugcgugccuu

SEQ ID NO: 1319506 - RNA, 18 nt, Human
accaccuucauggaaacc

SEQ ID NO: 1319507 - RNA, 22 nt, Human
acuccaagacucugguguugaa

SEQ ID NO: 1319508 - RNA, 19 nt, Human
agaaccuucaccaccuuca

SEQ ID NO: 1319509 - RNA, 22 nt, Human
agccaugacagugacuauggcc

SEQ ID NO: 1319510 - RNA, 22 nt, Human
aggcaaccacuguuccugguga

SEQ ID NO: 1319511 - RNA, 19 nt, Human
aggcgcaucaugagugucu

SEQ ID NO: 1319512 - RNA, 22 nt, Human
auuaaccagaaaaagagccacc

SEQ ID NO: 1319513 - RNA, 20 nt, Human
cagaaaaagagccaccaaau

SEQ ID NO: 1319514 - RNA, 21 nt, Human
cagggaacuccucuucuaauu

SEQ ID NO: 1319515 - RNA, 24 nt, Human
cauggaaaccaaaaucgucagaga

SEQ ID NO: 1319516 - RNA, 21 nt, Human
cccuaccaugugcuucccuug

SEQ ID NO: 1319517 - RNA, 19 nt, Human
ccuccugccacugcucccc

SEQ ID NO: 1319518 - RNA, 24 nt, Human
ccuccugccacugcuccccagguc

SEQ ID NO: 1319519 - RNA, 25 nt, Human
ccuucauggaaaccaaaaugaggau

SEQ ID NO: 1319520 - RNA, 22 nt, Human
ccuugagcagggaacuccucuu

SEQ ID NO: 1319521 - RNA, 23 nt, Human
cuaugcaaaccagagccugcgug

SEQ ID NO: 1319522 - RNA, 18 nt, Human
cucagagggaugaagcgu

SEQ ID NO: 1319523 - RNA, 24 nt, Human
cugaaaguuuccuugucugacucc

SEQ ID NO: 1319524 - RNA, 21 nt, Human
cuucaaaguucauguuccaug

SEQ ID NO: 1319525 - RNA, 20 nt, Human
gaacacggucgcucaucuuc

SEQ ID NO: 1319526 - RNA, 23 nt, Human
gacuauggccaaaaggcgcauca

SEQ ID NO: 1319527 - RNA, 18 nt, Human
gccugcgugccuuuugug

SEQ ID NO: 1319528 - RNA, 22 nt, Human
gggaacuccucuucuaauuguc

SEQ ID NO: 1319529 - RNA, 21 nt, Human
guuggaguugcuuucuuagcc

SEQ ID NO: 1319530 - RNA, 22 nt, Human
uaaccagaaaaagagccaccaa

SEQ ID NO: 1319531 - RNA, 23 nt, Human
uagaggcaaccacuguuccuggu

SEQ ID NO: 1319532 - RNA, 24 nt, Human
uauuggaaaugcuuuuauuuggag

SEQ ID NO: 1319533 - RNA, 22 nt, Human
ucaggaacggcaugaucuucca

SEQ ID NO: 1319534 - RNA, 21 nt, Human
ucuccuccugccacugcuccc

SEQ ID NO: 1319535 - RNA, 24 nt, Human
ucuccuccugccacugcuccccag

SEQ ID NO: 1319536 - RNA, 20 nt, Human
ucuuccaguugacauccugg

SEQ ID NO: 1319537 - RNA, 26 nt, Human
ugacuccacacauugccuucugauau

SEQ ID NO: 1319538 - RNA, 18 nt, Human
ugagugucuccuccugcc

SEQ ID NO: 1319539 - RNA, 22 nt, Human
ugagugucuccuccugccacug

SEQ ID NO: 1319540 - RNA, 21 nt, Human
uggguuggaguugcuuucuua

SEQ ID NO: 1319541 - RNA, 23 nt, Human
uggugagugcuaaggaccuucuu

SEQ ID NO: 1319542 - RNA, 25 nt, Human
uguagcauuaacccuaccaugugcu

SEQ ID NO: 1319543 - RNA, 20 nt, Human
ugucugacuccaagacucug

SEQ ID NO: 1319544 - RNA, 19 nt, Human
uucauuaggaagucauuug

SEQ ID NO: 1319545 - RNA, 21 nt, Human
uugaagauagaauuugccuua

SEQ ID NO: 1319546 - RNA, 22 nt, Human
acugcuugagcuaucugcucca

SEQ ID NO: 1319547 - RNA, 19 nt, Human
uaacuaguaguauuaaaau

SEQ ID NO: 1319548 - RNA, 26 nt, Human
uagugaauuacucauaguuaagaucu

SEQ ID NO: 1319549 - RNA, 19 nt, Human
agacaucucagcuccuucc

SEQ ID NO: 1319550 - RNA, 20 nt, Human
caaaccauucugugcauaau

SEQ ID NO: 1319551 - RNA, 23 nt, Human
ccccaucuucugaaauucccagc

SEQ ID NO: 1319552 - RNA, 18 nt, Human
ccgccgccgcacgcaccc

SEQ ID NO: 1319553 - RNA, 19 nt, Human
ccugcccucccuuguagaa

SEQ ID NO: 1319554 - RNA, 23 nt, Human
cuuguagaaguucucccccaucu

SEQ ID NO: 1319555 - RNA, 25 nt, Human
uagcaguacaauuaacauuggcuau

SEQ ID NO: 1319556 - RNA, 23 nt, Human
ucucucgcaaccgccgccgcacu

SEQ ID NO: 1319557 - RNA, 23 nt, Human
ucuuuuauuuauauauacuuuuu

SEQ ID NO: 1319558 - RNA, 24 nt, Human
ugacuuuagacaucucagcuccuu

SEQ ID NO: 1319559 - RNA, 21 nt, Human
ugcaccaaaccauucugugca

SEQ ID NO: 1319560 - RNA, 21 nt, Human
uuaaagcaaauauauagcgcc

SEQ ID NO: 1319561 - RNA, 24 nt, Human
uuaaagcaaauauauagcgccuca

SEQ ID NO: 1319562 - RNA, 23 nt, Human
aacacuuuccuguuuggccacca

SEQ ID NO: 1319563 - RNA, 19 nt, Human
aauccugagcuuagacgca

SEQ ID NO: 1319564 - RNA, 21 nt, Human
aaucugcuucuucuucuccuc

SEQ ID NO: 1319565 - RNA, 18 nt, Human
acccuugggguccugggg

SEQ ID NO: 1319566 - RNA, 19 nt, Human
accgccccgucccgacccc

SEQ ID NO: 1319567 - RNA, 22 nt, Human
accuccuccagccgccgccggu

SEQ ID NO: 1319568 - RNA, 19 nt, Human
acgccgcaggacggagcca

SEQ ID NO: 1319569 - RNA, 21 nt, Human
agcaggugaaugggcccuggg

SEQ ID NO: 1319570 - RNA, 24 nt, Human
agcauucuggcgcucacugaugcc

SEQ ID NO: 1319571 - RNA, 19 nt, Human
agcugcucggccuccuccu

SEQ ID NO: 1319572 - RNA, 19 nt, Human
agcuggcacuggguguggu

SEQ ID NO: 1319573 - RNA, 24 nt, Human
agcuucucuacacuguccuugcug

SEQ ID NO: 1319574 - RNA, 18 nt, Human
aggcgucgggagcucagc

SEQ ID NO: 1319575 - RNA, 22 nt, Human
agggagcucacugugauggacu

SEQ ID NO: 1319576 - RNA, 22 nt, Human
aggggugggugaagaaggugca

SEQ ID NO: 1319577 - RNA, 18 nt, Human
caccugagccuacgugcc

SEQ ID NO: 1319578 - RNA, 18 nt, Human
cacugugugcagaaaggu

SEQ ID NO: 1319579 - RNA, 18 nt, Human
cagaugaugcggccagag

SEQ ID NO: 1319580 - RNA, 22 nt, Human
cagcaccuugcggaggcguucc

SEQ ID NO: 1319581 - RNA, 18 nt, Human
cagcauucuggcgcucac

SEQ ID NO: 1319582 - RNA, 19 nt, Human
cagcauucuggcgcucacu

SEQ ID NO: 1319583 - RNA, 21 nt, Human
cagcuggcugcuccgagacuu

SEQ ID NO: 1319584 - RNA, 23 nt, Human
caggaugggagccagcacccgcu

SEQ ID NO: 1319585 - RNA, 18 nt, Human
caggggugggugaagaag

SEQ ID NO: 1319586 - RNA, 23 nt, Human
cagguaacugugacagaugaugc

SEQ ID NO: 1319587 - RNA, 21 nt, Human
caggugaaugggcccuggggc

SEQ ID NO: 1319588 - RNA, 22 nt, Human
cccgccauggagaaucuggaaa

SEQ ID NO: 1319589 - RNA, 22 nt, Human
cccugggagguuggagcugugg

SEQ ID NO: 1319590 - RNA, 24 nt, Human
ccgcaccgauugagaguccgugcg

SEQ ID NO: 1319591 - RNA, 18 nt, Human
ccgccccgucccgacccc

SEQ ID NO: 1319592 - RNA, 22 nt, Human
ccgccgcuccugcucccgcugc

SEQ ID NO: 1319593 - RNA, 22 nt, Human
ccgccgcuccugcucccgcugc

SEQ ID NO: 1319594 - RNA, 25 nt, Human
ccgccgcuccugcucccgcugcucc

SEQ ID NO: 1319595 - RNA, 22 nt, Human
ccgccgcuccugcucgcgccgc

SEQ ID NO: 1319596 - RNA, 24 nt, Human
ccgccgcuccugcucgcgccgcuc

SEQ ID NO: 1319597 - RNA, 19 nt, Human
ccgcggcagcugcagccgc

SEQ ID NO: 1319598 - RNA, 22 nt, Human
ccgcuccugcucccgccgcucc

SEQ ID NO: 1319599 - RNA, 22 nt, Human
ccgcuccugcucccgccgcucc

SEQ ID NO: 1319600 - RNA, 26 nt, Human
ccgcuccugcucccgccgcuccuccc

SEQ ID NO: 1319601 - RNA, 20 nt, Human
ccgcuccugcuccucuuccu

SEQ ID NO: 1319602 - RNA, 22 nt, Human
ccgcuccugcucgcgccgcucc

SEQ ID NO: 1319603 - RNA, 22 nt, Human
ccgcuccugcucgcgccgcucc

SEQ ID NO: 1319604 - RNA, 23 nt, Human
ccgcuccugcucgcgccgcuccu

SEQ ID NO: 1319605 - RNA, 20 nt, Human
ccgcugcucugccagccgcc

SEQ ID NO: 1319606 - RNA, 23 nt, Human
ccuccaggugcugcuccucgucc

SEQ ID NO: 1319607 - RNA, 18 nt, Human
ccuccucuuccugcuucc

SEQ ID NO: 1319608 - RNA, 24 nt, Human
ccuccugcugcagccaccugagcc

SEQ ID NO: 1319609 - RNA, 21 nt, Human
ccugcagcaccuugcggaggc

SEQ ID NO: 1319610 - RNA, 18 nt, Human
ccugcgcaauccugagcu

SEQ ID NO: 1319611 - RNA, 20 nt, Human
ccuucucagucuucucgucg

SEQ ID NO: 1319612 - RNA, 23 nt, Human
ccuugacccuugggguccugggg

SEQ ID NO: 1319613 - RNA, 22 nt, Human
cgcaauccugagcuuagacgca

SEQ ID NO: 1319614 - RNA, 25 nt, Human
cgcaggacggagccguucuccccga

SEQ ID NO: 1319615 - RNA, 18 nt, Human
cgguggacaugagcuggg

SEQ ID NO: 1319616 - RNA, 21 nt, Human
cucacgcuucagcuucaccuc

SEQ ID NO: 1319617 - RNA, 25 nt, Human
cuccaggcgcugccgcuccuucucc

SEQ ID NO: 1319618 - RNA, 23 nt, Human
cuccaguauccuggccuucgacu

SEQ ID NO: 1319619 - RNA, 22 nt, Human
cuccccgaccacuguagccagc

SEQ ID NO: 1319620 - RNA, 20 nt, Human
cuccuccagccgccgccgcu

SEQ ID NO: 1319621 - RNA, 19 nt, Human
cuccuccaucuucuuggcc

SEQ ID NO: 1319622 - RNA, 19 nt, Human
cuccucugccagccgcucc

SEQ ID NO: 1319623 - RNA, 22 nt, Human
cuccugcucccgcugcucugcc

SEQ ID NO: 1319624 - RNA, 21 nt, Human
cuccugcugcagccaccugag

SEQ ID NO: 1319625 - RNA, 23 nt, Human
cucgcgccgcuccugcucgcgcc

SEQ ID NO: 1319626 - RNA, 18 nt, Human
cucugccagccgcuccuc

SEQ ID NO: 1319627 - RNA, 24 nt, Human
cucugccagccgcuuagccucggc

SEQ ID NO: 1319628 - RNA, 20 nt, Human
cugcagcaccuugcggaggc

SEQ ID NO: 1319629 - RNA, 19 nt, Human
cugcagcagcucuuggugc

SEQ ID NO: 1319630 - RNA, 19 nt, Human
cugcucaaucugcuucuuc

SEQ ID NO: 1319631 - RNA, 19 nt, Human
cugcucccgccgcuccugc

SEQ ID NO: 1319632 - RNA, 19 nt, Human
cugcucccgccgcuccugc

SEQ ID NO: 1319633 - RNA, 23 nt, Human
cugcucccgccgcuccugcucgc

SEQ ID NO: 1319634 - RNA, 23 nt, Human
cuggcugcuccgagacuuucugc

SEQ ID NO: 1319635 - RNA, 18 nt, Human
cuggcugggcagggugag

SEQ ID NO: 1319636 - RNA, 20 nt, Human
cugguuccucugcacugugu

SEQ ID NO: 1319637 - RNA, 18 nt, Human
cuugcggaggcguuccuc

SEQ ID NO: 1319638 - RNA, 28 nt, Human
cuuggccgccgccuuuuucuuggccuuc

SEQ ID NO: 1319639 - RNA, 19 nt, Human
gaaucuggaaaggcuggcg

SEQ ID NO: 1319640 - RNA, 22 nt, Human
gacuucuuagguguugauuccu

SEQ ID NO: 1319641 - RNA, 18 nt, Human
gagccagcacccgcuccc

SEQ ID NO: 1319642 - RNA, 23 nt, Human
gagcuguggcugaagcuggaguc

SEQ ID NO: 1319643 - RNA, 23 nt, Human
gauggacuccaguauccuggccu

SEQ ID NO: 1319644 - RNA, 21 nt, Human
gcagcacgggucacacgccgc

SEQ ID NO: 1319645 - RNA, 20 nt, Human
gcagcuccucauccuccagg

SEQ ID NO: 1319646 - RNA, 23 nt, Human
gcagcugcucggccuccuccuuc

SEQ ID NO: 1319647 - RNA, 23 nt, Human
gcauucuggcgcucacugaugcc

SEQ ID NO: 1319648 - RNA, 22 nt, Human
gccgccgccgcuuguccuccuc

SEQ ID NO: 1319649 - RNA, 20 nt, Human
gccgccgcuuguccuccucc

SEQ ID NO: 1319650 - RNA, 25 nt, Human
gcgcagcugcucggccuccuccuuc

SEQ ID NO: 1319651 - RNA, 25 nt, Human
gcggcagcugcagccgcagcacggg

SEQ ID NO: 1319652 - RNA, 21 nt, Human
gcucagcauucuggcgcucac

SEQ ID NO: 1319653 - RNA, 21 nt, Human
gcuccagcaggugaaugggcc

SEQ ID NO: 1319654 - RNA, 21 nt, Human
gcucccgccgcuccugcuccc

SEQ ID NO: 1319655 - RNA, 24 nt, Human
gcucccgccgcuccugcucgcgcc

SEQ ID NO: 1319656 - RNA, 20 nt, Human
gcuccgagacuuucugcggg

SEQ ID NO: 1319657 - RNA, 23 nt, Human
gcuccugcucccgcugcucugcc

SEQ ID NO: 1319658 - RNA, 21 nt, Human
gcuccuggggggcugcagcuc

SEQ ID NO: 1319659 - RNA, 28 nt, Human
gcucuggcucuuugcugaauucucugac

SEQ ID NO: 1319660 - RNA, 19 nt, Human
gcugcagccaccugagccu

SEQ ID NO: 1319661 - RNA, 19 nt, Human
gcuucagcuucaccuccuc

SEQ ID NO: 1319662 - RNA, 20 nt, Human
gcuucagcuucaccuccucc

SEQ ID NO: 1319663 - RNA, 23 nt, Human
ggacucggggaagacggggcgau

SEQ ID NO: 1319664 - RNA, 21 nt, Human
ggagcucagcuggcugcuccg

SEQ ID NO: 1319665 - RNA, 19 nt, Human
gggaagacggggcgaucgg

SEQ ID NO: 1319666 - RNA, 20 nt, Human
gggcagggugaggaaggggu

SEQ ID NO: 1319667 - RNA, 19 nt, Human
ggggucaugagcaucuggu

SEQ ID NO: 1319668 - RNA, 20 nt, Human
gucgggagcucagcuggcug

SEQ ID NO: 1319669 - RNA, 22 nt, Human
uaagaaauccgucucuucuucc

SEQ ID NO: 1319670 - RNA, 27 nt, Human
uagacgcagaccgccccgucccgaccc

SEQ ID NO: 1319671 - RNA, 18 nt, Human
uccaguauccuggccuuc

SEQ ID NO: 1319672 - RNA, 21 nt, Human
uccaguauccuggccuucgac

SEQ ID NO: 1319673 - RNA, 23 nt, Human
uccgagacuuucugcgggauaac

SEQ ID NO: 1319674 - RNA, 22 nt, Human
uccuccagccgccgccgcuugu

SEQ ID NO: 1319675 - RNA, 19 nt, Human
uccuccaucuucuuggccg

SEQ ID NO: 1319676 - RNA, 22 nt, Human
uccuccaucuucuuggccgccg

SEQ ID NO: 1319677 - RNA, 20 nt, Human
uccuccuccugcugcagcca

SEQ ID NO: 1319678 - RNA, 26 nt, Human
ucggcagucuucuuggcaagccuucu

SEQ ID NO: 1319679 - RNA, 24 nt, Human
ucggccgccuuccgcagccgcucc

SEQ ID NO: 1319680 - RNA, 22 nt, Human
ucggccuccucuuggauuuccu

SEQ ID NO: 1319681 - RNA, 21 nt, Human
ucucuucuuccgucgguucuu

SEQ ID NO: 1319682 - RNA, 19 nt, Human
ucugccugcgcagcugcuc

SEQ ID NO: 1319683 - RNA, 19 nt, Human
ucugggcuaagacuugggg

SEQ ID NO: 1319684 - RNA, 26 nt, Human
ugagaagguguuuugggcaucagcuc

SEQ ID NO: 1319685 - RNA, 23 nt, Human
ugagcuucuggucacauagcucc

SEQ ID NO: 1319686 - RNA, 19 nt, Human
ugccaugguagccgcggca

SEQ ID NO: 1319687 - RNA, 28 nt, Human
ugccaugguagccgcggcagcugcagcc

SEQ ID NO: 1319688 - RNA, 22 nt, Human
ugccgaucuccaccacaggcac

SEQ ID NO: 1319689 - RNA, 26 nt, Human
ugcgcucggccuccucuuggauuuuu

SEQ ID NO: 1319690 - RNA, 22 nt, Human
ugcucagcauucuggcgcucac

SEQ ID NO: 1319691 - RNA, 18 nt, Human
ugcuccucuuccuucuuc

SEQ ID NO: 1319692 - RNA, 18 nt, Human
ugcugcuccucguccagc

SEQ ID NO: 1319693 - RNA, 22 nt, Human
ugcuucuucuucuccuccuuca

SEQ ID NO: 1319694 - RNA, 19 nt, Human
uggaaaggcuggcgagucc

SEQ ID NO: 1319695 - RNA, 18 nt, Human
uggagucggggacagagu

SEQ ID NO: 1319696 - RNA, 23 nt, Human
uggcugggcagggugaggaaggg

SEQ ID NO: 1319697 - RNA, 19 nt, Human
uggcugggcagggugaggg

SEQ ID NO: 1319698 - RNA, 21 nt, Human
ugggcagggugaggaaggggu

SEQ ID NO: 1319699 - RNA, 18 nt, Human
ugggugaagaaggugcag

SEQ ID NO: 1319700 - RNA, 19 nt, Human
ugggugaagaaggugcagc

SEQ ID NO: 1319701 - RNA, 21 nt, Human
uggucacauagcuccagcagg

SEQ ID NO: 1319702 - RNA, 21 nt, Human
ugucgggaugcccugggaggu

SEQ ID NO: 1319703 - RNA, 20 nt, Human
uguuuggccaccagagagua

SEQ ID NO: 1319704 - RNA, 19 nt, Human
uuauccggcaggaugggag

SEQ ID NO: 1319705 - RNA, 25 nt, Human
uuccucaagccacaccaaguccuua

SEQ ID NO: 1319706 - RNA, 22 nt, Human
uuggccaccagagaguacuucu

SEQ ID NO: 1319707 - RNA, 24 nt, Human
uugggcaucagcucuggcucuuug

SEQ ID NO: 1319708 - RNA, 18 nt, Human
uuugcugaauucucuggu

SEQ ID NO: 1319709 - RNA, 23 nt, Human
uuugcugaauucucuggugaaca

SEQ ID NO: 1319710 - RNA, 21 nt, Human
cuguugaauggagccugucac

SEQ ID NO: 1319711 - RNA, 24 nt, Human
uugaauggagccugucaccuacug

SEQ ID NO: 1319712 - RNA, 18 nt, Human
cagcggcggcucggggag

SEQ ID NO: 1319713 - RNA, 21 nt, Human
caggaggggccggccgggagc

SEQ ID NO: 1319714 - RNA, 24 nt, Human
cccaggaggggccggccgggagcg

SEQ ID NO: 1319715 - RNA, 18 nt, Human
ccugagauggcggcggcg

SEQ ID NO: 1319716 - RNA, 24 nt, Human
cgcccagggccggcggagcggcgg

SEQ ID NO: 1319717 - RNA, 22 nt, Human
cggccgggagcgggcugagccc

SEQ ID NO: 1319718 - RNA, 19 nt, Human
cgggagcgggcugagcccc

SEQ ID NO: 1319719 - RNA, 21 nt, Human
cugagauggcggcggcggcuu

SEQ ID NO: 1319720 - RNA, 21 nt, Human
gagauggcggcggcggcacag

SEQ ID NO: 1319721 - RNA, 21 nt, Human
gauggcggcggcggcacagcg

SEQ ID NO: 1319722 - RNA, 22 nt, Human
gcccagggccggcggagcggcg

SEQ ID NO: 1319723 - RNA, 21 nt, Human
gccgggagcgggcugagcccc

SEQ ID NO: 1319724 - RNA, 19 nt, Human
ggggagcccaggaggggcc

SEQ ID NO: 1319725 - RNA, 26 nt, Human
ucgcccagggccggcggagcggcggg

SEQ ID NO: 1319726 - RNA, 22 nt, Human
ugagauggcggcggcggcacag

SEQ ID NO: 1319727 - RNA, 18 nt, Human
cacagcccgcccagcccc

SEQ ID NO: 1319728 - RNA, 20 nt, Human
ccccuaggcgccgcggcagg

SEQ ID NO: 1319729 - RNA, 26 nt, Human
ccccuaggcgccgcggcagguguccg

SEQ ID NO: 1319730 - RNA, 18 nt, Human
cccgcccgcgcccucccu

SEQ ID NO: 1319731 - RNA, 21 nt, Human
cccgcgcccucccucgcgguc

SEQ ID NO: 1319732 - RNA, 18 nt, Human
cccucccucgcggucccg

SEQ ID NO: 1319733 - RNA, 20 nt, Human
ccgccccuaggcgccgcggc

SEQ ID NO: 1319734 - RNA, 25 nt, Human
ccucgcggucccggccccacuccuc

SEQ ID NO: 1319735 - RNA, 23 nt, Human
cgcccgcccgcgcccucccucgc

SEQ ID NO: 1319736 - RNA, 19 nt, Human
cgcccgcgcccucccucgc

SEQ ID NO: 1319737 - RNA, 23 nt, Human
cgcggcagguguccgcggugacc

SEQ ID NO: 1319738 - RNA, 19 nt, Human
cggucccggccccacuccu

SEQ ID NO: 1319739 - RNA, 24 nt, Human
cucuccgccguguucugcaccgac

SEQ ID NO: 1319740 - RNA, 21 nt, Human
gaagcggaagccgaaucugcu

SEQ ID NO: 1319741 - RNA, 21 nt, Human
gccccggcgcccgcccgcgcc

SEQ ID NO: 1319742 - RNA, 22 nt, Human
gcggcagguguccgcggugacc

SEQ ID NO: 1319743 - RNA, 22 nt, Human
ggacacagcccgcccagccccg

SEQ ID NO: 1319744 - RNA, 24 nt, Human
ggcgcccgcccgcgcccucccucg

SEQ ID NO: 1319745 - RNA, 23 nt, Human
uccgcggugaccggcaggcagcu

SEQ ID NO: 1319746 - RNA, 22 nt, Human
ucgcggucccggccccacuccu

SEQ ID NO: 1319747 - RNA, 25 nt, Human
ucugcaccgacagggccaccagggg

SEQ ID NO: 1319748 - RNA, 18 nt, Human
ugaugcagcggacacagc

SEQ ID NO: 1319749 - RNA, 19 nt, Human
aaaauacagaaacagcucc

SEQ ID NO: 1319750 - RNA, 22 nt, Human
aaacaaauccucagaguccucc

SEQ ID NO: 1319751 - RNA, 20 nt, Human
aaacagggaaaccgacgugg

SEQ ID NO: 1319752 - RNA, 18 nt, Human
aaauagccccuugccgcc

SEQ ID NO: 1319753 - RNA, 18 nt, Human
aaucccuggguucuccuu

SEQ ID NO: 1319754 - RNA, 21 nt, Human
agaagaaaacaaauccucaga

SEQ ID NO: 1319755 - RNA, 22 nt, Human
agaagaaaacaaauccucagag

SEQ ID NO: 1319756 - RNA, 20 nt, Human
agaaucccuggguucuccuu

SEQ ID NO: 1319757 - RNA, 21 nt, Human
agcagcuguacccccaaaaag

SEQ ID NO: 1319758 - RNA, 19 nt, Human
agccccuugccgccacuga

SEQ ID NO: 1319759 - RNA, 21 nt, Human
aggaauauuccacugguccuc

SEQ ID NO: 1319760 - RNA, 23 nt, Human
aggaguucuccuuuccuucuucu

SEQ ID NO: 1319761 - RNA, 20 nt, Human
aggcagcagagaugcaccuu

SEQ ID NO: 1319762 - RNA, 22 nt, Human
aggggcuuuuccuuggaguggg

SEQ ID NO: 1319763 - RNA, 21 nt, Human
agugggagggggaccauaggg

SEQ ID NO: 1319764 - RNA, 21 nt, Human
aucaucaucaaagaggccagu

SEQ ID NO: 1319765 - RNA, 19 nt, Human
aucaucaucaucaaagagg

SEQ ID NO: 1319766 - RNA, 28 nt, Human
auggaacggaggcagcaccaaacacauc

SEQ ID NO: 1319767 - RNA, 20 nt, Human
cacagccaucaucauccucu

SEQ ID NO: 1319768 - RNA, 20 nt, Human
cacagccaucaucauccucu

SEQ ID NO: 1319769 - RNA, 22 nt, Human
cacaggccgaggaccgcagagc

SEQ ID NO: 1319770 - RNA, 22 nt, Human
caccaucaucaucaucaaagag

SEQ ID NO: 1319771 - RNA, 25 nt, Human
caccaucaucaucaucaaagaggcc

SEQ ID NO: 1319772 - RNA, 19 nt, Human
cacugcugaacaacagggc

SEQ ID NO: 1319773 - RNA, 27 nt, Human
cagaaucccuggguucuccccccgagg

SEQ ID NO: 1319774 - RNA, 22 nt, Human
cagaguccuccucaucugaaaa

SEQ ID NO: 1319775 - RNA, 24 nt, Human
cagcaccaaacacauccgugucuc

SEQ ID NO: 1319776 - RNA, 19 nt, Human
cagccuuggccuccuggcu

SEQ ID NO: 1319777 - RNA, 21 nt, Human
cagcucaucugcaaacgaugu

SEQ ID NO: 1319778 - RNA, 21 nt, Human
caggcagcagagaugcaccuu

SEQ ID NO: 1319779 - RNA, 21 nt, Human
caggccaccuccagagccaaa

SEQ ID NO: 1319780 - RNA, 24 nt, Human
caucaucaaacagggaaaccgacg

SEQ ID NO: 1319781 - RNA, 22 nt, Human
caucaucaucaucaaagaggcc

SEQ ID NO: 1319782 - RNA, 22 nt, Human
caucuucaucaucaaacaggga

SEQ ID NO: 1319783 - RNA, 24 nt, Human
ccagugggagggggaccauagggg

SEQ ID NO: 1319784 - RNA, 22 nt, Human
ccccaaaaagauuauccucuuc

SEQ ID NO: 1319785 - RNA, 23 nt, Human
ccccaaaaagauuauccucuuca

SEQ ID NO: 1319786 - RNA, 22 nt, Human
ccccggaagccuagccccagcc

SEQ ID NO: 1319787 - RNA, 19 nt, Human
ccucagaguccuccucauc

SEQ ID NO: 1319788 - RNA, 21 nt, Human
ccucaucugaaaauaagccuu

SEQ ID NO: 1319789 - RNA, 25 nt, Human
ccuccuccuucucagagucagcaaa

SEQ ID NO: 1319790 - RNA, 20 nt, Human
ccuccucuucuuucucuucc

SEQ ID NO: 1319791 - RNA, 20 nt, Human
cgacccauggcaucccccuu

SEQ ID NO: 1319792 - RNA, 21 nt, Human
cucagagucagcaaaaagguc

SEQ ID NO: 1319793 - RNA, 18 nt, Human
cuccuuuccuucuucucu

SEQ ID NO: 1319794 - RNA, 20 nt, Human
cucuucuuucucuuccucag

SEQ ID NO: 1319795 - RNA, 20 nt, Human
cugcucuugcuuuauuuuca

SEQ ID NO: 1319796 - RNA, 20 nt, Human
cugcugggauuuucuuucca

SEQ ID NO: 1319797 - RNA, 23 nt, Human
cuucuuagcagcuguacccccaa

SEQ ID NO: 1319798 - RNA, 20 nt, Human
gacuccuccuuaacagaggc

SEQ ID NO: 1319799 - RNA, 24 nt, Human
gagaagaaaacaaauccucagagu

SEQ ID NO: 1319800 - RNA, 18 nt, Human
gagacaaugucugcuucu

SEQ ID NO: 1319801 - RNA, 18 nt, Human
gagugggcugcucaggcu

SEQ ID NO: 1319802 - RNA, 18 nt, Human
gcuguggggugccgagaa

SEQ ID NO: 1319803 - RNA, 18 nt, Human
ggccuccuggcucuggag

SEQ ID NO: 1319804 - RNA, 24 nt, Human
ggugugcuaacugguuuuguucau

SEQ ID NO: 1319805 - RNA, 23 nt, Human
guggugugcuaacugguuuuguu

SEQ ID NO: 1319806 - RNA, 20 nt, Human
uaaaaauacagaaacagcuc

SEQ ID NO: 1319807 - RNA, 19 nt, Human
uauccucuucaucuucauc

SEQ ID NO: 1319808 - RNA, 19 nt, Human
uaucggcaguggauuggac

SEQ ID NO: 1319809 - RNA, 21 nt, Human
ucaccaaagauaucggcagug

SEQ ID NO: 1319810 - RNA, 19 nt, Human
ucacugugaugggcaaaau

SEQ ID NO: 1319811 - RNA, 23 nt, Human
ucagaguccuccucaucugaaaa

SEQ ID NO: 1319812 - RNA, 23 nt, Human
ucaucugaaaauaagccuuuuug

SEQ ID NO: 1319813 - RNA, 18 nt, Human
uccacugguccuccucau

SEQ ID NO: 1319814 - RNA, 23 nt, Human
uccagagccaaauggcgagaagu

SEQ ID NO: 1319815 - RNA, 21 nt, Human
uccgagguuuugcuucuccug

SEQ ID NO: 1319816 - RNA, 18 nt, Human
uccucuuccucaucacuc

SEQ ID NO: 1319817 - RNA, 23 nt, Human
uccuuaacagaggcuccagcuug

SEQ ID NO: 1319818 - RNA, 25 nt, Human
uccuucuucucuuugagugucuucc

SEQ ID NO: 1319819 - RNA, 19 nt, Human
ucuccuuuccuucuucucu

SEQ ID NO: 1319820 - RNA, 20 nt, Human
ucucucugagcuuguagaga

SEQ ID NO: 1319821 - RNA, 23 nt, Human
ucucugggucuucuuuuggcugu

SEQ ID NO: 1319822 - RNA, 25 nt, Human
ucugacuccuccucuucuuucucuu

SEQ ID NO: 1319823 - RNA, 18 nt, Human
ucuggcgaugcuacggcu

SEQ ID NO: 1319824 - RNA, 21 nt, Human
ucugggucuucuuuuggcugu

SEQ ID NO: 1319825 - RNA, 19 nt, Human
ucuuccuccuccuucucag

SEQ ID NO: 1319826 - RNA, 18 nt, Human
ugaacaggccaccuccag

SEQ ID NO: 1319827 - RNA, 19 nt, Human
ugagaagaaaacaaauccu

SEQ ID NO: 1319828 - RNA, 20 nt, Human
ugcugaacaacagggcagau

SEQ ID NO: 1319829 - RNA, 23 nt, Human
ugcuuuauuuucaucugucugac

SEQ ID NO: 1319830 - RNA, 19 nt, Human
uguccucaauaucuuccuc

SEQ ID NO: 1319831 - RNA, 22 nt, Human
uguucauugucacugugauggg

SEQ ID NO: 1319832 - RNA, 19 nt, Human
uucaauguccucaauaucu

SEQ ID NO: 1319833 - RNA, 21 nt, Human
uucacagccuuggccuccugg

SEQ ID NO: 1319834 - RNA, 18 nt, Human
uucauugucacugugaug

SEQ ID NO: 1319835 - RNA, 22 nt, Human
uuccuuggagugggcugcucag

SEQ ID NO: 1319836 - RNA, 20 nt, Human
uucuuuuggcuguccuuggc

SEQ ID NO: 1319837 - RNA, 23 nt, Human
uugagauuuuugcuguaagauaa

SEQ ID NO: 1319838 - RNA, 18 nt, Human
uugcaggaggaacagaug

SEQ ID NO: 1319839 - RNA, 20 nt, Human
uugcaggaggaacagaugug

SEQ ID NO: 1319840 - RNA, 23 nt, Human
uuggagugggcugcucaggcuuc

SEQ ID NO: 1319841 - RNA, 22 nt, Human
uuuugcuucuccugaggguaag

SEQ ID NO: 1319842 - RNA, 18 nt, Human
aaacugcauccccauaac

SEQ ID NO: 1319843 - RNA, 21 nt, Human
aaacugcauccccauaacccc

SEQ ID NO: 1319844 - RNA, 28 nt, Human
aaguacaauggagggagggccgguaccc

SEQ ID NO: 1319845 - RNA, 21 nt, Human
accaccgcaccgcgcccaagc

SEQ ID NO: 1319846 - RNA, 22 nt, Human
acccaccacccagacaguagau

SEQ ID NO: 1319847 - RNA, 20 nt, Human
acccagacaguagauagggc

SEQ ID NO: 1319848 - RNA, 22 nt, Human
aggggcuaagccuagcugucug

SEQ ID NO: 1319849 - RNA, 23 nt, Human
caccaccgcaccgcgcccaagca

SEQ ID NO: 1319850 - RNA, 19 nt, Human
caccgcaccgcgcccaagc

SEQ ID NO: 1319851 - RNA, 24 nt, Human
caccgcaccucugugccucggucc

SEQ ID NO: 1319852 - RNA, 23 nt, Human
cacgcgggggccgcgcugggccg

SEQ ID NO: 1319853 - RNA, 23 nt, Human
cauaacccaccacccagacagua

SEQ ID NO: 1319854 - RNA, 22 nt, Human
caucagagaacaaaaccaaaag

SEQ ID NO: 1319855 - RNA, 23 nt, Human
caucgggggugcggagccuggga

SEQ ID NO: 1319856 - RNA, 22 nt, Human
ccaaacugcauccccauaaccc

SEQ ID NO: 1319857 - RNA, 21 nt, Human
ccccauaacccaccacccaga

SEQ ID NO: 1319858 - RNA, 18 nt, Human
ccgcgcccaagcagcugc

SEQ ID NO: 1319859 - RNA, 21 nt, Human
ccggagcgggcucagcacccg

SEQ ID NO: 1319860 - RNA, 21 nt, Human
cgcccaagcagcugccgccac

SEQ ID NO: 1319861 - RNA, 23 nt, Human
cggagccugggaggcacgcgggg

SEQ ID NO: 1319862 - RNA, 18 nt, Human
cggccggagcgggcucag

SEQ ID NO: 1319863 - RNA, 19 nt, Human
cgucccggccggagcgggc

SEQ ID NO: 1319864 - RNA, 19 nt, Human
cuagauacugagacacauc

SEQ ID NO: 1319865 - RNA, 23 nt, Human
cuggaggcuaccuggaaccccgg

SEQ ID NO: 1319866 - RNA, 18 nt, Human
gaaguugauuuuuaauga

SEQ ID NO: 1319867 - RNA, 18 nt, Human
gaccuggcucagacauga

SEQ ID NO: 1319868 - RNA, 19 nt, Human
gaggcuaccuggaaccccg

SEQ ID NO: 1319869 - RNA, 19 nt, Human
gccugggaggcacgcgggg

SEQ ID NO: 1319870 - RNA, 22 nt, Human
gcgcagcaucgggggugcggag

SEQ ID NO: 1319871 - RNA, 21 nt, Human
gcucagacaugaaucaugugc

SEQ ID NO: 1319872 - RNA, 23 nt, Human
ggagccugggaggcacgcggggg

SEQ ID NO: 1319873 - RNA, 23 nt, Human
ggaggcacgcgggggccgcgcug

SEQ ID NO: 1319874 - RNA, 19 nt, Human
ggggugcuguggugguggu

SEQ ID NO: 1319875 - RNA, 25 nt, Human
uacaauggagggagggcagaggggc

SEQ ID NO: 1319876 - RNA, 20 nt, Human
ucagacaugaaucaugugcu

SEQ ID NO: 1319877 - RNA, 19 nt, Human
uccccauaacccaccaccc

SEQ ID NO: 1319878 - RNA, 18 nt, Human
ugccaaacugcaucccca

SEQ ID NO: 1319879 - RNA, 22 nt, Human
ugccaaacugcauccccauaac

SEQ ID NO: 1319880 - RNA, 19 nt, Human
ugccucgguccucagcugc

SEQ ID NO: 1319881 - RNA, 18 nt, Human
ugcggagccugggaggca

SEQ ID NO: 1319882 - RNA, 21 nt, Human
ugcuguggugguggugggcug

SEQ ID NO: 1319883 - RNA, 20 nt, Human
uuacugccaguuaaccugga

SEQ ID NO: 1319884 - RNA, 25 nt, Human
uuacugccaguuaaccuggaggcua

SEQ ID NO: 1319885 - RNA, 21 nt, Human
acaugcuguguuucuucuggc

SEQ ID NO: 1319886 - RNA, 18 nt, Human
agaaagagguugcugggg

SEQ ID NO: 1319887 - RNA, 21 nt, Human
agagguugcuggggucagugc

SEQ ID NO: 1319888 - RNA, 23 nt, Human
cagugcugcagggaccauacaga

SEQ ID NO: 1319889 - RNA, 23 nt, Human
cccuccuugaccaccuucuucuu

SEQ ID NO: 1319890 - RNA, 18 nt, Human
ccugcugcaggucugugu

SEQ ID NO: 1319891 - RNA, 24 nt, Human
cuccugcugcaggucuguguucag

SEQ ID NO: 1319892 - RNA, 20 nt, Human
gcaggucuguguucagcccu

SEQ ID NO: 1319893 - RNA, 19 nt, Human
gcuguguuucuucuggcug

SEQ ID NO: 1319894 - RNA, 22 nt, Human
uccucuccaggugcucccgcug

SEQ ID NO: 1319895 - RNA, 22 nt, Human
ucuccaggugcucccgcugccg

SEQ ID NO: 1319896 - RNA, 20 nt, Human
ugcuggggucagugcugcag

SEQ ID NO: 1319897 - RNA, 23 nt, Human
ugcuggggucagugcugcaggga

SEQ ID NO: 1319898 - RNA, 19 nt, Human
uggcuguggcuggagaugg

SEQ ID NO: 1319899 - RNA, 22 nt, Human
uggcuguggcuggagauggcuc

SEQ ID NO: 1319900 - RNA, 23 nt, Human
uugagaguggccagguuccucuc

SEQ ID NO: 1319901 - RNA, 19 nt, Human
aauuccacggccgauaaac

SEQ ID NO: 1319902 - RNA, 23 nt, Human
aggaaugcgggagagcucagaac

SEQ ID NO: 1319903 - RNA, 23 nt, Human
augcgggagagcucagaacauuc

SEQ ID NO: 1319904 - RNA, 23 nt, Human
ggaggccacuguuuguuuguuuu

SEQ ID NO: 1319905 - RNA, 18 nt, Human
ucccagagaaaaugaggg

SEQ ID NO: 1319906 - RNA, 18 nt, Human
ugcauguaggauguugca

SEQ ID NO: 1319907 - RNA, 19 nt, Human
ugcauguaggauguugcag

SEQ ID NO: 1319908 - RNA, 24 nt, Human
ugggaggaggaaugcgggagagcc

SEQ ID NO: 1319909 - RNA, 23 nt, Human
uguuuguuuuucuuggccaagug

SEQ ID NO: 1319910 - RNA, 19 nt, Human
uucccagagaaaaugaggg

SEQ ID NO: 1319911 - RNA, 24 nt, Human
accacgggggggugagucacuuug

SEQ ID NO: 1319912 - RNA, 18 nt, Human
agaagccaucgcugccca

SEQ ID NO: 1319913 - RNA, 22 nt, Human
aggauaaccccuaggcugucca

SEQ ID NO: 1319914 - RNA, 23 nt, Human
aggcuguccaccucacuggccuc

SEQ ID NO: 1319915 - RNA, 19 nt, Human
ccuaggcuguccaccucac

SEQ ID NO: 1319916 - RNA, 21 nt, Human
ccucugcuugcuccaguccuu

SEQ ID NO: 1319917 - RNA, 21 nt, Human
cucacuggccucgggcagagg

SEQ ID NO: 1319918 - RNA, 20 nt, Human
cuccaguccuucagggugcc

SEQ ID NO: 1319919 - RNA, 18 nt, Human
ggcacaugcauucugggc

SEQ ID NO: 1319920 - RNA, 20 nt, Human
ggcagggcuuucucucuccu

SEQ ID NO: 1319921 - RNA, 23 nt, Human
ggcggguggggcaugaggggcug

SEQ ID NO: 1319922 - RNA, 18 nt, Human
ggguggggcaugaggggc

SEQ ID NO: 1319923 - RNA, 21 nt, Human
uaaccccuaggcuguccaccu

SEQ ID NO: 1319924 - RNA, 23 nt, Human
ugcauucugggcuaucuccaauu

SEQ ID NO: 1319925 - RNA, 18 nt, Human
uggcggguggggcaugag

SEQ ID NO: 1319926 - RNA, 23 nt, Human
uggcggguggggcaugaggggcu

SEQ ID NO: 1319927 - RNA, 20 nt, Human
ugggcacaugcauucugggc

SEQ ID NO: 1319928 - RNA, 23 nt, Human
aggccguccagcuuggugacggg

SEQ ID NO: 1319929 - RNA, 25 nt, Human
cagugaauuccugauagggagacuu

SEQ ID NO: 1319930 - RNA, 24 nt, Human
ccccauccacggccgcgaccccgg

SEQ ID NO: 1319931 - RNA, 23 nt, Human
ccgcgaacuccgcggucuuggcc

SEQ ID NO: 1319932 - RNA, 18 nt, Human
ccgcggucuuggccccgg

SEQ ID NO: 1319933 - RNA, 22 nt, Human
ccuuauccugggccuugccucc

SEQ ID NO: 1319934 - RNA, 19 nt, Human
ccuuccagaaguccuucag

SEQ ID NO: 1319935 - RNA, 21 nt, Human
cuccgcggucuuggccccggc

SEQ ID NO: 1319936 - RNA, 18 nt, Human
cugauagggagacuuggu

SEQ ID NO: 1319937 - RNA, 24 nt, Human
cuggguccucugcacggagacucu

SEQ ID NO: 1319938 - RNA, 21 nt, Human
cuuggccaggccguccagcuu

SEQ ID NO: 1319939 - RNA, 24 nt, Human
gccuugccuccgcgaacuccgcgg

SEQ ID NO: 1319940 - RNA, 20 nt, Human
ggcgagguggucagugaauu

SEQ ID NO: 1319941 - RNA, 21 nt, Human
uaaaaacccuauguuguaguc

SEQ ID NO: 1319942 - RNA, 20 nt, Human
uccagaaguccuucagggga

SEQ ID NO: 1319943 - RNA, 22 nt, Human
uccgcggucuuggccccggccc

SEQ ID NO: 1319944 - RNA, 19 nt, Human
ucuuggccccggccccauc

SEQ ID NO: 1319945 - RNA, 25 nt, Human
ucuuggccccggccccauccacggc

SEQ ID NO: 1319946 - RNA, 20 nt, Human
uggguccucugcacggagac

SEQ ID NO: 1319947 - RNA, 18 nt, Human
uggucagugaauuccuga

SEQ ID NO: 1319948 - RNA, 20 nt, Human
uggugaauacagucuccuuc

SEQ ID NO: 1319949 - RNA, 23 nt, Human
uuggugacgggcauccgcuccuu

SEQ ID NO: 1319950 - RNA, 24 nt, Human
aaugcuccagaguccccgggcggc

SEQ ID NO: 1319951 - RNA, 18 nt, Human
acccgggccccaacccgg

SEQ ID NO: 1319952 - RNA, 21 nt, Human
acccgggccccaacccggcuc

SEQ ID NO: 1319953 - RNA, 21 nt, Human
aucccgcacgccucuccgcua

SEQ ID NO: 1319954 - RNA, 22 nt, Human
cagaguccccgggcggcccaac

SEQ ID NO: 1319955 - RNA, 25 nt, Human
cccaacccgggccccaacccggcuc

SEQ ID NO: 1319956 - RNA, 19 nt, Human
cccaaugcuccagaguccc

SEQ ID NO: 1319957 - RNA, 25 nt, Human
ccccgggcggcccaacccgggcccc

SEQ ID NO: 1319958 - RNA, 19 nt, Human
cccgcacgccucuccgcua

SEQ ID NO: 1319959 - RNA, 25 nt, Human
cccgcacgccucuccgcuacagccg

SEQ ID NO: 1319960 - RNA, 21 nt, Human
cucuccgcuacagccgccuac

SEQ ID NO: 1319961 - RNA, 19 nt, Human
gggccccaacccggcucag

SEQ ID NO: 1319962 - RNA, 19 nt, Human
uccccgggcggcccaaccc

SEQ ID NO: 1319963 - RNA, 24 nt, Human
uccccgggcggcccaacccgggcc

SEQ ID NO: 1319964 - RNA, 21 nt, Human
ucccgcacgccucuccgcuac

SEQ ID NO: 1319965 - RNA, 21 nt, Human
ucuccgcuacagccgccuacc

SEQ ID NO: 1319966 - RNA, 27 nt, Human
ucuccgcuacagccgccuacccagagg

SEQ ID NO: 1319967 - RNA, 22 nt, Human
aaaaaaaaaaagaaucucagag

SEQ ID NO: 1319968 - RNA, 20 nt, Human
aacagagcgagacuguaauc

SEQ ID NO: 1319969 - RNA, 23 nt, Human
aagaauugcuugaaccugggagg

SEQ ID NO: 1319970 - RNA, 22 nt, Human
aagagccuccuuuacagguuaa

SEQ ID NO: 1319971 - RNA, 24 nt, Human
aauugcuugaaccugggaggcgga

SEQ ID NO: 1319972 - RNA, 24 nt, Human
agacugaggcagaagaauugcuug

SEQ ID NO: 1319973 - RNA, 23 nt, Human
agagccuccuuuacagguuaaaa

SEQ ID NO: 1319974 - RNA, 24 nt, Human
agcacuuugggagacugagauggg

SEQ ID NO: 1319975 - RNA, 24 nt, Human
agccugggcaacauagggagaccc

SEQ ID NO: 1319976 - RNA, 22 nt, Human
aggcagaagaauugcuugaacc

SEQ ID NO: 1319977 - RNA, 24 nt, Human
aggcagaagaauugcuugaaccug

SEQ ID NO: 1319978 - RNA, 19 nt, Human
aggcggagcuugcaguaag

SEQ ID NO: 1319979 - RNA, 24 nt, Human
aggcggagcuugcaguaagccaag

SEQ ID NO: 1319980 - RNA, 24 nt, Human
cagcacuuugggagacugagaugg

SEQ ID NO: 1319981 - RNA, 24 nt, Human
cauugcuugagcccaggaguugga

SEQ ID NO: 1319982 - RNA, 27 nt, Human
cauugcuugagcccaggaguuggaguu

SEQ ID NO: 1319983 - RNA, 21 nt, Human
ccuauaaucccagcugcuugg

SEQ ID NO: 1319984 - RNA, 18 nt, Human
ccugcaaaaccuccucug

SEQ ID NO: 1319985 - RNA, 18 nt, Human
ccugcaaaaccuccucug

SEQ ID NO: 1319986 - RNA, 22 nt, Human
ccugcucccucccuugccuucu

SEQ ID NO: 1319987 - RNA, 24 nt, Human
ccugggcaacauagggagacccca

SEQ ID NO: 1319988 - RNA, 24 nt, Human
cgagacuguaaucucagcacuuug

SEQ ID NO: 1319989 - RNA, 23 nt, Human
cuguacuccagacugggcaacag

SEQ ID NO: 1319990 - RNA, 19 nt, Human
cuugaaccugggaggcgga

SEQ ID NO: 1319991 - RNA, 18 nt, Human
gagcuugcaguaagccaa

SEQ ID NO: 1319992 - RNA, 20 nt, Human
ggagcauugcuugagcccag

SEQ ID NO: 1319993 - RNA, 22 nt, Human
ggaguuggaguucagccugggc

SEQ ID NO: 1319994 - RNA, 24 nt, Human
ggccuauaaucccagcugcuuggg

SEQ ID NO: 1319995 - RNA, 19 nt, Human
gguuaaaaaaaaaaaaaaa

SEQ ID NO: 1319996 - RNA, 24 nt, Human
guacuccagacugggcaacagagc

SEQ ID NO: 1319997 - RNA, 22 nt, Human
guuaaaaaaaaaaaaaaagaau

SEQ ID NO: 1319998 - RNA, 24 nt, Human
guuaaaaaaaaaaaaaaagaaucc

SEQ ID NO: 1319999 - RNA, 23 nt, Human
uacuccagacugggcaacagagc

SEQ ID NO: 1320000 - RNA, 24 nt, Human
uacuccagacugggcaacagagcg

SEQ ID NO: 1320001 - RNA, 23 nt, Human
uaggcaaguccugcaaaaccucc

SEQ ID NO: 1320002 - RNA, 19 nt, Human
uaguuuccugccccacauc

SEQ ID NO: 1320003 - RNA, 20 nt, Human
uccucugguucugguuccug

SEQ ID NO: 1320004 - RNA, 20 nt, Human
uccugcaaaaccuccucugg

SEQ ID NO: 1320005 - RNA, 19 nt, Human
uccugccccacaucuaaga

SEQ ID NO: 1320006 - RNA, 25 nt, Human
ugagaugggagcauugcuugagccc

SEQ ID NO: 1320007 - RNA, 23 nt, Human
ugagcccaggaguuggaguucag

SEQ ID NO: 1320008 - RNA, 24 nt, Human
ugaggcagaagaauugcuugaacc

SEQ ID NO: 1320009 - RNA, 24 nt, Human
ugaggcagaagaauugcuugaacc

SEQ ID NO: 1320010 - RNA, 21 nt, Human
ugggagacugagaugggagca

SEQ ID NO: 1320011 - RNA, 26 nt, Human
ugggagacugaggcagaagaauugcu

SEQ ID NO: 1320012 - RNA, 19 nt, Human
ugggagcauugcuugagcc

SEQ ID NO: 1320013 - RNA, 29 nt, Human
ugggaggcggagcuugcaguaacaacggu

SEQ ID NO: 1320014 - RNA, 22 nt, Human
ugggcaacauagggagacccca

SEQ ID NO: 1320015 - RNA, 22 nt, Human
ugggcucacucugacgccugga

SEQ ID NO: 1320016 - RNA, 18 nt, Human
ugguucugguuccugcuc

SEQ ID NO: 1320017 - RNA, 22 nt, Human
uuaaaaaaaaaaaaaaagaauc

SEQ ID NO: 1320018 - RNA, 19 nt, Human
uugaaccugggaggcggag

SEQ ID NO: 1320019 - RNA, 18 nt, Human
uugcuugaaccugggagg

SEQ ID NO: 1320020 - RNA, 23 nt, Human
uugcuugaaccugggaggcggag

SEQ ID NO: 1320021 - RNA, 21 nt, Human
uugcuugagcccaggaguugg

SEQ ID NO: 1320022 - RNA, 21 nt, Human
uugggagacugagaugggagc

SEQ ID NO: 1320023 - RNA, 23 nt, Human
uugggagacugaggcagaagaau

SEQ ID NO: 1320024 - RNA, 25 nt, Human
caucuccauguccaacuguuggggg

SEQ ID NO: 1320025 - RNA, 19 nt, Human
gaaggaagugucuuacugc

SEQ ID NO: 1320026 - RNA, 21 nt, Human
guggguauuuucaucuccaug

SEQ ID NO: 1320027 - RNA, 18 nt, Human
uacugcuuucauuagucc

SEQ ID NO: 1320028 - RNA, 19 nt, Human
ucuuacugcuuucauuagu

SEQ ID NO: 1320029 - RNA, 23 nt, Human
uggguauuuucaucuccaugucc

SEQ ID NO: 1320030 - RNA, 22 nt, Human
uucaucuccauguccaacuguu

SEQ ID NO: 1320031 - RNA, 21 nt, Human
aaacacuauagauguagauca

SEQ ID NO: 1320032 - RNA, 19 nt, Human
aaccaaccaccuccccgug

SEQ ID NO: 1320033 - RNA, 24 nt, Human
aagaaucucauaguccccagaauu

SEQ ID NO: 1320034 - RNA, 25 nt, Human
aagauuaaaagucgcagggcaggcc

SEQ ID NO: 1320035 - RNA, 21 nt, Human
aagggcuccgcccccagguga

SEQ ID NO: 1320036 - RNA, 23 nt, Human
accaaccaccuccccguguucag

SEQ ID NO: 1320037 - RNA, 21 nt, Human
acugccccacucggguggaag

SEQ ID NO: 1320038 - RNA, 29 nt, Human
agacacaaggcgaagauagaagggacccc

SEQ ID NO: 1320039 - RNA, 20 nt, Human
agcagacaguagaggucaaa

SEQ ID NO: 1320040 - RNA, 19 nt, Human
agcccugggccaggucucc

SEQ ID NO: 1320041 - RNA, 20 nt, Human
agccuccagccacgucccag

SEQ ID NO: 1320042 - RNA, 21 nt, Human
aggccaaggcgggcgggucac

SEQ ID NO: 1320043 - RNA, 23 nt, Human
aggcgggcgggucaccugaggcc

SEQ ID NO: 1320044 - RNA, 24 nt, Human
aggugcaguggcucaugccuguaa

SEQ ID NO: 1320045 - RNA, 23 nt, Human
aguggcucaugccuguaauccca

SEQ ID NO: 1320046 - RNA, 24 nt, Human
aguggcucaugccuguaaucccag

SEQ ID NO: 1320047 - RNA, 19 nt, Human
augccuguaaucccagcac

SEQ ID NO: 1320048 - RNA, 27 nt, Human
caaaaccaaccaccuccccguguucag

SEQ ID NO: 1320049 - RNA, 21 nt, Human
caaagcggcuggauuuggcac

SEQ ID NO: 1320050 - RNA, 22 nt, Human
caacccaucugggcuguaccgg

SEQ ID NO: 1320051 - RNA, 19 nt, Human
caaggcgggcgggucaccu

SEQ ID NO: 1320052 - RNA, 26 nt, Human
caaggcgggcgggucaccugaggcca

SEQ ID NO: 1320053 - RNA, 21 nt, Human
caagggauaaacuuggguuuc

SEQ ID NO: 1320054 - RNA, 19 nt, Human
caccacucagcacuguccc

SEQ ID NO: 1320055 - RNA, 23 nt, Human
cacucagcacugucccgucccuc

SEQ ID NO: 1320056 - RNA, 20 nt, Human
cacugagagcugcucauugc

SEQ ID NO: 1320057 - RNA, 19 nt, Human
cacuguaccagccggcggu

SEQ ID NO: 1320058 - RNA, 21 nt, Human
cagcacagagaccagucuccu

SEQ ID NO: 1320059 - RNA, 24 nt, Human
cagcacuuugggaggccaaggcgg

SEQ ID NO: 1320060 - RNA, 19 nt, Human
cagccuccagccacguccc

SEQ ID NO: 1320061 - RNA, 27 nt, Human
cagcucagagccaagcccuucagcaag

SEQ ID NO: 1320062 - RNA, 23 nt, Human
caucaaugacaucagacacgauc

SEQ ID NO: 1320063 - RNA, 20 nt, Human
caugccuguaaucccagcac

SEQ ID NO: 1320064 - RNA, 20 nt, Human
ccaaaaccaaccaccucccc

SEQ ID NO: 1320065 - RNA, 23 nt, Human
ccaaaaccaaccaccuccccgug

SEQ ID NO: 1320066 - RNA, 23 nt, Human
ccaauggccagguacaacccauc

SEQ ID NO: 1320067 - RNA, 26 nt, Human
ccauccggaaggaacacaaagcaagg

SEQ ID NO: 1320068 - RNA, 20 nt, Human
cccacaggcagagcugccgg

SEQ ID NO: 1320069 - RNA, 19 nt, Human
cccaccagcagcucagagc

SEQ ID NO: 1320070 - RNA, 19 nt, Human
cccaguaaagaaucucaua

SEQ ID NO: 1320071 - RNA, 23 nt, Human
cccaguaaagaaucucauagucc

SEQ ID NO: 1320072 - RNA, 19 nt, Human
cccauacagcggccaaagc

SEQ ID NO: 1320073 - RNA, 22 nt, Human
ccccucagcaggcagcgggagu

SEQ ID NO: 1320074 - RNA, 24 nt, Human
ccccucugagucuccagugagaau

SEQ ID NO: 1320075 - RNA, 21 nt, Human
cccgcccgccaccacucagca

SEQ ID NO: 1320076 - RNA, 21 nt, Human
cccucagcaaugcauucuucg

SEQ ID NO: 1320077 - RNA, 28 nt, Human
ccuccggagacacaaggcgaagauagag

SEQ ID NO: 1320078 - RNA, 18 nt, Human
ccucugagucuccaguga

SEQ ID NO: 1320079 - RNA, 19 nt, Human
ccucugagucuccagugag

SEQ ID NO: 1320080 - RNA, 21 nt, Human
ccuggauuacaggggagaagc

SEQ ID NO: 1320081 - RNA, 20 nt, Human
ccuguaaucccagcacuuug

SEQ ID NO: 1320082 - RNA, 24 nt, Human
cggaaggaacacaaagcaagggau

SEQ ID NO: 1320083 - RNA, 21 nt, Human
cggccccgaagugcucgggaa

SEQ ID NO: 1320084 - RNA, 24 nt, Human
cgggcgggucaccugaggccagga

SEQ ID NO: 1320085 - RNA, 24 nt, Human
cgggucaccugaggccaggaguuu

SEQ ID NO: 1320086 - RNA, 25 nt, Human
cucagcacugucccgucccuccgga

SEQ ID NO: 1320087 - RNA, 20 nt, Human
cucauagcgauucuucagcu

SEQ ID NO: 1320088 - RNA, 23 nt, Human
cucaugccuguaaucccagcacu

SEQ ID NO: 1320089 - RNA, 24 nt, Human
cucaugccuguaaucccagcacuu

SEQ ID NO: 1320090 - RNA, 23 nt, Human
cuccagugagaaugucuccaucc

SEQ ID NO: 1320091 - RNA, 23 nt, Human
cucuuuggcgccaccccugccug

SEQ ID NO: 1320092 - RNA, 23 nt, Human
cugcuugcagccuccagccacgu

SEQ ID NO: 1320093 - RNA, 18 nt, Human
cuugcagccuccagccac

SEQ ID NO: 1320094 - RNA, 19 nt, Human
gacaguagaggucaaaggg

SEQ ID NO: 1320095 - RNA, 21 nt, Human
gacaugaugaaauucccaucc

SEQ ID NO: 1320096 - RNA, 23 nt, Human
gagaagcccugggccaggucucc

SEQ ID NO: 1320097 - RNA, 18 nt, Human
gagcugccggucguggcc

SEQ ID NO: 1320098 - RNA, 21 nt, Human
gagggccaccaacccgggccc

SEQ ID NO: 1320099 - RNA, 23 nt, Human
gauucuucagcugcuugcagccu

SEQ ID NO: 1320100 - RNA, 24 nt, Human
gcaggccaggugcaguggcucaug

SEQ ID NO: 1320101 - RNA, 23 nt, Human
gccuaggcuggggcugcccggcu

SEQ ID NO: 1320102 - RNA, 24 nt, Human
gccuaggcuggggcugcccggcuc

SEQ ID NO: 1320103 - RNA, 18 nt, Human
gcggccaaagcggcugga

SEQ ID NO: 1320104 - RNA, 20 nt, Human
gcucaucaguguggcccugg

SEQ ID NO: 1320105 - RNA, 18 nt, Human
ggcaccaucacuggaaac

SEQ ID NO: 1320106 - RNA, 21 nt, Human
ggcaggccaggugcaguggcu

SEQ ID NO: 1320107 - RNA, 23 nt, Human
ggcaggccaggugcaguggcuca

SEQ ID NO: 1320108 - RNA, 18 nt, Human
gggcccccacuguaccag

SEQ ID NO: 1320109 - RNA, 22 nt, Human
gggucaccugaggccaggaguu

SEQ ID NO: 1320110 - RNA, 23 nt, Human
ggguggaagucagcacagagacc

SEQ ID NO: 1320111 - RNA, 18 nt, Human
ggucaccugaggccagga

SEQ ID NO: 1320112 - RNA, 19 nt, Human
gugaggaagcgguucuggg

SEQ ID NO: 1320113 - RNA, 24 nt, Human
guucugguuuauugccccucagca

SEQ ID NO: 1320114 - RNA, 18 nt, Human
ucaccugaggccaggagu

SEQ ID NO: 1320115 - RNA, 21 nt, Human
ucagcugcuugcagccuccag

SEQ ID NO: 1320116 - RNA, 25 nt, Human
ucaguguggcccuggauuacagggg

SEQ ID NO: 1320117 - RNA, 21 nt, Human
ucaugggaaccaauggccagg

SEQ ID NO: 1320118 - RNA, 18 nt, Human
uccaaaaccaaccaccuc

SEQ ID NO: 1320119 - RNA, 19 nt, Human
ucccacaggcagagcugcc

SEQ ID NO: 1320120 - RNA, 22 nt, Human
ucccacaggcagagcugccggu

SEQ ID NO: 1320121 - RNA, 21 nt, Human
ucccaguaaagaaucucauag

SEQ ID NO: 1320122 - RNA, 19 nt, Human
uccccagaauuggacauga

SEQ ID NO: 1320123 - RNA, 18 nt, Human
uccccguguucaguccua

SEQ ID NO: 1320124 - RNA, 24 nt, Human
uccuacggccacaacugccccacu

SEQ ID NO: 1320125 - RNA, 20 nt, Human
ucuuggaaucugaagggcuc

SEQ ID NO: 1320126 - RNA, 21 nt, Human
ucuuguauuucuagugggagg

SEQ ID NO: 1320127 - RNA, 27 nt, Human
ucuuuggcgccaccccugccugggguc

SEQ ID NO: 1320128 - RNA, 20 nt, Human
ugagugaugaagcuggagug

SEQ ID NO: 1320129 - RNA, 21 nt, Human
ugagugaugaagcuggaguga

SEQ ID NO: 1320130 - RNA, 19 nt, Human
ugcagagcccccagagcuc

SEQ ID NO: 1320131 - RNA, 19 nt, Human
ugccccacucggguggaag

SEQ ID NO: 1320132 - RNA, 19 nt, Human
ugcccggcucagccagcgg

SEQ ID NO: 1320133 - RNA, 23 nt, Human
ugccuguaaucccagcacuuugg

SEQ ID NO: 1320134 - RNA, 24 nt, Human
ugccuguaaucccagcacuuuggg

SEQ ID NO: 1320135 - RNA, 18 nt, Human
uggagggccaccaacccg

SEQ ID NO: 1320136 - RNA, 22 nt, Human
uggcucaugccuguaaucccag

SEQ ID NO: 1320137 - RNA, 24 nt, Human
uggcucaugccuguaaucccagca

SEQ ID NO: 1320138 - RNA, 20 nt, Human
ugggaggccaaggcgggcgg

SEQ ID NO: 1320139 - RNA, 24 nt, Human
ugggaggccaaggcgggcggguca

SEQ ID NO: 1320140 - RNA, 18 nt, Human
ugggaggggagagcagac

SEQ ID NO: 1320141 - RNA, 19 nt, Human
uguccaaaaccaaccaccu

SEQ ID NO: 1320142 - RNA, 27 nt, Human
uguccaaaaccaaccacuaccauaggg

SEQ ID NO: 1320143 - RNA, 21 nt, Human
ugucccgucccuccggagaca

SEQ ID NO: 1320144 - RNA, 21 nt, Human
uguguccaaaaccaaccaccu

SEQ ID NO: 1320145 - RNA, 21 nt, Human
ugugugcagagcccccagagc

SEQ ID NO: 1320146 - RNA, 19 nt, Human
uuacaggggagaagcccug

SEQ ID NO: 1320147 - RNA, 22 nt, Human
uucuucagcugcuugcagccuc

SEQ ID NO: 1320148 - RNA, 21 nt, Human
cauucccacagccacguucug

SEQ ID NO: 1320149 - RNA, 18 nt, Human
ggagcuccucacauuccc

SEQ ID NO: 1320150 - RNA, 22 nt, Human
ucccuggcagauggaugagauc

SEQ ID NO: 1320151 - RNA, 20 nt, Human
uccucacauucccacagcca

SEQ ID NO: 1320152 - RNA, 22 nt, Human
uccucacauucccacagccacg

SEQ ID NO: 1320153 - RNA, 22 nt, Human
uguccugguggucacaacacau

SEQ ID NO: 1320154 - RNA, 23 nt, Human
agacaccaugccugguuucugcu

SEQ ID NO: 1320155 - RNA, 19 nt, Human
ccaguccugccuguggguc

SEQ ID NO: 1320156 - RNA, 20 nt, Human
ccugccugugggucuuccuc

SEQ ID NO: 1320157 - RNA, 20 nt, Human
ggccaguccugccugugggu

SEQ ID NO: 1320158 - RNA, 18 nt, Human
gugggucuuccucagucu

SEQ ID NO: 1320159 - RNA, 19 nt, Human
uaacuccucucugcuucuc

SEQ ID NO: 1320160 - RNA, 23 nt, Human
uccucagucucaucagugucuuc

SEQ ID NO: 1320161 - RNA, 21 nt, Human
ugccugugggucuuccucagu

SEQ ID NO: 1320162 - RNA, 23 nt, Human
uuuaacuccucucugcuucucaa

SEQ ID NO: 1320163 - RNA, 20 nt, Human
aagcaugggggcugggaaag

SEQ ID NO: 1320164 - RNA, 24 nt, Human
acucacccaaggccaguaugcaaa

SEQ ID NO: 1320165 - RNA, 19 nt, Human
aggaaggggccuagcugac

SEQ ID NO: 1320166 - RNA, 21 nt, Human
aggaggaaggggccuagcuga

SEQ ID NO: 1320167 - RNA, 25 nt, Human
aggaugaagacagaccgaaaaggga

SEQ ID NO: 1320168 - RNA, 20 nt, Human
aggcaggaugaagacagacc

SEQ ID NO: 1320169 - RNA, 23 nt, Human
aguagcuucaacacggucuugca

SEQ ID NO: 1320170 - RNA, 18 nt, Human
cacccaaggccaguaugc

SEQ ID NO: 1320171 - RNA, 20 nt, Human
caccgcaagcuaugcaggag

SEQ ID NO: 1320172 - RNA, 23 nt, Human
cagcuuccucuucagauccuugg

SEQ ID NO: 1320173 - RNA, 21 nt, Human
caguacaggccggagcacucu

SEQ ID NO: 1320174 - RNA, 18 nt, Human
ccaguaugcaagcaugac

SEQ ID NO: 1320175 - RNA, 18 nt, Human
ccauggggccugcaaggc

SEQ ID NO: 1320176 - RNA, 25 nt, Human
cccaagcaucaaacauagguagaca

SEQ ID NO: 1320177 - RNA, 23 nt, Human
ccgaagcugucccaugaccagca

SEQ ID NO: 1320178 - RNA, 22 nt, Human
cugcugaaccagcccagugcau

SEQ ID NO: 1320179 - RNA, 20 nt, Human
cuucagauccuuggaagcca

SEQ ID NO: 1320180 - RNA, 23 nt, Human
gagcagcugaucauuauagccaa

SEQ ID NO: 1320181 - RNA, 20 nt, Human
gcauccccacagagcuacag

SEQ ID NO: 1320182 - RNA, 20 nt, Human
gccaucaccucaccaccgca

SEQ ID NO: 1320183 - RNA, 18 nt, Human
ggagaagagauccaugcu

SEQ ID NO: 1320184 - RNA, 22 nt, Human
ggcugggaaaggggguccuggg

SEQ ID NO: 1320185 - RNA, 22 nt, Human
gggaaaggggguccugggggug

SEQ ID NO: 1320186 - RNA, 23 nt, Human
ggguccuggggguggaaacccgc

SEQ ID NO: 1320187 - RNA, 21 nt, Human
ggugaggggcuacaaggucag

SEQ ID NO: 1320188 - RNA, 25 nt, Human
ucaccucaccaccgcaagcuaugca

SEQ ID NO: 1320189 - RNA, 24 nt, Human
ucaguacaggccggagcacucuga

SEQ ID NO: 1320190 - RNA, 24 nt, Human
uccccacagagcuacaguggagac

SEQ ID NO: 1320191 - RNA, 21 nt, Human
ugagaagagaugccuugaaga

SEQ ID NO: 1320192 - RNA, 22 nt, Human
ugccaucaccucaccaccgcaa

SEQ ID NO: 1320193 - RNA, 18 nt, Human
uggggagagaaggugagg

SEQ ID NO: 1320194 - RNA, 23 nt, Human
ugggggcugggaaaggggguccu

SEQ ID NO: 1320195 - RNA, 24 nt, Human
uggggugucuucugagccacuggu

SEQ ID NO: 1320196 - RNA, 18 nt, Human
uggugauggucauuugca

SEQ ID NO: 1320197 - RNA, 22 nt, Human
ugucuucugagccacugguccc

SEQ ID NO: 1320198 - RNA, 20 nt, Human
uuggagaagagauccaugcu

SEQ ID NO: 1320199 - RNA, 22 nt, Human
uuucuagccccaagcaucaaac

SEQ ID NO: 1320200 - RNA, 20 nt, Human
aagcagcuucauuuuccucu

SEQ ID NO: 1320201 - RNA, 24 nt, Human
aggcagagaugaacuucaacaggg

SEQ ID NO: 1320202 - RNA, 20 nt, Human
caucucugcucucaggcagg

SEQ ID NO: 1320203 - RNA, 18 nt, Human
uaagugaagacuuugcca

SEQ ID NO: 1320204 - RNA, 21 nt, Human
ucagggaggagccucaggcag

SEQ ID NO: 1320205 - RNA, 24 nt, Human
ucucaggcagguguccuucaggga

SEQ ID NO: 1320206 - RNA, 19 nt, Human
aacugugucacagugccaa

SEQ ID NO: 1320207 - RNA, 23 nt, Human
ugucacagugccaaacugggaga

SEQ ID NO: 1320208 - RNA, 22 nt, Human
aagggaacaaggaaaacaugga

SEQ ID NO: 1320209 - RNA, 24 nt, Human
acaaggaaaacauggaacccaaaa

SEQ ID NO: 1320210 - RNA, 18 nt, Human
aggauacugugagcaaau

SEQ ID NO: 1320211 - RNA, 18 nt, Human
auggaacccaaagggaaa

SEQ ID NO: 1320212 - RNA, 26 nt, Human
cccaaagggaaaugcagugagagcac

SEQ ID NO: 1320213 - RNA, 19 nt, Human
gaacaaggaaaacauggaa

SEQ ID NO: 1320214 - RNA, 19 nt, Human
ggaaaacauggaacccaaa

SEQ ID NO: 1320215 - RNA, 19 nt, Human
gggaacaaggaaaacaugg

SEQ ID NO: 1320216 - RNA, 21 nt, Human
ggugguuaagauaaaacacaa

SEQ ID NO: 1320217 - RNA, 21 nt, Human
gucaaacuuauuagagggucc

SEQ ID NO: 1320218 - RNA, 19 nt, Human
uaagauaaaacacaaguca

SEQ ID NO: 1320219 - RNA, 25 nt, Human
ugagcaaaugggguggaggggugcu

SEQ ID NO: 1320220 - RNA, 19 nt, Human
uggaagggaacaaggaaaa

SEQ ID NO: 1320221 - RNA, 26 nt, Human
ugggguggaggggugcucucuugagc

SEQ ID NO: 1320222 - RNA, 18 nt, Human
auagaacacguauguaca

SEQ ID NO: 1320223 - RNA, 18 nt, Human
cgcuagcuggggacugcg

SEQ ID NO: 1320224 - RNA, 20 nt, Human
cgggagccgcgcuggacagg

SEQ ID NO: 1320225 - RNA, 21 nt, Human
ggcgggagccgcgcuggacag

SEQ ID NO: 1320226 - RNA, 21 nt, Human
uccaagcaacauuuauugagg

SEQ ID NO: 1320227 - RNA, 27 nt, Human
ugcccucggcguccagacgccaggcuc

SEQ ID NO: 1320228 - RNA, 20 nt, Human
aagucagcuuccagagcuga

SEQ ID NO: 1320229 - RNA, 19 nt, Human
acacagaggagccucucga

SEQ ID NO: 1320230 - RNA, 24 nt, Human
accagguacucuucgguggugacu

SEQ ID NO: 1320231 - RNA, 28 nt, Human
acuuuaagagaaaccagcauaacaggga

SEQ ID NO: 1320232 - RNA, 20 nt, Human
agagaaaccagcauaacagg

SEQ ID NO: 1320233 - RNA, 25 nt, Human
aggcagaagauaaucuugggaucug

SEQ ID NO: 1320234 - RNA, 19 nt, Human
aggcagucaucuucagaag

SEQ ID NO: 1320235 - RNA, 19 nt, Human
auugguaaggcagaagaua

SEQ ID NO: 1320236 - RNA, 22 nt, Human
caaaaggcaaagauucacaagu

SEQ ID NO: 1320237 - RNA, 20 nt, Human
caaacucagucccgccccuu

SEQ ID NO: 1320238 - RNA, 18 nt, Human
cacccggcagccucuccc

SEQ ID NO: 1320239 - RNA, 22 nt, Human
cagcuuccagagcugaggcaaa

SEQ ID NO: 1320240 - RNA, 20 nt, Human
caggguucaccagguacucu

SEQ ID NO: 1320241 - RNA, 23 nt, Human
ccaaaaccugaagguuuccuccc

SEQ ID NO: 1320242 - RNA, 25 nt, Human
ccggcagccucucccacuguccucu

SEQ ID NO: 1320243 - RNA, 20 nt, Human
ccuccagaacucuccuuggg

SEQ ID NO: 1320244 - RNA, 18 nt, Human
ccuccccugcaugcagcc

SEQ ID NO: 1320245 - RNA, 19 nt, Human
ccuccuggcccagccuuuc

SEQ ID NO: 1320246 - RNA, 21 nt, Human
ccucugggggaccgccgguuu

SEQ ID NO: 1320247 - RNA, 22 nt, Human
ccuucugcugugaaucucuaac

SEQ ID NO: 1320248 - RNA, 22 nt, Human
ccuucuuucauccuuugaaccc

SEQ ID NO: 1320249 - RNA, 20 nt, Human
cucguuaugcaaauaggacc

SEQ ID NO: 1320250 - RNA, 20 nt, Human
cugaggcaaacaaggcucac

SEQ ID NO: 1320251 - RNA, 21 nt, Human
cugaggcaaacaaggcucaca

SEQ ID NO: 1320252 - RNA, 22 nt, Human
cuggccaguauggauuuucucu

SEQ ID NO: 1320253 - RNA, 20 nt, Human
cuguggccuccuggcccagc

SEQ ID NO: 1320254 - RNA, 21 nt, Human
cuuccagagcugaggcaaaca

SEQ ID NO: 1320255 - RNA, 19 nt, Human
gaacccuccagaacucucc

SEQ ID NO: 1320256 - RNA, 23 nt, Human
gaggcagucaucuucagaaguca

SEQ ID NO: 1320257 - RNA, 20 nt, Human
gauguuaaaaaucacaggcu

SEQ ID NO: 1320258 - RNA, 23 nt, Human
gcagauuuucuuuucucaaacuc

SEQ ID NO: 1320259 - RNA, 18 nt, Human
uagaggcagauggugcug

SEQ ID NO: 1320260 - RNA, 23 nt, Human
uagaggcagauggugcugagggg

SEQ ID NO: 1320261 - RNA, 24 nt, Human
uauggauuuucucucuaagguugu

SEQ ID NO: 1320262 - RNA, 19 nt, Human
ucagucccgccccuuguuc

SEQ ID NO: 1320263 - RNA, 22 nt, Human
ucauuugcuucaauuaaauuuu

SEQ ID NO: 1320264 - RNA, 23 nt, Human
uccagagcugaggcaaacaaggc

SEQ ID NO: 1320265 - RNA, 28 nt, Human
ucccugcagagaccgcagggacaaaggu

SEQ ID NO: 1320266 - RNA, 21 nt, Human
ucgguggugacugucuugacu

SEQ ID NO: 1320267 - RNA, 23 nt, Human
ucugccacccggcagccucuccc

SEQ ID NO: 1320268 - RNA, 24 nt, Human
ugaggcaaacaaggcucacaugga

SEQ ID NO: 1320269 - RNA, 21 nt, Human
ugcaaauaggacccacuuuaa

SEQ ID NO: 1320270 - RNA, 23 nt, Human
ugcugaggggguugucccugcag

SEQ ID NO: 1320271 - RNA, 23 nt, Human
uggauuuucucucuaagguuguc

SEQ ID NO: 1320272 - RNA, 19 nt, Human
uggccuccuggcccagccu

SEQ ID NO: 1320273 - RNA, 21 nt, Human
ugggaucuguuguuuuggguu

SEQ ID NO: 1320274 - RNA, 19 nt, Human
uggugaccaaaaccugaag

SEQ ID NO: 1320275 - RNA, 20 nt, Human
uggugcugugggaugcagag

SEQ ID NO: 1320276 - RNA, 26 nt, Human
uggugcugugggaugcagaggggccu

SEQ ID NO: 1320277 - RNA, 25 nt, Human
uggugguugugucucugccacccgg

SEQ ID NO: 1320278 - RNA, 23 nt, Human
uuagaggcagauggugcugaggg

SEQ ID NO: 1320279 - RNA, 22 nt, Human
uuagggcccucuguggccuccu

SEQ ID NO: 1320280 - RNA, 19 nt, Human
uuggugguugugucucugc

SEQ ID NO: 1320281 - RNA, 23 nt, Human
uuuauaaaaagaccacgucucug

SEQ ID NO: 1320282 - RNA, 24 nt, Human
caguuuccucucccuuuucccuuc

SEQ ID NO: 1320283 - RNA, 24 nt, Human
cucucccuuuucccuucauuggca

SEQ ID NO: 1320284 - RNA, 27 nt, Human
guccaguuuccucucccuuuucccuuc

SEQ ID NO: 1320285 - RNA, 19 nt, Human
ucccuuuucccuucauugg

SEQ ID NO: 1320286 - RNA, 19 nt, Human
uccucucccuuuucccuuc

SEQ ID NO: 1320287 - RNA, 24 nt, Human
aacugaaccacauagcagccccag

SEQ ID NO: 1320288 - RNA, 19 nt, Human
cccaggaugcaggcugguu

SEQ ID NO: 1320289 - RNA, 21 nt, Human
gauaagauaacuccuggccuc

SEQ ID NO: 1320290 - RNA, 22 nt, Human
uaagauaacuccuggccuccca

SEQ ID NO: 1320291 - RNA, 22 nt, Human
uagcagccccaggaugcaggga

SEQ ID NO: 1320292 - RNA, 23 nt, Human
uccaggaugagauaagauaacuc

SEQ ID NO: 1320293 - RNA, 19 nt, Human
cccgcagggccuggggccg

SEQ ID NO: 1320294 - RNA, 21 nt, Human
cccguggcagccgcaggcccc

SEQ ID NO: 1320295 - RNA, 19 nt, Human
ccgcaggccccagucaccc

SEQ ID NO: 1320296 - RNA, 19 nt, Human
cggcguccguucucaaccc

SEQ ID NO: 1320297 - RNA, 19 nt, Human
uaagcugugagguggugga

SEQ ID NO: 1320298 - RNA, 22 nt, Human
uaucagagauaagcugugaggu

SEQ ID NO: 1320299 - RNA, 21 nt, Human
uccccguggcagccgcaggcc

SEQ ID NO: 1320300 - RNA, 24 nt, Human
uggaugcggcguccguucucaacc

SEQ ID NO: 1320301 - RNA, 22 nt, Human
uggggccgggccucggccucuu

SEQ ID NO: 1320302 - RNA, 25 nt, Human
aaaaaaccuccaucagauccucaau

SEQ ID NO: 1320303 - RNA, 26 nt, Human
aaacagucaagugaagaugauaaagc

SEQ ID NO: 1320304 - RNA, 21 nt, Human
aacagaaaauaaauacauaaa

SEQ ID NO: 1320305 - RNA, 23 nt, Human
aaccaaacaaugggcaaccuccc

SEQ ID NO: 1320306 - RNA, 26 nt, Human
aaggaacaccuggcccacccagccca

SEQ ID NO: 1320307 - RNA, 19 nt, Human
aaugacuugcaacaucuuc

SEQ ID NO: 1320308 - RNA, 19 nt, Human
acaaacaauagcaugagcc

SEQ ID NO: 1320309 - RNA, 24 nt, Human
acaaacaauagcaugagcgaucug

SEQ ID NO: 1320310 - RNA, 18 nt, Human
acaccuggcccacccagc

SEQ ID NO: 1320311 - RNA, 24 nt, Human
acagaaaauaaauacauaaaaaac

SEQ ID NO: 1320312 - RNA, 30 nt, Human; identical to SEQ ID NO: 487367

SEQ ID NO: 1320313 - RNA, 26 nt, Human
acaugcaccacagaccagccagcucc

SEQ ID NO: 1320314 - RNA, 19 nt, Human
acccugcaaggucaaagag

SEQ ID NO: 1320315 - RNA, 19 nt, Human
acccugcaaggucaaagag

SEQ ID NO: 1320316 - RNA, 21 nt, Human
acuugcaacaucuuccaacuc

SEQ ID NO: 1320317 - RNA, 24 nt, Human
agaaaaaggaaugacuugcaacau

SEQ ID NO: 1320318 - RNA, 22 nt, Human
agaagcagcuaucugucagggg

SEQ ID NO: 1320319 - RNA, 20 nt, Human
agacuaaauuuacaacagca

SEQ ID NO: 1320320 - RNA, 26 nt, Human
agucaagugaagaugauaaagccaaa

SEQ ID NO: 1320321 - RNA, 19 nt, Human
aguuaacuagcccaaccua

SEQ ID NO: 1320322 - RNA, 18 nt, Human
auaaacuggccccaaaac

SEQ ID NO: 1320323 - RNA, 22 nt, Human
auaaacuggccccaaaacuggc

SEQ ID NO: 1320324 - RNA, 25 nt, Human
aucuucuucacacccugcaagguca

SEQ ID NO: 1320325 - RNA, 18 nt, Human
augcaccacagaccagcc

SEQ ID NO: 1320326 - RNA, 25 nt, Human
caaaaucucugcagcacuguaacau

SEQ ID NO: 1320327 - RNA, 20 nt, Human
caacaguguuuaaauguggu

SEQ ID NO: 1320328 - RNA, 26 nt, Human
caaccaaacaaugggcaaccucccag

SEQ ID NO: 1320329 - RNA, 23 nt, Human
caaccucccaguucuucaguccc

SEQ ID NO: 1320330 - RNA, 23 nt, Human
caagcccccaaaauccagccaua

SEQ ID NO: 1320331 - RNA, 19 nt, Human
caagcugaacagaaaauaa

SEQ ID NO: 1320332 - RNA, 23 nt, Human
cacaaacaauagcaugagcgauc

SEQ ID NO: 1320333 - RNA, 20 nt, Human
cacaugcaccacagaccagg

SEQ ID NO: 1320334 - RNA, 24 nt, Human
caccuggcccacccagcccagagu

SEQ ID NO: 1320335 - RNA, 18 nt, Human
cagccagcucccugggua

SEQ ID NO: 1320336 - RNA, 19 nt, Human
cagccauaaacuggcccca

SEQ ID NO: 1320337 - RNA, 23 nt, Human
cagccauaaacuggccccaaaac

SEQ ID NO: 1320338 - RNA, 20 nt, Human
cagcgcugccagcagagggg

SEQ ID NO: 1320339 - RNA, 21 nt, Human
cagcggcgcggguccugcagc

SEQ ID NO: 1320340 - RNA, 24 nt, Human
cauuuuugucauucagcuugagag

SEQ ID NO: 1320341 - RNA, 18 nt, Human
cccaaccuaugccuuuaa

SEQ ID NO: 1320342 - RNA, 22 nt, Human
cccacccagcccagaguggaaa

SEQ ID NO: 1320343 - RNA, 21 nt, Human
ccccaaaacuggccauaaaca

SEQ ID NO: 1320344 - RNA, 18 nt, Human
cccuggguaccagagggc

SEQ ID NO: 1320345 - RNA, 19 nt, Human
cccuggguaccagagggcu

SEQ ID NO: 1320346 - RNA, 19 nt, Human
ccuucguuucccauaaggg

SEQ ID NO: 1320347 - RNA, 23 nt, Human
cuaaaggacagaaaaaggaauga

SEQ ID NO: 1320348 - RNA, 28 nt, Human
cugaaaccccaguggacauuuucuccau

SEQ ID NO: 1320349 - RNA, 20 nt, Human
cugaagucaguuucuccucc

SEQ ID NO: 1320350 - RNA, 22 nt, Human
cugagacuaaauuuacaacagc

SEQ ID NO: 1320351 - RNA, 19 nt, Human
cugcagcacuguaacaugu

SEQ ID NO: 1320352 - RNA, 23 nt, Human
cugugugugugucuuuaauuccu

SEQ ID NO: 1320353 - RNA, 21 nt, Human
cuuaagccacaaacaauagca

SEQ ID NO: 1320354 - RNA, 24 nt, Human
cuucaguucuggucacagguuuuu

SEQ ID NO: 1320355 - RNA, 21 nt, Human
gagaccccugauuucccacuu

SEQ ID NO: 1320356 - RNA, 19 nt, Human
gcaacaucuuccaacucug

SEQ ID NO: 1320357 - RNA, 19 nt, Human
gcaaccucccaguucuuca

SEQ ID NO: 1320358 - RNA, 18 nt, Human
gcauggaaggaaauauga

SEQ ID NO: 1320359 - RNA, 19 nt, Human
gccauaaacuggccccaaa

SEQ ID NO: 1320360 - RNA, 24 nt, Human
gccgcaguuaacuagcccaaccua

SEQ ID NO: 1320361 - RNA, 21 nt, Human
gcguggagcugcgcaucuucu

SEQ ID NO: 1320362 - RNA, 18 nt, Human
gggcaaggaacaccuggc

SEQ ID NO: 1320363 - RNA, 22 nt, Human
uaagccacaaacaauagcauga

SEQ ID NO: 1320364 - RNA, 22 nt, Human
uacaaacagucaagugaagaug

SEQ ID NO: 1320365 - RNA, 26 nt, Human
uacaguauuacaaacagucaagugaa

SEQ ID NO: 1320366 - RNA, 24 nt, Human
uacuacaguauuacaaacagucaa

SEQ ID NO: 1320367 - RNA, 23 nt, Human
uagcuucuuagguggaaagcaac

SEQ ID NO: 1320368 - RNA, 25 nt, Human
uagguggaaagcaacuaagucuuuu

SEQ ID NO: 1320369 - RNA, 19 nt, Human
uaugcugaaauaauguaca

SEQ ID NO: 1320370 - RNA, 22 nt, Human
ucagucccuaaaggacagaaaa

SEQ ID NO: 1320371 - RNA, 23 nt, Human
ucaguucuggucacagguuuuua

SEQ ID NO: 1320372 - RNA, 21 nt, Human
ucccuggguaccagagggcuu

SEQ ID NO: 1320373 - RNA, 20 nt, Human
uccuucaguucuggucacag

SEQ ID NO: 1320374 - RNA, 22 nt, Human
uccuucaguucuggucacaggu

SEQ ID NO: 1320375 - RNA, 25 nt, Human
ucucucagcucugaaggcugugaga

SEQ ID NO: 1320376 - RNA, 22 nt, Human
ucuuugagucauucuuuuuggg

SEQ ID NO: 1320377 - RNA, 18 nt, Human
ucuuugguggaagacaag

SEQ ID NO: 1320378 - RNA, 22 nt, Human
ugaaaccccaguggacauuuuc

SEQ ID NO: 1320379 - RNA, 20 nt, Human
ugacuugcaacaucuuccaa

SEQ ID NO: 1320380 - RNA, 24 nt, Human
ugacuugcaacaucuuccaacucu

SEQ ID NO: 1320381 - RNA, 21 nt, Human
ugauuucccacuuuacaccuc

SEQ ID NO: 1320382 - RNA, 23 nt, Human
ugcaguuuucaguuccuagaguc

SEQ ID NO: 1320383 - RNA, 18 nt, Human
uggaagacaagcagcuug

SEQ ID NO: 1320384 - RNA, 19 nt, Human
uggaagacaagcagcuugg

SEQ ID NO: 1320385 - RNA, 22 nt, Human
uggagagaagcagcuaucuguc

SEQ ID NO: 1320386 - RNA, 24 nt, Human
uggccccaaaacuggccauaaaca

SEQ ID NO: 1320387 - RNA, 22 nt, Human
uguucgggucucucagcucuga

SEQ ID NO: 1320388 - RNA, 21 nt, Human
uuaacuagcccaaccuaugcc

SEQ ID NO: 1320389 - RNA, 18 nt, Human
uuagggucucccugacug

SEQ ID NO: 1320390 - RNA, 21 nt, Human
uuguuuuguuuucaaauugug

SEQ ID NO: 1320391 - RNA, 24 nt, Human
uuuucaguuccuagagucuuccuu

SEQ ID NO: 1320392 - RNA, 19 nt, Human
uuuuccgcuuccuggaggc

SEQ ID NO: 1320393 - RNA, 25 nt, Human
aaagagccugaucauugcuuagcaa

SEQ ID NO: 1320394 - RNA, 18 nt, Human
aagagccugaucauugcu

SEQ ID NO: 1320395 - RNA, 18 nt, Human
ccugaaggugagccagag

SEQ ID NO: 1320396 - RNA, 23 nt, Human
ccuuugauauuucaggcugacug

SEQ ID NO: 1320397 - RNA, 19 nt, Human
cuguguggugccugaaggu

SEQ ID NO: 1320398 - RNA, 24 nt, Human
cuuaguggcuuaaaacaauuuauu

SEQ ID NO: 1320399 - RNA, 20 nt, Human
cuuccugacuguguggugcc

SEQ ID NO: 1320400 - RNA, 21 nt, Human
gacuguguggugccugaaggu

SEQ ID NO: 1320401 - RNA, 19 nt, Human
gagucucuuaaucagcuga

SEQ ID NO: 1320402 - RNA, 18 nt, Human
gauauuucaggcugacug

SEQ ID NO: 1320403 - RNA, 19 nt, Human
ugccugaaggugagccaga

SEQ ID NO: 1320404 - RNA, 21 nt, Human
ugccugaaggugagccagagg

SEQ ID NO: 1320405 - RNA, 20 nt, Human
ugcuuagcaagcccuuuugc

SEQ ID NO: 1320406 - RNA, 20 nt, Human
uggcuuaaaacaauuuauua

SEQ ID NO: 1320407 - RNA, 22 nt, Human
aaacaaaugccaccacauccuc

SEQ ID NO: 1320408 - RNA, 18 nt, Human
aaaugccaccacauccuc

SEQ ID NO: 1320409 - RNA, 18 nt, Human
agacaagaagcuaugagc

SEQ ID NO: 1320410 - RNA, 19 nt, Human
augguccaaaugaacagug

SEQ ID NO: 1320411 - RNA, 18 nt, Human
auuuacuacaauaaauaa

SEQ ID NO: 1320412 - RNA, 22 nt, Human
caaccuauaaaggacaauuucc

SEQ ID NO: 1320413 - RNA, 24 nt, Human
caaccuauaaaggacaauuuccua

SEQ ID NO: 1320414 - RNA, 25 nt, Human
ccucugcauuccagcaccaacuaag

SEQ ID NO: 1320415 - RNA, 23 nt, Human
gaaacaaaugccaccacauccuc

SEQ ID NO: 1320416 - RNA, 23 nt, Human
gcaucuuuguguacaaucacucc

SEQ ID NO: 1320417 - RNA, 24 nt, Human
uaugagcaucuuuguguacaaucc

SEQ ID NO: 1320418 - RNA, 20 nt, Human
ucagacaagaagcuaugagc

SEQ ID NO: 1320419 - RNA, 24 nt, Human
ugggaaacaaaugccaccacaucc

SEQ ID NO: 1320420 - RNA, 19 nt, Human
aacagguaggucugcaggc

SEQ ID NO: 1320421 - RNA, 18 nt, Human
aggggcaggaagcaguag

SEQ ID NO: 1320422 - RNA, 19 nt, Human
cagccagccacagcagguu

SEQ ID NO: 1320423 - RNA, 20 nt, Human
ccaccaggucuaggggcagg

SEQ ID NO: 1320424 - RNA, 23 nt, Human
ccaguaguucagagaugcucucu

SEQ ID NO: 1320425 - RNA, 20 nt, Human
ccaugagccccagaggugcc

SEQ ID NO: 1320426 - RNA, 25 nt, Human
ccucuucugugucuaacagggguug

SEQ ID NO: 1320427 - RNA, 24 nt, Human
cuuccauguacgccaguaguucag

SEQ ID NO: 1320428 - RNA, 19 nt, Human
gcaguagugcaccuccucu

SEQ ID NO: 1320429 - RNA, 19 nt, Human
ggcugggauauuuggccac

SEQ ID NO: 1320430 - RNA, 23 nt, Human
guagugcaccuccucuucugugu

SEQ ID NO: 1320431 - RNA, 19 nt, Human
uacacuuccauguacgcca

SEQ ID NO: 1320432 - RNA, 24 nt, Human
uagugcaccuccucuucugugucu

SEQ ID NO: 1320433 - RNA, 25 nt, Human
ugagccccagaggugccuuaucaug

SEQ ID NO: 1320434 - RNA, 22 nt, Human
ugcaccuccucuucugugucua

SEQ ID NO: 1320435 - RNA, 23 nt, Human
uuaauuggaaauucugaggguuu

SEQ ID NO: 1320436 - RNA, 21 nt, Human
aaagguuuggggagauugugc

SEQ ID NO: 1320437 - RNA, 24 nt, Human
aagcagcugacucagcuccucuuc

SEQ ID NO: 1320438 - RNA, 18 nt, Human
ggagaccaacugcugcca

SEQ ID NO: 1320439 - RNA, 31 nt, Human
ucauccaagaauuuagagauucucagucgcu

SEQ ID NO: 1320440 - RNA, 23 nt, Human
ucugcagaugaggcugcugacug

SEQ ID NO: 1320441 - RNA, 19 nt, Human
ugaaaaagcagcugacuca

SEQ ID NO: 1320442 - RNA, 23 nt, Human
ugcagaugaggcugcugacuguu

SEQ ID NO: 1320443 - RNA, 20 nt, Human
ugccaucauccaagaauuua

SEQ ID NO: 1320444 - RNA, 21 nt, Human
uuagagauucucagucgcugg

SEQ ID NO: 1320445 - RNA, 22 nt, Human
augaaauuagucucgggcuuga

SEQ ID NO: 1320446 - RNA, 24 nt, Human
caaaaagauucaucaaauuaugaa

SEQ ID NO: 1320447 - RNA, 24 nt, Human
cuccaguggcucaaugacauagcc

SEQ ID NO: 1320448 - RNA, 21 nt, Human
ucccaugacucuccaaaaaga

SEQ ID NO: 1320449 - RNA, 22 nt, Human
ucguguguaucaggaaacccaa

SEQ ID NO: 1320450 - RNA, 23 nt, Human
ucuccaguaaacaaugccagggc

SEQ ID NO: 1320451 - RNA, 21 nt, Human
uggccacaaauuguuuacauu

SEQ ID NO: 1320452 - RNA, 21 nt, Human
uggcucaaugacauagcccaa

SEQ ID NO: 1320453 - RNA, 19 nt, Human
uggggcuucgagacuuggc

SEQ ID NO: 1320454 - RNA, 18 nt, Human
uuccucccaugacucucc

SEQ ID NO: 1320455 - RNA, 21 nt, Human
uugagguacaggaucuuguca

SEQ ID NO: 1320456 - RNA, 20 nt, Human
acuguccccagguggacaga

SEQ ID NO: 1320457 - RNA, 18 nt, Human
agaggaggaggaaggggc

SEQ ID NO: 1320458 - RNA, 19 nt, Human
agcagcuuaaauaugaggc

SEQ ID NO: 1320459 - RNA, 21 nt, Human
agcaggaagaggaggaggaag

SEQ ID NO: 1320460 - RNA, 24 nt, Human
aggaggaggaaggggccgcagagc

SEQ ID NO: 1320461 - RNA, 25 nt, Human
agguccagcagggaggggaccagga

SEQ ID NO: 1320462 - RNA, 23 nt, Human
aguuggagcaggaagaggaggag

SEQ ID NO: 1320463 - RNA, 20 nt, Human
cagcagggaggggaccagga

SEQ ID NO: 1320464 - RNA, 21 nt, Human
cagcccagugggacuaggcag

SEQ ID NO: 1320465 - RNA, 21 nt, Human
ccccuuagacccaggccugag

SEQ ID NO: 1320466 - RNA, 20 nt, Human
gaagaggaggaggaaggggc

SEQ ID NO: 1320467 - RNA, 19 nt, Human
gacuaggcaggaagcucug

SEQ ID NO: 1320468 - RNA, 20 nt, Human
gagcaggaagaggaggagga

SEQ ID NO: 1320469 - RNA, 24 nt, Human
gagcaggaagaggaggaggaaggg

SEQ ID NO: 1320470 - RNA, 21 nt, Human
ggaaggacagaacgacgcagg

SEQ ID NO: 1320471 - RNA, 24 nt, Human
ggaccaggaucucuugcuccacgg

SEQ ID NO: 1320472 - RNA, 18 nt, Human
gggaccaggaucucuugc

SEQ ID NO: 1320473 - RNA, 20 nt, Human
gguccagcagggaggggacc

SEQ ID NO: 1320474 - RNA, 20 nt, Human
uaugaggcaagcagucaggg

SEQ ID NO: 1320475 - RNA, 19 nt, Human
uccccagguggacagaagu

SEQ ID NO: 1320476 - RNA, 19 nt, Human
ucggaaggacagaacgacg

SEQ ID NO: 1320477 - RNA, 18 nt, Human
ugagccucuggcaggggc

SEQ ID NO: 1320478 - RNA, 20 nt, Human
ugccuggggcuggguugggg

SEQ ID NO: 1320479 - RNA, 21 nt, Human
ugccuggggcuggguuggggu

SEQ ID NO: 1320480 - RNA, 22 nt, Human
ugccuggggcuggguugggguc

SEQ ID NO: 1320481 - RNA, 18 nt, Human
ugggucagaggccuggug

SEQ ID NO: 1320482 - RNA, 21 nt, Human
ugggucagaggccuggugggc

SEQ ID NO: 1320483 - RNA, 21 nt, Human
uggguggcagguccagcaggg

SEQ ID NO: 1320484 - RNA, 24 nt, Human
uucggaaggacagaacgacgcagg

SEQ ID NO: 1320485 - RNA, 20 nt, Human
uuggagcaggaagaggagga

SEQ ID NO: 1320486 - RNA, 19 nt, Human
uuggcagggcggucuuccc

SEQ ID NO: 1320487 - RNA, 21 nt, Human
ccucucuucuuuccuccaggg

SEQ ID NO: 1320488 - RNA, 25 nt, Human
cuacaguggcuuugcuucuggcuag

SEQ ID NO: 1320489 - RNA, 19 nt, Human
gacccucucuucuuuccuu

SEQ ID NO: 1320490 - RNA, 19 nt, Human
ggccuuuguauuugcuuuu

SEQ ID NO: 1320491 - RNA, 18 nt, Human
uacaguggcuuugcuucu

SEQ ID NO: 1320492 - RNA, 18 nt, Human
uccagggucacuggguuu

SEQ ID NO: 1320493 - RNA, 25 nt, Human
uccuccagggucacuggguuuuacu

SEQ ID NO: 1320494 - RNA, 18 nt, Human
ucgaaagucuucucaccc

SEQ ID NO: 1320495 - RNA, 22 nt, Human
ucgaaagucuucucacccuuga

SEQ ID NO: 1320496 - RNA, 18 nt, Human
ucgcagcgcugggagugc

SEQ ID NO: 1320497 - RNA, 22 nt, Human
ucuuguuuugaucucugggccu

SEQ ID NO: 1320498 - RNA, 20 nt, Human
ugggaauguucugcucgaaa

SEQ ID NO: 1320499 - RNA, 26 nt, Human
aaaaacugaucaaaacagagagacaa

SEQ ID NO: 1320500 - RNA, 26 nt, Human
aaaacaaaaacugaucaaaacagaga

SEQ ID NO: 1320501 - RNA, 18 nt, Human
aaacuguaaccaucauac

SEQ ID NO: 1320502 - RNA, 23 nt, Human
agagagacaacauuuaaaaauau

SEQ ID NO: 1320503 - RNA, 28 nt, Human
auaaaacaaaaacugaucaaaacagaga

SEQ ID NO: 1320504 - RNA, 19 nt, Human
cacaaaggucacaguccag

SEQ ID NO: 1320505 - RNA, 18 nt, Human
caggacauguauguggug

SEQ ID NO: 1320506 - RNA, 22 nt, Human
gaauaaaacaaaaacugaucaa

SEQ ID NO: 1320507 - RNA, 23 nt, Human
gucacaguccaguugcaaaggcu

SEQ ID NO: 1320508 - RNA, 19 nt, Human
uaaaacaaaaacugaucaa

SEQ ID NO: 1320509 - RNA, 22 nt, Human
uaaaacaaaaacugaucaaaac

SEQ ID NO: 1320510 - RNA, 22 nt, Human
uacaaagggaaagaacuuuaca

SEQ ID NO: 1320511 - RNA, 23 nt, Human
ucaaaacagagagacaacauuua

SEQ ID NO: 1320512 - RNA, 21 nt, Human
ucuuucuuucuuuuauuccuu

SEQ ID NO: 1320513 - RNA, 21 nt, Human
ucuuucuuuuauuccuuccuu

SEQ ID NO: 1320514 - RNA, 24 nt, Human
ugaauaaaacaaaaacugaucaaa

SEQ ID NO: 1320515 - RNA, 21 nt, Human
aaaucccaccccuuccaucuc

SEQ ID NO: 1320516 - RNA, 18 nt, Human
aagaagggagaggauggu

SEQ ID NO: 1320517 - RNA, 24 nt, Human
aaggaagguacaguuuggaugagg

SEQ ID NO: 1320518 - RNA, 22 nt, Human
aaggagcagaugacaccaucag

SEQ ID NO: 1320519 - RNA, 21 nt, Human
acagcacagaggcacgggcac

SEQ ID NO: 1320520 - RNA, 22 nt, Human
acagcacagaggcacgggcacc

SEQ ID NO: 1320521 - RNA, 25 nt, Human
accaugggagagggcagcacuccug

SEQ ID NO: 1320522 - RNA, 20 nt, Human
acugggcuucugggcugcuu

SEQ ID NO: 1320523 - RNA, 19 nt, Human
aggagaagccaccuuggug

SEQ ID NO: 1320524 - RNA, 23 nt, Human
aggagcaaaucccaccccuucca

SEQ ID NO: 1320525 - RNA, 23 nt, Human
aguuacugggcuucugggcugcu

SEQ ID NO: 1320526 - RNA, 26 nt, Human
aucccaccccuuccaucucucagcca

SEQ ID NO: 1320527 - RNA, 21 nt, Human
auuggccuggucccaaccauu

SEQ ID NO: 1320528 - RNA, 19 nt, Human
caaccauuauaguaagugg

SEQ ID NO: 1320529 - RNA, 23 nt, Human
cacauacacagcacagaggcacg

SEQ ID NO: 1320530 - RNA, 24 nt, Human
caccccuuccaucucucagccaag

SEQ ID NO: 1320531 - RNA, 23 nt, Human
cccuuccaucucucagccaagga

SEQ ID NO: 1320532 - RNA, 21 nt, Human
cugaggggaucuuggccucac

SEQ ID NO: 1320533 - RNA, 27 nt, Human
cuuagucccuggcuuggcaggaagggu

SEQ ID NO: 1320534 - RNA, 20 nt, Human
gaacccaggagcaaauccca

SEQ ID NO: 1320535 - RNA, 21 nt, Human
ggccacaggaaggagcagaug

SEQ ID NO: 1320536 - RNA, 20 nt, Human
gggaagggcaguuacugggc

SEQ ID NO: 1320537 - RNA, 23 nt, Human
gggcuucugggcugcuuaguccc

SEQ ID NO: 1320538 - RNA, 21 nt, Human
gguagggaagauggauggggc

SEQ ID NO: 1320539 - RNA, 18 nt, Human
uaagaagggagaggaugg

SEQ ID NO: 1320540 - RNA, 26 nt, Human
uccaucucucagccaaggagaagcca

SEQ ID NO: 1320541 - RNA, 18 nt, Human
ugaagauauaaacaguaa

SEQ ID NO: 1320542 - RNA, 24 nt, Human
ugaggggaucuuggccucacagug

SEQ ID NO: 1320543 - RNA, 23 nt, Human
uggcaggaaggguagggaagaug

SEQ ID NO: 1320544 - RNA, 23 nt, Human
uggccuggucccaaccauuacag

SEQ ID NO: 1320545 - RNA, 23 nt, Human
uuuggaugaggccacaggaagga

SEQ ID NO: 1320546 - RNA, 24 nt, Human
caucauuguuuuaauugcuggaaa

SEQ ID NO: 1320547 - RNA, 19 nt, Human
cuguacuguuguugagaag

SEQ ID NO: 1320548 - RNA, 23 nt, Human
gacuucuuuaggccacuauccuu

SEQ ID NO: 1320549 - RNA, 18 nt, Human
uaacagcauuaacaagag

SEQ ID NO: 1320550 - RNA, 22 nt, Human
ucccaucauuguuuuaauugcu

SEQ ID NO: 1320551 - RNA, 21 nt, Human
caaggcacauuuggcgggugc

SEQ ID NO: 1320552 - RNA, 22 nt, Human
ccauucagcuuuucuauuuguc

SEQ ID NO: 1320553 - RNA, 27 nt, Human
ccuccagagcagccucaggcuuagcuu

SEQ ID NO: 1320554 - RNA, 21 nt, Human
ccugcaacaagucuuccuggg

SEQ ID NO: 1320555 - RNA, 25 nt, Human
cgccuuccuuccucuucauuuuggc

SEQ ID NO: 1320556 - RNA, 21 nt, Human
cuucccgaauaucagcuccag

SEQ ID NO: 1320557 - RNA, 23 nt, Human
gaauuaaagagucauugucucca

SEQ ID NO: 1320558 - RNA, 23 nt, Human
ggccaucaguccuguccgggucc

SEQ ID NO: 1320559 - RNA, 18 nt, Human
gucccgagcccuugacuc

SEQ ID NO: 1320560 - RNA, 24 nt, Human
uaccugcaacaagucuuccuggga

SEQ ID NO: 1320561 - RNA, 18 nt, Human
ucaguccuguccgggucc

SEQ ID NO: 1320562 - RNA, 19 nt, Human
ucucugaggccaucagucc

SEQ ID NO: 1320563 - RNA, 21 nt, Human
ucugcugggcuccggagucgc

SEQ ID NO: 1320564 - RNA, 19 nt, Human
ugaagggcuaauagucuag

SEQ ID NO: 1320565 - RNA, 24 nt, Human
uggcaaggcacauuuggcgggugc

SEQ ID NO: 1320566 - RNA, 23 nt, Human
uggccgcucgcuucuccggcccu

SEQ ID NO: 1320567 - RNA, 19 nt, Human
ugucacugaaaauucaggc

SEQ ID NO: 1320568 - RNA, 22 nt, Human
uguccggguccguaguccuggc

SEQ ID NO: 1320569 - RNA, 18 nt, Human
aaccagucuuguccgaga

SEQ ID NO: 1320570 - RNA, 23 nt, Human
caaggaacaucucaccaauuuca

SEQ ID NO: 1320571 - RNA, 20 nt, Human
ccaaccagcccaaggaacau

SEQ ID NO: 1320572 - RNA, 20 nt, Human
ccaccuaugaccucaggucc

SEQ ID NO: 1320573 - RNA, 18 nt, Human
cccaaggaacaucucacc

SEQ ID NO: 1320574 - RNA, 23 nt, Human
gguaagcggucuuuucacucucu

SEQ ID NO: 1320575 - RNA, 22 nt, Human
uaaccagucuuguccgagacuc

SEQ ID NO: 1320576 - RNA, 20 nt, Human
uaguuucauuguagaacgau

SEQ ID NO: 1320577 - RNA, 19 nt, Human
uuuauuaguuucauuguag

SEQ ID NO: 1320578 - RNA, 22 nt, Human
aacauugggaacacagggacau

SEQ ID NO: 1320579 - RNA, 23 nt, Human
acuugauuucucuuguucucagc

SEQ ID NO: 1320580 - RNA, 26 nt, Human
agaggaagaagggaggaaggcaaggg

SEQ ID NO: 1320581 - RNA, 20 nt, Human
cacuacuugggugacaggau

SEQ ID NO: 1320582 - RNA, 25 nt, Human
cagaacuuggugggcuccccccgag

SEQ ID NO: 1320583 - RNA, 18 nt, Human
caggaacaauagacacug

SEQ ID NO: 1320584 - RNA, 18 nt, Human
caucaagacaggaacaau

SEQ ID NO: 1320585 - RNA, 20 nt, Human
ccaagaggaagaagggagga

SEQ ID NO: 1320586 - RNA, 23 nt, Human
cccagaacuuggugggcuccggc

SEQ ID NO: 1320587 - RNA, 21 nt, Human
ccccagaaaugaugacaccuc

SEQ ID NO: 1320588 - RNA, 20 nt, Human
cucuucugaaucagcucuaa

SEQ ID NO: 1320589 - RNA, 20 nt, Human
gaaucagcucuaaauuucgg

SEQ ID NO: 1320590 - RNA, 23 nt, Human
gacacuggggacuccaagaggaa

SEQ ID NO: 1320591 - RNA, 23 nt, Human
ggaaaugacugcuaacuuggacg

SEQ ID NO: 1320592 - RNA, 22 nt, Human
ggaacacagggacaucaagaca

SEQ ID NO: 1320593 - RNA, 19 nt, Human
ggaaggcaaggguugaaga

SEQ ID NO: 1320594 - RNA, 20 nt, Human
gggugacaggauugagcuuc

SEQ ID NO: 1320595 - RNA, 23 nt, Human
uaaacauugggaacacagggaca

SEQ ID NO: 1320596 - RNA, 26 nt, Human
uacuugggugacaggauugagcuucu

SEQ ID NO: 1320597 - RNA, 18 nt, Human
ucacuuguaggcaagagc

SEQ ID NO: 1320598 - RNA, 23 nt, Human
ucacuuguaggcaagagcuaaac

SEQ ID NO: 1320599 - RNA, 22 nt, Human
ucagcaccuguggguucccaga

SEQ ID NO: 1320600 - RNA, 26 nt, Human
ucagugccugacggcgacuauccagg

SEQ ID NO: 1320601 - RNA, 21 nt, Human
uccaagaggaagaagggagga

SEQ ID NO: 1320602 - RNA, 23 nt, Human
uggaaacuccgccuccuuccuuc

SEQ ID NO: 1320603 - RNA, 24 nt, Human
ugggaacacagggacaucaagaca

SEQ ID NO: 1320604 - RNA, 22 nt, Human
ugucucuucugaaucagcucua

SEQ ID NO: 1320605 - RNA, 21 nt, Human
cagcaguugcaccagcaccug

SEQ ID NO: 1320606 - RNA, 18 nt, Human
caggagccgcacaggcgc

SEQ ID NO: 1320607 - RNA, 23 nt, Human
caggagccuccucagggcgccca

SEQ ID NO: 1320608 - RNA, 21 nt, Human
ccagcgcugcacccacgagcc

SEQ ID NO: 1320609 - RNA, 23 nt, Human
cccagugcgcccaggagcgccgg

SEQ ID NO: 1320610 - RNA, 23 nt, Human
cccgaagcacccuucagcgccca

SEQ ID NO: 1320611 - RNA, 27 nt, Human
ccgaagcacccuucagcgcccacagca

SEQ ID NO: 1320612 - RNA, 23 nt, Human
ccuucgcccagugcgcccaggag

SEQ ID NO: 1320613 - RNA, 19 nt, Human
cgcccagcgcugcacccac

SEQ ID NO: 1320614 - RNA, 20 nt, Human
cgcccaggagcgccggcagc

SEQ ID NO: 1320615 - RNA, 18 nt, Human
cgcccggggccgcagcag

SEQ ID NO: 1320616 - RNA, 22 nt, Human
cgcccggggccgcagcaggagc

SEQ ID NO: 1320617 - RNA, 22 nt, Human
cguguggccgccagugccuggg

SEQ ID NO: 1320618 - RNA, 18 nt, Human
gagcacguguggccgcca

SEQ ID NO: 1320619 - RNA, 25 nt, Human
gcacguguggccgccagugccuggg

SEQ ID NO: 1320620 - RNA, 24 nt, Human
gccccgaagcacccuucagcgccc

SEQ ID NO: 1320621 - RNA, 20 nt, Human
gcugcacccacgagccgcgc

SEQ ID NO: 1320622 - RNA, 18 nt, Human
ggagcgccggcagcagcg

SEQ ID NO: 1320623 - RNA, 23 nt, Human
ggagggaggcgcggucccagcuc

SEQ ID NO: 1320624 - RNA, 19 nt, Human
ugcgcccaggagcgccggg

SEQ ID NO: 1320625 - RNA, 18 nt, Human
uggggcuccggccccgaa

SEQ ID NO: 1320626 - RNA, 22 nt, Human
uguggccgccagugccuggggc

SEQ ID NO: 1320627 - RNA, 23 nt, Human
aaccucagcuuccuugucaguac

SEQ ID NO: 1320628 - RNA, 23 nt, Human
aaguggccucugaggauuacagu

SEQ ID NO: 1320629 - RNA, 21 nt, Human
accaauuccucaacaugguuc

SEQ ID NO: 1320630 - RNA, 18 nt, Human
aucaaaucaugaauuggc

SEQ ID NO: 1320631 - RNA, 19 nt, Human
cacaccauuuccccaucuc

SEQ ID NO: 1320632 - RNA, 23 nt, Human
cacuccucuggauuucuauaaaa

SEQ ID NO: 1320633 - RNA, 24 nt, Human
caggucacaccauuuccccaucuc

SEQ ID NO: 1320634 - RNA, 19 nt, Human
ccaucucuucaauauuccg

SEQ ID NO: 1320635 - RNA, 20 nt, Human
ccucugaggauuacaguagg

SEQ ID NO: 1320636 - RNA, 20 nt, Human
cuuaaccuccaaaccucagc

SEQ ID NO: 1320637 - RNA, 24 nt, Human
cuuaaccuccaaaccucagcuucc

SEQ ID NO: 1320638 - RNA, 21 nt, Human
cuucacuccucuggauuucua

SEQ ID NO: 1320639 - RNA, 21 nt, Human
gaacaguccucuucacuccuc

SEQ ID NO: 1320640 - RNA, 21 nt, Human
gcuuaaccuccaaaccucagc

SEQ ID NO: 1320641 - RNA, 23 nt, Human
uaaccuccaaaccucagcuuccu

SEQ ID NO: 1320642 - RNA, 19 nt, Human
uacaguaggguuaaaugag

SEQ ID NO: 1320643 - RNA, 23 nt, Human
uccucuggauuucuauaaaaugg

SEQ ID NO: 1320644 - RNA, 25 nt, Human
uccucuggauuucuauaaaauggaa

SEQ ID NO: 1320645 - RNA, 22 nt, Human
ugaggaaauguggaccaauucc

SEQ ID NO: 1320646 - RNA, 19 nt, Human
uuccucaacaugguucugg

SEQ ID NO: 1320647 - RNA, 22 nt, Human
aacaguguuggaagguggggcc

SEQ ID NO: 1320648 - RNA, 24 nt, Human
accuucucucagaacaucuuauug

SEQ ID NO: 1320649 - RNA, 21 nt, Human
agaaaccuaaucccacugccg

SEQ ID NO: 1320650 - RNA, 23 nt, Human
auacacaaccuucucucagaaca

SEQ ID NO: 1320651 - RNA, 25 nt, Human
augaagacaaaauauuuagcaaaua

SEQ ID NO: 1320652 - RNA, 23 nt, Human
cacaaccuucucucagaacaucu

SEQ ID NO: 1320653 - RNA, 22 nt, Human
cuauggucugaaugugucuccc

SEQ ID NO: 1320654 - RNA, 18 nt, Human
cuuugcugcuauggucug

SEQ ID NO: 1320655 - RNA, 20 nt, Human
guuuauacagaucaguugau

SEQ ID NO: 1320656 - RNA, 19 nt, Human
uacagcuuugcugcuaugg

SEQ ID NO: 1320657 - RNA, 23 nt, Human
ugauaaugaagacaaaauauuua

SEQ ID NO: 1320658 - RNA, 21 nt, Human
uggaagguggggccuuugggg

SEQ ID NO: 1320659 - RNA, 24 nt, Human
uggggccuuuggggaggcauucag

SEQ ID NO: 1320660 - RNA, 22 nt, Human
ugugucucccaaaauucauaug

SEQ ID NO: 1320661 - RNA, 21 nt, Human
aacaguacccauucccuugau

SEQ ID NO: 1320662 - RNA, 18 nt, Human
acuuguggggcauuccuu

SEQ ID NO: 1320663 - RNA, 20 nt, Human
aucaccuuucuuauagauuc

SEQ ID NO: 1320664 - RNA, 23 nt, Human
cauaugucaggugccucuccucu

SEQ ID NO: 1320665 - RNA, 21 nt, Human
ccagagguccuuuauuuuucu

SEQ ID NO: 1320666 - RNA, 21 nt, Human
uacccauucccuugaugucua

SEQ ID NO: 1320667 - RNA, 18 nt, Human
ugaacaguacccauuccc

SEQ ID NO: 1320668 - RNA, 21 nt, Human
uggccaaaggagcaacuccau

SEQ ID NO: 1320669 - RNA, 19 nt, Human
aagcuggagggcuugucag

SEQ ID NO: 1320670 - RNA, 20 nt, Human
accccaacggcgccugcgcc

SEQ ID NO: 1320671 - RNA, 23 nt, Human
aucugcugcuuguaaccugcagg

SEQ ID NO: 1320672 - RNA, 21 nt, Human
caaggcgucuugcgcccaacu

SEQ ID NO: 1320673 - RNA, 21 nt, Human
cagccuugcaaaaugucacuc

SEQ ID NO: 1320674 - RNA, 20 nt, Human
ccaggaagugccacacagca

SEQ ID NO: 1320675 - RNA, 21 nt, Human
ccccaacggcgccugcgccua

SEQ ID NO: 1320676 - RNA, 21 nt, Human
cugcaauaucuguagucugau

SEQ ID NO: 1320677 - RNA, 20 nt, Human
cuugucagagccaggacuga

SEQ ID NO: 1320678 - RNA, 21 nt, Human
gagccaggacugaagguggga

SEQ ID NO: 1320679 - RNA, 20 nt, Human
guggcgugaagcuggagggc

SEQ ID NO: 1320680 - RNA, 23 nt, Human
uaaccuacuauucacaaugacau

SEQ ID NO: 1320681 - RNA, 25 nt, Human
uauaaccuacuauucacaaugacau

SEQ ID NO: 1320682 - RNA, 26 nt, Human
ucaaaaucugcaauaucuguagucug

SEQ ID NO: 1320683 - RNA, 18 nt, Human
ucagagccaggacugaag

SEQ ID NO: 1320684 - RNA, 22 nt, Human
ugcaaaaugucacucagcagag

SEQ ID NO: 1320685 - RNA, 21 nt, Human
uguucuuguucuucaaaaucu

SEQ ID NO: 1320686 - RNA, 27 nt, Human
uucacaaugacauguagaauucucucu

SEQ ID NO: 1320687 - RNA, 21 nt, Human
uuggagacuggcucaccgcca

SEQ ID NO: 1320688 - RNA, 20 nt, Human
accuuagagccccccacccc

SEQ ID NO: 1320689 - RNA, 23 nt, Human
agagccccccaccccacugcuuc

SEQ ID NO: 1320690 - RNA, 18 nt, Human
caccccacugcuuccugc

SEQ ID NO: 1320691 - RNA, 21 nt, Human
ccccuccuccgcccccaaccu

SEQ ID NO: 1320692 - RNA, 23 nt, Human
cccuccuccgcccccaaccuuag

SEQ ID NO: 1320693 - RNA, 19 nt, Human
ccuccuccgcccccaaccu

SEQ ID NO: 1320694 - RNA, 18 nt, Human
cuuagagccccccacccc

SEQ ID NO: 1320695 - RNA, 21 nt, Human
uuagagccccccaccccacug

SEQ ID NO: 1320696 - RNA, 21 nt, Human
acccccauuggcccccuccag

SEQ ID NO: 1320697 - RNA, 22 nt, Human
acugcuuuucugugauugcuuc

SEQ ID NO: 1320698 - RNA, 21 nt, Human
ccccuccaguugaggccccgc

SEQ ID NO: 1320699 - RNA, 19 nt, Human
cccgccccgcgagcugggc

SEQ ID NO: 1320700 - RNA, 22 nt, Human
cccucguuugggacgcuagagg

SEQ ID NO: 1320701 - RNA, 23 nt, Human
cugacccccauuggcccccucca

SEQ ID NO: 1320702 - RNA, 21 nt, Human
ggucugccacucgguuccgcc

SEQ ID NO: 1320703 - RNA, 19 nt, Human
uaggaaccacggggcggag

SEQ ID NO: 1320704 - RNA, 18 nt, Human
uaucccgcccaucauccc

SEQ ID NO: 1320705 - RNA, 19 nt, Human
uccgccgcgcugaccccca

SEQ ID NO: 1320706 - RNA, 18 nt, Human
ugcuucuuuaucccgccc

SEQ ID NO: 1320707 - RNA, 18 nt, Human
uugacuagguccgacugc

SEQ ID NO: 1320708 - RNA, 20 nt, Human
aaaaugcacaucagccacaa

SEQ ID NO: 1320709 - RNA, 24 nt, Human
aagaacccaacaucaacaaaaacg

SEQ ID NO: 1320710 - RNA, 22 nt, Human
aagcaccaaaaugcacaucagc

SEQ ID NO: 1320711 - RNA, 19 nt, Human
aagcucagagcaggugcag

SEQ ID NO: 1320712 - RNA, 18 nt, Human
agcaccaaaaugcacauc

SEQ ID NO: 1320713 - RNA, 24 nt, Human
aggcuggagcaggaggaucacuug

SEQ ID NO: 1320714 - RNA, 24 nt, Human
aggucgaggcugcagugagcuaug

SEQ ID NO: 1320715 - RNA, 23 nt, Human
aucaugcacuccagccuggguga

SEQ ID NO: 1320716 - RNA, 28 nt, Human
caaagcaccaaaaugcacaucagccaca

SEQ ID NO: 1320717 - RNA, 21 nt, Human
caacaaaaacguauaaucugg

SEQ ID NO: 1320718 - RNA, 18 nt, Human
cacuccagccugggugac

SEQ ID NO: 1320719 - RNA, 22 nt, Human
cacuccagccugggugacagaa

SEQ ID NO: 1320720 - RNA, 24 nt, Human
cacuccagccugggugacagaaug

SEQ ID NO: 1320721 - RNA, 18 nt, Human
caugcacuccagccuggg

SEQ ID NO: 1320722 - RNA, 18 nt, Human
caugcacuccagccuggg

SEQ ID NO: 1320723 - RNA, 19 nt, Human
caugcacuccagccugggu

SEQ ID NO: 1320724 - RNA, 21 nt, Human
caugcacuccagccuggguga

SEQ ID NO: 1320725 - RNA, 22 nt, Human
caugcacuccagccugggugac

SEQ ID NO: 1320726 - RNA, 23 nt, Human
caugcacuccagccugggugaca

SEQ ID NO: 1320727 - RNA, 24 nt, Human
caugcacuccagccugggugacag

SEQ ID NO: 1320728 - RNA, 20 nt, Human
ccaaaaugcacaucagccac

SEQ ID NO: 1320729 - RNA, 22 nt, Human
cgguguaaaugguguuucuuuc

SEQ ID NO: 1320730 - RNA, 22 nt, Human
cuaaaccaaaugaucaggccuc

SEQ ID NO: 1320731 - RNA, 25 nt, Human
cucagagcaggugcagcacugaaaa

SEQ ID NO: 1320732 - RNA, 26 nt, Human
cugggugacagaaugagauccucucu

SEQ ID NO: 1320733 - RNA, 19 nt, Human
cuguaguccuagcuacuug

SEQ ID NO: 1320734 - RNA, 19 nt, Human
gagauccucucucucagaa

SEQ ID NO: 1320735 - RNA, 18 nt, Human
gagcaggaggaucacuug

SEQ ID NO: 1320736 - RNA, 23 nt, Human
gaggaucacuugagcccaggagg

SEQ ID NO: 1320737 - RNA, 24 nt, Human
gaucacuugagcccaggaggucga

SEQ ID NO: 1320738 - RNA, 21 nt, Human
gcagcacugaaaacaggacac

SEQ ID NO: 1320739 - RNA, 24 nt, Human
gcccaggaggucgaggcugcagug

SEQ ID NO: 1320740 - RNA, 24 nt, Human
gcuaugaucaugcacuccagccug

SEQ ID NO: 1320741 - RNA, 22 nt, Human
uaaaccaaaugaucaggccucg

SEQ ID NO: 1320742 - RNA, 19 nt, Human
uaccuaaaccaaaugauca

SEQ ID NO: 1320743 - RNA, 24 nt, Human
ucagagcaggugcagcacugaaaa

SEQ ID NO: 1320744 - RNA, 20 nt, Human
ucaugcacuccagccugggu

SEQ ID NO: 1320745 - RNA, 23 nt, Human
ucaugcacuccagccugggugac

SEQ ID NO: 1320746 - RNA, 24 nt, Human
uccagccugggugacagaaugaga

SEQ ID NO: 1320747 - RNA, 18 nt, Human
ugagaagaacccaacauc

SEQ ID NO: 1320748 - RNA, 22 nt, Human
ugagaagaacccaacaucaaca

SEQ ID NO: 1320749 - RNA, 27 nt, Human
ugagaagaacccaacaucaacaaaaag

SEQ ID NO: 1320750 - RNA, 24 nt, Human
ugagaggcuggagcaggaggauca

SEQ ID NO: 1320751 - RNA, 19 nt, Human
ugcacuccagccuggguga

SEQ ID NO: 1320752 - RNA, 21 nt, Human
ugcacuccagccugggugaca

SEQ ID NO: 1320753 - RNA, 22 nt, Human
ugcacuccagccugggugacag

SEQ ID NO: 1320754 - RNA, 23 nt, Human
ugcauacaaagcaccaaaaugca

SEQ ID NO: 1320755 - RNA, 24 nt, Human
uuaaacuugcauacaaagcaccaa

SEQ ID NO: 1320756 - RNA, 19 nt, Human
uuuaggugacagccuacag

SEQ ID NO: 1320757 - RNA, 23 nt, Human
cagggagagcugagaacucggug

SEQ ID NO: 1320758 - RNA, 24 nt, Human
ccccguucccccagugagcuuccc

SEQ ID NO: 1320759 - RNA, 18 nt, Human
ccgucugcggcgcgugag

SEQ ID NO: 1320760 - RNA, 18 nt, Human
cgucugcggcgcgugagg

SEQ ID NO: 1320761 - RNA, 20 nt, Human
cugcggcgcgugagggcagc

SEQ ID NO: 1320762 - RNA, 18 nt, Human
cugggacugugcucuucu

SEQ ID NO: 1320763 - RNA, 21 nt, Human
cuggggagccaggcguggagg

SEQ ID NO: 1320764 - RNA, 22 nt, Human
gaggaggggaggggcagucagu

SEQ ID NO: 1320765 - RNA, 26 nt, Human
gcggcgcgugagggcagcggucccgg

SEQ ID NO: 1320766 - RNA, 19 nt, Human
ucccggagagccagacccc

SEQ ID NO: 1320767 - RNA, 18 nt, Human
ucggugcggggaggcugc

SEQ ID NO: 1320768 - RNA, 18 nt, Human
aucccuuuuuuguccguu

SEQ ID NO: 1320769 - RNA, 21 nt, Human
cuugggaucccuuuuuugucc

SEQ ID NO: 1320770 - RNA, 21 nt, Human
uccuuuuggaguugaaucaga

SEQ ID NO: 1320771 - RNA, 22 nt, Human
ugaaucagacaacuugggaucc

SEQ ID NO: 1320772 - RNA, 23 nt, Human
aauuuugucuuuuauuagugaag

SEQ ID NO: 1320773 - RNA, 24 nt, Human
agaggcuuuagcuugccucacugu

SEQ ID NO: 1320774 - RNA, 21 nt, Human
caaaacaaagguaaaacaucu

SEQ ID NO: 1320775 - RNA, 21 nt, Human
gugaggaaagaggcuuuagcu

SEQ ID NO: 1320776 - RNA, 21 nt, Human
uaaaagaauagacauaaauaa

SEQ ID NO: 1320777 - RNA, 22 nt, Human
uaaauaauaauauagcaaaaca

SEQ ID NO: 1320778 - RNA, 28 nt, Human
ugccucacuguuccugaaacuagcucua

SEQ ID NO: 1320779 - RNA, 21 nt, Human
uuggugaggaaagaggcuuua

SEQ ID NO: 1320780 - RNA, 24 nt, Human
agccacaggcccuucaggaagucc

SEQ ID NO: 1320781 - RNA, 22 nt, Human
aggccagcugccccccaggaag

SEQ ID NO: 1320782 - RNA, 22 nt, Human
ccacaggcccuucaggaagucc

SEQ ID NO: 1320783 - RNA, 18 nt, Human
cugcuguggggcugcugu

SEQ ID NO: 1320784 - RNA, 19 nt, Human
gcugcuguacugagcugga

SEQ ID NO: 1320785 - RNA, 24 nt, Human
gcugcuguacugagcuggauuauu

SEQ ID NO: 1320786 - RNA, 19 nt, Human
gggucuccguggcaggcca

SEQ ID NO: 1320787 - RNA, 18 nt, Human
uccaucaucaggaacagc

SEQ ID NO: 1320788 - RNA, 23 nt, Human
ucuccguggcaggccagcugccc

SEQ ID NO: 1320789 - RNA, 22 nt, Human
uggcaggccagcugccccccuc

SEQ ID NO: 1320790 - RNA, 21 nt, Human
ugguauuccuguccucuccgu

SEQ ID NO: 1320791 - RNA, 23 nt, Human
agagggaccgcgcugccgucccu

SEQ ID NO: 1320792 - RNA, 25 nt, Human
caccuucgcccugccagccuagagg

SEQ ID NO: 1320793 - RNA, 25 nt, Human
ccccgcccuccuucguucucuucuc

SEQ ID NO: 1320794 - RNA, 22 nt, Human
ccccugccugcccccgcccucc

SEQ ID NO: 1320795 - RNA, 19 nt, Human
cccuccuucguucucuucu

SEQ ID NO: 1320796 - RNA, 18 nt, Human
cccugccugcccccgccc

SEQ ID NO: 1320797 - RNA, 21 nt, Human
cccugccugcccccgcccucc

SEQ ID NO: 1320798 - RNA, 24 nt, Human
cccugccugcccccgcccuccuuc

SEQ ID NO: 1320799 - RNA, 21 nt, Human
ccgcgcugccgucccuucccg

SEQ ID NO: 1320800 - RNA, 21 nt, Human
ccugccagccuagagggaccg

SEQ ID NO: 1320801 - RNA, 24 nt, Human
ccuucccggguggccccugccugc

SEQ ID NO: 1320802 - RNA, 27 nt, Human
cugcccccgcccuccuucguucucuuc

SEQ ID NO: 1320803 - RNA, 28 nt, Human
cugcccccgcccuccuucguucucuucu

SEQ ID NO: 1320804 - RNA, 19 nt, Human
cuucgcccugccagccuag

SEQ ID NO: 1320805 - RNA, 18 nt, Human
ucccggguggccccugcc

SEQ ID NO: 1320806 - RNA, 22 nt, Human
ugccagccuagagggaccgcgc

SEQ ID NO: 1320807 - RNA, 20 nt, Human
ugccugcccccgcccuccuu

SEQ ID NO: 1320808 - RNA, 21 nt, Human
uucccggguggccccugccug

SEQ ID NO: 1320809 - RNA, 23 nt, Human
aaaaggagcaggcccaggggacu

SEQ ID NO: 1320810 - RNA, 22 nt, Human
aagaggcagaccuaugaccaaa

SEQ ID NO: 1320811 - RNA, 27 nt, Human
agaaaagaggcagaccuaugaccaaaa

SEQ ID NO: 1320812 - RNA, 18 nt, Human
agaaagaaaagaggcaga

SEQ ID NO: 1320813 - RNA, 21 nt, Human
agaccuaugaccaaaaaccug

SEQ ID NO: 1320814 - RNA, 21 nt, Human
aggagcaggcccaggggacuc

SEQ ID NO: 1320815 - RNA, 19 nt, Human
cacagagccaggaaauaag

SEQ ID NO: 1320816 - RNA, 25 nt, Human
cagucagaaagaaaagaggcagacc

SEQ ID NO: 1320817 - RNA, 24 nt, Human
cccguggucagagauggaaggaac

SEQ ID NO: 1320818 - RNA, 20 nt, Human
ccuaugaccaaaaaccugga

SEQ ID NO: 1320819 - RNA, 19 nt, Human
cuccgcccccucgagcuuc

SEQ ID NO: 1320820 - RNA, 20 nt, Human
cuuccugcugucccugccac

SEQ ID NO: 1320821 - RNA, 21 nt, Human
cuuccugcugucccugccaca

SEQ ID NO: 1320822 - RNA, 22 nt, Human
gagauggaaggaacccccaggg

SEQ ID NO: 1320823 - RNA, 20 nt, Human
gagcaggcccaggggacucc

SEQ ID NO: 1320824 - RNA, 21 nt, Human
gcccccucgagcuuccugcug

SEQ ID NO: 1320825 - RNA, 20 nt, Human
gccccguggucagagaugga

SEQ ID NO: 1320826 - RNA, 21 nt, Human
ucccugccacagagccaggaa

SEQ ID NO: 1320827 - RNA, 18 nt, Human
ugaccaaaaaccuggacc

SEQ ID NO: 1320828 - RNA, 23 nt, Human
ugccacagagccaggaaauaaga

SEQ ID NO: 1320829 - RNA, 25 nt, Human
agucccgccgucuaugucgcccucu

SEQ ID NO: 1320830 - RNA, 23 nt, Human
caccgcguggccgauuguggggc

SEQ ID NO: 1320831 - RNA, 19 nt, Human
cgccaccgcguggccgauu

SEQ ID NO: 1320832 - RNA, 21 nt, Human
cggcuggagucccgccgucua

SEQ ID NO: 1320833 - RNA, 20 nt, Human
cuuagcgccaccgcguggcc

SEQ ID NO: 1320834 - RNA, 21 nt, Human
gcuuagcgccaccgcguggcc

SEQ ID NO: 1320835 - RNA, 18 nt, Human
ggcuggagucccgccguc

SEQ ID NO: 1320836 - RNA, 20 nt, Human
gggcugcggcgggcgugcuu

SEQ ID NO: 1320837 - RNA, 20 nt, Human
ucccgccgucuaugucgccc

SEQ ID NO: 1320838 - RNA, 24 nt, Human
uuggcggcuggagucccgccgucu

SEQ ID NO: 1320839 - RNA, 21 nt, Human
aaagccaacaauguuucuaag

SEQ ID NO: 1320840 - RNA, 20 nt, Human
aauguuucuaagacaagaug

SEQ ID NO: 1320841 - RNA, 20 nt, Human
agacaagaugagguuacggg

SEQ ID NO: 1320842 - RNA, 22 nt, Human
augauucaaaaugucacaaagu

SEQ ID NO: 1320843 - RNA, 24 nt, Human
cuuaagauaucugcaaagccaaca

SEQ ID NO: 1320844 - RNA, 20 nt, Human
uaaauacugcaacuucaugu

SEQ ID NO: 1320845 - RNA, 20 nt, Human
uaagaaaaauaaaaaagcaa

SEQ ID NO: 1320846 - RNA, 22 nt, Human
uaauuuauuauuuggaacccac

SEQ ID NO: 1320847 - RNA, 24 nt, Human
uacugcaacuucauguuuuauaga

SEQ ID NO: 1320848 - RNA, 19 nt, Human
uaggcauuaauuuuuaaau

SEQ ID NO: 1320849 - RNA, 18 nt, Human
ucauguuuuauagaaacu

SEQ ID NO: 1320850 - RNA, 18 nt, Human
ugacaguuuugcuguuuu

SEQ ID NO: 1320851 - RNA, 20 nt, Human
guuuaacuucucugaggcuc

SEQ ID NO: 1320852 - RNA, 23 nt, Human
ugucaacauguacuucguacagc

SEQ ID NO: 1320853 - RNA, 20 nt, Human
uugacucuacccccugacau

SEQ ID NO: 1320854 - RNA, 24 nt, Human
cuccacccucaauccaccagaacc

SEQ ID NO: 1320855 - RNA, 19 nt, Human
cugcuccucuaccugcucc

SEQ ID NO: 1320856 - RNA, 20 nt, Human
ggcuccggcugugggggcug

SEQ ID NO: 1320857 - RNA, 20 nt, Human
ggcuccggcugugggggcug

SEQ ID NO: 1320858 - RNA, 27 nt, Human
gggggcuguggcuccggcugugggggc

SEQ ID NO: 1320859 - RNA, 24 nt, Human
uacacugcuccucuaccugcucca

SEQ ID NO: 1320860 - RNA, 20 nt, Human
ucuaccugcuccacccucaa

SEQ ID NO: 1320861 - RNA, 21 nt, Human
uggcuccggcugugggggcug

SEQ ID NO: 1320862 - RNA, 21 nt, Human
uggcuccggcugugggggcug

SEQ ID NO: 1320863 - RNA, 20 nt, Human
ugggcugcuguggcuguucc

SEQ ID NO: 1320864 - RNA, 24 nt, Human
aggcgcucggcacgcugggaaaug

SEQ ID NO: 1320865 - RNA, 20 nt, Human
aucaaaggcagcugguaaca

SEQ ID NO: 1320866 - RNA, 18 nt, Human
cagcugguaacaagucau

SEQ ID NO: 1320867 - RNA, 21 nt, Human
cccggguccccagcugccggg

SEQ ID NO: 1320868 - RNA, 20 nt, Human
cccuggaggcuaagggaaug

SEQ ID NO: 1320869 - RNA, 20 nt, Human
ggcaucaaaggcagcuggua

SEQ ID NO: 1320870 - RNA, 22 nt, Human
uaagcccggguccccagcugcc

SEQ ID NO: 1320871 - RNA, 22 nt, Human
ucaaaggcagcugguaacaagu

SEQ ID NO: 1320872 - RNA, 19 nt, Human
ugccugaguagaugugaag

SEQ ID NO: 1320873 - RNA, 19 nt, Human
ugccugaguagaugugaag

SEQ ID NO: 1320874 - RNA, 18 nt, Human
ugguuuccggguuguccc

SEQ ID NO: 1320875 - RNA, 24 nt, Human
aaggugcugagaucacagguguga

SEQ ID NO: 1320876 - RNA, 19 nt, Human
aaguagcugggaaugcagg

SEQ ID NO: 1320877 - RNA, 21 nt, Human
acaggugcccaccaccacacc

SEQ ID NO: 1320878 - RNA, 23 nt, Human
accaaucagguacuggaggugaa

SEQ ID NO: 1320879 - RNA, 22 nt, Human
accauagggaaaugucuucuca

SEQ ID NO: 1320880 - RNA, 18 nt, Human
accauguuggccaggcug

SEQ ID NO: 1320881 - RNA, 24 nt, Human
acucuguugcccaggcuggagugc

SEQ ID NO: 1320882 - RNA, 18 nt, Human
agaacucaaaggacagga

SEQ ID NO: 1320883 - RNA, 19 nt, Human
agaucacaggugugagcca

SEQ ID NO: 1320884 - RNA, 24 nt, Human
agcugggaaugcaggggcgcgcca

SEQ ID NO: 1320885 - RNA, 18 nt, Human
aggaaggagaugaguugg

SEQ ID NO: 1320886 - RNA, 21 nt, Human
aggaaggcagguuugggcugg

SEQ ID NO: 1320887 - RNA, 25 nt, Human
aggcuggagugcaguggcaugaucu

SEQ ID NO: 1320888 - RNA, 24 nt, Human
agggauucuccugccucagccucc

SEQ ID NO: 1320889 - RNA, 22 nt, Human
agguaauccgccugccucggcc

SEQ ID NO: 1320890 - RNA, 24 nt, Human
agguaauccgccugccucggccuc

SEQ ID NO: 1320891 - RNA, 26 nt, Human
aggugcugagaucacaggugugagcc

SEQ ID NO: 1320892 - RNA, 18 nt, Human
aguaggugggauuacagg

SEQ ID NO: 1320893 - RNA, 18 nt, Human
agugcaguggcaugaucu

SEQ ID NO: 1320894 - RNA, 19 nt, Human
agugcaguggcaugaucuc

SEQ ID NO: 1320895 - RNA, 21 nt, Human
agugcaguggcaugaucucug

SEQ ID NO: 1320896 - RNA, 18 nt, Human
augggguuucaccauguu

SEQ ID NO: 1320897 - RNA, 22 nt, Human
augggguuucaccauguuggcc

SEQ ID NO: 1320898 - RNA, 23 nt, Human
augggguuucaccauguuggcca

SEQ ID NO: 1320899 - RNA, 24 nt, Human
augggguuucaccauguuggccag

SEQ ID NO: 1320900 - RNA, 20 nt, Human
caaccuccacuuccugggcu

SEQ ID NO: 1320901 - RNA, 23 nt, Human
caaccuccacuuccugggcucaa

SEQ ID NO: 1320902 - RNA, 22 nt, Human
caagccccuccagagaagcaag

SEQ ID NO: 1320903 - RNA, 22 nt, Human
caagggauucuccugccucagc

SEQ ID NO: 1320904 - RNA, 24 nt, Human
caaggugcugagaucacaggugug

SEQ ID NO: 1320905 - RNA, 22 nt, Human
caagugauucuccugccucagc

SEQ ID NO: 1320906 - RNA, 19 nt, Human
cacagaacucaaaggacag

SEQ ID NO: 1320907 - RNA, 19 nt, Human
cacaggugugagccaccac

SEQ ID NO: 1320908 - RNA, 24 nt, Human
caccacaccuggcuaauuuuugua

SEQ ID NO: 1320909 - RNA, 21 nt, Human
caccauguuggccaggcuggu

SEQ ID NO: 1320910 - RNA, 24 nt, Human
caccauguuggccaggcuggucuc

SEQ ID NO: 1320911 - RNA, 27 nt, Human
caccauguuggccaggcuggucucaaa

SEQ ID NO: 1320912 - RNA, 23 nt, Human
cacugcaaccuccacuuccuggg

SEQ ID NO: 1320913 - RNA, 20 nt, Human
cacuggacauuucaagcccc

SEQ ID NO: 1320914 - RNA, 24 nt, Human
caggugcccaccaccacaccuggc

SEQ ID NO: 1320915 - RNA, 19 nt, Human
cagguucaagggauucucc

SEQ ID NO: 1320916 - RNA, 24 nt, Human
cauguuggccaggcuggucucaaa

SEQ ID NO: 1320917 - RNA, 20 nt, Human
cauuguaacacagacaaagc

SEQ ID NO: 1320918 - RNA, 21 nt, Human
ccaaggugcugagaucacagg

SEQ ID NO: 1320919 - RNA, 24 nt, Human
ccaaggugcugagaucacaggugu

SEQ ID NO: 1320920 - RNA, 24 nt, Human
ccaaguagcugggaaugcaggggc

SEQ ID NO: 1320921 - RNA, 21 nt, Human
ccagggggcaacgugugccag

SEQ ID NO: 1320922 - RNA, 23 nt, Human
cccaaguagcugggaaugcaggg

SEQ ID NO: 1320923 - RNA, 23 nt, Human
cccgaguaggugggauuacaggu

SEQ ID NO: 1320924 - RNA, 18 nt, Human
ccgcaggguuggcaggcc

SEQ ID NO: 1320925 - RNA, 22 nt, Human
ccuccacuuccugggcucaagu

SEQ ID NO: 1320926 - RNA, 23 nt, Human
ccugaccuaagguaauccgccug

SEQ ID NO: 1320927 - RNA, 23 nt, Human
ccugccucagccucccaaguagc

SEQ ID NO: 1320928 - RNA, 24 nt, Human
ccugccucagccucccgaguaggu

SEQ ID NO: 1320929 - RNA, 23 nt, Human
ccugggcucaagugauucuccuc

SEQ ID NO: 1320930 - RNA, 23 nt, Human
ccugggcucaagugauucuccug

SEQ ID NO: 1320931 - RNA, 21 nt, Human
cgacagagaggggcaggguac

SEQ ID NO: 1320932 - RNA, 23 nt, Human
cuaauuuuuguauuuuuaguaga

SEQ ID NO: 1320933 - RNA, 23 nt, Human
cucaagugauucuccugccucag

SEQ ID NO: 1320934 - RNA, 24 nt, Human
cucaagugauucuccugccucagc

SEQ ID NO: 1320935 - RNA, 24 nt, Human
cucacugcaaccuccacuuccugg

SEQ ID NO: 1320936 - RNA, 21 nt, Human
cucccaaggugcugagaucac

SEQ ID NO: 1320937 - RNA, 26 nt, Human
cuccugaccuaagguaauccgccugc

SEQ ID NO: 1320938 - RNA, 24 nt, Human
cugcaaccuccacuuccugggcuc

SEQ ID NO: 1320939 - RNA, 23 nt, Human
cugccucagccucccaaguagcu

SEQ ID NO: 1320940 - RNA, 23 nt, Human
cugccucggccucccaaggugcu

SEQ ID NO: 1320941 - RNA, 24 nt, Human
cuggggaacccacuucccagguuc

SEQ ID NO: 1320942 - RNA, 26 nt, Human
cuuacugugcugggaguacuugugga

SEQ ID NO: 1320943 - RNA, 24 nt, Human
cuucccagguucaagggauucucc

SEQ ID NO: 1320944 - RNA, 24 nt, Human
cuuccugggcucaagugauucucc

SEQ ID NO: 1320945 - RNA, 19 nt, Human
cuuguggagugcgggcugu

SEQ ID NO: 1320946 - RNA, 20 nt, Human
cuuguggagugcgggcugug

SEQ ID NO: 1320947 - RNA, 20 nt, Human
cuuuuguauuuuuaguggag

SEQ ID NO: 1320948 - RNA, 19 nt, Human
gacacagaacucaaaggac

SEQ ID NO: 1320949 - RNA, 21 nt, Human
gacaggaaggagaugaguugg

SEQ ID NO: 1320950 - RNA, 24 nt, Human
gacaggggucccugccagggaugc

SEQ ID NO: 1320951 - RNA, 19 nt, Human
gacagugucaggcaaggac

SEQ ID NO: 1320952 - RNA, 24 nt, Human
gaccuaagguaauccgccugccuc

SEQ ID NO: 1320953 - RNA, 20 nt, Human
gagaugaguuggaggcuggg

SEQ ID NO: 1320954 - RNA, 18 nt, Human
gagaugggguuucaccau

SEQ ID NO: 1320955 - RNA, 24 nt, Human
gagaugggguuucaccauguuggc

SEQ ID NO: 1320956 - RNA, 23 nt, Human
gagcuaggaaggcagguuugggc

SEQ ID NO: 1320957 - RNA, 20 nt, Human
gaggcugggacagggguccc

SEQ ID NO: 1320958 - RNA, 19 nt, Human
gaguuggaggcugggacag

SEQ ID NO: 1320959 - RNA, 18 nt, Human
gaucacaggugugagcca

SEQ ID NO: 1320960 - RNA, 21 nt, Human
gauucuccugccucagccucc

SEQ ID NO: 1320961 - RNA, 20 nt, Human
gcccaggcuggagugcagug

SEQ ID NO: 1320962 - RNA, 24 nt, Human
gcccaggcuggagugcaguggcau

SEQ ID NO: 1320963 - RNA, 21 nt, Human
gccugguuuggggaauguucg

SEQ ID NO: 1320964 - RNA, 25 nt, Human
gcuggagugcaguggcaugaucucu

SEQ ID NO: 1320965 - RNA, 24 nt, Human
gggauucuccugccucagccuccc

SEQ ID NO: 1320966 - RNA, 22 nt, Human
gggcucaagugauucuccugcc

SEQ ID NO: 1320967 - RNA, 22 nt, Human
gggguuucaccauguuggccag

SEQ ID NO: 1320968 - RNA, 22 nt, Human
ggguuucaccauguuggccagg

SEQ ID NO: 1320969 - RNA, 23 nt, Human
guagagaugggguuucaccaugu

SEQ ID NO: 1320970 - RNA, 24 nt, Human
gugauucuccugccucagccuccc

SEQ ID NO: 1320971 - RNA, 21 nt, Human
gugcugagaucacagguguga

SEQ ID NO: 1320972 - RNA, 21 nt, Human
gugugagccaccacgcugggc

SEQ ID NO: 1320973 - RNA, 22 nt, Human
uaacuuuuguauuuuuagugga

SEQ ID NO: 1320974 - RNA, 24 nt, Human
uaauuuuuguauuuuuaguagaga

SEQ ID NO: 1320975 - RNA, 22 nt, Human
uacaggugcccaccaccacacc

SEQ ID NO: 1320976 - RNA, 24 nt, Human
uacucuguugcccaggcuggagug

SEQ ID NO: 1320977 - RNA, 22 nt, Human
uagagaugggguuucaccaugu

SEQ ID NO: 1320978 - RNA, 18 nt, Human
uagcauuguaacacagac

SEQ ID NO: 1320979 - RNA, 22 nt, Human
uagcuacgacagagaggggcag

SEQ ID NO: 1320980 - RNA, 25 nt, Human
uaggaaggcagguuugggcuggaga

SEQ ID NO: 1320981 - RNA, 24 nt, Human
uaguagagaugggguuucaccaug

SEQ ID NO: 1320982 - RNA, 26 nt, Human
uaguagagaugggguuucaccauguu

SEQ ID NO: 1320983 - RNA, 19 nt, Human
uauguguuucucaguugga

SEQ ID NO: 1320984 - RNA, 20 nt, Human
uauguuccaaaggacugacg

SEQ ID NO: 1320985 - RNA, 24 nt, Human
ucacugcaaccuccacuuccuggg

SEQ ID NO: 1320986 - RNA, 25 nt, Human
ucacugcaaccuccacuuccugggc

SEQ ID NO: 1320987 - RNA, 27 nt, Human
ucacugcaaccuccacuuccugggcuc

SEQ ID NO: 1320988 - RNA, 18 nt, Human
ucagccucccaaguagcu

SEQ ID NO: 1320989 - RNA, 20 nt, Human
ucagccucccaaguagcugg

SEQ ID NO: 1320990 - RNA, 19 nt, Human
uccaaaggacugacggacc

SEQ ID NO: 1320991 - RNA, 22 nt, Human
uccagagaagcaagucuuacug

SEQ ID NO: 1320992 - RNA, 23 nt, Human
ucccaaggugcugagaucacagg

SEQ ID NO: 1320993 - RNA, 24 nt, Human
ucccagguagacagugguugaggc

SEQ ID NO: 1320994 - RNA, 21 nt, Human
ucccagguucaagggauucuc

SEQ ID NO: 1320995 - RNA, 24 nt, Human
ucccagguucaagggauucuccug

SEQ ID NO: 1320996 - RNA, 23 nt, Human
ucccgaguaggugggauuacagg

SEQ ID NO: 1320997 - RNA, 24 nt, Human
ucccgaguaggugggauuacaggu

SEQ ID NO: 1320998 - RNA, 19 nt, Human
uccugggcucaagugauuc

SEQ ID NO: 1320999 - RNA, 20 nt, Human
uccugggcucaagugauucu

SEQ ID NO: 1321000 - RNA, 21 nt, Human
uccugggcucaagugauucuc

SEQ ID NO: 1321001 - RNA, 22 nt, Human
uccugggcucaagugauucucc

SEQ ID NO: 1321002 - RNA, 24 nt, Human
uccugggcucaagugauucuccug

SEQ ID NO: 1321003 - RNA, 18 nt, Human
ucggccucccaaggugcu

SEQ ID NO: 1321004 - RNA, 22 nt, Human
ucuagacuccauccuccauccc

SEQ ID NO: 1321005 - RNA, 19 nt, Human
ucuccugccucagccuccc

SEQ ID NO: 1321006 - RNA, 26 nt, Human
ucuccugccucagccucccaaguagc

SEQ ID NO: 1321007 - RNA, 18 nt, Human
ucuguugcccaggcugga

SEQ ID NO: 1321008 - RNA, 24 nt, Human
ucuguugcccaggcuggagugcag

SEQ ID NO: 1321009 - RNA, 23 nt, Human
ucuuacucuguugcccaggcugg

SEQ ID NO: 1321010 - RNA, 24 nt, Human
ucuuacucuguugcccaggcugga

SEQ ID NO: 1321011 - RNA, 19 nt, Human
ugacacagaacucaaagga

SEQ ID NO: 1321012 - RNA, 22 nt, Human
ugaccgugauugccugggauga

SEQ ID NO: 1321013 - RNA, 18 nt, Human
ugacguuggacucauugg

SEQ ID NO: 1321014 - RNA, 22 nt, Human
ugagaucacaggugugagccac

SEQ ID NO: 1321015 - RNA, 24 nt, Human
ugagaucacaggugugagccacca

SEQ ID NO: 1321016 - RNA, 23 nt, Human
ugaucucugcucacugcaaccuc

SEQ ID NO: 1321017 - RNA, 20 nt, Human
ugauucuccugccucagccu

SEQ ID NO: 1321018 - RNA, 25 nt, Human
ugcaaccuccacuuccugggcucaa

SEQ ID NO: 1321019 - RNA, 18 nt, Human
ugcccaggcuggagugca

SEQ ID NO: 1321020 - RNA, 21 nt, Human
ugcccaggcuggagugcagug

SEQ ID NO: 1321021 - RNA, 22 nt, Human
ugcccaggcuggagugcagugg

SEQ ID NO: 1321022 - RNA, 24 nt, Human
ugcccaggcuggagugcaguggca

SEQ ID NO: 1321023 - RNA, 21 nt, Human
ugcccugggcuuuaauuauuu

SEQ ID NO: 1321024 - RNA, 24 nt, Human
ugccucagccucccaaguagcugg

SEQ ID NO: 1321025 - RNA, 24 nt, Human
ugccucagccucccgaguaggugg

SEQ ID NO: 1321026 - RNA, 21 nt, Human
ugccucggccucccaaggugc

SEQ ID NO: 1321027 - RNA, 24 nt, Human
ugccucggccucccaaggugcuga

SEQ ID NO: 1321028 - RNA, 22 nt, Human
ugccugggaugagaguggagac

SEQ ID NO: 1321029 - RNA, 21 nt, Human
ugccugguuuggggaauguuc

SEQ ID NO: 1321030 - RNA, 24 nt, Human
ugcugagaucacaggugugagcca

SEQ ID NO: 1321031 - RNA, 27 nt, Human
uggagacucgggcuugggaggcauccc

SEQ ID NO: 1321032 - RNA, 24 nt, Human
uggagucuuacucuguugcccagg

SEQ ID NO: 1321033 - RNA, 19 nt, Human
uggagugcaguggcaugau

SEQ ID NO: 1321034 - RNA, 22 nt, Human
uggagugcaguggcaugaucuc

SEQ ID NO: 1321035 - RNA, 23 nt, Human
uggagugcaguggcaugaucucu

SEQ ID NO: 1321036 - RNA, 24 nt, Human
uggagugcaguggcaugaucucug

SEQ ID NO: 1321037 - RNA, 24 nt, Human
uggccaggcuggucucaaacuccu

SEQ ID NO: 1321038 - RNA, 24 nt, Human
ugggaaugcaggggcgcgccacca

SEQ ID NO: 1321039 - RNA, 20 nt, Human
ugggaugagaguggagacgg

SEQ ID NO: 1321040 - RNA, 21 nt, Human
ugggauuacaggugcccacca

SEQ ID NO: 1321041 - RNA, 24 nt, Human
ugggauuacaggugcccaccacca

SEQ ID NO: 1321042 - RNA, 18 nt, Human
ugggcucaagugauucuc

SEQ ID NO: 1321043 - RNA, 24 nt, Human
ugggcucaagugauucuccugccu

SEQ ID NO: 1321044 - RNA, 20 nt, Human
ugggcuggagacucgggcuu

SEQ ID NO: 1321045 - RNA, 24 nt, Human
ugggguuucaccauguuggccagg

SEQ ID NO: 1321046 - RNA, 20 nt, Human
ugggucuggagcuaggaagg

SEQ ID NO: 1321047 - RNA, 21 nt, Human
uguauuuuuaguagagauggg

SEQ ID NO: 1321048 - RNA, 22 nt, Human
ugugacacagaacucaaaggac

SEQ ID NO: 1321049 - RNA, 21 nt, Human
uguuuuuuaaagauggagucu

SEQ ID NO: 1321050 - RNA, 24 nt, Human
uuacucuguugcccaggcuggagu

SEQ ID NO: 1321051 - RNA, 18 nt, Human
uuaguagagaugggguuu

SEQ ID NO: 1321052 - RNA, 22 nt, Human
uuaguagagaugggguuucacc

SEQ ID NO: 1321053 - RNA, 24 nt, Human
uuaguagagaugggguuucaccau

SEQ ID NO: 1321054 - RNA, 23 nt, Human
uucaagggauucuccugccucag

SEQ ID NO: 1321055 - RNA, 18 nt, Human
uucuucuuguggccucug

SEQ ID NO: 1321056 - RNA, 19 nt, Human
uugauauguguuucucagu

SEQ ID NO: 1321057 - RNA, 19 nt, Human
uugcuugggacccaggggg

SEQ ID NO: 1321058 - RNA, 20 nt, Human
uuggaggcugggacaggggu

SEQ ID NO: 1321059 - RNA, 21 nt, Human
uugggaggcaucccagguaga

SEQ ID NO: 1321060 - RNA, 23 nt, Human
uuguauuuuuaguagagaugggg

SEQ ID NO: 1321061 - RNA, 22 nt, Human
uuuaaagauggagucuuacucu

SEQ ID NO: 1321062 - RNA, 24 nt, Human
uuucaccauguuggccaggcuggu

SEQ ID NO: 1321063 - RNA, 20 nt, Human
uuuuguauuuuuaguagaga

SEQ ID NO: 1321064 - RNA, 24 nt, Human
uuuuuaguagagaugggguuucac

SEQ ID NO: 1321065 - RNA, 21 nt, Human
uuuuucuucuuguggccucug

SEQ ID NO: 1321066 - RNA, 20 nt, Human
uuuuuguauuuuuaguagag

SEQ ID NO: 1321067 - RNA, 19 nt, Human
aaacacagccaaaagcucc

SEQ ID NO: 1321068 - RNA, 21 nt, Human
aaaggagcuuuguucugauua

SEQ ID NO: 1321069 - RNA, 18 nt, Human
aacacagccaaaagcucc

SEQ ID NO: 1321070 - RNA, 21 nt, Human
aagcuccacuuccaagaugau

SEQ ID NO: 1321071 - RNA, 18 nt, Human
aagcuugcagcuuacaag

SEQ ID NO: 1321072 - RNA, 25 nt, Human
acaaaagaaaauuauucuucucuca

SEQ ID NO: 1321073 - RNA, 21 nt, Human
acacagugaaacaaaagaaaa

SEQ ID NO: 1321074 - RNA, 21 nt, Human
accacuaugcuuucuaaccuu

SEQ ID NO: 1321075 - RNA, 19 nt, Human
agaaaauuauucuucucuc

SEQ ID NO: 1321076 - RNA, 23 nt, Human
aguacacagugaaacaaaagaaa

SEQ ID NO: 1321077 - RNA, 20 nt, Human
augcuuucaauauuuucagc

SEQ ID NO: 1321078 - RNA, 20 nt, Human
cacguacauaaugcccuaug

SEQ ID NO: 1321079 - RNA, 19 nt, Human
ccaaaagcuccacuuccaa

SEQ ID NO: 1321080 - RNA, 22 nt, Human
cuaaccuuguaaacacagccaa

SEQ ID NO: 1321081 - RNA, 23 nt, Human
cuuccaagaugauccaaaauugc

SEQ ID NO: 1321082 - RNA, 23 nt, Human
guaaacacagccaaaagcuccac

SEQ ID NO: 1321083 - RNA, 19 nt, Human
uaaccuuguaaacacagcc

SEQ ID NO: 1321084 - RNA, 18 nt, Human
ucuaaccuuguaaacaca

SEQ ID NO: 1321085 - RNA, 18 nt, Human
uguaaacacagccaaaag

SEQ ID NO: 1321086 - RNA, 24 nt, Human
aaagugcugagauuauaggcguga

SEQ ID NO: 1321087 - RNA, 24 nt, Human
aagcaacacagaccacaauuucua

SEQ ID NO: 1321088 - RNA, 21 nt, Human
acagaaaaaaacuugucaaca

SEQ ID NO: 1321089 - RNA, 18 nt, Human
accauguuggccaggcug

SEQ ID NO: 1321090 - RNA, 19 nt, Human
acccuguaagaagggcuga

SEQ ID NO: 1321091 - RNA, 18 nt, Human
acgggguuucaccauguu

SEQ ID NO: 1321092 - RNA, 23 nt, Human
acgggguuucaccauguuggcca

SEQ ID NO: 1321093 - RNA, 24 nt, Human
acgggguuucaccauguuggccag

SEQ ID NO: 1321094 - RNA, 26 nt, Human
acuuuguaauuaacuucauggccagu

SEQ ID NO: 1321095 - RNA, 23 nt, Human
agaaaagaaucuccccgcaugaa

SEQ ID NO: 1321096 - RNA, 18 nt, Human
agaccgccaccacgcccg

SEQ ID NO: 1321097 - RNA, 26 nt, Human
agcgaaaaaaaagagaaaaaaaaucu

SEQ ID NO: 1321098 - RNA, 18 nt, Human
aggcgugagucaccgcgc

SEQ ID NO: 1321099 - RNA, 18 nt, Human
aguagcugggauuacaga

SEQ ID NO: 1321100 - RNA, 18 nt, Human
auuauuuucacagacuuc

SEQ ID NO: 1321101 - RNA, 24 nt, Human
caaagugcugagauuauaggcgug

SEQ ID NO: 1321102 - RNA, 21 nt, Human
caacacaggaaaaagcuaaac

SEQ ID NO: 1321103 - RNA, 28 nt, Human
caagcgauucuugugccucagccuccug

SEQ ID NO: 1321104 - RNA, 20 nt, Human
cacaggaaaaagcuaaacag

SEQ ID NO: 1321105 - RNA, 21 nt, Human
caccauguuggccaggcuggu

SEQ ID NO: 1321106 - RNA, 22 nt, Human
caccauguuggccaggcugguc

SEQ ID NO: 1321107 - RNA, 27 nt, Human
caccauguuggccaggcuggucuagaa

SEQ ID NO: 1321108 - RNA, 25 nt, Human
cagaaaaagagcgaaaaaaaagaga

SEQ ID NO: 1321109 - RNA, 20 nt, Human
cagccuccugaguagcuggg

SEQ ID NO: 1321110 - RNA, 24 nt, Human
cauguuggccaggcuggucuagaa

SEQ ID NO: 1321111 - RNA, 19 nt, Human
cauuuuguugucaaguauc

SEQ ID NO: 1321112 - RNA, 22 nt, Human
ccaaagugcugagauuauaggc

SEQ ID NO: 1321113 - RNA, 22 nt, Human
ccaaagugcugagauuauaggc

SEQ ID NO: 1321114 - RNA, 24 nt, Human
ccaaagugcugagauuauaggcgu

SEQ ID NO: 1321115 - RNA, 22 nt, Human
ccaaauucuuccaguuuccuca

SEQ ID NO: 1321116 - RNA, 19 nt, Human
ccaagcaacacagaccaca

SEQ ID NO: 1321117 - RNA, 23 nt, Human
ccauaaauuuaaauaucucuaau

SEQ ID NO: 1321118 - RNA, 20 nt, Human
cccggguucaagcgauucuu

SEQ ID NO: 1321119 - RNA, 23 nt, Human
cccguggcggcugggccuuuccu

SEQ ID NO: 1321120 - RNA, 24 nt, Human
ccgccucccggguucaagcgauuc

SEQ ID NO: 1321121 - RNA, 24 nt, Human
ccgccucugccucccaaagugcug

SEQ ID NO: 1321122 - RNA, 19 nt, Human
ccggcgcgcgggcggccgc

SEQ ID NO: 1321123 - RNA, 22 nt, Human
ccucccggguucaagcgauucu

SEQ ID NO: 1321124 - RNA, 19 nt, Human
ccugaguagcugggauuac

SEQ ID NO: 1321125 - RNA, 20 nt, Human
cgauucuugugccucagccu

SEQ ID NO: 1321126 - RNA, 20 nt, Human
cgcgcgggcggccgcgaccg

SEQ ID NO: 1321127 - RNA, 19 nt, Human
cggcacagaaaauaugugc

SEQ ID NO: 1321128 - RNA, 24 nt, Human
cggggucuggcucugucgcccagg

SEQ ID NO: 1321129 - RNA, 18 nt, Human
cuagaacuccgccucugc

SEQ ID NO: 1321130 - RNA, 24 nt, Human
cucagccuccugaguagcugggau

SEQ ID NO: 1321131 - RNA, 19 nt, Human
cugaauucuacaugccgac

SEQ ID NO: 1321132 - RNA, 19 nt, Human
cugggauuacagagaccgc

SEQ ID NO: 1321133 - RNA, 22 nt, Human
cuucagaaaaagagcgaaaaaa

SEQ ID NO: 1321134 - RNA, 25 nt, Human
cuugugccucagccuccugaguagc

SEQ ID NO: 1321135 - RNA, 25 nt, Human
gaguagcugggauuacagagaccgc

SEQ ID NO: 1321136 - RNA, 22 nt, Human
gauuauaggcgugagucaccgc

SEQ ID NO: 1321137 - RNA, 21 nt, Human
gauucuugugccucagccucc

SEQ ID NO: 1321138 - RNA, 23 nt, Human
gcaacacagaccacaauuucuac

SEQ ID NO: 1321139 - RNA, 23 nt, Human
gcccggcuaauuuuuuguauuuu

SEQ ID NO: 1321140 - RNA, 20 nt, Human
gccgccggcgcgcgggcggc

SEQ ID NO: 1321141 - RNA, 23 nt, Human
gccucugccucccaaagugcuga

SEQ ID NO: 1321142 - RNA, 23 nt, Human
gcgauucuugugccucagccucc

SEQ ID NO: 1321143 - RNA, 30 nt, Human
gcucugucgcccaggcuggagggcaauggg

SEQ ID NO: 1321144 - RNA, 18 nt, Human
ggaggcggggcccagggg

SEQ ID NO: 1321145 - RNA, 24 nt, Human
ggaggcggggcccaggggcggguc

SEQ ID NO: 1321146 - RNA, 19 nt, Human
ggcucugucgcccaggcug

SEQ ID NO: 1321147 - RNA, 19 nt, Human
gggccgccggcgcgcgggc

SEQ ID NO: 1321148 - RNA, 21 nt, Human
gggcgggucgagggcggcccg

SEQ ID NO: 1321149 - RNA, 23 nt, Human
gggguuucaccauguuggccagg

SEQ ID NO: 1321150 - RNA, 23 nt, Human
ggguacuucgggaguuaaaaaca

SEQ ID NO: 1321151 - RNA, 22 nt, Human
ggguuucaccauguuggccagg

SEQ ID NO: 1321152 - RNA, 23 nt, Human
guagcugggauuacagagaccgc

SEQ ID NO: 1321153 - RNA, 23 nt, Human
gucaaguauccagcuggguacuu

SEQ ID NO: 1321154 - RNA, 22 nt, Human
gugccucagccuccugaguagc

SEQ ID NO: 1321155 - RNA, 26 nt, Human
uaaaauucaaagaaaagaaucucccc

SEQ ID NO: 1321156 - RNA, 21 nt, Human
uaagaagggcugaauucuaca

SEQ ID NO: 1321157 - RNA, 22 nt, Human
uaauuuuuuguauuuuuaguag

SEQ ID NO: 1321158 - RNA, 23 nt, Human
uaauuuuuuguauuuuuaguaga

SEQ ID NO: 1321159 - RNA, 22 nt, Human
uacagagaccgccaccacgccc

SEQ ID NO: 1321160 - RNA, 22 nt, Human
uagaaacgggguuucaccaugu

SEQ ID NO: 1321161 - RNA, 24 nt, Human
uaguagaaacgggguuucaccaug

SEQ ID NO: 1321162 - RNA, 25 nt, Human
uaguagaaacgggguuucaccaugu

SEQ ID NO: 1321163 - RNA, 21 nt, Human
ucaaguauccagcuggguacu

SEQ ID NO: 1321164 - RNA, 20 nt, Human
ucagccuccugaguagcugg

SEQ ID NO: 1321165 - RNA, 24 nt, Human
ucccaaagugcugagauuauaggc

SEQ ID NO: 1321166 - RNA, 20 nt, Human
ucccggguucaagcgauucu

SEQ ID NO: 1321167 - RNA, 20 nt, Human
ucccggguucaagcgauucu

SEQ ID NO: 1321168 - RNA, 22 nt, Human
ucccggguucaagcgauucuug

SEQ ID NO: 1321169 - RNA, 24 nt, Human
uccggcaaccgcgcggccccgccu

SEQ ID NO: 1321170 - RNA, 18 nt, Human
uccugaguagcugggauu

SEQ ID NO: 1321171 - RNA, 18 nt, Human
ucgcccaggcuggagggc

SEQ ID NO: 1321172 - RNA, 23 nt, Human
ucguucugaguguuuacaaagaa

SEQ ID NO: 1321173 - RNA, 24 nt, Human
ucucugcaaacuccgccucccggg

SEQ ID NO: 1321174 - RNA, 18 nt, Human
ucugaucacuuguuuucu

SEQ ID NO: 1321175 - RNA, 19 nt, Human
ucuggcucugucgcccagg

SEQ ID NO: 1321176 - RNA, 23 nt, Human
ucuggcucugucgcccaggcugg

SEQ ID NO: 1321177 - RNA, 24 nt, Human
ucuggcucugucgcccaggcugga

SEQ ID NO: 1321178 - RNA, 20 nt, Human
ugacguagaacaaaaucugc

SEQ ID NO: 1321179 - RNA, 22 nt, Human
ugacguagaacaaaaucugcgg

SEQ ID NO: 1321180 - RNA, 22 nt, Human
ugagacggggucuggcucuguc

SEQ ID NO: 1321181 - RNA, 18 nt, Human
ugagauuauaggcgugag

SEQ ID NO: 1321182 - RNA, 21 nt, Human
ugagauuauaggcgugaguca

SEQ ID NO: 1321183 - RNA, 22 nt, Human
ugagauuauaggcgugagucac

SEQ ID NO: 1321184 - RNA, 23 nt, Human
ugagauuauaggcgugagucacc

SEQ ID NO: 1321185 - RNA, 24 nt, Human
ugagauuauaggcgugagucaccg

SEQ ID NO: 1321186 - RNA, 21 nt, Human
ugcaacacaggaaaaagcuaa

SEQ ID NO: 1321187 - RNA, 30 nt, Human
ugcccaagcaacacagaccacaauuucuag

SEQ ID NO: 1321188 - RNA, 24 nt, Human
ugccucagccuccugaguagcugg

SEQ ID NO: 1321189 - RNA, 20 nt, Human
ugcgggugugugugugugug

SEQ ID NO: 1321190 - RNA, 21 nt, Human
uggccaggcuggucuagaacu

SEQ ID NO: 1321191 - RNA, 19 nt, Human
uggcgcgaucucagcucuc

SEQ ID NO: 1321192 - RNA, 24 nt, Human
uggcgcgaucucagcucucugcaa

SEQ ID NO: 1321193 - RNA, 20 nt, Human
ugggauuacagagaccgcca

SEQ ID NO: 1321194 - RNA, 21 nt, Human
ugggauuacagagaccgccac

SEQ ID NO: 1321195 - RNA, 23 nt, Human
ugggauuacagagaccgccacca

SEQ ID NO: 1321196 - RNA, 21 nt, Human
uguauuuuuaguagaaacggg

SEQ ID NO: 1321197 - RNA, 24 nt, Human
ugugccucagccuccugaguagcu

SEQ ID NO: 1321198 - RNA, 25 nt, Human
ugugcugcagcaugacugaucuggc

SEQ ID NO: 1321199 - RNA, 19 nt, Human
uuacagagaccgccaccac

SEQ ID NO: 1321200 - RNA, 20 nt, Human
uuacuaucuggacuuuacag

SEQ ID NO: 1321201 - RNA, 24 nt, Human
uuaguagaaacgggguuucaccau

SEQ ID NO: 1321202 - RNA, 30 nt, Human
uuauuuauuuauuuugagacggggucuggg

SEQ ID NO: 1321203 - RNA, 19 nt, Human
uucaaagaaaagaaucucc

SEQ ID NO: 1321204 - RNA, 23 nt, Human
uucaagcgauucuugugccucag

SEQ ID NO: 1321205 - RNA, 24 nt, Human
uucauacauuucuccugcauuucc

SEQ ID NO: 1321206 - RNA, 20 nt, Human
uuccucaacuuugcgccugu

SEQ ID NO: 1321207 - RNA, 19 nt, Human
uugcugggccgccggcgcg

SEQ ID NO: 1321208 - RNA, 27 nt, Human
uugcugggccgccggcgcgcgggcggc

SEQ ID NO: 1321209 - RNA, 23 nt, Human
uuguauuuuuaguagaaacgggg

SEQ ID NO: 1321210 - RNA, 19 nt, Human
uuuacuggaauacugucaa

SEQ ID NO: 1321211 - RNA, 23 nt, Human
uuuauuuauuuugagacgggguc

SEQ ID NO: 1321212 - RNA, 24 nt, Human
uuucaccauguuggccaggcuggu

SEQ ID NO: 1321213 - RNA, 19 nt, Human
uuuguugucaaguauccag

SEQ ID NO: 1321214 - RNA, 24 nt, Human
uuuuuaguagaaacgggguuucac

SEQ ID NO: 1321215 - RNA, 19 nt, Human
uuuuuguauuuuuaguaga

SEQ ID NO: 1321216 - RNA, 18 nt, Human
uuuuuuguauuuuuagua

SEQ ID NO: 1321217 - RNA, 24 nt, Human
cccgcgccagucccgccgccgccc

SEQ ID NO: 1321218 - RNA, 22 nt, Human
cccggaacuggcggcccagcuc

SEQ ID NO: 1321219 - RNA, 23 nt, Human
ccgcgccagucccgccgccgccc

SEQ ID NO: 1321220 - RNA, 24 nt, Human
ccgcgccagucccgccgccgcccu

SEQ ID NO: 1321221 - RNA, 23 nt, Human
ccgcugcccgcgccagucccgcc

SEQ ID NO: 1321222 - RNA, 21 nt, Human
cuugccuuucucgccggcugc

SEQ ID NO: 1321223 - RNA, 21 nt, Human
gaacuugccuuucucgccggc

SEQ ID NO: 1321224 - RNA, 25 nt, Human
gagcgcacccagaacuggaacuugc

SEQ ID NO: 1321225 - RNA, 19 nt, Human
ggggcugugcuuccggcug

SEQ ID NO: 1321226 - RNA, 22 nt, Human
ucccggaacuggcggcccagcu

SEQ ID NO: 1321227 - RNA, 24 nt, Human
ugaaacaaaaccagggggcugugc

SEQ ID NO: 1321228 - RNA, 24 nt, Human
ugcccaggcggaagcccuuggagc

SEQ ID NO: 1321229 - RNA, 21 nt, Human
ugcugcgugucaccgucuugg

SEQ ID NO: 1321230 - RNA, 18 nt, Human
uggguucccggccgcugc

SEQ ID NO: 1321231 - RNA, 18 nt, Human
aaaaggcuguauaaucua

SEQ ID NO: 1321232 - RNA, 21 nt, Human
agaagaaaacauguuuauuaa

SEQ ID NO: 1321233 - RNA, 19 nt, Human
agagcugaacuaguagcag

SEQ ID NO: 1321234 - RNA, 23 nt, Human
caauaagagcugaacuaguagca

SEQ ID NO: 1321235 - RNA, 20 nt, Human
caguggaauuaaacuucaau

SEQ ID NO: 1321236 - RNA, 21 nt, Human
cuaguagcaguggaaugguuu

SEQ ID NO: 1321237 - RNA, 21 nt, Human
ugagaagauacuugugcagug

SEQ ID NO: 1321238 - RNA, 20 nt, Human
ugugcaguggaauuaaacuu

SEQ ID NO: 1321239 - RNA, 20 nt, Human
agagccuggcauggaggagg

SEQ ID NO: 1321240 - RNA, 21 nt, Human
aggccgugggggccuccgagc

SEQ ID NO: 1321241 - RNA, 20 nt, Human
ccagagccuggcauggaggg

SEQ ID NO: 1321242 - RNA, 19 nt, Human
ccgugggggccuccgagcu

SEQ ID NO: 1321243 - RNA, 21 nt, Human
cggcccagagccuggcaugga

SEQ ID NO: 1321244 - RNA, 20 nt, Human
gcucccagaggccguggggg

SEQ ID NO: 1321245 - RNA, 23 nt, Human
ggcauggaggaggugagagcugu

SEQ ID NO: 1321246 - RNA, 18 nt, Human
ggaaggggccgguggggg

SEQ ID NO: 1321247 - RNA, 18 nt, Human
gggccggugggggacgag

SEQ ID NO: 1321248 - RNA, 21 nt, Human
ugguggcagccaaggaagggg

SEQ ID NO: 1321249 - RNA, 25 nt, Human
ugugguggcagccaaggaaggggcc

SEQ ID NO: 1321250 - RNA, 21 nt, Human
aaacgcuccggccgcugaucc

SEQ ID NO: 1321251 - RNA, 19 nt, Human
aaccccuccugcauuccgu

SEQ ID NO: 1321252 - RNA, 22 nt, Human
acacccagccgcacaagaaccc

SEQ ID NO: 1321253 - RNA, 21 nt, Human
acuguccugcuugguuaggaa

SEQ ID NO: 1321254 - RNA, 23 nt, Human
aggacggaaugcaggagggguuc

SEQ ID NO: 1321255 - RNA, 23 nt, Human
aggacggaaugcaggagggguuc

SEQ ID NO: 1321256 - RNA, 18 nt, Human
agugacacuguugaugug

SEQ ID NO: 1321257 - RNA, 23 nt, Human
augacccuccucccuggcaguga

SEQ ID NO: 1321258 - RNA, 20 nt, Human
cacaacuuuacguuucccuu

SEQ ID NO: 1321259 - RNA, 18 nt, Human
cacagcccaugcuggcac

SEQ ID NO: 1321260 - RNA, 20 nt, Human
caccacucucacauccauca

SEQ ID NO: 1321261 - RNA, 21 nt, Human
cagaguccgccaaacgcuccg

SEQ ID NO: 1321262 - RNA, 18 nt, Human
cagcaugggcuguggcaa

SEQ ID NO: 1321263 - RNA, 20 nt, Human
cagcuucucccucuccccuc

SEQ ID NO: 1321264 - RNA, 21 nt, Human
cagcuucucccucuccccucc

SEQ ID NO: 1321265 - RNA, 19 nt, Human
ccagcagaagaggcacccc

SEQ ID NO: 1321266 - RNA, 18 nt, Human
ccagcaggagguucccgc

SEQ ID NO: 1321267 - RNA, 18 nt, Human
ccagcaggagguucccgc

SEQ ID NO: 1321268 - RNA, 22 nt, Human
cccacacccagccgcacaagaa

SEQ ID NO: 1321269 - RNA, 23 nt, Human
cccacagcugugcagcgggaacc

SEQ ID NO: 1321270 - RNA, 18 nt, Human
cccagccgcacaagaacc

SEQ ID NO: 1321271 - RNA, 18 nt, Human
cccagcuucucccucucc

SEQ ID NO: 1321272 - RNA, 21 nt, Human
ccccaaaaaaacgcagaaugu

SEQ ID NO: 1321273 - RNA, 20 nt, Human
ccccacagcugugcagcggg

SEQ ID NO: 1321274 - RNA, 22 nt, Human
ccgcacaagaaccccuccugca

SEQ ID NO: 1321275 - RNA, 19 nt, Human
ccgccaaacgcuccggccg

SEQ ID NO: 1321276 - RNA, 20 nt, Human
ccucacacgcaggccugucc

SEQ ID NO: 1321277 - RNA, 23 nt, Human
ccucuucugcuggcaagagugug

SEQ ID NO: 1321278 - RNA, 23 nt, Human
ccucuucugcuggcaagagugug

SEQ ID NO: 1321279 - RNA, 21 nt, Human
ccucuucugcuggcaagaguu

SEQ ID NO: 1321280 - RNA, 21 nt, Human
ccucuucugcuggcaagaguu

SEQ ID NO: 1321281 - RNA, 22 nt, Human
cgaagggagaacacaaugacau

SEQ ID NO: 1321282 - RNA, 18 nt, Human
cgcugcacagcugugggg

SEQ ID NO: 1321283 - RNA, 23 nt, Human
cuccaaguccacgcagaguccgc

SEQ ID NO: 1321284 - RNA, 21 nt, Human
cucccagaaacucagacccaa

SEQ ID NO: 1321285 - RNA, 21 nt, Human
cucccuggcagugacacuguu

SEQ ID NO: 1321286 - RNA, 21 nt, Human
gaaguccucuacaucaucccu

SEQ ID NO: 1321287 - RNA, 19 nt, Human
gacauggcuagcaugaccc

SEQ ID NO: 1321288 - RNA, 19 nt, Human
gcagaagaggcaccccaca

SEQ ID NO: 1321289 - RNA, 18 nt, Human
gcggcuggguguggggcc

SEQ ID NO: 1321290 - RNA, 27 nt, Human
ggccucuucugcuggcaagaguguggu

SEQ ID NO: 1321291 - RNA, 27 nt, Human
ggccucuucugcuggcaagaguguggu

SEQ ID NO: 1321292 - RNA, 19 nt, Human
gggaaccguggagaaaugg

SEQ ID NO: 1321293 - RNA, 19 nt, Human
gggaaccguggagaaaugg

SEQ ID NO: 1321294 - RNA, 24 nt, Human
gucaugugggcuaguagauuggcc

SEQ ID NO: 1321295 - RNA, 21 nt, Human
gugaggauagacuggguggug

SEQ ID NO: 1321296 - RNA, 21 nt, Human
gugaggauagacuggguggug

SEQ ID NO: 1321297 - RNA, 23 nt, Human
uacguuucccuuuccuggccauu

SEQ ID NO: 1321298 - RNA, 21 nt, Human
uaguagauuggccagggcuuc

SEQ ID NO: 1321299 - RNA, 19 nt, Human
ucacacucuugccagcaga

SEQ ID NO: 1321300 - RNA, 20 nt, Human
ucccagaaacucagacccaa

SEQ ID NO: 1321301 - RNA, 21 nt, Human
ucccgcagggcuucaccacuc

SEQ ID NO: 1321302 - RNA, 22 nt, Human
ucuccacgguucccgugagggc

SEQ ID NO: 1321303 - RNA, 23 nt, Human
ugacacuguugaugugaacccca

SEQ ID NO: 1321304 - RNA, 20 nt, Human
ugacaugagugacuguccug

SEQ ID NO: 1321305 - RNA, 23 nt, Human
ugaggacggaaugcaggaggggu

SEQ ID NO: 1321306 - RNA, 23 nt, Human
ugaggacggaaugcaggaggggu

SEQ ID NO: 1321307 - RNA, 20 nt, Human
ugagggccccacacccagcc

SEQ ID NO: 1321308 - RNA, 21 nt, Human
ugagggccccacacccagccg

SEQ ID NO: 1321309 - RNA, 22 nt, Human
uggacaggccugcgugugagga

SEQ ID NO: 1321310 - RNA, 22 nt, Human
uggacaggccugcgugugagga

SEQ ID NO: 1321311 - RNA, 19 nt, Human
uggcuagcaugacccuccu

SEQ ID NO: 1321312 - RNA, 23 nt, Human
uggugaggagcugccccuugggu

SEQ ID NO: 1321313 - RNA, 26 nt, Human
uguccuguccucugaauccgcuuuca

SEQ ID NO: 1321314 - RNA, 23 nt, Human
ugugaggacggaaugcaggaggg

SEQ ID NO: 1321315 - RNA, 23 nt, Human
ugugaggacggaaugcaggaggg

SEQ ID NO: 1321316 - RNA, 19 nt, Human
ugugcggcugggugugggg

SEQ ID NO: 1321317 - RNA, 20 nt, Human
uguggaauucuguugaugau

SEQ ID NO: 1321318 - RNA, 24 nt, Human
uucgaagggagaacacaaugacau

SEQ ID NO: 1321319 - RNA, 20 nt, Human
aaaauguacccagaauccuc

SEQ ID NO: 1321320 - RNA, 23 nt, Human
aacccaucuuacccucugguccc

SEQ ID NO: 1321321 - RNA, 23 nt, Human
aacugaccucacucccugacccc

SEQ ID NO: 1321322 - RNA, 19 nt, Human
aagugaguccccaccuccc

SEQ ID NO: 1321323 - RNA, 19 nt, Human
acccagaagcccccauuau

SEQ ID NO: 1321324 - RNA, 22 nt, Human
acccagaagcccccauuauccc

SEQ ID NO: 1321325 - RNA, 23 nt, Human
accccugucugucauuccugggc

SEQ ID NO: 1321326 - RNA, 18 nt, Human
acuccaagccucccugaa

SEQ ID NO: 1321327 - RNA, 23 nt, Human
agaagcccccauuaucccugcuu

SEQ ID NO: 1321328 - RNA, 18 nt, Human
agaauccuccaaacuacc

SEQ ID NO: 1321329 - RNA, 19 nt, Human
aggcauagagccgcugucc

SEQ ID NO: 1321330 - RNA, 18 nt, Human
aucaagaaacccagaagc

SEQ ID NO: 1321331 - RNA, 18 nt, Human
auggccucuggguccagc

SEQ ID NO: 1321332 - RNA, 18 nt, Human
caacucuaccccugucug

SEQ ID NO: 1321333 - RNA, 19 nt, Human
caagaaacccagaagcccc

SEQ ID NO: 1321334 - RNA, 27 nt, Human
cacucccugaccccaugccacuaguuc

SEQ ID NO: 1321335 - RNA, 19 nt, Human
cacugaacucccugagccu

SEQ ID NO: 1321336 - RNA, 25 nt, Human
cagaauccuccaaacuaccccuaga

SEQ ID NO: 1321337 - RNA, 24 nt, Human
caucaagaaacccagaagccccca

SEQ ID NO: 1321338 - RNA, 23 nt, Human
ccaccucccugagaugccaaccc

SEQ ID NO: 1321339 - RNA, 22 nt, Human
ccagaauccuccaaacuacccc

SEQ ID NO: 1321340 - RNA, 20 nt, Human
cccaaaagugaguccccacc

SEQ ID NO: 1321341 - RNA, 21 nt, Human
cccagaauccuccaaacuacc

SEQ ID NO: 1321342 - RNA, 23 nt, Human
ccccaaagccuugccuagaaccc

SEQ ID NO: 1321343 - RNA, 21 nt, Human
ccccaccucccugagaugcca

SEQ ID NO: 1321344 - RNA, 31 nt, Human
ccccacugaacucccugagccuacccuuccu

SEQ ID NO: 1321345 - RNA, 18 nt, Human
ccccagauccuccugagc

SEQ ID NO: 1321346 - RNA, 23 nt, Human
ccccauuaucccugcuuggucug

SEQ ID NO: 1321347 - RNA, 26 nt, Human
cccccaaagccuugccuagaaccugc

SEQ ID NO: 1321348 - RNA, 21 nt, Human
cccuagagcagccauuccugc

SEQ ID NO: 1321349 - RNA, 22 nt, Human
cccucugaugcuacccaauauc

SEQ ID NO: 1321350 - RNA, 21 nt, Human
ccuacccuucugccucccaaa

SEQ ID NO: 1321351 - RNA, 22 nt, Human
ccuacccuucugccucccaaaa

SEQ ID NO: 1321352 - RNA, 21 nt, Human
ccucuauaacugaccucacuc

SEQ ID NO: 1321353 - RNA, 21 nt, Human
ccugaccugugacccauggcc

SEQ ID NO: 1321354 - RNA, 23 nt, Human
ccuuccacugcccccuugccauc

SEQ ID NO: 1321355 - RNA, 22 nt, Human
ccuucugccucccaaaagugag

SEQ ID NO: 1321356 - RNA, 24 nt, Human
cuaguucccccaaagccuugccua

SEQ ID NO: 1321357 - RNA, 23 nt, Human
cucacucccugaccccaugccac

SEQ ID NO: 1321358 - RNA, 22 nt, Human
cucauguccuauuccagccagu

SEQ ID NO: 1321359 - RNA, 18 nt, Human
cuccaagccucccugaac

SEQ ID NO: 1321360 - RNA, 24 nt, Human
cuccaagccucccugaaccaucuc

SEQ ID NO: 1321361 - RNA, 19 nt, Human
cugaaccaucuccauaacc

SEQ ID NO: 1321362 - RNA, 18 nt, Human
cuguccccacugaacucc

SEQ ID NO: 1321363 - RNA, 21 nt, Human
gaccccaugccacuaguuccc

SEQ ID NO: 1321364 - RNA, 20 nt, Human
gccagcaacucuaccccugu

SEQ ID NO: 1321365 - RNA, 18 nt, Human
ggcuuuauggccucuggg

SEQ ID NO: 1321366 - RNA, 19 nt, Human
uacccaauauccugaccug

SEQ ID NO: 1321367 - RNA, 19 nt, Human
uacccagaauccuccaaac

SEQ ID NO: 1321368 - RNA, 21 nt, Human
uaguucccccaaagccuugcc

SEQ ID NO: 1321369 - RNA, 18 nt, Human
uauccagacccuagagca

SEQ ID NO: 1321370 - RNA, 21 nt, Human
uaucccugcuuggucuggaga

SEQ ID NO: 1321371 - RNA, 18 nt, Human
ucccaaaagugagucccc

SEQ ID NO: 1321372 - RNA, 19 nt, Human
ucccaaaagugagucccca

SEQ ID NO: 1321373 - RNA, 22 nt, Human
ucccugagccuacccuucugcc

SEQ ID NO: 1321374 - RNA, 18 nt, Human
uccugggccugcuuucca

SEQ ID NO: 1321375 - RNA, 22 nt, Human
ucucaccuuccacugcccccuu

SEQ ID NO: 1321376 - RNA, 25 nt, Human
ugagccuacccuucugccucccaaa

SEQ ID NO: 1321377 - RNA, 21 nt, Human
ugccacuaguucccccaaagc

SEQ ID NO: 1321378 - RNA, 19 nt, Human
uggccucuggguccagccu

SEQ ID NO: 1321379 - RNA, 18 nt, Human
uguccagauccugaccug

SEQ ID NO: 1321380 - RNA, 18 nt, Human
uuccugggccugcuuucc

SEQ ID NO: 1321381 - RNA, 21 nt, Human
aaaagagagagcuucaauaug

SEQ ID NO: 1321382 - RNA, 23 nt, Human
acucugaauguacaaaagagaga

SEQ ID NO: 1321383 - RNA, 20 nt, Human
acugcgggaauccuggagaa

SEQ ID NO: 1321384 - RNA, 22 nt, Human
agaaacgagacugagaccuagg

SEQ ID NO: 1321385 - RNA, 19 nt, Human
cacccuuggaaaccuguaa

SEQ ID NO: 1321386 - RNA, 22 nt, Human
caccgugacccccucgcccccg

SEQ ID NO: 1321387 - RNA, 20 nt, Human
cacgcccguguccgucucca

SEQ ID NO: 1321388 - RNA, 23 nt, Human
caugcaaacuccgggcauacaau

SEQ ID NO: 1321389 - RNA, 18 nt, Human
ccacccuuggaaaccugu

SEQ ID NO: 1321390 - RNA, 22 nt, Human
ccacgcccguguccgucucccc

SEQ ID NO: 1321391 - RNA, 19 nt, Human
ccagguguggaaugcucac

SEQ ID NO: 1321392 - RNA, 21 nt, Human
cccagggucaacccccgggcu

SEQ ID NO: 1321393 - RNA, 23 nt, Human
cccccucgcccccggcacgccca

SEQ ID NO: 1321394 - RNA, 18 nt, Human
ccccucugggaggaacgc

SEQ ID NO: 1321395 - RNA, 21 nt, Human
cccuauugcugcuacucagaa

SEQ ID NO: 1321396 - RNA, 26 nt, Human
cccugcuccaggccgggacgccccuc

SEQ ID NO: 1321397 - RNA, 18 nt, Human
cggccacccuuggaaacc

SEQ ID NO: 1321398 - RNA, 21 nt, Human
ggccacccuuggaaaccugua

SEQ ID NO: 1321399 - RNA, 18 nt, Human
guccagguguggaaugcu

SEQ ID NO: 1321400 - RNA, 24 nt, Human
uaggugaugacacaaaugccuuga

SEQ ID NO: 1321401 - RNA, 21 nt, Human
uaugaaacaguaauccucuga

SEQ ID NO: 1321402 - RNA, 21 nt, Human
ucaaacucugaauguacaaaa

SEQ ID NO: 1321403 - RNA, 21 nt, Human
ucccguuccugcuuccccaca

SEQ ID NO: 1321404 - RNA, 19 nt, Human
ucccugcuccaggccggga

SEQ ID NO: 1321405 - RNA, 19 nt, Human
ugagaaaaaaucucaugca

SEQ ID NO: 1321406 - RNA, 21 nt, Human
ugccggugcccgcugggccgu

SEQ ID NO: 1321407 - RNA, 23 nt, Human
ugcuacucagaaacgagacugag

SEQ ID NO: 1321408 - RNA, 21 nt, Human
uggaaugcucacaguugucac

SEQ ID NO: 1321409 - RNA, 25 nt, Human
uuccucaacacugcgggaauccugg

SEQ ID NO: 1321410 - RNA, 19 nt, Human
uuuucagaaaaguuuucgc

SEQ ID NO: 1321411 - RNA, 23 nt, Human
aaacagauacaaagcaaagagac

SEQ ID NO: 1321412 - RNA, 19 nt, Human
aaagauggcgucagggugg

SEQ ID NO: 1321413 - RNA, 29 nt, Human
aacucacaaacagauacaaagggaaaguc

SEQ ID NO: 1321414 - RNA, 18 nt, Human
acaaagcaaagagacaga

SEQ ID NO: 1321415 - RNA, 19 nt, Human
acaaagcaaagagacagag

SEQ ID NO: 1321416 - RNA, 19 nt, Human
acccuuccaccccuucccc

SEQ ID NO: 1321417 - RNA, 19 nt, Human
accuccacccuuccacccc

SEQ ID NO: 1321418 - RNA, 22 nt, Human
acuagaacagagagagaagcca

SEQ ID NO: 1321419 - RNA, 25 nt, Human
agaagccaggaucaacucacaaaca

SEQ ID NO: 1321420 - RNA, 21 nt, Human
aggcggcccuguccggccagc

SEQ ID NO: 1321421 - RNA, 24 nt, Human
aggucuccaggagcggcgcaauuu

SEQ ID NO: 1321422 - RNA, 19 nt, Human
caacucacaaacagauaca

SEQ ID NO: 1321423 - RNA, 21 nt, Human
cacgcccccgugccaccccug

SEQ ID NO: 1321424 - RNA, 18 nt, Human
cagcccggcgacaggcgg

SEQ ID NO: 1321425 - RNA, 22 nt, Human
cagucuccgccaccgccgcggc

SEQ ID NO: 1321426 - RNA, 24 nt, Human
ccaccccuuccccgcgccaggacc

SEQ ID NO: 1321427 - RNA, 23 nt, Human
ccccgugccacugcucuccugac

SEQ ID NO: 1321428 - RNA, 23 nt, Human
ccccuaaauggauggaaccaagu

SEQ ID NO: 1321429 - RNA, 18 nt, Human
cccgugccacugcucucc

SEQ ID NO: 1321430 - RNA, 20 nt, Human
cccgugccacugcucuccug

SEQ ID NO: 1321431 - RNA, 21 nt, Human
cccgugccacugcucuccuga

SEQ ID NO: 1321432 - RNA, 23 nt, Human
ccgccaugcggucaaggaucugu

SEQ ID NO: 1321433 - RNA, 18 nt, Human
ccuccacccuuccacccc

SEQ ID NO: 1321434 - RNA, 18 nt, Human
ccuuaccaaggugggcug

SEQ ID NO: 1321435 - RNA, 19 nt, Human
cgacaggcggcccuguccg

SEQ ID NO: 1321436 - RNA, 19 nt, Human
cgcaacggcgaagcgcggc

SEQ ID NO: 1321437 - RNA, 22 nt, Human
cuaccuccacccuuccaccccu

SEQ ID NO: 1321438 - RNA, 26 nt, Human
cuaccuccacccuuccaccccuuccc

SEQ ID NO: 1321439 - RNA, 22 nt, Human
cuuccaccccuuccccgcgcca

SEQ ID NO: 1321440 - RNA, 18 nt, Human
cuuucccucuuccucacg

SEQ ID NO: 1321441 - RNA, 24 nt, Human
cuuuuguuguuuuguuuucagcca

SEQ ID NO: 1321442 - RNA, 19 nt, Human
gccccggauggcaaggccc

SEQ ID NO: 1321443 - RNA, 23 nt, Human
gcgcggcccggcuggggcucggg

SEQ ID NO: 1321444 - RNA, 19 nt, Human
gcucuuaaagccacagucu

SEQ ID NO: 1321445 - RNA, 21 nt, Human
ggagcggcgcaauuuuguucc

SEQ ID NO: 1321446 - RNA, 20 nt, Human
ggcacgcucuuaaagccaca

SEQ ID NO: 1321447 - RNA, 18 nt, Human
gggcccuggggcccuuac

SEQ ID NO: 1321448 - RNA, 21 nt, Human
ggguggguguggcaggcucca

SEQ ID NO: 1321449 - RNA, 20 nt, Human
ggugaacucuggggcagccc

SEQ ID NO: 1321450 - RNA, 23 nt, Human
guggggcuuggcuccgcuggggu

SEQ ID NO: 1321451 - RNA, 19 nt, Human
gugguuuggcagcgggugg

SEQ ID NO: 1321452 - RNA, 26 nt, Human
uacaaagcaaagagacagagagacag

SEQ ID NO: 1321453 - RNA, 21 nt, Human
uagaacagagagagaagccag

SEQ ID NO: 1321454 - RNA, 23 nt, Human
uagaacagagagagaagccagga

SEQ ID NO: 1321455 - RNA, 21 nt, Human
uagaggccggucaccagaaag

SEQ ID NO: 1321456 - RNA, 20 nt, Human
ucagccaaaacuagaacaga

SEQ ID NO: 1321457 - RNA, 23 nt, Human
ucagggugggaggaugccccgga

SEQ ID NO: 1321458 - RNA, 20 nt, Human
ucagucacucucucacgcuu

SEQ ID NO: 1321459 - RNA, 18 nt, Human
uccgccaccgccgcggcc

SEQ ID NO: 1321460 - RNA, 21 nt, Human
ucucagcagcccggcgacagg

SEQ ID NO: 1321461 - RNA, 21 nt, Human
ucuccgccaccgccgcggccg

SEQ ID NO: 1321462 - RNA, 19 nt, Human
uggcagcgggugggugugg

SEQ ID NO: 1321463 - RNA, 19 nt, Human
uggcaggcuccacacacug

SEQ ID NO: 1321464 - RNA, 22 nt, Human
ugggaggaugccccggauggca

SEQ ID NO: 1321465 - RNA, 23 nt, Human
uggggcagcccacgaggcacucc

SEQ ID NO: 1321466 - RNA, 18 nt, Human
uguccggccagcgugggg

SEQ ID NO: 1321467 - RNA, 21 nt, Human
uuaaagccacagucuccgccc

SEQ ID NO: 1321468 - RNA, 23 nt, Human
uuccccuuucccucuuccucacg

SEQ ID NO: 1321469 - RNA, 22 nt, Human
cgagcccgggaacagaaggaag

SEQ ID NO: 1321470 - RNA, 19 nt, Human
guggugugggcaauguccc

SEQ ID NO: 1321471 - RNA, 20 nt, Human
ugugggcaaugucccugagg

SEQ ID NO: 1321472 - RNA, 21 nt, Human
acccugguaccccauaguagc

SEQ ID NO: 1321473 - RNA, 24 nt, Human
acccugguaccccauaguagcugg

SEQ ID NO: 1321474 - RNA, 21 nt, Human
aggaaccccagaaaagaccuu

SEQ ID NO: 1321475 - RNA, 22 nt, Human
cacagcaggaaccccagaaaag

SEQ ID NO: 1321476 - RNA, 25 nt, Human
cauaguagcugcacacagcaggaac

SEQ ID NO: 1321477 - RNA, 25 nt, Human
ccccagaaaagaccuugccccuucu

SEQ ID NO: 1321478 - RNA, 26 nt, Human
cuggcugguaauugcugacucuccuu

SEQ ID NO: 1321479 - RNA, 18 nt, Human
gcacacagcaggaacccc

SEQ ID NO: 1321480 - RNA, 22 nt, Human
gcacacagcaggaaccccagga

SEQ ID NO: 1321481 - RNA, 21 nt, Human
gcagugggcucucccuuacuc

SEQ ID NO: 1321482 - RNA, 20 nt, Human
gccuuuuuuagcagugggcu

SEQ ID NO: 1321483 - RNA, 20 nt, Human
gggcaucccccacccuggua

SEQ ID NO: 1321484 - RNA, 22 nt, Human
gggcaucccccacccugguacc

SEQ ID NO: 1321485 - RNA, 18 nt, Human
ucacuggaggauucagaa

SEQ ID NO: 1321486 - RNA, 23 nt, Human
ucagggcaucccccacccuggua

SEQ ID NO: 1321487 - RNA, 22 nt, Human
uccaggaccuuggcuggcuggu

SEQ ID NO: 1321488 - RNA, 22 nt, Human
ucccacggccggcaggucugcc

SEQ ID NO: 1321489 - RNA, 19 nt, Human
uccgcggcucccacggccg

SEQ ID NO: 1321490 - RNA, 23 nt, Human
ugaggauuugacuaggccuuuuu

SEQ ID NO: 1321491 - RNA, 19 nt, Human
uggagaaggcaguaaaugg

SEQ ID NO: 1321492 - RNA, 22 nt, Human
uguuuccggccucugccucuug

SEQ ID NO: 1321493 - RNA, 23 nt, Human
uuccuggagaaggcaguaaaugg

SEQ ID NO: 1321494 - RNA, 24 nt, Human
uuccuggagaaggcaguaaauggg

SEQ ID NO: 1321495 - RNA, 21 nt, Human
uugcugacucuccuuguuucc

SEQ ID NO: 1321496 - RNA, 19 nt, Human
uuuagcagugggcucuccc

SEQ ID NO: 1321497 - RNA, 24 nt, Human
uuuccugucauucauuuauuugac

SEQ ID NO: 1321498 - RNA, 24 nt, Human
aaagugcugggaucacaggcguga

SEQ ID NO: 1321499 - RNA, 21 nt, Human
aagcgaacacgggcuccucca

SEQ ID NO: 1321500 - RNA, 19 nt, Human
aaguagcugggacuaaggc

SEQ ID NO: 1321501 - RNA, 26 nt, Human
aagugcugggaucacaggcgugagcc

SEQ ID NO: 1321502 - RNA, 26 nt, Human
acagaacuccagcaaaaagggaacgc

SEQ ID NO: 1321503 - RNA, 18 nt, Human
acgggguuucaccacguu

SEQ ID NO: 1321504 - RNA, 20 nt, Human
acgggguuucaccacguugg

SEQ ID NO: 1321505 - RNA, 24 nt, Human
acgggguuucaccacguuggccag

SEQ ID NO: 1321506 - RNA, 20 nt, Human
acugcaagcuccgccucccg

SEQ ID NO: 1321507 - RNA, 23 nt, Human
acuugcucugucgccaggcugga

SEQ ID NO: 1321508 - RNA, 22 nt, Human
agaaagagcuuggcuccuggug

SEQ ID NO: 1321509 - RNA, 22 nt, Human
agccuucugucguccugagcaa

SEQ ID NO: 1321510 - RNA, 20 nt, Human
aggaaggaugaugggcauau

SEQ ID NO: 1321511 - RNA, 24 nt, Human
aggcuggagugcaguggcagaucu

SEQ ID NO: 1321512 - RNA, 24 nt, Human
agugauuccccugccucagccucc

SEQ ID NO: 1321513 - RNA, 22 nt, Human
agugcaguggcagaucucgguu

SEQ ID NO: 1321514 - RNA, 23 nt, Human
agugcaguggcagaucucgguuc

SEQ ID NO: 1321515 - RNA, 18 nt, Human
augaaguggaaaaaguga

SEQ ID NO: 1321516 - RNA, 24 nt, Human
auuuuaguagagacgggguuucac

SEQ ID NO: 1321517 - RNA, 24 nt, Human
auuuuuuguauuuuaguagagacg

SEQ ID NO: 1321518 - RNA, 23 nt, Human
caaaaguugauuugaauccugau

SEQ ID NO: 1321519 - RNA, 22 nt, Human
caaaguaucauuuaacaugcaa

SEQ ID NO: 1321520 - RNA, 24 nt, Human
caaagugcugggaucacaggcgug

SEQ ID NO: 1321521 - RNA, 19 nt, Human
caacaugaaaaucauuaac

SEQ ID NO: 1321522 - RNA, 22 nt, Human
caagugauuccccugccucagc

SEQ ID NO: 1321523 - RNA, 27 nt, Human
caagugauuccccugccucagccuccc

SEQ ID NO: 1321524 - RNA, 25 nt, Human
caauucagacuaaccauaaugccga

SEQ ID NO: 1321525 - RNA, 23 nt, Human
cacaggcgugagccaccgcgccc

SEQ ID NO: 1321526 - RNA, 18 nt, Human
caccacguuggccaggau

SEQ ID NO: 1321527 - RNA, 22 nt, Human
caccacguuggccaggaugguc

SEQ ID NO: 1321528 - RNA, 24 nt, Human
caccacguuggccaggauggucuc

SEQ ID NO: 1321529 - RNA, 22 nt, Human
caccauccaauuccuaaucaaa

SEQ ID NO: 1321530 - RNA, 19 nt, Human
cacgauguuuucugcgcug

SEQ ID NO: 1321531 - RNA, 19 nt, Human
cagaaagagcuuggcuccu

SEQ ID NO: 1321532 - RNA, 19 nt, Human
ccaaaggagccaugaagug

SEQ ID NO: 1321533 - RNA, 22 nt, Human
ccaaagugcugggaucacaggc

SEQ ID NO: 1321534 - RNA, 24 nt, Human
ccaaagugcugggaucacaggcgu

SEQ ID NO: 1321535 - RNA, 24 nt, Human
ccaacucaccauccaauuccuaau

SEQ ID NO: 1321536 - RNA, 21 nt, Human
ccaaguagcugggacuaaggc

SEQ ID NO: 1321537 - RNA, 20 nt, Human
ccaccacgcccggcuaauuu

SEQ ID NO: 1321538 - RNA, 18 nt, Human
ccaccgcgcccggccugc

SEQ ID NO: 1321539 - RNA, 18 nt, Human
ccaccgcgcccggccugc

SEQ ID NO: 1321540 - RNA, 20 nt, Human
ccaccgcgcccggccugcuu

SEQ ID NO: 1321541 - RNA, 24 nt, Human
ccagcaaaaagcuaaggacugggg

SEQ ID NO: 1321542 - RNA, 19 nt, Human
cccaaguagcugggacuaa

SEQ ID NO: 1321543 - RNA, 21 nt, Human
cccggguucaagugauucccc

SEQ ID NO: 1321544 - RNA, 23 nt, Human
cccggguucaagugauuccccug

SEQ ID NO: 1321545 - RNA, 24 nt, Human
ccgccucccggguucaagugauuc

SEQ ID NO: 1321546 - RNA, 19 nt, Human
ccgcgcccggccugcuuug

SEQ ID NO: 1321547 - RNA, 21 nt, Human
ccucccggguucaagugauuc

SEQ ID NO: 1321548 - RNA, 22 nt, Human
ccucccggguucaagugauucc

SEQ ID NO: 1321549 - RNA, 23 nt, Human
ccugccucagccucccaaguagc

SEQ ID NO: 1321550 - RNA, 24 nt, Human
ccugccucagccucccaaguagcu

SEQ ID NO: 1321551 - RNA, 24 nt, Human
cgccucggccucccaaagugcugg

SEQ ID NO: 1321552 - RNA, 28 nt, Human
cgcuuugguuguuuuuuuuuuuuucuuu

SEQ ID NO: 1321553 - RNA, 24 nt, Human
cgggguuucaccacguuggccagg

SEQ ID NO: 1321554 - RNA, 24 nt, Human
cucagccucccaaguagcugggac

SEQ ID NO: 1321555 - RNA, 22 nt, Human
cucagucugaaacugaaauaaa

SEQ ID NO: 1321556 - RNA, 24 nt, Human
cuccugaccucgugaugcgcccgc

SEQ ID NO: 1321557 - RNA, 19 nt, Human
cucugucgccaggcuggag

SEQ ID NO: 1321558 - RNA, 23 nt, Human
cugcaagccuucugucguccuga

SEQ ID NO: 1321559 - RNA, 24 nt, Human
cuggagugcaguggcagaucucgg

SEQ ID NO: 1321560 - RNA, 20 nt, Human
cuugcucugucgccaggcug

SEQ ID NO: 1321561 - RNA, 22 nt, Human
cuugcucugucgccaggcugga

SEQ ID NO: 1321562 - RNA, 18 nt, Human
gaaaacauuuuuugagaa

SEQ ID NO: 1321563 - RNA, 19 nt, Human
gaauccugauagauuccac

SEQ ID NO: 1321564 - RNA, 24 nt, Human
gagacgggguuucaccacguuggc

SEQ ID NO: 1321565 - RNA, 18 nt, Human
gaucacaggcgugagcca

SEQ ID NO: 1321566 - RNA, 21 nt, Human
gaucacaggcgugagccaccg

SEQ ID NO: 1321567 - RNA, 23 nt, Human
gcccggcuaauuuuuuguauuuu

SEQ ID NO: 1321568 - RNA, 24 nt, Human
gccugcuuugguauuuuuuaagag

SEQ ID NO: 1321569 - RNA, 19 nt, Human
gcucugucgccaggcugga

SEQ ID NO: 1321570 - RNA, 20 nt, Human
ggaugaauccauuauauuua

SEQ ID NO: 1321571 - RNA, 24 nt, Human
ggauggucucgaucuccugaccuc

SEQ ID NO: 1321572 - RNA, 22 nt, Human
ggcuccguccucgccugcuuca

SEQ ID NO: 1321573 - RNA, 24 nt, Human
gggcuucuuagcagaccucagucu

SEQ ID NO: 1321574 - RNA, 23 nt, Human
gggguuucaccacguuggccagg

SEQ ID NO: 1321575 - RNA, 24 nt, Human
gugaugcgcccgccucggccuccc

SEQ ID NO: 1321576 - RNA, 24 nt, Human
gugauuccccugccucagccuccc

SEQ ID NO: 1321577 - RNA, 23 nt, Human
gugcaguggcagaucucgguuca

SEQ ID NO: 1321578 - RNA, 26 nt, Human
uaaauaaaccaaaagaaauggccugu

SEQ ID NO: 1321579 - RNA, 24 nt, Human
uaaggacugggggaucccaacuca

SEQ ID NO: 1321580 - RNA, 22 nt, Human
uaaggcgugcgccaccacgccc

SEQ ID NO: 1321581 - RNA, 23 nt, Human
uaauuuuuuguauuuuaguagag

SEQ ID NO: 1321582 - RNA, 24 nt, Human
uaauuuuuuguauuuuaguagaga

SEQ ID NO: 1321583 - RNA, 24 nt, Human
uacagaacuccagcaaaaggacau

SEQ ID NO: 1321584 - RNA, 20 nt, Human
uacccugguccaaaggagcc

SEQ ID NO: 1321585 - RNA, 22 nt, Human
uagagacgggguuucaccacgu

SEQ ID NO: 1321586 - RNA, 22 nt, Human
uagagcagcacgccggcaccuu

SEQ ID NO: 1321587 - RNA, 24 nt, Human
uaguagagacgggguuucaccacg

SEQ ID NO: 1321588 - RNA, 26 nt, Human
uaguagagacgggguuucaccacguu

SEQ ID NO: 1321589 - RNA, 24 nt, Human
ucaccacguuggccaggauggucu

SEQ ID NO: 1321590 - RNA, 18 nt, Human
ucacugcaagcuccgccu

SEQ ID NO: 1321591 - RNA, 19 nt, Human
ucacugcaagcuccgccuc

SEQ ID NO: 1321592 - RNA, 24 nt, Human
ucacugcaagcuccgccucccggg

SEQ ID NO: 1321593 - RNA, 18 nt, Human
ucagccucccaaguagcu

SEQ ID NO: 1321594 - RNA, 20 nt, Human
ucagccucccaaguagcugg

SEQ ID NO: 1321595 - RNA, 20 nt, Human
uccacuaacuuuuuugucuu

SEQ ID NO: 1321596 - RNA, 24 nt, Human
ucccaaagugcugggaucacaggc

SEQ ID NO: 1321597 - RNA, 23 nt, Human
ucccaaguagcugggacuaaggc

SEQ ID NO: 1321598 - RNA, 26 nt, Human
uccccugccucagccucccaaguagc

SEQ ID NO: 1321599 - RNA, 19 nt, Human
ucccggguucaagugauuc

SEQ ID NO: 1321600 - RNA, 24 nt, Human
ucccggguucaagugauuccccug

SEQ ID NO: 1321601 - RNA, 19 nt, Human
uccuuggaugaauccauua

SEQ ID NO: 1321602 - RNA, 18 nt, Human
ucggccucccaaagugcu

SEQ ID NO: 1321603 - RNA, 18 nt, Human
ucugucgccaggcuggag

SEQ ID NO: 1321604 - RNA, 21 nt, Human
ucugucgccaggcuggagugc

SEQ ID NO: 1321605 - RNA, 23 nt, Human
ucugucgccaggcuggagugcag

SEQ ID NO: 1321606 - RNA, 20 nt, Human
ugaaacugaaauaaaccugg

SEQ ID NO: 1321607 - RNA, 23 nt, Human
ugaaacugaaauaaaccuggacg

SEQ ID NO: 1321608 - RNA, 22 nt, Human
ugaagcgaacacgggcuccucc

SEQ ID NO: 1321609 - RNA, 21 nt, Human
ugacauuuugagauuuacaga

SEQ ID NO: 1321610 - RNA, 19 nt, Human
ugaugggcauauugcuugc

SEQ ID NO: 1321611 - RNA, 24 nt, Human
ugccucagccucccaaguagcugg

SEQ ID NO: 1321612 - RNA, 22 nt, Human
ugcgcugucuuuaaauuccagu

SEQ ID NO: 1321613 - RNA, 24 nt, Human
ugcugggaucacaggcgugagcca

SEQ ID NO: 1321614 - RNA, 21 nt, Human
ugcuucauuauuccagaaaga

SEQ ID NO: 1321615 - RNA, 21 nt, Human
uggagugcaguggcagaucuc

SEQ ID NO: 1321616 - RNA, 23 nt, Human
uggagugcaguggcagaucucgg

SEQ ID NO: 1321617 - RNA, 25 nt, Human
uggcaucgcuauuuuuauacccuuc

SEQ ID NO: 1321618 - RNA, 24 nt, Human
uggccaggauggucucgaucuccu

SEQ ID NO: 1321619 - RNA, 23 nt, Human
ugggacuaaggcgugcgccacca

SEQ ID NO: 1321620 - RNA, 19 nt, Human
ugggaucacaggcgugagc

SEQ ID NO: 1321621 - RNA, 21 nt, Human
ugggaucacaggcgugagcca

SEQ ID NO: 1321622 - RNA, 22 nt, Human
ugggaucacaggcgugagccac

SEQ ID NO: 1321623 - RNA, 23 nt, Human
ugggaucacaggcgugagccacc

SEQ ID NO: 1321624 - RNA, 24 nt, Human
ugggaucacaggcgugagccaccg

SEQ ID NO: 1321625 - RNA, 24 nt, Human
ugguaaauggaggcauuauaugga

SEQ ID NO: 1321626 - RNA, 22 nt, Human
ugguuguuuuuuuuuuuuucuu

SEQ ID NO: 1321627 - RNA, 18 nt, Human
uuaguagagacgggguuu

SEQ ID NO: 1321628 - RNA, 22 nt, Human
uuaguagagacgggguuucacc

SEQ ID NO: 1321629 - RNA, 24 nt, Human
uuaguagagacgggguuucaccac

SEQ ID NO: 1321630 - RNA, 25 nt, Human
uuaguagagacgggguuucaccacg

SEQ ID NO: 1321631 - RNA, 21 nt, Human
uucaagugauuccccugccuc

SEQ ID NO: 1321632 - RNA, 23 nt, Human
uucaagugauuccccugccucag

SEQ ID NO: 1321633 - RNA, 24 nt, Human
uucaagugauuccccugccucagc

SEQ ID NO: 1321634 - RNA, 21 nt, Human
uuccagaaagagcuuggcucc

SEQ ID NO: 1321635 - RNA, 19 nt, Human
uuccccugccucagccucc

SEQ ID NO: 1321636 - RNA, 22 nt, Human
uuccuuggaugaauccauuaua

SEQ ID NO: 1321637 - RNA, 21 nt, Human
uugucuuuuuuuuuggcugcc

SEQ ID NO: 1321638 - RNA, 19 nt, Human
uuucaccacguuggccagg

SEQ ID NO: 1321639 - RNA, 20 nt, Human
uuuuuguauuuuaguagaga

SEQ ID NO: 1321640 - RNA, 20 nt, Human
uagagaaacagaauuucaua

SEQ ID NO: 1321641 - RNA, 19 nt, Human
uguagagaaacagaauuuc

SEQ ID NO: 1321642 - RNA, 26 nt, Human
aacaguuuuuuuuuuuugcugugggg

SEQ ID NO: 1321643 - RNA, 18 nt, Human
aaguacaagacaaaaaug

SEQ ID NO: 1321644 - RNA, 20 nt, Human
aauuuucuuucugaugauac

SEQ ID NO: 1321645 - RNA, 24 nt, Human
acaagacaaaaaugcuuccucuca

SEQ ID NO: 1321646 - RNA, 21 nt, Human
acuccuucgccuucugacccc

SEQ ID NO: 1321647 - RNA, 18 nt, Human
agaauccucacauuacuc

SEQ ID NO: 1321648 - RNA, 18 nt, Human
aggaauaaaagaauggcc

SEQ ID NO: 1321649 - RNA, 21 nt, Human
caagacaaaaaugcuuccucu

SEQ ID NO: 1321650 - RNA, 22 nt, Human
cagcuguuucaaguacaagaca

SEQ ID NO: 1321651 - RNA, 24 nt, Human
gauggcaggugcugcagccaggaa

SEQ ID NO: 1321652 - RNA, 18 nt, Human
gggcccagcagcuguuuc

SEQ ID NO: 1321653 - RNA, 24 nt, Human
guaggauguuuagcagccucucuu

SEQ ID NO: 1321654 - RNA, 20 nt, Human
guuuuucuuaauuuucuuuc

SEQ ID NO: 1321655 - RNA, 21 nt, Human
guuuuuuuuuuuugcuguggg

SEQ ID NO: 1321656 - RNA, 25 nt, Human
uacaagacaaaaaugcuuccucuca

SEQ ID NO: 1321657 - RNA, 23 nt, Human
uaggauguuuagcagccucucuu

SEQ ID NO: 1321658 - RNA, 22 nt, Human
uccauaggcagaggagccucua

SEQ ID NO: 1321659 - RNA, 19 nt, Human
ucucaagauuucuucuguc

SEQ ID NO: 1321660 - RNA, 20 nt, Human
ucuuccguagcacaggaauu

SEQ ID NO: 1321661 - RNA, 20 nt, Human
ucuucugucacuacuuuggc

SEQ ID NO: 1321662 - RNA, 19 nt, Human
ugaugauacucucgauuuu

SEQ ID NO: 1321663 - RNA, 21 nt, Human
aggcugcugucucucaaacuu

SEQ ID NO: 1321664 - RNA, 19 nt, Human
acaacuagcuuccuugacc

SEQ ID NO: 1321665 - RNA, 21 nt, Human
agacguggaagacgcgcgcag

SEQ ID NO: 1321666 - RNA, 20 nt, Human
aggaacaguccacccauagc

SEQ ID NO: 1321667 - RNA, 24 nt, Human
aucaauuucagacuaggagauaug

SEQ ID NO: 1321668 - RNA, 21 nt, Human
aucagcuccacggaagagugg

SEQ ID NO: 1321669 - RNA, 22 nt, Human
caaaacuccuccauuaccaacc

SEQ ID NO: 1321670 - RNA, 25 nt, Human
cagccccaaagagcaaaggggacau

SEQ ID NO: 1321671 - RNA, 18 nt, Human
cagcggugcuuccgacga

SEQ ID NO: 1321672 - RNA, 23 nt, Human
caucucguaacugaaauagaagu

SEQ ID NO: 1321673 - RNA, 20 nt, Human
cauuccgugccuccuggagg

SEQ ID NO: 1321674 - RNA, 25 nt, Human
cauuccgugccuccuggagguauca

SEQ ID NO: 1321675 - RNA, 22 nt, Human
ccagcccagccccaaagagcaa

SEQ ID NO: 1321676 - RNA, 23 nt, Human
ccagcccagccccaaagagcaaa

SEQ ID NO: 1321677 - RNA, 24 nt, Human
ccagcccagccccaaagagcaaag

SEQ ID NO: 1321678 - RNA, 20 nt, Human
ccagccccaaagagcaaagg

SEQ ID NO: 1321679 - RNA, 22 nt, Human
cccaaagagcaaaggggacauu

SEQ ID NO: 1321680 - RNA, 22 nt, Human
cccauagcaaagacagaaggac

SEQ ID NO: 1321681 - RNA, 19 nt, Human
cccguccauaucaauuuca

SEQ ID NO: 1321682 - RNA, 22 nt, Human
cccguccauaucaauuucagac

SEQ ID NO: 1321683 - RNA, 27 nt, Human
cgagcaacucuugcaccgaagcgggac

SEQ ID NO: 1321684 - RNA, 23 nt, Human
cgcgagcaacucuugcaccgaag

SEQ ID NO: 1321685 - RNA, 24 nt, Human
cuccauaucaaaggaacaguccac

SEQ ID NO: 1321686 - RNA, 22 nt, Human
cuccuccauuaccaaccaccac

SEQ ID NO: 1321687 - RNA, 21 nt, Human
gagaauagaagcagcauaaga

SEQ ID NO: 1321688 - RNA, 24 nt, Human
gcaaagacagaaggacacggcccu

SEQ ID NO: 1321689 - RNA, 23 nt, Human
gcgccgagagaauagaagcagca

SEQ ID NO: 1321690 - RNA, 25 nt, Human
gcuccuggcagacgucacuagauuc

SEQ ID NO: 1321691 - RNA, 21 nt, Human
gggcaaauugccaaaagcaac

SEQ ID NO: 1321692 - RNA, 19 nt, Human
gucuuauucuucaaaacuc

SEQ ID NO: 1321693 - RNA, 22 nt, Human
uaaauuccguuuuaaucaucuc

SEQ ID NO: 1321694 - RNA, 23 nt, Human
uaagauauccggucagauucgac

SEQ ID NO: 1321695 - RNA, 20 nt, Human
uacuggauucgaccacugcu

SEQ ID NO: 1321696 - RNA, 22 nt, Human
uagagguucugucuucuggcuc

SEQ ID NO: 1321697 - RNA, 21 nt, Human
uagcaaagacagaaggacacg

SEQ ID NO: 1321698 - RNA, 23 nt, Human
uagcuuccuugaccaguuuucua

SEQ ID NO: 1321699 - RNA, 23 nt, Human
uauucccacaacuccacuugcau

SEQ ID NO: 1321700 - RNA, 18 nt, Human
ucaaaggaacaguccacc

SEQ ID NO: 1321701 - RNA, 25 nt, Human
ucuccuaaugucuuauucuucaaaa

SEQ ID NO: 1321702 - RNA, 21 nt, Human
ucugucuucuggcuccuggca

SEQ ID NO: 1321703 - RNA, 19 nt, Human
ugccucgaucgcgagcaac

SEQ ID NO: 1321704 - RNA, 25 nt, Human
ugucuuauucuucaaaacuccucca

SEQ ID NO: 1321705 - RNA, 20 nt, Human
uucaaaacuccuccauuacc

SEQ ID NO: 1321706 - RNA, 18 nt, Human
uugcaccgaagcgggaca

SEQ ID NO: 1321707 - RNA, 20 nt, Human
aaaaaaaaaaggagacucaa

SEQ ID NO: 1321708 - RNA, 22 nt, Human
aaaaaagcguugcucugccucc

SEQ ID NO: 1321709 - RNA, 24 nt, Human
aaaaaggagacucaaguuugaaaa

SEQ ID NO: 1321710 - RNA, 24 nt, Human
aaaaggagacucaaguuugaaaaa

SEQ ID NO: 1321711 - RNA, 19 nt, Human
aaaauuauagaaagccaga

SEQ ID NO: 1321712 - RNA, 21 nt, Human
acuuaaguuauaaacacacag

SEQ ID NO: 1321713 - RNA, 19 nt, Human
agaacccugcccuggccac

SEQ ID NO: 1321714 - RNA, 23 nt, Human
agagggaacuaaucacuucagug

SEQ ID NO: 1321715 - RNA, 22 nt, Human
aggccguuccgcgggggcggcg

SEQ ID NO: 1321716 - RNA, 21 nt, Human
agggaacuaaucacuucagug

SEQ ID NO: 1321717 - RNA, 19 nt, Human
agggggccgagggccgcgg

SEQ ID NO: 1321718 - RNA, 18 nt, Human
auagagaauauguaagac

SEQ ID NO: 1321719 - RNA, 19 nt, Human
auagagcccuggcagaacc

SEQ ID NO: 1321720 - RNA, 19 nt, Human
auauauauagcacuuaagu

SEQ ID NO: 1321721 - RNA, 24 nt, Human
aucacuuaaacagcaaccauauuu

SEQ ID NO: 1321722 - RNA, 22 nt, Human
caccaccuacaaaagugaugag

SEQ ID NO: 1321723 - RNA, 20 nt, Human
cagagcgagggagccgggga

SEQ ID NO: 1321724 - RNA, 22 nt, Human
caggccgggcauggcgggcgcc

SEQ ID NO: 1321725 - RNA, 20 nt, Human
cagguagaacuaccuaguua

SEQ ID NO: 1321726 - RNA, 22 nt, Human
cagugcgggcgaggaauccgcc

SEQ ID NO: 1321727 - RNA, 19 nt, Human
cccgcggcacacgcaccug

SEQ ID NO: 1321728 - RNA, 22 nt, Human
ccggcgcccagcggcgcccgca

SEQ ID NO: 1321729 - RNA, 21 nt, Human
ccuccuccgccgccgccgccg

SEQ ID NO: 1321730 - RNA, 20 nt, Human
ccugcccuggccacggcgaa

SEQ ID NO: 1321731 - RNA, 20 nt, Human
ccuggccacggcgaaaaaaa

SEQ ID NO: 1321732 - RNA, 19 nt, Human
cgaaagcagcucccgccgc

SEQ ID NO: 1321733 - RNA, 22 nt, Human
cgagcgggucuuggugcgggcc

SEQ ID NO: 1321734 - RNA, 23 nt, Human
cgagggggccgagggccgcggcg

SEQ ID NO: 1321735 - RNA, 19 nt, Human
cgccauggguccugccgag

SEQ ID NO: 1321736 - RNA, 21 nt, Human
cgccgccucuuccucuucaca

SEQ ID NO: 1321737 - RNA, 18 nt, Human
cgcggcgcgcgggggccg

SEQ ID NO: 1321738 - RNA, 24 nt, Human
cggcgcgcgggggccgccuucccg

SEQ ID NO: 1321739 - RNA, 18 nt, Human
cguccugccugccccggg

SEQ ID NO: 1321740 - RNA, 24 nt, Human
cucccgccgcggccugccgguacc

SEQ ID NO: 1321741 - RNA, 21 nt, Human
cuccuccgccgccgccgccgc

SEQ ID NO: 1321742 - RNA, 18 nt, Human
cuccucggacucggagcc

SEQ ID NO: 1321743 - RNA, 20 nt, Human
cugccgaggccgccgggucg

SEQ ID NO: 1321744 - RNA, 24 nt, Human
gaagccgaggcggggagccgcagg

SEQ ID NO: 1321745 - RNA, 21 nt, Human
gacagcucggccuccucggac

SEQ ID NO: 1321746 - RNA, 21 nt, Human
gaggaauccgccauggguccu

SEQ ID NO: 1321747 - RNA, 21 nt, Human
gaggaauccgccauggguccu

SEQ ID NO: 1321748 - RNA, 18 nt, Human
gagggagccggggagcgc

SEQ ID NO: 1321749 - RNA, 21 nt, Human
gcaggccgggcauggcgggcg

SEQ ID NO: 1321750 - RNA, 20 nt, Human
gccccagguggaccccugcu

SEQ ID NO: 1321751 - RNA, 20 nt, Human
gcggcacacgcaccugcaag

SEQ ID NO: 1321752 - RNA, 18 nt, Human
gcggcggcggcgaggggg

SEQ ID NO: 1321753 - RNA, 19 nt, Human
ggaagccgaggcggggagc

SEQ ID NO: 1321754 - RNA, 22 nt, Human
ggacgggaagccgaggcgggga

SEQ ID NO: 1321755 - RNA, 21 nt, Human
ggcgccuccuccuccuccgcc

SEQ ID NO: 1321756 - RNA, 19 nt, Human
gggccgagggccgcggcgc

SEQ ID NO: 1321757 - RNA, 22 nt, Human
guuaaaaaaaaaaaggagacuc

SEQ ID NO: 1321758 - RNA, 23 nt, Human
uaagagagggcuaucugcaggcg

SEQ ID NO: 1321759 - RNA, 23 nt, Human
uaagauggacacuauaggaaucc

SEQ ID NO: 1321760 - RNA, 23 nt, Human
uagcacuuaaguuauaaacacac

SEQ ID NO: 1321761 - RNA, 22 nt, Human
uccgccgccgccgccgccucuu

SEQ ID NO: 1321762 - RNA, 18 nt, Human
uccgcgggggcggcggac

SEQ ID NO: 1321763 - RNA, 21 nt, Human
uccuaggccccagguggaccc

SEQ ID NO: 1321764 - RNA, 22 nt, Human
uccuaggccccagguggacccc

SEQ ID NO: 1321765 - RNA, 24 nt, Human
uccuaggccccagguggaccccug

SEQ ID NO: 1321766 - RNA, 23 nt, Human
uccuccgccgccgccgccgccuc

SEQ ID NO: 1321767 - RNA, 22 nt, Human
uccuccuccgccgccgccgcua

SEQ ID NO: 1321768 - RNA, 22 nt, Human
uccuuuauugauuccccagcag

SEQ ID NO: 1321769 - RNA, 19 nt, Human
ucgaugacgccggcgccca

SEQ ID NO: 1321770 - RNA, 18 nt, Human
ucuaaaaacuaacaccac

SEQ ID NO: 1321771 - RNA, 22 nt, Human
ucugccuccuuuauugauuccc

SEQ ID NO: 1321772 - RNA, 18 nt, Human
ugagcuuuaggcuacaac

SEQ ID NO: 1321773 - RNA, 24 nt, Human
ugauuccccagcaggagccagcuu

SEQ ID NO: 1321774 - RNA, 20 nt, Human
ugccgguaccgggaagaccc

SEQ ID NO: 1321775 - RNA, 27 nt, Human
ugcucugccuccuuuauugauucccca

SEQ ID NO: 1321776 - RNA, 22 nt, Human
uggccacggcgaaaaaaaaaaa

SEQ ID NO: 1321777 - RNA, 20 nt, Human
uuacaaaauagcagacaaaa

SEQ ID NO: 1321778 - RNA, 19 nt, Human
uucagugcaacugcagcag

SEQ ID NO: 1321779 - RNA, 21 nt, Human
uuggugcgggccaggcucagc

SEQ ID NO: 1321780 - RNA, 24 nt, Human
uuuaagauggacacuauaggaauc

SEQ ID NO: 1321781 - RNA, 25 nt, Human
aagcaauucuccugccucagccucc

SEQ ID NO: 1321782 - RNA, 24 nt, Human
aaggugcugagaacacagguguga

SEQ ID NO: 1321783 - RNA, 19 nt, Human
aaguagcugggaaugcagg

SEQ ID NO: 1321784 - RNA, 21 nt, Human
aagugauucuccugccucagc

SEQ ID NO: 1321785 - RNA, 21 nt, Human
aaugcaggugcaugccaccau

SEQ ID NO: 1321786 - RNA, 20 nt, Human
acaggauggggguuuugcuc

SEQ ID NO: 1321787 - RNA, 23 nt, Human
acaggugcccaccaccacacccg

SEQ ID NO: 1321788 - RNA, 22 nt, Human
accauagggaaaugucuucuca

SEQ ID NO: 1321789 - RNA, 23 nt, Human
accuaucagguacuggaggugaa

SEQ ID NO: 1321790 - RNA, 21 nt, Human
acucuguugcccaggcuggag

SEQ ID NO: 1321791 - RNA, 25 nt, Human
acucuguugcccaggcuggagugca

SEQ ID NO: 1321792 - RNA, 22 nt, Human
agaacacaggugugagccacca

SEQ ID NO: 1321793 - RNA, 18 nt, Human
agaacucaagggacagga

SEQ ID NO: 1321794 - RNA, 18 nt, Human
agacaggauggggguuuu

SEQ ID NO: 1321795 - RNA, 25 nt, Human
agacaggauggggguuuugcucuaa

SEQ ID NO: 1321796 - RNA, 18 nt, Human
aggaaggagaugaguugg

SEQ ID NO: 1321797 - RNA, 25 nt, Human
aggcaucccggguagacagugguug

SEQ ID NO: 1321798 - RNA, 25 nt, Human
aggcuggagugcaguggcaagaucu

SEQ ID NO: 1321799 - RNA, 24 nt, Human
aggugauccgccugccucggccuc

SEQ ID NO: 1321800 - RNA, 18 nt, Human
aguagcugggauuacagg

SEQ ID NO: 1321801 - RNA, 20 nt, Human
augggguuucaccacauugg

SEQ ID NO: 1321802 - RNA, 24 nt, Human
augggguuucaccacauuggccag

SEQ ID NO: 1321803 - RNA, 18 nt, Human
auucuccugccucagccu

SEQ ID NO: 1321804 - RNA, 24 nt, Human
caaccuccaccuccugggcugaag

SEQ ID NO: 1321805 - RNA, 22 nt, Human
caagcaauucuccugccucagc

SEQ ID NO: 1321806 - RNA, 22 nt, Human
caagccccuccagagaagcaag

SEQ ID NO: 1321807 - RNA, 24 nt, Human
caaggugcugagaacacaggugug

SEQ ID NO: 1321808 - RNA, 19 nt, Human
cacagaacucaagggacag

SEQ ID NO: 1321809 - RNA, 19 nt, Human
cacaggugugagccaccac

SEQ ID NO: 1321810 - RNA, 24 nt, Human
cacauuggccaggcugaucucaaa

SEQ ID NO: 1321811 - RNA, 24 nt, Human
caccacacccggcuaauuuuugua

SEQ ID NO: 1321812 - RNA, 27 nt, Human
caccacauuggccaggcugaucucaaa

SEQ ID NO: 1321813 - RNA, 21 nt, Human
cacugcaaccuccaccuccug

SEQ ID NO: 1321814 - RNA, 23 nt, Human
cacugcaaccuccaccuccuggg

SEQ ID NO: 1321815 - RNA, 24 nt, Human
cagagucuuacucuguugcccagg

SEQ ID NO: 1321816 - RNA, 21 nt, Human
caggcugaucucaaacuccug

SEQ ID NO: 1321817 - RNA, 21 nt, Human
caggugcccaccaccacaccc

SEQ ID NO: 1321818 - RNA, 24 nt, Human
caggugcccaccaccacacccggc

SEQ ID NO: 1321819 - RNA, 21 nt, Human
ccaaggugcugagaacacagg

SEQ ID NO: 1321820 - RNA, 24 nt, Human
ccaaggugcugagaacacaggugu

SEQ ID NO: 1321821 - RNA, 27 nt, Human
ccaccucccagguucaagcaauucuuu

SEQ ID NO: 1321822 - RNA, 24 nt, Human
ccaccuccugggcugaagugauuc

SEQ ID NO: 1321823 - RNA, 21 nt, Human
ccagggggcaacgugugccag

SEQ ID NO: 1321824 - RNA, 23 nt, Human
cccaaguagcugggaaugcaggu

SEQ ID NO: 1321825 - RNA, 23 nt, Human
cccagguucaagcaauucuccug

SEQ ID NO: 1321826 - RNA, 23 nt, Human
cccgaguagcugggauuacaggu

SEQ ID NO: 1321827 - RNA, 24 nt, Human
cccgaguagcugggauuacaggug

SEQ ID NO: 1321828 - RNA, 21 nt, Human
ccgaguagcugggauuacagg

SEQ ID NO: 1321829 - RNA, 22 nt, Human
ccuccaccuccugggcugaagu

SEQ ID NO: 1321830 - RNA, 24 nt, Human
ccuccaccuccugggcugaaguga

SEQ ID NO: 1321831 - RNA, 24 nt, Human
ccucccagguucaagcaauucucc

SEQ ID NO: 1321832 - RNA, 24 nt, Human
ccuccugggcugaagugauucucc

SEQ ID NO: 1321833 - RNA, 21 nt, Human
ccugaccuaaggugauccgcc

SEQ ID NO: 1321834 - RNA, 23 nt, Human
ccugaccuaaggugauccgccug

SEQ ID NO: 1321835 - RNA, 23 nt, Human
ccugccucagccucccaaguagc

SEQ ID NO: 1321836 - RNA, 23 nt, Human
ccugccucagccucccgaguagc

SEQ ID NO: 1321837 - RNA, 24 nt, Human
ccugccucagccucccgaguagcu

SEQ ID NO: 1321838 - RNA, 24 nt, Human
ccugccucggccucccaaggugcu

SEQ ID NO: 1321839 - RNA, 23 nt, Human
cuaaggugauccgccugccucgg

SEQ ID NO: 1321840 - RNA, 24 nt, Human
cucacugcaaccuccaccuccugg

SEQ ID NO: 1321841 - RNA, 27 nt, Human
cucacugcaaccuccaccuccugggcu

SEQ ID NO: 1321842 - RNA, 23 nt, Human
cucagccucccgaguagcuggga

SEQ ID NO: 1321843 - RNA, 26 nt, Human
cuccugaccuaaggugauccgccugc

SEQ ID NO: 1321844 - RNA, 25 nt, Human
cuccugggcugaagugauucuccug

SEQ ID NO: 1321845 - RNA, 18 nt, Human
cugcaaccuccaccuccu

SEQ ID NO: 1321846 - RNA, 23 nt, Human
cugcaaccuccaccuccugggcu

SEQ ID NO: 1321847 - RNA, 23 nt, Human
cugccucagccucccaaguagcu

SEQ ID NO: 1321848 - RNA, 24 nt, Human
cuggggaacccaccucccagguuc

SEQ ID NO: 1321849 - RNA, 26 nt, Human
cuuacugugcugggaguacuugugga

SEQ ID NO: 1321850 - RNA, 19 nt, Human
cuuguggagugggggcugu

SEQ ID NO: 1321851 - RNA, 21 nt, Human
cuuguggagugggggcugugu

SEQ ID NO: 1321852 - RNA, 20 nt, Human
cuuucguauuuuuaguagag

SEQ ID NO: 1321853 - RNA, 18 nt, Human
gaacacaggugugagcca

SEQ ID NO: 1321854 - RNA, 19 nt, Human
gacacagaacucaagggac

SEQ ID NO: 1321855 - RNA, 21 nt, Human
gacaggaaggagaugaguugg

SEQ ID NO: 1321856 - RNA, 24 nt, Human
gaccuaaggugauccgccugccuc

SEQ ID NO: 1321857 - RNA, 18 nt, Human
gacuccauccugcauccc

SEQ ID NO: 1321858 - RNA, 20 nt, Human
gagaugaguuggaggcuggg

SEQ ID NO: 1321859 - RNA, 20 nt, Human
gagaugggguuucaccacau

SEQ ID NO: 1321860 - RNA, 24 nt, Human
gagaugggguuucaccacauuggc

SEQ ID NO: 1321861 - RNA, 21 nt, Human
gaguuggaggcugggucagug

SEQ ID NO: 1321862 - RNA, 21 nt, Human
gauucuccugccucagccucc

SEQ ID NO: 1321863 - RNA, 20 nt, Human
gcaaccuccaccuccugggc

SEQ ID NO: 1321864 - RNA, 19 nt, Human
gcccaggcuggagugcagu

SEQ ID NO: 1321865 - RNA, 21 nt, Human
gccugguuuggggaauguucg

SEQ ID NO: 1321866 - RNA, 24 nt, Human
gcuggagugcaguggcaagaucuc

SEQ ID NO: 1321867 - RNA, 20 nt, Human
ggagacagacaggauggggg

SEQ ID NO: 1321868 - RNA, 22 nt, Human
gggguuucaccacauuggccag

SEQ ID NO: 1321869 - RNA, 19 nt, Human
gugauccgccugccucggc

SEQ ID NO: 1321870 - RNA, 24 nt, Human
gugauucuccugccucagccuccc

SEQ ID NO: 1321871 - RNA, 18 nt, Human
gugcugagaacacaggug

SEQ ID NO: 1321872 - RNA, 18 nt, Human
gugcugagaacacaggug

SEQ ID NO: 1321873 - RNA, 21 nt, Human
gugcugagaacacagguguga

SEQ ID NO: 1321874 - RNA, 25 nt, Human
guggucccugccagugaugcuggug

SEQ ID NO: 1321875 - RNA, 21 nt, Human
gugugagccaccacgcugggc

SEQ ID NO: 1321876 - RNA, 18 nt, Human
uaagacagagucuuacuc

SEQ ID NO: 1321877 - RNA, 22 nt, Human
uaagacagagucuuacucuguu

SEQ ID NO: 1321878 - RNA, 24 nt, Human
uaauuuuuguauucuuaguagaga

SEQ ID NO: 1321879 - RNA, 23 nt, Human
uacaggugcccaccaccacaccc

SEQ ID NO: 1321880 - RNA, 18 nt, Human
uagcauuguaacacagac

SEQ ID NO: 1321881 - RNA, 22 nt, Human
uagcuacgacagagaggggcag

SEQ ID NO: 1321882 - RNA, 19 nt, Human
uagcugggaaugcaggugc

SEQ ID NO: 1321883 - RNA, 24 nt, Human
uaggaaguugacguuggacucauu

SEQ ID NO: 1321884 - RNA, 19 nt, Human
uaguagagaugggguuuca

SEQ ID NO: 1321885 - RNA, 23 nt, Human
uaguagagaugggguuucaccac

SEQ ID NO: 1321886 - RNA, 25 nt, Human
uaguagagaugggguuucaccacau

SEQ ID NO: 1321887 - RNA, 19 nt, Human
uauguguuucucaguugga

SEQ ID NO: 1321888 - RNA, 23 nt, Human
ucacugcaaccuccaccuccugg

SEQ ID NO: 1321889 - RNA, 24 nt, Human
ucacugcaaccuccaccuccuggg

SEQ ID NO: 1321890 - RNA, 25 nt, Human
ucacugcaaccuccaccuccugggc

SEQ ID NO: 1321891 - RNA, 27 nt, Human
ucacugcaaccuccaccuccugggcug

SEQ ID NO: 1321892 - RNA, 20 nt, Human
ucagccucccaaguagcugg

SEQ ID NO: 1321893 - RNA, 20 nt, Human
ucagccucccgaguagcugg

SEQ ID NO: 1321894 - RNA, 22 nt, Human
uccagagaagcaagucuuacug

SEQ ID NO: 1321895 - RNA, 23 nt, Human
ucccaaggugcugagaacacagg

SEQ ID NO: 1321896 - RNA, 24 nt, Human
ucccaaguagcugggaaugcaggu

SEQ ID NO: 1321897 - RNA, 21 nt, Human
ucccagguucaagcaauucuc

SEQ ID NO: 1321898 - RNA, 24 nt, Human
ucccagguucaagcaauucuccug

SEQ ID NO: 1321899 - RNA, 23 nt, Human
ucccgaguagcugggauuacagg

SEQ ID NO: 1321900 - RNA, 24 nt, Human
ucccgaguagcugggauuacaggu

SEQ ID NO: 1321901 - RNA, 24 nt, Human
uccugggcugaagugauucuccug

SEQ ID NO: 1321902 - RNA, 18 nt, Human
ucggccucccaaggugcu

SEQ ID NO: 1321903 - RNA, 23 nt, Human
ucuagacuccauccugcaucccc

SEQ ID NO: 1321904 - RNA, 26 nt, Human
ucuccugccucagccucccaaguagc

SEQ ID NO: 1321905 - RNA, 24 nt, Human
ucuccugccucagccucccgagua

SEQ ID NO: 1321906 - RNA, 18 nt, Human
ucuguugcccaggcugga

SEQ ID NO: 1321907 - RNA, 22 nt, Human
ucuuacucuguugcccaggcug

SEQ ID NO: 1321908 - RNA, 23 nt, Human
ucuuacucuguugcccaggcugg

SEQ ID NO: 1321909 - RNA, 24 nt, Human
ucuuacucuguugcccaggcugga

SEQ ID NO: 1321910 - RNA, 19 nt, Human
ugacacagaacucaaggga

SEQ ID NO: 1321911 - RNA, 18 nt, Human
ugaccuaaggugauccgc

SEQ ID NO: 1321912 - RNA, 24 nt, Human
ugaccuaaggugauccgccugccu

SEQ ID NO: 1321913 - RNA, 18 nt, Human
ugacguuggacucauugg

SEQ ID NO: 1321914 - RNA, 22 nt, Human
ugagaacacaggugugagccac

SEQ ID NO: 1321915 - RNA, 24 nt, Human
ugagaacacaggugugagccacca

SEQ ID NO: 1321916 - RNA, 20 nt, Human
ugcacuggacauuucaagcc

SEQ ID NO: 1321917 - RNA, 22 nt, Human
ugcacuggacauuucaagcccc

SEQ ID NO: 1321918 - RNA, 21 nt, Human
ugcccaccaccacacccggcu

SEQ ID NO: 1321919 - RNA, 18 nt, Human
ugcccaggcuggagugca

SEQ ID NO: 1321920 - RNA, 21 nt, Human
ugcccaggcuggagugcagug

SEQ ID NO: 1321921 - RNA, 22 nt, Human
ugcccaggcuggagugcagugg

SEQ ID NO: 1321922 - RNA, 24 nt, Human
ugcccaggcuggagugcaguggca

SEQ ID NO: 1321923 - RNA, 21 nt, Human
ugcccugggcuuuaauuauuu

SEQ ID NO: 1321924 - RNA, 24 nt, Human
ugccucagccucccaaguagcugg

SEQ ID NO: 1321925 - RNA, 24 nt, Human
ugccucagccucccgaguagcugg

SEQ ID NO: 1321926 - RNA, 21 nt, Human
ugccucggccucccaaggugc

SEQ ID NO: 1321927 - RNA, 24 nt, Human
ugccucggccucccaaggugcuga

SEQ ID NO: 1321928 - RNA, 22 nt, Human
ugccugggaugagaguggagac

SEQ ID NO: 1321929 - RNA, 21 nt, Human
ugccugguuuggggaauguuc

SEQ ID NO: 1321930 - RNA, 18 nt, Human
uggaggcugggucagugg

SEQ ID NO: 1321931 - RNA, 22 nt, Human
uggagugcaguggcaagaucuc

SEQ ID NO: 1321932 - RNA, 24 nt, Human
uggccaggcugaucucaaacuccu

SEQ ID NO: 1321933 - RNA, 22 nt, Human
ugggaaugcaggugcaugccac

SEQ ID NO: 1321934 - RNA, 24 nt, Human
ugggaaugcaggugcaugccacca

SEQ ID NO: 1321935 - RNA, 20 nt, Human
ugggaugagaguggagacag

SEQ ID NO: 1321936 - RNA, 21 nt, Human
ugggauuacaggugcccacca

SEQ ID NO: 1321937 - RNA, 24 nt, Human
ugggauuacaggugcccaccacca

SEQ ID NO: 1321938 - RNA, 24 nt, Human
ugggguuucaccacauuggccagg

SEQ ID NO: 1321939 - RNA, 21 nt, Human
uggugacucacaugacgaugu

SEQ ID NO: 1321940 - RNA, 22 nt, Human
ugugacacagaacucaagggac

SEQ ID NO: 1321941 - RNA, 21 nt, Human
uguugcccaggcuggagugca

SEQ ID NO: 1321942 - RNA, 24 nt, Human
uuacucuguugcccaggcuggagu

SEQ ID NO: 1321943 - RNA, 18 nt, Human
uuaguagagaugggguuu

SEQ ID NO: 1321944 - RNA, 22 nt, Human
uuaguagagaugggguuucacc

SEQ ID NO: 1321945 - RNA, 25 nt, Human
uuaguagagaugggguuucaccaca

SEQ ID NO: 1321946 - RNA, 21 nt, Human
uucaagcaauucuccugccuc

SEQ ID NO: 1321947 - RNA, 24 nt, Human
uucaagcaauucuccugccucagc

SEQ ID NO: 1321948 - RNA, 24 nt, Human
uucuuaguagagaugggguuucac

SEQ ID NO: 1321949 - RNA, 19 nt, Human
uugauauguguuucucagu

SEQ ID NO: 1321950 - RNA, 24 nt, Human
uugcccaggcuggagugcaguggc

SEQ ID NO: 1321951 - RNA, 19 nt, Human
uugcuugggacccaggggg

SEQ ID NO: 1321952 - RNA, 20 nt, Human
uuuuguauucuuaguagaga

SEQ ID NO: 1321953 - RNA, 20 nt, Human
uuuuuguauucuuaguagag

SEQ ID NO: 1321954 - RNA, 19 nt, Human
uuuuuuuuuuaagacagag

SEQ ID NO: 1321955 - RNA, 24 nt, Human
uuuuuuuuuuuuaagacagagucu

SEQ ID NO: 1321956 - RNA, 26 nt, Human
aaaaggugucaaaguauuuacaaggg

SEQ ID NO: 1321957 - RNA, 21 nt, Human
aaacacacacaaacgcacaca

SEQ ID NO: 1321958 - RNA, 22 nt, Human
aacagcaucacccaaagacgag

SEQ ID NO: 1321959 - RNA, 20 nt, Human
acacaaacacacacaaacgc

SEQ ID NO: 1321960 - RNA, 22 nt, Human
agaacacacagacacacaaaca

SEQ ID NO: 1321961 - RNA, 23 nt, Human
agacacacaaacacacacaaacg

SEQ ID NO: 1321962 - RNA, 21 nt, Human
agacgagaugauaacaaugug

SEQ ID NO: 1321963 - RNA, 24 nt, Human
aggcaauuagcagcaaaauaugcc

SEQ ID NO: 1321964 - RNA, 21 nt, Human
aguauccucucggcuucaucc

SEQ ID NO: 1321965 - RNA, 18 nt, Human
augauaacaaugugccuu

SEQ ID NO: 1321966 - RNA, 20 nt, Human
caaacgcacacauacacaca

SEQ ID NO: 1321967 - RNA, 28 nt, Human
cacaaacacacacaaacgcacacauaca

SEQ ID NO: 1321968 - RNA, 19 nt, Human
cacacaaaauccugcacac

SEQ ID NO: 1321969 - RNA, 28 nt, Human
cacacaaacacacacaaacgcacacaua

SEQ ID NO: 1321970 - RNA, 22 nt, Human
cacacacaaacgcacacauaca

SEQ ID NO: 1321971 - RNA, 25 nt, Human
cacacagacacacaaacacacacaa

SEQ ID NO: 1321972 - RNA, 20 nt, Human
cagaacacacagacacacaa

SEQ ID NO: 1321973 - RNA, 22 nt, Human
cagaacacacagacacacaaac

SEQ ID NO: 1321974 - RNA, 23 nt, Human
cagaacacacagacacacaaaca

SEQ ID NO: 1321975 - RNA, 19 nt, Human
cagugaggaacagcaucac

SEQ ID NO: 1321976 - RNA, 24 nt, Human
ccagagaccucugcaguauccucu

SEQ ID NO: 1321977 - RNA, 19 nt, Human
cucucggcuucauccucgc

SEQ ID NO: 1321978 - RNA, 25 nt, Human
cucucggcuucauccucgccucacu

SEQ ID NO: 1321979 - RNA, 18 nt, Human
cugcaguauccucucggc

SEQ ID NO: 1321980 - RNA, 22 nt, Human
gcacacauacacacaugcacca

SEQ ID NO: 1321981 - RNA, 22 nt, Human
gcacacggauguauacagcagc

SEQ ID NO: 1321982 - RNA, 22 nt, Human
gugaggaacagcaucacccaaa

SEQ ID NO: 1321983 - RNA, 19 nt, Human
uaaaaggaaaauuauccau

SEQ ID NO: 1321984 - RNA, 18 nt, Human
uaauugcccaaaccugau

SEQ ID NO: 1321985 - RNA, 20 nt, Human
uaauugcccaaaccugauuu

SEQ ID NO: 1321986 - RNA, 22 nt, Human
uaugaaauuccuuaggauuuaa

SEQ ID NO: 1321987 - RNA, 18 nt, Human
caccuucaggccuuguag

SEQ ID NO: 1321988 - RNA, 25 nt, Human
caccuucaggccuuguagggggucu

SEQ ID NO: 1321989 - RNA, 22 nt, Human
gaggaacggcaccuucaggccu

SEQ ID NO: 1321990 - RNA, 19 nt, Human
gucugccccuccaccagcc

SEQ ID NO: 1321991 - RNA, 21 nt, Human
guuucucgugggcaucgcagc

SEQ ID NO: 1321992 - RNA, 23 nt, Human
ucuccucuggccacaagaggagc

SEQ ID NO: 1321993 - RNA, 19 nt, Human
ugucccucuccucuggcca

SEQ ID NO: 1321994 - RNA, 19 nt, Human
uucucgugggcaucgcagc

SEQ ID NO: 1321995 - RNA, 20 nt, Human
uucucgugggcaucgcagcu

SEQ ID NO: 1321996 - RNA, 18 nt, Human
agcaggugcaccccugcu

SEQ ID NO: 1321997 - RNA, 21 nt, Human
agccacaggcccagcaggccc

SEQ ID NO: 1321998 - RNA, 23 nt, Human
aggcccagcaggcccaggaguga

SEQ ID NO: 1321999 - RNA, 19 nt, Human
aggcccaggagugaggcgg

SEQ ID NO: 1322000 - RNA, 23 nt, Human
caccccugcugcagccacgaggg

SEQ ID NO: 1322001 - RNA, 19 nt, Human
cagaaaaagaggaugaagg

SEQ ID NO: 1322002 - RNA, 25 nt, Human
cagccacaggcccagcaggcccagg

SEQ ID NO: 1322003 - RNA, 23 nt, Human
ccacacagaggauccagcugugu

SEQ ID NO: 1322004 - RNA, 21 nt, Human
ccagccccaccgagcacacgc

SEQ ID NO: 1322005 - RNA, 18 nt, Human
ccccaaagggcagcugcc

SEQ ID NO: 1322006 - RNA, 22 nt, Human
ccccugcugcagccacgagggg

SEQ ID NO: 1322007 - RNA, 26 nt, Human
ccggggcuggggcgcgugcuaggggc

SEQ ID NO: 1322008 - RNA, 20 nt, Human
ccugucucuccuugucuucu

SEQ ID NO: 1322009 - RNA, 25 nt, Human
cgcccaggcuguaagccacgaagac

SEQ ID NO: 1322010 - RNA, 21 nt, Human
cgcuccagccccaccgagcac

SEQ ID NO: 1322011 - RNA, 26 nt, Human
cggcggacccuggggauaggaggugc

SEQ ID NO: 1322012 - RNA, 22 nt, Human
cucggcggacccuggggauagg

SEQ ID NO: 1322013 - RNA, 25 nt, Human
gaaggugagcagcaggugcaccccc

SEQ ID NO: 1322014 - RNA, 18 nt, Human
gacccugcuccggggcug

SEQ ID NO: 1322015 - RNA, 22 nt, Human
gagcggggccgggucgcaagaa

SEQ ID NO: 1322016 - RNA, 21 nt, Human
gcacugggcguggcagccaca

SEQ ID NO: 1322017 - RNA, 18 nt, Human
gcucucggcggacccugg

SEQ ID NO: 1322018 - RNA, 25 nt, Human
ggagcggggccgggucgcaagaaga

SEQ ID NO: 1322019 - RNA, 20 nt, Human
ggcacaggggcccagaaaaa

SEQ ID NO: 1322020 - RNA, 23 nt, Human
gguccgcggccgagagcuggggg

SEQ ID NO: 1322021 - RNA, 24 nt, Human
guccugucucuccuugucuucuua

SEQ ID NO: 1322022 - RNA, 18 nt, Human
guggcucucggcggaccc

SEQ ID NO: 1322023 - RNA, 19 nt, Human
guggggcuagcgcggggcc

SEQ ID NO: 1322024 - RNA, 21 nt, Human
uaagccagccgcuccagcccc

SEQ ID NO: 1322025 - RNA, 22 nt, Human
uagcgcggggccaugccccgcc

SEQ ID NO: 1322026 - RNA, 22 nt, Human
uaggagaccgcggccgccacca

SEQ ID NO: 1322027 - RNA, 18 nt, Human
uccagccccaccgagcac

SEQ ID NO: 1322028 - RNA, 21 nt, Human
uccgcagguaggagaccgcgg

SEQ ID NO: 1322029 - RNA, 22 nt, Human
ucucguccgaguuguccuccuc

SEQ ID NO: 1322030 - RNA, 24 nt, Human
ucucguccgaguuguccuccucca

SEQ ID NO: 1322031 - RNA, 23 nt, Human
ucucuccuugucuucuuacaaga

SEQ ID NO: 1322032 - RNA, 18 nt, Human
ugagcagcaggugcaccc

SEQ ID NO: 1322033 - RNA, 24 nt, Human
ugaguucagucuuguucagggugc

SEQ ID NO: 1322034 - RNA, 19 nt, Human
ugcaccccugcugcagcca

SEQ ID NO: 1322035 - RNA, 21 nt, Human
ugcaccccugcugcagccacg

SEQ ID NO: 1322036 - RNA, 19 nt, Human
ugcaggacccgaggcacag

SEQ ID NO: 1322037 - RNA, 22 nt, Human
ugcugcccacgccccaaagggc

SEQ ID NO: 1322038 - RNA, 19 nt, Human
ugcuggggccgcgggaugu

SEQ ID NO: 1322039 - RNA, 20 nt, Human
uggcagccacaggcccagca

SEQ ID NO: 1322040 - RNA, 19 nt, Human
uggggcuagcgcggggcca

SEQ ID NO: 1322041 - RNA, 21 nt, Human
uggggggucuggagcggggcc

SEQ ID NO: 1322042 - RNA, 20 nt, Human
uguggggcuagcgcggggcc

SEQ ID NO: 1322043 - RNA, 22 nt, Human
uuuucuguaaaaaaucguggcu

SEQ ID NO: 1322044 - RNA, 24 nt, Human
aauuaaaaaaaaaucucauagucc

SEQ ID NO: 1322045 - RNA, 24 nt, Human
aucagccaccuccuauucuuccag

SEQ ID NO: 1322046 - RNA, 24 nt, Human
cuucuccauccuccuucucagcug

SEQ ID NO: 1322047 - RNA, 24 nt, Human
gauucugucaccuccuucuccauc

SEQ ID NO: 1322048 - RNA, 24 nt, Human
gccaccuccuauucuuccagauuc

SEQ ID NO: 1322049 - RNA, 19 nt, Human
ucucuaauaaaugacugca

SEQ ID NO: 1322050 - RNA, 22 nt, Human
ucuuccagauucugucaccucc

SEQ ID NO: 1322051 - RNA, 18 nt, Human
aaggaugaacccacugga

SEQ ID NO: 1322052 - RNA, 22 nt, Human
accaugaagggggcuuccugga

SEQ ID NO: 1322053 - RNA, 19 nt, Human
aggaggacgggaaaggacu

SEQ ID NO: 1322054 - RNA, 23 nt, Human
agggggcuuccuggaggagggug

SEQ ID NO: 1322055 - RNA, 19 nt, Human
aggugcaggaggcugugcu

SEQ ID NO: 1322056 - RNA, 20 nt, Human
cagauagaccaggaaggcag

SEQ ID NO: 1322057 - RNA, 21 nt, Human
caggauacagaagauguucug

SEQ ID NO: 1322058 - RNA, 22 nt, Human
caggauacagaagauguucuga

SEQ ID NO: 1322059 - RNA, 24 nt, Human
cugagggguggauugguugggggu

SEQ ID NO: 1322060 - RNA, 18 nt, Human
gacugagggguggauugg

SEQ ID NO: 1322061 - RNA, 21 nt, Human
gaugaggaggacgggaaagga

SEQ ID NO: 1322062 - RNA, 25 nt, Human
ggaaaggacuugaggacauugcaga

SEQ ID NO: 1322063 - RNA, 19 nt, Human
ggacauugcagauagacca

SEQ ID NO: 1322064 - RNA, 23 nt, Human
ggcaggcugggaggugaggaggu

SEQ ID NO: 1322065 - RNA, 18 nt, Human
ucuccuugagacaggggu

SEQ ID NO: 1322066 - RNA, 22 nt, Human
ugaacccagaccaugaaggggg

SEQ ID NO: 1322067 - RNA, 22 nt, Human
ugagaggaaggcugcccugugu

SEQ ID NO: 1322068 - RNA, 18 nt, Human
uggaggagggugagguga

SEQ ID NO: 1322069 - RNA, 23 nt, Human
uggaggagggugaggugaggcag

SEQ ID NO: 1322070 - RNA, 20 nt, Human
uggaguuuggaugaggagga

SEQ ID NO: 1322071 - RNA, 26 nt, Human
ugggaggugaggaggugcaggaggcu

SEQ ID NO: 1322072 - RNA, 20 nt, Human
ugguugggggugugcugagg

SEQ ID NO: 1322073 - RNA, 22 nt, Human
ugugcugaggaaggauggugag

SEQ ID NO: 1322074 - RNA, 25 nt, Human
aggcuaaaaaagaauuugugacuga

SEQ ID NO: 1322075 - RNA, 20 nt, Human
agugaauuuuuucuugggga

SEQ ID NO: 1322076 - RNA, 22 nt, Human
uaaaaaaccauauauauugugg

SEQ ID NO: 1322077 - RNA, 21 nt, Human
uaaaugauccaacauuuucuu

SEQ ID NO: 1322078 - RNA, 23 nt, Human
ugagagaaaauauuuuuucucua

SEQ ID NO: 1322079 - RNA, 20 nt, Human
aaguaacuuucucaugguca

SEQ ID NO: 1322080 - RNA, 19 nt, Human
acgaggcuaaaagaggccc

SEQ ID NO: 1322081 - RNA, 21 nt, Human
agcgggcgccucccgccuccu

SEQ ID NO: 1322082 - RNA, 18 nt, Human
aggcccggggcucggcga

SEQ ID NO: 1322083 - RNA, 19 nt, Human
caagaccagaaaacgucca

SEQ ID NO: 1322084 - RNA, 23 nt, Human
caagaccagaaaacguccagcug

SEQ ID NO: 1322085 - RNA, 21 nt, Human
caccuuccugaagcaagacca

SEQ ID NO: 1322086 - RNA, 19 nt, Human
cagcgggcgccucccgccu

SEQ ID NO: 1322087 - RNA, 22 nt, Human
cagcgggcgccucccgccuccu

SEQ ID NO: 1322088 - RNA, 18 nt, Human
cagcuagcaaguuguggc

SEQ ID NO: 1322089 - RNA, 23 nt, Human
ccagaaaacguccagcagaggca

SEQ ID NO: 1322090 - RNA, 21 nt, Human
ccccgcgaggggagaggcgga

SEQ ID NO: 1322091 - RNA, 20 nt, Human
ccucccucucuggggacgag

SEQ ID NO: 1322092 - RNA, 20 nt, Human
cgagagccagcccggucccu

SEQ ID NO: 1322093 - RNA, 21 nt, Human
gagagcagcgguugccggggc

SEQ ID NO: 1322094 - RNA, 25 nt, Human
gcgccucccgccuccuggaaggcca

SEQ ID NO: 1322095 - RNA, 22 nt, Human
ggcugugccgggcaccggcucc

SEQ ID NO: 1322096 - RNA, 21 nt, Human
ggggagaggcggagagcagcg

SEQ ID NO: 1322097 - RNA, 22 nt, Human
guugccggggcucagcugccuc

SEQ ID NO: 1322098 - RNA, 23 nt, Human
uaaaagaggcccggggcucggcg

SEQ ID NO: 1322099 - RNA, 23 nt, Human
uaaaugucuucuuuugagaaagg

SEQ ID NO: 1322100 - RNA, 19 nt, Human
ucgacagcgggcgccuccc

SEQ ID NO: 1322101 - RNA, 22 nt, Human
ugaagcaagaccagaaaacguc

SEQ ID NO: 1322102 - RNA, 18 nt, Human
ugagaaaggcgaaguaac

SEQ ID NO: 1322103 - RNA, 24 nt, Human
ugagaaaggcgaaguaacuuucuc

SEQ ID NO: 1322104 - RNA, 21 nt, Human
ugccggggcucagcugccucg

SEQ ID NO: 1322105 - RNA, 24 nt, Human
ugguggcgcguggggagcuucuag

SEQ ID NO: 1322106 - RNA, 22 nt, Human
uuccugaagcaagaccagaaaa

SEQ ID NO: 1322107 - RNA, 23 nt, Human
uuggcggcauaaaugucuucuuu

SEQ ID NO: 1322108 - RNA, 18 nt, Human
agaggacuugggcuccag

SEQ ID NO: 1322109 - RNA, 21 nt, Human
aggacccaguaacgcagcccu

SEQ ID NO: 1322110 - RNA, 20 nt, Human
ggacaccagaggacuugggc

SEQ ID NO: 1322111 - RNA, 19 nt, Human
aaaaucccauccauuugcu

SEQ ID NO: 1322112 - RNA, 26 nt, Human
aaacauccuccuguagcgucauuucc

SEQ ID NO: 1322113 - RNA, 23 nt, Human
aaacuuucaacauauaaacgucu

SEQ ID NO: 1322114 - RNA, 22 nt, Human
aacuucgaguuauaagccaaaa

SEQ ID NO: 1322115 - RNA, 18 nt, Human
aagcagaaagagcaacaa

SEQ ID NO: 1322116 - RNA, 27 nt, Human
aagcagaacacagaaaaagccuuucgg

SEQ ID NO: 1322117 - RNA, 24 nt, Human
aagcagaacacagaaaacauaaag

SEQ ID NO: 1322118 - RNA, 24 nt, Human
agaaaaagaaaaaucugguauaaa

SEQ ID NO: 1322119 - RNA, 21 nt, Human
agaaaacauaaagaaauaagg

SEQ ID NO: 1322120 - RNA, 24 nt, Human
agaaauaagguauuggggccuaaa

SEQ ID NO: 1322121 - RNA, 19 nt, Human
agaugugcuugcaaaaugu

SEQ ID NO: 1322122 - RNA, 18 nt, Human
aguacaauuuucaaauau

SEQ ID NO: 1322123 - RNA, 18 nt, Human
agugcacucacaacuacc

SEQ ID NO: 1322124 - RNA, 25 nt, Human
auuucuggaucugaauucaauggaa

SEQ ID NO: 1322125 - RNA, 21 nt, Human
caaaauguguaaugcuguagu

SEQ ID NO: 1322126 - RNA, 20 nt, Human
caacaaauaaugcccuucaa

SEQ ID NO: 1322127 - RNA, 24 nt, Human
caacugaacuaaaaguaaacacuc

SEQ ID NO: 1322128 - RNA, 19 nt, Human
caccuugucucuugccuuc

SEQ ID NO: 1322129 - RNA, 22 nt, Human
cagaaacuuaagaaaacuucga

SEQ ID NO: 1322130 - RNA, 22 nt, Human
cagaaagagcaacaacauuuua

SEQ ID NO: 1322131 - RNA, 25 nt, Human
cagaacacagaaaacauaaagaaau

SEQ ID NO: 1322132 - RNA, 26 nt, Human
cauuuaaaaaucccauccauuugcuc

SEQ ID NO: 1322133 - RNA, 30 nt, Human
ccuaaaaauuucauuuaaaaaucccauccu

SEQ ID NO: 1322134 - RNA, 20 nt, Human
cugaauucaauggaauuuca

SEQ ID NO: 1322135 - RNA, 19 nt, Human
cuuuuugcaaaggaaacug

SEQ ID NO: 1322136 - RNA, 30 nt, Human
gccaaaaugucaucagaaaaagaaaaaucc

SEQ ID NO: 1322137 - RNA, 20 nt, Human
ggccuugaucuucagaaacu

SEQ ID NO: 1322138 - RNA, 20 nt, Human
gugauucuuuugagacuuuu

SEQ ID NO: 1322139 - RNA, 23 nt, Human
uaagauggacuauagauuacaaa

SEQ ID NO: 1322140 - RNA, 22 nt, Human
uaagcagaaagagcaacaacau

SEQ ID NO: 1322141 - RNA, 20 nt, Human
uaagguauuggggccuaaaa

SEQ ID NO: 1322142 - RNA, 21 nt, Human
uaggccuugaucuucagaaac

SEQ ID NO: 1322143 - RNA, 22 nt, Human
uauucuccuguguauuucugga

SEQ ID NO: 1322144 - RNA, 24 nt, Human
uauuuuccacaauagcauuuugaa

SEQ ID NO: 1322145 - RNA, 18 nt, Human
ucagaaaaagaaaaaucu

SEQ ID NO: 1322146 - RNA, 20 nt, Human
ucaucagaaaaagaaaaauc

SEQ ID NO: 1322147 - RNA, 22 nt, Human
uccuguagcgucauuuccauuu

SEQ ID NO: 1322148 - RNA, 19 nt, Human
ucucuaugaaaccaugcuc

SEQ ID NO: 1322149 - RNA, 25 nt, Human
ucucuugccuucuuauaauaugaaa

SEQ ID NO: 1322150 - RNA, 21 nt, Human
ucugaauucaauggaauuuca

SEQ ID NO: 1322151 - RNA, 27 nt, Human
ugacaaaaagagagagaugcucccaaa

SEQ ID NO: 1322152 - RNA, 23 nt, Human
ugcccugagggaaaaauaagaug

SEQ ID NO: 1322153 - RNA, 21 nt, Human
uggaaaaaaacugaaugaaca

SEQ ID NO: 1322154 - RNA, 25 nt, Human
uggaaaaaaacugaaugaacauauu

SEQ ID NO: 1322155 - RNA, 20 nt, Human
uggaaaagagcaaauaguug

SEQ ID NO: 1322156 - RNA, 25 nt, Human
ugguauaaaauuuucuaccauaagg

SEQ ID NO: 1322157 - RNA, 20 nt, Human
uggugaaguucucucuauga

SEQ ID NO: 1322158 - RNA, 20 nt, Human
ugucagauuuuuaaaaagcc

SEQ ID NO: 1322159 - RNA, 22 nt, Human
ugucaucagaaaaagaaaaauc

SEQ ID NO: 1322160 - RNA, 20 nt, Human
uuuaaaaaucccauccauuu

SEQ ID NO: 1322161 - RNA, 21 nt, Human
aaccucugucucccaggugcc

SEQ ID NO: 1322162 - RNA, 24 nt, Human
aacgauucuccugccucagccucc

SEQ ID NO: 1322163 - RNA, 22 nt, Human
acugcaaccucugucucccagg

SEQ ID NO: 1322164 - RNA, 24 nt, Human
aguacaguggugcgaucucggcug

SEQ ID NO: 1322165 - RNA, 22 nt, Human
caaacgauucuccugccucagc

SEQ ID NO: 1322166 - RNA, 27 nt, Human
caaacgauucuccugccucagccuccc

SEQ ID NO: 1322167 - RNA, 20 nt, Human
caguuggggaagaaggaccc

SEQ ID NO: 1322168 - RNA, 21 nt, Human
ccucugucucccaggugcaaa

SEQ ID NO: 1322169 - RNA, 30 nt, Human
ccugcaguuggggaagaaggacccggagcc

SEQ ID NO: 1322170 - RNA, 23 nt, Human
ccugccucagccucccaaguagc

SEQ ID NO: 1322171 - RNA, 24 nt, Human
ccugccucagccucccaaguagcu

SEQ ID NO: 1322172 - RNA, 19 nt, Human
cugcaaccucugucuccca

SEQ ID NO: 1322173 - RNA, 22 nt, Human
cugcaaccucugucucccaggu

SEQ ID NO: 1322174 - RNA, 18 nt, Human
cugcaguuggggaagaag

SEQ ID NO: 1322175 - RNA, 20 nt, Human
cugccugcaguuggggaaga

SEQ ID NO: 1322176 - RNA, 20 nt, Human
gagcggccucucggcggagc

SEQ ID NO: 1322177 - RNA, 18 nt, Human
ucagccucccaaguagcu

SEQ ID NO: 1322178 - RNA, 20 nt, Human
ucagccucccaaguagcugg

SEQ ID NO: 1322179 - RNA, 21 nt, Human
ucccaggugcaaacgauucuc

SEQ ID NO: 1322180 - RNA, 24 nt, Human
ucccaggugcaaacgauucuccug

SEQ ID NO: 1322181 - RNA, 24 nt, Human
ucucccaggugcaaacgauucucc

SEQ ID NO: 1322182 - RNA, 26 nt, Human
ucuccugccucagccucccaaguagc

SEQ ID NO: 1322183 - RNA, 24 nt, Human
ugaaguacaguggugcgaucucgg

SEQ ID NO: 1322184 - RNA, 19 nt, Human
ugacugcaaccucugucuc

SEQ ID NO: 1322185 - RNA, 24 nt, Human
ugacugcaaccucugucucccagg

SEQ ID NO: 1322186 - RNA, 26 nt, Human
ugcaguuggggaagaaggacccggag

SEQ ID NO: 1322187 - RNA, 24 nt, Human
ugccucagccucccaaguagcugg

SEQ ID NO: 1322188 - RNA, 21 nt, Human
aaacgagaaagagacgacuua

SEQ ID NO: 1322189 - RNA, 24 nt, Human
aaggcgccuuucaugcacgguccu

SEQ ID NO: 1322190 - RNA, 19 nt, Human
acaggaaugaggaaagaau

SEQ ID NO: 1322191 - RNA, 22 nt, Human
acaggaaugaggaaagaaugac

SEQ ID NO: 1322192 - RNA, 23 nt, Human
agaaaaauaaauucaaacucuag

SEQ ID NO: 1322193 - RNA, 23 nt, Human
agaaagagacgacuuaaggggaa

SEQ ID NO: 1322194 - RNA, 21 nt, Human
agaagauccacagggucagag

SEQ ID NO: 1322195 - RNA, 21 nt, Human
aggagggagacauaguucugg

SEQ ID NO: 1322196 - RNA, 18 nt, Human
agggggaagggaguagag

SEQ ID NO: 1322197 - RNA, 29 nt, Human
agguaggaagguagguaaaguccgcuuug

SEQ ID NO: 1322198 - RNA, 18 nt, Human
cagaagauccacaggguc

SEQ ID NO: 1322199 - RNA, 22 nt, Human
cagaaucuuaacugaguaugac

SEQ ID NO: 1322200 - RNA, 20 nt, Human
cuucuugcugugucaucucu

SEQ ID NO: 1322201 - RNA, 22 nt, Human
cuugcugugucaucucucuucu

SEQ ID NO: 1322202 - RNA, 24 nt, Human
gaagauccacagggucagagacac

SEQ ID NO: 1322203 - RNA, 18 nt, Human
gcugugucaucucucuuc

SEQ ID NO: 1322204 - RNA, 24 nt, Human
ggggaagggaguagagcuugacua

SEQ ID NO: 1322205 - RNA, 21 nt, Human
ggucacaggaaugaggaaaga

SEQ ID NO: 1322206 - RNA, 24 nt, Human
guugaguuuauuuggguuugugua

SEQ ID NO: 1322207 - RNA, 19 nt, Human
uaggagcucucugucuuug

SEQ ID NO: 1322208 - RNA, 23 nt, Human
uauccaaacgagaaagagacgac

SEQ ID NO: 1322209 - RNA, 18 nt, Human
ucaucucucuucucaggg

SEQ ID NO: 1322210 - RNA, 21 nt, Human
ucuagggggaagggaguagag

SEQ ID NO: 1322211 - RNA, 22 nt, Human
ucucgcagauggucacaggaau

SEQ ID NO: 1322212 - RNA, 18 nt, Human
ugaggaaagaaugacucu

SEQ ID NO: 1322213 - RNA, 20 nt, Human
ugcaagaaauuccgggaauu

SEQ ID NO: 1322214 - RNA, 22 nt, Human
ugguagguagguaggaagguag

SEQ ID NO: 1322215 - RNA, 19 nt, Human
uguccagaagauccacagg

SEQ ID NO: 1322216 - RNA, 21 nt, Human
cccccggacgcccgcgccccg

SEQ ID NO: 1322217 - RNA, 18 nt, Human
ccccggacgcccgcgccc

SEQ ID NO: 1322218 - RNA, 22 nt, Human
ccccggacgcccgcgccccgcc

SEQ ID NO: 1322219 - RNA, 21 nt, Human
ccccgggggcuucgguccgcc

SEQ ID NO: 1322220 - RNA, 21 nt, Human
ccgcgccccgccccgccccgg

SEQ ID NO: 1322221 - RNA, 21 nt, Human
ccgcggcgcccccggacgccc

SEQ ID NO: 1322222 - RNA, 23 nt, Human
ccgcugagggggcgcggcgcagg

SEQ ID NO: 1322223 - RNA, 19 nt, Human
ccucgggaacugcgcggac

SEQ ID NO: 1322224 - RNA, 19 nt, Human
cgaggagggggcgcggucc

SEQ ID NO: 1322225 - RNA, 22 nt, Human
cgccccgccccgccccgggggc

SEQ ID NO: 1322226 - RNA, 18 nt, Human
cgccccggaccgaccucg

SEQ ID NO: 1322227 - RNA, 19 nt, Human
cggcgcagggaacagggcc

SEQ ID NO: 1322228 - RNA, 18 nt, Human
gcgcggcgcagggaacag

SEQ ID NO: 1322229 - RNA, 19 nt, Human
gcgcggggaccgaggaggg

SEQ ID NO: 1322230 - RNA, 19 nt, Human
gcggggcgcggggaccgag

SEQ ID NO: 1322231 - RNA, 20 nt, Human
ggcugggcccgcggcgcccc

SEQ ID NO: 1322232 - RNA, 19 nt, Human
gggcgcggggaccgaggag

SEQ ID NO: 1322233 - RNA, 19 nt, Human
gugaugcgagcacggcccg

SEQ ID NO: 1322234 - RNA, 18 nt, Human
ugcgagcacggcccgcug

SEQ ID NO: 1322235 - RNA, 24 nt, Human
ugcgagcacggcccgcugaggggg

SEQ ID NO: 1322236 - RNA, 18 nt, Human
agccauauuauccuuguu

SEQ ID NO: 1322237 - RNA, 27 nt, Human
aucuuuuuauccuccucaaguuuuuca

SEQ ID NO: 1322238 - RNA, 18 nt, Human
cuguauugcccuuucauc

SEQ ID NO: 1322239 - RNA, 21 nt, Human
uaaauggauuucuucuaauuu

SEQ ID NO: 1322240 - RNA, 25 nt, Human
uauugugcuuguaacuguaaaugga

SEQ ID NO: 1322241 - RNA, 18 nt, Human
uccacaucuuuaagugug

SEQ ID NO: 1322242 - RNA, 18 nt, Human
uccuuuauuugcugcugu

SEQ ID NO: 1322243 - RNA, 20 nt, Human
aggcggugaaggccuuaggg

SEQ ID NO: 1322244 - RNA, 21 nt, Human
cagcccagggucacggaguca

SEQ ID NO: 1322245 - RNA, 21 nt, Human
cagcugacuccagacauguug

SEQ ID NO: 1322246 - RNA, 22 nt, Human
ggcggugaaggccuuaggguac

SEQ ID NO: 1322247 - RNA, 19 nt, Human
ugaaggccuuaggguacgc

SEQ ID NO: 1322248 - RNA, 21 nt, Human
uagcuguggcuuuaacuuugg

SEQ ID NO: 1322249 - RNA, 20 nt, Human
uccuauggggguagcugugg

SEQ ID NO: 1322250 - RNA, 22 nt, Human
aucuccuuugagguccgcuggu

SEQ ID NO: 1322251 - RNA, 20 nt, Human
ccgcugggggccccaguccu

SEQ ID NO: 1322252 - RNA, 21 nt, Human
ucugcaacugccugaucuccu

SEQ ID NO: 1322253 - RNA, 23 nt, Human
auaguaagaaaaaggaccauuac

SEQ ID NO: 1322254 - RNA, 23 nt, Human
auugccacaggacuugggcucug

SEQ ID NO: 1322255 - RNA, 20 nt, Human
guaagaaaaaggaccauuac

SEQ ID NO: 1322256 - RNA, 24 nt, Human
ucacccgugugacaccaauuccau

SEQ ID NO: 1322257 - RNA, 18 nt, Human
uccauaguaagaaaaagg

SEQ ID NO: 1322258 - RNA, 19 nt, Human
uccauaguaagaaaaagga

SEQ ID NO: 1322259 - RNA, 22 nt, Human
ugccacaggacuugggcucugc

SEQ ID NO: 1322260 - RNA, 19 nt, Human
agaaggaaauaacaagcac

SEQ ID NO: 1322261 - RNA, 23 nt, Human
caagaagauuguuucuccagggg

SEQ ID NO: 1322262 - RNA, 23 nt, Human
cagaauauagcuuauaaucuguu

SEQ ID NO: 1322263 - RNA, 23 nt, Human
cauggaaagccacugggaagaca

SEQ ID NO: 1322264 - RNA, 20 nt, Human
ccacugggaagacaagaaga

SEQ ID NO: 1322265 - RNA, 24 nt, Human
ccguauuuugugaaucucccagaa

SEQ ID NO: 1322266 - RNA, 22 nt, Human
gaagacaagaagauuguuucuc

SEQ ID NO: 1322267 - RNA, 19 nt, Human
gcagccuccucuuaguuaa

SEQ ID NO: 1322268 - RNA, 25 nt, Human
ucugaagaaaauaagcaaagucauu

SEQ ID NO: 1322269 - RNA, 21 nt, Human
ugaagaaaauaagcaaaguca

SEQ ID NO: 1322270 - RNA, 24 nt, Human
ugaaucucccagaauauagcuuau

SEQ ID NO: 1322271 - RNA, 18 nt, Human
ugagaaggaaauaacaag

SEQ ID NO: 1322272 - RNA, 21 nt, Human
ugagcgucugcagcuccuuuc

SEQ ID NO: 1322273 - RNA, 19 nt, Human
ugggaagacaagaagauug

SEQ ID NO: 1322274 - RNA, 19 nt, Human
ugucugaagaaaauaagca

SEQ ID NO: 1322275 - RNA, 20 nt, Human
uucacugagaaggaaauaac

SEQ ID NO: 1322276 - RNA, 18 nt, Human
uugucugaagaaaauaag

SEQ ID NO: 1322277 - RNA, 23 nt, Human
caaaaugcaguaaacgauuccua

SEQ ID NO: 1322278 - RNA, 19 nt, Human
caccugaaauucauaaaaa

SEQ ID NO: 1322279 - RNA, 21 nt, Human
ccugaaauucauaaaaauaaa

SEQ ID NO: 1322280 - RNA, 19 nt, Human
ccugggauucacuuagcac

SEQ ID NO: 1322281 - RNA, 23 nt, Human
cugaaaacuggaaacuccuaaca

SEQ ID NO: 1322282 - RNA, 18 nt, Human
gcaguaaacgauuccuag

SEQ ID NO: 1322283 - RNA, 18 nt, Human
uaaaaauaaagcuaugaa

SEQ ID NO: 1322284 - RNA, 23 nt, Human
uguagaaucacaagugcauuuca

SEQ ID NO: 1322285 - RNA, 21 nt, Human
uguguguguagaaucacaagu

SEQ ID NO: 1322286 - RNA, 22 nt, Human
uucuguuaacugaaaacuggaa

SEQ ID NO: 1322287 - RNA, 24 nt, Human
aggcuucccugccccgcagccuug

SEQ ID NO: 1322288 - RNA, 21 nt, Human
cagccuuggccuuccugguuu

SEQ ID NO: 1322289 - RNA, 20 nt, Human
cagcggcucuuccucugccc

SEQ ID NO: 1322290 - RNA, 26 nt, Human
caggcgccuuccucuugccaggcuuc

SEQ ID NO: 1322291 - RNA, 25 nt, Human
ccagcggcucuuccucugccccucu

SEQ ID NO: 1322292 - RNA, 19 nt, Human
cccugccccgcagccuugg

SEQ ID NO: 1322293 - RNA, 18 nt, Human
ccugccccgcagccuugg

SEQ ID NO: 1322294 - RNA, 18 nt, Human
cugccccucugggaugcc

SEQ ID NO: 1322295 - RNA, 23 nt, Human
gccccgcagccuuggccuuccug

SEQ ID NO: 1322296 - RNA, 22 nt, Human
gcggcucuuccucugccccucu

SEQ ID NO: 1322297 - RNA, 24 nt, Human
uccucugccccucugggaugccua

SEQ ID NO: 1322298 - RNA, 20 nt, Human
ucgcagccagcggcucuucc

SEQ ID NO: 1322299 - RNA, 20 nt, Human
ucugccccucugggaugccu

SEQ ID NO: 1322300 - RNA, 23 nt, Human
ucuuccucugccccucugggaug

SEQ ID NO: 1322301 - RNA, 21 nt, Human
ucuugccaggcuucccugccc

SEQ ID NO: 1322302 - RNA, 19 nt, Human
ugaccccaggcgccuuccu

SEQ ID NO: 1322303 - RNA, 20 nt, Human
ugaccccaggcgccuuccuc

SEQ ID NO: 1322304 - RNA, 20 nt, Human
ugccccgcagccuuggccuu

SEQ ID NO: 1322305 - RNA, 19 nt, Human
uggcucugagcuugacccc

SEQ ID NO: 1322306 - RNA, 22 nt, Human
uucgcagccagcggcucuuccu

SEQ ID NO: 1322307 - RNA, 21 nt, Human
aaagaaaaaaagagcccugag

SEQ ID NO: 1322308 - RNA, 20 nt, Human
aacauuuuaagcuugcuuua

SEQ ID NO: 1322309 - RNA, 19 nt, Human
aauuucuauccaugugcuc

SEQ ID NO: 1322310 - RNA, 18 nt, Human
acuacaauauaguacauu

SEQ ID NO: 1322311 - RNA, 23 nt, Human
acuucaaagguaguucaaagggg

SEQ ID NO: 1322312 - RNA, 21 nt, Human
aggaaaccugcaagaccuauu

SEQ ID NO: 1322313 - RNA, 18 nt, Human
cauagaaaauaagacuuu

SEQ ID NO: 1322314 - RNA, 24 nt, Human
caugaaagacugcauucauucugc

SEQ ID NO: 1322315 - RNA, 23 nt, Human
ccaauacauucacugaaugcaga

SEQ ID NO: 1322316 - RNA, 19 nt, Human
ccagacuaacucauuagca

SEQ ID NO: 1322317 - RNA, 19 nt, Human
gauacacaaacauauauau

SEQ ID NO: 1322318 - RNA, 24 nt, Human
gauuuaaaugagugcaucucauuu

SEQ ID NO: 1322319 - RNA, 23 nt, Human
gcaaaaagaaaaaaagagcccug

SEQ ID NO: 1322320 - RNA, 25 nt, Human
gggaauaaagaagguagccgguacc

SEQ ID NO: 1322321 - RNA, 18 nt, Human
guauguauacauaaacau

SEQ ID NO: 1322322 - RNA, 21 nt, Human
uaaaaugacuacaauauagua

SEQ ID NO: 1322323 - RNA, 25 nt, Human
uaaacaaguaaauaaaagcaguuua

SEQ ID NO: 1322324 - RNA, 20 nt, Human
uaaauaaaagcaguuuagua

SEQ ID NO: 1322325 - RNA, 24 nt, Human
uaaauuucuauccaugugcucaua

SEQ ID NO: 1322326 - RNA, 26 nt, Human
uaagaugaaugaucuaugcaaaacca

SEQ ID NO: 1322327 - RNA, 21 nt, Human
uagcaugaaagacugcauuca

SEQ ID NO: 1322328 - RNA, 26 nt, Human
uaugcaaaaagaaaaaaagagccuua

SEQ ID NO: 1322329 - RNA, 21 nt, Human
ucaaaaggaaaccugcaagac

SEQ ID NO: 1322330 - RNA, 21 nt, Human
ucaaagggggaauaaagaagg

SEQ ID NO: 1322331 - RNA, 19 nt, Human
ucaaagguaguucaaaggg

SEQ ID NO: 1322332 - RNA, 21 nt, Human
ugagugcaucucauuuugauu

SEQ ID NO: 1322333 - RNA, 24 nt, Human
uuagcaugaaagacugcauucauu

SEQ ID NO: 1322334 - RNA, 23 nt, Human
aaccugcgcccucccuuccucua

SEQ ID NO: 1322335 - RNA, 19 nt, Human
ccugcgcccucccuuccuc

SEQ ID NO: 1322336 - RNA, 23 nt, Human
uggaccugacuccaaccugcgcc

SEQ ID NO: 1322337 - RNA, 21 nt, Human
uguuuggaccugacuccaacc

SEQ ID NO: 1322338 - RNA, 20 nt, Human
uuccucuaugacccuccugc

SEQ ID NO: 1322339 - RNA, 21 nt, Human
augcggaggaugcccugacug

SEQ ID NO: 1322340 - RNA, 20 nt, Human
cgcggaccaguaacggcugg

SEQ ID NO: 1322341 - RNA, 22 nt, Human
gaggaugcccugacugcgcgga

SEQ ID NO: 1322342 - RNA, 24 nt, Human
uauuccuuuauuuuaacauuugag

SEQ ID NO: 1322343 - RNA, 25 nt, Human
uccauacuacaguacauuuuuugag

SEQ ID NO: 1322344 - RNA, 22 nt, Human
ugaguuaaaaacaaacauuaaa

SEQ ID NO: 1322345 - RNA, 23 nt, Human
ugcggaggaugcccugacugcgc

SEQ ID NO: 1322346 - RNA, 22 nt, Human
uuuuuugaguuaaaaacaaaca

SEQ ID NO: 1322347 - RNA, 24 nt, Human
aaaucaaguuuuagggggagccag

SEQ ID NO: 1322348 - RNA, 20 nt, Human
aaaaaagacagggagauaua

SEQ ID NO: 1322349 - RNA, 26 nt, Human
aaaaauuagcaagaacauugaaaacc

SEQ ID NO: 1322350 - RNA, 21 nt, Human
aaacacaggagcaaacaaaga

SEQ ID NO: 1322351 - RNA, 22 nt, Human
aaacuuacuacuuuaaccccag

SEQ ID NO: 1322352 - RNA, 23 nt, Human
aaacuuacuacuuuaaccccaga

SEQ ID NO: 1322353 - RNA, 23 nt, Human
aaauguguggaguauacauucua

SEQ ID NO: 1322354 - RNA, 19 nt, Human
aaauuaagaaaacacacca

SEQ ID NO: 1322355 - RNA, 23 nt, Human
aacucccaagauccaauagaaaa

SEQ ID NO: 1322356 - RNA, 22 nt, Human
aagaaacaaaauuaagaaaaca

SEQ ID NO: 1322357 - RNA, 24 nt, Human
aagaacauugaaaaccaaccaccu

SEQ ID NO: 1322358 - RNA, 18 nt, Human
aagcccagcaaggugaaa

SEQ ID NO: 1322359 - RNA, 24 nt, Human
aauugccgagccagucacucaggu

SEQ ID NO: 1322360 - RNA, 18 nt, Human
acacgaauaugcauaaga

SEQ ID NO: 1322361 - RNA, 20 nt, Human
acagaagcuucuucaagcag

SEQ ID NO: 1322362 - RNA, 19 nt, Human
acaggagcaaacaaagaaa

SEQ ID NO: 1322363 - RNA, 18 nt, Human
acggguucuccaaacacc

SEQ ID NO: 1322364 - RNA, 19 nt, Human
acucuggagauggggaacc

SEQ ID NO: 1322365 - RNA, 22 nt, Human
agaaaaaaaauuagcaagaaca

SEQ ID NO: 1322366 - RNA, 23 nt, Human
agacacauacacagacauauaau

SEQ ID NO: 1322367 - RNA, 24 nt, Human
agacacauacacagacauauaauu

SEQ ID NO: 1322368 - RNA, 23 nt, Human
agagggucacuaugauaauagag

SEQ ID NO: 1322369 - RNA, 20 nt, Human
agcaaacaaagaaaacuccc

SEQ ID NO: 1322370 - RNA, 20 nt, Human
aggaaaagacaucuaaaugu

SEQ ID NO: 1322371 - RNA, 21 nt, Human
aucuuuccaaacccuuaauua

SEQ ID NO: 1322372 - RNA, 19 nt, Human
augaacaagauuacuacug

SEQ ID NO: 1322373 - RNA, 20 nt, Human
augaaucuuuccaaacccuu

SEQ ID NO: 1322374 - RNA, 27 nt, Human
caaaaaagacagggagauauacagugg

SEQ ID NO: 1322375 - RNA, 21 nt, Human
caaaacaaaaaguuucaaaga

SEQ ID NO: 1322376 - RNA, 20 nt, Human
caaagcuuaacaacaauuuu

SEQ ID NO: 1322377 - RNA, 25 nt, Human
caagaacauugaaaaccaaccaccu

SEQ ID NO: 1322378 - RNA, 20 nt, Human
cagagggucacuaugauaau

SEQ ID NO: 1322379 - RNA, 22 nt, Human
caggaaaagacaucuaaauggu

SEQ ID NO: 1322380 - RNA, 24 nt, Human
cauguauacacgaauaugcauagu

SEQ ID NO: 1322381 - RNA, 19 nt, Human
cauuucgccacaagaaaca

SEQ ID NO: 1322382 - RNA, 19 nt, Human
ccagcaaggugaaaguuuc

SEQ ID NO: 1322383 - RNA, 18 nt, Human
ccagcgguaagggugaca

SEQ ID NO: 1322384 - RNA, 22 nt, Human
ccugaauuucuucucugucuca

SEQ ID NO: 1322385 - RNA, 24 nt, Human
cgccacaagaaacaaaauuaagaa

SEQ ID NO: 1322386 - RNA, 19 nt, Human
cuacagcaugaagauuuua

SEQ ID NO: 1322387 - RNA, 19 nt, Human
cuuacuacuuuaaccccag

SEQ ID NO: 1322388 - RNA, 26 nt, Human
cuucucugucucaaaaaagacaggga

SEQ ID NO: 1322389 - RNA, 21 nt, Human
cuugcuagauucaguugccca

SEQ ID NO: 1322390 - RNA, 22 nt, Human
cuuuccaacagagaaacucugg

SEQ ID NO: 1322391 - RNA, 21 nt, Human
gauaauagagaaguucaggaa

SEQ ID NO: 1322392 - RNA, 21 nt, Human
gauccagcgguaagggugaca

SEQ ID NO: 1322393 - RNA, 24 nt, Human
gccacauuucgccacaagaaacaa

SEQ ID NO: 1322394 - RNA, 20 nt, Human
gcuccaacuuugggaauaag

SEQ ID NO: 1322395 - RNA, 19 nt, Human
gggcaaugcauuucugcag

SEQ ID NO: 1322396 - RNA, 24 nt, Human
gguuuuuguuugcgccugguuuua

SEQ ID NO: 1322397 - RNA, 18 nt, Human
guuuggguaaaugucuag

SEQ ID NO: 1322398 - RNA, 22 nt, Human
uaaacagaacuguaaaaggaaa

SEQ ID NO: 1322399 - RNA, 23 nt, Human
uaaacagaacuguaaaaggaaac

SEQ ID NO: 1322400 - RNA, 24 nt, Human
uaacaacaauuuuuuaaaggcuuc

SEQ ID NO: 1322401 - RNA, 22 nt, Human
uacugcuuuccaacagagaaac

SEQ ID NO: 1322402 - RNA, 18 nt, Human
uacuuuauugaguagaga

SEQ ID NO: 1322403 - RNA, 22 nt, Human
uagcaagaacauugaaaaccaa

SEQ ID NO: 1322404 - RNA, 18 nt, Human
uagcugaagcucauaaac

SEQ ID NO: 1322405 - RNA, 18 nt, Human
uauacagugcaaguugag

SEQ ID NO: 1322406 - RNA, 18 nt, Human
ucaaagaagaaaagguca

SEQ ID NO: 1322407 - RNA, 22 nt, Human
ucagcagcuuuacggguucucc

SEQ ID NO: 1322408 - RNA, 23 nt, Human
uccugaauuucuucucugucuca

SEQ ID NO: 1322409 - RNA, 23 nt, Human
uccugguugcaaaccucucucag

SEQ ID NO: 1322410 - RNA, 19 nt, Human
ucucaaaaaagacagggag

SEQ ID NO: 1322411 - RNA, 24 nt, Human
ucuugauacugcuuuccaacagag

SEQ ID NO: 1322412 - RNA, 22 nt, Human
ugaaagccacauuucgccacaa

SEQ ID NO: 1322413 - RNA, 24 nt, Human
ugaaagccacauuucgccacaaga

SEQ ID NO: 1322414 - RNA, 26 nt, Human
ugaaucuuuccaaacccuuaauuaua

SEQ ID NO: 1322415 - RNA, 18 nt, Human
ugagacuucuuuguaucu

SEQ ID NO: 1322416 - RNA, 18 nt, Human
uggcauaaaaugugugga

SEQ ID NO: 1322417 - RNA, 21 nt, Human
uguaaaaggaaacuuugcuaa

SEQ ID NO: 1322418 - RNA, 25 nt, Human
uuaaaggcuucuugauacugcuuuc

SEQ ID NO: 1322419 - RNA, 18 nt, Human
uucaaagaagaaaagguc

SEQ ID NO: 1322420 - RNA, 19 nt, Human
uucaaagaagaaaagguca

SEQ ID NO: 1322421 - RNA, 21 nt, Human
uucaaagaagaaaaggucauu

SEQ ID NO: 1322422 - RNA, 22 nt, Human
uucccauucagauuuuuucuug

SEQ ID NO: 1322423 - RNA, 20 nt, Human
uuccucaaccaaacuuacua

SEQ ID NO: 1322424 - RNA, 23 nt, Human
uugaacuagaguuuggguaaaug

SEQ ID NO: 1322425 - RNA, 20 nt, Human
uuucaaagaagaaaagguca

SEQ ID NO: 1322426 - RNA, 20 nt, Human
uuucaaagaagaaaagguca

SEQ ID NO: 1322427 - RNA, 19 nt, Human
uuugcuaaagcccagcaag

SEQ ID NO: 1322428 - RNA, 23 nt, Human
uuuuaaaggcuucuugauacugc

SEQ ID NO: 1322429 - RNA, 21 nt, Human
aaagaaagaaaaaaaaaagga

SEQ ID NO: 1322430 - RNA, 20 nt, Human
aagaaagaaaaaaaaaagga

SEQ ID NO: 1322431 - RNA, 19 nt, Human
aaggaacacauggcugaag

SEQ ID NO: 1322432 - RNA, 22 nt, Human
accgggagguccugggaggcca

SEQ ID NO: 1322433 - RNA, 20 nt, Human
agaaaaaaaaaaggaacaca

SEQ ID NO: 1322434 - RNA, 18 nt, Human
agcauagccagguucccc

SEQ ID NO: 1322435 - RNA, 25 nt, Human
aggcuggccuuuuccaccaggaggu

SEQ ID NO: 1322436 - RNA, 22 nt, Human
agggccagggaucccaggaagu

SEQ ID NO: 1322437 - RNA, 20 nt, Human
agucuucuggcuuuccagag

SEQ ID NO: 1322438 - RNA, 26 nt, Human
aucuccccuuucuccuuugaauccag

SEQ ID NO: 1322439 - RNA, 21 nt, Human
auggcugaagucuuucaagac

SEQ ID NO: 1322440 - RNA, 27 nt, Human
caaaaagcaaacgauaaaagaaagaaa

SEQ ID NO: 1322441 - RNA, 27 nt, Human
caagaaaauaaaacaaaaagcaaacga

SEQ ID NO: 1322442 - RNA, 24 nt, Human
cagcaaggcuggcgaaguaggcac

SEQ ID NO: 1322443 - RNA, 20 nt, Human
cagcugguccugucuccccu

SEQ ID NO: 1322444 - RNA, 19 nt, Human
caggcucuccaggcuuccc

SEQ ID NO: 1322445 - RNA, 24 nt, Human
cagggaucccaggaaguccaucuu

SEQ ID NO: 1322446 - RNA, 20 nt, Human
ccccuuucuccuuugaaucc

SEQ ID NO: 1322447 - RNA, 19 nt, Human
ccugggacuccuuucucuc

SEQ ID NO: 1322448 - RNA, 23 nt, Human
ccugggacuccuuucucuccugg

SEQ ID NO: 1322449 - RNA, 22 nt, Human
ccugggauuccaggguccccag

SEQ ID NO: 1322450 - RNA, 22 nt, Human
ccuugccugggacuccuuucuc

SEQ ID NO: 1322451 - RNA, 24 nt, Human
ccuuugaucccaggaucuccccuu

SEQ ID NO: 1322452 - RNA, 28 nt, Human
cgggcagcaaggcuggcgaaguaggcac

SEQ ID NO: 1322453 - RNA, 20 nt, Human
cucuccaggcuucccaggga

SEQ ID NO: 1322454 - RNA, 24 nt, Human
cucugaguucaaguuucagaaauc

SEQ ID NO: 1322455 - RNA, 20 nt, Human
cugcagucuucuggcuuucc

SEQ ID NO: 1322456 - RNA, 18 nt, Human
cuggccuuuuccaccagg

SEQ ID NO: 1322457 - RNA, 18 nt, Human
cuucacauuacccggccg

SEQ ID NO: 1322458 - RNA, 23 nt, Human
cuugccugggacuccuuucucuc

SEQ ID NO: 1322459 - RNA, 20 nt, Human
gagguccugggaggccagga

SEQ ID NO: 1322460 - RNA, 23 nt, Human
gccgggcagcaaggcuggcgaag

SEQ ID NO: 1322461 - RNA, 19 nt, Human
ggccuguguggccuuugug

SEQ ID NO: 1322462 - RNA, 21 nt, Human
ggcgaaguaggcacacuggga

SEQ ID NO: 1322463 - RNA, 20 nt, Human
ggggaccgggagguccuggg

SEQ ID NO: 1322464 - RNA, 23 nt, Human
uaaaagaaagaaaaaaaaaagga

SEQ ID NO: 1322465 - RNA, 25 nt, Human
ucagaaauccacugcagucuucugg

SEQ ID NO: 1322466 - RNA, 23 nt, Human
uccagcugguccugucuccccuu

SEQ ID NO: 1322467 - RNA, 18 nt, Human
ucccaggaaguccaucuu

SEQ ID NO: 1322468 - RNA, 23 nt, Human
ucccaggaucuccccuuucuccu

SEQ ID NO: 1322469 - RNA, 21 nt, Human
uccccaggcuggccuuuucca

SEQ ID NO: 1322470 - RNA, 18 nt, Human
uccccggguugaccuggg

SEQ ID NO: 1322471 - RNA, 22 nt, Human
uccccggguugaccugggauuc

SEQ ID NO: 1322472 - RNA, 18 nt, Human
ugaccugggauuccaggg

SEQ ID NO: 1322473 - RNA, 19 nt, Human
ugaucccaggaucuccccu

SEQ ID NO: 1322474 - RNA, 19 nt, Human
ugggaagggucacauuggc

SEQ ID NO: 1322475 - RNA, 18 nt, Human
uuucucuccugguucucc

SEQ ID NO: 1322476 - RNA, 21 nt, Human
uuugaucccaggaucuccccu

SEQ ID NO: 1322477 - RNA, 20 nt, Human
ccacuuugagagaacccugg

SEQ ID NO: 1322478 - RNA, 23 nt, Human
aaaaaagucagaggaaggucuag

SEQ ID NO: 1322479 - RNA, 22 nt, Human
aaaacccacucuggacuaagcc

SEQ ID NO: 1322480 - RNA, 21 nt, Human
aaacaccugacugucugcaau

SEQ ID NO: 1322481 - RNA, 22 nt, Human
aaagaaguuuccauucaccuuu

SEQ ID NO: 1322482 - RNA, 21 nt, Human
aaaggcagcaaagauccagag

SEQ ID NO: 1322483 - RNA, 19 nt, Human
aauuuuauacucucccacu

SEQ ID NO: 1322484 - RNA, 21 nt, Human
acuaaguuguccaaacaagac

SEQ ID NO: 1322485 - RNA, 18 nt, Human
agagcccuggacuugaaa

SEQ ID NO: 1322486 - RNA, 19 nt, Human
aguaaaaaagucagaggaa

SEQ ID NO: 1322487 - RNA, 21 nt, Human
auccuccuugggcuggauggu

SEQ ID NO: 1322488 - RNA, 18 nt, Human
aucucauuuccgucacca

SEQ ID NO: 1322489 - RNA, 19 nt, Human
cacugaauuucccaaggcc

SEQ ID NO: 1322490 - RNA, 26 nt, Human
cauaucaagauugaaaaauaggaaac

SEQ ID NO: 1322491 - RNA, 21 nt, Human
ccuccgagaaaccugaaguuc

SEQ ID NO: 1322492 - RNA, 20 nt, Human
cucuggacuaagccucuguc

SEQ ID NO: 1322493 - RNA, 23 nt, Human
gaaaacccacugaauuucccaag

SEQ ID NO: 1322494 - RNA, 20 nt, Human
gagacgaaccaggaacucug

SEQ ID NO: 1322495 - RNA, 20 nt, Human
ggcacaagaaggagguuagc

SEQ ID NO: 1322496 - RNA, 21 nt, Human
ggcuggaugguuucuucuggg

SEQ ID NO: 1322497 - RNA, 19 nt, Human
uaaaaaagucagaggaagg

SEQ ID NO: 1322498 - RNA, 22 nt, Human
uaaauuuucagucuugcugcaa

SEQ ID NO: 1322499 - RNA, 19 nt, Human
uaaguaaaaaagucagagg

SEQ ID NO: 1322500 - RNA, 21 nt, Human
uaguagguagagcccuggacu

SEQ ID NO: 1322501 - RNA, 18 nt, Human
uauacucucccacuaaca

SEQ ID NO: 1322502 - RNA, 23 nt, Human
uauuaugaacucaauuaccaggg

SEQ ID NO: 1322503 - RNA, 19 nt, Human
ucagaccugggacuuuggg

SEQ ID NO: 1322504 - RNA, 21 nt, Human
uccagaggacuucaaccuccg

SEQ ID NO: 1322505 - RNA, 24 nt, Human
uccuugggcuggaugguuucuucc

SEQ ID NO: 1322506 - RNA, 21 nt, Human
ucuaugguucagaccugggac

SEQ ID NO: 1322507 - RNA, 23 nt, Human
ucucccacuaacagaaacacagu

SEQ ID NO: 1322508 - RNA, 18 nt, Human
ugaaaaauaggaaaccau

SEQ ID NO: 1322509 - RNA, 19 nt, Human
ugaacucaauuaccaggga

SEQ ID NO: 1322510 - RNA, 21 nt, Human
ugaaguuccgaccucuugucu

SEQ ID NO: 1322511 - RNA, 19 nt, Human
ugaugucauaaaggcagca

SEQ ID NO: 1322512 - RNA, 21 nt, Human
uggaagcggccuugaucucau

SEQ ID NO: 1322513 - RNA, 20 nt, Human
uuaggaugucacccuccuug

SEQ ID NO: 1322514 - RNA, 20 nt, Human
uuccauucaccuuucaguca

SEQ ID NO: 1322515 - RNA, 22 nt, Human
uucuucuggggacuuggggaug

SEQ ID NO: 1322516 - RNA, 18 nt, Human
uugggcucauagacaucu

SEQ ID NO: 1322517 - RNA, 18 nt, Human
uugggcuggaugguuucu

SEQ ID NO: 1322518 - RNA, 21 nt, Human
uugggcuggaugguuucuucu

SEQ ID NO: 1322519 - RNA, 21 nt, Human
uugggugggauggcuuccucu

SEQ ID NO: 1322520 - RNA, 18 nt, Human
uugugagcguagauuaua

SEQ ID NO: 1322521 - RNA, 22 nt, Human
aaaaaaaaaaaagcaagcaaga

SEQ ID NO: 1322522 - RNA, 24 nt, Human
aaaaaaaaaaagcaagcaagaaaa

SEQ ID NO: 1322523 - RNA, 23 nt, Human
aaaaaaaaaagcaagcaagaaaa

SEQ ID NO: 1322524 - RNA, 27 nt, Human
aaaaaaaaaagcaagcaagaaaaagga

SEQ ID NO: 1322525 - RNA, 18 nt, Human
aaaaaaaagcaagcaaga

SEQ ID NO: 1322526 - RNA, 25 nt, Human
aaaaaaaagcaagcaagaaaaagga

SEQ ID NO: 1322527 - RNA, 25 nt, Human
aaaagaaaagauggaggaaaaaaga

SEQ ID NO: 1322528 - RNA, 23 nt, Human
aagaaaagaaaagaaaagaugga

SEQ ID NO: 1322529 - RNA, 22 nt, Human
aagcuaggcucuuagccuagcu

SEQ ID NO: 1322530 - RNA, 23 nt, Human
agaaaagaaaagaaaagauggag

SEQ ID NO: 1322531 - RNA, 20 nt, Human
agaaaagaaaagauggagga

SEQ ID NO: 1322532 - RNA, 22 nt, Human
agaaaagauggaggaaaaaaga

SEQ ID NO: 1322533 - RNA, 21 nt, Human
agaaagaaaaaaaaugaucag

SEQ ID NO: 1322534 - RNA, 19 nt, Human
agaaagaaaagaaaagaaa

SEQ ID NO: 1322535 - RNA, 21 nt, Human
agccaggccagaagcuaggcu

SEQ ID NO: 1322536 - RNA, 18 nt, Human
aggaagaaagaaaagaaa

SEQ ID NO: 1322537 - RNA, 21 nt, Human
aggaaggaagaaagaaaagaa

SEQ ID NO: 1322538 - RNA, 27 nt, Human
aggcaaucuuuucacauccugagcuuc

SEQ ID NO: 1322539 - RNA, 23 nt, Human
cacauccugagcuacaauccguc

SEQ ID NO: 1322540 - RNA, 25 nt, Human
cagcagaggcacagaguggggguuu

SEQ ID NO: 1322541 - RNA, 22 nt, Human
ccuauagcauccuauagcaauc

SEQ ID NO: 1322542 - RNA, 18 nt, Human
cguaaaagccaggccaga

SEQ ID NO: 1322543 - RNA, 18 nt, Human
cuccccucucaguuuccc

SEQ ID NO: 1322544 - RNA, 21 nt, Human
gcaagcaagaaaaaggaagga

SEQ ID NO: 1322545 - RNA, 18 nt, Human
ggaggaaaaaagaaagaa

SEQ ID NO: 1322546 - RNA, 23 nt, Human
uacagcccuggauucucagcaga

SEQ ID NO: 1322547 - RNA, 21 nt, Human
uagguuuucucagugccuuuc

SEQ ID NO: 1322548 - RNA, 19 nt, Human
ucagcagaggcacagagug

SEQ ID NO: 1322549 - RNA, 20 nt, Human
uccccucucaguuucccaca

SEQ ID NO: 1322550 - RNA, 22 nt, Human
ugcuugauucucucuccccucu

SEQ ID NO: 1322551 - RNA, 18 nt, Human
uggaggaaaaaagaaaga

SEQ ID NO: 1322552 - RNA, 19 nt, Human
uucccacaccuuaugcaga

SEQ ID NO: 1322553 - RNA, 18 nt, Human
uuucucagugccuuucug

SEQ ID NO: 1322554 - RNA, 19 nt, Human
aggcgacgcccagaacucc

SEQ ID NO: 1322555 - RNA, 22 nt, Human
cgacgcccagaacuccaggaga

SEQ ID NO: 1322556 - RNA, 19 nt, Human
cgcccagaacuccaggaga

SEQ ID NO: 1322557 - RNA, 21 nt, Human
ccccggauccagcucuggcuc

SEQ ID NO: 1322558 - RNA, 19 nt, Human
ccgccgcggacucuggcuc

SEQ ID NO: 1322559 - RNA, 23 nt, Human
ccgcggacucuggcucagguuuc

SEQ ID NO: 1322560 - RNA, 21 nt, Human
ccugcccacuucuccccaccu

SEQ ID NO: 1322561 - RNA, 18 nt, Human
cggauccagcucuggcuc

SEQ ID NO: 1322562 - RNA, 22 nt, Human
cggauccagcucuggcucuggc

SEQ ID NO: 1322563 - RNA, 19 nt, Human
cggcuggggccccggaucc

SEQ ID NO: 1322564 - RNA, 22 nt, Human
cucuccugcccacuucucccca

SEQ ID NO: 1322565 - RNA, 18 nt, Human
cugcgucugcggcucgug

SEQ ID NO: 1322566 - RNA, 18 nt, Human
ggcuccggcuggggcccc

SEQ ID NO: 1322567 - RNA, 24 nt, Human
gggcagcgcugcgucugcggcucg

SEQ ID NO: 1322568 - RNA, 21 nt, Human
uccugcccacuucuccccacc

SEQ ID NO: 1322569 - RNA, 18 nt, Human
ugggcuccgggcucgccc

SEQ ID NO: 1322570 - RNA, 18 nt, Human
aagcagcaagcucacagc

SEQ ID NO: 1322571 - RNA, 22 nt, Human
agcaagcucacagcaaaugcgu

SEQ ID NO: 1322572 - RNA, 21 nt, Human
aggaaacuugaggcucgggga

SEQ ID NO: 1322573 - RNA, 21 nt, Human
caugcgcccugcgguuuaacc

SEQ ID NO: 1322574 - RNA, 21 nt, Human
cccugcgguuuaaccuuccca

SEQ ID NO: 1322575 - RNA, 22 nt, Human
cccugugggacuuuggccaagu

SEQ ID NO: 1322576 - RNA, 22 nt, Human
ccugucagaaccucaguuucca

SEQ ID NO: 1322577 - RNA, 19 nt, Human
ccuucccaaccacucuagg

SEQ ID NO: 1322578 - RNA, 24 nt, Human
ccuucucugucaggcagggcugaa

SEQ ID NO: 1322579 - RNA, 19 nt, Human
gaggaaacuugaggcucgg

SEQ ID NO: 1322580 - RNA, 18 nt, Human
gaggucauuauuguccca

SEQ ID NO: 1322581 - RNA, 24 nt, Human
gccugagugaguggugagcgggag

SEQ ID NO: 1322582 - RNA, 19 nt, Human
ggaagcagcaagcucacag

SEQ ID NO: 1322583 - RNA, 19 nt, Human
gggauguuuagcgacuugc

SEQ ID NO: 1322584 - RNA, 24 nt, Human
uaccucacaggugguggugaggau

SEQ ID NO: 1322585 - RNA, 18 nt, Human
ucagaaccucaguuucca

SEQ ID NO: 1322586 - RNA, 18 nt, Human
ucugucaggcagggcuga

SEQ ID NO: 1322587 - RNA, 21 nt, Human
ugaggcugaaccuucucuguc

SEQ ID NO: 1322588 - RNA, 23 nt, Human
ugggcauccaucauggcaguucc

SEQ ID NO: 1322589 - RNA, 20 nt, Human
ugucccauuuugcagaugag

SEQ ID NO: 1322590 - RNA, 23 nt, Human
uuuggccaaguuacuuuuccugu

SEQ ID NO: 1322591 - RNA, 19 nt, Human
accuccaaucucuugaaga

SEQ ID NO: 1322592 - RNA, 23 nt, Human
uccuccagaccuccaaucucuug

SEQ ID NO: 1322593 - RNA, 21 nt, Human
ucucuugaagaugaccacucu

SEQ ID NO: 1322594 - RNA, 24 nt, Human
ugcuuaggcuuccuuucuccucca

SEQ ID NO: 1322595 - RNA, 22 nt, Human
aaacacacaucuccccauuuuc

SEQ ID NO: 1322596 - RNA, 20 nt, Human
agggcuguuuagagaagucc

SEQ ID NO: 1322597 - RNA, 26 nt, Human
cauguuaccgaagcugaaugaccaaa

SEQ ID NO: 1322598 - RNA, 23 nt, Human
gagaagucccuugcucuugccaa

SEQ ID NO: 1322599 - RNA, 24 nt, Human
uaaggaaguguagccuucuccaug

SEQ ID NO: 1322600 - RNA, 23 nt, Human
uccaaacacacaucuccccauuu

SEQ ID NO: 1322601 - RNA, 20 nt, Human
auaggccuugguaaaggcuu

SEQ ID NO: 1322602 - RNA, 19 nt, Human
gaggggcuuauaggccuug

SEQ ID NO: 1322603 - RNA, 20 nt, Human
caaaacaggaaacugggagc

SEQ ID NO: 1322604 - RNA, 25 nt, Human
cucgggcaaaacaggaaacugggag

SEQ ID NO: 1322605 - RNA, 24 nt, Human
cugggagcgugacaagucccuccu

SEQ ID NO: 1322606 - RNA, 20 nt, Human
gcuggugcaggcauugcugg

SEQ ID NO: 1322607 - RNA, 18 nt, Human
uaggaggaacccaauaaa

SEQ ID NO: 1322608 - RNA, 20 nt, Human
uaggaggaacccaauaaaua

SEQ ID NO: 1322609 - RNA, 20 nt, Human
uaggaggaacccaauaaaua

SEQ ID NO: 1322610 - RNA, 18 nt, Human
ucucgggcaaaacaggaa

SEQ ID NO: 1322611 - RNA, 19 nt, Human
ugacaagucccuccucccu

SEQ ID NO: 1322612 - RNA, 19 nt, Human
ugcaggcauugcugguguc

SEQ ID NO: 1322613 - RNA, 26 nt, Human
uggcaagaauaggaggaacccaauaa

SEQ ID NO: 1322614 - RNA, 18 nt, Human
aucacagcccugaaucug

SEQ ID NO: 1322615 - RNA, 19 nt, Human
aucacagcccugaaucugc

SEQ ID NO: 1322616 - RNA, 19 nt, Human
caguuucucaucacagccc

SEQ ID NO: 1322617 - RNA, 18 nt, Human
guauagucguguaaguga

SEQ ID NO: 1322618 - RNA, 20 nt, Human
ucaaaggccuucuguugcag

SEQ ID NO: 1322619 - RNA, 22 nt, Human
cacaauuaaaaaaccuuuacac

SEQ ID NO: 1322620 - RNA, 20 nt, Human
gaauaacaauuuauugacuu

SEQ ID NO: 1322621 - RNA, 22 nt, Human
ugucuaaugcuacauauacaca

SEQ ID NO: 1322622 - RNA, 23 nt, Human
cuguccggugguggacucuucug

SEQ ID NO: 1322623 - RNA, 22 nt, Human
aagagagacuguaggauuagca

SEQ ID NO: 1322624 - RNA, 21 nt, Human
aagagguuguaaaugucgcuc

SEQ ID NO: 1322625 - RNA, 24 nt, Human
aaguggcccugcccaagaucagga

SEQ ID NO: 1322626 - RNA, 19 nt, Human
acacugccccauggaaggc

SEQ ID NO: 1322627 - RNA, 24 nt, Human
accccauuccacuggcucucacaa

SEQ ID NO: 1322628 - RNA, 24 nt, Human
acccgggcugagguuccugggggc

SEQ ID NO: 1322629 - RNA, 18 nt, Human
accucuccuuccuccagg

SEQ ID NO: 1322630 - RNA, 18 nt, Human
acucaacaucugcuuugc

SEQ ID NO: 1322631 - RNA, 19 nt, Human
agcaggcuggcgccauagg

SEQ ID NO: 1322632 - RNA, 19 nt, Human
agcagucauuucugcgcuu

SEQ ID NO: 1322633 - RNA, 22 nt, Human
agguucccccacaccccccacc

SEQ ID NO: 1322634 - RNA, 20 nt, Human
aucguucugagagggaggca

SEQ ID NO: 1322635 - RNA, 21 nt, Human
cacaguuagacugcauccucu

SEQ ID NO: 1322636 - RNA, 20 nt, Human
caccacucugccuaccccuc

SEQ ID NO: 1322637 - RNA, 20 nt, Human
cacccgggcugagguuccug

SEQ ID NO: 1322638 - RNA, 21 nt, Human
cacggauaugagucucagggg

SEQ ID NO: 1322639 - RNA, 24 nt, Human
cacucuuccaucugggcccaucuc

SEQ ID NO: 1322640 - RNA, 20 nt, Human
cagaggccgcuaugcuccuc

SEQ ID NO: 1322641 - RNA, 22 nt, Human
cagcacccgggcugagguuccu

SEQ ID NO: 1322642 - RNA, 25 nt, Human
cagcagauacaaagcccuccucacg

SEQ ID NO: 1322643 - RNA, 21 nt, Human
cagcgaugcgccugcuucuga

SEQ ID NO: 1322644 - RNA, 24 nt, Human
caguagcugagguucccccacacc

SEQ ID NO: 1322645 - RNA, 22 nt, Human
cagugccuaaguggcccugccc

SEQ ID NO: 1322646 - RNA, 25 nt, Human
caguggguuucuccacccaacuauc

SEQ ID NO: 1322647 - RNA, 24 nt, Human
cauuucugcgcuuugcuuugaggg

SEQ ID NO: 1322648 - RNA, 23 nt, Human
ccacaccccccaccaagcagcuc

SEQ ID NO: 1322649 - RNA, 18 nt, Human
ccacgaacacugccccau

SEQ ID NO: 1322650 - RNA, 19 nt, Human
ccagccuggaacgucccuu

SEQ ID NO: 1322651 - RNA, 21 nt, Human
ccauaccaggcagcuugagag

SEQ ID NO: 1322652 - RNA, 21 nt, Human
ccauagguccgacuugccauc

SEQ ID NO: 1322653 - RNA, 18 nt, Human
cccacgaacacugcccca

SEQ ID NO: 1322654 - RNA, 22 nt, Human
cccacgaacacugccccaugga

SEQ ID NO: 1322655 - RNA, 22 nt, Human
cccaugcuuucccggucuuuuu

SEQ ID NO: 1322656 - RNA, 18 nt, Human
ccccacaccccccaccaa

SEQ ID NO: 1322657 - RNA, 19 nt, Human
ccccccaccaagcagcucc

SEQ ID NO: 1322658 - RNA, 21 nt, Human
ccccccgcccccgcaggaaua

SEQ ID NO: 1322659 - RNA, 18 nt, Human
ccccgcauccugcgccug

SEQ ID NO: 1322660 - RNA, 21 nt, Human
ccccucguccccuccagccug

SEQ ID NO: 1322661 - RNA, 25 nt, Human
cccggaagcccgggccagucacagg

SEQ ID NO: 1322662 - RNA, 24 nt, Human
ccgaccuaacuuccuccuggcugc

SEQ ID NO: 1322663 - RNA, 23 nt, Human
ccucagagaccucuccuuccucc

SEQ ID NO: 1322664 - RNA, 22 nt, Human
ccugaucucaaagaaguggcac

SEQ ID NO: 1322665 - RNA, 23 nt, Human
ccugaucucaaagaaguggcaca

SEQ ID NO: 1322666 - RNA, 24 nt, Human
ccuguccccgugucugcgccuggg

SEQ ID NO: 1322667 - RNA, 19 nt, Human
ccugugggccugucucugg

SEQ ID NO: 1322668 - RNA, 20 nt, Human
cgcaggaauaacaaugaccu

SEQ ID NO: 1322669 - RNA, 23 nt, Human
cgcaggaauaacaaugaccucca

SEQ ID NO: 1322670 - RNA, 21 nt, Human
cgccauagguccgacuugcca

SEQ ID NO: 1322671 - RNA, 21 nt, Human
cggaagcccgggccagucaca

SEQ ID NO: 1322672 - RNA, 18 nt, Human
cgggcugagguuccuggg

SEQ ID NO: 1322673 - RNA, 22 nt, Human
cggucacucuuccaucugggcc

SEQ ID NO: 1322674 - RNA, 22 nt, Human
cgucccuuccagggguuaaaga

SEQ ID NO: 1322675 - RNA, 22 nt, Human
cgucuccuuccuagcacgaccc

SEQ ID NO: 1322676 - RNA, 23 nt, Human
cguggccccgcauccugcgccug

SEQ ID NO: 1322677 - RNA, 22 nt, Human
cucagagaccucuccuuccucc

SEQ ID NO: 1322678 - RNA, 22 nt, Human
cuccacgggcugggcaugccca

SEQ ID NO: 1322679 - RNA, 18 nt, Human
cuccuugggcuuuccgag

SEQ ID NO: 1322680 - RNA, 23 nt, Human
cucugccuaccccucuccggugu

SEQ ID NO: 1322681 - RNA, 23 nt, Human
cucuggagguagcugccacugcu

SEQ ID NO: 1322682 - RNA, 19 nt, Human
cucuugggauuuccaacac

SEQ ID NO: 1322683 - RNA, 21 nt, Human
cugaucucaaagaaguggcac

SEQ ID NO: 1322684 - RNA, 25 nt, Human
cugaucucaaagaaguggcacagaa

SEQ ID NO: 1322685 - RNA, 18 nt, Human
cugcgccugccugcuuca

SEQ ID NO: 1322686 - RNA, 18 nt, Human
cugcgccuggggguccua

SEQ ID NO: 1322687 - RNA, 19 nt, Human
cuggcugcucuugaacacc

SEQ ID NO: 1322688 - RNA, 18 nt, Human
cuuccuagcacgaccugu

SEQ ID NO: 1322689 - RNA, 24 nt, Human
cuucugaggggcaggccaccuugg

SEQ ID NO: 1322690 - RNA, 18 nt, Human
cuuugccggucacucuuc

SEQ ID NO: 1322691 - RNA, 22 nt, Human
gaacaccgcaaugcgccagugu

SEQ ID NO: 1322692 - RNA, 20 nt, Human
gacaguagcugagguucccc

SEQ ID NO: 1322693 - RNA, 22 nt, Human
gacaguagcugagguuccccca

SEQ ID NO: 1322694 - RNA, 20 nt, Human
gaccgugacagucagcauca

SEQ ID NO: 1322695 - RNA, 20 nt, Human
gagcaggcuggcgccauagg

SEQ ID NO: 1322696 - RNA, 22 nt, Human
gagcagucauuucugcgcuuug

SEQ ID NO: 1322697 - RNA, 23 nt, Human
gagguucccccacaccccccacc

SEQ ID NO: 1322698 - RNA, 26 nt, Human
gagguucccccacaccccccaccaag

SEQ ID NO: 1322699 - RNA, 19 nt, Human
gcccuggauuccuggaauc

SEQ ID NO: 1322700 - RNA, 20 nt, Human
gccuaaguggcccugcccaa

SEQ ID NO: 1322701 - RNA, 19 nt, Human
ggagagacaguagcugagg

SEQ ID NO: 1322702 - RNA, 19 nt, Human
ggaggccaguccacccccc

SEQ ID NO: 1322703 - RNA, 23 nt, Human
ggaggccaguccaccccccgccc

SEQ ID NO: 1322704 - RNA, 23 nt, Human
ggcagagguugcugggauuccuu

SEQ ID NO: 1322705 - RNA, 22 nt, Human
ggcaggccaccuuggcugucuc

SEQ ID NO: 1322706 - RNA, 19 nt, Human
gggaauagguuccagcagc

SEQ ID NO: 1322707 - RNA, 19 nt, Human
gggcauggugcaguuggag

SEQ ID NO: 1322708 - RNA, 23 nt, Human
gggccagucacagggguccgggg

SEQ ID NO: 1322709 - RNA, 22 nt, Human
ggggaccugaguccgaccuaac

SEQ ID NO: 1322710 - RNA, 18 nt, Human
gguuggaaggagagaaga

SEQ ID NO: 1322711 - RNA, 20 nt, Human
gguugggucagagagaagag

SEQ ID NO: 1322712 - RNA, 24 nt, Human
guauccccucguccccuccagccu

SEQ ID NO: 1322713 - RNA, 24 nt, Human
guccugcgcauccucgacagauca

SEQ ID NO: 1322714 - RNA, 18 nt, Human
guggagcaggcuggcgcc

SEQ ID NO: 1322715 - RNA, 18 nt, Human
guggagcaggcuggcgcc

SEQ ID NO: 1322716 - RNA, 23 nt, Human
guugcugggauuccuucucucca

SEQ ID NO: 1322717 - RNA, 22 nt, Human
uauuaugacaugaagcauaggg

SEQ ID NO: 1322718 - RNA, 19 nt, Human
ucaaagaaguggcacagaa

SEQ ID NO: 1322719 - RNA, 18 nt, Human
ucacagggguccggggca

SEQ ID NO: 1322720 - RNA, 21 nt, Human
ucacagggguccggggcagca

SEQ ID NO: 1322721 - RNA, 23 nt, Human
ucagcagauacaaagcccuccuc

SEQ ID NO: 1322722 - RNA, 24 nt, Human
ucagcagauacaaagcccuccuca

SEQ ID NO: 1322723 - RNA, 19 nt, Human
ucagcaucagcgaugcgcc

SEQ ID NO: 1322724 - RNA, 21 nt, Human
uccacaggaggugggagaggg

SEQ ID NO: 1322725 - RNA, 23 nt, Human
uccagcagcccagaccccauucc

SEQ ID NO: 1322726 - RNA, 22 nt, Human
uccaggaggccaguccaccccc

SEQ ID NO: 1322727 - RNA, 20 nt, Human
ucccccacaccccccaccaa

SEQ ID NO: 1322728 - RNA, 23 nt, Human
uccccgugucugcgccugggggu

SEQ ID NO: 1322729 - RNA, 18 nt, Human
ucccggaagcccgggcca

SEQ ID NO: 1322730 - RNA, 18 nt, Human
ucccggaagcccgggcca

SEQ ID NO: 1322731 - RNA, 19 nt, Human
uccggagagacaguagcug

SEQ ID NO: 1322732 - RNA, 26 nt, Human
uccucagagaccucuccuuccuccag

SEQ ID NO: 1322733 - RNA, 27 nt, Human
uccucuagagaguacagccucaauugc

SEQ ID NO: 1322734 - RNA, 22 nt, Human
uccugcgaggccaacucuuggg

SEQ ID NO: 1322735 - RNA, 19 nt, Human
ucuagagaguacagccuca

SEQ ID NO: 1322736 - RNA, 21 nt, Human
ucucccacgaacacugcccca

SEQ ID NO: 1322737 - RNA, 22 nt, Human
ucucuagcaccacacaccgggc

SEQ ID NO: 1322738 - RNA, 18 nt, Human
ucugcugauguucaaguc

SEQ ID NO: 1322739 - RNA, 22 nt, Human
ucuuuuuccagggccauuuuua

SEQ ID NO: 1322740 - RNA, 23 nt, Human
ugagauccuccagagguaucccc

SEQ ID NO: 1322741 - RNA, 22 nt, Human
ugccaggguagcucccggaagc

SEQ ID NO: 1322742 - RNA, 20 nt, Human
ugcccagagcuugcuggcag

SEQ ID NO: 1322743 - RNA, 22 nt, Human
ugcccuguccucuccuugggcu

SEQ ID NO: 1322744 - RNA, 21 nt, Human
ugcgccagugucccaugcuuu

SEQ ID NO: 1322745 - RNA, 20 nt, Human
ugcugauguucaagucuggg

SEQ ID NO: 1322746 - RNA, 22 nt, Human
uggaacgucccuuccagggguu

SEQ ID NO: 1322747 - RNA, 21 nt, Human
uggaaggcccuggauuccugg

SEQ ID NO: 1322748 - RNA, 24 nt, Human
ugggacuugaacaccgcaaugcgc

SEQ ID NO: 1322749 - RNA, 20 nt, Human
uguagauggaacucgccuga

SEQ ID NO: 1322750 - RNA, 25 nt, Human
ugugggccugucucuggagguagcu

SEQ ID NO: 1322751 - RNA, 19 nt, Human
uguggguggucagcagaua

SEQ ID NO: 1322752 - RNA, 18 nt, Human
uuccugcuuccaggguuc

SEQ ID NO: 1322753 - RNA, 20 nt, Human
uuccuggaauccugaucuca

SEQ ID NO: 1322754 - RNA, 19 nt, Human
uucuuuguuugcagcaccc

SEQ ID NO: 1322755 - RNA, 26 nt, Human
aaagagccugucccaguugggaaggc

SEQ ID NO: 1322756 - RNA, 26 nt, Human
aaaucccagaggcccggcccugagcc

SEQ ID NO: 1322757 - RNA, 19 nt, Human
acacagcuccagcccuggc

SEQ ID NO: 1322758 - RNA, 18 nt, Human
acccugaugaaauccugg

SEQ ID NO: 1322759 - RNA, 18 nt, Human
acucagcuggaggggcgg

SEQ ID NO: 1322760 - RNA, 18 nt, Human
acuccauuccucucucca

SEQ ID NO: 1322761 - RNA, 23 nt, Human
agaagagacuccucccauucaga

SEQ ID NO: 1322762 - RNA, 20 nt, Human
agaauuacuucuguacugag

SEQ ID NO: 1322763 - RNA, 18 nt, Human
agagacuccucccauuca

SEQ ID NO: 1322764 - RNA, 21 nt, Human
agccugucccaguugggaagg

SEQ ID NO: 1322765 - RNA, 24 nt, Human
aggcagguggaacacuaagcuggg

SEQ ID NO: 1322766 - RNA, 20 nt, Human
aggcagguggaacacuaagg

SEQ ID NO: 1322767 - RNA, 19 nt, Human
aggcaugacaccccugucc

SEQ ID NO: 1322768 - RNA, 22 nt, Human
caacauaucuaagccuccccca

SEQ ID NO: 1322769 - RNA, 26 nt, Human
caacccgucaccuuggggacuaucuc

SEQ ID NO: 1322770 - RNA, 19 nt, Human
caagaagggcuaauaugaa

SEQ ID NO: 1322771 - RNA, 23 nt, Human
cacacagcuccagcccuggccac

SEQ ID NO: 1322772 - RNA, 21 nt, Human
cacuguucuuucuuaugcacg

SEQ ID NO: 1322773 - RNA, 19 nt, Human
cagaagagacuccucccau

SEQ ID NO: 1322774 - RNA, 21 nt, Human
cagaggcccggcccugagccu

SEQ ID NO: 1322775 - RNA, 21 nt, Human
cagaggcccggcccugagccu

SEQ ID NO: 1322776 - RNA, 18 nt, Human
cagcccacccuccaugcc

SEQ ID NO: 1322777 - RNA, 20 nt, Human
caugaacacucaggugaccu

SEQ ID NO: 1322778 - RNA, 21 nt, Human
caugggacagggccaagccaa

SEQ ID NO: 1322779 - RNA, 19 nt, Human
cauuaagucaccaaaacuc

SEQ ID NO: 1322780 - RNA, 21 nt, Human
cauuccucucuccaaauccca

SEQ ID NO: 1322781 - RNA, 18 nt, Human
ccaaaucccagaggcccg

SEQ ID NO: 1322782 - RNA, 20 nt, Human
ccagaaggaagaauucagaa

SEQ ID NO: 1322783 - RNA, 18 nt, Human
ccagcccuggccacuaac

SEQ ID NO: 1322784 - RNA, 22 nt, Human
ccaggcaugacaccccuguccc

SEQ ID NO: 1322785 - RNA, 22 nt, Human
ccauccuguugccaugacaacc

SEQ ID NO: 1322786 - RNA, 18 nt, Human
cccaaaauagacacacuc

SEQ ID NO: 1322787 - RNA, 19 nt, Human
cccaaagagagaaaugaaa

SEQ ID NO: 1322788 - RNA, 27 nt, Human
cccacuggggauccuuccacuccccaa

SEQ ID NO: 1322789 - RNA, 21 nt, Human
cccagaggcccggcccugagc

SEQ ID NO: 1322790 - RNA, 22 nt, Human
cccauccuguugccaugacaac

SEQ ID NO: 1322791 - RNA, 18 nt, Human
ccccacuggggauccuuc

SEQ ID NO: 1322792 - RNA, 19 nt, Human
cccccagaauuacuucugu

SEQ ID NO: 1322793 - RNA, 23 nt, Human
cccggcccugagccuccagcaag

SEQ ID NO: 1322794 - RNA, 21 nt, Human
cccggcccugagccuccagcc

SEQ ID NO: 1322795 - RNA, 18 nt, Human
cccugccuccaaccgggc

SEQ ID NO: 1322796 - RNA, 22 nt, Human
ccucaacccgucaccuugggga

SEQ ID NO: 1322797 - RNA, 24 nt, Human
ccuccagcaauggggagagccugc

SEQ ID NO: 1322798 - RNA, 24 nt, Human
ccucccccagugcauuccccacug

SEQ ID NO: 1322799 - RNA, 18 nt, Human
ccucugcugggcaaaggu

SEQ ID NO: 1322800 - RNA, 22 nt, Human
ccucugcugggcaaagguggag

SEQ ID NO: 1322801 - RNA, 22 nt, Human
ccucuuucuucccugugcccca

SEQ ID NO: 1322802 - RNA, 20 nt, Human
ccuggcacagggcugggcca

SEQ ID NO: 1322803 - RNA, 20 nt, Human
ccuguugccaugacaaccaa

SEQ ID NO: 1322804 - RNA, 21 nt, Human
ccuuaggccucuuucuucccu

SEQ ID NO: 1322805 - RNA, 24 nt, Human
cuccauuccucucuccaaauccca

SEQ ID NO: 1322806 - RNA, 24 nt, Human
cucccagcccacccuccaugccca

SEQ ID NO: 1322807 - RNA, 19 nt, Human
cucucuccaaaucccagag

SEQ ID NO: 1322808 - RNA, 20 nt, Human
cugcccguaugucucugucu

SEQ ID NO: 1322809 - RNA, 24 nt, Human
cugggcaaagguggagggggcuug

SEQ ID NO: 1322810 - RNA, 20 nt, Human
gaaaauguacuccauuccuc

SEQ ID NO: 1322811 - RNA, 21 nt, Human
gacaugaggcacugagggucu

SEQ ID NO: 1322812 - RNA, 23 nt, Human
gagacuccucccauucagggcac

SEQ ID NO: 1322813 - RNA, 18 nt, Human
gagccuccagcaagucuc

SEQ ID NO: 1322814 - RNA, 18 nt, Human
gaggcaugcacccugaug

SEQ ID NO: 1322815 - RNA, 21 nt, Human
gccaugagacuggggcugggg

SEQ ID NO: 1322816 - RNA, 23 nt, Human
gcccugagccuccagcaagucuc

SEQ ID NO: 1322817 - RNA, 18 nt, Human
gccuggcacagggcuggg

SEQ ID NO: 1322818 - RNA, 21 nt, Human
gcgcugguccccuuccuucuc

SEQ ID NO: 1322819 - RNA, 20 nt, Human
gcuccuuaggccucuuucuu

SEQ ID NO: 1322820 - RNA, 22 nt, Human
guacuugggcucaauccucuag

SEQ ID NO: 1322821 - RNA, 19 nt, Human
guccuugaugguggaggag

SEQ ID NO: 1322822 - RNA, 18 nt, Human
gucugcuuaggacuucca

SEQ ID NO: 1322823 - RNA, 18 nt, Human
guggagggggcuugcucu

SEQ ID NO: 1322824 - RNA, 21 nt, Human
guggagggggcuugcucuuau

SEQ ID NO: 1322825 - RNA, 18 nt, Human
uaaagcccagaaggaaga

SEQ ID NO: 1322826 - RNA, 23 nt, Human
uaaagcccagaaggaagaauuca

SEQ ID NO: 1322827 - RNA, 22 nt, Human
uaacuccaggcaugacaccccu

SEQ ID NO: 1322828 - RNA, 22 nt, Human
uaagucaccaaaacucugcuga

SEQ ID NO: 1322829 - RNA, 18 nt, Human
uacagucgagauuugcuc

SEQ ID NO: 1322830 - RNA, 21 nt, Human
uaguaacuccaggcaugacac

SEQ ID NO: 1322831 - RNA, 23 nt, Human
ucaacauaucuaagccuccccca

SEQ ID NO: 1322832 - RNA, 20 nt, Human
ucagagccuuuccaguuccc

SEQ ID NO: 1322833 - RNA, 18 nt, Human
ucagcuggaggggcggag

SEQ ID NO: 1322834 - RNA, 25 nt, Human
ucccaaacuucauuaagucaccaaa

SEQ ID NO: 1322835 - RNA, 24 nt, Human
ucuguacugagcaugcccaaaaua

SEQ ID NO: 1322836 - RNA, 18 nt, Human
ucuucauccaaaugaauc

SEQ ID NO: 1322837 - RNA, 22 nt, Human
ucuucccugugccccacaagaa

SEQ ID NO: 1322838 - RNA, 24 nt, Human
ugaaaauguacuccauuccucucu

SEQ ID NO: 1322839 - RNA, 18 nt, Human
ugaaagaaaggaagggaa

SEQ ID NO: 1322840 - RNA, 20 nt, Human
ugaacugaaagaaaggaagg

SEQ ID NO: 1322841 - RNA, 20 nt, Human
ugagacuggggcugggggcc

SEQ ID NO: 1322842 - RNA, 22 nt, Human
ugagacuggggcugggggcuga

SEQ ID NO: 1322843 - RNA, 18 nt, Human
ugagccacucccacuccc

SEQ ID NO: 1322844 - RNA, 19 nt, Human
ugagggucuuccucaaccc

SEQ ID NO: 1322845 - RNA, 20 nt, Human
ugccaugagacuggggcugg

SEQ ID NO: 1322846 - RNA, 23 nt, Human
ugccaugagacuggggcuggggg

SEQ ID NO: 1322847 - RNA, 19 nt, Human
ugcccugagccacucccac

SEQ ID NO: 1322848 - RNA, 24 nt, Human
ugcccugccuccaaccgggcuuca

SEQ ID NO: 1322849 - RNA, 19 nt, Human
ugccuggcacagggcuggg

SEQ ID NO: 1322850 - RNA, 20 nt, Human
ugcugggcaaagguggaggg

SEQ ID NO: 1322851 - RNA, 23 nt, Human
uggaggggcggagaggcuuccuc

SEQ ID NO: 1322852 - RNA, 23 nt, Human
uggcacagggcugggccauggga

SEQ ID NO: 1322853 - RNA, 21 nt, Human
ugggaagagccuccagcaaug

SEQ ID NO: 1322854 - RNA, 20 nt, Human
ugggaaggcugcagagggca

SEQ ID NO: 1322855 - RNA, 18 nt, Human
ugggcgucaggcaacugc

SEQ ID NO: 1322856 - RNA, 21 nt, Human
uggggacuaucucccagccca

SEQ ID NO: 1322857 - RNA, 21 nt, Human
uggucugguaaagcccagaag

SEQ ID NO: 1322858 - RNA, 21 nt, Human
uguacuccauuccucucucca

SEQ ID NO: 1322859 - RNA, 18 nt, Human
uguggggaggucugcuua

SEQ ID NO: 1322860 - RNA, 23 nt, Human
uucagaagagacuccucccauuc

SEQ ID NO: 1322861 - RNA, 19 nt, Human
uucaugaacacucagguga

SEQ ID NO: 1322862 - RNA, 19 nt, Human
uucuguacugagcaugccc

SEQ ID NO: 1322863 - RNA, 19 nt, Human
uugcuaguaacuccaggca

SEQ ID NO: 1322864 - RNA, 18 nt, Human
ggggagaaggagacggua

SEQ ID NO: 1322865 - RNA, 19 nt, Human
gucacaggggagaaggaga

SEQ ID NO: 1322866 - RNA, 19 nt, Human
ucacaggggagaaggagac

SEQ ID NO: 1322867 - RNA, 23 nt, Human
ugacuaagugaggaggucacagg

SEQ ID NO: 1322868 - RNA, 24 nt, Human
ugaggaggucacaggggagaagga

SEQ ID NO: 1322869 - RNA, 22 nt, Human
acagcaaacagcuggcucugga

SEQ ID NO: 1322870 - RNA, 18 nt, Human
aaaaaaccaucauacaaa

SEQ ID NO: 1322871 - RNA, 18 nt, Human
aaagugccaaaagaccca

SEQ ID NO: 1322872 - RNA, 21 nt, Human
agugaggcucauaguguccuc

SEQ ID NO: 1322873 - RNA, 22 nt, Human
caaaagacccacugaucgaacc

SEQ ID NO: 1322874 - RNA, 19 nt, Human
caaagugccaaaagaccca

SEQ ID NO: 1322875 - RNA, 22 nt, Human
cagaaacuucccucucaggccu

SEQ ID NO: 1322876 - RNA, 23 nt, Human
ccgaugccauaguucaccaccug

SEQ ID NO: 1322877 - RNA, 18 nt, Human
ccuccacuccccccuccu

SEQ ID NO: 1322878 - RNA, 21 nt, Human
ccucucaggccuccacucccc

SEQ ID NO: 1322879 - RNA, 23 nt, Human
ccugcagguguccucauugccac

SEQ ID NO: 1322880 - RNA, 22 nt, Human
cuagccccuccugcaggugucc

SEQ ID NO: 1322881 - RNA, 26 nt, Human
cugcagauacucugcauagggaggag

SEQ ID NO: 1322882 - RNA, 23 nt, Human
cuucuuggucccuguggucaagg

SEQ ID NO: 1322883 - RNA, 21 nt, Human
cuuuguacugugcauccuacu

SEQ ID NO: 1322884 - RNA, 24 nt, Human
gagucaggcuagccccuccugcag

SEQ ID NO: 1322885 - RNA, 22 nt, Human
guugcaacucgguuuccugacu

SEQ ID NO: 1322886 - RNA, 25 nt, Human
uaaaaaaccaucauacaaaaagaaa

SEQ ID NO: 1322887 - RNA, 27 nt, Human
ucauacaaaaagaaaagaaaguuguuu

SEQ ID NO: 1322888 - RNA, 31 nt, Human
uccagaaacuucccucucaggccuccacucu

SEQ ID NO: 1322889 - RNA, 19 nt, Human
ucucaggccuccacucccc

SEQ ID NO: 1322890 - RNA, 22 nt, Human
ucucaggccuccacuccccccu

SEQ ID NO: 1322891 - RNA, 24 nt, Human
ucucaggccuccacuccccccucc

SEQ ID NO: 1322892 - RNA, 24 nt, Human
ucuuaaaguucugggagucaggcu

SEQ ID NO: 1322893 - RNA, 20 nt, Human
ugagauguccuguucccaac

SEQ ID NO: 1322894 - RNA, 22 nt, Human
uguggucaagguucaaagugcc

SEQ ID NO: 1322895 - RNA, 22 nt, Human
uguguuaaaaaaccaucauaca

SEQ ID NO: 1322896 - RNA, 19 nt, Human
uucaaagugccaaaagacc

SEQ ID NO: 1322897 - RNA, 22 nt, Human
aagggggagaggaagggggagg

SEQ ID NO: 1322898 - RNA, 25 nt, Human
aauccugggcuccuucaugucuucu

SEQ ID NO: 1322899 - RNA, 19 nt, Human
accccagagaggaaaaacc

SEQ ID NO: 1322900 - RNA, 21 nt, Human
agagaggaagggggagaggaa

SEQ ID NO: 1322901 - RNA, 21 nt, Human
agauugccagugcuccagcca

SEQ ID NO: 1322902 - RNA, 18 nt, Human
aggaagggggagaggaag

SEQ ID NO: 1322903 - RNA, 19 nt, Human
aggaagggggagaggaagg

SEQ ID NO: 1322904 - RNA, 21 nt, Human
caagaugugggucucaucuuc

SEQ ID NO: 1322905 - RNA, 25 nt, Human
cagaauccugggcuccuuccccgag

SEQ ID NO: 1322906 - RNA, 20 nt, Human
ccacacugucuucagaaucc

SEQ ID NO: 1322907 - RNA, 18 nt, Human
ccccagagaggaaaaacc

SEQ ID NO: 1322908 - RNA, 22 nt, Human
cuuacgaccugggcauuccacu

SEQ ID NO: 1322909 - RNA, 21 nt, Human
gcaggcaauccaagacuagca

SEQ ID NO: 1322910 - RNA, 20 nt, Human
ggaagggagagaggaagggg

SEQ ID NO: 1322911 - RNA, 22 nt, Human
ggagaggaagggggaggaaagg

SEQ ID NO: 1322912 - RNA, 25 nt, Human
gggagagaggaagggggagaggaag

SEQ ID NO: 1322913 - RNA, 23 nt, Human
gggcuccuucaugucuucuacuu

SEQ ID NO: 1322914 - RNA, 19 nt, Human
gguauuuaccccagagagg

SEQ ID NO: 1322915 - RNA, 21 nt, Human
uagcauauugacuccacacug

SEQ ID NO: 1322916 - RNA, 18 nt, Human
uaguucuaaucaggaaaa

SEQ ID NO: 1322917 - RNA, 21 nt, Human
uuccuagcagcuguaguucua

SEQ ID NO: 1322918 - RNA, 21 nt, Human
uuugcacagggauguuccuag

SEQ ID NO: 1322919 - RNA, 23 nt, Human
aagccgccaucauaaguccuggc

SEQ ID NO: 1322920 - RNA, 18 nt, Human
agccgcgccccgccccuc

SEQ ID NO: 1322921 - RNA, 21 nt, Human
aggagguggggcccagggggc

SEQ ID NO: 1322922 - RNA, 18 nt, Human
cacuguaggacagagcac

SEQ ID NO: 1322923 - RNA, 19 nt, Human
cagagcccggaccacggcu

SEQ ID NO: 1322924 - RNA, 22 nt, Human
caggcaaagaccgugacugaca

SEQ ID NO: 1322925 - RNA, 23 nt, Human
ccaggcaaagaccgugacugaca

SEQ ID NO: 1322926 - RNA, 20 nt, Human
ccccgcccacgcaacgcggc

SEQ ID NO: 1322927 - RNA, 25 nt, Human
ccccucgcaggccagcgcucagggc

SEQ ID NO: 1322928 - RNA, 21 nt, Human
cccgcaacuccgccccugccc

SEQ ID NO: 1322929 - RNA, 21 nt, Human
ccgcaggccuccgagagcggg

SEQ ID NO: 1322930 - RNA, 19 nt, Human
ccgcccgccgcgccugacc

SEQ ID NO: 1322931 - RNA, 19 nt, Human
ccgccggacagcccaggug

SEQ ID NO: 1322932 - RNA, 21 nt, Human
ccgcgccccgccccucgcagg

SEQ ID NO: 1322933 - RNA, 18 nt, Human
ccgcggccagagcccgga

SEQ ID NO: 1322934 - RNA, 18 nt, Human
ccuccgcgaagcagaagc

SEQ ID NO: 1322935 - RNA, 27 nt, Human
ccugacccgcggccucuccgcuccgac

SEQ ID NO: 1322936 - RNA, 20 nt, Human
cgagccccgggcucgcaacc

SEQ ID NO: 1322937 - RNA, 18 nt, Human
cgccccugccccgcccac

SEQ ID NO: 1322938 - RNA, 21 nt, Human
cgccgagaagggccgcgccgg

SEQ ID NO: 1322939 - RNA, 19 nt, Human
cgccgccgccgccucgccg

SEQ ID NO: 1322940 - RNA, 22 nt, Human
cgccggacagcccaggugucgg

SEQ ID NO: 1322941 - RNA, 19 nt, Human
cgcggcgaggccgccccgu

SEQ ID NO: 1322942 - RNA, 24 nt, Human
cgcucacacgcacgcacggaccca

SEQ ID NO: 1322943 - RNA, 20 nt, Human
cgcucacacgcacgcacggu

SEQ ID NO: 1322944 - RNA, 19 nt, Human
cgugaagccgcaggccucc

SEQ ID NO: 1322945 - RNA, 21 nt, Human
cuggaccugggccugccuccc

SEQ ID NO: 1322946 - RNA, 19 nt, Human
cuuccgcgccgccgccgcc

SEQ ID NO: 1322947 - RNA, 21 nt, Human
gacccgcggccucuccgcucc

SEQ ID NO: 1322948 - RNA, 20 nt, Human
gaccugggccugccucccuc

SEQ ID NO: 1322949 - RNA, 18 nt, Human
gagguggggcccaggggg

SEQ ID NO: 1322950 - RNA, 19 nt, Human
gcccagagccgcgccccgc

SEQ ID NO: 1322951 - RNA, 19 nt, Human
gcccaggcgccggagaaga

SEQ ID NO: 1322952 - RNA, 18 nt, Human
gccccgccccucgcaggc

SEQ ID NO: 1322953 - RNA, 22 nt, Human
gccccgccccucgcaggccagc

SEQ ID NO: 1322954 - RNA, 20 nt, Human
gccuccgagagcgggacgag

SEQ ID NO: 1322955 - RNA, 19 nt, Human
gcuccggggcggacagacu

SEQ ID NO: 1322956 - RNA, 19 nt, Human
ggagguggggcccaggggg

SEQ ID NO: 1322957 - RNA, 19 nt, Human
ggagguggggcccaggggg

SEQ ID NO: 1322958 - RNA, 21 nt, Human
ggagguggggcccagggggcu

SEQ ID NO: 1322959 - RNA, 24 nt, Human
ggggcccagggggcuccggggcgg

SEQ ID NO: 1322960 - RNA, 24 nt, Human
guggggcccagggggcuccggggc

SEQ ID NO: 1322961 - RNA, 20 nt, Human
uagcgguaacgggcuggggu

SEQ ID NO: 1322962 - RNA, 20 nt, Human
uccgcgccgccgccgccucg

SEQ ID NO: 1322963 - RNA, 23 nt, Human
uccgcgccgccgccgccucgccg

SEQ ID NO: 1322964 - RNA, 22 nt, Human
ugauugccgacaccgccuccgc

SEQ ID NO: 1322965 - RNA, 19 nt, Human
ugccccgcccacgcaacgc

SEQ ID NO: 1322966 - RNA, 21 nt, Human
ugcuuguaggcgaugcccagg

SEQ ID NO: 1322967 - RNA, 20 nt, Human
uggccgcccgccgcgccuga

SEQ ID NO: 1322968 - RNA, 20 nt, Human
uggggcccagggggcuccgg

SEQ ID NO: 1322969 - RNA, 21 nt, Human
uggggcccagggggcuccggg

SEQ ID NO: 1322970 - RNA, 22 nt, Human
uuccgcgccgccgccgccucgc

SEQ ID NO: 1322971 - RNA, 22 nt, Human
uugcccaggcgccggagaagag

SEQ ID NO: 1322972 - RNA, 24 nt, Human
uuuccaguauggccgcccgccgcg

SEQ ID NO: 1322973 - RNA, 23 nt, Human
aaacacaguuuggcacagaguca

SEQ ID NO: 1322974 - RNA, 19 nt, Human
aagaggccagaggcagggc

SEQ ID NO: 1322975 - RNA, 19 nt, Human
aagaggccagaggcagggc

SEQ ID NO: 1322976 - RNA, 23 nt, Human
acagagucacagagaucguuagc

SEQ ID NO: 1322977 - RNA, 21 nt, Human
acaguggcuuagacacugagg

SEQ ID NO: 1322978 - RNA, 18 nt, Human
aggcagggcaaguccagg

SEQ ID NO: 1322979 - RNA, 23 nt, Human
agggcagcccugauucaagggag

SEQ ID NO: 1322980 - RNA, 18 nt, Human
augacauuaccaaggacc

SEQ ID NO: 1322981 - RNA, 18 nt, Human
caccuugcuaccuucagc

SEQ ID NO: 1322982 - RNA, 21 nt, Human
cagaguaucucaauguuuggu

SEQ ID NO: 1322983 - RNA, 23 nt, Human
cuucuuaucuuuccaccuugcua

SEQ ID NO: 1322984 - RNA, 22 nt, Human
ggccagaggcagggcaagucca

SEQ ID NO: 1322985 - RNA, 20 nt, Human
gucacuaagggcagcccuga

SEQ ID NO: 1322986 - RNA, 19 nt, Human
guccugggauguuuucagc

SEQ ID NO: 1322987 - RNA, 20 nt, Human
uaacugaaaagccaacuaac

SEQ ID NO: 1322988 - RNA, 24 nt, Human
uaagcugucuccaccugccacaaa

SEQ ID NO: 1322989 - RNA, 18 nt, Human
uaagggcagcccugauuc

SEQ ID NO: 1322990 - RNA, 23 nt, Human
uaccaaggaccccucugcuucuu

SEQ ID NO: 1322991 - RNA, 24 nt, Human
uaucuuuccaccuugcuaccuuca

SEQ ID NO: 1322992 - RNA, 21 nt, Human
ugaugggagagaaacauugca

SEQ ID NO: 1322993 - RNA, 20 nt, Human
ugucacagaugccuuuggaa

SEQ ID NO: 1322994 - RNA, 25 nt, Human
uuucagcugcaaguaacugaaaagc

SEQ ID NO: 1322995 - RNA, 23 nt, Human
uuucauggcuccaugacauuacc

SEQ ID NO: 1322996 - RNA, 24 nt, Human
cacccuaaucuuaagcaaauggga

SEQ ID NO: 1322997 - RNA, 22 nt, Human
caucuugucugcuuuucuuacu

SEQ ID NO: 1322998 - RNA, 20 nt, Human
cccuugauaacgaagauaga

SEQ ID NO: 1322999 - RNA, 23 nt, Human
gcaaaugggauuuccaguugacg

SEQ ID NO: 1323000 - RNA, 24 nt, Human
uguacaugcgguugacaaagagga

SEQ ID NO: 1323001 - RNA, 22 nt, Human
aaauaagacuuaaggacuuccc

SEQ ID NO: 1323002 - RNA, 20 nt, Human
acagggauucaucuuucuca

SEQ ID NO: 1323003 - RNA, 21 nt, Human
agccaggagagggccccacaa

SEQ ID NO: 1323004 - RNA, 19 nt, Human
aggaagacagacacaggga

SEQ ID NO: 1323005 - RNA, 20 nt, Human
caggucccucucuucuuuca

SEQ ID NO: 1323006 - RNA, 24 nt, Human
ccucucuucuuucuucugcacaaa

SEQ ID NO: 1323007 - RNA, 22 nt, Human
ccugugcugcagcugcugcagg

SEQ ID NO: 1323008 - RNA, 19 nt, Human
cucccugcugaggcggagg

SEQ ID NO: 1323009 - RNA, 23 nt, Human
cugaggcggaggagauucucucu

SEQ ID NO: 1323010 - RNA, 18 nt, Human
cugcagccccuucgcagg

SEQ ID NO: 1323011 - RNA, 20 nt, Human
cugcauacuugagcugcacc

SEQ ID NO: 1323012 - RNA, 19 nt, Human
cugcuuccuccuggccugc

SEQ ID NO: 1323013 - RNA, 23 nt, Human
cuucugcacaaacugaguaaccc

SEQ ID NO: 1323014 - RNA, 20 nt, Human
gccaguuccaguuucaagga

SEQ ID NO: 1323015 - RNA, 20 nt, Human
gccuucagucgguucaccag

SEQ ID NO: 1323016 - RNA, 21 nt, Human
ggagauucucucuuucuucuu

SEQ ID NO: 1323017 - RNA, 19 nt, Human
gucacggagccaggagagg

SEQ ID NO: 1323018 - RNA, 21 nt, Human
uaacccaggccgguucuccag

SEQ ID NO: 1323019 - RNA, 24 nt, Human
uaacccaggccgguucuccagcag

SEQ ID NO: 1323020 - RNA, 23 nt, Human
ucaccaggucccucucuucuuuc

SEQ ID NO: 1323021 - RNA, 22 nt, Human
ucacggagccaggagagggccc

SEQ ID NO: 1323022 - RNA, 23 nt, Human
ucugcacaaacugaguaacccag

SEQ ID NO: 1323023 - RNA, 19 nt, Human
ugccucaggcgcuuggcug

SEQ ID NO: 1323024 - RNA, 23 nt, Human
uucaucuuucucaucauguaagg

SEQ ID NO: 1323025 - RNA, 25 nt, Human
uucaucuuucucaucauguaagggg

SEQ ID NO: 1323026 - RNA, 18 nt, Human
uuccaguuucaaggaguc

SEQ ID NO: 1323027 - RNA, 18 nt, Human
uucucucuuucuucuucu

SEQ ID NO: 1323028 - RNA, 20 nt, Human
cugccuggccguccugauug

SEQ ID NO: 1323029 - RNA, 19 nt, Human
gccuggccguccugauugc

SEQ ID NO: 1323030 - RNA, 19 nt, Human
ugcaaaugcugccuggccg

SEQ ID NO: 1323031 - RNA, 26 nt, Human
uguggaacacgaccuuuuucuuccga

SEQ ID NO: 1323032 - RNA, 19 nt, Human
aaaccagccaagaccugca

SEQ ID NO: 1323033 - RNA, 20 nt, Human
aaagcagcugccuccuagac

SEQ ID NO: 1323034 - RNA, 19 nt, Human
aaaggcagaggaggaugaa

SEQ ID NO: 1323035 - RNA, 21 nt, Human
aagaccugcagaagggaucaa

SEQ ID NO: 1323036 - RNA, 19 nt, Human
aagccagaggcagagagga

SEQ ID NO: 1323037 - RNA, 19 nt, Human
acugcaccuggagguaaca

SEQ ID NO: 1323038 - RNA, 23 nt, Human
agagccuuagcucccuggacagc

SEQ ID NO: 1323039 - RNA, 20 nt, Human
aggggaaaggcagaggagga

SEQ ID NO: 1323040 - RNA, 20 nt, Human
agguaacagcgauccgcgau

SEQ ID NO: 1323041 - RNA, 22 nt, Human
aggucaggagaaugggugggga

SEQ ID NO: 1323042 - RNA, 19 nt, Human
aucuccuucacccucgccg

SEQ ID NO: 1323043 - RNA, 22 nt, Human
augaaagagacauaaagccaga

SEQ ID NO: 1323044 - RNA, 20 nt, Human
auuuccuguagggauagccg

SEQ ID NO: 1323045 - RNA, 18 nt, Human
caagucucuaauuguagc

SEQ ID NO: 1323046 - RNA, 21 nt, Human
caggucaggagaauggguggg

SEQ ID NO: 1323047 - RNA, 18 nt, Human
ccaauccagagaacuacc

SEQ ID NO: 1323048 - RNA, 20 nt, Human
cccaaguaugaucuacaggu

SEQ ID NO: 1323049 - RNA, 22 nt, Human
ccccgcgaacacccuggggacc

SEQ ID NO: 1323050 - RNA, 21 nt, Human
cccgcagccgcucgcuggggc

SEQ ID NO: 1323051 - RNA, 19 nt, Human
ccgcagccgcucgcugggg

SEQ ID NO: 1323052 - RNA, 20 nt, Human
ccgcagccgcucgcuggggc

SEQ ID NO: 1323053 - RNA, 21 nt, Human
ccgcgaacacccuggggaccu

SEQ ID NO: 1323054 - RNA, 19 nt, Human
cgccgcguagcugcagggc

SEQ ID NO: 1323055 - RNA, 20 nt, Human
cgcguagcugcagggcccgg

SEQ ID NO: 1323056 - RNA, 22 nt, Human
cuaauuguagcuugguuucccu

SEQ ID NO: 1323057 - RNA, 25 nt, Human
cugaaaccagccaagaccugcagaa

SEQ ID NO: 1323058 - RNA, 26 nt, Human
cuggagguaacagcgauccgcgaucu

SEQ ID NO: 1323059 - RNA, 20 nt, Human
cuggggcuucccaccgccuc

SEQ ID NO: 1323060 - RNA, 22 nt, Human
gaaaaagcagcugccuccuaga

SEQ ID NO: 1323061 - RNA, 20 nt, Human
gaaagagacauaaagccaga

SEQ ID NO: 1323062 - RNA, 18 nt, Human
gaacguguccagggcccc

SEQ ID NO: 1323063 - RNA, 20 nt, Human
gaggagccacuggcuugaaa

SEQ ID NO: 1323064 - RNA, 18 nt, Human
gcagccgcucgcuggggc

SEQ ID NO: 1323065 - RNA, 23 nt, Human
gccacgcgccucgcgcgaguccu

SEQ ID NO: 1323066 - RNA, 19 nt, Human
ggaggagccacuggcuuga

SEQ ID NO: 1323067 - RNA, 21 nt, Human
gggcaggggaaaggcagagga

SEQ ID NO: 1323068 - RNA, 24 nt, Human
gucaucuuuuucauugcuguacuc

SEQ ID NO: 1323069 - RNA, 22 nt, Human
guccagggccccgcgaacaccc

SEQ ID NO: 1323070 - RNA, 20 nt, Human
guuuguuuggggagagccuu

SEQ ID NO: 1323071 - RNA, 18 nt, Human
uacaaagucugaacgugg

SEQ ID NO: 1323072 - RNA, 19 nt, Human
uagcucccuggacagcaac

SEQ ID NO: 1323073 - RNA, 20 nt, Human
uaggcugggcccuuaucacu

SEQ ID NO: 1323074 - RNA, 25 nt, Human
ucaagggcaggggaaaggcagagga

SEQ ID NO: 1323075 - RNA, 23 nt, Human
ucccaaguggauguaacaguuug

SEQ ID NO: 1323076 - RNA, 19 nt, Human
ucccccaucuccuucaccc

SEQ ID NO: 1323077 - RNA, 21 nt, Human
uccuagacuaggcugggcccu

SEQ ID NO: 1323078 - RNA, 21 nt, Human
ucucuaauuguagcuugguuu

SEQ ID NO: 1323079 - RNA, 22 nt, Human
ucucugcgugggcagaaucugu

SEQ ID NO: 1323080 - RNA, 24 nt, Human
ugaaagagacauaaagccagaggc

SEQ ID NO: 1323081 - RNA, 22 nt, Human
ugcagggcccggcucugcgcuu

SEQ ID NO: 1323082 - RNA, 24 nt, Human
uggacagcaaccacagggcugggc

SEQ ID NO: 1323083 - RNA, 23 nt, Human
ugggacccguuuccugaaaccag

SEQ ID NO: 1323084 - RNA, 23 nt, Human
ugggacucugaggccgcgccucg

SEQ ID NO: 1323085 - RNA, 27 nt, Human
uguacucccaaguggauguaacaguuu

SEQ ID NO: 1323086 - RNA, 24 nt, Human
uguccagggccccgcgaacacccu

SEQ ID NO: 1323087 - RNA, 18 nt, Human
aagcugcaggcgcccggc

SEQ ID NO: 1323088 - RNA, 18 nt, Human
acccucccacugcuggau

SEQ ID NO: 1323089 - RNA, 19 nt, Human
agagaacagccccaugcug

SEQ ID NO: 1323090 - RNA, 19 nt, Human
agccccccagcccccccag

SEQ ID NO: 1323091 - RNA, 22 nt, Human
agccgcaccuuggugaagccca

SEQ ID NO: 1323092 - RNA, 20 nt, Human
agccugucauccaccacgac

SEQ ID NO: 1323093 - RNA, 20 nt, Human
agcuggaaguggaagacgcc

SEQ ID NO: 1323094 - RNA, 28 nt, Human
aggaguggggcccagaacucauuccgcu

SEQ ID NO: 1323095 - RNA, 24 nt, Human
aggcaggcugcccgaauugccuca

SEQ ID NO: 1323096 - RNA, 20 nt, Human
auagccaagggcaucagggc

SEQ ID NO: 1323097 - RNA, 26 nt, Human
aucagcuuccccucacgcacgggcag

SEQ ID NO: 1323098 - RNA, 18 nt, Human
auccucgucauccuccuc

SEQ ID NO: 1323099 - RNA, 22 nt, Human
auccucgucauccuccucauca

SEQ ID NO: 1323100 - RNA, 24 nt, Human
caaggaaccagcaguuacccaggc

SEQ ID NO: 1323101 - RNA, 21 nt, Human
caccccgaucacucagggcag

SEQ ID NO: 1323102 - RNA, 23 nt, Human
cagaaggaccgugcacuugggcg

SEQ ID NO: 1323103 - RNA, 23 nt, Human
cagcacagaacuccugugggugg

SEQ ID NO: 1323104 - RNA, 18 nt, Human
cagccccccagccccccc

SEQ ID NO: 1323105 - RNA, 23 nt, Human
cagcccccccagggcccuuccuc

SEQ ID NO: 1323106 - RNA, 21 nt, Human
cagccgcagcagccgcaccuu

SEQ ID NO: 1323107 - RNA, 24 nt, Human
cagcggccaaacugccagagcugg

SEQ ID NO: 1323108 - RNA, 18 nt, Human
cagcuggucauagccaag

SEQ ID NO: 1323109 - RNA, 23 nt, Human
caggaacaccuugugugugcccg

SEQ ID NO: 1323110 - RNA, 21 nt, Human
caggagccggggauacagaaa

SEQ ID NO: 1323111 - RNA, 20 nt, Human
caggagccggggauacagag

SEQ ID NO: 1323112 - RNA, 20 nt, Human
caggagccggggauacagag

SEQ ID NO: 1323113 - RNA, 19 nt, Human
caggagggaccacccggcg

SEQ ID NO: 1323114 - RNA, 21 nt, Human
cagggcagagaacagccccau

SEQ ID NO: 1323115 - RNA, 27 nt, Human
ccaacggugagguaagugaggcccuuu

SEQ ID NO: 1323116 - RNA, 21 nt, Human
ccacgccgccugugaaaucca

SEQ ID NO: 1323117 - RNA, 19 nt, Human
ccagcggccaaacugccag

SEQ ID NO: 1323118 - RNA, 22 nt, Human
cccacgccgccugugaaaucca

SEQ ID NO: 1323119 - RNA, 25 nt, Human
ccccagcccccccagggcccuuccu

SEQ ID NO: 1323120 - RNA, 18 nt, Human
cccccagcccccccaggg

SEQ ID NO: 1323121 - RNA, 24 nt, Human
cccccagcccccccagggcccuuc

SEQ ID NO: 1323122 - RNA, 18 nt, Human
ccccccgcgcugggcccc

SEQ ID NO: 1323123 - RNA, 22 nt, Human
ccccgaaaaagcugcaggcgcc

SEQ ID NO: 1323124 - RNA, 23 nt, Human
ccccgaauccaggcaggcugccc

SEQ ID NO: 1323125 - RNA, 23 nt, Human
ccccgcgcugggccccgugcccc

SEQ ID NO: 1323126 - RNA, 19 nt, Human
ccccgugccccugcagccc

SEQ ID NO: 1323127 - RNA, 23 nt, Human
ccccugcagccccccagcccccc

SEQ ID NO: 1323128 - RNA, 22 nt, Human
cccggcuccgaccccagccucc

SEQ ID NO: 1323129 - RNA, 19 nt, Human
cccugcagccccccagccc

SEQ ID NO: 1323130 - RNA, 20 nt, Human
cccuuuaccaggcccucuuc

SEQ ID NO: 1323131 - RNA, 25 nt, Human
ccgcagccgcagcagccgcaccuug

SEQ ID NO: 1323132 - RNA, 26 nt, Human
ccgccugugaaauccacaaaagcugg

SEQ ID NO: 1323133 - RNA, 18 nt, Human
ccgugccccugcagcccc

SEQ ID NO: 1323134 - RNA, 23 nt, Human
ccucauccucgucauccuccuca

SEQ ID NO: 1323135 - RNA, 22 nt, Human
ccucgcccacgccgccugugaa

SEQ ID NO: 1323136 - RNA, 19 nt, Human
ccugugaaauccacaaaag

SEQ ID NO: 1323137 - RNA, 19 nt, Human
ccuugugugugcccgugau

SEQ ID NO: 1323138 - RNA, 24 nt, Human
cgccuuuggccuucuccgaguccu

SEQ ID NO: 1323139 - RNA, 18 nt, Human
cggccaaacugccagagc

SEQ ID NO: 1323140 - RNA, 23 nt, Human
cggccccagcuggucauagccaa

SEQ ID NO: 1323141 - RNA, 21 nt, Human
cggcccccccgcgcugggccc

SEQ ID NO: 1323142 - RNA, 27 nt, Human
cgugccccugcagccccccagcccccc

SEQ ID NO: 1323143 - RNA, 18 nt, Human
cucauccucgucauccuc

SEQ ID NO: 1323144 - RNA, 19 nt, Human
gcaccuuggugaagcccag

SEQ ID NO: 1323145 - RNA, 21 nt, Human
gcagagaacagccccaugcug

SEQ ID NO: 1323146 - RNA, 20 nt, Human
gcagggcagagaacagcccc

SEQ ID NO: 1323147 - RNA, 24 nt, Human
gcagggcagagaacagccccaugc

SEQ ID NO: 1323148 - RNA, 18 nt, Human
gcggcagcugcaaggaac

SEQ ID NO: 1323149 - RNA, 19 nt, Human
gcggccaaacugccagagc

SEQ ID NO: 1323150 - RNA, 18 nt, Human
ggaggcggcagcugcaag

SEQ ID NO: 1323151 - RNA, 20 nt, Human
ggcagagaacagccccaugc

SEQ ID NO: 1323152 - RNA, 20 nt, Human
ggccccgaaaaagcugcagg

SEQ ID NO: 1323153 - RNA, 20 nt, Human
ggcucucaggcgccgccggu

SEQ ID NO: 1323154 - RNA, 18 nt, Human
guaggccuucuccaggag

SEQ ID NO: 1323155 - RNA, 19 nt, Human
gucauccuccucaucaggc

SEQ ID NO: 1323156 - RNA, 19 nt, Human
gucccuuuaccaggccccu

SEQ ID NO: 1323157 - RNA, 19 nt, Human
uaagugaggcccuuggcuc

SEQ ID NO: 1323158 - RNA, 21 nt, Human
uccgaccccagccuccucauc

SEQ ID NO: 1323159 - RNA, 19 nt, Human
uccgcagccgcagcagccg

SEQ ID NO: 1323160 - RNA, 20 nt, Human
uccgcagccgcagcagccgc

SEQ ID NO: 1323161 - RNA, 21 nt, Human
uccgcagccgcagcagccgca

SEQ ID NO: 1323162 - RNA, 22 nt, Human
uccucauccucgucauccuccu

SEQ ID NO: 1323163 - RNA, 24 nt, Human
uccucauccucgucauccuccuca

SEQ ID NO: 1323164 - RNA, 26 nt, Human
uccuuggccagggcauggcgcagggc

SEQ ID NO: 1323165 - RNA, 18 nt, Human
ucucagauagagcaccuc

SEQ ID NO: 1323166 - RNA, 18 nt, Human
ugagguaagugaggcccu

SEQ ID NO: 1323167 - RNA, 23 nt, Human
ugcaggcgcccggcuccgacccc

SEQ ID NO: 1323168 - RNA, 23 nt, Human
ugcccgaauugccucauagcucu

SEQ ID NO: 1323169 - RNA, 20 nt, Human
uggcgcagggcagagaacag

SEQ ID NO: 1323170 - RNA, 21 nt, Human
uggcgcccacgagggacuccu

SEQ ID NO: 1323171 - RNA, 22 nt, Human
uggguggugggggauuccaggc

SEQ ID NO: 1323172 - RNA, 24 nt, Human
uggugggggauuccaggccucagc

SEQ ID NO: 1323173 - RNA, 18 nt, Human
ugucccuuuaccaggccc

SEQ ID NO: 1323174 - RNA, 25 nt, Human
uuccucauccucgucauccuccuca

SEQ ID NO: 1323175 - RNA, 21 nt, Human
agaguguggccggcuuccucc

SEQ ID NO: 1323176 - RNA, 20 nt, Human
agcugcaguggccagacugu

SEQ ID NO: 1323177 - RNA, 23 nt, Human
aggaaauggggaggcagccagga

SEQ ID NO: 1323178 - RNA, 22 nt, Human
aggcagccaggaggcugggaaa

SEQ ID NO: 1323179 - RNA, 24 nt, Human
aggcagccaggaggcugggaaagc

SEQ ID NO: 1323180 - RNA, 23 nt, Human
agggcuccuggugccugguucag

SEQ ID NO: 1323181 - RNA, 20 nt, Human
aucaccagugugggaggaaa

SEQ ID NO: 1323182 - RNA, 21 nt, Human
caagacaggaugaagggcagg

SEQ ID NO: 1323183 - RNA, 23 nt, Human
cagacgccaagacaggaugaagg

SEQ ID NO: 1323184 - RNA, 20 nt, Human
cagacucuaggcucaauccu

SEQ ID NO: 1323185 - RNA, 18 nt, Human
caggaaagucccuagaaa

SEQ ID NO: 1323186 - RNA, 23 nt, Human
ccccguguugccacaccugagcc

SEQ ID NO: 1323187 - RNA, 27 nt, Human
cgaggacacaaagcugguuugcggagg

SEQ ID NO: 1323188 - RNA, 22 nt, Human
cgcgaggcagacgccaagacag

SEQ ID NO: 1323189 - RNA, 19 nt, Human
cggagggcuggccuggggc

SEQ ID NO: 1323190 - RNA, 21 nt, Human
cucuagauaggauuccgagaa

SEQ ID NO: 1323191 - RNA, 20 nt, Human
gacaggaugaagggcaggag

SEQ ID NO: 1323192 - RNA, 21 nt, Human
gagaagugcuauuagccaugc

SEQ ID NO: 1323193 - RNA, 19 nt, Human
gaggaaauggggaggcagc

SEQ ID NO: 1323194 - RNA, 21 nt, Human
gaggcugaauguucuuggaga

SEQ ID NO: 1323195 - RNA, 22 nt, Human
gccggcuuccuccucucuccag

SEQ ID NO: 1323196 - RNA, 22 nt, Human
gccuggggcgcagggcuccugg

SEQ ID NO: 1323197 - RNA, 18 nt, Human
ggagaguguggccggcuu

SEQ ID NO: 1323198 - RNA, 23 nt, Human
guucagaggcggucacuaggcac

SEQ ID NO: 1323199 - RNA, 18 nt, Human
ucuccagacagcaagacc

SEQ ID NO: 1323200 - RNA, 23 nt, Human
uggagaguguggccggcuuccuc

SEQ ID NO: 1323201 - RNA, 21 nt, Human
uggccuggggcgcagggcucc

SEQ ID NO: 1323202 - RNA, 25 nt, Human
uggccuggggcgcagggcuccuggc

SEQ ID NO: 1323203 - RNA, 20 nt, Human
ugggaggaaauggggaggca

SEQ ID NO: 1323204 - RNA, 22 nt, Human
ugggaggaaauggggaggcagc

SEQ ID NO: 1323205 - RNA, 19 nt, Human
uucagagccuuucaacccc

SEQ ID NO: 1323206 - RNA, 21 nt, Human
uugccacaccugagccagugc

SEQ ID NO: 1323207 - RNA, 19 nt, Human
cagcuccucuggcgugcuc

SEQ ID NO: 1323208 - RNA, 22 nt, Human
cagcuccucuggcgugcucgug

SEQ ID NO: 1323209 - RNA, 19 nt, Human
ggcugcggcaccgcccucg

SEQ ID NO: 1323210 - RNA, 24 nt, Human
ggcugcgggaguuacugggggagg

SEQ ID NO: 1323211 - RNA, 20 nt, Human
guggcgcugcugcuguggcc

SEQ ID NO: 1323212 - RNA, 18 nt, Human
ucguggcgcugcugcugu

SEQ ID NO: 1323213 - RNA, 18 nt, Human
ugcugcuguggccggcca

SEQ ID NO: 1323214 - RNA, 18 nt, Human
ugcuguggccggccaggu

SEQ ID NO: 1323215 - RNA, 22 nt, Human
ccgccuccuggcagccgggcuu

SEQ ID NO: 1323216 - RNA, 24 nt, Human
ccuccuggcagccgggcuuggcuc

SEQ ID NO: 1323217 - RNA, 18 nt, Human
cggccucuggagaccccc

SEQ ID NO: 1323218 - RNA, 21 nt, Human
uggagacccccaccggcgcug

SEQ ID NO: 1323219 - RNA, 18 nt, Human
ugggccgccuccuggcag

SEQ ID NO: 1323220 - RNA, 18 nt, Human
cccggccugggugcgggg

SEQ ID NO: 1323221 - RNA, 20 nt, Human
guguguggggggacuccugg

SEQ ID NO: 1323222 - RNA, 18 nt, Human
ucuuuuuuuuuuuuuuuu

SEQ ID NO: 1323223 - RNA, 22 nt, Human
ucuuuuuuuuuuuuuuuuuucu

SEQ ID NO: 1323224 - RNA, 18 nt, Human
uguggggggacuccuggg

SEQ ID NO: 1323225 - RNA, 25 nt, Human
uuauuaaaaaaguguaaaaugggaa

SEQ ID NO: 1323226 - RNA, 27 nt, Human
uucuuuuucuuuuuuuuuuuuuuuuuu

SEQ ID NO: 1323227 - RNA, 27 nt, Human
uuucuuuuucuuuuuuuuuuuuuuuuu

SEQ ID NO: 1323228 - RNA, 27 nt, Human
uuuucuuuuucuuuuuuuuuuuuuuuu

SEQ ID NO: 1323229 - RNA, 25 nt, Human
uuuuucuuuuucuuuuucuuuuuuu

SEQ ID NO: 1323230 - RNA, 27 nt, Human
uuuuucuuuuucuuuuuuuuuuuuuuu

SEQ ID NO: 1323231 - RNA, 20 nt, Human
agagcucauguucucaccac

SEQ ID NO: 1323232 - RNA, 24 nt, Human
augcaaguuuauacuuaaaguuca

SEQ ID NO: 1323233 - RNA, 19 nt, Human
cacacagcuggugaaugac

SEQ ID NO: 1323234 - RNA, 21 nt, Human
cagagcucauguucucaccac

SEQ ID NO: 1323235 - RNA, 18 nt, Human
cagggagggacugagggg

SEQ ID NO: 1323236 - RNA, 18 nt, Human
cagguccccauuuuggcu

SEQ ID NO: 1323237 - RNA, 24 nt, Human
caugaaccuuaugaguugaugcca

SEQ ID NO: 1323238 - RNA, 21 nt, Human
cgcucccaaguccagacuccc

SEQ ID NO: 1323239 - RNA, 22 nt, Human
cuagcucaguccucaugaaccu

SEQ ID NO: 1323240 - RNA, 28 nt, Human
cucaccacuaagccuccacugucucaga

SEQ ID NO: 1323241 - RNA, 22 nt, Human
gcucgggugagaguucacgcuc

SEQ ID NO: 1323242 - RNA, 18 nt, Human
gggcugggcgggcuccag

SEQ ID NO: 1323243 - RNA, 20 nt, Human
gggcugggcgggcuccaguu

SEQ ID NO: 1323244 - RNA, 26 nt, Human
gggcugggcgggcuccaguuguaagg

SEQ ID NO: 1323245 - RNA, 22 nt, Human
gggcuucagggagggacugagg

SEQ ID NO: 1323246 - RNA, 19 nt, Human
ggggcugggcgggcuccag

SEQ ID NO: 1323247 - RNA, 20 nt, Human
uaaaguucagcagccuuugg

SEQ ID NO: 1323248 - RNA, 20 nt, Human
ucagcagccuuuggucuugg

SEQ ID NO: 1323249 - RNA, 27 nt, Human
ugacagguccccauuuuggcuuuuaug

SEQ ID NO: 1323250 - RNA, 22 nt, Human
uuccugagccaagccauaguuu

SEQ ID NO: 1323251 - RNA, 24 nt, Human
uuggcuaaaacauuuuugacaggu

SEQ ID NO: 1323252 - RNA, 19 nt, Human
uuggucuuggcaucuuccu

SEQ ID NO: 1323253 - RNA, 18 nt, Human
ccuugaaauccugacggg

SEQ ID NO: 1323254 - RNA, 20 nt, Human
cugcuuccuggauccuccug

SEQ ID NO: 1323255 - RNA, 19 nt, Human
ggauccuccugugagccac

SEQ ID NO: 1323256 - RNA, 20 nt, Human
ggucaauauuugcugcuucc

SEQ ID NO: 1323257 - RNA, 22 nt, Human
uggauccuccugugagccacug

SEQ ID NO: 1323258 - RNA, 22 nt, Human
ugugagccacugauccauuuuu

SEQ ID NO: 1323259 - RNA, 26 nt, Human
agcccccagcuuuccguggcuauugg

SEQ ID NO: 1323260 - RNA, 19 nt, Human
augggucuuaggccuguga

SEQ ID NO: 1323261 - RNA, 20 nt, Human
cagagcuccagccaggccgc

SEQ ID NO: 1323262 - RNA, 18 nt, Human
cagcacggccccucccuu

SEQ ID NO: 1323263 - RNA, 19 nt, Human
ccagcccccagcuuuccgu

SEQ ID NO: 1323264 - RNA, 19 nt, Human
ccccagagcuccagccagg

SEQ ID NO: 1323265 - RNA, 22 nt, Human
ccccagagcuccagccaggccg

SEQ ID NO: 1323266 - RNA, 22 nt, Human
ccccagauccccgggagagguc

SEQ ID NO: 1323267 - RNA, 18 nt, Human
cccccagauccccgggag

SEQ ID NO: 1323268 - RNA, 19 nt, Human
ccccgggaaggaguggguc

SEQ ID NO: 1323269 - RNA, 19 nt, Human
cccucgggacugucccucc

SEQ ID NO: 1323270 - RNA, 19 nt, Human
cccuggauccugaggcgcc

SEQ ID NO: 1323271 - RNA, 18 nt, Human
ccucgggacugucccucc

SEQ ID NO: 1323272 - RNA, 21 nt, Human
cgaauguagacggugaggcca

SEQ ID NO: 1323273 - RNA, 20 nt, Human
cgcggaugcugacgccgggc

SEQ ID NO: 1323274 - RNA, 23 nt, Human
cgggaaggagugggucugggucc

SEQ ID NO: 1323275 - RNA, 21 nt, Human
cugcugcccucgggacugucc

SEQ ID NO: 1323276 - RNA, 22 nt, Human
cugcugcccucgggacuguccc

SEQ ID NO: 1323277 - RNA, 18 nt, Human
gagggaccccagagcucc

SEQ ID NO: 1323278 - RNA, 25 nt, Human
gcccccagcuuuccguggcuauugg

SEQ ID NO: 1323279 - RNA, 18 nt, Human
ggaauaacuagguggaca

SEQ ID NO: 1323280 - RNA, 22 nt, Human
gggaaggagugggucugggucc

SEQ ID NO: 1323281 - RNA, 21 nt, Human
gggacugucccuccagccccc

SEQ ID NO: 1323282 - RNA, 24 nt, Human
gggugucacagagaccgaugcggg

SEQ ID NO: 1323283 - RNA, 23 nt, Human
uaacuagguggacaaaggccaaa

SEQ ID NO: 1323284 - RNA, 21 nt, Human
ucaugggucuuaggccuguga

SEQ ID NO: 1323285 - RNA, 23 nt, Human
ucccuugggugucacagagacug

SEQ ID NO: 1323286 - RNA, 20 nt, Human
uccgcaggauccccucgcgg

SEQ ID NO: 1323287 - RNA, 23 nt, Human
uccguggcuauugggcccccucu

SEQ ID NO: 1323288 - RNA, 19 nt, Human
ugaggccaaggacgcccug

SEQ ID NO: 1323289 - RNA, 21 nt, Human
ugauccucgcccccagauccc

SEQ ID NO: 1323290 - RNA, 19 nt, Human
ugggcccccucugcagagg

SEQ ID NO: 1323291 - RNA, 18 nt, Human
uggguccaguccgcagga

SEQ ID NO: 1323292 - RNA, 21 nt, Human
uguagacggugaggccaagga

SEQ ID NO: 1323293 - RNA, 18 nt, Human
uugggcccccucugcaga

SEQ ID NO: 1323294 - RNA, 20 nt, Human
uugggcccccucugcagagg

SEQ ID NO: 1323295 - RNA, 25 nt, Human
aaaaaaaggaaaaaugccccaagaa

SEQ ID NO: 1323296 - RNA, 23 nt, Human
aaaaaggaaaaaugccccaagaa

SEQ ID NO: 1323297 - RNA, 18 nt, Human
aaaaucucccgggaccac

SEQ ID NO: 1323298 - RNA, 19 nt, Human
aaccccccccuccgcccuc

SEQ ID NO: 1323299 - RNA, 19 nt, Human
aaccuggucgaugggcaga

SEQ ID NO: 1323300 - RNA, 21 nt, Human
aaccuggucgaugggcagacc

SEQ ID NO: 1323301 - RNA, 18 nt, Human
aacuccuuccucacucug

SEQ ID NO: 1323302 - RNA, 27 nt, Human
aagcguuacaagguuaaagacaaaacc

SEQ ID NO: 1323303 - RNA, 24 nt, Human
acaagguuaaagacaaaacccaag

SEQ ID NO: 1323304 - RNA, 24 nt, Human
acacaccugcuagccccuuccccu

SEQ ID NO: 1323305 - RNA, 28 nt, Human
accacuuccuaccccagaacuccccccg

SEQ ID NO: 1323306 - RNA, 21 nt, Human
accaugaaaacauuggagaau

SEQ ID NO: 1323307 - RNA, 19 nt, Human
acccagaagccucaggccu

SEQ ID NO: 1323308 - RNA, 27 nt, Human
accccagaacuccccccgcccagcccc

SEQ ID NO: 1323309 - RNA, 21 nt, Human
accccuccaaccgccagacuu

SEQ ID NO: 1323310 - RNA, 24 nt, Human
acccgccugaccucccuacucccc

SEQ ID NO: 1323311 - RNA, 24 nt, Human
acgcugcgggggccguggggacag

SEQ ID NO: 1323312 - RNA, 21 nt, Human
acgugguggucuccaggcugg

SEQ ID NO: 1323313 - RNA, 25 nt, Human
acucaggccgcaccaucugagcccc

SEQ ID NO: 1323314 - RNA, 20 nt, Human
acuccccccgcccagccccc

SEQ ID NO: 1323315 - RNA, 19 nt, Human
acugaagacauuggggacc

SEQ ID NO: 1323316 - RNA, 18 nt, Human
agaacuccccccgcccag

SEQ ID NO: 1323317 - RNA, 21 nt, Human
agaacuccccccgcccagccc

SEQ ID NO: 1323318 - RNA, 18 nt, Human
agacccugcccaaccccc

SEQ ID NO: 1323319 - RNA, 22 nt, Human
agcaacagggacagaugaaaaa

SEQ ID NO: 1323320 - RNA, 24 nt, Human
agcguuaaaggaguugaguugagu

SEQ ID NO: 1323321 - RNA, 26 nt, Human
aggaggcuccacccucaacucaaccc

SEQ ID NO: 1323322 - RNA, 20 nt, Human
aggagggguaaaaaaaaaaa

SEQ ID NO: 1323323 - RNA, 19 nt, Human
aggcacaggugacauucag

SEQ ID NO: 1323324 - RNA, 19 nt, Human
aggcagggugcugaggggc

SEQ ID NO: 1323325 - RNA, 20 nt, Human
aggcagggugcugaggggcg

SEQ ID NO: 1323326 - RNA, 19 nt, Human
aggcgccaaggaggccagc

SEQ ID NO: 1323327 - RNA, 21 nt, Human
aggcggccacccugccccagc

SEQ ID NO: 1323328 - RNA, 25 nt, Human
agggguaaaaaaaaaacaaaaaaaa

SEQ ID NO: 1323329 - RNA, 18 nt, Human
augaaauuuggggguucc

SEQ ID NO: 1323330 - RNA, 23 nt, Human
auggaacccucuguuuacacacc

SEQ ID NO: 1323331 - RNA, 25 nt, Human
augggauuuugccggaaauauuagg

SEQ ID NO: 1323332 - RNA, 18 nt, Human
caacccaagcaacaggga

SEQ ID NO: 1323333 - RNA, 20 nt, Human
caacucaacccaagcaacag

SEQ ID NO: 1323334 - RNA, 20 nt, Human
caagaaacaaagagggggaa

SEQ ID NO: 1323335 - RNA, 22 nt, Human
caagcaacagggacagaugaaa

SEQ ID NO: 1323336 - RNA, 21 nt, Human
cacacucaggccgcaccaucu

SEQ ID NO: 1323337 - RNA, 21 nt, Human
caccaggacccagaagccuca

SEQ ID NO: 1323338 - RNA, 18 nt, Human
caccccaccuugccccca

SEQ ID NO: 1323339 - RNA, 25 nt, Human
caccugaggagacccugcccaaccu

SEQ ID NO: 1323340 - RNA, 22 nt, Human
cacugccccccacccaccccuc

SEQ ID NO: 1323341 - RNA, 24 nt, Human
cagaacuccccccgcccagccccc

SEQ ID NO: 1323342 - RNA, 20 nt, Human
cagacagggccgaggggcag

SEQ ID NO: 1323343 - RNA, 24 nt, Human
cagccaggagcccccuccuguggc

SEQ ID NO: 1323344 - RNA, 18 nt, Human
cagcccccacugcccccc

SEQ ID NO: 1323345 - RNA, 22 nt, Human
cagcccccacugccccccaccc

SEQ ID NO: 1323346 - RNA, 21 nt, Human
caggccgcaccaucugagccc

SEQ ID NO: 1323347 - RNA, 20 nt, Human
caggugauggcagaggaggg

SEQ ID NO: 1323348 - RNA, 21 nt, Human
caguggccuucuccacucccc

SEQ ID NO: 1323349 - RNA, 21 nt, Human
ccaacacacaguaaguaaggu

SEQ ID NO: 1323350 - RNA, 22 nt, Human
ccaagcaacagggacagaugaa

SEQ ID NO: 1323351 - RNA, 20 nt, Human
ccaccccuccaaccgccaga

SEQ ID NO: 1323352 - RNA, 18 nt, Human
ccacugccccccacccac

SEQ ID NO: 1323353 - RNA, 20 nt, Human
ccacugccccccacccaccc

SEQ ID NO: 1323354 - RNA, 24 nt, Human
ccacugccccccacccaccccucc

SEQ ID NO: 1323355 - RNA, 18 nt, Human
ccagaacuccccccgccc

SEQ ID NO: 1323356 - RNA, 21 nt, Human
cccaagagggggccccccacu

SEQ ID NO: 1323357 - RNA, 22 nt, Human
cccacccaccccuccaaccgcc

SEQ ID NO: 1323358 - RNA, 19 nt, Human
cccagaagccucaggccuc

SEQ ID NO: 1323359 - RNA, 20 nt, Human
cccagaagccucaggccucu

SEQ ID NO: 1323360 - RNA, 26 nt, Human
cccagcccccacugccccccacccac

SEQ ID NO: 1323361 - RNA, 21 nt, Human
ccccaagaggucccacagaag

SEQ ID NO: 1323362 - RNA, 19 nt, Human
ccccacccaccccuccaac

SEQ ID NO: 1323363 - RNA, 24 nt, Human
ccccacccaccccuccaaccgcca

SEQ ID NO: 1323364 - RNA, 19 nt, Human
ccccagaacuccccccgcc

SEQ ID NO: 1323365 - RNA, 20 nt, Human
ccccagaagccaggccggac

SEQ ID NO: 1323366 - RNA, 22 nt, Human
cccccacccaccccuccaaccc

SEQ ID NO: 1323367 - RNA, 22 nt, Human
cccccacugccccccacccacc

SEQ ID NO: 1323368 - RNA, 24 nt, Human
cccccacugccccccacccacccc

SEQ ID NO: 1323369 - RNA, 26 nt, Human
cccccacugccccccacccaccccuc

SEQ ID NO: 1323370 - RNA, 26 nt, Human
cccccaggaggcuccacccucaacuc

SEQ ID NO: 1323371 - RNA, 25 nt, Human
ccccccacccaccccuccaaccgcc

SEQ ID NO: 1323372 - RNA, 21 nt, Human
ccccccaggaggcuccacccu

SEQ ID NO: 1323373 - RNA, 19 nt, Human
ccccccgcccagcccccac

SEQ ID NO: 1323374 - RNA, 20 nt, Human
ccccgcccacccuacggggg

SEQ ID NO: 1323375 - RNA, 26 nt, Human
ccccuguuacaugggggggggguuua

SEQ ID NO: 1323376 - RNA, 24 nt, Human
cccgggaccacuuccuaccccaga

SEQ ID NO: 1323377 - RNA, 21 nt, Human
cccgucaccaggacccagaag

SEQ ID NO: 1323378 - RNA, 22 nt, Human
cccgucaccaggacccagaagc

SEQ ID NO: 1323379 - RNA, 20 nt, Human
cccugcccaaccccccccuc

SEQ ID NO: 1323380 - RNA, 20 nt, Human
cccugccccagccugaugga

SEQ ID NO: 1323381 - RNA, 22 nt, Human
ccggccagccucaggccagcca

SEQ ID NO: 1323382 - RNA, 26 nt, Human
ccuacggguguaucccaaaugccgcc

SEQ ID NO: 1323383 - RNA, 22 nt, Human
ccucaggacuucuggggaccag

SEQ ID NO: 1323384 - RNA, 22 nt, Human
ccucaggccagccaggagcccc

SEQ ID NO: 1323385 - RNA, 22 nt, Human
ccucccagaggccgagucccug

SEQ ID NO: 1323386 - RNA, 21 nt, Human
ccuccuggagacaaggcaggg

SEQ ID NO: 1323387 - RNA, 19 nt, Human
ccugaccucccuacucccc

SEQ ID NO: 1323388 - RNA, 25 nt, Human
ccugaggagacccugcccaaccccc

SEQ ID NO: 1323389 - RNA, 22 nt, Human
ccugcccaaccccccccuccgc

SEQ ID NO: 1323390 - RNA, 24 nt, Human
ccugcccaaccccccccuccgccc

SEQ ID NO: 1323391 - RNA, 23 nt, Human
ccuuccccuccggccagccucag

SEQ ID NO: 1323392 - RNA, 25 nt, Human
cgccggccgcacacucaggccgcac

SEQ ID NO: 1323393 - RNA, 29 nt, Human
cgggaaugggugggguaugggggacugcc

SEQ ID NO: 1323394 - RNA, 19 nt, Human
cggggggcaggacguggug

SEQ ID NO: 1323395 - RNA, 23 nt, Human
cucacaagggcaucucugucaug

SEQ ID NO: 1323396 - RNA, 19 nt, Human
cucaccccaccuugccccc

SEQ ID NO: 1323397 - RNA, 18 nt, Human
cuccccccgcccagcccc

SEQ ID NO: 1323398 - RNA, 22 nt, Human
cuccccccgcccagcccccacu

SEQ ID NO: 1323399 - RNA, 25 nt, Human
cucccgggaccacuuccuaccccag

SEQ ID NO: 1323400 - RNA, 28 nt, Human
cugcccaaccccccccuccgcccucagg

SEQ ID NO: 1323401 - RNA, 19 nt, Human
cugccccccacccaccccu

SEQ ID NO: 1323402 - RNA, 22 nt, Human
cugcuauggcaucaccagaccc

SEQ ID NO: 1323403 - RNA, 21 nt, Human
cuuccuaccccagaacucccc

SEQ ID NO: 1323404 - RNA, 18 nt, Human
gacccagaagccucaggc

SEQ ID NO: 1323405 - RNA, 18 nt, Human
gacccgccugaccucccu

SEQ ID NO: 1323406 - RNA, 18 nt, Human
gagacccugcccaacccc

SEQ ID NO: 1323407 - RNA, 19 nt, Human
gagaggggaggguuccuca

SEQ ID NO: 1323408 - RNA, 18 nt, Human
gagcaucguggcucacgc

SEQ ID NO: 1323409 - RNA, 18 nt, Human
gaggccagccucacaagg

SEQ ID NO: 1323410 - RNA, 22 nt, Human
gagggguaaaaaaaaaacaaaa

SEQ ID NO: 1323411 - RNA, 24 nt, Human
gaugggcagaccuggcagcucucc

SEQ ID NO: 1323412 - RNA, 19 nt, Human
gccaaacuccuuccucacu

SEQ ID NO: 1323413 - RNA, 21 nt, Human
gccaaacuccuuccucacucu

SEQ ID NO: 1323414 - RNA, 19 nt, Human
gccagccucaggccagccg

SEQ ID NO: 1323415 - RNA, 21 nt, Human
gcccaaccccccccuccgccc

SEQ ID NO: 1323416 - RNA, 19 nt, Human
gccccccacccaccccucc

SEQ ID NO: 1323417 - RNA, 20 nt, Human
gccccccacccaccccucca

SEQ ID NO: 1323418 - RNA, 21 nt, Human
gcccucaggacuucuggggac

SEQ ID NO: 1323419 - RNA, 24 nt, Human
gccgcaagguggaccgaggcggca

SEQ ID NO: 1323420 - RNA, 19 nt, Human
gccgccggccgcacacuca

SEQ ID NO: 1323421 - RNA, 19 nt, Human
ggaaaaaugccccaagaaa

SEQ ID NO: 1323422 - RNA, 21 nt, Human
ggaaaaaugccccaagaaaca

SEQ ID NO: 1323423 - RNA, 19 nt, Human
ggagacccugcccaacccc

SEQ ID NO: 1323424 - RNA, 21 nt, Human
ggagcccccuccuguggccuu

SEQ ID NO: 1323425 - RNA, 18 nt, Human
ggcagggugcugaggggc

SEQ ID NO: 1323426 - RNA, 21 nt, Human
ggccgagucccugccgcagcc

SEQ ID NO: 1323427 - RNA, 20 nt, Human
ggcgauaaauggcggggggc

SEQ ID NO: 1323428 - RNA, 18 nt, Human
gggaaugggugggguaug

SEQ ID NO: 1323429 - RNA, 23 nt, Human
gggcgauaaauggcggggggcag

SEQ ID NO: 1323430 - RNA, 21 nt, Human
gggcucaguggccagugcccc

SEQ ID NO: 1323431 - RNA, 24 nt, Human
gggcugcgugcaggggggcugagc

SEQ ID NO: 1323432 - RNA, 20 nt, Human
gggggccguggggacaggcg

SEQ ID NO: 1323433 - RNA, 22 nt, Human
ggggggguccccaagaucuucc

SEQ ID NO: 1323434 - RNA, 19 nt, Human
gggguauggggagcaucgu

SEQ ID NO: 1323435 - RNA, 20 nt, Human
guggccuccgagcacccucc

SEQ ID NO: 1323436 - RNA, 18 nt, Human
guggccuucuccacuccc

SEQ ID NO: 1323437 - RNA, 22 nt, Human
guggccuucuccacuccccucu

SEQ ID NO: 1323438 - RNA, 20 nt, Human
uaccccagaacuccccccgc

SEQ ID NO: 1323439 - RNA, 19 nt, Human
uauggcaucaccagacccc

SEQ ID NO: 1323440 - RNA, 24 nt, Human
ucacgcugcgggggccguggggac

SEQ ID NO: 1323441 - RNA, 18 nt, Human
ucaggccucuagacugcu

SEQ ID NO: 1323442 - RNA, 21 nt, Human
ucagugcacggcccccgagga

SEQ ID NO: 1323443 - RNA, 20 nt, Human
uccaaaaucucccgggacca

SEQ ID NO: 1323444 - RNA, 24 nt, Human
uccaaaaucucccgggaccacuuc

SEQ ID NO: 1323445 - RNA, 21 nt, Human
uccaagggggcucaguggcca

SEQ ID NO: 1323446 - RNA, 18 nt, Human
ucccaaaugccgccggcc

SEQ ID NO: 1323447 - RNA, 22 nt, Human
ucccagaggccgagucccugcc

SEQ ID NO: 1323448 - RNA, 20 nt, Human
uccccaagaucuuccuucca

SEQ ID NO: 1323449 - RNA, 22 nt, Human
uccccgcaucagugcacggccc

SEQ ID NO: 1323450 - RNA, 23 nt, Human
ucccuacuccccggccucacccc

SEQ ID NO: 1323451 - RNA, 28 nt, Human
uccugacaccugaggagacccugcccaa

SEQ ID NO: 1323452 - RNA, 20 nt, Human
uccuuccucacucuggcugg

SEQ ID NO: 1323453 - RNA, 22 nt, Human
ugacuuuuccauccaaaaucuc

SEQ ID NO: 1323454 - RNA, 20 nt, Human
ugagcugggggcacaagugg

SEQ ID NO: 1323455 - RNA, 22 nt, Human
ugagcugggggcacaagugggg

SEQ ID NO: 1323456 - RNA, 24 nt, Human
ugagcugggggcacaagugggggc

SEQ ID NO: 1323457 - RNA, 19 nt, Human
ugauggcagaggaggggac

SEQ ID NO: 1323458 - RNA, 20 nt, Human
ugauggcagaggaggggacc

SEQ ID NO: 1323459 - RNA, 23 nt, Human
ugcaggggggcugagcugggggc

SEQ ID NO: 1323460 - RNA, 21 nt, Human
ugccccaagaaacaaagaggg

SEQ ID NO: 1323461 - RNA, 19 nt, Human
ugccccagccugauggaac

SEQ ID NO: 1323462 - RNA, 26 nt, Human
ugccgcagcccuaggcgccgcggugg

SEQ ID NO: 1323463 - RNA, 20 nt, Human
uggccuccgagcacccuccu

SEQ ID NO: 1323464 - RNA, 19 nt, Human
uggcggggggcaggacgug

SEQ ID NO: 1323465 - RNA, 22 nt, Human
ugggauuuugccggaaauauua

SEQ ID NO: 1323466 - RNA, 21 nt, Human
ugggggcacaagugggggcga

SEQ ID NO: 1323467 - RNA, 18 nt, Human
ugggggguccccaggaga

SEQ ID NO: 1323468 - RNA, 25 nt, Human
uuggagaaucuuagcgggacuuugg

SEQ ID NO: 1323469 - RNA, 24 nt, Human
uugucacugccccccuguuacaug

SEQ ID NO: 1323470 - RNA, 19 nt, Human
uuuacacaccugcuagccc

SEQ ID NO: 1323471 - RNA, 20 nt, Human
uuuccauccaaaaucucccg

SEQ ID NO: 1323472 - RNA, 19 nt, Human
uuugucacugccccccugu

SEQ ID NO: 1323473 - RNA, 24 nt, Human
aagcuuguuuuccugcaacuggau

SEQ ID NO: 1323474 - RNA, 19 nt, Human
aaugagccaugauaggacc

SEQ ID NO: 1323475 - RNA, 21 nt, Human
acaacagagggagacccugaa

SEQ ID NO: 1323476 - RNA, 25 nt, Human
accacaaauggaagaagggccauga

SEQ ID NO: 1323477 - RNA, 18 nt, Human
acuacacuccagccuugg

SEQ ID NO: 1323478 - RNA, 18 nt, Human
acuacacuccagccuugg

SEQ ID NO: 1323479 - RNA, 19 nt, Human
acuacacuccagccuugga

SEQ ID NO: 1323480 - RNA, 25 nt, Human
acuacacuccagccuuggacaacag

SEQ ID NO: 1323481 - RNA, 19 nt, Human
acuacacuccagccuuggg

SEQ ID NO: 1323482 - RNA, 21 nt, Human
acuggauugugagggccagag

SEQ ID NO: 1323483 - RNA, 23 nt, Human
agaaguugggcaaaaggcugauu

SEQ ID NO: 1323484 - RNA, 26 nt, Human
agacagaaguugggcaaaagggaccc

SEQ ID NO: 1323485 - RNA, 21 nt, Human
agaccgcccagcuccaggcac

SEQ ID NO: 1323486 - RNA, 24 nt, Human
agcaccuguagucucagccacgug

SEQ ID NO: 1323487 - RNA, 19 nt, Human
aggcacuaggccuggaaau

SEQ ID NO: 1323488 - RNA, 22 nt, Human
aggcaggagcuucaccugagga

SEQ ID NO: 1323489 - RNA, 25 nt, Human
aggcaggagcuucaccugaggaugc

SEQ ID NO: 1323490 - RNA, 19 nt, Human
aggcaggaggagcugggcc

SEQ ID NO: 1323491 - RNA, 21 nt, Human
aggcaggaggagcugggccug

SEQ ID NO: 1323492 - RNA, 20 nt, Human
agguugagaugggaggaucg

SEQ ID NO: 1323493 - RNA, 24 nt, Human
aguggcaagcaccuguagucucag

SEQ ID NO: 1323494 - RNA, 19 nt, Human
aucugggucuggagggucc

SEQ ID NO: 1323495 - RNA, 18 nt, Human
caacagagggagacccug

SEQ ID NO: 1323496 - RNA, 18 nt, Human
caacuggauggucccacg

SEQ ID NO: 1323497 - RNA, 23 nt, Human
caccuguagucucagccacgugg

SEQ ID NO: 1323498 - RNA, 24 nt, Human
caccuguagucucagccacguggg

SEQ ID NO: 1323499 - RNA, 21 nt, Human
cacuaggccuggaaauggccu

SEQ ID NO: 1323500 - RNA, 23 nt, Human
cagaagucuuucaugguaggucc

SEQ ID NO: 1323501 - RNA, 23 nt, Human
cagccuuggacaacagagggaga

SEQ ID NO: 1323502 - RNA, 22 nt, Human
cagcuguagucccagcuacugg

SEQ ID NO: 1323503 - RNA, 23 nt, Human
cagcuguagucccagcuacuggg

SEQ ID NO: 1323504 - RNA, 24 nt, Human
cagucagucucucuuccuggauuc

SEQ ID NO: 1323505 - RNA, 24 nt, Human
cagucaguuucucuuccuggauuc

SEQ ID NO: 1323506 - RNA, 24 nt, Human
cagugggcguguuaagcuuguuuu

SEQ ID NO: 1323507 - RNA, 19 nt, Human
ccacugaacuccauccuga

SEQ ID NO: 1323508 - RNA, 18 nt, Human
ccacugugaggcagaggc

SEQ ID NO: 1323509 - RNA, 19 nt, Human
ccagcacugggaaacuagg

SEQ ID NO: 1323510 - RNA, 21 nt, Human
cccagugacguaggcgaacac

SEQ ID NO: 1323511 - RNA, 21 nt, Human
cccucauuuuccguuccccag

SEQ ID NO: 1323512 - RNA, 24 nt, Human
ccuggcaugaggcgugcccagagg

SEQ ID NO: 1323513 - RNA, 22 nt, Human
cgagaagaccgcccagcuccag

SEQ ID NO: 1323514 - RNA, 19 nt, Human
cgcaagaaccacaaaugga

SEQ ID NO: 1323515 - RNA, 21 nt, Human
cggcaacacacaggaccuggc

SEQ ID NO: 1323516 - RNA, 22 nt, Human
cuacuacacuccagccuuggac

SEQ ID NO: 1323517 - RNA, 19 nt, Human
cucaagggaaucuucagcu

SEQ ID NO: 1323518 - RNA, 18 nt, Human
cucguuggucuuugucuc

SEQ ID NO: 1323519 - RNA, 23 nt, Human
cuggaagguugaggcugcaguca

SEQ ID NO: 1323520 - RNA, 21 nt, Human
cuggcaugaggcgugcccaga

SEQ ID NO: 1323521 - RNA, 19 nt, Human
gaauccacguauacaaaaa

SEQ ID NO: 1323522 - RNA, 25 nt, Human
gagaagaccgcccagcuccaggcac

SEQ ID NO: 1323523 - RNA, 19 nt, Human
gaggcaggaggagcugggc

SEQ ID NO: 1323524 - RNA, 21 nt, Human
gagugacagggcaagguccug

SEQ ID NO: 1323525 - RNA, 21 nt, Human
gaguuucgucuccuccacugg

SEQ ID NO: 1323526 - RNA, 18 nt, Human
gauugcuugagccuggga

SEQ ID NO: 1323527 - RNA, 22 nt, Human
gauugcuugagccugggaguuu

SEQ ID NO: 1323528 - RNA, 24 nt, Human
gccgaaaggcaggagcuucaccug

SEQ ID NO: 1323529 - RNA, 24 nt, Human
gcuguagucccagcuacugggaag

SEQ ID NO: 1323530 - RNA, 22 nt, Human
gcugucaccccucuggaaucca

SEQ ID NO: 1323531 - RNA, 20 nt, Human
ggaaggcugacaugguagga

SEQ ID NO: 1323532 - RNA, 18 nt, Human
ggaguuugaggcuauaau

SEQ ID NO: 1323533 - RNA, 22 nt, Human
ggcauaguggcaagcaccugua

SEQ ID NO: 1323534 - RNA, 23 nt, Human
ggcgugcccagagggacagaggc

SEQ ID NO: 1323535 - RNA, 18 nt, Human
gguaggauugcuugagcc

SEQ ID NO: 1323536 - RNA, 21 nt, Human
gguggcugugguggcucguug

SEQ ID NO: 1323537 - RNA, 18 nt, Human
gugaggcagaggcuggcc

SEQ ID NO: 1323538 - RNA, 25 nt, Human
uacuacacuccagccuuggacaaca

SEQ ID NO: 1323539 - RNA, 20 nt, Human
uagcacuacuacacuccagc

SEQ ID NO: 1323540 - RNA, 18 nt, Human
uaggguuuauccaucuug

SEQ ID NO: 1323541 - RNA, 23 nt, Human
uaguggcaagcaccuguagucuc

SEQ ID NO: 1323542 - RNA, 24 nt, Human
uaguggcaagcaccuguagucuca

SEQ ID NO: 1323543 - RNA, 20 nt, Human
uaguugggcauaguggcaag

SEQ ID NO: 1323544 - RNA, 21 nt, Human
ucauuuuccguuccccagcau

SEQ ID NO: 1323545 - RNA, 27 nt, Human
uccacguauacaaaaauuccaaauauu

SEQ ID NO: 1323546 - RNA, 20 nt, Human
uccacugugaggcagaggcu

SEQ ID NO: 1323547 - RNA, 21 nt, Human
ucuuagaagguggggaauaau

SEQ ID NO: 1323548 - RNA, 23 nt, Human
ugaacucccucauuuuccguucc

SEQ ID NO: 1323549 - RNA, 21 nt, Human
ugacagggcaagguccuguuu

SEQ ID NO: 1323550 - RNA, 18 nt, Human
ugacaugguaggauugcu

SEQ ID NO: 1323551 - RNA, 22 nt, Human
ugacgagaagaccgcccagcuc

SEQ ID NO: 1323552 - RNA, 21 nt, Human
ugagaugggaggaucgcuuca

SEQ ID NO: 1323553 - RNA, 22 nt, Human
ugagccugggaguuugaggcua

SEQ ID NO: 1323554 - RNA, 25 nt, Human
ugaggaugccacagugagacaccau

SEQ ID NO: 1323555 - RNA, 21 nt, Human
ugagguccccaugccuggacu

SEQ ID NO: 1323556 - RNA, 20 nt, Human
ugcccagagggacagaggca

SEQ ID NO: 1323557 - RNA, 21 nt, Human
ugcccagucaguuucucuucc

SEQ ID NO: 1323558 - RNA, 19 nt, Human
uggaagguugaggcugcag

SEQ ID NO: 1323559 - RNA, 22 nt, Human
uggaagguugaggcugcaguca

SEQ ID NO: 1323560 - RNA, 22 nt, Human
uggcagcuuucuccaacuuugg

SEQ ID NO: 1323561 - RNA, 20 nt, Human
ugggaggcaggaggagcugg

SEQ ID NO: 1323562 - RNA, 21 nt, Human
ugggaggcaggaggagcuggg

SEQ ID NO: 1323563 - RNA, 18 nt, Human
ugggagguugagauggga

SEQ ID NO: 1323564 - RNA, 23 nt, Human
ugggagguugagaugggaggauc

SEQ ID NO: 1323565 - RNA, 21 nt, Human
ugggcaaaaggcugauuugag

SEQ ID NO: 1323566 - RNA, 26 nt, Human
ugggcaaaaggcugauuugaggaagu

SEQ ID NO: 1323567 - RNA, 22 nt, Human
uggucuuugucucuuagaaggu

SEQ ID NO: 1323568 - RNA, 21 nt, Human
uguugagguccccaugccugg

SEQ ID NO: 1323569 - RNA, 18 nt, Human
uuaguugggcauaguggc

SEQ ID NO: 1323570 - RNA, 24 nt, Human
uuccccagcauuggcggguucugg

SEQ ID NO: 1323571 - RNA, 24 nt, Human
uugcuugagccugggaguuugagg

SEQ ID NO: 1323572 - RNA, 21 nt, Human
uuuuccugcaacuggaugguc

SEQ ID NO: 1323573 - RNA, 20 nt, Human
aaaaggagcuuccauugaaa

SEQ ID NO: 1323574 - RNA, 22 nt, Human
aaaaugccacaaagcauugcaa

SEQ ID NO: 1323575 - RNA, 22 nt, Human
aagcagcugucgaggagacuuc

SEQ ID NO: 1323576 - RNA, 20 nt, Human
aagcauugcaaggccacagu

SEQ ID NO: 1323577 - RNA, 23 nt, Human
aauuccuauucccuuucauccuc

SEQ ID NO: 1323578 - RNA, 23 nt, Human
aggcaaagcagcugucgaggaga

SEQ ID NO: 1323579 - RNA, 21 nt, Human
auugcaaggccacaguggaca

SEQ ID NO: 1323580 - RNA, 20 nt, Human
caaagcagcugucgaggaga

SEQ ID NO: 1323581 - RNA, 24 nt, Human
caagugagagcagaacaucccaug

SEQ ID NO: 1323582 - RNA, 19 nt, Human
caggaagagcaugcaggca

SEQ ID NO: 1323583 - RNA, 21 nt, Human
ccaggggucccuuauucuucc

SEQ ID NO: 1323584 - RNA, 22 nt, Human
cccaggcacgugaucgcagccg

SEQ ID NO: 1323585 - RNA, 20 nt, Human
ccccugaggucucagcuccu

SEQ ID NO: 1323586 - RNA, 20 nt, Human
cccuucuucucccccguucc

SEQ ID NO: 1323587 - RNA, 19 nt, Human
ccgcggugcccuucuucuc

SEQ ID NO: 1323588 - RNA, 20 nt, Human
ccgcggugcccuucuucucc

SEQ ID NO: 1323589 - RNA, 21 nt, Human
ccucccgccgcggugcccuuc

SEQ ID NO: 1323590 - RNA, 18 nt, Human
ccugcagcguagcucgcu

SEQ ID NO: 1323591 - RNA, 20 nt, Human
cgcagccggcugguaacugc

SEQ ID NO: 1323592 - RNA, 21 nt, Human
cuccccugaggucucagcucc

SEQ ID NO: 1323593 - RNA, 21 nt, Human
cuggcuucccuguucugucuu

SEQ ID NO: 1323594 - RNA, 24 nt, Human
cuuuuucuuccccugcuggcuucc

SEQ ID NO: 1323595 - RNA, 22 nt, Human
gcgcgccccuccccugaggucu

SEQ ID NO: 1323596 - RNA, 19 nt, Human
ggcagauuuguuccaaggg

SEQ ID NO: 1323597 - RNA, 21 nt, Human
ggcuugguagggacucuccag

SEQ ID NO: 1323598 - RNA, 18 nt, Human
uaccgcgcgccccucccc

SEQ ID NO: 1323599 - RNA, 23 nt, Human
ucaagagcagcagcaucuuuuuc

SEQ ID NO: 1323600 - RNA, 23 nt, Human
uccagguccagaagcugguuuuc

SEQ ID NO: 1323601 - RNA, 18 nt, Human
uccccugcuggcuucccu

SEQ ID NO: 1323602 - RNA, 21 nt, Human
ucgcagccggcugguaacugc

SEQ ID NO: 1323603 - RNA, 22 nt, Human
ucuccagguccagaagcugguu

SEQ ID NO: 1323604 - RNA, 21 nt, Human
ugaggcaaagcagcugucgag

SEQ ID NO: 1323605 - RNA, 22 nt, Human
ugaggcaucaagagcagcagca

SEQ ID NO: 1323606 - RNA, 26 nt, Human
ugccugaggcaaagcagccggggguc

SEQ ID NO: 1323607 - RNA, 18 nt, Human
ugcuaggggacccgggac

SEQ ID NO: 1323608 - RNA, 21 nt, Human
uggcuugguagggacucucca

SEQ ID NO: 1323609 - RNA, 20 nt, Human
ugucuuguacuucuggggca

SEQ ID NO: 1323610 - RNA, 21 nt, Human
uucccuuucauccucucucca

SEQ ID NO: 1323611 - RNA, 22 nt, Human
uuccucaguaguagaggacuuu

SEQ ID NO: 1323612 - RNA, 20 nt, Human
uuucuuccccugcuggcuuc

SEQ ID NO: 1323613 - RNA, 25 nt, Human
aaaggaaugaaugaauguuggagga

SEQ ID NO: 1323614 - RNA, 23 nt, Human
acagccuuugagagcuagagucu

SEQ ID NO: 1323615 - RNA, 18 nt, Human
agaauucuuucugugcuc

SEQ ID NO: 1323616 - RNA, 21 nt, Human
agaccaaaccaggauucaaaa

SEQ ID NO: 1323617 - RNA, 22 nt, Human
agagacaaggaggaaaaaaagc

SEQ ID NO: 1323618 - RNA, 19 nt, Human
agcauuuuuucauuuccuu

SEQ ID NO: 1323619 - RNA, 23 nt, Human
aggaaaaaaagcauaauucucaa

SEQ ID NO: 1323620 - RNA, 25 nt, Human
aggagaugaauacuguugaauucaa

SEQ ID NO: 1323621 - RNA, 26 nt, Human
caaggcucugguuucacaucaggcuc

SEQ ID NO: 1323622 - RNA, 19 nt, Human
caguaauuaacauucacac

SEQ ID NO: 1323623 - RNA, 26 nt, Human
caugacaaauauuggccaugaauucc

SEQ ID NO: 1323624 - RNA, 22 nt, Human
ccugagaagggaagggaggugu

SEQ ID NO: 1323625 - RNA, 23 nt, Human
ggaaaaaaagcauaauucucaag

SEQ ID NO: 1323626 - RNA, 24 nt, Human
guccacacaauaucacuugucuuc

SEQ ID NO: 1323627 - RNA, 19 nt, Human
uaacaaaugcaggaugaaa

SEQ ID NO: 1323628 - RNA, 21 nt, Human
uacccuuggaggaugacagcc

SEQ ID NO: 1323629 - RNA, 23 nt, Human
uagacauugcgcuguagcagucc

SEQ ID NO: 1323630 - RNA, 18 nt, Human
uagagaaauaggguuaua

SEQ ID NO: 1323631 - RNA, 23 nt, Human
ucugacagggaaagggagccuga

SEQ ID NO: 1323632 - RNA, 19 nt, Human
ucuucugggccuuccugga

SEQ ID NO: 1323633 - RNA, 18 nt, Human
ugaaugaauguuggagga

SEQ ID NO: 1323634 - RNA, 21 nt, Human
ugacaugacaaauauuggcca

SEQ ID NO: 1323635 - RNA, 22 nt, Human
ugagaagggaagggaggugucc

SEQ ID NO: 1323636 - RNA, 18 nt, Human
uggaggagaugaauacug

SEQ ID NO: 1323637 - RNA, 26 nt, Human
uggaugccuuuacucaucuuaauuuc

SEQ ID NO: 1323638 - RNA, 18 nt, Human
ugucuucugggccuuccu

SEQ ID NO: 1323639 - RNA, 19 nt, Human
ugugaaaaaauaagaacuu

SEQ ID NO: 1323640 - RNA, 20 nt, Human
ugugaaaaaauaagaacuuu

SEQ ID NO: 1323641 - RNA, 24 nt, Human
uuaaaugugcacuugugccuugug

SEQ ID NO: 1323642 - RNA, 22 nt, Human
uuaacauucacacucugcaaaa

SEQ ID NO: 1323643 - RNA, 24 nt, Human
uucucaaguccuucagaggaacau

SEQ ID NO: 1323644 - RNA, 21 nt, Human
uuuagagagacaaggaggaaa

SEQ ID NO: 1323645 - RNA, 20 nt, Human
aaguagaggguggagaaggg

SEQ ID NO: 1323646 - RNA, 21 nt, Human
agccacagggacugguggccc

SEQ ID NO: 1323647 - RNA, 27 nt, Human
agggggaaguggugcugggacccuagc

SEQ ID NO: 1323648 - RNA, 24 nt, Human
aguagaggguggagaagggggaag

SEQ ID NO: 1323649 - RNA, 21 nt, Human
aguggugcugggacccuagcc

SEQ ID NO: 1323650 - RNA, 22 nt, Human
cacaccuguucuccugccccuc

SEQ ID NO: 1323651 - RNA, 22 nt, Human
cagcagcagccacagggacugg

SEQ ID NO: 1323652 - RNA, 24 nt, Human
cucacaccuguucuccugccccuc

SEQ ID NO: 1323653 - RNA, 18 nt, Human
cucugcauacaggacaca

SEQ ID NO: 1323654 - RNA, 23 nt, Human
gagggagcuggccccugcccggc

SEQ ID NO: 1323655 - RNA, 22 nt, Human
gaggguuccagggggcaggaug

SEQ ID NO: 1323656 - RNA, 21 nt, Human
ggagaagggggaaguggugcu

SEQ ID NO: 1323657 - RNA, 23 nt, Human
uccagccccacugggcgggaagu

SEQ ID NO: 1323658 - RNA, 18 nt, Human
uggagaagggggaagugg

SEQ ID NO: 1323659 - RNA, 20 nt, Human
ugggagggagcuggccccug

SEQ ID NO: 1323660 - RNA, 22 nt, Human
ugucaagauggagacagcagca

SEQ ID NO: 1323661 - RNA, 20 nt, Human
accccgggcccuagacacac

SEQ ID NO: 1323662 - RNA, 25 nt, Human
accccgggcccuagacacacggcuc

SEQ ID NO: 1323663 - RNA, 24 nt, Human
ccccgggcccuagacacacggcuc

SEQ ID NO: 1323664 - RNA, 19 nt, Human
ccgcugccgcucacugugu

SEQ ID NO: 1323665 - RNA, 18 nt, Human
gggcccuagacacacggc

SEQ ID NO: 1323666 - RNA, 19 nt, Human
ucgccuggcuccugccggc

SEQ ID NO: 1323667 - RNA, 20 nt, Human
uggcuccugccggcugcccu

SEQ ID NO: 1323668 - RNA, 19 nt, Human
ugggagaggccacaaaaug

SEQ ID NO: 1323669 - RNA, 18 nt, Human
aaaaaugcucuaggucua

SEQ ID NO: 1323670 - RNA, 23 nt, Human
aaacaagaggcagaaugagggac

SEQ ID NO: 1323671 - RNA, 25 nt, Human
aaaccaucaagccacaaaucaacaa

SEQ ID NO: 1323672 - RNA, 23 nt, Human
aacaaaguugaaguaauauccau

SEQ ID NO: 1323673 - RNA, 22 nt, Human
aaccaccauguuuacuguaacc

SEQ ID NO: 1323674 - RNA, 21 nt, Human
aagcaaaguaacacaacagaa

SEQ ID NO: 1323675 - RNA, 19 nt, Human
aagccacaaaucaacaagc

SEQ ID NO: 1323676 - RNA, 19 nt, Human
aagcugguuuuuccucagu

SEQ ID NO: 1323677 - RNA, 18 nt, Human
acaaaaccagaaaacuaa

SEQ ID NO: 1323678 - RNA, 20 nt, Human
acaacagaaaaccaaacucu

SEQ ID NO: 1323679 - RNA, 23 nt, Human
acuguuguuuacacguggaagac

SEQ ID NO: 1323680 - RNA, 25 nt, Human
agagcuguggccggagcuguggccu

SEQ ID NO: 1323681 - RNA, 25 nt, Human
agcccaaacaauauuccaggacccc

SEQ ID NO: 1323682 - RNA, 20 nt, Human
aggaagaaggcgcucccccu

SEQ ID NO: 1323683 - RNA, 18 nt, Human
aggaccccacaaaaccag

SEQ ID NO: 1323684 - RNA, 18 nt, Human
agggacauggaugaagcu

SEQ ID NO: 1323685 - RNA, 19 nt, Human
agguauuaaaaauagcaac

SEQ ID NO: 1323686 - RNA, 24 nt, Human
augaguucaugucauuugcaggga

SEQ ID NO: 1323687 - RNA, 18 nt, Human
caagaaaaacuguuggag

SEQ ID NO: 1323688 - RNA, 21 nt, Human
caagcuuaaucacaaaaguuu

SEQ ID NO: 1323689 - RNA, 22 nt, Human
caauagcaaagacuuggaacca

SEQ ID NO: 1323690 - RNA, 19 nt, Human
caauauuccaggaccccac

SEQ ID NO: 1323691 - RNA, 24 nt, Human
caauauuccaggaccccacaaaac

SEQ ID NO: 1323692 - RNA, 25 nt, Human
cacaaaaccagaaaacuaacaggac

SEQ ID NO: 1323693 - RNA, 22 nt, Human
cacacgcggccgggcucucggc

SEQ ID NO: 1323694 - RNA, 21 nt, Human
cacauguauguuuauugcagu

SEQ ID NO: 1323695 - RNA, 20 nt, Human
caccgccaccgccguggcuc

SEQ ID NO: 1323696 - RNA, 22 nt, Human
cacugccacuccacucugggaa

SEQ ID NO: 1323697 - RNA, 18 nt, Human
caggagccagagcugugg

SEQ ID NO: 1323698 - RNA, 19 nt, Human
caggagccagagcuguggc

SEQ ID NO: 1323699 - RNA, 25 nt, Human
cauauacaccauggaauacuaugca

SEQ ID NO: 1323700 - RNA, 21 nt, Human
cauguuacauagguauacaua

SEQ ID NO: 1323701 - RNA, 30 nt, Human
ccaaacaauauuccaggaccccacaaaacc

SEQ ID NO: 1323702 - RNA, 21 nt, Human
ccacaaaaccagaaaacuaac

SEQ ID NO: 1323703 - RNA, 22 nt, Human
ccacaaaaccagaaaacuaaca

SEQ ID NO: 1323704 - RNA, 25 nt, Human
ccacaaaucaacaagcuuaaucaca

SEQ ID NO: 1323705 - RNA, 21 nt, Human
ccaccgccaccgccaccgcca

SEQ ID NO: 1323706 - RNA, 21 nt, Human
ccaccgccaccgccaccgcca

SEQ ID NO: 1323707 - RNA, 24 nt, Human
ccaccgccaccgccaccgccgugg

SEQ ID NO: 1323708 - RNA, 25 nt, Human
ccaccgccaccgccguggcugccgg

SEQ ID NO: 1323709 - RNA, 20 nt, Human
ccacugccacuccacucugg

SEQ ID NO: 1323710 - RNA, 25 nt, Human
ccagaacuuaaaguuaaaaaaaaaa

SEQ ID NO: 1323711 - RNA, 26 nt, Human
ccagaagugggggccgaggacaggcg

SEQ ID NO: 1323712 - RNA, 21 nt, Human
ccagagcuguggccggagcug

SEQ ID NO: 1323713 - RNA, 21 nt, Human
ccauauucacuugcugucuaa

SEQ ID NO: 1323714 - RNA, 25 nt, Human
cccaaacaauauuccaggaccccac

SEQ ID NO: 1323715 - RNA, 26 nt, Human
cccacaaaaccagaaaacuaacagga

SEQ ID NO: 1323716 - RNA, 18 nt, Human
cccagaaucccggaccca

SEQ ID NO: 1323717 - RNA, 23 nt, Human
ccgccaccgccaccgccaccgcc

SEQ ID NO: 1323718 - RNA, 23 nt, Human
ccgccaccgccaccgccaccgcc

SEQ ID NO: 1323719 - RNA, 23 nt, Human
ccgccaccgccaccgccaccgcc

SEQ ID NO: 1323720 - RNA, 18 nt, Human
ccgccgccaccgccaccg

SEQ ID NO: 1323721 - RNA, 21 nt, Human
ccgccgccaccgccaccgcca

SEQ ID NO: 1323722 - RNA, 23 nt, Human
ccgccgccgccaccgccaccgcc

SEQ ID NO: 1323723 - RNA, 18 nt, Human
ccgccgccgccgccaccg

SEQ ID NO: 1323724 - RNA, 18 nt, Human
ccgccgccgccgccgccg

SEQ ID NO: 1323725 - RNA, 20 nt, Human
ccgccugccgcugccgccgc

SEQ ID NO: 1323726 - RNA, 18 nt, Human
ccgcugccgccgccgccg

SEQ ID NO: 1323727 - RNA, 24 nt, Human
ccgcugccgccgccgccgccgccg

SEQ ID NO: 1323728 - RNA, 19 nt, Human
ccuccccggcuucguuacu

SEQ ID NO: 1323729 - RNA, 19 nt, Human
ccugccgcugccgccgccg

SEQ ID NO: 1323730 - RNA, 19 nt, Human
ccuguuaaacaagaggcag

SEQ ID NO: 1323731 - RNA, 22 nt, Human
cgaugagaacacauggacacag

SEQ ID NO: 1323732 - RNA, 23 nt, Human
cgccgccgccgccgccgccaccg

SEQ ID NO: 1323733 - RNA, 23 nt, Human
cgguguccgacuuuuccugccug

SEQ ID NO: 1323734 - RNA, 22 nt, Human
cuaaagcacacacuguuguuua

SEQ ID NO: 1323735 - RNA, 20 nt, Human
cucaacuuuguacauuugau

SEQ ID NO: 1323736 - RNA, 19 nt, Human
cucaggaauggaugaugcc

SEQ ID NO: 1323737 - RNA, 24 nt, Human
cucagugcugagccuugaaaucuc

SEQ ID NO: 1323738 - RNA, 19 nt, Human
cugccgcugccgccgccgc

SEQ ID NO: 1323739 - RNA, 19 nt, Human
cuguaaaccaucaagccac

SEQ ID NO: 1323740 - RNA, 19 nt, Human
cuuaaaaccuagaugacgg

SEQ ID NO: 1323741 - RNA, 20 nt, Human
gaaaguaggcgggacaggcc

SEQ ID NO: 1323742 - RNA, 20 nt, Human
gaacccggggccaccgcccc

SEQ ID NO: 1323743 - RNA, 24 nt, Human
gaagugggggccgaggacaggcgg

SEQ ID NO: 1323744 - RNA, 18 nt, Human
gacuaaagaaccucccaa

SEQ ID NO: 1323745 - RNA, 18 nt, Human
gagaaacucacaaaauac

SEQ ID NO: 1323746 - RNA, 18 nt, Human
gagcaggagccagagcug

SEQ ID NO: 1323747 - RNA, 22 nt, Human
gcaggcucauuccagaaguggg

SEQ ID NO: 1323748 - RNA, 19 nt, Human
gccaccgccguggcugccg

SEQ ID NO: 1323749 - RNA, 26 nt, Human
gccgccugccgcugccgccgccgccg

SEQ ID NO: 1323750 - RNA, 22 nt, Human
gccgcugccgccgccgccgccg

SEQ ID NO: 1323751 - RNA, 18 nt, Human
gccugucggggcgugggg

SEQ ID NO: 1323752 - RNA, 21 nt, Human
ggaggguacuuggaaaguagg

SEQ ID NO: 1323753 - RNA, 22 nt, Human
ggaggguacuuggaaaguagga

SEQ ID NO: 1323754 - RNA, 22 nt, Human
ggcgugggggaaaggggaggga

SEQ ID NO: 1323755 - RNA, 21 nt, Human
gggauccgccgcggagcagga

SEQ ID NO: 1323756 - RNA, 18 nt, Human
gggccaccgcccccuacc

SEQ ID NO: 1323757 - RNA, 24 nt, Human
gggccgaggacaggcgggcuagaa

SEQ ID NO: 1323758 - RNA, 19 nt, Human
ggggagggagagcauuagg

SEQ ID NO: 1323759 - RNA, 22 nt, Human
gguauacauaggcacauguaua

SEQ ID NO: 1323760 - RNA, 21 nt, Human
guaacacaacagaaaaccaaa

SEQ ID NO: 1323761 - RNA, 21 nt, Human
gucauuugcagggacauggaa

SEQ ID NO: 1323762 - RNA, 24 nt, Human
uaaagagauacucaacuuuguaca

SEQ ID NO: 1323763 - RNA, 23 nt, Human
uaacacaacagaaaaccaaacuc

SEQ ID NO: 1323764 - RNA, 21 nt, Human
uaaccaccauguuacauaggu

SEQ ID NO: 1323765 - RNA, 23 nt, Human
uaagcaagcaagcaagcaagcaa

SEQ ID NO: 1323766 - RNA, 20 nt, Human
uacaauagcaaagacuugga

SEQ ID NO: 1323767 - RNA, 23 nt, Human
uaggacaaauaucuaaugaaugc

SEQ ID NO: 1323768 - RNA, 18 nt, Human
uaucuaaugaaugcaggg

SEQ ID NO: 1323769 - RNA, 21 nt, Human
uaugaaaaaucuuguuccaca

SEQ ID NO: 1323770 - RNA, 21 nt, Human
ucaauacccggcuaucccugg

SEQ ID NO: 1323771 - RNA, 18 nt, Human
ucagugcugagccuugaa

SEQ ID NO: 1323772 - RNA, 19 nt, Human
ucauuugcagggacaugga

SEQ ID NO: 1323773 - RNA, 21 nt, Human
ucccagaaucccggacccacu

SEQ ID NO: 1323774 - RNA, 20 nt, Human
ucccggacccacugccacuc

SEQ ID NO: 1323775 - RNA, 20 nt, Human
uccgccgcggagcaggagcu

SEQ ID NO: 1323776 - RNA, 19 nt, Human
ucuaagcaaaguaacacaa

SEQ ID NO: 1323777 - RNA, 22 nt, Human
ucucaauaagcccaaacaauau

SEQ ID NO: 1323778 - RNA, 22 nt, Human
ugaaagagcagauguggaaaua

SEQ ID NO: 1323779 - RNA, 22 nt, Human
ugagcucaggaauggaugaugc

SEQ ID NO: 1323780 - RNA, 18 nt, Human
ugagggaacaaaguugaa

SEQ ID NO: 1323781 - RNA, 19 nt, Human
uggaaaguaggcgggacag

SEQ ID NO: 1323782 - RNA, 20 nt, Human
uggaaccaacccaaaugcca

SEQ ID NO: 1323783 - RNA, 20 nt, Human
uggaauacuaugcagccaua

SEQ ID NO: 1323784 - RNA, 22 nt, Human
uggaugaagcugggagccauca

SEQ ID NO: 1323785 - RNA, 23 nt, Human
uggccugagagucagggggcggg

SEQ ID NO: 1323786 - RNA, 21 nt, Human
ugggagccaucauucuaagca

SEQ ID NO: 1323787 - RNA, 21 nt, Human
ugggaggguacuuggaaagua

SEQ ID NO: 1323788 - RNA, 19 nt, Human
ugggaugccgccugccgcu

SEQ ID NO: 1323789 - RNA, 21 nt, Human
ugggggccgaggacaggcggg

SEQ ID NO: 1323790 - RNA, 22 nt, Human
uguaauuaugaaaaaucuuguu

SEQ ID NO: 1323791 - RNA, 20 nt, Human
uguccgacuuuuccugccug

SEQ ID NO: 1323792 - RNA, 18 nt, Human
uguggaaauaaauucugg

SEQ ID NO: 1323793 - RNA, 22 nt, Human
uguuaaacaagaggcagaauga

SEQ ID NO: 1323794 - RNA, 26 nt, Human
uguucugcacauguaucccagaacuu

SEQ ID NO: 1323795 - RNA, 21 nt, Human
uuaaaaaaaaaauaguaggau

SEQ ID NO: 1323796 - RNA, 20 nt, Human
uuaaaaauagcaacauguaa

SEQ ID NO: 1323797 - RNA, 18 nt, Human
uucagccuaucacccugg

SEQ ID NO: 1323798 - RNA, 19 nt, Human
uuccucaguuuccucaccu

SEQ ID NO: 1323799 - RNA, 19 nt, Human
uuggagaucuacuaugucc

SEQ ID NO: 1323800 - RNA, 19 nt, Human
uuggcagaggccuuuucuu

SEQ ID NO: 1323801 - RNA, 23 nt, Human
uugugggauccgccgcggagcag

SEQ ID NO: 1323802 - RNA, 22 nt, Human
uuuauugcagugcuauuuacaa

SEQ ID NO: 1323803 - RNA, 20 nt, Human
aagaugccuccuccccugag

SEQ ID NO: 1323804 - RNA, 21 nt, Human
acagugugugguccccuuggg

SEQ ID NO: 1323805 - RNA, 21 nt, Human
agggggcacugagagggcacu

SEQ ID NO: 1323806 - RNA, 22 nt, Human
aucgcaguucucagucauaccc

SEQ ID NO: 1323807 - RNA, 21 nt, Human
cuguuguccccuccagacagc

SEQ ID NO: 1323808 - RNA, 19 nt, Human
cuucuguuguccccuccag

SEQ ID NO: 1323809 - RNA, 24 nt, Human
cuuucauaucgcaguucucaguca

SEQ ID NO: 1323810 - RNA, 23 nt, Human
uaacagugugugguccccuuggg

SEQ ID NO: 1323811 - RNA, 20 nt, Human
ucagauaccuucucugcacc

SEQ ID NO: 1323812 - RNA, 23 nt, Human
ucauaacagugugugguccccuu

SEQ ID NO: 1323813 - RNA, 22 nt, Human
uccccugagccugaggaggcca

SEQ ID NO: 1323814 - RNA, 18 nt, Human
ucuaggaaagugacagac

SEQ ID NO: 1323815 - RNA, 22 nt, Human
ugaggaggccaucauaacagug

SEQ ID NO: 1323816 - RNA, 21 nt, Human
uggcuggggcaugcaucccug

SEQ ID NO: 1323817 - RNA, 18 nt, Human
ugugugguccccuugggg

SEQ ID NO: 1323818 - RNA, 25 nt, Human
uuugaucagauaccuucucugcacc

SEQ ID NO: 1323819 - RNA, 24 nt, Human
agguagguacccagcaccuucagc

SEQ ID NO: 1323820 - RNA, 20 nt, Human
cggccaccagagguagguac

SEQ ID NO: 1323821 - RNA, 20 nt, Human
gcccugggucccagccuggu

SEQ ID NO: 1323822 - RNA, 19 nt, Human
uggcccugggucccagccu

SEQ ID NO: 1323823 - RNA, 25 nt, Human
aaaaaacaacucaaaaagagcuaau

SEQ ID NO: 1323824 - RNA, 19 nt, Human
aacucaaaaagagcuaaua

SEQ ID NO: 1323825 - RNA, 18 nt, Human
auaaucaaauauauuacu

SEQ ID NO: 1323826 - RNA, 20 nt, Human
cacgcuaagaacuuaaaaaa

SEQ ID NO: 1323827 - RNA, 20 nt, Human
cauaaucaaauauauuacuu

SEQ ID NO: 1323828 - RNA, 22 nt, Human
uaaaaaacaacucaaaaagagc

SEQ ID NO: 1323829 - RNA, 25 nt, Human
uaaaaaacaacucaaaaagagcuaa

SEQ ID NO: 1323830 - RNA, 23 nt, Human
uaaaugaaaagagucaagaauuu

SEQ ID NO: 1323831 - RNA, 25 nt, Human
uacuguaagggaggagaauuauaaa

SEQ ID NO: 1323832 - RNA, 27 nt, Human
uauuuugcuuucauaaucaaauauauu

SEQ ID NO: 1323833 - RNA, 21 nt, Human
ugucauagagacuaacugaag

SEQ ID NO: 1323834 - RNA, 22 nt, Human
ugucauagagacuaacugaagu

SEQ ID NO: 1323835 - RNA, 22 nt, Human
uuucauaaucaaauauauuacu

SEQ ID NO: 1323836 - RNA, 22 nt, Human
acaggacaggagggaaccgaca

SEQ ID NO: 1323837 - RNA, 18 nt, Human
acccgccgccaccgccuc

SEQ ID NO: 1323838 - RNA, 24 nt, Human
acugcacuccagcccaggcaacag

SEQ ID NO: 1323839 - RNA, 18 nt, Human
agcaagacccucgccccg

SEQ ID NO: 1323840 - RNA, 23 nt, Human
agcuacucagaggcugggguggg

SEQ ID NO: 1323841 - RNA, 23 nt, Human
aucguggcacugcacuccagccc

SEQ ID NO: 1323842 - RNA, 19 nt, Human
cacugcacuccagcccagg

SEQ ID NO: 1323843 - RNA, 19 nt, Human
cacugcacuccagcccagg

SEQ ID NO: 1323844 - RNA, 20 nt, Human
cacugcacuccagcccaggc

SEQ ID NO: 1323845 - RNA, 21 nt, Human
cacugcacuccagcccaggca

SEQ ID NO: 1323846 - RNA, 22 nt, Human
cacugcacuccagcccaggcaa

SEQ ID NO: 1323847 - RNA, 23 nt, Human
cacugcacuccagcccaggcaac

SEQ ID NO: 1323848 - RNA, 27 nt, Human
cacugcacuccagcccaggcaacagag

SEQ ID NO: 1323849 - RNA, 19 nt, Human
cacuuguagucccagcuac

SEQ ID NO: 1323850 - RNA, 24 nt, Human
cacuuguagucccagcuacucaga

SEQ ID NO: 1323851 - RNA, 20 nt, Human
cagcccaggcaacagagcaa

SEQ ID NO: 1323852 - RNA, 21 nt, Human
caggagggaaccgacaccucg

SEQ ID NO: 1323853 - RNA, 27 nt, Human
ccagcccaggcaacagagcaagacccu

SEQ ID NO: 1323854 - RNA, 19 nt, Human
cccccaucccaggggcagg

SEQ ID NO: 1323855 - RNA, 23 nt, Human
cccgacccgccgccaccgccucu

SEQ ID NO: 1323856 - RNA, 21 nt, Human
ccgacccgccgccaccgccuc

SEQ ID NO: 1323857 - RNA, 18 nt, Human
cgccccgacccgccgcca

SEQ ID NO: 1323858 - RNA, 18 nt, Human
cggggaggggcaccgggc

SEQ ID NO: 1323859 - RNA, 24 nt, Human
cugcuugagcccaggaggucaagg

SEQ ID NO: 1323860 - RNA, 22 nt, Human
gacccgccgccaccgccucuuu

SEQ ID NO: 1323861 - RNA, 21 nt, Human
gcacugcacuccagcccaggc

SEQ ID NO: 1323862 - RNA, 22 nt, Human
gcccaggaggucaaggcugcag

SEQ ID NO: 1323863 - RNA, 22 nt, Human
ggggugggaggacugcuugagc

SEQ ID NO: 1323864 - RNA, 24 nt, Human
uggcacugcacuccagcccaggca

SEQ ID NO: 1323865 - RNA, 26 nt, Human
uggcacugcacuccagcccaggcaac

SEQ ID NO: 1323866 - RNA, 23 nt, Human
uggggugggaggacugcuugagc

SEQ ID NO: 1323867 - RNA, 24 nt, Human
uggggugggaggacugcuugagcc

SEQ ID NO: 1323868 - RNA, 24 nt, Human
agauccuggaaacuacuaagugcu

SEQ ID NO: 1323869 - RNA, 20 nt, Human
aguucuacuagcagcagccc

SEQ ID NO: 1323870 - RNA, 18 nt, Human
augcauccaaaaccacag

SEQ ID NO: 1323871 - RNA, 22 nt, Human
cagugguuuugacacuuuuuuu

SEQ ID NO: 1323872 - RNA, 18 nt, Human
ccuggaaacuacuaagug

SEQ ID NO: 1323873 - RNA, 19 nt, Human
cuuuugucccccuggucga

SEQ ID NO: 1323874 - RNA, 18 nt, Human
gaaauccucuaucaauca

SEQ ID NO: 1323875 - RNA, 21 nt, Human
gucgaagcugacucaccuaca

SEQ ID NO: 1323876 - RNA, 23 nt, Human
ucuccagguuguugcuuuugucc

SEQ ID NO: 1323877 - RNA, 26 nt, Human
ugccaagccuggaagauccuggaaac

SEQ ID NO: 1323878 - RNA, 18 nt, Human
uugcagcagugucagagc

SEQ ID NO: 1323879 - RNA, 21 nt, Human
uuugacacuuuuuuuguuucu

SEQ ID NO: 1323880 - RNA, 21 nt, Human
agcaggggagggcccacgggc

SEQ ID NO: 1323881 - RNA, 18 nt, Human
agccacacugcacagugc

SEQ ID NO: 1323882 - RNA, 21 nt, Human
augcuggagagccagccacac

SEQ ID NO: 1323883 - RNA, 23 nt, Human
caggcaauccccaguacuccuga

SEQ ID NO: 1323884 - RNA, 18 nt, Human
cccacgggcgcccagccc

SEQ ID NO: 1323885 - RNA, 21 nt, Human
ccgcaguggcagcaggggagg

SEQ ID NO: 1323886 - RNA, 24 nt, Human
ucaggcccggcuugcgugggccgc

SEQ ID NO: 1323887 - RNA, 19 nt, Human
uccccaguacuccugaugc

SEQ ID NO: 1323888 - RNA, 19 nt, Human
uggcagcaggggagggccc

SEQ ID NO: 1323889 - RNA, 23 nt, Human
uggcagcaggggagggcccacgg

SEQ ID NO: 1323890 - RNA, 18 nt, Human
ugggccgcaguggcagca

SEQ ID NO: 1323891 - RNA, 23 nt, Human
ugggccgcaguggcagcagggga

SEQ ID NO: 1323892 - RNA, 19 nt, Human
aggggccgggcgccgcggg

SEQ ID NO: 1323893 - RNA, 20 nt, Human
aggggccgggcgccgcgggg

SEQ ID NO: 1323894 - RNA, 22 nt, Human
gcggggaacgggggagcuggcg

SEQ ID NO: 1323895 - RNA, 27 nt, Human
gggccgggcgccgcggggaacggggga

SEQ ID NO: 1323896 - RNA, 23 nt, Human
aacaaaggaaagaauacugaaaa

SEQ ID NO: 1323897 - RNA, 20 nt, Human
aagguggcagaugaacauca

SEQ ID NO: 1323898 - RNA, 20 nt, Human
acaaaggaaagaauacugaa

SEQ ID NO: 1323899 - RNA, 28 nt, Human
accugcugcauccccaggcugugugaac

SEQ ID NO: 1323900 - RNA, 23 nt, Human
agaaacuauacaggaacagacaa

SEQ ID NO: 1323901 - RNA, 24 nt, Human
agcgccgaaaccucacaggaaaaa

SEQ ID NO: 1323902 - RNA, 18 nt, Human
aggaaagaauacugaaaa

SEQ ID NO: 1323903 - RNA, 18 nt, Human
aggcaguuauaaacaaga

SEQ ID NO: 1323904 - RNA, 20 nt, Human
aggcaguuauaaacaagaug

SEQ ID NO: 1323905 - RNA, 20 nt, Human
aggcuauuuuauuuucaaac

SEQ ID NO: 1323906 - RNA, 18 nt, Human
auggcaguggagcaggac

SEQ ID NO: 1323907 - RNA, 19 nt, Human
caagagguccucccaaccc

SEQ ID NO: 1323908 - RNA, 19 nt, Human
caaggagaaacuauacagg

SEQ ID NO: 1323909 - RNA, 20 nt, Human
caauugccagaacucacaga

SEQ ID NO: 1323910 - RNA, 25 nt, Human
caauugccagaacucacagaauagc

SEQ ID NO: 1323911 - RNA, 22 nt, Human
caccugcugcauccccaggcug

SEQ ID NO: 1323912 - RNA, 22 nt, Human
cagaacucacagaauagcagua

SEQ ID NO: 1323913 - RNA, 23 nt, Human
cagcuccugcgccaagagguccu

SEQ ID NO: 1323914 - RNA, 27 nt, Human
caucaggaaggaacauccaugagcuuc

SEQ ID NO: 1323915 - RNA, 19 nt, Human
cauggcaguggagcaggac

SEQ ID NO: 1323916 - RNA, 18 nt, Human
ccagcugggacaggguuc

SEQ ID NO: 1323917 - RNA, 23 nt, Human
ccgaaaccucacaggaaaaaugg

SEQ ID NO: 1323918 - RNA, 25 nt, Human
cgccgaaaccucacaggaaaaaugg

SEQ ID NO: 1323919 - RNA, 24 nt, Human
cucacagaauagcaguaucagcgc

SEQ ID NO: 1323920 - RNA, 20 nt, Human
cuguacaaaugcuuuauuuc

SEQ ID NO: 1323921 - RNA, 24 nt, Human
gcgccaagagguccucccaacccu

SEQ ID NO: 1323922 - RNA, 22 nt, Human
ggcagaugaacaucaggaagga

SEQ ID NO: 1323923 - RNA, 19 nt, Human
gugaucaagggccuggucu

SEQ ID NO: 1323924 - RNA, 26 nt, Human
ucacagaauagcaguaucagcgccga

SEQ ID NO: 1323925 - RNA, 22 nt, Human
ucacuggauuuaaccguauccc

SEQ ID NO: 1323926 - RNA, 19 nt, Human
ucagaacuucagcuccugc

SEQ ID NO: 1323927 - RNA, 22 nt, Human
ucagaacuucagcuccugcgcc

SEQ ID NO: 1323928 - RNA, 18 nt, Human
ucuauucaacauuuagaa

SEQ ID NO: 1323929 - RNA, 20 nt, Human
ucuauucaacauuuagaagg

SEQ ID NO: 1323930 - RNA, 19 nt, Human
ucuccccucaagacacggu

SEQ ID NO: 1323931 - RNA, 18 nt, Human
ucugugacaccugcugca

SEQ ID NO: 1323932 - RNA, 22 nt, Human
ugaacggacucaauugccagaa

SEQ ID NO: 1323933 - RNA, 18 nt, Human
ugacaccugcugcauccc

SEQ ID NO: 1323934 - RNA, 22 nt, Human
ugacaccugcugcauccccagg

SEQ ID NO: 1323935 - RNA, 18 nt, Human
ugccagaacucacagaau

SEQ ID NO: 1323936 - RNA, 19 nt, Human
uggcaguggagcaggacca

SEQ ID NO: 1323937 - RNA, 21 nt, Human
ugugaacggacucaauugcca

SEQ ID NO: 1323938 - RNA, 22 nt, Human
ugugaucaagggccuggucucc

SEQ ID NO: 1323939 - RNA, 23 nt, Human
uucaaacuggagaaagugaugga

SEQ ID NO: 1323940 - RNA, 19 nt, Human
uucaauagcaagguggcag

SEQ ID NO: 1323941 - RNA, 18 nt, Human
uuugucagcccccaugac

SEQ ID NO: 1323942 - RNA, 23 nt, Human
aacacaauauacucugcaguuac

SEQ ID NO: 1323943 - RNA, 19 nt, Human
aacagcaaaaugaacacaa

SEQ ID NO: 1323944 - RNA, 24 nt, Human
aaccaugaugcuugcuccaagcag

SEQ ID NO: 1323945 - RNA, 23 nt, Human
aagcagacaaagaaauuucuuac

SEQ ID NO: 1323946 - RNA, 23 nt, Human
aagcauauuacagcauuucacac

SEQ ID NO: 1323947 - RNA, 18 nt, Human
aaggagggggugcccuuc

SEQ ID NO: 1323948 - RNA, 21 nt, Human
acagcaucacaagcagacaaa

SEQ ID NO: 1323949 - RNA, 24 nt, Human
acuauccuauguuuuuaaauaaaa

SEQ ID NO: 1323950 - RNA, 18 nt, Human
acugcacuucagcacugg

SEQ ID NO: 1323951 - RNA, 18 nt, Human
acugcacuucagcacugg

SEQ ID NO: 1323952 - RNA, 19 nt, Human
acugcacuucagcacuggc

SEQ ID NO: 1323953 - RNA, 20 nt, Human
acugcacuucagcacuggca

SEQ ID NO: 1323954 - RNA, 22 nt, Human
acugcacuucagcacuggcaca

SEQ ID NO: 1323955 - RNA, 23 nt, Human
acugcacuucagcacuggcacag

SEQ ID NO: 1323956 - RNA, 23 nt, Human
agaaaaaaagcuauacaugaaua

SEQ ID NO: 1323957 - RNA, 18 nt, Human
aggaaaaaaaaaaagaga

SEQ ID NO: 1323958 - RNA, 25 nt, Human
auaaaaaugaaaguugacauauguc

SEQ ID NO: 1323959 - RNA, 18 nt, Human
augucauggguacaacua

SEQ ID NO: 1323960 - RNA, 24 nt, Human
auuacaaaaacauucuugaugugg

SEQ ID NO: 1323961 - RNA, 24 nt, Human
caacaugaacacauucgauuuauu

SEQ ID NO: 1323962 - RNA, 19 nt, Human
cacgcccuauguggagcag

SEQ ID NO: 1323963 - RNA, 23 nt, Human
cagcaaaaugaacacaauauacu

SEQ ID NO: 1323964 - RNA, 22 nt, Human
cagcacuggcacaggaaaaaaa

SEQ ID NO: 1323965 - RNA, 19 nt, Human
cagcaggccaucauuucaa

SEQ ID NO: 1323966 - RNA, 19 nt, Human
caggaaaaaaaaaaagaga

SEQ ID NO: 1323967 - RNA, 21 nt, Human
caucacaagcagacaaagaaa

SEQ ID NO: 1323968 - RNA, 20 nt, Human
ccagccugcguguguccucu

SEQ ID NO: 1323969 - RNA, 19 nt, Human
ccugaacuacucaaacagc

SEQ ID NO: 1323970 - RNA, 19 nt, Human
cucccuauaucuuauuucu

SEQ ID NO: 1323971 - RNA, 19 nt, Human
cugaacuacucaaacagca

SEQ ID NO: 1323972 - RNA, 18 nt, Human
cugaagggcuuucaacug

SEQ ID NO: 1323973 - RNA, 19 nt, Human
cugcacuucagcacuggca

SEQ ID NO: 1323974 - RNA, 23 nt, Human
cuuccaccaaaccucccauugug

SEQ ID NO: 1323975 - RNA, 24 nt, Human
cuucucacugcaguucuuuuuaau

SEQ ID NO: 1323976 - RNA, 23 nt, Human
cuuuaaaguguuucagaaaaaaa

SEQ ID NO: 1323977 - RNA, 19 nt, Human
cuuugaagaagcaaagaaa

SEQ ID NO: 1323978 - RNA, 22 nt, Human
gaaaaaaagcuauacaugaaua

SEQ ID NO: 1323979 - RNA, 23 nt, Human
gagggggcuuuacugcacuucag

SEQ ID NO: 1323980 - RNA, 20 nt, Human
gccagccugcguguguccuc

SEQ ID NO: 1323981 - RNA, 19 nt, Human
ggggugcccuucaguuuga

SEQ ID NO: 1323982 - RNA, 18 nt, Human
gggugcccuucaguuuga

SEQ ID NO: 1323983 - RNA, 22 nt, Human
gguguuugaaaggcaacuccuu

SEQ ID NO: 1323984 - RNA, 19 nt, Human
guaaaguguucucacgccc

SEQ ID NO: 1323985 - RNA, 18 nt, Human
guguuugaaaggcaacuc

SEQ ID NO: 1323986 - RNA, 24 nt, Human
uaaaaaguauucaaacauuuaaaa

SEQ ID NO: 1323987 - RNA, 22 nt, Human
uaaaguguuucagaaaaaaagc

SEQ ID NO: 1323988 - RNA, 18 nt, Human
uaacagcaucacaagcag

SEQ ID NO: 1323989 - RNA, 22 nt, Human
uaacagcaucacaagcagacaa

SEQ ID NO: 1323990 - RNA, 20 nt, Human
uaagaaaucuugaugugaua

SEQ ID NO: 1323991 - RNA, 24 nt, Human
uaauaugugcuuucuaaaauaguu

SEQ ID NO: 1323992 - RNA, 25 nt, Human
uagaauacgaugcaagaaguaaaaa

SEQ ID NO: 1323993 - RNA, 23 nt, Human
uaguuguuugguguuugaaaggc

SEQ ID NO: 1323994 - RNA, 23 nt, Human
uauucaaacauuuaaaacuccca

SEQ ID NO: 1323995 - RNA, 18 nt, Human
ucaaacagcaaaaugaac

SEQ ID NO: 1323996 - RNA, 23 nt, Human
ucauucugggagaaggagggggu

SEQ ID NO: 1323997 - RNA, 27 nt, Human
uccucuaucacugaagggcuuucaacu

SEQ ID NO: 1323998 - RNA, 20 nt, Human
uccugaacuacucaaacagc

SEQ ID NO: 1323999 - RNA, 18 nt, Human
ucugggagaaggaggggg

SEQ ID NO: 1324000 - RNA, 19 nt, Human
ucuuauuucuggcuuugaa

SEQ ID NO: 1324001 - RNA, 25 nt, Human
ugagggggcuuuacugcacuucagc

SEQ ID NO: 1324002 - RNA, 24 nt, Human
ugauaaagcaagaccagauuuacu

SEQ ID NO: 1324003 - RNA, 24 nt, Human
ugcuuacccaccaacaugaacaca

SEQ ID NO: 1324004 - RNA, 23 nt, Human
uggaagcaaugccauaggacagg

SEQ ID NO: 1324005 - RNA, 21 nt, Human
uggaaguugaaaugaaaaacu

SEQ ID NO: 1324006 - RNA, 20 nt, Human
uggagcacaguguugagcuc

SEQ ID NO: 1324007 - RNA, 22 nt, Human
uggcacaggaaaaaaaaaaaga

SEQ ID NO: 1324008 - RNA, 20 nt, Human
uggggaaaccaugaugcuug

SEQ ID NO: 1324009 - RNA, 22 nt, Human
uggggaaaccaugaugcuugcu

SEQ ID NO: 1324010 - RNA, 19 nt, Human
ugucucaagacugcagcaa

SEQ ID NO: 1324011 - RNA, 18 nt, Human
ugucuggaccacugggga

SEQ ID NO: 1324012 - RNA, 22 nt, Human
uuacaaaaacauucuugaugug

SEQ ID NO: 1324013 - RNA, 21 nt, Human
uuacugcacuucagcacuggc

SEQ ID NO: 1324014 - RNA, 23 nt, Human
uuagaguuaaaauaauguuuccc

SEQ ID NO: 1324015 - RNA, 21 nt, Human
uuuacugcacuucagcacugg

SEQ ID NO: 1324016 - RNA, 21 nt, Human
aaauaacuggaaccagggacc

SEQ ID NO: 1324017 - RNA, 20 nt, Human
aagaggggggggggcaguag

SEQ ID NO: 1324018 - RNA, 20 nt, Human
aaguuugauuuuuuuuucuu

SEQ ID NO: 1324019 - RNA, 21 nt, Human
accauauuuuagcaaaagcua

SEQ ID NO: 1324020 - RNA, 20 nt, Human
accccuacccuaaacccugg

SEQ ID NO: 1324021 - RNA, 19 nt, Human
acuggaaccagggacccua

SEQ ID NO: 1324022 - RNA, 18 nt, Human
agaggggggggggcagua

SEQ ID NO: 1324023 - RNA, 21 nt, Human
aggaaagaagagcucaucugg

SEQ ID NO: 1324024 - RNA, 22 nt, Human
aggacucaggucccagcugcug

SEQ ID NO: 1324025 - RNA, 21 nt, Human
aguaacuaacuacagucacag

SEQ ID NO: 1324026 - RNA, 22 nt, Human
agugccaaccauauuuuagcaa

SEQ ID NO: 1324027 - RNA, 24 nt, Human
augucugcugcuuagagucaacag

SEQ ID NO: 1324028 - RNA, 21 nt, Human
caaaguaacuaacuacaguca

SEQ ID NO: 1324029 - RNA, 21 nt, Human
caacagauuaaccccuacccu

SEQ ID NO: 1324030 - RNA, 19 nt, Human
cacguauaauccacaggau

SEQ ID NO: 1324031 - RNA, 20 nt, Human
cagauuaaccccuacccuaa

SEQ ID NO: 1324032 - RNA, 21 nt, Human
cagugccagaagggcagggag

SEQ ID NO: 1324033 - RNA, 23 nt, Human
cauauuuuagcaaaagcuaggag

SEQ ID NO: 1324034 - RNA, 25 nt, Human
caucagugauggccaauuaacggcc

SEQ ID NO: 1324035 - RNA, 24 nt, Human
cauucuuaaaaaaaagaggggggg

SEQ ID NO: 1324036 - RNA, 24 nt, Human
ccacccagacugauaauuuauaga

SEQ ID NO: 1324037 - RNA, 22 nt, Human
ccccaaggcccuucagugccag

SEQ ID NO: 1324038 - RNA, 20 nt, Human
cccuaaacccuggcauuccc

SEQ ID NO: 1324039 - RNA, 18 nt, Human
cccuacccuaaacccugg

SEQ ID NO: 1324040 - RNA, 23 nt, Human
cccuacccuaaacccuggcauuc

SEQ ID NO: 1324041 - RNA, 18 nt, Human
cugauuuccaucucuucc

SEQ ID NO: 1324042 - RNA, 22 nt, Human
cuggaaauuuucaguaucccaa

SEQ ID NO: 1324043 - RNA, 20 nt, Human
cugguuuuggaggagaggga

SEQ ID NO: 1324044 - RNA, 19 nt, Human
gaaaauaacuggaaccagg

SEQ ID NO: 1324045 - RNA, 20 nt, Human
gaaaauaacuggaaccaggg

SEQ ID NO: 1324046 - RNA, 22 nt, Human
gaaaauaacuggaaccagggac

SEQ ID NO: 1324047 - RNA, 24 nt, Human
gaaccagggacccuaagcaggaaa

SEQ ID NO: 1324048 - RNA, 25 nt, Human
gagcaaacuaccccaaggcccuuca

SEQ ID NO: 1324049 - RNA, 20 nt, Human
ggcagggagauguguggcuc

SEQ ID NO: 1324050 - RNA, 21 nt, Human
gggauuuucugauuuccaucu

SEQ ID NO: 1324051 - RNA, 21 nt, Human
gggcagggagauguguggcuc

SEQ ID NO: 1324052 - RNA, 19 nt, Human
ggggaauauggcaaaggga

SEQ ID NO: 1324053 - RNA, 22 nt, Human
ggggggggggcaguagguggag

SEQ ID NO: 1324054 - RNA, 19 nt, Human
gguaggacucaggucccag

SEQ ID NO: 1324055 - RNA, 24 nt, Human
uaaaaaaaaaaaggaaguaaauaa

SEQ ID NO: 1324056 - RNA, 19 nt, Human
uaaccccuacccuaaaccc

SEQ ID NO: 1324057 - RNA, 25 nt, Human
uaaccccuacccuaaacccuggcau

SEQ ID NO: 1324058 - RNA, 20 nt, Human
uaaggugggcugaacaggga

SEQ ID NO: 1324059 - RNA, 26 nt, Human
uaccauuucuucaggaugucugcugc

SEQ ID NO: 1324060 - RNA, 21 nt, Human
uagagauuccuuccucugucc

SEQ ID NO: 1324061 - RNA, 18 nt, Human
uaggggaauauggcaaag

SEQ ID NO: 1324062 - RNA, 20 nt, Human
uaucaaaguaacuaacuaca

SEQ ID NO: 1324063 - RNA, 18 nt, Human
ucaguaucccaaccugca

SEQ ID NO: 1324064 - RNA, 19 nt, Human
ucagugauggccaauuaac

SEQ ID NO: 1324065 - RNA, 19 nt, Human
ucaucuggaaauuuucagu

SEQ ID NO: 1324066 - RNA, 18 nt, Human
ucccuaauuaugaaaacu

SEQ ID NO: 1324067 - RNA, 21 nt, Human
ucuguccugauccuccaggga

SEQ ID NO: 1324068 - RNA, 23 nt, Human
ucuguccugauccuccagggaaa

SEQ ID NO: 1324069 - RNA, 22 nt, Human
ugacugcucugauucccugguu

SEQ ID NO: 1324070 - RNA, 20 nt, Human
ugauggccaauuaacggccu

SEQ ID NO: 1324071 - RNA, 22 nt, Human
ugcuggagugaugggauuuucu

SEQ ID NO: 1324072 - RNA, 19 nt, Human
uggaaccagggacccuaag

SEQ ID NO: 1324073 - RNA, 22 nt, Human
uggcaaagggaggaaaucuggg

SEQ ID NO: 1324074 - RNA, 21 nt, Human
uggccaaagaaaauuaucaaa

SEQ ID NO: 1324075 - RNA, 20 nt, Human
ugguagacccagugggugcc

SEQ ID NO: 1324076 - RNA, 24 nt, Human
uuaacggccucacuacuuauuucu

SEQ ID NO: 1324077 - RNA, 21 nt, Human
uucaggaugucugcugcuuag

SEQ ID NO: 1324078 - RNA, 22 nt, Human
uucugauuuccaucucuuccug

SEQ ID NO: 1324079 - RNA, 19 nt, Human
uucuucaggaugucugcug

SEQ ID NO: 1324080 - RNA, 19 nt, Human
cuucaaaggacaccaaccc

SEQ ID NO: 1324081 - RNA, 23 nt, Human
aaacaauuuauuauaacucuagu

SEQ ID NO: 1324082 - RNA, 23 nt, Human
aaauaaacacagaugccaacaaa

SEQ ID NO: 1324083 - RNA, 20 nt, Human
aacagaggcacuguaagaga

SEQ ID NO: 1324084 - RNA, 24 nt, Human
aagcagaaaacacuggcaccaaaa

SEQ ID NO: 1324085 - RNA, 21 nt, Human
aauaaaccaguuuauuacaga

SEQ ID NO: 1324086 - RNA, 19 nt, Human
acaaagcaaaugauuaagc

SEQ ID NO: 1324087 - RNA, 24 nt, Human
acaaagcaaaugauuaagcagaaa

SEQ ID NO: 1324088 - RNA, 20 nt, Human
acaauuacuuauccuugauc

SEQ ID NO: 1324089 - RNA, 18 nt, Human
acugcagcaccuuccacc

SEQ ID NO: 1324090 - RNA, 19 nt, Human
agacagaccaacagaggca

SEQ ID NO: 1324091 - RNA, 21 nt, Human
agacauccuaguuuccaauaa

SEQ ID NO: 1324092 - RNA, 22 nt, Human
agggaauuaucuauuuuucuca

SEQ ID NO: 1324093 - RNA, 20 nt, Human
auaaaauguacauguaaauc

SEQ ID NO: 1324094 - RNA, 22 nt, Human
auaaacacagaugccaacaaag

SEQ ID NO: 1324095 - RNA, 19 nt, Human
caaaauaaacaaaggcaag

SEQ ID NO: 1324096 - RNA, 23 nt, Human
caauucaguuugagacagaccaa

SEQ ID NO: 1324097 - RNA, 19 nt, Human
cauguaguuuucgauaaca

SEQ ID NO: 1324098 - RNA, 20 nt, Human
ccuaguuuccaauaauuuau

SEQ ID NO: 1324099 - RNA, 26 nt, Human
cuguuacccaugaaucaauauaaacc

SEQ ID NO: 1324100 - RNA, 22 nt, Human
gaacugcccuucuuugguucuu

SEQ ID NO: 1324101 - RNA, 19 nt, Human
gcagcaccuuccacccacc

SEQ ID NO: 1324102 - RNA, 18 nt, Human
gcucaguagacauuuacu

SEQ ID NO: 1324103 - RNA, 19 nt, Human
gggaaggaguaguuaagac

SEQ ID NO: 1324104 - RNA, 21 nt, Human
guaaauaaacacagaugccaa

SEQ ID NO: 1324105 - RNA, 21 nt, Human
uaaacaaaggcaagauuugcc

SEQ ID NO: 1324106 - RNA, 24 nt, Human
uaaauaaacacagaugccaacaaa

SEQ ID NO: 1324107 - RNA, 25 nt, Human
uaaauaaacacagaugccaacaaag

SEQ ID NO: 1324108 - RNA, 20 nt, Human
uaaccacacaauuacuuauc

SEQ ID NO: 1324109 - RNA, 23 nt, Human
uaagggaauuaucuauuuuucuc

SEQ ID NO: 1324110 - RNA, 18 nt, Human
uaaucuaauuauagcacc

SEQ ID NO: 1324111 - RNA, 23 nt, Human
uagcauguguuuggugaggcaga

SEQ ID NO: 1324112 - RNA, 24 nt, Human
uauuacagauuaaaucauuuuuuc

SEQ ID NO: 1324113 - RNA, 20 nt, Human
ucaauuacagaacauacuaa

SEQ ID NO: 1324114 - RNA, 24 nt, Human
ucagacauccuaguuuccaauaau

SEQ ID NO: 1324115 - RNA, 19 nt, Human
ucaguagacauuuacugaa

SEQ ID NO: 1324116 - RNA, 24 nt, Human
uccacccacccuuuggucgcuuga

SEQ ID NO: 1324117 - RNA, 24 nt, Human
uccuuuauaccuaaugcaaaguua

SEQ ID NO: 1324118 - RNA, 24 nt, Human
ucgcuugaacugcccuucuuuggu

SEQ ID NO: 1324119 - RNA, 23 nt, Human
ugaauaacacaccucaaacaaaa

SEQ ID NO: 1324120 - RNA, 23 nt, Human
ugacuaggaaagaggugagaaga

SEQ ID NO: 1324121 - RNA, 19 nt, Human
ugagaagagaugggcccuc

SEQ ID NO: 1324122 - RNA, 21 nt, Human
ugagacagaccaacagaggca

SEQ ID NO: 1324123 - RNA, 19 nt, Human
uguguuuggugaggcagag

SEQ ID NO: 1324124 - RNA, 18 nt, Human
uugaacugcccuucuuug

SEQ ID NO: 1324125 - RNA, 23 nt, Human
uuggaauuuaccugggaaggagu

SEQ ID NO: 1324126 - RNA, 21 nt, Human
uuggaccauaccuuuucccac

SEQ ID NO: 1324127 - RNA, 18 nt, Human
uuugcccacaguaagggc

SEQ ID NO: 1324128 - RNA, 20 nt, Human
accaggagcagggcagccca

SEQ ID NO: 1324129 - RNA, 18 nt, Human
acuagcagacugcgcaug

SEQ ID NO: 1324130 - RNA, 23 nt, Human
agacacacagaucugagcuugga

SEQ ID NO: 1324131 - RNA, 18 nt, Human
agcucugcaaagcgugug

SEQ ID NO: 1324132 - RNA, 18 nt, Human
agcuuggaugguggucac

SEQ ID NO: 1324133 - RNA, 20 nt, Human
cacacacacacuagcagacu

SEQ ID NO: 1324134 - RNA, 33 nt, Human
cacacacacacuagcagacugcgcaugcacagu

SEQ ID NO: 1324135 - RNA, 21 nt, Human
cagcccagccaccgacgcauc

SEQ ID NO: 1324136 - RNA, 24 nt, Human
ccugcguaugcugcacacacacag

SEQ ID NO: 1324137 - RNA, 23 nt, Human
cguagacacacagaucugagcuu

SEQ ID NO: 1324138 - RNA, 18 nt, Human
gggcuccggccugaccag

SEQ ID NO: 1324139 - RNA, 22 nt, Human
guaugcugcacacacacacuag

SEQ ID NO: 1324140 - RNA, 18 nt, Human
ucacuggauuaaagggag

SEQ ID NO: 1324141 - RNA, 25 nt, Human
ucacuggauuaaagggaguccacgu

SEQ ID NO: 1324142 - RNA, 19 nt, Human
ugaccaggagcagggcagc

SEQ ID NO: 1324143 - RNA, 19 nt, Human
ugagcguagacacacagau

SEQ ID NO: 1324144 - RNA, 20 nt, Human
ugaucgaccugacagucacu

SEQ ID NO: 1324145 - RNA, 30 nt, Human
ugcacacacacacuagcagacugcgcaugg

SEQ ID NO: 1324146 - RNA, 20 nt, Human
ugcgcaugcacagcucugca

SEQ ID NO: 1324147 - RNA, 18 nt, Human
aaccggccccgcagaagc

SEQ ID NO: 1324148 - RNA, 23 nt, Human
aggagggcgccucugccggggac

SEQ ID NO: 1324149 - RNA, 20 nt, Human
aggcuggcgcgcagcagcuc

SEQ ID NO: 1324150 - RNA, 20 nt, Human
caaagaaguuucagagagug

SEQ ID NO: 1324151 - RNA, 27 nt, Human
cacagcuccacggggucuggguggugg

SEQ ID NO: 1324152 - RNA, 23 nt, Human
cacucaccccgcgcuggugcucc

SEQ ID NO: 1324153 - RNA, 24 nt, Human
cagagaguggguggaucagggcuc

SEQ ID NO: 1324154 - RNA, 21 nt, Human
cagagugagccccuuccugcc

SEQ ID NO: 1324155 - RNA, 23 nt, Human
ccccgcagaagcucacucacccc

SEQ ID NO: 1324156 - RNA, 18 nt, Human
ccccuuccugccacaguc

SEQ ID NO: 1324157 - RNA, 22 nt, Human
cccgcagaagcucacucacccc

SEQ ID NO: 1324158 - RNA, 20 nt, Human
ccgcugccuccuccgcagcc

SEQ ID NO: 1324159 - RNA, 21 nt, Human
ccgcugccuccuccgcagccu

SEQ ID NO: 1324160 - RNA, 19 nt, Human
ccgggcccccgccgcugcc

SEQ ID NO: 1324161 - RNA, 23 nt, Human
ccugccacagucaccccaacuga

SEQ ID NO: 1324162 - RNA, 24 nt, Human
cuccugagucaaggagggcgccuc

SEQ ID NO: 1324163 - RNA, 19 nt, Human
cuggugcuccaggcuggcg

SEQ ID NO: 1324164 - RNA, 29 nt, Human
cuuccugccacagucaccccaacugaaau

SEQ ID NO: 1324165 - RNA, 21 nt, Human
gagaguggguggaucagggcu

SEQ ID NO: 1324166 - RNA, 18 nt, Human
gagccccuuccugccaca

SEQ ID NO: 1324167 - RNA, 18 nt, Human
gaggugacugacgaggag

SEQ ID NO: 1324168 - RNA, 21 nt, Human
gcagcagcucuagcucgcgcu

SEQ ID NO: 1324169 - RNA, 22 nt, Human
gcccgggcccccgccgcugccu

SEQ ID NO: 1324170 - RNA, 23 nt, Human
gcccgggcccccgccgcugccuc

SEQ ID NO: 1324171 - RNA, 22 nt, Human
gcgcagcagcucuagcucgcgc

SEQ ID NO: 1324172 - RNA, 21 nt, Human
gucugggugguggccucgcgu

SEQ ID NO: 1324173 - RNA, 24 nt, Human
guggggccagagugagccccuucc

SEQ ID NO: 1324174 - RNA, 24 nt, Human
uagcaggggacccuggacccuucu

SEQ ID NO: 1324175 - RNA, 20 nt, Human
uagguguagugagccagacg

SEQ ID NO: 1324176 - RNA, 20 nt, Human
ucggcacagcuccacggggu

SEQ ID NO: 1324177 - RNA, 24 nt, Human
ugccacagucaccccaacugaaau

SEQ ID NO: 1324178 - RNA, 20 nt, Human
ugcuccaggcuggcgcgcag

SEQ ID NO: 1324179 - RNA, 18 nt, Human
ugguggggccagagugag

SEQ ID NO: 1324180 - RNA, 22 nt, Human
aagcagauggaaagccccccuc

SEQ ID NO: 1324181 - RNA, 25 nt, Human
aagguauuccugucccaggucaucg

SEQ ID NO: 1324182 - RNA, 20 nt, Human
acaaggccacgcugcggcag

SEQ ID NO: 1324183 - RNA, 24 nt, Human
acggagccuugugcccugagcccu

SEQ ID NO: 1324184 - RNA, 19 nt, Human
agagcccuucacagcugcc

SEQ ID NO: 1324185 - RNA, 24 nt, Human
agaggaaacgggucuccucuucgg

SEQ ID NO: 1324186 - RNA, 23 nt, Human
agcagagcccuucacagcugccu

SEQ ID NO: 1324187 - RNA, 24 nt, Human
aggagaccccagcucacguucucc

SEQ ID NO: 1324188 - RNA, 21 nt, Human
aggaggagggaacagcagagc

SEQ ID NO: 1324189 - RNA, 18 nt, Human
aggccccaggacagcgug

SEQ ID NO: 1324190 - RNA, 18 nt, Human
agguggagcugaaagggc

SEQ ID NO: 1324191 - RNA, 19 nt, Human
agugaauuaaacaaaaaga

SEQ ID NO: 1324192 - RNA, 20 nt, Human
caccgccccgcgugucgcag

SEQ ID NO: 1324193 - RNA, 19 nt, Human
cacugaaccacacugccca

SEQ ID NO: 1324194 - RNA, 24 nt, Human
cacugaaccacacugcccaggggc

SEQ ID NO: 1324195 - RNA, 20 nt, Human
cagauggaaagccccccagc

SEQ ID NO: 1324196 - RNA, 20 nt, Human
cagccggguccucuuccccc

SEQ ID NO: 1324197 - RNA, 22 nt, Human
cagcgagccgcaggacgaacac

SEQ ID NO: 1324198 - RNA, 20 nt, Human
ccaaacagcugauggugggc

SEQ ID NO: 1324199 - RNA, 20 nt, Human
ccacacugcccaggggccuc

SEQ ID NO: 1324200 - RNA, 19 nt, Human
cccaggacagcgugcagga

SEQ ID NO: 1324201 - RNA, 18 nt, Human
cccaggucaucgagucgc

SEQ ID NO: 1324202 - RNA, 21 nt, Human
ccccagcucacguucuccucg

SEQ ID NO: 1324203 - RNA, 25 nt, Human
cccccgggugccgccuggcugugcg

SEQ ID NO: 1324204 - RNA, 22 nt, Human
cccugagcccuggacacagccc

SEQ ID NO: 1324205 - RNA, 20 nt, Human
cccugcuaggaugcugcugu

SEQ ID NO: 1324206 - RNA, 18 nt, Human
ccgcacugcugcaggcug

SEQ ID NO: 1324207 - RNA, 19 nt, Human
ccgcacugcugcaggcugu

SEQ ID NO: 1324208 - RNA, 22 nt, Human
ccggcaguccucccgccucucc

SEQ ID NO: 1324209 - RNA, 25 nt, Human
ccugagcccuggacacagcccuggc

SEQ ID NO: 1324210 - RNA, 24 nt, Human
ccuggacagucccgugggcuuccg

SEQ ID NO: 1324211 - RNA, 19 nt, Human
ccuguguucuuccgaggag

SEQ ID NO: 1324212 - RNA, 25 nt, Human
cgccagcgagccgcaggacgaacac

SEQ ID NO: 1324213 - RNA, 26 nt, Human
cggagugggcagcguggacaaggcca

SEQ ID NO: 1324214 - RNA, 23 nt, Human
cgugcaggacgugucugcgcggg

SEQ ID NO: 1324215 - RNA, 22 nt, Human
cguggaucacagaugcucucuc

SEQ ID NO: 1324216 - RNA, 24 nt, Human
cguuucucaccgcuggucaccgug

SEQ ID NO: 1324217 - RNA, 24 nt, Human
cucgcagcguucggccuguugaau

SEQ ID NO: 1324218 - RNA, 25 nt, Human
cugcccagcuaacggagccuugugc

SEQ ID NO: 1324219 - RNA, 19 nt, Human
cugccuguuugacuuguga

SEQ ID NO: 1324220 - RNA, 25 nt, Human
cugcugcccagcuaacggagccuug

SEQ ID NO: 1324221 - RNA, 21 nt, Human
cuguaguguauuucugcagcu

SEQ ID NO: 1324222 - RNA, 27 nt, Human
cuuccgggagcccggugucacaccgcc

SEQ ID NO: 1324223 - RNA, 22 nt, Human
gaaaacaggaggagggaacagc

SEQ ID NO: 1324224 - RNA, 21 nt, Human
gagaagugacacagagaaggc

SEQ ID NO: 1324225 - RNA, 19 nt, Human
gagcaguuggugaggagac

SEQ ID NO: 1324226 - RNA, 18 nt, Human
gagcccauagaacugcca

SEQ ID NO: 1324227 - RNA, 19 nt, Human
gagcccggugucacaccgc

SEQ ID NO: 1324228 - RNA, 19 nt, Human
gaugcugcuguuuggaggc

SEQ ID NO: 1324229 - RNA, 22 nt, Human
gaugugaaaacaggaggaggga

SEQ ID NO: 1324230 - RNA, 23 nt, Human
gcauggucaacuaugccagcacc

SEQ ID NO: 1324231 - RNA, 19 nt, Human
gcccaaugccacccgggug

SEQ ID NO: 1324232 - RNA, 24 nt, Human
gcccugagcccuggacacagcccu

SEQ ID NO: 1324233 - RNA, 21 nt, Human
gcgaagcagauggaaagcccc

SEQ ID NO: 1324234 - RNA, 18 nt, Human
gcugcaggcugugcgccg

SEQ ID NO: 1324235 - RNA, 21 nt, Human
gcugcugcccagcuaacggag

SEQ ID NO: 1324236 - RNA, 20 nt, Human
ggacagucccgugggcuucc

SEQ ID NO: 1324237 - RNA, 21 nt, Human
ggcaguccucccgccucuccg

SEQ ID NO: 1324238 - RNA, 21 nt, Human
ggccucagccuccucuccugg

SEQ ID NO: 1324239 - RNA, 24 nt, Human
gggaacagcagagcccuucacagc

SEQ ID NO: 1324240 - RNA, 18 nt, Human
gggcaaagagugaagggg

SEQ ID NO: 1324241 - RNA, 19 nt, Human
gggccagcugcugcccagc

SEQ ID NO: 1324242 - RNA, 20 nt, Human
ggggguugggguggggggag

SEQ ID NO: 1324243 - RNA, 20 nt, Human
gggguggggggagcaguugg

SEQ ID NO: 1324244 - RNA, 22 nt, Human
ggucaucguggugacagacggg

SEQ ID NO: 1324245 - RNA, 18 nt, Human
ggugacagacgggaggcc

SEQ ID NO: 1324246 - RNA, 19 nt, Human
gguggagcugaaagggcug

SEQ ID NO: 1324247 - RNA, 22 nt, Human
guggacaaggccacgcugcggc

SEQ ID NO: 1324248 - RNA, 22 nt, Human
guggagcugaaagggcuguuuc

SEQ ID NO: 1324249 - RNA, 22 nt, Human
guuccagguccccugacaucag

SEQ ID NO: 1324250 - RNA, 19 nt, Human
uaaggcagagaaauuuuua

SEQ ID NO: 1324251 - RNA, 18 nt, Human
ucagcaagguacgugcac

SEQ ID NO: 1324252 - RNA, 27 nt, Human
ucccuccgggcaucucagagcugccug

SEQ ID NO: 1324253 - RNA, 20 nt, Human
ucgcugcgggcucaugucuc

SEQ ID NO: 1324254 - RNA, 21 nt, Human
ucggccagccggguccucuuc

SEQ ID NO: 1324255 - RNA, 23 nt, Human
ucgugcauuuuuuuuuccuucug

SEQ ID NO: 1324256 - RNA, 24 nt, Human
ucucagucagaggaaacgggucuc

SEQ ID NO: 1324257 - RNA, 19 nt, Human
ugaauuaaacaaaaagauu

SEQ ID NO: 1324258 - RNA, 22 nt, Human
ugacaucagcaagguacgugca

SEQ ID NO: 1324259 - RNA, 18 nt, Human
ugacuugugagcaaccuu

SEQ ID NO: 1324260 - RNA, 21 nt, Human
ugauccugggagcacugggga

SEQ ID NO: 1324261 - RNA, 22 nt, Human
ugauccugggagcacuggggag

SEQ ID NO: 1324262 - RNA, 21 nt, Human
ugauggugggcaaagagugaa

SEQ ID NO: 1324263 - RNA, 19 nt, Human
ugcccugagcccuggacac

SEQ ID NO: 1324264 - RNA, 22 nt, Human
ugcccugagcccuggacacagc

SEQ ID NO: 1324265 - RNA, 24 nt, Human
ugcccugagcccuggacacagccc

SEQ ID NO: 1324266 - RNA, 23 nt, Human
ugccugcagacacuuugauuccc

SEQ ID NO: 1324267 - RNA, 22 nt, Human
ugcggcagaucgccagcgagcc

SEQ ID NO: 1324268 - RNA, 22 nt, Human
ugcugcuguuuggaggcucccg

SEQ ID NO: 1324269 - RNA, 19 nt, Human
ugcuucccacugaaccaca

SEQ ID NO: 1324270 - RNA, 19 nt, Human
ugggccagcugcugcccag

SEQ ID NO: 1324271 - RNA, 21 nt, Human
ugggguggggggagcaguugg

SEQ ID NO: 1324272 - RNA, 19 nt, Human
uggugaggagaccccagcu

SEQ ID NO: 1324273 - RNA, 21 nt, Human
uggugggcaaagagugaaggg

SEQ ID NO: 1324274 - RNA, 18 nt, Human
ugucgcagguggucaucg

SEQ ID NO: 1324275 - RNA, 18 nt, Human
uguuagcuaggucauugc

SEQ ID NO: 1324276 - RNA, 21 nt, Human
uuagagugaauuaaacaaaaa

SEQ ID NO: 1324277 - RNA, 23 nt, Human
uugggguggggggagcaguuggu

SEQ ID NO: 1324278 - RNA, 21 nt, Human
uuucaugggccagcugcugcc

SEQ ID NO: 1324279 - RNA, 18 nt, Human
aagacucuucccucuccc

SEQ ID NO: 1324280 - RNA, 20 nt, Human
aagacucuucccucucccua

SEQ ID NO: 1324281 - RNA, 22 nt, Human
acaguacugaaaagaaaaccac

SEQ ID NO: 1324282 - RNA, 22 nt, Human
caggccccagauucuuggaaaa

SEQ ID NO: 1324283 - RNA, 23 nt, Human
caggccccagauucuuggaaagg

SEQ ID NO: 1324284 - RNA, 18 nt, Human
caucccaggccccagauu

SEQ ID NO: 1324285 - RNA, 20 nt, Human
cccuauuguugccaaaauaa

SEQ ID NO: 1324286 - RNA, 21 nt, Human
ccucucccuauuguugccaaa

SEQ ID NO: 1324287 - RNA, 26 nt, Human
ccucucccuauuguugccaaaauaac

SEQ ID NO: 1324288 - RNA, 22 nt, Human
cgagugucuucagaaaagcuga

SEQ ID NO: 1324289 - RNA, 22 nt, Human
cuugaagacucuucccucuccc

SEQ ID NO: 1324290 - RNA, 20 nt, Human
gacucuucccucucccuauu

SEQ ID NO: 1324291 - RNA, 18 nt, Human
ucuucccucucccuauug

SEQ ID NO: 1324292 - RNA, 18 nt, Human
ugaaaagaaaaccaccac

SEQ ID NO: 1324293 - RNA, 26 nt, Human
ugaaaagaaaaccaccaccaaucuug

SEQ ID NO: 1324294 - RNA, 18 nt, Human
ugaagacucuucccucuc

SEQ ID NO: 1324295 - RNA, 21 nt, Human
ugccaaaauaacugccucuga

SEQ ID NO: 1324296 - RNA, 23 nt, Human
ugccaaaauaacugccucugauc

SEQ ID NO: 1324297 - RNA, 22 nt, Human
ugccucugaucuguuuuuguuu

SEQ ID NO: 1324298 - RNA, 18 nt, Human
uggaaaacaguacugaaa

SEQ ID NO: 1324299 - RNA, 24 nt, Human
uggaaaacaguacugaaaagaaaa

SEQ ID NO: 1324300 - RNA, 22 nt, Human
uuggaaaacaguacugaaaaga

SEQ ID NO: 1324301 - RNA, 18 nt, Human
uuuuuguuugcaucccag

SEQ ID NO: 1324302 - RNA, 21 nt, Human
aaggcuuuuaggggagugggg

SEQ ID NO: 1324303 - RNA, 18 nt, Human
agaagcaucuucagggag

SEQ ID NO: 1324304 - RNA, 19 nt, Human
agugggggcacagcuggag

SEQ ID NO: 1324305 - RNA, 24 nt, Human
caucuucagggagggagucgggga

SEQ ID NO: 1324306 - RNA, 25 nt, Human
ccugagaagcaucuucagggaggga

SEQ ID NO: 1324307 - RNA, 30 nt, Human
cugugguacgagagguacaggggagguguu

SEQ ID NO: 1324308 - RNA, 19 nt, Human
cuuuuaggggagugggggc

SEQ ID NO: 1324309 - RNA, 22 nt, Human
ggaauacaaggcuuuuagggga

SEQ ID NO: 1324310 - RNA, 22 nt, Human
ggaggugucuggacuucuggag

SEQ ID NO: 1324311 - RNA, 23 nt, Human
gggaauacaaggcuuuuagggga

SEQ ID NO: 1324312 - RNA, 20 nt, Human
ggggagugggggcacagcug

SEQ ID NO: 1324313 - RNA, 20 nt, Human
uacaaggcuuuuaggggagu

SEQ ID NO: 1324314 - RNA, 31 nt, Human
ucugugguacgagagguacaggggagguguu

SEQ ID NO: 1324315 - RNA, 21 nt, Human
ugggagccugagaagcaucuu

SEQ ID NO: 1324316 - RNA, 22 nt, Human
ugguggggccagagggaaccug

SEQ ID NO: 1324317 - RNA, 21 nt, Human
acaaaguaaaauccuuccuuc

SEQ ID NO: 1324318 - RNA, 18 nt, Human
agauuuugucauucacag

SEQ ID NO: 1324319 - RNA, 20 nt, Human
caacaaagccccaaggcaca

SEQ ID NO: 1324320 - RNA, 26 nt, Human
caacaaagccccaaggcacagcuuga

SEQ ID NO: 1324321 - RNA, 20 nt, Human
caccguagggaaaaccuugg

SEQ ID NO: 1324322 - RNA, 19 nt, Human
cacucuggcuuucuuaguc

SEQ ID NO: 1324323 - RNA, 25 nt, Human
cagugaaccuaucucuuguggcacc

SEQ ID NO: 1324324 - RNA, 26 nt, Human
ccagauucugcacucuggcuuucuua

SEQ ID NO: 1324325 - RNA, 21 nt, Human
cuucagcacuucuggccuacc

SEQ ID NO: 1324326 - RNA, 19 nt, Human
gacagggccuucugaugug

SEQ ID NO: 1324327 - RNA, 22 nt, Human
gagcacagugaaccuaucucuu

SEQ ID NO: 1324328 - RNA, 20 nt, Human
gcccuggagcacagugaacc

SEQ ID NO: 1324329 - RNA, 24 nt, Human
gugaaccuaucucuuguggcaccc

SEQ ID NO: 1324330 - RNA, 22 nt, Human
uaauguccccauugauuccaca

SEQ ID NO: 1324331 - RNA, 23 nt, Human
uccacagggucacugccugauuu

SEQ ID NO: 1324332 - RNA, 18 nt, Human
uccagauucugcacucug

SEQ ID NO: 1324333 - RNA, 18 nt, Human
uccagauucugcacucug

SEQ ID NO: 1324334 - RNA, 25 nt, Human
ucuccggaauaaccuuaacugaucu

SEQ ID NO: 1324335 - RNA, 21 nt, Human
ugacagggccuucugaugugg

SEQ ID NO: 1324336 - RNA, 19 nt, Human
uggagcacagugaaccuau

SEQ ID NO: 1324337 - RNA, 18 nt, Human
uggcacccugacucgccu

SEQ ID NO: 1324338 - RNA, 21 nt, Human
caccuuuauuguguccggggg

SEQ ID NO: 1324339 - RNA, 20 nt, Human
uccuggggccuggggucacc

SEQ ID NO: 1324340 - RNA, 19 nt, Human
ucgcucccuuuccuggggc

SEQ ID NO: 1324341 - RNA, 22 nt, Human
uggggucaccuccccucucugg

SEQ ID NO: 1324342 - RNA, 18 nt, Human
uguccucgcucccuuucc

SEQ ID NO: 1324343 - RNA, 22 nt, Human
accccaaggaggaccgguggag

SEQ ID NO: 1324344 - RNA, 23 nt, Human
ccgccgcgccccucccggaggcc

SEQ ID NO: 1324345 - RNA, 18 nt, Human
ccgcgccccucccggagg

SEQ ID NO: 1324346 - RNA, 20 nt, Human
cucggcggcgguggcguccu

SEQ ID NO: 1324347 - RNA, 19 nt, Human
gaccgguggagccugcggu

SEQ ID NO: 1324348 - RNA, 18 nt, Human
gcggccgccgcgccccuc

SEQ ID NO: 1324349 - RNA, 24 nt, Human
gcucuucgugauugggggcgccag

SEQ ID NO: 1324350 - RNA, 19 nt, Human
ggcgguggcguccugcgcg

SEQ ID NO: 1324351 - RNA, 21 nt, Human
gugagcucggcggcgguggcg

SEQ ID NO: 1324352 - RNA, 18 nt, Human
ucccggaggccgugagcu

SEQ ID NO: 1324353 - RNA, 21 nt, Human
ucggcggcgguggcguccugc

SEQ ID NO: 1324354 - RNA, 20 nt, Human
ugaccccaaggaggaccggg

SEQ ID NO: 1324355 - RNA, 22 nt, Human
agacuuuaagaauuuacuuggu

SEQ ID NO: 1324356 - RNA, 23 nt, Human
agaggcuuccccugaacaggggu

SEQ ID NO: 1324357 - RNA, 23 nt, Human
aggaaggacccggggucccaggg

SEQ ID NO: 1324358 - RNA, 23 nt, Human
aggcacagcuugcagggguuagc

SEQ ID NO: 1324359 - RNA, 19 nt, Human
caagaggcuuccccugaac

SEQ ID NO: 1324360 - RNA, 21 nt, Human
cagcuugcagggguuagcuga

SEQ ID NO: 1324361 - RNA, 21 nt, Human
caggaaggacccgggguccca

SEQ ID NO: 1324362 - RNA, 21 nt, Human
cccuucagcaacaccuccugg

SEQ ID NO: 1324363 - RNA, 21 nt, Human
cggcagggcgauggccgcaac

SEQ ID NO: 1324364 - RNA, 27 nt, Human
cucuaggucauuccaggcacagcuugc

SEQ ID NO: 1324365 - RNA, 27 nt, Human
cugaucuuaagaaaggaauggggcaca

SEQ ID NO: 1324366 - RNA, 20 nt, Human
cugcuauccccuucagcaac

SEQ ID NO: 1324367 - RNA, 20 nt, Human
uaagcagauauaagcugcga

SEQ ID NO: 1324368 - RNA, 22 nt, Human
uacugccuccuccucaggucuc

SEQ ID NO: 1324369 - RNA, 22 nt, Human
ucagaucccuaacuguucccag

SEQ ID NO: 1324370 - RNA, 24 nt, Human
ucagaucccuaacuguucccagac

SEQ ID NO: 1324371 - RNA, 21 nt, Human
ucagcccuuccacucacuguu

SEQ ID NO: 1324372 - RNA, 19 nt, Human
ugauuucugggguccuaca

SEQ ID NO: 1324373 - RNA, 25 nt, Human
ugccuccuccucaggucucugcuau

SEQ ID NO: 1324374 - RNA, 22 nt, Human
ugggguccuacaggaaggaccc

SEQ ID NO: 1324375 - RNA, 20 nt, Human
aagccacugaugauuuagga

SEQ ID NO: 1324376 - RNA, 24 nt, Human
aggcaaguaugaaccacuuugagg

SEQ ID NO: 1324377 - RNA, 26 nt, Human
auaaagccuugaaccauauucugcaa

SEQ ID NO: 1324378 - RNA, 22 nt, Human
cauggcagcccuucuugccuuu

SEQ ID NO: 1324379 - RNA, 19 nt, Human
cuggacauguggcauggcc

SEQ ID NO: 1324380 - RNA, 22 nt, Human
gcaaguaugaaccacuuugagg

SEQ ID NO: 1324381 - RNA, 21 nt, Human
ggugcgguaucaucuaagaga

SEQ ID NO: 1324382 - RNA, 18 nt, Human
guccuacaagaagaaaag

SEQ ID NO: 1324383 - RNA, 25 nt, Human
uaagcauuguacuuagaauaaucuu

SEQ ID NO: 1324384 - RNA, 18 nt, Human
uaagccacugaugauuua

SEQ ID NO: 1324385 - RNA, 20 nt, Human
uaccccauucgcaucaggau

SEQ ID NO: 1324386 - RNA, 19 nt, Human
ucuaaaaaacauggcagcc

SEQ ID NO: 1324387 - RNA, 21 nt, Human
ugccacuggcgcuaccgcugg

SEQ ID NO: 1324388 - RNA, 18 nt, Human
uggauuucugaggaacau

SEQ ID NO: 1324389 - RNA, 21 nt, Human
uggcagcccuucuugccuuug

SEQ ID NO: 1324390 - RNA, 26 nt, Human
uggcagcccuucuugccuuuguuuuu

SEQ ID NO: 1324391 - RNA, 23 nt, Human
uggcauggccuucuguaccaacu

SEQ ID NO: 1324392 - RNA, 24 nt, Human
ugggugcgguaucaucuaagagaa

SEQ ID NO: 1324393 - RNA, 22 nt, Human
uguggcauggccuucuguacca

SEQ ID NO: 1324394 - RNA, 21 nt, Human
uucuuuaagccacugaugauu

SEQ ID NO: 1324395 - RNA, 25 nt, Human
aaaaaaaaacuccaggauccccagc

SEQ ID NO: 1324396 - RNA, 21 nt, Human
aaaaacuccaggauccccgcc

SEQ ID NO: 1324397 - RNA, 24 nt, Human
aaacugcaacucucuucagcacca

SEQ ID NO: 1324398 - RNA, 20 nt, Human
aaccuccaucucccuggguc

SEQ ID NO: 1324399 - RNA, 23 nt, Human
aaugcagggcugagguuuccaag

SEQ ID NO: 1324400 - RNA, 23 nt, Human
aaugguggcauccugccugacac

SEQ ID NO: 1324401 - RNA, 18 nt, Human
acagauguaagccaccgu

SEQ ID NO: 1324402 - RNA, 24 nt, Human
acagcccagagguccacuccccca

SEQ ID NO: 1324403 - RNA, 21 nt, Human
acaggcacccgucaccaugcc

SEQ ID NO: 1324404 - RNA, 20 nt, Human
acaggguuucaccacguuag

SEQ ID NO: 1324405 - RNA, 22 nt, Human
acugcaauaucaagguccaggc

SEQ ID NO: 1324406 - RNA, 19 nt, Human
agaaagcagaucaagaucu

SEQ ID NO: 1324407 - RNA, 24 nt, Human
agagagaagccagagugaagagaa

SEQ ID NO: 1324408 - RNA, 22 nt, Human
agagcccagugccuguugggga

SEQ ID NO: 1324409 - RNA, 27 nt, Human
agagcugggauucgaaacaagggccga

SEQ ID NO: 1324410 - RNA, 21 nt, Human
agagugaagagaaaaaaaaac

SEQ ID NO: 1324411 - RNA, 19 nt, Human
agagugcugggauuacaga

SEQ ID NO: 1324412 - RNA, 23 nt, Human
agauguaagccaccgugcccggc

SEQ ID NO: 1324413 - RNA, 18 nt, Human
agcaugguggggagagaa

SEQ ID NO: 1324414 - RNA, 20 nt, Human
agcgaggaaugcagggcuga

SEQ ID NO: 1324415 - RNA, 19 nt, Human
aggcuggagugcaguggca

SEQ ID NO: 1324416 - RNA, 18 nt, Human
agggaguagggguggggg

SEQ ID NO: 1324417 - RNA, 19 nt, Human
aggggcagcagggagggca

SEQ ID NO: 1324418 - RNA, 18 nt, Human
aguagcugggauuacagg

SEQ ID NO: 1324419 - RNA, 25 nt, Human
aguagcugggauuacaggcacccgu

SEQ ID NO: 1324420 - RNA, 21 nt, Human
agugaagagaaaaaaaaacuc

SEQ ID NO: 1324421 - RNA, 23 nt, Human
agugcaguggcacgcucuuggcu

SEQ ID NO: 1324422 - RNA, 24 nt, Human
agugcaguggcacgcucuuggcuc

SEQ ID NO: 1324423 - RNA, 24 nt, Human
auuuuuguauuuuuaguagagaca

SEQ ID NO: 1324424 - RNA, 24 nt, Human
caaaucccgacauacagaaaccag

SEQ ID NO: 1324425 - RNA, 21 nt, Human
caaccuccaucucccuggguc

SEQ ID NO: 1324426 - RNA, 22 nt, Human
caagccauucuccugccucagc

SEQ ID NO: 1324427 - RNA, 27 nt, Human
caccacguuagccaggcugaucuugaa

SEQ ID NO: 1324428 - RNA, 24 nt, Human
caccaugcccggcuaauuuuugua

SEQ ID NO: 1324429 - RNA, 23 nt, Human
cacguuagccaggcugaucuuga

SEQ ID NO: 1324430 - RNA, 24 nt, Human
cacguuagccaggcugaucuugaa

SEQ ID NO: 1324431 - RNA, 24 nt, Human
cagagugcugggauuacagaugua

SEQ ID NO: 1324432 - RNA, 22 nt, Human
caggauccccagccaggacucc

SEQ ID NO: 1324433 - RNA, 19 nt, Human
caggcacccaucugagcuc

SEQ ID NO: 1324434 - RNA, 24 nt, Human
caggguuucaccacguuagccagg

SEQ ID NO: 1324435 - RNA, 20 nt, Human
cagguagaagcauggugggg

SEQ ID NO: 1324436 - RNA, 23 nt, Human
cagguagccuaaggagaaagccc

SEQ ID NO: 1324437 - RNA, 20 nt, Human
caucucccuggguccaagcc

SEQ ID NO: 1324438 - RNA, 25 nt, Human
ccaagccauucuccugccucagccu

SEQ ID NO: 1324439 - RNA, 18 nt, Human
ccacaguugcuggaggag

SEQ ID NO: 1324440 - RNA, 22 nt, Human
ccacucccccaggcccugcacc

SEQ ID NO: 1324441 - RNA, 20 nt, Human
ccagagcagcagcugguggg

SEQ ID NO: 1324442 - RNA, 21 nt, Human
ccagagugcugggauuacaga

SEQ ID NO: 1324443 - RNA, 22 nt, Human
ccagagugcugggauuacagau

SEQ ID NO: 1324444 - RNA, 24 nt, Human
ccagagugcugggauuacagaugu

SEQ ID NO: 1324445 - RNA, 20 nt, Human
ccagcaucugugggagacag

SEQ ID NO: 1324446 - RNA, 19 nt, Human
cccccaggcccugcaccug

SEQ ID NO: 1324447 - RNA, 23 nt, Human
ccccccugccucucuccuguccc

SEQ ID NO: 1324448 - RNA, 18 nt, Human
cccccugccucucuccug

SEQ ID NO: 1324449 - RNA, 19 nt, Human
ccccgcccagaccaucucc

SEQ ID NO: 1324450 - RNA, 19 nt, Human
ccccucacagcccagaggu

SEQ ID NO: 1324451 - RNA, 19 nt, Human
ccccucaccuuuguggagg

SEQ ID NO: 1324452 - RNA, 18 nt, Human
ccccuuggagcgaggaau

SEQ ID NO: 1324453 - RNA, 23 nt, Human
cccgaguagcugggauuacaggc

SEQ ID NO: 1324454 - RNA, 24 nt, Human
cccgaguagcugggauuacaggca

SEQ ID NO: 1324455 - RNA, 21 nt, Human
cccugcaaccuccaucucccu

SEQ ID NO: 1324456 - RNA, 19 nt, Human
cccugccucucuccugucc

SEQ ID NO: 1324457 - RNA, 20 nt, Human
cccuggagagagaagccaga

SEQ ID NO: 1324458 - RNA, 21 nt, Human
cccuggguccaagccauucuc

SEQ ID NO: 1324459 - RNA, 22 nt, Human
cccuuggggcccagcuccaccc

SEQ ID NO: 1324460 - RNA, 23 nt, Human
ccgaguagcugggauuacaggca

SEQ ID NO: 1324461 - RNA, 19 nt, Human
ccucacagcccagaggucc

SEQ ID NO: 1324462 - RNA, 23 nt, Human
ccuccacccugacucccuucaaa

SEQ ID NO: 1324463 - RNA, 18 nt, Human
ccugacuucaggugaucc

SEQ ID NO: 1324464 - RNA, 24 nt, Human
ccugccucagccucccgaguagcu

SEQ ID NO: 1324465 - RNA, 26 nt, Human
ccuuguccccucaccuuuguggaggu

SEQ ID NO: 1324466 - RNA, 24 nt, Human
cgggggacccuggggaccuccuca

SEQ ID NO: 1324467 - RNA, 21 nt, Human
cucacagcccagagguccacu

SEQ ID NO: 1324468 - RNA, 24 nt, Human
cucagccucccgaguagcugggau

SEQ ID NO: 1324469 - RNA, 21 nt, Human
cucauagccccccacaggcac

SEQ ID NO: 1324470 - RNA, 20 nt, Human
cuccacccccgcccagaccu

SEQ ID NO: 1324471 - RNA, 23 nt, Human
cuccagccccagcagggaugguu

SEQ ID NO: 1324472 - RNA, 24 nt, Human
cucucuccuguccccucacagccc

SEQ ID NO: 1324473 - RNA, 23 nt, Human
cucucuugucgaccaggcuggag

SEQ ID NO: 1324474 - RNA, 18 nt, Human
cugcaaccuccaucuccc

SEQ ID NO: 1324475 - RNA, 24 nt, Human
cugccgcggccucccagagugcug

SEQ ID NO: 1324476 - RNA, 18 nt, Human
cugccucucuccuguccc

SEQ ID NO: 1324477 - RNA, 19 nt, Human
cuucugccgcggccuccca

SEQ ID NO: 1324478 - RNA, 21 nt, Human
cuucugccgcggccucccaga

SEQ ID NO: 1324479 - RNA, 19 nt, Human
cuuggcucccugcaaccuc

SEQ ID NO: 1324480 - RNA, 19 nt, Human
cuuuaguuccccccugccu

SEQ ID NO: 1324481 - RNA, 19 nt, Human
gacacaggggcagcaggga

SEQ ID NO: 1324482 - RNA, 23 nt, Human
gacgggggacccuggggaccucc

SEQ ID NO: 1324483 - RNA, 22 nt, Human
gacuucaggugauccuucugcc

SEQ ID NO: 1324484 - RNA, 19 nt, Human
gagcagcagcuggugggga

SEQ ID NO: 1324485 - RNA, 19 nt, Human
gagcagcagcuggugggga

SEQ ID NO: 1324486 - RNA, 21 nt, Human
gagcagcagcugguggggaag

SEQ ID NO: 1324487 - RNA, 23 nt, Human
gagcagcagcugguggggaagca

SEQ ID NO: 1324488 - RNA, 19 nt, Human
gaguagggguggggguguu

SEQ ID NO: 1324489 - RNA, 18 nt, Human
gauuacagauguaagcca

SEQ ID NO: 1324490 - RNA, 20 nt, Human
gauuacagauguaagccacc

SEQ ID NO: 1324491 - RNA, 24 nt, Human
gauuacaggcacccgucaccaugc

SEQ ID NO: 1324492 - RNA, 19 nt, Human
gcaauaucaagguccaggc

SEQ ID NO: 1324493 - RNA, 20 nt, Human
gcagggcugagguuuccaag

SEQ ID NO: 1324494 - RNA, 22 nt, Human
gccaccgugcccggccuucuau

SEQ ID NO: 1324495 - RNA, 22 nt, Human
gcccggcuaauuuuuguauuuu

SEQ ID NO: 1324496 - RNA, 22 nt, Human
gcccuuguccccucaccuuugu

SEQ ID NO: 1324497 - RNA, 25 nt, Human
gcccuuguccccucaccuuugugga

SEQ ID NO: 1324498 - RNA, 20 nt, Human
gccucagccucccgaguagc

SEQ ID NO: 1324499 - RNA, 21 nt, Human
ggaggcuugaggaguggcagg

SEQ ID NO: 1324500 - RNA, 24 nt, Human
ggauuacagauguaagccaccgug

SEQ ID NO: 1324501 - RNA, 22 nt, Human
ggcagcagggagggcaggccag

SEQ ID NO: 1324502 - RNA, 22 nt, Human
ggccagcaucugugggagacag

SEQ ID NO: 1324503 - RNA, 24 nt, Human
ggcccgacgggggacccuggggac

SEQ ID NO: 1324504 - RNA, 24 nt, Human
ggcugaucuugaacuccugacuuc

SEQ ID NO: 1324505 - RNA, 18 nt, Human
gggaagcaaagagcccag

SEQ ID NO: 1324506 - RNA, 20 nt, Human
gggaagcaaagagcccagug

SEQ ID NO: 1324507 - RNA, 25 nt, Human
gggaccuccucauagccccccacag

SEQ ID NO: 1324508 - RNA, 24 nt, Human
gggaggcuugaggaguggcaggag

SEQ ID NO: 1324509 - RNA, 19 nt, Human
gggcagcagggagggcagg

SEQ ID NO: 1324510 - RNA, 22 nt, Human
gggccagagcugggauucgaaa

SEQ ID NO: 1324511 - RNA, 18 nt, Human
gggcccagcuccaccccc

SEQ ID NO: 1324512 - RNA, 20 nt, Human
gggggacccuggggaccucc

SEQ ID NO: 1324513 - RNA, 19 nt, Human
gguagaagcauggugggga

SEQ ID NO: 1324514 - RNA, 19 nt, Human
ggugguguggcagacacag

SEQ ID NO: 1324515 - RNA, 21 nt, Human
ggugguguggcagacacaggg

SEQ ID NO: 1324516 - RNA, 18 nt, Human
guagcugggauuacaggc

SEQ ID NO: 1324517 - RNA, 19 nt, Human
gucgaccaggcuggagugc

SEQ ID NO: 1324518 - RNA, 18 nt, Human
uaagggccagagcuggga

SEQ ID NO: 1324519 - RNA, 24 nt, Human
uaauuuuuguauuuuuaguagaga

SEQ ID NO: 1324520 - RNA, 23 nt, Human
uacagauguaagccaccgugccc

SEQ ID NO: 1324521 - RNA, 23 nt, Human
uacaggcacccgucaccaugccc

SEQ ID NO: 1324522 - RNA, 19 nt, Human
uagaagcaugguggggaga

SEQ ID NO: 1324523 - RNA, 22 nt, Human
uagagacaggguuucaccacgu

SEQ ID NO: 1324524 - RNA, 23 nt, Human
uagaucuccuccacccugacucc

SEQ ID NO: 1324525 - RNA, 24 nt, Human
uagccaggcugaucuugaacuccu

SEQ ID NO: 1324526 - RNA, 19 nt, Human
uaguagagacaggguuuca

SEQ ID NO: 1324527 - RNA, 26 nt, Human
uaguagagacaggguuucaccacguu

SEQ ID NO: 1324528 - RNA, 20 nt, Human
ucagccucccgaguagcugg

SEQ ID NO: 1324529 - RNA, 18 nt, Human
uccaagccauucuccugc

SEQ ID NO: 1324530 - RNA, 19 nt, Human
uccacaguugcuggaggag

SEQ ID NO: 1324531 - RNA, 18 nt, Human
ucccagagugcugggauu

SEQ ID NO: 1324532 - RNA, 23 nt, Human
ucccagagugcugggauuacaga

SEQ ID NO: 1324533 - RNA, 24 nt, Human
uccccucacagcccagagguccac

SEQ ID NO: 1324534 - RNA, 19 nt, Human
uccccucaccuuuguggag

SEQ ID NO: 1324535 - RNA, 20 nt, Human
ucccgacuccagccccagca

SEQ ID NO: 1324536 - RNA, 24 nt, Human
ucccgaguagcugggauuacaggc

SEQ ID NO: 1324537 - RNA, 22 nt, Human
ucccugcaaccuccaucucccu

SEQ ID NO: 1324538 - RNA, 25 nt, Human
ucccugcaaccuccaucucccuggg

SEQ ID NO: 1324539 - RNA, 22 nt, Human
ucccuggguccaagccauucuc

SEQ ID NO: 1324540 - RNA, 18 nt, Human
ucgaccaggcuggagugc

SEQ ID NO: 1324541 - RNA, 22 nt, Human
ucuagagcccuggcccuugucc

SEQ ID NO: 1324542 - RNA, 20 nt, Human
ucuauagaucuccuccaccc

SEQ ID NO: 1324543 - RNA, 24 nt, Human
ucuccugccucagccucccgagua

SEQ ID NO: 1324544 - RNA, 22 nt, Human
ucucucuugucgaccaggcugg

SEQ ID NO: 1324545 - RNA, 23 nt, Human
ucucucuugucgaccaggcugga

SEQ ID NO: 1324546 - RNA, 23 nt, Human
ucucuugucgaccaggcuggagu

SEQ ID NO: 1324547 - RNA, 18 nt, Human
ucugugggagacagguag

SEQ ID NO: 1324548 - RNA, 24 nt, Human
ucuucagcaccagagcagcagcug

SEQ ID NO: 1324549 - RNA, 23 nt, Human
ucuugaacuccugacuucaggug

SEQ ID NO: 1324550 - RNA, 18 nt, Human
ucuugucgaccaggcugg

SEQ ID NO: 1324551 - RNA, 23 nt, Human
ugacuucaggugauccuucugcc

SEQ ID NO: 1324552 - RNA, 19 nt, Human
ugaggacaacggcagggug

SEQ ID NO: 1324553 - RNA, 19 nt, Human
ugauaagggccagagcugg

SEQ ID NO: 1324554 - RNA, 22 nt, Human
ugcaguggcacgcucuuggcuc

SEQ ID NO: 1324555 - RNA, 24 nt, Human
ugcccggcuaauuuuuguauuuuu

SEQ ID NO: 1324556 - RNA, 24 nt, Human
ugccucagccucccgaguagcugg

SEQ ID NO: 1324557 - RNA, 18 nt, Human
ugcgcucagcaguggagc

SEQ ID NO: 1324558 - RNA, 18 nt, Human
ugcugggauuacagaugu

SEQ ID NO: 1324559 - RNA, 24 nt, Human
ugcugggauuacagauguaagcca

SEQ ID NO: 1324560 - RNA, 19 nt, Human
uggagggugggggcgggag

SEQ ID NO: 1324561 - RNA, 21 nt, Human
uggagggugggggcgggagcg

SEQ ID NO: 1324562 - RNA, 23 nt, Human
uggagugcaguggcacgcucuug

SEQ ID NO: 1324563 - RNA, 24 nt, Human
uggagugcaguggcacgcucuugg

SEQ ID NO: 1324564 - RNA, 19 nt, Human
uggcagacacaggggcagc

SEQ ID NO: 1324565 - RNA, 22 nt, Human
ugggagacagguagccuaagga

SEQ ID NO: 1324566 - RNA, 22 nt, Human
ugggaggcuugaggaguggcag

SEQ ID NO: 1324567 - RNA, 23 nt, Human
ugggaggcuugaggaguggcagg

SEQ ID NO: 1324568 - RNA, 21 nt, Human
ugggauuacagauguaagcca

SEQ ID NO: 1324569 - RNA, 22 nt, Human
ugggauuacagauguaagccac

SEQ ID NO: 1324570 - RNA, 23 nt, Human
ugggauuacagauguaagccacc

SEQ ID NO: 1324571 - RNA, 23 nt, Human
ugggauuacagauguaagccacc

SEQ ID NO: 1324572 - RNA, 24 nt, Human
ugggauuacagauguaagccaccg

SEQ ID NO: 1324573 - RNA, 22 nt, Human
ugggauuacaggcacccgucac

SEQ ID NO: 1324574 - RNA, 24 nt, Human
ugggauuacaggcacccgucacca

SEQ ID NO: 1324575 - RNA, 25 nt, Human
ugggauuacaggcacccgucaccau

SEQ ID NO: 1324576 - RNA, 23 nt, Human
ugggcuuuaguuccccccugccu

SEQ ID NO: 1324577 - RNA, 24 nt, Human
uggggguguucaguaccuccccuc

SEQ ID NO: 1324578 - RNA, 20 nt, Human
uggguccaagccauucuccu

SEQ ID NO: 1324579 - RNA, 19 nt, Human
ugguguggcagacacaggg

SEQ ID NO: 1324580 - RNA, 21 nt, Human
ugucgaccaggcuggagugca

SEQ ID NO: 1324581 - RNA, 24 nt, Human
uguggaggugggauuuagcuggag

SEQ ID NO: 1324582 - RNA, 19 nt, Human
uguucaguaccuccccucc

SEQ ID NO: 1324583 - RNA, 18 nt, Human
uuaguagagacaggguuu

SEQ ID NO: 1324584 - RNA, 24 nt, Human
uucagccuguccugucugccccuu

SEQ ID NO: 1324585 - RNA, 19 nt, Human
uucaggugauccuucugcc

SEQ ID NO: 1324586 - RNA, 23 nt, Human
uugcuauuuucagccuguccugu

SEQ ID NO: 1324587 - RNA, 21 nt, Human
uuggagggugggggcgggagc

SEQ ID NO: 1324588 - RNA, 24 nt, Human
uuuuuaguagagacaggguuucac

SEQ ID NO: 1324589 - RNA, 20 nt, Human
uuuuuguauuuuuaguagag

SEQ ID NO: 1324590 - RNA, 20 nt, Human
cauuuucuucugccacuugu

SEQ ID NO: 1324591 - RNA, 22 nt, Human
ucuucugccacuugucuuugac

SEQ ID NO: 1324592 - RNA, 23 nt, Human
ugucuuugacacgaugccuucag

SEQ ID NO: 1324593 - RNA, 21 nt, Human
agacaagccccgcccgccccc

SEQ ID NO: 1324594 - RNA, 21 nt, Human
ccccaccuuccucugccccuc

SEQ ID NO: 1324595 - RNA, 24 nt, Human
ccccgcccgcccccaccuuccucu

SEQ ID NO: 1324596 - RNA, 24 nt, Human
ccccgccucccccgccuuccuccu

SEQ ID NO: 1324597 - RNA, 19 nt, Human
ccccgccuuccuccucucc

SEQ ID NO: 1324598 - RNA, 20 nt, Human
ccccgccuuccuccucuccu

SEQ ID NO: 1324599 - RNA, 19 nt, Human
ccccucuggccccgccucc

SEQ ID NO: 1324600 - RNA, 22 nt, Human
cccucuggccccgccucccccg

SEQ ID NO: 1324601 - RNA, 21 nt, Human
ccgcagacaagccccgcccgc

SEQ ID NO: 1324602 - RNA, 25 nt, Human
ccgcagacaagccccgcccgccccc

SEQ ID NO: 1324603 - RNA, 19 nt, Human
ccucccccgccuuccuccu

SEQ ID NO: 1324604 - RNA, 26 nt, Human
ccugggccaucccgcagacaagcccc

SEQ ID NO: 1324605 - RNA, 18 nt, Human
ccuuccuccucuccuccc

SEQ ID NO: 1324606 - RNA, 20 nt, Human
cucuccucccucccgcgaag

SEQ ID NO: 1324607 - RNA, 21 nt, Human
gccccgccucccccgccuucc

SEQ ID NO: 1324608 - RNA, 18 nt, Human
gccucccccgccuuccuc

SEQ ID NO: 1324609 - RNA, 21 nt, Human
ggccccgccucccccgccuuc

SEQ ID NO: 1324610 - RNA, 26 nt, Human
ggccccgccucccccgccuuccuccc

SEQ ID NO: 1324611 - RNA, 18 nt, Human
ucccccgccuuccuccuc

SEQ ID NO: 1324612 - RNA, 22 nt, Human
uccuccucuccucccucccgcg

SEQ ID NO: 1324613 - RNA, 24 nt, Human
uggccccgccucccccgccuuccu

SEQ ID NO: 1324614 - RNA, 24 nt, Human
uuccuccucuccucccucccgcga

SEQ ID NO: 1324615 - RNA, 23 nt, Human
cacugaaguguugcucccucaaa

SEQ ID NO: 1324616 - RNA, 22 nt, Human
cucaaacuuccuguuccagcag

SEQ ID NO: 1324617 - RNA, 18 nt, Human
uugcucccucaaacuucc

SEQ ID NO: 1324618 - RNA, 24 nt, Human
uugcucccucaaacuuccuguucc

SEQ ID NO: 1324619 - RNA, 21 nt, Human
aaagcuuuuucagacccacuc

SEQ ID NO: 1324620 - RNA, 20 nt, Human
aagauauuuuuaucccugug

SEQ ID NO: 1324621 - RNA, 21 nt, Human
aagugagugagaggggucugg

SEQ ID NO: 1324622 - RNA, 22 nt, Human
aggagauuuuuuuuuuucucuc

SEQ ID NO: 1324623 - RNA, 18 nt, Human
aggggucuggauucuguu

SEQ ID NO: 1324624 - RNA, 21 nt, Human
cccacaaagcccaggggaccg

SEQ ID NO: 1324625 - RNA, 27 nt, Human
cccccuggggacaaggcucuaagaggc

SEQ ID NO: 1324626 - RNA, 20 nt, Human
ccccuggggacaaggcucua

SEQ ID NO: 1324627 - RNA, 23 nt, Human
ccccuggggacaaggcucuaaga

SEQ ID NO: 1324628 - RNA, 22 nt, Human
ccuguccucaaagcccccuggg

SEQ ID NO: 1324629 - RNA, 19 nt, Human
cugcaggcugaguccuguc

SEQ ID NO: 1324630 - RNA, 20 nt, Human
cuggauucuguuaggcgcug

SEQ ID NO: 1324631 - RNA, 22 nt, Human
cugugccccaaauucuguuuug

SEQ ID NO: 1324632 - RNA, 18 nt, Human
gagauuuuuuuuuuucuc

SEQ ID NO: 1324633 - RNA, 23 nt, Human
gccagucccugccccggggacac

SEQ ID NO: 1324634 - RNA, 24 nt, Human
gcccacaaagcccaggggaccgcc

SEQ ID NO: 1324635 - RNA, 21 nt, Human
gcucuaagaggcggaagugag

SEQ ID NO: 1324636 - RNA, 21 nt, Human
ggcaaaaacaugcagaaggaa

SEQ ID NO: 1324637 - RNA, 21 nt, Human
ggggacaaggcucuaagaggc

SEQ ID NO: 1324638 - RNA, 27 nt, Human
uaccaggggcccugcaggcugaguccu

SEQ ID NO: 1324639 - RNA, 19 nt, Human
uauuucaaccaugaucagu

SEQ ID NO: 1324640 - RNA, 19 nt, Human
uccaguuccuagggguaag

SEQ ID NO: 1324641 - RNA, 26 nt, Human
uccuagggguaagauauuucaacccc

SEQ ID NO: 1324642 - RNA, 24 nt, Human
ucuggauucuguuaggcgcugggg

SEQ ID NO: 1324643 - RNA, 19 nt, Human
ugaaaagaugcugugcccc

SEQ ID NO: 1324644 - RNA, 23 nt, Human
ugaaaauuucaauuccuuuggga

SEQ ID NO: 1324645 - RNA, 22 nt, Human
ugaguccuguccucaaagcccc

SEQ ID NO: 1324646 - RNA, 25 nt, Human
ugcagaaggaagucaacauaacugg

SEQ ID NO: 1324647 - RNA, 19 nt, Human
uggcaaaaacaugcagaag

SEQ ID NO: 1324648 - RNA, 22 nt, Human
uguuuuggcaaaaacaugcaga

SEQ ID NO: 1324649 - RNA, 23 nt, Human
uucaaaagauggcacuuuccagg

SEQ ID NO: 1324650 - RNA, 20 nt, Human
uucaaaaguaaaaagcuaau

SEQ ID NO: 1324651 - RNA, 18 nt, Human
uuggacccuauaaauacc

SEQ ID NO: 1324652 - RNA, 23 nt, Human
uuuuucagacccacucaggcaca

SEQ ID NO: 1324653 - RNA, 18 nt, Human
uuuuuucucucucaaagc

SEQ ID NO: 1324654 - RNA, 18 nt, Human
acagggcauccuucaaag

SEQ ID NO: 1324655 - RNA, 19 nt, Human
acucuaaaagaugacaaga

SEQ ID NO: 1324656 - RNA, 19 nt, Human
augacaagacagcuccccu

SEQ ID NO: 1324657 - RNA, 20 nt, Human
ccccucagugagacccuggc

SEQ ID NO: 1324658 - RNA, 22 nt, Human
ccccucagugagacccuggccu

SEQ ID NO: 1324659 - RNA, 22 nt, Human
uggcacugaaugaugaucuaca

SEQ ID NO: 1324660 - RNA, 22 nt, Human
aagcgccggaaucuccucagcu

SEQ ID NO: 1324661 - RNA, 24 nt, Human
caaacgagcacacaagcagcacca

SEQ ID NO: 1324662 - RNA, 25 nt, Human
ccagguccgcaccaaacgagcacac

SEQ ID NO: 1324663 - RNA, 19 nt, Human
cuggaguaaagaagcaggu

SEQ ID NO: 1324664 - RNA, 18 nt, Human
gaguaaagaagcagguuc

SEQ ID NO: 1324665 - RNA, 21 nt, Human
gggaagggggaaaugaaagac

SEQ ID NO: 1324666 - RNA, 21 nt, Human
ucagcugccguuucacaaaag

SEQ ID NO: 1324667 - RNA, 20 nt, Human
ucuggaguaaagaagcaggu

SEQ ID NO: 1324668 - RNA, 19 nt, Human
aagagaaauacaaggaguc

SEQ ID NO: 1324669 - RNA, 21 nt, Human
acaacccucaggacaugacug

SEQ ID NO: 1324670 - RNA, 20 nt, Human
acaaggagucauaagcagag

SEQ ID NO: 1324671 - RNA, 20 nt, Human
acaaggagucauaagcagag

SEQ ID NO: 1324672 - RNA, 20 nt, Human
acauagaaugacacacaaga

SEQ ID NO: 1324673 - RNA, 19 nt, Human
agggagcgccgcuuccacc

SEQ ID NO: 1324674 - RNA, 22 nt, Human
auuuagccaucacauuuuccag

SEQ ID NO: 1324675 - RNA, 19 nt, Human
cagagagugcagguaagca

SEQ ID NO: 1324676 - RNA, 20 nt, Human
cauacaacuucaauuccacc

SEQ ID NO: 1324677 - RNA, 19 nt, Human
cauuacagauggguuuuuc

SEQ ID NO: 1324678 - RNA, 19 nt, Human
ccaccguaaugucauugcc

SEQ ID NO: 1324679 - RNA, 26 nt, Human
cccucaggacaugacuguuuccucca

SEQ ID NO: 1324680 - RNA, 21 nt, Human
ccucagguuauugaagaacuc

SEQ ID NO: 1324681 - RNA, 23 nt, Human
cgccgcuuccacccucaggcuca

SEQ ID NO: 1324682 - RNA, 25 nt, Human
cgugcuuacucucuugcagugacca

SEQ ID NO: 1324683 - RNA, 20 nt, Human
cucuuuucuuccucuuuauu

SEQ ID NO: 1324684 - RNA, 25 nt, Human
cugcacugcccccuccugagacaua

SEQ ID NO: 1324685 - RNA, 22 nt, Human
cuuuucuuccucuuuauucucu

SEQ ID NO: 1324686 - RNA, 24 nt, Human
gcuccugaaucauuguuucugacu

SEQ ID NO: 1324687 - RNA, 19 nt, Human
uaaaugauuuucuccugca

SEQ ID NO: 1324688 - RNA, 21 nt, Human
uaagcagagggcuaguaagug

SEQ ID NO: 1324689 - RNA, 18 nt, Human
uauugaagaacucuucuu

SEQ ID NO: 1324690 - RNA, 20 nt, Human
uccucuuuauucucucucau

SEQ ID NO: 1324691 - RNA, 21 nt, Human
ucucacagauuuucccugaag

SEQ ID NO: 1324692 - RNA, 22 nt, Human
ugagacauagaaugacacacaa

SEQ ID NO: 1324693 - RNA, 23 nt, Human
ugagcguuaucaccuuucuuugu

SEQ ID NO: 1324694 - RNA, 24 nt, Human
ugcuccugaaucauuguuucugac

SEQ ID NO: 1324695 - RNA, 24 nt, Human
uggguuuuucacuuccaacagcuu

SEQ ID NO: 1324696 - RNA, 22 nt, Human
uuccuagggauccacacuucag

SEQ ID NO: 1324697 - RNA, 21 nt, Human
uucuccugcauacaacuucaa

SEQ ID NO: 1324698 - RNA, 19 nt, Human
uuucacuuccaacagcuug

SEQ ID NO: 1324699 - RNA, 23 nt, Human
uuuucuuccucuuuauucucucu

SEQ ID NO: 1324700 - RNA, 21 nt, Human
acugcagcugaacccccagcu

SEQ ID NO: 1324701 - RNA, 23 nt, Human
agaccagauccuguucauuuucc

SEQ ID NO: 1324702 - RNA, 21 nt, Human
caacugcagcugaacccccag

SEQ ID NO: 1324703 - RNA, 22 nt, Human
caacugcagcugaacccccagc

SEQ ID NO: 1324704 - RNA, 20 nt, Human
cagaugauacacccaagguc

SEQ ID NO: 1324705 - RNA, 20 nt, Human
cagcagccguggcugcuuca

SEQ ID NO: 1324706 - RNA, 23 nt, Human
cagcugaacccccagcuccgguu

SEQ ID NO: 1324707 - RNA, 21 nt, Human
ccauccaaguugaaaagguga

SEQ ID NO: 1324708 - RNA, 22 nt, Human
ccauccaaguugaaaaggugag

SEQ ID NO: 1324709 - RNA, 19 nt, Human
ccuguacucaggagcagag

SEQ ID NO: 1324710 - RNA, 22 nt, Human
ccuguacucaggagcagaggac

SEQ ID NO: 1324711 - RNA, 22 nt, Human
cucaccccacacgccaguuuac

SEQ ID NO: 1324712 - RNA, 19 nt, Human
gccgagacccuguacucag

SEQ ID NO: 1324713 - RNA, 19 nt, Human
gcugaacccccagcuccgg

SEQ ID NO: 1324714 - RNA, 19 nt, Human
gcugaacccccagcuccgg

SEQ ID NO: 1324715 - RNA, 21 nt, Human
gcuugagaccagauccuguuc

SEQ ID NO: 1324716 - RNA, 20 nt, Human
ggagacacagcaucccucgg

SEQ ID NO: 1324717 - RNA, 24 nt, Human
gucgagcuccaacugcagcugaac

SEQ ID NO: 1324718 - RNA, 24 nt, Human
uacucaggagcagaggacagcgug

SEQ ID NO: 1324719 - RNA, 21 nt, Human
ucagccagaggagcucucugu

SEQ ID NO: 1324720 - RNA, 23 nt, Human
uccgguuccucacagacucggca

SEQ ID NO: 1324721 - RNA, 23 nt, Human
ucgagcuccaacugcagcugaac

SEQ ID NO: 1324722 - RNA, 20 nt, Human
ucucuguggcugugcucacc

SEQ ID NO: 1324723 - RNA, 26 nt, Human
ugaacccccagcuccgguuccucaca

SEQ ID NO: 1324724 - RNA, 20 nt, Human
ugggguugagcccauccaag

SEQ ID NO: 1324725 - RNA, 24 nt, Human
ugggguugagcccauccaaguuga

SEQ ID NO: 1324726 - RNA, 20 nt, Human
ugguuggagcucaggaaggc

SEQ ID NO: 1324727 - RNA, 23 nt, Human
aaagugcccucuaccccagccua

SEQ ID NO: 1324728 - RNA, 19 nt, Human
aacccagacuaccugaaag

SEQ ID NO: 1324729 - RNA, 21 nt, Human
aaccccuuccccgcugcccca

SEQ ID NO: 1324730 - RNA, 23 nt, Human
aagugccuuccaaaagugccccc

SEQ ID NO: 1324731 - RNA, 22 nt, Human
acccggaauucccacaacgcac

SEQ ID NO: 1324732 - RNA, 21 nt, Human
agaaagacacagguugcagaa

SEQ ID NO: 1324733 - RNA, 21 nt, Human
agaaccccuuccccgcugccc

SEQ ID NO: 1324734 - RNA, 23 nt, Human
agacacagguugcagaaaaaaca

SEQ ID NO: 1324735 - RNA, 18 nt, Human
agaguucuucagaacccc

SEQ ID NO: 1324736 - RNA, 22 nt, Human
agccucggcacccccuccccaa

SEQ ID NO: 1324737 - RNA, 22 nt, Human
aggcaggagaagugccuuccaa

SEQ ID NO: 1324738 - RNA, 24 nt, Human
aggcaggagaagugccuuccaaaa

SEQ ID NO: 1324739 - RNA, 23 nt, Human
aggggaagggggaaacagcccag

SEQ ID NO: 1324740 - RNA, 25 nt, Human
aggggaagggggaaacagcccaggg

SEQ ID NO: 1324741 - RNA, 21 nt, Human
agguauuuggggguggaaaug

SEQ ID NO: 1324742 - RNA, 25 nt, Human
cacagcuaggcccaguuccccaccc

SEQ ID NO: 1324743 - RNA, 18 nt, Human
cacccccuccccaaagac

SEQ ID NO: 1324744 - RNA, 25 nt, Human
caccuguccaugcucugaguccugc

SEQ ID NO: 1324745 - RNA, 22 nt, Human
cagaguucuucagaaccccuuc

SEQ ID NO: 1324746 - RNA, 26 nt, Human
cagccuauuccuucagccaguaccca

SEQ ID NO: 1324747 - RNA, 21 nt, Human
cagccucuggcgccuccgccc

SEQ ID NO: 1324748 - RNA, 23 nt, Human
caggacucuuaacuaaaacauua

SEQ ID NO: 1324749 - RNA, 24 nt, Human
caggugccuccuggggagguauuu

SEQ ID NO: 1324750 - RNA, 24 nt, Human
ccaaagacccuccccaggggcugc

SEQ ID NO: 1324751 - RNA, 20 nt, Human
ccaugcucugaguccugcag

SEQ ID NO: 1324752 - RNA, 23 nt, Human
cccaagacccuaugcaagacgag

SEQ ID NO: 1324753 - RNA, 21 nt, Human
ccccaaagacccuccccaggg

SEQ ID NO: 1324754 - RNA, 24 nt, Human
ccccaagacccuaugcaagacgag

SEQ ID NO: 1324755 - RNA, 18 nt, Human
ccccgcugccccaagacc

SEQ ID NO: 1324756 - RNA, 22 nt, Human
cccuccccaaagacccucccca

SEQ ID NO: 1324757 - RNA, 19 nt, Human
ccuccaacccagacuaccu

SEQ ID NO: 1324758 - RNA, 22 nt, Human
ccuccaacccagacuaccugaa

SEQ ID NO: 1324759 - RNA, 18 nt, Human
ccuccaacccagacuacu

SEQ ID NO: 1324760 - RNA, 23 nt, Human
ccuuccaaaagugcccucuaccc

SEQ ID NO: 1324761 - RNA, 18 nt, Human
ccuuggucauggcucugc

SEQ ID NO: 1324762 - RNA, 19 nt, Human
cggaauucccacaacgcac

SEQ ID NO: 1324763 - RNA, 22 nt, Human
cggaauucccacaacgcacucc

SEQ ID NO: 1324764 - RNA, 26 nt, Human
cggcacccccuccccaaagacccucc

SEQ ID NO: 1324765 - RNA, 18 nt, Human
cuaggcccaguuccccac

SEQ ID NO: 1324766 - RNA, 20 nt, Human
cuccccaaagacccucccca

SEQ ID NO: 1324767 - RNA, 22 nt, Human
cuccccgcuuagucauuggaga

SEQ ID NO: 1324768 - RNA, 18 nt, Human
cucggcacccccucccca

SEQ ID NO: 1324769 - RNA, 19 nt, Human
cucggcacccccuccccaa

SEQ ID NO: 1324770 - RNA, 21 nt, Human
gaagugccuuccaaaagugcc

SEQ ID NO: 1324771 - RNA, 21 nt, Human
gacacgacuggcugcaccccc

SEQ ID NO: 1324772 - RNA, 18 nt, Human
gcacaaagggccuguggg

SEQ ID NO: 1324773 - RNA, 18 nt, Human
gcacccccuccccaaaga

SEQ ID NO: 1324774 - RNA, 22 nt, Human
gcccauggugccuggagagugu

SEQ ID NO: 1324775 - RNA, 20 nt, Human
gccucggcacccccucccca

SEQ ID NO: 1324776 - RNA, 20 nt, Human
ggaagggggaaacagcccag

SEQ ID NO: 1324777 - RNA, 18 nt, Human
ggaauucccacaacgcac

SEQ ID NO: 1324778 - RNA, 20 nt, Human
ggaauucccacaacgcacuc

SEQ ID NO: 1324779 - RNA, 19 nt, Human
ggagaguguacacggcccu

SEQ ID NO: 1324780 - RNA, 19 nt, Human
ggcccaguuccccaccccc

SEQ ID NO: 1324781 - RNA, 21 nt, Human
ggggaagggggaaacagccca

SEQ ID NO: 1324782 - RNA, 19 nt, Human
gggguggaaauggggcaca

SEQ ID NO: 1324783 - RNA, 19 nt, Human
guccucuuggccagaguuc

SEQ ID NO: 1324784 - RNA, 21 nt, Human
guucuucagaaccccuucccc

SEQ ID NO: 1324785 - RNA, 19 nt, Human
uacccagguccccuugguc

SEQ ID NO: 1324786 - RNA, 22 nt, Human
uaccccagccuauuccuucagc

SEQ ID NO: 1324787 - RNA, 26 nt, Human
uaggauguccgcaucuccccgcuuag

SEQ ID NO: 1324788 - RNA, 22 nt, Human
uaggcucccgggaggcaggaga

SEQ ID NO: 1324789 - RNA, 20 nt, Human
ucagaggugcaacggaggcc

SEQ ID NO: 1324790 - RNA, 24 nt, Human
uccccaaagacccuccccaggggc

SEQ ID NO: 1324791 - RNA, 22 nt, Human
uccgcaucuccccgcuuaguca

SEQ ID NO: 1324792 - RNA, 18 nt, Human
uccucguccucuuggcca

SEQ ID NO: 1324793 - RNA, 20 nt, Human
uccugcagccaacaggacuc

SEQ ID NO: 1324794 - RNA, 23 nt, Human
ucuuggccagaguucuucagaac

SEQ ID NO: 1324795 - RNA, 20 nt, Human
ugcacaaagggccugugggg

SEQ ID NO: 1324796 - RNA, 21 nt, Human
ugcacaaagggccuguggggg

SEQ ID NO: 1324797 - RNA, 24 nt, Human
ugcagaaaaaacauagcccuugcc

SEQ ID NO: 1324798 - RNA, 25 nt, Human
ugcccugagggucuccacccggaau

SEQ ID NO: 1324799 - RNA, 18 nt, Human
ugccuuggcguucaaggc

SEQ ID NO: 1324800 - RNA, 20 nt, Human
uggaggccugagaaggagcu

SEQ ID NO: 1324801 - RNA, 18 nt, Human
uggagugagaucuaggcu

SEQ ID NO: 1324802 - RNA, 19 nt, Human
uggagugagaucuaggcuc

SEQ ID NO: 1324803 - RNA, 23 nt, Human
uguccaugcucugaguccugcag

SEQ ID NO: 1324804 - RNA, 21 nt, Human
uuccccgcugccccaagaccc

SEQ ID NO: 1324805 - RNA, 23 nt, Human
uuggucauggcucugccuccucc

SEQ ID NO: 1324806 - RNA, 18 nt, Human
uuuaaggggaagggggaa

SEQ ID NO: 1324807 - RNA, 24 nt, Human
aagcuuugaauugcuuacaccgcc

SEQ ID NO: 1324808 - RNA, 20 nt, Human
acacaacugaauauugugcu

SEQ ID NO: 1324809 - RNA, 22 nt, Human
acaccgccaccaccaccaaacc

SEQ ID NO: 1324810 - RNA, 21 nt, Human
acacugcagcagacagagguu

SEQ ID NO: 1324811 - RNA, 18 nt, Human
caacucgcggccacccag

SEQ ID NO: 1324812 - RNA, 20 nt, Human
caaguugucuaucaaacacu

SEQ ID NO: 1324813 - RNA, 20 nt, Human
caccaaaccaagcagccccc

SEQ ID NO: 1324814 - RNA, 23 nt, Human
caccaaaccaagcagcccccgac

SEQ ID NO: 1324815 - RNA, 21 nt, Human
caccaccaaaccaagcagccc

SEQ ID NO: 1324816 - RNA, 22 nt, Human
caccaccaaaccaagcagcccc

SEQ ID NO: 1324817 - RNA, 23 nt, Human
caccaccaaaccaagcagccccc

SEQ ID NO: 1324818 - RNA, 18 nt, Human
caccaccaccaaaccaag

SEQ ID NO: 1324819 - RNA, 22 nt, Human
caccgccaccaccaccaaacca

SEQ ID NO: 1324820 - RNA, 23 nt, Human
caccgccaccaccaccaaaccaa

SEQ ID NO: 1324821 - RNA, 22 nt, Human
cagcgaguguaucucgcacucc

SEQ ID NO: 1324822 - RNA, 18 nt, Human
cccagcgccacgcgugac

SEQ ID NO: 1324823 - RNA, 23 nt, Human
cccgacggucgugcagucaggcc

SEQ ID NO: 1324824 - RNA, 19 nt, Human
ccgccaccaccaccaaacc

SEQ ID NO: 1324825 - RNA, 21 nt, Human
ccgccaccaccaccaaaccaa

SEQ ID NO: 1324826 - RNA, 23 nt, Human
ccgccaccaccaccaaaccaagc

SEQ ID NO: 1324827 - RNA, 22 nt, Human
ccucgguacugccuuguugcuc

SEQ ID NO: 1324828 - RNA, 18 nt, Human
cggggcgaccucggggcg

SEQ ID NO: 1324829 - RNA, 18 nt, Human
cucgcacuccuuccaaaa

SEQ ID NO: 1324830 - RNA, 23 nt, Human
gaauugcuuacaccgccaccacc

SEQ ID NO: 1324831 - RNA, 19 nt, Human
gaccucggggcggucuggc

SEQ ID NO: 1324832 - RNA, 18 nt, Human
gccuuuggagaacucugg

SEQ ID NO: 1324833 - RNA, 18 nt, Human
gccuuuggagaacucugg

SEQ ID NO: 1324834 - RNA, 19 nt, Human
gcucucugucagcucuuga

SEQ ID NO: 1324835 - RNA, 21 nt, Human
ggccuuuggagaacucuggcc

SEQ ID NO: 1324836 - RNA, 23 nt, Human
ggggcggucuggcacccgggaag

SEQ ID NO: 1324837 - RNA, 23 nt, Human
uacaccgccaccaccaccaaacc

SEQ ID NO: 1324838 - RNA, 27 nt, Human
uacaccgccaccaccaccaaaccaagc

SEQ ID NO: 1324839 - RNA, 18 nt, Human
uaucaaacacugcagcag

SEQ ID NO: 1324840 - RNA, 21 nt, Human
ucaaagcuuugaauugcuuac

SEQ ID NO: 1324841 - RNA, 18 nt, Human
ucaucagaaauggggccu

SEQ ID NO: 1324842 - RNA, 24 nt, Human
ugcagcgaguguaucucgcacucc

SEQ ID NO: 1324843 - RNA, 22 nt, Human
ugcagucaggcccgggagcgcc

SEQ ID NO: 1324844 - RNA, 26 nt, Human
ugccuuguugcucucugucagcucuu

SEQ ID NO: 1324845 - RNA, 22 nt, Human
uugcagcgaguguaucucgcac

SEQ ID NO: 1324846 - RNA, 19 nt, Human
agggugggcugggcugagg

SEQ ID NO: 1324847 - RNA, 24 nt, Human
ccucucagcaucgcuuuugcuggg

SEQ ID NO: 1324848 - RNA, 19 nt, Human
cuuuugcugggccgugauc

SEQ ID NO: 1324849 - RNA, 18 nt, Human
gagggugggcugggcuga

SEQ ID NO: 1324850 - RNA, 21 nt, Human
gaggugggacgugcuggugug

SEQ ID NO: 1324851 - RNA, 20 nt, Human
ggcuggaaaagcaggugagg

SEQ ID NO: 1324852 - RNA, 22 nt, Human
ggugagggugggcugggcugag

SEQ ID NO: 1324853 - RNA, 20 nt, Human
ggugggacgugcuggugugu

SEQ ID NO: 1324854 - RNA, 22 nt, Human
gugggcugggcugaggccauug

SEQ ID NO: 1324855 - RNA, 19 nt, Human
ugagggugggcugggcuga

SEQ ID NO: 1324856 - RNA, 25 nt, Human
uguaauaaaauccgugagcacgagg

SEQ ID NO: 1324857 - RNA, 23 nt, Human
uguguaauaaaauccgugagcac

SEQ ID NO: 1324858 - RNA, 21 nt, Human
aaaaaaaagcaaguuuuggga

SEQ ID NO: 1324859 - RNA, 24 nt, Human
aaaaaacuaaaaacucccacaacu

SEQ ID NO: 1324860 - RNA, 24 nt, Human
aaaaacaaaaugcuuaccaagccc

SEQ ID NO: 1324861 - RNA, 23 nt, Human
aaaaacuaaaaacucccacaacu

SEQ ID NO: 1324862 - RNA, 19 nt, Human
aaaaagaaauugagcagag

SEQ ID NO: 1324863 - RNA, 22 nt, Human
aaaaagaaauugagcagaggca

SEQ ID NO: 1324864 - RNA, 24 nt, Human
aaaauaaaaagaaauugagcagag

SEQ ID NO: 1324865 - RNA, 23 nt, Human
aaacaaaaaacuaaaaacuccca

SEQ ID NO: 1324866 - RNA, 24 nt, Human
aaacaaaaugcuuaccaagcccag

SEQ ID NO: 1324867 - RNA, 23 nt, Human
aaacacaccccuacacaaauccc

SEQ ID NO: 1324868 - RNA, 21 nt, Human
aaacagagauacacagaucua

SEQ ID NO: 1324869 - RNA, 19 nt, Human
aaaccauucacccuucccc

SEQ ID NO: 1324870 - RNA, 21 nt, Human
aaacuaccacaaagauuuuga

SEQ ID NO: 1324871 - RNA, 23 nt, Human
aaaugacccuuuugacaaauucu

SEQ ID NO: 1324872 - RNA, 22 nt, Human
aacaaaaaacuaaaaacuccca

SEQ ID NO: 1324873 - RNA, 22 nt, Human
aacacaccccuacacaaauccc

SEQ ID NO: 1324874 - RNA, 18 nt, Human
aacaucccacaucuccaa

SEQ ID NO: 1324875 - RNA, 21 nt, Human
aaccaaguaauccugagacaa

SEQ ID NO: 1324876 - RNA, 18 nt, Human
aacccaccuucucauacu

SEQ ID NO: 1324877 - RNA, 21 nt, Human
aacccaccuucucauacucca

SEQ ID NO: 1324878 - RNA, 22 nt, Human
aaccucccuauguucaaauuaa

SEQ ID NO: 1324879 - RNA, 24 nt, Human
aacuaccacaaagauuuugagcag

SEQ ID NO: 1324880 - RNA, 18 nt, Human
aagaacaucccacaucuc

SEQ ID NO: 1324881 - RNA, 18 nt, Human
aagacaaaggaaaggcua

SEQ ID NO: 1324882 - RNA, 22 nt, Human
aagauuuugagcagcucuauuc

SEQ ID NO: 1324883 - RNA, 25 nt, Human
aagcaccaaaaauuugauaaaaacu

SEQ ID NO: 1324884 - RNA, 18 nt, Human
aagcaggagaaucacuug

SEQ ID NO: 1324885 - RNA, 24 nt, Human
aagcaggagaaucacuugagccca

SEQ ID NO: 1324886 - RNA, 22 nt, Human
aaggggucacacuauguuccag

SEQ ID NO: 1324887 - RNA, 19 nt, Human
aaguauuagagauuauagu

SEQ ID NO: 1324888 - RNA, 25 nt, Human
aaucacuugagcccaggaguuggcg

SEQ ID NO: 1324889 - RNA, 28 nt, Human
aaucacuugagcccaggaguuggcgaga

SEQ ID NO: 1324890 - RNA, 26 nt, Human
aaugaaagucacauuaacaaagaaaa

SEQ ID NO: 1324891 - RNA, 26 nt, Human
acaaauucugcuuuaaaaaauucuga

SEQ ID NO: 1324892 - RNA, 24 nt, Human
acacaaacugaugguuucaaacau

SEQ ID NO: 1324893 - RNA, 20 nt, Human
acacacacaaacacaccccu

SEQ ID NO: 1324894 - RNA, 22 nt, Human
acacacacacaaacacaccccu

SEQ ID NO: 1324895 - RNA, 24 nt, Human
acacacacacacaaacacaccccu

SEQ ID NO: 1324896 - RNA, 23 nt, Human
acacacacacauucacacacaca

SEQ ID NO: 1324897 - RNA, 19 nt, Human
acacaccccuacacaaauc

SEQ ID NO: 1324898 - RNA, 23 nt, Human
acacagaucuaguuuuuccacca

SEQ ID NO: 1324899 - RNA, 21 nt, Human
acacugaaaagaacagagagc

SEQ ID NO: 1324900 - RNA, 23 nt, Human
acagaacccaugauuaucauacu

SEQ ID NO: 1324901 - RNA, 22 nt, Human
acagagaaaaaccauugcuaga

SEQ ID NO: 1324902 - RNA, 21 nt, Human
acagaguaugagaaauaaccc

SEQ ID NO: 1324903 - RNA, 21 nt, Human
acaggcucagccuguagcugg

SEQ ID NO: 1324904 - RNA, 19 nt, Human
acauagauccaagaaguga

SEQ ID NO: 1324905 - RNA, 20 nt, Human
accaaaacagagaaagaaaa

SEQ ID NO: 1324906 - RNA, 18 nt, Human
accauucacccuucccca

SEQ ID NO: 1324907 - RNA, 23 nt, Human
acugaauaaaugcaugccaaaac

SEQ ID NO: 1324908 - RNA, 23 nt, Human
acugcuaugcaaauuauucaaau

SEQ ID NO: 1324909 - RNA, 25 nt, Human
agaaaaaccaaguaauccugagggg

SEQ ID NO: 1324910 - RNA, 23 nt, Human
agaaaagcaaguucucgcuugag

SEQ ID NO: 1324911 - RNA, 24 nt, Human
agaaacauuacuucaaauaauuga

SEQ ID NO: 1324912 - RNA, 23 nt, Human
agaaggccucacugucauaaggg

SEQ ID NO: 1324913 - RNA, 20 nt, Human
agacaaaaaaaugacccuuu

SEQ ID NO: 1324914 - RNA, 19 nt, Human
agacaaauaucccuguucu

SEQ ID NO: 1324915 - RNA, 19 nt, Human
agagaaagaaaaaacaaaa

SEQ ID NO: 1324916 - RNA, 23 nt, Human
agagagccaggcgugguggcuca

SEQ ID NO: 1324917 - RNA, 19 nt, Human
agaucaagacaaaggaaag

SEQ ID NO: 1324918 - RNA, 20 nt, Human
agauuaaacucuaaccuauu

SEQ ID NO: 1324919 - RNA, 24 nt, Human
aggcgugguggcucaugccuguaa

SEQ ID NO: 1324920 - RNA, 22 nt, Human
aguuucuuauuaaaaagaaaca

SEQ ID NO: 1324921 - RNA, 23 nt, Human
auaauaagaaauuaaguaaauac

SEQ ID NO: 1324922 - RNA, 21 nt, Human
augaaaaaaauuuuaaauccu

SEQ ID NO: 1324923 - RNA, 21 nt, Human
augauaucuccaaaaacugag

SEQ ID NO: 1324924 - RNA, 19 nt, Human
augccuguaaucccagcac

SEQ ID NO: 1324925 - RNA, 19 nt, Human
augugcauauguauauaca

SEQ ID NO: 1324926 - RNA, 23 nt, Human
caaaaaacuaaaaacucccacaa

SEQ ID NO: 1324927 - RNA, 23 nt, Human
caaaacagagaaagaaaaaacaa

SEQ ID NO: 1324928 - RNA, 23 nt, Human
caaacacaccccuacacaaaucc

SEQ ID NO: 1324929 - RNA, 24 nt, Human
caaaguuucuuauuaaaaagaaac

SEQ ID NO: 1324930 - RNA, 22 nt, Human
caacacaacucuuuuaaaagac

SEQ ID NO: 1324931 - RNA, 20 nt, Human
caacagagaaaaaccauugc

SEQ ID NO: 1324932 - RNA, 21 nt, Human
caagugauccuccugccugua

SEQ ID NO: 1324933 - RNA, 18 nt, Human
caaguucucgcuugagga

SEQ ID NO: 1324934 - RNA, 25 nt, Human
cacaaacacaccccuacacaaaucc

SEQ ID NO: 1324935 - RNA, 21 nt, Human
cacacaaacacaccccuacac

SEQ ID NO: 1324936 - RNA, 26 nt, Human
cacacaaacacaccccuacacaaauc

SEQ ID NO: 1324937 - RNA, 23 nt, Human
cacacacacacacaaacacaccc

SEQ ID NO: 1324938 - RNA, 22 nt, Human
cacacacacauucacacacaca

SEQ ID NO: 1324939 - RNA, 24 nt, Human
cacacauucacacacacacacaaa

SEQ ID NO: 1324940 - RNA, 19 nt, Human
cacaccaccaugcccagca

SEQ ID NO: 1324941 - RNA, 20 nt, Human
cacaccccuacacaaauccc

SEQ ID NO: 1324942 - RNA, 24 nt, Human
cacaccgucucugcaccaagcacc

SEQ ID NO: 1324943 - RNA, 19 nt, Human
cacagaucuaguuuuucca

SEQ ID NO: 1324944 - RNA, 24 nt, Human
cacagaucuaguuuuuccaccauc

SEQ ID NO: 1324945 - RNA, 20 nt, Human
caccccuacacaaaucccug

SEQ ID NO: 1324946 - RNA, 21 nt, Human
cacccuuccccacaccgucuc

SEQ ID NO: 1324947 - RNA, 18 nt, Human
caccgucucugcaccaag

SEQ ID NO: 1324948 - RNA, 23 nt, Human
cacugcagccuugaacuccuggg

SEQ ID NO: 1324949 - RNA, 24 nt, Human
cagaacccaugauuaucauacuag

SEQ ID NO: 1324950 - RNA, 23 nt, Human
cagagaaaaaccauugcuagaag

SEQ ID NO: 1324951 - RNA, 22 nt, Human
cagccaaacugauccauuugaa

SEQ ID NO: 1324952 - RNA, 24 nt, Human
cagccuguagcugggacuacaggc

SEQ ID NO: 1324953 - RNA, 19 nt, Human
caucccacaucuccaaauc

SEQ ID NO: 1324954 - RNA, 20 nt, Human
cauugcuagaagauacugaa

SEQ ID NO: 1324955 - RNA, 19 nt, Human
ccaaaacagagaaagaaaa

SEQ ID NO: 1324956 - RNA, 23 nt, Human
ccaaaacagagaaagaaaaaaca

SEQ ID NO: 1324957 - RNA, 18 nt, Human
ccaaaacagagauacaca

SEQ ID NO: 1324958 - RNA, 21 nt, Human
ccaaaaccauucacccuuccc

SEQ ID NO: 1324959 - RNA, 22 nt, Human
ccaacacaaauacuguagaccu

SEQ ID NO: 1324960 - RNA, 25 nt, Human
ccaccauccugauauuuuuuaaucu

SEQ ID NO: 1324961 - RNA, 19 nt, Human
cccacaauauagcuuucaa

SEQ ID NO: 1324962 - RNA, 21 nt, Human
cccacaauauagcuuucaaga

SEQ ID NO: 1324963 - RNA, 20 nt, Human
cccaccuucucauacuccaa

SEQ ID NO: 1324964 - RNA, 21 nt, Human
cccaccuucucauacuccaaa

SEQ ID NO: 1324965 - RNA, 20 nt, Human
ccccacaccgucucugcacc

SEQ ID NO: 1324966 - RNA, 28 nt, Human
ccccacaccgucucugcaccaagcaccc

SEQ ID NO: 1324967 - RNA, 23 nt, Human
ccccuaaaaauaaaauaaaguaa

SEQ ID NO: 1324968 - RNA, 22 nt, Human
ccccuacacaaaucccugaaaa

SEQ ID NO: 1324969 - RNA, 24 nt, Human
ccuacaggcucagccuguagcugg

SEQ ID NO: 1324970 - RNA, 20 nt, Human
ccucuauaauucaaacagca

SEQ ID NO: 1324971 - RNA, 22 nt, Human
ccugggcucaagugauccuccu

SEQ ID NO: 1324972 - RNA, 23 nt, Human
ccugggcucaagugauccuccug

SEQ ID NO: 1324973 - RNA, 21 nt, Human
ccuguaaucccagcacugugg

SEQ ID NO: 1324974 - RNA, 21 nt, Human
ccuguagcugggacuacaggc

SEQ ID NO: 1324975 - RNA, 21 nt, Human
ccuguagcugggacuacaggc

SEQ ID NO: 1324976 - RNA, 22 nt, Human
ccuugaacuccugggcucaagu

SEQ ID NO: 1324977 - RNA, 23 nt, Human
ccuugaacuccugggcucaagug

SEQ ID NO: 1324978 - RNA, 22 nt, Human
cuaaaaacucccacaacuacau

SEQ ID NO: 1324979 - RNA, 24 nt, Human
cuaaaacagaacccaugauuaucu

SEQ ID NO: 1324980 - RNA, 25 nt, Human
cucaagugauccuccugccuguagc

SEQ ID NO: 1324981 - RNA, 18 nt, Human
cucagccuguagcuggga

SEQ ID NO: 1324982 - RNA, 22 nt, Human
cucagguuacaaaaacuaagga

SEQ ID NO: 1324983 - RNA, 21 nt, Human
cucaucaacuaaaacagaacc

SEQ ID NO: 1324984 - RNA, 23 nt, Human
cucaugccuguaaucccagcacu

SEQ ID NO: 1324985 - RNA, 20 nt, Human
cucauuaacagaucaagaca

SEQ ID NO: 1324986 - RNA, 21 nt, Human
cucauuaacagaucaagacaa

SEQ ID NO: 1324987 - RNA, 21 nt, Human
cucccacaacuacauacauga

SEQ ID NO: 1324988 - RNA, 19 nt, Human
cucccacuauaaaaccccu

SEQ ID NO: 1324989 - RNA, 23 nt, Human
cucccacuauaaaaccccucaaa

SEQ ID NO: 1324990 - RNA, 19 nt, Human
cuccugccuacaggcucag

SEQ ID NO: 1324991 - RNA, 23 nt, Human
cuccugggcucaagugauccucc

SEQ ID NO: 1324992 - RNA, 19 nt, Human
cucugcaccaagcaccaaa

SEQ ID NO: 1324993 - RNA, 23 nt, Human
cugcagccuugaacuccugggcu

SEQ ID NO: 1324994 - RNA, 23 nt, Human
cuguaaucccagcacugugggga

SEQ ID NO: 1324995 - RNA, 21 nt, Human
cuguagccuccugccuacagg

SEQ ID NO: 1324996 - RNA, 24 nt, Human
cuguagcugggacuacaggcgcac

SEQ ID NO: 1324997 - RNA, 24 nt, Human
gaaaaaagacugcuaauagucuug

SEQ ID NO: 1324998 - RNA, 23 nt, Human
gaaagucacauuaacaaagaaaa

SEQ ID NO: 1324999 - RNA, 23 nt, Human
gaaggggucacacuauguuccag

SEQ ID NO: 1325000 - RNA, 20 nt, Human
gaauucugcuuuuuaaacaa

SEQ ID NO: 1325001 - RNA, 23 nt, Human
gacaaaggaaaggcuaagaaaaa

SEQ ID NO: 1325002 - RNA, 21 nt, Human
gagaaagaaaaaacaaaaugc

SEQ ID NO: 1325003 - RNA, 24 nt, Human
gagagccaggcgugguggcucaug

SEQ ID NO: 1325004 - RNA, 24 nt, Human
gagccaggcgugguggcucaugcc

SEQ ID NO: 1325005 - RNA, 19 nt, Human
gaucauagcgcacugcagc

SEQ ID NO: 1325006 - RNA, 22 nt, Human
gcaaauagcuuaauauggacaa

SEQ ID NO: 1325007 - RNA, 24 nt, Human
gcacugcagccuugaacuccuggg

SEQ ID NO: 1325008 - RNA, 19 nt, Human
gcucaagugauccuccugc

SEQ ID NO: 1325009 - RNA, 20 nt, Human
ggaagcaggagaaucacuug

SEQ ID NO: 1325010 - RNA, 24 nt, Human
ggaagcaggagaaucacuugagcc

SEQ ID NO: 1325011 - RNA, 22 nt, Human
ggcacggagacacugaaaagaa

SEQ ID NO: 1325012 - RNA, 25 nt, Human
gggaacagaagagaaacugcaugac

SEQ ID NO: 1325013 - RNA, 22 nt, Human
gggcucaagugauccuccugcc

SEQ ID NO: 1325014 - RNA, 24 nt, Human
gguggcucaugccuguaaucccag

SEQ ID NO: 1325015 - RNA, 18 nt, Human
guauuuauguauauacac

SEQ ID NO: 1325016 - RNA, 26 nt, Human
uaaaaaaacaaaaaacuaaaaacucc

SEQ ID NO: 1325017 - RNA, 19 nt, Human
uaaaaaacugaaacucaca

SEQ ID NO: 1325018 - RNA, 20 nt, Human
uaaaaaaucugucaaaccau

SEQ ID NO: 1325019 - RNA, 21 nt, Human
uaaaaagaaauugagcagagg

SEQ ID NO: 1325020 - RNA, 20 nt, Human
uaaaaccccucaaacuaaga

SEQ ID NO: 1325021 - RNA, 23 nt, Human
uaaaauuugcucugaaaaaagac

SEQ ID NO: 1325022 - RNA, 21 nt, Human
uaacagaucaagacaaaggaa

SEQ ID NO: 1325023 - RNA, 23 nt, Human
uaacagaucaagacaaaggaaag

SEQ ID NO: 1325024 - RNA, 25 nt, Human
uaacccaccuucucauacuccaaau

SEQ ID NO: 1325025 - RNA, 18 nt, Human
uaaguaaauacacaguaa

SEQ ID NO: 1325026 - RNA, 26 nt, Human
uaauaagaaauuaaguaaauacacag

SEQ ID NO: 1325027 - RNA, 19 nt, Human
uaauuccuaacuuaaagua

SEQ ID NO: 1325028 - RNA, 21 nt, Human
uacaaaaacuaaggaaacuac

SEQ ID NO: 1325029 - RNA, 18 nt, Human
uacaacuuuagaagagug

SEQ ID NO: 1325030 - RNA, 24 nt, Human
uacacaaaucccugaaaaggauuc

SEQ ID NO: 1325031 - RNA, 20 nt, Human
uaccaaaacagagaaagaaa

SEQ ID NO: 1325032 - RNA, 21 nt, Human
uacgguagaucaacagagaaa

SEQ ID NO: 1325033 - RNA, 23 nt, Human
uacguggguacucaguaaugaaa

SEQ ID NO: 1325034 - RNA, 22 nt, Human
uagaagauacugaauaaaugca

SEQ ID NO: 1325035 - RNA, 25 nt, Human
uagaucaacagagaaaaagggaggc

SEQ ID NO: 1325036 - RNA, 22 nt, Human
uagcaguacacauuagguuuuc

SEQ ID NO: 1325037 - RNA, 22 nt, Human
uaggcaucuuucaauuaugacu

SEQ ID NO: 1325038 - RNA, 18 nt, Human
uauagugguacaaaaaac

SEQ ID NO: 1325039 - RNA, 26 nt, Human
uaucuacacacacacacauucacaca

SEQ ID NO: 1325040 - RNA, 23 nt, Human
uauguaaugugcauauguauaua

SEQ ID NO: 1325041 - RNA, 23 nt, Human
ucaaauuaaucacuggaauacag

SEQ ID NO: 1325042 - RNA, 24 nt, Human
ucaagacaaaggaaaggcuaagaa

SEQ ID NO: 1325043 - RNA, 19 nt, Human
ucacuggaauacagcaaag

SEQ ID NO: 1325044 - RNA, 19 nt, Human
uccccacaccgucucugca

SEQ ID NO: 1325045 - RNA, 19 nt, Human
ucccugaaaaggauucaaa

SEQ ID NO: 1325046 - RNA, 21 nt, Human
uccugggcucaagugauccuc

SEQ ID NO: 1325047 - RNA, 22 nt, Human
uccugggcucaagugauccucc

SEQ ID NO: 1325048 - RNA, 24 nt, Human
uccugggcucaagugauccuccug

SEQ ID NO: 1325049 - RNA, 21 nt, Human
ucuaagggauagguggggaaa

SEQ ID NO: 1325050 - RNA, 24 nt, Human
ucuauaauucaaacagcaaauagc

SEQ ID NO: 1325051 - RNA, 21 nt, Human
ucugaucaacaauugaagaaa

SEQ ID NO: 1325052 - RNA, 19 nt, Human
ucugcaccaagcaccaaaa

SEQ ID NO: 1325053 - RNA, 19 nt, Human
ugaaaaaagacugcuaauu

SEQ ID NO: 1325054 - RNA, 23 nt, Human
ugaaaagaacagagagccaggcg

SEQ ID NO: 1325055 - RNA, 22 nt, Human
ugaaacucacauuuucucuaag

SEQ ID NO: 1325056 - RNA, 25 nt, Human
ugaacuccugggcucaagugauccu

SEQ ID NO: 1325057 - RNA, 23 nt, Human
ugaauauauauacuuuguguaga

SEQ ID NO: 1325058 - RNA, 19 nt, Human
ugagaaaaaccaaguaauc

SEQ ID NO: 1325059 - RNA, 22 nt, Human
ugagaaaaaccaaguaauccug

SEQ ID NO: 1325060 - RNA, 24 nt, Human
ugagaaauaacccaccuucucaua

SEQ ID NO: 1325061 - RNA, 18 nt, Human
ugagcagaggcauucaua

SEQ ID NO: 1325062 - RNA, 20 nt, Human
ugagcagaggcauucauagg

SEQ ID NO: 1325063 - RNA, 20 nt, Human
ugauaaaggcaaaaguguaa

SEQ ID NO: 1325064 - RNA, 21 nt, Human
ugauaugcaauaaccccuauc

SEQ ID NO: 1325065 - RNA, 23 nt, Human
ugcacugaauuauucccaaaacc

SEQ ID NO: 1325066 - RNA, 24 nt, Human
ugccaaaacagagauacacagauc

SEQ ID NO: 1325067 - RNA, 21 nt, Human
ugccauaggcaucuuucaauu

SEQ ID NO: 1325068 - RNA, 23 nt, Human
ugccuguaaucccagcacugugg

SEQ ID NO: 1325069 - RNA, 24 nt, Human
ugccuguaaucccagcacuguggg

SEQ ID NO: 1325070 - RNA, 18 nt, Human
ugcuuuuuaaacaaucug

SEQ ID NO: 1325071 - RNA, 19 nt, Human
uggagccaaagaaggccuc

SEQ ID NO: 1325072 - RNA, 24 nt, Human
uggcucaugccuguaaucccagca

SEQ ID NO: 1325073 - RNA, 26 nt, Human
ugggaacagaagagaaacugcaugac

SEQ ID NO: 1325074 - RNA, 18 nt, Human
ugggacuacaggcgcaca

SEQ ID NO: 1325075 - RNA, 20 nt, Human
ugggcucaagugauccuccu

SEQ ID NO: 1325076 - RNA, 24 nt, Human
ugggcucaagugauccuccugccu

SEQ ID NO: 1325077 - RNA, 24 nt, Human
ugguggcucaugccuguaauccca

SEQ ID NO: 1325078 - RNA, 21 nt, Human
uguaaagaggccuacaggugu

SEQ ID NO: 1325079 - RNA, 20 nt, Human
uguaagcacugcugacugau

SEQ ID NO: 1325080 - RNA, 20 nt, Human
uguauguaaugugcauaugu

SEQ ID NO: 1325081 - RNA, 23 nt, Human
uguauguaaugugcauauguaua

SEQ ID NO: 1325082 - RNA, 20 nt, Human
ugucauaagggaacaggcag

SEQ ID NO: 1325083 - RNA, 21 nt, Human
ugugcaaucuaaauuguauuu

SEQ ID NO: 1325084 - RNA, 20 nt, Human
uguggaagggaaaaaaaagc

SEQ ID NO: 1325085 - RNA, 20 nt, Human
uuaaaguaaaugaaauaauc

SEQ ID NO: 1325086 - RNA, 22 nt, Human
uuaaauccuuaccaaaacagag

SEQ ID NO: 1325087 - RNA, 20 nt, Human
uuagucucaaauaggaagaa

SEQ ID NO: 1325088 - RNA, 21 nt, Human
uucaaauguucucucucagac

SEQ ID NO: 1325089 - RNA, 22 nt, Human
uucaaauguucucucucagacu

SEQ ID NO: 1325090 - RNA, 23 nt, Human
uucacacacacacacaaacacac

SEQ ID NO: 1325091 - RNA, 18 nt, Human
uuccuccuucauauaccc

SEQ ID NO: 1325092 - RNA, 18 nt, Human
uucuuugcuuggaugaau

SEQ ID NO: 1325093 - RNA, 22 nt, Human
uugcuuggaugaauaguuggug

SEQ ID NO: 1325094 - RNA, 19 nt, Human
uuggccuuguuaaaaaaaa

SEQ ID NO: 1325095 - RNA, 20 nt, Human
uuuaaaaauagcaguacaca

SEQ ID NO: 1325096 - RNA, 21 nt, Human
uuuauggcauucuguaagagc

SEQ ID NO: 1325097 - RNA, 23 nt, Human
uuuuccaccauccugauauuuuu

SEQ ID NO: 1325098 - RNA, 21 nt, Human
uuuucucccacuauaaaaccc

SEQ ID NO: 1325099 - RNA, 19 nt, Human
uuuugguaaaauuucuucu

SEQ ID NO: 1325100 - RNA, 20 nt, Human
aaacucuccacucaccccuc

SEQ ID NO: 1325101 - RNA, 23 nt, Human
acagcugggaucugaggccuaag

SEQ ID NO: 1325102 - RNA, 19 nt, Human
acuuacccacccagucaca

SEQ ID NO: 1325103 - RNA, 22 nt, Human
agcauugggaggggaggaggga

SEQ ID NO: 1325104 - RNA, 19 nt, Human
caaugaaagauuaugcauc

SEQ ID NO: 1325105 - RNA, 22 nt, Human
cagcauugggaggggaggaggg

SEQ ID NO: 1325106 - RNA, 18 nt, Human
cagccuuucccuaacagu

SEQ ID NO: 1325107 - RNA, 22 nt, Human
ccaccgaacuuacccacccagu

SEQ ID NO: 1325108 - RNA, 23 nt, Human
ccacucaccccucuaacaaacaa

SEQ ID NO: 1325109 - RNA, 21 nt, Human
ccagucacagacggaggcugg

SEQ ID NO: 1325110 - RNA, 20 nt, Human
ccucuaacaaacaaugaaag

SEQ ID NO: 1325111 - RNA, 18 nt, Human
gaggagggaggggacgcu

SEQ ID NO: 1325112 - RNA, 21 nt, Human
gaggggaggagggaggggacg

SEQ ID NO: 1325113 - RNA, 22 nt, Human
gaggggaggagggaggggacgc

SEQ ID NO: 1325114 - RNA, 20 nt, Human
gcacagcugggaucugaggc

SEQ ID NO: 1325115 - RNA, 22 nt, Human
ggaggggaggagggaggggacg

SEQ ID NO: 1325116 - RNA, 21 nt, Human
gugaagugacggcugccgagc

SEQ ID NO: 1325117 - RNA, 20 nt, Human
uaacaaacaaugaaagauua

SEQ ID NO: 1325118 - RNA, 18 nt, Human
ucagcauugggaggggag

SEQ ID NO: 1325119 - RNA, 25 nt, Human
uccacucaccccucuaacaaacaau

SEQ ID NO: 1325120 - RNA, 26 nt, Human
ugaaucaaaugucagguuccuaaugc

SEQ ID NO: 1325121 - RNA, 24 nt, Human
uggaacauggagagccaagucuug

SEQ ID NO: 1325122 - RNA, 20 nt, Human
ugggaggggaggagggaggg

SEQ ID NO: 1325123 - RNA, 21 nt, Human
uguuuuaaaggaccuaggcag

SEQ ID NO: 1325124 - RNA, 20 nt, Human
uuuaaacucuccacucaccc

SEQ ID NO: 1325125 - RNA, 20 nt, Human
acagaaccggggcagccgca

SEQ ID NO: 1325126 - RNA, 23 nt, Human
gccgcagggcuccugcaggaccu

SEQ ID NO: 1325127 - RNA, 22 nt, Human
gcuccugcaggaccucccggac

SEQ ID NO: 1325128 - RNA, 22 nt, Human
ucccuugagcggcuucuugggu

SEQ ID NO: 1325129 - RNA, 18 nt, Human
uccugcaggaccucccgg

SEQ ID NO: 1325130 - RNA, 19 nt, Human
aagcguuuucugcaagaac

SEQ ID NO: 1325131 - RNA, 20 nt, Human
aauugucaagagcaguuggu

SEQ ID NO: 1325132 - RNA, 18 nt, Human
acccagagauacaugguu

SEQ ID NO: 1325133 - RNA, 20 nt, Human
accuugaguagguauagaag

SEQ ID NO: 1325134 - RNA, 19 nt, Human
acuauaguuucauucaaau

SEQ ID NO: 1325135 - RNA, 19 nt, Human
agaguccugggugacaugc

SEQ ID NO: 1325136 - RNA, 23 nt, Human
agcaguuggugguucugaaauac

SEQ ID NO: 1325137 - RNA, 19 nt, Human
agccaacacugaagacaca

SEQ ID NO: 1325138 - RNA, 23 nt, Human
auagagccaugcccacugaccca

SEQ ID NO: 1325139 - RNA, 20 nt, Human
caaaaugaaaucccugagga

SEQ ID NO: 1325140 - RNA, 24 nt, Human
caagccaacacugaagacacaaau

SEQ ID NO: 1325141 - RNA, 21 nt, Human
cacaguuaugugaacguguca

SEQ ID NO: 1325142 - RNA, 21 nt, Human
caccggcagaguccuggguga

SEQ ID NO: 1325143 - RNA, 22 nt, Human
cagcagcucccugcugagccuc

SEQ ID NO: 1325144 - RNA, 19 nt, Human
cagccagcagcucccugcu

SEQ ID NO: 1325145 - RNA, 21 nt, Human
caugugcugcacaguuaugug

SEQ ID NO: 1325146 - RNA, 26 nt, Human
ccagcggcuccugacuccuguucucu

SEQ ID NO: 1325147 - RNA, 22 nt, Human
cccaaaauaucucuucuccuuu

SEQ ID NO: 1325148 - RNA, 19 nt, Human
ccucucggcuuaguaaggg

SEQ ID NO: 1325149 - RNA, 20 nt, Human
ccugcaagacuucaggcucu

SEQ ID NO: 1325150 - RNA, 24 nt, Human
cuauagguccugccugcaggaaug

SEQ ID NO: 1325151 - RNA, 20 nt, Human
cuguggucuuccuaaguacu

SEQ ID NO: 1325152 - RNA, 18 nt, Human
gauuaccuccuaugaaac

SEQ ID NO: 1325153 - RNA, 20 nt, Human
gcucugagaauaggaauaga

SEQ ID NO: 1325154 - RNA, 22 nt, Human
ggaauagagccaugcccacuga

SEQ ID NO: 1325155 - RNA, 25 nt, Human
ggauggaauugagaggagcagggcu

SEQ ID NO: 1325156 - RNA, 21 nt, Human
ggcacuucuguagggcuggca

SEQ ID NO: 1325157 - RNA, 26 nt, Human
ggcuaaggccucccaaugcuguuugu

SEQ ID NO: 1325158 - RNA, 25 nt, Human
gugguucugaaauacaauccucagc

SEQ ID NO: 1325159 - RNA, 22 nt, Human
uaaaacaagccaacacugaaga

SEQ ID NO: 1325160 - RNA, 24 nt, Human
uacagauggaucagcuaaaacaag

SEQ ID NO: 1325161 - RNA, 22 nt, Human
uagagccaugcccacugacccc

SEQ ID NO: 1325162 - RNA, 22 nt, Human
uagcuguggucuuccuaaguac

SEQ ID NO: 1325163 - RNA, 24 nt, Human
uagguucauugaaaccaggguaac

SEQ ID NO: 1325164 - RNA, 19 nt, Human
ucauucaaaucuucaggug

SEQ ID NO: 1325165 - RNA, 21 nt, Human
ucauugaaaccaggguaacac

SEQ ID NO: 1325166 - RNA, 18 nt, Human
ucccggcaugugcugcac

SEQ ID NO: 1325167 - RNA, 22 nt, Human
ucuccugccagcggcuccugac

SEQ ID NO: 1325168 - RNA, 21 nt, Human
ucuucaggugccuauaggucc

SEQ ID NO: 1325169 - RNA, 21 nt, Human
ugaaaccaggguaacaccuuu

SEQ ID NO: 1325170 - RNA, 20 nt, Human
ugaaauacaauccucagcca

SEQ ID NO: 1325171 - RNA, 18 nt, Human
ugacaugcugucuccugc

SEQ ID NO: 1325172 - RNA, 24 nt, Human
ugacaugcugucuccugccagcgg

SEQ ID NO: 1325173 - RNA, 19 nt, Human
ugagaggagcagggcuaag

SEQ ID NO: 1325174 - RNA, 22 nt, Human
ugaggaauuuuguagcuaccca

SEQ ID NO: 1325175 - RNA, 20 nt, Human
ugcugcacaguuaugugaac

SEQ ID NO: 1325176 - RNA, 21 nt, Human
ugucaagagcaguuggugguu

SEQ ID NO: 1325177 - RNA, 20 nt, Human
uuuuguugugugauuugugg

SEQ ID NO: 1325178 - RNA, 25 nt, Human
cucugcacuaccuuccugccacucc

SEQ ID NO: 1325179 - RNA, 18 nt, Human
uaccuuccugccacuccc

SEQ ID NO: 1325180 - RNA, 18 nt, Human
ucguugcuauccagacuc

SEQ ID NO: 1325181 - RNA, 23 nt, Human
ugucucguugcuauccagacucc

SEQ ID NO: 1325182 - RNA, 19 nt, Human
aggagacggcugugccggg

SEQ ID NO: 1325183 - RNA, 20 nt, Human
cagcuggcgguuccucccgc

SEQ ID NO: 1325184 - RNA, 24 nt, Human
ccagucgccgcccugggcuuuggg

SEQ ID NO: 1325185 - RNA, 20 nt, Human
cccagaacaacccauuugau

SEQ ID NO: 1325186 - RNA, 20 nt, Human
cccccuguccucuuaacaga

SEQ ID NO: 1325187 - RNA, 22 nt, Human
ccccgaauucccagaacaaccc

SEQ ID NO: 1325188 - RNA, 20 nt, Human
cccucccagcgccuccccgc

SEQ ID NO: 1325189 - RNA, 22 nt, Human
ccgaauucccagaacaacccau

SEQ ID NO: 1325190 - RNA, 25 nt, Human
ccugacagucgugccagucgccgcc

SEQ ID NO: 1325191 - RNA, 23 nt, Human
cgcccugggcuuuggggacgucc

SEQ ID NO: 1325192 - RNA, 18 nt, Human
cggggcgggacccccugu

SEQ ID NO: 1325193 - RNA, 18 nt, Human
gcagcuggcgguuccucc

SEQ ID NO: 1325194 - RNA, 18 nt, Human
gccgggccagggaggggc

SEQ ID NO: 1325195 - RNA, 26 nt, Human
gcucuuuccacacgucuccuccccca

SEQ ID NO: 1325196 - RNA, 23 nt, Human
ggcugccggaccggagaccccgg

SEQ ID NO: 1325197 - RNA, 22 nt, Human
gggcgugggguccguggggcgu

SEQ ID NO: 1325198 - RNA, 19 nt, Human
ggguccuggaggagacggc

SEQ ID NO: 1325199 - RNA, 18 nt, Human
gguucccggcacuguuac

SEQ ID NO: 1325200 - RNA, 22 nt, Human
uacuuccucuuuaucuucugcc

SEQ ID NO: 1325201 - RNA, 20 nt, Human
ucccagcgccuccccgcguc

SEQ ID NO: 1325202 - RNA, 19 nt, Human
uccgggcacacugcggaca

SEQ ID NO: 1325203 - RNA, 19 nt, Human
uccucuuuaucuucugccg

SEQ ID NO: 1325204 - RNA, 22 nt, Human
uggaaaccgcucugccagcccc

SEQ ID NO: 1325205 - RNA, 21 nt, Human
uuccucuuuaucuucugccgc

SEQ ID NO: 1325206 - RNA, 26 nt, Human
aaacagcagaugcaacuacacaagca

SEQ ID NO: 1325207 - RNA, 23 nt, Human
aacuugguuuccucuaaucuccu

SEQ ID NO: 1325208 - RNA, 22 nt, Human
acacaagcaucccaggaagcca

SEQ ID NO: 1325209 - RNA, 20 nt, Human
acaugagccacacuccgucu

SEQ ID NO: 1325210 - RNA, 18 nt, Human
acguggugaggagauugg

SEQ ID NO: 1325211 - RNA, 25 nt, Human
agaugcaacuacacaagcaucccag

SEQ ID NO: 1325212 - RNA, 18 nt, Human
aggaauuucagguauggu

SEQ ID NO: 1325213 - RNA, 18 nt, Human
auccugaaaaguaacuug

SEQ ID NO: 1325214 - RNA, 18 nt, Human
caaaacagcagaugcaac

SEQ ID NO: 1325215 - RNA, 22 nt, Human
caacagaauaagaaaaucugca

SEQ ID NO: 1325216 - RNA, 28 nt, Human
caaccgccucggccacucccguccaggc

SEQ ID NO: 1325217 - RNA, 18 nt, Human
caccaaaacagcagaugc

SEQ ID NO: 1325218 - RNA, 23 nt, Human
caccaaaacagcagaugcaacua

SEQ ID NO: 1325219 - RNA, 18 nt, Human
ccuccgcccaaccgccuc

SEQ ID NO: 1325220 - RNA, 22 nt, Human
cgccucggccacucccguccag

SEQ ID NO: 1325221 - RNA, 19 nt, Human
cucggccacucccguccag

SEQ ID NO: 1325222 - RNA, 21 nt, Human
cuggaggcacucugauucugg

SEQ ID NO: 1325223 - RNA, 22 nt, Human
cugucaccaaaacagcagaugc

SEQ ID NO: 1325224 - RNA, 20 nt, Human
gcgauaagaucacaugagcc

SEQ ID NO: 1325225 - RNA, 19 nt, Human
uaaccaggaauuucaggua

SEQ ID NO: 1325226 - RNA, 23 nt, Human
uaagaucacaugagccacacucc

SEQ ID NO: 1325227 - RNA, 21 nt, Human
ucugucaccaaaacagcagau

SEQ ID NO: 1325228 - RNA, 23 nt, Human
ucugucaccaaaacagcagaugc

SEQ ID NO: 1325229 - RNA, 21 nt, Human
ugaaugaaucaguugugugaa

SEQ ID NO: 1325230 - RNA, 21 nt, Human
aaaaugaaggcaaacaaagga

SEQ ID NO: 1325231 - RNA, 27 nt, Human
aaacacacacucucaauaucacuaugu

SEQ ID NO: 1325232 - RNA, 25 nt, Human
auuuggugaugccuacuacgagcuu

SEQ ID NO: 1325233 - RNA, 21 nt, Human
cugccguguauuucccacacu

SEQ ID NO: 1325234 - RNA, 22 nt, Human
uaaaaugaaggcaaacaaagga

SEQ ID NO: 1325235 - RNA, 20 nt, Human
uaaagcuauagucaucccug

SEQ ID NO: 1325236 - RNA, 20 nt, Human
uaacauagccauuaucaucu

SEQ ID NO: 1325237 - RNA, 21 nt, Human
uacgagcuuauauuuaguauu

SEQ ID NO: 1325238 - RNA, 23 nt, Human
uaugaaaacauuucuauuuugga

SEQ ID NO: 1325239 - RNA, 22 nt, Human
ugccaugugagaguacauagag

SEQ ID NO: 1325240 - RNA, 18 nt, Human
uucauucuuacaaaggau

SEQ ID NO: 1325241 - RNA, 20 nt, Human
uuugcuucaacgucuuuaac

SEQ ID NO: 1325242 - RNA, 18 nt, Human
aagaggcuugggauaauc

SEQ ID NO: 1325243 - RNA, 26 nt, Human
acaaguuauuuuguugaucaaaaagc

SEQ ID NO: 1325244 - RNA, 19 nt, Human
agaaggaucaccagugggg

SEQ ID NO: 1325245 - RNA, 22 nt, Human
aggccagaacuguuguaaagca

SEQ ID NO: 1325246 - RNA, 24 nt, Human
agggcgccgguggcgacccuggcg

SEQ ID NO: 1325247 - RNA, 24 nt, Human
aggggacaucguggcggcucgagg

SEQ ID NO: 1325248 - RNA, 21 nt, Human
auaaaaugauaccaaauaccc

SEQ ID NO: 1325249 - RNA, 21 nt, Human
caagagaaaaugagagacucg

SEQ ID NO: 1325250 - RNA, 21 nt, Human
caggaccagggagggaaaggu

SEQ ID NO: 1325251 - RNA, 22 nt, Human
caggaggcacaaagccaauuaa

SEQ ID NO: 1325252 - RNA, 22 nt, Human
caggggacaucguggcggcucg

SEQ ID NO: 1325253 - RNA, 19 nt, Human
cauggaaaauaacaaaaaa

SEQ ID NO: 1325254 - RNA, 25 nt, Human
ccaaauacccaauucuucugcaaaa

SEQ ID NO: 1325255 - RNA, 18 nt, Human
ccacuuucuggaaaugag

SEQ ID NO: 1325256 - RNA, 19 nt, Human
ccccaggcccgagggucuc

SEQ ID NO: 1325257 - RNA, 23 nt, Human
cccccagguuaccacaggacucu

SEQ ID NO: 1325258 - RNA, 26 nt, Human
cgccgguggcgacccuggcggcggcc

SEQ ID NO: 1325259 - RNA, 22 nt, Human
cgcggagggagggcgccggugg

SEQ ID NO: 1325260 - RNA, 23 nt, Human
cgcugaguuuagcugagcugcgc

SEQ ID NO: 1325261 - RNA, 23 nt, Human
cuauuccuggaacaaaggcaagc

SEQ ID NO: 1325262 - RNA, 18 nt, Human
cugcaaaauaaaaccccc

SEQ ID NO: 1325263 - RNA, 19 nt, Human
cugggcaaaacuaacuggu

SEQ ID NO: 1325264 - RNA, 18 nt, Human
gaccacauuuacaggacc

SEQ ID NO: 1325265 - RNA, 19 nt, Human
gagucaacaucagucacug

SEQ ID NO: 1325266 - RNA, 18 nt, Human
gcggagggagggcgccgg

SEQ ID NO: 1325267 - RNA, 19 nt, Human
ggacaucguggcggcucga

SEQ ID NO: 1325268 - RNA, 23 nt, Human
ggcaaaacuaacugguccacaag

SEQ ID NO: 1325269 - RNA, 21 nt, Human
ggggagggaggcgcggaggga

SEQ ID NO: 1325270 - RNA, 18 nt, Human
gggggagggaggcgcgga

SEQ ID NO: 1325271 - RNA, 22 nt, Human
guaaagcaggaggcacaaagcc

SEQ ID NO: 1325272 - RNA, 18 nt, Human
guccacaagagaaaauga

SEQ ID NO: 1325273 - RNA, 21 nt, Human
uaaaaugauaccaaauaccca

SEQ ID NO: 1325274 - RNA, 22 nt, Human
uaaagcaggaggcacaaagcca

SEQ ID NO: 1325275 - RNA, 26 nt, Human
uaccaaauacccaauucuucugcaaa

SEQ ID NO: 1325276 - RNA, 20 nt, Human
ucaaaaagcaccugagaaaa

SEQ ID NO: 1325277 - RNA, 19 nt, Human
ucaaccagguuuguaucua

SEQ ID NO: 1325278 - RNA, 19 nt, Human
ucagucacugaauggcagg

SEQ ID NO: 1325279 - RNA, 20 nt, Human
ucauuucugcauuucccccc

SEQ ID NO: 1325280 - RNA, 24 nt, Human
uccacaagagaaaaugagagacuc

SEQ ID NO: 1325281 - RNA, 20 nt, Human
ucccagagcaccggucccca

SEQ ID NO: 1325282 - RNA, 20 nt, Human
uccccaggcccgagggucuc

SEQ ID NO: 1325283 - RNA, 23 nt, Human
uccccaggcccgagggucucccg

SEQ ID NO: 1325284 - RNA, 26 nt, Human
ucccccagguuaccacaggacucuau

SEQ ID NO: 1325285 - RNA, 26 nt, Human
ucgagggggagggaggcgcggaggga

SEQ ID NO: 1325286 - RNA, 19 nt, Human
ucugcaaaauaaaaccccc

SEQ ID NO: 1325287 - RNA, 20 nt, Human
ugcuuuugaaaagcaccuau

SEQ ID NO: 1325288 - RNA, 21 nt, Human
ugggacagaaggaucaccagu

SEQ ID NO: 1325289 - RNA, 22 nt, Human
uguaaagcaggaggcacaaagc

SEQ ID NO: 1325290 - RNA, 25 nt, Human
uuaaugaucucauuucugcauuucc

SEQ ID NO: 1325291 - RNA, 18 nt, Human
uuccuggaacaaaggcaa

SEQ ID NO: 1325292 - RNA, 19 nt, Human
uucucaauagugucugaca

SEQ ID NO: 1325293 - RNA, 25 nt, Human
uugaaaagcaccuauauaauucugu

SEQ ID NO: 1325294 - RNA, 24 nt, Human
aaagaacugaagccuccuuggccg

SEQ ID NO: 1325295 - RNA, 22 nt, Human
aagaacugaagccuccuuggcc

SEQ ID NO: 1325296 - RNA, 19 nt, Human
aagaagaugccuaggcuuu

SEQ ID NO: 1325297 - RNA, 22 nt, Human
aagaauaaagcugucaaggaaa

SEQ ID NO: 1325298 - RNA, 21 nt, Human
aagacccuuucuacuccaccc

SEQ ID NO: 1325299 - RNA, 24 nt, Human
aagacccuuucuacuccaccccaa

SEQ ID NO: 1325300 - RNA, 23 nt, Human
aaggagcaaggacagaggucagg

SEQ ID NO: 1325301 - RNA, 18 nt, Human
aaggagcugcuucgcagg

SEQ ID NO: 1325302 - RNA, 22 nt, Human
aagucccacccccacccccacc

SEQ ID NO: 1325303 - RNA, 20 nt, Human
accacuuucacaaagaauaa

SEQ ID NO: 1325304 - RNA, 21 nt, Human
accacuuucacaaagaauaaa

SEQ ID NO: 1325305 - RNA, 23 nt, Human
accccaaaagauagccgcuuugu

SEQ ID NO: 1325306 - RNA, 26 nt, Human
accccaaaagauagccgcuuugugga

SEQ ID NO: 1325307 - RNA, 18 nt, Human
acccccacccccacccca

SEQ ID NO: 1325308 - RNA, 28 nt, Human
acccccacccccaccccaguuuucccac

SEQ ID NO: 1325309 - RNA, 19 nt, Human
acgaacucugaaacaagag

SEQ ID NO: 1325310 - RNA, 19 nt, Human
agaaaagcuuaaucugcag

SEQ ID NO: 1325311 - RNA, 21 nt, Human
agaagucccacccccaccccc

SEQ ID NO: 1325312 - RNA, 19 nt, Human
aggcuaucucccuccaaug

SEQ ID NO: 1325313 - RNA, 18 nt, Human
agguggcucugccuuccu

SEQ ID NO: 1325314 - RNA, 28 nt, Human
auccaagacccuuucuacuccaccccaa

SEQ ID NO: 1325315 - RNA, 24 nt, Human
caaucagcugcacagaauucaagu

SEQ ID NO: 1325316 - RNA, 23 nt, Human
cacagaaaacagacccguaggcu

SEQ ID NO: 1325317 - RNA, 24 nt, Human
cacccccaccccaguuuucccacu

SEQ ID NO: 1325318 - RNA, 24 nt, Human
cagaugcggcuuugauggccugug

SEQ ID NO: 1325319 - RNA, 22 nt, Human
cagccucugcaaccagugcccu

SEQ ID NO: 1325320 - RNA, 20 nt, Human
cagcuguggauuccgccuuc

SEQ ID NO: 1325321 - RNA, 25 nt, Human
ccagugcccuccgugagaaagcucc

SEQ ID NO: 1325322 - RNA, 24 nt, Human
cccacccccaccccaguuuuccca

SEQ ID NO: 1325323 - RNA, 25 nt, Human
cccacccccaccccaguuuucccaa

SEQ ID NO: 1325324 - RNA, 21 nt, Human
cccacccccacccccacccca

SEQ ID NO: 1325325 - RNA, 20 nt, Human
ccccaaaagauagccgcuuu

SEQ ID NO: 1325326 - RNA, 22 nt, Human
ccccacccccaccccaguuuuc

SEQ ID NO: 1325327 - RNA, 24 nt, Human
cccccacccccaccccaguuuucc

SEQ ID NO: 1325328 - RNA, 22 nt, Human
cccuuucuacuccaccccaaaa

SEQ ID NO: 1325329 - RNA, 22 nt, Human
ccgcuaagcgacccggggcugc

SEQ ID NO: 1325330 - RNA, 18 nt, Human
ccucugcaaccagugccc

SEQ ID NO: 1325331 - RNA, 23 nt, Human
ccuuccuaucucagcaggggacg

SEQ ID NO: 1325332 - RNA, 19 nt, Human
ccuucuggucuccgccuug

SEQ ID NO: 1325333 - RNA, 18 nt, Human
cgacccggggcugcccga

SEQ ID NO: 1325334 - RNA, 21 nt, Human
cggcaaagaacugaagccucc

SEQ ID NO: 1325335 - RNA, 22 nt, Human
cggcaaagaacugaagccuccu

SEQ ID NO: 1325336 - RNA, 24 nt, Human
cguaggcugcagggagaaggagca

SEQ ID NO: 1325337 - RNA, 20 nt, Human
cucugcaaccagugcccucc

SEQ ID NO: 1325338 - RNA, 22 nt, Human
cugaauauagguaaggguucac

SEQ ID NO: 1325339 - RNA, 22 nt, Human
cugguggacagcagaugcuccc

SEQ ID NO: 1325340 - RNA, 24 nt, Human
gaagucccacccccacccccaccc

SEQ ID NO: 1325341 - RNA, 20 nt, Human
gaggucaggcuaucucccuc

SEQ ID NO: 1325342 - RNA, 21 nt, Human
gcaguuagaagucccaccccc

SEQ ID NO: 1325343 - RNA, 23 nt, Human
ggcaaagaacugaagccuccuug

SEQ ID NO: 1325344 - RNA, 20 nt, Human
ggucuccgccuugcaggcgg

SEQ ID NO: 1325345 - RNA, 20 nt, Human
gucgccagcuguggauuccg

SEQ ID NO: 1325346 - RNA, 20 nt, Human
uaaauuauaccacuuucaca

SEQ ID NO: 1325347 - RNA, 18 nt, Human
uaaggcagccgcggcggc

SEQ ID NO: 1325348 - RNA, 18 nt, Human
uacuucacuuuuuguacc

SEQ ID NO: 1325349 - RNA, 19 nt, Human
uagggaaauaucacucauc

SEQ ID NO: 1325350 - RNA, 22 nt, Human
uagguauagggaaauaucacuc

SEQ ID NO: 1325351 - RNA, 24 nt, Human
uauaccacuuucacaaagaauaaa

SEQ ID NO: 1325352 - RNA, 23 nt, Human
uaucacucaucaaaggguugaca

SEQ ID NO: 1325353 - RNA, 25 nt, Human
uaucucagcaggggacgaacucuga

SEQ ID NO: 1325354 - RNA, 25 nt, Human
uccaagacccuuucuacuccacccc

SEQ ID NO: 1325355 - RNA, 22 nt, Human
uccgggguacggucaaccucug

SEQ ID NO: 1325356 - RNA, 21 nt, Human
uccuuggccgcuaagcgaccc

SEQ ID NO: 1325357 - RNA, 18 nt, Human
ugacauagaagcucacaa

SEQ ID NO: 1325358 - RNA, 18 nt, Human
ugauggccugugcuccgc

SEQ ID NO: 1325359 - RNA, 23 nt, Human
ugcaggcggcaaagaacugaagc

SEQ ID NO: 1325360 - RNA, 26 nt, Human
ugcccgaaggagcugcuucgcagggg

SEQ ID NO: 1325361 - RNA, 24 nt, Human
ugucaaggaaaugggcacacacag

SEQ ID NO: 1325362 - RNA, 25 nt, Human
uucaugcaguuagaagucccacccc

SEQ ID NO: 1325363 - RNA, 18 nt, Human
uuccuaucucagcagggg

SEQ ID NO: 1325364 - RNA, 31 nt, Human; identical to SEQ ID NO: 1208770

SEQ ID NO: 1325365 - RNA, 23 nt, Human
uuuggugaaaaaauacagauaga

SEQ ID NO: 1325366 - RNA, 20 nt, Human
agccagggggugcacacgug

SEQ ID NO: 1325367 - RNA, 19 nt, Human
gauggcaccagcugggggg

SEQ ID NO: 1325368 - RNA, 18 nt, Human
uggcaucagccagggggu

SEQ ID NO: 1325369 - RNA, 21 nt, Human
ugucacacccguggacgaugg

SEQ ID NO: 1325370 - RNA, 19 nt, Human
ugugccaccuucuucccgg

SEQ ID NO: 1325371 - RNA, 19 nt, Human
uguguaggucgugugcugg

SEQ ID NO: 1325372 - RNA, 21 nt, Human
uuugcacgucucugggucugg

SEQ ID NO: 1325373 - RNA, 21 nt, Human
aaagccugggcagccugaaac

SEQ ID NO: 1325374 - RNA, 24 nt, Human
aagcugccgccaccccggccuguc

SEQ ID NO: 1325375 - RNA, 21 nt, Human
accaggugccugguccccugc

SEQ ID NO: 1325376 - RNA, 18 nt, Human
accgcaacacccccgccc

SEQ ID NO: 1325377 - RNA, 21 nt, Human
acgagcagcaagcaggcagaa

SEQ ID NO: 1325378 - RNA, 18 nt, Human
acugcacuccagccuggg

SEQ ID NO: 1325379 - RNA, 18 nt, Human
acugcacuccagccuggg

SEQ ID NO: 1325380 - RNA, 24 nt, Human
acugcacuccagccugggugagag

SEQ ID NO: 1325381 - RNA, 24 nt, Human
acugugucacugcacuccagccug

SEQ ID NO: 1325382 - RNA, 19 nt, Human
agacagaucggccuguggu

SEQ ID NO: 1325383 - RNA, 23 nt, Human
agacggugcugguggcugaagca

SEQ ID NO: 1325384 - RNA, 21 nt, Human
agaggucguacuuguacacgu

SEQ ID NO: 1325385 - RNA, 22 nt, Human
agcaagcaggcagaaccaccac

SEQ ID NO: 1325386 - RNA, 23 nt, Human
agcaggaguggccgucaggccug

SEQ ID NO: 1325387 - RNA, 20 nt, Human
agccaccgcaacacccccgg

SEQ ID NO: 1325388 - RNA, 21 nt, Human
aggagcagaacccgaaacuca

SEQ ID NO: 1325389 - RNA, 20 nt, Human
aggaggagcagacggugcug

SEQ ID NO: 1325390 - RNA, 22 nt, Human
aggaguggccgucaggccuggc

SEQ ID NO: 1325391 - RNA, 21 nt, Human
aggcugaggcgggaggauugc

SEQ ID NO: 1325392 - RNA, 24 nt, Human
aggcugaggcgggaggauugcuug

SEQ ID NO: 1325393 - RNA, 23 nt, Human
agggcucagacagaucggccugu

SEQ ID NO: 1325394 - RNA, 20 nt, Human
aggggagggaaggacauggu

SEQ ID NO: 1325395 - RNA, 23 nt, Human
aggggcugaaggccuccgccguc

SEQ ID NO: 1325396 - RNA, 22 nt, Human
aggucgaggcugcagugagcug

SEQ ID NO: 1325397 - RNA, 23 nt, Human
aggugcugaaggucugcagaacc

SEQ ID NO: 1325398 - RNA, 25 nt, Human
augagcugcagggcccccgguggcu

SEQ ID NO: 1325399 - RNA, 22 nt, Human
augcccggggaacgagcagcaa

SEQ ID NO: 1325400 - RNA, 21 nt, Human
auggcgcccgaccagcugcau

SEQ ID NO: 1325401 - RNA, 19 nt, Human
auucugaggaggagcagac

SEQ ID NO: 1325402 - RNA, 19 nt, Human
auugcuugagcccaggagg

SEQ ID NO: 1325403 - RNA, 19 nt, Human
caagcaccacacggagcua

SEQ ID NO: 1325404 - RNA, 22 nt, Human
caagccacagucaccccccucc

SEQ ID NO: 1325405 - RNA, 19 nt, Human
caagugagacccaccccgc

SEQ ID NO: 1325406 - RNA, 19 nt, Human
caagugagacccaccccgc

SEQ ID NO: 1325407 - RNA, 21 nt, Human
cacaagccacagucacccccc

SEQ ID NO: 1325408 - RNA, 27 nt, Human
cacagcauccaugaacucgaaugcaga

SEQ ID NO: 1325409 - RNA, 23 nt, Human
caccacacggagcuaaacccagc

SEQ ID NO: 1325410 - RNA, 24 nt, Human
caccacgcaagugagacccacccc

SEQ ID NO: 1325411 - RNA, 23 nt, Human
caccccccucccgagggcgucca

SEQ ID NO: 1325412 - RNA, 19 nt, Human
cacgaucacggcccacgug

SEQ ID NO: 1325413 - RNA, 20 nt, Human
cacgugcuuggcgugcgggc

SEQ ID NO: 1325414 - RNA, 18 nt, Human
cacuccagccugggugag

SEQ ID NO: 1325415 - RNA, 22 nt, Human
cacuccagccugggugagagcg

SEQ ID NO: 1325416 - RNA, 19 nt, Human
cacugcacuccagccuggg

SEQ ID NO: 1325417 - RNA, 19 nt, Human
cacugcacuccagccuggg

SEQ ID NO: 1325418 - RNA, 19 nt, Human
cacugcacuccagccuggg

SEQ ID NO: 1325419 - RNA, 20 nt, Human
cacugcacuccagccugggu

SEQ ID NO: 1325420 - RNA, 22 nt, Human
cacugcacuccagccuggguga

SEQ ID NO: 1325421 - RNA, 22 nt, Human
cacugcacuccagccuggguga

SEQ ID NO: 1325422 - RNA, 23 nt, Human
cacugcacuccagccugggugag

SEQ ID NO: 1325423 - RNA, 24 nt, Human
cacugcacuccagccugggugaga

SEQ ID NO: 1325424 - RNA, 21 nt, Human
cagaaccaccacccagcgccu

SEQ ID NO: 1325425 - RNA, 24 nt, Human
cagaacccgaaacucagagcacag

SEQ ID NO: 1325426 - RNA, 19 nt, Human
cagaaccgggccaaauccu

SEQ ID NO: 1325427 - RNA, 18 nt, Human
cagaaccucagcaaagcc

SEQ ID NO: 1325428 - RNA, 22 nt, Human
cagagcacagcuugcccugaua

SEQ ID NO: 1325429 - RNA, 22 nt, Human
cagcaagcaggcagaaccacca

SEQ ID NO: 1325430 - RNA, 18 nt, Human
cagcagcaggaguggccg

SEQ ID NO: 1325431 - RNA, 22 nt, Human
cagcagcaggaguggccgucag

SEQ ID NO: 1325432 - RNA, 24 nt, Human
cagcccucuagaagaugugggaaa

SEQ ID NO: 1325433 - RNA, 28 nt, Human
cagcccucuagaagaugugggaaaugac

SEQ ID NO: 1325434 - RNA, 20 nt, Human
cagcgcucagguccucucgg

SEQ ID NO: 1325435 - RNA, 24 nt, Human
cagcuacucgggaggcugaggcgg

SEQ ID NO: 1325436 - RNA, 20 nt, Human
caggaguggccgucaggccu

SEQ ID NO: 1325437 - RNA, 23 nt, Human
caggccggagcccagcgcgugcu

SEQ ID NO: 1325438 - RNA, 19 nt, Human
caucccggcucagcgccuc

SEQ ID NO: 1325439 - RNA, 19 nt, Human
caugcacacagcauccaug

SEQ ID NO: 1325440 - RNA, 23 nt, Human
ccaccgcaacacccccgcccgag

SEQ ID NO: 1325441 - RNA, 18 nt, Human
ccacgcaugccccccgcu

SEQ ID NO: 1325442 - RNA, 22 nt, Human
ccacgccccccacucugccaga

SEQ ID NO: 1325443 - RNA, 23 nt, Human
ccacgugguccugcccgugcccc

SEQ ID NO: 1325444 - RNA, 18 nt, Human
cccaccccgcuuccacgu

SEQ ID NO: 1325445 - RNA, 19 nt, Human
cccacgcccccugcugccc

SEQ ID NO: 1325446 - RNA, 22 nt, Human
cccacgugguccugcccgugcc

SEQ ID NO: 1325447 - RNA, 18 nt, Human
cccaggacgucccucuuc

SEQ ID NO: 1325448 - RNA, 21 nt, Human
cccaggccgcagcaggcaaga

SEQ ID NO: 1325449 - RNA, 18 nt, Human
cccccgcccgagagccac

SEQ ID NO: 1325450 - RNA, 21 nt, Human
ccccuugcaggugcugaaggu

SEQ ID NO: 1325451 - RNA, 21 nt, Human
cccgcccgagagccacccgcc

SEQ ID NO: 1325452 - RNA, 21 nt, Human
cccgccgacccccagugggcc

SEQ ID NO: 1325453 - RNA, 21 nt, Human
cccuugggguccagcagggcc

SEQ ID NO: 1325454 - RNA, 27 nt, Human
ccgcaacacccccgcccgagagccacc

SEQ ID NO: 1325455 - RNA, 20 nt, Human
ccgccaccccggccugucca

SEQ ID NO: 1325456 - RNA, 24 nt, Human
ccucagagccaccgcaacaccccc

SEQ ID NO: 1325457 - RNA, 18 nt, Human
ccucuagaagauguggga

SEQ ID NO: 1325458 - RNA, 19 nt, Human
ccugguccccugcccacug

SEQ ID NO: 1325459 - RNA, 21 nt, Human
cgcaacacccccgcccgagag

SEQ ID NO: 1325460 - RNA, 21 nt, Human
cggcgggcgggccacggggga

SEQ ID NO: 1325461 - RNA, 22 nt, Human
cgggaggcugaggcgggaggau

SEQ ID NO: 1325462 - RNA, 20 nt, Human
cgggccaaauccuagggcuc

SEQ ID NO: 1325463 - RNA, 19 nt, Human
cgggugggaggcagggaca

SEQ ID NO: 1325464 - RNA, 21 nt, Human
cgggugggccacaggggaggg

SEQ ID NO: 1325465 - RNA, 21 nt, Human
cgucuuguagggguugaggau

SEQ ID NO: 1325466 - RNA, 23 nt, Human
cucagagccaccgcaacaccccc

SEQ ID NO: 1325467 - RNA, 19 nt, Human
cuccgcgcugacgcugccc

SEQ ID NO: 1325468 - RNA, 24 nt, Human
cugaagcagaaccgggccaaaucc

SEQ ID NO: 1325469 - RNA, 24 nt, Human
cugaagcccacuccgugcuccgcg

SEQ ID NO: 1325470 - RNA, 20 nt, Human
cugcccagggcagcugacga

SEQ ID NO: 1325471 - RNA, 22 nt, Human
cugcugcccggccguccacucg

SEQ ID NO: 1325472 - RNA, 20 nt, Human
gacccggcuccauucagcag

SEQ ID NO: 1325473 - RNA, 24 nt, Human
gaggcgggaggauugcuugagccc

SEQ ID NO: 1325474 - RNA, 18 nt, Human
gaggcgggcgcgcagguc

SEQ ID NO: 1325475 - RNA, 22 nt, Human
gcacuccagccugggugagagc

SEQ ID NO: 1325476 - RNA, 18 nt, Human
gcagcagcaggaguggcc

SEQ ID NO: 1325477 - RNA, 19 nt, Human
gcccacgcaugcccgggga

SEQ ID NO: 1325478 - RNA, 24 nt, Human
gcccaggaggucgaggcugcagug

SEQ ID NO: 1325479 - RNA, 19 nt, Human
gcgggccgaggcgggcgcg

SEQ ID NO: 1325480 - RNA, 21 nt, Human
ggaaaugacacauuccugucc

SEQ ID NO: 1325481 - RNA, 19 nt, Human
ggaggaggagggacacggc

SEQ ID NO: 1325482 - RNA, 19 nt, Human
ggccacaggggagggaagg

SEQ ID NO: 1325483 - RNA, 19 nt, Human
ggccacgggggagggaagg

SEQ ID NO: 1325484 - RNA, 19 nt, Human
ggccgaggcgggcgcgcag

SEQ ID NO: 1325485 - RNA, 19 nt, Human
ggccugagggacccggcuc

SEQ ID NO: 1325486 - RNA, 19 nt, Human
gggagggaaggacacggug

SEQ ID NO: 1325487 - RNA, 25 nt, Human
gggagggaaggacacggugggcggg

SEQ ID NO: 1325488 - RNA, 25 nt, Human
gggagggaaggacaugguggguggg

SEQ ID NO: 1325489 - RNA, 20 nt, Human
gggcagcugacgagcagaaa

SEQ ID NO: 1325490 - RNA, 21 nt, Human
gggcagcugacgagcagaaac

SEQ ID NO: 1325491 - RNA, 18 nt, Human
gggccgaggcgggcgcgc

SEQ ID NO: 1325492 - RNA, 18 nt, Human
gggcgggccguggaggag

SEQ ID NO: 1325493 - RNA, 20 nt, Human
ggggagggaaggacauggug

SEQ ID NO: 1325494 - RNA, 20 nt, Human
gggguccagcagggccuuga

SEQ ID NO: 1325495 - RNA, 25 nt, Human
gggguccagcagggccuugagcugc

SEQ ID NO: 1325496 - RNA, 24 nt, Human
gggugccugccacgccccccacuc

SEQ ID NO: 1325497 - RNA, 21 nt, Human
gggugggaggcagggacaugg

SEQ ID NO: 1325498 - RNA, 20 nt, Human
ggugggugggccacggggga

SEQ ID NO: 1325499 - RNA, 25 nt, Human
guaggagcagaacccgaaacucaga

SEQ ID NO: 1325500 - RNA, 24 nt, Human
gucacugcacuccagccuggguga

SEQ ID NO: 1325501 - RNA, 19 nt, Human
gugggcgggccguggagga

SEQ ID NO: 1325502 - RNA, 19 nt, Human
ucaccccccucccgagggc

SEQ ID NO: 1325503 - RNA, 20 nt, Human
ucacugcacuccagccuggg

SEQ ID NO: 1325504 - RNA, 21 nt, Human
ucacugcacuccagccugggu

SEQ ID NO: 1325505 - RNA, 23 nt, Human
ucacugcacuccagccuggguga

SEQ ID NO: 1325506 - RNA, 20 nt, Human
ucagagcacagcuugcccug

SEQ ID NO: 1325507 - RNA, 26 nt, Human
ucagcaaagccugggcagccugaaac

SEQ ID NO: 1325508 - RNA, 27 nt, Human
ucagcaaagccugggcagccugaaacg

SEQ ID NO: 1325509 - RNA, 21 nt, Human
ucaggccuggcugggcagcgu

SEQ ID NO: 1325510 - RNA, 23 nt, Human
ucagguccucucggcaacccacg

SEQ ID NO: 1325511 - RNA, 21 nt, Human
uccagccugggugagagcgag

SEQ ID NO: 1325512 - RNA, 22 nt, Human
uccagccugggugagagcgaga

SEQ ID NO: 1325513 - RNA, 22 nt, Human
ucccaucggucaccaggccgga

SEQ ID NO: 1325514 - RNA, 23 nt, Human
uccccagugcgggcucccagucc

SEQ ID NO: 1325515 - RNA, 25 nt, Human
ucgcccagcccauccgcugcccagg

SEQ ID NO: 1325516 - RNA, 20 nt, Human
ucgggaggcugaggcgggag

SEQ ID NO: 1325517 - RNA, 21 nt, Human
ucuccaagguggccauagccc

SEQ ID NO: 1325518 - RNA, 19 nt, Human
ucucuugcaccgggcuggc

SEQ ID NO: 1325519 - RNA, 20 nt, Human
ucugcagaaccucagcaaag

SEQ ID NO: 1325520 - RNA, 19 nt, Human
ugaggaggagcagacggug

SEQ ID NO: 1325521 - RNA, 22 nt, Human
ugaggcgggaggauugcuugag

SEQ ID NO: 1325522 - RNA, 24 nt, Human
ugaggcgggaggauugcuugagcc

SEQ ID NO: 1325523 - RNA, 21 nt, Human
ugcaugcacacagcauccaug

SEQ ID NO: 1325524 - RNA, 21 nt, Human
ugcccagggcagcugacgagc

SEQ ID NO: 1325525 - RNA, 21 nt, Human
ugcccuugggguccagcaggg

SEQ ID NO: 1325526 - RNA, 20 nt, Human
ugcuuggcgugcgggccgag

SEQ ID NO: 1325527 - RNA, 21 nt, Human
uggaggaggagggacacggcg

SEQ ID NO: 1325528 - RNA, 21 nt, Human
uggccagguggagauggcgcc

SEQ ID NO: 1325529 - RNA, 18 nt, Human
uggcugcagaggccccac

SEQ ID NO: 1325530 - RNA, 18 nt, Human
uggcugggcagcgucuug

SEQ ID NO: 1325531 - RNA, 22 nt, Human
uggcugggcagcgucuuguagg

SEQ ID NO: 1325532 - RNA, 20 nt, Human
ugggaggcagggacauggcg

SEQ ID NO: 1325533 - RNA, 22 nt, Human
ugggaggcagggacauggcggg

SEQ ID NO: 1325534 - RNA, 19 nt, Human
ugggaggcagggacauggg

SEQ ID NO: 1325535 - RNA, 19 nt, Human
ugggccuuggcagcagcag

SEQ ID NO: 1325536 - RNA, 21 nt, Human
ugggugggccacgggggaggg

SEQ ID NO: 1325537 - RNA, 19 nt, Human
uguagacucagcuacucgg

SEQ ID NO: 1325538 - RNA, 20 nt, Human
uuccccagugcgggcuccca

SEQ ID NO: 1325539 - RNA, 24 nt, Human
uuccuguccagacacaagccacag

SEQ ID NO: 1325540 - RNA, 21 nt, Human
uucgaacuuccauuguggaga

SEQ ID NO: 1325541 - RNA, 20 nt, Human
uugagcugcugcaugagcug

SEQ ID NO: 1325542 - RNA, 24 nt, Human
uugcuugagcccaggaggucgagg

SEQ ID NO: 1325543 - RNA, 22 nt, Human
aagaggcaucuccagauguacc

SEQ ID NO: 1325544 - RNA, 23 nt, Human
aagcuguuucuucuuuggugccu

SEQ ID NO: 1325545 - RNA, 18 nt, Human
accaaguauaacuaccaa

SEQ ID NO: 1325546 - RNA, 23 nt, Human
accaaguauaacuaccaaagcug

SEQ ID NO: 1325547 - RNA, 18 nt, Human
guauaacuaccaaagcug

SEQ ID NO: 1325548 - RNA, 21 nt, Human
gucugaccaaguauaacuacc

SEQ ID NO: 1325549 - RNA, 21 nt, Human
guggaagaggcaucuccagau

SEQ ID NO: 1325550 - RNA, 18 nt, Human
uaccugagggguggggag

SEQ ID NO: 1325551 - RNA, 23 nt, Human
uagguuuagaaaacaggauauga

SEQ ID NO: 1325552 - RNA, 22 nt, Human
ucuguugauguaccacccuaga

SEQ ID NO: 1325553 - RNA, 19 nt, Human
uggaagaggcaucuccaga

SEQ ID NO: 1325554 - RNA, 21 nt, Human
auuccaacugauuaccauuua

SEQ ID NO: 1325555 - RNA, 24 nt, Human
caacugauuaccauuuacagugau

SEQ ID NO: 1325556 - RNA, 21 nt, Human
cacacugccaagguccccacc

SEQ ID NO: 1325557 - RNA, 26 nt, Human
ccccagugcaccccagcuccggggca

SEQ ID NO: 1325558 - RNA, 23 nt, Human
ccucucgggggacugcagggaga

SEQ ID NO: 1325559 - RNA, 23 nt, Human
cucauguccacacugccaagguc

SEQ ID NO: 1325560 - RNA, 24 nt, Human
cugccgggaaagagcuccugaagu

SEQ ID NO: 1325561 - RNA, 24 nt, Human
gacugcagggagaggcgucuccag

SEQ ID NO: 1325562 - RNA, 25 nt, Human
gcucagaguuaucacugaacuucag

SEQ ID NO: 1325563 - RNA, 21 nt, Human
ggacaggggagagggcaggag

SEQ ID NO: 1325564 - RNA, 22 nt, Human
ggcagaagaggcagccugcaga

SEQ ID NO: 1325565 - RNA, 18 nt, Human
gggagagggcaggagacu

SEQ ID NO: 1325566 - RNA, 18 nt, Human
ucaggacaggggagaggg

SEQ ID NO: 1325567 - RNA, 20 nt, Human
ucaggacaggggagagggca

SEQ ID NO: 1325568 - RNA, 23 nt, Human
ucaggacaggggagagggcagga

SEQ ID NO: 1325569 - RNA, 22 nt, Human
uccaacugauuaccauuuacag

SEQ ID NO: 1325570 - RNA, 23 nt, Human
uccccagugcaccccagcuccgg

SEQ ID NO: 1325571 - RNA, 25 nt, Human
ucuccagugggcagccuuucccaag

SEQ ID NO: 1325572 - RNA, 22 nt, Human
ucugcucauguccacacugcca

SEQ ID NO: 1325573 - RNA, 20 nt, Human
ugaaguuguggggucugggg

SEQ ID NO: 1325574 - RNA, 18 nt, Human
cuguauauaaauucuccu

SEQ ID NO: 1325575 - RNA, 21 nt, Human
aaauccaucucuagcagcaag

SEQ ID NO: 1325576 - RNA, 24 nt, Human
gauggcgggaggacaagaggcagg

SEQ ID NO: 1325577 - RNA, 22 nt, Human
gcgggaggacaagaggcaggag

SEQ ID NO: 1325578 - RNA, 22 nt, Human
ggacaagaggcaggagcccaga

SEQ ID NO: 1325579 - RNA, 21 nt, Human
gggaggacaagaggcaggagc

SEQ ID NO: 1325580 - RNA, 18 nt, Human
ucuagcagcaaguuucag

SEQ ID NO: 1325581 - RNA, 22 nt, Human
aagaacaccaguaguugaggac

SEQ ID NO: 1325582 - RNA, 24 nt, Human
agauugcagauucccugaagaaca

SEQ ID NO: 1325583 - RNA, 25 nt, Human
cccugaagaacaccaguaguugagg

SEQ ID NO: 1325584 - RNA, 18 nt, Human
ccuucaaacuguagccua

SEQ ID NO: 1325585 - RNA, 21 nt, Human
cugaagaacaccaguaguuga

SEQ ID NO: 1325586 - RNA, 19 nt, Human
uagauugcagauucccuga

SEQ ID NO: 1325587 - RNA, 23 nt, Human
uccguuuuucaauggcuuccuuc

SEQ ID NO: 1325588 - RNA, 21 nt, Human
aaaggaaacaugggggcaagg

SEQ ID NO: 1325589 - RNA, 19 nt, Human
aagcgcaggaggggcgggg

SEQ ID NO: 1325590 - RNA, 24 nt, Human
aaggucugcaggguccuggucagc

SEQ ID NO: 1325591 - RNA, 19 nt, Human
agcagcaaagccgcuucug

SEQ ID NO: 1325592 - RNA, 19 nt, Human
aggaaacaugggggcaagg

SEQ ID NO: 1325593 - RNA, 21 nt, Human
caaggucugcaggguccuggu

SEQ ID NO: 1325594 - RNA, 19 nt, Human
cacuuccuagcagcaaagc

SEQ ID NO: 1325595 - RNA, 18 nt, Human
ccccgugccggggcgucc

SEQ ID NO: 1325596 - RNA, 21 nt, Human
ccuugggaccaucugucuggg

SEQ ID NO: 1325597 - RNA, 20 nt, Human
cuagcagcaaagccgcuucu

SEQ ID NO: 1325598 - RNA, 20 nt, Human
cuggcggccacgggucuccc

SEQ ID NO: 1325599 - RNA, 21 nt, Human
cuucauaaaggaaacaugggg

SEQ ID NO: 1325600 - RNA, 20 nt, Human
cuuugcgccuucuggaaagu

SEQ ID NO: 1325601 - RNA, 18 nt, Human
ggaacaauagggcaccug

SEQ ID NO: 1325602 - RNA, 18 nt, Human
ggaggggcggggguggga

SEQ ID NO: 1325603 - RNA, 21 nt, Human
gggccccgcgauguuuuccag

SEQ ID NO: 1325604 - RNA, 22 nt, Human
uagaugaggaacaauagggcac

SEQ ID NO: 1325605 - RNA, 22 nt, Human
ucagcagacaggugcacuuccu

SEQ ID NO: 1325606 - RNA, 22 nt, Human
ucuggguggggguggaacuggg

SEQ ID NO: 1325607 - RNA, 19 nt, Human
ugccggggcguccaccgga

SEQ ID NO: 1325608 - RNA, 20 nt, Human
ugccggggcguccaccggag

SEQ ID NO: 1325609 - RNA, 19 nt, Human
ugggaagaggagagcgaca

SEQ ID NO: 1325610 - RNA, 21 nt, Human
ugggacagucaggaucagagu

SEQ ID NO: 1325611 - RNA, 19 nt, Human
ugggaccaucugucugggu

SEQ ID NO: 1325612 - RNA, 18 nt, Human
ugggagaaacuuugcgcc

SEQ ID NO: 1325613 - RNA, 23 nt, Human
uucauaaaggaaacaugggggca

SEQ ID NO: 1325614 - RNA, 23 nt, Human
uugggaccaucugucuggguggg

SEQ ID NO: 1325615 - RNA, 20 nt, Human
aauaaaaccucagcauauga

SEQ ID NO: 1325616 - RNA, 18 nt, Human
acaucaccaacuccaucu

SEQ ID NO: 1325617 - RNA, 26 nt, Human
auccagaaccacaaacuaccauaggg

SEQ ID NO: 1325618 - RNA, 21 nt, Human
cagggaaacccuuugcaaaga

SEQ ID NO: 1325619 - RNA, 20 nt, Human
cagugaaguaagauauggug

SEQ ID NO: 1325620 - RNA, 18 nt, Human
ccuccucccuccucagau

SEQ ID NO: 1325621 - RNA, 28 nt, Human
cugcuggagucuaaaggcuuggugucuu

SEQ ID NO: 1325622 - RNA, 20 nt, Human
cuggacuaaauaaaaccuca

SEQ ID NO: 1325623 - RNA, 23 nt, Human
cugugaauugggaguagucguau

SEQ ID NO: 1325624 - RNA, 24 nt, Human
cuugaaaaugccagcucauuccca

SEQ ID NO: 1325625 - RNA, 21 nt, Human
gaacaagcaggugaccaaagu

SEQ ID NO: 1325626 - RNA, 18 nt, Human
gcaaagauuucauccaga

SEQ ID NO: 1325627 - RNA, 22 nt, Human
gcgaggcguuugauagcuuggg

SEQ ID NO: 1325628 - RNA, 20 nt, Human
guaaauauguacugaaaacc

SEQ ID NO: 1325629 - RNA, 24 nt, Human
uaaauauguacugaaaaccucuga

SEQ ID NO: 1325630 - RNA, 20 nt, Human
uacaucccaucccacccuuu

SEQ ID NO: 1325631 - RNA, 21 nt, Human
ucagugaaguaagauaugguu

SEQ ID NO: 1325632 - RNA, 21 nt, Human
uccaucuuccuugggcaccuc

SEQ ID NO: 1325633 - RNA, 23 nt, Human
uccuucagcaucuggacuaaaua

SEQ ID NO: 1325634 - RNA, 24 nt, Human
ucucuugguauccuccuccuccaa

SEQ ID NO: 1325635 - RNA, 20 nt, Human
ugaaugacugaugagucacu

SEQ ID NO: 1325636 - RNA, 22 nt, Human
ugacuucagugaaguaagauau

SEQ ID NO: 1325637 - RNA, 19 nt, Human
ugagugccagggaaacccu

SEQ ID NO: 1325638 - RNA, 22 nt, Human
ugcaaagauuucauccagaacc

SEQ ID NO: 1325639 - RNA, 19 nt, Human
ugcaggcuuugauuucuga

SEQ ID NO: 1325640 - RNA, 23 nt, Human
ugguggccugugaacaagcaggu

SEQ ID NO: 1325641 - RNA, 22 nt, Human
ugugaacaagcaggugaccaaa

SEQ ID NO: 1325642 - RNA, 21 nt, Human
uucuguuugagugccagggaa

SEQ ID NO: 1325643 - RNA, 22 nt, Human
uugccagccucaggcucucuuc

SEQ ID NO: 1325644 - RNA, 21 nt, Human
uuggagccuccucccuccuca

SEQ ID NO: 1325645 - RNA, 21 nt, Human
uuuucauccacccaguagcug

SEQ ID NO: 1325646 - RNA, 23 nt, Human
aaagauaaacaaauuagaggcca

SEQ ID NO: 1325647 - RNA, 20 nt, Human
aagcggccgagaggcaggag

SEQ ID NO: 1325648 - RNA, 20 nt, Human
agaggcaggaggccgggccc

SEQ ID NO: 1325649 - RNA, 23 nt, Human
agauaaacaaauuagaggccaag

SEQ ID NO: 1325650 - RNA, 22 nt, Human
aggcaggagcuggaccugcuga

SEQ ID NO: 1325651 - RNA, 18 nt, Human
aggcaggaggccgggccu

SEQ ID NO: 1325652 - RNA, 22 nt, Human
aggcaggaggccgggccugcaa

SEQ ID NO: 1325653 - RNA, 24 nt, Human
aggcaggaggccgggccugcaaag

SEQ ID NO: 1325654 - RNA, 18 nt, Human
cccgugcaggccuucgag

SEQ ID NO: 1325655 - RNA, 20 nt, Human
ccgggccugcaaaggcccac

SEQ ID NO: 1325656 - RNA, 18 nt, Human
cgagaggcaggaggccgg

SEQ ID NO: 1325657 - RNA, 22 nt, Human
cgggagcugggccugccgaagc

SEQ ID NO: 1325658 - RNA, 18 nt, Human
cugggccuaaagaggcca

SEQ ID NO: 1325659 - RNA, 22 nt, Human
cugggccugaagaggccgccaa

SEQ ID NO: 1325660 - RNA, 19 nt, Human
gaggcaggagcuggaccug

SEQ ID NO: 1325661 - RNA, 18 nt, Human
gcgggagcugggccugcc

SEQ ID NO: 1325662 - RNA, 21 nt, Human
ggaagggaaaaacggggccug

SEQ ID NO: 1325663 - RNA, 28 nt, Human
ggaggcaggagcuggaccucccaagggg

SEQ ID NO: 1325664 - RNA, 20 nt, Human
ggaggccgggccugcaaagg

SEQ ID NO: 1325665 - RNA, 18 nt, Human
ggccgagaggcaggaguu

SEQ ID NO: 1325666 - RNA, 20 nt, Human
ggccugaagaggccgccaaa

SEQ ID NO: 1325667 - RNA, 19 nt, Human
gugaggcagaggcugggcc

SEQ ID NO: 1325668 - RNA, 21 nt, Human
uaaacaaauuagaggccaaga

SEQ ID NO: 1325669 - RNA, 20 nt, Human
ucugcugugaggcagaggcu

SEQ ID NO: 1325670 - RNA, 18 nt, Human
ugaggcagaggcugggcc

SEQ ID NO: 1325671 - RNA, 23 nt, Human
ugccggaagggaaaaacggggcc

SEQ ID NO: 1325672 - RNA, 18 nt, Human
uggaggucaaguucuggg

SEQ ID NO: 1325673 - RNA, 22 nt, Human
uggcaggcgggagcugggccug

SEQ ID NO: 1325674 - RNA, 20 nt, Human
ugggccuaaagaggccacug

SEQ ID NO: 1325675 - RNA, 18 nt, Human
ugugaggaaugagcuggg

SEQ ID NO: 1325676 - RNA, 18 nt, Human
ugugaggccgaggccggg

SEQ ID NO: 1325677 - RNA, 23 nt, Human
aaaauagaaaaacaagggaaaga

SEQ ID NO: 1325678 - RNA, 23 nt, Human
aaacacuugaaacacugcuuuga

SEQ ID NO: 1325679 - RNA, 20 nt, Human
cagcucagcaagcauccucu

SEQ ID NO: 1325680 - RNA, 23 nt, Human
cuuugaaagauaaaauagaaaaa

SEQ ID NO: 1325681 - RNA, 23 nt, Human
uaaaauagaaaaacaagggaaag

SEQ ID NO: 1325682 - RNA, 22 nt, Human
uagaaaaacaagggaaagaaga

SEQ ID NO: 1325683 - RNA, 20 nt, Human
uagauuaguuuauaaacacu

SEQ ID NO: 1325684 - RNA, 21 nt, Human
aaacaucuggaaagacugugg

SEQ ID NO: 1325685 - RNA, 21 nt, Human
aagucaaccacacacaaccac

SEQ ID NO: 1325686 - RNA, 22 nt, Human
aaugaaaggagaaacaucugga

SEQ ID NO: 1325687 - RNA, 20 nt, Human
acccgggcuguuuucugucc

SEQ ID NO: 1325688 - RNA, 21 nt, Human
agacuccaucucaaacaaaag

SEQ ID NO: 1325689 - RNA, 24 nt, Human
agggaguucccaggacccaggaag

SEQ ID NO: 1325690 - RNA, 23 nt, Human
aggguugaagucgccacaggggu

SEQ ID NO: 1325691 - RNA, 25 nt, Human
aguagauggaaaaugaaaggagaaa

SEQ ID NO: 1325692 - RNA, 19 nt, Human
aucuggaaagacugugggg

SEQ ID NO: 1325693 - RNA, 21 nt, Human
caaaugccucaacacuaggcc

SEQ ID NO: 1325694 - RNA, 27 nt, Human
caaccaccaugcuccguuuuccagggc

SEQ ID NO: 1325695 - RNA, 19 nt, Human
cacacaaccaccaugcucc

SEQ ID NO: 1325696 - RNA, 20 nt, Human
cacacacaaccaccaugcuc

SEQ ID NO: 1325697 - RNA, 19 nt, Human
cagcuuucccccucagcuu

SEQ ID NO: 1325698 - RNA, 22 nt, Human
caggacccaggaagucaaccac

SEQ ID NO: 1325699 - RNA, 19 nt, Human
cagucaacugugggugaug

SEQ ID NO: 1325700 - RNA, 20 nt, Human
cauucucgcuccagcccagg

SEQ ID NO: 1325701 - RNA, 22 nt, Human
ccaccaugcuccguuuuccagg

SEQ ID NO: 1325702 - RNA, 20 nt, Human
ccagccagaaccuuccuagu

SEQ ID NO: 1325703 - RNA, 21 nt, Human
cccagcccugcugccccggga

SEQ ID NO: 1325704 - RNA, 19 nt, Human
cccaggaagucaaccacac

SEQ ID NO: 1325705 - RNA, 20 nt, Human
cccgggcuguuuucuguccc

SEQ ID NO: 1325706 - RNA, 20 nt, Human
cccugacucaugaagaaccc

SEQ ID NO: 1325707 - RNA, 18 nt, Human
ccguuuccagggccuugg

SEQ ID NO: 1325708 - RNA, 19 nt, Human
cguccccagcccugcugcc

SEQ ID NO: 1325709 - RNA, 21 nt, Human
cuccguuuuccagggccuugg

SEQ ID NO: 1325710 - RNA, 27 nt, Human
cucguccccagcccugcugccgguucc

SEQ ID NO: 1325711 - RNA, 18 nt, Human
gcccucguccccagcccu

SEQ ID NO: 1325712 - RNA, 23 nt, Human
uccagggccuuggacaaaugccu

SEQ ID NO: 1325713 - RNA, 19 nt, Human
ucccaggguugaagucgcc

SEQ ID NO: 1325714 - RNA, 20 nt, Human
uccugagccucgguuugcuc

SEQ ID NO: 1325715 - RNA, 21 nt, Human
ucugucccuucccuuccaggg

SEQ ID NO: 1325716 - RNA, 23 nt, Human
ugacucaugaagaacccuugccu

SEQ ID NO: 1325717 - RNA, 18 nt, Human
ugccuucuggaccauucc

SEQ ID NO: 1325718 - RNA, 18 nt, Human
uggaaaaugaaaggagaa

SEQ ID NO: 1325719 - RNA, 18 nt, Human
uggaaagacuguggggcc

SEQ ID NO: 1325720 - RNA, 22 nt, Human
ugggcaagacuccaucucaaac

SEQ ID NO: 1325721 - RNA, 18 nt, Human
uugcucaucuguaagaug

SEQ ID NO: 1325722 - RNA, 24 nt, Human
aaaccaaagaccacauccagaaga

SEQ ID NO: 1325723 - RNA, 21 nt, Human
aaagaccacauccagaagaaa

SEQ ID NO: 1325724 - RNA, 24 nt, Human
aaagaccacauccagaagaaaauc

SEQ ID NO: 1325725 - RNA, 18 nt, Human
aaccaaagaccacaucca

SEQ ID NO: 1325726 - RNA, 20 nt, Human
aagaaaaucaagauggccca

SEQ ID NO: 1325727 - RNA, 24 nt, Human
aagaaacgcgugccaaagagaaca

SEQ ID NO: 1325728 - RNA, 25 nt, Human
acagccgacaccauggagaacagua

SEQ ID NO: 1325729 - RNA, 22 nt, Human
accauggagaacaguaagaaac

SEQ ID NO: 1325730 - RNA, 22 nt, Human
agacagccgacaccauggagaa

SEQ ID NO: 1325731 - RNA, 23 nt, Human
caguaagaaacgcgugccaaaga

SEQ ID NO: 1325732 - RNA, 19 nt, Human
ccagaacuugucacagucu

SEQ ID NO: 1325733 - RNA, 18 nt, Human
cugaaaaccaaagaccac

SEQ ID NO: 1325734 - RNA, 18 nt, Human
gagaacaguaagaaacgc

SEQ ID NO: 1325735 - RNA, 25 nt, Human
gugccaaagagaacaagugaggauc

SEQ ID NO: 1325736 - RNA, 19 nt, Human
ucaguugcagguacugcuu

SEQ ID NO: 1325737 - RNA, 19 nt, Human
uccccgggaagaauccuca

SEQ ID NO: 1325738 - RNA, 24 nt, Human
uccccgggaagaauccucaguugc

SEQ ID NO: 1325739 - RNA, 18 nt, Human
aggaguguucaggaucug

SEQ ID NO: 1325740 - RNA, 19 nt, Human
aggaguguucaggaucugc

SEQ ID NO: 1325741 - RNA, 19 nt, Human
augcugccuugggagccca

SEQ ID NO: 1325742 - RNA, 20 nt, Human
augcugccuugggagcccau

SEQ ID NO: 1325743 - RNA, 21 nt, Human
augcugccuugggagcccaug

SEQ ID NO: 1325744 - RNA, 25 nt, Human
caaagugccaggccccuuuccuaug

SEQ ID NO: 1325745 - RNA, 23 nt, Human
cagccgccgggcagcuggggugg

SEQ ID NO: 1325746 - RNA, 18 nt, Human
ccuugggagcccaugcug

SEQ ID NO: 1325747 - RNA, 20 nt, Human
gcagcuggggugggguggga

SEQ ID NO: 1325748 - RNA, 19 nt, Human
uaacaggaaacacguggca

SEQ ID NO: 1325749 - RNA, 22 nt, Human
uggaaguguccccagagcccuc

SEQ ID NO: 1325750 - RNA, 19 nt, Human
ugggagagcagcuggggau

SEQ ID NO: 1325751 - RNA, 21 nt, Human
ugggguggggugggagagcag

SEQ ID NO: 1325752 - RNA, 18 nt, Human
aaauaucucuucgauauc

SEQ ID NO: 1325753 - RNA, 22 nt, Human
aaggcugaauaauauuccauua

SEQ ID NO: 1325754 - RNA, 18 nt, Human
agguucaucuauguugua

SEQ ID NO: 1325755 - RNA, 18 nt, Human
cacaacauccucaagguu

SEQ ID NO: 1325756 - RNA, 20 nt, Human
caguagggacugagcucgug

SEQ ID NO: 1325757 - RNA, 19 nt, Human
cauuccuaucagcauugca

SEQ ID NO: 1325758 - RNA, 21 nt, Human
cgcgcggaggauggauugcuc

SEQ ID NO: 1325759 - RNA, 20 nt, Human
cgcgugcgaacgugugugcg

SEQ ID NO: 1325760 - RNA, 26 nt, Human
gggauugcuggaucauaugguagcuu

SEQ ID NO: 1325761 - RNA, 22 nt, Human
uauccugcuuucaauucuuuug

SEQ ID NO: 1325762 - RNA, 18 nt, Human
uauugcacuuggcacaac

SEQ ID NO: 1325763 - RNA, 24 nt, Human
uauugugaauagugcugcaaugaa

SEQ ID NO: 1325764 - RNA, 21 nt, Human
uccagcgcgccggccgccgcg

SEQ ID NO: 1325765 - RNA, 24 nt, Human
ucuuggcuauugugaauagugcug

SEQ ID NO: 1325766 - RNA, 20 nt, Human
ugcauaguggugguaccauc

SEQ ID NO: 1325767 - RNA, 19 nt, Human
ugcuucaaccucuuggcua

SEQ ID NO: 1325768 - RNA, 18 nt, Human
uuugggcugcuucaaccu

SEQ ID NO: 1325769 - RNA, 21 nt, Human
aagaggcacccacccgaccca

SEQ ID NO: 1325770 - RNA, 24 nt, Human
accacauucgagcugcuuucaguc

SEQ ID NO: 1325771 - RNA, 19 nt, Human
accauuuggccagcaaagc

SEQ ID NO: 1325772 - RNA, 20 nt, Human
acccacccgacccaacccga

SEQ ID NO: 1325773 - RNA, 22 nt, Human
acccgagcccauauccaggccc

SEQ ID NO: 1325774 - RNA, 28 nt, Human
accugccuuccccggggcagaucuccau

SEQ ID NO: 1325775 - RNA, 22 nt, Human
acucaccugccuuccccggggc

SEQ ID NO: 1325776 - RNA, 22 nt, Human
acucugcagccacaauggcaga

SEQ ID NO: 1325777 - RNA, 21 nt, Human
agagcuugcccaccuccgcau

SEQ ID NO: 1325778 - RNA, 19 nt, Human
agaggaaggcagaggaggg

SEQ ID NO: 1325779 - RNA, 20 nt, Human
agcaaagccuaaaacacaua

SEQ ID NO: 1325780 - RNA, 21 nt, Human
agcacuuucucucuguucugu

SEQ ID NO: 1325781 - RNA, 24 nt, Human
agcaucuucccacccccagggggc

SEQ ID NO: 1325782 - RNA, 24 nt, Human
agccacaauggcagagcugaguag

SEQ ID NO: 1325783 - RNA, 26 nt, Human
agccugguggccugggaccagcccug

SEQ ID NO: 1325784 - RNA, 18 nt, Human
aggaaggcagaggaggga

SEQ ID NO: 1325785 - RNA, 20 nt, Human
aggagccacaccacgcagag

SEQ ID NO: 1325786 - RNA, 19 nt, Human
aggcagaggagggaggaac

SEQ ID NO: 1325787 - RNA, 22 nt, Human
aggcagaggagggaggaacugu

SEQ ID NO: 1325788 - RNA, 23 nt, Human
aggcagaggagggaggaacugug

SEQ ID NO: 1325789 - RNA, 24 nt, Human
aggucucuuuauccuccuuggcug

SEQ ID NO: 1325790 - RNA, 18 nt, Human
aucgcagcucacuuuuac

SEQ ID NO: 1325791 - RNA, 22 nt, Human
aucguugcuuaacuguuuuccu

SEQ ID NO: 1325792 - RNA, 20 nt, Human
augccaccuccucagcucuc

SEQ ID NO: 1325793 - RNA, 24 nt, Human
caagaaugccaccuccucagcucu

SEQ ID NO: 1325794 - RNA, 26 nt, Human
cacccaggccacagggggauggaggc

SEQ ID NO: 1325795 - RNA, 20 nt, Human
caccuccucagcucucuccc

SEQ ID NO: 1325796 - RNA, 21 nt, Human
caccuccucagcucucucccu

SEQ ID NO: 1325797 - RNA, 26 nt, Human
cacucugcagccacaauggcagagcu

SEQ ID NO: 1325798 - RNA, 18 nt, Human
cagccucagagcacgcag

SEQ ID NO: 1325799 - RNA, 18 nt, Human
cagcucucucccucaagg

SEQ ID NO: 1325800 - RNA, 25 nt, Human
cagcucucucccucaaggaggagcc

SEQ ID NO: 1325801 - RNA, 18 nt, Human
cagcuucucgcagcccuc

SEQ ID NO: 1325802 - RNA, 22 nt, Human
cauugagcaucuucccaccccc

SEQ ID NO: 1325803 - RNA, 18 nt, Human
cauugcacccagccuggu

SEQ ID NO: 1325804 - RNA, 21 nt, Human
cauugcacccagccugguggc

SEQ ID NO: 1325805 - RNA, 24 nt, Human
cauugcacccagccugguggccug

SEQ ID NO: 1325806 - RNA, 22 nt, Human
cauuuggccagcaaagccuaaa

SEQ ID NO: 1325807 - RNA, 19 nt, Human
ccaacccgacccgacccga

SEQ ID NO: 1325808 - RNA, 19 nt, Human
ccacaccacgcagaggaag

SEQ ID NO: 1325809 - RNA, 22 nt, Human
ccacaccacgcagaggaaggca

SEQ ID NO: 1325810 - RNA, 19 nt, Human
ccacguguggacgcugggg

SEQ ID NO: 1325811 - RNA, 25 nt, Human
ccagcaaagccuaaaacagcggacc

SEQ ID NO: 1325812 - RNA, 20 nt, Human
ccaggcccagugagcucugc

SEQ ID NO: 1325813 - RNA, 22 nt, Human
cccacccccagggggccuggaa

SEQ ID NO: 1325814 - RNA, 22 nt, Human
cccauggccucuguguucuucu

SEQ ID NO: 1325815 - RNA, 19 nt, Human
ccccacccagccaaggcua

SEQ ID NO: 1325816 - RNA, 23 nt, Human
cccccagggggccuggaagacuu

SEQ ID NO: 1325817 - RNA, 27 nt, Human
cccccgcugccuccacguguggacgcu

SEQ ID NO: 1325818 - RNA, 21 nt, Human
cccgacccgacccucgggagc

SEQ ID NO: 1325819 - RNA, 22 nt, Human
cccucgggagcccugcucucug

SEQ ID NO: 1325820 - RNA, 22 nt, Human
cccugcucucuggucaguuggc

SEQ ID NO: 1325821 - RNA, 21 nt, Human
cccuggaguccaucguugcuu

SEQ ID NO: 1325822 - RNA, 19 nt, Human
ccucaguuaggguaagagg

SEQ ID NO: 1325823 - RNA, 21 nt, Human
ccuccucagcucucucccuca

SEQ ID NO: 1325824 - RNA, 25 nt, Human
ccuugugucauggcugacaugcuug

SEQ ID NO: 1325825 - RNA, 19 nt, Human
cggcugcccccgcugccuc

SEQ ID NO: 1325826 - RNA, 22 nt, Human
cgggaaaagaaauaugucaagu

SEQ ID NO: 1325827 - RNA, 22 nt, Human
cuacacucaccugccuuccccg

SEQ ID NO: 1325828 - RNA, 26 nt, Human
cucacuuuuacggagcacuuucucuc

SEQ ID NO: 1325829 - RNA, 21 nt, Human
cucauucacuuucagaagguc

SEQ ID NO: 1325830 - RNA, 22 nt, Human
cucuguagcagaaugugcuacu

SEQ ID NO: 1325831 - RNA, 24 nt, Human
cugcgucgggggguugggggggca

SEQ ID NO: 1325832 - RNA, 18 nt, Human
cuguucuggagcucaggg

SEQ ID NO: 1325833 - RNA, 22 nt, Human
cuuccuggucagaucccucugg

SEQ ID NO: 1325834 - RNA, 19 nt, Human
gaaaucuuccuuuggguga

SEQ ID NO: 1325835 - RNA, 18 nt, Human
gaacacagucauacucau

SEQ ID NO: 1325836 - RNA, 23 nt, Human
gacccucgggagcccugcucucu

SEQ ID NO: 1325837 - RNA, 18 nt, Human
gagcucagggucgggcag

SEQ ID NO: 1325838 - RNA, 22 nt, Human
gagguggguggaggaaugaggu

SEQ ID NO: 1325839 - RNA, 22 nt, Human
gcagcccucccuccuuccuaca

SEQ ID NO: 1325840 - RNA, 22 nt, Human
gccugguggccugggaccagcc

SEQ ID NO: 1325841 - RNA, 23 nt, Human
gccugguggccugggaccagccc

SEQ ID NO: 1325842 - RNA, 21 nt, Human
ggaagcaagaaugccaccucc

SEQ ID NO: 1325843 - RNA, 23 nt, Human
ggagguggguggaggaaugaggu

SEQ ID NO: 1325844 - RNA, 20 nt, Human
ggauggaggcugcccccagc

SEQ ID NO: 1325845 - RNA, 21 nt, Human
ggauggaggcugcccccagcu

SEQ ID NO: 1325846 - RNA, 23 nt, Human
gggaaaagaaauaugucaaguau

SEQ ID NO: 1325847 - RNA, 22 nt, Human
gggaagcaagaaugccaccucc

SEQ ID NO: 1325848 - RNA, 18 nt, Human
gggggauggaggcugccc

SEQ ID NO: 1325849 - RNA, 19 nt, Human
gggguggggaggugggugg

SEQ ID NO: 1325850 - RNA, 18 nt, Human
gggguugggggggcacag

SEQ ID NO: 1325851 - RNA, 19 nt, Human
guccagggcagagccucag

SEQ ID NO: 1325852 - RNA, 27 nt, Human
uaagaggcacccacccgacccaacccg

SEQ ID NO: 1325853 - RNA, 21 nt, Human
uagaugagggcauuaucuccc

SEQ ID NO: 1325854 - RNA, 22 nt, Human
ucacucugcagccacaauggca

SEQ ID NO: 1325855 - RNA, 23 nt, Human
ucacugcugggccauguggacgg

SEQ ID NO: 1325856 - RNA, 22 nt, Human
ucauacucauucacuuucagaa

SEQ ID NO: 1325857 - RNA, 18 nt, Human
ucauggcugacaugcuug

SEQ ID NO: 1325858 - RNA, 21 nt, Human
ucauggggguggggagguggg

SEQ ID NO: 1325859 - RNA, 23 nt, Human
uccagcaucaaacuuuucacucc

SEQ ID NO: 1325860 - RNA, 20 nt, Human
uccccggggcagaucuccau

SEQ ID NO: 1325861 - RNA, 23 nt, Human
ucccucuggguugagagcucuuc

SEQ ID NO: 1325862 - RNA, 18 nt, Human
ucucccacugccccacca

SEQ ID NO: 1325863 - RNA, 24 nt, Human
ucuccgguuuucccccuggagucc

SEQ ID NO: 1325864 - RNA, 18 nt, Human
ucugcaggggcuuccugg

SEQ ID NO: 1325865 - RNA, 23 nt, Human
ucuguguucuucuuccuaauggg

SEQ ID NO: 1325866 - RNA, 18 nt, Human
ucuucuccgguuuucccc

SEQ ID NO: 1325867 - RNA, 20 nt, Human
ugacaugucccaccugucuc

SEQ ID NO: 1325868 - RNA, 18 nt, Human
ugagagcucuucccccuc

SEQ ID NO: 1325869 - RNA, 19 nt, Human
ugagcaucuucccaccccc

SEQ ID NO: 1325870 - RNA, 20 nt, Human
ugagcaucuucccacccccu

SEQ ID NO: 1325871 - RNA, 21 nt, Human
ugagucagggaagcaagaaug

SEQ ID NO: 1325872 - RNA, 21 nt, Human
ugcagaaggaagucacggcug

SEQ ID NO: 1325873 - RNA, 19 nt, Human
ugcagccacaauggcagag

SEQ ID NO: 1325874 - RNA, 22 nt, Human
ugcccccagcuucucgcagccc

SEQ ID NO: 1325875 - RNA, 19 nt, Human
ugccuggcgcuccuggagg

SEQ ID NO: 1325876 - RNA, 21 nt, Human
uggcaugcuuugacagcaagu

SEQ ID NO: 1325877 - RNA, 22 nt, Human
uggccucuguguucuucuuccu

SEQ ID NO: 1325878 - RNA, 21 nt, Human
uggcugacaugcuugucuccu

SEQ ID NO: 1325879 - RNA, 19 nt, Human
ugggaagcugcgucggggg

SEQ ID NO: 1325880 - RNA, 19 nt, Human
ugggaagcugcgucggggg

SEQ ID NO: 1325881 - RNA, 20 nt, Human
ugggaagcugcgucgggggg

SEQ ID NO: 1325882 - RNA, 20 nt, Human
uggggguggggaggugggug

SEQ ID NO: 1325883 - RNA, 20 nt, Human
uggguggaggaaugagguuu

SEQ ID NO: 1325884 - RNA, 21 nt, Human
ugguuccuccgcuccauucuc

SEQ ID NO: 1325885 - RNA, 24 nt, Human
ugucugcaggggcuuccugggugg

SEQ ID NO: 1325886 - RNA, 21 nt, Human
ugugaaaucuuccuuugggug

SEQ ID NO: 1325887 - RNA, 18 nt, Human
ugugcucccaguguggga

SEQ ID NO: 1325888 - RNA, 21 nt, Human
uguucugugccacccgagccc

SEQ ID NO: 1325889 - RNA, 18 nt, Human
uucauuccgcucuguagc

SEQ ID NO: 1325890 - RNA, 20 nt, Human
uuccccggggcagaucucca

SEQ ID NO: 1325891 - RNA, 19 nt, Human
uugcccaccuccgcaucgc

SEQ ID NO: 1325892 - RNA, 22 nt, Human
uugcccaccuccgcaucgcagc

SEQ ID NO: 1325893 - RNA, 21 nt, Human
uuucuucuucuccgguuuucc

SEQ ID NO: 1325894 - RNA, 26 nt, Human
cccucagcuuccacagcaucuucauc

SEQ ID NO: 1325895 - RNA, 24 nt, Human
cugccggguacaacggcuuucuuu

SEQ ID NO: 1325896 - RNA, 20 nt, Human
cuuuuuaccucaugccccuc

SEQ ID NO: 1325897 - RNA, 21 nt, Human
gacucuucuucuuccucuuca

SEQ ID NO: 1325898 - RNA, 18 nt, Human
guaaaacuaaagguccac

SEQ ID NO: 1325899 - RNA, 21 nt, Human
gucugugcugucaggcgaccc

SEQ ID NO: 1325900 - RNA, 18 nt, Human
uacaaccugcuuuucuug

SEQ ID NO: 1325901 - RNA, 18 nt, Human
uaccucaugccccucagc

SEQ ID NO: 1325902 - RNA, 22 nt, Human
ucacugagcaaacuucugauuc

SEQ ID NO: 1325903 - RNA, 22 nt, Human
uccacagcaucuucaucuggau

SEQ ID NO: 1325904 - RNA, 21 nt, Human
uccucuucuguacgugcugcc

SEQ ID NO: 1325905 - RNA, 23 nt, Human
ucuaccauaaccgaagaaauuuc

SEQ ID NO: 1325906 - RNA, 19 nt, Human
ugcugccggguacaacggc

SEQ ID NO: 1325907 - RNA, 21 nt, Human
ugcuucuguuucuucuaccau

SEQ ID NO: 1325908 - RNA, 23 nt, Human
ugcuuuucuuguaaaacuaaagg

SEQ ID NO: 1325909 - RNA, 18 nt, Human
ugucaggcgacccauuug

SEQ ID NO: 1325910 - RNA, 24 nt, Human
ugucaggcgacccauuuguuguca

SEQ ID NO: 1325911 - RNA, 20 nt, Human
uucgccuuuuuugucaaacg

SEQ ID NO: 1325912 - RNA, 18 nt, Human
uugaauggcuguuucucu

SEQ ID NO: 1325913 - RNA, 19 nt, Human
uugcugcaaauuuaccucu

SEQ ID NO: 1325914 - RNA, 19 nt, Human
uugcugcaaauuuaccucu

SEQ ID NO: 1325915 - RNA, 21 nt, Human
uuucuuguaaaacuaaagguu

SEQ ID NO: 1325916 - RNA, 18 nt, Human
uuuuuugucaaacgugag

SEQ ID NO: 1325917 - RNA, 22 nt, Human
acagggagcccccuguaccucc

SEQ ID NO: 1325918 - RNA, 19 nt, Human
agcuggaaguccaggcugg

SEQ ID NO: 1325919 - RNA, 21 nt, Human
aggcaggccagcagugcagac

SEQ ID NO: 1325920 - RNA, 19 nt, Human
agggaagcagggucuccca

SEQ ID NO: 1325921 - RNA, 22 nt, Human
aggggugccggcuguggggugc

SEQ ID NO: 1325922 - RNA, 21 nt, Human
caagggacacagccagcuggc

SEQ ID NO: 1325923 - RNA, 18 nt, Human
cagagcuuggccagaggc

SEQ ID NO: 1325924 - RNA, 20 nt, Human
ccaggcugggggacagggag

SEQ ID NO: 1325925 - RNA, 21 nt, Human
ccccuggguagggaagcaggg

SEQ ID NO: 1325926 - RNA, 20 nt, Human
ccccuguaccucccagggcc

SEQ ID NO: 1325927 - RNA, 23 nt, Human
cccugcaggucugugcccagggg

SEQ ID NO: 1325928 - RNA, 18 nt, Human
ccuuggcuugggucucug

SEQ ID NO: 1325929 - RNA, 28 nt, Human
cucuggucugggucaaggccggaaagcc

SEQ ID NO: 1325930 - RNA, 20 nt, Human
cuggauuucgggccugggaa

SEQ ID NO: 1325931 - RNA, 22 nt, Human
cuggugaucaugggcuuuccuu

SEQ ID NO: 1325932 - RNA, 22 nt, Human
cugugcccaggggugccggcug

SEQ ID NO: 1325933 - RNA, 24 nt, Human
gcagagcuuggccagaggcuugga

SEQ ID NO: 1325934 - RNA, 18 nt, Human
gcagcugauucuuccuuc

SEQ ID NO: 1325935 - RNA, 22 nt, Human
gcaggucugugcccaggggugc

SEQ ID NO: 1325936 - RNA, 22 nt, Human
gcccaggggugccggcuguggg

SEQ ID NO: 1325937 - RNA, 18 nt, Human
ggacacagccagcuggca

SEQ ID NO: 1325938 - RNA, 19 nt, Human
ggagcuggccugcagcccu

SEQ ID NO: 1325939 - RNA, 26 nt, Human
ggcugggggacagggagcccccugua

SEQ ID NO: 1325940 - RNA, 21 nt, Human
ggcuuggaaggccccugggua

SEQ ID NO: 1325941 - RNA, 21 nt, Human
uagaagaccaugguccucccu

SEQ ID NO: 1325942 - RNA, 21 nt, Human
ucaccucggaagagcuggaag

SEQ ID NO: 1325943 - RNA, 20 nt, Human
ucagguccagguccuguagg

SEQ ID NO: 1325944 - RNA, 18 nt, Human
uccuuggcuugggucucu

SEQ ID NO: 1325945 - RNA, 18 nt, Human
ucucuggucugggucaag

SEQ ID NO: 1325946 - RNA, 18 nt, Human
ugaucaugggcuuuccuu

SEQ ID NO: 1325947 - RNA, 20 nt, Human
ugcccaggggugccggcugu

SEQ ID NO: 1325948 - RNA, 20 nt, Human
uggaaggccccuggguaggg

SEQ ID NO: 1325949 - RNA, 19 nt, Human
uggaaguccaggcuggggg

SEQ ID NO: 1325950 - RNA, 18 nt, Human
uggaaguggucugcaggc

SEQ ID NO: 1325951 - RNA, 21 nt, Human
uggaaguggucugcaggcuga

SEQ ID NO: 1325952 - RNA, 20 nt, Human
uggaggcccugcaggucugu

SEQ ID NO: 1325953 - RNA, 20 nt, Human
uggccagaggcuuggaaggc

SEQ ID NO: 1325954 - RNA, 22 nt, Human
ugggaaggcagagcuuggccag

SEQ ID NO: 1325955 - RNA, 19 nt, Human
uggggugccccagcucauu

SEQ ID NO: 1325956 - RNA, 21 nt, Human
ugggucaaggcaucugcucag

SEQ ID NO: 1325957 - RNA, 20 nt, Human
ugguggcucgugcuucaugc

SEQ ID NO: 1325958 - RNA, 19 nt, Human
ugucuggaaguggucugca

SEQ ID NO: 1325959 - RNA, 21 nt, Human
uuccuuggcuugggucucugg

SEQ ID NO: 1325960 - RNA, 21 nt, Human
acuacuugaaaauggauucca

SEQ ID NO: 1325961 - RNA, 20 nt, Human
acugugacagcuuuacagca

SEQ ID NO: 1325962 - RNA, 24 nt, Human
agaagcagugucaagacccacagc

SEQ ID NO: 1325963 - RNA, 18 nt, Human
auggggcucacuggggac

SEQ ID NO: 1325964 - RNA, 25 nt, Human
caaguuuagaagcagugucaagacc

SEQ ID NO: 1325965 - RNA, 25 nt, Human
cagcaggcucccuccccgaggccgu

SEQ ID NO: 1325966 - RNA, 19 nt, Human
ccuccugugcugcccugga

SEQ ID NO: 1325967 - RNA, 22 nt, Human
cgucaugugcuucacugaaccc

SEQ ID NO: 1325968 - RNA, 19 nt, Human
cucucccaugucaaguuua

SEQ ID NO: 1325969 - RNA, 22 nt, Human
cugggcaccugccuccugugcu

SEQ ID NO: 1325970 - RNA, 19 nt, Human
cuucacugaacccggcugc

SEQ ID NO: 1325971 - RNA, 26 nt, Human
gcucucaacgaauuuagagcuuuggc

SEQ ID NO: 1325972 - RNA, 24 nt, Human
gggcaccugccuccugugcugccc

SEQ ID NO: 1325973 - RNA, 22 nt, Human
guccuacacguuuccucuccca

SEQ ID NO: 1325974 - RNA, 19 nt, Human
uaacugugacagcuuuaca

SEQ ID NO: 1325975 - RNA, 19 nt, Human
uaaugaaugggacacuuuc

SEQ ID NO: 1325976 - RNA, 23 nt, Human
uacuacuugaaaauggauuccag

SEQ ID NO: 1325977 - RNA, 18 nt, Human
uagaagcagugucaagac

SEQ ID NO: 1325978 - RNA, 23 nt, Human
ucagcggguccuacacguuuccu

SEQ ID NO: 1325979 - RNA, 23 nt, Human
ugaaaauggauuccagcucucaa

SEQ ID NO: 1325980 - RNA, 18 nt, Human
uggcagaggugaagccug

SEQ ID NO: 1325981 - RNA, 22 nt, Human
uggcagaggugaagccugcguc

SEQ ID NO: 1325982 - RNA, 19 nt, Human
uuagagcuuuggcaaaauu

SEQ ID NO: 1325983 - RNA, 21 nt, Human
uuguggauuuuuaugaaaucc

SEQ ID NO: 1325984 - RNA, 21 nt, Human
uuuaagauuucuuugaugucc

SEQ ID NO: 1325985 - RNA, 22 nt, Human
uuugauguccgaugugcucauu

SEQ ID NO: 1325986 - RNA, 20 nt, Human
cauuggaggaaaaacucugg

SEQ ID NO: 1325987 - RNA, 19 nt, Human
ccccucugggguggggccu

SEQ ID NO: 1325988 - RNA, 21 nt, Human
cccucugggguggggccucca

SEQ ID NO: 1325989 - RNA, 21 nt, Human
ccuuccuuucccgggggcagg

SEQ ID NO: 1325990 - RNA, 24 nt, Human
ggaggaaaaacucuggguggggag

SEQ ID NO: 1325991 - RNA, 22 nt, Human
ggcagcuccuuccuuucccggg

SEQ ID NO: 1325992 - RNA, 22 nt, Human
ggcgcagaggggcguggggccg

SEQ ID NO: 1325993 - RNA, 20 nt, Human
gggagggccuggaacaggga

SEQ ID NO: 1325994 - RNA, 18 nt, Human
ggggagggccuggaacag

SEQ ID NO: 1325995 - RNA, 21 nt, Human
ggggagggccuggaacaggga

SEQ ID NO: 1325996 - RNA, 20 nt, Human
ggguggggagggccuggaac

SEQ ID NO: 1325997 - RNA, 21 nt, Human
uccacggggugcccccaccgu

SEQ ID NO: 1325998 - RNA, 25 nt, Human
uccauuggaggaaaaacucuggguu

SEQ ID NO: 1325999 - RNA, 19 nt, Human
ugcaagaugcccugagucc

SEQ ID NO: 1326000 - RNA, 18 nt, Human
ugcccugagucccaggga

SEQ ID NO: 1326001 - RNA, 18 nt, Human
ugggagguguagggcugg

SEQ ID NO: 1326002 - RNA, 19 nt, Human
ugggagguguagggcuggg

SEQ ID NO: 1326003 - RNA, 20 nt, Human
ugggagguguagggcugggg

SEQ ID NO: 1326004 - RNA, 20 nt, Human
uggggagggccuggaacagg

SEQ ID NO: 1326005 - RNA, 24 nt, Human
uggggccggcgggccuugcgcugc

SEQ ID NO: 1326006 - RNA, 23 nt, Human
ugugccgggcucuggccugcauu

SEQ ID NO: 1326007 - RNA, 19 nt, Human
uuggaaugaaccccugccu

SEQ ID NO: 1326008 - RNA, 24 nt, Human
aaauauugagggcuucaaagagcu

SEQ ID NO: 1326009 - RNA, 18 nt, Human
aggcagaggguggggagc

SEQ ID NO: 1326010 - RNA, 21 nt, Human
aggcagaggguggggagcugg

SEQ ID NO: 1326011 - RNA, 22 nt, Human
aggcagaggguggggagcugga

SEQ ID NO: 1326012 - RNA, 29 nt, Human
aggcagaggguggggagcugggggacccc

SEQ ID NO: 1326013 - RNA, 20 nt, Human
aggguggggagcuggagagg

SEQ ID NO: 1326014 - RNA, 19 nt, Human
agucaggaacccuggagau

SEQ ID NO: 1326015 - RNA, 23 nt, Human
caaagagcucuuccuggacguuu

SEQ ID NO: 1326016 - RNA, 20 nt, Human
caccuccccauccucugccc

SEQ ID NO: 1326017 - RNA, 21 nt, Human
cauccucugcccccacccacu

SEQ ID NO: 1326018 - RNA, 19 nt, Human
ccaaugacccacucccugg

SEQ ID NO: 1326019 - RNA, 18 nt, Human
ccacucccugggaacaag

SEQ ID NO: 1326020 - RNA, 21 nt, Human
cccacagucaaagagagaagc

SEQ ID NO: 1326021 - RNA, 18 nt, Human
cccauccucugcccccac

SEQ ID NO: 1326022 - RNA, 19 nt, Human
ccccaggggagaaggcugc

SEQ ID NO: 1326023 - RNA, 22 nt, Human
cccuccaacaaauauugagggc

SEQ ID NO: 1326024 - RNA, 28 nt, Human
cccuuuggccaaugacccacucccuggg

SEQ ID NO: 1326025 - RNA, 24 nt, Human
ccucccacagucaaagagagaagc

SEQ ID NO: 1326026 - RNA, 21 nt, Human
ccuccccauccucugccccca

SEQ ID NO: 1326027 - RNA, 18 nt, Human
cugagugacaccauuucc

SEQ ID NO: 1326028 - RNA, 18 nt, Human
cugcuccugcugcuucug

SEQ ID NO: 1326029 - RNA, 19 nt, Human
cugcugcuucugccugggc

SEQ ID NO: 1326030 - RNA, 19 nt, Human
gaggguggggagcuggaga

SEQ ID NO: 1326031 - RNA, 25 nt, Human
ggaaggcccuaaccuggcccugucc

SEQ ID NO: 1326032 - RNA, 24 nt, Human
ggagaagcagucccagggccugag

SEQ ID NO: 1326033 - RNA, 22 nt, Human
guggaaggcccuaaccuggccc

SEQ ID NO: 1326034 - RNA, 23 nt, Human
guggaaggcccuaaccuggcccu

SEQ ID NO: 1326035 - RNA, 23 nt, Human
uaacaggaaugggcaacucuaga

SEQ ID NO: 1326036 - RNA, 21 nt, Human
uaaccuggcccuguccucccu

SEQ ID NO: 1326037 - RNA, 19 nt, Human
uaccuuauguucccuuugg

SEQ ID NO: 1326038 - RNA, 23 nt, Human
uagaaguguuuguguguggaagg

SEQ ID NO: 1326039 - RNA, 21 nt, Human
uaggaaggagaaggaguccug

SEQ ID NO: 1326040 - RNA, 21 nt, Human
uccaagaacauaacaggaaug

SEQ ID NO: 1326041 - RNA, 21 nt, Human
ucccuccaacaaauauugagg

SEQ ID NO: 1326042 - RNA, 20 nt, Human
uccucugcccccacccacuc

SEQ ID NO: 1326043 - RNA, 22 nt, Human
uccuggacguuucucuuaaucu

SEQ ID NO: 1326044 - RNA, 23 nt, Human
ucuccagucuucacuuuaacaaa

SEQ ID NO: 1326045 - RNA, 18 nt, Human
ucugccugggccaccucc

SEQ ID NO: 1326046 - RNA, 21 nt, Human
ucugccugggccaccucccca

SEQ ID NO: 1326047 - RNA, 19 nt, Human
ugacaccauuucccuuucc

SEQ ID NO: 1326048 - RNA, 18 nt, Human
ugacccacucccugggaa

SEQ ID NO: 1326049 - RNA, 24 nt, Human
ugacuggaggcagaggguggggag

SEQ ID NO: 1326050 - RNA, 22 nt, Human
ugagcugcuugaguccucuagg

SEQ ID NO: 1326051 - RNA, 21 nt, Human
ugcagaggagacagcuaguca

SEQ ID NO: 1326052 - RNA, 21 nt, Human
ugcuucugccugggccaccuc

SEQ ID NO: 1326053 - RNA, 21 nt, Human
uggaggcagaggguggggagc

SEQ ID NO: 1326054 - RNA, 20 nt, Human
uggccaaugacccacucccu

SEQ ID NO: 1326055 - RNA, 21 nt, Human
uggcuggagaagcagucccag

SEQ ID NO: 1326056 - RNA, 18 nt, Human
ugggacagcgaguccucc

SEQ ID NO: 1326057 - RNA, 21 nt, Human
uguguaaaaauacagcuuuua

SEQ ID NO: 1326058 - RNA, 25 nt, Human
uguguggaaggcccuaaccuggccc

SEQ ID NO: 1326059 - RNA, 24 nt, Human
uuaacaaacucuuuuaaguuuucu

SEQ ID NO: 1326060 - RNA, 18 nt, Human
uuccugaaauaggaacaa

SEQ ID NO: 1326061 - RNA, 25 nt, Human
aaaaaccagugaagaggcaagauaa

SEQ ID NO: 1326062 - RNA, 22 nt, Human
aacccaggccacucagaagucc

SEQ ID NO: 1326063 - RNA, 18 nt, Human
aagagaaguugcgagucu

SEQ ID NO: 1326064 - RNA, 21 nt, Human
accagagucagagaccuccug

SEQ ID NO: 1326065 - RNA, 25 nt, Human
agaagccugacucauucccacaggc

SEQ ID NO: 1326066 - RNA, 28 nt, Human
aggcaagauaaugaaaauuaauucaaga

SEQ ID NO: 1326067 - RNA, 22 nt, Human
aggccaacaccagagucagaga

SEQ ID NO: 1326068 - RNA, 18 nt, Human
caagaaggcagugauggu

SEQ ID NO: 1326069 - RNA, 20 nt, Human
cagaugaaagacaagugaca

SEQ ID NO: 1326070 - RNA, 21 nt, Human
ccaacaccagagucagagacc

SEQ ID NO: 1326071 - RNA, 22 nt, Human
ccaacaccagagucagagaccu

SEQ ID NO: 1326072 - RNA, 20 nt, Human
ccuucccagaugaaagacaa

SEQ ID NO: 1326073 - RNA, 22 nt, Human
cuaggucagugccaaucgccuc

SEQ ID NO: 1326074 - RNA, 22 nt, Human
cucagaagucccgagacccgau

SEQ ID NO: 1326075 - RNA, 22 nt, Human
gcaccggcaaggagggaggcca

SEQ ID NO: 1326076 - RNA, 21 nt, Human
gcgguaacccaggccacucag

SEQ ID NO: 1326077 - RNA, 20 nt, Human
gcgguaacccaggccacucc

SEQ ID NO: 1326078 - RNA, 22 nt, Human
gggaaaauggaagagaaguugc

SEQ ID NO: 1326079 - RNA, 21 nt, Human
ggugaugguuguaaauggguc

SEQ ID NO: 1326080 - RNA, 22 nt, Human
uaaaaaccagugaagaggcaag

SEQ ID NO: 1326081 - RNA, 25 nt, Human
uaauggcaccggcaaggagggaggc

SEQ ID NO: 1326082 - RNA, 21 nt, Human
uacacauuaaaaaccagugaa

SEQ ID NO: 1326083 - RNA, 20 nt, Human
ucaguggugcugaaacaggu

SEQ ID NO: 1326084 - RNA, 23 nt, Human
ucccacaggccguggggacugcc

SEQ ID NO: 1326085 - RNA, 18 nt, Human
ucccgagacccgaugcuu

SEQ ID NO: 1326086 - RNA, 18 nt, Human
ugaauggaggcuggcaga

SEQ ID NO: 1326087 - RNA, 23 nt, Human
ugaauggaggcuggcagagauag

SEQ ID NO: 1326088 - RNA, 24 nt, Human
ugaggcaaggccuaggucagugcc

SEQ ID NO: 1326089 - RNA, 20 nt, Human
uucaagaaggcagugauggu

SEQ ID NO: 1326090 - RNA, 25 nt, Human
caggacacaccaccuuaggacacac

SEQ ID NO: 1326091 - RNA, 18 nt, Human
ccccugcaaaacacaaag

SEQ ID NO: 1326092 - RNA, 20 nt, Human
ccccugcaaaacacaaagag

SEQ ID NO: 1326093 - RNA, 23 nt, Human
uaccccagguucccccugcaaaa

SEQ ID NO: 1326094 - RNA, 21 nt, Human
aacaagaauaccacaauucau

SEQ ID NO: 1326095 - RNA, 24 nt, Human
aagaugacaggcgugagccaccgg

SEQ ID NO: 1326096 - RNA, 24 nt, Human
aagcgauccaccugccucggccuc

SEQ ID NO: 1326097 - RNA, 18 nt, Human
aauuacuuugagacaggg

SEQ ID NO: 1326098 - RNA, 27 nt, Human
acaggcgugagccaccgggccccccau

SEQ ID NO: 1326099 - RNA, 21 nt, Human
acuacaggugcaggccaccau

SEQ ID NO: 1326100 - RNA, 25 nt, Human
acuauccucccaccucagccuccug

SEQ ID NO: 1326101 - RNA, 19 nt, Human
agaugacaggcgugagcca

SEQ ID NO: 1326102 - RNA, 22 nt, Human
agaugacaggcgugagccaccg

SEQ ID NO: 1326103 - RNA, 22 nt, Human
aggacuuugccggagggcagga

SEQ ID NO: 1326104 - RNA, 18 nt, Human
aguagcugggacuacagg

SEQ ID NO: 1326105 - RNA, 22 nt, Human
auaccucucuuggaaacaacuu

SEQ ID NO: 1326106 - RNA, 19 nt, Human
augcugccuugcguuuugg

SEQ ID NO: 1326107 - RNA, 24 nt, Human
caaauugcuaagaugacaggcgug

SEQ ID NO: 1326108 - RNA, 27 nt, Human
caccaugaugcccaggcugaucucgaa

SEQ ID NO: 1326109 - RNA, 24 nt, Human
caccucagccuccugaguagcugg

SEQ ID NO: 1326110 - RNA, 20 nt, Human
cagccuccugaguagcuggg

SEQ ID NO: 1326111 - RNA, 24 nt, Human
caggguuucgcucugucauccagg

SEQ ID NO: 1326112 - RNA, 19 nt, Human
cauccaggcugguguguag

SEQ ID NO: 1326113 - RNA, 24 nt, Human
caucuauucaaaugagggcugcgu

SEQ ID NO: 1326114 - RNA, 24 nt, Human
caugaugcccaggcugaucucgaa

SEQ ID NO: 1326115 - RNA, 23 nt, Human
cccaccucagccuccugaguagc

SEQ ID NO: 1326116 - RNA, 24 nt, Human
cccaccucagccuccugaguagcu

SEQ ID NO: 1326117 - RNA, 22 nt, Human
ccugaguagcugggacuacagg

SEQ ID NO: 1326118 - RNA, 23 nt, Human
ccugaguagcugggacuacaggu

SEQ ID NO: 1326119 - RNA, 21 nt, Human
ccugccucggccucccaaauu

SEQ ID NO: 1326120 - RNA, 21 nt, Human
ccugggcucaagcgauccacc

SEQ ID NO: 1326121 - RNA, 22 nt, Human
ccugggcucaagcgauccaccu

SEQ ID NO: 1326122 - RNA, 23 nt, Human
ccugggcucaagcgauccaccug

SEQ ID NO: 1326123 - RNA, 22 nt, Human
cgcucugucauccaggcuggug

SEQ ID NO: 1326124 - RNA, 22 nt, Human
cgugagccaccgggccccccau

SEQ ID NO: 1326125 - RNA, 21 nt, Human
cucaagcgauccaccugccuc

SEQ ID NO: 1326126 - RNA, 24 nt, Human
cucagccuccugaguagcugggac

SEQ ID NO: 1326127 - RNA, 21 nt, Human
cuccugggcucaagcgaucca

SEQ ID NO: 1326128 - RNA, 21 nt, Human
cugguguguaguggugcauuc

SEQ ID NO: 1326129 - RNA, 23 nt, Human
gacaggguuucgcucugucaucc

SEQ ID NO: 1326130 - RNA, 18 nt, Human
gaugacaggcgugagcca

SEQ ID NO: 1326131 - RNA, 24 nt, Human
gcgauccaccugccucggccuccc

SEQ ID NO: 1326132 - RNA, 20 nt, Human
gcugguguguaguggugcau

SEQ ID NO: 1326133 - RNA, 24 nt, Human
ggacuacaggugcaggccaccaug

SEQ ID NO: 1326134 - RNA, 20 nt, Human
gugcaggccaccaugaugcc

SEQ ID NO: 1326135 - RNA, 24 nt, Human
uaagaugacaggcgugagccaccg

SEQ ID NO: 1326136 - RNA, 19 nt, Human
uagcucagucauugcuuga

SEQ ID NO: 1326137 - RNA, 24 nt, Human
ucacugcagccucaacuuucuggg

SEQ ID NO: 1326138 - RNA, 23 nt, Human
ucagccuccugaguagcugggac

SEQ ID NO: 1326139 - RNA, 22 nt, Human
uccacgguagcaauuguuuuuc

SEQ ID NO: 1326140 - RNA, 20 nt, Human
ucccaaauugcuaagaugac

SEQ ID NO: 1326141 - RNA, 26 nt, Human
uccucccaccucagccuccugaguag

SEQ ID NO: 1326142 - RNA, 24 nt, Human
uccugaguagcugggacuacaggu

SEQ ID NO: 1326143 - RNA, 18 nt, Human
uccugggcucaagcgauc

SEQ ID NO: 1326144 - RNA, 24 nt, Human
uccugggcucaagcgauccaccug

SEQ ID NO: 1326145 - RNA, 30 nt, Human
ucgauagcacuuuccuuucaauaucuuccu

SEQ ID NO: 1326146 - RNA, 21 nt, Human
ucgcucugucauccaggcugg

SEQ ID NO: 1326147 - RNA, 22 nt, Human
ucgcucugucauccaggcuggu

SEQ ID NO: 1326148 - RNA, 23 nt, Human
ucucgaacuccugggcucaagcg

SEQ ID NO: 1326149 - RNA, 24 nt, Human
ucugucauccaggcugguguguag

SEQ ID NO: 1326150 - RNA, 24 nt, Human
ugcccaggcugaucucgaacuccu

SEQ ID NO: 1326151 - RNA, 21 nt, Human
ugccucggccucccaaauugc

SEQ ID NO: 1326152 - RNA, 23 nt, Human
ugccucggccucccaaauugcua

SEQ ID NO: 1326153 - RNA, 24 nt, Human
ugccucggccucccaaauugcuaa

SEQ ID NO: 1326154 - RNA, 20 nt, Human
uggcaucgauagcacuuucc

SEQ ID NO: 1326155 - RNA, 22 nt, Human
uggcaucgauagcacuuuccuu

SEQ ID NO: 1326156 - RNA, 22 nt, Human
ugggacuacaggugcaggccac

SEQ ID NO: 1326157 - RNA, 24 nt, Human
ugggacuacaggugcaggccacca

SEQ ID NO: 1326158 - RNA, 25 nt, Human
ugggacuacaggugcaggccaccau

SEQ ID NO: 1326159 - RNA, 22 nt, Human
uguaguggugcauucacggcuc

SEQ ID NO: 1326160 - RNA, 21 nt, Human
ugugcaugaggugugaccaag

SEQ ID NO: 1326161 - RNA, 22 nt, Human
uucaccuugcaggacuggaugc

SEQ ID NO: 1326162 - RNA, 18 nt, Human
uucaugugcaugaggugu

SEQ ID NO: 1326163 - RNA, 22 nt, Human
uugagacaggguuucgcucugu

SEQ ID NO: 1326164 - RNA, 23 nt, Human
uugcugaauuaaauaguuggugc

SEQ ID NO: 1326165 - RNA, 23 nt, Human
uuggcaucgauagcacuuuccuu

SEQ ID NO: 1326166 - RNA, 19 nt, Human
uuucgcucugucauccagg

SEQ ID NO: 1326167 - RNA, 22 nt, Human
uuucgcucugucauccaggcug

SEQ ID NO: 1326168 - RNA, 23 nt, Human
uuucgcucugucauccaggcugg

SEQ ID NO: 1326169 - RNA, 22 nt, Human
uuuggcaucgauagcacuuucc

SEQ ID NO: 1326170 - RNA, 24 nt, Human
uuuggcaucgauagcacuuuccuu

SEQ ID NO: 1326171 - RNA, 18 nt, Human
aaacagauagggggcagg

SEQ ID NO: 1326172 - RNA, 19 nt, Human
aacauuuuccugugcuucu

SEQ ID NO: 1326173 - RNA, 20 nt, Human
aauacuuucagaaccccaca

SEQ ID NO: 1326174 - RNA, 21 nt, Human
agagcaaaugaagcaucuguu

SEQ ID NO: 1326175 - RNA, 18 nt, Human
agcgucuuaguccucuag

SEQ ID NO: 1326176 - RNA, 19 nt, Human
aggaaagacaaauaauauu

SEQ ID NO: 1326177 - RNA, 26 nt, Human
auaaaaaccaugaauaagaauuucau

SEQ ID NO: 1326178 - RNA, 20 nt, Human
auaauacuuucagaacccca

SEQ ID NO: 1326179 - RNA, 18 nt, Human
aucugaaauggcucaaga

SEQ ID NO: 1326180 - RNA, 23 nt, Human
caaaaaaggucugaaaaaauuaa

SEQ ID NO: 1326181 - RNA, 24 nt, Human
caccaauguuugguaaaccuaaaa

SEQ ID NO: 1326182 - RNA, 25 nt, Human
cacuuuaauuccaauuuccugggga

SEQ ID NO: 1326183 - RNA, 23 nt, Human
cagaaagauggaauuccaccaau

SEQ ID NO: 1326184 - RNA, 23 nt, Human
ccaaaaaaggucugaaaaaauua

SEQ ID NO: 1326185 - RNA, 22 nt, Human
cgucuuaguccucuaggagcca

SEQ ID NO: 1326186 - RNA, 19 nt, Human
ggagagaauaaaaaccaug

SEQ ID NO: 1326187 - RNA, 18 nt, Human
ggagguuucuuccccacu

SEQ ID NO: 1326188 - RNA, 21 nt, Human
guaaaaugauacaugugcccc

SEQ ID NO: 1326189 - RNA, 21 nt, Human
uaaauggucuugaaagcucau

SEQ ID NO: 1326190 - RNA, 18 nt, Human
uaauacuuucagaacccc

SEQ ID NO: 1326191 - RNA, 25 nt, Human
uacauaguauguuauaaaaacaucu

SEQ ID NO: 1326192 - RNA, 23 nt, Human
uacuuucagaaccccacagaaca

SEQ ID NO: 1326193 - RNA, 20 nt, Human
uagcuaugaucuucccuuuu

SEQ ID NO: 1326194 - RNA, 20 nt, Human
uaguauucguucugacucua

SEQ ID NO: 1326195 - RNA, 21 nt, Human
ucacagcaaacagauaggggg

SEQ ID NO: 1326196 - RNA, 23 nt, Human
ugaacacaaaggaaggaacacaa

SEQ ID NO: 1326197 - RNA, 21 nt, Human
ugauuaauacugcuugagugu

SEQ ID NO: 1326198 - RNA, 18 nt, Human
ugauuuuggauuucuugu

SEQ ID NO: 1326199 - RNA, 18 nt, Human
uggcucaagaaacacugg

SEQ ID NO: 1326200 - RNA, 24 nt, Human
uguaaaaugauacaugugccccaa

SEQ ID NO: 1326201 - RNA, 23 nt, Human
ugucuagugucaaaauuauaaua

SEQ ID NO: 1326202 - RNA, 22 nt, Human
uguuuccuuaaauggucuugaa

SEQ ID NO: 1326203 - RNA, 21 nt, Human
uucagacucagacauaaaggu

SEQ ID NO: 1326204 - RNA, 22 nt, Human
uuucaauuacaaaucacagaaa

SEQ ID NO: 1326205 - RNA, 23 nt, Human
uuucucagaaagauggaauucca

SEQ ID NO: 1326206 - RNA, 19 nt, Human
uuugcacuaucacagcaaa

SEQ ID NO: 1326207 - RNA, 22 nt, Human
aacacaguuguucaccccccca

SEQ ID NO: 1326208 - RNA, 24 nt, Human
aacuggcuggcgucccagaacaca

SEQ ID NO: 1326209 - RNA, 24 nt, Human
ccagaacacaguuguucacccccc

SEQ ID NO: 1326210 - RNA, 19 nt, Human
ccccaccagcuggcuggcc

SEQ ID NO: 1326211 - RNA, 19 nt, Human
uggcuggccgucugccuga

SEQ ID NO: 1326212 - RNA, 25 nt, Human
aaaaagaacaucuuuuacuaacaga

SEQ ID NO: 1326213 - RNA, 18 nt, Human
aggagacuucagcaauau

SEQ ID NO: 1326214 - RNA, 18 nt, Human
auccuuuucucuccucaa

SEQ ID NO: 1326215 - RNA, 18 nt, Human
cacaaaauggcagugaag

SEQ ID NO: 1326216 - RNA, 19 nt, Human
caccugggagugaugugca

SEQ ID NO: 1326217 - RNA, 22 nt, Human
cagcagcaccucacaaaauggc

SEQ ID NO: 1326218 - RNA, 26 nt, Human
cagcagcaccucacaaaauggcagug

SEQ ID NO: 1326219 - RNA, 22 nt, Human
ccucuggaaggcuauuugauuc

SEQ ID NO: 1326220 - RNA, 24 nt, Human
cgguaacauaugccaggagacuuc

SEQ ID NO: 1326221 - RNA, 23 nt, Human
cuuucuagaaaccugcccucugg

SEQ ID NO: 1326222 - RNA, 21 nt, Human
gggaaaaagaacaucuuuuac

SEQ ID NO: 1326223 - RNA, 22 nt, Human
ucccguuugguccaaaggggau

SEQ ID NO: 1326224 - RNA, 19 nt, Human
ugaaguuguggcgccuccc

SEQ ID NO: 1326225 - RNA, 18 nt, Human
uggaaggaagggaagcag

SEQ ID NO: 1326226 - RNA, 22 nt, Human
uggcagugaaguuguggcgccu

SEQ ID NO: 1326227 - RNA, 19 nt, Human
ugggaaaaagaacaucuuu

SEQ ID NO: 1326228 - RNA, 19 nt, Human
ugggaauacaaaauaacca

SEQ ID NO: 1326229 - RNA, 19 nt, Human
ugguccaaaggggauggaa

SEQ ID NO: 1326230 - RNA, 20 nt, Human
uucuagaaaccugcccucug

SEQ ID NO: 1326231 - RNA, 20 nt, Human
aacauggcaaaaaccugucu

SEQ ID NO: 1326232 - RNA, 24 nt, Human
aagagaaaucagguucagggugca

SEQ ID NO: 1326233 - RNA, 24 nt, Human
accugaggucaggaguucaagacc

SEQ ID NO: 1326234 - RNA, 18 nt, Human
agccuggccaacauggca

SEQ ID NO: 1326235 - RNA, 24 nt, Human
agccuggccaacauggcaaaaacc

SEQ ID NO: 1326236 - RNA, 23 nt, Human
agcuccucaaguuuucucuccag

SEQ ID NO: 1326237 - RNA, 18 nt, Human
aggcaggcggaucaccug

SEQ ID NO: 1326238 - RNA, 22 nt, Human
aggcaggcggaucaccugaggu

SEQ ID NO: 1326239 - RNA, 26 nt, Human
aggcaggcggaucaccugaggucagg

SEQ ID NO: 1326240 - RNA, 21 nt, Human
aggccgaggcaggcggaucac

SEQ ID NO: 1326241 - RNA, 23 nt, Human
aucaccugaggucaggaguucaa

SEQ ID NO: 1326242 - RNA, 19 nt, Human
caacauggcaaaaaccugu

SEQ ID NO: 1326243 - RNA, 24 nt, Human
cacaccuguaaucccagcccuuug

SEQ ID NO: 1326244 - RNA, 18 nt, Human
caccagcacugcauccuu

SEQ ID NO: 1326245 - RNA, 23 nt, Human
caccugaggucaggaguucaaga

SEQ ID NO: 1326246 - RNA, 23 nt, Human
caccuguaaucccagcccuuugg

SEQ ID NO: 1326247 - RNA, 24 nt, Human
caccuguaaucccagcccuuuggg

SEQ ID NO: 1326248 - RNA, 21 nt, Human
cacugcauccuucucccuggc

SEQ ID NO: 1326249 - RNA, 22 nt, Human
cagaacccuggucugcagcucc

SEQ ID NO: 1326250 - RNA, 24 nt, Human
cagcccuuugggaggccgaggcag

SEQ ID NO: 1326251 - RNA, 25 nt, Human
cagcccuuugggaggccgaggcagg

SEQ ID NO: 1326252 - RNA, 24 nt, Human
caguaaagagaaaucagguucagu

SEQ ID NO: 1326253 - RNA, 23 nt, Human
cccggcuuccuucagagccucca

SEQ ID NO: 1326254 - RNA, 18 nt, Human
cccuggccagacggucga

SEQ ID NO: 1326255 - RNA, 24 nt, Human
cccuuugggaggccgaggcaggcg

SEQ ID NO: 1326256 - RNA, 21 nt, Human
ccucuaaauccuuuacccggg

SEQ ID NO: 1326257 - RNA, 22 nt, Human
ccugcagcuccagaacccuggu

SEQ ID NO: 1326258 - RNA, 24 nt, Human
ccugcagcuccagaacccuggucu

SEQ ID NO: 1326259 - RNA, 19 nt, Human
ccuucagagccuccagcuc

SEQ ID NO: 1326260 - RNA, 26 nt, Human
cgaggcaggcggaucaccugagguca

SEQ ID NO: 1326261 - RNA, 20 nt, Human
cgagggucucgcagugggcc

SEQ ID NO: 1326262 - RNA, 22 nt, Human
cggaauucgugcucccucuucc

SEQ ID NO: 1326263 - RNA, 24 nt, Human
cggaucaccugaggucaggaguuc

SEQ ID NO: 1326264 - RNA, 27 nt, Human
cggaucaccugaggucaggaguucaag

SEQ ID NO: 1326265 - RNA, 19 nt, Human
cggcucggcucuggagcuu

SEQ ID NO: 1326266 - RNA, 19 nt, Human
cggucgagcuccucaugcu

SEQ ID NO: 1326267 - RNA, 22 nt, Human
cuaucaacaguuaccacggccg

SEQ ID NO: 1326268 - RNA, 20 nt, Human
cucacaccuguaaucccagc

SEQ ID NO: 1326269 - RNA, 24 nt, Human
cucacaccuguaaucccagcccuu

SEQ ID NO: 1326270 - RNA, 20 nt, Human
cucaccgucgagcuccucaa

SEQ ID NO: 1326271 - RNA, 18 nt, Human
cuccagguccuggagcuc

SEQ ID NO: 1326272 - RNA, 19 nt, Human
cuccccggcucggcucugg

SEQ ID NO: 1326273 - RNA, 21 nt, Human
cuccucaugcuuccucuuaaa

SEQ ID NO: 1326274 - RNA, 19 nt, Human
cucucugcagccuuugccc

SEQ ID NO: 1326275 - RNA, 24 nt, Human
cucuuccuucuuccugguuagcug

SEQ ID NO: 1326276 - RNA, 19 nt, Human
cugcaguaaagagaaaucc

SEQ ID NO: 1326277 - RNA, 25 nt, Human
cugcauccuucucccuggccagacg

SEQ ID NO: 1326278 - RNA, 19 nt, Human
gaggcaggcggaucaccug

SEQ ID NO: 1326279 - RNA, 23 nt, Human
gaucaccugaggucaggaguuca

SEQ ID NO: 1326280 - RNA, 24 nt, Human
gaucaccugaggucaggaguucaa

SEQ ID NO: 1326281 - RNA, 19 nt, Human
gcagcaguuccugucucug

SEQ ID NO: 1326282 - RNA, 19 nt, Human
gcagcuccugcagcugcuc

SEQ ID NO: 1326283 - RNA, 20 nt, Human
gccaacauggcaaaaaccug

SEQ ID NO: 1326284 - RNA, 21 nt, Human
gcggaucaccugaggucagga

SEQ ID NO: 1326285 - RNA, 22 nt, Human
ggaucaccugaggucaggaguu

SEQ ID NO: 1326286 - RNA, 23 nt, Human
ggaucaccugaggucaggaguuc

SEQ ID NO: 1326287 - RNA, 21 nt, Human
ggccgggcacgguggcucaca

SEQ ID NO: 1326288 - RNA, 24 nt, Human
gggcacgguggcucacaccuguaa

SEQ ID NO: 1326289 - RNA, 24 nt, Human
gggccugcagcuccagaacccugg

SEQ ID NO: 1326290 - RNA, 19 nt, Human
gguccuggagcuccccggc

SEQ ID NO: 1326291 - RNA, 23 nt, Human
gguggcucacaccuguaauccca

SEQ ID NO: 1326292 - RNA, 24 nt, Human
gguggcucacaccuguaaucccag

SEQ ID NO: 1326293 - RNA, 23 nt, Human
guugcucauguugucagccugca

SEQ ID NO: 1326294 - RNA, 23 nt, Human
ucaccugaggucaggaguucaag

SEQ ID NO: 1326295 - RNA, 22 nt, Human
ucggcguugguggccucugccc

SEQ ID NO: 1326296 - RNA, 26 nt, Human
ucucugcagccuuugccccggccgac

SEQ ID NO: 1326297 - RNA, 20 nt, Human
ucugcagccuuugccccggc

SEQ ID NO: 1326298 - RNA, 20 nt, Human
ucugcagcuccugcagcugc

SEQ ID NO: 1326299 - RNA, 21 nt, Human
uggccagacggucgagcuccu

SEQ ID NO: 1326300 - RNA, 24 nt, Human
uggccuccagguccuggagcuccc

SEQ ID NO: 1326301 - RNA, 21 nt, Human
uggcucacaccuguaauccca

SEQ ID NO: 1326302 - RNA, 20 nt, Human
ugggaggccgaggcaggcgg

SEQ ID NO: 1326303 - RNA, 24 nt, Human
ugggaggccgaggcaggcggauca

SEQ ID NO: 1326304 - RNA, 19 nt, Human
ugguggccucugcccucug

SEQ ID NO: 1326305 - RNA, 24 nt, Human
uucagggugcaccgugaggggccc

SEQ ID NO: 1326306 - RNA, 22 nt, Human
uuccugucucugcaggcaagcu

SEQ ID NO: 1326307 - RNA, 25 nt, Human
uugggaggccgaggcaggcggauca

SEQ ID NO: 1326308 - RNA, 18 nt, Human
aaaaaggaaauaaaugca

SEQ ID NO: 1326309 - RNA, 19 nt, Human
aacaaaaacugaaaauugg

SEQ ID NO: 1326310 - RNA, 23 nt, Human
aagaggauugcuugaggccagga

SEQ ID NO: 1326311 - RNA, 24 nt, Human
aaggcaagaggauugcuugaggcc

SEQ ID NO: 1326312 - RNA, 19 nt, Human
aggaaaaaggaaauaaaug

SEQ ID NO: 1326313 - RNA, 18 nt, Human
aggcaagaggauugcuug

SEQ ID NO: 1326314 - RNA, 19 nt, Human
aggcaagaggauugcuuga

SEQ ID NO: 1326315 - RNA, 22 nt, Human
aggcaagaggauugcuugaggc

SEQ ID NO: 1326316 - RNA, 21 nt, Human
auaaaaaacggcucugucuua

SEQ ID NO: 1326317 - RNA, 24 nt, Human
auaaaaaacggcucugucuuaaaa

SEQ ID NO: 1326318 - RNA, 23 nt, Human
aucacacuaucuccacuccugau

SEQ ID NO: 1326319 - RNA, 26 nt, Human
auuccuccacaguuuuccuccauucu

SEQ ID NO: 1326320 - RNA, 18 nt, Human
auuggaggaaaggaaaaa

SEQ ID NO: 1326321 - RNA, 26 nt, Human
caacaaaaacugaaaauuggaggaaa

SEQ ID NO: 1326322 - RNA, 22 nt, Human
caaggcaagaggauugcuugag

SEQ ID NO: 1326323 - RNA, 26 nt, Human
caaggcaagaggauugcuugaggcca

SEQ ID NO: 1326324 - RNA, 18 nt, Human
cacacuaucuccacuccu

SEQ ID NO: 1326325 - RNA, 20 nt, Human
cagcauuuugggaugccaag

SEQ ID NO: 1326326 - RNA, 21 nt, Human
cagcauuuugggaugccaagg

SEQ ID NO: 1326327 - RNA, 21 nt, Human
cccuguaaucccagcauuuug

SEQ ID NO: 1326328 - RNA, 22 nt, Human
ccuguaaucccagcauuuuggg

SEQ ID NO: 1326329 - RNA, 21 nt, Human
ggccaggauucugagaccagc

SEQ ID NO: 1326330 - RNA, 21 nt, Human
uaccugucauacuuuaaaagu

SEQ ID NO: 1326331 - RNA, 22 nt, Human
uagaauuuauaaaaaacggcuc

SEQ ID NO: 1326332 - RNA, 22 nt, Human
ucaacaaaaacugaaaauugga

SEQ ID NO: 1326333 - RNA, 18 nt, Human
uccacaguuuuccuccau

SEQ ID NO: 1326334 - RNA, 22 nt, Human
uccuccacaguuuuccuccauu

SEQ ID NO: 1326335 - RNA, 24 nt, Human
ucucaaaugucaucacacuaucuc

SEQ ID NO: 1326336 - RNA, 24 nt, Human
ugccaaggcaagaggauugcuccg

SEQ ID NO: 1326337 - RNA, 22 nt, Human
uggaggaaaggaaaaaggaaau

SEQ ID NO: 1326338 - RNA, 19 nt, Human
ugggaugccaaggcaagag

SEQ ID NO: 1326339 - RNA, 22 nt, Human
ugucaucacacuaucuccacuc

SEQ ID NO: 1326340 - RNA, 20 nt, Human
uucugagaccagccuggucc

SEQ ID NO: 1326341 - RNA, 24 nt, Human
aaaaucgccacaaauacaaaagca

SEQ ID NO: 1326342 - RNA, 20 nt, Human
aaagcaucacugaacuaaaa

SEQ ID NO: 1326343 - RNA, 23 nt, Human
aaauacaaaagcaucacugaacu

SEQ ID NO: 1326344 - RNA, 25 nt, Human
aauacaaaagcaucacugaacuaaa

SEQ ID NO: 1326345 - RNA, 19 nt, Human
acaaauacaaaagcaucac

SEQ ID NO: 1326346 - RNA, 26 nt, Human
caaaagcaucacugaacuaaaaauac

SEQ ID NO: 1326347 - RNA, 22 nt, Human
caaauacaaaagcaucacugaa

SEQ ID NO: 1326348 - RNA, 23 nt, Human
caaauacaaaagcaucacugaac

SEQ ID NO: 1326349 - RNA, 20 nt, Human
cauauacguauauucucaua

SEQ ID NO: 1326350 - RNA, 25 nt, Human
cauucugugcauuuucaauuugugu

SEQ ID NO: 1326351 - RNA, 25 nt, Human
ccacaaauacaaaagcaucacugaa

SEQ ID NO: 1326352 - RNA, 20 nt, Human
cccaauuuaggcuuucuggc

SEQ ID NO: 1326353 - RNA, 24 nt, Human
cuguuucccaauuuaggcuuucug

SEQ ID NO: 1326354 - RNA, 23 nt, Human
uaaauagaaacaaaagucuccau

SEQ ID NO: 1326355 - RNA, 24 nt, Human
uaaauagaaacaaaagucuccaug

SEQ ID NO: 1326356 - RNA, 18 nt, Human
uauuggcuuuccaucuua

SEQ ID NO: 1326357 - RNA, 24 nt, Human
uccaugcaauuuucagaugaaaaa

SEQ ID NO: 1326358 - RNA, 19 nt, Human
ucuggccaugggagugaca

SEQ ID NO: 1326359 - RNA, 22 nt, Human
uguguguuuucauuuagauggu

SEQ ID NO: 1326360 - RNA, 23 nt, Human
uguuucccaauuuaggcuuucug

SEQ ID NO: 1326361 - RNA, 23 nt, Human
uucugugcauuuucaauuugugu

SEQ ID NO: 1326362 - RNA, 24 nt, Human
uuguguguuuucauuuagaugguu

SEQ ID NO: 1326363 - RNA, 24 nt, Human
acgcucuagcuucucccuacaggc

SEQ ID NO: 1326364 - RNA, 18 nt, Human
cagggguuucggcgucgg

SEQ ID NO: 1326365 - RNA, 19 nt, Human
cccccggccccggcugcuc

SEQ ID NO: 1326366 - RNA, 21 nt, Human
ccccggccccggcugcucgac

SEQ ID NO: 1326367 - RNA, 23 nt, Human
ccggcagcggcggcagggguuuc

SEQ ID NO: 1326368 - RNA, 18 nt, Human
ccggcccccggccccggc

SEQ ID NO: 1326369 - RNA, 20 nt, Human
ccggcccccggccccggcug

SEQ ID NO: 1326370 - RNA, 22 nt, Human
cggcccccggccccggcugcuc

SEQ ID NO: 1326371 - RNA, 21 nt, Human
cuccggcccccggccccggcc

SEQ ID NO: 1326372 - RNA, 18 nt, Human
ucucccuacaggcccggc

SEQ ID NO: 1326373 - RNA, 19 nt, Human
ugaaacgcucuagcuucuc

SEQ ID NO: 1326374 - RNA, 18 nt, Human
aaaccacagccuccaccg

SEQ ID NO: 1326375 - RNA, 19 nt, Human
accacagccuccaccagca

SEQ ID NO: 1326376 - RNA, 20 nt, Human
cuaaaccacagccuccaccu

SEQ ID NO: 1326377 - RNA, 20 nt, Human
cucuggucucuaaaccacag

SEQ ID NO: 1326378 - RNA, 19 nt, Human
ggucucuaaaccacagccu

SEQ ID NO: 1326379 - RNA, 22 nt, Human
uccaccagcaacuccugaauaa

SEQ ID NO: 1326380 - RNA, 24 nt, Human
ucuaaaccacagccuccaccagca

SEQ ID NO: 1326381 - RNA, 20 nt, Human
ucucuaaaccacagccucca

SEQ ID NO: 1326382 - RNA, 20 nt, Human
uggucucuaaaccacagccu

SEQ ID NO: 1326383 - RNA, 22 nt, Human
aaacaaaugcuaguccagccac

SEQ ID NO: 1326384 - RNA, 18 nt, Human
aggggaaucagggagccc

SEQ ID NO: 1326385 - RNA, 23 nt, Human
cccuccgucccuuuaccacuucc

SEQ ID NO: 1326386 - RNA, 21 nt, Human
ccuccuaccacuauacucucc

SEQ ID NO: 1326387 - RNA, 26 nt, Human
ccuccuaccacuauacucuccaaacc

SEQ ID NO: 1326388 - RNA, 21 nt, Human
cuugugguauacaaaccaugc

SEQ ID NO: 1326389 - RNA, 24 nt, Human
ggagccccuccuaccacuauacuc

SEQ ID NO: 1326390 - RNA, 20 nt, Human
ucagggagccccuccuaccc

SEQ ID NO: 1326391 - RNA, 23 nt, Human
uccaaaccauguagaaccaaaga

SEQ ID NO: 1326392 - RNA, 23 nt, Human
ucccugcuucaggcagauccccc

SEQ ID NO: 1326393 - RNA, 20 nt, Human
uccgucccuuuaccacuucc

SEQ ID NO: 1326394 - RNA, 21 nt, Human
uccuucuugccuugugcucug

SEQ ID NO: 1326395 - RNA, 20 nt, Human
ucugcagggaaaggguuguu

SEQ ID NO: 1326396 - RNA, 20 nt, Human
ugcuucaggcagauccccca

SEQ ID NO: 1326397 - RNA, 18 nt, Human
ugggagauaagcuggagg

SEQ ID NO: 1326398 - RNA, 20 nt, Human
uguagaaccaaagaugguua

SEQ ID NO: 1326399 - RNA, 22 nt, Human
uguagaaccaaagaugguuacc

SEQ ID NO: 1326400 - RNA, 21 nt, Human
uguucaggauaaaugguugau

SEQ ID NO: 1326401 - RNA, 24 nt, Human
uuccuucuugccuugugcucugac

SEQ ID NO: 1326402 - RNA, 20 nt, Human
uuucucaaaugguguuguuc

SEQ ID NO: 1326403 - RNA, 22 nt, Human
caccagugacauaaaagacaaa

SEQ ID NO: 1326404 - RNA, 23 nt, Human
caccagugacauaaaagacaaaa

SEQ ID NO: 1326405 - RNA, 19 nt, Human
ugucgugcucuuuuggaca

SEQ ID NO: 1326406 - RNA, 21 nt, Human
ugucgugcucuuuuggacaga

SEQ ID NO: 1326407 - RNA, 21 nt, Human
uuuggacagagacccaccagu

SEQ ID NO: 1326408 - RNA, 24 nt, Human
aaagcaaauuggcuccguuuaagg

SEQ ID NO: 1326409 - RNA, 22 nt, Human
aaaguaugagggggaaggacca

SEQ ID NO: 1326410 - RNA, 23 nt, Human
aaaguaugagggggaaggaccag

SEQ ID NO: 1326411 - RNA, 24 nt, Human
accucggcaccccgagcccguuca

SEQ ID NO: 1326412 - RNA, 18 nt, Human
agagccagcgccaagagc

SEQ ID NO: 1326413 - RNA, 22 nt, Human
agcauccaguuggugaccaggc

SEQ ID NO: 1326414 - RNA, 26 nt, Human
agccggaccucggcaccccgagcccg

SEQ ID NO: 1326415 - RNA, 19 nt, Human
auccuucuaaggugaaccc

SEQ ID NO: 1326416 - RNA, 20 nt, Human
caagauaagggucugauaac

SEQ ID NO: 1326417 - RNA, 20 nt, Human
cagaaaguaugagggggaag

SEQ ID NO: 1326418 - RNA, 22 nt, Human
cagcaaguccucuucugaaccc

SEQ ID NO: 1326419 - RNA, 21 nt, Human
cagcccuuucuugccccaggc

SEQ ID NO: 1326420 - RNA, 18 nt, Human
caggguuccaucuccccu

SEQ ID NO: 1326421 - RNA, 23 nt, Human
caucucuuuucucucuucuccaa

SEQ ID NO: 1326422 - RNA, 24 nt, Human
cauuccuggauagcagcccuuucu

SEQ ID NO: 1326423 - RNA, 21 nt, Human
ccaaacuuagccagggguagg

SEQ ID NO: 1326424 - RNA, 25 nt, Human
cccggccccgcagccggaccucggc

SEQ ID NO: 1326425 - RNA, 23 nt, Human
cggcaagguggagguggcuuccc

SEQ ID NO: 1326426 - RNA, 20 nt, Human
cuaagacagggcuaauagcu

SEQ ID NO: 1326427 - RNA, 28 nt, Human
cucagccuugcgccucgggggucguaac

SEQ ID NO: 1326428 - RNA, 20 nt, Human
cuccccaaaacaaacaaaaa

SEQ ID NO: 1326429 - RNA, 25 nt, Human
cuccugaaauccgcaaggaaguggg

SEQ ID NO: 1326430 - RNA, 27 nt, Human
cucggcaccccgagcccguucaccggg

SEQ ID NO: 1326431 - RNA, 24 nt, Human
cucuuuucucucuucuccacagca

SEQ ID NO: 1326432 - RNA, 18 nt, Human
cugcguagccuugggcaa

SEQ ID NO: 1326433 - RNA, 19 nt, Human
cugcguagccuugggcaag

SEQ ID NO: 1326434 - RNA, 21 nt, Human
cuggcuauacaggaaagcaaa

SEQ ID NO: 1326435 - RNA, 18 nt, Human
cuucccaucucuuuucuc

SEQ ID NO: 1326436 - RNA, 26 nt, Human
gagccagcgccaagagcuucaaaaaa

SEQ ID NO: 1326437 - RNA, 21 nt, Human
gccaagagcuucaaaaaaucc

SEQ ID NO: 1326438 - RNA, 19 nt, Human
gccuguauccucacacccu

SEQ ID NO: 1326439 - RNA, 19 nt, Human
ggacccggauagcgagaug

SEQ ID NO: 1326440 - RNA, 22 nt, Human
ggauucuugacuccugaaaucc

SEQ ID NO: 1326441 - RNA, 18 nt, Human
ggguaggggggcacauuu

SEQ ID NO: 1326442 - RNA, 20 nt, Human
ggguaggggggcacauuuuc

SEQ ID NO: 1326443 - RNA, 20 nt, Human
uaaaugauccucucucccca

SEQ ID NO: 1326444 - RNA, 18 nt, Human
uaacagacggcaaggugg

SEQ ID NO: 1326445 - RNA, 18 nt, Human
uaagacagggcuaauagc

SEQ ID NO: 1326446 - RNA, 22 nt, Human
uaauagcuauaauuucaccugc

SEQ ID NO: 1326447 - RNA, 20 nt, Human
uagcagcccuuucuugcccc

SEQ ID NO: 1326448 - RNA, 26 nt, Human
uagcagcccuuucuugccccaggcuc

SEQ ID NO: 1326449 - RNA, 26 nt, Human
uagccuugggcaaguuccucaaucuc

SEQ ID NO: 1326450 - RNA, 22 nt, Human
uaucuccuuucgaacucaaguc

SEQ ID NO: 1326451 - RNA, 23 nt, Human
uaugacaugggaacccaaacuua

SEQ ID NO: 1326452 - RNA, 20 nt, Human
uccccaaaacaaacaaaaaa

SEQ ID NO: 1326453 - RNA, 21 nt, Human
uccccaaaacaaacaaaaaau

SEQ ID NO: 1326454 - RNA, 21 nt, Human
uccucuucugaacccucauug

SEQ ID NO: 1326455 - RNA, 19 nt, Human
ucucuuuucucucuucucc

SEQ ID NO: 1326456 - RNA, 23 nt, Human
ucuuccauguacaugggcugcuc

SEQ ID NO: 1326457 - RNA, 19 nt, Human
ugaccaggcuccccgaauu

SEQ ID NO: 1326458 - RNA, 20 nt, Human
ugauccucucuccccaaaac

SEQ ID NO: 1326459 - RNA, 22 nt, Human
ugcauguuguuauggagcuguc

SEQ ID NO: 1326460 - RNA, 24 nt, Human
ugccccaggcucuggcacgaugcc

SEQ ID NO: 1326461 - RNA, 21 nt, Human
uggcuucccggccccgcagcc

SEQ ID NO: 1326462 - RNA, 22 nt, Human
uggcuuuacaaagcaaauuggc

SEQ ID NO: 1326463 - RNA, 21 nt, Human
ugggaacccaaacuuagccag

SEQ ID NO: 1326464 - RNA, 20 nt, Human
uguuauggagcugucucagc

SEQ ID NO: 1326465 - RNA, 26 nt, Human
uguuauggagcugucucagcacgggg

SEQ ID NO: 1326466 - RNA, 25 nt, Human
uucaaaaaauccuucuaaggugaac

SEQ ID NO: 1326467 - RNA, 29 nt, Human
uucccaucucuuuucucucuucuccacaa

SEQ ID NO: 1326468 - RNA, 22 nt, Human
uuuagcuuugaugaucucuccu

SEQ ID NO: 1326469 - RNA, 20 nt, Human
uuugaugaucucuccuauuu

SEQ ID NO: 1326470 - RNA, 21 nt, Human
uuuucuguuuuguuguugagu

SEQ ID NO: 1326471 - RNA, 20 nt, Human
aauggcaggcucuggcugug

SEQ ID NO: 1326472 - RNA, 26 nt, Human
agaaagcaaacaccacucucagccca

SEQ ID NO: 1326473 - RNA, 19 nt, Human
caggcucuggcuguggugc

SEQ ID NO: 1326474 - RNA, 23 nt, Human
cagugauaccccaaauuagauga

SEQ ID NO: 1326475 - RNA, 23 nt, Human
ccgcccuucagacgaaauccuug

SEQ ID NO: 1326476 - RNA, 23 nt, Human
ccuucugguggagaaagcaaaca

SEQ ID NO: 1326477 - RNA, 18 nt, Human
cucccccuucucuuuguc

SEQ ID NO: 1326478 - RNA, 24 nt, Human
gacugugcaacuccuccacaagau

SEQ ID NO: 1326479 - RNA, 20 nt, Human
gugagaaacagccucaguca

SEQ ID NO: 1326480 - RNA, 21 nt, Human
ucacugaggggaugagguacu

SEQ ID NO: 1326481 - RNA, 19 nt, Human
ucagcccauuccugcuacc

SEQ ID NO: 1326482 - RNA, 24 nt, Human
ucagcccauuccugcuaccucuua

SEQ ID NO: 1326483 - RNA, 19 nt, Human
uggucugcuagguuuucuu

SEQ ID NO: 1326484 - RNA, 19 nt, Human
ugguggagaaagcaaacac

SEQ ID NO: 1326485 - RNA, 23 nt, Human
ugguggagaaagcaaacaccacu

SEQ ID NO: 1326486 - RNA, 20 nt, Human
uucauugguccuaauggcag

SEQ ID NO: 1326487 - RNA, 21 nt, Human
uuucauugguccuaauggcag

SEQ ID NO: 1326488 - RNA, 21 nt, Human
accacauauguacgcauugcc

SEQ ID NO: 1326489 - RNA, 22 nt, Human
acuagaagcaaaaacauuuuca

SEQ ID NO: 1326490 - RNA, 21 nt, Human
caaucucuggcagcacagcug

SEQ ID NO: 1326491 - RNA, 22 nt, Human
cacagcugcagcaaccugcgcu

SEQ ID NO: 1326492 - RNA, 21 nt, Human
cagcacagcugcagcaaccug

SEQ ID NO: 1326493 - RNA, 24 nt, Human
ccacauauguacgcauugccccuc

SEQ ID NO: 1326494 - RNA, 24 nt, Human
ccgcuggagcuaacgaaaccacau

SEQ ID NO: 1326495 - RNA, 25 nt, Human
cgggaucgccuccauucaguguuuc

SEQ ID NO: 1326496 - RNA, 23 nt, Human
cugaauuacaaucucuggcagca

SEQ ID NO: 1326497 - RNA, 22 nt, Human
cugcgcugcugcugcuccaucc

SEQ ID NO: 1326498 - RNA, 25 nt, Human
gcagcaaccugcgcugcugcugcuc

SEQ ID NO: 1326499 - RNA, 19 nt, Human
gcugcugcuccauccaucu

SEQ ID NO: 1326500 - RNA, 19 nt, Human
gguuccugaauuacaaucu

SEQ ID NO: 1326501 - RNA, 18 nt, Human
uacuguaauuccuaaggu

SEQ ID NO: 1326502 - RNA, 20 nt, Human
uccaaaaaauauacuagaag

SEQ ID NO: 1326503 - RNA, 21 nt, Human
uccuaagguaagaaagggagc

SEQ ID NO: 1326504 - RNA, 28 nt, Human
ugcuccauccaucucgggaucgccucca

SEQ ID NO: 1326505 - RNA, 21 nt, Human
uggcagcacagcugcagcaac

SEQ ID NO: 1326506 - RNA, 20 nt, Human
ugguuccugaauuacaaucu

SEQ ID NO: 1326507 - RNA, 18 nt, Human
uguacgcauugccccaaa

SEQ ID NO: 1326508 - RNA, 19 nt, Human
ugucagaggauuagccccc

SEQ ID NO: 1326509 - RNA, 26 nt, Human
uuaaaaauauuuauuaauauuuagaa

SEQ ID NO: 1326510 - RNA, 18 nt, Human
uuuauuaauauuuagaac

SEQ ID NO: 1326511 - RNA, 21 nt, Human
aaaacagcccugggcagggau

SEQ ID NO: 1326512 - RNA, 21 nt, Human
aacaucaucuucccuacaauc

SEQ ID NO: 1326513 - RNA, 21 nt, Human
aagagaccgagugacuggaug

SEQ ID NO: 1326514 - RNA, 23 nt, Human
aauguacauggcaugaguauaug

SEQ ID NO: 1326515 - RNA, 27 nt, Human
agacacuacaggucggaaauccaagcu

SEQ ID NO: 1326516 - RNA, 21 nt, Human
aggaauugcaagaugaggggg

SEQ ID NO: 1326517 - RNA, 18 nt, Human
aucugguuggacaguggg

SEQ ID NO: 1326518 - RNA, 20 nt, Human
caaaccaaagcagaauggcc

SEQ ID NO: 1326519 - RNA, 22 nt, Human
cacccugccuuaagagaccgag

SEQ ID NO: 1326520 - RNA, 19 nt, Human
cacuguauaaauauagagu

SEQ ID NO: 1326521 - RNA, 21 nt, Human
cagcagguuccuaggugguuu

SEQ ID NO: 1326522 - RNA, 19 nt, Human
cagugggugagcaccaggc

SEQ ID NO: 1326523 - RNA, 23 nt, Human
caucaucuucccuacaaucugca

SEQ ID NO: 1326524 - RNA, 24 nt, Human
caugagccuuaaggaaauggacua

SEQ ID NO: 1326525 - RNA, 20 nt, Human
cauuuuauccauuuggagua

SEQ ID NO: 1326526 - RNA, 25 nt, Human
ccaaagcagaauggccuuagagcaa

SEQ ID NO: 1326527 - RNA, 23 nt, Human
cccuacaaucugcaucccccaaa

SEQ ID NO: 1326528 - RNA, 19 nt, Human
cuagaggcugagccaaacc

SEQ ID NO: 1326529 - RNA, 22 nt, Human
gaaaacagcccugggcagggau

SEQ ID NO: 1326530 - RNA, 19 nt, Human
gaaucagcugucuuaaagu

SEQ ID NO: 1326531 - RNA, 18 nt, Human
gaucaucauccugaucca

SEQ ID NO: 1326532 - RNA, 28 nt, Human
ggaggcuuucgguaagcaaggcaucugg

SEQ ID NO: 1326533 - RNA, 22 nt, Human
ggagguuuguggggauuucucu

SEQ ID NO: 1326534 - RNA, 19 nt, Human
uaaacaucaucuucccuac

SEQ ID NO: 1326535 - RNA, 18 nt, Human
uacagcaauguucugaga

SEQ ID NO: 1326536 - RNA, 20 nt, Human
uaggauggagguuugugggg

SEQ ID NO: 1326537 - RNA, 19 nt, Human
ucagagucucauuuuaucc

SEQ ID NO: 1326538 - RNA, 18 nt, Human
uccucaaucagagucuca

SEQ ID NO: 1326539 - RNA, 23 nt, Human
ucuauacacacauuaccuauaua

SEQ ID NO: 1326540 - RNA, 22 nt, Human
ucucuucagagcaauuccugga

SEQ ID NO: 1326541 - RNA, 23 nt, Human
ucuucagagcaauuccuggaggc

SEQ ID NO: 1326542 - RNA, 21 nt, Human
ucuucuucuuccuccccaguc

SEQ ID NO: 1326543 - RNA, 22 nt, Human
ugaguauaugucacuguauaaa

SEQ ID NO: 1326544 - RNA, 24 nt, Human
uggcacccugccuuaagagaccga

SEQ ID NO: 1326545 - RNA, 22 nt, Human
uggcaugaguauaugucacugu

SEQ ID NO: 1326546 - RNA, 23 nt, Human
uuacuuuuuuuuccucaaucaga

SEQ ID NO: 1326547 - RNA, 22 nt, Human
uuagaaaucuugaacccgcgcu

SEQ ID NO: 1326548 - RNA, 21 nt, Human
uuagagcaacagcagguuccu

SEQ ID NO: 1326549 - RNA, 23 nt, Human
uucacaucaguuucucuucuucu

SEQ ID NO: 1326550 - RNA, 24 nt, Human
uucagggaagagcuaucuugauca

SEQ ID NO: 1326551 - RNA, 23 nt, Human
uucucuucagagcaauuccugga

SEQ ID NO: 1326552 - RNA, 19 nt, Human
uugcuggagacacuacagg

SEQ ID NO: 1326553 - RNA, 24 nt, Human
uacauggguacgccagcgagugcc

SEQ ID NO: 1326554 - RNA, 28 nt, Human
aaacaacaacaauaaaauccccaguagg

SEQ ID NO: 1326555 - RNA, 27 nt, Human
aagaaaaaagaaagugggagaaucuga

SEQ ID NO: 1326556 - RNA, 18 nt, Human
aagaaaauggaaucccua

SEQ ID NO: 1326557 - RNA, 21 nt, Human
aagaaaauggaaucccuaagc

SEQ ID NO: 1326558 - RNA, 27 nt, Human
aagaaagugggagaaucugaucacgac

SEQ ID NO: 1326559 - RNA, 18 nt, Human
agaggugaacaaagaaaa

SEQ ID NO: 1326560 - RNA, 19 nt, Human
agcgugaggggcgaaaaga

SEQ ID NO: 1326561 - RNA, 18 nt, Human
aggaaagaaaaaagaaag

SEQ ID NO: 1326562 - RNA, 21 nt, Human
cagucuauuccuccagaggcu

SEQ ID NO: 1326563 - RNA, 22 nt, Human
cauuccaggaaagaaaaaagaa

SEQ ID NO: 1326564 - RNA, 20 nt, Human
ccaaaggccaacccugcagc

SEQ ID NO: 1326565 - RNA, 18 nt, Human
cccacuccauuccaggaa

SEQ ID NO: 1326566 - RNA, 19 nt, Human
cccugggcugccuaaauag

SEQ ID NO: 1326567 - RNA, 18 nt, Human
cuauauggccagcauuau

SEQ ID NO: 1326568 - RNA, 23 nt, Human
cuccagagagcagaagccccucu

SEQ ID NO: 1326569 - RNA, 19 nt, Human
cugcagcauucuagugcuc

SEQ ID NO: 1326570 - RNA, 24 nt, Human
cuuaggguugcuaaaucaaguggu

SEQ ID NO: 1326571 - RNA, 21 nt, Human
gaaagaaaaaagaaaguggga

SEQ ID NO: 1326572 - RNA, 18 nt, Human
gagagcaaagcagauucc

SEQ ID NO: 1326573 - RNA, 25 nt, Human
gaucacgacgggcugagguccugug

SEQ ID NO: 1326574 - RNA, 20 nt, Human
ggaaagaaaaaagaaagugg

SEQ ID NO: 1326575 - RNA, 24 nt, Human
ggcaaguagaggugaacaaagaaa

SEQ ID NO: 1326576 - RNA, 21 nt, Human
gguagagauggaaaaagacug

SEQ ID NO: 1326577 - RNA, 28 nt, Human
uaaaaaugaacaucaacuucgguagaga

SEQ ID NO: 1326578 - RNA, 23 nt, Human
ucccugggcugccuaaauaguuc

SEQ ID NO: 1326579 - RNA, 19 nt, Human
uccgaauugacuccugaga

SEQ ID NO: 1326580 - RNA, 22 nt, Human
ucgcguuaaacacaaacaacaa

SEQ ID NO: 1326581 - RNA, 18 nt, Human
ucgguagagauggaaaaa

SEQ ID NO: 1326582 - RNA, 18 nt, Human
ugaaacguugcugcccuc

SEQ ID NO: 1326583 - RNA, 22 nt, Human
ugagagcaaagcagauuccaaa

SEQ ID NO: 1326584 - RNA, 20 nt, Human
ugccccaggggaugccuuca

SEQ ID NO: 1326585 - RNA, 21 nt, Human
ugccccaggggaugccuucag

SEQ ID NO: 1326586 - RNA, 22 nt, Human
ugccccaggggaugccuucagu

SEQ ID NO: 1326587 - RNA, 21 nt, Human
ugggagaaucugaucacgacg

SEQ ID NO: 1326588 - RNA, 18 nt, Human
uuaaacacaaacaacaac

SEQ ID NO: 1326589 - RNA, 18 nt, Human
uuuagaggcaaguagagg

SEQ ID NO: 1326590 - RNA, 23 nt, Human
aaguuccagguuuguauuucugg

SEQ ID NO: 1326591 - RNA, 23 nt, Human
accccaaaauuucccuguuucac

SEQ ID NO: 1326592 - RNA, 21 nt, Human
aggcaguagaugaccacgauc

SEQ ID NO: 1326593 - RNA, 18 nt, Human
cacaguucugacuggggg

SEQ ID NO: 1326594 - RNA, 21 nt, Human
cagaaggcaguagaugaccac

SEQ ID NO: 1326595 - RNA, 22 nt, Human
cagaaggcaguagaugaccacg

SEQ ID NO: 1326596 - RNA, 19 nt, Human
caguguguggccacuuggu

SEQ ID NO: 1326597 - RNA, 23 nt, Human
cccuguuucacaguucugacugg

SEQ ID NO: 1326598 - RNA, 19 nt, Human
ccucagcuagauuaggccc

SEQ ID NO: 1326599 - RNA, 23 nt, Human
ccuguuucacaguucugacuggg

SEQ ID NO: 1326600 - RNA, 20 nt, Human
uacguggacuuccagguggg

SEQ ID NO: 1326601 - RNA, 19 nt, Human
uagauuaggcccugcccag

SEQ ID NO: 1326602 - RNA, 19 nt, Human
ugagaaagccuuuucauac

SEQ ID NO: 1326603 - RNA, 23 nt, Human
ugagucgcuauacggguuuuuca

SEQ ID NO: 1326604 - RNA, 22 nt, Human
ugcuuuuacucccaccccaaaa

SEQ ID NO: 1326605 - RNA, 21 nt, Human
uuagugggagaccaguucugc

SEQ ID NO: 1326606 - RNA, 28 nt, Human
uucaacaaaaaaaaguuuauuuuccaaa

SEQ ID NO: 1326607 - RNA, 18 nt, Human
uucacaguucugacuggg

SEQ ID NO: 1326608 - RNA, 22 nt, Human
uuucacaguucugacugggggc

SEQ ID NO: 1326609 - RNA, 18 nt, Human
acaggguuucacuauguu

SEQ ID NO: 1326610 - RNA, 21 nt, Human
acaggguuucacuauguuggc

SEQ ID NO: 1326611 - RNA, 24 nt, Human
acaggguuucacuauguuggccag

SEQ ID NO: 1326612 - RNA, 21 nt, Human
acuauguuggccaggcuagug

SEQ ID NO: 1326613 - RNA, 24 nt, Human
augauccaccugccucggccuccc

SEQ ID NO: 1326614 - RNA, 24 nt, Human
auuuuaguagagacaggguuucac

SEQ ID NO: 1326615 - RNA, 23 nt, Human
caccugccucggccucccaaagu

SEQ ID NO: 1326616 - RNA, 18 nt, Human
cacuauguuggccaggcu

SEQ ID NO: 1326617 - RNA, 21 nt, Human
cacuauguuggccaggcuagu

SEQ ID NO: 1326618 - RNA, 24 nt, Human
caggguuucacuauguuggccagg

SEQ ID NO: 1326619 - RNA, 22 nt, Human
ccacacccggcuaauuuuugua

SEQ ID NO: 1326620 - RNA, 24 nt, Human
ccugccucggccucccaaagugcu

SEQ ID NO: 1326621 - RNA, 24 nt, Human
cuaauuuuuguauuuuaguagaga

SEQ ID NO: 1326622 - RNA, 19 nt, Human
cucaugauccaccugccuc

SEQ ID NO: 1326623 - RNA, 24 nt, Human
cuucugaucucaugauccaccugc

SEQ ID NO: 1326624 - RNA, 19 nt, Human
gagggcggacaccaaagcu

SEQ ID NO: 1326625 - RNA, 25 nt, Human
gaguagcugggacuacagugcacgc

SEQ ID NO: 1326626 - RNA, 22 nt, Human
gaucucaugauccaccugccuc

SEQ ID NO: 1326627 - RNA, 24 nt, Human
gaucucaugauccaccugccucgg

SEQ ID NO: 1326628 - RNA, 22 nt, Human
ggguuucacuauguuggccagg

SEQ ID NO: 1326629 - RNA, 23 nt, Human
uaauuuuuguauuuuaguagaga

SEQ ID NO: 1326630 - RNA, 25 nt, Human
uaauuuuuguauuuuaguagagaca

SEQ ID NO: 1326631 - RNA, 22 nt, Human
uagagacaggguuucacuaugu

SEQ ID NO: 1326632 - RNA, 24 nt, Human
uaguagagacaggguuucacuaug

SEQ ID NO: 1326633 - RNA, 24 nt, Human
uauguuggccaggcuagugucgaa

SEQ ID NO: 1326634 - RNA, 18 nt, Human
ucggccucccaaagugcu

SEQ ID NO: 1326635 - RNA, 23 nt, Human
ugaucucaugauccaccugccuc

SEQ ID NO: 1326636 - RNA, 21 nt, Human
ugccucggccucccaaagugc

SEQ ID NO: 1326637 - RNA, 24 nt, Human
ugccucggccucccaaagugcugg

SEQ ID NO: 1326638 - RNA, 24 nt, Human
uggccaggcuagugucgaacuucu

SEQ ID NO: 1326639 - RNA, 23 nt, Human
ugggacuacagugcacgccucca

SEQ ID NO: 1326640 - RNA, 21 nt, Human
uuaguagagacaggguuucac

SEQ ID NO: 1326641 - RNA, 24 nt, Human
uuaguagagacaggguuucacuau

SEQ ID NO: 1326642 - RNA, 24 nt, Human
uuucacuauguuggccaggcuagu

SEQ ID NO: 1326643 - RNA, 19 nt, Human
uuuuuguauuuuaguagag

SEQ ID NO: 1326644 - RNA, 22 nt, Human
aauuauccagccaugagcccug

SEQ ID NO: 1326645 - RNA, 22 nt, Human
acagagcugcucacagauacca

SEQ ID NO: 1326646 - RNA, 25 nt, Human
accaacuacccgcgaccucuaccac

SEQ ID NO: 1326647 - RNA, 20 nt, Human
agaugcuucuagaagccugg

SEQ ID NO: 1326648 - RNA, 21 nt, Human
agcccuggcccagaugcuucu

SEQ ID NO: 1326649 - RNA, 19 nt, Human
agcuucgaaaaggcuuagg

SEQ ID NO: 1326650 - RNA, 18 nt, Human
aggccccuuguccucugg

SEQ ID NO: 1326651 - RNA, 25 nt, Human
aggcccugaggugggagcacacugc

SEQ ID NO: 1326652 - RNA, 23 nt, Human
aggggcugggcaugguuggcuuu

SEQ ID NO: 1326653 - RNA, 24 nt, Human
cacagagcugcucacagauaccac

SEQ ID NO: 1326654 - RNA, 22 nt, Human
cacccacuugcucuuucggcug

SEQ ID NO: 1326655 - RNA, 19 nt, Human
cccaccaacuacccgcgac

SEQ ID NO: 1326656 - RNA, 22 nt, Human
ccccuuguccucuggcagccca

SEQ ID NO: 1326657 - RNA, 19 nt, Human
ccucucagggagaaaaccu

SEQ ID NO: 1326658 - RNA, 21 nt, Human
ccuuuucguauuucauaauga

SEQ ID NO: 1326659 - RNA, 21 nt, Human
cgucagaauucagaacgaugg

SEQ ID NO: 1326660 - RNA, 25 nt, Human
cgucccuagcucugaagggggugcc

SEQ ID NO: 1326661 - RNA, 18 nt, Human
cucacuuguacaaucccc

SEQ ID NO: 1326662 - RNA, 22 nt, Human
cuccgucucacuuguacaaucc

SEQ ID NO: 1326663 - RNA, 22 nt, Human
gaaaaccuuugaguccacagag

SEQ ID NO: 1326664 - RNA, 24 nt, Human
gagcugcucacagauaccacugcc

SEQ ID NO: 1326665 - RNA, 21 nt, Human
gcccugaggugggagcacacu

SEQ ID NO: 1326666 - RNA, 20 nt, Human
ggagaaaaccuuugagucca

SEQ ID NO: 1326667 - RNA, 24 nt, Human
ggagaaaaccuuugaguccacaga

SEQ ID NO: 1326668 - RNA, 24 nt, Human
ggccgcagaggcaaggcccugagg

SEQ ID NO: 1326669 - RNA, 22 nt, Human
ggcuuggggugcugggaggggc

SEQ ID NO: 1326670 - RNA, 24 nt, Human
gggcuuggggugcugggaggggcu

SEQ ID NO: 1326671 - RNA, 20 nt, Human
gggugcugggaggggcuggg

SEQ ID NO: 1326672 - RNA, 18 nt, Human
gugcugggaggggcuggg

SEQ ID NO: 1326673 - RNA, 22 nt, Human
gugcugggaggggcugggcaug

SEQ ID NO: 1326674 - RNA, 18 nt, Human
guuccaucucugaauguc

SEQ ID NO: 1326675 - RNA, 19 nt, Human
uaaaacgaggacgcgaagc

SEQ ID NO: 1326676 - RNA, 28 nt, Human
uaggccccuuguccucuggcagcccagg

SEQ ID NO: 1326677 - RNA, 24 nt, Human
uauccagccaugagcccuggccca

SEQ ID NO: 1326678 - RNA, 20 nt, Human
ucacagauaccacugccugu

SEQ ID NO: 1326679 - RNA, 21 nt, Human
uccaaguggaggccgcagagg

SEQ ID NO: 1326680 - RNA, 22 nt, Human
uccaaguggaggccgcagaggc

SEQ ID NO: 1326681 - RNA, 19 nt, Human
ucgaaaaggcuuaggcccc

SEQ ID NO: 1326682 - RNA, 22 nt, Human
ucguggggcuuggggugcuggg

SEQ ID NO: 1326683 - RNA, 26 nt, Human
ugaaucagcuggccugggucggaucc

SEQ ID NO: 1326684 - RNA, 18 nt, Human
ugaggugggagcacacug

SEQ ID NO: 1326685 - RNA, 21 nt, Human
ugcuucgccucccgcgcaguc

SEQ ID NO: 1326686 - RNA, 23 nt, Human
uggcuuugugaucuggggucugg

SEQ ID NO: 1326687 - RNA, 18 nt, Human
ugggaggggcugggcaug

SEQ ID NO: 1326688 - RNA, 18 nt, Human
ugggaggggcugggcaug

SEQ ID NO: 1326689 - RNA, 20 nt, Human
ugggaggggcugggcauggu

SEQ ID NO: 1326690 - RNA, 20 nt, Human
ugggaggggcugggcauggu

SEQ ID NO: 1326691 - RNA, 18 nt, Human
uggggcuuggggugcugg

SEQ ID NO: 1326692 - RNA, 21 nt, Human
uggggugcugggaggggcugg

SEQ ID NO: 1326693 - RNA, 24 nt, Human
uguuccaucucugaaugucucuca

SEQ ID NO: 1326694 - RNA, 20 nt, Human
uugugcccaccaacuacccg

SEQ ID NO: 1326695 - RNA, 20 nt, Human
ccccauggccccagaaccuc

SEQ ID NO: 1326696 - RNA, 21 nt, Human
cccuggccggcgccggacccc

SEQ ID NO: 1326697 - RNA, 23 nt, Human
ccgcccuggccggcgccggaccc

SEQ ID NO: 1326698 - RNA, 21 nt, Human
ccggacccccauggccccaga

SEQ ID NO: 1326699 - RNA, 22 nt, Human
ccggacccccauggccccagaa

SEQ ID NO: 1326700 - RNA, 19 nt, Human
cggacccccauggccccag

SEQ ID NO: 1326701 - RNA, 18 nt, Human
uggcaugcuggggagugg

SEQ ID NO: 1326702 - RNA, 21 nt, Human
accagauuggauccagccauc

SEQ ID NO: 1326703 - RNA, 21 nt, Human
cacgcugcuuuuaacaaacug

SEQ ID NO: 1326704 - RNA, 18 nt, Human
cacugcugauuauauccc

SEQ ID NO: 1326705 - RNA, 23 nt, Human
gcacugcugauuauaucccacgc

SEQ ID NO: 1326706 - RNA, 23 nt, Human
ucccacgcugcuuuuaacaaacu

SEQ ID NO: 1326707 - RNA, 21 nt, Human
aaaguccucuccacucagccc

SEQ ID NO: 1326708 - RNA, 19 nt, Human
agaaauagcccaggcucgg

SEQ ID NO: 1326709 - RNA, 19 nt, Human
agaugagggugguggcugg

SEQ ID NO: 1326710 - RNA, 18 nt, Human
aggcgguggugauggugg

SEQ ID NO: 1326711 - RNA, 19 nt, Human
aggcucggagucccacuua

SEQ ID NO: 1326712 - RNA, 20 nt, Human
agggaagggguggggggugg

SEQ ID NO: 1326713 - RNA, 18 nt, Human
agggugguggcuggaggc

SEQ ID NO: 1326714 - RNA, 20 nt, Human
agguggaagaugaggguggu

SEQ ID NO: 1326715 - RNA, 20 nt, Human
aggugggggguugggagcag

SEQ ID NO: 1326716 - RNA, 23 nt, Human
cacagccccggcucaggggagcu

SEQ ID NO: 1326717 - RNA, 19 nt, Human
cagcccauagggaccugca

SEQ ID NO: 1326718 - RNA, 18 nt, Human
caggcucggagucccacu

SEQ ID NO: 1326719 - RNA, 19 nt, Human
cgccagcgccagaaauagc

SEQ ID NO: 1326720 - RNA, 23 nt, Human
cgcgccagcgccagaaauagccc

SEQ ID NO: 1326721 - RNA, 22 nt, Human
cuggaggcgguggugaugguuu

SEQ ID NO: 1326722 - RNA, 19 nt, Human
gaaggugcagguggaagau

SEQ ID NO: 1326723 - RNA, 19 nt, Human
gaggugggggguugggagc

SEQ ID NO: 1326724 - RNA, 20 nt, Human
gaugggaagaggccagggga

SEQ ID NO: 1326725 - RNA, 22 nt, Human
ggaagggguggggggugggagg

SEQ ID NO: 1326726 - RNA, 20 nt, Human
ggaggaggggguagggaugg

SEQ ID NO: 1326727 - RNA, 19 nt, Human
ggaggggguagggauggga

SEQ ID NO: 1326728 - RNA, 21 nt, Human
ggaugggaagaggccagggga

SEQ ID NO: 1326729 - RNA, 18 nt, Human
gggggaggaggggguagg

SEQ ID NO: 1326730 - RNA, 23 nt, Human
gggggaggaggggguagggaugg

SEQ ID NO: 1326731 - RNA, 20 nt, Human
ggggggugggaggugggggg

SEQ ID NO: 1326732 - RNA, 19 nt, Human
gggggugggaggugggggg

SEQ ID NO: 1326733 - RNA, 24 nt, Human
ggguagggaugggaagaggccagg

SEQ ID NO: 1326734 - RNA, 24 nt, Human
ggguggacggggggaggagggggu

SEQ ID NO: 1326735 - RNA, 21 nt, Human
ggguggggggugggagguggg

SEQ ID NO: 1326736 - RNA, 22 nt, Human
gguagggaugggaagaggccag

SEQ ID NO: 1326737 - RNA, 20 nt, Human
ggugaugguggguguaggga

SEQ ID NO: 1326738 - RNA, 21 nt, Human
gguggacggggggaggagggg

SEQ ID NO: 1326739 - RNA, 19 nt, Human
ggugguggcuggaggcggu

SEQ ID NO: 1326740 - RNA, 23 nt, Human
gguguagggaagggguggggggu

SEQ ID NO: 1326741 - RNA, 20 nt, Human
gugugguggugaaggugcag

SEQ ID NO: 1326742 - RNA, 26 nt, Human
uagaagagcacagccccggcgucgac

SEQ ID NO: 1326743 - RNA, 20 nt, Human
uggaaaagugauggcuggaa

SEQ ID NO: 1326744 - RNA, 23 nt, Human
uggcugggauggccuuccuggag

SEQ ID NO: 1326745 - RNA, 21 nt, Human
ugggaggugggggguugggag

SEQ ID NO: 1326746 - RNA, 21 nt, Human
uggggggugggaggugggggg

SEQ ID NO: 1326747 - RNA, 21 nt, Human
uggguggacggggggaggagg

SEQ ID NO: 1326748 - RNA, 29 nt, Human
ugguggguguagggaagggguggggggug

SEQ ID NO: 1326749 - RNA, 21 nt, Human
uguagggaagggguggggggu

SEQ ID NO: 1326750 - RNA, 22 nt, Human
aaaugaugaccgccggaauccc

SEQ ID NO: 1326751 - RNA, 24 nt, Human
aagaacccaccugcucuggagucu

SEQ ID NO: 1326752 - RNA, 22 nt, Human
acucuguggugauaaaaaagag

SEQ ID NO: 1326753 - RNA, 22 nt, Human
agaauggaaggaaacggugggg

SEQ ID NO: 1326754 - RNA, 19 nt, Human
agaguagacaucaagaacc

SEQ ID NO: 1326755 - RNA, 19 nt, Human
aggaaaaguagggagggcc

SEQ ID NO: 1326756 - RNA, 18 nt, Human
aguagacaucaagaaccc

SEQ ID NO: 1326757 - RNA, 24 nt, Human
cagaguagacaucaagaacccacc

SEQ ID NO: 1326758 - RNA, 20 nt, Human
cagccccagcauaaccuggc

SEQ ID NO: 1326759 - RNA, 21 nt, Human
cccagcauaaccuggcgcccc

SEQ ID NO: 1326760 - RNA, 24 nt, Human
cgccaagaauaaaugaugaccgcc

SEQ ID NO: 1326761 - RNA, 24 nt, Human
cggccagcugggcgccagggggcc

SEQ ID NO: 1326762 - RNA, 22 nt, Human
cuccgcgcucaggcguggcuuc

SEQ ID NO: 1326763 - RNA, 21 nt, Human
gagugguuggcucagaaugga

SEQ ID NO: 1326764 - RNA, 19 nt, Human
gggcgccagggggccuggg

SEQ ID NO: 1326765 - RNA, 23 nt, Human
ggguccccgaauauccugggcuc

SEQ ID NO: 1326766 - RNA, 20 nt, Human
gucugcguuacucuguggug

SEQ ID NO: 1326767 - RNA, 20 nt, Human
gugcagccccagcauaaccu

SEQ ID NO: 1326768 - RNA, 23 nt, Human
uagggagggccggaaagcccagg

SEQ ID NO: 1326769 - RNA, 19 nt, Human
uccccgaauauccugggcu

SEQ ID NO: 1326770 - RNA, 18 nt, Human
uccgggaagugccgcugc

SEQ ID NO: 1326771 - RNA, 25 nt, Human
ucuaaaacaauauuuucuuuuggga

SEQ ID NO: 1326772 - RNA, 24 nt, Human
ugcccguuuuggcaggaauacauu

SEQ ID NO: 1326773 - RNA, 23 nt, Human
ugccguuaggcgcaggucuuggc

SEQ ID NO: 1326774 - RNA, 22 nt, Human
ugcucuggagucuuggugggca

SEQ ID NO: 1326775 - RNA, 25 nt, Human
uguggugauaaaaaagagaagcggc

SEQ ID NO: 1326776 - RNA, 19 nt, Human
uuggcucagaauggaagga

SEQ ID NO: 1326777 - RNA, 23 nt, Human
aaaaaaauaauacuuuggcauuc

SEQ ID NO: 1326778 - RNA, 19 nt, Human
aaaaagacauccagaaaac

SEQ ID NO: 1326779 - RNA, 25 nt, Human
aaaaagacauccagaaaacuucgag

SEQ ID NO: 1326780 - RNA, 19 nt, Human
aaaagcucaaaacccagcc

SEQ ID NO: 1326781 - RNA, 20 nt, Human
aaacaaaaacccaacaaaag

SEQ ID NO: 1326782 - RNA, 21 nt, Human
aaacaaaaacccaacaaaaga

SEQ ID NO: 1326783 - RNA, 21 nt, Human
aaagaaacaauacacaaauaa

SEQ ID NO: 1326784 - RNA, 19 nt, Human
aacaaauuucacgaaaagu

SEQ ID NO: 1326785 - RNA, 22 nt, Human
aacccagccaauuuuuauacag

SEQ ID NO: 1326786 - RNA, 26 nt, Human
aagaaacaaacaaaaacccaacaaaa

SEQ ID NO: 1326787 - RNA, 22 nt, Human
aagaauaaauaaaauacacugg

SEQ ID NO: 1326788 - RNA, 24 nt, Human
aauaauagcauaauaaauuuuaaa

SEQ ID NO: 1326789 - RNA, 18 nt, Human
acaaacaaaaacccaaca

SEQ ID NO: 1326790 - RNA, 19 nt, Human
acccaggugucuggcuggc

SEQ ID NO: 1326791 - RNA, 20 nt, Human
acuucgagggugcccagaaa

SEQ ID NO: 1326792 - RNA, 21 nt, Human
agaaacaaacaaaaacccaac

SEQ ID NO: 1326793 - RNA, 22 nt, Human
agaaacccagccuccuugaguu

SEQ ID NO: 1326794 - RNA, 19 nt, Human
agacaaggccaugggagug

SEQ ID NO: 1326795 - RNA, 19 nt, Human
agcaaugcgaccucugccu

SEQ ID NO: 1326796 - RNA, 27 nt, Human
agcgggcuggucucuuuucccccuggg

SEQ ID NO: 1326797 - RNA, 18 nt, Human
aggcgccuggaagcucag

SEQ ID NO: 1326798 - RNA, 21 nt, Human
auacacauccaguuucgaauc

SEQ ID NO: 1326799 - RNA, 19 nt, Human
auggcucaagacccaggug

SEQ ID NO: 1326800 - RNA, 20 nt, Human
auguuuguuuaaaaaaguuc

SEQ ID NO: 1326801 - RNA, 25 nt, Human
caaaagcucaaaacccagccaauuu

SEQ ID NO: 1326802 - RNA, 20 nt, Human
caaacaaaaacccaacaaaa

SEQ ID NO: 1326803 - RNA, 20 nt, Human
caaacaaaaacccaacaaaa

SEQ ID NO: 1326804 - RNA, 25 nt, Human
caaacaaaaacccaacaaaagaaua

SEQ ID NO: 1326805 - RNA, 24 nt, Human
caaacaaaaacccaacaaccccgg

SEQ ID NO: 1326806 - RNA, 23 nt, Human
caagaagaaacaaacaaaaaccc

SEQ ID NO: 1326807 - RNA, 22 nt, Human
caaugaaggaagucagucugga

SEQ ID NO: 1326808 - RNA, 26 nt, Human
caccuaggugcgucuuccccagagac

SEQ ID NO: 1326809 - RNA, 20 nt, Human
cagacgaggcgccuggaagc

SEQ ID NO: 1326810 - RNA, 24 nt, Human
ccccacaccagugcgaaugcugcc

SEQ ID NO: 1326811 - RNA, 25 nt, Human
cgagaaagauaaaaagacauccaga

SEQ ID NO: 1326812 - RNA, 27 nt, Human
cgagaaagauaaaaagacauccagaaa

SEQ ID NO: 1326813 - RNA, 22 nt, Human
cggccagugcuuaaucggcuuc

SEQ ID NO: 1326814 - RNA, 22 nt, Human
cuugggaagcgggcuggucucu

SEQ ID NO: 1326815 - RNA, 23 nt, Human
cuugggaagcgggcuggucucuu

SEQ ID NO: 1326816 - RNA, 24 nt, Human
gaaacaaacaaaaacccaacaaaa

SEQ ID NO: 1326817 - RNA, 25 nt, Human
gaagaaacaaacaaaaacccaacaa

SEQ ID NO: 1326818 - RNA, 20 nt, Human
gaauacacauccaguuucga

SEQ ID NO: 1326819 - RNA, 19 nt, Human
gacauccagaaaacuucga

SEQ ID NO: 1326820 - RNA, 20 nt, Human
gauaaaaagacauccagaaa

SEQ ID NO: 1326821 - RNA, 21 nt, Human
ggugaaagagaaugagaaaga

SEQ ID NO: 1326822 - RNA, 23 nt, Human
gucgaacaucauucugguguuug

SEQ ID NO: 1326823 - RNA, 21 nt, Human
gugauacagcaaugcgaccuc

SEQ ID NO: 1326824 - RNA, 18 nt, Human
uaaaagaaacaauacaca

SEQ ID NO: 1326825 - RNA, 23 nt, Human
uaaaagaaacaauacacaaauaa

SEQ ID NO: 1326826 - RNA, 22 nt, Human
uaaaauacacuggaagcugcaa

SEQ ID NO: 1326827 - RNA, 21 nt, Human
uaaauaaaauacacuggaagc

SEQ ID NO: 1326828 - RNA, 25 nt, Human
uacaagaagaaacaaacaaaaaccc

SEQ ID NO: 1326829 - RNA, 20 nt, Human
uacagaaaguucaacgucaa

SEQ ID NO: 1326830 - RNA, 22 nt, Human
uacagaaaguucaacgucaaaa

SEQ ID NO: 1326831 - RNA, 21 nt, Human
ucaaacucuaggcagaagccu

SEQ ID NO: 1326832 - RNA, 22 nt, Human
ucaagacccaggugucuggcug

SEQ ID NO: 1326833 - RNA, 21 nt, Human
uccuagacaaggccaugggag

SEQ ID NO: 1326834 - RNA, 20 nt, Human
uccuugaguugaaaggacuc

SEQ ID NO: 1326835 - RNA, 21 nt, Human
ucgggcauuggguaccagccg

SEQ ID NO: 1326836 - RNA, 24 nt, Human
ucuaaaaaguaguaaauguccaga

SEQ ID NO: 1326837 - RNA, 22 nt, Human
ucugccguugccggccugcagc

SEQ ID NO: 1326838 - RNA, 21 nt, Human
ucuguguccaagcacugcuga

SEQ ID NO: 1326839 - RNA, 25 nt, Human
ugaaauaauaaaagaaaccgguacc

SEQ ID NO: 1326840 - RNA, 20 nt, Human
ugagaaagaacuucuggaua

SEQ ID NO: 1326841 - RNA, 21 nt, Human
ugagaaagaacuucuggauag

SEQ ID NO: 1326842 - RNA, 21 nt, Human
ugcgaaugcugccacagugac

SEQ ID NO: 1326843 - RNA, 21 nt, Human
uggcuggcuugggaagcgggc

SEQ ID NO: 1326844 - RNA, 23 nt, Human
ugggaagcgggcuggucucuuuu

SEQ ID NO: 1326845 - RNA, 21 nt, Human
uguaaggucucuguacaaaga

SEQ ID NO: 1326846 - RNA, 20 nt, Human
uguccagacugauuuuggga

SEQ ID NO: 1326847 - RNA, 18 nt, Human
uguuugcgccgcucaaug

SEQ ID NO: 1326848 - RNA, 23 nt, Human
uucacacgagaaagauaaaaaga

SEQ ID NO: 1326849 - RNA, 22 nt, Human
uuccuugaauaaaucuugaaaa

SEQ ID NO: 1326850 - RNA, 21 nt, Human
uugaaaacguuaaauuugcaa

SEQ ID NO: 1326851 - RNA, 22 nt, Human
uuuaaaaaguuucuguacaauu

SEQ ID NO: 1326852 - RNA, 19 nt, Human
uuugcaaaauucuauucau

SEQ ID NO: 1326853 - RNA, 18 nt, Human
accacguucacgcucagc

SEQ ID NO: 1326854 - RNA, 23 nt, Human
acguucacgcucagcuuucaguu

SEQ ID NO: 1326855 - RNA, 19 nt, Human
agagauggguuuucaccgu

SEQ ID NO: 1326856 - RNA, 20 nt, Human
aguagagauggguuuucacc

SEQ ID NO: 1326857 - RNA, 18 nt, Human
caaggagauaucaauggu

SEQ ID NO: 1326858 - RNA, 23 nt, Human
cguucacgcucagcuuucaguuu

SEQ ID NO: 1326859 - RNA, 23 nt, Human
cuuucaguuuauccaagacccag

SEQ ID NO: 1326860 - RNA, 21 nt, Human
uaguagagauggguuuucacc

SEQ ID NO: 1326861 - RNA, 24 nt, Human
uaguagagauggguuuucaccgug

SEQ ID NO: 1326862 - RNA, 20 nt, Human
ucaauggugauaccacguuc

SEQ ID NO: 1326863 - RNA, 23 nt, Human
ucaguuuauccaagacccagcca

SEQ ID NO: 1326864 - RNA, 24 nt, Human
uuaguagagauggguuuucaccgu

SEQ ID NO: 1326865 - RNA, 21 nt, Human
uugaugaagucucuguguccu

SEQ ID NO: 1326866 - RNA, 24 nt, Human
uuuuuaguagagauggguuuucac

SEQ ID NO: 1326867 - RNA, 21 nt, Human
uuuuuguauuuuuaguagaga

SEQ ID NO: 1326868 - RNA, 21 nt, Human
uuuuuuguauuuuuaguagag

SEQ ID NO: 1326869 - RNA, 24 nt, Human
uuuuuuguauuuuuaguagagaug

SEQ ID NO: 1326870 - RNA, 20 nt, Human
agacgcccccuucccucaag

SEQ ID NO: 1326871 - RNA, 19 nt, Human
gggcaggaagcuggggagg

SEQ ID NO: 1326872 - RNA, 19 nt, Human
ucccuagcagggaccagcu

SEQ ID NO: 1326873 - RNA, 19 nt, Human
ucuuugggcaggaagcugg

SEQ ID NO: 1326874 - RNA, 18 nt, Human
ugaauguggggcucuuug

SEQ ID NO: 1326875 - RNA, 19 nt, Human
uggggagggaacggggugg

SEQ ID NO: 1326876 - RNA, 23 nt, Human
acagaccaaaagaccaccaugua

SEQ ID NO: 1326877 - RNA, 22 nt, Human
accgcagugaggggucugaccg

SEQ ID NO: 1326878 - RNA, 20 nt, Human
caacagaccaaaagaccacc

SEQ ID NO: 1326879 - RNA, 21 nt, Human
caaggagcugcaaacccaaac

SEQ ID NO: 1326880 - RNA, 24 nt, Human
cccggaggcauucuccagcaagcc

SEQ ID NO: 1326881 - RNA, 18 nt, Human
ccgccgccgcugcugcca

SEQ ID NO: 1326882 - RNA, 27 nt, Human
ccgccgccgcugcugccacugggcaga

SEQ ID NO: 1326883 - RNA, 21 nt, Human
cugcaaacccaaacgagaaau

SEQ ID NO: 1326884 - RNA, 22 nt, Human
gagcagccugcuugaggcuggu

SEQ ID NO: 1326885 - RNA, 20 nt, Human
gccgccgccgcugcugccac

SEQ ID NO: 1326886 - RNA, 20 nt, Human
gcuccagagagcagccugcu

SEQ ID NO: 1326887 - RNA, 26 nt, Human
ucuacucuaucccgcaacagaccaaa

SEQ ID NO: 1326888 - RNA, 23 nt, Human
ucuaucccgcaacagaccaaaag

SEQ ID NO: 1326889 - RNA, 23 nt, Human
ucuccagcaagccacagaggagc

SEQ ID NO: 1326890 - RNA, 20 nt, Human
ucugaccgcgcugagugcuc

SEQ ID NO: 1326891 - RNA, 25 nt, Human
ucuggcaaggagcugcaaacccaaa

SEQ ID NO: 1326892 - RNA, 18 nt, Human
uggcaaggagcugcaaac

SEQ ID NO: 1326893 - RNA, 20 nt, Human
uggcugccgccgccgcugcu

SEQ ID NO: 1326894 - RNA, 22 nt, Human
uggggcuagugaggcugcugua

SEQ ID NO: 1326895 - RNA, 24 nt, Human
uuuggcugccgccgccgcugcugc

SEQ ID NO: 1326896 - RNA, 22 nt, Human
aaaaauagaacuucugauuaga

SEQ ID NO: 1326897 - RNA, 18 nt, Human
aaaaggaaagaauuaagg

SEQ ID NO: 1326898 - RNA, 19 nt, Human
aaacacagaaaaaauaucc

SEQ ID NO: 1326899 - RNA, 24 nt, Human
aaacacagaaaaaauauccugaca

SEQ ID NO: 1326900 - RNA, 24 nt, Human
aaacaguagcaggcuaacuucaau

SEQ ID NO: 1326901 - RNA, 22 nt, Human
aagacuucaaaagaccuuaacc

SEQ ID NO: 1326902 - RNA, 22 nt, Human
aagagcaaaauugaaaaggaaa

SEQ ID NO: 1326903 - RNA, 21 nt, Human
aaugagaaagacuucaaaaga

SEQ ID NO: 1326904 - RNA, 22 nt, Human
acaaagaacaagcuugcuucca

SEQ ID NO: 1326905 - RNA, 18 nt, Human
accugcaaugguuucuuu

SEQ ID NO: 1326906 - RNA, 22 nt, Human
agaauggagcuugcaaagaaga

SEQ ID NO: 1326907 - RNA, 23 nt, Human
auacugaaauccuuugucucuga

SEQ ID NO: 1326908 - RNA, 24 nt, Human
augcaaaccuacaggauguauagu

SEQ ID NO: 1326909 - RNA, 20 nt, Human
caaacuuguuagucugcaag

SEQ ID NO: 1326910 - RNA, 21 nt, Human
caaagaacaagcuugcuucca

SEQ ID NO: 1326911 - RNA, 19 nt, Human
ccuugaggauugagguaag

SEQ ID NO: 1326912 - RNA, 23 nt, Human
ccuuugucucugacccaagaguc

SEQ ID NO: 1326913 - RNA, 27 nt, Human
cucuauauguuacuuuucuaugcugcc

SEQ ID NO: 1326914 - RNA, 22 nt, Human
cugaaauccuuugucucugacc

SEQ ID NO: 1326915 - RNA, 22 nt, Human
cugacuaaacccuccugauaaa

SEQ ID NO: 1326916 - RNA, 23 nt, Human
gacuuuuguuuccucaacgcuuu

SEQ ID NO: 1326917 - RNA, 24 nt, Human
gagaaagacuucaaaagaccuuaa

SEQ ID NO: 1326918 - RNA, 23 nt, Human
gcugaagucuuuugucucugacc

SEQ ID NO: 1326919 - RNA, 24 nt, Human
gcuuugguggcugguguuccuuuu

SEQ ID NO: 1326920 - RNA, 21 nt, Human
guaguaaauaugaaauacuuu

SEQ ID NO: 1326921 - RNA, 22 nt, Human
guuccuuuucuuuucuugccuu

SEQ ID NO: 1326922 - RNA, 24 nt, Human
uaaauaugaaauacuuuuaauuau

SEQ ID NO: 1326923 - RNA, 18 nt, Human
uaaggugucucaccagac

SEQ ID NO: 1326924 - RNA, 23 nt, Human
uaagugcuuugguggcugguguu

SEQ ID NO: 1326925 - RNA, 19 nt, Human
uagaauggagcuugcaaag

SEQ ID NO: 1326926 - RNA, 21 nt, Human
uagugguaaaaauagaacuuc

SEQ ID NO: 1326927 - RNA, 18 nt, Human
uccugacagggugauggc

SEQ ID NO: 1326928 - RNA, 23 nt, Human
uccuucagcugcauauucuugcu

SEQ ID NO: 1326929 - RNA, 24 nt, Human
uccuuugucucugacccaagaguc

SEQ ID NO: 1326930 - RNA, 23 nt, Human
ucucacagcuuccguagguugga

SEQ ID NO: 1326931 - RNA, 19 nt, Human
ucucagacucuguagaccu

SEQ ID NO: 1326932 - RNA, 19 nt, Human
ugaaaucgcuaagugcuuu

SEQ ID NO: 1326933 - RNA, 20 nt, Human
ugacuuggaguauucaguaa

SEQ ID NO: 1326934 - RNA, 21 nt, Human
ugacuuggaguauucaguaac

SEQ ID NO: 1326935 - RNA, 22 nt, Human
ugagaaaaggcuaccccaagua

SEQ ID NO: 1326936 - RNA, 18 nt, Human
ugaugcaaaccuacagga

SEQ ID NO: 1326937 - RNA, 23 nt, Human
ugauggcacucauccagguagaa

SEQ ID NO: 1326938 - RNA, 19 nt, Human
ugcaaaccuacaggaugua

SEQ ID NO: 1326939 - RNA, 21 nt, Human
ugcaaagaagaauugaaacuc

SEQ ID NO: 1326940 - RNA, 18 nt, Human
ugcagugagcaaccuuga

SEQ ID NO: 1326941 - RNA, 21 nt, Human
ugccaagaaugcaaggcccuu

SEQ ID NO: 1326942 - RNA, 22 nt, Human
uggaguauucaguaaccucaau

SEQ ID NO: 1326943 - RNA, 22 nt, Human
uguauaaacacagaaaaaauau

SEQ ID NO: 1326944 - RNA, 23 nt, Human
uguauaaacacagaaaaaauauc

SEQ ID NO: 1326945 - RNA, 24 nt, Human
uguuuaguuacuaacuagcuaucu

SEQ ID NO: 1326946 - RNA, 23 nt, Human
uuagugguaaaaauagaacuucu

SEQ ID NO: 1326947 - RNA, 23 nt, Human
uucagcugcauauucuugccguc

SEQ ID NO: 1326948 - RNA, 20 nt, Human
uuccaugauucuguauaaac

SEQ ID NO: 1326949 - RNA, 22 nt, Human
uucuaugcugccaaaacaaacu

SEQ ID NO: 1326950 - RNA, 20 nt, Human
uugacagugaguugggaaau

SEQ ID NO: 1326951 - RNA, 19 nt, Human
aaacaacauuucccacuaa

SEQ ID NO: 1326952 - RNA, 20 nt, Human
aaacaacauuucccacuaaa

SEQ ID NO: 1326953 - RNA, 18 nt, Human
aaacaguuacauggcccu

SEQ ID NO: 1326954 - RNA, 21 nt, Human
agaaucacagggagcucacca

SEQ ID NO: 1326955 - RNA, 24 nt, Human
cauuccugcugcucugcccagagg

SEQ ID NO: 1326956 - RNA, 20 nt, Human
ccaccucucaaacaacauuu

SEQ ID NO: 1326957 - RNA, 24 nt, Human
cucaaacaacauuucccacuaaac

SEQ ID NO: 1326958 - RNA, 21 nt, Human
cucaccaccucucaaacaaca

SEQ ID NO: 1326959 - RNA, 18 nt, Human
ggcuguagcaccugccag

SEQ ID NO: 1326960 - RNA, 18 nt, Human
uccugcugcucugcccag

SEQ ID NO: 1326961 - RNA, 21 nt, Human
uccugcugcucugcccagagg

SEQ ID NO: 1326962 - RNA, 24 nt, Human
uuccugcugcucugcccagaggcc

SEQ ID NO: 1326963 - RNA, 22 nt, Human
aaucugcaggcucaccacccac

SEQ ID NO: 1326964 - RNA, 23 nt, Human
acggccaugcgccagcuugugcu

SEQ ID NO: 1326965 - RNA, 23 nt, Human
caagaacacggccauauuuaauc

SEQ ID NO: 1326966 - RNA, 23 nt, Human
cccccacauacaugaacaagaac

SEQ ID NO: 1326967 - RNA, 21 nt, Human
ccccuauaauccgagacccuu

SEQ ID NO: 1326968 - RNA, 18 nt, Human
cucacuaggguuccccca

SEQ ID NO: 1326969 - RNA, 23 nt, Human
cucucucucacuaggguuccccc

SEQ ID NO: 1326970 - RNA, 22 nt, Human
gaacacggccauauuuaaucug

SEQ ID NO: 1326971 - RNA, 23 nt, Human
gaacacggccauauuuaaucugc

SEQ ID NO: 1326972 - RNA, 19 nt, Human
ucccccacauacaugaaca

SEQ ID NO: 1326973 - RNA, 24 nt, Human
ucccccacauacaugaacaagaac

SEQ ID NO: 1326974 - RNA, 18 nt, Human
ugaacaagaacacggcca

SEQ ID NO: 1326975 - RNA, 19 nt, Human
uucccccacauacaugaac

SEQ ID NO: 1326976 - RNA, 18 nt, Human
aaaugaagccgcggaccc

SEQ ID NO: 1326977 - RNA, 21 nt, Human
aacaaaauaguaaucagagaa

SEQ ID NO: 1326978 - RNA, 21 nt, Human
aacagagccuccacagcaugg

SEQ ID NO: 1326979 - RNA, 19 nt, Human
aagauuucaucugcgagaa

SEQ ID NO: 1326980 - RNA, 23 nt, Human
aaguugcaaaccuucaggggaga

SEQ ID NO: 1326981 - RNA, 24 nt, Human
acaacagagccuccacagcaugga

SEQ ID NO: 1326982 - RNA, 18 nt, Human
acccgaagaguaagcagu

SEQ ID NO: 1326983 - RNA, 26 nt, Human
aguaagcaguagaaagagcgaaacaa

SEQ ID NO: 1326984 - RNA, 20 nt, Human
caacuuucaggagauuuuga

SEQ ID NO: 1326985 - RNA, 23 nt, Human
cagcaaugaugaagucuucuuua

SEQ ID NO: 1326986 - RNA, 19 nt, Human
caguuuuuguauuuuuaga

SEQ ID NO: 1326987 - RNA, 20 nt, Human
caguuuuuguauuuuuagau

SEQ ID NO: 1326988 - RNA, 24 nt, Human
cccgaagaguaagcaguagaaaga

SEQ ID NO: 1326989 - RNA, 24 nt, Human
gaaacaacagagccuccacagcau

SEQ ID NO: 1326990 - RNA, 21 nt, Human
gaguuguucguuccucccugg

SEQ ID NO: 1326991 - RNA, 22 nt, Human
gcgaaacaacagagccuccaca

SEQ ID NO: 1326992 - RNA, 23 nt, Human
gcgaaacaacagagccuccacag

SEQ ID NO: 1326993 - RNA, 24 nt, Human
gcgaaacaacagagccuccacagc

SEQ ID NO: 1326994 - RNA, 20 nt, Human
gcggacccucgcggugagug

SEQ ID NO: 1326995 - RNA, 26 nt, Human
ggaauucuucuacagcuccccugcuc

SEQ ID NO: 1326996 - RNA, 19 nt, Human
ggacccgaagaguaagcag

SEQ ID NO: 1326997 - RNA, 23 nt, Human
uaagcaguagaaagagcgaaaca

SEQ ID NO: 1326998 - RNA, 23 nt, Human
uaagcaguagaaagagcgaaaca

SEQ ID NO: 1326999 - RNA, 19 nt, Human
uagaaagagcgaaacaaca

SEQ ID NO: 1327000 - RNA, 22 nt, Human
uagaaagagcgaaacaacagag

SEQ ID NO: 1327001 - RNA, 19 nt, Human
uagaguuaaagacuggggu

SEQ ID NO: 1327002 - RNA, 22 nt, Human
ucuccuggcaugaaagaguugg

SEQ ID NO: 1327003 - RNA, 22 nt, Human
ucuggaguuuguuccuucugau

SEQ ID NO: 1327004 - RNA, 19 nt, Human
ugaaaggagcuauagagcu

SEQ ID NO: 1327005 - RNA, 20 nt, Human
ugagguggagaaggaauuua

SEQ ID NO: 1327006 - RNA, 23 nt, Human
ugcuggugguugagguggagaag

SEQ ID NO: 1327007 - RNA, 23 nt, Human
uggaguuguucguuccucccugg

SEQ ID NO: 1327008 - RNA, 20 nt, Human
uggugguugagguggagaag

SEQ ID NO: 1327009 - RNA, 24 nt, Human
ugugaaauucauccucagcaauga

SEQ ID NO: 1327010 - RNA, 24 nt, Human
uguuaacagcucuuaagguggcac

SEQ ID NO: 1327011 - RNA, 23 nt, Human
uucaggagauuuugacccaugug

SEQ ID NO: 1327012 - RNA, 24 nt, Human
uucugguggguucguggccucgcu

SEQ ID NO: 1327013 - RNA, 24 nt, Human
uucuucuacagcuccccugcucaa

SEQ ID NO: 1327014 - RNA, 26 nt, Human
uuguucguuccucccuggggcucgug

SEQ ID NO: 1327015 - RNA, 25 nt, Human
aaacaaacaauacauuuaaaaagca

SEQ ID NO: 1327016 - RNA, 19 nt, Human
aaacaagaaagaaacauaa

SEQ ID NO: 1327017 - RNA, 19 nt, Human
aaacaagaaagaaacauaa

SEQ ID NO: 1327018 - RNA, 21 nt, Human
aaacaagaaagaaacauaagg

SEQ ID NO: 1327019 - RNA, 23 nt, Human
aaacugaaaguaauaagcgacgc

SEQ ID NO: 1327020 - RNA, 20 nt, Human
aaagugaaaacagauacgaa

SEQ ID NO: 1327021 - RNA, 23 nt, Human
aaauacaaauauuuaaaauacaa

SEQ ID NO: 1327022 - RNA, 18 nt, Human
aaccagcaaugaaagcac

SEQ ID NO: 1327023 - RNA, 25 nt, Human
aagaaagaaacauaagggaaaaaga

SEQ ID NO: 1327024 - RNA, 19 nt, Human
aaggaaacugaaaguaaua

SEQ ID NO: 1327025 - RNA, 22 nt, Human
acaaacaauacauuuaaaaagc

SEQ ID NO: 1327026 - RNA, 28 nt, Human
acauuuaaaaagcaauaauuagaaaaag

SEQ ID NO: 1327027 - RNA, 23 nt, Human
agcgacgcgaaacaagaaagaaa

SEQ ID NO: 1327028 - RNA, 28 nt, Human
aguaauaagcgacgcgaaacaagaaaga

SEQ ID NO: 1327029 - RNA, 23 nt, Human
caaaugaaaaacgauaacauuuu

SEQ ID NO: 1327030 - RNA, 23 nt, Human
cagagcccgugggcggaggccag

SEQ ID NO: 1327031 - RNA, 21 nt, Human
cgaaaauuaguagacaaauga

SEQ ID NO: 1327032 - RNA, 23 nt, Human
cucaaagugaaaacagauacgaa

SEQ ID NO: 1327033 - RNA, 23 nt, Human
gaaacaagaaagaaacauaaggg

SEQ ID NO: 1327034 - RNA, 24 nt, Human
ggaaaaagagaauuuaaaaacuga

SEQ ID NO: 1327035 - RNA, 22 nt, Human
gggaaaaagagaauuuaaaaac

SEQ ID NO: 1327036 - RNA, 23 nt, Human
gugaaaacagauacgaaugaaau

SEQ ID NO: 1327037 - RNA, 26 nt, Human
uaaauacaaauauuuaaaauacaagg

SEQ ID NO: 1327038 - RNA, 24 nt, Human
uaagggaaaaagagaauuuaaaaa

SEQ ID NO: 1327039 - RNA, 24 nt, Human
uaguaggaauaagauuuuaaaaua

SEQ ID NO: 1327040 - RNA, 23 nt, Human
uauuaagaaacucaguaguaaca

SEQ ID NO: 1327041 - RNA, 25 nt, Human
uauuuuuauuuucuagguggagacg

SEQ ID NO: 1327042 - RNA, 19 nt, Human
ucaguaguaacaaaugcac

SEQ ID NO: 1327043 - RNA, 21 nt, Human
uucaaggaggagaauccaaaa

SEQ ID NO: 1327044 - RNA, 20 nt, Human
agcuggagacccggggagga

SEQ ID NO: 1327045 - RNA, 18 nt, Human
cgacccaggcgggagcug

SEQ ID NO: 1327046 - RNA, 22 nt, Human
cggggaggagcugacguuccca

SEQ ID NO: 1327047 - RNA, 21 nt, Human
cuggcgacccaggcgggagcu

SEQ ID NO: 1327048 - RNA, 18 nt, Human
gguggugcugcuggcgac

SEQ ID NO: 1327049 - RNA, 24 nt, Human
gugcugcuggcgacccaggcggga

SEQ ID NO: 1327050 - RNA, 23 nt, Human
ugauguuccaguuugaggguggu

SEQ ID NO: 1327051 - RNA, 22 nt, Human
cuggaacccagaaacccaguaa

SEQ ID NO: 1327052 - RNA, 22 nt, Human
cuucuggaacccagaaacccag

SEQ ID NO: 1327053 - RNA, 22 nt, Human
gaacccagaaacccaguaaacc

SEQ ID NO: 1327054 - RNA, 20 nt, Human
aaaaaaagauauaaagaaaa

SEQ ID NO: 1327055 - RNA, 25 nt, Human
aaaccaggcaccaggcaagcaaaaa

SEQ ID NO: 1327056 - RNA, 22 nt, Human
aagcaaaaaucagaaccugcuc

SEQ ID NO: 1327057 - RNA, 21 nt, Human
acagaagaaacagccugauuc

SEQ ID NO: 1327058 - RNA, 26 nt, Human
auaaagaaaauaaacaacaaaugaaa

SEQ ID NO: 1327059 - RNA, 22 nt, Human
caagcaaaaaucagaaccugcu

SEQ ID NO: 1327060 - RNA, 19 nt, Human
cagaagaaacagccugauu

SEQ ID NO: 1327061 - RNA, 25 nt, Human
cagaagaaacagccugauuccuuca

SEQ ID NO: 1327062 - RNA, 19 nt, Human
cagccugauuccuucacau

SEQ ID NO: 1327063 - RNA, 23 nt, Human
ccacagaagaaacagccugauuc

SEQ ID NO: 1327064 - RNA, 21 nt, Human
ccaggcaccaggcaagcaaaa

SEQ ID NO: 1327065 - RNA, 23 nt, Human
guagaagcuucuuuaaaguugag

SEQ ID NO: 1327066 - RNA, 21 nt, Human
uaaaaaaagauauaaagaaaa

SEQ ID NO: 1327067 - RNA, 19 nt, Human
uccaguguguagaagcuuc

SEQ ID NO: 1327068 - RNA, 21 nt, Human
ugcaguauuuucuauuaaaaa

SEQ ID NO: 1327069 - RNA, 18 nt, Human
ugcugggaaaccaggcac

SEQ ID NO: 1327070 - RNA, 18 nt, Human
ugucugaagugcuugaag

SEQ ID NO: 1327071 - RNA, 21 nt, Human
aaaaaccugacaugcacauug

SEQ ID NO: 1327072 - RNA, 18 nt, Human
aaaaggacaaaguagccu

SEQ ID NO: 1327073 - RNA, 19 nt, Human
aaauagugaucaugaaaaa

SEQ ID NO: 1327074 - RNA, 18 nt, Human
aaaugccccuuccagucc

SEQ ID NO: 1327075 - RNA, 23 nt, Human
acaaaaaccugacaugcacauug

SEQ ID NO: 1327076 - RNA, 25 nt, Human
acacacagauagauuugauauacaa

SEQ ID NO: 1327077 - RNA, 21 nt, Human
acuuucuuuuuaauuucagag

SEQ ID NO: 1327078 - RNA, 21 nt, Human
agauauuuaagacauuuagau

SEQ ID NO: 1327079 - RNA, 23 nt, Human
aggaagucauugaauccuuaaaa

SEQ ID NO: 1327080 - RNA, 23 nt, Human
aggacaaaguagccucuucccuu

SEQ ID NO: 1327081 - RNA, 24 nt, Human
agguccacauccuccaagucagga

SEQ ID NO: 1327082 - RNA, 22 nt, Human
auaaacauacacuucauacacu

SEQ ID NO: 1327083 - RNA, 24 nt, Human
augaaaauccaacuuuccagauca

SEQ ID NO: 1327084 - RNA, 18 nt, Human
ccacagaccccaguuccu

SEQ ID NO: 1327085 - RNA, 19 nt, Human
ccagggcgaguugagcguu

SEQ ID NO: 1327086 - RNA, 18 nt, Human
cccacagaccccaguucc

SEQ ID NO: 1327087 - RNA, 20 nt, Human
cccacagaccccaguuccug

SEQ ID NO: 1327088 - RNA, 20 nt, Human
ccccuuccaguccacagaga

SEQ ID NO: 1327089 - RNA, 21 nt, Human
ccuuccaguccacagagaaaa

SEQ ID NO: 1327090 - RNA, 25 nt, Human
cggcgcucaagcugcccacaggucu

SEQ ID NO: 1327091 - RNA, 22 nt, Human
cuggcccacagaccccaguucc

SEQ ID NO: 1327092 - RNA, 24 nt, Human
cuucccagacucuccucaugaaaa

SEQ ID NO: 1327093 - RNA, 24 nt, Human
cuucccagacucuccucaugaaaa

SEQ ID NO: 1327094 - RNA, 18 nt, Human
cuuuaaaaaagccucugg

SEQ ID NO: 1327095 - RNA, 22 nt, Human
gcaauguuuuaauauaaacuuu

SEQ ID NO: 1327096 - RNA, 22 nt, Human
gucuggaaucccaaugugaucc

SEQ ID NO: 1327097 - RNA, 18 nt, Human
uaaauagugaucaugaaa

SEQ ID NO: 1327098 - RNA, 19 nt, Human
uacaaguacaaaaaccuga

SEQ ID NO: 1327099 - RNA, 21 nt, Human
uagccacuagguccacauccu

SEQ ID NO: 1327100 - RNA, 18 nt, Human
uauacaaguacaaaaacc

SEQ ID NO: 1327101 - RNA, 24 nt, Human
uccacagagaaaaagcuuucuccu

SEQ ID NO: 1327102 - RNA, 18 nt, Human
uccaugggcgccgccaug

SEQ ID NO: 1327103 - RNA, 22 nt, Human
uccuggggugacgcagcugggc

SEQ ID NO: 1327104 - RNA, 21 nt, Human
ugacaugcacauugaagagaa

SEQ ID NO: 1327105 - RNA, 18 nt, Human
ugaucaugaaaaaugccc

SEQ ID NO: 1327106 - RNA, 27 nt, Human
ugccagucuucguagagacggccacac

SEQ ID NO: 1327107 - RNA, 22 nt, Human
uggcccacagaccccaguuccu

SEQ ID NO: 1327108 - RNA, 18 nt, Human
ugugauccuccugucuuc

SEQ ID NO: 1327109 - RNA, 21 nt, Human
uuccagggcgaguugagcguu

SEQ ID NO: 1327110 - RNA, 18 nt, Human
uuuaauauaaacuuucuu

SEQ ID NO: 1327111 - RNA, 20 nt, Human
aagcaaucuggcaaaagccc

SEQ ID NO: 1327112 - RNA, 25 nt, Human
aagcaucauucugggccagucaccc

SEQ ID NO: 1327113 - RNA, 19 nt, Human
aagcuuccaggagcuguuu

SEQ ID NO: 1327114 - RNA, 22 nt, Human
aauaaaaagaaaugaaaagucu

SEQ ID NO: 1327115 - RNA, 20 nt, Human
acuucugccucagccacccc

SEQ ID NO: 1327116 - RNA, 22 nt, Human
agaaaguucaggaggguucagg

SEQ ID NO: 1327117 - RNA, 21 nt, Human
agaacagagaagagaugagga

SEQ ID NO: 1327118 - RNA, 21 nt, Human
agagaaugcacccccugcccc

SEQ ID NO: 1327119 - RNA, 23 nt, Human
agagaaugcacccccugccccaa

SEQ ID NO: 1327120 - RNA, 23 nt, Human
agaguguacauucuccaauauua

SEQ ID NO: 1327121 - RNA, 21 nt, Human
agccugugcuaacaaauugca

SEQ ID NO: 1327122 - RNA, 23 nt, Human
aggaacacaggcugcucagccca

SEQ ID NO: 1327123 - RNA, 21 nt, Human
agugcagugaugcgaucucag

SEQ ID NO: 1327124 - RNA, 24 nt, Human
agugcagugaugcgaucucagcuc

SEQ ID NO: 1327125 - RNA, 21 nt, Human
augcagaaaguagacucagga

SEQ ID NO: 1327126 - RNA, 21 nt, Human
augcagccuaggaggacauua

SEQ ID NO: 1327127 - RNA, 22 nt, Human
caagcaauacuucugccucagc

SEQ ID NO: 1327128 - RNA, 20 nt, Human
cacacagagcaaacauguac

SEQ ID NO: 1327129 - RNA, 20 nt, Human
cacccccugccccaagugca

SEQ ID NO: 1327130 - RNA, 20 nt, Human
cacuguguuucuccaggcag

SEQ ID NO: 1327131 - RNA, 25 nt, Human
caggaagacacauagcagccagaga

SEQ ID NO: 1327132 - RNA, 21 nt, Human
cauaaggaaagaugggguaac

SEQ ID NO: 1327133 - RNA, 22 nt, Human
cauggccucucguagccuagcc

SEQ ID NO: 1327134 - RNA, 21 nt, Human
cauugcaaccucugccuccug

SEQ ID NO: 1327135 - RNA, 18 nt, Human
ccaacccuggcuccacac

SEQ ID NO: 1327136 - RNA, 18 nt, Human
ccaggggguccaccgagg

SEQ ID NO: 1327137 - RNA, 21 nt, Human
cccaagugcccuuccaaaugc

SEQ ID NO: 1327138 - RNA, 24 nt, Human
cccaagugcccuuccaaaugccag

SEQ ID NO: 1327139 - RNA, 18 nt, Human
cccacauguguguagaaa

SEQ ID NO: 1327140 - RNA, 18 nt, Human
cccacuggacugguuucc

SEQ ID NO: 1327141 - RNA, 19 nt, Human
ccccuaaagccugaaugag

SEQ ID NO: 1327142 - RNA, 19 nt, Human
ccucugccuccuggguuca

SEQ ID NO: 1327143 - RNA, 21 nt, Human
ccuggguucaagcaauacuuc

SEQ ID NO: 1327144 - RNA, 23 nt, Human
cucaagaugugaaaacaugaaga

SEQ ID NO: 1327145 - RNA, 24 nt, Human
cucagaacagagaagagaugagga

SEQ ID NO: 1327146 - RNA, 20 nt, Human
cucagccaccccucagacag

SEQ ID NO: 1327147 - RNA, 24 nt, Human
cucauugcaaccucugccuccugg

SEQ ID NO: 1327148 - RNA, 19 nt, Human
cucuguugcccaggcuuga

SEQ ID NO: 1327149 - RNA, 21 nt, Human
cugugcuaacaaauugcaucu

SEQ ID NO: 1327150 - RNA, 21 nt, Human
cuucugccucagccaccccuc

SEQ ID NO: 1327151 - RNA, 20 nt, Human
gaauuucccaagugcccuuc

SEQ ID NO: 1327152 - RNA, 19 nt, Human
gagcuuggucucccucaca

SEQ ID NO: 1327153 - RNA, 20 nt, Human
gaucagagagcucagaacag

SEQ ID NO: 1327154 - RNA, 22 nt, Human
gcaaccucugccuccuggguuc

SEQ ID NO: 1327155 - RNA, 28 nt, Human
gcccuugguggugagcuugaccuacugg

SEQ ID NO: 1327156 - RNA, 19 nt, Human
gguaaccccuaaagccuga

SEQ ID NO: 1327157 - RNA, 22 nt, Human
guugugcagccccaacccuggc

SEQ ID NO: 1327158 - RNA, 20 nt, Human
uaaaugaaagcaaucuggca

SEQ ID NO: 1327159 - RNA, 24 nt, Human
uacacacauaaggaaagauggggu

SEQ ID NO: 1327160 - RNA, 22 nt, Human
uauauuugccaagggcaggcac

SEQ ID NO: 1327161 - RNA, 20 nt, Human
ucagaacagagaagagauga

SEQ ID NO: 1327162 - RNA, 23 nt, Human
ucaucaugucauugaauuaccuc

SEQ ID NO: 1327163 - RNA, 24 nt, Human
ucauugcaaccucugccuccuggg

SEQ ID NO: 1327164 - RNA, 25 nt, Human
ucauugcaaccucugccuccugggu

SEQ ID NO: 1327165 - RNA, 23 nt, Human
uccaaccaaggagauuucaagcg

SEQ ID NO: 1327166 - RNA, 18 nt, Human
uccacacagagcaaacau

SEQ ID NO: 1327167 - RNA, 20 nt, Human
uccacacagagcaaacaugu

SEQ ID NO: 1327168 - RNA, 20 nt, Human
uccaggagcuguuuuucaga

SEQ ID NO: 1327169 - RNA, 25 nt, Human
ucccaagugcccuuccaaaugccag

SEQ ID NO: 1327170 - RNA, 21 nt, Human
ucccucacaggcaaugacagu

SEQ ID NO: 1327171 - RNA, 27 nt, Human
ucccucacaggcaaugacagucuuggc

SEQ ID NO: 1327172 - RNA, 21 nt, Human
uccuggguucaagcaauacuu

SEQ ID NO: 1327173 - RNA, 24 nt, Human
uccuggguucaagcaauacuucug

SEQ ID NO: 1327174 - RNA, 23 nt, Human
ucuccaggcaggcgguaaggccu

SEQ ID NO: 1327175 - RNA, 21 nt, Human
ucucguagccuagccuagagc

SEQ ID NO: 1327176 - RNA, 22 nt, Human
ucugccucagccaccccucaga

SEQ ID NO: 1327177 - RNA, 24 nt, Human
ucugccucagccaccccucagaca

SEQ ID NO: 1327178 - RNA, 22 nt, Human
ucugcuucauugauaaaacauc

SEQ ID NO: 1327179 - RNA, 24 nt, Human
ucuguugcccaggcuugagugcag

SEQ ID NO: 1327180 - RNA, 19 nt, Human
ucuugcucuguugcccagg

SEQ ID NO: 1327181 - RNA, 23 nt, Human
ucuugcucuguugcccaggcuug

SEQ ID NO: 1327182 - RNA, 24 nt, Human
ucuugcucuguugcccaggcuuga

SEQ ID NO: 1327183 - RNA, 25 nt, Human
ucuugcucuguugcccaggcuugag

SEQ ID NO: 1327184 - RNA, 21 nt, Human
ucuuggccaugggucuagaca

SEQ ID NO: 1327185 - RNA, 24 nt, Human
ugacaggguuuccaggaagacaca

SEQ ID NO: 1327186 - RNA, 20 nt, Human
ugcaaccucugccuccuggg

SEQ ID NO: 1327187 - RNA, 18 nt, Human
ugcacccccugccccaag

SEQ ID NO: 1327188 - RNA, 19 nt, Human
ugcacccccugccccaagu

SEQ ID NO: 1327189 - RNA, 19 nt, Human
ugccaagggcaggcacugu

SEQ ID NO: 1327190 - RNA, 24 nt, Human
ugcccaggcuugagugcagugaug

SEQ ID NO: 1327191 - RNA, 23 nt, Human
ugccucagccaccccucagacag

SEQ ID NO: 1327192 - RNA, 24 nt, Human
ugccucagccaccccucagacagc

SEQ ID NO: 1327193 - RNA, 24 nt, Human
ugcucuguugcccaggcuugagug

SEQ ID NO: 1327194 - RNA, 18 nt, Human
uggaaugacagccugugc

SEQ ID NO: 1327195 - RNA, 23 nt, Human
uggguucaagcaauacuucugcc

SEQ ID NO: 1327196 - RNA, 20 nt, Human
ugucuuggaaugacagccug

SEQ ID NO: 1327197 - RNA, 23 nt, Human
uguuuuguuuuuuugagacgcag

SEQ ID NO: 1327198 - RNA, 25 nt, Human
uucucugaauuucccaagugcccuu

SEQ ID NO: 1327199 - RNA, 18 nt, Human
uugacccuugaacaacaa

SEQ ID NO: 1327200 - RNA, 19 nt, Human
uugcaaccucugccuccug

SEQ ID NO: 1327201 - RNA, 23 nt, Human
uugcaaccucugccuccuggguu

SEQ ID NO: 1327202 - RNA, 24 nt, Human
uugcaaccucugccuccuggguuc

SEQ ID NO: 1327203 - RNA, 18 nt, Human
uugcccaggcuugagugc

SEQ ID NO: 1327204 - RNA, 21 nt, Human
uuucaaaacuuccagugaaaa

SEQ ID NO: 1327205 - RNA, 24 nt, Human
uuugaacugggcagguccacuugu

SEQ ID NO: 1327206 - RNA, 18 nt, Human
uuuguuuuguuuuguuuu

SEQ ID NO: 1327207 - RNA, 24 nt, Human
uuuucuggaagaaucuaacuaggg

SEQ ID NO: 1327208 - RNA, 20 nt, Human
aaaaauaaaaaugcuaaagg

SEQ ID NO: 1327209 - RNA, 21 nt, Human
aacauuaaaaaagcauggcag

SEQ ID NO: 1327210 - RNA, 23 nt, Human
aagaacaucagggaaagaccaac

SEQ ID NO: 1327211 - RNA, 20 nt, Human
aagaauggcacgcaggguuu

SEQ ID NO: 1327212 - RNA, 23 nt, Human
aagcuagaaaagguuuuccacag

SEQ ID NO: 1327213 - RNA, 24 nt, Human
aaugcuaaaggaugccagaaagaa

SEQ ID NO: 1327214 - RNA, 21 nt, Human
acaaaguaauaaacagugcuc

SEQ ID NO: 1327215 - RNA, 22 nt, Human
acacaccugccagagcaggccc

SEQ ID NO: 1327216 - RNA, 19 nt, Human
acucaugugauuaaaacag

SEQ ID NO: 1327217 - RNA, 20 nt, Human
acucccauccccaauacaca

SEQ ID NO: 1327218 - RNA, 21 nt, Human
acuuuccucuucugugagauu

SEQ ID NO: 1327219 - RNA, 24 nt, Human
aggcuguuuccaguucuuggccuu

SEQ ID NO: 1327220 - RNA, 23 nt, Human
aguucuuggccuuuaaacaacuc

SEQ ID NO: 1327221 - RNA, 20 nt, Human
aucaagaaaggguacaacug

SEQ ID NO: 1327222 - RNA, 22 nt, Human
augagcccagagcacauacaaa

SEQ ID NO: 1327223 - RNA, 19 nt, Human
caacugcugcagcucauga

SEQ ID NO: 1327224 - RNA, 22 nt, Human
caccagaacaaaugaaacacac

SEQ ID NO: 1327225 - RNA, 21 nt, Human
cauagugcagcgcucauucuu

SEQ ID NO: 1327226 - RNA, 18 nt, Human
caucagggaaagaccaac

SEQ ID NO: 1327227 - RNA, 19 nt, Human
cauuuuaucugaauucugg

SEQ ID NO: 1327228 - RNA, 21 nt, Human
ccagaaagaacaucagggaaa

SEQ ID NO: 1327229 - RNA, 19 nt, Human
ccagaacaaaugaaacaca

SEQ ID NO: 1327230 - RNA, 20 nt, Human
ccagaacaaaugaaacacac

SEQ ID NO: 1327231 - RNA, 18 nt, Human
ccagagcacauacaaauc

SEQ ID NO: 1327232 - RNA, 19 nt, Human
ccugcacacaccugccaga

SEQ ID NO: 1327233 - RNA, 24 nt, Human
cgauaugcauacuaaugaccuaca

SEQ ID NO: 1327234 - RNA, 18 nt, Human
cucccuguucucggcugc

SEQ ID NO: 1327235 - RNA, 18 nt, Human
cugcacacaccugccaga

SEQ ID NO: 1327236 - RNA, 19 nt, Human
gagcacauacaaauccuaa

SEQ ID NO: 1327237 - RNA, 19 nt, Human
gagcccagagcacauacaa

SEQ ID NO: 1327238 - RNA, 21 nt, Human
guaauagcagaacauaagcac

SEQ ID NO: 1327239 - RNA, 20 nt, Human
gugcagcgcucauucuuggc

SEQ ID NO: 1327240 - RNA, 24 nt, Human
uaaauuagaaacacaaauaaaagu

SEQ ID NO: 1327241 - RNA, 25 nt, Human
uaaauuagaaacacaaauaaaagug

SEQ ID NO: 1327242 - RNA, 27 nt, Human
uaagcuagaaaagguuuuccacaucca

SEQ ID NO: 1327243 - RNA, 19 nt, Human
uacaaaguaauaaacagug

SEQ ID NO: 1327244 - RNA, 19 nt, Human
uagaagaauggcacgcagg

SEQ ID NO: 1327245 - RNA, 20 nt, Human
ucaucaagaaaggguacaac

SEQ ID NO: 1327246 - RNA, 19 nt, Human
ucccuuaacuuuuuacaaa

SEQ ID NO: 1327247 - RNA, 20 nt, Human
ucugaauucuggaaugaaua

SEQ ID NO: 1327248 - RNA, 21 nt, Human
ugaagagcucacugugguuag

SEQ ID NO: 1327249 - RNA, 24 nt, Human
ugaauauacaugcugcaauaacau

SEQ ID NO: 1327250 - RNA, 20 nt, Human
ugccugguagaagaauggca

SEQ ID NO: 1327251 - RNA, 22 nt, Human
uggaaugaauauacaugcugca

SEQ ID NO: 1327252 - RNA, 18 nt, Human
uggcaccagaacaaauga

SEQ ID NO: 1327253 - RNA, 21 nt, Human
uggcaccagaacaaaugaaac

SEQ ID NO: 1327254 - RNA, 18 nt, Human
uggccuuuaaacaacucu

SEQ ID NO: 1327255 - RNA, 19 nt, Human
ugggagccuuucauuccuc

SEQ ID NO: 1327256 - RNA, 22 nt, Human
uuggccuuuaaacaacucuaaa

SEQ ID NO: 1327257 - RNA, 21 nt, Human
accucccgggaaggcaggagc

SEQ ID NO: 1327258 - RNA, 18 nt, Human
agccuggaaggcugggcu

SEQ ID NO: 1327259 - RNA, 22 nt, Human
aggcaggagccggucuccaugg

SEQ ID NO: 1327260 - RNA, 22 nt, Human
aggcugggcuguuccucgccuc

SEQ ID NO: 1327261 - RNA, 22 nt, Human
cagcagccacccagugucaggc

SEQ ID NO: 1327262 - RNA, 24 nt, Human
caggagccggucuccauggccucu

SEQ ID NO: 1327263 - RNA, 19 nt, Human
cccgggaaggcaggagccg

SEQ ID NO: 1327264 - RNA, 22 nt, Human
cccugcagccgcgcccggcgcc

SEQ ID NO: 1327265 - RNA, 20 nt, Human
ccggcccugccagccccgug

SEQ ID NO: 1327266 - RNA, 20 nt, Human
cucccagcagcaccucagga

SEQ ID NO: 1327267 - RNA, 22 nt, Human
cucucccggcccugccagcccc

SEQ ID NO: 1327268 - RNA, 20 nt, Human
cucuuuagccaaccucccgg

SEQ ID NO: 1327269 - RNA, 20 nt, Human
gccccguggggccuccccgc

SEQ ID NO: 1327270 - RNA, 21 nt, Human
uccauggccucucccggcccu

SEQ ID NO: 1327271 - RNA, 18 nt, Human
uccccgcccugcagccgc

SEQ ID NO: 1327272 - RNA, 24 nt, Human
ucccgggaaggcaggagccggucu

SEQ ID NO: 1327273 - RNA, 18 nt, Human
ugcagccgcgcccggcgc

SEQ ID NO: 1327274 - RNA, 24 nt, Human
ugccagccccguggggccuccccg

SEQ ID NO: 1327275 - RNA, 19 nt, Human
uggaaggcugggcuguucc

SEQ ID NO: 1327276 - RNA, 20 nt, Human
uggaaggcugggcuguuccu

SEQ ID NO: 1327277 - RNA, 21 nt, Human
uggaaggcugggcuguuccuc

SEQ ID NO: 1327278 - RNA, 24 nt, Human
aucacagcuaucuacgcuacagca

SEQ ID NO: 1327279 - RNA, 18 nt, Human
cagaaaguaaaaaugcug

SEQ ID NO: 1327280 - RNA, 19 nt, Human
ggcaggagcuugaagacac

SEQ ID NO: 1327281 - RNA, 20 nt, Human
guaaaaaugcuguuacaguu

SEQ ID NO: 1327282 - RNA, 25 nt, Human
uaaaaaugcuguuacagucccagug

SEQ ID NO: 1327283 - RNA, 22 nt, Human
uacagaaaguaaaaaugcuguu

SEQ ID NO: 1327284 - RNA, 20 nt, Human
uacagucccaguguaacugg

SEQ ID NO: 1327285 - RNA, 25 nt, Human
ucacacaaaaaccuaacaacgucac

SEQ ID NO: 1327286 - RNA, 22 nt, Human
ugaaguccguaagcuggggcag

SEQ ID NO: 1327287 - RNA, 24 nt, Human
uggggcaggagcuugaagacacuc

SEQ ID NO: 1327288 - RNA, 19 nt, Human
ugguugacucaccaaucac

SEQ ID NO: 1327289 - RNA, 19 nt, Human
uuuguuggggugaaguccg

SEQ ID NO: 1327290 - RNA, 20 nt, Human
uggauccuuccaccucaauu

SEQ ID NO: 1327291 - RNA, 22 nt, Human
acagcaagagacaugcccccag

SEQ ID NO: 1327292 - RNA, 24 nt, Human
acagcaagagacaugcccccagaa

SEQ ID NO: 1327293 - RNA, 22 nt, Human
accaaugccccaggacaggccc

SEQ ID NO: 1327294 - RNA, 18 nt, Human
accuugaauccaggacua

SEQ ID NO: 1327295 - RNA, 19 nt, Human
agaaugccaccaaugcccc

SEQ ID NO: 1327296 - RNA, 21 nt, Human
agaaugccaccaaugccccag

SEQ ID NO: 1327297 - RNA, 20 nt, Human
agagacaugcccccagaaug

SEQ ID NO: 1327298 - RNA, 22 nt, Human
agggauacugccauuuguuuuu

SEQ ID NO: 1327299 - RNA, 21 nt, Human
augccaccaaugccccaggac

SEQ ID NO: 1327300 - RNA, 20 nt, Human
cagaaugccaccaaugcccc

SEQ ID NO: 1327301 - RNA, 18 nt, Human
caugcccccagaaugcca

SEQ ID NO: 1327302 - RNA, 23 nt, Human
cauuuguuuuccuguuccuguuc

SEQ ID NO: 1327303 - RNA, 26 nt, Human
ccaccaaugccccaggacaggcccac

SEQ ID NO: 1327304 - RNA, 22 nt, Human
ccagcugauguuccacuuguuc

SEQ ID NO: 1327305 - RNA, 21 nt, Human
ccccagaaugccaccaaugcc

SEQ ID NO: 1327306 - RNA, 23 nt, Human
ccccagaaugccaccaaugcccc

SEQ ID NO: 1327307 - RNA, 20 nt, Human
cccuagguggcuggcaacca

SEQ ID NO: 1327308 - RNA, 19 nt, Human
cccuguggaaaccuguugc

SEQ ID NO: 1327309 - RNA, 22 nt, Human
ccuguggaaaccuguugcugaa

SEQ ID NO: 1327310 - RNA, 21 nt, Human
cuagcacccuuuuggcuuucu

SEQ ID NO: 1327311 - RNA, 22 nt, Human
cugccauuuguuuuccuguucc

SEQ ID NO: 1327312 - RNA, 21 nt, Human
cugcuggaacucuagggcugu

SEQ ID NO: 1327313 - RNA, 19 nt, Human
gacaugcccccagaaugcc

SEQ ID NO: 1327314 - RNA, 20 nt, Human
gaccagguuaucaggggccg

SEQ ID NO: 1327315 - RNA, 25 nt, Human
gaggcagagauggcacagcaagaga

SEQ ID NO: 1327316 - RNA, 18 nt, Human
gcccccagaaugccacca

SEQ ID NO: 1327317 - RNA, 23 nt, Human
ggcacagcaagagacaugccccc

SEQ ID NO: 1327318 - RNA, 22 nt, Human
gggaccagguuaucaggggccg

SEQ ID NO: 1327319 - RNA, 20 nt, Human
ggggaggcagagauggcaca

SEQ ID NO: 1327320 - RNA, 23 nt, Human
uagcagaugauguagggccuucc

SEQ ID NO: 1327321 - RNA, 19 nt, Human
uccuguuccuguucgcucc

SEQ ID NO: 1327322 - RNA, 25 nt, Human
ucuucuguuguuucagagauuugau

SEQ ID NO: 1327323 - RNA, 18 nt, Human
ugauguagggccuucccu

SEQ ID NO: 1327324 - RNA, 23 nt, Human
uggaacucuagggcuguuuuucu

SEQ ID NO: 1327325 - RNA, 23 nt, Human
uguucgcuccugcuggaacucua

SEQ ID NO: 1327326 - RNA, 18 nt, Human
uguuucuucuguuguuuc

SEQ ID NO: 1327327 - RNA, 19 nt, Human
uuguuguuugcuuucuuuu

SEQ ID NO: 1327328 - RNA, 20 nt, Human
uuuccuguuccuguucgcuc

SEQ ID NO: 1327329 - RNA, 22 nt, Human
uuucucagggauacugccauuu

SEQ ID NO: 1327330 - RNA, 19 nt, Human
aagcaagggguggugggga

SEQ ID NO: 1327331 - RNA, 21 nt, Human
aagcaaggggugguggggaga

SEQ ID NO: 1327332 - RNA, 18 nt, Human
aaggucuucccgaggccc

SEQ ID NO: 1327333 - RNA, 21 nt, Human
accggccccuucccuaucucc

SEQ ID NO: 1327334 - RNA, 25 nt, Human
agggaggguguggggugaccuucgg

SEQ ID NO: 1327335 - RNA, 23 nt, Human
aggggugguggggagauccuagg

SEQ ID NO: 1327336 - RNA, 24 nt, Human
aggggugguggggagauccuagga

SEQ ID NO: 1327337 - RNA, 23 nt, Human
caacuguaaucccagcacauugg

SEQ ID NO: 1327338 - RNA, 24 nt, Human
caacuguaaucccagcacauuggg

SEQ ID NO: 1327339 - RNA, 19 nt, Human
cagcagaacagccaagcuc

SEQ ID NO: 1327340 - RNA, 21 nt, Human
caggugcagcagaacagccaa

SEQ ID NO: 1327341 - RNA, 23 nt, Human
ccaccggccccuucccuaucucc

SEQ ID NO: 1327342 - RNA, 19 nt, Human
ccucccacauacuuggagg

SEQ ID NO: 1327343 - RNA, 22 nt, Human
cgcauuaaaaaaaaauccugag

SEQ ID NO: 1327344 - RNA, 24 nt, Human
cggcugcuggggggcagagggagg

SEQ ID NO: 1327345 - RNA, 21 nt, Human
cgucccgcccguccccuccca

SEQ ID NO: 1327346 - RNA, 20 nt, Human
cuauaugcuaagcauuaccc

SEQ ID NO: 1327347 - RNA, 19 nt, Human
cucgucccgcccguccccu

SEQ ID NO: 1327348 - RNA, 22 nt, Human
cuggggggcagagggagggugu

SEQ ID NO: 1327349 - RNA, 19 nt, Human
cugguuggggcaggaagca

SEQ ID NO: 1327350 - RNA, 21 nt, Human
gaaacccuuccccacuccuga

SEQ ID NO: 1327351 - RNA, 19 nt, Human
gaaggucuucccgaggccc

SEQ ID NO: 1327352 - RNA, 19 nt, Human
gaucauggaggagaaaccc

SEQ ID NO: 1327353 - RNA, 20 nt, Human
gccaggacagcuccagguuc

SEQ ID NO: 1327354 - RNA, 23 nt, Human
ggaaaggaaggcacacagggaua

SEQ ID NO: 1327355 - RNA, 18 nt, Human
gggaggguguggggugag

SEQ ID NO: 1327356 - RNA, 22 nt, Human
gggcagagggaggguguggggu

SEQ ID NO: 1327357 - RNA, 24 nt, Human
gguagcugacaacuguaaucccag

SEQ ID NO: 1327358 - RNA, 18 nt, Human
guccagaagcugcauccg

SEQ ID NO: 1327359 - RNA, 22 nt, Human
uagcugacaacuguaaucccag

SEQ ID NO: 1327360 - RNA, 24 nt, Human
uagcugacaacuguaaucccagca

SEQ ID NO: 1327361 - RNA, 18 nt, Human
uaggauaacagaaagcau

SEQ ID NO: 1327362 - RNA, 23 nt, Human
ucaggugcagcagaacagccaag

SEQ ID NO: 1327363 - RNA, 19 nt, Human
uccaaauggucagggagcu

SEQ ID NO: 1327364 - RNA, 18 nt, Human
ucccgcccguccccuccc

SEQ ID NO: 1327365 - RNA, 19 nt, Human
ugccaggacagcuccaggu

SEQ ID NO: 1327366 - RNA, 18 nt, Human
uggggcaggaagcaaggg

SEQ ID NO: 1327367 - RNA, 21 nt, Human
uggggggcagagggagggugu

SEQ ID NO: 1327368 - RNA, 24 nt, Human
ugguugagggucaagaggugggaa

SEQ ID NO: 1327369 - RNA, 24 nt, Human
uuucuguuccugauuuguaggugg

SEQ ID NO: 1327370 - RNA, 22 nt, Human
aaagaaacagacuuuccagguc

SEQ ID NO: 1327371 - RNA, 19 nt, Human
aaaggcaagugugccucag

SEQ ID NO: 1327372 - RNA, 22 nt, Human
aaggaaaaagaaagaaagaaaa

SEQ ID NO: 1327373 - RNA, 20 nt, Human
acagcagagugaguagauac

SEQ ID NO: 1327374 - RNA, 18 nt, Human
agaaagaaaauaaaucuu

SEQ ID NO: 1327375 - RNA, 21 nt, Human
aggaaaaagaaagaaagaaaa

SEQ ID NO: 1327376 - RNA, 21 nt, Human
auauuuuccugauauucuuau

SEQ ID NO: 1327377 - RNA, 19 nt, Human
caaagaaacagacuuucca

SEQ ID NO: 1327378 - RNA, 22 nt, Human
caaagaaacagacuuuccaggu

SEQ ID NO: 1327379 - RNA, 24 nt, Human
caaagaaacagacuuuccagguca

SEQ ID NO: 1327380 - RNA, 22 nt, Human
cuauagcuuuggaauucaguag

SEQ ID NO: 1327381 - RNA, 20 nt, Human
gacuagcaaagaaacagacu

SEQ ID NO: 1327382 - RNA, 18 nt, Human
gaugaaggaaaaagaaag

SEQ ID NO: 1327383 - RNA, 23 nt, Human
gggaagcaagugcuguuggcuca

SEQ ID NO: 1327384 - RNA, 20 nt, Human
guccaaccuggcauugucuu

SEQ ID NO: 1327385 - RNA, 18 nt, Human
uacacaaucccgcaugca

SEQ ID NO: 1327386 - RNA, 19 nt, Human
ucauaggcucucuacaggg

SEQ ID NO: 1327387 - RNA, 26 nt, Human
ucuuuuauuccacagcaauaguuuca

SEQ ID NO: 1327388 - RNA, 20 nt, Human
ugaaggaaaaagaaagaaag

SEQ ID NO: 1327389 - RNA, 24 nt, Human
ugaucuagaugaaggaaaaagaaa

SEQ ID NO: 1327390 - RNA, 18 nt, Human
uucaucuuuuauuccaca

SEQ ID NO: 1327391 - RNA, 20 nt, Human
uucaucuuuuauuccacagc

SEQ ID NO: 1327392 - RNA, 25 nt, Human
uuucagggggucugccuacagcaga

SEQ ID NO: 1327393 - RNA, 21 nt, Human
aaaaaagaaguggacucagaa

SEQ ID NO: 1327394 - RNA, 21 nt, Human
aaacauuuuaaagcaaugguu

SEQ ID NO: 1327395 - RNA, 20 nt, Human
aaaugauuucccagaaaggc

SEQ ID NO: 1327396 - RNA, 23 nt, Human
aacagauccccucccccaacccc

SEQ ID NO: 1327397 - RNA, 25 nt, Human
aaccccuaaaaaaauucuauauccu

SEQ ID NO: 1327398 - RNA, 18 nt, Human
aagaauaauugagauagg

SEQ ID NO: 1327399 - RNA, 19 nt, Human
aagauuacaaaauaaggca

SEQ ID NO: 1327400 - RNA, 19 nt, Human
aagcaaguaaacuacccag

SEQ ID NO: 1327401 - RNA, 19 nt, Human
aagcaucacuuaauucaua

SEQ ID NO: 1327402 - RNA, 22 nt, Human
aagcugcagcauguguauaagg

SEQ ID NO: 1327403 - RNA, 22 nt, Human
aagcuguuucuaucacccauag

SEQ ID NO: 1327404 - RNA, 24 nt, Human
acaagcuucaucccaagauguucc

SEQ ID NO: 1327405 - RNA, 23 nt, Human
acaagguaagaauaugaaucaac

SEQ ID NO: 1327406 - RNA, 21 nt, Human
acagaacuccuaccacaaagg

SEQ ID NO: 1327407 - RNA, 23 nt, Human
acagaaggcaaucuuuaccaaaa

SEQ ID NO: 1327408 - RNA, 21 nt, Human
acagacauuuuuuaguaacuc

SEQ ID NO: 1327409 - RNA, 21 nt, Human
acgucaugaaaguaacaggcu

SEQ ID NO: 1327410 - RNA, 19 nt, Human
agaaauauuuauuaucccc

SEQ ID NO: 1327411 - RNA, 20 nt, Human
agacagaaugcaaaucuaua

SEQ ID NO: 1327412 - RNA, 20 nt, Human
agauccccucccccaacccc

SEQ ID NO: 1327413 - RNA, 22 nt, Human
aggaaaaaagaaguggacucag

SEQ ID NO: 1327414 - RNA, 24 nt, Human
auacuaacauaguucugguuacac

SEQ ID NO: 1327415 - RNA, 23 nt, Human
aucauaaacaaguaaaaugcacc

SEQ ID NO: 1327416 - RNA, 23 nt, Human
caaaaggcaaaaauuaagaauca

SEQ ID NO: 1327417 - RNA, 19 nt, Human
caaccuuucucagcacaag

SEQ ID NO: 1327418 - RNA, 21 nt, Human
caacuaguacccugaaccaaa

SEQ ID NO: 1327419 - RNA, 22 nt, Human
caacuaguacccugaaccaaag

SEQ ID NO: 1327420 - RNA, 22 nt, Human
caagacagaaugcaaaucuaua

SEQ ID NO: 1327421 - RNA, 20 nt, Human
cacacgcacgcacacacaca

SEQ ID NO: 1327422 - RNA, 21 nt, Human
cagauccccucccccaacccc

SEQ ID NO: 1327423 - RNA, 19 nt, Human
cagcaaugcaaccuuucuc

SEQ ID NO: 1327424 - RNA, 22 nt, Human
caguaaaucaagucccaguagc

SEQ ID NO: 1327425 - RNA, 27 nt, Human
cauaaaauccucaacuuuggcuauuuc

SEQ ID NO: 1327426 - RNA, 19 nt, Human
cauagaagaaaacuaugca

SEQ ID NO: 1327427 - RNA, 18 nt, Human
ccagaucaaauagucuug

SEQ ID NO: 1327428 - RNA, 23 nt, Human
ccaguagcaacaaguuaaacaag

SEQ ID NO: 1327429 - RNA, 26 nt, Human
cccaagagguaaauaugcuuuacaga

SEQ ID NO: 1327430 - RNA, 18 nt, Human
cccaagauguucccccuu

SEQ ID NO: 1327431 - RNA, 21 nt, Human
cccccuuuuccccucagcuau

SEQ ID NO: 1327432 - RNA, 20 nt, Human
cuaucacccauagaagaaaa

SEQ ID NO: 1327433 - RNA, 23 nt, Human
cucacacgucaugaaaguaacag

SEQ ID NO: 1327434 - RNA, 23 nt, Human
gaaaugauuucccagaaaggcuu

SEQ ID NO: 1327435 - RNA, 18 nt, Human
gaacuccuaccacaaagg

SEQ ID NO: 1327436 - RNA, 19 nt, Human
gcugaagaguucucaaucc

SEQ ID NO: 1327437 - RNA, 19 nt, Human
gcugcagcauguguauaag

SEQ ID NO: 1327438 - RNA, 23 nt, Human
ggaaaacauacauaaaauccuca

SEQ ID NO: 1327439 - RNA, 18 nt, Human
guaaacaggaaaacauac

SEQ ID NO: 1327440 - RNA, 19 nt, Human
guaaguuuauaaccaauga

SEQ ID NO: 1327441 - RNA, 18 nt, Human
guuuuaaguuuccuguau

SEQ ID NO: 1327442 - RNA, 19 nt, Human
uaaaaagauaaugcuauca

SEQ ID NO: 1327443 - RNA, 22 nt, Human
uaaaauccucaacuuuggcuaa

SEQ ID NO: 1327444 - RNA, 21 nt, Human
uaaauaaacaaaaauagagca

SEQ ID NO: 1327445 - RNA, 23 nt, Human
uaaggacaagcuucaucccaaga

SEQ ID NO: 1327446 - RNA, 21 nt, Human
uaauaugguugguguggacug

SEQ ID NO: 1327447 - RNA, 22 nt, Human
uacacacgcacgcacacacaca

SEQ ID NO: 1327448 - RNA, 25 nt, Human
uaccaaaaaauccaauuaauugcua

SEQ ID NO: 1327449 - RNA, 18 nt, Human
uaccagaucaaauagucu

SEQ ID NO: 1327450 - RNA, 18 nt, Human
uagcugagcugcuacacc

SEQ ID NO: 1327451 - RNA, 22 nt, Human
uagcugagcugcuacaccuugc

SEQ ID NO: 1327452 - RNA, 18 nt, Human
uauacagaaggcaaucuu

SEQ ID NO: 1327453 - RNA, 21 nt, Human
uauaucccauaagaguuauac

SEQ ID NO: 1327454 - RNA, 23 nt, Human
uauccccuccccccacauacaga

SEQ ID NO: 1327455 - RNA, 24 nt, Human
ucaacagaacuccuaccacaaagg

SEQ ID NO: 1327456 - RNA, 19 nt, Human
ucaacagugucccaccaac

SEQ ID NO: 1327457 - RNA, 18 nt, Human
ucaagcugcagcaugugu

SEQ ID NO: 1327458 - RNA, 25 nt, Human
ucagcaaacuuuauauuggaaaaga

SEQ ID NO: 1327459 - RNA, 21 nt, Human
ucaguguaacuucuccaguuu

SEQ ID NO: 1327460 - RNA, 21 nt, Human
uccaaacauuauacagaaggc

SEQ ID NO: 1327461 - RNA, 23 nt, Human
uccacauaugguauacacauaua

SEQ ID NO: 1327462 - RNA, 25 nt, Human
ucccccuuuuccccucagcuauuuc

SEQ ID NO: 1327463 - RNA, 20 nt, Human
uccgcaagcaaguaaacuac

SEQ ID NO: 1327464 - RNA, 19 nt, Human
uccuaaaucccgaagucuc

SEQ ID NO: 1327465 - RNA, 24 nt, Human
ucuaagccuguaggucacacacua

SEQ ID NO: 1327466 - RNA, 21 nt, Human
ucuccaauuaccagaucaaau

SEQ ID NO: 1327467 - RNA, 23 nt, Human
ucuuuguuguacccauaaacuuu

SEQ ID NO: 1327468 - RNA, 18 nt, Human
ugaagauauuauccaugu

SEQ ID NO: 1327469 - RNA, 18 nt, Human
ugagguggggcauugggg

SEQ ID NO: 1327470 - RNA, 20 nt, Human
ugaguguaaaucauccacac

SEQ ID NO: 1327471 - RNA, 20 nt, Human
ugauaaaguucuucacaguu

SEQ ID NO: 1327472 - RNA, 23 nt, Human
ugcacaguaauaaaucuagcuga

SEQ ID NO: 1327473 - RNA, 20 nt, Human
ugccaaagaugaacucuaaa

SEQ ID NO: 1327474 - RNA, 22 nt, Human
ugcugguuuaauuuuagaauca

SEQ ID NO: 1327475 - RNA, 18 nt, Human
uggauaaaaugucuuuga

SEQ ID NO: 1327476 - RNA, 22 nt, Human
ugguauacacauauaaauaugc

SEQ ID NO: 1327477 - RNA, 21 nt, Human
uguaauaacagaaauuuuacc

SEQ ID NO: 1327478 - RNA, 20 nt, Human
uguaauaggcugcugguuua

SEQ ID NO: 1327479 - RNA, 22 nt, Human
uguacccauaaacuuugaauac

SEQ ID NO: 1327480 - RNA, 20 nt, Human
ugugcuuguaauaggcugcu

SEQ ID NO: 1327481 - RNA, 24 nt, Human
ugugguaguaauaagauuuccauc

SEQ ID NO: 1327482 - RNA, 23 nt, Human
uuacauaaaauaaaucaucucuu

SEQ ID NO: 1327483 - RNA, 19 nt, Human
uuacauagugccuaucucc

SEQ ID NO: 1327484 - RNA, 18 nt, Human
uuagaaauaagaaaagaa

SEQ ID NO: 1327485 - RNA, 30 nt, Human
uucaaaaagcuguuucuaucacccauagaa

SEQ ID NO: 1327486 - RNA, 20 nt, Human
uucacaaaaacuauacugua

SEQ ID NO: 1327487 - RNA, 20 nt, Human
uucccagaaaggcuuagaaa

SEQ ID NO: 1327488 - RNA, 21 nt, Human
uuucauuuuuccauguuaguu

SEQ ID NO: 1327489 - RNA, 21 nt, Human
uuugccaaagaugaacucuaa

SEQ ID NO: 1327490 - RNA, 22 nt, Human
ucuuuggacagcaaggacucgg

SEQ ID NO: 1327491 - RNA, 20 nt, Human
uugaaagagaggcuagaagu

SEQ ID NO: 1327492 - RNA, 20 nt, Human
aggcggagguugcagugagc

SEQ ID NO: 1327493 - RNA, 24 nt, Human
aggcggagguugcagugagccaag

SEQ ID NO: 1327494 - RNA, 25 nt, Human
cccgugguuuaaggacuuucaagac

SEQ ID NO: 1327495 - RNA, 18 nt, Human
gagguugcagugagccaa

SEQ ID NO: 1327496 - RNA, 21 nt, Human
gagguugcagugagccaagau

SEQ ID NO: 1327497 - RNA, 18 nt, Human
ggagguugcagugagcca

SEQ ID NO: 1327498 - RNA, 20 nt, Human
ggagguugcagugagccaag

SEQ ID NO: 1327499 - RNA, 24 nt, Human
ggagguugcagugagccaagaugg

SEQ ID NO: 1327500 - RNA, 20 nt, Human
uucaagacucuuaacagguu

SEQ ID NO: 1327501 - RNA, 22 nt, Human
uugcagugagccaagauggugc

SEQ ID NO: 1327502 - RNA, 18 nt, Human
uuuaaggacuuucaagac

SEQ ID NO: 1327503 - RNA, 18 nt, Human
agguucccucauccacuu

SEQ ID NO: 1327504 - RNA, 24 nt, Human
caauggcuaugguuccugaaauuu

SEQ ID NO: 1327505 - RNA, 22 nt, Human
cccucauccacuucaauggcua

SEQ ID NO: 1327506 - RNA, 26 nt, Human
cucccauacgauagugggcagacccc

SEQ ID NO: 1327507 - RNA, 20 nt, Human
cuggaggacuagggcccuca

SEQ ID NO: 1327508 - RNA, 20 nt, Human
guagguguaauccucgcccc

SEQ ID NO: 1327509 - RNA, 27 nt, Human
uagaaagaaaagaaaaaaaaucccacu

SEQ ID NO: 1327510 - RNA, 24 nt, Human
ucaccaaaguuuguuacuguucac

SEQ ID NO: 1327511 - RNA, 21 nt, Human
ucugaagccuucucucagcuc

SEQ ID NO: 1327512 - RNA, 18 nt, Human
ucuggaggacuagggccc

SEQ ID NO: 1327513 - RNA, 20 nt, Human
ucuggaggacuagggcccuc

SEQ ID NO: 1327514 - RNA, 18 nt, Human
ugagugcauguauauagg

SEQ ID NO: 1327515 - RNA, 20 nt, Human
ugccuuugguuugaaugucc

SEQ ID NO: 1327516 - RNA, 24 nt, Human
uguggagcucccaggguaaaaaga

SEQ ID NO: 1327517 - RNA, 23 nt, Human
uuugccuuugguuugaauguccu

SEQ ID NO: 1327518 - RNA, 24 nt, Human
aaccugaccaaucagcacucccaa

SEQ ID NO: 1327519 - RNA, 20 nt, Human
aacuucccaaguccuuaccc

SEQ ID NO: 1327520 - RNA, 20 nt, Human
aauaagcuacuggcuguuaa

SEQ ID NO: 1327521 - RNA, 18 nt, Human
agaaaaccucacugcaac

SEQ ID NO: 1327522 - RNA, 23 nt, Human
agacagggccugagugaaaagga

SEQ ID NO: 1327523 - RNA, 21 nt, Human
aggccccugaguccucuccua

SEQ ID NO: 1327524 - RNA, 18 nt, Human
agucaggccccugagucc

SEQ ID NO: 1327525 - RNA, 20 nt, Human
augaagaaaaccucacugca

SEQ ID NO: 1327526 - RNA, 21 nt, Human
caggccccugaguccucuccu

SEQ ID NO: 1327527 - RNA, 24 nt, Human
caguucugccaucgcagccgggaa

SEQ ID NO: 1327528 - RNA, 19 nt, Human
caguugacaccaccuaggc

SEQ ID NO: 1327529 - RNA, 28 nt, Human
ccaucugugcacuuccuuuuaaaauccc

SEQ ID NO: 1327530 - RNA, 24 nt, Human
cccaucugugcacuuccuuuuaaa

SEQ ID NO: 1327531 - RNA, 20 nt, Human
ccccugaguccucuccuagg

SEQ ID NO: 1327532 - RNA, 22 nt, Human
cccugaguccucuccuaggccc

SEQ ID NO: 1327533 - RNA, 20 nt, Human
cgcagccgggaacagaagac

SEQ ID NO: 1327534 - RNA, 21 nt, Human
gagugggaaagauucugugcu

SEQ ID NO: 1327535 - RNA, 18 nt, Human
gcugguauucuggcucaa

SEQ ID NO: 1327536 - RNA, 19 nt, Human
uaaaaccucagagcacuac

SEQ ID NO: 1327537 - RNA, 19 nt, Human
uaaaaucccauagcugcag

SEQ ID NO: 1327538 - RNA, 21 nt, Human
uaaaaucccauagcugcaguc

SEQ ID NO: 1327539 - RNA, 22 nt, Human
uaaaaucccauagcugcagucc

SEQ ID NO: 1327540 - RNA, 23 nt, Human
uaaaaucccauagcugcaguccc

SEQ ID NO: 1327541 - RNA, 20 nt, Human
uaaugagagacagggccuga

SEQ ID NO: 1327542 - RNA, 24 nt, Human
uacuggcuguuaaugagagacagg

SEQ ID NO: 1327543 - RNA, 21 nt, Human
uaggcugguauucuggcucaa

SEQ ID NO: 1327544 - RNA, 19 nt, Human
uauuguaaaaccucagagc

SEQ ID NO: 1327545 - RNA, 21 nt, Human
ucagcacucccaacuucccaa

SEQ ID NO: 1327546 - RNA, 22 nt, Human
ucccaaguccuuacccgccaaa

SEQ ID NO: 1327547 - RNA, 21 nt, Human
ucuccuaggcccaucugugca

SEQ ID NO: 1327548 - RNA, 22 nt, Human
ugaagaaaaccucacugcaacc

SEQ ID NO: 1327549 - RNA, 21 nt, Human
ugacuguaucuccaaccugac

SEQ ID NO: 1327550 - RNA, 18 nt, Human
ugagagacagggccugag

SEQ ID NO: 1327551 - RNA, 18 nt, Human
ugaguuguacaaaagguu

SEQ ID NO: 1327552 - RNA, 24 nt, Human
ugcaggcugcaucuaggaucacca

SEQ ID NO: 1327553 - RNA, 20 nt, Human
uuuaaaaucccauagcugca

SEQ ID NO: 1327554 - RNA, 22 nt, Human
uuuaaaaucccauagcugcagu

SEQ ID NO: 1327555 - RNA, 25 nt, Human
cccggaguugggacaaaccgggguc

SEQ ID NO: 1327556 - RNA, 19 nt, Human
ccuguccucgaggucggcc

SEQ ID NO: 1327557 - RNA, 20 nt, Human
cuggccccggaguugggaca

SEQ ID NO: 1327558 - RNA, 24 nt, Human
cucaggacuaggggaguccaaaaa

SEQ ID NO: 1327559 - RNA, 21 nt, Human
gagaggccaucauuauuagcc

SEQ ID NO: 1327560 - RNA, 22 nt, Human
ggacuaggggaguccaaaaauc

SEQ ID NO: 1327561 - RNA, 21 nt, Human
guccaaaaaucugagaggcca

SEQ ID NO: 1327562 - RNA, 22 nt, Human
uuagccaagcacacaggauaaa

SEQ ID NO: 1327563 - RNA, 18 nt, Human
aaagacugccagggcagc

SEQ ID NO: 1327564 - RNA, 24 nt, Human
aaaguguugggauuauaggcauga

SEQ ID NO: 1327565 - RNA, 23 nt, Human
aacuuagcagaaacccagggcuc

SEQ ID NO: 1327566 - RNA, 25 nt, Human
aagaagcccaagccaaggcacuucc

SEQ ID NO: 1327567 - RNA, 18 nt, Human
aagacugccagggcagcu

SEQ ID NO: 1327568 - RNA, 18 nt, Human
aagcaaggccaggagaca

SEQ ID NO: 1327569 - RNA, 25 nt, Human
aagcaauccuucugccucagccucc

SEQ ID NO: 1327570 - RNA, 18 nt, Human
aagcagcacccaccuuca

SEQ ID NO: 1327571 - RNA, 20 nt, Human
aagcagcacccaccuucagc

SEQ ID NO: 1327572 - RNA, 19 nt, Human
aagcagcuucuuucuucuu

SEQ ID NO: 1327573 - RNA, 22 nt, Human
aagcagcuucuuucuucuuuuu

SEQ ID NO: 1327574 - RNA, 24 nt, Human
aagcaggccagaucaggcuucaag

SEQ ID NO: 1327575 - RNA, 23 nt, Human
aaggugugguaugguagacaccu

SEQ ID NO: 1327576 - RNA, 21 nt, Human
aaguguugggauuauaggcau

SEQ ID NO: 1327577 - RNA, 22 nt, Human
aauuaaacaguucccuaggaga

SEQ ID NO: 1327578 - RNA, 23 nt, Human
acaaagagcagcgccuguaacuc

SEQ ID NO: 1327579 - RNA, 22 nt, Human
acccagaaaacacaagcagcuu

SEQ ID NO: 1327580 - RNA, 19 nt, Human
acccucuccaaucagggau

SEQ ID NO: 1327581 - RNA, 21 nt, Human
acgcaccaccacgccuggcuc

SEQ ID NO: 1327582 - RNA, 24 nt, Human
acuacaaccuauugagguaggcac

SEQ ID NO: 1327583 - RNA, 24 nt, Human
acuauguugcccaggcuggucuug

SEQ ID NO: 1327584 - RNA, 25 nt, Human
acuauguugcccaggcuggucuuga

SEQ ID NO: 1327585 - RNA, 24 nt, Human
agaaacccagggcucucccacccu

SEQ ID NO: 1327586 - RNA, 20 nt, Human
agaaugaccacugacauuaa

SEQ ID NO: 1327587 - RNA, 23 nt, Human
agacagggucucacuauguugcc

SEQ ID NO: 1327588 - RNA, 18 nt, Human
agacuauaggcacgcacc

SEQ ID NO: 1327589 - RNA, 23 nt, Human
agcaggugguugguuccagagau

SEQ ID NO: 1327590 - RNA, 21 nt, Human
agccaucccuaguacaggacc

SEQ ID NO: 1327591 - RNA, 23 nt, Human
agccugaggcggggcccgaucgc

SEQ ID NO: 1327592 - RNA, 19 nt, Human
aggaaggugggcaaggcuc

SEQ ID NO: 1327593 - RNA, 25 nt, Human
aggcaaaaaagcaacacuaaaagca

SEQ ID NO: 1327594 - RNA, 22 nt, Human
aggcaagaagaaugaccuugau

SEQ ID NO: 1327595 - RNA, 20 nt, Human
aggcaugagccaccacgccc

SEQ ID NO: 1327596 - RNA, 19 nt, Human
aggccccaaggagacccaa

SEQ ID NO: 1327597 - RNA, 18 nt, Human
aggcggggcccgaucgcg

SEQ ID NO: 1327598 - RNA, 22 nt, Human
aggggcgggagcgaaaccugcc

SEQ ID NO: 1327599 - RNA, 24 nt, Human
aguaaugcugcuuguggguugcuu

SEQ ID NO: 1327600 - RNA, 27 nt, Human
auaauucuugacaccuacuuuucucug

SEQ ID NO: 1327601 - RNA, 22 nt, Human
aucagaugccaagguaaacacc

SEQ ID NO: 1327602 - RNA, 23 nt, Human
aucagccggccucagccucccaa

SEQ ID NO: 1327603 - RNA, 21 nt, Human
auccuucugccucagccuccc

SEQ ID NO: 1327604 - RNA, 19 nt, Human
augacacuuucucucuucc

SEQ ID NO: 1327605 - RNA, 20 nt, Human
augauucuuguggccacaaa

SEQ ID NO: 1327606 - RNA, 24 nt, Human
augcacacaugugcacacacaccu

SEQ ID NO: 1327607 - RNA, 18 nt, Human
auggagcgcuuucugugu

SEQ ID NO: 1327608 - RNA, 20 nt, Human
auugcaaguugcucucagca

SEQ ID NO: 1327609 - RNA, 23 nt, Human
auuuuuaaaccauucuaaaggca

SEQ ID NO: 1327610 - RNA, 21 nt, Human
caaaaaagcaacacuaaaagc

SEQ ID NO: 1327611 - RNA, 18 nt, Human
caacacuaaaagcaggcc

SEQ ID NO: 1327612 - RNA, 19 nt, Human
caagaagcccaagccaagg

SEQ ID NO: 1327613 - RNA, 19 nt, Human
caagagcccugacaccacc

SEQ ID NO: 1327614 - RNA, 22 nt, Human
caagcaauccuucugccucagc

SEQ ID NO: 1327615 - RNA, 23 nt, Human
caaggcccaggugcccaaacacc

SEQ ID NO: 1327616 - RNA, 19 nt, Human
caaguuggugaccccugac

SEQ ID NO: 1327617 - RNA, 20 nt, Human
caauccugcugcggcuucug

SEQ ID NO: 1327618 - RNA, 18 nt, Human
cacaugugcacacacacc

SEQ ID NO: 1327619 - RNA, 22 nt, Human
caccaccacgccuggcucauuu

SEQ ID NO: 1327620 - RNA, 19 nt, Human
caccacgccuggcucauuu

SEQ ID NO: 1327621 - RNA, 25 nt, Human
cacgcaggucaugaggauguguaau

SEQ ID NO: 1327622 - RNA, 19 nt, Human
cacuauguugcccaggcug

SEQ ID NO: 1327623 - RNA, 24 nt, Human
cacuauguugcccaggcuggucuu

SEQ ID NO: 1327624 - RNA, 27 nt, Human
cacuauguugcccaggcuggucuugaa

SEQ ID NO: 1327625 - RNA, 22 nt, Human
cacucagaauacacucccucag

SEQ ID NO: 1327626 - RNA, 18 nt, Human
cagaaugaccacugacau

SEQ ID NO: 1327627 - RNA, 19 nt, Human
cagacaccccaacuugggc

SEQ ID NO: 1327628 - RNA, 20 nt, Human
cagagaugagccccaacucu

SEQ ID NO: 1327629 - RNA, 22 nt, Human
cagagcaagagguggacagaga

SEQ ID NO: 1327630 - RNA, 21 nt, Human
cagccauaucugaagcagcac

SEQ ID NO: 1327631 - RNA, 19 nt, Human
caggacccagggaauuugc

SEQ ID NO: 1327632 - RNA, 22 nt, Human
caggagacaaggguaccagcca

SEQ ID NO: 1327633 - RNA, 24 nt, Human
cagggucucacuauguugcccagg

SEQ ID NO: 1327634 - RNA, 24 nt, Human
cagggucuugcuuugucacccagg

SEQ ID NO: 1327635 - RNA, 20 nt, Human
caguccggggccgcgugcag

SEQ ID NO: 1327636 - RNA, 21 nt, Human
cauggucccaggcccugcagu

SEQ ID NO: 1327637 - RNA, 21 nt, Human
ccaaacaccaacaguaaugcu

SEQ ID NO: 1327638 - RNA, 24 nt, Human
ccaaacaccaacaguaaugcugcu

SEQ ID NO: 1327639 - RNA, 24 nt, Human
ccaaaguguugggauuauaggcau

SEQ ID NO: 1327640 - RNA, 21 nt, Human
ccacauccaggggugcagagg

SEQ ID NO: 1327641 - RNA, 21 nt, Human
ccagaucaggcuucaaguugg

SEQ ID NO: 1327642 - RNA, 24 nt, Human
ccagcccacauggucccaggcccu

SEQ ID NO: 1327643 - RNA, 24 nt, Human
ccagggcagacacagcagccucca

SEQ ID NO: 1327644 - RNA, 19 nt, Human
ccauacuucaaccucuggg

SEQ ID NO: 1327645 - RNA, 22 nt, Human
cccaagccaaggcacuuccagc

SEQ ID NO: 1327646 - RNA, 22 nt, Human
ccccaguacuccucgaggcacc

SEQ ID NO: 1327647 - RNA, 25 nt, Human
ccccauucugcuggugcucccaaaa

SEQ ID NO: 1327648 - RNA, 26 nt, Human
ccccauucugcuggugcucccaaaag

SEQ ID NO: 1327649 - RNA, 21 nt, Human
cccuccuggacuggccaguuc

SEQ ID NO: 1327650 - RNA, 21 nt, Human
ccucaggccccaaggagaccc

SEQ ID NO: 1327651 - RNA, 28 nt, Human
ccuccaagcaauccuucugccucagccu

SEQ ID NO: 1327652 - RNA, 26 nt, Human
ccugcaggccacaggcugaacaagcu

SEQ ID NO: 1327653 - RNA, 27 nt, Human
ccugcggccaggacagcuguggaaggc

SEQ ID NO: 1327654 - RNA, 18 nt, Human
ccuggcaacugugauugg

SEQ ID NO: 1327655 - RNA, 20 nt, Human
ccuuggguuugggguugagg

SEQ ID NO: 1327656 - RNA, 18 nt, Human
cgccuugaacacccugcg

SEQ ID NO: 1327657 - RNA, 23 nt, Human
cgggcggcccugaaacacugggc

SEQ ID NO: 1327658 - RNA, 20 nt, Human
cuagugaaaggaaggcuggg

SEQ ID NO: 1327659 - RNA, 19 nt, Human
cucaaacucuccauacuuc

SEQ ID NO: 1327660 - RNA, 23 nt, Human
cucaggccccaaggagacccaag

SEQ ID NO: 1327661 - RNA, 18 nt, Human
cuccaagcaauccuucug

SEQ ID NO: 1327662 - RNA, 24 nt, Human
cuccagcccacauggucccaggcc

SEQ ID NO: 1327663 - RNA, 18 nt, Human
cuccagugggguauacag

SEQ ID NO: 1327664 - RNA, 24 nt, Human
cuccagugggguauacagacagcc

SEQ ID NO: 1327665 - RNA, 21 nt, Human
cucccucauuucaucccacua

SEQ ID NO: 1327666 - RNA, 23 nt, Human
cucccucauuucaucccacuaca

SEQ ID NO: 1327667 - RNA, 22 nt, Human
cugaagcaagcccuccuggacu

SEQ ID NO: 1327668 - RNA, 19 nt, Human
cugccaagggaaauaccac

SEQ ID NO: 1327669 - RNA, 18 nt, Human
cuggagcaccaauggagg

SEQ ID NO: 1327670 - RNA, 24 nt, Human
cuggagcaccaauggaggucacca

SEQ ID NO: 1327671 - RNA, 19 nt, Human
cuggaucacggugauuggu

SEQ ID NO: 1327672 - RNA, 20 nt, Human
cugggaagugggcuggagcc

SEQ ID NO: 1327673 - RNA, 19 nt, Human
cugguuggagcaagugauc

SEQ ID NO: 1327674 - RNA, 21 nt, Human
cuuaagccaguuugggcuggu

SEQ ID NO: 1327675 - RNA, 18 nt, Human
cuuaggccaugcuggccu

SEQ ID NO: 1327676 - RNA, 19 nt, Human
cuucagccaucccuaguac

SEQ ID NO: 1327677 - RNA, 20 nt, Human
cuuggccuuggcuuggucuu

SEQ ID NO: 1327678 - RNA, 21 nt, Human
cuuggccuuggcuuggucuuc

SEQ ID NO: 1327679 - RNA, 18 nt, Human
cuuucucucuuccuuggg

SEQ ID NO: 1327680 - RNA, 22 nt, Human
gaaauucaaaagccaaaagcuu

SEQ ID NO: 1327681 - RNA, 18 nt, Human
gaacaagcuagcucuaaa

SEQ ID NO: 1327682 - RNA, 20 nt, Human
gaaggcugggguuugagucc

SEQ ID NO: 1327683 - RNA, 20 nt, Human
gaauuccagagagugcaggg

SEQ ID NO: 1327684 - RNA, 21 nt, Human
gacacuggaggcgagcgggcg

SEQ ID NO: 1327685 - RNA, 22 nt, Human
gacagggucuugcuuugucacc

SEQ ID NO: 1327686 - RNA, 24 nt, Human
gaccuccaagcaauccuucugccu

SEQ ID NO: 1327687 - RNA, 21 nt, Human
gaccuggcaaucgcucccccu

SEQ ID NO: 1327688 - RNA, 20 nt, Human
gagacagggucuugcuuugu

SEQ ID NO: 1327689 - RNA, 20 nt, Human
gagaucauggcucacuccag

SEQ ID NO: 1327690 - RNA, 23 nt, Human
gagcaagagguggacagagagga

SEQ ID NO: 1327691 - RNA, 24 nt, Human
gagcagcugagacuauaggcacgc

SEQ ID NO: 1327692 - RNA, 19 nt, Human
gaggaaacugaggcacaga

SEQ ID NO: 1327693 - RNA, 20 nt, Human
gaggucaccaggcaggggug

SEQ ID NO: 1327694 - RNA, 21 nt, Human
gauuauaggcaugagccacca

SEQ ID NO: 1327695 - RNA, 22 nt, Human
gauuauaggcaugagccaccac

SEQ ID NO: 1327696 - RNA, 24 nt, Human
gcaacacuaaaagcaggccagauc

SEQ ID NO: 1327697 - RNA, 20 nt, Human
gcagacacagcagccuccac

SEQ ID NO: 1327698 - RNA, 22 nt, Human
gcagagcaagagguggacagag

SEQ ID NO: 1327699 - RNA, 23 nt, Human
gcagagcaagagguggacagaga

SEQ ID NO: 1327700 - RNA, 18 nt, Human
gcaugugacucgagcugg

SEQ ID NO: 1327701 - RNA, 21 nt, Human
gcccacgggaaaccuccagga

SEQ ID NO: 1327702 - RNA, 23 nt, Human
gccccgcccacacaagcaguuuc

SEQ ID NO: 1327703 - RNA, 23 nt, Human
gccucagccucccaaaguguugg

SEQ ID NO: 1327704 - RNA, 20 nt, Human
gcggcccugaaacacugggc

SEQ ID NO: 1327705 - RNA, 24 nt, Human
ggaagugggcuggagccuuuggga

SEQ ID NO: 1327706 - RNA, 22 nt, Human
ggagcaccaauggaggucacca

SEQ ID NO: 1327707 - RNA, 22 nt, Human
ggaucucuagccuggugugucc

SEQ ID NO: 1327708 - RNA, 27 nt, Human
ggaugugcuguuccccacaaagagcag

SEQ ID NO: 1327709 - RNA, 19 nt, Human
ggauuauaggcaugagcca

SEQ ID NO: 1327710 - RNA, 19 nt, Human
ggcagacacagcagccucc

SEQ ID NO: 1327711 - RNA, 24 nt, Human
ggccaaucagagccuuccaugaga

SEQ ID NO: 1327712 - RNA, 22 nt, Human
ggcugggguuugaguccuggcc

SEQ ID NO: 1327713 - RNA, 24 nt, Human
ggcuggucuugaacuccugcacuc

SEQ ID NO: 1327714 - RNA, 18 nt, Human
gggagcugugcugaaagc

SEQ ID NO: 1327715 - RNA, 18 nt, Human
ggucaagguuacacagcu

SEQ ID NO: 1327716 - RNA, 22 nt, Human
ggucaggcuuaggccaugcugg

SEQ ID NO: 1327717 - RNA, 19 nt, Human
ggucuuccuuacacgaagc

SEQ ID NO: 1327718 - RNA, 23 nt, Human
ggugcaguugagaggccugagga

SEQ ID NO: 1327719 - RNA, 24 nt, Human
guagcagaugccaccauggauacc

SEQ ID NO: 1327720 - RNA, 20 nt, Human
guggguugcuucuguccugg

SEQ ID NO: 1327721 - RNA, 23 nt, Human
guguaaugugggcugggcgcaag

SEQ ID NO: 1327722 - RNA, 19 nt, Human
uaaauuuuacagcagggag

SEQ ID NO: 1327723 - RNA, 18 nt, Human
uaacugcucaccaagcac

SEQ ID NO: 1327724 - RNA, 23 nt, Human
uaagagaaaagcuagaaauucac

SEQ ID NO: 1327725 - RNA, 20 nt, Human
uaagcaaggccaggagacaa

SEQ ID NO: 1327726 - RNA, 19 nt, Human
uaagcuccuggauccagcc

SEQ ID NO: 1327727 - RNA, 23 nt, Human
uaaugcuuccacguggguccccg

SEQ ID NO: 1327728 - RNA, 20 nt, Human
uacaggggugagaucauggc

SEQ ID NO: 1327729 - RNA, 21 nt, Human
uacaggggugagaucauggcu

SEQ ID NO: 1327730 - RNA, 19 nt, Human
uacccagaaaacacaagca

SEQ ID NO: 1327731 - RNA, 18 nt, Human
uaccugaagcaagcccuc

SEQ ID NO: 1327732 - RNA, 24 nt, Human
uagacaccuuggccuuggcuuggu

SEQ ID NO: 1327733 - RNA, 22 nt, Human
uagagacagggucucacuaugu

SEQ ID NO: 1327734 - RNA, 19 nt, Human
uagagugugaauccugaaa

SEQ ID NO: 1327735 - RNA, 21 nt, Human
uagcagacuccccucccccca

SEQ ID NO: 1327736 - RNA, 18 nt, Human
uaggagagaaaggcaucu

SEQ ID NO: 1327737 - RNA, 22 nt, Human
uaggauaacaccuagucuuuaa

SEQ ID NO: 1327738 - RNA, 18 nt, Human
uaugguagacaccuuggc

SEQ ID NO: 1327739 - RNA, 24 nt, Human
uaugguagacaccuuggccuuggc

SEQ ID NO: 1327740 - RNA, 19 nt, Human
uauguugcccaggcugguc

SEQ ID NO: 1327741 - RNA, 23 nt, Human
uauguugcccaggcuggucuuga

SEQ ID NO: 1327742 - RNA, 24 nt, Human
uauguugcccaggcuggucuugaa

SEQ ID NO: 1327743 - RNA, 19 nt, Human
ucacugcaccucacugcaa

SEQ ID NO: 1327744 - RNA, 24 nt, Human
uccaagcaauccuucugccucagc

SEQ ID NO: 1327745 - RNA, 24 nt, Human
ucccaaaguguugggauuauaggc

SEQ ID NO: 1327746 - RNA, 23 nt, Human
ucccacuacaaccuauugaggua

SEQ ID NO: 1327747 - RNA, 22 nt, Human
uccguaaaaggcuucugugucc

SEQ ID NO: 1327748 - RNA, 18 nt, Human
uccugcugcggcuucugc

SEQ ID NO: 1327749 - RNA, 19 nt, Human
ucucacuauguugcccagg

SEQ ID NO: 1327750 - RNA, 23 nt, Human
ucucacuauguugcccaggcugg

SEQ ID NO: 1327751 - RNA, 24 nt, Human
ucucacuauguugcccaggcuggu

SEQ ID NO: 1327752 - RNA, 26 nt, Human
ucucacuauguugcccaggcuggucu

SEQ ID NO: 1327753 - RNA, 27 nt, Human
ucucacuauguugcccaggcuggucuu

SEQ ID NO: 1327754 - RNA, 20 nt, Human
ucuccagugugccuggcaac

SEQ ID NO: 1327755 - RNA, 20 nt, Human
ucucuguggcuuacaaccaa

SEQ ID NO: 1327756 - RNA, 24 nt, Human
ucugccucagccucccgagcagcu

SEQ ID NO: 1327757 - RNA, 20 nt, Human
ucuggaacaggcaguuccag

SEQ ID NO: 1327758 - RNA, 21 nt, Human
ucugugguccagcuucucuug

SEQ ID NO: 1327759 - RNA, 24 nt, Human
ucuguguucugggagcugugcuga

SEQ ID NO: 1327760 - RNA, 19 nt, Human
ucuugcuuugucacccagg

SEQ ID NO: 1327761 - RNA, 20 nt, Human
ucuugcuuugucacccagga

SEQ ID NO: 1327762 - RNA, 23 nt, Human
ucuugcuuugucacccaggauga

SEQ ID NO: 1327763 - RNA, 24 nt, Human
ucuugcuuugucacccaggaugaa

SEQ ID NO: 1327764 - RNA, 20 nt, Human
ugaaauuauaggcuuggggc

SEQ ID NO: 1327765 - RNA, 18 nt, Human
ugacacuuucucucuucc

SEQ ID NO: 1327766 - RNA, 21 nt, Human
ugaccccugacuggcugccuu

SEQ ID NO: 1327767 - RNA, 21 nt, Human
ugaccuccaagcaauccuucu

SEQ ID NO: 1327768 - RNA, 21 nt, Human
ugagacuauaggcacgcacca

SEQ ID NO: 1327769 - RNA, 24 nt, Human
ugagacuauaggcacgcaccacca

SEQ ID NO: 1327770 - RNA, 22 nt, Human
ugagacuccugccacgcagguc

SEQ ID NO: 1327771 - RNA, 21 nt, Human
ugagagcaggugguugguucc

SEQ ID NO: 1327772 - RNA, 18 nt, Human
ugaggauguguaaugugg

SEQ ID NO: 1327773 - RNA, 19 nt, Human
ugagguaggcacugcuauc

SEQ ID NO: 1327774 - RNA, 21 nt, Human
ugauaugggagcaauuaguuu

SEQ ID NO: 1327775 - RNA, 23 nt, Human
ugcaaucagaugccaagguaaac

SEQ ID NO: 1327776 - RNA, 19 nt, Human
ugcacagagccugaggcgg

SEQ ID NO: 1327777 - RNA, 21 nt, Human
ugcacagagccugaggcgggg

SEQ ID NO: 1327778 - RNA, 23 nt, Human
ugcagagucaagaggccugggug

SEQ ID NO: 1327779 - RNA, 21 nt, Human
ugcagcagagaugagccccaa

SEQ ID NO: 1327780 - RNA, 21 nt, Human
ugccaccauggauaccugcug

SEQ ID NO: 1327781 - RNA, 24 nt, Human
ugcccaggcuggucuugaacuccu

SEQ ID NO: 1327782 - RNA, 20 nt, Human
ugccccagggcagacacagc

SEQ ID NO: 1327783 - RNA, 22 nt, Human
ugccccagggcagacacagcag

SEQ ID NO: 1327784 - RNA, 23 nt, Human
ugccccagggcagacacagcagc

SEQ ID NO: 1327785 - RNA, 24 nt, Human
ugccucagccucccgagcagcuga

SEQ ID NO: 1327786 - RNA, 21 nt, Human
ugcggccaggacagcugugga

SEQ ID NO: 1327787 - RNA, 26 nt, Human
ugcuuaagccaguuugggcugguuuu

SEQ ID NO: 1327788 - RNA, 19 nt, Human
ugcuuuguugcuuaagcca

SEQ ID NO: 1327789 - RNA, 22 nt, Human
uggaagaaagaaugaggucagc

SEQ ID NO: 1327790 - RNA, 18 nt, Human
uggauaccugcugguucu

SEQ ID NO: 1327791 - RNA, 21 nt, Human
uggcaaucccuuccuuggauu

SEQ ID NO: 1327792 - RNA, 24 nt, Human
uggcucacuccagccuugaccucc

SEQ ID NO: 1327793 - RNA, 20 nt, Human
uggcucaguuacugcagcag

SEQ ID NO: 1327794 - RNA, 22 nt, Human
ugggaagugggcuggagccuuu

SEQ ID NO: 1327795 - RNA, 18 nt, Human
ugggagcugugcugaaag

SEQ ID NO: 1327796 - RNA, 18 nt, Human
ugggauuauaggcaugag

SEQ ID NO: 1327797 - RNA, 19 nt, Human
ugggauuauaggcaugagc

SEQ ID NO: 1327798 - RNA, 22 nt, Human
ugggauuauaggcaugagccac

SEQ ID NO: 1327799 - RNA, 23 nt, Human
ugggauuauaggcaugagccacc

SEQ ID NO: 1327800 - RNA, 24 nt, Human
ugggauuauaggcaugagccacca

SEQ ID NO: 1327801 - RNA, 19 nt, Human
ugggcaaggcucucuccca

SEQ ID NO: 1327802 - RNA, 21 nt, Human
ugggcagcaucuaggccuggg

SEQ ID NO: 1327803 - RNA, 21 nt, Human
ugggguagggacuggcguggc

SEQ ID NO: 1327804 - RNA, 22 nt, Human
ugggguagggacuggcguggcc

SEQ ID NO: 1327805 - RNA, 22 nt, Human
ugguagacaccuuggccuuggc

SEQ ID NO: 1327806 - RNA, 22 nt, Human
ugguccagauugggcaugaccc

SEQ ID NO: 1327807 - RNA, 18 nt, Human
uggucuugaacuccugca

SEQ ID NO: 1327808 - RNA, 20 nt, Human
uggugaccccugacuggcug

SEQ ID NO: 1327809 - RNA, 24 nt, Human
uguagagacagggucucacuaugu

SEQ ID NO: 1327810 - RNA, 18 nt, Human
ugugacucgagcugggcc

SEQ ID NO: 1327811 - RNA, 21 nt, Human
uucaagagcccugacaccacc

SEQ ID NO: 1327812 - RNA, 21 nt, Human
uucaucccacuacaaccuauu

SEQ ID NO: 1327813 - RNA, 19 nt, Human
uucaugcaacaauagugac

SEQ ID NO: 1327814 - RNA, 19 nt, Human
uuccuggcccugcauugcu

SEQ ID NO: 1327815 - RNA, 22 nt, Human
uucuguguccuucucuggggcu

SEQ ID NO: 1327816 - RNA, 19 nt, Human
uucuguguucugggagcug

SEQ ID NO: 1327817 - RNA, 21 nt, Human
uucuguguucugggagcugug

SEQ ID NO: 1327818 - RNA, 18 nt, Human
uucuucuuuuuuugagac

SEQ ID NO: 1327819 - RNA, 24 nt, Human
uucuuuuuuugagacagggucuug

SEQ ID NO: 1327820 - RNA, 18 nt, Human
uugaagcaccugggcaug

SEQ ID NO: 1327821 - RNA, 21 nt, Human
uugggauuauaggcaugagcc

SEQ ID NO: 1327822 - RNA, 18 nt, Human
uuugggcugguuuucccu

SEQ ID NO: 1327823 - RNA, 18 nt, Human
uuuguagagacagggucu

SEQ ID NO: 1327824 - RNA, 24 nt, Human
uuuguagagacagggucucacuau

SEQ ID NO: 1327825 - RNA, 19 nt, Human
aaacaggucuguaaacaug

SEQ ID NO: 1327826 - RNA, 20 nt, Human
aaacaugaucucaucccccc

SEQ ID NO: 1327827 - RNA, 23 nt, Human
aacaugaucucauccccccaucc

SEQ ID NO: 1327828 - RNA, 18 nt, Human
acaagugcuaucaggaac

SEQ ID NO: 1327829 - RNA, 21 nt, Human
acccagaugguccacgccagu

SEQ ID NO: 1327830 - RNA, 20 nt, Human
agccaggggugcuggccagg

SEQ ID NO: 1327831 - RNA, 18 nt, Human
caaaacaggucuguaaac

SEQ ID NO: 1327832 - RNA, 24 nt, Human
caagugauuaaaaaacuucuuggc

SEQ ID NO: 1327833 - RNA, 22 nt, Human
caggaaggcagacucgucccuu

SEQ ID NO: 1327834 - RNA, 21 nt, Human
caggggcugaggacacccaga

SEQ ID NO: 1327835 - RNA, 20 nt, Human
caguggccuugaaauuuccc

SEQ ID NO: 1327836 - RNA, 25 nt, Human
caucccuucuuccaaggagcuuccu

SEQ ID NO: 1327837 - RNA, 23 nt, Human
ccaggugaggggcugaggcacaa

SEQ ID NO: 1327838 - RNA, 19 nt, Human
ccccaggaggagggagacu

SEQ ID NO: 1327839 - RNA, 21 nt, Human
cucauccccccaucccuucuu

SEQ ID NO: 1327840 - RNA, 24 nt, Human
cugguucguuggcagccccuuccc

SEQ ID NO: 1327841 - RNA, 22 nt, Human
gacacaggcaggcgaaaagcag

SEQ ID NO: 1327842 - RNA, 19 nt, Human
gacucgucccuuuaaccca

SEQ ID NO: 1327843 - RNA, 23 nt, Human
ggaggagggagacucuuuggcag

SEQ ID NO: 1327844 - RNA, 23 nt, Human
ggaugacaaaacaggucuguaaa

SEQ ID NO: 1327845 - RNA, 19 nt, Human
ggcagccccuuccccagga

SEQ ID NO: 1327846 - RNA, 22 nt, Human
gucugguucguuggcagccccu

SEQ ID NO: 1327847 - RNA, 23 nt, Human
ucacugagucugguucguuggca

SEQ ID NO: 1327848 - RNA, 24 nt, Human
uccacacaccaccugguggcuccc

SEQ ID NO: 1327849 - RNA, 18 nt, Human
uccccugcagaagccaga

SEQ ID NO: 1327850 - RNA, 19 nt, Human
ucugucaugacguggucac

SEQ ID NO: 1327851 - RNA, 21 nt, Human
ugaggacacccagauggucca

SEQ ID NO: 1327852 - RNA, 20 nt, Human
ugaggggcugaggcacaagu

SEQ ID NO: 1327853 - RNA, 27 nt, Human
ugaggggcugaggcacaagugcuauca

SEQ ID NO: 1327854 - RNA, 23 nt, Human
ugaggucuguagaaaaggggucc

SEQ ID NO: 1327855 - RNA, 19 nt, Human
ugccccacaggggcugagg

SEQ ID NO: 1327856 - RNA, 24 nt, Human
ugcccuggcagguggccaggugag

SEQ ID NO: 1327857 - RNA, 23 nt, Human
ugcggcagcccucccgggggcac

SEQ ID NO: 1327858 - RNA, 24 nt, Human
ugcggcagcccucccgggggcacg

SEQ ID NO: 1327859 - RNA, 22 nt, Human
ugcuaggguugcaggugcccug

SEQ ID NO: 1327860 - RNA, 21 nt, Human
uggcagcaggaugacaaaaga

SEQ ID NO: 1327861 - RNA, 19 nt, Human
uguaaacaugaucucaucc

SEQ ID NO: 1327862 - RNA, 21 nt, Human
uucuuggcagcaggaugacaa

SEQ ID NO: 1327863 - RNA, 25 nt, Human
aggcuucugaccuaacuaugaguuu

SEQ ID NO: 1327864 - RNA, 19 nt, Human
caggcuucugaccuaacua

SEQ ID NO: 1327865 - RNA, 21 nt, Human
cgaccagaaaauucccuuguc

SEQ ID NO: 1327866 - RNA, 18 nt, Human
cgggacuguggggagagg

SEQ ID NO: 1327867 - RNA, 21 nt, Human
cuaugaguuuccuccgcgcau

SEQ ID NO: 1327868 - RNA, 21 nt, Human
cuuaggaagagaagccggaaa

SEQ ID NO: 1327869 - RNA, 22 nt, Human
gacaggaaaacgggacuguggg

SEQ ID NO: 1327870 - RNA, 18 nt, Human
gacuguggggagagggug

SEQ ID NO: 1327871 - RNA, 19 nt, Human
gcagacccuccuuaggaag

SEQ ID NO: 1327872 - RNA, 22 nt, Human
gcagacgggccgcagacccucc

SEQ ID NO: 1327873 - RNA, 21 nt, Human
gcgcguuaacaauucugauuc

SEQ ID NO: 1327874 - RNA, 25 nt, Human
ggacaggaaaacgggacugugggga

SEQ ID NO: 1327875 - RNA, 20 nt, Human
ggacuguggggagagggugg

SEQ ID NO: 1327876 - RNA, 22 nt, Human
uacagcaguaacacucaguggu

SEQ ID NO: 1327877 - RNA, 18 nt, Human
uaggaagagaagccggaa

SEQ ID NO: 1327878 - RNA, 19 nt, Human
uaugaguuuccuccgcgca

SEQ ID NO: 1327879 - RNA, 21 nt, Human
ucaguggugucccugccuucc

SEQ ID NO: 1327880 - RNA, 22 nt, Human
ucaguggugucccugccuuccu

SEQ ID NO: 1327881 - RNA, 19 nt, Human
ucaugugcaguuagaaucc

SEQ ID NO: 1327882 - RNA, 25 nt, Human
ucccuugucuugccaggcuucugac

SEQ ID NO: 1327883 - RNA, 19 nt, Human
ugccaggcuucugaccuaa

SEQ ID NO: 1327884 - RNA, 21 nt, Human
ugcccugcucuggccccuaaa

SEQ ID NO: 1327885 - RNA, 18 nt, Human
ugggucucaguguuccuu

SEQ ID NO: 1327886 - RNA, 23 nt, Human
uguggggagaggguggugcagac

SEQ ID NO: 1327887 - RNA, 18 nt, Human
aaaaaaaaaaagagaaca

SEQ ID NO: 1327888 - RNA, 23 nt, Human
aaaaaaaaaaagagaacagagga

SEQ ID NO: 1327889 - RNA, 19 nt, Human
aaaaaaaagagaacagagg

SEQ ID NO: 1327890 - RNA, 19 nt, Human
aaaaagaaaaaaaaaaaga

SEQ ID NO: 1327891 - RNA, 21 nt, Human
aaaagaaaaaaaaaaagagaa

SEQ ID NO: 1327892 - RNA, 23 nt, Human
aaacagccagauaggaucuaaau

SEQ ID NO: 1327893 - RNA, 23 nt, Human
aaagauguacacucuuuaucuuc

SEQ ID NO: 1327894 - RNA, 19 nt, Human
aaccagaaagauguacacu

SEQ ID NO: 1327895 - RNA, 19 nt, Human
aagacaccaaauuccagcc

SEQ ID NO: 1327896 - RNA, 18 nt, Human
aagagaacagaggaccca

SEQ ID NO: 1327897 - RNA, 20 nt, Human
aagaggggcugcagagaggc

SEQ ID NO: 1327898 - RNA, 19 nt, Human
aagcagaaggcaggagaga

SEQ ID NO: 1327899 - RNA, 24 nt, Human
aagcagaaggcaggagagacagag

SEQ ID NO: 1327900 - RNA, 19 nt, Human
aagcaggcguucagcuuug

SEQ ID NO: 1327901 - RNA, 23 nt, Human
aaggaaccaugcucuucacgagc

SEQ ID NO: 1327902 - RNA, 19 nt, Human
aauaaaccaucuacuaaga

SEQ ID NO: 1327903 - RNA, 23 nt, Human
accaaauuccagccuggcuguag

SEQ ID NO: 1327904 - RNA, 20 nt, Human
accacagcuccuucucagca

SEQ ID NO: 1327905 - RNA, 23 nt, Human
accccauaaaccacacaugacuc

SEQ ID NO: 1327906 - RNA, 18 nt, Human
agacagauaaacugagga

SEQ ID NO: 1327907 - RNA, 21 nt, Human
agauuuaaaaagaaaaaaaaa

SEQ ID NO: 1327908 - RNA, 20 nt, Human
agccauagccaucucucuca

SEQ ID NO: 1327909 - RNA, 21 nt, Human
cacagcuaagccucucuccuc

SEQ ID NO: 1327910 - RNA, 27 nt, Human
cacaugacagagagcaggcccacaugg

SEQ ID NO: 1327911 - RNA, 18 nt, Human
cacaugcaucaagcccca

SEQ ID NO: 1327912 - RNA, 21 nt, Human
caccauagcuugauucauauu

SEQ ID NO: 1327913 - RNA, 19 nt, Human
caccauauaaagcaugggu

SEQ ID NO: 1327914 - RNA, 22 nt, Human
cacccugagacuugguggugga

SEQ ID NO: 1327915 - RNA, 23 nt, Human
caccuaggccaacugaggguuca

SEQ ID NO: 1327916 - RNA, 21 nt, Human
cagacagauaaacugaggaug

SEQ ID NO: 1327917 - RNA, 18 nt, Human
cagcagcaauacgagaag

SEQ ID NO: 1327918 - RNA, 26 nt, Human
cagcuaagccucucuccucauggucc

SEQ ID NO: 1327919 - RNA, 19 nt, Human
cauccucgccccucaagag

SEQ ID NO: 1327920 - RNA, 18 nt, Human
cauuuucccaaccucacc

SEQ ID NO: 1327921 - RNA, 18 nt, Human
ccagagcacauucccagg

SEQ ID NO: 1327922 - RNA, 19 nt, Human
ccagagcacauucccaggg

SEQ ID NO: 1327923 - RNA, 23 nt, Human
ccagagcacauucccagggaucu

SEQ ID NO: 1327924 - RNA, 18 nt, Human
ccaggaacugaaaaacca

SEQ ID NO: 1327925 - RNA, 19 nt, Human
cccacugggaaagugggga

SEQ ID NO: 1327926 - RNA, 19 nt, Human
cccauaaaccacacaugac

SEQ ID NO: 1327927 - RNA, 25 nt, Human
ccgcccagagcacauucccagggau

SEQ ID NO: 1327928 - RNA, 18 nt, Human
ccgccugagcccaacccc

SEQ ID NO: 1327929 - RNA, 23 nt, Human
ccucaagagggcugagaaaagga

SEQ ID NO: 1327930 - RNA, 18 nt, Human
ccucagaaacacacagcu

SEQ ID NO: 1327931 - RNA, 28 nt, Human
ccucagaaacacacagcuaagccucucu

SEQ ID NO: 1327932 - RNA, 20 nt, Human
ccucagcauccucgccccuc

SEQ ID NO: 1327933 - RNA, 18 nt, Human
ccugagauaggugcuggg

SEQ ID NO: 1327934 - RNA, 23 nt, Human
ccugagcccaaccccggcucagc

SEQ ID NO: 1327935 - RNA, 18 nt, Human
cgacuucaguccucagca

SEQ ID NO: 1327936 - RNA, 21 nt, Human
cggaguuucucuucuuccugu

SEQ ID NO: 1327937 - RNA, 20 nt, Human
cucagcaccucuaugagugc

SEQ ID NO: 1327938 - RNA, 19 nt, Human
cuccugaaagucaggcgug

SEQ ID NO: 1327939 - RNA, 23 nt, Human
cucuuuaucuucucggcuggagg

SEQ ID NO: 1327940 - RNA, 23 nt, Human
cugagauaggugcugggacccac

SEQ ID NO: 1327941 - RNA, 18 nt, Human
gaaggaaaagaggggcug

SEQ ID NO: 1327942 - RNA, 21 nt, Human
gacuccacuuugcugaaauag

SEQ ID NO: 1327943 - RNA, 24 nt, Human
gagccauagccaucucucucaugc

SEQ ID NO: 1327944 - RNA, 24 nt, Human
gccuugugccauuuucccaaccuc

SEQ ID NO: 1327945 - RNA, 22 nt, Human
gcggaacugaacuagccuccaa

SEQ ID NO: 1327946 - RNA, 22 nt, Human
ggaacugaaaaaccacagucug

SEQ ID NO: 1327947 - RNA, 22 nt, Human
ggaagagagggagcuuuggagc

SEQ ID NO: 1327948 - RNA, 20 nt, Human
gggaaaguggggaugagggg

SEQ ID NO: 1327949 - RNA, 18 nt, Human
gggagagagagaauaagc

SEQ ID NO: 1327950 - RNA, 18 nt, Human
ggggcugcagagaggcuc

SEQ ID NO: 1327951 - RNA, 19 nt, Human
gucugccucaucuuucucc

SEQ ID NO: 1327952 - RNA, 28 nt, Human
gugcagccagggugggaagagagggagc

SEQ ID NO: 1327953 - RNA, 21 nt, Human
uaaacugaggaugcuaggagc

SEQ ID NO: 1327954 - RNA, 19 nt, Human
uaaauuggcuguguuucug

SEQ ID NO: 1327955 - RNA, 18 nt, Human
uaagacaccaaauuccag

SEQ ID NO: 1327956 - RNA, 27 nt, Human
uaccccauaaaccacacaugacuccaa

SEQ ID NO: 1327957 - RNA, 24 nt, Human
uacccuuggagaaaugcugcauuu

SEQ ID NO: 1327958 - RNA, 19 nt, Human
uaggaaagauggugcagug

SEQ ID NO: 1327959 - RNA, 20 nt, Human
uaguauagcaucacaugaca

SEQ ID NO: 1327960 - RNA, 21 nt, Human
ucagaaccacagcuccuucuc

SEQ ID NO: 1327961 - RNA, 20 nt, Human
uccacaguacugaugaucaa

SEQ ID NO: 1327962 - RNA, 24 nt, Human
ucccucuggucaugaaaauggccc

SEQ ID NO: 1327963 - RNA, 24 nt, Human
ucugcaaagcaaaacuuuuuaacc

SEQ ID NO: 1327964 - RNA, 23 nt, Human
ugaagcuucuguagguuuccaga

SEQ ID NO: 1327965 - RNA, 24 nt, Human
ugaaggaaaagaggggcugcagag

SEQ ID NO: 1327966 - RNA, 18 nt, Human
ugagaaaaggaaccaugc

SEQ ID NO: 1327967 - RNA, 21 nt, Human
ugaucaaagcaguaacagcag

SEQ ID NO: 1327968 - RNA, 21 nt, Human
ugcauggcgaaugcauuugaa

SEQ ID NO: 1327969 - RNA, 18 nt, Human
ugccauagguaaaaaauu

SEQ ID NO: 1327970 - RNA, 24 nt, Human
ugccucaucuuucucccuguccgc

SEQ ID NO: 1327971 - RNA, 20 nt, Human
ugcuaggagcucagcagcaa

SEQ ID NO: 1327972 - RNA, 19 nt, Human
ugggaaaguggggaugagg

SEQ ID NO: 1327973 - RNA, 19 nt, Human
ugggaaggccagaaucaua

SEQ ID NO: 1327974 - RNA, 18 nt, Human
uguccggguccaguacag

SEQ ID NO: 1327975 - RNA, 21 nt, Human
uguccggguccaguacagugu

SEQ ID NO: 1327976 - RNA, 23 nt, Human
uucacagacagauaaacugagga

SEQ ID NO: 1327977 - RNA, 23 nt, Human
uucccaaccucaccauauaaagc

SEQ ID NO: 1327978 - RNA, 20 nt, Human
uugaacagaucccucugguc

SEQ ID NO: 1327979 - RNA, 18 nt, Human
uugagguucaggagaagc

SEQ ID NO: 1327980 - RNA, 21 nt, Human
uugugccaaccugcugucugg

SEQ ID NO: 1327981 - RNA, 24 nt, Human
uuuaaaaagaaaaaaaaaaagaga

SEQ ID NO: 1327982 - RNA, 22 nt, Human
uuuaaccagaaagauguacacu

SEQ ID NO: 1327983 - RNA, 19 nt, Human
uuugagguucaggagaagc

SEQ ID NO: 1327984 - RNA, 23 nt, Human
uuuuaaccagaaagauguacacu

SEQ ID NO: 1327985 - RNA, 20 nt, Human
aaacaggagccggcagggcu

SEQ ID NO: 1327986 - RNA, 18 nt, Human
accuugcuggacuccaca

SEQ ID NO: 1327987 - RNA, 22 nt, Human
auacacgaguuuugauaccaca

SEQ ID NO: 1327988 - RNA, 21 nt, Human
cacaguguggugcagacaaga

SEQ ID NO: 1327989 - RNA, 22 nt, Human
caggagccggcagggcugggcu

SEQ ID NO: 1327990 - RNA, 22 nt, Human
cccugagucaccuugcuggacu

SEQ ID NO: 1327991 - RNA, 23 nt, Human
cccugagucaccuugcuggacuc

SEQ ID NO: 1327992 - RNA, 24 nt, Human
cuuuggaaucuuugaggauaaaca

SEQ ID NO: 1327993 - RNA, 18 nt, Human
ggucauuuuuagcuggcu

SEQ ID NO: 1327994 - RNA, 22 nt, Human
uaaacaggagccggcagggcug

SEQ ID NO: 1327995 - RNA, 21 nt, Human
uccccuggagggcaggaccca

SEQ ID NO: 1327996 - RNA, 19 nt, Human
ucucuagcggaagccgugg

SEQ ID NO: 1327997 - RNA, 18 nt, Human
ugggagccuuugaacagg

SEQ ID NO: 1327998 - RNA, 19 nt, Human
auccauucaucaacccaca

SEQ ID NO: 1327999 - RNA, 23 nt, Human
caaaaugagcacugugugagcug

SEQ ID NO: 1328000 - RNA, 18 nt, Human
cacugugugagcugaggu

SEQ ID NO: 1328001 - RNA, 20 nt, Human
cccacaaaaugagcacugug

SEQ ID NO: 1328002 - RNA, 19 nt, Human
ucaacccacaaaaugagca

SEQ ID NO: 1328003 - RNA, 22 nt, Human
aaaacacugcccaaauguugcc

SEQ ID NO: 1328004 - RNA, 24 nt, Human
aaccugacggggagcaggggccca

SEQ ID NO: 1328005 - RNA, 22 nt, Human
aagcugagggcccaaaagugga

SEQ ID NO: 1328006 - RNA, 20 nt, Human
aaggagcagcauccaggagg

SEQ ID NO: 1328007 - RNA, 19 nt, Human
aagggagagaagagggaga

SEQ ID NO: 1328008 - RNA, 24 nt, Human
acauaggucagagacagcacaacc

SEQ ID NO: 1328009 - RNA, 20 nt, Human
accucagcaccuugaguccg

SEQ ID NO: 1328010 - RNA, 21 nt, Human
agaaaaaagauucaaggagca

SEQ ID NO: 1328011 - RNA, 25 nt, Human
agacagcacaaccugacggggagca

SEQ ID NO: 1328012 - RNA, 19 nt, Human
agacagugccacagagccc

SEQ ID NO: 1328013 - RNA, 24 nt, Human
agcaggcaugucacagcccugggu

SEQ ID NO: 1328014 - RNA, 21 nt, Human
aggacaggccgcuuaucuccc

SEQ ID NO: 1328015 - RNA, 19 nt, Human
aggagaggguccugcccag

SEQ ID NO: 1328016 - RNA, 24 nt, Human
aggaggcagaaaccccucggggau

SEQ ID NO: 1328017 - RNA, 19 nt, Human
aggcagcaguggccaggug

SEQ ID NO: 1328018 - RNA, 20 nt, Human
aggcaugucacagcccuggg

SEQ ID NO: 1328019 - RNA, 22 nt, Human
aggcaugucacagcccugggug

SEQ ID NO: 1328020 - RNA, 20 nt, Human
agggaggucgggaaaguggg

SEQ ID NO: 1328021 - RNA, 20 nt, Human
agggaucuggggcccagggc

SEQ ID NO: 1328022 - RNA, 23 nt, Human
aggucagagacagcacaaccuga

SEQ ID NO: 1328023 - RNA, 23 nt, Human
agugaccaggcccaggggaagga

SEQ ID NO: 1328024 - RNA, 21 nt, Human
cacaaccugacggggagcagg

SEQ ID NO: 1328025 - RNA, 19 nt, Human
cacaggccagaauccccau

SEQ ID NO: 1328026 - RNA, 21 nt, Human
cacccaugacuccuugaaagc

SEQ ID NO: 1328027 - RNA, 20 nt, Human
caccccugcugugccccacu

SEQ ID NO: 1328028 - RNA, 23 nt, Human
cagaaaucccucacuuaaacauc

SEQ ID NO: 1328029 - RNA, 25 nt, Human
cagacagagggcaggugggcaugga

SEQ ID NO: 1328030 - RNA, 24 nt, Human
cagcacaaccugacggggagcaau

SEQ ID NO: 1328031 - RNA, 19 nt, Human
cagcaggccucggugucug

SEQ ID NO: 1328032 - RNA, 20 nt, Human
cagcaguggccaggugagca

SEQ ID NO: 1328033 - RNA, 25 nt, Human
cagcccaggccuuggccucgagggc

SEQ ID NO: 1328034 - RNA, 25 nt, Human
caggccagaauccccauggaaagcg

SEQ ID NO: 1328035 - RNA, 20 nt, Human
cauugugcaacaggaaggau

SEQ ID NO: 1328036 - RNA, 29 nt, Human
ccaggccuuggccucgagggcuccugacc

SEQ ID NO: 1328037 - RNA, 18 nt, Human
cccaaauguugccuacuc

SEQ ID NO: 1328038 - RNA, 19 nt, Human
cccacagcaagcugcugga

SEQ ID NO: 1328039 - RNA, 18 nt, Human
cccacauuccagcgaggc

SEQ ID NO: 1328040 - RNA, 25 nt, Human
cccccaccgcugaccccucccccag

SEQ ID NO: 1328041 - RNA, 19 nt, Human
ccccccgggggcaaggggg

SEQ ID NO: 1328042 - RNA, 21 nt, Human
ccccccgggggcaaggggggc

SEQ ID NO: 1328043 - RNA, 18 nt, Human
ccccgggggcaagggggg

SEQ ID NO: 1328044 - RNA, 24 nt, Human
cccugggugcccagcauccgaccc

SEQ ID NO: 1328045 - RNA, 18 nt, Human
ccugcuucgagugugggg

SEQ ID NO: 1328046 - RNA, 21 nt, Human
ccuggccugaccuucacugac

SEQ ID NO: 1328047 - RNA, 19 nt, Human
cgacccaagggugcagcag

SEQ ID NO: 1328048 - RNA, 29 nt, Human
cgggggcaaggggggcaguggggaagucc

SEQ ID NO: 1328049 - RNA, 23 nt, Human
cucccccauguacugucuggcag

SEQ ID NO: 1328050 - RNA, 25 nt, Human
cucuuagguuucccauugugcaaca

SEQ ID NO: 1328051 - RNA, 24 nt, Human
cuugaaagcuccuucucccaggag

SEQ ID NO: 1328052 - RNA, 18 nt, Human
cuugaguccgaggagggg

SEQ ID NO: 1328053 - RNA, 24 nt, Human
gaagacagugccacagagcccaag

SEQ ID NO: 1328054 - RNA, 20 nt, Human
gaccuggguggggaggaggc

SEQ ID NO: 1328055 - RNA, 25 nt, Human
gagaggguccugcccagaccgggga

SEQ ID NO: 1328056 - RNA, 19 nt, Human
gagagucuucuccaggaag

SEQ ID NO: 1328057 - RNA, 18 nt, Human
gagcagcauccaggagga

SEQ ID NO: 1328058 - RNA, 21 nt, Human
gcagaaaccccucggggaugu

SEQ ID NO: 1328059 - RNA, 24 nt, Human
gcaggggacagggugauguacgga

SEQ ID NO: 1328060 - RNA, 23 nt, Human
gcaggugggcauggaaucccucg

SEQ ID NO: 1328061 - RNA, 19 nt, Human
ggaaggagggggcccaggc

SEQ ID NO: 1328062 - RNA, 23 nt, Human
ggacaggccgcuuaucuccccca

SEQ ID NO: 1328063 - RNA, 19 nt, Human
ggagauggccuguagcccc

SEQ ID NO: 1328064 - RNA, 20 nt, Human
ggcugggcaagcaggccccu

SEQ ID NO: 1328065 - RNA, 18 nt, Human
gggaaggagaggguccug

SEQ ID NO: 1328066 - RNA, 23 nt, Human
gggaaggagaggguccugcccag

SEQ ID NO: 1328067 - RNA, 18 nt, Human
gggaaggagggggcccag

SEQ ID NO: 1328068 - RNA, 20 nt, Human
gggcaagcaggccccugucu

SEQ ID NO: 1328069 - RNA, 25 nt, Human
gggcaagcaggccccugucuuuuuc

SEQ ID NO: 1328070 - RNA, 21 nt, Human
gggcaggugggcauggaaucc

SEQ ID NO: 1328071 - RNA, 20 nt, Human
ggggaaggagggggcccagg

SEQ ID NO: 1328072 - RNA, 21 nt, Human
gguauagaaagaugggaagga

SEQ ID NO: 1328073 - RNA, 23 nt, Human
ggucgggaaagugggguacacug

SEQ ID NO: 1328074 - RNA, 25 nt, Human
ggugcagcaggccucggugucugcu

SEQ ID NO: 1328075 - RNA, 21 nt, Human
guaagggagagaagagggaga

SEQ ID NO: 1328076 - RNA, 22 nt, Human
gucgggaaagugggguacacug

SEQ ID NO: 1328077 - RNA, 22 nt, Human
gugaacucaaauauacagucac

SEQ ID NO: 1328078 - RNA, 18 nt, Human
guggaaugcugugguccc

SEQ ID NO: 1328079 - RNA, 24 nt, Human
guggaggggagucagaggccuaca

SEQ ID NO: 1328080 - RNA, 21 nt, Human
uaggucagagacagcacaacc

SEQ ID NO: 1328081 - RNA, 30 nt, Human
uaucucccccaccgcugaccccucccccaa

SEQ ID NO: 1328082 - RNA, 18 nt, Human
uaugagcuuccagaaauc

SEQ ID NO: 1328083 - RNA, 19 nt, Human
ucaccagggaucuggggcc

SEQ ID NO: 1328084 - RNA, 21 nt, Human
uccagcgaggcagacagaggg

SEQ ID NO: 1328085 - RNA, 22 nt, Human
uccaggaaggugucaccaggga

SEQ ID NO: 1328086 - RNA, 20 nt, Human
uccaggaggagaccaugacc

SEQ ID NO: 1328087 - RNA, 24 nt, Human
uccccugaaaguccuucuccccca

SEQ ID NO: 1328088 - RNA, 18 nt, Human
uccuggguuuggaccugc

SEQ ID NO: 1328089 - RNA, 22 nt, Human
ucucaccccugcugugccccac

SEQ ID NO: 1328090 - RNA, 20 nt, Human
ucugaccccgaccuucacug

SEQ ID NO: 1328091 - RNA, 21 nt, Human
ucugugucugaccccgaccuu

SEQ ID NO: 1328092 - RNA, 20 nt, Human
ucuucaaaacacugcccaaa

SEQ ID NO: 1328093 - RNA, 20 nt, Human
ugacuccuugaaagcuccuu

SEQ ID NO: 1328094 - RNA, 19 nt, Human
ugacucuauucucaccccu

SEQ ID NO: 1328095 - RNA, 20 nt, Human
ugagcaagcaaaauaggcuc

SEQ ID NO: 1328096 - RNA, 18 nt, Human
ugaguccgaggaggggag

SEQ ID NO: 1328097 - RNA, 18 nt, Human
ugcaaugguccccugccc

SEQ ID NO: 1328098 - RNA, 21 nt, Human
ugcaaugguccccugcccgag

SEQ ID NO: 1328099 - RNA, 29 nt, Human
ugcccagaccggggaugcucacaaggggg

SEQ ID NO: 1328100 - RNA, 21 nt, Human
ugcccgagauaagcugagggc

SEQ ID NO: 1328101 - RNA, 18 nt, Human
ugcugaauggauaaggca

SEQ ID NO: 1328102 - RNA, 20 nt, Human
ugcuggaccacacccugacc

SEQ ID NO: 1328103 - RNA, 19 nt, Human
uggaaagcguaccuaacuu

SEQ ID NO: 1328104 - RNA, 20 nt, Human
uggccucgagggcuccugac

SEQ ID NO: 1328105 - RNA, 21 nt, Human
uggguggggaggaggcagaaa

SEQ ID NO: 1328106 - RNA, 21 nt, Human
ugucauucuucaaaacacugc

SEQ ID NO: 1328107 - RNA, 25 nt, Human
uguggggaguuauugcuggugaacu

SEQ ID NO: 1328108 - RNA, 22 nt, Human
uuccagcgaggcagacagaggg

SEQ ID NO: 1328109 - RNA, 22 nt, Human
agcgcagaggagaaccuguguu

SEQ ID NO: 1328110 - RNA, 22 nt, Human
cagaggagaaccuguguuccac

SEQ ID NO: 1328111 - RNA, 24 nt, Human
gcagaggagaaccuguguuccaca

SEQ ID NO: 1328112 - RNA, 22 nt, Human
gguagguagguuaucaugagau

SEQ ID NO: 1328113 - RNA, 21 nt, Human
guagguagguuaucaugagau

SEQ ID NO: 1328114 - RNA, 23 nt, Human
guagguuaucaugagaugcugcu

SEQ ID NO: 1328115 - RNA, 19 nt, Human
uagguuaucaugagaugcu

SEQ ID NO: 1328116 - RNA, 18 nt, Human
uauccacacagcgcagag

SEQ ID NO: 1328117 - RNA, 19 nt, Human
uccacagagguaugguagg

SEQ ID NO: 1328118 - RNA, 23 nt, Human
aagcauuuaacuugggcugcaau

SEQ ID NO: 1328119 - RNA, 20 nt, Human
acuuugcauccugaucuccu

SEQ ID NO: 1328120 - RNA, 19 nt, Human
caaccccugaaauccgacu

SEQ ID NO: 1328121 - RNA, 21 nt, Human
ccccugaaauccgacuguggg

SEQ ID NO: 1328122 - RNA, 23 nt, Human
cgacugugggccugauccucagu

SEQ ID NO: 1328123 - RNA, 22 nt, Human
uaagcauuuaacuugggcugca

SEQ ID NO: 1328124 - RNA, 30 nt, Human
uccuuugucuugcucauucuguuuccaauu

SEQ ID NO: 1328125 - RNA, 20 nt, Human
ucugcaaccccugaaauccg

SEQ ID NO: 1328126 - RNA, 18 nt, Human
ugcaaccccugaaauccg

SEQ ID NO: 1328127 - RNA, 20 nt, Human
ugucuugcucauucuguuuc

SEQ ID NO: 1328128 - RNA, 22 nt, Human
ugucuugcucauucuguuucca

SEQ ID NO: 1328129 - RNA, 22 nt, Human
uugaguuuucucagaggcccau

SEQ ID NO: 1328130 - RNA, 25 nt, Human
uuugcauccugaucuccuuugucuu

SEQ ID NO: 1328131 - RNA, 22 nt, Human
agaaagacagauguugagcugg

SEQ ID NO: 1328132 - RNA, 24 nt, Human
cagaaacagauaagaaagacagau

SEQ ID NO: 1328133 - RNA, 24 nt, Human
cuggacuacccuuagaucaccaug

SEQ ID NO: 1328134 - RNA, 18 nt, Human
gaacauuccuucuuggaa

SEQ ID NO: 1328135 - RNA, 23 nt, Human
uuccuucuuggaaggaggcuggu

SEQ ID NO: 1328136 - RNA, 24 nt, Human
uuggaacauuccuucuuggaagga

SEQ ID NO: 1328137 - RNA, 21 nt, Human
gagagaagccauuugagguga

SEQ ID NO: 1328138 - RNA, 27 nt, Human
ucaggcacacaaaaaaaguuguaccaa

SEQ ID NO: 1328139 - RNA, 21 nt, Human
ucagggaagagagaagccauu

SEQ ID NO: 1328140 - RNA, 25 nt, Human
aaaauuccgcccacaccccgugccc

SEQ ID NO: 1328141 - RNA, 23 nt, Human
aaacaacguaaaggaacuacuga

SEQ ID NO: 1328142 - RNA, 20 nt, Human
aagcccgcgagccggcgccc

SEQ ID NO: 1328143 - RNA, 24 nt, Human
aagcucaagacggcaccgcagcag

SEQ ID NO: 1328144 - RNA, 18 nt, Human
acagcuucuuccaagugc

SEQ ID NO: 1328145 - RNA, 19 nt, Human
acuucccagcucccagaga

SEQ ID NO: 1328146 - RNA, 19 nt, Human
agccggaccgccaaagccc

SEQ ID NO: 1328147 - RNA, 24 nt, Human
aggaacuacugagucuggacagaa

SEQ ID NO: 1328148 - RNA, 19 nt, Human
aggcuuaccagcgcagcgg

SEQ ID NO: 1328149 - RNA, 23 nt, Human
augaaacaaacagaaaaccgaag

SEQ ID NO: 1328150 - RNA, 20 nt, Human
caaaacacaggcuuaccagc

SEQ ID NO: 1328151 - RNA, 23 nt, Human
caaaacacaggcuuaccagcgca

SEQ ID NO: 1328152 - RNA, 22 nt, Human
caaacagaaaaccgaagcccug

SEQ ID NO: 1328153 - RNA, 20 nt, Human
caaagcccgcgagccggcgc

SEQ ID NO: 1328154 - RNA, 18 nt, Human
caaaggccagccgcgcuc

SEQ ID NO: 1328155 - RNA, 18 nt, Human
caaauaaaugaccgagaa

SEQ ID NO: 1328156 - RNA, 22 nt, Human
caccccgugcccccgggaauuu

SEQ ID NO: 1328157 - RNA, 20 nt, Human
caggauauggggguuaccac

SEQ ID NO: 1328158 - RNA, 19 nt, Human
ccagugcggauaggccaau

SEQ ID NO: 1328159 - RNA, 21 nt, Human
ccccccgccacgcagggcccc

SEQ ID NO: 1328160 - RNA, 22 nt, Human
cccccgccacgcagggccccgg

SEQ ID NO: 1328161 - RNA, 21 nt, Human
ccccuagugaccccuggccuc

SEQ ID NO: 1328162 - RNA, 20 nt, Human
cccuucuccccucuuaauuc

SEQ ID NO: 1328163 - RNA, 21 nt, Human
cccuucuccccucuuaauucu

SEQ ID NO: 1328164 - RNA, 19 nt, Human
ccgcccacaccccgugccc

SEQ ID NO: 1328165 - RNA, 26 nt, Human
ccgcccacaccccgugcccccgggaa

SEQ ID NO: 1328166 - RNA, 21 nt, Human
ccggcccccccgccacgcagg

SEQ ID NO: 1328167 - RNA, 20 nt, Human
ccgucucuccugccccggcc

SEQ ID NO: 1328168 - RNA, 22 nt, Human
ccguguguagagugggcucugc

SEQ ID NO: 1328169 - RNA, 19 nt, Human
ccuccugucacgauuuccu

SEQ ID NO: 1328170 - RNA, 18 nt, Human
ccucgugcccgacgcccc

SEQ ID NO: 1328171 - RNA, 20 nt, Human
cgaaaacaacguaaaggaac

SEQ ID NO: 1328172 - RNA, 19 nt, Human
cgagcccugagcguccccc

SEQ ID NO: 1328173 - RNA, 24 nt, Human
cgccacgcagggccccggucacgc

SEQ ID NO: 1328174 - RNA, 22 nt, Human
cggaggcccacguucuuccugu

SEQ ID NO: 1328175 - RNA, 18 nt, Human
cguccgcagcccggccag

SEQ ID NO: 1328176 - RNA, 21 nt, Human
cucaggaccgcgagcccugag

SEQ ID NO: 1328177 - RNA, 21 nt, Human
cuccggccgaaccgccacuuc

SEQ ID NO: 1328178 - RNA, 23 nt, Human
cuucuaagaggaccgagugccuu

SEQ ID NO: 1328179 - RNA, 21 nt, Human
gaaaacaacguaaaggaaccg

SEQ ID NO: 1328180 - RNA, 21 nt, Human
gacccugccucacuuucccac

SEQ ID NO: 1328181 - RNA, 21 nt, Human
gagaagguguuaucuaagacc

SEQ ID NO: 1328182 - RNA, 24 nt, Human
gagcuucauuugcccaacggaggc

SEQ ID NO: 1328183 - RNA, 22 nt, Human
gcaagacccugccucacuuucc

SEQ ID NO: 1328184 - RNA, 18 nt, Human
gccccgucucuccugccc

SEQ ID NO: 1328185 - RNA, 19 nt, Human
gccgggugaggccgguuug

SEQ ID NO: 1328186 - RNA, 18 nt, Human
gcgaaccaaaacacaggc

SEQ ID NO: 1328187 - RNA, 23 nt, Human
gcucaggaccgcgagcccugagc

SEQ ID NO: 1328188 - RNA, 22 nt, Human
gcugcagugaaugcuuuuaacc

SEQ ID NO: 1328189 - RNA, 18 nt, Human
ggaggagcacggagggca

SEQ ID NO: 1328190 - RNA, 23 nt, Human
ggucacgcgcggggggagccgga

SEQ ID NO: 1328191 - RNA, 24 nt, Human
uacgauggaaccuccggccgaacc

SEQ ID NO: 1328192 - RNA, 18 nt, Human
uagugaaucuccuucugu

SEQ ID NO: 1328193 - RNA, 19 nt, Human
uaucuggccguguguagag

SEQ ID NO: 1328194 - RNA, 25 nt, Human
uauuccauuuccccuucuccccucu

SEQ ID NO: 1328195 - RNA, 18 nt, Human
ucacgcgcggggggagcc

SEQ ID NO: 1328196 - RNA, 22 nt, Human
uccagacauaccaugcagcuuc

SEQ ID NO: 1328197 - RNA, 24 nt, Human
ucccagagacuguagagaucaccu

SEQ ID NO: 1328198 - RNA, 21 nt, Human
uccccgcucuaaugccggagg

SEQ ID NO: 1328199 - RNA, 21 nt, Human
uccgcaaaggccagccgcgcu

SEQ ID NO: 1328200 - RNA, 21 nt, Human
uccgcagaaccccggcgaggc

SEQ ID NO: 1328201 - RNA, 24 nt, Human
uccgcagaaccccggcgaggccga

SEQ ID NO: 1328202 - RNA, 24 nt, Human
ucgauaaagcccagauucacaaaa

SEQ ID NO: 1328203 - RNA, 21 nt, Human
ucggcaaagcucaagacggca

SEQ ID NO: 1328204 - RNA, 22 nt, Human
ucuaagaccucuacagccauuu

SEQ ID NO: 1328205 - RNA, 24 nt, Human
ucuacugucuucccaaggaucuga

SEQ ID NO: 1328206 - RNA, 20 nt, Human
ucugcaagacccugccucac

SEQ ID NO: 1328207 - RNA, 26 nt, Human
ucuguggccuccugucacgauuuccu

SEQ ID NO: 1328208 - RNA, 19 nt, Human
ugaaacaaacagaaaaccg

SEQ ID NO: 1328209 - RNA, 25 nt, Human
ugaaacaaacagaaaaccgaagccc

SEQ ID NO: 1328210 - RNA, 20 nt, Human
ugaccccuggccucgugccc

SEQ ID NO: 1328211 - RNA, 22 nt, Human
ugagcgucccccuagugacccc

SEQ ID NO: 1328212 - RNA, 27 nt, Human
ugcccgacgccccgucucuccugcccc

SEQ ID NO: 1328213 - RNA, 18 nt, Human
ugccggaggagcacggag

SEQ ID NO: 1328214 - RNA, 23 nt, Human
ugcuuuuaaccugucaacuguga

SEQ ID NO: 1328215 - RNA, 23 nt, Human
uggacauggacagggaacggcuc

SEQ ID NO: 1328216 - RNA, 21 nt, Human
uggguggcucugaaaagagcc

SEQ ID NO: 1328217 - RNA, 21 nt, Human
uuaccacugugcuaguggagg

SEQ ID NO: 1328218 - RNA, 26 nt, Human
uuugggcgcgaagcacgggcgugugg

SEQ ID NO: 1328219 - RNA, 21 nt, Human
aaagcuuccacagcauggaag

SEQ ID NO: 1328220 - RNA, 18 nt, Human
aaaguucuccaagucccc

SEQ ID NO: 1328221 - RNA, 22 nt, Human
aaaguucuccaaguccccacuc

SEQ ID NO: 1328222 - RNA, 26 nt, Human
aaaucaaguuaagccuaaagcugccu

SEQ ID NO: 1328223 - RNA, 24 nt, Human
aacaaaaccaaaaaaaccuauuac

SEQ ID NO: 1328224 - RNA, 22 nt, Human
aacaaagcuuccacagcaugga

SEQ ID NO: 1328225 - RNA, 19 nt, Human
aaccaaaaaaaccuauuac

SEQ ID NO: 1328226 - RNA, 20 nt, Human
aagguggcauggacccaaaa

SEQ ID NO: 1328227 - RNA, 26 nt, Human
aagugucagaagccuaaaggugagcc

SEQ ID NO: 1328228 - RNA, 20 nt, Human
acacaaugaacucugauucu

SEQ ID NO: 1328229 - RNA, 21 nt, Human
acagaaaaguucuccaagucc

SEQ ID NO: 1328230 - RNA, 20 nt, Human
acccuaagauuuauugugaa

SEQ ID NO: 1328231 - RNA, 24 nt, Human
acccuaagauuuauugugaaaagu

SEQ ID NO: 1328232 - RNA, 20 nt, Human
agaaggacaugcaugguaag

SEQ ID NO: 1328233 - RNA, 18 nt, Human
agucugacuucaagaaug

SEQ ID NO: 1328234 - RNA, 22 nt, Human
auaauccuuuagcuagacagaa

SEQ ID NO: 1328235 - RNA, 25 nt, Human
caaaaaguaagcaacccuaagauuu

SEQ ID NO: 1328236 - RNA, 19 nt, Human
caagaaugaagccucagac

SEQ ID NO: 1328237 - RNA, 20 nt, Human
caagguggcauggacccaaa

SEQ ID NO: 1328238 - RNA, 23 nt, Human
cacagaaaacaaaaccaaaaaaa

SEQ ID NO: 1328239 - RNA, 18 nt, Human
cacagagcgcugacuggu

SEQ ID NO: 1328240 - RNA, 22 nt, Human
cacggcccaucugcgaagcaaa

SEQ ID NO: 1328241 - RNA, 19 nt, Human
cagaaaaggcaaugaacag

SEQ ID NO: 1328242 - RNA, 24 nt, Human
cagaaaaggcaaugaacauuuuug

SEQ ID NO: 1328243 - RNA, 26 nt, Human
cagaaaaggcaaugaacauuuuugau

SEQ ID NO: 1328244 - RNA, 21 nt, Human
cagcauggaaggugauccgag

SEQ ID NO: 1328245 - RNA, 22 nt, Human
caucugcgaagcaaaacuaauc

SEQ ID NO: 1328246 - RNA, 22 nt, Human
cauuucuccauuuccauacuga

SEQ ID NO: 1328247 - RNA, 19 nt, Human
cgccugagggaaacagcua

SEQ ID NO: 1328248 - RNA, 24 nt, Human
cggcccaucugcgaagcaaaacua

SEQ ID NO: 1328249 - RNA, 19 nt, Human
cguggaacaggccgccuga

SEQ ID NO: 1328250 - RNA, 20 nt, Human
cguggugaguguuacagcuc

SEQ ID NO: 1328251 - RNA, 23 nt, Human
cugcuggcuaggggcgccagcug

SEQ ID NO: 1328252 - RNA, 22 nt, Human
gacccaaaaaguaagcaacccu

SEQ ID NO: 1328253 - RNA, 19 nt, Human
gcaccacgaccucccuccu

SEQ ID NO: 1328254 - RNA, 20 nt, Human
gcgaaacgacugauggaaca

SEQ ID NO: 1328255 - RNA, 19 nt, Human
gcgaagcaaaacuaauccu

SEQ ID NO: 1328256 - RNA, 22 nt, Human
ggggagaaggacaugcauggua

SEQ ID NO: 1328257 - RNA, 21 nt, Human
guccauuuuacagagugcuga

SEQ ID NO: 1328258 - RNA, 24 nt, Human
gugaaauaacaaagcuuccacagc

SEQ ID NO: 1328259 - RNA, 18 nt, Human
uaagccuccauaacgcag

SEQ ID NO: 1328260 - RNA, 22 nt, Human
uaauagcacagaaaacaaaacc

SEQ ID NO: 1328261 - RNA, 25 nt, Human
ucagaaaaggcaaugaacauuuuug

SEQ ID NO: 1328262 - RNA, 25 nt, Human
uccaaguccccacucgacccaggaa

SEQ ID NO: 1328263 - RNA, 23 nt, Human
uccacagcauggaaggugauccg

SEQ ID NO: 1328264 - RNA, 20 nt, Human
uccauacugauugcuuccuc

SEQ ID NO: 1328265 - RNA, 20 nt, Human
uccucucaccaccacggccc

SEQ ID NO: 1328266 - RNA, 20 nt, Human
uccuggggagaaggacaugc

SEQ ID NO: 1328267 - RNA, 21 nt, Human
uccuggggagaaggacaugca

SEQ ID NO: 1328268 - RNA, 21 nt, Human
ucuccaaguccccacucgacc

SEQ ID NO: 1328269 - RNA, 22 nt, Human
ucuccaaguccccacucgaccc

SEQ ID NO: 1328270 - RNA, 20 nt, Human
ucugcgaagcaaaacuaauc

SEQ ID NO: 1328271 - RNA, 23 nt, Human
ucuuuugacacaaugaacucuga

SEQ ID NO: 1328272 - RNA, 24 nt, Human
ugagccaguggaaaagccugaaga

SEQ ID NO: 1328273 - RNA, 21 nt, Human
ugauugguccauuuuacaggg

SEQ ID NO: 1328274 - RNA, 20 nt, Human
uggcuucaccucucacaagc

SEQ ID NO: 1328275 - RNA, 24 nt, Human
uucaagguggcauggacccaaaaa

SEQ ID NO: 1328276 - RNA, 22 nt, Human
uucguggugaguguuacagcuc

SEQ ID NO: 1328277 - RNA, 21 nt, Human
uucuaacagagcguucuguga

SEQ ID NO: 1328278 - RNA, 19 nt, Human
uugguccauuuuacagagu

SEQ ID NO: 1328279 - RNA, 19 nt, Human
uugguccauuuuacagggu

SEQ ID NO: 1328280 - RNA, 20 nt, Human
uugguuccuuccgguggguu

SEQ ID NO: 1328281 - RNA, 23 nt, Human
uuucugggaaaauuguuuuucag

SEQ ID NO: 1328282 - RNA, 18 nt, Human
aaguuuccagaaugcagc

SEQ ID NO: 1328283 - RNA, 22 nt, Human
acaacugggccagguucuaugu

SEQ ID NO: 1328284 - RNA, 20 nt, Human
agucaaaaguaugcagcagc

SEQ ID NO: 1328285 - RNA, 18 nt, Human
ccugguaucacugaaaug

SEQ ID NO: 1328286 - RNA, 21 nt, Human
cugcagagcgcucuucuuggu

SEQ ID NO: 1328287 - RNA, 21 nt, Human
cuuguucugcuguccaggcug

SEQ ID NO: 1328288 - RNA, 22 nt, Human
cuuguucugcuguccaggcugg

SEQ ID NO: 1328289 - RNA, 22 nt, Human
gauggaguacaagaagguccag

SEQ ID NO: 1328290 - RNA, 22 nt, Human
ggaguacaagaagguccaguug

SEQ ID NO: 1328291 - RNA, 22 nt, Human
gguccaguuggcuguguauaug

SEQ ID NO: 1328292 - RNA, 25 nt, Human
ggucuuguucugcuguccaggcugg

SEQ ID NO: 1328293 - RNA, 20 nt, Human
guauauguaauauacacagg

SEQ ID NO: 1328294 - RNA, 20 nt, Human
guccaggcuggaguacaacu

SEQ ID NO: 1328295 - RNA, 20 nt, Human
ucaaaguuuccagaaugcag

SEQ ID NO: 1328296 - RNA, 22 nt, Human
ucugauauuuauggcuucccuu

SEQ ID NO: 1328297 - RNA, 19 nt, Human
ucuucuugguccacuaaau

SEQ ID NO: 1328298 - RNA, 20 nt, Human
ucuuguucugcuguccaggc

SEQ ID NO: 1328299 - RNA, 23 nt, Human
ucuuguucugcuguccaggcugg

SEQ ID NO: 1328300 - RNA, 24 nt, Human
ucuuguucugcuguccaggcugga

SEQ ID NO: 1328301 - RNA, 23 nt, Human
ugaaaugggcugaauagguucug

SEQ ID NO: 1328302 - RNA, 22 nt, Human
ugagacagggucuuguucugcu

SEQ ID NO: 1328303 - RNA, 22 nt, Human
ugcucggccuacgguaauuuua

SEQ ID NO: 1328304 - RNA, 20 nt, Human
uggguuugguaucacucgag

SEQ ID NO: 1328305 - RNA, 21 nt, Human
uggguuugguaucacucgagg

SEQ ID NO: 1328306 - RNA, 18 nt, Human
uguguauauguaauauac

SEQ ID NO: 1328307 - RNA, 24 nt, Human
uugucauaaaaauuauucauggcu

SEQ ID NO: 1328308 - RNA, 24 nt, Human
uuguucugcuguccaggcuggagu

SEQ ID NO: 1328309 - RNA, 22 nt, Human
uuugguaucacucgaggagaug

SEQ ID NO: 1328310 - RNA, 20 nt, Human
aggcugccgcccuggcagcu

SEQ ID NO: 1328311 - RNA, 20 nt, Human
gcccuggcagcucccagggc

SEQ ID NO: 1328312 - RNA, 20 nt, Human
aaaaagccccaaaugagaug

SEQ ID NO: 1328313 - RNA, 22 nt, Human
aagaaagaggcucuuuguucuc

SEQ ID NO: 1328314 - RNA, 22 nt, Human
acaaaaucaauaaaaucaguga

SEQ ID NO: 1328315 - RNA, 19 nt, Human
acacauuuccaaugcugcc

SEQ ID NO: 1328316 - RNA, 18 nt, Human
accauggggugccacagc

SEQ ID NO: 1328317 - RNA, 22 nt, Human
acccuggcagccgggaguucug

SEQ ID NO: 1328318 - RNA, 24 nt, Human
agaaagucgaugucaacaugagaa

SEQ ID NO: 1328319 - RNA, 24 nt, Human
agacaaaauaaccucccugugauc

SEQ ID NO: 1328320 - RNA, 20 nt, Human
agagacuguucugcacauug

SEQ ID NO: 1328321 - RNA, 20 nt, Human
agagcaggaagggccccuuc

SEQ ID NO: 1328322 - RNA, 20 nt, Human
agaguucuucccagcugcac

SEQ ID NO: 1328323 - RNA, 22 nt, Human
agaguucuucccagcugcacuc

SEQ ID NO: 1328324 - RNA, 23 nt, Human
aggcagggaaggaauaggauuag

SEQ ID NO: 1328325 - RNA, 20 nt, Human
agggaagccugacccucucu

SEQ ID NO: 1328326 - RNA, 18 nt, Human
augccucagcucugauga

SEQ ID NO: 1328327 - RNA, 25 nt, Human
caaaauaaccucccugugaucagac

SEQ ID NO: 1328328 - RNA, 20 nt, Human
caaaaucaauaaaaucagug

SEQ ID NO: 1328329 - RNA, 21 nt, Human
caaagcggacagccaucuguc

SEQ ID NO: 1328330 - RNA, 22 nt, Human
caaagcggacagccaucugucu

SEQ ID NO: 1328331 - RNA, 22 nt, Human
caacgaugggugcccaugcaug

SEQ ID NO: 1328332 - RNA, 20 nt, Human
cacugccaaaaagccccaaa

SEQ ID NO: 1328333 - RNA, 23 nt, Human
cagaacacugcagacacaccaug

SEQ ID NO: 1328334 - RNA, 18 nt, Human
cagagccucaaagcggac

SEQ ID NO: 1328335 - RNA, 18 nt, Human
cagcaaaacagguuuccc

SEQ ID NO: 1328336 - RNA, 19 nt, Human
cagcacgcagaccgucuug

SEQ ID NO: 1328337 - RNA, 21 nt, Human
ccagaacacugcagacacacc

SEQ ID NO: 1328338 - RNA, 21 nt, Human
ccagaacacugcagacacacc

SEQ ID NO: 1328339 - RNA, 23 nt, Human
ccagaacacugcagacacaccau

SEQ ID NO: 1328340 - RNA, 28 nt, Human
cccacagucacugugacccccucaacaa

SEQ ID NO: 1328341 - RNA, 21 nt, Human
cccacugccaaaaagccccaa

SEQ ID NO: 1328342 - RNA, 26 nt, Human
ccccaaaugagaugccguccuccucu

SEQ ID NO: 1328343 - RNA, 22 nt, Human
ccccaaggcaacaguguagucu

SEQ ID NO: 1328344 - RNA, 24 nt, Human
cccccacagucacugugacccccu

SEQ ID NO: 1328345 - RNA, 23 nt, Human
ccccucaugcauuugugaaacag

SEQ ID NO: 1328346 - RNA, 22 nt, Human
cccgacaagcccccaaggcaac

SEQ ID NO: 1328347 - RNA, 19 nt, Human
cccuggcagccgggaguuc

SEQ ID NO: 1328348 - RNA, 18 nt, Human
cccuggcccgacaagccc

SEQ ID NO: 1328349 - RNA, 21 nt, Human
ccucaacacacacacauuucc

SEQ ID NO: 1328350 - RNA, 24 nt, Human
cuacaauuggcauugaauggacca

SEQ ID NO: 1328351 - RNA, 18 nt, Human
cuccucauccucacacca

SEQ ID NO: 1328352 - RNA, 20 nt, Human
cuggcaggcagcccugcagg

SEQ ID NO: 1328353 - RNA, 22 nt, Human
cuucaaaaauaccagucucccu

SEQ ID NO: 1328354 - RNA, 21 nt, Human
cuuggcccuggcccgacaagc

SEQ ID NO: 1328355 - RNA, 18 nt, Human
gaacacugcagacacacc

SEQ ID NO: 1328356 - RNA, 18 nt, Human
gacacaccauggggugcc

SEQ ID NO: 1328357 - RNA, 20 nt, Human
gagcaggaagggccccuucu

SEQ ID NO: 1328358 - RNA, 18 nt, Human
gagccaagguccagggaa

SEQ ID NO: 1328359 - RNA, 21 nt, Human
gaugccguccuccucauccuc

SEQ ID NO: 1328360 - RNA, 23 nt, Human
gaugggugcccaugcaugugccc

SEQ ID NO: 1328361 - RNA, 22 nt, Human
gcccacugccaaaaagccccaa

SEQ ID NO: 1328362 - RNA, 22 nt, Human
gcccuggcccgacaagccccca

SEQ ID NO: 1328363 - RNA, 24 nt, Human
ggagcaaggggcuggggguagggg

SEQ ID NO: 1328364 - RNA, 23 nt, Human
ggguggggaguagguucccaggg

SEQ ID NO: 1328365 - RNA, 19 nt, Human
gugaaacagaagccccaga

SEQ ID NO: 1328366 - RNA, 18 nt, Human
guucaaggccaugccuca

SEQ ID NO: 1328367 - RNA, 23 nt, Human
uaaaaucagugaaucacaauuca

SEQ ID NO: 1328368 - RNA, 19 nt, Human
uaaaaugaggcccacugcc

SEQ ID NO: 1328369 - RNA, 18 nt, Human
uaagccccacugucuagc

SEQ ID NO: 1328370 - RNA, 20 nt, Human
uagaugccaggggugccccc

SEQ ID NO: 1328371 - RNA, 21 nt, Human
uaguaagccccacugucuagc

SEQ ID NO: 1328372 - RNA, 23 nt, Human
uaucauagagccccucuguuggg

SEQ ID NO: 1328373 - RNA, 21 nt, Human
uauccuggagagagcugaaau

SEQ ID NO: 1328374 - RNA, 21 nt, Human
ucaacacacacacauuuccaa

SEQ ID NO: 1328375 - RNA, 19 nt, Human
ucaacaugagaaagaaaga

SEQ ID NO: 1328376 - RNA, 23 nt, Human
ucauugaacucauucuuggcuac

SEQ ID NO: 1328377 - RNA, 20 nt, Human
ucccugugaucagacuuagc

SEQ ID NO: 1328378 - RNA, 21 nt, Human
ucugacagggagaaggcauug

SEQ ID NO: 1328379 - RNA, 21 nt, Human
ucuguccuggcccugcagcac

SEQ ID NO: 1328380 - RNA, 21 nt, Human
ugaaacagaagccccagagac

SEQ ID NO: 1328381 - RNA, 24 nt, Human
ugaaugaagggagcuacuucccuc

SEQ ID NO: 1328382 - RNA, 20 nt, Human
ugagaugccguccuccucau

SEQ ID NO: 1328383 - RNA, 22 nt, Human
ugccaaaaagccccaaaugaga

SEQ ID NO: 1328384 - RNA, 18 nt, Human
ugccaggggugcccccac

SEQ ID NO: 1328385 - RNA, 19 nt, Human
ugcccagaacacugcagac

SEQ ID NO: 1328386 - RNA, 18 nt, Human
ugccccugguuuaaagcc

SEQ ID NO: 1328387 - RNA, 18 nt, Human
ugccuggagggacaaccu

SEQ ID NO: 1328388 - RNA, 19 nt, Human
uggcccgacaagcccccaa

SEQ ID NO: 1328389 - RNA, 23 nt, Human
uggggaguagguucccaggggag

SEQ ID NO: 1328390 - RNA, 25 nt, Human
ugucagagacuguucugcacauugu

SEQ ID NO: 1328391 - RNA, 27 nt, Human
aacccggcccagccuagcccagcgggg

SEQ ID NO: 1328392 - RNA, 21 nt, Human
acacagccucccugguccucc

SEQ ID NO: 1328393 - RNA, 18 nt, Human
acuccuggugcccucccc

SEQ ID NO: 1328394 - RNA, 22 nt, Human
agcccaguccaacccggcccag

SEQ ID NO: 1328395 - RNA, 22 nt, Human
aggugaccagccaccauggagc

SEQ ID NO: 1328396 - RNA, 19 nt, Human
augaagcaggcauggcccu

SEQ ID NO: 1328397 - RNA, 18 nt, Human
caccauggagcagcccca

SEQ ID NO: 1328398 - RNA, 20 nt, Human
caccgcucuucacuccucgc

SEQ ID NO: 1328399 - RNA, 23 nt, Human
caccucgugcugggcgccgggga

SEQ ID NO: 1328400 - RNA, 26 nt, Human
cagcccccuccccuuaggcucugucc

SEQ ID NO: 1328401 - RNA, 23 nt, Human
ccaagccuggcacguuccccagg

SEQ ID NO: 1328402 - RNA, 22 nt, Human
ccagccaccauggagcagcccc

SEQ ID NO: 1328403 - RNA, 24 nt, Human
ccagccaccauggagcagccccaa

SEQ ID NO: 1328404 - RNA, 24 nt, Human
ccagggcuccuggcagcccccucc

SEQ ID NO: 1328405 - RNA, 24 nt, Human
cccaccgcucuucacuccucgccc

SEQ ID NO: 1328406 - RNA, 18 nt, Human
ccccagcccaguccaacc

SEQ ID NO: 1328407 - RNA, 22 nt, Human
ccccagcccaguccaacccggc

SEQ ID NO: 1328408 - RNA, 24 nt, Human
ccucgcugcgacacagccucccug

SEQ ID NO: 1328409 - RNA, 24 nt, Human
ccucgugcugggcgccggggaagc

SEQ ID NO: 1328410 - RNA, 22 nt, Human
cgccccagcccaguccaacccg

SEQ ID NO: 1328411 - RNA, 18 nt, Human
cucgccccagcccagucc

SEQ ID NO: 1328412 - RNA, 21 nt, Human
cugcacaggcucuccugggug

SEQ ID NO: 1328413 - RNA, 21 nt, Human
cuggugcccuccccagaugug

SEQ ID NO: 1328414 - RNA, 21 nt, Human
gaagcaggcauggcccugacc

SEQ ID NO: 1328415 - RNA, 23 nt, Human
gacacagccucccugguccuccc

SEQ ID NO: 1328416 - RNA, 21 nt, Human
gcgccggggaagcgcucgcgc

SEQ ID NO: 1328417 - RNA, 19 nt, Human
gcgcucccugguuccccac

SEQ ID NO: 1328418 - RNA, 19 nt, Human
ggcagcccccuccccuuag

SEQ ID NO: 1328419 - RNA, 20 nt, Human
gguuccccaccgcucuucac

SEQ ID NO: 1328420 - RNA, 26 nt, Human
guggagggcgcaccucgaccccacag

SEQ ID NO: 1328421 - RNA, 25 nt, Human
guggagggcgcaccucgaccccacg

SEQ ID NO: 1328422 - RNA, 19 nt, Human
uccccagcgcucccugguu

SEQ ID NO: 1328423 - RNA, 25 nt, Human
uccccagcgcucccugguuccccac

SEQ ID NO: 1328424 - RNA, 25 nt, Human
uccccaggcugcacaggcucuccug

SEQ ID NO: 1328425 - RNA, 19 nt, Human
ucccccagaccagggcucc

SEQ ID NO: 1328426 - RNA, 21 nt, Human
ucccccagaccagggcuccug

SEQ ID NO: 1328427 - RNA, 19 nt, Human
ucccugguuccccaccgcu

SEQ ID NO: 1328428 - RNA, 24 nt, Human
ucgcugcgacacagccucccuggu

SEQ ID NO: 1328429 - RNA, 18 nt, Human
ucugucccugacccucgc

SEQ ID NO: 1328430 - RNA, 22 nt, Human
ugacccucgcugcgacacagcc

SEQ ID NO: 1328431 - RNA, 24 nt, Human
aaaaaaauaaacuaucacuaguua

SEQ ID NO: 1328432 - RNA, 27 nt, Human
aaaauaaacuaucacuaguuacauaaa

SEQ ID NO: 1328433 - RNA, 18 nt, Human
aaacaagaaaauucaugc

SEQ ID NO: 1328434 - RNA, 26 nt, Human
aaaccaccccccaacccuaaaagcuc

SEQ ID NO: 1328435 - RNA, 20 nt, Human
aacgguucuucuuuuucuuu

SEQ ID NO: 1328436 - RNA, 21 nt, Human
aagacagcaagagugaggagu

SEQ ID NO: 1328437 - RNA, 18 nt, Human
aagagauagcaaaccacc

SEQ ID NO: 1328438 - RNA, 23 nt, Human
aaucuuuagcuaucaaguucaaa

SEQ ID NO: 1328439 - RNA, 23 nt, Human
acauguucugugcauauaccacu

SEQ ID NO: 1328440 - RNA, 21 nt, Human
acccuaaaagcuccuuccccu

SEQ ID NO: 1328441 - RNA, 21 nt, Human
agacaacaaacuuuuaaaaca

SEQ ID NO: 1328442 - RNA, 19 nt, Human
agcagccuucuuuuucuuc

SEQ ID NO: 1328443 - RNA, 23 nt, Human
agcagccuucuuuuucuucuucu

SEQ ID NO: 1328444 - RNA, 23 nt, Human
agcuuuuggggcuuucucaugcu

SEQ ID NO: 1328445 - RNA, 19 nt, Human
aggcaaaauuguacaucaa

SEQ ID NO: 1328446 - RNA, 22 nt, Human
agucaucuggucauuucugauu

SEQ ID NO: 1328447 - RNA, 22 nt, Human
auaaaauuuuccugacugguua

SEQ ID NO: 1328448 - RNA, 23 nt, Human
auaaaauuuuccugacugguuaa

SEQ ID NO: 1328449 - RNA, 21 nt, Human
auccuuuucuuucucaguucc

SEQ ID NO: 1328450 - RNA, 23 nt, Human
caaaaguauuaauuuuauuccca

SEQ ID NO: 1328451 - RNA, 19 nt, Human
caaagcagcauaugacagc

SEQ ID NO: 1328452 - RNA, 18 nt, Human
cagcauccaaagaugaca

SEQ ID NO: 1328453 - RNA, 23 nt, Human
cagccuaaacaaaauucauacaa

SEQ ID NO: 1328454 - RNA, 22 nt, Human
cagcucugaccuccccgugaag

SEQ ID NO: 1328455 - RNA, 18 nt, Human
caguaaagggcaagacug

SEQ ID NO: 1328456 - RNA, 21 nt, Human
cauaguaaugaacuuaagaag

SEQ ID NO: 1328457 - RNA, 21 nt, Human
cauuauuacuaaaguggaggu

SEQ ID NO: 1328458 - RNA, 22 nt, Human
ccaaaaacaagaaaauucaugc

SEQ ID NO: 1328459 - RNA, 25 nt, Human
ccaaauaucuuaaccacuaguacga

SEQ ID NO: 1328460 - RNA, 20 nt, Human
ccaagccaaaguguagucag

SEQ ID NO: 1328461 - RNA, 23 nt, Human
cccaagccaaaguguagucaaaa

SEQ ID NO: 1328462 - RNA, 18 nt, Human
cccccaacccuaaaagcu

SEQ ID NO: 1328463 - RNA, 19 nt, Human
cccccaacccuaaaagcuc

SEQ ID NO: 1328464 - RNA, 22 nt, Human
cccccaacccuaaaagcuccuu

SEQ ID NO: 1328465 - RNA, 22 nt, Human
ccccccaacccuaaaagcuccc

SEQ ID NO: 1328466 - RNA, 21 nt, Human
cuaaagagauagcaaaccacc

SEQ ID NO: 1328467 - RNA, 18 nt, Human
cuacagaguaaggguuuu

SEQ ID NO: 1328468 - RNA, 22 nt, Human
cuagcagccuucuuuuucuucu

SEQ ID NO: 1328469 - RNA, 23 nt, Human
cuuaagacagcaagagugaggag

SEQ ID NO: 1328470 - RNA, 20 nt, Human
cuuguuucuuauccucaucu

SEQ ID NO: 1328471 - RNA, 24 nt, Human
gcaaaccaccccccaacccuaaaa

SEQ ID NO: 1328472 - RNA, 21 nt, Human
gcauccaaagaugacacuaag

SEQ ID NO: 1328473 - RNA, 19 nt, Human
gcuaaagagauagcaaacc

SEQ ID NO: 1328474 - RNA, 23 nt, Human
ggaugugugaggaucaaaggcac

SEQ ID NO: 1328475 - RNA, 26 nt, Human
uaaaacauuacauuuacuaagauucu

SEQ ID NO: 1328476 - RNA, 22 nt, Human
uaaaauacacuuaucuacagag

SEQ ID NO: 1328477 - RNA, 21 nt, Human
uaaaauagcuauuuauucagc

SEQ ID NO: 1328478 - RNA, 18 nt, Human
uaaaguggagguaaaucc

SEQ ID NO: 1328479 - RNA, 22 nt, Human
uaacacauucuaaugcuaaaaa

SEQ ID NO: 1328480 - RNA, 19 nt, Human
uaagcucaguaaagggcaa

SEQ ID NO: 1328481 - RNA, 18 nt, Human
uaaggguuuugaaauauu

SEQ ID NO: 1328482 - RNA, 24 nt, Human
uacaaagacaacaaacuuuuaaaa

SEQ ID NO: 1328483 - RNA, 24 nt, Human
uacuaagauucuggcaauaagaca

SEQ ID NO: 1328484 - RNA, 19 nt, Human
uauacgaggggaaaaaauu

SEQ ID NO: 1328485 - RNA, 19 nt, Human
uauguuguaguuuucacag

SEQ ID NO: 1328486 - RNA, 23 nt, Human
ucacucaaagcagcauaugacag

SEQ ID NO: 1328487 - RNA, 23 nt, Human
ucagcaguagacaugaggcacaa

SEQ ID NO: 1328488 - RNA, 21 nt, Human
ucaucuggucauuucugauua

SEQ ID NO: 1328489 - RNA, 21 nt, Human
uccaaaaacaagaaaauucau

SEQ ID NO: 1328490 - RNA, 23 nt, Human
uccccagguaaauaaaaguauac

SEQ ID NO: 1328491 - RNA, 21 nt, Human
ucgcaccuccucaauauacuc

SEQ ID NO: 1328492 - RNA, 21 nt, Human
ugaaauauuaauguaaucccu

SEQ ID NO: 1328493 - RNA, 22 nt, Human
ugaagcauggcuacugugucca

SEQ ID NO: 1328494 - RNA, 23 nt, Human
ugacacagggagagcaauaaugu

SEQ ID NO: 1328495 - RNA, 22 nt, Human
ugacagcauccaaagaugacug

SEQ ID NO: 1328496 - RNA, 20 nt, Human
ugacauggagcuuucagaag

SEQ ID NO: 1328497 - RNA, 18 nt, Human
ugcugcaaauggcuguuu

SEQ ID NO: 1328498 - RNA, 18 nt, Human
ugcugguagccagcucug

SEQ ID NO: 1328499 - RNA, 18 nt, Human
uggagcuuucagaagauu

SEQ ID NO: 1328500 - RNA, 27 nt, Human
ugucuauuuaaaauaauuccucuccca

SEQ ID NO: 1328501 - RNA, 21 nt, Human
ugugaacgguucuucuuuuuc

SEQ ID NO: 1328502 - RNA, 20 nt, Human
ugugaggaucaaaggcacac

SEQ ID NO: 1328503 - RNA, 22 nt, Human
uuaagacagcaagagugaggag

SEQ ID NO: 1328504 - RNA, 21 nt, Human
uuaauauacaaagacaacaaa

SEQ ID NO: 1328505 - RNA, 24 nt, Human
uucucaguuccaucuuuugacuuc

SEQ ID NO: 1328506 - RNA, 21 nt, Human
uuucacaguugaaauuuccuc

SEQ ID NO: 1328507 - RNA, 22 nt, Human
uuuuuuccuguugcuuuuucuc

SEQ ID NO: 1328508 - RNA, 19 nt, Human
cccucuucucuucucucuc

SEQ ID NO: 1328509 - RNA, 23 nt, Human
ccuccuccucauuuucccugagc

SEQ ID NO: 1328510 - RNA, 18 nt, Human
cgagucaguccuggagca

SEQ ID NO: 1328511 - RNA, 23 nt, Human
cucuucucucuccucuauccuug

SEQ ID NO: 1328512 - RNA, 22 nt, Human
cucuucucuucucucuccucua

SEQ ID NO: 1328513 - RNA, 18 nt, Human
cuucucucuccucuaucc

SEQ ID NO: 1328514 - RNA, 23 nt, Human
uccucauuuucccugagcagugg

SEQ ID NO: 1328515 - RNA, 19 nt, Human
uccuggaaaauguucugcu

SEQ ID NO: 1328516 - RNA, 23 nt, Human
uccuggagcaucaugucuuuggu

SEQ ID NO: 1328517 - RNA, 20 nt, Human
ucucccucuucucuucucuc

SEQ ID NO: 1328518 - RNA, 23 nt, Human
ucugcuguucucccucuucucuu

SEQ ID NO: 1328519 - RNA, 19 nt, Human
ucuucucuucucucuccuc

SEQ ID NO: 1328520 - RNA, 18 nt, Human
aaacaagaaaagcccuga

SEQ ID NO: 1328521 - RNA, 19 nt, Human
acaagaaaagcccugacgc

SEQ ID NO: 1328522 - RNA, 18 nt, Human
caagaaaagcccugacgc

SEQ ID NO: 1328523 - RNA, 20 nt, Human
cccgcccagucccgcccgcc

SEQ ID NO: 1328524 - RNA, 24 nt, Human
ccgcccgccgagguccguguccaa

SEQ ID NO: 1328525 - RNA, 19 nt, Human
ccgccgagguccgugucca

SEQ ID NO: 1328526 - RNA, 19 nt, Human
gauccuccucgcgcacccc

SEQ ID NO: 1328527 - RNA, 22 nt, Human
gggaaagauggugaaaaaaugc

SEQ ID NO: 1328528 - RNA, 23 nt, Human
ggugaaaaaaugcgaggaaaaga

SEQ ID NO: 1328529 - RNA, 30 nt, Human
uaacuuuauuaaacaagaaaagcccugacu

SEQ ID NO: 1328530 - RNA, 23 nt, Human
uauuaaacaagaaaagcccugac

SEQ ID NO: 1328531 - RNA, 20 nt, Human
ugaugccccgccccgcccag

SEQ ID NO: 1328532 - RNA, 23 nt, Human
uuggcuccuggagauugagggaa

SEQ ID NO: 1328533 - RNA, 21 nt, Human
aaaacauuaccugaaugaguu

SEQ ID NO: 1328534 - RNA, 18 nt, Human
aagaagccgaauaaggga

SEQ ID NO: 1328535 - RNA, 20 nt, Human
aaggaaaagcaggaauaaug

SEQ ID NO: 1328536 - RNA, 22 nt, Human
aauaagggaacacuaggaaaaa

SEQ ID NO: 1328537 - RNA, 20 nt, Human
aauuucuccauuuccaaaga

SEQ ID NO: 1328538 - RNA, 21 nt, Human
acaaaaaaucguuuccccuca

SEQ ID NO: 1328539 - RNA, 18 nt, Human
agcuauuuagaccucauu

SEQ ID NO: 1328540 - RNA, 23 nt, Human
aggauaaaagugacaaaaaagga

SEQ ID NO: 1328541 - RNA, 22 nt, Human
augaagccaaugguguuaugcu

SEQ ID NO: 1328542 - RNA, 23 nt, Human
cacaaaaaaucguuuccccucac

SEQ ID NO: 1328543 - RNA, 24 nt, Human
cauacccacuugaaaaaucaaagg

SEQ ID NO: 1328544 - RNA, 23 nt, Human
ccaaagaagccgaauaagggaac

SEQ ID NO: 1328545 - RNA, 19 nt, Human
cuaggaggcauacccacuu

SEQ ID NO: 1328546 - RNA, 20 nt, Human
cuaggaggcauacccacuug

SEQ ID NO: 1328547 - RNA, 19 nt, Human
gaggcauacccacuugaaa

SEQ ID NO: 1328548 - RNA, 27 nt, Human
gggaacacuaggaaaaaaccgguaccc

SEQ ID NO: 1328549 - RNA, 19 nt, Human
uacccacuugaaaaaucaa

SEQ ID NO: 1328550 - RNA, 25 nt, Human
uccauuguccagaacacagucauac

SEQ ID NO: 1328551 - RNA, 21 nt, Human
ugaaaugcaaaacauuaccug

SEQ ID NO: 1328552 - RNA, 22 nt, Human
ugacaaaaaaggaaaagcagga

SEQ ID NO: 1328553 - RNA, 19 nt, Human
uguuaugcucuggaauguu

SEQ ID NO: 1328554 - RNA, 25 nt, Human
uuagauauuuguacagaaauucaac

SEQ ID NO: 1328555 - RNA, 21 nt, Human
uucuaaaugcaucagccucaa

SEQ ID NO: 1328556 - RNA, 23 nt, Human
acagacagacgugcacacugagg

SEQ ID NO: 1328557 - RNA, 23 nt, Human
accccuuccgcccucaggccccu

SEQ ID NO: 1328558 - RNA, 18 nt, Human
accuaccuccuggccagc

SEQ ID NO: 1328559 - RNA, 19 nt, Human
acugaggccaccgaaggac

SEQ ID NO: 1328560 - RNA, 20 nt, Human
agagcaggaaggaaggcugg

SEQ ID NO: 1328561 - RNA, 22 nt, Human
agcacagagagccuggcuccgg

SEQ ID NO: 1328562 - RNA, 26 nt, Human
agccacaagcacagacggacagacag

SEQ ID NO: 1328563 - RNA, 19 nt, Human
agcuggccugugaaccacu

SEQ ID NO: 1328564 - RNA, 28 nt, Human
aggaaggcuggccucggcagugagaggc

SEQ ID NO: 1328565 - RNA, 24 nt, Human
agggacuggccggcgaaaugggag

SEQ ID NO: 1328566 - RNA, 21 nt, Human
caacccccggccagcuggccu

SEQ ID NO: 1328567 - RNA, 21 nt, Human
caagcacagacggacagacag

SEQ ID NO: 1328568 - RNA, 19 nt, Human
cacagagagccuggcuccg

SEQ ID NO: 1328569 - RNA, 22 nt, Human
caggccccucuuccugccucuc

SEQ ID NO: 1328570 - RNA, 24 nt, Human
cagggcaguggggcauggagccgg

SEQ ID NO: 1328571 - RNA, 19 nt, Human
caucggccaggcuucugag

SEQ ID NO: 1328572 - RNA, 25 nt, Human
cauggcacugagagagcagagcagg

SEQ ID NO: 1328573 - RNA, 18 nt, Human
ccaggcuucugagggaag

SEQ ID NO: 1328574 - RNA, 28 nt, Human
cccaaaagcacccaucggccaggcuucu

SEQ ID NO: 1328575 - RNA, 24 nt, Human
ccccaaaccccuuccgcccucagg

SEQ ID NO: 1328576 - RNA, 21 nt, Human
ccccggccagcuggccuguga

SEQ ID NO: 1328577 - RNA, 20 nt, Human
ccuccgugucaguccuccuc

SEQ ID NO: 1328578 - RNA, 21 nt, Human
ccuuccgcccucaggccccuc

SEQ ID NO: 1328579 - RNA, 21 nt, Human
cgaaaugggagccccaaaccc

SEQ ID NO: 1328580 - RNA, 23 nt, Human
cuccccaacccccggccagcugg

SEQ ID NO: 1328581 - RNA, 19 nt, Human
cucgcagcucagucaccgu

SEQ ID NO: 1328582 - RNA, 23 nt, Human
cucggcagugagaggccugugug

SEQ ID NO: 1328583 - RNA, 23 nt, Human
cugagaggcuccccaaaagcacc

SEQ ID NO: 1328584 - RNA, 22 nt, Human
cugaggccaccgaaggacucau

SEQ ID NO: 1328585 - RNA, 21 nt, Human
gcacaguagucacgggucgug

SEQ ID NO: 1328586 - RNA, 20 nt, Human
gcagcucagucaccgugggg

SEQ ID NO: 1328587 - RNA, 19 nt, Human
gcaguggggcauggagccg

SEQ ID NO: 1328588 - RNA, 23 nt, Human
gcgaagccaggucugguggccuu

SEQ ID NO: 1328589 - RNA, 25 nt, Human
gcgagcggguccugcgugucugcgg

SEQ ID NO: 1328590 - RNA, 23 nt, Human
gcuguggcgggggaccucagcca

SEQ ID NO: 1328591 - RNA, 20 nt, Human
ggacggguaagcaggagggc

SEQ ID NO: 1328592 - RNA, 21 nt, Human
ggccccucuuccugccucucc

SEQ ID NO: 1328593 - RNA, 21 nt, Human
ggccucggcagugagaggccu

SEQ ID NO: 1328594 - RNA, 19 nt, Human
gggcauggagccggcugcu

SEQ ID NO: 1328595 - RNA, 20 nt, Human
ggguaagcaggagggcgagc

SEQ ID NO: 1328596 - RNA, 18 nt, Human
ggucugguggccuugccc

SEQ ID NO: 1328597 - RNA, 18 nt, Human
gugggguggguggaggca

SEQ ID NO: 1328598 - RNA, 18 nt, Human
gugggguggguggaggca

SEQ ID NO: 1328599 - RNA, 19 nt, Human
uagccacaagcacagacgg

SEQ ID NO: 1328600 - RNA, 19 nt, Human
ucaguccuccuccccugcc

SEQ ID NO: 1328601 - RNA, 20 nt, Human
ucaguccuccuccccugcca

SEQ ID NO: 1328602 - RNA, 21 nt, Human
ucggcagugagaggccugugu

SEQ ID NO: 1328603 - RNA, 19 nt, Human
uguguggcuccccaacccc

SEQ ID NO: 1328604 - RNA, 20 nt, Human
aaaggccccaauguuaacau

SEQ ID NO: 1328605 - RNA, 18 nt, Human
accagauacaagcccauc

SEQ ID NO: 1328606 - RNA, 21 nt, Human
agaaggcagcuuuugugaaag

SEQ ID NO: 1328607 - RNA, 24 nt, Human
agaaggcagcuuuugugaaaguug

SEQ ID NO: 1328608 - RNA, 18 nt, Human
agcaggaauuacagaucc

SEQ ID NO: 1328609 - RNA, 19 nt, Human
agcaggaauuacagaucca

SEQ ID NO: 1328610 - RNA, 21 nt, Human
aggacacugccuguugacuuc

SEQ ID NO: 1328611 - RNA, 25 nt, Human
aggaggcuuuggugaaagauaacca

SEQ ID NO: 1328612 - RNA, 21 nt, Human
aggcuuuggugaaagauaacc

SEQ ID NO: 1328613 - RNA, 20 nt, Human
aguggaaaguucucugucuu

SEQ ID NO: 1328614 - RNA, 19 nt, Human
ccauaaacaugccucuagu

SEQ ID NO: 1328615 - RNA, 27 nt, Human
ccauaaacaugccucuaguaucauccu

SEQ ID NO: 1328616 - RNA, 22 nt, Human
cccaggaagaauacauugugcc

SEQ ID NO: 1328617 - RNA, 21 nt, Human
ccuagcugaaggucugacaca

SEQ ID NO: 1328618 - RNA, 19 nt, Human
ccuagcuucacguugucuc

SEQ ID NO: 1328619 - RNA, 21 nt, Human
cggaagccuccuccaaccucc

SEQ ID NO: 1328620 - RNA, 23 nt, Human
cucaaguuggaguucacugagaa

SEQ ID NO: 1328621 - RNA, 19 nt, Human
cucguauaaccaauagucu

SEQ ID NO: 1328622 - RNA, 19 nt, Human
gaagaauacauugugcccc

SEQ ID NO: 1328623 - RNA, 19 nt, Human
gagaacuuucuggggaaga

SEQ ID NO: 1328624 - RNA, 21 nt, Human
gagcaggaauuacagauccag

SEQ ID NO: 1328625 - RNA, 19 nt, Human
gcuucggaugcacuaacug

SEQ ID NO: 1328626 - RNA, 19 nt, Human
ggaagccuccuccaaccuc

SEQ ID NO: 1328627 - RNA, 21 nt, Human
gugucugaggaggaugauucu

SEQ ID NO: 1328628 - RNA, 18 nt, Human
gugugaggcguggaugac

SEQ ID NO: 1328629 - RNA, 21 nt, Human
uaaaaguuucuuugaggcucu

SEQ ID NO: 1328630 - RNA, 21 nt, Human
uacgguauucuaauagagaaa

SEQ ID NO: 1328631 - RNA, 21 nt, Human
ucagggcucuuuacccaggaa

SEQ ID NO: 1328632 - RNA, 22 nt, Human
ucaguuaaauuagaauuucuaa

SEQ ID NO: 1328633 - RNA, 19 nt, Human
uccaggguuuuauguaggg

SEQ ID NO: 1328634 - RNA, 27 nt, Human
ucgcugagguguuccaacuugagguug

SEQ ID NO: 1328635 - RNA, 28 nt, Human
ucggaagccuccuccaaccuccaacuga

SEQ ID NO: 1328636 - RNA, 19 nt, Human
ucugucagggcucuuuacc

SEQ ID NO: 1328637 - RNA, 21 nt, Human
ugaauauuuucccgugugcuu

SEQ ID NO: 1328638 - RNA, 23 nt, Human
ugacacagguuccuuuucuccag

SEQ ID NO: 1328639 - RNA, 20 nt, Human
ugagcaggaauuacagaucc

SEQ ID NO: 1328640 - RNA, 26 nt, Human
ugagcaggaauuacagauccagguga

SEQ ID NO: 1328641 - RNA, 18 nt, Human
ugaguauuggcuggaagg

SEQ ID NO: 1328642 - RNA, 22 nt, Human
ugcaacuuuguuggcacagaag

SEQ ID NO: 1328643 - RNA, 22 nt, Human
ugcuguacaggugugugaggcg

SEQ ID NO: 1328644 - RNA, 22 nt, Human
uggauucuggggugugcaauuc

SEQ ID NO: 1328645 - RNA, 21 nt, Human
uggggaagaaauauucucaaa

SEQ ID NO: 1328646 - RNA, 24 nt, Human
uggggaucugguuuugugaauauu

SEQ ID NO: 1328647 - RNA, 24 nt, Human
uggggugauacacuaaugagugga

SEQ ID NO: 1328648 - RNA, 18 nt, Human
uggugaaagauaaccaug

SEQ ID NO: 1328649 - RNA, 22 nt, Human
ugugaauauuuucccgugugcu

SEQ ID NO: 1328650 - RNA, 21 nt, Human
ugugcaggcguuuccaggguu

SEQ ID NO: 1328651 - RNA, 18 nt, Human
uucuaggugaggugaugg

SEQ ID NO: 1328652 - RNA, 23 nt, Human
uucuaggugaggugauggaggac

SEQ ID NO: 1328653 - RNA, 22 nt, Human
uucuugcagacccaguucaguu

SEQ ID NO: 1328654 - RNA, 24 nt, Human
uuggcacagaaggcagcuuuugug

SEQ ID NO: 1328655 - RNA, 19 nt, Human
uuguuggcacagaaggcag

SEQ ID NO: 1328656 - RNA, 24 nt, Human
uuucccgugugcuugagcaggaau

SEQ ID NO: 1328657 - RNA, 20 nt, Human
uuuuccuagcuucacguugu

SEQ ID NO: 1328658 - RNA, 22 nt, Human
uuuuccuagcuucacguugucu

SEQ ID NO: 1328659 - RNA, 21 nt, Human
cacuuccauuccaggauggga

SEQ ID NO: 1328660 - RNA, 21 nt, Human
cucuucccaaggcagccuuag

SEQ ID NO: 1328661 - RNA, 22 nt, Human
ggcaacucuuaguagguaacac

SEQ ID NO: 1328662 - RNA, 18 nt, Human
ucccaaggcagccuuagc

SEQ ID NO: 1328663 - RNA, 21 nt, Human
uggagauuauagauggagguu

SEQ ID NO: 1328664 - RNA, 25 nt, Human
ccuagaaaaccauauuuucccauuu

SEQ ID NO: 1328665 - RNA, 22 nt, Human
gaaaaggagccuuaguguccug

SEQ ID NO: 1328666 - RNA, 18 nt, Human
gaaguuuucccuagcucu

SEQ ID NO: 1328667 - RNA, 24 nt, Human
ucucuaaaauagagccucaacuuu

SEQ ID NO: 1328668 - RNA, 18 nt, Human
ugagacugguaaaaggcu

SEQ ID NO: 1328669 - RNA, 23 nt, Human
uguauuagaaauaucuuugugca

SEQ ID NO: 1328670 - RNA, 24 nt, Human
uugaaguuuucccuagcucuuucu

SEQ ID NO: 1328671 - RNA, 24 nt, Human
aaauccacugcagauuaggggugg

SEQ ID NO: 1328672 - RNA, 20 nt, Human
accccuuguccagcagccuc

SEQ ID NO: 1328673 - RNA, 21 nt, Human
acugcccccuggcugauguac

SEQ ID NO: 1328674 - RNA, 18 nt, Human
agauccuccaggguagca

SEQ ID NO: 1328675 - RNA, 23 nt, Human
agugcugcgucuuuggcacugcc

SEQ ID NO: 1328676 - RNA, 20 nt, Human
cacacucuccagcuccuucc

SEQ ID NO: 1328677 - RNA, 19 nt, Human
caccagaaguggcuguguc

SEQ ID NO: 1328678 - RNA, 22 nt, Human
cacugaguugacugauuauugc

SEQ ID NO: 1328679 - RNA, 22 nt, Human
cagaugaugcauggccuucccc

SEQ ID NO: 1328680 - RNA, 21 nt, Human
cagccucucauccugcuccug

SEQ ID NO: 1328681 - RNA, 22 nt, Human
caucuccuccugguccugggcc

SEQ ID NO: 1328682 - RNA, 21 nt, Human
ccagaaguggcugugucaggg

SEQ ID NO: 1328683 - RNA, 21 nt, Human
ccagcagccucuccuguuccu

SEQ ID NO: 1328684 - RNA, 21 nt, Human
ccagcagccucuccuguuccu

SEQ ID NO: 1328685 - RNA, 20 nt, Human
ccccaggugagugguaacca

SEQ ID NO: 1328686 - RNA, 18 nt, Human
cccguagauaccuguugc

SEQ ID NO: 1328687 - RNA, 21 nt, Human
cccguagauaccuguugcuga

SEQ ID NO: 1328688 - RNA, 22 nt, Human
cccguagauaccuguugcugaa

SEQ ID NO: 1328689 - RNA, 22 nt, Human
ccucuccagcucccacagaguc

SEQ ID NO: 1328690 - RNA, 18 nt, Human
ccugacgauguccuccuc

SEQ ID NO: 1328691 - RNA, 23 nt, Human
ccugcagccucuccuccugucuc

SEQ ID NO: 1328692 - RNA, 25 nt, Human
ccugcagccucuccuccugucuccu

SEQ ID NO: 1328693 - RNA, 22 nt, Human
ccugcuccugaagccucuccug

SEQ ID NO: 1328694 - RNA, 20 nt, Human
ccuuguccagcagccucucc

SEQ ID NO: 1328695 - RNA, 21 nt, Human
cuccugucuccuguucaggag

SEQ ID NO: 1328696 - RNA, 24 nt, Human
cugaagccucuccuguuccagcag

SEQ ID NO: 1328697 - RNA, 23 nt, Human
cugcagccucuccuccugucucc

SEQ ID NO: 1328698 - RNA, 22 nt, Human
cuguuagcuccugcuggaaugc

SEQ ID NO: 1328699 - RNA, 20 nt, Human
gcacugcccccuggcugaug

SEQ ID NO: 1328700 - RNA, 19 nt, Human
gccacagccucucauccug

SEQ ID NO: 1328701 - RNA, 21 nt, Human
gcccccuggcugauguacuuu

SEQ ID NO: 1328702 - RNA, 22 nt, Human
gccuggagcugucuucccacac

SEQ ID NO: 1328703 - RNA, 21 nt, Human
gcuccugaagccucuccuguu

SEQ ID NO: 1328704 - RNA, 19 nt, Human
gcuggaaugccagggcucu

SEQ ID NO: 1328705 - RNA, 19 nt, Human
ggcucuggggccagggguu

SEQ ID NO: 1328706 - RNA, 25 nt, Human
gggggcucuggggccagggguucag

SEQ ID NO: 1328707 - RNA, 20 nt, Human
ggggugguagucaggguccc

SEQ ID NO: 1328708 - RNA, 22 nt, Human
ggucucaucuuguagcugcucc

SEQ ID NO: 1328709 - RNA, 23 nt, Human
uagcagaugaugcauggccuucc

SEQ ID NO: 1328710 - RNA, 23 nt, Human
uauugcggagcuugagugcaggg

SEQ ID NO: 1328711 - RNA, 24 nt, Human
ucaguggugaucuucaucuccucc

SEQ ID NO: 1328712 - RNA, 23 nt, Human
uccugcuccugaagccucuccug

SEQ ID NO: 1328713 - RNA, 20 nt, Human
ucucaucuuguagcugcucc

SEQ ID NO: 1328714 - RNA, 20 nt, Human
ucuccagcucccacagaguc

SEQ ID NO: 1328715 - RNA, 28 nt, Human
ucuccagcuccuuccuuagggggccgcc

SEQ ID NO: 1328716 - RNA, 24 nt, Human
ucuccugcugccacagccucucau

SEQ ID NO: 1328717 - RNA, 20 nt, Human
ucuuuggcacugcccccugg

SEQ ID NO: 1328718 - RNA, 18 nt, Human
ugaagcucuaguuucucc

SEQ ID NO: 1328719 - RNA, 21 nt, Human
ugagugguaaccaccagaagu

SEQ ID NO: 1328720 - RNA, 22 nt, Human
ugaguugacugauuauugcgga

SEQ ID NO: 1328721 - RNA, 20 nt, Human
ugcgucuuuggcacugcccu

SEQ ID NO: 1328722 - RNA, 21 nt, Human
ugcugcgucuuuggcacugcc

SEQ ID NO: 1328723 - RNA, 24 nt, Human
uggagcugucuucccacacucucc

SEQ ID NO: 1328724 - RNA, 21 nt, Human
uggcacugcccccuggcugau

SEQ ID NO: 1328725 - RNA, 22 nt, Human
uggcugauguacuuucucaugg

SEQ ID NO: 1328726 - RNA, 19 nt, Human
uguccagcagccucuccug

SEQ ID NO: 1328727 - RNA, 24 nt, Human
uguucaggagacucaacaucugau

SEQ ID NO: 1328728 - RNA, 19 nt, Human
uucaguggugaucuucauc

SEQ ID NO: 1328729 - RNA, 19 nt, Human
uuccaccucagccuggagc

SEQ ID NO: 1328730 - RNA, 19 nt, Human
acauugacauuaaauauau

SEQ ID NO: 1328731 - RNA, 22 nt, Human
cacaucaacauugacauuaaau

SEQ ID NO: 1328732 - RNA, 24 nt, Human
cacuucuuuccaucucucauggga

SEQ ID NO: 1328733 - RNA, 24 nt, Human
cugagggcagagacuaugacuuac

SEQ ID NO: 1328734 - RNA, 24 nt, Human
uauaaauugccugagggcagagac

SEQ ID NO: 1328735 - RNA, 24 nt, Human
ucuauacugcuauaugucuuugag

SEQ ID NO: 1328736 - RNA, 19 nt, Human
ugaaagggagaacaaugca

SEQ ID NO: 1328737 - RNA, 21 nt, Human
agacauaugggagaggucaga

SEQ ID NO: 1328738 - RNA, 19 nt, Human
agacugccacgugaccggc

SEQ ID NO: 1328739 - RNA, 23 nt, Human
agaggucagagaacuggcgagcc

SEQ ID NO: 1328740 - RNA, 23 nt, Human
agcugcagcagaguccuaagcag

SEQ ID NO: 1328741 - RNA, 20 nt, Human
aggccagugcuaggugggga

SEQ ID NO: 1328742 - RNA, 18 nt, Human
auggggaaacccagugcc

SEQ ID NO: 1328743 - RNA, 21 nt, Human
ccuccaaccagggaaggcggg

SEQ ID NO: 1328744 - RNA, 21 nt, Human
ccucugaagcagagaagcaga

SEQ ID NO: 1328745 - RNA, 21 nt, Human
ccucugagacugcuggcugag

SEQ ID NO: 1328746 - RNA, 18 nt, Human
cgucuauguuccucugag

SEQ ID NO: 1328747 - RNA, 18 nt, Human
gaagcagagaagcagagg

SEQ ID NO: 1328748 - RNA, 18 nt, Human
gcagaguccuaagcagac

SEQ ID NO: 1328749 - RNA, 21 nt, Human
gccaggcuucuuguggaccau

SEQ ID NO: 1328750 - RNA, 18 nt, Human
gcgagccugggccucuga

SEQ ID NO: 1328751 - RNA, 21 nt, Human
uccauuccucauccaacuauu

SEQ ID NO: 1328752 - RNA, 21 nt, Human
ucuauguuccucugagacugc

SEQ ID NO: 1328753 - RNA, 23 nt, Human
ucuauguuccucugagacugcug

SEQ ID NO: 1328754 - RNA, 21 nt, Human
ucugaagcagagaagcagagg

SEQ ID NO: 1328755 - RNA, 21 nt, Human
ucugcugggagccuuccaaca

SEQ ID NO: 1328756 - RNA, 24 nt, Human
ucugugcggacagccgaugcuggg

SEQ ID NO: 1328757 - RNA, 20 nt, Human
ugagaagccaucaggugggu

SEQ ID NO: 1328758 - RNA, 18 nt, Human
ugagacugcuggcugaga

SEQ ID NO: 1328759 - RNA, 19 nt, Human
ugaggacagcugcagcaga

SEQ ID NO: 1328760 - RNA, 19 nt, Human
ugccaggcuucuuguggac

SEQ ID NO: 1328761 - RNA, 20 nt, Human
ugcccuguggguagugggau

SEQ ID NO: 1328762 - RNA, 25 nt, Human
uggcugagaagccaucagguggguu

SEQ ID NO: 1328763 - RNA, 27 nt, Human
uggcugagaagccaucagguggguucc

SEQ ID NO: 1328764 - RNA, 23 nt, Human
ugggagaggucagagaacuggcg

SEQ ID NO: 1328765 - RNA, 21 nt, Human
uucagcccagcccacagcccu

SEQ ID NO: 1328766 - RNA, 19 nt, Human
uuccauuccucauccaacu

SEQ ID NO: 1328767 - RNA, 18 nt, Human
uucuuguggaccaugcag

SEQ ID NO: 1328768 - RNA, 22 nt, Human
aaaguuuuggggcaccagcuau

SEQ ID NO: 1328769 - RNA, 24 nt, Human
aagcagccccuugagagcaagagc

SEQ ID NO: 1328770 - RNA, 24 nt, Human
aagccaaguggaugguggcccggc

SEQ ID NO: 1328771 - RNA, 24 nt, Human
acagagccaggcccagaaagaagc

SEQ ID NO: 1328772 - RNA, 23 nt, Human
acccagguggccaccaggagaau

SEQ ID NO: 1328773 - RNA, 19 nt, Human
acccugcagggcccagccc

SEQ ID NO: 1328774 - RNA, 23 nt, Human
acucuggguccuguccaccuggu

SEQ ID NO: 1328775 - RNA, 21 nt, Human
agcaguagcacacaagccaca

SEQ ID NO: 1328776 - RNA, 23 nt, Human
agcauccgccuccuacaggcagc

SEQ ID NO: 1328777 - RNA, 20 nt, Human
aggcaacuuugucucaucuu

SEQ ID NO: 1328778 - RNA, 19 nt, Human
aggccucugccccacucag

SEQ ID NO: 1328779 - RNA, 21 nt, Human
aggggaugaagcuaagguggu

SEQ ID NO: 1328780 - RNA, 23 nt, Human
agggggaaaagaaaagguagucg

SEQ ID NO: 1328781 - RNA, 18 nt, Human
agguggccagggagggag

SEQ ID NO: 1328782 - RNA, 27 nt, Human
aggugguagcuggucuuggcccgccug

SEQ ID NO: 1328783 - RNA, 21 nt, Human
auccucgccugccuucugcca

SEQ ID NO: 1328784 - RNA, 21 nt, Human
caaaugcagacaugcacauac

SEQ ID NO: 1328785 - RNA, 19 nt, Human
caacacaucugucacuugc

SEQ ID NO: 1328786 - RNA, 21 nt, Human
caagagcagaggccaggccag

SEQ ID NO: 1328787 - RNA, 22 nt, Human
cacggcccagcagaggcauccc

SEQ ID NO: 1328788 - RNA, 31 nt, Human
cagagccaggcccagaaagaagcauccgccu

SEQ ID NO: 1328789 - RNA, 22 nt, Human
cagcaccaucccuggugcacgg

SEQ ID NO: 1328790 - RNA, 24 nt, Human
cagcagcuuggaugaagcagugcu

SEQ ID NO: 1328791 - RNA, 23 nt, Human
cagcaguagcacacaagccacag

SEQ ID NO: 1328792 - RNA, 19 nt, Human
cagccagcaguagcacaca

SEQ ID NO: 1328793 - RNA, 22 nt, Human
cagccccuugagagcaagagca

SEQ ID NO: 1328794 - RNA, 23 nt, Human
caggcagccacagcugaccccug

SEQ ID NO: 1328795 - RNA, 22 nt, Human
cagggacacacauucucuuccu

SEQ ID NO: 1328796 - RNA, 19 nt, Human
caucuuguucacugugaac

SEQ ID NO: 1328797 - RNA, 22 nt, Human
ccagcagucacucuccaucucu

SEQ ID NO: 1328798 - RNA, 21 nt, Human
ccagcaucagcuagggugcag

SEQ ID NO: 1328799 - RNA, 19 nt, Human
cccagaaagaagcauccgc

SEQ ID NO: 1328800 - RNA, 21 nt, Human
cccagagguucugacuggggc

SEQ ID NO: 1328801 - RNA, 21 nt, Human
ccccuugagagcaagagcaga

SEQ ID NO: 1328802 - RNA, 21 nt, Human
ccucgccugccuucugccagc

SEQ ID NO: 1328803 - RNA, 23 nt, Human
ccucgccugccuucugccagcag

SEQ ID NO: 1328804 - RNA, 19 nt, Human
ccuuacccuugggaaaaaa

SEQ ID NO: 1328805 - RNA, 20 nt, Human
cgccuccuacaggcagccac

SEQ ID NO: 1328806 - RNA, 23 nt, Human
cgugcagggcccacaugaugucc

SEQ ID NO: 1328807 - RNA, 21 nt, Human
cuaccacgccgcuuacuccuc

SEQ ID NO: 1328808 - RNA, 21 nt, Human
cucaucuuggcuggccagcag

SEQ ID NO: 1328809 - RNA, 22 nt, Human
cucuccaucucugcuggcuggg

SEQ ID NO: 1328810 - RNA, 23 nt, Human
cucucggugaagauuuguuucac

SEQ ID NO: 1328811 - RNA, 26 nt, Human
cucuucauuguuguuucccucuucca

SEQ ID NO: 1328812 - RNA, 18 nt, Human
cugagaucccagagguuc

SEQ ID NO: 1328813 - RNA, 22 nt, Human
cuggugcacggcccagcagagg

SEQ ID NO: 1328814 - RNA, 26 nt, Human
cuucaaaggacgccguucaccucucc

SEQ ID NO: 1328815 - RNA, 27 nt, Human
cuucauuguuguuucccucuuccauuu

SEQ ID NO: 1328816 - RNA, 21 nt, Human
cuugacccugcagggcccagc

SEQ ID NO: 1328817 - RNA, 22 nt, Human
cuuugaagucggccaugaggag

SEQ ID NO: 1328818 - RNA, 19 nt, Human
gaaagaagcauccgccucc

SEQ ID NO: 1328819 - RNA, 19 nt, Human
gaccaggcucacaaggcuc

SEQ ID NO: 1328820 - RNA, 21 nt, Human
gacucuggguccuguccaccu

SEQ ID NO: 1328821 - RNA, 19 nt, Human
gagccaggcccagaaagaa

SEQ ID NO: 1328822 - RNA, 27 nt, Human
gaggggaggaagaauucuagaggacag

SEQ ID NO: 1328823 - RNA, 19 nt, Human
gcagugaaaguuguucaag

SEQ ID NO: 1328824 - RNA, 18 nt, Human
gcauggaggccacagcag

SEQ ID NO: 1328825 - RNA, 25 nt, Human
gccccuugagagcaagagcagaggc

SEQ ID NO: 1328826 - RNA, 23 nt, Human
ggagggaggugaaaguuuugggg

SEQ ID NO: 1328827 - RNA, 20 nt, Human
ggccaggccagcuucacuga

SEQ ID NO: 1328828 - RNA, 23 nt, Human
ggcccagaaagaagcauccgccu

SEQ ID NO: 1328829 - RNA, 21 nt, Human
gggacacacauucucuuccuc

SEQ ID NO: 1328830 - RNA, 19 nt, Human
ggugugggggaggggagga

SEQ ID NO: 1328831 - RNA, 18 nt, Human
gucccuguggccuucuag

SEQ ID NO: 1328832 - RNA, 18 nt, Human
guggaugguggcccggcc

SEQ ID NO: 1328833 - RNA, 23 nt, Human
uaacccgggacugguuggugcaa

SEQ ID NO: 1328834 - RNA, 24 nt, Human
uaauaauacuguuaaaaacaacac

SEQ ID NO: 1328835 - RNA, 22 nt, Human
uacccuugggaaaaaaguucug

SEQ ID NO: 1328836 - RNA, 18 nt, Human
uaggggagcuaaggggug

SEQ ID NO: 1328837 - RNA, 18 nt, Human
uaucuaaacauggugacc

SEQ ID NO: 1328838 - RNA, 24 nt, Human
ucacugagaucccagagguucuga

SEQ ID NO: 1328839 - RNA, 21 nt, Human
ucagcaccaucccuggugcac

SEQ ID NO: 1328840 - RNA, 19 nt, Human
uccccgauggcagugaaag

SEQ ID NO: 1328841 - RNA, 25 nt, Human
uccguggcagccgcugcauuccuuc

SEQ ID NO: 1328842 - RNA, 22 nt, Human
uccuacaggcagccacagcugc

SEQ ID NO: 1328843 - RNA, 19 nt, Human
uccucgccugccuucugcc

SEQ ID NO: 1328844 - RNA, 20 nt, Human
uccuugaaggcaggccucug

SEQ ID NO: 1328845 - RNA, 18 nt, Human
ucgucuuuccucccaaag

SEQ ID NO: 1328846 - RNA, 23 nt, Human
ucucucuuuggauaaucuggguu

SEQ ID NO: 1328847 - RNA, 21 nt, Human
ucugccagcagucacucucca

SEQ ID NO: 1328848 - RNA, 20 nt, Human
ucugucuucucucuuuggau

SEQ ID NO: 1328849 - RNA, 30 nt, Human
ugaaaagcagccccuugagagcaagagcag

SEQ ID NO: 1328850 - RNA, 18 nt, Human
ugaaggcaggccucugcc

SEQ ID NO: 1328851 - RNA, 20 nt, Human
ugaggaaaguagacucuggg

SEQ ID NO: 1328852 - RNA, 21 nt, Human
ugagugcauggaggccacagc

SEQ ID NO: 1328853 - RNA, 18 nt, Human
ugcagacaugcacauacg

SEQ ID NO: 1328854 - RNA, 21 nt, Human
ugccccacucagcaccauccc

SEQ ID NO: 1328855 - RNA, 19 nt, Human
ugcuggucaagaggaguca

SEQ ID NO: 1328856 - RNA, 20 nt, Human
uggaauccugcugggcagcc

SEQ ID NO: 1328857 - RNA, 18 nt, Human
uggcugggucugauccug

SEQ ID NO: 1328858 - RNA, 25 nt, Human
ugggcaucccugacuuccggcauuu

SEQ ID NO: 1328859 - RNA, 18 nt, Human
ugggcucccagcaucagc

SEQ ID NO: 1328860 - RNA, 19 nt, Human
ugguugaaaagcagccccu

SEQ ID NO: 1328861 - RNA, 19 nt, Human
uguuucacgaauugaauga

SEQ ID NO: 1328862 - RNA, 20 nt, Human
uucaaaggacgccguucacc

SEQ ID NO: 1328863 - RNA, 24 nt, Human
uugaaaagcagccccuugagagca

SEQ ID NO: 1328864 - RNA, 23 nt, Human
uuuauaaugauucugucuucucu

SEQ ID NO: 1328865 - RNA, 19 nt, Human
accgcgcucgcucagaagc

SEQ ID NO: 1328866 - RNA, 23 nt, Human
aggcacccucaggaggacggcaa

SEQ ID NO: 1328867 - RNA, 19 nt, Human
agugauucgggcuccuucc

SEQ ID NO: 1328868 - RNA, 20 nt, Human
aguguggaggccaagagcac

SEQ ID NO: 1328869 - RNA, 26 nt, Human
caaaagcaccgcgcucgcucagaagc

SEQ ID NO: 1328870 - RNA, 21 nt, Human
cacacagugcuuaagcuccag

SEQ ID NO: 1328871 - RNA, 20 nt, Human
caucagugauucgggcuccu

SEQ ID NO: 1328872 - RNA, 21 nt, Human
cccgucccgcguucccaaaag

SEQ ID NO: 1328873 - RNA, 18 nt, Human
ccgccacccagccccucg

SEQ ID NO: 1328874 - RNA, 24 nt, Human
ccgccgcgccucggcccagcuccu

SEQ ID NO: 1328875 - RNA, 18 nt, Human
ccgcgccgccgcgccucg

SEQ ID NO: 1328876 - RNA, 23 nt, Human
ccgcgccgccgcgccucggccca

SEQ ID NO: 1328877 - RNA, 20 nt, Human
ccucagaaacgcugggugga

SEQ ID NO: 1328878 - RNA, 18 nt, Human
ccugcugaaccaucucca

SEQ ID NO: 1328879 - RNA, 20 nt, Human
ccuuccaaggcuccccauga

SEQ ID NO: 1328880 - RNA, 19 nt, Human
cgggcuccuuccaaggcuc

SEQ ID NO: 1328881 - RNA, 25 nt, Human
cucgcgacccucaccuacgccuccc

SEQ ID NO: 1328882 - RNA, 18 nt, Human
cucggcccagcuccuggc

SEQ ID NO: 1328883 - RNA, 22 nt, Human
cugcugaaccaucuccaugcac

SEQ ID NO: 1328884 - RNA, 19 nt, Human
gaaagauuggccaucuucc

SEQ ID NO: 1328885 - RNA, 20 nt, Human
gaccuggacuugccccugca

SEQ ID NO: 1328886 - RNA, 19 nt, Human
gcccgggucaccgggaacc

SEQ ID NO: 1328887 - RNA, 22 nt, Human
gcccgucccgcguucccaaaag

SEQ ID NO: 1328888 - RNA, 24 nt, Human
ggaaccuucgccugggucuaaaca

SEQ ID NO: 1328889 - RNA, 19 nt, Human
gucccgcguucccaaaagc

SEQ ID NO: 1328890 - RNA, 20 nt, Human
uccaaggcuccccaugacug

SEQ ID NO: 1328891 - RNA, 26 nt, Human
ucccgcguucccaaaagcaccgcgcu

SEQ ID NO: 1328892 - RNA, 23 nt, Human
ucgcccgucccgcguucccaaaa

SEQ ID NO: 1328893 - RNA, 21 nt, Human
ucucaaccgccacccagcccc

SEQ ID NO: 1328894 - RNA, 22 nt, Human
ugaauucuuagcaguacgauuc

SEQ ID NO: 1328895 - RNA, 29 nt, Human
ugucucaaccgccacccagccccucgcug

SEQ ID NO: 1328896 - RNA, 19 nt, Human
uguggaggccaagagcaca

SEQ ID NO: 1328897 - RNA, 23 nt, Human
uucagauugccucagaaacgcug

SEQ ID NO: 1328898 - RNA, 21 nt, Human
acgcaggcuuccccgcccccu

SEQ ID NO: 1328899 - RNA, 25 nt, Human
aggagcugcgcagucgcaccgagcc

SEQ ID NO: 1328900 - RNA, 22 nt, Human
caccgagcccggaacggacccu

SEQ ID NO: 1328901 - RNA, 22 nt, Human
cacgcaggcuuccccgcccccu

SEQ ID NO: 1328902 - RNA, 21 nt, Human
cagaaccggguccagagccgg

SEQ ID NO: 1328903 - RNA, 24 nt, Human
cagaaccggguccagagccgggga

SEQ ID NO: 1328904 - RNA, 23 nt, Human
cagagccggggagggggcgggcu

SEQ ID NO: 1328905 - RNA, 18 nt, Human
ccaccgaggaagcgccga

SEQ ID NO: 1328906 - RNA, 24 nt, Human
cccgcccccugcggggaggagacc

SEQ ID NO: 1328907 - RNA, 18 nt, Human
ccgagcugcgcacacgca

SEQ ID NO: 1328908 - RNA, 22 nt, Human
gaaccggguccagagccgggga

SEQ ID NO: 1328909 - RNA, 21 nt, Human
gaagucuccccgaacuuaccu

SEQ ID NO: 1328910 - RNA, 18 nt, Human
gagaagacaggagacugc

SEQ ID NO: 1328911 - RNA, 19 nt, Human
gcaggcuuccccgcccccu

SEQ ID NO: 1328912 - RNA, 22 nt, Human
gcagucgcaccgagcccggaac

SEQ ID NO: 1328913 - RNA, 20 nt, Human
ggaacggacccucccacaga

SEQ ID NO: 1328914 - RNA, 24 nt, Human
gggaagccaccgaggaagcgccga

SEQ ID NO: 1328915 - RNA, 19 nt, Human
gugcaugggcugcuguggu

SEQ ID NO: 1328916 - RNA, 25 nt, Human
uauauaucuuucauuaugccaucuu

SEQ ID NO: 1328917 - RNA, 24 nt, Human
uccaagagaagacaggagacugcc

SEQ ID NO: 1328918 - RNA, 21 nt, Human
ucugugugcaugggcugcugu

SEQ ID NO: 1328919 - RNA, 19 nt, Human
uugcuaaacugucuucugc

SEQ ID NO: 1328920 - RNA, 23 nt, Human
aaaaaauaacauucaaacacuga

SEQ ID NO: 1328921 - RNA, 25 nt, Human
aaaaaauaacauucaaacacugaga

SEQ ID NO: 1328922 - RNA, 26 nt, Human
aaaaacaaaguuaaauaaccugaaua

SEQ ID NO: 1328923 - RNA, 23 nt, Human
aaaaaguaucugacaauuaugaa

SEQ ID NO: 1328924 - RNA, 22 nt, Human
aaaggaccaugcuuaacgucaa

SEQ ID NO: 1328925 - RNA, 21 nt, Human
aaaggccaucuuuccugagcc

SEQ ID NO: 1328926 - RNA, 22 nt, Human
aacaagugaugaaauauuuuaa

SEQ ID NO: 1328927 - RNA, 19 nt, Human
aaguuaaaaucauaggcac

SEQ ID NO: 1328928 - RNA, 23 nt, Human
aaucucuagcccagguuucuuuc

SEQ ID NO: 1328929 - RNA, 25 nt, Human
acaaaauaaucaacauucauaaaac

SEQ ID NO: 1328930 - RNA, 19 nt, Human
acaggaaaugaacuuaugu

SEQ ID NO: 1328931 - RNA, 21 nt, Human
accaaacacaucugauguuaa

SEQ ID NO: 1328932 - RNA, 24 nt, Human
accacauauacaaguucggcuaua

SEQ ID NO: 1328933 - RNA, 21 nt, Human
acccaccccaucacccucaaa

SEQ ID NO: 1328934 - RNA, 27 nt, Human
acccuuacuacuauauaucaaacauaa

SEQ ID NO: 1328935 - RNA, 22 nt, Human
acugagaggaaaaaaggaaucu

SEQ ID NO: 1328936 - RNA, 22 nt, Human
agaguuauacaaacaucugggg

SEQ ID NO: 1328937 - RNA, 20 nt, Human
aggaccaugcuuaacgucaa

SEQ ID NO: 1328938 - RNA, 24 nt, Human
aggcaauuuuucucuuuaagaaaa

SEQ ID NO: 1328939 - RNA, 24 nt, Human
auccaaccccaugaagacuaaauc

SEQ ID NO: 1328940 - RNA, 20 nt, Human
caccaaauacauaguacugg

SEQ ID NO: 1328941 - RNA, 22 nt, Human
caccccaucacccucaaauuca

SEQ ID NO: 1328942 - RNA, 22 nt, Human
cagcagaguuucuauuacuuuc

SEQ ID NO: 1328943 - RNA, 24 nt, Human
cauacaagaaaagaugcacgugau

SEQ ID NO: 1328944 - RNA, 20 nt, Human
cauagucuagaucauucuag

SEQ ID NO: 1328945 - RNA, 20 nt, Human
caucaaccuaucaaccuuaa

SEQ ID NO: 1328946 - RNA, 18 nt, Human
cauucaaaauacaucagu

SEQ ID NO: 1328947 - RNA, 18 nt, Human
cccacccccuaaucucaa

SEQ ID NO: 1328948 - RNA, 24 nt, Human
ccuaccacauaauagaccguuaug

SEQ ID NO: 1328949 - RNA, 22 nt, Human
ccuugcauuauacaccaaauac

SEQ ID NO: 1328950 - RNA, 19 nt, Human
cuagcauucaguuaacaua

SEQ ID NO: 1328951 - RNA, 23 nt, Human
cugaaaacugagacuuguucugu

SEQ ID NO: 1328952 - RNA, 25 nt, Human
cugaaaacugagacuuguucuguuu

SEQ ID NO: 1328953 - RNA, 19 nt, Human
cugugguaguacaacagca

SEQ ID NO: 1328954 - RNA, 18 nt, Human
cuuaacgucaaaaaugga

SEQ ID NO: 1328955 - RNA, 20 nt, Human
cuuggaaacucauaauagcu

SEQ ID NO: 1328956 - RNA, 20 nt, Human
gaaacugauuaucuaacuua

SEQ ID NO: 1328957 - RNA, 24 nt, Human
gauagccugaauucaccauuuucu

SEQ ID NO: 1328958 - RNA, 19 nt, Human
gcaaucaaaacaaacacac

SEQ ID NO: 1328959 - RNA, 21 nt, Human
gcccagguuucuuuccuccca

SEQ ID NO: 1328960 - RNA, 27 nt, Human
gccucugucaaauauuuuuuaaaaauc

SEQ ID NO: 1328961 - RNA, 25 nt, Human
gcuugugcuaaaugaaugacucucc

SEQ ID NO: 1328962 - RNA, 23 nt, Human
gcuuucuaguaaaaaggcaauuu

SEQ ID NO: 1328963 - RNA, 19 nt, Human
ggguuucugugguuaaaga

SEQ ID NO: 1328964 - RNA, 20 nt, Human
ggugguggugacaugugagc

SEQ ID NO: 1328965 - RNA, 28 nt, Human
guaaauccuuagauuuucccaaacagaa

SEQ ID NO: 1328966 - RNA, 18 nt, Human
gugagcuacauccaaaac

SEQ ID NO: 1328967 - RNA, 19 nt, Human
gugguguuguaucaagaau

SEQ ID NO: 1328968 - RNA, 21 nt, Human
uaaaguggaucaacuuaagua

SEQ ID NO: 1328969 - RNA, 23 nt, Human
uaaauaaccugaauacuccuuuu

SEQ ID NO: 1328970 - RNA, 24 nt, Human
uaaauggcucuucaaguuuuuaga

SEQ ID NO: 1328971 - RNA, 23 nt, Human
uaacaagugaugaaauauuuuaa

SEQ ID NO: 1328972 - RNA, 24 nt, Human
uaagacauaauccaaccccaugaa

SEQ ID NO: 1328973 - RNA, 20 nt, Human
uaagugacaauaucuuagag

SEQ ID NO: 1328974 - RNA, 24 nt, Human
uaauccaaccccaugaagacuaaa

SEQ ID NO: 1328975 - RNA, 24 nt, Human
uacaaacaaguuuuguagaaaaau

SEQ ID NO: 1328976 - RNA, 19 nt, Human
uacauagucuagaucauuc

SEQ ID NO: 1328977 - RNA, 26 nt, Human
uaccaaaaaugcaaaaauugauguaa

SEQ ID NO: 1328978 - RNA, 21 nt, Human
uaccaaacacaucugauguua

SEQ ID NO: 1328979 - RNA, 24 nt, Human
uaugaaauaacucugacagagaaa

SEQ ID NO: 1328980 - RNA, 21 nt, Human
ucaaaacaaacacacacaagu

SEQ ID NO: 1328981 - RNA, 21 nt, Human
uccaaccccaugaagacuaaa

SEQ ID NO: 1328982 - RNA, 25 nt, Human
uccagaauaucaagccuucuauuuc

SEQ ID NO: 1328983 - RNA, 23 nt, Human
ucccaauuucuuuugccaacuua

SEQ ID NO: 1328984 - RNA, 24 nt, Human
uccuaucaugaaaaccugcuaaua

SEQ ID NO: 1328985 - RNA, 22 nt, Human
ucugcauucuugucuuugcugg

SEQ ID NO: 1328986 - RNA, 22 nt, Human
ugaaauaacucugacagagaaa

SEQ ID NO: 1328987 - RNA, 25 nt, Human
ugagaaaauuaaauaacuuuggaag

SEQ ID NO: 1328988 - RNA, 19 nt, Human
ugagagaaaaaaacagaag

SEQ ID NO: 1328989 - RNA, 23 nt, Human
ugcaaaaaucauuucugaaauuc

SEQ ID NO: 1328990 - RNA, 22 nt, Human
ugcacugaaaacugagacuugu

SEQ ID NO: 1328991 - RNA, 22 nt, Human
ugcagccauuuaaaaacaaagu

SEQ ID NO: 1328992 - RNA, 24 nt, Human
ugcauuauacaccaaauacauagu

SEQ ID NO: 1328993 - RNA, 22 nt, Human
ugcccagauauuggccucuguc

SEQ ID NO: 1328994 - RNA, 19 nt, Human
uggcaaucaaaacaaacac

SEQ ID NO: 1328995 - RNA, 18 nt, Human
uggcaguuuaaaucucca

SEQ ID NO: 1328996 - RNA, 21 nt, Human
uguacaaacaaguuuuguaga

SEQ ID NO: 1328997 - RNA, 22 nt, Human
uguagaaaaaugauccagcaaa

SEQ ID NO: 1328998 - RNA, 19 nt, Human
uguaugauuaccaaacaca

SEQ ID NO: 1328999 - RNA, 22 nt, Human
uguaugauuaccaaacacaucu

SEQ ID NO: 1329000 - RNA, 20 nt, Human
ugucaaugcaacaugaugga

SEQ ID NO: 1329001 - RNA, 31 nt, Human; identical to SEQ ID NO: 791533

SEQ ID NO: 1329002 - RNA, 24 nt, Human
uuagauuuucccaaacagaaaaau

SEQ ID NO: 1329003 - RNA, 22 nt, Human
uucccaaacagaaaaauugcaa

SEQ ID NO: 1329004 - RNA, 19 nt, Human
uuuaaaguggaucaacuua

SEQ ID NO: 1329005 - RNA, 21 nt, Human
uuuaacaagugaugaaauauu

SEQ ID NO: 1329006 - RNA, 22 nt, Human
uuuaggaucauucaaaauacau

SEQ ID NO: 1329007 - RNA, 21 nt, Human
uuuccucccacccccuaaucu

SEQ ID NO: 1329008 - RNA, 21 nt, Human
uuugaugaucucugucgguuu

SEQ ID NO: 1329009 - RNA, 21 nt, Human
aaagguguacaucaaauucua

SEQ ID NO: 1329010 - RNA, 22 nt, Human
accacagauucuuuccaauccu

SEQ ID NO: 1329011 - RNA, 21 nt, Human
accacuguggauuccaaauug

SEQ ID NO: 1329012 - RNA, 24 nt, Human
agaaaacacuauucucucuuccca

SEQ ID NO: 1329013 - RNA, 21 nt, Human
aggcugcaccgugacuagcag

SEQ ID NO: 1329014 - RNA, 22 nt, Human
auccagaguuucaacaccacug

SEQ ID NO: 1329015 - RNA, 26 nt, Human
aucuuccuccaggcccucuaguguca

SEQ ID NO: 1329016 - RNA, 19 nt, Human
caacuggaucagcaucaaa

SEQ ID NO: 1329017 - RNA, 27 nt, Human
cauuccaucccuuugcuggcagaucca

SEQ ID NO: 1329018 - RNA, 18 nt, Human
ccacuguggauuccaaau

SEQ ID NO: 1329019 - RNA, 21 nt, Human
cccuaucauccucaucuuccu

SEQ ID NO: 1329020 - RNA, 22 nt, Human
ccuacaucuucuggcaaacacu

SEQ ID NO: 1329021 - RNA, 25 nt, Human
cuaguagauuuucaaacugugcaaa

SEQ ID NO: 1329022 - RNA, 21 nt, Human
cuaucauccucaucuuccucc

SEQ ID NO: 1329023 - RNA, 24 nt, Human
cuccucuacugaguacaaugguug

SEQ ID NO: 1329024 - RNA, 24 nt, Human
cucucuucccagaauuuucuaaaa

SEQ ID NO: 1329025 - RNA, 19 nt, Human
gagugagcuuuaacaacug

SEQ ID NO: 1329026 - RNA, 24 nt, Human
gcacaaaguccuuugaaaggugua

SEQ ID NO: 1329027 - RNA, 23 nt, Human
guagauuuucaaacugugcaaag

SEQ ID NO: 1329028 - RNA, 21 nt, Human
guccauggucaauaacaauuu

SEQ ID NO: 1329029 - RNA, 23 nt, Human
uacaaaggcugcaccgugacuag

SEQ ID NO: 1329030 - RNA, 22 nt, Human
uacuggaauuucaaauaauuca

SEQ ID NO: 1329031 - RNA, 21 nt, Human
uaucauccucaucuuccucca

SEQ ID NO: 1329032 - RNA, 22 nt, Human
uauccaaaaacagauucaugcc

SEQ ID NO: 1329033 - RNA, 20 nt, Human
uccuccaggcccucuagugu

SEQ ID NO: 1329034 - RNA, 20 nt, Human
ucuucuggcaaacacucuaa

SEQ ID NO: 1329035 - RNA, 18 nt, Human
ugacacaggagguuuuuc

SEQ ID NO: 1329036 - RNA, 20 nt, Human
ugcaauggggguugucggag

SEQ ID NO: 1329037 - RNA, 22 nt, Human
ugcagaauccagaguuucaaca

SEQ ID NO: 1329038 - RNA, 24 nt, Human
uggucaauaacaauuucacuuucu

SEQ ID NO: 1329039 - RNA, 21 nt, Human
ugugcaaauaucugcaucaaa

SEQ ID NO: 1329040 - RNA, 18 nt, Human
uucaacaccacuguggau

SEQ ID NO: 1329041 - RNA, 21 nt, Human
uucaacaccacuguggauucc

SEQ ID NO: 1329042 - RNA, 24 nt, Human
uucaggauaaaucucagauuuucc

SEQ ID NO: 1329043 - RNA, 23 nt, Human
uucugccuuugccaaaccauugu

SEQ ID NO: 1329044 - RNA, 25 nt, Human
uucuugguuauugacacaggagguu

SEQ ID NO: 1329045 - RNA, 21 nt, Human
uuuacuggaauuucaaauaau

SEQ ID NO: 1329046 - RNA, 22 nt, Human
aagccacuuccagggcagcuag

SEQ ID NO: 1329047 - RNA, 18 nt, Human
aaggaacccuccugagug

SEQ ID NO: 1329048 - RNA, 22 nt, Human
acagcucuugcccaaggaagca

SEQ ID NO: 1329049 - RNA, 23 nt, Human
agagaaaauaauuuaauagagaa

SEQ ID NO: 1329050 - RNA, 19 nt, Human
agagaugaggaccaaggaa

SEQ ID NO: 1329051 - RNA, 19 nt, Human
agcucccgccuccggcccg

SEQ ID NO: 1329052 - RNA, 23 nt, Human
aggaagcauuuaagggcagaagg

SEQ ID NO: 1329053 - RNA, 25 nt, Human
agguccccugccucagcagggccug

SEQ ID NO: 1329054 - RNA, 23 nt, Human
agugccccucugcuccagauggc

SEQ ID NO: 1329055 - RNA, 18 nt, Human
aucuugaccugcuccuuc

SEQ ID NO: 1329056 - RNA, 22 nt, Human
caaggaacccuccugagugcuc

SEQ ID NO: 1329057 - RNA, 20 nt, Human
caaguauucagcucgggcca

SEQ ID NO: 1329058 - RNA, 23 nt, Human
cacuuuguccucauaauguccca

SEQ ID NO: 1329059 - RNA, 26 nt, Human
cagccccauugaagagauggggagac

SEQ ID NO: 1329060 - RNA, 19 nt, Human
cagccuggguuagugcccc

SEQ ID NO: 1329061 - RNA, 23 nt, Human
cagccuggguuagugccccucug

SEQ ID NO: 1329062 - RNA, 25 nt, Human
cagcgagauucccucaucuugaccu

SEQ ID NO: 1329063 - RNA, 22 nt, Human
ccaaggaagcauuuaagggcag

SEQ ID NO: 1329064 - RNA, 23 nt, Human
cccaaaagauccagcuuucaugc

SEQ ID NO: 1329065 - RNA, 18 nt, Human
ccccugccucagcagggc

SEQ ID NO: 1329066 - RNA, 24 nt, Human
ccuaggccagggcaggaacaaggc

SEQ ID NO: 1329067 - RNA, 22 nt, Human
ccucccucucccugucccaggc

SEQ ID NO: 1329068 - RNA, 22 nt, Human
ccugcagggaggacagacagcu

SEQ ID NO: 1329069 - RNA, 21 nt, Human
ccuucaaguauucagcucggg

SEQ ID NO: 1329070 - RNA, 26 nt, Human
cucauaaugucccaugcugugggcuu

SEQ ID NO: 1329071 - RNA, 22 nt, Human
cugcuccagauggcucacaucu

SEQ ID NO: 1329072 - RNA, 24 nt, Human
cuucuagggucacugaagggugca

SEQ ID NO: 1329073 - RNA, 20 nt, Human
cuugucccgggccaucucuc

SEQ ID NO: 1329074 - RNA, 22 nt, Human
gaaccucagugugaagcagcuc

SEQ ID NO: 1329075 - RNA, 20 nt, Human
gaccaaggaacccuccugag

SEQ ID NO: 1329076 - RNA, 25 nt, Human
gagauucccucaucuugaccugcuc

SEQ ID NO: 1329077 - RNA, 21 nt, Human
gcagggaggacagacagcucu

SEQ ID NO: 1329078 - RNA, 20 nt, Human
gcccgggacacguacugccc

SEQ ID NO: 1329079 - RNA, 19 nt, Human
gcuugcccagggcuccacg

SEQ ID NO: 1329080 - RNA, 22 nt, Human
ggaacaaggcuugggcuucuua

SEQ ID NO: 1329081 - RNA, 18 nt, Human
ggaacggaggugggagag

SEQ ID NO: 1329082 - RNA, 23 nt, Human
ggcagaagggcuacaaaucacca

SEQ ID NO: 1329083 - RNA, 25 nt, Human
ggccauggcagcugaagccacuucc

SEQ ID NO: 1329084 - RNA, 23 nt, Human
ggcccagaaaggggaaagagcuu

SEQ ID NO: 1329085 - RNA, 19 nt, Human
ggcccggggcuccgcuugg

SEQ ID NO: 1329086 - RNA, 21 nt, Human
ggcggcagggcaggccuagaa

SEQ ID NO: 1329087 - RNA, 18 nt, Human
gggaaagagcuugcccag

SEQ ID NO: 1329088 - RNA, 24 nt, Human
gggcaggaacaaggcuugggcuuc

SEQ ID NO: 1329089 - RNA, 19 nt, Human
uaaaccccaaaagauccag

SEQ ID NO: 1329090 - RNA, 19 nt, Human
uaggccagggcaggaacaa

SEQ ID NO: 1329091 - RNA, 25 nt, Human
ucaaauacauucuuuuccagguucc

SEQ ID NO: 1329092 - RNA, 20 nt, Human
ucacaucuguccaaucauuc

SEQ ID NO: 1329093 - RNA, 20 nt, Human
ucagccccauugaagagauu

SEQ ID NO: 1329094 - RNA, 22 nt, Human
ucagcccgggacacguacugcc

SEQ ID NO: 1329095 - RNA, 19 nt, Human
uccaagccucccucucccu

SEQ ID NO: 1329096 - RNA, 22 nt, Human
uccaagccucccucucccuguc

SEQ ID NO: 1329097 - RNA, 20 nt, Human
uccagcacaaggcccgcgcu

SEQ ID NO: 1329098 - RNA, 21 nt, Human
ucccagcgagauucccucauc

SEQ ID NO: 1329099 - RNA, 21 nt, Human
ucccuaggccagggcaggaac

SEQ ID NO: 1329100 - RNA, 28 nt, Human
ucucucugagcaggucucgggcagaggu

SEQ ID NO: 1329101 - RNA, 25 nt, Human
ucuucuagggucacugaagggugca

SEQ ID NO: 1329102 - RNA, 23 nt, Human
ugaccugcuccuucaaguauuca

SEQ ID NO: 1329103 - RNA, 18 nt, Human
ugagguucugaaccucag

SEQ ID NO: 1329104 - RNA, 21 nt, Human
uggccuugagcuccucagccc

SEQ ID NO: 1329105 - RNA, 18 nt, Human
ugggcugugaagguauca

SEQ ID NO: 1329106 - RNA, 21 nt, Human
ugggucagacugucuccaagc

SEQ ID NO: 1329107 - RNA, 22 nt, Human
ugucccaggcucaaacuccagc

SEQ ID NO: 1329108 - RNA, 19 nt, Human
ugugaagguaucagcccca

SEQ ID NO: 1329109 - RNA, 18 nt, Human
uuacacucgagcuccugc

SEQ ID NO: 1329110 - RNA, 22 nt, Human
uucuagggucacugaagggugc

SEQ ID NO: 1329111 - RNA, 21 nt, Human
uugcccagggcuccacggcgg

SEQ ID NO: 1329112 - RNA, 26 nt, Human
uuggaagaggagacgauggccuugag

SEQ ID NO: 1329113 - RNA, 23 nt, Human
acuuugcacguguucaaaaacca

SEQ ID NO: 1329114 - RNA, 21 nt, Human
uacucucagcuuuagaaaguu

SEQ ID NO: 1329115 - RNA, 20 nt, Human
ugcagagaaagaaucagaac

SEQ ID NO: 1329116 - RNA, 23 nt, Human
uguaauggagcucaguuuugagg

SEQ ID NO: 1329117 - RNA, 23 nt, Human
uguguaauggagcucaguuuuga

SEQ ID NO: 1329118 - RNA, 21 nt, Human
uucaaaaaccaaagccuuuuc

SEQ ID NO: 1329119 - RNA, 24 nt, Human
uucaaaaaccaaagccuuuucuuu

SEQ ID NO: 1329120 - RNA, 18 nt, Human
acucgcuccuucaggucc

SEQ ID NO: 1329121 - RNA, 21 nt, Human
acugcccccuggcugauguac

SEQ ID NO: 1329122 - RNA, 22 nt, Human
agggccacugcuaguucuuggu

SEQ ID NO: 1329123 - RNA, 20 nt, Human
cacacucuccagcuccuucc

SEQ ID NO: 1329124 - RNA, 21 nt, Human
cagauccuccaggguagcaga

SEQ ID NO: 1329125 - RNA, 22 nt, Human
cagaugaugcacggcccucccc

SEQ ID NO: 1329126 - RNA, 23 nt, Human
cagcagcuccuccaccuuguccu

SEQ ID NO: 1329127 - RNA, 23 nt, Human
ccagcagccucuccuguuccucc

SEQ ID NO: 1329128 - RNA, 25 nt, Human
ccccacacacagauucacccccagu

SEQ ID NO: 1329129 - RNA, 28 nt, Human
cccgaaaaccucuccuguuccagcagcu

SEQ ID NO: 1329130 - RNA, 22 nt, Human
ccuccugccaccccuccuguuc

SEQ ID NO: 1329131 - RNA, 22 nt, Human
ccucuccagcucccguagaguc

SEQ ID NO: 1329132 - RNA, 18 nt, Human
ccugacgauguccuccuc

SEQ ID NO: 1329133 - RNA, 23 nt, Human
ccugcagccucuccuccugucuc

SEQ ID NO: 1329134 - RNA, 25 nt, Human
ccugcagccucuccuccugucuccu

SEQ ID NO: 1329135 - RNA, 23 nt, Human
ccuuccauaaagucgcugcagcu

SEQ ID NO: 1329136 - RNA, 21 nt, Human
cgcugcagcuucuccauggcc

SEQ ID NO: 1329137 - RNA, 22 nt, Human
cgcugcagcuucuccauggccc

SEQ ID NO: 1329138 - RNA, 22 nt, Human
cgucucugacacugcccccugg

SEQ ID NO: 1329139 - RNA, 27 nt, Human
cuccagcuccuuccuuagggggccgcc

SEQ ID NO: 1329140 - RNA, 21 nt, Human
cuccccacacacagauucacc

SEQ ID NO: 1329141 - RNA, 21 nt, Human
cuccugucuccuguucaggag

SEQ ID NO: 1329142 - RNA, 21 nt, Human
cucuccagauccuccagggua

SEQ ID NO: 1329143 - RNA, 19 nt, Human
cugcagccucuccuccugu

SEQ ID NO: 1329144 - RNA, 23 nt, Human
cugcagccucuccuccugucucc

SEQ ID NO: 1329145 - RNA, 22 nt, Human
cugcagcuucuccauggccccc

SEQ ID NO: 1329146 - RNA, 19 nt, Human
gccacagccucucauccug

SEQ ID NO: 1329147 - RNA, 21 nt, Human
gcccccuggcugauguacuuu

SEQ ID NO: 1329148 - RNA, 22 nt, Human
gccuggagcugucuucccacac

SEQ ID NO: 1329149 - RNA, 23 nt, Human
gcugcagcuucuccauggccccc

SEQ ID NO: 1329150 - RNA, 19 nt, Human
ggcucuggggccagggguu

SEQ ID NO: 1329151 - RNA, 23 nt, Human
gggcucuggggccagggguucag

SEQ ID NO: 1329152 - RNA, 18 nt, Human
gugcugggggcucugggg

SEQ ID NO: 1329153 - RNA, 21 nt, Human
guggagcuugaauccagggcc

SEQ ID NO: 1329154 - RNA, 24 nt, Human
guggaugaauugaagcuccaguuu

SEQ ID NO: 1329155 - RNA, 25 nt, Human
uagcagaugaugcacggcccuccuc

SEQ ID NO: 1329156 - RNA, 22 nt, Human
ucagguccaccuucuccuucca

SEQ ID NO: 1329157 - RNA, 18 nt, Human
uccccacacacagauuca

SEQ ID NO: 1329158 - RNA, 22 nt, Human
ucccgaaaaccucuccuguucu

SEQ ID NO: 1329159 - RNA, 21 nt, Human
ucgcugcagcuucuccauggc

SEQ ID NO: 1329160 - RNA, 23 nt, Human
ucucccagugcugcgucucugac

SEQ ID NO: 1329161 - RNA, 24 nt, Human
ucuccugcugccacagccucucau

SEQ ID NO: 1329162 - RNA, 22 nt, Human
ucuccuguuccuccugccaccc

SEQ ID NO: 1329163 - RNA, 21 nt, Human
ugacacugcccccuggcugau

SEQ ID NO: 1329164 - RNA, 23 nt, Human
ugacacugcccccuggcugaugu

SEQ ID NO: 1329165 - RNA, 20 nt, Human
ugcgucucugacacugcccu

SEQ ID NO: 1329166 - RNA, 24 nt, Human
uggagcugucuucccacacucucc

SEQ ID NO: 1329167 - RNA, 24 nt, Human
uguucaggagacucaacaucugau

SEQ ID NO: 1329168 - RNA, 19 nt, Human
uuccaccucagccuggagc

SEQ ID NO: 1329169 - RNA, 19 nt, Human
uuccugcagccucuccucc

SEQ ID NO: 1329170 - RNA, 19 nt, Human
aagagaggacucaagcaca

SEQ ID NO: 1329171 - RNA, 19 nt, Human
aagugcugggauuauaggc

SEQ ID NO: 1329172 - RNA, 19 nt, Human
aagugcugggauuauaggc

SEQ ID NO: 1329173 - RNA, 23 nt, Human
aagugcugggauuauaggcuuga

SEQ ID NO: 1329174 - RNA, 23 nt, Human
aggcggaaggcacaaggcgugac

SEQ ID NO: 1329175 - RNA, 24 nt, Human
agugcugggauuauaggcuugagu

SEQ ID NO: 1329176 - RNA, 19 nt, Human
auaggcuugagucaccacc

SEQ ID NO: 1329177 - RNA, 18 nt, Human
augggguuucacuauguu

SEQ ID NO: 1329178 - RNA, 19 nt, Human
augggguuucacuauguug

SEQ ID NO: 1329179 - RNA, 25 nt, Human
augggguuucacuauguugccccgg

SEQ ID NO: 1329180 - RNA, 19 nt, Human
caagcgauccuccugccuc

SEQ ID NO: 1329181 - RNA, 27 nt, Human
caagcgauccuccugccuccgccuucc

SEQ ID NO: 1329182 - RNA, 18 nt, Human
ccgaagugcugggauuau

SEQ ID NO: 1329183 - RNA, 22 nt, Human
ccgaagugcugggauuauaggc

SEQ ID NO: 1329184 - RNA, 23 nt, Human
ccgaagugcugggauuauaggcu

SEQ ID NO: 1329185 - RNA, 19 nt, Human
ccgcugcccuuccuggcug

SEQ ID NO: 1329186 - RNA, 25 nt, Human
ccuccugccuccgccuuccgaagug

SEQ ID NO: 1329187 - RNA, 18 nt, Human
ccuggccucaagcgaucc

SEQ ID NO: 1329188 - RNA, 20 nt, Human
ccuggccucaagcgauccuc

SEQ ID NO: 1329189 - RNA, 23 nt, Human
ccuggccucaagcgauccuccug

SEQ ID NO: 1329190 - RNA, 20 nt, Human
ccuggugcgccccgcugccc

SEQ ID NO: 1329191 - RNA, 24 nt, Human
cucaagcgauccuccugccuccgc

SEQ ID NO: 1329192 - RNA, 21 nt, Human
cuccugccuccgccuuccgaa

SEQ ID NO: 1329193 - RNA, 20 nt, Human
cuuccuggcugugacucugg

SEQ ID NO: 1329194 - RNA, 20 nt, Human
cuuuaugcccggcagacccc

SEQ ID NO: 1329195 - RNA, 26 nt, Human
gauuauaggcuugagucaccaccgug

SEQ ID NO: 1329196 - RNA, 21 nt, Human
gccccgcugcccuuccuggcu

SEQ ID NO: 1329197 - RNA, 19 nt, Human
gccucgagguuucuagccc

SEQ ID NO: 1329198 - RNA, 23 nt, Human
gcuggucuaaaauuccuggccuc

SEQ ID NO: 1329199 - RNA, 18 nt, Human
guagagaugggguuucac

SEQ ID NO: 1329200 - RNA, 18 nt, Human
guagagaugggguuucac

SEQ ID NO: 1329201 - RNA, 22 nt, Human
guagagaugggguuucacuaug

SEQ ID NO: 1329202 - RNA, 22 nt, Human
uagagaugggguuucacuaugu

SEQ ID NO: 1329203 - RNA, 19 nt, Human
uauguugccccggcugguc

SEQ ID NO: 1329204 - RNA, 23 nt, Human
uauguugccccggcuggucuaaa

SEQ ID NO: 1329205 - RNA, 24 nt, Human
uauuuuguagagaugggguuucac

SEQ ID NO: 1329206 - RNA, 27 nt, Human
uauuuuuauuuuguagagaugggguuu

SEQ ID NO: 1329207 - RNA, 22 nt, Human
ucacuauguugccccggcuggu

SEQ ID NO: 1329208 - RNA, 24 nt, Human
ucccuguggcgugagccuucggcc

SEQ ID NO: 1329209 - RNA, 23 nt, Human
uccgaagugcugggauuauaggc

SEQ ID NO: 1329210 - RNA, 24 nt, Human
uccgaagugcugggauuauaggcu

SEQ ID NO: 1329211 - RNA, 18 nt, Human
ugagccuucggccuggug

SEQ ID NO: 1329212 - RNA, 23 nt, Human
ugagccuucggccuggugcgccc

SEQ ID NO: 1329213 - RNA, 18 nt, Human
uggccucaagcgauccuc

SEQ ID NO: 1329214 - RNA, 21 nt, Human
uggccucaagcgauccuccug

SEQ ID NO: 1329215 - RNA, 24 nt, Human
uggccucaagcgauccuccugccu

SEQ ID NO: 1329216 - RNA, 21 nt, Human
ugggauguaaagagcaagaga

SEQ ID NO: 1329217 - RNA, 18 nt, Human
ugggauuauaggcuugag

SEQ ID NO: 1329218 - RNA, 18 nt, Human
ugggauuauaggcuugag

SEQ ID NO: 1329219 - RNA, 22 nt, Human
ugggauuauaggcuugagucac

SEQ ID NO: 1329220 - RNA, 24 nt, Human
ugggauuauaggcuugagucacca

SEQ ID NO: 1329221 - RNA, 24 nt, Human
ugggauuauaggcuugagucacca

SEQ ID NO: 1329222 - RNA, 18 nt, Human
ugggguuucacuauguug

SEQ ID NO: 1329223 - RNA, 24 nt, Human
ugggguuucacuauguugccccgg

SEQ ID NO: 1329224 - RNA, 19 nt, Human
uggugggguuccgaaggcc

SEQ ID NO: 1329225 - RNA, 22 nt, Human
uguagagaugggguuucacuau

SEQ ID NO: 1329226 - RNA, 24 nt, Human
uguagagaugggguuucacuaugu

SEQ ID NO: 1329227 - RNA, 24 nt, Human
uuguagagaugggguuucacuaug

SEQ ID NO: 1329228 - RNA, 24 nt, Human
uuuguagagaugggguuucacuau

SEQ ID NO: 1329229 - RNA, 23 nt, Human
aaagaaccugaccaaugucaggc

SEQ ID NO: 1329230 - RNA, 19 nt, Human
aaagagggacugucccgua

SEQ ID NO: 1329231 - RNA, 20 nt, Human
aagaaccugaccaaugucag

SEQ ID NO: 1329232 - RNA, 23 nt, Human
aagcagguccccuccaaaacccc

SEQ ID NO: 1329233 - RNA, 26 nt, Human
acugaaguucuuguaacuugggaugg

SEQ ID NO: 1329234 - RNA, 21 nt, Human
agacccaggaggcuguggaga

SEQ ID NO: 1329235 - RNA, 27 nt, Human
agcuggagggugagaccucucccugug

SEQ ID NO: 1329236 - RNA, 19 nt, Human
aggcagguagccaaaggga

SEQ ID NO: 1329237 - RNA, 18 nt, Human
cacaggagccugcuucca

SEQ ID NO: 1329238 - RNA, 18 nt, Human
cagccuccucugauaccc

SEQ ID NO: 1329239 - RNA, 20 nt, Human
caggagccugcuuccaaaga

SEQ ID NO: 1329240 - RNA, 20 nt, Human
caggaggcuguggagauugc

SEQ ID NO: 1329241 - RNA, 23 nt, Human
cagguccccuccaaaaccccucc

SEQ ID NO: 1329242 - RNA, 20 nt, Human
ccaaggcugaccauccuccu

SEQ ID NO: 1329243 - RNA, 19 nt, Human
ccccuccaaaaccccuccu

SEQ ID NO: 1329244 - RNA, 26 nt, Human
cccguaauugagagaugcuccaaggc

SEQ ID NO: 1329245 - RNA, 24 nt, Human
cccuccaaaaccccuccugcugga

SEQ ID NO: 1329246 - RNA, 20 nt, Human
cccuccugcuggaauccucc

SEQ ID NO: 1329247 - RNA, 20 nt, Human
ccuccagaugugaggaguag

SEQ ID NO: 1329248 - RNA, 21 nt, Human
ccuccagaugugaggaguagg

SEQ ID NO: 1329249 - RNA, 24 nt, Human
ccuccagaugugaggaguaggagc

SEQ ID NO: 1329250 - RNA, 18 nt, Human
ccuccugcuggaauccuc

SEQ ID NO: 1329251 - RNA, 18 nt, Human
ccuuccccacuucuagag

SEQ ID NO: 1329252 - RNA, 21 nt, Human
cgcaagcagguccccuccaaa

SEQ ID NO: 1329253 - RNA, 24 nt, Human
cgcaagcagguccccuccaaaacc

SEQ ID NO: 1329254 - RNA, 18 nt, Human
cuccugcugcacacccag

SEQ ID NO: 1329255 - RNA, 21 nt, Human
cuccugcuggaauccuccaga

SEQ ID NO: 1329256 - RNA, 19 nt, Human
cucucccuguggaucugga

SEQ ID NO: 1329257 - RNA, 19 nt, Human
cugcugcacacccagcagc

SEQ ID NO: 1329258 - RNA, 21 nt, Human
gaagcuacacaucuggccuuc

SEQ ID NO: 1329259 - RNA, 23 nt, Human
gacaggguuccgcgcccuguccc

SEQ ID NO: 1329260 - RNA, 24 nt, Human
gagaagcucccaaaagagagggaa

SEQ ID NO: 1329261 - RNA, 23 nt, Human
gagccugcuuccaaagagggacu

SEQ ID NO: 1329262 - RNA, 21 nt, Human
gaggagggugcuagcggugaa

SEQ ID NO: 1329263 - RNA, 20 nt, Human
gcaagcagguccccuccaaa

SEQ ID NO: 1329264 - RNA, 18 nt, Human
gcagacagaucaaggcug

SEQ ID NO: 1329265 - RNA, 18 nt, Human
gcccuguccagccucccc

SEQ ID NO: 1329266 - RNA, 18 nt, Human
ggugagaccucucccugu

SEQ ID NO: 1329267 - RNA, 22 nt, Human
gguuuaacauccacagcuggag

SEQ ID NO: 1329268 - RNA, 20 nt, Human
guaggagcagacagaucaag

SEQ ID NO: 1329269 - RNA, 21 nt, Human
guggaaugaaaccgcucugcc

SEQ ID NO: 1329270 - RNA, 22 nt, Human
uaacuugggaugggggccaggu

SEQ ID NO: 1329271 - RNA, 18 nt, Human
uagccaaagggaaacugg

SEQ ID NO: 1329272 - RNA, 24 nt, Human
uagucucacugaaguucuuguaac

SEQ ID NO: 1329273 - RNA, 20 nt, Human
uagugguggaaugaaaccgc

SEQ ID NO: 1329274 - RNA, 25 nt, Human
uccaaaaccccuccugcuggaaucc

SEQ ID NO: 1329275 - RNA, 21 nt, Human
uccacagcuggagggugagac

SEQ ID NO: 1329276 - RNA, 22 nt, Human
uccacagcuggagggugagacc

SEQ ID NO: 1329277 - RNA, 24 nt, Human
uccccuccaaaaccccuccugcug

SEQ ID NO: 1329278 - RNA, 18 nt, Human
ucccuuagucucacugaa

SEQ ID NO: 1329279 - RNA, 25 nt, Human
uccucuggucaguaaggaacccuga

SEQ ID NO: 1329280 - RNA, 18 nt, Human
uccugcuggaauccucca

SEQ ID NO: 1329281 - RNA, 23 nt, Human
ucgcaagcagguccccuccaaaa

SEQ ID NO: 1329282 - RNA, 26 nt, Human
ucgcaagcagguccccuccaaaaccc

SEQ ID NO: 1329283 - RNA, 18 nt, Human
ucucccuguggaucugga

SEQ ID NO: 1329284 - RNA, 24 nt, Human
ugaaagaaggcagguagccaaagg

SEQ ID NO: 1329285 - RNA, 23 nt, Human
ugacccugaggucaguucaucuu

SEQ ID NO: 1329286 - RNA, 22 nt, Human
ugagauagauuccaaggagacu

SEQ ID NO: 1329287 - RNA, 21 nt, Human
ugcagagauggaaaggauuau

SEQ ID NO: 1329288 - RNA, 24 nt, Human
ugcagagauggaaaggauuauuac

SEQ ID NO: 1329289 - RNA, 24 nt, Human
uggaaugaaaccgcucugccauuu

SEQ ID NO: 1329290 - RNA, 22 nt, Human
ugggaugggggccaggucagcc

SEQ ID NO: 1329291 - RNA, 20 nt, Human
uggucaguaaggaacccuga

SEQ ID NO: 1329292 - RNA, 20 nt, Human
ugugcagagauggaaaggau

SEQ ID NO: 1329293 - RNA, 21 nt, Human
ugugcagagauggaaaggauu

SEQ ID NO: 1329294 - RNA, 23 nt, Human
uucugcccagagaagcucccaaa

SEQ ID NO: 1329295 - RNA, 23 nt, Human
uucuuguaacuugggaugggggc

SEQ ID NO: 1329296 - RNA, 19 nt, Human
acccugagugccuggagcc

SEQ ID NO: 1329297 - RNA, 25 nt, Human
agcugucggcccgagaggaagcuuc

SEQ ID NO: 1329298 - RNA, 23 nt, Human
auccugagugcccaugggaggca

SEQ ID NO: 1329299 - RNA, 24 nt, Human
auccuugucuuccuccagugcugg

SEQ ID NO: 1329300 - RNA, 21 nt, Human
caccucucagagucuucugag

SEQ ID NO: 1329301 - RNA, 21 nt, Human
caccugguagaggaaagaccc

SEQ ID NO: 1329302 - RNA, 22 nt, Human
cacuucuggauccugagugccc

SEQ ID NO: 1329303 - RNA, 21 nt, Human
ccagaccaccucucagagucu

SEQ ID NO: 1329304 - RNA, 18 nt, Human
ccagaccuuccugcugac

SEQ ID NO: 1329305 - RNA, 18 nt, Human
cccugaacguccagaccu

SEQ ID NO: 1329306 - RNA, 22 nt, Human
ccuccagugcuggucccggucc

SEQ ID NO: 1329307 - RNA, 18 nt, Human
ccuccucugcuugacccc

SEQ ID NO: 1329308 - RNA, 19 nt, Human
ccucugauugucccuggcc

SEQ ID NO: 1329309 - RNA, 19 nt, Human
ccugagugcccaugggagg

SEQ ID NO: 1329310 - RNA, 20 nt, Human
cgagaggaagcuucauggug

SEQ ID NO: 1329311 - RNA, 26 nt, Human
cucguggugguaccccugccuuccuc

SEQ ID NO: 1329312 - RNA, 22 nt, Human
cuugaccccggguguccaugaa

SEQ ID NO: 1329313 - RNA, 22 nt, Human
cuugucuuccuccagugcuggu

SEQ ID NO: 1329314 - RNA, 19 nt, Human
gaggaaagacccugaacgg

SEQ ID NO: 1329315 - RNA, 20 nt, Human
gcagacccagaccaccucuc

SEQ ID NO: 1329316 - RNA, 23 nt, Human
gccuggagccgucuccugauugu

SEQ ID NO: 1329317 - RNA, 25 nt, Human
gccuggagccgucuccugauuguuc

SEQ ID NO: 1329318 - RNA, 26 nt, Human
gccuggagcugucuuguggcgucgcg

SEQ ID NO: 1329319 - RNA, 20 nt, Human
gcgacccugagugccuggag

SEQ ID NO: 1329320 - RNA, 19 nt, Human
gucucgugccugcuugugg

SEQ ID NO: 1329321 - RNA, 22 nt, Human
uccaugaaugguguccugaccc

SEQ ID NO: 1329322 - RNA, 19 nt, Human
uccaugggcggacucagac

SEQ ID NO: 1329323 - RNA, 27 nt, Human
ucccugacugucacuguccuggcuaaa

SEQ ID NO: 1329324 - RNA, 18 nt, Human
ucccugggauguggugug

SEQ ID NO: 1329325 - RNA, 20 nt, Human
ucccugggaugugguguggc

SEQ ID NO: 1329326 - RNA, 25 nt, Human
ugacgcgacccugagugccuggagc

SEQ ID NO: 1329327 - RNA, 21 nt, Human
ugagugccuggagcugucuug

SEQ ID NO: 1329328 - RNA, 23 nt, Human
ugagugcucaccugguagaggaa

SEQ ID NO: 1329329 - RNA, 26 nt, Human
ugagugucccugacugucacuguccu

SEQ ID NO: 1329330 - RNA, 18 nt, Human
ugccuuccuccucugcuu

SEQ ID NO: 1329331 - RNA, 24 nt, Human
uggaagcagacccagaccaccucu

SEQ ID NO: 1329332 - RNA, 19 nt, Human
ugucacuguccuggcuaaa

SEQ ID NO: 1329333 - RNA, 20 nt, Human
uguccagaucuaucuaccaa

SEQ ID NO: 1329334 - RNA, 21 nt, Human
uguccagaucuaucuaccaau

SEQ ID NO: 1329335 - RNA, 18 nt, Human
ugugaugagacccugagu

SEQ ID NO: 1329336 - RNA, 20 nt, Human
uuccuccacugcuugacccc

SEQ ID NO: 1329337 - RNA, 20 nt, Human
uuccucuagugcugggcccc

SEQ ID NO: 1329338 - RNA, 21 nt, Human
uugagugccuggagcugucuc

SEQ ID NO: 1329339 - RNA, 22 nt, Human
uugggaugcugagugccuggag

SEQ ID NO: 1329340 - RNA, 26 nt, Human
uugguggcucugcugauggggcccag

SEQ ID NO: 1329341 - RNA, 21 nt, Human
aaaaacacucccccaggggcc

SEQ ID NO: 1329342 - RNA, 20 nt, Human
aaaaagacaaauaaagccca

SEQ ID NO: 1329343 - RNA, 22 nt, Human
aaacagaacaacaaacacaaga

SEQ ID NO: 1329344 - RNA, 23 nt, Human
aaagacccccaccaccaccgcau

SEQ ID NO: 1329345 - RNA, 19 nt, Human
aaagccaguggaaacaagg

SEQ ID NO: 1329346 - RNA, 24 nt, Human
aaagccaguggaaacaaggaccaa

SEQ ID NO: 1329347 - RNA, 21 nt, Human
aacaaacacaagaguugagca

SEQ ID NO: 1329348 - RNA, 18 nt, Human
aacacaaaaacagcaaca

SEQ ID NO: 1329349 - RNA, 19 nt, Human
aacacaaaaacagcaacag

SEQ ID NO: 1329350 - RNA, 22 nt, Human
aacaccccugcccuccggaucu

SEQ ID NO: 1329351 - RNA, 19 nt, Human
aagaaacugccauaaccag

SEQ ID NO: 1329352 - RNA, 19 nt, Human
aaggaccaagagccaaaca

SEQ ID NO: 1329353 - RNA, 20 nt, Human
aaggaccaagagccaaacau

SEQ ID NO: 1329354 - RNA, 23 nt, Human
aauccccauuuauucccuaaagc

SEQ ID NO: 1329355 - RNA, 21 nt, Human
aauuccucuggccagaaaccu

SEQ ID NO: 1329356 - RNA, 20 nt, Human
acaacacaaaaacagcaaca

SEQ ID NO: 1329357 - RNA, 21 nt, Human
acagaacaacaaacacaagag

SEQ ID NO: 1329358 - RNA, 19 nt, Human
acaguacaaaagaccccca

SEQ ID NO: 1329359 - RNA, 22 nt, Human
acaucaaaaaaaucacccugga

SEQ ID NO: 1329360 - RNA, 21 nt, Human
accaccaccgcauucugccau

SEQ ID NO: 1329361 - RNA, 18 nt, Human
accacuaggucuuugcca

SEQ ID NO: 1329362 - RNA, 21 nt, Human
acccacaggcugugacagggc
